United States Patent 12,624,385 (RIBOREGULATORS AND METHODS OF USE THEREOF) - sequence listing, part 7

SEQ ID NO: 102098 - DNA, 103 bp, Artificial Sequence
  Synthetic Polynucleotide
taatacgactcactatagggggcccccggggctcctccttcaccgccacaaacagaggagatgtggcatggaaggaggaaacctggcggcagcgcaaaagatg

SEQ ID NO: 102099 - DNA, 103 bp, Artificial Sequence
  Synthetic Polynucleotide
taatacgactcactataggggctgccctctggcccccggggctcctccttaacagaggagaaaggagatgccccgggggaacctggcggcagcgcaaaagatg

SEQ ID NO: 102100 - DNA, 103 bp, Artificial Sequence
  Synthetic Polynucleotide
taatacgactcactatagggtggcagctcggctgccctctggcccccgggaacagaggagacccgggatgcagagggcaaacctggcggcagcgcaaaagatg

SEQ ID NO: 102101 - DNA, 103 bp, Artificial Sequence
  Synthetic Polynucleotide
taatacgactcactatagggctgcctcggctggcagctcggctgccctctaacagaggagaagagggatgccgagctgcaacctggcggcagcgcaaaagatg

SEQ ID NO: 102102 - DNA, 103 bp, Artificial Sequence
  Synthetic Polynucleotide
taatacgactcactataggggaactcgagtggctgctggccaccccggggaacagaggagaccccggatgggccagcagaacctggcggcagcgcaaaagatg

SEQ ID NO: 102103 - DNA, 103 bp, Artificial Sequence
  Synthetic Polynucleotide
taatacgactcactataggggggattgtagctgcctcggctggcagctcgaacagaggagacgagctatgagccgaggcaacctggcggcagcgcaaaagatg

SEQ ID NO: 102104 - DNA, 103 bp, Artificial Sequence
  Synthetic Polynucleotide
taatacgactcactatagggggtactgcaggggattgtagctgcctcggcaacagaggagagccgagatggctacaatcaacctggcggcagcgcaaaagatg

SEQ ID NO: 102105 - DNA, 103 bp, Artificial Sequence
  Synthetic Polynucleotide
taatacgactcactatagggtgtgccacttggtactgcaggggattgtagaacagaggagactacaaatgcctgcagtaaacctggcggcagcgcaaaagatg

SEQ ID NO: 102106 - DNA, 103 bp, Artificial Sequence
  Synthetic Polynucleotide
taatacgactcactatagggctgcccacagtgtgccacttggtactgcagaacagaggagactgcagatgcaagtggcaaacctggcggcagcgcaaaagatg

SEQ ID NO: 102107 - DNA, 103 bp, Artificial Sequence
  Synthetic Polynucleotide
taatacgactcactataggggcatggctgtctgcccacagtgtgccacttaacagaggagaaagtggatgactgtgggcaacctggcggcagcgcaaaagatg

SEQ ID NO: 102108 - DNA, 103 bp, Artificial Sequence
  Synthetic Polynucleotide
taatacgactcactataggggggggcaggtgcatggctgtctgcccacagaacagaggagactgtggatggacagccataacctggcggcagcgcaaaagatg

SEQ ID NO: 102109 - DNA, 103 bp, Artificial Sequence
  Synthetic Polynucleotide
taatacgactcactatagggtgccagagttgggggcaggtgcatggctgtaacagaggagaacagccatgcacctgcccaacctggcggcagcgcaaaagatg

SEQ ID NO: 102110 - DNA, 103 bp, Artificial Sequence
  Synthetic Polynucleotide
taatacgactcactatagggggccgggtgctgccagagttgggggcaggtaacagaggagaacctgcatgcaactctggaacctggcggcagcgcaaaagatg

SEQ ID NO: 102111 - DNA, 103 bp, Artificial Sequence
  Synthetic Polynucleotide
taatacgactcactatagggcgcagaggctggccgggtgctgccagagttaacagaggagaaactctatgagcacccggaacctggcggcagcgcaaaagatg

SEQ ID NO: 102112 - DNA, 103 bp, Artificial Sequence
  Synthetic Polynucleotide
taatacgactcactatagggcttgagaacgcgcagaggctggccgggtgcaacagaggagagcacccatgcagcctctgaacctggcggcagcgcaaaagatg

SEQ ID NO: 102113 - DNA, 103 bp, Artificial Sequence
  Synthetic Polynucleotide
taatacgactcactatagggggccccctgagaactcgagtggctgctggcaacagaggagagccagcatgcactcgagtaacctggcggcagcgcaaaagatg

SEQ ID NO: 102114 - DNA, 103 bp, Artificial Sequence
  Synthetic Polynucleotide
taatacgactcactatagggccaaaggggccttgagaacgcgcagaggctaacagaggagaagcctcatggcgttctcaaacctggcggcagcgcaaaagatg

SEQ ID NO: 102115 - DNA, 103 bp, Artificial Sequence
  Synthetic Polynucleotide
taatacgactcactataggggcggcagtggccaaaggggccttgagaacgaacagaggagacgttctatgggcccctttaacctggcggcagcgcaaaagatg

SEQ ID NO: 102116 - DNA, 103 bp, Artificial Sequence
  Synthetic Polynucleotide
taatacgactcactataggggcaggggggtgcggcagtggccaaaggggcaacagaggagagcccctatggccactgccaacctggcggcagcgcaaaagatg

SEQ ID NO: 102117 - DNA, 103 bp, Artificial Sequence
  Synthetic Polynucleotide
taatacgactcactatagggggaggggactgcaggggggtgcggcagtggaacagaggagaccactgatgcacccccctaacctggcggcagcgcaaaagatg

SEQ ID NO: 102118 - DNA, 103 bp, Artificial Sequence
  Synthetic Polynucleotide
taatacgactcactatagggggcgccttcaggaggggactgcaggggggtaacagaggagaacccccatgcagtcccctaacctggcggcagcgcaaaagatg

SEQ ID NO: 102119 - DNA, 103 bp, Artificial Sequence
  Synthetic Polynucleotide
taatacgactcactatagggagccggggagggcgccttcaggaggggactaacagaggagaagtcccatgctgaaggcgaacctggcggcagcgcaaaagatg

SEQ ID NO: 102120 - DNA, 103 bp, Artificial Sequence
  Synthetic Polynucleotide
taatacgactcactataggggtaaggggccagccggggagggcgccttcaaacagaggagatgaaggatgcctccccggaacctggcggcagcgcaaaagatg

SEQ ID NO: 102121 - DNA, 103 bp, Artificial Sequence
  Synthetic Polynucleotide
taatacgactcactatagggttgcccttgtgtaaggggccagccggggagaacagaggagactccccatgtggccccttaacctggcggcagcgcaaaagatg

SEQ ID NO: 102122 - DNA, 103 bp, Artificial Sequence
  Synthetic Polynucleotide
taatacgactcactatagggcactgccttcttgcccttgtgtaaggggccaacagaggagaggccccatgcacaagggcaacctggcggcagcgcaaaagatg

SEQ ID NO: 102123 - DNA, 103 bp, Artificial Sequence
  Synthetic Polynucleotide
taatacgactcactatagggtatctttgttcactgccttcttgcccttgtaacagaggagaacaaggatgagaaggcagaacctggcggcagcgcaaaagatg

SEQ ID NO: 102124 - DNA, 103 bp, Artificial Sequence
  Synthetic Polynucleotide
taatacgactcactatagggggcccagctcggccccctgagaactcgagtaacagaggagaactcgaatgctcagggggaacctggcggcagcgcaaaagatg

SEQ ID NO: 102125 - DNA, 103 bp, Artificial Sequence
  Synthetic Polynucleotide
taatacgactcactatagggtactcaaggctatctttgttcactgccttcaacagaggagagaaggcatggaacaaagaaacctggcggcagcgcaaaagatg

SEQ ID NO: 102126 - DNA, 103 bp, Artificial Sequence
  Synthetic Polynucleotide
taatacgactcactatagggcctcagccggtactcaaggctatctttgttaacagaggagaaacaaaatgagccttgagaacctggcggcagcgcaaaagatg

SEQ ID NO: 102127 - DNA, 103 bp, Artificial Sequence
  Synthetic Polynucleotide
taatacgactcactatagggtgcgctcccgcctcagccggtactcaaggcaacagaggagagccttgatgaccggctgaaacctggcggcagcgcaaaagatg

SEQ ID NO: 102128 - DNA, 103 bp, Artificial Sequence
  Synthetic Polynucleotide
taatacgactcactataggggcgatgttgttgcgctcccgcctcagccggaacagaggagaccggctatggcgggagcgaacctggcggcagcgcaaaagatg

SEQ ID NO: 102129 - DNA, 103 bp, Artificial Sequence
  Synthetic Polynucleotide
taatacgactcactatagggcttgcgcacggcgatgttgttgcgctcccgaacagaggagacgggagatgaacaacatcaacctggcggcagcgcaaaagatg

SEQ ID NO: 102130 - DNA, 103 bp, Artificial Sequence
  Synthetic Polynucleotide
taatacgactcactatagggtgtctcggctcttgcgcacggcgatgttgtaacagaggagaacaacaatgccgtgcgcaaacctggcggcagcgcaaaagatg

SEQ ID NO: 102131 - DNA, 103 bp, Artificial Sequence
  Synthetic Polynucleotide
taatacgactcactatagggctcttggccttgtctcggctcttgcgcacgaacagaggagacgtgcgatggagccgagaaacctggcggcagcgcaaaagatg

SEQ ID NO: 102132 - DNA, 103 bp, Artificial Sequence
  Synthetic Polynucleotide
taatacgactcactatagggcagaatgcgcctcttggccttgtctcggctaacagaggagaagccgaatgaaggccaagaacctggcggcagcgcaaaagatg

SEQ ID NO: 102133 - DNA, 103 bp, Artificial Sequence
  Synthetic Polynucleotide
taatacgactcactataggggctgcgtctccagaatgcgcctcttggcctaacagaggagaaggccaatgggcgcattcaacctggcggcagcgcaaaagatg

SEQ ID NO: 102134 - DNA, 103 bp, Artificial Sequence
  Synthetic Polynucleotide
taatacgactcactatagggagcaccttctgctgcgtctccagaatgcgcaacagaggagagcgcatatgggagacgcaaacctggcggcagcgcaaaagatg

SEQ ID NO: 102135 - DNA, 103 bp, Artificial Sequence
  Synthetic Polynucleotide
taatacgactcactatagggtagctccccgggcccagctcggccccctgaaacagaggagatcagggatgcgagctgggaacctggcggcagcgcaaaagatg

SEQ ID NO: 102136 - DNA, 103 bp, Artificial Sequence
  Synthetic Polynucleotide
taatacgactcactatagggcatgtactccagcaccttctgctgcgtctcaacagaggagagagacgatgcagaaggtgaacctggcggcagcgcaaaagatg

SEQ ID NO: 102137 - DNA, 103 bp, Artificial Sequence
  Synthetic Polynucleotide
taatacgactcactatagggcgttctctgccatgtactccagcaccttctaacagaggagaagaaggatgtggagtacaaacctggcggcagcgcaaaagatg

SEQ ID NO: 102138 - DNA, 103 bp, Artificial Sequence
  Synthetic Polynucleotide
taatacgactcactatagggcggaggcgctcgttctctgccatgtactccaacagaggagaggagtaatgggcagagaaaacctggcggcagcgcaaaagatg

SEQ ID NO: 102139 - DNA, 103 bp, Artificial Sequence
  Synthetic Polynucleotide
taatacgactcactatagggcacgcggctgcggaggcgctcgttctctgcaacagaggagagcagagatggagcgcctcaacctggcggcagcgcaaaagatg

SEQ ID NO: 102140 - DNA, 103 bp, Artificial Sequence
  Synthetic Polynucleotide
taatacgactcactatagggtgagctgctccacgcggctgcggaggcgctaacagaggagaagcgccatggcagccgcgaacctggcggcagcgcaaaagatg

SEQ ID NO: 102141 - DNA, 103 bp, Artificial Sequence
  Synthetic Polynucleotide
taatacgactcactatagggagctcctgggtgagctgctccacgcggctgaacagaggagacagccgatgggagcagctaacctggcggcagcgcaaaagatg

SEQ ID NO: 102142 - DNA, 103 bp, Artificial Sequence
  Synthetic Polynucleotide
taatacgactcactataggggagggtgtctagctcctgggtgagctgctcaacagaggagagagcagatgacccaggagaacctggcggcagcgcaaaagatg

SEQ ID NO: 102143 - DNA, 103 bp, Artificial Sequence
  Synthetic Polynucleotide
taatacgactcactatagggagaggttgcggagggtgtctagctcctgggaacagaggagacccaggatgtagacacccaacctggcggcagcgcaaaagatg

SEQ ID NO: 102144 - DNA, 103 bp, Artificial Sequence
  Synthetic Polynucleotide
taatacgactcactatagggatctggcggaagaggttgcggagggtgtctaacagaggagaagacacatgccgcaacctaacctggcggcagcgcaaaagatg

SEQ ID NO: 102145 - DNA, 103 bp, Artificial Sequence
  Synthetic Polynucleotide
taatacgactcactatagggcgcctcaggaatctggcggaagaggttgcgaacagaggagacgcaacatgttccgccagaacctggcggcagcgcaaaagatg

SEQ ID NO: 102146 - DNA, 103 bp, Artificial Sequence
  Synthetic Polynucleotide
taatacgactcactatagggacatgtcccctagctccccgggcccagctcaacagaggagagagctgatgccggggagcaacctggcggcagcgcaaaagatg

SEQ ID NO: 102147 - DNA, 103 bp, Artificial Sequence
  Synthetic Polynucleotide
taatacgactcactatagggtgaggttggccgcctcaggaatctggcggaaacagaggagatccgccatgttcctgaggaacctggcggcagcgcaaaagatg

SEQ ID NO: 102148 - DNA, 103 bp, Artificial Sequence
  Synthetic Polynucleotide
taatacgactcactatagggacgcccttgatgaggttggccgcctcaggaaacagaggagatcctgaatgggccaacctaacctggcggcagcgcaaaagatg

SEQ ID NO: 102149 - DNA, 103 bp, Artificial Sequence
  Synthetic Polynucleotide
taatacgactcactataggggcaaccccccacgcccttgatgaggttggcaacagaggagagccaacatgatcaagggcaacctggcggcagcgcaaaagatg

SEQ ID NO: 102150 - DNA, 103 bp, Artificial Sequence
  Synthetic Polynucleotide
taatacgactcactatagggtcatgctcacacatgtcccctagctccccgaacagaggagacggggaatgaggggacataacctggcggcagcgcaaaagatg

SEQ ID NO: 102151 - DNA, 103 bp, Artificial Sequence
  Synthetic Polynucleotide
taatacgactcactatagggagtgctgttttgctgcgatatcttgctcataacagaggagaatgagcatgatatcgcagaacctggcggcagcgcaaaagatg

SEQ ID NO: 102152 - DNA, 103 bp, Artificial Sequence
  Synthetic Polynucleotide
taatacgactcactatagggcccagggccagcaggcaccagctgaggaacaacagaggagagttcctatgctggtgcctaacctggcggcagcgcaaaagatg

SEQ ID NO: 102153 - DNA, 103 bp, Artificial Sequence
  Synthetic Polynucleotide
taatacgactcactatagggtgcctcctcccccagggccagcaggcaccaaacagaggagatggtgcatgctggccctgaacctggcggcagcgcaaaagatg

SEQ ID NO: 102154 - DNA, 103 bp, Artificial Sequence
  Synthetic Polynucleotide
taatacgactcactataggggccacagctttgcctcctcccccagggccaaacagaggagatggcccatggggaggaggaacctggcggcagcgcaaaagatg

SEQ ID NO: 102155 - DNA, 103 bp, Artificial Sequence
  Synthetic Polynucleotide
taatacgactcactatagggcttgctgggagccacagctttgcctcctccaacagaggagaggaggaatgaaagctgtgaacctggcggcagcgcaaaagatg

SEQ ID NO: 102156 - DNA, 103 bp, Artificial Sequence
  Synthetic Polynucleotide
taatacgactcactatagggttttgctctgcttgctgggagccacagcttaacagaggagaaagctgatgctcccagcaaacctggcggcagcgcaaaagatg

SEQ ID NO: 102157 - DNA, 103 bp, Artificial Sequence
  Synthetic Polynucleotide
taatacgactcactatagggggcgaactctttttgctctgcttgctgggaaacagaggagatcccagatggcagagcaaaacctggcggcagcgcaaaagatg

SEQ ID NO: 102158 - DNA, 103 bp, Artificial Sequence
  Synthetic Polynucleotide
taatacgactcactatagggtcgatccatgggcgaactctttttgctctgaacagaggagacagagcatgaagagttcgaacctggcggcagcgcaaaagatg

SEQ ID NO: 102159 - DNA, 103 bp, Artificial Sequence
  Synthetic Polynucleotide
taatacgactcactatagggcgtcactgtttcgatccatgggcgaactctaacagaggagaagagttatgccatggatcaacctggcggcagcgcaaaagatg

SEQ ID NO: 102160 - DNA, 103 bp, Artificial Sequence
  Synthetic Polynucleotide
taatacgactcactatagggtgccgatactcgtcactgtttcgatccatgaacagaggagacatggaatgaaacagtgaaacctggcggcagcgcaaaagatg

SEQ ID NO: 102161 - DNA, 103 bp, Artificial Sequence
  Synthetic Polynucleotide
taatacgactcactatagggctctcggcgttgccgatactcgtcactgttaacagaggagaaacagtatggagtatcggaacctggcggcagcgcaaaagatg

SEQ ID NO: 102162 - DNA, 103 bp, Artificial Sequence
  Synthetic Polynucleotide
taatacgactcactatagggtcacccctggagtgctgttttgctgcgataaacagaggagatatcgcatgaaaacagcaaacctggcggcagcgcaaaagatg

SEQ ID NO: 102163 - DNA, 103 bp, Artificial Sequence
  Synthetic Polynucleotide
taatacgactcactatagggtgttgttcctctctcggcgttgccgatactaacagaggagaagtatcatgaacgccgagaacctggcggcagcgcaaaagatg

SEQ ID NO: 102164 - DNA, 103 bp, Artificial Sequence
  Synthetic Polynucleotide
taatacgactcactatagggttcacagccatgttgttcctctctcggcgtaacagaggagaacgccgatggaggaacaaaacctggcggcagcgcaaaagatg

SEQ ID NO: 102165 - DNA, 103 bp, Artificial Sequence
  Synthetic Polynucleotide
taatacgactcactatagggccggctctttttcacagccatgttgttcctaacagaggagaaggaacatgatggctgtgaacctggcggcagcgcaaaagatg

SEQ ID NO: 102166 - DNA, 103 bp, Artificial Sequence
  Synthetic Polynucleotide
taatacgactcactatagggtgcttttcaaccggctctttttcacagccaaacagaggagatggctgatgaaaagagccaacctggcggcagcgcaaaagatg

SEQ ID NO: 102167 - DNA, 103 bp, Artificial Sequence
  Synthetic Polynucleotide
taatacgactcactataggggctttctgcttgcttttcaaccggctctttaacagaggagaaaagagatggttgaaaagaacctggcggcagcgcaaaagatg

SEQ ID NO: 102168 - DNA, 103 bp, Artificial Sequence
  Synthetic Polynucleotide
taatacgactcactatagggtgtgtcttgtgctttctgcttgcttttcaaaacagaggagattgaaaatgaagcagaaaaacctggcggcagcgcaaaagatg

SEQ ID NO: 102169 - DNA, 103 bp, Artificial Sequence
  Synthetic Polynucleotide
taatacgactcactatagggctctctgcagtgtgtcttgtgctttctgctaacagaggagaagcagaatgcacaagacaaacctggcggcagcgcaaaagatg

SEQ ID NO: 102170 - DNA, 103 bp, Artificial Sequence
  Synthetic Polynucleotide
taatacgactcactatagggagctgattgactctctgcagtgtgtcttgtaacagaggagaacaagaatgactgcagagaacctggcggcagcgcaaaagatg

SEQ ID NO: 102171 - DNA, 103 bp, Artificial Sequence
  Synthetic Polynucleotide
taatacgactcactatagggctcttctttgagctgattgactctctgcagaacagaggagactgcagatggtcaatcagaacctggcggcagcgcaaaagatg

SEQ ID NO: 102172 - DNA, 103 bp, Artificial Sequence
  Synthetic Polynucleotide
taatacgactcactatagggaccgttcattctcttctttgagctgattgaaacagaggagatcaatcatgtcaaagaagaacctggcggcagcgcaaaagatg

SEQ ID NO: 102173 - DNA, 103 bp, Artificial Sequence
  Synthetic Polynucleotide
taatacgactcactatagggctaattccgttcacccctggagtgctgtttaacagaggagaaaacagatgtccaggggtaacctggcggcagcgcaaaagatg

SEQ ID NO: 102174 - DNA, 103 bp, Artificial Sequence
  Synthetic Polynucleotide
taatacgactcactatagggtttgcttccaaccgttcattctcttctttgaacagaggagacaaagaatggaatgaacgaacctggcggcagcgcaaaagatg

SEQ ID NO: 102175 - DNA, 103 bp, Artificial Sequence
  Synthetic Polynucleotide
taatacgactcactatagggcaatttgatttttgcttccaaccgttcattaacagaggagaaatgaaatgttggaagcaaacctggcggcagcgcaaaagatg

SEQ ID NO: 102176 - DNA, 103 bp, Artificial Sequence
  Synthetic Polynucleotide
taatacgactcactatagggccttggtcagcaatttgatttttgcttccaaacagaggagatggaagatgaaatcaaataacctggcggcagcgcaaaagatg

SEQ ID NO: 102177 - DNA, 103 bp, Artificial Sequence
  Synthetic Polynucleotide
taatacgactcactatagggacacttaattccttggtcagcaatttgattaacagaggagaaatcaaatggctgaccaaaacctggcggcagcgcaaaagatg

SEQ ID NO: 102178 - DNA, 103 bp, Artificial Sequence
  Synthetic Polynucleotide
taatacgactcactatagggatctttgagtacacttaattccttggtcagaacagaggagactgaccatggaattaagtaacctggcggcagcgcaaaagatg

SEQ ID NO: 102179 - DNA, 103 bp, Artificial Sequence
  Synthetic Polynucleotide
taatacgactcactatagggcaagaaacaaatctttgagtacacttaattaacagaggagaaattaaatgtactcaaagaacctggcggcagcgcaaaagatg

SEQ ID NO: 102180 - DNA, 103 bp, Artificial Sequence
  Synthetic Polynucleotide
taatacgactcactatagggtgtgcatgctcaagaaacaaatctttgagtaacagaggagaactcaaatgtttgtttctaacctggcggcagcgcaaaagatg

SEQ ID NO: 102181 - DNA, 103 bp, Artificial Sequence
  Synthetic Polynucleotide
taatacgactcactatagggtgcaaggttgtgtgcatgctcaagaaacaaaacagaggagattgtttatggagcatgcaaacctggcggcagcgcaaaagatg

SEQ ID NO: 102182 - DNA, 103 bp, Artificial Sequence
  Synthetic Polynucleotide
taatacgactcactataggggtacgttgtctgcaaggttgtgtgcatgctaacagaggagaagcatgatgacaaccttgaacctggcggcagcgcaaaagatg

SEQ ID NO: 102183 - DNA, 103 bp, Artificial Sequence
  Synthetic Polynucleotide
taatacgactcactatagggctaatggactgtacgttgtctgcaaggttgaacagaggagacaacctatgagacaacgtaacctggcggcagcgcaaaagatg

SEQ ID NO: 102184 - DNA, 103 bp, Artificial Sequence
  Synthetic Polynucleotide
taatacgactcactatagggatggataacactaattccgttcacccctggaacagaggagaccagggatgaacggaattaacctggcggcagcgcaaaagatg

SEQ ID NO: 102185 - DNA, 103 bp, Artificial Sequence
  Synthetic Polynucleotide
taatacgactcactatagggattttcagtgctaatggactgtacgttgtcaacagaggagagacaacatgcagtccattaacctggcggcagcgcaaaagatg

SEQ ID NO: 102186 - DNA, 103 bp, Artificial Sequence
  Synthetic Polynucleotide
taatacgactcactatagggctgctgtcgtattttcagtgctaatggactaacagaggagaagtccaatggcactgaaaaacctggcggcagcgcaaaagatg

SEQ ID NO: 102187 - DNA, 103 bp, Artificial Sequence
  Synthetic Polynucleotide
taatacgactcactatagggttgtcgccatctgctgtcgtattttcagtgaacagaggagacactgaatgtacgacagcaacctggcggcagcgcaaaagatg

SEQ ID NO: 102188 - DNA, 103 bp, Artificial Sequence
  Synthetic Polynucleotide
taatacgactcactatagggctgtcctgcattgtcgccatctgctgtcgtaacagaggagaacgacaatggatggcgacaacctggcggcagcgcaaaagatg

SEQ ID NO: 102189 - DNA, 103 bp, Artificial Sequence
  Synthetic Polynucleotide
taatacgactcactataggggtgcctgggtatggataacactaattccgtaacagaggagaacggaaatggtgttatccaacctggcggcagcgcaaaagatg

SEQ ID NO: 102190 - DNA, 103 bp, Artificial Sequence
  Synthetic Polynucleotide
taatacgactcactatagggccgctggcatgtgcctgggtatggataacaaacagaggagatgttatatgtacccaggcaacctggcggcagcgcaaaagatg

SEQ ID NO: 102191 - DNA, 103 bp, Artificial Sequence
  Synthetic Polynucleotide
taatacgactcactatagggctgctgtaagccgctggcatgtgcctgggtaacagaggagaacccagatgcatgccagcaacctggcggcagcgcaaaagatg

SEQ ID NO: 102192 - DNA, 103 bp, Artificial Sequence
  Synthetic Polynucleotide
taatacgactcactataggggctgaggaacctgctgtaagccgctggcataacagaggagaatgccaatggcttacagcaacctggcggcagcgcaaaagatg

SEQ ID NO: 102193 - DNA, 103 bp, Artificial Sequence
  Synthetic Polynucleotide
taatacgactcactataggggcaggcaccagctgaggaacctgctgtaagaacagaggagacttacaatgggttcctcaaacctggcggcagcgcaaaagatg

SEQ ID NO: 102194 - DNA, 103 bp, Artificial Sequence
  Synthetic Polynucleotide
taatacgactcactataggggaactccaaaggctccttgactgcggccataacagaggagaatggccatggtcaaggagaacctggcggcagcgcaaaagatg

SEQ ID NO: 102195 - DNA, 103 bp, Artificial Sequence
  Synthetic Polynucleotide
taatacgactcactataggggaacccattctcggcttcactagtattatcaacagaggagagataatatgagtgaagccaacctggcggcagcgcaaaagatg

SEQ ID NO: 102196 - DNA, 103 bp, Artificial Sequence
  Synthetic Polynucleotide
taatacgactcactatagggtttcagctggtgttcaaaataccataatataacagaggagaatattaatgtattttgaaaacctggcggcagcgcaaaagatg

SEQ ID NO: 102197 - DNA, 103 bp, Artificial Sequence
  Synthetic Polynucleotide
taatacgactcactatagggccactaagtgtttcagctggtgttcaaaataacagaggagaattttgatgaccagctgaaacctggcggcagcgcaaaagatg

SEQ ID NO: 102198 - DNA, 103 bp, Artificial Sequence
  Synthetic Polynucleotide
taatacgactcactatagggacaaattcagccactaagtgtttcagctggaacagaggagaccagctatgacacttagtaacctggcggcagcgcaaaagatg

SEQ ID NO: 102199 - DNA, 103 bp, Artificial Sequence
  Synthetic Polynucleotide
taatacgactcactatagggtaagacctgcacaaattcagccactaagtgaacagaggagacacttaatggctgaatttaacctggcggcagcgcaaaagatg

SEQ ID NO: 102200 - DNA, 103 bp, Artificial Sequence
  Synthetic Polynucleotide
taatacgactcactatagggttaaagtttctaagacctgcacaaattcagaacagaggagactgaatatgtgcaggtctaacctggcggcagcgcaaaagatg

SEQ ID NO: 102201 - DNA, 103 bp, Artificial Sequence
  Synthetic Polynucleotide
taatacgactcactataggggtatcatgacttaaagtttctaagacctgcaacagaggagagcaggtatgagaaactttaacctggcggcagcgcaaaagatg

SEQ ID NO: 102202 - DNA, 103 bp, Artificial Sequence
  Synthetic Polynucleotide
taatacgactcactatagggggttactaatgtatcatgacttaaagtttcaacagaggagagaaactatgagtcatgataacctggcggcagcgcaaaagatg

SEQ ID NO: 102203 - DNA, 103 bp, Artificial Sequence
  Synthetic Polynucleotide
taatacgactcactataggggagttttagtggttactaatgtatcatgacaacagaggagagtcatgatgcattagtaaaacctggcggcagcgcaaaagatg

SEQ ID NO: 102204 - DNA, 103 bp, Artificial Sequence
  Synthetic Polynucleotide
taatacgactcactataggggtaagggctcgagttttagtggttactaataacagaggagaattagtatgcactaaaacaacctggcggcagcgcaaaagatg

SEQ ID NO: 102205 - DNA, 103 bp, Artificial Sequence
  Synthetic Polynucleotide
taatacgactcactatagggatgagccacggtaagggctcgagttttagtaacagaggagaactaaaatgcgagcccttaacctggcggcagcgcaaaagatg

SEQ ID NO: 102206 - DNA, 103 bp, Artificial Sequence
  Synthetic Polynucleotide
taatacgactcactatagggcctccagggagaacccattctcggcttcacaacagaggagagtgaagatgagaatgggtaacctggcggcagcgcaaaagatg

SEQ ID NO: 102207 - DNA, 103 bp, Artificial Sequence
  Synthetic Polynucleotide
taatacgactcactatagggaaagcagctcatgagccacggtaagggctcaacagaggagagagcccatgccgtggctcaacctggcggcagcgcaaaagatg

SEQ ID NO: 102208 - DNA, 103 bp, Artificial Sequence
  Synthetic Polynucleotide
taatacgactcactatagggggcttgttacaaagcagctcatgagccacgaacagaggagacgtggcatgtgagctgctaacctggcggcagcgcaaaagatg

SEQ ID NO: 102209 - DNA, 103 bp, Artificial Sequence
  Synthetic Polynucleotide
taatacgactcactatagggttcttcctcaggcttgttacaaagcagctcaacagaggagagagctgatgtgtaacaagaacctggcggcagcgcaaaagatg

SEQ ID NO: 102210 - DNA, 103 bp, Artificial Sequence
  Synthetic Polynucleotide
taatacgactcactataggggaagagccttttcttcctcaggcttgttacaacagaggagagtaacaatgctgaggaagaacctggcggcagcgcaaaagatg

SEQ ID NO: 102211 - DNA, 103 bp, Artificial Sequence
  Synthetic Polynucleotide
taatacgactcactatagggacttgcacaagaagagccttttcttcctcaaacagaggagatgaggaatgaaaggctctaacctggcggcagcgcaaaagatg

SEQ ID NO: 102212 - DNA, 103 bp, Artificial Sequence
  Synthetic Polynucleotide
taatacgactcactatagggtttatttaccacttgcacaagaagagccttaacagaggagaaaggctatgcttgtgcaaaacctggcggcagcgcaaaagatg

SEQ ID NO: 102213 - DNA, 103 bp, Artificial Sequence
  Synthetic Polynucleotide
taatacgactcactataggggatctcccagtttatttaccacttgcacaaaacagaggagattgtgcatgtggtaaataaacctggcggcagcgcaaaagatg

SEQ ID NO: 102214 - DNA, 103 bp, Artificial Sequence
  Synthetic Polynucleotide
taatacgactcactatagggctgttctgaggatctcccagtttatttaccaacagaggagaggtaaaatgactgggagaaacctggcggcagcgcaaaagatg

SEQ ID NO: 102215 - DNA, 103 bp, Artificial Sequence
  Synthetic Polynucleotide
taatacgactcactatagggtgtggcaattctgttctgaggatctcccagaacagaggagactgggaatgcctcagaacaacctggcggcagcgcaaaagatg

SEQ ID NO: 102216 - DNA, 103 bp, Artificial Sequence
  Synthetic Polynucleotide
taatacgactcactataggggggatgcttttgtggcaattctgttctgagaacagaggagactcagaatggaattgccaaacctggcggcagcgcaaaagatg

SEQ ID NO: 102217 - DNA, 103 bp, Artificial Sequence
  Synthetic Polynucleotide
taatacgactcactatagggcgtaacacttcctccagggagaacccattcaacagaggagagaatggatgctccctggaaacctggcggcagcgcaaaagatg

SEQ ID NO: 102218 - DNA, 103 bp, Artificial Sequence
  Synthetic Polynucleotide
taatacgactcactatagggtctaacagatgggatgcttttgtggcaattaacagaggagaaattgcatgaaaagcatcaacctggcggcagcgcaaaagatg

SEQ ID NO: 102219 - DNA, 103 bp, Artificial Sequence
  Synthetic Polynucleotide
taatacgactcactatagggaagtaatgtctctaacagatgggatgctttaacagaggagaaaagcaatgcatctgttaaacctggcggcagcgcaaaagatg

SEQ ID NO: 102220 - DNA, 103 bp, Artificial Sequence
  Synthetic Polynucleotide
taatacgactcactataggggatgtttacaaagtaatgtctctaacagataacagaggagaatctgtatgagacattacaacctggcggcagcgcaaaagatg

SEQ ID NO: 102221 - DNA, 103 bp, Artificial Sequence
  Synthetic Polynucleotide
taatacgactcactatagggttcatattgggatgtttacaaagtaatgtcaacagaggagagacattatgttgtaaacaaacctggcggcagcgcaaaagatg

SEQ ID NO: 102222 - DNA, 103 bp, Artificial Sequence
  Synthetic Polynucleotide
taatacgactcactatagggcacaactcctttcatattgggatgtttacaaacagaggagatgtaaaatgcccaatatgaacctggcggcagcgcaaaagatg

SEQ ID NO: 102223 - DNA, 103 bp, Artificial Sequence
  Synthetic Polynucleotide
taatacgactcactatagggcttcaccagacacaactcctttcatattggaacagaggagaccaataatgaaggagttgaacctggcggcagcgcaaaagatg

SEQ ID NO: 102224 - DNA, 103 bp, Artificial Sequence
  Synthetic Polynucleotide
taatacgactcactatagggagcctttctacttcaccagacacaactcctaacagaggagaaggagtatggtctggtgaaacctggcggcagcgcaaaagatg

SEQ ID NO: 102225 - DNA, 103 bp, Artificial Sequence
  Synthetic Polynucleotide
taatacgactcactataggggcggaagagtagcctttctacttcaccagaaacagaggagatctggtatggtagaaaggaacctggcggcagcgcaaaagatg

SEQ ID NO: 102226 - DNA, 103 bp, Artificial Sequence
  Synthetic Polynucleotide
taatacgactcactatagggtgatatttgagcggaagagtagcctttctaaacagaggagatagaaaatgtactcttccaacctggcggcagcgcaaaagatg

SEQ ID NO: 102227 - DNA, 103 bp, Artificial Sequence
  Synthetic Polynucleotide
taatacgactcactataggggctttggagctgatatttgagcggaagagtaacagaggagaactcttatgctcaaatataacctggcggcagcgcaaaagatg

SEQ ID NO: 102228 - DNA, 103 bp, Artificial Sequence
  Synthetic Polynucleotide
taatacgactcactataggggcctccgagccgtaacacttcctccagggaaacagaggagatccctgatggaagtgttaaacctggcggcagcgcaaaagatg

SEQ ID NO: 102229 - DNA, 103 bp, Artificial Sequence
  Synthetic Polynucleotide
taatacgactcactatagggataatattgagctttggagctgatatttgaaacagaggagatcaaatatgagctccaaaaacctggcggcagcgcaaaagatg

SEQ ID NO: 102230 - DNA, 103 bp, Artificial Sequence
  Synthetic Polynucleotide
taatacgactcactatagggagcaaattgcataatattgagctttggagcaacagaggagagctccaatgctcaatattaacctggcggcagcgcaaaagatg

SEQ ID NO: 102231 - DNA, 103 bp, Artificial Sequence
  Synthetic Polynucleotide
taatacgactcactatagggtgatttaaaaagcaaattgcataatattgaaacagaggagatcaataatgtgcaatttgaacctggcggcagcgcaaaagatg

SEQ ID NO: 102232 - DNA, 103 bp, Artificial Sequence
  Synthetic Polynucleotide
taatacgactcactatagggcagagccatttgatttaaaaagcaaattgcaacagaggagagcaattatgtttttaaataacctggcggcagcgcaaaagatg

SEQ ID NO: 102233 - DNA, 103 bp, Artificial Sequence
  Synthetic Polynucleotide
taatacgactcactatagggcttcatgggacagagccatttgatttaaaaaacagaggagattttaaatgaaatggctcaacctggcggcagcgcaaaagatg

SEQ ID NO: 102234 - DNA, 103 bp, Artificial Sequence
  Synthetic Polynucleotide
taatacgactcactatagggaattcactttcttcatgggacagagccattaacagaggagaaatggcatggtcccatgaaacctggcggcagcgcaaaagatg

SEQ ID NO: 102235 - DNA, 103 bp, Artificial Sequence
  Synthetic Polynucleotide
taatacgactcactatagggtttgttagccaattcactttcttcatgggaaacagaggagatcccatatggaaagtgaaaacctggcggcagcgcaaaagatg

SEQ ID NO: 102236 - DNA, 103 bp, Artificial Sequence
  Synthetic Polynucleotide
taatacgactcactatagggcagttattaatttgttagccaattcactttaacagaggagaaaagtgatgtggctaacaaacctggcggcagcgcaaaagatg

SEQ ID NO: 102237 - DNA, 103 bp, Artificial Sequence
  Synthetic Polynucleotide
taatacgactcactatagggcaaaagtaaacagttattaatttgttagccaacagaggagaggctaaatgattaataacaacctggcggcagcgcaaaagatg

SEQ ID NO: 102238 - DNA, 103 bp, Artificial Sequence
  Synthetic Polynucleotide
taatacgactcactatagggccgaaaaaagcaaaagtaaacagttattaaaacagaggagattaataatggtttactttaacctggcggcagcgcaaaagatg

SEQ ID NO: 102239 - DNA, 103 bp, Artificial Sequence
  Synthetic Polynucleotide
taatacgactcactatagggcttgcttggtgcctccgagccgtaacacttaacagaggagaaagtgtatgggctcggagaacctggcggcagcgcaaaagatg

SEQ ID NO: 102240 - DNA, 103 bp, Artificial Sequence
  Synthetic Polynucleotide
taatacgactcactatagggtgacacaagtccgaaaaaagcaaaagtaaaaacagaggagatttactatggcttttttcaacctggcggcagcgcaaaagatg

SEQ ID NO: 102241 - DNA, 103 bp, Artificial Sequence
  Synthetic Polynucleotide
taatacgactcactatagggtctttttttttgacacaagtccgaaaaaagaacagaggagactttttatggacttgtgtaacctggcggcagcgcaaaagatg

SEQ ID NO: 102242 - DNA, 103 bp, Artificial Sequence
  Synthetic Polynucleotide
taatacgactcactatagggtgattcaacatctttttttttgacacaagtaacagaggagaacttgtatgaaaaaaaaaaacctggcggcagcgcaaaagatg

SEQ ID NO: 102243 - DNA, 103 bp, Artificial Sequence
  Synthetic Polynucleotide
taatacgactcactatagggtaagcatttttgattcaacatcttttttttaacagaggagaaaaaaaatgatgttgaataacctggcggcagcgcaaaagatg

SEQ ID NO: 102244 - DNA, 103 bp, Artificial Sequence
  Synthetic Polynucleotide
taatacgactcactatagggaaaagggcgctaagcatttttgattcaacaaacagaggagatgttgaatgaaaaatgctaacctggcggcagcgcaaaagatg

SEQ ID NO: 102245 - DNA, 103 bp, Artificial Sequence
  Synthetic Polynucleotide
taatacgactcactatagggcacacctgttaaaagggcgctaagcattttaacagaggagaaaaatgatgagcgcccttaacctggcggcagcgcaaaagatg

SEQ ID NO: 102246 - DNA, 103 bp, Artificial Sequence
  Synthetic Polynucleotide
taatacgactcactatagggatgccctattcacacctgttaaaagggcgcaacagaggagagcgcccatgtaacaggtgaacctggcggcagcgcaaaagatg

SEQ ID NO: 102247 - DNA, 103 bp, Artificial Sequence
  Synthetic Polynucleotide
taatacgactcactataggggaataagggtatgccctattcacacctgttaacagaggagaaacaggatggaatagggcaacctggcggcagcgcaaaagatg

SEQ ID NO: 102248 - DNA, 103 bp, Artificial Sequence
  Synthetic Polynucleotide
taatacgactcactatagggaccagtctgggaataagggtatgccctattaacagaggagaaataggatgtacccttataacctggcggcagcgcaaaagatg

SEQ ID NO: 102249 - DNA, 103 bp, Artificial Sequence
  Synthetic Polynucleotide
taatacgactcactatagggctttgtcatcaccagtctgggaataagggtaacagaggagaacccttatgcccagactgaacctggcggcagcgcaaaagatg

SEQ ID NO: 102250 - DNA, 103 bp, Artificial Sequence
  Synthetic Polynucleotide
taatacgactcactatagggataaggtaatcttgcttggtgcctccgagcaacagaggagagctcggatgcaccaagcaaacctggcggcagcgcaaaagatg

SEQ ID NO: 102251 - DNA, 103 bp, Artificial Sequence
  Synthetic Polynucleotide
taatacgactcactatagggtgctcccttactttgtcatcaccagtctggaacagaggagaccagacatgtgatgacaaaacctggcggcagcgcaaaagatg

SEQ ID NO: 102252 - DNA, 103 bp, Artificial Sequence
  Synthetic Polynucleotide
taatacgactcactatagggtgtgtcaatctgctcccttactttgtcatcaacagaggagagatgacatggtaagggagaacctggcggcagcgcaaaagatg

SEQ ID NO: 102253 - DNA, 103 bp, Artificial Sequence
  Synthetic Polynucleotide
taatacgactcactatagggctttaaacagtgtgtcaatctgctcccttaaacagaggagataagggatgagattgacaaacctggcggcagcgcaaaagatg

SEQ ID NO: 102254 - DNA, 103 bp, Artificial Sequence
  Synthetic Polynucleotide
taatacgactcactatagggatatgcaacactttaaacagtgtgtcaatcaacagaggagagattgaatgactgtttaaaacctggcggcagcgcaaaagatg

SEQ ID NO: 102255 - DNA, 103 bp, Artificial Sequence
  Synthetic Polynucleotide
taatacgactcactatagggaaaattcacaatatgcaacactttaaacagaacagaggagactgtttatggtgttgcataacctggcggcagcgcaaaagatg

SEQ ID NO: 102256 - DNA, 103 bp, Artificial Sequence
  Synthetic Polynucleotide
taatacgactcactatagggcactggtattaaaattcacaatatgcaacaaacagaggagatgttgcatgttgtgaattaacctggcggcagcgcaaaagatg

SEQ ID NO: 102257 - DNA, 103 bp, Artificial Sequence
  Synthetic Polynucleotide
taatacgactcactatagggaaagcctggacactggtattaaaattcacaaacagaggagatgtgaaatgtaataccagaacctggcggcagcgcaaaagatg

SEQ ID NO: 102258 - DNA, 103 bp, Artificial Sequence
  Synthetic Polynucleotide
taatacgactcactatagggaagcaacattaaagcctggacactggtattaacagaggagaaataccatggtccaggctaacctggcggcagcgcaaaagatg

SEQ ID NO: 102259 - DNA, 103 bp, Artificial Sequence
  Synthetic Polynucleotide
taatacgactcactatagggttacttggaaaagcaacattaaagcctggaaacagaggagatccaggatgtaatgttgcaacctggcggcagcgcaaaagatg

SEQ ID NO: 102260 - DNA, 103 bp, Artificial Sequence
  Synthetic Polynucleotide
taatacgactcactatagggtgagaattcattacttggaaaagcaacattaacagaggagaaatgttatgtttccaagtaacctggcggcagcgcaaaagatg

SEQ ID NO: 102261 - DNA, 103 bp, Artificial Sequence
  Synthetic Polynucleotide
taatacgactcactatagggagtagccagcataaggtaatcttgcttggtaacagaggagaaccaagatggattaccttaacctggcggcagcgcaaaagatg

SEQ ID NO: 102262 - DNA, 103 bp, Artificial Sequence
  Synthetic Polynucleotide
taatacgactcactatagggtattgtctgctgagaattcattacttggaaaacagaggagattccaaatgatgaattctaacctggcggcagcgcaaaagatg

SEQ ID NO: 102263 - DNA, 103 bp, Artificial Sequence
  Synthetic Polynucleotide
taatacgactcactatagggatcgatccgatattgtctgctgagaattcaaacagaggagatgaattatgagcagacaaaacctggcggcagcgcaaaagatg

SEQ ID NO: 102264 - DNA, 103 bp, Artificial Sequence
  Synthetic Polynucleotide
taatacgactcactataggggctgtgtaatatcgatccgatattgtctgcaacagaggagagcagacatgatcggatcgaacctggcggcagcgcaaaagatg

SEQ ID NO: 102265 - DNA, 103 bp, Artificial Sequence
  Synthetic Polynucleotide
taatacgactcactatagggcctgtataatgctgtgtaatatcgatccgaaacagaggagatcggatatgtattacacaaacctggcggcagcgcaaaagatg

SEQ ID NO: 102266 - DNA, 103 bp, Artificial Sequence
  Synthetic Polynucleotide
taatacgactcactatagggccaacatcttcctgtataatgctgtgtaataacagaggagaattacaatgcattatacaaacctggcggcagcgcaaaagatg

SEQ ID NO: 102267 - DNA, 103 bp, Artificial Sequence
  Synthetic Polynucleotide
taatacgactcactatagggaaccctggatccaacatcttcctgtataataacagaggagaattataatggaagatgttaacctggcggcagcgcaaaagatg

SEQ ID NO: 102268 - DNA, 103 bp, Artificial Sequence
  Synthetic Polynucleotide
taatacgactcactatagggacacgtcatcaaccctggatccaacatcttaacagaggagaaagatgatggatccagggaacctggcggcagcgcaaaagatg

SEQ ID NO: 102269 - DNA, 103 bp, Artificial Sequence
  Synthetic Polynucleotide
taatacgactcactatagggcttgcttggaacacgtcatcaaccctggataacagaggagaatccagatgtgatgacgtaacctggcggcagcgcaaaagatg

SEQ ID NO: 102270 - DNA, 103 bp, Artificial Sequence
  Synthetic Polynucleotide
taatacgactcactatagggagaaacatagcttgcttggaacacgtcatcaacagaggagagatgacatgttccaagcaaacctggcggcagcgcaaaagatg

SEQ ID NO: 102271 - DNA, 103 bp, Artificial Sequence
  Synthetic Polynucleotide
taatacgactcactataggggacaaggttaagaaacatagcttgcttggaaacagaggagatccaagatggctatgtttaacctggcggcagcgcaaaagatg

SEQ ID NO: 102272 - DNA, 103 bp, Artificial Sequence
  Synthetic Polynucleotide
taatacgactcactatagggtctcatccaaagtagccagcataaggtaataacagaggagaattaccatgtgctggctaaacctggcggcagcgcaaaagatg

SEQ ID NO: 102273 - DNA, 103 bp, Artificial Sequence
  Synthetic Polynucleotide
taatacgactcactataggggagatttgtagacaaggttaagaaacatagaacagaggagactatgtatgttaaccttgaacctggcggcagcgcaaaagatg

SEQ ID NO: 102274 - DNA, 103 bp, Artificial Sequence
  Synthetic Polynucleotide
taatacgactcactatagggtcagctttcagagatttgtagacaaggttaaacagaggagataacctatgctacaaatcaacctggcggcagcgcaaaagatg

SEQ ID NO: 102275 - DNA, 103 bp, Artificial Sequence
  Synthetic Polynucleotide
taatacgactcactatagggcaacacaatgtcagctttcagagatttgtaaacagaggagatacaaaatgctgaaagctaacctggcggcagcgcaaaagatg

SEQ ID NO: 102276 - DNA, 103 bp, Artificial Sequence
  Synthetic Polynucleotide
taatacgactcactatagggtcacccggcgcaacacaatgtcagctttcaaacagaggagatgaaagatgacattgtgtaacctggcggcagcgcaaaagatg

SEQ ID NO: 102277 - DNA, 103 bp, Artificial Sequence
  Synthetic Polynucleotide
taatacgactcactatagggacaaaagccttcacccggcgcaacacaatgaacagaggagacattgtatggcgccgggtaacctggcggcagcgcaaaagatg

SEQ ID NO: 102278 - DNA, 103 bp, Artificial Sequence
  Synthetic Polynucleotide
taatacgactcactatagggtaacctcttcacaaaagccttcacccggcgaacagaggagacgccggatgaaggcttttaacctggcggcagcgcaaaagatg

SEQ ID NO: 102279 - DNA, 103 bp, Artificial Sequence
  Synthetic Polynucleotide
taatacgactcactatagggtaacttgaagtaacctcttcacaaaagcctaacagaggagaaggcttatgtgaagaggtaacctggcggcagcgcaaaagatg

SEQ ID NO: 102280 - DNA, 103 bp, Artificial Sequence
  Synthetic Polynucleotide
taatacgactcactatagggtgttgacaagtaacttgaagtaacctcttcaacagaggagagaagagatgacttcaagtaacctggcggcagcgcaaaagatg

SEQ ID NO: 102281 - DNA, 103 bp, Artificial Sequence
  Synthetic Polynucleotide
taatacgactcactatagggtggtggcatctgttgacaagtaacttgaagaacagaggagacttcaaatgacttgtcaaaacctggcggcagcgcaaaagatg

SEQ ID NO: 102282 - DNA, 103 bp, Artificial Sequence
  Synthetic Polynucleotide
taatacgactcactatagggcacatataaatggtggcatctgttgacaagaacagaggagacttgtcatgagatgccacaacctggcggcagcgcaaaagatg

SEQ ID NO: 102283 - DNA, 103 bp, Artificial Sequence
  Synthetic Polynucleotide
taatacgactcactatagggacttcctcattctcatccaaagtagccagcaacagaggagagctggcatgtttggatgaaacctggcggcagcgcaaaagatg

SEQ ID NO: 102284 - DNA, 103 bp, Artificial Sequence
  Synthetic Polynucleotide
taatacgactcactatagggtataaagctccacatataaatggtggcatcaacagaggagagatgccatgatttatatgaacctggcggcagcgcaaaagatg

SEQ ID NO: 102285 - DNA, 103 bp, Artificial Sequence
  Synthetic Polynucleotide
taatacgactcactatagggagacacaagatataaagctccacatataaaaacagaggagatttataatgggagctttaaacctggcggcagcgcaaaagatg

SEQ ID NO: 102286 - DNA, 103 bp, Artificial Sequence
  Synthetic Polynucleotide
taatacgactcactatagggtaaggatctcagacacaagatataaagctcaacagaggagagagcttatgatcttgtgtaacctggcggcagcgcaaaagatg

SEQ ID NO: 102287 - DNA, 103 bp, Artificial Sequence
  Synthetic Polynucleotide
taatacgactcactatagggggttttgctttaaggatctcagacacaagaaacagaggagatcttgtatgtgagatcctaacctggcggcagcgcaaaagatg

SEQ ID NO: 102288 - DNA, 103 bp, Artificial Sequence
  Synthetic Polynucleotide
taatacgactcactatagggtcttaaacctggttttgctttaaggatctcaacagaggagagagatcatgaaagcaaaaaacctggcggcagcgcaaaagatg

SEQ ID NO: 102289 - DNA, 103 bp, Artificial Sequence
  Synthetic Polynucleotide
taatacgactcactatagggctagttggcttcttaaacctggttttgcttaacagaggagaaagcaaatgcaggtttaaaacctggcggcagcgcaaaagatg

SEQ ID NO: 102290 - DNA, 103 bp, Artificial Sequence
  Synthetic Polynucleotide
taatacgactcactatagggggatgatcatctagttggcttcttaaacctaacagaggagaaggtttatgaagccaactaacctggcggcagcgcaaaagatg

SEQ ID NO: 102291 - DNA, 103 bp, Artificial Sequence
  Synthetic Polynucleotide
taatacgactcactatagggatcagactccggatgatcatctagttggctaacagaggagaagccaaatggatgatcataacctggcggcagcgcaaaagatg

SEQ ID NO: 102292 - DNA, 103 bp, Artificial Sequence
  Synthetic Polynucleotide
taatacgactcactatagggtttcttcatcatcagactccggatgatcataacagaggagaatgatcatgcggagtctgaacctggcggcagcgcaaaagatg

SEQ ID NO: 102293 - DNA, 103 bp, Artificial Sequence
  Synthetic Polynucleotide
taatacgactcactatagggtcaataaaattttcttcatcatcagactccaacagaggagaggagtcatgtgatgaagaaacctggcggcagcgcaaaagatg

SEQ ID NO: 102294 - DNA, 103 bp, Artificial Sequence
  Synthetic Polynucleotide
taatacgactcactatagggtccatctatcacttcctcattctcatccaaaacagaggagattggatatgaatgaggaaaacctggcggcagcgcaaaagatg

SEQ ID NO: 102295 - DNA, 103 bp, Artificial Sequence
  Synthetic Polynucleotide
taatacgactcactatagggatcatttgcatcaataaaattttcttcatcaacagaggagagatgaaatgaattttattaacctggcggcagcgcaaaagatg

SEQ ID NO: 102296 - DNA, 103 bp, Artificial Sequence
  Synthetic Polynucleotide
taatacgactcactatagggtgtcttcatcatcatttgcatcaataaaataacagaggagaattttaatgatgcaaatgaacctggcggcagcgcaaaagatg

SEQ ID NO: 102297 - DNA, 103 bp, Artificial Sequence
  Synthetic Polynucleotide
taatacgactcactatagggaatttttccatgtcttcatcatcatttgcaaacagaggagatgcaaaatgtgatgaagaaacctggcggcagcgcaaaagatg

SEQ ID NO: 102298 - DNA, 103 bp, Artificial Sequence
  Synthetic Polynucleotide
taatacgactcactatagggtgcatcagtgaatttttccatgtcttcatcaacagaggagagatgaaatgatggaaaaaaacctggcggcagcgcaaaagatg

SEQ ID NO: 102299 - DNA, 103 bp, Artificial Sequence
  Synthetic Polynucleotide
taatacgactcactatagggtttctttgtctgcatcagtgaatttttccaaacagaggagatggaaaatgtcactgatgaacctggcggcagcgcaaaagatg

SEQ ID NO: 102300 - DNA, 103 bp, Artificial Sequence
  Synthetic Polynucleotide
taatacgactcactatagggactatctctgtttctttgtctgcatcagtgaacagaggagacactgaatgagacaaagaaacctggcggcagcgcaaaagatg

SEQ ID NO: 102301 - DNA, 103 bp, Artificial Sequence
  Synthetic Polynucleotide
taatacgactcactatagggaagttttttcactatctctgtttctttgtcaacagaggagagacaaaatgacagagataaacctggcggcagcgcaaaagatg

SEQ ID NO: 102302 - DNA, 103 bp, Artificial Sequence
  Synthetic Polynucleotide
taatacgactcactatagggcctctgtctcaagttttttcactatctctgaacagaggagacagagaatgtgaaaaaacaacctggcggcagcgcaaaagatg

SEQ ID NO: 102303 - DNA, 103 bp, Artificial Sequence
  Synthetic Polynucleotide
taatacgactcactatagggggaactgtttcctctgtctcaagttttttcaacagaggagagaaaaaatgtgagacagaaacctggcggcagcgcaaaagatg

SEQ ID NO: 102304 - DNA, 103 bp, Artificial Sequence
  Synthetic Polynucleotide
taatacgactcactatagggatcagtttcaggaactgtttcctctgtctcaacagaggagagagacaatggaaacagttaacctggcggcagcgcaaaagatg

SEQ ID NO: 102305 - DNA, 103 bp, Artificial Sequence
  Synthetic Polynucleotide
taatacgactcactataggggcttggcatggaactccaaaggctccttgaaacagaggagatcaaggatgctttggagtaacctggcggcagcgcaaaagatg

SEQ ID NO: 102306 - DNA, 103 bp, Artificial Sequence
  Synthetic Polynucleotide
taatacgactcactatagggcttttttgcctccatctatcacttcctcataacagaggagaatgaggatgtgatagatgaacctggcggcagcgcaaaagatg

SEQ ID NO: 102307 - DNA, 103 bp, Artificial Sequence
  Synthetic Polynucleotide
taatacgactcactatagggtggtttctacatcagtttcaggaactgtttaacagaggagaaaacagatgctgaaactgaacctggcggcagcgcaaaagatg

SEQ ID NO: 102308 - DNA, 103 bp, Artificial Sequence
  Synthetic Polynucleotide
taatacgactcactatagggtctggttttttggtttctacatcagtttcaaacagaggagatgaaacatgtgtagaaacaacctggcggcagcgcaaaagatg

SEQ ID NO: 102309 - DNA, 103 bp, Artificial Sequence
  Synthetic Polynucleotide
taatacgactcactatagggggaagcaacctctggttttttggtttctacaacagaggagagtagaaatgaaaaaaccaaacctggcggcagcgcaaaagatg

SEQ ID NO: 102310 - DNA, 103 bp, Artificial Sequence
  Synthetic Polynucleotide
taatacgactcactatagggagtgcacccaggaagcaacctctggtttttaacagaggagaaaaaacatgaggttgcttaacctggcggcagcgcaaaagatg

SEQ ID NO: 102311 - DNA, 103 bp, Artificial Sequence
  Synthetic Polynucleotide
taatacgactcactatagggaaattatcaaagtgcacccaggaagcaaccaacagaggagaggttgcatgctgggtgcaaacctggcggcagcgcaaaagatg

SEQ ID NO: 102312 - DNA, 103 bp, Artificial Sequence
  Synthetic Polynucleotide
taatacgactcactatagggcccacctttcaaattatcaaagtgcacccaaacagaggagatgggtgatgtttgataataacctggcggcagcgcaaaagatg

SEQ ID NO: 102313 - DNA, 103 bp, Artificial Sequence
  Synthetic Polynucleotide
taatacgactcactatagggttaactgtttcccacctttcaaattatcaaaacagaggagattgataatgtgaaaggtgaacctggcggcagcgcaaaagatg

SEQ ID NO: 102314 - DNA, 103 bp, Artificial Sequence
  Synthetic Polynucleotide
taatacgactcactatagggtcgtatttatttaactgtttcccacctttcaacagaggagagaaaggatggaaacagttaacctggcggcagcgcaaaagatg

SEQ ID NO: 102315 - DNA, 103 bp, Artificial Sequence
  Synthetic Polynucleotide
taatacgactcactatagggactgaatggatcgtatttatttaactgtttaacagaggagaaaacagatgaataaatacaacctggcggcagcgcaaaagatg

SEQ ID NO: 102316 - DNA, 103 bp, Artificial Sequence
  Synthetic Polynucleotide
taatacgactcactataggggagggtttctactgaatggatcgtatttataacagaggagaataaatatgatccattcaaacctggcggcagcgcaaaagatg

SEQ ID NO: 102317 - DNA, 103 bp, Artificial Sequence
  Synthetic Polynucleotide
taatacgactcactatagggtcgattgctccttttttgcctccatctatcaacagaggagagatagaatgaggcaaaaaaacctggcggcagcgcaaaagatg

SEQ ID NO: 102318 - DNA, 103 bp, Artificial Sequence
  Synthetic Polynucleotide
taatacgactcactatagggccacagaacagagggtttctactgaatggaaacagaggagatccattatgtagaaacccaacctggcggcagcgcaaaagatg

SEQ ID NO: 102319 - DNA, 103 bp, Artificial Sequence
  Synthetic Polynucleotide
taatacgactcactatagggattttcagctccacagaacagagggtttctaacagaggagaagaaacatgctgttctgtaacctggcggcagcgcaaaagatg

SEQ ID NO: 102320 - DNA, 103 bp, Artificial Sequence
  Synthetic Polynucleotide
taatacgactcactatagggaaagacttgtattttcagctccacagaacaaacagaggagatgttctatggagctgaaaaacctggcggcagcgcaaaagatg

SEQ ID NO: 102321 - DNA, 103 bp, Artificial Sequence
  Synthetic Polynucleotide
taatacgactcactatagggttgagttcccaaagacttgtattttcagctaacagaggagaagctgaatgtacaagtctaacctggcggcagcgcaaaagatg

SEQ ID NO: 102322 - DNA, 103 bp, Artificial Sequence
  Synthetic Polynucleotide
taatacgactcactatagggagataactttttgagttcccaaagacttgtaacagaggagaacaagtatgtgggaactcaacctggcggcagcgcaaaagatg

SEQ ID NO: 102323 - DNA, 103 bp, Artificial Sequence
  Synthetic Polynucleotide
taatacgactcactataggggaaaatgcacagataactttttgagttcccaacagaggagagggaacatgaaaagttataacctggcggcagcgcaaaagatg

SEQ ID NO: 102324 - DNA, 103 bp, Artificial Sequence
  Synthetic Polynucleotide
taatacgactcactatagggacggagggatgaaaatgcacagataactttaacagaggagaaaagttatgtgtgcatttaacctggcggcagcgcaaaagatg

SEQ ID NO: 102325 - DNA, 103 bp, Artificial Sequence
  Synthetic Polynucleotide
taatacgactcactatagggaaaaagggccacggagggatgaaaatgcacaacagaggagagtgcatatgcatccctccaacctggcggcagcgcaaaagatg

SEQ ID NO: 102326 - DNA, 103 bp, Artificial Sequence
  Synthetic Polynucleotide
taatacgactcactatagggtggtctttgcaaaaagggccacggagggataacagaggagaatccctatgtggccctttaacctggcggcagcgcaaaagatg

SEQ ID NO: 102327 - DNA, 103 bp, Artificial Sequence
  Synthetic Polynucleotide
taatacgactcactatagggccctgaaggatggtctttgcaaaaagggccaacagaggagaggccctatgtgcaaagacaacctggcggcagcgcaaaagatg

SEQ ID NO: 102328 - DNA, 103 bp, Artificial Sequence
  Synthetic Polynucleotide
taatacgactcactatagggctgaaggtcatcgattgctccttttttgccaacagaggagaggcaaaatgggagcaatcaacctggcggcagcgcaaaagatg

SEQ ID NO: 102329 - DNA, 103 bp, Artificial Sequence
  Synthetic Polynucleotide
taatacgactcactatagggaatatagtttccctgaaggatggtctttgcaacagaggagagcaaagatgatccttcagaacctggcggcagcgcaaaagatg

SEQ ID NO: 102330 - DNA, 103 bp, Artificial Sequence
  Synthetic Polynucleotide
taatacgactcactatagggctgaatactgaatatagtttccctgaaggaaacagaggagatccttcatggaaactataaacctggcggcagcgcaaaagatg

SEQ ID NO: 102331 - DNA, 103 bp, Artificial Sequence
  Synthetic Polynucleotide
taatacgactcactatagggagtgggtcccctgaatactgaatatagtttaacagaggagaaaactaatgtcagtattcaacctggcggcagcgcaaaagatg

SEQ ID NO: 102332 - DNA, 103 bp, Artificial Sequence
  Synthetic Polynucleotide
taatacgactcactataggggaaatcctgcagtgggtcccctgaatactgaacagaggagacagtatatgggggacccaaacctggcggcagcgcaaaagatg

SEQ ID NO: 102333 - DNA, 103 bp, Artificial Sequence
  Synthetic Polynucleotide
taatacgactcactatagggtcattagagtgaaatcctgcagtgggtcccaacagaggagagggaccatgtgcaggattaacctggcggcagcgcaaaagatg

SEQ ID NO: 102334 - DNA, 103 bp, Artificial Sequence
  Synthetic Polynucleotide
taatacgactcactatagggtccaaaaatctcattagagtgaaatcctgcaacagaggagagcaggaatgcactctaataacctggcggcagcgcaaaagatg

SEQ ID NO: 102335 - DNA, 103 bp, Artificial Sequence
  Synthetic Polynucleotide
taatacgactcactatagggtacaaatcgatccaaaaatctcattagagtaacagaggagaactctaatgagatttttgaacctggcggcagcgcaaaagatg

SEQ ID NO: 102336 - DNA, 103 bp, Artificial Sequence
  Synthetic Polynucleotide
taatacgactcactataggggatttcggtatacaaatcgatccaaaaatcaacagaggagagattttatgatcgatttgaacctggcggcagcgcaaaagatg

SEQ ID NO: 102337 - DNA, 103 bp, Artificial Sequence
  Synthetic Polynucleotide
taatacgactcactatagggtggggctttggatttcggtatacaaatcgaaacagaggagatcgattatgataccgaaaaacctggcggcagcgcaaaagatg

SEQ ID NO: 102338 - DNA, 103 bp, Artificial Sequence
  Synthetic Polynucleotide
taatacgactcactatagggtttgcctttatggggctttggatttcggtaaacagaggagataccgaatgccaaagcccaacctggcggcagcgcaaaagatg

SEQ ID NO: 102339 - DNA, 103 bp, Artificial Sequence
  Synthetic Polynucleotide
taatacgactcactatagggattcaccttgctgaaggtcatcgattgctcaacagaggagagagcaaatgatgaccttcaacctggcggcagcgcaaaagatg

SEQ ID NO: 102340 - DNA, 103 bp, Artificial Sequence
  Synthetic Polynucleotide
taatacgactcactatagggctgtgttttctttgcctttatggggctttgaacagaggagacaaagcatgataaaggcaaacctggcggcagcgcaaaagatg

SEQ ID NO: 102341 - DNA, 103 bp, Artificial Sequence
  Synthetic Polynucleotide
taatacgactcactatagggacaacactatctgtgttttctttgcctttaaacagaggagataaaggatgagaaaacacaacctggcggcagcgcaaaagatg

SEQ ID NO: 102342 - DNA, 103 bp, Artificial Sequence
  Synthetic Polynucleotide
taatacgactcactatagggcggctgcatcacaacactatctgtgttttcaacagaggagagaaaacatggatagtgttaacctggcggcagcgcaaaagatg

SEQ ID NO: 102343 - DNA, 103 bp, Artificial Sequence
  Synthetic Polynucleotide
taatacgactcactataggggttttcttttcggctgcatcacaacactataacagaggagaatagtgatgtgatgcagcaacctggcggcagcgcaaaagatg

SEQ ID NO: 102344 - DNA, 103 bp, Artificial Sequence
  Synthetic Polynucleotide
taatacgactcactatagggttaataaaatgttttcttttcggctgcatcaacagaggagagatgcaatggaaaagaaaaacctggcggcagcgcaaaagatg

SEQ ID NO: 102345 - DNA, 103 bp, Artificial Sequence
  Synthetic Polynucleotide
taatacgactcactatagggacgaatatccttaataaaatgttttcttttaacagaggagaaaaagaatgcattttattaacctggcggcagcgcaaaagatg

SEQ ID NO: 102346 - DNA, 103 bp, Artificial Sequence
  Synthetic Polynucleotide
taatacgactcactatagggcaggaagatgacgaatatccttaataaaataacagaggagaattttaatgaggatattcaacctggcggcagcgcaaaagatg

SEQ ID NO: 102347 - DNA, 103 bp, Artificial Sequence
  Synthetic Polynucleotide
taatacgactcactatagggttactgttcacaggaagatgacgaatatccaacagaggagaggatatatgtcatcttccaacctggcggcagcgcaaaagatg

SEQ ID NO: 102348 - DNA, 103 bp, Artificial Sequence
  Synthetic Polynucleotide
taatacgactcactatagggaaggaactccttactgttcacaggaagatgaacagaggagacatcttatggtgaacagtaacctggcggcagcgcaaaagatg

SEQ ID NO: 102349 - DNA, 103 bp, Artificial Sequence
  Synthetic Polynucleotide
taatacgactcactatagggcttcttttgcaaggaactccttactgttcaaacagaggagatgaacaatgaggagttccaacctggcggcagcgcaaaagatg

SEQ ID NO: 102350 - DNA, 103 bp, Artificial Sequence
  Synthetic Polynucleotide
taatacgactcactatagggaatgcttccaattcaccttgctgaaggtcaaacagaggagatgacctatggcaaggtgaaacctggcggcagcgcaaaagatg

SEQ ID NO: 102351 - DNA, 103 bp, Artificial Sequence
  Synthetic Polynucleotide
taatacgactcactatagggatttggctttcttcttttgcaaggaactccaacagaggagaggagttatgtgcaaaagaaacctggcggcagcgcaaaagatg

SEQ ID NO: 102352 - DNA, 103 bp, Artificial Sequence
  Synthetic Polynucleotide
taatacgactcactatagggatccactggtatttggctttcttcttttgcaacagaggagagcaaaaatggaaagccaaaacctggcggcagcgcaaaagatg

SEQ ID NO: 102353 - DNA, 103 bp, Artificial Sequence
  Synthetic Polynucleotide
taatacgactcactatagggaaaacacttcatccactggtatttggctttaacagaggagaaaagccatgtaccagtggaacctggcggcagcgcaaaagatg

SEQ ID NO: 102354 - DNA, 103 bp, Artificial Sequence
  Synthetic Polynucleotide
taatacgactcactatagggtacctgtggaaaaacacttcatccactggtaacagaggagaaccagtatgtgaagtgttaacctggcggcagcgcaaaagatg

SEQ ID NO: 102355 - DNA, 103 bp, Artificial Sequence
  Synthetic Polynucleotide
taatacgactcactatagggttttttataatacctgtggaaaaacacttcaacagaggagagaagtgatgttccacaggaacctggcggcagcgcaaaagatg

SEQ ID NO: 102356 - DNA, 103 bp, Artificial Sequence
  Synthetic Polynucleotide
taatacgactcactatagggtaacagcaacttttttataatacctgtggaaacagaggagatccacaatgattataaaaaacctggcggcagcgcaaaagatg

SEQ ID NO: 102357 - DNA, 103 bp, Artificial Sequence
  Synthetic Polynucleotide
taatacgactcactatagggtgtttctctttaacagcaacttttttataaaacagaggagattataaatgagttgctgtaacctggcggcagcgcaaaagatg

SEQ ID NO: 102358 - DNA, 103 bp, Artificial Sequence
  Synthetic Polynucleotide
taatacgactcactatagggatcccgtttttgtttctctttaacagcaacaacagaggagagttgctatgaaagagaaaaacctggcggcagcgcaaaagatg

SEQ ID NO: 102359 - DNA, 103 bp, Artificial Sequence
  Synthetic Polynucleotide
taatacgactcactatagggcttcatctgcatcccgtttttgtttctcttaacagaggagaaagagaatgaaaaacgggaacctggcggcagcgcaaaagatg

SEQ ID NO: 102360 - DNA, 103 bp, Artificial Sequence
  Synthetic Polynucleotide
taatacgactcactatagggtctatactttcttcatctgcatcccgttttaacagaggagaaaaacgatgtgcagatgaaacctggcggcagcgcaaaagatg

SEQ ID NO: 102361 - DNA, 103 bp, Artificial Sequence
  Synthetic Polynucleotide
taatacgactcactatagggattttgaataaatgcttccaattcaccttgaacagaggagacaaggtatgttggaagcaaacctggcggcagcgcaaaagatg

SEQ ID NO: 102362 - DNA, 103 bp, Artificial Sequence
  Synthetic Polynucleotide
taatacgactcactatagggatccacgtcttctatactttcttcatctgcaacagaggagagcagatatggaaagtataaacctggcggcagcgcaaaagatg

SEQ ID NO: 102363 - DNA, 103 bp, Artificial Sequence
  Synthetic Polynucleotide
taatacgactcactatagggattcttcatcatccacgtcttctatactttaacagaggagaaaagtaatgaagacgtggaacctggcggcagcgcaaaagatg

SEQ ID NO: 102364 - DNA, 103 bp, Artificial Sequence
  Synthetic Polynucleotide
taatacgactcactatagggagctcttcaaattcttcatcatccacgtctaacagaggagaagacgtatgtgatgaagaaacctggcggcagcgcaaaagatg

SEQ ID NO: 102365 - DNA, 103 bp, Artificial Sequence
  Synthetic Polynucleotide
taatacgactcactatagggtgtgtcaatcagctcttcaaattcttcatcaacagaggagagatgaaatgtttgaagagaacctggcggcagcgcaaaagatg

SEQ ID NO: 102366 - DNA, 103 bp, Artificial Sequence
  Synthetic Polynucleotide
taatacgactcactatagggcatcttcaaatgtgtcaatcagctcttcaaaacagaggagattgaagatgtgattgacaaacctggcggcagcgcaaaagatg

SEQ ID NO: 102367 - DNA, 103 bp, Artificial Sequence
  Synthetic Polynucleotide
taatacgactcactatagggaaacagttatcatcttcaaatgtgtcaatcaacagaggagagattgaatgatttgaagaaacctggcggcagcgcaaaagatg

SEQ ID NO: 102368 - DNA, 103 bp, Artificial Sequence
  Synthetic Polynucleotide
taatacgactcactatagggtccagagctgaaacagttatcatcttcaaaaacagaggagatttgaaatggataactgtaacctggcggcagcgcaaaagatg

SEQ ID NO: 102369 - DNA, 103 bp, Artificial Sequence
  Synthetic Polynucleotide
taatacgactcactatagggtatcatcctttccagagctgaaacagttataacagaggagaataactatgtcagctctgaacctggcggcagcgcaaaagatg

SEQ ID NO: 102370 - DNA, 103 bp, Artificial Sequence
  Synthetic Polynucleotide
taatacgactcactataggggcaaaatccatatcatcctttccagagctgaacagaggagacagctcatgaaaggatgaaacctggcggcagcgcaaaagatg

SEQ ID NO: 102371 - DNA, 103 bp, Artificial Sequence
  Synthetic Polynucleotide
taatacgactcactatagggcacgtttccagcaaaatccatatcatccttaacagaggagaaaggatatgatggattttaacctggcggcagcgcaaaagatg

SEQ ID NO: 102372 - DNA, 103 bp, Artificial Sequence
  Synthetic Polynucleotide
taatacgactcactatagggccaaattaagattttgaataaatgcttccaaacagaggagatggaagatgttattcaaaaacctggcggcagcgcaaaagatg

SEQ ID NO: 102373 - DNA, 103 bp, Artificial Sequence
  Synthetic Polynucleotide
taatacgactcactatagggttctctttttcacgtttccagcaaaatccaaacagaggagatggattatgctggaaacgaacctggcggcagcgcaaaagatg

SEQ ID NO: 102374 - DNA, 103 bp, Artificial Sequence
  Synthetic Polynucleotide
taatacgactcactataggggctccttttgttctctttttcacgtttccaaacagaggagatggaaaatggaaaaagagaacctggcggcagcgcaaaagatg

SEQ ID NO: 102375 - DNA, 103 bp, Artificial Sequence
  Synthetic Polynucleotide
taatacgactcactataggggttatccttagctccttttgttctctttttaacagaggagaaaaaagatgacaaaaggaaacctggcggcagcgcaaaagatg

SEQ ID NO: 102376 - DNA, 103 bp, Artificial Sequence
  Synthetic Polynucleotide
taatacgactcactatagggcatctaatgtgttatccttagctccttttgaacagaggagacaaaagatgctaaggataaacctggcggcagcgcaaaagatg

SEQ ID NO: 102377 - DNA, 103 bp, Artificial Sequence
  Synthetic Polynucleotide
taatacgactcactatagggtctgaatcttcatctaatgtgttatccttaaacagaggagataaggaatgcacattagaaacctggcggcagcgcaaaagatg

SEQ ID NO: 102378 - DNA, 103 bp, Artificial Sequence
  Synthetic Polynucleotide
taatacgactcactatagggatcactaccttctgaatcttcatctaatgtaacagaggagaacattaatggaagattcaaacctggcggcagcgcaaaagatg

SEQ ID NO: 102379 - DNA, 103 bp, Artificial Sequence
  Synthetic Polynucleotide
taatacgactcactatagggcaagttcatcatcactaccttctgaatcttaacagaggagaaagattatgaaggtagtgaacctggcggcagcgcaaaagatg

SEQ ID NO: 102380 - DNA, 103 bp, Artificial Sequence
  Synthetic Polynucleotide
taatacgactcactatagggtccaggttaccaagttcatcatcactacctaacagaggagaaggtagatgtgatgaactaacctggcggcagcgcaaaagatg

SEQ ID NO: 102381 - DNA, 103 bp, Artificial Sequence
  Synthetic Polynucleotide
taatacgactcactatagggttcatcgtcatccaggttaccaagttcatcaacagaggagagatgaaatgggtaacctgaacctggcggcagcgcaaaagatg

SEQ ID NO: 102382 - DNA, 103 bp, Artificial Sequence
  Synthetic Polynucleotide
taatacgactcactatagggctaaagaaacttcatcgtcatccaggttacaacagaggagagtaaccatgatgacgatgaacctggcggcagcgcaaaagatg

SEQ ID NO: 102383 - DNA, 103 bp, Artificial Sequence
  Synthetic Polynucleotide
taatacgactcactataggggtatacttcgccaaattaagattttgaataaacagaggagatattcaatgtcttaatttaacctggcggcagcgcaaaagatg

SEQ ID NO: 102384 - DNA, 103 bp, Artificial Sequence
  Synthetic Polynucleotide
taatacgactcactatagggtccatacttcctaaagaaacttcatcgtcaaacagaggagatgacgaatgagtttctttaacctggcggcagcgcaaaagatg

SEQ ID NO: 102385 - DNA, 103 bp, Artificial Sequence
  Synthetic Polynucleotide
taatacgactcactatagggttcttcatcatccatacttcctaaagaaacaacagaggagagtttctatgggaagtatgaacctggcggcagcgcaaaagatg

SEQ ID NO: 102386 - DNA, 103 bp, Artificial Sequence
  Synthetic Polynucleotide
taatacgactcactatagggcttcagcaaattcttcatcatccatacttcaacagaggagagaagtaatgatgatgaagaacctggcggcagcgcaaaagatg

SEQ ID NO: 102387 - DNA, 103 bp, Artificial Sequence
  Synthetic Polynucleotide
taatacgactcactatagggtcttcatcaacttcagcaaattcttcatcaaacagaggagatgatgaatgatttgctgaaacctggcggcagcgcaaaagatg

SEQ ID NO: 102388 - DNA, 103 bp, Artificial Sequence
  Synthetic Polynucleotide
taatacgactcactatagggtgttcctccatcttcatcaacttcagcaaaaacagaggagatttgctatggttgatgaaaacctggcggcagcgcaaaagatg

SEQ ID NO: 102389 - DNA, 103 bp, Artificial Sequence
  Synthetic Polynucleotide
taatacgactcactatagggcatccatgaatgttcctccatcttcatcaaaacagaggagattgatgatgatggaggaaaacctggcggcagcgcaaaagatg

SEQ ID NO: 102390 - DNA, 103 bp, Artificial Sequence
  Synthetic Polynucleotide
taatacgactcactatagggtcatctaacacatccatgaatgttcctccaaacagaggagatggaggatgattcatggaaacctggcggcagcgcaaaagatg

SEQ ID NO: 102391 - DNA, 103 bp, Artificial Sequence
  Synthetic Polynucleotide
taatacgactcactatagggctcactttcatcatctaacacatccatgaaaacagaggagattcatgatggtgttagataacctggcggcagcgcaaaagatg

SEQ ID NO: 102392 - DNA, 103 bp, Artificial Sequence
  Synthetic Polynucleotide
taatacgactcactatagggctggaacgctctcactttcatcatctaacaaacagaggagatgttagatgatgaaagtgaacctggcggcagcgcaaaagatg

SEQ ID NO: 102393 - DNA, 103 bp, Artificial Sequence
  Synthetic Polynucleotide
taatacgactcactatagggacttcaagttctggaacgctctcactttcaaacagaggagatgaaagatggagcgttccaacctggcggcagcgcaaaagatg

SEQ ID NO: 102394 - DNA, 103 bp, Artificial Sequence
  Synthetic Polynucleotide
taatacgactcactatagggggaagcttttgtatacttcgccaaattaagaacagaggagacttaatatggcgaagtataacctggcggcagcgcaaaagatg

SEQ ID NO: 102395 - DNA, 103 bp, Artificial Sequence
  Synthetic Polynucleotide
taatacgactcactatagggtttggagtggacttcaagttctggaacgctaacagaggagaagcgttatggaacttgaaaacctggcggcagcgcaaaagatg

SEQ ID NO: 102396 - DNA, 103 bp, Artificial Sequence
  Synthetic Polynucleotide
taatacgactcactatagggtagtactgactttggagtggacttcaagttaacagaggagaaacttgatgtccactccaaacctggcggcagcgcaaaagatg

SEQ ID NO: 102397 - DNA, 103 bp, Artificial Sequence
  Synthetic Polynucleotide
taatacgactcactatagggttgcttttcttagtactgactttggagtggaacagaggagaccactcatgagtcagtacaacctggcggcagcgcaaaagatg

SEQ ID NO: 102398 - DNA, 103 bp, Artificial Sequence
  Synthetic Polynucleotide
taatacgactcactatagggaccttttctcttgcttttcttagtactgacaacagaggagagtcagtatgaagaaaagcaacctggcggcagcgcaaaagatg

SEQ ID NO: 102399 - DNA, 103 bp, Artificial Sequence
  Synthetic Polynucleotide
taatacgactcactatagggaatcatctgtaccttttctcttgcttttctaacagaggagaagaaaaatgagagaaaagaacctggcggcagcgcaaaagatg

SEQ ID NO: 102400 - DNA, 103 bp, Artificial Sequence
  Synthetic Polynucleotide
taatacgactcactataggggcaaagtcaaaatcatctgtaccttttctcaacagaggagagagaaaatgtacagatgaaacctggcggcagcgcaaaagatg

SEQ ID NO: 102401 - DNA, 103 bp, Artificial Sequence
  Synthetic Polynucleotide
taatacgactcactatagggaaatgagccagcaaagtcaaaatcatctgtaacagaggagaacagatatgtttgactttaacctggcggcagcgcaaaagatg

SEQ ID NO: 102402 - DNA, 103 bp, Artificial Sequence
  Synthetic Polynucleotide
taatacgactcactatagggttggcccttgaaatgagccagcaaagtcaaaacagaggagattgactatgctggctcataacctggcggcagcgcaaaagatg

SEQ ID NO: 102403 - DNA, 103 bp, Artificial Sequence
  Synthetic Polynucleotide
taatacgactcactatagggttcttttttcttggcccttgaaatgagccaaacagaggagatggctcatgtcaagggccaacctggcggcagcgcaaaagatg

SEQ ID NO: 102404 - DNA, 103 bp, Artificial Sequence
  Synthetic Polynucleotide
taatacgactcactatagggtaagtttcttttcttttttcttggcccttgaacagaggagacaagggatgagaaaaaagaacctggcggcagcgcaaaagatg

SEQ ID NO: 102405 - DNA, 103 bp, Artificial Sequence
  Synthetic Polynucleotide
taatacgactcactatagggcttcaactaaggaagcttttgtatacttcgaacagaggagacgaagtatgcaaaagcttaacctggcggcagcgcaaaagatg

SEQ ID NO: 102406 - DNA, 103 bp, Artificial Sequence
  Synthetic Polynucleotide
taatacgactcactatagggtggaatcatttaagtttcttttcttttttcaacagaggagagaaaaaatgaaagaaactaacctggcggcagcgcaaaagatg

SEQ ID NO: 102407 - DNA, 103 bp, Artificial Sequence
  Synthetic Polynucleotide
taatacgactcactatagggacaaataggctggaatcatttaagtttcttaacagaggagaaagaaaatgaaatgattcaacctggcggcagcgcaaaagatg

SEQ ID NO: 102408 - DNA, 103 bp, Artificial Sequence
  Synthetic Polynucleotide
taatacgactcactatagggttcagcagatacaaataggctggaatcattaacagaggagaaatgatatgagcctatttaacctggcggcagcgcaaaagatg

SEQ ID NO: 102409 - DNA, 103 bp, Artificial Sequence
  Synthetic Polynucleotide
taatacgactcactatagggggccaaactcttcagcagatacaaataggcaacagaggagagcctatatgtatctgctgaacctggcggcagcgcaaaagatg

SEQ ID NO: 102410 - DNA, 103 bp, Artificial Sequence
  Synthetic Polynucleotide
taatacgactcactatagggtccaatagatggccaaactcttcagcagataacagaggagaatctgcatgagagtttggaacctggcggcagcgcaaaagatg

SEQ ID NO: 102411 - DNA, 103 bp, Artificial Sequence
  Synthetic Polynucleotide
taatacgactcactatagggcatattttcatccaatagatggccaaactcaacagaggagagagtttatgcatctattgaacctggcggcagcgcaaaagatg

SEQ ID NO: 102412 - DNA, 103 bp, Artificial Sequence
  Synthetic Polynucleotide
taatacgactcactatagggacttggatcccatattttcatccaatagataacagaggagaatctatatgatgaaaataaacctggcggcagcgcaaaagatg

SEQ ID NO: 102413 - DNA, 103 bp, Artificial Sequence
  Synthetic Polynucleotide
taatacgactcactatagggatgttatcaaacttggatcccatattttcaaacagaggagatgaaaaatggggatccaaaacctggcggcagcgcaaaagatg

SEQ ID NO: 102414 - DNA, 103 bp, Artificial Sequence
  Synthetic Polynucleotide
taatacgactcactatagggattcatgccaatgttatcaaacttggatccaacagaggagaggatccatgtttgataacaacctggcggcagcgcaaaagatg

SEQ ID NO: 102415 - DNA, 103 bp, Artificial Sequence
  Synthetic Polynucleotide
taatacgactcactatagggtagccatggcattcatgccaatgttatcaaaacagaggagattgataatgttggcatgaaacctggcggcagcgcaaaagatg

SEQ ID NO: 102416 - DNA, 103 bp, Artificial Sequence
  Synthetic Polynucleotide
taatacgactcactatagggcgccaaggccgcttggcatggaactccaaaaacagaggagatttggaatgccatgccaaaacctggcggcagcgcaaaagatg

SEQ ID NO: 102417 - DNA, 103 bp, Artificial Sequence
  Synthetic Polynucleotide
taatacgactcactatagggggttcatcttcttcaactaaggaagcttttaacagaggagaaaaagcatgcttagttgaaacctggcggcagcgcaaaagatg

SEQ ID NO: 102418 - DNA, 103 bp, Artificial Sequence
  Synthetic Polynucleotide
taatacgactcactatagggttatctttgttagccatggcattcatgccaaacagaggagatggcatatgtgccatggcaacctggcggcagcgcaaaagatg

SEQ ID NO: 102419 - DNA, 103 bp, Artificial Sequence
  Synthetic Polynucleotide
taatacgactcactataggggagacttgcattatctttgttagccatggcaacagaggagagccatgatgaacaaagataacctggcggcagcgcaaaagatg

SEQ ID NO: 102420 - DNA, 103 bp, Artificial Sequence
  Synthetic Polynucleotide
taatacgactcactatagggtaagctgtttgagacttgcattatctttgtaacagaggagaacaaagatgatgcaagtcaacctggcggcagcgcaaaagatg

SEQ ID NO: 102421 - DNA, 103 bp, Artificial Sequence
  Synthetic Polynucleotide
taatacgactcactataggggcctcccatctaagctgtttgagacttgcaaacagaggagatgcaagatgcaaacagctaacctggcggcagcgcaaaagatg

SEQ ID NO: 102422 - DNA, 103 bp, Artificial Sequence
  Synthetic Polynucleotide
taatacgactcactatagggatcacgttcagcctcccatctaagctgtttaacagaggagaaaacagatgagatgggagaacctggcggcagcgcaaaagatg

SEQ ID NO: 102423 - DNA, 103 bp, Artificial Sequence
  Synthetic Polynucleotide
taatacgactcactataggggtagccagtcatcacgttcagcctcccatcaacagaggagagatgggatgctgaacgtgaacctggcggcagcgcaaaagatg

SEQ ID NO: 102424 - DNA, 103 bp, Artificial Sequence
  Synthetic Polynucleotide
taatacgactcactatagggtctctgttgtgtagccagtcatcacgttcaaacagaggagatgaacgatgtgactggctaacctggcggcagcgcaaaagatg

SEQ ID NO: 102425 - DNA, 103 bp, Artificial Sequence
  Synthetic Polynucleotide
taatacgactcactatagggactttttgcatctctgttgtgtagccagtcaacagaggagagactggatgcacaacagaaacctggcggcagcgcaaaagatg

SEQ ID NO: 102426 - DNA, 103 bp, Artificial Sequence
  Synthetic Polynucleotide
taatacgactcactatagggtcttgatgatactttttgcatctctgttgtaacagaggagaacaacaatgatgcaaaaaaacctggcggcagcgcaaaagatg

SEQ ID NO: 102427 - DNA, 103 bp, Artificial Sequence
  Synthetic Polynucleotide
taatacgactcactatagggtgtttctttttcttgatgatactttttgcaaacagaggagatgcaaaatgtatcatcaaaacctggcggcagcgcaaaagatg

SEQ ID NO: 102428 - DNA, 103 bp, Artificial Sequence
  Synthetic Polynucleotide
taatacgactcactatagggtttttcagctggttcatcttcttcaactaaaacagaggagattagttatggaagatgaaaacctggcggcagcgcaaaagatg

SEQ ID NO: 102429 - DNA, 103 bp, Artificial Sequence
  Synthetic Polynucleotide
taatacgactcactatagggctttttaaaatgtttctttttcttgatgataacagaggagaatcatcatgaaaaagaaaaacctggcggcagcgcaaaagatg

SEQ ID NO: 102430 - DNA, 103 bp, Artificial Sequence
  Synthetic Polynucleotide
taatacgactcactatagggtaatcctcttctttttaaaatgtttcttttaacagaggagaaaaagaatgattttaaaaaacctggcggcagcgcaaaagatg

SEQ ID NO: 102431 - DNA, 103 bp, Artificial Sequence
  Synthetic Polynucleotide
taatacgactcactatagggtgagtggttttaatcctcttctttttaaaaaacagaggagattttaaatggaagaggataacctggcggcagcgcaaaagatg

SEQ ID NO: 102432 - DNA, 103 bp, Artificial Sequence
  Synthetic Polynucleotide
taatacgactcactatagggtttagttttttgagtggttttaatcctcttaacagaggagaaagaggatgaaaaccactaacctggcggcagcgcaaaagatg

SEQ ID NO: 102433 - DNA, 103 bp, Artificial Sequence
  Synthetic Polynucleotide
taatacgactcactatagggtcctttgttttttagttttttgagtggtttaacagaggagaaaaccaatgaaaaaactaaacctggcggcagcgcaaaagatg

SEQ ID NO: 102434 - DNA, 103 bp, Artificial Sequence
  Synthetic Polynucleotide
taatacgactcactatagggtggaattttctttttcagctggttcatcttaacagaggagaaagatgatgcagctgaaaaacctggcggcagcgcaaaagatg

SEQ ID NO: 102435 - DNA, 103 bp, Artificial Sequence
  Synthetic Polynucleotide
taatacgactcactatagggtcttttttgctggaattttctttttcagctaacagaggagaagctgaatgagaaaattcaacctggcggcagcgcaaaagatg

SEQ ID NO: 102436 - DNA, 103 bp, Artificial Sequence
  Synthetic Polynucleotide
taatacgactcactatagggtatttttacttcttttttgctggaattttcaacagaggagagaaaatatgagcaaaaaaaacctggcggcagcgcaaaagatg

SEQ ID NO: 102437 - DNA, 103 bp, Artificial Sequence
  Synthetic Polynucleotide
taatacgactcactatagggttattttaggtatttttacttcttttttgcaacagaggagagcaaaaatgaagtaaaaaaacctggcggcagcgcaaaagatg

SEQ ID NO: 102438 - DNA, 103 bp, Artificial Sequence
  Synthetic Polynucleotide
taatacgactcactatagggtttttattatttattttaggtatttttactaacagaggagaagtaaaatgacctaaaataacctggcggcagcgcaaaagatg

SEQ ID NO: 102439 - DNA, 103 bp, Artificial Sequence
  Synthetic Polynucleotide
taatacgactcactatagggttctgctgtatttttattatttattttaggaacagaggagacctaaaatgaataataaaaacctggcggcagcgcaaaagatg

SEQ ID NO: 102440 - DNA, 103 bp, Artificial Sequence
  Synthetic Polynucleotide
taatacgactcactatagggtcctttgactttctgctgtatttttattataacagaggagaataataatgatacagcagaacctggcggcagcgcaaaagatg

SEQ ID NO: 102441 - DNA, 103 bp, Artificial Sequence
  Synthetic Polynucleotide
taatacgactcactatagggttaactgatgtcctttgactttctgctgtaaacagaggagatacagcatgaagtcaaagaacctggcggcagcgcaaaagatg

SEQ ID NO: 102442 - DNA, 103 bp, Artificial Sequence
  Synthetic Polynucleotide
taatacgactcactatagggctcctcggggcgccaaggccgcttggcatgaacagaggagacatgccatgcggccttggaacctggcggcagcgcaaaagatg

SEQ ID NO: 102443 - DNA, 103 bp, Artificial Sequence
  Synthetic Polynucleotide
taatacgactcactatagggtttcaccttattaactgatgtcctttgactaacagaggagaagtcaaatgacatcagttaacctggcggcagcgcaaaagatg

SEQ ID NO: 102444 - DNA, 103 bp, Artificial Sequence
  Synthetic Polynucleotide
taatacgactcactatagggtattcttatttttcaccttattaactgatgaacagaggagacatcagatgataaggtgaaacctggcggcagcgcaaaagatg

SEQ ID NO: 102445 - DNA, 103 bp, Artificial Sequence
  Synthetic Polynucleotide
taatacgactcactatagggggttctggcctattcttatttttcaccttaaacagaggagataaggtatgaaataagaaaacctggcggcagcgcaaaagatg

SEQ ID NO: 102446 - DNA, 103 bp, Artificial Sequence
  Synthetic Polynucleotide
taatacgactcactatagggatcagaatgtggttctggcctattcttattaacagaggagaaataagatgaggccagaaaacctggcggcagcgcaaaagatg

SEQ ID NO: 102447 - DNA, 103 bp, Artificial Sequence
  Synthetic Polynucleotide
taatacgactcactatagggtgccattctcatcagaatgtggttctggccaacagaggagaggccagatgcacattctgaacctggcggcagcgcaaaagatg

SEQ ID NO: 102448 - DNA, 103 bp, Artificial Sequence
  Synthetic Polynucleotide
taatacgactcactatagggggtgtggtactgccattctcatcagaatgtaacagaggagaacattcatgtgagaatggaacctggcggcagcgcaaaagatg

SEQ ID NO: 102449 - DNA, 103 bp, Artificial Sequence
  Synthetic Polynucleotide
taatacgactcactatagggctttactttcggtgtggtactgccattctcaacagaggagagagaatatgagtaccacaaacctggcggcagcgcaaaagatg

SEQ ID NO: 102450 - DNA, 103 bp, Artificial Sequence
  Synthetic Polynucleotide
taatacgactcactataggggtttatctttctttactttcggtgtggtacaacagaggagagtaccaatgcgaaagtaaaacctggcggcagcgcaaaagatg

SEQ ID NO: 102451 - DNA, 103 bp, Artificial Sequence
  Synthetic Polynucleotide
taatacgactcactatagggaagatgttctgtttatctttctttactttcaacagaggagagaaagtatggaaagataaaacctggcggcagcgcaaaagatg

SEQ ID NO: 102452 - DNA, 103 bp, Artificial Sequence
  Synthetic Polynucleotide
taatacgactcactatagggaaaaaattcaaagatgttctgtttatctttaacagaggagaaaagatatgcagaacatcaacctggcggcagcgcaaaagatg

SEQ ID NO: 102453 - DNA, 103 bp, Artificial Sequence
  Synthetic Polynucleotide
taatacgactcactatagggcttctactgcctcctcggggcgccaaggccaacagaggagaggccttatggccccgaggaacctggcggcagcgcaaaagatg

SEQ ID NO: 102454 - DNA, 103 bp, Artificial Sequence
  Synthetic Polynucleotide
taatacgactcactatagggtctgtctctcaaaaaattcaaagatgttctaacagaggagaagaacaatgttgaattttaacctggcggcagcgcaaaagatg

SEQ ID NO: 102455 - DNA, 103 bp, Artificial Sequence
  Synthetic Polynucleotide
taatacgactcactatagggagtaacaaagtctgtctctcaaaaaattcaaacagaggagatgaattatgtgagagacaaacctggcggcagcgcaaaagatg

SEQ ID NO: 102456 - DNA, 103 bp, Artificial Sequence
  Synthetic Polynucleotide
taatacgactcactatagggtccaggcctaagtaacaaagtctgtctctcaacagaggagagagagaatgactttgttaaacctggcggcagcgcaaaagatg

SEQ ID NO: 102457 - DNA, 103 bp, Artificial Sequence
  Synthetic Polynucleotide
taatacgactcactatagggaccatttgcctccaggcctaagtaacaaagaacagaggagactttgtatgttaggcctgaacctggcggcagcgcaaaagatg

SEQ ID NO: 102458 - DNA, 103 bp, Artificial Sequence
  Synthetic Polynucleotide
taatacgactcactatagggtccagatcataccatttgcctccaggcctaaacagaggagataggccatgaggcaaatgaacctggcggcagcgcaaaagatg

SEQ ID NO: 102459 - DNA, 103 bp, Artificial Sequence
  Synthetic Polynucleotide
taatacgactcactatagggattgctgtactccagatcataccatttgccaacagaggagaggcaaaatgtatgatctgaacctggcggcagcgcaaaagatg

SEQ ID NO: 102460 - DNA, 103 bp, Artificial Sequence
  Synthetic Polynucleotide
taatacgactcactatagggaagaatattcattgctgtactccagatcataacagaggagaatgatcatgagtacagcaaacctggcggcagcgcaaaagatg

SEQ ID NO: 102461 - DNA, 103 bp, Artificial Sequence
  Synthetic Polynucleotide
taatacgactcactatagggtggggtttcaaagaatattcattgctgtacaacagaggagagtacagatgtgaatattcaacctggcggcagcgcaaaagatg

SEQ ID NO: 102462 - DNA, 103 bp, Artificial Sequence
  Synthetic Polynucleotide
taatacgactcactatagggatcctgaggctggggtttcaaagaatattcaacagaggagagaatatatgttgaaacccaacctggcggcagcgcaaaagatg

SEQ ID NO: 102463 - DNA, 103 bp, Artificial Sequence
  Synthetic Polynucleotide
taatacgactcactatagggtagatacaacatcctgaggctggggtttcaaacagaggagatgaaacatgagcctcaggaacctggcggcagcgcaaaagatg

SEQ ID NO: 102464 - DNA, 103 bp, Artificial Sequence
  Synthetic Polynucleotide
taatacgactcactatagggtcgtccggatcttctactgcctcctcggggaacagaggagaccccgaatgggcagtagaaacctggcggcagcgcaaaagatg

SEQ ID NO: 102465 - DNA, 103 bp, Artificial Sequence
  Synthetic Polynucleotide
taatacgactcactataggggttttgtacttagatacaacatcctgaggcaacagaggagagcctcaatgtgttgtatcaacctggcggcagcgcaaaagatg

SEQ ID NO: 102466 - DNA, 103 bp, Artificial Sequence
  Synthetic Polynucleotide
taatacgactcactatagggctgagcaagggttttgtacttagatacaacaacagaggagagttgtaatgaagtacaaaaacctggcggcagcgcaaaagatg

SEQ ID NO: 102467 - DNA, 103 bp, Artificial Sequence
  Synthetic Polynucleotide
taatacgactcactataggggatacagcttctgagcaagggttttgtactaacagaggagaagtacaatgcccttgctcaacctggcggcagcgcaaaagatg

SEQ ID NO: 102468 - DNA, 103 bp, Artificial Sequence
  Synthetic Polynucleotide
taatacgactcactatagggatttcatgctgatacagcttctgagcaaggaacagaggagaccttgcatggaagctgtaaacctggcggcagcgcaaaagatg

SEQ ID NO: 102469 - DNA, 103 bp, Artificial Sequence
  Synthetic Polynucleotide
taatacgactcactataggggaataagttgatttcatgctgatacagcttaacagaggagaaagctgatgcagcatgaaaacctggcggcagcgcaaaagatg

SEQ ID NO: 102470 - DNA, 103 bp, Artificial Sequence
  Synthetic Polynucleotide
taatacgactcactatagggtcttacttttgaataagttgatttcatgctaacagaggagaagcatgatgtcaacttataacctggcggcagcgcaaaagatg

SEQ ID NO: 102471 - DNA, 103 bp, Artificial Sequence
  Synthetic Polynucleotide
taatacgactcactatagggtgactattcgtcttacttttgaataagttgaacagaggagacaacttatgcaaaagtaaaacctggcggcagcgcaaaagatg

SEQ ID NO: 102472 - DNA, 103 bp, Artificial Sequence
  Synthetic Polynucleotide
taatacgactcactatagggggctcccttttgactattcgtcttacttttaacagaggagaaaaagtatgacgaatagtaacctggcggcagcgcaaaagatg

SEQ ID NO: 102473 - DNA, 103 bp, Artificial Sequence
  Synthetic Polynucleotide
taatacgactcactatagggaggtagaagaggctcccttttgactattcgaacagaggagacgaataatgaaaagggagaacctggcggcagcgcaaaagatg

SEQ ID NO: 102474 - DNA, 103 bp, Artificial Sequence
  Synthetic Polynucleotide
taatacgactcactataggggccttcatccaggtagaagaggctccctttaacagaggagaaaagggatgctcttctacaacctggcggcagcgcaaaagatg

SEQ ID NO: 102475 - DNA, 103 bp, Artificial Sequence
  Synthetic Polynucleotide
taatacgactcactatagggctcatcctcctcgtccggatcttctactgcaacagaggagagcagtaatggatccggacaacctggcggcagcgcaaaagatg

SEQ ID NO: 102476 - DNA, 103 bp, Artificial Sequence
  Synthetic Polynucleotide
taatacgactcactatagggtgacacaattgccttcatccaggtagaagaaacagaggagatcttctatgtggatgaagaacctggcggcagcgcaaaagatg

SEQ ID NO: 102477 - DNA, 103 bp, Artificial Sequence
  Synthetic Polynucleotide
taatacgactcactataggggtgtccccgatgacacaattgccttcatccaacagaggagaggatgaatgcaattgtgtaacctggcggcagcgcaaaagatg

SEQ ID NO: 102478 - DNA, 103 bp, Artificial Sequence
  Synthetic Polynucleotide
taatacgactcactatagggctgtcacctagtgtccccgatgacacaattaacagaggagaaattgtatgatcggggacaacctggcggcagcgcaaaagatg

SEQ ID NO: 102479 - DNA, 103 bp, Artificial Sequence
  Synthetic Polynucleotide
taatacgactcactatagggggctgccatcctgtcacctagtgtccccgaaacagaggagatcggggatgctaggtgacaacctggcggcagcgcaaaagatg

SEQ ID NO: 102480 - DNA, 103 bp, Artificial Sequence
  Synthetic Polynucleotide
taatacgactcactataggggaagaatcatggctgccatcctgtcacctaaacagaggagataggtgatgggatggcagaacctggcggcagcgcaaaagatg

SEQ ID NO: 102481 - DNA, 103 bp, Artificial Sequence
  Synthetic Polynucleotide
taatacgactcactatagggtcctgaataagaagaatcatggctgccatcaacagaggagagatggcatgcatgattctaacctggcggcagcgcaaaagatg

SEQ ID NO: 102482 - DNA, 103 bp, Artificial Sequence
  Synthetic Polynucleotide
taatacgactcactatagggaacggcatcatcctgaataagaagaatcataacagaggagaatgattatgcttattcagaacctggcggcagcgcaaaagatg

SEQ ID NO: 102483 - DNA, 103 bp, Artificial Sequence
  Synthetic Polynucleotide
taatacgactcactataggggaagtgtgtgaacggcatcatcctgaataaaacagaggagattattcatgatgatgccgaacctggcggcagcgcaaaagatg

SEQ ID NO: 102484 - DNA, 103 bp, Artificial Sequence
  Synthetic Polynucleotide
taatacgactcactatagggtctacaaactgaagtgtgtgaacggcatcaaacagaggagatgatgcatgtcacacactaacctggcggcagcgcaaaagatg

SEQ ID NO: 102485 - DNA, 103 bp, Artificial Sequence
  Synthetic Polynucleotide
taatacgactcactatagggcacaagagtttctacaaactgaagtgtgtgaacagaggagacacacaatgcagtttgtaaacctggcggcagcgcaaaagatg

SEQ ID NO: 102486 - DNA, 103 bp, Artificial Sequence
  Synthetic Polynucleotide
taatacgactcactatagggtagtattatcctcatcctcctcgtccggataacagaggagaatccggatgaggaggatgaacctggcggcagcgcaaaagatg

SEQ ID NO: 102487 - DNA, 103 bp, Artificial Sequence
  Synthetic Polynucleotide
taatacgactcactatagggtaacaaggttcacaagagtttctacaaactaacagaggagaagtttgatgaaactcttgaacctggcggcagcgcaaaagatg

SEQ ID NO: 102488 - DNA, 103 bp, Artificial Sequence
  Synthetic Polynucleotide
taatacgactcactatagggcccttctttttaacaaggttcacaagagttaacagaggagaaactctatggaaccttgtaacctggcggcagcgcaaaagatg

SEQ ID NO: 102489 - DNA, 103 bp, Artificial Sequence
  Synthetic Polynucleotide
taatacgactcactatagggctgtttgctgcccttctttttaacaaggttaacagaggagaaaccttatgaaaaagaagaacctggcggcagcgcaaaagatg

SEQ ID NO: 102490 - DNA, 103 bp, Artificial Sequence
  Synthetic Polynucleotide
taatacgactcactatagggtaaggcactgctgtttgctgcccttcttttaacagaggagaaaaagaatggcagcaaacaacctggcggcagcgcaaaagatg

SEQ ID NO: 102491 - DNA, 103 bp, Artificial Sequence
  Synthetic Polynucleotide
taatacgactcactatagggtccaaggccataaggcactgctgtttgctgaacagaggagacagcaaatggcagtgcctaacctggcggcagcgcaaaagatg

SEQ ID NO: 102492 - DNA, 103 bp, Artificial Sequence
  Synthetic Polynucleotide
taatacgactcactatagggtttgaaagtatccaaggccataaggcactgaacagaggagacagtgcatgatggccttgaacctggcggcagcgcaaaagatg

SEQ ID NO: 102493 - DNA, 103 bp, Artificial Sequence
  Synthetic Polynucleotide
taatacgactcactatagggtaagcaactctttgaaagtatccaaggccaaacagaggagatggcctatgatactttcaaacctggcggcagcgcaaaagatg

SEQ ID NO: 102494 - DNA, 103 bp, Artificial Sequence
  Synthetic Polynucleotide
taatacgactcactatagggaggtctgtgataagcaactctttgaaagtaaacagaggagatactttatgagagttgctaacctggcggcagcgcaaaagatg

SEQ ID NO: 102495 - DNA, 103 bp, Artificial Sequence
  Synthetic Polynucleotide
taatacgactcactataggggtctggcaaaaggtctgtgataagcaactcaacagaggagagagttgatgatcacagacaacctggcggcagcgcaaaagatg

SEQ ID NO: 102496 - DNA, 103 bp, Artificial Sequence
  Synthetic Polynucleotide
taatacgactcactataggggcttccgattgtctggcaaaaggtctgtgaaacagaggagatcacagatgttttgccagaacctggcggcagcgcaaaagatg

SEQ ID NO: 102497 - DNA, 103 bp, Artificial Sequence
  Synthetic Polynucleotide
taatacgactcactatagggtcggcttcactagtattatcctcatcctccaacagaggagaggaggaatgggataatacaacctggcggcagcgcaaaagatg

SEQ ID NO: 102498 - DNA, 103 bp, Artificial Sequence
  Synthetic Polynucleotide
taatacgactcactatagggaaaatcctcagcttccgattgtctggcaaaaacagaggagatttgccatgcaatcggaaaacctggcggcagcgcaaaagatg

SEQ ID NO: 102499 - DNA, 103 bp, Artificial Sequence
  Synthetic Polynucleotide
taatacgactcactatagggacgctggctgaaaatcctcagcttccgattaacagaggagaaatcggatgctgaggattaacctggcggcagcgcaaaagatg

SEQ ID NO: 102500 - DNA, 103 bp, Artificial Sequence
  Synthetic Polynucleotide
taatacgactcactatagggtgtcaaaaggacgctggctgaaaatcctcaaacagaggagatgaggaatgtcagccagcaacctggcggcagcgcaaaagatg

SEQ ID NO: 102501 - DNA, 103 bp, Artificial Sequence
  Synthetic Polynucleotide
taatacgactcactatagggtgttccagtttgtcaaaaggacgctggctgaacagaggagacagccaatgtccttttgaaacctggcggcagcgcaaaagatg

SEQ ID NO: 102502 - DNA, 103 bp, Artificial Sequence
  Synthetic Polynucleotide
taatacgactcactatagggactggacaactgttccagtttgtcaaaaggaacagaggagaccttttatgaaactggaaaacctggcggcagcgcaaaagatg

SEQ ID NO: 102503 - DNA, 103 bp, Artificial Sequence
  Synthetic Polynucleotide
taatacgactcactatagggccttgttgccactggacaactgttccagttaacagaggagaaactggatgagttgtccaaacctggcggcagcgcaaaagatg

SEQ ID NO: 102504 - DNA, 103 bp, Artificial Sequence
  Synthetic Polynucleotide
taatacgactcactatagggtctcttgagtccttgttgccactggacaacaacagaggagagttgtcatgtggcaacaaaacctggcggcagcgcaaaagatg

SEQ ID NO: 102505 - DNA, 103 bp, Artificial Sequence
  Synthetic Polynucleotide
taatacgactcactatagggcagtcttctatctcttgagtccttgttgccaacagaggagaggcaacatggactcaagaaacctggcggcagcgcaaaagatg

SEQ ID NO: 102506 - DNA, 103 bp, Artificial Sequence
  Synthetic Polynucleotide
taatacgactcactatagggaccataatatcagtcttctatctcttgagtaacagaggagaactcaaatgatagaagacaacctggcggcagcgcaaaagatg

SEQ ID NO: 102507 - DNA, 103 bp, Artificial Sequence
  Synthetic Polynucleotide
taatacgactcactatagggtgttcaaaataccataatatcagtcttctaaacagaggagatagaagatggatattatgaacctggcggcagcgcaaaagatg

SEQ ID NO: 102508 - DNA, 103 bp, Artificial Sequence
  Synthetic Polynucleotide
taatacgactcactatagggaggtggtgctgttactacaaatcgctccataacagaggagaatggagatgtttgtagtaaacctggcggcagcgcaaaagatg

SEQ ID NO: 102509 - DNA, 103 bp, Artificial Sequence
  Synthetic Polynucleotide
taatacgactcactatagggttttcctccatcttcatgcagctcacctccaacagaggagaggaggtatgctgcatgaaaacctggcggcagcgcaaaagatg

SEQ ID NO: 102510 - DNA, 103 bp, Artificial Sequence
  Synthetic Polynucleotide
taatacgactcactatagggtgcagaagagttttcctccatcttcatgcaaacagaggagatgcatgatgatggaggaaaacctggcggcagcgcaaaagatg

SEQ ID NO: 102511 - DNA, 103 bp, Artificial Sequence
  Synthetic Polynucleotide
taatacgactcactatagggttgcaagaagtgcagaagagttttcctccaaacagaggagatggaggatgactcttctgaacctggcggcagcgcaaaagatg

SEQ ID NO: 102512 - DNA, 103 bp, Artificial Sequence
  Synthetic Polynucleotide
taatacgactcactatagggcagaaccacattgcaagaagtgcagaagagaacagaggagactcttcatgacttcttgcaacctggcggcagcgcaaaagatg

SEQ ID NO: 102513 - DNA, 103 bp, Artificial Sequence
  Synthetic Polynucleotide
taatacgactcactataggggaacatgattcagaaccacattgcaagaagaacagaggagacttcttatgatgtggttcaacctggcggcagcgcaaaagatg

SEQ ID NO: 102514 - DNA, 103 bp, Artificial Sequence
  Synthetic Polynucleotide
taatacgactcactataggggcagacttgcgaacatgattcagaaccacaaacagaggagatgtggtatggaatcatgtaacctggcggcagcgcaaaagatg

SEQ ID NO: 102515 - DNA, 103 bp, Artificial Sequence
  Synthetic Polynucleotide
taatacgactcactataggggtcactaatggcagacttgcgaacatgattaacagaggagaaatcatatgcgcaagtctaacctggcggcagcgcaaaagatg

SEQ ID NO: 102516 - DNA, 103 bp, Artificial Sequence
  Synthetic Polynucleotide
taatacgactcactatagggacttgaggtggtcactaatggcagacttgcaacagaggagagcaagtatgccattagtgaacctggcggcagcgcaaaagatg

SEQ ID NO: 102517 - DNA, 103 bp, Artificial Sequence
  Synthetic Polynucleotide
taatacgactcactatagggtgagtctttgacttgaggtggtcactaatgaacagaggagacattagatgccacctcaaaacctggcggcagcgcaaaagatg

SEQ ID NO: 102518 - DNA, 103 bp, Artificial Sequence
  Synthetic Polynucleotide
taatacgactcactatagggcctcttggtatgagtctttgacttgaggtgaacagaggagacacctcatgtcaaagactaacctggcggcagcgcaaaagatg

SEQ ID NO: 102519 - DNA, 103 bp, Artificial Sequence
  Synthetic Polynucleotide
taatacgactcactatagggggtttcgagcaggtggtgctgttactacaaaacagaggagattgtagatgcagcaccacaacctggcggcagcgcaaaagatg

SEQ ID NO: 102520 - DNA, 103 bp, Artificial Sequence
  Synthetic Polynucleotide
taatacgactcactatagggattctgccttcctcttggtatgagtctttgaacagaggagacaaagaatgataccaagaaacctggcggcagcgcaaaagatg

SEQ ID NO: 102521 - DNA, 103 bp, Artificial Sequence
  Synthetic Polynucleotide
taatacgactcactatagggtgctcttcaaattctgccttcctcttggtaaacagaggagataccaaatggaaggcagaaacctggcggcagcgcaaaagatg

SEQ ID NO: 102522 - DNA, 103 bp, Artificial Sequence
  Synthetic Polynucleotide
taatacgactcactatagggtctcacattctgctcttcaaattctgccttaacagaggagaaaggcaatgtttgaagagaacctggcggcagcgcaaaagatg

SEQ ID NO: 102523 - DNA, 103 bp, Artificial Sequence
  Synthetic Polynucleotide
taatacgactcactatagggtctgcttctttctcacattctgctcttcaaaacagaggagattgaagatgagaatgtgaaacctggcggcagcgcaaaagatg

SEQ ID NO: 102524 - DNA, 103 bp, Artificial Sequence
  Synthetic Polynucleotide
taatacgactcactataggggttaggggcctctgcttctttctcacattcaacagaggagagaatgtatgaaagaagcaaacctggcggcagcgcaaaagatg

SEQ ID NO: 102525 - DNA, 103 bp, Artificial Sequence
  Synthetic Polynucleotide
taatacgactcactatagggaagagatgcagttaggggcctctgcttcttaacagaggagaaagaagatgaggcccctaaacctggcggcagcgcaaaagatg

SEQ ID NO: 102526 - DNA, 103 bp, Artificial Sequence
  Synthetic Polynucleotide
taatacgactcactatagggtgttgcactgaagagatgcagttaggggccaacagaggagaggccccatgctgcatctcaacctggcggcagcgcaaaagatg

SEQ ID NO: 102527 - DNA, 103 bp, Artificial Sequence
  Synthetic Polynucleotide
taatacgactcactatagggtgcgcagtactgttgcactgaagagatgcaaacagaggagatgcatcatgtcagtgcaaaacctggcggcagcgcaaaagatg

SEQ ID NO: 102528 - DNA, 103 bp, Artificial Sequence
  Synthetic Polynucleotide
taatacgactcactatagggtttctctgtttgcgcagtactgttgcactgaacagaggagacagtgcatgagtactgcgaacctggcggcagcgcaaaagatg

SEQ ID NO: 102529 - DNA, 103 bp, Artificial Sequence
  Synthetic Polynucleotide
taatacgactcactatagggtaacactgactttctctgtttgcgcagtacaacagaggagagtactgatgaaacagagaaacctggcggcagcgcaaaagatg

SEQ ID NO: 102530 - DNA, 103 bp, Artificial Sequence
  Synthetic Polynucleotide
taatacgactcactataggggtcttagaacggtttcgagcaggtggtgctaacagaggagaagcaccatgtgctcgaaaaacctggcggcagcgcaaaagatg

SEQ ID NO: 102531 - DNA, 103 bp, Artificial Sequence
  Synthetic Polynucleotide
taatacgactcactatagggaagtcctggataacactgactttctctgttaacagaggagaaacagaatgagtcagtgtaacctggcggcagcgcaaaagatg

SEQ ID NO: 102532 - DNA, 103 bp, Artificial Sequence
  Synthetic Polynucleotide
taatacgactcactatagggcattttcacaaagtcctggataacactgacaacagaggagagtcagtatgatccaggacaacctggcggcagcgcaaaagatg

SEQ ID NO: 102533 - DNA, 103 bp, Artificial Sequence
  Synthetic Polynucleotide
taatacgactcactatagggcttccaggcacattttcacaaagtcctggaaacagaggagatccaggatgttgtgaaaaaacctggcggcagcgcaaaagatg

SEQ ID NO: 102534 - DNA, 103 bp, Artificial Sequence
  Synthetic Polynucleotide
taatacgactcactataggggggatgttggcttccaggcacattttcacaaacagaggagatgtgaaatggtgcctggaaacctggcggcagcgcaaaagatg

SEQ ID NO: 102535 - DNA, 103 bp, Artificial Sequence
  Synthetic Polynucleotide
taatacgactcactatagggcttctcaagtgggatgttggcttccaggcaaacagaggagatgcctgatggccaacatcaacctggcggcagcgcaaaagatg

SEQ ID NO: 102536 - DNA, 103 bp, Artificial Sequence
  Synthetic Polynucleotide
taatacgactcactatagggggtgatcagccttctcaagtgggatgttggaacagaggagaccaacaatgcacttgagaaacctggcggcagcgcaaaagatg

SEQ ID NO: 102537 - DNA, 103 bp, Artificial Sequence
  Synthetic Polynucleotide
taatacgactcactatagggcggactgctgggtgatcagccttctcaagtaacagaggagaacttgaatgggctgatcaaacctggcggcagcgcaaaagatg

SEQ ID NO: 102538 - DNA, 103 bp, Artificial Sequence
  Synthetic Polynucleotide
taatacgactcactatagggtaggaaagcacggactgctgggtgatcagcaacagaggagagctgatatgccagcagtcaacctggcggcagcgcaaaagatg

SEQ ID NO: 102539 - DNA, 103 bp, Artificial Sequence
  Synthetic Polynucleotide
taatacgactcactatagggcatggcgagataggaaagcacggactgctgaacagaggagacagcagatggtgctttccaacctggcggcagcgcaaaagatg

SEQ ID NO: 102540 - DNA, 103 bp, Artificial Sequence
  Synthetic Polynucleotide
taatacgactcactatagggccattcttcacatggcgagataggaaagcaaacagaggagatgctttatgatctcgccaaacctggcggcagcgcaaaagatg

SEQ ID NO: 102541 - DNA, 103 bp, Artificial Sequence
  Synthetic Polynucleotide
taatacgactcactatagggatacaaagcagtcttagaacggtttcgagcaacagaggagagctcgaatgcgttctaagaacctggcggcagcgcaaaagatg

SEQ ID NO: 102542 - DNA, 103 bp, Artificial Sequence
  Synthetic Polynucleotide
taatacgactcactatagggtatggagcctccattcttcacatggcgagaaacagaggagatctcgcatggtgaagaataacctggcggcagcgcaaaagatg

SEQ ID NO: 102543 - DNA, 103 bp, Artificial Sequence
  Synthetic Polynucleotide
taatacgactcactatagggctgacttaggtatggagcctccattcttcaaacagaggagatgaagaatggaggctccaaacctggcggcagcgcaaaagatg

SEQ ID NO: 102544 - DNA, 103 bp, Artificial Sequence
  Synthetic Polynucleotide
taatacgactcactatagggcgtagctggtctgacttaggtatggagcctaacagaggagaaggctcatgacctaagtcaacctggcggcagcgcaaaagatg

SEQ ID NO: 102545 - DNA, 103 bp, Artificial Sequence
  Synthetic Polynucleotide
taatacgactcactatagggatatgccctccgtagctggtctgacttaggaacagaggagacctaagatggaccagctaaacctggcggcagcgcaaaagatg

SEQ ID NO: 102546 - DNA, 103 bp, Artificial Sequence
  Synthetic Polynucleotide
taatacgactcactatagggcatcaggaagatatgccctccgtagctggtaacagaggagaaccagcatgggagggcataacctggcggcagcgcaaaagatg

SEQ ID NO: 102547 - DNA, 103 bp, Artificial Sequence
  Synthetic Polynucleotide
taatacgactcactatagggttctcatatccatcaggaagatatgccctcaacagaggagagagggcatgtcttcctgaaacctggcggcagcgcaaaagatg

SEQ ID NO: 102548 - DNA, 103 bp, Artificial Sequence
  Synthetic Polynucleotide
taatacgactcactatagggttgattctcattctcatatccatcaggaagaacagaggagacttcctatgggatatgagaacctggcggcagcgcaaaagatg

SEQ ID NO: 102549 - DNA, 103 bp, Artificial Sequence
  Synthetic Polynucleotide
taatacgactcactatagggagttgaggagttgattctcattctcatatcaacagaggagagatatgatgatgagaatcaacctggcggcagcgcaaaagatg

SEQ ID NO: 102550 - DNA, 103 bp, Artificial Sequence
  Synthetic Polynucleotide
taatacgactcactatagggcaatcttgtgagttgaggagttgattctcaaacagaggagatgagaaatgactcctcaaaacctggcggcagcgcaaaagatg

SEQ ID NO: 102551 - DNA, 103 bp, Artificial Sequence
  Synthetic Polynucleotide
taatacgactcactatagggggggagtcacatacaaagcagtcttagaacaacagaggagagttctaatgctgctttgtaacctggcggcagcgcaaaagatg

SEQ ID NO: 102552 - DNA, 103 bp, Artificial Sequence
  Synthetic Polynucleotide
taatacgactcactatagggactcgatccaggggagtcacatacaaagcaaacagaggagatgctttatgtgtgactccaacctggcggcagcgcaaaagatg

SEQ ID NO: 102553 - DNA, 103 bp, Artificial Sequence
  Synthetic Polynucleotide
taatacgactcactatagggaaactcagtgactcgatccaggggagtcacaacagaggagagtgactatgctggatcgaaacctggcggcagcgcaaaagatg

SEQ ID NO: 102554 - DNA, 103 bp, Artificial Sequence
  Synthetic Polynucleotide
taatacgactcactataggggctcacctccaaactcagtgactcgatccaaacagaggagatggatcatgtcactgagtaacctggcggcagcgcaaaagatg

SEQ ID NO: 102555 - DNA, 103 bp, Artificial Sequence
  Synthetic Polynucleotide
taatacgactcactatagggtcttcatgcagctcacctccaaactcagtgaacagaggagacactgaatgtggaggtgaaacctggcggcagcgcaaaagatg

SEQ ID NO: 102556 - DNA, 103 bp, Artificial Sequence
  Synthetic Polynucleotide
taatacgactcactatagggctcttggcttttgtccttatttctcatcataacagaggagaatgatgatgaataaggacaacctggcggcagcgcaaaagatg

SEQ ID NO: 102557 - DNA, 103 bp, Artificial Sequence
  Synthetic Polynucleotide
taatacgactcactatagggctcactttccgactgactgcctgagtctgaaacagaggagatcagacatgggcagtcagaacctggcggcagcgcaaaagatg

SEQ ID NO: 102558 - DNA, 103 bp, Artificial Sequence
  Synthetic Polynucleotide
taatacgactcactataggggttctctagtttttttaggcccttcactttaacagaggagaaaagtgatgggcctaaaaaacctggcggcagcgcaaaagatg

SEQ ID NO: 102559 - DNA, 103 bp, Artificial Sequence
  Synthetic Polynucleotide
taatacgactcactatagggttttcttgaagttctctagtttttttaggcaacagaggagagcctaaatgaactagagaaacctggcggcagcgcaaaagatg

SEQ ID NO: 102560 - DNA, 103 bp, Artificial Sequence
  Synthetic Polynucleotide
taatacgactcactatagggtcgtcctcttttttcttgaagttctctagtaacagaggagaactagaatgcttcaagaaaacctggcggcagcgcaaaagatg

SEQ ID NO: 102561 - DNA, 103 bp, Artificial Sequence
  Synthetic Polynucleotide
taatacgactcactatagggttgtttgatttcgtcctcttttttcttgaaaacagaggagattcaagatgaaagaggacaacctggcggcagcgcaaaagatg

SEQ ID NO: 102562 - DNA, 103 bp, Artificial Sequence
  Synthetic Polynucleotide
taatacgactcactatagggtccctaaccattgtttgatttcgtcctcttaacagaggagaaagaggatgaaatcaaacaacctggcggcagcgcaaaagatg

SEQ ID NO: 102563 - DNA, 103 bp, Artificial Sequence
  Synthetic Polynucleotide
taatacgactcactatagggggagaaactttccctaaccattgtttgattaacagaggagaaatcaaatgatggttaggaacctggcggcagcgcaaaagatg

SEQ ID NO: 102564 - DNA, 103 bp, Artificial Sequence
  Synthetic Polynucleotide
taatacgactcactatagggtacatcttcaggagaaactttccctaaccaaacagaggagatggttaatgaaagtttctaacctggcggcagcgcaaaagatg

SEQ ID NO: 102565 - DNA, 103 bp, Artificial Sequence
  Synthetic Polynucleotide
taatacgactcactatagggtgaaatattctacatcttcaggagaaacttaacagaggagaaagtttatgctgaagatgaacctggcggcagcgcaaaagatg

SEQ ID NO: 102566 - DNA, 103 bp, Artificial Sequence
  Synthetic Polynucleotide
taatacgactcactatagggtgttggcaattgaaatattctacatcttcaaacagaggagatgaagaatgagaatatttaacctggcggcagcgcaaaagatg

SEQ ID NO: 102567 - DNA, 103 bp, Artificial Sequence
  Synthetic Polynucleotide
taatacgactcactatagggagccagctcctgttggcaattgaaatattcaacagaggagagaatatatgaattgccaaaacctggcggcagcgcaaaagatg

SEQ ID NO: 102568 - DNA, 103 bp, Artificial Sequence
  Synthetic Polynucleotide
taatacgactcactatagggcacttccctgctcactttccgactgactgcaacagaggagagcagtcatgcggaaagtgaacctggcggcagcgcaaaagatg

SEQ ID NO: 102569 - DNA, 103 bp, Artificial Sequence
  Synthetic Polynucleotide
taatacgactcactatagggtcaactctgaagccagctcctgttggcaataacagaggagaattgccatgaggagctggaacctggcggcagcgcaaaagatg

SEQ ID NO: 102570 - DNA, 103 bp, Artificial Sequence
  Synthetic Polynucleotide
taatacgactcactatagggtactgtttattcaactctgaagccagctccaacagaggagaggagctatgttcagagttaacctggcggcagcgcaaaagatg

SEQ ID NO: 102571 - DNA, 103 bp, Artificial Sequence
  Synthetic Polynucleotide
taatacgactcactatagggtactatctgatactgtttattcaactctgaaacagaggagatcagagatgaataaacagaacctggcggcagcgcaaaagatg

SEQ ID NO: 102572 - DNA, 103 bp, Artificial Sequence
  Synthetic Polynucleotide
taatacgactcactatagggttactctttctactatctgatactgtttataacagaggagaataaacatgatcagatagaacctggcggcagcgcaaaagatg

SEQ ID NO: 102573 - DNA, 103 bp, Artificial Sequence
  Synthetic Polynucleotide
taatacgactcactatagggttcacagctattactctttctactatctgaaacagaggagatcagatatgagaaagagtaacctggcggcagcgcaaaagatg

SEQ ID NO: 102574 - DNA, 103 bp, Artificial Sequence
  Synthetic Polynucleotide
taatacgactcactatagggtttacttgtcttcacagctattactctttcaacagaggagagaaagaatgatagctgtgaacctggcggcagcgcaaaagatg

SEQ ID NO: 102575 - DNA, 103 bp, Artificial Sequence
  Synthetic Polynucleotide
taatacgactcactatagggccaatgtagatttacttgtcttcacagctaaacagaggagatagctgatgagacaagtaaacctggcggcagcgcaaaagatg

SEQ ID NO: 102576 - DNA, 103 bp, Artificial Sequence
  Synthetic Polynucleotide
taatacgactcactatagggtctgtttgacccaatgtagatttacttgtcaacagaggagagacaagatgatctacattaacctggcggcagcgcaaaagatg

SEQ ID NO: 102577 - DNA, 103 bp, Artificial Sequence
  Synthetic Polynucleotide
taatacgactcactatagggagctggaaaatctgtttgacccaatgtagaaacagaggagatctacaatgggtcaaacaaacctggcggcagcgcaaaagatg

SEQ ID NO: 102578 - DNA, 103 bp, Artificial Sequence
  Synthetic Polynucleotide
taatacgactcactatagggtccgactatgagctggaaaatctgtttgacaacagaggagagtcaaaatgattttccagaacctggcggcagcgcaaaagatg

SEQ ID NO: 102579 - DNA, 103 bp, Artificial Sequence
  Synthetic Polynucleotide
taatacgactcactatagggcttcctggatcacttccctgctcactttccaacagaggagaggaaagatggcagggaagaacctggcggcagcgcaaaagatg

SEQ ID NO: 102580 - DNA, 103 bp, Artificial Sequence
  Synthetic Polynucleotide
taatacgactcactatagggggtgccggcttccgactatgagctggaaaaaacagaggagattttccatgtcatagtcgaacctggcggcagcgcaaaagatg

SEQ ID NO: 102581 - DNA, 103 bp, Artificial Sequence
  Synthetic Polynucleotide
taatacgactcactatagggctcatttgagggtgccggcttccgactatgaacagaggagacatagtatgaagccggcaaacctggcggcagcgcaaaagatg

SEQ ID NO: 102582 - DNA, 103 bp, Artificial Sequence
  Synthetic Polynucleotide
taatacgactcactataggggatattcgggctcatttgagggtgccggctaacagaggagaagccggatgcctcaaatgaacctggcggcagcgcaaaagatg

SEQ ID NO: 102583 - DNA, 103 bp, Artificial Sequence
  Synthetic Polynucleotide
taatacgactcactatagggcatttacatagatattcgggctcatttgagaacagaggagactcaaaatggcccgaataaacctggcggcagcgcaaaagatg

SEQ ID NO: 102584 - DNA, 103 bp, Artificial Sequence
  Synthetic Polynucleotide
taatacgactcactataggggagtcccatccatttacatagatattcgggaacagaggagacccgaaatgctatgtaaaaacctggcggcagcgcaaaagatg

SEQ ID NO: 102585 - DNA, 103 bp, Artificial Sequence
  Synthetic Polynucleotide
taatacgactcactatagggctgaataggggagtcccatccatttacataaacagaggagatatgtaatgggatgggacaacctggcggcagcgcaaaagatg

SEQ ID NO: 102586 - DNA, 103 bp, Artificial Sequence
  Synthetic Polynucleotide
taatacgactcactatagggcagctacactctgaataggggagtcccatcaacagaggagagatgggatgcccctattcaacctggcggcagcgcaaaagatg

SEQ ID NO: 102587 - DNA, 103 bp, Artificial Sequence
  Synthetic Polynucleotide
taatacgactcactatagggttcatcttcccagctacactctgaatagggaacagaggagaccctatatggagtgtagcaacctggcggcagcgcaaaagatg

SEQ ID NO: 102588 - DNA, 103 bp, Artificial Sequence
  Synthetic Polynucleotide
taatacgactcactatagggcaatgagggcttcatcttcccagctacactaacagaggagaagtgtaatggggaagatgaacctggcggcagcgcaaaagatg

SEQ ID NO: 102589 - DNA, 103 bp, Artificial Sequence
  Synthetic Polynucleotide
taatacgactcactatagggaatttctttccaatgagggcttcatcttccaacagaggagaggaagaatgagccctcataacctggcggcagcgcaaaagatg

SEQ ID NO: 102590 - DNA, 103 bp, Artificial Sequence
  Synthetic Polynucleotide
taatacgactcactataggggccatgtccacttcctggatcacttccctgaacagaggagacagggaatggatccaggaaacctggcggcagcgcaaaagatg

SEQ ID NO: 102591 - DNA, 103 bp, Artificial Sequence
  Synthetic Polynucleotide
taatacgactcactataggggcaattctggaatttctttccaatgagggcaacagaggagagccctcatgggaaagaaaaacctggcggcagcgcaaaagatg

SEQ ID NO: 102592 - DNA, 103 bp, Artificial Sequence
  Synthetic Polynucleotide
taatacgactcactatagggagctgtcaatgcaattctggaatttctttcaacagaggagagaaagaatgtccagaattaacctggcggcagcgcaaaagatg

SEQ ID NO: 102593 - DNA, 103 bp, Artificial Sequence
  Synthetic Polynucleotide
taatacgactcactatagggctactgtggaagctgtcaatgcaattctggaacagaggagaccagaaatgcattgacagaacctggcggcagcgcaaaagatg

SEQ ID NO: 102594 - DNA, 103 bp, Artificial Sequence
  Synthetic Polynucleotide
taatacgactcactatagggtgagttgttcctactgtggaagctgtcaataacagaggagaattgacatgttccacagtaacctggcggcagcgcaaaagatg

SEQ ID NO: 102595 - DNA, 103 bp, Artificial Sequence
  Synthetic Polynucleotide
taatacgactcactatagggggatggtttttgagttgttcctactgtggaaacagaggagatccacaatgggaacaactaacctggcggcagcgcaaaagatg

SEQ ID NO: 102596 - DNA, 103 bp, Artificial Sequence
  Synthetic Polynucleotide
taatacgactcactatagggtctcttgttgggatggtttttgagttgttcaacagaggagagaacaaatgaaaaaccataacctggcggcagcgcaaaagatg

SEQ ID NO: 102597 - DNA, 103 bp, Artificial Sequence
  Synthetic Polynucleotide
taatacgactcactatagggggccttgcattctcttgttgggatggttttaacagaggagaaaaaccatgccaacaagaaacctggcggcagcgcaaaagatg

SEQ ID NO: 102598 - DNA, 103 bp, Artificial Sequence
  Synthetic Polynucleotide
taatacgactcactatagggtctgcttcagggccttgcattctcttgttgaacagaggagacaacaaatgaatgcaaggaacctggcggcagcgcaaaagatg

SEQ ID NO: 102599 - DNA, 103 bp, Artificial Sequence
  Synthetic Polynucleotide
taatacgactcactatagggaatcgtggtctctgcttcagggccttgcataacagaggagaatgcaaatgcctgaagcaaacctggcggcagcgcaaaagatg

SEQ ID NO: 102600 - DNA, 103 bp, Artificial Sequence
  Synthetic Polynucleotide
taatacgactcactatagggtaaagctacaaatcgtggtctctgcttcagaacagaggagactgaagatgagaccacgaaacctggcggcagcgcaaaagatg

SEQ ID NO: 102601 - DNA, 103 bp, Artificial Sequence
  Synthetic Polynucleotide
taatacgactcactatagggtcgactcgctgccatgtccacttcctggataacagaggagaatccagatggtggacatgaacctggcggcagcgcaaaagatg

SEQ ID NO: 102602 - DNA, 103 bp, Artificial Sequence
  Synthetic Polynucleotide
taatacgactcactataggggttgtttctttaaagctacaaatcgtggtcaacagaggagagaccacatgttgtagcttaacctggcggcagcgcaaaagatg

SEQ ID NO: 102603 - DNA, 103 bp, Artificial Sequence
  Synthetic Polynucleotide
taatacgactcactatagggaaatatgcaggttgtttctttaaagctacaaacagaggagatgtagcatgaaagaaacaaacctggcggcagcgcaaaagatg

SEQ ID NO: 102604 - DNA, 103 bp, Artificial Sequence
  Synthetic Polynucleotide
taatacgactcactatagggctcccctcctaaatatgcaggttgtttcttaacagaggagaaagaaaatgcctgcatataacctggcggcagcgcaaaagatg

SEQ ID NO: 102605 - DNA, 103 bp, Artificial Sequence
  Synthetic Polynucleotide
taatacgactcactataggggttccagattctcccctcctaaatatgcagaacagaggagactgcatatgtaggaggggaacctggcggcagcgcaaaagatg

SEQ ID NO: 102606 - DNA, 103 bp, Artificial Sequence
  Synthetic Polynucleotide
taatacgactcactatagggtaatctcgaagttccagattctcccctcctaacagaggagaaggaggatggaatctggaaacctggcggcagcgcaaaagatg

SEQ ID NO: 102607 - DNA, 103 bp, Artificial Sequence
  Synthetic Polynucleotide
taatacgactcactatagggttctagctgataatctcgaagttccagattaacagaggagaaatctgatgcttcgagataacctggcggcagcgcaaaagatg

SEQ ID NO: 102608 - DNA, 103 bp, Artificial Sequence
  Synthetic Polynucleotide
taatacgactcactatagggagtttagaccttctagctgataatctcgaaaacagaggagattcgagatgatcagctagaacctggcggcagcgcaaaagatg

SEQ ID NO: 102609 - DNA, 103 bp, Artificial Sequence
  Synthetic Polynucleotide
taatacgactcactatagggtgagctagccagtttagaccttctagctgaaacagaggagatcagctatgaggtctaaaaacctggcggcagcgcaaaagatg

SEQ ID NO: 102610 - DNA, 103 bp, Artificial Sequence
  Synthetic Polynucleotide
taatacgactcactataggggcaccaggaatgagctagccagtttagaccaacagaggagaggtctaatgtggctagctaacctggcggcagcgcaaaagatg

SEQ ID NO: 102611 - DNA, 103 bp, Artificial Sequence
  Synthetic Polynucleotide
taatacgactcactataggggagctgctgttcgactcgctgccatgtccaaacagaggagatggacaatgcagcgagtcaacctggcggcagcgcaaaagatg

SEQ ID NO: 102612 - DNA, 103 bp, Artificial Sequence
  Synthetic Polynucleotide
taatacgactcactatagggagaagattcagagctgctgttcgactcgctaacagaggagaagcgagatgaacagcagcaacctggcggcagcgcaaaagatg

SEQ ID NO: 102613 - DNA, 103 bp, Artificial Sequence
  Synthetic Polynucleotide
taatacgactcactatagggactgactctcagaagattcagagctgctgtaacagaggagaacagcaatgctgaatcttaacctggcggcagcgcaaaagatg

SEQ ID NO: 102614 - DNA, 103 bp, Artificial Sequence
  Synthetic Polynucleotide
taatacgactcactatagggtcagattccgactgactctcagaagattcaaacagaggagatgaatcatgtgagagtcaaacctggcggcagcgcaaaagatg

SEQ ID NO: 102615 - DNA, 103 bp, Artificial Sequence
  Synthetic Polynucleotide
taatacgactcactatagggtgattcgctctcagattccgactgactctcaacagaggagagagagtatgtcggaatctaacctggcggcagcgcaaaagatg

SEQ ID NO: 102616 - DNA, 103 bp, Artificial Sequence
  Synthetic Polynucleotide
taatacgactcactatagggaactgtcctcctcttggcttttgtccttataacagaggagaataaggatgaaagccaagaacctggcggcagcgcaaaagatg

SEQ ID NO: 102617 - DNA, 103 bp, Artificial Sequence
  Synthetic Polynucleotide
taatacgactcactatagggtggaacctgctgattcgctctcagattccgaacagaggagacggaatatgagagcgaataacctggcggcagcgcaaaagatg

SEQ ID NO: 102618 - DNA, 103 bp, Artificial Sequence
  Synthetic Polynucleotide
taatacgactcactatagggggctgggatttggaacctgctgattcgctcaacagaggagagagcgaatgagcaggttcaacctggcggcagcgcaaaagatg

SEQ ID NO: 102619 - DNA, 103 bp, Artificial Sequence
  Synthetic Polynucleotide
taatacgactcactatagggtgggaggactggctgggatttggaacctgcaacagaggagagcaggtatgaaatcccagaacctggcggcagcgcaaaagatg

SEQ ID NO: 102620 - DNA, 103 bp, Artificial Sequence
  Synthetic Polynucleotide
taatacgactcactatagggctttggcttctgggaggactggctgggattaacagaggagaaatcccatgcagtcctccaacctggcggcagcgcaaaagatg

SEQ ID NO: 102621 - DNA, 103 bp, Artificial Sequence
  Synthetic Polynucleotide
taatacgactcactataggggctggcttctctttggcttctgggaggactaacagaggagaagtcctatgagaagccaaaacctggcggcagcgcaaaagatg

SEQ ID NO: 102622 - DNA, 103 bp, Artificial Sequence
  Synthetic Polynucleotide
taatacgactcactatagggcttcttagaggctggcttctctttggcttcaacagaggagagaagccatggagaagccaaacctggcggcagcgcaaaagatg

SEQ ID NO: 102623 - DNA, 103 bp, Artificial Sequence
  Synthetic Polynucleotide
taatacgactcactatagggctatccgttccttcttagaggctggcttctaacagaggagaagaagcatgcctctaagaaacctggcggcagcgcaaaagatg

SEQ ID NO: 102624 - DNA, 103 bp, Artificial Sequence
  Synthetic Polynucleotide
taatacgactcactatagggttcacatcagctatccgttccttcttagagaacagaggagactctaaatgggaacggataacctggcggcagcgcaaaagatg

SEQ ID NO: 102625 - DNA, 103 bp, Artificial Sequence
  Synthetic Polynucleotide
taatacgactcactatagggccacatcttcttcacatcagctatccgttcaacagaggagagaacggatggctgatgtgaacctggcggcagcgcaaaagatg

SEQ ID NO: 102626 - DNA, 103 bp, Artificial Sequence
  Synthetic Polynucleotide
taatacgactcactataggggatattcttcccacatcttcttcacatcagaacagaggagactgatgatgagaagatgtaacctggcggcagcgcaaaagatg

SEQ ID NO: 102627 - DNA, 103 bp, Artificial Sequence
  Synthetic Polynucleotide
taatacgactcactatagggctgtgtagcgaactgtcctcctcttggcttaacagaggagaaagccaatgggaggacagaacctggcggcagcgcaaaagatg

SEQ ID NO: 102628 - DNA, 103 bp, Artificial Sequence
  Synthetic Polynucleotide
taatacgactcactatagggtaaacatcaggatattcttcccacatcttcaacagaggagagaagatatgggaagaataaacctggcggcagcgcaaaagatg

SEQ ID NO: 102629 - DNA, 103 bp, Artificial Sequence
  Synthetic Polynucleotide
taatacgactcactatagggcctgaccccataaacatcaggatattcttcaacagaggagagaagaaatgcctgatgttaacctggcggcagcgcaaaagatg

SEQ ID NO: 102630 - DNA, 103 bp, Artificial Sequence
  Synthetic Polynucleotide
taatacgactcactatagggggtttgaccgcctgaccccataaacatcagaacagaggagactgatgatgatggggtcaaacctggcggcagcgcaaaagatg

SEQ ID NO: 102631 - DNA, 103 bp, Artificial Sequence
  Synthetic Polynucleotide
taatacgactcactatagggtgtctgcttcggtttgaccgcctgaccccaaacagaggagatggggtatggcggtcaaaaacctggcggcagcgcaaaagatg

SEQ ID NO: 102632 - DNA, 103 bp, Artificial Sequence
  Synthetic Polynucleotide
taatacgactcactatagggcgatggttcttgtctgcttcggtttgaccgaacagaggagacggtcaatgcgaagcagaaacctggcggcagcgcaaaagatg

SEQ ID NO: 102633 - DNA, 103 bp, Artificial Sequence
  Synthetic Polynucleotide
taatacgactcactatagggtattaaatcgcgatggttcttgtctgcttcaacagaggagagaagcaatgaagaaccataacctggcggcagcgcaaaagatg

SEQ ID NO: 102634 - DNA, 103 bp, Artificial Sequence
  Synthetic Polynucleotide
taatacgactcactatagggtcttccttaatattaaatcgcgatggttctaacagaggagaagaaccatggcgatttaaaacctggcggcagcgcaaaagatg

SEQ ID NO: 102635 - DNA, 103 bp, Artificial Sequence
  Synthetic Polynucleotide
taatacgactcactataggggctacttgcctcttccttaatattaaatcgaacagaggagacgatttatgattaaggaaaacctggcggcagcgcaaaagatg

SEQ ID NO: 102636 - DNA, 103 bp, Artificial Sequence
  Synthetic Polynucleotide
taatacgactcactatagggtctcagacccgctacttgcctcttccttaaaacagaggagattaaggatgaggcaagtaaacctggcggcagcgcaaaagatg

SEQ ID NO: 102637 - DNA, 103 bp, Artificial Sequence
  Synthetic Polynucleotide
taatacgactcactataggggggctcccactctcagacccgctacttgccaacagaggagaggcaagatgcgggtctgaaacctggcggcagcgcaaaagatg

SEQ ID NO: 102638 - DNA, 103 bp, Artificial Sequence
  Synthetic Polynucleotide
taatacgactcactatagggcgatgcattgctgtgtagcgaactgtcctcaacagaggagagaggacatgtcgctacacaacctggcggcagcgcaaaagatg

SEQ ID NO: 102639 - DNA, 103 bp, Artificial Sequence
  Synthetic Polynucleotide
taatacgactcactatagggtcttctttttgggctcccactctcagacccaacagaggagagggtctatgagtgggagcaacctggcggcagcgcaaaagatg

SEQ ID NO: 102640 - DNA, 103 bp, Artificial Sequence
  Synthetic Polynucleotide
taatacgactcactataggggcctctggcctcttctttttgggctcccacaacagaggagagtgggaatgcaaaaagaaaacctggcggcagcgcaaaagatg

SEQ ID NO: 102641 - DNA, 103 bp, Artificial Sequence
  Synthetic Polynucleotide
taatacgactcactatagggtttttcagctgcctctggcctcttctttttaacagaggagaaaaaagatgaggccagagaacctggcggcagcgcaaaagatg

SEQ ID NO: 102642 - DNA, 103 bp, Artificial Sequence
  Synthetic Polynucleotide
taatacgactcactatagggtttttcttgttttttcagctgcctctggccaacagaggagaggccagatgcagctgaaaaacctggcggcagcgcaaaagatg

SEQ ID NO: 102643 - DNA, 103 bp, Artificial Sequence
  Synthetic Polynucleotide
taatacgactcactatagggcctgtttccatttttcttgttttttcagctaacagaggagaagctgaatgaacaagaaaaacctggcggcagcgcaaaagatg

SEQ ID NO: 102644 - DNA, 103 bp, Artificial Sequence
  Synthetic Polynucleotide
taatacgactcactatagggtctgagggttcctgtttccatttttcttgtaacagaggagaacaagaatgatggaaacaaacctggcggcagcgcaaaagatg

SEQ ID NO: 102645 - DNA, 103 bp, Artificial Sequence
  Synthetic Polynucleotide
taatacgactcactatagggctgttcatcttctgagggttcctgtttccaaacagaggagatggaaaatggaaccctcaaacctggcggcagcgcaaaagatg

SEQ ID NO: 102646 - DNA, 103 bp, Artificial Sequence
  Synthetic Polynucleotide
taatacgactcactatagggtgccttgttcctgttcatcttctgagggttaacagaggagaaaccctatgaagatgaacaacctggcggcagcgcaaaagatg

SEQ ID NO: 102647 - DNA, 103 bp, Artificial Sequence
  Synthetic Polynucleotide
taatacgactcactatagggtctgcactggtgccttgttcctgttcatctaacagaggagaagatgaatgggaacaaggaacctggcggcagcgcaaaagatg

SEQ ID NO: 102648 - DNA, 103 bp, Artificial Sequence
  Synthetic Polynucleotide
taatacgactcactatagggtggctcactctctgcactggtgccttgttcaacagaggagagaacaaatgaccagtgcaaacctggcggcagcgcaaaagatg

SEQ ID NO: 102649 - DNA, 103 bp, Artificial Sequence
  Synthetic Polynucleotide
taatacgactcactatagggctgagtgactcgatgcattgctgtgtagcgaacagaggagacgctacatggcaatgcataacctggcggcagcgcaaaagatg

SEQ ID NO: 102650 - DNA, 103 bp, Artificial Sequence
  Synthetic Polynucleotide
taatacgactcactatagggttttttgttctggctcactctctgcactggaacagaggagaccagtgatgagagtgagcaacctggcggcagcgcaaaagatg

SEQ ID NO: 102651 - DNA, 103 bp, Artificial Sequence
  Synthetic Polynucleotide
taatacgactcactataggggcttttacttttttttgttctggctcactcaacagaggagagagtgaatgagaacaaaaaacctggcggcagcgcaaaagatg

SEQ ID NO: 102652 - DNA, 103 bp, Artificial Sequence
  Synthetic Polynucleotide
taatacgactcactatagggaggtcttctggcttttacttttttttgttcaacagaggagagaacaaatgaaagtaaaaaacctggcggcagcgcaaaagatg

SEQ ID NO: 102653 - DNA, 103 bp, Artificial Sequence
  Synthetic Polynucleotide
taatacgactcactatagggttctggggacaggtcttctggcttttacttaacagaggagaaagtaaatgccagaagacaacctggcggcagcgcaaaagatg

SEQ ID NO: 102654 - DNA, 103 bp, Artificial Sequence
  Synthetic Polynucleotide
taatacgactcactatagggggcactgttcttctggggacaggtcttctgaacagaggagacagaagatgtgtccccagaacctggcggcagcgcaaaagatg

SEQ ID NO: 102655 - DNA, 103 bp, Artificial Sequence
  Synthetic Polynucleotide
taatacgactcactatagggacgaggtttgggcactgttcttctggggacaacagaggagagtccccatgagaacagtgaacctggcggcagcgcaaaagatg

SEQ ID NO: 102656 - DNA, 103 bp, Artificial Sequence
  Synthetic Polynucleotide
taatacgactcactataggggctttttaacacgaggtttgggcactgttcaacagaggagagaacagatgccaaacctcaacctggcggcagcgcaaaagatg

SEQ ID NO: 102657 - DNA, 103 bp, Artificial Sequence
  Synthetic Polynucleotide
taatacgactcactataggggtcttcggctgctttttaacacgaggtttgaacagaggagacaaaccatgtgttaaaaaaacctggcggcagcgcaaaagatg

SEQ ID NO: 102658 - DNA, 103 bp, Artificial Sequence
  Synthetic Polynucleotide
taatacgactcactatagggtccacgctgagtcttcggctgctttttaacaacagaggagagttaaaatgcagccgaagaacctggcggcagcgcaaaagatg

SEQ ID NO: 102659 - DNA, 103 bp, Artificial Sequence
  Synthetic Polynucleotide
taatacgactcactatagggtttttctctttccacgctgagtcttcggctaacagaggagaagccgaatgctcagcgtgaacctggcggcagcgcaaaagatg

SEQ ID NO: 102660 - DNA, 103 bp, Artificial Sequence
  Synthetic Polynucleotide
taatacgactcactatagggtcttcagaggctgagtgactcgatgcattgaacagaggagacaatgcatggagtcactcaacctggcggcagcgcaaaagatg

SEQ ID NO: 102661 - DNA, 103 bp, Artificial Sequence
  Synthetic Polynucleotide
taatacgactcactataggggaatcttgcttttttctctttccacgctgaaacagaggagatcagcgatgaaagagaaaaacctggcggcagcgcaaaagatg

SEQ ID NO: 102662 - DNA, 103 bp, Artificial Sequence
  Synthetic Polynucleotide
taatacgactcactatagggctcatcagaagaatcttgcttttttctcttaacagaggagaaagagaatgaagcaagataacctggcggcagcgcaaaagatg

SEQ ID NO: 102663 - DNA, 103 bp, Artificial Sequence
  Synthetic Polynucleotide
taatacgactcactatagggcatcatcatcctcatcagaagaatcttgctaacagaggagaagcaagatgcttctgatgaacctggcggcagcgcaaaagatg

SEQ ID NO: 102664 - DNA, 103 bp, Artificial Sequence
  Synthetic Polynucleotide
taatacgactcactataggggcttcgtcatcatcatcatcctcatcagaaaacagaggagattctgaatgggatgatgaaacctggcggcagcgcaaaagatg

SEQ ID NO: 102665 - DNA, 103 bp, Artificial Sequence
  Synthetic Polynucleotide
taatacgactcactatagggccttttgggagcttcgtcatcatcatcatcaacagaggagagatgatatggatgacgaaaacctggcggcagcgcaaaagatg

SEQ ID NO: 102666 - DNA, 103 bp, Artificial Sequence
  Synthetic Polynucleotide
taatacgactcactataggggacgagtctgccttttgggagcttcgtcataacagaggagaatgacgatgctcccaaaaaacctggcggcagcgcaaaagatg

SEQ ID NO: 102667 - DNA, 103 bp, Artificial Sequence
  Synthetic Polynucleotide
taatacgactcactataggggccgctcttcgacgagtctgccttttgggaaacagaggagatcccaaatggcagactcgaacctggcggcagcgcaaaagatg

SEQ ID NO: 102668 - DNA, 103 bp, Artificial Sequence
  Synthetic Polynucleotide
taatacgactcactatagggaacgtttttagccgctcttcgacgagtctgaacagaggagacagactatgcgaagagcgaacctggcggcagcgcaaaagatg

SEQ ID NO: 102669 - DNA, 103 bp, Artificial Sequence
  Synthetic Polynucleotide
taatacgactcactatagggctttgtaactaacgtttttagccgctcttcaacagaggagagaagagatgctaaaaacgaacctggcggcagcgcaaaagatg

SEQ ID NO: 102670 - DNA, 103 bp, Artificial Sequence
  Synthetic Polynucleotide
taatacgactcactatagggtcatcatcttctttgtaactaacgtttttaaacagaggagataaaaaatgtagttacaaaacctggcggcagcgcaaaagatg

SEQ ID NO: 102671 - DNA, 103 bp, Artificial Sequence
  Synthetic Polynucleotide
taatacgactcactatagggacccgaagcttcttcagaggctgagtgactaacagaggagaagtcacatggcctctgaaaacctggcggcagcgcaaaagatg

SEQ ID NO: 102672 - DNA, 103 bp, Artificial Sequence
  Synthetic Polynucleotide
taatacgactcactatagggagtctcaaagtcatcatcttctttgtaactaacagaggagaagttacatggaagatgataacctggcggcagcgcaaaagatg

SEQ ID NO: 102673 - DNA, 103 bp, Artificial Sequence
  Synthetic Polynucleotide
taatacgactcactatagggcatctgagtcagtctcaaagtcatcatcttaacagaggagaaagatgatgactttgagaaacctggcggcagcgcaaaagatg

SEQ ID NO: 102674 - DNA, 103 bp, Artificial Sequence
  Synthetic Polynucleotide
taatacgactcactatagggtcaatgagatcatctgagtcagtctcaaagaacagaggagactttgaatgtgactcagaaacctggcggcagcgcaaaagatg

SEQ ID NO: 102675 - DNA, 103 bp, Artificial Sequence
  Synthetic Polynucleotide
taatacgactcactatagggtccagtcatttcaatgagatcatctgagtcaacagaggagagactcaatggatctcattaacctggcggcagcgcaaaagatg

SEQ ID NO: 102676 - DNA, 103 bp, Artificial Sequence
  Synthetic Polynucleotide
taatacgactcactatagggcaactccttctccagtcatttcaatgagataacagaggagaatctcaatgaaatgactgaacctggcggcagcgcaaaagatg

SEQ ID NO: 102677 - DNA, 103 bp, Artificial Sequence
  Synthetic Polynucleotide
taatacgactcactatagggtgctgttcatcaactccttctccagtcattaacagaggagaaatgacatgagaaggagtaacctggcggcagcgcaaaagatg

SEQ ID NO: 102678 - DNA, 103 bp, Artificial Sequence
  Synthetic Polynucleotide
taatacgactcactatagggactattatcttgctgttcatcaactccttcaacagaggagagaaggaatggatgaacagaacctggcggcagcgcaaaagatg

SEQ ID NO: 102679 - DNA, 103 bp, Artificial Sequence
  Synthetic Polynucleotide
taatacgactcactatagggcaatagtttcactattatcttgctgttcataacagaggagaatgaacatgaagataataaacctggcggcagcgcaaaagatg

SEQ ID NO: 102680 - DNA, 103 bp, Artificial Sequence
  Synthetic Polynucleotide
taatacgactcactatagggaagaccttttcaatagtttcactattatctaacagaggagaagataaatgtgaaactataacctggcggcagcgcaaaagatg

SEQ ID NO: 102681 - DNA, 103 bp, Artificial Sequence
  Synthetic Polynucleotide
taatacgactcactatagggtcttgaatctaagaccttttcaatagtttcaacagaggagagaaactatggaaaaggtcaacctggcggcagcgcaaaagatg

SEQ ID NO: 102682 - DNA, 103 bp, Artificial Sequence
  Synthetic Polynucleotide
taatacgactcactatagggctgagtctgaacccgaagcttcttcagaggaacagaggagacctctgatgaagcttcggaacctggcggcagcgcaaaagatg

SEQ ID NO: 102683 - DNA, 103 bp, Artificial Sequence
  Synthetic Polynucleotide
taatacgactcactatagggtctttcccagtcttgaatctaagaccttttaacagaggagaaaaaggatgtagattcaaaacctggcggcagcgcaaaagatg

SEQ ID NO: 102684 - DNA, 103 bp, Artificial Sequence
  Synthetic Polynucleotide
taatacgactcactataggggtggctcctttctttcccagtcttgaatctaacagaggagaagattcatgactgggaaaaacctggcggcagcgcaaaagatg

SEQ ID NO: 102685 - DNA, 103 bp, Artificial Sequence
  Synthetic Polynucleotide
taatacgactcactatagggagatgctccagtggctcctttctttcccagaacagaggagactgggaatgaaaggagccaacctggcggcagcgcaaaagatg

SEQ ID NO: 102686 - DNA, 103 bp, Artificial Sequence
  Synthetic Polynucleotide
taatacgactcactatagggatacagtagtagatgctccagtggctccttaacagaggagaaaggagatgctggagcataacctggcggcagcgcaaaagatg

SEQ ID NO: 102687 - DNA, 103 bp, Artificial Sequence
  Synthetic Polynucleotide
taatacgactcactatagggtcaatcgcatatacagtagtagatgctccaaacagaggagatggagcatgtactactgtaacctggcggcagcgcaaaagatg

SEQ ID NO: 102688 - DNA, 103 bp, Artificial Sequence
  Synthetic Polynucleotide
taatacgactcactataggggccattagcttcaatcgcatatacagtagtaacagaggagaactactatgtatgcgattaacctggcggcagcgcaaaagatg

SEQ ID NO: 102689 - DNA, 103 bp, Artificial Sequence
  Synthetic Polynucleotide
taatacgactcactatagggcactagggtcgccattagcttcaatcgcataacagaggagaatgcgaatgaagctaatgaacctggcggcagcgcaaaagatg

SEQ ID NO: 102690 - DNA, 103 bp, Artificial Sequence
  Synthetic Polynucleotide
taatacgactcactatagggtcaaagtcaccactagggtcgccattagctaacagaggagaagctaaatgcgaccctagaacctggcggcagcgcaaaagatg

SEQ ID NO: 102691 - DNA, 103 bp, Artificial Sequence
  Synthetic Polynucleotide
taatacgactcactatagggcttttcagtgtcaaagtcaccactagggtcaacagaggagagaccctatgggtgactttaacctggcggcagcgcaaaagatg

SEQ ID NO: 102692 - DNA, 103 bp, Artificial Sequence
  Synthetic Polynucleotide
taatacgactcactatagggcaccttcatccttttcagtgtcaaagtcacaacagaggagagtgactatgacactgaaaaacctggcggcagcgcaaaagatg

SEQ ID NO: 102693 - DNA, 103 bp, Artificial Sequence
  Synthetic Polynucleotide
taatacgactcactataggggactgactgcctgagtctgaacccgaagctaacagaggagaagcttcatgttcagactcaacctggcggcagcgcaaaagatg

SEQ ID NO: 102694 - DNA, 103 bp, Artificial Sequence
  Synthetic Polynucleotide
taatacgactcactatagggtactggatttcaccttcatccttttcagtgaacagaggagacactgaatgggatgaaggaacctggcggcagcgcaaaagatg

SEQ ID NO: 102695 - DNA, 103 bp, Artificial Sequence
  Synthetic Polynucleotide
taatacgactcactatagggcttgatgaggtactggatttcaccttcatcaacagaggagagatgaaatggaaatccagaacctggcggcagcgcaaaagatg

SEQ ID NO: 102696 - DNA, 103 bp, Artificial Sequence
  Synthetic Polynucleotide
taatacgactcactatagggaacccttccacttgatgaggtactggatttaacagaggagaaaatccatgacctcatcaaacctggcggcagcgcaaaagatg

SEQ ID NO: 102697 - DNA, 103 bp, Artificial Sequence
  Synthetic Polynucleotide
taatacgactcactatagggatgtaagaccaacccttccacttgatgaggaacagaggagacctcatatggtggaagggaacctggcggcagcgcaaaagatg

SEQ ID NO: 102698 - DNA, 103 bp, Artificial Sequence
  Synthetic Polynucleotide
taatacgactcactatagggtgtgctgtggatgtaagaccaacccttccaaacagaggagatggaagatgtggtcttacaacctggcggcagcgcaaaagatg

SEQ ID NO: 102699 - DNA, 103 bp, Artificial Sequence
  Synthetic Polynucleotide
taatacgactcactatagggcactctcccatgtgctgtggatgtaagaccaacagaggagaggtcttatgtccacagcaaacctggcggcagcgcaaaagatg

SEQ ID NO: 102700 - DNA, 103 bp, Artificial Sequence
  Synthetic Polynucleotide
taatacgactcactatagggaaggattcttcactctcccatgtgctgtggaacagaggagaccacagatgatgggagagaacctggcggcagcgcaaaagatg

SEQ ID NO: 102701 - DNA, 103 bp, Artificial Sequence
  Synthetic Polynucleotide
taatacgactcactatagggctgttgctgtaaggattcttcactctcccaaacagaggagatgggagatggaagaatccaacctggcggcagcgcaaaagatg

SEQ ID NO: 102702 - DNA, 103 bp, Artificial Sequence
  Synthetic Polynucleotide
taatacgactcactatagggccttcactttctgttgctgtaaggattcttaacagaggagaaagaatatgtacagcaacaacctggcggcagcgcaaaagatg

SEQ ID NO: 102703 - DNA, 103 bp, Artificial Sequence
  Synthetic Polynucleotide
taatacgactcactatagggttttttaggcccttcactttctgttgctgtaacagaggagaacagcaatggaaagtgaaaacctggcggcagcgcaaaagatg

SEQ ID NO: 102704 - DNA, 103 bp, Artificial Sequence
  Synthetic Polynucleotide
taatacgactcactataggggggggacggggagcccaggcccgacgccataacagaggagaatggcgatgggcctgggcaacctggcggcagcgcaaaagatg

SEQ ID NO: 102705 - DNA, 103 bp, Artificial Sequence
  Synthetic Polynucleotide
taatacgactcactatagggttctgggtcctcttcattttctgggtggggaacagaggagaccccacatggaaaatgaaaacctggcggcagcgcaaaagatg

SEQ ID NO: 102706 - DNA, 103 bp, Artificial Sequence
  Synthetic Polynucleotide
taatacgactcactataggggctactacggctggtggaaccatcagaaacaacagaggagagtttctatgggttccaccaacctggcggcagcgcaaaagatg

SEQ ID NO: 102707 - DNA, 103 bp, Artificial Sequence
  Synthetic Polynucleotide
taatacgactcactatagggtgcggctgcggctactacggctggtggaacaacagaggagagttccaatggccgtagtaaacctggcggcagcgcaaaagatg

SEQ ID NO: 102708 - DNA, 103 bp, Artificial Sequence
  Synthetic Polynucleotide
taatacgactcactatagggcggagtttcttgcggctgcggctactacggaacagaggagaccgtagatgccgcagccgaacctggcggcagcgcaaaagatg

SEQ ID NO: 102709 - DNA, 103 bp, Artificial Sequence
  Synthetic Polynucleotide
taatacgactcactatagggtttagtggttcggagtttcttgcggctgcgaacagaggagacgcagcatgaagaaactcaacctggcggcagcgcaaaagatg

SEQ ID NO: 102710 - DNA, 103 bp, Artificial Sequence
  Synthetic Polynucleotide
taatacgactcactatagggtctttttctttttagtggttcggagtttctaacagaggagaagaaacatggaaccactaaacctggcggcagcgcaaaagatg

SEQ ID NO: 102711 - DNA, 103 bp, Artificial Sequence
  Synthetic Polynucleotide
taatacgactcactatagggtcctcgcctttctttttctttttagtggttaacagaggagaaaccacatgaaagaaaaaaacctggcggcagcgcaaaagatg

SEQ ID NO: 102712 - DNA, 103 bp, Artificial Sequence
  Synthetic Polynucleotide
taatacgactcactatagggagtcacctcctcctcgcctttctttttcttaacagaggagaaagaaaatgaaaggcgagaacctggcggcagcgcaaaagatg

SEQ ID NO: 102713 - DNA, 103 bp, Artificial Sequence
  Synthetic Polynucleotide
taatacgactcactatagggcatccacagcagtcacctcctcctcgccttaacagaggagaaaggcgatgaggaggtgaaacctggcggcagcgcaaaagatg

SEQ ID NO: 102714 - DNA, 103 bp, Artificial Sequence
  Synthetic Polynucleotide
taatacgactcactataggggtctcataaccatccacagcagtcacctccaacagaggagaggaggtatgtgctgtggaaacctggcggcagcgcaaaagatg

SEQ ID NO: 102715 - DNA, 103 bp, Artificial Sequence
  Synthetic Polynucleotide
taatacgactcactatagggctggtggtctgtctcataaccatccacagcaacagaggagagctgtgatgggttatgagaacctggcggcagcgcaaaagatg

SEQ ID NO: 102716 - DNA, 103 bp, Artificial Sequence
  Synthetic Polynucleotide
taatacgactcactatagggacaaatcctcttctgggtcctcttcattttaacagaggagaaaaatgatgaggacccagaacctggcggcagcgcaaaagatg

SEQ ID NO: 102717 - DNA, 103 bp, Artificial Sequence
  Synthetic Polynucleotide
taatacgactcactatagggcgcaatagtcctggtggtctgtctcataacaacagaggagagttatgatgcagaccaccaacctggcggcagcgcaaaagatg

SEQ ID NO: 102718 - DNA, 103 bp, Artificial Sequence
  Synthetic Polynucleotide
taatacgactcactatagggtggcacacctcgcaatagtcctggtggtctaacagaggagaagaccaatgggactattgaacctggcggcagcgcaaaagatg

SEQ ID NO: 102719 - DNA, 103 bp, Artificial Sequence
  Synthetic Polynucleotide
taatacgactcactatagggaccgccttgctggcacacctcgcaatagtcaacagaggagagactatatggaggtgtgcaacctggcggcagcgcaaaagatg

SEQ ID NO: 102720 - DNA, 103 bp, Artificial Sequence
  Synthetic Polynucleotide
taatacgactcactatagggggatgatctcaccgccttgctggcacacctaacagaggagaaggtgtatgagcaaggcgaacctggcggcagcgcaaaagatg

SEQ ID NO: 102721 - DNA, 103 bp, Artificial Sequence
  Synthetic Polynucleotide
taatacgactcactataggggtatcacacaggatgatctcaccgccttgcaacagaggagagcaaggatgtgagatcataacctggcggcagcgcaaaagatg

SEQ ID NO: 102722 - DNA, 103 bp, Artificial Sequence
  Synthetic Polynucleotide
taatacgactcactatagggacggggacaggtatcacacaggatgatctcaacagaggagagagatcatgctgtgtgataacctggcggcagcgcaaaagatg

SEQ ID NO: 102723 - DNA, 103 bp, Artificial Sequence
  Synthetic Polynucleotide
taatacgactcactatagggtgtggtaagcacggggacaggtatcacacaaacagaggagatgtgtgatgcctgtccccaacctggcggcagcgcaaaagatg

SEQ ID NO: 102724 - DNA, 103 bp, Artificial Sequence
  Synthetic Polynucleotide
taatacgactcactatagggaggcagaccatgtggtaagcacggggacagaacagaggagactgtccatgtgcttaccaaacctggcggcagcgcaaaagatg

SEQ ID NO: 102725 - DNA, 103 bp, Artificial Sequence
  Synthetic Polynucleotide
taatacgactcactataggggtcgggatccaggcagaccatgtggtaagcaacagaggagagcttacatgatggtctgcaacctggcggcagcgcaaaagatg

SEQ ID NO: 102726 - DNA, 103 bp, Artificial Sequence
  Synthetic Polynucleotide
taatacgactcactatagggccttctccatgtcgggatccaggcagaccaaacagaggagatggtctatgtggatcccgaacctggcggcagcgcaaaagatg

SEQ ID NO: 102727 - DNA, 103 bp, Artificial Sequence
  Synthetic Polynucleotide
taatacgactcactatagggtctgtttctgacaaatcctcttctgggtccaacagaggagaggacccatgagaggatttaacctggcggcagcgcaaaagatg

SEQ ID NO: 102728 - DNA, 103 bp, Artificial Sequence
  Synthetic Polynucleotide
taatacgactcactatagggccctcgggagccttctccatgtcgggatccaacagaggagaggatccatgcatggagaaaacctggcggcagcgcaaaagatg

SEQ ID NO: 102729 - DNA, 103 bp, Artificial Sequence
  Synthetic Polynucleotide
taatacgactcactataggggctccacttgccctcgggagccttctccataacagaggagaatggagatggctcccgagaacctggcggcagcgcaaaagatg

SEQ ID NO: 102730 - DNA, 103 bp, Artificial Sequence
  Synthetic Polynucleotide
taatacgactcactatagggagtgtgggcagctccacttgccctcgggagaacagaggagactcccgatggcaagtggaaacctggcggcagcgcaaaagatg

SEQ ID NO: 102731 - DNA, 103 bp, Artificial Sequence
  Synthetic Polynucleotide
taatacgactcactatagggtccttctcgcagtgtgggcagctccacttgaacagaggagacaagtgatgctgcccacaaacctggcggcagcgcaaaagatg

SEQ ID NO: 102732 - DNA, 103 bp, Artificial Sequence
  Synthetic Polynucleotide
taatacgactcactatagggctggatgccttccttctcgcagtgtgggcaaacagaggagatgcccaatgtgcgagaagaacctggcggcagcgcaaaagatg

SEQ ID NO: 102733 - DNA, 103 bp, Artificial Sequence
  Synthetic Polynucleotide
taatacgactcactatagggtagcttcccactggatgccttccttctcgcaacagaggagagcgagaatgaaggcatccaacctggcggcagcgcaaaagatg

SEQ ID NO: 102734 - DNA, 103 bp, Artificial Sequence
  Synthetic Polynucleotide
taatacgactcactatagggttgtcctctttagcttcccactggatgcctaacagaggagaaggcatatggtgggaagcaacctggcggcagcgcaaaagatg

SEQ ID NO: 102735 - DNA, 103 bp, Artificial Sequence
  Synthetic Polynucleotide
taatacgactcactatagggaccctccgaattgtcctctttagcttcccaaacagaggagatgggaaatgaaagaggacaacctggcggcagcgcaaaagatg

SEQ ID NO: 102736 - DNA, 103 bp, Artificial Sequence
  Synthetic Polynucleotide
taatacgactcactatagggggatctcctcaccctccgaattgtcctcttaacagaggagaaagaggatgattcggaggaacctggcggcagcgcaaaagatg

SEQ ID NO: 102737 - DNA, 103 bp, Artificial Sequence
  Synthetic Polynucleotide
taatacgactcactatagggacctcttccaggatctcctcaccctccgaaaacagaggagattcggaatgtgaggagataacctggcggcagcgcaaaagatg

SEQ ID NO: 102738 - DNA, 103 bp, Artificial Sequence
  Synthetic Polynucleotide
taatacgactcactatagggctttggagtctctgtttctgacaaatcctcaacagaggagagaggatatgtcagaaacaaacctggcggcagcgcaaaagatg

SEQ ID NO: 102739 - DNA, 103 bp, Artificial Sequence
  Synthetic Polynucleotide
taatacgactcactataggggtctcccccaacctcttccaggatctcctcaacagaggagagaggagatgctggaagagaacctggcggcagcgcaaaagatg

SEQ ID NO: 102740 - DNA, 103 bp, Artificial Sequence
  Synthetic Polynucleotide
taatacgactcactatagggcctcttcgaggtctcccccaacctcttccaaacagaggagatggaagatgttgggggagaacctggcggcagcgcaaaagatg

SEQ ID NO: 102741 - DNA, 103 bp, Artificial Sequence
  Synthetic Polynucleotide
taatacgactcactatagggtggtcatcctcctcttcgaggtctcccccaaacagaggagatgggggatgcctcgaagaaacctggcggcagcgcaaaagatg

SEQ ID NO: 102742 - DNA, 103 bp, Artificial Sequence
  Synthetic Polynucleotide
taatacgactcactatagggttccatatggtggtcatcctcctcttcgagaacagaggagactcgaaatggaggatgacaacctggcggcagcgcaaaagatg

SEQ ID NO: 102743 - DNA, 103 bp, Artificial Sequence
  Synthetic Polynucleotide
taatacgactcactatagggcccgacagaattccatatggtggtcatcctaacagaggagaaggatgatgaccatatggaacctggcggcagcgcaaaagatg

SEQ ID NO: 102744 - DNA, 103 bp, Artificial Sequence
  Synthetic Polynucleotide
taatacgactcactatagggtccttgcagacccgacagaattccatatggaacagaggagaccatatatgattctgtcgaacctggcggcagcgcaaaagatg

SEQ ID NO: 102745 - DNA, 103 bp, Artificial Sequence
  Synthetic Polynucleotide
taatacgactcactatagggttccccaccatccttgcagacccgacagaaaacagaggagattctgtatggtctgcaagaacctggcggcagcgcaaaagatg

SEQ ID NO: 102746 - DNA, 103 bp, Artificial Sequence
  Synthetic Polynucleotide
taatacgactcactatagggagcagagcagttccccaccatccttgcagaaacagaggagatctgcaatgatggtggggaacctggcggcagcgcaaaagatg

SEQ ID NO: 102747 - DNA, 103 bp, Artificial Sequence
  Synthetic Polynucleotide
taatacgactcactatagggcaggtatcacagcagagcagttccccaccaaacagaggagatggtggatgactgctctgaacctggcggcagcgcaaaagatg

SEQ ID NO: 102748 - DNA, 103 bp, Artificial Sequence
  Synthetic Polynucleotide
taatacgactcactatagggggaagaaggacaggtatcacagcagagcagaacagaggagactgctcatgtgtgataccaacctggcggcagcgcaaaagatg

SEQ ID NO: 102749 - DNA, 103 bp, Artificial Sequence
  Synthetic Polynucleotide
taatacgactcactatagggtcttcttgagctttggagtctctgtttctgaacagaggagacagaaaatgagactccaaaacctggcggcagcgcaaaagatg

SEQ ID NO: 102750 - DNA, 103 bp, Artificial Sequence
  Synthetic Polynucleotide
taatacgactcactatagggggatgtggtaggaagaaggacaggtatcacaacagaggagagtgataatggtccttcttaacctggcggcagcgcaaaagatg

SEQ ID NO: 102751 - DNA, 103 bp, Artificial Sequence
  Synthetic Polynucleotide
taatacgactcactatagggttcaggcagtggatgtggtaggaagaaggaaacagaggagatccttcatgctaccacataacctggcggcagcgcaaaagatg

SEQ ID NO: 102752 - DNA, 103 bp, Artificial Sequence
  Synthetic Polynucleotide
taatacgactcactatagggaagtgggggattcaggcagtggatgtggtaaacagaggagataccacatgcactgcctgaacctggcggcagcgcaaaagatg

SEQ ID NO: 102753 - DNA, 103 bp, Artificial Sequence
  Synthetic Polynucleotide
taatacgactcactatagggggatctctggaagtgggggattcaggcagtaacagaggagaactgccatgatcccccacaacctggcggcagcgcaaaagatg

SEQ ID NO: 102754 - DNA, 103 bp, Artificial Sequence
  Synthetic Polynucleotide
taatacgactcactatagggtcaccgttggggatctctggaagtgggggaaacagaggagatcccccatgtccagagataacctggcggcagcgcaaaagatg

SEQ ID NO: 102755 - DNA, 103 bp, Artificial Sequence
  Synthetic Polynucleotide
taatacgactcactatagggacagagccattcaccgttggggatctctggaacagaggagaccagagatgcccaacggtaacctggcggcagcgcaaaagatg

SEQ ID NO: 102756 - DNA, 103 bp, Artificial Sequence
  Synthetic Polynucleotide
taatacgactcactatagggtacaacggggacagagccattcaccgttggaacagaggagaccaacgatgaatggctctaacctggcggcagcgcaaaagatg

SEQ ID NO: 102757 - DNA, 103 bp, Artificial Sequence
  Synthetic Polynucleotide
taatacgactcactataggggctggacacgtacaacggggacagagccataacagaggagaatggctatgtccccgttgaacctggcggcagcgcaaaagatg

SEQ ID NO: 102758 - DNA, 103 bp, Artificial Sequence
  Synthetic Polynucleotide
taatacgactcactataggggcccttcagagctggacacgtacaacggggaacagaggagaccccgtatgacgtgtccaaacctggcggcagcgcaaaagatg

SEQ ID NO: 102759 - DNA, 103 bp, Artificial Sequence
  Synthetic Polynucleotide
taatacgactcactatagggtctgcactttgcccttcagagctggacacgaacagaggagacgtgtcatgctctgaaggaacctggcggcagcgcaaaagatg

SEQ ID NO: 102760 - DNA, 103 bp, Artificial Sequence
  Synthetic Polynucleotide
taatacgactcactatagggggctttttcttcttcttgagctttggagtcaacagaggagagactccatggctcaagaaaacctggcggcagcgcaaaagatg

SEQ ID NO: 102761 - DNA, 103 bp, Artificial Sequence
  Synthetic Polynucleotide
taatacgactcactatagggattaggatcttctgcactttgcccttcagaaacagaggagatctgaaatgcaaagtgcaaacctggcggcagcgcaaaagatg

SEQ ID NO: 102762 - DNA, 103 bp, Artificial Sequence
  Synthetic Polynucleotide
taatacgactcactatagggccacttccagattaggatcttctgcactttaacagaggagaaaagtgatgaagatcctaaacctggcggcagcgcaaaagatg

SEQ ID NO: 102763 - DNA, 103 bp, Artificial Sequence
  Synthetic Polynucleotide
taatacgactcactataggggtggctgaccccacttccagattaggatctaacagaggagaagatccatgtctggaagtaacctggcggcagcgcaaaagatg

SEQ ID NO: 102764 - DNA, 103 bp, Artificial Sequence
  Synthetic Polynucleotide
taatacgactcactataggggtgggagatggtggctgaccccacttccagaacagaggagactggaaatggggtcagccaacctggcggcagcgcaaaagatg

SEQ ID NO: 102765 - DNA, 103 bp, Artificial Sequence
  Synthetic Polynucleotide
taatacgactcactatagggaggcactggtgtgggagatggtggctgaccaacagaggagaggtcagatgccatctcccaacctggcggcagcgcaaaagatg

SEQ ID NO: 102766 - DNA, 103 bp, Artificial Sequence
  Synthetic Polynucleotide
taatacgactcactatagggctggaggccgaggcactggtgtgggagatgaacagaggagacatctcatgcaccagtgcaacctggcggcagcgcaaaagatg

SEQ ID NO: 102767 - DNA, 103 bp, Artificial Sequence
  Synthetic Polynucleotide
taatacgactcactatagggggatcagcatctggaggccgaggcactggtaacagaggagaaccagtatgtcggcctccaacctggcggcagcgcaaaagatg

SEQ ID NO: 102768 - DNA, 103 bp, Artificial Sequence
  Synthetic Polynucleotide
taatacgactcactataggggggcgtgttgggatcagcatctggaggccgaacagaggagacggcctatggatgctgataacctggcggcagcgcaaaagatg

SEQ ID NO: 102769 - DNA, 103 bp, Artificial Sequence
  Synthetic Polynucleotide
taatacgactcactataggggctttggggagggcgtgttgggatcagcataacagaggagaatgctgatgccaacacgcaacctggcggcagcgcaaaagatg

SEQ ID NO: 102770 - DNA, 103 bp, Artificial Sequence
  Synthetic Polynucleotide
taatacgactcactatagggccctccaagggctttggggagggcgtgttgaacagaggagacaacacatgctccccaaaaacctggcggcagcgcaaaagatg

SEQ ID NO: 102771 - DNA, 103 bp, Artificial Sequence
  Synthetic Polynucleotide
taatacgactcactatagggaggtttcttaggctttttcttcttcttgagaacagaggagactcaagatgaagaaaaagaacctggcggcagcgcaaaagatg

SEQ ID NO: 102772 - DNA, 103 bp, Artificial Sequence
  Synthetic Polynucleotide
taatacgactcactatagggctctggccgcccctccaagggctttggggaaacagaggagatccccaatgcccttggagaacctggcggcagcgcaaaagatg

SEQ ID NO: 102773 - DNA, 103 bp, Artificial Sequence
  Synthetic Polynucleotide
taatacgactcactatagggagaactgccgctctggccgcccctccaaggaacagaggagaccttggatgggcggccagaacctggcggcagcgcaaaagatg

SEQ ID NO: 102774 - DNA, 103 bp, Artificial Sequence
  Synthetic Polynucleotide
taatacgactcactatagggcatttcacaaagaactgccgctctggccgcaacagaggagagcggccatggcggcagttaacctggcggcagcgcaaaagatg

SEQ ID NO: 102775 - DNA, 103 bp, Artificial Sequence
  Synthetic Polynucleotide
taatacgactcactatagggcatgccttgccatttcacaaagaactgccgaacagaggagacggcagatgtttgtgaaaaacctggcggcagcgcaaaagatg

SEQ ID NO: 102776 - DNA, 103 bp, Artificial Sequence
  Synthetic Polynucleotide
taatacgactcactataggggccagtaagacatgccttgccatttcacaaaacagaggagattgtgaatgggcaaggcaaacctggcggcagcgcaaaagatg

SEQ ID NO: 102777 - DNA, 103 bp, Artificial Sequence
  Synthetic Polynucleotide
taatacgactcactatagggcaggagcagtgccagtaagacatgccttgcaacagaggagagcaaggatggtcttactgaacctggcggcagcgcaaaagatg

SEQ ID NO: 102778 - DNA, 103 bp, Artificial Sequence
  Synthetic Polynucleotide
taatacgactcactatagggttcagaaacccaggagcagtgccagtaagaaacagaggagatcttacatgcactgctccaacctggcggcagcgcaaaagatg

SEQ ID NO: 102779 - DNA, 103 bp, Artificial Sequence
  Synthetic Polynucleotide
taatacgactcactatagggccagctgcagttcagaaacccaggagcagtaacagaggagaactgctatggggtttctgaacctggcggcagcgcaaaagatg

SEQ ID NO: 102780 - DNA, 103 bp, Artificial Sequence
  Synthetic Polynucleotide
taatacgactcactatagggcagtgcagctccagctgcagttcagaaaccaacagaggagaggtttcatgactgcagctaacctggcggcagcgcaaaagatg

SEQ ID NO: 102781 - DNA, 103 bp, Artificial Sequence
  Synthetic Polynucleotide
taatacgactcactatagggcatcacctgacagtgcagctccagctgcagaacagaggagactgcagatggagctgcacaacctggcggcagcgcaaaagatg

SEQ ID NO: 102782 - DNA, 103 bp, Artificial Sequence
  Synthetic Polynucleotide
taatacgactcactatagggtagggtcccgaggtttcttaggctttttctaacagaggagaagaaaaatgctaagaaacaacctggcggcagcgcaaaagatg

SEQ ID NO: 102783 - DNA, 103 bp, Artificial Sequence
  Synthetic Polynucleotide
taatacgactcactatagggagtttcggaacatcacctgacagtgcagctaacagaggagaagctgcatggtcaggtgaaacctggcggcagcgcaaaagatg

SEQ ID NO: 102784 - DNA, 103 bp, Artificial Sequence
  Synthetic Polynucleotide
taatacgactcactatagggttccgctgatagtttcggaacatcacctgaaacagaggagatcaggtatggttccgaaaaacctggcggcagcgcaaaagatg

SEQ ID NO: 102785 - DNA, 103 bp, Artificial Sequence
  Synthetic Polynucleotide
taatacgactcactatagggcatatcattcttccgctgatagtttcggaaaacagaggagattccgaatgtatcagcggaacctggcggcagcgcaaaagatg

SEQ ID NO: 102786 - DNA, 103 bp, Artificial Sequence
  Synthetic Polynucleotide
taatacgactcactataggggtggctcatccatatcattcttccgctgataacagaggagaatcagcatgagaatgataaacctggcggcagcgcaaaagatg

SEQ ID NO: 102787 - DNA, 103 bp, Artificial Sequence
  Synthetic Polynucleotide
taatacgactcactatagggtccccagaaggtggctcatccatatcattcaacagaggagagaatgaatgggatgagccaacctggcggcagcgcaaaagatg

SEQ ID NO: 102788 - DNA, 103 bp, Artificial Sequence
  Synthetic Polynucleotide
taatacgactcactatagggaccaccaaagtccccagaaggtggctcatcaacagaggagagatgagatgccttctgggaacctggcggcagcgcaaaagatg

SEQ ID NO: 102789 - DNA, 103 bp, Artificial Sequence
  Synthetic Polynucleotide
taatacgactcactatagggtctcttcatcaccaccaaagtccccagaagaacagaggagacttctgatgactttggtgaacctggcggcagcgcaaaagatg

SEQ ID NO: 102790 - DNA, 103 bp, Artificial Sequence
  Synthetic Polynucleotide
taatacgactcactatagggtttcggcttttctcttcatcaccaccaaagaacagaggagactttggatgtgatgaagaaacctggcggcagcgcaaaagatg

SEQ ID NO: 102791 - DNA, 103 bp, Artificial Sequence
  Synthetic Polynucleotide
taatacgactcactataggggttctttcgctttcggcttttctcttcatcaacagaggagagatgaaatgaaaagccgaaacctggcggcagcgcaaaagatg

SEQ ID NO: 102792 - DNA, 103 bp, Artificial Sequence
  Synthetic Polynucleotide
taatacgactcactatagggtagggtccttgttctttcgctttcggctttaacagaggagaaaagccatgagcgaaagaaacctggcggcagcgcaaaagatg

SEQ ID NO: 102793 - DNA, 103 bp, Artificial Sequence
  Synthetic Polynucleotide
taatacgactcactatagggttagggattttagggtcccgaggtttcttaaacagaggagataagaaatgtcgggacccaacctggcggcagcgcaaaagatg

SEQ ID NO: 102794 - DNA, 103 bp, Artificial Sequence
  Synthetic Polynucleotide
taatacgactcactatagggtctgcaaatttagggtccttgttctttcgcaacagaggagagcgaaaatgcaaggacccaacctggcggcagcgcaaaagatg

SEQ ID NO: 102795 - DNA, 103 bp, Artificial Sequence
  Synthetic Polynucleotide
taatacgactcactatagggttcctccatctctgcaaatttagggtccttaacagaggagaaaggacatgaaatttgcaaacctggcggcagcgcaaaagatg

SEQ ID NO: 102796 - DNA, 103 bp, Artificial Sequence
  Synthetic Polynucleotide
taatacgactcactataggggatagaagcgttcctccatctctgcaaattaacagaggagaaatttgatgagatggaggaacctggcggcagcgcaaaagatg

SEQ ID NO: 102797 - DNA, 103 bp, Artificial Sequence
  Synthetic Polynucleotide
taatacgactcactatagggatcccatagcgatagaagcgttcctccatcaacagaggagagatggaatgacgcttctaaacctggcggcagcgcaaaagatg

SEQ ID NO: 102798 - DNA, 103 bp, Artificial Sequence
  Synthetic Polynucleotide
taatacgactcactatagggctcgggttttatcccatagcgatagaagcgaacagaggagacgcttcatgcgctatgggaacctggcggcagcgcaaaagatg

SEQ ID NO: 102799 - DNA, 103 bp, Artificial Sequence
  Synthetic Polynucleotide
taatacgactcactatagggtcatcatccactcgggttttatcccatagcaacagaggagagctatgatgtaaaacccgaacctggcggcagcgcaaaagatg

SEQ ID NO: 102800 - DNA, 103 bp, Artificial Sequence
  Synthetic Polynucleotide
taatacgactcactatagggattcggtggatcatcatccactcgggttttaacagaggagaaaaaccatggtggatgataacctggcggcagcgcaaaagatg

SEQ ID NO: 102801 - DNA, 103 bp, Artificial Sequence
  Synthetic Polynucleotide
taatacgactcactataggggtggttgaggattcggtggatcatcatccaaacagaggagatggatgatgatccaccgaaacctggcggcagcgcaaaagatg

SEQ ID NO: 102802 - DNA, 103 bp, Artificial Sequence
  Synthetic Polynucleotide
taatacgactcactatagggtgtccacactgtggttgaggattcggtggaaacagaggagatccaccatgtcctcaaccaacctggcggcagcgcaaaagatg

SEQ ID NO: 102803 - DNA, 103 bp, Artificial Sequence
  Synthetic Polynucleotide
taatacgactcactatagggtggcccttcttgtccacactgtggttgaggaacagaggagacctcaaatgcagtgtggaaacctggcggcagcgcaaaagatg

SEQ ID NO: 102804 - DNA, 103 bp, Artificial Sequence
  Synthetic Polynucleotide
taatacgactcactataggggcgcttgctcttagggattttagggtcccgaacagaggagacgggacatgaaaatccctaacctggcggcagcgcaaaagatg

SEQ ID NO: 102805 - DNA, 103 bp, Artificial Sequence
  Synthetic Polynucleotide
taatacgactcactataggggtagtggacgtggcccttcttgtccacactaacagaggagaagtgtgatgaagaagggcaacctggcggcagcgcaaaagatg

SEQ ID NO: 102806 - DNA, 103 bp, Artificial Sequence
  Synthetic Polynucleotide
taatacgactcactatagggacttgatcaagtagtggacgtggcccttctaacagaggagaagaaggatgacgtccactaacctggcggcagcgcaaaagatg

SEQ ID NO: 102807 - DNA, 103 bp, Artificial Sequence
  Synthetic Polynucleotide
taatacgactcactatagggaagtcccgccacttgatcaagtagtggacgaacagaggagacgtccaatgcttgatcaaaacctggcggcagcgcaaaagatg

SEQ ID NO: 102808 - DNA, 103 bp, Artificial Sequence
  Synthetic Polynucleotide
taatacgactcactatagggatcgtaaggtaagtcccgccacttgatcaaaacagaggagattgatcatgtggcgggacaacctggcggcagcgcaaaagatg

SEQ ID NO: 102809 - DNA, 103 bp, Artificial Sequence
  Synthetic Polynucleotide
taatacgactcactatagggaagaagcctgatcgtaaggtaagtcccgccaacagaggagaggcgggatgtaccttacgaacctggcggcagcgcaaaagatg

SEQ ID NO: 102810 - DNA, 103 bp, Artificial Sequence
  Synthetic Polynucleotide
taatacgactcactatagggtcactctcccaagaagcctgatcgtaaggtaacagaggagaaccttaatgtcaggcttcaacctggcggcagcgcaaaagatg

SEQ ID NO: 102811 - DNA, 103 bp, Artificial Sequence
  Synthetic Polynucleotide
taatacgactcactatagggctccacatcctcactctcccaagaagcctgaacagaggagacaggctatgtgggagagtaacctggcggcagcgcaaaagatg

SEQ ID NO: 102812 - DNA, 103 bp, Artificial Sequence
  Synthetic Polynucleotide
taatacgactcactatagggaatcctggatctccacatcctcactctcccaacagaggagagggagaatgaggatgtggaacctggcggcagcgcaaaagatg

SEQ ID NO: 102813 - DNA, 103 bp, Artificial Sequence
  Synthetic Polynucleotide
taatacgactcactatagggaacaggtcgtaatcctggatctccacatccaacagaggagaggatgtatggatccaggaaacctggcggcagcgcaaaagatg

SEQ ID NO: 102814 - DNA, 103 bp, Artificial Sequence
  Synthetic Polynucleotide
taatacgactcactataggggctctgcttgaacaggtcgtaatcctggataacagaggagaatccagatgtacgacctgaacctggcggcagcgcaaaagatg

SEQ ID NO: 102815 - DNA, 103 bp, Artificial Sequence
  Synthetic Polynucleotide
taatacgactcactatagggccgccgagcagggggacggggagcccaggcaacagaggagagcctggatgccccgtcccaacctggcggcagcgcaaaagatg

SEQ ID NO: 102816 - DNA, 103 bp, Artificial Sequence
  Synthetic Polynucleotide
taatacgactcactatagggcctttttttggcgcttgctcttagggatttaacagaggagaaaatccatgagagcaagcaacctggcggcagcgcaaaagatg

SEQ ID NO: 102817 - DNA, 103 bp, Artificial Sequence
  Synthetic Polynucleotide
taatacgactcactataggggattccaatagctctgcttgaacaggtcgtaacagaggagaacgaccatgtcaagcagaaacctggcggcagcgcaaaagatg

SEQ ID NO: 102818 - DNA, 103 bp, Artificial Sequence
  Synthetic Polynucleotide
taatacgactcactatagggaactccctgtgattccaatagctctgcttgaacagaggagacaagcaatgctattggaaaacctggcggcagcgcaaaagatg

SEQ ID NO: 102819 - DNA, 103 bp, Artificial Sequence
  Synthetic Polynucleotide
taatacgactcactatagggacccctcattaactccctgtgattccaataaacagaggagatattggatgcacagggagaacctggcggcagcgcaaaagatg

SEQ ID NO: 102820 - DNA, 103 bp, Artificial Sequence
  Synthetic Polynucleotide
taatacgactcactatagggggccttcctcacccctcattaactccctgtaacagaggagaacagggatgtaatgagggaacctggcggcagcgcaaaagatg

SEQ ID NO: 102821 - DNA, 103 bp, Artificial Sequence
  Synthetic Polynucleotide
taatacgactcactatagggttgcctggtcggccttcctcacccctcattaacagaggagaaatgagatgtgaggaaggaacctggcggcagcgcaaaagatg

SEQ ID NO: 102822 - DNA, 103 bp, Artificial Sequence
  Synthetic Polynucleotide
taatacgactcactatagggcttgagcttcttgcctggtcggccttcctcaacagaggagagaggaaatgcgaccaggcaacctggcggcagcgcaaaagatg

SEQ ID NO: 102823 - DNA, 103 bp, Artificial Sequence
  Synthetic Polynucleotide
taatacgactcactataggggcttcaccttcttgagcttcttgcctggtcaacagaggagagaccagatgagaagctcaaacctggcggcagcgcaaaagatg

SEQ ID NO: 102824 - DNA, 103 bp, Artificial Sequence
  Synthetic Polynucleotide
taatacgactcactatagggaacttccgaagcttcaccttcttgagcttcaacagaggagagaagctatggaaggtgaaaacctggcggcagcgcaaaagatg

SEQ ID NO: 102825 - DNA, 103 bp, Artificial Sequence
  Synthetic Polynucleotide
taatacgactcactatagggaggcctctccaacttccgaagcttcaccttaacagaggagaaaggtgatgcttcggaagaacctggcggcagcgcaaaagatg

SEQ ID NO: 102826 - DNA, 103 bp, Artificial Sequence
  Synthetic Polynucleotide
taatacgactcactataggggcgtttctggaggcctctccaacttccgaaaacagaggagattcggaatgtggagaggcaacctggcggcagcgcaaaagatg

SEQ ID NO: 102827 - DNA, 103 bp, Artificial Sequence
  Synthetic Polynucleotide
taatacgactcactatagggagcatacgctcctttttttggcgcttgctcaacagaggagagagcaaatgccaaaaaaaaacctggcggcagcgcaaaagatg

SEQ ID NO: 102828 - DNA, 103 bp, Artificial Sequence
  Synthetic Polynucleotide
taatacgactcactatagggtcaactgttggcgtttctggaggcctctccaacagaggagaggagagatgtccagaaacaacctggcggcagcgcaaaagatg

SEQ ID NO: 102829 - DNA, 103 bp, Artificial Sequence
  Synthetic Polynucleotide
taatacgactcactatagggcactgttggatcaactgttggcgtttctggaacagaggagaccagaaatgccaacagttaacctggcggcagcgcaaaagatg

SEQ ID NO: 102830 - DNA, 103 bp, Artificial Sequence
  Synthetic Polynucleotide
taatacgactcactataggggctcatacttcactgttggatcaactgttgaacagaggagacaacagatgatccaacagaacctggcggcagcgcaaaagatg

SEQ ID NO: 102831 - DNA, 103 bp, Artificial Sequence
  Synthetic Polynucleotide
taatacgactcactatagggtctggctgtcgctcatacttcactgttggaaacagaggagatccaacatggaagtatgaaacctggcggcagcgcaaaagatg

SEQ ID NO: 102832 - DNA, 103 bp, Artificial Sequence
  Synthetic Polynucleotide
taatacgactcactatagggatccaggtactctggctgtcgctcatacttaacagaggagaaagtatatgcgacagccaaacctggcggcagcgcaaaagatg

SEQ ID NO: 102833 - DNA, 103 bp, Artificial Sequence
  Synthetic Polynucleotide
taatacgactcactatagggcacctgtagcatccaggtactctggctgtcaacagaggagagacagcatgagtacctggaacctggcggcagcgcaaaagatg

SEQ ID NO: 102834 - DNA, 103 bp, Artificial Sequence
  Synthetic Polynucleotide
taatacgactcactatagggtgcagggttccacctgtagcatccaggtacaacagaggagagtacctatgtgctacaggaacctggcggcagcgcaaaagatg

SEQ ID NO: 102835 - DNA, 103 bp, Artificial Sequence
  Synthetic Polynucleotide
taatacgactcactatagggttgataggggtgcagggttccacctgtagcaacagaggagagctacaatgggaaccctgaacctggcggcagcgcaaaagatg

SEQ ID NO: 102836 - DNA, 103 bp, Artificial Sequence
  Synthetic Polynucleotide
taatacgactcactatagggggccctccatttgataggggtgcagggttcaacagaggagagaacccatgacccctatcaacctggcggcagcgcaaaagatg

SEQ ID NO: 102837 - DNA, 103 bp, Artificial Sequence
  Synthetic Polynucleotide
taatacgactcactatagggaaccaattcaggccctccatttgataggggaacagaggagacccctaatgaatggagggaacctggcggcagcgcaaaagatg

SEQ ID NO: 102838 - DNA, 103 bp, Artificial Sequence
  Synthetic Polynucleotide
taatacgactcactatagggccggcataagagcatacgctcctttttttgaacagaggagacaaaaaatggagcgtatgaacctggcggcagcgcaaaagatg

SEQ ID NO: 102839 - DNA, 103 bp, Artificial Sequence
  Synthetic Polynucleotide
taatacgactcactatagggggagaagcgcaaccaattcaggccctccataacagaggagaatggagatgctgaattggaacctggcggcagcgcaaaagatg

SEQ ID NO: 102840 - DNA, 103 bp, Artificial Sequence
  Synthetic Polynucleotide
taatacgactcactatagggcctgagcccaggagaagcgcaaccaattcaaacagaggagatgaattatgtgcgcttctaacctggcggcagcgcaaaagatg

SEQ ID NO: 102841 - DNA, 103 bp, Artificial Sequence
  Synthetic Polynucleotide
taatacgactcactataggggtgtcagtgccctgagcccaggagaagcgcaacagaggagagcgcttatgctgggctcaaacctggcggcagcgcaaaagatg

SEQ ID NO: 102842 - DNA, 103 bp, Artificial Sequence
  Synthetic Polynucleotide
taatacgactcactatagggagccaagatggtgtcagtgccctgagcccaaacagaggagatgggctatgggcactgacaacctggcggcagcgcaaaagatg

SEQ ID NO: 102843 - DNA, 103 bp, Artificial Sequence
  Synthetic Polynucleotide
taatacgactcactatagggccatctcatcagccaagatggtgtcagtgcaacagaggagagcactgatgccatcttggaacctggcggcagcgcaaaagatg

SEQ ID NO: 102844 - DNA, 103 bp, Artificial Sequence
  Synthetic Polynucleotide
taatacgactcactatagggttcccaaggcccatctcatcagccaagatgaacagaggagacatcttatgtgatgagataacctggcggcagcgcaaaagatg

SEQ ID NO: 102845 - DNA, 103 bp, Artificial Sequence
  Synthetic Polynucleotide
taatacgactcactatagggctgtacagttttcccaaggcccatctcatcaacagaggagagatgagatgggccttgggaacctggcggcagcgcaaaagatg

SEQ ID NO: 102846 - DNA, 103 bp, Artificial Sequence
  Synthetic Polynucleotide
taatacgactcactatagggagactgctgtctgtacagttttcccaaggcaacagaggagagccttgatgaaactgtacaacctggcggcagcgcaaaagatg

SEQ ID NO: 102847 - DNA, 103 bp, Artificial Sequence
  Synthetic Polynucleotide
taatacgactcactataggggaatacaggaagactgctgtctgtacagttaacagaggagaaactgtatggacagcagtaacctggcggcagcgcaaaagatg

SEQ ID NO: 102848 - DNA, 103 bp, Artificial Sequence
  Synthetic Polynucleotide
taatacgactcactatagggcttgtaaagggaatacaggaagactgctgtaacagaggagaacagcaatgttcctgtataacctggcggcagcgcaaaagatg

SEQ ID NO: 102849 - DNA, 103 bp, Artificial Sequence
  Synthetic Polynucleotide
taatacgactcactatagggcccccagctgccggcataagagcatacgctaacagaggagaagcgtaatgtcttatgccaacctggcggcagcgcaaaagatg

SEQ ID NO: 102850 - DNA, 103 bp, Artificial Sequence
  Synthetic Polynucleotide
taatacgactcactatagggaatgaccctccttgtaaagggaatacaggaaacagaggagatcctgtatgccctttacaaacctggcggcagcgcaaaagatg

SEQ ID NO: 102851 - DNA, 103 bp, Artificial Sequence
  Synthetic Polynucleotide
taatacgactcactataggggggcctttggaatgaccctccttgtaaaggaacagaggagacctttaatgggagggtcaaacctggcggcagcgcaaaagatg

SEQ ID NO: 102852 - DNA, 103 bp, Artificial Sequence
  Synthetic Polynucleotide
taatacgactcactatagggcactaggaaggggcctttggaatgaccctcaacagaggagagagggtatgtccaaaggcaacctggcggcagcgcaaaagatg

SEQ ID NO: 102853 - DNA, 103 bp, Artificial Sequence
  Synthetic Polynucleotide
taatacgactcactataggggaggggcgctcactaggaaggggcctttggaacagaggagaccaaagatgccttcctagaacctggcggcagcgcaaaagatg

SEQ ID NO: 102854 - DNA, 103 bp, Artificial Sequence
  Synthetic Polynucleotide
taatacgactcactatagggatggtagaaagaggggcgctcactaggaagaacagaggagacttcctatggagcgccccaacctggcggcagcgcaaaagatg

SEQ ID NO: 102855 - DNA, 103 bp, Artificial Sequence
  Synthetic Polynucleotide
taatacgactcactatagggccagttgatgatggtagaaagaggggcgctaacagaggagaagcgccatgctttctaccaacctggcggcagcgcaaaagatg

SEQ ID NO: 102856 - DNA, 103 bp, Artificial Sequence
  Synthetic Polynucleotide
taatacgactcactatagggactcccgctcccagttgatgatggtagaaaaacagaggagatttctaatgtcatcaactaacctggcggcagcgcaaaagatg

SEQ ID NO: 102857 - DNA, 103 bp, Artificial Sequence
  Synthetic Polynucleotide
taatacgactcactatagggcacatttcaaactcccgctcccagttgatgaacagaggagacatcaaatgggagcgggaaacctggcggcagcgcaaaagatg

SEQ ID NO: 102858 - DNA, 103 bp, Artificial Sequence
  Synthetic Polynucleotide
taatacgactcactataggggtctggagcccacatttcaaactcccgctcaacagaggagagagcggatgtttgaaatgaacctggcggcagcgcaaaagatg

SEQ ID NO: 102859 - DNA, 103 bp, Artificial Sequence
  Synthetic Polynucleotide
taatacgactcactatagggcgacatacatgtctggagcccacatttcaaaacagaggagattgaaaatggggctccagaacctggcggcagcgcaaaagatg

SEQ ID NO: 102860 - DNA, 103 bp, Artificial Sequence
  Synthetic Polynucleotide
taatacgactcactatagggccagagctgtcccccagctgccggcataagaacagaggagacttatgatggcagctgggaacctggcggcagcgcaaaagatg

SEQ ID NO: 102861 - DNA, 103 bp, Artificial Sequence
  Synthetic Polynucleotide
taatacgactcactatagggacataggttacgacatacatgtctggagccaacagaggagaggctccatgcatgtatgtaacctggcggcagcgcaaaagatg

SEQ ID NO: 102862 - DNA, 103 bp, Artificial Sequence
  Synthetic Polynucleotide
taatacgactcactatagggcttgtcacccacataggttacgacatacataacagaggagaatgtatatggtaacctataacctggcggcagcgcaaaagatg

SEQ ID NO: 102863 - DNA, 103 bp, Artificial Sequence
  Synthetic Polynucleotide
taatacgactcactatagggcacggctgtccttgtcacccacataggttaaacagaggagataacctatgtgggtgacaaacctggcggcagcgcaaaagatg

SEQ ID NO: 102864 - DNA, 103 bp, Artificial Sequence
  Synthetic Polynucleotide
taatacgactcactatagggcggatgatggcacggctgtccttgtcacccaacagaggagagggtgaatgggacagccgaacctggcggcagcgcaaaagatg

SEQ ID NO: 102865 - DNA, 103 bp, Artificial Sequence
  Synthetic Polynucleotide
taatacgactcactatagggctcattctctcggatgatggcacggctgtcaacagaggagagacagcatggccatcatcaacctggcggcagcgcaaaagatg

SEQ ID NO: 102866 - DNA, 103 bp, Artificial Sequence
  Synthetic Polynucleotide
taatacgactcactatagggcaaaggagaactcattctctcggatgatggaacagaggagaccatcaatggagagaatgaacctggcggcagcgcaaaagatg

SEQ ID NO: 102867 - DNA, 103 bp, Artificial Sequence
  Synthetic Polynucleotide
taatacgactcactataggggcattgtcttcaaaggagaactcattctctaacagaggagaagagaaatggttctccttaacctggcggcagcgcaaaagatg

SEQ ID NO: 102868 - DNA, 103 bp, Artificial Sequence
  Synthetic Polynucleotide
taatacgactcactatagggaccacgaatggcattgtcttcaaaggagaaaacagaggagattctccatggaagacaataacctggcggcagcgcaaaagatg

SEQ ID NO: 102869 - DNA, 103 bp, Artificial Sequence
  Synthetic Polynucleotide
taatacgactcactatagggccttcttgccaccacgaatggcattgtcttaacagaggagaaagacaatgccattcgtgaacctggcggcagcgcaaaagatg

SEQ ID NO: 102870 - DNA, 103 bp, Artificial Sequence
  Synthetic Polynucleotide
taatacgactcactatagggatgcgggaggccttcttgccaccacgaatgaacagaggagacattcgatgtggcaagaaaacctggcggcagcgcaaaagatg

SEQ ID NO: 102871 - DNA, 103 bp, Artificial Sequence
  Synthetic Polynucleotide
taatacgactcactatagggtggcccctccccagagctgtcccccagctgaacagaggagacagctgatggacagctctaacctggcggcagcgcaaaagatg

SEQ ID NO: 102872 - DNA, 103 bp, Artificial Sequence
  Synthetic Polynucleotide
taatacgactcactatagggctctttcttcatgcgggaggccttcttgccaacagaggagaggcaagatggcctcccgcaacctggcggcagcgcaaaagatg

SEQ ID NO: 102873 - DNA, 103 bp, Artificial Sequence
  Synthetic Polynucleotide
taatacgactcactatagggtcacagatgcctctttcttcatgcgggaggaacagaggagacctcccatgtgaagaaagaacctggcggcagcgcaaaagatg

SEQ ID NO: 102874 - DNA, 103 bp, Artificial Sequence
  Synthetic Polynucleotide
taatacgactcactatagggacatggaatttcacagatgcctctttcttcaacagaggagagaagaaatgggcatctgtaacctggcggcagcgcaaaagatg

SEQ ID NO: 102875 - DNA, 103 bp, Artificial Sequence
  Synthetic Polynucleotide
taatacgactcactatagggtgtcagcagcacatggaatttcacagatgcaacagaggagagcatctatgaaattccataacctggcggcagcgcaaaagatg

SEQ ID NO: 102876 - DNA, 103 bp, Artificial Sequence
  Synthetic Polynucleotide
taatacgactcactatagggattcataggatgtcagcagcacatggaattaacagaggagaaattccatgtgctgctgaaacctggcggcagcgcaaaagatg

SEQ ID NO: 102877 - DNA, 103 bp, Artificial Sequence
  Synthetic Polynucleotide
taatacgactcactatagggatggtgatcaattcataggatgtcagcagcaacagaggagagctgctatgatcctatgaaacctggcggcagcgcaaaagatg

SEQ ID NO: 102878 - DNA, 103 bp, Artificial Sequence
  Synthetic Polynucleotide
taatacgactcactatagggagccatgtcaatggtgatcaattcataggaaacagaggagatcctatatgttgatcaccaacctggcggcagcgcaaaagatg

SEQ ID NO: 102879 - DNA, 103 bp, Artificial Sequence
  Synthetic Polynucleotide
taatacgactcactatagggagcccaaaatagccatgtcaatggtgatcaaacagaggagatgatcaatgttgacatggaacctggcggcagcgcaaaagatg

SEQ ID NO: 102880 - DNA, 103 bp, Artificial Sequence
  Synthetic Polynucleotide
taatacgactcactatagggcaatcaatagagcccaaaatagccatgtcaaacagaggagatgacatatgtattttgggaacctggcggcagcgcaaaagatg

SEQ ID NO: 102881 - DNA, 103 bp, Artificial Sequence
  Synthetic Polynucleotide
taatacgactcactataggggaggcaggcccaatcaatagagcccaaaataacagaggagaattttgatgtctattgataacctggcggcagcgcaaaagatg

SEQ ID NO: 102882 - DNA, 103 bp, Artificial Sequence
  Synthetic Polynucleotide
taatacgactcactatagggccacaaactctggcccctccccagagctgtaacagaggagaacagctatggggaggggcaacctggcggcagcgcaaaagatg

SEQ ID NO: 102883 - DNA, 103 bp, Artificial Sequence
  Synthetic Polynucleotide
taatacgactcactatagggcatccacgatgaggcaggcccaatcaatagaacagaggagactattgatggggcctgccaacctggcggcagcgcaaaagatg

SEQ ID NO: 102884 - DNA, 103 bp, Artificial Sequence
  Synthetic Polynucleotide
taatacgactcactatagggcgatgggcttcatccacgatgaggcaggccaacagaggagaggcctgatgcatcgtggaaacctggcggcagcgcaaaagatg

SEQ ID NO: 102885 - DNA, 103 bp, Artificial Sequence
  Synthetic Polynucleotide
taatacgactcactataggggttcttcagccgatgggcttcatccacgataacagaggagaatcgtgatggaagcccataacctggcggcagcgcaaaagatg

SEQ ID NO: 102886 - DNA, 103 bp, Artificial Sequence
  Synthetic Polynucleotide
taatacgactcactatagggtagactgattgttcttcagccgatgggcttaacagaggagaaagcccatgggctgaagaaacctggcggcagcgcaaaagatg

SEQ ID NO: 102887 - DNA, 103 bp, Artificial Sequence
  Synthetic Polynucleotide
taatacgactcactatagggcggaagaacttagactgattgttcttcagcaacagaggagagctgaaatgcaatcagtcaacctggcggcagcgcaaaagatg

SEQ ID NO: 102888 - DNA, 103 bp, Artificial Sequence
  Synthetic Polynucleotide
taatacgactcactatagggattcaatacccggaagaacttagactgattaacagaggagaaatcagatgaagttcttcaacctggcggcagcgcaaaagatg

SEQ ID NO: 102889 - DNA, 103 bp, Artificial Sequence
  Synthetic Polynucleotide
taatacgactcactataggggtgagtaaccattcaatacccggaagaactaacagaggagaagttctatggggtattgaaacctggcggcagcgcaaaagatg

SEQ ID NO: 102890 - DNA, 103 bp, Artificial Sequence
  Synthetic Polynucleotide
taatacgactcactatagggttgtgctggagtgagtaaccattcaataccaacagaggagaggtattatgtggttactcaacctggcggcagcgcaaaagatg

SEQ ID NO: 102891 - DNA, 103 bp, Artificial Sequence
  Synthetic Polynucleotide
taatacgactcactatagggcagcaacagcttgtgctggagtgagtaaccaacagaggagaggttacatgctccagcacaacctggcggcagcgcaaaagatg

SEQ ID NO: 102892 - DNA, 103 bp, Artificial Sequence
  Synthetic Polynucleotide
taatacgactcactataggggtgtcccagtcagcaacagcttgtgctggaaacagaggagatccagcatgagctgttgcaacctggcggcagcgcaaaagatg

SEQ ID NO: 102893 - DNA, 103 bp, Artificial Sequence
  Synthetic Polynucleotide
taatacgactcactatagggtcctcctcctccacaaactctggcccctccaacagaggagaggagggatgagagtttgtaacctggcggcagcgcaaaagatg

SEQ ID NO: 102894 - DNA, 103 bp, Artificial Sequence
  Synthetic Polynucleotide
taatacgactcactatagggttttgtaatggtgtcccagtcagcaacagcaacagaggagagctgttatggactgggacaacctggcggcagcgcaaaagatg

SEQ ID NO: 102895 - DNA, 103 bp, Artificial Sequence
  Synthetic Polynucleotide
taatacgactcactatagggttccagattgttttgtaatggtgtcccagtaacagaggagaactgggatgccattacaaaacctggcggcagcgcaaaagatg

SEQ ID NO: 102896 - DNA, 103 bp, Artificial Sequence
  Synthetic Polynucleotide
taatacgactcactataggggaaacaactcttccagattgttttgtaatgaacagaggagacattacatgacaatctggaacctggcggcagcgcaaaagatg

SEQ ID NO: 102897 - DNA, 103 bp, Artificial Sequence
  Synthetic Polynucleotide
taatacgactcactatagggttgagcagatgaaacaactcttccagattgaacagaggagacaatctatgagagttgttaacctggcggcagcgcaaaagatg

SEQ ID NO: 102898 - DNA, 103 bp, Artificial Sequence
  Synthetic Polynucleotide
taatacgactcactatagggggtgagaaagttgagcagatgaaacaactcaacagaggagagagttgatgcatctgctcaacctggcggcagcgcaaaagatg

SEQ ID NO: 102899 - DNA, 103 bp, Artificial Sequence
  Synthetic Polynucleotide
taatacgactcactatagggacctctcgggggtgagaaagttgagcagataacagaggagaatctgcatgactttctcaaacctggcggcagcgcaaaagatg

SEQ ID NO: 102900 - DNA, 103 bp, Artificial Sequence
  Synthetic Polynucleotide
taatacgactcactatagggaaattgtggaacctctcgggggtgagaaagaacagaggagactttctatgccccgagagaacctggcggcagcgcaaaagatg

SEQ ID NO: 102901 - DNA, 103 bp, Artificial Sequence
  Synthetic Polynucleotide
taatacgactcactatagggaaaaccttccaaattgtggaacctctcgggaacagaggagacccgagatgttccacaataacctggcggcagcgcaaaagatg

SEQ ID NO: 102902 - DNA, 103 bp, Artificial Sequence
  Synthetic Polynucleotide
taatacgactcactatagggactcctccaaaaaaccttccaaattgtggaaacagaggagatccacaatgtggaaggttaacctggcggcagcgcaaaagatg

SEQ ID NO: 102903 - DNA, 103 bp, Artificial Sequence
  Synthetic Polynucleotide
taatacgactcactatagggatgtcagcaaactcctccaaaaaaccttccaacagaggagaggaaggatgtttggaggaaacctggcggcagcgcaaaagatg

SEQ ID NO: 102904 - DNA, 103 bp, Artificial Sequence
  Synthetic Polynucleotide
taatacgactcactatagggagccacctcttcctcctcctccacaaactcaacagaggagagagtttatggaggaggagaacctggcggcagcgcaaaagatg

SEQ ID NO: 102905 - DNA, 103 bp, Artificial Sequence
  Synthetic Polynucleotide
taatacgactcactatagggctccttggcaatgtcagcaaactcctccaaaacagaggagattggagatgtttgctgacaacctggcggcagcgcaaaagatg

SEQ ID NO: 102906 - DNA, 103 bp, Artificial Sequence
  Synthetic Polynucleotide
taatacgactcactatagggttatctggtcctccttggcaatgtcagcaaaacagaggagattgctgatgttgccaaggaacctggcggcagcgcaaaagatg

SEQ ID NO: 102907 - DNA, 103 bp, Artificial Sequence
  Synthetic Polynucleotide
taatacgactcactatagggtgcagtttttttatctggtcctccttggcaaacagaggagatgccaaatgggaccagataacctggcggcagcgcaaaagatg

SEQ ID NO: 102908 - DNA, 103 bp, Artificial Sequence
  Synthetic Polynucleotide
taatacgactcactatagggcagcatgtcatgcagtttttttatctggtcaacagaggagagaccagatgaaaaaactgaacctggcggcagcgcaaaagatg

SEQ ID NO: 102909 - DNA, 103 bp, Artificial Sequence
  Synthetic Polynucleotide
taatacgactcactatagggtgtgcggccccagcatgtcatgcagtttttaacagaggagaaaaaacatgatgacatgcaacctggcggcagcgcaaaagatg

SEQ ID NO: 102910 - DNA, 103 bp, Artificial Sequence
  Synthetic Polynucleotide
taatacgactcactatagggcgccgcaacatgtgcggccccagcatgtcaaacagaggagatgacatatgggggccgcaaacctggcggcagcgcaaaagatg

SEQ ID NO: 102911 - DNA, 103 bp, Artificial Sequence
  Synthetic Polynucleotide
taatacgactcactatagggggctttgagccgccgcaacatgtgcggcccaacagaggagagggccgatgatgttgcggaacctggcggcagcgcaaaagatg

SEQ ID NO: 102912 - DNA, 103 bp, Artificial Sequence
  Synthetic Polynucleotide
taatacgactcactatagggtgaacacatcggctttgagccgccgcaacaaacagaggagatgttgcatgggctcaaagaacctggcggcagcgcaaaagatg

SEQ ID NO: 102913 - DNA, 103 bp, Artificial Sequence
  Synthetic Polynucleotide
taatacgactcactatagggggcatgttcttgaacacatcggctttgagcaacagaggagagctcaaatgcgatgtgttaacctggcggcagcgcaaaagatg

SEQ ID NO: 102914 - DNA, 103 bp, Artificial Sequence
  Synthetic Polynucleotide
taatacgactcactatagggtgtcttggagggcatgttcttgaacacatcaacagaggagagatgtgatgaagaacatgaacctggcggcagcgcaaaagatg

SEQ ID NO: 102915 - DNA, 103 bp, Artificial Sequence
  Synthetic Polynucleotide
taatacgactcactatagggctgagcgcagagccacctcttcctcctcctaacagaggagaaggaggatgaagaggtggaacctggcggcagcgcaaaagatg

SEQ ID NO: 102916 - DNA, 103 bp, Artificial Sequence
  Synthetic Polynucleotide
taatacgactcactatagggcaattagttctgtcttggagggcatgttctaacagaggagaagaacaatgcctccaagaaacctggcggcagcgcaaaagatg

SEQ ID NO: 102917 - DNA, 103 bp, Artificial Sequence
  Synthetic Polynucleotide
taatacgactcactatagggtccacacgcacaattagttctgtcttggagaacagaggagactccaaatgagaactaataacctggcggcagcgcaaaagatg

SEQ ID NO: 102918 - DNA, 103 bp, Artificial Sequence
  Synthetic Polynucleotide
taatacgactcactatagggagggctcagctccacacgcacaattagttcaacagaggagagaactaatggtgcgtgtgaacctggcggcagcgcaaaagatg

SEQ ID NO: 102919 - DNA, 103 bp, Artificial Sequence
  Synthetic Polynucleotide
taatacgactcactatagggtcttctgcatagggctcagctccacacgcaaacagaggagatgcgtgatgagctgagccaacctggcggcagcgcaaaagatg

SEQ ID NO: 102920 - DNA, 103 bp, Artificial Sequence
  Synthetic Polynucleotide
taatacgactcactatagggttgtagtatttcttctgcatagggctcagcaacagaggagagctgagatgtatgcagaaaacctggcggcagcgcaaaagatg

SEQ ID NO: 102921 - DNA, 103 bp, Artificial Sequence
  Synthetic Polynucleotide
taatacgactcactataggggaggatgtacttgtagtatttcttctgcataacagaggagaatgcagatgaaatactacaacctggcggcagcgcaaaagatg

SEQ ID NO: 102922 - DNA, 103 bp, Artificial Sequence
  Synthetic Polynucleotide
taatacgactcactatagggaatttcgagtgaggatgtacttgtagtattaacagaggagaaatactatgagtacatccaacctggcggcagcgcaaaagatg

SEQ ID NO: 102923 - DNA, 103 bp, Artificial Sequence
  Synthetic Polynucleotide
taatacgactcactatagggagtgcttcaaaatttcgagtgaggatgtacaacagaggagagtacatatgcactcgaaaaacctggcggcagcgcaaaagatg

SEQ ID NO: 102924 - DNA, 103 bp, Artificial Sequence
  Synthetic Polynucleotide
taatacgactcactatagggtcgggcattgagtgcttcaaaatttcgagtaacagaggagaactcgaatgtttgaagcaaacctggcggcagcgcaaaagatg

SEQ ID NO: 102925 - DNA, 103 bp, Artificial Sequence
  Synthetic Polynucleotide
taatacgactcactatagggtgccaccacctcgggcattgagtgcttcaaaacagaggagattgaagatgtcaatgcccaacctggcggcagcgcaaaagatg

SEQ ID NO: 102926 - DNA, 103 bp, Artificial Sequence
  Synthetic Polynucleotide
taatacgactcactatagggtcctcactgcccgccgagcagggggacgggaacagaggagacccgtcatgctgctcggcaacctggcggcagcgcaaaagatg

SEQ ID NO: 102927 - DNA, 103 bp, Artificial Sequence
  Synthetic Polynucleotide
taatacgactcactatagggccctcactgtctgagcgcagagccacctctaacagaggagaagaggtatgtctgcgctcaacctggcggcagcgcaaaagatg

SEQ ID NO: 102928 - DNA, 103 bp, Artificial Sequence
  Synthetic Polynucleotide
taatacgactcactataggggacacctggttgccaccacctcgggcattgaacagaggagacaatgcatgaggtggtggaacctggcggcagcgcaaaagatg

SEQ ID NO: 102929 - DNA, 103 bp, Artificial Sequence
  Synthetic Polynucleotide
taatacgactcactatagggattcagcagagacacctggttgccaccaccaacagaggagaggtggtatgaaccaggtgaacctggcggcagcgcaaaagatg

SEQ ID NO: 102930 - DNA, 103 bp, Artificial Sequence
  Synthetic Polynucleotide
taatacgactcactatagggccatcaccacattcagcagagacacctggtaacagaggagaaccaggatgctctgctgaaacctggcggcagcgcaaaagatg

SEQ ID NO: 102931 - DNA, 103 bp, Artificial Sequence
  Synthetic Polynucleotide
taatacgactcactatagggttcttaagatccatcaccacattcagcagaaacagaggagatctgctatgtgtggtgataacctggcggcagcgcaaaagatg

SEQ ID NO: 102932 - DNA, 103 bp, Artificial Sequence
  Synthetic Polynucleotide
taatacgactcactataggggttgcagcacttcttaagatccatcaccacaacagaggagagtggtgatggatcttaagaacctggcggcagcgcaaaagatg

SEQ ID NO: 102933 - DNA, 103 bp, Artificial Sequence
  Synthetic Polynucleotide
taatacgactcactatagggggtatggatggttgcagcacttcttaagataacagaggagaatcttaatgagtgctgcaaacctggcggcagcgcaaaagatg

SEQ ID NO: 102934 - DNA, 103 bp, Artificial Sequence
  Synthetic Polynucleotide
taatacgactcactatagggacagggaagaggtatggatggttgcagcacaacagaggagagtgctgatgccatccataaacctggcggcagcgcaaaagatg

SEQ ID NO: 102935 - DNA, 103 bp, Artificial Sequence
  Synthetic Polynucleotide
taatacgactcactatagggcattgcagccacagggaagaggtatggatgaacagaggagacatccaatgctcttccctaacctggcggcagcgcaaaagatg

SEQ ID NO: 102936 - DNA, 103 bp, Artificial Sequence
  Synthetic Polynucleotide
taatacgactcactatagggtaggagcttccattgcagccacagggaagaaacagaggagatcttccatgtggctgcaaaacctggcggcagcgcaaaagatg

SEQ ID NO: 102937 - DNA, 103 bp, Artificial Sequence
  Synthetic Polynucleotide
taatacgactcactatagggttaggcatcttaggagcttccattgcagccaacagaggagaggctgcatgggaagctccaacctggcggcagcgcaaaagatg

SEQ ID NO: 102938 - DNA, 103 bp, Artificial Sequence
  Synthetic Polynucleotide
taatacgactcactatagggatagtcgctgccctcactgtctgagcgcagaacagaggagactgcgcatggacagtgagaacctggcggcagcgcaaaagatg

SEQ ID NO: 102939 - DNA, 103 bp, Artificial Sequence
  Synthetic Polynucleotide
taatacgactcactatagggatacatgccattaggcatcttaggagcttcaacagaggagagaagctatgaagatgcctaacctggcggcagcgcaaaagatg

SEQ ID NO: 102940 - DNA, 103 bp, Artificial Sequence
  Synthetic Polynucleotide
taatacgactcactatagggcactgccatcatacatgccattaggcatctaacagaggagaagatgcatgatggcatgtaacctggcggcagcgcaaaagatg

SEQ ID NO: 102941 - DNA, 103 bp, Artificial Sequence
  Synthetic Polynucleotide
taatacgactcactatagggctgattagggcactgccatcatacatgccaaacagaggagatggcatatgtgatggcagaacctggcggcagcgcaaaagatg

SEQ ID NO: 102942 - DNA, 103 bp, Artificial Sequence
  Synthetic Polynucleotide
taatacgactcactatagggcccagatgctctgattagggcactgccatcaacagaggagagatggcatggccctaatcaacctggcggcagcgcaaaagatg

SEQ ID NO: 102943 - DNA, 103 bp, Artificial Sequence
  Synthetic Polynucleotide
taatacgactcactataggggcaataatttcccagatgctctgattagggaacagaggagaccctaaatggagcatctgaacctggcggcagcgcaaaagatg

SEQ ID NO: 102944 - DNA, 103 bp, Artificial Sequence
  Synthetic Polynucleotide
taatacgactcactatagggttctgcagcagcaataatttcccagatgctaacagaggagaagcatcatggaaattattaacctggcggcagcgcaaaagatg

SEQ ID NO: 102945 - DNA, 103 bp, Artificial Sequence
  Synthetic Polynucleotide
taatacgactcactatagggcttgagcattttctgcagcagcaataatttaacagaggagaaaattaatgctgctgcagaacctggcggcagcgcaaaagatg

SEQ ID NO: 102946 - DNA, 103 bp, Artificial Sequence
  Synthetic Polynucleotide
taatacgactcactatagggccttaaggttcttgagcattttctgcagcaaacagaggagatgctgcatgaaatgctcaaacctggcggcagcgcaaaagatg

SEQ ID NO: 102947 - DNA, 103 bp, Artificial Sequence
  Synthetic Polynucleotide
taatacgactcactatagggtgcccaccctccttaaggttcttgagcattaacagaggagaaatgctatggaaccttaaaacctggcggcagcgcaaaagatg

SEQ ID NO: 102948 - DNA, 103 bp, Artificial Sequence
  Synthetic Polynucleotide
taatacgactcactataggggagtacacgatgcccaccctccttaaggttaacagaggagaaaccttatggagggtgggaacctggcggcagcgcaaaagatg

SEQ ID NO: 102949 - DNA, 103 bp, Artificial Sequence
  Synthetic Polynucleotide
taatacgactcactatagggtgccaggagtatagtcgctgccctcactgtaacagaggagaacagtgatggcagcgactaacctggcggcagcgcaaaagatg

SEQ ID NO: 102950 - DNA, 103 bp, Artificial Sequence
  Synthetic Polynucleotide
taatacgactcactataggggggaaaagatgagtacacgatgcccaccctaacagaggagaagggtgatgatcgtgtacaacctggcggcagcgcaaaagatg

SEQ ID NO: 102951 - DNA, 103 bp, Artificial Sequence
  Synthetic Polynucleotide
taatacgactcactatagggttggtcatctgggaaaagatgagtacacgaaacagaggagatcgtgtatgcatcttttcaacctggcggcagcgcaaaagatg

SEQ ID NO: 102952 - DNA, 103 bp, Artificial Sequence
  Synthetic Polynucleotide
taatacgactcactataggggtctagcatcttggtcatctgggaaaagataacagaggagaatctttatgcagatgaccaacctggcggcagcgcaaaagatg

SEQ ID NO: 102953 - DNA, 103 bp, Artificial Sequence
  Synthetic Polynucleotide
taatacgactcactatagggcctctagcaggtctagcatcttggtcatctaacagaggagaagatgaatgagatgctagaacctggcggcagcgcaaaagatg

SEQ ID NO: 102954 - DNA, 103 bp, Artificial Sequence
  Synthetic Polynucleotide
taatacgactcactatagggtccaagaaatcctctagcaggtctagcatcaacagaggagagatgctatgcctgctagaaacctggcggcagcgcaaaagatg

SEQ ID NO: 102955 - DNA, 103 bp, Artificial Sequence
  Synthetic Polynucleotide
taatacgactcactatagggaccttcatgttccaagaaatcctctagcagaacagaggagactgctaatggatttcttgaacctggcggcagcgcaaaagatg

SEQ ID NO: 102956 - DNA, 103 bp, Artificial Sequence
  Synthetic Polynucleotide
taatacgactcactatagggcgtatttataaccttcatgttccaagaaataacagaggagaatttctatgaacatgaagaacctggcggcagcgcaaaagatg

SEQ ID NO: 102957 - DNA, 103 bp, Artificial Sequence
  Synthetic Polynucleotide
taatacgactcactatagggtcgatgcgttcgtatttataaccttcatgtaacagaggagaacatgaatgttataaataaacctggcggcagcgcaaaagatg

SEQ ID NO: 102958 - DNA, 103 bp, Artificial Sequence
  Synthetic Polynucleotide
taatacgactcactataggggattccaccatcgatgcgttcgtatttataaacagaggagatataaaatggaacgcatcaacctggcggcagcgcaaaagatg

SEQ ID NO: 102959 - DNA, 103 bp, Artificial Sequence
  Synthetic Polynucleotide
taatacgactcactatagggtgttcccagtgattccaccatcgatgcgttaacagaggagaaacgcaatgatggtggaaaacctggcggcagcgcaaaagatg

SEQ ID NO: 102960 - DNA, 103 bp, Artificial Sequence
  Synthetic Polynucleotide
taatacgactcactatagggttcttcttcttgccaggagtatagtcgctgaacagaggagacagcgaatgtactcctggaacctggcggcagcgcaaaagatg

SEQ ID NO: 102961 - DNA, 103 bp, Artificial Sequence
  Synthetic Polynucleotide
taatacgactcactatagggtcttgccgcatgttcccagtgattccaccaaacagaggagatggtggatgcactgggaaaacctggcggcagcgcaaaagatg

SEQ ID NO: 102962 - DNA, 103 bp, Artificial Sequence
  Synthetic Polynucleotide
taatacgactcactataggggtcaatggcctcttgccgcatgttcccagtaacagaggagaactgggatgatgcggcaaaacctggcggcagcgcaaaagatg

SEQ ID NO: 102963 - DNA, 103 bp, Artificial Sequence
  Synthetic Polynucleotide
taatacgactcactatagggcattgaagcggtcaatggcctcttgccgcaaacagaggagatgcggcatgaggccattgaacctggcggcagcgcaaaagatg

SEQ ID NO: 102964 - DNA, 103 bp, Artificial Sequence
  Synthetic Polynucleotide
taatacgactcactataggggcacccggtgcattgaagcggtcaatggccaacagaggagaggccatatgccgcttcaaaacctggcggcagcgcaaaagatg

SEQ ID NO: 102965 - DNA, 103 bp, Artificial Sequence
  Synthetic Polynucleotide
taatacgactcactataggggaactgctgagcacccggtgcattgaagcgaacagaggagacgcttcatggcaccgggtaacctggcggcagcgcaaaagatg

SEQ ID NO: 102966 - DNA, 103 bp, Artificial Sequence
  Synthetic Polynucleotide
taatacgactcactataggggcaagaagcagaactgctgagcacccggtgaacagaggagacaccggatgctcagcagtaacctggcggcagcgcaaaagatg

SEQ ID NO: 102967 - DNA, 103 bp, Artificial Sequence
  Synthetic Polynucleotide
taatacgactcactatagggcgagtggaaagcaagaagcagaactgctgaaacagaggagatcagcaatgctgcttcttaacctggcggcagcgcaaaagatg

SEQ ID NO: 102968 - DNA, 103 bp, Artificial Sequence
  Synthetic Polynucleotide
taatacgactcactataggggcccccagctcgagtggaaagcaagaagcaaacagaggagatgcttcatgctttccactaacctggcggcagcgcaaaagatg

SEQ ID NO: 102969 - DNA, 103 bp, Artificial Sequence
  Synthetic Polynucleotide
taatacgactcactatagggtgattccaaggcccccagctcgagtggaaaaacagaggagatttccaatggagctggggaacctggcggcagcgcaaaagatg

SEQ ID NO: 102970 - DNA, 103 bp, Artificial Sequence
  Synthetic Polynucleotide
taatacgactcactataggggtggccagattgattccaaggcccccagctaacagaggagaagctggatgccttggaataacctggcggcagcgcaaaagatg

SEQ ID NO: 102971 - DNA, 103 bp, Artificial Sequence
  Synthetic Polynucleotide
taatacgactcactatagggaagcttcttcttcttcttcttgccaggagtaacagaggagaactcctatgaagaagaagaacctggcggcagcgcaaaagatg

SEQ ID NO: 102972 - DNA, 103 bp, Artificial Sequence
  Synthetic Polynucleotide
taatacgactcactatagggtgtgtcagcagtggccagattgattccaagaacagaggagacttggaatgaatctggccaacctggcggcagcgcaaaagatg

SEQ ID NO: 102973 - DNA, 103 bp, Artificial Sequence
  Synthetic Polynucleotide
taatacgactcactatagggagataataactgtgtcagcagtggccagataacagaggagaatctggatgctgctgacaaacctggcggcagcgcaaaagatg

SEQ ID NO: 102974 - DNA, 103 bp, Artificial Sequence
  Synthetic Polynucleotide
taatacgactcactatagggtcagagtcatagataataactgtgtcagcaaacagaggagatgctgaatgagttattataacctggcggcagcgcaaaagatg

SEQ ID NO: 102975 - DNA, 103 bp, Artificial Sequence
  Synthetic Polynucleotide
taatacgactcactatagggggggttccagtcagagtcatagataataacaacagaggagagttattatgtatgactctaacctggcggcagcgcaaaagatg

SEQ ID NO: 102976 - DNA, 103 bp, Artificial Sequence
  Synthetic Polynucleotide
taatacgactcactatagggtgtcattatgggggttccagtcagagtcataacagaggagaatgactatgactggaaccaacctggcggcagcgcaaaagatg

SEQ ID NO: 102977 - DNA, 103 bp, Artificial Sequence
  Synthetic Polynucleotide
taatacgactcactatagggaaggcctgaatgtcattatgggggttccagaacagaggagactggaaatgccataatgaaacctggcggcagcgcaaaagatg

SEQ ID NO: 102978 - DNA, 103 bp, Artificial Sequence
  Synthetic Polynucleotide
taatacgactcactatagggagctctgctaaaggcctgaatgtcattatgaacagaggagacataatatgattcaggccaacctggcggcagcgcaaaagatg

SEQ ID NO: 102979 - DNA, 103 bp, Artificial Sequence
  Synthetic Polynucleotide
taatacgactcactatagggcaatccggtgagctctgctaaaggcctgaaaacagaggagattcaggatgttagcagagaacctggcggcagcgcaaaagatg

SEQ ID NO: 102980 - DNA, 103 bp, Artificial Sequence
  Synthetic Polynucleotide
taatacgactcactatagggttattttgcccaatccggtgagctctgctaaacagaggagatagcagatgtcaccggataacctggcggcagcgcaaaagatg

SEQ ID NO: 102981 - DNA, 103 bp, Artificial Sequence
  Synthetic Polynucleotide
taatacgactcactatagggcattacctttttattttgcccaatccggtgaacagaggagacaccggatggggcaaaataacctggcggcagcgcaaaagatg

SEQ ID NO: 102982 - DNA, 103 bp, Artificial Sequence
  Synthetic Polynucleotide
taatacgactcactatagggtcttaggtccaagcttcttcttcttcttctaacagaggagaagaagaatgagaagaagcaacctggcggcagcgcaaaagatg

SEQ ID NO: 102983 - DNA, 103 bp, Artificial Sequence
  Synthetic Polynucleotide
taatacgactcactatagggaccggtagatcattacctttttattttgccaacagaggagaggcaaaatgaaaaggtaaaacctggcggcagcgcaaaagatg

SEQ ID NO: 102984 - DNA, 103 bp, Artificial Sequence
  Synthetic Polynucleotide
taatacgactcactatagggcgggtcacaaaccggtagatcattacctttaacagaggagaaaaggtatggatctaccgaacctggcggcagcgcaaaagatg

SEQ ID NO: 102985 - DNA, 103 bp, Artificial Sequence
  Synthetic Polynucleotide
taatacgactcactatagggcactgacgcacgggtcacaaaccggtagataacagaggagaatctacatgtttgtgaccaacctggcggcagcgcaaaagatg

SEQ ID NO: 102986 - DNA, 103 bp, Artificial Sequence
  Synthetic Polynucleotide
taatacgactcactatagggtgcgctcctccactgacgcacgggtcacaaaacagaggagattgtgaatggtgcgtcagaacctggcggcagcgcaaaagatg

SEQ ID NO: 102987 - DNA, 103 bp, Artificial Sequence
  Synthetic Polynucleotide
taatacgactcactatagggacctgcgtgatgcgctcctccactgacgcaaacagaggagatgcgtcatgggaggagcgaacctggcggcagcgcaaaagatg

SEQ ID NO: 102988 - DNA, 103 bp, Artificial Sequence
  Synthetic Polynucleotide
taatacgactcactatagggcttctttgccacctgcgtgatgcgctcctcaacagaggagagaggagatgatcacgcagaacctggcggcagcgcaaaagatg

SEQ ID NO: 102989 - DNA, 103 bp, Artificial Sequence
  Synthetic Polynucleotide
taatacgactcactataggggcatcattttcttctttgccacctgcgtgaaacagaggagatcacgcatgtggcaaagaaacctggcggcagcgcaaaagatg

SEQ ID NO: 102990 - DNA, 103 bp, Artificial Sequence
  Synthetic Polynucleotide
taatacgactcactatagggagatgcgtcagcatcattttcttctttgccaacagaggagaggcaaaatggaaaatgataacctggcggcagcgcaaaagatg

SEQ ID NO: 102991 - DNA, 103 bp, Artificial Sequence
  Synthetic Polynucleotide
taatacgactcactatagggccgcaccactagatgcgtcagcatcattttaacagaggagaaaaatgatgctgacgcataacctggcggcagcgcaaaagatg

SEQ ID NO: 102992 - DNA, 103 bp, Artificial Sequence
  Synthetic Polynucleotide
taatacgactcactatagggccagcccaggccgcaccactagatgcgtcaaacagaggagatgacgcatgtagtggtgcaacctggcggcagcgcaaaagatg

SEQ ID NO: 102993 - DNA, 103 bp, Artificial Sequence
  Synthetic Polynucleotide
taatacgactcactatagggttcttctctttcttaggtccaagcttcttcaacagaggagagaagaaatgtggacctaaaacctggcggcagcgcaaaagatg

SEQ ID NO: 102994 - DNA, 103 bp, Artificial Sequence
  Synthetic Polynucleotide
taatacgactcactataggggtcttggagcccagcccaggccgcaccactaacagaggagaagtggtatggcctgggctaacctggcggcagcgcaaaagatg

SEQ ID NO: 102995 - DNA, 103 bp, Artificial Sequence
  Synthetic Polynucleotide
taatacgactcactatagggcatagatccagtcttggagcccagcccaggaacagaggagacctgggatgggctccaagaacctggcggcagcgcaaaagatg

SEQ ID NO: 102996 - DNA, 103 bp, Artificial Sequence
  Synthetic Polynucleotide
taatacgactcactatagggcctgtttggacatagatccagtcttggagcaacagaggagagctccaatgctggatctaaacctggcggcagcgcaaaagatg

SEQ ID NO: 102997 - DNA, 103 bp, Artificial Sequence
  Synthetic Polynucleotide
taatacgactcactatagggtcatcaagctcctgtttggacatagatccaaacagaggagatggatcatggtccaaacaaacctggcggcagcgcaaaagatg

SEQ ID NO: 102998 - DNA, 103 bp, Artificial Sequence
  Synthetic Polynucleotide
taatacgactcactatagggtttgaggatatcatcaagctcctgtttggaaacagaggagatccaaaatggagcttgataacctggcggcagcgcaaaagatg

SEQ ID NO: 102999 - DNA, 103 bp, Artificial Sequence
  Synthetic Polynucleotide
taatacgactcactatagggcagtgccaaatttgaggatatcatcaagctaacagaggagaagcttgatgatatcctcaaacctggcggcagcgcaaaagatg

SEQ ID NO: 103000 - DNA, 103 bp, Artificial Sequence
  Synthetic Polynucleotide
taatacgactcactatagggaatagttcctcagtgccaaatttgaggataaacagaggagatatcctatgatttggcacaacctggcggcagcgcaaaagatg

SEQ ID NO: 103001 - DNA, 103 bp, Artificial Sequence
  Synthetic Polynucleotide
taatacgactcactatagggttcatccttgaatagttcctcagtgccaaaaacagaggagatttggcatggaggaactaaacctggcggcagcgcaaaagatg

SEQ ID NO: 103002 - DNA, 103 bp, Artificial Sequence
  Synthetic Polynucleotide
taatacgactcactatagggcatcagtggcttcatccttgaatagttcctaacagaggagaaggaacatgtcaaggatgaacctggcggcagcgcaaaagatg

SEQ ID NO: 103003 - DNA, 103 bp, Artificial Sequence
  Synthetic Polynucleotide
taatacgactcactatagggtctcctcctccatcagtggcttcatccttgaacagaggagacaaggaatgagccactgaaacctggcggcagcgcaaaagatg

SEQ ID NO: 103004 - DNA, 103 bp, Artificial Sequence
  Synthetic Polynucleotide
taatacgactcactatagggggatttgctcttcttctctttcttaggtccaacagaggagaggacctatgaaagagaagaacctggcggcagcgcaaaagatg

SEQ ID NO: 103005 - DNA, 103 bp, Artificial Sequence
  Synthetic Polynucleotide
taatacgactcactatagggctctttgttgtctcctcctccatcagtggcaacagaggagagccactatgggaggaggaaacctggcggcagcgcaaaagatg

SEQ ID NO: 103006 - DNA, 103 bp, Artificial Sequence
  Synthetic Polynucleotide
taatacgactcactatagggtatcttctccctctttgttgtctcctcctcaacagaggagagaggagatgacaacaaagaacctggcggcagcgcaaaagatg

SEQ ID NO: 103007 - DNA, 103 bp, Artificial Sequence
  Synthetic Polynucleotide
taatacgactcactatagggataacactgctatcttctccctctttgttgaacagaggagacaacaaatggggagaagaaacctggcggcagcgcaaaagatg

SEQ ID NO: 103008 - DNA, 103 bp, Artificial Sequence
  Synthetic Polynucleotide
taatacgactcactatagggatcgtagtggataacactgctatcttctccaacagaggagaggagaaatgagcagtgttaacctggcggcagcgcaaaagatg

SEQ ID NO: 103009 - DNA, 103 bp, Artificial Sequence
  Synthetic Polynucleotide
taatacgactcactatagggtggccttatcatcgtagtggataacactgcaacagaggagagcagtgatgtccactacgaacctggcggcagcgcaaaagatg

SEQ ID NO: 103010 - DNA, 103 bp, Artificial Sequence
  Synthetic Polynucleotide
taatacgactcactatagggagccgttcaatggccttatcatcgtagtggaacagaggagaccactaatgtgataaggcaacctggcggcagcgcaaaagatg

SEQ ID NO: 103011 - DNA, 103 bp, Artificial Sequence
  Synthetic Polynucleotide
taatacgactcactatagggacggtctagcagccgttcaatggccttatcaacagaggagagataagatgattgaacggaacctggcggcagcgcaaaagatg

SEQ ID NO: 103012 - DNA, 103 bp, Artificial Sequence
  Synthetic Polynucleotide
taatacgactcactatagggcatcctggttacggtctagcagccgttcaaaacagaggagattgaacatgtgctagaccaacctggcggcagcgcaaaagatg

SEQ ID NO: 103013 - DNA, 103 bp, Artificial Sequence
  Synthetic Polynucleotide
taatacgactcactatagggtcttcagtctcatcctggttacggtctagcaacagaggagagctagaatgtaaccaggaaacctggcggcagcgcaaaagatg

SEQ ID NO: 103014 - DNA, 103 bp, Artificial Sequence
  Synthetic Polynucleotide
taatacgactcactatagggcaattctgtgtcttcagtctcatcctggttaacagaggagaaaccagatggagactgaaaacctggcggcagcgcaaaagatg

SEQ ID NO: 103015 - DNA, 103 bp, Artificial Sequence
  Synthetic Polynucleotide
taatacgactcactatagggccttccgcttggatttgctcttcttctcttaacagaggagaaagagaatgagagcaaataacctggcggcagcgcaaaagatg

SEQ ID NO: 103016 - DNA, 103 bp, Artificial Sequence
  Synthetic Polynucleotide
taatacgactcactatagggtcatgccctgcaattctgtgtcttcagtctaacagaggagaagactgatgacacagaataacctggcggcagcgcaaaagatg

SEQ ID NO: 103017 - DNA, 103 bp, Artificial Sequence
  Synthetic Polynucleotide
taatacgactcactatagggaaatattcattcatgccctgcaattctgtgaacagaggagacacagaatggcagggcataacctggcggcagcgcaaaagatg

SEQ ID NO: 103018 - DNA, 103 bp, Artificial Sequence
  Synthetic Polynucleotide
taatacgactcactataggggaatgagctcaaatattcattcatgccctgaacagaggagacagggcatgaatgaatataacctggcggcagcgcaaaagatg

SEQ ID NO: 103019 - DNA, 103 bp, Artificial Sequence
  Synthetic Polynucleotide
taatacgactcactataggggggccactttgaatgagctcaaatattcataacagaggagaatgaatatgtgagctcataacctggcggcagcgcaaaagatg

SEQ ID NO: 103020 - DNA, 103 bp, Artificial Sequence
  Synthetic Polynucleotide
taatacgactcactatagggaccacatactgggccactttgaatgagctcaacagaggagagagctcatgcaaagtggcaacctggcggcagcgcaaaagatg

SEQ ID NO: 103021 - DNA, 103 bp, Artificial Sequence
  Synthetic Polynucleotide
taatacgactcactatagggttcttcccgtaccacatactgggccactttaacagaggagaaaagtgatgcagtatgtgaacctggcggcagcgcaaaagatg

SEQ ID NO: 103022 - DNA, 103 bp, Artificial Sequence
  Synthetic Polynucleotide
taatacgactcactatagggcccccatttcttcttcccgtaccacatactaacagaggagaagtatgatgtacgggaagaacctggcggcagcgcaaaagatg

SEQ ID NO: 103023 - DNA, 103 bp, Artificial Sequence
  Synthetic Polynucleotide
taatacgactcactatagggtcctcttcctcccccatttcttcttcccgtaacagaggagaacgggaatgagaaatgggaacctggcggcagcgcaaaagatg

SEQ ID NO: 103024 - DNA, 103 bp, Artificial Sequence
  Synthetic Polynucleotide
taatacgactcactatagggccgttctacctcctcttcctcccccatttcaacagaggagagaaatgatggaggaagagaacctggcggcagcgcaaaagatg

SEQ ID NO: 103025 - DNA, 103 bp, Artificial Sequence
  Synthetic Polynucleotide
taatacgactcactatagggtaatgatttcccgttctacctcctcttcctaacagaggagaaggaagatgaggtagaacaacctggcggcagcgcaaaagatg

SEQ ID NO: 103026 - DNA, 103 bp, Artificial Sequence
  Synthetic Polynucleotide
taatacgactcactatagggtcctcctcctccttccgcttggatttgctcaacagaggagagagcaaatgcaagcggaaaacctggcggcagcgcaaaagatg

SEQ ID NO: 103027 - DNA, 103 bp, Artificial Sequence
  Synthetic Polynucleotide
taatacgactcactatagggtcttcctgtttaatgatttcccgttctaccaacagaggagaggtagaatgggaaatcataacctggcggcagcgcaaaagatg

SEQ ID NO: 103028 - DNA, 103 bp, Artificial Sequence
  Synthetic Polynucleotide
taatacgactcactatagggatccacactttcttcctgtttaatgatttcaacagaggagagaaatcatgaaacaggaaaacctggcggcagcgcaaaagatg

SEQ ID NO: 103029 - DNA, 103 bp, Artificial Sequence
  Synthetic Polynucleotide
taatacgactcactatagggagtagtcaggatccacactttcttcctgttaacagaggagaaacaggatgaaagtgtggaacctggcggcagcgcaaaagatg

SEQ ID NO: 103030 - DNA, 103 bp, Artificial Sequence
  Synthetic Polynucleotide
taatacgactcactatagggaatttctcccagtagtcaggatccacacttaacagaggagaaagtgtatgtcctgactaaacctggcggcagcgcaaaagatg

SEQ ID NO: 103031 - DNA, 103 bp, Artificial Sequence
  Synthetic Polynucleotide
taatacgactcactataggggtgccgcagcaatttctcccagtagtcaggaacagaggagacctgacatgtgggagaaaaacctggcggcagcgcaaaagatg

SEQ ID NO: 103032 - DNA, 103 bp, Artificial Sequence
  Synthetic Polynucleotide
taatacgactcactataggggctcataatggtgccgcagcaatttctcccaacagaggagagggagaatgtgctgcggcaacctggcggcagcgcaaaagatg

SEQ ID NO: 103033 - DNA, 103 bp, Artificial Sequence
  Synthetic Polynucleotide
taatacgactcactatagggtcttgctgctgctcataatggtgccgcagcaacagaggagagctgcgatgccattatgaaacctggcggcagcgcaaaagatg

SEQ ID NO: 103034 - DNA, 103 bp, Artificial Sequence
  Synthetic Polynucleotide
taatacgactcactatagggggctagatcttcttgctgctgctcataatgaacagaggagacattatatgcagcagcaaaacctggcggcagcgcaaaagatg

SEQ ID NO: 103035 - DNA, 103 bp, Artificial Sequence
  Synthetic Polynucleotide
taatacgactcactatagggccagatttcgggctagatcttcttgctgctaacagaggagaagcagcatgaagatctagaacctggcggcagcgcaaaagatg

SEQ ID NO: 103036 - DNA, 103 bp, Artificial Sequence
  Synthetic Polynucleotide
taatacgactcactatagggtttcctttgcccagatttcgggctagatctaacagaggagaagatctatgccgaaatctaacctggcggcagcgcaaaagatg

SEQ ID NO: 103037 - DNA, 103 bp, Artificial Sequence
  Synthetic Polynucleotide
taatacgactcactatagggcatatcctcctcctcactgcccgccgagcaaacagaggagatgctcgatgggcagtgagaacctggcggcagcgcaaaagatg

SEQ ID NO: 103038 - DNA, 103 bp, Artificial Sequence
  Synthetic Polynucleotide
taatacgactcactatagggatcctcctcctcctcctcctccttccgcttaacagaggagaaagcggatggaggaggagaacctggcggcagcgcaaaagatg

SEQ ID NO: 103039 - DNA, 103 bp, Artificial Sequence
  Synthetic Polynucleotide
taatacgactcactatagggacggattctttttcctttgcccagatttcgaacagaggagacgaaatatgggcaaaggaaacctggcggcagcgcaaaagatg

SEQ ID NO: 103040 - DNA, 103 bp, Artificial Sequence
  Synthetic Polynucleotide
taatacgactcactatagggtgacctgtttacggattctttttcctttgcaacagaggagagcaaagatgaaagaatccaacctggcggcagcgcaaaagatg

SEQ ID NO: 103041 - DNA, 103 bp, Artificial Sequence
  Synthetic Polynucleotide
taatacgactcactatagggtcattgtagttgacctgtttacggattcttaacagaggagaaagaatatgtaaacaggtaacctggcggcagcgcaaaagatg

SEQ ID NO: 103042 - DNA, 103 bp, Artificial Sequence
  Synthetic Polynucleotide
taatacgactcactatagggctgggagccatcattgtagttgacctgtttaacagaggagaaaacagatgaactacaataacctggcggcagcgcaaaagatg

SEQ ID NO: 103043 - DNA, 103 bp, Artificial Sequence
  Synthetic Polynucleotide
taatacgactcactatagggctcggtcctcctgggagccatcattgtagtaacagaggagaactacaatgatggctcccaacctggcggcagcgcaaaagatg

SEQ ID NO: 103044 - DNA, 103 bp, Artificial Sequence
  Synthetic Polynucleotide
taatacgactcactatagggccacacacacctcggtcctcctgggagccaaacagaggagatggctcatgggaggaccgaacctggcggcagcgcaaaagatg

SEQ ID NO: 103045 - DNA, 103 bp, Artificial Sequence
  Synthetic Polynucleotide
taatacgactcactataggggcggggccggccacacacacctcggtcctcaacagaggagagaggacatgggtgtgtgtaacctggcggcagcgcaaaagatg

SEQ ID NO: 103046 - DNA, 103 bp, Artificial Sequence
  Synthetic Polynucleotide
taatacgactcactatagggtgggtggggggcggggccggccacacacacaacagaggagagtgtgtatggccggccccaacctggcggcagcgcaaaagatg

SEQ ID NO: 103047 - DNA, 103 bp, Artificial Sequence
  Synthetic Polynucleotide
taatacgactcactataggggaacggcccatgggtggggggcggggccggaacagaggagaccggccatgccccccaccaacctggcggcagcgcaaaagatg

SEQ ID NO: 103048 - DNA, 103 bp, Artificial Sequence
  Synthetic Polynucleotide
taatacgactcactatagggtgctctagtggaacggcccatgggtgggggaacagaggagacccccaatgatgggccgtaacctggcggcagcgcaaaagatg

SEQ ID NO: 103049 - DNA, 103 bp, Artificial Sequence
  Synthetic Polynucleotide
taatacgactcactatagggcatcatcatcatcctcctcctcctcctcctaacagaggagaaggaggatgaggaggaggaacctggcggcagcgcaaaagatg

SEQ ID NO: 103050 - DNA, 103 bp, Artificial Sequence
  Synthetic Polynucleotide
taatacgactcactatagggcggggcccactgctctagtggaacggcccaaacagaggagatgggccatgccactagagaacctggcggcagcgcaaaagatg

SEQ ID NO: 103051 - DNA, 103 bp, Artificial Sequence
  Synthetic Polynucleotide
taatacgactcactatagggggcagatgagcggggcccactgctctagtgaacagaggagacactagatgagtgggcccaacctggcggcagcgcaaaagatg

SEQ ID NO: 103052 - DNA, 103 bp, Artificial Sequence
  Synthetic Polynucleotide
taatacgactcactatagggagggagagagggcagatgagcggggcccacaacagaggagagtgggcatggctcatctgaacctggcggcagcgcaaaagatg

SEQ ID NO: 103053 - DNA, 103 bp, Artificial Sequence
  Synthetic Polynucleotide
taatacgactcactataggggccaatctggagggagagagggcagatgagaacagaggagactcatcatgcctctctccaacctggcggcagcgcaaaagatg

SEQ ID NO: 103054 - DNA, 103 bp, Artificial Sequence
  Synthetic Polynucleotide
taatacgactcactatagggtggtcgtcctgccaatctggagggagagagaacagaggagactctctatgtccagattgaacctggcggcagcgcaaaagatg

SEQ ID NO: 103055 - DNA, 103 bp, Artificial Sequence
  Synthetic Polynucleotide
taatacgactcactataggggttgtcggactggtcgtcctgccaatctggaacagaggagaccagatatgcaggacgacaacctggcggcagcgcaaaagatg

SEQ ID NO: 103056 - DNA, 103 bp, Artificial Sequence
  Synthetic Polynucleotide
taatacgactcactatagggaatcggactggttgtcggactggtcgtcctaacagaggagaaggacgatgagtccgacaaacctggcggcagcgcaaaagatg

SEQ ID NO: 103057 - DNA, 103 bp, Artificial Sequence
  Synthetic Polynucleotide
taatacgactcactataggggccactgagtaatcggactggttgtcggacaacagaggagagtccgaatgccagtccgaaacctggcggcagcgcaaaagatg

SEQ ID NO: 103058 - DNA, 103 bp, Artificial Sequence
  Synthetic Polynucleotide
taatacgactcactatagggttcctctgaagccactgagtaatcggactgaacagaggagacagtccatgtactcagtgaacctggcggcagcgcaaaagatg

SEQ ID NO: 103059 - DNA, 103 bp, Artificial Sequence
  Synthetic Polynucleotide
taatacgactcactatagggcttcatcaccttcctctgaagccactgagtaacagaggagaactcagatgcttcagaggaacctggcggcagcgcaaaagatg

SEQ ID NO: 103060 - DNA, 103 bp, Artificial Sequence
  Synthetic Polynucleotide
taatacgactcactatagggtcctttgaatcatcatcatcatcctcctccaacagaggagaggaggaatgtgatgatgaaacctggcggcagcgcaaaagatg

SEQ ID NO: 103061 - DNA, 103 bp, Artificial Sequence
  Synthetic Polynucleotide
taatacgactcactatagggtcatcaaagtcttcatcaccttcctctgaaaacagaggagattcagaatgaggtgatgaaacctggcggcagcgcaaaagatg

SEQ ID NO: 103062 - DNA, 103 bp, Artificial Sequence
  Synthetic Polynucleotide
taatacgactcactatagggttctgaacgttcatcaaagtcttcatcaccaacagaggagaggtgatatggactttgataacctggcggcagcgcaaaagatg

SEQ ID NO: 103063 - DNA, 103 bp, Artificial Sequence
  Synthetic Polynucleotide
taatacgactcactatagggtacggggagcttctgaacgttcatcaaagtaacagaggagaactttgatgaacgttcagaacctggcggcagcgcaaaagatg

SEQ ID NO: 103064 - DNA, 103 bp, Artificial Sequence
  Synthetic Polynucleotide
taatacgactcactatagggcgactgggcctacggggagcttctgaacgtaacagaggagaacgttcatgagctccccgaacctggcggcagcgcaaaagatg

SEQ ID NO: 103065 - DNA, 103 bp, Artificial Sequence
  Synthetic Polynucleotide
taatacgactcactatagggcaggcccttacgactgggcctacggggagcaacagaggagagctcccatgaggcccagtaacctggcggcagcgcaaaagatg

SEQ ID NO: 103066 - DNA, 103 bp, Artificial Sequence
  Synthetic Polynucleotide
taatacgactcactatagggtatcattccgcaggcccttacgactgggccaacagaggagaggcccaatggtaagggccaacctggcggcagcgcaaaagatg

SEQ ID NO: 103067 - DNA, 103 bp, Artificial Sequence
  Synthetic Polynucleotide
taatacgactcactatagggggcttatctttatcattccgcaggcccttaaacagaggagataagggatggcggaatgaaacctggcggcagcgcaaaagatg

SEQ ID NO: 103068 - DNA, 103 bp, Artificial Sequence
  Synthetic Polynucleotide
taatacgactcactatagggaggaggcaatggcttatctttatcattccgaacagaggagacggaatatgaaagataagaacctggcggcagcgcaaaagatg

SEQ ID NO: 103069 - DNA, 103 bp, Artificial Sequence
  Synthetic Polynucleotide
taatacgactcactataggggggccaacagaggaggcaatggcttatcttaacagaggagaaagataatgcattgcctcaacctggcggcagcgcaaaagatg

SEQ ID NO: 103070 - DNA, 103 bp, Artificial Sequence
  Synthetic Polynucleotide
taatacgactcactatagggccaccaacacgggccaacagaggaggcaataacagaggagaattgccatgtctgttggcaacctggcggcagcgcaaaagatg

SEQ ID NO: 103071 - DNA, 103 bp, Artificial Sequence
  Synthetic Polynucleotide
taatacgactcactatagggtgatttaggctcctttgaatcatcatcatcaacagaggagagatgatatggattcaaagaacctggcggcagcgcaaaagatg

SEQ ID NO: 103072 - DNA, 103 bp, Artificial Sequence
  Synthetic Polynucleotide
taatacgactcactatagggttcaatattcccaccaacacgggccaacagaacagaggagactgttgatgcgtgttggtaacctggcggcagcgcaaaagatg

SEQ ID NO: 103073 - DNA, 103 bp, Artificial Sequence
  Synthetic Polynucleotide
taatacgactcactatagggaaccaagtacttcaatattcccaccaacacaacagaggagagtgttgatgggaatattgaacctggcggcagcgcaaaagatg

SEQ ID NO: 103074 - DNA, 103 bp, Artificial Sequence
  Synthetic Polynucleotide
taatacgactcactatagggcgagcattaaaaccaagtacttcaatattcaacagaggagagaatatatgagtacttggaacctggcggcagcgcaaaagatg

SEQ ID NO: 103075 - DNA, 103 bp, Artificial Sequence
  Synthetic Polynucleotide
taatacgactcactatagggttttcgctgacgagcattaaaaccaagtacaacagaggagagtacttatgtttaatgctaacctggcggcagcgcaaaagatg

SEQ ID NO: 103076 - DNA, 103 bp, Artificial Sequence
  Synthetic Polynucleotide
taatacgactcactatagggtaagaaaggcttttcgctgacgagcattaaaacagaggagattaatgatggtcagcgaaaacctggcggcagcgcaaaagatg

SEQ ID NO: 103077 - DNA, 103 bp, Artificial Sequence
  Synthetic Polynucleotide
taatacgactcactatagggataattgcattaagaaaggcttttcgctgaaacagaggagatcagcgatgagcctttctaacctggcggcagcgcaaaagatg

SEQ ID NO: 103078 - DNA, 103 bp, Artificial Sequence
  Synthetic Polynucleotide
taatacgactcactatagggaccatatcgcataattgcattaagaaaggcaacagaggagagcctttatgaatgcaattaacctggcggcagcgcaaaagatg

SEQ ID NO: 103079 - DNA, 103 bp, Artificial Sequence
  Synthetic Polynucleotide
taatacgactcactataggggaggtggcataccatatcgcataattgcataacagaggagaatgcaaatgtgcgatatgaacctggcggcagcgcaaaagatg

SEQ ID NO: 103080 - DNA, 103 bp, Artificial Sequence
  Synthetic Polynucleotide
taatacgactcactatagggaaagcatcctgaggtggcataccatatcgcaacagaggagagcgataatgtatgccaccaacctggcggcagcgcaaaagatg

SEQ ID NO: 103081 - DNA, 103 bp, Artificial Sequence
  Synthetic Polynucleotide
taatacgactcactatagggctgggtagtaaaagcatcctgaggtggcataacagaggagaatgccaatgcaggatgctaacctggcggcagcgcaaaagatg

SEQ ID NO: 103082 - DNA, 103 bp, Artificial Sequence
  Synthetic Polynucleotide
taatacgactcactataggggctgagcagatgatttaggctcctttgaataacagaggagaattcaaatgagcctaaataacctggcggcagcgcaaaagatg

SEQ ID NO: 103083 - DNA, 103 bp, Artificial Sequence
  Synthetic Polynucleotide
taatacgactcactatagggttacaagccactgggtagtaaaagcatcctaacagaggagaaggatgatgttactacccaacctggcggcagcgcaaaagatg

SEQ ID NO: 103084 - DNA, 103 bp, Artificial Sequence
  Synthetic Polynucleotide
taatacgactcactatagggcgcaggtctcttacaagccactgggtagtaaacagaggagatactacatggtggcttgtaacctggcggcagcgcaaaagatg

SEQ ID NO: 103085 - DNA, 103 bp, Artificial Sequence
  Synthetic Polynucleotide
taatacgactcactatagggtgatttgcctcgcaggtctcttacaagccaaacagaggagatggcttatgagagacctgaacctggcggcagcgcaaaagatg

SEQ ID NO: 103086 - DNA, 103 bp, Artificial Sequence
  Synthetic Polynucleotide
taatacgactcactatagggactctttctctgatttgcctcgcaggtctcaacagaggagagagaccatggaggcaaataacctggcggcagcgcaaaagatg

SEQ ID NO: 103087 - DNA, 103 bp, Artificial Sequence
  Synthetic Polynucleotide
taatacgactcactatagggtatgccttgaactctttctctgatttgcctaacagaggagaaggcaaatgagagaaagaaacctggcggcagcgcaaaagatg

SEQ ID NO: 103088 - DNA, 103 bp, Artificial Sequence
  Synthetic Polynucleotide
taatacgactcactatagggaagagagacatatgccttgaactctttctcaacagaggagagagaaaatgttcaaggcaaacctggcggcagcgcaaaagatg

SEQ ID NO: 103089 - DNA, 103 bp, Artificial Sequence
  Synthetic Polynucleotide
taatacgactcactataggggccgcatgaaaagagagacatatgccttgaaacagaggagatcaaggatgatgtctctcaacctggcggcagcgcaaaagatg

SEQ ID NO: 103090 - DNA, 103 bp, Artificial Sequence
  Synthetic Polynucleotide
taatacgactcactatagggtcacataaatgccgcatgaaaagagagacaaacagaggagatgtctcatgtttcatgcgaacctggcggcagcgcaaaagatg

SEQ ID NO: 103091 - DNA, 103 bp, Artificial Sequence
  Synthetic Polynucleotide
taatacgactcactatagggtgcccccggctcacataaatgccgcatgaaaacagaggagattcatgatgcatttatgtaacctggcggcagcgcaaaagatg

SEQ ID NO: 103092 - DNA, 103 bp, Artificial Sequence
  Synthetic Polynucleotide
taatacgactcactatagggcagccccatctgcccccggctcacataaataacagaggagaatttatatgagccgggggaacctggcggcagcgcaaaagatg

SEQ ID NO: 103093 - DNA, 103 bp, Artificial Sequence
  Synthetic Polynucleotide
taatacgactcactatagggtcttccaggagctgagcagatgatttaggcaacagaggagagcctaaatgatctgctcaaacctggcggcagcgcaaaagatg

SEQ ID NO: 103094 - DNA, 103 bp, Artificial Sequence
  Synthetic Polynucleotide
taatacgactcactataggggcaaaggtctcagccccatctgcccccggcaacagaggagagccgggatgagatggggcaacctggcggcagcgcaaaagatg

SEQ ID NO: 103095 - DNA, 103 bp, Artificial Sequence
  Synthetic Polynucleotide
taatacgactcactataggggacaccatcagcaaaggtctcagccccatcaacagaggagagatgggatggagacctttaacctggcggcagcgcaaaagatg

SEQ ID NO: 103096 - DNA, 103 bp, Artificial Sequence
  Synthetic Polynucleotide
taatacgactcactatagggcttctcgggggacaccatcagcaaaggtctaacagaggagaagacctatgctgatggtgaacctggcggcagcgcaaaagatg

SEQ ID NO: 103097 - DNA, 103 bp, Artificial Sequence
  Synthetic Polynucleotide
taatacgactcactatagggcgagacaggccttctcgggggacaccatcaaacagaggagatgatggatgcccccgagaaacctggcggcagcgcaaaagatg

SEQ ID NO: 103098 - DNA, 103 bp, Artificial Sequence
  Synthetic Polynucleotide
taatacgactcactataggggacatgctggcgagacaggccttctcggggaacagaggagaccccgaatgggcctgtctaacctggcggcagcgcaaaagatg

SEQ ID NO: 103099 - DNA, 103 bp, Artificial Sequence
  Synthetic Polynucleotide
taatacgactcactatagggttctagtaaggacatgctggcgagacaggcaacagaggagagcctgtatggccagcatgaacctggcggcagcgcaaaagatg

SEQ ID NO: 103100 - DNA, 103 bp, Artificial Sequence
  Synthetic Polynucleotide
taatacgactcactatagggataacaccaattctagtaaggacatgctggaacagaggagaccagcaatgccttactagaacctggcggcagcgcaaaagatg

SEQ ID NO: 103101 - DNA, 103 bp, Artificial Sequence
  Synthetic Polynucleotide
taatacgactcactatagggaatcaaagacataacaccaattctagtaagaacagaggagacttactatgattggtgttaacctggcggcagcgcaaaagatg

SEQ ID NO: 103102 - DNA, 103 bp, Artificial Sequence
  Synthetic Polynucleotide
taatacgactcactatagggccttcttgcgaatcaaagacataacaccaaaacagaggagattggtgatgtgtctttgaaacctggcggcagcgcaaaagatg

SEQ ID NO: 103103 - DNA, 103 bp, Artificial Sequence
  Synthetic Polynucleotide
taatacgactcactatagggaactcctgaaccttcttgcgaatcaaagacaacagaggagagtctttatgtcgcaagaaaacctggcggcagcgcaaaagatg

SEQ ID NO: 103104 - DNA, 103 bp, Artificial Sequence
  Synthetic Polynucleotide
taatacgactcactatagggcatgccccagtcttccaggagctgagcagaaacagaggagatctgctatgctcctggaaaacctggcggcagcgcaaaagatg

SEQ ID NO: 103105 - DNA, 103 bp, Artificial Sequence
  Synthetic Polynucleotide
taatacgactcactatagggaacatgttcaaactcctgaaccttcttgcgaacagaggagacgcaagatggttcaggagaacctggcggcagcgcaaaagatg

SEQ ID NO: 103106 - DNA, 103 bp, Artificial Sequence
  Synthetic Polynucleotide
taatacgactcactatagggagcgcccattaacatgttcaaactcctgaaaacagaggagattcaggatgttgaacatgaacctggcggcagcgcaaaagatg

SEQ ID NO: 103107 - DNA, 103 bp, Artificial Sequence
  Synthetic Polynucleotide
taatacgactcactatagggggcatgctccagcgcccattaacatgttcaaacagaggagatgaacaatgtaatgggcgaacctggcggcagcgcaaaagatg

SEQ ID NO: 103108 - DNA, 103 bp, Artificial Sequence
  Synthetic Polynucleotide
taatacgactcactatagggagccagttcaggcatgctccagcgcccattaacagaggagaaatgggatgtggagcatgaacctggcggcagcgcaaaagatg

SEQ ID NO: 103109 - DNA, 103 bp, Artificial Sequence
  Synthetic Polynucleotide
taatacgactcactatagggcctccacctcagccagttcaggcatgctccaacagaggagaggagcaatgctgaactggaacctggcggcagcgcaaaagatg

SEQ ID NO: 103110 - DNA, 103 bp, Artificial Sequence
  Synthetic Polynucleotide
taatacgactcactatagggttcttgttttcctccacctcagccagttcaaacagaggagatgaactatgtgaggtggaaacctggcggcagcgcaaaagatg

SEQ ID NO: 103111 - DNA, 103 bp, Artificial Sequence
  Synthetic Polynucleotide
taatacgactcactatagggctgggacatcttcttgttttcctccacctcaacagaggagagaggtgatggaaaacaagaacctggcggcagcgcaaaagatg

SEQ ID NO: 103112 - DNA, 103 bp, Artificial Sequence
  Synthetic Polynucleotide
taatacgactcactataggggtgaccctggctgggacatcttcttgttttaacagaggagaaaaacaatgagatgtcccaacctggcggcagcgcaaaagatg

SEQ ID NO: 103113 - DNA, 103 bp, Artificial Sequence
  Synthetic Polynucleotide
taatacgactcactatagggtttggggagggtgaccctggctgggacatcaacagaggagagatgtcatggccagggtcaacctggcggcagcgcaaaagatg

SEQ ID NO: 103114 - DNA, 103 bp, Artificial Sequence
  Synthetic Polynucleotide
taatacgactcactatagggtgtaggagtttttggggagggtgaccctggaacagaggagaccagggatgccctccccaaacctggcggcagcgcaaaagatg

SEQ ID NO: 103115 - DNA, 103 bp, Artificial Sequence
  Synthetic Polynucleotide
taatacgactcactatagggcaatgtcttccatgccccagtcttccaggaaacagaggagatcctggatgactggggcaaacctggcggcagcgcaaaagatg

SEQ ID NO: 103116 - DNA, 103 bp, Artificial Sequence
  Synthetic Polynucleotide
taatacgactcactataggggagtggagggtgtaggagtttttggggaggaacagaggagacctcccatgaaactcctaaacctggcggcagcgcaaaagatg

SEQ ID NO: 103117 - DNA, 103 bp, Artificial Sequence
  Synthetic Polynucleotide
taatacgactcactataggggtgtcccctggagtggagggtgtaggagttaacagaggagaaactccatgaccctccacaacctggcggcagcgcaaaagatg

SEQ ID NO: 103118 - DNA, 103 bp, Artificial Sequence
  Synthetic Polynucleotide
taatacgactcactataggggttgggctgcgtgtcccctggagtggagggaacagaggagaccctccatgccaggggacaacctggcggcagcgcaaaagatg

SEQ ID NO: 103119 - DNA, 103 bp, Artificial Sequence
  Synthetic Polynucleotide
taatacgactcactataggggtgcaggagtgttgggctgcgtgtcccctgaacagaggagacaggggatgcgcagcccaaacctggcggcagcgcaaaagatg

SEQ ID NO: 103120 - DNA, 103 bp, Artificial Sequence
  Synthetic Polynucleotide
taatacgactcactatagggggtgggacaggtgcaggagtgttgggctgcaacagaggagagcagccatgcactcctgcaacctggcggcagcgcaaaagatg

SEQ ID NO: 103121 - DNA, 103 bp, Artificial Sequence
  Synthetic Polynucleotide
taatacgactcactatagggatcttcagcaggtgggacaggtgcaggagtaacagaggagaactcctatgcctgtcccaaacctggcggcagcgcaaaagatg

SEQ ID NO: 103122 - DNA, 103 bp, Artificial Sequence
  Synthetic Polynucleotide
taatacgactcactatagggtttttatcccatcttcagcaggtgggacagaacagaggagactgtccatgctgctgaagaacctggcggcagcgcaaaagatg

SEQ ID NO: 103123 - DNA, 103 bp, Artificial Sequence
  Synthetic Polynucleotide
taatacgactcactatagggttttcctctatttttatcccatcttcagcaaacagaggagatgctgaatgtgggataaaaacctggcggcagcgcaaaagatg

SEQ ID NO: 103124 - DNA, 103 bp, Artificial Sequence
  Synthetic Polynucleotide
taatacgactcactatagggtttgaggctattttcctctatttttatcccaacagaggagagggataatgatagaggaaaacctggcggcagcgcaaaagatg

SEQ ID NO: 103125 - DNA, 103 bp, Artificial Sequence
  Synthetic Polynucleotide
taatacgactcactatagggtctcttcttctttgaggctattttcctctaaacagaggagatagaggatgatagcctcaaacctggcggcagcgcaaaagatg

SEQ ID NO: 103126 - DNA, 103 bp, Artificial Sequence
  Synthetic Polynucleotide
taatacgactcactatagggaacacgtggtcaatgtcttccatgccccagaacagaggagactggggatgggaagacataacctggcggcagcgcaaaagatg

SEQ ID NO: 103127 - DNA, 103 bp, Artificial Sequence
  Synthetic Polynucleotide
taatacgactcactatagggccttctatgctctcttcttctttgaggctaaacagaggagatagcctatgagaagaagaaacctggcggcagcgcaaaagatg

SEQ ID NO: 103128 - DNA, 103 bp, Artificial Sequence
  Synthetic Polynucleotide
taatacgactcactatagggctccttttctccttctatgctctcttcttcaacagaggagagaagaaatgagcatagaaaacctggcggcagcgcaaaagatg

SEQ ID NO: 103129 - DNA, 103 bp, Artificial Sequence
  Synthetic Polynucleotide
taatacgactcactatagggtagatttaacctccttttctccttctatgcaacagaggagagcatagatggagaaaaggaacctggcggcagcgcaaaagatg

SEQ ID NO: 103130 - DNA, 103 bp, Artificial Sequence
  Synthetic Polynucleotide
taatacgactcactatagggtcaggggctgtagatttaacctccttttctaacagaggagaagaaaaatgggttaaatcaacctggcggcagcgcaaaagatg

SEQ ID NO: 103131 - DNA, 103 bp, Artificial Sequence
  Synthetic Polynucleotide
taatacgactcactatagggaatggcagtctcaggggctgtagatttaacaacagaggagagttaaaatgacagcccctaacctggcggcagcgcaaaagatg

SEQ ID NO: 103132 - DNA, 103 bp, Artificial Sequence
  Synthetic Polynucleotide
taatacgactcactataggggtgtacactcaatggcagtctcaggggctgaacagaggagacagcccatgagactgccaaacctggcggcagcgcaaaagatg

SEQ ID NO: 103133 - DNA, 103 bp, Artificial Sequence
  Synthetic Polynucleotide
taatacgactcactataggggcaggggcctgtgtacactcaatggcagtcaacagaggagagactgcatgtgagtgtacaacctggcggcagcgcaaaagatg

SEQ ID NO: 103134 - DNA, 103 bp, Artificial Sequence
  Synthetic Polynucleotide
taatacgactcactatagggtgaggcaggggcaggggcctgtgtacactcaacagaggagagagtgtatgcaggcccctaacctggcggcagcgcaaaagatg

SEQ ID NO: 103135 - DNA, 103 bp, Artificial Sequence
  Synthetic Polynucleotide
taatacgactcactatagggtttcatcctctgaggcaggggcaggggcctaacagaggagaaggcccatgcccctgcctaacctggcggcagcgcaaaagatg

SEQ ID NO: 103136 - DNA, 103 bp, Artificial Sequence
  Synthetic Polynucleotide
taatacgactcactatagggacaacgaccttttcatcctctgaggcagggaacagaggagaccctgcatgagaggatgaaacctggcggcagcgcaaaagatg

SEQ ID NO: 103137 - DNA, 103 bp, Artificial Sequence
  Synthetic Polynucleotide
taatacgactcactatagggctcctctgagaacacgtggtcaatgtcttcaacagaggagagaagacatggaccacgtgaacctggcggcagcgcaaaagatg

SEQ ID NO: 103138 - DNA, 103 bp, Artificial Sequence
  Synthetic Polynucleotide
taatacgactcactatagggagggggttcaacaacgaccttttcatcctcaacagaggagagaggatatgaaggtcgttaacctggcggcagcgcaaaagatg

SEQ ID NO: 103139 - DNA, 103 bp, Artificial Sequence
  Synthetic Polynucleotide
taatacgactcactatagggcctctccctcagggggttcaacaacgacctaacagaggagaaggtcgatgttgaaccccaacctggcggcagcgcaaaagatg

SEQ ID NO: 103140 - DNA, 103 bp, Artificial Sequence
  Synthetic Polynucleotide
taatacgactcactatagggtccactttctcctctccctcagggggttcaaacagaggagatgaaccatgtgagggagaaacctggcggcagcgcaaaagatg

SEQ ID NO: 103141 - DNA, 103 bp, Artificial Sequence
  Synthetic Polynucleotide
taatacgactcactatagggctctgccttttccactttctcctctccctcaacagaggagagagggaatggagaaagtgaacctggcggcagcgcaaaagatg

SEQ ID NO: 103142 - DNA, 103 bp, Artificial Sequence
  Synthetic Polynucleotide
taatacgactcactatagggtctccttcacctctgccttttccactttctaacagaggagaagaaagatgaaaaggcagaacctggcggcagcgcaaaagatg

SEQ ID NO: 103143 - DNA, 103 bp, Artificial Sequence
  Synthetic Polynucleotide
taatacgactcactatagggtcctctgttctctccttcacctctgcctttaacagaggagaaaaggcatgggtgaaggaaacctggcggcagcgcaaaagatg

SEQ ID NO: 103144 - DNA, 103 bp, Artificial Sequence
  Synthetic Polynucleotide
taatacgactcactatagggctccataggttcctctgttctctccttcacaacagaggagagtgaagatgagaacagagaacctggcggcagcgcaaaagatg

SEQ ID NO: 103145 - DNA, 103 bp, Artificial Sequence
  Synthetic Polynucleotide
taatacgactcactatagggtgggctctgtctccataggttcctctgttcaacagaggagagaacagatgaacctatggaacctggcggcagcgcaaaagatg

SEQ ID NO: 103146 - DNA, 103 bp, Artificial Sequence
  Synthetic Polynucleotide
taatacgactcactataggggcagcacctttgggctctgtctccataggtaacagaggagaacctatatggacagagccaacctggcggcagcgcaaaagatg

SEQ ID NO: 103147 - DNA, 103 bp, Artificial Sequence
  Synthetic Polynucleotide
taatacgactcactatagggctctacatcagcagcacctttgggctctgtaacagaggagaacagagatgaaaggtgctaacctggcggcagcgcaaaagatg

SEQ ID NO: 103148 - DNA, 103 bp, Artificial Sequence
  Synthetic Polynucleotide
taatacgactcactatagggaaagtgcatccatatcctcctcctcactgcaacagaggagagcagtgatgaggaggataaacctggcggcagcgcaaaagatg

SEQ ID NO: 103149 - DNA, 103 bp, Artificial Sequence
  Synthetic Polynucleotide
taatacgactcactatagggttcgataatcctcctctgagaacacgtggtaacagaggagaaccacgatgtctcagaggaacctggcggcagcgcaaaagatg

SEQ ID NO: 103150 - DNA, 103 bp, Artificial Sequence
  Synthetic Polynucleotide
taatacgactcactatagggcctccaccttctctacatcagcagcaccttaacagaggagaaaggtgatgctgatgtagaacctggcggcagcgcaaaagatg

SEQ ID NO: 103151 - DNA, 103 bp, Artificial Sequence
  Synthetic Polynucleotide
taatacgactcactataggggctgacttttcctccaccttctctacatcaaacagaggagatgatgtatggaaggtggaaacctggcggcagcgcaaaagatg

SEQ ID NO: 103152 - DNA, 103 bp, Artificial Sequence
  Synthetic Polynucleotide
taatacgactcactatagggcagatctattgctgacttttcctccaccttaacagaggagaaaggtgatggaaaagtcaaacctggcggcagcgcaaaagatg

SEQ ID NO: 103153 - DNA, 103 bp, Artificial Sequence
  Synthetic Polynucleotide
taatacgactcactatagggcaataggggtcagatctattgctgacttttaacagaggagaaaaagtatgcaatagatcaacctggcggcagcgcaaaagatg

SEQ ID NO: 103154 - DNA, 103 bp, Artificial Sequence
  Synthetic Polynucleotide
taatacgactcactatagggtcttctaccacaataggggtcagatctattaacagaggagaaatagaatggacccctataacctggcggcagcgcaaaagatg

SEQ ID NO: 103155 - DNA, 103 bp, Artificial Sequence
  Synthetic Polynucleotide
taatacgactcactatagggctcttctttgtcttctaccacaataggggtaacagaggagaacccctatggtggtagaaaacctggcggcagcgcaaaagatg

SEQ ID NO: 103156 - DNA, 103 bp, Artificial Sequence
  Synthetic Polynucleotide
taatacgactcactatagggcttctttcttctcttctttgtcttctaccaaacagaggagatggtagatgacaaagaagaacctggcggcagcgcaaaagatg

SEQ ID NO: 103157 - DNA, 103 bp, Artificial Sequence
  Synthetic Polynucleotide
taatacgactcactatagggttctcttcttcttctttcttctcttctttgaacagaggagacaaagaatggaagaaagaaacctggcggcagcgcaaaagatg

SEQ ID NO: 103158 - DNA, 103 bp, Artificial Sequence
  Synthetic Polynucleotide
taatacgactcactatagggcacctcttttttctcttcttcttctttcttaacagaggagaaagaaaatggaagaagagaacctggcggcagcgcaaaagatg

SEQ ID NO: 103159 - DNA, 103 bp, Artificial Sequence
  Synthetic Polynucleotide
taatacgactcactatagggtctgaagcatcacctcttttttctcttcttaacagaggagaaagaagatgaaaaagaggaacctggcggcagcgcaaaagatg

SEQ ID NO: 103160 - DNA, 103 bp, Artificial Sequence
  Synthetic Polynucleotide
taatacgactcactatagggttggtgagggttcgataatcctcctctgagaacagaggagactcagaatgggattatcgaacctggcggcagcgcaaaagatg

SEQ ID NO: 103161 - DNA, 103 bp, Artificial Sequence
  Synthetic Polynucleotide
taatacgactcactataggggtctctccattctgaagcatcacctcttttaacagaggagaaaaagaatggatgcttcaaacctggcggcagcgcaaaagatg

SEQ ID NO: 103162 - DNA, 103 bp, Artificial Sequence
  Synthetic Polynucleotide
taatacgactcactataggggtccttgggggtctctccattctgaagcataacagaggagaatgcttatgaatggagagaacctggcggcagcgcaaaagatg

SEQ ID NO: 103163 - DNA, 103 bp, Artificial Sequence
  Synthetic Polynucleotide
taatacgactcactatagggcatcattcaggtccttgggggtctctccataacagaggagaatggagatgcccccaaggaacctggcggcagcgcaaaagatg

SEQ ID NO: 103164 - DNA, 103 bp, Artificial Sequence
  Synthetic Polynucleotide
taatacgactcactatagggttctgtttctcatcattcaggtccttggggaacagaggagaccccaaatgcctgaatgaaacctggcggcagcgcaaaagatg

SEQ ID NO: 103165 - DNA, 103 bp, Artificial Sequence
  Synthetic Polynucleotide
taatacgactcactatagggaatatttttcttctgtttctcatcattcagaacagaggagactgaatatggagaaacagaacctggcggcagcgcaaaagatg

SEQ ID NO: 103166 - DNA, 103 bp, Artificial Sequence
  Synthetic Polynucleotide
taatacgactcactatagggaacgttgtttaatatttttcttctgtttctaacagaggagaagaaacatgagaaaaataaacctggcggcagcgcaaaagatg

SEQ ID NO: 103167 - DNA, 103 bp, Artificial Sequence
  Synthetic Polynucleotide
taatacgactcactatagggttaaacatgaaacgttgtttaatatttttcaacagaggagagaaaaaatgtaaacaacgaacctggcggcagcgcaaaagatg

SEQ ID NO: 103168 - DNA, 103 bp, Artificial Sequence
  Synthetic Polynucleotide
taatacgactcactatagggatctgcaatgttaaacatgaaacgttgtttaacagaggagaaaacaaatgttcatgtttaacctggcggcagcgcaaaagatg

SEQ ID NO: 103169 - DNA, 103 bp, Artificial Sequence
  Synthetic Polynucleotide
taatacgactcactatagggtaaaaccaccatctgcaatgttaaacatgaaacagaggagatcatgtatgacattgcagaacctggcggcagcgcaaaagatg

SEQ ID NO: 103170 - DNA, 103 bp, Artificial Sequence
  Synthetic Polynucleotide
taatacgactcactatagggtgcaactcagtaaaaccaccatctgcaatgaacagaggagacattgcatgtggtggtttaacctggcggcagcgcaaaagatg

SEQ ID NO: 103171 - DNA, 103 bp, Artificial Sequence
  Synthetic Polynucleotide
taatacgactcactatagggggccttgtagttggtgagggttcgataatcaacagaggagagattatatgaccctcaccaacctggcggcagcgcaaaagatg

SEQ ID NO: 103172 - DNA, 103 bp, Artificial Sequence
  Synthetic Polynucleotide
taatacgactcactatagggccaaagggagtgcaactcagtaaaaccaccaacagaggagaggtggtatgactgagttgaacctggcggcagcgcaaaagatg

SEQ ID NO: 103173 - DNA, 103 bp, Artificial Sequence
  Synthetic Polynucleotide
taatacgactcactatagggcttcattctgccaaagggagtgcaactcagaacagaggagactgagtatgactccctttaacctggcggcagcgcaaaagatg

SEQ ID NO: 103174 - DNA, 103 bp, Artificial Sequence
  Synthetic Polynucleotide
taatacgactcactataggggctgcccgctcttcattctgccaaagggagaacagaggagactccctatggcagaatgaaacctggcggcagcgcaaaagatg

SEQ ID NO: 103175 - DNA, 103 bp, Artificial Sequence
  Synthetic Polynucleotide
taatacgactcactatagggggtaactgtggctgcccgctcttcattctgaacagaggagacagaatatggagcgggcaaacctggcggcagcgcaaaagatg

SEQ ID NO: 103176 - DNA, 103 bp, Artificial Sequence
  Synthetic Polynucleotide
taatacgactcactatagggaagtcttcttggtaactgtggctgcccgctaacagaggagaagcgggatgccacagttaaacctggcggcagcgcaaaagatg

SEQ ID NO: 103177 - DNA, 103 bp, Artificial Sequence
  Synthetic Polynucleotide
taatacgactcactatagggcagatctcataagtcttcttggtaactgtgaacagaggagacacagtatgcaagaagacaacctggcggcagcgcaaaagatg

SEQ ID NO: 103178 - DNA, 103 bp, Artificial Sequence
  Synthetic Polynucleotide
taatacgactcactatagggccgtcgatgccagatctcataagtcttcttaacagaggagaaagaagatgtatgagatcaacctggcggcagcgcaaaagatg

SEQ ID NO: 103179 - DNA, 103 bp, Artificial Sequence
  Synthetic Polynucleotide
taatacgactcactatagggagtagtcatgccgtcgatgccagatctcataacagaggagaatgagaatgggcatcgacaacctggcggcagcgcaaaagatg

SEQ ID NO: 103180 - DNA, 103 bp, Artificial Sequence
  Synthetic Polynucleotide
taatacgactcactataggggctagcagccagtagtcatgccgtcgatgcaacagaggagagcatcgatggcatgactaaacctggcggcagcgcaaaagatg

SEQ ID NO: 103181 - DNA, 103 bp, Artificial Sequence
  Synthetic Polynucleotide
taatacgactcactatagggtataatgccggctagcagccagtagtcatgaacagaggagacatgacatgtggctgctaaacctggcggcagcgcaaaagatg

SEQ ID NO: 103182 - DNA, 103 bp, Artificial Sequence
  Synthetic Polynucleotide
taatacgactcactatagggactggctgaaggccttgtagttggtgagggaacagaggagaccctcaatgactacaaggaacctggcggcagcgcaaaagatg

SEQ ID NO: 103183 - DNA, 103 bp, Artificial Sequence
  Synthetic Polynucleotide
taatacgactcactatagggagccatggtttataatgccggctagcagccaacagaggagaggctgcatgccggcattaaacctggcggcagcgcaaaagatg

SEQ ID NO: 103184 - DNA, 103 bp, Artificial Sequence
  Synthetic Polynucleotide
taatacgactcactatagggcaccgggcatagccatggtttataatgccgaacagaggagacggcatatgaaaccatggaacctggcggcagcgcaaaagatg

SEQ ID NO: 103185 - DNA, 103 bp, Artificial Sequence
  Synthetic Polynucleotide
taatacgactcactataggggatgtcttgccaccgggcatagccatggttaacagaggagaaaccatatgtatgcccggaacctggcggcagcgcaaaagatg

SEQ ID NO: 103186 - DNA, 103 bp, Artificial Sequence
  Synthetic Polynucleotide
taatacgactcactatagggggtcattctggatgtcttgccaccgggcataacagaggagaatgcccatgggcaagacaaacctggcggcagcgcaaaagatg

SEQ ID NO: 103187 - DNA, 103 bp, Artificial Sequence
  Synthetic Polynucleotide
taatacgactcactataggggcatagcgtgggtcattctggatgtcttgcaacagaggagagcaagaatgccagaatgaaacctggcggcagcgcaaaagatg

SEQ ID NO: 103188 - DNA, 103 bp, Artificial Sequence
  Synthetic Polynucleotide
taatacgactcactatagggattgaggatggcatagcgtgggtcattctgaacagaggagacagaatatgccacgctataacctggcggcagcgcaaaagatg

SEQ ID NO: 103189 - DNA, 103 bp, Artificial Sequence
  Synthetic Polynucleotide
taatacgactcactatagggtgaaaggctcattgaggatggcatagcgtgaacagaggagacacgctatgccatcctcaaacctggcggcagcgcaaaagatg

SEQ ID NO: 103190 - DNA, 103 bp, Artificial Sequence
  Synthetic Polynucleotide
taatacgactcactatagggatttcacccttgaaaggctcattgaggatgaacagaggagacatcctatgtgagcctttaacctggcggcagcgcaaaagatg

SEQ ID NO: 103191 - DNA, 103 bp, Artificial Sequence
  Synthetic Polynucleotide
taatacgactcactataggggccacggttcatttcacccttgaaaggctcaacagaggagagagcctatgaagggtgaaaacctggcggcagcgcaaaagatg

SEQ ID NO: 103192 - DNA, 103 bp, Artificial Sequence
  Synthetic Polynucleotide
taatacgactcactatagggctaagaaattgccacggttcatttcaccctaacagaggagaagggtgatgtgaaccgtgaacctggcggcagcgcaaaagatg

SEQ ID NO: 103193 - DNA, 103 bp, Artificial Sequence
  Synthetic Polynucleotide
taatacgactcactatagggggtctgacaaactggctgaaggccttgtagaacagaggagactacaaatgcttcagccaaacctggcggcagcgcaaaagatg

SEQ ID NO: 103194 - DNA, 103 bp, Artificial Sequence
  Synthetic Polynucleotide
taatacgactcactatagggttcttgatctctaagaaattgccacggttcaacagaggagagaaccgatgcaatttcttaacctggcggcagcgcaaaagatg

SEQ ID NO: 103195 - DNA, 103 bp, Artificial Sequence
  Synthetic Polynucleotide
taatacgactcactatagggtagaaatttattcttgatctctaagaaattaacagaggagaaatttcatggagatcaagaacctggcggcagcgcaaaagatg

SEQ ID NO: 103196 - DNA, 103 bp, Artificial Sequence
  Synthetic Polynucleotide
taatacgactcactatagggaccttcgagctagaaatttattcttgatctaacagaggagaagatcaatgataaatttcaacctggcggcagcgcaaaagatg

SEQ ID NO: 103197 - DNA, 103 bp, Artificial Sequence
  Synthetic Polynucleotide
taatacgactcactatagggaagagcttaaaccttcgagctagaaatttaaacagaggagataaattatgagctcgaagaacctggcggcagcgcaaaagatg

SEQ ID NO: 103198 - DNA, 103 bp, Artificial Sequence
  Synthetic Polynucleotide
taatacgactcactatagggagcttgttctaagagcttaaaccttcgagcaacagaggagagctcgaatgtttaagctcaacctggcggcagcgcaaaagatg

SEQ ID NO: 103199 - DNA, 103 bp, Artificial Sequence
  Synthetic Polynucleotide
taatacgactcactatagggcaatcaccagagcttgttctaagagcttaaaacagaggagattaagcatgtagaacaagaacctggcggcagcgcaaaagatg

SEQ ID NO: 103200 - DNA, 103 bp, Artificial Sequence
  Synthetic Polynucleotide
taatacgactcactatagggagctgttcctcaatcaccagagcttgttctaacagaggagaagaacaatgtctggtgataacctggcggcagcgcaaaagatg

SEQ ID NO: 103201 - DNA, 103 bp, Artificial Sequence
  Synthetic Polynucleotide
taatacgactcactatagggagcccggcgcagctgttcctcaatcaccagaacagaggagactggtgatggaggaacagaacctggcggcagcgcaaaagatg

SEQ ID NO: 103202 - DNA, 103 bp, Artificial Sequence
  Synthetic Polynucleotide
taatacgactcactatagggtcaagtaagcagcccggcgcagctgttcctaacagaggagaaggaacatgtgcgccgggaacctggcggcagcgcaaaagatg

SEQ ID NO: 103203 - DNA, 103 bp, Artificial Sequence
  Synthetic Polynucleotide
taatacgactcactatagggtctgacatgttcaagtaagcagcccggcgcaacagaggagagcgccgatgtgcttacttaacctggcggcagcgcaaaagatg

SEQ ID NO: 103204 - DNA, 103 bp, Artificial Sequence
  Synthetic Polynucleotide
taatacgactcactatagggagcaatgaggggtctgacaaactggctgaaaacagaggagattcagcatgtttgtcagaaacctggcggcagcgcaaaagatg

SEQ ID NO: 103205 - DNA, 103 bp, Artificial Sequence
  Synthetic Polynucleotide
taatacgactcactatagggagaagggtcttctgacatgttcaagtaagcaacagaggagagcttacatgaacatgtcaaacctggcggcagcgcaaaagatg

SEQ ID NO: 103206 - DNA, 103 bp, Artificial Sequence
  Synthetic Polynucleotide
taatacgactcactatagggtggaagggtgagaagggtcttctgacatgtaacagaggagaacatgtatgaagacccttaacctggcggcagcgcaaaagatg

SEQ ID NO: 103207 - DNA, 103 bp, Artificial Sequence
  Synthetic Polynucleotide
taatacgactcactatagggttgagggccatggaagggtgagaagggtctaacagaggagaagacccatgtcacccttcaacctggcggcagcgcaaaagatg

SEQ ID NO: 103208 - DNA, 103 bp, Artificial Sequence
  Synthetic Polynucleotide
taatacgactcactatagggaaagcgggtgttgagggccatggaagggtgaacagaggagacaccctatgatggccctcaacctggcggcagcgcaaaagatg

SEQ ID NO: 103209 - DNA, 103 bp, Artificial Sequence
  Synthetic Polynucleotide
taatacgactcactatagggccacctcagcaaagcgggtgttgagggccaaacagaggagatggcccatgacacccgctaacctggcggcagcgcaaaagatg

SEQ ID NO: 103210 - DNA, 103 bp, Artificial Sequence
  Synthetic Polynucleotide
taatacgactcactataggggccaaacactccacctcagcaaagcgggtgaacagaggagacacccgatgtgctgaggtaacctggcggcagcgcaaaagatg

SEQ ID NO: 103211 - DNA, 103 bp, Artificial Sequence
  Synthetic Polynucleotide
taatacgactcactatagggatgactttccgccaaacactccacctcagcaacagaggagagctgagatggagtgtttgaacctggcggcagcgcaaaagatg

SEQ ID NO: 103212 - DNA, 103 bp, Artificial Sequence
  Synthetic Polynucleotide
taatacgactcactatagggacaggtgctgatgactttccgccaaacactaacagaggagaagtgttatgcggaaagtcaacctggcggcagcgcaaaagatg

SEQ ID NO: 103213 - DNA, 103 bp, Artificial Sequence
  Synthetic Polynucleotide
taatacgactcactataggggactccttggacaggtgctgatgactttccaacagaggagaggaaagatgtcagcacctaacctggcggcagcgcaaaagatg

SEQ ID NO: 103214 - DNA, 103 bp, Artificial Sequence
  Synthetic Polynucleotide
taatacgactcactatagggtcctgccattgactccttggacaggtgctgaacagaggagacagcacatgtccaaggagaacctggcggcagcgcaaaagatg

SEQ ID NO: 103215 - DNA, 103 bp, Artificial Sequence
  Synthetic Polynucleotide
taatacgactcactataggggatttttggcagcaatgaggggtctgacaaaacagaggagattgtcaatgccctcattgaacctggcggcagcgcaaaagatg

SEQ ID NO: 103216 - DNA, 103 bp, Artificial Sequence
  Synthetic Polynucleotide
taatacgactcactatagggctggcttgtttcctgccattgactccttggaacagaggagaccaaggatgcaatggcagaacctggcggcagcgcaaaagatg

SEQ ID NO: 103217 - DNA, 103 bp, Artificial Sequence
  Synthetic Polynucleotide
taatacgactcactatagggactgcattggctggcttgtttcctgccattaacagaggagaaatggcatgaaacaagccaacctggcggcagcgcaaaagatg

SEQ ID NO: 103218 - DNA, 103 bp, Artificial Sequence
  Synthetic Polynucleotide
taatacgactcactatagggtttgtgcaggactgcattggctggcttgttaacagaggagaaacaagatggccaatgcaaacctggcggcagcgcaaaagatg

SEQ ID NO: 103219 - DNA, 103 bp, Artificial Sequence
  Synthetic Polynucleotide
taatacgactcactataggggtttcagaactttgtgcaggactgcattggaacagaggagaccaatgatgtcctgcacaaacctggcggcagcgcaaaagatg

SEQ ID NO: 103220 - DNA, 103 bp, Artificial Sequence
  Synthetic Polynucleotide
taatacgactcactatagggtcttccagctgtttcagaactttgtgcaggaacagaggagacctgcaatgagttctgaaaacctggcggcagcgcaaaagatg

SEQ ID NO: 103221 - DNA, 103 bp, Artificial Sequence
  Synthetic Polynucleotide
taatacgactcactatagggactcagcagttcttccagctgtttcagaacaacagaggagagttctgatgcagctggaaaacctggcggcagcgcaaaagatg

SEQ ID NO: 103222 - DNA, 103 bp, Artificial Sequence
  Synthetic Polynucleotide
taatacgactcactatagggctttcatgtcactcagcagttcttccagctaacagaggagaagctggatgaactgctgaaacctggcggcagcgcaaaagatg

SEQ ID NO: 103223 - DNA, 103 bp, Artificial Sequence
  Synthetic Polynucleotide
taatacgactcactataggggtcacatcagctttcatgtcactcagcagtaacagaggagaactgctatgtgacatgaaaacctggcggcagcgcaaaagatg

SEQ ID NO: 103224 - DNA, 103 bp, Artificial Sequence
  Synthetic Polynucleotide
taatacgactcactatagggtgggagtcgagtcacatcagctttcatgtcaacagaggagagacatgatggctgatgtgaacctggcggcagcgcaaaagatg

SEQ ID NO: 103225 - DNA, 103 bp, Artificial Sequence
  Synthetic Polynucleotide
taatacgactcactatagggcaatggtagctgggagtcgagtcacatcagaacagaggagactgatgatgctcgactccaacctggcggcagcgcaaaagatg

SEQ ID NO: 103226 - DNA, 103 bp, Artificial Sequence
  Synthetic Polynucleotide
taatacgactcactataggggcaatcttgggatttttggcagcaatgaggaacagaggagacctcatatgtgccaaaaaaacctggcggcagcgcaaaagatg

SEQ ID NO: 103227 - DNA, 103 bp, Artificial Sequence
  Synthetic Polynucleotide
taatacgactcactatagggggaattcgggcaatggtagctgggagtcgaaacagaggagatcgactatgagctaccataacctggcggcagcgcaaaagatg

SEQ ID NO: 103228 - DNA, 103 bp, Artificial Sequence
  Synthetic Polynucleotide
taatacgactcactatagggagcaactgggggaattcgggcaatggtagcaacagaggagagctaccatggcccgaattaacctggcggcagcgcaaaagatg

SEQ ID NO: 103229 - DNA, 103 bp, Artificial Sequence
  Synthetic Polynucleotide
taatacgactcactataggggtaacctcacagcaactgggggaattcgggaacagaggagacccgaaatgccccagttgaacctggcggcagcgcaaaagatg

SEQ ID NO: 103230 - DNA, 103 bp, Artificial Sequence
  Synthetic Polynucleotide
taatacgactcactatagggtctgacatctgtaacctcacagcaactgggaacagaggagacccagtatgtgtgaggttaacctggcggcagcgcaaaagatg

SEQ ID NO: 103231 - DNA, 103 bp, Artificial Sequence
  Synthetic Polynucleotide
taatacgactcactatagggaatgttacgctctgacatctgtaacctcacaacagaggagagtgaggatgcagatgtcaaacctggcggcagcgcaaaagatg

SEQ ID NO: 103232 - DNA, 103 bp, Artificial Sequence
  Synthetic Polynucleotide
taatacgactcactatagggggcggctgagaatgttacgctctgacatctaacagaggagaagatgtatgagcgtaacaaacctggcggcagcgcaaaagatg

SEQ ID NO: 103233 - DNA, 103 bp, Artificial Sequence
  Synthetic Polynucleotide
taatacgactcactatagggcggtttgccaggcggctgagaatgttacgcaacagaggagagcgtaaatgtctcagccgaacctggcggcagcgcaaaagatg

SEQ ID NO: 103234 - DNA, 103 bp, Artificial Sequence
  Synthetic Polynucleotide
taatacgactcactatagggttcgggtgcccggtttgccaggcggctgagaacagaggagactcagcatgctggcaaacaacctggcggcagcgcaaaagatg

SEQ ID NO: 103235 - DNA, 103 bp, Artificial Sequence
  Synthetic Polynucleotide
taatacgactcactataggggtggggtaggttcgggtgcccggtttgccaaacagaggagatggcaaatggggcacccgaacctggcggcagcgcaaaagatg

SEQ ID NO: 103236 - DNA, 103 bp, Artificial Sequence
  Synthetic Polynucleotide
taatacgactcactataggggctacctgctgtggggtaggttcgggtgccaacagaggagaggcaccatgacctaccccaacctggcggcagcgcaaaagatg

SEQ ID NO: 103237 - DNA, 103 bp, Artificial Sequence
  Synthetic Polynucleotide
taatacgactcactatagggcttggagacagcaatcttgggatttttggcaacagaggagagccaaaatgcccaagattaacctggcggcagcgcaaaagatg

SEQ ID NO: 103238 - DNA, 103 bp, Artificial Sequence
  Synthetic Polynucleotide
taatacgactcactatagggctgctgctgggctacctgctgtggggtaggaacagaggagacctaccatgcagcaggtaaacctggcggcagcgcaaaagatg

SEQ ID NO: 103239 - DNA, 103 bp, Artificial Sequence
  Synthetic Polynucleotide
taatacgactcactatagggccatcatcatcttggagacagcaatcttggaacagaggagaccaagaatgctgtctccaaacctggcggcagcgcaaaagatg

SEQ ID NO: 103240 - DNA, 103 bp, Artificial Sequence
  Synthetic Polynucleotide
taatacgactcactatagggctgttgttcaaaagtgcatccatatcctccaacagaggagaggaggaatgggatgcactaacctggcggcagcgcaaaagatg

SEQ ID NO: 103241 - DNA, 103 bp, Artificial Sequence
  Synthetic Polynucleotide
taatacgactcactataggggcacccaaaaccatcatcatcttggagacaaacagaggagatgtctcatggatgatgataacctggcggcagcgcaaaagatg

SEQ ID NO: 103242 - DNA, 103 bp, Artificial Sequence
  Synthetic Polynucleotide
taatacgactcactatagggccgccattttgcacccaaaaccatcatcataacagaggagaatgatgatggttttgggtaacctggcggcagcgcaaaagatg

SEQ ID NO: 103243 - DNA, 103 bp, Artificial Sequence
  Synthetic Polynucleotide
taatacgactcactatagggtactgaactcccgccattttgcacccaaaaaacagaggagattttggatgcaaaatggcaacctggcggcagcgcaaaagatg

SEQ ID NO: 103244 - DNA, 103 bp, Artificial Sequence
  Synthetic Polynucleotide
taatacgactcactataggggggttattggtactgaactcccgccattttaacagaggagaaaaatgatgggagttcagaacctggcggcagcgcaaaagatg

SEQ ID NO: 103245 - DNA, 103 bp, Artificial Sequence
  Synthetic Polynucleotide
taatacgactcactataggggcctttgaaggggttattggtactgaactcaacagaggagagagttcatgaccaataacaacctggcggcagcgcaaaagatg

SEQ ID NO: 103246 - DNA, 103 bp, Artificial Sequence
  Synthetic Polynucleotide
taatacgactcactatagggccccagaactgcctttgaaggggttattggaacagaggagaccaataatgccttcaaagaacctggcggcagcgcaaaagatg

SEQ ID NO: 103247 - DNA, 103 bp, Artificial Sequence
  Synthetic Polynucleotide
taatacgactcactataggggccactgatgccccagaactgcctttgaagaacagaggagacttcaaatgcagttctggaacctggcggcagcgcaaaagatg

SEQ ID NO: 103248 - DNA, 103 bp, Artificial Sequence
  Synthetic Polynucleotide
taatacgactcactatagggtgccgcagctgccactgatgccccagaactaacagaggagaagttctatggcatcagtgaacctggcggcagcgcaaaagatg

SEQ ID NO: 103249 - DNA, 103 bp, Artificial Sequence
  Synthetic Polynucleotide
taatacgactcactatagggccgctgctgctgccgcagctgccactgatgaacagaggagacatcagatgcagctgcggaacctggcggcagcgcaaaagatg

SEQ ID NO: 103250 - DNA, 103 bp, Artificial Sequence
  Synthetic Polynucleotide
taatacgactcactatagggaccacagctaccgctgctgctgccgcagctaacagaggagaagctgcatgagcagcagcaacctggcggcagcgcaaaagatg

SEQ ID NO: 103251 - DNA, 103 bp, Artificial Sequence
  Synthetic Polynucleotide
taatacgactcactatagggtgggggcaggctgttgttcaaaagtgcatcaacagaggagagatgcaatgttgaacaacaacctggcggcagcgcaaaagatg

SEQ ID NO: 103252 - DNA, 103 bp, Artificial Sequence
  Synthetic Polynucleotide
taatacgactcactatagggcatgctctccaccacagctaccgctgctgcaacagaggagagcagcaatggtagctgtgaacctggcggcagcgcaaaagatg

SEQ ID NO: 103253 - DNA, 103 bp, Artificial Sequence
  Synthetic Polynucleotide
taatacgactcactatagggtggctgtcaccatgctctccaccacagctaaacagaggagatagctgatgtggagagcaaacctggcggcagcgcaaaagatg

SEQ ID NO: 103254 - DNA, 103 bp, Artificial Sequence
  Synthetic Polynucleotide
taatacgactcactataggggcaacctcagtggctgtcaccatgctctccaacagaggagaggagagatgggtgacagcaacctggcggcagcgcaaaagatg

SEQ ID NO: 103255 - DNA, 103 bp, Artificial Sequence
  Synthetic Polynucleotide
taatacgactcactatagggaggtggtggtgcaacctcagtggctgtcacaacagaggagagtgacaatgactgaggttaacctggcggcagcgcaaaagatg

SEQ ID NO: 103256 - DNA, 103 bp, Artificial Sequence
  Synthetic Polynucleotide
taatacgactcactatagggccacagggggaggtggtggtgcaacctcagaacagaggagactgaggatgcaccaccacaacctggcggcagcgcaaaagatg

SEQ ID NO: 103257 - DNA, 103 bp, Artificial Sequence
  Synthetic Polynucleotide
taatacgactcactatagggataggcacctccacagggggaggtggtggtaacagaggagaaccaccatgtccccctgtaacctggcggcagcgcaaaagatg

SEQ ID NO: 103258 - DNA, 103 bp, Artificial Sequence
  Synthetic Polynucleotide
taatacgactcactatagggggccttgcggataggcacctccacagggggaacagaggagaccccctatggaggtgcctaacctggcggcagcgcaaaagatg

SEQ ID NO: 103259 - DNA, 103 bp, Artificial Sequence
  Synthetic Polynucleotide
taatacgactcactatagggccttggtcttggccttgcggataggcacctaacagaggagaaggtgcatgtccgcaaggaacctggcggcagcgcaaaagatg

SEQ ID NO: 103260 - DNA, 103 bp, Artificial Sequence
  Synthetic Polynucleotide
taatacgactcactatagggcctttgccctccttggtcttggccttgcggaacagaggagaccgcaaatgcaagaccaaaacctggcggcagcgcaaaagatg

SEQ ID NO: 103261 - DNA, 103 bp, Artificial Sequence
  Synthetic Polynucleotide
taatacgactcactatagggagcattgggacctttgccctccttggtcttaacagaggagaaagaccatggagggcaaaaacctggcggcagcgcaaaagatg

SEQ ID NO: 103262 - DNA, 103 bp, Artificial Sequence
  Synthetic Polynucleotide
taatacgactcactatagggctgggtggggtgggggcaggctgttgttcaaacagaggagatgaacaatggcctgccccaacctggcggcagcgcaaaagatg

SEQ ID NO: 103263 - DNA, 103 bp, Artificial Sequence
  Synthetic Polynucleotide
taatacgactcactataggggcttcctccgagcattgggacctttgccctaacagaggagaagggcaatggtcccaatgaacctggcggcagcgcaaaagatg

SEQ ID NO: 103264 - DNA, 103 bp, Artificial Sequence
  Synthetic Polynucleotide
taatacgactcactatagggctgcccttgggcttcctccgagcattgggaaacagaggagatcccaaatgtcggaggaaaacctggcggcagcgcaaaagatg

SEQ ID NO: 103265 - DNA, 103 bp, Artificial Sequence
  Synthetic Polynucleotide
taatacgactcactatagggtacacgagggctgcccttgggcttcctccgaacagaggagacggaggatgcccaagggcaacctggcggcagcgcaaaagatg

SEQ ID NO: 103266 - DNA, 103 bp, Artificial Sequence
  Synthetic Polynucleotide
taatacgactcactatagggtggcatcaggtacacgagggctgcccttggaacagaggagaccaaggatggccctcgtgaacctggcggcagcgcaaaagatg

SEQ ID NO: 103267 - DNA, 103 bp, Artificial Sequence
  Synthetic Polynucleotide
taatacgactcactatagggttaggcttcttggcatcaggtacacgagggaacagaggagaccctcgatgacctgatgcaacctggcggcagcgcaaaagatg

SEQ ID NO: 103268 - DNA, 103 bp, Artificial Sequence
  Synthetic Polynucleotide
taatacgactcactatagggtttcttgggtttaggcttcttggcatcaggaacagaggagacctgatatgaagaagcctaacctggcggcagcgcaaaagatg

SEQ ID NO: 103269 - DNA, 103 bp, Artificial Sequence
  Synthetic Polynucleotide
taatacgactcactatagggggggagctactttcttgggtttaggcttctaacagaggagaagaagcatgaacccaagaaacctggcggcagcgcaaaagatg

SEQ ID NO: 103270 - DNA, 103 bp, Artificial Sequence
  Synthetic Polynucleotide
taatacgactcactatagggttgattttcaggggagctactttcttgggtaacagaggagaacccaaatgagtagctccaacctggcggcagcgcaaaagatg

SEQ ID NO: 103271 - DNA, 103 bp, Artificial Sequence
  Synthetic Polynucleotide
taatacgactcactatagggacctcccagcttgattttcaggggagctacaacagaggagagtagctatgctgaaaatcaacctggcggcagcgcaaaagatg

SEQ ID NO: 103272 - DNA, 103 bp, Artificial Sequence
  Synthetic Polynucleotide
taatacgactcactatagggtggaaccaaaacctcccagcttgattttcaaacagaggagatgaaaaatgagctgggagaacctggcggcagcgcaaaagatg

SEQ ID NO: 103273 - DNA, 103 bp, Artificial Sequence
  Synthetic Polynucleotide
taatacgactcactatagggtcttcattttctgggtggggtgggggcaggaacagaggagacctgccatgaccccacccaacctggcggcagcgcaaaagatg

SEQ ID NO: 103274 - DNA, 103 bp, Artificial Sequence
  Synthetic Polynucleotide
taatacgactcactatagggctcttacgcttggaaccaaaacctcccagcaacagaggagagctgggatgttttggttcaacctggcggcagcgcaaaagatg

SEQ ID NO: 103275 - DNA, 103 bp, Artificial Sequence
  Synthetic Polynucleotide
taatacgactcactatagggactcgaggatctcttacgcttggaaccaaaaacagaggagatttggtatgaagcgtaagaacctggcggcagcgcaaaagatg

SEQ ID NO: 103276 - DNA, 103 bp, Artificial Sequence
  Synthetic Polynucleotide
taatacgactcactatagggcatcatcctcactcgaggatctcttacgctaacagaggagaagcgtaatggatcctcgaaacctggcggcagcgcaaaagatg

SEQ ID NO: 103277 - DNA, 103 bp, Artificial Sequence
  Synthetic Polynucleotide
taatacgactcactatagggacatctaagtcatcatcctcactcgaggataacagaggagaatcctcatgtgaggatgaaacctggcggcagcgcaaaagatg

SEQ ID NO: 103278 - DNA, 103 bp, Artificial Sequence
  Synthetic Polynucleotide
taatacgactcactataggggtcagattccacatctaagtcatcatcctcaacagaggagagaggatatggacttagataacctggcggcagcgcaaaagatg

SEQ ID NO: 103279 - DNA, 103 bp, Artificial Sequence
  Synthetic Polynucleotide
taatacgactcactatagggcatcatcgaagtcagattccacatctaagtaacagaggagaacttagatgtggaatctgaacctggcggcagcgcaaaagatg

SEQ ID NO: 103280 - DNA, 103 bp, Artificial Sequence
  Synthetic Polynucleotide
taatacgactcactatagggttgatactggcatcatcgaagtcagattccaacagaggagaggaatcatgcttcgatgaaacctggcggcagcgcaaaagatg

SEQ ID NO: 103281 - DNA, 103 bp, Artificial Sequence
  Synthetic Polynucleotide
taatacgactcactatagggagaatagctattgatactggcatcatcgaaaacagaggagattcgatatggccagtatcaacctggcggcagcgcaaaagatg

SEQ ID NO: 103282 - DNA, 103 bp, Artificial Sequence
  Synthetic Polynucleotide
taatacgactcactatagggcatcagaaacagaatagctattgatactggaacagaggagaccagtaatgatagctattaacctggcggcagcgcaaaagatg

SEQ ID NO: 103283 - DNA, 103 bp, Artificial Sequence
  Synthetic Polynucleotide
taatacgactcactatagggctggtggaaccatcagaaacagaatagctaaacagaggagatagctaatgtgtttctgaaacctggcggcagcgcaaaagatg

SEQ ID NO: 103284 - DNA, 103 bp, Artificial Sequence
  Synthetic Polynucleotide
taatacgactcactatagggaaaaagactcatcattcctggatctgccataacagaggagaatggcaatgccaggaatgaacctggcggcagcgcaaaagatg

SEQ ID NO: 103285 - DNA, 103 bp, Artificial Sequence
  Synthetic Polynucleotide
taatacgactcactatagggttgctgacccataggatttactggattttcaacagaggagagaaaatatggtaaatcctaacctggcggcagcgcaaaagatg

SEQ ID NO: 103286 - DNA, 103 bp, Artificial Sequence
  Synthetic Polynucleotide
taatacgactcactatagggcattggagtattatttgtaaggcctaaattaacagaggagaaatttaatgcttacaaataacctggcggcagcgcaaaagatg

SEQ ID NO: 103287 - DNA, 103 bp, Artificial Sequence
  Synthetic Polynucleotide
taatacgactcactatagggcggactgattcattggagtattatttgtaaaacagaggagattacaaatgatactccaaaacctggcggcagcgcaaaagatg

SEQ ID NO: 103288 - DNA, 103 bp, Artificial Sequence
  Synthetic Polynucleotide
taatacgactcactatagggtatcttggtacggactgattcattggagtaaacagaggagatactccatggaatcagtcaacctggcggcagcgcaaaagatg

SEQ ID NO: 103289 - DNA, 103 bp, Artificial Sequence
  Synthetic Polynucleotide
taatacgactcactatagggagcattggggtatcttggtacggactgattaacagaggagaaatcagatggtaccaagaaacctggcggcagcgcaaaagatg

SEQ ID NO: 103290 - DNA, 103 bp, Artificial Sequence
  Synthetic Polynucleotide
taatacgactcactatagggggaatcctacagcattggggtatcttggtaaacagaggagataccaaatgaccccaatgaacctggcggcagcgcaaaagatg

SEQ ID NO: 103291 - DNA, 103 bp, Artificial Sequence
  Synthetic Polynucleotide
taatacgactcactatagggctgtttgatgggaatcctacagcattggggaacagaggagaccccaaatgtgtaggattaacctggcggcagcgcaaaagatg

SEQ ID NO: 103292 - DNA, 103 bp, Artificial Sequence
  Synthetic Polynucleotide
taatacgactcactatagggtccttgaccactgtttgatgggaatcctacaacagaggagagtaggaatgccatcaaacaacctggcggcagcgcaaaagatg

SEQ ID NO: 103293 - DNA, 103 bp, Artificial Sequence
  Synthetic Polynucleotide
taatacgactcactatagggggtgcattagtccttgaccactgtttgatgaacagaggagacatcaaatggtggtcaagaacctggcggcagcgcaaaagatg

SEQ ID NO: 103294 - DNA, 103 bp, Artificial Sequence
  Synthetic Polynucleotide
taatacgactcactatagggatgggctgctggtgcattagtccttgaccaaacagaggagatggtcaatgactaatgcaaacctggcggcagcgcaaaagatg

SEQ ID NO: 103295 - DNA, 103 bp, Artificial Sequence
  Synthetic Polynucleotide
taatacgactcactatagggactggggtggatgggctgctggtgcattagaacagaggagactaatgatgcagcagcccaacctggcggcagcgcaaaagatg

SEQ ID NO: 103296 - DNA, 103 bp, Artificial Sequence
  Synthetic Polynucleotide
taatacgactcactatagggctattggcatttgctgacccataggatttaaacagaggagataaatcatgtgggtcagcaacctggcggcagcgcaaaagatg

SEQ ID NO: 103297 - DNA, 103 bp, Artificial Sequence
  Synthetic Polynucleotide
taatacgactcactatagggtaagtgagccactggggtggatgggctgctaacagaggagaagcagcatgtccaccccaaacctggcggcagcgcaaaagatg

SEQ ID NO: 103298 - DNA, 103 bp, Artificial Sequence
  Synthetic Polynucleotide
taatacgactcactatagggttcatttggttaagtgagccactggggtggaacagaggagaccacccatgtggctcactaacctggcggcagcgcaaaagatg

SEQ ID NO: 103299 - DNA, 103 bp, Artificial Sequence
  Synthetic Polynucleotide
taatacgactcactatagggagtttgtgtgttcatttggttaagtgagccaacagaggagaggctcaatgaaccaaatgaacctggcggcagcgcaaaagatg

SEQ ID NO: 103300 - DNA, 103 bp, Artificial Sequence
  Synthetic Polynucleotide
taatacgactcactatagggaaggatgcatagtttgtgtgttcatttggtaacagaggagaaccaaaatgacacacaaaaacctggcggcagcgcaaaagatg

SEQ ID NO: 103301 - DNA, 103 bp, Artificial Sequence
  Synthetic Polynucleotide
taatacgactcactatagggtgaggctgtgaaggatgcatagtttgtgtgaacagaggagacacacaatgtatgcatccaacctggcggcagcgcaaaagatg

SEQ ID NO: 103302 - DNA, 103 bp, Artificial Sequence
  Synthetic Polynucleotide
taatacgactcactatagggataagttccctgaggctgtgaaggatgcataacagaggagaatgcatatgtcacagcctaacctggcggcagcgcaaaagatg

SEQ ID NO: 103303 - DNA, 103 bp, Artificial Sequence
  Synthetic Polynucleotide
taatacgactcactataggggtggagaggcataagttccctgaggctgtgaacagaggagacacagcatgagggaacttaacctggcggcagcgcaaaagatg

SEQ ID NO: 103304 - DNA, 103 bp, Artificial Sequence
  Synthetic Polynucleotide
taatacgactcactataggggacatgggaggtggagaggcataagttcccaacagaggagagggaacatgtgcctctccaacctggcggcagcgcaaaagatg

SEQ ID NO: 103305 - DNA, 103 bp, Artificial Sequence
  Synthetic Polynucleotide
taatacgactcactatagggtttcatgggtgacatgggaggtggagaggcaacagaggagagcctctatgcctcccatgaacctggcggcagcgcaaaagatg

SEQ ID NO: 103306 - DNA, 103 bp, Artificial Sequence
  Synthetic Polynucleotide
taatacgactcactatagggtactcattgctttcatgggtgacatgggagaacagaggagactcccaatgcacccatgaaacctggcggcagcgcaaaagatg

SEQ ID NO: 103307 - DNA, 103 bp, Artificial Sequence
  Synthetic Polynucleotide
taatacgactcactatagggaagccttggtctattggcatttgctgacccaacagaggagagggtcaatgaatgccaataacctggcggcagcgcaaaagatg

SEQ ID NO: 103308 - DNA, 103 bp, Artificial Sequence
  Synthetic Polynucleotide
taatacgactcactatagggcctgctggattactcattgctttcatgggtaacagaggagaacccatatgagcaatgagaacctggcggcagcgcaaaagatg

SEQ ID NO: 103309 - DNA, 103 bp, Artificial Sequence
  Synthetic Polynucleotide
taatacgactcactatagggaggaggagtgcctgctggattactcattgcaacagaggagagcaatgatgaatccagcaaacctggcggcagcgcaaaagatg

SEQ ID NO: 103310 - DNA, 103 bp, Artificial Sequence
  Synthetic Polynucleotide
taatacgactcactatagggtgacttgtggaggaggagtgcctgctggataacagaggagaatccagatggcactcctcaacctggcggcagcgcaaaagatg

SEQ ID NO: 103311 - DNA, 103 bp, Artificial Sequence
  Synthetic Polynucleotide
taatacgactcactatagggcttcccggcctgacttgtggaggaggagtgaacagaggagacactccatgtccacaagtaacctggcggcagcgcaaaagatg

SEQ ID NO: 103312 - DNA, 103 bp, Artificial Sequence
  Synthetic Polynucleotide
taatacgactcactatagggtatcccagcacttcccggcctgacttgtggaacagaggagaccacaaatgaggccgggaaacctggcggcagcgcaaaagatg

SEQ ID NO: 103313 - DNA, 103 bp, Artificial Sequence
  Synthetic Polynucleotide
taatacgactcactatagggcttccattggtatcccagcacttcccggccaacagaggagaggccggatggtgctgggaaacctggcggcagcgcaaaagatg

SEQ ID NO: 103314 - DNA, 103 bp, Artificial Sequence
  Synthetic Polynucleotide
taatacgactcactatagggtaactgccaacttccattggtatcccagcaaacagaggagatgctggatgaccaatggaaacctggcggcagcgcaaaagatg

SEQ ID NO: 103315 - DNA, 103 bp, Artificial Sequence
  Synthetic Polynucleotide
taatacgactcactatagggcatatttggataactgccaacttccattggaacagaggagaccaatgatggttggcagtaacctggcggcagcgcaaaagatg

SEQ ID NO: 103316 - DNA, 103 bp, Artificial Sequence
  Synthetic Polynucleotide
taatacgactcactataggggaggatggggcatatttggataactgccaaaacagaggagattggcaatgatccaaataaacctggcggcagcgcaaaagatg

SEQ ID NO: 103317 - DNA, 103 bp, Artificial Sequence
  Synthetic Polynucleotide
taatacgactcactatagggtgagatggctgaggatggggcatatttggaaacagaggagatccaaaatggccccatccaacctggcggcagcgcaaaagatg

SEQ ID NO: 103318 - DNA, 103 bp, Artificial Sequence
  Synthetic Polynucleotide
taatacgactcactatagggtaaagaggcaaagccttggtctattggcataacagaggagaatgccaatggaccaaggcaacctggcggcagcgcaaaagatg

SEQ ID NO: 103319 - DNA, 103 bp, Artificial Sequence
  Synthetic Polynucleotide
taatacgactcactatagggagggggctggtgagatggctgaggatggggaacagaggagaccccatatgcagccatctaacctggcggcagcgcaaaagatg

SEQ ID NO: 103320 - DNA, 103 bp, Artificial Sequence
  Synthetic Polynucleotide
taatacgactcactatagggccatggcaccagggggctggtgagatggctaacagaggagaagccatatgaccagccccaacctggcggcagcgcaaaagatg

SEQ ID NO: 103321 - DNA, 103 bp, Artificial Sequence
  Synthetic Polynucleotide
taatacgactcactatagggtgtccgattcccatggcaccagggggctggaacagaggagaccagccatgtggtgccataacctggcggcagcgcaaaagatg

SEQ ID NO: 103322 - DNA, 103 bp, Artificial Sequence
  Synthetic Polynucleotide
taatacgactcactatagggcatattcctctgtccgattcccatggcaccaacagaggagaggtgccatgggaatcggaaacctggcggcagcgcaaaagatg

SEQ ID NO: 103323 - DNA, 103 bp, Artificial Sequence
  Synthetic Polynucleotide
taatacgactcactatagggttctggggcccatattcctctgtccgattcaacagaggagagaatcgatgagaggaataaacctggcggcagcgcaaaagatg

SEQ ID NO: 103324 - DNA, 103 bp, Artificial Sequence
  Synthetic Polynucleotide
taatacgactcactatagggtgctgcatgtttctggggcccatattcctcaacagaggagagaggaaatggggccccagaacctggcggcagcgcaaaagatg

SEQ ID NO: 103325 - DNA, 103 bp, Artificial Sequence
  Synthetic Polynucleotide
taatacgactcactatagggtggacgagactgctgcatgtttctggggccaacagaggagaggccccatgaacatgcagaacctggcggcagcgcaaaagatg

SEQ ID NO: 103326 - DNA, 103 bp, Artificial Sequence
  Synthetic Polynucleotide
taatacgactcactatagggtgcctataaatggacgagactgctgcatgtaacagaggagaacatgcatgagtctcgtcaacctggcggcagcgcaaaagatg

SEQ ID NO: 103327 - DNA, 103 bp, Artificial Sequence
  Synthetic Polynucleotide
taatacgactcactataggggccgaggacatgcctataaatggacgagacaacagaggagagtctcgatgatttataggaacctggcggcagcgcaaaagatg

SEQ ID NO: 103328 - DNA, 103 bp, Artificial Sequence
  Synthetic Polynucleotide
taatacgactcactatagggttcccttggtgccgaggacatgcctataaaaacagaggagatttataatgatgtcctcgaacctggcggcagcgcaaaagatg

SEQ ID NO: 103329 - DNA, 103 bp, Artificial Sequence
  Synthetic Polynucleotide
taatacgactcactataggggggatggctgtaaagaggcaaagccttggtaacagaggagaaccaagatgttgcctcttaacctggcggcagcgcaaaagatg

SEQ ID NO: 103330 - DNA, 103 bp, Artificial Sequence
  Synthetic Polynucleotide
taatacgactcactataggggcccagtcaattcccttggtgccgaggacaaacagaggagatgtcctatgcaccaagggaacctggcggcagcgcaaaagatg

SEQ ID NO: 103331 - DNA, 103 bp, Artificial Sequence
  Synthetic Polynucleotide
taatacgactcactatagggggcctcatgtgcccagtcaattcccttggtaacagaggagaaccaagatgattgactggaacctggcggcagcgcaaaagatg

SEQ ID NO: 103332 - DNA, 103 bp, Artificial Sequence
  Synthetic Polynucleotide
taatacgactcactatagggacaaccatttggcctcatgtgcccagtcaaaacagaggagattgactatgcacatgaggaacctggcggcagcgcaaaagatg

SEQ ID NO: 103333 - DNA, 103 bp, Artificial Sequence
  Synthetic Polynucleotide
taatacgactcactatagggcaacaccaggacaaccatttggcctcatgtaacagaggagaacatgaatgcaaatggttaacctggcggcagcgcaaaagatg

SEQ ID NO: 103334 - DNA, 103 bp, Artificial Sequence
  Synthetic Polynucleotide
taatacgactcactatagggtctccaaggccaacaccaggacaaccatttaacagaggagaaaatggatgtcctggtgtaacctggcggcagcgcaaaagatg

SEQ ID NO: 103335 - DNA, 103 bp, Artificial Sequence
  Synthetic Polynucleotide
taatacgactcactatagggtgcttgtgggtctccaaggccaacaccaggaacagaggagacctggtatgggccttggaaacctggcggcagcgcaaaagatg

SEQ ID NO: 103336 - DNA, 103 bp, Artificial Sequence
  Synthetic Polynucleotide
taatacgactcactataggggttcctggattgcttgtgggtctccaaggcaacagaggagagccttgatgacccacaagaacctggcggcagcgcaaaagatg

SEQ ID NO: 103337 - DNA, 103 bp, Artificial Sequence
  Synthetic Polynucleotide
taatacgactcactatagggggtatcagtcgttcctggattgcttgtgggaacagaggagacccacaatgaatccaggaaacctggcggcagcgcaaaagatg

SEQ ID NO: 103338 - DNA, 103 bp, Artificial Sequence
  Synthetic Polynucleotide
taatacgactcactatagggttgttggccaggtatcagtcgttcctggataacagaggagaatccagatgcgactgataaacctggcggcagcgcaaaagatg

SEQ ID NO: 103339 - DNA, 103 bp, Artificial Sequence
  Synthetic Polynucleotide
taatacgactcactataggggaccaggatgttgttggccaggtatcagtcaacagaggagagactgaatgctggccaacaacctggcggcagcgcaaaagatg

SEQ ID NO: 103340 - DNA, 103 bp, Artificial Sequence
  Synthetic Polynucleotide
taatacgactcactatagggggatgatgaagggatggctgtaaagaggcaaacagaggagatgcctcatgacagccatcaacctggcggcagcgcaaaagatg

SEQ ID NO: 103341 - DNA, 103 bp, Artificial Sequence
  Synthetic Polynucleotide
taatacgactcactataggggatggctgttgaccaggatgttgttggccaaacagaggagatggccaatgacatcctggaacctggcggcagcgcaaaagatg

SEQ ID NO: 103342 - DNA, 103 bp, Artificial Sequence
  Synthetic Polynucleotide
taatacgactcactatagggctgctgaaaagatggctgttgaccaggatgaacagaggagacatcctatgcaacagccaaacctggcggcagcgcaaaagatg

SEQ ID NO: 103343 - DNA, 103 bp, Artificial Sequence
  Synthetic Polynucleotide
taatacgactcactatagggaggttggcaactgctgaaaagatggctgttaacagaggagaaacagcatgcttttcagcaacctggcggcagcgcaaaagatg

SEQ ID NO: 103344 - DNA, 103 bp, Artificial Sequence
  Synthetic Polynucleotide
taatacgactcactatagggagtggaggacaggttggcaactgctgaaaaaacagaggagattttcaatggttgccaacaacctggcggcagcgcaaaagatg

SEQ ID NO: 103345 - DNA, 103 bp, Artificial Sequence
  Synthetic Polynucleotide
taatacgactcactataggggtgaggctgcagtggaggacaggttggcaaaacagaggagattgccaatgtgtcctccaaacctggcggcagcgcaaaagatg

SEQ ID NO: 103346 - DNA, 103 bp, Artificial Sequence
  Synthetic Polynucleotide
taatacgactcactataggggcaagcccgggtgaggctgcagtggaggacaacagaggagagtcctcatgtgcagcctcaacctggcggcagcgcaaaagatg

SEQ ID NO: 103347 - DNA, 103 bp, Artificial Sequence
  Synthetic Polynucleotide
taatacgactcactataggggactggtggtgcaagcccgggtgaggctgcaacagaggagagcagccatgcccgggcttaacctggcggcagcgcaaaagatg

SEQ ID NO: 103348 - DNA, 103 bp, Artificial Sequence
  Synthetic Polynucleotide
taatacgactcactatagggtggaggtgaagactggtggtgcaagcccggaacagaggagaccgggcatgcaccaccagaacctggcggcagcgcaaaagatg

SEQ ID NO: 103349 - DNA, 103 bp, Artificial Sequence
  Synthetic Polynucleotide
taatacgactcactataggggatgagggtgtggaggtgaagactggtggtaacagaggagaaccaccatgcttcacctcaacctggcggcagcgcaaaagatg

SEQ ID NO: 103350 - DNA, 103 bp, Artificial Sequence
  Synthetic Polynucleotide
taatacgactcactatagggcaaggctggtgatgagggtgtggaggtgaaaacagaggagattcaccatgacaccctcaaacctggcggcagcgcaaaagatg

SEQ ID NO: 103351 - DNA, 103 bp, Artificial Sequence
  Synthetic Polynucleotide
taatacgactcactatagggattagttgaaggatgatgaagggatggctgaacagaggagacagccaatgcttcatcataacctggcggcagcgcaaaagatg

SEQ ID NO: 103352 - DNA, 103 bp, Artificial Sequence
  Synthetic Polynucleotide
taatacgactcactataggggagctgtgcccaaggctggtgatgagggtgaacagaggagacaccctatgcaccagcctaacctggcggcagcgcaaaagatg

SEQ ID NO: 103353 - DNA, 103 bp, Artificial Sequence
  Synthetic Polynucleotide
taatacgactcactataggggtgatgggtggagctgtgcccaaggctggtaacagaggagaaccagcatggggcacagcaacctggcggcagcgcaaaagatg

SEQ ID NO: 103354 - DNA, 103 bp, Artificial Sequence
  Synthetic Polynucleotide
taatacgactcactataggggtgttctggggtgatgggtggagctgtgccaacagaggagaggcacaatgccacccatcaacctggcggcagcgcaaaagatg

SEQ ID NO: 103355 - DNA, 103 bp, Artificial Sequence
  Synthetic Polynucleotide
taatacgactcactatagggtttctgcggggtgttctggggtgatgggtgaacagaggagacacccaatgccccagaacaacctggcggcagcgcaaaagatg

SEQ ID NO: 103356 - DNA, 103 bp, Artificial Sequence
  Synthetic Polynucleotide
taatacgactcactataggggcacaggcactttctgcggggtgttctgggaacagaggagacccagaatgccccgcagaaacctggcggcagcgcaaaagatg

SEQ ID NO: 103357 - DNA, 103 bp, Artificial Sequence
  Synthetic Polynucleotide
taatacgactcactataggggaatgctgatgcacaggcactttctgcgggaacagaggagacccgcaatgagtgcctgtaacctggcggcagcgcaaaagatg

SEQ ID NO: 103358 - DNA, 103 bp, Artificial Sequence
  Synthetic Polynucleotide
taatacgactcactatagggctccgacggggaatgctgatgcacaggcacaacagaggagagtgcctatgcatcagcataacctggcggcagcgcaaaagatg

SEQ ID NO: 103359 - DNA, 103 bp, Artificial Sequence
  Synthetic Polynucleotide
taatacgactcactatagggctagaaagggctccgacggggaatgctgataacagaggagaatcagcatgccccgtcggaacctggcggcagcgcaaaagatg

SEQ ID NO: 103360 - DNA, 103 bp, Artificial Sequence
  Synthetic Polynucleotide
taatacgactcactatagggactggtttctctagaaagggctccgacgggaacagaggagacccgtcatggccctttctaacctggcggcagcgcaaaagatg

SEQ ID NO: 103361 - DNA, 103 bp, Artificial Sequence
  Synthetic Polynucleotide
taatacgactcactatagggcatatccggcactggtttctctagaaagggaacagaggagaccctttatggagaaaccaaacctggcggcagcgcaaaagatg

SEQ ID NO: 103362 - DNA, 103 bp, Artificial Sequence
  Synthetic Polynucleotide
taatacgactcactatagggtttgattttgattagttgaaggatgatgaaaacagaggagattcatcatgcttcaactaaacctggcggcagcgcaaaagatg

SEQ ID NO: 103363 - DNA, 103 bp, Artificial Sequence
  Synthetic Polynucleotide
taatacgactcactatagggtaacctgagtcatatccggcactggtttctaacagaggagaagaaacatgtgccggataaacctggcggcagcgcaaaagatg

SEQ ID NO: 103364 - DNA, 103 bp, Artificial Sequence
  Synthetic Polynucleotide
taatacgactcactatagggttcggtccactaacctgagtcatatccggcaacagaggagagccggaatggactcaggtaacctggcggcagcgcaaaagatg

SEQ ID NO: 103365 - DNA, 103 bp, Artificial Sequence
  Synthetic Polynucleotide
taatacgactcactatagggtagctgagcattcggtccactaacctgagtaacagaggagaactcagatgagtggaccgaacctggcggcagcgcaaaagatg

SEQ ID NO: 103366 - DNA, 103 bp, Artificial Sequence
  Synthetic Polynucleotide
taatacgactcactatagggcactcttcactagctgagcattcggtccacaacagaggagagtggacatgatgctcagcaacctggcggcagcgcaaaagatg

SEQ ID NO: 103367 - DNA, 103 bp, Artificial Sequence
  Synthetic Polynucleotide
taatacgactcactatagggaggtaatcatcactcttcactagctgagcaaacagaggagatgctcaatgagtgaagagaacctggcggcagcgcaaaagatg

SEQ ID NO: 103368 - DNA, 103 bp, Artificial Sequence
  Synthetic Polynucleotide
taatacgactcactatagggtattgatggcaggtaatcatcactcttcacaacagaggagagtgaagatggatgattacaacctggcggcagcgcaaaagatg

SEQ ID NO: 103369 - DNA, 103 bp, Artificial Sequence
  Synthetic Polynucleotide
taatacgactcactataggggctgctgttctattgatggcaggtaatcataacagaggagaatgattatgtgccatcaaaacctggcggcagcgcaaaagatg

SEQ ID NO: 103370 - DNA, 103 bp, Artificial Sequence
  Synthetic Polynucleotide
taatacgactcactatagggttttgttgtggctgctgttctattgatggcaacagaggagagccatcatgagaacagcaaacctggcggcagcgcaaaagatg

SEQ ID NO: 103371 - DNA, 103 bp, Artificial Sequence
  Synthetic Polynucleotide
taatacgactcactatagggtttcttcttcttttgttgtggctgctgttcaacagaggagagaacagatgccacaacaaaacctggcggcagcgcaaaagatg

SEQ ID NO: 103372 - DNA, 103 bp, Artificial Sequence
  Synthetic Polynucleotide
taatacgactcactatagggtgtttttctttttcttcttcttttgttgtgaacagaggagacacaacatgagaagaagaaacctggcggcagcgcaaaagatg

SEQ ID NO: 103373 - DNA, 103 bp, Artificial Sequence
  Synthetic Polynucleotide
taatacgactcactataggggtcagctttgtttgattttgattagttgaaaacagaggagattcaacatgtcaaaatcaaacctggcggcagcgcaaaagatg

SEQ ID NO: 103374 - DNA, 103 bp, Artificial Sequence
  Synthetic Polynucleotide
taatacgactcactatagggacaatgtggttgtttttctttttcttcttcaacagaggagagaagaaatgaaagaaaaaaacctggcggcagcgcaaaagatg

SEQ ID NO: 103375 - DNA, 103 bp, Artificial Sequence
  Synthetic Polynucleotide
taatacgactcactatagggatcctctgctacaatgtggttgtttttcttaacagaggagaaagaaaatgaaccacattaacctggcggcagcgcaaaagatg

SEQ ID NO: 103376 - DNA, 103 bp, Artificial Sequence
  Synthetic Polynucleotide
taatacgactcactatagggctttactgggatcctctgctacaatgtggtaacagaggagaaccacaatgtagcagaggaacctggcggcagcgcaaaagatg

SEQ ID NO: 103377 - DNA, 103 bp, Artificial Sequence
  Synthetic Polynucleotide
taatacgactcactatagggttaccaaaacctttactgggatcctctgctaacagaggagaagcagaatgtcccagtaaaacctggcggcagcgcaaaagatg

SEQ ID NO: 103378 - DNA, 103 bp, Artificial Sequence
  Synthetic Polynucleotide
taatacgactcactataggggaagtcatctttaccaaaacctttactgggaacagaggagacccagtatgggttttggtaacctggcggcagcgcaaaagatg

SEQ ID NO: 103379 - DNA, 103 bp, Artificial Sequence
  Synthetic Polynucleotide
taatacgactcactatagggccccaccagggaagtcatctttaccaaaacaacagaggagagttttgatgaagatgactaacctggcggcagcgcaaaagatg

SEQ ID NO: 103380 - DNA, 103 bp, Artificial Sequence
  Synthetic Polynucleotide
taatacgactcactatagggtggttatctaccccaccagggaagtcatctaacagaggagaagatgaatgccctggtggaacctggcggcagcgcaaaagatg

SEQ ID NO: 103381 - DNA, 103 bp, Artificial Sequence
  Synthetic Polynucleotide
taatacgactcactatagggatttagttcttggttatctaccccaccaggaacagaggagacctggtatggtagataacaacctggcggcagcgcaaaagatg

SEQ ID NO: 103382 - DNA, 103 bp, Artificial Sequence
  Synthetic Polynucleotide
taatacgactcactataggggtgagttcctatttagttcttggttatctaaacagaggagatagataatgaagaactaaaacctggcggcagcgcaaaagatg

SEQ ID NO: 103383 - DNA, 103 bp, Artificial Sequence
  Synthetic Polynucleotide
taatacgactcactataggggacccatccagtgagttcctatttagttctaacagaggagaagaactatgtaggaactcaacctggcggcagcgcaaaagatg

SEQ ID NO: 103384 - DNA, 103 bp, Artificial Sequence
  Synthetic Polynucleotide
taatacgactcactatagggatcaaaatgtgtcagctttgtttgattttgaacagaggagacaaaatatgacaaagctgaacctggcggcagcgcaaaagatg

SEQ ID NO: 103385 - DNA, 103 bp, Artificial Sequence
  Synthetic Polynucleotide
taatacgactcactatagggttcttcttgggacccatccagtgagttcctaacagaggagaaggaacatgctggatgggaacctggcggcagcgcaaaagatg

SEQ ID NO: 103386 - DNA, 103 bp, Artificial Sequence
  Synthetic Polynucleotide
taatacgactcactatagggttttctttttttcttcttgggacccatccaaacagaggagatggatgatgcccaagaagaacctggcggcagcgcaaaagatg

SEQ ID NO: 103387 - DNA, 103 bp, Artificial Sequence
  Synthetic Polynucleotide
taatacgactcactataggggaccttttctttttctttttttcttcttggaacagaggagaccaagaatgaaaaaagaaaacctggcggcagcgcaaaagatg

SEQ ID NO: 103388 - DNA, 103 bp, Artificial Sequence
  Synthetic Polynucleotide
taatacgactcactatagggttttgcctttgaccttttctttttctttttaacagaggagaaaaaagatgaagaaaaggaacctggcggcagcgcaaaagatg

SEQ ID NO: 103389 - DNA, 103 bp, Artificial Sequence
  Synthetic Polynucleotide
taatacgactcactatagggtcgggtctttttttgcctttgaccttttctaacagaggagaagaaaaatgcaaaggcaaaacctggcggcagcgcaaaagatg

SEQ ID NO: 103390 - DNA, 103 bp, Artificial Sequence
  Synthetic Polynucleotide
taatacgactcactatagggttcggttccttcgggtctttttttgcctttaacagaggagaaaaggcatgaaaagacccaacctggcggcagcgcaaaagatg

SEQ ID NO: 103391 - DNA, 103 bp, Artificial Sequence
  Synthetic Polynucleotide
taatacgactcactatagggcttgggttctttcggttccttcgggtctttaacagaggagaaaagacatgaaggaaccgaacctggcggcagcgcaaaagatg

SEQ ID NO: 103392 - DNA, 103 bp, Artificial Sequence
  Synthetic Polynucleotide
taatacgactcactatagggcttttttctccttgggttctttcggttcctaacagaggagaaggaacatgaagaacccaaacctggcggcagcgcaaaagatg

SEQ ID NO: 103393 - DNA, 103 bp, Artificial Sequence
  Synthetic Polynucleotide
taatacgactcactatagggtccttgggctcttttttctccttgggttctaacagaggagaagaaccatgggagaaaaaaacctggcggcagcgcaaaagatg

SEQ ID NO: 103394 - DNA, 103 bp, Artificial Sequence
  Synthetic Polynucleotide
taatacgactcactatagggggtcttgggttccttgggctcttttttctcaacagaggagagagaaaatggagcccaagaacctggcggcagcgcaaaagatg

SEQ ID NO: 103395 - DNA, 103 bp, Artificial Sequence
  Synthetic Polynucleotide
taatacgactcactatagggcatcctcgccaaaaagactcatcattcctgaacagaggagacaggaaatgtgagtctttaacctggcggcagcgcaaaagatg

SEQ ID NO: 103396 - DNA, 103 bp, Artificial Sequence
  Synthetic Polynucleotide
taatacgactcactataggggattatagtgatcaaaatgtgtcagctttgaacagaggagacaaagcatgcacattttgaacctggcggcagcgcaaaagatg

SEQ ID NO: 103397 - DNA, 103 bp, Artificial Sequence
  Synthetic Polynucleotide
taatacgactcactataggggggctttcggggtcttgggttccttgggctaacagaggagaagcccaatgaacccaagaaacctggcggcagcgcaaaagatg

SEQ ID NO: 103398 - DNA, 103 bp, Artificial Sequence
  Synthetic Polynucleotide
taatacgactcactatagggggaatcttaggggctttcggggtcttgggtaacagaggagaacccaaatgcccgaaagcaacctggcggcagcgcaaaagatg

SEQ ID NO: 103399 - DNA, 103 bp, Artificial Sequence
  Synthetic Polynucleotide
taatacgactcactatagggtggctctttgggaatcttaggggctttcggaacagaggagaccgaaaatgcctaagattaacctggcggcagcgcaaaagatg

SEQ ID NO: 103400 - DNA, 103 bp, Artificial Sequence
  Synthetic Polynucleotide
taatacgactcactatagggtcttttcctttggctctttgggaatcttagaacagaggagactaagaatgccaaagagcaacctggcggcagcgcaaaagatg

SEQ ID NO: 103401 - DNA, 103 bp, Artificial Sequence
  Synthetic Polynucleotide
taatacgactcactataggggtttttgctttcttttcctttggctctttgaacagaggagacaaagaatgaaaggaaaaaacctggcggcagcgcaaaagatg

SEQ ID NO: 103402 - DNA, 103 bp, Artificial Sequence
  Synthetic Polynucleotide
taatacgactcactatagggtggcgtggcagtttttgctttcttttccttaacagaggagaaaggaaatgaaagcaaaaaacctggcggcagcgcaaaagatg

SEQ ID NO: 103403 - DNA, 103 bp, Artificial Sequence
  Synthetic Polynucleotide
taatacgactcactatagggatttgggttttggcgtggcagtttttgcttaacagaggagaaagcaaatgctgccacgcaacctggcggcagcgcaaaagatg

SEQ ID NO: 103404 - DNA, 103 bp, Artificial Sequence
  Synthetic Polynucleotide
taatacgactcactatagggtttttgctggatttgggttttggcgtggcaaacagaggagatgccacatgaaaacccaaaacctggcggcagcgcaaaagatg

SEQ ID NO: 103405 - DNA, 103 bp, Artificial Sequence
  Synthetic Polynucleotide
taatacgactcactatagggattacttgactttttgctggatttgggtttaacagaggagaaaacccatgtccagcaaaaacctggcggcagcgcaaaagatg

SEQ ID NO: 103406 - DNA, 103 bp, Artificial Sequence
  Synthetic Polynucleotide
taatacgactcactatagggcaggtttcttattacttgactttttgctggaacagaggagaccagcaatgagtcaagtaaacctggcggcagcgcaaaagatg

SEQ ID NO: 103407 - DNA, 103 bp, Artificial Sequence
  Synthetic Polynucleotide
taatacgactcactatagggtgttcatactgattatagtgatcaaaatgtaacagaggagaacatttatgtcactataaaacctggcggcagcgcaaaagatg

SEQ ID NO: 103408 - DNA, 103 bp, Artificial Sequence
  Synthetic Polynucleotide
taatacgactcactataggggcttctgagtcaggtttcttattacttgacaacagaggagagtcaagatgtaagaaaccaacctggcggcagcgcaaaagatg

SEQ ID NO: 103409 - DNA, 103 bp, Artificial Sequence
  Synthetic Polynucleotide
taatacgactcactatagggcaaagcacttgcttctgagtcaggtttcttaacagaggagaaagaaaatggactcagaaaacctggcggcagcgcaaaagatg

SEQ ID NO: 103410 - DNA, 103 bp, Artificial Sequence
  Synthetic Polynucleotide
taatacgactcactatagggcctttttcttcaaagcacttgcttctgagtaacagaggagaactcagatgcaagtgcttaacctggcggcagcgcaaaagatg

SEQ ID NO: 103411 - DNA, 103 bp, Artificial Sequence
  Synthetic Polynucleotide
taatacgactcactatagggcccttgttgacctttttcttcaaagcacttaacagaggagaaagtgcatggaagaaaaaaacctggcggcagcgcaaaagatg

SEQ ID NO: 103412 - DNA, 103 bp, Artificial Sequence
  Synthetic Polynucleotide
taatacgactcactatagggttctgtttttcccttgttgacctttttcttaacagaggagaaagaaaatggtcaacaagaacctggcggcagcgcaaaagatg

SEQ ID NO: 103413 - DNA, 103 bp, Artificial Sequence
  Synthetic Polynucleotide
taatacgactcactatagggtttcagaaccttctgtttttcccttgttgaaacagaggagatcaacaatggaaaaacagaacctggcggcagcgcaaaagatg

SEQ ID NO: 103414 - DNA, 103 bp, Artificial Sequence
  Synthetic Polynucleotide
taatacgactcactatagggaagtctgaattttcagaaccttctgtttttaacagaggagaaaaaacatgaggttctgaaacctggcggcagcgcaaaagatg

SEQ ID NO: 103415 - DNA, 103 bp, Artificial Sequence
  Synthetic Polynucleotide
taatacgactcactatagggtgttttgtctaagtctgaattttcagaaccaacagaggagaggttctatgaattcagacaacctggcggcagcgcaaaagatg

SEQ ID NO: 103416 - DNA, 103 bp, Artificial Sequence
  Synthetic Polynucleotide
taatacgactcactatagggatggtgggggtgttttgtctaagtctgaataacagaggagaattcagatgtagacaaaaaacctggcggcagcgcaaaagatg

SEQ ID NO: 103417 - DNA, 103 bp, Artificial Sequence
  Synthetic Polynucleotide
taatacgactcactatagggggaggaggagatggtgggggtgttttgtctaacagaggagaagacaaatgacccccaccaacctggcggcagcgcaaaagatg

SEQ ID NO: 103418 - DNA, 103 bp, Artificial Sequence
  Synthetic Polynucleotide
taatacgactcactatagggcatcttttgttgttcatactgattatagtgaacagaggagacactatatgcagtatgaaaacctggcggcagcgcaaaagatg

SEQ ID NO: 103419 - DNA, 103 bp, Artificial Sequence
  Synthetic Polynucleotide
taatacgactcactatagggatcttcttcaggaggaggagatggtgggggaacagaggagacccccaatgtctcctcctaacctggcggcagcgcaaaagatg

SEQ ID NO: 103420 - DNA, 103 bp, Artificial Sequence
  Synthetic Polynucleotide
taatacgactcactatagggctgggtcctcatcttcttcaggaggaggagaacagaggagactcctcatgctgaagaagaacctggcggcagcgcaaaagatg

SEQ ID NO: 103421 - DNA, 103 bp, Artificial Sequence
  Synthetic Polynucleotide
taatacgactcactatagggttctgaacacctgggtcctcatcttcttcaaacagaggagatgaagaatgtgaggacccaacctggcggcagcgcaaaagatg

SEQ ID NO: 103422 - DNA, 103 bp, Artificial Sequence
  Synthetic Polynucleotide
taatacgactcactatagggggaccgtctcttctgaacacctgggtcctcaacagaggagagaggacatgggtgttcagaacctggcggcagcgcaaaagatg

SEQ ID NO: 103423 - DNA, 103 bp, Artificial Sequence
  Synthetic Polynucleotide
taatacgactcactatagggcctgtctgctggaccgtctcttctgaacacaacagaggagagtgttcatgagagacggtaacctggcggcagcgcaaaagatg

SEQ ID NO: 103424 - DNA, 103 bp, Artificial Sequence
  Synthetic Polynucleotide
taatacgactcactatagggtttctcttcacctgtctgctggaccgtctcaacagaggagagagacgatgcagcagacaaacctggcggcagcgcaaaagatg

SEQ ID NO: 103425 - DNA, 103 bp, Artificial Sequence
  Synthetic Polynucleotide
taatacgactcactatagggagtgtagcgctttctcttcacctgtctgctaacagaggagaagcagaatggtgaagagaaacctggcggcagcgcaaaagatg

SEQ ID NO: 103426 - DNA, 103 bp, Artificial Sequence
  Synthetic Polynucleotide
taatacgactcactatagggccaggtcttcagtgtagcgctttctcttcaaacagaggagatgaagaatgagcgctacaaacctggcggcagcgcaaaagatg

SEQ ID NO: 103427 - DNA, 103 bp, Artificial Sequence
  Synthetic Polynucleotide
taatacgactcactatagggatcttgaactccaggtcttcagtgtagcgcaacagaggagagcgctaatgtgaagacctaacctggcggcagcgcaaaagatg

SEQ ID NO: 103428 - DNA, 103 bp, Artificial Sequence
  Synthetic Polynucleotide
taatacgactcactatagggctcatcagaaatcttgaactccaggtcttcaacagaggagagaagacatggagttcaagaacctggcggcagcgcaaaagatg

SEQ ID NO: 103429 - DNA, 103 bp, Artificial Sequence
  Synthetic Polynucleotide
taatacgactcactatagggccatcagatgcatcttttgttgttcatactaacagaggagaagtatgatgaacaaaagaaacctggcggcagcgcaaaagatg

SEQ ID NO: 103430 - DNA, 103 bp, Artificial Sequence
  Synthetic Polynucleotide
taatacgactcactatagggcatctgcctcctcatcagaaatcttgaactaacagaggagaagttcaatgtttctgatgaacctggcggcagcgcaaaagatg

SEQ ID NO: 103431 - DNA, 103 bp, Artificial Sequence
  Synthetic Polynucleotide
taatacgactcactataggggcatctgcatcatctgcctcctcatcagaaaacagaggagattctgaatgggaggcagaaacctggcggcagcgcaaaagatg

SEQ ID NO: 103432 - DNA, 103 bp, Artificial Sequence
  Synthetic Polynucleotide
taatacgactcactatagggcctcccagcagcatctgcatcatctgcctcaacagaggagagaggcaatggatgcagataacctggcggcagcgcaaaagatg

SEQ ID NO: 103433 - DNA, 103 bp, Artificial Sequence
  Synthetic Polynucleotide
taatacgactcactatagggagggggaatccctcccagcagcatctgcataacagaggagaatgcagatgctgctgggaaacctggcggcagcgcaaaagatg

SEQ ID NO: 103434 - DNA, 103 bp, Artificial Sequence
  Synthetic Polynucleotide
taatacgactcactataggggaggtgttggagggggaatccctcccagcaaacagaggagatgctggatgggattccccaacctggcggcagcgcaaaagatg

SEQ ID NO: 103435 - DNA, 103 bp, Artificial Sequence
  Synthetic Polynucleotide
taatacgactcactatagggttctgactgggaggtgttggagggggaatcaacagaggagagattccatgtccaacaccaacctggcggcagcgcaaaagatg

SEQ ID NO: 103436 - DNA, 103 bp, Artificial Sequence
  Synthetic Polynucleotide
taatacgactcactatagggattcctgctgttctgactgggaggtgttggaacagaggagaccaacaatgcccagtcagaacctggcggcagcgcaaaagatg

SEQ ID NO: 103437 - DNA, 103 bp, Artificial Sequence
  Synthetic Polynucleotide
taatacgactcactataggggcatcaacagattcctgctgttctgactggaacagaggagaccagtcatgacagcaggaaacctggcggcagcgcaaaagatg

SEQ ID NO: 103438 - DNA, 103 bp, Artificial Sequence
  Synthetic Polynucleotide
taatacgactcactatagggtgggccttctgcatcaacagattcctgctgaacagaggagacagcagatgtctgttgataacctggcggcagcgcaaaagatg

SEQ ID NO: 103439 - DNA, 103 bp, Artificial Sequence
  Synthetic Polynucleotide
taatacgactcactatagggtttctaccactgggccttctgcatcaacagaacagaggagactgttgatgcagaaggccaacctggcggcagcgcaaaagatg

SEQ ID NO: 103440 - DNA, 103 bp, Artificial Sequence
  Synthetic Polynucleotide
taatacgactcactatagggttcggctgatccatcagatgcatcttttgtaacagaggagaacaaaaatggcatctgataacctggcggcagcgcaaaagatg

SEQ ID NO: 103441 - DNA, 103 bp, Artificial Sequence
  Synthetic Polynucleotide
taatacgactcactatagggctcataattttttctaccactgggccttctaacagaggagaagaaggatgagtggtagaaacctggcggcagcgcaaaagatg

SEQ ID NO: 103442 - DNA, 103 bp, Artificial Sequence
  Synthetic Polynucleotide
taatacgactcactatagggtgaacgactgctcataattttttctaccacaacagaggagagtggtaatgaaaattatgaacctggcggcagcgcaaaagatg

SEQ ID NO: 103443 - DNA, 103 bp, Artificial Sequence
  Synthetic Polynucleotide
taatacgactcactataggggcttttttactgaacgactgctcataatttaacagaggagaaaattaatggcagtcgttaacctggcggcagcgcaaaagatg

SEQ ID NO: 103444 - DNA, 103 bp, Artificial Sequence
  Synthetic Polynucleotide
taatacgactcactataggggattccttctgcttttttactgaacgactgaacagaggagacagtcgatgagtaaaaaaaacctggcggcagcgcaaaagatg

SEQ ID NO: 103445 - DNA, 103 bp, Artificial Sequence
  Synthetic Polynucleotide
taatacgactcactatagggctcctctccagattccttctgcttttttacaacagaggagagtaaaaatgcagaaggaaaacctggcggcagcgcaaaagatg

SEQ ID NO: 103446 - DNA, 103 bp, Artificial Sequence
  Synthetic Polynucleotide
taatacgactcactatagggcaatttctacctcctctccagattccttctaacagaggagaagaaggatgctggagaggaacctggcggcagcgcaaaagatg

SEQ ID NO: 103447 - DNA, 103 bp, Artificial Sequence
  Synthetic Polynucleotide
taatacgactcactatagggtagaattcctcaatttctacctcctctccaaacagaggagatggagaatgggtagaaataacctggcggcagcgcaaaagatg

SEQ ID NO: 103448 - DNA, 103 bp, Artificial Sequence
  Synthetic Polynucleotide
taatacgactcactataggggtatttcacatagaattcctcaatttctacaacagaggagagtagaaatggaggaattcaacctggcggcagcgcaaaagatg

SEQ ID NO: 103449 - DNA, 103 bp, Artificial Sequence
  Synthetic Polynucleotide
taatacgactcactatagggagaagtttttgtatttcacatagaattcctaacagaggagaaggaatatgatgtgaaataacctggcggcagcgcaaaagatg

SEQ ID NO: 103450 - DNA, 103 bp, Artificial Sequence
  Synthetic Polynucleotide
taatacgactcactatagggtgaagataagagaagtttttgtatttcacaaacagaggagatgtgaaatgcaaaaacttaacctggcggcagcgcaaaagatg

SEQ ID NO: 103451 - DNA, 103 bp, Artificial Sequence
  Synthetic Polynucleotide
taatacgactcactatagggcatcattctgttcggctgatccatcagatgaacagaggagacatctgatggatcagccgaacctggcggcagcgcaaaagatg

SEQ ID NO: 103452 - DNA, 103 bp, Artificial Sequence
  Synthetic Polynucleotide
taatacgactcactatagggccactgacaatgaagataagagaagtttttaacagaggagaaaaaacatgtcttatcttaacctggcggcagcgcaaaagatg

SEQ ID NO: 103453 - DNA, 103 bp, Artificial Sequence
  Synthetic Polynucleotide
taatacgactcactatagggctatagatgcccactgacaatgaagataagaacagaggagacttatcatgattgtcagtaacctggcggcagcgcaaaagatg

SEQ ID NO: 103454 - DNA, 103 bp, Artificial Sequence
  Synthetic Polynucleotide
taatacgactcactatagggtccagatcttctatagatgcccactgacaaaacagaggagattgtcaatgggcatctataacctggcggcagcgcaaaagatg

SEQ ID NO: 103455 - DNA, 103 bp, Artificial Sequence
  Synthetic Polynucleotide
taatacgactcactatagggcttatctttttccagatcttctatagatgcaacagaggagagcatctatggaagatctgaacctggcggcagcgcaaaagatg

SEQ ID NO: 103456 - DNA, 103 bp, Artificial Sequence
  Synthetic Polynucleotide
taatacgactcactataggggctgaattctcttatctttttccagatcttaacagaggagaaagatcatgaaaaagataaacctggcggcagcgcaaaagatg

SEQ ID NO: 103457 - DNA, 103 bp, Artificial Sequence
  Synthetic Polynucleotide
taatacgactcactatagggttaattttttgctgaattctcttatcttttaacagaggagaaaaagaatggagaattcaaacctggcggcagcgcaaaagatg

SEQ ID NO: 103458 - DNA, 103 bp, Artificial Sequence
  Synthetic Polynucleotide
taatacgactcactatagggcttaaatcgtttaattttttgctgaattctaacagaggagaagaattatgcaaaaaattaacctggcggcagcgcaaaagatg

SEQ ID NO: 103459 - DNA, 103 bp, Artificial Sequence
  Synthetic Polynucleotide
taatacgactcactatagggcctgctttgccttaaatcgtttaattttttaacagaggagaaaaaaaatgaacgatttaaacctggcggcagcgcaaaagatg

SEQ ID NO: 103460 - DNA, 103 bp, Artificial Sequence
  Synthetic Polynucleotide
taatacgactcactatagggttgttctggccctgctttgccttaaatcgtaacagaggagaacgattatgggcaaagcaaacctggcggcagcgcaaaagatg

SEQ ID NO: 103461 - DNA, 103 bp, Artificial Sequence
  Synthetic Polynucleotide
taatacgactcactatagggtgaaaggaacttgttctggccctgctttgcaacagaggagagcaaagatgggccagaacaacctggcggcagcgcaaaagatg

SEQ ID NO: 103462 - DNA, 103 bp, Artificial Sequence
  Synthetic Polynucleotide
taatacgactcactataggggggtgttgctcatcattctgttcggctgataacagaggagaatcagcatgacagaatgaaacctggcggcagcgcaaaagatg

SEQ ID NO: 103463 - DNA, 103 bp, Artificial Sequence
  Synthetic Polynucleotide
taatacgactcactatagggcctcaatctctgaaaggaacttgttctggcaacagaggagagccagaatgagttcctttaacctggcggcagcgcaaaagatg

SEQ ID NO: 103464 - DNA, 103 bp, Artificial Sequence
  Synthetic Polynucleotide
taatacgactcactatagggaaaagctcatcctcaatctctgaaaggaacaacagaggagagttcctatgagagattgaaacctggcggcagcgcaaaagatg

SEQ ID NO: 103465 - DNA, 103 bp, Artificial Sequence
  Synthetic Polynucleotide
taatacgactcactatagggatctggattaaaaagctcatcctcaatctcaacagaggagagagattatggatgagcttaacctggcggcagcgcaaaagatg

SEQ ID NO: 103466 - DNA, 103 bp, Artificial Sequence
  Synthetic Polynucleotide
taatacgactcactatagggcctccacataatctggattaaaaagctcataacagaggagaatgagcatgttaatccagaacctggcggcagcgcaaaagatg

SEQ ID NO: 103467 - DNA, 103 bp, Artificial Sequence
  Synthetic Polynucleotide
taatacgactcactatagggatccggtcaacctccacataatctggattaaacagaggagataatccatgttatgtggaaacctggcggcagcgcaaaagatg

SEQ ID NO: 103468 - DNA, 103 bp, Artificial Sequence
  Synthetic Polynucleotide
taatacgactcactatagggaaagtccattatccggtcaacctccacataaacagaggagatatgtgatggttgaccggaacctggcggcagcgcaaaagatg

SEQ ID NO: 103469 - DNA, 103 bp, Artificial Sequence
  Synthetic Polynucleotide
taatacgactcactatagggtgctacgtgcaaagtccattatccggtcaaaacagaggagattgaccatgtaatggactaacctggcggcagcgcaaaagatg

SEQ ID NO: 103470 - DNA, 103 bp, Artificial Sequence
  Synthetic Polynucleotide
taatacgactcactatagggcggtcatctgtgctacgtgcaaagtccattaacagaggagaaatggaatgtgcacgtagaacctggcggcagcgcaaaagatg

SEQ ID NO: 103471 - DNA, 103 bp, Artificial Sequence
  Synthetic Polynucleotide
taatacgactcactatagggaggctctccccggtcatctgtgctacgtgcaacagaggagagcacgtatgacagatgacaacctggcggcagcgcaaaagatg

SEQ ID NO: 103472 - DNA, 103 bp, Artificial Sequence
  Synthetic Polynucleotide
taatacgactcactatagggagtgagtcacaggctctccccggtcatctgaacagaggagacagatgatgggggagagcaacctggcggcagcgcaaaagatg

SEQ ID NO: 103473 - DNA, 103 bp, Artificial Sequence
  Synthetic Polynucleotide
taatacgactcactatagggccgttcccaggggtgttgctcatcattctgaacagaggagacagaatatggagcaacacaacctggcggcagcgcaaaagatg

SEQ ID NO: 103474 - DNA, 103 bp, Artificial Sequence
  Synthetic Polynucleotide
taatacgactcactatagggttcaccagatagtgagtcacaggctctcccaacagaggagagggagaatgtgtgactcaaacctggcggcagcgcaaaagatg

SEQ ID NO: 103475 - DNA, 103 bp, Artificial Sequence
  Synthetic Polynucleotide
taatacgactcactatagggtgaacaccacttcaccagatagtgagtcacaacagaggagagtgactatgtatctggtgaacctggcggcagcgcaaaagatg

SEQ ID NO: 103476 - DNA, 103 bp, Artificial Sequence
  Synthetic Polynucleotide
taatacgactcactatagggcataaggaagtgaacaccacttcaccagataacagaggagaatctggatgagtggtgttaacctggcggcagcgcaaaagatg

SEQ ID NO: 103477 - DNA, 103 bp, Artificial Sequence
  Synthetic Polynucleotide
taatacgactcactataggggtgctgtcttcataaggaagtgaacaccacaacagaggagagtggtgatgacttccttaaacctggcggcagcgcaaaagatg

SEQ ID NO: 103478 - DNA, 103 bp, Artificial Sequence
  Synthetic Polynucleotide
taatacgactcactatagggccgctcccacgtgctgtcttcataaggaagaacagaggagacttcctatggaagacagcaacctggcggcagcgcaaaagatg

SEQ ID NO: 103479 - DNA, 103 bp, Artificial Sequence
  Synthetic Polynucleotide
taatacgactcactatagggtgtcctgcctccgctcccacgtgctgtcttaacagaggagaaagacaatgcgtgggagcaacctggcggcagcgcaaaagatg

SEQ ID NO: 103480 - DNA, 103 bp, Artificial Sequence
  Synthetic Polynucleotide
taatacgactcactataggggcttgatctatgtcctgcctccgctcccacaacagaggagagtgggaatggaggcaggaaacctggcggcagcgcaaaagatg

SEQ ID NO: 103481 - DNA, 103 bp, Artificial Sequence
  Synthetic Polynucleotide
taatacgactcactatagggctcgatctttgcttgatctatgtcctgcctaacagaggagaaggcagatgatagatcaaaacctggcggcagcgcaaaagatg

SEQ ID NO: 103482 - DNA, 103 bp, Artificial Sequence
  Synthetic Polynucleotide
taatacgactcactatagggtctcaaactcctcgatctttgcttgatctaaacagaggagatagatcatgcaaagatcgaacctggcggcagcgcaaaagatg

SEQ ID NO: 103483 - DNA, 103 bp, Artificial Sequence
  Synthetic Polynucleotide
taatacgactcactataggggacattagtttctcaaactcctcgatctttaacagaggagaaaagatatgggagtttgaaacctggcggcagcgcaaaagatg

SEQ ID NO: 103484 - DNA, 103 bp, Artificial Sequence
  Synthetic Polynucleotide
taatacgactcactatagggagacgcgagtccgttcccaggggtgttgctaacagaggagaagcaacatgcctgggaacaacctggcggcagcgcaaaagatg

SEQ ID NO: 103485 - DNA, 103 bp, Artificial Sequence
  Synthetic Polynucleotide
taatacgactcactatagggcggctccctggacattagtttctcaaactcaacagaggagagagtttatgaaactaatgaacctggcggcagcgcaaaagatg

SEQ ID NO: 103486 - DNA, 103 bp, Artificial Sequence
  Synthetic Polynucleotide
taatacgactcactataggggctctgtttccggctccctggacattagttaacagaggagaaactaaatgccagggagcaacctggcggcagcgcaaaagatg

SEQ ID NO: 103487 - DNA, 103 bp, Artificial Sequence
  Synthetic Polynucleotide
taatacgactcactatagggcgctccacacgctctgtttccggctccctgaacagaggagacagggaatgggaaacagaaacctggcggcagcgcaaaagatg

SEQ ID NO: 103488 - DNA, 103 bp, Artificial Sequence
  Synthetic Polynucleotide
taatacgactcactatagggagcaggaggtcgctccacacgctctgtttcaacagaggagagaaacaatgcgtgtggagaacctggcggcagcgcaaaagatg

SEQ ID NO: 103489 - DNA, 103 bp, Artificial Sequence
  Synthetic Polynucleotide
taatacgactcactatagggtccaatcatcagcaggaggtcgctccacacaacagaggagagtgtggatggacctcctgaacctggcggcagcgcaaaagatg

SEQ ID NO: 103490 - DNA, 103 bp, Artificial Sequence
  Synthetic Polynucleotide
taatacgactcactatagggtccgatttcttccaatcatcagcaggaggtaacagaggagaacctccatgtgatgattgaacctggcggcagcgcaaaagatg

SEQ ID NO: 103491 - DNA, 103 bp, Artificial Sequence
  Synthetic Polynucleotide
taatacgactcactatagggcctggaactctccgatttcttccaatcatcaacagaggagagatgatatgaagaaatcgaacctggcggcagcgcaaaagatg

SEQ ID NO: 103492 - DNA, 103 bp, Artificial Sequence
  Synthetic Polynucleotide
taatacgactcactatagggttttatactccctggaactctccgatttctaacagaggagaagaaatatgagagttccaaacctggcggcagcgcaaaagatg

SEQ ID NO: 103493 - DNA, 103 bp, Artificial Sequence
  Synthetic Polynucleotide
taatacgactcactatagggttgttattgtttttatactccctggaactcaacagaggagagagttcatgggagtataaaacctggcggcagcgcaaaagatg

SEQ ID NO: 103494 - DNA, 103 bp, Artificial Sequence
  Synthetic Polynucleotide
taatacgactcactatagggttccctgagtttgttattgtttttatactcaacagaggagagagtatatgaacaataacaacctggcggcagcgcaaaagatg

SEQ ID NO: 103495 - DNA, 103 bp, Artificial Sequence
  Synthetic Polynucleotide
taatacgactcactataggggcgagtgcggagacgcgagtccgttcccagaacagaggagactgggaatggactcgcgtaacctggcggcagcgcaaaagatg

SEQ ID NO: 103496 - DNA, 103 bp, Artificial Sequence
  Synthetic Polynucleotide
taatacgactcactatagggccaactggtattccctgagtttgttattgtaacagaggagaacaataatgaactcagggaacctggcggcagcgcaaaagatg

SEQ ID NO: 103497 - DNA, 103 bp, Artificial Sequence
  Synthetic Polynucleotide
taatacgactcactatagggtttactccctccaactggtattccctgagtaacagaggagaactcagatgataccagttaacctggcggcagcgcaaaagatg

SEQ ID NO: 103498 - DNA, 103 bp, Artificial Sequence
  Synthetic Polynucleotide
taatacgactcactatagggaagtagccagtttactccctccaactggtaaacagaggagataccagatggagggagtaaacctggcggcagcgcaaaagatg

SEQ ID NO: 103499 - DNA, 103 bp, Artificial Sequence
  Synthetic Polynucleotide
taatacgactcactatagggaccaattgaaaagtagccagtttactccctaacagaggagaagggagatgactggctacaacctggcggcagcgcaaaagatg

SEQ ID NO: 103500 - DNA, 103 bp, Artificial Sequence
  Synthetic Polynucleotide
taatacgactcactatagggcgcatgttgtaccaattgaaaagtagccagaacagaggagactggctatgtttcaattgaacctggcggcagcgcaaaagatg

SEQ ID NO: 103501 - DNA, 103 bp, Artificial Sequence
  Synthetic Polynucleotide
taatacgactcactatagggaatgcagtttcgcatgttgtaccaattgaaaacagaggagattcaatatgtacaacatgaacctggcggcagcgcaaaagatg

SEQ ID NO: 103502 - DNA, 103 bp, Artificial Sequence
  Synthetic Polynucleotide
taatacgactcactatagggcatctgctaaaatgcagtttcgcatgttgtaacagaggagaacaacaatggaaactgcaaacctggcggcagcgcaaaagatg

SEQ ID NO: 103503 - DNA, 103 bp, Artificial Sequence
  Synthetic Polynucleotide
taatacgactcactatagggaaacccatttcatctgctaaaatgcagtttaacagaggagaaaactgatgtttagcagaaacctggcggcagcgcaaaagatg

SEQ ID NO: 103504 - DNA, 103 bp, Artificial Sequence
  Synthetic Polynucleotide
taatacgactcactatagggagtttttcccaaacccatttcatctgctaaaacagaggagattagcaatggaaatgggtaacctggcggcagcgcaaaagatg

SEQ ID NO: 103505 - DNA, 103 bp, Artificial Sequence
  Synthetic Polynucleotide
taatacgactcactatagggtggactggatagtttttcccaaacccatttaacagaggagaaaatggatgtgggaaaaaaacctggcggcagcgcaaaagatg

SEQ ID NO: 103506 - DNA, 103 bp, Artificial Sequence
  Synthetic Polynucleotide
taatacgactcactatagggaaaatattcccatcctcgccaaaaagactcaacagaggagagagtctatgtggcgaggaaacctggcggcagcgcaaaagatg

SEQ ID NO: 103507 - DNA, 103 bp, Artificial Sequence
  Synthetic Polynucleotide
taatacgactcactataggggtgtgatactgcgagtgcggagacgcgagtaacagaggagaactcgcatgtccgcactcaacctggcggcagcgcaaaagatg

SEQ ID NO: 103508 - DNA, 103 bp, Artificial Sequence
  Synthetic Polynucleotide
taatacgactcactatagggagaaatgtaatggactggatagtttttcccaacagaggagagggaaaatgtatccagtcaacctggcggcagcgcaaaagatg

SEQ ID NO: 103509 - DNA, 103 bp, Artificial Sequence
  Synthetic Polynucleotide
taatacgactcactatagggtatctcatagagaaatgtaatggactggataacagaggagaatccagatgattacatttaacctggcggcagcgcaaaagatg

SEQ ID NO: 103510 - DNA, 103 bp, Artificial Sequence
  Synthetic Polynucleotide
taatacgactcactatagggctttcaaatatatctcatagagaaatgtaaaacagaggagattacatatgtctatgagaaacctggcggcagcgcaaaagatg

SEQ ID NO: 103511 - DNA, 103 bp, Artificial Sequence
  Synthetic Polynucleotide
taatacgactcactatagggccatggattcctttcaaatatatctcatagaacagaggagactatgaatgatatttgaaaacctggcggcagcgcaaaagatg

SEQ ID NO: 103512 - DNA, 103 bp, Artificial Sequence
  Synthetic Polynucleotide
taatacgactcactatagggtaaaaaagggccatggattcctttcaaataaacagaggagatatttgatgggaatccataacctggcggcagcgcaaaagatg

SEQ ID NO: 103513 - DNA, 103 bp, Artificial Sequence
  Synthetic Polynucleotide
taatacgactcactataggggggcaattactaaaaaagggccatggattcaacagaggagagaatccatggccctttttaacctggcggcagcgcaaaagatg

SEQ ID NO: 103514 - DNA, 103 bp, Artificial Sequence
  Synthetic Polynucleotide
taatacgactcactataggggtggacaatggggcaattactaaaaaagggaacagaggagaccctttatgagtaattgcaacctggcggcagcgcaaaagatg

SEQ ID NO: 103515 - DNA, 103 bp, Artificial Sequence
  Synthetic Polynucleotide
taatacgactcactataggggttggggattgtggacaatggggcaattacaacagaggagagtaattatgccattgtccaacctggcggcagcgcaaaagatg

SEQ ID NO: 103516 - DNA, 103 bp, Artificial Sequence
  Synthetic Polynucleotide
taatacgactcactatagggccctttcccagttggggattgtggacaatgaacagaggagacattgtatgcaatccccaaacctggcggcagcgcaaaagatg

SEQ ID NO: 103517 - DNA, 103 bp, Artificial Sequence
  Synthetic Polynucleotide
taatacgactcactataggggttcggaattccctttcccagttggggattaacagaggagaaatcccatgctgggaaagaacctggcggcagcgcaaaagatg

SEQ ID NO: 103518 - DNA, 103 bp, Artificial Sequence
  Synthetic Polynucleotide
taatacgactcactatagggaacgggaggggtgtgatactgcgagtgcggaacagaggagaccgcacatgcagtatcacaacctggcggcagcgcaaaagatg

SEQ ID NO: 103519 - DNA, 103 bp, Artificial Sequence
  Synthetic Polynucleotide
taatacgactcactatagggctctgtccaggttcggaattccctttcccaaacagaggagatgggaaatggaattccgaaacctggcggcagcgcaaaagatg

SEQ ID NO: 103520 - DNA, 103 bp, Artificial Sequence
  Synthetic Polynucleotide
taatacgactcactatagggccacgttcaactctgtccaggttcggaattaacagaggagaaattccatgcctggacagaacctggcggcagcgcaaaagatg

SEQ ID NO: 103521 - DNA, 103 bp, Artificial Sequence
  Synthetic Polynucleotide
taatacgactcactatagggtgatacacaaccacgttcaactctgtccagaacagaggagactggacatggttgaacgtaacctggcggcagcgcaaaagatg

SEQ ID NO: 103522 - DNA, 103 bp, Artificial Sequence
  Synthetic Polynucleotide
taatacgactcactatagggttgactcccatgatacacaaccacgttcaaaacagaggagattgaacatggttgtgtataacctggcggcagcgcaaaagatg

SEQ ID NO: 103523 - DNA, 103 bp, Artificial Sequence
  Synthetic Polynucleotide
taatacgactcactataggggacgactagcttgactcccatgatacacaaaacagaggagattgtgtatgatgggagtcaacctggcggcagcgcaaaagatg

SEQ ID NO: 103524 - DNA, 103 bp, Artificial Sequence
  Synthetic Polynucleotide
taatacgactcactatagggtgaatggtccgacgactagcttgactcccaaacagaggagatgggagatgagctagtcgaacctggcggcagcgcaaaagatg

SEQ ID NO: 103525 - DNA, 103 bp, Artificial Sequence
  Synthetic Polynucleotide
taatacgactcactatagggttcatacaactgaatggtccgacgactagcaacagaggagagctagtatgcggaccattaacctggcggcagcgcaaaagatg

SEQ ID NO: 103526 - DNA, 103 bp, Artificial Sequence
  Synthetic Polynucleotide
taatacgactcactatagggtgaagtacatttcatacaactgaatggtccaacagaggagaggaccaatgagttgtatgaacctggcggcagcgcaaaagatg

SEQ ID NO: 103527 - DNA, 103 bp, Artificial Sequence
  Synthetic Polynucleotide
taatacgactcactatagggtggggatctttgaagtacatttcatacaacaacagaggagagttgtaatgaatgtacttaacctggcggcagcgcaaaagatg

SEQ ID NO: 103528 - DNA, 103 bp, Artificial Sequence
  Synthetic Polynucleotide
taatacgactcactatagggcactcgaccctggggatctttgaagtacataacagaggagaatgtacatgaaagatcccaacctggcggcagcgcaaaagatg

SEQ ID NO: 103529 - DNA, 103 bp, Artificial Sequence
  Synthetic Polynucleotide
taatacgactcactataggggcacctgaggaacgggaggggtgtgatactaacagaggagaagtatcatgcccctcccgaacctggcggcagcgcaaaagatg

SEQ ID NO: 103530 - DNA, 103 bp, Artificial Sequence
  Synthetic Polynucleotide
taatacgactcactatagggacccctttatcactcgaccctggggatcttaacagaggagaaagatcatgagggtcgagaacctggcggcagcgcaaaagatg

SEQ ID NO: 103531 - DNA, 103 bp, Artificial Sequence
  Synthetic Polynucleotide
taatacgactcactatagggaacttataggacccctttatcactcgacccaacagaggagagggtcgatggataaagggaacctggcggcagcgcaaaagatg

SEQ ID NO: 103532 - DNA, 103 bp, Artificial Sequence
  Synthetic Polynucleotide
taatacgactcactataggggatggcatgaaacttataggacccctttataacagaggagaataaagatgtcctataagaacctggcggcagcgcaaaagatg

SEQ ID NO: 103533 - DNA, 103 bp, Artificial Sequence
  Synthetic Polynucleotide
taatacgactcactatagggatgtagtgatgatggcatgaaacttataggaacagaggagacctataatgttcatgccaaacctggcggcagcgcaaaagatg

SEQ ID NO: 103534 - DNA, 103 bp, Artificial Sequence
  Synthetic Polynucleotide
taatacgactcactatagggatcatctcaaatgtagtgatgatggcatgaaacagaggagatcatgcatgcatcactacaacctggcggcagcgcaaaagatg

SEQ ID NO: 103535 - DNA, 103 bp, Artificial Sequence
  Synthetic Polynucleotide
taatacgactcactatagggatcagtcaaaatcatctcaaatgtagtgataacagaggagaatcactatgtttgagatgaacctggcggcagcgcaaaagatg

SEQ ID NO: 103536 - DNA, 103 bp, Artificial Sequence
  Synthetic Polynucleotide
taatacgactcactataggggctcaggacaatcagtcaaaatcatctcaaaacagaggagattgagaatgttttgactgaacctggcggcagcgcaaaagatg

SEQ ID NO: 103537 - DNA, 103 bp, Artificial Sequence
  Synthetic Polynucleotide
taatacgactcactatagggatattccgcagctcaggacaatcagtcaaaaacagaggagatttgacatgttgtcctgaaacctggcggcagcgcaaaagatg

SEQ ID NO: 103538 - DNA, 103 bp, Artificial Sequence
  Synthetic Polynucleotide
taatacgactcactataggggcgccatggaatattccgcagctcaggacaaacagaggagatgtcctatgctgcggaataacctggcggcagcgcaaaagatg

SEQ ID NO: 103539 - DNA, 103 bp, Artificial Sequence
  Synthetic Polynucleotide
taatacgactcactatagggtgactacacagcgccatggaatattccgcaaacagaggagatgcggaatgttccatggcaacctggcggcagcgcaaaagatg

SEQ ID NO: 103540 - DNA, 103 bp, Artificial Sequence
  Synthetic Polynucleotide
taatacgactcactatagggccaccatggggcacctgaggaacgggagggaacagaggagaccctccatgtcctcaggtaacctggcggcagcgcaaaagatg

SEQ ID NO: 103541 - DNA, 103 bp, Artificial Sequence
  Synthetic Polynucleotide
taatacgactcactataggggcttcatcaatgactacacagcgccatggaaacagaggagatccatgatgctgtgtagtaacctggcggcagcgcaaaagatg

SEQ ID NO: 103542 - DNA, 103 bp, Artificial Sequence
  Synthetic Polynucleotide
taatacgactcactatagggcagcctgtgggcttcatcaatgactacacaaacagaggagatgtgtaatgattgatgaaaacctggcggcagcgcaaaagatg

SEQ ID NO: 103543 - DNA, 103 bp, Artificial Sequence
  Synthetic Polynucleotide
taatacgactcactatagggtcctgttcttcagcctgtgggcttcatcaaaacagaggagattgatgatgcccacaggcaacctggcggcagcgcaaaagatg

SEQ ID NO: 103544 - DNA, 103 bp, Artificial Sequence
  Synthetic Polynucleotide
taatacgactcactatagggagcttgcagttcctgttcttcagcctgtggaacagaggagaccacagatggaagaacagaacctggcggcagcgcaaaagatg

SEQ ID NO: 103545 - DNA, 103 bp, Artificial Sequence
  Synthetic Polynucleotide
taatacgactcactatagggtccctccaacagcttgcagttcctgttcttaacagaggagaaagaacatgaactgcaagaacctggcggcagcgcaaaagatg

SEQ ID NO: 103546 - DNA, 103 bp, Artificial Sequence
  Synthetic Polynucleotide
taatacgactcactatagggtcatcttgagtccctccaacagcttgcagtaacagaggagaactgcaatgtgttggaggaacctggcggcagcgcaaaagatg

SEQ ID NO: 103547 - DNA, 103 bp, Artificial Sequence
  Synthetic Polynucleotide
taatacgactcactatagggtccaagtccatcatcttgagtccctccaacaacagaggagagttggaatgactcaagataacctggcggcagcgcaaaagatg

SEQ ID NO: 103548 - DNA, 103 bp, Artificial Sequence
  Synthetic Polynucleotide
taatacgactcactatagggcactttgtgttccaagtccatcatcttgagaacagaggagactcaagatgatggacttgaacctggcggcagcgcaaaagatg

SEQ ID NO: 103549 - DNA, 103 bp, Artificial Sequence
  Synthetic Polynucleotide
taatacgactcactatagggccgtcagcagcactttgtgttccaagtccaaacagaggagatggactatgaacacaaagaacctggcggcagcgcaaaagatg

SEQ ID NO: 103550 - DNA, 103 bp, Artificial Sequence
  Synthetic Polynucleotide
taatacgactcactatagggagtggggttcccgtcagcagcactttgtgtaacagaggagaacacaaatggctgctgacaacctggcggcagcgcaaaagatg

SEQ ID NO: 103551 - DNA, 103 bp, Artificial Sequence
  Synthetic Polynucleotide
taatacgactcactataggggccaccactgccaccatggggcacctgaggaacagaggagacctcagatgccccatggtaacctggcggcagcgcaaaagatg

SEQ ID NO: 103552 - DNA, 103 bp, Artificial Sequence
  Synthetic Polynucleotide
taatacgactcactatagggagtgttctggagtggggttcccgtcagcagaacagaggagactgctgatgggaaccccaaacctggcggcagcgcaaaagatg

SEQ ID NO: 103553 - DNA, 103 bp, Artificial Sequence
  Synthetic Polynucleotide
taatacgactcactataggggttcttccacagtgttctggagtggggttcaacagaggagagaacccatgtccagaacaaacctggcggcagcgcaaaagatg

SEQ ID NO: 103554 - DNA, 103 bp, Artificial Sequence
  Synthetic Polynucleotide
taatacgactcactatagggaagctgaagagttcttccacagtgttctggaacagaggagaccagaaatgtgtggaagaaacctggcggcagcgcaaaagatg

SEQ ID NO: 103555 - DNA, 103 bp, Artificial Sequence
  Synthetic Polynucleotide
taatacgactcactataggggaaatgaagcaagctgaagagttcttccacaacagaggagagtggaaatgctcttcagcaacctggcggcagcgcaaaagatg

SEQ ID NO: 103556 - DNA, 103 bp, Artificial Sequence
  Synthetic Polynucleotide
taatacgactcactatagggttggttccaagaaatgaagcaagctgaagaaacagaggagatcttcaatgtgcttcattaacctggcggcagcgcaaaagatg

SEQ ID NO: 103557 - DNA, 103 bp, Artificial Sequence
  Synthetic Polynucleotide
taatacgactcactataggggggaagcgacttggttccaagaaatgaagcaacagaggagagcttcaatgcttggaaccaacctggcggcagcgcaaaagatg

SEQ ID NO: 103558 - DNA, 103 bp, Artificial Sequence
  Synthetic Polynucleotide
taatacgactcactatagggggtttctgaagggaagcgacttggttccaaaacagaggagattggaaatgagtcgcttcaacctggcggcagcgcaaaagatg

SEQ ID NO: 103559 - DNA, 103 bp, Artificial Sequence
  Synthetic Polynucleotide
taatacgactcactataggggcataaatgtggtttctgaagggaagcgacaacagaggagagtcgctatgcttcagaaaaacctggcggcagcgcaaaagatg

SEQ ID NO: 103560 - DNA, 103 bp, Artificial Sequence
  Synthetic Polynucleotide
taatacgactcactatagggccaaattcttgcataaatgtggtttctgaaaacagaggagattcagaatgcacatttataacctggcggcagcgcaaaagatg

SEQ ID NO: 103561 - DNA, 103 bp, Artificial Sequence
  Synthetic Polynucleotide
taatacgactcactatagggttttagatcaccaaattcttgcataaatgtaacagaggagaacatttatgcaagaatttaacctggcggcagcgcaaaagatg

SEQ ID NO: 103562 - DNA, 103 bp, Artificial Sequence
  Synthetic Polynucleotide
taatacgactcactatagggccatctgaccgccaccactgccaccatgggaacagaggagacccatgatggcagtggtgaacctggcggcagcgcaaaagatg

SEQ ID NO: 103563 - DNA, 103 bp, Artificial Sequence
  Synthetic Polynucleotide
taatacgactcactataggggctcttctgtttttagatcaccaaattcttaacagaggagaaagaatatggtgatctaaaacctggcggcagcgcaaaagatg

SEQ ID NO: 103564 - DNA, 103 bp, Artificial Sequence
  Synthetic Polynucleotide
taatacgactcactatagggttttgcacctgctcttctgtttttagatcaaacagaggagatgatctatgaacagaagaaacctggcggcagcgcaaaagatg

SEQ ID NO: 103565 - DNA, 103 bp, Artificial Sequence
  Synthetic Polynucleotide
taatacgactcactatagggagcttgaagtttttgcacctgctcttctgtaacagaggagaacagaaatgcaggtgcaaaacctggcggcagcgcaaaagatg

SEQ ID NO: 103566 - DNA, 103 bp, Artificial Sequence
  Synthetic Polynucleotide
taatacgactcactataggggctttagaatagcttgaagtttttgcacctaacagaggagaaggtgcatgaacttcaagaacctggcggcagcgcaaaagatg

SEQ ID NO: 103567 - DNA, 103 bp, Artificial Sequence
  Synthetic Polynucleotide
taatacgactcactatagggaacatcattggctttagaatagcttgaagtaacagaggagaacttcaatgtattctaaaaacctggcggcagcgcaaaagatg

SEQ ID NO: 103568 - DNA, 103 bp, Artificial Sequence
  Synthetic Polynucleotide
taatacgactcactataggggagacgtctcaacatcattggctttagaataacagaggagaattctaatgccaatgatgaacctggcggcagcgcaaaagatg

SEQ ID NO: 103569 - DNA, 103 bp, Artificial Sequence
  Synthetic Polynucleotide
taatacgactcactatagggcatcctctttgagacgtctcaacatcattgaacagaggagacaatgaatgtgagacgtcaacctggcggcagcgcaaaagatg

SEQ ID NO: 103570 - DNA, 103 bp, Artificial Sequence
  Synthetic Polynucleotide
taatacgactcactatagggttcttttctacatcctctttgagacgtctcaacagaggagagagacgatgcaaagaggaaacctggcggcagcgcaaaagatg

SEQ ID NO: 103571 - DNA, 103 bp, Artificial Sequence
  Synthetic Polynucleotide
taatacgactcactataggggggggccaagttcttttctacatcctctttaacagaggagaaaagagatggtagaaaagaacctggcggcagcgcaaaagatg

SEQ ID NO: 103572 - DNA, 103 bp, Artificial Sequence
  Synthetic Polynucleotide
taatacgactcactatagggtttcttctttgggggccaagttcttttctaaacagaggagatagaaaatgacttggcccaacctggcggcagcgcaaaagatg

SEQ ID NO: 103573 - DNA, 103 bp, Artificial Sequence
  Synthetic Polynucleotide
taatacgactcactataggggggtagacacccatctgaccgccaccactgaacagaggagacagtggatgcggtcagataacctggcggcagcgcaaaagatg

SEQ ID NO: 103574 - DNA, 103 bp, Artificial Sequence
  Synthetic Polynucleotide
taatacgactcactatagggtcaataatagtttcttctttgggggccaagaacagaggagacttggcatgcaaagaagaaacctggcggcagcgcaaaagatg

SEQ ID NO: 103575 - DNA, 103 bp, Artificial Sequence
  Synthetic Polynucleotide
taatacgactcactatagggtagctcaacttcaataatagtttcttctttaacagaggagaaaagaaatgactattattaacctggcggcagcgcaaaagatg

SEQ ID NO: 103576 - DNA, 103 bp, Artificial Sequence
  Synthetic Polynucleotide
taatacgactcactataggggaatgtttgttagctcaacttcaataatagaacagaggagactattaatgaagttgagcaacctggcggcagcgcaaaagatg

SEQ ID NO: 103577 - DNA, 103 bp, Artificial Sequence
  Synthetic Polynucleotide
taatacgactcactatagggtatttcttctgaatgtttgttagctcaactaacagaggagaagttgaatgaacaaacataacctggcggcagcgcaaaagatg

SEQ ID NO: 103578 - DNA, 103 bp, Artificial Sequence
  Synthetic Polynucleotide
taatacgactcactatagggggctcggtaatatttcttctgaatgtttgtaacagaggagaacaaacatgcagaagaaaaacctggcggcagcgcaaaagatg

SEQ ID NO: 103579 - DNA, 103 bp, Artificial Sequence
  Synthetic Polynucleotide
taatacgactcactatagggtctcaaggatggctcggtaatatttcttctaacagaggagaagaagaatgattaccgagaacctggcggcagcgcaaaagatg

SEQ ID NO: 103580 - DNA, 103 bp, Artificial Sequence
  Synthetic Polynucleotide
taatacgactcactataggggtgaaattcttctcaaggatggctcggtaaaacagaggagattaccgatgcatccttgaaacctggcggcagcgcaaaagatg

SEQ ID NO: 103581 - DNA, 103 bp, Artificial Sequence
  Synthetic Polynucleotide
taatacgactcactatagggggaaagaaatgtgaaattcttctcaaggataacagaggagaatccttatgaagaatttcaacctggcggcagcgcaaaagatg

SEQ ID NO: 103582 - DNA, 103 bp, Artificial Sequence
  Synthetic Polynucleotide
taatacgactcactatagggcaccgcctttggaaagaaatgtgaaattctaacagaggagaagaattatgcatttctttaacctggcggcagcgcaaaagatg

SEQ ID NO: 103583 - DNA, 103 bp, Artificial Sequence
  Synthetic Polynucleotide
taatacgactcactatagggttagcttgaccaccgcctttggaaagaaataacagaggagaatttctatgcaaaggcggaacctggcggcagcgcaaaagatg

SEQ ID NO: 103584 - DNA, 103 bp, Artificial Sequence
  Synthetic Polynucleotide
taatacgactcactatagggctgcatgccagggtagacacccatctgaccaacagaggagaggtcagatgggtgtctacaacctggcggcagcgcaaaagatg

SEQ ID NO: 103585 - DNA, 103 bp, Artificial Sequence
  Synthetic Polynucleotide
taatacgactcactataggggttaggtacgttagcttgaccaccgcctttaacagaggagaaaaggcatgggtcaagctaacctggcggcagcgcaaaagatg

SEQ ID NO: 103586 - DNA, 103 bp, Artificial Sequence
  Synthetic Polynucleotide
taatacgactcactatagggtgtttaataggttaggtacgttagcttgacaacagaggagagtcaagatgacgtacctaaacctggcggcagcgcaaaagatg

SEQ ID NO: 103587 - DNA, 103 bp, Artificial Sequence
  Synthetic Polynucleotide
taatacgactcactatagggtccatcatagtgtttaataggttaggtacgaacagaggagacgtaccatgcctattaaaaacctggcggcagcgcaaaagatg

SEQ ID NO: 103588 - DNA, 103 bp, Artificial Sequence
  Synthetic Polynucleotide
taatacgactcactatagggcttccgcaattccatcatagtgtttaatagaacagaggagactattaatgactatgatgaacctggcggcagcgcaaaagatg

SEQ ID NO: 103589 - DNA, 103 bp, Artificial Sequence
  Synthetic Polynucleotide
taatacgactcactataggggattgcagcacttccgcaattccatcatagaacagaggagactatgaatgaattgcggaaacctggcggcagcgcaaaagatg

SEQ ID NO: 103590 - DNA, 103 bp, Artificial Sequence
  Synthetic Polynucleotide
taatacgactcactatagggaggtacggatgattgcagcacttccgcaataacagaggagaattgcgatggtgctgcaaaacctggcggcagcgcaaaagatg

SEQ ID NO: 103591 - DNA, 103 bp, Artificial Sequence
  Synthetic Polynucleotide
taatacgactcactatagggaccattgataaggtacggatgattgcagcaaacagaggagatgctgcatgcatccgtacaacctggcggcagcgcaaaagatg

SEQ ID NO: 103592 - DNA, 103 bp, Artificial Sequence
  Synthetic Polynucleotide
taatacgactcactatagggtctcttcagcaccattgataaggtacggataacagaggagaatccgtatgttatcaatgaacctggcggcagcgcaaaagatg

SEQ ID NO: 103593 - DNA, 103 bp, Artificial Sequence
  Synthetic Polynucleotide
taatacgactcactatagggtccaaaattttctcttcagcaccattgataaacagaggagatatcaaatgtgctgaagaaacctggcggcagcgcaaaagatg

SEQ ID NO: 103594 - DNA, 103 bp, Artificial Sequence
  Synthetic Polynucleotide
taatacgactcactatagggtttaaactcttccaaaattttctcttcagcaacagaggagagctgaaatgaaaattttgaacctggcggcagcgcaaaagatg

SEQ ID NO: 103595 - DNA, 103 bp, Artificial Sequence
  Synthetic Polynucleotide
taatacgactcactataggggcctctcattctgcatgccagggtagacacaacagaggagagtgtctatgctggcatgcaacctggcggcagcgcaaaagatg

SEQ ID NO: 103596 - DNA, 103 bp, Artificial Sequence
  Synthetic Polynucleotide
taatacgactcactatagggtgtgtgtttctttaaactcttccaaaatttaacagaggagaaaatttatgaagagtttaaacctggcggcagcgcaaaagatg

SEQ ID NO: 103597 - DNA, 103 bp, Artificial Sequence
  Synthetic Polynucleotide
taatacgactcactataggggactctgcattgtgtgtttctttaaactctaacagaggagaagagttatgagaaacacaaacctggcggcagcgcaaaagatg

SEQ ID NO: 103598 - DNA, 103 bp, Artificial Sequence
  Synthetic Polynucleotide
taatacgactcactatagggaaaatctggagactctgcattgtgtgtttcaacagaggagagaaacaatgaatgcagagaacctggcggcagcgcaaaagatg

SEQ ID NO: 103599 - DNA, 103 bp, Artificial Sequence
  Synthetic Polynucleotide
taatacgactcactatagggcctggagctgaaaatctggagactctgcataacagaggagaatgcagatgctccagattaacctggcggcagcgcaaaagatg

SEQ ID NO: 103600 - DNA, 103 bp, Artificial Sequence
  Synthetic Polynucleotide
taatacgactcactatagggtggatcattgcctggagctgaaaatctggaaacagaggagatccagaatgtcagctccaaacctggcggcagcgcaaaagatg

SEQ ID NO: 103601 - DNA, 103 bp, Artificial Sequence
  Synthetic Polynucleotide
taatacgactcactataggggccagcagcctggatcattgcctggagctgaacagaggagacagctcatggcaatgatcaacctggcggcagcgcaaaagatg

SEQ ID NO: 103602 - DNA, 103 bp, Artificial Sequence
  Synthetic Polynucleotide
taatacgactcactataggggcactagcttgccagcagcctggatcattgaacagaggagacaatgaatgaggctgctgaacctggcggcagcgcaaaagatg

SEQ ID NO: 103603 - DNA, 103 bp, Artificial Sequence
  Synthetic Polynucleotide
taatacgactcactatagggttgtcaatcagcactagcttgccagcagccaacagaggagaggctgcatgcaagctagtaacctggcggcagcgcaaaagatg

SEQ ID NO: 103604 - DNA, 103 bp, Artificial Sequence
  Synthetic Polynucleotide
taatacgactcactatagggtggcagcagcttgtcaatcagcactagcttaacagaggagaaagctaatgctgattgacaacctggcggcagcgcaaaagatg

SEQ ID NO: 103605 - DNA, 103 bp, Artificial Sequence
  Synthetic Polynucleotide
taatacgactcactatagggccttcagttttggcagcagcttgtcaatcaaacagaggagatgattgatgagctgctgcaacctggcggcagcgcaaaagatg

SEQ ID NO: 103606 - DNA, 103 bp, Artificial Sequence
  Synthetic Polynucleotide
taatacgactcactataggggattgcccatgcctctcattctgcatgccaaacagaggagatggcatatggaatgagagaacctggcggcagcgcaaaagatg

SEQ ID NO: 103607 - DNA, 103 bp, Artificial Sequence
  Synthetic Polynucleotide
taatacgactcactatagggtggccaccagccttcagttttggcagcagcaacagaggagagctgctatgaaaactgaaaacctggcggcagcgcaaaagatg

SEQ ID NO: 103608 - DNA, 103 bp, Artificial Sequence
  Synthetic Polynucleotide
taatacgactcactatagggaagcaccctgtggccaccagccttcagtttaacagaggagaaaactgatggctggtggcaacctggcggcagcgcaaaagatg

SEQ ID NO: 103609 - DNA, 103 bp, Artificial Sequence
  Synthetic Polynucleotide
taatacgactcactataggggggaaaagataagcaccctgtggccaccagaacagaggagactggtgatgacagggtgcaacctggcggcagcgcaaaagatg

SEQ ID NO: 103610 - DNA, 103 bp, Artificial Sequence
  Synthetic Polynucleotide
taatacgactcactatagggcgcaccatctgggaaaagataagcaccctgaacagaggagacagggtatgtatcttttcaacctggcggcagcgcaaaagatg

SEQ ID NO: 103611 - DNA, 103 bp, Artificial Sequence
  Synthetic Polynucleotide
taatacgactcactataggggtccaagcagcgcaccatctgggaaaagataacagaggagaatctttatgcagatggtgaacctggcggcagcgcaaaagatg

SEQ ID NO: 103612 - DNA, 103 bp, Artificial Sequence
  Synthetic Polynucleotide
taatacgactcactatagggcttccagtatgtccaagcagcgcaccatctaacagaggagaagatggatggctgcttggaacctggcggcagcgcaaaagatg

SEQ ID NO: 103613 - DNA, 103 bp, Artificial Sequence
  Synthetic Polynucleotide
taatacgactcactatagggatgaggtagtcttccagtatgtccaagcagaacagaggagactgcttatgcatactggaaacctggcggcagcgcaaaagatg

SEQ ID NO: 103614 - DNA, 103 bp, Artificial Sequence
  Synthetic Polynucleotide
taatacgactcactatagggccgtctttgaatgaggtagtcttccagtataacagaggagaatactgatggactacctcaacctggcggcagcgcaaaagatg

SEQ ID NO: 103615 - DNA, 103 bp, Artificial Sequence
  Synthetic Polynucleotide
taatacgactcactatagggcatatgggtaccgtctttgaatgaggtagtaacagaggagaactaccatgttcaaagacaacctggcggcagcgcaaaagatg

SEQ ID NO: 103616 - DNA, 103 bp, Artificial Sequence
  Synthetic Polynucleotide
taatacgactcactatagggtcgatcctttcatatgggtaccgtctttgaaacagaggagatcaaagatggtacccataaacctggcggcagcgcaaaagatg

SEQ ID NO: 103617 - DNA, 103 bp, Artificial Sequence
  Synthetic Polynucleotide
taatacgactcactatagggaccttcactgaaaatattcccatcctcgccaacagaggagaggcgagatggggaatattaacctggcggcagcgcaaaagatg

SEQ ID NO: 103618 - DNA, 103 bp, Artificial Sequence
  Synthetic Polynucleotide
taatacgactcactataggggtccacaaaggattgcccatgcctctcattaacagaggagaaatgagatgcatgggcaaaacctggcggcagcgcaaaagatg

SEQ ID NO: 103619 - DNA, 103 bp, Artificial Sequence
  Synthetic Polynucleotide
taatacgactcactatagggtactcggccgtcgatcctttcatatgggtaaacagaggagatacccaatggaaaggatcaacctggcggcagcgcaaaagatg

SEQ ID NO: 103620 - DNA, 103 bp, Artificial Sequence
  Synthetic Polynucleotide
taatacgactcactatagggggttgcctcttactcggccgtcgatcctttaacagaggagaaaaggaatgacggccgagaacctggcggcagcgcaaaagatg

SEQ ID NO: 103621 - DNA, 103 bp, Artificial Sequence
  Synthetic Polynucleotide
taatacgactcactataggggcctggcggaggttgcctcttactcggccgaacagaggagacggccgatgaagaggcaaaacctggcggcagcgcaaaagatg

SEQ ID NO: 103622 - DNA, 103 bp, Artificial Sequence
  Synthetic Polynucleotide
taatacgactcactataggggtcgatagctgcctggcggaggttgcctctaacagaggagaagaggcatgctccgccagaacctggcggcagcgcaaaagatg

SEQ ID NO: 103623 - DNA, 103 bp, Artificial Sequence
  Synthetic Polynucleotide
taatacgactcactatagggtggagaatctgtcgatagctgcctggcggaaacagaggagatccgccatgcagctatcgaacctggcggcagcgcaaaagatg

SEQ ID NO: 103624 - DNA, 103 bp, Artificial Sequence
  Synthetic Polynucleotide
taatacgactcactataggggaatcaggtttggagaatctgtcgatagctaacagaggagaagctatatgcagattctcaacctggcggcagcgcaaaagatg

SEQ ID NO: 103625 - DNA, 103 bp, Artificial Sequence
  Synthetic Polynucleotide
taatacgactcactatagggaaacctatcagaatcaggtttggagaatctaacagaggagaagattcatgaaacctgataacctggcggcagcgcaaaagatg

SEQ ID NO: 103626 - DNA, 103 bp, Artificial Sequence
  Synthetic Polynucleotide
taatacgactcactatagggggaggaaaacaaacctatcagaatcaggttaacagaggagaaacctgatgctgataggtaacctggcggcagcgcaaaagatg

SEQ ID NO: 103627 - DNA, 103 bp, Artificial Sequence
  Synthetic Polynucleotide
taatacgactcactatagggcttgtacacaggaggaaaacaaacctatcaaacagaggagatgatagatgtgttttcctaacctggcggcagcgcaaaagatg

SEQ ID NO: 103628 - DNA, 103 bp, Artificial Sequence
  Synthetic Polynucleotide
taatacgactcactatagggacctcctgcccttgtacacaggaggaaaacaacagaggagagttttcatgctgtgtacaaacctggcggcagcgcaaaagatg

SEQ ID NO: 103629 - DNA, 103 bp, Artificial Sequence
  Synthetic Polynucleotide
taatacgactcactatagggtggagctgctgtccacaaaggattgcccataacagaggagaatgggcatgcctttgtggaacctggcggcagcgcaaaagatg

SEQ ID NO: 103630 - DNA, 103 bp, Artificial Sequence
  Synthetic Polynucleotide
taatacgactcactatagggtaatgcctaaacctcctgcccttgtacacaaacagaggagatgtgtaatggggcaggagaacctggcggcagcgcaaaagatg

SEQ ID NO: 103631 - DNA, 103 bp, Artificial Sequence
  Synthetic Polynucleotide
taatacgactcactataggggcagtgaggttaatgcctaaacctcctgccaacagaggagaggcaggatgtttaggcataacctggcggcagcgcaaaagatg

SEQ ID NO: 103632 - DNA, 103 bp, Artificial Sequence
  Synthetic Polynucleotide
taatacgactcactatagggggtatcagcagcagtgaggttaatgcctaaaacagaggagattaggcatgaacctcactaacctggcggcagcgcaaaagatg

SEQ ID NO: 103633 - DNA, 103 bp, Artificial Sequence
  Synthetic Polynucleotide
taatacgactcactatagggagatgatgcaggtatcagcagcagtgaggtaacagaggagaacctcaatgctgctgataaacctggcggcagcgcaaaagatg

SEQ ID NO: 103634 - DNA, 103 bp, Artificial Sequence
  Synthetic Polynucleotide
taatacgactcactatagggtctgaatcaaagatgatgcaggtatcagcaaacagaggagatgctgaatgctgcatcataacctggcggcagcgcaaaagatg

SEQ ID NO: 103635 - DNA, 103 bp, Artificial Sequence
  Synthetic Polynucleotide
taatacgactcactataggggggattccagtctgaatcaaagatgatgcaaacagaggagatgcatcatgtttgattcaaacctggcggcagcgcaaaagatg

SEQ ID NO: 103636 - DNA, 103 bp, Artificial Sequence
  Synthetic Polynucleotide
taatacgactcactatagggggtcattttggggattccagtctgaatcaaaacagaggagattgattatgactggaatcaacctggcggcagcgcaaaagatg

SEQ ID NO: 103637 - DNA, 103 bp, Artificial Sequence
  Synthetic Polynucleotide
taatacgactcactatagggtgagcctggaggtcattttggggattccagaacagaggagactggaaatgccaaaatgaaacctggcggcagcgcaaaagatg

SEQ ID NO: 103638 - DNA, 103 bp, Artificial Sequence
  Synthetic Polynucleotide
taatacgactcactatagggacatctagcctgagcctggaggtcattttgaacagaggagacaaaatatgctccaggctaacctggcggcagcgcaaaagatg

SEQ ID NO: 103639 - DNA, 103 bp, Artificial Sequence
  Synthetic Polynucleotide
taatacgactcactatagggctattctatgacatctagcctgagcctggaaacagaggagatccaggatgaggctagataacctggcggcagcgcaaaagatg

SEQ ID NO: 103640 - DNA, 103 bp, Artificial Sequence
  Synthetic Polynucleotide
taatacgactcactataggggggccccacatggagctgctgtccacaaagaacagaggagactttgtatgcagcagctcaacctggcggcagcgcaaaagatg

SEQ ID NO: 103641 - DNA, 103 bp, Artificial Sequence
  Synthetic Polynucleotide
taatacgactcactatagggttgctctgtcctattctatgacatctagccaacagaggagaggctagatgtcatagaataacctggcggcagcgcaaaagatg

SEQ ID NO: 103642 - DNA, 103 bp, Artificial Sequence
  Synthetic Polynucleotide
taatacgactcactatagggtttcacagatttgctctgtcctattctatgaacagaggagacatagaatgggacagagcaacctggcggcagcgcaaaagatg

SEQ ID NO: 103643 - DNA, 103 bp, Artificial Sequence
  Synthetic Polynucleotide
taatacgactcactataggggcctgtagattttcacagatttgctctgtcaacagaggagagacagaatgaatctgtgaaacctggcggcagcgcaaaagatg

SEQ ID NO: 103644 - DNA, 103 bp, Artificial Sequence
  Synthetic Polynucleotide
taatacgactcactatagggcttgtaatcagcctgtagattttcacagataacagaggagaatctgtatgaatctacagaacctggcggcagcgcaaaagatg

SEQ ID NO: 103645 - DNA, 103 bp, Artificial Sequence
  Synthetic Polynucleotide
taatacgactcactatagggataggaatttcttgtaatcagcctgtagataacagaggagaatctacatgctgattacaaacctggcggcagcgcaaaagatg

SEQ ID NO: 103646 - DNA, 103 bp, Artificial Sequence
  Synthetic Polynucleotide
taatacgactcactatagggtttccctttcataggaatttcttgtaatcaaacagaggagatgattaatggaaattcctaacctggcggcagcgcaaaagatg

SEQ ID NO: 103647 - DNA, 103 bp, Artificial Sequence
  Synthetic Polynucleotide
taatacgactcactatagggttgtcgaacatttccctttcataggaatttaacagaggagaaaattcatgtgaaagggaaacctggcggcagcgcaaaagatg

SEQ ID NO: 103648 - DNA, 103 bp, Artificial Sequence
  Synthetic Polynucleotide
taatacgactcactatagggcaaactagccttgtcgaacatttccctttcaacagaggagagaaaggatgatgttcgacaacctggcggcagcgcaaaagatg

SEQ ID NO: 103649 - DNA, 103 bp, Artificial Sequence
  Synthetic Polynucleotide
taatacgactcactatagggggcccagtttcaaactagccttgtcgaacaaacagaggagatgttcgatgaggctagttaacctggcggcagcgcaaaagatg

SEQ ID NO: 103650 - DNA, 103 bp, Artificial Sequence
  Synthetic Polynucleotide
taatacgactcactataggggctttatccaggcccagtttcaaactagccaacagaggagaggctagatggaaactgggaacctggcggcagcgcaaaagatg

SEQ ID NO: 103651 - DNA, 103 bp, Artificial Sequence
  Synthetic Polynucleotide
taatacgactcactatagggaacagccctggggccccacatggagctgctaacagaggagaagcagcatgatgtggggcaacctggcggcagcgcaaaagatg

SEQ ID NO: 103652 - DNA, 103 bp, Artificial Sequence
  Synthetic Polynucleotide
taatacgactcactatagggctgtagcacagctttatccaggcccagtttaacagaggagaaaactgatgctggataaaaacctggcggcagcgcaaaagatg

SEQ ID NO: 103653 - DNA, 103 bp, Artificial Sequence
  Synthetic Polynucleotide
taatacgactcactatagggcactcatagactgtagcacagctttatccaaacagaggagatggataatgctgtgctacaacctggcggcagcgcaaaagatg

SEQ ID NO: 103654 - DNA, 103 bp, Artificial Sequence
  Synthetic Polynucleotide
taatacgactcactatagggttttctcttccactcatagactgtagcacaaacagaggagatgtgctatggtctatgagaacctggcggcagcgcaaaagatg

SEQ ID NO: 103655 - DNA, 103 bp, Artificial Sequence
  Synthetic Polynucleotide
taatacgactcactatagggattggtagcattttctcttccactcatagaaacagaggagatctatgatgggaagagaaaacctggcggcagcgcaaaagatg

SEQ ID NO: 103656 - DNA, 103 bp, Artificial Sequence
  Synthetic Polynucleotide
taatacgactcactataggggttgtaccccattggtagcattttctcttcaacagaggagagaagagatgatgctaccaaacctggcggcagcgcaaaagatg

SEQ ID NO: 103657 - DNA, 103 bp, Artificial Sequence
  Synthetic Polynucleotide
taatacgactcactatagggttggaaagctgttgtaccccattggtagcaaacagaggagatgctacatgtggggtacaaacctggcggcagcgcaaaagatg

SEQ ID NO: 103658 - DNA, 103 bp, Artificial Sequence
  Synthetic Polynucleotide
taatacgactcactatagggtatttctttcttggaaagctgttgtaccccaacagaggagaggggtaatgcagctttccaacctggcggcagcgcaaaagatg

SEQ ID NO: 103659 - DNA, 103 bp, Artificial Sequence
  Synthetic Polynucleotide
taatacgactcactataggggaagatcctctatttctttcttggaaagctaacagaggagaagctttatgagaaagaaaaacctggcggcagcgcaaaagatg

SEQ ID NO: 103660 - DNA, 103 bp, Artificial Sequence
  Synthetic Polynucleotide
taatacgactcactatagggccttttcgtagaagatcctctatttctttcaacagaggagagaaagaatgagaggatctaacctggcggcagcgcaaaagatg

SEQ ID NO: 103661 - DNA, 103 bp, Artificial Sequence
  Synthetic Polynucleotide
taatacgactcactatagggaccataggccccttttcgtagaagatcctcaacagaggagagaggatatgctacgaaaaaacctggcggcagcgcaaaagatg

SEQ ID NO: 103662 - DNA, 103 bp, Artificial Sequence
  Synthetic Polynucleotide
taatacgactcactatagggctggtacctgaacagccctggggccccacaaacagaggagatgtgggatgccagggctgaacctggcggcagcgcaaaagatg

SEQ ID NO: 103663 - DNA, 103 bp, Artificial Sequence
  Synthetic Polynucleotide
taatacgactcactatagggccatgagtgcaccataggccccttttcgtaaacagaggagatacgaaatggggcctatgaacctggcggcagcgcaaaagatg

SEQ ID NO: 103664 - DNA, 103 bp, Artificial Sequence
  Synthetic Polynucleotide
taatacgactcactatagggtcctcctcatccatgagtgcaccataggccaacagaggagaggcctaatgtgcactcataacctggcggcagcgcaaaagatg

SEQ ID NO: 103665 - DNA, 103 bp, Artificial Sequence
  Synthetic Polynucleotide
taatacgactcactatagggagacccttcatcctcctcatccatgagtgcaacagaggagagcactcatggatgaggagaacctggcggcagcgcaaaagatg

SEQ ID NO: 103666 - DNA, 103 bp, Artificial Sequence
  Synthetic Polynucleotide
taatacgactcactatagggcacagaatttagacccttcatcctcctcataacagaggagaatgaggatgatgaagggtaacctggcggcagcgcaaaagatg

SEQ ID NO: 103667 - DNA, 103 bp, Artificial Sequence
  Synthetic Polynucleotide
taatacgactcactatagggatatcttcttcacagaatttagacccttcaaacagaggagatgaaggatgtaaattctgaacctggcggcagcgcaaaagatg

SEQ ID NO: 103668 - DNA, 103 bp, Artificial Sequence
  Synthetic Polynucleotide
taatacgactcactataggggatctgatcaatatcttcttcacagaatttaacagaggagaaaattcatggaagaagataacctggcggcagcgcaaaagatg

SEQ ID NO: 103669 - DNA, 103 bp, Artificial Sequence
  Synthetic Polynucleotide
taatacgactcactataggggacgtaggaggatctgatcaatatcttcttaacagaggagaaagaagatgttgatcagaaacctggcggcagcgcaaaagatg

SEQ ID NO: 103670 - DNA, 103 bp, Artificial Sequence
  Synthetic Polynucleotide
taatacgactcactataggggtgtgggttcgacgtaggaggatctgatcaaacagaggagatgatcaatgcctcctacgaacctggcggcagcgcaaaagatg

SEQ ID NO: 103671 - DNA, 103 bp, Artificial Sequence
  Synthetic Polynucleotide
taatacgactcactatagggaatggtaatggtgtgggttcgacgtaggagaacagaggagactcctaatgcgaacccacaacctggcggcagcgcaaaagatg

SEQ ID NO: 103672 - DNA, 103 bp, Artificial Sequence
  Synthetic Polynucleotide
taatacgactcactatagggcttctgactcaatggtaatggtgtgggttcaacagaggagagaacccatgccattaccaaacctggcggcagcgcaaaagatg

SEQ ID NO: 103673 - DNA, 103 bp, Artificial Sequence
  Synthetic Polynucleotide
taatacgactcactatagggcgtatctggtctggtacctgaacagccctgaacagaggagacagggcatgtcaggtaccaacctggcggcagcgcaaaagatg

SEQ ID NO: 103674 - DNA, 103 bp, Artificial Sequence
  Synthetic Polynucleotide
taatacgactcactataggggaacctttcccttctgactcaatggtaatgaacagaggagacattacatgtgagtcagaaacctggcggcagcgcaaaagatg

SEQ ID NO: 103675 - DNA, 103 bp, Artificial Sequence
  Synthetic Polynucleotide
taatacgactcactatagggagcaaatgtggaacctttcccttctgactcaacagaggagagagtcaatggggaaaggtaacctggcggcagcgcaaaagatg

SEQ ID NO: 103676 - DNA, 103 bp, Artificial Sequence
  Synthetic Polynucleotide
taatacgactcactatagggaactggccttagcaaatgtggaacctttccaacagaggagaggaaagatgccacatttgaacctggcggcagcgcaaaagatg

SEQ ID NO: 103677 - DNA, 103 bp, Artificial Sequence
  Synthetic Polynucleotide
taatacgactcactataggggatgcaacaaaactggccttagcaaatgtgaacagaggagacacattatgtaaggccagaacctggcggcagcgcaaaagatg

SEQ ID NO: 103678 - DNA, 103 bp, Artificial Sequence
  Synthetic Polynucleotide
taatacgactcactatagggcctatttccagatgcaacaaaactggccttaacagaggagaaaggccatgtttgttgcaaacctggcggcagcgcaaaagatg

SEQ ID NO: 103679 - DNA, 103 bp, Artificial Sequence
  Synthetic Polynucleotide
taatacgactcactatagggaaatatctgtcctatttccagatgcaacaaaacagaggagattgttgatgctggaaataaacctggcggcagcgcaaaagatg

SEQ ID NO: 103680 - DNA, 103 bp, Artificial Sequence
  Synthetic Polynucleotide
taatacgactcactatagggtcatccaaggaaatatctgtcctatttccaaacagaggagatggaaaatggacagatataacctggcggcagcgcaaaagatg

SEQ ID NO: 103681 - DNA, 103 bp, Artificial Sequence
  Synthetic Polynucleotide
taatacgactcactataggggaaatttggatcatccaaggaaatatctgtaacagaggagaacagatatgtccttggataacctggcggcagcgcaaaagatg

SEQ ID NO: 103682 - DNA, 103 bp, Artificial Sequence
  Synthetic Polynucleotide
taatacgactcactatagggacttttgccagaaatttggatcatccaaggaacagaggagaccttggatgatccaaattaacctggcggcagcgcaaaagatg

SEQ ID NO: 103683 - DNA, 103 bp, Artificial Sequence
  Synthetic Polynucleotide
taatacgactcactatagggttcttagcccacttttgccagaaatttggaaacagaggagatccaaaatgctggcaaaaaacctggcggcagcgcaaaagatg

SEQ ID NO: 103684 - DNA, 103 bp, Artificial Sequence
  Synthetic Polynucleotide
taatacgactcactataggggtagggggctcgtatctggtctggtacctgaacagaggagacaggtaatggaccagataaacctggcggcagcgcaaaagatg

SEQ ID NO: 103685 - DNA, 103 bp, Artificial Sequence
  Synthetic Polynucleotide
taatacgactcactatagggcaattcagccttcttagcccacttttgccaaacagaggagatggcaaatgtgggctaagaacctggcggcagcgcaaaagatg

SEQ ID NO: 103686 - DNA, 103 bp, Artificial Sequence
  Synthetic Polynucleotide
taatacgactcactatagggcatcaatatccaattcagccttcttagcccaacagaggagagggctaatgaggctgaataacctggcggcagcgcaaaagatg

SEQ ID NO: 103687 - DNA, 103 bp, Artificial Sequence
  Synthetic Polynucleotide
taatacgactcactatagggccatttaaggcatcaatatccaattcagccaacagaggagaggctgaatgggatattgaaacctggcggcagcgcaaaagatg

SEQ ID NO: 103688 - DNA, 103 bp, Artificial Sequence
  Synthetic Polynucleotide
taatacgactcactataggggttgttcctcccatttaaggcatcaatatcaacagaggagagatattatggccttaaataacctggcggcagcgcaaaagatg

SEQ ID NO: 103689 - DNA, 103 bp, Artificial Sequence
  Synthetic Polynucleotide
taatacgactcactatagggcaataaccaggttgttcctcccatttaaggaacagaggagaccttaaatgggaggaacaaacctggcggcagcgcaaaagatg

SEQ ID NO: 103690 - DNA, 103 bp, Artificial Sequence
  Synthetic Polynucleotide
taatacgactcactatagggcttggagtatcaataaccaggttgttcctcaacagaggagagaggaaatgcctggttataacctggcggcagcgcaaaagatg

SEQ ID NO: 103691 - DNA, 103 bp, Artificial Sequence
  Synthetic Polynucleotide
taatacgactcactatagggctttctcactcttggagtatcaataaccagaacagaggagactggttatggatactccaaacctggcggcagcgcaaaagatg

SEQ ID NO: 103692 - DNA, 103 bp, Artificial Sequence
  Synthetic Polynucleotide
taatacgactcactataggggcctggtctgctttctcactcttggagtataacagaggagaatactcatggagtgagaaaacctggcggcagcgcaaaagatg

SEQ ID NO: 103693 - DNA, 103 bp, Artificial Sequence
  Synthetic Polynucleotide
taatacgactcactataggggcactgtagagcctggtctgctttctcactaacagaggagaagtgagatggcagaccagaacctggcggcagcgcaaaagatg

SEQ ID NO: 103694 - DNA, 103 bp, Artificial Sequence
  Synthetic Polynucleotide
taatacgactcactatagggttccttcactgcactgtagagcctggtctgaacagaggagacagaccatgctctacagtaacctggcggcagcgcaaaagatg

SEQ ID NO: 103695 - DNA, 103 bp, Artificial Sequence
  Synthetic Polynucleotide
taatacgactcactataggggctgctgctggtagggggctcgtatctggtaacagaggagaaccagaatggagccccctaacctggcggcagcgcaaaagatg

SEQ ID NO: 103696 - DNA, 103 bp, Artificial Sequence
  Synthetic Polynucleotide
taatacgactcactatagggtcagctcatcttccttcactgcactgtagaaacagaggagatctacaatgcagtgaaggaacctggcggcagcgcaaaagatg

SEQ ID NO: 103697 - DNA, 103 bp, Artificial Sequence
  Synthetic Polynucleotide
taatacgactcactataggggagaactccatcagctcatcttccttcactaacagaggagaagtgaaatgagatgagctaacctggcggcagcgcaaaagatg

SEQ ID NO: 103698 - DNA, 103 bp, Artificial Sequence
  Synthetic Polynucleotide
taatacgactcactatagggttccaagtctgagaactccatcagctcatcaacagaggagagatgagatgatggagttcaacctggcggcagcgcaaaagatg

SEQ ID NO: 103699 - DNA, 103 bp, Artificial Sequence
  Synthetic Polynucleotide
taatacgactcactatagggcagaatcactttccaagtctgagaactccaaacagaggagatggagtatgcagacttggaacctggcggcagcgcaaaagatg

SEQ ID NO: 103700 - DNA, 103 bp, Artificial Sequence
  Synthetic Polynucleotide
taatacgactcactatagggggcttttcttcagaatcactttccaagtctaacagaggagaagacttatgaagtgattcaacctggcggcagcgcaaaagatg

SEQ ID NO: 103701 - DNA, 103 bp, Artificial Sequence
  Synthetic Polynucleotide
taatacgactcactatagggctttgcacagggcttttcttcagaatcactaacagaggagaagtgatatggaagaaaagaacctggcggcagcgcaaaagatg

SEQ ID NO: 103702 - DNA, 103 bp, Artificial Sequence
  Synthetic Polynucleotide
taatacgactcactataggggacgccgtggctttgcacagggcttttcttaacagaggagaaagaaaatgcctgtgcaaaacctggcggcagcgcaaaagatg

SEQ ID NO: 103703 - DNA, 103 bp, Artificial Sequence
  Synthetic Polynucleotide
taatacgactcactatagggttatcctggggacgccgtggctttgcacagaacagaggagactgtgcatggccacggcgaacctggcggcagcgcaaaagatg

SEQ ID NO: 103704 - DNA, 103 bp, Artificial Sequence
  Synthetic Polynucleotide
taatacgactcactataggggccctgtgacttatcctggggacgccgtggaacagaggagaccacggatgccccaggataacctggcggcagcgcaaaagatg

SEQ ID NO: 103705 - DNA, 103 bp, Artificial Sequence
  Synthetic Polynucleotide
taatacgactcactatagggtccttgcatagccctgtgacttatcctgggaacagaggagacccaggatgagtcacaggaacctggcggcagcgcaaaagatg

SEQ ID NO: 103706 - DNA, 103 bp, Artificial Sequence
  Synthetic Polynucleotide
taatacgactcactatagggggctgtggctgctgctgctggtagggggctaacagaggagaagccccatgccagcagcaaacctggcggcagcgcaaaagatg

SEQ ID NO: 103707 - DNA, 103 bp, Artificial Sequence
  Synthetic Polynucleotide
taatacgactcactatagggaaacattcactccttgcatagccctgtgacaacagaggagagtcacaatgctatgcaagaacctggcggcagcgcaaaagatg

SEQ ID NO: 103708 - DNA, 103 bp, Artificial Sequence
  Synthetic Polynucleotide
taatacgactcactatagggctccaccctgaaacattcactccttgcataaacagaggagatatgcaatgagtgaatgtaacctggcggcagcgcaaaagatg

SEQ ID NO: 103709 - DNA, 103 bp, Artificial Sequence
  Synthetic Polynucleotide
taatacgactcactataggggcagattcttctccaccctgaaacattcacaacagaggagagtgaatatgtcagggtggaacctggcggcagcgcaaaagatg

SEQ ID NO: 103710 - DNA, 103 bp, Artificial Sequence
  Synthetic Polynucleotide
taatacgactcactatagggccatagacaagcagattcttctccaccctgaacagaggagacagggtatggaagaatctaacctggcggcagcgcaaaagatg

SEQ ID NO: 103711 - DNA, 103 bp, Artificial Sequence
  Synthetic Polynucleotide
taatacgactcactatagggccgtccccaaccatagacaagcagattcttaacagaggagaaagaatatgcttgtctataacctggcggcagcgcaaaagatg

SEQ ID NO: 103712 - DNA, 103 bp, Artificial Sequence
  Synthetic Polynucleotide
taatacgactcactatagggtgtctgtccaccgtccccaaccatagacaaaacagaggagattgtctatggttggggacaacctggcggcagcgcaaaagatg

SEQ ID NO: 103713 - DNA, 103 bp, Artificial Sequence
  Synthetic Polynucleotide
taatacgactcactatagggtgggaaagaatgtctgtccaccgtccccaaaacagaggagattggggatggtggacagaaacctggcggcagcgcaaaagatg

SEQ ID NO: 103714 - DNA, 103 bp, Artificial Sequence
  Synthetic Polynucleotide
taatacgactcactatagggatagcgtccgtgggaaagaatgtctgtccaaacagaggagatggacaatgattctttccaacctggcggcagcgcaaaagatg

SEQ ID NO: 103715 - DNA, 103 bp, Artificial Sequence
  Synthetic Polynucleotide
taatacgactcactataggggttggcgtttatagcgtccgtgggaaagaaaacagaggagattctttatgacggacgctaacctggcggcagcgcaaaagatg

SEQ ID NO: 103716 - DNA, 103 bp, Artificial Sequence
  Synthetic Polynucleotide
taatacgactcactatagggtgctcagtgagttggcgtttatagcgtccgaacagaggagacggacgatgtaaacgccaaacctggcggcagcgcaaaagatg

SEQ ID NO: 103717 - DNA, 103 bp, Artificial Sequence
  Synthetic Polynucleotide
taatacgactcactatagggcggtggctgcggctgtggctgctgctgctgaacagaggagacagcagatgcagccacagaacctggcggcagcgcaaaagatg

SEQ ID NO: 103718 - DNA, 103 bp, Artificial Sequence
  Synthetic Polynucleotide
taatacgactcactatagggttctacatcttgctcagtgagttggcgtttaacagaggagaaaacgcatgctcactgagaacctggcggcagcgcaaaagatg

SEQ ID NO: 103719 - DNA, 103 bp, Artificial Sequence
  Synthetic Polynucleotide
taatacgactcactatagggtgcagatggtttctacatcttgctcagtgaaacagaggagatcactgatgaagatgtagaacctggcggcagcgcaaaagatg

SEQ ID NO: 103720 - DNA, 103 bp, Artificial Sequence
  Synthetic Polynucleotide
taatacgactcactatagggaggatggttctgcagatggtttctacatctaacagaggagaagatgtatgaaccatctgaacctggcggcagcgcaaaagatg

SEQ ID NO: 103721 - DNA, 103 bp, Artificial Sequence
  Synthetic Polynucleotide
taatacgactcactatagggacagtacaccaggatggttctgcagatggtaacagaggagaaccatcatgagaaccatcaacctggcggcagcgcaaaagatg

SEQ ID NO: 103722 - DNA, 103 bp, Artificial Sequence
  Synthetic Polynucleotide
taatacgactcactatagggaatgattaagacagtacaccaggatggttcaacagaggagagaaccaatgtggtgtactaacctggcggcagcgcaaaagatg

SEQ ID NO: 103723 - DNA, 103 bp, Artificial Sequence
  Synthetic Polynucleotide
taatacgactcactatagggtcccctttgtaatgattaagacagtacaccaacagaggagaggtgtaatgtcttaatcaaacctggcggcagcgcaaaagatg

SEQ ID NO: 103724 - DNA, 103 bp, Artificial Sequence
  Synthetic Polynucleotide
taatacgactcactataggggatattctcatcccctttgtaatgattaagaacagaggagacttaatatgtacaaagggaacctggcggcagcgcaaaagatg

SEQ ID NO: 103725 - DNA, 103 bp, Artificial Sequence
  Synthetic Polynucleotide
taatacgactcactatagggtgaagcttttgatattctcatcccctttgtaacagaggagaacaaagatgatgagaataaacctggcggcagcgcaaaagatg

SEQ ID NO: 103726 - DNA, 103 bp, Artificial Sequence
  Synthetic Polynucleotide
taatacgactcactatagggagatcccagatgaagcttttgatattctcaaacagaggagatgagaaatgcaaaagcttaacctggcggcagcgcaaaagatg

SEQ ID NO: 103727 - DNA, 103 bp, Artificial Sequence
  Synthetic Polynucleotide
taatacgactcactataggggggtgtgatcagatcccagatgaagcttttaacagaggagaaaaagcatgatctgggataacctggcggcagcgcaaaagatg

SEQ ID NO: 103728 - DNA, 103 bp, Artificial Sequence
  Synthetic Polynucleotide
taatacgactcactatagggggccttcaagaccttcactgaaaatattccaacagaggagaggaataatgtcagtgaagaacctggcggcagcgcaaaagatg

SEQ ID NO: 103729 - DNA, 103 bp, Artificial Sequence
  Synthetic Polynucleotide
taatacgactcactataggggagccggctgcggtggctgcggctgtggctaacagaggagaagccacatgcgcagccacaacctggcggcagcgcaaaagatg

SEQ ID NO: 103730 - DNA, 103 bp, Artificial Sequence
  Synthetic Polynucleotide
taatacgactcactatagggcatccgctgtgggtgtgatcagatcccagaaacagaggagatctgggatgtgatcacacaacctggcggcagcgcaaaagatg

SEQ ID NO: 103731 - DNA, 103 bp, Artificial Sequence
  Synthetic Polynucleotide
taatacgactcactatagggcgagtctggccatccgctgtgggtgtgatcaacagaggagagatcacatgcacagcggaaacctggcggcagcgcaaaagatg

SEQ ID NO: 103732 - DNA, 103 bp, Artificial Sequence
  Synthetic Polynucleotide
taatacgactcactataggggaccaaggctcgagtctggccatccgctgtaacagaggagaacagcgatgggccagactaacctggcggcagcgcaaaagatg

SEQ ID NO: 103733 - DNA, 103 bp, Artificial Sequence
  Synthetic Polynucleotide
taatacgactcactatagggcggaatggttgaccaaggctcgagtctggcaacagaggagagccagaatggagccttggaacctggcggcagcgcaaaagatg

SEQ ID NO: 103734 - DNA, 103 bp, Artificial Sequence
  Synthetic Polynucleotide
taatacgactcactataggggctgacaaaccggaatggttgaccaaggctaacagaggagaagccttatgcaaccattcaacctggcggcagcgcaaaagatg

SEQ ID NO: 103735 - DNA, 103 bp, Artificial Sequence
  Synthetic Polynucleotide
taatacgactcactatagggtggcacaggagctgacaaaccggaatggttaacagaggagaaaccatatgggtttgtcaaacctggcggcagcgcaaaagatg

SEQ ID NO: 103736 - DNA, 103 bp, Artificial Sequence
  Synthetic Polynucleotide
taatacgactcactatagggtccttccccttggcacaggagctgacaaacaacagaggagagtttgtatgctcctgtgcaacctggcggcagcgcaaaagatg

SEQ ID NO: 103737 - DNA, 103 bp, Artificial Sequence
  Synthetic Polynucleotide
taatacgactcactatagggttctttcccttccttccccttggcacaggaaacagaggagatcctgtatgaaggggaagaacctggcggcagcgcaaaagatg

SEQ ID NO: 103738 - DNA, 103 bp, Artificial Sequence
  Synthetic Polynucleotide
taatacgactcactatagggggctttcaccttctttcccttccttcccctaacagaggagaaggggaatgaagggaaagaacctggcggcagcgcaaaagatg

SEQ ID NO: 103739 - DNA, 103 bp, Artificial Sequence
  Synthetic Polynucleotide
taatacgactcactataggggtgtgctctgggctttcaccttctttccctaacagaggagaagggaaatgaggtgaaagaacctggcggcagcgcaaaagatg

SEQ ID NO: 103740 - DNA, 103 bp, Artificial Sequence
  Synthetic Polynucleotide
taatacgactcactatagggggccccgacggagccggctgcggtggctgcaacagaggagagcagccatggcagccggcaacctggcggcagcgcaaaagatg

SEQ ID NO: 103741 - DNA, 103 bp, Artificial Sequence
  Synthetic Polynucleotide
taatacgactcactatagggaccaccggctgtgtgctctgggctttcaccaacagaggagaggtgaaatgccagagcacaacctggcggcagcgcaaaagatg

SEQ ID NO: 103742 - DNA, 103 bp, Artificial Sequence
  Synthetic Polynucleotide
taatacgactcactatagggggcatcctgcaccaccggctgtgtgctctgaacagaggagacagagcatgcagccggtgaacctggcggcagcgcaaaagatg

SEQ ID NO: 103743 - DNA, 103 bp, Artificial Sequence
  Synthetic Polynucleotide
taatacgactcactatagggccagccagtcggcatcctgcaccaccggctaacagaggagaagccggatgtgcaggatgaacctggcggcagcgcaaaagatg

SEQ ID NO: 103744 - DNA, 103 bp, Artificial Sequence
  Synthetic Polynucleotide
taatacgactcactatagggttgcagctggccagccagtcggcatcctgcaacagaggagagcaggaatgcgactggctaacctggcggcagcgcaaaagatg

SEQ ID NO: 103745 - DNA, 103 bp, Artificial Sequence
  Synthetic Polynucleotide
taatacgactcactatagggggcatctgggttgcagctggccagccagtcaacagaggagagactggatggccagctgcaacctggcggcagcgcaaaagatg

SEQ ID NO: 103746 - DNA, 103 bp, Artificial Sequence
  Synthetic Polynucleotide
taatacgactcactatagggcctggaacagggcatctgggttgcagctggaacagaggagaccagctatgacccagatgaacctggcggcagcgcaaaagatg

SEQ ID NO: 103747 - DNA, 103 bp, Artificial Sequence
  Synthetic Polynucleotide
taatacgactcactatagggtagctgtcctcctggaacagggcatctgggaacagaggagacccagaatgcctgttccaaacctggcggcagcgcaaaagatg

SEQ ID NO: 103748 - DNA, 103 bp, Artificial Sequence
  Synthetic Polynucleotide
taatacgactcactataggggtgtttcttgtagctgtcctcctggaacagaacagaggagactgttcatggaggacagcaacctggcggcagcgcaaaagatg

SEQ ID NO: 103749 - DNA, 103 bp, Artificial Sequence
  Synthetic Polynucleotide
taatacgactcactataggggatgcttcaggtgtttcttgtagctgtcctaacagaggagaaggacaatgacaagaaacaacctggcggcagcgcaaaagatg

SEQ ID NO: 103750 - DNA, 103 bp, Artificial Sequence
  Synthetic Polynucleotide
taatacgactcactatagggttgttacagtgatgcttcaggtgtttcttgaacagaggagacaagaaatgcctgaagcaaacctggcggcagcgcaaaagatg

SEQ ID NO: 103751 - DNA, 103 bp, Artificial Sequence
  Synthetic Polynucleotide
taatacgactcactatagggctgtgcagggggccccgacggagccggctgaacagaggagacagccgatgccgtcggggaacctggcggcagcgcaaaagatg

SEQ ID NO: 103752 - DNA, 103 bp, Artificial Sequence
  Synthetic Polynucleotide
taatacgactcactatagggcagcaggaccttgttacagtgatgcttcagaacagaggagactgaagatgcactgtaacaacctggcggcagcgcaaaagatg

SEQ ID NO: 103753 - DNA, 103 bp, Artificial Sequence
  Synthetic Polynucleotide
taatacgactcactatagggtgcggacacgcagcaggaccttgttacagtaacagaggagaactgtaatgaggtcctgcaacctggcggcagcgcaaaagatg

SEQ ID NO: 103754 - DNA, 103 bp, Artificial Sequence
  Synthetic Polynucleotide
taatacgactcactatagggtagtacagcatgcggacacgcagcaggaccaacagaggagaggtcctatggcgtgtccgaacctggcggcagcgcaaaagatg

SEQ ID NO: 103755 - DNA, 103 bp, Artificial Sequence
  Synthetic Polynucleotide
taatacgactcactatagggttgtcttaggtagtacagcatgcggacacgaacagaggagacgtgtcatgatgctgtacaacctggcggcagcgcaaaagatg

SEQ ID NO: 103756 - DNA, 103 bp, Artificial Sequence
  Synthetic Polynucleotide
taatacgactcactatagggctatcacttcttgtcttaggtagtacagcaaacagaggagatgctgtatgacctaagacaacctggcggcagcgcaaaagatg

SEQ ID NO: 103757 - DNA, 103 bp, Artificial Sequence
  Synthetic Polynucleotide
taatacgactcactataggggcctggtctcctatcacttcttgtcttaggaacagaggagacctaagatgagaagtgataacctggcggcagcgcaaaagatg

SEQ ID NO: 103758 - DNA, 103 bp, Artificial Sequence
  Synthetic Polynucleotide
taatacgactcactataggggatcttatccgcctggtctcctatcacttcaacagaggagagaagtgatgggagaccagaacctggcggcagcgcaaaagatg

SEQ ID NO: 103759 - DNA, 103 bp, Artificial Sequence
  Synthetic Polynucleotide
taatacgactcactatagggcaccctctaagatcttatccgcctggtctcaacagaggagagagaccatgcggataagaaacctggcggcagcgcaaaagatg

SEQ ID NO: 103760 - DNA, 103 bp, Artificial Sequence
  Synthetic Polynucleotide
taatacgactcactatagggcttgagtcagcaccctctaagatcttatccaacagaggagaggataaatgcttagagggaacctggcggcagcgcaaaagatg

SEQ ID NO: 103761 - DNA, 103 bp, Artificial Sequence
  Synthetic Polynucleotide
taatacgactcactatagggatcggcttcacttgagtcagcaccctctaaaacagaggagattagagatggctgactcaaacctggcggcagcgcaaaagatg

SEQ ID NO: 103762 - DNA, 103 bp, Artificial Sequence
  Synthetic Polynucleotide
taatacgactcactataggggagggtggccctgtgcagggggccccgacgaacagaggagacgtcggatgcccctgcacaacctggcggcagcgcaaaagatg

SEQ ID NO: 103763 - DNA, 103 bp, Artificial Sequence
  Synthetic Polynucleotide
taatacgactcactatagggggatccacacatcggcttcacttgagtcagaacagaggagactgactatggtgaagccgaacctggcggcagcgcaaaagatg

SEQ ID NO: 103764 - DNA, 103 bp, Artificial Sequence
  Synthetic Polynucleotide
taatacgactcactatagggaaaggttcagggatccacacatcggcttcaaacagaggagatgaagcatgtgtgtggataacctggcggcagcgcaaaagatg

SEQ ID NO: 103765 - DNA, 103 bp, Artificial Sequence
  Synthetic Polynucleotide
taatacgactcactatagggttcagcatggaaaggttcagggatccacacaacagaggagagtgtggatgcctgaacctaacctggcggcagcgcaaaagatg

SEQ ID NO: 103766 - DNA, 103 bp, Artificial Sequence
  Synthetic Polynucleotide
taatacgactcactatagggctgcaggaacttcagcatggaaaggttcagaacagaggagactgaacatgtccatgctgaacctggcggcagcgcaaaagatg

SEQ ID NO: 103767 - DNA, 103 bp, Artificial Sequence
  Synthetic Polynucleotide
taatacgactcactatagggtcccaccaatctgcaggaacttcagcatggaacagaggagaccatgcatgagttcctgcaacctggcggcagcgcaaaagatg

SEQ ID NO: 103768 - DNA, 103 bp, Artificial Sequence
  Synthetic Polynucleotide
taatacgactcactatagggtgcttccttatcccaccaatctgcaggaacaacagaggagagttcctatggattggtggaacctggcggcagcgcaaaagatg

SEQ ID NO: 103769 - DNA, 103 bp, Artificial Sequence
  Synthetic Polynucleotide
taatacgactcactataggggggatttgtctgcttccttatcccaccaataacagaggagaattggtatgataaggaagaacctggcggcagcgcaaaagatg

SEQ ID NO: 103770 - DNA, 103 bp, Artificial Sequence
  Synthetic Polynucleotide
taatacgactcactatagggccaattaagagggatttgtctgcttccttaaacagaggagataaggaatgagacaaatcaacctggcggcagcgcaaaagatg

SEQ ID NO: 103771 - DNA, 103 bp, Artificial Sequence
  Synthetic Polynucleotide
taatacgactcactatagggtttgaacactccaattaagagggatttgtcaacagaggagagacaaaatgctcttaattaacctggcggcagcgcaaaagatg

SEQ ID NO: 103772 - DNA, 103 bp, Artificial Sequence
  Synthetic Polynucleotide
taatacgactcactatagggcatagccatgtttgaacactccaattaagaaacagaggagatcttaaatggagtgttcaaacctggcggcagcgcaaaagatg

SEQ ID NO: 103773 - DNA, 103 bp, Artificial Sequence
  Synthetic Polynucleotide
taatacgactcactatagggtgcatgtgctgagggtggccctgtgcagggaacagaggagaccctgcatggggccacccaacctggcggcagcgcaaaagatg

SEQ ID NO: 103774 - DNA, 103 bp, Artificial Sequence
  Synthetic Polynucleotide
taatacgactcactatagggttgtacttctcatagccatgtttgaacactaacagaggagaagtgttatgacatggctaaacctggcggcagcgcaaaagatg

SEQ ID NO: 103775 - DNA, 103 bp, Artificial Sequence
  Synthetic Polynucleotide
taatacgactcactatagggtcgcatggagttgtacttctcatagccatgaacagaggagacatggcatggagaagtacaacctggcggcagcgcaaaagatg

SEQ ID NO: 103776 - DNA, 103 bp, Artificial Sequence
  Synthetic Polynucleotide
taatacgactcactatagggcggggtcagctcgcatggagttgtacttctaacagaggagaagaagtatgactccatgcaacctggcggcagcgcaaaagatg

SEQ ID NO: 103777 - DNA, 103 bp, Artificial Sequence
  Synthetic Polynucleotide
taatacgactcactatagggaagcacagcgcggggtcagctcgcatggagaacagaggagactccatatgagctgacccaacctggcggcagcgcaaaagatg

SEQ ID NO: 103778 - DNA, 103 bp, Artificial Sequence
  Synthetic Polynucleotide
taatacgactcactatagggtcgttccagaaagcacagcgcggggtcagcaacagaggagagctgacatggcgctgtgcaacctggcggcagcgcaaaagatg

SEQ ID NO: 103779 - DNA, 103 bp, Artificial Sequence
  Synthetic Polynucleotide
taatacgactcactataggggcataccgactcgttccagaaagcacagcgaacagaggagacgctgtatgttctggaacaacctggcggcagcgcaaaagatg

SEQ ID NO: 103780 - DNA, 103 bp, Artificial Sequence
  Synthetic Polynucleotide
taatacgactcactatagggttggcatcaggcataccgactcgttccagaaacagaggagatctggaatgagtcggtataacctggcggcagcgcaaaagatg

SEQ ID NO: 103781 - DNA, 103 bp, Artificial Sequence
  Synthetic Polynucleotide
taatacgactcactatagggagctatggccttggcatcaggcataccgacaacagaggagagtcggtatgcctgatgccaacctggcggcagcgcaaaagatg

SEQ ID NO: 103782 - DNA, 103 bp, Artificial Sequence
  Synthetic Polynucleotide
taatacgactcactatagggtttgctcggcagctatggccttggcatcagaacagaggagactgatgatgaggccatagaacctggcggcagcgcaaaagatg

SEQ ID NO: 103783 - DNA, 103 bp, Artificial Sequence
  Synthetic Polynucleotide
taatacgactcactatagggtctgttcctctttgctcggcagctatggccaacagaggagaggccatatgtgccgagcaaacctggcggcagcgcaaaagatg

SEQ ID NO: 103784 - DNA, 103 bp, Artificial Sequence
  Synthetic Polynucleotide
taatacgactcactataggggcccatctgctgcatgtgctgagggtggccaacagaggagaggccacatgcagcacatgaacctggcggcagcgcaaaagatg

SEQ ID NO: 103785 - DNA, 103 bp, Artificial Sequence
  Synthetic Polynucleotide
taatacgactcactatagggtgctagcatgtctgttcctctttgctcggcaacagaggagagccgagatgagaggaacaaacctggcggcagcgcaaaagatg

SEQ ID NO: 103786 - DNA, 103 bp, Artificial Sequence
  Synthetic Polynucleotide
taatacgactcactatagggcaccaccatctgctagcatgtctgttcctcaacagaggagagaggaaatgacatgctagaacctggcggcagcgcaaaagatg

SEQ ID NO: 103787 - DNA, 103 bp, Artificial Sequence
  Synthetic Polynucleotide
taatacgactcactatagggtctcccccgtcaccaccatctgctagcatgaacagaggagacatgctatgagatggtggaacctggcggcagcgcaaaagatg

SEQ ID NO: 103788 - DNA, 103 bp, Artificial Sequence
  Synthetic Polynucleotide
taatacgactcactatagggtctatcaaattctcccccgtcaccaccatcaacagaggagagatggtatggacgggggaaacctggcggcagcgcaaaagatg

SEQ ID NO: 103789 - DNA, 103 bp, Artificial Sequence
  Synthetic Polynucleotide
taatacgactcactatagggcttcatcttctctatcaaattctcccccgtaacagaggagaacggggatgaatttgataaacctggcggcagcgcaaaagatg

SEQ ID NO: 103790 - DNA, 103 bp, Artificial Sequence
  Synthetic Polynucleotide
taatacgactcactatagggtattctgggtcttcatcttctctatcaaataacagaggagaatttgaatgagaagatgaaacctggcggcagcgcaaaagatg

SEQ ID NO: 103791 - DNA, 103 bp, Artificial Sequence
  Synthetic Polynucleotide
taatacgactcactatagggggttggtttatattctgggtcttcatcttcaacagaggagagaagatatggacccagaaaacctggcggcagcgcaaaagatg

SEQ ID NO: 103792 - DNA, 103 bp, Artificial Sequence
  Synthetic Polynucleotide
taatacgactcactatagggacggtgttctggttggtttatattctgggtaacagaggagaacccagatgataaaccaaaacctggcggcagcgcaaaagatg

SEQ ID NO: 103793 - DNA, 103 bp, Artificial Sequence
  Synthetic Polynucleotide
taatacgactcactatagggtcatctttgaacggtgttctggttggtttaaacagaggagataaaccatgcagaacaccaacctggcggcagcgcaaaagatg

SEQ ID NO: 103794 - DNA, 103 bp, Artificial Sequence
  Synthetic Polynucleotide
taatacgactcactatagggttcatctatttcatctttgaacggtgttctaacagaggagaagaacaatgttcaaagataacctggcggcagcgcaaaagatg

SEQ ID NO: 103795 - DNA, 103 bp, Artificial Sequence
  Synthetic Polynucleotide
taatacgactcactatagggccatatagctgcccatctgctgcatgtgctaacagaggagaagcacaatgagcagatggaacctggcggcagcgcaaaagatg

SEQ ID NO: 103796 - DNA, 103 bp, Artificial Sequence
  Synthetic Polynucleotide
taatacgactcactatagggaatttgcaaattcatctatttcatctttgaaacagaggagatcaaagatgaaatagatgaacctggcggcagcgcaaaagatg

SEQ ID NO: 103797 - DNA, 103 bp, Artificial Sequence
  Synthetic Polynucleotide
taatacgactcactatagggtctgaaggagaatttgcaaattcatctattaacagaggagaaatagaatgatttgcaaaaacctggcggcagcgcaaaagatg

SEQ ID NO: 103798 - DNA, 103 bp, Artificial Sequence
  Synthetic Polynucleotide
taatacgactcactatagggttccttatcctctgaaggagaatttgcaaaaacagaggagatttgcaatgtctccttcaaacctggcggcagcgcaaaagatg

SEQ ID NO: 103799 - DNA, 103 bp, Artificial Sequence
  Synthetic Polynucleotide
taatacgactcactatagggccatggattcttccttatcctctgaaggagaacagaggagactccttatgaggataaggaacctggcggcagcgcaaaagatg

SEQ ID NO: 103800 - DNA, 103 bp, Artificial Sequence
  Synthetic Polynucleotide
taatacgactcactataggggcatgtatttccatggattcttccttatccaacagaggagaggataaatgagaatccataacctggcggcagcgcaaaagatg

SEQ ID NO: 103801 - DNA, 103 bp, Artificial Sequence
  Synthetic Polynucleotide
taatacgactcactatagggcttgcctgtggcatgtatttccatggattcaacagaggagagaatccatggaaatacataacctggcggcagcgcaaaagatg

SEQ ID NO: 103802 - DNA, 103 bp, Artificial Sequence
  Synthetic Polynucleotide
taatacgactcactatagggtctcactgtgcttgcctgtggcatgtatttaacagaggagaaaatacatgccacaggcaaacctggcggcagcgcaaaagatg

SEQ ID NO: 103803 - DNA, 103 bp, Artificial Sequence
  Synthetic Polynucleotide
taatacgactcactatagggtcagcattactctcactgtgcttgcctgtgaacagaggagacacaggatggcacagtgaaacctggcggcagcgcaaaagatg

SEQ ID NO: 103804 - DNA, 103 bp, Artificial Sequence
  Synthetic Polynucleotide
taatacgactcactatagggttggcctaactcagcattactctcactgtgaacagaggagacacagtatgagtaatgctaacctggcggcagcgcaaaagatg

SEQ ID NO: 103805 - DNA, 103 bp, Artificial Sequence
  Synthetic Polynucleotide
taatacgactcactataggggccagtaaagttggcctaactcagcattacaacagaggagagtaatgatgagttaggccaacctggcggcagcgcaaaagatg

SEQ ID NO: 103806 - DNA, 103 bp, Artificial Sequence
  Synthetic Polynucleotide
taatacgactcactatagggtccccacgtgccatatagctgcccatctgcaacagaggagagcagatatgcagctatataacctggcggcagcgcaaaagatg

SEQ ID NO: 103807 - DNA, 103 bp, Artificial Sequence
  Synthetic Polynucleotide
taatacgactcactataggggaagtgttaggccagtaaagttggcctaacaacagaggagagttaggatgactttactgaacctggcggcagcgcaaaagatg

SEQ ID NO: 103808 - DNA, 103 bp, Artificial Sequence
  Synthetic Polynucleotide
taatacgactcactatagggagtcagggttgaagtgttaggccagtaaagaacagaggagactttacatgcctaacactaacctggcggcagcgcaaaagatg

SEQ ID NO: 103809 - DNA, 103 bp, Artificial Sequence
  Synthetic Polynucleotide
taatacgactcactataggggcagacgtgtagtcagggttgaagtgttagaacagaggagactaacaatgcaaccctgaaacctggcggcagcgcaaaagatg

SEQ ID NO: 103810 - DNA, 103 bp, Artificial Sequence
  Synthetic Polynucleotide
taatacgactcactatagggatgagccggcgcagacgtgtagtcagggttaacagaggagaaaccctatgtacacgtctaacctggcggcagcgcaaaagatg

SEQ ID NO: 103811 - DNA, 103 bp, Artificial Sequence
  Synthetic Polynucleotide
taatacgactcactatagggataggcagtaatgagccggcgcagacgtgtaacagaggagaacacgtatgcgccggctcaacctggcggcagcgcaaaagatg

SEQ ID NO: 103812 - DNA, 103 bp, Artificial Sequence
  Synthetic Polynucleotide
taatacgactcactatagggagctgcgctgataggcagtaatgagccggcaacagaggagagccggcatgttactgcctaacctggcggcagcgcaaaagatg

SEQ ID NO: 103813 - DNA, 103 bp, Artificial Sequence
  Synthetic Polynucleotide
taatacgactcactatagggtgccttttatagctgcgctgataggcagtaaacagaggagatactgcatgtcagcgcagaacctggcggcagcgcaaaagatg

SEQ ID NO: 103814 - DNA, 103 bp, Artificial Sequence
  Synthetic Polynucleotide
taatacgactcactatagggcctcatctgttgccttttatagctgcgctgaacagaggagacagcgcatgtataaaaggaacctggcggcagcgcaaaagatg

SEQ ID NO: 103815 - DNA, 103 bp, Artificial Sequence
  Synthetic Polynucleotide
taatacgactcactataggggggcctcttgcctcatctgttgccttttataacagaggagaataaaaatgaacagatgaaacctggcggcagcgcaaaagatg

SEQ ID NO: 103816 - DNA, 103 bp, Artificial Sequence
  Synthetic Polynucleotide
taatacgactcactataggggtcttcattagggcctcttgcctcatctgtaacagaggagaacagatatggcaagaggcaacctggcggcagcgcaaaagatg

SEQ ID NO: 103817 - DNA, 103 bp, Artificial Sequence
  Synthetic Polynucleotide
taatacgactcactatagggcatggaaaaatccccacgtgccatatagctaacagaggagaagctatatggcacgtgggaacctggcggcagcgcaaaagatg

SEQ ID NO: 103818 - DNA, 103 bp, Artificial Sequence
  Synthetic Polynucleotide
taatacgactcactataggggcgccggtcagtcttcattagggcctcttgaacagaggagacaagagatgctaatgaagaacctggcggcagcgcaaaagatg

SEQ ID NO: 103819 - DNA, 103 bp, Artificial Sequence
  Synthetic Polynucleotide
taatacgactcactataggggccgccgtctgcgccggtcagtcttcattaaacagaggagataatgaatgctgaccggcaacctggcggcagcgcaaaagatg

SEQ ID NO: 103820 - DNA, 103 bp, Artificial Sequence
  Synthetic Polynucleotide
taatacgactcactatagggtcctctcgaggccgccgtctgcgccggtcaaacagaggagatgaccgatgcagacggcgaacctggcggcagcgcaaaagatg

SEQ ID NO: 103821 - DNA, 103 bp, Artificial Sequence
  Synthetic Polynucleotide
taatacgactcactatagggagctctcacttcctctcgaggccgccgtctaacagaggagaagacggatgcctcgagagaacctggcggcagcgcaaaagatg

SEQ ID NO: 103822 - DNA, 103 bp, Artificial Sequence
  Synthetic Polynucleotide
taatacgactcactatagggccgcttccagagctctcacttcctctcgagaacagaggagactcgagatgaagtgagagaacctggcggcagcgcaaaagatg

SEQ ID NO: 103823 - DNA, 103 bp, Artificial Sequence
  Synthetic Polynucleotide
taatacgactcactataggggcttccctttccgcttccagagctctcactaacagaggagaagtgagatgtctggaagcaacctggcggcagcgcaaaagatg

SEQ ID NO: 103824 - DNA, 103 bp, Artificial Sequence
  Synthetic Polynucleotide
taatacgactcactatagggagatataatagcttccctttccgcttccagaacagaggagactggaaatggaaagggaaaacctggcggcagcgcaaaagatg

SEQ ID NO: 103825 - DNA, 103 bp, Artificial Sequence
  Synthetic Polynucleotide
taatacgactcactataggggccgcttctcagatataatagcttccctttaacagaggagaaaagggatgctattatataacctggcggcagcgcaaaagatg

SEQ ID NO: 103826 - DNA, 103 bp, Artificial Sequence
  Synthetic Polynucleotide
taatacgactcactataggggtccacttttgccgcttctcagatataataaacagaggagatattatatgtgagaagcgaacctggcggcagcgcaaaagatg

SEQ ID NO: 103827 - DNA, 103 bp, Artificial Sequence
  Synthetic Polynucleotide
taatacgactcactatagggttctcttcttgtccacttttgccgcttctcaacagaggagagagaagatgcaaaagtggaacctggcggcagcgcaaaagatg

SEQ ID NO: 103828 - DNA, 103 bp, Artificial Sequence
  Synthetic Polynucleotide
taatacgactcactatagggcatgctgctgcatggaaaaatccccacgtgaacagaggagacacgtgatgatttttccaaacctggcggcagcgcaaaagatg

SEQ ID NO: 103829 - DNA, 103 bp, Artificial Sequence
  Synthetic Polynucleotide
taatacgactcactatagggaatcagcctcttctcttcttgtccacttttaacagaggagaaaaagtatgcaagaagagaacctggcggcagcgcaaaagatg

SEQ ID NO: 103830 - DNA, 103 bp, Artificial Sequence
  Synthetic Polynucleotide
taatacgactcactatagggacacggtaaaaatcagcctcttctcttcttaacagaggagaaagaagatgagaggctgaaacctggcggcagcgcaaaagatg

SEQ ID NO: 103831 - DNA, 103 bp, Artificial Sequence
  Synthetic Polynucleotide
taatacgactcactatagggggtggataccacacggtaaaaatcagcctcaacagaggagagaggctatgttttaccgtaacctggcggcagcgcaaaagatg

SEQ ID NO: 103832 - DNA, 103 bp, Artificial Sequence
  Synthetic Polynucleotide
taatacgactcactatagggtaaccccaaaggtggataccacacggtaaaaacagaggagatttaccatgtggtatccaaacctggcggcagcgcaaaagatg

SEQ ID NO: 103833 - DNA, 103 bp, Artificial Sequence
  Synthetic Polynucleotide
taatacgactcactataggggggtcaaaaataaccccaaaggtggataccaacagaggagaggtatcatgctttggggtaacctggcggcagcgcaaaagatg

SEQ ID NO: 103834 - DNA, 103 bp, Artificial Sequence
  Synthetic Polynucleotide
taatacgactcactatagggctgtttcacagggtcaaaaataaccccaaaaacagaggagatttgggatgatttttgacaacctggcggcagcgcaaaagatg

SEQ ID NO: 103835 - DNA, 103 bp, Artificial Sequence
  Synthetic Polynucleotide
taatacgactcactatagggagtcaaattgctgtttcacagggtcaaaaaaacagaggagatttttgatgctgtgaaacaacctggcggcagcgcaaaagatg

SEQ ID NO: 103836 - DNA, 103 bp, Artificial Sequence
  Synthetic Polynucleotide
taatacgactcactatagggaattggttccagtcaaattgctgtttcacaaacagaggagatgtgaaatggcaatttgaaacctggcggcagcgcaaaagatg

SEQ ID NO: 103837 - DNA, 103 bp, Artificial Sequence
  Synthetic Polynucleotide
taatacgactcactatagggaaaggctctaaattggttccagtcaaattgaacagaggagacaatttatgtggaaccaaaacctggcggcagcgcaaaagatg

SEQ ID NO: 103838 - DNA, 103 bp, Artificial Sequence
  Synthetic Polynucleotide
taatacgactcactatagggcaagcctggcaaaggctctaaattggttccaacagaggagaggaaccatgttagagcctaacctggcggcagcgcaaaagatg

SEQ ID NO: 103839 - DNA, 103 bp, Artificial Sequence
  Synthetic Polynucleotide
taatacgactcactatagggcattctccgaggccttcaagaccttcactgaacagaggagacagtgaatgtcttgaaggaacctggcggcagcgcaaaagatg

SEQ ID NO: 103840 - DNA, 103 bp, Artificial Sequence
  Synthetic Polynucleotide
taatacgactcactatagggtgtggctgaccatgctgctgcatggaaaaaaacagaggagatttttcatggcagcagcaaacctggcggcagcgcaaaagatg

SEQ ID NO: 103841 - DNA, 103 bp, Artificial Sequence
  Synthetic Polynucleotide
taatacgactcactataggggattttttgtcaagcctggcaaaggctctaaacagaggagatagagcatgtgccaggctaacctggcggcagcgcaaaagatg

SEQ ID NO: 103842 - DNA, 103 bp, Artificial Sequence
  Synthetic Polynucleotide
taatacgactcactatagggactctcatcagattttttgtcaagcctggcaacagaggagagccaggatggacaaaaaaaacctggcggcagcgcaaaagatg

SEQ ID NO: 103843 - DNA, 103 bp, Artificial Sequence
  Synthetic Polynucleotide
taatacgactcactatagggatttctccaaactctcatcagattttttgtaacagaggagaacaaaaatgctgatgagaaacctggcggcagcgcaaaagatg

SEQ ID NO: 103844 - DNA, 103 bp, Artificial Sequence
  Synthetic Polynucleotide
taatacgactcactatagggcaactgaagtatttctccaaactctcatcaaacagaggagatgatgaatgtttggagaaaacctggcggcagcgcaaaagatg

SEQ ID NO: 103845 - DNA, 103 bp, Artificial Sequence
  Synthetic Polynucleotide
taatacgactcactatagggggccacaaaacaactgaagtatttctccaaaacagaggagattggagatgtacttcagtaacctggcggcagcgcaaaagatg

SEQ ID NO: 103846 - DNA, 103 bp, Artificial Sequence
  Synthetic Polynucleotide
taatacgactcactataggggcctacacatggccacaaaacaactgaagtaacagaggagaacttcaatggttttgtggaacctggcggcagcgcaaaagatg

SEQ ID NO: 103847 - DNA, 103 bp, Artificial Sequence
  Synthetic Polynucleotide
taatacgactcactatagggcgacatactcgcctacacatggccacaaaaaacagaggagattttgtatgcatgtgtagaacctggcggcagcgcaaaagatg

SEQ ID NO: 103848 - DNA, 103 bp, Artificial Sequence
  Synthetic Polynucleotide
taatacgactcactataggggacgggcattcgacatactcgcctacacataacagaggagaatgtgtatgcgagtatgtaacctggcggcagcgcaaaagatg

SEQ ID NO: 103849 - DNA, 103 bp, Artificial Sequence
  Synthetic Polynucleotide
taatacgactcactatagggcatctggcttgacgggcattcgacatactcaacagaggagagagtatatggaatgcccgaacctggcggcagcgcaaaagatg

SEQ ID NO: 103850 - DNA, 103 bp, Artificial Sequence
  Synthetic Polynucleotide
taatacgactcactatagggggcggttcatcatctggcttgacgggcattaacagaggagaaatgccatgcaagccagaaacctggcggcagcgcaaaagatg

SEQ ID NO: 103851 - DNA, 103 bp, Artificial Sequence
  Synthetic Polynucleotide
taatacgactcactatagggcatcctctgctgtggctgaccatgctgctgaacagaggagacagcagatgggtcagccaaacctggcggcagcgcaaaagatg

SEQ ID NO: 103852 - DNA, 103 bp, Artificial Sequence
  Synthetic Polynucleotide
taatacgactcactatagggggagaggtcgggcggttcatcatctggcttaacagaggagaaagccaatggatgaaccgaacctggcggcagcgcaaaagatg

SEQ ID NO: 103853 - DNA, 103 bp, Artificial Sequence
  Synthetic Polynucleotide
taatacgactcactatagggcaattatggaggagaggtcgggcggttcataacagaggagaatgaacatgccgacctctaacctggcggcagcgcaaaagatg

SEQ ID NO: 103854 - DNA, 103 bp, Artificial Sequence
  Synthetic Polynucleotide
taatacgactcactataggggtgatcggctcaattatggaggagaggtcgaacagaggagacgacctatgctccataataacctggcggcagcgcaaaagatg

SEQ ID NO: 103855 - DNA, 103 bp, Artificial Sequence
  Synthetic Polynucleotide
taatacgactcactatagggtcgctcctctgtgatcggctcaattatggaaacagaggagatccataatggagccgatcaacctggcggcagcgcaaaagatg

SEQ ID NO: 103856 - DNA, 103 bp, Artificial Sequence
  Synthetic Polynucleotide
taatacgactcactatagggttcgagaggctcgctcctctgtgatcggctaacagaggagaagccgaatgcagaggagcaacctggcggcagcgcaaaagatg

SEQ ID NO: 103857 - DNA, 103 bp, Artificial Sequence
  Synthetic Polynucleotide
taatacgactcactatagggcggtacagagttcgagaggctcgctcctctaacagaggagaagaggaatgagcctctcgaacctggcggcagcgcaaaagatg

SEQ ID NO: 103858 - DNA, 103 bp, Artificial Sequence
  Synthetic Polynucleotide
taatacgactcactatagggcagctcaatgcggtacagagttcgagaggcaacagaggagagcctctatgactctgtacaacctggcggcagcgcaaaagatg

SEQ ID NO: 103859 - DNA, 103 bp, Artificial Sequence
  Synthetic Polynucleotide
taatacgactcactatagggtcttccgtagcagctcaatgcggtacagagaacagaggagactctgtatggcattgagcaacctggcggcagcgcaaaagatg

SEQ ID NO: 103860 - DNA, 103 bp, Artificial Sequence
  Synthetic Polynucleotide
taatacgactcactatagggtgctcgcggatcttccgtagcagctcaatgaacagaggagacattgaatggctacggaaaacctggcggcagcgcaaaagatg

SEQ ID NO: 103861 - DNA, 103 bp, Artificial Sequence
  Synthetic Polynucleotide
taatacgactcactatagggatggagaacctgctcgcggatcttccgtagaacagaggagactacggatgatccgcgagaacctggcggcagcgcaaaagatg

SEQ ID NO: 103862 - DNA, 103 bp, Artificial Sequence
  Synthetic Polynucleotide
taatacgactcactatagggaaaactggctcatcctctgctgtggctgacaacagaggagagtcagcatgagcagaggaaacctggcggcagcgcaaaagatg

SEQ ID NO: 103863 - DNA, 103 bp, Artificial Sequence
  Synthetic Polynucleotide
taatacgactcactataggggctgggggtgatggagaacctgctcgcggaaacagaggagatccgcgatgaggttctccaacctggcggcagcgcaaaagatg

SEQ ID NO: 103864 - DNA, 103 bp, Artificial Sequence
  Synthetic Polynucleotide
taatacgactcactatagggctctctcccagctgggggtgatggagaaccaacagaggagaggttctatgtcacccccaaacctggcggcagcgcaaaagatg

SEQ ID NO: 103865 - DNA, 103 bp, Artificial Sequence
  Synthetic Polynucleotide
taatacgactcactataggggagcttaagcctctctcccagctgggggtgaacagaggagacaccccatgctgggagagaacctggcggcagcgcaaaagatg

SEQ ID NO: 103866 - DNA, 103 bp, Artificial Sequence
  Synthetic Polynucleotide
taatacgactcactatagggttggctggcagagcttaagcctctctcccaaacagaggagatgggagatgggcttaagcaacctggcggcagcgcaaaagatg

SEQ ID NO: 103867 - DNA, 103 bp, Artificial Sequence
  Synthetic Polynucleotide
taatacgactcactatagggagatccaagcttggctggcagagcttaagcaacagaggagagcttaaatgctgccagccaacctggcggcagcgcaaaagatg

SEQ ID NO: 103868 - DNA, 103 bp, Artificial Sequence
  Synthetic Polynucleotide
taatacgactcactatagggccactctggcagatccaagcttggctggcaaacagaggagatgccagatgagcttggataacctggcggcagcgcaaaagatg

SEQ ID NO: 103869 - DNA, 103 bp, Artificial Sequence
  Synthetic Polynucleotide
taatacgactcactatagggcacactcccaccactctggcagatccaagcaacagaggagagcttggatgtgccagagtaacctggcggcagcgcaaaagatg

SEQ ID NO: 103870 - DNA, 103 bp, Artificial Sequence
  Synthetic Polynucleotide
taatacgactcactatagggtcatgccgtccacactcccaccactctggcaacagaggagagccagaatggtgggagtgaacctggcggcagcgcaaaagatg

SEQ ID NO: 103871 - DNA, 103 bp, Artificial Sequence
  Synthetic Polynucleotide
taatacgactcactatagggcaagtctcggtcatgccgtccacactcccaaacagaggagatgggagatgggacggcataacctggcggcagcgcaaaagatg

SEQ ID NO: 103872 - DNA, 103 bp, Artificial Sequence
  Synthetic Polynucleotide
taatacgactcactatagggcaccaaccagcaagtctcggtcatgccgtcaacagaggagagacggcatgaccgagactaacctggcggcagcgcaaaagatg

SEQ ID NO: 103873 - DNA, 103 bp, Artificial Sequence
  Synthetic Polynucleotide
taatacgactcactatagggtggccttgggaaaactggctcatcctctgcaacagaggagagcagagatggagccagttaacctggcggcagcgcaaaagatg

SEQ ID NO: 103874 - DNA, 103 bp, Artificial Sequence
  Synthetic Polynucleotide
taatacgactcactatagggtgtttagcagcaccaaccagcaagtctcggaacagaggagaccgagaatggctggttggaacctggcggcagcgcaaaagatg

SEQ ID NO: 103875 - DNA, 103 bp, Artificial Sequence
  Synthetic Polynucleotide
taatacgactcactatagggactgaccccgtgtttagcagcaccaaccagaacagaggagactggttatggctgctaaaaacctggcggcagcgcaaaagatg

SEQ ID NO: 103876 - DNA, 103 bp, Artificial Sequence
  Synthetic Polynucleotide
taatacgactcactatagggaatccgtccgactgaccccgtgtttagcagaacagaggagactgctaatgacggggtcaaacctggcggcagcgcaaaagatg

SEQ ID NO: 103877 - DNA, 103 bp, Artificial Sequence
  Synthetic Polynucleotide
taatacgactcactatagggaggatgtgataatccgtccgactgaccccgaacagaggagacggggtatgtcggacggaaacctggcggcagcgcaaaagatg

SEQ ID NO: 103878 - DNA, 103 bp, Artificial Sequence
  Synthetic Polynucleotide
taatacgactcactatagggagggtcattgaggatgtgataatccgtccgaacagaggagacggacgatgtatcacatcaacctggcggcagcgcaaaagatg

SEQ ID NO: 103879 - DNA, 103 bp, Artificial Sequence
  Synthetic Polynucleotide
taatacgactcactatagggaggataactcagggtcattgaggatgtgataacagaggagaatcacaatgtcaatgaccaacctggcggcagcgcaaaagatg

SEQ ID NO: 103880 - DNA, 103 bp, Artificial Sequence
  Synthetic Polynucleotide
taatacgactcactataggggcatccaagaaggataactcagggtcattgaacagaggagacaatgaatgtgagttatcaacctggcggcagcgcaaaagatg

SEQ ID NO: 103881 - DNA, 103 bp, Artificial Sequence
  Synthetic Polynucleotide
taatacgactcactataggggtttttatgtgcatccaagaaggataactcaacagaggagagagttaatgttcttggataacctggcggcagcgcaaaagatg

SEQ ID NO: 103882 - DNA, 103 bp, Artificial Sequence
  Synthetic Polynucleotide
taatacgactcactatagggtttgagcaaagtttttatgtgcatccaagaaacagaggagatcttggatgcacataaaaaacctggcggcagcgcaaaagatg

SEQ ID NO: 103883 - DNA, 103 bp, Artificial Sequence
  Synthetic Polynucleotide
taatacgactcactataggggcccctctgttttgagcaaagtttttatgtaacagaggagaacataaatgctttgctcaaacctggcggcagcgcaaaagatg

SEQ ID NO: 103884 - DNA, 103 bp, Artificial Sequence
  Synthetic Polynucleotide
taatacgactcactataggggaggccctcttggccttgggaaaactggctaacagaggagaagccagatgtcccaaggcaacctggcggcagcgcaaaagatg

SEQ ID NO: 103885 - DNA, 103 bp, Artificial Sequence
  Synthetic Polynucleotide
taatacgactcactatagggtgtattacctgcccctctgttttgagcaaaaacagaggagatttgctatgaacagagggaacctggcggcagcgcaaaagatg

SEQ ID NO: 103886 - DNA, 103 bp, Artificial Sequence
  Synthetic Polynucleotide
taatacgactcactatagggtcaaggaagatgtattacctgcccctctgtaacagaggagaacagagatgcaggtaataaacctggcggcagcgcaaaagatg

SEQ ID NO: 103887 - DNA, 103 bp, Artificial Sequence
  Synthetic Polynucleotide
taatacgactcactataggggccagtgggttcaaggaagatgtattacctaacagaggagaaggtaaatgatcttccttaacctggcggcagcgcaaaagatg

SEQ ID NO: 103888 - DNA, 103 bp, Artificial Sequence
  Synthetic Polynucleotide
taatacgactcactatagggaaatccaactgccagtgggttcaaggaagaaacagaggagatcttccatgaacccactgaacctggcggcagcgcaaaagatg

SEQ ID NO: 103889 - DNA, 103 bp, Artificial Sequence
  Synthetic Polynucleotide
taatacgactcactataggggagtctggacaaatccaactgccagtgggtaacagaggagaacccacatgcagttggataacctggcggcagcgcaaaagatg

SEQ ID NO: 103890 - DNA, 103 bp, Artificial Sequence
  Synthetic Polynucleotide
taatacgactcactatagggatgactggaggagtctggacaaatccaactaacagaggagaagttggatgtgtccagacaacctggcggcagcgcaaaagatg

SEQ ID NO: 103891 - DNA, 103 bp, Artificial Sequence
  Synthetic Polynucleotide
taatacgactcactatagggagcagatgagatgactggaggagtctggacaacagaggagagtccagatgcctccagtcaacctggcggcagcgcaaaagatg

SEQ ID NO: 103892 - DNA, 103 bp, Artificial Sequence
  Synthetic Polynucleotide
taatacgactcactatagggcttgaatatgagcagatgagatgactggagaacagaggagactccagatgtctcatctgaacctggcggcagcgcaaaagatg

SEQ ID NO: 103893 - DNA, 103 bp, Artificial Sequence
  Synthetic Polynucleotide
taatacgactcactatagggaccctctcatcttgaatatgagcagatgagaacagaggagactcatcatgtcatattcaaacctggcggcagcgcaaaagatg

SEQ ID NO: 103894 - DNA, 103 bp, Artificial Sequence
  Synthetic Polynucleotide
taatacgactcactatagggttgttccagtaccctctcatcttgaatatgaacagaggagacatattatggatgagaggaacctggcggcagcgcaaaagatg

SEQ ID NO: 103895 - DNA, 103 bp, Artificial Sequence
  Synthetic Polynucleotide
taatacgactcactatagggttccctgattgaggccctcttggccttgggaacagaggagacccaagatgaagagggccaacctggcggcagcgcaaaagatg

SEQ ID NO: 103896 - DNA, 103 bp, Artificial Sequence
  Synthetic Polynucleotide
taatacgactcactatagggtgccttcggcttgttccagtaccctctcataacagaggagaatgagaatgtactggaacaacctggcggcagcgcaaaagatg

SEQ ID NO: 103897 - DNA, 103 bp, Artificial Sequence
  Synthetic Polynucleotide
taatacgactcactatagggtcctccactttgccttcggcttgttccagtaacagaggagaactggaatgagccgaaggaacctggcggcagcgcaaaagatg

SEQ ID NO: 103898 - DNA, 103 bp, Artificial Sequence
  Synthetic Polynucleotide
taatacgactcactataggggttttcaggctcctccactttgccttcggcaacagaggagagccgaaatgaaagtggagaacctggcggcagcgcaaaagatg

SEQ ID NO: 103899 - DNA, 103 bp, Artificial Sequence
  Synthetic Polynucleotide
taatacgactcactatagggtggcagctgggttttcaggctcctccacttaacagaggagaaagtggatgagcctgaaaaacctggcggcagcgcaaaagatg

SEQ ID NO: 103900 - DNA, 103 bp, Artificial Sequence
  Synthetic Polynucleotide
taatacgactcactatagggcatttctccttggcagctgggttttcaggcaacagaggagagcctgaatgcccagctgcaacctggcggcagcgcaaaagatg

SEQ ID NO: 103901 - DNA, 103 bp, Artificial Sequence
  Synthetic Polynucleotide
taatacgactcactatagggtttgccctcacatttctccttggcagctggaacagaggagaccagctatgaaggagaaaaacctggcggcagcgcaaaagatg

SEQ ID NO: 103902 - DNA, 103 bp, Artificial Sequence
  Synthetic Polynucleotide
taatacgactcactatagggcttcctcttctttgccctcacatttctcctaacagaggagaaggagaatggtgagggcaaacctggcggcagcgcaaaagatg

SEQ ID NO: 103903 - DNA, 103 bp, Artificial Sequence
  Synthetic Polynucleotide
taatacgactcactatagggtcggtttcttcttcctcttctttgccctcaaacagaggagatgagggatgagaagaggaaacctggcggcagcgcaaaagatg

SEQ ID NO: 103904 - DNA, 103 bp, Artificial Sequence
  Synthetic Polynucleotide
taatacgactcactatagggcccgctgccatcggtttcttcttcctcttcaacagaggagagaagagatggaagaaaccaacctggcggcagcgcaaaagatg

SEQ ID NO: 103905 - DNA, 103 bp, Artificial Sequence
  Synthetic Polynucleotide
taatacgactcactatagggtgctctccttcccgctgccatcggtttcttaacagaggagaaagaaaatgatggcagcgaacctggcggcagcgcaaaagatg

SEQ ID NO: 103906 - DNA, 103 bp, Artificial Sequence
  Synthetic Polynucleotide
taatacgactcactatagggataaaaggatttccctgattgaggccctctaacagaggagaagagggatgcaatcagggaacctggcggcagcgcaaaagatg

SEQ ID NO: 103907 - DNA, 103 bp, Artificial Sequence
  Synthetic Polynucleotide
taatacgactcactatagggcattcctgcttgctctccttcccgctgccaaacagaggagatggcagatggaaggagagaacctggcggcagcgcaaaagatg

SEQ ID NO: 103908 - DNA, 103 bp, Artificial Sequence
  Synthetic Polynucleotide
taatacgactcactatagggctctgcctcacattcctgcttgctctccttaacagaggagaaaggagatgaagcaggaaaacctggcggcagcgcaaaagatg

SEQ ID NO: 103909 - DNA, 103 bp, Artificial Sequence
  Synthetic Polynucleotide
taatacgactcactatagggcagagctggcctctgcctcacattcctgctaacagaggagaagcaggatggtgaggcagaacctggcggcagcgcaaaagatg

SEQ ID NO: 103910 - DNA, 103 bp, Artificial Sequence
  Synthetic Polynucleotide
taatacgactcactatagggtcatttttcacagagctggcctctgcctcaaacagaggagatgaggcatgggccagctcaacctggcggcagcgcaaaagatg

SEQ ID NO: 103911 - DNA, 103 bp, Artificial Sequence
  Synthetic Polynucleotide
taatacgactcactatagggacctttcagttcatttttcacagagctggcaacagaggagagccagcatggtgaaaaataacctggcggcagcgcaaaagatg

SEQ ID NO: 103912 - DNA, 103 bp, Artificial Sequence
  Synthetic Polynucleotide
taatacgactcactatagggcgacctcaacacctttcagttcatttttcaaacagaggagatgaaaaatgaactgaaagaacctggcggcagcgcaaaagatg

SEQ ID NO: 103913 - DNA, 103 bp, Artificial Sequence
  Synthetic Polynucleotide
taatacgactcactataggggtgtctgcgccgacctcaacacctttcagtaacagaggagaactgaaatgtgttgaggtaacctggcggcagcgcaaaagatg

SEQ ID NO: 103914 - DNA, 103 bp, Artificial Sequence
  Synthetic Polynucleotide
taatacgactcactatagggtttggacccagtgtctgcgccgacctcaacaacagaggagagttgagatgggcgcagacaacctggcggcagcgcaaaagatg

SEQ ID NO: 103915 - DNA, 103 bp, Artificial Sequence
  Synthetic Polynucleotide
taatacgactcactatagggctgaaatagatttggacccagtgtctgcgcaacagaggagagcgcagatgctgggtccaaacctggcggcagcgcaaaagatg

SEQ ID NO: 103916 - DNA, 103 bp, Artificial Sequence
  Synthetic Polynucleotide
taatacgactcactataggggaacctttctctgaaatagatttggacccaaacagaggagatgggtcatgatctatttcaacctggcggcagcgcaaaagatg

SEQ ID NO: 103917 - DNA, 103 bp, Artificial Sequence
  Synthetic Polynucleotide
taatacgactcactatagggtgaggtggcaataaaaggatttccctgattaacagaggagaaatcagatgaatccttttaacctggcggcagcgcaaaagatg

SEQ ID NO: 103918 - DNA, 103 bp, Artificial Sequence
  Synthetic Polynucleotide
taatacgactcactatagggatcctcttcggaacctttctctgaaatagaaacagaggagatctattatggagaaaggtaacctggcggcagcgcaaaagatg

SEQ ID NO: 103919 - DNA, 103 bp, Artificial Sequence
  Synthetic Polynucleotide
taatacgactcactatagggtttcctcttcatcctcttcggaacctttctaacagaggagaagaaagatgccgaagaggaacctggcggcagcgcaaaagatg

SEQ ID NO: 103920 - DNA, 103 bp, Artificial Sequence
  Synthetic Polynucleotide
taatacgactcactatagggtcctccagcttttcctcttcatcctcttcgaacagaggagacgaagaatgtgaagaggaaacctggcggcagcgcaaaagatg

SEQ ID NO: 103921 - DNA, 103 bp, Artificial Sequence
  Synthetic Polynucleotide
taatacgactcactatagggcttatcgtcatcctccagcttttcctcttcaacagaggagagaagagatgaagctggagaacctggcggcagcgcaaaagatg

SEQ ID NO: 103922 - DNA, 103 bp, Artificial Sequence
  Synthetic Polynucleotide
taatacgactcactatagggactcttccgacttatcgtcatcctccagctaacagaggagaagctggatgatgacgataaacctggcggcagcgcaaaagatg

SEQ ID NO: 103923 - DNA, 103 bp, Artificial Sequence
  Synthetic Polynucleotide
taatacgactcactatagggggctgggaagactcttccgacttatcgtcaaacagaggagatgacgaatggtcggaagaaacctggcggcagcgcaaaagatg

SEQ ID NO: 103924 - DNA, 103 bp, Artificial Sequence
  Synthetic Polynucleotide
taatacgactcactatagggtcctgcttcgggctgggaagactcttccgaaacagaggagatcggaaatgtcttcccagaacctggcggcagcgcaaaagatg

SEQ ID NO: 103925 - DNA, 103 bp, Artificial Sequence
  Synthetic Polynucleotide
taatacgactcactatagggtagagacagctcctgcttcgggctgggaagaacagaggagacttcccatgccgaagcagaacctggcggcagcgcaaaagatg

SEQ ID NO: 103926 - DNA, 103 bp, Artificial Sequence
  Synthetic Polynucleotide
taatacgactcactatagggttcttccctctagagacagctcctgcttcgaacagaggagacgaagcatgagctgtctcaacctggcggcagcgcaaaagatg

SEQ ID NO: 103927 - DNA, 103 bp, Artificial Sequence
  Synthetic Polynucleotide
taatacgactcactatagggttcatcaaaattcttccctctagagacagcaacagaggagagctgtcatgagagggaagaacctggcggcagcgcaaaagatg

SEQ ID NO: 103928 - DNA, 103 bp, Artificial Sequence
  Synthetic Polynucleotide
taatacgactcactatagggggccaggtcctgaggtggcaataaaaggataacagaggagaatccttatgttgccacctaacctggcggcagcgcaaaagatg

SEQ ID NO: 103929 - DNA, 103 bp, Artificial Sequence
  Synthetic Polynucleotide
taatacgactcactatagggcattgctttcttcatcaaaattcttccctcaacagaggagagagggaatgattttgatgaacctggcggcagcgcaaaagatg

SEQ ID NO: 103930 - DNA, 103 bp, Artificial Sequence
  Synthetic Polynucleotide
taatacgactcactatagggctcatggaagcattgctttcttcatcaaaaaacagaggagattttgaatgagaaagcaaaacctggcggcagcgcaaaagatg

SEQ ID NO: 103931 - DNA, 103 bp, Artificial Sequence
  Synthetic Polynucleotide
taatacgactcactatagggtctagcagtgctcatggaagcattgctttcaacagaggagagaaagcatggcttccatgaacctggcggcagcgcaaaagatg

SEQ ID NO: 103932 - DNA, 103 bp, Artificial Sequence
  Synthetic Polynucleotide
taatacgactcactataggggggtttcatctctagcagtgctcatggaagaacagaggagacttccaatggcactgctaaacctggcggcagcgcaaaagatg

SEQ ID NO: 103933 - DNA, 103 bp, Artificial Sequence
  Synthetic Polynucleotide
taatacgactcactatagggaatccatctcgggtttcatctctagcagtgaacagaggagacactgcatgagatgaaacaacctggcggcagcgcaaaagatg

SEQ ID NO: 103934 - DNA, 103 bp, Artificial Sequence
  Synthetic Polynucleotide
taatacgactcactatagggctccatgtagaatccatctcgggtttcatcaacagaggagagatgaaatgcgagatggaaacctggcggcagcgcaaaagatg

SEQ ID NO: 103935 - DNA, 103 bp, Artificial Sequence
  Synthetic Polynucleotide
taatacgactcactataggggatctccgtcctccatgtagaatccatctcaacagaggagagagatgatgtctacatggaacctggcggcagcgcaaaagatg

SEQ ID NO: 103936 - DNA, 103 bp, Artificial Sequence
  Synthetic Polynucleotide
taatacgactcactataggggctactgaaggatctccgtcctccatgtagaacagaggagactacatatgggacggagaaacctggcggcagcgcaaaagatg

SEQ ID NO: 103937 - DNA, 103 bp, Artificial Sequence
  Synthetic Polynucleotide
taatacgactcactatagggaaggagctgagctactgaaggatctccgtcaacagaggagagacggaatgccttcagtaaacctggcggcagcgcaaaagatg

SEQ ID NO: 103938 - DNA, 103 bp, Artificial Sequence
  Synthetic Polynucleotide
taatacgactcactatagggttctttcatgaaggagctgagctactgaagaacagaggagacttcagatgctcagctccaacctggcggcagcgcaaaagatg

SEQ ID NO: 103939 - DNA, 103 bp, Artificial Sequence
  Synthetic Polynucleotide
taatacgactcactatagggtgggacaagtggccaggtcctgaggtggcaaacagaggagatgccacatgaggacctggaacctggcggcagcgcaaaagatg

SEQ ID NO: 103940 - DNA, 103 bp, Artificial Sequence
  Synthetic Polynucleotide
taatacgactcactatagggaaggcaaatgttctttcatgaaggagctgaaacagaggagatcagctatgtcatgaaagaacctggcggcagcgcaaaagatg

SEQ ID NO: 103941 - DNA, 103 bp, Artificial Sequence
  Synthetic Polynucleotide
taatacgactcactatagggccaaaacgagaaggcaaatgttctttcatgaacagaggagacatgaaatgacatttgccaacctggcggcagcgcaaaagatg

SEQ ID NO: 103942 - DNA, 103 bp, Artificial Sequence
  Synthetic Polynucleotide
taatacgactcactatagggtatccttaggccaaaacgagaaggcaaatgaacagaggagacatttgatgtctcgttttaacctggcggcagcgcaaaagatg

SEQ ID NO: 103943 - DNA, 103 bp, Artificial Sequence
  Synthetic Polynucleotide
taatacgactcactatagggatcattactctatccttaggccaaaacgagaacagaggagactcgttatggcctaaggaaacctggcggcagcgcaaaagatg

SEQ ID NO: 103944 - DNA, 103 bp, Artificial Sequence
  Synthetic Polynucleotide
taatacgactcactatagggtaagcggtttatcattactctatccttaggaacagaggagacctaagatgagagtaatgaacctggcggcagcgcaaaagatg

SEQ ID NO: 103945 - DNA, 103 bp, Artificial Sequence
  Synthetic Polynucleotide
taatacgactcactatagggagatgttgtctaagcggtttatcattactcaacagaggagagagtaaatgtaaaccgctaacctggcggcagcgcaaaagatg

SEQ ID NO: 103946 - DNA, 103 bp, Artificial Sequence
  Synthetic Polynucleotide
taatacgactcactatagggactgcttcacagatgttgtctaagcggtttaacagaggagaaaaccgatgagacaacataacctggcggcagcgcaaaagatg

SEQ ID NO: 103947 - DNA, 103 bp, Artificial Sequence
  Synthetic Polynucleotide
taatacgactcactataggggcctttcaacactgcttcacagatgttgtcaacagaggagagacaacatgtgtgaagcaaacctggcggcagcgcaaaagatg

SEQ ID NO: 103948 - DNA, 103 bp, Artificial Sequence
  Synthetic Polynucleotide
taatacgactcactatagggctggccatttgcctttcaacactgcttcacaacagaggagagtgaagatgtgttgaaagaacctggcggcagcgcaaaagatg

SEQ ID NO: 103949 - DNA, 103 bp, Artificial Sequence
  Synthetic Polynucleotide
taatacgactcactatagggcgcctatttactggccatttgcctttcaacaacagaggagagttgaaatgcaaatggccaacctggcggcagcgcaaaagatg

SEQ ID NO: 103950 - DNA, 103 bp, Artificial Sequence
  Synthetic Polynucleotide
taatacgactcactatagggcgggtaaccacattctccgaggccttcaagaacagaggagacttgaaatgctcggagaaaacctggcggcagcgcaaaagatg

SEQ ID NO: 103951 - DNA, 103 bp, Artificial Sequence
  Synthetic Polynucleotide
taatacgactcactatagggctggggcacgtgggacaagtggccaggtccaacagaggagaggacctatgcacttgtccaacctggcggcagcgcaaaagatg

SEQ ID NO: 103952 - DNA, 103 bp, Artificial Sequence
  Synthetic Polynucleotide
taatacgactcactatagggaaacatctggcgcctatttactggccatttaacagaggagaaaatggatggtaaataggaacctggcggcagcgcaaaagatg

SEQ ID NO: 103953 - DNA, 103 bp, Artificial Sequence
  Synthetic Polynucleotide
taatacgactcactatagggcttggaaatcaaacatctggcgcctatttaaacagaggagataaataatggccagatgtaacctggcggcagcgcaaaagatg

SEQ ID NO: 103954 - DNA, 103 bp, Artificial Sequence
  Synthetic Polynucleotide
taatacgactcactataggggggatgaggccttggaaatcaaacatctggaacagaggagaccagatatgtgatttccaaacctggcggcagcgcaaaagatg

SEQ ID NO: 103955 - DNA, 103 bp, Artificial Sequence
  Synthetic Polynucleotide
taatacgactcactatagggtgtgtaacctgggatgaggccttggaaatcaacagaggagagatttcatgggcctcatcaacctggcggcagcgcaaaagatg

SEQ ID NO: 103956 - DNA, 103 bp, Artificial Sequence
  Synthetic Polynucleotide
taatacgactcactatagggctgtggtgggtgtgtaacctgggatgaggcaacagaggagagcctcaatgcaggttacaaacctggcggcagcgcaaaagatg

SEQ ID NO: 103957 - DNA, 103 bp, Artificial Sequence
  Synthetic Polynucleotide
taatacgactcactataggggggctgtccactgtggtgggtgtgtaacctaacagaggagaaggttaatgacccaccacaacctggcggcagcgcaaaagatg

SEQ ID NO: 103958 - DNA, 103 bp, Artificial Sequence
  Synthetic Polynucleotide
taatacgactcactatagggcttctgcaaggggctgtccactgtggtgggaacagaggagacccaccatggtggacagcaacctggcggcagcgcaaaagatg

SEQ ID NO: 103959 - DNA, 103 bp, Artificial Sequence
  Synthetic Polynucleotide
taatacgactcactatagggcaaagctcctcttctgcaaggggctgtccaaacagaggagatggacaatgccttgcagaaacctggcggcagcgcaaaagatg

SEQ ID NO: 103960 - DNA, 103 bp, Artificial Sequence
  Synthetic Polynucleotide
taatacgactcactataggggagagctcagcaaagctcctcttctgcaagaacagaggagacttgcaatggaggagcttaacctggcggcagcgcaaaagatg

SEQ ID NO: 103961 - DNA, 103 bp, Artificial Sequence
  Synthetic Polynucleotide
taatacgactcactataggggccgaccatggagagctcagcaaagctcctaacagaggagaaggagcatggctgagctcaacctggcggcagcgcaaaagatg

SEQ ID NO: 103962 - DNA, 103 bp, Artificial Sequence
  Synthetic Polynucleotide
taatacgactcactatagggtgggactctgctggggcacgtgggacaagtaacagaggagaacttgtatgacgtgccccaacctggcggcagcgcaaaagatg

SEQ ID NO: 103963 - DNA, 103 bp, Artificial Sequence
  Synthetic Polynucleotide
taatacgactcactatagggtgctggcttggccgaccatggagagctcagaacagaggagactgagcatgccatggtcgaacctggcggcagcgcaaaagatg

SEQ ID NO: 103964 - DNA, 103 bp, Artificial Sequence
  Synthetic Polynucleotide
taatacgactcactatagggctcccactaatgctggcttggccgaccatgaacagaggagacatggtatgccaagccagaacctggcggcagcgcaaaagatg

SEQ ID NO: 103965 - DNA, 103 bp, Artificial Sequence
  Synthetic Polynucleotide
taatacgactcactataggggatgtcctcactcccactaatgctggcttgaacagaggagacaagccatgattagtgggaacctggcggcagcgcaaaagatg

SEQ ID NO: 103966 - DNA, 103 bp, Artificial Sequence
  Synthetic Polynucleotide
taatacgactcactataggggagacgtagtgatgtcctcactcccactaaaacagaggagattagtgatggtgaggacaaacctggcggcagcgcaaaagatg

SEQ ID NO: 103967 - DNA, 103 bp, Artificial Sequence
  Synthetic Polynucleotide
taatacgactcactataggggacaactgaggagacgtagtgatgtcctcaaacagaggagatgaggaatgcactacgtcaacctggcggcagcgcaaaagatg

SEQ ID NO: 103968 - DNA, 103 bp, Artificial Sequence
  Synthetic Polynucleotide
taatacgactcactatagggatcttcctttgacaactgaggagacgtagtaacagaggagaactacgatgcctcagttgaacctggcggcagcgcaaaagatg

SEQ ID NO: 103969 - DNA, 103 bp, Artificial Sequence
  Synthetic Polynucleotide
taatacgactcactatagggggttgagggcatcttcctttgacaactgagaacagaggagactcagtatgcaaaggaagaacctggcggcagcgcaaaagatg

SEQ ID NO: 103970 - DNA, 103 bp, Artificial Sequence
  Synthetic Polynucleotide
taatacgactcactataggggggacagagaggttgagggcatcttcctttaacagaggagaaaaggaatgtgccctcaaaacctggcggcagcgcaaaagatg

SEQ ID NO: 103971 - DNA, 103 bp, Artificial Sequence
  Synthetic Polynucleotide
taatacgactcactatagggccgctggcgagggacagagaggttgagggcaacagaggagagccctcatgctctctgtcaacctggcggcagcgcaaaagatg

SEQ ID NO: 103972 - DNA, 103 bp, Artificial Sequence
  Synthetic Polynucleotide
taatacgactcactatagggtcctcctcctccgctggcgagggacagagaaacagaggagatctctgatgctcgccagcaacctggcggcagcgcaaaagatg

SEQ ID NO: 103973 - DNA, 103 bp, Artificial Sequence
  Synthetic Polynucleotide
taatacgactcactatagggggtgccatgctgggactctgctggggcacgaacagaggagacgtgccatggcagagtccaacctggcggcagcgcaaaagatg

SEQ ID NO: 103974 - DNA, 103 bp, Artificial Sequence
  Synthetic Polynucleotide
taatacgactcactatagggatttttctcctcctcctcctccgctggcgaaacagaggagatcgccaatggaggaggagaacctggcggcagcgcaaaagatg

SEQ ID NO: 103975 - DNA, 103 bp, Artificial Sequence
  Synthetic Polynucleotide
taatacgactcactatagggctcaatttcgatttttctcctcctcctcctaacagaggagaaggaggatgaggagaaaaaacctggcggcagcgcaaaagatg

SEQ ID NO: 103976 - DNA, 103 bp, Artificial Sequence
  Synthetic Polynucleotide
taatacgactcactatagggctctttcggcctcaatttcgatttttctccaacagaggagaggagaaatgtcgaaattgaacctggcggcagcgcaaaagatg

SEQ ID NO: 103977 - DNA, 103 bp, Artificial Sequence
  Synthetic Polynucleotide
taatacgactcactatagggctcttggcagctctttcggcctcaatttcgaacagaggagacgaaatatgggccgaaagaacctggcggcagcgcaaaagatg

SEQ ID NO: 103978 - DNA, 103 bp, Artificial Sequence
  Synthetic Polynucleotide
taatacgactcactataggggagatttcgcctcttggcagctctttcggcaacagaggagagccgaaatggctgccaagaacctggcggcagcgcaaaagatg

SEQ ID NO: 103979 - DNA, 103 bp, Artificial Sequence
  Synthetic Polynucleotide
taatacgactcactatagggccatctccatgagatttcgcctcttggcagaacagaggagactgccaatgggcgaaatcaacctggcggcagcgcaaaagatg

SEQ ID NO: 103980 - DNA, 103 bp, Artificial Sequence
  Synthetic Polynucleotide
taatacgactcactatagggagctgggcaaccatctccatgagatttcgcaacagaggagagcgaaaatgcatggagataacctggcggcagcgcaaaagatg

SEQ ID NO: 103981 - DNA, 103 bp, Artificial Sequence
  Synthetic Polynucleotide
taatacgactcactatagggagactctcgaagctgggcaaccatctccataacagaggagaatggagatggttgcccagaacctggcggcagcgcaaaagatg

SEQ ID NO: 103982 - DNA, 103 bp, Artificial Sequence
  Synthetic Polynucleotide
taatacgactcactatagggagaccacctgagactctcgaagctgggcaaaacagaggagattgcccatgttcgagagtaacctggcggcagcgcaaaagatg

SEQ ID NO: 103983 - DNA, 103 bp, Artificial Sequence
  Synthetic Polynucleotide
taatacgactcactatagggccattttctgagaccacctgagactctcgaaacagaggagatcgagaatgtcaggtggtaacctggcggcagcgcaaaagatg

SEQ ID NO: 103984 - DNA, 103 bp, Artificial Sequence
  Synthetic Polynucleotide
taatacgactcactatagggacgcaaggaaggtgccatgctgggactctgaacagaggagacagagtatgagcatggcaaacctggcggcagcgcaaaagatg

SEQ ID NO: 103985 - DNA, 103 bp, Artificial Sequence
  Synthetic Polynucleotide
taatacgactcactatagggtttttcttgtccattttctgagaccacctgaacagaggagacaggtgatgtcagaaaataacctggcggcagcgcaaaagatg

SEQ ID NO: 103986 - DNA, 103 bp, Artificial Sequence
  Synthetic Polynucleotide
taatacgactcactatagggaatctacaactttttcttgtccattttctgaacagaggagacagaaaatggacaagaaaaacctggcggcagcgcaaaagatg

SEQ ID NO: 103987 - DNA, 103 bp, Artificial Sequence
  Synthetic Polynucleotide
taatacgactcactataggggcctttgataaatctacaactttttcttgtaacagaggagaacaagaatgagttgtagaaacctggcggcagcgcaaaagatg

SEQ ID NO: 103988 - DNA, 103 bp, Artificial Sequence
  Synthetic Polynucleotide
taatacgactcactatagggctctcttgaggcctttgataaatctacaacaacagaggagagttgtaatgttatcaaagaacctggcggcagcgcaaaagatg

SEQ ID NO: 103989 - DNA, 103 bp, Artificial Sequence
  Synthetic Polynucleotide
taatacgactcactatagggagcttgttgcctctcttgaggcctttgataaacagaggagatatcaaatgcctcaagagaacctggcggcagcgcaaaagatg

SEQ ID NO: 103990 - DNA, 103 bp, Artificial Sequence
  Synthetic Polynucleotide
taatacgactcactatagggtttgaggtagagcttgttgcctctcttgagaacagaggagactcaagatgggcaacaagaacctggcggcagcgcaaaagatg

SEQ ID NO: 103991 - DNA, 103 bp, Artificial Sequence
  Synthetic Polynucleotide
taatacgactcactatagggagatgaaaaatttgaggtagagcttgttgcaacagaggagagcaacaatgtctacctcaaacctggcggcagcgcaaaagatg

SEQ ID NO: 103992 - DNA, 103 bp, Artificial Sequence
  Synthetic Polynucleotide
taatacgactcactatagggttgaagaaagagatgaaaaatttgaggtagaacagaggagactacctatgatttttcataacctggcggcagcgcaaaagatg

SEQ ID NO: 103993 - DNA, 103 bp, Artificial Sequence
  Synthetic Polynucleotide
taatacgactcactatagggaagataaactttgaagaaagagatgaaaaaaacagaggagatttttcatgtctttcttcaacctggcggcagcgcaaaagatg

SEQ ID NO: 103994 - DNA, 103 bp, Artificial Sequence
  Synthetic Polynucleotide
taatacgactcactataggggacattaggcaagataaactttgaagaaagaacagaggagactttctatgaagtttatcaacctggcggcagcgcaaaagatg

SEQ ID NO: 103995 - DNA, 103 bp, Artificial Sequence
  Synthetic Polynucleotide
taatacgactcactataggggcaccgagtgacgcaaggaaggtgccatgcaacagaggagagcatggatgcttccttgcaacctggcggcagcgcaaaagatg

SEQ ID NO: 103996 - DNA, 103 bp, Artificial Sequence
  Synthetic Polynucleotide
taatacgactcactatagggctggtgttgagacattaggcaagataaactaacagaggagaagtttaatgtgcctaatgaacctggcggcagcgcaaaagatg

SEQ ID NO: 103997 - DNA, 103 bp, Artificial Sequence
  Synthetic Polynucleotide
taatacgactcactataggggcatcagacactggtgttgagacattaggcaacagaggagagcctaaatgctcaacaccaacctggcggcagcgcaaaagatg

SEQ ID NO: 103998 - DNA, 103 bp, Artificial Sequence
  Synthetic Polynucleotide
taatacgactcactatagggagtcttaaaggcatcagacactggtgttgaaacagaggagatcaacaatggtgtctgataacctggcggcagcgcaaaagatg

SEQ ID NO: 103999 - DNA, 103 bp, Artificial Sequence
  Synthetic Polynucleotide
taatacgactcactataggggttccatttgagtcttaaaggcatcagacaaacagaggagatgtctgatgcctttaagaaacctggcggcagcgcaaaagatg

SEQ ID NO: 104000 - DNA, 103 bp, Artificial Sequence
  Synthetic Polynucleotide
taatacgactcactataggggcttggagcagttccatttgagtcttaaagaacagaggagactttaaatgtcaaatggaaacctggcggcagcgcaaaagatg

SEQ ID NO: 104001 - DNA, 103 bp, Artificial Sequence
  Synthetic Polynucleotide
taatacgactcactatagggcgaaaggcctgcttggagcagttccatttgaacagaggagacaaatgatgctgctccaaaacctggcggcagcgcaaaagatg

SEQ ID NO: 104002 - DNA, 103 bp, Artificial Sequence
  Synthetic Polynucleotide
taatacgactcactatagggtgggtgtgcgcgaaaggcctgcttggagcaaacagaggagatgctccatgcaggcctttaacctggcggcagcgcaaaagatg

SEQ ID NO: 104003 - DNA, 103 bp, Artificial Sequence
  Synthetic Polynucleotide
taatacgactcactatagggagatgccttgtgggtgtgcgcgaaaggcctaacagaggagaaggcctatggcgcacaccaacctggcggcagcgcaaaagatg

SEQ ID NO: 104004 - DNA, 103 bp, Artificial Sequence
  Synthetic Polynucleotide
taatacgactcactataggggccattaaggagatgccttgtgggtgtgcgaacagaggagacgcacaatgacaaggcataacctggcggcagcgcaaaagatg

SEQ ID NO: 104005 - DNA, 103 bp, Artificial Sequence
  Synthetic Polynucleotide
taatacgactcactatagggccactagggagccattaaggagatgccttgaacagaggagacaaggcatgtccttaatgaacctggcggcagcgcaaaagatg

SEQ ID NO: 104006 - DNA, 103 bp, Artificial Sequence
  Synthetic Polynucleotide
taatacgactcactatagggtggaactgctgcaccgagtgacgcaaggaaaacagaggagattccttatgtcactcggtaacctggcggcagcgcaaaagatg

SEQ ID NO: 104007 - DNA, 103 bp, Artificial Sequence
  Synthetic Polynucleotide
taatacgactcactatagggggctctccatccactagggagccattaaggaacagaggagaccttaaatgctccctagtaacctggcggcagcgcaaaagatg

SEQ ID NO: 104008 - DNA, 103 bp, Artificial Sequence
  Synthetic Polynucleotide
taatacgactcactatagggcttcatgggaggctctccatccactagggaaacagaggagatccctaatggatggagagaacctggcggcagcgcaaaagatg

SEQ ID NO: 104009 - DNA, 103 bp, Artificial Sequence
  Synthetic Polynucleotide
taatacgactcactatagggcccgcctcctcttcatgggaggctctccataacagaggagaatggagatgctcccatgaaacctggcggcagcgcaaaagatg

SEQ ID NO: 104010 - DNA, 103 bp, Artificial Sequence
  Synthetic Polynucleotide
taatacgactcactatagggttcctccttccccgcctcctcttcatgggaaacagaggagatcccatatggaggaggcgaacctggcggcagcgcaaaagatg

SEQ ID NO: 104011 - DNA, 103 bp, Artificial Sequence
  Synthetic Polynucleotide
taatacgactcactatagggctccacatttttcctccttccccgcctcctaacagaggagaaggaggatgggaaggaggaacctggcggcagcgcaaaagatg

SEQ ID NO: 104012 - DNA, 103 bp, Artificial Sequence
  Synthetic Polynucleotide
taatacgactcactataggggatcaagtccctccacatttttcctccttcaacagaggagagaaggaatgaaaatgtggaacctggcggcagcgcaaaagatg

SEQ ID NO: 104013 - DNA, 103 bp, Artificial Sequence
  Synthetic Polynucleotide
taatacgactcactatagggatgaaaagcagatcaagtccctccacatttaacagaggagaaaatgtatggggacttgaaacctggcggcagcgcaaaagatg

SEQ ID NO: 104014 - DNA, 103 bp, Artificial Sequence
  Synthetic Polynucleotide
taatacgactcactatagggtttgtggctcatgaaaagcagatcaagtccaacagaggagaggacttatgctgcttttcaacctggcggcagcgcaaaagatg

SEQ ID NO: 104015 - DNA, 103 bp, Artificial Sequence
  Synthetic Polynucleotide
taatacgactcactatagggatgacgtccgtttgtggctcatgaaaagcaaacagaggagatgctttatgtgagccacaaacctggcggcagcgcaaaagatg

SEQ ID NO: 104016 - DNA, 103 bp, Artificial Sequence
  Synthetic Polynucleotide
taatacgactcactatagggtctgcactcaatgacgtccgtttgtggctcaacagaggagagagccaatgacggacgtcaacctggcggcagcgcaaaagatg

SEQ ID NO: 104017 - DNA, 103 bp, Artificial Sequence
  Synthetic Polynucleotide
taatacgactcactatagggggggtggtgatggaactgctgcaccgagtgaacagaggagacactcgatgcagcagttcaacctggcggcagcgcaaaagatg

SEQ ID NO: 104018 - DNA, 103 bp, Artificial Sequence
  Synthetic Polynucleotide
taatacgactcactatagggctcagcatcctctgcactcaatgacgtccgaacagaggagacggacgatgttgagtgcaaacctggcggcagcgcaaaagatg

SEQ ID NO: 104019 - DNA, 103 bp, Artificial Sequence
  Synthetic Polynucleotide
taatacgactcactatagggctttggtcacctcagcatcctctgcactcaaacagaggagatgagtgatgaggatgctgaacctggcggcagcgcaaaagatg

SEQ ID NO: 104020 - DNA, 103 bp, Artificial Sequence
  Synthetic Polynucleotide
taatacgactcactatagggtcttcaaaagctttggtcacctcagcatccaacagaggagaggatgcatgggtgaccaaaacctggcggcagcgcaaaagatg

SEQ ID NO: 104021 - DNA, 103 bp, Artificial Sequence
  Synthetic Polynucleotide
taatacgactcactatagggctctatatcttcttcaaaagctttggtcacaacagaggagagtgaccatggcttttgaaaacctggcggcagcgcaaaagatg

SEQ ID NO: 104022 - DNA, 103 bp, Artificial Sequence
  Synthetic Polynucleotide
taatacgactcactatagggttggtggggtctctatatcttcttcaaaagaacagaggagacttttgatgaagatatagaacctggcggcagcgcaaaagatg

SEQ ID NO: 104023 - DNA, 103 bp, Artificial Sequence
  Synthetic Polynucleotide
taatacgactcactatagggatgtttcttgttggtggggtctctatatctaacagaggagaagatatatggaccccaccaacctggcggcagcgcaaaagatg

SEQ ID NO: 104024 - DNA, 103 bp, Artificial Sequence
  Synthetic Polynucleotide
taatacgactcactataggggggagaaggaatgtttcttgttggtggggtaacagaggagaaccccaatgacaagaaacaacctggcggcagcgcaaaagatg

SEQ ID NO: 104025 - DNA, 103 bp, Artificial Sequence
  Synthetic Polynucleotide
taatacgactcactatagggccagctgtccgggagaaggaatgtttcttgaacagaggagacaagaaatgttccttctcaacctggcggcagcgcaaaagatg

SEQ ID NO: 104026 - DNA, 103 bp, Artificial Sequence
  Synthetic Polynucleotide
taatacgactcactataggggtgtctgggtccagctgtccgggagaaggaaacagaggagatccttcatgcggacagctaacctggcggcagcgcaaaagatg

SEQ ID NO: 104027 - DNA, 103 bp, Artificial Sequence
  Synthetic Polynucleotide
taatacgactcactatagggagggatccgtgtgtctgggtccagctgtccaacagaggagaggacagatggacccagacaacctggcggcagcgcaaaagatg

SEQ ID NO: 104028 - DNA, 103 bp, Artificial Sequence
  Synthetic Polynucleotide
taatacgactcactataggggagcagtagaggggtggtgatggaactgctaacagaggagaagcagtatgatcaccaccaacctggcggcagcgcaaaagatg

SEQ ID NO: 104029 - DNA, 103 bp, Artificial Sequence
  Synthetic Polynucleotide
taatacgactcactataggggattgataacagggatccgtgtgtctgggtaacagaggagaacccagatgcacggatccaacctggcggcagcgcaaaagatg

SEQ ID NO: 104030 - DNA, 103 bp, Artificial Sequence
  Synthetic Polynucleotide
taatacgactcactatagggccatcttcaagattgataacagggatccgtaacagaggagaacggatatgtgttatcaaaacctggcggcagcgcaaaagatg

SEQ ID NO: 104031 - DNA, 103 bp, Artificial Sequence
  Synthetic Polynucleotide
taatacgactcactatagggcagcctagtcccatcttcaagattgataacaacagaggagagttatcatgcttgaagataacctggcggcagcgcaaaagatg

SEQ ID NO: 104032 - DNA, 103 bp, Artificial Sequence
  Synthetic Polynucleotide
taatacgactcactatagggcttcccccaccagcctagtcccatcttcaaaacagaggagattgaagatgggactaggcaacctggcggcagcgcaaaagatg

SEQ ID NO: 104033 - DNA, 103 bp, Artificial Sequence
  Synthetic Polynucleotide
taatacgactcactatagggttaggagcatcttcccccaccagcctagtcaacagaggagagactagatgggtgggggaaacctggcggcagcgcaaaagatg

SEQ ID NO: 104034 - DNA, 103 bp, Artificial Sequence
  Synthetic Polynucleotide
taatacgactcactatagggatccttatttttaggagcatcttcccccacaacagaggagagtggggatggatgctcctaacctggcggcagcgcaaaagatg

SEQ ID NO: 104035 - DNA, 103 bp, Artificial Sequence
  Synthetic Polynucleotide
taatacgactcactatagggattcaactaaatccttatttttaggagcataacagaggagaatgctcatgaaaataaggaacctggcggcagcgcaaaagatg

SEQ ID NO: 104036 - DNA, 103 bp, Artificial Sequence
  Synthetic Polynucleotide
taatacgactcactatagggagcttcagccattcaactaaatccttatttaacagaggagaaaataaatgtttagttgaaacctggcggcagcgcaaaagatg

SEQ ID NO: 104037 - DNA, 103 bp, Artificial Sequence
  Synthetic Polynucleotide
taatacgactcactatagggagtagggtgcagcttcagccattcaactaaaacagaggagattagttatgtggctgaagaacctggcggcagcgcaaaagatg

SEQ ID NO: 104038 - DNA, 103 bp, Artificial Sequence
  Synthetic Polynucleotide
taatacgactcactatagggcaacagtgtaagtagggtgcagcttcagccaacagaggagaggctgaatgtgcaccctaaacctggcggcagcgcaaaagatg

SEQ ID NO: 104039 - DNA, 103 bp, Artificial Sequence
  Synthetic Polynucleotide
taatacgactcactatagggtctccatggagagcagtagaggggtggtgaaacagaggagatcaccaatgctctactgcaacctggcggcagcgcaaaagatg

SEQ ID NO: 104040 - DNA, 103 bp, Artificial Sequence
  Synthetic Polynucleotide
taatacgactcactatagggcttggcatatcaacagtgtaagtagggtgcaacagaggagagcacccatgttacactgtaacctggcggcagcgcaaaagatg

SEQ ID NO: 104041 - DNA, 103 bp, Artificial Sequence
  Synthetic Polynucleotide
taatacgactcactatagggtggtacataacttggcatatcaacagtgtaaacagaggagatacactatggatatgccaaacctggcggcagcgcaaaagatg

SEQ ID NO: 104042 - DNA, 103 bp, Artificial Sequence
  Synthetic Polynucleotide
taatacgactcactatagggctgcattctttggtacataacttggcatataacagaggagaatatgcatggttatgtacaacctggcggcagcgcaaaagatg

SEQ ID NO: 104043 - DNA, 103 bp, Artificial Sequence
  Synthetic Polynucleotide
taatacgactcactatagggaacagcacatctgcattctttggtacataaaacagaggagattatgtatgaaagaatgcaacctggcggcagcgcaaaagatg

SEQ ID NO: 104044 - DNA, 103 bp, Artificial Sequence
  Synthetic Polynucleotide
taatacgactcactatagggaaatgaggaaaacagcacatctgcattcttaacagaggagaaagaatatggatgtgctgaacctggcggcagcgcaaaagatg

SEQ ID NO: 104045 - DNA, 103 bp, Artificial Sequence
  Synthetic Polynucleotide
taatacgactcactatagggtcggtttctgaaatgaggaaaacagcacataacagaggagaatgtgcatgtttcctcataacctggcggcagcgcaaaagatg

SEQ ID NO: 104046 - DNA, 103 bp, Artificial Sequence
  Synthetic Polynucleotide
taatacgactcactatagggcgtttctgtttcggtttctgaaatgaggaaaacagaggagattcctcatgtcagaaaccaacctggcggcagcgcaaaagatg

SEQ ID NO: 104047 - DNA, 103 bp, Artificial Sequence
  Synthetic Polynucleotide
taatacgactcactatagggacatctatgtcgtttctgtttcggtttctgaacagaggagacagaaaatgaaacagaaaaacctggcggcagcgcaaaagatg

SEQ ID NO: 104048 - DNA, 103 bp, Artificial Sequence
  Synthetic Polynucleotide
taatacgactcactatagggtagggtttcgacatctatgtcgtttctgttaacagaggagaaacagaatggacatagataacctggcggcagcgcaaaagatg

SEQ ID NO: 104049 - DNA, 103 bp, Artificial Sequence
  Synthetic Polynucleotide
taatacgactcactatagggtccaatttattagggtttcgacatctatgtaacagaggagaacatagatgtcgaaacccaacctggcggcagcgcaaaagatg

SEQ ID NO: 104050 - DNA, 103 bp, Artificial Sequence
  Synthetic Polynucleotide
taatacgactcactatagggggcaacggattctccatggagagcagtagaaacagaggagatctactatgctccatggaaacctggcggcagcgcaaaagatg

SEQ ID NO: 104051 - DNA, 103 bp, Artificial Sequence
  Synthetic Polynucleotide
taatacgactcactatagggagtgtttatatccaatttattagggtttcgaacagaggagacgaaacatgaataaattgaacctggcggcagcgcaaaagatg

SEQ ID NO: 104052 - DNA, 103 bp, Artificial Sequence
  Synthetic Polynucleotide
taatacgactcactatagggctcctgtcaaagtgtttatatccaatttataacagaggagaataaatatgatataaacaaacctggcggcagcgcaaaagatg

SEQ ID NO: 104053 - DNA, 103 bp, Artificial Sequence
  Synthetic Polynucleotide
taatacgactcactatagggaccctttcttctcctgtcaaagtgtttataaacagaggagatataaaatgtttgacaggaacctggcggcagcgcaaaagatg

SEQ ID NO: 104054 - DNA, 103 bp, Artificial Sequence
  Synthetic Polynucleotide
taatacgactcactataggggacaacaggcaccctttcttctcctgtcaaaacagaggagattgacaatggaagaaaggaacctggcggcagcgcaaaagatg

SEQ ID NO: 104055 - DNA, 103 bp, Artificial Sequence
  Synthetic Polynucleotide
taatacgactcactatagggttcgtttattgacaacaggcaccctttcttaacagaggagaaagaaaatgtgcctgttgaacctggcggcagcgcaaaagatg

SEQ ID NO: 104056 - DNA, 103 bp, Artificial Sequence
  Synthetic Polynucleotide
taatacgactcactatagggttcttcccatttcgtttattgacaacaggcaacagaggagagcctgtatgcaataaacgaacctggcggcagcgcaaaagatg

SEQ ID NO: 104057 - DNA, 103 bp, Artificial Sequence
  Synthetic Polynucleotide
taatacgactcactatagggtccacccatcttcttcccatttcgtttattaacagaggagaaataaaatgaatgggaagaacctggcggcagcgcaaaagatg

SEQ ID NO: 104058 - DNA, 103 bp, Artificial Sequence
  Synthetic Polynucleotide
taatacgactcactataggggcgccatagctccacccatcttcttcccataacagaggagaatgggaatgagatgggtgaacctggcggcagcgcaaaagatg

SEQ ID NO: 104059 - DNA, 103 bp, Artificial Sequence
  Synthetic Polynucleotide
taatacgactcactatagggttcattggaggcgccatagctccacccatcaacagaggagagatgggatgagctatggcaacctggcggcagcgcaaaagatg

SEQ ID NO: 104060 - DNA, 103 bp, Artificial Sequence
  Synthetic Polynucleotide
taatacgactcactataggggggtagatccttcattggaggcgccatagcaacagaggagagctatgatgcctccaatgaacctggcggcagcgcaaaagatg

SEQ ID NO: 104061 - DNA, 103 bp, Artificial Sequence
  Synthetic Polynucleotide
taatacgactcactatagggctggattttccgggtaaccacattctccgaaacagaggagatcggagatggtggttaccaacctggcggcagcgcaaaagatg

SEQ ID NO: 104062 - DNA, 103 bp, Artificial Sequence
  Synthetic Polynucleotide
taatacgactcactatagggtgggactgtgggcaacggattctccatggaaacagaggagatccatgatgaatccgttgaacctggcggcagcgcaaaagatg

SEQ ID NO: 104063 - DNA, 103 bp, Artificial Sequence
  Synthetic Polynucleotide
taatacgactcactatagggccagccacctgggtagatccttcattggagaacagaggagactccaaatgaggatctacaacctggcggcagcgcaaaagatg

SEQ ID NO: 104064 - DNA, 103 bp, Artificial Sequence
  Synthetic Polynucleotide
taatacgactcactatagggggattttcttccagccacctgggtagatccaacagaggagaggatctatgcaggtggctaacctggcggcagcgcaaaagatg

SEQ ID NO: 104065 - DNA, 103 bp, Artificial Sequence
  Synthetic Polynucleotide
taatacgactcactatagggtgcaaattcaggattttcttccagccacctaacagaggagaaggtggatggaagaaaataacctggcggcagcgcaaaagatg

SEQ ID NO: 104066 - DNA, 103 bp, Artificial Sequence
  Synthetic Polynucleotide
taatacgactcactatagggctggagcaactgcaaattcaggattttcttaacagaggagaaagaaaatgctgaatttgaacctggcggcagcgcaaaagatg

SEQ ID NO: 104067 - DNA, 103 bp, Artificial Sequence
  Synthetic Polynucleotide
taatacgactcactatagggtcagtccagtctggagcaactgcaaattcaaacagaggagatgaattatgagttgctccaacctggcggcagcgcaaaagatg

SEQ ID NO: 104068 - DNA, 103 bp, Artificial Sequence
  Synthetic Polynucleotide
taatacgactcactatagggcttaactatatcagtccagtctggagcaacaacagaggagagttgctatggactggactaacctggcggcagcgcaaaagatg

SEQ ID NO: 104069 - DNA, 103 bp, Artificial Sequence
  Synthetic Polynucleotide
taatacgactcactatagggaaccagactgcttaactatatcagtccagtaacagaggagaactggaatgatatagttaaacctggcggcagcgcaaaagatg

SEQ ID NO: 104070 - DNA, 103 bp, Artificial Sequence
  Synthetic Polynucleotide
taatacgactcactatagggtcaggaacaaaaccagactgcttaactataaacagaggagatatagtatggcagtctggaacctggcggcagcgcaaaagatg

SEQ ID NO: 104071 - DNA, 103 bp, Artificial Sequence
  Synthetic Polynucleotide
taatacgactcactatagggaaacatcgactcaggaacaaaaccagactgaacagaggagacagtctatgtttgttcctaacctggcggcagcgcaaaagatg

SEQ ID NO: 104072 - DNA, 103 bp, Artificial Sequence
  Synthetic Polynucleotide
taatacgactcactataggggaaggcggtcaaacatcgactcaggaacaaaacagaggagattgttcatgagtcgatgtaacctggcggcagcgcaaaagatg

SEQ ID NO: 104073 - DNA, 103 bp, Artificial Sequence
  Synthetic Polynucleotide
taatacgactcactatagggggggagaatctgggactgtgggcaacggataacagaggagaatccgtatgccacagtccaacctggcggcagcgcaaaagatg

SEQ ID NO: 104074 - DNA, 103 bp, Artificial Sequence
  Synthetic Polynucleotide
taatacgactcactatagggggcccagtgagaaggcggtcaaacatcgacaacagaggagagtcgatatgtgaccgcctaacctggcggcagcgcaaaagatg

SEQ ID NO: 104075 - DNA, 103 bp, Artificial Sequence
  Synthetic Polynucleotide
taatacgactcactatagggccgcactacaggcccagtgagaaggcggtcaacagaggagagaccgcatgctcactgggaacctggcggcagcgcaaaagatg

SEQ ID NO: 104076 - DNA, 103 bp, Artificial Sequence
  Synthetic Polynucleotide
taatacgactcactatagggctccctctccccgcactacaggcccagtgaaacagaggagatcactgatgctgtagtgcaacctggcggcagcgcaaaagatg

SEQ ID NO: 104077 - DNA, 103 bp, Artificial Sequence
  Synthetic Polynucleotide
taatacgactcactatagggcttctgctcgctccctctccccgcactacaaacagaggagatgtagtatggggagagggaacctggcggcagcgcaaaagatg

SEQ ID NO: 104078 - DNA, 103 bp, Artificial Sequence
  Synthetic Polynucleotide
taatacgactcactatagggccttcttcctcttctgctcgctccctctccaacagaggagaggagagatggcgagcagaaacctggcggcagcgcaaaagatg

SEQ ID NO: 104079 - DNA, 103 bp, Artificial Sequence
  Synthetic Polynucleotide
taatacgactcactatagggcacttttgggccttcttcctcttctgctcgaacagaggagacgagcaatggaggaagaaaacctggcggcagcgcaaaagatg

SEQ ID NO: 104080 - DNA, 103 bp, Artificial Sequence
  Synthetic Polynucleotide
taatacgactcactatagggctggcgatctcacttttgggccttcttcctaacagaggagaaggaagatggcccaaaagaacctggcggcagcgcaaaagatg

SEQ ID NO: 104081 - DNA, 103 bp, Artificial Sequence
  Synthetic Polynucleotide
taatacgactcactatagggcgcggctgctctggcgatctcacttttgggaacagaggagacccaaaatggagatcgccaacctggcggcagcgcaaaagatg

SEQ ID NO: 104082 - DNA, 103 bp, Artificial Sequence
  Synthetic Polynucleotide
taatacgactcactatagggcagcggcggccgcggctgctctggcgatctaacagaggagaagatcgatggagcagccgaacctggcggcagcgcaaaagatg

SEQ ID NO: 104083 - DNA, 103 bp, Artificial Sequence
  Synthetic Polynucleotide
taatacgactcactataggggaggccacagcagcggcggccgcggctgctaacagaggagaagcagcatgggccgccgcaacctggcggcagcgcaaaagatg

SEQ ID NO: 104084 - DNA, 103 bp, Artificial Sequence
  Synthetic Polynucleotide
taatacgactcactataggggggaggattcggggagaatctgggactgtgaacagaggagacacagtatgagattctccaacctggcggcagcgcaaaagatg

SEQ ID NO: 104085 - DNA, 103 bp, Artificial Sequence
  Synthetic Polynucleotide
taatacgactcactatagggccctgacgtggaggccacagcagcggcggcaacagaggagagccgccatggctgtggccaacctggcggcagcgcaaaagatg

SEQ ID NO: 104086 - DNA, 103 bp, Artificial Sequence
  Synthetic Polynucleotide
taatacgactcactatagggaagggttgatccctgacgtggaggccacagaacagaggagactgtggatgccacgtcagaacctggcggcagcgcaaaagatg

SEQ ID NO: 104087 - DNA, 103 bp, Artificial Sequence
  Synthetic Polynucleotide
taatacgactcactatagggttcaccagcaaagggttgatccctgacgtgaacagaggagacacgtcatggatcaacccaacctggcggcagcgcaaaagatg

SEQ ID NO: 104088 - DNA, 103 bp, Artificial Sequence
  Synthetic Polynucleotide
taatacgactcactatagggaaacaggctgttcaccagcaaagggttgataacagaggagaatcaacatgttgctggtgaacctggcggcagcgcaaaagatg

SEQ ID NO: 104089 - DNA, 103 bp, Artificial Sequence
  Synthetic Polynucleotide
taatacgactcactatagggccattccagcaaacaggctgttcaccagcaaacagaggagatgctggatgacagcctgtaacctggcggcagcgcaaaagatg

SEQ ID NO: 104090 - DNA, 103 bp, Artificial Sequence
  Synthetic Polynucleotide
taatacgactcactatagggctcgtcaggtccattccagcaaacaggctgaacagaggagacagcctatgtgctggaataacctggcggcagcgcaaaagatg

SEQ ID NO: 104091 - DNA, 103 bp, Artificial Sequence
  Synthetic Polynucleotide
taatacgactcactatagggattctgaaggctcgtcaggtccattccagcaacagaggagagctggaatggacctgacgaacctggcggcagcgcaaaagatg

SEQ ID NO: 104092 - DNA, 103 bp, Artificial Sequence
  Synthetic Polynucleotide
taatacgactcactataggggattctggagattctgaaggctcgtcaggtaacagaggagaacctgaatggccttcagaaacctggcggcagcgcaaaagatg

SEQ ID NO: 104093 - DNA, 103 bp, Artificial Sequence
  Synthetic Polynucleotide
taatacgactcactatagggagcgactggagattctggagattctgaaggaacagaggagaccttcaatgtctccagaaaacctggcggcagcgcaaaagatg

SEQ ID NO: 104094 - DNA, 103 bp, Artificial Sequence
  Synthetic Polynucleotide
taatacgactcactatagggtgccagctggagcgactggagattctggagaacagaggagactccagatgctccagtcgaacctggcggcagcgcaaaagatg

SEQ ID NO: 104095 - DNA, 103 bp, Artificial Sequence
  Synthetic Polynucleotide
taatacgactcactatagggccccttgttggggaggattcggggagaatcaacagaggagagattctatgcgaatcctcaacctggcggcagcgcaaaagatg

SEQ ID NO: 104096 - DNA, 103 bp, Artificial Sequence
  Synthetic Polynucleotide
taatacgactcactatagggccatgaggcctgccagctggagcgactggaaacagaggagatccagtatgtccagctggaacctggcggcagcgcaaaagatg

SEQ ID NO: 104097 - DNA, 103 bp, Artificial Sequence
  Synthetic Polynucleotide
taatacgactcactatagggggagggaagcccatgaggcctgccagctggaacagaggagaccagctatgaggcctcataacctggcggcagcgcaaaagatg

SEQ ID NO: 104098 - DNA, 103 bp, Artificial Sequence
  Synthetic Polynucleotide
taatacgactcactatagggtgccagtcctggagggaagcccatgaggccaacagaggagaggcctcatgggcttccctaacctggcggcagcgcaaaagatg

SEQ ID NO: 104099 - DNA, 103 bp, Artificial Sequence
  Synthetic Polynucleotide
taatacgactcactatagggtggcagctgttgccagtcctggagggaagcaacagaggagagcttccatgcaggactggaacctggcggcagcgcaaaagatg

SEQ ID NO: 104100 - DNA, 103 bp, Artificial Sequence
  Synthetic Polynucleotide
taatacgactcactatagggcctccggcggtggcagctgttgccagtcctaacagaggagaaggactatgaacagctgcaacctggcggcagcgcaaaagatg

SEQ ID NO: 104101 - DNA, 103 bp, Artificial Sequence
  Synthetic Polynucleotide
taatacgactcactatagggcttcgcatcgcctccggcggtggcagctgtaacagaggagaacagctatgaccgccggaaacctggcggcagcgcaaaagatg

SEQ ID NO: 104102 - DNA, 103 bp, Artificial Sequence
  Synthetic Polynucleotide
taatacgactcactatagggcagcagggttcttcgcatcgcctccggcggaacagaggagaccgccgatggcgatgcgaaacctggcggcagcgcaaaagatg

SEQ ID NO: 104103 - DNA, 103 bp, Artificial Sequence
  Synthetic Polynucleotide
taatacgactcactatagggggcagcacagcagcagggttcttcgcatcgaacagaggagacgatgcatggaaccctgcaacctggcggcagcgcaaaagatg

SEQ ID NO: 104104 - DNA, 103 bp, Artificial Sequence
  Synthetic Polynucleotide
taatacgactcactatagggcagcatcaggggcagcacagcagcagggttaacagaggagaaaccctatggctgtgctgaacctggcggcagcgcaaaagatg

SEQ ID NO: 104105 - DNA, 103 bp, Artificial Sequence
  Synthetic Polynucleotide
taatacgactcactatagggccattcctggcagcatcaggggcagcacagaacagaggagactgtgcatgccctgatgcaacctggcggcagcgcaaaagatg

SEQ ID NO: 104106 - DNA, 103 bp, Artificial Sequence
  Synthetic Polynucleotide
taatacgactcactatagggggcctaacagccccttgttggggaggattcaacagaggagagaatccatgccaacaaggaacctggcggcagcgcaaaagatg

SEQ ID NO: 104107 - DNA, 103 bp, Artificial Sequence
  Synthetic Polynucleotide
taatacgactcactatagggggcaggcccgccattcctggcagcatcaggaacagaggagacctgatatggccaggaataacctggcggcagcgcaaaagatg

SEQ ID NO: 104108 - DNA, 103 bp, Artificial Sequence
  Synthetic Polynucleotide
taatacgactcactatagggaaacacgttgggcaggcccgccattcctggaacagaggagaccaggaatggcgggcctgaacctggcggcagcgcaaaagatg

SEQ ID NO: 104109 - DNA, 103 bp, Artificial Sequence
  Synthetic Polynucleotide
taatacgactcactatagggcgcccaagccaaacacgttgggcaggcccgaacagaggagacgggccatgccaacgtgtaacctggcggcagcgcaaaagatg

SEQ ID NO: 104110 - DNA, 103 bp, Artificial Sequence
  Synthetic Polynucleotide
taatacgactcactatagggttcaacagcccgcccaagccaaacacgttgaacagaggagacaacgtatgtggcttgggaacctggcggcagcgcaaaagatg

SEQ ID NO: 104111 - DNA, 103 bp, Artificial Sequence
  Synthetic Polynucleotide
taatacgactcactatagggcagagggttattcaacagcccgcccaagccaacagaggagaggcttgatggggctgttgaacctggcggcagcgcaaaagatg

SEQ ID NO: 104112 - DNA, 103 bp, Artificial Sequence
  Synthetic Polynucleotide
taatacgactcactatagggtagcagctgacagagggttattcaacagccaacagaggagaggctgtatgataaccctcaacctggcggcagcgcaaaagatg

SEQ ID NO: 104113 - DNA, 103 bp, Artificial Sequence
  Synthetic Polynucleotide
taatacgactcactataggggtgtttccagtagcagctgacagagggttaaacagaggagataacccatggtcagctgcaacctggcggcagcgcaaaagatg

SEQ ID NO: 104114 - DNA, 103 bp, Artificial Sequence
  Synthetic Polynucleotide
taatacgactcactatagggagcagtagtggtgtttccagtagcagctgaaacagaggagatcagctatgactggaaacaacctggcggcagcgcaaaagatg

SEQ ID NO: 104115 - DNA, 103 bp, Artificial Sequence
  Synthetic Polynucleotide
taatacgactcactatagggcttgactagaagcagtagtggtgtttccagaacagaggagactggaaatgccactactgaacctggcggcagcgcaaaagatg

SEQ ID NO: 104116 - DNA, 103 bp, Artificial Sequence
  Synthetic Polynucleotide
taatacgactcactatagggtccggttctccttgactagaagcagtagtgaacagaggagacactacatgttctagtcaaacctggcggcagcgcaaaagatg

SEQ ID NO: 104117 - DNA, 103 bp, Artificial Sequence
  Synthetic Polynucleotide
taatacgactcactatagggaagggtttgcggcctaacagccccttgttgaacagaggagacaacaaatggctgttaggaacctggcggcagcgcaaaagatg

SEQ ID NO: 104118 - DNA, 103 bp, Artificial Sequence
  Synthetic Polynucleotide
taatacgactcactatagggagtgctgtcttccggttctccttgactagaaacagaggagatctagtatgggagaaccgaacctggcggcagcgcaaaagatg

SEQ ID NO: 104119 - DNA, 103 bp, Artificial Sequence
  Synthetic Polynucleotide
taatacgactcactatagggctccttttgaagtgctgtcttccggttctcaacagaggagagagaacatgaagacagcaaacctggcggcagcgcaaaagatg

SEQ ID NO: 104120 - DNA, 103 bp, Artificial Sequence
  Synthetic Polynucleotide
taatacgactcactatagggcctttctcctctccttttgaagtgctgtctaacagaggagaagacagatgttcaaaaggaacctggcggcagcgcaaaagatg

SEQ ID NO: 104121 - DNA, 103 bp, Artificial Sequence
  Synthetic Polynucleotide
taatacgactcactatagggattctcatttcctttctcctctccttttgaaacagaggagatcaaaaatggaggagaaaaacctggcggcagcgcaaaagatg

SEQ ID NO: 104122 - DNA, 103 bp, Artificial Sequence
  Synthetic Polynucleotide
taatacgactcactatagggtctcgtcttcattctcatttcctttctcctaacagaggagaaggagaatggaaatgagaaacctggcggcagcgcaaaagatg

SEQ ID NO: 104123 - DNA, 103 bp, Artificial Sequence
  Synthetic Polynucleotide
taatacgactcactataggggagtctttgttctcgtcttcattctcatttaacagaggagaaaatgaatgtgaagacgaaacctggcggcagcgcaaaagatg

SEQ ID NO: 104124 - DNA, 103 bp, Artificial Sequence
  Synthetic Polynucleotide
taatacgactcactataggggcttttctcagagtctttgttctcgtcttcaacagaggagagaagacatgaacaaagacaacctggcggcagcgcaaaagatg

SEQ ID NO: 104125 - DNA, 103 bp, Artificial Sequence
  Synthetic Polynucleotide
taatacgactcactatagggcagcatctgtgcttttctcagagtctttgtaacagaggagaacaaagatgctgagaaaaaacctggcggcagcgcaaaagatg

SEQ ID NO: 104126 - DNA, 103 bp, Artificial Sequence
  Synthetic Polynucleotide
taatacgactcactataggggcagccgaaacagcatctgtgcttttctcaaacagaggagatgagaaatgcacagatgcaacctggcggcagcgcaaaagatg

SEQ ID NO: 104127 - DNA, 103 bp, Artificial Sequence
  Synthetic Polynucleotide
taatacgactcactatagggcgcagagtcagcagccgaaacagcatctgtaacagaggagaacagatatggtttcggctaacctggcggcagcgcaaaagatg

SEQ ID NO: 104128 - DNA, 103 bp, Artificial Sequence
  Synthetic Polynucleotide
taatacgactcactatagggaactaaagttaagggtttgcggcctaacagaacagaggagactgttaatgcgcaaacccaacctggcggcagcgcaaaagatg

SEQ ID NO: 104129 - DNA, 103 bp, Artificial Sequence
  Synthetic Polynucleotide
taatacgactcactatagggcagatccattcgcagagtcagcagccgaaaaacagaggagatttcggatgctgactctgaacctggcggcagcgcaaaagatg

SEQ ID NO: 104130 - DNA, 103 bp, Artificial Sequence
  Synthetic Polynucleotide
taatacgactcactataggggcagcaccaacagatccattcgcagagtcaaacagaggagatgactcatggaatggatcaacctggcggcagcgcaaaagatg

SEQ ID NO: 104131 - DNA, 103 bp, Artificial Sequence
  Synthetic Polynucleotide
taatacgactcactatagggcggggcagtagcagcaccaacagatccattaacagaggagaaatggaatggttggtgctaacctggcggcagcgcaaaagatg

SEQ ID NO: 104132 - DNA, 103 bp, Artificial Sequence
  Synthetic Polynucleotide
taatacgactcactataggggcaatccagccggggcagtagcagcaccaaaacagaggagattggtgatgctactgcccaacctggcggcagcgcaaaagatg

SEQ ID NO: 104133 - DNA, 103 bp, Artificial Sequence
  Synthetic Polynucleotide
taatacgactcactataggggggtttgagggcaatccagccggggcagtaaacagaggagatactgcatgggctggattaacctggcggcagcgcaaaagatg

SEQ ID NO: 104134 - DNA, 103 bp, Artificial Sequence
  Synthetic Polynucleotide
taatacgactcactataggggaaggctagcgggtttgagggcaatccagcaacagaggagagctggaatgccctcaaacaacctggcggcagcgcaaaagatg

SEQ ID NO: 104135 - DNA, 103 bp, Artificial Sequence
  Synthetic Polynucleotide
taatacgactcactatagggggaaagggttgaaggctagcgggtttgaggaacagaggagacctcaaatgcgctagcctaacctggcggcagcgcaaaagatg

SEQ ID NO: 104136 - DNA, 103 bp, Artificial Sequence
  Synthetic Polynucleotide
taatacgactcactataggggtggacaggaggaaagggttgaaggctagcaacagaggagagctagcatgcaaccctttaacctggcggcagcgcaaaagatg

SEQ ID NO: 104137 - DNA, 103 bp, Artificial Sequence
  Synthetic Polynucleotide
taatacgactcactatagggcggggccattgtggacaggaggaaagggttaacagaggagaaaccctatgctcctgtccaacctggcggcagcgcaaaagatg

SEQ ID NO: 104138 - DNA, 103 bp, Artificial Sequence
  Synthetic Polynucleotide
taatacgactcactatagggagaagaggcccggggccattgtggacaggaaacagaggagatcctgtatgcaatggcccaacctggcggcagcgcaaaagatg

SEQ ID NO: 104139 - DNA, 103 bp, Artificial Sequence
  Synthetic Polynucleotide
taatacgactcactatagggtggctccgagaactaaagttaagggtttgcaacagaggagagcaaacatgtaactttagaacctggcggcagcgcaaaagatg

SEQ ID NO: 104140 - DNA, 103 bp, Artificial Sequence
  Synthetic Polynucleotide
taatacgactcactatagggatggatgggtagaagaggcccggggccattaacagaggagaaatggcatggggcctcttaacctggcggcagcgcaaaagatg

SEQ ID NO: 104141 - DNA, 103 bp, Artificial Sequence
  Synthetic Polynucleotide
taatacgactcactatagggaggtagaaacatggatgggtagaagaggccaacagaggagaggcctcatgtacccatccaacctggcggcagcgcaaaagatg

SEQ ID NO: 104142 - DNA, 103 bp, Artificial Sequence
  Synthetic Polynucleotide
taatacgactcactatagggccagtcctggaggtagaaacatggatgggtaacagaggagaacccatatgtgtttctacaacctggcggcagcgcaaaagatg

SEQ ID NO: 104143 - DNA, 103 bp, Artificial Sequence
  Synthetic Polynucleotide
taatacgactcactataggggtcaatccccccagtcctggaggtagaaacaacagaggagagtttctatgtccaggactaacctggcggcagcgcaaaagatg

SEQ ID NO: 104144 - DNA, 103 bp, Artificial Sequence
  Synthetic Polynucleotide
taatacgactcactatagggcccaggcagcgtcaatccccccagtcctggaacagaggagaccaggaatggggggattgaacctggcggcagcgcaaaagatg

SEQ ID NO: 104145 - DNA, 103 bp, Artificial Sequence
  Synthetic Polynucleotide
taatacgactcactatagggatgctgggaacccaggcagcgtcaatccccaacagaggagaggggatatgcgctgcctgaacctggcggcagcgcaaaagatg

SEQ ID NO: 104146 - DNA, 103 bp, Artificial Sequence
  Synthetic Polynucleotide
taatacgactcactatagggagtcctgccaatgctgggaacccaggcagcaacagaggagagctgccatggttcccagcaacctggcggcagcgcaaaagatg

SEQ ID NO: 104147 - DNA, 103 bp, Artificial Sequence
  Synthetic Polynucleotide
taatacgactcactatagggggcattctgaagtcctgccaatgctgggaaaacagaggagattcccaatgttggcaggaaacctggcggcagcgcaaaagatg

SEQ ID NO: 104148 - DNA, 103 bp, Artificial Sequence
  Synthetic Polynucleotide
taatacgactcactatagggtggagcccacggcattctgaagtcctgccaaacagaggagatggcagatgttcagaatgaacctggcggcagcgcaaaagatg

SEQ ID NO: 104149 - DNA, 103 bp, Artificial Sequence
  Synthetic Polynucleotide
taatacgactcactatagggttttcttcgctggagcccacggcattctgaaacagaggagatcagaaatgcgtgggctcaacctggcggcagcgcaaaagatg

SEQ ID NO: 104150 - DNA, 103 bp, Artificial Sequence
  Synthetic Polynucleotide
taatacgactcactatagggggggactgtctggctccgagaactaaagttaacagaggagaaactttatgtctcggagcaacctggcggcagcgcaaaagatg

SEQ ID NO: 104151 - DNA, 103 bp, Artificial Sequence
  Synthetic Polynucleotide
taatacgactcactataggggtcagcagccttttcttcgctggagcccacaacagaggagagtgggcatgagcgaagaaaacctggcggcagcgcaaaagatg

SEQ ID NO: 104152 - DNA, 103 bp, Artificial Sequence
  Synthetic Polynucleotide
taatacgactcactatagggcctcagccttgtcagcagccttttcttcgcaacagaggagagcgaagatgaggctgctgaacctggcggcagcgcaaaagatg

SEQ ID NO: 104153 - DNA, 103 bp, Artificial Sequence
  Synthetic Polynucleotide
taatacgactcactatagggaagggtcctccctcagccttgtcagcagccaacagaggagaggctgcatgcaaggctgaaacctggcggcagcgcaaaagatg

SEQ ID NO: 104154 - DNA, 103 bp, Artificial Sequence
  Synthetic Polynucleotide
taatacgactcactatagggtccatctttaaagggtcctccctcagccttaacagaggagaaaggctatgggaggacccaacctggcggcagcgcaaaagatg

SEQ ID NO: 104155 - DNA, 103 bp, Artificial Sequence
  Synthetic Polynucleotide
taatacgactcactatagggcaagggtctctccatctttaaagggtcctcaacagaggagagaggacatgttaaagatgaacctggcggcagcgcaaaagatg

SEQ ID NO: 104156 - DNA, 103 bp, Artificial Sequence
  Synthetic Polynucleotide
taatacgactcactatagggtcgctgccttcaagggtctctccatctttaaacagaggagataaagaatgagagaccctaacctggcggcagcgcaaaagatg

SEQ ID NO: 104157 - DNA, 103 bp, Artificial Sequence
  Synthetic Polynucleotide
taatacgactcactatagggctcctcggcatcgctgccttcaagggtctcaacagaggagagagaccatggaaggcagcaacctggcggcagcgcaaaagatg

SEQ ID NO: 104158 - DNA, 103 bp, Artificial Sequence
  Synthetic Polynucleotide
taatacgactcactatagggtatccaggctctcctcggcatcgctgccttaacagaggagaaaggcaatgatgccgaggaacctggcggcagcgcaaaagatg

SEQ ID NO: 104159 - DNA, 103 bp, Artificial Sequence
  Synthetic Polynucleotide
taatacgactcactatagggtctgcagtcttatccaggctctcctcggcaaacagaggagatgccgaatggagcctggaaacctggcggcagcgcaaaagatg

SEQ ID NO: 104160 - DNA, 103 bp, Artificial Sequence
  Synthetic Polynucleotide
taatacgactcactataggggagggaggactctgcagtcttatccaggctaacagaggagaagcctgatgaagactgcaaacctggcggcagcgcaaaagatg

SEQ ID NO: 104161 - DNA, 103 bp, Artificial Sequence
  Synthetic Polynucleotide
taatacgactcactatagggtagtaggagaggggactgtctggctccgagaacagaggagactcggaatgagacagtccaacctggcggcagcgcaaaagatg

SEQ ID NO: 104162 - DNA, 103 bp, Artificial Sequence
  Synthetic Polynucleotide
taatacgactcactatagggcgtcttctaagagggaggactctgcagtctaacagaggagaagactgatgagtcctcccaacctggcggcagcgcaaaagatg

SEQ ID NO: 104163 - DNA, 103 bp, Artificial Sequence
  Synthetic Polynucleotide
taatacgactcactatagggtgtgctatttcgtcttctaagagggaggacaacagaggagagtcctcatgcttagaagaaacctggcggcagcgcaaaagatg

SEQ ID NO: 104164 - DNA, 103 bp, Artificial Sequence
  Synthetic Polynucleotide
taatacgactcactatagggctcttcaccctgtgctatttcgtcttctaaaacagaggagattagaaatggaaatagcaaacctggcggcagcgcaaaagatg

SEQ ID NO: 104165 - DNA, 103 bp, Artificial Sequence
  Synthetic Polynucleotide
taatacgactcactataggggtgagtctagctcttcaccctgtgctatttaacagaggagaaaatagatgagggtgaagaacctggcggcagcgcaaaagatg

SEQ ID NO: 104166 - DNA, 103 bp, Artificial Sequence
  Synthetic Polynucleotide
taatacgactcactatagggcccccatcaagtgagtctagctcttcacccaacagaggagagggtgaatggctagactcaacctggcggcagcgcaaaagatg

SEQ ID NO: 104167 - DNA, 103 bp, Artificial Sequence
  Synthetic Polynucleotide
taatacgactcactatagggtatttcatcccccccatcaagtgagtctagaacagaggagactagacatgcttgatgggaacctggcggcagcgcaaaagatg

SEQ ID NO: 104168 - DNA, 103 bp, Artificial Sequence
  Synthetic Polynucleotide
taatacgactcactatagggcattgttttctatttcatcccccccatcaaaacagaggagattgatgatggggatgaaaaacctggcggcagcgcaaaagatg

SEQ ID NO: 104169 - DNA, 103 bp, Artificial Sequence
  Synthetic Polynucleotide
taatacgactcactatagggtcatcattttcattgttttctatttcatccaacagaggagaggatgaatgagaaaacaaaacctggcggcagcgcaaaagatg

SEQ ID NO: 104170 - DNA, 103 bp, Artificial Sequence
  Synthetic Polynucleotide
taatacgactcactatagggataggatttactggattttccgggtaaccaaacagaggagatggttaatgggaaaatccaacctggcggcagcgcaaaagatg

SEQ ID NO: 104171 - DNA, 103 bp, Artificial Sequence
  Synthetic Polynucleotide
taatacgactcactataggggagttgtttatagtaggagaggggactgtcaacagaggagagacagtatgctctcctacaacctggcggcagcgcaaaagatg

SEQ ID NO: 104172 - DNA, 103 bp, Artificial Sequence
  Synthetic Polynucleotide
taatacgactcactatagggatactgccctgagttgtttatagtaggagaaacagaggagatctcctatgataaacaacaacctggcggcagcgcaaaagatg

SEQ ID NO: 104173 - DNA, 103 bp, Artificial Sequence
  Synthetic Polynucleotide
taatacgactcactataggggatatcgagaatactgccctgagttgtttaaacagaggagataaacaatgcagggcagtaacctggcggcagcgcaaaagatg

SEQ ID NO: 104174 - DNA, 103 bp, Artificial Sequence
  Synthetic Polynucleotide
taatacgactcactatagggttactgtaaggatatcgagaatactgccctaacagaggagaagggcaatgttctcgataaacctggcggcagcgcaaaagatg

SEQ ID NO: 104175 - DNA, 103 bp, Artificial Sequence
  Synthetic Polynucleotide
taatacgactcactatagggctgatttaggttactgtaaggatatcgagaaacagaggagatctcgaatgccttacagtaacctggcggcagcgcaaaagatg

SEQ ID NO: 104176 - DNA, 103 bp, Artificial Sequence
  Synthetic Polynucleotide
taatacgactcactatagggtaactaatccctgatttaggttactgtaagaacagaggagacttacaatgacctaaatcaacctggcggcagcgcaaaagatg

SEQ ID NO: 104177 - DNA, 103 bp, Artificial Sequence
  Synthetic Polynucleotide
taatacgactcactatagggcctgtattgttaactaatccctgatttaggaacagaggagacctaaaatggggattagtaacctggcggcagcgcaaaagatg

SEQ ID NO: 104178 - DNA, 103 bp, Artificial Sequence
  Synthetic Polynucleotide
taatacgactcactatagggttgattcatccctgtattgttaactaatccaacagaggagaggattaatgaacaatacaaacctggcggcagcgcaaaagatg

SEQ ID NO: 104179 - DNA, 103 bp, Artificial Sequence
  Synthetic Polynucleotide
taatacgactcactatagggggcctaaattttgattcatccctgtattgtaacagaggagaacaataatgggatgaatcaacctggcggcagcgcaaaagatg

SEQ ID NO: 104180 - DNA, 103 bp, Artificial Sequence
  Synthetic Polynucleotide
taatacgactcactatagggttatttgtaaggcctaaattttgattcatcaacagaggagagatgaaatgaaatttaggaacctggcggcagcgcaaaagatg

SEQ ID NO: 104181 - DNA, 103 bp, Artificial Sequence
  Synthetic Polynucleotide
taatacgactcactatagggataggaagaaacgctagatggagaatccataacagaggagaatggatatgccatctagcaacctggcggcagcgcaaaagatg

SEQ ID NO: 104182 - DNA, 103 bp, Artificial Sequence
  Synthetic Polynucleotide
taatacgactcactatagggccccttgtcctccctctcactatcagagggaacagaggagaccctctatgagtgagaggaacctggcggcagcgcaaaagatg

SEQ ID NO: 104183 - DNA, 103 bp, Artificial Sequence
  Synthetic Polynucleotide
taatacgactcactatagggtactggcaaactgtagcaacgaggaccctcaacagaggagagagggtatgcgttgctacaacctggcggcagcgcaaaagatg

SEQ ID NO: 104184 - DNA, 103 bp, Artificial Sequence
  Synthetic Polynucleotide
taatacgactcactatagggatggcagagttactggcaaactgtagcaacaacagaggagagttgctatggtttgccagaacctggcggcagcgcaaaagatg

SEQ ID NO: 104185 - DNA, 103 bp, Artificial Sequence
  Synthetic Polynucleotide
taatacgactcactatagggctccagtctgatggcagagttactggcaaaaacagaggagatttgccatgaactctgccaacctggcggcagcgcaaaagatg

SEQ ID NO: 104186 - DNA, 103 bp, Artificial Sequence
  Synthetic Polynucleotide
taatacgactcactatagggtagggtatagctccagtctgatggcagagtaacagaggagaactctgatgtcagactggaacctggcggcagcgcaaaagatg

SEQ ID NO: 104187 - DNA, 103 bp, Artificial Sequence
  Synthetic Polynucleotide
taatacgactcactatagggtgggaggggatagggtatagctccagtctgaacagaggagacagactatggctatacccaacctggcggcagcgcaaaagatg

SEQ ID NO: 104188 - DNA, 103 bp, Artificial Sequence
  Synthetic Polynucleotide
taatacgactcactataggggtgggtagactgggaggggatagggtatagaacagaggagactatacatgatcccctccaacctggcggcagcgcaaaagatg

SEQ ID NO: 104189 - DNA, 103 bp, Artificial Sequence
  Synthetic Polynucleotide
taatacgactcactatagggtctggccaaggtgggtagactgggaggggaaacagaggagatcccctatgagtctacccaacctggcggcagcgcaaaagatg

SEQ ID NO: 104190 - DNA, 103 bp, Artificial Sequence
  Synthetic Polynucleotide
taatacgactcactatagggtggtcatctttctggccaaggtgggtagacaacagaggagagtctacatgccttggccaaacctggcggcagcgcaaaagatg

SEQ ID NO: 104191 - DNA, 103 bp, Artificial Sequence
  Synthetic Polynucleotide
taatacgactcactatagggcggtgtcctatggtcatctttctggccaagaacagaggagacttggcatgaaagatgacaacctggcggcagcgcaaaagatg

SEQ ID NO: 104192 - DNA, 103 bp, Artificial Sequence
  Synthetic Polynucleotide
taatacgactcactatagggctgctgctcccggtgtcctatggtcatcttaacagaggagaaagatgatgataggacacaacctggcggcagcgcaaaagatg

SEQ ID NO: 104193 - DNA, 103 bp, Artificial Sequence
  Synthetic Polynucleotide
taatacgactcactataggggcccatgggcccccttgtcctccctctcacaacagaggagagtgagaatgaggacaaggaacctggcggcagcgcaaaagatg

SEQ ID NO: 104194 - DNA, 103 bp, Artificial Sequence
  Synthetic Polynucleotide
taatacgactcactataggggatggcttctctgctgctcccggtgtcctaaacagaggagataggacatggggagcagcaacctggcggcagcgcaaaagatg

SEQ ID NO: 104195 - DNA, 103 bp, Artificial Sequence
  Synthetic Polynucleotide
taatacgactcactataggggcaactggaggatggcttctctgctgctccaacagaggagaggagcaatggagaagccaaacctggcggcagcgcaaaagatg

SEQ ID NO: 104196 - DNA, 103 bp, Artificial Sequence
  Synthetic Polynucleotide
taatacgactcactatagggagcatcagcagcaactggaggatggcttctaacagaggagaagaagcatgcctccagttaacctggcggcagcgcaaaagatg

SEQ ID NO: 104197 - DNA, 103 bp, Artificial Sequence
  Synthetic Polynucleotide
taatacgactcactatagggtgagaagatgagcatcagcagcaactggagaacagaggagactccagatgctgctgatgaacctggcggcagcgcaaaagatg

SEQ ID NO: 104198 - DNA, 103 bp, Artificial Sequence
  Synthetic Polynucleotide
taatacgactcactatagggtctggcctgggcccatgggcccccttgtccaacagaggagaggacaaatgggcccatggaacctggcggcagcgcaaaagatg

SEQ ID NO: 104199 - DNA, 103 bp, Artificial Sequence
  Synthetic Polynucleotide
taatacgactcactatagggcccaacagtgtctggcctgggcccatgggcaacagaggagagcccatatgcccaggccaaacctggcggcagcgcaaaagatg

SEQ ID NO: 104200 - DNA, 103 bp, Artificial Sequence
  Synthetic Polynucleotide
taatacgactcactatagggctcccctctgcccaacagtgtctggcctggaacagaggagaccaggcatgacactgttgaacctggcggcagcgcaaaagatg

SEQ ID NO: 104201 - DNA, 103 bp, Artificial Sequence
  Synthetic Polynucleotide
taatacgactcactatagggggccgtgaacctcccctctgcccaacagtgaacagaggagacactgtatggcagaggggaacctggcggcagcgcaaaagatg

SEQ ID NO: 104202 - DNA, 103 bp, Artificial Sequence
  Synthetic Polynucleotide
taatacgactcactatagggacccgggctgggccgtgaacctcccctctgaacagaggagacagaggatgggttcacggaacctggcggcagcgcaaaagatg

SEQ ID NO: 104203 - DNA, 103 bp, Artificial Sequence
  Synthetic Polynucleotide
taatacgactcactatagggagcggataggacccgggctgggccgtgaacaacagaggagagttcacatgccagcccggaacctggcggcagcgcaaaagatg

SEQ ID NO: 104204 - DNA, 103 bp, Artificial Sequence
  Synthetic Polynucleotide
taatacgactcactatagggcgatgcctgcagcggataggacccgggctgaacagaggagacagcccatgtcctatccgaacctggcggcagcgcaaaagatg

SEQ ID NO: 104205 - DNA, 103 bp, Artificial Sequence
  Synthetic Polynucleotide
taatacgactcactatagggaaccttcgatcgatgcctgcagcggataggaacagaggagacctatcatgtgcaggcataacctggcggcagcgcaaaagatg

SEQ ID NO: 104206 - DNA, 103 bp, Artificial Sequence
  Synthetic Polynucleotide
taatacgactcactatagggagtaggaggaataggaagaaacgctagatgaacagaggagacatctaatgtttcttcctaacctggcggcagcgcaaaagatg

SEQ ID NO: 104207 - DNA, 103 bp, Artificial Sequence
  Synthetic Polynucleotide
taatacgactcactatagggggttaccggaaaccttcgatcgatgcctgcaacagaggagagcaggcatggatcgaaggaacctggcggcagcgcaaaagatg

SEQ ID NO: 104208 - DNA, 103 bp, Artificial Sequence
  Synthetic Polynucleotide
taatacgactcactatagggggtgtatgctggttaccggaaaccttcgataacagaggagaatcgaaatgttccggtaaaacctggcggcagcgcaaaagatg

SEQ ID NO: 104209 - DNA, 103 bp, Artificial Sequence
  Synthetic Polynucleotide
taatacgactcactatagggcggatgagatggtgtatgctggttaccggaaacagaggagatccggtatgcagcatacaaacctggcggcagcgcaaaagatg

SEQ ID NO: 104210 - DNA, 103 bp, Artificial Sequence
  Synthetic Polynucleotide
taatacgactcactatagggcccgctgtttcggatgagatggtgtatgctaacagaggagaagcataatgcatctcatcaacctggcggcagcgcaaaagatg

SEQ ID NO: 104211 - DNA, 103 bp, Artificial Sequence
  Synthetic Polynucleotide
taatacgactcactataggggaagccgaaccccgctgtttcggatgagataacagaggagaatctcaatggaaacagcgaacctggcggcagcgcaaaagatg

SEQ ID NO: 104212 - DNA, 103 bp, Artificial Sequence
  Synthetic Polynucleotide
taatacgactcactatagggtgccataggagaagccgaaccccgctgtttaacagaggagaaaacagatgggttcggctaacctggcggcagcgcaaaagatg

SEQ ID NO: 104213 - DNA, 103 bp, Artificial Sequence
  Synthetic Polynucleotide
taatacgactcactatagggccccagatcctgccataggagaagccgaacaacagaggagagttcggatgctcctatggaacctggcggcagcgcaaaagatg

SEQ ID NO: 104214 - DNA, 103 bp, Artificial Sequence
  Synthetic Polynucleotide
taatacgactcactataggggatcttttcgccccagatcctgccataggaaacagaggagatcctatatgaggatctggaacctggcggcagcgcaaaagatg

SEQ ID NO: 104215 - DNA, 103 bp, Artificial Sequence
  Synthetic Polynucleotide
taatacgactcactatagggaccatctcttgatcttttcgccccagatccaacagaggagaggatctatggcgaaaagaaacctggcggcagcgcaaaagatg

SEQ ID NO: 104216 - DNA, 103 bp, Artificial Sequence
  Synthetic Polynucleotide
taatacgactcactatagggtctccagttcaccatctcttgatcttttcgaacagaggagacgaaaaatgcaagagatgaacctggcggcagcgcaaaagatg

SEQ ID NO: 104217 - DNA, 103 bp, Artificial Sequence
  Synthetic Polynucleotide
taatacgactcactataggggaagagagagagtaggaggaataggaagaaaacagaggagattcttcatgttcctcctaaacctggcggcagcgcaaaagatg

SEQ ID NO: 104218 - DNA, 103 bp, Artificial Sequence
  Synthetic Polynucleotide
taatacgactcactatagggtttagactggtctccagttcaccatctcttaacagaggagaaagagaatgtgaactggaaacctggcggcagcgcaaaagatg

SEQ ID NO: 104219 - DNA, 103 bp, Artificial Sequence
  Synthetic Polynucleotide
taatacgactcactatagggaccttgggtgtttagactggtctccagttcaacagaggagagaactgatgaccagtctaaacctggcggcagcgcaaaagatg

SEQ ID NO: 104220 - DNA, 103 bp, Artificial Sequence
  Synthetic Polynucleotide
taatacgactcactatagggctgtggtacaaccttgggtgtttagactggaacagaggagaccagtcatgacacccaagaacctggcggcagcgcaaaagatg

SEQ ID NO: 104221 - DNA, 103 bp, Artificial Sequence
  Synthetic Polynucleotide
taatacgactcactatagggaggtctccctctgtggtacaaccttgggtgaacagaggagacacccaatgttgtaccacaacctggcggcagcgcaaaagatg

SEQ ID NO: 104222 - DNA, 103 bp, Artificial Sequence
  Synthetic Polynucleotide
taatacgactcactatagggggcaaacagcaggtctccctctgtggtacaaacagaggagatgtaccatggagggagacaacctggcggcagcgcaaaagatg

SEQ ID NO: 104223 - DNA, 103 bp, Artificial Sequence
  Synthetic Polynucleotide
taatacgactcactatagggtacacttctgggcaaacagcaggtctccctaacagaggagaagggagatgtgctgtttgaacctggcggcagcgcaaaagatg

SEQ ID NO: 104224 - DNA, 103 bp, Artificial Sequence
  Synthetic Polynucleotide
taatacgactcactatagggtggagttctttacacttctgggcaaacagcaacagaggagagctgttatgccagaagtgaacctggcggcagcgcaaaagatg

SEQ ID NO: 104225 - DNA, 103 bp, Artificial Sequence
  Synthetic Polynucleotide
taatacgactcactatagggtataaatccttggagttctttacacttctgaacagaggagacagaagatgaaagaactcaacctggcggcagcgcaaaagatg

SEQ ID NO: 104226 - DNA, 103 bp, Artificial Sequence
  Synthetic Polynucleotide
taatacgactcactatagggtgagaggaggtataaatccttggagttcttaacagaggagaaagaacatgaaggatttaaacctggcggcagcgcaaaagatg

SEQ ID NO: 104227 - DNA, 103 bp, Artificial Sequence
  Synthetic Polynucleotide
taatacgactcactatagggagtaggtctgtgagaggaggtataaatcctaacagaggagaaggattatgacctcctctaacctggcggcagcgcaaaagatg

SEQ ID NO: 104228 - DNA, 103 bp, Artificial Sequence
  Synthetic Polynucleotide
taatacgactcactataggggggaaaagacgaagagagagagtaggaggaaacagaggagatcctccatgtctctctctaacctggcggcagcgcaaaagatg

SEQ ID NO: 104229 - DNA, 103 bp, Artificial Sequence
  Synthetic Polynucleotide
taatacgactcactatagggcagcccattgagtaggtctgtgagaggaggaacagaggagacctcctatgacagacctaaacctggcggcagcgcaaaagatg

SEQ ID NO: 104230 - DNA, 103 bp, Artificial Sequence
  Synthetic Polynucleotide
taatacgactcactataggggacccatcttcagcccattgagtaggtctgaacagaggagacagaccatgtcaatgggcaacctggcggcagcgcaaaagatg

SEQ ID NO: 104231 - DNA, 103 bp, Artificial Sequence
  Synthetic Polynucleotide
taatacgactcactatagggctctcaaaacgacccatcttcagcccattgaacagaggagacaatggatggaagatgggaacctggcggcagcgcaaaagatg

SEQ ID NO: 104232 - DNA, 103 bp, Artificial Sequence
  Synthetic Polynucleotide
taatacgactcactataggggcttaatcctctctcaaaacgacccatcttaacagaggagaaagatgatgcgttttgagaacctggcggcagcgcaaaagatg

SEQ ID NO: 104233 - DNA, 103 bp, Artificial Sequence
  Synthetic Polynucleotide
taatacgactcactataggggctgaaaactgcttaatcctctctcaaaacaacagaggagagttttgatggaggattaaaacctggcggcagcgcaaaagatg

SEQ ID NO: 104234 - DNA, 103 bp, Artificial Sequence
  Synthetic Polynucleotide
taatacgactcactataggggccacactctgctgaaaactgcttaatcctaacagaggagaaggattatgcagttttcaaacctggcggcagcgcaaaagatg

SEQ ID NO: 104235 - DNA, 103 bp, Artificial Sequence
  Synthetic Polynucleotide
taatacgactcactatagggcctgtccattgccacactctgctgaaaactaacagaggagaagttttatgcagagtgtgaacctggcggcagcgcaaaagatg

SEQ ID NO: 104236 - DNA, 103 bp, Artificial Sequence
  Synthetic Polynucleotide
taatacgactcactatagggtacgctggatcctgtccattgccacactctaacagaggagaagagtgatgcaatggacaaacctggcggcagcgcaaaagatg

SEQ ID NO: 104237 - DNA, 103 bp, Artificial Sequence
  Synthetic Polynucleotide
taatacgactcactatagggacacctacaatacgctggatcctgtccattaacagaggagaaatggaatggatccagcgaacctggcggcagcgcaaaagatg

SEQ ID NO: 104238 - DNA, 103 bp, Artificial Sequence
  Synthetic Polynucleotide
taatacgactcactatagggcttctgcaaaacacctacaatacgctggataacagaggagaatccagatgattgtaggtaacctggcggcagcgcaaaagatg

SEQ ID NO: 104239 - DNA, 103 bp, Artificial Sequence
  Synthetic Polynucleotide
taatacgactcactatagggctggggaggtgggaaaagacgaagagagagaacagaggagactctctatgcgtcttttcaacctggcggcagcgcaaaagatg

SEQ ID NO: 104240 - DNA, 103 bp, Artificial Sequence
  Synthetic Polynucleotide
taatacgactcactatagggccatctgtggcttctgcaaaacacctacaaaacagaggagattgtagatgttttgcagaaacctggcggcagcgcaaaagatg

SEQ ID NO: 104241 - DNA, 103 bp, Artificial Sequence
  Synthetic Polynucleotide
taatacgactcactatagggtaacgttcccccatctgtggcttctgcaaaaacagaggagatttgcaatggccacagataacctggcggcagcgcaaaagatg

SEQ ID NO: 104242 - DNA, 103 bp, Artificial Sequence
  Synthetic Polynucleotide
taatacgactcactatagggggttcctaggtaacgttcccccatctgtggaacagaggagaccacagatgggggaacgtaacctggcggcagcgcaaaagatg

SEQ ID NO: 104243 - DNA, 103 bp, Artificial Sequence
  Synthetic Polynucleotide
taatacgactcactatagggcctgtagcaaggttcctaggtaacgttcccaacagaggagagggaacatgacctaggaaaacctggcggcagcgcaaaagatg

SEQ ID NO: 104244 - DNA, 103 bp, Artificial Sequence
  Synthetic Polynucleotide
taatacgactcactatagggatcccttctacctgtagcaaggttcctaggaacagaggagacctaggatgcttgctacaaacctggcggcagcgcaaaagatg

SEQ ID NO: 104245 - DNA, 103 bp, Artificial Sequence
  Synthetic Polynucleotide
taatacgactcactatagggagtctttaacatcccttctacctgtagcaaaacagaggagattgctaatggtagaagggaacctggcggcagcgcaaaagatg

SEQ ID NO: 104246 - DNA, 103 bp, Artificial Sequence
  Synthetic Polynucleotide
taatacgactcactataggggtggaaaccaagtctttaacatcccttctaaacagaggagatagaagatgtgttaaagaaacctggcggcagcgcaaaagatg

SEQ ID NO: 104247 - DNA, 103 bp, Artificial Sequence
  Synthetic Polynucleotide
taatacgactcactataggggcagctatttgtggaaaccaagtctttaacaacagaggagagttaaaatgttggtttccaacctggcggcagcgcaaaagatg

SEQ ID NO: 104248 - DNA, 103 bp, Artificial Sequence
  Synthetic Polynucleotide
taatacgactcactatagggtgacttctgggcagctatttgtggaaaccaaacagaggagatggtttatgcaaatagctaacctggcggcagcgcaaaagatg

SEQ ID NO: 104249 - DNA, 103 bp, Artificial Sequence
  Synthetic Polynucleotide
taatacgactcactatagggcacccaatgatgacttctgggcagctatttaacagaggagaaaatagatgcccagaagtaacctggcggcagcgcaaaagatg

SEQ ID NO: 104250 - DNA, 103 bp, Artificial Sequence
  Synthetic Polynucleotide
taatacgactcactatagggtcactgttcactggggaggtgggaaaagacaacagaggagagtctttatgcacctccccaacctggcggcagcgcaaaagatg

SEQ ID NO: 104251 - DNA, 103 bp, Artificial Sequence
  Synthetic Polynucleotide
taatacgactcactatagggtgcttgccaccacccaatgatgacttctggaacagaggagaccagaaatgatcattgggaacctggcggcagcgcaaaagatg

SEQ ID NO: 104252 - DNA, 103 bp, Artificial Sequence
  Synthetic Polynucleotide
taatacgactcactatagggggtcagctgatgcttgccaccacccaatgaaacagaggagatcattgatgggtggcaagaacctggcggcagcgcaaaagatg

SEQ ID NO: 104253 - DNA, 103 bp, Artificial Sequence
  Synthetic Polynucleotide
taatacgactcactataggggaaaatgcttggtcagctgatgcttgccacaacagaggagagtggcaatgatcagctgaaacctggcggcagcgcaaaagatg

SEQ ID NO: 104254 - DNA, 103 bp, Artificial Sequence
  Synthetic Polynucleotide
taatacgactcactatagggtggtggcttggaaaatgcttggtcagctgaaacagaggagatcagctatgcaagcatttaacctggcggcagcgcaaaagatg

SEQ ID NO: 104255 - DNA, 103 bp, Artificial Sequence
  Synthetic Polynucleotide
taatacgactcactatagggtgaatcactgtggtggcttggaaaatgcttaacagaggagaaagcatatgccaagccacaacctggcggcagcgcaaaagatg

SEQ ID NO: 104256 - DNA, 103 bp, Artificial Sequence
  Synthetic Polynucleotide
taatacgactcactatagggaggaagcagctgaatcactgtggtggcttgaacagaggagacaagccatgacagtgattaacctggcggcagcgcaaaagatg

SEQ ID NO: 104257 - DNA, 103 bp, Artificial Sequence
  Synthetic Polynucleotide
taatacgactcactataggggatgcaggagaggaagcagctgaatcactgaacagaggagacagtgaatgagctgcttcaacctggcggcagcgcaaaagatg

SEQ ID NO: 104258 - DNA, 103 bp, Artificial Sequence
  Synthetic Polynucleotide
taatacgactcactatagggttccataggagatgcaggagaggaagcagcaacagaggagagctgctatgtctcctgcaaacctggcggcagcgcaaaagatg

SEQ ID NO: 104259 - DNA, 103 bp, Artificial Sequence
  Synthetic Polynucleotide
taatacgactcactatagggggtccatcttttccataggagatgcaggagaacagaggagactcctgatgctcctatggaacctggcggcagcgcaaaagatg

SEQ ID NO: 104260 - DNA, 103 bp, Artificial Sequence
  Synthetic Polynucleotide
taatacgactcactatagggagctgtgtctggtccatcttttccataggaaacagaggagatcctatatgaaagatggaaacctggcggcagcgcaaaagatg

SEQ ID NO: 104261 - DNA, 103 bp, Artificial Sequence
  Synthetic Polynucleotide
taatacgactcactataggggaagccaaagtcactgttcactggggaggtaacagaggagaacctccatggtgaacagtaacctggcggcagcgcaaaagatg

SEQ ID NO: 104262 - DNA, 103 bp, Artificial Sequence
  Synthetic Polynucleotide
taatacgactcactatagggtagatgtcctagctgtgtctggtccatcttaacagaggagaaagatgatgcagacacagaacctggcggcagcgcaaaagatg

SEQ ID NO: 104263 - DNA, 103 bp, Artificial Sequence
  Synthetic Polynucleotide
taatacgactcactataggggttttaaagctagatgtcctagctgtgtctaacagaggagaagacacatgtaggacatcaacctggcggcagcgcaaaagatg

SEQ ID NO: 104264 - DNA, 103 bp, Artificial Sequence
  Synthetic Polynucleotide
taatacgactcactatagggggctgctttggttttaaagctagatgtcctaacagaggagaaggacaatgagctttaaaaacctggcggcagcgcaaaagatg

SEQ ID NO: 104265 - DNA, 103 bp, Artificial Sequence
  Synthetic Polynucleotide
taatacgactcactataggggaggtgccaaggctgctttggttttaaagcaacagaggagagctttaatgccaaagcagaacctggcggcagcgcaaaagatg

SEQ ID NO: 104266 - DNA, 103 bp, Artificial Sequence
  Synthetic Polynucleotide
taatacgactcactataggggccattgtgtgaggtgccaaggctgctttgaacagaggagacaaagcatgcttggcaccaacctggcggcagcgcaaaagatg

SEQ ID NO: 104267 - DNA, 103 bp, Artificial Sequence
  Synthetic Polynucleotide
taatacgactcactatagggttcatagctggccattgtgtgaggtgccaaaacagaggagattggcaatgcacacaatgaacctggcggcagcgcaaaagatg

SEQ ID NO: 104268 - DNA, 103 bp, Artificial Sequence
  Synthetic Polynucleotide
taatacgactcactatagggccaggtgaggttcatagctggccattgtgtaacagaggagaacacaaatgccagctatgaacctggcggcagcgcaaaagatg

SEQ ID NO: 104269 - DNA, 103 bp, Artificial Sequence
  Synthetic Polynucleotide
taatacgactcactatagggtggtgtggatccaggtgaggttcatagctgaacagaggagacagctaatgacctcacctaacctggcggcagcgcaaaagatg

SEQ ID NO: 104270 - DNA, 103 bp, Artificial Sequence
  Synthetic Polynucleotide
taatacgactcactatagggcaaattggagtggtgtggatccaggtgaggaacagaggagacctcacatggatccacacaacctggcggcagcgcaaaagatg

SEQ ID NO: 104271 - DNA, 103 bp, Artificial Sequence
  Synthetic Polynucleotide
taatacgactcactatagggaggggggttgcaaattggagtggtgtggataacagaggagaatccacatgactccaattaacctggcggcagcgcaaaagatg

SEQ ID NO: 104272 - DNA, 103 bp, Artificial Sequence
  Synthetic Polynucleotide
taatacgactcactatagggtatcagaggggaagccaaagtcactgttcaaacagaggagatgaacaatgactttggctaacctggcggcagcgcaaaagatg

SEQ ID NO: 104273 - DNA, 103 bp, Artificial Sequence
  Synthetic Polynucleotide
taatacgactcactataggggggagctgagaggggggttgcaaattggagaacagaggagactccaaatggcaacccccaacctggcggcagcgcaaaagatg

SEQ ID NO: 104274 - DNA, 103 bp, Artificial Sequence
  Synthetic Polynucleotide
taatacgactcactatagggatagtacctggggagctgagaggggggttgaacagaggagacaacccatgtctcagctcaacctggcggcagcgcaaaagatg

SEQ ID NO: 104275 - DNA, 103 bp, Artificial Sequence
  Synthetic Polynucleotide
taatacgactcactataggggctaaaggagatagtacctggggagctgagaacagaggagactcagcatgccaggtactaacctggcggcagcgcaaaagatg

SEQ ID NO: 104276 - DNA, 103 bp, Artificial Sequence
  Synthetic Polynucleotide
taatacgactcactatagggaaggaccatggctaaaggagatagtacctgaacagaggagacaggtaatgtctcctttaaacctggcggcagcgcaaaagatg

SEQ ID NO: 104277 - DNA, 103 bp, Artificial Sequence
  Synthetic Polynucleotide
taatacgactcactatagggccagtgcctaaaggaccatggctaaaggagaacagaggagactccttatgccatggtccaacctggcggcagcgcaaaagatg

SEQ ID NO: 104278 - DNA, 103 bp, Artificial Sequence
  Synthetic Polynucleotide
taatacgactcactatagggaatgccggttccagtgcctaaaggaccatgaacagaggagacatggtatgttaggcactaacctggcggcagcgcaaaagatg

SEQ ID NO: 104279 - DNA, 103 bp, Artificial Sequence
  Synthetic Polynucleotide
taatacgactcactataggggaatgacgccaatgccggttccagtgcctaaacagaggagataggcaatggaaccggcaaacctggcggcagcgcaaaagatg

SEQ ID NO: 104280 - DNA, 103 bp, Artificial Sequence
  Synthetic Polynucleotide
taatacgactcactatagggtggaggaaaagaatgacgccaatgccggttaacagaggagaaaccggatgtggcgtcataacctggcggcagcgcaaaagatg

SEQ ID NO: 104281 - DNA, 103 bp, Artificial Sequence
  Synthetic Polynucleotide
taatacgactcactatagggcactccatgctggaggaaaagaatgacgccaacagaggagaggcgtcatgcttttcctcaacctggcggcagcgcaaaagatg

SEQ ID NO: 104282 - DNA, 103 bp, Artificial Sequence
  Synthetic Polynucleotide
taatacgactcactatagggtgaagggttgcactccatgctggaggaaaaaacagaggagattttccatgagcatggagaacctggcggcagcgcaaaagatg

SEQ ID NO: 104283 - DNA, 103 bp, Artificial Sequence
  Synthetic Polynucleotide
taatacgactcactatagggtccctctcactatcagaggggaagccaaagaacagaggagactttggatgcccctctgaaacctggcggcagcgcaaaagatg

SEQ ID NO: 104284 - DNA, 103 bp, Artificial Sequence
  Synthetic Polynucleotide
taatacgactcactataggggcagagtgggtgaagggttgcactccatgcaacagaggagagcatggatggcaacccttaacctggcggcagcgcaaaagatg

SEQ ID NO: 104285 - DNA, 103 bp, Artificial Sequence
  Synthetic Polynucleotide
taatacgactcactatagggggtggttggggcagagtgggtgaagggttgaacagaggagacaacccatgacccactctaacctggcggcagcgcaaaagatg

SEQ ID NO: 104286 - DNA, 103 bp, Artificial Sequence
  Synthetic Polynucleotide
taatacgactcactataggggtgggactggggtggttggggcagagtgggaacagaggagacccactatgccccaaccaaacctggcggcagcgcaaaagatg

SEQ ID NO: 104287 - DNA, 103 bp, Artificial Sequence
  Synthetic Polynucleotide
taatacgactcactataggggctgtagtaggtgggactggggtggttgggaacagaggagacccaacatgcccagtcccaacctggcggcagcgcaaaagatg

SEQ ID NO: 104288 - DNA, 103 bp, Artificial Sequence
  Synthetic Polynucleotide
taatacgactcactataggggacaggagatgctgtagtaggtgggactggaacagaggagaccagtcatgcctactacaaacctggcggcagcgcaaaagatg

SEQ ID NO: 104289 - DNA, 103 bp, Artificial Sequence
  Synthetic Polynucleotide
taatacgactcactatagggcaccagggatgacaggagatgctgtagtagaacagaggagactactaatgcatctcctgaacctggcggcagcgcaaaagatg

SEQ ID NO: 104290 - DNA, 103 bp, Artificial Sequence
  Synthetic Polynucleotide
taatacgactcactatagggttcataggctcaccagggatgacaggagataacagaggagaatctccatgcatccctggaacctggcggcagcgcaaaagatg

SEQ ID NO: 104291 - DNA, 103 bp, Artificial Sequence
  Synthetic Polynucleotide
taatacgactcactatagggtccagatagtttcataggctcaccagggataacagaggagaatccctatggagcctatgaacctggcggcagcgcaaaagatg

SEQ ID NO: 104292 - DNA, 103 bp, Artificial Sequence
  Synthetic Polynucleotide
taatacgactcactataggggaggaccctctccagatagtttcataggctaacagaggagaagcctaatgaactatctgaacctggcggcagcgcaaaagatg

SEQ ID NO: 104293 - DNA, 103 bp, Artificial Sequence
  Synthetic Polynucleotide
taatacgactcactatagggctgtagcaacgaggaccctctccagatagtaacagaggagaactatcatgagagggtccaacctggcggcagcgcaaaagatg

SEQ ID NO: 104294 - DNA, 103 bp, Artificial Sequence
  Synthetic Polynucleotide
taatacgactcactatagggcccagcagggcgtggagccaggcaacgcataacagaggagaatgcgtatgctggctccaaacctggcggcagcgcaaaagatg

SEQ ID NO: 104295 - DNA, 103 bp, Artificial Sequence
  Synthetic Polynucleotide
taatacgactcactataggggctgttaagaagctccaggtagccaccttcaacagaggagagaaggtatgtacctggagaacctggcggcagcgcaaaagatg

SEQ ID NO: 104296 - DNA, 103 bp, Artificial Sequence
  Synthetic Polynucleotide
taatacgactcactatagggggacttggctttgaaaggctcgatggtgaaaacagaggagattcaccatggagcctttcaacctggcggcagcgcaaaagatg

SEQ ID NO: 104297 - DNA, 103 bp, Artificial Sequence
  Synthetic Polynucleotide
taatacgactcactatagggcatccttcagggacttggctttgaaaggctaacagaggagaagccttatgaagccaagtaacctggcggcagcgcaaaagatg

SEQ ID NO: 104298 - DNA, 103 bp, Artificial Sequence
  Synthetic Polynucleotide
taatacgactcactatagggaggtcttccacatccttcagggacttggctaacagaggagaagccaaatgcctgaaggaaacctggcggcagcgcaaaagatg

SEQ ID NO: 104299 - DNA, 103 bp, Artificial Sequence
  Synthetic Polynucleotide
taatacgactcactatagggaagctttcccaggtcttccacatccttcagaacagaggagactgaagatggtggaagacaacctggcggcagcgcaaaagatg

SEQ ID NO: 104300 - DNA, 103 bp, Artificial Sequence
  Synthetic Polynucleotide
taatacgactcactataggggagtctgcacaagctttcccaggtcttccaaacagaggagatggaagatgtgggaaagcaacctggcggcagcgcaaaagatg

SEQ ID NO: 104301 - DNA, 103 bp, Artificial Sequence
  Synthetic Polynucleotide
taatacgactcactatagggctcgtcctctgagtctgcacaagctttcccaacagaggagagggaaaatgtgtgcagacaacctggcggcagcgcaaaagatg

SEQ ID NO: 104302 - DNA, 103 bp, Artificial Sequence
  Synthetic Polynucleotide
taatacgactcactatagggcgaggaacttctcgtcctctgagtctgcacaacagaggagagtgcagatgcagaggacgaacctggcggcagcgcaaaagatg

SEQ ID NO: 104303 - DNA, 103 bp, Artificial Sequence
  Synthetic Polynucleotide
taatacgactcactatagggctgtgtcttccgaggaacttctcgtcctctaacagaggagaagaggaatggaagttcctaacctggcggcagcgcaaaagatg

SEQ ID NO: 104304 - DNA, 103 bp, Artificial Sequence
  Synthetic Polynucleotide
taatacgactcactatagggagctccccagctgtgtcttccgaggaacttaacagaggagaaagttcatgggaagacacaacctggcggcagcgcaaaagatg

SEQ ID NO: 104305 - DNA, 103 bp, Artificial Sequence
  Synthetic Polynucleotide
taatacgactcactatagggaacagcagggagctccccagctgtgtcttcaacagaggagagaagacatggctggggagaacctggcggcagcgcaaaagatg

SEQ ID NO: 104306 - DNA, 103 bp, Artificial Sequence
  Synthetic Polynucleotide
taatacgactcactatagggggtcagcatcgctgttaagaagctccaggtaacagaggagaacctggatgttcttaacaaacctggcggcagcgcaaaagatg

SEQ ID NO: 104307 - DNA, 103 bp, Artificial Sequence
  Synthetic Polynucleotide
taatacgactcactatagggttaggtcccgaacagcagggagctccccagaacagaggagactggggatgtccctgctgaacctggcggcagcgcaaaagatg

SEQ ID NO: 104308 - DNA, 103 bp, Artificial Sequence
  Synthetic Polynucleotide
taatacgactcactatagggtccagtttctttaggtcccgaacagcagggaacagaggagaccctgcatgtcgggacctaacctggcggcagcgcaaaagatg

SEQ ID NO: 104309 - DNA, 103 bp, Artificial Sequence
  Synthetic Polynucleotide
taatacgactcactatagggcagcgcaaactccagtttctttaggtcccgaacagaggagacgggacatgaagaaactgaacctggcggcagcgcaaaagatg

SEQ ID NO: 104310 - DNA, 103 bp, Artificial Sequence
  Synthetic Polynucleotide
taatacgactcactatagggagacagggcccagcgcaaactccagtttctaacagaggagaagaaacatgagtttgcgcaacctggcggcagcgcaaaagatg

SEQ ID NO: 104311 - DNA, 103 bp, Artificial Sequence
  Synthetic Polynucleotide
taatacgactcactatagggtgggggcctgagacagggcccagcgcaaacaacagaggagagtttgcatggggccctgtaacctggcggcagcgcaaaagatg

SEQ ID NO: 104312 - DNA, 103 bp, Artificial Sequence
  Synthetic Polynucleotide
taatacgactcactatagggggggaaagcctgggggcctgagacagggccaacagaggagaggccctatgtcaggccccaacctggcggcagcgcaaaagatg

SEQ ID NO: 104313 - DNA, 103 bp, Artificial Sequence
  Synthetic Polynucleotide
taatacgactcactataggggcaccagtttggggaaagcctgggggcctgaacagaggagacaggccatgaggctttccaacctggcggcagcgcaaaagatg

SEQ ID NO: 104314 - DNA, 103 bp, Artificial Sequence
  Synthetic Polynucleotide
taatacgactcactataggggtgaggatccgcaccagtttggggaaagccaacagaggagaggctttatgcaaactggtaacctggcggcagcgcaaaagatg

SEQ ID NO: 104315 - DNA, 103 bp, Artificial Sequence
  Synthetic Polynucleotide
taatacgactcactatagggggaaaaggccgtgaggatccgcaccagtttaacagaggagaaaactgatgcggatcctcaacctggcggcagcgcaaaagatg

SEQ ID NO: 104316 - DNA, 103 bp, Artificial Sequence
  Synthetic Polynucleotide
taatacgactcactataggggctgcagggaggaaaaggccgtgaggatccaacagaggagaggatccatgcggccttttaacctggcggcagcgcaaaagatg

SEQ ID NO: 104317 - DNA, 103 bp, Artificial Sequence
  Synthetic Polynucleotide
taatacgactcactatagggaggcacagggggtcagcatcgctgttaagaaacagaggagatcttaaatgcgatgctgaaacctggcggcagcgcaaaagatg

SEQ ID NO: 104318 - DNA, 103 bp, Artificial Sequence
  Synthetic Polynucleotide
taatacgactcactatagggaggtccagatgctgcagggaggaaaaggccaacagaggagaggccttatgctccctgcaaacctggcggcagcgcaaaagatg

SEQ ID NO: 104319 - DNA, 103 bp, Artificial Sequence
  Synthetic Polynucleotide
taatacgactcactatagggcagcgcatccaggtccagatgctgcagggaaacagaggagatccctgatgcatctggacaacctggcggcagcgcaaaagatg

SEQ ID NO: 104320 - DNA, 103 bp, Artificial Sequence
  Synthetic Polynucleotide
taatacgactcactatagggtgttctcactcagcgcatccaggtccagataacagaggagaatctggatgtggatgcgcaacctggcggcagcgcaaaagatg

SEQ ID NO: 104321 - DNA, 103 bp, Artificial Sequence
  Synthetic Polynucleotide
taatacgactcactatagggtccccgatcttgttctcactcagcgcatccaacagaggagaggatgcatggagtgagaaaacctggcggcagcgcaaaagatg

SEQ ID NO: 104322 - DNA, 103 bp, Artificial Sequence
  Synthetic Polynucleotide
taatacgactcactataggggacaccctcgtccccgatcttgttctcactaacagaggagaagtgagatgaagatcgggaacctggcggcagcgcaaaagatg

SEQ ID NO: 104323 - DNA, 103 bp, Artificial Sequence
  Synthetic Polynucleotide
taatacgactcactatagggagagctgcgagacaccctcgtccccgatctaacagaggagaagatcgatgacgagggtgaacctggcggcagcgcaaaagatg

SEQ ID NO: 104324 - DNA, 103 bp, Artificial Sequence
  Synthetic Polynucleotide
taatacgactcactatagggaaggtggctgagagctgcgagacaccctcgaacagaggagacgagggatgctcgcagctaacctggcggcagcgcaaaagatg

SEQ ID NO: 104325 - DNA, 103 bp, Artificial Sequence
  Synthetic Polynucleotide
taatacgactcactatagggcagctgggggaaggtggctgagagctgcgaaacagaggagatcgcagatgtcagccaccaacctggcggcagcgcaaaagatg

SEQ ID NO: 104326 - DNA, 103 bp, Artificial Sequence
  Synthetic Polynucleotide
taatacgactcactatagggccaaggacttcagctgggggaaggtggctgaacagaggagacagccaatgtcccccagcaacctggcggcagcgcaaaagatg

SEQ ID NO: 104327 - DNA, 103 bp, Artificial Sequence
  Synthetic Polynucleotide
taatacgactcactatagggttgagggtttccaaggacttcagctgggggaacagaggagacccccaatggaagtccttaacctggcggcagcgcaaaagatg

SEQ ID NO: 104328 - DNA, 103 bp, Artificial Sequence
  Synthetic Polynucleotide
taatacgactcactataggggaagtggtagaggcacagggggtcagcatcaacagaggagagatgctatgcccctgtgcaacctggcggcagcgcaaaagatg

SEQ ID NO: 104329 - DNA, 103 bp, Artificial Sequence
  Synthetic Polynucleotide
taatacgactcactatagggctgggacagattgagggtttccaaggacttaacagaggagaaagtccatggaaaccctcaacctggcggcagcgcaaaagatg

SEQ ID NO: 104330 - DNA, 103 bp, Artificial Sequence
  Synthetic Polynucleotide
taatacgactcactatagggtgatgttgttctgggacagattgagggtttaacagaggagaaaacccatgatctgtcccaacctggcggcagcgcaaaagatg

SEQ ID NO: 104331 - DNA, 103 bp, Artificial Sequence
  Synthetic Polynucleotide
taatacgactcactatagggcccaggtcagtgatgttgttctgggacagaaacagaggagatctgtcatggaacaacataacctggcggcagcgcaaaagatg

SEQ ID NO: 104332 - DNA, 103 bp, Artificial Sequence
  Synthetic Polynucleotide
taatacgactcactatagggtttgtaggcacccaggtcagtgatgttgttaacagaggagaaacaacatgactgacctgaacctggcggcagcgcaaaagatg

SEQ ID NO: 104333 - DNA, 103 bp, Artificial Sequence
  Synthetic Polynucleotide
taatacgactcactatagggcctcggcgagtttgtaggcacccaggtcagaacagaggagactgaccatggtgcctacaaacctggcggcagcgcaaaagatg

SEQ ID NO: 104334 - DNA, 103 bp, Artificial Sequence
  Synthetic Polynucleotide
taatacgactcactataggggaaggcagggcctcggcgagtttgtaggcaaacagaggagatgcctaatgactcgccgaaacctggcggcagcgcaaaagatg

SEQ ID NO: 104335 - DNA, 103 bp, Artificial Sequence
  Synthetic Polynucleotide
taatacgactcactatagggtgcagcgagcgaaggcagggcctcggcgagaacagaggagactcgccatggccctgcctaacctggcggcagcgcaaaagatg

SEQ ID NO: 104336 - DNA, 103 bp, Artificial Sequence
  Synthetic Polynucleotide
taatacgactcactatagggtgagcagggatgcagcgagcgaaggcagggaacagaggagaccctgcatgcgctcgctgaacctggcggcagcgcaaaagatg

SEQ ID NO: 104337 - DNA, 103 bp, Artificial Sequence
  Synthetic Polynucleotide
taatacgactcactatagggaagcttagcctgagcagggatgcagcgagcaacagaggagagctcgcatgatccctgctaacctggcggcagcgcaaaagatg

SEQ ID NO: 104338 - DNA, 103 bp, Artificial Sequence
  Synthetic Polynucleotide
taatacgactcactataggggttattgtacaagcttagcctgagcagggaaacagaggagatccctgatgaggctaagcaacctggcggcagcgcaaaagatg

SEQ ID NO: 104339 - DNA, 103 bp, Artificial Sequence
  Synthetic Polynucleotide
taatacgactcactatagggtctggtcatagaagtggtagaggcacagggaacagaggagaccctgtatgtctaccactaacctggcggcagcgcaaaagatg

SEQ ID NO: 104340 - DNA, 103 bp, Artificial Sequence
  Synthetic Polynucleotide
taatacgactcactatagggcgcagatgcagttattgtacaagcttagccaacagaggagaggctaaatgtgtacaataaacctggcggcagcgcaaaagatg

SEQ ID NO: 104341 - DNA, 103 bp, Artificial Sequence
  Synthetic Polynucleotide
taatacgactcactataggggctcccacgtcgcagatgcagttattgtacaacagaggagagtacaaatgctgcatctgaacctggcggcagcgcaaaagatg

SEQ ID NO: 104342 - DNA, 103 bp, Artificial Sequence
  Synthetic Polynucleotide
taatacgactcactatagggcaagctctcggctcccacgtcgcagatgcaaacagaggagatgcatcatggacgtgggaaacctggcggcagcgcaaaagatg

SEQ ID NO: 104343 - DNA, 103 bp, Artificial Sequence
  Synthetic Polynucleotide
taatacgactcactataggggcacacgagccaagctctcggctcccacgtaacagaggagaacgtggatgccgagagctaacctggcggcagcgcaaaagatg

SEQ ID NO: 104344 - DNA, 103 bp, Artificial Sequence
  Synthetic Polynucleotide
taatacgactcactatagggatgtccggaagcacacgagccaagctctcgaacagaggagacgagagatgggctcgtgtaacctggcggcagcgcaaaagatg

SEQ ID NO: 104345 - DNA, 103 bp, Artificial Sequence
  Synthetic Polynucleotide
taatacgactcactataggggagggacaccatgtccggaagcacacgagcaacagaggagagctcgtatgcttccggacaacctggcggcagcgcaaaagatg

SEQ ID NO: 104346 - DNA, 103 bp, Artificial Sequence
  Synthetic Polynucleotide
taatacgactcactatagggccatcacccggagggacaccatgtccggaaaacagaggagattccggatgtggtgtcccaacctggcggcagcgcaaaagatg

SEQ ID NO: 104347 - DNA, 103 bp, Artificial Sequence
  Synthetic Polynucleotide
taatacgactcactatagggtactggacgtccatcacccggagggacaccaacagaggagaggtgtcatgccgggtgataacctggcggcagcgcaaaagatg

SEQ ID NO: 104348 - DNA, 103 bp, Artificial Sequence
  Synthetic Polynucleotide
taatacgactcactataggggaacttgttgtactggacgtccatcacccgaacagaggagacgggtgatggacgtccagaacctggcggcagcgcaaaagatg

SEQ ID NO: 104349 - DNA, 103 bp, Artificial Sequence
  Synthetic Polynucleotide
taatacgactcactatagggcggcagccgtgaacttgttgtactggacgtaacagaggagaacgtccatgacaacaagtaacctggcggcagcgcaaaagatg

SEQ ID NO: 104350 - DNA, 103 bp, Artificial Sequence
  Synthetic Polynucleotide
taatacgactcactataggggccaggtccatctggtcatagaagtggtagaacagaggagactaccaatgctatgaccaaacctggcggcagcgcaaaagatg

SEQ ID NO: 104351 - DNA, 103 bp, Artificial Sequence
  Synthetic Polynucleotide
taatacgactcactatagggtgctgggccccggcagccgtgaacttgttgaacagaggagacaacaaatgcacggctgcaacctggcggcagcgcaaaagatg

SEQ ID NO: 104352 - DNA, 103 bp, Artificial Sequence
  Synthetic Polynucleotide
taatacgactcactatagggggcagcgagctgctgggccccggcagccgtaacagaggagaacggctatgggggcccagaacctggcggcagcgcaaaagatg

SEQ ID NO: 104353 - DNA, 103 bp, Artificial Sequence
  Synthetic Polynucleotide
taatacgactcactatagggtccgaaggctggcagcgagctgctgggcccaacagaggagagggcccatgagctcgctgaacctggcggcagcgcaaaagatg

SEQ ID NO: 104354 - DNA, 103 bp, Artificial Sequence
  Synthetic Polynucleotide
taatacgactcactatagggtgaggacacctccgaaggctggcagcgagcaacagaggagagctcgcatgcagccttcgaacctggcggcagcgcaaaagatg

SEQ ID NO: 104355 - DNA, 103 bp, Artificial Sequence
  Synthetic Polynucleotide
taatacgactcactatagggcgtctccacatgaggacacctccgaaggctaacagaggagaagccttatgaggtgtcctaacctggcggcagcgcaaaagatg

SEQ ID NO: 104356 - DNA, 103 bp, Artificial Sequence
  Synthetic Polynucleotide
taatacgactcactatagggacatcgccagcgtctccacatgaggacaccaacagaggagaggtgtcatgatgtggagaaacctggcggcagcgcaaaagatg

SEQ ID NO: 104357 - DNA, 103 bp, Artificial Sequence
  Synthetic Polynucleotide
taatacgactcactataggggtgggcgtccacatcgccagcgtctccacaaacagaggagatgtggaatggctggcgataacctggcggcagcgcaaaagatg

SEQ ID NO: 104358 - DNA, 103 bp, Artificial Sequence
  Synthetic Polynucleotide
taatacgactcactataggggaatgggatggtgggcgtccacatcgccagaacagaggagactggcgatgtggacgcccaacctggcggcagcgcaaaagatg

SEQ ID NO: 104359 - DNA, 103 bp, Artificial Sequence
  Synthetic Polynucleotide
taatacgactcactatagggcctggacactgaatgggatggtgggcgtccaacagaggagaggacgcatgccatcccataacctggcggcagcgcaaaagatg

SEQ ID NO: 104360 - DNA, 103 bp, Artificial Sequence
  Synthetic Polynucleotide
taatacgactcactatagggtgcaggtgttcctggacactgaatgggatgaacagaggagacatcccatgcagtgtccaaacctggcggcagcgcaaaagatg

SEQ ID NO: 104361 - DNA, 103 bp, Artificial Sequence
  Synthetic Polynucleotide
taatacgactcactatagggttcttctccagccaggtccatctggtcataaacagaggagatatgacatgatggacctgaacctggcggcagcgcaaaagatg

SEQ ID NO: 104362 - DNA, 103 bp, Artificial Sequence
  Synthetic Polynucleotide
taatacgactcactatagggatcctgttgttgcaggtgttcctggacactaacagaggagaagtgtcatggaacacctgaacctggcggcagcgcaaaagatg

SEQ ID NO: 104363 - DNA, 103 bp, Artificial Sequence
  Synthetic Polynucleotide
taatacgactcactatagggtgatccgtgaatcctgttgttgcaggtgttaacagaggagaaacaccatgaacaacaggaacctggcggcagcgcaaaagatg

SEQ ID NO: 104364 - DNA, 103 bp, Artificial Sequence
  Synthetic Polynucleotide
taatacgactcactatagggcatctcaggctgatccgtgaatcctgttgtaacagaggagaacaacaatgttcacggataacctggcggcagcgcaaaagatg

SEQ ID NO: 104365 - DNA, 103 bp, Artificial Sequence
  Synthetic Polynucleotide
taatacgactcactataggggctcaatctcttcttctccagccaggtccaaacagaggagatggaccatgctggagaagaacctggcggcagcgcaaaagatg

SEQ ID NO: 104366 - DNA, 103 bp, Artificial Sequence
  Synthetic Polynucleotide
taatacgactcactatagggtctgagtagagctcaatctcttcttctccaaacagaggagatggagaatgagagattgaaacctggcggcagcgcaaaagatg

SEQ ID NO: 104367 - DNA, 103 bp, Artificial Sequence
  Synthetic Polynucleotide
taatacgactcactatagggtgtgtcgggttctgagtagagctcaatctcaacagaggagagagattatgctctactcaaacctggcggcagcgcaaaagatg

SEQ ID NO: 104368 - DNA, 103 bp, Artificial Sequence
  Synthetic Polynucleotide
taatacgactcactatagggacaggtaggacccagcagggcgtggagccaaacagaggagatggctcatggccctgctgaacctggcggcagcgcaaaagatg

SEQ ID NO: 104369 - DNA, 103 bp, Artificial Sequence
  Synthetic Polynucleotide
taatacgactcactatagggtgatggtgtctgtgtcgggttctgagtagaaacagaggagatctactatgaacccgacaaacctggcggcagcgcaaaagatg

SEQ ID NO: 104370 - DNA, 103 bp, Artificial Sequence
  Synthetic Polynucleotide
taatacgactcactatagggtggtcgcagttgatggtgtctgtgtcgggtaacagaggagaacccgaatgagacaccataacctggcggcagcgcaaaagatg

SEQ ID NO: 104371 - DNA, 103 bp, Artificial Sequence
  Synthetic Polynucleotide
taatacgactcactatagggcctgctgaactggtcgcagttgatggtgtcaacagaggagagacaccatgaactgcgacaacctggcggcagcgcaaaagatg

SEQ ID NO: 104372 - DNA, 103 bp, Artificial Sequence
  Synthetic Polynucleotide
taatacgactcactatagggcacacaacagcctgctgaactggtcgcagtaacagaggagaactgcgatgagttcagcaaacctggcggcagcgcaaaagatg

SEQ ID NO: 104373 - DNA, 103 bp, Artificial Sequence
  Synthetic Polynucleotide
taatacgactcactatagggccttccatgtcacacaacagcctgctgaacaacagaggagagttcagatggctgttgtgaacctggcggcagcgcaaaagatg

SEQ ID NO: 104374 - DNA, 103 bp, Artificial Sequence
  Synthetic Polynucleotide
taatacgactcactatagggctcttcatcaccttccatgtcacacaacagaacagaggagactgttgatggacatggaaaacctggcggcagcgcaaaagatg

SEQ ID NO: 104375 - DNA, 103 bp, Artificial Sequence
  Synthetic Polynucleotide
taatacgactcactatagggcctccctggtctcttcatcaccttccatgtaacagaggagaacatggatggtgatgaagaacctggcggcagcgcaaaagatg

SEQ ID NO: 104376 - DNA, 103 bp, Artificial Sequence
  Synthetic Polynucleotide
taatacgactcactatagggttggcataagcctccctggtctcttcatcaaacagaggagatgatgaatggaccagggaaacctggcggcagcgcaaaagatg

SEQ ID NO: 104377 - DNA, 103 bp, Artificial Sequence
  Synthetic Polynucleotide
taatacgactcactatagggttccgcgatattggcataagcctccctggtaacagaggagaaccaggatggcttatgccaacctggcggcagcgcaaaagatg

SEQ ID NO: 104378 - DNA, 103 bp, Artificial Sequence
  Synthetic Polynucleotide
taatacgactcactatagggactggtccagttccgcgatattggcataagaacagaggagacttatgatgatatcgcggaacctggcggcagcgcaaaagatg

SEQ ID NO: 104379 - DNA, 103 bp, Artificial Sequence
  Synthetic Polynucleotide
taatacgactcactatagggtggggctctgacaggtaggacccagcagggaacagaggagaccctgcatggtcctacctaacctggcggcagcgcaaaagatg

SEQ ID NO: 104380 - DNA, 103 bp, Artificial Sequence
  Synthetic Polynucleotide
taatacgactcactatagggtggaagacatactggtccagttccgcgataaacagaggagatatcgcatgactggaccaaacctggcggcagcgcaaaagatg

SEQ ID NO: 104381 - DNA, 103 bp, Artificial Sequence
  Synthetic Polynucleotide
taatacgactcactatagggctgggagtcctggaagacatactggtccagaacagaggagactggacatgtatgtcttcaacctggcggcagcgcaaaagatg

SEQ ID NO: 104382 - DNA, 103 bp, Artificial Sequence
  Synthetic Polynucleotide
taatacgactcactatagggggccctccagctgggagtcctggaagacataacagaggagaatgtctatgaggactcccaacctggcggcagcgcaaaagatg

SEQ ID NO: 104383 - DNA, 103 bp, Artificial Sequence
  Synthetic Polynucleotide
taatacgactcactatagggtccttgctcaggccctccagctgggagtccaacagaggagaggactcatggctggagggaacctggcggcagcgcaaaagatg

SEQ ID NO: 104384 - DNA, 103 bp, Artificial Sequence
  Synthetic Polynucleotide
taatacgactcactatagggcttgaaaatgtccttgctcaggccctccagaacagaggagactggagatgctgagcaagaacctggcggcagcgcaaaagatg

SEQ ID NO: 104385 - DNA, 103 bp, Artificial Sequence
  Synthetic Polynucleotide
taatacgactcactataggggtcctatgtgcttgaaaatgtccttgctcaaacagaggagatgagcaatgacattttcaaacctggcggcagcgcaaaagatg

SEQ ID NO: 104386 - DNA, 103 bp, Artificial Sequence
  Synthetic Polynucleotide
taatacgactcactatagggacttcatctggtcctatgtgcttgaaaatgaacagaggagacattttatggcacataggaacctggcggcagcgcaaaagatg

SEQ ID NO: 104387 - DNA, 103 bp, Artificial Sequence
  Synthetic Polynucleotide
taatacgactcactatagggctcaccgatcacttcatctggtcctatgtgaacagaggagacacataatgccagatgaaaacctggcggcagcgcaaaagatg

SEQ ID NO: 104388 - DNA, 103 bp, Artificial Sequence
  Synthetic Polynucleotide
taatacgactcactatagggtctccatactctcaccgatcacttcatctgaacagaggagacagatgatgtgatcggtgaacctggcggcagcgcaaaagatg

SEQ ID NO: 104389 - DNA, 103 bp, Artificial Sequence
  Synthetic Polynucleotide
taatacgactcactatagggtctgctggcatctccatactctcaccgatcaacagaggagagatcggatggagtatggaaacctggcggcagcgcaaaagatg

SEQ ID NO: 104390 - DNA, 103 bp, Artificial Sequence
  Synthetic Polynucleotide
taatacgactcactatagggtgagctgccttggggctctgacaggtaggaaacagaggagatcctacatgtcagagcccaacctggcggcagcgcaaaagatg

SEQ ID NO: 104391 - DNA, 103 bp, Artificial Sequence
  Synthetic Polynucleotide
taatacgactcactatagggctgcccaacttctgctggcatctccatactaacagaggagaagtatgatgatgccagcaaacctggcggcagcgcaaaagatg

SEQ ID NO: 104392 - DNA, 103 bp, Artificial Sequence
  Synthetic Polynucleotide
taatacgactcactatagggtctgacttttctgcccaacttctgctggcaaacagaggagatgccagatgaagttgggcaacctggcggcagcgcaaaagatg

SEQ ID NO: 104393 - DNA, 103 bp, Artificial Sequence
  Synthetic Polynucleotide
taatacgactcactatagggaagggtcttttctgacttttctgcccaactaacagaggagaagttggatggaaaagtcaaacctggcggcagcgcaaaagatg

SEQ ID NO: 104394 - DNA, 103 bp, Artificial Sequence
  Synthetic Polynucleotide
taatacgactcactatagggctcctctgggaagggtcttttctgacttttaacagaggagaaaaagtatgaaaagacccaacctggcggcagcgcaaaagatg

SEQ ID NO: 104395 - DNA, 103 bp, Artificial Sequence
  Synthetic Polynucleotide
taatacgactcactatagggctgccggaagctcctctgggaagggtctttaacagaggagaaaagacatgtcccagaggaacctggcggcagcgcaaaagatg

SEQ ID NO: 104396 - DNA, 103 bp, Artificial Sequence
  Synthetic Polynucleotide
taatacgactcactatagggtgcttcaggtctgccggaagctcctctgggaacagaggagacccagaatggcttccggcaacctggcggcagcgcaaaagatg

SEQ ID NO: 104397 - DNA, 103 bp, Artificial Sequence
  Synthetic Polynucleotide
taatacgactcactatagggtggcttccagtgcttcaggtctgccggaagaacagaggagacttccgatggacctgaagaacctggcggcagcgcaaaagatg

SEQ ID NO: 104398 - DNA, 103 bp, Artificial Sequence
  Synthetic Polynucleotide
taatacgactcactatagggagaaaggcactggcttccagtgcttcaggtaacagaggagaacctgaatgactggaagcaacctggcggcagcgcaaaagatg

SEQ ID NO: 104399 - DNA, 103 bp, Artificial Sequence
  Synthetic Polynucleotide
taatacgactcactataggggaggaactggagaaaggcactggcttccagaacagaggagactggaaatgagtgcctttaacctggcggcagcgcaaaagatg

SEQ ID NO: 104400 - DNA, 103 bp, Artificial Sequence
  Synthetic Polynucleotide
taatacgactcactataggggcagctcaacgaggaactggagaaaggcacaacagaggagagtgcctatgtccagttccaacctggcggcagcgcaaaagatg

SEQ ID NO: 104401 - DNA, 103 bp, Artificial Sequence
  Synthetic Polynucleotide
taatacgactcactatagggtggcacactgtgagctgccttggggctctgaacagaggagacagagcatgaaggcagctaacctggcggcagcgcaaaagatg

SEQ ID NO: 104402 - DNA, 103 bp, Artificial Sequence
  Synthetic Polynucleotide
taatacgactcactatagggggagattcaggcagctcaacgaggaactggaacagaggagaccagttatgcgttgagctaacctggcggcagcgcaaaagatg

SEQ ID NO: 104403 - DNA, 103 bp, Artificial Sequence
  Synthetic Polynucleotide
taatacgactcactatagggggtccctcagggagattcaggcagctcaacaacagaggagagttgagatgcctgaatctaacctggcggcagcgcaaaagatg

SEQ ID NO: 104404 - DNA, 103 bp, Artificial Sequence
  Synthetic Polynucleotide
taatacgactcactatagggaaactggatgggtccctcagggagattcagaacagaggagactgaatatgcctgagggaaacctggcggcagcgcaaaagatg

SEQ ID NO: 104405 - DNA, 103 bp, Artificial Sequence
  Synthetic Polynucleotide
taatacgactcactatagggtggtggggacaaactggatgggtccctcagaacagaggagactgaggatgccatccagtaacctggcggcagcgcaaaagatg

SEQ ID NO: 104406 - DNA, 103 bp, Artificial Sequence
  Synthetic Polynucleotide
taatacgactcactatagggagagtggagatggtggggacaaactggatgaacagaggagacatccaatgtgtccccacaacctggcggcagcgcaaaagatg

SEQ ID NO: 104407 - DNA, 103 bp, Artificial Sequence
  Synthetic Polynucleotide
taatacgactcactatagggcccatggggcagagtggagatggtggggacaacagaggagagtccccatgatctccactaacctggcggcagcgcaaaagatg

SEQ ID NO: 104408 - DNA, 103 bp, Artificial Sequence
  Synthetic Polynucleotide
taatacgactcactatagggtttgccagagcccatggggcagagtggagaaacagaggagatctccaatgtgccccatgaacctggcggcagcgcaaaagatg

SEQ ID NO: 104409 - DNA, 103 bp, Artificial Sequence
  Synthetic Polynucleotide
taatacgactcactataggggcctcagagatttgccagagcccatggggcaacagaggagagccccaatggctctggcaaacctggcggcagcgcaaaagatg

SEQ ID NO: 104410 - DNA, 103 bp, Artificial Sequence
  Synthetic Polynucleotide
taatacgactcactatagggccctgttccagcctcagagatttgccagagaacagaggagactctggatgatctctgagaacctggcggcagcgcaaaagatg

SEQ ID NO: 104411 - DNA, 103 bp, Artificial Sequence
  Synthetic Polynucleotide
taatacgactcactatagggtactggagacccctgttccagcctcagagaaacagaggagatctctgatgctggaacagaacctggcggcagcgcaaaagatg

SEQ ID NO: 104412 - DNA, 103 bp, Artificial Sequence
  Synthetic Polynucleotide
taatacgactcactatagggaactccatggtggcacactgtgagctgcctaacagaggagaaggcagatgacagtgtgcaacctggcggcagcgcaaaagatg

SEQ ID NO: 104413 - DNA, 103 bp, Artificial Sequence
  Synthetic Polynucleotide
taatacgactcactatagggtagatgaatatactggagacccctgttccaaacagaggagatggaacatgggtctccagaacctggcggcagcgcaaaagatg

SEQ ID NO: 104414 - DNA, 103 bp, Artificial Sequence
  Synthetic Polynucleotide
taatacgactcactatagggctcaccatggtagatgaatatactggagacaacagaggagagtctccatgatattcatcaacctggcggcagcgcaaaagatg

SEQ ID NO: 104415 - DNA, 103 bp, Artificial Sequence
  Synthetic Polynucleotide
taatacgactcactatagggcctggggcacctcaccatggtagatgaataaacagaggagatattcaatgaccatggtgaacctggcggcagcgcaaaagatg

SEQ ID NO: 104416 - DNA, 103 bp, Artificial Sequence
  Synthetic Polynucleotide
taatacgactcactatagggacttggctggcctggggcacctcaccatggaacagaggagaccatggatgggtgccccaaacctggcggcagcgcaaaagatg

SEQ ID NO: 104417 - DNA, 103 bp, Artificial Sequence
  Synthetic Polynucleotide
taatacgactcactataggggggagggggtacttggctggcctggggcacaacagaggagagtgcccatggccagccaaaacctggcggcagcgcaaaagatg

SEQ ID NO: 104418 - DNA, 103 bp, Artificial Sequence
  Synthetic Polynucleotide
taatacgactcactatagggtgaatccactgggagggggtacttggctggaacagaggagaccagccatgtaccccctcaacctggcggcagcgcaaaagatg

SEQ ID NO: 104419 - DNA, 103 bp, Artificial Sequence
  Synthetic Polynucleotide
taatacgactcactatagggccgtggacagtgaatccactgggagggggtaacagaggagaacccccatgcagtggattaacctggcggcagcgcaaaagatg

SEQ ID NO: 104420 - DNA, 103 bp, Artificial Sequence
  Synthetic Polynucleotide
taatacgactcactatagggtgttgggaggccgtggacagtgaatccactaacagaggagaagtggaatgactgtccacaacctggcggcagcgcaaaagatg

SEQ ID NO: 104421 - DNA, 103 bp, Artificial Sequence
  Synthetic Polynucleotide
taatacgactcactatagggggtctggagatgttgggaggccgtggacagaacagaggagactgtccatggcctcccaaaacctggcggcagcgcaaaagatg

SEQ ID NO: 104422 - DNA, 103 bp, Artificial Sequence
  Synthetic Polynucleotide
taatacgactcactataggggagcctggccggtctggagatgttgggaggaacagaggagacctcccatgatctccagaaacctggcggcagcgcaaaagatg

SEQ ID NO: 104423 - DNA, 103 bp, Artificial Sequence
  Synthetic Polynucleotide
taatacgactcactatagggtaggggccccaactccatggtggcacactgaacagaggagacagtgtatgaccatggagaacctggcggcagcgcaaaagatg

SEQ ID NO: 104424 - DNA, 103 bp, Artificial Sequence
  Synthetic Polynucleotide
taatacgactcactatagggggggctggtggagcctggccggtctggagaaacagaggagatctccaatgcggccaggcaacctggcggcagcgcaaaagatg

SEQ ID NO: 104425 - DNA, 103 bp, Artificial Sequence
  Synthetic Polynucleotide
taatacgactcactatagggatggagcgaaggggctggtggagcctggccaacagaggagaggccagatgccaccagccaacctggcggcagcgcaaaagatg

SEQ ID NO: 104426 - DNA, 103 bp, Artificial Sequence
  Synthetic Polynucleotide
taatacgactcactatagggtcagtggctgatggagcgaaggggctggtgaacagaggagacaccagatgcttcgctccaacctggcggcagcgcaaaagatg

SEQ ID NO: 104427 - DNA, 103 bp, Artificial Sequence
  Synthetic Polynucleotide
taatacgactcactataggggctgggcaggtcagtggctgatggagcgaaaacagaggagattcgctatgtcagccactaacctggcggcagcgcaaaagatg

SEQ ID NO: 104428 - DNA, 103 bp, Artificial Sequence
  Synthetic Polynucleotide
taatacgactcactataggggttcaggcatgctgggcaggtcagtggctgaacagaggagacagccaatgacctgcccaaacctggcggcagcgcaaaagatg

SEQ ID NO: 104429 - DNA, 103 bp, Artificial Sequence
  Synthetic Polynucleotide
taatacgactcactataggggtcagggcaggttcaggcatgctgggcaggaacagaggagacctgccatgcatgcctgaaacctggcggcagcgcaaaagatg

SEQ ID NO: 104430 - DNA, 103 bp, Artificial Sequence
  Synthetic Polynucleotide
taatacgactcactatagggtgctcgggaggtcagggcaggttcaggcataacagaggagaatgcctatgcctgccctgaacctggcggcagcgcaaaagatg

SEQ ID NO: 104431 - DNA, 103 bp, Artificial Sequence
  Synthetic Polynucleotide
taatacgactcactatagggctgtcatgtttgctcgggaggtcagggcagaacagaggagactgcccatgcctcccgagaacctggcggcagcgcaaaagatg

SEQ ID NO: 104432 - DNA, 103 bp, Artificial Sequence
  Synthetic Polynucleotide
taatacgactcactataggggtcttgtgctctgtcatgtttgctcgggagaacagaggagactcccgatgaaacatgacaacctggcggcagcgcaaaagatg

SEQ ID NO: 104433 - DNA, 103 bp, Artificial Sequence
  Synthetic Polynucleotide
taatacgactcactatagggggtgggggacgtcttgtgctctgtcatgttaacagaggagaaacatgatggagcacaagaacctggcggcagcgcaaaagatg

SEQ ID NO: 104434 - DNA, 103 bp, Artificial Sequence
  Synthetic Polynucleotide
taatacgactcactatagggagccaccttctaggggccccaactccatggaacagaggagaccatggatgtggggccccaacctggcggcagcgcaaaagatg

SEQ ID NO: 104435 - DNA, 103 bp, Artificial Sequence
  Synthetic Polynucleotide
taatacgactcactatagggccgggcattgggtgggggacgtcttgtgctaacagaggagaagcacaatgcgtcccccaaacctggcggcagcgcaaaagatg

SEQ ID NO: 104436 - DNA, 103 bp, Artificial Sequence
  Synthetic Polynucleotide
taatacgactcactatagggtctccagctgccgggcattgggtgggggacaacagaggagagtccccatgccaatgcccaacctggcggcagcgcaaaagatg

SEQ ID NO: 104437 - DNA, 103 bp, Artificial Sequence
  Synthetic Polynucleotide
taatacgactcactataggggttggagacctctccagctgccgggcattgaacagaggagacaatgcatggcagctggaaacctggcggcagcgcaaaagatg

SEQ ID NO: 104438 - DNA, 103 bp, Artificial Sequence
  Synthetic Polynucleotide
taatacgactcactatagggttggaagcttgttggagacctctccagctgaacagaggagacagctgatgaggtctccaaacctggcggcagcgcaaaagatg

SEQ ID NO: 104439 - DNA, 103 bp, Artificial Sequence
  Synthetic Polynucleotide
taatacgactcactatagggccaggccattttggaagcttgttggagaccaacagaggagaggtctcatgcaagcttccaacctggcggcagcgcaaaagatg

SEQ ID NO: 104440 - DNA, 103 bp, Artificial Sequence
  Synthetic Polynucleotide
taatacgactcactatagggccaggctagaccaggccattttggaagcttaacagaggagaaagcttatgaaatggcctaacctggcggcagcgcaaaagatg

SEQ ID NO: 104441 - DNA, 103 bp, Artificial Sequence
  Synthetic Polynucleotide
taatacgactcactatagggggcacggtgaccaggctagaccaggccattaacagaggagaaatggcatggtctagcctaacctggcggcagcgcaaaagatg

SEQ ID NO: 104442 - DNA, 103 bp, Artificial Sequence
  Synthetic Polynucleotide
taatacgactcactatagggctcagacccaggcacggtgaccaggctagaaacagaggagatctagcatggtcaccgtgaacctggcggcagcgcaaaagatg

SEQ ID NO: 104443 - DNA, 103 bp, Artificial Sequence
  Synthetic Polynucleotide
taatacgactcactataggggagggagggcctcagacccaggcacggtgaaacagaggagatcaccgatgctgggtctgaacctggcggcagcgcaaaagatg

SEQ ID NO: 104444 - DNA, 103 bp, Artificial Sequence
  Synthetic Polynucleotide
taatacgactcactatagggcagccctgtggagggagggcctcagacccaaacagaggagatgggtcatgggccctcccaacctggcggcagcgcaaaagatg

SEQ ID NO: 104445 - DNA, 103 bp, Artificial Sequence
  Synthetic Polynucleotide
taatacgactcactatagggagctccaggtagccaccttctaggggccccaacagaggagaggggccatgagaaggtggaacctggcggcagcgcaaaagatg

SEQ ID NO: 104446 - DNA, 103 bp, Artificial Sequence
  Synthetic Polynucleotide
taatacgactcactatagggtcgctcaaggcagccctgtggagggagggcaacagaggagagccctcatgccacagggcaacctggcggcagcgcaaaagatg

SEQ ID NO: 104447 - DNA, 103 bp, Artificial Sequence
  Synthetic Polynucleotide
taatacgactcactatagggcgccaccgtgtcgctcaaggcagccctgtgaacagaggagacacaggatggccttgagcaacctggcggcagcgcaaaagatg

SEQ ID NO: 104448 - DNA, 103 bp, Artificial Sequence
  Synthetic Polynucleotide
taatacgactcactatagggactcccacagcgccaccgtgtcgctcaaggaacagaggagaccttgaatgacacggtggaacctggcggcagcgcaaaagatg

SEQ ID NO: 104449 - DNA, 103 bp, Artificial Sequence
  Synthetic Polynucleotide
taatacgactcactatagggtgctgcagggactcccacagcgccaccgtgaacagaggagacacggtatggctgtgggaaacctggcggcagcgcaaaagatg

SEQ ID NO: 104450 - DNA, 103 bp, Artificial Sequence
  Synthetic Polynucleotide
taatacgactcactatagggctccccatgctgctgcagggactcccacagaacagaggagactgtggatgtccctgcagaacctggcggcagcgcaaaagatg

SEQ ID NO: 104451 - DNA, 103 bp, Artificial Sequence
  Synthetic Polynucleotide
taatacgactcactataggggtagcttggtctccccatgctgctgcagggaacagaggagaccctgcatgagcatggggaacctggcggcagcgcaaaagatg

SEQ ID NO: 104452 - DNA, 103 bp, Artificial Sequence
  Synthetic Polynucleotide
taatacgactcactataggggctgcctgaagtagcttggtctccccatgcaacagaggagagcatggatggaccaagctaacctggcggcagcgcaaaagatg

SEQ ID NO: 104453 - DNA, 103 bp, Artificial Sequence
  Synthetic Polynucleotide
taatacgactcactatagggcttctcctctgctgcctgaagtagcttggtaacagaggagaaccaagatgcttcaggcaaacctggcggcagcgcaaaagatg

SEQ ID NO: 104454 - DNA, 103 bp, Artificial Sequence
  Synthetic Polynucleotide
taatacgactcactatagggcgatggtgaacttctcctctgctgcctgaaaacagaggagattcaggatgcagaggagaaacctggcggcagcgcaaaagatg

SEQ ID NO: 104455 - DNA, 103 bp, Artificial Sequence
  Synthetic Polynucleotide
taatacgactcactatagggttgaaaggctcgatggtgaacttctcctctaacagaggagaagaggaatggttcaccataacctggcggcagcgcaaaagatg

SEQ ID NO: 104456 - DNA, 103 bp, Artificial Sequence
  Synthetic Polynucleotide
taatacgactcactatagggatcaagtgcaggcctcgacgttgttggcataacagaggagaatgccaatgacgtcgaggaacctggcggcagcgcaaaagatg

SEQ ID NO: 104457 - DNA, 103 bp, Artificial Sequence
  Synthetic Polynucleotide
taatacgactcactatagggtttgcgatctttcaccgcaaggttggagtaaacagaggagatactccatgcttgcggtgaacctggcggcagcgcaaaagatg

SEQ ID NO: 104458 - DNA, 103 bp, Artificial Sequence
  Synthetic Polynucleotide
taatacgactcactatagggtggccactgctttgcgatctttcaccgcaaaacagaggagattgcggatgaagatcgcaaacctggcggcagcgcaaaagatg

SEQ ID NO: 104459 - DNA, 103 bp, Artificial Sequence
  Synthetic Polynucleotide
taatacgactcactatagggtagtgcagaatggccactgctttgcgatctaacagaggagaagatcgatgagcagtggcaacctggcggcagcgcaaaagatg

SEQ ID NO: 104460 - DNA, 103 bp, Artificial Sequence
  Synthetic Polynucleotide
taatacgactcactatagggtaccccagggtagtgcagaatggccactgcaacagaggagagcagtgatgattctgcacaacctggcggcagcgcaaaagatg

SEQ ID NO: 104461 - DNA, 103 bp, Artificial Sequence
  Synthetic Polynucleotide
taatacgactcactatagggcatttgaggctaccccagggtagtgcagaaaacagaggagattctgcatgaccctggggaacctggcggcagcgcaaaagatg

SEQ ID NO: 104462 - DNA, 103 bp, Artificial Sequence
  Synthetic Polynucleotide
taatacgactcactataggggccttggttccatttgaggctaccccagggaacagaggagaccctggatgagcctcaaaaacctggcggcagcgcaaaagatg

SEQ ID NO: 104463 - DNA, 103 bp, Artificial Sequence
  Synthetic Polynucleotide
taatacgactcactatagggagccccactggccttggttccatttgaggcaacagaggagagcctcaatgggaaccaagaacctggcggcagcgcaaaagatg

SEQ ID NO: 104464 - DNA, 103 bp, Artificial Sequence
  Synthetic Polynucleotide
taatacgactcactatagggaactagtgggagccccactggccttggttcaacagaggagagaaccaatgccagtggggaacctggcggcagcgcaaaagatg

SEQ ID NO: 104465 - DNA, 103 bp, Artificial Sequence
  Synthetic Polynucleotide
taatacgactcactataggggatcccgaggaactagtgggagccccactgaacagaggagacagtggatgtcccactagaacctggcggcagcgcaaaagatg

SEQ ID NO: 104466 - DNA, 103 bp, Artificial Sequence
  Synthetic Polynucleotide
taatacgactcactataggggcctattggagatcccgaggaactagtgggaacagaggagacccactatgtcctcgggaaacctggcggcagcgcaaaagatg

SEQ ID NO: 104467 - DNA, 103 bp, Artificial Sequence
  Synthetic Polynucleotide
taatacgactcactatagggcacccttgacatcaagtgcaggcctcgacgaacagaggagacgtcgaatgctgcacttgaacctggcggcagcgcaaaagatg

SEQ ID NO: 104468 - DNA, 103 bp, Artificial Sequence
  Synthetic Polynucleotide
taatacgactcactatagggttgtaggagagcctattggagatcccgaggaacagaggagacctcggatgctccaatagaacctggcggcagcgcaaaagatg

SEQ ID NO: 104469 - DNA, 103 bp, Artificial Sequence
  Synthetic Polynucleotide
taatacgactcactatagggggaggggtggttgtaggagagcctattggaaacagaggagatccaatatgctctcctacaacctggcggcagcgcaaaagatg

SEQ ID NO: 104470 - DNA, 103 bp, Artificial Sequence
  Synthetic Polynucleotide
taatacgactcactataggggggtttagtgggaggggtggttgtaggagaaacagaggagatctcctatgaccacccctaacctggcggcagcgcaaaagatg

SEQ ID NO: 104471 - DNA, 103 bp, Artificial Sequence
  Synthetic Polynucleotide
taatacgactcactatagggtgaaggatgggggtttagtgggaggggtggaacagaggagaccacccatgccactaaacaacctggcggcagcgcaaaagatg

SEQ ID NO: 104472 - DNA, 103 bp, Artificial Sequence
  Synthetic Polynucleotide
taatacgactcactataggggggtgcaggttgaaggatgggggtttagtgaacagaggagacactaaatgcccatccttaacctggcggcagcgcaaaagatg

SEQ ID NO: 104473 - DNA, 103 bp, Artificial Sequence
  Synthetic Polynucleotide
taatacgactcactataggggtgaggggcggggtgcaggttgaaggatggaacagaggagaccatccatgaacctgcacaacctggcggcagcgcaaaagatg

SEQ ID NO: 104474 - DNA, 103 bp, Artificial Sequence
  Synthetic Polynucleotide
taatacgactcactatagggtagccagcaagtgaggggcggggtgcaggtaacagaggagaacctgcatgccgcccctcaacctggcggcagcgcaaaagatg

SEQ ID NO: 104475 - DNA, 103 bp, Artificial Sequence
  Synthetic Polynucleotide
taatacgactcactatagggaggtgcatactagccagcaagtgaggggcgaacagaggagacgccccatgcttgctggcaacctggcggcagcgcaaaagatg

SEQ ID NO: 104476 - DNA, 103 bp, Artificial Sequence
  Synthetic Polynucleotide
taatacgactcactatagggaagtttctgcaggtgcatactagccagcaaaacagaggagattgctgatgagtatgcacaacctggcggcagcgcaaaagatg

SEQ ID NO: 104477 - DNA, 103 bp, Artificial Sequence
  Synthetic Polynucleotide
taatacgactcactatagggactggctattaagtttctgcaggtgcatacaacagaggagagtatgcatgtgcagaaacaacctggcggcagcgcaaaagatg

SEQ ID NO: 104478 - DNA, 103 bp, Artificial Sequence
  Synthetic Polynucleotide
taatacgactcactatagggggtgaggtgccacccttgacatcaagtgcaaacagaggagatgcactatgtgtcaagggaacctggcggcagcgcaaaagatg

SEQ ID NO: 104479 - DNA, 103 bp, Artificial Sequence
  Synthetic Polynucleotide
taatacgactcactatagggatcccctgatactggctattaagtttctgcaacagaggagagcagaaatgtaatagccaaacctggcggcagcgcaaaagatg

SEQ ID NO: 104480 - DNA, 103 bp, Artificial Sequence
  Synthetic Polynucleotide
taatacgactcactatagggggcagcagccatcccctgatactggctattaacagaggagaaatagcatgtatcaggggaacctggcggcagcgcaaaagatg

SEQ ID NO: 104481 - DNA, 103 bp, Artificial Sequence
  Synthetic Polynucleotide
taatacgactcactatagggggcctggagtggcagcagccatcccctgataacagaggagaatcaggatgtggctgctgaacctggcggcagcgcaaaagatg

SEQ ID NO: 104482 - DNA, 103 bp, Artificial Sequence
  Synthetic Polynucleotide
taatacgactcactatagggtccccgggttggcctggagtggcagcagccaacagaggagaggctgcatgcactccaggaacctggcggcagcgcaaaagatg

SEQ ID NO: 104483 - DNA, 103 bp, Artificial Sequence
  Synthetic Polynucleotide
taatacgactcactataggggggtcctgcctccccgggttggcctggagtaacagaggagaactccaatgcaacccgggaacctggcggcagcgcaaaagatg

SEQ ID NO: 104484 - DNA, 103 bp, Artificial Sequence
  Synthetic Polynucleotide
taatacgactcactatagggagttttgcaggggtcctgcctccccgggttaacagaggagaaacccgatgaggcaggacaacctggcggcagcgcaaaagatg

SEQ ID NO: 104485 - DNA, 103 bp, Artificial Sequence
  Synthetic Polynucleotide
taatacgactcactatagggccaaagtcccagttttgcaggggtcctgccaacagaggagaggcaggatgcctgcaaaaaacctggcggcagcgcaaaagatg

SEQ ID NO: 104486 - DNA, 103 bp, Artificial Sequence
  Synthetic Polynucleotide
taatacgactcactatagggcgcctgggccccaaagtcccagttttgcagaacagaggagactgcaaatgtgggactttaacctggcggcagcgcaaaagatg

SEQ ID NO: 104487 - DNA, 103 bp, Artificial Sequence
  Synthetic Polynucleotide
taatacgactcactatagggctgcccctcccgcctgggccccaaagtcccaacagaggagagggactatggggcccaggaacctggcggcagcgcaaaagatg

SEQ ID NO: 104488 - DNA, 103 bp, Artificial Sequence
  Synthetic Polynucleotide
taatacgactcactataggggagagtgattctgcccctcccgcctgggccaacagaggagaggcccaatggggaggggcaacctggcggcagcgcaaaagatg

SEQ ID NO: 104489 - DNA, 103 bp, Artificial Sequence
  Synthetic Polynucleotide
taatacgactcactatagggctccttcgcaggtgaggtgccacccttgacaacagaggagagtcaagatgggcacctcaaacctggcggcagcgcaaaagatg

SEQ ID NO: 104490 - DNA, 103 bp, Artificial Sequence
  Synthetic Polynucleotide
taatacgactcactatagggagcagaaggagagagtgattctgcccctccaacagaggagaggagggatggaatcactcaacctggcggcagcgcaaaagatg

SEQ ID NO: 104491 - DNA, 103 bp, Artificial Sequence
  Synthetic Polynucleotide
taatacgactcactatagggtctgggcaccagcagaaggagagagtgattaacagaggagaaatcacatgctccttctgaacctggcggcagcgcaaaagatg

SEQ ID NO: 104492 - DNA, 103 bp, Artificial Sequence
  Synthetic Polynucleotide
taatacgactcactatagggatagcagggctctgggcaccagcagaaggaaacagaggagatccttcatgtggtgcccaaacctggcggcagcgcaaaagatg

SEQ ID NO: 104493 - DNA, 103 bp, Artificial Sequence
  Synthetic Polynucleotide
taatacgactcactatagggcgaatcgatgatagcagggctctgggcaccaacagaggagaggtgccatgagccctgctaacctggcggcagcgcaaaagatg

SEQ ID NO: 104494 - DNA, 103 bp, Artificial Sequence
  Synthetic Polynucleotide
taatacgactcactatagggccactgggtccgaatcgatgatagcagggcaacagaggagagccctgatgtcatcgattaacctggcggcagcgcaaaagatg

SEQ ID NO: 104495 - DNA, 103 bp, Artificial Sequence
  Synthetic Polynucleotide
taatacgactcactatagggacttcctcatccactgggtccgaatcgatgaacagaggagacatcgaatgggacccagtaacctggcggcagcgcaaaagatg

SEQ ID NO: 104496 - DNA, 103 bp, Artificial Sequence
  Synthetic Polynucleotide
taatacgactcactatagggcgacatcagcacttcctcatccactgggtcaacagaggagagacccaatggatgaggaaaacctggcggcagcgcaaaagatg

SEQ ID NO: 104497 - DNA, 103 bp, Artificial Sequence
  Synthetic Polynucleotide
taatacgactcactatagggccaccaccagcgacatcagcacttcctcataacagaggagaatgaggatgtgctgatgtaacctggcggcagcgcaaaagatg

SEQ ID NO: 104498 - DNA, 103 bp, Artificial Sequence
  Synthetic Polynucleotide
taatacgactcactatagggaaccccagttccaccaccagcgacatcagcaacagaggagagctgatatggctggtggtaacctggcggcagcgcaaaagatg

SEQ ID NO: 104499 - DNA, 103 bp, Artificial Sequence
  Synthetic Polynucleotide
taatacgactcactatagggggctcggtccaaccccagttccaccaccagaacagaggagactggtgatggaactggggaacctggcggcagcgcaaaagatg

SEQ ID NO: 104500 - DNA, 103 bp, Artificial Sequence
  Synthetic Polynucleotide
taatacgactcactatagggggttggcatcctccttcgcaggtgaggtgcaacagaggagagcacctatgctgcgaaggaacctggcggcagcgcaaaagatg

SEQ ID NO: 104501 - DNA, 103 bp, Artificial Sequence
  Synthetic Polynucleotide
taatacgactcactataggggaagctcattggctcggtccaaccccagttaacagaggagaaactggatgtggaccgagaacctggcggcagcgcaaaagatg

SEQ ID NO: 104502 - DNA, 103 bp, Artificial Sequence
  Synthetic Polynucleotide
taatacgactcactatagggcacagctccggaagctcattggctcggtccaacagaggagaggaccgatgcaatgagctaacctggcggcagcgcaaaagatg

SEQ ID NO: 104503 - DNA, 103 bp, Artificial Sequence
  Synthetic Polynucleotide
taatacgactcactatagggctgccccagccacagctccggaagctcattaacagaggagaaatgagatgccggagctgaacctggcggcagcgcaaaagatg

SEQ ID NO: 104504 - DNA, 103 bp, Artificial Sequence
  Synthetic Polynucleotide
taatacgactcactatagggcaaactcattctgccccagccacagctccgaacagaggagacggagcatgggctggggcaacctggcggcagcgcaaaagatg

SEQ ID NO: 104505 - DNA, 103 bp, Artificial Sequence
  Synthetic Polynucleotide
taatacgactcactataggggcagtgaagtcaaactcattctgccccagcaacagaggagagctgggatggaatgagttaacctggcggcagcgcaaaagatg

SEQ ID NO: 104506 - DNA, 103 bp, Artificial Sequence
  Synthetic Polynucleotide
taatacgactcactatagggtggaaagtccgcagtgaagtcaaactcattaacagaggagaaatgagatggacttcactaacctggcggcagcgcaaaagatg

SEQ ID NO: 104507 - DNA, 103 bp, Artificial Sequence
  Synthetic Polynucleotide
taatacgactcactatagggagcagctagatggaaagtccgcagtgaagtaacagaggagaacttcaatgcggactttcaacctggcggcagcgcaaaagatg

SEQ ID NO: 104508 - DNA, 103 bp, Artificial Sequence
  Synthetic Polynucleotide
taatacgactcactatagggctcatctcttggttggcatcctccttcgcaaacagaggagatgcgaaatgggatgccaaaacctggcggcagcgcaaaagatg

SEQ ID NO: 104509 - DNA, 103 bp, Artificial Sequence
  Synthetic Polynucleotide
taatacgactcactatagggggccacggagctcatctcttggttggcatcaacagaggagagatgccatgcaagagatgaacctggcggcagcgcaaaagatg

SEQ ID NO: 104510 - DNA, 103 bp, Artificial Sequence
  Synthetic Polynucleotide
taatacgactcactatagggggttggagtaggccacggagctcatctcttaacagaggagaaagagaatggctccgtggaacctggcggcagcgcaaaagatg

SEQ ID NO: 104511 - DNA, 103 bp, Artificial Sequence
  Synthetic Polynucleotide
taatacgactcactatagggttcaccgcaaggttggagtaggccacggagaacagaggagactccgtatgctactccaaaacctggcggcagcgcaaaagatg

SEQ ID NO: 104512 - DNA, 103 bp, Artificial Sequence
  Synthetic Polynucleotide
taatacgactcactatagggcattttactacagcttacggtaaacaacataacagaggagaatgttgatgaccgtaagcaacctggcggcagcgcaaaagatg

SEQ ID NO: 104513 - DNA, 103 bp, Artificial Sequence
  Synthetic Polynucleotide
taatacgactcactataggggtttctagatactcttttcgctttgtccttaacagaggagaaaggacatggcgaaaagaaacctggcggcagcgcaaaagatg

SEQ ID NO: 104514 - DNA, 103 bp, Artificial Sequence
  Synthetic Polynucleotide
taatacgactcactatagggcctataataacatgatttgcctttcccataaacagaggagatatgggatgggcaaatcaaacctggcggcagcgcaaaagatg

SEQ ID NO: 104515 - DNA, 103 bp, Artificial Sequence
  Synthetic Polynucleotide
taatacgactcactatagggtagtcaggaacctataataacatgatttgcaacagaggagagcaaatatggttattataaacctggcggcagcgcaaaagatg

SEQ ID NO: 104516 - DNA, 103 bp, Artificial Sequence
  Synthetic Polynucleotide
taatacgactcactatagggtgttgccccttagtcaggaacctataataaaacagaggagattattaatggttcctgacaacctggcggcagcgcaaaagatg

SEQ ID NO: 104517 - DNA, 103 bp, Artificial Sequence
  Synthetic Polynucleotide
taatacgactcactatagggccaaatccactgttgccccttagtcaggaaaacagaggagattcctgatgaaggggcaaaacctggcggcagcgcaaaagatg

SEQ ID NO: 104518 - DNA, 103 bp, Artificial Sequence
  Synthetic Polynucleotide
taatacgactcactataggggagtctgaagccaaatccactgttgcccctaacagaggagaaggggcatgagtggatttaacctggcggcagcgcaaaagatg

SEQ ID NO: 104519 - DNA, 103 bp, Artificial Sequence
  Synthetic Polynucleotide
taatacgactcactatagggatataataatgagtctgaagccaaatccacaacagaggagagtggatatggcttcagacaacctggcggcagcgcaaaagatg

SEQ ID NO: 104520 - DNA, 103 bp, Artificial Sequence
  Synthetic Polynucleotide
taatacgactcactatagggatggtaagtgatataataatgagtctgaagaacagaggagacttcagatgcattattataacctggcggcagcgcaaaagatg

SEQ ID NO: 104521 - DNA, 103 bp, Artificial Sequence
  Synthetic Polynucleotide
taatacgactcactatagggaattccactgatggtaagtgatataataataacagaggagaattattatgtcacttaccaacctggcggcagcgcaaaagatg

SEQ ID NO: 104522 - DNA, 103 bp, Artificial Sequence
  Synthetic Polynucleotide
taatacgactcactatagggtctggccttgaattccactgatggtaagtgaacagaggagacacttaatgtcagtggaaaacctggcggcagcgcaaaagatg

SEQ ID NO: 104523 - DNA, 103 bp, Artificial Sequence
  Synthetic Polynucleotide
taatacgactcactatagggaacaataaactctggccttgaattccactgaacagaggagacagtggatgtcaaggccaaacctggcggcagcgcaaaagatg

SEQ ID NO: 104524 - DNA, 103 bp, Artificial Sequence
  Synthetic Polynucleotide
taatacgactcactatagggtttcagatttgtttctagatactcttttcgaacagaggagacgaaaaatgtatctagaaaacctggcggcagcgcaaaagatg

SEQ ID NO: 104525 - DNA, 103 bp, Artificial Sequence
  Synthetic Polynucleotide
taatacgactcactatagggtgtgagtacaaacaataaactctggccttgaacagaggagacaaggcatgagtttattgaacctggcggcagcgcaaaagatg

SEQ ID NO: 104526 - DNA, 103 bp, Artificial Sequence
  Synthetic Polynucleotide
taatacgactcactatagggcttactacagtgtgagtacaaacaataaacaacagaggagagtttatatgttgtactcaaacctggcggcagcgcaaaagatg

SEQ ID NO: 104527 - DNA, 103 bp, Artificial Sequence
  Synthetic Polynucleotide
taatacgactcactatagggttctgcataacttactacagtgtgagtacaaacagaggagatgtactatgactgtagtaaacctggcggcagcgcaaaagatg

SEQ ID NO: 104528 - DNA, 103 bp, Artificial Sequence
  Synthetic Polynucleotide
taatacgactcactatagggcagccctaacttctgcataacttactacagaacagaggagactgtagatggttatgcagaacctggcggcagcgcaaaagatg

SEQ ID NO: 104529 - DNA, 103 bp, Artificial Sequence
  Synthetic Polynucleotide
taatacgactcactatagggcgtcgtctttcagccctaacttctgcataaaacagaggagattatgcatgagttagggcaacctggcggcagcgcaaaagatg

SEQ ID NO: 104530 - DNA, 103 bp, Artificial Sequence
  Synthetic Polynucleotide
taatacgactcactataggggccaagttctcgtcgtctttcagccctaacaacagaggagagttaggatggaaagacgaaacctggcggcagcgcaaaagatg

SEQ ID NO: 104531 - DNA, 103 bp, Artificial Sequence
  Synthetic Polynucleotide
taatacgactcactatagggactcttcaatgccaagttctcgtcgtctttaacagaggagaaaagacatggagaacttgaacctggcggcagcgcaaaagatg

SEQ ID NO: 104532 - DNA, 103 bp, Artificial Sequence
  Synthetic Polynucleotide
taatacgactcactatagggtcaggaagagactcttcaatgccaagttctaacagaggagaagaactatgcattgaagaaacctggcggcagcgcaaaagatg

SEQ ID NO: 104533 - DNA, 103 bp, Artificial Sequence
  Synthetic Polynucleotide
taatacgactcactatagggagcagctgtctcaggaagagactcttcaataacagaggagaattgaaatgtctcttcctaacctggcggcagcgcaaaagatg

SEQ ID NO: 104534 - DNA, 103 bp, Artificial Sequence
  Synthetic Polynucleotide
taatacgactcactatagggggcttttgtcagcagctgtctcaggaagagaacagaggagactcttcatgagacagctgaacctggcggcagcgcaaaagatg

SEQ ID NO: 104535 - DNA, 103 bp, Artificial Sequence
  Synthetic Polynucleotide
taatacgactcactatagggctacgtttcttttcagatttgtttctagataacagaggagaatctagatgcaaatctgaaacctggcggcagcgcaaaagatg

SEQ ID NO: 104536 - DNA, 103 bp, Artificial Sequence
  Synthetic Polynucleotide
taatacgactcactatagggccagaatcttggcttttgtcagcagctgtcaacagaggagagacagcatgtgacaaaagaacctggcggcagcgcaaaagatg

SEQ ID NO: 104537 - DNA, 103 bp, Artificial Sequence
  Synthetic Polynucleotide
taatacgactcactatagggattatctgacccagaatcttggcttttgtcaacagaggagagacaaaatgcaagattctaacctggcggcagcgcaaaagatg

SEQ ID NO: 104538 - DNA, 103 bp, Artificial Sequence
  Synthetic Polynucleotide
taatacgactcactatagggtgtttatacgattatctgacccagaatcttaacagaggagaaagattatgggtcagataaacctggcggcagcgcaaaagatg

SEQ ID NO: 104539 - DNA, 103 bp, Artificial Sequence
  Synthetic Polynucleotide
taatacgactcactatagggagactgactgtgtttatacgattatctgacaacagaggagagtcagaatgtcgtataaaaacctggcggcagcgcaaaagatg

SEQ ID NO: 104540 - DNA, 103 bp, Artificial Sequence
  Synthetic Polynucleotide
taatacgactcactatagggtgcttccttgagactgactgtgtttatacgaacagaggagacgtataatgacagtcagtaacctggcggcagcgcaaaagatg

SEQ ID NO: 104541 - DNA, 103 bp, Artificial Sequence
  Synthetic Polynucleotide
taatacgactcactatagggacctttccaatgcttccttgagactgactgaacagaggagacagtcaatgtcaaggaagaacctggcggcagcgcaaaagatg

SEQ ID NO: 104542 - DNA, 103 bp, Artificial Sequence
  Synthetic Polynucleotide
taatacgactcactatagggctgtgatcaaacctttccaatgcttccttgaacagaggagacaaggaatgattggaaagaacctggcggcagcgcaaaagatg

SEQ ID NO: 104543 - DNA, 103 bp, Artificial Sequence
  Synthetic Polynucleotide
taatacgactcactatagggaggggttgggctgtgatcaaacctttccaaaacagaggagattggaaatgtttgatcacaacctggcggcagcgcaaaagatg

SEQ ID NO: 104544 - DNA, 103 bp, Artificial Sequence
  Synthetic Polynucleotide
taatacgactcactatagggaagaggcagaaggggttgggctgtgatcaaaacagaggagattgatcatggcccaacccaacctggcggcagcgcaaaagatg

SEQ ID NO: 104545 - DNA, 103 bp, Artificial Sequence
  Synthetic Polynucleotide
taatacgactcactataggggaactccgagaagaggcagaaggggttgggaacagaggagacccaacatgttctgcctcaacctggcggcagcgcaaaagatg

SEQ ID NO: 104546 - DNA, 103 bp, Artificial Sequence
  Synthetic Polynucleotide
taatacgactcactatagggaaattgatctctacgtttcttttcagatttaacagaggagaaaatctatgaagaaacgtaacctggcggcagcgcaaaagatg

SEQ ID NO: 104547 - DNA, 103 bp, Artificial Sequence
  Synthetic Polynucleotide
taatacgactcactatagggtgattttcttgaactccgagaagaggcagaaacagaggagatctgccatgtctcggagtaacctggcggcagcgcaaaagatg

SEQ ID NO: 104548 - DNA, 103 bp, Artificial Sequence
  Synthetic Polynucleotide
taatacgactcactatagggccgtgtgagatgattttcttgaactccgagaacagaggagactcggaatgcaagaaaataacctggcggcagcgcaaaagatg

SEQ ID NO: 104549 - DNA, 103 bp, Artificial Sequence
  Synthetic Polynucleotide
taatacgactcactatagggtctgagacggccgtgtgagatgattttcttaacagaggagaaagaaaatgatctcacacaacctggcggcagcgcaaaagatg

SEQ ID NO: 104550 - DNA, 103 bp, Artificial Sequence
  Synthetic Polynucleotide
taatacgactcactatagggtgaggaagggtctgagacggccgtgtgagaaacagaggagatctcacatggccgtctcaaacctggcggcagcgcaaaagatg

SEQ ID NO: 104551 - DNA, 103 bp, Artificial Sequence
  Synthetic Polynucleotide
taatacgactcactatagggtggttggtgttgaggaagggtctgagacggaacagaggagaccgtctatgacccttcctaacctggcggcagcgcaaaagatg

SEQ ID NO: 104552 - DNA, 103 bp, Artificial Sequence
  Synthetic Polynucleotide
taatacgactcactataggggtcgggatcttggttggtgttgaggaagggaacagaggagacccttcatgaacaccaacaacctggcggcagcgcaaaagatg

SEQ ID NO: 104553 - DNA, 103 bp, Artificial Sequence
  Synthetic Polynucleotide
taatacgactcactataggggctcgtatccgtcgggatcttggttggtgtaacagaggagaacaccaatgaagatcccgaacctggcggcagcgcaaaagatg

SEQ ID NO: 104554 - DNA, 103 bp, Artificial Sequence
  Synthetic Polynucleotide
taatacgactcactatagggtgggtggagtgctcgtatccgtcgggatctaacagaggagaagatccatgcggatacgaaacctggcggcagcgcaaaagatg

SEQ ID NO: 104555 - DNA, 103 bp, Artificial Sequence
  Synthetic Polynucleotide
taatacgactcactatagggaaatgctgcctgggtggagtgctcgtatccaacagaggagaggatacatgcactccaccaacctggcggcagcgcaaaagatg

SEQ ID NO: 104556 - DNA, 103 bp, Artificial Sequence
  Synthetic Polynucleotide
taatacgactcactatagggatgagctggtaaatgctgcctgggtggagtaacagaggagaactccaatgaggcagcataacctggcggcagcgcaaaagatg

SEQ ID NO: 104557 - DNA, 103 bp, Artificial Sequence
  Synthetic Polynucleotide
taatacgactcactatagggtgagaacattaaattgatctctacgtttctaacagaggagaagaaacatggagatcaataacctggcggcagcgcaaaagatg

SEQ ID NO: 104558 - DNA, 103 bp, Artificial Sequence
  Synthetic Polynucleotide
taatacgactcactatagggccatcttctcatgagctggtaaatgctgccaacagaggagaggcagcatgtaccagctcaacctggcggcagcgcaaaagatg

SEQ ID NO: 104559 - DNA, 103 bp, Artificial Sequence
  Synthetic Polynucleotide
taatacgactcactatagggcttctttgcaccatcttctcatgagctggtaacagaggagaaccagcatgtgagaagataacctggcggcagcgcaaaagatg

SEQ ID NO: 104560 - DNA, 103 bp, Artificial Sequence
  Synthetic Polynucleotide
taatacgactcactatagggaaatgatgaccttctttgcaccatcttctcaacagaggagagagaagatggtgcaaagaaacctggcggcagcgcaaaagatg

SEQ ID NO: 104561 - DNA, 103 bp, Artificial Sequence
  Synthetic Polynucleotide
taatacgactcactatagggactgactactaaatgatgaccttctttgcaaacagaggagatgcaaaatgggtcatcataacctggcggcagcgcaaaagatg

SEQ ID NO: 104562 - DNA, 103 bp, Artificial Sequence
  Synthetic Polynucleotide
taatacgactcactataggggaatttatggactgactactaaatgatgacaacagaggagagtcatcatgtagtagtcaaacctggcggcagcgcaaaagatg

SEQ ID NO: 104563 - DNA, 103 bp, Artificial Sequence
  Synthetic Polynucleotide
taatacgactcactatagggaacagactgggaatttatggactgactactaacagaggagaagtagtatgtccataaataacctggcggcagcgcaaaagatg

SEQ ID NO: 104564 - DNA, 103 bp, Artificial Sequence
  Synthetic Polynucleotide
taatacgactcactatagggatgatgaaccaacagactgggaatttatggaacagaggagaccataaatgcccagtctgaacctggcggcagcgcaaaagatg

SEQ ID NO: 104565 - DNA, 103 bp, Artificial Sequence
  Synthetic Polynucleotide
taatacgactcactatagggggctgtgttaatgatgaaccaacagactggaacagaggagaccagtcatgtggttcatcaacctggcggcagcgcaaaagatg

SEQ ID NO: 104566 - DNA, 103 bp, Artificial Sequence
  Synthetic Polynucleotide
taatacgactcactatagggagacatcactggctgtgttaatgatgaaccaacagaggagaggttcaatgttaacacagaacctggcggcagcgcaaaagatg

SEQ ID NO: 104567 - DNA, 103 bp, Artificial Sequence
  Synthetic Polynucleotide
taatacgactcactatagggttgtagcttgagacatcactggctgtgttaaacagaggagataacacatgcagtgatgtaacctggcggcagcgcaaaagatg

SEQ ID NO: 104568 - DNA, 103 bp, Artificial Sequence
  Synthetic Polynucleotide
taatacgactcactatagggagttctttaatgagaacattaaattgatctaacagaggagaagatcaatgtaatgttctaacctggcggcagcgcaaaagatg

SEQ ID NO: 104569 - DNA, 103 bp, Artificial Sequence
  Synthetic Polynucleotide
taatacgactcactatagggattggtaaatttgtagcttgagacatcactaacagaggagaagtgatatgtcaagctacaacctggcggcagcgcaaaagatg

SEQ ID NO: 104570 - DNA, 103 bp, Artificial Sequence
  Synthetic Polynucleotide
taatacgactcactataggggccttgtggaattggtaaatttgtagcttgaacagaggagacaagctatgaatttaccaaacctggcggcagcgcaaaagatg

SEQ ID NO: 104571 - DNA, 103 bp, Artificial Sequence
  Synthetic Polynucleotide
taatacgactcactatagggactgggacatgccttgtggaattggtaaataacagaggagaatttacatgttccacaagaacctggcggcagcgcaaaagatg

SEQ ID NO: 104572 - DNA, 103 bp, Artificial Sequence
  Synthetic Polynucleotide
taatacgactcactataggggaaaactgaaactgggacatgccttgtggaaacagaggagatccacaatgcatgtcccaaacctggcggcagcgcaaaagatg

SEQ ID NO: 104573 - DNA, 103 bp, Artificial Sequence
  Synthetic Polynucleotide
taatacgactcactatagggtaattgagctgaaaactgaaactgggacataacagaggagaatgtccatgtttcagtttaacctggcggcagcgcaaaagatg

SEQ ID NO: 104574 - DNA, 103 bp, Artificial Sequence
  Synthetic Polynucleotide
taatacgactcactataggggcatggctcctaattgagctgaaaactgaaaacagaggagattcagtatgcagctcaataacctggcggcagcgcaaaagatg

SEQ ID NO: 104575 - DNA, 103 bp, Artificial Sequence
  Synthetic Polynucleotide
taatacgactcactatagggttcagatgttgcatggctcctaattgagctaacagaggagaagctcaatgaggagccataacctggcggcagcgcaaaagatg

SEQ ID NO: 104576 - DNA, 103 bp, Artificial Sequence
  Synthetic Polynucleotide
taatacgactcactatagggcaattggtctttcagatgttgcatggctccaacagaggagaggagccatgcaacatctgaacctggcggcagcgcaaaagatg

SEQ ID NO: 104577 - DNA, 103 bp, Artificial Sequence
  Synthetic Polynucleotide
taatacgactcactatagggtccgttgttccaattggtctttcagatgttaacagaggagaaacatcatgaagaccaataacctggcggcagcgcaaaagatg

SEQ ID NO: 104578 - DNA, 103 bp, Artificial Sequence
  Synthetic Polynucleotide
taatacgactcactatagggatcatgcgtgtccgttgttccaattggtctaacagaggagaagaccaatgggaacaacgaacctggcggcagcgcaaaagatg

SEQ ID NO: 104579 - DNA, 103 bp, Artificial Sequence
  Synthetic Polynucleotide
taatacgactcactatagggcatggatcccagttctttaatgagaacattaacagaggagaaatgttatgattaaagaaaacctggcggcagcgcaaaagatg

SEQ ID NO: 104580 - DNA, 103 bp, Artificial Sequence
  Synthetic Polynucleotide
taatacgactcactatagggatttgcttctatcatgcgtgtccgttgttcaacagaggagagaacaaatgacacgcatgaacctggcggcagcgcaaaagatg

SEQ ID NO: 104581 - DNA, 103 bp, Artificial Sequence
  Synthetic Polynucleotide
taatacgactcactataggggccgatgaatatttgcttctatcatgcgtgaacagaggagacacgcaatgtagaagcaaaacctggcggcagcgcaaaagatg

SEQ ID NO: 104582 - DNA, 103 bp, Artificial Sequence
  Synthetic Polynucleotide
taatacgactcactatagggtcttcttgttgccgatgaatatttgcttctaacagaggagaagaagcatgtattcatcgaacctggcggcagcgcaaaagatg

SEQ ID NO: 104583 - DNA, 103 bp, Artificial Sequence
  Synthetic Polynucleotide
taatacgactcactatagggttttcttagttcttcttgttgccgatgaataacagaggagaattcatatgcaacaagaaaacctggcggcagcgcaaaagatg

SEQ ID NO: 104584 - DNA, 103 bp, Artificial Sequence
  Synthetic Polynucleotide
taatacgactcactataggggttcttgaatttttcttagttcttcttgttaacagaggagaaacaagatgaactaagaaaacctggcggcagcgcaaaagatg

SEQ ID NO: 104585 - DNA, 103 bp, Artificial Sequence
  Synthetic Polynucleotide
taatacgactcactatagggatctgaagttgttcttgaatttttcttagtaacagaggagaactaagatgaattcaagaaacctggcggcagcgcaaaagatg

SEQ ID NO: 104586 - DNA, 103 bp, Artificial Sequence
  Synthetic Polynucleotide
taatacgactcactatagggaccatggaccatctgaagttgttcttgaataacagaggagaattcaaatgcaacttcagaacctggcggcagcgcaaaagatg

SEQ ID NO: 104587 - DNA, 103 bp, Artificial Sequence
  Synthetic Polynucleotide
taatacgactcactataggggcagcccctgaccatggaccatctgaagttaacagaggagaaacttcatgtggtccatgaacctggcggcagcgcaaaagatg

SEQ ID NO: 104588 - DNA, 103 bp, Artificial Sequence
  Synthetic Polynucleotide
taatacgactcactatagggaaaaacatctgcagcccctgaccatggaccaacagaggagaggtccaatgtcaggggctaacctggcggcagcgcaaaagatg

SEQ ID NO: 104589 - DNA, 103 bp, Artificial Sequence
  Synthetic Polynucleotide
taatacgactcactatagggtgattgttgcaaaaacatctgcagcccctgaacagaggagacaggggatgcagatgtttaacctggcggcagcgcaaaagatg

SEQ ID NO: 104590 - DNA, 103 bp, Artificial Sequence
  Synthetic Polynucleotide
taatacgactcactatagggtaccaggaagcatggatcccagttctttaaaacagaggagattaaagatgtgggatccaaacctggcggcagcgcaaaagatg

SEQ ID NO: 104591 - DNA, 103 bp, Artificial Sequence
  Synthetic Polynucleotide
taatacgactcactatagggacccaggatttgattgttgcaaaaacatctaacagaggagaagatgtatgtgcaacaataacctggcggcagcgcaaaagatg

SEQ ID NO: 104592 - DNA, 103 bp, Artificial Sequence
  Synthetic Polynucleotide
taatacgactcactatagggccaaaattcaacccaggatttgattgttgcaacagaggagagcaacaatgaaatcctggaacctggcggcagcgcaaaagatg

SEQ ID NO: 104593 - DNA, 103 bp, Artificial Sequence
  Synthetic Polynucleotide
taatacgactcactatagggttgaacggaaccaaaattcaacccaggattaacagaggagaaatcctatgttgaattttaacctggcggcagcgcaaaagatg

SEQ ID NO: 104594 - DNA, 103 bp, Artificial Sequence
  Synthetic Polynucleotide
taatacgactcactatagggcagaagaaagttgaacggaaccaaaattcaaacagaggagatgaattatggttccgttcaacctggcggcagcgcaaaagatg

SEQ ID NO: 104595 - DNA, 103 bp, Artificial Sequence
  Synthetic Polynucleotide
taatacgactcactataggggatgaatttccagaagaaagttgaacggaaaacagaggagattccgtatgactttcttcaacctggcggcagcgcaaaagatg

SEQ ID NO: 104596 - DNA, 103 bp, Artificial Sequence
  Synthetic Polynucleotide
taatacgactcactatagggctggatattagatgaatttccagaagaaagaacagaggagactttctatgggaaattcaaacctggcggcagcgcaaaagatg

SEQ ID NO: 104597 - DNA, 103 bp, Artificial Sequence
  Synthetic Polynucleotide
taatacgactcactataggggtgcaagttgctggatattagatgaatttcaacagaggagagaaattatgctaatatccaacctggcggcagcgcaaaagatg

SEQ ID NO: 104598 - DNA, 103 bp, Artificial Sequence
  Synthetic Polynucleotide
taatacgactcactatagggatatttataggtgcaagttgctggatattaaacagaggagataatatatggcaacttgcaacctggcggcagcgcaaaagatg

SEQ ID NO: 104599 - DNA, 103 bp, Artificial Sequence
  Synthetic Polynucleotide
taatacgactcactatagggttggccttgcatatttataggtgcaagttgaacagaggagacaacttatgcctataaataacctggcggcagcgcaaaagatg

SEQ ID NO: 104600 - DNA, 103 bp, Artificial Sequence
  Synthetic Polynucleotide
taatacgactcactatagggtaggaacaacttggccttgcatatttatagaacagaggagactataaatgtgcaaggccaacctggcggcagcgcaaaagatg

SEQ ID NO: 104601 - DNA, 103 bp, Artificial Sequence
  Synthetic Polynucleotide
taatacgactcactatagggtttctagcattaccaggaagcatggatcccaacagaggagagggatcatggcttcctggaacctggcggcagcgcaaaagatg

SEQ ID NO: 104602 - DNA, 103 bp, Artificial Sequence
  Synthetic Polynucleotide
taatacgactcactatagggatctggttagtaggaacaacttggccttgcaacagaggagagcaaggatgagttgttccaacctggcggcagcgcaaaagatg

SEQ ID NO: 104603 - DNA, 103 bp, Artificial Sequence
  Synthetic Polynucleotide
taatacgactcactatagggtccactttgaatctggttagtaggaacaacaacagaggagagttgttatgactaaccagaacctggcggcagcgcaaaagatg

SEQ ID NO: 104604 - DNA, 103 bp, Artificial Sequence
  Synthetic Polynucleotide
taatacgactcactatagggcagtattcattccactttgaatctggttagaacagaggagactaaccatgttcaaagtgaacctggcggcagcgcaaaagatg

SEQ ID NO: 104605 - DNA, 103 bp, Artificial Sequence
  Synthetic Polynucleotide
taatacgactcactatagggccaatgtgtccagtattcattccactttgaaacagaggagatcaaagatgaatgaatacaacctggcggcagcgcaaaagatg

SEQ ID NO: 104606 - DNA, 103 bp, Artificial Sequence
  Synthetic Polynucleotide
taatacgactcactatagggctgagttgtgccaatgtgtccagtattcataacagaggagaatgaatatgggacacattaacctggcggcagcgcaaaagatg

SEQ ID NO: 104607 - DNA, 103 bp, Artificial Sequence
  Synthetic Polynucleotide
taatacgactcactataggggtatcatgtgctgagttgtgccaatgtgtcaacagaggagagacacaatggcacaactcaacctggcggcagcgcaaaagatg

SEQ ID NO: 104608 - DNA, 103 bp, Artificial Sequence
  Synthetic Polynucleotide
taatacgactcactataggggtctgttgttgtatcatgtgctgagttgtgaacagaggagacacaacatggcacatgataacctggcggcagcgcaaaagatg

SEQ ID NO: 104609 - DNA, 103 bp, Artificial Sequence
  Synthetic Polynucleotide
taatacgactcactatagggactctgtaaagtctgttgttgtatcatgtgaacagaggagacacatgatgcaacaacagaacctggcggcagcgcaaaagatg

SEQ ID NO: 104610 - DNA, 103 bp, Artificial Sequence
  Synthetic Polynucleotide
taatacgactcactataggggagttgatgtactctgtaaagtctgttgttaacagaggagaaacaacatgctttacagaaacctggcggcagcgcaaaagatg

SEQ ID NO: 104611 - DNA, 103 bp, Artificial Sequence
  Synthetic Polynucleotide
taatacgactcactatagggtgttgactctgagttgatgtactctgtaaaaacagaggagatttacaatgtacatcaacaacctggcggcagcgcaaaagatg

SEQ ID NO: 104612 - DNA, 103 bp, Artificial Sequence
  Synthetic Polynucleotide
taatacgactcactatagggtttgtccatctttctagcattaccaggaagaacagaggagacttcctatgaatgctagaaacctggcggcagcgcaaaagatg

SEQ ID NO: 104613 - DNA, 103 bp, Artificial Sequence
  Synthetic Polynucleotide
taatacgactcactatagggcagtacattttgttgactctgagttgatgtaacagaggagaacatcaatgcagagtcaaaacctggcggcagcgcaaaagatg

SEQ ID NO: 104614 - DNA, 103 bp, Artificial Sequence
  Synthetic Polynucleotide
taatacgactcactatagggtgtgcccactcagtacattttgttgactctaacagaggagaagagtcatgaaaatgtacaacctggcggcagcgcaaaagatg

SEQ ID NO: 104615 - DNA, 103 bp, Artificial Sequence
  Synthetic Polynucleotide
taatacgactcactataggggtttgctgactgtgcccactcagtacatttaacagaggagaaaatgtatggagtgggcaaacctggcggcagcgcaaaagatg

SEQ ID NO: 104616 - DNA, 103 bp, Artificial Sequence
  Synthetic Polynucleotide
taatacgactcactataggggggtagagatgtttgctgactgtgcccactaacagaggagaagtgggatgagtcagcaaaacctggcggcagcgcaaaagatg

SEQ ID NO: 104617 - DNA, 103 bp, Artificial Sequence
  Synthetic Polynucleotide
taatacgactcactataggggtgtctgactgggtagagatgtttgctgacaacagaggagagtcagcatgcatctctacaacctggcggcagcgcaaaagatg

SEQ ID NO: 104618 - DNA, 103 bp, Artificial Sequence
  Synthetic Polynucleotide
taatacgactcactatagggagagtgctctgtgtctgactgggtagagataacagaggagaatctctatgcagtcagacaacctggcggcagcgcaaaagatg

SEQ ID NO: 104619 - DNA, 103 bp, Artificial Sequence
  Synthetic Polynucleotide
taatacgactcactatagggtggggctgtaagagtgctctgtgtctgactaacagaggagaagtcagatgcagagcactaacctggcggcagcgcaaaagatg

SEQ ID NO: 104620 - DNA, 103 bp, Artificial Sequence
  Synthetic Polynucleotide
taatacgactcactatagggtgttatacagtggggctgtaagagtgctctaacagaggagaagagcaatgttacagcccaacctggcggcagcgcaaaagatg

SEQ ID NO: 104621 - DNA, 103 bp, Artificial Sequence
  Synthetic Polynucleotide
taatacgactcactatagggatcaccatagtgttatacagtggggctgtaaacagaggagatacagcatgactgtataaaacctggcggcagcgcaaaagatg

SEQ ID NO: 104622 - DNA, 103 bp, Artificial Sequence
  Synthetic Polynucleotide
taatacgactcactatagggaggctgagaaatcaccatagtgttatacagaacagaggagactgtatatgactatggtgaacctggcggcagcgcaaaagatg

SEQ ID NO: 104623 - DNA, 103 bp, Artificial Sequence
  Synthetic Polynucleotide
taatacgactcactatagggcaatcgagctcattttactacagcttacggaacagaggagaccgtaaatggtagtaaaaaacctggcggcagcgcaaaagatg

SEQ ID NO: 104624 - DNA, 103 bp, Artificial Sequence
  Synthetic Polynucleotide
taatacgactcactataggggaacagtagatttgtccatctttctagcataacagaggagaatgctaatgagatggacaaacctggcggcagcgcaaaagatg

SEQ ID NO: 104625 - DNA, 103 bp, Artificial Sequence
  Synthetic Polynucleotide
taatacgactcactatagggttccggctgcaggctgagaaatcaccatagaacagaggagactatggatgtttctcagcaacctggcggcagcgcaaaagatg

SEQ ID NO: 104626 - DNA, 103 bp, Artificial Sequence
  Synthetic Polynucleotide
taatacgactcactatagggtggaccatgcttccggctgcaggctgagaaaacagaggagattctcaatgtgcagccggaacctggcggcagcgcaaaagatg

SEQ ID NO: 104627 - DNA, 103 bp, Artificial Sequence
  Synthetic Polynucleotide
taatacgactcactatagggagatggaatctggaccatgcttccggctgcaacagaggagagcagccatgagcatggtcaacctggcggcagcgcaaaagatg

SEQ ID NO: 104628 - DNA, 103 bp, Artificial Sequence
  Synthetic Polynucleotide
taatacgactcactataggggtggcatactagatggaatctggaccatgcaacagaggagagcatggatgagattccataacctggcggcagcgcaaaagatg

SEQ ID NO: 104629 - DNA, 103 bp, Artificial Sequence
  Synthetic Polynucleotide
taatacgactcactataggggtgctgttttgtggcatactagatggaatcaacagaggagagattccatgtagtatgccaacctggcggcagcgcaaaagatg

SEQ ID NO: 104630 - DNA, 103 bp, Artificial Sequence
  Synthetic Polynucleotide
taatacgactcactatagggagcactctgggtgctgttttgtggcatactaacagaggagaagtatgatgcaaaacagcaacctggcggcagcgcaaaagatg

SEQ ID NO: 104631 - DNA, 103 bp, Artificial Sequence
  Synthetic Polynucleotide
taatacgactcactatagggtagttactgcagcactctgggtgctgttttaacagaggagaaaaacaatgcccagagtgaacctggcggcagcgcaaaagatg

SEQ ID NO: 104632 - DNA, 103 bp, Artificial Sequence
  Synthetic Polynucleotide
taatacgactcactatagggtgagtgaatgtagttactgcagcactctggaacagaggagaccagagatgtgcagtaacaacctggcggcagcgcaaaagatg

SEQ ID NO: 104633 - DNA, 103 bp, Artificial Sequence
  Synthetic Polynucleotide
taatacgactcactatagggctgcctgtcctgagtgaatgtagttactgcaacagaggagagcagtaatgacattcactaacctggcggcagcgcaaaagatg

SEQ ID NO: 104634 - DNA, 103 bp, Artificial Sequence
  Synthetic Polynucleotide
taatacgactcactatagggaaaatcttatctgcctgtcctgagtgaatgaacagaggagacattcaatgaggacaggcaacctggcggcagcgcaaaagatg

SEQ ID NO: 104635 - DNA, 103 bp, Artificial Sequence
  Synthetic Polynucleotide
taatacgactcactatagggcttttctgcagaacagtagatttgtccatcaacagaggagagatggaatgatctactgtaacctggcggcagcgcaaaagatg

SEQ ID NO: 104636 - DNA, 103 bp, Artificial Sequence
  Synthetic Polynucleotide
taatacgactcactatagggtgaccttgagaaaatcttatctgcctgtccaacagaggagaggacagatggataagattaacctggcggcagcgcaaaagatg

SEQ ID NO: 104637 - DNA, 103 bp, Artificial Sequence
  Synthetic Polynucleotide
taatacgactcactatagggcacaagttgttgaccttgagaaaatcttataacagaggagaataagaatgtctcaaggtaacctggcggcagcgcaaaagatg

SEQ ID NO: 104638 - DNA, 103 bp, Artificial Sequence
  Synthetic Polynucleotide
taatacgactcactatagggctaatttggtcacaagttgttgaccttgagaacagaggagactcaagatgaacaacttgaacctggcggcagcgcaaaagatg

SEQ ID NO: 104639 - DNA, 103 bp, Artificial Sequence
  Synthetic Polynucleotide
taatacgactcactatagggggagcagtcactaatttggtcacaagttgtaacagaggagaacaactatggaccaaattaacctggcggcagcgcaaaagatg

SEQ ID NO: 104640 - DNA, 103 bp, Artificial Sequence
  Synthetic Polynucleotide
taatacgactcactatagggacaagctacaggagcagtcactaatttggtaacagaggagaaccaaaatggtgactgctaacctggcggcagcgcaaaagatg

SEQ ID NO: 104641 - DNA, 103 bp, Artificial Sequence
  Synthetic Polynucleotide
taatacgactcactatagggtgactgccccacaagctacaggagcagtcaaacagaggagatgactgatgctgtagcttaacctggcggcagcgcaaaagatg

SEQ ID NO: 104642 - DNA, 103 bp, Artificial Sequence
  Synthetic Polynucleotide
taatacgactcactatagggctaggtaccatgactgccccacaagctacaaacagaggagatgtagcatgtggggcagtaacctggcggcagcgcaaaagatg

SEQ ID NO: 104643 - DNA, 103 bp, Artificial Sequence
  Synthetic Polynucleotide
taatacgactcactatagggaagcatagtactaggtaccatgactgccccaacagaggagaggggcaatgatggtacctaacctggcggcagcgcaaaagatg

SEQ ID NO: 104644 - DNA, 103 bp, Artificial Sequence
  Synthetic Polynucleotide
taatacgactcactatagggcctggcccataagcatagtactaggtaccaaacagaggagatggtacatggtactatgcaacctggcggcagcgcaaaagatg

SEQ ID NO: 104645 - DNA, 103 bp, Artificial Sequence
  Synthetic Polynucleotide
taatacgactcactataggggcagtcaccacctggcccataagcatagtaaacagaggagatactatatgtatgggccaaacctggcggcagcgcaaaagatg

SEQ ID NO: 104646 - DNA, 103 bp, Artificial Sequence
  Synthetic Polynucleotide
taatacgactcactatagggaaaatcaatgcttttctgcagaacagtagaaacagaggagatctactatgctgcagaaaaacctggcggcagcgcaaaagatg

SEQ ID NO: 104647 - DNA, 103 bp, Artificial Sequence
  Synthetic Polynucleotide
taatacgactcactatagggagtaggatatgcagtcaccacctggcccataacagaggagaatgggcatggtggtgactaacctggcggcagcgcaaaagatg

SEQ ID NO: 104648 - DNA, 103 bp, Artificial Sequence
  Synthetic Polynucleotide
taatacgactcactataggggtgtagcaaaagtaggatatgcagtcaccaaacagaggagatggtgaatgcatatcctaaacctggcggcagcgcaaaagatg

SEQ ID NO: 104649 - DNA, 103 bp, Artificial Sequence
  Synthetic Polynucleotide
taatacgactcactatagggtgttgctgttgtgtagcaaaagtaggatataacagaggagaatatccatgttttgctacaacctggcggcagcgcaaaagatg

SEQ ID NO: 104650 - DNA, 103 bp, Artificial Sequence
  Synthetic Polynucleotide
taatacgactcactatagggtgtctgtgactgttgctgttgtgtagcaaaaacagaggagatttgctatgcaacagcaaaacctggcggcagcgcaaaagatg

SEQ ID NO: 104651 - DNA, 103 bp, Artificial Sequence
  Synthetic Polynucleotide
taatacgactcactatagggttactgacaatgtctgtgactgttgctgttaacagaggagaaacagcatgagtcacagaaacctggcggcagcgcaaaagatg

SEQ ID NO: 104652 - DNA, 103 bp, Artificial Sequence
  Synthetic Polynucleotide
taatacgactcactatagggtgctgctgcgttactgacaatgtctgtgacaacagaggagagtcacaatgattgtcagtaacctggcggcagcgcaaaagatg

SEQ ID NO: 104653 - DNA, 103 bp, Artificial Sequence
  Synthetic Polynucleotide
taatacgactcactatagggctgctgctgctgctgctgcgttactgacaaaacagaggagattgtcaatgacgcagcagaacctggcggcagcgcaaaagatg

SEQ ID NO: 104654 - DNA, 103 bp, Artificial Sequence
  Synthetic Polynucleotide
taatacgactcactatagggcctgggagctctgctgctgctgctgctgcgaacagaggagacgcagcatgagcagcagcaacctggcggcagcgcaaaagatg

SEQ ID NO: 104655 - DNA, 103 bp, Artificial Sequence
  Synthetic Polynucleotide
taatacgactcactatagggagctgctgctcctgggagctctgctgctgcaacagaggagagcagcaatggagctcccaaacctggcggcagcgcaaaagatg

SEQ ID NO: 104656 - DNA, 103 bp, Artificial Sequence
  Synthetic Polynucleotide
taatacgactcactatagggaactgaagtgagctgctgctcctgggagctaacagaggagaagctccatggagcagcagaacctggcggcagcgcaaaagatg

SEQ ID NO: 104657 - DNA, 103 bp, Artificial Sequence
  Synthetic Polynucleotide
taatacgactcactataggggttttcgtaaaaaatcaatgcttttctgcaaacagaggagatgcagaatggcattgattaacctggcggcagcgcaaaagatg

SEQ ID NO: 104658 - DNA, 103 bp, Artificial Sequence
  Synthetic Polynucleotide
taatacgactcactatagggatggttgctgaactgaagtgagctgctgctaacagaggagaagcagcatgtcacttcagaacctggcggcagcgcaaaagatg

SEQ ID NO: 104659 - DNA, 103 bp, Artificial Sequence
  Synthetic Polynucleotide
taatacgactcactatagggtgagcctgagatggttgctgaactgaagtgaacagaggagacacttcatgtcagcaaccaacctggcggcagcgcaaaagatg

SEQ ID NO: 104660 - DNA, 103 bp, Artificial Sequence
  Synthetic Polynucleotide
taatacgactcactatagggctgggtcagctgagcctgagatggttgctgaacagaggagacagcaaatgtctcaggctaacctggcggcagcgcaaaagatg

SEQ ID NO: 104661 - DNA, 103 bp, Artificial Sequence
  Synthetic Polynucleotide
taatacgactcactataggggttgcggtggctgggtcagctgagcctgagaacagaggagactcaggatgagctgacccaacctggcggcagcgcaaaagatg

SEQ ID NO: 104662 - DNA, 103 bp, Artificial Sequence
  Synthetic Polynucleotide
taatacgactcactatagggtgtaaaaattgttgcggtggctgggtcagcaacagaggagagctgacatggccaccgcaaacctggcggcagcgcaaaagatg

SEQ ID NO: 104663 - DNA, 103 bp, Artificial Sequence
  Synthetic Polynucleotide
taatacgactcactatagggcctagaagtctgtaaaaattgttgcggtggaacagaggagaccaccgatgcaatttttaaacctggcggcagcgcaaaagatg

SEQ ID NO: 104664 - DNA, 103 bp, Artificial Sequence
  Synthetic Polynucleotide
taatacgactcactatagggcatggagcaacctagaagtctgtaaaaattaacagaggagaaattttatgagacttctaaacctggcggcagcgcaaaagatg

SEQ ID NO: 104665 - DNA, 103 bp, Artificial Sequence
  Synthetic Polynucleotide
taatacgactcactataggggagggattcccatggagcaacctagaagtcaacagaggagagacttcatggttgctccaaacctggcggcagcgcaaaagatg

SEQ ID NO: 104666 - DNA, 103 bp, Artificial Sequence
  Synthetic Polynucleotide
taatacgactcactataggggagttgagttgagggattcccatggagcaaaacagaggagattgctcatggggaatcccaacctggcggcagcgcaaaagatg

SEQ ID NO: 104667 - DNA, 103 bp, Artificial Sequence
  Synthetic Polynucleotide
taatacgactcactatagggcagagagaatgagttgagttgagggattccaacagaggagaggaatcatgcaactcaacaacctggcggcagcgcaaaagatg

SEQ ID NO: 104668 - DNA, 103 bp, Artificial Sequence
  Synthetic Polynucleotide
taatacgactcactatagggatttctttatgttttcgtaaaaaatcaatgaacagaggagacattgaatgtttacgaaaaacctggcggcagcgcaaaagatg

SEQ ID NO: 104669 - DNA, 103 bp, Artificial Sequence
  Synthetic Polynucleotide
taatacgactcactatagggggaaatgcagcagagagaatgagttgagttaacagaggagaaactcaatgcattctctcaacctggcggcagcgcaaaagatg

SEQ ID NO: 104670 - DNA, 103 bp, Artificial Sequence
  Synthetic Polynucleotide
taatacgactcactatagggctgttgtagaggaaatgcagcagagagaataacagaggagaattctcatggctgcatttaacctggcggcagcgcaaaagatg

SEQ ID NO: 104671 - DNA, 103 bp, Artificial Sequence
  Synthetic Polynucleotide
taatacgactcactatagggggaaggtgctctgttgtagaggaaatgcagaacagaggagactgcatatgctctacaacaacctggcggcagcgcaaaagatg

SEQ ID NO: 104672 - DNA, 103 bp, Artificial Sequence
  Synthetic Polynucleotide
taatacgactcactatagggtgtgactgagggaaggtgctctgttgtagaaacagaggagatctacaatggagcaccttaacctggcggcagcgcaaaagatg

SEQ ID NO: 104673 - DNA, 103 bp, Artificial Sequence
  Synthetic Polynucleotide
taatacgactcactatagggttgctggtgatgtgactgagggaaggtgctaacagaggagaagcaccatgcctcagtcaaacctggcggcagcgcaaaagatg

SEQ ID NO: 104674 - DNA, 103 bp, Artificial Sequence
  Synthetic Polynucleotide
taatacgactcactataggggagactgatgttgctggtgatgtgactgagaacagaggagactcagtatgatcaccagcaacctggcggcagcgcaaaagatg

SEQ ID NO: 104675 - DNA, 103 bp, Artificial Sequence
  Synthetic Polynucleotide
taatacgactcactatagggtgctgttgctgagactgatgttgctggtgaaacagaggagatcaccaatgacatcagtcaacctggcggcagcgcaaaagatg

SEQ ID NO: 104676 - DNA, 103 bp, Artificial Sequence
  Synthetic Polynucleotide
taatacgactcactataggggctgagttgctgctgttgctgagactgatgaacagaggagacatcagatgcagcaacagaacctggcggcagcgcaaaagatg

SEQ ID NO: 104677 - DNA, 103 bp, Artificial Sequence
  Synthetic Polynucleotide
taatacgactcactatagggtcctgtgccggctgagttgctgctgttgctaacagaggagaagcaacatgagcaactcaaacctggcggcagcgcaaaagatg

SEQ ID NO: 104678 - DNA, 103 bp, Artificial Sequence
  Synthetic Polynucleotide
taatacgactcactatagggaagctgtcagtcctgtgccggctgagttgcaacagaggagagcaactatgccggcacagaacctggcggcagcgcaaaagatg

SEQ ID NO: 104679 - DNA, 103 bp, Artificial Sequence
  Synthetic Polynucleotide
taatacgactcactatagggctgtgcagtgatttctttatgttttcgtaaaacagaggagattacgaatgcataaagaaaacctggcggcagcgcaaaagatg

SEQ ID NO: 104680 - DNA, 103 bp, Artificial Sequence
  Synthetic Polynucleotide
taatacgactcactatagggagggtcgggcaagctgtcagtcctgtgccgaacagaggagacggcacatgactgacagcaacctggcggcagcgcaaaagatg

SEQ ID NO: 104681 - DNA, 103 bp, Artificial Sequence
  Synthetic Polynucleotide
taatacgactcactataggggaaccttggaagggtcgggcaagctgtcagaacagaggagactgacaatgtgcccgaccaacctggcggcagcgcaaaagatg

SEQ ID NO: 104682 - DNA, 103 bp, Artificial Sequence
  Synthetic Polynucleotide
taatacgactcactatagggtactgtggttgaaccttggaagggtcgggcaacagaggagagcccgaatgttccaaggtaacctggcggcagcgcaaaagatg

SEQ ID NO: 104683 - DNA, 103 bp, Artificial Sequence
  Synthetic Polynucleotide
taatacgactcactatagggtagcatctgactgtgcagtgatttctttataacagaggagaataaagatgtcactgcacaacctggcggcagcgcaaaagatg

SEQ ID NO: 104684 - DNA, 103 bp, Artificial Sequence
  Synthetic Polynucleotide
taatacgactcactatagggcgaatttcactagcatctgactgtgcagtgaacagaggagacactgcatggtcagatgcaacctggcggcagcgcaaaagatg

SEQ ID NO: 104685 - DNA, 103 bp, Artificial Sequence
  Synthetic Polynucleotide
taatacgactcactatagggccagtcctgtcgaatttcactagcatctgaaacagaggagatcagatatgagtgaaattaacctggcggcagcgcaaaagatg

SEQ ID NO: 104686 - DNA, 103 bp, Artificial Sequence
  Synthetic Polynucleotide
taatacgactcactatagggatgtaggtttccagtcctgtcgaatttcacaacagaggagagtgaaaatggacaggactaacctggcggcagcgcaaaagatg

SEQ ID NO: 104687 - DNA, 103 bp, Artificial Sequence
  Synthetic Polynucleotide
taatacgactcactatagggtctctgtcaacaatcgagctcattttactaaacagaggagatagtaaatggagctcgataacctggcggcagcgcaaaagatg

SEQ ID NO: 104688 - DNA, 103 bp, Artificial Sequence
  Synthetic Polynucleotide
taatacgactcactatagggttactaaggaatgtaggtttccagtcctgtaacagaggagaacaggaatggaaacctacaacctggcggcagcgcaaaagatg

SEQ ID NO: 104689 - DNA, 103 bp, Artificial Sequence
  Synthetic Polynucleotide
taatacgactcactatagggaaactcttcattactaaggaatgtaggtttaacagaggagaaaacctatgttccttagtaacctggcggcagcgcaaaagatg

SEQ ID NO: 104690 - DNA, 103 bp, Artificial Sequence
  Synthetic Polynucleotide
taatacgactcactatagggttaattgtgtaaactcttcattactaaggaaacagaggagatccttaatgatgaagagtaacctggcggcagcgcaaaagatg

SEQ ID NO: 104691 - DNA, 103 bp, Artificial Sequence
  Synthetic Polynucleotide
taatacgactcactataggggcctctaacattaattgtgtaaactcttcaaacagaggagatgaagaatgtacacaattaacctggcggcagcgcaaaagatg

SEQ ID NO: 104692 - DNA, 103 bp, Artificial Sequence
  Synthetic Polynucleotide
taatacgactcactatagggaccatcaagagcctctaacattaattgtgtaacagaggagaacacaaatgatgttagagaacctggcggcagcgcaaaagatg

SEQ ID NO: 104693 - DNA, 103 bp, Artificial Sequence
  Synthetic Polynucleotide
taatacgactcactatagggctaaaaaaaaaccatcaagagcctctaacaaacagaggagatgttagatgctcttgatgaacctggcggcagcgcaaaagatg

SEQ ID NO: 104694 - DNA, 103 bp, Artificial Sequence
  Synthetic Polynucleotide
taatacgactcactataggggtcatgattgctaaaaaaaaaccatcaagaaacagaggagatcttgaatgtttttttttaacctggcggcagcgcaaaagatg

SEQ ID NO: 104695 - DNA, 103 bp, Artificial Sequence
  Synthetic Polynucleotide
taatacgactcactataggggcttccatctgtcatgattgctaaaaaaaaaacagaggagattttttatggcaatcatgaacctggcggcagcgcaaaagatg

SEQ ID NO: 104696 - DNA, 103 bp, Artificial Sequence
  Synthetic Polynucleotide
taatacgactcactatagggcatatattatgcttccatctgtcatgattgaacagaggagacaatcaatgcagatggaaaacctggcggcagcgcaaaagatg

SEQ ID NO: 104697 - DNA, 103 bp, Artificial Sequence
  Synthetic Polynucleotide
taatacgactcactatagggctctcagacacatatattatgcttccatctaacagaggagaagatggatgcataatataaacctggcggcagcgcaaaagatg

SEQ ID NO: 104698 - DNA, 103 bp, Artificial Sequence
  Synthetic Polynucleotide
taatacgactcactatagggactactgtcatctctgtcaacaatcgagctaacagaggagaagctcgatggttgacagaaacctggcggcagcgcaaaagatg

SEQ ID NO: 104699 - DNA, 103 bp, Artificial Sequence
  Synthetic Polynucleotide
taatacgactcactatagggtgaagttacactctcagacacatatattataacagaggagaataataatggtgtctgagaacctggcggcagcgcaaaagatg

SEQ ID NO: 104700 - DNA, 103 bp, Artificial Sequence
  Synthetic Polynucleotide
taatacgactcactataggggttcaagtaatgaagttacactctcagacaaacagaggagatgtctgatggtgtaacttaacctggcggcagcgcaaaagatg

SEQ ID NO: 104701 - DNA, 103 bp, Artificial Sequence
  Synthetic Polynucleotide
taatacgactcactataggggatggtaaatgttcaagtaatgaagttacaaacagaggagatgtaacatgattacttgaaacctggcggcagcgcaaaagatg

SEQ ID NO: 104702 - DNA, 103 bp, Artificial Sequence
  Synthetic Polynucleotide
taatacgactcactatagggcacaagatcagatggtaaatgttcaagtaaaacagaggagattacttatgcatttaccaaacctggcggcagcgcaaaagatg

SEQ ID NO: 104703 - DNA, 103 bp, Artificial Sequence
  Synthetic Polynucleotide
taatacgactcactatagggtactttgatccacaagatcagatggtaaataacagaggagaatttacatgctgatcttgaacctggcggcagcgcaaaagatg

SEQ ID NO: 104704 - DNA, 103 bp, Artificial Sequence
  Synthetic Polynucleotide
taatacgactcactatagggaaattaaatatactttgatccacaagatcaaacagaggagatgatctatgggatcaaagaacctggcggcagcgcaaaagatg

SEQ ID NO: 104705 - DNA, 103 bp, Artificial Sequence
  Synthetic Polynucleotide
taatacgactcactatagggttctgggataaaattaaatatactttgatcaacagaggagagatcaaatgatatttaataacctggcggcagcgcaaaagatg

SEQ ID NO: 104706 - DNA, 103 bp, Artificial Sequence
  Synthetic Polynucleotide
taatacgactcactatagggaatgttccccttctgggataaaattaaataaacagaggagatatttaatgttatcccagaacctggcggcagcgcaaaagatg

SEQ ID NO: 104707 - DNA, 103 bp, Artificial Sequence
  Synthetic Polynucleotide
taatacgactcactatagggtaaacctctgaatgttccccttctgggataaacagaggagatatcccatgaggggaacaaacctggcggcagcgcaaaagatg

SEQ ID NO: 104708 - DNA, 103 bp, Artificial Sequence
  Synthetic Polynucleotide
taatacgactcactataggggagtattttataaacctctgaatgttccccaacagaggagaggggaaatgtcagaggttaacctggcggcagcgcaaaagatg

SEQ ID NO: 104709 - DNA, 103 bp, Artificial Sequence
  Synthetic Polynucleotide
taatacgactcactatagggcatcaaaaatactactgtcatctctgtcaaaacagaggagattgacaatgatgacagtaaacctggcggcagcgcaaaagatg

SEQ ID NO: 104710 - DNA, 103 bp, Artificial Sequence
  Synthetic Polynucleotide
taatacgactcactataggggatgagtagagagtattttataaacctctgaacagaggagacagaggatgataaaatacaacctggcggcagcgcaaaagatg

SEQ ID NO: 104711 - DNA, 103 bp, Artificial Sequence
  Synthetic Polynucleotide
taatacgactcactatagggctttccagcagatgagtagagagtattttaaacagaggagataaaatatgctctactcaaacctggcggcagcgcaaaagatg

SEQ ID NO: 104712 - DNA, 103 bp, Artificial Sequence
  Synthetic Polynucleotide
taatacgactcactatagggtaatgaatcactttccagcagatgagtagaaacagaggagatctactatgctgctggaaaacctggcggcagcgcaaaagatg

SEQ ID NO: 104713 - DNA, 103 bp, Artificial Sequence
  Synthetic Polynucleotide
taatacgactcactatagggattctggggttaatgaatcactttccagcaaacagaggagatgctggatggtgattcataacctggcggcagcgcaaaagatg

SEQ ID NO: 104714 - DNA, 103 bp, Artificial Sequence
  Synthetic Polynucleotide
taatacgactcactataggggattttaaatattctggggttaatgaatcaaacagaggagatgattcatgaaccccagaaacctggcggcagcgcaaaagatg

SEQ ID NO: 104715 - DNA, 103 bp, Artificial Sequence
  Synthetic Polynucleotide
taatacgactcactatagggctgattttttgattttaaatattctggggtaacagaggagaaccccaatgtatttaaaaaacctggcggcagcgcaaaagatg

SEQ ID NO: 104716 - DNA, 103 bp, Artificial Sequence
  Synthetic Polynucleotide
taatacgactcactatagggagaattctaactgattttttgattttaaataacagaggagaatttaaatgcaaaaaatcaacctggcggcagcgcaaaagatg

SEQ ID NO: 104717 - DNA, 103 bp, Artificial Sequence
  Synthetic Polynucleotide
taatacgactcactatagggatgtgacaacagaattctaactgattttttaacagaggagaaaaaaaatggttagaattaacctggcggcagcgcaaaagatg

SEQ ID NO: 104718 - DNA, 103 bp, Artificial Sequence
  Synthetic Polynucleotide
taatacgactcactatagggtcctcgcagcatgtgacaacagaattctaaaacagaggagattagaaatgtgttgtcacaacctggcggcagcgcaaaagatg

SEQ ID NO: 104719 - DNA, 103 bp, Artificial Sequence
  Synthetic Polynucleotide
taatacgactcactatagggggtctattgttcctcgcagcatgtgacaacaacagaggagagttgtcatgtgctgcgagaacctggcggcagcgcaaaagatg

SEQ ID NO: 104720 - DNA, 103 bp, Artificial Sequence
  Synthetic Polynucleotide
taatacgactcactatagggtccaccaacccatcaaaaatactactgtcaaacagaggagatgacagatgtatttttgaaacctggcggcagcgcaaaagatg

SEQ ID NO: 104721 - DNA, 103 bp, Artificial Sequence
  Synthetic Polynucleotide
taatacgactcactatagggggctcctttgggtctattgttcctcgcagcaacagaggagagctgcgatgaacaatagaaacctggcggcagcgcaaaagatg

SEQ ID NO: 104722 - DNA, 103 bp, Artificial Sequence
  Synthetic Polynucleotide
taatacgactcactatagggataggtagatggctcctttgggtctattgtaacagaggagaacaataatgccaaaggagaacctggcggcagcgcaaaagatg

SEQ ID NO: 104723 - DNA, 103 bp, Artificial Sequence
  Synthetic Polynucleotide
taatacgactcactatagggttacatattcataggtagatggctcctttgaacagaggagacaaaggatgcatctacctaacctggcggcagcgcaaaagatg

SEQ ID NO: 104724 - DNA, 103 bp, Artificial Sequence
  Synthetic Polynucleotide
taatacgactcactatagggcctataaattttacatattcataggtagataacagaggagaatctacatgtgaatatgtaacctggcggcagcgcaaaagatg

SEQ ID NO: 104725 - DNA, 103 bp, Artificial Sequence
  Synthetic Polynucleotide
taatacgactcactatagggtttgaaatttcctataaattttacatattcaacagaggagagaatatatgaaatttataaacctggcggcagcgcaaaagatg

SEQ ID NO: 104726 - DNA, 103 bp, Artificial Sequence
  Synthetic Polynucleotide
taatacgactcactatagggtgtttaaagatttgaaatttcctataaattaacagaggagaaatttaatggaaatttcaaacctggcggcagcgcaaaagatg

SEQ ID NO: 104727 - DNA, 103 bp, Artificial Sequence
  Synthetic Polynucleotide
taatacgactcactataggggaggatacactgtttaaagatttgaaatttaacagaggagaaaatttatgatctttaaaaacctggcggcagcgcaaaagatg

SEQ ID NO: 104728 - DNA, 103 bp, Artificial Sequence
  Synthetic Polynucleotide
taatacgactcactataggggtgtgctgaagaggatacactgtttaaagaaacagaggagatctttaatgagtgtatccaacctggcggcagcgcaaaagatg

SEQ ID NO: 104729 - DNA, 103 bp, Artificial Sequence
  Synthetic Polynucleotide
taatacgactcactatagggcaaaaccattgtgtgctgaagaggatacacaacagaggagagtgtatatgcttcagcacaacctggcggcagcgcaaaagatg

SEQ ID NO: 104730 - DNA, 103 bp, Artificial Sequence
  Synthetic Polynucleotide
taatacgactcactatagggatagttccttcaaaaccattgtgtgctgaaaacagaggagattcagcatgcaatggtttaacctggcggcagcgcaaaagatg

SEQ ID NO: 104731 - DNA, 103 bp, Artificial Sequence
  Synthetic Polynucleotide
taatacgactcactataggggtcatcttcttccaccaacccatcaaaaataacagaggagaatttttatggggttggtgaacctggcggcagcgcaaaagatg

SEQ ID NO: 104732 - DNA, 103 bp, Artificial Sequence
  Synthetic Polynucleotide
taatacgactcactatagggtgtgcgttgtatagttccttcaaaaccattaacagaggagaaatggtatggaaggaactaacctggcggcagcgcaaaagatg

SEQ ID NO: 104733 - DNA, 103 bp, Artificial Sequence
  Synthetic Polynucleotide
taatacgactcactatagggatggcctatgtgtgcgttgtatagttccttaacagaggagaaaggaaatgtacaacgcaaacctggcggcagcgcaaaagatg

SEQ ID NO: 104734 - DNA, 103 bp, Artificial Sequence
  Synthetic Polynucleotide
taatacgactcactatagggtcttcataagatggcctatgtgtgcgttgtaacagaggagaacaacgatgacataggccaacctggcggcagcgcaaaagatg

SEQ ID NO: 104735 - DNA, 103 bp, Artificial Sequence
  Synthetic Polynucleotide
taatacgactcactatagggacaaactctatcttcataagatggcctatgaacagaggagacataggatgtcttatgaaaacctggcggcagcgcaaaagatg

SEQ ID NO: 104736 - DNA, 103 bp, Artificial Sequence
  Synthetic Polynucleotide
taatacgactcactatagggtagctacaaaacaaactctatcttcataagaacagaggagacttatgatgatagagtttaacctggcggcagcgcaaaagatg

SEQ ID NO: 104737 - DNA, 103 bp, Artificial Sequence
  Synthetic Polynucleotide
taatacgactcactatagggaacctgacagtagctacaaaacaaactctaaacagaggagatagagtatgttttgtagcaacctggcggcagcgcaaaagatg

SEQ ID NO: 104738 - DNA, 103 bp, Artificial Sequence
  Synthetic Polynucleotide
taatacgactcactatagggaggtgtagctaacctgacagtagctacaaaaacagaggagatttgtaatgactgtcaggaacctggcggcagcgcaaaagatg

SEQ ID NO: 104739 - DNA, 103 bp, Artificial Sequence
  Synthetic Polynucleotide
taatacgactcactatagggtgatgaactgaggtgtagctaacctgacagaacagaggagactgtcaatgtagctacacaacctggcggcagcgcaaaagatg

SEQ ID NO: 104740 - DNA, 103 bp, Artificial Sequence
  Synthetic Polynucleotide
taatacgactcactatagggcacatttccttgatgaactgaggtgtagctaacagaggagaagctacatgtcagttcataacctggcggcagcgcaaaagatg

SEQ ID NO: 104741 - DNA, 103 bp, Artificial Sequence
  Synthetic Polynucleotide
taatacgactcactatagggttcaacagtgcacatttccttgatgaactgaacagaggagacagttcatgaaggaaatgaacctggcggcagcgcaaaagatg

SEQ ID NO: 104742 - DNA, 103 bp, Artificial Sequence
  Synthetic Polynucleotide
taatacgactcactatagggctttgtccttgtcatcttcttccaccaaccaacagaggagaggttggatgaagaagatgaacctggcggcagcgcaaaagatg

SEQ ID NO: 104743 - DNA, 103 bp, Artificial Sequence
  Synthetic Polynucleotide
taatacgactcactatagggcattgggttcttcaacagtgcacatttcctaacagaggagaaggaaaatggcactgttgaacctggcggcagcgcaaaagatg

SEQ ID NO: 104744 - DNA, 103 bp, Artificial Sequence
  Synthetic Polynucleotide
taatacgactcactataggggtaaactcttcattgggttcttcaacagtgaacagaggagacactgtatgagaacccaaaacctggcggcagcgcaaaagatg

SEQ ID NO: 104745 - DNA, 103 bp, Artificial Sequence
  Synthetic Polynucleotide
taatacgactcactatagggatgtctagatgtaaactcttcattgggttcaacagaggagagaacccatggaagagtttaacctggcggcagcgcaaaagatg

SEQ ID NO: 104746 - DNA, 103 bp, Artificial Sequence
  Synthetic Polynucleotide
taatacgactcactatagggattctaaactatgtctagatgtaaactcttaacagaggagaaagagtatgcatctagacaacctggcggcagcgcaaaagatg

SEQ ID NO: 104747 - DNA, 103 bp, Artificial Sequence
  Synthetic Polynucleotide
taatacgactcactatagggagaaacttccattctaaactatgtctagataacagaggagaatctagatgtagtttagaaacctggcggcagcgcaaaagatg

SEQ ID NO: 104748 - DNA, 103 bp, Artificial Sequence
  Synthetic Polynucleotide
taatacgactcactatagggatctagaaacagaaacttccattctaaactaacagaggagaagtttaatgtggaagtttaacctggcggcagcgcaaaagatg

SEQ ID NO: 104749 - DNA, 103 bp, Artificial Sequence
  Synthetic Polynucleotide
taatacgactcactataggggtgccctgtgatctagaaacagaaacttccaacagaggagaggaagtatgtgtttctagaacctggcggcagcgcaaaagatg

SEQ ID NO: 104750 - DNA, 103 bp, Artificial Sequence
  Synthetic Polynucleotide
taatacgactcactatagggattatgggtggtgccctgtgatctagaaacaacagaggagagtttctatgtcacagggcaacctggcggcagcgcaaaagatg

SEQ ID NO: 104751 - DNA, 103 bp, Artificial Sequence
  Synthetic Polynucleotide
taatacgactcactatagggcaaataccctattatgggtggtgccctgtgaacagaggagacacaggatgccacccataaacctggcggcagcgcaaaagatg

SEQ ID NO: 104752 - DNA, 103 bp, Artificial Sequence
  Synthetic Polynucleotide
taatacgactcactatagggcttcaaatggcaaataccctattatgggtgaacagaggagacacccaatgtagggtattaacctggcggcagcgcaaaagatg

SEQ ID NO: 104753 - DNA, 103 bp, Artificial Sequence
  Synthetic Polynucleotide
taatacgactcactatagggactcttttcgctttgtccttgtcatcttctaacagaggagaagaagaatgcaaggacaaaacctggcggcagcgcaaaagatg

SEQ ID NO: 104754 - DNA, 103 bp, Artificial Sequence
  Synthetic Polynucleotide
taatacgactcactataggggttcccagaacttcaaatggcaaataccctaacagaggagaagggtaatggccatttgaaacctggcggcagcgcaaaagatg

SEQ ID NO: 104755 - DNA, 103 bp, Artificial Sequence
  Synthetic Polynucleotide
taatacgactcactatagggatagcctgatgttcccagaacttcaaatggaacagaggagaccatttatggttctgggaaacctggcggcagcgcaaaagatg

SEQ ID NO: 104756 - DNA, 103 bp, Artificial Sequence
  Synthetic Polynucleotide
taatacgactcactataggggatagtaatcatagcctgatgttcccagaaaacagaggagattctggatgcatcaggctaacctggcggcagcgcaaaagatg

SEQ ID NO: 104757 - DNA, 103 bp, Artificial Sequence
  Synthetic Polynucleotide
taatacgactcactatagggtcatccacatgatagtaatcatagcctgataacagaggagaatcaggatgtgattactaaacctggcggcagcgcaaaagatg

SEQ ID NO: 104758 - DNA, 103 bp, Artificial Sequence
  Synthetic Polynucleotide
taatacgactcactatagggattttctaggtcatccacatgatagtaatcaacagaggagagattacatgcatgtggataacctggcggcagcgcaaaagatg

SEQ ID NO: 104759 - DNA, 103 bp, Artificial Sequence
  Synthetic Polynucleotide
taatacgactcactatagggattttgccaaattttctaggtcatccacataacagaggagaatgtggatgacctagaaaaacctggcggcagcgcaaaagatg

SEQ ID NO: 104760 - DNA, 103 bp, Artificial Sequence
  Synthetic Polynucleotide
taatacgactcactatagggtgctcatgacattttgccaaattttctaggaacagaggagacctagaatgtttggcaaaaacctggcggcagcgcaaaagatg

SEQ ID NO: 104761 - DNA, 103 bp, Artificial Sequence
  Synthetic Polynucleotide
taatacgactcactatagggttgcattaagtgctcatgacattttgccaaaacagaggagattggcaatgtgtcatgagaacctggcggcagcgcaaaagatg

SEQ ID NO: 104762 - DNA, 103 bp, Artificial Sequence
  Synthetic Polynucleotide
taatacgactcactatagggctttcccatattgcattaagtgctcatgacaacagaggagagtcatgatgacttaatgcaacctggcggcagcgcaaaagatg

SEQ ID NO: 104763 - DNA, 103 bp, Artificial Sequence
  Synthetic Polynucleotide
taatacgactcactatagggcatgatttgcctttcccatattgcattaagaacagaggagacttaatatgatatgggaaaacctggcggcagcgcaaaagatg

SEQ ID NO: 104764 - DNA, 103 bp, Artificial Sequence
  Synthetic Polynucleotide
taatacgactcactatagggtccacacttgaagcactcattgctgctcataacagaggagaatgagcatgaatgagtgcaacctggcggcagcgcaaaagatg

SEQ ID NO: 104765 - DNA, 103 bp, Artificial Sequence
  Synthetic Polynucleotide
taatacgactcactatagggatccgaggtaaaaccacctctgccacggctaacagaggagaagccgtatgagaggtggtaacctggcggcagcgcaaaagatg

SEQ ID NO: 104766 - DNA, 103 bp, Artificial Sequence
  Synthetic Polynucleotide
taatacgactcactatagggggaaacctctatccgaggtaaaaccacctcaacagaggagagaggtgatgttacctcggaacctggcggcagcgcaaaagatg

SEQ ID NO: 104767 - DNA, 103 bp, Artificial Sequence
  Synthetic Polynucleotide
taatacgactcactataggggaaacaaactggaaacctctatccgaggtaaacagaggagatacctcatgtagaggtttaacctggcggcagcgcaaaagatg

SEQ ID NO: 104768 - DNA, 103 bp, Artificial Sequence
  Synthetic Polynucleotide
taatacgactcactatagggaagagacgaggaaacaaactggaaacctctaacagaggagaagaggtatgcagtttgttaacctggcggcagcgcaaaagatg

SEQ ID NO: 104769 - DNA, 103 bp, Artificial Sequence
  Synthetic Polynucleotide
taatacgactcactatagggaaatgtctggaagagacgaggaaacaaactaacagaggagaagtttgatgcctcgtctcaacctggcggcagcgcaaaagatg

SEQ ID NO: 104770 - DNA, 103 bp, Artificial Sequence
  Synthetic Polynucleotide
taatacgactcactatagggcagcgataacaaatgtctggaagagacgagaacagaggagactcgtcatgtccagacataacctggcggcagcgcaaaagatg

SEQ ID NO: 104771 - DNA, 103 bp, Artificial Sequence
  Synthetic Polynucleotide
taatacgactcactatagggagactcaccacagcgataacaaatgtctggaacagaggagaccagacatgtgttatcgcaacctggcggcagcgcaaaagatg

SEQ ID NO: 104772 - DNA, 103 bp, Artificial Sequence
  Synthetic Polynucleotide
taatacgactcactatagggcaagatgaccagactcaccacagcgataacaacagaggagagttatcatggtggtgagtaacctggcggcagcgcaaaagatg

SEQ ID NO: 104773 - DNA, 103 bp, Artificial Sequence
  Synthetic Polynucleotide
taatacgactcactatagggcaatccttggcaagatgaccagactcaccaaacagaggagatggtgaatgtggtcatctaacctggcggcagcgcaaaagatg

SEQ ID NO: 104774 - DNA, 103 bp, Artificial Sequence
  Synthetic Polynucleotide
taatacgactcactatagggctgaagatcacaatccttggcaagatgaccaacagaggagaggtcatatggccaaggataacctggcggcagcgcaaaagatg

SEQ ID NO: 104775 - DNA, 103 bp, Artificial Sequence
  Synthetic Polynucleotide
taatacgactcactatagggggccagatcgtccacacttgaagcactcataacagaggagaatgagtatgtcaagtgtgaacctggcggcagcgcaaaagatg

SEQ ID NO: 104776 - DNA, 103 bp, Artificial Sequence
  Synthetic Polynucleotide
taatacgactcactatagggaggcatcctcctgaagatcacaatccttggaacagaggagaccaaggatggtgatcttcaacctggcggcagcgcaaaagatg

SEQ ID NO: 104777 - DNA, 103 bp, Artificial Sequence
  Synthetic Polynucleotide
taatacgactcactatagggcagttatagcaggcatcctcctgaagatcaaacagaggagatgatctatgggaggatgcaacctggcggcagcgcaaaagatg

SEQ ID NO: 104778 - DNA, 103 bp, Artificial Sequence
  Synthetic Polynucleotide
taatacgactcactatagggacctctaccgcagttatagcaggcatcctcaacagaggagagaggatatgtgctataacaacctggcggcagcgcaaaagatg

SEQ ID NO: 104779 - DNA, 103 bp, Artificial Sequence
  Synthetic Polynucleotide
taatacgactcactatagggcaatgtggccacctctaccgcagttatagcaacagaggagagctataatggcggtagagaacctggcggcagcgcaaaagatg

SEQ ID NO: 104780 - DNA, 103 bp, Artificial Sequence
  Synthetic Polynucleotide
taatacgactcactatagggcagtccttggcaatgtggccacctctaccgaacagaggagacggtagatgtggccacataacctggcggcagcgcaaaagatg

SEQ ID NO: 104781 - DNA, 103 bp, Artificial Sequence
  Synthetic Polynucleotide
taatacgactcactataggggggctccttgcagtccttggcaatgtggccaacagaggagaggccacatggccaaggacaacctggcggcagcgcaaaagatg

SEQ ID NO: 104782 - DNA, 103 bp, Artificial Sequence
  Synthetic Polynucleotide
taatacgactcactataggggctctctcttgggctccttgcagtccttggaacagaggagaccaaggatggcaaggagcaacctggcggcagcgcaaaagatg

SEQ ID NO: 104783 - DNA, 103 bp, Artificial Sequence
  Synthetic Polynucleotide
taatacgactcactatagggcattgctctcgctctctcttgggctccttgaacagaggagacaaggaatgcaagagagaaacctggcggcagcgcaaaagatg

SEQ ID NO: 104784 - DNA, 103 bp, Artificial Sequence
  Synthetic Polynucleotide
taatacgactcactataggggttgtagcagcattgctctcgctctctcttaacagaggagaaagagaatgcgagagcaaaacctggcggcagcgcaaaagatg

SEQ ID NO: 104785 - DNA, 103 bp, Artificial Sequence
  Synthetic Polynucleotide
taatacgactcactataggggtttgccacagttgtagcagcattgctctcaacagaggagagagagcatggctgctacaaacctggcggcagcgcaaaagatg

SEQ ID NO: 104786 - DNA, 103 bp, Artificial Sequence
  Synthetic Polynucleotide
taatacgactcactatagggcgggcccagtggccagatcgtccacacttgaacagaggagacaagtgatgacgatctggaacctggcggcagcgcaaaagatg

SEQ ID NO: 104787 - DNA, 103 bp, Artificial Sequence
  Synthetic Polynucleotide
taatacgactcactatagggagatggcctggtttgccacagttgtagcagaacagaggagactgctaatgctgtggcaaaacctggcggcagcgcaaaagatg

SEQ ID NO: 104788 - DNA, 103 bp, Artificial Sequence
  Synthetic Polynucleotide
taatacgactcactataggggtcacgagccagatggcctggtttgccacaaacagaggagatgtggcatgccaggccataacctggcggcagcgcaaaagatg

SEQ ID NO: 104789 - DNA, 103 bp, Artificial Sequence
  Synthetic Polynucleotide
taatacgactcactatagggcatggtcgcagtcacgagccagatggcctgaacagaggagacaggccatgtggctcgtgaacctggcggcagcgcaaaagatg

SEQ ID NO: 104790 - DNA, 103 bp, Artificial Sequence
  Synthetic Polynucleotide
taatacgactcactatagggtgctcatctgcatggtcgcagtcacgagccaacagaggagaggctcgatgctgcgaccaaacctggcggcagcgcaaaagatg

SEQ ID NO: 104791 - DNA, 103 bp, Artificial Sequence
  Synthetic Polynucleotide
taatacgactcactatagggatagcatttctgctcatctgcatggtcgcaaacagaggagatgcgacatggcagatgagaacctggcggcagcgcaaaagatg

SEQ ID NO: 104792 - DNA, 103 bp, Artificial Sequence
  Synthetic Polynucleotide
taatacgactcactatagggctccacaagaatagcatttctgctcatctgaacagaggagacagatgatgagaaatgctaacctggcggcagcgcaaaagatg

SEQ ID NO: 104793 - DNA, 103 bp, Artificial Sequence
  Synthetic Polynucleotide
taatacgactcactatagggtgtccgaattctccacaagaatagcatttcaacagaggagagaaatgatgttcttgtggaacctggcggcagcgcaaaagatg

SEQ ID NO: 104794 - DNA, 103 bp, Artificial Sequence
  Synthetic Polynucleotide
taatacgactcactatagggtttttgaatgtgtccgaattctccacaagaaacagaggagatcttgtatggaattcggaaacctggcggcagcgcaaaagatg

SEQ ID NO: 104795 - DNA, 103 bp, Artificial Sequence
  Synthetic Polynucleotide
taatacgactcactatagggtggtgcagtctttttgaatgtgtccgaattaacagaggagaaattcgatgacattcaaaaacctggcggcagcgcaaaagatg

SEQ ID NO: 104796 - DNA, 103 bp, Artificial Sequence
  Synthetic Polynucleotide
taatacgactcactatagggcacttcactttggtgcagtctttttgaatgaacagaggagacattcaatgagactgcacaacctggcggcagcgcaaaagatg

SEQ ID NO: 104797 - DNA, 103 bp, Artificial Sequence
  Synthetic Polynucleotide
taatacgactcactatagggaggacattcccgggcccagtggccagatcgaacagaggagacgatctatgcactgggccaacctggcggcagcgcaaaagatg

SEQ ID NO: 104798 - DNA, 103 bp, Artificial Sequence
  Synthetic Polynucleotide
taatacgactcactatagggacacctatagcacttcactttggtgcagtcaacagaggagagactgcatgaaagtgaagaacctggcggcagcgcaaaagatg

SEQ ID NO: 104799 - DNA, 103 bp, Artificial Sequence
  Synthetic Polynucleotide
taatacgactcactatagggcagtttcaccacacctatagcacttcacttaacagaggagaaagtgaatggctataggtaacctggcggcagcgcaaaagatg

SEQ ID NO: 104800 - DNA, 103 bp, Artificial Sequence
  Synthetic Polynucleotide
taatacgactcactataggggctacatgaccagtttcaccacacctatagaacagaggagactatagatgtggtgaaacaacctggcggcagcgcaaaagatg

SEQ ID NO: 104801 - DNA, 103 bp, Artificial Sequence
  Synthetic Polynucleotide
taatacgactcactataggggcagttgatggctacatgaccagtttcaccaacagaggagaggtgaaatgggtcatgtaaacctggcggcagcgcaaaagatg

SEQ ID NO: 104802 - DNA, 103 bp, Artificial Sequence
  Synthetic Polynucleotide
taatacgactcactatagggttgtcttgctgcagttgatggctacatgacaacagaggagagtcatgatgccatcaactaacctggcggcagcgcaaaagatg

SEQ ID NO: 104803 - DNA, 103 bp, Artificial Sequence
  Synthetic Polynucleotide
taatacgactcactatagggttgacttcacttgtcttgctgcagttgatgaacagaggagacatcaaatgcagcaagacaacctggcggcagcgcaaaagatg

SEQ ID NO: 104804 - DNA, 103 bp, Artificial Sequence
  Synthetic Polynucleotide
taatacgactcactataggggcggtaacagttgacttcacttgtcttgctaacagaggagaagcaagatgagtgaagtcaacctggcggcagcgcaaaagatg

SEQ ID NO: 104805 - DNA, 103 bp, Artificial Sequence
  Synthetic Polynucleotide
taatacgactcactatagggactcgccacagcggtaacagttgacttcacaacagaggagagtgaagatgactgttaccaacctggcggcagcgcaaaagatg

SEQ ID NO: 104806 - DNA, 103 bp, Artificial Sequence
  Synthetic Polynucleotide
taatacgactcactatagggaggtgccctgactcgccacagcggtaacagaacagaggagactgttaatgctgtggcgaaacctggcggcagcgcaaaagatg

SEQ ID NO: 104807 - DNA, 103 bp, Artificial Sequence
  Synthetic Polynucleotide
taatacgactcactatagggttcccgtgcaaggtgccctgactcgccacaaacagaggagatgtggcatgtcagggcacaacctggcggcagcgcaaaagatg

SEQ ID NO: 104808 - DNA, 103 bp, Artificial Sequence
  Synthetic Polynucleotide
taatacgactcactatagggctccaccagtaggacattcccgggcccagtaacagaggagaactgggatggggaatgtcaacctggcggcagcgcaaaagatg

SEQ ID NO: 104809 - DNA, 103 bp, Artificial Sequence
  Synthetic Polynucleotide
taatacgactcactatagggcaattgtgcattcccgtgcaaggtgccctgaacagaggagacagggcatgttgcacgggaacctggcggcagcgcaaaagatg

SEQ ID NO: 104810 - DNA, 103 bp, Artificial Sequence
  Synthetic Polynucleotide
taatacgactcactataggggctgtagcctcaattgtgcattcccgtgcaaacagaggagatgcacgatgatgcacaataacctggcggcagcgcaaaagatg

SEQ ID NO: 104811 - DNA, 103 bp, Artificial Sequence
  Synthetic Polynucleotide
taatacgactcactatagggcgaccacggcctccaccagtaggacattccaacagaggagaggaatgatgtactggtggaacctggcggcagcgcaaaagatg

SEQ ID NO: 104812 - DNA, 103 bp, Artificial Sequence
  Synthetic Polynucleotide
taatacgactcactatagggtctcattccacgaccacggcctccaccagtaacagaggagaactggtatgggccgtggtaacctggcggcagcgcaaaagatg

SEQ ID NO: 104813 - DNA, 103 bp, Artificial Sequence
  Synthetic Polynucleotide
taatacgactcactatagggtgccacggcttctcattccacgaccacggcaacagaggagagccgtgatggtggaatgaaacctggcggcagcgcaaaagatg

SEQ ID NO: 104814 - DNA, 103 bp, Artificial Sequence
  Synthetic Polynucleotide
taatacgactcactatagggaaaccacctctgccacggcttctcattccaaacagaggagatggaatatgaagccgtggaacctggcggcagcgcaaaagatg

SEQ ID NO: 104815 - DNA, 103 bp, Artificial Sequence
  Synthetic Polynucleotide
taatacgactcactatagggctggttctcggctccagattccatggtcataacagaggagaatgaccatggaatctggaaacctggcggcagcgcaaaagatg

SEQ ID NO: 104816 - DNA, 103 bp, Artificial Sequence
  Synthetic Polynucleotide
taatacgactcactatagggagatacctgggctaatgtggcaatctgtggaacagaggagaccacagatggccacattaaacctggcggcagcgcaaaagatg

SEQ ID NO: 104817 - DNA, 103 bp, Artificial Sequence
  Synthetic Polynucleotide
taatacgactcactatagggctgctggcatagatacctgggctaatgtggaacagaggagaccacatatgcccaggtataacctggcggcagcgcaaaagatg

SEQ ID NO: 104818 - DNA, 103 bp, Artificial Sequence
  Synthetic Polynucleotide
taatacgactcactataggggttgcatgagctgctggcatagatacctggaacagaggagaccaggtatgtatgccagcaacctggcggcagcgcaaaagatg

SEQ ID NO: 104819 - DNA, 103 bp, Artificial Sequence
  Synthetic Polynucleotide
taatacgactcactatagggagcagatgatgttgcatgagctgctggcataacagaggagaatgccaatggctcatgcaaacctggcggcagcgcaaaagatg

SEQ ID NO: 104820 - DNA, 103 bp, Artificial Sequence
  Synthetic Polynucleotide
taatacgactcactatagggttacggtgggagcagatgatgttgcatgagaacagaggagactcatgatgcatcatctgaacctggcggcagcgcaaaagatg

SEQ ID NO: 104821 - DNA, 103 bp, Artificial Sequence
  Synthetic Polynucleotide
taatacgactcactatagggtgtactagagttacggtgggagcagatgataacagaggagaatcatcatgtcccaccgtaacctggcggcagcgcaaaagatg

SEQ ID NO: 104822 - DNA, 103 bp, Artificial Sequence
  Synthetic Polynucleotide
taatacgactcactatagggattgggcagctgtactagagttacggtgggaacagaggagacccaccatgactctagtaaacctggcggcagcgcaaaagatg

SEQ ID NO: 104823 - DNA, 103 bp, Artificial Sequence
  Synthetic Polynucleotide
taatacgactcactatagggctgtctgcccattgggcagctgtactagagaacagaggagactctagatgagctgcccaaacctggcggcagcgcaaaagatg

SEQ ID NO: 104824 - DNA, 103 bp, Artificial Sequence
  Synthetic Polynucleotide
taatacgactcactatagggtggacttgaactgtctgcccattgggcagcaacagaggagagctgccatgtgggcagacaacctggcggcagcgcaaaagatg

SEQ ID NO: 104825 - DNA, 103 bp, Artificial Sequence
  Synthetic Polynucleotide
taatacgactcactatagggaatgactccatggacttgaactgtctgcccaacagaggagagggcagatggttcaagtcaacctggcggcagcgcaaaagatg

SEQ ID NO: 104826 - DNA, 103 bp, Artificial Sequence
  Synthetic Polynucleotide
taatacgactcactatagggctccactctgctggttctcggctccagattaacagaggagaaatctgatgccgagaaccaacctggcggcagcgcaaaagatg

SEQ ID NO: 104827 - DNA, 103 bp, Artificial Sequence
  Synthetic Polynucleotide
taatacgactcactataggggggccgcctgaatgactccatggacttgaaaacagaggagattcaagatgatggagtcaaacctggcggcagcgcaaaagatg

SEQ ID NO: 104828 - DNA, 103 bp, Artificial Sequence
  Synthetic Polynucleotide
taatacgactcactatagggactgatggctgggccgcctgaatgactccaaacagaggagatggagtatgtcaggcggcaacctggcggcagcgcaaaagatg

SEQ ID NO: 104829 - DNA, 103 bp, Artificial Sequence
  Synthetic Polynucleotide
taatacgactcactatagggagactgaataactgatggctgggccgcctgaacagaggagacaggcgatgcagccatcaaacctggcggcagcgcaaaagatg

SEQ ID NO: 104830 - DNA, 103 bp, Artificial Sequence
  Synthetic Polynucleotide
taatacgactcactatagggggacttgtggagactgaataactgatggctaacagaggagaagccatatgttattcagtaacctggcggcagcgcaaaagatg

SEQ ID NO: 104831 - DNA, 103 bp, Artificial Sequence
  Synthetic Polynucleotide
taatacgactcactatagggtgaactgtttggacttgtggagactgaataaacagaggagatattcaatgtccacaagtaacctggcggcagcgcaaaagatg

SEQ ID NO: 104832 - DNA, 103 bp, Artificial Sequence
  Synthetic Polynucleotide
taatacgactcactatagggagttgaaatctgaactgtttggacttgtggaacagaggagaccacaaatgcaaacagttaacctggcggcagcgcaaaagatg

SEQ ID NO: 104833 - DNA, 103 bp, Artificial Sequence
  Synthetic Polynucleotide
taatacgactcactatagggtttctgcaatagttgaaatctgaactgtttaacagaggagaaaacagatgagatttcaaaacctggcggcagcgcaaaagatg

SEQ ID NO: 104834 - DNA, 103 bp, Artificial Sequence
  Synthetic Polynucleotide
taatacgactcactataggggaatcttcactttctgcaatagttgaaatcaacagaggagagatttcatgtattgcagaaacctggcggcagcgcaaaagatg

SEQ ID NO: 104835 - DNA, 103 bp, Artificial Sequence
  Synthetic Polynucleotide
taatacgactcactatagggtgactcctgtgaatcttcactttctgcaataacagaggagaattgcaatgagtgaagataacctggcggcagcgcaaaagatg

SEQ ID NO: 104836 - DNA, 103 bp, Artificial Sequence
  Synthetic Polynucleotide
taatacgactcactatagggcactatccactgactcctgtgaatcttcacaacagaggagagtgaagatgcacaggagtaacctggcggcagcgcaaaagatg

SEQ ID NO: 104837 - DNA, 103 bp, Artificial Sequence
  Synthetic Polynucleotide
taatacgactcactatagggacagctgcatctccactctgctggttctcgaacagaggagacgagaaatggcagagtggaacctggcggcagcgcaaaagatg

SEQ ID NO: 104838 - DNA, 103 bp, Artificial Sequence
  Synthetic Polynucleotide
taatacgactcactataggggaatcagttacactatccactgactcctgtaacagaggagaacaggaatgagtggatagaacctggcggcagcgcaaaagatg

SEQ ID NO: 104839 - DNA, 103 bp, Artificial Sequence
  Synthetic Polynucleotide
taatacgactcactatagggtcgcttttgggaatcagttacactatccacaacagaggagagtggatatggtaactgataacctggcggcagcgcaaaagatg

SEQ ID NO: 104840 - DNA, 103 bp, Artificial Sequence
  Synthetic Polynucleotide
taatacgactcactataggggaatttcccttcgcttttgggaatcagttaaacagaggagataactgatgcccaaaagcaacctggcggcagcgcaaaagatg

SEQ ID NO: 104841 - DNA, 103 bp, Artificial Sequence
  Synthetic Polynucleotide
taatacgactcactatagggctccttgaaagaatttcccttcgcttttggaacagaggagaccaaaaatgaagggaaataacctggcggcagcgcaaaagatg

SEQ ID NO: 104842 - DNA, 103 bp, Artificial Sequence
  Synthetic Polynucleotide
taatacgactcactataggggtaggaaggcctccttgaaagaatttccctaacagaggagaagggaaatgctttcaaggaacctggcggcagcgcaaaagatg

SEQ ID NO: 104843 - DNA, 103 bp, Artificial Sequence
  Synthetic Polynucleotide
taatacgactcactatagggaaattttcctgtaggaaggcctccttgaaaaacagaggagatttcaaatgggccttcctaacctggcggcagcgcaaaagatg

SEQ ID NO: 104844 - DNA, 103 bp, Artificial Sequence
  Synthetic Polynucleotide
taatacgactcactatagggaagtcattcaaaattttcctgtaggaaggcaacagaggagagccttcatgcaggaaaataacctggcggcagcgcaaaagatg

SEQ ID NO: 104845 - DNA, 103 bp, Artificial Sequence
  Synthetic Polynucleotide
taatacgactcactatagggatcagaagataagtcattcaaaattttcctaacagaggagaaggaaaatgttgaatgacaacctggcggcagcgcaaaagatg

SEQ ID NO: 104846 - DNA, 103 bp, Artificial Sequence
  Synthetic Polynucleotide
taatacgactcactatagggctcctggtgcatcagaagataagtcattcaaacagaggagatgaatgatgtatcttctgaacctggcggcagcgcaaaagatg

SEQ ID NO: 104847 - DNA, 103 bp, Artificial Sequence
  Synthetic Polynucleotide
taatacgactcactatagggatccttggcactcctggtgcatcagaagataacagaggagaatcttcatgtgcaccaggaacctggcggcagcgcaaaagatg

SEQ ID NO: 104848 - DNA, 103 bp, Artificial Sequence
  Synthetic Polynucleotide
taatacgactcactatagggagcttctgttacagctgcatctccactctgaacagaggagacagagtatggatgcagctaacctggcggcagcgcaaaagatg

SEQ ID NO: 104849 - DNA, 103 bp, Artificial Sequence
  Synthetic Polynucleotide
taatacgactcactatagggctcttcttcaatccttggcactcctggtgcaacagaggagagcaccaatggtgccaaggaacctggcggcagcgcaaaagatg

SEQ ID NO: 104850 - DNA, 103 bp, Artificial Sequence
  Synthetic Polynucleotide
taatacgactcactatagggcttcagacttctcttcttcaatccttggcaaacagaggagatgccaaatgttgaagaagaacctggcggcagcgcaaaagatg

SEQ ID NO: 104851 - DNA, 103 bp, Artificial Sequence
  Synthetic Polynucleotide
taatacgactcactataggggaagtctcctcttcagacttctcttcttcaaacagaggagatgaagaatggaagtctgaaacctggcggcagcgcaaaagatg

SEQ ID NO: 104852 - DNA, 103 bp, Artificial Sequence
  Synthetic Polynucleotide
taatacgactcactatagggggcaggtgctgaagtctcctcttcagacttaacagaggagaaagtctatggaggagactaacctggcggcagcgcaaaagatg

SEQ ID NO: 104853 - DNA, 103 bp, Artificial Sequence
  Synthetic Polynucleotide
taatacgactcactatagggcagtggtgatggcaggtgctgaagtctcctaacagaggagaaggagaatgcagcacctgaacctggcggcagcgcaaaagatg

SEQ ID NO: 104854 - DNA, 103 bp, Artificial Sequence
  Synthetic Polynucleotide
taatacgactcactatagggggcaccgttacagtggtgatggcaggtgctaacagaggagaagcaccatgcatcaccacaacctggcggcagcgcaaaagatg

SEQ ID NO: 104855 - DNA, 103 bp, Artificial Sequence
  Synthetic Polynucleotide
taatacgactcactatagggaattggagttggcaccgttacagtggtgataacagaggagaatcaccatggtaacggtgaacctggcggcagcgcaaaagatg

SEQ ID NO: 104856 - DNA, 103 bp, Artificial Sequence
  Synthetic Polynucleotide
taatacgactcactatagggtagtttggtaaattggagttggcaccgttaaacagaggagataacggatgcaactccaaaacctggcggcagcgcaaaagatg

SEQ ID NO: 104857 - DNA, 103 bp, Artificial Sequence
  Synthetic Polynucleotide
taatacgactcactatagggtgtccactgctagtttggtaaattggagttaacagaggagaaactccatgttaccaaacaacctggcggcagcgcaaaagatg

SEQ ID NO: 104858 - DNA, 103 bp, Artificial Sequence
  Synthetic Polynucleotide
taatacgactcactatagggggcaatatactgtccactgctagtttggtaaacagaggagataccaaatgagcagtggaaacctggcggcagcgcaaaagatg

SEQ ID NO: 104859 - DNA, 103 bp, Artificial Sequence
  Synthetic Polynucleotide
taatacgactcactataggggttggttttcagcttctgttacagctgcataacagaggagaatgcagatgtaacagaagaacctggcggcagcgcaaaagatg

SEQ ID NO: 104860 - DNA, 103 bp, Artificial Sequence
  Synthetic Polynucleotide
taatacgactcactatagggcctgggtaatggcaatatactgtccactgcaacagaggagagcagtgatgagtatattgaacctggcggcagcgcaaaagatg

SEQ ID NO: 104861 - DNA, 103 bp, Artificial Sequence
  Synthetic Polynucleotide
taatacgactcactatagggattgctcctccctgggtaatggcaatatacaacagaggagagtatatatgcattacccaaacctggcggcagcgcaaaagatg

SEQ ID NO: 104862 - DNA, 103 bp, Artificial Sequence
  Synthetic Polynucleotide
taatacgactcactatagggagccagctgtattgctcctccctgggtaataacagaggagaattaccatgggaggagcaaacctggcggcagcgcaaaagatg

SEQ ID NO: 104863 - DNA, 103 bp, Artificial Sequence
  Synthetic Polynucleotide
taatacgactcactatagggtaccattgttagccagctgtattgctcctcaacagaggagagaggagatgtacagctggaacctggcggcagcgcaaaagatg

SEQ ID NO: 104864 - DNA, 103 bp, Artificial Sequence
  Synthetic Polynucleotide
taatacgactcactatagggaccccatcggtaccattgttagccagctgtaacagaggagaacagctatgtaacaatggaacctggcggcagcgcaaaagatg

SEQ ID NO: 104865 - DNA, 103 bp, Artificial Sequence
  Synthetic Polynucleotide
taatacgactcactatagggcaggccctgtaccccatcggtaccattgttaacagaggagaaacaatatgaccgatgggaacctggcggcagcgcaaaagatg

SEQ ID NO: 104866 - DNA, 103 bp, Artificial Sequence
  Synthetic Polynucleotide
taatacgactcactatagggttaatgtttgcaggccctgtaccccatcggaacagaggagaccgatgatgtacagggccaacctggcggcagcgcaaaagatg

SEQ ID NO: 104867 - DNA, 103 bp, Artificial Sequence
  Synthetic Polynucleotide
taatacgactcactatagggttggtcatggttaatgtttgcaggccctgtaacagaggagaacagggatggcaaacattaacctggcggcagcgcaaaagatg

SEQ ID NO: 104868 - DNA, 103 bp, Artificial Sequence
  Synthetic Polynucleotide
taatacgactcactatagggggctgctgcattggtcatggttaatgtttgaacagaggagacaaacaatgaccatgaccaacctggcggcagcgcaaaagatg

SEQ ID NO: 104869 - DNA, 103 bp, Artificial Sequence
  Synthetic Polynucleotide
taatacgactcactatagggccggctgagtggctgctgcattggtcatggaacagaggagaccatgaatgatgcagcagaacctggcggcagcgcaaaagatg

SEQ ID NO: 104870 - DNA, 103 bp, Artificial Sequence
  Synthetic Polynucleotide
taatacgactcactatagggactgtcatttgttggttttcagcttctgttaacagaggagaaacagaatgtgaaaaccaaacctggcggcagcgcaaaagatg

SEQ ID NO: 104871 - DNA, 103 bp, Artificial Sequence
  Synthetic Polynucleotide
taatacgactcactatagggatggtagtacccggctgagtggctgctgcaaacagaggagatgcagcatgcactcagccaacctggcggcagcgcaaaagatg

SEQ ID NO: 104872 - DNA, 103 bp, Artificial Sequence
  Synthetic Polynucleotide
taatacgactcactatagggatactgtagaatggtagtacccggctgagtaacagaggagaactcagatgggtactaccaacctggcggcagcgcaaaagatg

SEQ ID NO: 104873 - DNA, 103 bp, Artificial Sequence
  Synthetic Polynucleotide
taatacgactcactatagggtggtctgtgcatactgtagaatggtagtacaacagaggagagtactaatgttctacagtaacctggcggcagcgcaaaagatg

SEQ ID NO: 104874 - DNA, 103 bp, Artificial Sequence
  Synthetic Polynucleotide
taatacgactcactatagggtgtccatcagtggtctgtgcatactgtagaaacagaggagatctacaatgtgcacagacaacctggcggcagcgcaaaagatg

SEQ ID NO: 104875 - DNA, 103 bp, Artificial Sequence
  Synthetic Polynucleotide
taatacgactcactatagggtaagatctgctgtccatcagtggtctgtgcaacagaggagagcacagatgactgatggaaacctggcggcagcgcaaaagatg

SEQ ID NO: 104876 - DNA, 103 bp, Artificial Sequence
  Synthetic Polynucleotide
taatacgactcactatagggtgctgggcactaagatctgctgtccatcagaacagaggagactgatgatgagcagatctaacctggcggcagcgcaaaagatg

SEQ ID NO: 104877 - DNA, 103 bp, Artificial Sequence
  Synthetic Polynucleotide
taatacgactcactatagggacaacttggttgctgggcactaagatctgcaacagaggagagcagatatgagtgcccagaacctggcggcagcgcaaaagatg

SEQ ID NO: 104878 - DNA, 103 bp, Artificial Sequence
  Synthetic Polynucleotide
taatacgactcactatagggagcttgaacaacaacttggttgctgggcacaacagaggagagtgcccatgaaccaagttaacctggcggcagcgcaaaagatg

SEQ ID NO: 104879 - DNA, 103 bp, Artificial Sequence
  Synthetic Polynucleotide
taatacgactcactatagggctccagaggcagcttgaacaacaacttggtaacagaggagaaccaagatgttgttcaagaacctggcggcagcgcaaaagatg

SEQ ID NO: 104880 - DNA, 103 bp, Artificial Sequence
  Synthetic Polynucleotide
taatacgactcactataggggtttgtacgtctccagaggcagcttgaacaaacagaggagatgttcaatgtgcctctggaacctggcggcagcgcaaaagatg

SEQ ID NO: 104881 - DNA, 103 bp, Artificial Sequence
  Synthetic Polynucleotide
taatacgactcactatagggctgggcttgaactgtcatttgttggttttcaacagaggagagaaaacatgcaaatgacaaacctggcggcagcgcaaaagatg

SEQ ID NO: 104882 - DNA, 103 bp, Artificial Sequence
  Synthetic Polynucleotide
taatacgactcactatagggaatctggtatgtttgtacgtctccagaggcaacagaggagagcctctatggacgtacaaaacctggcggcagcgcaaaagatg

SEQ ID NO: 104883 - DNA, 103 bp, Artificial Sequence
  Synthetic Polynucleotide
taatacgactcactataggggtgctgtgcgaatctggtatgtttgtacgtaacagaggagaacgtacatgcataccagaaacctggcggcagcgcaaaagatg

SEQ ID NO: 104884 - DNA, 103 bp, Artificial Sequence
  Synthetic Polynucleotide
taatacgactcactataggggtgctagtgggtgctgtgcgaatctggtataacagaggagaataccaatgtcgcacagcaacctggcggcagcgcaaaagatg

SEQ ID NO: 104885 - DNA, 103 bp, Artificial Sequence
  Synthetic Polynucleotide
taatacgactcactatagggaggggcaatagtgctagtgggtgctgtgcgaacagaggagacgcacaatgcccactagcaacctggcggcagcgcaaaagatg

SEQ ID NO: 104886 - DNA, 103 bp, Artificial Sequence
  Synthetic Polynucleotide
taatacgactcactatagggtaacaactccaggggcaatagtgctagtggaacagaggagaccactaatgctattgcccaacctggcggcagcgcaaaagatg

SEQ ID NO: 104887 - DNA, 103 bp, Artificial Sequence
  Synthetic Polynucleotide
taatacgactcactataggggaggatgccataacaactccaggggcaataaacagaggagatattgcatgtggagttgtaacctggcggcagcgcaaaagatg

SEQ ID NO: 104888 - DNA, 103 bp, Artificial Sequence
  Synthetic Polynucleotide
taatacgactcactatagggaagtgctggggaggatgccataacaactccaacagaggagaggagttatgatggcatccaacctggcggcagcgcaaaagatg

SEQ ID NO: 104889 - DNA, 103 bp, Artificial Sequence
  Synthetic Polynucleotide
taatacgactcactataggggctgtgtaggaagtgctggggaggatgccaaacagaggagatggcatatgccccagcacaacctggcggcagcgcaaaagatg

SEQ ID NO: 104890 - DNA, 103 bp, Artificial Sequence
  Synthetic Polynucleotide
taatacgactcactatagggtcttcagcaggctgtgtaggaagtgctgggaacagaggagacccagcatgtcctacacaaacctggcggcagcgcaaaagatg

SEQ ID NO: 104891 - DNA, 103 bp, Artificial Sequence
  Synthetic Polynucleotide
taatacgactcactatagggtcgtgctgcttcttcagcaggctgtgtaggaacagaggagacctacaatgcctgctgaaaacctggcggcagcgcaaaagatg

SEQ ID NO: 104892 - DNA, 103 bp, Artificial Sequence
  Synthetic Polynucleotide
taatacgactcactatagggcaatctgtggctgggcttgaactgtcatttaacagaggagaaaatgaatgttcaagcccaacctggcggcagcgcaaaagatg

SEQ ID NO: 104893 - DNA, 103 bp, Artificial Sequence
  Synthetic Polynucleotide
taatacgactcactatagggcctctctctttcgtgctgcttcttcagcagaacagaggagactgctgatgaagcagcacaacctggcggcagcgcaaaagatg

SEQ ID NO: 104894 - DNA, 103 bp, Artificial Sequence
  Synthetic Polynucleotide
taatacgactcactatagggattagacggacctctctctttcgtgctgctaacagaggagaagcagcatgaaagagagaaacctggcggcagcgcaaaagatg

SEQ ID NO: 104895 - DNA, 103 bp, Artificial Sequence
  Synthetic Polynucleotide
taatacgactcactatagggcctgttcttcattagacggacctctctcttaacagaggagaaagagaatggtccgtctaaacctggcggcagcgcaaaagatg

SEQ ID NO: 104896 - DNA, 103 bp, Artificial Sequence
  Synthetic Polynucleotide
taatacgactcactataggggagctgcttccctgttcttcattagacggaaacagaggagatccgtcatgtgaagaacaaacctggcggcagcgcaaaagatg

SEQ ID NO: 104897 - DNA, 103 bp, Artificial Sequence
  Synthetic Polynucleotide
taatacgactcactatagggcgacactctcgagctgcttccctgttcttcaacagaggagagaagaaatgggaagcagcaacctggcggcagcgcaaaagatg

SEQ ID NO: 104898 - DNA, 103 bp, Artificial Sequence
  Synthetic Polynucleotide
taatacgactcactatagggcttctttctacgacactctcgagctgcttcaacagaggagagaagcaatgcgagagtgtaacctggcggcagcgcaaaagatg

SEQ ID NO: 104899 - DNA, 103 bp, Artificial Sequence
  Synthetic Polynucleotide
taatacgactcactatagggcatattctttcttctttctacgacactctcaacagaggagagagagtatggtagaaagaaacctggcggcagcgcaaaagatg

SEQ ID NO: 104900 - DNA, 103 bp, Artificial Sequence
  Synthetic Polynucleotide
taatacgactcactatagggaaacatttcacatattctttcttctttctaaacagaggagatagaaaatggaaagaataaacctggcggcagcgcaaaagatg

SEQ ID NO: 104901 - DNA, 103 bp, Artificial Sequence
  Synthetic Polynucleotide
taatacgactcactatagggtctgttttctaaacatttcacatattctttaacagaggagaaaagaaatggtgaaatgtaacctggcggcagcgcaaaagatg

SEQ ID NO: 104902 - DNA, 103 bp, Artificial Sequence
  Synthetic Polynucleotide
taatacgactcactataggggcactgccactctgttttctaaacatttcaaacagaggagatgaaatatgtagaaaacaaacctggcggcagcgcaaaagatg

SEQ ID NO: 104903 - DNA, 103 bp, Artificial Sequence
  Synthetic Polynucleotide
taatacgactcactataggggctaatgtggcaatctgtggctgggcttgaaacagaggagatcaagcatggccacagataacctggcggcagcgcaaaagatg

SEQ ID NO: 104904 - DNA, 103 bp, Artificial Sequence
  Synthetic Polynucleotide
taatacgactcactatagggtgattttcaagcactgccactctgttttctaacagaggagaagaaaaatgagtggcagtaacctggcggcagcgcaaaagatg

SEQ ID NO: 104905 - DNA, 103 bp, Artificial Sequence
  Synthetic Polynucleotide
taatacgactcactatagggtgtcttgttttgattttcaagcactgccacaacagaggagagtggcaatgcttgaaaataacctggcggcagcgcaaaagatg

SEQ ID NO: 104906 - DNA, 103 bp, Artificial Sequence
  Synthetic Polynucleotide
taatacgactcactatagggcctcaatcaatgtcttgttttgattttcaaaacagaggagattgaaaatgaaaacaagaaacctggcggcagcgcaaaagatg

SEQ ID NO: 104907 - DNA, 103 bp, Artificial Sequence
  Synthetic Polynucleotide
taatacgactcactataggggcttttagctcctcaatcaatgtcttgtttaacagaggagaaaacaaatgattgattgaaacctggcggcagcgcaaaagatg

SEQ ID NO: 104908 - DNA, 103 bp, Artificial Sequence
  Synthetic Polynucleotide
taatacgactcactataggggtccttaagtgcttttagctcctcaatcaaaacagaggagattgattatggagctaaaaaacctggcggcagcgcaaaagatg

SEQ ID NO: 104909 - DNA, 103 bp, Artificial Sequence
  Synthetic Polynucleotide
taatacgactcactatagggggcagtaaaggtccttaagtgcttttagctaacagaggagaagctaaatgcacttaaggaacctggcggcagcgcaaaagatg

SEQ ID NO: 104910 - DNA, 103 bp, Artificial Sequence
  Synthetic Polynucleotide
taatacgactcactatagggtctgatttgtggcagtaaaggtccttaagtaacagaggagaacttaaatgcctttactgaacctggcggcagcgcaaaagatg

SEQ ID NO: 104911 - DNA, 103 bp, Artificial Sequence
  Synthetic Polynucleotide
taatacgactcactatagggttggtcaccagcatccaattccagctccataacagaggagaatggagatggaattggataacctggcggcagcgcaaaagatg

SEQ ID NO: 104912 - DNA, 103 bp, Artificial Sequence
  Synthetic Polynucleotide
taatacgactcactatagggcggcagcgcccagtccagtggggccctcacaacagaggagagtgaggatgccactggacaacctggcggcagcgcaaaagatg

SEQ ID NO: 104913 - DNA, 103 bp, Artificial Sequence
  Synthetic Polynucleotide
taatacgactcactatagggacctcggcagagaggctctgagaagaggtcaacagaggagagacctcatgtcagagcctaacctggcggcagcgcaaaagatg

SEQ ID NO: 104914 - DNA, 103 bp, Artificial Sequence
  Synthetic Polynucleotide
taatacgactcactatagggggaggatgggacctcggcagagaggctctgaacagaggagacagagcatgtctgccgagaacctggcggcagcgcaaaagatg

SEQ ID NO: 104915 - DNA, 103 bp, Artificial Sequence
  Synthetic Polynucleotide
taatacgactcactataggggcctgcagggggaggatgggacctcggcagaacagaggagactgccgatgtcccatcctaacctggcggcagcgcaaaagatg

SEQ ID NO: 104916 - DNA, 103 bp, Artificial Sequence
  Synthetic Polynucleotide
taatacgactcactatagggtgtgagatttgcctgcagggggaggatgggaacagaggagacccatcatgcccctgcagaacctggcggcagcgcaaaagatg

SEQ ID NO: 104917 - DNA, 103 bp, Artificial Sequence
  Synthetic Polynucleotide
taatacgactcactatagggctcccttccttgtgagatttgcctgcagggaacagaggagaccctgcatgcaaatctcaaacctggcggcagcgcaaaagatg

SEQ ID NO: 104918 - DNA, 103 bp, Artificial Sequence
  Synthetic Polynucleotide
taatacgactcactatagggggaagccatcctcccttccttgtgagatttaacagaggagaaaatctatgaaggaagggaacctggcggcagcgcaaaagatg

SEQ ID NO: 104919 - DNA, 103 bp, Artificial Sequence
  Synthetic Polynucleotide
taatacgactcactataggggctaccagtaggaagccatcctcccttcctaacagaggagaaggaagatgggatggcttaacctggcggcagcgcaaaagatg

SEQ ID NO: 104920 - DNA, 103 bp, Artificial Sequence
  Synthetic Polynucleotide
taatacgactcactatagggtgacagaggggctaccagtaggaagccatcaacagaggagagatggcatgctactggtaaacctggcggcagcgcaaaagatg

SEQ ID NO: 104921 - DNA, 103 bp, Artificial Sequence
  Synthetic Polynucleotide
taatacgactcactatagggtcctgcaaaatgacagaggggctaccagtaaacagaggagatactggatgcccctctgtaacctggcggcagcgcaaaagatg

SEQ ID NO: 104922 - DNA, 103 bp, Artificial Sequence
  Synthetic Polynucleotide
taatacgactcactatagggtgagtatctgtcctgcaaaatgacagagggaacagaggagaccctctatgattttgcagaacctggcggcagcgcaaaagatg

SEQ ID NO: 104923 - DNA, 103 bp, Artificial Sequence
  Synthetic Polynucleotide
taatacgactcactatagggcctcagaaagcggcagcgcccagtccagtgaacagaggagacactggatggggcgctgcaacctggcggcagcgcaaaagatg

SEQ ID NO: 104924 - DNA, 103 bp, Artificial Sequence
  Synthetic Polynucleotide
taatacgactcactatagggtcgctcggtacctcagaaagcggcagcgccaacagaggagaggcgctatggctttctgaaacctggcggcagcgcaaaagatg

SEQ ID NO: 104925 - DNA, 103 bp, Artificial Sequence
  Synthetic Polynucleotide
taatacgactcactatagggtacttcccagtcgctcggtacctcagaaagaacagaggagactttctatggtaccgagcaacctggcggcagcgcaaaagatg

SEQ ID NO: 104926 - DNA, 103 bp, Artificial Sequence
  Synthetic Polynucleotide
taatacgactcactataggggcaaatcatctacttcccagtcgctcggtaaacagaggagataccgaatgactgggaagaacctggcggcagcgcaaaagatg

SEQ ID NO: 104927 - DNA, 103 bp, Artificial Sequence
  Synthetic Polynucleotide
taatacgactcactatagggagggagcacagcaaatcatctacttcccagaacagaggagactgggaatgagatgatttaacctggcggcagcgcaaaagatg

SEQ ID NO: 104928 - DNA, 103 bp, Artificial Sequence
  Synthetic Polynucleotide
taatacgactcactataggggggactcagcagggagcacagcaaatcatcaacagaggagagatgatatgctgtgctccaacctggcggcagcgcaaaagatg

SEQ ID NO: 104929 - DNA, 103 bp, Artificial Sequence
  Synthetic Polynucleotide
taatacgactcactatagggacgacgctgggggactcagcagggagcacaaacagaggagatgtgctatgtgctgagtcaacctggcggcagcgcaaaagatg

SEQ ID NO: 104930 - DNA, 103 bp, Artificial Sequence
  Synthetic Polynucleotide
taatacgactcactatagggagaatgttcaacgacgctgggggactcagcaacagaggagagctgagatgcccagcgtcaacctggcggcagcgcaaaagatg

SEQ ID NO: 104931 - DNA, 103 bp, Artificial Sequence
  Synthetic Polynucleotide
taatacgactcactatagggggaggagctgagaatgttcaacgacgctggaacagaggagaccagcgatgttgaacattaacctggcggcagcgcaaaagatg

SEQ ID NO: 104932 - DNA, 103 bp, Artificial Sequence
  Synthetic Polynucleotide
taatacgactcactatagggccagcaggtcttggtcaccagcatccaattaacagaggagaaattggatgctggtgaccaacctggcggcagcgcaaaagatg

SEQ ID NO: 104933 - DNA, 103 bp, Artificial Sequence
  Synthetic Polynucleotide
taatacgactcactatagggggcaggggttggaggagctgagaatgttcaaacagaggagatgaacaatgtcagctcctaacctggcggcagcgcaaaagatg

SEQ ID NO: 104934 - DNA, 103 bp, Artificial Sequence
  Synthetic Polynucleotide
taatacgactcactatagggtggtggacaaggcaggggttggaggagctgaacagaggagacagctcatgcaacccctgaacctggcggcagcgcaaaagatg

SEQ ID NO: 104935 - DNA, 103 bp, Artificial Sequence
  Synthetic Polynucleotide
taatacgactcactatagggggtgtggtcatggtggacaaggcaggggttaacagaggagaaaccccatgcttgtccacaacctggcggcagcgcaaaagatg

SEQ ID NO: 104936 - DNA, 103 bp, Artificial Sequence
  Synthetic Polynucleotide
taatacgactcactatagggggagggagtaggtgtggtcatggtggacaaaacagaggagattgtccatgatgaccacaaacctggcggcagcgcaaaagatg

SEQ ID NO: 104937 - DNA, 103 bp, Artificial Sequence
  Synthetic Polynucleotide
taatacgactcactataggggtttcccgtgggagggagtaggtgtggtcaaacagaggagatgaccaatgctactccctaacctggcggcagcgcaaaagatg

SEQ ID NO: 104938 - DNA, 103 bp, Artificial Sequence
  Synthetic Polynucleotide
taatacgactcactatagggcatagagacagtttcccgtgggagggagtaaacagaggagatactccatgccacgggaaaacctggcggcagcgcaaaagatg

SEQ ID NO: 104939 - DNA, 103 bp, Artificial Sequence
  Synthetic Polynucleotide
taatacgactcactatagggtctctagatccatagagacagtttcccgtgaacagaggagacacgggatgctgtctctaaacctggcggcagcgcaaaagatg

SEQ ID NO: 104940 - DNA, 103 bp, Artificial Sequence
  Synthetic Polynucleotide
taatacgactcactatagggcagctctcactctctagatccatagagacaaacagaggagatgtctcatgggatctagaaacctggcggcagcgcaaaagatg

SEQ ID NO: 104941 - DNA, 103 bp, Artificial Sequence
  Synthetic Polynucleotide
taatacgactcactatagggctcttttctacagctctcactctctagatcaacagaggagagatctaatgagtgagagcaacctggcggcagcgcaaaagatg

SEQ ID NO: 104942 - DNA, 103 bp, Artificial Sequence
  Synthetic Polynucleotide
taatacgactcactatagggtctgggtcccctcttttctacagctctcacaacagaggagagtgagaatggtagaaaagaacctggcggcagcgcaaaagatg

SEQ ID NO: 104943 - DNA, 103 bp, Artificial Sequence
  Synthetic Polynucleotide
taatacgactcactatagggagcaggaaggccagcaggtcttggtcaccaaacagaggagatggtgaatgagacctgctaacctggcggcagcgcaaaagatg

SEQ ID NO: 104944 - DNA, 103 bp, Artificial Sequence
  Synthetic Polynucleotide
taatacgactcactatagggtgtggagtcatctgggtcccctcttttctaaacagaggagatagaaaatgggggacccaaacctggcggcagcgcaaaagatg

SEQ ID NO: 104945 - DNA, 103 bp, Artificial Sequence
  Synthetic Polynucleotide
taatacgactcactatagggctccatatgctgtggagtcatctgggtcccaacagaggagagggaccatgatgactccaaacctggcggcagcgcaaaagatg

SEQ ID NO: 104946 - DNA, 103 bp, Artificial Sequence
  Synthetic Polynucleotide
taatacgactcactatagggctgccagctcctccatatgctgtggagtcaaacagaggagatgactcatgagcatatggaacctggcggcagcgcaaaagatg

SEQ ID NO: 104947 - DNA, 103 bp, Artificial Sequence
  Synthetic Polynucleotide
taatacgactcactatagggatctcctgctctgccagctcctccatatgcaacagaggagagcatatatgggagctggcaacctggcggcagcgcaaaagatg

SEQ ID NO: 104948 - DNA, 103 bp, Artificial Sequence
  Synthetic Polynucleotide
taatacgactcactatagggtagcctagcaatctcctgctctgccagctcaacagaggagagagctgatggagcaggagaacctggcggcagcgcaaaagatg

SEQ ID NO: 104949 - DNA, 103 bp, Artificial Sequence
  Synthetic Polynucleotide
taatacgactcactatagggctgtcagtactagcctagcaatctcctgctaacagaggagaagcaggatgttgctaggcaacctggcggcagcgcaaaagatg

SEQ ID NO: 104950 - DNA, 103 bp, Artificial Sequence
  Synthetic Polynucleotide
taatacgactcactatagggttctcctcatctgtcagtactagcctagcaaacagaggagatgctagatgagtactgacaacctggcggcagcgcaaaagatg

SEQ ID NO: 104951 - DNA, 103 bp, Artificial Sequence
  Synthetic Polynucleotide
taatacgactcactatagggcaatagactcttctcctcatctgtcagtacaacagaggagagtactgatggatgaggagaacctggcggcagcgcaaaagatg

SEQ ID NO: 104952 - DNA, 103 bp, Artificial Sequence
  Synthetic Polynucleotide
taatacgactcactatagggcctccttctccaatagactcttctcctcataacagaggagaatgaggatgagagtctataacctggcggcagcgcaaaagatg

SEQ ID NO: 104953 - DNA, 103 bp, Artificial Sequence
  Synthetic Polynucleotide
taatacgactcactatagggagaataagcccctccttctccaatagactcaacagaggagagagtctatgggagaaggaaacctggcggcagcgcaaaagatg

SEQ ID NO: 104954 - DNA, 103 bp, Artificial Sequence
  Synthetic Polynucleotide
taatacgactcactatagggactttcctctagcaggaaggccagcaggtcaacagaggagagacctgatggccttcctgaacctggcggcagcgcaaaagatg

SEQ ID NO: 104955 - DNA, 103 bp, Artificial Sequence
  Synthetic Polynucleotide
taatacgactcactatagggtgtctcaggcagaataagcccctccttctcaacagaggagagagaagatggggcttattaacctggcggcagcgcaaaagatg

SEQ ID NO: 104956 - DNA, 103 bp, Artificial Sequence
  Synthetic Polynucleotide
taatacgactcactatagggtgagaggaagtgtctcaggcagaataagccaacagaggagaggcttaatgtgcctgagaaacctggcggcagcgcaaaagatg

SEQ ID NO: 104957 - DNA, 103 bp, Artificial Sequence
  Synthetic Polynucleotide
taatacgactcactatagggtctgtcttagtgagaggaagtgtctcaggcaacagaggagagcctgaatgacttcctctaacctggcggcagcgcaaaagatg

SEQ ID NO: 104958 - DNA, 103 bp, Artificial Sequence
  Synthetic Polynucleotide
taatacgactcactatagggaatttgttcctctgtcttagtgagaggaagaacagaggagacttcctatgactaagacaaacctggcggcagcgcaaaagatg

SEQ ID NO: 104959 - DNA, 103 bp, Artificial Sequence
  Synthetic Polynucleotide
taatacgactcactatagggcacgtttcagaatttgttcctctgtcttagaacagaggagactaagaatgaggaacaaaaacctggcggcagcgcaaaagatg

SEQ ID NO: 104960 - DNA, 103 bp, Artificial Sequence
  Synthetic Polynucleotide
taatacgactcactatagggttcctccgcacacgtttcagaatttgttccaacagaggagaggaacaatgtctgaaacgaacctggcggcagcgcaaaagatg

SEQ ID NO: 104961 - DNA, 103 bp, Artificial Sequence
  Synthetic Polynucleotide
taatacgactcactatagggatttcgaatcttcctccgcacacgtttcagaacagaggagactgaaaatggtgcggaggaacctggcggcagcgcaaaagatg

SEQ ID NO: 104962 - DNA, 103 bp, Artificial Sequence
  Synthetic Polynucleotide
taatacgactcactatagggcagatcttttatttcgaatcttcctccgcaaacagaggagatgcggaatgagattcgaaaacctggcggcagcgcaaaagatg

SEQ ID NO: 104963 - DNA, 103 bp, Artificial Sequence
  Synthetic Polynucleotide
taatacgactcactatagggctctcttgagcagatcttttatttcgaatcaacagaggagagattcgatgtaaaagatcaacctggcggcagcgcaaaagatg

SEQ ID NO: 104964 - DNA, 103 bp, Artificial Sequence
  Synthetic Polynucleotide
taatacgactcactatagggtttcctgcggctctcttgagcagatcttttaacagaggagaaaaagaatggctcaagagaacctggcggcagcgcaaaagatg

SEQ ID NO: 104965 - DNA, 103 bp, Artificial Sequence
  Synthetic Polynucleotide
taatacgactcactatagggccaaatctccactttcctctagcaggaaggaacagaggagaccttccatgtagaggaaaaacctggcggcagcgcaaaagatg

SEQ ID NO: 104966 - DNA, 103 bp, Artificial Sequence
  Synthetic Polynucleotide
taatacgactcactatagggacaccttctttttcctgcggctctcttgagaacagaggagactcaagatggccgcaggaaacctggcggcagcgcaaaagatg

SEQ ID NO: 104967 - DNA, 103 bp, Artificial Sequence
  Synthetic Polynucleotide
taatacgactcactatagggcccccaacatacaccttctttttcctgcggaacagaggagaccgcagatgaaagaaggtaacctggcggcagcgcaaaagatg

SEQ ID NO: 104968 - DNA, 103 bp, Artificial Sequence
  Synthetic Polynucleotide
taatacgactcactataggggctctctaaacccccaacatacaccttcttaacagaggagaaagaagatgtatgttgggaacctggcggcagcgcaaaagatg

SEQ ID NO: 104969 - DNA, 103 bp, Artificial Sequence
  Synthetic Polynucleotide
taatacgactcactatagggtcaagaccctgctctctaaacccccaacataacagaggagaatgttgatggtttagagaaacctggcggcagcgcaaaagatg

SEQ ID NO: 104970 - DNA, 103 bp, Artificial Sequence
  Synthetic Polynucleotide
taatacgactcactataggggctgtgtatttcaagaccctgctctctaaaaacagaggagatttagaatgcagggtcttaacctggcggcagcgcaaaagatg

SEQ ID NO: 104971 - DNA, 103 bp, Artificial Sequence
  Synthetic Polynucleotide
taatacgactcactatagggcatattctgggctgtgtatttcaagaccctaacagaggagaagggtcatgaaatacacaaacctggcggcagcgcaaaagatg

SEQ ID NO: 104972 - DNA, 103 bp, Artificial Sequence
  Synthetic Polynucleotide
taatacgactcactatagggtctgaagctccatattctgggctgtgtattaacagaggagaaatacaatgcccagaataaacctggcggcagcgcaaaagatg

SEQ ID NO: 104973 - DNA, 103 bp, Artificial Sequence
  Synthetic Polynucleotide
taatacgactcactatagggtgtactttgttctgaagctccatattctggaacagaggagaccagaaatgggagcttcaaacctggcggcagcgcaaaagatg

SEQ ID NO: 104974 - DNA, 103 bp, Artificial Sequence
  Synthetic Polynucleotide
taatacgactcactatagggctccagaagctgtactttgttctgaagctcaacagaggagagagcttatgaacaaagtaaacctggcggcagcgcaaaagatg

SEQ ID NO: 104975 - DNA, 103 bp, Artificial Sequence
  Synthetic Polynucleotide
taatacgactcactatagggaattctgttcctccagaagctgtactttgtaacagaggagaacaaagatgagcttctggaacctggcggcagcgcaaaagatg

SEQ ID NO: 104976 - DNA, 103 bp, Artificial Sequence
  Synthetic Polynucleotide
taatacgactcactatagggggtgccgtccccaaatctccactttcctctaacagaggagaagaggaatgtggagatttaacctggcggcagcgcaaaagatg

SEQ ID NO: 104977 - DNA, 103 bp, Artificial Sequence
  Synthetic Polynucleotide
taatacgactcactatagggagaagggacaaattctgttcctccagaagcaacagaggagagcttctatgggaacagaaaacctggcggcagcgcaaaagatg

SEQ ID NO: 104978 - DNA, 103 bp, Artificial Sequence
  Synthetic Polynucleotide
taatacgactcactatagggcagttgatctagaagggacaaattctgttcaacagaggagagaacagatgttgtcccttaacctggcggcagcgcaaaagatg

SEQ ID NO: 104979 - DNA, 103 bp, Artificial Sequence
  Synthetic Polynucleotide
taatacgactcactatagggggagtttcctcagttgatctagaagggacaaacagaggagatgtcccatgtagatcaacaacctggcggcagcgcaaaagatg

SEQ ID NO: 104980 - DNA, 103 bp, Artificial Sequence
  Synthetic Polynucleotide
taatacgactcactatagggaccatggcctggagtttcctcagttgatctaacagaggagaagatcaatggaggaaactaacctggcggcagcgcaaaagatg

SEQ ID NO: 104981 - DNA, 103 bp, Artificial Sequence
  Synthetic Polynucleotide
taatacgactcactatagggtatctcaatcaccatggcctggagtttcctaacagaggagaaggaaaatgcaggccatgaacctggcggcagcgcaaaagatg

SEQ ID NO: 104982 - DNA, 103 bp, Artificial Sequence
  Synthetic Polynucleotide
taatacgactcactatagggttttgtttgatatctcaatcaccatggcctaacagaggagaaggccaatgtgattgagaaacctggcggcagcgcaaaagatg

SEQ ID NO: 104983 - DNA, 103 bp, Artificial Sequence
  Synthetic Polynucleotide
taatacgactcactatagggctgctgctggttttgtttgatatctcaatcaacagaggagagattgaatgatcaaacaaaacctggcggcagcgcaaaagatg

SEQ ID NO: 104984 - DNA, 103 bp, Artificial Sequence
  Synthetic Polynucleotide
taatacgactcactataggggcaggtgctgctgctgctggttttgtttgaaacagaggagatcaaacatgaccagcagcaacctggcggcagcgcaaaagatg

SEQ ID NO: 104985 - DNA, 103 bp, Artificial Sequence
  Synthetic Polynucleotide
taatacgactcactatagggggaccaagatgcaggtgctgctgctgctggaacagaggagaccagcaatggcagcacctaacctggcggcagcgcaaaagatg

SEQ ID NO: 104986 - DNA, 103 bp, Artificial Sequence
  Synthetic Polynucleotide
taatacgactcactataggggagactagtaggaccaagatgcaggtgctgaacagaggagacagcacatgcatcttggtaacctggcggcagcgcaaaagatg

SEQ ID NO: 104987 - DNA, 103 bp, Artificial Sequence
  Synthetic Polynucleotide
taatacgactcactatagggggcctcatcgggtgccgtccccaaatctccaacagaggagaggagatatggggacggcaaacctggcggcagcgcaaaagatg

SEQ ID NO: 104988 - DNA, 103 bp, Artificial Sequence
  Synthetic Polynucleotide
taatacgactcactataggggaggcagaaggagactagtaggaccaagataacagaggagaatcttgatgctactagtcaacctggcggcagcgcaaaagatg

SEQ ID NO: 104989 - DNA, 103 bp, Artificial Sequence
  Synthetic Polynucleotide
taatacgactcactataggggtacaaggaggaggcagaaggagactagtaaacagaggagatactagatgccttctgccaacctggcggcagcgcaaaagatg

SEQ ID NO: 104990 - DNA, 103 bp, Artificial Sequence
  Synthetic Polynucleotide
taatacgactcactatagggtacatagcaggtacaaggaggaggcagaagaacagaggagacttctgatgcctccttgtaacctggcggcagcgcaaaagatg

SEQ ID NO: 104991 - DNA, 103 bp, Artificial Sequence
  Synthetic Polynucleotide
taatacgactcactataggggtcagaggagtacatagcaggtacaaggagaacagaggagactccttatgcctgctatgaacctggcggcagcgcaaaagatg

SEQ ID NO: 104992 - DNA, 103 bp, Artificial Sequence
  Synthetic Polynucleotide
taatacgactcactatagggtcccccttgtgtcagaggagtacatagcagaacagaggagactgctaatgactcctctgaacctggcggcagcgcaaaagatg

SEQ ID NO: 104993 - DNA, 103 bp, Artificial Sequence
  Synthetic Polynucleotide
taatacgactcactataggggctggcaggctcccccttgtgtcagaggagaacagaggagactcctcatgcacaaggggaacctggcggcagcgcaaaagatg

SEQ ID NO: 104994 - DNA, 103 bp, Artificial Sequence
  Synthetic Polynucleotide
taatacgactcactatagggtccatgctcagctggcaggctcccccttgtaacagaggagaacaaggatgagcctgccaaacctggcggcagcgcaaaagatg

SEQ ID NO: 104995 - DNA, 103 bp, Artificial Sequence
  Synthetic Polynucleotide
taatacgactcactataggggggacaacactccatgctcagctggcaggcaacagaggagagcctgcatgctgagcatgaacctggcggcagcgcaaaagatg

SEQ ID NO: 104996 - DNA, 103 bp, Artificial Sequence
  Synthetic Polynucleotide
taatacgactcactatagggcgaagctggcgggacaacactccatgctcaaacagaggagatgagcaatgagtgttgtcaacctggcggcagcgcaaaagatg

SEQ ID NO: 104997 - DNA, 103 bp, Artificial Sequence
  Synthetic Polynucleotide
taatacgactcactatagggggggagggcacgaagctggcgggacaacacaacagaggagagtgttgatgcgccagcttaacctggcggcagcgcaaaagatg

SEQ ID NO: 104998 - DNA, 103 bp, Artificial Sequence
  Synthetic Polynucleotide
taatacgactcactataggggggccctcacggcctcatcgggtgccgtccaacagaggagaggacggatgccgatgaggaacctggcggcagcgcaaaagatg

SEQ ID NO: 104999 - DNA, 103 bp, Artificial Sequence
  Synthetic Polynucleotide
taatacgactcactatagggggtcctcactggggagggcacgaagctggcaacagaggagagccagcatggtgccctccaacctggcggcagcgcaaaagatg

SEQ ID NO: 105000 - DNA, 103 bp, Artificial Sequence
  Synthetic Polynucleotide
taatacgactcactatagggagctggtaagggtcctcactggggagggcaaacagaggagatgccctatgcagtgaggaaacctggcggcagcgcaaaagatg

SEQ ID NO: 105001 - DNA, 103 bp, Artificial Sequence
  Synthetic Polynucleotide
taatacgactcactatagggaggcagctccagctggtaagggtcctcactaacagaggagaagtgagatgccttaccagaacctggcggcagcgcaaaagatg

SEQ ID NO: 105002 - DNA, 103 bp, Artificial Sequence
  Synthetic Polynucleotide
taatacgactcactatagggactgcagggcaggcagctccagctggtaagaacagaggagacttaccatgtggagctgcaacctggcggcagcgcaaaagatg

SEQ ID NO: 105003 - DNA, 103 bp, Artificial Sequence
  Synthetic Polynucleotide
taatacgactcactatagggggcacttctgactgcagggcaggcagctccaacagaggagaggagctatgtgccctgcaaacctggcggcagcgcaaaagatg

SEQ ID NO: 105004 - DNA, 103 bp, Artificial Sequence
  Synthetic Polynucleotide
taatacgactcactataggggctgtctttcggcacttctgactgcagggcaacagaggagagccctgatgtcagaagtgaacctggcggcagcgcaaaagatg

SEQ ID NO: 105005 - DNA, 103 bp, Artificial Sequence
  Synthetic Polynucleotide
taatacgactcactatagggactggtgtgtgctgtctttcggcacttctgaacagaggagacagaagatgcgaaagacaaacctggcggcagcgcaaaagatg

SEQ ID NO: 105006 - DNA, 103 bp, Artificial Sequence
  Synthetic Polynucleotide
taatacgactcactatagggccgtccaaccactggtgtgtgctgtctttcaacagaggagagaaagaatgcacacaccaaacctggcggcagcgcaaaagatg

SEQ ID NO: 105007 - DNA, 103 bp, Artificial Sequence
  Synthetic Polynucleotide
taatacgactcactatagggacagtctgagccgtccaaccactggtgtgtaacagaggagaacacacatgtggttggacaacctggcggcagcgcaaaagatg

SEQ ID NO: 105008 - DNA, 103 bp, Artificial Sequence
  Synthetic Polynucleotide
taatacgactcactatagggcctggagtacacagtctgagccgtccaaccaacagaggagaggttggatggctcagactaacctggcggcagcgcaaaagatg

SEQ ID NO: 105009 - DNA, 103 bp, Artificial Sequence
  Synthetic Polynucleotide
taatacgactcactatagggcagtccagtggggccctcacggcctcatcgaacagaggagacgatgaatgcgtgagggcaacctggcggcagcgcaaaagatg

SEQ ID NO: 105010 - DNA, 103 bp, Artificial Sequence
  Synthetic Polynucleotide
taatacgactcactatagggttgccaggggcctggagtacacagtctgagaacagaggagactcagaatgtgtactccaaacctggcggcagcgcaaaagatg

SEQ ID NO: 105011 - DNA, 103 bp, Artificial Sequence
  Synthetic Polynucleotide
taatacgactcactataggggcaggaagtgttgccaggggcctggagtacaacagaggagagtactcatggcccctggcaacctggcggcagcgcaaaagatg

SEQ ID NO: 105012 - DNA, 103 bp, Artificial Sequence
  Synthetic Polynucleotide
taatacgactcactatagggaatgcagcaggcaggaagtgttgccaggggaacagaggagacccctgatgacacttcctaacctggcggcagcgcaaaagatg

SEQ ID NO: 105013 - DNA, 103 bp, Artificial Sequence
  Synthetic Polynucleotide
taatacgactcactatagggtgaggcatgtaatgcagcaggcaggaagtgaacagaggagacacttcatgcctgctgcaaacctggcggcagcgcaaaagatg

SEQ ID NO: 105014 - DNA, 103 bp, Artificial Sequence
  Synthetic Polynucleotide
taatacgactcactatagggactgggagcctgaggcatgtaatgcagcagaacagaggagactgctgatgtacatgcctaacctggcggcagcgcaaaagatg

SEQ ID NO: 105015 - DNA, 103 bp, Artificial Sequence
  Synthetic Polynucleotide
taatacgactcactataggggaggctctgcactgggagcctgaggcatgtaacagaggagaacatgcatgaggctcccaaacctggcggcagcgcaaaagatg

SEQ ID NO: 105016 - DNA, 103 bp, Artificial Sequence
  Synthetic Polynucleotide
taatacgactcactatagggcactccaggggaggctctgcactgggagccaacagaggagaggctccatgtgcagagccaacctggcggcagcgcaaaagatg

SEQ ID NO: 105017 - DNA, 103 bp, Artificial Sequence
  Synthetic Polynucleotide
taatacgactcactatagggagggaatggccactccaggggaggctctgcaacagaggagagcagagatgcccctggagaacctggcggcagcgcaaaagatg

SEQ ID NO: 105018 - DNA, 103 bp, Artificial Sequence
  Synthetic Polynucleotide
taatacgactcactatagggagaagaggtcagggaatggccactccagggaacagaggagaccctggatgggccattccaacctggcggcagcgcaaaagatg

SEQ ID NO: 105019 - DNA, 103 bp, Artificial Sequence
  Synthetic Polynucleotide
taatacgactcactatagggagaggctctgagaagaggtcagggaatggcaacagaggagagccattatgtgacctcttaacctggcggcagcgcaaaagatg

SEQ ID NO: 105020 - DNA, 103 bp, Artificial Sequence
  Synthetic Polynucleotide
taatacgactcactatagggggccgggaagggttccaagacggcgtccataacagaggagaatggacatggtcttggaaaacctggcggcagcgcaaaagatg

SEQ ID NO: 105021 - DNA, 103 bp, Artificial Sequence
  Synthetic Polynucleotide
taatacgactcactatagggcaggtgctcaggaaagtgcgcattgttgagaacagaggagactcaacatggcgcactttaacctggcggcagcgcaaaagatg

SEQ ID NO: 105022 - DNA, 103 bp, Artificial Sequence
  Synthetic Polynucleotide
taatacgactcactatagggctccagggtctccaccttcttccacagttcaacagaggagagaactgatgaagaaggtgaacctggcggcagcgcaaaagatg

SEQ ID NO: 105023 - DNA, 103 bp, Artificial Sequence
  Synthetic Polynucleotide
taatacgactcactatagggtgttggcattctccagggtctccaccttctaacagaggagaagaaggatgagaccctggaacctggcggcagcgcaaaagatg

SEQ ID NO: 105024 - DNA, 103 bp, Artificial Sequence
  Synthetic Polynucleotide
taatacgactcactatagggagcagggtcctgttggcattctccagggtcaacagaggagagaccctatggaatgccaaaacctggcggcagcgcaaaagatg

SEQ ID NO: 105025 - DNA, 103 bp, Artificial Sequence
  Synthetic Polynucleotide
taatacgactcactatagggcagctgctggagcagggtcctgttggcattaacagaggagaaatgccatgaggaccctgaacctggcggcagcgcaaaagatg

SEQ ID NO: 105026 - DNA, 103 bp, Artificial Sequence
  Synthetic Polynucleotide
taatacgactcactatagggggagtttctgcagctgctggagcagggtccaacagaggagaggacccatgtccagcagcaacctggcggcagcgcaaaagatg

SEQ ID NO: 105027 - DNA, 103 bp, Artificial Sequence
  Synthetic Polynucleotide
taatacgactcactatagggaccagagtctggagtttctgcagctgctggaacagaggagaccagcaatggcagaaactaacctggcggcagcgcaaaagatg

SEQ ID NO: 105028 - DNA, 103 bp, Artificial Sequence
  Synthetic Polynucleotide
taatacgactcactatagggcttgttggtgaccagagtctggagtttctgaacagaggagacagaaaatgcagactctgaacctggcggcagcgcaaaagatg

SEQ ID NO: 105029 - DNA, 103 bp, Artificial Sequence
  Synthetic Polynucleotide
taatacgactcactataggggtctggagatcttgttggtgaccagagtctaacagaggagaagactcatgtcaccaacaaacctggcggcagcgcaaaagatg

SEQ ID NO: 105030 - DNA, 103 bp, Artificial Sequence
  Synthetic Polynucleotide
taatacgactcactatagggatcttgtaaggtctggagatcttgttggtgaacagaggagacaccaaatggatctccagaacctggcggcagcgcaaaagatg

SEQ ID NO: 105031 - DNA, 103 bp, Artificial Sequence
  Synthetic Polynucleotide
taatacgactcactatagggggtggcggccatcttgtaaggtctggagataacagaggagaatctccatgccttacaagaacctggcggcagcgcaaaagatg

SEQ ID NO: 105032 - DNA, 103 bp, Artificial Sequence
  Synthetic Polynucleotide
taatacgactcactatagggtaaagtggtccaggtgctcaggaaagtgcgaacagaggagacgcactatgctgagcaccaacctggcggcagcgcaaaagatg

SEQ ID NO: 105033 - DNA, 103 bp, Artificial Sequence
  Synthetic Polynucleotide
taatacgactcactatagggtcccagtctgggtggcggccatcttgtaagaacagaggagacttacaatgtggccgccaaacctggcggcagcgcaaaagatg

SEQ ID NO: 105034 - DNA, 103 bp, Artificial Sequence
  Synthetic Polynucleotide
taatacgactcactatagggatgaggcaggtcccagtctgggtggcggccaacagaggagaggccgcatgccagactggaacctggcggcagcgcaaaagatg

SEQ ID NO: 105035 - DNA, 103 bp, Artificial Sequence
  Synthetic Polynucleotide
taatacgactcactatagggggctgccaccatgaggcaggtcccagtctgaacagaggagacagactatgacctgcctcaacctggcggcagcgcaaaagatg

SEQ ID NO: 105036 - DNA, 103 bp, Artificial Sequence
  Synthetic Polynucleotide
taatacgactcactatagggcaaagcacaaggctgccaccatgaggcaggaacagaggagacctgccatgtggtggcagaacctggcggcagcgcaaaagatg

SEQ ID NO: 105037 - DNA, 103 bp, Artificial Sequence
  Synthetic Polynucleotide
taatacgactcactatagggagcaccagaacaaagcacaaggctgccaccaacagaggagaggtggcatgcttgtgcttaacctggcggcagcgcaaaagatg

SEQ ID NO: 105038 - DNA, 103 bp, Artificial Sequence
  Synthetic Polynucleotide
taatacgactcactataggggagggagcccagcaccagaacaaagcacaaaacagaggagattgtgcatggttctggtgaacctggcggcagcgcaaaagatg

SEQ ID NO: 105039 - DNA, 103 bp, Artificial Sequence
  Synthetic Polynucleotide
taatacgactcactatagggggcagggcacgagggagcccagcaccagaaaacagaggagattctggatgtgggctcccaacctggcggcagcgcaaaagatg

SEQ ID NO: 105040 - DNA, 103 bp, Artificial Sequence
  Synthetic Polynucleotide
taatacgactcactatagggaactcgggaaggcagggcacgagggagcccaacagaggagagggctcatgcgtgccctgaacctggcggcagcgcaaaagatg

SEQ ID NO: 105041 - DNA, 103 bp, Artificial Sequence
  Synthetic Polynucleotide
taatacgactcactataggggccggaggagaactcgggaaggcagggcacaacagaggagagtgcccatgcttcccgagaacctggcggcagcgcaaaagatg

SEQ ID NO: 105042 - DNA, 103 bp, Artificial Sequence
  Synthetic Polynucleotide
taatacgactcactatagggcagtctgggagccggaggagaactcgggaaaacagaggagattcccgatgtctcctccgaacctggcggcagcgcaaaagatg

SEQ ID NO: 105043 - DNA, 103 bp, Artificial Sequence
  Synthetic Polynucleotide
taatacgactcactatagggatgttctccgtaaagtggtccaggtgctcaaacagaggagatgagcaatgggaccacttaacctggcggcagcgcaaaagatg

SEQ ID NO: 105044 - DNA, 103 bp, Artificial Sequence
  Synthetic Polynucleotide
taatacgactcactatagggtcttccttcacagtctgggagccggaggagaacagaggagactcctcatgctcccagacaacctggcggcagcgcaaaagatg

SEQ ID NO: 105045 - DNA, 103 bp, Artificial Sequence
  Synthetic Polynucleotide
taatacgactcactatagggggccagggggtcttccttcacagtctgggaaacagaggagatcccagatggtgaaggaaaacctggcggcagcgcaaaagatg

SEQ ID NO: 105046 - DNA, 103 bp, Artificial Sequence
  Synthetic Polynucleotide
taatacgactcactatagggcgccgtctgcggccagggggtcttccttcaaacagaggagatgaaggatgaccccctggaacctggcggcagcgcaaaagatg

SEQ ID NO: 105047 - DNA, 103 bp, Artificial Sequence
  Synthetic Polynucleotide
taatacgactcactataggggccgtgtagacgccgtctgcggccagggggaacagaggagaccccctatgcgcagacggaacctggcggcagcgcaaaagatg

SEQ ID NO: 105048 - DNA, 103 bp, Artificial Sequence
  Synthetic Polynucleotide
taatacgactcactatagggcatctggctggccgtgtagacgccgtctgcaacagaggagagcagacatggtctacacgaacctggcggcagcgcaaaagatg

SEQ ID NO: 105049 - DNA, 103 bp, Artificial Sequence
  Synthetic Polynucleotide
taatacgactcactatagggttcgggagggcatctggctggccgtgtagaaacagaggagatctacaatgccagccagaaacctggcggcagcgcaaaagatg

SEQ ID NO: 105050 - DNA, 103 bp, Artificial Sequence
  Synthetic Polynucleotide
taatacgactcactatagggaataggaggcttcgggagggcatctggctgaacagaggagacagccaatggccctcccgaacctggcggcagcgcaaaagatg

SEQ ID NO: 105051 - DNA, 103 bp, Artificial Sequence
  Synthetic Polynucleotide
taatacgactcactataggggtcatcgtagaataggaggcttcgggagggaacagaggagaccctccatgagcctcctaaacctggcggcagcgcaaaagatg

SEQ ID NO: 105052 - DNA, 103 bp, Artificial Sequence
  Synthetic Polynucleotide
taatacgactcactatagggagcctgccccgtcatcgtagaataggaggcaacagaggagagcctccatgtctacgatgaacctggcggcagcgcaaaagatg

SEQ ID NO: 105053 - DNA, 103 bp, Artificial Sequence
  Synthetic Polynucleotide
taatacgactcactatagggtcttcccataagcctgccccgtcatcgtagaacagaggagactacgaatgcggggcaggaacctggcggcagcgcaaaagatg

SEQ ID NO: 105054 - DNA, 103 bp, Artificial Sequence
  Synthetic Polynucleotide
taatacgactcactataggggaagtcctccatgttctccgtaaagtggtcaacagaggagagaccacatgacggagaacaacctggcggcagcgcaaaagatg

SEQ ID NO: 105055 - DNA, 103 bp, Artificial Sequence
  Synthetic Polynucleotide
taatacgactcactataggggctgcggccatcttcccataagcctgccccaacagaggagaggggcaatgttatgggaaaacctggcggcagcgcaaaagatg

SEQ ID NO: 105056 - DNA, 103 bp, Artificial Sequence
  Synthetic Polynucleotide
taatacgactcactataggggcagcagggtgctgcggccatcttcccataaacagaggagatatgggatgatggccgcaaacctggcggcagcgcaaaagatg

SEQ ID NO: 105057 - DNA, 103 bp, Artificial Sequence
  Synthetic Polynucleotide
taatacgactcactatagggggctccatgggcagcagggtgctgcggccaaacagaggagatggccgatgcaccctgctaacctggcggcagcgcaaaagatg

SEQ ID NO: 105058 - DNA, 103 bp, Artificial Sequence
  Synthetic Polynucleotide
taatacgactcactataggggccatctgggggctccatgggcagcagggtaacagaggagaaccctgatgcccatggagaacctggcggcagcgcaaaagatg

SEQ ID NO: 105059 - DNA, 103 bp, Artificial Sequence
  Synthetic Polynucleotide
taatacgactcactatagggtgatttcccagccatctgggggctccatggaacagaggagaccatggatgccccagatgaacctggcggcagcgcaaaagatg

SEQ ID NO: 105060 - DNA, 103 bp, Artificial Sequence
  Synthetic Polynucleotide
taatacgactcactatagggcccccggggttgatttcccagccatctgggaacagaggagacccagaatgctgggaaataacctggcggcagcgcaaaagatg

SEQ ID NO: 105061 - DNA, 103 bp, Artificial Sequence
  Synthetic Polynucleotide
taatacgactcactatagggctctgccggccccccggggttgatttcccaaacagaggagatgggaaatgaaccccgggaacctggcggcagcgcaaaagatg

SEQ ID NO: 105062 - DNA, 103 bp, Artificial Sequence
  Synthetic Polynucleotide
taatacgactcactatagggggggccgctgctctgccggccccccggggtaacagaggagaaccccgatgggccggcagaacctggcggcagcgcaaaagatg

SEQ ID NO: 105063 - DNA, 103 bp, Artificial Sequence
  Synthetic Polynucleotide
taatacgactcactatagggaggtggtcccggggccgctgctctgccggcaacagaggagagccggcatggcagcggccaacctggcggcagcgcaaaagatg

SEQ ID NO: 105064 - DNA, 103 bp, Artificial Sequence
  Synthetic Polynucleotide
taatacgactcactatagggatcatgctgcaggtggtcccggggccgctgaacagaggagacagcggatgcgggaccacaacctggcggcagcgcaaaagatg

SEQ ID NO: 105065 - DNA, 103 bp, Artificial Sequence
  Synthetic Polynucleotide
taatacgactcactatagggggtcattggagaagtcctccatgttctccgaacagaggagacggagaatgtggaggactaacctggcggcagcgcaaaagatg

SEQ ID NO: 105066 - DNA, 103 bp, Artificial Sequence
  Synthetic Polynucleotide
taatacgactcactatagggtgtccaggtgatcatgctgcaggtggtcccaacagaggagagggaccatgtgcagcatgaacctggcggcagcgcaaaagatg

SEQ ID NO: 105067 - DNA, 103 bp, Artificial Sequence
  Synthetic Polynucleotide
taatacgactcactatagggtcgtgggtgctgtccaggtgatcatgctgcaacagaggagagcagcaatgtcacctggaaacctggcggcagcgcaaaagatg

SEQ ID NO: 105068 - DNA, 103 bp, Artificial Sequence
  Synthetic Polynucleotide
taatacgactcactatagggcttggtggtctcgtgggtgctgtccaggtgaacagaggagacacctgatgagcacccacaacctggcggcagcgcaaaagatg

SEQ ID NO: 105069 - DNA, 103 bp, Artificial Sequence
  Synthetic Polynucleotide
taatacgactcactatagggcactcaggtacttggtggtctcgtgggtgcaacagaggagagcacccatgagaccaccaaacctggcggcagcgcaaaagatg

SEQ ID NO: 105070 - DNA, 103 bp, Artificial Sequence
  Synthetic Polynucleotide
taatacgactcactatagggggccaggcctcactcaggtacttggtggtcaacagaggagagaccacatggtacctgagaacctggcggcagcgcaaaagatg

SEQ ID NO: 105071 - DNA, 103 bp, Artificial Sequence
  Synthetic Polynucleotide
taatacgactcactatagggaccgtctttaggccaggcctcactcaggtaaacagaggagatacctgatggaggcctggaacctggcggcagcgcaaaagatg

SEQ ID NO: 105072 - DNA, 103 bp, Artificial Sequence
  Synthetic Polynucleotide
taatacgactcactatagggtgccgtttccaccgtctttaggccaggcctaacagaggagaaggcctatgctaaagacgaacctggcggcagcgcaaaagatg

SEQ ID NO: 105073 - DNA, 103 bp, Artificial Sequence
  Synthetic Polynucleotide
taatacgactcactatagggtcggggctggtgccgtttccaccgtctttaaacagaggagataaagaatgtggaaacggaacctggcggcagcgcaaaagatg

SEQ ID NO: 105074 - DNA, 103 bp, Artificial Sequence
  Synthetic Polynucleotide
taatacgactcactataggggtgggagaagtcggggctggtgccgtttccaacagaggagaggaaacatgaccagccccaacctggcggcagcgcaaaagatg

SEQ ID NO: 105075 - DNA, 103 bp, Artificial Sequence
  Synthetic Polynucleotide
taatacgactcactatagggactccttggagtgggagaagtcggggctggaacagaggagaccagccatgacttctcccaacctggcggcagcgcaaaagatg

SEQ ID NO: 105076 - DNA, 103 bp, Artificial Sequence
  Synthetic Polynucleotide
taatacgactcactatagggctgctgaacaggtcattggagaagtcctccaacagaggagaggaggaatgctccaatgaaacctggcggcagcgcaaaagatg

SEQ ID NO: 105077 - DNA, 103 bp, Artificial Sequence
  Synthetic Polynucleotide
taatacgactcactatagggtcgtggaaccactccttggagtgggagaagaacagaggagacttctcatgctccaaggaaacctggcggcagcgcaaaagatg

SEQ ID NO: 105078 - DNA, 103 bp, Artificial Sequence
  Synthetic Polynucleotide
taatacgactcactatagggcagatccctgtcgtggaaccactccttggaaacagaggagatccaagatgtggttccacaacctggcggcagcgcaaaagatg

SEQ ID NO: 105079 - DNA, 103 bp, Artificial Sequence
  Synthetic Polynucleotide
taatacgactcactatagggtgttggggcccagatccctgtcgtggaaccaacagaggagaggttccatgacagggatcaacctggcggcagcgcaaaagatg

SEQ ID NO: 105080 - DNA, 103 bp, Artificial Sequence
  Synthetic Polynucleotide
taatacgactcactatagggttgatggtggtgttggggcccagatccctgaacagaggagacagggaatggggccccaaaacctggcggcagcgcaaaagatg

SEQ ID NO: 105081 - DNA, 103 bp, Artificial Sequence
  Synthetic Polynucleotide
taatacgactcactatagggctaggagagtttgatggtggtgttggggccaacagaggagaggccccatgaccaccatcaacctggcggcagcgcaaaagatg

SEQ ID NO: 105082 - DNA, 103 bp, Artificial Sequence
  Synthetic Polynucleotide
taatacgactcactatagggatcaaagaagctgctgaacaggtcattggaaacagaggagatccaatatgctgttcagcaacctggcggcagcgcaaaagatg

SEQ ID NO: 105083 - DNA, 103 bp, Artificial Sequence
  Synthetic Polynucleotide
taatacgactcactataggggcacagggtcatcaaagaagctgctgaacaaacagaggagatgttcaatggcttctttgaacctggcggcagcgcaaaagatg

SEQ ID NO: 105084 - DNA, 103 bp, Artificial Sequence
  Synthetic Polynucleotide
taatacgactcactatagggttctcatccagcacagggtcatcaaagaagaacagaggagacttcttatgtgaccctgtaacctggcggcagcgcaaaagatg

SEQ ID NO: 105085 - DNA, 103 bp, Artificial Sequence
  Synthetic Polynucleotide
taatacgactcactatagggtagagggctcttctcatccagcacagggtcaacagaggagagaccctatgctggatgagaacctggcggcagcgcaaaagatg

SEQ ID NO: 105086 - DNA, 103 bp, Artificial Sequence
  Synthetic Polynucleotide
taatacgactcactatagggacagcctgtcggccgggaagggttccaagaaacagaggagatcttggatgccttcccggaacctggcggcagcgcaaaagatg

SEQ ID NO: 105087 - DNA, 103 bp, Artificial Sequence
  Synthetic Polynucleotide
taatacgactcactatagggccatgtccaatagagggctcttctcatccaaacagaggagatggatgatgagagccctcaacctggcggcagcgcaaaagatg

SEQ ID NO: 105088 - DNA, 103 bp, Artificial Sequence
  Synthetic Polynucleotide
taatacgactcactataggggagtccagttccatgtccaatagagggctcaacagaggagagagcccatgattggacataacctggcggcagcgcaaaagatg

SEQ ID NO: 105089 - DNA, 103 bp, Artificial Sequence
  Synthetic Polynucleotide
taatacgactcactatagggtggcgtaggggagtccagttccatgtccaaaacagaggagattggacatggaactggacaacctggcggcagcgcaaaagatg

SEQ ID NO: 105090 - DNA, 103 bp, Artificial Sequence
  Synthetic Polynucleotide
taatacgactcactatagggcctggatgcctggcgtaggggagtccagttaacagaggagaaactggatgcccctacgcaacctggcggcagcgcaaaagatg

SEQ ID NO: 105091 - DNA, 103 bp, Artificial Sequence
  Synthetic Polynucleotide
taatacgactcactatagggctgtgctccgcctggatgcctggcgtagggaacagaggagaccctacatgaggcatccaaacctggcggcagcgcaaaagatg

SEQ ID NO: 105092 - DNA, 103 bp, Artificial Sequence
  Synthetic Polynucleotide
taatacgactcactatagggcagggagtagctgtgctccgcctggatgccaacagaggagaggcatcatggcggagcacaacctggcggcagcgcaaaagatg

SEQ ID NO: 105093 - DNA, 103 bp, Artificial Sequence
  Synthetic Polynucleotide
taatacgactcactatagggagtcgccgctcagggagtagctgtgctccgaacagaggagacggagcatggctactcccaacctggcggcagcgcaaaagatg

SEQ ID NO: 105094 - DNA, 103 bp, Artificial Sequence
  Synthetic Polynucleotide
taatacgactcactatagggtggggcgctgagtcgccgctcagggagtagaacagaggagactactcatggagcggcgaaacctggcggcagcgcaaaagatg

SEQ ID NO: 105095 - DNA, 103 bp, Artificial Sequence
  Synthetic Polynucleotide
taatacgactcactatagggaagggggctctggggcgctgagtcgccgctaacagaggagaagcggcatgtcagcgcccaacctggcggcagcgcaaaagatg

SEQ ID NO: 105096 - DNA, 103 bp, Artificial Sequence
  Synthetic Polynucleotide
taatacgactcactatagggtgatgggcacaagggggctctggggcgctgaacagaggagacagcgcatgagagcccccaacctggcggcagcgcaaaagatg

SEQ ID NO: 105097 - DNA, 103 bp, Artificial Sequence
  Synthetic Polynucleotide
taatacgactcactataggggatccggggaacagcctgtcggccgggaagaacagaggagacttcccatgcgacaggctaacctggcggcagcgcaaaagatg

SEQ ID NO: 105098 - DNA, 103 bp, Artificial Sequence
  Synthetic Polynucleotide
taatacgactcactatagggtcctccatcttgatgggcacaagggggctcaacagaggagagagcccatgtgtgcccataacctggcggcagcgcaaaagatg

SEQ ID NO: 105099 - DNA, 103 bp, Artificial Sequence
  Synthetic Polynucleotide
taatacgactcactatagggttgggtggtgtcctccatcttgatgggcacaacagaggagagtgcccatgaagatggagaacctggcggcagcgcaaaagatg

SEQ ID NO: 105100 - DNA, 103 bp, Artificial Sequence
  Synthetic Polynucleotide
taatacgactcactataggggctctgcatcttgggtggtgtcctccatctaacagaggagaagatggatgacaccacccaacctggcggcagcgcaaaagatg

SEQ ID NO: 105101 - DNA, 103 bp, Artificial Sequence
  Synthetic Polynucleotide
taatacgactcactatagggcatgctccatgctctgcatcttgggtggtgaacagaggagacaccacatgagatgcagaaacctggcggcagcgcaaaagatg

SEQ ID NO: 105102 - DNA, 103 bp, Artificial Sequence
  Synthetic Polynucleotide
taatacgactcactatagggtcccagcgcccatgctccatgctctgcatcaacagaggagagatgcaatgcatggagcaaacctggcggcagcgcaaaagatg

SEQ ID NO: 105103 - DNA, 103 bp, Artificial Sequence
  Synthetic Polynucleotide
taatacgactcactatagggacagtttgtgtcccagcgcccatgctccataacagaggagaatggagatggggcgctggaacctggcggcagcgcaaaagatg

SEQ ID NO: 105104 - DNA, 103 bp, Artificial Sequence
  Synthetic Polynucleotide
taatacgactcactatagggatgatggagcacagtttgtgtcccagcgccaacagaggagaggcgctatgacacaaactaacctggcggcagcgcaaaagatg

SEQ ID NO: 105105 - DNA, 103 bp, Artificial Sequence
  Synthetic Polynucleotide
taatacgactcactatagggctgcttcaccatgatggagcacagtttgtgaacagaggagacacaaaatgtgctccatcaacctggcggcagcgcaaaagatg

SEQ ID NO: 105106 - DNA, 103 bp, Artificial Sequence
  Synthetic Polynucleotide
taatacgactcactatagggggctctgctcctgcttcaccatgatggagcaacagaggagagctccaatgtggtgaagcaacctggcggcagcgcaaaagatg

SEQ ID NO: 105107 - DNA, 103 bp, Artificial Sequence
  Synthetic Polynucleotide
taatacgactcactatagggggcagctccgggctctgctcctgcttcaccaacagaggagaggtgaaatgggagcagagaacctggcggcagcgcaaaagatg

SEQ ID NO: 105108 - DNA, 103 bp, Artificial Sequence
  Synthetic Polynucleotide
taatacgactcactatagggcaggaagctggatccggggaacagcctgtcaacagaggagagacaggatgttccccggaaacctggcggcagcgcaaaagatg

SEQ ID NO: 105109 - DNA, 103 bp, Artificial Sequence
  Synthetic Polynucleotide
taatacgactcactatagggagggtccacgggcagctccgggctctgctcaacagaggagagagcagatgccggagctgaacctggcggcagcgcaaaagatg

SEQ ID NO: 105110 - DNA, 103 bp, Artificial Sequence
  Synthetic Polynucleotide
taatacgactcactataggggggcagccagagggtccacgggcagctccgaacagaggagacggagcatgccgtggaccaacctggcggcagcgcaaaagatg

SEQ ID NO: 105111 - DNA, 103 bp, Artificial Sequence
  Synthetic Polynucleotide
taatacgactcactatagggatggccgagggggcagccagagggtccacgaacagaggagacgtggaatgtctggctgcaacctggcggcagcgcaaaagatg

SEQ ID NO: 105112 - DNA, 103 bp, Artificial Sequence
  Synthetic Polynucleotide
taatacgactcactatagggcgcggcagccatggccgagggggcagccagaacagaggagactggctatgccctcggccaacctggcggcagcgcaaaagatg

SEQ ID NO: 105113 - DNA, 103 bp, Artificial Sequence
  Synthetic Polynucleotide
taatacgactcactatagggccatggcggccgcggcagccatggccgaggaacagaggagacctcggatgtggctgccgaacctggcggcagcgcaaaagatg

SEQ ID NO: 105114 - DNA, 103 bp, Artificial Sequence
  Synthetic Polynucleotide
taatacgactcactatagggggggtggtggccatggcggccgcggcagccaacagaggagaggctgcatgggccgccataacctggcggcagcgcaaaagatg

SEQ ID NO: 105115 - DNA, 103 bp, Artificial Sequence
  Synthetic Polynucleotide
taatacgactcactataggggcccagcagcggggtggtggccatggcggcaacagaggagagccgccatggccaccaccaacctggcggcagcgcaaaagatg

SEQ ID NO: 105116 - DNA, 103 bp, Artificial Sequence
  Synthetic Polynucleotide
taatacgactcactatagggaggggctgaggcccagcagcggggtggtggaacagaggagaccaccaatgcgctgctggaacctggcggcagcgcaaaagatg

SEQ ID NO: 105117 - DNA, 103 bp, Artificial Sequence
  Synthetic Polynucleotide
taatacgactcactatagggagcctggacaaggggctgaggcccagcagcaacagaggagagctgctatgcctcagcccaacctggcggcagcgcaaaagatg

SEQ ID NO: 105118 - DNA, 103 bp, Artificial Sequence
  Synthetic Polynucleotide
taatacgactcactatagggggggatgggcagcctggacaaggggctgagaacagaggagactcagcatgttgtccaggaacctggcggcagcgcaaaagatg

SEQ ID NO: 105119 - DNA, 103 bp, Artificial Sequence
  Synthetic Polynucleotide
taatacgactcactatagggcccccaagtccaggaagctggatccggggaaacagaggagatccccgatgccagcttccaacctggcggcagcgcaaaagatg

SEQ ID NO: 105120 - DNA, 103 bp, Artificial Sequence
  Synthetic Polynucleotide
taatacgactcactataggggggcctggtgggggatgggcagcctggacaaacagaggagatgtccaatgtgcccatccaacctggcggcagcgcaaaagatg

SEQ ID NO: 105121 - DNA, 103 bp, Artificial Sequence
  Synthetic Polynucleotide
taatacgactcactatagggatctctcccggggcctggtgggggatgggcaacagaggagagcccatatgccaccaggcaacctggcggcagcgcaaaagatg

SEQ ID NO: 105122 - DNA, 103 bp, Artificial Sequence
  Synthetic Polynucleotide
taatacgactcactatagggcagctgagtcatctctcccggggcctggtgaacagaggagacaccagatgccgggagagaacctggcggcagcgcaaaagatg

SEQ ID NO: 105123 - DNA, 103 bp, Artificial Sequence
  Synthetic Polynucleotide
taatacgactcactatagggtgatcactggcagctgagtcatctctcccgaacagaggagacgggagatgtgactcagcaacctggcggcagcgcaaaagatg

SEQ ID NO: 105124 - DNA, 103 bp, Artificial Sequence
  Synthetic Polynucleotide
taatacgactcactatagggggctctgctttgatcactggcagctgagtcaacagaggagagactcaatggccagtgataacctggcggcagcgcaaaagatg

SEQ ID NO: 105125 - DNA, 103 bp, Artificial Sequence
  Synthetic Polynucleotide
taatacgactcactatagggcacctccagaggctctgctttgatcactggaacagaggagaccagtgatgaaagcagagaacctggcggcagcgcaaaagatg

SEQ ID NO: 105126 - DNA, 103 bp, Artificial Sequence
  Synthetic Polynucleotide
taatacgactcactatagggggaactggttcacctccagaggctctgcttaacagaggagaaagcagatgctctggaggaacctggcggcagcgcaaaagatg

SEQ ID NO: 105127 - DNA, 103 bp, Artificial Sequence
  Synthetic Polynucleotide
taatacgactcactataggggtcactttgaggaactggttcacctccagaaacagaggagatctggaatggaaccagttaacctggcggcagcgcaaaagatg

SEQ ID NO: 105128 - DNA, 103 bp, Artificial Sequence
  Synthetic Polynucleotide
taatacgactcactataggggtcctccggtgtcactttgaggaactggttaacagaggagaaaccagatgctcaaagtgaacctggcggcagcgcaaaagatg

SEQ ID NO: 105129 - DNA, 103 bp, Artificial Sequence
  Synthetic Polynucleotide
taatacgactcactatagggtctgcaccaggtcctccggtgtcactttgaaacagaggagatcaaagatgcaccggaggaacctggcggcagcgcaaaagatg

SEQ ID NO: 105130 - DNA, 103 bp, Artificial Sequence
  Synthetic Polynucleotide
taatacgactcactatagggtcgttcagatcccccaagtccaggaagctgaacagaggagacagcttatgggacttgggaacctggcggcagcgcaaaagatg

SEQ ID NO: 105131 - DNA, 103 bp, Artificial Sequence
  Synthetic Polynucleotide
taatacgactcactataggggtcggaggcatctgcaccaggtcctccggtaacagaggagaaccggaatgcctggtgcaaacctggcggcagcgcaaaagatg

SEQ ID NO: 105132 - DNA, 103 bp, Artificial Sequence
  Synthetic Polynucleotide
taatacgactcactataggggctggggggcgtcggaggcatctgcaccagaacagaggagactggtgatgatgcctccgaacctggcggcagcgcaaaagatg

SEQ ID NO: 105133 - DNA, 103 bp, Artificial Sequence
  Synthetic Polynucleotide
taatacgactcactatagggtgccatggctgctggggggcgtcggaggcaaacagaggagatgcctcatgcgccccccaaacctggcggcagcgcaaaagatg

SEQ ID NO: 105134 - DNA, 103 bp, Artificial Sequence
  Synthetic Polynucleotide
taatacgactcactatagggtcgctgtcactgccatggctgctggggggcaacagaggagagcccccatgcagccatggaacctggcggcagcgcaaaagatg

SEQ ID NO: 105135 - DNA, 103 bp, Artificial Sequence
  Synthetic Polynucleotide
taatacgactcactatagggctgggagccgtcgctgtcactgccatggctaacagaggagaagccatatgagtgacagcaacctggcggcagcgcaaaagatg

SEQ ID NO: 105136 - DNA, 103 bp, Artificial Sequence
  Synthetic Polynucleotide
taatacgactcactatagggagcggggactctgggagccgtcgctgtcacaacagaggagagtgacaatgacggctcccaacctggcggcagcgcaaaagatg

SEQ ID NO: 105137 - DNA, 103 bp, Artificial Sequence
  Synthetic Polynucleotide
taatacgactcactataggggggggcagagagcggggactctgggagccgaacagaggagacggctcatggagtccccgaacctggcggcagcgcaaaagatg

SEQ ID NO: 105138 - DNA, 103 bp, Artificial Sequence
  Synthetic Polynucleotide
taatacgactcactatagggagggctggaggggggcagagagcggggactaacagaggagaagtcccatgtctctgcccaacctggcggcagcgcaaaagatg

SEQ ID NO: 105139 - DNA, 103 bp, Artificial Sequence
  Synthetic Polynucleotide
taatacgactcactatagggtgggcctgacagggctggaggggggcagagaacagaggagactctgcatgcctccagccaacctggcggcagcgcaaaagatg

SEQ ID NO: 105140 - DNA, 103 bp, Artificial Sequence
  Synthetic Polynucleotide
taatacgactcactataggggagcgcgccatgggcctgacagggctggagaacagaggagactccagatgtgtcaggccaacctggcggcagcgcaaaagatg

SEQ ID NO: 105141 - DNA, 103 bp, Artificial Sequence
  Synthetic Polynucleotide
taatacgactcactataggggaagtccgactcgttcagatcccccaagtcaacagaggagagacttgatggatctgaacaacctggcggcagcgcaaaagatg

SEQ ID NO: 105142 - DNA, 103 bp, Artificial Sequence
  Synthetic Polynucleotide
taatacgactcactatagggggccgtggaggagcgcgccatgggcctgacaacagaggagagtcaggatgatggcgcgcaacctggcggcagcgcaaaagatg

SEQ ID NO: 105143 - DNA, 103 bp, Artificial Sequence
  Synthetic Polynucleotide
taatacgactcactatagggaggtggagatggccgtggaggagcgcgccaaacagaggagatggcgcatgcctccacggaacctggcggcagcgcaaaagatg

SEQ ID NO: 105144 - DNA, 103 bp, Artificial Sequence
  Synthetic Polynucleotide
taatacgactcactatagggaggagtggggaggtggagatggccgtggagaacagaggagactccacatgcatctccacaacctggcggcagcgcaaaagatg

SEQ ID NO: 105145 - DNA, 103 bp, Artificial Sequence
  Synthetic Polynucleotide
taatacgactcactatagggaggggcagtgaggagtggggaggtggagataacagaggagaatctccatgtccccactcaacctggcggcagcgcaaaagatg

SEQ ID NO: 105146 - DNA, 103 bp, Artificial Sequence
  Synthetic Polynucleotide
taatacgactcactataggggtaatttgtgaggggcagtgaggagtggggaacagaggagaccccacatgtcactgcccaacctggcggcagcgcaaaagatg

SEQ ID NO: 105147 - DNA, 103 bp, Artificial Sequence
  Synthetic Polynucleotide
taatacgactcactataggggatgtcccctgtaatttgtgaggggcagtgaacagaggagacactgcatgtcacaaattaacctggcggcagcgcaaaagatg

SEQ ID NO: 105148 - DNA, 103 bp, Artificial Sequence
  Synthetic Polynucleotide
taatacgactcactatagggcagtggccctgatgtcccctgtaatttgtgaacagaggagacacaaaatgcaggggacaaacctggcggcagcgcaaaagatg

SEQ ID NO: 105149 - DNA, 103 bp, Artificial Sequence
  Synthetic Polynucleotide
taatacgactcactatagggctgtcaggagcagtggccctgatgtcccctaacagaggagaaggggaatgcagggccacaacctggcggcagcgcaaaagatg

SEQ ID NO: 105150 - DNA, 103 bp, Artificial Sequence
  Synthetic Polynucleotide
taatacgactcactatagggttctcctcctctgtcaggagcagtggccctaacagaggagaagggccatggctcctgacaacctggcggcagcgcaaaagatg

SEQ ID NO: 105151 - DNA, 103 bp, Artificial Sequence
  Synthetic Polynucleotide
taatacgactcactatagggcagggtccgcttctcctcctctgtcaggagaacagaggagactcctgatggaggaggagaacctggcggcagcgcaaaagatg

SEQ ID NO: 105152 - DNA, 103 bp, Artificial Sequence
  Synthetic Polynucleotide
taatacgactcactatagggcattgttgaggaagtccgactcgttcagataacagaggagaatctgaatgagtcggactaacctggcggcagcgcaaaagatg

SEQ ID NO: 105153 - DNA, 103 bp, Artificial Sequence
  Synthetic Polynucleotide
taatacgactcactatagggcctcagcaatcagggtccgcttctcctcctaacagaggagaaggaggatgagcggacccaacctggcggcagcgcaaaagatg

SEQ ID NO: 105154 - DNA, 103 bp, Artificial Sequence
  Synthetic Polynucleotide
taatacgactcactatagggatggggtagccctcagcaatcagggtccgcaacagaggagagcggacatggattgctgaaacctggcggcagcgcaaaagatg

SEQ ID NO: 105155 - DNA, 103 bp, Artificial Sequence
  Synthetic Polynucleotide
taatacgactcactatagggttttgtggggatggggtagccctcagcaataacagaggagaattgctatgggctaccccaacctggcggcagcgcaaaagatg

SEQ ID NO: 105156 - DNA, 103 bp, Artificial Sequence
  Synthetic Polynucleotide
taatacgactcactatagggtgagggggagttttgtggggatggggtagcaacagaggagagctaccatgtccccacaaaacctggcggcagcgcaaaagatg

SEQ ID NO: 105157 - DNA, 103 bp, Artificial Sequence
  Synthetic Polynucleotide
taatacgactcactatagggtcggctttggtgagggggagttttgtggggaacagaggagaccccacatgactccccctaacctggcggcagcgcaaaagatg

SEQ ID NO: 105158 - DNA, 103 bp, Artificial Sequence
  Synthetic Polynucleotide
taatacgactcactatagggggccttctcctcggctttggtgagggggagaacagaggagactccccatgaccaaagccaacctggcggcagcgcaaaagatg

SEQ ID NO: 105159 - DNA, 103 bp, Artificial Sequence
  Synthetic Polynucleotide
taatacgactcactatagggctctcttcaaggccttctcctcggctttggaacagaggagaccaaagatgaggagaaggaacctggcggcagcgcaaaagatg

SEQ ID NO: 105160 - DNA, 103 bp, Artificial Sequence
  Synthetic Polynucleotide
taatacgactcactatagggttcctccggactctcttcaaggccttctccaacagaggagaggagaaatgcttgaagagaacctggcggcagcgcaaaagatg

SEQ ID NO: 105161 - DNA, 103 bp, Artificial Sequence
  Synthetic Polynucleotide
taatacgactcactataggggttcttgattttcctccggactctcttcaaaacagaggagattgaagatggtccggaggaacctggcggcagcgcaaaagatg

SEQ ID NO: 105162 - DNA, 103 bp, Artificial Sequence
  Synthetic Polynucleotide
taatacgactcactatagggctgagatcttgttcttgattttcctccggaaacagaggagatccggaatgaaatcaagaaacctggcggcagcgcaaaagatg

SEQ ID NO: 105163 - DNA, 103 bp, Artificial Sequence
  Synthetic Polynucleotide
taatacgactcactatagggggaaagtgcgcattgttgaggaagtccgacaacagaggagagtcggaatgcctcaacaaaacctggcggcagcgcaaaagatg

SEQ ID NO: 105164 - DNA, 103 bp, Artificial Sequence
  Synthetic Polynucleotide
taatacgactcactatagggctctcctgggctgagatcttgttcttgattaacagaggagaaatcaaatgcaagatctcaacctggcggcagcgcaaaagatg

SEQ ID NO: 105165 - DNA, 103 bp, Artificial Sequence
  Synthetic Polynucleotide
taatacgactcactatagggcttacgacggctctcctgggctgagatcttaacagaggagaaagatcatggcccaggagaacctggcggcagcgcaaaagatg

SEQ ID NO: 105166 - DNA, 103 bp, Artificial Sequence
  Synthetic Polynucleotide
taatacgactcactatagggactccttcttcttacgacggctctcctgggaacagaggagacccaggatggccgtcgtaaacctggcggcagcgcaaaagatg

SEQ ID NO: 105167 - DNA, 103 bp, Artificial Sequence
  Synthetic Polynucleotide
taatacgactcactatagggcactccacatactccttcttcttacgacggaacagaggagaccgtcgatggaagaaggaaacctggcggcagcgcaaaagatg

SEQ ID NO: 105168 - DNA, 103 bp, Artificial Sequence
  Synthetic Polynucleotide
taatacgactcactatagggcttttctagacactccacatactccttcttaacagaggagaaagaagatgtatgtggagaacctggcggcagcgcaaaagatg

SEQ ID NO: 105169 - DNA, 103 bp, Artificial Sequence
  Synthetic Polynucleotide
taatacgactcactatagggtctccaccttcttttctagacactccacataacagaggagaatgtggatggtctagaaaaacctggcggcagcgcaaaagatg

SEQ ID NO: 105170 - DNA, 103 bp, Artificial Sequence
  Synthetic Polynucleotide
taatacgactcactataggggatgtaaatgtctccaccttcttttctagaaacagaggagatctagaatggaaggtggaaacctggcggcagcgcaaaagatg

SEQ ID NO: 105171 - DNA, 103 bp, Artificial Sequence
  Synthetic Polynucleotide
taatacgactcactatagggattgttctcagatgtaaatgtctccaccttaacagaggagaaaggtgatgacatttacaaacctggcggcagcgcaaaagatg

SEQ ID NO: 105172 - DNA, 103 bp, Artificial Sequence
  Synthetic Polynucleotide
taatacgactcactatagggtccacagttcattgttctcagatgtaaatgaacagaggagacatttaatgctgagaacaaacctggcggcagcgcaaaagatg

SEQ ID NO: 105173 - DNA, 103 bp, Artificial Sequence
  Synthetic Polynucleotide
taatacgactcactatagggtccaccttcttccacagttcattgttctcaaacagaggagatgagaaatgtgaactgtgaacctggcggcagcgcaaaagatg

SEQ ID NO: 105174 - DNA, 103 bp, Artificial Sequence
  Synthetic Polynucleotide
taatacgactcactataggggccctgctccccgctctccagcacctccataacagaggagaatggagatgctggagagcaacctggcggcagcgcaaaagatg

SEQ ID NO: 105175 - DNA, 103 bp, Artificial Sequence
  Synthetic Polynucleotide
taatacgactcactatagggcagaagttctgagaagtgcgtgtggtacataacagaggagaatgtacatgacgcacttcaacctggcggcagcgcaaaagatg

SEQ ID NO: 105176 - DNA, 103 bp, Artificial Sequence
  Synthetic Polynucleotide
taatacgactcactatagggtaccttcttccgaagctccaagttctcagtaacagaggagaactgagatgttggagcttaacctggcggcagcgcaaaagatg

SEQ ID NO: 105177 - DNA, 103 bp, Artificial Sequence
  Synthetic Polynucleotide
taatacgactcactatagggctagaacctctaccttcttccgaagctccaaacagaggagatggagcatgggaagaaggaacctggcggcagcgcaaaagatg

SEQ ID NO: 105178 - DNA, 103 bp, Artificial Sequence
  Synthetic Polynucleotide
taatacgactcactatagggttagtgttctctagaacctctaccttcttcaacagaggagagaagaaatgagaggttctaacctggcggcagcgcaaaagatg

SEQ ID NO: 105179 - DNA, 103 bp, Artificial Sequence
  Synthetic Polynucleotide
taatacgactcactataggggagagtcctattagtgttctctagaacctcaacagaggagagaggttatggagaacactaacctggcggcagcgcaaaagatg

SEQ ID NO: 105180 - DNA, 103 bp, Artificial Sequence
  Synthetic Polynucleotide
taatacgactcactataggggttgctgaaggagagtcctattagtgttctaacagaggagaagaacaatgataggactcaacctggcggcagcgcaaaagatg

SEQ ID NO: 105181 - DNA, 103 bp, Artificial Sequence
  Synthetic Polynucleotide
taatacgactcactatagggagcttctggagttgctgaaggagagtcctaaacagaggagataggacatgccttcagcaaacctggcggcagcgcaaaagatg

SEQ ID NO: 105182 - DNA, 103 bp, Artificial Sequence
  Synthetic Polynucleotide
taatacgactcactatagggcaaagtctgaagcttctggagttgctgaagaacagaggagacttcagatgctccagaagaacctggcggcagcgcaaaagatg

SEQ ID NO: 105183 - DNA, 103 bp, Artificial Sequence
  Synthetic Polynucleotide
taatacgactcactatagggtgcccatcaccaaagtctgaagcttctggaaacagaggagatccagaatgttcagacttaacctggcggcagcgcaaaagatg

SEQ ID NO: 105184 - DNA, 103 bp, Artificial Sequence
  Synthetic Polynucleotide
taatacgactcactatagggcgagaaaccttgcccatcaccaaagtctgaaacagaggagatcagacatgggtgatgggaacctggcggcagcgcaaaagatg

SEQ ID NO: 105185 - DNA, 103 bp, Artificial Sequence
  Synthetic Polynucleotide
taatacgactcactatagggcttgcaggttcgagaaaccttgcccatcacaacagaggagagtgatgatgaaggtttctaacctggcggcagcgcaaaagatg

SEQ ID NO: 105186 - DNA, 103 bp, Artificial Sequence
  Synthetic Polynucleotide
taatacgactcactatagggaaaactcatccagaagttctgagaagtgcgaacagaggagacgcactatgcagaacttcaacctggcggcagcgcaaaagatg

SEQ ID NO: 105187 - DNA, 103 bp, Artificial Sequence
  Synthetic Polynucleotide
taatacgactcactatagggtgccagctaacttgcaggttcgagaaacctaacagaggagaaggtttatggaacctgcaaacctggcggcagcgcaaaagatg

SEQ ID NO: 105188 - DNA, 103 bp, Artificial Sequence
  Synthetic Polynucleotide
taatacgactcactatagggccagtctgcgtgccagctaacttgcaggttaacagaggagaaacctgatggttagctggaacctggcggcagcgcaaaagatg

SEQ ID NO: 105189 - DNA, 103 bp, Artificial Sequence
  Synthetic Polynucleotide
taatacgactcactataggggaggcaggtgccagtctgcgtgccagctaaaacagaggagattagctatgacgcagactaacctggcggcagcgcaaaagatg

SEQ ID NO: 105190 - DNA, 103 bp, Artificial Sequence
  Synthetic Polynucleotide
taatacgactcactatagggccacaaccatgaggcaggtgccagtctgcgaacagaggagacgcagaatggcacctgccaacctggcggcagcgcaaaagatg

SEQ ID NO: 105191 - DNA, 103 bp, Artificial Sequence
  Synthetic Polynucleotide
taatacgactcactatagggaagcacagcaccacaaccatgaggcaggtgaacagaggagacacctgatgcatggttgtaacctggcggcagcgcaaaagatg

SEQ ID NO: 105192 - DNA, 103 bp, Artificial Sequence
  Synthetic Polynucleotide
taatacgactcactatagggtgcaacggcaaagcacagcaccacaaccataacagaggagaatggttatggtgctgtgcaacctggcggcagcgcaaaagatg

SEQ ID NO: 105193 - DNA, 103 bp, Artificial Sequence
  Synthetic Polynucleotide
taatacgactcactatagggagctgccgaatgcaacggcaaagcacagcaaacagaggagatgctgtatgttgccgttgaacctggcggcagcgcaaaagatg

SEQ ID NO: 105194 - DNA, 103 bp, Artificial Sequence
  Synthetic Polynucleotide
taatacgactcactatagggccttgaaagaagctgccgaatgcaacggcaaacagaggagatgccgtatgattcggcagaacctggcggcagcgcaaaagatg

SEQ ID NO: 105195 - DNA, 103 bp, Artificial Sequence
  Synthetic Polynucleotide
taatacgactcactataggggggcccgtagccttgaaagaagctgccgaaaacagaggagattcggcatgttctttcaaaacctggcggcagcgcaaaagatg

SEQ ID NO: 105196 - DNA, 103 bp, Artificial Sequence
  Synthetic Polynucleotide
taatacgactcactatagggcagaaggatagggcccgtagccttgaaagaaacagaggagatctttcatggctacgggcaacctggcggcagcgcaaaagatg

SEQ ID NO: 105197 - DNA, 103 bp, Artificial Sequence
  Synthetic Polynucleotide
taatacgactcactatagggacgttctgggaaaactcatccagaagttctaacagaggagaagaactatgggatgagttaacctggcggcagcgcaaaagatg

SEQ ID NO: 105198 - DNA, 103 bp, Artificial Sequence
  Synthetic Polynucleotide
taatacgactcactatagggatcttggtggcagaaggatagggcccgtagaacagaggagactacggatgctatccttcaacctggcggcagcgcaaaagatg

SEQ ID NO: 105199 - DNA, 103 bp, Artificial Sequence
  Synthetic Polynucleotide
taatacgactcactataggggggcagagccatcttggtggcagaaggataaacagaggagatatcctatggccaccaagaacctggcggcagcgcaaaagatg

SEQ ID NO: 105200 - DNA, 103 bp, Artificial Sequence
  Synthetic Polynucleotide
taatacgactcactatagggaatgctggctgggcagagccatcttggtggaacagaggagaccaccaatgtggctctgcaacctggcggcagcgcaaaagatg

SEQ ID NO: 105201 - DNA, 103 bp, Artificial Sequence
  Synthetic Polynucleotide
taatacgactcactatagggtcctgcagggaatgctggctgggcagagccaacagaggagaggctctatgcagccagcaaacctggcggcagcgcaaaagatg

SEQ ID NO: 105202 - DNA, 103 bp, Artificial Sequence
  Synthetic Polynucleotide
taatacgactcactatagggtgtgtagggctcctgcagggaatgctggctaacagaggagaagccagatgtccctgcagaacctggcggcagcgcaaaagatg

SEQ ID NO: 105203 - DNA, 103 bp, Artificial Sequence
  Synthetic Polynucleotide
taatacgactcactatagggccacggaggctgtgtagggctcctgcagggaacagaggagaccctgcatgagccctacaaacctggcggcagcgcaaaagatg

SEQ ID NO: 105204 - DNA, 103 bp, Artificial Sequence
  Synthetic Polynucleotide
taatacgactcactatagggctggatctcaccacggaggctgtgtagggcaacagaggagagccctaatgagcctccgtaacctggcggcagcgcaaaagatg

SEQ ID NO: 105205 - DNA, 103 bp, Artificial Sequence
  Synthetic Polynucleotide
taatacgactcactatagggcagcaggtttctggatctcaccacggaggcaacagaggagagcctccatggtgagatccaacctggcggcagcgcaaaagatg

SEQ ID NO: 105206 - DNA, 103 bp, Artificial Sequence
  Synthetic Polynucleotide
taatacgactcactatagggcctcgtagatcagcaggtttctggatctcaaacagaggagatgagatatggaaacctgcaacctggcggcagcgcaaaagatg

SEQ ID NO: 105207 - DNA, 103 bp, Artificial Sequence
  Synthetic Polynucleotide
taatacgactcactatagggggagaatgttcctcgtagatcagcaggtttaacagaggagaaaacctatggatctacgaaacctggcggcagcgcaaaagatg

SEQ ID NO: 105208 - DNA, 103 bp, Artificial Sequence
  Synthetic Polynucleotide
taatacgactcactatagggctgacccaagacgttctgggaaaactcatcaacagaggagagatgagatgtcccagaacaacctggcggcagcgcaaaagatg

SEQ ID NO: 105209 - DNA, 103 bp, Artificial Sequence
  Synthetic Polynucleotide
taatacgactcactatagggctcctctgggggagaatgttcctcgtagataacagaggagaatctacatggaacattctaacctggcggcagcgcaaaagatg

SEQ ID NO: 105210 - DNA, 103 bp, Artificial Sequence
  Synthetic Polynucleotide
taatacgactcactatagggggctggatgactcctctgggggagaatgttaacagaggagaaacattatgccccagaggaacctggcggcagcgcaaaagatg

SEQ ID NO: 105211 - DNA, 103 bp, Artificial Sequence
  Synthetic Polynucleotide
taatacgactcactataggggccgagcccgggctggatgactcctctgggaacagaggagacccagaatggtcatccagaacctggcggcagcgcaaaagatg

SEQ ID NO: 105212 - DNA, 103 bp, Artificial Sequence
  Synthetic Polynucleotide
taatacgactcactatagggcagctccccagccgagcccgggctggatgaaacagaggagatcatccatgccgggctcgaacctggcggcagcgcaaaagatg

SEQ ID NO: 105213 - DNA, 103 bp, Artificial Sequence
  Synthetic Polynucleotide
taatacgactcactatagggcccagccccccagctccccagccgagcccgaacagaggagacgggctatgctggggagcaacctggcggcagcgcaaaagatg

SEQ ID NO: 105214 - DNA, 103 bp, Artificial Sequence
  Synthetic Polynucleotide
taatacgactcactataggggaacctctatcccagccccccagctccccaaacagaggagatggggaatgggggggctgaacctggcggcagcgcaaaagatg

SEQ ID NO: 105215 - DNA, 103 bp, Artificial Sequence
  Synthetic Polynucleotide
taatacgactcactataggggagcagggaggaacctctatcccagcccccaacagaggagagggggcatggatagaggtaacctggcggcagcgcaaaagatg

SEQ ID NO: 105216 - DNA, 103 bp, Artificial Sequence
  Synthetic Polynucleotide
taatacgactcactatagggctgacaccctgagcagggaggaacctctataacagaggagaatagagatgcctccctgcaacctggcggcagcgcaaaagatg

SEQ ID NO: 105217 - DNA, 103 bp, Artificial Sequence
  Synthetic Polynucleotide
taatacgactcactataggggactccagccctgacaccctgagcagggagaacagaggagactccctatgcagggtgtcaacctggcggcagcgcaaaagatg

SEQ ID NO: 105218 - DNA, 103 bp, Artificial Sequence
  Synthetic Polynucleotide
taatacgactcactatagggatccggcctggactccagccctgacaccctaacagaggagaagggtgatggggctggagaacctggcggcagcgcaaaagatg

SEQ ID NO: 105219 - DNA, 103 bp, Artificial Sequence
  Synthetic Polynucleotide
taatacgactcactatagggcattcaggagctgacccaagacgttctgggaacagaggagacccagaatgtcttgggtcaacctggcggcagcgcaaaagatg

SEQ ID NO: 105220 - DNA, 103 bp, Artificial Sequence
  Synthetic Polynucleotide
taatacgactcactataggggaagatccacatccggcctggactccagccaacagaggagaggctggatgccaggccggaacctggcggcagcgcaaaagatg

SEQ ID NO: 105221 - DNA, 103 bp, Artificial Sequence
  Synthetic Polynucleotide
taatacgactcactatagggatgaaatggggaagatccacatccggcctgaacagaggagacaggccatgtgtggatctaacctggcggcagcgcaaaagatg

SEQ ID NO: 105222 - DNA, 103 bp, Artificial Sequence
  Synthetic Polynucleotide
taatacgactcactatagggattcgagataatgaaatggggaagatccacaacagaggagagtggatatgccccatttcaacctggcggcagcgcaaaagatg

SEQ ID NO: 105223 - DNA, 103 bp, Artificial Sequence
  Synthetic Polynucleotide
taatacgactcactatagggggctggtctcattcgagataatgaaatgggaacagaggagacccattatgttatctcgaaacctggcggcagcgcaaaagatg

SEQ ID NO: 105224 - DNA, 103 bp, Artificial Sequence
  Synthetic Polynucleotide
taatacgactcactataggggacttctccaggctggtctcattcgagataaacagaggagatatctcatgtgagaccagaacctggcggcagcgcaaaagatg

SEQ ID NO: 105225 - DNA, 103 bp, Artificial Sequence
  Synthetic Polynucleotide
taatacgactcactatagggcaaaagcactgacttctccaggctggtctcaacagaggagagagaccatgctggagaagaacctggcggcagcgcaaaagatg

SEQ ID NO: 105226 - DNA, 103 bp, Artificial Sequence
  Synthetic Polynucleotide
taatacgactcactataggggctgcagctccaaaagcactgacttctccaaacagaggagatggagaatgcagtgctttaacctggcggcagcgcaaaagatg

SEQ ID NO: 105227 - DNA, 103 bp, Artificial Sequence
  Synthetic Polynucleotide
taatacgactcactatagggaccaggtgctgctgcagctccaaaagcactaacagaggagaagtgctatgggagctgcaaacctggcggcagcgcaaaagatg

SEQ ID NO: 105228 - DNA, 103 bp, Artificial Sequence
  Synthetic Polynucleotide
taatacgactcactatagggtttggcgctgaccaggtgctgctgcagctcaacagaggagagagctgatgcagcacctgaacctggcggcagcgcaaaagatg

SEQ ID NO: 105229 - DNA, 103 bp, Artificial Sequence
  Synthetic Polynucleotide
taatacgactcactatagggtcccctccagtttggcgctgaccaggtgctaacagaggagaagcaccatgtcagcgccaaacctggcggcagcgcaaaagatg

SEQ ID NO: 105230 - DNA, 103 bp, Artificial Sequence
  Synthetic Polynucleotide
taatacgactcactatagggaggaaaggatcattcaggagctgacccaagaacagaggagacttgggatggctcctgaaaacctggcggcagcgcaaaagatg

SEQ ID NO: 105231 - DNA, 103 bp, Artificial Sequence
  Synthetic Polynucleotide
taatacgactcactatagggagtgtttcattcccctccagtttggcgctgaacagaggagacagcgcatgactggagggaacctggcggcagcgcaaaagatg

SEQ ID NO: 105232 - DNA, 103 bp, Artificial Sequence
  Synthetic Polynucleotide
taatacgactcactatagggtacaacttttagtgtttcattcccctccagaacagaggagactggagatgaatgaaacaaacctggcggcagcgcaaaagatg

SEQ ID NO: 105233 - DNA, 103 bp, Artificial Sequence
  Synthetic Polynucleotide
taatacgactcactatagggtgtcgagttctacaacttttagtgtttcataacagaggagaatgaaaatgtaaaagttgaacctggcggcagcgcaaaagatg

SEQ ID NO: 105234 - DNA, 103 bp, Artificial Sequence
  Synthetic Polynucleotide
taatacgactcactatagggttcactcttctgtcgagttctacaacttttaacagaggagaaaaagtatgagaactcgaaacctggcggcagcgcaaaagatg

SEQ ID NO: 105235 - DNA, 103 bp, Artificial Sequence
  Synthetic Polynucleotide
taatacgactcactataggggaaagtggtgttcactcttctgtcgagttcaacagaggagagaactcatgagaagagtgaacctggcggcagcgcaaaagatg

SEQ ID NO: 105236 - DNA, 103 bp, Artificial Sequence
  Synthetic Polynucleotide
taatacgactcactatagggcttctctgagaggaaaggatcattcaggagaacagaggagactcctgatggatcctttcaacctggcggcagcgcaaaagatg

SEQ ID NO: 105237 - DNA, 103 bp, Artificial Sequence
  Synthetic Polynucleotide
taatacgactcactatagggttgacacactcttctctgagaggaaaggataacagaggagaatccttatgtctcagagaaacctggcggcagcgcaaaagatg

SEQ ID NO: 105238 - DNA, 103 bp, Artificial Sequence
  Synthetic Polynucleotide
taatacgactcactatagggtccacctccattgacacactcttctctgagaacagaggagactcagaatggagtgtgtcaacctggcggcagcgcaaaagatg

SEQ ID NO: 105239 - DNA, 103 bp, Artificial Sequence
  Synthetic Polynucleotide
taatacgactcactatagggcggggaaggttccacctccattgacacactaacagaggagaagtgtgatgatggaggtgaacctggcggcagcgcaaaagatg

SEQ ID NO: 105240 - DNA, 103 bp, Artificial Sequence
  Synthetic Polynucleotide
taatacgactcactatagggactgcagcacgccctgctccccgctctccaaacagaggagatggagaatggggagcaggaacctggcggcagcgcaaaagatg

SEQ ID NO: 105241 - DNA, 103 bp, Artificial Sequence
  Synthetic Polynucleotide
taatacgactcactatagggccggggacgtcggggaaggttccacctccaaacagaggagatggaggatgaaccttcccaacctggcggcagcgcaaaagatg

SEQ ID NO: 105242 - DNA, 103 bp, Artificial Sequence
  Synthetic Polynucleotide
taatacgactcactatagggatgagaggcgccggggacgtcggggaaggtaacagaggagaaccttcatggacgtccccaacctggcggcagcgcaaaagatg

SEQ ID NO: 105243 - DNA, 103 bp, Artificial Sequence
  Synthetic Polynucleotide
taatacgactcactatagggctcagcctggatgagaggcgccggggacgtaacagaggagaacgtccatggcgcctctcaacctggcggcagcgcaaaagatg

SEQ ID NO: 105244 - DNA, 103 bp, Artificial Sequence
  Synthetic Polynucleotide
taatacgactcactatagggagtagctgtgctcagcctggatgagaggcgaacagaggagacgcctcatgtccaggctgaacctggcggcagcgcaaaagatg

SEQ ID NO: 105245 - DNA, 103 bp, Artificial Sequence
  Synthetic Polynucleotide
taatacgactcactatagggtcgcacagggagtagctgtgctcagcctggaacagaggagaccaggcatggcacagctaaacctggcggcagcgcaaaagatg

SEQ ID NO: 105246 - DNA, 103 bp, Artificial Sequence
  Synthetic Polynucleotide
taatacgactcactatagggccgaggctcctcgcacagggagtagctgtgaacagaggagacacagcatgtccctgtgcaacctggcggcagcgcaaaagatg

SEQ ID NO: 105247 - DNA, 103 bp, Artificial Sequence
  Synthetic Polynucleotide
taatacgactcactataggggcgactgggcccgaggctcctcgcacagggaacagaggagaccctgtatgaggagcctcaacctggcggcagcgcaaaagatg

SEQ ID NO: 105248 - DNA, 103 bp, Artificial Sequence
  Synthetic Polynucleotide
taatacgactcactatagggtgggtgaagggcgactgggcccgaggctccaacagaggagaggagccatgggcccagtcaacctggcggcagcgcaaaagatg

SEQ ID NO: 105249 - DNA, 103 bp, Artificial Sequence
  Synthetic Polynucleotide
taatacgactcactatagggggtggtaatgtgggtgaagggcgactgggcaacagaggagagcccagatgcccttcaccaacctggcggcagcgcaaaagatg

SEQ ID NO: 105250 - DNA, 103 bp, Artificial Sequence
  Synthetic Polynucleotide
taatacgactcactatagggagctgtcactggtggtaatgtgggtgaaggaacagaggagaccttcaatgacattaccaaacctggcggcagcgcaaaagatg

SEQ ID NO: 105251 - DNA, 103 bp, Artificial Sequence
  Synthetic Polynucleotide
taatacgactcactatagggttgcggtcccactgcagcacgccctgctccaacagaggagaggagcaatgcgtgctgcaaacctggcggcagcgcaaaagatg

SEQ ID NO: 105252 - DNA, 103 bp, Artificial Sequence
  Synthetic Polynucleotide
taatacgactcactatagggtcgtcattgaagctgtcactggtggtaatgaacagaggagacattacatgcagtgacagaacctggcggcagcgcaaaagatg

SEQ ID NO: 105253 - DNA, 103 bp, Artificial Sequence
  Synthetic Polynucleotide
taatacgactcactatagggttccacctcatcgtcattgaagctgtcactaacagaggagaagtgacatgttcaatgacaacctggcggcagcgcaaaagatg

SEQ ID NO: 105254 - DNA, 103 bp, Artificial Sequence
  Synthetic Polynucleotide
taatacgactcactatagggatttctcactttccacctcatcgtcattgaaacagaggagatcaatgatgatgaggtggaacctggcggcagcgcaaaagatg

SEQ ID NO: 105255 - DNA, 103 bp, Artificial Sequence
  Synthetic Polynucleotide
taatacgactcactataggggacaggtaccatttctcactttccacctcaaacagaggagatgaggtatgaagtgagaaaacctggcggcagcgcaaaagatg

SEQ ID NO: 105256 - DNA, 103 bp, Artificial Sequence
  Synthetic Polynucleotide
taatacgactcactataggggaagtctgtagacaggtaccatttctcactaacagaggagaagtgagatgtggtacctgaacctggcggcagcgcaaaagatg

SEQ ID NO: 105257 - DNA, 103 bp, Artificial Sequence
  Synthetic Polynucleotide
taatacgactcactatagggatgttgaagggaagtctgtagacaggtaccaacagaggagaggtaccatgctacagactaacctggcggcagcgcaaaagatg

SEQ ID NO: 105258 - DNA, 103 bp, Artificial Sequence
  Synthetic Polynucleotide
taatacgactcactataggggtcttgatggatgttgaagggaagtctgtaaacagaggagatacagaatgcccttcaacaacctggcggcagcgcaaaagatg

SEQ ID NO: 105259 - DNA, 103 bp, Artificial Sequence
  Synthetic Polynucleotide
taatacgactcactatagggaactggctctgtcttgatggatgttgaaggaacagaggagaccttcaatgtccatcaagaacctggcggcagcgcaaaagatg

SEQ ID NO: 105260 - DNA, 103 bp, Artificial Sequence
  Synthetic Polynucleotide
taatacgactcactataggggttcgtctgtaactggctctgtcttgatggaacagaggagaccatcaatgcagagccagaacctggcggcagcgcaaaagatg

SEQ ID NO: 105261 - DNA, 103 bp, Artificial Sequence
  Synthetic Polynucleotide
taatacgactcactatagggcctgggggtggttcgtctgtaactggctctaacagaggagaagagccatgtacagacgaaacctggcggcagcgcaaaagatg

SEQ ID NO: 105262 - DNA, 103 bp, Artificial Sequence
  Synthetic Polynucleotide
taatacgactcactatagggctcgctcagcttgcggtcccactgcagcacaacagaggagagtgctgatgtgggaccgcaacctggcggcagcgcaaaagatg

SEQ ID NO: 105263 - DNA, 103 bp, Artificial Sequence
  Synthetic Polynucleotide
taatacgactcactatagggcggaacgagtcctgggggtggttcgtctgtaacagaggagaacagacatgccacccccaaacctggcggcagcgcaaaagatg

SEQ ID NO: 105264 - DNA, 103 bp, Artificial Sequence
  Synthetic Polynucleotide
taatacgactcactataggggagtgacagacggaacgagtcctgggggtgaacagaggagacaccccatggactcgttcaacctggcggcagcgcaaaagatg

SEQ ID NO: 105265 - DNA, 103 bp, Artificial Sequence
  Synthetic Polynucleotide
taatacgactcactataggggtgatggtcagagtgacagacggaacgagtaacagaggagaactcgtatggtctgtcacaacctggcggcagcgcaaaagatg

SEQ ID NO: 105266 - DNA, 103 bp, Artificial Sequence
  Synthetic Polynucleotide
taatacgactcactatagggggagatggctgtgatggtcagagtgacagaaacagaggagatctgtcatgctgaccatcaacctggcggcagcgcaaaagatg

SEQ ID NO: 105267 - DNA, 103 bp, Artificial Sequence
  Synthetic Polynucleotide
taatacgactcactatagggccaacggggtggagatggctgtgatggtcaaacagaggagatgaccaatgcagccatctaacctggcggcagcgcaaaagatg

SEQ ID NO: 105268 - DNA, 103 bp, Artificial Sequence
  Synthetic Polynucleotide
taatacgactcactatagggtcctccttttccaacggggtggagatggctaacagaggagaagccatatgcaccccgttaacctggcggcagcgcaaaagatg

SEQ ID NO: 105269 - DNA, 103 bp, Artificial Sequence
  Synthetic Polynucleotide
taatacgactcactatagggcagaggaggttcctccttttccaacggggtaacagaggagaaccccgatggaaaaggagaacctggcggcagcgcaaaagatg

SEQ ID NO: 105270 - DNA, 103 bp, Artificial Sequence
  Synthetic Polynucleotide
taatacgactcactatagggtgttcatttccagaggaggttcctccttttaacagaggagaaaaaggatgaacctcctcaacctggcggcagcgcaaaagatg

SEQ ID NO: 105271 - DNA, 103 bp, Artificial Sequence
  Synthetic Polynucleotide
taatacgactcactatagggtcaaccccagtgttcatttccagaggaggtaacagaggagaacctccatgggaaatgaaaacctggcggcagcgcaaaagatg

SEQ ID NO: 105272 - DNA, 103 bp, Artificial Sequence
  Synthetic Polynucleotide
taatacgactcactataggggcacgaggaatcaaccccagtgttcatttcaacagaggagagaaatgatgactggggttaacctggcggcagcgcaaaagatg

SEQ ID NO: 105273 - DNA, 103 bp, Artificial Sequence
  Synthetic Polynucleotide
taatacgactcactataggggctctgacagctcgctcagcttgcggtcccaacagaggagagggaccatgagctgagcgaacctggcggcagcgcaaaagatg

SEQ ID NO: 105274 - DNA, 103 bp, Artificial Sequence
  Synthetic Polynucleotide
taatacgactcactatagggtaatggtctggcacgaggaatcaaccccagaacagaggagactggggatgattcctcgtaacctggcggcagcgcaaaagatg

SEQ ID NO: 105275 - DNA, 103 bp, Artificial Sequence
  Synthetic Polynucleotide
taatacgactcactatagggattttaggaataatggtctggcacgaggaaaacagaggagattcctcatgccagaccataacctggcggcagcgcaaaagatg

SEQ ID NO: 105276 - DNA, 103 bp, Artificial Sequence
  Synthetic Polynucleotide
taatacgactcactatagggctccagcttaattttaggaataatggtctgaacagaggagacagaccatgattcctaaaaacctggcggcagcgcaaaagatg

SEQ ID NO: 105277 - DNA, 103 bp, Artificial Sequence
  Synthetic Polynucleotide
taatacgactcactatagggcttcatgaggctccagcttaattttaggaaaacagaggagattcctaatgttaagctggaacctggcggcagcgcaaaagatg

SEQ ID NO: 105278 - DNA, 103 bp, Artificial Sequence
  Synthetic Polynucleotide
taatacgactcactatagggaactgatccacttcatgaggctccagcttaaacagaggagataagctatggcctcatgaaacctggcggcagcgcaaaagatg

SEQ ID NO: 105279 - DNA, 103 bp, Artificial Sequence
  Synthetic Polynucleotide
taatacgactcactataggggaagtttagaaactgatccacttcatgaggaacagaggagacctcatatggtggatcagaacctggcggcagcgcaaaagatg

SEQ ID NO: 105280 - DNA, 103 bp, Artificial Sequence
  Synthetic Polynucleotide
taatacgactcactatagggctttaggagagaagtttagaaactgatccaaacagaggagatggatcatgttctaaactaacctggcggcagcgcaaaagatg

SEQ ID NO: 105281 - DNA, 103 bp, Artificial Sequence
  Synthetic Polynucleotide
taatacgactcactatagggactggggcttctttaggagagaagtttagaaacagaggagatctaaaatgctctcctaaaacctggcggcagcgcaaaagatg

SEQ ID NO: 105282 - DNA, 103 bp, Artificial Sequence
  Synthetic Polynucleotide
taatacgactcactatagggcaggtggtccactggggcttctttaggagaaacagaggagatctcctatggaagccccaaacctggcggcagcgcaaaagatg

SEQ ID NO: 105283 - DNA, 103 bp, Artificial Sequence
  Synthetic Polynucleotide
taatacgactcactataggggcggcaaatgcaggtggtccactggggcttaacagaggagaaagcccatgtggaccaccaacctggcggcagcgcaaaagatg

SEQ ID NO: 105284 - DNA, 103 bp, Artificial Sequence
  Synthetic Polynucleotide
taatacgactcactatagggccgtccccgggctctgacagctcgctcagcaacagaggagagctgagatggctgtcagaaacctggcggcagcgcaaaagatg

SEQ ID NO: 105285 - DNA, 103 bp, Artificial Sequence
  Synthetic Polynucleotide
taatacgactcactatagggggaggggtgggcggcaaatgcaggtggtccaacagaggagaggaccaatggcatttgccaacctggcggcagcgcaaaagatg

SEQ ID NO: 105286 - DNA, 103 bp, Artificial Sequence
  Synthetic Polynucleotide
taatacgactcactataggggtgactgctcggaggggtgggcggcaaatgaacagaggagacatttgatgcccacccctaacctggcggcagcgcaaaagatg

SEQ ID NO: 105287 - DNA, 103 bp, Artificial Sequence
  Synthetic Polynucleotide
taatacgactcactatagggagtcactgccgtgactgctcggaggggtggaacagaggagaccacccatgcgagcagtcaacctggcggcagcgcaaaagatg

SEQ ID NO: 105288 - DNA, 103 bp, Artificial Sequence
  Synthetic Polynucleotide
taatacgactcactatagggctgccctctgagtcactgccgtgactgctcaacagaggagagagcagatgcggcagtgaaacctggcggcagcgcaaaagatg

SEQ ID NO: 105289 - DNA, 103 bp, Artificial Sequence
  Synthetic Polynucleotide
taatacgactcactataggggggactcaggctgccctctgagtcactgccaacagaggagaggcagtatgtcagagggcaacctggcggcagcgcaaaagatg

SEQ ID NO: 105290 - DNA, 103 bp, Artificial Sequence
  Synthetic Polynucleotide
taatacgactcactatagggggcgtgggttgggactcaggctgccctctgaacagaggagacagaggatggcctgagtcaacctggcggcagcgcaaaagatg

SEQ ID NO: 105291 - DNA, 103 bp, Artificial Sequence
  Synthetic Polynucleotide
taatacgactcactatagggaaggggtgcaggcgtgggttgggactcaggaacagaggagacctgagatgcaacccacgaacctggcggcagcgcaaaagatg

SEQ ID NO: 105292 - DNA, 103 bp, Artificial Sequence
  Synthetic Polynucleotide
taatacgactcactatagggaggcaggctgaaggggtgcaggcgtgggttaacagaggagaaacccaatgctgcaccccaacctggcggcagcgcaaaagatg

SEQ ID NO: 105293 - DNA, 103 bp, Artificial Sequence
  Synthetic Polynucleotide
taatacgactcactatagggtgtgggtctgaggcaggctgaaggggtgcaaacagaggagatgcaccatgtcagcctgcaacctggcggcagcgcaaaagatg

SEQ ID NO: 105294 - DNA, 103 bp, Artificial Sequence
  Synthetic Polynucleotide
taatacgactcactatagggctggaggggctgtgggtctgaggcaggctgaacagaggagacagcctatgtcagacccaaacctggcggcagcgcaaaagatg

SEQ ID NO: 105295 - DNA, 103 bp, Artificial Sequence
  Synthetic Polynucleotide
taatacgactcactataggggagggcctcgccgtccccgggctctgacagaacagaggagactgtcaatgcccggggacaacctggcggcagcgcaaaagatg

SEQ ID NO: 105296 - DNA, 103 bp, Artificial Sequence
  Synthetic Polynucleotide
taatacgactcactataggggggtgcagctctggaggggctgtgggtctgaacagaggagacagaccatgagcccctccaacctggcggcagcgcaaaagatg

SEQ ID NO: 105297 - DNA, 103 bp, Artificial Sequence
  Synthetic Polynucleotide
taatacgactcactatagggagggggcccggggtgcagctctggaggggcaacagaggagagcccctatggagctgcacaacctggcggcagcgcaaaagatg

SEQ ID NO: 105298 - DNA, 103 bp, Artificial Sequence
  Synthetic Polynucleotide
taatacgactcactataggggagagggcggagggggcccggggtgcagctaacagaggagaagctgcatgccgggccccaacctggcggcagcgcaaaagatg

SEQ ID NO: 105299 - DNA, 103 bp, Artificial Sequence
  Synthetic Polynucleotide
taatacgactcactatagggaggggagctggagagggcggagggggcccgaacagaggagacgggccatgtccgccctcaacctggcggcagcgcaaaagatg

SEQ ID NO: 105300 - DNA, 103 bp, Artificial Sequence
  Synthetic Polynucleotide
taatacgactcactatagggccgtgaggagaggggagctggagagggcggaacagaggagaccgcccatgccagctcccaacctggcggcagcgcaaaagatg

SEQ ID NO: 105301 - DNA, 103 bp, Artificial Sequence
  Synthetic Polynucleotide
taatacgactcactatagggttatgaggagccgtgaggagaggggagctgaacagaggagacagctcatgtctcctcacaacctggcggcagcgcaaaagatg

SEQ ID NO: 105302 - DNA, 103 bp, Artificial Sequence
  Synthetic Polynucleotide
taatacgactcactatagggtccctgcagtttatgaggagccgtgaggagaacagaggagactcctcatggctcctcataacctggcggcagcgcaaaagatg

SEQ ID NO: 105303 - DNA, 103 bp, Artificial Sequence
  Synthetic Polynucleotide
taatacgactcactataggggagggcctgatccctgcagtttatgaggagaacagaggagactcctcatgaactgcaggaacctggcggcagcgcaaaagatg

SEQ ID NO: 105304 - DNA, 103 bp, Artificial Sequence
  Synthetic Polynucleotide
taatacgactcactataggggtcaggaccagagggcctgatccctgcagtaacagaggagaactgcaatgatcaggcccaacctggcggcagcgcaaaagatg

SEQ ID NO: 105305 - DNA, 103 bp, Artificial Sequence
  Synthetic Polynucleotide
taatacgactcactatagggctcctcctctgtcaggaccagagggcctgaaacagaggagatcaggcatgctggtcctgaacctggcggcagcgcaaaagatg

SEQ ID NO: 105306 - DNA, 103 bp, Artificial Sequence
  Synthetic Polynucleotide
taatacgactcactatagggtgtggtacatgagggcctcgccgtccccggaacagaggagaccggggatggcgaggcccaacctggcggcagcgcaaaagatg

SEQ ID NO: 105307 - DNA, 103 bp, Artificial Sequence
  Synthetic Polynucleotide
taatacgactcactataggggggtcctcttctcctcctctgtcaggaccaaacagaggagatggtccatgcagaggaggaacctggcggcagcgcaaaagatg

SEQ ID NO: 105308 - DNA, 103 bp, Artificial Sequence
  Synthetic Polynucleotide
taatacgactcactatagggtcagcgatcagggtcctcttctcctcctctaacagaggagaagaggaatggaagaggacaacctggcggcagcgcaaaagatg

SEQ ID NO: 105309 - DNA, 103 bp, Artificial Sequence
  Synthetic Polynucleotide
taatacgactcactataggggggatagccctcagcgatcagggtcctcttaacagaggagaaagaggatgctgatcgctaacctggcggcagcgcaaaagatg

SEQ ID NO: 105310 - DNA, 103 bp, Artificial Sequence
  Synthetic Polynucleotide
taatacgactcactatagggtggtggggatgggatagccctcagcgatcaaacagaggagatgatcgatgagggctatcaacctggcggcagcgcaaaagatg

SEQ ID NO: 105311 - DNA, 103 bp, Artificial Sequence
  Synthetic Polynucleotide
taatacgactcactatagggaggggcaatttggtggggatgggatagcccaacagaggagagggctaatgcatccccacaacctggcggcagcgcaaaagatg

SEQ ID NO: 105312 - DNA, 103 bp, Artificial Sequence
  Synthetic Polynucleotide
taatacgactcactatagggtgattttgacaggggcaatttggtggggataacagaggagaatccccatgaaattgcccaacctggcggcagcgcaaaagatg

SEQ ID NO: 105313 - DNA, 103 bp, Artificial Sequence
  Synthetic Polynucleotide
taatacgactcactatagggccttctcctctgattttgacaggggcaattaacagaggagaaattgcatgtgtcaaaataacctggcggcagcgcaaaagatg

SEQ ID NO: 105314 - DNA, 103 bp, Artificial Sequence
  Synthetic Polynucleotide
taatacgactcactatagggttcttcagggccttctcctctgattttgacaacagaggagagtcaaaatgagaggagaaaacctggcggcagcgcaaaagatg

SEQ ID NO: 105315 - DNA, 103 bp, Artificial Sequence
  Synthetic Polynucleotide
taatacgactcactatagggcctccgaattttcttcagggccttctcctcaacagaggagagaggagatggccctgaagaacctggcggcagcgcaaaagatg

SEQ ID NO: 105316 - DNA, 103 bp, Artificial Sequence
  Synthetic Polynucleotide
taatacgactcactatagggtcttgatcttcctccgaattttcttcagggaacagaggagaccctgaatgaaattcggaaacctggcggcagcgcaaaagatg

SEQ ID NO: 105317 - DNA, 103 bp, Artificial Sequence
  Synthetic Polynucleotide
taatacgactcactataggggagaagtgcgtgtggtacatgagggcctcgaacagaggagacgaggcatgcatgtaccaaacctggcggcagcgcaaaagatg

SEQ ID NO: 105318 - DNA, 103 bp, Artificial Sequence
  Synthetic Polynucleotide
taatacgactcactataggggaaatcttattcttgatcttcctccgaattaacagaggagaaattcgatggaagatcaaaacctggcggcagcgcaaaagatg

SEQ ID NO: 105319 - DNA, 103 bp, Artificial Sequence
  Synthetic Polynucleotide
taatacgactcactatagggttcctgagcagaaatcttattcttgatcttaacagaggagaaagatcatgaataagattaacctggcggcagcgcaaaagatg

SEQ ID NO: 105320 - DNA, 103 bp, Artificial Sequence
  Synthetic Polynucleotide
taatacgactcactatagggttctcctactttcctgagcagaaatcttataacagaggagaataagaatgctgctcaggaacctggcggcagcgcaaaagatg

SEQ ID NO: 105321 - DNA, 103 bp, Artificial Sequence
  Synthetic Polynucleotide
taatacgactcactatagggtctttcttctttctcctactttcctgagcaaacagaggagatgctcaatgaagtaggagaacctggcggcagcgcaaaagatg

SEQ ID NO: 105322 - DNA, 103 bp, Artificial Sequence
  Synthetic Polynucleotide
taatacgactcactataggggtccatgtattctttcttctttctcctactaacagaggagaagtaggatgaagaagaaaaacctggcggcagcgcaaaagatg

SEQ ID NO: 105323 - DNA, 103 bp, Artificial Sequence
  Synthetic Polynucleotide
taatacgactcactatagggtctccaggctgtccatgtattctttcttctaacagaggagaagaagaatgaatacatggaacctggcggcagcgcaaaagatg

SEQ ID NO: 105324 - DNA, 103 bp, Artificial Sequence
  Synthetic Polynucleotide
taatacgactcactatagggtccacttttttctccaggctgtccatgtataacagaggagaatacatatgcagcctggaaacctggcggcagcgcaaaagatg

SEQ ID NO: 105325 - DNA, 103 bp, Artificial Sequence
  Synthetic Polynucleotide
taatacgactcactatagggtgaacaagactccacttttttctccaggctaacagaggagaagcctgatgaaaaaagtgaacctggcggcagcgcaaaagatg

SEQ ID NO: 105326 - DNA, 103 bp, Artificial Sequence
  Synthetic Polynucleotide
taatacgactcactatagggagttctcagttgaacaagactccactttttaacagaggagaaaaaagatgagtcttgttaacctggcggcagcgcaaaagatg

SEQ ID NO: 105327 - DNA, 103 bp, Artificial Sequence
  Synthetic Polynucleotide
taatacgactcactatagggcgaagctccaagttctcagttgaacaagacaacagaggagagtcttgatgaactgagaaaacctggcggcagcgcaaaagatg

SEQ ID NO: 105328 - DNA, 103 bp, Artificial Sequence
  Synthetic Polynucleotide
taatacgactcactatagggcatctttccagcagctaaatccgtattcataacagaggagaatgaatatggatttagctaacctggcggcagcgcaaaagatg

SEQ ID NO: 105329 - DNA, 103 bp, Artificial Sequence
  Synthetic Polynucleotide
taatacgactcactatagggcacgtgtctcaggatgccgtcctgccggtcaacagaggagagaccggatggacggcatcaacctggcggcagcgcaaaagatg

SEQ ID NO: 105330 - DNA, 103 bp, Artificial Sequence
  Synthetic Polynucleotide
taatacgactcactataggggctgatggaggggaggatgatgagggcaaaaacagaggagatttgccatgatcatcctcaacctggcggcagcgcaaaagatg

SEQ ID NO: 105331 - DNA, 103 bp, Artificial Sequence
  Synthetic Polynucleotide
taatacgactcactatagggggccaaaagggctgatggaggggaggatgaaacagaggagatcatccatgcctccatcaaacctggcggcagcgcaaaagatg

SEQ ID NO: 105332 - DNA, 103 bp, Artificial Sequence
  Synthetic Polynucleotide
taatacgactcactataggggttttgttggggccaaaagggctgatggagaacagaggagactccatatgcccttttggaacctggcggcagcgcaaaagatg

SEQ ID NO: 105333 - DNA, 103 bp, Artificial Sequence
  Synthetic Polynucleotide
taatacgactcactatagggagggctctcggttttgttggggccaaaaggaacagaggagaccttttatgcccaacaaaaacctggcggcagcgcaaaagatg

SEQ ID NO: 105334 - DNA, 103 bp, Artificial Sequence
  Synthetic Polynucleotide
taatacgactcactatagggcaaagtccccagggctctcggttttgttggaacagaggagaccaacaatgccgagagccaacctggcggcagcgcaaaagatg

SEQ ID NO: 105335 - DNA, 103 bp, Artificial Sequence
  Synthetic Polynucleotide
taatacgactcactatagggcgtacaggcgcaaagtccccagggctctcgaacagaggagacgagagatgtggggacttaacctggcggcagcgcaaaagatg

SEQ ID NO: 105336 - DNA, 103 bp, Artificial Sequence
  Synthetic Polynucleotide
taatacgactcactatagggggagaacactcgtacaggcgcaaagtccccaacagaggagaggggacatggcgcctgtaaacctggcggcagcgcaaaagatg

SEQ ID NO: 105337 - DNA, 103 bp, Artificial Sequence
  Synthetic Polynucleotide
taatacgactcactataggggcaaagttctggagaacactcgtacaggcgaacagaggagacgcctgatggagtgttctaacctggcggcagcgcaaaagatg

SEQ ID NO: 105338 - DNA, 103 bp, Artificial Sequence
  Synthetic Polynucleotide
taatacgactcactataggggcatcgttgtgcaaagttctggagaacactaacagaggagaagtgttatgcagaactttaacctggcggcagcgcaaaagatg

SEQ ID NO: 105339 - DNA, 103 bp, Artificial Sequence
  Synthetic Polynucleotide
taatacgactcactataggggcgggaggcagcatcgttgtgcaaagttctaacagaggagaagaactatgcacaacgataacctggcggcagcgcaaaagatg

SEQ ID NO: 105340 - DNA, 103 bp, Artificial Sequence
  Synthetic Polynucleotide
taatacgactcactatagggcgcccagctccacgtgtctcaggatgccgtaacagaggagaacggcaatgtgagacacgaacctggcggcagcgcaaaagatg

SEQ ID NO: 105341 - DNA, 103 bp, Artificial Sequence
  Synthetic Polynucleotide
taatacgactcactatagggcagcagccacgcgggaggcagcatcgttgtaacagaggagaacaacgatgctgcctcccaacctggcggcagcgcaaaagatg

SEQ ID NO: 105342 - DNA, 103 bp, Artificial Sequence
  Synthetic Polynucleotide
taatacgactcactatagggggcacagcatcagcagccacgcgggaggcaaacagaggagatgcctcatgcgtggctgcaacctggcggcagcgcaaaagatg

SEQ ID NO: 105343 - DNA, 103 bp, Artificial Sequence
  Synthetic Polynucleotide
taatacgactcactatagggctcggagcctggcacagcatcagcagccacaacagaggagagtggctatggatgctgtgaacctggcggcagcgcaaaagatg

SEQ ID NO: 105344 - DNA, 103 bp, Artificial Sequence
  Synthetic Polynucleotide
taatacgactcactataggggtcctggggcctcggagcctggcacagcataacagaggagaatgctgatgcaggctccgaacctggcggcagcgcaaaagatg

SEQ ID NO: 105345 - DNA, 103 bp, Artificial Sequence
  Synthetic Polynucleotide
taatacgactcactatagggtcgggtcggggtcctggggcctcggagcctaacagaggagaaggctcatgggccccaggaacctggcggcagcgcaaaagatg

SEQ ID NO: 105346 - DNA, 103 bp, Artificial Sequence
  Synthetic Polynucleotide
taatacgactcactatagggtgtgtcagcctcgggtcggggtcctggggcaacagaggagagccccaatgccccgacccaacctggcggcagcgcaaaagatg

SEQ ID NO: 105347 - DNA, 103 bp, Artificial Sequence
  Synthetic Polynucleotide
taatacgactcactatagggcttctcgggttgtgtcagcctcgggtcgggaacagaggagacccgacatgaggctgacaaacctggcggcagcgcaaaagatg

SEQ ID NO: 105348 - DNA, 103 bp, Artificial Sequence
  Synthetic Polynucleotide
taatacgactcactatagggcctggagactcttctcgggttgtgtcagccaacagaggagaggctgaatgaacccgagaaacctggcggcagcgcaaaagatg

SEQ ID NO: 105349 - DNA, 103 bp, Artificial Sequence
  Synthetic Polynucleotide
taatacgactcactatagggcccggggcttcctggagactcttctcgggtaacagaggagaacccgaatggagtctccaaacctggcggcagcgcaaaagatg

SEQ ID NO: 105350 - DNA, 103 bp, Artificial Sequence
  Synthetic Polynucleotide
taatacgactcactatagggcccagtctgccccggggcttcctggagactaacagaggagaagtctcatggaagccccgaacctggcggcagcgcaaaagatg

SEQ ID NO: 105351 - DNA, 103 bp, Artificial Sequence
  Synthetic Polynucleotide
taatacgactcactatagggccccagccctcgcccagctccacgtgtctcaacagaggagagagacaatgggagctgggaacctggcggcagcgcaaaagatg

SEQ ID NO: 105352 - DNA, 103 bp, Artificial Sequence
  Synthetic Polynucleotide
taatacgactcactatagggtcctggaagccccagtctgccccggggcttaacagaggagaaagcccatgggcagactgaacctggcggcagcgcaaaagatg

SEQ ID NO: 105353 - DNA, 103 bp, Artificial Sequence
  Synthetic Polynucleotide
taatacgactcactataggggttcgcggtgtcctggaagccccagtctgcaacagaggagagcagacatgggcttccagaacctggcggcagcgcaaaagatg

SEQ ID NO: 105354 - DNA, 103 bp, Artificial Sequence
  Synthetic Polynucleotide
taatacgactcactatagggaattggtcaggttcgcggtgtcctggaagcaacagaggagagcttccatgacaccgcgaaacctggcggcagcgcaaaagatg

SEQ ID NO: 105355 - DNA, 103 bp, Artificial Sequence
  Synthetic Polynucleotide
taatacgactcactatagggtcctccgtcgaattggtcaggttcgcggtgaacagaggagacaccgcatgcctgaccaaaacctggcggcagcgcaaaagatg

SEQ ID NO: 105356 - DNA, 103 bp, Artificial Sequence
  Synthetic Polynucleotide
taatacgactcactataggggttgtccagctcctccgtcgaattggtcagaacagaggagactgaccatgtcgacggagaacctggcggcagcgcaaaagatg

SEQ ID NO: 105357 - DNA, 103 bp, Artificial Sequence
  Synthetic Polynucleotide
taatacgactcactatagggccagggtggcgttgtccagctcctccgtcgaacagaggagacgacggatgagctggacaaacctggcggcagcgcaaaagatg

SEQ ID NO: 105358 - DNA, 103 bp, Artificial Sequence
  Synthetic Polynucleotide
taatacgactcactatagggttcctcaggaccagggtggcgttgtccagcaacagaggagagctggaatgcgccaccctaacctggcggcagcgcaaaagatg

SEQ ID NO: 105359 - DNA, 103 bp, Artificial Sequence
  Synthetic Polynucleotide
taatacgactcactatagggctctgttgcattcctcaggaccagggtggcaacagaggagagccaccatggtcctgaggaacctggcggcagcgcaaaagatg

SEQ ID NO: 105360 - DNA, 103 bp, Artificial Sequence
  Synthetic Polynucleotide
taatacgactcactatagggggcccagcccctctgttgcattcctcaggaaacagaggagatcctgaatgatgcaacagaacctggcggcagcgcaaaagatg

SEQ ID NO: 105361 - DNA, 103 bp, Artificial Sequence
  Synthetic Polynucleotide
taatacgactcactatagggagggcgacctggcccagcccctctgttgcaaacagaggagatgcaacatgggggctgggaacctggcggcagcgcaaaagatg

SEQ ID NO: 105362 - DNA, 103 bp, Artificial Sequence
  Synthetic Polynucleotide
taatacgactcactatagggcttgacgtgaccccagccctcgcccagctcaacagaggagagagctgatggagggctggaacctggcggcagcgcaaaagatg

SEQ ID NO: 105363 - DNA, 103 bp, Artificial Sequence
  Synthetic Polynucleotide
taatacgactcactatagggccagtccagcagggcgacctggcccagcccaacagaggagagggctgatgcaggtcgccaacctggcggcagcgcaaaagatg

SEQ ID NO: 105364 - DNA, 103 bp, Artificial Sequence
  Synthetic Polynucleotide
taatacgactcactatagggcaggcgccacccagtccagcagggcgacctaacagaggagaaggtcgatgtgctggactaacctggcggcagcgcaaaagatg

SEQ ID NO: 105365 - DNA, 103 bp, Artificial Sequence
  Synthetic Polynucleotide
taatacgactcactataggggtgctcggcccaggcgccacccagtccagcaacagaggagagctggaatgggtggcgccaacctggcggcagcgcaaaagatg

SEQ ID NO: 105366 - DNA, 103 bp, Artificial Sequence
  Synthetic Polynucleotide
taatacgactcactatagggtcctgagccagtgctcggcccaggcgccacaacagaggagagtggcgatggggccgagcaacctggcggcagcgcaaaagatg

SEQ ID NO: 105367 - DNA, 103 bp, Artificial Sequence
  Synthetic Polynucleotide
taatacgactcactataggggccctgcacgtcctgagccagtgctcggccaacagaggagaggccgaatgctggctcagaacctggcggcagcgcaaaagatg

SEQ ID NO: 105368 - DNA, 103 bp, Artificial Sequence
  Synthetic Polynucleotide
taatacgactcactataggggccgcctccagccctgcacgtcctgagccaaacagaggagatggctcatgacgtgcaggaacctggcggcagcgcaaaagatg

SEQ ID NO: 105369 - DNA, 103 bp, Artificial Sequence
  Synthetic Polynucleotide
taatacgactcactatagggctcgtctcccgccgcctccagccctgcacgaacagaggagacgtgcaatgctggaggcgaacctggcggcagcgcaaaagatg

SEQ ID NO: 105370 - DNA, 103 bp, Artificial Sequence
  Synthetic Polynucleotide
taatacgactcactatagggcctgctggtccttgacgtgaccccagccctaacagaggagaagggctatggtcacgtcaaacctggcggcagcgcaaaagatg

SEQ ID NO: 105371 - DNA, 103 bp, Artificial Sequence
  Synthetic Polynucleotide
taatacgactcactatagggtttggcaggacctgctggtccttgacgtgaaacagaggagatcacgtatgggaccagcaaacctggcggcagcgcaaaagatg

SEQ ID NO: 105372 - DNA, 103 bp, Artificial Sequence
  Synthetic Polynucleotide
taatacgactcactatagggagagtcggggtttggcaggacctgctggtcaacagaggagagaccagatggtcctgccaaacctggcggcagcgcaaaagatg

SEQ ID NO: 105373 - DNA, 103 bp, Artificial Sequence
  Synthetic Polynucleotide
taatacgactcactatagggggaagtcgtcagagtcggggtttggcaggaaacagaggagatcctgcatgaccccgactaacctggcggcagcgcaaaagatg

SEQ ID NO: 105374 - DNA, 103 bp, Artificial Sequence
  Synthetic Polynucleotide
taatacgactcactatagggatggagctgaggaagtcgtcagagtcggggaacagaggagaccccgaatgtgacgacttaacctggcggcagcgcaaaagatg

SEQ ID NO: 105375 - DNA, 103 bp, Artificial Sequence
  Synthetic Polynucleotide
taatacgactcactatagggagagcccaggatggagctgaggaagtcgtcaacagaggagagacgacatgctcagctccaacctggcggcagcgcaaaagatg

SEQ ID NO: 105376 - DNA, 103 bp, Artificial Sequence
  Synthetic Polynucleotide
taatacgactcactatagggcagcagaagccatctttccagcagctaaataacagaggagaatttagatgctggaaagaaacctggcggcagcgcaaaagatg

SEQ ID NO: 105377 - DNA, 103 bp, Artificial Sequence
  Synthetic Polynucleotide
taatacgactcactataggggtgagtctccagagcccaggatggagctgaaacagaggagatcagctatgtcctgggctaacctggcggcagcgcaaaagatg

SEQ ID NO: 105378 - DNA, 103 bp, Artificial Sequence
  Synthetic Polynucleotide
taatacgactcactataggggagctgggcagtgagtctccagagcccaggaacagaggagacctgggatgtggagactcaacctggcggcagcgcaaaagatg

SEQ ID NO: 105379 - DNA, 103 bp, Artificial Sequence
  Synthetic Polynucleotide
taatacgactcactatagggccagagtggggagctgggcagtgagtctccaacagaggagaggagacatgctgcccagcaacctggcggcagcgcaaaagatg

SEQ ID NO: 105380 - DNA, 103 bp, Artificial Sequence
  Synthetic Polynucleotide
taatacgactcactatagggcttcgggggaccagagtggggagctgggcaaacagaggagatgcccaatgccccactctaacctggcggcagcgcaaaagatg

SEQ ID NO: 105381 - DNA, 103 bp, Artificial Sequence
  Synthetic Polynucleotide
taatacgactcactatagggctatcactgccttcgggggaccagagtgggaacagaggagacccactatggtcccccgaaacctggcggcagcgcaaaagatg

SEQ ID NO: 105382 - DNA, 103 bp, Artificial Sequence
  Synthetic Polynucleotide
taatacgactcactatagggggagatgccactatcactgccttcgggggaaacagaggagatcccccatgggcagtgataacctggcggcagcgcaaaagatg

SEQ ID NO: 105383 - DNA, 103 bp, Artificial Sequence
  Synthetic Polynucleotide
taatacgactcactatagggggaggtcttcggagatgccactatcactgcaacagaggagagcagtgatggtggcatctaacctggcggcagcgcaaaagatg

SEQ ID NO: 105384 - DNA, 103 bp, Artificial Sequence
  Synthetic Polynucleotide
taatacgactcactataggggggtcggaggggaggtcttcggagatgccaaacagaggagatggcatatgcgaagacctaacctggcggcagcgcaaaagatg

SEQ ID NO: 105385 - DNA, 103 bp, Artificial Sequence
  Synthetic Polynucleotide
taatacgactcactatagggggtgtcctgggggtcggaggggaggtcttcaacagaggagagaagacatgccctccgacaacctggcggcagcgcaaaagatg

SEQ ID NO: 105386 - DNA, 103 bp, Artificial Sequence
  Synthetic Polynucleotide
taatacgactcactatagggtgcgtggaggggtgtcctgggggtcggaggaacagaggagacctccgatgcccaggacaaacctggcggcagcgcaaaagatg

SEQ ID NO: 105387 - DNA, 103 bp, Artificial Sequence
  Synthetic Polynucleotide
taatacgactcactatagggatggagcaggcagcagaagccatctttccaaacagaggagatggaaaatgggcttctgcaacctggcggcagcgcaaaagatg

SEQ ID NO: 105388 - DNA, 103 bp, Artificial Sequence
  Synthetic Polynucleotide
taatacgactcactataggggctggtccgctgcgtggaggggtgtcctggaacagaggagaccaggaatgccctccacgaacctggcggcagcgcaaaagatg

SEQ ID NO: 105389 - DNA, 103 bp, Artificial Sequence
  Synthetic Polynucleotide
taatacgactcactataggggggggaggtggctggtccgctgcgtggaggaacagaggagacctccaatgagcggaccaaacctggcggcagcgcaaaagatg

SEQ ID NO: 105390 - DNA, 103 bp, Artificial Sequence
  Synthetic Polynucleotide
taatacgactcactatagggggcagccggcgggggaggtggctggtccgcaacagaggagagcggacatgccacctcccaacctggcggcagcgcaaaagatg

SEQ ID NO: 105391 - DNA, 103 bp, Artificial Sequence
  Synthetic Polynucleotide
taatacgactcactatagggtgggcaggatggcagccggcgggggaggtgaacagaggagacacctcatgcgccggctgaacctggcggcagcgcaaaagatg

SEQ ID NO: 105392 - DNA, 103 bp, Artificial Sequence
  Synthetic Polynucleotide
taatacgactcactatagggcttgccaggctgggcaggatggcagccggcaacagaggagagccggcatgcatcctgccaacctggcggcagcgcaaaagatg

SEQ ID NO: 105393 - DNA, 103 bp, Artificial Sequence
  Synthetic Polynucleotide
taatacgactcactatagggggcagggccccttgccaggctgggcaggataacagaggagaatcctgatgagcctggcaaacctggcggcagcgcaaaagatg

SEQ ID NO: 105394 - DNA, 103 bp, Artificial Sequence
  Synthetic Polynucleotide
taatacgactcactatagggtgataggagaggcagggccccttgccaggcaacagaggagagcctggatgggggccctgaacctggcggcagcgcaaaagatg

SEQ ID NO: 105395 - DNA, 103 bp, Artificial Sequence
  Synthetic Polynucleotide
taatacgactcactataggggttgccaggatgataggagaggcagggcccaacagaggagagggcccatgctctcctataacctggcggcagcgcaaaagatg

SEQ ID NO: 105396 - DNA, 103 bp, Artificial Sequence
  Synthetic Polynucleotide
taatacgactcactatagggtggagcaagagttgccaggatgataggagaaacagaggagatctcctatgatcctggcaaacctggcggcagcgcaaaagatg

SEQ ID NO: 105397 - DNA, 103 bp, Artificial Sequence
  Synthetic Polynucleotide
taatacgactcactatagggggggttgtggtggagcaagagttgccaggaaacagaggagatcctggatgctcttgctcaacctggcggcagcgcaaaagatg

SEQ ID NO: 105398 - DNA, 103 bp, Artificial Sequence
  Synthetic Polynucleotide
taatacgactcactataggggatggggtccatggagcaggcagcagaagcaacagaggagagcttctatggcctgctccaacctggcggcagcgcaaaagatg

SEQ ID NO: 105399 - DNA, 103 bp, Artificial Sequence
  Synthetic Polynucleotide
taatacgactcactatagggcactggccctggggttgtggtggagcaagaaacagaggagatcttgcatgaccacaaccaacctggcggcagcgcaaaagatg

SEQ ID NO: 105400 - DNA, 103 bp, Artificial Sequence
  Synthetic Polynucleotide
taatacgactcactataggggtacttggatcactggccctggggttgtggaacagaggagaccacaaatgcagggccagaacctggcggcagcgcaaaagatg

SEQ ID NO: 105401 - DNA, 103 bp, Artificial Sequence
  Synthetic Polynucleotide
taatacgactcactataggggaggcttcaggtacttggatcactggccctaacagaggagaagggccatggatccaagtaacctggcggcagcgcaaaagatg

SEQ ID NO: 105402 - DNA, 103 bp, Artificial Sequence
  Synthetic Polynucleotide
taatacgactcactatagggtatggtcacagaggcttcaggtacttggataacagaggagaatccaaatgcctgaagccaacctggcggcagcgcaaaagatg

SEQ ID NO: 105403 - DNA, 103 bp, Artificial Sequence
  Synthetic Polynucleotide
taatacgactcactatagggtttccaggtctatggtcacagaggcttcagaacagaggagactgaagatgctgtgaccaaacctggcggcagcgcaaaagatg

SEQ ID NO: 105404 - DNA, 103 bp, Artificial Sequence
  Synthetic Polynucleotide
taatacgactcactataggggggctccacatttccaggtctatggtcacaaacagaggagatgtgacatgagacctggaaacctggcggcagcgcaaaagatg

SEQ ID NO: 105405 - DNA, 103 bp, Artificial Sequence
  Synthetic Polynucleotide
taatacgactcactatagggccttcctcctgggctccacatttccaggtcaacagaggagagacctgatgatgtggagcaacctggcggcagcgcaaaagatg

SEQ ID NO: 105406 - DNA, 103 bp, Artificial Sequence
  Synthetic Polynucleotide
taatacgactcactatagggcagcacagatccttcctcctgggctccacaaacagaggagatgtggaatgcaggaggaaaacctggcggcagcgcaaaagatg

SEQ ID NO: 105407 - DNA, 103 bp, Artificial Sequence
  Synthetic Polynucleotide
taatacgactcactataggggccggcttctcagcacagatccttcctcctaacagaggagaaggaggatggatctgtgcaacctggcggcagcgcaaaagatg

SEQ ID NO: 105408 - DNA, 103 bp, Artificial Sequence
  Synthetic Polynucleotide
taatacgactcactatagggcaccggatcagccggcttctcagcacagataacagaggagaatctgtatggagaagccgaacctggcggcagcgcaaaagatg

SEQ ID NO: 105409 - DNA, 103 bp, Artificial Sequence
  Synthetic Polynucleotide
taatacgactcactatagggcaaagctgtcgatggggtccatggagcaggaacagaggagacctgctatgtggaccccaaacctggcggcagcgcaaaagatg

SEQ ID NO: 105410 - DNA, 103 bp, Artificial Sequence
  Synthetic Polynucleotide
taatacgactcactataggggggacaggtccaccggatcagccggcttctaacagaggagaagaagcatgctgatccggaacctggcggcagcgcaaaagatg

SEQ ID NO: 105411 - DNA, 103 bp, Artificial Sequence
  Synthetic Polynucleotide
taatacgactcactatagggttgcatcgtggggacaggtccaccggatcaaacagaggagatgatccatgggacctgtcaacctggcggcagcgcaaaagatg

SEQ ID NO: 105412 - DNA, 103 bp, Artificial Sequence
  Synthetic Polynucleotide
taatacgactcactatagggcacggtgagattgcatcgtggggacaggtcaacagaggagagacctgatgccacgatgcaacctggcggcagcgcaaaagatg

SEQ ID NO: 105413 - DNA, 103 bp, Artificial Sequence
  Synthetic Polynucleotide
taatacgactcactatagggggaggtctttcacggtgagattgcatcgtgaacagaggagacacgatatgatctcaccgaacctggcggcagcgcaaaagatg

SEQ ID NO: 105414 - DNA, 103 bp, Artificial Sequence
  Synthetic Polynucleotide
taatacgactcactatagggcccgaaaggaggaggtctttcacggtgagaaacagaggagatctcacatggaaagacctaacctggcggcagcgcaaaagatg

SEQ ID NO: 105415 - DNA, 103 bp, Artificial Sequence
  Synthetic Polynucleotide
taatacgactcactatagggcccactgctgcccgaaaggaggaggtctttaacagaggagaaaagacatgctcctttcgaacctggcggcagcgcaaaagatg

SEQ ID NO: 105416 - DNA, 103 bp, Artificial Sequence
  Synthetic Polynucleotide
taatacgactcactataggggttgcaggtccccactgctgcccgaaaggaaacagaggagatcctttatggcagcagtgaacctggcggcagcgcaaaagatg

SEQ ID NO: 105417 - DNA, 103 bp, Artificial Sequence
  Synthetic Polynucleotide
taatacgactcactatagggaggtgatgctgttgcaggtccccactgctgaacagaggagacagcagatgggacctgcaaacctggcggcagcgcaaaagatg

SEQ ID NO: 105418 - DNA, 103 bp, Artificial Sequence
  Synthetic Polynucleotide
taatacgactcactatagggggaggcccccaggtgatgctgttgcaggtcaacagaggagagacctgatgcagcatcacaacctggcggcagcgcaaaagatg

SEQ ID NO: 105419 - DNA, 103 bp, Artificial Sequence
  Synthetic Polynucleotide
taatacgactcactataggggcaggaggtaggaggcccccaggtgatgctaacagaggagaagcatcatgtgggggcctaacctggcggcagcgcaaaagatg

SEQ ID NO: 105420 - DNA, 103 bp, Artificial Sequence
  Synthetic Polynucleotide
taatacgactcactatagggtccaggagctcaaagctgtcgatggggtccaacagaggagaggacccatgcgacagcttaacctggcggcagcgcaaaagatg

SEQ ID NO: 105421 - DNA, 103 bp, Artificial Sequence
  Synthetic Polynucleotide
taatacgactcactataggggccccaggtcgcaggaggtaggaggcccccaacagaggagagggggcatgctacctcctaacctggcggcagcgcaaaagatg

SEQ ID NO: 105422 - DNA, 103 bp, Artificial Sequence
  Synthetic Polynucleotide
taatacgactcactatagggacagtgcccagccccaggtcgcaggaggtaaacagaggagatacctcatgcgacctgggaacctggcggcagcgcaaaagatg

SEQ ID NO: 105423 - DNA, 103 bp, Artificial Sequence
  Synthetic Polynucleotide
taatacgactcactatagggccagctcctgacagtgcccagccccaggtcaacagaggagagacctgatgctgggcactaacctggcggcagcgcaaaagatg

SEQ ID NO: 105424 - DNA, 103 bp, Artificial Sequence
  Synthetic Polynucleotide
taatacgactcactatagggtcggtgagcaccagctcctgacagtgcccaaacagaggagatgggcaatgtcaggagctaacctggcggcagcgcaaaagatg

SEQ ID NO: 105425 - DNA, 103 bp, Artificial Sequence
  Synthetic Polynucleotide
taatacgactcactatagggcttctcatcctcggtgagcaccagctcctgaacagaggagacaggagatggtgctcaccaacctggcggcagcgcaaaagatg

SEQ ID NO: 105426 - DNA, 103 bp, Artificial Sequence
  Synthetic Polynucleotide
taatacgactcactatagggccagcagcttcttctcatcctcggtgagcaaacagaggagatgctcaatgaggatgagaaacctggcggcagcgcaaaagatg

SEQ ID NO: 105427 - DNA, 103 bp, Artificial Sequence
  Synthetic Polynucleotide
taatacgactcactatagggccttctttagccagcagcttcttctcatccaacagaggagaggatgaatggaagctgctaacctggcggcagcgcaaaagatg

SEQ ID NO: 105428 - DNA, 103 bp, Artificial Sequence
  Synthetic Polynucleotide
taatacgactcactatagggcagggtgatgccttctttagccagcagcttaacagaggagaaagctgatggctaaagaaaacctggcggcagcgcaaaagatg

SEQ ID NO: 105429 - DNA, 103 bp, Artificial Sequence
  Synthetic Polynucleotide
taatacgactcactataggggctgagtgggcagggtgatgccttctttagaacagaggagactaaagatggcatcacccaacctggcggcagcgcaaaagatg

SEQ ID NO: 105430 - DNA, 103 bp, Artificial Sequence
  Synthetic Polynucleotide
taatacgactcactataggggtgaggggcagctgagtgggcagggtgatgaacagaggagacatcacatggcccactcaaacctggcggcagcgcaaaagatg

SEQ ID NO: 105431 - DNA, 103 bp, Artificial Sequence
  Synthetic Polynucleotide
taatacgactcactatagggaaacaggagatccaggagctcaaagctgtcaacagaggagagacagcatggagctcctgaacctggcggcagcgcaaaagatg

SEQ ID NO: 105432 - DNA, 103 bp, Artificial Sequence
  Synthetic Polynucleotide
taatacgactcactatagggctcgtacttagtgaggggcagctgagtgggaacagaggagacccactatgctgcccctcaacctggcggcagcgcaaaagatg

SEQ ID NO: 105433 - DNA, 103 bp, Artificial Sequence
  Synthetic Polynucleotide
taatacgactcactataggggcactcgctcctcgtacttagtgaggggcaaacagaggagatgccccatgctaagtacgaacctggcggcagcgcaaaagatg

SEQ ID NO: 105434 - DNA, 103 bp, Artificial Sequence
  Synthetic Polynucleotide
taatacgactcactatagggatttttttcagcactcgctcctcgtacttaaacagaggagataagtaatgggagcgagtaacctggcggcagcgcaaaagatg

SEQ ID NO: 105435 - DNA, 103 bp, Artificial Sequence
  Synthetic Polynucleotide
taatacgactcactatagggtttccggcggatttttttcagcactcgctcaacagaggagagagcgaatgctgaaaaaaaacctggcggcagcgcaaaagatg

SEQ ID NO: 105436 - DNA, 103 bp, Artificial Sequence
  Synthetic Polynucleotide
taatacgactcactatagggtgttccggattttccggcggatttttttcaaacagaggagatgaaaaatgtccgccggaaacctggcggcagcgcaaaagatg

SEQ ID NO: 105437 - DNA, 103 bp, Artificial Sequence
  Synthetic Polynucleotide
taatacgactcactataggggccgactgcttgttccggattttccggcggaacagaggagaccgccgatgaatccggaaaacctggcggcagcgcaaaagatg

SEQ ID NO: 105438 - DNA, 103 bp, Artificial Sequence
  Synthetic Polynucleotide
taatacgactcactataggggctttcttgcgccgactgcttgttccggataacagaggagaatccggatgaagcagtcgaacctggcggcagcgcaaaagatg

SEQ ID NO: 105439 - DNA, 103 bp, Artificial Sequence
  Synthetic Polynucleotide
taatacgactcactatagggtcttcttcctgctttcttgcgccgactgctaacagaggagaagcagtatgcgcaagaaaaacctggcggcagcgcaaaagatg

SEQ ID NO: 105440 - DNA, 103 bp, Artificial Sequence
  Synthetic Polynucleotide
taatacgactcactatagggtattccttcttcttcttcctgctttcttgcaacagaggagagcaagaatgcaggaagaaaacctggcggcagcgcaaaagatg

SEQ ID NO: 105441 - DNA, 103 bp, Artificial Sequence
  Synthetic Polynucleotide
taatacgactcactataggggccatcgatatattccttcttcttcttcctaacagaggagaaggaagatgaagaaggaaaacctggcggcagcgcaaaagatg

SEQ ID NO: 105442 - DNA, 103 bp, Artificial Sequence
  Synthetic Polynucleotide
taatacgactcactatagggcctgccggtcaaacaggagatccaggagctaacagaggagaagctccatgatctcctgtaacctggcggcagcgcaaaagatg

SEQ ID NO: 105443 - DNA, 103 bp, Artificial Sequence
  Synthetic Polynucleotide
taatacgactcactataggggagtctccaggccatcgatatattccttctaacagaggagaagaaggatgatatcgatgaacctggcggcagcgcaaaagatg

SEQ ID NO: 105444 - DNA, 103 bp, Artificial Sequence
  Synthetic Polynucleotide
taatacgactcactataggggctgacatccgagtctccaggccatcgataaacagaggagatatcgaatgcctggagacaacctggcggcagcgcaaaagatg

SEQ ID NO: 105445 - DNA, 103 bp, Artificial Sequence
  Synthetic Polynucleotide
taatacgactcactatagggagcagtgcaagctgacatccgagtctccagaacagaggagactggagatgcggatgtcaaacctggcggcagcgcaaaagatg

SEQ ID NO: 105446 - DNA, 103 bp, Artificial Sequence
  Synthetic Polynucleotide
taatacgactcactatagggcctgattctgagcagtgcaagctgacatccaacagaggagaggatgtatgcttgcactgaacctggcggcagcgcaaaagatg

SEQ ID NO: 105447 - DNA, 103 bp, Artificial Sequence
  Synthetic Polynucleotide
taatacgactcactatagggctctgtaactcctgattctgagcagtgcaaaacagaggagattgcacatgtcagaatcaaacctggcggcagcgcaaaagatg

SEQ ID NO: 105448 - DNA, 103 bp, Artificial Sequence
  Synthetic Polynucleotide
taatacgactcactatagggcaagactttcctctgtaactcctgattctgaacagaggagacagaatatggagttacagaacctggcggcagcgcaaaagatg

SEQ ID NO: 105449 - DNA, 103 bp, Artificial Sequence
  Synthetic Polynucleotide
taatacgactcactatagggtctcgagatgcaagactttcctctgtaactaacagaggagaagttacatgggaaagtctaacctggcggcagcgcaaaagatg

SEQ ID NO: 105450 - DNA, 103 bp, Artificial Sequence
  Synthetic Polynucleotide
taatacgactcactatagggaggttttgcttctcgagatgcaagactttcaacagaggagagaaagtatggcatctcgaaacctggcggcagcgcaaaagatg

SEQ ID NO: 105451 - DNA, 103 bp, Artificial Sequence
  Synthetic Polynucleotide
taatacgactcactatagggcaagagggacaggttttgcttctcgagatgaacagaggagacatctcatgaagcaaaacaacctggcggcagcgcaaaagatg

SEQ ID NO: 105452 - DNA, 103 bp, Artificial Sequence
  Synthetic Polynucleotide
taatacgactcactatagggtcagttgctccaagagggacaggttttgctaacagaggagaagcaaaatgtgtccctctaacctggcggcagcgcaaaagatg

SEQ ID NO: 105453 - DNA, 103 bp, Artificial Sequence
  Synthetic Polynucleotide
taatacgactcactatagggaggatgccgtcctgccggtcaaacaggagaaacagaggagatctcctatgtgaccggcaaacctggcggcagcgcaaaagatg

SEQ ID NO: 105454 - DNA, 103 bp, Artificial Sequence
  Synthetic Polynucleotide
taatacgactcactatagggtggagtttcttcagttgctccaagagggacaacagaggagagtccctatgggagcaactaacctggcggcagcgcaaaagatg

SEQ ID NO: 105455 - DNA, 103 bp, Artificial Sequence
  Synthetic Polynucleotide
taatacgactcactatagggcacaatggcctggagtttcttcagttgctcaacagaggagagagcaaatgaagaaactcaacctggcggcagcgcaaaagatg

SEQ ID NO: 105456 - DNA, 103 bp, Artificial Sequence
  Synthetic Polynucleotide
taatacgactcactatagggtggactgcaccacaatggcctggagtttctaacagaggagaagaaacatgaggccattgaacctggcggcagcgcaaaagatg

SEQ ID NO: 105457 - DNA, 103 bp, Artificial Sequence
  Synthetic Polynucleotide
taatacgactcactataggggacttgctggtggactgcaccacaatggccaacagaggagaggccatatgggtgcagtcaacctggcggcagcgcaaaagatg

SEQ ID NO: 105458 - DNA, 103 bp, Artificial Sequence
  Synthetic Polynucleotide
taatacgactcactatagggtgtctgggctgacttgctggtggactgcacaacagaggagagtgcagatgaccagcaagaacctggcggcagcgcaaaagatg

SEQ ID NO: 105459 - DNA, 103 bp, Artificial Sequence
  Synthetic Polynucleotide
taatacgactcactatagggcacaggtgcctgtctgggctgacttgctggaacagaggagaccagcaatgcagcccagaaacctggcggcagcgcaaaagatg

SEQ ID NO: 105460 - DNA, 103 bp, Artificial Sequence
  Synthetic Polynucleotide
taatacgactcactatagggaggactgcgacacaggtgcctgtctgggctaacagaggagaagcccaatgaggcacctgaacctggcggcagcgcaaaagatg

SEQ ID NO: 105461 - DNA, 103 bp, Artificial Sequence
  Synthetic Polynucleotide
taatacgactcactatagggggacagcaacaggactgcgacacaggtgccaacagaggagaggcaccatggtcgcagtcaacctggcggcagcgcaaaagatg

SEQ ID NO: 105462 - DNA, 103 bp, Artificial Sequence
  Synthetic Polynucleotide
taatacgactcactatagggtgagggcaaaggacagcaacaggactgcgaaacagaggagatcgcagatgtgttgctgtaacctggcggcagcgcaaaagatg

SEQ ID NO: 105463 - DNA, 103 bp, Artificial Sequence
  Synthetic Polynucleotide
taatacgactcactataggggggaggatgatgagggcaaaggacagcaacaacagaggagagttgctatgctttgccctaacctggcggcagcgcaaaagatg

SEQ ID NO: 105464 - DNA, 103 bp, Artificial Sequence
  Synthetic Polynucleotide
taatacgactcactataggggtccagcaggtcagggattccgagatccataacagaggagaatggatatgggaatccctaacctggcggcagcgcaaaagatg

SEQ ID NO: 105465 - DNA, 103 bp, Artificial Sequence
  Synthetic Polynucleotide
taatacgactcactatagggagttaccggaacctctggaggggggcagtgaacagaggagacactgcatgcctccagagaacctggcggcagcgcaaaagatg

SEQ ID NO: 105466 - DNA, 103 bp, Artificial Sequence
  Synthetic Polynucleotide
taatacgactcactataggggtgggtcaggatatttctggaagtcactccaacagaggagaggagtgatgtccagaaataacctggcggcagcgcaaaagatg

SEQ ID NO: 105467 - DNA, 103 bp, Artificial Sequence
  Synthetic Polynucleotide
taatacgactcactatagggttacgtccttgtgggtcaggatatttctggaacagaggagaccagaaatgtcctgacccaacctggcggcagcgcaaaagatg

SEQ ID NO: 105468 - DNA, 103 bp, Artificial Sequence
  Synthetic Polynucleotide
taatacgactcactatagggagattttctgttacgtccttgtgggtcaggaacagaggagacctgacatgcaaggacgtaacctggcggcagcgcaaaagatg

SEQ ID NO: 105469 - DNA, 103 bp, Artificial Sequence
  Synthetic Polynucleotide
taatacgactcactatagggttgggtctccagattttctgttacgtccttaacagaggagaaaggacatgacagaaaataacctggcggcagcgcaaaagatg

SEQ ID NO: 105470 - DNA, 103 bp, Artificial Sequence
  Synthetic Polynucleotide
taatacgactcactatagggactctaccacttgggtctccagattttctgaacagaggagacagaaaatgtggagacccaacctggcggcagcgcaaaagatg

SEQ ID NO: 105471 - DNA, 103 bp, Artificial Sequence
  Synthetic Polynucleotide
taatacgactcactatagggctcagtctggactctaccacttgggtctccaacagaggagaggagacatgagtggtagaaacctggcggcagcgcaaaagatg

SEQ ID NO: 105472 - DNA, 103 bp, Artificial Sequence
  Synthetic Polynucleotide
taatacgactcactatagggaggtggctccctcagtctggactctaccacaacagaggagagtggtaatgtccagactgaacctggcggcagcgcaaaagatg

SEQ ID NO: 105473 - DNA, 103 bp, Artificial Sequence
  Synthetic Polynucleotide
taatacgactcactatagggccttggctccaggtggctccctcagtctggaacagaggagaccagacatggggagccacaacctggcggcagcgcaaaagatg

SEQ ID NO: 105474 - DNA, 103 bp, Artificial Sequence
  Synthetic Polynucleotide
taatacgactcactatagggccatttgcatccttggctccaggtggctccaacagaggagaggagccatgtggagccaaaacctggcggcagcgcaaaagatg

SEQ ID NO: 105475 - DNA, 103 bp, Artificial Sequence
  Synthetic Polynucleotide
taatacgactcactatagggccttgttgagccatttgcatccttggctccaacagaggagaggagccatggatgcaaataacctggcggcagcgcaaaagatg

SEQ ID NO: 105476 - DNA, 103 bp, Artificial Sequence
  Synthetic Polynucleotide
taatacgactcactatagggcctgtagcctagttaccggaacctctggagaacagaggagactccagatgttccggtaaaacctggcggcagcgcaaaagatg

SEQ ID NO: 105477 - DNA, 103 bp, Artificial Sequence
  Synthetic Polynucleotide
taatacgactcactatagggcaagcagtgtccttgttgagccatttgcataacagaggagaatgcaaatggctcaacaaaacctggcggcagcgcaaaagatg

SEQ ID NO: 105478 - DNA, 103 bp, Artificial Sequence
  Synthetic Polynucleotide
taatacgactcactatagggcccatcttctcaagcagtgtccttgttgagaacagaggagactcaacatggacactgctaacctggcggcagcgcaaaagatg

SEQ ID NO: 105479 - DNA, 103 bp, Artificial Sequence
  Synthetic Polynucleotide
taatacgactcactatagggtggcttccctcccatcttctcaagcagtgtaacagaggagaacactgatggagaagatgaacctggcggcagcgcaaaagatg

SEQ ID NO: 105480 - DNA, 103 bp, Artificial Sequence
  Synthetic Polynucleotide
taatacgactcactatagggcactgggtcttggcttccctcccatcttctaacagaggagaagaagaatggagggaagcaacctggcggcagcgcaaaagatg

SEQ ID NO: 105481 - DNA, 103 bp, Artificial Sequence
  Synthetic Polynucleotide
taatacgactcactatagggcggatgcgcccactgggtcttggcttccctaacagaggagaagggaaatgaagacccagaacctggcggcagcgcaaaagatg

SEQ ID NO: 105482 - DNA, 103 bp, Artificial Sequence
  Synthetic Polynucleotide
taatacgactcactatagggcagcacggaccggatgcgcccactgggtctaacagaggagaagacccatggggcgcatcaacctggcggcagcgcaaaagatg

SEQ ID NO: 105483 - DNA, 103 bp, Artificial Sequence
  Synthetic Polynucleotide
taatacgactcactatagggcatctgcatgcagcacggaccggatgcgccaacagaggagaggcgcaatgggtccgtgcaacctggcggcagcgcaaaagatg

SEQ ID NO: 105484 - DNA, 103 bp, Artificial Sequence
  Synthetic Polynucleotide
taatacgactcactatagggagtccctgttcctgtagcctagttaccggaaacagaggagatccggtatgtaggctacaaacctggcggcagcgcaaaagatg

SEQ ID NO: 105485 - DNA, 103 bp, Artificial Sequence
  Synthetic Polynucleotide
taatacgactcactatagggccagccttgcagtccctgttcctgtagcctaacagaggagaaggctaatggaacagggaaacctggcggcagcgcaaaagatg

SEQ ID NO: 105486 - DNA, 103 bp, Artificial Sequence
  Synthetic Polynucleotide
taatacgactcactatagggcaccggacttccagccttgcagtccctgttaacagaggagaaacaggatgtgcaaggctaacctggcggcagcgcaaaagatg

SEQ ID NO: 105487 - DNA, 103 bp, Artificial Sequence
  Synthetic Polynucleotide
taatacgactcactatagggccacggtccccaccggacttccagccttgcaacagaggagagcaaggatggaagtccggaacctggcggcagcgcaaaagatg

SEQ ID NO: 105488 - DNA, 103 bp, Artificial Sequence
  Synthetic Polynucleotide
taatacgactcactatagggaaggccacagccacggtccccaccggacttaacagaggagaaagtccatgggggaccgtaacctggcggcagcgcaaaagatg

SEQ ID NO: 105489 - DNA, 103 bp, Artificial Sequence
  Synthetic Polynucleotide
taatacgactcactatagggcactctcttgaaggccacagccacggtcccaacagaggagagggaccatggctgtggccaacctggcggcagcgcaaaagatg

SEQ ID NO: 105490 - DNA, 103 bp, Artificial Sequence
  Synthetic Polynucleotide
taatacgactcactatagggtcttcaggctcactctcttgaaggccacagaacagaggagactgtggatgtcaagagagaacctggcggcagcgcaaaagatg

SEQ ID NO: 105491 - DNA, 103 bp, Artificial Sequence
  Synthetic Polynucleotide
taatacgactcactatagggcttcaagaaatcttcaggctcactctcttgaacagaggagacaagagatggagcctgaaaacctggcggcagcgcaaaagatg

SEQ ID NO: 105492 - DNA, 103 bp, Artificial Sequence
  Synthetic Polynucleotide
taatacgactcactatagggccagccacgcgtccagcaggtcagggattcaacagaggagagaatccatgacctgctggaacctggcggcagcgcaaaagatg

SEQ ID NO: 105493 - DNA, 103 bp, Artificial Sequence
  Synthetic Polynucleotide
taatacgactcactatagggcaatgaaaagcttcaagaaatcttcaggctaacagaggagaagcctgatgatttcttgaaacctggcggcagcgcaaaagatg

SEQ ID NO: 105494 - DNA, 103 bp, Artificial Sequence
  Synthetic Polynucleotide
taatacgactcactatagggtcattgggatcaatgaaaagcttcaagaaaaacagaggagatttcttatggcttttcataacctggcggcagcgcaaaagatg

SEQ ID NO: 105495 - DNA, 103 bp, Artificial Sequence
  Synthetic Polynucleotide
taatacgactcactataggggcagtacacctcattgggatcaatgaaaagaacagaggagacttttcatggatcccaataacctggcggcagcgcaaaagatg

SEQ ID NO: 105496 - DNA, 103 bp, Artificial Sequence
  Synthetic Polynucleotide
taatacgactcactatagggatgcttctgagcagtacacctcattgggataacagaggagaatcccaatgaggtgtactaacctggcggcagcgcaaaagatg

SEQ ID NO: 105497 - DNA, 103 bp, Artificial Sequence
  Synthetic Polynucleotide
taatacgactcactatagggctgccaggagatgcttctgagcagtacaccaacagaggagaggtgtaatgctcagaagcaacctggcggcagcgcaaaagatg

SEQ ID NO: 105498 - DNA, 103 bp, Artificial Sequence
  Synthetic Polynucleotide
taatacgactcactataggggccactgtcactgccaggagatgcttctgaaacagaggagatcagaaatgtctcctggcaacctggcggcagcgcaaaagatg

SEQ ID NO: 105499 - DNA, 103 bp, Artificial Sequence
  Synthetic Polynucleotide
taatacgactcactatagggcctcagagatgccactgtcactgccaggagaacagaggagactcctgatggtgacagtgaacctggcggcagcgcaaaagatg

SEQ ID NO: 105500 - DNA, 103 bp, Artificial Sequence
  Synthetic Polynucleotide
taatacgactcactatagggtggcaggggtcctcagagatgccactgtcaaacagaggagatgacagatgcatctctgaaacctggcggcagcgcaaaagatg

SEQ ID NO: 105501 - DNA, 103 bp, Artificial Sequence
  Synthetic Polynucleotide
taatacgactcactatagggactgtctggatggcaggggtcctcagagataacagaggagaatctctatggacccctgcaacctggcggcagcgcaaaagatg

SEQ ID NO: 105502 - DNA, 103 bp, Artificial Sequence
  Synthetic Polynucleotide
taatacgactcactataggggggcagggggactgtctggatggcaggggtaacagaggagaacccctatgatccagacaaacctggcggcagcgcaaaagatg

SEQ ID NO: 105503 - DNA, 103 bp, Artificial Sequence
  Synthetic Polynucleotide
taatacgactcactatagggtctgggggctccagccacgcgtccagcaggaacagaggagacctgctatgcgcgtggctaacctggcggcagcgcaaaagatg

SEQ ID NO: 105504 - DNA, 103 bp, Artificial Sequence
  Synthetic Polynucleotide
taatacgactcactataggggttgccctgggggcagggggactgtctggaaacagaggagatccagaatgtccccctgcaacctggcggcagcgcaaaagatg

SEQ ID NO: 105505 - DNA, 103 bp, Artificial Sequence
  Synthetic Polynucleotide
taatacgactcactatagggaggagaactggttgccctgggggcagggggaacagaggagaccccctatgcccagggcaaacctggcggcagcgcaaaagatg

SEQ ID NO: 105506 - DNA, 103 bp, Artificial Sequence
  Synthetic Polynucleotide
taatacgactcactatagggcatagagcataggagaactggttgccctggaacagaggagaccagggatgccagttctcaacctggcggcagcgcaaaagatg

SEQ ID NO: 105507 - DNA, 103 bp, Artificial Sequence
  Synthetic Polynucleotide
taatacgactcactatagggtagacaacctcatagagcataggagaactgaacagaggagacagttcatgtatgctctaaacctggcggcagcgcaaaagatg

SEQ ID NO: 105508 - DNA, 103 bp, Artificial Sequence
  Synthetic Polynucleotide
taatacgactcactatagggccctgcctcatagacaacctcatagagcataacagaggagaatgctcatggaggttgtcaacctggcggcagcgcaaaagatg

SEQ ID NO: 105509 - DNA, 103 bp, Artificial Sequence
  Synthetic Polynucleotide
taatacgactcactatagggtctccagggcccctgcctcatagacaacctaacagaggagaaggttgatgatgaggcagaacctggcggcagcgcaaaagatg

SEQ ID NO: 105510 - DNA, 103 bp, Artificial Sequence
  Synthetic Polynucleotide
taatacgactcactatagggccctgcatcctctccagggcccctgcctcaaacagaggagatgaggcatgggccctggaaacctggcggcagcgcaaaagatg

SEQ ID NO: 105511 - DNA, 103 bp, Artificial Sequence
  Synthetic Polynucleotide
taatacgactcactatagggcccagtttccccctgcatcctctccagggcaacagaggagagccctgatgaggatgcagaacctggcggcagcgcaaaagatg

SEQ ID NO: 105512 - DNA, 103 bp, Artificial Sequence
  Synthetic Polynucleotide
taatacgactcactatagggctacatttggcccagtttccccctgcatccaacagaggagaggatgcatggggaaactgaacctggcggcagcgcaaaagatg

SEQ ID NO: 105513 - DNA, 103 bp, Artificial Sequence
  Synthetic Polynucleotide
taatacgactcactataggggagataaggcctacatttggcccagtttccaacagaggagaggaaacatggccaaatgtaacctggcggcagcgcaaaagatg

SEQ ID NO: 105514 - DNA, 103 bp, Artificial Sequence
  Synthetic Polynucleotide
taatacgactcactataggggaagatatcctctgggggctccagccacgcaacagaggagagcgtggatggagcccccaaacctggcggcagcgcaaaagatg

SEQ ID NO: 105515 - DNA, 103 bp, Artificial Sequence
  Synthetic Polynucleotide
taatacgactcactatagggtagctggatggagataaggcctacatttggaacagaggagaccaaatatgggccttatcaacctggcggcagcgcaaaagatg

SEQ ID NO: 105516 - DNA, 103 bp, Artificial Sequence
  Synthetic Polynucleotide
taatacgactcactatagggtccactgatctagctggatggagataaggcaacagaggagagccttaatgccatccagcaacctggcggcagcgcaaaagatg

SEQ ID NO: 105517 - DNA, 103 bp, Artificial Sequence
  Synthetic Polynucleotide
taatacgactcactatagggaatgctgggctccactgatctagctggatgaacagaggagacatccaatgagatcagtgaacctggcggcagcgcaaaagatg

SEQ ID NO: 105518 - DNA, 103 bp, Artificial Sequence
  Synthetic Polynucleotide
taatacgactcactatagggaggcaccataaatgctgggctccactgatcaacagaggagagatcagatgagcccagcaaacctggcggcagcgcaaaagatg

SEQ ID NO: 105519 - DNA, 103 bp, Artificial Sequence
  Synthetic Polynucleotide
taatacgactcactatagggtgcaggaatcaggcaccataaatgctgggcaacagaggagagcccagatgttatggtgcaacctggcggcagcgcaaaagatg

SEQ ID NO: 105520 - DNA, 103 bp, Artificial Sequence
  Synthetic Polynucleotide
taatacgactcactatagggtcactgaccatgcaggaatcaggcaccataaacagaggagatatggtatgtgattcctgaacctggcggcagcgcaaaagatg

SEQ ID NO: 105521 - DNA, 103 bp, Artificial Sequence
  Synthetic Polynucleotide
taatacgactcactatagggaaagggcagctcactgaccatgcaggaatcaacagaggagagattccatgatggtcagtaacctggcggcagcgcaaaagatg

SEQ ID NO: 105522 - DNA, 103 bp, Artificial Sequence
  Synthetic Polynucleotide
taatacgactcactatagggcatgagcatcaaagggcagctcactgaccaaacagaggagatggtcaatgagctgccctaacctggcggcagcgcaaaagatg

SEQ ID NO: 105523 - DNA, 103 bp, Artificial Sequence
  Synthetic Polynucleotide
taatacgactcactatagggaggatgtgggcatgagcatcaaagggcagcaacagaggagagctgccatgtgatgctcaaacctggcggcagcgcaaaagatg

SEQ ID NO: 105524 - DNA, 103 bp, Artificial Sequence
  Synthetic Polynucleotide
taatacgactcactatagggtgctctgggcaggatgtgggcatgagcatcaacagaggagagatgctatggcccacatcaacctggcggcagcgcaaaagatg

SEQ ID NO: 105525 - DNA, 103 bp, Artificial Sequence
  Synthetic Polynucleotide
taatacgactcactatagggatcctgtcgagaagatatcctctgggggctaacagaggagaagccccatgaggatatctaacctggcggcagcgcaaaagatg

SEQ ID NO: 105526 - DNA, 103 bp, Artificial Sequence
  Synthetic Polynucleotide
taatacgactcactatagggctacggtgcctgctctgggcaggatgtgggaacagaggagacccacaatgtgcccagagaacctggcggcagcgcaaaagatg

SEQ ID NO: 105527 - DNA, 103 bp, Artificial Sequence
  Synthetic Polynucleotide
taatacgactcactatagggggcactggggctacggtgcctgctctgggcaacagaggagagcccagatgaggcaccgtaacctggcggcagcgcaaaagatg

SEQ ID NO: 105528 - DNA, 103 bp, Artificial Sequence
  Synthetic Polynucleotide
taatacgactcactatagggggttgtacagggcactggggctacggtgccaacagaggagaggcaccatggccccagtgaacctggcggcagcgcaaaagatg

SEQ ID NO: 105529 - DNA, 103 bp, Artificial Sequence
  Synthetic Polynucleotide
taatacgactcactatagggagggcagcagggttgtacagggcactggggaacagaggagaccccagatgcctgtacaaaacctggcggcagcgcaaaagatg

SEQ ID NO: 105530 - DNA, 103 bp, Artificial Sequence
  Synthetic Polynucleotide
taatacgactcactatagggagggtttgacagggcagcagggttgtacagaacagaggagactgtacatgcctgctgccaacctggcggcagcgcaaaagatg

SEQ ID NO: 105531 - DNA, 103 bp, Artificial Sequence
  Synthetic Polynucleotide
taatacgactcactatagggggtcaggaacagggtttgacagggcagcagaacagaggagactgctgatgtgtcaaaccaacctggcggcagcgcaaaagatg

SEQ ID NO: 105532 - DNA, 103 bp, Artificial Sequence
  Synthetic Polynucleotide
taatacgactcactatagggtctcctcatcggtcaggaacagggtttgacaacagaggagagtcaaaatgtgttcctgaaacctggcggcagcgcaaaagatg

SEQ ID NO: 105533 - DNA, 103 bp, Artificial Sequence
  Synthetic Polynucleotide
taatacgactcactatagggagcagacgcttctcctcatcggtcaggaacaacagaggagagttcctatgcgatgaggaaacctggcggcagcgcaaaagatg

SEQ ID NO: 105534 - DNA, 103 bp, Artificial Sequence
  Synthetic Polynucleotide
taatacgactcactatagggttcctgccccagcagacgcttctcctcatcaacagaggagagatgagatgaagcgtctgaacctggcggcagcgcaaaagatg

SEQ ID NO: 105535 - DNA, 103 bp, Artificial Sequence
  Synthetic Polynucleotide
taatacgactcactataggggggaaaccccttcctgccccagcagacgctaacagaggagaagcgtcatgtggggcaggaacctggcggcagcgcaaaagatg

SEQ ID NO: 105536 - DNA, 103 bp, Artificial Sequence
  Synthetic Polynucleotide
taatacgactcactatagggtccaggacggatcctgtcgagaagatatccaacagaggagaggatatatgctcgacaggaacctggcggcagcgcaaaagatg

SEQ ID NO: 105537 - DNA, 103 bp, Artificial Sequence
  Synthetic Polynucleotide
taatacgactcactatagggtgagagggcagggaaaccccttcctgccccaacagaggagaggggcaatgaggggtttcaacctggcggcagcgcaaaagatg

SEQ ID NO: 105538 - DNA, 103 bp, Artificial Sequence
  Synthetic Polynucleotide
taatacgactcactataggggaggggcaggtgagagggcagggaaaccccaacagaggagaggggttatgctgccctctaacctggcggcagcgcaaaagatg

SEQ ID NO: 105539 - DNA, 103 bp, Artificial Sequence
  Synthetic Polynucleotide
taatacgactcactatagggctgccttggtgaggggcaggtgagagggcaaacagaggagatgccctatgacctgccccaacctggcggcagcgcaaaagatg

SEQ ID NO: 105540 - DNA, 103 bp, Artificial Sequence
  Synthetic Polynucleotide
taatacgactcactatagggaccctctcctctgccttggtgaggggcaggaacagaggagacctgccatgcaccaaggcaacctggcggcagcgcaaaagatg

SEQ ID NO: 105541 - DNA, 103 bp, Artificial Sequence
  Synthetic Polynucleotide
taatacgactcactatagggcttcttgaggaccctctcctctgccttggtaacagaggagaaccaagatggaggagaggaacctggcggcagcgcaaaagatg

SEQ ID NO: 105542 - DNA, 103 bp, Artificial Sequence
  Synthetic Polynucleotide
taatacgactcactatagggtcctcctgaccttcttgaggaccctctcctaacagaggagaaggagaatgtcctcaagaaacctggcggcagcgcaaaagatg

SEQ ID NO: 105543 - DNA, 103 bp, Artificial Sequence
  Synthetic Polynucleotide
taatacgactcactatagggttacggattttcctcctgaccttcttgaggaacagaggagacctcaaatgggtcaggagaacctggcggcagcgcaaaagatg

SEQ ID NO: 105544 - DNA, 103 bp, Artificial Sequence
  Synthetic Polynucleotide
taatacgactcactatagggtgactgcttgttacggattttcctcctgacaacagaggagagtcaggatgaaaatccgtaacctggcggcagcgcaaaagatg

SEQ ID NO: 105545 - DNA, 103 bp, Artificial Sequence
  Synthetic Polynucleotide
taatacgactcactatagggtgtcctgagctgactgcttgttacggatttaacagaggagaaaatccatgacaagcagtaacctggcggcagcgcaaaagatg

SEQ ID NO: 105546 - DNA, 103 bp, Artificial Sequence
  Synthetic Polynucleotide
taatacgactcactatagggcgccgccgactgtcctgagctgactgcttgaacagaggagacaagcaatgagctcaggaaacctggcggcagcgcaaaagatg

SEQ ID NO: 105547 - DNA, 103 bp, Artificial Sequence
  Synthetic Polynucleotide
taatacgactcactataggggagtcccagctccaggacggatcctgtcgaaacagaggagatcgacaatgtccgtcctgaacctggcggcagcgcaaaagatg

SEQ ID NO: 105548 - DNA, 103 bp, Artificial Sequence
  Synthetic Polynucleotide
taatacgactcactatagggctccttcttccgccgccgactgtcctgagcaacagaggagagctcagatgagtcggcggaacctggcggcagcgcaaaagatg

SEQ ID NO: 105549 - DNA, 103 bp, Artificial Sequence
  Synthetic Polynucleotide
taatacgactcactatagggcatcaatgtactccttcttccgccgccgacaacagaggagagtcggcatgggaagaaggaacctggcggcagcgcaaaagatg

SEQ ID NO: 105550 - DNA, 103 bp, Artificial Sequence
  Synthetic Polynucleotide
taatacgactcactatagggctctccagcccatcaatgtactccttcttcaacagaggagagaagaaatggtacattgaaacctggcggcagcgcaaaagatg

SEQ ID NO: 105551 - DNA, 103 bp, Artificial Sequence
  Synthetic Polynucleotide
taatacgactcactatagggtgccaccctgctctccagcccatcaatgtaaacagaggagatacattatggggctggagaacctggcggcagcgcaaaagatg

SEQ ID NO: 105552 - DNA, 103 bp, Artificial Sequence
  Synthetic Polynucleotide
taatacgactcactatagggcagaacaggctgccaccctgctctccagccaacagaggagaggctggatggcagggtggaacctggcggcagcgcaaaagatg

SEQ ID NO: 105553 - DNA, 103 bp, Artificial Sequence
  Synthetic Polynucleotide
taatacgactcactatagggtggttctgtgcagaacaggctgccaccctgaacagaggagacagggtatgagcctgttcaacctggcggcagcgcaaaagatg

SEQ ID NO: 105554 - DNA, 103 bp, Artificial Sequence
  Synthetic Polynucleotide
taatacgactcactatagggctgtaattcttggttctgtgcagaacaggcaacagaggagagcctgtatggcacagaacaacctggcggcagcgcaaaagatg

SEQ ID NO: 105555 - DNA, 103 bp, Artificial Sequence
  Synthetic Polynucleotide
taatacgactcactatagggggacttttttctgtaattcttggttctgtgaacagaggagacacagaatgaagaattacaacctggcggcagcgcaaaagatg

SEQ ID NO: 105556 - DNA, 103 bp, Artificial Sequence
  Synthetic Polynucleotide
taatacgactcactatagggtccagctcctggacttttttctgtaattctaacagaggagaagaattatggaaaaaagtaacctggcggcagcgcaaaagatg

SEQ ID NO: 105557 - DNA, 103 bp, Artificial Sequence
  Synthetic Polynucleotide
taatacgactcactataggggttgtgcctctccagctcctggacttttttaacagaggagaaaaaaaatgcaggagctgaacctggcggcagcgcaaaagatg

SEQ ID NO: 105558 - DNA, 103 bp, Artificial Sequence
  Synthetic Polynucleotide
taatacgactcactataggggggggcagtggagtcccagctccaggacggaacagaggagaccgtccatgagctgggacaacctggcggcagcgcaaaagatg

SEQ ID NO: 105559 - DNA, 103 bp, Artificial Sequence
  Synthetic Polynucleotide
taatacgactcactatagggccaaggagatgttgtgcctctccagctcctaacagaggagaaggagcatgagaggcacaaacctggcggcagcgcaaaagatg

SEQ ID NO: 105560 - DNA, 103 bp, Artificial Sequence
  Synthetic Polynucleotide
taatacgactcactatagggagctgagctaccaaggagatgttgtgcctcaacagaggagagaggcaatgcatctccttaacctggcggcagcgcaaaagatg

SEQ ID NO: 105561 - DNA, 103 bp, Artificial Sequence
  Synthetic Polynucleotide
taatacgactcactatagggcagctggcggagctgagctaccaaggagataacagaggagaatctccatggtagctcagaacctggcggcagcgcaaaagatg

SEQ ID NO: 105562 - DNA, 103 bp, Artificial Sequence
  Synthetic Polynucleotide
taatacgactcactatagggttagcgtctgcagctggcggagctgagctaaacagaggagatagctcatgtccgccagcaacctggcggcagcgcaaaagatg

SEQ ID NO: 105563 - DNA, 103 bp, Artificial Sequence
  Synthetic Polynucleotide
taatacgactcactataggggtttgagcaattagcgtctgcagctggcggaacagaggagaccgccaatggcagacgctaacctggcggcagcgcaaaagatg

SEQ ID NO: 105564 - DNA, 103 bp, Artificial Sequence
  Synthetic Polynucleotide
taatacgactcactatagggtttgttggaagtttgagcaattagcgtctgaacagaggagacagacgatgattgctcaaaacctggcggcagcgcaaaagatg

SEQ ID NO: 105565 - DNA, 103 bp, Artificial Sequence
  Synthetic Polynucleotide
taatacgactcactatagggtctgggcagctttgttggaagtttgagcaaaacagaggagattgctcatgcttccaacaaacctggcggcagcgcaaaagatg

SEQ ID NO: 105566 - DNA, 103 bp, Artificial Sequence
  Synthetic Polynucleotide
taatacgactcactatagggcaagtgctggtctgggcagctttgttggaaaacagaggagattccaaatgagctgcccaaacctggcggcagcgcaaaagatg

SEQ ID NO: 105567 - DNA, 103 bp, Artificial Sequence
  Synthetic Polynucleotide
taatacgactcactatagggaatcaaaacacaagtgctggtctgggcagcaacagaggagagctgccatgaccagcactaacctggcggcagcgcaaaagatg

SEQ ID NO: 105568 - DNA, 103 bp, Artificial Sequence
  Synthetic Polynucleotide
taatacgactcactatagggaaaaaagaagaatcaaaacacaagtgctggaacagaggagaccagcaatggtgttttgaaacctggcggcagcgcaaaagatg

SEQ ID NO: 105569 - DNA, 103 bp, Artificial Sequence
  Synthetic Polynucleotide
taatacgactcactatagggacctctggaggggggcagtggagtcccagcaacagaggagagctgggatgccactgcccaacctggcggcagcgcaaaagatg

SEQ ID NO: 105570 - DNA, 103 bp, Artificial Sequence
  Synthetic Polynucleotide
taatacgactcactatagggagagccagggaaaaaagaagaatcaaaacaaacagaggagatgttttatgtcttcttttaacctggcggcagcgcaaaagatg

SEQ ID NO: 105571 - DNA, 103 bp, Artificial Sequence
  Synthetic Polynucleotide
taatacgactcactatagggcaggatgatgagagccagggaaaaaagaagaacagaggagacttcttatgtccctggctaacctggcggcagcgcaaaagatg

SEQ ID NO: 105572 - DNA, 103 bp, Artificial Sequence
  Synthetic Polynucleotide
taatacgactcactatagggtgaagctgggcaggatgatgagagccagggaacagaggagaccctggatgtcatcatccaacctggcggcagcgcaaaagatg

SEQ ID NO: 105573 - DNA, 103 bp, Artificial Sequence
  Synthetic Polynucleotide
taatacgactcactatagggtggaatggactgaagctgggcaggatgatgaacagaggagacatcatatggcccagcttaacctggcggcagcgcaaaagatg

SEQ ID NO: 105574 - DNA, 103 bp, Artificial Sequence
  Synthetic Polynucleotide
taatacgactcactatagggtggtcgactctggaatggactgaagctgggaacagaggagacccagcatgagtccattcaacctggcggcagcgcaaaagatg

SEQ ID NO: 105575 - DNA, 103 bp, Artificial Sequence
  Synthetic Polynucleotide
taatacgactcactatagggacccagcttctggtcgactctggaatggacaacagaggagagtccatatgagagtcgacaacctggcggcagcgcaaaagatg

SEQ ID NO: 105576 - DNA, 103 bp, Artificial Sequence
  Synthetic Polynucleotide
taatacgactcactatagggtaatcctcagacccagcttctggtcgactcaacagaggagagagtcgatgagaagctggaacctggcggcagcgcaaaagatg

SEQ ID NO: 105577 - DNA, 103 bp, Artificial Sequence
  Synthetic Polynucleotide
taatacgactcactataggggtgaggctggtaatcctcagacccagcttcaacagaggagagaagctatgtctgaggataacctggcggcagcgcaaaagatg

SEQ ID NO: 105578 - DNA, 103 bp, Artificial Sequence
  Synthetic Polynucleotide
taatacgactcactatagggaagtcactccgtgaggctggtaatcctcagaacagaggagactgaggatgaccagcctcaacctggcggcagcgcaaaagatg

SEQ ID NO: 105579 - DNA, 103 bp, Artificial Sequence
  Synthetic Polynucleotide
taatacgactcactatagggatatttctggaagtcactccgtgaggctggaacagaggagaccagccatgcggagtgacaacctggcggcagcgcaaaagatg

SEQ ID NO: 105580 - DNA, 103 bp, Artificial Sequence
  Synthetic Polynucleotide
taatacgactcactataggggggcggtccgtccagcaagttctcagccataacagaggagaatggctatgaacttgctgaacctggcggcagcgcaaaagatg

SEQ ID NO: 105581 - DNA, 103 bp, Artificial Sequence
  Synthetic Polynucleotide
taatacgactcactatagggaagatcattttccaagtcaaacaatgatccaacagaggagaggatcaatgtttgacttgaacctggcggcagcgcaaaagatg

SEQ ID NO: 105582 - DNA, 103 bp, Artificial Sequence
  Synthetic Polynucleotide
taatacgactcactatagggaattgcttgtgtgggtacaattcccactgaaacagaggagatcagtgatgattgtacccaacctggcggcagcgcaaaagatg

SEQ ID NO: 105583 - DNA, 103 bp, Artificial Sequence
  Synthetic Polynucleotide
taatacgactcactatagggggcctgttgcaattgcttgtgtgggtacaaaacagaggagattgtacatgcacaagcaaaacctggcggcagcgcaaaagatg

SEQ ID NO: 105584 - DNA, 103 bp, Artificial Sequence
  Synthetic Polynucleotide
taatacgactcactatagggtctgcagtggggcctgttgcaattgcttgtaacagaggagaacaagcatgtgcaacaggaacctggcggcagcgcaaaagatg

SEQ ID NO: 105585 - DNA, 103 bp, Artificial Sequence
  Synthetic Polynucleotide
taatacgactcactatagggtttttcaggatctgcagtggggcctgttgcaacagaggagagcaacaatgcccactgcaaacctggcggcagcgcaaaagatg

SEQ ID NO: 105586 - DNA, 103 bp, Artificial Sequence
  Synthetic Polynucleotide
taatacgactcactatagggtcagtttgcgtttttcaggatctgcagtggaacagaggagaccactgatgatcctgaaaaacctggcggcagcgcaaaagatg

SEQ ID NO: 105587 - DNA, 103 bp, Artificial Sequence
  Synthetic Polynucleotide
taatacgactcactatagggtgctgctgtatcagtttgcgtttttcaggaaacagaggagatcctgaatgacgcaaactaacctggcggcagcgcaaaagatg

SEQ ID NO: 105588 - DNA, 103 bp, Artificial Sequence
  Synthetic Polynucleotide
taatacgactcactatagggtagaaccagctgctgctgtatcagtttgcgaacagaggagacgcaaaatgatacagcagaacctggcggcagcgcaaaagatg

SEQ ID NO: 105589 - DNA, 103 bp, Artificial Sequence
  Synthetic Polynucleotide
taatacgactcactatagggcatgaagcagtagaaccagctgctgctgtaaacagaggagatacagcatgagctggttcaacctggcggcagcgcaaaagatg

SEQ ID NO: 105590 - DNA, 103 bp, Artificial Sequence
  Synthetic Polynucleotide
taatacgactcactatagggcacttatgagcatgaagcagtagaaccagcaacagaggagagctggtatgactgcttcaaacctggcggcagcgcaaaagatg

SEQ ID NO: 105591 - DNA, 103 bp, Artificial Sequence
  Synthetic Polynucleotide
taatacgactcactatagggtcgtctctgacacttatgagcatgaagcagaacagaggagactgcttatggctcataagaacctggcggcagcgcaaaagatg

SEQ ID NO: 105592 - DNA, 103 bp, Artificial Sequence
  Synthetic Polynucleotide
taatacgactcactataggggctcatcaggaagatcattttccaagtcaaaacagaggagattgactatgaaaatgatcaacctggcggcagcgcaaaagatg

SEQ ID NO: 105593 - DNA, 103 bp, Artificial Sequence
  Synthetic Polynucleotide
taatacgactcactatagggttgcttgctctcgtctctgacacttatgagaacagaggagactcataatggtcagagacaacctggcggcagcgcaaaagatg

SEQ ID NO: 105594 - DNA, 103 bp, Artificial Sequence
  Synthetic Polynucleotide
taatacgactcactatagggacctctccgtttgcttgctctcgtctctgaaacagaggagatcagagatgagagcaagcaacctggcggcagcgcaaaagatg

SEQ ID NO: 105595 - DNA, 103 bp, Artificial Sequence
  Synthetic Polynucleotide
taatacgactcactataggggcaggcccgaacctctccgtttgcttgctcaacagaggagagagcaaatgaacggagagaacctggcggcagcgcaaaagatg

SEQ ID NO: 105596 - DNA, 103 bp, Artificial Sequence
  Synthetic Polynucleotide
taatacgactcactataggggcgggagcgagcaggcccgaacctctccgtaacagaggagaacggagatgttcgggcctaacctggcggcagcgcaaaagatg

SEQ ID NO: 105597 - DNA, 103 bp, Artificial Sequence
  Synthetic Polynucleotide
taatacgactcactataggggttcgacaatgcgggagcgagcaggcccgaaacagaggagatcgggcatgctcgctcccaacctggcggcagcgcaaaagatg

SEQ ID NO: 105598 - DNA, 103 bp, Artificial Sequence
  Synthetic Polynucleotide
taatacgactcactataggggtttttcatggttcgacaatgcgggagcgaaacagaggagatcgctcatgcattgtcgaaacctggcggcagcgcaaaagatg

SEQ ID NO: 105599 - DNA, 103 bp, Artificial Sequence
  Synthetic Polynucleotide
taatacgactcactataggggattcaaaacgtttttcatggttcgacaataacagaggagaattgtcatgccatgaaaaaacctggcggcagcgcaaaagatg

SEQ ID NO: 105600 - DNA, 103 bp, Artificial Sequence
  Synthetic Polynucleotide
taatacgactcactatagggtgcgtcatgtgattcaaaacgtttttcatgaacagaggagacatgaaatgcgttttgaaaacctggcggcagcgcaaaagatg

SEQ ID NO: 105601 - DNA, 103 bp, Artificial Sequence
  Synthetic Polynucleotide
taatacgactcactatagggagcctgacaatgcgtcatgtgattcaaaacaacagaggagagttttgatgcacatgacgaacctggcggcagcgcaaaagatg

SEQ ID NO: 105602 - DNA, 103 bp, Artificial Sequence
  Synthetic Polynucleotide
taatacgactcactatagggaggctttcccagcctgacaatgcgtcatgtaacagaggagaacatgaatgattgtcaggaacctggcggcagcgcaaaagatg

SEQ ID NO: 105603 - DNA, 103 bp, Artificial Sequence
  Synthetic Polynucleotide
taatacgactcactatagggttgggtatcagctcatcaggaagatcatttaacagaggagaaaatgaatgtcctgatgaaacctggcggcagcgcaaaagatg

SEQ ID NO: 105604 - DNA, 103 bp, Artificial Sequence
  Synthetic Polynucleotide
taatacgactcactataggggcaacttggcaggctttcccagcctgacaaaacagaggagattgtcaatgtgggaaagcaacctggcggcagcgcaaaagatg

SEQ ID NO: 105605 - DNA, 103 bp, Artificial Sequence
  Synthetic Polynucleotide
taatacgactcactatagggtgcacaatgggcaacttggcaggctttcccaacagaggagagggaaaatgtgccaagttaacctggcggcagcgcaaaagatg

SEQ ID NO: 105606 - DNA, 103 bp, Artificial Sequence
  Synthetic Polynucleotide
taatacgactcactataggggtcgtgaagatgcacaatgggcaacttggcaacagaggagagccaagatgcccattgtgaacctggcggcagcgcaaaagatg

SEQ ID NO: 105607 - DNA, 103 bp, Artificial Sequence
  Synthetic Polynucleotide
taatacgactcactataggggagatgatttgtcgtgaagatgcacaatggaacagaggagaccattgatgatcttcacgaacctggcggcagcgcaaaagatg

SEQ ID NO: 105608 - DNA, 103 bp, Artificial Sequence
  Synthetic Polynucleotide
taatacgactcactatagggcttccaatgagagatgatttgtcgtgaagaaacagaggagatcttcaatgcaaatcatcaacctggcggcagcgcaaaagatg

SEQ ID NO: 105609 - DNA, 103 bp, Artificial Sequence
  Synthetic Polynucleotide
taatacgactcactataggggtgtgcagttcttccaatgagagatgatttaacagaggagaaaatcaatgctcattggaaacctggcggcagcgcaaaagatg

SEQ ID NO: 105610 - DNA, 103 bp, Artificial Sequence
  Synthetic Polynucleotide
taatacgactcactatagggcagtcatgtcgtgtgcagttcttccaatgaaacagaggagatcattgatggaactgcacaacctggcggcagcgcaaaagatg

SEQ ID NO: 105611 - DNA, 103 bp, Artificial Sequence
  Synthetic Polynucleotide
taatacgactcactataggggcaaacaggacagtcatgtcgtgtgcagttaacagaggagaaactgcatgcgacatgacaacctggcggcagcgcaaaagatg

SEQ ID NO: 105612 - DNA, 103 bp, Artificial Sequence
  Synthetic Polynucleotide
taatacgactcactatagggtcaaagggaggcaaacaggacagtcatgtcaacagaggagagacatgatggtcctgtttaacctggcggcagcgcaaaagatg

SEQ ID NO: 105613 - DNA, 103 bp, Artificial Sequence
  Synthetic Polynucleotide
taatacgactcactatagggctggcatttttcaaagggaggcaaacaggaaacagaggagatcctgtatgcctccctttaacctggcggcagcgcaaaagatg

SEQ ID NO: 105614 - DNA, 103 bp, Artificial Sequence
  Synthetic Polynucleotide
taatacgactcactatagggttctcctccattgggtatcagctcatcaggaacagaggagacctgatatgctgatacccaacctggcggcagcgcaaaagatg

SEQ ID NO: 105615 - DNA, 103 bp, Artificial Sequence
  Synthetic Polynucleotide
taatacgactcactatagggtcgcttgtcactggcatttttcaaagggagaacagaggagactccctatgaaaaatgccaacctggcggcagcgcaaaagatg

SEQ ID NO: 105616 - DNA, 103 bp, Artificial Sequence
  Synthetic Polynucleotide
taatacgactcactatagggtttgttggtttcgcttgtcactggcattttaacagaggagaaaaatgatggtgacaagcaacctggcggcagcgcaaaagatg

SEQ ID NO: 105617 - DNA, 103 bp, Artificial Sequence
  Synthetic Polynucleotide
taatacgactcactatagggcccaggatggtttgttggtttcgcttgtcaaacagaggagatgacaaatgaaaccaacaaacctggcggcagcgcaaaagatg

SEQ ID NO: 105618 - DNA, 103 bp, Artificial Sequence
  Synthetic Polynucleotide
taatacgactcactatagggagctggagaccccaggatggtttgttggttaacagaggagaaaccaaatgaccatcctgaacctggcggcagcgcaaaagatg

SEQ ID NO: 105619 - DNA, 103 bp, Artificial Sequence
  Synthetic Polynucleotide
taatacgactcactataggggaattccactagctggagaccccaggatggaacagaggagaccatccatgggtctccagaacctggcggcagcgcaaaagatg

SEQ ID NO: 105620 - DNA, 103 bp, Artificial Sequence
  Synthetic Polynucleotide
taatacgactcactatagggattgtgttttgaattccactagctggagacaacagaggagagtctccatgtagtggaataacctggcggcagcgcaaaagatg

SEQ ID NO: 105621 - DNA, 103 bp, Artificial Sequence
  Synthetic Polynucleotide
taatacgactcactatagggaacagaaccaattgtgttttgaattccactaacagaggagaagtggaatgcaaaacacaaacctggcggcagcgcaaaagatg

SEQ ID NO: 105622 - DNA, 103 bp, Artificial Sequence
  Synthetic Polynucleotide
taatacgactcactataggggccctgtgccaacagaaccaattgtgttttaacagaggagaaaaacaatgttggttctgaacctggcggcagcgcaaaagatg

SEQ ID NO: 105623 - DNA, 103 bp, Artificial Sequence
  Synthetic Polynucleotide
taatacgactcactataggggcattctgttgccctgtgccaacagaaccaaacagaggagatggttcatgtggcacaggaacctggcggcagcgcaaaagatg

SEQ ID NO: 105624 - DNA, 103 bp, Artificial Sequence
  Synthetic Polynucleotide
taatacgactcactatagggtaaagaagtggcattctgttgccctgtgccaacagaggagaggcacaatgcaacagaataacctggcggcagcgcaaaagatg

SEQ ID NO: 105625 - DNA, 103 bp, Artificial Sequence
  Synthetic Polynucleotide
taatacgactcactatagggaaaggcctaattctcctccattgggtatcaaacagaggagatgatacatgatggaggagaacctggcggcagcgcaaaagatg

SEQ ID NO: 105626 - DNA, 103 bp, Artificial Sequence
  Synthetic Polynucleotide
taatacgactcactatagggttgggttacttaaagaagtggcattctgttaacagaggagaaacagaatgccacttcttaacctggcggcagcgcaaaagatg

SEQ ID NO: 105627 - DNA, 103 bp, Artificial Sequence
  Synthetic Polynucleotide
taatacgactcactatagggtctatgggatttgggttacttaaagaagtgaacagaggagacacttcatgaagtaacccaacctggcggcagcgcaaaagatg

SEQ ID NO: 105628 - DNA, 103 bp, Artificial Sequence
  Synthetic Polynucleotide
taatacgactcactatagggggagctggggtctatgggatttgggttactaacagaggagaagtaacatgaatcccataaacctggcggcagcgcaaaagatg

SEQ ID NO: 105629 - DNA, 103 bp, Artificial Sequence
  Synthetic Polynucleotide
taatacgactcactatagggctcgctgcatggagctggggtctatgggataacagaggagaatcccaatgaccccagctaacctggcggcagcgcaaaagatg

SEQ ID NO: 105630 - DNA, 103 bp, Artificial Sequence
  Synthetic Polynucleotide
taatacgactcactataggggcagcataggctcgctgcatggagctggggaacagaggagaccccagatgcatgcagcgaacctggcggcagcgcaaaagatg

SEQ ID NO: 105631 - DNA, 103 bp, Artificial Sequence
  Synthetic Polynucleotide
taatacgactcactataggggagtccgagagcagcataggctcgctgcataacagaggagaatgcagatggcctatgctaacctggcggcagcgcaaaagatg

SEQ ID NO: 105632 - DNA, 103 bp, Artificial Sequence
  Synthetic Polynucleotide
taatacgactcactatagggtcatgtaggggagtccgagagcagcataggaacagaggagacctatgatgctctcggacaacctggcggcagcgcaaaagatg

SEQ ID NO: 105633 - DNA, 103 bp, Artificial Sequence
  Synthetic Polynucleotide
taatacgactcactatagggtggggctggttcatgtaggggagtccgagaaacagaggagatctcggatgcccctacataacctggcggcagcgcaaaagatg

SEQ ID NO: 105634 - DNA, 103 bp, Artificial Sequence
  Synthetic Polynucleotide
taatacgactcactatagggcagctgcgtctggggctggttcatgtagggaacagaggagaccctacatgaaccagcccaacctggcggcagcgcaaaagatg

SEQ ID NO: 105635 - DNA, 103 bp, Artificial Sequence
  Synthetic Polynucleotide
taatacgactcactatagggcctgaggctgcagctgcgtctggggctggtaacagaggagaaccagcatgagacgcagcaacctggcggcagcgcaaaagatg

SEQ ID NO: 105636 - DNA, 103 bp, Artificial Sequence
  Synthetic Polynucleotide
taatacgactcactatagggccactgtttaaaaggcctaattctcctccaaacagaggagatggaggatgattaggcctaacctggcggcagcgcaaaagatg

SEQ ID NO: 105637 - DNA, 103 bp, Artificial Sequence
  Synthetic Polynucleotide
taatacgactcactatagggtggccaggaacctgaggctgcagctgcgtcaacagaggagagacgcaatggcagcctcaaacctggcggcagcgcaaaagatg

SEQ ID NO: 105638 - DNA, 103 bp, Artificial Sequence
  Synthetic Polynucleotide
taatacgactcactatagggtgctggttgctggccaggaacctgaggctgaacagaggagacagcctatggttcctggcaacctggcggcagcgcaaaagatg

SEQ ID NO: 105639 - DNA, 103 bp, Artificial Sequence
  Synthetic Polynucleotide
taatacgactcactatagggtttgaggctgtgctggttgctggccaggaaaacagaggagattcctgatgagcaaccagaacctggcggcagcgcaaaagatg

SEQ ID NO: 105640 - DNA, 103 bp, Artificial Sequence
  Synthetic Polynucleotide
taatacgactcactatagggtgctggtgggtttgaggctgtgctggttgcaacagaggagagcaaccatgacagcctcaaacctggcggcagcgcaaaagatg

SEQ ID NO: 105641 - DNA, 103 bp, Artificial Sequence
  Synthetic Polynucleotide
taatacgactcactatagggagtcctcatctgctggtgggtttgaggctgaacagaggagacagcctatgacccaccagaacctggcggcagcgcaaaagatg

SEQ ID NO: 105642 - DNA, 103 bp, Artificial Sequence
  Synthetic Polynucleotide
taatacgactcactataggggggggttgagagtcctcatctgctggtgggaacagaggagacccaccatgagatgaggaaacctggcggcagcgcaaaagatg

SEQ ID NO: 105643 - DNA, 103 bp, Artificial Sequence
  Synthetic Polynucleotide
taatacgactcactatagggttatttcccagggggttgagagtcctcatcaacagaggagagatgagatgtctcaacccaacctggcggcagcgcaaaagatg

SEQ ID NO: 105644 - DNA, 103 bp, Artificial Sequence
  Synthetic Polynucleotide
taatacgactcactataggggttcattggattatttcccagggggttgagaacagaggagactcaacatgctgggaaataacctggcggcagcgcaaaagatg

SEQ ID NO: 105645 - DNA, 103 bp, Artificial Sequence
  Synthetic Polynucleotide
taatacgactcactatagggctgctggaatgttcattggattatttcccaaacagaggagatgggaaatgatccaatgaaacctggcggcagcgcaaaagatg

SEQ ID NO: 105646 - DNA, 103 bp, Artificial Sequence
  Synthetic Polynucleotide
taatacgactcactataggggttattcctcctgctggaatgttcattggaaacagaggagatccaatatgcattccagcaacctggcggcagcgcaaaagatg

SEQ ID NO: 105647 - DNA, 103 bp, Artificial Sequence
  Synthetic Polynucleotide
taatacgactcactatagggaacaaggttcccactgtttaaaaggcctaaaacagaggagattaggcatgttaaacagtaacctggcggcagcgcaaaagatg

SEQ ID NO: 105648 - DNA, 103 bp, Artificial Sequence
  Synthetic Polynucleotide
taatacgactcactatagggctgatctgttgttattcctcctgctggaataacagaggagaattccaatgggaggaataaacctggcggcagcgcaaaagatg

SEQ ID NO: 105649 - DNA, 103 bp, Artificial Sequence
  Synthetic Polynucleotide
taatacgactcactatagggttgggggctgctgatctgttgttattcctcaacagaggagagaggaaatgcaacagatcaacctggcggcagcgcaaaagatg

SEQ ID NO: 105650 - DNA, 103 bp, Artificial Sequence
  Synthetic Polynucleotide
taatacgactcactataggggaaatcaagtttgggggctgctgatctgttaacagaggagaaacagaatggcagcccccaacctggcggcagcgcaaaagatg

SEQ ID NO: 105651 - DNA, 103 bp, Artificial Sequence
  Synthetic Polynucleotide
taatacgactcactatagggagctgattctgaaatcaagtttgggggctgaacagaggagacagcccatgaacttgattaacctggcggcagcgcaaaagatg

SEQ ID NO: 105652 - DNA, 103 bp, Artificial Sequence
  Synthetic Polynucleotide
taatacgactcactatagggaagtcggaagagctgattctgaaatcaagtaacagaggagaacttgaatgcagaatcagaacctggcggcagcgcaaaagatg

SEQ ID NO: 105653 - DNA, 103 bp, Artificial Sequence
  Synthetic Polynucleotide
taatacgactcactataggggcccccagggaagtcggaagagctgattctaacagaggagaagaatcatgtcttccgacaacctggcggcagcgcaaaagatg

SEQ ID NO: 105654 - DNA, 103 bp, Artificial Sequence
  Synthetic Polynucleotide
taatacgactcactatagggtgggtttgtggcccccagggaagtcggaagaacagaggagacttccgatgtccctggggaacctggcggcagcgcaaaagatg

SEQ ID NO: 105655 - DNA, 103 bp, Artificial Sequence
  Synthetic Polynucleotide
taatacgactcactatagggcgttcatcagtgggtttgtggcccccagggaacagaggagaccctggatgccacaaaccaacctggcggcagcgcaaaagatg

SEQ ID NO: 105656 - DNA, 103 bp, Artificial Sequence
  Synthetic Polynucleotide
taatacgactcactatagggttggagccatcgttcatcagtgggtttgtgaacagaggagacacaaaatgactgatgaaaacctggcggcagcgcaaaagatg

SEQ ID NO: 105657 - DNA, 103 bp, Artificial Sequence
  Synthetic Polynucleotide
taatacgactcactataggggttaccagagttggagccatcgttcatcagaacagaggagactgatgatggatggctccaacctggcggcagcgcaaaagatg

SEQ ID NO: 105658 - DNA, 103 bp, Artificial Sequence
  Synthetic Polynucleotide
taatacgactcactatagggcagcatctggaacaaggttcccactgtttaaacagaggagataaacaatgggaaccttgaacctggcggcagcgcaaaagatg

SEQ ID NO: 105659 - DNA, 103 bp, Artificial Sequence
  Synthetic Polynucleotide
taatacgactcactataggggggttccaatgttaccagagttggagccataacagaggagaatggctatgactctggtaaacctggcggcagcgcaaaagatg

SEQ ID NO: 105660 - DNA, 103 bp, Artificial Sequence
  Synthetic Polynucleotide
taatacgactcactatagggatagtgctgagggttccaatgttaccagagaacagaggagactctggatgcattggaacaacctggcggcagcgcaaaagatg

SEQ ID NO: 105661 - DNA, 103 bp, Artificial Sequence
  Synthetic Polynucleotide
taatacgactcactatagggtgctgttggtatagtgctgagggttccaataacagaggagaattggaatgctcagcactaacctggcggcagcgcaaaagatg

SEQ ID NO: 105662 - DNA, 103 bp, Artificial Sequence
  Synthetic Polynucleotide
taatacgactcactatagggaaggaggagctgctgttggtatagtgctgaaacagaggagatcagcaatgtaccaacagaacctggcggcagcgcaaaagatg

SEQ ID NO: 105663 - DNA, 103 bp, Artificial Sequence
  Synthetic Polynucleotide
taatacgactcactatagggccggtgctagaaggaggagctgctgttggtaacagaggagaaccaacatgagctcctccaacctggcggcagcgcaaaagatg

SEQ ID NO: 105664 - DNA, 103 bp, Artificial Sequence
  Synthetic Polynucleotide
taatacgactcactatagggtttccttacaccggtgctagaaggaggagcaacagaggagagctcctatgtctagcaccaacctggcggcagcgcaaaagatg

SEQ ID NO: 105665 - DNA, 103 bp, Artificial Sequence
  Synthetic Polynucleotide
taatacgactcactatagggcgtgccagcctttccttacaccggtgctagaacagaggagactagcaatggtgtaaggaaacctggcggcagcgcaaaagatg

SEQ ID NO: 105666 - DNA, 103 bp, Artificial Sequence
  Synthetic Polynucleotide
taatacgactcactataggggtgacatgttcgtgccagcctttccttacaaacagaggagatgtaagatgaggctggcaaacctggcggcagcgcaaaagatg

SEQ ID NO: 105667 - DNA, 103 bp, Artificial Sequence
  Synthetic Polynucleotide
taatacgactcactatagggcaggtcctgagtgacatgttcgtgccagccaacagaggagaggctggatggaacatgtcaacctggcggcagcgcaaaagatg

SEQ ID NO: 105668 - DNA, 103 bp, Artificial Sequence
  Synthetic Polynucleotide
taatacgactcactataggggatggctccgcaggtcctgagtgacatgttaacagaggagaaacatgatgctcaggaccaacctggcggcagcgcaaaagatg

SEQ ID NO: 105669 - DNA, 103 bp, Artificial Sequence
  Synthetic Polynucleotide
taatacgactcactatagggtgtttggaagcagcatctggaacaaggttcaacagaggagagaacctatgtccagatgcaacctggcggcagcgcaaaagatg

SEQ ID NO: 105670 - DNA, 103 bp, Artificial Sequence
  Synthetic Polynucleotide
taatacgactcactatagggttatgcactagatggctccgcaggtcctgaaacagaggagatcaggaatggcggagccaaacctggcggcagcgcaaaagatg

SEQ ID NO: 105671 - DNA, 103 bp, Artificial Sequence
  Synthetic Polynucleotide
taatacgactcactatagggttggacgagtttatgcactagatggctccgaacagaggagacggagcatgctagtgcataacctggcggcagcgcaaaagatg

SEQ ID NO: 105672 - DNA, 103 bp, Artificial Sequence
  Synthetic Polynucleotide
taatacgactcactatagggggaagatggcttggacgagtttatgcactaaacagaggagatagtgcatgaactcgtccaacctggcggcagcgcaaaagatg

SEQ ID NO: 105673 - DNA, 103 bp, Artificial Sequence
  Synthetic Polynucleotide
taatacgactcactatagggtcaggtgttgggaagatggcttggacgagtaacagaggagaactcgtatgagccatcttaacctggcggcagcgcaaaagatg

SEQ ID NO: 105674 - DNA, 103 bp, Artificial Sequence
  Synthetic Polynucleotide
taatacgactcactatagggagctgcgggatcaggtgttgggaagatggcaacagaggagagccatcatgccaacacctaacctggcggcagcgcaaaagatg

SEQ ID NO: 105675 - DNA, 103 bp, Artificial Sequence
  Synthetic Polynucleotide
taatacgactcactataggggatcctttagagctgcgggatcaggtgttgaacagaggagacaacacatgatcccgcagaacctggcggcagcgcaaaagatg

SEQ ID NO: 105676 - DNA, 103 bp, Artificial Sequence
  Synthetic Polynucleotide
taatacgactcactatagggtccatgcggcgatcctttagagctgcgggaaacagaggagatcccgcatgtctaaaggaaacctggcggcagcgcaaaagatg

SEQ ID NO: 105677 - DNA, 103 bp, Artificial Sequence
  Synthetic Polynucleotide
taatacgactcactatagggtaccaggttttccatgcggcgatcctttagaacagaggagactaaagatgcgccgcatgaacctggcggcagcgcaaaagatg

SEQ ID NO: 105678 - DNA, 103 bp, Artificial Sequence
  Synthetic Polynucleotide
taatacgactcactatagggtagcataggctaccaggttttccatgcggcaacagaggagagccgcaatgaaaacctggaacctggcggcagcgcaaaagatg

SEQ ID NO: 105679 - DNA, 103 bp, Artificial Sequence
  Synthetic Polynucleotide
taatacgactcactatagggtccactttcttagcataggctaccaggtttaacagaggagaaaacctatgagcctatgcaacctggcggcagcgcaaaagatg

SEQ ID NO: 105680 - DNA, 103 bp, Artificial Sequence
  Synthetic Polynucleotide
taatacgactcactatagggcagttgtttatgtttggaagcagcatctggaacagaggagaccagatatggcttccaaaaacctggcggcagcgcaaaagatg

SEQ ID NO: 105681 - DNA, 103 bp, Artificial Sequence
  Synthetic Polynucleotide
taatacgactcactatagggcatgtccccttccactttcttagcataggcaacagaggagagcctatatgaagaaagtgaacctggcggcagcgcaaaagatg

SEQ ID NO: 105682 - DNA, 103 bp, Artificial Sequence
  Synthetic Polynucleotide
taatacgactcactatagggcagactcgtacatgtccccttccactttctaacagaggagaagaaagatgaaggggacaaacctggcggcagcgcaaaagatg

SEQ ID NO: 105683 - DNA, 103 bp, Artificial Sequence
  Synthetic Polynucleotide
taatacgactcactatagggctgctgttggcagactcgtacatgtcccctaacagaggagaaggggaatggtacgagtcaacctggcggcagcgcaaaagatg

SEQ ID NO: 105684 - DNA, 103 bp, Artificial Sequence
  Synthetic Polynucleotide
taatacgactcactatagggatattcatccctgctgttggcagactcgtaaacagaggagatacgagatggccaacagcaacctggcggcagcgcaaaagatg

SEQ ID NO: 105685 - DNA, 103 bp, Artificial Sequence
  Synthetic Polynucleotide
taatacgactcactatagggataagtgataatattcatccctgctgttggaacagaggagaccaacaatggggatgaataacctggcggcagcgcaaaagatg

SEQ ID NO: 105686 - DNA, 103 bp, Artificial Sequence
  Synthetic Polynucleotide
taatacgactcactatagggttctctgctaataagtgataatattcatccaacagaggagaggatgaatgttatcacttaacctggcggcagcgcaaaagatg

SEQ ID NO: 105687 - DNA, 103 bp, Artificial Sequence
  Synthetic Polynucleotide
taatacgactcactatagggcttgtagattttctctgctaataagtgataaacagaggagatatcacatgttagcagagaacctggcggcagcgcaaaagatg

SEQ ID NO: 105688 - DNA, 103 bp, Artificial Sequence
  Synthetic Polynucleotide
taatacgactcactatagggctttttgtatcttgtagattttctctgctaaacagaggagatagcagatgaaatctacaaacctggcggcagcgcaaaagatg

SEQ ID NO: 105689 - DNA, 103 bp, Artificial Sequence
  Synthetic Polynucleotide
taatacgactcactatagggtcttctagttctttttgtatcttgtagattaacagaggagaaatctaatggatacaaaaaacctggcggcagcgcaaaagatg

SEQ ID NO: 105690 - DNA, 103 bp, Artificial Sequence
  Synthetic Polynucleotide
taatacgactcactatagggcctccgtttttcttctagttctttttgtataacagaggagaatacaaatggaactagaaaacctggcggcagcgcaaaagatg

SEQ ID NO: 105691 - DNA, 103 bp, Artificial Sequence
  Synthetic Polynucleotide
taatacgactcactatagggttttggggttgggcggtccgtccagcaagtaacagaggagaacttgcatgacggaccgcaacctggcggcagcgcaaaagatg

SEQ ID NO: 105692 - DNA, 103 bp, Artificial Sequence
  Synthetic Polynucleotide
taatacgactcactataggggaagctccgacagttgtttatgtttggaagaacagaggagacttccaatgataaacaacaacctggcggcagcgcaaaagatg

SEQ ID NO: 105693 - DNA, 103 bp, Artificial Sequence
  Synthetic Polynucleotide
taatacgactcactataggggtaaacgcgacctccgtttttcttctagttaacagaggagaaactagatgaaaaacggaaacctggcggcagcgcaaaagatg

SEQ ID NO: 105694 - DNA, 103 bp, Artificial Sequence
  Synthetic Polynucleotide
taatacgactcactatagggccttgtttatgtaaacgcgacctccgttttaacagaggagaaaaacgatggtcgcgtttaacctggcggcagcgcaaaagatg

SEQ ID NO: 105695 - DNA, 103 bp, Artificial Sequence
  Synthetic Polynucleotide
taatacgactcactatagggccccaagatgccttgtttatgtaaacgcgaaacagaggagatcgcgtatgcataaacaaaacctggcggcagcgcaaaagatg

SEQ ID NO: 105696 - DNA, 103 bp, Artificial Sequence
  Synthetic Polynucleotide
taatacgactcactatagggctggctggttccccaagatgccttgtttataacagaggagaataaacatggcatcttggaacctggcggcagcgcaaaagatg

SEQ ID NO: 105697 - DNA, 103 bp, Artificial Sequence
  Synthetic Polynucleotide
taatacgactcactataggggctggtaaggctggctggttccccaagatgaacagaggagacatcttatggaaccagccaacctggcggcagcgcaaaagatg

SEQ ID NO: 105698 - DNA, 103 bp, Artificial Sequence
  Synthetic Polynucleotide
taatacgactcactatagggagcccccggggctggtaaggctggctggttaacagaggagaaaccagatggccttaccaaacctggcggcagcgcaaaagatg

SEQ ID NO: 105699 - DNA, 103 bp, Artificial Sequence
  Synthetic Polynucleotide
taatacgactcactatagggcagggggctgagcccccggggctggtaaggaacagaggagaccttacatgccccgggggaacctggcggcagcgcaaaagatg

SEQ ID NO: 105700 - DNA, 103 bp, Artificial Sequence
  Synthetic Polynucleotide
taatacgactcactatagggtgtggaatcacagggggctgagcccccgggaacagaggagacccgggatgtcagcccccaacctggcggcagcgcaaaagatg

SEQ ID NO: 105701 - DNA, 103 bp, Artificial Sequence
  Synthetic Polynucleotide
taatacgactcactatagggaggttgtgcctgtggaatcacagggggctgaacagaggagacagcccatggtgattccaaacctggcggcagcgcaaaagatg

SEQ ID NO: 105702 - DNA, 103 bp, Artificial Sequence
  Synthetic Polynucleotide
taatacgactcactataggggaggtctcacaggttgtgcctgtggaatcaaacagaggagatgattcatgaggcacaacaacctggcggcagcgcaaaagatg

SEQ ID NO: 105703 - DNA, 103 bp, Artificial Sequence
  Synthetic Polynucleotide
taatacgactcactatagggcctcctcgtagaagctccgacagttgtttaaacagaggagataaacaatggtcggagctaacctggcggcagcgcaaaagatg

SEQ ID NO: 105704 - DNA, 103 bp, Artificial Sequence
  Synthetic Polynucleotide
taatacgactcactatagggggtccatttggaggtctcacaggttgtgccaacagaggagaggcacaatgtgtgagaccaacctggcggcagcgcaaaagatg

SEQ ID NO: 105705 - DNA, 103 bp, Artificial Sequence
  Synthetic Polynucleotide
taatacgactcactatagggcagggacaggggtccatttggaggtctcacaacagaggagagtgagaatgccaaatggaaacctggcggcagcgcaaaagatg

SEQ ID NO: 105706 - DNA, 103 bp, Artificial Sequence
  Synthetic Polynucleotide
taatacgactcactataggggattcactggcagggacaggggtccatttgaacagaggagacaaatgatgccctgtcccaacctggcggcagcgcaaaagatg

SEQ ID NO: 105707 - DNA, 103 bp, Artificial Sequence
  Synthetic Polynucleotide
taatacgactcactatagggacttgcatgcgattcactggcagggacaggaacagaggagacctgtcatggccagtgaaaacctggcggcagcgcaaaagatg

SEQ ID NO: 105708 - DNA, 103 bp, Artificial Sequence
  Synthetic Polynucleotide
taatacgactcactatagggcccttgagaaacttgcatgcgattcactggaacagaggagaccagtgatgcgcatgcaaaacctggcggcagcgcaaaagatg

SEQ ID NO: 105709 - DNA, 103 bp, Artificial Sequence
  Synthetic Polynucleotide
taatacgactcactatagggatgaattcatcccttgagaaacttgcatgcaacagaggagagcatgcatgtttctcaagaacctggcggcagcgcaaaagatg

SEQ ID NO: 105710 - DNA, 103 bp, Artificial Sequence
  Synthetic Polynucleotide
taatacgactcactatagggatggggttaaatgaattcatcccttgagaaaacagaggagattctcaatggatgaattcaacctggcggcagcgcaaaagatg

SEQ ID NO: 105711 - DNA, 103 bp, Artificial Sequence
  Synthetic Polynucleotide
taatacgactcactatagggccccaaggacatggggttaaatgaattcataacagaggagaatgaatatgtttaaccccaacctggcggcagcgcaaaagatg

SEQ ID NO: 105712 - DNA, 103 bp, Artificial Sequence
  Synthetic Polynucleotide
taatacgactcactatagggactggacgttccccaaggacatggggttaaaacagaggagattaaccatgtgtccttggaacctggcggcagcgcaaaagatg

SEQ ID NO: 105713 - DNA, 103 bp, Artificial Sequence
  Synthetic Polynucleotide
taatacgactcactataggggcttgtggcaactggacgttccccaaggacaacagaggagagtccttatggaacgtccaaacctggcggcagcgcaaaagatg

SEQ ID NO: 105714 - DNA, 103 bp, Artificial Sequence
  Synthetic Polynucleotide
taatacgactcactatagggagagccgctgcctcctcgtagaagctccgaaacagaggagatcggagatgctacgaggaaacctggcggcagcgcaaaagatg

SEQ ID NO: 105715 - DNA, 103 bp, Artificial Sequence
  Synthetic Polynucleotide
taatacgactcactatagggtcccatgggtgcttgtggcaactggacgttaacagaggagaaacgtcatgttgccacaaaacctggcggcagcgcaaaagatg

SEQ ID NO: 105716 - DNA, 103 bp, Artificial Sequence
  Synthetic Polynucleotide
taatacgactcactatagggctgcacgaggtcccatgggtgcttgtggcaaacagaggagatgccacatgcacccatggaacctggcggcagcgcaaaagatg

SEQ ID NO: 105717 - DNA, 103 bp, Artificial Sequence
  Synthetic Polynucleotide
taatacgactcactatagggattggggaggctgcacgaggtcccatgggtaacagaggagaacccatatgacctcgtgcaacctggcggcagcgcaaaagatg

SEQ ID NO: 105718 - DNA, 103 bp, Artificial Sequence
  Synthetic Polynucleotide
taatacgactcactatagggagagtggttcattggggaggctgcacgaggaacagaggagacctcgtatggcctccccaaacctggcggcagcgcaaaagatg

SEQ ID NO: 105719 - DNA, 103 bp, Artificial Sequence
  Synthetic Polynucleotide
taatacgactcactatagggtcatctggacagagtggttcattggggaggaacagaggagacctcccatgtgaaccactaacctggcggcagcgcaaaagatg

SEQ ID NO: 105720 - DNA, 103 bp, Artificial Sequence
  Synthetic Polynucleotide
taatacgactcactatagggcccatgctgttcatctggacagagtggttcaacagaggagagaaccaatgtgtccagataacctggcggcagcgcaaaagatg

SEQ ID NO: 105721 - DNA, 103 bp, Artificial Sequence
  Synthetic Polynucleotide
taatacgactcactatagggtggcactgagcccatgctgttcatctggacaacagaggagagtccagatgaacagcatgaacctggcggcagcgcaaaagatg

SEQ ID NO: 105722 - DNA, 103 bp, Artificial Sequence
  Synthetic Polynucleotide
taatacgactcactatagggtggccatccctggcactgagcccatgctgtaacagaggagaacagcaatggctcagtgcaacctggcggcagcgcaaaagatg

SEQ ID NO: 105723 - DNA, 103 bp, Artificial Sequence
  Synthetic Polynucleotide
taatacgactcactataggggaaggagaaatggccatccctggcactgagaacagaggagactcagtatgagggatggcaacctggcggcagcgcaaaagatg

SEQ ID NO: 105724 - DNA, 103 bp, Artificial Sequence
  Synthetic Polynucleotide
taatacgactcactatagggaggcattcgggaaggagaaatggccatcccaacagaggagagggatgatgatttctcctaacctggcggcagcgcaaaagatg

SEQ ID NO: 105725 - DNA, 103 bp, Artificial Sequence
  Synthetic Polynucleotide
taatacgactcactatagggggttgatactagagccgctgcctcctcgtaaacagaggagatacgagatggcagcggctaacctggcggcagcgcaaaagatg

SEQ ID NO: 105726 - DNA, 103 bp, Artificial Sequence
  Synthetic Polynucleotide
taatacgactcactatagggtcggaggctgaggcattcgggaaggagaaaaacagaggagatttctcatgcccgaatgcaacctggcggcagcgcaaaagatg

SEQ ID NO: 105727 - DNA, 103 bp, Artificial Sequence
  Synthetic Polynucleotide
taatacgactcactatagggcccatcatgttcggaggctgaggcattcggaacagaggagaccgaatatgtcagcctccaacctggcggcagcgcaaaagatg

SEQ ID NO: 105728 - DNA, 103 bp, Artificial Sequence
  Synthetic Polynucleotide
taatacgactcactatagggggtgtgtgcacccatcatgttcggaggctgaacagaggagacagcctatgaacatgatgaacctggcggcagcgcaaaagatg

SEQ ID NO: 105729 - DNA, 103 bp, Artificial Sequence
  Synthetic Polynucleotide
taatacgactcactatagggtcatgttgttggtgtgtgcacccatcatgtaacagaggagaacatgaatggtgcacacaaacctggcggcagcgcaaaagatg

SEQ ID NO: 105730 - DNA, 103 bp, Artificial Sequence
  Synthetic Polynucleotide
taatacgactcactataggggcctgggccatcatgttgttggtgtgtgcaaacagaggagatgcacaatgcaacaacataacctggcggcagcgcaaaagatg

SEQ ID NO: 105731 - DNA, 103 bp, Artificial Sequence
  Synthetic Polynucleotide
taatacgactcactatagggctgagcgggcgcctgggccatcatgttgttaacagaggagaaacaacatgatggcccagaacctggcggcagcgcaaaagatg

SEQ ID NO: 105732 - DNA, 103 bp, Artificial Sequence
  Synthetic Polynucleotide
taatacgactcactataggggaaactggctctgagcgggcgcctgggccaaacagaggagatggcccatgcgcccgctcaacctggcggcagcgcaaaagatg

SEQ ID NO: 105733 - DNA, 103 bp, Artificial Sequence
  Synthetic Polynucleotide
taatacgactcactatagggttctgtggcagaaactggctctgagcgggcaacagaggagagcccgcatggagccagttaacctggcggcagcgcaaaagatg

SEQ ID NO: 105734 - DNA, 103 bp, Artificial Sequence
  Synthetic Polynucleotide
taatacgactcactatagggcgggaactggttctgtggcagaaactggctaacagaggagaagccagatgctgccacagaacctggcggcagcgcaaaagatg

SEQ ID NO: 105735 - DNA, 103 bp, Artificial Sequence
  Synthetic Polynucleotide
taatacgactcactatagggcgctggatgacgggaactggttctgtggcaaacagaggagatgccacatgaccagttccaacctggcggcagcgcaaaagatg

SEQ ID NO: 105736 - DNA, 103 bp, Artificial Sequence
  Synthetic Polynucleotide
taatacgactcactatagggcctattcctgggttgatactagagccgctgaacagaggagacagcggatgtagtatcaaaacctggcggcagcgcaaaagatg

SEQ ID NO: 105737 - DNA, 103 bp, Artificial Sequence
  Synthetic Polynucleotide
taatacgactcactatagggctcatcgccccgctggatgacgggaactggaacagaggagaccagttatggtcatccagaacctggcggcagcgcaaaagatg

SEQ ID NO: 105738 - DNA, 103 bp, Artificial Sequence
  Synthetic Polynucleotide
taatacgactcactatagggcatgcccacactcatcgccccgctggatgaaacagaggagatcatccatgggggcgatgaacctggcggcagcgcaaaagatg

SEQ ID NO: 105739 - DNA, 103 bp, Artificial Sequence
  Synthetic Polynucleotide
taatacgactcactataggggcggctgccccatgcccacactcatcgcccaacagaggagagggcgaatggtgtgggcaaacctggcggcagcgcaaaagatg

SEQ ID NO: 105740 - DNA, 103 bp, Artificial Sequence
  Synthetic Polynucleotide
taatacgactcactataggggtttgggctggcggctgccccatgcccacaaacagaggagatgtgggatgggggcagccaacctggcggcagcgcaaaagatg

SEQ ID NO: 105741 - DNA, 103 bp, Artificial Sequence
  Synthetic Polynucleotide
taatacgactcactatagggtgacacgcctgtttgggctggcggctgcccaacagaggagagggcagatgccagcccaaaacctggcggcagcgcaaaagatg

SEQ ID NO: 105742 - DNA, 103 bp, Artificial Sequence
  Synthetic Polynucleotide
taatacgactcactatagggcctgtccctgtgacacgcctgtttgggctgaacagaggagacagcccatgcaggcgtgtaacctggcggcagcgcaaaagatg

SEQ ID NO: 105743 - DNA, 103 bp, Artificial Sequence
  Synthetic Polynucleotide
taatacgactcactataggggcaccaggcacctgtccctgtgacacgcctaacagaggagaaggcgtatgacagggacaaacctggcggcagcgcaaaagatg

SEQ ID NO: 105744 - DNA, 103 bp, Artificial Sequence
  Synthetic Polynucleotide
taatacgactcactatagggaggaagagcagcaccaggcacctgtccctgaacagaggagacagggaatggtgcctggtaacctggcggcagcgcaaaagatg

SEQ ID NO: 105745 - DNA, 103 bp, Artificial Sequence
  Synthetic Polynucleotide
taatacgactcactatagggtgagagggttaggaagagcagcaccaggcaaacagaggagatgcctgatgctgctcttcaacctggcggcagcgcaaaagatg

SEQ ID NO: 105746 - DNA, 103 bp, Artificial Sequence
  Synthetic Polynucleotide
taatacgactcactatagggcccagcatgttgagagggttaggaagagcaaacagaggagatgctctatgtaaccctctaacctggcggcagcgcaaaagatg

SEQ ID NO: 105747 - DNA, 103 bp, Artificial Sequence
  Synthetic Polynucleotide
taatacgactcactataggggctcacatttcctattcctgggttgatactaacagaggagaagtatcatgccaggaataaacctggcggcagcgcaaaagatg

SEQ ID NO: 105748 - DNA, 103 bp, Artificial Sequence
  Synthetic Polynucleotide
taatacgactcactatagggggcctgaggccccagcatgttgagagggttaacagaggagaaaccctatgaacatgctgaacctggcggcagcgcaaaagatg

SEQ ID NO: 105749 - DNA, 103 bp, Artificial Sequence
  Synthetic Polynucleotide
taatacgactcactataggggtagctggctggcctgaggccccagcatgtaacagaggagaacatgcatgggcctcaggaacctggcggcagcgcaaaagatg

SEQ ID NO: 105750 - DNA, 103 bp, Artificial Sequence
  Synthetic Polynucleotide
taatacgactcactatagggggagggcaaggtagctggctggcctgaggcaacagaggagagcctcaatgcagccagctaacctggcggcagcgcaaaagatg

SEQ ID NO: 105751 - DNA, 103 bp, Artificial Sequence
  Synthetic Polynucleotide
taatacgactcactatagggctgtgtcactggagggcaaggtagctggctaacagaggagaagccagatgccttgccctaacctggcggcagcgcaaaagatg

SEQ ID NO: 105752 - DNA, 103 bp, Artificial Sequence
  Synthetic Polynucleotide
taatacgactcactataggggcagtggtgactgtgtcactggagggcaagaacagaggagacttgccatgcagtgacacaacctggcggcagcgcaaaagatg

SEQ ID NO: 105753 - DNA, 103 bp, Artificial Sequence
  Synthetic Polynucleotide
taatacgactcactatagggggtgttgggtgcagtggtgactgtgtcactaacagaggagaagtgacatggtcaccactaacctggcggcagcgcaaaagatg

SEQ ID NO: 105754 - DNA, 103 bp, Artificial Sequence
  Synthetic Polynucleotide
taatacgactcactatagggagcaggaggcggtgttgggtgcagtggtgaaacagaggagatcaccaatgcacccaacaaacctggcggcagcgcaaaagatg

SEQ ID NO: 105755 - DNA, 103 bp, Artificial Sequence
  Synthetic Polynucleotide
taatacgactcactatagggcagccgtggaagcaggaggcggtgttgggtaacagaggagaacccaaatgcgcctcctgaacctggcggcagcgcaaaagatg

SEQ ID NO: 105756 - DNA, 103 bp, Artificial Sequence
  Synthetic Polynucleotide
taatacgactcactatagggggcatgccagcagccgtggaagcaggaggcaacagaggagagcctccatgttccacggcaacctggcggcagcgcaaaagatg

SEQ ID NO: 105757 - DNA, 103 bp, Artificial Sequence
  Synthetic Polynucleotide
taatacgactcactatagggctggagagatggcatgccagcagccgtggaaacagaggagatccacgatggctggcatgaacctggcggcagcgcaaaagatg

SEQ ID NO: 105758 - DNA, 103 bp, Artificial Sequence
  Synthetic Polynucleotide
taatacgactcactatagggggctgctggcgctcacatttcctattcctgaacagaggagacaggaaatggaaatgtgaaacctggcggcagcgcaaaagatg

SEQ ID NO: 105759 - DNA, 103 bp, Artificial Sequence
  Synthetic Polynucleotide
taatacgactcactataggggtgtcgtgtgctggagagatggcatgccagaacagaggagactggcaatgcatctctccaacctggcggcagcgcaaaagatg

SEQ ID NO: 105760 - DNA, 103 bp, Artificial Sequence
  Synthetic Polynucleotide
taatacgactcactatagggatcccaggtggtgtcgtgtgctggagagataacagaggagaatctctatggcacacgacaacctggcggcagcgcaaaagatg

SEQ ID NO: 105761 - DNA, 103 bp, Artificial Sequence
  Synthetic Polynucleotide
taatacgactcactataggggggaggagtcatcccaggtggtgtcgtgtgaacagaggagacacacgatgccacctgggaacctggcggcagcgcaaaagatg

SEQ ID NO: 105762 - DNA, 103 bp, Artificial Sequence
  Synthetic Polynucleotide
taatacgactcactatagggctgctggctggggaggagtcatcccaggtgaacagaggagacacctgatgtgactcctcaacctggcggcagcgcaaaagatg

SEQ ID NO: 105763 - DNA, 103 bp, Artificial Sequence
  Synthetic Polynucleotide
taatacgactcactatagggtgagtgggagctgctggctggggaggagtcaacagaggagagactccatgccagccagcaacctggcggcagcgcaaaagatg

SEQ ID NO: 105764 - DNA, 103 bp, Artificial Sequence
  Synthetic Polynucleotide
taatacgactcactatagggagttgatggctgagtgggagctgctggctgaacagaggagacagccaatggctcccactaacctggcggcagcgcaaaagatg

SEQ ID NO: 105765 - DNA, 103 bp, Artificial Sequence
  Synthetic Polynucleotide
taatacgactcactatagggacgacacaggagttgatggctgagtgggagaacagaggagactcccaatgagccatcaaaacctggcggcagcgcaaaagatg

SEQ ID NO: 105766 - DNA, 103 bp, Artificial Sequence
  Synthetic Polynucleotide
taatacgactcactatagggtgcccggaagacgacacaggagttgatggcaacagaggagagccatcatgtcctgtgtcaacctggcggcagcgcaaaagatg

SEQ ID NO: 105767 - DNA, 103 bp, Artificial Sequence
  Synthetic Polynucleotide
taatacgactcactatagggggtgggagtctgcccggaagacgacacaggaacagaggagacctgtgatgtcttccgggaacctggcggcagcgcaaaagatg

SEQ ID NO: 105768 - DNA, 103 bp, Artificial Sequence
  Synthetic Polynucleotide
taatacgactcactatagggcaggagtcggggtgggagtctgcccggaagaacagaggagacttccgatgagactcccaaacctggcggcagcgcaaaagatg

SEQ ID NO: 105769 - DNA, 103 bp, Artificial Sequence
  Synthetic Polynucleotide
taatacgactcactatagggtgctgcacggggctgctggcgctcacatttaacagaggagaaaatgtatgcgccagcagaacctggcggcagcgcaaaagatg

SEQ ID NO: 105770 - DNA, 103 bp, Artificial Sequence
  Synthetic Polynucleotide
taatacgactcactatagggggcactgagccaggagtcggggtgggagtcaacagaggagagactccatgcccgactccaacctggcggcagcgcaaaagatg

SEQ ID NO: 105771 - DNA, 103 bp, Artificial Sequence
  Synthetic Polynucleotide
taatacgactcactatagggggtagcactgggcactgagccaggagtcggaacagaggagaccgactatgggctcagtgaacctggcggcagcgcaaaagatg

SEQ ID NO: 105772 - DNA, 103 bp, Artificial Sequence
  Synthetic Polynucleotide
taatacgactcactatagggtctgggtttgggtagcactgggcactgagcaacagaggagagctcagatgccagtgctaaacctggcggcagcgcaaaagatg

SEQ ID NO: 105773 - DNA, 103 bp, Artificial Sequence
  Synthetic Polynucleotide
taatacgactcactataggggtaggggtgctctgggtttgggtagcactgaacagaggagacagtgcatgccaaacccaaacctggcggcagcgcaaaagatg

SEQ ID NO: 105774 - DNA, 103 bp, Artificial Sequence
  Synthetic Polynucleotide
taatacgactcactatagggtgcctggactgtaggggtgctctgggtttgaacagaggagacaaaccatgagcacccctaacctggcggcagcgcaaaagatg

SEQ ID NO: 105775 - DNA, 103 bp, Artificial Sequence
  Synthetic Polynucleotide
taatacgactcactatagggcctgggctgctgcctggactgtaggggtgcaacagaggagagcacccatgcagtccaggaacctggcggcagcgcaaaagatg

SEQ ID NO: 105776 - DNA, 103 bp, Artificial Sequence
  Synthetic Polynucleotide
taatacgactcactataggggtcacctgggcctgggctgctgcctggactaacagaggagaagtccaatgagcagcccaaacctggcggcagcgcaaaagatg

SEQ ID NO: 105777 - DNA, 103 bp, Artificial Sequence
  Synthetic Polynucleotide
taatacgactcactatagggaggctgcggggtcacctgggcctgggctgcaacagaggagagcagccatggcccaggtgaacctggcggcagcgcaaaagatg

SEQ ID NO: 105778 - DNA, 103 bp, Artificial Sequence
  Synthetic Polynucleotide
taatacgactcactatagggctggggtttgaggctgcggggtcacctgggaacagaggagacccaggatgccccgcagcaacctggcggcagcgcaaaagatg

SEQ ID NO: 105779 - DNA, 103 bp, Artificial Sequence
  Synthetic Polynucleotide
taatacgactcactataggggggggctgaactggggtttgaggctgcgggaacagaggagacccgcaatgtcaaaccccaacctggcggcagcgcaaaagatg

SEQ ID NO: 105780 - DNA, 103 bp, Artificial Sequence
  Synthetic Polynucleotide
taatacgactcactatagggacccaggccctgctgcacggggctgctggcaacagaggagagccagcatgcccgtgcagaacctggcggcagcgcaaaagatg

SEQ ID NO: 105781 - DNA, 103 bp, Artificial Sequence
  Synthetic Polynucleotide
taatacgactcactatagggagccacagacgggggctgaactggggtttgaacagaggagacaaaccatggttcagcccaacctggcggcagcgcaaaagatg

SEQ ID NO: 105782 - DNA, 103 bp, Artificial Sequence
  Synthetic Polynucleotide
taatacgactcactatagggactgaggggtagccacagacgggggctgaaaacagaggagattcagcatgcgtctgtggaacctggcggcagcgcaaaagatg

SEQ ID NO: 105783 - DNA, 103 bp, Artificial Sequence
  Synthetic Polynucleotide
taatacgactcactatagggtgctgcgatgactgaggggtagccacagacaacagaggagagtctgtatgtacccctcaaacctggcggcagcgcaaaagatg

SEQ ID NO: 105784 - DNA, 103 bp, Artificial Sequence
  Synthetic Polynucleotide
taatacgactcactatagggcgtcggctgttgctgcgatgactgaggggtaacagaggagaacccctatgtcatcgcagaacctggcggcagcgcaaaagatg

SEQ ID NO: 105785 - DNA, 103 bp, Artificial Sequence
  Synthetic Polynucleotide
taatacgactcactatagggcgtgcacaggcgtcggctgttgctgcgatgaacagaggagacatcgcatgaacagccgaaacctggcggcagcgcaaaagatg

SEQ ID NO: 105786 - DNA, 103 bp, Artificial Sequence
  Synthetic Polynucleotide
taatacgactcactatagggggaggctgggcgtgcacaggcgtcggctgtaacagaggagaacagccatggcctgtgcaaacctggcggcagcgcaaaagatg

SEQ ID NO: 105787 - DNA, 103 bp, Artificial Sequence
  Synthetic Polynucleotide
taatacgactcactatagggcggtgtgccaggaggctgggcgtgcacaggaacagaggagacctgtgatggcccagcctaacctggcggcagcgcaaaagatg

SEQ ID NO: 105788 - DNA, 103 bp, Artificial Sequence
  Synthetic Polynucleotide
taatacgactcactatagggcctgggaaagcggtgtgccaggaggctgggaacagaggagacccagcatgctggcacacaacctggcggcagcgcaaaagatg

SEQ ID NO: 105789 - DNA, 103 bp, Artificial Sequence
  Synthetic Polynucleotide
taatacgactcactatagggctggctgctgcctgggaaagcggtgtgccaaacagaggagatggcacatggctttcccaaacctggcggcagcgcaaaagatg

SEQ ID NO: 105790 - DNA, 103 bp, Artificial Sequence
  Synthetic Polynucleotide
taatacgactcactataggggttatcaatgctggctgctgcctgggaaagaacagaggagactttccatggcagcagccaacctggcggcagcgcaaaagatg

SEQ ID NO: 105791 - DNA, 103 bp, Artificial Sequence
  Synthetic Polynucleotide
taatacgactcactataggggagcctggccacccaggccctgctgcacggaacagaggagaccgtgcatgagggcctggaacctggcggcagcgcaaaagatg

SEQ ID NO: 105792 - DNA, 103 bp, Artificial Sequence
  Synthetic Polynucleotide
taatacgactcactatagggtagggactctgttatcaatgctggctgctgaacagaggagacagcagatggcattgataaacctggcggcagcgcaaaagatg

SEQ ID NO: 105793 - DNA, 103 bp, Artificial Sequence
  Synthetic Polynucleotide
taatacgactcactataggggaggagggggtagggactctgttatcaatgaacagaggagacattgaatgcagagtcccaacctggcggcagcgcaaaagatg

SEQ ID NO: 105794 - DNA, 103 bp, Artificial Sequence
  Synthetic Polynucleotide
taatacgactcactataggggctggccaccgaggagggggtagggactctaacagaggagaagagtcatgaccccctccaacctggcggcagcgcaaaagatg

SEQ ID NO: 105795 - DNA, 103 bp, Artificial Sequence
  Synthetic Polynucleotide
taatacgactcactatagggtggtttctgcgctggccaccgaggagggggaacagaggagaccccctatgcggtggccaaacctggcggcagcgcaaaagatg

SEQ ID NO: 105796 - DNA, 103 bp, Artificial Sequence
  Synthetic Polynucleotide
taatacgactcactatagggtgctgggaattggtttctgcgctggccaccaacagaggagaggtggcatgcgcagaaacaacctggcggcagcgcaaaagatg

SEQ ID NO: 105797 - DNA, 103 bp, Artificial Sequence
  Synthetic Polynucleotide
taatacgactcactatagggaggtcctggctgctgggaattggtttctgcaacagaggagagcagaaatgaattcccagaacctggcggcagcgcaaaagatg

SEQ ID NO: 105798 - DNA, 103 bp, Artificial Sequence
  Synthetic Polynucleotide
taatacgactcactatagggcaggtacgtcaggtcctggctgctgggaataacagaggagaattcccatgagccaggacaacctggcggcagcgcaaaagatg

SEQ ID NO: 105799 - DNA, 103 bp, Artificial Sequence
  Synthetic Polynucleotide
taatacgactcactatagggatttccagcacaggtacgtcaggtcctggcaacagaggagagccaggatgtgacgtaccaacctggcggcagcgcaaaagatg

SEQ ID NO: 105800 - DNA, 103 bp, Artificial Sequence
  Synthetic Polynucleotide
taatacgactcactatagggctccgtcttcatttccagcacaggtacgtcaacagaggagagacgtaatggtgctggaaaacctggcggcagcgcaaaagatg

SEQ ID NO: 105801 - DNA, 103 bp, Artificial Sequence
  Synthetic Polynucleotide
taatacgactcactatagggctgcttgggtctccgtcttcatttccagcaaacagaggagatgctggatgtgaagacggaacctggcggcagcgcaaaagatg

SEQ ID NO: 105802 - DNA, 103 bp, Artificial Sequence
  Synthetic Polynucleotide
taatacgactcactatagggagtttggctcttttggggttgggcggtccgaacagaggagacggaccatgcaaccccaaaacctggcggcagcgcaaaagatg

SEQ ID NO: 105803 - DNA, 103 bp, Artificial Sequence
  Synthetic Polynucleotide
taatacgactcactatagggggctgcccttgagcctggccacccaggcccaacagaggagagggcctatgtggccaggcaacctggcggcagcgcaaaagatg

SEQ ID NO: 105804 - DNA, 103 bp, Artificial Sequence
  Synthetic Polynucleotide
taatacgactcactatagggtcagtgtcctctgcttgggtctccgtcttcaacagaggagagaagacatggacccaagcaacctggcggcagcgcaaaagatg

SEQ ID NO: 105805 - DNA, 103 bp, Artificial Sequence
  Synthetic Polynucleotide
taatacgactcactatagggaggatcgggctcagtgtcctctgcttgggtaacagaggagaacccaaatggaggacactaacctggcggcagcgcaaaagatg

SEQ ID NO: 105806 - DNA, 103 bp, Artificial Sequence
  Synthetic Polynucleotide
taatacgactcactatagggtggattcaccaggatcgggctcagtgtcctaacagaggagaaggacaatgagcccgatcaacctggcggcagcgcaaaagatg

SEQ ID NO: 105807 - DNA, 103 bp, Artificial Sequence
  Synthetic Polynucleotide
taatacgactcactatagggggctcccctttggattcaccaggatcgggcaacagaggagagcccgaatgtggtgaatcaacctggcggcagcgcaaaagatg

SEQ ID NO: 105808 - DNA, 103 bp, Artificial Sequence
  Synthetic Polynucleotide
taatacgactcactatagggctcagacctgggctcccctttggattcaccaacagaggagaggtgaaatgaaaggggagaacctggcggcagcgcaaaagatg

SEQ ID NO: 105809 - DNA, 103 bp, Artificial Sequence
  Synthetic Polynucleotide
taatacgactcactatagggcctccatcatctcagacctgggctccccttaacagaggagaaaggggatgccaggtctgaacctggcggcagcgcaaaagatg

SEQ ID NO: 105810 - DNA, 103 bp, Artificial Sequence
  Synthetic Polynucleotide
taatacgactcactatagggtgcaaatcctcctccatcatctcagacctgaacagaggagacaggtcatggatgatggaaacctggcggcagcgcaaaagatg

SEQ ID NO: 105811 - DNA, 103 bp, Artificial Sequence
  Synthetic Polynucleotide
taatacgactcactatagggggaagctccttgcaaatcctcctccatcataacagaggagaatgatgatggaggatttgaacctggcggcagcgcaaaagatg

SEQ ID NO: 105812 - DNA, 103 bp, Artificial Sequence
  Synthetic Polynucleotide
taatacgactcactatagggctttaacttgggaagctccttgcaaatcctaacagaggagaaggattatgaaggagcttaacctggcggcagcgcaaaagatg

SEQ ID NO: 105813 - DNA, 103 bp, Artificial Sequence
  Synthetic Polynucleotide
taatacgactcactatagggtctgtttcttctttaacttgggaagctcctaacagaggagaaggagcatgccaagttaaaacctggcggcagcgcaaaagatg

SEQ ID NO: 105814 - DNA, 103 bp, Artificial Sequence
  Synthetic Polynucleotide
taatacgactcactatagggagcactgttcggctgcccttgagcctggccaacagaggagaggccagatgcaagggcagaacctggcggcagcgcaaaagatg

SEQ ID NO: 105815 - DNA, 103 bp, Artificial Sequence
  Synthetic Polynucleotide
taatacgactcactatagggctctgctatgtctgtttcttctttaacttgaacagaggagacaagttatggaagaaacaaacctggcggcagcgcaaaagatg

SEQ ID NO: 105816 - DNA, 103 bp, Artificial Sequence
  Synthetic Polynucleotide
taatacgactcactatagggctgatttctgctctgctatgtctgtttcttaacagaggagaaagaaaatgacatagcagaacctggcggcagcgcaaaagatg

SEQ ID NO: 105817 - DNA, 103 bp, Artificial Sequence
  Synthetic Polynucleotide
taatacgactcactatagggtccattggttctgatttctgctctgctatgaacagaggagacatagcatggcagaaatcaacctggcggcagcgcaaaagatg

SEQ ID NO: 105818 - DNA, 103 bp, Artificial Sequence
  Synthetic Polynucleotide
taatacgactcactatagggttcatccacttccattggttctgatttctgaacagaggagacagaaaatggaaccaatgaacctggcggcagcgcaaaagatg

SEQ ID NO: 105819 - DNA, 103 bp, Artificial Sequence
  Synthetic Polynucleotide
taatacgactcactatagggcaggtttcttttcatccacttccattggttaacagaggagaaaccaaatgaagtggatgaacctggcggcagcgcaaaagatg

SEQ ID NO: 105820 - DNA, 103 bp, Artificial Sequence
  Synthetic Polynucleotide
taatacgactcactatagggactttcacttcaggtttcttttcatccactaacagaggagaagtggaatgaaagaaaccaacctggcggcagcgcaaaagatg

SEQ ID NO: 105821 - DNA, 103 bp, Artificial Sequence
  Synthetic Polynucleotide
taatacgactcactatagggtttaacttctactttcacttcaggtttcttaacagaggagaaagaaaatggaagtgaaaaacctggcggcagcgcaaaagatg

SEQ ID NO: 105822 - DNA, 103 bp, Artificial Sequence
  Synthetic Polynucleotide
taatacgactcactatagggcttcttcctctttaacttctactttcacttaacagaggagaaagtgaatgtagaagttaaacctggcggcagcgcaaaagatg

SEQ ID NO: 105823 - DNA, 103 bp, Artificial Sequence
  Synthetic Polynucleotide
taatacgactcactatagggctgctactctcttcttcctctttaacttctaacagaggagaagaagtatgagaggaagaaacctggcggcagcgcaaaagatg

SEQ ID NO: 105824 - DNA, 103 bp, Artificial Sequence
  Synthetic Polynucleotide
taatacgactcactatagggtgtgccgttactgctactctcttcttcctcaacagaggagagaggaaatggagagtagcaacctggcggcagcgcaaaagatg

SEQ ID NO: 105825 - DNA, 103 bp, Artificial Sequence
  Synthetic Polynucleotide
taatacgactcactatagggtggccatgttagcactgttcggctgcccttaacagaggagaaagggcatgcgaacagtgaacctggcggcagcgcaaaagatg

SEQ ID NO: 105826 - DNA, 103 bp, Artificial Sequence
  Synthetic Polynucleotide
taatacgactcactatagggactgagaggctgtgccgttactgctactctaacagaggagaagagtaatggtaacggcaaacctggcggcagcgcaaaagatg

SEQ ID NO: 105827 - DNA, 103 bp, Artificial Sequence
  Synthetic Polynucleotide
taatacgactcactatagggggagatgttgactgagaggctgtgccgttaaacagaggagataacggatgagcctctcaaacctggcggcagcgcaaaagatg

SEQ ID NO: 105828 - DNA, 103 bp, Artificial Sequence
  Synthetic Polynucleotide
taatacgactcactatagggcggctgcgaaggagatgttgactgagaggcaacagaggagagcctctatgtcaacatctaacctggcggcagcgcaaaagatg

SEQ ID NO: 105829 - DNA, 103 bp, Artificial Sequence
  Synthetic Polynucleotide
taatacgactcactatagggtttttttgcgcggctgcgaaggagatgttgaacagaggagacaacatatgcttcgcagcaacctggcggcagcgcaaaagatg

SEQ ID NO: 105830 - DNA, 103 bp, Artificial Sequence
  Synthetic Polynucleotide
taatacgactcactatagggggtttaaagatttttttgcgcggctgcgaaaacagaggagattcgcaatggcgcaaaaaaacctggcggcagcgcaaaagatg

SEQ ID NO: 105831 - DNA, 103 bp, Artificial Sequence
  Synthetic Polynucleotide
taatacgactcactatagggtaactcctctggtttaaagatttttttgcgaacagaggagacgcaaaatgatctttaaaaacctggcggcagcgcaaaagatg

SEQ ID NO: 105832 - DNA, 103 bp, Artificial Sequence
  Synthetic Polynucleotide
taatacgactcactataggggggcctggcgtaactcctctggtttaaagaaacagaggagatctttaatgcagaggagtaacctggcggcagcgcaaaagatg

SEQ ID NO: 105833 - DNA, 103 bp, Artificial Sequence
  Synthetic Polynucleotide
taatacgactcactataggggttggcatgagggcctggcgtaactcctctaacagaggagaagaggaatgacgccaggcaacctggcggcagcgcaaaagatg

SEQ ID NO: 105834 - DNA, 103 bp, Artificial Sequence
  Synthetic Polynucleotide
taatacgactcactatagggtgcttctagggttggcatgagggcctggcgaacagaggagacgccagatgctcatgccaaacctggcggcagcgcaaaagatg

SEQ ID NO: 105835 - DNA, 103 bp, Artificial Sequence
  Synthetic Polynucleotide
taatacgactcactataggggtcgatacagtgcttctagggttggcatgaaacagaggagatcatgcatgccctagaagaacctggcggcagcgcaaaagatg

SEQ ID NO: 105836 - DNA, 103 bp, Artificial Sequence
  Synthetic Polynucleotide
taatacgactcactataggggcactgaggctggccatgttagcactgttcaacagaggagagaacagatgtaacatggcaacctggcggcagcgcaaaagatg

SEQ ID NO: 105837 - DNA, 103 bp, Artificial Sequence
  Synthetic Polynucleotide
taatacgactcactatagggtctgggtcctgtcgatacagtgcttctaggaacagaggagacctagaatgactgtatcgaacctggcggcagcgcaaaagatg

SEQ ID NO: 105838 - DNA, 103 bp, Artificial Sequence
  Synthetic Polynucleotide
taatacgactcactatagggaggtaatgactctgggtcctgtcgatacagaacagaggagactgtatatgcaggacccaaacctggcggcagcgcaaaagatg

SEQ ID NO: 105839 - DNA, 103 bp, Artificial Sequence
  Synthetic Polynucleotide
taatacgactcactataggggctgccggaaaggtaatgactctgggtcctaacagaggagaaggaccatgagtcattacaacctggcggcagcgcaaaagatg

SEQ ID NO: 105840 - DNA, 103 bp, Artificial Sequence
  Synthetic Polynucleotide
taatacgactcactatagggggatctacaggctgccggaaaggtaatgacaacagaggagagtcattatgtttccggcaaacctggcggcagcgcaaaagatg

SEQ ID NO: 105841 - DNA, 103 bp, Artificial Sequence
  Synthetic Polynucleotide
taatacgactcactataggggaggagctggggatctacaggctgccggaaaacagaggagattccggatgcctgtagataacctggcggcagcgcaaaagatg

SEQ ID NO: 105842 - DNA, 103 bp, Artificial Sequence
  Synthetic Polynucleotide
taatacgactcactatagggctggaattccgaggagctggggatctacagaacagaggagactgtagatgcccagctccaacctggcggcagcgcaaaagatg

SEQ ID NO: 105843 - DNA, 103 bp, Artificial Sequence
  Synthetic Polynucleotide
taatacgactcactatagggtcaaaatagtctggaattccgaggagctggaacagaggagaccagctatgcggaattccaacctggcggcagcgcaaaagatg

SEQ ID NO: 105844 - DNA, 103 bp, Artificial Sequence
  Synthetic Polynucleotide
taatacgactcactatagggctttacgatgtcaaaatagtctggaattccaacagaggagaggaattatggactattttaacctggcggcagcgcaaaagatg

SEQ ID NO: 105845 - DNA, 103 bp, Artificial Sequence
  Synthetic Polynucleotide
taatacgactcactatagggccatgggattctttacgatgtcaaaatagtaacagaggagaactattatgacatcgtaaaacctggcggcagcgcaaaagatg

SEQ ID NO: 105846 - DNA, 103 bp, Artificial Sequence
  Synthetic Polynucleotide
taatacgactcactataggggtggagaggtccatgggattctttacgatgaacagaggagacatcgtatggaatcccataacctggcggcagcgcaaaagatg

SEQ ID NO: 105847 - DNA, 103 bp, Artificial Sequence
  Synthetic Polynucleotide
taatacgactcactatagggcttgcccatggcactgaggctggccatgttaacagaggagaaacatgatgagcctcagtaacctggcggcagcgcaaaagatg

SEQ ID NO: 105848 - DNA, 103 bp, Artificial Sequence
  Synthetic Polynucleotide
taatacgactcactatagggccgcttgatggtggagaggtccatgggattaacagaggagaaatcccatggacctctccaacctggcggcagcgcaaaagatg

SEQ ID NO: 105849 - DNA, 103 bp, Artificial Sequence
  Synthetic Polynucleotide
taatacgactcactatagggtgtccagcttccgcttgatggtggagaggtaacagaggagaacctctatgccatcaagcaacctggcggcagcgcaaaagatg

SEQ ID NO: 105850 - DNA, 103 bp, Artificial Sequence
  Synthetic Polynucleotide
taatacgactcactatagggtattgccctgtgtccagcttccgcttgatgaacagaggagacatcaaatggaagctggaaacctggcggcagcgcaaaagatg

SEQ ID NO: 105851 - DNA, 103 bp, Artificial Sequence
  Synthetic Polynucleotide
taatacgactcactataggggggctcttggtattgccctgtgtccagcttaacagaggagaaagctgatgacagggcaaaacctggcggcagcgcaaaagatg

SEQ ID NO: 105852 - DNA, 103 bp, Artificial Sequence
  Synthetic Polynucleotide
taatacgactcactatagggcgtactgccagggctcttggtattgccctgaacagaggagacagggcatgaccaagagcaacctggcggcagcgcaaaagatg

SEQ ID NO: 105853 - DNA, 103 bp, Artificial Sequence
  Synthetic Polynucleotide
taatacgactcactatagggacgtcgtccacgtactgccagggctcttggaacagaggagaccaagaatgctggcagtaaacctggcggcagcgcaaaagatg

SEQ ID NO: 105854 - DNA, 103 bp, Artificial Sequence
  Synthetic Polynucleotide
taatacgactcactatagggcatgagccagacgtcgtccacgtactgccaaacagaggagatggcagatggtggacgacaacctggcggcagcgcaaaagatg

SEQ ID NO: 105855 - DNA, 103 bp, Artificial Sequence
  Synthetic Polynucleotide
taatacgactcactatagggcattgttgaacatgagccagacgtcgtccaaacagaggagatggacgatgtctggctcaaacctggcggcagcgcaaaagatg

SEQ ID NO: 105856 - DNA, 103 bp, Artificial Sequence
  Synthetic Polynucleotide
taatacgactcactatagggtagagccaggcattgttgaacatgagccagaacagaggagactggctatggttcaacaaaacctggcggcagcgcaaaagatg

SEQ ID NO: 105857 - DNA, 103 bp, Artificial Sequence
  Synthetic Polynucleotide
taatacgactcactatagggcttgcgattatagagccaggcattgttgaaaacagaggagattcaacatggcctggctcaacctggcggcagcgcaaaagatg

SEQ ID NO: 105858 - DNA, 103 bp, Artificial Sequence
  Synthetic Polynucleotide
taatacgactcactatagggtcagagggctcttgcccatggcactgaggcaacagaggagagcctcaatgccatgggcaaacctggcggcagcgcaaaagatg

SEQ ID NO: 105859 - DNA, 103 bp, Artificial Sequence
  Synthetic Polynucleotide
taatacgactcactatagggctcgggatgtcttgcgattatagagccaggaacagaggagacctggcatgataatcgcaaacctggcggcagcgcaaaagatg

SEQ ID NO: 105860 - DNA, 103 bp, Artificial Sequence
  Synthetic Polynucleotide
taatacgactcactatagggaacttatagactcgggatgtcttgcgattaaacagaggagataatcgatggacatcccgaacctggcggcagcgcaaaagatg

SEQ ID NO: 105861 - DNA, 103 bp, Artificial Sequence
  Synthetic Polynucleotide
taatacgactcactatagggcttactgcaaaacttatagactcgggatgtaacagaggagaacatccatggtctataagaacctggcggcagcgcaaaagatg

SEQ ID NO: 105862 - DNA, 103 bp, Artificial Sequence
  Synthetic Polynucleotide
taatacgactcactatagggcctctgcaagcttactgcaaaacttatagaaacagaggagatctataatgtttgcagtaaacctggcggcagcgcaaaagatg

SEQ ID NO: 105863 - DNA, 103 bp, Artificial Sequence
  Synthetic Polynucleotide
taatacgactcactatagggtgctcaaagacctctgcaagcttactgcaaaacagaggagattgcagatggcttgcagaaacctggcggcagcgcaaaagatg

SEQ ID NO: 105864 - DNA, 103 bp, Artificial Sequence
  Synthetic Polynucleotide
taatacgactcactataggggtcaatttcctgctcaaagacctctgcaagaacagaggagacttgcaatggtctttgagaacctggcggcagcgcaaaagatg

SEQ ID NO: 105865 - DNA, 103 bp, Artificial Sequence
  Synthetic Polynucleotide
taatacgactcactataggggcatgacagggtcaatttcctgctcaaagaaacagaggagatctttgatgaggaaattgaacctggcggcagcgcaaaagatg

SEQ ID NO: 105866 - DNA, 103 bp, Artificial Sequence
  Synthetic Polynucleotide
taatacgactcactatagggccaagggactgcatgacagggtcaatttccaacagaggagaggaaatatgccctgtcataacctggcggcagcgcaaaagatg

SEQ ID NO: 105867 - DNA, 103 bp, Artificial Sequence
  Synthetic Polynucleotide
taatacgactcactatagggacagcaatatccaagggactgcatgacaggaacagaggagacctgtcatgcagtcccttaacctggcggcagcgcaaaagatg

SEQ ID NO: 105868 - DNA, 103 bp, Artificial Sequence
  Synthetic Polynucleotide
taatacgactcactatagggacttgcgtccacagcaatatccaagggactaacagaggagaagtcccatggatattgctaacctggcggcagcgcaaaagatg

SEQ ID NO: 105869 - DNA, 103 bp, Artificial Sequence
  Synthetic Polynucleotide
taatacgactcactatagggtctccctggctcagagggctcttgcccatgaacagaggagacatgggatggagccctctaacctggcggcagcgcaaaagatg

SEQ ID NO: 105870 - DNA, 103 bp, Artificial Sequence
  Synthetic Polynucleotide
taatacgactcactataggggaaaactcatacttgcgtccacagcaatataacagaggagaatattgatgtggacgcaaaacctggcggcagcgcaaaagatg

SEQ ID NO: 105871 - DNA, 103 bp, Artificial Sequence
  Synthetic Polynucleotide
taatacgactcactatagggagtctgtggggaaaactcatacttgcgtccaacagaggagaggacgcatgtatgagtttaacctggcggcagcgcaaaagatg

SEQ ID NO: 105872 - DNA, 103 bp, Artificial Sequence
  Synthetic Polynucleotide
taatacgactcactatagggagcagcacaaagtctgtggggaaaactcataacagaggagaatgagtatgccccacagaaacctggcggcagcgcaaaagatg

SEQ ID NO: 105873 - DNA, 103 bp, Artificial Sequence
  Synthetic Polynucleotide
taatacgactcactatagggtgcttcccatagcagcacaaagtctgtgggaacagaggagacccacaatgtttgtgctgaacctggcggcagcgcaaaagatg

SEQ ID NO: 105874 - DNA, 103 bp, Artificial Sequence
  Synthetic Polynucleotide
taatacgactcactatagggggtacacagctgcttcccatagcagcacaaaacagaggagattgtgcatgtatgggaagaacctggcggcagcgcaaaagatg

SEQ ID NO: 105875 - DNA, 103 bp, Artificial Sequence
  Synthetic Polynucleotide
taatacgactcactatagggcgcgaggaatggtacacagctgcttcccataacagaggagaatgggaatgagctgtgtaaacctggcggcagcgcaaaagatg

SEQ ID NO: 105876 - DNA, 103 bp, Artificial Sequence
  Synthetic Polynucleotide
taatacgactcactatagggtaggcagcatcgcgaggaatggtacacagcaacagaggagagctgtgatgcattcctcgaacctggcggcagcgcaaaagatg

SEQ ID NO: 105877 - DNA, 103 bp, Artificial Sequence
  Synthetic Polynucleotide
taatacgactcactatagggatagctgtagtaggcagcatcgcgaggaataacagaggagaattcctatggatgctgccaacctggcggcagcgcaaaagatg

SEQ ID NO: 105878 - DNA, 103 bp, Artificial Sequence
  Synthetic Polynucleotide
taatacgactcactatagggacctattctgatagctgtagtaggcagcataacagaggagaatgctgatgactacagctaacctggcggcagcgcaaaagatg

SEQ ID NO: 105879 - DNA, 103 bp, Artificial Sequence
  Synthetic Polynucleotide
taatacgactcactatagggcagaaatgatacctattctgatagctgtagaacagaggagactacagatgtcagaatagaacctggcggcagcgcaaaagatg

SEQ ID NO: 105880 - DNA, 103 bp, Artificial Sequence
  Synthetic Polynucleotide
taatacgactcactatagggggctgaagaatctccctggctcagagggctaacagaggagaagccctatgagccagggaaacctggcggcagcgcaaaagatg

SEQ ID NO: 105881 - DNA, 103 bp, Artificial Sequence
  Synthetic Polynucleotide
taatacgactcactatagggacacttctcacagaaatgatacctattctgaacagaggagacagaatatgtatcatttcaacctggcggcagcgcaaaagatg

SEQ ID NO: 105882 - DNA, 103 bp, Artificial Sequence
  Synthetic Polynucleotide
taatacgactcactatagggtctctgtgaaacacttctcacagaaatgataacagaggagaatcattatggtgagaagtaacctggcggcagcgcaaaagatg

SEQ ID NO: 105883 - DNA, 103 bp, Artificial Sequence
  Synthetic Polynucleotide
taatacgactcactatagggtcgccctggatctctgtgaaacacttctcaaacagaggagatgagaaatgtttcacagaaacctggcggcagcgcaaaagatg

SEQ ID NO: 105884 - DNA, 103 bp, Artificial Sequence
  Synthetic Polynucleotide
taatacgactcactatagggggtcacattctcgccctggatctctgtgaaaacagaggagattcacaatgatccagggcaacctggcggcagcgcaaaagatg

SEQ ID NO: 105885 - DNA, 103 bp, Artificial Sequence
  Synthetic Polynucleotide
taatacgactcactatagggcgtcacccagggtcacattctcgccctggaaacagaggagatccaggatgagaatgtgaaacctggcggcagcgcaaaagatg

SEQ ID NO: 105886 - DNA, 103 bp, Artificial Sequence
  Synthetic Polynucleotide
taatacgactcactatagggtgtgaagggtcgtcacccagggtcacattcaacagaggagagaatgtatgcctgggtgaaacctggcggcagcgcaaaagatg

SEQ ID NO: 105887 - DNA, 103 bp, Artificial Sequence
  Synthetic Polynucleotide
taatacgactcactatagggcgtctggggctgtgaagggtcgtcacccagaacagaggagactgggtatggacccttcaaacctggcggcagcgcaaaagatg

SEQ ID NO: 105888 - DNA, 103 bp, Artificial Sequence
  Synthetic Polynucleotide
taatacgactcactatagggttgaaattgtcgtctggggctgtgaagggtaacagaggagaacccttatgagccccagaaacctggcggcagcgcaaaagatg

SEQ ID NO: 105889 - DNA, 103 bp, Artificial Sequence
  Synthetic Polynucleotide
taatacgactcactatagggaactgatcctttgaaattgtcgtctggggcaacagaggagagccccaatggacaatttcaacctggcggcagcgcaaaagatg

SEQ ID NO: 105890 - DNA, 103 bp, Artificial Sequence
  Synthetic Polynucleotide
taatacgactcactatagggcttcttttcaaactgatcctttgaaattgtaacagaggagaacaattatgaaggatcagaacctggcggcagcgcaaaagatg

SEQ ID NO: 105891 - DNA, 103 bp, Artificial Sequence
  Synthetic Polynucleotide
taatacgactcactataggggcaggctgggggctgaagaatctccctggcaacagaggagagccaggatgattcttcagaacctggcggcagcgcaaaagatg

SEQ ID NO: 105892 - DNA, 103 bp, Artificial Sequence
  Synthetic Polynucleotide
taatacgactcactatagggtatcatttttcttcttttcaaactgatcctaacagaggagaaggatcatgttgaaaagaaacctggcggcagcgcaaaagatg

SEQ ID NO: 105893 - DNA, 103 bp, Artificial Sequence
  Synthetic Polynucleotide
taatacgactcactataggggggtctaaggtatcatttttcttcttttcaaacagaggagatgaaaaatggaaaaatgaaacctggcggcagcgcaaaagatg

SEQ ID NO: 105894 - DNA, 103 bp, Artificial Sequence
  Synthetic Polynucleotide
taatacgactcactataggggaaaggttcggggtctaaggtatcatttttaacagaggagaaaaaatatgaccttagacaacctggcggcagcgcaaaagatg

SEQ ID NO: 105895 - DNA, 103 bp, Artificial Sequence
  Synthetic Polynucleotide
taatacgactcactatagggtgcaatcaacgaaaggttcggggtctaaggaacagaggagaccttagatgccgaaccttaacctggcggcagcgcaaaagatg

SEQ ID NO: 105896 - DNA, 103 bp, Artificial Sequence
  Synthetic Polynucleotide
taatacgactcactatagggccacactccttgcaatcaacgaaaggttcgaacagaggagacgaaccatgcgttgattgaacctggcggcagcgcaaaagatg

SEQ ID NO: 105897 - DNA, 103 bp, Artificial Sequence
  Synthetic Polynucleotide
taatacgactcactatagggcatcttccggccacactccttgcaatcaacaacagaggagagttgatatgaaggagtgtaacctggcggcagcgcaaaagatg

SEQ ID NO: 105898 - DNA, 103 bp, Artificial Sequence
  Synthetic Polynucleotide
taatacgactcactatagggaaatctgatgcatcttccggccacactcctaacagaggagaaggagtatggccggaagaaacctggcggcagcgcaaaagatg

SEQ ID NO: 105899 - DNA, 103 bp, Artificial Sequence
  Synthetic Polynucleotide
taatacgactcactatagggtgcagaacgcaaatctgatgcatcttccggaacagaggagaccggaaatggcatcagataacctggcggcagcgcaaaagatg

SEQ ID NO: 105900 - DNA, 103 bp, Artificial Sequence
  Synthetic Polynucleotide
taatacgactcactataggggatgtcatagtgcagaacgcaaatctgatgaacagaggagacatcagatgtgcgttctgaacctggcggcagcgcaaaagatg

SEQ ID NO: 105901 - DNA, 103 bp, Artificial Sequence
  Synthetic Polynucleotide
taatacgactcactatagggaaggccaaatgatgtcatagtgcagaacgcaacagaggagagcgttcatgactatgacaaacctggcggcagcgcaaaagatg

SEQ ID NO: 105902 - DNA, 103 bp, Artificial Sequence
  Synthetic Polynucleotide
taatacgactcactataggggcctgtttaggcaggctgggggctgaagaaaacagaggagattcttcatgccccagcctaacctggcggcagcgcaaaagatg

SEQ ID NO: 105903 - DNA, 103 bp, Artificial Sequence
  Synthetic Polynucleotide
taatacgactcactatagggacaaaacctgaaggccaaatgatgtcatagaacagaggagactatgaatgcatttggccaacctggcggcagcgcaaaagatg

SEQ ID NO: 105904 - DNA, 103 bp, Artificial Sequence
  Synthetic Polynucleotide
taatacgactcactataggggttgtcgcacacaaaacctgaaggccaaataacagaggagaatttggatgtcaggttttaacctggcggcagcgcaaaagatg

SEQ ID NO: 105905 - DNA, 103 bp, Artificial Sequence
  Synthetic Polynucleotide
taatacgactcactatagggtcttcaagcagttgtcgcacacaaaacctgaacagaggagacaggttatgtgtgcgacaaacctggcggcagcgcaaaagatg

SEQ ID NO: 105906 - DNA, 103 bp, Artificial Sequence
  Synthetic Polynucleotide
taatacgactcactatagggctgccagttttcttcaagcagttgtcgcacaacagaggagagtgcgaatgctgcttgaaaacctggcggcagcgcaaaagatg

SEQ ID NO: 105907 - DNA, 103 bp, Artificial Sequence
  Synthetic Polynucleotide
taatacgactcactatagggttttcgaggtctgccagttttcttcaagcaaacagaggagatgcttgatgaaaactggcaacctggcggcagcgcaaaagatg

SEQ ID NO: 105908 - DNA, 103 bp, Artificial Sequence
  Synthetic Polynucleotide
taatacgactcactatagggatttgttttcttttcgaggtctgccagtttaacagaggagaaaactgatggacctcgaaaacctggcggcagcgcaaaagatg

SEQ ID NO: 105909 - DNA, 103 bp, Artificial Sequence
  Synthetic Polynucleotide
taatacgactcactatagggttagcactgaatttgttttcttttcgaggtaacagaggagaacctcgatgagaaaacaaaacctggcggcagcgcaaaagatg

SEQ ID NO: 105910 - DNA, 103 bp, Artificial Sequence
  Synthetic Polynucleotide
taatacgactcactatagggctgcagcctcttagcactgaatttgttttcaacagaggagagaaaacatgttcagtgctaacctggcggcagcgcaaaagatg

SEQ ID NO: 105911 - DNA, 103 bp, Artificial Sequence
  Synthetic Polynucleotide
taatacgactcactataggggtcttgtggtctgcagcctcttagcactgaaacagaggagatcagtgatgagaggctgcaacctggcggcagcgcaaaagatg

SEQ ID NO: 105912 - DNA, 103 bp, Artificial Sequence
  Synthetic Polynucleotide
taatacgactcactatagggtggtttcccagtcttgtggtctgcagcctcaacagaggagagaggctatggaccacaagaacctggcggcagcgcaaaagatg

SEQ ID NO: 105913 - DNA, 103 bp, Artificial Sequence
  Synthetic Polynucleotide
taatacgactcactataggggggcgagctgagtttggctcttttggggttaacagaggagaaaccccatgagagccaaaaacctggcggcagcgcaaaagatg

SEQ ID NO: 105914 - DNA, 103 bp, Artificial Sequence
  Synthetic Polynucleotide
taatacgactcactatagggggtgctggctgcctgtttaggcaggctgggaacagaggagacccagcatgcctaaacagaacctggcggcagcgcaaaagatg

SEQ ID NO: 105915 - DNA, 103 bp, Artificial Sequence
  Synthetic Polynucleotide
taatacgactcactataggggtcttccaagtggtttcccagtcttgtggtaacagaggagaaccacaatgctgggaaacaacctggcggcagcgcaaaagatg

SEQ ID NO: 105916 - DNA, 103 bp, Artificial Sequence
  Synthetic Polynucleotide
taatacgactcactatagggtgttcactcggtcttccaagtggtttcccaaacagaggagatgggaaatgacttggaagaacctggcggcagcgcaaaagatg

SEQ ID NO: 105917 - DNA, 103 bp, Artificial Sequence
  Synthetic Polynucleotide
taatacgactcactatagggcgcaaaaatttgttcactcggtcttccaagaacagaggagacttggaatgccgagtgaaaacctggcggcagcgcaaaagatg

SEQ ID NO: 105918 - DNA, 103 bp, Artificial Sequence
  Synthetic Polynucleotide
taatacgactcactatagggattctggcgccgcaaaaatttgttcactcgaacagaggagacgagtgatgaaatttttgaacctggcggcagcgcaaaagatg

SEQ ID NO: 105919 - DNA, 103 bp, Artificial Sequence
  Synthetic Polynucleotide
taatacgactcactatagggcttcagggtgattctggcgccgcaaaaattaacagaggagaaattttatgggcgccagaaacctggcggcagcgcaaaagatg

SEQ ID NO: 105920 - DNA, 103 bp, Artificial Sequence
  Synthetic Polynucleotide
taatacgactcactatagggacctccccggcttcagggtgattctggcgcaacagaggagagcgccaatgtcaccctgaaacctggcggcagcgcaaaagatg

SEQ ID NO: 105921 - DNA, 103 bp, Artificial Sequence
  Synthetic Polynucleotide
taatacgactcactatagggtcggacaaaaacctccccggcttcagggtgaacagaggagacaccctatggccggggagaacctggcggcagcgcaaaagatg

SEQ ID NO: 105922 - DNA, 103 bp, Artificial Sequence
  Synthetic Polynucleotide
taatacgactcactatagggtggccaccactcggacaaaaacctccccggaacagaggagaccggggatgtttttgtccaacctggcggcagcgcaaaagatg

SEQ ID NO: 105923 - DNA, 103 bp, Artificial Sequence
  Synthetic Polynucleotide
taatacgactcactatagggttgtctgagctggccaccactcggacaaaaaacagaggagattttgtatgagtggtggcaacctggcggcagcgcaaaagatg

SEQ ID NO: 105924 - DNA, 103 bp, Artificial Sequence
  Synthetic Polynucleotide
taatacgactcactatagggctccaccgtcttgtctgagctggccaccacaacagaggagagtggtgatgagctcagacaacctggcggcagcgcaaaagatg

SEQ ID NO: 105925 - DNA, 103 bp, Artificial Sequence
  Synthetic Polynucleotide
taatacgactcactatagggtgggcccagaggtgctggctgcctgtttagaacagaggagactaaacatgcagccagcaaacctggcggcagcgcaaaagatg

SEQ ID NO: 105926 - DNA, 103 bp, Artificial Sequence
  Synthetic Polynucleotide
taatacgactcactatagggcgggcttgacctccaccgtcttgtctgagcaacagaggagagctcagatgagacggtggaacctggcggcagcgcaaaagatg

SEQ ID NO: 105927 - DNA, 103 bp, Artificial Sequence
  Synthetic Polynucleotide
taatacgactcactataggggacttcatcccgggcttgacctccaccgtcaacagaggagagacggtatgggtcaagccaacctggcggcagcgcaaaagatg

SEQ ID NO: 105928 - DNA, 103 bp, Artificial Sequence
  Synthetic Polynucleotide
taatacgactcactatagggcacaaaccgtgacttcatcccgggcttgacaacagaggagagtcaagatggggatgaagaacctggcggcagcgcaaaagatg

SEQ ID NO: 105929 - DNA, 103 bp, Artificial Sequence
  Synthetic Polynucleotide
taatacgactcactatagggccccagaatccacaaaccgtgacttcatccaacagaggagaggatgaatgcacggtttgaacctggcggcagcgcaaaagatg

SEQ ID NO: 105930 - DNA, 103 bp, Artificial Sequence
  Synthetic Polynucleotide
taatacgactcactatagggtcagacatttccccagaatccacaaaccgtaacagaggagaacggttatgggattctggaacctggcggcagcgcaaaagatg

SEQ ID NO: 105931 - DNA, 103 bp, Artificial Sequence
  Synthetic Polynucleotide
taatacgactcactatagggtgggaaagattcagacatttccccagaatcaacagaggagagattctatggaaatgtctaacctggcggcagcgcaaaagatg

SEQ ID NO: 105932 - DNA, 103 bp, Artificial Sequence
  Synthetic Polynucleotide
taatacgactcactatagggtggttcgatatgggaaagattcagacatttaacagaggagaaaatgtatgaatctttccaacctggcggcagcgcaaaagatg

SEQ ID NO: 105933 - DNA, 103 bp, Artificial Sequence
  Synthetic Polynucleotide
taatacgactcactatagggaacagagctttggttcgatatgggaaagataacagaggagaatctttatgatatcgaacaacctggcggcagcgcaaaagatg

SEQ ID NO: 105934 - DNA, 103 bp, Artificial Sequence
  Synthetic Polynucleotide
taatacgactcactatagggctcaaaagcaaacagagctttggttcgataaacagaggagatatcgaatgaaagctctgaacctggcggcagcgcaaaagatg

SEQ ID NO: 105935 - DNA, 103 bp, Artificial Sequence
  Synthetic Polynucleotide
taatacgactcactatagggcgtcaatttcctcaaaagcaaacagagcttaacagaggagaaagctcatgttgcttttgaacctggcggcagcgcaaaagatg

SEQ ID NO: 105936 - DNA, 103 bp, Artificial Sequence
  Synthetic Polynucleotide
taatacgactcactataggggcagcgggggtgggcccagaggtgctggctaacagaggagaagccagatgctctgggccaacctggcggcagcgcaaaagatg

SEQ ID NO: 105937 - DNA, 103 bp, Artificial Sequence
  Synthetic Polynucleotide
taatacgactcactatagggacatccacgccgtcaatttcctcaaaagcaaacagaggagatgctttatgggaaattgaaacctggcggcagcgcaaaagatg

SEQ ID NO: 105938 - DNA, 103 bp, Artificial Sequence
  Synthetic Polynucleotide
taatacgactcactatagggaaaaaagcagacatccacgccgtcaatttcaacagaggagagaaattatgggcgtggataacctggcggcagcgcaaaagatg

SEQ ID NO: 105939 - DNA, 103 bp, Artificial Sequence
  Synthetic Polynucleotide
taatacgactcactatagggcgtgcattccaaaaaagcagacatccacgcaacagaggagagcgtggatgtctgcttttaacctggcggcagcgcaaaagatg

SEQ ID NO: 105940 - DNA, 103 bp, Artificial Sequence
  Synthetic Polynucleotide
taatacgactcactatagggtattcttggacgtgcattccaaaaaagcagaacagaggagactgcttatgtggaatgcaaacctggcggcagcgcaaaagatg

SEQ ID NO: 105941 - DNA, 103 bp, Artificial Sequence
  Synthetic Polynucleotide
taatacgactcactatagggatcagagccgtattcttggacgtgcattccaacagaggagaggaatgatggtccaagaaaacctggcggcagcgcaaaagatg

SEQ ID NO: 105942 - DNA, 103 bp, Artificial Sequence
  Synthetic Polynucleotide
taatacgactcactataggggaggggggcaatcagagccgtattcttggaaacagaggagatccaagatgacggctctgaacctggcggcagcgcaaaagatg

SEQ ID NO: 105943 - DNA, 103 bp, Artificial Sequence
  Synthetic Polynucleotide
taatacgactcactatagggctcgtgtttggaggggggcaatcagagccgaacagaggagacggctcatgttgccccccaacctggcggcagcgcaaaagatg

SEQ ID NO: 105944 - DNA, 103 bp, Artificial Sequence
  Synthetic Polynucleotide
taatacgactcactataggggtacacacgcctcgtgtttggaggggggcaaacagaggagatgccccatgccaaacacgaacctggcggcagcgcaaaagatg

SEQ ID NO: 105945 - DNA, 103 bp, Artificial Sequence
  Synthetic Polynucleotide
taatacgactcactataggggataagaaatgtacacacgcctcgtgtttgaacagaggagacaaacaatgggcgtgtgtaacctggcggcagcgcaaaagatg

SEQ ID NO: 105946 - DNA, 103 bp, Artificial Sequence
  Synthetic Polynucleotide
taatacgactcactatagggatactatccagataagaaatgtacacacgcaacagaggagagcgtgtatgcatttcttaaacctggcggcagcgcaaaagatg

SEQ ID NO: 105947 - DNA, 103 bp, Artificial Sequence
  Synthetic Polynucleotide
taatacgactcactatagggtgcttgggaggcagcgggggtgggcccagaaacagaggagatctgggatgacccccgctaacctggcggcagcgcaaaagatg

SEQ ID NO: 105948 - DNA, 103 bp, Artificial Sequence
  Synthetic Polynucleotide
taatacgactcactataggggaagaaatgaatactatccagataagaaataacagaggagaatttctatgctggatagtaacctggcggcagcgcaaaagatg

SEQ ID NO: 105949 - DNA, 103 bp, Artificial Sequence
  Synthetic Polynucleotide
taatacgactcactatagggaacgtggccggaagaaatgaatactatccaaacagaggagatggataatgttcatttctaacctggcggcagcgcaaaagatg

SEQ ID NO: 105950 - DNA, 103 bp, Artificial Sequence
  Synthetic Polynucleotide
taatacgactcactataggggtgcggaggcaacgtggccggaagaaatgaaacagaggagatcatttatgccggccacgaacctggcggcagcgcaaaagatg

SEQ ID NO: 105951 - DNA, 103 bp, Artificial Sequence
  Synthetic Polynucleotide
taatacgactcactataggggtaaacggctgtgcggaggcaacgtggccgaacagaggagacggccaatgtgcctccgcaacctggcggcagcgcaaaagatg

SEQ ID NO: 105952 - DNA, 103 bp, Artificial Sequence
  Synthetic Polynucleotide
taatacgactcactatagggggatctcatggtaaacggctgtgcggaggcaacagaggagagcctccatgcagccgtttaacctggcggcagcgcaaaagatg

SEQ ID NO: 105953 - DNA, 103 bp, Artificial Sequence
  Synthetic Polynucleotide
taatacgactcactatagggtatccaataaggatctcatggtaaacggctaacagaggagaagccgtatgccatgagataacctggcggcagcgcaaaagatg

SEQ ID NO: 105954 - DNA, 103 bp, Artificial Sequence
  Synthetic Polynucleotide
taatacgactcactatagggatactctaaatatccaataaggatctcatgaacagaggagacatgagatgcttattggaaacctggcggcagcgcaaaagatg

SEQ ID NO: 105955 - DNA, 103 bp, Artificial Sequence
  Synthetic Polynucleotide
taatacgactcactatagggatttcttcacatactctaaatatccaataaaacagaggagattattgatgatttagagtaacctggcggcagcgcaaaagatg

SEQ ID NO: 105956 - DNA, 103 bp, Artificial Sequence
  Synthetic Polynucleotide
taatacgactcactatagggacataccctaatttcttcacatactctaaaaacagaggagatttagaatgtgtgaagaaaacctggcggcagcgcaaaagatg

SEQ ID NO: 105957 - DNA, 103 bp, Artificial Sequence
  Synthetic Polynucleotide
taatacgactcactataggggtgccctgtcacataccctaatttcttcacaacagaggagagtgaagatgttagggtataacctggcggcagcgcaaaagatg

SEQ ID NO: 105958 - DNA, 103 bp, Artificial Sequence
  Synthetic Polynucleotide
taatacgactcactataggggcggattcagtgcttgggaggcagcgggggaacagaggagacccccgatgcctcccaagaacctggcggcagcgcaaaagatg

SEQ ID NO: 105959 - DNA, 103 bp, Artificial Sequence
  Synthetic Polynucleotide
taatacgactcactatagggaggcccagatgtgccctgtcacataccctaaacagaggagatagggtatgtgacagggcaacctggcggcagcgcaaaagatg

SEQ ID NO: 105960 - DNA, 103 bp, Artificial Sequence
  Synthetic Polynucleotide
taatacgactcactatagggcttggaggacaggcccagatgtgccctgtcaacagaggagagacaggatgcatctgggcaacctggcggcagcgcaaaagatg

SEQ ID NO: 105961 - DNA, 103 bp, Artificial Sequence
  Synthetic Polynucleotide
taatacgactcactatagggatctccttcacttggaggacaggcccagataacagaggagaatctggatgtgtcctccaaacctggcggcagcgcaaaagatg

SEQ ID NO: 105962 - DNA, 103 bp, Artificial Sequence
  Synthetic Polynucleotide
taatacgactcactatagggagatgtaatcatctccttcacttggaggacaacagaggagagtcctcatggtgaaggagaacctggcggcagcgcaaaagatg

SEQ ID NO: 105963 - DNA, 103 bp, Artificial Sequence
  Synthetic Polynucleotide
taatacgactcactatagggtggcaatggaagatgtaatcatctccttcaaacagaggagatgaaggatgtgattacataacctggcggcagcgcaaaagatg

SEQ ID NO: 105964 - DNA, 103 bp, Artificial Sequence
  Synthetic Polynucleotide
taatacgactcactatagggatcaggtgggtggcaatggaagatgtaatcaacagaggagagattacatgttccattgcaacctggcggcagcgcaaaagatg

SEQ ID NO: 105965 - DNA, 103 bp, Artificial Sequence
  Synthetic Polynucleotide
taatacgactcactataggggtattttttgatcaggtgggtggcaatggaaacagaggagatccattatgacccacctgaacctggcggcagcgcaaaagatg

SEQ ID NO: 105966 - DNA, 103 bp, Artificial Sequence
  Synthetic Polynucleotide
taatacgactcactatagggtttggcttgggtattttttgatcaggtgggaacagaggagacccaccatgtcaaaaaataacctggcggcagcgcaaaagatg

SEQ ID NO: 105967 - DNA, 103 bp, Artificial Sequence
  Synthetic Polynucleotide
taatacgactcactatagggctgcagtcgttttggcttgggtattttttgaacagaggagacaaaaaatgcccaagccaaacctggcggcagcgcaaaagatg

SEQ ID NO: 105968 - DNA, 103 bp, Artificial Sequence
  Synthetic Polynucleotide
taatacgactcactatagggtgtaccactcctgcagtcgttttggcttggaacagaggagaccaagcatgaacgactgcaacctggcggcagcgcaaaagatg

SEQ ID NO: 105969 - DNA, 103 bp, Artificial Sequence
  Synthetic Polynucleotide
taatacgactcactatagggttttgtgcttgcggattcagtgcttgggagaacagaggagactcccaatgactgaatccaacctggcggcagcgcaaaagatg

SEQ ID NO: 105970 - DNA, 103 bp, Artificial Sequence
  Synthetic Polynucleotide
taatacgactcactatagggagcatctttttgtaccactcctgcagtcgtaacagaggagaacgactatgggagtggtaaacctggcggcagcgcaaaagatg

SEQ ID NO: 105971 - DNA, 103 bp, Artificial Sequence
  Synthetic Polynucleotide
taatacgactcactatagggcgccttgtccagcatctttttgtaccactcaacagaggagagagtggatgaaaaagatgaacctggcggcagcgcaaaagatg

SEQ ID NO: 105972 - DNA, 103 bp, Artificial Sequence
  Synthetic Polynucleotide
taatacgactcactataggggctctgcaaacgccttgtccagcatcttttaacagaggagaaaaagaatgtggacaaggaacctggcggcagcgcaaaagatg

SEQ ID NO: 105973 - DNA, 103 bp, Artificial Sequence
  Synthetic Polynucleotide
taatacgactcactatagggtggatgatccgctctgcaaacgccttgtccaacagaggagaggacaaatggtttgcagaaacctggcggcagcgcaaaagatg

SEQ ID NO: 105974 - DNA, 103 bp, Artificial Sequence
  Synthetic Polynucleotide
taatacgactcactatagggcttgtagtcatggatgatccgctctgcaaaaacagaggagatttgcaatgcggatcatcaacctggcggcagcgcaaaagatg

SEQ ID NO: 105975 - DNA, 103 bp, Artificial Sequence
  Synthetic Polynucleotide
taatacgactcactatagggtgaaaatatccttgtagtcatggatgatccaacagaggagaggatcaatgatgactacaaacctggcggcagcgcaaaagatg

SEQ ID NO: 105976 - DNA, 103 bp, Artificial Sequence
  Synthetic Polynucleotide
taatacgactcactataggggttgcttgtttgaaaatatccttgtagtcaaacagaggagatgactaatgggatattttaacctggcggcagcgcaaaagatg

SEQ ID NO: 105977 - DNA, 103 bp, Artificial Sequence
  Synthetic Polynucleotide
taatacgactcactatagggcctgtcttcagttgcttgtttgaaaatatcaacagaggagagatattatgaaacaagcaaacctggcggcagcgcaaaagatg

SEQ ID NO: 105978 - DNA, 103 bp, Artificial Sequence
  Synthetic Polynucleotide
taatacgactcactatagggcactggtgagcctgtcttcagttgcttgttaacagaggagaaacaagatgctgaagacaaacctggcggcagcgcaaaagatg

SEQ ID NO: 105979 - DNA, 103 bp, Artificial Sequence
  Synthetic Polynucleotide
taatacgactcactatagggagttccttggcactggtgagcctgtcttcaaacagaggagatgaagaatggctcaccagaacctggcggcagcgcaaaagatg

SEQ ID NO: 105980 - DNA, 103 bp, Artificial Sequence
  Synthetic Polynucleotide
taatacgactcactatagggccccacttgcttttgtgcttgcggattcagaacagaggagactgaatatgcaagcacaaaacctggcggcagcgcaaaagatg

SEQ ID NO: 105981 - DNA, 103 bp, Artificial Sequence
  Synthetic Polynucleotide
taatacgactcactatagggaaaatagggcagttccttggcactggtgagaacagaggagactcaccatggccaaggaaaacctggcggcagcgcaaaagatg

SEQ ID NO: 105982 - DNA, 103 bp, Artificial Sequence
  Synthetic Polynucleotide
taatacgactcactatagggaatcaccttcaaaatagggcagttccttggaacagaggagaccaaggatgtgccctattaacctggcggcagcgcaaaagatg

SEQ ID NO: 105983 - DNA, 103 bp, Artificial Sequence
  Synthetic Polynucleotide
taatacgactcactatagggttgggccagaaatcaccttcaaaatagggcaacagaggagagccctaatgtgaaggtgaaacctggcggcagcgcaaaagatg

SEQ ID NO: 105984 - DNA, 103 bp, Artificial Sequence
  Synthetic Polynucleotide
taatacgactcactatagggttctaacacattgggccagaaatcaccttcaacagaggagagaaggtatgttctggcccaacctggcggcagcgcaaaagatg

SEQ ID NO: 105985 - DNA, 103 bp, Artificial Sequence
  Synthetic Polynucleotide
taatacgactcactatagggtaatgctctcttctaacacattgggccagaaacagaggagatctggcatgatgtgttagaacctggcggcagcgcaaaagatg

SEQ ID NO: 105986 - DNA, 103 bp, Artificial Sequence
  Synthetic Polynucleotide
taatacgactcactatagggtctagttccttaatgctctcttctaacacaaacagaggagatgtgttatgagagagcataacctggcggcagcgcaaaagatg

SEQ ID NO: 105987 - DNA, 103 bp, Artificial Sequence
  Synthetic Polynucleotide
taatacgactcactatagggttcttcttgttctagttccttaatgctctcaacagaggagagagagcatgaaggaactaaacctggcggcagcgcaaaagatg

SEQ ID NO: 105988 - DNA, 103 bp, Artificial Sequence
  Synthetic Polynucleotide
taatacgactcactatagggtcctctcctcttcttcttgttctagttcctaacagaggagaaggaacatgaacaagaagaacctggcggcagcgcaaaagatg

SEQ ID NO: 105989 - DNA, 103 bp, Artificial Sequence
  Synthetic Polynucleotide
taatacgactcactatagggtcttcctttttcctctcctcttcttcttgtaacagaggagaacaagaatgagaggagagaacctggcggcagcgcaaaagatg

SEQ ID NO: 105990 - DNA, 103 bp, Artificial Sequence
  Synthetic Polynucleotide
taatacgactcactatagggtgcagtgctctcttcctttttcctctcctcaacagaggagagaggagatgaaaaaggaaaacctggcggcagcgcaaaagatg

SEQ ID NO: 105991 - DNA, 103 bp, Artificial Sequence
  Synthetic Polynucleotide
taatacgactcactatagggtagtcgccagccccacttgcttttgtgcttaacagaggagaaagcacatgagcaagtggaacctggcggcagcgcaaaagatg

SEQ ID NO: 105992 - DNA, 103 bp, Artificial Sequence
  Synthetic Polynucleotide
taatacgactcactatagggtttcactggctgcagtgctctcttccttttaacagaggagaaaaaggatgagagcactgaacctggcggcagcgcaaaagatg

SEQ ID NO: 105993 - DNA, 103 bp, Artificial Sequence
  Synthetic Polynucleotide
taatacgactcactatagggccctcagtggtttcactggctgcagtgctcaacagaggagagagcacatgagccagtgaaacctggcggcagcgcaaaagatg

SEQ ID NO: 105994 - DNA, 103 bp, Artificial Sequence
  Synthetic Polynucleotide
taatacgactcactataggggccctgactgccctcagtggtttcactggcaacagaggagagccagtatgaccactgagaacctggcggcagcgcaaaagatg

SEQ ID NO: 105995 - DNA, 103 bp, Artificial Sequence
  Synthetic Polynucleotide
taatacgactcactatagggtcttgctgtcgccctgactgccctcagtggaacagaggagaccactgatggcagtcaggaacctggcggcagcgcaaaagatg

SEQ ID NO: 105996 - DNA, 103 bp, Artificial Sequence
  Synthetic Polynucleotide
taatacgactcactatagggttcttggcattcttgctgtcgccctgactgaacagaggagacagtcaatgcgacagcaaaacctggcggcagcgcaaaagatg

SEQ ID NO: 105997 - DNA, 103 bp, Artificial Sequence
  Synthetic Polynucleotide
taatacgactcactataggggttgttcttcttcttggcattcttgctgtcaacagaggagagacagcatgaatgccaagaacctggcggcagcgcaaaagatg

SEQ ID NO: 105998 - DNA, 103 bp, Artificial Sequence
  Synthetic Polynucleotide
taatacgactcactatagggtggttttcttgttgttcttcttcttggcataacagaggagaatgccaatgagaagaacaaacctggcggcagcgcaaaagatg

SEQ ID NO: 105999 - DNA, 103 bp, Artificial Sequence
  Synthetic Polynucleotide
taatacgactcactatagggttgttcttgttggttttcttgttgttcttcaacagaggagagaagaaatgcaagaaaacaacctggcggcagcgcaaaagatg

SEQ ID NO: 106000 - DNA, 103 bp, Artificial Sequence
  Synthetic Polynucleotide
taatacgactcactataggggatgctgcttttgttcttgttggttttcttaacagaggagaaagaaaatgaacaagaacaacctggcggcagcgcaaaagatg

SEQ ID NO: 106001 - DNA, 103 bp, Artificial Sequence
  Synthetic Polynucleotide
taatacgactcactatagggtggcgcggctgatgctgcttttgttcttgtaacagaggagaacaagaatgaaagcagcaaacctggcggcagcgcaaaagatg

SEQ ID NO: 106002 - DNA, 103 bp, Artificial Sequence
  Synthetic Polynucleotide
taatacgactcactataggggcagggctgctagtcgccagccccacttgcaacagaggagagcaagtatggctggcgacaacctggcggcagcgcaaaagatg

SEQ ID NO: 106003 - DNA, 103 bp, Artificial Sequence
  Synthetic Polynucleotide
taatacgactcactatagggttcttcttgttggcgcggctgatgctgcttaacagaggagaaagcagatgcagccgcgcaacctggcggcagcgcaaaagatg

SEQ ID NO: 106004 - DNA, 103 bp, Artificial Sequence
  Synthetic Polynucleotide
taatacgactcactatagggcatgctgggcttcttcttgttggcgcggctaacagaggagaagccgcatgaacaagaagaacctggcggcagcgcaaaagatg

SEQ ID NO: 106005 - DNA, 103 bp, Artificial Sequence
  Synthetic Polynucleotide
taatacgactcactatagggacacgttgggcatgctgggcttcttcttgtaacagaggagaacaagaatgagcccagcaaacctggcggcagcgcaaaagatg

SEQ ID NO: 106006 - DNA, 103 bp, Artificial Sequence
  Synthetic Polynucleotide
taatacgactcactatagggaggtcattggacacgttgggcatgctgggcaacagaggagagcccagatggcccaacgtaacctggcggcagcgcaaaagatg

SEQ ID NO: 106007 - DNA, 103 bp, Artificial Sequence
  Synthetic Polynucleotide
taatacgactcactatagggcttctgggacaggtcattggacacgttgggaacagaggagacccaacatgtccaatgacaacctggcggcagcgcaaaagatg

SEQ ID NO: 106008 - DNA, 103 bp, Artificial Sequence
  Synthetic Polynucleotide
taatacgactcactatagggtggcatacagcttctgggacaggtcattggaacagaggagaccaatgatgtgtcccagaaacctggcggcagcgcaaaagatg

SEQ ID NO: 106009 - DNA, 103 bp, Artificial Sequence
  Synthetic Polynucleotide
taatacgactcactatagggttctccatggtggcatacagcttctgggacaacagaggagagtcccaatggctgtatgcaacctggcggcagcgcaaaagatg

SEQ ID NO: 106010 - DNA, 103 bp, Artificial Sequence
  Synthetic Polynucleotide
taatacgactcactatagggctccttgtgcttctccatggtggcatacagaacagaggagactgtatatgaccatggagaacctggcggcagcgcaaaagatg

SEQ ID NO: 106011 - DNA, 103 bp, Artificial Sequence
  Synthetic Polynucleotide
taatacgactcactatagggcgaagaagacctccttgtgcttctccatggaacagaggagaccatggatgagcacaaggaacctggcggcagcgcaaaagatg

SEQ ID NO: 106012 - DNA, 103 bp, Artificial Sequence
  Synthetic Polynucleotide
taatacgactcactatagggaggtggatcacgaagaagacctccttgtgcaacagaggagagcacaaatgggtcttcttaacctggcggcagcgcaaaagatg

SEQ ID NO: 106013 - DNA, 103 bp, Artificial Sequence
  Synthetic Polynucleotide
taatacgactcactatagggctgtgacgtggcagggctgctagtcgccagaacagaggagactggcgatgagcagccctaacctggcggcagcgcaaaagatg

SEQ ID NO: 106014 - DNA, 103 bp, Artificial Sequence
  Synthetic Polynucleotide
taatacgactcactatagggcccagcgtgcaggtggatcacgaagaagacaacagaggagagtcttcatggtgatccacaacctggcggcagcgcaaaagatg

SEQ ID NO: 106015 - DNA, 103 bp, Artificial Sequence
  Synthetic Polynucleotide
taatacgactcactatagggtgatgacaggcccagcgtgcaggtggatcaaacagaggagatgatccatgtgcacgctgaacctggcggcagcgcaaaagatg

SEQ ID NO: 106016 - DNA, 103 bp, Artificial Sequence
  Synthetic Polynucleotide
taatacgactcactatagggggcagggtgttgatgacaggcccagcgtgcaacagaggagagcacgcatggcctgtcataacctggcggcagcgcaaaagatg

SEQ ID NO: 106017 - DNA, 103 bp, Artificial Sequence
  Synthetic Polynucleotide
taatacgactcactataggggacgatggggggcagggtgttgatgacaggaacagaggagacctgtcatgaacaccctgaacctggcggcagcgcaaaagatg

SEQ ID NO: 106018 - DNA, 103 bp, Artificial Sequence
  Synthetic Polynucleotide
taatacgactcactatagggggtcggggtcgacgatggggggcagggtgtaacagaggagaacacccatgcccccatcgaacctggcggcagcgcaaaagatg

SEQ ID NO: 106019 - DNA, 103 bp, Artificial Sequence
  Synthetic Polynucleotide
taatacgactcactatagggctgagcagggggtcggggtcgacgatggggaacagaggagaccccatatgcgaccccgaaacctggcggcagcgcaaaagatg

SEQ ID NO: 106020 - DNA, 103 bp, Artificial Sequence
  Synthetic Polynucleotide
taatacgactcactataggggaggtcacagctgagcagggggtcggggtcaacagaggagagaccccatgcccctgctcaacctggcggcagcgcaaaagatg

SEQ ID NO: 106021 - DNA, 103 bp, Artificial Sequence
  Synthetic Polynucleotide
taatacgactcactataggggcccatccatgaggtcacagctgagcagggaacagaggagaccctgcatggctgtgaccaacctggcggcagcgcaaaagatg

SEQ ID NO: 106022 - DNA, 103 bp, Artificial Sequence
  Synthetic Polynucleotide
taatacgactcactatagggaaggcgtcgcgcccatccatgaggtcacagaacagaggagactgtgaatgcatggatggaacctggcggcagcgcaaaagatg

SEQ ID NO: 106023 - DNA, 103 bp, Artificial Sequence
  Synthetic Polynucleotide
taatacgactcactataggggagggtgaggaaggcgtcgcgcccatccataacagaggagaatggatatgcgcgacgccaacctggcggcagcgcaaaagatg

SEQ ID NO: 106024 - DNA, 103 bp, Artificial Sequence
  Synthetic Polynucleotide
taatacgactcactatagggccgagaaaccgggcgagctgagtttggctcaacagaggagagagccaatgtcagctcgcaacctggcggcagcgcaaaagatg

SEQ ID NO: 106025 - DNA, 103 bp, Artificial Sequence
  Synthetic Polynucleotide
taatacgactcactatagggcaggtccagtctgtgacgtggcagggctgcaacagaggagagcagccatgccacgtcacaacctggcggcagcgcaaaagatg

SEQ ID NO: 106026 - DNA, 103 bp, Artificial Sequence
  Synthetic Polynucleotide
taatacgactcactatagggtgtctctggcgagggtgaggaaggcgtcgcaacagaggagagcgacgatgtcctcacccaacctggcggcagcgcaaaagatg

SEQ ID NO: 106027 - DNA, 103 bp, Artificial Sequence
  Synthetic Polynucleotide
taatacgactcactatagggtcccagtgcttgtctctggcgagggtgaggaacagaggagacctcacatgcgccagagaaacctggcggcagcgcaaaagatg

SEQ ID NO: 106028 - DNA, 103 bp, Artificial Sequence
  Synthetic Polynucleotide
taatacgactcactatagggggaggagaactcccagtgcttgtctctggcaacagaggagagccagaatgaagcactggaacctggcggcagcgcaaaagatg

SEQ ID NO: 106029 - DNA, 103 bp, Artificial Sequence
  Synthetic Polynucleotide
taatacgactcactatagggagcggcgcaaggaggagaactcccagtgctaacagaggagaagcactatgagttctcctaacctggcggcagcgcaaaagatg

SEQ ID NO: 106030 - DNA, 103 bp, Artificial Sequence
  Synthetic Polynucleotide
taatacgactcactataggggaccacttggagcggcgcaaggaggagaacaacagaggagagttctcatgcttgcgccgaacctggcggcagcgcaaaagatg

SEQ ID NO: 106031 - DNA, 103 bp, Artificial Sequence
  Synthetic Polynucleotide
taatacgactcactataggggcagagcgtggaccacttggagcggcgcaaaacagaggagattgcgcatgtccaagtggaacctggcggcagcgcaaaagatg

SEQ ID NO: 106032 - DNA, 103 bp, Artificial Sequence
  Synthetic Polynucleotide
taatacgactcactatagggccaccagcatgcagagcgtggaccacttggaacagaggagaccaagtatgccacgctctaacctggcggcagcgcaaaagatg

SEQ ID NO: 106033 - DNA, 103 bp, Artificial Sequence
  Synthetic Polynucleotide
taatacgactcactataggggtgtgcagctccaccagcatgcagagcgtgaacagaggagacacgctatgcatgctggtaacctggcggcagcgcaaaagatg

SEQ ID NO: 106034 - DNA, 103 bp, Artificial Sequence
  Synthetic Polynucleotide
taatacgactcactatagggctggccctgggtgtgcagctccaccagcataacagaggagaatgctgatggagctgcacaacctggcggcagcgcaaaagatg

SEQ ID NO: 106035 - DNA, 103 bp, Artificial Sequence
  Synthetic Polynucleotide
taatacgactcactatagggcaaagcggtcctggccctgggtgtgcagctaacagaggagaagctgcatgcccagggccaacctggcggcagcgcaaaagatg

SEQ ID NO: 106036 - DNA, 103 bp, Artificial Sequence
  Synthetic Polynucleotide
taatacgactcactatagggatgcagataccaggtccagtctgtgacgtgaacagaggagacacgtcatggactggaccaacctggcggcagcgcaaaagatg

SEQ ID NO: 106037 - DNA, 103 bp, Artificial Sequence
  Synthetic Polynucleotide
taatacgactcactatagggcaggtgtagacaaagcggtcctggccctggaacagaggagaccagggatgggaccgcttaacctggcggcagcgcaaaagatg

SEQ ID NO: 106038 - DNA, 103 bp, Artificial Sequence
  Synthetic Polynucleotide
taatacgactcactataggggcactcgttgcaggtgtagacaaagcggtcaacagaggagagaccgcatggtctacaccaacctggcggcagcgcaaaagatg

SEQ ID NO: 106039 - DNA, 103 bp, Artificial Sequence
  Synthetic Polynucleotide
taatacgactcactatagggcgtggtgcttgcactcgttgcaggtgtagaaacagaggagatctacaatggcaacgagtaacctggcggcagcgcaaaagatg

SEQ ID NO: 106040 - DNA, 103 bp, Artificial Sequence
  Synthetic Polynucleotide
taatacgactcactatagggcgcgtctccacgtggtgcttgcactcgttgaacagaggagacaacgaatgcaagcaccaaacctggcggcagcgcaaaagatg

SEQ ID NO: 106041 - DNA, 103 bp, Artificial Sequence
  Synthetic Polynucleotide
taatacgactcactataggggcagtgccagcgcgtctccacgtggtgcttaacagaggagaaagcacatggtggagacgaacctggcggcagcgcaaaagatg

SEQ ID NO: 106042 - DNA, 103 bp, Artificial Sequence
  Synthetic Polynucleotide
taatacgactcactatagggcgcacacagtgcagtgccagcgcgtctccaaacagaggagatggagaatggctggcactaacctggcggcagcgcaaaagatg

SEQ ID NO: 106043 - DNA, 103 bp, Artificial Sequence
  Synthetic Polynucleotide
taatacgactcactatagggtcgtagtcctcgcacacagtgcagtgccagaacagaggagactggcaatgcactgtgtgaacctggcggcagcgcaaaagatg

SEQ ID NO: 106044 - DNA, 103 bp, Artificial Sequence
  Synthetic Polynucleotide
taatacgactcactataggggatgcagaggtcgtagtcctcgcacacagtaacagaggagaactgtgatggaggactacaacctggcggcagcgcaaaagatg

SEQ ID NO: 106045 - DNA, 103 bp, Artificial Sequence
  Synthetic Polynucleotide
taatacgactcactatagggtatagcagttgatgcagaggtcgtagtcctaacagaggagaaggactatgacctctgcaaacctggcggcagcgcaaaagatg

SEQ ID NO: 106046 - DNA, 103 bp, Artificial Sequence
  Synthetic Polynucleotide
taatacgactcactatagggctcttcgtgttatagcagttgatgcagaggaacagaggagacctctgatgcaactgctaaacctggcggcagcgcaaaagatg

SEQ ID NO: 106047 - DNA, 103 bp, Artificial Sequence
  Synthetic Polynucleotide
taatacgactcactataggggttagcattcatgcagataccaggtccagtaacagaggagaactggaatgggtatctgcaacctggcggcagcgcaaaagatg

SEQ ID NO: 106048 - DNA, 103 bp, Artificial Sequence
  Synthetic Polynucleotide
taatacgactcactatagggatgggcatggctcttcgtgttatagcagttaacagaggagaaactgcatgaacacgaagaacctggcggcagcgcaaaagatg

SEQ ID NO: 106049 - DNA, 103 bp, Artificial Sequence
  Synthetic Polynucleotide
taatacgactcactatagggtcaccatcttatgggcatggctcttcgtgtaacagaggagaacacgaatggccatgcccaacctggcggcagcgcaaaagatg

SEQ ID NO: 106050 - DNA, 103 bp, Artificial Sequence
  Synthetic Polynucleotide
taatacgactcactatagggagcccccacttcaccatcttatgggcatggaacagaggagaccatgcatgtaagatggtaacctggcggcagcgcaaaagatg

SEQ ID NO: 106051 - DNA, 103 bp, Artificial Sequence
  Synthetic Polynucleotide
taatacgactcactatagggatccaggcccagcccccacttcaccatcttaacagaggagaaagatgatgaagtgggggaacctggcggcagcgcaaaagatg

SEQ ID NO: 106052 - DNA, 103 bp, Artificial Sequence
  Synthetic Polynucleotide
taatacgactcactatagggtgccctcgtcatccaggcccagcccccactaacagaggagaagtgggatgtgggcctggaacctggcggcagcgcaaaagatg

SEQ ID NO: 106053 - DNA, 103 bp, Artificial Sequence
  Synthetic Polynucleotide
taatacgactcactatagggccctggctgctgccctcgtcatccaggcccaacagaggagagggcctatgtgacgagggaacctggcggcagcgcaaaagatg

SEQ ID NO: 106054 - DNA, 103 bp, Artificial Sequence
  Synthetic Polynucleotide
taatacgactcactatagggctgtggctcgccctggctgctgccctcgtcaacagaggagagacgagatgagcagccagaacctggcggcagcgcaaaagatg

SEQ ID NO: 106055 - DNA, 103 bp, Artificial Sequence
  Synthetic Polynucleotide
taatacgactcactatagggggctctttgactgtggctcgccctggctgcaacagaggagagcagccatggcgagccacaacctggcggcagcgcaaaagatg

SEQ ID NO: 106056 - DNA, 103 bp, Artificial Sequence
  Synthetic Polynucleotide
taatacgactcactataggggactcctgggggctctttgactgtggctcgaacagaggagacgagccatggtcaaagagaacctggcggcagcgcaaaagatg

SEQ ID NO: 106057 - DNA, 103 bp, Artificial Sequence
  Synthetic Polynucleotide
taatacgactcactatagggcagccggcgtgactcctgggggctctttgaaacagaggagatcaaagatgccccaggagaacctggcggcagcgcaaaagatg

SEQ ID NO: 106058 - DNA, 103 bp, Artificial Sequence
  Synthetic Polynucleotide
taatacgactcactatagggtctggttaaagttagcattcatgcagatacaacagaggagagtatctatgtgaatgctaaacctggcggcagcgcaaaagatg

SEQ ID NO: 106059 - DNA, 103 bp, Artificial Sequence
  Synthetic Polynucleotide
taatacgactcactataggggctggatgctcagccggcgtgactcctgggaacagaggagacccaggatgcacgccggcaacctggcggcagcgcaaaagatg

SEQ ID NO: 106060 - DNA, 103 bp, Artificial Sequence
  Synthetic Polynucleotide
taatacgactcactatagggtggatgcagcgctggatgctcagccggcgtaacagaggagaacgccgatggagcatccaaacctggcggcagcgcaaaagatg

SEQ ID NO: 106061 - DNA, 103 bp, Artificial Sequence
  Synthetic Polynucleotide
taatacgactcactatagggcaccagcgactggatgcagcgctggatgctaacagaggagaagcatcatgcgctgcatcaacctggcggcagcgcaaaagatg

SEQ ID NO: 106062 - DNA, 103 bp, Artificial Sequence
  Synthetic Polynucleotide
taatacgactcactatagggggcacgcgtgcaccagcgactggatgcagcaacagaggagagctgcaatgagtcgctggaacctggcggcagcgcaaaagatg

SEQ ID NO: 106063 - DNA, 103 bp, Artificial Sequence
  Synthetic Polynucleotide
taatacgactcactatagggttgcggcactggcacgcgtgcaccagcgacaacagaggagagtcgctatggcacgcgtgaacctggcggcagcgcaaaagatg

SEQ ID NO: 106064 - DNA, 103 bp, Artificial Sequence
  Synthetic Polynucleotide
taatacgactcactataggggcagttggcgttgcggcactggcacgcgtgaacagaggagacacgcgatgcagtgccgcaacctggcggcagcgcaaaagatg

SEQ ID NO: 106065 - DNA, 103 bp, Artificial Sequence
  Synthetic Polynucleotide
taatacgactcactatagggatggcagcgagcagttggcgttgcggcactaacagaggagaagtgccatgacgccaactaacctggcggcagcgcaaaagatg

SEQ ID NO: 106066 - DNA, 103 bp, Artificial Sequence
  Synthetic Polynucleotide
taatacgactcactatagggttctggcaggatggcagcgagcagttggcgaacagaggagacgccaaatgctcgctgccaacctggcggcagcgcaaaagatg

SEQ ID NO: 106067 - DNA, 103 bp, Artificial Sequence
  Synthetic Polynucleotide
taatacgactcactatagggccgcttcatcttctggcaggatggcagcgaaacagaggagatcgctgatgtcctgccagaacctggcggcagcgcaaaagatg

SEQ ID NO: 106068 - DNA, 103 bp, Artificial Sequence
  Synthetic Polynucleotide
taatacgactcactataggggctgcaccacccgcttcatcttctggcaggaacagaggagacctgccatgagatgaagcaacctggcggcagcgcaaaagatg

SEQ ID NO: 106069 - DNA, 103 bp, Artificial Sequence
  Synthetic Polynucleotide
taatacgactcactatagggcctgggtgggtctggttaaagttagcattcaacagaggagagaatgcatgctttaaccaaacctggcggcagcgcaaaagatg

SEQ ID NO: 106070 - DNA, 103 bp, Artificial Sequence
  Synthetic Polynucleotide
taatacgactcactatagggcccttggtgtgctgcaccacccgcttcatcaacagaggagagatgaaatgggtggtgcaaacctggcggcagcgcaaaagatg

SEQ ID NO: 106071 - DNA, 103 bp, Artificial Sequence
  Synthetic Polynucleotide
taatacgactcactataggggcgtttgcagcccttggtgtgctgcaccacaacagaggagagtggtgatgcacaccaagaacctggcggcagcgcaaaagatg

SEQ ID NO: 106072 - DNA, 103 bp, Artificial Sequence
  Synthetic Polynucleotide
taatacgactcactatagggcgttggtcttgcgtttgcagcccttggtgtaacagaggagaacaccaatggctgcaaacaacctggcggcagcgcaaaagatg

SEQ ID NO: 106073 - DNA, 103 bp, Artificial Sequence
  Synthetic Polynucleotide
taatacgactcactataggggggcagcccccgttggtcttgcgtttgcagaacagaggagactgcaaatgcaagaccaaaacctggcggcagcgcaaaagatg

SEQ ID NO: 106074 - DNA, 103 bp, Artificial Sequence
  Synthetic Polynucleotide
taatacgactcactatagggcttgcacaccgggcagcccccgttggtcttaacagaggagaaagaccatggggggctgcaacctggcggcagcgcaaaagatg

SEQ ID NO: 106075 - DNA, 103 bp, Artificial Sequence
  Synthetic Polynucleotide
taatacgactcactatagggcgatgagctgcttgcacaccgggcagccccaacagaggagaggggctatgcggtgtgcaaacctggcggcagcgcaaaagatg

SEQ ID NO: 106076 - DNA, 103 bp, Artificial Sequence
  Synthetic Polynucleotide
taatacgactcactatagggcagcagagggcgatgagctgcttgcacaccaacagaggagaggtgtgatggcagctcataacctggcggcagcgcaaaagatg

SEQ ID NO: 106077 - DNA, 103 bp, Artificial Sequence
  Synthetic Polynucleotide
taatacgactcactatagggggcgtggtagcagcagagggcgatgagctgaacagaggagacagctcatggccctctgcaacctggcggcagcgcaaaagatg

SEQ ID NO: 106078 - DNA, 103 bp, Artificial Sequence
  Synthetic Polynucleotide
taatacgactcactatagggggcagtgcttggcgtggtagcagcagagggaacagaggagaccctctatggctaccacgaacctggcggcagcgcaaaagatg

SEQ ID NO: 106079 - DNA, 103 bp, Artificial Sequence
  Synthetic Polynucleotide
taatacgactcactatagggttgttttcttggcagtgcttggcgtggtagaacagaggagactaccaatgcaagcactgaacctggcggcagcgcaaaagatg

SEQ ID NO: 106080 - DNA, 103 bp, Artificial Sequence
  Synthetic Polynucleotide
taatacgactcactatagggattgaggaggcctgggtgggtctggttaaaaacagaggagatttaacatgacccacccaaacctggcggcagcgcaaaagatg

SEQ ID NO: 106081 - DNA, 103 bp, Artificial Sequence
  Synthetic Polynucleotide
taatacgactcactatagggcacggggcatttgttttcttggcagtgcttaacagaggagaaagcacatgcaagaaaacaacctggcggcagcgcaaaagatg

SEQ ID NO: 106082 - DNA, 103 bp, Artificial Sequence
  Synthetic Polynucleotide
taatacgactcactatagggggcagaagggcacggggcatttgttttcttaacagaggagaaagaaaatgaatgccccgaacctggcggcagcgcaaaagatg

SEQ ID NO: 106083 - DNA, 103 bp, Artificial Sequence
  Synthetic Polynucleotide
taatacgactcactatagggttgatgttgaggcagaagggcacggggcataacagaggagaatgcccatggcccttctgaacctggcggcagcgcaaaagatg

SEQ ID NO: 106084 - DNA, 103 bp, Artificial Sequence
  Synthetic Polynucleotide
taatacgactcactataggggagcttgtgtttgatgttgaggcagaagggaacagaggagacccttcatgctcaacatcaacctggcggcagcgcaaaagatg

SEQ ID NO: 106085 - DNA, 103 bp, Artificial Sequence
  Synthetic Polynucleotide
taatacgactcactataggggctgctggcggagcttgtgtttgatgttgaaacagaggagatcaacaatgaacacaagcaacctggcggcagcgcaaaagatg

SEQ ID NO: 106086 - DNA, 103 bp, Artificial Sequence
  Synthetic Polynucleotide
taatacgactcactatagggtgctggatctgctgctggcggagcttgtgtaacagaggagaacacaaatgccgccagcaaacctggcggcagcgcaaaagatg

SEQ ID NO: 106087 - DNA, 103 bp, Artificial Sequence
  Synthetic Polynucleotide
taatacgactcactatagggctgcaggcggtgctggatctgctgctggcgaacagaggagacgccagatgcagatccagaacctggcggcagcgcaaaagatg

SEQ ID NO: 106088 - DNA, 103 bp, Artificial Sequence
  Synthetic Polynucleotide
taatacgactcactataggggctgggcctgctgcaggcggtgctggatctaacagaggagaagatccatgaccgcctgcaacctggcggcagcgcaaaagatg

SEQ ID NO: 106089 - DNA, 103 bp, Artificial Sequence
  Synthetic Polynucleotide
taatacgactcactatagggcggcgcatgagctgggcctgctgcaggcggaacagaggagaccgcctatggcaggcccaaacctggcggcagcgcaaaagatg

SEQ ID NO: 106090 - DNA, 103 bp, Artificial Sequence
  Synthetic Polynucleotide
taatacgactcactatagggggccatccgccggcgcatgagctgggcctgaacagaggagacaggccatgctcatgcgcaacctggcggcagcgcaaaagatg

SEQ ID NO: 106091 - DNA, 103 bp, Artificial Sequence
  Synthetic Polynucleotide
taatacgactcactatagggcagagttactattgaggaggcctgggtgggaacagaggagacccaccatggcctcctcaaacctggcggcagcgcaaaagatg

SEQ ID NO: 106092 - DNA, 103 bp, Artificial Sequence
  Synthetic Polynucleotide
taatacgactcactatagggtgttcatggtggccatccgccggcgcatgaaacagaggagatcatgcatgggcggatggaacctggcggcagcgcaaaagatg

SEQ ID NO: 106093 - DNA, 103 bp, Artificial Sequence
  Synthetic Polynucleotide
taatacgactcactatagggacgttgcgggtgttcatggtggccatccgcaacagaggagagcggatatgcaccatgaaaacctggcggcagcgcaaaagatg

SEQ ID NO: 106094 - DNA, 103 bp, Artificial Sequence
  Synthetic Polynucleotide
taatacgactcactatagggctgctgaggcacgttgcgggtgttcatggtaacagaggagaaccatgatgacccgcaacaacctggcggcagcgcaaaagatg

SEQ ID NO: 106095 - DNA, 103 bp, Artificial Sequence
  Synthetic Polynucleotide
taatacgactcactatagggaaggcagactctgctgaggcacgttgcgggaacagaggagacccgcaatgtgcctcagcaacctggcggcagcgcaaaagatg

SEQ ID NO: 106096 - DNA, 103 bp, Artificial Sequence
  Synthetic Polynucleotide
taatacgactcactataggggaggtaggagaaggcagactctgctgaggcaacagaggagagcctcaatggagtctgccaacctggcggcagcgcaaaagatg

SEQ ID NO: 106097 - DNA, 103 bp, Artificial Sequence
  Synthetic Polynucleotide
taatacgactcactataggggggcggtgctgaggtaggagaaggcagactaacagaggagaagtctgatgtctcctaccaacctggcggcagcgcaaaagatg

SEQ ID NO: 106098 - DNA, 103 bp, Artificial Sequence
  Synthetic Polynucleotide
taatacgactcactatagggtgggggtcccgggcggtgctgaggtaggagaacagaggagactcctaatgcagcaccgcaacctggcggcagcgcaaaagatg

SEQ ID NO: 106099 - DNA, 103 bp, Artificial Sequence
  Synthetic Polynucleotide
taatacgactcactatagggggctgctgtgtgggggtcccgggcggtgctaacagaggagaagcaccatgcgggaccccaacctggcggcagcgcaaaagatg

SEQ ID NO: 106100 - DNA, 103 bp, Artificial Sequence
  Synthetic Polynucleotide
taatacgactcactataggggggtgtgctgggctgctgtgtgggggtcccaacagaggagagggaccatgacacagcagaacctggcggcagcgcaaaagatg

SEQ ID NO: 106101 - DNA, 103 bp, Artificial Sequence
  Synthetic Polynucleotide
taatacgactcactataggggcggcgtctggggtgtgctgggctgctgtgaacagaggagacacagcatgccagcacacaacctggcggcagcgcaaaagatg

SEQ ID NO: 106102 - DNA, 103 bp, Artificial Sequence
  Synthetic Polynucleotide
taatacgactcactatagggaagctatggccagagttactattgaggaggaacagaggagacctcctatgtagtaactcaacctggcggcagcgcaaaagatg

SEQ ID NO: 106103 - DNA, 103 bp, Artificial Sequence
  Synthetic Polynucleotide
taatacgactcactataggggcagggggctgcggcgtctggggtgtgctgaacagaggagacagcacatgccagacgccaacctggcggcagcgcaaaagatg

SEQ ID NO: 106104 - DNA, 103 bp, Artificial Sequence
  Synthetic Polynucleotide
taatacgactcactatagggttggggctgggcagggggctgcggcgtctgaacagaggagacagacgatgcagccccctaacctggcggcagcgcaaaagatg

SEQ ID NO: 106105 - DNA, 103 bp, Artificial Sequence
  Synthetic Polynucleotide
taatacgactcactatagggcgggtgagggttggggctgggcagggggctaacagaggagaagccccatgcccagccccaacctggcggcagcgcaaaagatg

SEQ ID NO: 106106 - DNA, 103 bp, Artificial Sequence
  Synthetic Polynucleotide
taatacgactcactataggggacatgctcacgggtgagggttggggctggaacagaggagaccagccatgaccctcaccaacctggcggcagcgcaaaagatg

SEQ ID NO: 106107 - DNA, 103 bp, Artificial Sequence
  Synthetic Polynucleotide
taatacgactcactataggggccagctggtgacatgctcacgggtgagggaacagaggagaccctcaatggtgagcatgaacctggcggcagcgcaaaagatg

SEQ ID NO: 106108 - DNA, 103 bp, Artificial Sequence
  Synthetic Polynucleotide
taatacgactcactatagggcgctggggaagccagctggtgacatgctcaaacagaggagatgagcaatgcaccagctgaacctggcggcagcgcaaaagatg

SEQ ID NO: 106109 - DNA, 103 bp, Artificial Sequence
  Synthetic Polynucleotide
taatacgactcactataggggtccgggccacgctggggaagccagctggtaacagaggagaaccagcatgcttccccagaacctggcggcagcgcaaaagatg

SEQ ID NO: 106110 - DNA, 103 bp, Artificial Sequence
  Synthetic Polynucleotide
taatacgactcactatagggggggggctgagtccgggccacgctggggaaaacagaggagattccccatggtggcccggaacctggcggcagcgcaaaagatg

SEQ ID NO: 106111 - DNA, 103 bp, Artificial Sequence
  Synthetic Polynucleotide
taatacgactcactatagggacaccgtggtggggggctgagtccgggccaaacagaggagatggcccatgctcagccccaacctggcggcagcgcaaaagatg

SEQ ID NO: 106112 - DNA, 103 bp, Artificial Sequence
  Synthetic Polynucleotide
taatacgactcactatagggttccctgtggacaccgtggtggggggctgaaacagaggagatcagccatgcaccacggtaacctggcggcagcgcaaaagatg

SEQ ID NO: 106113 - DNA, 103 bp, Artificial Sequence
  Synthetic Polynucleotide
taatacgactcactatagggctgattaattaagctatggccagagttactaacagaggagaagtaacatgggccatagcaacctggcggcagcgcaaaagatg

SEQ ID NO: 106114 - DNA, 103 bp, Artificial Sequence
  Synthetic Polynucleotide
taatacgactcactataggggctggtaggcttccctgtggacaccgtggtaacagaggagaaccacgatgtccacagggaacctggcggcagcgcaaaagatg

SEQ ID NO: 106115 - DNA, 103 bp, Artificial Sequence
  Synthetic Polynucleotide
taatacgactcactatagggccggcacctggctggtaggcttccctgtggaacagaggagaccacagatgagcctaccaaacctggcggcagcgcaaaagatg

SEQ ID NO: 106116 - DNA, 103 bp, Artificial Sequence
  Synthetic Polynucleotide
taatacgactcactatagggggtgggggggccggcacctggctggtaggcaacagaggagagcctacatgccaggtgccaacctggcggcagcgcaaaagatg

SEQ ID NO: 106117 - DNA, 103 bp, Artificial Sequence
  Synthetic Polynucleotide
taatacgactcactatagggctgggccgggggtgggggggccggcacctgaacagaggagacaggtgatggcccccccaaacctggcggcagcgcaaaagatg

SEQ ID NO: 106118 - DNA, 103 bp, Artificial Sequence
  Synthetic Polynucleotide
taatacgactcactatagggcaggagggggctgggccgggggtgggggggaacagaggagaccccccatgccccggcccaacctggcggcagcgcaaaagatg

SEQ ID NO: 106119 - DNA, 103 bp, Artificial Sequence
  Synthetic Polynucleotide
taatacgactcactatagggtccaccgctgcaggagggggctgggccgggaacagaggagacccggcatggccccctccaacctggcggcagcgcaaaagatg

SEQ ID NO: 106120 - DNA, 103 bp, Artificial Sequence
  Synthetic Polynucleotide
taatacgactcactatagggccgagccgcttccaccgctgcaggagggggaacagaggagaccccctatggcagcggtgaacctggcggcagcgcaaaagatg

SEQ ID NO: 106121 - DNA, 103 bp, Artificial Sequence
  Synthetic Polynucleotide
taatacgactcactataggggctcgatctgccgagccgcttccaccgctgaacagaggagacagcggatgaagcggctcaacctggcggcagcgcaaaagatg

SEQ ID NO: 106122 - DNA, 103 bp, Artificial Sequence
  Synthetic Polynucleotide
taatacgactcactatagggtgggcctcacgctcgatctgccgagccgctaacagaggagaagcggcatggcagatcgaaacctggcggcagcgcaaaagatg

SEQ ID NO: 106123 - DNA, 103 bp, Artificial Sequence
  Synthetic Polynucleotide
taatacgactcactatagggctgctgctgctgggcctcacgctcgatctgaacagaggagacagatcatgcgtgaggccaacctggcggcagcgcaaaagatg

SEQ ID NO: 106124 - DNA, 103 bp, Artificial Sequence
  Synthetic Polynucleotide
taatacgactcactatagggcttgtgaagcctgattaattaagctatggcaacagaggagagccataatgtaattaatcaacctggcggcagcgcaaaagatg

SEQ ID NO: 106125 - DNA, 103 bp, Artificial Sequence
  Synthetic Polynucleotide
taatacgactcactatagggggtacaggtgctgctgctgctgggcctcacaacagaggagagtgaggatgagcagcagcaacctggcggcagcgcaaaagatg

SEQ ID NO: 106126 - DNA, 103 bp, Artificial Sequence
  Synthetic Polynucleotide
taatacgactcactatagggatgttcacccggtacaggtgctgctgctgcaacagaggagagcagcaatggcacctgtaaacctggcggcagcgcaaaagatg

SEQ ID NO: 106127 - DNA, 103 bp, Artificial Sequence
  Synthetic Polynucleotide
taatacgactcactataggggctgttgttgatgttcacccggtacaggtgaacagaggagacacctgatgcgggtgaacaacctggcggcagcgcaaaagatg

SEQ ID NO: 106128 - DNA, 103 bp, Artificial Sequence
  Synthetic Polynucleotide
taatacgactcactatagggctgggggcatgctgttgttgatgttcacccaacagaggagagggtgaatgtcaacaacaaacctggcggcagcgcaaaagatg

SEQ ID NO: 106129 - DNA, 103 bp, Artificial Sequence
  Synthetic Polynucleotide
taatacgactcactatagggcccgtgcgtcctgggggcatgctgttgttgaacagaggagacaacaaatgcatgcccccaacctggcggcagcgcaaaagatg

SEQ ID NO: 106130 - DNA, 103 bp, Artificial Sequence
  Synthetic Polynucleotide
taatacgactcactatagggggtccccatgcccgtgcgtcctgggggcataacagaggagaatgcccatgggacgcacgaacctggcggcagcgcaaaagatg

SEQ ID NO: 106131 - DNA, 103 bp, Artificial Sequence
  Synthetic Polynucleotide
taatacgactcactatagggggctccccggggtccccatgcccgtgcgtcaacagaggagagacgcaatggcatggggaaacctggcggcagcgcaaaagatg

SEQ ID NO: 106132 - DNA, 103 bp, Artificial Sequence
  Synthetic Polynucleotide
taatacgactcactatagggggggccatctggctccccggggtccccatgaacagaggagacatgggatgcccggggagaacctggcggcagcgcaaaagatg

SEQ ID NO: 106133 - DNA, 103 bp, Artificial Sequence
  Synthetic Polynucleotide
taatacgactcactatagggcaggctcacgggggccatctggctccccggaacagaggagaccggggatgcagatggccaacctggcggcagcgcaaaagatg

SEQ ID NO: 106134 - DNA, 103 bp, Artificial Sequence
  Synthetic Polynucleotide
taatacgactcactatagggggggcacattcaggctcacgggggccatctaacagaggagaagatggatgccgtgagccaacctggcggcagcgcaaaagatg

SEQ ID NO: 106135 - DNA, 103 bp, Artificial Sequence
  Synthetic Polynucleotide
taatacgactcactatagggctgtcattcgccgagaaaccgggcgagctgaacagaggagacagctcatgcggtttctcaacctggcggcagcgcaaaagatg

SEQ ID NO: 106136 - DNA, 103 bp, Artificial Sequence
  Synthetic Polynucleotide
taatacgactcactatagggtgcgcctgcccttgtgaagcctgattaattaacagaggagaaattaaatgggcttcacaaacctggcggcagcgcaaaagatg

SEQ ID NO: 106137 - DNA, 103 bp, Artificial Sequence
  Synthetic Polynucleotide
taatacgactcactatagggtggttgggtcggggcacattcaggctcacgaacagaggagacgtgagatggaatgtgccaacctggcggcagcgcaaaagatg

SEQ ID NO: 106138 - DNA, 103 bp, Artificial Sequence
  Synthetic Polynucleotide
taatacgactcactatagggcccgctcacctggttgggtcggggcacattaacagaggagaaatgtgatgcgacccaacaacctggcggcagcgcaaaagatg

SEQ ID NO: 106139 - DNA, 103 bp, Artificial Sequence
  Synthetic Polynucleotide
taatacgactcactataggggcatgacgggcccgctcacctggttgggtcaacagaggagagacccaatgaggtgagcgaacctggcggcagcgcaaaagatg

SEQ ID NO: 106140 - DNA, 103 bp, Artificial Sequence
  Synthetic Polynucleotide
taatacgactcactatagggggcatgctgggcatgacgggcccgctcaccaacagaggagaggtgagatggcccgtcataacctggcggcagcgcaaaagatg

SEQ ID NO: 106141 - DNA, 103 bp, Artificial Sequence
  Synthetic Polynucleotide
taatacgactcactatagggctgcccgggaggcatgctgggcatgacgggaacagaggagacccgtcatgcccagcatgaacctggcggcagcgcaaaagatg

SEQ ID NO: 106142 - DNA, 103 bp, Artificial Sequence
  Synthetic Polynucleotide
taatacgactcactatagggcctgctgccactgcccgggaggcatgctggaacagaggagaccagcaatgctcccgggcaacctggcggcagcgcaaaagatg

SEQ ID NO: 106143 - DNA, 103 bp, Artificial Sequence
  Synthetic Polynucleotide
taatacgactcactatagggggaaggggcgcctgctgccactgcccgggaaacagaggagatcccggatggtggcagcaaacctggcggcagcgcaaaagatg

SEQ ID NO: 106144 - DNA, 103 bp, Artificial Sequence
  Synthetic Polynucleotide
taatacgactcactatagggctgctgctggggaaggggcgcctgctgccaaacagaggagatggcagatggcgccccttaacctggcggcagcgcaaaagatg

SEQ ID NO: 106145 - DNA, 103 bp, Artificial Sequence
  Synthetic Polynucleotide
taatacgactcactatagggctggcatgggctgctgctggggaaggggcgaacagaggagacgccccatgcccagcagcaacctggcggcagcgcaaaagatg

SEQ ID NO: 106146 - DNA, 103 bp, Artificial Sequence
  Synthetic Polynucleotide
taatacgactcactatagggctgggcaagcctggcatgggctgctgctggaacagaggagaccagcaatggcccatgccaacctggcggcagcgcaaaagatg

SEQ ID NO: 106147 - DNA, 103 bp, Artificial Sequence
  Synthetic Polynucleotide
taatacgactcactatagggattcatgacttgcgcctgcccttgtgaagcaacagaggagagcttcaatggggcaggcgaacctggcggcagcgcaaaagatg

SEQ ID NO: 106148 - DNA, 103 bp, Artificial Sequence
  Synthetic Polynucleotide
taatacgactcactatagggtatcacaggcctgggcaagcctggcatgggaacagaggagacccatgatgggcttgcccaacctggcggcagcgcaaaagatg

SEQ ID NO: 106149 - DNA, 103 bp, Artificial Sequence
  Synthetic Polynucleotide
taatacgactcactatagggcctgcatggatatcacaggcctgggcaagcaacagaggagagcttgcatgggcctgtgaaacctggcggcagcgcaaaagatg

SEQ ID NO: 106150 - DNA, 103 bp, Artificial Sequence
  Synthetic Polynucleotide
taatacgactcactataggggccgcctgggcctgcatggatatcacaggcaacagaggagagcctgtatgatccatgcaaacctggcggcagcgcaaaagatg

SEQ ID NO: 106151 - DNA, 103 bp, Artificial Sequence
  Synthetic Polynucleotide
taatacgactcactatagggcccagccacggccgcctgggcctgcatggaaacagaggagatccatgatggcccaggcgaacctggcggcagcgcaaaagatg

SEQ ID NO: 106152 - DNA, 103 bp, Artificial Sequence
  Synthetic Polynucleotide
taatacgactcactataggggcatccggggcccagccacggccgcctgggaacagaggagacccaggatgccgtggctgaacctggcggcagcgcaaaagatg

SEQ ID NO: 106153 - DNA, 103 bp, Artificial Sequence
  Synthetic Polynucleotide
taatacgactcactatagggtgcacgctgggcatccggggcccagccacgaacagaggagacgtggcatggccccggataacctggcggcagcgcaaaagatg

SEQ ID NO: 106154 - DNA, 103 bp, Artificial Sequence
  Synthetic Polynucleotide
taatacgactcactatagggcctgggtggctgcacgctgggcatccggggaacagaggagaccccggatgcccagcgtgaacctggcggcagcgcaaaagatg

SEQ ID NO: 106155 - DNA, 103 bp, Artificial Sequence
  Synthetic Polynucleotide
taatacgactcactataggggtgagatgctcctgggtggctgcacgctggaacagaggagaccagcgatgagccacccaaacctggcggcagcgcaaaagatg

SEQ ID NO: 106156 - DNA, 103 bp, Artificial Sequence
  Synthetic Polynucleotide
taatacgactcactatagggagagcgctgggtgagatgctcctgggtggcaacagaggagagccaccatggagcatctcaacctggcggcagcgcaaaagatg

SEQ ID NO: 106157 - DNA, 103 bp, Artificial Sequence
  Synthetic Polynucleotide
taatacgactcactatagggcaggtcttgcagagcgctgggtgagatgctaacagaggagaagcatcatgcccagcgctaacctggcggcagcgcaaaagatg

SEQ ID NO: 106158 - DNA, 103 bp, Artificial Sequence
  Synthetic Polynucleotide
taatacgactcactatagggcaagagatccattcatgacttgcgcctgccaacagaggagaggcaggatgaagtcatgaaacctggcggcagcgcaaaagatg

SEQ ID NO: 106159 - DNA, 103 bp, Artificial Sequence
  Synthetic Polynucleotide
taatacgactcactataggggggtccgcagcaggtcttgcagagcgctggaacagaggagaccagcgatgtgcaagaccaacctggcggcagcgcaaaagatg

SEQ ID NO: 106160 - DNA, 103 bp, Artificial Sequence
  Synthetic Polynucleotide
taatacgactcactatagggggcgacttcagggtccgcagcaggtcttgcaacagaggagagcaagaatggctgcggacaacctggcggcagcgcaaaagatg

SEQ ID NO: 106161 - DNA, 103 bp, Artificial Sequence
  Synthetic Polynucleotide
taatacgactcactatagggaggggagctgggcgacttcagggtccgcagaacagaggagactgcggatgctgaagtcgaacctggcggcagcgcaaaagatg

SEQ ID NO: 106162 - DNA, 103 bp, Artificial Sequence
  Synthetic Polynucleotide
taatacgactcactataggggttgctgctgaggggagctgggcgacttcaaacagaggagatgaagtatgccagctcccaacctggcggcagcgcaaaagatg

SEQ ID NO: 106163 - DNA, 103 bp, Artificial Sequence
  Synthetic Polynucleotide
taatacgactcactatagggagcacctgctgttgctgctgaggggagctgaacagaggagacagctcatgtcagcagcaaacctggcggcagcgcaaaagatg

SEQ ID NO: 106164 - DNA, 103 bp, Artificial Sequence
  Synthetic Polynucleotide
taatacgactcactataggggagaatgttcagcacctgctgttgctgctgaacagaggagacagcagatgcagcaggtgaacctggcggcagcgcaaaagatg

SEQ ID NO: 106165 - DNA, 103 bp, Artificial Sequence
  Synthetic Polynucleotide
taatacgactcactatagggggtttgatttgagaatgttcagcacctgctaacagaggagaagcaggatgtgaacattcaacctggcggcagcgcaaaagatg

SEQ ID NO: 106166 - DNA, 103 bp, Artificial Sequence
  Synthetic Polynucleotide
taatacgactcactatagggattagctgcgggtttgatttgagaatgttcaacagaggagagaacatatgcaaatcaaaaacctggcggcagcgcaaaagatg

SEQ ID NO: 106167 - DNA, 103 bp, Artificial Sequence
  Synthetic Polynucleotide
taatacgactcactataggggaaagctgccattagctgcgggtttgatttaacagaggagaaaatcaatgccgcagctaaacctggcggcagcgcaaaagatg

SEQ ID NO: 106168 - DNA, 103 bp, Artificial Sequence
  Synthetic Polynucleotide
taatacgactcactataggggctgtttgatgaaagctgccattagctgcgaacagaggagacgcagcatgtggcagcttaacctggcggcagcgcaaaagatg

SEQ ID NO: 106169 - DNA, 103 bp, Artificial Sequence
  Synthetic Polynucleotide
taatacgactcactatagggccagcagccccaagagatccattcatgactaacagaggagaagtcatatgtggatctctaacctggcggcagcgcaaaagatg

SEQ ID NO: 106170 - DNA, 103 bp, Artificial Sequence
  Synthetic Polynucleotide
taatacgactcactatagggttggctgtgcgctgtttgatgaaagctgccaacagaggagaggcagcatgcatcaaacaaacctggcggcagcgcaaaagatg

SEQ ID NO: 106171 - DNA, 103 bp, Artificial Sequence
  Synthetic Polynucleotide
taatacgactcactatagggggccacgtacttggctgtgcgctgtttgataacagaggagaatcaaaatgcgcacagccaacctggcggcagcgcaaaagatg

SEQ ID NO: 106172 - DNA, 103 bp, Artificial Sequence
  Synthetic Polynucleotide
taatacgactcactatagggcgggctgattggccacgtacttggctgtgcaacagaggagagcacagatgagtacgtggaacctggcggcagcgcaaaagatg

SEQ ID NO: 106173 - DNA, 103 bp, Artificial Sequence
  Synthetic Polynucleotide
taatacgactcactatagggggctgcatgccgggctgattggccacgtacaacagaggagagtacgtatgcaatcagccaacctggcggcagcgcaaaagatg

SEQ ID NO: 106174 - DNA, 103 bp, Artificial Sequence
  Synthetic Polynucleotide
taatacgactcactataggggccaggctggggctgcatgccgggctgattaacagaggagaaatcagatgggcatgcagaacctggcggcagcgcaaaagatg

SEQ ID NO: 106175 - DNA, 103 bp, Artificial Sequence
  Synthetic Polynucleotide
taatacgactcactataggggggactggaggccaggctggggctgcatgcaacagaggagagcatgcatgcccagcctgaacctggcggcagcgcaaaagatg

SEQ ID NO: 106176 - DNA, 103 bp, Artificial Sequence
  Synthetic Polynucleotide
taatacgactcactatagggatgccgggctgggactggaggccaggctggaacagaggagaccagccatgcctccagtcaacctggcggcagcgcaaaagatg

SEQ ID NO: 106177 - DNA, 103 bp, Artificial Sequence
  Synthetic Polynucleotide
taatacgactcactatagggctggggttgcatgccgggctgggactggagaacagaggagactccagatgcagcccggcaacctggcggcagcgcaaaagatg

SEQ ID NO: 106178 - DNA, 103 bp, Artificial Sequence
  Synthetic Polynucleotide
taatacgactcactataggggcatgccaggctggggttgcatgccgggctaacagaggagaagcccgatgtgcaaccccaacctggcggcagcgcaaaagatg

SEQ ID NO: 106179 - DNA, 103 bp, Artificial Sequence
  Synthetic Polynucleotide
taatacgactcactatagggggctgctggtgcatgccaggctggggttgcaacagaggagagcaaccatggcctggcataacctggcggcagcgcaaaagatg

SEQ ID NO: 106180 - DNA, 103 bp, Artificial Sequence
  Synthetic Polynucleotide
taatacgactcactatagggccttcctctgccagcagccccaagagatccaacagaggagaggatctatgggggctgctaacctggcggcagcgcaaaagatg

SEQ ID NO: 106181 - DNA, 103 bp, Artificial Sequence
  Synthetic Polynucleotide
taatacgactcactatagggctgcaggctgggctgctggtgcatgccaggaacagaggagacctggcatgcaccagcagaacctggcggcagcgcaaaagatg

SEQ ID NO: 106182 - DNA, 103 bp, Artificial Sequence
  Synthetic Polynucleotide
taatacgactcactatagggcattcaggttctgcaggctgggctgctggtaacagaggagaaccagcatgccagcctgcaacctggcggcagcgcaaaagatg

SEQ ID NO: 106183 - DNA, 103 bp, Artificial Sequence
  Synthetic Polynucleotide
taatacgactcactataggggcctgcatggcattcaggttctgcaggctgaacagaggagacagcctatggaacctgaaaacctggcggcagcgcaaaagatg

SEQ ID NO: 106184 - DNA, 103 bp, Artificial Sequence
  Synthetic Polynucleotide
taatacgactcactatagggcggcacgccagcctgcatggcattcaggttaacagaggagaaacctgatggccatgcagaacctggcggcagcgcaaaagatg

SEQ ID NO: 106185 - DNA, 103 bp, Artificial Sequence
  Synthetic Polynucleotide
taatacgactcactatagggcaccgggccgcggcacgccagcctgcatggaacagaggagaccatgcatgctggcgtgcaacctggcggcagcgcaaaagatg

SEQ ID NO: 106186 - DNA, 103 bp, Artificial Sequence
  Synthetic Polynucleotide
taatacgactcactatagggtgtggaggcacaccgggccgcggcacgccaaacagaggagatggcgtatggcggcccggaacctggcggcagcgcaaaagatg

SEQ ID NO: 106187 - DNA, 103 bp, Artificial Sequence
  Synthetic Polynucleotide
taatacgactcactatagggcgcctgctgctgtggaggcacaccgggccgaacagaggagacggcccatggtgcctccaaacctggcggcagcgcaaaagatg

SEQ ID NO: 106188 - DNA, 103 bp, Artificial Sequence
  Synthetic Polynucleotide
taatacgactcactatagggggcctcccatcgcctgctgctgtggaggcaaacagaggagatgcctcatgagcagcaggaacctggcggcagcgcaaaagatg

SEQ ID NO: 106189 - DNA, 103 bp, Artificial Sequence
  Synthetic Polynucleotide
taatacgactcactatagggtgggggttcaggcctcccatcgcctgctgcaacagaggagagcagcaatggatgggaggaacctggcggcagcgcaaaagatg

SEQ ID NO: 106190 - DNA, 103 bp, Artificial Sequence
  Synthetic Polynucleotide
taatacgactcactatagggggcctggccctgggggttcaggcctcccataacagaggagaatgggaatgctgaaccccaacctggcggcagcgcaaaagatg

SEQ ID NO: 106191 - DNA, 103 bp, Artificial Sequence
  Synthetic Polynucleotide
taatacgactcactatagggttccagctccccttcctctgccagcagcccaacagaggagagggctgatggcagaggaaaacctggcggcagcgcaaaagatg

SEQ ID NO: 106192 - DNA, 103 bp, Artificial Sequence
  Synthetic Polynucleotide
taatacgactcactatagggtgatgttcaaggcctggccctgggggttcaaacagaggagatgaaccatgagggccaggaacctggcggcagcgcaaaagatg

SEQ ID NO: 106193 - DNA, 103 bp, Artificial Sequence
  Synthetic Polynucleotide
taatacgactcactatagggcctgggttcatgatgttcaaggcctggcccaacagaggagagggccaatgcttgaacataacctggcggcagcgcaaaagatg

SEQ ID NO: 106194 - DNA, 103 bp, Artificial Sequence
  Synthetic Polynucleotide
taatacgactcactatagggggggttgtgtcctgggttcatgatgttcaaaacagaggagattgaacatgatgaacccaaacctggcggcagcgcaaaagatg

SEQ ID NO: 106195 - DNA, 103 bp, Artificial Sequence
  Synthetic Polynucleotide
taatacgactcactatagggtcgccatgttggggttgtgtcctgggttcaaacagaggagatgaaccatggacacaaccaacctggcggcagcgcaaaagatg

SEQ ID NO: 106196 - DNA, 103 bp, Artificial Sequence
  Synthetic Polynucleotide
taatacgactcactatagggggattcatactcgccatgttggggttgtgtaacagaggagaacacaaatgcaacatggcaacctggcggcagcgcaaaagatg

SEQ ID NO: 106197 - DNA, 103 bp, Artificial Sequence
  Synthetic Polynucleotide
taatacgactcactatagggtcggtactgtggattcatactcgccatgttaacagaggagaaacatgatgagtatgaataacctggcggcagcgcaaaagatg

SEQ ID NO: 106198 - DNA, 103 bp, Artificial Sequence
  Synthetic Polynucleotide
taatacgactcactataggggtaacatttctcggtactgtggattcatacaacagaggagagtatgaatgcacagtaccaacctggcggcagcgcaaaagatg

SEQ ID NO: 106199 - DNA, 103 bp, Artificial Sequence
  Synthetic Polynucleotide
taatacgactcactatagggagctgcctccgtaacatttctcggtactgtaacagaggagaacagtaatgagaaatgttaacctggcggcagcgcaaaagatg

SEQ ID NO: 106200 - DNA, 103 bp, Artificial Sequence
  Synthetic Polynucleotide
taatacgactcactatagggctgctgcagcagctgcctccgtaacatttcaacagaggagagaaatgatgcggaggcagaacctggcggcagcgcaaaagatg

SEQ ID NO: 106201 - DNA, 103 bp, Artificial Sequence
  Synthetic Polynucleotide
taatacgactcactataggggttgctgctgctgctgcagcagctgcctccaacagaggagaggaggcatgtgctgcagcaacctggcggcagcgcaaaagatg

SEQ ID NO: 106202 - DNA, 103 bp, Artificial Sequence
  Synthetic Polynucleotide
taatacgactcactataggggggtacggcattccagctccccttcctctgaacagaggagacagaggatggggagctggaacctggcggcagcgcaaaagatg

SEQ ID NO: 106203 - DNA, 103 bp, Artificial Sequence
  Synthetic Polynucleotide
taatacgactcactatagggtgctgctgctgttgctgctgctgctgcagcaacagaggagagctgcaatggcagcagcaaacctggcggcagcgcaaaagatg

SEQ ID NO: 106204 - DNA, 103 bp, Artificial Sequence
  Synthetic Polynucleotide
taatacgactcactatagggctgctgttgttgctgctgctgttgctgctgaacagaggagacagcagatgcagcagcagaacctggcggcagcgcaaaagatg

SEQ ID NO: 106205 - DNA, 103 bp, Artificial Sequence
  Synthetic Polynucleotide
taatacgactcactataggggctgctgttgctgctgttgttgctgctgctaacagaggagaagcagcatgaacaacagcaacctggcggcagcgcaaaagatg

SEQ ID NO: 106206 - DNA, 103 bp, Artificial Sequence
  Synthetic Polynucleotide
taatacgactcactatagggccttgctgctgctgctgttgctgctgttgtaacagaggagaacaacaatggcaacagcaaacctggcggcagcgcaaaagatg

SEQ ID NO: 106207 - DNA, 103 bp, Artificial Sequence
  Synthetic Polynucleotide
taatacgactcactataggggccggcactcccttgctgctgctgctgttgaacagaggagacaacagatgcagcagcaaaacctggcggcagcgcaaaagatg

SEQ ID NO: 106208 - DNA, 103 bp, Artificial Sequence
  Synthetic Polynucleotide
taatacgactcactatagggccccagccatgccggcactcccttgctgctaacagaggagaagcagcatgggagtgccgaacctggcggcagcgcaaaagatg

SEQ ID NO: 106209 - DNA, 103 bp, Artificial Sequence
  Synthetic Polynucleotide
taatacgactcactatagggcccgccatgcccccagccatgccggcactcaacagaggagagagtgcatgcatggctggaacctggcggcagcgcaaaagatg

SEQ ID NO: 106210 - DNA, 103 bp, Artificial Sequence
  Synthetic Polynucleotide
taatacgactcactatagggctggccgtgccccgccatgcccccagccataacagaggagaatggctatgggcatggcgaacctggcggcagcgcaaaagatg

SEQ ID NO: 106211 - DNA, 103 bp, Artificial Sequence
  Synthetic Polynucleotide
taatacgactcactataggggctgctggaactggccgtgccccgccatgcaacagaggagagcatggatgggcacggccaacctggcggcagcgcaaaagatg

SEQ ID NO: 106212 - DNA, 103 bp, Artificial Sequence
  Synthetic Polynucleotide
taatacgactcactatagggggtccttgaggctgctggaactggccgtgcaacagaggagagcacggatggttccagcaaacctggcggcagcgcaaaagatg

SEQ ID NO: 106213 - DNA, 103 bp, Artificial Sequence
  Synthetic Polynucleotide
taatacgactcactatagggggctggagtagggtacggcattccagctccaacagaggagaggagctatgatgccgtacaacctggcggcagcgcaaaagatg

SEQ ID NO: 106214 - DNA, 103 bp, Artificial Sequence
  Synthetic Polynucleotide
taatacgactcactataggggtagcctccgggtccttgaggctgctggaaaacagaggagattccagatgcctcaaggaaacctggcggcagcgcaaaagatg

SEQ ID NO: 106215 - DNA, 103 bp, Artificial Sequence
  Synthetic Polynucleotide
taatacgactcactatagggtggccggtgggtagcctccgggtccttgagaacagaggagactcaagatgccggaggctaacctggcggcagcgcaaaagatg

SEQ ID NO: 106216 - DNA, 103 bp, Artificial Sequence
  Synthetic Polynucleotide
taatacgactcactatagggtgctgctgcatggccggtgggtagcctccgaacagaggagacggaggatgcccaccggcaacctggcggcagcgcaaaagatg

SEQ ID NO: 106217 - DNA, 103 bp, Artificial Sequence
  Synthetic Polynucleotide
taatacgactcactatagggcatgcgctgctgctgctgcatggccggtggaacagaggagaccaccgatgatgcagcagaacctggcggcagcgcaaaagatg

SEQ ID NO: 106218 - DNA, 103 bp, Artificial Sequence
  Synthetic Polynucleotide
taatacgactcactataggggatgctgctgcatgcgctgctgctgctgcaaacagaggagatgcagcatgagcagcgcaaacctggcggcagcgcaaaagatg

SEQ ID NO: 106219 - DNA, 103 bp, Artificial Sequence
  Synthetic Polynucleotide
taatacgactcactatagggtggagggggagatgctgctgcatgcgctgcaacagaggagagcagcgatggcagcagcaaacctggcggcagcgcaaaagatg

SEQ ID NO: 106220 - DNA, 103 bp, Artificial Sequence
  Synthetic Polynucleotide
taatacgactcactatagggggagctgccctggagggggagatgctgctgaacagaggagacagcagatgctccccctcaacctggcggcagcgcaaaagatg

SEQ ID NO: 106221 - DNA, 103 bp, Artificial Sequence
  Synthetic Polynucleotide
taatacgactcactatagggtctggcccatggagctgccctggagggggaaacagaggagatcccccatgagggcagctaacctggcggcagcgcaaaagatg

SEQ ID NO: 106222 - DNA, 103 bp, Artificial Sequence
  Synthetic Polynucleotide
taatacgactcactatagggtgagccgccatctggcccatggagctgcccaacagaggagagggcagatgcatgggccaaacctggcggcagcgcaaaagatg

SEQ ID NO: 106223 - DNA, 103 bp, Artificial Sequence
  Synthetic Polynucleotide
taatacgactcactatagggctgtcccatctgagccgccatctggcccataacagaggagaatgggcatgatggcggctaacctggcggcagcgcaaaagatg

SEQ ID NO: 106224 - DNA, 103 bp, Artificial Sequence
  Synthetic Polynucleotide
taatacgactcactatagggcgccctgcatggctggagtagggtacggcaaacagaggagatgccgtatgctactccagaacctggcggcagcgcaaaagatg

SEQ ID NO: 106225 - DNA, 103 bp, Artificial Sequence
  Synthetic Polynucleotide
taatacgactcactatagggtctggccaagctgtcccatctgagccgccaaacagaggagatggcggatgagatgggacaacctggcggcagcgcaaaagatg

SEQ ID NO: 106226 - DNA, 103 bp, Artificial Sequence
  Synthetic Polynucleotide
taatacgactcactatagggggctgccccatctggccaagctgtcccatcaacagaggagagatgggatggcttggccaaacctggcggcagcgcaaaagatg

SEQ ID NO: 106227 - DNA, 103 bp, Artificial Sequence
  Synthetic Polynucleotide
taatacgactcactatagggccccagccccggctgccccatctggccaagaacagaggagacttggcatgatggggcagaacctggcggcagcgcaaaagatg

SEQ ID NO: 106228 - DNA, 103 bp, Artificial Sequence
  Synthetic Polynucleotide
taatacgactcactatagggtgctgtctgcccccagccccggctgccccaaacagaggagatggggcatgcggggctggaacctggcggcagcgcaaaagatg

SEQ ID NO: 106229 - DNA, 103 bp, Artificial Sequence
  Synthetic Polynucleotide
taatacgactcactatagggatgttgggggtgctgtctgcccccagccccaacagaggagaggggctatgggcagacagaacctggcggcagcgcaaaagatg

SEQ ID NO: 106230 - DNA, 103 bp, Artificial Sequence
  Synthetic Polynucleotide
taatacgactcactatagggggcttgctggatgttgggggtgctgtctgcaacagaggagagcagacatgacccccaacaacctggcggcagcgcaaaagatg

SEQ ID NO: 106231 - DNA, 103 bp, Artificial Sequence
  Synthetic Polynucleotide
taatacgactcactataggggctgctgcagggcttgctggatgttgggggaacagaggagacccccaatgtccagcaagaacctggcggcagcgcaaaagatg

SEQ ID NO: 106232 - DNA, 103 bp, Artificial Sequence
  Synthetic Polynucleotide
taatacgactcactatagggtgcagaatccgctgctgcagggcttgctggaacagaggagaccagcaatgcctgcagcaaacctggcggcagcgcaaaagatg

SEQ ID NO: 106233 - DNA, 103 bp, Artificial Sequence
  Synthetic Polynucleotide
taatacgactcactatagggctgctgttgctgcagaatccgctgctgcagaacagaggagactgcagatgcggattctgaacctggcggcagcgcaaaagatg

SEQ ID NO: 106234 - DNA, 103 bp, Artificial Sequence
  Synthetic Polynucleotide
taatacgactcactataggggctgcttcatctgctgttgctgcagaatccaacagaggagaggattcatgagcaacagcaacctggcggcagcgcaaaagatg

SEQ ID NO: 106235 - DNA, 103 bp, Artificial Sequence
  Synthetic Polynucleotide
taatacgactcactatagggctgctcgaggcgccctgcatggctggagtaaacagaggagatactccatgcatgcagggaacctggcggcagcgcaaaagatg

SEQ ID NO: 106236 - DNA, 103 bp, Artificial Sequence
  Synthetic Polynucleotide
taatacgactcactataggggacccaatctgctgcttcatctgctgttgcaacagaggagagcaacaatggatgaagcaaacctggcggcagcgcaaaagatg

SEQ ID NO: 106237 - DNA, 103 bp, Artificial Sequence
  Synthetic Polynucleotide
taatacgactcactatagggctggcctggggacccaatctgctgcttcataacagaggagaatgaagatgcagattgggaacctggcggcagcgcaaaagatg

SEQ ID NO: 106238 - DNA, 103 bp, Artificial Sequence
  Synthetic Polynucleotide
taatacgactcactatagggtggggttcggctggcctggggacccaatctaacagaggagaagattgatgccccaggccaacctggcggcagcgcaaaagatg

SEQ ID NO: 106239 - DNA, 103 bp, Artificial Sequence
  Synthetic Polynucleotide
taatacgactcactatagggtgggggctcatggggttcggctggcctgggaacagaggagacccaggatggccgaacccaacctggcggcagcgcaaaagatg

SEQ ID NO: 106240 - DNA, 103 bp, Artificial Sequence
  Synthetic Polynucleotide
taatacgactcactatagggcatgtgttgctgggggctcatggggttcggaacagaggagaccgaacatgatgagccccaacctggcggcagcgcaaaagatg

SEQ ID NO: 106241 - DNA, 103 bp, Artificial Sequence
  Synthetic Polynucleotide
taatacgactcactataggggtcctgagagcatgtgttgctgggggctcaaacagaggagatgagccatgagcaacacaaacctggcggcagcgcaaaagatg

SEQ ID NO: 106242 - DNA, 103 bp, Artificial Sequence
  Synthetic Polynucleotide
taatacgactcactataggggcctgtggctgtcctgagagcatgtgttgcaacagaggagagcaacaatggctctcaggaacctggcggcagcgcaaaagatg

SEQ ID NO: 106243 - DNA, 103 bp, Artificial Sequence
  Synthetic Polynucleotide
taatacgactcactataggggagatgcgaggcctgtggctgtcctgagagaacagaggagactctcaatgcagccacagaacctggcggcagcgcaaaagatg

SEQ ID NO: 106244 - DNA, 103 bp, Artificial Sequence
  Synthetic Polynucleotide
taatacgactcactataggggctggccagggagatgcgaggcctgtggctaacagaggagaagccacatgcctcgcatcaacctggcggcagcgcaaaagatg

SEQ ID NO: 106245 - DNA, 103 bp, Artificial Sequence
  Synthetic Polynucleotide
taatacgactcactataggggtggcgatctgctggccagggagatgcgagaacagaggagactcgcaatgccctggccaaacctggcggcagcgcaaaagatg

SEQ ID NO: 106246 - DNA, 103 bp, Artificial Sequence
  Synthetic Polynucleotide
taatacgactcactatagggaaaatctgtgctgtcattcgccgagaaaccaacagaggagaggtttcatggcgaatgacaacctggcggcagcgcaaaagatg

SEQ ID NO: 106247 - DNA, 103 bp, Artificial Sequence
  Synthetic Polynucleotide
taatacgactcactatagggagccagcacgctgctcgaggcgccctgcataacagaggagaatgcagatggcctcgagcaacctggcggcagcgcaaaagatg

SEQ ID NO: 106248 - DNA, 103 bp, Artificial Sequence
  Synthetic Polynucleotide
taatacgactcactatagggactaagggacgtggcgatctgctggccaggaacagaggagacctggcatgcagatcgccaacctggcggcagcgcaaaagatg

SEQ ID NO: 106249 - DNA, 103 bp, Artificial Sequence
  Synthetic Polynucleotide
taatacgactcactataggggcacctggttactaagggacgtggcgatctaacagaggagaagatcgatgcgtcccttaaacctggcggcagcgcaaaagatg

SEQ ID NO: 106250 - DNA, 103 bp, Artificial Sequence
  Synthetic Polynucleotide
taatacgactcactataggggctggagaccgcacctggttactaagggacaacagaggagagtccctatgtaaccaggtaacctggcggcagcgcaaaagatg

SEQ ID NO: 106251 - DNA, 103 bp, Artificial Sequence
  Synthetic Polynucleotide
taatacgactcactatagggctggacaggggctggagaccgcacctggttaacagaggagaaaccagatgcggtctccaaacctggcggcagcgcaaaagatg

SEQ ID NO: 106252 - DNA, 103 bp, Artificial Sequence
  Synthetic Polynucleotide
taatacgactcactataggggccgtggagactggacaggggctggagaccaacagaggagaggtctcatgcccctgtccaacctggcggcagcgcaaaagatg

SEQ ID NO: 106253 - DNA, 103 bp, Artificial Sequence
  Synthetic Polynucleotide
taatacgactcactatagggtgggactggggccgtggagactggacagggaacagaggagaccctgtatggtctccacgaacctggcggcagcgcaaaagatg

SEQ ID NO: 106254 - DNA, 103 bp, Artificial Sequence
  Synthetic Polynucleotide
taatacgactcactatagggatgtggaggctgggactggggccgtggagaaacagaggagatctccaatgccccagtccaacctggcggcagcgcaaaagatg

SEQ ID NO: 106255 - DNA, 103 bp, Artificial Sequence
  Synthetic Polynucleotide
taatacgactcactatagggacgggctggaatgtggaggctgggactgggaacagaggagacccagtatgagcctccacaacctggcggcagcgcaaaagatg

SEQ ID NO: 106256 - DNA, 103 bp, Artificial Sequence
  Synthetic Polynucleotide
taatacgactcactatagggatccgtggtgacgggctggaatgtggaggcaacagaggagagcctccatgttccagcccaacctggcggcagcgcaaaagatg

SEQ ID NO: 106257 - DNA, 103 bp, Artificial Sequence
  Synthetic Polynucleotide
taatacgactcactatagggctggggctgtatccgtggtgacgggctggaaacagaggagatccagcatgtcaccacggaacctggcggcagcgcaaaagatg

SEQ ID NO: 106258 - DNA, 103 bp, Artificial Sequence
  Synthetic Polynucleotide
taatacgactcactatagggttagggtctcagccagcacgctgctcgaggaacagaggagacctcgaatggcgtgctggaacctggcggcagcgcaaaagatg

SEQ ID NO: 106259 - DNA, 103 bp, Artificial Sequence
  Synthetic Polynucleotide
taatacgactcactataggggtggcgaaggctggggctgtatccgtggtgaacagaggagacaccacatgtacagccccaacctggcggcagcgcaaaagatg

SEQ ID NO: 106260 - DNA, 103 bp, Artificial Sequence
  Synthetic Polynucleotide
taatacgactcactataggggagacgtggtgtggcgaaggctggggctgtaacagaggagaacagccatggccttcgccaacctggcggcagcgcaaaagatg

SEQ ID NO: 106261 - DNA, 103 bp, Artificial Sequence
  Synthetic Polynucleotide
taatacgactcactatagggagtctggggtgagacgtggtgtggcgaaggaacagaggagaccttcgatgcaccacgtcaacctggcggcagcgcaaaagatg

SEQ ID NO: 106262 - DNA, 103 bp, Artificial Sequence
  Synthetic Polynucleotide
taatacgactcactatagggggggggaaccagtctggggtgagacgtggtaacagaggagaaccacgatgcaccccagaaacctggcggcagcgcaaaagatg

SEQ ID NO: 106263 - DNA, 103 bp, Artificial Sequence
  Synthetic Polynucleotide
taatacgactcactatagggagtccggggtggggggaaccagtctggggtaacagaggagaaccccaatgtggttccccaacctggcggcagcgcaaaagatg

SEQ ID NO: 106264 - DNA, 103 bp, Artificial Sequence
  Synthetic Polynucleotide
taatacgactcactatagggggtgactgcgagtccggggtggggggaaccaacagaggagaggttccatgcaccccggaaacctggcggcagcgcaaaagatg

SEQ ID NO: 106265 - DNA, 103 bp, Artificial Sequence
  Synthetic Polynucleotide
taatacgactcactatagggagctggccatggtgactgcgagtccggggtaacagaggagaaccccgatgtcgcagtcaaacctggcggcagcgcaaaagatg

SEQ ID NO: 106266 - DNA, 103 bp, Artificial Sequence
  Synthetic Polynucleotide
taatacgactcactatagggtgatctatggagctggccatggtgactgcgaacagaggagacgcagtatgcatggccagaacctggcggcagcgcaaaagatg

SEQ ID NO: 106267 - DNA, 103 bp, Artificial Sequence
  Synthetic Polynucleotide
taatacgactcactatagggcaagtgtccctgatctatggagctggccataacagaggagaatggccatgtccatagataacctggcggcagcgcaaaagatg

SEQ ID NO: 106268 - DNA, 103 bp, Artificial Sequence
  Synthetic Polynucleotide
taatacgactcactatagggcggggttccccaagtgtccctgatctatggaacagaggagaccatagatgagggacactaacctggcggcagcgcaaaagatg

SEQ ID NO: 106269 - DNA, 103 bp, Artificial Sequence
  Synthetic Polynucleotide
taatacgactcactataggggaaacctgcgttagggtctcagccagcacgaacagaggagacgtgctatgtgagaccctaacctggcggcagcgcaaaagatg

SEQ ID NO: 106270 - DNA, 103 bp, Artificial Sequence
  Synthetic Polynucleotide
taatacgactcactataggggcactctgttcggggttccccaagtgtcccaacagaggagagggacaatgggggaacccaacctggcggcagcgcaaaagatg

SEQ ID NO: 106271 - DNA, 103 bp, Artificial Sequence
  Synthetic Polynucleotide
taatacgactcactatagggggggagcattgcactctgttcggggttcccaacagaggagagggaacatggaacagagtaacctggcggcagcgcaaaagatg

SEQ ID NO: 106272 - DNA, 103 bp, Artificial Sequence
  Synthetic Polynucleotide
taatacgactcactatagggtgttcagctgggggagcattgcactctgttaacagaggagaaacagaatgcaatgctccaacctggcggcagcgcaaaagatg

SEQ ID NO: 106273 - DNA, 103 bp, Artificial Sequence
  Synthetic Polynucleotide
taatacgactcactatagggctgctgggggtgttcagctgggggagcattaacagaggagaaatgctatgccagctgaaaacctggcggcagcgcaaaagatg

SEQ ID NO: 106274 - DNA, 103 bp, Artificial Sequence
  Synthetic Polynucleotide
taatacgactcactatagggcagcgcactcctgctgggggtgttcagctgaacagaggagacagctgatgacccccagcaacctggcggcagcgcaaaagatg

SEQ ID NO: 106275 - DNA, 103 bp, Artificial Sequence
  Synthetic Polynucleotide
taatacgactcactataggggttcgctggacagcgcactcctgctgggggaacagaggagacccccaatgggagtgcgcaacctggcggcagcgcaaaagatg

SEQ ID NO: 106276 - DNA, 103 bp, Artificial Sequence
  Synthetic Polynucleotide
taatacgactcactatagggaccagggacagttcgctggacagcgcactcaacagaggagagagtgcatggtccagcgaaacctggcggcagcgcaaaagatg

SEQ ID NO: 106277 - DNA, 103 bp, Artificial Sequence
  Synthetic Polynucleotide
taatacgactcactatagggggtgtccccgaccagggacagttcgctggaaacagaggagatccagcatgctgtccctgaacctggcggcagcgcaaaagatg

SEQ ID NO: 106278 - DNA, 103 bp, Artificial Sequence
  Synthetic Polynucleotide
taatacgactcactatagggtgtcccccgtggtgtccccgaccagggacaaacagaggagatgtcccatgtcggggacaaacctggcggcagcgcaaaagatg

SEQ ID NO: 106279 - DNA, 103 bp, Artificial Sequence
  Synthetic Polynucleotide
taatacgactcactatagggttctctagcgtgtcccccgtggtgtccccgaacagaggagacggggaatgcacgggggaaacctggcggcagcgcaaaagatg

SEQ ID NO: 106280 - DNA, 103 bp, Artificial Sequence
  Synthetic Polynucleotide
taatacgactcactatagggcatttgcggggaaacctgcgttagggtctcaacagaggagagagaccatgacgcaggttaacctggcggcagcgcaaaagatg

SEQ ID NO: 106281 - DNA, 103 bp, Artificial Sequence
  Synthetic Polynucleotide
taatacgactcactatagggctccacaaacttctctagcgtgtcccccgtaacagaggagaacggggatgacgctagagaacctggcggcagcgcaaaagatg

SEQ ID NO: 106282 - DNA, 103 bp, Artificial Sequence
  Synthetic Polynucleotide
taatacgactcactatagggcgtgaccagtcatttgcggggaaacctgcgaacagaggagacgcaggatgccccgcaaaaacctggcggcagcgcaaaagatg

SEQ ID NO: 106283 - DNA, 103 bp, Artificial Sequence
  Synthetic Polynucleotide
taatacgactcactatagggttcagtcccgcgtgaccagtcatttgcgggaacagaggagacccgcaatggactggtcaaacctggcggcagcgcaaaagatg

SEQ ID NO: 106284 - DNA, 103 bp, Artificial Sequence
  Synthetic Polynucleotide
taatacgactcactatagggctgtgcggtgttcagtcccgcgtgaccagtaacagaggagaactggtatggcgggactgaacctggcggcagcgcaaaagatg

SEQ ID NO: 106285 - DNA, 103 bp, Artificial Sequence
  Synthetic Polynucleotide
taatacgactcactatagggtgcctcctgcctgtgcggtgttcagtcccgaacagaggagacgggacatgacaccgcacaacctggcggcagcgcaaaagatg

SEQ ID NO: 106286 - DNA, 103 bp, Artificial Sequence
  Synthetic Polynucleotide
taatacgactcactatagggatcttggccatgcctcctgcctgtgcggtgaacagaggagacaccgcatgggcaggaggaacctggcggcagcgcaaaagatg

SEQ ID NO: 106287 - DNA, 103 bp, Artificial Sequence
  Synthetic Polynucleotide
taatacgactcactatagggagttattcccatcttggccatgcctcctgcaacagaggagagcaggaatgatggccaagaacctggcggcagcgcaaaagatg

SEQ ID NO: 106288 - DNA, 103 bp, Artificial Sequence
  Synthetic Polynucleotide
taatacgactcactatagggacaatgatccaaaatctgtgctgtcattcgaacagaggagacgaatgatggcacagattaacctggcggcagcgcaaaagatg

SEQ ID NO: 106289 - DNA, 103 bp, Artificial Sequence
  Synthetic Polynucleotide
taatacgactcactatagggttgtgttcccagttattcccatcttggccaaacagaggagatggccaatgtgggaataaaacctggcggcagcgcaaaagatg

SEQ ID NO: 106290 - DNA, 103 bp, Artificial Sequence
  Synthetic Polynucleotide
taatacgactcactatagggccaaatggacttgtgttcccagttattcccaacagaggagagggaatatgtgggaacacaacctggcggcagcgcaaaagatg

SEQ ID NO: 106291 - DNA, 103 bp, Artificial Sequence
  Synthetic Polynucleotide
taatacgactcactatagggaaagggctgtccaaatggacttgtgttcccaacagaggagagggaacatgagtccatttaacctggcggcagcgcaaaagatg

SEQ ID NO: 106292 - DNA, 103 bp, Artificial Sequence
  Synthetic Polynucleotide
taatacgactcactatagggcagcttgactaaagggctgtccaaatggacaacagaggagagtccatatggacagccctaacctggcggcagcgcaaaagatg

SEQ ID NO: 106293 - DNA, 103 bp, Artificial Sequence
  Synthetic Polynucleotide
taatacgactcactatagggggctgccctccagcttgactaaagggctgtaacagaggagaacagccatgtagtcaagcaacctggcggcagcgcaaaagatg

SEQ ID NO: 106294 - DNA, 103 bp, Artificial Sequence
  Synthetic Polynucleotide
taatacgactcactatagggggctcccattggctgccctccagcttgactaacagaggagaagtcaaatgggagggcagaacctggcggcagcgcaaaagatg

SEQ ID NO: 106295 - DNA, 103 bp, Artificial Sequence
  Synthetic Polynucleotide
taatacgactcactatagggtcactccagtggctcccattggctgccctcaacagaggagagagggcatgcaatgggagaacctggcggcagcgcaaaagatg

SEQ ID NO: 106296 - DNA, 103 bp, Artificial Sequence
  Synthetic Polynucleotide
taatacgactcactatagggaactgggggttcactccagtggctcccattaacagaggagaaatgggatgcactggagtaacctggcggcagcgcaaaagatg

SEQ ID NO: 106297 - DNA, 103 bp, Artificial Sequence
  Synthetic Polynucleotide
taatacgactcactatagggtttgctggctaactgggggttcactccagtaacagaggagaactggaatgaacccccagaacctggcggcagcgcaaaagatg

SEQ ID NO: 106298 - DNA, 103 bp, Artificial Sequence
  Synthetic Polynucleotide
taatacgactcactatagggccatgctctgtttgctggctaactgggggtaacagaggagaacccccatgtagccagcaaacctggcggcagcgcaaaagatg

SEQ ID NO: 106299 - DNA, 103 bp, Artificial Sequence
  Synthetic Polynucleotide
taatacgactcactatagggtccaagtcaaacaatgatccaaaatctgtgaacagaggagacacagaatgtggatcattaacctggcggcagcgcaaaagatg

SEQ ID NO: 106300 - DNA, 103 bp, Artificial Sequence
  Synthetic Polynucleotide
taatacgactcactatagggaaactgttgaccatgctctgtttgctggctaacagaggagaagccagatgacagagcataacctggcggcagcgcaaaagatg

SEQ ID NO: 106301 - DNA, 103 bp, Artificial Sequence
  Synthetic Polynucleotide
taatacgactcactataggggaaggtgggcaaactgttgaccatgctctgaacagaggagacagagcatggtcaacagtaacctggcggcagcgcaaaagatg

SEQ ID NO: 106302 - DNA, 103 bp, Artificial Sequence
  Synthetic Polynucleotide
taatacgactcactatagggtatctgtagggaaggtgggcaaactgttgaaacagaggagatcaacaatgtgcccacctaacctggcggcagcgcaaaagatg

SEQ ID NO: 106303 - DNA, 103 bp, Artificial Sequence
  Synthetic Polynucleotide
taatacgactcactataggggtattcttgatatctgtagggaaggtgggcaacagaggagagcccacatgccctacagaaacctggcggcagcgcaaaagatg

SEQ ID NO: 106304 - DNA, 103 bp, Artificial Sequence
  Synthetic Polynucleotide
taatacgactcactatagggggtgactgaagtattcttgatatctgtaggaacagaggagacctacaatgatcaagaataacctggcggcagcgcaaaagatg

SEQ ID NO: 106305 - DNA, 103 bp, Artificial Sequence
  Synthetic Polynucleotide
taatacgactcactatagggttggcacgttggtgactgaagtattcttgaaacagaggagatcaagaatgcttcagtcaaacctggcggcagcgcaaaagatg

SEQ ID NO: 106306 - DNA, 103 bp, Artificial Sequence
  Synthetic Polynucleotide
taatacgactcactatagggtgagacatatttggcacgttggtgactgaaaacagaggagattcagtatgcaacgtgccaacctggcggcagcgcaaaagatg

SEQ ID NO: 106307 - DNA, 103 bp, Artificial Sequence
  Synthetic Polynucleotide
taatacgactcactatagggtgtttgcatctgagacatatttggcacgttaacagaggagaaacgtgatgaatatgtctaacctggcggcagcgcaaaagatg

SEQ ID NO: 106308 - DNA, 103 bp, Artificial Sequence
  Synthetic Polynucleotide
taatacgactcactatagggttcccactgatgtttgcatctgagacatataacagaggagaatatgtatgagatgcaaaaacctggcggcagcgcaaaagatg

SEQ ID NO: 106309 - DNA, 103 bp, Artificial Sequence
  Synthetic Polynucleotide
taatacgactcactataggggtgggtacaattcccactgatgtttgcatcaacagaggagagatgcaatgatcagtgggaacctggcggcagcgcaaaagatg

SEQ ID NO: 106310 - DNA, 103 bp, Artificial Sequence
  Synthetic Polynucleotide
taatacgactcactatagggatccattccgcttacactaggctgaggcataacagaggagaatgcctatgcctagtgtaaacctggcggcagcgcaaaagatg

SEQ ID NO: 106311 - DNA, 103 bp, Artificial Sequence
  Synthetic Polynucleotide
taatacgactcactatagggatctggatccgaactgtttgctaagagatcaacagaggagagatctcatggcaaacagtaacctggcggcagcgcaaaagatg

SEQ ID NO: 106312 - DNA, 103 bp, Artificial Sequence
  Synthetic Polynucleotide
taatacgactcactatagggaaaaagagaataattgtgctcttcttttttaacagaggagaaaaaaaatggagcacaataacctggcggcagcgcaaaagatg

SEQ ID NO: 106313 - DNA, 103 bp, Artificial Sequence
  Synthetic Polynucleotide
taatacgactcactatagggtgtcggagacaaaaagagaataattgtgctaacagaggagaagcacaatgattctctttaacctggcggcagcgcaaaagatg

SEQ ID NO: 106314 - DNA, 103 bp, Artificial Sequence
  Synthetic Polynucleotide
taatacgactcactatagggtcacccaagttgtcggagacaaaaagagaaaacagaggagattctctatgtgtctccgaaacctggcggcagcgcaaaagatg

SEQ ID NO: 106315 - DNA, 103 bp, Artificial Sequence
  Synthetic Polynucleotide
taatacgactcactatagggagttggctgttcacccaagttgtcggagacaacagaggagagtctccatgaacttgggtaacctggcggcagcgcaaaagatg

SEQ ID NO: 106316 - DNA, 103 bp, Artificial Sequence
  Synthetic Polynucleotide
taatacgactcactataggggactgcatttagttggctgttcacccaagtaacagaggagaacttggatgaacagccaaaacctggcggcagcgcaaaagatg

SEQ ID NO: 106317 - DNA, 103 bp, Artificial Sequence
  Synthetic Polynucleotide
taatacgactcactatagggtcttcttcaggactgcatttagttggctgtaacagaggagaacagccatgtaaatgcagaacctggcggcagcgcaaaagatg

SEQ ID NO: 106318 - DNA, 103 bp, Artificial Sequence
  Synthetic Polynucleotide
taatacgactcactataggggtcctcctcatcttcttcaggactgcatttaacagaggagaaaatgcatgcctgaagaaaacctggcggcagcgcaaaagatg

SEQ ID NO: 106319 - DNA, 103 bp, Artificial Sequence
  Synthetic Polynucleotide
taatacgactcactatagggcatcctcctcgtcctcctcatcttcttcagaacagaggagactgaagatgatgaggaggaacctggcggcagcgcaaaagatg

SEQ ID NO: 106320 - DNA, 103 bp, Artificial Sequence
  Synthetic Polynucleotide
taatacgactcactatagggtcatcatcaacatcctcctcgtcctcctcaaacagaggagatgaggaatgcgaggaggaaacctggcggcagcgcaaaagatg

SEQ ID NO: 106321 - DNA, 103 bp, Artificial Sequence
  Synthetic Polynucleotide
taatacgactcactatagggatcatggtcctcatcatcaacatcctcctcaacagaggagagaggagatggttgatgataacctggcggcagcgcaaaagatg

SEQ ID NO: 106322 - DNA, 103 bp, Artificial Sequence
  Synthetic Polynucleotide
taatacgactcactatagggcatacatgaaatctggatccgaactgtttgaacagaggagacaaacaatgcggatccagaacctggcggcagcgcaaaagatg

SEQ ID NO: 106323 - DNA, 103 bp, Artificial Sequence
  Synthetic Polynucleotide
taatacgactcactatagggcgaatccttcatcatggtcctcatcatcaaaacagaggagattgatgatgaggaccatgaacctggcggcagcgcaaaagatg

SEQ ID NO: 106324 - DNA, 103 bp, Artificial Sequence
  Synthetic Polynucleotide
taatacgactcactatagggtgctcactgccgaatccttcatcatggtccaacagaggagaggaccaatgtgaaggattaacctggcggcagcgcaaaagatg

SEQ ID NO: 106325 - DNA, 103 bp, Artificial Sequence
  Synthetic Polynucleotide
taatacgactcactatagggagacagttcatgctcactgccgaatccttcaacagaggagagaaggaatgggcagtgagaacctggcggcagcgcaaaagatg

SEQ ID NO: 106326 - DNA, 103 bp, Artificial Sequence
  Synthetic Polynucleotide
taatacgactcactatagggcctcattttcagacagttcatgctcactgcaacagaggagagcagtgatgatgaactgtaacctggcggcagcgcaaaagatg

SEQ ID NO: 106327 - DNA, 103 bp, Artificial Sequence
  Synthetic Polynucleotide
taatacgactcactatagggtcttcctcctcctcattttcagacagttcaaacagaggagatgaactatgtgaaaatgaaacctggcggcagcgcaaaagatg

SEQ ID NO: 106328 - DNA, 103 bp, Artificial Sequence
  Synthetic Polynucleotide
taatacgactcactatagggctcttcctcttcttcctcctcctcattttcaacagaggagagaaaatatggaggaggaaaacctggcggcagcgcaaaagatg

SEQ ID NO: 106329 - DNA, 103 bp, Artificial Sequence
  Synthetic Polynucleotide
taatacgactcactatagggcttcataatcctcttcctcttcttcctcctaacagaggagaaggaggatgaagaggaagaacctggcggcagcgcaaaagatg

SEQ ID NO: 106330 - DNA, 103 bp, Artificial Sequence
  Synthetic Polynucleotide
taatacgactcactatagggtccttgtcatcttcataatcctcttcctctaacagaggagaagaggaatgggattatgaaacctggcggcagcgcaaaagatg

SEQ ID NO: 106331 - DNA, 103 bp, Artificial Sequence
  Synthetic Polynucleotide
taatacgactcactatagggaatatcatcatccttgtcatcttcataatcaacagaggagagattatatggatgacaagaacctggcggcagcgcaaaagatg

SEQ ID NO: 106332 - DNA, 103 bp, Artificial Sequence
  Synthetic Polynucleotide
taatacgactcactatagggaagtatcactaatatcatcatccttgtcataacagaggagaatgacaatgatgatgataaacctggcggcagcgcaaaagatg

SEQ ID NO: 106333 - DNA, 103 bp, Artificial Sequence
  Synthetic Polynucleotide
taatacgactcactatagggctatccagttcatacatgaaatctggatccaacagaggagaggatccatgtttcatgtaaacctggcggcagcgcaaaagatg

SEQ ID NO: 106334 - DNA, 103 bp, Artificial Sequence
  Synthetic Polynucleotide
taatacgactcactatagggggttcagagaaagtatcactaatatcatcaaacagaggagatgatgaatgtagtgatacaacctggcggcagcgcaaaagatg

SEQ ID NO: 106335 - DNA, 103 bp, Artificial Sequence
  Synthetic Polynucleotide
taatacgactcactatagggttcatagcctggttcagagaaagtatcactaacagaggagaagtgatatgttctctgaaaacctggcggcagcgcaaaagatg

SEQ ID NO: 106336 - DNA, 103 bp, Artificial Sequence
  Synthetic Polynucleotide
taatacgactcactatagggcagaatcattttcatagcctggttcagagaaacagaggagatctctgatgcaggctatgaacctggcggcagcgcaaaagatg

SEQ ID NO: 106337 - DNA, 103 bp, Artificial Sequence
  Synthetic Polynucleotide
taatacgactcactatagggaggtcttctacagaatcattttcatagcctaacagaggagaaggctaatgaaatgattcaacctggcggcagcgcaaaagatg

SEQ ID NO: 106338 - DNA, 103 bp, Artificial Sequence
  Synthetic Polynucleotide
taatacgactcactatagggcacctccttcaggtcttctacagaatcattaacagaggagaaatgatatggtagaagacaacctggcggcagcgcaaaagatg

SEQ ID NO: 106339 - DNA, 103 bp, Artificial Sequence
  Synthetic Polynucleotide
taatacgactcactatagggatattgaagtcacctccttcaggtcttctaaacagaggagatagaagatgtgaaggaggaacctggcggcagcgcaaaagatg

SEQ ID NO: 106340 - DNA, 103 bp, Artificial Sequence
  Synthetic Polynucleotide
taatacgactcactatagggttccgtgaagatattgaagtcacctccttcaacagaggagagaaggaatggacttcaataacctggcggcagcgcaaaagatg

SEQ ID NO: 106341 - DNA, 103 bp, Artificial Sequence
  Synthetic Polynucleotide
taatacgactcactatagggtttacctctcttccgtgaagatattgaagtaacagaggagaacttcaatgtcttcacggaacctggcggcagcgcaaaagatg

SEQ ID NO: 106342 - DNA, 103 bp, Artificial Sequence
  Synthetic Polynucleotide
taatacgactcactatagggagtatcttcttttacctctcttccgtgaagaacagaggagacttcacatgagagaggtaaacctggcggcagcgcaaaagatg

SEQ ID NO: 106343 - DNA, 103 bp, Artificial Sequence
  Synthetic Polynucleotide
taatacgactcactatagggtactcccagaagtatcttcttttacctctcaacagaggagagagaggatgaagaagataaacctggcggcagcgcaaaagatg

SEQ ID NO: 106344 - DNA, 103 bp, Artificial Sequence
  Synthetic Polynucleotide
taatacgactcactataggggttcatctctctatccagttcatacatgaaaacagaggagattcatgatggaactggataacctggcggcagcgcaaaagatg

SEQ ID NO: 106345 - DNA, 103 bp, Artificial Sequence
  Synthetic Polynucleotide
taatacgactcactatagggttgttcactatactcccagaagtatcttctaacagaggagaagaagaatgttctgggagaacctggcggcagcgcaaaagatg

SEQ ID NO: 106346 - DNA, 103 bp, Artificial Sequence
  Synthetic Polynucleotide
taatacgactcactatagggatggtgtaagttgttcactatactcccagaaacagaggagatctgggatgatagtgaacaacctggcggcagcgcaaaagatg

SEQ ID NO: 106347 - DNA, 103 bp, Artificial Sequence
  Synthetic Polynucleotide
taatacgactcactatagggtcttgctgtgatggtgtaagttgttcactaaacagaggagatagtgaatgacttacaccaacctggcggcagcgcaaaagatg

SEQ ID NO: 106348 - DNA, 103 bp, Artificial Sequence
  Synthetic Polynucleotide
taatacgactcactatagggcagcatcctctcttgctgtgatggtgtaagaacagaggagacttacaatgtcacagcaaaacctggcggcagcgcaaaagatg

SEQ ID NO: 106349 - DNA, 103 bp, Artificial Sequence
  Synthetic Polynucleotide
taatacgactcactatagggcagatggtctcagcatcctctcttgctgtgaacagaggagacacagcatgagaggatgcaacctggcggcagcgcaaaagatg

SEQ ID NO: 106350 - DNA, 103 bp, Artificial Sequence
  Synthetic Polynucleotide
taatacgactcactatagggcggttccactcagatggtctcagcatcctcaacagaggagagaggatatggagaccatcaacctggcggcagcgcaaaagatg

SEQ ID NO: 106351 - DNA, 103 bp, Artificial Sequence
  Synthetic Polynucleotide
taatacgactcactatagggcaaagtatctcggttccactcagatggtctaacagaggagaagaccaatggagtggaacaacctggcggcagcgcaaaagatg

SEQ ID NO: 106352 - DNA, 103 bp, Artificial Sequence
  Synthetic Polynucleotide
taatacgactcactatagggtattacttggcaaagtatctcggttccactaacagaggagaagtggaatggagatacttaacctggcggcagcgcaaaagatg

SEQ ID NO: 106353 - DNA, 103 bp, Artificial Sequence
  Synthetic Polynucleotide
taatacgactcactatagggttctgatacatattacttggcaaagtatctaacagaggagaagatacatggccaagtaaaacctggcggcagcgcaaaagatg

SEQ ID NO: 106354 - DNA, 103 bp, Artificial Sequence
  Synthetic Polynucleotide
taatacgactcactatagggtaagccatttttctgatacatattacttggaacagaggagaccaagtatgatgtatcagaacctggcggcagcgcaaaagatg

SEQ ID NO: 106355 - DNA, 103 bp, Artificial Sequence
  Synthetic Polynucleotide
taatacgactcactatagggtctgttggtagttcatctctctatccagttaacagaggagaaactggatggagagatgaaacctggcggcagcgcaaaagatg

SEQ ID NO: 106356 - DNA, 103 bp, Artificial Sequence
  Synthetic Polynucleotide
taatacgactcactatagggttccatgatgtaagccatttttctgatacaaacagaggagatgtatcatgaaaatggctaacctggcggcagcgcaaaagatg

SEQ ID NO: 106357 - DNA, 103 bp, Artificial Sequence
  Synthetic Polynucleotide
taatacgactcactatagggactgcatattttccatgatgtaagccatttaacagaggagaaaatggatgacatcatggaacctggcggcagcgcaaaagatg

SEQ ID NO: 106358 - DNA, 103 bp, Artificial Sequence
  Synthetic Polynucleotide
taatacgactcactatagggtgacttctttactgcatattttccatgatgaacagaggagacatcatatgaaatatgcaaacctggcggcagcgcaaaagatg

SEQ ID NO: 106359 - DNA, 103 bp, Artificial Sequence
  Synthetic Polynucleotide
taatacgactcactatagggcagttctccgtgacttctttactgcatattaacagaggagaaatatgatgtaaagaagtaacctggcggcagcgcaaaagatg

SEQ ID NO: 106360 - DNA, 103 bp, Artificial Sequence
  Synthetic Polynucleotide
taatacgactcactatagggtcttctacatcagttctccgtgacttctttaacagaggagaaaagaaatgacggagaacaacctggcggcagcgcaaaagatg

SEQ ID NO: 106361 - DNA, 103 bp, Artificial Sequence
  Synthetic Polynucleotide
taatacgactcactatagggtggagtcaggtcttctacatcagttctccgaacagaggagacggagaatggatgtagaaaacctggcggcagcgcaaaagatg

SEQ ID NO: 106362 - DNA, 103 bp, Artificial Sequence
  Synthetic Polynucleotide
taatacgactcactatagggttttaggatttggagtcaggtcttctacataacagaggagaatgtagatgacctgactcaacctggcggcagcgcaaaagatg

SEQ ID NO: 106363 - DNA, 103 bp, Artificial Sequence
  Synthetic Polynucleotide
taatacgactcactatagggtggaggagttttttaggatttggagtcaggaacagaggagacctgacatgaaatcctaaaacctggcggcagcgcaaaagatg

SEQ ID NO: 106364 - DNA, 103 bp, Artificial Sequence
  Synthetic Polynucleotide
taatacgactcactatagggattgcctatctggaggagttttttaggattaacagaggagaaatcctatgaaactcctcaacctggcggcagcgcaaaagatg

SEQ ID NO: 106365 - DNA, 103 bp, Artificial Sequence
  Synthetic Polynucleotide
taatacgactcactatagggtccgaagttcattgcctatctggaggagttaacagaggagaaactccatgagataggcaaacctggcggcagcgcaaaagatg

SEQ ID NO: 106366 - DNA, 103 bp, Artificial Sequence
  Synthetic Polynucleotide
taatacgactcactatagggtctctaggattctgttggtagttcatctctaacagaggagaagagatatgctaccaacaaacctggcggcagcgcaaaagatg

SEQ ID NO: 106367 - DNA, 103 bp, Artificial Sequence
  Synthetic Polynucleotide
taatacgactcactatagggttattcagtttccgaagttcattgcctatcaacagaggagagataggatgtgaacttcgaacctggcggcagcgcaaaagatg

SEQ ID NO: 106368 - DNA, 103 bp, Artificial Sequence
  Synthetic Polynucleotide
taatacgactcactatagggactaatcaccttattcagtttccgaagttcaacagaggagagaacttatgaaactgaataacctggcggcagcgcaaaagatg

SEQ ID NO: 106369 - DNA, 103 bp, Artificial Sequence
  Synthetic Polynucleotide
taatacgactcactataggggagtcaggtcactaatcaccttattcagttaacagaggagaaactgaatgaggtgattaaacctggcggcagcgcaaaagatg

SEQ ID NO: 106370 - DNA, 103 bp, Artificial Sequence
  Synthetic Polynucleotide
taatacgactcactatagggtcactgactggagtcaggtcactaatcaccaacagaggagaggtgatatgtgacctgacaacctggcggcagcgcaaaagatg

SEQ ID NO: 106371 - DNA, 103 bp, Artificial Sequence
  Synthetic Polynucleotide
taatacgactcactatagggtaagggaagctcactgactggagtcaggtcaacagaggagagacctgatgccagtcagtaacctggcggcagcgcaaaagatg

SEQ ID NO: 106372 - DNA, 103 bp, Artificial Sequence
  Synthetic Polynucleotide
taatacgactcactataggggtcgggctgttaagggaagctcactgactgaacagaggagacagtcaatgagcttccctaacctggcggcagcgcaaaagatg

SEQ ID NO: 106373 - DNA, 103 bp, Artificial Sequence
  Synthetic Polynucleotide
taatacgactcactatagggcttgaccttggtcgggctgttaagggaagcaacagaggagagcttccatgaacagcccgaacctggcggcagcgcaaaagatg

SEQ ID NO: 106374 - DNA, 103 bp, Artificial Sequence
  Synthetic Polynucleotide
taatacgactcactatagggtttttccttccttgaccttggtcgggctgtaacagaggagaacagccatgccaaggtcaaacctggcggcagcgcaaaagatg

SEQ ID NO: 106375 - DNA, 103 bp, Artificial Sequence
  Synthetic Polynucleotide
taatacgactcactatagggccagcttatttttttccttccttgaccttgaacagaggagacaaggtatgggaaggaaaaacctggcggcagcgcaaaagatg

SEQ ID NO: 106376 - DNA, 103 bp, Artificial Sequence
  Synthetic Polynucleotide
taatacgactcactataggggctctggaagccagcttatttttttccttcaacagaggagagaaggaatgaaataagctaacctggcggcagcgcaaaagatg

SEQ ID NO: 106377 - DNA, 103 bp, Artificial Sequence
  Synthetic Polynucleotide
taatacgactcactatagggaagaaagttgtctctaggattctgttggtaaacagaggagataccaaatgaatcctagaaacctggcggcagcgcaaaagatg

SEQ ID NO: 106378 - DNA, 103 bp, Artificial Sequence
  Synthetic Polynucleotide
taatacgactcactatagggtaaccgacaagctctggaagccagcttattaacagaggagaaataagatggcttccagaaacctggcggcagcgcaaaagatg

SEQ ID NO: 106379 - DNA, 103 bp, Artificial Sequence
  Synthetic Polynucleotide
taatacgactcactatagggctttcttctttaaccgacaagctctggaagaacagaggagacttccaatgcttgtcggtaacctggcggcagcgcaaaagatg

SEQ ID NO: 106380 - DNA, 103 bp, Artificial Sequence
  Synthetic Polynucleotide
taatacgactcactatagggtcatactgggctttcttctttaaccgacaaaacagaggagattgtcgatgaaagaagaaaacctggcggcagcgcaaaagatg

SEQ ID NO: 106381 - DNA, 103 bp, Artificial Sequence
  Synthetic Polynucleotide
taatacgactcactatagggtttattagcttcatactgggctttcttcttaacagaggagaaagaagatggcccagtataacctggcggcagcgcaaaagatg

SEQ ID NO: 106382 - DNA, 103 bp, Artificial Sequence
  Synthetic Polynucleotide
taatacgactcactatagggataatttcactttattagcttcatactgggaacagaggagacccagtatgaagctaataaacctggcggcagcgcaaaagatg

SEQ ID NO: 106383 - DNA, 103 bp, Artificial Sequence
  Synthetic Polynucleotide
taatacgactcactatagggttgaggccccataatttcactttattagctaacagaggagaagctaaatgagtgaaattaacctggcggcagcgcaaaagatg

SEQ ID NO: 106384 - DNA, 103 bp, Artificial Sequence
  Synthetic Polynucleotide
taatacgactcactatagggatattctgtgttgaggccccataatttcacaacagaggagagtgaaaatgtggggcctcaacctggcggcagcgcaaaagatg

SEQ ID NO: 106385 - DNA, 103 bp, Artificial Sequence
  Synthetic Polynucleotide
taatacgactcactatagggataaattatcatattctgtgttgaggccccaacagaggagaggggccatgacacagaataacctggcggcagcgcaaaagatg

SEQ ID NO: 106386 - DNA, 103 bp, Artificial Sequence
  Synthetic Polynucleotide
taatacgactcactatagggattacaaacaataaattatcatattctgtgaacagaggagacacagaatgtgataatttaacctggcggcagcgcaaaagatg

SEQ ID NO: 106387 - DNA, 103 bp, Artificial Sequence
  Synthetic Polynucleotide
taatacgactcactataggggatggagttgattacaaacaataaattatcaacagaggagagataatatgttgtttgtaaacctggcggcagcgcaaaagatg

SEQ ID NO: 106388 - DNA, 103 bp, Artificial Sequence
  Synthetic Polynucleotide
taatacgactcactatagggcctccaaagaaagaaagttgtctctaggataacagaggagaatcctaatgacaactttcaacctggcggcagcgcaaaagatg

SEQ ID NO: 106389 - DNA, 103 bp, Artificial Sequence
  Synthetic Polynucleotide
taatacgactcactatagggtctcttgcttgatggagttgattacaaacaaacagaggagatgtttgatgtcaactccaaacctggcggcagcgcaaaagatg

SEQ ID NO: 106390 - DNA, 103 bp, Artificial Sequence
  Synthetic Polynucleotide
taatacgactcactatagggcggtttacaatctcttgcttgatggagttgaacagaggagacaactcatgcaagcaagaaacctggcggcagcgcaaaagatg

SEQ ID NO: 106391 - DNA, 103 bp, Artificial Sequence
  Synthetic Polynucleotide
taatacgactcactatagggattctgtacccggtttacaatctcttgcttaacagaggagaaagcaaatgattgtaaacaacctggcggcagcgcaaaagatg

SEQ ID NO: 106392 - DNA, 103 bp, Artificial Sequence
  Synthetic Polynucleotide
taatacgactcactatagggcatctcttggattctgtacccggtttacaaaacagaggagattgtaaatggggtacagaaacctggcggcagcgcaaaagatg

SEQ ID NO: 106393 - DNA, 103 bp, Artificial Sequence
  Synthetic Polynucleotide
taatacgactcactatagggggtcctctctcatctcttggattctgtaccaacagaggagaggtacaatgtccaagagaaacctggcggcagcgcaaaagatg

SEQ ID NO: 106394 - DNA, 103 bp, Artificial Sequence
  Synthetic Polynucleotide
taatacgactcactatagggccccatgttgggtcctctctcatctcttggaacagaggagaccaagaatggagagaggaaacctggcggcagcgcaaaagatg

SEQ ID NO: 106395 - DNA, 103 bp, Artificial Sequence
  Synthetic Polynucleotide
taatacgactcactatagggcaagcttctgccccatgttgggtcctctctaacagaggagaagagagatgccaacatggaacctggcggcagcgcaaaagatg

SEQ ID NO: 106396 - DNA, 103 bp, Artificial Sequence
  Synthetic Polynucleotide
taatacgactcactatagggatgaggatttcaagcttctgccccatgttgaacagaggagacaacatatggcagaagctaacctggcggcagcgcaaaagatg

SEQ ID NO: 106397 - DNA, 103 bp, Artificial Sequence
  Synthetic Polynucleotide
taatacgactcactatagggagtatctttaatgaggatttcaagcttctgaacagaggagacagaagatggaaatcctcaacctggcggcagcgcaaaagatg

SEQ ID NO: 106398 - DNA, 103 bp, Artificial Sequence
  Synthetic Polynucleotide
taatacgactcactataggggtagaccgagagtatctttaatgaggatttaacagaggagaaaatccatgttaaagataaacctggcggcagcgcaaaagatg

SEQ ID NO: 106399 - DNA, 103 bp, Artificial Sequence
  Synthetic Polynucleotide
taatacgactcactatagggtctttgcagtcctccaaagaaagaaagttgaacagaggagacaacttatgttctttggaaacctggcggcagcgcaaaagatg

SEQ ID NO: 106400 - DNA, 103 bp, Artificial Sequence
  Synthetic Polynucleotide
taatacgactcactatagggccagcaactggtagaccgagagtatctttaaacagaggagataaagaatgtctcggtctaacctggcggcagcgcaaaagatg

SEQ ID NO: 106401 - DNA, 103 bp, Artificial Sequence
  Synthetic Polynucleotide
taatacgactcactatagggtgaggtttgcccagcaactggtagaccgagaacagaggagactcggtatgccagttgctaacctggcggcagcgcaaaagatg

SEQ ID NO: 106402 - DNA, 103 bp, Artificial Sequence
  Synthetic Polynucleotide
taatacgactcactatagggtaacaaattctgaggtttgcccagcaactgaacagaggagacagttgatgggcaaacctaacctggcggcagcgcaaaagatg

SEQ ID NO: 106403 - DNA, 103 bp, Artificial Sequence
  Synthetic Polynucleotide
taatacgactcactatagggaacacttggttaacaaattctgaggtttgcaacagaggagagcaaacatgagaatttgtaacctggcggcagcgcaaaagatg

SEQ ID NO: 106404 - DNA, 103 bp, Artificial Sequence
  Synthetic Polynucleotide
taatacgactcactatagggagtcttctctaacacttggttaacaaattcaacagaggagagaatttatgaaccaagtgaacctggcggcagcgcaaaagatg

SEQ ID NO: 106405 - DNA, 103 bp, Artificial Sequence
  Synthetic Polynucleotide
taatacgactcactatagggtcccttctgcagtcttctctaacacttggtaacagaggagaaccaagatgtagagaagaaacctggcggcagcgcaaaagatg

SEQ ID NO: 106406 - DNA, 103 bp, Artificial Sequence
  Synthetic Polynucleotide
taatacgactcactatagggccagtgggattcccttctgcagtcttctctaacagaggagaagagaaatgtgcagaaggaacctggcggcagcgcaaaagatg

SEQ ID NO: 106407 - DNA, 103 bp, Artificial Sequence
  Synthetic Polynucleotide
taatacgactcactatagggtacaaggcctccagtgggattcccttctgcaacagaggagagcagaaatgaatcccactaacctggcggcagcgcaaaagatg

SEQ ID NO: 106408 - DNA, 103 bp, Artificial Sequence
  Synthetic Polynucleotide
taatacgactcactatagggtccttaatcctacaaggcctccagtgggataacagaggagaatcccaatggaggccttgaacctggcggcagcgcaaaagatg

SEQ ID NO: 106409 - DNA, 103 bp, Artificial Sequence
  Synthetic Polynucleotide
taatacgactcactataggggatgttggtatccttaatcctacaaggcctaacagaggagaaggcctatgaggattaagaacctggcggcagcgcaaaagatg

SEQ ID NO: 106410 - DNA, 103 bp, Artificial Sequence
  Synthetic Polynucleotide
taatacgactcactatagggattttcaatgtctttgcagtcctccaaagaaacagaggagatctttgatggactgcaaaaacctggcggcagcgcaaaagatg

SEQ ID NO: 106411 - DNA, 103 bp, Artificial Sequence
  Synthetic Polynucleotide
taatacgactcactatagggttacacctttgatgttggtatccttaatccaacagaggagaggattaatgataccaacaaacctggcggcagcgcaaaagatg

SEQ ID NO: 106412 - DNA, 103 bp, Artificial Sequence
  Synthetic Polynucleotide
taatacgactcactatagggcgaaaggcggatccattccgcttacactagaacagaggagactagtgatggcggaatggaacctggcggcagcgcaaaagatg

SEQ ID NO: 106413 - DNA, 103 bp, Artificial Sequence
  Synthetic Polynucleotide
taatacgactcactatagggaagactccagattttcaatgtctttgcagtaacagaggagaactgcaatgacattgaaaaacctggcggcagcgcaaaagatg

SEQ ID NO: 106414 - DNA, 103 bp, Artificial Sequence
  Synthetic Polynucleotide
taatacgactcactatagggacatctgtgaaagactccagattttcaatgaacagaggagacattgaatgtctggagtcaacctggcggcagcgcaaaagatg

SEQ ID NO: 106415 - DNA, 103 bp, Artificial Sequence
  Synthetic Polynucleotide
taatacgactcactatagggattatccaggacatctgtgaaagactccagaacagaggagactggagatgttcacagataacctggcggcagcgcaaaagatg

SEQ ID NO: 106416 - DNA, 103 bp, Artificial Sequence
  Synthetic Polynucleotide
taatacgactcactatagggaagcaccctcattatccaggacatctgtgaaacagaggagatcacagatgtcctggataaacctggcggcagcgcaaaagatg

SEQ ID NO: 106417 - DNA, 103 bp, Artificial Sequence
  Synthetic Polynucleotide
taatacgactcactatagggtttgaggttaaagcaccctcattatccaggaacagaggagacctggaatgtgagggtgcaacctggcggcagcgcaaaagatg

SEQ ID NO: 106418 - DNA, 103 bp, Artificial Sequence
  Synthetic Polynucleotide
taatacgactcactatagggctgttcccagtttgaggttaaagcaccctcaacagaggagagagggtatgttaacctcaaacctggcggcagcgcaaaagatg

SEQ ID NO: 106419 - DNA, 103 bp, Artificial Sequence
  Synthetic Polynucleotide
taatacgactcactatagggatgtatcccactgttcccagtttgaggttaaacagaggagataacctatgactgggaacaacctggcggcagcgcaaaagatg

SEQ ID NO: 106420 - DNA, 103 bp, Artificial Sequence
  Synthetic Polynucleotide
taatacgactcactatagggtcttcacagtatgtatcccactgttcccagaacagaggagactgggaatggtgggatacaacctggcggcagcgcaaaagatg

SEQ ID NO: 106421 - DNA, 103 bp, Artificial Sequence
  Synthetic Polynucleotide
taatacgactcactatagggtttcgttaggtcttcacagtatgtatcccaaacagaggagatgggatatgtactgtgaaaacctggcggcagcgcaaaagatg

SEQ ID NO: 106422 - DNA, 103 bp, Artificial Sequence
  Synthetic Polynucleotide
taatacgactcactataggggtttggtatatttcgttaggtcttcacagtaacagaggagaactgtgatgacctaacgaaacctggcggcagcgcaaaagatg

SEQ ID NO: 106423 - DNA, 103 bp, Artificial Sequence
  Synthetic Polynucleotide
taatacgactcactatagggaaggcatccccgaaaggcggatccattccgaacagaggagacggaatatgtccgcctttaacctggcggcagcgcaaaagatg

SEQ ID NO: 106424 - DNA, 103 bp, Artificial Sequence
  Synthetic Polynucleotide
taatacgactcactatagggcagctggttagtttggtatatttcgttaggaacagaggagacctaacatgatataccaaaacctggcggcagcgcaaaagatg

SEQ ID NO: 106425 - DNA, 103 bp, Artificial Sequence
  Synthetic Polynucleotide
taatacgactcactatagggccagatgtcacagctggttagtttggtataaacagaggagatataccatgctaaccagcaacctggcggcagcgcaaaagatg

SEQ ID NO: 106426 - DNA, 103 bp, Artificial Sequence
  Synthetic Polynucleotide
taatacgactcactatagggcttttgttccccagatgtcacagctggttaaacagaggagataaccaatggtgacatctaacctggcggcagcgcaaaagatg

SEQ ID NO: 106427 - DNA, 103 bp, Artificial Sequence
  Synthetic Polynucleotide
taatacgactcactatagggtaatccacttcttttgttccccagatgtcaaacagaggagatgacatatggggaacaaaaacctggcggcagcgcaaaagatg

SEQ ID NO: 106428 - DNA, 103 bp, Artificial Sequence
  Synthetic Polynucleotide
taatacgactcactatagggaagacccaagtaatccacttcttttgttccaacagaggagaggaacaatggaagtggataacctggcggcagcgcaaaagatg

SEQ ID NO: 106429 - DNA, 103 bp, Artificial Sequence
  Synthetic Polynucleotide
taatacgactcactatagggaaaagtcatcaagacccaagtaatccacttaacagaggagaaagtggatgacttgggtcaacctggcggcagcgcaaaagatg

SEQ ID NO: 106430 - DNA, 103 bp, Artificial Sequence
  Synthetic Polynucleotide
taatacgactcactatagggtaaggactagaaaagtcatcaagacccaagaacagaggagacttgggatgtgatgacttaacctggcggcagcgcaaaagatg

SEQ ID NO: 106431 - DNA, 103 bp, Artificial Sequence
  Synthetic Polynucleotide
taatacgactcactatagggttcatcttggtaaggactagaaaagtcatcaacagaggagagatgacatgtctagtcctaacctggcggcagcgcaaaagatg

SEQ ID NO: 106432 - DNA, 103 bp, Artificial Sequence
  Synthetic Polynucleotide
taatacgactcactatagggttataacctcttcatcttggtaaggactagaacagaggagactagtcatgaccaagatgaacctggcggcagcgcaaaagatg

SEQ ID NO: 106433 - DNA, 103 bp, Artificial Sequence
  Synthetic Polynucleotide
taatacgactcactatagggggagttttacttataacctcttcatcttggaacagaggagaccaagaatgagaggttataacctggcggcagcgcaaaagatg

SEQ ID NO: 106434 - DNA, 103 bp, Artificial Sequence
  Synthetic Polynucleotide
taatacgactcactataggggtggcttcgaaaggcatccccgaaaggcggaacagaggagaccgcctatgggggatgccaacctggcggcagcgcaaaagatg

SEQ ID NO: 106435 - DNA, 103 bp, Artificial Sequence
  Synthetic Polynucleotide
taatacgactcactatagggagctaaagttggagttttacttataacctcaacagaggagagaggttatgagtaaaactaacctggcggcagcgcaaaagatg

SEQ ID NO: 106436 - DNA, 103 bp, Artificial Sequence
  Synthetic Polynucleotide
taatacgactcactatagggtattaagttgagctaaagttggagttttacaacagaggagagtaaaaatgcaactttagaacctggcggcagcgcaaaagatg

SEQ ID NO: 106437 - DNA, 103 bp, Artificial Sequence
  Synthetic Polynucleotide
taatacgactcactataggggagtcctcactattaagttgagctaaagttaacagaggagaaactttatgtcaacttaaaacctggcggcagcgcaaaagatg

SEQ ID NO: 106438 - DNA, 103 bp, Artificial Sequence
  Synthetic Polynucleotide
taatacgactcactatagggaacagactgtgagtcctcactattaagttgaacagaggagacaacttatgagtgaggacaacctggcggcagcgcaaaagatg

SEQ ID NO: 106439 - DNA, 103 bp, Artificial Sequence
  Synthetic Polynucleotide
taatacgactcactataggggggaatcagaaacagactgtgagtcctcacaacagaggagagtgaggatgcacagtctgaacctggcggcagcgcaaaagatg

SEQ ID NO: 106440 - DNA, 103 bp, Artificial Sequence
  Synthetic Polynucleotide
taatacgactcactataggggggtaataaagggaatcagaaacagactgtaacagaggagaacagtcatgttctgattcaacctggcggcagcgcaaaagatg

SEQ ID NO: 106441 - DNA, 103 bp, Artificial Sequence
  Synthetic Polynucleotide
taatacgactcactatagggaagtgaatcggggtaataaagggaatcagaaacagaggagatctgatatgctttattacaacctggcggcagcgcaaaagatg

SEQ ID NO: 106442 - DNA, 103 bp, Artificial Sequence
  Synthetic Polynucleotide
taatacgactcactatagggtgacactgaaaagtgaatcggggtaataaaaacagaggagatttattatgccgattcacaacctggcggcagcgcaaaagatg

SEQ ID NO: 106443 - DNA, 103 bp, Artificial Sequence
  Synthetic Polynucleotide
taatacgactcactatagggggattttgtttgacactgaaaagtgaatcgaacagaggagacgattcatgtttcagtgtaacctggcggcagcgcaaaagatg

SEQ ID NO: 106444 - DNA, 103 bp, Artificial Sequence
  Synthetic Polynucleotide
taatacgactcactatagggagagggtaagggattttgtttgacactgaaaacagaggagattcagtatgaaacaaaataacctggcggcagcgcaaaagatg

SEQ ID NO: 106445 - DNA, 103 bp, Artificial Sequence
  Synthetic Polynucleotide
taatacgactcactatagggccgaaaaggtgtggcttcgaaaggcatcccaacagaggagagggatgatgttcgaagccaacctggcggcagcgcaaaagatg

SEQ ID NO: 106446 - DNA, 103 bp, Artificial Sequence
  Synthetic Polynucleotide
taatacgactcactatagggcagggaatgaagagggtaagggattttgttaacagaggagaaacaaaatgccttaccctaacctggcggcagcgcaaaagatg

SEQ ID NO: 106447 - DNA, 103 bp, Artificial Sequence
  Synthetic Polynucleotide
taatacgactcactatagggatctttttaccagggaatgaagagggtaagaacagaggagacttaccatgttcattcccaacctggcggcagcgcaaaagatg

SEQ ID NO: 106448 - DNA, 103 bp, Artificial Sequence
  Synthetic Polynucleotide
taatacgactcactatagggtctgcttgtgatctttttaccagggaatgaaacagaggagatcattcatgggtaaaaagaacctggcggcagcgcaaaagatg

SEQ ID NO: 106449 - DNA, 103 bp, Artificial Sequence
  Synthetic Polynucleotide
taatacgactcactataggggagcagctgctctgcttgtgatctttttacaacagaggagagtaaaaatgtcacaagcaaacctggcggcagcgcaaaagatg

SEQ ID NO: 106450 - DNA, 103 bp, Artificial Sequence
  Synthetic Polynucleotide
taatacgactcactataggggaacacacaggagcagctgctctgcttgtgaacagaggagacacaagatgagcagctgcaacctggcggcagcgcaaaagatg

SEQ ID NO: 106451 - DNA, 103 bp, Artificial Sequence
  Synthetic Polynucleotide
taatacgactcactatagggagtcttagaagaacacacaggagcagctgcaacagaggagagcagctatgcctgtgtgtaacctggcggcagcgcaaaagatg

SEQ ID NO: 106452 - DNA, 103 bp, Artificial Sequence
  Synthetic Polynucleotide
taatacgactcactatagggcagcctgcagagtcttagaagaacacacagaacagaggagactgtgtatgcttctaagaaacctggcggcagcgcaaaagatg

SEQ ID NO: 106453 - DNA, 103 bp, Artificial Sequence
  Synthetic Polynucleotide
taatacgactcactatagggaaagggacctcagcctgcagagtcttagaaaacagaggagattctaaatgtctgcaggcaacctggcggcagcgcaaaagatg

SEQ ID NO: 106454 - DNA, 103 bp, Artificial Sequence
  Synthetic Polynucleotide
taatacgactcactatagggacagtctgacaaagggacctcagcctgcagaacagaggagactgcagatggaggtccctaacctggcggcagcgcaaaagatg

SEQ ID NO: 106455 - DNA, 103 bp, Artificial Sequence
  Synthetic Polynucleotide
taatacgactcactatagggctttttggacacagtctgacaaagggacctaacagaggagaaggtccatgtgtcagactaacctggcggcagcgcaaaagatg

SEQ ID NO: 106456 - DNA, 103 bp, Artificial Sequence
  Synthetic Polynucleotide
taatacgactcactatagggagagtttgttccgaaaaggtgtggcttcgaaacagaggagatcgaagatgcaccttttcaacctggcggcagcgcaaaagatg

SEQ ID NO: 106457 - DNA, 103 bp, Artificial Sequence
  Synthetic Polynucleotide
taatacgactcactatagggggtttacttgctttttggacacagtctgacaacagaggagagtcagaatgtgtccaaaaaacctggcggcagcgcaaaagatg

SEQ ID NO: 106458 - DNA, 103 bp, Artificial Sequence
  Synthetic Polynucleotide
taatacgactcactataggggcttgaagtgggtttacttgctttttggacaacagaggagagtccaaatggcaagtaaaaacctggcggcagcgcaaaagatg

SEQ ID NO: 106459 - DNA, 103 bp, Artificial Sequence
  Synthetic Polynucleotide
taatacgactcactatagggtgatttgtgtgcttgaagtgggtttacttgaacagaggagacaagtaatgccacttcaaaacctggcggcagcgcaaaagatg

SEQ ID NO: 106460 - DNA, 103 bp, Artificial Sequence
  Synthetic Polynucleotide
taatacgactcactataggggtcttcaccatgatttgtgtgcttgaagtgaacagaggagacacttcatgcacacaaataacctggcggcagcgcaaaagatg

SEQ ID NO: 106461 - DNA, 103 bp, Artificial Sequence
  Synthetic Polynucleotide
taatacgactcactatagggatacatgttggtcttcaccatgatttgtgtaacagaggagaacacaaatgatggtgaagaacctggcggcagcgcaaaagatg

SEQ ID NO: 106462 - DNA, 103 bp, Artificial Sequence
  Synthetic Polynucleotide
taatacgactcactatagggtttcattatgatacatgttggtcttcaccaaacagaggagatggtgaatgccaacatgtaacctggcggcagcgcaaaagatg

SEQ ID NO: 106463 - DNA, 103 bp, Artificial Sequence
  Synthetic Polynucleotide
taatacgactcactatagggaagttcaccttttcattatgatacatgttgaacagaggagacaacatatgtcataatgaaacctggcggcagcgcaaaagatg

SEQ ID NO: 106464 - DNA, 103 bp, Artificial Sequence
  Synthetic Polynucleotide
taatacgactcactatagggttcaacatgaaagttcaccttttcattatgaacagaggagacataatatgaaggtgaacaacctggcggcagcgcaaaagatg

SEQ ID NO: 106465 - DNA, 103 bp, Artificial Sequence
  Synthetic Polynucleotide
taatacgactcactatagggagtctttacattcaacatgaaagttcacctaacagaggagaaggtgaatgttcatgttgaacctggcggcagcgcaaaagatg

SEQ ID NO: 106466 - DNA, 103 bp, Artificial Sequence
  Synthetic Polynucleotide
taatacgactcactatagggttttttacatagtctttacattcaacatgaaacagaggagatcatgtatgatgtaaagaaacctggcggcagcgcaaaagatg

SEQ ID NO: 106467 - DNA, 103 bp, Artificial Sequence
  Synthetic Polynucleotide
taatacgactcactatagggtgtgctcatcagagtttgttccgaaaaggtaacagaggagaacctttatggaacaaactaacctggcggcagcgcaaaagatg

SEQ ID NO: 106468 - DNA, 103 bp, Artificial Sequence
  Synthetic Polynucleotide
taatacgactcactatagggtacctttgccttttttacatagtctttacaaacagaggagatgtaaaatgtatgtaaaaaacctggcggcagcgcaaaagatg

SEQ ID NO: 106469 - DNA, 103 bp, Artificial Sequence
  Synthetic Polynucleotide
taatacgactcactatagggggttgatctttacctttgccttttttacataacagaggagaatgtaaatgaggcaaaggaacctggcggcagcgcaaaagatg

SEQ ID NO: 106470 - DNA, 103 bp, Artificial Sequence
  Synthetic Polynucleotide
taatacgactcactatagggtgttgcactgggttgatctttacctttgccaacagaggagaggcaaaatgaaagatcaaaacctggcggcagcgcaaaagatg

SEQ ID NO: 106471 - DNA, 103 bp, Artificial Sequence
  Synthetic Polynucleotide
taatacgactcactataggggggccggctctgttgcactgggttgatcttaacagaggagaaagatcatgccagtgcaaaacctggcggcagcgcaaaagatg

SEQ ID NO: 106472 - DNA, 103 bp, Artificial Sequence
  Synthetic Polynucleotide
taatacgactcactatagggggctcaacaagggccggctctgttgcactgaacagaggagacagtgcatgagagccggcaacctggcggcagcgcaaaagatg

SEQ ID NO: 106473 - DNA, 103 bp, Artificial Sequence
  Synthetic Polynucleotide
taatacgactcactataggggtgtgaatctggctcaacaagggccggctcaacagaggagagagccgatgcttgttgagaacctggcggcagcgcaaaagatg

SEQ ID NO: 106474 - DNA, 103 bp, Artificial Sequence
  Synthetic Polynucleotide
taatacgactcactatagggtgctgcatctgtgtgaatctggctcaacaaaacagaggagattgttgatgcagattcacaacctggcggcagcgcaaaagatg

SEQ ID NO: 106475 - DNA, 103 bp, Artificial Sequence
  Synthetic Polynucleotide
taatacgactcactatagggtgttctcctttgctgcatctgtgtgaatctaacagaggagaagattcatgcagatgcagaacctggcggcagcgcaaaagatg

SEQ ID NO: 106476 - DNA, 103 bp, Artificial Sequence
  Synthetic Polynucleotide
taatacgactcactatagggcagtagcaggtgttctcctttgctgcatctaacagaggagaagatgcatgaaaggagaaaacctggcggcagcgcaaaagatg

SEQ ID NO: 106477 - DNA, 103 bp, Artificial Sequence
  Synthetic Polynucleotide
taatacgactcactatagggcactgcaccacagtagcaggtgttctccttaacagaggagaaaggagatgacctgctacaacctggcggcagcgcaaaagatg

SEQ ID NO: 106478 - DNA, 103 bp, Artificial Sequence
  Synthetic Polynucleotide
taatacgactcactatagggctaagagatctgtgctcatcagagtttgttaacagaggagaaacaaaatgtgatgagcaaacctggcggcagcgcaaaagatg

SEQ ID NO: 106479 - DNA, 103 bp, Artificial Sequence
  Synthetic Polynucleotide
taatacgactcactataggggtctctttgccactgcaccacagtagcaggaacagaggagacctgctatggtggtgcagaacctggcggcagcgcaaaagatg

SEQ ID NO: 106480 - DNA, 103 bp, Artificial Sequence
  Synthetic Polynucleotide
taatacgactcactatagggtttttctcttgtctctttgccactgcaccaaacagaggagatggtgcatgggcaaagagaacctggcggcagcgcaaaagatg

SEQ ID NO: 106481 - DNA, 103 bp, Artificial Sequence
  Synthetic Polynucleotide
taatacgactcactatagggctccatcccttttttctcttgtctctttgcaacagaggagagcaaagatgcaagagaaaaacctggcggcagcgcaaaagatg

SEQ ID NO: 106482 - DNA, 103 bp, Artificial Sequence
  Synthetic Polynucleotide
taatacgactcactatagggcttgaagaggctccatcccttttttctcttaacagaggagaaagagaatgaagggatggaacctggcggcagcgcaaaagatg

SEQ ID NO: 106483 - DNA, 103 bp, Artificial Sequence
  Synthetic Polynucleotide
taatacgactcactataggggtggcatgaccttgaagaggctccatccctaacagaggagaagggatatggcctcttcaaacctggcggcagcgcaaaagatg

SEQ ID NO: 106484 - DNA, 103 bp, Artificial Sequence
  Synthetic Polynucleotide
taatacgactcactatagggcaaagcgggagtggcatgaccttgaagaggaacagaggagacctcttatgggtcatgccaacctggcggcagcgcaaaagatg

SEQ ID NO: 106485 - DNA, 103 bp, Artificial Sequence
  Synthetic Polynucleotide
taatacgactcactatagggctttaaaaggcaaagcgggagtggcatgacaacagaggagagtcatgatgctcccgcttaacctggcggcagcgcaaaagatg

SEQ ID NO: 106486 - DNA, 103 bp, Artificial Sequence
  Synthetic Polynucleotide
taatacgactcactatagggtcctgggtttctttaaaaggcaaagcgggaaacagaggagatcccgcatggccttttaaaacctggcggcagcgcaaaagatg

SEQ ID NO: 106487 - DNA, 103 bp, Artificial Sequence
  Synthetic Polynucleotide
taatacgactcactatagggtagtaatagttcctgggtttctttaaaaggaacagaggagaccttttatggaaacccagaacctggcggcagcgcaaaagatg

SEQ ID NO: 106488 - DNA, 103 bp, Artificial Sequence
  Synthetic Polynucleotide
taatacgactcactataggggcaggggacttagtaatagttcctgggtttaacagaggagaaaacccatgaactattacaacctggcggcagcgcaaaagatg

SEQ ID NO: 106489 - DNA, 103 bp, Artificial Sequence
  Synthetic Polynucleotide
taatacgactcactataggggaactgtttgctaagagatctgtgctcatcaacagaggagagatgagatgagatctcttaacctggcggcagcgcaaaagatg

SEQ ID NO: 106490 - DNA, 103 bp, Artificial Sequence
  Synthetic Polynucleotide
taatacgactcactatagggccttcctggggcaggggacttagtaatagtaacagaggagaactattatgaagtcccctaacctggcggcagcgcaaaagatg

SEQ ID NO: 106491 - DNA, 103 bp, Artificial Sequence
  Synthetic Polynucleotide
taatacgactcactatagggtgacccaggaccttcctggggcaggggactaacagaggagaagtcccatgccccaggaaaacctggcggcagcgcaaaagatg

SEQ ID NO: 106492 - DNA, 103 bp, Artificial Sequence
  Synthetic Polynucleotide
taatacgactcactatagggctgctgcaagtgacccaggaccttcctgggaacagaggagacccaggatggtcctgggtaacctggcggcagcgcaaaagatg

SEQ ID NO: 106493 - DNA, 103 bp, Artificial Sequence
  Synthetic Polynucleotide
taatacgactcactatagggctgctctctcctgctgcaagtgacccaggaaacagaggagatcctggatgacttgcagcaacctggcggcagcgcaaaagatg

SEQ ID NO: 106494 - DNA, 103 bp, Artificial Sequence
  Synthetic Polynucleotide
taatacgactcactatagggagaaagactgctgctctctcctgctgcaagaacagaggagacttgcaatgggagagagcaacctggcggcagcgcaaaagatg

SEQ ID NO: 106495 - DNA, 103 bp, Artificial Sequence
  Synthetic Polynucleotide
taatacgactcactatagggatgtactggcagaaagactgctgctctctcaacagaggagagagagaatggcagtctttaacctggcggcagcgcaaaagatg

SEQ ID NO: 106496 - DNA, 103 bp, Artificial Sequence
  Synthetic Polynucleotide
taatacgactcactatagggtctgagactgatgtactggcagaaagactgaacagaggagacagtctatgtgccagtacaacctggcggcagcgcaaaagatg

SEQ ID NO: 106497 - DNA, 103 bp, Artificial Sequence
  Synthetic Polynucleotide
taatacgactcactatagggctgggatgaatctgagactgatgtactggcaacagaggagagccagtatgtcagtctcaaacctggcggcagcgcaaaagatg

SEQ ID NO: 106498 - DNA, 103 bp, Artificial Sequence
  Synthetic Polynucleotide
taatacgactcactatagggcttcttttttctgggatgaatctgagactgaacagaggagacagtctatgattcatcccaacctggcggcagcgcaaaagatg

SEQ ID NO: 106499 - DNA, 103 bp, Artificial Sequence
  Synthetic Polynucleotide
taatacgactcactatagggtaattgtgctcttcttttttctgggatgaaaacagaggagattcatcatggaaaaaagaaacctggcggcagcgcaaaagatg

SEQ ID NO: 106500 - DNA, 103 bp, Artificial Sequence
  Synthetic Polynucleotide
taatacgactcactatagggaatatattttttccttgcacatttgctcataacagaggagaatgagcatgtgtgcaaggaacctggcggcagcgcaaaagatg

SEQ ID NO: 106501 - DNA, 103 bp, Artificial Sequence
  Synthetic Polynucleotide
taatacgactcactatagggagcagacttgctctctgtcaaagaagctgtaacagaggagaacagctatgttgacagagaacctggcggcagcgcaaaagatg

SEQ ID NO: 106502 - DNA, 103 bp, Artificial Sequence
  Synthetic Polynucleotide
taatacgactcactatagggtctgcacatgagcagacttgctctctgtcaaacagaggagatgacagatggcaagtctgaacctggcggcagcgcaaaagatg

SEQ ID NO: 106503 - DNA, 103 bp, Artificial Sequence
  Synthetic Polynucleotide
taatacgactcactatagggccagtctgagtctgcacatgagcagacttgaacagaggagacaagtcatgtcatgtgcaaacctggcggcagcgcaaaagatg

SEQ ID NO: 106504 - DNA, 103 bp, Artificial Sequence
  Synthetic Polynucleotide
taatacgactcactatagggtgaattttggccagtctgagtctgcacatgaacagaggagacatgtgatgactcagactaacctggcggcagcgcaaaagatg

SEQ ID NO: 106505 - DNA, 103 bp, Artificial Sequence
  Synthetic Polynucleotide
taatacgactcactatagggaagcagggattgaattttggccagtctgagaacagaggagactcagaatggccaaaattaacctggcggcagcgcaaaagatg

SEQ ID NO: 106506 - DNA, 103 bp, Artificial Sequence
  Synthetic Polynucleotide
taatacgactcactatagggacctgagctaaagcagggattgaattttggaacagaggagaccaaaaatgaatccctgcaacctggcggcagcgcaaaagatg

SEQ ID NO: 106507 - DNA, 103 bp, Artificial Sequence
  Synthetic Polynucleotide
taatacgactcactatagggaattgctgctacctgagctaaagcagggataacagaggagaatccctatgttagctcagaacctggcggcagcgcaaaagatg

SEQ ID NO: 106508 - DNA, 103 bp, Artificial Sequence
  Synthetic Polynucleotide
taatacgactcactatagggctgtctctgcaattgctgctacctgagctaaacagaggagatagctcatgtagcagcaaaacctggcggcagcgcaaaagatg

SEQ ID NO: 106509 - DNA, 103 bp, Artificial Sequence
  Synthetic Polynucleotide
taatacgactcactataggggcagattcatctgtctctgcaattgctgctaacagaggagaagcagcatgtgcagagacaacctggcggcagcgcaaaagatg

SEQ ID NO: 106510 - DNA, 103 bp, Artificial Sequence
  Synthetic Polynucleotide
taatacgactcactatagggttctgattctgcagattcatctgtctctgcaacagaggagagcagagatggatgaatctaacctggcggcagcgcaaaagatg

SEQ ID NO: 106511 - DNA, 103 bp, Artificial Sequence
  Synthetic Polynucleotide
taatacgactcactataggggatttgtcttaatatattttttccttgcacaacagaggagagtgcaaatgaaaaatataaacctggcggcagcgcaaaagatg

SEQ ID NO: 106512 - DNA, 103 bp, Artificial Sequence
  Synthetic Polynucleotide
taatacgactcactatagggcaattacaccttctgattctgcagattcataacagaggagaatgaatatgcagaatcagaacctggcggcagcgcaaaagatg

SEQ ID NO: 106513 - DNA, 103 bp, Artificial Sequence
  Synthetic Polynucleotide
taatacgactcactatagggttatgagaatcaattacaccttctgattctaacagaggagaagaatcatgaggtgtaataacctggcggcagcgcaaaagatg

SEQ ID NO: 106514 - DNA, 103 bp, Artificial Sequence
  Synthetic Polynucleotide
taatacgactcactatagggttctctacgtttatgagaatcaattacaccaacagaggagaggtgtaatggattctcataacctggcggcagcgcaaaagatg

SEQ ID NO: 106515 - DNA, 103 bp, Artificial Sequence
  Synthetic Polynucleotide
taatacgactcactataggggtgaaaggatttctctacgtttatgagaataacagaggagaattctcatgaacgtagagaacctggcggcagcgcaaaagatg

SEQ ID NO: 106516 - DNA, 103 bp, Artificial Sequence
  Synthetic Polynucleotide
taatacgactcactataggggagggtcttcgtgaaaggatttctctacgtaacagaggagaacgtagatgaatcctttcaacctggcggcagcgcaaaagatg

SEQ ID NO: 106517 - DNA, 103 bp, Artificial Sequence
  Synthetic Polynucleotide
taatacgactcactatagggtttcctataagagggtcttcgtgaaaggataacagaggagaatccttatgcgaagacccaacctggcggcagcgcaaaagatg

SEQ ID NO: 106518 - DNA, 103 bp, Artificial Sequence
  Synthetic Polynucleotide
taatacgactcactatagggcattcagtattttcctataagagggtcttcaacagaggagagaagacatgcttataggaaacctggcggcagcgcaaaagatg

SEQ ID NO: 106519 - DNA, 103 bp, Artificial Sequence
  Synthetic Polynucleotide
taatacgactcactataggggaggacagttcattcagtattttcctataaaacagaggagattatagatgaatactgaaaacctggcggcagcgcaaaagatg

SEQ ID NO: 106520 - DNA, 103 bp, Artificial Sequence
  Synthetic Polynucleotide
taatacgactcactatagggaggcacatcagaggacagttcattcagtataacagaggagaatactgatggaactgtccaacctggcggcagcgcaaaagatg

SEQ ID NO: 106521 - DNA, 103 bp, Artificial Sequence
  Synthetic Polynucleotide
taatacgactcactatagggtgggaacaccaggcacatcagaggacagttaacagaggagaaactgtatgctgatgtgcaacctggcggcagcgcaaaagatg

SEQ ID NO: 106522 - DNA, 103 bp, Artificial Sequence
  Synthetic Polynucleotide
taatacgactcactatagggatttgtcttggatttgtcttaatatattttaacagaggagaaaaataatgtaagacaaaaacctggcggcagcgcaaaagatg

SEQ ID NO: 106523 - DNA, 103 bp, Artificial Sequence
  Synthetic Polynucleotide
taatacgactcactatagggtcttcaatcttgggaacaccaggcacatcaaacagaggagatgatgtatgtggtgttccaacctggcggcagcgcaaaagatg

SEQ ID NO: 106524 - DNA, 103 bp, Artificial Sequence
  Synthetic Polynucleotide
taatacgactcactatagggtgatctctcttcttcaatcttgggaacaccaacagaggagaggtgttatgaagattgaaaacctggcggcagcgcaaaagatg

SEQ ID NO: 106525 - DNA, 103 bp, Artificial Sequence
  Synthetic Polynucleotide
taatacgactcactatagggcttcttcctctgatctctcttcttcaatctaacagaggagaagattgatgaagagagataacctggcggcagcgcaaaagatg

SEQ ID NO: 106526 - DNA, 103 bp, Artificial Sequence
  Synthetic Polynucleotide
taatacgactcactatagggggtggtgttccttcttcctctgatctctctaacagaggagaagagagatgagaggaagaaacctggcggcagcgcaaaagatg

SEQ ID NO: 106527 - DNA, 103 bp, Artificial Sequence
  Synthetic Polynucleotide
taatacgactcactatagggagcaatactaggtggtgttccttcttcctcaacagaggagagaggaaatgggaacaccaaacctggcggcagcgcaaaagatg

SEQ ID NO: 106528 - DNA, 103 bp, Artificial Sequence
  Synthetic Polynucleotide
taatacgactcactatagggctgccatggtagcaatactaggtggtgttcaacagaggagagaacacatgctagtattgaacctggcggcagcgcaaaagatg

SEQ ID NO: 106529 - DNA, 103 bp, Artificial Sequence
  Synthetic Polynucleotide
taatacgactcactatagggctagttggtactgccatggtagcaatactaaacagaggagatagtatatgtaccatggcaacctggcggcagcgcaaaagatg

SEQ ID NO: 106530 - DNA, 103 bp, Artificial Sequence
  Synthetic Polynucleotide
taatacgactcactatagggctgatatatgctagttggtactgccatggtaacagaggagaaccatgatggtaccaactaacctggcggcagcgcaaaagatg

SEQ ID NO: 106531 - DNA, 103 bp, Artificial Sequence
  Synthetic Polynucleotide
taatacgactcactatagggccgtgctagtctgatatatgctagttggtaaacagaggagataccaaatggcatatatcaacctggcggcagcgcaaaagatg

SEQ ID NO: 106532 - DNA, 103 bp, Artificial Sequence
  Synthetic Polynucleotide
taatacgactcactatagggatgtattgccccgtgctagtctgatatatgaacagaggagacatataatggactagcacaacctggcggcagcgcaaaagatg

SEQ ID NO: 106533 - DNA, 103 bp, Artificial Sequence
  Synthetic Polynucleotide
taatacgactcactatagggttccatggtcatttgtcttggatttgtcttaacagaggagaaagacaatgccaagacaaaacctggcggcagcgcaaaagatg

SEQ ID NO: 106534 - DNA, 103 bp, Artificial Sequence
  Synthetic Polynucleotide
taatacgactcactatagggggctatagcaatgtattgccccgtgctagtaacagaggagaactagcatggggcaatacaacctggcggcagcgcaaaagatg

SEQ ID NO: 106535 - DNA, 103 bp, Artificial Sequence
  Synthetic Polynucleotide
taatacgactcactatagggttccaccttgggctatagcaatgtattgccaacagaggagaggcaatatgttgctatagaacctggcggcagcgcaaaagatg

SEQ ID NO: 106536 - DNA, 103 bp, Artificial Sequence
  Synthetic Polynucleotide
taatacgactcactatagggatctggattgttccaccttgggctatagcaaacagaggagatgctatatgccaaggtggaacctggcggcagcgcaaaagatg

SEQ ID NO: 106537 - DNA, 103 bp, Artificial Sequence
  Synthetic Polynucleotide
taatacgactcactatagggtgggttagaaatctggattgttccaccttgaacagaggagacaaggtatgacaatccagaacctggcggcagcgcaaaagatg

SEQ ID NO: 106538 - DNA, 103 bp, Artificial Sequence
  Synthetic Polynucleotide
taatacgactcactatagggcatcagatcctgggttagaaatctggattgaacagaggagacaatccatgtttctaaccaacctggcggcagcgcaaaagatg

SEQ ID NO: 106539 - DNA, 103 bp, Artificial Sequence
  Synthetic Polynucleotide
taatacgactcactatagggccctgaacaccatcagatcctgggttagaaaacagaggagattctaaatgaggatctgaaacctggcggcagcgcaaaagatg

SEQ ID NO: 106540 - DNA, 103 bp, Artificial Sequence
  Synthetic Polynucleotide
taatacgactcactatagggtgcctgcagtccctgaacaccatcagatccaacagaggagaggatctatgggtgttcagaacctggcggcagcgcaaaagatg

SEQ ID NO: 106541 - DNA, 103 bp, Artificial Sequence
  Synthetic Polynucleotide
taatacgactcactatagggtcattgttaatgcctgcagtccctgaacacaacagaggagagtgttcatggactgcaggaacctggcggcagcgcaaaagatg

SEQ ID NO: 106542 - DNA, 103 bp, Artificial Sequence
  Synthetic Polynucleotide
taatacgactcactatagggcctgaatttgtcattgttaatgcctgcagtaacagaggagaactgcaatgattaacaataacctggcggcagcgcaaaagatg

SEQ ID NO: 106543 - DNA, 103 bp, Artificial Sequence
  Synthetic Polynucleotide
taatacgactcactatagggtggaggagctcctgaatttgtcattgttaaaacagaggagattaacaatgacaaattcaaacctggcggcagcgcaaaagatg

SEQ ID NO: 106544 - DNA, 103 bp, Artificial Sequence
  Synthetic Polynucleotide
taatacgactcactatagggattcaactgtttccatggtcatttgtcttgaacagaggagacaagacatgtgaccatggaacctggcggcagcgcaaaagatg

SEQ ID NO: 106545 - DNA, 103 bp, Artificial Sequence
  Synthetic Polynucleotide
taatacgactcactatagggtagcacctggtggaggagctcctgaatttgaacagaggagacaaattatggagctcctcaacctggcggcagcgcaaaagatg

SEQ ID NO: 106546 - DNA, 103 bp, Artificial Sequence
  Synthetic Polynucleotide
taatacgactcactatagggtgtacaattgtagcacctggtggaggagctaacagaggagaagctccatgaccaggtgcaacctggcggcagcgcaaaagatg

SEQ ID NO: 106547 - DNA, 103 bp, Artificial Sequence
  Synthetic Polynucleotide
taatacgactcactatagggtgctgcgtactgtacaattgtagcacctggaacagaggagaccaggtatgacaattgtaaacctggcggcagcgcaaaagatg

SEQ ID NO: 106548 - DNA, 103 bp, Artificial Sequence
  Synthetic Polynucleotide
taatacgactcactatagggcagctgattgtgctgcgtactgtacaattgaacagaggagacaattgatgagtacgcagaacctggcggcagcgcaaaagatg

SEQ ID NO: 106549 - DNA, 103 bp, Artificial Sequence
  Synthetic Polynucleotide
taatacgactcactatagggtgtgtgccatcagctgattgtgctgcgtacaacagaggagagtacgcatgacaatcagcaacctggcggcagcgcaaaagatg

SEQ ID NO: 106550 - DNA, 103 bp, Artificial Sequence
  Synthetic Polynucleotide
taatacgactcactatagggaaagaactgctgtgtgccatcagctgattgaacagaggagacaatcaatggatggcacaaacctggcggcagcgcaaaagatg

SEQ ID NO: 106551 - DNA, 103 bp, Artificial Sequence
  Synthetic Polynucleotide
taatacgactcactatagggtgcctgggacaaagaactgctgtgtgccataacagaggagaatggcaatgagcagttctaacctggcggcagcgcaaaagatg

SEQ ID NO: 106552 - DNA, 103 bp, Artificial Sequence
  Synthetic Polynucleotide
taatacgactcactatagggacaacctggctgcctgggacaaagaactgcaacagaggagagcagttatgtgtcccaggaacctggcggcagcgcaaaagatg

SEQ ID NO: 106553 - DNA, 103 bp, Artificial Sequence
  Synthetic Polynucleotide
taatacgactcactatagggagcttgaacaacaacctggctgcctgggacaacagaggagagtcccaatgagccaggttaacctggcggcagcgcaaaagatg

SEQ ID NO: 106554 - DNA, 103 bp, Artificial Sequence
  Synthetic Polynucleotide
taatacgactcactatagggcaccagtggcagcttgaacaacaacctggcaacagaggagagccaggatgttgttcaagaacctggcggcagcgcaaaagatg

SEQ ID NO: 106555 - DNA, 103 bp, Artificial Sequence
  Synthetic Polynucleotide
taatacgactcactatagggtcatgctgggattcaactgtttccatggtcaacagaggagagaccatatgaacagttgaaacctggcggcagcgcaaaagatg

SEQ ID NO: 106556 - DNA, 103 bp, Artificial Sequence
  Synthetic Polynucleotide
taatacgactcactataggggttggcatgtcaccagtggcagcttgaacaaacagaggagatgttcaatgtgccactggaacctggcggcagcgcaaaagatg

SEQ ID NO: 106557 - DNA, 103 bp, Artificial Sequence
  Synthetic Polynucleotide
taatacgactcactataggggatctggtaagttggcatgtcaccagtggcaacagaggagagccactatggacatgccaaacctggcggcagcgcaaaagatg

SEQ ID NO: 106558 - DNA, 103 bp, Artificial Sequence
  Synthetic Polynucleotide
taatacgactcactatagggtaggagctcggatctggtaagttggcatgtaacagaggagaacatgcatgcttaccagaaacctggcggcagcgcaaaagatg

SEQ ID NO: 106559 - DNA, 103 bp, Artificial Sequence
  Synthetic Polynucleotide
taatacgactcactatagggaaagcagcagtaggagctcggatctggtaaaacagaggagattaccaatgccgagctccaacctggcggcagcgcaaaagatg

SEQ ID NO: 106560 - DNA, 103 bp, Artificial Sequence
  Synthetic Polynucleotide
taatacgactcactatagggtccctgtggcaaagcagcagtaggagctcgaacagaggagacgagctatgactgctgctaacctggcggcagcgcaaaagatg

SEQ ID NO: 106561 - DNA, 103 bp, Artificial Sequence
  Synthetic Polynucleotide
taatacgactcactatagggccatcaccactccctgtggcaaagcagcagaacagaggagactgctgatgtgccacaggaacctggcggcagcgcaaaagatg

SEQ ID NO: 106562 - DNA, 103 bp, Artificial Sequence
  Synthetic Polynucleotide
taatacgactcactatagggggcgatgcagccatcaccactccctgtggcaacagaggagagccacaatgagtggtgataacctggcggcagcgcaaaagatg

SEQ ID NO: 106563 - DNA, 103 bp, Artificial Sequence
  Synthetic Polynucleotide
taatacgactcactatagggcaaacttccgggcgatgcagccatcaccacaacagaggagagtggtgatggctgcatcgaacctggcggcagcgcaaaagatg

SEQ ID NO: 106564 - DNA, 103 bp, Artificial Sequence
  Synthetic Polynucleotide
taatacgactcactatagggggggactgtgcaaacttccgggcgatgcagaacagaggagactgcatatgccggaagttaacctggcggcagcgcaaaagatg

SEQ ID NO: 106565 - DNA, 103 bp, Artificial Sequence
  Synthetic Polynucleotide
taatacgactcactataggggccagctgctggggactgtgcaaacttccgaacagaggagacggaagatggcacagtccaacctggcggcagcgcaaaagatg

SEQ ID NO: 106566 - DNA, 103 bp, Artificial Sequence
  Synthetic Polynucleotide
taatacgactcactatagggtatacttccatcatgctgggattcaactgtaacagaggagaacagttatgtcccagcataacctggcggcagcgcaaaagatg

SEQ ID NO: 106567 - DNA, 103 bp, Artificial Sequence
  Synthetic Polynucleotide
taatacgactcactatagggtgcttcttctgccagctgctggggactgtgaacagaggagacacagtatgcagcagctgaacctggcggcagcgcaaaagatg

SEQ ID NO: 106568 - DNA, 103 bp, Artificial Sequence
  Synthetic Polynucleotide
taatacgactcactataggggtttgcgtgttgcttcttctgccagctgctaacagaggagaagcagcatgcagaagaagaacctggcggcagcgcaaaagatg

SEQ ID NO: 106569 - DNA, 103 bp, Artificial Sequence
  Synthetic Polynucleotide
taatacgactcactatagggctcagctctcgtttgcgtgttgcttcttctaacagaggagaagaagaatgaacacgcaaaacctggcggcagcgcaaaagatg

SEQ ID NO: 106570 - DNA, 103 bp, Artificial Sequence
  Synthetic Polynucleotide
taatacgactcactatagggtttcattagcctcagctctcgtttgcgtgtaacagaggagaacacgcatgcgagagctgaacctggcggcagcgcaaaagatg

SEQ ID NO: 106571 - DNA, 103 bp, Artificial Sequence
  Synthetic Polynucleotide
taatacgactcactatagggcttccctgtttttcattagcctcagctctcaacagaggagagagagcatgggctaatgaaacctggcggcagcgcaaaagatg

SEQ ID NO: 106572 - DNA, 103 bp, Artificial Sequence
  Synthetic Polynucleotide
taatacgactcactatagggtcccgggcagcttccctgtttttcattagcaacagaggagagctaatatgaaacagggaaacctggcggcagcgcaaaagatg

SEQ ID NO: 106573 - DNA, 103 bp, Artificial Sequence
  Synthetic Polynucleotide
taatacgactcactatagggcctgcgacactcccgggcagcttccctgttaacagaggagaaacaggatggctgcccggaacctggcggcagcgcaaaagatg

SEQ ID NO: 106574 - DNA, 103 bp, Artificial Sequence
  Synthetic Polynucleotide
taatacgactcactatagggctttcttcttcctgcgacactcccgggcagaacagaggagactgcccatgagtgtcgcaaacctggcggcagcgcaaaagatg

SEQ ID NO: 106575 - DNA, 103 bp, Artificial Sequence
  Synthetic Polynucleotide
taatacgactcactatagggttgacatattctttcttcttcctgcgacacaacagaggagagtgtcgatggaagaagaaaacctggcggcagcgcaaaagatg

SEQ ID NO: 106576 - DNA, 103 bp, Artificial Sequence
  Synthetic Polynucleotide
taatacgactcactatagggttcaagacatttgacatattctttcttcttaacagaggagaaagaagatggaatatgtcaacctggcggcagcgcaaaagatg

SEQ ID NO: 106577 - DNA, 103 bp, Artificial Sequence
  Synthetic Polynucleotide
taatacgactcactatagggaagaagctgttatacttccatcatgctgggaacagaggagacccagcatgatggaagtaaacctggcggcagcgcaaaagatg

SEQ ID NO: 106578 - DNA, 103 bp, Artificial Sequence
  Synthetic Polynucleotide
taatacgactcactatagggccacacgattttcaagacatttgacatattaacagaggagaaatatgatgaatgtcttgaacctggcggcagcgcaaaagatg

SEQ ID NO: 106579 - DNA, 103 bp, Artificial Sequence
  Synthetic Polynucleotide
taatacgactcactatagggtcaagcacagccacacgattttcaagacataacagaggagaatgtctatgaaatcgtgtaacctggcggcagcgcaaaagatg

SEQ ID NO: 106580 - DNA, 103 bp, Artificial Sequence
  Synthetic Polynucleotide
taatacgactcactataggggttttggttttcaagcacagccacacgattaacagaggagaaatcgtatggctgtgcttaacctggcggcagcgcaaaagatg

SEQ ID NO: 106581 - DNA, 103 bp, Artificial Sequence
  Synthetic Polynucleotide
taatacgactcactatagggtgagagtcttgttttggttttcaagcacagaacagaggagactgtgcatgaaaaccaaaaacctggcggcagcgcaaaagatg

SEQ ID NO: 106582 - DNA, 103 bp, Artificial Sequence
  Synthetic Polynucleotide
taatacgactcactatagggagttcctcaatgagagtcttgttttggtttaacagaggagaaaaccaatgcaagactctaacctggcggcagcgcaaaagatg

SEQ ID NO: 106583 - DNA, 103 bp, Artificial Sequence
  Synthetic Polynucleotide
taatacgactcactataggggagggccttgagttcctcaatgagagtcttaacagaggagaaagactatgattgaggaaaacctggcggcagcgcaaaagatg

SEQ ID NO: 106584 - DNA, 103 bp, Artificial Sequence
  Synthetic Polynucleotide
taatacgactcactatagggaaagatctttgagggccttgagttcctcaaaacagaggagattgaggatgtcaaggcccaacctggcggcagcgcaaaagatg

SEQ ID NO: 106585 - DNA, 103 bp, Artificial Sequence
  Synthetic Polynucleotide
taatacgactcactatagggttatggcaataaagatctttgagggccttgaacagaggagacaaggcatgcaaagatctaacctggcggcagcgcaaaagatg

SEQ ID NO: 106586 - DNA, 103 bp, Artificial Sequence
  Synthetic Polynucleotide
taatacgactcactatagggttactctactttatggcaataaagatctttaacagaggagaaaagatatgtattgccataacctggcggcagcgcaaaagatg

SEQ ID NO: 106587 - DNA, 103 bp, Artificial Sequence
  Synthetic Polynucleotide
taatacgactcactatagggctctctgtcaaagaagctgttatacttccaaacagaggagatggaagatgaacagcttcaacctggcggcagcgcaaaagatg

SEQ ID NO: 106588 - DNA, 103 bp, Artificial Sequence
  Synthetic Polynucleotide
taatacgactcactataggggtggggccccgggttcatatacgccatcataacagaggagaatgatgatgtatatgaacaacctggcggcagcgcaaaagatg

SEQ ID NO: 106589 - DNA, 103 bp, Artificial Sequence
  Synthetic Polynucleotide
taatacgactcactatagggccgctgcttcctgggggcgcttgggtagggaacagaggagaccctacatgagcgcccccaacctggcggcagcgcaaaagatg

SEQ ID NO: 106590 - DNA, 103 bp, Artificial Sequence
  Synthetic Polynucleotide
taatacgactcactatagggtgcgctcccgccgctgcttcctgggggcgcaacagaggagagcgcccatgggaagcagcaacctggcggcagcgcaaaagatg

SEQ ID NO: 106591 - DNA, 103 bp, Artificial Sequence
  Synthetic Polynucleotide
taatacgactcactataggggtgaaggtggtgcgctcccgccgctgcttcaacagaggagagaagcaatggcgggagcgaacctggcggcagcgcaaaagatg

SEQ ID NO: 106592 - DNA, 103 bp, Artificial Sequence
  Synthetic Polynucleotide
taatacgactcactatagggttggctccgggtgaaggtggtgcgctcccgaacagaggagacgggagatgaccaccttcaacctggcggcagcgcaaaagatg

SEQ ID NO: 106593 - DNA, 103 bp, Artificial Sequence
  Synthetic Polynucleotide
taatacgactcactataggggctcctccagttggctccgggtgaaggtggaacagaggagaccacctatgcccggagccaacctggcggcagcgcaaaagatg

SEQ ID NO: 106594 - DNA, 103 bp, Artificial Sequence
  Synthetic Polynucleotide
taatacgactcactatagggagtgcctccagctcctccagttggctccggaacagaggagaccggagatgactggaggaaacctggcggcagcgcaaaagatg

SEQ ID NO: 106595 - DNA, 103 bp, Artificial Sequence
  Synthetic Polynucleotide
taatacgactcactatagggcttggcaaacagtgcctccagctcctccagaacagaggagactggagatgctggaggcaaacctggcggcagcgcaaaagatg

SEQ ID NO: 106596 - DNA, 103 bp, Artificial Sequence
  Synthetic Polynucleotide
taatacgactcactatagggggtactgggtcttggcaaacagtgcctccaaacagaggagatggaggatgtgtttgccaaacctggcggcagcgcaaaagatg

SEQ ID NO: 106597 - DNA, 103 bp, Artificial Sequence
  Synthetic Polynucleotide
taatacgactcactatagggtagacgtctgggtactgggtcttggcaaacaacagaggagagtttgcatggacccagtaaacctggcggcagcgcaaaagatg

SEQ ID NO: 106598 - DNA, 103 bp, Artificial Sequence
  Synthetic Polynucleotide
taatacgactcactatagggctcacgggcatagacgtctgggtactgggtaacagaggagaacccagatgccagacgtcaacctggcggcagcgcaaaagatg

SEQ ID NO: 106599 - DNA, 103 bp, Artificial Sequence
  Synthetic Polynucleotide
taatacgactcactatagggtgacagaatagtggggccccgggttcatataacagaggagaatatgaatgcggggccccaacctggcggcagcgcaaaagatg

SEQ ID NO: 106600 - DNA, 103 bp, Artificial Sequence
  Synthetic Polynucleotide
taatacgactcactataggggagccacctcctcacgggcatagacgtctgaacagaggagacagacgatgatgcccgtgaacctggcggcagcgcaaaagatg

SEQ ID NO: 106601 - DNA, 103 bp, Artificial Sequence
  Synthetic Polynucleotide
taatacgactcactatagggttgatcttcagagccacctcctcacgggcaaacagaggagatgcccgatgggaggtggcaacctggcggcagcgcaaaagatg

SEQ ID NO: 106602 - DNA, 103 bp, Artificial Sequence
  Synthetic Polynucleotide
taatacgactcactatagggctcaggcagattgatcttcagagccacctcaacagaggagagaggtgatgctgaagatcaacctggcggcagcgcaaaagatg

SEQ ID NO: 106603 - DNA, 103 bp, Artificial Sequence
  Synthetic Polynucleotide
taatacgactcactataggggaaccctggactcaggcagattgatcttcaaacagaggagatgaagaatgatctgcctgaacctggcggcagcgcaaaagatg

SEQ ID NO: 106604 - DNA, 103 bp, Artificial Sequence
  Synthetic Polynucleotide
taatacgactcactatagggaaccaaacctgaaccctggactcaggcagaaacagaggagatctgccatggtccagggtaacctggcggcagcgcaaaagatg

SEQ ID NO: 106605 - DNA, 103 bp, Artificial Sequence
  Synthetic Polynucleotide
taatacgactcactatagggccggttcttgaaccaaacctgaaccctggaaacagaggagatccaggatgcaggtttggaacctggcggcagcgcaaaagatg

SEQ ID NO: 106606 - DNA, 103 bp, Artificial Sequence
  Synthetic Polynucleotide
taatacgactcactatagggatttagccctccggttcttgaaccaaacctaacagaggagaaggtttatgtcaagaaccaacctggcggcagcgcaaaagatg

SEQ ID NO: 106607 - DNA, 103 bp, Artificial Sequence
  Synthetic Polynucleotide
taatacgactcactatagggtgctgcctgcatttagccctccggttcttgaacagaggagacaagaaatggagggctaaaacctggcggcagcgcaaaagatg

SEQ ID NO: 106608 - DNA, 103 bp, Artificial Sequence
  Synthetic Polynucleotide
taatacgactcactatagggctgctgtcgctgctgcctgcatttagccctaacagaggagaagggctatgtgcaggcagaacctggcggcagcgcaaaagatg

SEQ ID NO: 106609 - DNA, 103 bp, Artificial Sequence
  Synthetic Polynucleotide
taatacgactcactataggggctgtttctgctgctgtcgctgctgcctgcaacagaggagagcaggcatgagcgacagcaacctggcggcagcgcaaaagatg

SEQ ID NO: 106610 - DNA, 103 bp, Artificial Sequence
  Synthetic Polynucleotide
taatacgactcactataggggccaaggcgttgacagaatagtggggccccaacagaggagaggggccatgctattctgtaacctggcggcagcgcaaaagatg

SEQ ID NO: 106611 - DNA, 103 bp, Artificial Sequence
  Synthetic Polynucleotide
taatacgactcactatagggggctgctgctgctgtttctgctgctgtcgcaacagaggagagcgacaatggcagaaacaaacctggcggcagcgcaaaagatg

SEQ ID NO: 106612 - DNA, 103 bp, Artificial Sequence
  Synthetic Polynucleotide
taatacgactcactataggggccccctgggggctgctgctgctgtttctgaacagaggagacagaaaatgcagcagcagaacctggcggcagcgcaaaagatg

SEQ ID NO: 106613 - DNA, 103 bp, Artificial Sequence
  Synthetic Polynucleotide
taatacgactcactatagggccttggcctggccccctgggggctgctgctaacagaggagaagcagcatgccccaggggaacctggcggcagcgcaaaagatg

SEQ ID NO: 106614 - DNA, 103 bp, Artificial Sequence
  Synthetic Polynucleotide
taatacgactcactataggggcaggccgggccttggcctggccccctgggaacagaggagacccaggatgccaggccaaaacctggcggcagcgcaaaagatg

SEQ ID NO: 106615 - DNA, 103 bp, Artificial Sequence
  Synthetic Polynucleotide
taatacgactcactatagggcttcctcttggcaggccgggccttggcctgaacagaggagacaggccatggcccggcctaacctggcggcagcgcaaaagatg

SEQ ID NO: 106616 - DNA, 103 bp, Artificial Sequence
  Synthetic Polynucleotide
taatacgactcactatagggacgtgcccgccttcctcttggcaggccgggaacagaggagacccggcatgccaagaggaaacctggcggcagcgcaaaagatg

SEQ ID NO: 106617 - DNA, 103 bp, Artificial Sequence
  Synthetic Polynucleotide
taatacgactcactatagggggtcttggggacgtgcccgccttcctcttgaacagaggagacaagagatgggcgggcacaacctggcggcagcgcaaaagatg

SEQ ID NO: 106618 - DNA, 103 bp, Artificial Sequence
  Synthetic Polynucleotide
taatacgactcactatagggatctgtggagggtcttggggacgtgcccgcaacagaggagagcgggcatgtccccaagaaacctggcggcagcgcaaaagatg

SEQ ID NO: 106619 - DNA, 103 bp, Artificial Sequence
  Synthetic Polynucleotide
taatacgactcactatagggctggacacacatctgtggagggtcttggggaacagaggagaccccaaatgcctccacagaacctggcggcagcgcaaaagatg

SEQ ID NO: 106620 - DNA, 103 bp, Artificial Sequence
  Synthetic Polynucleotide
taatacgactcactatagggcccagagggtctggacacacatctgtggagaacagaggagactccacatgtgtgtgtccaacctggcggcagcgcaaaagatg

SEQ ID NO: 106621 - DNA, 103 bp, Artificial Sequence
  Synthetic Polynucleotide
taatacgactcactataggggccacttagggccaaggcgttgacagaataaacagaggagatattctatgaacgccttgaacctggcggcagcgcaaaagatg

SEQ ID NO: 106622 - DNA, 103 bp, Artificial Sequence
  Synthetic Polynucleotide
taatacgactcactatagggatctgagatgcccagagggtctggacacacaacagaggagagtgtgtatggaccctctgaacctggcggcagcgcaaaagatg

SEQ ID NO: 106623 - DNA, 103 bp, Artificial Sequence
  Synthetic Polynucleotide
taatacgactcactataggggactgtaggaatctgagatgcccagagggtaacagaggagaaccctcatggcatctcagaacctggcggcagcgcaaaagatg

SEQ ID NO: 106624 - DNA, 103 bp, Artificial Sequence
  Synthetic Polynucleotide
taatacgactcactatagggggcagagggggactgtaggaatctgagatgaacagaggagacatctcatgttcctacagaacctggcggcagcgcaaaagatg

SEQ ID NO: 106625 - DNA, 103 bp, Artificial Sequence
  Synthetic Polynucleotide
taatacgactcactatagggtgaggggccgggcagagggggactgtaggaaacagaggagatcctacatgccccctctgaacctggcggcagcgcaaaagatg

SEQ ID NO: 106626 - DNA, 103 bp, Artificial Sequence
  Synthetic Polynucleotide
taatacgactcactatagggttggggagcctgaggggccgggcagaggggaacagaggagacccctcatgccggcccctaacctggcggcagcgcaaaagatg

SEQ ID NO: 106627 - DNA, 103 bp, Artificial Sequence
  Synthetic Polynucleotide
taatacgactcactatagggactgccgtggttggggagcctgaggggccgaacagaggagacggcccatgaggctccccaacctggcggcagcgcaaaagatg

SEQ ID NO: 106628 - DNA, 103 bp, Artificial Sequence
  Synthetic Polynucleotide
taatacgactcactatagggcacagtggccactgccgtggttggggagccaacagaggagaggctccatgaccacggcaaacctggcggcagcgcaaaagatg

SEQ ID NO: 106629 - DNA, 103 bp, Artificial Sequence
  Synthetic Polynucleotide
taatacgactcactatagggtccagatggacacagtggccactgccgtggaacagaggagaccacggatgtggccactgaacctggcggcagcgcaaaagatg

SEQ ID NO: 106630 - DNA, 103 bp, Artificial Sequence
  Synthetic Polynucleotide
taatacgactcactataggggaggctgggctccagatggacacagtggccaacagaggagaggccacatggtccatctgaacctggcggcagcgcaaaagatg

SEQ ID NO: 106631 - DNA, 103 bp, Artificial Sequence
  Synthetic Polynucleotide
taatacgactcactatagggaggggactctgaggctgggctccagatggaaacagaggagatccatcatgagcccagccaacctggcggcagcgcaaaagatg

SEQ ID NO: 106632 - DNA, 103 bp, Artificial Sequence
  Synthetic Polynucleotide
taatacgactcactatagggccacactggggccacttagggccaaggcgtaacagaggagaacgcctatgccctaagtgaacctggcggcagcgcaaaagatg

SEQ ID NO: 106633 - DNA, 103 bp, Artificial Sequence
  Synthetic Polynucleotide
taatacgactcactatagggcctcaggcaaaggggactctgaggctgggcaacagaggagagcccagatgcagagtcccaacctggcggcagcgcaaaagatg

SEQ ID NO: 106634 - DNA, 103 bp, Artificial Sequence
  Synthetic Polynucleotide
taatacgactcactataggggcccgctgcgcctcaggcaaaggggactctaacagaggagaagagtcatgtttgcctgaaacctggcggcagcgcaaaagatg

SEQ ID NO: 106635 - DNA, 103 bp, Artificial Sequence
  Synthetic Polynucleotide
taatacgactcactatagggcaccagcccagcccgctgcgcctcaggcaaaacagaggagattgcctatggcgcagcggaacctggcggcagcgcaaaagatg

SEQ ID NO: 106636 - DNA, 103 bp, Artificial Sequence
  Synthetic Polynucleotide
taatacgactcactataggggccctgaggccaccagcccagcccgctgcgaacagaggagacgcagcatgctgggctggaacctggcggcagcgcaaaagatg

SEQ ID NO: 106637 - DNA, 103 bp, Artificial Sequence
  Synthetic Polynucleotide
taatacgactcactataggggtcagagacggccctgaggccaccagcccaaacagaggagatgggctatgggcctcaggaacctggcggcagcgcaaaagatg

SEQ ID NO: 106638 - DNA, 103 bp, Artificial Sequence
  Synthetic Polynucleotide
taatacgactcactataggggggggcggaggtcagagacggccctgaggcaacagaggagagcctcaatgccgtctctgaacctggcggcagcgcaaaagatg

SEQ ID NO: 106639 - DNA, 103 bp, Artificial Sequence
  Synthetic Polynucleotide
taatacgactcactatagggtcatggcatagggggcggaggtcagagacgaacagaggagacgtctcatgcctccgcccaacctggcggcagcgcaaaagatg

SEQ ID NO: 106640 - DNA, 103 bp, Artificial Sequence
  Synthetic Polynucleotide
taatacgactcactatagggggggcgtaggtcatggcatagggggcggagaacagaggagactccgcatgctatgccataacctggcggcagcgcaaaagatg

SEQ ID NO: 106641 - DNA, 103 bp, Artificial Sequence
  Synthetic Polynucleotide
taatacgactcactatagggagcggaggccggggcgtaggtcatggcataaacagaggagatatgccatgacctacgccaacctggcggcagcgcaaaagatg

SEQ ID NO: 106642 - DNA, 103 bp, Artificial Sequence
  Synthetic Polynucleotide
taatacgactcactatagggaagagcagaaagcggaggccggggcgtaggaacagaggagacctacgatgcggcctccgaacctggcggcagcgcaaaagatg

SEQ ID NO: 106643 - DNA, 103 bp, Artificial Sequence
  Synthetic Polynucleotide
taatacgactcactatagggtgcatcagatccacactggggccacttaggaacagaggagacctaagatgccccagtgtaacctggcggcagcgcaaaagatg

SEQ ID NO: 106644 - DNA, 103 bp, Artificial Sequence
  Synthetic Polynucleotide
taatacgactcactataggggcggagggggaagagcagaaagcggaggccaacagaggagaggcctcatgtttctgctcaacctggcggcagcgcaaaagatg

SEQ ID NO: 106645 - DNA, 103 bp, Artificial Sequence
  Synthetic Polynucleotide
taatacgactcactatagggagacccataggcggagggggaagagcagaaaacagaggagattctgcatgtccccctccaacctggcggcagcgcaaaagatg

SEQ ID NO: 106646 - DNA, 103 bp, Artificial Sequence
  Synthetic Polynucleotide
taatacgactcactatagggaggagctcggagacccataggcggagggggaacagaggagaccccctatgcctatgggtaacctggcggcagcgcaaaagatg

SEQ ID NO: 106647 - DNA, 103 bp, Artificial Sequence
  Synthetic Polynucleotide
taatacgactcactatagggccgctgaaataggagctcggagacccatagaacagaggagactatggatgtccgagctcaacctggcggcagcgcaaaagatg

SEQ ID NO: 106648 - DNA, 103 bp, Artificial Sequence
  Synthetic Polynucleotide
taatacgactcactatagggggggtctaggccgctgaaataggagctcggaacagaggagaccgagcatgtatttcagcaacctggcggcagcgcaaaagatg

SEQ ID NO: 106649 - DNA, 103 bp, Artificial Sequence
  Synthetic Polynucleotide
taatacgactcactataggggagaaaggtaggggtctaggccgctgaaataacagaggagaatttcaatggcctagaccaacctggcggcagcgcaaaagatg

SEQ ID NO: 106650 - DNA, 103 bp, Artificial Sequence
  Synthetic Polynucleotide
taatacgactcactatagggggcaccatgggagaaaggtaggggtctaggaacagaggagacctagaatgctacctttcaacctggcggcagcgcaaaagatg

SEQ ID NO: 106651 - DNA, 103 bp, Artificial Sequence
  Synthetic Polynucleotide
taatacgactcactatagggccctagctggggcaccatgggagaaaggtaaacagaggagataccttatgcccatggtgaacctggcggcagcgcaaaagatg

SEQ ID NO: 106652 - DNA, 103 bp, Artificial Sequence
  Synthetic Polynucleotide
taatacgactcactataggggagccgggccccctagctggggcaccatggaacagaggagaccatggatgcccagctagaacctggcggcagcgcaaaagatg

SEQ ID NO: 106653 - DNA, 103 bp, Artificial Sequence
  Synthetic Polynucleotide
taatacgactcactatagggagggggctaagagccgggccccctagctggaacagaggagaccagctatggggcccggcaacctggcggcagcgcaaaagatg

SEQ ID NO: 106654 - DNA, 103 bp, Artificial Sequence
  Synthetic Polynucleotide
taatacgactcactatagggcacagcctggtgcatcagatccacactgggaacagaggagacccagtatggatctgatgaacctggcggcagcgcaaaagatg

SEQ ID NO: 106655 - DNA, 103 bp, Artificial Sequence
  Synthetic Polynucleotide
taatacgactcactatagggggggccagagagggggctaagagccgggccaacagaggagaggcccgatgcttagccccaacctggcggcagcgcaaaagatg

SEQ ID NO: 106656 - DNA, 103 bp, Artificial Sequence
  Synthetic Polynucleotide
taatacgactcactataggggtcccacggaggggccagagagggggctaaaacagaggagattagccatgtctctggccaacctggcggcagcgcaaaagatg

SEQ ID NO: 106657 - DNA, 103 bp, Artificial Sequence
  Synthetic Polynucleotide
taatacgactcactataggggccagggaaggtcccacggaggggccagagaacagaggagactctggatgctccgtgggaacctggcggcagcgcaaaagatg

SEQ ID NO: 106658 - DNA, 103 bp, Artificial Sequence
  Synthetic Polynucleotide
taatacgactcactataggggggggactgggccagggaaggtcccacggaaacagaggagatccgtgatgccttccctgaacctggcggcagcgcaaaagatg

SEQ ID NO: 106659 - DNA, 103 bp, Artificial Sequence
  Synthetic Polynucleotide
taatacgactcactatagggatagggaggtgggggactgggccagggaagaacagaggagacttcccatgcccagtcccaacctggcggcagcgcaaaagatg

SEQ ID NO: 106660 - DNA, 103 bp, Artificial Sequence
  Synthetic Polynucleotide
taatacgactcactatagggctctggcctgatagggaggtgggggactggaacagaggagaccagtcatgcacctccctaacctggcggcagcgcaaaagatg

SEQ ID NO: 106661 - DNA, 103 bp, Artificial Sequence
  Synthetic Polynucleotide
taatacgactcactatagggggcgccatagctctggcctgatagggaggtaacagaggagaacctccatgtcaggccagaacctggcggcagcgcaaaagatg

SEQ ID NO: 106662 - DNA, 103 bp, Artificial Sequence
  Synthetic Polynucleotide
taatacgactcactatagggcggggctgtaggcgccatagctctggcctgaacagaggagacaggccatggctatggcgaacctggcggcagcgcaaaagatg

SEQ ID NO: 106663 - DNA, 103 bp, Artificial Sequence
  Synthetic Polynucleotide
taatacgactcactatagggaagctatccacggggctgtaggcgccatagaacagaggagactatggatgctacagcccaacctggcggcagcgcaaaagatg

SEQ ID NO: 106664 - DNA, 103 bp, Artificial Sequence
  Synthetic Polynucleotide
taatacgactcactatagggcttgaattccaagctatccacggggctgtaaacagaggagatacagcatggtggatagcaacctggcggcagcgcaaaagatg

SEQ ID NO: 106665 - DNA, 103 bp, Artificial Sequence
  Synthetic Polynucleotide
taatacgactcactatagggttgggtagggcacagcctggtgcatcagataacagaggagaatctgaatgaccaggctgaacctggcggcagcgcaaaagatg

SEQ ID NO: 106666 - DNA, 103 bp, Artificial Sequence
  Synthetic Polynucleotide
taatacgactcactatagggccgtggggtccttgaattccaagctatccaaacagaggagatggataatgtggaattcaaacctggcggcagcgcaaaagatg

SEQ ID NO: 106667 - DNA, 103 bp, Artificial Sequence
  Synthetic Polynucleotide
taatacgactcactatagggttccaggtgcccgtggggtccttgaattccaacagaggagaggaattatgggaccccacaacctggcggcagcgcaaaagatg

SEQ ID NO: 106668 - DNA, 103 bp, Artificial Sequence
  Synthetic Polynucleotide
taatacgactcactataggggtaggtgaatttccaggtgcccgtggggtcaacagaggagagaccccatgggcacctggaacctggcggcagcgcaaaagatg

SEQ ID NO: 106669 - DNA, 103 bp, Artificial Sequence
  Synthetic Polynucleotide
taatacgactcactatagggccatgggattgtaggtgaatttccaggtgcaacagaggagagcacctatgaattcacctaacctggcggcagcgcaaaagatg

SEQ ID NO: 106670 - DNA, 103 bp, Artificial Sequence
  Synthetic Polynucleotide
taatacgactcactatagggtccagagggtccatgggattgtaggtgaataacagaggagaattcacatgcaatcccataacctggcggcagcgcaaaagatg

SEQ ID NO: 106671 - DNA, 103 bp, Artificial Sequence
  Synthetic Polynucleotide
taatacgactcactatagggatccttgtagtccagagggtccatgggattaacagaggagaaatcccatggaccctctgaacctggcggcagcgcaaaagatg

SEQ ID NO: 106672 - DNA, 103 bp, Artificial Sequence
  Synthetic Polynucleotide
taatacgactcactatagggaggcactctgatccttgtagtccagagggtaacagaggagaaccctcatgactacaaggaacctggcggcagcgcaaaagatg

SEQ ID NO: 106673 - DNA, 103 bp, Artificial Sequence
  Synthetic Polynucleotide
taatacgactcactatagggtgaaacttccaggcactctgatccttgtagaacagaggagactacaaatgtcagagtgcaacctggcggcagcgcaaaagatg

SEQ ID NO: 106674 - DNA, 103 bp, Artificial Sequence
  Synthetic Polynucleotide
taatacgactcactatagggctacaagatctgaaacttccaggcactctgaacagaggagacagagtatgtggaagtttaacctggcggcagcgcaaaagatg

SEQ ID NO: 106675 - DNA, 103 bp, Artificial Sequence
  Synthetic Polynucleotide
taatacgactcactatagggctgggggcgcttgggtagggcacagcctggaacagaggagaccaggcatggccctacccaacctggcggcagcgcaaaagatg

SEQ ID NO: 106676 - DNA, 103 bp, Artificial Sequence
  Synthetic Polynucleotide
taatacgactcactatagggtcggaaccagtgcacggcgttcacccccataacagaggagaatggggatgaacgccgtgaacctggcggcagcgcaaaagatg

SEQ ID NO: 106677 - DNA, 103 bp, Artificial Sequence
  Synthetic Polynucleotide
taatacgactcactatagggccaggggtccaggatgtagacgcagcggataacagaggagaatccgcatggtctacatcaacctggcggcagcgcaaaagatg

SEQ ID NO: 106678 - DNA, 103 bp, Artificial Sequence
  Synthetic Polynucleotide
taatacgactcactatagggaatccatggaaagcctgtccggccttccgcaacagaggagagcggaaatgcggacaggcaacctggcggcagcgcaaaagatg

SEQ ID NO: 106679 - DNA, 103 bp, Artificial Sequence
  Synthetic Polynucleotide
taatacgactcactatagggtgatggcatcaatccatggaaagcctgtccaacagaggagaggacagatgttccatggaaacctggcggcagcgcaaaagatg

SEQ ID NO: 106680 - DNA, 103 bp, Artificial Sequence
  Synthetic Polynucleotide
taatacgactcactatagggagctgtgtcatgatggcatcaatccatggaaacagaggagatccatgatgtgatgccataacctggcggcagcgcaaaagatg

SEQ ID NO: 106681 - DNA, 103 bp, Artificial Sequence
  Synthetic Polynucleotide
taatacgactcactatagggctcctgacgaagctgtgtcatgatggcatcaacagaggagagatgccatgatgacacagaacctggcggcagcgcaaaagatg

SEQ ID NO: 106682 - DNA, 103 bp, Artificial Sequence
  Synthetic Polynucleotide
taatacgactcactataggggaatccaaccctcctgacgaagctgtgtcaaacagaggagatgacacatgttcgtcaggaacctggcggcagcgcaaaagatg

SEQ ID NO: 106683 - DNA, 103 bp, Artificial Sequence
  Synthetic Polynucleotide
taatacgactcactataggggctagatgatgaatccaaccctcctgacgaaacagaggagatcgtcaatggggttggataacctggcggcagcgcaaaagatg

SEQ ID NO: 106684 - DNA, 103 bp, Artificial Sequence
  Synthetic Polynucleotide
taatacgactcactatagggtgcatgcctggctagatgatgaatccaaccaacagaggagaggttggatgcatcatctaaacctggcggcagcgcaaaagatg

SEQ ID NO: 106685 - DNA, 103 bp, Artificial Sequence
  Synthetic Polynucleotide
taatacgactcactatagggagcaagcaactgcatgcctggctagatgataacagaggagaatcatcatgccaggcatgaacctggcggcagcgcaaaagatg

SEQ ID NO: 106686 - DNA, 103 bp, Artificial Sequence
  Synthetic Polynucleotide
taatacgactcactatagggcgtgtcaggaagcaagcaactgcatgcctgaacagaggagacaggcaatgagttgcttgaacctggcggcagcgcaaaagatg

SEQ ID NO: 106687 - DNA, 103 bp, Artificial Sequence
  Synthetic Polynucleotide
taatacgactcactatagggcaggtcccctcgtgtcaggaagcaagcaacaacagaggagagttgctatgttcctgacaaacctggcggcagcgcaaaagatg

SEQ ID NO: 106688 - DNA, 103 bp, Artificial Sequence
  Synthetic Polynucleotide
taatacgactcactatagggagccggcgaaccaggggtccaggatgtagaaacagaggagatctacaatgtggacccctaacctggcggcagcgcaaaagatg

SEQ ID NO: 106689 - DNA, 103 bp, Artificial Sequence
  Synthetic Polynucleotide
taatacgactcactatagggaactaatccacaggtcccctcgtgtcaggaaacagaggagatcctgaatggaggggaccaacctggcggcagcgcaaaagatg

SEQ ID NO: 106690 - DNA, 103 bp, Artificial Sequence
  Synthetic Polynucleotide
taatacgactcactatagggccttcttcccaactaatccacaggtcccctaacagaggagaaggggaatggtggattagaacctggcggcagcgcaaaagatg

SEQ ID NO: 106691 - DNA, 103 bp, Artificial Sequence
  Synthetic Polynucleotide
taatacgactcactatagggtaccttcattccttcttcccaactaatccaaacagaggagatggattatgtgggaagaaaacctggcggcagcgcaaaagatg

SEQ ID NO: 106692 - DNA, 103 bp, Artificial Sequence
  Synthetic Polynucleotide
taatacgactcactatagggattcttcaaataccttcattccttcttcccaacagaggagagggaagatggaatgaaggaacctggcggcagcgcaaaagatg

SEQ ID NO: 106693 - DNA, 103 bp, Artificial Sequence
  Synthetic Polynucleotide
taatacgactcactatagggtcaagcaataattcttcaaataccttcattaacagaggagaaatgaaatgatttgaagaaacctggcggcagcgcaaaagatg

SEQ ID NO: 106694 - DNA, 103 bp, Artificial Sequence
  Synthetic Polynucleotide
taatacgactcactatagggccaatctgcatcaagcaataattcttcaaaaacagaggagatttgaaatgttattgcttaacctggcggcagcgcaaaagatg

SEQ ID NO: 106695 - DNA, 103 bp, Artificial Sequence
  Synthetic Polynucleotide
taatacgactcactatagggcatttatgctccaatctgcatcaagcaataaacagaggagatattgcatgatgcagattaacctggcggcagcgcaaaagatg

SEQ ID NO: 106696 - DNA, 103 bp, Artificial Sequence
  Synthetic Polynucleotide
taatacgactcactatagggcaacttccagcatttatgctccaatctgcaaacagaggagatgcagaatggagcataaaaacctggcggcagcgcaaaagatg

SEQ ID NO: 106697 - DNA, 103 bp, Artificial Sequence
  Synthetic Polynucleotide
taatacgactcactatagggcagccacatccaacttccagcatttatgctaacagaggagaagcataatggctggaagtaacctggcggcagcgcaaaagatg

SEQ ID NO: 106698 - DNA, 103 bp, Artificial Sequence
  Synthetic Polynucleotide
taatacgactcactatagggaactacaagacagccacatccaacttccagaacagaggagactggaaatgggatgtggcaacctggcggcagcgcaaaagatg

SEQ ID NO: 106699 - DNA, 103 bp, Artificial Sequence
  Synthetic Polynucleotide
taatacgactcactatagggacattggaggagccggcgaaccaggggtccaacagaggagaggacccatggttcgccggaacctggcggcagcgcaaaagatg

SEQ ID NO: 106700 - DNA, 103 bp, Artificial Sequence
  Synthetic Polynucleotide
taatacgactcactatagggtgaaaaaaggaactacaagacagccacatcaacagaggagagatgtgatggtcttgtagaacctggcggcagcgcaaaagatg

SEQ ID NO: 106701 - DNA, 103 bp, Artificial Sequence
  Synthetic Polynucleotide
taatacgactcactatagggaaaaaactgttgaaaaaaggaactacaagaaacagaggagatcttgtatgtccttttttaacctggcggcagcgcaaaagatg

SEQ ID NO: 106702 - DNA, 103 bp, Artificial Sequence
  Synthetic Polynucleotide
taatacgactcactatagggaatagcagtgaaaaaactgttgaaaaaaggaacagaggagaccttttatgaacagttttaacctggcggcagcgcaaaagatg

SEQ ID NO: 106703 - DNA, 103 bp, Artificial Sequence
  Synthetic Polynucleotide
taatacgactcactatagggccaacagggcaatagcagtgaaaaaactgtaacagaggagaacagttatgtcactgctaaacctggcggcagcgcaaaagatg

SEQ ID NO: 106704 - DNA, 103 bp, Artificial Sequence
  Synthetic Polynucleotide
taatacgactcactatagggcctaccaaaaccaacagggcaatagcagtgaacagaggagacactgcatgtgccctgttaacctggcggcagcgcaaaagatg

SEQ ID NO: 106705 - DNA, 103 bp, Artificial Sequence
  Synthetic Polynucleotide
taatacgactcactataggggatctgttctcctaccaaaaccaacagggcaacagaggagagccctgatggttttggtaaacctggcggcagcgcaaaagatg

SEQ ID NO: 106706 - DNA, 103 bp, Artificial Sequence
  Synthetic Polynucleotide
taatacgactcactatagggtctccattgggatctgttctcctaccaaaaaacagaggagattttggatggagaacagaaacctggcggcagcgcaaaagatg

SEQ ID NO: 106707 - DNA, 103 bp, Artificial Sequence
  Synthetic Polynucleotide
taatacgactcactatagggcctgatatagtctccattgggatctgttctaacagaggagaagaacaatgcccaatggaaacctggcggcagcgcaaaagatg

SEQ ID NO: 106708 - DNA, 103 bp, Artificial Sequence
  Synthetic Polynucleotide
taatacgactcactataggggcaaataacgcctgatatagtctccattggaacagaggagaccaatgatgactatatcaaacctggcggcagcgcaaaagatg

SEQ ID NO: 106709 - DNA, 103 bp, Artificial Sequence
  Synthetic Polynucleotide
taatacgactcactatagggcttaggacaggcaaataacgcctgatatagaacagaggagactatatatggcgttatttaacctggcggcagcgcaaaagatg

SEQ ID NO: 106710 - DNA, 103 bp, Artificial Sequence
  Synthetic Polynucleotide
taatacgactcactataggggttgatgcccacattggaggagccggcgaaaacagaggagattcgccatgtcctccaataacctggcggcagcgcaaaagatg

SEQ ID NO: 106711 - DNA, 103 bp, Artificial Sequence
  Synthetic Polynucleotide
taatacgactcactatagggagggaagcctcttaggacaggcaaataacgaacagaggagacgttatatgcctgtcctaaacctggcggcagcgcaaaagatg

SEQ ID NO: 106712 - DNA, 103 bp, Artificial Sequence
  Synthetic Polynucleotide
taatacgactcactatagggtatattttgcagggaagcctcttaggacagaacagaggagactgtccatggaggcttccaacctggcggcagcgcaaaagatg

SEQ ID NO: 106713 - DNA, 103 bp, Artificial Sequence
  Synthetic Polynucleotide
taatacgactcactatagggggatcatagatatattttgcagggaagcctaacagaggagaaggcttatgtgcaaaataaacctggcggcagcgcaaaagatg

SEQ ID NO: 106714 - DNA, 103 bp, Artificial Sequence
  Synthetic Polynucleotide
taatacgactcactatagggtgcattccagggatcatagatatattttgcaacagaggagagcaaaaatgatctatgataacctggcggcagcgcaaaagatg

SEQ ID NO: 106715 - DNA, 103 bp, Artificial Sequence
  Synthetic Polynucleotide
taatacgactcactatagggtaccttctggtgcattccagggatcatagaaacagaggagatctatgatgcctggaatgaacctggcggcagcgcaaaagatg

SEQ ID NO: 106716 - DNA, 103 bp, Artificial Sequence
  Synthetic Polynucleotide
taatacgactcactatagggaccttttggataccttctggtgcattccagaacagaggagactggaaatgaccagaaggaacctggcggcagcgcaaaagatg

SEQ ID NO: 106717 - DNA, 103 bp, Artificial Sequence
  Synthetic Polynucleotide
taatacgactcactatagggacatttggctaccttttggataccttctggaacagaggagaccagaaatgatccaaaagaacctggcggcagcgcaaaagatg

SEQ ID NO: 106718 - DNA, 103 bp, Artificial Sequence
  Synthetic Polynucleotide
taatacgactcactatagggctcctatcaaacatttggctaccttttggaaacagaggagatccaaaatgtagccaaataacctggcggcagcgcaaaagatg

SEQ ID NO: 106719 - DNA, 103 bp, Artificial Sequence
  Synthetic Polynucleotide
taatacgactcactatagggggataattaactcctatcaaacatttggctaacagaggagaagccaaatgtttgataggaacctggcggcagcgcaaaagatg

SEQ ID NO: 106720 - DNA, 103 bp, Artificial Sequence
  Synthetic Polynucleotide
taatacgactcactatagggcattggtttaggataattaactcctatcaaaacagaggagattgataatggttaattataacctggcggcagcgcaaaagatg

SEQ ID NO: 106721 - DNA, 103 bp, Artificial Sequence
  Synthetic Polynucleotide
taatacgactcactatagggatcgccacctgttgatgcccacattggaggaacagaggagacctccaatgtgggcatcaaacctggcggcagcgcaaaagatg

SEQ ID NO: 106722 - DNA, 103 bp, Artificial Sequence
  Synthetic Polynucleotide
taatacgactcactatagggcatggttcaccattggtttaggataattaaaacagaggagattaattatgctaaaccaaaacctggcggcagcgcaaaagatg

SEQ ID NO: 106723 - DNA, 103 bp, Artificial Sequence
  Synthetic Polynucleotide
taatacgactcactatagggcttgcctcagcatggttcaccattggtttaaacagaggagataaaccatgggtgaaccaaacctggcggcagcgcaaaagatg

SEQ ID NO: 106724 - DNA, 103 bp, Artificial Sequence
  Synthetic Polynucleotide
taatacgactcactatagggattcaaacggcttgcctcagcatggttcacaacagaggagagtgaacatggctgaggcaaacctggcggcagcgcaaaagatg

SEQ ID NO: 106725 - DNA, 103 bp, Artificial Sequence
  Synthetic Polynucleotide
taatacgactcactatagggtcctttcgatattcaaacggcttgcctcagaacagaggagactgaggatggccgtttgaaacctggcggcagcgcaaaagatg

SEQ ID NO: 106726 - DNA, 103 bp, Artificial Sequence
  Synthetic Polynucleotide
taatacgactcactatagggatctgtttcatcctttcgatattcaaacggaacagaggagaccgtttatgtatcgaaagaacctggcggcagcgcaaaagatg

SEQ ID NO: 106727 - DNA, 103 bp, Artificial Sequence
  Synthetic Polynucleotide
taatacgactcactatagggctgctgatagatctgtttcatcctttcgataacagaggagaatcgaaatgatgaaacagaacctggcggcagcgcaaaagatg

SEQ ID NO: 106728 - DNA, 103 bp, Artificial Sequence
  Synthetic Polynucleotide
taatacgactcactatagggatcgtgaaagctgctgatagatctgtttcaaacagaggagatgaaacatgtctatcagcaacctggcggcagcgcaaaagatg

SEQ ID NO: 106729 - DNA, 103 bp, Artificial Sequence
  Synthetic Polynucleotide
taatacgactcactatagggagtcctctatatcgtgaaagctgctgatagaacagaggagactatcaatggctttcacgaacctggcggcagcgcaaaagatg

SEQ ID NO: 106730 - DNA, 103 bp, Artificial Sequence
  Synthetic Polynucleotide
taatacgactcactatagggcagaagacctagtcctctatatcgtgaaagaacagaggagactttcaatgtatagaggaaacctggcggcagcgcaaaagatg

SEQ ID NO: 106731 - DNA, 103 bp, Artificial Sequence
  Synthetic Polynucleotide
taatacgactcactataggggtactgatgccagaagacctagtcctctataacagaggagaatagagatgtaggtcttcaacctggcggcagcgcaaaagatg

SEQ ID NO: 106732 - DNA, 103 bp, Artificial Sequence
  Synthetic Polynucleotide
taatacgactcactatagggtgaagcaaaaatcgccacctgttgatgcccaacagaggagagggcatatgcaggtggcgaacctggcggcagcgcaaaagatg

SEQ ID NO: 106733 - DNA, 103 bp, Artificial Sequence
  Synthetic Polynucleotide
taatacgactcactatagggggattagaaggtactgatgccagaagacctaacagaggagaaggtctatgggcatcagtaacctggcggcagcgcaaaagatg

SEQ ID NO: 106734 - DNA, 103 bp, Artificial Sequence
  Synthetic Polynucleotide
taatacgactcactatagggattcccattaggattagaaggtactgatgcaacagaggagagcatcaatgccttctaataacctggcggcagcgcaaaagatg

SEQ ID NO: 106735 - DNA, 103 bp, Artificial Sequence
  Synthetic Polynucleotide
taatacgactcactatagggtgaagcctccattcccattaggattagaagaacagaggagacttctaatgctaatgggaaacctggcggcagcgcaaaagatg

SEQ ID NO: 106736 - DNA, 103 bp, Artificial Sequence
  Synthetic Polynucleotide
taatacgactcactataggggaatatcccatgaagcctccattcccattaaacagaggagataatggatgtggaggcttaacctggcggcagcgcaaaagatg

SEQ ID NO: 106737 - DNA, 103 bp, Artificial Sequence
  Synthetic Polynucleotide
taatacgactcactatagggattttctgcagaatatcccatgaagcctccaacagaggagaggaggcatgatgggatataacctggcggcagcgcaaaagatg

SEQ ID NO: 106738 - DNA, 103 bp, Artificial Sequence
  Synthetic Polynucleotide
taatacgactcactatagggaacctgggatattttctgcagaatatcccaaacagaggagatgggatatgctgcagaaaaacctggcggcagcgcaaaagatg

SEQ ID NO: 106739 - DNA, 103 bp, Artificial Sequence
  Synthetic Polynucleotide
taatacgactcactatagggctgctgctacaacctgggatattttctgcaaacagaggagatgcagaatgtatcccaggaacctggcggcagcgcaaaagatg

SEQ ID NO: 106740 - DNA, 103 bp, Artificial Sequence
  Synthetic Polynucleotide
taatacgactcactataggggcaacttccactgctgctacaacctgggataacagaggagaatcccaatgtgtagcagcaacctggcggcagcgcaaaagatg

SEQ ID NO: 106741 - DNA, 103 bp, Artificial Sequence
  Synthetic Polynucleotide
taatacgactcactatagggtcccttgagagcaacttccactgctgctacaacagaggagagtagcaatggtggaagttaacctggcggcagcgcaaaagatg

SEQ ID NO: 106742 - DNA, 103 bp, Artificial Sequence
  Synthetic Polynucleotide
taatacgactcactatagggaaaataccactcccttgagagcaacttccaaacagaggagatggaagatgctctcaaggaacctggcggcagcgcaaaagatg

SEQ ID NO: 106743 - DNA, 103 bp, Artificial Sequence
  Synthetic Polynucleotide
taatacgactcactatagggctcaagacactgaagcaaaaatcgccacctaacagaggagaaggtggatgtttttgcttaacctggcggcagcgcaaaagatg

SEQ ID NO: 106744 - DNA, 103 bp, Artificial Sequence
  Synthetic Polynucleotide
taatacgactcactatagggagcatagtgtaaaataccactcccttgagaaacagaggagatctcaaatgagtggtattaacctggcggcagcgcaaaagatg

SEQ ID NO: 106745 - DNA, 103 bp, Artificial Sequence
  Synthetic Polynucleotide
taatacgactcactatagggtgtcgccatgagcatagtgtaaaataccacaacagaggagagtggtaatgtacactatgaacctggcggcagcgcaaaagatg

SEQ ID NO: 106746 - DNA, 103 bp, Artificial Sequence
  Synthetic Polynucleotide
taatacgactcactataggggtttgctgactgtcgccatgagcatagtgtaacagaggagaacactaatgtcatggcgaaacctggcggcagcgcaaaagatg

SEQ ID NO: 106747 - DNA, 103 bp, Artificial Sequence
  Synthetic Polynucleotide
taatacgactcactatagggcaacaggtgagtttgctgactgtcgccatgaacagaggagacatggcatgagtcagcaaaacctggcggcagcgcaaaagatg

SEQ ID NO: 106748 - DNA, 103 bp, Artificial Sequence
  Synthetic Polynucleotide
taatacgactcactatagggttccttgcttcaacaggtgagtttgctgacaacagaggagagtcagcatgctcacctgtaacctggcggcagcgcaaaagatg

SEQ ID NO: 106749 - DNA, 103 bp, Artificial Sequence
  Synthetic Polynucleotide
taatacgactcactatagggatggagcttcttccttgcttcaacaggtgaaacagaggagatcacctatggaagcaaggaacctggcggcagcgcaaaagatg

SEQ ID NO: 106750 - DNA, 103 bp, Artificial Sequence
  Synthetic Polynucleotide
taatacgactcactatagggaccagtgcccatggagcttcttccttgcttaacagaggagaaagcaaatgagaagctccaacctggcggcagcgcaaaagatg

SEQ ID NO: 106751 - DNA, 103 bp, Artificial Sequence
  Synthetic Polynucleotide
taatacgactcactatagggcaccactgagaccagtgcccatggagcttcaacagaggagagaagctatgtgggcactgaacctggcggcagcgcaaaagatg

SEQ ID NO: 106752 - DNA, 103 bp, Artificial Sequence
  Synthetic Polynucleotide
taatacgactcactatagggggacgtttcccaccactgagaccagtgcccaacagaggagagggcacatgtctcagtggaacctggcggcagcgcaaaagatg

SEQ ID NO: 106753 - DNA, 103 bp, Artificial Sequence
  Synthetic Polynucleotide
taatacgactcactatagggttcctgactaggacgtttcccaccactgagaacagaggagactcagtatggggaaacgtaacctggcggcagcgcaaaagatg

SEQ ID NO: 106754 - DNA, 103 bp, Artificial Sequence
  Synthetic Polynucleotide
taatacgactcactatagggcatcaagatcctcaagacactgaagcaaaaaacagaggagattttgcatgagtgtcttgaacctggcggcagcgcaaaagatg

SEQ ID NO: 106755 - DNA, 103 bp, Artificial Sequence
  Synthetic Polynucleotide
taatacgactcactataggggtgtgtcctcttcctgactaggacgtttccaacagaggagaggaaacatgctagtcaggaacctggcggcagcgcaaaagatg

SEQ ID NO: 106756 - DNA, 103 bp, Artificial Sequence
  Synthetic Polynucleotide
taatacgactcactatagggccaatactctgtgtgtcctcttcctgactaaacagaggagatagtcaatgagaggacacaacctggcggcagcgcaaaagatg

SEQ ID NO: 106757 - DNA, 103 bp, Artificial Sequence
  Synthetic Polynucleotide
taatacgactcactataggggactttaggaccaatactctgtgtgtcctcaacagaggagagaggacatgcagagtattaacctggcggcagcgcaaaagatg

SEQ ID NO: 106758 - DNA, 103 bp, Artificial Sequence
  Synthetic Polynucleotide
taatacgactcactatagggtctgtctctggactttaggaccaatactctaacagaggagaagagtaatggtcctaaagaacctggcggcagcgcaaaagatg

SEQ ID NO: 106759 - DNA, 103 bp, Artificial Sequence
  Synthetic Polynucleotide
taatacgactcactatagggtaattagtgctctgtctctggactttaggaaacagaggagatcctaaatgccagagacaaacctggcggcagcgcaaaagatg

SEQ ID NO: 106760 - DNA, 103 bp, Artificial Sequence
  Synthetic Polynucleotide
taatacgactcactatagggcgtagattggcatcaagatcctcaagacacaacagaggagagtgtctatgggatcttgaaacctggcggcagcgcaaaagatg

SEQ ID NO: 106761 - DNA, 103 bp, Artificial Sequence
  Synthetic Polynucleotide
taatacgactcactataggggtttaattttcgtagattggcatcaagatcaacagaggagagatcttatggccaatctaaacctggcggcagcgcaaaagatg

SEQ ID NO: 106762 - DNA, 103 bp, Artificial Sequence
  Synthetic Polynucleotide
taatacgactcactatagggggagcccctttcggaaccagtgcacggcgtaacagaggagaacgccgatgactggttccaacctggcggcagcgcaaaagatg

SEQ ID NO: 106763 - DNA, 103 bp, Artificial Sequence
  Synthetic Polynucleotide
taatacgactcactatagggacagacgggagtttaattttcgtagattggaacagaggagaccaatcatggaaaattaaaacctggcggcagcgcaaaagatg

SEQ ID NO: 106764 - DNA, 103 bp, Artificial Sequence
  Synthetic Polynucleotide
taatacgactcactatagggcgaatcacaaacagacgggagtttaattttaacagaggagaaaaattatgctcccgtctaacctggcggcagcgcaaaagatg

SEQ ID NO: 106765 - DNA, 103 bp, Artificial Sequence
  Synthetic Polynucleotide
taatacgactcactatagggtggttgtccacgaatcacaaacagacgggaaacagaggagatcccgtatgtttgtgattaacctggcggcagcgcaaaagatg

SEQ ID NO: 106766 - DNA, 103 bp, Artificial Sequence
  Synthetic Polynucleotide
taatacgactcactatagggacacatctgctggttgtccacgaatcacaaaacagaggagattgtgaatggtggacaacaacctggcggcagcgcaaaagatg

SEQ ID NO: 106767 - DNA, 103 bp, Artificial Sequence
  Synthetic Polynucleotide
taatacgactcactatagggagcctgggaaacacatctgctggttgtccaaacagaggagatggacaatgagcagatgtaacctggcggcagcgcaaaagatg

SEQ ID NO: 106768 - DNA, 103 bp, Artificial Sequence
  Synthetic Polynucleotide
taatacgactcactatagggttccttgaaaagcctgggaaacacatctgcaacagaggagagcagatatgtttcccaggaacctggcggcagcgcaaaagatg

SEQ ID NO: 106769 - DNA, 103 bp, Artificial Sequence
  Synthetic Polynucleotide
taatacgactcactatagggtaatgttccattccttgaaaagcctgggaaaacagaggagattcccaatgttttcaaggaacctggcggcagcgcaaaagatg

SEQ ID NO: 106770 - DNA, 103 bp, Artificial Sequence
  Synthetic Polynucleotide
taatacgactcactataggggaaagtttagtaatgttccattccttgaaaaacagaggagatttcaaatgatggaacataacctggcggcagcgcaaaagatg

SEQ ID NO: 106771 - DNA, 103 bp, Artificial Sequence
  Synthetic Polynucleotide
taatacgactcactatagggatactcaattgaaagtttagtaatgttccaaacagaggagatggaacatgactaaacttaacctggcggcagcgcaaaagatg

SEQ ID NO: 106772 - DNA, 103 bp, Artificial Sequence
  Synthetic Polynucleotide
taatacgactcactataggggctcagaatcatactcaattgaaagtttagaacagaggagactaaacatgcaattgagtaacctggcggcagcgcaaaagatg

SEQ ID NO: 106773 - DNA, 103 bp, Artificial Sequence
  Synthetic Polynucleotide
taatacgactcactatagggtcgtggagccggagcccctttcggaaccagaacagaggagactggttatgaaaggggctaacctggcggcagcgcaaaagatg

SEQ ID NO: 106774 - DNA, 103 bp, Artificial Sequence
  Synthetic Polynucleotide
taatacgactcactatagggtttccaaagggctcagaatcatactcaattaacagaggagaaattgaatgtgattctgaaacctggcggcagcgcaaaagatg

SEQ ID NO: 106775 - DNA, 103 bp, Artificial Sequence
  Synthetic Polynucleotide
taatacgactcactataggggtctcgttcctttccaaagggctcagaatcaacagaggagagattctatgccctttggaaacctggcggcagcgcaaaagatg

SEQ ID NO: 106776 - DNA, 103 bp, Artificial Sequence
  Synthetic Polynucleotide
taatacgactcactatagggtaatagctgcgtctcgttcctttccaaaggaacagaggagacctttgatgaggaacgagaacctggcggcagcgcaaaagatg

SEQ ID NO: 106777 - DNA, 103 bp, Artificial Sequence
  Synthetic Polynucleotide
taatacgactcactataggggccagtttcttaatagctgcgtctcgttccaacagaggagaggaacgatgcgcagctataacctggcggcagcgcaaaagatg

SEQ ID NO: 106778 - DNA, 103 bp, Artificial Sequence
  Synthetic Polynucleotide
taatacgactcactatagggagcttcagttgccagtttcttaatagctgcaacagaggagagcagctatgaagaaactgaacctggcggcagcgcaaaagatg

SEQ ID NO: 106779 - DNA, 103 bp, Artificial Sequence
  Synthetic Polynucleotide
taatacgactcactatagggcttctactccagcttcagttgccagtttctaacagaggagaagaaacatgcaactgaagaacctggcggcagcgcaaaagatg

SEQ ID NO: 106780 - DNA, 103 bp, Artificial Sequence
  Synthetic Polynucleotide
taatacgactcactatagggcttacaatgacttctactccagcttcagttaacagaggagaaactgaatgtggagtagaaacctggcggcagcgcaaaagatg

SEQ ID NO: 106781 - DNA, 103 bp, Artificial Sequence
  Synthetic Polynucleotide
taatacgactcactatagggatgtgaaattcttacaatgacttctactccaacagaggagaggagtaatggtcattgtaaacctggcggcagcgcaaaagatg

SEQ ID NO: 106782 - DNA, 103 bp, Artificial Sequence
  Synthetic Polynucleotide
taatacgactcactatagggcatataatgtatgtgaaattcttacaatgaaacagaggagatcattgatggaatttcacaacctggcggcagcgcaaaagatg

SEQ ID NO: 106783 - DNA, 103 bp, Artificial Sequence
  Synthetic Polynucleotide
taatacgactcactatagggttgtctaggtcatataatgtatgtgaaattaacagaggagaaatttcatgtacattataaacctggcggcagcgcaaaagatg

SEQ ID NO: 106784 - DNA, 103 bp, Artificial Sequence
  Synthetic Polynucleotide
taatacgactcactatagggggcggggttgtcgtggagccggagccccttaacagaggagaaaggggatgcggctccacaacctggcggcagcgcaaaagatg

SEQ ID NO: 106785 - DNA, 103 bp, Artificial Sequence
  Synthetic Polynucleotide
taatacgactcactatagggttctatgatcttgtctaggtcatataatgtaacagaggagaacattaatggacctagacaacctggcggcagcgcaaaagatg

SEQ ID NO: 106786 - DNA, 103 bp, Artificial Sequence
  Synthetic Polynucleotide
taatacgactcactatagggcaccattgagttctatgatcttgtctaggtaacagaggagaacctagatgagatcatagaacctggcggcagcgcaaaagatg

SEQ ID NO: 106787 - DNA, 103 bp, Artificial Sequence
  Synthetic Polynucleotide
taatacgactcactatagggggcggttgtccaccattgagttctatgatcaacagaggagagatcatatgactcaatggaacctggcggcagcgcaaaagatg

SEQ ID NO: 106788 - DNA, 103 bp, Artificial Sequence
  Synthetic Polynucleotide
taatacgactcactatagggataagttagaggcggttgtccaccattgagaacagaggagactcaatatgggacaaccgaacctggcggcagcgcaaaagatg

SEQ ID NO: 106789 - DNA, 103 bp, Artificial Sequence
  Synthetic Polynucleotide
taatacgactcactatagggggaatcttttataagttagaggcggttgtcaacagaggagagacaacatgctctaacttaacctggcggcagcgcaaaagatg

SEQ ID NO: 106790 - DNA, 103 bp, Artificial Sequence
  Synthetic Polynucleotide
taatacgactcactatagggatgagagtctggaatcttttataagttagaaacagaggagatctaacatgtaaaagattaacctggcggcagcgcaaaagatg

SEQ ID NO: 106791 - DNA, 103 bp, Artificial Sequence
  Synthetic Polynucleotide
taatacgactcactatagggcattttgctgatgagagtctggaatcttttaacagaggagaaaaagaatgcagactctcaacctggcggcagcgcaaaagatg

SEQ ID NO: 106792 - DNA, 103 bp, Artificial Sequence
  Synthetic Polynucleotide
taatacgactcactatagggctagtggttccattttgctgatgagagtctaacagaggagaagactcatgtcagcaaaaaacctggcggcagcgcaaaagatg

SEQ ID NO: 106793 - DNA, 103 bp, Artificial Sequence
  Synthetic Polynucleotide
taatacgactcactatagggactggtatctctagtggttccattttgctgaacagaggagacagcaaatgggaaccactaacctggcggcagcgcaaaagatg

SEQ ID NO: 106794 - DNA, 103 bp, Artificial Sequence
  Synthetic Polynucleotide
taatacgactcactatagggaattgtctctactggtatctctagtggttcaacagaggagagaaccaatggagataccaaacctggcggcagcgcaaaagatg

SEQ ID NO: 106795 - DNA, 103 bp, Artificial Sequence
  Synthetic Polynucleotide
taatacgactcactatagggactccttcagggcggggttgtcgtggagccaacagaggagaggctccatgacaaccccgaacctggcggcagcgcaaaagatg

SEQ ID NO: 106796 - DNA, 103 bp, Artificial Sequence
  Synthetic Polynucleotide
taatacgactcactatagggcttctgaagtaattgtctctactggtatctaacagaggagaagatacatgtagagacaaaacctggcggcagcgcaaaagatg

SEQ ID NO: 106797 - DNA, 103 bp, Artificial Sequence
  Synthetic Polynucleotide
taatacgactcactatagggttttctatcacttctgaagtaattgtctctaacagaggagaagagacatgtacttcagaaacctggcggcagcgcaaaagatg

SEQ ID NO: 106798 - DNA, 103 bp, Artificial Sequence
  Synthetic Polynucleotide
taatacgactcactatagggagttgtgcacttttctatcacttctgaagtaacagaggagaacttcaatggtgatagaaaacctggcggcagcgcaaaagatg

SEQ ID NO: 106799 - DNA, 103 bp, Artificial Sequence
  Synthetic Polynucleotide
taatacgactcactatagggcagacagaggagttgtgcacttttctatcaaacagaggagatgatagatgagtgcacaaaacctggcggcagcgcaaaagatg

SEQ ID NO: 106800 - DNA, 103 bp, Artificial Sequence
  Synthetic Polynucleotide
taatacgactcactatagggtcatggtcatcagacagaggagttgtgcacaacagaggagagtgcacatgtcctctgtcaacctggcggcagcgcaaaagatg

SEQ ID NO: 106801 - DNA, 103 bp, Artificial Sequence
  Synthetic Polynucleotide
taatacgactcactatagggatatttctcatcatggtcatcagacagaggaacagaggagacctctgatggatgaccataacctggcggcagcgcaaaagatg

SEQ ID NO: 106802 - DNA, 103 bp, Artificial Sequence
  Synthetic Polynucleotide
taatacgactcactatagggaagggactccatatttctcatcatggtcataacagaggagaatgaccatgatgagaaataacctggcggcagcgcaaaagatg

SEQ ID NO: 106803 - DNA, 103 bp, Artificial Sequence
  Synthetic Polynucleotide
taatacgactcactatagggtcttccagtgaagggactccatatttctcaaacagaggagatgagaaatgtggagtcccaacctggcggcagcgcaaaagatg

SEQ ID NO: 106804 - DNA, 103 bp, Artificial Sequence
  Synthetic Polynucleotide
taatacgactcactatagggaaaacctagctcttccagtgaagggactccaacagaggagaggagtcatgtcactggaaaacctggcggcagcgcaaaagatg

SEQ ID NO: 106805 - DNA, 103 bp, Artificial Sequence
  Synthetic Polynucleotide
taatacgactcactatagggcatctgtatcaaaacctagctcttccagtgaacagaggagacactggatgagctaggttaacctggcggcagcgcaaaagatg

SEQ ID NO: 106806 - DNA, 103 bp, Artificial Sequence
  Synthetic Polynucleotide
taatacgactcactatagggccctgaatgcactccttcagggcggggttgaacagaggagacaacccatgcctgaaggaaacctggcggcagcgcaaaagatg

SEQ ID NO: 106807 - DNA, 103 bp, Artificial Sequence
  Synthetic Polynucleotide
taatacgactcactataggggaggataagccatctgtatcaaaacctagcaacagaggagagctaggatgtgatacagaaacctggcggcagcgcaaaagatg

SEQ ID NO: 106808 - DNA, 103 bp, Artificial Sequence
  Synthetic Polynucleotide
taatacgactcactatagggccacactgcagaggataagccatctgtatcaacagaggagagatacaatgggcttatccaacctggcggcagcgcaaaagatg

SEQ ID NO: 106809 - DNA, 103 bp, Artificial Sequence
  Synthetic Polynucleotide
taatacgactcactatagggctccacctggccacactgcagaggataagcaacagaggagagcttatatgctgcagtgtaacctggcggcagcgcaaaagatg

SEQ ID NO: 106810 - DNA, 103 bp, Artificial Sequence
  Synthetic Polynucleotide
taatacgactcactataggggcttcagtttctccacctggccacactgcaaacagaggagatgcagtatggccaggtggaacctggcggcagcgcaaaagatg

SEQ ID NO: 106811 - DNA, 103 bp, Artificial Sequence
  Synthetic Polynucleotide
taatacgactcactatagggacgagtaagtgcttcagtttctccacctggaacagaggagaccaggtatggaaactgaaaacctggcggcagcgcaaaagatg

SEQ ID NO: 106812 - DNA, 103 bp, Artificial Sequence
  Synthetic Polynucleotide
taatacgactcactataggggcctttccaaacgagtaagtgcttcagtttaacagaggagaaaactgatgcacttactcaacctggcggcagcgcaaaagatg

SEQ ID NO: 106813 - DNA, 103 bp, Artificial Sequence
  Synthetic Polynucleotide
taatacgactcactatagggctttccaaatgcctttccaaacgagtaagtaacagaggagaacttacatgtttggaaagaacctggcggcagcgcaaaagatg

SEQ ID NO: 106814 - DNA, 103 bp, Artificial Sequence
  Synthetic Polynucleotide
taatacgactcactatagggccaagcttttctttccaaatgcctttccaaaacagaggagattggaaatgcatttggaaaacctggcggcagcgcaaaagatg

SEQ ID NO: 106815 - DNA, 103 bp, Artificial Sequence
  Synthetic Polynucleotide
taatacgactcactatagggaatttgccacccaagcttttctttccaaataacagaggagaatttggatggaaaagcttaacctggcggcagcgcaaaagatg

SEQ ID NO: 106816 - DNA, 103 bp, Artificial Sequence
  Synthetic Polynucleotide
taatacgactcactatagggggtctttcaaaatttgccacccaagcttttaacagaggagaaaaagcatgggtggcaaaaacctggcggcagcgcaaaagatg

SEQ ID NO: 106817 - DNA, 103 bp, Artificial Sequence
  Synthetic Polynucleotide
taatacgactcactatagggggtgtcggcgccctgaatgcactccttcagaacagaggagactgaagatgtgcattcagaacctggcggcagcgcaaaagatg

SEQ ID NO: 106818 - DNA, 103 bp, Artificial Sequence
  Synthetic Polynucleotide
taatacgactcactatagggattcattcgaggtctttcaaaatttgccacaacagaggagagtggcaatgtttgaaagaaacctggcggcagcgcaaaagatg

SEQ ID NO: 106819 - DNA, 103 bp, Artificial Sequence
  Synthetic Polynucleotide
taatacgactcactataggggagaattcgcattcattcgaggtctttcaaaacagaggagattgaaaatgctcgaatgaaacctggcggcagcgcaaaagatg

SEQ ID NO: 106820 - DNA, 103 bp, Artificial Sequence
  Synthetic Polynucleotide
taatacgactcactatagggcttgcaagcagagaattcgcattcattcgaaacagaggagatcgaatatgtgcgaattcaacctggcggcagcgcaaaagatg

SEQ ID NO: 106821 - DNA, 103 bp, Artificial Sequence
  Synthetic Polynucleotide
taatacgactcactatagggtccagtagggcttgcaagcagagaattcgcaacagaggagagcgaatatgctgcttgcaaacctggcggcagcgcaaaagatg

SEQ ID NO: 106822 - DNA, 103 bp, Artificial Sequence
  Synthetic Polynucleotide
taatacgactcactatagggaaggactaagtccagtagggcttgcaagcaaacagaggagatgcttgatggccctactgaacctggcggcagcgcaaaagatg

SEQ ID NO: 106823 - DNA, 103 bp, Artificial Sequence
  Synthetic Polynucleotide
taatacgactcactatagggaatcggagataaggactaagtccagtagggaacagaggagaccctacatgacttagtccaacctggcggcagcgcaaaagatg

SEQ ID NO: 106824 - DNA, 103 bp, Artificial Sequence
  Synthetic Polynucleotide
taatacgactcactatagggcaaacaaccaaatcggagataaggactaagaacagaggagacttagtatgtatctccgaaacctggcggcagcgcaaaagatg

SEQ ID NO: 106825 - DNA, 103 bp, Artificial Sequence
  Synthetic Polynucleotide
taatacgactcactataggggtcgacatgacaaacaaccaaatcggagataacagaggagaatctccatgttggttgttaacctggcggcagcgcaaaagatg

SEQ ID NO: 106826 - DNA, 103 bp, Artificial Sequence
  Synthetic Polynucleotide
taatacgactcactatagggaagtaaaacagtcgacatgacaaacaaccaaacagaggagatggttgatggtcatgtcgaacctggcggcagcgcaaaagatg

SEQ ID NO: 106827 - DNA, 103 bp, Artificial Sequence
  Synthetic Polynucleotide
taatacgactcactatagggtgttagtttgaagtaaaacagtcgacatgaaacagaggagatcatgtatgctgttttacaacctggcggcagcgcaaaagatg

SEQ ID NO: 106828 - DNA, 103 bp, Artificial Sequence
  Synthetic Polynucleotide
taatacgactcactatagggcgcagcggatggtgtcggcgccctgaatgcaacagaggagagcattcatggcgccgacaaacctggcggcagcgcaaaagatg

SEQ ID NO: 106829 - DNA, 103 bp, Artificial Sequence
  Synthetic Polynucleotide
taatacgactcactatagggtgtagagatctgttagtttgaagtaaaacaaacagaggagatgttttatgtcaaactaaaacctggcggcagcgcaaaagatg

SEQ ID NO: 106830 - DNA, 103 bp, Artificial Sequence
  Synthetic Polynucleotide
taatacgactcactatagggtttacctttttgtagagatctgttagtttgaacagaggagacaaactatgagatctctaaacctggcggcagcgcaaaagatg

SEQ ID NO: 106831 - DNA, 103 bp, Artificial Sequence
  Synthetic Polynucleotide
taatacgactcactatagggactgttcttctttacctttttgtagagatcaacagaggagagatctcatgaaaaaggtaaacctggcggcagcgcaaaagatg

SEQ ID NO: 106832 - DNA, 103 bp, Artificial Sequence
  Synthetic Polynucleotide
taatacgactcactatagggggggaggggaactgttcttctttaccttttaacagaggagaaaaaggatgagaagaacaaacctggcggcagcgcaaaagatg

SEQ ID NO: 106833 - DNA, 103 bp, Artificial Sequence
  Synthetic Polynucleotide
taatacgactcactatagggtaaagggaaaggggaggggaactgttcttcaacagaggagagaagaaatgttcccctccaacctggcggcagcgcaaaagatg

SEQ ID NO: 106834 - DNA, 103 bp, Artificial Sequence
  Synthetic Polynucleotide
taatacgactcactatagggcagttgcccataaagggaaaggggaggggaaacagaggagatcccctatgctttcccttaacctggcggcagcgcaaaagatg

SEQ ID NO: 106835 - DNA, 103 bp, Artificial Sequence
  Synthetic Polynucleotide
taatacgactcactatagggcacgccataacagttgcccataaagggaaaaacagaggagatttcccatgatgggcaacaacctggcggcagcgcaaaagatg

SEQ ID NO: 106836 - DNA, 103 bp, Artificial Sequence
  Synthetic Polynucleotide
taatacgactcactatagggtagaaaaattcacgccataacagttgcccaaacagaggagatgggcaatggttatggcgaacctggcggcagcgcaaaagatg

SEQ ID NO: 106837 - DNA, 103 bp, Artificial Sequence
  Synthetic Polynucleotide
taatacgactcactatagggtgctgctgtatagaaaaattcacgccataaaacagaggagattatggatggaatttttcaacctggcggcagcgcaaaagatg

SEQ ID NO: 106838 - DNA, 103 bp, Artificial Sequence
  Synthetic Polynucleotide
taatacgactcactataggggattatttgttgctgctgtatagaaaaattaacagaggagaaattttatgatacagcagaacctggcggcagcgcaaaagatg

SEQ ID NO: 106839 - DNA, 103 bp, Artificial Sequence
  Synthetic Polynucleotide
taatacgactcactatagggaggatgtagacgcagcggatggtgtcggcgaacagaggagacgccgaatgcatccgctgaacctggcggcagcgcaaaagatg

SEQ ID NO: 106840 - DNA, 103 bp, Artificial Sequence
  Synthetic Polynucleotide
taatacgactcactatagggtcaaagcgtggattatttgttgctgctgtaaacagaggagatacagcatgaacaaataaaacctggcggcagcgcaaaagatg

SEQ ID NO: 106841 - DNA, 103 bp, Artificial Sequence
  Synthetic Polynucleotide
taatacgactcactatagggttccattttatcaaagcgtggattatttgtaacagaggagaacaaatatgccacgctttaacctggcggcagcgcaaaagatg

SEQ ID NO: 106842 - DNA, 103 bp, Artificial Sequence
  Synthetic Polynucleotide
taatacgactcactatagggtagggtttccttccattttatcaaagcgtgaacagaggagacacgctatgataaaatggaacctggcggcagcgcaaaagatg

SEQ ID NO: 106843 - DNA, 103 bp, Artificial Sequence
  Synthetic Polynucleotide
taatacgactcactatagggtgaacacagatagggtttccttccattttaaacagaggagataaaatatgaggaaacccaacctggcggcagcgcaaaagatg

SEQ ID NO: 106844 - DNA, 103 bp, Artificial Sequence
  Synthetic Polynucleotide
taatacgactcactatagggccaaggaatctgaacacagatagggtttccaacagaggagaggaaacatgatctgtgttaacctggcggcagcgcaaaagatg

SEQ ID NO: 106845 - DNA, 103 bp, Artificial Sequence
  Synthetic Polynucleotide
taatacgactcactataggggatttttatcccaaggaatctgaacacagaaacagaggagatctgtgatgagattccttaacctggcggcagcgcaaaagatg

SEQ ID NO: 106846 - DNA, 103 bp, Artificial Sequence
  Synthetic Polynucleotide
taatacgactcactatagggaaagcctcaggatttttatcccaaggaatcaacagaggagagattccatgggataaaaaaacctggcggcagcgcaaaagatg

SEQ ID NO: 106847 - DNA, 103 bp, Artificial Sequence
  Synthetic Polynucleotide
taatacgactcactatagggccatttggctaaagcctcaggatttttatcaacagaggagagataaaatgcctgaggctaacctggcggcagcgcaaaagatg

SEQ ID NO: 106848 - DNA, 103 bp, Artificial Sequence
  Synthetic Polynucleotide
taatacgactcactatagggggccttccgcccatttggctaaagcctcagaacagaggagactgaggatgtagccaaataacctggcggcagcgcaaaagatg

SEQ ID NO: 106849 - DNA, 103 bp, Artificial Sequence
  Synthetic Polynucleotide
taatacgactcactatagggaagcctgtccggccttccgcccatttggctaacagaggagaagccaaatgggcggaaggaacctggcggcagcgcaaaagatg

SEQ ID NO: 106850 - DNA, 103 bp, Artificial Sequence
  Synthetic Polynucleotide
taatacgactcactatagggtgtgtgggtccgcccgggtggagctggcataacagaggagaatgccaatgccacccgggaacctggcggcagcgcaaaagatg

SEQ ID NO: 106851 - DNA, 103 bp, Artificial Sequence
  Synthetic Polynucleotide
taatacgactcactataggggtcggctggctgtccccggactacaaacagaacagaggagactgtttatggtccggggaaacctggcggcagcgcaaaagatg

SEQ ID NO: 106852 - DNA, 103 bp, Artificial Sequence
  Synthetic Polynucleotide
taatacgactcactatagggatcaaatacccggaccccgctctcccagctaacagaggagaagctggatgagcggggtcaacctggcggcagcgcaaaagatg

SEQ ID NO: 106853 - DNA, 103 bp, Artificial Sequence
  Synthetic Polynucleotide
taatacgactcactatagggggagcagctcatcaaatacccggaccccgcaacagaggagagcggggatggggtatttgaacctggcggcagcgcaaaagatg

SEQ ID NO: 106854 - DNA, 103 bp, Artificial Sequence
  Synthetic Polynucleotide
taatacgactcactatagggtctgcatccaggagcagctcatcaaataccaacagaggagaggtattatgtgagctgctaacctggcggcagcgcaaaagatg

SEQ ID NO: 106855 - DNA, 103 bp, Artificial Sequence
  Synthetic Polynucleotide
taatacgactcactatagggcacgctgaaatctgcatccaggagcagctcaacagaggagagagctgatgctggatgcaaacctggcggcagcgcaaaagatg

SEQ ID NO: 106856 - DNA, 103 bp, Artificial Sequence
  Synthetic Polynucleotide
taatacgactcactatagggtgcctgcgttcacgctgaaatctgcatccaaacagaggagatggatgatgatttcagcgaacctggcggcagcgcaaaagatg

SEQ ID NO: 106857 - DNA, 103 bp, Artificial Sequence
  Synthetic Polynucleotide
taatacgactcactatagggcacatccagctgcctgcgttcacgctgaaaaacagaggagatttcagatggaacgcaggaacctggcggcagcgcaaaagatg

SEQ ID NO: 106858 - DNA, 103 bp, Artificial Sequence
  Synthetic Polynucleotide
taatacgactcactataggggcaggacagccacatccagctgcctgcgttaacagaggagaaacgcaatgagctggatgaacctggcggcagcgcaaaagatg

SEQ ID NO: 106859 - DNA, 103 bp, Artificial Sequence
  Synthetic Polynucleotide
taatacgactcactatagggagaaagcactgcaggacagccacatccagcaacagaggagagctggaatgggctgtcctaacctggcggcagcgcaaaagatg

SEQ ID NO: 106860 - DNA, 103 bp, Artificial Sequence
  Synthetic Polynucleotide
taatacgactcactatagggaactgctggaagaaagcactgcaggacagcaacagaggagagctgtcatgcagtgctttaacctggcggcagcgcaaaagatg

SEQ ID NO: 106861 - DNA, 103 bp, Artificial Sequence
  Synthetic Polynucleotide
taatacgactcactataggggcagtggaagaactgctggaagaaagcactaacagaggagaagtgctatgttccagcagaacctggcggcagcgcaaaagatg

SEQ ID NO: 106862 - DNA, 103 bp, Artificial Sequence
  Synthetic Polynucleotide
taatacgactcactatagggttgggaacacgtcggctggctgtccccggaaacagaggagatccgggatgagccagccgaacctggcggcagcgcaaaagatg

SEQ ID NO: 106863 - DNA, 103 bp, Artificial Sequence
  Synthetic Polynucleotide
taatacgactcactatagggcagggcagtagcagtggaagaactgctggaaacagaggagatccagcatgtcttccactaacctggcggcagcgcaaaagatg

SEQ ID NO: 106864 - DNA, 103 bp, Artificial Sequence
  Synthetic Polynucleotide
taatacgactcactatagggccaaagcccacagggcagtagcagtggaagaacagaggagacttccaatgctactgcccaacctggcggcagcgcaaaagatg

SEQ ID NO: 106865 - DNA, 103 bp, Artificial Sequence
  Synthetic Polynucleotide
taatacgactcactatagggcgtgcgacggccaaagcccacagggcagtaaacagaggagatactgcatggtgggctttaacctggcggcagcgcaaaagatg

SEQ ID NO: 106866 - DNA, 103 bp, Artificial Sequence
  Synthetic Polynucleotide
taatacgactcactatagggcactggggtccgtgcgacggccaaagcccaaacagaggagatgggctatggccgtcgcaaacctggcggcagcgcaaaagatg

SEQ ID NO: 106867 - DNA, 103 bp, Artificial Sequence
  Synthetic Polynucleotide
taatacgactcactatagggatgtagtccccactggggtccgtgcgacggaacagaggagaccgtcgatgggaccccagaacctggcggcagcgcaaaagatg

SEQ ID NO: 106868 - DNA, 103 bp, Artificial Sequence
  Synthetic Polynucleotide
taatacgactcactataggggtatcgcctgatgtagtccccactggggtcaacagaggagagaccccatgggggactacaacctggcggcagcgcaaaagatg

SEQ ID NO: 106869 - DNA, 103 bp, Artificial Sequence
  Synthetic Polynucleotide
taatacgactcactatagggatttgggcaggtatcgcctgatgtagtcccaacagaggagagggactatgtcaggcgataacctggcggcagcgcaaaagatg

SEQ ID NO: 106870 - DNA, 103 bp, Artificial Sequence
  Synthetic Polynucleotide
taatacgactcactatagggaacgctttcaatttgggcaggtatcgcctgaacagaggagacaggcgatgcctgcccaaaacctggcggcagcgcaaaagatg

SEQ ID NO: 106871 - DNA, 103 bp, Artificial Sequence
  Synthetic Polynucleotide
taatacgactcactatagggtcgagaggggaacgctttcaatttgggcagaacagaggagactgcccatgttgaaagcgaacctggcggcagcgcaaaagatg

SEQ ID NO: 106872 - DNA, 103 bp, Artificial Sequence
  Synthetic Polynucleotide
taatacgactcactatagggcatagatgtatcgagaggggaacgctttcaaacagaggagatgaaagatgtcccctctcaacctggcggcagcgcaaaagatg

SEQ ID NO: 106873 - DNA, 103 bp, Artificial Sequence
  Synthetic Polynucleotide
taatacgactcactatagggttgaacagccttgggaacacgtcggctggcaacagaggagagccagcatgcgtgttcccaacctggcggcagcgcaaaagatg

SEQ ID NO: 106874 - DNA, 103 bp, Artificial Sequence
  Synthetic Polynucleotide
taatacgactcactatagggttccagggctcatagatgtatcgagaggggaacagaggagacccctcatgatacatctaaacctggcggcagcgcaaaagatg

SEQ ID NO: 106875 - DNA, 103 bp, Artificial Sequence
  Synthetic Polynucleotide
taatacgactcactatagggctctggggcattccagggctcatagatgtaaacagaggagatacatcatggagccctggaacctggcggcagcgcaaaagatg

SEQ ID NO: 106876 - DNA, 103 bp, Artificial Sequence
  Synthetic Polynucleotide
taatacgactcactatagggtctgaattgactctggggcattccagggctaacagaggagaagccctatgatgccccagaacctggcggcagcgcaaaagatg

SEQ ID NO: 106877 - DNA, 103 bp, Artificial Sequence
  Synthetic Polynucleotide
taatacgactcactatagggttggctgccttctgaattgactctggggcaaacagaggagatgccccatggtcaattcaaacctggcggcagcgcaaaagatg

SEQ ID NO: 106878 - DNA, 103 bp, Artificial Sequence
  Synthetic Polynucleotide
taatacgactcactatagggaatgatgcacttggctgccttctgaattgaaacagaggagatcaattatgaaggcagccaacctggcggcagcgcaaaagatg

SEQ ID NO: 106879 - DNA, 103 bp, Artificial Sequence
  Synthetic Polynucleotide
taatacgactcactatagggagtccacaccaatgatgcacttggctgcctaacagaggagaaggcagatgagtgcatcaaacctggcggcagcgcaaaagatg

SEQ ID NO: 106880 - DNA, 103 bp, Artificial Sequence
  Synthetic Polynucleotide
taatacgactcactatagggggccgtgggtagtccacaccaatgatgcacaacagaggagagtgcatatgtggtgtggaaacctggcggcagcgcaaaagatg

SEQ ID NO: 106881 - DNA, 103 bp, Artificial Sequence
  Synthetic Polynucleotide
taatacgactcactataggggttgacgatgggccgtgggtagtccacaccaacagaggagaggtgtgatgtacccacggaacctggcggcagcgcaaaagatg

SEQ ID NO: 106882 - DNA, 103 bp, Artificial Sequence
  Synthetic Polynucleotide
taatacgactcactatagggtctcggcatggttgacgatgggccgtgggtaacagaggagaacccacatgccatcgtcaaacctggcggcagcgcaaaagatg

SEQ ID NO: 106883 - DNA, 103 bp, Artificial Sequence
  Synthetic Polynucleotide
taatacgactcactatagggagccggctggtctcggcatggttgacgatgaacagaggagacatcgtatgccatgccgaaacctggcggcagcgcaaaagatg

SEQ ID NO: 106884 - DNA, 103 bp, Artificial Sequence
  Synthetic Polynucleotide
taatacgactcactatagggtccccattccttgaacagccttgggaacacaacagaggagagtgttcatgaggctgttcaacctggcggcagcgcaaaagatg

SEQ ID NO: 106885 - DNA, 103 bp, Artificial Sequence
  Synthetic Polynucleotide
taatacgactcactatagggttcaatgttaagccggctggtctcggcatgaacagaggagacatgccatgaccagccggaacctggcggcagcgcaaaagatg

SEQ ID NO: 106886 - DNA, 103 bp, Artificial Sequence
  Synthetic Polynucleotide
taatacgactcactataggggcttcattcgttcaatgttaagccggctggaacagaggagaccagccatgttaacattgaacctggcggcagcgcaaaagatg

SEQ ID NO: 106887 - DNA, 103 bp, Artificial Sequence
  Synthetic Polynucleotide
taatacgactcactatagggtggtaaatctgcttcattcgttcaatgttaaacagaggagataacatatgacgaatgaaaacctggcggcagcgcaaaagatg

SEQ ID NO: 106888 - DNA, 103 bp, Artificial Sequence
  Synthetic Polynucleotide
taatacgactcactatagggcgaaagctgctggtaaatctgcttcattcgaacagaggagacgaatgatgcagatttacaacctggcggcagcgcaaaagatg

SEQ ID NO: 106889 - DNA, 103 bp, Artificial Sequence
  Synthetic Polynucleotide
taatacgactcactatagggcccggtagcgcgaaagctgctggtaaatctaacagaggagaagatttatgagcagctttaacctggcggcagcgcaaaagatg

SEQ ID NO: 106890 - DNA, 103 bp, Artificial Sequence
  Synthetic Polynucleotide
taatacgactcactatagggagacagagtccccggtagcgcgaaagctgcaacagaggagagcagctatggcgctaccgaacctggcggcagcgcaaaagatg

SEQ ID NO: 106891 - DNA, 103 bp, Artificial Sequence
  Synthetic Polynucleotide
taatacgactcactatagggagatgccagtagacagagtccccggtagcgaacagaggagacgctacatgggactctgtaacctggcggcagcgcaaaagatg

SEQ ID NO: 106892 - DNA, 103 bp, Artificial Sequence
  Synthetic Polynucleotide
taatacgactcactatagggaggaagggacagatgccagtagacagagtcaacagaggagagactctatgtactggcataacctggcggcagcgcaaaagatg

SEQ ID NO: 106893 - DNA, 103 bp, Artificial Sequence
  Synthetic Polynucleotide
taatacgactcactatagggtcttccacacaggaagggacagatgccagtaacagaggagaactggcatgtgtcccttcaacctggcggcagcgcaaaagatg

SEQ ID NO: 106894 - DNA, 103 bp, Artificial Sequence
  Synthetic Polynucleotide
taatacgactcactataggggtgactgaggtcttccacacaggaagggacaacagaggagagtccctatgtgtgtggaaaacctggcggcagcgcaaaagatg

SEQ ID NO: 106895 - DNA, 103 bp, Artificial Sequence
  Synthetic Polynucleotide
taatacgactcactatagggagcgggtcactccccattccttgaacagccaacagaggagaggctgtatgaggaatgggaacctggcggcagcgcaaaagatg

SEQ ID NO: 106896 - DNA, 103 bp, Artificial Sequence
  Synthetic Polynucleotide
taatacgactcactatagggctgccacagggtgactgaggtcttccacacaacagaggagagtgtggatgacctcagtcaacctggcggcagcgcaaaagatg

SEQ ID NO: 106897 - DNA, 103 bp, Artificial Sequence
  Synthetic Polynucleotide
taatacgactcactataggggagctgggctctgccacagggtgactgaggaacagaggagacctcagatgccctgtggcaacctggcggcagcgcaaaagatg

SEQ ID NO: 106898 - DNA, 103 bp, Artificial Sequence
  Synthetic Polynucleotide
taatacgactcactatagggagcctggctcgagctgggctctgccacaggaacagaggagacctgtgatggagcccagcaacctggcggcagcgcaaaagatg

SEQ ID NO: 106899 - DNA, 103 bp, Artificial Sequence
  Synthetic Polynucleotide
taatacgactcactatagggtcatgctgccagcctggctcgagctgggctaacagaggagaagcccaatgcgagccaggaacctggcggcagcgcaaaagatg

SEQ ID NO: 106900 - DNA, 103 bp, Artificial Sequence
  Synthetic Polynucleotide
taatacgactcactatagggcctgcactgctcatgctgccagcctggctcaacagaggagagagccaatgtggcagcataacctggcggcagcgcaaaagatg

SEQ ID NO: 106901 - DNA, 103 bp, Artificial Sequence
  Synthetic Polynucleotide
taatacgactcactatagggtggtcttgggcctgcactgctcatgctgccaacagaggagaggcagcatgagcagtgcaaacctggcggcagcgcaaaagatg

SEQ ID NO: 106902 - DNA, 103 bp, Artificial Sequence
  Synthetic Polynucleotide
taatacgactcactatagggcactgggtagtggtcttgggcctgcactgcaacagaggagagcagtgatggcccaagacaacctggcggcagcgcaaaagatg

SEQ ID NO: 106903 - DNA, 103 bp, Artificial Sequence
  Synthetic Polynucleotide
taatacgactcactataggggatgctgggccactgggtagtggtcttgggaacagaggagacccaagatgactacccagaacctggcggcagcgcaaaagatg

SEQ ID NO: 106904 - DNA, 103 bp, Artificial Sequence
  Synthetic Polynucleotide
taatacgactcactataggggcgtttgggggatgctgggccactgggtagaacagaggagactacccatgggcccagcaaacctggcggcagcgcaaaagatg

SEQ ID NO: 106905 - DNA, 103 bp, Artificial Sequence
  Synthetic Polynucleotide
taatacgactcactatagggcttccagcttgcgtttgggggatgctgggcaacagaggagagcccagatgcccccaaacaacctggcggcagcgcaaaagatg

SEQ ID NO: 106906 - DNA, 103 bp, Artificial Sequence
  Synthetic Polynucleotide
taatacgactcactatagggtcaaaggtcaagcgggtcactccccattccaacagaggagaggaatgatgagtgacccgaacctggcggcagcgcaaaagatg

SEQ ID NO: 106907 - DNA, 103 bp, Artificial Sequence
  Synthetic Polynucleotide
taatacgactcactatagggtcctcggctgcttccagcttgcgtttggggaacagaggagaccccaaatgcaagctggaaacctggcggcagcgcaaaagatg

SEQ ID NO: 106908 - DNA, 103 bp, Artificial Sequence
  Synthetic Polynucleotide
taatacgactcactatagggaccaggtggttcctcggctgcttccagcttaacagaggagaaagctgatggcagccgagaacctggcggcagcgcaaaagatg

SEQ ID NO: 106909 - DNA, 103 bp, Artificial Sequence
  Synthetic Polynucleotide
taatacgactcactatagggtgagttcttcaccaggtggttcctcggctgaacagaggagacagccgatgaaccacctgaacctggcggcagcgcaaaagatg

SEQ ID NO: 106910 - DNA, 103 bp, Artificial Sequence
  Synthetic Polynucleotide
taatacgactcactataggggcccgtttgctgagttcttcaccaggtggtaacagaggagaaccaccatgtgaagaactaacctggcggcagcgcaaaagatg

SEQ ID NO: 106911 - DNA, 103 bp, Artificial Sequence
  Synthetic Polynucleotide
taatacgactcactatagggtgccacccgggcccgtttgctgagttcttcaacagaggagagaagaaatgagcaaacggaacctggcggcagcgcaaaagatg

SEQ ID NO: 106912 - DNA, 103 bp, Artificial Sequence
  Synthetic Polynucleotide
taatacgactcactatagggttggcaactctgccacccgggcccgtttgcaacagaggagagcaaacatgcccgggtggaacctggcggcagcgcaaaagatg

SEQ ID NO: 106913 - DNA, 103 bp, Artificial Sequence
  Synthetic Polynucleotide
taatacgactcactatagggagctctggggttggcaactctgccacccggaacagaggagaccgggtatgagagttgccaacctggcggcagcgcaaaagatg

SEQ ID NO: 106914 - DNA, 103 bp, Artificial Sequence
  Synthetic Polynucleotide
taatacgactcactatagggcttgctcggcagctctggggttggcaactcaacagaggagagagttgatgaccccagagaacctggcggcagcgcaaaagatg

SEQ ID NO: 106915 - DNA, 103 bp, Artificial Sequence
  Synthetic Polynucleotide
taatacgactcactatagggagagtcatattcaaaggtcaagcgggtcacaacagaggagagtgaccatgttgacctttaacctggcggcagcgcaaaagatg

SEQ ID NO: 106916 - DNA, 103 bp, Artificial Sequence
  Synthetic Polynucleotide
taatacgactcactatagggcaaagggttcagagtcatattcaaaggtcaaacagaggagatgacctatgaatatgactaacctggcggcagcgcaaaagatg

SEQ ID NO: 106917 - DNA, 103 bp, Artificial Sequence
  Synthetic Polynucleotide
taatacgactcactatagggcgttctttcccaaagggttcagagtcatataacagaggagaatatgaatgtgaacccttaacctggcggcagcgcaaaagatg

SEQ ID NO: 106918 - DNA, 103 bp, Artificial Sequence
  Synthetic Polynucleotide
taatacgactcactatagggggctgcatcccgttctttcccaaagggttcaacagaggagagaacccatggggaaagaaaacctggcggcagcgcaaaagatg

SEQ ID NO: 106919 - DNA, 103 bp, Artificial Sequence
  Synthetic Polynucleotide
taatacgactcactataggggtaggaaccatgtgtgggtccgcccgggtgaacagaggagacacccgatgggacccacaaacctggcggcagcgcaaaagatg

SEQ ID NO: 106920 - DNA, 103 bp, Artificial Sequence
  Synthetic Polynucleotide
taatacgactcactatagggtcttcatgatggctgcatcccgttctttccaacagaggagaggaaagatggggatgcagaacctggcggcagcgcaaaagatg

SEQ ID NO: 106921 - DNA, 103 bp, Artificial Sequence
  Synthetic Polynucleotide
taatacgactcactatagggtccttggccatcttcatgatggctgcatccaacagaggagaggatgcatgcatcatgaaaacctggcggcagcgcaaaagatg

SEQ ID NO: 106922 - DNA, 103 bp, Artificial Sequence
  Synthetic Polynucleotide
taatacgactcactatagggcacaccagcctccttggccatcttcatgataacagaggagaatcatgatgatggccaagaacctggcggcagcgcaaaagatg

SEQ ID NO: 106923 - DNA, 103 bp, Artificial Sequence
  Synthetic Polynucleotide
taatacgactcactatagggtcactacttccacaccagcctccttggccaaacagaggagatggccaatgaggctggtgaacctggcggcagcgcaaaagatg

SEQ ID NO: 106924 - DNA, 103 bp, Artificial Sequence
  Synthetic Polynucleotide
taatacgactcactataggggaattctccgtcactacttccacaccagccaacagaggagaggctggatgggaagtagtaacctggcggcagcgcaaaagatg

SEQ ID NO: 106925 - DNA, 103 bp, Artificial Sequence
  Synthetic Polynucleotide
taatacgactcactataggggagggtatgagaattctccgtcactacttcaacagaggagagaagtaatgacggagaataacctggcggcagcgcaaaagatg

SEQ ID NO: 106926 - DNA, 103 bp, Artificial Sequence
  Synthetic Polynucleotide
taatacgactcactatagggccaggtcatagagggtatgagaattctccgaacagaggagacggagaatgctcatacccaacctggcggcagcgcaaaagatg

SEQ ID NO: 106927 - DNA, 103 bp, Artificial Sequence
  Synthetic Polynucleotide
taatacgactcactatagggatgatcctgtccaggtcatagagggtatgaaacagaggagatcatacatgctatgacctaacctggcggcagcgcaaaagatg

SEQ ID NO: 106928 - DNA, 103 bp, Artificial Sequence
  Synthetic Polynucleotide
taatacgactcactatagggattcagctcaatgatcctgtccaggtcataaacagaggagatatgacatggacaggatcaacctggcggcagcgcaaaagatg

SEQ ID NO: 106929 - DNA, 103 bp, Artificial Sequence
  Synthetic Polynucleotide
taatacgactcactataggggcttctgcccattcagctcaatgatcctgtaacagaggagaacaggaatgttgagctgaaacctggcggcagcgcaaaagatg

SEQ ID NO: 106930 - DNA, 103 bp, Artificial Sequence
  Synthetic Polynucleotide
taatacgactcactatagggagagactgaagtaggaaccatgtgtgggtcaacagaggagagacccaatgatggttcctaacctggcggcagcgcaaaagatg

SEQ ID NO: 106931 - DNA, 103 bp, Artificial Sequence
  Synthetic Polynucleotide
taatacgactcactataggggtaaggggtggcttctgcccattcagctcaaacagaggagatgagctatgtgggcagaaaacctggcggcagcgcaaaagatg

SEQ ID NO: 106932 - DNA, 103 bp, Artificial Sequence
  Synthetic Polynucleotide
taatacgactcactataggggcgcttgtatgtaaggggtggcttctgcccaacagaggagagggcagatgccaccccttaacctggcggcagcgcaaaagatg

SEQ ID NO: 106933 - DNA, 103 bp, Artificial Sequence
  Synthetic Polynucleotide
taatacgactcactatagggtggcctgaaagcgcttgtatgtaaggggtgaacagaggagacaccccatgcatacaagcaacctggcggcagcgcaaaagatg

SEQ ID NO: 106934 - DNA, 103 bp, Artificial Sequence
  Synthetic Polynucleotide
taatacgactcactatagggcggctgatgatggcctgaaagcgcttgtataacagaggagaatacaaatgctttcaggcaacctggcggcagcgcaaaagatg

SEQ ID NO: 106935 - DNA, 103 bp, Artificial Sequence
  Synthetic Polynucleotide
taatacgactcactatagggcagctccatgcggctgatgatggcctgaaaaacagaggagatttcagatgatcatcagcaacctggcggcagcgcaaaagatg

SEQ ID NO: 106936 - DNA, 103 bp, Artificial Sequence
  Synthetic Polynucleotide
taatacgactcactataggggcttcttgggcagctccatgcggctgatgaaacagaggagatcatcaatggcatggagcaacctggcggcagcgcaaaagatg

SEQ ID NO: 106937 - DNA, 103 bp, Artificial Sequence
  Synthetic Polynucleotide
taatacgactcactatagggaagcccactggcttcttgggcagctccatgaacagaggagacatggaatggcccaagaaaacctggcggcagcgcaaaagatg

SEQ ID NO: 106938 - DNA, 103 bp, Artificial Sequence
  Synthetic Polynucleotide
taatacgactcactataggggctggtcaccaagcccactggcttcttgggaacagaggagacccaagatgccagtgggcaacctggcggcagcgcaaaagatg

SEQ ID NO: 106939 - DNA, 103 bp, Artificial Sequence
  Synthetic Polynucleotide
taatacgactcactatagggccatctgctggctggtcaccaagcccactgaacagaggagacagtggatgtggtgaccaaacctggcggcagcgcaaaagatg

SEQ ID NO: 106940 - DNA, 103 bp, Artificial Sequence
  Synthetic Polynucleotide
taatacgactcactatagggctgcagctctccatctgctggctggtcaccaacagaggagaggtgacatgccagcagataacctggcggcagcgcaaaagatg

SEQ ID NO: 106941 - DNA, 103 bp, Artificial Sequence
  Synthetic Polynucleotide
taatacgactcactatagggcaaatcttccagagactgaagtaggaaccaaacagaggagatggttcatgcttcagtctaacctggcggcagcgcaaaagatg

SEQ ID NO: 106942 - DNA, 103 bp, Artificial Sequence
  Synthetic Polynucleotide
taatacgactcactataggggatctcggccctgcagctctccatctgctgaacagaggagacagcagatggagagctgcaacctggcggcagcgcaaaagatg

SEQ ID NO: 106943 - DNA, 103 bp, Artificial Sequence
  Synthetic Polynucleotide
taatacgactcactatagggggttctcctggatctcggccctgcagctctaacagaggagaagagctatggggccgagaaacctggcggcagcgcaaaagatg

SEQ ID NO: 106944 - DNA, 103 bp, Artificial Sequence
  Synthetic Polynucleotide
taatacgactcactataggggtctcgtcgtggttctcctggatctcggccaacagaggagaggccgaatgccaggagaaaacctggcggcagcgcaaaagatg

SEQ ID NO: 106945 - DNA, 103 bp, Artificial Sequence
  Synthetic Polynucleotide
taatacgactcactatagggcacgccgtaggtctcgtcgtggttctcctgaacagaggagacaggagatgcacgacgagaacctggcggcagcgcaaaagatg

SEQ ID NO: 106946 - DNA, 103 bp, Artificial Sequence
  Synthetic Polynucleotide
taatacgactcactatagggccagggagggcacgccgtaggtctcgtcgtaacagaggagaacgacgatgcctacggcgaacctggcggcagcgcaaaagatg

SEQ ID NO: 106947 - DNA, 103 bp, Artificial Sequence
  Synthetic Polynucleotide
taatacgactcactatagggcccagctcctccagggagggcacgccgtagaacagaggagactacggatggccctccctaacctggcggcagcgcaaaagatg

SEQ ID NO: 106948 - DNA, 103 bp, Artificial Sequence
  Synthetic Polynucleotide
taatacgactcactatagggagtggggaaccccagctcctccagggagggaacagaggagaccctccatggaggagctgaacctggcggcagcgcaaaagatg

SEQ ID NO: 106949 - DNA, 103 bp, Artificial Sequence
  Synthetic Polynucleotide
taatacgactcactatagggcaagtccttcagtggggaaccccagctcctaacagaggagaaggagcatgggttccccaaacctggcggcagcgcaaaagatg

SEQ ID NO: 106950 - DNA, 103 bp, Artificial Sequence
  Synthetic Polynucleotide
taatacgactcactatagggacagctggaccaagtccttcagtggggaacaacagaggagagttcccatgtgaaggactaacctggcggcagcgcaaaagatg

SEQ ID NO: 106951 - DNA, 103 bp, Artificial Sequence
  Synthetic Polynucleotide
taatacgactcactatagggtccctgccagacagctggaccaagtccttcaacagaggagagaaggaatgggtccagctaacctggcggcagcgcaaaagatg

SEQ ID NO: 106952 - DNA, 103 bp, Artificial Sequence
  Synthetic Polynucleotide
taatacgactcactatagggaacttgtgtccaaatcttccagagactgaaaacagaggagattcagtatgtggaagattaacctggcggcagcgcaaaagatg

SEQ ID NO: 106953 - DNA, 103 bp, Artificial Sequence
  Synthetic Polynucleotide
taatacgactcactatagggctgtctctcctccctgccagacagctggacaacagaggagagtccagatgtctggcaggaacctggcggcagcgcaaaagatg

SEQ ID NO: 106954 - DNA, 103 bp, Artificial Sequence
  Synthetic Polynucleotide
taatacgactcactataggggccagagcttctgtctctcctccctgccagaacagaggagactggcaatgaggagagacaacctggcggcagcgcaaaagatg

SEQ ID NO: 106955 - DNA, 103 bp, Artificial Sequence
  Synthetic Polynucleotide
taatacgactcactatagggatccaggcgggccagagcttctgtctctccaacagaggagaggagagatggaagctctgaacctggcggcagcgcaaaagatg

SEQ ID NO: 106956 - DNA, 103 bp, Artificial Sequence
  Synthetic Polynucleotide
taatacgactcactatagggccaagtgcttatccaggcgggccagagcttaacagaggagaaagctcatgcccgcctggaacctggcggcagcgcaaaagatg

SEQ ID NO: 106957 - DNA, 103 bp, Artificial Sequence
  Synthetic Polynucleotide
taatacgactcactataggggccttccgttccaagtgcttatccaggcggaacagaggagaccgcctatgtaagcacttaacctggcggcagcgcaaaagatg

SEQ ID NO: 106958 - DNA, 103 bp, Artificial Sequence
  Synthetic Polynucleotide
taatacgactcactatagggggcaacccaggccttccgttccaagtgcttaacagaggagaaagcacatggaacggaagaacctggcggcagcgcaaaagatg

SEQ ID NO: 106959 - DNA, 103 bp, Artificial Sequence
  Synthetic Polynucleotide
taatacgactcactatagggtctcatagttggcaacccaggccttccgttaacagaggagaaacggaatgcctgggttgaacctggcggcagcgcaaaagatg

SEQ ID NO: 106960 - DNA, 103 bp, Artificial Sequence
  Synthetic Polynucleotide
taatacgactcactatagggattcggggtctctcatagttggcaacccagaacagaggagactgggtatgcaactatgaaacctggcggcagcgcaaaagatg

SEQ ID NO: 106961 - DNA, 103 bp, Artificial Sequence
  Synthetic Polynucleotide
taatacgactcactataggggttggcgttcattcggggtctctcatagttaacagaggagaaactatatgagaccccgaaacctggcggcagcgcaaaagatg

SEQ ID NO: 106962 - DNA, 103 bp, Artificial Sequence
  Synthetic Polynucleotide
taatacgactcactatagggccaggagggagttggcgttcattcggggtcaacagaggagagaccccatgtgaacgccaaacctggcggcagcgcaaaagatg

SEQ ID NO: 106963 - DNA, 103 bp, Artificial Sequence
  Synthetic Polynucleotide
taatacgactcactatagggagtttccttaaacttgtgtccaaatcttccaacagaggagaggaagaatgggacacaagaacctggcggcagcgcaaaagatg

SEQ ID NO: 106964 - DNA, 103 bp, Artificial Sequence
  Synthetic Polynucleotide
taatacgactcactataggggtggggctggccaggagggagttggcgttcaacagaggagagaacgcatgctccctcctaacctggcggcagcgcaaaagatg

SEQ ID NO: 106965 - DNA, 103 bp, Artificial Sequence
  Synthetic Polynucleotide
taatacgactcactataggggctgaggcctgtggggctggccaggagggaaacagaggagatccctcatggccagccccaacctggcggcagcgcaaaagatg

SEQ ID NO: 106966 - DNA, 103 bp, Artificial Sequence
  Synthetic Polynucleotide
taatacgactcactataggggcaggtaggggctgaggcctgtggggctggaacagaggagaccagccatgcaggcctcaaacctggcggcagcgcaaaagatg

SEQ ID NO: 106967 - DNA, 103 bp, Artificial Sequence
  Synthetic Polynucleotide
taatacgactcactatagggcaaccaaagcgcaggtaggggctgaggcctaacagaggagaaggcctatgcccctacctaacctggcggcagcgcaaaagatg

SEQ ID NO: 106968 - DNA, 103 bp, Artificial Sequence
  Synthetic Polynucleotide
taatacgactcactataggggcaggagagacaaccaaagcgcaggtagggaacagaggagaccctacatgcgctttggtaacctggcggcagcgcaaaagatg

SEQ ID NO: 106969 - DNA, 103 bp, Artificial Sequence
  Synthetic Polynucleotide
taatacgactcactatagggagaagaggcggcaggagagacaaccaaagcaacagaggagagctttgatggtctctcctaacctggcggcagcgcaaaagatg

SEQ ID NO: 106970 - DNA, 103 bp, Artificial Sequence
  Synthetic Polynucleotide
taatacgactcactatagggaggcggtagtagaagaggcggcaggagagaaacagaggagatctctcatgccgcctcttaacctggcggcagcgcaaaagatg

SEQ ID NO: 106971 - DNA, 103 bp, Artificial Sequence
  Synthetic Polynucleotide
taatacgactcactatagggcaggtcccacaggcggtagtagaagaggcgaacagaggagacgcctcatgtactaccgcaacctggcggcagcgcaaaagatg

SEQ ID NO: 106972 - DNA, 103 bp, Artificial Sequence
  Synthetic Polynucleotide
taatacgactcactatagggcctttttatacaggtcccacaggcggtagtaacagaggagaactaccatgtgtgggaccaacctggcggcagcgcaaaagatg

SEQ ID NO: 106973 - DNA, 103 bp, Artificial Sequence
  Synthetic Polynucleotide
taatacgactcactatagggttccgcttcacctttttatacaggtcccacaacagaggagagtgggaatggtataaaaaaacctggcggcagcgcaaaagatg

SEQ ID NO: 106974 - DNA, 103 bp, Artificial Sequence
  Synthetic Polynucleotide
taatacgactcactataggggcgggagttcagtttccttaaacttgtgtcaacagaggagagacacaatgttaaggaaaaacctggcggcagcgcaaaagatg

SEQ ID NO: 106975 - DNA, 103 bp, Artificial Sequence
  Synthetic Polynucleotide
taatacgactcactatagggaggtgtgctgttccgcttcacctttttataaacagaggagatataaaatggtgaagcggaacctggcggcagcgcaaaagatg

SEQ ID NO: 106976 - DNA, 103 bp, Artificial Sequence
  Synthetic Polynucleotide
taatacgactcactataggggggagaggggaggtgtgctgttccgcttcaaacagaggagatgaagcatgacagcacacaacctggcggcagcgcaaaagatg

SEQ ID NO: 106977 - DNA, 103 bp, Artificial Sequence
  Synthetic Polynucleotide
taatacgactcactatagggtgcccaaatagggagaggggaggtgtgctgaacagaggagacagcacatgtcccctctcaacctggcggcagcgcaaaagatg

SEQ ID NO: 106978 - DNA, 103 bp, Artificial Sequence
  Synthetic Polynucleotide
taatacgactcactatagggccataggagttgcccaaatagggagaggggaacagaggagacccctcatgctatttgggaacctggcggcagcgcaaaagatg

SEQ ID NO: 106979 - DNA, 103 bp, Artificial Sequence
  Synthetic Polynucleotide
taatacgactcactatagggagaactctcgccataggagttgcccaaataaacagaggagatatttgatgaactcctataacctggcggcagcgcaaaagatg

SEQ ID NO: 106980 - DNA, 103 bp, Artificial Sequence
  Synthetic Polynucleotide
taatacgactcactataggggccgtgtagaagaactctcgccataggagtaacagaggagaactcctatggcgagagttaacctggcggcagcgcaaaagatg

SEQ ID NO: 106981 - DNA, 103 bp, Artificial Sequence
  Synthetic Polynucleotide
taatacgactcactataggggttggtagctgccgtgtagaagaactctcgaacagaggagacgagagatgttctacacgaacctggcggcagcgcaaaagatg

SEQ ID NO: 106982 - DNA, 103 bp, Artificial Sequence
  Synthetic Polynucleotide
taatacgactcactatagggacctggggttgttggtagctgccgtgtagaaacagaggagatctacaatgcagctaccaaacctggcggcagcgcaaaagatg

SEQ ID NO: 106983 - DNA, 103 bp, Artificial Sequence
  Synthetic Polynucleotide
taatacgactcactatagggatgcggtcaaacctggggttgttggtagctaacagaggagaagctacatgcaaccccagaacctggcggcagcgcaaaagatg

SEQ ID NO: 106984 - DNA, 103 bp, Artificial Sequence
  Synthetic Polynucleotide
taatacgactcactataggggttcccctccatgcggtcaaacctggggttaacagaggagaaaccccatgtttgaccgcaacctggcggcagcgcaaaagatg

SEQ ID NO: 106985 - DNA, 103 bp, Artificial Sequence
  Synthetic Polynucleotide
taatacgactcactatagggctacaaacaggcgggagttcagtttccttaaacagaggagataaggaatgtgaactcccaacctggcggcagcgcaaaagatg

SEQ ID NO: 106986 - DNA, 103 bp, Artificial Sequence
  Synthetic Polynucleotide
taatacgactcactatagggtgcagatggggttcccctccatgcggtcaaaacagaggagattgaccatgtggaggggaaacctggcggcagcgcaaaagatg

SEQ ID NO: 106987 - DNA, 103 bp, Artificial Sequence
  Synthetic Polynucleotide
taatacgactcactataggggggatctggatgcagatggggttcccctccaacagaggagaggagggatgccccatctgaacctggcggcagcgcaaaagatg

SEQ ID NO: 106988 - DNA, 103 bp, Artificial Sequence
  Synthetic Polynucleotide
taatacgactcactataggggcggtcccaggggatctggatgcagatgggaacagaggagacccatcatgatccagatcaacctggcggcagcgcaaaagatg

SEQ ID NO: 106989 - DNA, 103 bp, Artificial Sequence
  Synthetic Polynucleotide
taatacgactcactatagggcctcaggattgcggtcccaggggatctggaaacagaggagatccagaatgcctgggaccaacctggcggcagcgcaaaagatg

SEQ ID NO: 106990 - DNA, 103 bp, Artificial Sequence
  Synthetic Polynucleotide
taatacgactcactatagggttggccagggcctcaggattgcggtcccagaacagaggagactgggaatgcaatcctgaaacctggcggcagcgcaaaagatg

SEQ ID NO: 106991 - DNA, 103 bp, Artificial Sequence
  Synthetic Polynucleotide
taatacgactcactatagggctcagcccacttggccagggcctcaggattaacagaggagaaatcctatggccctggccaacctggcggcagcgcaaaagatg

SEQ ID NO: 106992 - DNA, 103 bp, Artificial Sequence
  Synthetic Polynucleotide
taatacgactcactatagggctgtcttgccctcagcccacttggccagggaacagaggagaccctggatgagtgggctgaacctggcggcagcgcaaaagatg

SEQ ID NO: 106993 - DNA, 103 bp, Artificial Sequence
  Synthetic Polynucleotide
taatacgactcactatagggcaagggaagcctgtcttgccctcagcccacaacagaggagagtgggcatggggcaagacaacctggcggcagcgcaaaagatg

SEQ ID NO: 106994 - DNA, 103 bp, Artificial Sequence
  Synthetic Polynucleotide
taatacgactcactatagggggcatcaatccaagggaagcctgtcttgccaacagaggagaggcaagatgggcttccctaacctggcggcagcgcaaaagatg

SEQ ID NO: 106995 - DNA, 103 bp, Artificial Sequence
  Synthetic Polynucleotide
taatacgactcactataggggggtcatgatggcatcaatccaagggaagcaacagaggagagcttccatgggattgatgaacctggcggcagcgcaaaagatg

SEQ ID NO: 106996 - DNA, 103 bp, Artificial Sequence
  Synthetic Polynucleotide
taatacgactcactatagggtgtccccggactacaaacaggcgggagttcaacagaggagagaactcatgcctgtttgtaacctggcggcagcgcaaaagatg

SEQ ID NO: 106997 - DNA, 103 bp, Artificial Sequence
  Synthetic Polynucleotide
taatacgactcactatagggtgcctcagttgggtcatgatggcatcaatcaacagaggagagattgaatgcatcatgacaacctggcggcagcgcaaaagatg

SEQ ID NO: 106998 - DNA, 103 bp, Artificial Sequence
  Synthetic Polynucleotide
taatacgactcactatagggccagccctcctgcctcagttgggtcatgataacagaggagaatcatgatgcaactgaggaacctggcggcagcgcaaaagatg

SEQ ID NO: 106999 - DNA, 103 bp, Artificial Sequence
  Synthetic Polynucleotide
taatacgactcactatagggggtggtggatccagccctcctgcctcagttaacagaggagaaactgaatgaggagggctaacctggcggcagcgcaaaagatg

SEQ ID NO: 107000 - DNA, 103 bp, Artificial Sequence
  Synthetic Polynucleotide
taatacgactcactatagggtgccgggccaggtggtggatccagccctccaacagaggagaggagggatggatccaccaaacctggcggcagcgcaaaagatg

SEQ ID NO: 107001 - DNA, 103 bp, Artificial Sequence
  Synthetic Polynucleotide
taatacgactcactatagggggccacggcatgccgggccaggtggtggataacagaggagaatccacatgctggcccggaacctggcggcagcgcaaaagatg

SEQ ID NO: 107002 - DNA, 103 bp, Artificial Sequence
  Synthetic Polynucleotide
taatacgactcactatagggtcaggaagcaggccacggcatgccgggccaaacagaggagatggcccatgatgccgtggaacctggcggcagcgcaaaagatg

SEQ ID NO: 107003 - DNA, 103 bp, Artificial Sequence
  Synthetic Polynucleotide
taatacgactcactatagggtccccgcgggtcaggaagcaggccacggcaaacagaggagatgccgtatgctgcttcctaacctggcggcagcgcaaaagatg

SEQ ID NO: 107004 - DNA, 103 bp, Artificial Sequence
  Synthetic Polynucleotide
taatacgactcactataggggacccagaggtccccgcgggtcaggaagcaaacagaggagatgcttcatgacccgcgggaacctggcggcagcgcaaaagatg

SEQ ID NO: 107005 - DNA, 103 bp, Artificial Sequence
  Synthetic Polynucleotide
taatacgactcactatagggtctcccagctgacccagaggtccccgcgggaacagaggagacccgcgatgacctctgggaacctggcggcagcgcaaaagatg

SEQ ID NO: 107006 - DNA, 103 bp, Artificial Sequence
  Synthetic Polynucleotide
taatacgactcactatagggcggaccccgctctcccagctgacccagaggaacagaggagacctctgatgcagctgggaaacctggcggcagcgcaaaagatg

SEQ ID NO: 107007 - DNA, 103 bp, Artificial Sequence
  Synthetic Polynucleotide
taatacgactcactatagggggtgctgtccgagggtgtcgggagggccataacagaggagaatggccatgccgacacccaacctggcggcagcgcaaaagatg

SEQ ID NO: 107008 - DNA, 103 bp, Artificial Sequence
  Synthetic Polynucleotide
taatacgactcactatagggccgctcaaagcaggctcgcagggcctcgctaacagaggagaagcgagatgctgcgagccaacctggcggcagcgcaaaagatg

SEQ ID NO: 107009 - DNA, 103 bp, Artificial Sequence
  Synthetic Polynucleotide
taatacgactcactatagggggcgtccgggggcgcgggctggggaggtggaacagaggagaccacctatgcagcccgcgaacctggcggcagcgcaaaagatg

SEQ ID NO: 107010 - DNA, 103 bp, Artificial Sequence
  Synthetic Polynucleotide
taatacgactcactatagggcggaggcggaggcgtccgggggcgcgggctaacagaggagaagcccgatgccccggacgaacctggcggcagcgcaaaagatg

SEQ ID NO: 107011 - DNA, 103 bp, Artificial Sequence
  Synthetic Polynucleotide
taatacgactcactatagggccctgccgcgcggaggcggaggcgtccgggaacagaggagacccggaatgctccgcctcaacctggcggcagcgcaaaagatg

SEQ ID NO: 107012 - DNA, 103 bp, Artificial Sequence
  Synthetic Polynucleotide
taatacgactcactatagggttgcatctgcccctgccgcgcggaggcggaaacagaggagatccgccatggcgcggcagaacctggcggcagcgcaaaagatg

SEQ ID NO: 107013 - DNA, 103 bp, Artificial Sequence
  Synthetic Polynucleotide
taatacgactcactatagggccgggatgccttgcatctgcccctgccgcgaacagaggagacgcggcatgggcagatgcaacctggcggcagcgcaaaagatg

SEQ ID NO: 107014 - DNA, 103 bp, Artificial Sequence
  Synthetic Polynucleotide
taatacgactcactatagggtgggagggcgccgggatgccttgcatctgcaacagaggagagcagatatgaggcatcccaacctggcggcagcgcaaaagatg

SEQ ID NO: 107015 - DNA, 103 bp, Artificial Sequence
  Synthetic Polynucleotide
taatacgactcactatagggctggagcgcctgggagggcgccgggatgccaacagaggagaggcatcatggcgccctccaacctggcggcagcgcaaaagatg

SEQ ID NO: 107016 - DNA, 103 bp, Artificial Sequence
  Synthetic Polynucleotide
taatacgactcactataggggcgccggctcctggagcgcctgggagggcgaacagaggagacgccctatgaggcgctccaacctggcggcagcgcaaaagatg

SEQ ID NO: 107017 - DNA, 103 bp, Artificial Sequence
  Synthetic Polynucleotide
taatacgactcactataggggcagaccagggcgccggctcctggagcgccaacagaggagaggcgctatgggagccggcaacctggcggcagcgcaaaagatg

SEQ ID NO: 107018 - DNA, 103 bp, Artificial Sequence
  Synthetic Polynucleotide
taatacgactcactataggggcaggggagtgcagaccagggcgccggctcaacagaggagagagccgatgccctggtctaacctggcggcagcgcaaaagatg

SEQ ID NO: 107019 - DNA, 103 bp, Artificial Sequence
  Synthetic Polynucleotide
taatacgactcactatagggggtacgggttccgctcaaagcaggctcgcaaacagaggagatgcgagatggctttgagcaacctggcggcagcgcaaaagatg

SEQ ID NO: 107020 - DNA, 103 bp, Artificial Sequence
  Synthetic Polynucleotide
taatacgactcactataggggcagcaggccgcaggggagtgcagaccaggaacagaggagacctggtatgcactcccctaacctggcggcagcgcaaaagatg

SEQ ID NO: 107021 - DNA, 103 bp, Artificial Sequence
  Synthetic Polynucleotide
taatacgactcactatagggagctcatccagcagcaggccgcaggggagtaacagaggagaactcccatgcggcctgctaacctggcggcagcgcaaaagatg

SEQ ID NO: 107022 - DNA, 103 bp, Artificial Sequence
  Synthetic Polynucleotide
taatacgactcactataggggctcgccaggagctcatccagcagcaggccaacagaggagaggcctgatgctggatgagaacctggcggcagcgcaaaagatg

SEQ ID NO: 107023 - DNA, 103 bp, Artificial Sequence
  Synthetic Polynucleotide
taatacgactcactataggggaaactccgggctcgccaggagctcatccaaacagaggagatggatgatgtcctggcgaaacctggcggcagcgcaaaagatg

SEQ ID NO: 107024 - DNA, 103 bp, Artificial Sequence
  Synthetic Polynucleotide
taatacgactcactataggggcctgctgcagaaactccgggctcgccaggaacagaggagacctggcatgcccggagttaacctggcggcagcgcaaaagatg

SEQ ID NO: 107025 - DNA, 103 bp, Artificial Sequence
  Synthetic Polynucleotide
taatacgactcactataggggagaggttgcgcctgctgcagaaactccggaacagaggagaccggagatgctgcagcagaacctggcggcagcgcaaaagatg

SEQ ID NO: 107026 - DNA, 103 bp, Artificial Sequence
  Synthetic Polynucleotide
taatacgactcactatagggccgtttctaggagaggttgcgcctgctgcaaacagaggagatgcagcatgcgcaacctcaacctggcggcagcgcaaaagatg

SEQ ID NO: 107027 - DNA, 103 bp, Artificial Sequence
  Synthetic Polynucleotide
taatacgactcactatagggcccggggcctccgtttctaggagaggttgcaacagaggagagcaaccatgcctagaaacaacctggcggcagcgcaaaagatg

SEQ ID NO: 107028 - DNA, 103 bp, Artificial Sequence
  Synthetic Polynucleotide
taatacgactcactatagggctccagctcccccggggcctccgtttctagaacagaggagactagaaatggaggccccgaacctggcggcagcgcaaaagatg

SEQ ID NO: 107029 - DNA, 103 bp, Artificial Sequence
  Synthetic Polynucleotide
taatacgactcactatagggcttccgaggcctccagctcccccggggcctaacagaggagaaggcccatggggagctggaacctggcggcagcgcaaaagatg

SEQ ID NO: 107030 - DNA, 103 bp, Artificial Sequence
  Synthetic Polynucleotide
taatacgactcactataggggcgatgcccgggtacgggttccgctcaaagaacagaggagactttgaatggaacccgtaaacctggcggcagcgcaaaagatg

SEQ ID NO: 107031 - DNA, 103 bp, Artificial Sequence
  Synthetic Polynucleotide
taatacgactcactataggggaggcggcctcttccgaggcctccagctccaacagaggagaggagctatgggcctcggaaacctggcggcagcgcaaaagatg

SEQ ID NO: 107032 - DNA, 103 bp, Artificial Sequence
  Synthetic Polynucleotide
taatacgactcactatagggtgcttccagcgaggcggcctcttccgaggcaacagaggagagcctcgatggaggccgccaacctggcggcagcgcaaaagatg

SEQ ID NO: 107033 - DNA, 103 bp, Artificial Sequence
  Synthetic Polynucleotide
taatacgactcactatagggcgctgaggggtgcttccagcgaggcggcctaacagaggagaaggccgatgcgctggaagaacctggcggcagcgcaaaagatg

SEQ ID NO: 107034 - DNA, 103 bp, Artificial Sequence
  Synthetic Polynucleotide
taatacgactcactatagggtattcttcctcgctgaggggtgcttccagcaacagaggagagctggaatgacccctcagaacctggcggcagcgcaaaagatg

SEQ ID NO: 107035 - DNA, 103 bp, Artificial Sequence
  Synthetic Polynucleotide
taatacgactcactatagggcagagcccggtattcttcctcgctgaggggaacagaggagacccctcatggaggaagaaaacctggcggcagcgcaaaagatg

SEQ ID NO: 107036 - DNA, 103 bp, Artificial Sequence
  Synthetic Polynucleotide
taatacgactcactataggggctcctccagcagagcccggtattcttcctaacagaggagaaggaagatgaccgggctcaacctggcggcagcgcaaaagatg

SEQ ID NO: 107037 - DNA, 103 bp, Artificial Sequence
  Synthetic Polynucleotide
taatacgactcactatagggttctctggtggcgatgcccgggtacgggttaacagaggagaaacccgatgccgggcatcaacctggcggcagcgcaaaagatg

SEQ ID NO: 107038 - DNA, 103 bp, Artificial Sequence
  Synthetic Polynucleotide
taatacgactcactataggggggccagccgttctctggtggcgatgcccgaacagaggagacgggcaatgccaccagagaacctggcggcagcgcaaaagatg

SEQ ID NO: 107039 - DNA, 103 bp, Artificial Sequence
  Synthetic Polynucleotide
taatacgactcactatagggccgatggcctgggccagccgttctctggtgaacagaggagacaccagatgacggctggcaacctggcggcagcgcaaaagatg

SEQ ID NO: 107040 - DNA, 103 bp, Artificial Sequence
  Synthetic Polynucleotide
taatacgactcactatagggctccggaatgccgatggcctgggccagccgaacagaggagacggctgatgcaggccatcaacctggcggcagcgcaaaagatg

SEQ ID NO: 107041 - DNA, 103 bp, Artificial Sequence
  Synthetic Polynucleotide
taatacgactcactatagggggaccctgggctccggaatgccgatggcctaacagaggagaaggccaatggcattccggaacctggcggcagcgcaaaagatg

SEQ ID NO: 107042 - DNA, 103 bp, Artificial Sequence
  Synthetic Polynucleotide
taatacgactcactatagggaaccaaatctggaccctgggctccggaatgaacagaggagacattccatggcccagggtaacctggcggcagcgcaaaagatg

SEQ ID NO: 107043 - DNA, 103 bp, Artificial Sequence
  Synthetic Polynucleotide
taatacgactcactatagggctcattctgaaaccaaatctggaccctgggaacagaggagacccaggatgcagatttggaacctggcggcagcgcaaaagatg

SEQ ID NO: 107044 - DNA, 103 bp, Artificial Sequence
  Synthetic Polynucleotide
taatacgactcactatagggccgcggggagggtgctgtccgagggtgtcgaacagaggagacgacacatgcggacagcaaacctggcggcagcgcaaaagatg

SEQ ID NO: 107045 - DNA, 103 bp, Artificial Sequence
  Synthetic Polynucleotide
taatacgactcactatagggggcgtgacctctcattctgaaaccaaatctaacagaggagaagatttatgttcagaatgaacctggcggcagcgcaaaagatg

SEQ ID NO: 107046 - DNA, 103 bp, Artificial Sequence
  Synthetic Polynucleotide
taatacgactcactatagggtgcctcagctggcgtgacctctcattctgaaacagaggagatcagaaatggaggtcacgaacctggcggcagcgcaaaagatg

SEQ ID NO: 107047 - DNA, 103 bp, Artificial Sequence
  Synthetic Polynucleotide
taatacgactcactatagggccgccggtgctgcctcagctggcgtgacctaacagaggagaaggtcaatgcagctgaggaacctggcggcagcgcaaaagatg

SEQ ID NO: 107048 - DNA, 103 bp, Artificial Sequence
  Synthetic Polynucleotide
taatacgactcactataggggccgagattcccgccggtgctgcctcagctaacagaggagaagctgaatgagcaccggcaacctggcggcagcgcaaaagatg

SEQ ID NO: 107049 - DNA, 103 bp, Artificial Sequence
  Synthetic Polynucleotide
taatacgactcactatagggccgggccagggccgagattcccgccggtgcaacagaggagagcaccgatgggaatctcgaacctggcggcagcgcaaaagatg

SEQ ID NO: 107050 - DNA, 103 bp, Artificial Sequence
  Synthetic Polynucleotide
taatacgactcactataggggccgcgtctcccgggccagggccgagattcaacagaggagagaatctatgccctggcccaacctggcggcagcgcaaaagatg

SEQ ID NO: 107051 - DNA, 103 bp, Artificial Sequence
  Synthetic Polynucleotide
taatacgactcactatagggcttctggcgggccgcgtctcccgggccaggaacagaggagacctggcatgggagacgcgaacctggcggcagcgcaaaagatg

SEQ ID NO: 107052 - DNA, 103 bp, Artificial Sequence
  Synthetic Polynucleotide
taatacgactcactatagggtttcgccggccttctggcgggccgcgtctcaacagaggagagagacgatgcccgccagaaacctggcggcagcgcaaaagatg

SEQ ID NO: 107053 - DNA, 103 bp, Artificial Sequence
  Synthetic Polynucleotide
taatacgactcactatagggggcggtccgctttcgccggccttctggcggaacagaggagaccgccaatgggccggcgaaacctggcggcagcgcaaaagatg

SEQ ID NO: 107054 - DNA, 103 bp, Artificial Sequence
  Synthetic Polynucleotide
taatacgactcactatagggatccggtgacggcggtccgctttcgccggcaacagaggagagccggcatgagcggaccgaacctggcggcagcgcaaaagatg

SEQ ID NO: 107055 - DNA, 103 bp, Artificial Sequence
  Synthetic Polynucleotide
taatacgactcactatagggccccgggcttccgcggggagggtgctgtccaacagaggagaggacagatgcctccccgcaacctggcggcagcgcaaaagatg

SEQ ID NO: 107056 - DNA, 103 bp, Artificial Sequence
  Synthetic Polynucleotide
taatacgactcactataggggcggtctgggatccggtgacggcggtccgcaacagaggagagcggacatgcgtcaccggaacctggcggcagcgcaaaagatg

SEQ ID NO: 107057 - DNA, 103 bp, Artificial Sequence
  Synthetic Polynucleotide
taatacgactcactataggggaggagcagggcggtctgggatccggtgacaacagaggagagtcaccatgtcccagaccaacctggcggcagcgcaaaagatg

SEQ ID NO: 107058 - DNA, 103 bp, Artificial Sequence
  Synthetic Polynucleotide
taatacgactcactatagggcaaaggctcggaggagcagggcggtctgggaacagaggagacccagaatgccctgctccaacctggcggcagcgcaaaagatg

SEQ ID NO: 107059 - DNA, 103 bp, Artificial Sequence
  Synthetic Polynucleotide
taatacgactcactatagggcgatccttctcaaaggctcggaggagcaggaacagaggagacctgctatgccgagccttaacctggcggcagcgcaaaagatg

SEQ ID NO: 107060 - DNA, 103 bp, Artificial Sequence
  Synthetic Polynucleotide
taatacgactcactataggggcctggaaagcgatccttctcaaaggctcgaacagaggagacgagccatggagaaggataacctggcggcagcgcaaaagatg

SEQ ID NO: 107061 - DNA, 103 bp, Artificial Sequence
  Synthetic Polynucleotide
taatacgactcactataggggggcggcgatgcctggaaagcgatccttctaacagaggagaagaaggatggctttccagaacctggcggcagcgcaaaagatg

SEQ ID NO: 107062 - DNA, 103 bp, Artificial Sequence
  Synthetic Polynucleotide
taatacgactcactatagggagctcctcccgggcggcgatgcctggaaagaacagaggagactttccatgcatcgccgcaacctggcggcagcgcaaaagatg

SEQ ID NO: 107063 - DNA, 103 bp, Artificial Sequence
  Synthetic Polynucleotide
taatacgactcactatagggctctctggccagctcctcccgggcggcgataacagaggagaatcgccatgcgggaggagaacctggcggcagcgcaaaagatg

SEQ ID NO: 107064 - DNA, 103 bp, Artificial Sequence
  Synthetic Polynucleotide
taatacgactcactatagggggaggcccgtctctctggccagctcctcccaacagaggagagggaggatgtggccagagaacctggcggcagcgcaaaagatg

SEQ ID NO: 107065 - DNA, 103 bp, Artificial Sequence
  Synthetic Polynucleotide
taatacgactcactatagggctggactccgggaggcccgtctctctggccaacagaggagaggccagatggacgggcctaacctggcggcagcgcaaaagatg

SEQ ID NO: 107066 - DNA, 103 bp, Artificial Sequence
  Synthetic Polynucleotide
taatacgactcactatagggccgtcctcgtccccgggcttccgcggggagaacagaggagactccccatggaagcccggaacctggcggcagcgcaaaagatg

SEQ ID NO: 107067 - DNA, 103 bp, Artificial Sequence
  Synthetic Polynucleotide
taatacgactcactataggggatctgaatcctggactccgggaggcccgtaacagaggagaacgggcatgccggagtccaacctggcggcagcgcaaaagatg

SEQ ID NO: 107068 - DNA, 103 bp, Artificial Sequence
  Synthetic Polynucleotide
taatacgactcactatagggtctgaaaccagatctgaatcctggactccgaacagaggagacggagtatgggattcagaaacctggcggcagcgcaaaagatg

SEQ ID NO: 107069 - DNA, 103 bp, Artificial Sequence
  Synthetic Polynucleotide
taatacgactcactataggggcccttcgattctgaaaccagatctgaatcaacagaggagagattcaatgctggtttcaaacctggcggcagcgcaaaagatg

SEQ ID NO: 107070 - DNA, 103 bp, Artificial Sequence
  Synthetic Polynucleotide
taatacgactcactatagggcgggtgcctggcccttcgattctgaaaccaaacagaggagatggtttatgaatcgaaggaacctggcggcagcgcaaaagatg

SEQ ID NO: 107071 - DNA, 103 bp, Artificial Sequence
  Synthetic Polynucleotide
taatacgactcactatagggcaccctgtcccgggtgcctggcccttcgataacagaggagaatcgaaatgccaggcaccaacctggcggcagcgcaaaagatg

SEQ ID NO: 107072 - DNA, 103 bp, Artificial Sequence
  Synthetic Polynucleotide
taatacgactcactatagggggcgccctgccaccctgtcccgggtgcctgaacagaggagacaggcaatggggacagggaacctggcggcagcgcaaaagatg

SEQ ID NO: 107073 - DNA, 103 bp, Artificial Sequence
  Synthetic Polynucleotide
taatacgactcactatagggtgcctgcgcgggcgccctgccaccctgtccaacagaggagaggacagatgggcagggcgaacctggcggcagcgcaaaagatg

SEQ ID NO: 107074 - DNA, 103 bp, Artificial Sequence
  Synthetic Polynucleotide
taatacgactcactatagggacaggccgcctgcctgcgcgggcgccctgcaacagaggagagcagggatgccgcgcaggaacctggcggcagcgcaaaagatg

SEQ ID NO: 107075 - DNA, 103 bp, Artificial Sequence
  Synthetic Polynucleotide
taatacgactcactataggggccgcgctgcacaggccgcctgcctgcgcgaacagaggagacgcgcaatgaggcggcctaacctggcggcagcgcaaaagatg

SEQ ID NO: 107076 - DNA, 103 bp, Artificial Sequence
  Synthetic Polynucleotide
taatacgactcactatagggcccgccgggggccgcgctgcacaggccgccaacagaggagaggcggcatgtgcagcgcgaacctggcggcagcgcaaaagatg

SEQ ID NO: 107077 - DNA, 103 bp, Artificial Sequence
  Synthetic Polynucleotide
taatacgactcactataggggtctccgtcgccgtcctcgtccccgggcttaacagaggagaaagcccatggacgaggacaacctggcggcagcgcaaaagatg

SEQ ID NO: 107078 - DNA, 103 bp, Artificial Sequence
  Synthetic Polynucleotide
taatacgactcactatagggcagggtgacccccgccgggggccgcgctgcaacagaggagagcagcgatgcccccggcgaacctggcggcagcgcaaaagatg

SEQ ID NO: 107079 - DNA, 103 bp, Artificial Sequence
  Synthetic Polynucleotide
taatacgactcactatagggcacgagggagcagggtgacccccgccggggaacagaggagaccccggatggggtcacccaacctggcggcagcgcaaaagatg

SEQ ID NO: 107080 - DNA, 103 bp, Artificial Sequence
  Synthetic Polynucleotide
taatacgactcactataggggaaggcgacccacgagggagcagggtgaccaacagaggagaggtcacatggctccctcgaacctggcggcagcgcaaaagatg

SEQ ID NO: 107081 - DNA, 103 bp, Artificial Sequence
  Synthetic Polynucleotide
taatacgactcactatagggcggtgtgggcgaaggcgacccacgagggagaacagaggagactccctatggggtcgcctaacctggcggcagcgcaaaagatg

SEQ ID NO: 107082 - DNA, 103 bp, Artificial Sequence
  Synthetic Polynucleotide
taatacgactcactatagggccccacgcgccggtgtgggcgaaggcgaccaacagaggagaggtcgcatgcgcccacacaacctggcggcagcgcaaaagatg

SEQ ID NO: 107083 - DNA, 103 bp, Artificial Sequence
  Synthetic Polynucleotide
taatacgactcactatagggaagccccgttccccacgcgccggtgtgggcaacagaggagagcccacatgggcgcgtggaacctggcggcagcgcaaaagatg

SEQ ID NO: 107084 - DNA, 103 bp, Artificial Sequence
  Synthetic Polynucleotide
taatacgactcactatagggggggtgcgggaagccccgttccccacgcgcaacagaggagagcgcgtatggaacggggcaacctggcggcagcgcaaaagatg

SEQ ID NO: 107085 - DNA, 103 bp, Artificial Sequence
  Synthetic Polynucleotide
taatacgactcactatagggcagggcacgtggggtgcgggaagccccgttaacagaggagaaacgggatgtcccgcaccaacctggcggcagcgcaaaagatg

SEQ ID NO: 107086 - DNA, 103 bp, Artificial Sequence
  Synthetic Polynucleotide
taatacgactcactatagggcccaggcgcgcagggcacgtggggtgcgggaacagaggagacccgcaatgcacgtgcccaacctggcggcagcgcaaaagatg

SEQ ID NO: 107087 - DNA, 103 bp, Artificial Sequence
  Synthetic Polynucleotide
taatacgactcactataggggtgggagagccccaggcgcgcagggcacgtaacagaggagaacgtgcatggcgcgcctgaacctggcggcagcgcaaaagatg

SEQ ID NO: 107088 - DNA, 103 bp, Artificial Sequence
  Synthetic Polynucleotide
taatacgactcactataggggtccaaacgagtctccgtcgccgtcctcgtaacagaggagaacgaggatggcgacggagaacctggcggcagcgcaaaagatg

SEQ ID NO: 107089 - DNA, 103 bp, Artificial Sequence
  Synthetic Polynucleotide
taatacgactcactatagggaaagccccctgtgggagagccccaggcgcgaacagaggagacgcgccatgggctctcccaacctggcggcagcgcaaaagatg

SEQ ID NO: 107090 - DNA, 103 bp, Artificial Sequence
  Synthetic Polynucleotide
taatacgactcactatagggctggctcacgaaagccccctgtgggagagcaacagaggagagctctcatgcagggggctaacctggcggcagcgcaaaagatg

SEQ ID NO: 107091 - DNA, 103 bp, Artificial Sequence
  Synthetic Polynucleotide
taatacgactcactatagggccctcgctgcctggctcacgaaagccccctaacagaggagaagggggatgtcgtgagccaacctggcggcagcgcaaaagatg

SEQ ID NO: 107092 - DNA, 103 bp, Artificial Sequence
  Synthetic Polynucleotide
taatacgactcactataggggcgggggcggccctcgctgcctggctcacgaacagaggagacgtgagatgggcagcgagaacctggcggcagcgcaaaagatg

SEQ ID NO: 107093 - DNA, 103 bp, Artificial Sequence
  Synthetic Polynucleotide
taatacgactcactataggggggctgcagcgcgggggcggccctcgctgcaacagaggagagcagcgatggccgcccccaacctggcggcagcgcaaaagatg

SEQ ID NO: 107094 - DNA, 103 bp, Artificial Sequence
  Synthetic Polynucleotide
taatacgactcactatagggcggcctggctgggctgcagcgcgggggcggaacagaggagaccgcccatgcgctgcagcaacctggcggcagcgcaaaagatg

SEQ ID NO: 107095 - DNA, 103 bp, Artificial Sequence
  Synthetic Polynucleotide
taatacgactcactatagggtctgccggcgcggcctggctgggctgcagcaacagaggagagctgcaatgcagccaggcaacctggcggcagcgcaaaagatg

SEQ ID NO: 107096 - DNA, 103 bp, Artificial Sequence
  Synthetic Polynucleotide
taatacgactcactatagggggagatcccctctgccggcgcggcctggctaacagaggagaagccagatggcgccggcaaacctggcggcagcgcaaaagatg

SEQ ID NO: 107097 - DNA, 103 bp, Artificial Sequence
  Synthetic Polynucleotide
taatacgactcactataggggggcaggttgggagatcccctctgccggcgaacagaggagacgccggatgaggggatctaacctggcggcagcgcaaaagatg

SEQ ID NO: 107098 - DNA, 103 bp, Artificial Sequence
  Synthetic Polynucleotide
taatacgactcactatagggccgcgcgccggggcaggttgggagatccccaacagaggagaggggatatgccaacctgcaacctggcggcagcgcaaaagatg

SEQ ID NO: 107099 - DNA, 103 bp, Artificial Sequence
  Synthetic Polynucleotide
taatacgactcactatagggttggctcggggtccaaacgagtctccgtcgaacagaggagacgacggatgctcgtttggaacctggcggcagcgcaaaagatg

SEQ ID NO: 107100 - DNA, 103 bp, Artificial Sequence
  Synthetic Polynucleotide
taatacgactcactatagggggcgaaatccccgcgcgccggggcaggttgaacagaggagacaacctatgccggcgcgcaacctggcggcagcgcaaaagatg

SEQ ID NO: 107101 - DNA, 103 bp, Artificial Sequence
  Synthetic Polynucleotide
taatacgactcactataggggggcggcgtaggcgaaatccccgcgcgccgaacagaggagacggcgcatggggatttcgaacctggcggcagcgcaaaagatg

SEQ ID NO: 107102 - DNA, 103 bp, Artificial Sequence
  Synthetic Polynucleotide
taatacgactcactatagggggaggagccggggcggcgtaggcgaaatccaacagaggagaggatttatgctacgccgcaacctggcggcagcgcaaaagatg

SEQ ID NO: 107103 - DNA, 103 bp, Artificial Sequence
  Synthetic Polynucleotide
taatacgactcactatagggcgccccgtccggaggagccggggcggcgtaaacagaggagatacgccatgccggctcctaacctggcggcagcgcaaaagatg

SEQ ID NO: 107104 - DNA, 103 bp, Artificial Sequence
  Synthetic Polynucleotide
taatacgactcactatagggggtgggagagcgccccgtccggaggagccgaacagaggagacggctcatgcggacggggaacctggcggcagcgcaaaagatg

SEQ ID NO: 107105 - DNA, 103 bp, Artificial Sequence
  Synthetic Polynucleotide
taatacgactcactatagggggagcctgagggtgggagagcgccccgtccaacagaggagaggacggatggctctcccaaacctggcggcagcgcaaaagatg

SEQ ID NO: 107106 - DNA, 103 bp, Artificial Sequence
  Synthetic Polynucleotide
taatacgactcactatagggaggccaccgaggagcctgagggtgggagagaacagaggagactctccatgcctcaggctaacctggcggcagcgcaaaagatg

SEQ ID NO: 107107 - DNA, 103 bp, Artificial Sequence
  Synthetic Polynucleotide
taatacgactcactatagggccgggtgcggaggccaccgaggagcctgagaacagaggagactcaggatgctcggtggcaacctggcggcagcgcaaaagatg

SEQ ID NO: 107108 - DNA, 103 bp, Artificial Sequence
  Synthetic Polynucleotide
taatacgactcactatagggcggcttttgcccgggtgcggaggccaccgaaacagaggagatcggtgatgtccgcacccaacctggcggcagcgcaaaagatg

SEQ ID NO: 107109 - DNA, 103 bp, Artificial Sequence
  Synthetic Polynucleotide
taatacgactcactatagggccggtcctcccggcttttgcccgggtgcggaacagaggagaccgcacatgggcaaaagcaacctggcggcagcgcaaaagatg

SEQ ID NO: 107110 - DNA, 103 bp, Artificial Sequence
  Synthetic Polynucleotide
taatacgactcactataggggggcctcgctttggctcggggtccaaacgaaacagaggagatcgtttatgccccgagccaacctggcggcagcgcaaaagatg

SEQ ID NO: 107111 - DNA, 103 bp, Artificial Sequence
  Synthetic Polynucleotide
taatacgactcactataggggctgcgggtcccggtcctcccggcttttgcaacagaggagagcaaaaatggggaggaccaacctggcggcagcgcaaaagatg

SEQ ID NO: 107112 - DNA, 103 bp, Artificial Sequence
  Synthetic Polynucleotide
taatacgactcactatagggaggccgtcgcgctgcgggtcccggtcctccaacagaggagaggaggaatgggacccgcaaacctggcggcagcgcaaaagatg

SEQ ID NO: 107113 - DNA, 103 bp, Artificial Sequence
  Synthetic Polynucleotide
taatacgactcactatagggggggcccggcaggccgtcgcgctgcgggtcaacagaggagagacccgatgcgcgacggcaacctggcggcagcgcaaaagatg

SEQ ID NO: 107114 - DNA, 103 bp, Artificial Sequence
  Synthetic Polynucleotide
taatacgactcactatagggccaccgcgcaggggcccggcaggccgtcgcaacagaggagagcgacgatgtgccgggccaacctggcggcagcgcaaaagatg

SEQ ID NO: 107115 - DNA, 103 bp, Artificial Sequence
  Synthetic Polynucleotide
taatacgactcactatagggccaggctgtgccaccgcgcaggggcccggcaacagaggagagccgggatgctgcgcggtaacctggcggcagcgcaaaagatg

SEQ ID NO: 107116 - DNA, 103 bp, Artificial Sequence
  Synthetic Polynucleotide
taatacgactcactatagggttgagcgggcccaggctgtgccaccgcgcaaacagaggagatgcgcgatggcacagcctaacctggcggcagcgcaaaagatg

SEQ ID NO: 107117 - DNA, 103 bp, Artificial Sequence
  Synthetic Polynucleotide
taatacgactcactataggggcggccccgcttgagcgggcccaggctgtgaacagaggagacacagcatgggcccgctcaacctggcggcagcgcaaaagatg

SEQ ID NO: 107118 - DNA, 103 bp, Artificial Sequence
  Synthetic Polynucleotide
taatacgactcactatagggccttggccctgcggccccgcttgagcgggcaacagaggagagcccgcatgagcggggccaacctggcggcagcgcaaaagatg

SEQ ID NO: 107119 - DNA, 103 bp, Artificial Sequence
  Synthetic Polynucleotide
taatacgactcactatagggcgcaagcaccccttggccctgcggccccgcaacagaggagagcggggatgcagggccaaaacctggcggcagcgcaaaagatg

SEQ ID NO: 107120 - DNA, 103 bp, Artificial Sequence
  Synthetic Polynucleotide
taatacgactcactatagggacgtgggtggcgcaagcaccccttggccctaacagaggagaagggccatggggtgcttgaacctggcggcagcgcaaaagatg

SEQ ID NO: 107121 - DNA, 103 bp, Artificial Sequence
  Synthetic Polynucleotide
taatacgactcactatagggcaggctcgcagggcctcgctttggctcgggaacagaggagacccgagatgaagcgaggcaacctggcggcagcgcaaaagatg

SEQ ID NO: 107122 - DNA, 103 bp, Artificial Sequence
  Synthetic Polynucleotide
taatacgactcactatagggctcccctgggacgtgggtggcgcaagcaccaacagaggagaggtgctatggccacccacaacctggcggcagcgcaaaagatg

SEQ ID NO: 107123 - DNA, 103 bp, Artificial Sequence
  Synthetic Polynucleotide
taatacgactcactatagggccaccacggactcccctgggacgtgggtggaacagaggagaccacccatgtcccaggggaacctggcggcagcgcaaaagatg

SEQ ID NO: 107124 - DNA, 103 bp, Artificial Sequence
  Synthetic Polynucleotide
taatacgactcactatagggggccccagccccaccacggactcccctgggaacagaggagacccaggatggtccgtggtaacctggcggcagcgcaaaagatg

SEQ ID NO: 107125 - DNA, 103 bp, Artificial Sequence
  Synthetic Polynucleotide
taatacgactcactatagggtggggaccccggccccagccccaccacggaaacagaggagatccgtgatggggctggggaacctggcggcagcgcaaaagatg

SEQ ID NO: 107126 - DNA, 103 bp, Artificial Sequence
  Synthetic Polynucleotide
taatacgactcactatagggcccggcgacctggggaccccggccccagccaacagaggagaggctggatgcggggtcccaacctggcggcagcgcaaaagatg

SEQ ID NO: 107127 - DNA, 103 bp, Artificial Sequence
  Synthetic Polynucleotide
taatacgactcactatagggcccacgccgccccggcgacctggggaccccaacagaggagaggggtcatgaggtcgccgaacctggcggcagcgcaaaagatg

SEQ ID NO: 107128 - DNA, 103 bp, Artificial Sequence
  Synthetic Polynucleotide
taatacgactcactataggggcttggggttcccacgccgccccggcgaccaacagaggagaggtcgcatgggcggcgtgaacctggcggcagcgcaaaagatg

SEQ ID NO: 107129 - DNA, 103 bp, Artificial Sequence
  Synthetic Polynucleotide
taatacgactcactatagggagctgccccggcttggggttcccacgccgcaacagaggagagcggcgatggaaccccaaaacctggcggcagcgcaaaagatg

SEQ ID NO: 107130 - DNA, 103 bp, Artificial Sequence
  Synthetic Polynucleotide
taatacgactcactatagggggggaggtggagctgccccggcttggggttaacagaggagaaaccccatgccggggcagaacctggcggcagcgcaaaagatg

SEQ ID NO: 107131 - DNA, 103 bp, Artificial Sequence
  Synthetic Polynucleotide
taatacgactcactatagggggcgcgggctggggaggtggagctgccccgaacagaggagacggggcatgtccacctccaacctggcggcagcgcaaaagatg

SEQ ID NO: 107132 - DNA, 103 bp, Artificial Sequence
  Synthetic Polynucleotide
taatacgactcactatagggcacaatggcttcgactgcatcaccttccataacagaggagaatggaaatggatgcagtcaacctggcggcagcgcaaaagatg

SEQ ID NO: 107133 - DNA, 103 bp, Artificial Sequence
  Synthetic Polynucleotide
taatacgactcactatagggtaagtggcaggcatcttcttcctggcccccaacagaggagagggggcatggaagaagataacctggcggcagcgcaaaagatg

SEQ ID NO: 107134 - DNA, 103 bp, Artificial Sequence
  Synthetic Polynucleotide
taatacgactcactatagggatgccgaaccaattctccactggtcacaaaaacagaggagatttgtgatgagtggagaaaacctggcggcagcgcaaaagatg

SEQ ID NO: 107135 - DNA, 103 bp, Artificial Sequence
  Synthetic Polynucleotide
taatacgactcactatagggtgtaacgacgatgccgaaccaattctccacaacagaggagagtggagatgtggttcggcaacctggcggcagcgcaaaagatg

SEQ ID NO: 107136 - DNA, 103 bp, Artificial Sequence
  Synthetic Polynucleotide
taatacgactcactatagggtgggtgtgtttgtaacgacgatgccgaaccaacagaggagaggttcgatgtcgtcgttaaacctggcggcagcgcaaaagatg

SEQ ID NO: 107137 - DNA, 103 bp, Artificial Sequence
  Synthetic Polynucleotide
taatacgactcactatagggtggcttctcgtgggtgtgtttgtaacgacgaacagaggagacgtcgtatgaaacacaccaacctggcggcagcgcaaaagatg

SEQ ID NO: 107138 - DNA, 103 bp, Artificial Sequence
  Synthetic Polynucleotide
taatacgactcactatagggaacacttgaatggcttctcgtgggtgtgttaacagaggagaaacacaatgacgagaagcaacctggcggcagcgcaaaagatg

SEQ ID NO: 107139 - DNA, 103 bp, Artificial Sequence
  Synthetic Polynucleotide
taatacgactcactatagggtcgcacatggaacacttgaatggcttctcgaacagaggagacgagaaatgattcaagtgaacctggcggcagcgcaaaagatg

SEQ ID NO: 107140 - DNA, 103 bp, Artificial Sequence
  Synthetic Polynucleotide
taatacgactcactatagggactggcgtaatcgcacatggaacacttgaaaacagaggagattcaagatgtccatgtgcaacctggcggcagcgcaaaagatg

SEQ ID NO: 107141 - DNA, 103 bp, Artificial Sequence
  Synthetic Polynucleotide
taatacgactcactatagggtgacttctacactggcgtaatcgcacatggaacagaggagaccatgtatgattacgccaaacctggcggcagcgcaaaagatg

SEQ ID NO: 107142 - DNA, 103 bp, Artificial Sequence
  Synthetic Polynucleotide
taatacgactcactatagggtttaatttgctgacttctacactggcgtaaaacagaggagattacgcatgtgtagaagtaacctggcggcagcgcaaaagatg

SEQ ID NO: 107143 - DNA, 103 bp, Artificial Sequence
  Synthetic Polynucleotide
taatacgactcactatagggaatgtgacgttttaatttgctgacttctacaacagaggagagtagaaatgagcaaattaaacctggcggcagcgcaaaagatg

SEQ ID NO: 107144 - DNA, 103 bp, Artificial Sequence
  Synthetic Polynucleotide
taatacgactcactatagggggttctggggtaagtggcaggcatcttcttaacagaggagaaagaagatgcctgccactaacctggcggcagcgcaaaagatg

SEQ ID NO: 107145 - DNA, 103 bp, Artificial Sequence
  Synthetic Polynucleotide
taatacgactcactatagggtatgagagcgaatgtgacgttttaatttgcaacagaggagagcaaatatgaacgtcacaaacctggcggcagcgcaaaagatg

SEQ ID NO: 107146 - DNA, 103 bp, Artificial Sequence
  Synthetic Polynucleotide
taatacgactcactatagggcgctctccagtatgagagcgaatgtgacgtaacagaggagaacgtcaatgtcgctctcaaacctggcggcagcgcaaaagatg

SEQ ID NO: 107147 - DNA, 103 bp, Artificial Sequence
  Synthetic Polynucleotide
taatacgactcactatagggctgaaacggacgctctccagtatgagagcgaacagaggagacgctctatgactggagagaacctggcggcagcgcaaaagatg

SEQ ID NO: 107148 - DNA, 103 bp, Artificial Sequence
  Synthetic Polynucleotide
taatacgactcactatagggacaaactgcactgaaacggacgctctccagaacagaggagactggagatggtccgtttcaacctggcggcagcgcaaaagatg

SEQ ID NO: 107149 - DNA, 103 bp, Artificial Sequence
  Synthetic Polynucleotide
taatacgactcactataggggcataactgcacaaactgcactgaaacggaaacagaggagatccgttatggtgcagtttaacctggcggcagcgcaaaagatg

SEQ ID NO: 107150 - DNA, 103 bp, Artificial Sequence
  Synthetic Polynucleotide
taatacgactcactataggggtccctgctggcataactgcacaaactgcaaacagaggagatgcagtatgtgcagttataacctggcggcagcgcaaaagatg

SEQ ID NO: 107151 - DNA, 103 bp, Artificial Sequence
  Synthetic Polynucleotide
taatacgactcactataggggcttgtatgtgtccctgctggcataactgcaacagaggagagcagttatgccagcagggaacctggcggcagcgcaaaagatg

SEQ ID NO: 107152 - DNA, 103 bp, Artificial Sequence
  Synthetic Polynucleotide
taatacgactcactatagggtgccttttcagcttgtatgtgtccctgctgaacagaggagacagcagatgcacatacaaaacctggcggcagcgcaaaagatg

SEQ ID NO: 107153 - DNA, 103 bp, Artificial Sequence
  Synthetic Polynucleotide
taatacgactcactatagggggttctcatgtgccttttcagcttgtatgtaacagaggagaacatacatgctgaaaaggaacctggcggcagcgcaaaagatg

SEQ ID NO: 107154 - DNA, 103 bp, Artificial Sequence
  Synthetic Polynucleotide
taatacgactcactatagggcccctgaatgggttctcatgtgccttttcaaacagaggagatgaaaaatgacatgagaaaacctggcggcagcgcaaaagatg

SEQ ID NO: 107155 - DNA, 103 bp, Artificial Sequence
  Synthetic Polynucleotide
taatacgactcactatagggccatccgtctggttctggggtaagtggcagaacagaggagactgccaatgaccccagaaaacctggcggcagcgcaaaagatg

SEQ ID NO: 107156 - DNA, 103 bp, Artificial Sequence
  Synthetic Polynucleotide
taatacgactcactatagggtaaggcttttcccctgaatgggttctcatgaacagaggagacatgagatgccattcaggaacctggcggcagcgcaaaagatg

SEQ ID NO: 107157 - DNA, 103 bp, Artificial Sequence
  Synthetic Polynucleotide
taatacgactcactatagggataacattcataaggcttttcccctgaatgaacagaggagacattcaatggaaaagcctaacctggcggcagcgcaaaagatg

SEQ ID NO: 107158 - DNA, 103 bp, Artificial Sequence
  Synthetic Polynucleotide
taatacgactcactatagggcatgacaaatataacattcataaggcttttaacagaggagaaaaagcatgatgaatgttaacctggcggcagcgcaaaagatg

SEQ ID NO: 107159 - DNA, 103 bp, Artificial Sequence
  Synthetic Polynucleotide
taatacgactcactataggggtaaaccgagcatgacaaatataacattcaaacagaggagatgaatgatgtatttgtcaaacctggcggcagcgcaaaagatg

SEQ ID NO: 107160 - DNA, 103 bp, Artificial Sequence
  Synthetic Polynucleotide
taatacgactcactatagggaccactttgggtaaaccgagcatgacaaataacagaggagaatttgtatggctcggtttaacctggcggcagcgcaaaagatg

SEQ ID NO: 107161 - DNA, 103 bp, Artificial Sequence
  Synthetic Polynucleotide
taatacgactcactatagggtcttcatggtaccactttgggtaaaccgagaacagaggagactcggtatgcccaaagtgaacctggcggcagcgcaaaagatg

SEQ ID NO: 107162 - DNA, 103 bp, Artificial Sequence
  Synthetic Polynucleotide
taatacgactcactatagggaaaatgtgcatcttcatggtaccactttggaacagaggagaccaaagatgtaccatgaaaacctggcggcagcgcaaaagatg

SEQ ID NO: 107163 - DNA, 103 bp, Artificial Sequence
  Synthetic Polynucleotide
taatacgactcactataggggtgcttctgtaaaatgtgcatcttcatggtaacagaggagaaccatgatgatgcacattaacctggcggcagcgcaaaagatg

SEQ ID NO: 107164 - DNA, 103 bp, Artificial Sequence
  Synthetic Polynucleotide
taatacgactcactatagggcattttctgtgtgcttctgtaaaatgtgcaaacagaggagatgcacaatgtacagaagcaacctggcggcagcgcaaaagatg

SEQ ID NO: 107165 - DNA, 103 bp, Artificial Sequence
  Synthetic Polynucleotide
taatacgactcactatagggaatttggccacattttctgtgtgcttctgtaacagaggagaacagaaatgcacagaaaaaacctggcggcagcgcaaaagatg

SEQ ID NO: 107166 - DNA, 103 bp, Artificial Sequence
  Synthetic Polynucleotide
taatacgactcactatagggcacctcacccccatccgtctggttctggggaacagaggagaccccagatgcagacggataacctggcggcagcgcaaaagatg

SEQ ID NO: 107167 - DNA, 103 bp, Artificial Sequence
  Synthetic Polynucleotide
taatacgactcactataggggggacagtgaaatttggccacattttctgtaacagaggagaacagaaatggtggccaaaaacctggcggcagcgcaaaagatg

SEQ ID NO: 107168 - DNA, 103 bp, Artificial Sequence
  Synthetic Polynucleotide
taatacgactcactatagggtgtcacagtggggacagtgaaatttggccaaacagaggagatggccaatgttcactgtcaacctggcggcagcgcaaaagatg

SEQ ID NO: 107169 - DNA, 103 bp, Artificial Sequence
  Synthetic Polynucleotide
taatacgactcactataggggctatgactgtgtcacagtggggacagtgaaacagaggagatcactgatgccactgtgaaacctggcggcagcgcaaaagatg

SEQ ID NO: 107170 - DNA, 103 bp, Artificial Sequence
  Synthetic Polynucleotide
taatacgactcactatagggactttttcgggctatgactgtgtcacagtgaacagaggagacactgtatgacagtcataaacctggcggcagcgcaaaagatg

SEQ ID NO: 107171 - DNA, 103 bp, Artificial Sequence
  Synthetic Polynucleotide
taatacgactcactatagggcacccaaatcactttttcgggctatgactgaacagaggagacagtcaatgcccgaaaaaaacctggcggcagcgcaaaagatg

SEQ ID NO: 107172 - DNA, 103 bp, Artificial Sequence
  Synthetic Polynucleotide
taatacgactcactatagggcgcaagtggacacccaaatcactttttcggaacagaggagaccgaaaatgtgatttgggaacctggcggcagcgcaaaagatg

SEQ ID NO: 107173 - DNA, 103 bp, Artificial Sequence
  Synthetic Polynucleotide
taatacgactcactatagggatgctgctttcgcaagtggacacccaaatcaacagaggagagatttgatggtccacttgaacctggcggcagcgcaaaagatg

SEQ ID NO: 107174 - DNA, 103 bp, Artificial Sequence
  Synthetic Polynucleotide
taatacgactcactatagggcaatataggaatgctgctttcgcaagtggaaacagaggagatccactatggaaagcagcaacctggcggcagcgcaaaagatg

SEQ ID NO: 107175 - DNA, 103 bp, Artificial Sequence
  Synthetic Polynucleotide
taatacgactcactatagggttgccttgctcaatataggaatgctgctttaacagaggagaaaagcaatgttcctatataacctggcggcagcgcaaaagatg

SEQ ID NO: 107176 - DNA, 103 bp, Artificial Sequence
  Synthetic Polynucleotide
taatacgactcactatagggacggcatttcttgccttgctcaatataggaaacagaggagatcctatatggagcaaggcaacctggcggcagcgcaaaagatg

SEQ ID NO: 107177 - DNA, 103 bp, Artificial Sequence
  Synthetic Polynucleotide
taatacgactcactatagggcatcctggaccacctcacccccatccgtctaacagaggagaagacggatgggggtgaggaacctggcggcagcgcaaaagatg

SEQ ID NO: 107178 - DNA, 103 bp, Artificial Sequence
  Synthetic Polynucleotide
taatacgactcactatagggcatcacagtaacggcatttcttgccttgctaacagaggagaagcaagatgagaaatgccaacctggcggcagcgcaaaagatg

SEQ ID NO: 107179 - DNA, 103 bp, Artificial Sequence
  Synthetic Polynucleotide
taatacgactcactatagggtgaaacacagcatcacagtaacggcatttcaacagaggagagaaatgatgttactgtgaaacctggcggcagcgcaaaagatg

SEQ ID NO: 107180 - DNA, 103 bp, Artificial Sequence
  Synthetic Polynucleotide
taatacgactcactatagggatagcgctcatgaaacacagcatcacagtaaacagaggagatactgtatggctgtgtttaacctggcggcagcgcaaaagatg

SEQ ID NO: 107181 - DNA, 103 bp, Artificial Sequence
  Synthetic Polynucleotide
taatacgactcactatagggggatgagggcatagcgctcatgaaacacagaacagaggagactgtgtatgatgagcgctaacctggcggcagcgcaaaagatg

SEQ ID NO: 107182 - DNA, 103 bp, Artificial Sequence
  Synthetic Polynucleotide
taatacgactcactatagggttctgatgctggatgagggcatagcgctcaaacagaggagatgagcgatgtgccctcataacctggcggcagcgcaaaagatg

SEQ ID NO: 107183 - DNA, 103 bp, Artificial Sequence
  Synthetic Polynucleotide
taatacgactcactatagggcttgtgtgacttctgatgctggatgagggcaacagaggagagccctcatgcagcatcagaacctggcggcagcgcaaaagatg

SEQ ID NO: 107184 - DNA, 103 bp, Artificial Sequence
  Synthetic Polynucleotide
taatacgactcactataggggcttctcattcttgtgtgacttctgatgctaacagaggagaagcatcatgagtcacacaaacctggcggcagcgcaaaagatg

SEQ ID NO: 107185 - DNA, 103 bp, Artificial Sequence
  Synthetic Polynucleotide
taatacgactcactatagggcacttaaagcgcttctcattcttgtgtgacaacagaggagagtcacaatggaatgagaaaacctggcggcagcgcaaaagatg

SEQ ID NO: 107186 - DNA, 103 bp, Artificial Sequence
  Synthetic Polynucleotide
taatacgactcactatagggacactggtcacacttaaagcgcttctcattaacagaggagaaatgagatgcgctttaagaacctggcggcagcgcaaaagatg

SEQ ID NO: 107187 - DNA, 103 bp, Artificial Sequence
  Synthetic Polynucleotide
taatacgactcactatagggaagcgtaatcacactggtcacacttaaagcaacagaggagagctttaatggtgaccagtaacctggcggcagcgcaaaagatg

SEQ ID NO: 107188 - DNA, 103 bp, Artificial Sequence
  Synthetic Polynucleotide
taatacgactcactatagggctgctgttgacatcctggaccacctcacccaacagaggagagggtgaatgggtccaggaaacctggcggcagcgcaaaagatg

SEQ ID NO: 107189 - DNA, 103 bp, Artificial Sequence
  Synthetic Polynucleotide
taatacgactcactatagggtcctgtctacaagcgtaatcacactggtcaaacagaggagatgaccaatgtgattacgcaacctggcggcagcgcaaaagatg

SEQ ID NO: 107190 - DNA, 103 bp, Artificial Sequence
  Synthetic Polynucleotide
taatacgactcactatagggcatgtgcctctcctgtctacaagcgtaatcaacagaggagagattacatgtgtagacagaacctggcggcagcgcaaaagatg

SEQ ID NO: 107191 - DNA, 103 bp, Artificial Sequence
  Synthetic Polynucleotide
taatacgactcactatagggtgtgcatgatcatgtgcctctcctgtctacaacagaggagagtagacatgagaggcacaaacctggcggcagcgcaaaagatg

SEQ ID NO: 107192 - DNA, 103 bp, Artificial Sequence
  Synthetic Polynucleotide
taatacgactcactatagggtgggtgcgcttgtgcatgatcatgtgcctcaacagaggagagaggcaatggatcatgcaaacctggcggcagcgcaaaagatg

SEQ ID NO: 107193 - DNA, 103 bp, Artificial Sequence
  Synthetic Polynucleotide
taatacgactcactatagggctccccggtgtgggtgcgcttgtgcatgataacagaggagaatcatgatgaagcgcaccaacctggcggcagcgcaaaagatg

SEQ ID NO: 107194 - DNA, 103 bp, Artificial Sequence
  Synthetic Polynucleotide
taatacgactcactatagggcgtaaggcttctccccggtgtgggtgcgctaacagaggagaagcgcaatgacaccggggaacctggcggcagcgcaaaagatg

SEQ ID NO: 107195 - DNA, 103 bp, Artificial Sequence
  Synthetic Polynucleotide
taatacgactcactatagggtggctgcaggcgtaaggcttctccccggtgaacagaggagacaccggatggaagccttaaacctggcggcagcgcaaaagatg

SEQ ID NO: 107196 - DNA, 103 bp, Artificial Sequence
  Synthetic Polynucleotide
taatacgactcactatagggcttatcgcagtggctgcaggcgtaaggcttaacagaggagaaagcctatggcctgcagcaacctggcggcagcgcaaaagatg

SEQ ID NO: 107197 - DNA, 103 bp, Artificial Sequence
  Synthetic Polynucleotide
taatacgactcactatagggggcggaaggtcttatcgcagtggctgcaggaacagaggagacctgcaatgactgcgataaacctggcggcagcgcaaaagatg

SEQ ID NO: 107198 - DNA, 103 bp, Artificial Sequence
  Synthetic Polynucleotide
taatacgactcactatagggagctgcttctggcggaaggtcttatcgcagaacagaggagactgcgaatggaccttccgaacctggcggcagcgcaaaagatg

SEQ ID NO: 107199 - DNA, 103 bp, Artificial Sequence
  Synthetic Polynucleotide
taatacgactcactatagggcatctgtacactgctgttgacatcctggacaacagaggagagtccagatggtcaacagcaacctggcggcagcgcaaaagatg

SEQ ID NO: 107200 - DNA, 103 bp, Artificial Sequence
  Synthetic Polynucleotide
taatacgactcactatagggcatgtcgagaagctgcttctggcggaaggtaacagaggagaaccttcatgcagaagcagaacctggcggcagcgcaaaagatg

SEQ ID NO: 107201 - DNA, 103 bp, Artificial Sequence
  Synthetic Polynucleotide
taatacgactcactataggggcttgaagtgcatgtcgagaagctgcttctaacagaggagaagaagcatgttctcgacaaacctggcggcagcgcaaaagatg

SEQ ID NO: 107202 - DNA, 103 bp, Artificial Sequence
  Synthetic Polynucleotide
taatacgactcactatagggtcgtgatagcgcttgaagtgcatgtcgagaaacagaggagatctcgaatggcacttcaaaacctggcggcagcgcaaaagatg

SEQ ID NO: 107203 - DNA, 103 bp, Artificial Sequence
  Synthetic Polynucleotide
taatacgactcactataggggaagttggggtcgtgatagcgcttgaagtgaacagaggagacacttcatgcgctatcacaacctggcggcagcgcaaaagatg

SEQ ID NO: 107204 - DNA, 103 bp, Artificial Sequence
  Synthetic Polynucleotide
taatacgactcactatagggccgcagggacgaagttggggtcgtgatagcaacagaggagagctatcatgaccccaactaacctggcggcagcgcaaaagatg

SEQ ID NO: 107205 - DNA, 103 bp, Artificial Sequence
  Synthetic Polynucleotide
taatacgactcactatagggcagacaaaagccgcagggacgaagttggggaacagaggagaccccaaatgcgtccctgcaacctggcggcagcgcaaaagatg

SEQ ID NO: 107206 - DNA, 103 bp, Artificial Sequence
  Synthetic Polynucleotide
taatacgactcactatagggacacttagaacagacaaaagccgcagggacaacagaggagagtccctatggcttttgtcaacctggcggcagcgcaaaagatg

SEQ ID NO: 107207 - DNA, 103 bp, Artificial Sequence
  Synthetic Polynucleotide
taatacgactcactatagggatgttttcccacacttagaacagacaaaagaacagaggagacttttgatggttctaagtaacctggcggcagcgcaaaagatg

SEQ ID NO: 107208 - DNA, 103 bp, Artificial Sequence
  Synthetic Polynucleotide
taatacgactcactatagggcgacgtgtaaatgttttcccacacttagaaaacagaggagattctaaatgtgggaaaacaacctggcggcagcgcaaaagatg

SEQ ID NO: 107209 - DNA, 103 bp, Artificial Sequence
  Synthetic Polynucleotide
taatacgactcactatagggcatggtattccgacgtgtaaatgttttcccaacagaggagagggaaaatgtttacacgtaacctggcggcagcgcaaaagatg

SEQ ID NO: 107210 - DNA, 103 bp, Artificial Sequence
  Synthetic Polynucleotide
taatacgactcactatagggccatcatcaccatctgtacactgctgttgaaacagaggagatcaacaatggtgtacagaaacctggcggcagcgcaaaagatg

SEQ ID NO: 107211 - DNA, 103 bp, Artificial Sequence
  Synthetic Polynucleotide
taatacgactcactatagggcatgtcttgccatggtattccgacgtgtaaaacagaggagattacacatgggaataccaaacctggcggcagcgcaaaagatg

SEQ ID NO: 107212 - DNA, 103 bp, Artificial Sequence
  Synthetic Polynucleotide
taatacgactcactatagggcaattatcagcatgtcttgccatggtattcaacagaggagagaatacatgggcaagacaaacctggcggcagcgcaaaagatg

SEQ ID NO: 107213 - DNA, 103 bp, Artificial Sequence
  Synthetic Polynucleotide
taatacgactcactatagggtgggccagcacaattatcagcatgtcttgcaacagaggagagcaagaatggctgataataacctggcggcagcgcaaaagatg

SEQ ID NO: 107214 - DNA, 103 bp, Artificial Sequence
  Synthetic Polynucleotide
taatacgactcactatagggctacgccatctgggccagcacaattatcagaacagaggagactgataatggtgctggccaacctggcggcagcgcaaaagatg

SEQ ID NO: 107215 - DNA, 103 bp, Artificial Sequence
  Synthetic Polynucleotide
taatacgactcactatagggttttccccctctacgccatctgggccagcaaacagaggagatgctggatgagatggcgtaacctggcggcagcgcaaaagatg

SEQ ID NO: 107216 - DNA, 103 bp, Artificial Sequence
  Synthetic Polynucleotide
taatacgactcactatagggttctcctccattttccccctctacgccatcaacagaggagagatggcatggagggggaaaacctggcggcagcgcaaaagatg

SEQ ID NO: 107217 - DNA, 103 bp, Artificial Sequence
  Synthetic Polynucleotide
taatacgactcactatagggtcttcttcgtttctcctccattttccccctaacagaggagaagggggatgatggaggagaacctggcggcagcgcaaaagatg

SEQ ID NO: 107218 - DNA, 103 bp, Artificial Sequence
  Synthetic Polynucleotide
taatacgactcactatagggccacgtttactcttcttcgtttctcctccaaacagaggagatggaggatgaacgaagaaaacctggcggcagcgcaaaagatg

SEQ ID NO: 107219 - DNA, 103 bp, Artificial Sequence
  Synthetic Polynucleotide
taatacgactcactatagggtctttttcttccacgtttactcttcttcgtaacagaggagaacgaagatgagtaaacgtaacctggcggcagcgcaaaagatg

SEQ ID NO: 107220 - DNA, 103 bp, Artificial Sequence
  Synthetic Polynucleotide
taatacgactcactatagggagcgcatctttctttttcttccacgtttacaacagaggagagtaaacatggaagaaaaaaacctggcggcagcgcaaaagatg

SEQ ID NO: 107221 - DNA, 103 bp, Artificial Sequence
  Synthetic Polynucleotide
taatacgactcactatagggtccagctgttccatcatcaccatctgtacaaacagaggagatgtacaatgggtgatgataacctggcggcagcgcaaaagatg

SEQ ID NO: 107222 - DNA, 103 bp, Artificial Sequence
  Synthetic Polynucleotide
taatacgactcactatagggtctttcttagagcgcatctttctttttcttaacagaggagaaagaaaatgaaagatgcgaacctggcggcagcgcaaaagatg

SEQ ID NO: 107223 - DNA, 103 bp, Artificial Sequence
  Synthetic Polynucleotide
taatacgactcactatagggagaggaatcttctttcttagagcgcatcttaacagaggagaaagatgatgtctaagaaaaacctggcggcagcgcaaaagatg

SEQ ID NO: 107224 - DNA, 103 bp, Artificial Sequence
  Synthetic Polynucleotide
taatacgactcactatagggtttcactgtcagaggaatcttctttcttagaacagaggagactaagaatgaagattcctaacctggcggcagcgcaaaagatg

SEQ ID NO: 107225 - DNA, 103 bp, Artificial Sequence
  Synthetic Polynucleotide
taatacgactcactatagggggttcagcattttcactgtcagaggaatctaacagaggagaagattcatgtgacagtgaaacctggcggcagcgcaaaagatg

SEQ ID NO: 107226 - DNA, 103 bp, Artificial Sequence
  Synthetic Polynucleotide
taatacgactcactataggggtccagatctggttcagcattttcactgtcaacagaggagagacagtatgaatgctgaaaacctggcggcagcgcaaaagatg

SEQ ID NO: 107227 - DNA, 103 bp, Artificial Sequence
  Synthetic Polynucleotide
taatacgactcactatagggcctcattgtcgtccagatctggttcagcataacagaggagaatgctgatgcagatctggaacctggcggcagcgcaaaagatg

SEQ ID NO: 107228 - DNA, 103 bp, Artificial Sequence
  Synthetic Polynucleotide
taatacgactcactatagggtcctcctcatcctcattgtcgtccagatctaacagaggagaagatctatgcgacaatgaaacctggcggcagcgcaaaagatg

SEQ ID NO: 107229 - DNA, 103 bp, Artificial Sequence
  Synthetic Polynucleotide
taatacgactcactatagggtacggcaggctcctcctcatcctcattgtcaacagaggagagacaatatggatgaggagaacctggcggcagcgcaaaagatg

SEQ ID NO: 107230 - DNA, 103 bp, Artificial Sequence
  Synthetic Polynucleotide
taatacgactcactataggggttcaatttctacggcaggctcctcctcataacagaggagaatgaggatgagcctgccgaacctggcggcagcgcaaaagatg

SEQ ID NO: 107231 - DNA, 103 bp, Artificial Sequence
  Synthetic Polynucleotide
taatacgactcactatagggtctggctcaggttcaatttctacggcaggcaacagaggagagcctgcatgagaaattgaaacctggcggcagcgcaaaagatg

SEQ ID NO: 107232 - DNA, 103 bp, Artificial Sequence
  Synthetic Polynucleotide
taatacgactcactatagggaagggtggggtccagctgttccatcatcacaacagaggagagtgatgatggaacagctgaacctggcggcagcgcaaaagatg

SEQ ID NO: 107233 - DNA, 103 bp, Artificial Sequence
  Synthetic Polynucleotide
taatacgactcactatagggaggctgaggctctggctcaggttcaatttcaacagaggagagaaattatgcctgagccaaacctggcggcagcgcaaaagatg

SEQ ID NO: 107234 - DNA, 103 bp, Artificial Sequence
  Synthetic Polynucleotide
taatacgactcactatagggctggggtcacaggctgaggctctggctcagaacagaggagactgagcatgagcctcagcaacctggcggcagcgcaaaagatg

SEQ ID NO: 107235 - DNA, 103 bp, Artificial Sequence
  Synthetic Polynucleotide
taatacgactcactatagggggtggtggggctggggtcacaggctgaggcaacagaggagagcctcaatgtgtgaccccaacctggcggcagcgcaaaagatg

SEQ ID NO: 107236 - DNA, 103 bp, Artificial Sequence
  Synthetic Polynucleotide
taatacgactcactatagggcttcttggcgggtggtggggctggggtcacaacagaggagagtgaccatggccccaccaaacctggcggcagcgcaaaagatg

SEQ ID NO: 107237 - DNA, 103 bp, Artificial Sequence
  Synthetic Polynucleotide
taatacgactcactataggggtcctctccgcttcttggcgggtggtggggaacagaggagaccccacatgccgccaagaaacctggcggcagcgcaaaagatg

SEQ ID NO: 107238 - DNA, 103 bp, Artificial Sequence
  Synthetic Polynucleotide
taatacgactcactatagggccagggggtcgtcctctccgcttcttggcgaacagaggagacgccaaatggcggagaggaacctggcggcagcgcaaaagatg

SEQ ID NO: 107239 - DNA, 103 bp, Artificial Sequence
  Synthetic Polynucleotide
taatacgactcactataggggttggttctgccagggggtcgtcctctccgaacagaggagacggagaatgcgaccccctaacctggcggcagcgcaaaagatg

SEQ ID NO: 107240 - DNA, 103 bp, Artificial Sequence
  Synthetic Polynucleotide
taatacgactcactataggggtttgggctggttggttctgccagggggtcaacagaggagagaccccatggcagaaccaaacctggcggcagcgcaaaagatg

SEQ ID NO: 107241 - DNA, 103 bp, Artificial Sequence
  Synthetic Polynucleotide
taatacgactcactatagggggctggttctgtttgggctggttggttctgaacagaggagacagaacatgccagcccaaaacctggcggcagcgcaaaagatg

SEQ ID NO: 107242 - DNA, 103 bp, Artificial Sequence
  Synthetic Polynucleotide
taatacgactcactataggggatagctgttggctggttctgtttgggctgaacagaggagacagcccatgcagaaccagaacctggcggcagcgcaaaagatg

SEQ ID NO: 107243 - DNA, 103 bp, Artificial Sequence
  Synthetic Polynucleotide
taatacgactcactatagggcggactcctccacaatggcttcgactgcataacagaggagaatgcagatgaagccattgaacctggcggcagcgcaaaagatg

SEQ ID NO: 107244 - DNA, 103 bp, Artificial Sequence
  Synthetic Polynucleotide
taatacgactcactatagggtcatctgaagaagggtggggtccagctgttaacagaggagaaacagcatgaccccacccaacctggcggcagcgcaaaagatg

SEQ ID NO: 107245 - DNA, 103 bp, Artificial Sequence
  Synthetic Polynucleotide
taatacgactcactatagggcaacctgaatgatagctgttggctggttctaacagaggagaagaaccatgcaacagctaaacctggcggcagcgcaaaagatg

SEQ ID NO: 107246 - DNA, 103 bp, Artificial Sequence
  Synthetic Polynucleotide
taatacgactcactatagggttctggtcttcaacctgaatgatagctgttaacagaggagaaacagcatgcattcaggtaacctggcggcagcgcaaaagatg

SEQ ID NO: 107247 - DNA, 103 bp, Artificial Sequence
  Synthetic Polynucleotide
taatacgactcactatagggtgcacctgtattctggtcttcaacctgaataacagaggagaattcagatggaagaccagaacctggcggcagcgcaaaagatg

SEQ ID NO: 107248 - DNA, 103 bp, Artificial Sequence
  Synthetic Polynucleotide
taatacgactcactatagggtgttctcaattgcacctgtattctggtcttaacagaggagaaagaccatgatacaggtgaacctggcggcagcgcaaaagatg

SEQ ID NO: 107249 - DNA, 103 bp, Artificial Sequence
  Synthetic Polynucleotide
taatacgactcactatagggtcaactataatgttctcaattgcacctgtaaacagaggagatacaggatgaattgagaaaacctggcggcagcgcaaaagatg

SEQ ID NO: 107250 - DNA, 103 bp, Artificial Sequence
  Synthetic Polynucleotide
taatacgactcactatagggtttttttacttcaactataatgttctcaataacagaggagaattgagatgattatagttaacctggcggcagcgcaaaagatg

SEQ ID NO: 107251 - DNA, 103 bp, Artificial Sequence
  Synthetic Polynucleotide
taatacgactcactatagggcatctggctctttttttacttcaactataaaacagaggagattatagatgaagtaaaaaaacctggcggcagcgcaaaagatg

SEQ ID NO: 107252 - DNA, 103 bp, Artificial Sequence
  Synthetic Polynucleotide
taatacgactcactataggggcgggctcagcatctggctctttttttactaacagaggagaagtaaaatgagagccagaaacctggcggcagcgcaaaagatg

SEQ ID NO: 107253 - DNA, 103 bp, Artificial Sequence
  Synthetic Polynucleotide
taatacgactcactatagggctctccctctgcgggctcagcatctggctcaacagaggagagagccaatggctgagcccaacctggcggcagcgcaaaagatg

SEQ ID NO: 107254 - DNA, 103 bp, Artificial Sequence
  Synthetic Polynucleotide
taatacgactcactatagggcctcctcttcctctccctctgcgggctcagaacagaggagactgagcatgcagagggagaacctggcggcagcgcaaaagatg

SEQ ID NO: 107255 - DNA, 103 bp, Artificial Sequence
  Synthetic Polynucleotide
taatacgactcactatagggacttcagtcttcatctgaagaagggtggggaacagaggagaccccacatgtcttcagataacctggcggcagcgcaaaagatg

SEQ ID NO: 107256 - DNA, 103 bp, Artificial Sequence
  Synthetic Polynucleotide
taatacgactcactataggggctggctgggcctcctcttcctctccctctaacagaggagaagagggatgggaagaggaaacctggcggcagcgcaaaagatg

SEQ ID NO: 107257 - DNA, 103 bp, Artificial Sequence
  Synthetic Polynucleotide
taatacgactcactatagggatctgtggcagctggctgggcctcctcttcaacagaggagagaagagatggcccagccaaacctggcggcagcgcaaaagatg

SEQ ID NO: 107258 - DNA, 103 bp, Artificial Sequence
  Synthetic Polynucleotide
taatacgactcactatagggcgttgggggcatctgtggcagctggctgggaacagaggagacccagcatgctgccacagaacctggcggcagcgcaaaagatg

SEQ ID NO: 107259 - DNA, 103 bp, Artificial Sequence
  Synthetic Polynucleotide
taatacgactcactataggggtgaggtctccgttgggggcatctgtggcaaacagaggagatgccacatgtgcccccaaaacctggcggcagcgcaaaagatg

SEQ ID NO: 107260 - DNA, 103 bp, Artificial Sequence
  Synthetic Polynucleotide
taatacgactcactatagggcatctcgggcgtgaggtctccgttgggggcaacagaggagagcccccatgggagacctcaacctggcggcagcgcaaaagatg

SEQ ID NO: 107261 - DNA, 103 bp, Artificial Sequence
  Synthetic Polynucleotide
taatacgactcactatagggtgctgaggatcatctcgggcgtgaggtctcaacagaggagagagaccatgcgcccgagaaacctggcggcagcgcaaaagatg

SEQ ID NO: 107262 - DNA, 103 bp, Artificial Sequence
  Synthetic Polynucleotide
taatacgactcactatagggcggtccatcatgctgaggatcatctcgggcaacagaggagagcccgaatggatcctcagaacctggcggcagcgcaaaagatg

SEQ ID NO: 107263 - DNA, 103 bp, Artificial Sequence
  Synthetic Polynucleotide
taatacgactcactataggggccctccattacttcagtcttcatctgaagaacagaggagacttcagatgaagactgaaaacctggcggcagcgcaaaagatg

SEQ ID NO: 107264 - DNA, 103 bp, Artificial Sequence
  Synthetic Polynucleotide
taatacgactcactataggggagccactgtgccctccattacttcagtctaacagaggagaagactgatgtaatggaggaacctggcggcagcgcaaaagatg

SEQ ID NO: 107265 - DNA, 103 bp, Artificial Sequence
  Synthetic Polynucleotide
taatacgactcactatagggtctgcttctggagccactgtgccctccattaacagaggagaaatggaatgcacagtggcaacctggcggcagcgcaaaagatg

SEQ ID NO: 107266 - DNA, 103 bp, Artificial Sequence
  Synthetic Polynucleotide
taatacgactcactatagggcacagcagcctctgcttctggagccactgtaacagaggagaacagtgatgccagaagcaaacctggcggcagcgcaaaagatg

SEQ ID NO: 107267 - DNA, 103 bp, Artificial Sequence
  Synthetic Polynucleotide
taatacgactcactataggggggtatcgtccacagcagcctctgcttctgaacagaggagacagaagatgaggctgctgaacctggcggcagcgcaaaagatg

SEQ ID NO: 107268 - DNA, 103 bp, Artificial Sequence
  Synthetic Polynucleotide
taatacgactcactataggggttataatctgggtatcgtccacagcagccaacagaggagaggctgcatgggacgatacaacctggcggcagcgcaaaagatg

SEQ ID NO: 107269 - DNA, 103 bp, Artificial Sequence
  Synthetic Polynucleotide
taatacgactcactatagggaacctgtaaagttataatctgggtatcgtcaacagaggagagacgatatgcagattataaacctggcggcagcgcaaaagatg

SEQ ID NO: 107270 - DNA, 103 bp, Artificial Sequence
  Synthetic Polynucleotide
taatacgactcactatagggccatatttacaacctgtaaagttataatctaacagaggagaagattaatgctttacaggaacctggcggcagcgcaaaagatg

SEQ ID NO: 107271 - DNA, 103 bp, Artificial Sequence
  Synthetic Polynucleotide
taatacgactcactatagggataaaagtttcggactcctccacaatggctaacagaggagaagccatatgggaggagtcaacctggcggcagcgcaaaagatg

SEQ ID NO: 107272 - DNA, 103 bp, Artificial Sequence
  Synthetic Polynucleotide
taatacgactcactatagggggctgttcctccatatttacaacctgtaaaaacagaggagatttacaatgtgtaaatataacctggcggcagcgcaaaagatg

SEQ ID NO: 107273 - DNA, 103 bp, Artificial Sequence
  Synthetic Polynucleotide
taatacgactcactatagggtatgtttatgggctgttcctccatatttacaacagaggagagtaaatatggaggaacagaacctggcggcagcgcaaaagatg

SEQ ID NO: 107274 - DNA, 103 bp, Artificial Sequence
  Synthetic Polynucleotide
taatacgactcactataggggaagttctcctatgtttatgggctgttcctaacagaggagaaggaacatgccataaacaaacctggcggcagcgcaaaagatg

SEQ ID NO: 107275 - DNA, 103 bp, Artificial Sequence
  Synthetic Polynucleotide
taatacgactcactatagggtgaacaagctgaagttctcctatgtttatgaacagaggagacataaaatgaggagaactaacctggcggcagcgcaaaagatg

SEQ ID NO: 107276 - DNA, 103 bp, Artificial Sequence
  Synthetic Polynucleotide
taatacgactcactatagggaacaggtacttgaacaagctgaagttctccaacagaggagaggagaaatgcagcttgttaacctggcggcagcgcaaaagatg

SEQ ID NO: 107277 - DNA, 103 bp, Artificial Sequence
  Synthetic Polynucleotide
taatacgactcactatagggcagtcacaggaacaggtacttgaacaagctaacagaggagaagcttgatgaagtacctgaacctggcggcagcgcaaaagatg

SEQ ID NO: 107278 - DNA, 103 bp, Artificial Sequence
  Synthetic Polynucleotide
taatacgactcactataggggcaacaggtacagtcacaggaacaggtactaacagaggagaagtaccatgtcctgtgacaacctggcggcagcgcaaaagatg

SEQ ID NO: 107279 - DNA, 103 bp, Artificial Sequence
  Synthetic Polynucleotide
taatacgactcactatagggtgaagtggtagcaacaggtacagtcacaggaacagaggagacctgtgatggtacctgttaacctggcggcagcgcaaaagatg

SEQ ID NO: 107280 - DNA, 103 bp, Artificial Sequence
  Synthetic Polynucleotide
taatacgactcactataggggttcttctactgaagtggtagcaacaggtaaacagaggagatacctgatgctaccacttaacctggcggcagcgcaaaagatg

SEQ ID NO: 107281 - DNA, 103 bp, Artificial Sequence
  Synthetic Polynucleotide
taatacgactcactataggggccccctgaagttcttctactgaagtggtaaacagaggagataccacatgagtagaagaaacctggcggcagcgcaaaagatg

SEQ ID NO: 107282 - DNA, 103 bp, Artificial Sequence
  Synthetic Polynucleotide
taatacgactcactatagggctttcctttaataaaagtttcggactcctcaacagaggagagaggagatggaaacttttaacctggcggcagcgcaaaagatg

SEQ ID NO: 107283 - DNA, 103 bp, Artificial Sequence
  Synthetic Polynucleotide
taatacgactcactatagggattttcataagccccctgaagttcttctacaacagaggagagtagaaatgcttcaggggaacctggcggcagcgcaaaagatg

SEQ ID NO: 107284 - DNA, 103 bp, Artificial Sequence
  Synthetic Polynucleotide
taatacgactcactatagggtagacacttcattttcataagccccctgaaaacagaggagattcaggatgcttatgaaaaacctggcggcagcgcaaaagatg

SEQ ID NO: 107285 - DNA, 103 bp, Artificial Sequence
  Synthetic Polynucleotide
taatacgactcactatagggaggccctctttagacacttcattttcataaaacagaggagattatgaatgtgaagtgtcaacctggcggcagcgcaaaagatg

SEQ ID NO: 107286 - DNA, 103 bp, Artificial Sequence
  Synthetic Polynucleotide
taatacgactcactatagggactttccgcaaggccctctttagacacttcaacagaggagagaagtgatgaaagagggcaacctggcggcagcgcaaaagatg

SEQ ID NO: 107287 - DNA, 103 bp, Artificial Sequence
  Synthetic Polynucleotide
taatacgactcactatagggtcatgggttcactttccgcaaggccctcttaacagaggagaaagaggatgttgcggaaaaacctggcggcagcgcaaaagatg

SEQ ID NO: 107288 - DNA, 103 bp, Artificial Sequence
  Synthetic Polynucleotide
taatacgactcactataggggtgtggcatatcatgggttcactttccgcaaacagaggagatgcggaatgtgaacccataacctggcggcagcgcaaaagatg

SEQ ID NO: 107289 - DNA, 103 bp, Artificial Sequence
  Synthetic Polynucleotide
taatacgactcactatagggcaaaggtagggtgtggcatatcatgggttcaacagaggagagaacccatgatatgccacaacctggcggcagcgcaaaagatg

SEQ ID NO: 107290 - DNA, 103 bp, Artificial Sequence
  Synthetic Polynucleotide
taatacgactcactatagggacccttcaggcaaaggtagggtgtggcataaacagaggagatatgccatgccctaccttaacctggcggcagcgcaaaagatg

SEQ ID NO: 107291 - DNA, 103 bp, Artificial Sequence
  Synthetic Polynucleotide
taatacgactcactatagggaccacctgaaacccttcaggcaaaggtaggaacagaggagacctaccatggcctgaaggaacctggcggcagcgcaaaagatg

SEQ ID NO: 107292 - DNA, 103 bp, Artificial Sequence
  Synthetic Polynucleotide
taatacgactcactatagggccccactttaaccacctgaaacccttcaggaacagaggagacctgaaatgtttcaggtgaacctggcggcagcgcaaaagatg

SEQ ID NO: 107293 - DNA, 103 bp, Artificial Sequence
  Synthetic Polynucleotide
taatacgactcactatagggtctttctctcctttcctttaataaaagtttaacagaggagaaaacttatgttaaaggaaaacctggcggcagcgcaaaagatg

SEQ ID NO: 107294 - DNA, 103 bp, Artificial Sequence
  Synthetic Polynucleotide
taatacgactcactatagggctccattggcccccactttaaccacctgaaaacagaggagattcaggatgttaaagtggaacctggcggcagcgcaaaagatg

SEQ ID NO: 107295 - DNA, 103 bp, Artificial Sequence
  Synthetic Polynucleotide
taatacgactcactataggggtctccacctctccattggcccccactttaaacagaggagataaagtatgggccaatggaacctggcggcagcgcaaaagatg

SEQ ID NO: 107296 - DNA, 103 bp, Artificial Sequence
  Synthetic Polynucleotide
taatacgactcactatagggttgttctagtgtctccacctctccattggcaacagaggagagccaatatggaggtggagaacctggcggcagcgcaaaagatg

SEQ ID NO: 107297 - DNA, 103 bp, Artificial Sequence
  Synthetic Polynucleotide
taatacgactcactataggggaagttccccttgttctagtgtctccacctaacagaggagaaggtggatgcactagaacaacctggcggcagcgcaaaagatg

SEQ ID NO: 107298 - DNA, 103 bp, Artificial Sequence
  Synthetic Polynucleotide
taatacgactcactatagggtcctggggtggaagttccccttgttctagtaacagaggagaactagaatgaggggaactaacctggcggcagcgcaaaagatg

SEQ ID NO: 107299 - DNA, 103 bp, Artificial Sequence
  Synthetic Polynucleotide
taatacgactcactatagggactaggatcttcctggggtggaagttccccaacagaggagaggggaaatgccaccccagaacctggcggcagcgcaaaagatg

SEQ ID NO: 107300 - DNA, 103 bp, Artificial Sequence
  Synthetic Polynucleotide
taatacgactcactatagggctttttgccaactaggatcttcctggggtgaacagaggagacaccccatgaagatcctaaacctggcggcagcgcaaaagatg

SEQ ID NO: 107301 - DNA, 103 bp, Artificial Sequence
  Synthetic Polynucleotide
taatacgactcactatagggtagtctgggtctttttgccaactaggatctaacagaggagaagatccatgttggcaaaaaacctggcggcagcgcaaaagatg

SEQ ID NO: 107302 - DNA, 103 bp, Artificial Sequence
  Synthetic Polynucleotide
taatacgactcactatagggtggtggctgatagtctgggtctttttgccaaacagaggagatggcaaatggacccagacaacctggcggcagcgcaaaagatg

SEQ ID NO: 107303 - DNA, 103 bp, Artificial Sequence
  Synthetic Polynucleotide
taatacgactcactatagggtttttttggctggtggctgatagtctgggtaacagaggagaacccagatgatcagccacaacctggcggcagcgcaaaagatg

SEQ ID NO: 107304 - DNA, 103 bp, Artificial Sequence
  Synthetic Polynucleotide
taatacgactcactatagggctctggtaagtctttctctcctttcctttaaacagaggagataaaggatgggagagaaaaacctggcggcagcgcaaaagatg

SEQ ID NO: 107305 - DNA, 103 bp, Artificial Sequence
  Synthetic Polynucleotide
taatacgactcactataggggttttctttgtttttttggctggtggctgaaacagaggagatcagccatgagccaaaaaaacctggcggcagcgcaaaagatg

SEQ ID NO: 107306 - DNA, 103 bp, Artificial Sequence
  Synthetic Polynucleotide
taatacgactcactataggggctctttttggttttctttgtttttttggcaacagaggagagccaaaatgacaaagaaaaacctggcggcagcgcaaaagatg

SEQ ID NO: 107307 - DNA, 103 bp, Artificial Sequence
  Synthetic Polynucleotide
taatacgactcactatagggaacgcagtttgctctttttggttttctttgaacagaggagacaaagaatgccaaaaagaaacctggcggcagcgcaaaagatg

SEQ ID NO: 107308 - DNA, 103 bp, Artificial Sequence
  Synthetic Polynucleotide
taatacgactcactatagggtcctctgtataacgcagtttgctctttttgaacagaggagacaaaaaatgcaaactgcgaacctggcggcagcgcaaaagatg

SEQ ID NO: 107309 - DNA, 103 bp, Artificial Sequence
  Synthetic Polynucleotide
taatacgactcactatagggatctttgccctcctctgtataacgcagtttaacagaggagaaaactgatgtatacagagaacctggcggcagcgcaaaagatg

SEQ ID NO: 107310 - DNA, 103 bp, Artificial Sequence
  Synthetic Polynucleotide
taatacgactcactatagggacacatctacatctttgccctcctctgtataacagaggagaatacagatgagggcaaagaacctggcggcagcgcaaaagatg

SEQ ID NO: 107311 - DNA, 103 bp, Artificial Sequence
  Synthetic Polynucleotide
taatacgactcactatagggtcgtagacagacacatctacatctttgcccaacagaggagagggcaaatgtgtagatgtaacctggcggcagcgcaaaagatg

SEQ ID NO: 107312 - DNA, 103 bp, Artificial Sequence
  Synthetic Polynucleotide
taatacgactcactatagggttcctcaaaatcgtagacagacacatctacaacagaggagagtagatatgtctgtctacaacctggcggcagcgcaaaagatg

SEQ ID NO: 107313 - DNA, 103 bp, Artificial Sequence
  Synthetic Polynucleotide
taatacgactcactatagggcctgctgttcttcctcaaaatcgtagacagaacagaggagactgtctatgattttgaggaacctggcggcagcgcaaaagatg

SEQ ID NO: 107314 - DNA, 103 bp, Artificial Sequence
  Synthetic Polynucleotide
taatacgactcactatagggagcagaccctcctgctgttcttcctcaaaaaacagaggagattttgaatgagaacagcaaacctggcggcagcgcaaaagatg

SEQ ID NO: 107315 - DNA, 103 bp, Artificial Sequence
  Synthetic Polynucleotide
taatacgactcactatagggttcccggcgtctctggtaagtctttctctcaacagaggagagagagaatgacttaccagaacctggcggcagcgcaaaagatg

SEQ ID NO: 107316 - DNA, 103 bp, Artificial Sequence
  Synthetic Polynucleotide
taatacgactcactatagggaacctctgatagcagaccctcctgctgttcaacagaggagagaacagatggagggtctgaacctggcggcagcgcaaaagatg

SEQ ID NO: 107317 - DNA, 103 bp, Artificial Sequence
  Synthetic Polynucleotide
taatacgactcactatagggtctctgcattaacctctgatagcagaccctaacagaggagaagggtcatgtatcagaggaacctggcggcagcgcaaaagatg

SEQ ID NO: 107318 - DNA, 103 bp, Artificial Sequence
  Synthetic Polynucleotide
taatacgactcactatagggccaaccactttctctgcattaacctctgataacagaggagaatcagaatgtaatgcagaaacctggcggcagcgcaaaagatg

SEQ ID NO: 107319 - DNA, 103 bp, Artificial Sequence
  Synthetic Polynucleotide
taatacgactcactatagggcttcatattaccaaccactttctctgcattaacagaggagaaatgcaatgaaagtggttaacctggcggcagcgcaaaagatg

SEQ ID NO: 107320 - DNA, 103 bp, Artificial Sequence
  Synthetic Polynucleotide
taatacgactcactataggggctttggaggcttcatattaccaaccacttaacagaggagaaagtggatggtaatatgaaacctggcggcagcgcaaaagatg

SEQ ID NO: 107321 - DNA, 103 bp, Artificial Sequence
  Synthetic Polynucleotide
taatacgactcactatagggatttttgttggctttggaggcttcatattaaacagaggagataatatatggcctccaaaaacctggcggcagcgcaaaagatg

SEQ ID NO: 107322 - DNA, 103 bp, Artificial Sequence
  Synthetic Polynucleotide
taatacgactcactatagggtttctttttaatttttgttggctttggaggaacagaggagacctccaatgccaacaaaaaacctggcggcagcgcaaaagatg

SEQ ID NO: 107323 - DNA, 103 bp, Artificial Sequence
  Synthetic Polynucleotide
taatacgactcactatagggtctttacacctttctttttaatttttgttgaacagaggagacaacaaatgttaaaaagaaacctggcggcagcgcaaaagatg

SEQ ID NO: 107324 - DNA, 103 bp, Artificial Sequence
  Synthetic Polynucleotide
taatacgactcactatagggtggaatgtcttctttacacctttctttttaaacagaggagataaaaaatgaggtgtaaaaacctggcggcagcgcaaaagatg

SEQ ID NO: 107325 - DNA, 103 bp, Artificial Sequence
  Synthetic Polynucleotide
taatacgactcactatagggaagctcacactggaatgtcttctttacaccaacagaggagaggtgtaatgaagacattcaacctggcggcagcgcaaaagatg

SEQ ID NO: 107326 - DNA, 103 bp, Artificial Sequence
  Synthetic Polynucleotide
taatacgactcactatagggcctggcccccttcccggcgtctctggtaagaacagaggagacttaccatggacgccgggaacctggcggcagcgcaaaagatg

SEQ ID NO: 107327 - DNA, 103 bp, Artificial Sequence
  Synthetic Polynucleotide
taatacgactcactatagggtgtaactgcaaagctcacactggaatgtctaacagaggagaagacatatgagtgtgagcaacctggcggcagcgcaaaagatg

SEQ ID NO: 107328 - DNA, 103 bp, Artificial Sequence
  Synthetic Polynucleotide
taatacgactcactatagggcgtggacacgtgtaactgcaaagctcacacaacagaggagagtgtgaatgttgcagttaaacctggcggcagcgcaaaagatg

SEQ ID NO: 107329 - DNA, 103 bp, Artificial Sequence
  Synthetic Polynucleotide
taatacgactcactatagggatttgaacgccgtggacacgtgtaactgcaaacagaggagatgcagtatgacgtgtccaaacctggcggcagcgcaaaagatg

SEQ ID NO: 107330 - DNA, 103 bp, Artificial Sequence
  Synthetic Polynucleotide
taatacgactcactataggggacgatccaaatttgaacgccgtggacacgaacagaggagacgtgtcatgggcgttcaaaacctggcggcagcgcaaaagatg

SEQ ID NO: 107331 - DNA, 103 bp, Artificial Sequence
  Synthetic Polynucleotide
taatacgactcactatagggcttttcatgtgacgatccaaatttgaacgcaacagaggagagcgttcatgtttggatcgaacctggcggcagcgcaaaagatg

SEQ ID NO: 107332 - DNA, 103 bp, Artificial Sequence
  Synthetic Polynucleotide
taatacgactcactatagggatcagtgtggcttttcatgtgacgatccaaaacagaggagattggatatgcacatgaaaaacctggcggcagcgcaaaagatg

SEQ ID NO: 107333 - DNA, 103 bp, Artificial Sequence
  Synthetic Polynucleotide
taatacgactcactataggggtggtctctcatcagtgtggcttttcatgtaacagaggagaacatgaatggccacactgaacctggcggcagcgcaaaagatg

SEQ ID NO: 107334 - DNA, 103 bp, Artificial Sequence
  Synthetic Polynucleotide
taatacgactcactatagggtggcacttgtgtggtctctcatcagtgtggaacagaggagaccacacatgtgagagaccaacctggcggcagcgcaaaagatg

SEQ ID NO: 107335 - DNA, 103 bp, Artificial Sequence
  Synthetic Polynucleotide
taatacgactcactataggggccacagagatggcacttgtgtggtctctcaacagaggagagagagaatgcacaagtgcaacctggcggcagcgcaaaagatg

SEQ ID NO: 107336 - DNA, 103 bp, Artificial Sequence
  Synthetic Polynucleotide
taatacgactcactatagggtgaatgccctgccacagagatggcacttgtaacagaggagaacaagtatgatctctgtgaacctggcggcagcgcaaaagatg

SEQ ID NO: 107337 - DNA, 103 bp, Artificial Sequence
  Synthetic Polynucleotide
taatacgactcactataggggcatcttcttcctggcccccttcccggcgtaacagaggagaacgccgatgagggggccaaacctggcggcagcgcaaaagatg

SEQ ID NO: 107338 - DNA, 103 bp, Artificial Sequence
  Synthetic Polynucleotide
taatacgactcactataggggtgactgttctgaatgccctgccacagagaaacagaggagatctctgatgcagggcattaacctggcggcagcgcaaaagatg

SEQ ID NO: 107339 - DNA, 103 bp, Artificial Sequence
  Synthetic Polynucleotide
taatacgactcactatagggcctcaggagggtgactgttctgaatgccctaacagaggagaagggcaatgagaacagtcaacctggcggcagcgcaaaagatg

SEQ ID NO: 107340 - DNA, 103 bp, Artificial Sequence
  Synthetic Polynucleotide
taatacgactcactatagggtaaggtgattcctcaggagggtgactgttcaacagaggagagaacagatgccctcctgaaacctggcggcagcgcaaaagatg

SEQ ID NO: 107341 - DNA, 103 bp, Artificial Sequence
  Synthetic Polynucleotide
taatacgactcactataggggtgtgtgtgttaaggtgattcctcaggaggaacagaggagacctcctatggaatcacctaacctggcggcagcgcaaaagatg

SEQ ID NO: 107342 - DNA, 103 bp, Artificial Sequence
  Synthetic Polynucleotide
taatacgactcactatagggacgagtacctgtgtgtgtgttaaggtgattaacagaggagaaatcacatgaacacacacaacctggcggcagcgcaaaagatg

SEQ ID NO: 107343 - DNA, 103 bp, Artificial Sequence
  Synthetic Polynucleotide
taatacgactcactatagggacttgtgaggacgagtacctgtgtgtgtgtaacagaggagaacacacatgcaggtactcaacctggcggcagcgcaaaagatg

SEQ ID NO: 107344 - DNA, 103 bp, Artificial Sequence
  Synthetic Polynucleotide
taatacgactcactatagggcagtctgggcacttgtgaggacgagtacctaacagaggagaaggtacatgtcctcacaaaacctggcggcagcgcaaaagatg

SEQ ID NO: 107345 - DNA, 103 bp, Artificial Sequence
  Synthetic Polynucleotide
taatacgactcactatagggggccatgtcgcagtctgggcacttgtgaggaacagaggagacctcacatgtgcccagacaacctggcggcagcgcaaaagatg

SEQ ID NO: 107346 - DNA, 103 bp, Artificial Sequence
  Synthetic Polynucleotide
taatacgactcactatagggtggtcacaaaggccatgtcgcagtctgggcaacagaggagagcccagatggcgacatggaacctggcggcagcgcaaaagatg

SEQ ID NO: 107347 - DNA, 103 bp, Artificial Sequence
  Synthetic Polynucleotide
taatacgactcactatagggaattctccactggtcacaaaggccatgtcgaacagaggagacgacatatgctttgtgacaacctggcggcagcgcaaaagatg

SEQ ID NO: 107348 - DNA, 103 bp, Artificial Sequence
  Synthetic Polynucleotide
taatacgactcactatagggagaaaggacagagatctcagtggctgccataacagaggagaatggcaatgactgagatcaacctggcggcagcgcaaaagatg

SEQ ID NO: 107349 - DNA, 103 bp, Artificial Sequence
  Synthetic Polynucleotide
taatacgactcactataggggtctttctctctgcacactccgtctttttcaacagaggagagaaaaaatgggagtgtgcaacctggcggcagcgcaaaagatg

SEQ ID NO: 107350 - DNA, 103 bp, Artificial Sequence
  Synthetic Polynucleotide
taatacgactcactatagggtttctcatgagtatgtttatagcgcctgtgaacagaggagacacaggatgtataaacataacctggcggcagcgcaaaagatg

SEQ ID NO: 107351 - DNA, 103 bp, Artificial Sequence
  Synthetic Polynucleotide
taatacgactcactatagggatttaaagggtttctcatgagtatgtttataacagaggagaataaacatgctcatgagaaacctggcggcagcgcaaaagatg

SEQ ID NO: 107352 - DNA, 103 bp, Artificial Sequence
  Synthetic Polynucleotide
taatacgactcactatagggcacatggaacatttaaagggtttctcatgaaacagaggagatcatgaatgaccctttaaaacctggcggcagcgcaaaagatg

SEQ ID NO: 107353 - DNA, 103 bp, Artificial Sequence
  Synthetic Polynucleotide
taatacgactcactatagggggcatacttgcacatggaacatttaaagggaacagaggagaccctttatgtgttccatgaacctggcggcagcgcaaaagatg

SEQ ID NO: 107354 - DNA, 103 bp, Artificial Sequence
  Synthetic Polynucleotide
taatacgactcactatagggcctccacactggcatacttgcacatggaacaacagaggagagttccaatggcaagtatgaacctggcggcagcgcaaaagatg

SEQ ID NO: 107355 - DNA, 103 bp, Artificial Sequence
  Synthetic Polynucleotide
taatacgactcactatagggaatttacttgcctccacactggcatacttgaacagaggagacaagtaatgcagtgtggaaacctggcggcagcgcaaaagatg

SEQ ID NO: 107356 - DNA, 103 bp, Artificial Sequence
  Synthetic Polynucleotide
taatacgactcactatagggatggcgcttcaatttacttgcctccacactaacagaggagaagtgtgatggcaagtaaaaacctggcggcagcgcaaaagatg

SEQ ID NO: 107357 - DNA, 103 bp, Artificial Sequence
  Synthetic Polynucleotide
taatacgactcactataggggggatcggacatggcgcttcaatttacttgaacagaggagacaagtaatgtgaagcgccaacctggcggcagcgcaaaagatg

SEQ ID NO: 107358 - DNA, 103 bp, Artificial Sequence
  Synthetic Polynucleotide
taatacgactcactatagggtccccagtgtgggatcggacatggcgcttcaacagaggagagaagcgatgtgtccgatcaacctggcggcagcgcaaaagatg

SEQ ID NO: 107359 - DNA, 103 bp, Artificial Sequence
  Synthetic Polynucleotide
taatacgactcactatagggaaaggggcgctccccagtgtgggatcggacaacagaggagagtccgaatgcacactgggaacctggcggcagcgcaaaagatg

SEQ ID NO: 107360 - DNA, 103 bp, Artificial Sequence
  Synthetic Polynucleotide
taatacgactcactatagggggctccgatggtctttctctctgcacactcaacagaggagagagtgtatggagagaaagaacctggcggcagcgcaaaagatg

SEQ ID NO: 107361 - DNA, 103 bp, Artificial Sequence
  Synthetic Polynucleotide
taatacgactcactatagggggcaacactgaaaggggcgctccccagtgtaacagaggagaacactgatgagcgcccctaacctggcggcagcgcaaaagatg

SEQ ID NO: 107362 - DNA, 103 bp, Artificial Sequence
  Synthetic Polynucleotide
taatacgactcactatagggtagctgcactggcaacactgaaaggggcgcaacagaggagagcgcccatgtcagtgttgaacctggcggcagcgcaaaagatg

SEQ ID NO: 107363 - DNA, 103 bp, Artificial Sequence
  Synthetic Polynucleotide
taatacgactcactatagggtctgctggcatagctgcactggcaacactgaacagaggagacagtgtatgcagtgcagcaacctggcggcagcgcaaaagatg

SEQ ID NO: 107364 - DNA, 103 bp, Artificial Sequence
  Synthetic Polynucleotide
taatacgactcactatagggtgtaggtatctctgctggcatagctgcactaacagaggagaagtgcaatgatgccagcaaacctggcggcagcgcaaaagatg

SEQ ID NO: 107365 - DNA, 103 bp, Artificial Sequence
  Synthetic Polynucleotide
taatacgactcactatagggcgtttcagcttgtaggtatctctgctggcaaacagaggagatgccagatgagatacctaaacctggcggcagcgcaaaagatg

SEQ ID NO: 107366 - DNA, 103 bp, Artificial Sequence
  Synthetic Polynucleotide
taatacgactcactatagggtctcatgtggcgtttcagcttgtaggtatcaacagaggagagataccatgaagctgaaaaacctggcggcagcgcaaaagatg

SEQ ID NO: 107367 - DNA, 103 bp, Artificial Sequence
  Synthetic Polynucleotide
taatacgactcactatagggctgagtgcgttctcatgtggcgtttcagctaacagaggagaagctgaatggccacatgaaacctggcggcagcgcaaaagatg

SEQ ID NO: 107368 - DNA, 103 bp, Artificial Sequence
  Synthetic Polynucleotide
taatacgactcactatagggggcttctcacctgagtgcgttctcatgtggaacagaggagaccacatatgaacgcactcaacctggcggcagcgcaaaagatg

SEQ ID NO: 107369 - DNA, 103 bp, Artificial Sequence
  Synthetic Polynucleotide
taatacgactcactataggggcattcgtaaggcttctcacctgagtgcgtaacagaggagaacgcacatgggtgagaagaacctggcggcagcgcaaaagatg

SEQ ID NO: 107370 - DNA, 103 bp, Artificial Sequence
  Synthetic Polynucleotide
taatacgactcactatagggggcagatgtggcattcgtaaggcttctcacaacagaggagagtgagaatgcttacgaataacctggcggcagcgcaaaagatg

SEQ ID NO: 107371 - DNA, 103 bp, Artificial Sequence
  Synthetic Polynucleotide
taatacgactcactatagggaactcactagggctccgatggtctttctctaacagaggagaagagaaatgccatcggagaacctggcggcagcgcaaaagatg

SEQ ID NO: 107372 - DNA, 103 bp, Artificial Sequence
  Synthetic Polynucleotide
taatacgactcactatagggaagcgggtgtggcagatgtggcattcgtaaaacagaggagattacgaatgccacatctgaacctggcggcagcgcaaaagatg

SEQ ID NO: 107373 - DNA, 103 bp, Artificial Sequence
  Synthetic Polynucleotide
taatacgactcactataggggctctgggtgaagcgggtgtggcagatgtgaacagaggagacacatcatgcacacccgcaacctggcggcagcgcaaaagatg

SEQ ID NO: 107374 - DNA, 103 bp, Artificial Sequence
  Synthetic Polynucleotide
taatacgactcactatagggtcatggtcccgctctgggtgaagcgggtgtaacagaggagaacacccatgtcacccagaaacctggcggcagcgcaaaagatg

SEQ ID NO: 107375 - DNA, 103 bp, Artificial Sequence
  Synthetic Polynucleotide
taatacgactcactatagggatatgtattttcatggtcccgctctgggtgaacagaggagacacccaatgcgggaccataacctggcggcagcgcaaaagatg

SEQ ID NO: 107376 - DNA, 103 bp, Artificial Sequence
  Synthetic Polynucleotide
taatacgactcactatagggtttctgcagaatatgtattttcatggtcccaacagaggagagggaccatgaaaatacataacctggcggcagcgcaaaagatg

SEQ ID NO: 107377 - DNA, 103 bp, Artificial Sequence
  Synthetic Polynucleotide
taatacgactcactatagggtttcgccgtgtttctgcagaatatgtatttaacagaggagaaaatacatgttctgcagaaacctggcggcagcgcaaaagatg

SEQ ID NO: 107378 - DNA, 103 bp, Artificial Sequence
  Synthetic Polynucleotide
taatacgactcactatagggttggggacattttcgccgtgtttctgcagaaacagaggagatctgcaatgacacggcgaaacctggcggcagcgcaaaagatg

SEQ ID NO: 107379 - DNA, 103 bp, Artificial Sequence
  Synthetic Polynucleotide
taatacgactcactatagggacactggtatttggggacattttcgccgtgaacagaggagacacggcatgaatgtccccaacctggcggcagcgcaaaagatg

SEQ ID NO: 107380 - DNA, 103 bp, Artificial Sequence
  Synthetic Polynucleotide
taatacgactcactatagggcacaatggggacactggtatttggggacataacagaggagaatgtccatgaataccagtaacctggcggcagcgcaaaagatg

SEQ ID NO: 107381 - DNA, 103 bp, Artificial Sequence
  Synthetic Polynucleotide
taatacgactcactatagggatgatggtggcacaatggggacactggtataacagaggagaataccaatgtccccattgaacctggcggcagcgcaaaagatg

SEQ ID NO: 107382 - DNA, 103 bp, Artificial Sequence
  Synthetic Polynucleotide
taatacgactcactatagggctcggcctccaactcactagggctccgatgaacagaggagacatcggatgcctagtgagaacctggcggcagcgcaaaagatg

SEQ ID NO: 107383 - DNA, 103 bp, Artificial Sequence
  Synthetic Polynucleotide
taatacgactcactatagggtttccgtgcaatgatggtggcacaatggggaacagaggagaccccatatggccaccatcaacctggcggcagcgcaaaagatg

SEQ ID NO: 107384 - DNA, 103 bp, Artificial Sequence
  Synthetic Polynucleotide
taatacgactcactataggggtaggtcgcttttccgtgcaatgatggtggaacagaggagaccaccaatgttgcacggaaacctggcggcagcgcaaaagatg

SEQ ID NO: 107385 - DNA, 103 bp, Artificial Sequence
  Synthetic Polynucleotide
taatacgactcactatagggatatgcacacgtaggtcgcttttccgtgcaaacagaggagatgcacgatgaagcgacctaacctggcggcagcgcaaaagatg

SEQ ID NO: 107386 - DNA, 103 bp, Artificial Sequence
  Synthetic Polynucleotide
taatacgactcactatagggcaagttgcgcatatgcacacgtaggtcgctaacagaggagaagcgacatgcgtgtgcataacctggcggcagcgcaaaagatg

SEQ ID NO: 107387 - DNA, 103 bp, Artificial Sequence
  Synthetic Polynucleotide
taatacgactcactatagggtgtaagcatgcaagttgcgcatatgcacacaacagaggagagtgtgcatgtgcgcaactaacctggcggcagcgcaaaagatg

SEQ ID NO: 107388 - DNA, 103 bp, Artificial Sequence
  Synthetic Polynucleotide
taatacgactcactatagggtctgcagcgctgtaagcatgcaagttgcgcaacagaggagagcgcaaatggcatgcttaaacctggcggcagcgcaaaagatg

SEQ ID NO: 107389 - DNA, 103 bp, Artificial Sequence
  Synthetic Polynucleotide
taatacgactcactataggggcatttcagctctgcagcgctgtaagcatgaacagaggagacatgctatgagcgctgcaaacctggcggcagcgcaaaagatg

SEQ ID NO: 107390 - DNA, 103 bp, Artificial Sequence
  Synthetic Polynucleotide
taatacgactcactatagggaacagtagcggcatttcagctctgcagcgcaacagaggagagcgctgatgagctgaaataacctggcggcagcgcaaaagatg

SEQ ID NO: 107391 - DNA, 103 bp, Artificial Sequence
  Synthetic Polynucleotide
taatacgactcactatagggaagacagcagaacagtagcggcatttcagcaacagaggagagctgaaatgccgctactgaacctggcggcagcgcaaaagatg

SEQ ID NO: 107392 - DNA, 103 bp, Artificial Sequence
  Synthetic Polynucleotide
taatacgactcactataggggcgttcatggaagacagcagaacagtagcgaacagaggagacgctacatgtctgctgtcaacctggcggcagcgcaaaagatg

SEQ ID NO: 107393 - DNA, 103 bp, Artificial Sequence
  Synthetic Polynucleotide
taatacgactcactatagggcagaggtacgctcggcctccaactcactagaacagaggagactagtgatgtggaggccgaacctggcggcagcgcaaaagatg

SEQ ID NO: 107394 - DNA, 103 bp, Artificial Sequence
  Synthetic Polynucleotide
taatacgactcactatagggtgagggcatagcgttcatggaagacagcagaacagaggagactgctgatgtccatgaacaacctggcggcagcgcaaaagatg

SEQ ID NO: 107395 - DNA, 103 bp, Artificial Sequence
  Synthetic Polynucleotide
taatacgactcactatagggtggtgctgaatgagggcatagcgttcatggaacagaggagaccatgaatgctatgccctaacctggcggcagcgcaaaagatg

SEQ ID NO: 107396 - DNA, 103 bp, Artificial Sequence
  Synthetic Polynucleotide
taatacgactcactatagggatgagttttctggtgctgaatgagggcataaacagaggagatatgccatgattcagcacaacctggcggcagcgcaaaagatg

SEQ ID NO: 107397 - DNA, 103 bp, Artificial Sequence
  Synthetic Polynucleotide
taatacgactcactatagggtctcattcttatgagttttctggtgctgaaaacagaggagattcagcatgagaaaactcaacctggcggcagcgcaaaagatg

SEQ ID NO: 107398 - DNA, 103 bp, Artificial Sequence
  Synthetic Polynucleotide
taatacgactcactatagggttgaacctcttctcattcttatgagttttcaacagaggagagaaaacatgtaagaatgaaacctggcggcagcgcaaaagatg

SEQ ID NO: 107399 - DNA, 103 bp, Artificial Sequence
  Synthetic Polynucleotide
taatacgactcactataggggtgtttgcacttgaacctcttctcattcttaacagaggagaaagaatatgaagaggttcaacctggcggcagcgcaaaagatg

SEQ ID NO: 107400 - DNA, 103 bp, Artificial Sequence
  Synthetic Polynucleotide
taatacgactcactatagggcataactgcagtgtttgcacttgaacctctaacagaggagaagaggtatgagtgcaaacaacctggcggcagcgcaaaagatg

SEQ ID NO: 107401 - DNA, 103 bp, Artificial Sequence
  Synthetic Polynucleotide
taatacgactcactatagggtgcttgcaggcataactgcagtgtttgcacaacagaggagagtgcaaatgctgcagttaaacctggcggcagcgcaaaagatg

SEQ ID NO: 107402 - DNA, 103 bp, Artificial Sequence
  Synthetic Polynucleotide
taatacgactcactatagggatgacgttcctgcttgcaggcataactgcaaacagaggagatgcagtatggcctgcaagaacctggcggcagcgcaaaagatg

SEQ ID NO: 107403 - DNA, 103 bp, Artificial Sequence
  Synthetic Polynucleotide
taatacgactcactataggggagcggtcatatgacgttcctgcttgcaggaacagaggagacctgcaatgaggaacgtcaacctggcggcagcgcaaaagatg

SEQ ID NO: 107404 - DNA, 103 bp, Artificial Sequence
  Synthetic Polynucleotide
taatacgactcactatagggtggaaggccccagaggtacgctcggcctccaacagaggagaggaggcatggcgtacctcaacctggcggcagcgcaaaagatg

SEQ ID NO: 107405 - DNA, 103 bp, Artificial Sequence
  Synthetic Polynucleotide
taatacgactcactataggggtacgaatgtgagcggtcatatgacgttccaacagaggagaggaacgatgtatgaccgcaacctggcggcagcgcaaaagatg

SEQ ID NO: 107406 - DNA, 103 bp, Artificial Sequence
  Synthetic Polynucleotide
taatacgactcactatagggtccagtgtgggtacgaatgtgagcggtcataacagaggagaatgaccatgcacattcgtaacctggcggcagcgcaaaagatg

SEQ ID NO: 107407 - DNA, 103 bp, Artificial Sequence
  Synthetic Polynucleotide
taatacgactcactatagggatggtttctctccagtgtgggtacgaatgtaacagaggagaacattcatgcccacactgaacctggcggcagcgcaaaagatg

SEQ ID NO: 107408 - DNA, 103 bp, Artificial Sequence
  Synthetic Polynucleotide
taatacgactcactatagggaggcaggtgaatggtttctctccagtgtggaacagaggagaccacacatgagagaaaccaacctggcggcagcgcaaaagatg

SEQ ID NO: 107409 - DNA, 103 bp, Artificial Sequence
  Synthetic Polynucleotide
taatacgactcactatagggattgcaagaaaggcaggtgaatggtttctcaacagaggagagagaaaatgttcacctgcaacctggcggcagcgcaaaagatg

SEQ ID NO: 107410 - DNA, 103 bp, Artificial Sequence
  Synthetic Polynucleotide
taatacgactcactatagggggaaacatttattgcaagaaaggcaggtgaaacagaggagatcacctatgtttcttgcaaacctggcggcagcgcaaaagatg

SEQ ID NO: 107411 - DNA, 103 bp, Artificial Sequence
  Synthetic Polynucleotide
taatacgactcactatagggtgcttctgtcggaaacatttattgcaagaaaacagaggagattcttgatgtaaatgtttaacctggcggcagcgcaaaagatg

SEQ ID NO: 107412 - DNA, 103 bp, Artificial Sequence
  Synthetic Polynucleotide
taatacgactcactataggggtttagaagttgcttctgtcggaaacatttaacagaggagaaaatgtatgcgacagaagaacctggcggcagcgcaaaagatg

SEQ ID NO: 107413 - DNA, 103 bp, Artificial Sequence
  Synthetic Polynucleotide
taatacgactcactatagggtgaagtgagcgtttagaagttgcttctgtcaacagaggagagacagaatgaacttctaaaacctggcggcagcgcaaaagatg

SEQ ID NO: 107414 - DNA, 103 bp, Artificial Sequence
  Synthetic Polynucleotide
taatacgactcactatagggtggtatttcctgaagtgagcgtttagaagtaacagaggagaacttctatgcgctcacttaacctggcggcagcgcaaaagatg

SEQ ID NO: 107415 - DNA, 103 bp, Artificial Sequence
  Synthetic Polynucleotide
taatacgactcactataggggacgctgtcctggaaggccccagaggtacgaacagaggagacgtaccatgggggccttcaacctggcggcagcgcaaaagatg

SEQ ID NO: 107416 - DNA, 103 bp, Artificial Sequence
  Synthetic Polynucleotide
taatacgactcactatagggatttgcatcgtggtatttcctgaagtgagcaacagaggagagctcacatgaggaaatacaacctggcggcagcgcaaaagatg

SEQ ID NO: 107417 - DNA, 103 bp, Artificial Sequence
  Synthetic Polynucleotide
taatacgactcactatagggtcgggatgaaatttgcatcgtggtatttccaacagaggagaggaaatatgacgatgcaaaacctggcggcagcgcaaaagatg

SEQ ID NO: 107418 - DNA, 103 bp, Artificial Sequence
  Synthetic Polynucleotide
taatacgactcactatagggttgtaaacagtcgggatgaaatttgcatcgaacagaggagacgatgcatgtttcatcccaacctggcggcagcgcaaaagatg

SEQ ID NO: 107419 - DNA, 103 bp, Artificial Sequence
  Synthetic Polynucleotide
taatacgactcactatagggcttggagcatttgtaaacagtcgggatgaaaacagaggagattcatcatgactgtttacaacctggcggcagcgcaaaagatg

SEQ ID NO: 107420 - DNA, 103 bp, Artificial Sequence
  Synthetic Polynucleotide
taatacgactcactatagggctttgccacacttggagcatttgtaaacagaacagaggagactgtttatgaatgctccaaacctggcggcagcgcaaaagatg

SEQ ID NO: 107421 - DNA, 103 bp, Artificial Sequence
  Synthetic Polynucleotide
taatacgactcactatagggcgggaaaagcctttgccacacttggagcataacagaggagaatgctcatggtgtggcaaaacctggcggcagcgcaaaagatg

SEQ ID NO: 107422 - DNA, 103 bp, Artificial Sequence
  Synthetic Polynucleotide
taatacgactcactataggggttaatccagcgggaaaagcctttgccacaaacagaggagatgtggcatgggcttttccaacctggcggcagcgcaaaagatg

SEQ ID NO: 107423 - DNA, 103 bp, Artificial Sequence
  Synthetic Polynucleotide
taatacgactcactataggggtctgtgcaggttaatccagcgggaaaagcaacagaggagagcttttatggctggattaaacctggcggcagcgcaaaagatg

SEQ ID NO: 107424 - DNA, 103 bp, Artificial Sequence
  Synthetic Polynucleotide
taatacgactcactatagggttctccgaatgtctgtgcaggttaatccagaacagaggagactggatatgcctgcacagaacctggcggcagcgcaaaagatg

SEQ ID NO: 107425 - DNA, 103 bp, Artificial Sequence
  Synthetic Polynucleotide
taatacgactcactatagggtgatccacacttctccgaatgtctgtgcagaacagaggagactgcacatgcattcggagaacctggcggcagcgcaaaagatg

SEQ ID NO: 107426 - DNA, 103 bp, Artificial Sequence
  Synthetic Polynucleotide
taatacgactcactatagggcttcctccaggacgctgtcctggaaggcccaacagaggagagggcctatgaggacagcgaacctggcggcagcgcaaaagatg

SEQ ID NO: 107427 - DNA, 103 bp, Artificial Sequence
  Synthetic Polynucleotide
taatacgactcactatagggttgcttcccctgatccacacttctccgaataacagaggagaattcggatgagtgtggataacctggcggcagcgcaaaagatg

SEQ ID NO: 107428 - DNA, 103 bp, Artificial Sequence
  Synthetic Polynucleotide
taatacgactcactataggggcagccgactttgcttcccctgatccacacaacagaggagagtgtggatgaggggaagcaacctggcggcagcgcaaaagatg

SEQ ID NO: 107429 - DNA, 103 bp, Artificial Sequence
  Synthetic Polynucleotide
taatacgactcactatagggctttcctgaagcagccgactttgcttccccaacagaggagaggggaaatgaagtcggctaacctggcggcagcgcaaaagatg

SEQ ID NO: 107430 - DNA, 103 bp, Artificial Sequence
  Synthetic Polynucleotide
taatacgactcactatagggttcttcttccctttcctgaagcagccgactaacagaggagaagtcggatgcttcaggaaaacctggcggcagcgcaaaagatg

SEQ ID NO: 107431 - DNA, 103 bp, Artificial Sequence
  Synthetic Polynucleotide
taatacgactcactatagggctctttcttgttcttcttccctttcctgaaaacagaggagattcaggatggggaagaagaacctggcggcagcgcaaaagatg

SEQ ID NO: 107432 - DNA, 103 bp, Artificial Sequence
  Synthetic Polynucleotide
taatacgactcactatagggggtctgcttcctctttcttgttcttcttccaacagaggagaggaagaatgacaagaaagaacctggcggcagcgcaaaagatg

SEQ ID NO: 107433 - DNA, 103 bp, Artificial Sequence
  Synthetic Polynucleotide
taatacgactcactatagggccttcaggatggtctgcttcctctttcttgaacagaggagacaagaaatgggaagcagaaacctggcggcagcgcaaaagatg

SEQ ID NO: 107434 - DNA, 103 bp, Artificial Sequence
  Synthetic Polynucleotide
taatacgactcactatagggtttgtggcttccttcaggatggtctgcttcaacagaggagagaagcaatgcatcctgaaaacctggcggcagcgcaaaagatg

SEQ ID NO: 107435 - DNA, 103 bp, Artificial Sequence
  Synthetic Polynucleotide
taatacgactcactatagggcttctgaccctttgtggcttccttcaggataacagaggagaatcctgatggaagccacaaacctggcggcagcgcaaaagatg

SEQ ID NO: 107436 - DNA, 103 bp, Artificial Sequence
  Synthetic Polynucleotide
taatacgactcactatagggtcgcagcttccttctgaccctttgtggcttaacagaggagaaagccaatgagggtcagaaacctggcggcagcgcaaaagatg

SEQ ID NO: 107437 - DNA, 103 bp, Artificial Sequence
  Synthetic Polynucleotide
taatacgactcactatagggagctccacttcttcctccaggacgctgtccaacagaggagaggacagatgcctggaggaaacctggcggcagcgcaaaagatg

SEQ ID NO: 107438 - DNA, 103 bp, Artificial Sequence
  Synthetic Polynucleotide
taatacgactcactatagggttccatcccttcgcagcttccttctgacccaacagaggagagggtcaatgggaagctgcaacctggcggcagcgcaaaagatg

SEQ ID NO: 107439 - DNA, 103 bp, Artificial Sequence
  Synthetic Polynucleotide
taatacgactcactatagggcgcggcttccttccatcccttcgcagcttcaacagaggagagaagctatgaagggatggaacctggcggcagcgcaaaagatg

SEQ ID NO: 107440 - DNA, 103 bp, Artificial Sequence
  Synthetic Polynucleotide
taatacgactcactatagggcgtctccgttcgcggcttccttccatccctaacagaggagaagggatatgaggaagccgaacctggcggcagcgcaaaagatg

SEQ ID NO: 107441 - DNA, 103 bp, Artificial Sequence
  Synthetic Polynucleotide
taatacgactcactataggggcagcagcttcgtctccgttcgcggcttccaacagaggagaggaagcatggaacggagaaacctggcggcagcgcaaaagatg

SEQ ID NO: 107442 - DNA, 103 bp, Artificial Sequence
  Synthetic Polynucleotide
taatacgactcactatagggagcctcctcagcagcagcttcgtctccgttaacagaggagaaacggaatggaagctgctaacctggcggcagcgcaaaagatg

SEQ ID NO: 107443 - DNA, 103 bp, Artificial Sequence
  Synthetic Polynucleotide
taatacgactcactatagggtcgtggtggaagcctcctcagcagcagcttaacagaggagaaagctgatgctgaggaggaacctggcggcagcgcaaaagatg

SEQ ID NO: 107444 - DNA, 103 bp, Artificial Sequence
  Synthetic Polynucleotide
taatacgactcactatagggtgttctcccttcgtggtggaagcctcctcaaacagaggagatgaggaatgttccaccacaacctggcggcagcgcaaaagatg

SEQ ID NO: 107445 - DNA, 103 bp, Artificial Sequence
  Synthetic Polynucleotide
taatacgactcactatagggtcctgggaactgttctcccttcgtggtggaaacagaggagatccaccatgaagggagaaaacctggcggcagcgcaaaagatg

SEQ ID NO: 107446 - DNA, 103 bp, Artificial Sequence
  Synthetic Polynucleotide
taatacgactcactataggggaaacatctctcctgggaactgttctccctaacagaggagaagggagatgagttcccagaacctggcggcagcgcaaaagatg

SEQ ID NO: 107447 - DNA, 103 bp, Artificial Sequence
  Synthetic Polynucleotide
taatacgactcactatagggcaggcgacaggaaacatctctcctgggaacaacagaggagagttcccatgagagatgttaacctggcggcagcgcaaaagatg

SEQ ID NO: 107448 - DNA, 103 bp, Artificial Sequence
  Synthetic Polynucleotide
taatacgactcactatagggggccagcaccagctccacttcttcctccagaacagaggagactggagatggaagtggagaacctggcggcagcgcaaaagatg

SEQ ID NO: 107449 - DNA, 103 bp, Artificial Sequence
  Synthetic Polynucleotide
taatacgactcactatagggggtttctctgcaggcgacaggaaacatctcaacagaggagagagatgatgcctgtcgccaacctggcggcagcgcaaaagatg

SEQ ID NO: 107450 - DNA, 103 bp, Artificial Sequence
  Synthetic Polynucleotide
taatacgactcactatagggctctggctgtggtttctctgcaggcgacagaacagaggagactgtcgatggcagagaaaaacctggcggcagcgcaaaagatg

SEQ ID NO: 107451 - DNA, 103 bp, Artificial Sequence
  Synthetic Polynucleotide
taatacgactcactatagggtcctctttgactctggctgtggtttctctgaacagaggagacagagaatgcacagccagaacctggcggcagcgcaaaagatg

SEQ ID NO: 107452 - DNA, 103 bp, Artificial Sequence
  Synthetic Polynucleotide
taatacgactcactatagggttcatccacttcctctttgactctggctgtaacagaggagaacagccatggtcaaagagaacctggcggcagcgcaaaagatg

SEQ ID NO: 107453 - DNA, 103 bp, Artificial Sequence
  Synthetic Polynucleotide
taatacgactcactatagggaggtcacgccttcatccacttcctctttgaaacagaggagatcaaagatgaagtggatgaacctggcggcagcgcaaaagatg

SEQ ID NO: 107454 - DNA, 103 bp, Artificial Sequence
  Synthetic Polynucleotide
taatacgactcactatagggagcatttcacaggtcacgccttcatccactaacagaggagaagtggaatgaggcgtgacaacctggcggcagcgcaaaagatg

SEQ ID NO: 107455 - DNA, 103 bp, Artificial Sequence
  Synthetic Polynucleotide
taatacgactcactatagggcgtgttgaggagcatttcacaggtcacgccaacagaggagaggcgtgatgtgtgaaatgaacctggcggcagcgcaaaagatg

SEQ ID NO: 107456 - DNA, 103 bp, Artificial Sequence
  Synthetic Polynucleotide
taatacgactcactatagggacttatccatcgtgttgaggagcatttcacaacagaggagagtgaaaatgtcctcaacaaacctggcggcagcgcaaaagatg

SEQ ID NO: 107457 - DNA, 103 bp, Artificial Sequence
  Synthetic Polynucleotide
taatacgactcactatagggtgaattgctcagaaaggacagagatctcagaacagaggagactgagaatgctgtcctttaacctggcggcagcgcaaaagatg

SEQ ID NO: 107458 - DNA, 103 bp, Artificial Sequence
  Synthetic Polynucleotide
taatacgactcactatagggcctccgagggggccagcaccagctccacttaacagaggagaaagtggatgtggtgctggaacctggcggcagcgcaaaagatg

SEQ ID NO: 107459 - DNA, 103 bp, Artificial Sequence
  Synthetic Polynucleotide
taatacgactcactatagggttctcgctctcctccgagggggccagcaccaacagaggagaggtgctatgcccctcggaaacctggcggcagcgcaaaagatg

SEQ ID NO: 107460 - DNA, 103 bp, Artificial Sequence
  Synthetic Polynucleotide
taatacgactcactatagggcaggatgtacttctcgctctcctccgagggaacagaggagaccctcgatggagagcgagaacctggcggcagcgcaaaagatg

SEQ ID NO: 107461 - DNA, 103 bp, Artificial Sequence
  Synthetic Polynucleotide
taatacgactcactatagggtctgcagggtcaggatgtacttctcgctctaacagaggagaagagcgatgagtacatccaacctggcggcagcgcaaaagatg

SEQ ID NO: 107462 - DNA, 103 bp, Artificial Sequence
  Synthetic Polynucleotide
taatacgactcactatagggaagtgcaccgtctgcagggtcaggatgtacaacagaggagagtacatatggaccctgcaaacctggcggcagcgcaaaagatg

SEQ ID NO: 107463 - DNA, 103 bp, Artificial Sequence
  Synthetic Polynucleotide
taatacgactcactatagggttcagaagtgaagtgcaccgtctgcagggtaacagaggagaaccctgatgacggtgcacaacctggcggcagcgcaaaagatg

SEQ ID NO: 107464 - DNA, 103 bp, Artificial Sequence
  Synthetic Polynucleotide
taatacgactcactatagggactccacagcttcagaagtgaagtgcaccgaacagaggagacggtgcatgtcacttctgaacctggcggcagcgcaaaagatg

SEQ ID NO: 107465 - DNA, 103 bp, Artificial Sequence
  Synthetic Polynucleotide
taatacgactcactatagggatatcctgcaactccacagcttcagaagtgaacagaggagacacttcatgagctgtggaaacctggcggcagcgcaaaagatg

SEQ ID NO: 107466 - DNA, 103 bp, Artificial Sequence
  Synthetic Polynucleotide
taatacgactcactatagggcagcaagctcatatcctgcaactccacagcaacagaggagagctgtgatgttgcaggataacctggcggcagcgcaaaagatg

SEQ ID NO: 107467 - DNA, 103 bp, Artificial Sequence
  Synthetic Polynucleotide
taatacgactcactataggggctgtatgctcagcaagctcatatcctgcaaacagaggagatgcaggatgtgagcttgcaacctggcggcagcgcaaaagatg

SEQ ID NO: 107468 - DNA, 103 bp, Artificial Sequence
  Synthetic Polynucleotide
taatacgactcactatagggttgatcttggtgaattgctcagaaaggacaaacagaggagatgtcctatgtgagcaattaacctggcggcagcgcaaaagatg

SEQ ID NO: 107469 - DNA, 103 bp, Artificial Sequence
  Synthetic Polynucleotide
taatacgactcactatagggccttcttgctgctgtatgctcagcaagctcaacagaggagagagcttatggagcatacaaacctggcggcagcgcaaaagatg

SEQ ID NO: 107470 - DNA, 103 bp, Artificial Sequence
  Synthetic Polynucleotide
taatacgactcactatagggcacctgcaccccttcttgctgctgtatgctaacagaggagaagcataatgcagcaagaaaacctggcggcagcgcaaaagatg

SEQ ID NO: 107471 - DNA, 103 bp, Artificial Sequence
  Synthetic Polynucleotide
taatacgactcactataggggttgcaccaccacctgcaccccttcttgctaacagaggagaagcaagatggggtgcaggaacctggcggcagcgcaaaagatg

SEQ ID NO: 107472 - DNA, 103 bp, Artificial Sequence
  Synthetic Polynucleotide
taatacgactcactataggggggccaggctgttgcaccaccacctgcaccaacagaggagaggtgcaatgggtggtgcaaacctggcggcagcgcaaaagatg

SEQ ID NO: 107473 - DNA, 103 bp, Artificial Sequence
  Synthetic Polynucleotide
taatacgactcactatagggcagcaacccagggccaggctgttgcaccacaacagaggagagtggtgatgcagcctggcaacctggcggcagcgcaaaagatg

SEQ ID NO: 107474 - DNA, 103 bp, Artificial Sequence
  Synthetic Polynucleotide
taatacgactcactatagggcctcaagccacagcaacccagggccaggctaacagaggagaagcctgatgctgggttgcaacctggcggcagcgcaaaagatg

SEQ ID NO: 107475 - DNA, 103 bp, Artificial Sequence
  Synthetic Polynucleotide
taatacgactcactatagggcggggcccttcctcaagccacagcaacccaaacagaggagatgggttatggtggcttgaaacctggcggcagcgcaaaagatg

SEQ ID NO: 107476 - DNA, 103 bp, Artificial Sequence
  Synthetic Polynucleotide
taatacgactcactatagggcaggctctgccggggcccttcctcaagccaaacagaggagatggcttatggaagggcccaacctggcggcagcgcaaaagatg

SEQ ID NO: 107477 - DNA, 103 bp, Artificial Sequence
  Synthetic Polynucleotide
taatacgactcactatagggcacactgctgcaggctctgccggggcccttaacagaggagaaagggcatgggcagagccaacctggcggcagcgcaaaagatg

SEQ ID NO: 107478 - DNA, 103 bp, Artificial Sequence
  Synthetic Polynucleotide
taatacgactcactatagggctaatggccacacactgctgcaggctctgcaacagaggagagcagagatggcagcagtgaacctggcggcagcgcaaaagatg

SEQ ID NO: 107479 - DNA, 103 bp, Artificial Sequence
  Synthetic Polynucleotide
taatacgactcactatagggctcgagttctttgatcttggtgaattgctcaacagaggagagagcaaatgaccaagatcaacctggcggcagcgcaaaagatg

SEQ ID NO: 107480 - DNA, 103 bp, Artificial Sequence
  Synthetic Polynucleotide
taatacgactcactatagggttgctggatactaatggccacacactgctgaacagaggagacagcagatggtggccattaacctggcggcagcgcaaaagatg

SEQ ID NO: 107481 - DNA, 103 bp, Artificial Sequence
  Synthetic Polynucleotide
taatacgactcactatagggagtacagctcttgctggatactaatggccaaacagaggagatggccaatggtatccagcaacctggcggcagcgcaaaagatg

SEQ ID NO: 107482 - DNA, 103 bp, Artificial Sequence
  Synthetic Polynucleotide
taatacgactcactatagggtcttgcggggagtacagctcttgctggataaacagaggagatatccaatgagagctgtaaacctggcggcagcgcaaaagatg

SEQ ID NO: 107483 - DNA, 103 bp, Artificial Sequence
  Synthetic Polynucleotide
taatacgactcactatagggcacctccatctcttgcggggagtacagctcaacagaggagagagctgatgtccccgcaaaacctggcggcagcgcaaaagatg

SEQ ID NO: 107484 - DNA, 103 bp, Artificial Sequence
  Synthetic Polynucleotide
taatacgactcactatagggggaactgcaacacctccatctcttgcggggaacagaggagaccccgcatgagatggaggaacctggcggcagcgcaaaagatg

SEQ ID NO: 107485 - DNA, 103 bp, Artificial Sequence
  Synthetic Polynucleotide
taatacgactcactatagggtctagagcgtggaactgcaacacctccatcaacagaggagagatggaatggttgcagttaacctggcggcagcgcaaaagatg

SEQ ID NO: 107486 - DNA, 103 bp, Artificial Sequence
  Synthetic Polynucleotide
taatacgactcactatagggcacattctcctctagagcgtggaactgcaaaacagaggagattgcagatgcacgctctaaacctggcggcagcgcaaaagatg

SEQ ID NO: 107487 - DNA, 103 bp, Artificial Sequence
  Synthetic Polynucleotide
taatacgactcactatagggtggccaccatcacattctcctctagagcgtaacagaggagaacgctcatgaggagaatgaacctggcggcagcgcaaaagatg

SEQ ID NO: 107488 - DNA, 103 bp, Artificial Sequence
  Synthetic Polynucleotide
taatacgactcactatagggctgtcttcactggccaccatcacattctccaacagaggagaggagaaatggatggtggcaacctggcggcagcgcaaaagatg

SEQ ID NO: 107489 - DNA, 103 bp, Artificial Sequence
  Synthetic Polynucleotide
taatacgactcactatagggcgctaacttactgtcttcactggccaccataacagaggagaatggtgatgagtgaagacaacctggcggcagcgcaaaagatg

SEQ ID NO: 107490 - DNA, 103 bp, Artificial Sequence
  Synthetic Polynucleotide
taatacgactcactatagggccggcatcaactcgagttctttgatcttggaacagaggagaccaagaatgaagaactcgaacctggcggcagcgcaaaagatg

SEQ ID NO: 107491 - DNA, 103 bp, Artificial Sequence
  Synthetic Polynucleotide
taatacgactcactatagggccaggctcaccgctaacttactgtcttcacaacagaggagagtgaagatggtaagttagaacctggcggcagcgcaaaagatg

SEQ ID NO: 107492 - DNA, 103 bp, Artificial Sequence
  Synthetic Polynucleotide
taatacgactcactataggggtagtttcagccaggctcaccgctaacttaaacagaggagataagttatgggtgagcctaacctggcggcagcgcaaaagatg

SEQ ID NO: 107493 - DNA, 103 bp, Artificial Sequence
  Synthetic Polynucleotide
taatacgactcactataggggatcagtccagtagtttcagccaggctcacaacagaggagagtgagcatggctgaaactaacctggcggcagcgcaaaagatg

SEQ ID NO: 107494 - DNA, 103 bp, Artificial Sequence
  Synthetic Polynucleotide
taatacgactcactatagggcctcgagcttgatcagtccagtagtttcagaacagaggagactgaaaatgctggactgaaacctggcggcagcgcaaaagatg

SEQ ID NO: 107495 - DNA, 103 bp, Artificial Sequence
  Synthetic Polynucleotide
taatacgactcactatagggtcctgctcttcctcgagcttgatcagtccaaacagaggagatggactatgcaagctcgaaacctggcggcagcgcaaaagatg

SEQ ID NO: 107496 - DNA, 103 bp, Artificial Sequence
  Synthetic Polynucleotide
taatacgactcactatagggctggttcttctcctgctcttcctcgagcttaacagaggagaaagctcatggaagagcagaacctggcggcagcgcaaaagatg

SEQ ID NO: 107497 - DNA, 103 bp, Artificial Sequence
  Synthetic Polynucleotide
taatacgactcactatagggcagccaataactggttcttctcctgctcttaacagaggagaaagagcatgagaagaaccaacctggcggcagcgcaaaagatg

SEQ ID NO: 107498 - DNA, 103 bp, Artificial Sequence
  Synthetic Polynucleotide
taatacgactcactatagggtttgttctttcagccaataactggttcttcaacagaggagagaagaaatggttattggcaacctggcggcagcgcaaaagatg

SEQ ID NO: 107499 - DNA, 103 bp, Artificial Sequence
  Synthetic Polynucleotide
taatacgactcactataggggagctgctcctttgttctttcagccaataaaacagaggagattattgatggaaagaacaaacctggcggcagcgcaaaagatg

SEQ ID NO: 107500 - DNA, 103 bp, Artificial Sequence
  Synthetic Polynucleotide
taatacgactcactatagggccacaaaaaagagctgctcctttgttctttaacagaggagaaaagaaatgaggagcagcaacctggcggcagcgcaaaagatg

SEQ ID NO: 107501 - DNA, 103 bp, Artificial Sequence
  Synthetic Polynucleotide
taatacgactcactatagggaggcctttttccggcatcaactcgagttctaacagaggagaagaactatggttgatgccaacctggcggcagcgcaaaagatg

SEQ ID NO: 107502 - DNA, 103 bp, Artificial Sequence
  Synthetic Polynucleotide
taatacgactcactataggggacattgtttccacaaaaaagagctgctccaacagaggagaggagcaatgcttttttgtaacctggcggcagcgcaaaagatg

SEQ ID NO: 107503 - DNA, 103 bp, Artificial Sequence
  Synthetic Polynucleotide
taatacgactcactatagggttcatctcctgacattgtttccacaaaaaaaacagaggagattttttatggaaacaatgaacctggcggcagcgcaaaagatg

SEQ ID NO: 107504 - DNA, 103 bp, Artificial Sequence
  Synthetic Polynucleotide
taatacgactcactatagggcgtcacttctttcatctcctgacattgtttaacagaggagaaaacaaatgcaggagatgaacctggcggcagcgcaaaagatg

SEQ ID NO: 107505 - DNA, 103 bp, Artificial Sequence
  Synthetic Polynucleotide
taatacgactcactatagggagaacaatttcgtcacttctttcatctcctaacagaggagaaggagaatgaagaagtgaaacctggcggcagcgcaaaagatg

SEQ ID NO: 107506 - DNA, 103 bp, Artificial Sequence
  Synthetic Polynucleotide
taatacgactcactatagggtgaaactgtgagaacaatttcgtcacttctaacagaggagaagaagtatggaaattgttaacctggcggcagcgcaaaagatg

SEQ ID NO: 107507 - DNA, 103 bp, Artificial Sequence
  Synthetic Polynucleotide
taatacgactcactatagggcatttgaatttgaaactgtgagaacaatttaacagaggagaaaattgatgtcacagtttaacctggcggcagcgcaaaagatg

SEQ ID NO: 107508 - DNA, 103 bp, Artificial Sequence
  Synthetic Polynucleotide
taatacgactcactatagggtgttcttccacatttgaatttgaaactgtgaacagaggagacacagtatgaaattcaaaaacctggcggcagcgcaaaagatg

SEQ ID NO: 107509 - DNA, 103 bp, Artificial Sequence
  Synthetic Polynucleotide
taatacgactcactatagggttgatcctcttgttcttccacatttgaattaacagaggagaaattcaatggtggaagaaaacctggcggcagcgcaaaagatg

SEQ ID NO: 107510 - DNA, 103 bp, Artificial Sequence
  Synthetic Polynucleotide
taatacgactcactatagggcagctgtaggttgatcctcttgttcttccaaacagaggagatggaagatgaagaggatcaacctggcggcagcgcaaaagatg

SEQ ID NO: 107511 - DNA, 103 bp, Artificial Sequence
  Synthetic Polynucleotide
taatacgactcactatagggtctgcttgaccagctgtaggttgatcctctaacagaggagaagaggaatgacctacagcaacctggcggcagcgcaaaagatg

SEQ ID NO: 107512 - DNA, 103 bp, Artificial Sequence
  Synthetic Polynucleotide
taatacgactcactatagggctcctccttcaggcctttttccggcatcaaaacagaggagattgatgatggaaaaaggcaacctggcggcagcgcaaaagatg

SEQ ID NO: 107513 - DNA, 103 bp, Artificial Sequence
  Synthetic Polynucleotide
taatacgactcactatagggcttttcagcatctgcttgaccagctgtaggaacagaggagacctacaatgggtcaagcaaacctggcggcagcgcaaaagatg

SEQ ID NO: 107514 - DNA, 103 bp, Artificial Sequence
  Synthetic Polynucleotide
taatacgactcactatagggtagatttggccttttcagcatctgcttgacaacagaggagagtcaagatgatgctgaaaaacctggcggcagcgcaaaagatg

SEQ ID NO: 107515 - DNA, 103 bp, Artificial Sequence
  Synthetic Polynucleotide
taatacgactcactatagggtgattttttgtagatttggccttttcagcaaacagaggagatgctgaatgggccaaatcaacctggcggcagcgcaaaagatg

SEQ ID NO: 107516 - DNA, 103 bp, Artificial Sequence
  Synthetic Polynucleotide
taatacgactcactatagggtgtctttctttgattttttgtagatttggcaacagaggagagccaaaatgacaaaaaataacctggcggcagcgcaaaagatg

SEQ ID NO: 107517 - DNA, 103 bp, Artificial Sequence
  Synthetic Polynucleotide
taatacgactcactatagggttgctccctttgtctttctttgattttttgaacagaggagacaaaaaatgaaagaaagaaacctggcggcagcgcaaaagatg

SEQ ID NO: 107518 - DNA, 103 bp, Artificial Sequence
  Synthetic Polynucleotide
taatacgactcactatagggaaggttccttttgctccctttgtctttcttaacagaggagaaagaaaatgaaagggagcaacctggcggcagcgcaaaagatg

SEQ ID NO: 107519 - DNA, 103 bp, Artificial Sequence
  Synthetic Polynucleotide
taatacgactcactatagggatcacagtggaaggttccttttgctcccttaacagaggagaaagggaatgaaaggaaccaacctggcggcagcgcaaaagatg

SEQ ID NO: 107520 - DNA, 103 bp, Artificial Sequence
  Synthetic Polynucleotide
taatacgactcactatagggacatgcagacatcacagtggaaggttccttaacagaggagaaaggaaatgtccactgtgaacctggcggcagcgcaaaagatg

SEQ ID NO: 107521 - DNA, 103 bp, Artificial Sequence
  Synthetic Polynucleotide
taatacgactcactataggggaagaggtgaacatgcagacatcacagtggaacagaggagaccactgatgtgtctgcataacctggcggcagcgcaaaagatg

SEQ ID NO: 107522 - DNA, 103 bp, Artificial Sequence
  Synthetic Polynucleotide
taatacgactcactatagggtgacattctagaagaggtgaacatgcagacaacagaggagagtctgcatgttcacctctaacctggcggcagcgcaaaagatg

SEQ ID NO: 107523 - DNA, 103 bp, Artificial Sequence
  Synthetic Polynucleotide
taatacgactcactatagggcgtctttttcctcctccttcaggcctttttaacagaggagaaaaaagatgtgaaggaggaacctggcggcagcgcaaaagatg

SEQ ID NO: 107524 - DNA, 103 bp, Artificial Sequence
  Synthetic Polynucleotide
taatacgactcactataggggattaaaacttgacattctagaagaggtgaaacagaggagatcacctatgctagaatgtaacctggcggcagcgcaaaagatg

SEQ ID NO: 107525 - DNA, 103 bp, Artificial Sequence
  Synthetic Polynucleotide
taatacgactcactatagggttcatatgacgattaaaacttgacattctaaacagaggagatagaatatgaagttttaaaacctggcggcagcgcaaaagatg

SEQ ID NO: 107526 - DNA, 103 bp, Artificial Sequence
  Synthetic Polynucleotide
taatacgactcactatagggggtgtgagttttcatatgacgattaaaactaacagaggagaagttttatgcgtcatatgaacctggcggcagcgcaaaagatg

SEQ ID NO: 107527 - DNA, 103 bp, Artificial Sequence
  Synthetic Polynucleotide
taatacgactcactataggggcttctcactggtgtgagttttcatatgacaacagaggagagtcataatgaaactcacaaacctggcggcagcgcaaaagatg

SEQ ID NO: 107528 - DNA, 103 bp, Artificial Sequence
  Synthetic Polynucleotide
taatacgactcactatagggcacaggtgaggcttctcactggtgtgagttaacagaggagaaactcaatgcagtgagaaaacctggcggcagcgcaaaagatg

SEQ ID NO: 107529 - DNA, 103 bp, Artificial Sequence
  Synthetic Polynucleotide
taatacgactcactataggggcagaggtgacacaggtgaggcttctcactaacagaggagaagtgagatgcctcacctgaacctggcggcagcgcaaaagatg

SEQ ID NO: 107530 - DNA, 103 bp, Artificial Sequence
  Synthetic Polynucleotide
taatacgactcactatagggaggttttcaggcagaggtgacacaggtgagaacagaggagactcaccatggtcacctctaacctggcggcagcgcaaaagatg

SEQ ID NO: 107531 - DNA, 103 bp, Artificial Sequence
  Synthetic Polynucleotide
taatacgactcactatagggaccgtacggaaggttttcaggcagaggtgaaacagaggagatcacctatgcctgaaaacaacctggcggcagcgcaaaagatg

SEQ ID NO: 107532 - DNA, 103 bp, Artificial Sequence
  Synthetic Polynucleotide
taatacgactcactatagggcagcagagtgaccgtacggaaggttttcagaacagaggagactgaaaatgttccgtacgaacctggcggcagcgcaaaagatg

SEQ ID NO: 107533 - DNA, 103 bp, Artificial Sequence
  Synthetic Polynucleotide
taatacgactcactatagggcatggttccgcagcagagtgaccgtacggaaacagaggagatccgtaatgtcactctgcaacctggcggcagcgcaaaagatg

SEQ ID NO: 107534 - DNA, 103 bp, Artificial Sequence
  Synthetic Polynucleotide
taatacgactcactatagggctgcacactccgtctttttcctcctccttcaacagaggagagaaggaatgggaaaaagaaacctggcggcagcgcaaaagatg

SEQ ID NO: 107535 - DNA, 103 bp, Artificial Sequence
  Synthetic Polynucleotide
taatacgactcactatagggtgggtgttaacatggttccgcagcagagtgaacagaggagacactctatggcggaaccaaacctggcggcagcgcaaaagatg

SEQ ID NO: 107536 - DNA, 103 bp, Artificial Sequence
  Synthetic Polynucleotide
taatacgactcactatagggggttcctgtgtgggtgttaacatggttccgaacagaggagacggaacatggttaacaccaacctggcggcagcgcaaaagatg

SEQ ID NO: 107537 - DNA, 103 bp, Artificial Sequence
  Synthetic Polynucleotide
taatacgactcactatagggtgtagggcctggttcctgtgtgggtgttaaaacagaggagattaacaatgacacaggaaaacctggcggcagcgcaaaagatg

SEQ ID NO: 107538 - DNA, 103 bp, Artificial Sequence
  Synthetic Polynucleotide
taatacgactcactatagggtcgttacacttgtagggcctggttcctgtgaacagaggagacacaggatgcaggccctaaacctggcggcagcgcaaaagatg

SEQ ID NO: 107539 - DNA, 103 bp, Artificial Sequence
  Synthetic Polynucleotide
taatacgactcactatagggcatgttgcagtcgttacacttgtagggcctaacagaggagaaggcccatgaagtgtaacaacctggcggcagcgcaaaagatg

SEQ ID NO: 107540 - DNA, 103 bp, Artificial Sequence
  Synthetic Polynucleotide
taatacgactcactatagggtgacaaatgccatgttgcagtcgttacactaacagaggagaagtgtaatgactgcaacaaacctggcggcagcgcaaaagatg

SEQ ID NO: 107541 - DNA, 103 bp, Artificial Sequence
  Synthetic Polynucleotide
taatacgactcactatagggtctccactggtgacaaatgccatgttgcagaacagaggagactgcaaatgggcatttgtaacctggcggcagcgcaaaagatg

SEQ ID NO: 107542 - DNA, 103 bp, Artificial Sequence
  Synthetic Polynucleotide
taatacgactcactatagggtcggacgagttctccactggtgacaaatgcaacagaggagagcatttatgaccagtggaaacctggcggcagcgcaaaagatg

SEQ ID NO: 107543 - DNA, 103 bp, Artificial Sequence
  Synthetic Polynucleotide
taatacgactcactatagggagcgcctgtgtcggacgagttctccactggaacagaggagaccagtgatgaactcgtccaacctggcggcagcgcaaaagatg

SEQ ID NO: 107544 - DNA, 103 bp, Artificial Sequence
  Synthetic Polynucleotide
taatacgactcactataggggtatgtttatagcgcctgtgtcggacgagtaacagaggagaactcgtatgacacaggcgaacctggcggcagcgcaaaagatg

SEQ ID NO: 107545 - DNA, 103 bp, Artificial Sequence
  Synthetic Polynucleotide
taatacgactcactatagggcttcaacctggctccggctacgcacaacataacagaggagaatgttgatggtagccggaaacctggcggcagcgcaaaagatg

SEQ ID NO: 107546 - DNA, 103 bp, Artificial Sequence
  Synthetic Polynucleotide
taatacgactcactatagggctcccggctctgttcgataagccgctttctaacagaggagaagaaagatgcttatcgaaaacctggcggcagcgcaaaagatg

SEQ ID NO: 107547 - DNA, 103 bp, Artificial Sequence
  Synthetic Polynucleotide
taatacgactcactatagggttgtttgagtgtgctgtttttggcgctcagaacagaggagactgagcatgaaaaacagcaacctggcggcagcgcaaaagatg

SEQ ID NO: 107548 - DNA, 103 bp, Artificial Sequence
  Synthetic Polynucleotide
taatacgactcactatagggtttcttccagttgtttgagtgtgctgttttaacagaggagaaaaacaatgcactcaaacaacctggcggcagcgcaaaagatg

SEQ ID NO: 107549 - DNA, 103 bp, Artificial Sequence
  Synthetic Polynucleotide
taatacgactcactatagggcctttgagtttttcttccagttgtttgagtaacagaggagaactcaaatgactggaagaaacctggcggcagcgcaaaagatg

SEQ ID NO: 107550 - DNA, 103 bp, Artificial Sequence
  Synthetic Polynucleotide
taatacgactcactataggggtcagcctggcctttgagtttttcttccagaacagaggagactggaaatgaaactcaaaaacctggcggcagcgcaaaagatg

SEQ ID NO: 107551 - DNA, 103 bp, Artificial Sequence
  Synthetic Polynucleotide
taatacgactcactatagggcctcttcatagtcagcctggcctttgagttaacagaggagaaactcaatggccaggctgaacctggcggcagcgcaaaagatg

SEQ ID NO: 107552 - DNA, 103 bp, Artificial Sequence
  Synthetic Polynucleotide
taatacgactcactatagggtctttcttcacctcttcatagtcagcctggaacagaggagaccaggcatgctatgaagaaacctggcggcagcgcaaaagatg

SEQ ID NO: 107553 - DNA, 103 bp, Artificial Sequence
  Synthetic Polynucleotide
taatacgactcactatagggaatgttcagctctttcttcacctcttcataaacagaggagatatgaaatggtgaagaaaaacctggcggcagcgcaaaagatg

SEQ ID NO: 107554 - DNA, 103 bp, Artificial Sequence
  Synthetic Polynucleotide
taatacgactcactatagggtggacttcagaatgttcagctctttcttcaaacagaggagatgaagaatgagctgaacaaacctggcggcagcgcaaaagatg

SEQ ID NO: 107555 - DNA, 103 bp, Artificial Sequence
  Synthetic Polynucleotide
taatacgactcactataggggcaaactccatggacttcagaatgttcagcaacagaggagagctgaaatgtctgaagtcaacctggcggcagcgcaaaagatg

SEQ ID NO: 107556 - DNA, 103 bp, Artificial Sequence
  Synthetic Polynucleotide
taatacgactcactatagggctcggacggtgcaaactccatggacttcagaacagaggagactgaagatgatggagtttaacctggcggcagcgcaaaagatg

SEQ ID NO: 107557 - DNA, 103 bp, Artificial Sequence
  Synthetic Polynucleotide
taatacgactcactatagggtcttcttgaactcccggctctgttcgataaaacagaggagattatcgatgagagccgggaacctggcggcagcgcaaaagatg

SEQ ID NO: 107558 - DNA, 103 bp, Artificial Sequence
  Synthetic Polynucleotide
taatacgactcactatagggtcccagcgccctcggacggtgcaaactccaaacagaggagatggagtatgcaccgtccgaacctggcggcagcgcaaaagatg

SEQ ID NO: 107559 - DNA, 103 bp, Artificial Sequence
  Synthetic Polynucleotide
taatacgactcactataggggcatcctgtgtcccagcgccctcggacggtaacagaggagaaccgtcatggggcgctggaacctggcggcagcgcaaaagatg

SEQ ID NO: 107560 - DNA, 103 bp, Artificial Sequence
  Synthetic Polynucleotide
taatacgactcactataggggggcttggccgcatcctgtgtcccagcgccaacagaggagaggcgctatgacacaggataacctggcggcagcgcaaaagatg

SEQ ID NO: 107561 - DNA, 103 bp, Artificial Sequence
  Synthetic Polynucleotide
taatacgactcactataggggcacctccaggggcttggccgcatcctgtgaacagaggagacacaggatgcggccaagcaacctggcggcagcgcaaaagatg

SEQ ID NO: 107562 - DNA, 103 bp, Artificial Sequence
  Synthetic Polynucleotide
taatacgactcactatagggtccagcaacagcacctccaggggcttggccaacagaggagaggccaaatgcctggaggtaacctggcggcagcgcaaaagatg

SEQ ID NO: 107563 - DNA, 103 bp, Artificial Sequence
  Synthetic Polynucleotide
taatacgactcactataggggcggttcttctccagcaacagcacctccagaacagaggagactggagatgctgttgctgaacctggcggcagcgcaaaagatg

SEQ ID NO: 107564 - DNA, 103 bp, Artificial Sequence
  Synthetic Polynucleotide
taatacgactcactatagggactgcagcgagcggttcttctccagcaacaaacagaggagatgttgcatgagaagaaccaacctggcggcagcgcaaaagatg

SEQ ID NO: 107565 - DNA, 103 bp, Artificial Sequence
  Synthetic Polynucleotide
taatacgactcactataggggcgttctcggactgcagcgagcggttcttcaacagaggagagaagaaatgctcgctgcaaacctggcggcagcgcaaaagatg

SEQ ID NO: 107566 - DNA, 103 bp, Artificial Sequence
  Synthetic Polynucleotide
taatacgactcactataggggcgcagcgcggcgttctcggactgcagcgaaacagaggagatcgctgatgtccgagaacaacctggcggcagcgcaaaagatg

SEQ ID NO: 107567 - DNA, 103 bp, Artificial Sequence
  Synthetic Polynucleotide
taatacgactcactatagggtgttggagatgcgcagcgcggcgttctcggaacagaggagaccgagaatgccgcgctgcaacctggcggcagcgcaaaagatg

SEQ ID NO: 107568 - DNA, 103 bp, Artificial Sequence
  Synthetic Polynucleotide
taatacgactcactatagggtctggagtgttcttcttgaactcccggctcaacagaggagagagccgatggttcaagaaaacctggcggcagcgcaaaagatg

SEQ ID NO: 107569 - DNA, 103 bp, Artificial Sequence
  Synthetic Polynucleotide
taatacgactcactatagggctcaggtcgctgttggagatgcgcagcgcgaacagaggagacgcgctatgcatctccaaaacctggcggcagcgcaaaagatg

SEQ ID NO: 107570 - DNA, 103 bp, Artificial Sequence
  Synthetic Polynucleotide
taatacgactcactatagggggctgacccgctcaggtcgctgttggagataacagaggagaatctccatgagcgacctgaacctggcggcagcgcaaaagatg

SEQ ID NO: 107571 - DNA, 103 bp, Artificial Sequence
  Synthetic Polynucleotide
taatacgactcactatagggctttcctcctggctgacccgctcaggtcgcaacagaggagagcgaccatggcgggtcagaacctggcggcagcgcaaaagatg

SEQ ID NO: 107572 - DNA, 103 bp, Artificial Sequence
  Synthetic Polynucleotide
taatacgactcactatagggtggtctttccctttcctcctggctgacccgaacagaggagacgggtcatgcaggaggaaaacctggcggcagcgcaaaagatg

SEQ ID NO: 107573 - DNA, 103 bp, Artificial Sequence
  Synthetic Polynucleotide
taatacgactcactatagggactttcaggctggtctttccctttcctcctaacagaggagaaggaggatggggaaagacaacctggcggcagcgcaaaagatg

SEQ ID NO: 107574 - DNA, 103 bp, Artificial Sequence
  Synthetic Polynucleotide
taatacgactcactatagggccgggcgccgactttcaggctggtctttccaacagaggagaggaaagatgagcctgaaaaacctggcggcagcgcaaaagatg

SEQ ID NO: 107575 - DNA, 103 bp, Artificial Sequence
  Synthetic Polynucleotide
taatacgactcactatagggggcaaagatcccgggcgccgactttcaggcaacagaggagagcctgaatgtcggcgcccaacctggcggcagcgcaaaagatg

SEQ ID NO: 107576 - DNA, 103 bp, Artificial Sequence
  Synthetic Polynucleotide
taatacgactcactatagggagggggggccggcaaagatcccgggcgccgaacagaggagacggcgcatgggatctttgaacctggcggcagcgcaaaagatg

SEQ ID NO: 107577 - DNA, 103 bp, Artificial Sequence
  Synthetic Polynucleotide
taatacgactcactatagggactgagaaggagggggggccggcaaagatcaacagaggagagatcttatgcggccccccaacctggcggcagcgcaaaagatg

SEQ ID NO: 107578 - DNA, 103 bp, Artificial Sequence
  Synthetic Polynucleotide
taatacgactcactatagggttgcggggcaactgagaaggagggggggccaacagaggagaggccccatgtccttctcaaacctggcggcagcgcaaaagatg

SEQ ID NO: 107579 - DNA, 103 bp, Artificial Sequence
  Synthetic Polynucleotide
taatacgactcactataggggcgcaaatcctctggagtgttcttcttgaaaacagaggagattcaagatgaacactccaaacctggcggcagcgcaaaagatg

SEQ ID NO: 107580 - DNA, 103 bp, Artificial Sequence
  Synthetic Polynucleotide
taatacgactcactatagggctcccccgggttgcggggcaactgagaaggaacagaggagaccttctatgttgccccgcaacctggcggcagcgcaaaagatg

SEQ ID NO: 107581 - DNA, 103 bp, Artificial Sequence
  Synthetic Polynucleotide
taatacgactcactatagggtggaagcctgctcccccgggttgcggggcaaacagaggagatgccccatgacccgggggaacctggcggcagcgcaaaagatg

SEQ ID NO: 107582 - DNA, 103 bp, Artificial Sequence
  Synthetic Polynucleotide
taatacgactcactatagggccattagtattggaagcctgctcccccgggaacagaggagacccgggatggcaggcttcaacctggcggcagcgcaaaagatg

SEQ ID NO: 107583 - DNA, 103 bp, Artificial Sequence
  Synthetic Polynucleotide
taatacgactcactatagggctggtgtgtaccattagtattggaagcctgaacagaggagacaggctatgaatactaataacctggcggcagcgcaaaagatg

SEQ ID NO: 107584 - DNA, 103 bp, Artificial Sequence
  Synthetic Polynucleotide
taatacgactcactatagggctggtgagaactggtgtgtaccattagtataacagaggagaatactaatggtacacaccaacctggcggcagcgcaaaagatg

SEQ ID NO: 107585 - DNA, 103 bp, Artificial Sequence
  Synthetic Polynucleotide
taatacgactcactatagggcttaaccccgctggtgagaactggtgtgtaaacagaggagatacacaatggttctcaccaacctggcggcagcgcaaaagatg

SEQ ID NO: 107586 - DNA, 103 bp, Artificial Sequence
  Synthetic Polynucleotide
taatacgactcactatagggaaagtcttgacttaaccccgctggtgagaaaacagaggagattctcaatggcggggttaaacctggcggcagcgcaaaagatg

SEQ ID NO: 107587 - DNA, 103 bp, Artificial Sequence
  Synthetic Polynucleotide
taatacgactcactatagggatgagctgaaaaagtcttgacttaaccccgaacagaggagacggggtatggtcaagactaacctggcggcagcgcaaaagatg

SEQ ID NO: 107588 - DNA, 103 bp, Artificial Sequence
  Synthetic Polynucleotide
taatacgactcactatagggcttgccagggatgagctgaaaaagtcttgaaacagaggagatcaagaatgtttcagctcaacctggcggcagcgcaaaagatg

SEQ ID NO: 107589 - DNA, 103 bp, Artificial Sequence
  Synthetic Polynucleotide
taatacgactcactatagggtaggctggggcttgccagggatgagctgaaaacagaggagattcagcatgtccctggcaaacctggcggcagcgcaaaagatg

SEQ ID NO: 107590 - DNA, 103 bp, Artificial Sequence
  Synthetic Polynucleotide
taatacgactcactatagggctacctgcttgcgcaaatcctctggagtgtaacagaggagaacactcatgaggatttgcaacctggcggcagcgcaaaagatg

SEQ ID NO: 107591 - DNA, 103 bp, Artificial Sequence
  Synthetic Polynucleotide
taatacgactcactatagggaagccaggggtaggctggggcttgccagggaacagaggagaccctggatggccccagccaacctggcggcagcgcaaaagatg

SEQ ID NO: 107592 - DNA, 103 bp, Artificial Sequence
  Synthetic Polynucleotide
taatacgactcactatagggtttcctgtagaagccaggggtaggctggggaacagaggagaccccagatgacccctggcaacctggcggcagcgcaaaagatg

SEQ ID NO: 107593 - DNA, 103 bp, Artificial Sequence
  Synthetic Polynucleotide
taatacgactcactatagggtagtgcaaattttcctgtagaagccaggggaacagaggagacccctgatgtctacaggaaacctggcggcagcgcaaaagatg

SEQ ID NO: 107594 - DNA, 103 bp, Artificial Sequence
  Synthetic Polynucleotide
taatacgactcactataggggaagagagtttagtgcaaattttcctgtagaacagaggagactacagatgaatttgcacaacctggcggcagcgcaaaagatg

SEQ ID NO: 107595 - DNA, 103 bp, Artificial Sequence
  Synthetic Polynucleotide
taatacgactcactatagggtgccgctggagaagagagtttagtgcaaataacagaggagaatttgcatgaaactctctaacctggcggcagcgcaaaagatg

SEQ ID NO: 107596 - DNA, 103 bp, Artificial Sequence
  Synthetic Polynucleotide
taatacgactcactatagggctgcattagctgccgctggagaagagagttaacagaggagaaactctatgctccagcggaacctggcggcagcgcaaaagatg

SEQ ID NO: 107597 - DNA, 103 bp, Artificial Sequence
  Synthetic Polynucleotide
taatacgactcactatagggagtagaaggactgcattagctgccgctggaaacagaggagatccagcatgagctaatgcaacctggcggcagcgcaaaagatg

SEQ ID NO: 107598 - DNA, 103 bp, Artificial Sequence
  Synthetic Polynucleotide
taatacgactcactatagggatagccttggagtagaaggactgcattagcaacagaggagagctaatatggtccttctaaacctggcggcagcgcaaaagatg

SEQ ID NO: 107599 - DNA, 103 bp, Artificial Sequence
  Synthetic Polynucleotide
taatacgactcactatagggggcttcctgcatagccttggagtagaaggaaacagaggagatccttcatgtccaaggctaacctggcggcagcgcaaaagatg

SEQ ID NO: 107600 - DNA, 103 bp, Artificial Sequence
  Synthetic Polynucleotide
taatacgactcactatagggttgtgcttccggcttcctgcatagccttggaacagaggagaccaaggatgtgcaggaagaacctggcggcagcgcaaaagatg

SEQ ID NO: 107601 - DNA, 103 bp, Artificial Sequence
  Synthetic Polynucleotide
taatacgactcactatagggagcagcggcgctacctgcttgcgcaaatccaacagaggagaggatttatgcaagcaggtaacctggcggcagcgcaaaagatg

SEQ ID NO: 107602 - DNA, 103 bp, Artificial Sequence
  Synthetic Polynucleotide
taatacgactcactatagggaaaatcatgcttgtgcttccggcttcctgcaacagaggagagcaggaatgcggaagcacaacctggcggcagcgcaaaagatg

SEQ ID NO: 107603 - DNA, 103 bp, Artificial Sequence
  Synthetic Polynucleotide
taatacgactcactatagggacctgttgaaaaaatcatgcttgtgcttccaacagaggagaggaagcatgagcatgattaacctggcggcagcgcaaaagatg

SEQ ID NO: 107604 - DNA, 103 bp, Artificial Sequence
  Synthetic Polynucleotide
taatacgactcactatagggtgctgtatggacctgttgaaaaaatcatgcaacagaggagagcatgaatgtttcaacagaacctggcggcagcgcaaaagatg

SEQ ID NO: 107605 - DNA, 103 bp, Artificial Sequence
  Synthetic Polynucleotide
taatacgactcactatagggatggagtttgtgctgtatggacctgttgaaaacagaggagattcaacatgtccatacagaacctggcggcagcgcaaaagatg

SEQ ID NO: 107606 - DNA, 103 bp, Artificial Sequence
  Synthetic Polynucleotide
taatacgactcactatagggttgggaagatatggagtttgtgctgtatggaacagaggagaccatacatgacaaactccaacctggcggcagcgcaaaagatg

SEQ ID NO: 107607 - DNA, 103 bp, Artificial Sequence
  Synthetic Polynucleotide
taatacgactcactataggggtaatggactttgggaagatatggagtttgaacagaggagacaaactatgtatcttcccaacctggcggcagcgcaaaagatg

SEQ ID NO: 107608 - DNA, 103 bp, Artificial Sequence
  Synthetic Polynucleotide
taatacgactcactataggggggctttgttgtaatggactttgggaagataacagaggagaatcttcatgaagtccattaacctggcggcagcgcaaaagatg

SEQ ID NO: 107609 - DNA, 103 bp, Artificial Sequence
  Synthetic Polynucleotide
taatacgactcactatagggattgacatctgggctttgttgtaatggactaacagaggagaagtccaatgcaacaaagcaacctggcggcagcgcaaaagatg

SEQ ID NO: 107610 - DNA, 103 bp, Artificial Sequence
  Synthetic Polynucleotide
taatacgactcactataggggggccatgccattgacatctgggctttgttaacagaggagaaacaaaatgcagatgtcaaacctggcggcagcgcaaaagatg

SEQ ID NO: 107611 - DNA, 103 bp, Artificial Sequence
  Synthetic Polynucleotide
taatacgactcactatagggctgggggatggggccatgccattgacatctaacagaggagaagatgtatgtggcatggcaacctggcggcagcgcaaaagatg

SEQ ID NO: 107612 - DNA, 103 bp, Artificial Sequence
  Synthetic Polynucleotide
taatacgactcactataggggaaactcttcagcagcggcgctacctgcttaacagaggagaaagcagatggcgccgctgaacctggcggcagcgcaaaagatg

SEQ ID NO: 107613 - DNA, 103 bp, Artificial Sequence
  Synthetic Polynucleotide
taatacgactcactatagggttctgactggctgggggatggggccatgccaacagaggagaggcatgatgccatcccccaacctggcggcagcgcaaaagatg

SEQ ID NO: 107614 - DNA, 103 bp, Artificial Sequence
  Synthetic Polynucleotide
taatacgactcactatagggtcccagcactttctgactggctgggggatgaacagaggagacatcccatggccagtcagaacctggcggcagcgcaaaagatg

SEQ ID NO: 107615 - DNA, 103 bp, Artificial Sequence
  Synthetic Polynucleotide
taatacgactcactatagggtcggagacgctcccagcactttctgactggaacagaggagaccagtcatgaagtgctggaacctggcggcagcgcaaaagatg

SEQ ID NO: 107616 - DNA, 103 bp, Artificial Sequence
  Synthetic Polynucleotide
taatacgactcactatagggctcctcgccctcggagacgctcccagcactaacagaggagaagtgctatgagcgtctccaacctggcggcagcgcaaaagatg

SEQ ID NO: 107617 - DNA, 103 bp, Artificial Sequence
  Synthetic Polynucleotide
taatacgactcactatagggcagtgtccatctcctcgccctcggagacgcaacagaggagagcgtctatgagggcgaggaacctggcggcagcgcaaaagatg

SEQ ID NO: 107618 - DNA, 103 bp, Artificial Sequence
  Synthetic Polynucleotide
taatacgactcactataggggcgatttctgcagtgtccatctcctcgcccaacagaggagagggcgaatggatggacacaacctggcggcagcgcaaaagatg

SEQ ID NO: 107619 - DNA, 103 bp, Artificial Sequence
  Synthetic Polynucleotide
taatacgactcactataggggacctgccgggcgatttctgcagtgtccataacagaggagaatggacatggcagaaatcaacctggcggcagcgcaaaagatg

SEQ ID NO: 107620 - DNA, 103 bp, Artificial Sequence
  Synthetic Polynucleotide
taatacgactcactataggggctgctctttgacctgccgggcgatttctgaacagaggagacagaaaatgcccggcaggaacctggcggcagcgcaaaagatg

SEQ ID NO: 107621 - DNA, 103 bp, Artificial Sequence
  Synthetic Polynucleotide
taatacgactcactatagggtgcttaatcagctgctctttgacctgccggaacagaggagaccggcaatgcaaagagcaaacctggcggcagcgcaaaagatg

SEQ ID NO: 107622 - DNA, 103 bp, Artificial Sequence
  Synthetic Polynucleotide
taatacgactcactatagggtccgatattgtgcttaatcagctgctctttaacagaggagaaaagagatgctgattaagaacctggcggcagcgcaaaagatg

SEQ ID NO: 107623 - DNA, 103 bp, Artificial Sequence
  Synthetic Polynucleotide
taatacgactcactatagggtctctccttggaaactcttcagcagcggcgaacagaggagacgccgcatgtgaagagttaacctggcggcagcgcaaaagatg

SEQ ID NO: 107624 - DNA, 103 bp, Artificial Sequence
  Synthetic Polynucleotide
taatacgactcactatagggaaatacgttgtccgatattgtgcttaatcaaacagaggagatgattaatgacaatatcgaacctggcggcagcgcaaaagatg

SEQ ID NO: 107625 - DNA, 103 bp, Artificial Sequence
  Synthetic Polynucleotide
taatacgactcactatagggtaatgtccgaaaatacgttgtccgatattgaacagaggagacaatatatgacaacgtataacctggcggcagcgcaaaagatg

SEQ ID NO: 107626 - DNA, 103 bp, Artificial Sequence
  Synthetic Polynucleotide
taatacgactcactatagggtcccaacacataatgtccgaaaatacgttgaacagaggagacaacgtatgttcggacataacctggcggcagcgcaaaagatg

SEQ ID NO: 107627 - DNA, 103 bp, Artificial Sequence
  Synthetic Polynucleotide
taatacgactcactatagggcttgagacagtcccaacacataatgtccgaaacagaggagatcggacatgatgtgttggaacctggcggcagcgcaaaagatg

SEQ ID NO: 107628 - DNA, 103 bp, Artificial Sequence
  Synthetic Polynucleotide
taatacgactcactatagggctcacggacccttgagacagtcccaacacaaacagaggagatgtgttatgactgtctcaaacctggcggcagcgcaaaagatg

SEQ ID NO: 107629 - DNA, 103 bp, Artificial Sequence
  Synthetic Polynucleotide
taatacgactcactatagggcagaatctcgctcacggacccttgagacagaacagaggagactgtctatggggtccgtgaacctggcggcagcgcaaaagatg

SEQ ID NO: 107630 - DNA, 103 bp, Artificial Sequence
  Synthetic Polynucleotide
taatacgactcactatagggtgggccgggccagaatctcgctcacggaccaacagaggagaggtccgatggcgagattcaacctggcggcagcgcaaaagatg

SEQ ID NO: 107631 - DNA, 103 bp, Artificial Sequence
  Synthetic Polynucleotide
taatacgactcactatagggttccatggcttgggccgggccagaatctcgaacagaggagacgagatatgggcccggccaacctggcggcagcgcaaaagatg

SEQ ID NO: 107632 - DNA, 103 bp, Artificial Sequence
  Synthetic Polynucleotide
taatacgactcactatagggagtcagtttattccatggcttgggccgggcaacagaggagagcccggatgaagccatggaacctggcggcagcgcaaaagatg

SEQ ID NO: 107633 - DNA, 103 bp, Artificial Sequence
  Synthetic Polynucleotide
taatacgactcactatagggtgccacgaacagtcagtttattccatggctaacagaggagaagccatatgataaactgaaacctggcggcagcgcaaaagatg

SEQ ID NO: 107634 - DNA, 103 bp, Artificial Sequence
  Synthetic Polynucleotide
taatacgactcactatagggagtgcatcaatctctccttggaaactcttcaacagaggagagaagagatgccaaggagaaacctggcggcagcgcaaaagatg

SEQ ID NO: 107635 - DNA, 103 bp, Artificial Sequence
  Synthetic Polynucleotide
taatacgactcactatagggaatggctccttgccacgaacagtcagtttaaacagaggagataaactatgtgttcgtggaacctggcggcagcgcaaaagatg

SEQ ID NO: 107636 - DNA, 103 bp, Artificial Sequence
  Synthetic Polynucleotide
taatacgactcactatagggcatcttgtgaaatggctccttgccacgaacaacagaggagagttcgtatgaaggagccaaacctggcggcagcgcaaaagatg

SEQ ID NO: 107637 - DNA, 103 bp, Artificial Sequence
  Synthetic Polynucleotide
taatacgactcactatagggggaactgtttcatcttgtgaaatggctcctaacagaggagaaggagcatgttcacaagaaacctggcggcagcgcaaaagatg

SEQ ID NO: 107638 - DNA, 103 bp, Artificial Sequence
  Synthetic Polynucleotide
taatacgactcactatagggtcatcggagaggaactgtttcatcttgtgaaacagaggagatcacaaatggaaacagttaacctggcggcagcgcaaaagatg

SEQ ID NO: 107639 - DNA, 103 bp, Artificial Sequence
  Synthetic Polynucleotide
taatacgactcactataggggatgttctgctcatcggagaggaactgtttaacagaggagaaaacagatgctctccgataacctggcggcagcgcaaaagatg

SEQ ID NO: 107640 - DNA, 103 bp, Artificial Sequence
  Synthetic Polynucleotide
taatacgactcactatagggggagggccaggatgttctgctcatcggagaaacagaggagatctccgatgagcagaacaaacctggcggcagcgcaaaagatg

SEQ ID NO: 107641 - DNA, 103 bp, Artificial Sequence
  Synthetic Polynucleotide
taatacgactcactatagggtggatgctacggagggccaggatgttctgcaacagaggagagcagaaatgcctggccctaacctggcggcagcgcaaaagatg

SEQ ID NO: 107642 - DNA, 103 bp, Artificial Sequence
  Synthetic Polynucleotide
taatacgactcactatagggttgtctgccttggatgctacggagggccagaacagaggagactggccatgcgtagcatcaacctggcggcagcgcaaaagatg

SEQ ID NO: 107643 - DNA, 103 bp, Artificial Sequence
  Synthetic Polynucleotide
taatacgactcactataggggattctctctttgtctgccttggatgctacaacagaggagagtagcaatgaaggcagacaacctggcggcagcgcaaaagatg

SEQ ID NO: 107644 - DNA, 103 bp, Artificial Sequence
  Synthetic Polynucleotide
taatacgactcactatagggctctggcctggattctctctttgtctgcctaacagaggagaaggcagatgaagagagaaaacctggcggcagcgcaaaagatg

SEQ ID NO: 107645 - DNA, 103 bp, Artificial Sequence
  Synthetic Polynucleotide
taatacgactcactatagggtcttttactcagtgcatcaatctctccttgaacagaggagacaaggaatgattgatgcaaacctggcggcagcgcaaaagatg

SEQ ID NO: 107646 - DNA, 103 bp, Artificial Sequence
  Synthetic Polynucleotide
taatacgactcactatagggtctgttcaggctctggcctggattctctctaacagaggagaagagagatgccaggccagaacctggcggcagcgcaaaagatg

SEQ ID NO: 107647 - DNA, 103 bp, Artificial Sequence
  Synthetic Polynucleotide
taatacgactcactatagggcctgaaatagtctgttcaggctctggcctgaacagaggagacaggccatggcctgaacaaacctggcggcagcgcaaaagatg

SEQ ID NO: 107648 - DNA, 103 bp, Artificial Sequence
  Synthetic Polynucleotide
taatacgactcactatagggttcggtacttcctgaaatagtctgttcaggaacagaggagacctgaaatgactatttcaaacctggcggcagcgcaaaagatg

SEQ ID NO: 107649 - DNA, 103 bp, Artificial Sequence
  Synthetic Polynucleotide
taatacgactcactatagggatttcttcgtttcggtacttcctgaaatagaacagaggagactatttatggaagtaccgaacctggcggcagcgcaaaagatg

SEQ ID NO: 107650 - DNA, 103 bp, Artificial Sequence
  Synthetic Polynucleotide
taatacgactcactatagggcttcagacccatttcttcgtttcggtacttaacagaggagaaagtacatgaacgaagaaaacctggcggcagcgcaaaagatg

SEQ ID NO: 107651 - DNA, 103 bp, Artificial Sequence
  Synthetic Polynucleotide
taatacgactcactataggggtgatgttaccttcagacccatttcttcgtaacagaggagaacgaagatgtgggtctgaaacctggcggcagcgcaaaagatg

SEQ ID NO: 107652 - DNA, 103 bp, Artificial Sequence
  Synthetic Polynucleotide
taatacgactcactataggggatccgggtggtgatgttaccttcagacccaacagaggagagggtctatgggtaacatcaacctggcggcagcgcaaaagatg

SEQ ID NO: 107653 - DNA, 103 bp, Artificial Sequence
  Synthetic Polynucleotide
taatacgactcactatagggccgaggctcggatccgggtggtgatgttacaacagaggagagtaacaatgccacccggaaacctggcggcagcgcaaaagatg

SEQ ID NO: 107654 - DNA, 103 bp, Artificial Sequence
  Synthetic Polynucleotide
taatacgactcactataggggagccagtctccgaggctcggatccgggtgaacagaggagacacccgatgccgagcctcaacctggcggcagcgcaaaagatg

SEQ ID NO: 107655 - DNA, 103 bp, Artificial Sequence
  Synthetic Polynucleotide
taatacgactcactatagggggcttcatcagagccagtctccgaggctcgaacagaggagacgagccatggagactggcaacctggcggcagcgcaaaagatg

SEQ ID NO: 107656 - DNA, 103 bp, Artificial Sequence
  Synthetic Polynucleotide
taatacgactcactatagggcgagttctctcttcaacctggctccggctaaacagaggagatagccgatgccaggttgaaacctggcggcagcgcaaaagatg

SEQ ID NO: 107657 - DNA, 103 bp, Artificial Sequence
  Synthetic Polynucleotide
taatacgactcactatagggcttccttgcttcttttactcagtgcatcaaaacagaggagattgatgatgtgagtaaaaaacctggcggcagcgcaaaagatg

SEQ ID NO: 107658 - DNA, 103 bp, Artificial Sequence
  Synthetic Polynucleotide
taatacgactcactatagggtggacttgatggcttcatcagagccagtctaacagaggagaagactgatgctgatgaagaacctggcggcagcgcaaaagatg

SEQ ID NO: 107659 - DNA, 103 bp, Artificial Sequence
  Synthetic Polynucleotide
taatacgactcactatagggtgctctaggatggacttgatggcttcatcaaacagaggagatgatgaatgcatcaagtcaacctggcggcagcgcaaaagatg

SEQ ID NO: 107660 - DNA, 103 bp, Artificial Sequence
  Synthetic Polynucleotide
taatacgactcactatagggcctcttggcttgctctaggatggacttgataacagaggagaatcaagatgatcctagagaacctggcggcagcgcaaaagatg

SEQ ID NO: 107661 - DNA, 103 bp, Artificial Sequence
  Synthetic Polynucleotide
taatacgactcactatagggcttggagctccctcttggcttgctctaggaaacagaggagatcctagatgaagccaagaaacctggcggcagcgcaaaagatg

SEQ ID NO: 107662 - DNA, 103 bp, Artificial Sequence
  Synthetic Polynucleotide
taatacgactcactataggggttttctgcacttggagctccctcttggctaacagaggagaagccaaatgggagctccaaacctggcggcagcgcaaaagatg

SEQ ID NO: 107663 - DNA, 103 bp, Artificial Sequence
  Synthetic Polynucleotide
taatacgactcactatagggcggctctgcagttttctgcacttggagctcaacagaggagagagctcatggtgcagaaaaacctggcggcagcgcaaaagatg

SEQ ID NO: 107664 - DNA, 103 bp, Artificial Sequence
  Synthetic Polynucleotide
taatacgactcactatagggaaggctgggccggctctgcagttttctgcaaacagaggagatgcagaatgctgcagagcaacctggcggcagcgcaaaagatg

SEQ ID NO: 107665 - DNA, 103 bp, Artificial Sequence
  Synthetic Polynucleotide
taatacgactcactataggggatgcggaggaaggctgggccggctctgcaaacagaggagatgcagaatgggcccagccaacctggcggcagcgcaaaagatg

SEQ ID NO: 107666 - DNA, 103 bp, Artificial Sequence
  Synthetic Polynucleotide
taatacgactcactatagggcccgctgccggatgcggaggaaggctgggcaacagaggagagcccagatgtcctccgcaaacctggcggcagcgcaaaagatg

SEQ ID NO: 107667 - DNA, 103 bp, Artificial Sequence
  Synthetic Polynucleotide
taatacgactcactatagggcatcagagttcccgctgccggatgcggaggaacagaggagacctccgatgccggcagcgaacctggcggcagcgcaaaagatg

SEQ ID NO: 107668 - DNA, 103 bp, Artificial Sequence
  Synthetic Polynucleotide
taatacgactcactataggggctgcttcagcttccttgcttcttttactcaacagaggagagagtaaatgaagcaaggaaacctggcggcagcgcaaaagatg

SEQ ID NO: 107669 - DNA, 103 bp, Artificial Sequence
  Synthetic Polynucleotide
taatacgactcactatagggcggatggcgtcatcagagttcccgctgccgaacagaggagacggcagatggaactctgaaacctggcggcagcgcaaaagatg

SEQ ID NO: 107670 - DNA, 103 bp, Artificial Sequence
  Synthetic Polynucleotide
taatacgactcactatagggcaggatggagcggatggcgtcatcagagttaacagaggagaaactctatggacgccatcaacctggcggcagcgcaaaagatg

SEQ ID NO: 107671 - DNA, 103 bp, Artificial Sequence
  Synthetic Polynucleotide
taatacgactcactataggggggcttgctgcaggatggagcggatggcgtaacagaggagaacgccaatggctccatccaacctggcggcagcgcaaaagatg

SEQ ID NO: 107672 - DNA, 103 bp, Artificial Sequence
  Synthetic Polynucleotide
taatacgactcactatagggatctcccggcgggcttgctgcaggatggagaacagaggagactccatatggcagcaagcaacctggcggcagcgcaaaagatg

SEQ ID NO: 107673 - DNA, 103 bp, Artificial Sequence
  Synthetic Polynucleotide
taatacgactcactatagggctgggcctccatctcccggcgggcttgctgaacagaggagacagcaaatgcgccgggagaacctggcggcagcgcaaaagatg

SEQ ID NO: 107674 - DNA, 103 bp, Artificial Sequence
  Synthetic Polynucleotide
taatacgactcactataggggggcagcctgctgggcctccatctcccggcaacagaggagagccgggatgtggaggcccaacctggcggcagcgcaaaagatg

SEQ ID NO: 107675 - DNA, 103 bp, Artificial Sequence
  Synthetic Polynucleotide
taatacgactcactataggggcagggtcgagggcagcctgctgggcctccaacagaggagaggaggcatggcaggctgcaacctggcggcagcgcaaaagatg

SEQ ID NO: 107676 - DNA, 103 bp, Artificial Sequence
  Synthetic Polynucleotide
taatacgactcactatagggctgctttaaggcagggtcgagggcagcctgaacagaggagacaggctatgctcgaccctaacctggcggcagcgcaaaagatg

SEQ ID NO: 107677 - DNA, 103 bp, Artificial Sequence
  Synthetic Polynucleotide
taatacgactcactatagggacagtggtgcctgctttaaggcagggtcgaaacagaggagatcgaccatgccttaaagcaacctggcggcagcgcaaaagatg

SEQ ID NO: 107678 - DNA, 103 bp, Artificial Sequence
  Synthetic Polynucleotide
taatacgactcactatagggtcactctgggacagtggtgcctgctttaagaacagaggagacttaaaatgggcaccactaacctggcggcagcgcaaaagatg

SEQ ID NO: 107679 - DNA, 103 bp, Artificial Sequence
  Synthetic Polynucleotide
taatacgactcactatagggattcaagaaagctgcttcagcttccttgctaacagaggagaagcaagatggctgaagcaaacctggcggcagcgcaaaagatg

SEQ ID NO: 107680 - DNA, 103 bp, Artificial Sequence
  Synthetic Polynucleotide
taatacgactcactataggggatggtgatgtcactctgggacagtggtgcaacagaggagagcaccaatgtcccagagtaacctggcggcagcgcaaaagatg

SEQ ID NO: 107681 - DNA, 103 bp, Artificial Sequence
  Synthetic Polynucleotide
taatacgactcactatagggtgggggtgaggatggtgatgtcactctgggaacagaggagacccagaatgacatcaccaaacctggcggcagcgcaaaagatg

SEQ ID NO: 107682 - DNA, 103 bp, Artificial Sequence
  Synthetic Polynucleotide
taatacgactcactataggggacagaagcttgggggtgaggatggtgatgaacagaggagacatcacatgcctcaccccaacctggcggcagcgcaaaagatg

SEQ ID NO: 107683 - DNA, 103 bp, Artificial Sequence
  Synthetic Polynucleotide
taatacgactcactataggggggcgaggtggacagaagcttgggggtgagaacagaggagactcaccatgaagcttctgaacctggcggcagcgcaaaagatg

SEQ ID NO: 107684 - DNA, 103 bp, Artificial Sequence
  Synthetic Polynucleotide
taatacgactcactatagggcggtgggcatgggcgaggtggacagaagctaacagaggagaagcttcatgccacctcgcaacctggcggcagcgcaaaagatg

SEQ ID NO: 107685 - DNA, 103 bp, Artificial Sequence
  Synthetic Polynucleotide
taatacgactcactatagggtagctggacacggtgggcatgggcgaggtgaacagaggagacacctcatgcatgcccacaacctggcggcagcgcaaaagatg

SEQ ID NO: 107686 - DNA, 103 bp, Artificial Sequence
  Synthetic Polynucleotide
taatacgactcactataggggagaggtgggtagctggacacggtgggcataacagaggagaatgcccatggtgtccagcaacctggcggcagcgcaaaagatg

SEQ ID NO: 107687 - DNA, 103 bp, Artificial Sequence
  Synthetic Polynucleotide
taatacgactcactataggggggagatggcgagaggtgggtagctggacaaacagaggagatgtccaatgacccacctcaacctggcggcagcgcaaaagatg

SEQ ID NO: 107688 - DNA, 103 bp, Artificial Sequence
  Synthetic Polynucleotide
taatacgactcactatagggggcttcttcagggagatggcgagaggtgggaacagaggagacccaccatgcgccatctcaacctggcggcagcgcaaaagatg

SEQ ID NO: 107689 - DNA, 103 bp, Artificial Sequence
  Synthetic Polynucleotide
taatacgactcactatagggagctgcggagggcttcttcagggagatggcaacagaggagagccatcatgctgaagaagaacctggcggcagcgcaaaagatg

SEQ ID NO: 107690 - DNA, 103 bp, Artificial Sequence
  Synthetic Polynucleotide
taatacgactcactatagggttttgtagacattcaagaaagctgcttcagaacagaggagactgaagatgctttcttgaaacctggcggcagcgcaaaagatg

SEQ ID NO: 107691 - DNA, 103 bp, Artificial Sequence
  Synthetic Polynucleotide
taatacgactcactatagggcggcctcaggagctgcggagggcttcttcaaacagaggagatgaagaatgcctccgcagaacctggcggcagcgcaaaagatg

SEQ ID NO: 107692 - DNA, 103 bp, Artificial Sequence
  Synthetic Polynucleotide
taatacgactcactataggggcagaggcaccggcctcaggagctgcggagaacagaggagactccgcatgtcctgaggcaacctggcggcagcgcaaaagatg

SEQ ID NO: 107693 - DNA, 103 bp, Artificial Sequence
  Synthetic Polynucleotide
taatacgactcactataggggttcggcagagcagaggcaccggcctcaggaacagaggagacctgagatgggtgcctctaacctggcggcagcgcaaaagatg

SEQ ID NO: 107694 - DNA, 103 bp, Artificial Sequence
  Synthetic Polynucleotide
taatacgactcactataggggggccggggggttcggcagagcagaggcacaacagaggagagtgcctatgctctgccgaaacctggcggcagcgcaaaagatg

SEQ ID NO: 107695 - DNA, 103 bp, Artificial Sequence
  Synthetic Polynucleotide
taatacgactcactatagggtcctttttgagggccggggggttcggcagaaacagaggagatctgccatgccccccggcaacctggcggcagcgcaaaagatg

SEQ ID NO: 107696 - DNA, 103 bp, Artificial Sequence
  Synthetic Polynucleotide
taatacgactcactataggggtcctgggcctcctttttgagggccgggggaacagaggagacccccgatgctcaaaaagaacctggcggcagcgcaaaagatg

SEQ ID NO: 107697 - DNA, 103 bp, Artificial Sequence
  Synthetic Polynucleotide
taatacgactcactataggggcccgggggcgtcctgggcctcctttttgaaacagaggagatcaaaaatgaggcccaggaacctggcggcagcgcaaaagatg

SEQ ID NO: 107698 - DNA, 103 bp, Artificial Sequence
  Synthetic Polynucleotide
taatacgactcactatagggtgggggtccagcccgggggcgtcctgggccaacagaggagaggcccaatgcgcccccggaacctggcggcagcgcaaaagatg

SEQ ID NO: 107699 - DNA, 103 bp, Artificial Sequence
  Synthetic Polynucleotide
taatacgactcactatagggggctgctccctgggggtccagcccgggggcaacagaggagagcccccatgctggaccccaacctggcggcagcgcaaaagatg

SEQ ID NO: 107700 - DNA, 103 bp, Artificial Sequence
  Synthetic Polynucleotide
taatacgactcactataggggtgcacaatcggctgctccctgggggtccaaacagaggagatggaccatgagggagcagaacctggcggcagcgcaaaagatg

SEQ ID NO: 107701 - DNA, 103 bp, Artificial Sequence
  Synthetic Polynucleotide
taatacgactcactatagggtcaatcaatcttttgtagacattcaagaaaaacagaggagatttcttatgtgtctacaaaacctggcggcagcgcaaaagatg

SEQ ID NO: 107702 - DNA, 103 bp, Artificial Sequence
  Synthetic Polynucleotide
taatacgactcactatagggaggaccccttgtgcacaatcggctgctcccaacagaggagagggagcatgcgattgtgcaacctggcggcagcgcaaaagatg

SEQ ID NO: 107703 - DNA, 103 bp, Artificial Sequence
  Synthetic Polynucleotide
taatacgactcactatagggcacctgtctcaggaccccttgtgcacaatcaacagaggagagattgtatgcaaggggtcaacctggcggcagcgcaaaagatg

SEQ ID NO: 107704 - DNA, 103 bp, Artificial Sequence
  Synthetic Polynucleotide
taatacgactcactatagggcctcatttttcacctgtctcaggaccccttaacagaggagaaaggggatgtgagacaggaacctggcggcagcgcaaaagatg

SEQ ID NO: 107705 - DNA, 103 bp, Artificial Sequence
  Synthetic Polynucleotide
taatacgactcactatagggctgcggcccacctcatttttcacctgtctcaacagaggagagagacaatggaaaaatgaaacctggcggcagcgcaaaagatg

SEQ ID NO: 107706 - DNA, 103 bp, Artificial Sequence
  Synthetic Polynucleotide
taatacgactcactatagggccaggcaccgctgcggcccacctcatttttaacagaggagaaaaaatatggtgggccgcaacctggcggcagcgcaaaagatg

SEQ ID NO: 107707 - DNA, 103 bp, Artificial Sequence
  Synthetic Polynucleotide
taatacgactcactatagggagtggtccttccaggcaccgctgcggcccaaacagaggagatgggccatggcggtgcctaacctggcggcagcgcaaaagatg

SEQ ID NO: 107708 - DNA, 103 bp, Artificial Sequence
  Synthetic Polynucleotide
taatacgactcactataggggcgctccaccagtggtccttccaggcaccgaacagaggagacggtgcatggaaggaccaaacctggcggcagcgcaaaagatg

SEQ ID NO: 107709 - DNA, 103 bp, Artificial Sequence
  Synthetic Polynucleotide
taatacgactcactatagggcggctgcaccgcgctccaccagtggtccttaacagaggagaaaggacatgtggtggagcaacctggcggcagcgcaaaagatg

SEQ ID NO: 107710 - DNA, 103 bp, Artificial Sequence
  Synthetic Polynucleotide
taatacgactcactatagggttcttctctccggctgcaccgcgctccaccaacagaggagaggtggaatgcggtgcagcaacctggcggcagcgcaaaagatg

SEQ ID NO: 107711 - DNA, 103 bp, Artificial Sequence
  Synthetic Polynucleotide
taatacgactcactataggggaggcggcatttcttctctccggctgcaccaacagaggagaggtgcaatgggagagaagaacctggcggcagcgcaaaagatg

SEQ ID NO: 107712 - DNA, 103 bp, Artificial Sequence
  Synthetic Polynucleotide
taatacgactcactatagggatctgggacgtcaatcaatcttttgtagacaacagaggagagtctacatgagattgattaacctggcggcagcgcaaaagatg

SEQ ID NO: 107713 - DNA, 103 bp, Artificial Sequence
  Synthetic Polynucleotide
taatacgactcactatagggctcctcggaggaggcggcatttcttctctcaacagaggagagagagaatgaatgccgccaacctggcggcagcgcaaaagatg

SEQ ID NO: 107714 - DNA, 103 bp, Artificial Sequence
  Synthetic Polynucleotide
taatacgactcactatagggcggccttggcctcctcggaggaggcggcataacagaggagaatgccgatgcctccgaggaacctggcggcagcgcaaaagatg

SEQ ID NO: 107715 - DNA, 103 bp, Artificial Sequence
  Synthetic Polynucleotide
taatacgactcactatagggcccgtttcttcggccttggcctcctcggagaacagaggagactccgaatgggccaaggcaacctggcggcagcgcaaaagatg

SEQ ID NO: 107716 - DNA, 103 bp, Artificial Sequence
  Synthetic Polynucleotide
taatacgactcactatagggtttcccgccgcccgtttcttcggccttggcaacagaggagagccaagatggaagaaacgaacctggcggcagcgcaaaagatg

SEQ ID NO: 107717 - DNA, 103 bp, Artificial Sequence
  Synthetic Polynucleotide
taatacgactcactatagggtgcccttctctttcccgccgcccgtttcttaacagaggagaaagaaaatggcggcgggaaacctggcggcagcgcaaaagatg

SEQ ID NO: 107718 - DNA, 103 bp, Artificial Sequence
  Synthetic Polynucleotide
taatacgactcactatagggctgccaccgctgcccttctctttcccgccgaacagaggagacggcggatgagagaagggaacctggcggcagcgcaaaagatg

SEQ ID NO: 107719 - DNA, 103 bp, Artificial Sequence
  Synthetic Polynucleotide
taatacgactcactataggggccacctccgctgccaccgctgcccttctcaacagaggagagagaagatgagcggtggcaacctggcggcagcgcaaaagatg

SEQ ID NO: 107720 - DNA, 103 bp, Artificial Sequence
  Synthetic Polynucleotide
taatacgactcactataggggaggctggctgccacctccgctgccaccgcaacagaggagagcggtgatggcggaggtgaacctggcggcagcgcaaaagatg

SEQ ID NO: 107721 - DNA, 103 bp, Artificial Sequence
  Synthetic Polynucleotide
taatacgactcactatagggcgctcggcccgaggctggctgccacctccgaacagaggagacggaggatgcagccagccaacctggcggcagcgcaaaagatg

SEQ ID NO: 107722 - DNA, 103 bp, Artificial Sequence
  Synthetic Polynucleotide
taatacgactcactataggggagctgactgcgctcggcccgaggctggctaacagaggagaagccagatgcgggccgagaacctggcggcagcgcaaaagatg

SEQ ID NO: 107723 - DNA, 103 bp, Artificial Sequence
  Synthetic Polynucleotide
taatacgactcactatagggctggtacgggatctgggacgtcaatcaatcaacagaggagagattgaatgacgtcccagaacctggcggcagcgcaaaagatg

SEQ ID NO: 107724 - DNA, 103 bp, Artificial Sequence
  Synthetic Polynucleotide
taatacgactcactatagggagggtccctggagctgactgcgctcggcccaacagaggagagggccgatggcagtcagcaacctggcggcagcgcaaaagatg

SEQ ID NO: 107725 - DNA, 103 bp, Artificial Sequence
  Synthetic Polynucleotide
taatacgactcactatagggtctgacgacgagggtccctggagctgactgaacagaggagacagtcaatgccagggaccaacctggcggcagcgcaaaagatg

SEQ ID NO: 107726 - DNA, 103 bp, Artificial Sequence
  Synthetic Polynucleotide
taatacgactcactatagggcttccagtactctgacgacgagggtccctgaacagaggagacagggaatgtcgtcgtcaaacctggcggcagcgcaaaagatg

SEQ ID NO: 107727 - DNA, 103 bp, Artificial Sequence
  Synthetic Polynucleotide
taatacgactcactatagggtgggccactccttccagtactctgacgacgaacagaggagacgtcgtatgagtactggaaacctggcggcagcgcaaaagatg

SEQ ID NO: 107728 - DNA, 103 bp, Artificial Sequence
  Synthetic Polynucleotide
taatacgactcactataggggactcagcgctgggccactccttccagtacaacagaggagagtactgatgggagtggccaacctggcggcagcgcaaaagatg

SEQ ID NO: 107729 - DNA, 103 bp, Artificial Sequence
  Synthetic Polynucleotide
taatacgactcactatagggggagtatggggactcagcgctgggccactcaacagaggagagagtggatgagcgctgagaacctggcggcagcgcaaaagatg

SEQ ID NO: 107730 - DNA, 103 bp, Artificial Sequence
  Synthetic Polynucleotide
taatacgactcactatagggctgagctctgggagtatggggactcagcgcaacagaggagagcgctgatgccccatactaacctggcggcagcgcaaaagatg

SEQ ID NO: 107731 - DNA, 103 bp, Artificial Sequence
  Synthetic Polynucleotide
taatacgactcactatagggagactcagctctgagctctgggagtatgggaacagaggagacccataatgccagagctcaacctggcggcagcgcaaaagatg

SEQ ID NO: 107732 - DNA, 103 bp, Artificial Sequence
  Synthetic Polynucleotide
taatacgactcactatagggggccccggtcagactcagctctgagctctgaacagaggagacagagcatggagctgagtaacctggcggcagcgcaaaagatg

SEQ ID NO: 107733 - DNA, 103 bp, Artificial Sequence
  Synthetic Polynucleotide
taatacgactcactatagggcgctgcggctggccccggtcagactcagctaacagaggagaagctgaatgtgaccggggaacctggcggcagcgcaaaagatg

SEQ ID NO: 107734 - DNA, 103 bp, Artificial Sequence
  Synthetic Polynucleotide
taatacgactcactatagggagatccaaagctggtacgggatctgggacgaacagaggagacgtcccatgtcccgtaccaacctggcggcagcgcaaaagatg

SEQ ID NO: 107735 - DNA, 103 bp, Artificial Sequence
  Synthetic Polynucleotide
taatacgactcactatagggtgtggtgtctcgctgcggctggccccggtcaacagaggagagaccggatgcagccgcagaacctggcggcagcgcaaaagatg

SEQ ID NO: 107736 - DNA, 103 bp, Artificial Sequence
  Synthetic Polynucleotide
taatacgactcactatagggggggctgttctgtggtgtctcgctgcggctaacagaggagaagccgcatggagacaccaaacctggcggcagcgcaaaagatg

SEQ ID NO: 107737 - DNA, 103 bp, Artificial Sequence
  Synthetic Polynucleotide
taatacgactcactatagggaggatggcagggggctgttctgtggtgtctaacagaggagaagacacatgagaacagccaacctggcggcagcgcaaaagatg

SEQ ID NO: 107738 - DNA, 103 bp, Artificial Sequence
  Synthetic Polynucleotide
taatacgactcactatagggacgatcggggaggatggcagggggctgttcaacagaggagagaacagatgcctgccatcaacctggcggcagcgcaaaagatg

SEQ ID NO: 107739 - DNA, 103 bp, Artificial Sequence
  Synthetic Polynucleotide
taatacgactcactatagggggacatgggcacgatcggggaggatggcagaacagaggagactgccaatgtccccgatcaacctggcggcagcgcaaaagatg

SEQ ID NO: 107740 - DNA, 103 bp, Artificial Sequence
  Synthetic Polynucleotide
taatacgactcactatagggtggtgggcttggacatgggcacgatcggggaacagaggagaccccgaatgtgcccatgtaacctggcggcagcgcaaaagatg

SEQ ID NO: 107741 - DNA, 103 bp, Artificial Sequence
  Synthetic Polynucleotide
taatacgactcactatagggaccgagggcttggtgggcttggacatgggcaacagaggagagcccatatgcaagcccacaacctggcggcagcgcaaaagatg

SEQ ID NO: 107742 - DNA, 103 bp, Artificial Sequence
  Synthetic Polynucleotide
taatacgactcactatagggcagcggggggaccgagggcttggtgggcttaacagaggagaaagcccatgaagccctcgaacctggcggcagcgcaaaagatg

SEQ ID NO: 107743 - DNA, 103 bp, Artificial Sequence
  Synthetic Polynucleotide
taatacgactcactataggggctcgggggtcagcggggggaccgagggctaacagaggagaagccctatgtccccccgcaacctggcggcagcgcaaaagatg

SEQ ID NO: 107744 - DNA, 103 bp, Artificial Sequence
  Synthetic Polynucleotide
taatacgactcactatagggacctcgtactgctcgggggtcagcggggggaacagaggagaccccccatggacccccgaaacctggcggcagcgcaaaagatg

SEQ ID NO: 107745 - DNA, 103 bp, Artificial Sequence
  Synthetic Polynucleotide
taatacgactcactatagggttgctgtccgagatccaaagctggtacgggaacagaggagacccgtaatggctttggataacctggcggcagcgcaaaagatg

SEQ ID NO: 107746 - DNA, 103 bp, Artificial Sequence
  Synthetic Polynucleotide
taatacgactcactataggggtacatgtagacctcgtactgctcgggggtaacagaggagaacccccatgcagtacgagaacctggcggcagcgcaaaagatg

SEQ ID NO: 107747 - DNA, 103 bp, Artificial Sequence
  Synthetic Polynucleotide
taatacgactcactatagggccacctcctggtacatgtagacctcgtactaacagaggagaagtacgatgtctacatgtaacctggcggcagcgcaaaagatg

SEQ ID NO: 107748 - DNA, 103 bp, Artificial Sequence
  Synthetic Polynucleotide
taatacgactcactatagggtcgatggtgtccacctcctggtacatgtagaacagaggagactacatatgccaggaggtaacctggcggcagcgcaaaagatg

SEQ ID NO: 107749 - DNA, 103 bp, Artificial Sequence
  Synthetic Polynucleotide
taatacgactcactatagggccgggtgagctcgatggtgtccacctcctgaacagaggagacaggagatggacaccatcaacctggcggcagcgcaaaagatg

SEQ ID NO: 107750 - DNA, 103 bp, Artificial Sequence
  Synthetic Polynucleotide
taatacgactcactatagggccttaacctgccgggtgagctcgatggtgtaacagaggagaacaccaatgagctcacccaacctggcggcagcgcaaaagatg

SEQ ID NO: 107751 - DNA, 103 bp, Artificial Sequence
  Synthetic Polynucleotide
taatacgactcactataggggccagcttttccttaacctgccgggtgagcaacagaggagagctcacatggcaggttaaaacctggcggcagcgcaaaagatg

SEQ ID NO: 107752 - DNA, 103 bp, Artificial Sequence
  Synthetic Polynucleotide
taatacgactcactataggggccgttcttggccagcttttccttaacctgaacagaggagacaggttatggaaaagctgaacctggcggcagcgcaaaagatg

SEQ ID NO: 107753 - DNA, 103 bp, Artificial Sequence
  Synthetic Polynucleotide
taatacgactcactatagggtctggcagatgccgttcttggccagcttttaacagaggagaaaaagcatgccaagaacgaacctggcggcagcgcaaaagatg

SEQ ID NO: 107754 - DNA, 103 bp, Artificial Sequence
  Synthetic Polynucleotide
taatacgactcactatagggccgaagattctctggcagatgccgttcttgaacagaggagacaagaaatgcatctgccaaacctggcggcagcgcaaaagatg

SEQ ID NO: 107755 - DNA, 103 bp, Artificial Sequence
  Synthetic Polynucleotide
taatacgactcactatagggcaccttctccccgaagattctctggcagataacagaggagaatctgcatgagaatcttcaacctggcggcagcgcaaaagatg

SEQ ID NO: 107756 - DNA, 103 bp, Artificial Sequence
  Synthetic Polynucleotide
taatacgactcactatagggtgagctggagttgctgtccgagatccaaagaacagaggagactttggatgtcggacagcaacctggcggcagcgcaaaagatg

SEQ ID NO: 107757 - DNA, 103 bp, Artificial Sequence
  Synthetic Polynucleotide
taatacgactcactatagggacaggcccagcaccttctccccgaagattcaacagaggagagaatctatggggagaaggaacctggcggcagcgcaaaagatg

SEQ ID NO: 107758 - DNA, 103 bp, Artificial Sequence
  Synthetic Polynucleotide
taatacgactcactatagggctgccctgggacaggcccagcaccttctccaacagaggagaggagaaatggctgggcctaacctggcggcagcgcaaaagatg

SEQ ID NO: 107759 - DNA, 103 bp, Artificial Sequence
  Synthetic Polynucleotide
taatacgactcactataggggtcgctgacgctgccctgggacaggcccagaacagaggagactgggcatgtcccagggcaacctggcggcagcgcaaaagatg

SEQ ID NO: 107760 - DNA, 103 bp, Artificial Sequence
  Synthetic Polynucleotide
taatacgactcactataggggggacagcatgtcgctgacgctgccctgggaacagaggagacccaggatggcgtcagcgaacctggcggcagcgcaaaagatg

SEQ ID NO: 107761 - DNA, 103 bp, Artificial Sequence
  Synthetic Polynucleotide
taatacgactcactatagggggcttcggtcgggacagcatgtcgctgacgaacagaggagacgtcagatgcatgctgtcaacctggcggcagcgcaaaagatg

SEQ ID NO: 107762 - DNA, 103 bp, Artificial Sequence
  Synthetic Polynucleotide
taatacgactcactatagggcttgctccatggcttcggtcgggacagcataacagaggagaatgctgatgcgaccgaagaacctggcggcagcgcaaaagatg

SEQ ID NO: 107763 - DNA, 103 bp, Artificial Sequence
  Synthetic Polynucleotide
taatacgactcactatagggtctgcgtcagcttgctccatggcttcggtcaacagaggagagaccgaatgcatggagcaaacctggcggcagcgcaaaagatg

SEQ ID NO: 107764 - DNA, 103 bp, Artificial Sequence
  Synthetic Polynucleotide
taatacgactcactatagggtctcggcctttctgcgtcagcttgctccataacagaggagaatggagatggctgacgcaaacctggcggcagcgcaaaagatg

SEQ ID NO: 107765 - DNA, 103 bp, Artificial Sequence
  Synthetic Polynucleotide
taatacgactcactataggggatgaagggttctcggcctttctgcgtcagaacagaggagactgacgatgaaaggccgaaacctggcggcagcgcaaaagatg

SEQ ID NO: 107766 - DNA, 103 bp, Artificial Sequence
  Synthetic Polynucleotide
taatacgactcactataggggctgcatccggatgaagggttctcggccttaacagaggagaaaggccatgaacccttcaaacctggcggcagcgcaaaagatg

SEQ ID NO: 107767 - DNA, 103 bp, Artificial Sequence
  Synthetic Polynucleotide
taatacgactcactataggggcggtggcatcgagttctctcttcaacctgaacagaggagacaggttatggagagaactaacctggcggcagcgcaaaagatg

SEQ ID NO: 107768 - DNA, 103 bp, Artificial Sequence
  Synthetic Polynucleotide
taatacgactcactatagggcgctgcactttgagctggagttgctgtccgaacagaggagacggacaatgactccagctaacctggcggcagcgcaaaagatg

SEQ ID NO: 107769 - DNA, 103 bp, Artificial Sequence
  Synthetic Polynucleotide
taatacgactcactatagggttcagccagagctgcatccggatgaagggtaacagaggagaacccttatgccggatgcaaacctggcggcagcgcaaaagatg

SEQ ID NO: 107770 - DNA, 103 bp, Artificial Sequence
  Synthetic Polynucleotide
taatacgactcactatagggtagctcgccgttcagccagagctgcatccgaacagaggagacggatgatgctctggctgaacctggcggcagcgcaaaagatg

SEQ ID NO: 107771 - DNA, 103 bp, Artificial Sequence
  Synthetic Polynucleotide
taatacgactcactatagggcaccctggcctagctcgccgttcagccagaaacagaggagatctggcatgacggcgagcaacctggcggcagcgcaaaagatg

SEQ ID NO: 107772 - DNA, 103 bp, Artificial Sequence
  Synthetic Polynucleotide
taatacgactcactatagggacgggtagaacaccctggcctagctcgccgaacagaggagacggcgaatgaggccagggaacctggcggcagcgcaaaagatg

SEQ ID NO: 107773 - DNA, 103 bp, Artificial Sequence
  Synthetic Polynucleotide
taatacgactcactatagggctggccctggacgggtagaacaccctggccaacagaggagaggccagatggttctacccaacctggcggcagcgcaaaagatg

SEQ ID NO: 107774 - DNA, 103 bp, Artificial Sequence
  Synthetic Polynucleotide
taatacgactcactataggggcccttgctgctggccctggacgggtagaaaacagaggagattctacatgtccagggccaacctggcggcagcgcaaaagatg

SEQ ID NO: 107775 - DNA, 103 bp, Artificial Sequence
  Synthetic Polynucleotide
taatacgactcactatagggtggaggactggcccttgctgctggccctggaacagaggagaccagggatggcagcaaggaacctggcggcagcgcaaaagatg

SEQ ID NO: 107776 - DNA, 103 bp, Artificial Sequence
  Synthetic Polynucleotide
taatacgactcactatagggtgtcacggagtggaggactggcccttgctgaacagaggagacagcaaatgccagtcctcaacctggcggcagcgcaaaagatg

SEQ ID NO: 107777 - DNA, 103 bp, Artificial Sequence
  Synthetic Polynucleotide
taatacgactcactatagggcctggagcgatgtcacggagtggaggactgaacagaggagacagtccatgactccgtgaaacctggcggcagcgcaaaagatg

SEQ ID NO: 107778 - DNA, 103 bp, Artificial Sequence
  Synthetic Polynucleotide
taatacgactcactatagggtgcagcgggtcctggagcgatgtcacggagaacagaggagactccgtatgatcgctccaaacctggcggcagcgcaaaagatg

SEQ ID NO: 107779 - DNA, 103 bp, Artificial Sequence
  Synthetic Polynucleotide
taatacgactcactatagggatcgtgcaggcgctgcactttgagctggagaacagaggagactccagatgaaagtgcagaacctggcggcagcgcaaaagatg

SEQ ID NO: 107780 - DNA, 103 bp, Artificial Sequence
  Synthetic Polynucleotide
taatacgactcactatagggacagccctgctgcagcgggtcctggagcgaaacagaggagatcgctcatggacccgctgaacctggcggcagcgcaaaagatg

SEQ ID NO: 107781 - DNA, 103 bp, Artificial Sequence
  Synthetic Polynucleotide
taatacgactcactatagggctgagctcacacagccctgctgcagcgggtaacagaggagaacccgcatgagcagggctaacctggcggcagcgcaaaagatg

SEQ ID NO: 107782 - DNA, 103 bp, Artificial Sequence
  Synthetic Polynucleotide
taatacgactcactatagggggagtgctttctgagctcacacagccctgcaacagaggagagcagggatgtgtgagctcaacctggcggcagcgcaaaagatg

SEQ ID NO: 107783 - DNA, 103 bp, Artificial Sequence
  Synthetic Polynucleotide
taatacgactcactatagggggaggtctttggagtgctttctgagctcacaacagaggagagtgagcatggaaagcactaacctggcggcagcgcaaaagatg

SEQ ID NO: 107784 - DNA, 103 bp, Artificial Sequence
  Synthetic Polynucleotide
taatacgactcactatagggtgcagctggcggaggtctttggagtgctttaacagaggagaaaagcaatgcaaagacctaacctggcggcagcgcaaaagatg

SEQ ID NO: 107785 - DNA, 103 bp, Artificial Sequence
  Synthetic Polynucleotide
taatacgactcactatagggggggcagggctgcagctggcggaggtctttaacagaggagaaaagacatgcgccagctgaacctggcggcagcgcaaaagatg

SEQ ID NO: 107786 - DNA, 103 bp, Artificial Sequence
  Synthetic Polynucleotide
taatacgactcactatagggcggggactcaggggcagggctgcagctggcaacagaggagagccagcatgagccctgccaacctggcggcagcgcaaaagatg

SEQ ID NO: 107787 - DNA, 103 bp, Artificial Sequence
  Synthetic Polynucleotide
taatacgactcactatagggtggaactcatcggggactcaggggcagggcaacagaggagagccctgatgctgagtcccaacctggcggcagcgcaaaagatg

SEQ ID NO: 107788 - DNA, 103 bp, Artificial Sequence
  Synthetic Polynucleotide
taatacgactcactatagggaccgactcactggaactcatcggggactcaaacagaggagatgagtcatggatgagttcaacctggcggcagcgcaaaagatg

SEQ ID NO: 107789 - DNA, 103 bp, Artificial Sequence
  Synthetic Polynucleotide
taatacgactcactatagggcaggctcttcaccgactcactggaactcataacagaggagaatgagtatgagtgagtcgaacctggcggcagcgcaaaagatg

SEQ ID NO: 107790 - DNA, 103 bp, Artificial Sequence
  Synthetic Polynucleotide
taatacgactcactatagggctgtttcaatatcgtgcaggcgctgcacttaacagaggagaaagtgcatggcctgcacgaacctggcggcagcgcaaaagatg

SEQ ID NO: 107791 - DNA, 103 bp, Artificial Sequence
  Synthetic Polynucleotide
taatacgactcactatagggccagctcggtcaggctcttcaccgactcacaacagaggagagtgagtatgtgaagagccaacctggcggcagcgcaaaagatg

SEQ ID NO: 107792 - DNA, 103 bp, Artificial Sequence
  Synthetic Polynucleotide
taatacgactcactatagggggctgctggaccagctcggtcaggctcttcaacagaggagagaagagatggaccgagctaacctggcggcagcgcaaaagatg

SEQ ID NO: 107793 - DNA, 103 bp, Artificial Sequence
  Synthetic Polynucleotide
taatacgactcactatagggggggggacagggctgctggaccagctcggtaacagaggagaaccgagatggtccagcagaacctggcggcagcgcaaaagatg

SEQ ID NO: 107794 - DNA, 103 bp, Artificial Sequence
  Synthetic Polynucleotide
taatacgactcactatagggtcgcctcgatggggggacagggctgctggaaacagaggagatccagcatgcctgtccccaacctggcggcagcgcaaaagatg

SEQ ID NO: 107795 - DNA, 103 bp, Artificial Sequence
  Synthetic Polynucleotide
taatacgactcactatagggctgtccttgctcgcctcgatggggggacagaacagaggagactgtccatgcatcgaggcaacctggcggcagcgcaaaagatg

SEQ ID NO: 107796 - DNA, 103 bp, Artificial Sequence
  Synthetic Polynucleotide
taatacgactcactatagggtggtggcttgctgtccttgctcgcctcgataacagaggagaatcgagatgagcaaggacaacctggcggcagcgcaaaagatg

SEQ ID NO: 107797 - DNA, 103 bp, Artificial Sequence
  Synthetic Polynucleotide
taatacgactcactatagggcactgggctctggtggcttgctgtccttgcaacagaggagagcaaggatggcaagccacaacctggcggcagcgcaaaagatg

SEQ ID NO: 107798 - DNA, 103 bp, Artificial Sequence
  Synthetic Polynucleotide
taatacgactcactataggggctggcgggtcactgggctctggtggcttgaacagaggagacaagccatgagagcccagaacctggcggcagcgcaaaagatg

SEQ ID NO: 107799 - DNA, 103 bp, Artificial Sequence
  Synthetic Polynucleotide
taatacgactcactatagggggagtcggatgctggcgggtcactgggctcaacagaggagagagcccatggacccgccaaacctggcggcagcgcaaaagatg

SEQ ID NO: 107800 - DNA, 103 bp, Artificial Sequence
  Synthetic Polynucleotide
taatacgactcactatagggttgtgggctgggagtcggatgctggcgggtaacagaggagaacccgcatgcatccgactaacctggcggcagcgcaaaagatg

SEQ ID NO: 107801 - DNA, 103 bp, Artificial Sequence
  Synthetic Polynucleotide
taatacgactcactatagggttctggttctctgtttcaatatcgtgcaggaacagaggagacctgcaatgtattgaaacaacctggcggcagcgcaaaagatg

SEQ ID NO: 107802 - DNA, 103 bp, Artificial Sequence
  Synthetic Polynucleotide
taatacgactcactatagggggcagcggggttgtgggctgggagtcggataacagaggagaatccgaatgccagcccacaacctggcggcagcgcaaaagatg

SEQ ID NO: 107803 - DNA, 103 bp, Artificial Sequence
  Synthetic Polynucleotide
taatacgactcactatagggtccggagagaggcagcggggttgtgggctgaacagaggagacagcccatgaccccgctgaacctggcggcagcgcaaaagatg

SEQ ID NO: 107804 - DNA, 103 bp, Artificial Sequence
  Synthetic Polynucleotide
taatacgactcactataggggggccgagtgtccggagagaggcagcggggaacagaggagaccccgcatgctctctccgaacctggcggcagcgcaaaagatg

SEQ ID NO: 107805 - DNA, 103 bp, Artificial Sequence
  Synthetic Polynucleotide
taatacgactcactatagggtggatgctgagggccgagtgtccggagagaaacagaggagatctctcatgacactcggcaacctggcggcagcgcaaaagatg

SEQ ID NO: 107806 - DNA, 103 bp, Artificial Sequence
  Synthetic Polynucleotide
taatacgactcactatagggtactaattcttggatgctgagggccgagtgaacagaggagacactcgatgctcagcatcaacctggcggcagcgcaaaagatg

SEQ ID NO: 107807 - DNA, 103 bp, Artificial Sequence
  Synthetic Polynucleotide
taatacgactcactataggggggacatggctactaattcttggatgctgaaacagaggagatcagcaatgaagaattagaacctggcggcagcgcaaaagatg

SEQ ID NO: 107808 - DNA, 103 bp, Artificial Sequence
  Synthetic Polynucleotide
taatacgactcactatagggtccagctccggggacatggctactaattctaacagaggagaagaattatgagccatgtcaacctggcggcagcgcaaaagatg

SEQ ID NO: 107809 - DNA, 103 bp, Artificial Sequence
  Synthetic Polynucleotide
taatacgactcactataggggccgtaggtgtccagctccggggacatggcaacagaggagagccatgatgccggagctgaacctggcggcagcgcaaaagatg

SEQ ID NO: 107810 - DNA, 103 bp, Artificial Sequence
  Synthetic Polynucleotide
taatacgactcactataggggcttggttatgccgtaggtgtccagctccgaacagaggagacggagcatgacacctacgaacctggcggcagcgcaaaagatg

SEQ ID NO: 107811 - DNA, 103 bp, Artificial Sequence
  Synthetic Polynucleotide
taatacgactcactatagggtccttcacccgcttggttatgccgtaggtgaacagaggagacacctaatgcataaccaaaacctggcggcagcgcaaaagatg

SEQ ID NO: 107812 - DNA, 103 bp, Artificial Sequence
  Synthetic Polynucleotide
taatacgactcactatagggttccctaagtttctggttctctgtttcaataacagaggagaattgaaatggagaaccagaacctggcggcagcgcaaaagatg

SEQ ID NO: 107813 - DNA, 103 bp, Artificial Sequence
  Synthetic Polynucleotide
taatacgactcactatagggcgtcagcacctccttcacccgcttggttataacagaggagaataaccatgcgggtgaagaacctggcggcagcgcaaaagatg

SEQ ID NO: 107814 - DNA, 103 bp, Artificial Sequence
  Synthetic Polynucleotide
taatacgactcactatagggggttgttgtccgtcagcacctccttcacccaacagaggagagggtgaatgaggtgctgaaacctggcggcagcgcaaaagatg

SEQ ID NO: 107815 - DNA, 103 bp, Artificial Sequence
  Synthetic Polynucleotide
taatacgactcactatagggcgctggccgaggttgttgtccgtcagcaccaacagaggagaggtgctatgggacaacaaaacctggcggcagcgcaaaagatg

SEQ ID NO: 107816 - DNA, 103 bp, Artificial Sequence
  Synthetic Polynucleotide
taatacgactcactatagggcccaaataagcgctggccgaggttgttgtcaacagaggagagacaacatgctcggccagaacctggcggcagcgcaaaagatg

SEQ ID NO: 107817 - DNA, 103 bp, Artificial Sequence
  Synthetic Polynucleotide
taatacgactcactatagggagatggtctccccaaataagcgctggccgaaacagaggagatcggccatggcttatttgaacctggcggcagcgcaaaagatg

SEQ ID NO: 107818 - DNA, 103 bp, Artificial Sequence
  Synthetic Polynucleotide
taatacgactcactataggggtgagccctaagatggtctccccaaataagaacagaggagacttattatgggagaccataacctggcggcagcgcaaaagatg

SEQ ID NO: 107819 - DNA, 103 bp, Artificial Sequence
  Synthetic Polynucleotide
taatacgactcactatagggagagccttgggtgagccctaagatggtctcaacagaggagagagaccatgttagggctcaacctggcggcagcgcaaaagatg

SEQ ID NO: 107820 - DNA, 103 bp, Artificial Sequence
  Synthetic Polynucleotide
taatacgactcactatagggggtcagagacagagccttgggtgagccctaaacagaggagatagggcatgcccaaggctaacctggcggcagcgcaaaagatg

SEQ ID NO: 107821 - DNA, 103 bp, Artificial Sequence
  Synthetic Polynucleotide
taatacgactcactatagggcgggcaaggaggtcagagacagagccttggaacagaggagaccaaggatgtgtctctgaaacctggcggcagcgcaaaagatg

SEQ ID NO: 107822 - DNA, 103 bp, Artificial Sequence
  Synthetic Polynucleotide
taatacgactcactataggggggtttggggcgggcaaggaggtcagagacaacagaggagagtctctatgctccttgccaacctggcggcagcgcaaaagatg

SEQ ID NO: 107823 - DNA, 103 bp, Artificial Sequence
  Synthetic Polynucleotide
taatacgactcactatagggcttccagagtttccctaagtttctggttctaacagaggagaagaaccatgaacttagggaacctggcggcagcgcaaaagatg

SEQ ID NO: 107824 - DNA, 103 bp, Artificial Sequence
  Synthetic Polynucleotide
taatacgactcactataggggcttatgccagggtttggggcgggcaaggaaacagaggagatccttgatggccccaaacaacctggcggcagcgcaaaagatg

SEQ ID NO: 107825 - DNA, 103 bp, Artificial Sequence
  Synthetic Polynucleotide
taatacgactcactatagggttcagactgagcttatgccagggtttggggaacagaggagaccccaaatgctggcataaaacctggcggcagcgcaaaagatg

SEQ ID NO: 107826 - DNA, 103 bp, Artificial Sequence
  Synthetic Polynucleotide
taatacgactcactatagggctctcgtcctttcagactgagcttatgccaaacagaggagatggcatatgctcagtctgaacctggcggcagcgcaaaagatg

SEQ ID NO: 107827 - DNA, 103 bp, Artificial Sequence
  Synthetic Polynucleotide
taatacgactcactatagggggacgaagggctctcgtcctttcagactgaaacagaggagatcagtcatgaaggacgagaacctggcggcagcgcaaaagatg

SEQ ID NO: 107828 - DNA, 103 bp, Artificial Sequence
  Synthetic Polynucleotide
taatacgactcactatagggagctgcatccggacgaagggctctcgtcctaacagaggagaaggacgatggcccttcgtaacctggcggcagcgcaaaagatg

SEQ ID NO: 107829 - DNA, 103 bp, Artificial Sequence
  Synthetic Polynucleotide
taatacgactcactataggggttcagccacagctgcatccggacgaagggaacagaggagacccttcatgcggatgcagaacctggcggcagcgcaaaagatg

SEQ ID NO: 107830 - DNA, 103 bp, Artificial Sequence
  Synthetic Polynucleotide
taatacgactcactatagggtgttggggtcgttcagccacagctgcatccaacagaggagaggatgcatgtgtggctgaaacctggcggcagcgcaaaagatg

SEQ ID NO: 107831 - DNA, 103 bp, Artificial Sequence
  Synthetic Polynucleotide
taatacgactcactatagggttctccacattgttggggtcgttcagccacaacagaggagagtggctatgcgaccccaaaacctggcggcagcgcaaaagatg

SEQ ID NO: 107832 - DNA, 103 bp, Artificial Sequence
  Synthetic Polynucleotide
taatacgactcactataggggtccatcagcttctccacattgttggggtcaacagaggagagaccccatgaatgtggagaacctggcggcagcgcaaaagatg

SEQ ID NO: 107833 - DNA, 103 bp, Artificial Sequence
  Synthetic Polynucleotide
taatacgactcactatagggtccgtttcatgtccatcagcttctccacataacagaggagaatgtggatgagctgatggaacctggcggcagcgcaaaagatg

SEQ ID NO: 107834 - DNA, 103 bp, Artificial Sequence
  Synthetic Polynucleotide
taatacgactcactatagggttgttgtattcttccagagtttccctaagtaacagaggagaacttagatgaactctggaaacctggcggcagcgcaaaagatg

SEQ ID NO: 107835 - DNA, 103 bp, Artificial Sequence
  Synthetic Polynucleotide
taatacgactcactatagggttcttctccatccgtttcatgtccatcagcaacagaggagagctgatatgcatgaaacgaacctggcggcagcgcaaaagatg

SEQ ID NO: 107836 - DNA, 103 bp, Artificial Sequence
  Synthetic Polynucleotide
taatacgactcactatagggcatgtaggctttcttctccatccgtttcataacagaggagaatgaaaatgatggagaagaacctggcggcagcgcaaaagatg

SEQ ID NO: 107837 - DNA, 103 bp, Artificial Sequence
  Synthetic Polynucleotide
taatacgactcactataggggccgccgcttcatgtaggctttcttctccaaacagaggagatggagaatgaagcctacaaacctggcggcagcgcaaaagatg

SEQ ID NO: 107838 - DNA, 103 bp, Artificial Sequence
  Synthetic Polynucleotide
taatacgactcactatagggactgagctgtgccgccgcttcatgtaggctaacagaggagaagcctaatggaagcggcgaacctggcggcagcgcaaaagatg

SEQ ID NO: 107839 - DNA, 103 bp, Artificial Sequence
  Synthetic Polynucleotide
taatacgactcactataggggctgtcactgactgagctgtgccgccgcttaacagaggagaaagcggatgcacagctcaaacctggcggcagcgcaaaagatg

SEQ ID NO: 107840 - DNA, 103 bp, Artificial Sequence
  Synthetic Polynucleotide
taatacgactcactatagggcgcagggctggctgtcactgactgagctgtaacagaggagaacagctatgtcagtgacaaacctggcggcagcgcaaaagatg

SEQ ID NO: 107841 - DNA, 103 bp, Artificial Sequence
  Synthetic Polynucleotide
taatacgactcactataggggagggcggttcgcagggctggctgtcactgaacagaggagacagtgaatgccagccctgaacctggcggcagcgcaaaagatg

SEQ ID NO: 107842 - DNA, 103 bp, Artificial Sequence
  Synthetic Polynucleotide
taatacgactcactatagggggtgccgacagagggcggttcgcagggctgaacagaggagacagcccatggaaccgcccaacctggcggcagcgcaaaagatg

SEQ ID NO: 107843 - DNA, 103 bp, Artificial Sequence
  Synthetic Polynucleotide
taatacgactcactatagggggctgtactcggtgccgacagagggcggttaacagaggagaaaccgcatgctgtcggcaaacctggcggcagcgcaaaagatg

SEQ ID NO: 107844 - DNA, 103 bp, Artificial Sequence
  Synthetic Polynucleotide
taatacgactcactatagggctggcgccctggctgtactcggtgccgacaaacagaggagatgtcggatgcgagtacagaacctggcggcagcgcaaaagatg

SEQ ID NO: 107845 - DNA, 103 bp, Artificial Sequence
  Synthetic Polynucleotide
taatacgactcactatagggagcaaattccttgttgtattcttccagagtaacagaggagaactctgatggaatacaacaacctggcggcagcgcaaaagatg

SEQ ID NO: 107846 - DNA, 103 bp, Artificial Sequence
  Synthetic Polynucleotide
taatacgactcactataggggggctgggggctggcgccctggctgtactcaacagaggagagagtacatgcagggcgccaacctggcggcagcgcaaaagatg

SEQ ID NO: 107847 - DNA, 103 bp, Artificial Sequence
  Synthetic Polynucleotide
taatacgactcactataggggctggtgctggggctgggggctggcgccctaacagaggagaagggcgatggcccccagcaacctggcggcagcgcaaaagatg

SEQ ID NO: 107848 - DNA, 103 bp, Artificial Sequence
  Synthetic Polynucleotide
taatacgactcactatagggggtttcttcagctggtgctggggctgggggaacagaggagacccccaatgccagcaccaaacctggcggcagcgcaaaagatg

SEQ ID NO: 107849 - DNA, 103 bp, Artificial Sequence
  Synthetic Polynucleotide
taatacgactcactatagggcaccacccggggtttcttcagctggtgctgaacagaggagacagcacatgctgaagaaaaacctggcggcagcgcaaaagatg

SEQ ID NO: 107850 - DNA, 103 bp, Artificial Sequence
  Synthetic Polynucleotide
taatacgactcactatagggccggagccagcaccacccggggtttcttcaaacagaggagatgaagaatgcccgggtggaacctggcggcagcgcaaaagatg

SEQ ID NO: 107851 - DNA, 103 bp, Artificial Sequence
  Synthetic Polynucleotide
taatacgactcactatagggtccttctcctccggagccagcaccacccggaacagaggagaccgggtatggctggctccaacctggcggcagcgcaaaagatg

SEQ ID NO: 107852 - DNA, 103 bp, Artificial Sequence
  Synthetic Polynucleotide
taatacgactcactatagggtttcagcgcctccttctcctccggagccagaacagaggagactggctatggaggagaagaacctggcggcagcgcaaaagatg

SEQ ID NO: 107853 - DNA, 103 bp, Artificial Sequence
  Synthetic Polynucleotide
taatacgactcactataggggatacgctcgtttcagcgcctccttctcctaacagaggagaaggagaatgaggcgctgaaacctggcggcagcgcaaaagatg

SEQ ID NO: 107854 - DNA, 103 bp, Artificial Sequence
  Synthetic Polynucleotide
taatacgactcactatagggggcttttgctgatacgctcgtttcagcgccaacagaggagaggcgctatgacgagcgtaaacctggcggcagcgcaaaagatg

SEQ ID NO: 107855 - DNA, 103 bp, Artificial Sequence
  Synthetic Polynucleotide
taatacgactcactatagggtgacgggtatggcttttgctgatacgctcgaacagaggagacgagcgatgcagcaaaagaacctggcggcagcgcaaaagatg

SEQ ID NO: 107856 - DNA, 103 bp, Artificial Sequence
  Synthetic Polynucleotide
taatacgactcactatagggttttcacttcagcaaattccttgttgtattaacagaggagaaatacaatgaggaatttgaacctggcggcagcgcaaaagatg

SEQ ID NO: 107857 - DNA, 103 bp, Artificial Sequence
  Synthetic Polynucleotide
taatacgactcactatagggtggtttttggtgacgggtatggcttttgctaacagaggagaagcaaaatgcatacccgtaacctggcggcagcgcaaaagatg

SEQ ID NO: 107858 - DNA, 103 bp, Artificial Sequence
  Synthetic Polynucleotide
taatacgactcactatagggaggtcttcgatggtttttggtgacgggtataacagaggagaatacccatgaccaaaaacaacctggcggcagcgcaaaagatg

SEQ ID NO: 107859 - DNA, 103 bp, Artificial Sequence
  Synthetic Polynucleotide
taatacgactcactatagggctgggtggcgaggtcttcgatggtttttggaacagaggagaccaaaaatgatcgaagacaacctggcggcagcgcaaaagatg

SEQ ID NO: 107860 - DNA, 103 bp, Artificial Sequence
  Synthetic Polynucleotide
taatacgactcactatagggtcaggttgagctgggtggcgaggtcttcgaaacagaggagatcgaagatgtcgccacccaacctggcggcagcgcaaaagatg

SEQ ID NO: 107861 - DNA, 103 bp, Artificial Sequence
  Synthetic Polynucleotide
taatacgactcactataggggtgctggttttcaggttgagctgggtggcgaacagaggagacgccacatggctcaacctaacctggcggcagcgcaaaagatg

SEQ ID NO: 107862 - DNA, 103 bp, Artificial Sequence
  Synthetic Polynucleotide
taatacgactcactataggggttgatgacggtgctggttttcaggttgagaacagaggagactcaacatgaaaaccagcaacctggcggcagcgcaaaagatg

SEQ ID NO: 107863 - DNA, 103 bp, Artificial Sequence
  Synthetic Polynucleotide
taatacgactcactatagggtgtggaaccagttgatgacggtgctggtttaacagaggagaaaaccaatgccgtcatcaaacctggcggcagcgcaaaagatg

SEQ ID NO: 107864 - DNA, 103 bp, Artificial Sequence
  Synthetic Polynucleotide
taatacgactcactataggggacctgtagttgtggaaccagttgatgacgaacagaggagacgtcatatgctggttccaaacctggcggcagcgcaaaagatg

SEQ ID NO: 107865 - DNA, 103 bp, Artificial Sequence
  Synthetic Polynucleotide
taatacgactcactataggggcggatccgagacctgtagttgtggaaccaaacagaggagatggttcatgaactacaggaacctggcggcagcgcaaaagatg

SEQ ID NO: 107866 - DNA, 103 bp, Artificial Sequence
  Synthetic Polynucleotide
taatacgactcactatagggacagttctctgcggatccgagacctgtagtaacagaggagaactacaatgctcggatccaacctggcggcagcgcaaaagatg

SEQ ID NO: 107867 - DNA, 103 bp, Artificial Sequence
  Synthetic Polynucleotide
taatacgactcactatagggacctcttgatttttcacttcagcaaattccaacagaggagaggaattatgtgaagtgaaaacctggcggcagcgcaaaagatg

SEQ ID NO: 107868 - DNA, 103 bp, Artificial Sequence
  Synthetic Polynucleotide
taatacgactcactatagggtcctcaatgaacagttctctgcggatccgaaacagaggagatcggatatgcagagaactaacctggcggcagcgcaaaagatg

SEQ ID NO: 107869 - DNA, 103 bp, Artificial Sequence
  Synthetic Polynucleotide
taatacgactcactatagggggcctgaatttcctcaatgaacagttctctaacagaggagaagagaaatgttcattgagaacctggcggcagcgcaaaagatg

SEQ ID NO: 107870 - DNA, 103 bp, Artificial Sequence
  Synthetic Polynucleotide
taatacgactcactatagggcctgactcccggcctgaatttcctcaatgaaacagaggagatcattgatgaaattcaggaacctggcggcagcgcaaaagatg

SEQ ID NO: 107871 - DNA, 103 bp, Artificial Sequence
  Synthetic Polynucleotide
taatacgactcactatagggcccgcctggccctgactcccggcctgaattaacagaggagaaattcaatgcgggagtcaaacctggcggcagcgcaaaagatg

SEQ ID NO: 107872 - DNA, 103 bp, Artificial Sequence
  Synthetic Polynucleotide
taatacgactcactataggggtcgctggcgcccgcctggccctgactcccaacagaggagagggagtatgggccaggcgaacctggcggcagcgcaaaagatg

SEQ ID NO: 107873 - DNA, 103 bp, Artificial Sequence
  Synthetic Polynucleotide
taatacgactcactatagggccgagggtgagtcgctggcgcccgcctggcaacagaggagagccaggatggcgccagcgaacctggcggcagcgcaaaagatg

SEQ ID NO: 107874 - DNA, 103 bp, Artificial Sequence
  Synthetic Polynucleotide
taatacgactcactatagggccgctgcgggccgagggtgagtcgctggcgaacagaggagacgccagatgctcaccctcaacctggcggcagcgcaaaagatg

SEQ ID NO: 107875 - DNA, 103 bp, Artificial Sequence
  Synthetic Polynucleotide
taatacgactcactatagggcgccgcccggccgctgcgggccgagggtgaaacagaggagatcacccatggcccgcagcaacctggcggcagcgcaaaagatg

SEQ ID NO: 107876 - DNA, 103 bp, Artificial Sequence
  Synthetic Polynucleotide
taatacgactcactatagggccgagctgggcgccgcccggccgctgcgggaacagaggagacccgcaatggccgggcggaacctggcggcagcgcaaaagatg

SEQ ID NO: 107877 - DNA, 103 bp, Artificial Sequence
  Synthetic Polynucleotide
taatacgactcactatagggctgtcgccctccgagctgggcgccgcccggaacagaggagaccgggcatggcccagctcaacctggcggcagcgcaaaagatg

SEQ ID NO: 107878 - DNA, 103 bp, Artificial Sequence
  Synthetic Polynucleotide
taatacgactcactatagggcaataccgttgcggtggcatcgagttctctaacagaggagaagagaaatggatgccaccaacctggcggcagcgcaaaagatg

SEQ ID NO: 107879 - DNA, 103 bp, Artificial Sequence
  Synthetic Polynucleotide
taatacgactcactatagggttttatcgtaacctcttgatttttcacttcaacagaggagagaagtgatgaatcaagagaacctggcggcagcgcaaaagatg

SEQ ID NO: 107880 - DNA, 103 bp, Artificial Sequence
  Synthetic Polynucleotide
taatacgactcactataggggccgtcgcagctgtcgccctccgagctgggaacagaggagacccagcatggagggcgacaacctggcggcagcgcaaaagatg

SEQ ID NO: 107881 - DNA, 103 bp, Artificial Sequence
  Synthetic Polynucleotide
taatacgactcactatagggtggcctccacgccgtcgcagctgtcgccctaacagaggagaagggcgatggctgcgacgaacctggcggcagcgcaaaagatg

SEQ ID NO: 107882 - DNA, 103 bp, Artificial Sequence
  Synthetic Polynucleotide
taatacgactcactataggggggccctcagtggcctccacgccgtcgcagaacagaggagactgcgaatgcgtggaggcaacctggcggcagcgcaaaagatg

SEQ ID NO: 107883 - DNA, 103 bp, Artificial Sequence
  Synthetic Polynucleotide
taatacgactcactatagggggcgctgcctgggccctcagtggcctccacaacagaggagagtggagatgactgagggcaacctggcggcagcgcaaaagatg

SEQ ID NO: 107884 - DNA, 103 bp, Artificial Sequence
  Synthetic Polynucleotide
taatacgactcactatagggcctcggtgtcggcgctgcctgggccctcagaacagaggagactgaggatgcaggcagcgaacctggcggcagcgcaaaagatg

SEQ ID NO: 107885 - DNA, 103 bp, Artificial Sequence
  Synthetic Polynucleotide
taatacgactcactataggggacttgggctcctcggtgtcggcgctgcctaacagaggagaaggcagatgcgacaccgaaacctggcggcagcgcaaaagatg

SEQ ID NO: 107886 - DNA, 103 bp, Artificial Sequence
  Synthetic Polynucleotide
taatacgactcactatagggctctccctgagacttgggctcctcggtgtcaacagaggagagacaccatggagcccaagaacctggcggcagcgcaaaagatg

SEQ ID NO: 107887 - DNA, 103 bp, Artificial Sequence
  Synthetic Polynucleotide
taatacgactcactatagggcccgctcggcctctccctgagacttgggctaacagaggagaagcccaatgctcagggagaacctggcggcagcgcaaaagatg

SEQ ID NO: 107888 - DNA, 103 bp, Artificial Sequence
  Synthetic Polynucleotide
taatacgactcactatagggggcacctcctcccgctcggcctctccctgaaacagaggagatcagggatgggccgagcgaacctggcggcagcgcaaaagatg

SEQ ID NO: 107889 - DNA, 103 bp, Artificial Sequence
  Synthetic Polynucleotide
taatacgactcactatagggcgccggccgcggcacctcctcccgctcggcaacagaggagagccgagatggaggaggtgaacctggcggcagcgcaaaagatg

SEQ ID NO: 107890 - DNA, 103 bp, Artificial Sequence
  Synthetic Polynucleotide
taatacgactcactatagggctttaagtgcttttatcgtaacctcttgataacagaggagaatcaagatgttacgataaaacctggcggcagcgcaaaagatg

SEQ ID NO: 107891 - DNA, 103 bp, Artificial Sequence
  Synthetic Polynucleotide
taatacgactcactatagggccgtctgctccgccggccgcggcacctcctaacagaggagaaggaggatgcgcggccggaacctggcggcagcgcaaaagatg

SEQ ID NO: 107892 - DNA, 103 bp, Artificial Sequence
  Synthetic Polynucleotide
taatacgactcactatagggggcggcggctccgtctgctccgccggccgcaacagaggagagcggccatgggagcagacaacctggcggcagcgcaaaagatg

SEQ ID NO: 107893 - DNA, 103 bp, Artificial Sequence
  Synthetic Polynucleotide
taatacgactcactatagggggtccccgagggcggcggctccgtctgctcaacagaggagagagcagatggagccgccgaacctggcggcagcgcaaaagatg

SEQ ID NO: 107894 - DNA, 103 bp, Artificial Sequence
  Synthetic Polynucleotide
taatacgactcactatagggccgggcccggggtccccgagggcggcggctaacagaggagaagccgcatgcctcggggaaacctggcggcagcgcaaaagatg

SEQ ID NO: 107895 - DNA, 103 bp, Artificial Sequence
  Synthetic Polynucleotide
taatacgactcactatagggcgggcgtcgtccgggcccggggtccccgagaacagaggagactcgggatgcccgggcccaacctggcggcagcgcaaaagatg

SEQ ID NO: 107896 - DNA, 103 bp, Artificial Sequence
  Synthetic Polynucleotide
taatacgactcactataggggtcgtcgtcgcgggcgtcgtccgggcccggaacagaggagaccgggcatggacgacgccaacctggcggcagcgcaaaagatg

SEQ ID NO: 107897 - DNA, 103 bp, Artificial Sequence
  Synthetic Polynucleotide
taatacgactcactatagggctccctcgtggtcgtcgtcgcgggcgtcgtaacagaggagaacgacgatggcgacgacgaacctggcggcagcgcaaaagatg

SEQ ID NO: 107898 - DNA, 103 bp, Artificial Sequence
  Synthetic Polynucleotide
taatacgactcactatagggtccacggggcctccctcgtggtcgtcgtcgaacagaggagacgacgaatgccacgagggaacctggcggcagcgcaaaagatg

SEQ ID NO: 107899 - DNA, 103 bp, Artificial Sequence
  Synthetic Polynucleotide
taatacgactcactatagggccccgggccttccacggggcctccctcgtgaacagaggagacacgagatgggccccgtgaacctggcggcagcgcaaaagatg

SEQ ID NO: 107900 - DNA, 103 bp, Artificial Sequence
  Synthetic Polynucleotide
taatacgactcactatagggtgggcaggggccccgggccttccacggggcaacagaggagagccccgatgaaggcccggaacctggcggcagcgcaaaagatg

SEQ ID NO: 107901 - DNA, 103 bp, Artificial Sequence
  Synthetic Polynucleotide
taatacgactcactatagggcggattttctctttaagtgcttttatcgtaaacagaggagatacgatatgagcacttaaaacctggcggcagcgcaaaagatg

SEQ ID NO: 107902 - DNA, 103 bp, Artificial Sequence
  Synthetic Polynucleotide
taatacgactcactataggggaggcggggctgggcaggggccccgggcctaacagaggagaaggcccatggcccctgccaacctggcggcagcgcaaaagatg

SEQ ID NO: 107903 - DNA, 103 bp, Artificial Sequence
  Synthetic Polynucleotide
taatacgactcactatagggggcggtcgcggaggcggggctgggcaggggaacagaggagacccctgatgagccccgccaacctggcggcagcgcaaaagatg

SEQ ID NO: 107904 - DNA, 103 bp, Artificial Sequence
  Synthetic Polynucleotide
taatacgactcactataggggcgcggcggtggcggtcgcggaggcggggcaacagaggagagccccgatgccgcgaccgaacctggcggcagcgcaaaagatg

SEQ ID NO: 107905 - DNA, 103 bp, Artificial Sequence
  Synthetic Polynucleotide
taatacgactcactatagggggggccgcgggcgcggcggtggcggtcgcgaacagaggagacgcgacatgcaccgccgcaacctggcggcagcgcaaaagatg

SEQ ID NO: 107906 - DNA, 103 bp, Artificial Sequence
  Synthetic Polynucleotide
taatacgactcactatagggggcgtcctcgggggccgcgggcgcggcggtaacagaggagaaccgccatgcccgcggccaacctggcggcagcgcaaaagatg

SEQ ID NO: 107907 - DNA, 103 bp, Artificial Sequence
  Synthetic Polynucleotide
taatacgactcactatagggctgaggtagcggcgtcctcgggggccgcggaacagaggagaccgcggatgccgaggacgaacctggcggcagcgcaaaagatg

SEQ ID NO: 107908 - DNA, 103 bp, Artificial Sequence
  Synthetic Polynucleotide
taatacgactcactataggggcggcggcggctgaggtagcggcgtcctcgaacagaggagacgaggaatgcgctacctcaacctggcggcagcgcaaaagatg

SEQ ID NO: 107909 - DNA, 103 bp, Artificial Sequence
  Synthetic Polynucleotide
taatacgactcactatagggctcccccggcgcggcggcggctgaggtagcaacagaggagagctaccatggccgccgccaacctggcggcagcgcaaaagatg

SEQ ID NO: 107910 - DNA, 103 bp, Artificial Sequence
  Synthetic Polynucleotide
taatacgactcactatagggccgcggggccctcccccggcgcggcggcggaacagaggagaccgccgatgcgccgggggaacctggcggcagcgcaaaagatg

SEQ ID NO: 107911 - DNA, 103 bp, Artificial Sequence
  Synthetic Polynucleotide
taatacgactcactataggggagctcggggccgcggggccctcccccggcaacagaggagagccgggatggggccccgcaacctggcggcagcgcaaaagatg

SEQ ID NO: 107912 - DNA, 103 bp, Artificial Sequence
  Synthetic Polynucleotide
taatacgactcactatagggttcatattctcggattttctctttaagtgcaacagaggagagcacttatggagaaaatcaacctggcggcagcgcaaaagatg

SEQ ID NO: 107913 - DNA, 103 bp, Artificial Sequence
  Synthetic Polynucleotide
taatacgactcactatagggcggcggcgcggagctcggggccgcggggccaacagaggagaggccccatggccccgagcaacctggcggcagcgcaaaagatg

SEQ ID NO: 107914 - DNA, 103 bp, Artificial Sequence
  Synthetic Polynucleotide
taatacgactcactatagggtgttgctgggcggcggcgcggagctcggggaacagaggagaccccgaatgccgcgccgcaacctggcggcagcgcaaaagatg

SEQ ID NO: 107915 - DNA, 103 bp, Artificial Sequence
  Synthetic Polynucleotide
taatacgactcactatagggctgctgctgctgttgctgggcggcggcgcgaacagaggagacgcgccatggcccagcaaaacctggcggcagcgcaaaagatg

SEQ ID NO: 107916 - DNA, 103 bp, Artificial Sequence
  Synthetic Polynucleotide
taatacgactcactataggggggggcgctgctgctgctgctgttgctgggaacagaggagacccagcatgagcagcagcaacctggcggcagcgcaaaagatg

SEQ ID NO: 107917 - DNA, 103 bp, Artificial Sequence
  Synthetic Polynucleotide
taatacgactcactatagggtgggcctgcggggggcgctgctgctgctgcaacagaggagagcagcaatggcagcgcccaacctggcggcagcgcaaaagatg

SEQ ID NO: 107918 - DNA, 103 bp, Artificial Sequence
  Synthetic Polynucleotide
taatacgactcactatagggtgcagcgagctgggcctgcggggggcgctgaacagaggagacagcgcatgccgcaggccaacctggcggcagcgcaaaagatg

SEQ ID NO: 107919 - DNA, 103 bp, Artificial Sequence
  Synthetic Polynucleotide
taatacgactcactataggggaaaaggctctgcagcgagctgggcctgcgaacagaggagacgcaggatgagctcgctgaacctggcggcagcgcaaaagatg

SEQ ID NO: 107920 - DNA, 103 bp, Artificial Sequence
  Synthetic Polynucleotide
taatacgactcactatagggcggggaggccgaaaaggctctgcagcgagcaacagaggagagctcgcatgagagcctttaacctggcggcagcgcaaaagatg

SEQ ID NO: 107921 - DNA, 103 bp, Artificial Sequence
  Synthetic Polynucleotide
taatacgactcactatagggcccgcggcctcggggaggccgaaaaggctcaacagaggagagagcctatgcggcctcccaacctggcggcagcgcaaaagatg

SEQ ID NO: 107922 - DNA, 103 bp, Artificial Sequence
  Synthetic Polynucleotide
taatacgactcactataggggtcccgggcgcccgcggcctcggggaggccaacagaggagaggcctcatggaggccgcgaacctggcggcagcgcaaaagatg

SEQ ID NO: 107923 - DNA, 103 bp, Artificial Sequence
  Synthetic Polynucleotide
taatacgactcactatagggtcagtgtctgttcatattctcggattttctaacagaggagaagaaaaatggagaatatgaacctggcggcagcgcaaaagatg

SEQ ID NO: 107924 - DNA, 103 bp, Artificial Sequence
  Synthetic Polynucleotide
taatacgactcactatagggtgtcgcgcgagtcccgggcgcccgcggcctaacagaggagaaggccgatggcgcccgggaacctggcggcagcgcaaaagatg

SEQ ID NO: 107925 - DNA, 103 bp, Artificial Sequence
  Synthetic Polynucleotide
taatacgactcactatagggcgcagggggttgtcgcgcgagtcccgggcgaacagaggagacgcccgatgctcgcgcgaaacctggcggcagcgcaaaagatg

SEQ ID NO: 107926 - DNA, 103 bp, Artificial Sequence
  Synthetic Polynucleotide
taatacgactcactatagggcttcttcttgcgcagggggttgtcgcgcgaaacagaggagatcgcgcatgaaccccctgaacctggcggcagcgcaaaagatg

SEQ ID NO: 107927 - DNA, 103 bp, Artificial Sequence
  Synthetic Polynucleotide
taatacgactcactatagggagttcgcggccttcttcttgcgcagggggtaacagaggagaacccccatggcaagaagaaacctggcggcagcgcaaaagatg

SEQ ID NO: 107928 - DNA, 103 bp, Artificial Sequence
  Synthetic Polynucleotide
taatacgactcactatagggatgctgttcaagttcgcggccttcttcttgaacagaggagacaagaaatgggccgcgaaaacctggcggcagcgcaaaagatg

SEQ ID NO: 107929 - DNA, 103 bp, Artificial Sequence
  Synthetic Polynucleotide
taatacgactcactataggggcggtggatgatgctgttcaagttcgcggcaacagaggagagccgcgatgttgaacagcaacctggcggcagcgcaaaagatg

SEQ ID NO: 107930 - DNA, 103 bp, Artificial Sequence
  Synthetic Polynucleotide
taatacgactcactatagggccttctccaggcggtggatgatgctgttcaaacagaggagatgaacaatgtcatccaccaacctggcggcagcgcaaaagatg

SEQ ID NO: 107931 - DNA, 103 bp, Artificial Sequence
  Synthetic Polynucleotide
taatacgactcactatagggcggctggcggccttctccaggcggtggatgaacagaggagacatccaatgcctggagaaaacctggcggcagcgcaaaagatg

SEQ ID NO: 107932 - DNA, 103 bp, Artificial Sequence
  Synthetic Polynucleotide
taatacgactcactatagggaggttcctcccggctggcggccttctccagaacagaggagactggagatggccgccagcaacctggcggcagcgcaaaagatg

SEQ ID NO: 107933 - DNA, 103 bp, Artificial Sequence
  Synthetic Polynucleotide
taatacgactcactatagggcccattcgataggttcctcccggctggcggaacagaggagaccgccaatggggaggaacaacctggcggcagcgcaaaagatg

SEQ ID NO: 107934 - DNA, 103 bp, Artificial Sequence
  Synthetic Polynucleotide
taatacgactcactataggggcttggttcttcagtgtctgttcatattctaacagaggagaagaataatgacagacactaacctggcggcagcgcaaaagatg

SEQ ID NO: 107935 - DNA, 103 bp, Artificial Sequence
  Synthetic Polynucleotide
taatacgactcactatagggtatggtttcggcttggttcttcagtgtctgaacagaggagacagacaatgaagaaccaaaacctggcggcagcgcaaaagatg

SEQ ID NO: 107936 - DNA, 103 bp, Artificial Sequence
  Synthetic Polynucleotide
taatacgactcactatagggtctcaagagctatggtttcggcttggttctaacagaggagaagaaccatgccgaaaccaaacctggcggcagcgcaaaagatg

SEQ ID NO: 107937 - DNA, 103 bp, Artificial Sequence
  Synthetic Polynucleotide
taatacgactcactatagggttctgttccttctcaagagctatggtttcgaacagaggagacgaaacatgagctcttgaaacctggcggcagcgcaaaagatg

SEQ ID NO: 107938 - DNA, 103 bp, Artificial Sequence
  Synthetic Polynucleotide
taatacgactcactatagggattctgtaacttctgttccttctcaagagcaacagaggagagctcttatgaaggaacagaacctggcggcagcgcaaaagatg

SEQ ID NO: 107939 - DNA, 103 bp, Artificial Sequence
  Synthetic Polynucleotide
taatacgactcactataggggccggttcgccaataccgttgcggtggcataacagaggagaatgccaatgcaacggtataacctggcggcagcgcaaaagatg

SEQ ID NO: 107940 - DNA, 103 bp, Artificial Sequence
  Synthetic Polynucleotide
taatacgactcactatagggctgcaaagtcattctgtaacttctgttcctaacagaggagaaggaacatgagttacagaaacctggcggcagcgcaaaagatg

SEQ ID NO: 107941 - DNA, 103 bp, Artificial Sequence
  Synthetic Polynucleotide
taatacgactcactatagggctctccttttctgcaaagtcattctgtaacaacagaggagagttacaatgtgactttgcaacctggcggcagcgcaaaagatg

SEQ ID NO: 107942 - DNA, 103 bp, Artificial Sequence
  Synthetic Polynucleotide
taatacgactcactatagggctgcagctttctctccttttctgcaaagtcaacagaggagagactttatggaaaaggagaacctggcggcagcgcaaaagatg

SEQ ID NO: 107943 - DNA, 103 bp, Artificial Sequence
  Synthetic Polynucleotide
taatacgactcactatagggtctgtgtctcctgcagctttctctccttttaacagaggagaaaaaggatggaaagctgcaacctggcggcagcgcaaaagatg

SEQ ID NO: 107944 - DNA, 103 bp, Artificial Sequence
  Synthetic Polynucleotide
taatacgactcactataggggtggtggacatctgtgtctcctgcagctttaacagaggagaaaagctatgggagacacaaacctggcggcagcgcaaaagatg

SEQ ID NO: 107945 - DNA, 103 bp, Artificial Sequence
  Synthetic Polynucleotide
taatacgactcactatagggcagctttgaggtggtggacatctgtgtctcaacagaggagagagacaatgatgtccaccaacctggcggcagcgcaaaagatg

SEQ ID NO: 107946 - DNA, 103 bp, Artificial Sequence
  Synthetic Polynucleotide
taatacgactcactatagggcagcttcctccagctttgaggtggtggacaaacagaggagatgtccaatgcctcaaagcaacctggcggcagcgcaaaagatg

SEQ ID NO: 107947 - DNA, 103 bp, Artificial Sequence
  Synthetic Polynucleotide
taatacgactcactatagggaccttatgctcagcttcctccagctttgagaacagaggagactcaaaatgggaggaagcaacctggcggcagcgcaaaagatg

SEQ ID NO: 107948 - DNA, 103 bp, Artificial Sequence
  Synthetic Polynucleotide
taatacgactcactatagggtaggctctgaaccttatgctcagcttcctcaacagaggagagaggaaatggagcataagaacctggcggcagcgcaaaagatg

SEQ ID NO: 107949 - DNA, 103 bp, Artificial Sequence
  Synthetic Polynucleotide
taatacgactcactataggggggctgtttgtaggctctgaaccttatgctaacagaggagaagcataatgttcagagccaacctggcggcagcgcaaaagatg

SEQ ID NO: 107950 - DNA, 103 bp, Artificial Sequence
  Synthetic Polynucleotide
taatacgactcactatagggctttcatcctgccggttcgccaataccgttaacagaggagaaacggtatgggcgaaccgaacctggcggcagcgcaaaagatg

SEQ ID NO: 107951 - DNA, 103 bp, Artificial Sequence
  Synthetic Polynucleotide
taatacgactcactataggggttttttccagggctgtttgtaggctctgaaacagaggagatcagagatgacaaacagcaacctggcggcagcgcaaaagatg

SEQ ID NO: 107952 - DNA, 103 bp, Artificial Sequence
  Synthetic Polynucleotide
taatacgactcactatagggttctgttcgagttttttccagggctgtttgaacagaggagacaaacaatgctggaaaaaaacctggcggcagcgcaaaagatg

SEQ ID NO: 107953 - DNA, 103 bp, Artificial Sequence
  Synthetic Polynucleotide
taatacgactcactatagggggtcaaataattctgttcgagttttttccaaacagaggagatggaaaatgctcgaacagaacctggcggcagcgcaaaagatg

SEQ ID NO: 107954 - DNA, 103 bp, Artificial Sequence
  Synthetic Polynucleotide
taatacgactcactatagggttggttttcaggtcaaataattctgttcgaaacagaggagatcgaacatgattatttgaaacctggcggcagcgcaaaagatg

SEQ ID NO: 107955 - DNA, 103 bp, Artificial Sequence
  Synthetic Polynucleotide
taatacgactcactatagggttcatcgtatttggttttcaggtcaaataaaacagaggagattatttatgctgaaaaccaacctggcggcagcgcaaaagatg

SEQ ID NO: 107956 - DNA, 103 bp, Artificial Sequence
  Synthetic Polynucleotide
taatacgactcactatagggcagtagtttcttcatcgtatttggttttcaaacagaggagatgaaaaatgaatacgatgaacctggcggcagcgcaaaagatg

SEQ ID NO: 107957 - DNA, 103 bp, Artificial Sequence
  Synthetic Polynucleotide
taatacgactcactatagggtcggcctttgcagtagtttcttcatcgtataacagaggagaatacgaatgagaaactacaacctggcggcagcgcaaaagatg

SEQ ID NO: 107958 - DNA, 103 bp, Artificial Sequence
  Synthetic Polynucleotide
taatacgactcactatagggttcaatctcgtcggcctttgcagtagtttcaacagaggagagaaactatggcaaaggccaacctggcggcagcgcaaaagatg

SEQ ID NO: 107959 - DNA, 103 bp, Artificial Sequence
  Synthetic Polynucleotide
taatacgactcactatagggtcatgatcatttcaatctcgtcggcctttgaacagaggagacaaaggatgacgagattgaacctggcggcagcgcaaaagatg

SEQ ID NO: 107960 - DNA, 103 bp, Artificial Sequence
  Synthetic Polynucleotide
taatacgactcactatagggtcaaggtccgtcatgatcatttcaatctcgaacagaggagacgagatatgaatgatcataacctggcggcagcgcaaaagatg

SEQ ID NO: 107961 - DNA, 103 bp, Artificial Sequence
  Synthetic Polynucleotide
taatacgactcactatagggggactgctcactttcatcctgccggttcgcaacagaggagagcgaacatgcaggatgaaaacctggcggcagcgcaaaagatg

SEQ ID NO: 107962 - DNA, 103 bp, Artificial Sequence
  Synthetic Polynucleotide
taatacgactcactataggggtttgccctttcaaggtccgtcatgatcataacagaggagaatgatcatgacggaccttaacctggcggcagcgcaaaagatg

SEQ ID NO: 107963 - DNA, 103 bp, Artificial Sequence
  Synthetic Polynucleotide
taatacgactcactatagggctgccctctggtttgccctttcaaggtccgaacagaggagacggaccatgaaagggcaaaacctggcggcagcgcaaaagatg

SEQ ID NO: 107964 - DNA, 103 bp, Artificial Sequence
  Synthetic Polynucleotide
taatacgactcactatagggtgagccacctctgccctctggtttgcccttaacagaggagaaagggcatgccagagggcaacctggcggcagcgcaaaagatg

SEQ ID NO: 107965 - DNA, 103 bp, Artificial Sequence
  Synthetic Polynucleotide
taatacgactcactatagggcgcctctctctgagccacctctgccctctgaacagaggagacagaggatggaggtggctaacctggcggcagcgcaaaagatg

SEQ ID NO: 107966 - DNA, 103 bp, Artificial Sequence
  Synthetic Polynucleotide
taatacgactcactatagggttaaggtctccgcctctctctgagccacctaacagaggagaaggtggatgagagagaggaacctggcggcagcgcaaaagatg

SEQ ID NO: 107967 - DNA, 103 bp, Artificial Sequence
  Synthetic Polynucleotide
taatacgactcactatagggagctgttcccttaaggtctccgcctctctcaacagaggagagagagaatgggagaccttaacctggcggcagcgcaaaagatg

SEQ ID NO: 107968 - DNA, 103 bp, Artificial Sequence
  Synthetic Polynucleotide
taatacgactcactatagggggccgatgagagctgttcccttaaggtctcaacagaggagagagaccatgagggaacagaacctggcggcagcgcaaaagatg

SEQ ID NO: 107969 - DNA, 103 bp, Artificial Sequence
  Synthetic Polynucleotide
taatacgactcactataggggggagtgattggccgatgagagctgttcccaacagaggagagggaacatgtctcatcggaacctggcggcagcgcaaaagatg

SEQ ID NO: 107970 - DNA, 103 bp, Artificial Sequence
  Synthetic Polynucleotide
taatacgactcactataggggccagctggagggagtgattggccgatgagaacagaggagactcatcatgcaatcactcaacctggcggcagcgcaaaagatg

SEQ ID NO: 107971 - DNA, 103 bp, Artificial Sequence
  Synthetic Polynucleotide
taatacgactcactataggggatctgtgaggccagctggagggagtgattaacagaggagaaatcacatgctccagctgaacctggcggcagcgcaaaagatg

SEQ ID NO: 107972 - DNA, 103 bp, Artificial Sequence
  Synthetic Polynucleotide
taatacgactcactataggggccgctttctggactgctcactttcatcctaacagaggagaaggatgatggtgagcagtaacctggcggcagcgcaaaagatg

SEQ ID NO: 107973 - DNA, 103 bp, Artificial Sequence
  Synthetic Polynucleotide
taatacgactcactataggggtgccttctggatctgtgaggccagctggaaacagaggagatccagcatgcctcacagaaacctggcggcagcgcaaaagatg

SEQ ID NO: 107974 - DNA, 103 bp, Artificial Sequence
  Synthetic Polynucleotide
taatacgactcactatagggtccacgtctggtgccttctggatctgtgagaacagaggagactcacaatgccagaaggcaacctggcggcagcgcaaaagatg

SEQ ID NO: 107975 - DNA, 103 bp, Artificial Sequence
  Synthetic Polynucleotide
taatacgactcactatagggtatggcctgctccacgtctggtgccttctgaacagaggagacagaagatgccagacgtgaacctggcggcagcgcaaaagatg

SEQ ID NO: 107976 - DNA, 103 bp, Artificial Sequence
  Synthetic Polynucleotide
taatacgactcactatagggtcagcacctctatggcctgctccacgtctgaacagaggagacagacgatgagcaggccaaacctggcggcagcgcaaaagatg

SEQ ID NO: 107977 - DNA, 103 bp, Artificial Sequence
  Synthetic Polynucleotide
taatacgactcactatagggctggagcgggtcagcacctctatggcctgcaacagaggagagcaggcatgagaggtgctaacctggcggcagcgcaaaagatg

SEQ ID NO: 107978 - DNA, 103 bp, Artificial Sequence
  Synthetic Polynucleotide
taatacgactcactatagggaacttctaggctggagcgggtcagcacctcaacagaggagagaggtgatgacccgctccaacctggcggcagcgcaaaagatg

SEQ ID NO: 107979 - DNA, 103 bp, Artificial Sequence
  Synthetic Polynucleotide
taatacgactcactatagggcggccaactcaacttctaggctggagcgggaacagaggagacccgctatggcctagaagaacctggcggcagcgcaaaagatg

SEQ ID NO: 107980 - DNA, 103 bp, Artificial Sequence
  Synthetic Polynucleotide
taatacgactcactatagggcgctccttggcggccaactcaacttctaggaacagaggagacctagaatgtgagttggcaacctggcggcagcgcaaaagatg

SEQ ID NO: 107981 - DNA, 103 bp, Artificial Sequence
  Synthetic Polynucleotide
taatacgactcactatagggtgcgatctcccgctccttggcggccaactcaacagaggagagagttgatggccaaggagaacctggcggcagcgcaaaagatg

SEQ ID NO: 107982 - DNA, 103 bp, Artificial Sequence
  Synthetic Polynucleotide
taatacgactcactatagggccaccagctgtgcgatctcccgctccttggaacagaggagaccaaggatggggagatcgaacctggcggcagcgcaaaagatg

SEQ ID NO: 107983 - DNA, 103 bp, Artificial Sequence
  Synthetic Polynucleotide
taatacgactcactatagggtgttcgataagccgctttctggactgctcaaacagaggagatgagcaatgcagaaagcgaacctggcggcagcgcaaaagatg

SEQ ID NO: 107984 - DNA, 103 bp, Artificial Sequence
  Synthetic Polynucleotide
taatacgactcactatagggtgcacgtcctccaccagctgtgcgatctccaacagaggagaggagatatgacagctggtaacctggcggcagcgcaaaagatg

SEQ ID NO: 107985 - DNA, 103 bp, Artificial Sequence
  Synthetic Polynucleotide
taatacgactcactatagggctggagtctctgcacgtcctccaccagctgaacagaggagacagctgatggaggacgtgaacctggcggcagcgcaaaagatg

SEQ ID NO: 107986 - DNA, 103 bp, Artificial Sequence
  Synthetic Polynucleotide
taatacgactcactatagggtgaggctggcctggagtctctgcacgtcctaacagaggagaaggacgatgagagactccaacctggcggcagcgcaaaagatg

SEQ ID NO: 107987 - DNA, 103 bp, Artificial Sequence
  Synthetic Polynucleotide
taatacgactcactatagggcgcagcttggtgaggctggcctggagtctcaacagaggagagagactatgggccagcctaacctggcggcagcgcaaaagatg

SEQ ID NO: 107988 - DNA, 103 bp, Artificial Sequence
  Synthetic Polynucleotide
taatacgactcactatagggcgaattctcccgcagcttggtgaggctggcaacagaggagagccagcatgaccaagctgaacctggcggcagcgcaaaagatg

SEQ ID NO: 107989 - DNA, 103 bp, Artificial Sequence
  Synthetic Polynucleotide
taatacgactcactatagggtctggctggccgaattctcccgcagcttggaacagaggagaccaagcatggggagaattaacctggcggcagcgcaaaagatg

SEQ ID NO: 107990 - DNA, 103 bp, Artificial Sequence
  Synthetic Polynucleotide
taatacgactcactatagggagctgtgagatctggctggccgaattctccaacagaggagaggagaaatgggccagccaaacctggcggcagcgcaaaagatg

SEQ ID NO: 107991 - DNA, 103 bp, Artificial Sequence
  Synthetic Polynucleotide
taatacgactcactatagggctgctgctcaagctgtgagatctggctggcaacagaggagagccagcatgatctcacagaacctggcggcagcgcaaaagatg

SEQ ID NO: 107992 - DNA, 103 bp, Artificial Sequence
  Synthetic Polynucleotide
taatacgactcactatagggtggcgctcagctgctgctcaagctgtgagaaacagaggagatctcacatgttgagcagcaacctggcggcagcgcaaaagatg

SEQ ID NO: 107993 - DNA, 103 bp, Artificial Sequence
  Synthetic Polynucleotide
taatacgactcactataggggtgctgtttttggcgctcagctgctgctcaaacagaggagatgagcaatggctgagcgcaacctggcggcagcgcaaaagatg

SEQ ID NO: 107994 - DNA, 103 bp, Artificial Sequence
  Synthetic Polynucleotide
taatacgactcactatagggttgaaacatcgatcccacattggcggccataacagaggagaatggccatgaatgtgggaaacctggcggcagcgcaaaagatg

SEQ ID NO: 107995 - DNA, 103 bp, Artificial Sequence
  Synthetic Polynucleotide
taatacgactcactatagggatgttcactctcctcctgccgtgcagacagaacagaggagactgtctatgcggcaggagaacctggcggcagcgcaaaagatg

SEQ ID NO: 107996 - DNA, 103 bp, Artificial Sequence
  Synthetic Polynucleotide
taatacgactcactatagggccgctccaggtcggcgatctggttggcggaaacagaggagatccgccatgcagatcgccaacctggcggcagcgcaaaagatg

SEQ ID NO: 107997 - DNA, 103 bp, Artificial Sequence
  Synthetic Polynucleotide
taatacgactcactatagggccgtgagctgccgctccaggtcggcgatctaacagaggagaagatcgatgacctggagcaacctggcggcagcgcaaaagatg

SEQ ID NO: 107998 - DNA, 103 bp, Artificial Sequence
  Synthetic Polynucleotide
taatacgactcactatagggtcggacttggccgtgagctgccgctccaggaacagaggagacctggaatggcagctcacaacctggcggcagcgcaaaagatg

SEQ ID NO: 107999 - DNA, 103 bp, Artificial Sequence
  Synthetic Polynucleotide
taatacgactcactatagggttctatggcctcggacttggccgtgagctgaacagaggagacagctcatggccaagtccaacctggcggcagcgcaaaagatg

SEQ ID NO: 108000 - DNA, 103 bp, Artificial Sequence
  Synthetic Polynucleotide
taatacgactcactatagggcttccagcttttctatggcctcggacttggaacagaggagaccaagtatgaggccatagaacctggcggcagcgcaaaagatg

SEQ ID NO: 108001 - DNA, 103 bp, Artificial Sequence
  Synthetic Polynucleotide
taatacgactcactatagggtggagcttctcttccagcttttctatggccaacagaggagaggccatatgaaagctggaaacctggcggcagcgcaaaagatg

SEQ ID NO: 108002 - DNA, 103 bp, Artificial Sequence
  Synthetic Polynucleotide
taatacgactcactatagggagactgggcctggagcttctcttccagcttaacagaggagaaagctgatggagaagctcaacctggcggcagcgcaaaagatg

SEQ ID NO: 108003 - DNA, 103 bp, Artificial Sequence
  Synthetic Polynucleotide
taatacgactcactatagggcctcatagtcagactgggcctggagcttctaacagaggagaagaagcatgaggcccagtaacctggcggcagcgcaaaagatg

SEQ ID NO: 108004 - DNA, 103 bp, Artificial Sequence
  Synthetic Polynucleotide
taatacgactcactataggggttttaatttcctcatagtcagactgggccaacagaggagaggcccaatgtgactatgaaacctggcggcagcgcaaaagatg

SEQ ID NO: 108005 - DNA, 103 bp, Artificial Sequence
  Synthetic Polynucleotide
taatacgactcactataggggctcagctccgttttaatttcctcatagtcaacagaggagagactatatggaaattaaaaacctggcggcagcgcaaaagatg

SEQ ID NO: 108006 - DNA, 103 bp, Artificial Sequence
  Synthetic Polynucleotide
taatacgactcactataggggtttatgagaatgttcactctcctcctgccaacagaggagaggcaggatgagagtgaacaacctggcggcagcgcaaaagatg

SEQ ID NO: 108007 - DNA, 103 bp, Artificial Sequence
  Synthetic Polynucleotide
taatacgactcactatagggctttcaggatgctcagctccgttttaatttaacagaggagaaaattaatgcggagctgaaacctggcggcagcgcaaaagatg

SEQ ID NO: 108008 - DNA, 103 bp, Artificial Sequence
  Synthetic Polynucleotide
taatacgactcactatagggagcttcatggctttcaggatgctcagctccaacagaggagaggagctatgcatcctgaaaacctggcggcagcgcaaaagatg

SEQ ID NO: 108009 - DNA, 103 bp, Artificial Sequence
  Synthetic Polynucleotide
taatacgactcactataggggctggaggccagcttcatggctttcaggataacagaggagaatcctgatggccatgaagaacctggcggcagcgcaaaagatg

SEQ ID NO: 108010 - DNA, 103 bp, Artificial Sequence
  Synthetic Polynucleotide
taatacgactcactatagggggctgcaggtgctggaggccagcttcatggaacagaggagaccatgaatgtggcctccaaacctggcggcagcgcaaaagatg

SEQ ID NO: 108011 - DNA, 103 bp, Artificial Sequence
  Synthetic Polynucleotide
taatacgactcactatagggccctgggggaggctgcaggtgctggaggccaacagaggagaggcctcatgcacctgcagaacctggcggcagcgcaaaagatg

SEQ ID NO: 108012 - DNA, 103 bp, Artificial Sequence
  Synthetic Polynucleotide
taatacgactcactatagggcttggccatgccctgggggaggctgcaggtaacagaggagaacctgcatgctcccccagaacctggcggcagcgcaaaagatg

SEQ ID NO: 108013 - DNA, 103 bp, Artificial Sequence
  Synthetic Polynucleotide
taatacgactcactatagggagtcttcaggcttggccatgccctgggggaaacagaggagatcccccatggcatggccaaacctggcggcagcgcaaaagatg

SEQ ID NO: 108014 - DNA, 103 bp, Artificial Sequence
  Synthetic Polynucleotide
taatacgactcactatagggataagcagtgagtcttcaggcttggccatgaacagaggagacatggcatggcctgaagaaacctggcggcagcgcaaaagatg

SEQ ID NO: 108015 - DNA, 103 bp, Artificial Sequence
  Synthetic Polynucleotide
taatacgactcactatagggctcctttgcaataagcagtgagtcttcaggaacagaggagacctgaaatgtcactgcttaacctggcggcagcgcaaaagatg

SEQ ID NO: 108016 - DNA, 103 bp, Artificial Sequence
  Synthetic Polynucleotide
taatacgactcactatagggggaagaaggcctcctttgcaataagcagtgaacagaggagacactgcatgttgcaaaggaacctggcggcagcgcaaaagatg

SEQ ID NO: 108017 - DNA, 103 bp, Artificial Sequence
  Synthetic Polynucleotide
taatacgactcactatagggtcaattaaatgtttatgagaatgttcactcaacagaggagagagtgaatgttctcataaaacctggcggcagcgcaaaagatg

SEQ ID NO: 108018 - DNA, 103 bp, Artificial Sequence
  Synthetic Polynucleotide
taatacgactcactatagggttctgcgtggggaagaaggcctcctttgcaaacagaggagatgcaaaatgggccttcttaacctggcggcagcgcaaaagatg

SEQ ID NO: 108019 - DNA, 103 bp, Artificial Sequence
  Synthetic Polynucleotide
taatacgactcactatagggcagaaggaatttctgcgtggggaagaaggcaacagaggagagccttcatgcccacgcagaacctggcggcagcgcaaaagatg

SEQ ID NO: 108020 - DNA, 103 bp, Artificial Sequence
  Synthetic Polynucleotide
taatacgactcactatagggtgggcttctccagaaggaatttctgcgtggaacagaggagaccacgcatgaattccttcaacctggcggcagcgcaaaagatg

SEQ ID NO: 108021 - DNA, 103 bp, Artificial Sequence
  Synthetic Polynucleotide
taatacgactcactataggggccaggaggctgggcttctccagaaggaataacagaggagaattcctatgggagaagccaacctggcggcagcgcaaaagatg

SEQ ID NO: 108022 - DNA, 103 bp, Artificial Sequence
  Synthetic Polynucleotide
taatacgactcactatagggctcagggctggccaggaggctgggcttctcaacagaggagagagaagatgagcctcctgaacctggcggcagcgcaaaagatg

SEQ ID NO: 108023 - DNA, 103 bp, Artificial Sequence
  Synthetic Polynucleotide
taatacgactcactatagggatgggtcttcctcagggctggccaggaggcaacagaggagagcctccatgccagccctgaacctggcggcagcgcaaaagatg

SEQ ID NO: 108024 - DNA, 103 bp, Artificial Sequence
  Synthetic Polynucleotide
taatacgactcactatagggtcgtcctctgatgggtcttcctcagggctgaacagaggagacagcccatgggaagacccaacctggcggcagcgcaaaagatg

SEQ ID NO: 108025 - DNA, 103 bp, Artificial Sequence
  Synthetic Polynucleotide
taatacgactcactatagggcttgatggaatcgtcctctgatgggtcttcaacagaggagagaagacatgtcagaggacaacctggcggcagcgcaaaagatg

SEQ ID NO: 108026 - DNA, 103 bp, Artificial Sequence
  Synthetic Polynucleotide
taatacgactcactatagggccagtgaatccttgatggaatcgtcctctgaacagaggagacagaggatgattccatcaaacctggcggcagcgcaaaagatg

SEQ ID NO: 108027 - DNA, 103 bp, Artificial Sequence
  Synthetic Polynucleotide
taatacgactcactatagggtgctccgtgcccagtgaatccttgatggaaaacagaggagattccatatgggattcactaacctggcggcagcgcaaaagatg

SEQ ID NO: 108028 - DNA, 103 bp, Artificial Sequence
  Synthetic Polynucleotide
taatacgactcactatagggccggcggagttcaattaaatgtttatgagaaacagaggagatctcatatgcatttaattaacctggcggcagcgcaaaagatg

SEQ ID NO: 108029 - DNA, 103 bp, Artificial Sequence
  Synthetic Polynucleotide
taatacgactcactatagggggggtaggactgctccgtgcccagtgaatcaacagaggagagattcaatgggcacggagaacctggcggcagcgcaaaagatg

SEQ ID NO: 108030 - DNA, 103 bp, Artificial Sequence
  Synthetic Polynucleotide
taatacgactcactataggggctgaggggaggggtaggactgctccgtgcaacagaggagagcacggatgagtcctaccaacctggcggcagcgcaaaagatg

SEQ ID NO: 108031 - DNA, 103 bp, Artificial Sequence
  Synthetic Polynucleotide
taatacgactcactatagggggtgggagctgctgaggggaggggtaggacaacagaggagagtcctaatgctcccctcaaacctggcggcagcgcaaaagatg

SEQ ID NO: 108032 - DNA, 103 bp, Artificial Sequence
  Synthetic Polynucleotide
taatacgactcactatagggccctggtggaggtgggagctgctgaggggaaacagaggagatcccctatgcagctcccaaacctggcggcagcgcaaaagatg

SEQ ID NO: 108033 - DNA, 103 bp, Artificial Sequence
  Synthetic Polynucleotide
taatacgactcactatagggggtcttctggccctggtggaggtgggagctaacagaggagaagctccatgctccaccagaacctggcggcagcgcaaaagatg

SEQ ID NO: 108034 - DNA, 103 bp, Artificial Sequence
  Synthetic Polynucleotide
taatacgactcactatagggggagacagggggtcttctggccctggtggaaacagaggagatccaccatggccagaagaaacctggcggcagcgcaaaagatg

SEQ ID NO: 108035 - DNA, 103 bp, Artificial Sequence
  Synthetic Polynucleotide
taatacgactcactatagggcccggggctgggagacagggggtcttctggaacagaggagaccagaaatgcccctgtctaacctggcggcagcgcaaaagatg

SEQ ID NO: 108036 - DNA, 103 bp, Artificial Sequence
  Synthetic Polynucleotide
taatacgactcactataggggcaggggctgcccggggctgggagacagggaacagaggagaccctgtatgccagccccgaacctggcggcagcgcaaaagatg

SEQ ID NO: 108037 - DNA, 103 bp, Artificial Sequence
  Synthetic Polynucleotide
taatacgactcactatagggctggggcccagcaggggctgcccggggctgaacagaggagacagcccatggcagcccctaacctggcggcagcgcaaaagatg

SEQ ID NO: 108038 - DNA, 103 bp, Artificial Sequence
  Synthetic Polynucleotide
taatacgactcactatagggaggccccaagctggggcccagcaggggctgaacagaggagacagcccatgctgggccccaacctggcggcagcgcaaaagatg

SEQ ID NO: 108039 - DNA, 103 bp, Artificial Sequence
  Synthetic Polynucleotide
taatacgactcactatagggtcttaaattcccggcggagttcaattaaataacagaggagaatttaaatgaactccgccaacctggcggcagcgcaaaagatg

SEQ ID NO: 108040 - DNA, 103 bp, Artificial Sequence
  Synthetic Polynucleotide
taatacgactcactataggggagtgccgtcaggccccaagctggggcccaaacagaggagatgggccatggcttggggcaacctggcggcagcgcaaaagatg

SEQ ID NO: 108041 - DNA, 103 bp, Artificial Sequence
  Synthetic Polynucleotide
taatacgactcactataggggagaaagtccgagtgccgtcaggccccaagaacagaggagacttgggatgtgacggcacaacctggcggcagcgcaaaagatg

SEQ ID NO: 108042 - DNA, 103 bp, Artificial Sequence
  Synthetic Polynucleotide
taatacgactcactataggggggggacagcgagaaagtccgagtgccgtcaacagaggagagacggcatgcggactttcaacctggcggcagcgcaaaagatg

SEQ ID NO: 108043 - DNA, 103 bp, Artificial Sequence
  Synthetic Polynucleotide
taatacgactcactatagggggctggggaagggggacagcgagaaagtccaacagaggagaggacttatgcgctgtcccaacctggcggcagcgcaaaagatg

SEQ ID NO: 108044 - DNA, 103 bp, Artificial Sequence
  Synthetic Polynucleotide
taatacgactcactatagggcctgatgccaggctggggaagggggacagcaacagaggagagctgtcatgcttccccagaacctggcggcagcgcaaaagatg

SEQ ID NO: 108045 - DNA, 103 bp, Artificial Sequence
  Synthetic Polynucleotide
taatacgactcactatagggcagtctctcccctgatgccaggctggggaaaacagaggagattccccatgctggcatcaaacctggcggcagcgcaaaagatg

SEQ ID NO: 108046 - DNA, 103 bp, Artificial Sequence
  Synthetic Polynucleotide
taatacgactcactatagggggggcatcatcagtctctcccctgatgccaaacagaggagatggcatatggggagagacaacctggcggcagcgcaaaagatg

SEQ ID NO: 108047 - DNA, 103 bp, Artificial Sequence
  Synthetic Polynucleotide
taatacgactcactatagggaaggcggctgggggcatcatcagtctctccaacagaggagaggagagatggatgatgccaacctggcggcagcgcaaaagatg

SEQ ID NO: 108048 - DNA, 103 bp, Artificial Sequence
  Synthetic Polynucleotide
taatacgactcactatagggctctcccttgaaggcggctgggggcatcataacagaggagaatgatgatgccagccgccaacctggcggcagcgcaaaagatg

SEQ ID NO: 108049 - DNA, 103 bp, Artificial Sequence
  Synthetic Polynucleotide
taatacgactcactatagggggccgcccgcctctcccttgaaggcggctgaacagaggagacagccgatgtcaagggagaacctggcggcagcgcaaaagatg

SEQ ID NO: 108050 - DNA, 103 bp, Artificial Sequence
  Synthetic Polynucleotide
taatacgactcactatagggggtacatttttcttaaattcccggcggagtaacagaggagaactccgatgggaatttaaaacctggcggcagcgcaaaagatg

SEQ ID NO: 108051 - DNA, 103 bp, Artificial Sequence
  Synthetic Polynucleotide
taatacgactcactatagggaacaccagcaggccgcccgcctctcccttgaacagaggagacaagggatgggcgggcggaacctggcggcagcgcaaaagatg

SEQ ID NO: 108052 - DNA, 103 bp, Artificial Sequence
  Synthetic Polynucleotide
taatacgactcactatagggggctggggggaacaccagcaggccgcccgcaacagaggagagcgggcatgctgctggtgaacctggcggcagcgcaaaagatg

SEQ ID NO: 108053 - DNA, 103 bp, Artificial Sequence
  Synthetic Polynucleotide
taatacgactcactatagggcgccatagaaggctggggggaacaccagcaaacagaggagatgctggatgtccccccagaacctggcggcagcgcaaaagatg

SEQ ID NO: 108054 - DNA, 103 bp, Artificial Sequence
  Synthetic Polynucleotide
taatacgactcactataggggggggcttggcgccatagaaggctggggggaacagaggagaccccccatgcttctatggaacctggcggcagcgcaaaagatg

SEQ ID NO: 108055 - DNA, 103 bp, Artificial Sequence
  Synthetic Polynucleotide
taatacgactcactatagggaggggctgtggggggcttggcgccatagaaaacagaggagattctatatggccaagcccaacctggcggcagcgcaaaagatg

SEQ ID NO: 108056 - DNA, 103 bp, Artificial Sequence
  Synthetic Polynucleotide
taatacgactcactatagggccggggtggcaggggctgtggggggcttggaacagaggagaccaagcatgccacagcccaacctggcggcagcgcaaaagatg

SEQ ID NO: 108057 - DNA, 103 bp, Artificial Sequence
  Synthetic Polynucleotide
taatacgactcactataggggggccaggggccggggtggcaggggctgtgaacagaggagacacagcatgtgccaccccaacctggcggcagcgcaaaagatg

SEQ ID NO: 108058 - DNA, 103 bp, Artificial Sequence
  Synthetic Polynucleotide
taatacgactcactatagggcagtggctcagggccaggggccggggtggcaacagaggagagccaccatggcccctggcaacctggcggcagcgcaaaagatg

SEQ ID NO: 108059 - DNA, 103 bp, Artificial Sequence
  Synthetic Polynucleotide
taatacgactcactatagggcaggaccgcccagtggctcagggccaggggaacagaggagacccctgatgctgagccacaacctggcggcagcgcaaaagatg

SEQ ID NO: 108060 - DNA, 103 bp, Artificial Sequence
  Synthetic Polynucleotide
taatacgactcactatagggtccgcgggctcaggaccgcccagtggctcaaacagaggagatgagccatggggcggtccaacctggcggcagcgcaaaagatg

SEQ ID NO: 108061 - DNA, 103 bp, Artificial Sequence
  Synthetic Polynucleotide
taatacgactcactataggggatttcctcaggtacatttttcttaaattcaacagaggagagaatttatgaaaaatgtaaacctggcggcagcgcaaaagatg

SEQ ID NO: 108062 - DNA, 103 bp, Artificial Sequence
  Synthetic Polynucleotide
taatacgactcactatagggcccaccaccatccgcgggctcaggaccgccaacagaggagaggcggtatggagcccgcgaacctggcggcagcgcaaaagatg

SEQ ID NO: 108063 - DNA, 103 bp, Artificial Sequence
  Synthetic Polynucleotide
taatacgactcactatagggccgctccgcccccaccaccatccgcgggctaacagaggagaagcccgatgatggtggtgaacctggcggcagcgcaaaagatg

SEQ ID NO: 108064 - DNA, 103 bp, Artificial Sequence
  Synthetic Polynucleotide
taatacgactcactatagggccgggccccgccgctccgcccccaccaccaaacagaggagatggtggatggggcggagcaacctggcggcagcgcaaaagatg

SEQ ID NO: 108065 - DNA, 103 bp, Artificial Sequence
  Synthetic Polynucleotide
taatacgactcactatagggctcctctgccccgggccccgccgctccgccaacagaggagaggcggaatggcggggcccaacctggcggcagcgcaaaagatg

SEQ ID NO: 108066 - DNA, 103 bp, Artificial Sequence
  Synthetic Polynucleotide
taatacgactcactatagggccagctgctcctcctctgccccgggccccgaacagaggagacggggcatggggcagaggaacctggcggcagcgcaaaagatg

SEQ ID NO: 108067 - DNA, 103 bp, Artificial Sequence
  Synthetic Polynucleotide
taatacgactcactatagggtctgccgtgtccagctgctcctcctctgccaacagaggagaggcagaatgggagcagctaacctggcggcagcgcaaaagatg

SEQ ID NO: 108068 - DNA, 103 bp, Artificial Sequence
  Synthetic Polynucleotide
taatacgactcactataggggaaggcgatctctgccgtgtccagctgctcaacagaggagagagcagatggacacggcaaacctggcggcagcgcaaaagatg

SEQ ID NO: 108069 - DNA, 103 bp, Artificial Sequence
  Synthetic Polynucleotide
taatacgactcactatagggccttcacctggaaggcgatctctgccgtgtaacagaggagaacacggatgagatcgcctaacctggcggcagcgcaaaagatg

SEQ ID NO: 108070 - DNA, 103 bp, Artificial Sequence
  Synthetic Polynucleotide
taatacgactcactatagggagcagctgctccttcacctggaaggcgatcaacagaggagagatcgcatgccaggtgaaaacctggcggcagcgcaaaagatg

SEQ ID NO: 108071 - DNA, 103 bp, Artificial Sequence
  Synthetic Polynucleotide
taatacgactcactataggggttgtgtttcagcagctgctccttcacctgaacagaggagacaggtgatggagcagctgaacctggcggcagcgcaaaagatg

SEQ ID NO: 108072 - DNA, 103 bp, Artificial Sequence
  Synthetic Polynucleotide
taatacgactcactatagggccatctctctgatttcctcaggtacattttaacagaggagaaaaatgatgctgaggaaaaacctggcggcagcgcaaaagatg

SEQ ID NO: 108073 - DNA, 103 bp, Artificial Sequence
  Synthetic Polynucleotide
taatacgactcactataggggctgcccgatgttgtgtttcagcagctgctaacagaggagaagcagcatgtgaaacacaaacctggcggcagcgcaaaagatg

SEQ ID NO: 108074 - DNA, 103 bp, Artificial Sequence
  Synthetic Polynucleotide
taatacgactcactatagggccaaacacccgctgcccgatgttgtgtttcaacagaggagagaaacaatgcatcgggcaaacctggcggcagcgcaaaagatg

SEQ ID NO: 108075 - DNA, 103 bp, Artificial Sequence
  Synthetic Polynucleotide
taatacgactcactatagggcacgtaatgcccaaacacccgctgcccgataacagaggagaatcgggatgcgggtgtttaacctggcggcagcgcaaaagatg

SEQ ID NO: 108076 - DNA, 103 bp, Artificial Sequence
  Synthetic Polynucleotide
taatacgactcactatagggacagccccagcacgtaatgcccaaacacccaacagaggagagggtgtatgggcattacgaacctggcggcagcgcaaaagatg

SEQ ID NO: 108077 - DNA, 103 bp, Artificial Sequence
  Synthetic Polynucleotide
taatacgactcactataggggagccctgcgacagccccagcacgtaatgcaacagaggagagcattaatggctggggctaacctggcggcagcgcaaaagatg

SEQ ID NO: 108078 - DNA, 103 bp, Artificial Sequence
  Synthetic Polynucleotide
taatacgactcactatagggctcgctgaccgagccctgcgacagccccagaacagaggagactggggatgtcgcagggcaacctggcggcagcgcaaaagatg

SEQ ID NO: 108079 - DNA, 103 bp, Artificial Sequence
  Synthetic Polynucleotide
taatacgactcactataggggggctaggatctcgctgaccgagccctgcgaacagaggagacgcaggatgcggtcagcgaacctggcggcagcgcaaaagatg

SEQ ID NO: 108080 - DNA, 103 bp, Artificial Sequence
  Synthetic Polynucleotide
taatacgactcactatagggggcttgggccgggctaggatctcgctgaccaacagaggagaggtcagatggatcctagcaacctggcggcagcgcaaaagatg

SEQ ID NO: 108081 - DNA, 103 bp, Artificial Sequence
  Synthetic Polynucleotide
taatacgactcactatagggcttgcgccagggcttgggccgggctaggataacagaggagaatcctaatgcggcccaagaacctggcggcagcgcaaaagatg

SEQ ID NO: 108082 - DNA, 103 bp, Artificial Sequence
  Synthetic Polynucleotide
taatacgactcactatagggtcaccgtgagcttgcgccagggcttgggccaacagaggagaggcccaatgcctggcgcaaacctggcggcagcgcaaaagatg

SEQ ID NO: 108083 - DNA, 103 bp, Artificial Sequence
  Synthetic Polynucleotide
taatacgactcactatagggacaggagccaccatctctctgatttcctcaaacagaggagatgaggaatgcagagagataacctggcggcagcgcaaaagatg

SEQ ID NO: 108084 - DNA, 103 bp, Artificial Sequence
  Synthetic Polynucleotide
taatacgactcactatagggtccttgcccttcaccgtgagcttgcgccagaacagaggagactggcgatggctcacggtaacctggcggcagcgcaaaagatg

SEQ ID NO: 108085 - DNA, 103 bp, Artificial Sequence
  Synthetic Polynucleotide
taatacgactcactataggggatgaagggctccttgcccttcaccgtgagaacagaggagactcacgatgaagggcaagaacctggcggcagcgcaaaagatg

SEQ ID NO: 108086 - DNA, 103 bp, Artificial Sequence
  Synthetic Polynucleotide
taatacgactcactataggggcttcatcttgatgaagggctccttgccctaacagaggagaagggcaatgagcccttcaaacctggcggcagcgcaaaagatg

SEQ ID NO: 108087 - DNA, 103 bp, Artificial Sequence
  Synthetic Polynucleotide
taatacgactcactataggggacaggaactgcttcatcttgatgaagggcaacagaggagagcccttatgcaagatgaaaacctggcggcagcgcaaaagatg

SEQ ID NO: 108088 - DNA, 103 bp, Artificial Sequence
  Synthetic Polynucleotide
taatacgactcactatagggctgctcatccgacaggaactgcttcatcttaacagaggagaaagatgatgcagttcctgaacctggcggcagcgcaaaagatg

SEQ ID NO: 108089 - DNA, 103 bp, Artificial Sequence
  Synthetic Polynucleotide
taatacgactcactatagggccagtacattctgctcatccgacaggaactaacagaggagaagttccatgcggatgagcaacctggcggcagcgcaaaagatg

SEQ ID NO: 108090 - DNA, 103 bp, Artificial Sequence
  Synthetic Polynucleotide
taatacgactcactataggggtcctgagcgccagtacattctgctcatccaacagaggagaggatgaatggaatgtactaacctggcggcagcgcaaaagatg

SEQ ID NO: 108091 - DNA, 103 bp, Artificial Sequence
  Synthetic Polynucleotide
taatacgactcactatagggcacttggatggtcctgagcgccagtacattaacagaggagaaatgtaatggcgctcaggaacctggcggcagcgcaaaagatg

SEQ ID NO: 108092 - DNA, 103 bp, Artificial Sequence
  Synthetic Polynucleotide
taatacgactcactatagggctcgctgccgcacttggatggtcctgagcgaacagaggagacgctcaatgccatccaagaacctggcggcagcgcaaaagatg

SEQ ID NO: 108093 - DNA, 103 bp, Artificial Sequence
  Synthetic Polynucleotide
taatacgactcactataggggtgatgctgcctcgctgccgcacttggatgaacagaggagacatccaatggcggcagcgaacctggcggcagcgcaaaagatg

SEQ ID NO: 108094 - DNA, 103 bp, Artificial Sequence
  Synthetic Polynucleotide
taatacgactcactataggggctttttaatacaggagccaccatctctctaacagaggagaagagagatggtggctcctaacctggcggcagcgcaaaagatg

SEQ ID NO: 108095 - DNA, 103 bp, Artificial Sequence
  Synthetic Polynucleotide
taatacgactcactataggggattctcggggtgatgctgcctcgctgccgaacagaggagacggcagatgggcagcatcaacctggcggcagcgcaaaagatg

SEQ ID NO: 108096 - DNA, 103 bp, Artificial Sequence
  Synthetic Polynucleotide
taatacgactcactatagggcaggcgtgcggattctcggggtgatgctgcaacagaggagagcagcaatgccccgagaaaacctggcggcagcgcaaaagatg

SEQ ID NO: 108097 - DNA, 103 bp, Artificial Sequence
  Synthetic Polynucleotide
taatacgactcactataggggagcctgtctcaggcgtgcggattctcgggaacagaggagacccgagatgccgcacgccaacctggcggcagcgcaaaagatg

SEQ ID NO: 108098 - DNA, 103 bp, Artificial Sequence
  Synthetic Polynucleotide
taatacgactcactatagggggcgtcgtctgagcctgtctcaggcgtgcgaacagaggagacgcacgatggagacaggcaacctggcggcagcgcaaaagatg

SEQ ID NO: 108099 - DNA, 103 bp, Artificial Sequence
  Synthetic Polynucleotide
taatacgactcactatagggtgctcttgatggcgtcgtctgagcctgtctaacagaggagaagacagatgcagacgacgaacctggcggcagcgcaaaagatg

SEQ ID NO: 108100 - DNA, 103 bp, Artificial Sequence
  Synthetic Polynucleotide
taatacgactcactatagggtgctctagaatgctcttgatggcgtcgtctaacagaggagaagacgaatgcatcaagagaacctggcggcagcgcaaaagatg

SEQ ID NO: 108101 - DNA, 103 bp, Artificial Sequence
  Synthetic Polynucleotide
taatacgactcactatagggcttcttggcctgctctagaatgctcttgataacagaggagaatcaagatgattctagagaacctggcggcagcgcaaaagatg

SEQ ID NO: 108102 - DNA, 103 bp, Artificial Sequence
  Synthetic Polynucleotide
taatacgactcactatagggactcgatctccttcttggcctgctctagaaaacagaggagattctagatgaggccaagaaacctggcggcagcgcaaaagatg

SEQ ID NO: 108103 - DNA, 103 bp, Artificial Sequence
  Synthetic Polynucleotide
taatacgactcactatagggcccttctgcgactcgatctccttcttggccaacagaggagaggccaaatgggagatcgaaacctggcggcagcgcaaaagatg

SEQ ID NO: 108104 - DNA, 103 bp, Artificial Sequence
  Synthetic Polynucleotide
taatacgactcactataggggggctcgccgcccttctgcgactcgatctcaacagaggagagagatcatgtcgcagaagaacctggcggcagcgcaaaagatg

SEQ ID NO: 108105 - DNA, 103 bp, Artificial Sequence
  Synthetic Polynucleotide
taatacgactcactataggggcttccaatattgaaacatcgatcccacataacagaggagaatgtggatgcgatgtttcaacctggcggcagcgcaaaagatg

SEQ ID NO: 108106 - DNA, 103 bp, Artificial Sequence
  Synthetic Polynucleotide
taatacgactcactatagggcggcttggaagctttttaatacaggagccaaacagaggagatggctcatgtattaaaaaaacctggcggcagcgcaaaagatg

SEQ ID NO: 108107 - DNA, 103 bp, Artificial Sequence
  Synthetic Polynucleotide
taatacgactcactatagggccgaggtcttgggctcgccgcccttctgcgaacagaggagacgcagaatggcggcgagcaacctggcggcagcgcaaaagatg

SEQ ID NO: 108108 - DNA, 103 bp, Artificial Sequence
  Synthetic Polynucleotide
taatacgactcactatagggagcggggccaccgaggtcttgggctcgccgaacagaggagacggcgaatgcaagacctcaacctggcggcagcgcaaaagatg

SEQ ID NO: 108109 - DNA, 103 bp, Artificial Sequence
  Synthetic Polynucleotide
taatacgactcactatagggggcgatgctcagcggggccaccgaggtcttaacagaggagaaagaccatggtggccccgaacctggcggcagcgcaaaagatg

SEQ ID NO: 108110 - DNA, 103 bp, Artificial Sequence
  Synthetic Polynucleotide
taatacgactcactatagggtcgtgccgttggcgatgctcagcggggccaaacagaggagatggcccatgtgagcatcgaacctggcggcagcgcaaaagatg

SEQ ID NO: 108111 - DNA, 103 bp, Artificial Sequence
  Synthetic Polynucleotide
taatacgactcactatagggctggcgggggtcgtgccgttggcgatgctcaacagaggagagagcatatgcaacggcacaacctggcggcagcgcaaaagatg

SEQ ID NO: 108112 - DNA, 103 bp, Artificial Sequence
  Synthetic Polynucleotide
taatacgactcactatagggctccgaggtgctggcgggggtcgtgccgttaacagaggagaaacggcatgacccccgccaacctggcggcagcgcaaaagatg

SEQ ID NO: 108113 - DNA, 103 bp, Artificial Sequence
  Synthetic Polynucleotide
taatacgactcactatagggtgatggcgtcctccgaggtgctggcgggggaacagaggagacccccgatggcacctcggaacctggcggcagcgcaaaagatg

SEQ ID NO: 108114 - DNA, 103 bp, Artificial Sequence
  Synthetic Polynucleotide
taatacgactcactatagggaggatgctcttgatggcgtcctccgaggtgaacagaggagacacctcatgggacgccataacctggcggcagcgcaaaagatg

SEQ ID NO: 108115 - DNA, 103 bp, Artificial Sequence
  Synthetic Polynucleotide
taatacgactcactatagggtgcctgctccaggatgctcttgatggcgtcaacagaggagagacgccatgaagagcatcaacctggcggcagcgcaaaagatg

SEQ ID NO: 108116 - DNA, 103 bp, Artificial Sequence
  Synthetic Polynucleotide
taatacgactcactatagggtctcacggcgtgcctgctccaggatgctctaacagaggagaagagcaatgtggagcaggaacctggcggcagcgcaaaagatg

SEQ ID NO: 108117 - DNA, 103 bp, Artificial Sequence
  Synthetic Polynucleotide
taatacgactcactataggggccaccacctcggcttggaagctttttaataacagaggagaattaaaatgcttccaagcaacctggcggcagcgcaaaagatg

SEQ ID NO: 108118 - DNA, 103 bp, Artificial Sequence
  Synthetic Polynucleotide
taatacgactcactatagggtgcgcctgcatctcacggcgtgcctgctccaacagaggagaggagcaatgacgccgtgaaacctggcggcagcgcaaaagatg

SEQ ID NO: 108119 - DNA, 103 bp, Artificial Sequence
  Synthetic Polynucleotide
taatacgactcactatagggcgcctgctgttgcgcctgcatctcacggcgaacagaggagacgccgtatgatgcaggcgaacctggcggcagcgcaaaagatg

SEQ ID NO: 108120 - DNA, 103 bp, Artificial Sequence
  Synthetic Polynucleotide
taatacgactcactatagggtctccagcagcgcctgctgttgcgcctgcaaacagaggagatgcaggatgaacagcaggaacctggcggcagcgcaaaagatg

SEQ ID NO: 108121 - DNA, 103 bp, Artificial Sequence
  Synthetic Polynucleotide
taatacgactcactataggggccacctccatctccagcagcgcctgctgtaacagaggagaacagcaatggctgctggaaacctggcggcagcgcaaaagatg

SEQ ID NO: 108122 - DNA, 103 bp, Artificial Sequence
  Synthetic Polynucleotide
taatacgactcactataggggcccctgggcgccacctccatctccagcagaacagaggagactgctgatgatggaggtgaacctggcggcagcgcaaaagatg

SEQ ID NO: 108123 - DNA, 103 bp, Artificial Sequence
  Synthetic Polynucleotide
taatacgactcactataggggcaccgagcggcccctgggcgccacctccaaacagaggagatggaggatgcgcccagggaacctggcggcagcgcaaaagatg

SEQ ID NO: 108124 - DNA, 103 bp, Artificial Sequence
  Synthetic Polynucleotide
taatacgactcactatagggggcgaggggggcaccgagcggcccctgggcaacagaggagagcccagatgccgctcggtaacctggcggcagcgcaaaagatg

SEQ ID NO: 108125 - DNA, 103 bp, Artificial Sequence
  Synthetic Polynucleotide
taatacgactcactatagggccgctccgggggcgaggggggcaccgagcgaacagaggagacgctcgatgcccccctcgaacctggcggcagcgcaaaagatg

SEQ ID NO: 108126 - DNA, 103 bp, Artificial Sequence
  Synthetic Polynucleotide
taatacgactcactatagggccagtgatggccgctccgggggcgagggggaacagaggagaccccctatgccccggagcaacctggcggcagcgcaaaagatg

SEQ ID NO: 108127 - DNA, 103 bp, Artificial Sequence
  Synthetic Polynucleotide
taatacgactcactatagggctcgcggtggccagtgatggccgctccgggaacagaggagacccggaatggccatcactaacctggcggcagcgcaaaagatg

SEQ ID NO: 108128 - DNA, 103 bp, Artificial Sequence
  Synthetic Polynucleotide
taatacgactcactatagggcttactaagggccaccacctcggcttggaaaacagaggagattccaaatggaggtggtgaacctggcggcagcgcaaaagatg

SEQ ID NO: 108129 - DNA, 103 bp, Artificial Sequence
  Synthetic Polynucleotide
taatacgactcactatagggcccgttctggctcgcggtggccagtgatggaacagaggagaccatcaatggccaccgcgaacctggcggcagcgcaaaagatg

SEQ ID NO: 108130 - DNA, 103 bp, Artificial Sequence
  Synthetic Polynucleotide
taatacgactcactatagggaggccggggccccgttctggctcgcggtggaacagaggagaccaccgatggccagaacgaacctggcggcagcgcaaaagatg

SEQ ID NO: 108131 - DNA, 103 bp, Artificial Sequence
  Synthetic Polynucleotide
taatacgactcactatagggtgcttcaccaaggccggggccccgttctggaacagaggagaccagaaatgggccccggcaacctggcggcagcgcaaaagatg

SEQ ID NO: 108132 - DNA, 103 bp, Artificial Sequence
  Synthetic Polynucleotide
taatacgactcactataggggccctcctcctgcttcaccaaggccggggcaacagaggagagccccgatgttggtgaagaacctggcggcagcgcaaaagatg

SEQ ID NO: 108133 - DNA, 103 bp, Artificial Sequence
  Synthetic Polynucleotide
taatacgactcactatagggggcccccgctgccctcctcctgcttcaccaaacagaggagatggtgaatgaggaggaggaacctggcggcagcgcaaaagatg

SEQ ID NO: 108134 - DNA, 103 bp, Artificial Sequence
  Synthetic Polynucleotide
taatacgactcactataggggcctgcgcggggcccccgctgccctcctccaacagaggagaggaggaatgcagcgggggaacctggcggcagcgcaaaagatg

SEQ ID NO: 108135 - DNA, 103 bp, Artificial Sequence
  Synthetic Polynucleotide
taatacgactcactatagggcgggagcggcgcctgcgcggggcccccgctaacagaggagaagcgggatgcccgcgcagaacctggcggcagcgcaaaagatg

SEQ ID NO: 108136 - DNA, 103 bp, Artificial Sequence
  Synthetic Polynucleotide
taatacgactcactataggggggacaggaccgggagcggcgcctgcgcggaacagaggagaccgcgcatgcgccgctccaacctggcggcagcgcaaaagatg

SEQ ID NO: 108137 - DNA, 103 bp, Artificial Sequence
  Synthetic Polynucleotide
taatacgactcactatagggaaggcggcgggggacaggaccgggagcggcaacagaggagagccgctatgggtcctgtcaacctggcggcagcgcaaaagatg

SEQ ID NO: 108138 - DNA, 103 bp, Artificial Sequence
  Synthetic Polynucleotide
taatacgactcactataggggctctgcacgaaggcggcgggggacaggacaacagaggagagtcctgatgcccgccgccaacctggcggcagcgcaaaagatg

SEQ ID NO: 108139 - DNA, 103 bp, Artificial Sequence
  Synthetic Polynucleotide
taatacgactcactatagggcctgacttctcttactaagggccaccacctaacagaggagaaggtggatgcccttagtaaacctggcggcagcgcaaaagatg

SEQ ID NO: 108140 - DNA, 103 bp, Artificial Sequence
  Synthetic Polynucleotide
taatacgactcactatagggtgcggatgatgctctgcacgaaggcggcggaacagaggagaccgccgatgtcgtgcagaaacctggcggcagcgcaaaagatg

SEQ ID NO: 108141 - DNA, 103 bp, Artificial Sequence
  Synthetic Polynucleotide
taatacgactcactataggggacttgaccttgcggatgatgctctgcacgaacagaggagacgtgcaatgcatcatccgaacctggcggcagcgcaaaagatg

SEQ ID NO: 108142 - DNA, 103 bp, Artificial Sequence
  Synthetic Polynucleotide
taatacgactcactataggggccgatctcggacttgaccttgcggatgataacagaggagaatcatcatgaaggtcaagaacctggcggcagcgcaaaagatg

SEQ ID NO: 108143 - DNA, 103 bp, Artificial Sequence
  Synthetic Polynucleotide
taatacgactcactatagggagccggcgtcgccgatctcggacttgacctaacagaggagaaggtcaatgccgagatcgaacctggcggcagcgcaaaagatg

SEQ ID NO: 108144 - DNA, 103 bp, Artificial Sequence
  Synthetic Polynucleotide
taatacgactcactatagggtggtcgaagtagccggcgtcgccgatctcgaacagaggagacgagatatgcgacgccggaacctggcggcagcgcaaaagatg

SEQ ID NO: 108145 - DNA, 103 bp, Artificial Sequence
  Synthetic Polynucleotide
taatacgactcactatagggggcccagtggtggtcgaagtagccggcgtcaacagaggagagacgccatgtacttcgacaacctggcggcagcgcaaaagatg

SEQ ID NO: 108146 - DNA, 103 bp, Artificial Sequence
  Synthetic Polynucleotide
taatacgactcactatagggcgcggtcggaggcccagtggtggtcgaagtaacagaggagaacttcgatgaccactgggaacctggcggcagcgcaaaagatg

SEQ ID NO: 108147 - DNA, 103 bp, Artificial Sequence
  Synthetic Polynucleotide
taatacgactcactatagggctgagcaggccgcggtcggaggcccagtggaacagaggagaccactgatgctccgaccgaacctggcggcagcgcaaaagatg

SEQ ID NO: 108148 - DNA, 103 bp, Artificial Sequence
  Synthetic Polynucleotide
taatacgactcactataggggtaggggcggctgagcaggccgcggtcggaaacagaggagatccgacatgggcctgctcaacctggcggcagcgcaaaagatg

SEQ ID NO: 108149 - DNA, 103 bp, Artificial Sequence
  Synthetic Polynucleotide
taatacgactcactatagggacacggaggcgtaggggcggctgagcaggcaacagaggagagcctgcatggccgcccctaacctggcggcagcgcaaaagatg

SEQ ID NO: 108150 - DNA, 103 bp, Artificial Sequence
  Synthetic Polynucleotide
taatacgactcactataggggcctccgcctcctgacttctcttactaaggaacagaggagaccttagatggagaagtcaaacctggcggcagcgcaaaagatg

SEQ ID NO: 108151 - DNA, 103 bp, Artificial Sequence
  Synthetic Polynucleotide
taatacgactcactatagggagcgagggcgacacggaggcgtaggggcggaacagaggagaccgcccatgcgcctccgtaacctggcggcagcgcaaaagatg

SEQ ID NO: 108152 - DNA, 103 bp, Artificial Sequence
  Synthetic Polynucleotide
taatacgactcactatagggggaggaggacagcgagggcgacacggaggcaacagaggagagcctccatgtcgccctcgaacctggcggcagcgcaaaagatg

SEQ ID NO: 108153 - DNA, 103 bp, Artificial Sequence
  Synthetic Polynucleotide
taatacgactcactatagggcagaggaggaggaggaggacagcgagggcgaacagaggagacgccctatgtgtcctcctaacctggcggcagcgcaaaagatg

SEQ ID NO: 108154 - DNA, 103 bp, Artificial Sequence
  Synthetic Polynucleotide
taatacgactcactatagggccagagtagccagaggaggaggaggaggacaacagaggagagtcctcatgctcctcctcaacctggcggcagcgcaaaagatg

SEQ ID NO: 108155 - DNA, 103 bp, Artificial Sequence
  Synthetic Polynucleotide
taatacgactcactataggggttgggctggccagagtagccagaggaggaaacagaggagatcctccatgggctactctaacctggcggcagcgcaaaagatg

SEQ ID NO: 108156 - DNA, 103 bp, Artificial Sequence
  Synthetic Polynucleotide
taatacgactcactatagggaggcgcggccgttgggctggccagagtagcaacagaggagagctactatggccagcccaaacctggcggcagcgcaaaagatg

SEQ ID NO: 108157 - DNA, 103 bp, Artificial Sequence
  Synthetic Polynucleotide
taatacgactcactatagggccgcggggccaggcgcggccgttgggctggaacagaggagaccagccatgcggccgcgcaacctggcggcagcgcaaaagatg

SEQ ID NO: 108158 - DNA, 103 bp, Artificial Sequence
  Synthetic Polynucleotide
taatacgactcactatagggggcctcgtccccgcggggccaggcgcggccaacagaggagaggccgcatgtggccccgcaacctggcggcagcgcaaaagatg

SEQ ID NO: 108159 - DNA, 103 bp, Artificial Sequence
  Synthetic Polynucleotide
taatacgactcactatagggggggcacaggggcctcgtccccgcggggccaacagaggagaggccccatggggacgaggaacctggcggcagcgcaaaagatg

SEQ ID NO: 108160 - DNA, 103 bp, Artificial Sequence
  Synthetic Polynucleotide
taatacgactcactatagggtcgtcctcggggggcacaggggcctcgtccaacagaggagaggacgaatgccctgtgccaacctggcggcagcgcaaaagatg

SEQ ID NO: 108161 - DNA, 103 bp, Artificial Sequence
  Synthetic Polynucleotide
taatacgactcactatagggcagaaaagcagcctccgcctcctgacttctaacagaggagaagaagtatggaggcggagaacctggcggcagcgcaaaagatg

SEQ ID NO: 108162 - DNA, 103 bp, Artificial Sequence
  Synthetic Polynucleotide
taatacgactcactatagggtgccgccgcctcgtcctcggggggcacaggaacagaggagacctgtgatgcccgaggacaacctggcggcagcgcaaaagatg

SEQ ID NO: 108163 - DNA, 103 bp, Artificial Sequence
  Synthetic Polynucleotide
taatacgactcactatagggcctccgcccctgccgccgcctcgtcctcggaacagaggagaccgaggatgaggcggcggaacctggcggcagcgcaaaagatg

SEQ ID NO: 108164 - DNA, 103 bp, Artificial Sequence
  Synthetic Polynucleotide
taatacgactcactataggggggggttcgtcctccgcccctgccgccgccaacagaggagaggcggcatgaggggcggaaacctggcggcagcgcaaaagatg

SEQ ID NO: 108165 - DNA, 103 bp, Artificial Sequence
  Synthetic Polynucleotide
taatacgactcactataggggcccgtcctggggggttcgtcctccgccccaacagaggagaggggcgatggacgaacccaacctggcggcagcgcaaaagatg

SEQ ID NO: 108166 - DNA, 103 bp, Artificial Sequence
  Synthetic Polynucleotide
taatacgactcactatagggccttgagctcgcccgtcctggggggttcgtaacagaggagaacgaacatgccaggacggaacctggcggcagcgcaaaagatg

SEQ ID NO: 108167 - DNA, 103 bp, Artificial Sequence
  Synthetic Polynucleotide
taatacgactcactataggggcgccctcagccttgagctcgcccgtcctgaacagaggagacaggacatgcgagctcaaaacctggcggcagcgcaaaagatg

SEQ ID NO: 108168 - DNA, 103 bp, Artificial Sequence
  Synthetic Polynucleotide
taatacgactcactatagggctcggccgtcgcgccctcagccttgagctcaacagaggagagagctcatggctgagggcaacctggcggcagcgcaaaagatg

SEQ ID NO: 108169 - DNA, 103 bp, Artificial Sequence
  Synthetic Polynucleotide
taatacgactcactataggggcgcgcccgcctcggccgtcgcgccctcagaacagaggagactgaggatgcgacggccgaacctggcggcagcgcaaaagatg

SEQ ID NO: 108170 - DNA, 103 bp, Artificial Sequence
  Synthetic Polynucleotide
taatacgactcactatagggtagggcagccgcgcgcccgcctcggccgtcaacagaggagagacggcatgggcgggcgcaacctggcggcagcgcaaaagatg

SEQ ID NO: 108171 - DNA, 103 bp, Artificial Sequence
  Synthetic Polynucleotide
taatacgactcactatagggggccgggtagtagggcagccgcgcgcccgcaacagaggagagcgggcatgcggctgcccaacctggcggcagcgcaaaagatg

SEQ ID NO: 108172 - DNA, 103 bp, Artificial Sequence
  Synthetic Polynucleotide
taatacgactcactatagggtgtaaacactcagaaaagcagcctccgcctaacagaggagaaggcggatgctgcttttcaacctggcggcagcgcaaaagatg

SEQ ID NO: 108173 - DNA, 103 bp, Artificial Sequence
  Synthetic Polynucleotide
taatacgactcactataggggcggcacgtaggccgggtagtagggcagccaacagaggagaggctgcatgactacccggaacctggcggcagcgcaaaagatg

SEQ ID NO: 108174 - DNA, 103 bp, Artificial Sequence
  Synthetic Polynucleotide
taatacgactcactatagggttcagggtgcgcggcacgtaggccgggtagaacagaggagactacccatgctacgtgccaacctggcggcagcgcaaaagatg

SEQ ID NO: 108175 - DNA, 103 bp, Artificial Sequence
  Synthetic Polynucleotide
taatacgactcactatagggcacggtgggcttcagggtgcgcggcacgtaaacagaggagatacgtgatgcgcaccctgaacctggcggcagcgcaaaagatg

SEQ ID NO: 108176 - DNA, 103 bp, Artificial Sequence
  Synthetic Polynucleotide
taatacgactcactatagggtcagcggcggcacggtgggcttcagggtgcaacagaggagagcacccatgagcccaccgaacctggcggcagcgcaaaagatg

SEQ ID NO: 108177 - DNA, 103 bp, Artificial Sequence
  Synthetic Polynucleotide
taatacgactcactatagggtgctcgggggtcagcggcggcacggtgggcaacagaggagagcccacatggccgccgctaacctggcggcagcgcaaaagatg

SEQ ID NO: 108178 - DNA, 103 bp, Artificial Sequence
  Synthetic Polynucleotide
taatacgactcactatagggcagctcgtactgctcgggggtcagcggcggaacagaggagaccgccgatgacccccgagaacctggcggcagcgcaaaagatg

SEQ ID NO: 108179 - DNA, 103 bp, Artificial Sequence
  Synthetic Polynucleotide
taatacgactcactatagggggtacatgtacagctcgtactgctcgggggaacagaggagacccccgatgagtacgagcaacctggcggcagcgcaaaagatg

SEQ ID NO: 108180 - DNA, 103 bp, Artificial Sequence
  Synthetic Polynucleotide
taatacgactcactatagggtctacctcacggtacatgtacagctcgtacaacagaggagagtacgaatggtacatgtaaacctggcggcagcgcaaaagatg

SEQ ID NO: 108181 - DNA, 103 bp, Artificial Sequence
  Synthetic Polynucleotide
taatacgactcactatagggctccagcgtgtctacctcacggtacatgtaaacagaggagatacatgatgcgtgaggtaaacctggcggcagcgcaaaagatg

SEQ ID NO: 108182 - DNA, 103 bp, Artificial Sequence
  Synthetic Polynucleotide
taatacgactcactatagggggcgggtgagctccagcgtgtctacctcacaacagaggagagtgaggatgacacgctggaacctggcggcagcgcaaaagatg

SEQ ID NO: 108183 - DNA, 103 bp, Artificial Sequence
  Synthetic Polynucleotide
taatacgactcactatagggattaattgcttgtaaacactcagaaaagcaaacagaggagatgctttatggagtgtttaaacctggcggcagcgcaaaagatg

SEQ ID NO: 108184 - DNA, 103 bp, Artificial Sequence
  Synthetic Polynucleotide
taatacgactcactatagggtccttgacctggcgggtgagctccagcgtgaacagaggagacacgctatggctcacccgaacctggcggcagcgcaaaagatg

SEQ ID NO: 108185 - DNA, 103 bp, Artificial Sequence
  Synthetic Polynucleotide
taatacgactcactatagggggccagcttctccttgacctggcgggtgagaacagaggagactcaccatgcaggtcaagaacctggcggcagcgcaaaagatg

SEQ ID NO: 108186 - DNA, 103 bp, Artificial Sequence
  Synthetic Polynucleotide
taatacgactcactatagggtgccgttcttggccagcttctccttgacctaacagaggagaaggtcaatgagaagctggaacctggcggcagcgcaaaagatg

SEQ ID NO: 108187 - DNA, 103 bp, Artificial Sequence
  Synthetic Polynucleotide
taatacgactcactatagggctctggcagatgccgttcttggccagcttcaacagaggagagaagctatgcaagaacggaacctggcggcagcgcaaaagatg

SEQ ID NO: 108188 - DNA, 103 bp, Artificial Sequence
  Synthetic Polynucleotide
taatacgactcactatagggcccgaagatcctctggcagatgccgttcttaacagaggagaaagaacatgatctgccagaacctggcggcagcgcaaaagatg

SEQ ID NO: 108189 - DNA, 103 bp, Artificial Sequence
  Synthetic Polynucleotide
taatacgactcactataggggcaccttctccccgaagatcctctggcagaaacagaggagatctgccatgggatcttcgaacctggcggcagcgcaaaagatg

SEQ ID NO: 108190 - DNA, 103 bp, Artificial Sequence
  Synthetic Polynucleotide
taatacgactcactataggggacaggcccagcaccttctccccgaagatcaacagaggagagatcttatgggagaaggtaacctggcggcagcgcaaaagatg

SEQ ID NO: 108191 - DNA, 103 bp, Artificial Sequence
  Synthetic Polynucleotide
taatacgactcactataggggctgccctgtgacaggcccagcaccttctcaacagaggagagagaagatgctgggcctgaacctggcggcagcgcaaaagatg

SEQ ID NO: 108192 - DNA, 103 bp, Artificial Sequence
  Synthetic Polynucleotide
taatacgactcactatagggtgtcgctcacgctgccctgtgacaggcccaaacagaggagatgggccatgcacagggcaaacctggcggcagcgcaaaagatg

SEQ ID NO: 108193 - DNA, 103 bp, Artificial Sequence
  Synthetic Polynucleotide
taatacgactcactatagggcgggacagcatgtcgctcacgctgccctgtaacagaggagaacagggatgcgtgagcgaaacctggcggcagcgcaaaagatg

SEQ ID NO: 108194 - DNA, 103 bp, Artificial Sequence
  Synthetic Polynucleotide
taatacgactcactatagggtggtgcttcaattaattgcttgtaaacactaacagaggagaagtgttatgaagcaattaaacctggcggcagcgcaaaagatg

SEQ ID NO: 108195 - DNA, 103 bp, Artificial Sequence
  Synthetic Polynucleotide
taatacgactcactatagggtggcttcggccgggacagcatgtcgctcacaacagaggagagtgagcatgatgctgtccaacctggcggcagcgcaaaagatg

SEQ ID NO: 108196 - DNA, 103 bp, Artificial Sequence
  Synthetic Polynucleotide
taatacgactcactataggggcttgctccatggcttcggccgggacagcaaacagaggagatgctgtatgggccgaagcaacctggcggcagcgcaaaagatg

SEQ ID NO: 108197 - DNA, 103 bp, Artificial Sequence
  Synthetic Polynucleotide
taatacgactcactatagggttctgcgtcagcttgctccatggcttcggcaacagaggagagccgaaatgatggagcaaaacctggcggcagcgcaaaagatg

SEQ ID NO: 108198 - DNA, 103 bp, Artificial Sequence
  Synthetic Polynucleotide
taatacgactcactatagggctcccgccccttctgcgtcagcttgctccaaacagaggagatggagcatgctgacgcagaacctggcggcagcgcaaaagatg

SEQ ID NO: 108199 - DNA, 103 bp, Artificial Sequence
  Synthetic Polynucleotide
taatacgactcactatagggggatgaagggctcccgccccttctgcgtcaaacagaggagatgacgcatgaggggcgggaacctggcggcagcgcaaaagatg

SEQ ID NO: 108200 - DNA, 103 bp, Artificial Sequence
  Synthetic Polynucleotide
taatacgactcactatagggagctgcatgcggatgaagggctcccgccccaacagaggagaggggcgatggcccttcataacctggcggcagcgcaaaagatg

SEQ ID NO: 108201 - DNA, 103 bp, Artificial Sequence
  Synthetic Polynucleotide
taatacgactcactatagggagagagccacagctgcatgcggatgaagggaacagaggagacccttcatgcgcatgcagaacctggcggcagcgcaaaagatg

SEQ ID NO: 108202 - DNA, 103 bp, Artificial Sequence
  Synthetic Polynucleotide
taatacgactcactatagggcgagctggtcagagagccacagctgcatgcaacagaggagagcatgcatgtgtggctctaacctggcggcagcgcaaaagatg

SEQ ID NO: 108203 - DNA, 103 bp, Artificial Sequence
  Synthetic Polynucleotide
taatacgactcactatagggactgcctggccgagctggtcagagagccacaacagaggagagtggctatgtgaccagctaacctggcggcagcgcaaaagatg

SEQ ID NO: 108204 - DNA, 103 bp, Artificial Sequence
  Synthetic Polynucleotide
taatacgactcactatagggctgctggcccactgcctggccgagctggtcaacagaggagagaccagatgggccaggcaaacctggcggcagcgcaaaagatg

SEQ ID NO: 108205 - DNA, 103 bp, Artificial Sequence
  Synthetic Polynucleotide
taatacgactcactataggggcacggggtctggtgcttcaattaattgctaacagaggagaagcaatatgttgaagcacaacctggcggcagcgcaaaagatg

SEQ ID NO: 108206 - DNA, 103 bp, Artificial Sequence
  Synthetic Polynucleotide
taatacgactcactatagggaggcaccaggctgctggcccactgcctggcaacagaggagagccaggatgtgggccagcaacctggcggcagcgcaaaagatg

SEQ ID NO: 108207 - DNA, 103 bp, Artificial Sequence
  Synthetic Polynucleotide
taatacgactcactatagggctggcctgggaggcaccaggctgctggcccaacagaggagagggccaatggcctggtgcaacctggcggcagcgcaaaagatg

SEQ ID NO: 108208 - DNA, 103 bp, Artificial Sequence
  Synthetic Polynucleotide
taatacgactcactatagggttctgtgggactggcctgggaggcaccaggaacagaggagacctggtatgtcccaggccaacctggcggcagcgcaaaagatg

SEQ ID NO: 108209 - DNA, 103 bp, Artificial Sequence
  Synthetic Polynucleotide
taatacgactcactatagggaggaccttggttctgtgggactggcctgggaacagaggagacccaggatggtcccacagaacctggcggcagcgcaaaagatg

SEQ ID NO: 108210 - DNA, 103 bp, Artificial Sequence
  Synthetic Polynucleotide
taatacgactcactatagggggggatggtgaggaccttggttctgtgggaaacagaggagatcccacatgaccaaggtcaacctggcggcagcgcaaaagatg

SEQ ID NO: 108211 - DNA, 103 bp, Artificial Sequence
  Synthetic Polynucleotide
taatacgactcactataggggctggggggtggggatggtgaggaccttggaacagaggagaccaaggatgtcaccatccaacctggcggcagcgcaaaagatg

SEQ ID NO: 108212 - DNA, 103 bp, Artificial Sequence
  Synthetic Polynucleotide
taatacgactcactataggggctctgtggggctggggggtggggatggtgaacagaggagacaccatatgcaccccccaaacctggcggcagcgcaaaagatg

SEQ ID NO: 108213 - DNA, 103 bp, Artificial Sequence
  Synthetic Polynucleotide
taatacgactcactatagggctcttctcaggctctgtggggctggggggtaacagaggagaacccccatgccccacagaaacctggcggcagcgcaaaagatg

SEQ ID NO: 108214 - DNA, 103 bp, Artificial Sequence
  Synthetic Polynucleotide
taatacgactcactatagggctcctgggagctcttctcaggctctgtgggaacagaggagacccacaatgcctgagaagaacctggcggcagcgcaaaagatg

SEQ ID NO: 108215 - DNA, 103 bp, Artificial Sequence
  Synthetic Polynucleotide
taatacgactcactatagggggctcaacggctcctgggagctcttctcagaacagaggagactgagaatggctcccaggaacctggcggcagcgcaaaagatg

SEQ ID NO: 108216 - DNA, 103 bp, Artificial Sequence
  Synthetic Polynucleotide
taatacgactcactatagggagatcaaatcgcttccaatattgaaacatcaacagaggagagatgttatgatattggaaaacctggcggcagcgcaaaagatg

SEQ ID NO: 108217 - DNA, 103 bp, Artificial Sequence
  Synthetic Polynucleotide
taatacgactcactatagggtcaaacacaggcacggggtctggtgcttcaaacagaggagatgaagcatgagaccccgtaacctggcggcagcgcaaaagatg

SEQ ID NO: 108218 - DNA, 103 bp, Artificial Sequence
  Synthetic Polynucleotide
taatacgactcactatagggtccagggacaggctcaacggctcctgggagaacagaggagactcccaatggccgttgagaacctggcggcagcgcaaaagatg

SEQ ID NO: 108219 - DNA, 103 bp, Artificial Sequence
  Synthetic Polynucleotide
taatacgactcactatagggcttgctgctctccagggacaggctcaacggaacagaggagaccgttgatgctgtccctgaacctggcggcagcgcaaaagatg

SEQ ID NO: 108220 - DNA, 103 bp, Artificial Sequence
  Synthetic Polynucleotide
taatacgactcactataggggctggttctccttgctgctctccagggacaaacagaggagatgtcccatgagagcagcaaacctggcggcagcgcaaaagatg

SEQ ID NO: 108221 - DNA, 103 bp, Artificial Sequence
  Synthetic Polynucleotide
taatacgactcactatagggccctctggctgctggttctccttgctgctcaacagaggagagagcagatgggagaaccaaacctggcggcagcgcaaaagatg

SEQ ID NO: 108222 - DNA, 103 bp, Artificial Sequence
  Synthetic Polynucleotide
taatacgactcactataggggctggagcggccctctggctgctggttctcaacagaggagagagaacatgcagccagagaacctggcggcagcgcaaaagatg

SEQ ID NO: 108223 - DNA, 103 bp, Artificial Sequence
  Synthetic Polynucleotide
taatacgactcactatagggtcaacgaggagctggagcggccctctggctaacagaggagaagccagatggccgctccaaacctggcggcagcgcaaaagatg

SEQ ID NO: 108224 - DNA, 103 bp, Artificial Sequence
  Synthetic Polynucleotide
taatacgactcactatagggatcttcccgctcaacgaggagctggagcggaacagaggagaccgctcatgctcctcgttaacctggcggcagcgcaaaagatg

SEQ ID NO: 108225 - DNA, 103 bp, Artificial Sequence
  Synthetic Polynucleotide
taatacgactcactataggggcctgagtacatcttcccgctcaacgaggaaacagaggagatcctcgatgagcgggaagaacctggcggcagcgcaaaagatg

SEQ ID NO: 108226 - DNA, 103 bp, Artificial Sequence
  Synthetic Polynucleotide
taatacgactcactataggggggcctggctgcctgagtacatcttcccgcaacagaggagagcgggaatgtgtactcagaacctggcggcagcgcaaaagatg

SEQ ID NO: 108227 - DNA, 103 bp, Artificial Sequence
  Synthetic Polynucleotide
taatacgactcactatagggatgccccctggggcctggctgcctgagtacaacagaggagagtactcatgcagccaggcaacctggcggcagcgcaaaagatg

SEQ ID NO: 108228 - DNA, 103 bp, Artificial Sequence
  Synthetic Polynucleotide
taatacgactcactataggggcgtgccgcctcaaacacaggcacggggtcaacagaggagagaccccatgcctgtgtttaacctggcggcagcgcaaaagatg

SEQ ID NO: 108229 - DNA, 103 bp, Artificial Sequence
  Synthetic Polynucleotide
taatacgactcactataggggatctcctggatgccccctggggcctggctaacagaggagaagccagatgccagggggcaacctggcggcagcgcaaaagatg

SEQ ID NO: 108230 - DNA, 103 bp, Artificial Sequence
  Synthetic Polynucleotide
taatacgactcactatagggacatggccacgatctcctggatgccccctgaacagaggagacaggggatgtccaggagaaacctggcggcagcgcaaaagatg

SEQ ID NO: 108231 - DNA, 103 bp, Artificial Sequence
  Synthetic Polynucleotide
taatacgactcactatagggagctcgggggacatggccacgatctcctggaacagaggagaccaggaatgcgtggccataacctggcggcagcgcaaaagatg

SEQ ID NO: 108232 - DNA, 103 bp, Artificial Sequence
  Synthetic Polynucleotide
taatacgactcactataggggtacgtgtccagctcgggggacatggccacaacagaggagagtggccatgtcccccgagaacctggcggcagcgcaaaagatg

SEQ ID NO: 108233 - DNA, 103 bp, Artificial Sequence
  Synthetic Polynucleotide
taatacgactcactatagggtggtgatggagtacgtgtccagctcgggggaacagaggagacccccgatgtggacacgtaacctggcggcagcgcaaaagatg

SEQ ID NO: 108234 - DNA, 103 bp, Artificial Sequence
  Synthetic Polynucleotide
taatacgactcactatagggttcaccctcttggtgatggagtacgtgtccaacagaggagaggacacatgctccatcacaacctggcggcagcgcaaaagatg

SEQ ID NO: 108235 - DNA, 103 bp, Artificial Sequence
  Synthetic Polynucleotide
taatacgactcactataggggaggacctccttcaccctcttggtgatggaaacagaggagatccatcatgaagagggtgaacctggcggcagcgcaaaagatg

SEQ ID NO: 108236 - DNA, 103 bp, Artificial Sequence
  Synthetic Polynucleotide
taatacgactcactatagggtgttgtctgtgaggacctccttcaccctctaacagaggagaagagggatgaggaggtccaacctggcggcagcgcaaaagatg

SEQ ID NO: 108237 - DNA, 103 bp, Artificial Sequence
  Synthetic Polynucleotide
taatacgactcactatagggtgccctagattgttgtctgtgaggacctccaacagaggagaggaggtatgcacagacaaaacctggcggcagcgcaaaagatg

SEQ ID NO: 108238 - DNA, 103 bp, Artificial Sequence
  Synthetic Polynucleotide
taatacgactcactatagggaaacagccgctgccctagattgttgtctgtaacagaggagaacagacatgaatctagggaacctggcggcagcgcaaaagatg

SEQ ID NO: 108239 - DNA, 103 bp, Artificial Sequence
  Synthetic Polynucleotide
taatacgactcactatagggcgtctaggctgcgtgccgcctcaaacacagaacagaggagactgtgtatgaggcggcacaacctggcggcagcgcaaaagatg

SEQ ID NO: 108240 - DNA, 103 bp, Artificial Sequence
  Synthetic Polynucleotide
taatacgactcactatagggtgctttccccaaacagccgctgccctagataacagaggagaatctagatgagcggctgtaacctggcggcagcgcaaaagatg

SEQ ID NO: 108241 - DNA, 103 bp, Artificial Sequence
  Synthetic Polynucleotide
taatacgactcactatagggagacccaggatgctttccccaaacagccgcaacagaggagagcggctatgtggggaaagaacctggcggcagcgcaaaagatg

SEQ ID NO: 108242 - DNA, 103 bp, Artificial Sequence
  Synthetic Polynucleotide
taatacgactcactataggggccctgtgtcagacccaggatgctttccccaacagaggagaggggaaatgatcctgggtaacctggcggcagcgcaaaagatg

SEQ ID NO: 108243 - DNA, 103 bp, Artificial Sequence
  Synthetic Polynucleotide
taatacgactcactatagggcagacacggagccctgtgtcagacccaggaaacagaggagatcctggatgtgacacaggaacctggcggcagcgcaaaagatg

SEQ ID NO: 108244 - DNA, 103 bp, Artificial Sequence
  Synthetic Polynucleotide
taatacgactcactataggggacagcaggtcagacacggagccctgtgtcaacagaggagagacacaatgctccgtgtcaacctggcggcagcgcaaaagatg

SEQ ID NO: 108245 - DNA, 103 bp, Artificial Sequence
  Synthetic Polynucleotide
taatacgactcactatagggtttgggccgggacagcaggtcagacacggaaacagaggagatccgtgatggacctgctgaacctggcggcagcgcaaaagatg

SEQ ID NO: 108246 - DNA, 103 bp, Artificial Sequence
  Synthetic Polynucleotide
taatacgactcactatagggtgtgccagggtttgggccgggacagcaggtaacagaggagaacctgcatgcccggcccaaacctggcggcagcgcaaaagatg

SEQ ID NO: 108247 - DNA, 103 bp, Artificial Sequence
  Synthetic Polynucleotide
taatacgactcactatagggaggctcagcttgtgccagggtttgggccggaacagaggagaccggccatgaccctggcaaacctggcggcagcgcaaaagatg

SEQ ID NO: 108248 - DNA, 103 bp, Artificial Sequence
  Synthetic Polynucleotide
taatacgactcactatagggccgccccttcaggctcagcttgtgccagggaacagaggagaccctggatgaagctgagcaacctggcggcagcgcaaaagatg

SEQ ID NO: 108249 - DNA, 103 bp, Artificial Sequence
  Synthetic Polynucleotide
taatacgactcactatagggcaaaaggctcccgccccttcaggctcagctaacagaggagaagctgaatgtgaaggggcaacctggcggcagcgcaaaagatg

SEQ ID NO: 108250 - DNA, 103 bp, Artificial Sequence
  Synthetic Polynucleotide
taatacgactcactatagggtgcagtctgtcgtctaggctgcgtgccgccaacagaggagaggcggcatgcagcctagaaacctggcggcagcgcaaaagatg

SEQ ID NO: 108251 - DNA, 103 bp, Artificial Sequence
  Synthetic Polynucleotide
taatacgactcactatagggtgcatgcggacaaaaggctcccgccccttcaacagaggagagaagggatgggagcctttaacctggcggcagcgcaaaagatg

SEQ ID NO: 108252 - DNA, 103 bp, Artificial Sequence
  Synthetic Polynucleotide
taatacgactcactataggggagccacagctgcatgcggacaaaaggctcaacagaggagagagcctatggtccgcatgaacctggcggcagcgcaaaagatg

SEQ ID NO: 108253 - DNA, 103 bp, Artificial Sequence
  Synthetic Polynucleotide
taatacgactcactataggggggggtcattgagccacagctgcatgcggaaacagaggagatccgcaatgagctgtggcaacctggcggcagcgcaaaagatg

SEQ ID NO: 108254 - DNA, 103 bp, Artificial Sequence
  Synthetic Polynucleotide
taatacgactcactatagggtccacgttatgggggtcattgagccacagcaacagaggagagctgtgatgcaatgacccaacctggcggcagcgcaaaagatg

SEQ ID NO: 108255 - DNA, 103 bp, Artificial Sequence
  Synthetic Polynucleotide
taatacgactcactatagggcctcagcttctccacgttatgggggtcattaacagaggagaaatgacatgcataacgtgaacctggcggcagcgcaaaagatg

SEQ ID NO: 108256 - DNA, 103 bp, Artificial Sequence
  Synthetic Polynucleotide
taatacgactcactatagggtcttcatatccctcagcttctccacgttataacagaggagaataacgatgagaagctgaaacctggcggcagcgcaaaagatg

SEQ ID NO: 108257 - DNA, 103 bp, Artificial Sequence
  Synthetic Polynucleotide
taatacgactcactatagggttctccagcttcttcatatccctcagcttcaacagaggagagaagctatgggatatgaaaacctggcggcagcgcaaaagatg

SEQ ID NO: 108258 - DNA, 103 bp, Artificial Sequence
  Synthetic Polynucleotide
taatacgactcactataggggtaggctttcttctccagcttcttcatatcaacagaggagagatatgatgaagctggagaacctggcggcagcgcaaaagatg

SEQ ID NO: 108259 - DNA, 103 bp, Artificial Sequence
  Synthetic Polynucleotide
taatacgactcactataggggacgtttcaggtaggctttcttctccagctaacagaggagaagctggatgagaaagcctaacctggcggcagcgcaaaagatg

SEQ ID NO: 108260 - DNA, 103 bp, Artificial Sequence
  Synthetic Polynucleotide
taatacgactcactatagggaggccatagcgacgtttcaggtaggctttcaacagaggagagaaagcatgcctgaaacgaacctggcggcagcgcaaaagatg

SEQ ID NO: 108261 - DNA, 103 bp, Artificial Sequence
  Synthetic Polynucleotide
taatacgactcactataggggctggggggctgcagtctgtcgtctaggctaacagaggagaagcctaatggacagactgaacctggcggcagcgcaaaagatg

SEQ ID NO: 108262 - DNA, 103 bp, Artificial Sequence
  Synthetic Polynucleotide
taatacgactcactatagggggtgctgatgaggccatagcgacgtttcagaacagaggagactgaaaatgcgctatggcaacctggcggcagcgcaaaagatg

SEQ ID NO: 108263 - DNA, 103 bp, Artificial Sequence
  Synthetic Polynucleotide
taatacgactcactatagggtgtctgagccggtgctgatgaggccatagcaacagaggagagctatgatgtcatcagcaaacctggcggcagcgcaaaagatg

SEQ ID NO: 108264 - DNA, 103 bp, Artificial Sequence
  Synthetic Polynucleotide
taatacgactcactatagggggggactcactgtctgagccggtgctgatgaacagaggagacatcagatgcggctcagaaacctggcggcagcgcaaaagatg

SEQ ID NO: 108265 - DNA, 103 bp, Artificial Sequence
  Synthetic Polynucleotide
taatacgactcactataggggcgggtggccggggactcactgtctgagccaacagaggagaggctcaatgagtgagtccaacctggcggcagcgcaaaagatg

SEQ ID NO: 108266 - DNA, 103 bp, Artificial Sequence
  Synthetic Polynucleotide
taatacgactcactatagggggcactctgagcgggtggccggggactcacaacagaggagagtgagtatgcggccacccaacctggcggcagcgcaaaagatg

SEQ ID NO: 108267 - DNA, 103 bp, Artificial Sequence
  Synthetic Polynucleotide
taatacgactcactatagggcaggggctggggcactctgagcgggtggccaacagaggagaggccacatgctcagagtgaacctggcggcagcgcaaaagatg

SEQ ID NO: 108268 - DNA, 103 bp, Artificial Sequence
  Synthetic Polynucleotide
taatacgactcactataggggggctgcaggcaggggctggggcactctgaaacagaggagatcagagatgcccagccccaacctggcggcagcgcaaaagatg

SEQ ID NO: 108269 - DNA, 103 bp, Artificial Sequence
  Synthetic Polynucleotide
taatacgactcactatagggtcaggtcctggggctgcaggcaggggctggaacagaggagaccagccatggcctgcagcaacctggcggcagcgcaaaagatg

SEQ ID NO: 108270 - DNA, 103 bp, Artificial Sequence
  Synthetic Polynucleotide
taatacgactcactatagggtgcaggaggctcaggtcctggggctgcaggaacagaggagacctgcaatgccaggacctaacctggcggcagcgcaaaagatg

SEQ ID NO: 108271 - DNA, 103 bp, Artificial Sequence
  Synthetic Polynucleotide
taatacgactcactatagggcttcttgatctgcaggaggctcaggtcctgaacagaggagacaggacatgagcctcctgaacctggcggcagcgcaaaagatg

SEQ ID NO: 108272 - DNA, 103 bp, Artificial Sequence
  Synthetic Polynucleotide
taatacgactcactatagggtggggtcaaagctggggggctgcagtctgtaacagaggagaacagacatgagccccccaaacctggcggcagcgcaaaagatg

SEQ ID NO: 108273 - DNA, 103 bp, Artificial Sequence
  Synthetic Polynucleotide
taatacgactcactatagggccacccggggcttcttgatctgcaggaggcaacagaggagagcctccatgagatcaagaaacctggcggcagcgcaaaagatg

SEQ ID NO: 108274 - DNA, 103 bp, Artificial Sequence
  Synthetic Polynucleotide
taatacgactcactatagggggtgccagcaccacccggggcttcttgatcaacagaggagagatcaaatggccccgggtaacctggcggcagcgcaaaagatg

SEQ ID NO: 108275 - DNA, 103 bp, Artificial Sequence
  Synthetic Polynucleotide
taatacgactcactatagggcttctcctcgggtgccagcaccacccggggaacagaggagaccccggatggtgctggcaaacctggcggcagcgcaaaagatg

SEQ ID NO: 108276 - DNA, 103 bp, Artificial Sequence
  Synthetic Polynucleotide
taatacgactcactataggggcagtgcctccttctcctcgggtgccagcaaacagaggagatgctggatgccgaggagaaacctggcggcagcgcaaaagatg

SEQ ID NO: 108277 - DNA, 103 bp, Artificial Sequence
  Synthetic Polynucleotide
taatacgactcactatagggtaggccttccgcagtgcctccttctcctcgaacagaggagacgaggaatgggaggcactaacctggcggcagcgcaaaagatg

SEQ ID NO: 108278 - DNA, 103 bp, Artificial Sequence
  Synthetic Polynucleotide
taatacgactcactatagggttccagctgataggccttccgcagtgcctcaacagaggagagaggcaatgcggaaggccaacctggcggcagcgcaaaagatg

SEQ ID NO: 108279 - DNA, 103 bp, Artificial Sequence
  Synthetic Polynucleotide
taatacgactcactatagggaggggtagggttccagctgataggccttccaacagaggagaggaaggatgatcagctggaacctggcggcagcgcaaaagatg

SEQ ID NO: 108280 - DNA, 103 bp, Artificial Sequence
  Synthetic Polynucleotide
taatacgactcactataggggtctgctgcgaggggtagggttccagctgaaacagaggagatcagctatgaccctacccaacctggcggcagcgcaaaagatg

SEQ ID NO: 108281 - DNA, 103 bp, Artificial Sequence
  Synthetic Polynucleotide
taatacgactcactataggggagctcgatggtctgctgcgaggggtagggaacagaggagaccctacatgtcgcagcagaacctggcggcagcgcaaaagatg

SEQ ID NO: 108282 - DNA, 103 bp, Artificial Sequence
  Synthetic Polynucleotide
taatacgactcactatagggggaaggagaggagctcgatggtctgctgcgaacagaggagacgcagcatgccatcgagcaacctggcggcagcgcaaaagatg

SEQ ID NO: 108283 - DNA, 103 bp, Artificial Sequence
  Synthetic Polynucleotide
taatacgactcactatagggggctgcccactggggtcaaagctggggggcaacagaggagagcccccatgctttgacccaacctggcggcagcgcaaaagatg

SEQ ID NO: 108284 - DNA, 103 bp, Artificial Sequence
  Synthetic Polynucleotide
taatacgactcactatagggaggttgagctggaaggagaggagctcgatgaacagaggagacatcgaatgcctctccttaacctggcggcagcgcaaaagatg

SEQ ID NO: 108285 - DNA, 103 bp, Artificial Sequence
  Synthetic Polynucleotide
taatacgactcactataggggttggtcttgaggttgagctggaaggagagaacagaggagactctccatgcagctcaacaacctggcggcagcgcaaaagatg

SEQ ID NO: 108286 - DNA, 103 bp, Artificial Sequence
  Synthetic Polynucleotide
taatacgactcactatagggtgatgacggtgttggtcttgaggttgagctaacagaggagaagctcaatgtcaagaccaaacctggcggcagcgcaaaagatg

SEQ ID NO: 108287 - DNA, 103 bp, Artificial Sequence
  Synthetic Polynucleotide
taatacgactcactatagggtggaaccagttgatgacggtgttggtcttgaacagaggagacaagacatgcaccgtcataacctggcggcagcgcaaaagatg

SEQ ID NO: 108288 - DNA, 103 bp, Artificial Sequence
  Synthetic Polynucleotide
taatacgactcactatagggcctgtagttgtggaaccagttgatgacggtaacagaggagaaccgtcatgaactggttcaacctggcggcagcgcaaaagatg

SEQ ID NO: 108289 - DNA, 103 bp, Artificial Sequence
  Synthetic Polynucleotide
taatacgactcactataggggcatccgggacctgtagttgtggaaccagtaacagaggagaactggtatgacaactacaaacctggcggcagcgcaaaagatg

SEQ ID NO: 108290 - DNA, 103 bp, Artificial Sequence
  Synthetic Polynucleotide
taatacgactcactatagggatctcccggcgcatccgggacctgtagttgaacagaggagacaactaatggtcccggataacctggcggcagcgcaaaagatg

SEQ ID NO: 108291 - DNA, 103 bp, Artificial Sequence
  Synthetic Polynucleotide
taatacgactcactatagggctccaccaacatctcccggcgcatccgggaaacagaggagatcccggatgcgccgggagaacctggcggcagcgcaaaagatg

SEQ ID NO: 108292 - DNA, 103 bp, Artificial Sequence
  Synthetic Polynucleotide
taatacgactcactatagggcctgggtcccctccaccaacatctcccggcaacagaggagagccgggatgtgttggtggaacctggcggcagcgcaaaagatg

SEQ ID NO: 108293 - DNA, 103 bp, Artificial Sequence
  Synthetic Polynucleotide
taatacgactcactatagggtctggctcatcctgggtcccctccaccaacaacagaggagagttggtatgggggacccaaacctggcggcagcgcaaaagatg

SEQ ID NO: 108294 - DNA, 103 bp, Artificial Sequence
  Synthetic Polynucleotide
taatacgactcactataggggtctcgccggggctgcccactggggtcaaaaacagaggagatttgacatgagtgggcagaacctggcggcagcgcaaaagatg

SEQ ID NO: 108295 - DNA, 103 bp, Artificial Sequence
  Synthetic Polynucleotide
taatacgactcactatagggtggatcaaggtctggctcatcctgggtcccaacagaggagagggaccatggatgagccaaacctggcggcagcgcaaaagatg

SEQ ID NO: 108296 - DNA, 103 bp, Artificial Sequence
  Synthetic Polynucleotide
taatacgactcactataggggacccccgcttggatcaaggtctggctcataacagaggagaatgagcatgaccttgatcaacctggcggcagcgcaaaagatg

SEQ ID NO: 108297 - DNA, 103 bp, Artificial Sequence
  Synthetic Polynucleotide
taatacgactcactatagggaggattccaggacccccgcttggatcaaggaacagaggagaccttgaatgaagcgggggaacctggcggcagcgcaaaagatg

SEQ ID NO: 108298 - DNA, 103 bp, Artificial Sequence
  Synthetic Polynucleotide
taatacgactcactataggggcctggcggtaggattccaggacccccgctaacagaggagaagcgggatgcctggaatcaacctggcggcagcgcaaaagatg

SEQ ID NO: 108299 - DNA, 103 bp, Artificial Sequence
  Synthetic Polynucleotide
taatacgactcactatagggggtgggagtggcctggcggtaggattccagaacagaggagactggaaatgtaccgccagaacctggcggcagcgcaaaagatg

SEQ ID NO: 108300 - DNA, 103 bp, Artificial Sequence
  Synthetic Polynucleotide
taatacgactcactataggggtggggtctgggtgggagtggcctggcggtaacagaggagaaccgccatgccactcccaaacctggcggcagcgcaaaagatg

SEQ ID NO: 108301 - DNA, 103 bp, Artificial Sequence
  Synthetic Polynucleotide
taatacgactcactataggggctctgcggggtggggtctgggtgggagtgaacagaggagacactccatgccagaccccaacctggcggcagcgcaaaagatg

SEQ ID NO: 108302 - DNA, 103 bp, Artificial Sequence
  Synthetic Polynucleotide
taatacgactcactatagggcagagtcagggctctgcggggtggggtctgaacagaggagacagaccatgccccgcagaaacctggcggcagcgcaaaagatg

SEQ ID NO: 108303 - DNA, 103 bp, Artificial Sequence
  Synthetic Polynucleotide
taatacgactcactatagggtcctcagtctcagagtcagggctctgcgggaacagaggagacccgcaatgccctgactcaacctggcggcagcgcaaaagatg

SEQ ID NO: 108304 - DNA, 103 bp, Artificial Sequence
  Synthetic Polynucleotide
taatacgactcactatagggtggcttctggtcctcagtctcagagtcaggaacagaggagacctgacatggagactgagaacctggcggcagcgcaaaagatg

SEQ ID NO: 108305 - DNA, 103 bp, Artificial Sequence
  Synthetic Polynucleotide
taatacgactcactatagggaagtgtggaggtctcgccggggctgcccacaacagaggagagtgggcatgcccggcgagaacctggcggcagcgcaaaagatg

SEQ ID NO: 108306 - DNA, 103 bp, Artificial Sequence
  Synthetic Polynucleotide
taatacgactcactatagggccttcacggttggcttctggtcctcagtctaacagaggagaagactgatgaccagaagcaacctggcggcagcgcaaaagatg

SEQ ID NO: 108307 - DNA, 103 bp, Artificial Sequence
  Synthetic Polynucleotide
taatacgactcactatagggagctccagttccttcacggttggcttctggaacagaggagaccagaaatgaaccgtgaaaacctggcggcagcgcaaaagatg

SEQ ID NO: 108308 - DNA, 103 bp, Artificial Sequence
  Synthetic Polynucleotide
taatacgactcactataggggccctcctgaagctccagttccttcacggtaacagaggagaaccgtgatggaactggagaacctggcggcagcgcaaaagatg

SEQ ID NO: 108309 - DNA, 103 bp, Artificial Sequence
  Synthetic Polynucleotide
taatacgactcactatagggtctcctcagggccctcctgaagctccagttaacagaggagaaactggatgttcaggaggaacctggcggcagcgcaaaagatg

SEQ ID NO: 108310 - DNA, 103 bp, Artificial Sequence
  Synthetic Polynucleotide
taatacgactcactatagggggtgtgctgttctcctcagggccctcctgaaacagaggagatcaggaatgccctgaggaaacctggcggcagcgcaaaagatg

SEQ ID NO: 108311 - DNA, 103 bp, Artificial Sequence
  Synthetic Polynucleotide
taatacgactcactatagggggtggtcaggggtgtgctgttctcctcaggaacagaggagacctgagatgaacagcacaaacctggcggcagcgcaaaagatg

SEQ ID NO: 108312 - DNA, 103 bp, Artificial Sequence
  Synthetic Polynucleotide
taatacgactcactatagggccttgtcctgggtggtcaggggtgtgctgtaacagaggagaacagcaatgccctgaccaaacctggcggcagcgcaaaagatg

SEQ ID NO: 108313 - DNA, 103 bp, Artificial Sequence
  Synthetic Polynucleotide
taatacgactcactatagggctcacttgggccttgtcctgggtggtcaggaacagaggagacctgacatgccaggacaaaacctggcggcagcgcaaaagatg

SEQ ID NO: 108314 - DNA, 103 bp, Artificial Sequence
  Synthetic Polynucleotide
taatacgactcactatagggctgcttgatcctcacttgggccttgtcctgaacagaggagacaggacatggcccaagtgaacctggcggcagcgcaaaagatg

SEQ ID NO: 108315 - DNA, 103 bp, Artificial Sequence
  Synthetic Polynucleotide
taatacgactcactatagggccatctgttcctgcttgatcctcacttgggaacagaggagacccaagatgggatcaagcaacctggcggcagcgcaaaagatg

SEQ ID NO: 108316 - DNA, 103 bp, Artificial Sequence
  Synthetic Polynucleotide
taatacgactcactatagggctcttccacgaagtgtggaggtctcgccggaacagaggagaccggcgatgcctccacacaacctggcggcagcgcaaaagatg

SEQ ID NO: 108317 - DNA, 103 bp, Artificial Sequence
  Synthetic Polynucleotide
taatacgactcactataggggcatcctcctccatctgttcctgcttgatcaacagaggagagatcaaatgggaacagataacctggcggcagcgcaaaagatg

SEQ ID NO: 108318 - DNA, 103 bp, Artificial Sequence
  Synthetic Polynucleotide
taatacgactcactatagggctcttcctcagcatcctcctccatctgttcaacagaggagagaacagatggaggaggataacctggcggcagcgcaaaagatg

SEQ ID NO: 108319 - DNA, 103 bp, Artificial Sequence
  Synthetic Polynucleotide
taatacgactcactatagggggctgcctgcctcttcctcagcatcctcctaacagaggagaaggaggatgctgaggaagaacctggcggcagcgcaaaagatg

SEQ ID NO: 108320 - DNA, 103 bp, Artificial Sequence
  Synthetic Polynucleotide
taatacgactcactatagggtcctggggctggctgcctgcctcttcctcaaacagaggagatgaggaatgggcaggcagaacctggcggcagcgcaaaagatg

SEQ ID NO: 108321 - DNA, 103 bp, Artificial Sequence
  Synthetic Polynucleotide
taatacgactcactatagggctcccctgagtcctggggctggctgcctgcaacagaggagagcaggcatgcagccccagaacctggcggcagcgcaaaagatg

SEQ ID NO: 108322 - DNA, 103 bp, Artificial Sequence
  Synthetic Polynucleotide
taatacgactcactatagggctttgtccagctcccctgagtcctggggctaacagaggagaagccccatgactcaggggaacctggcggcagcgcaaaagatg

SEQ ID NO: 108323 - DNA, 103 bp, Artificial Sequence
  Synthetic Polynucleotide
taatacgactcactatagggggaccttggcctttgtccagctcccctgagaacagaggagactcaggatggctggacaaaacctggcggcagcgcaaaagatg

SEQ ID NO: 108324 - DNA, 103 bp, Artificial Sequence
  Synthetic Polynucleotide
taatacgactcactatagggctctttggggggaccttggcctttgtccagaacagaggagactggacatgggccaaggtaacctggcggcagcgcaaaagatg

SEQ ID NO: 108325 - DNA, 103 bp, Artificial Sequence
  Synthetic Polynucleotide
taatacgactcactatagggcgggatgctcctctttggggggaccttggcaacagaggagagccaagatgcccccaaagaacctggcggcagcgcaaaagatg

SEQ ID NO: 108326 - DNA, 103 bp, Artificial Sequence
  Synthetic Polynucleotide
taatacgactcactatagggcccggagggtcgggatgctcctctttggggaacagaggagaccccaaatgggagcatccaacctggcggcagcgcaaaagatg

SEQ ID NO: 108327 - DNA, 103 bp, Artificial Sequence
  Synthetic Polynucleotide
taatacgactcactataggggagtcgccgtagatcaaatcgcttccaataaacagaggagatattggatgcgatttgataacctggcggcagcgcaaaagatg

SEQ ID NO: 108328 - DNA, 103 bp, Artificial Sequence
  Synthetic Polynucleotide
taatacgactcactatagggctcggggttcctcttccacgaagtgtggagaacagaggagactccacatgtcgtggaagaacctggcggcagcgcaaaagatg

SEQ ID NO: 108329 - DNA, 103 bp, Artificial Sequence
  Synthetic Polynucleotide
taatacgactcactatagggtccatcattacccggagggtcgggatgctcaacagaggagagagcatatggaccctccgaacctggcggcagcgcaaaagatg

SEQ ID NO: 108330 - DNA, 103 bp, Artificial Sequence
  Synthetic Polynucleotide
taatacgactcactatagggcttttgggagtccatcattacccggagggtaacagaggagaaccctcatggtaatgatgaacctggcggcagcgcaaaagatg

SEQ ID NO: 108331 - DNA, 103 bp, Artificial Sequence
  Synthetic Polynucleotide
taatacgactcactatagggccgggagccacttttgggagtccatcattaaacagaggagataatgaatgactcccaaaaacctggcggcagcgcaaaagatg

SEQ ID NO: 108332 - DNA, 103 bp, Artificial Sequence
  Synthetic Polynucleotide
taatacgactcactatagggaaggaggggcccgggagccacttttgggagaacagaggagactcccaatggtggctcccaacctggcggcagcgcaaaagatg

SEQ ID NO: 108333 - DNA, 103 bp, Artificial Sequence
  Synthetic Polynucleotide
taatacgactcactatagggatccacctggaaggaggggcccgggagccaaacagaggagatggctcatgggcccctccaacctggcggcagcgcaaaagatg

SEQ ID NO: 108334 - DNA, 103 bp, Artificial Sequence
  Synthetic Polynucleotide
taatacgactcactatagggtctggggtggatccacctggaaggaggggcaacagaggagagcccctatgtccaggtggaacctggcggcagcgcaaaagatg

SEQ ID NO: 108335 - DNA, 103 bp, Artificial Sequence
  Synthetic Polynucleotide
taatacgactcactatagggtgagggacagtctggggtggatccacctggaacagaggagaccaggtatgtccaccccaaacctggcggcagcgcaaaagatg

SEQ ID NO: 108336 - DNA, 103 bp, Artificial Sequence
  Synthetic Polynucleotide
taatacgactcactatagggggggatgaagtgagggacagtctggggtggaacagaggagaccacccatgactgtccctaacctggcggcagcgcaaaagatg

SEQ ID NO: 108337 - DNA, 103 bp, Artificial Sequence
  Synthetic Polynucleotide
taatacgactcactatagggctctcctgttggggatgaagtgagggacagaacagaggagactgtccatgacttcatccaacctggcggcagcgcaaaagatg

SEQ ID NO: 108338 - DNA, 103 bp, Artificial Sequence
  Synthetic Polynucleotide
taatacgactcactatagggcccggcctcactctcctgttggggatgaagaacagaggagacttcatatgcaacaggagaacctggcggcagcgcaaaagatg

SEQ ID NO: 108339 - DNA, 103 bp, Artificial Sequence
  Synthetic Polynucleotide
taatacgactcactatagggggctgaggagctcggggttcctcttccacgaacagaggagacgtggaatgggaaccccgaacctggcggcagcgcaaaagatg

SEQ ID NO: 108340 - DNA, 103 bp, Artificial Sequence
  Synthetic Polynucleotide
taatacgactcactataggggaagtcgctccccggcctcactctcctgttaacagaggagaaacaggatggtgaggccgaacctggcggcagcgcaaaagatg

SEQ ID NO: 108341 - DNA, 103 bp, Artificial Sequence
  Synthetic Polynucleotide
taatacgactcactataggggggtccgggtgaagtcgctccccggcctcaaacagaggagatgaggcatgggagcgactaacctggcggcagcgcaaaagatg

SEQ ID NO: 108342 - DNA, 103 bp, Artificial Sequence
  Synthetic Polynucleotide
taatacgactcactatagggaaaacttaaagggtccgggtgaagtcgctcaacagaggagagagcgaatgcacccggacaacctggcggcagcgcaaaagatg

SEQ ID NO: 108343 - DNA, 103 bp, Artificial Sequence
  Synthetic Polynucleotide
taatacgactcactatagggaggctgacttaaaacttaaagggtccgggtaacagaggagaacccggatgctttaagttaacctggcggcagcgcaaaagatg

SEQ ID NO: 108344 - DNA, 103 bp, Artificial Sequence
  Synthetic Polynucleotide
taatacgactcactataggggaggactctgaggctgacttaaaacttaaaaacagaggagatttaagatgtaagtcagcaacctggcggcagcgcaaaagatg

SEQ ID NO: 108345 - DNA, 103 bp, Artificial Sequence
  Synthetic Polynucleotide
taatacgactcactataggggctgcagcgtgaggactctgaggctgacttaacagaggagaaagtcaatgtcagagtccaacctggcggcagcgcaaaagatg

SEQ ID NO: 108346 - DNA, 103 bp, Artificial Sequence
  Synthetic Polynucleotide
taatacgactcactatagggacacctccaggctgcagcgtgaggactctgaacagaggagacagagtatgcacgctgcaaacctggcggcagcgcaaaagatg

SEQ ID NO: 108347 - DNA, 103 bp, Artificial Sequence
  Synthetic Polynucleotide
taatacgactcactataggggagttcagtgacacctccaggctgcagcgtaacagaggagaacgctgatgcctggaggtaacctggcggcagcgcaaaagatg

SEQ ID NO: 108348 - DNA, 103 bp, Artificial Sequence
  Synthetic Polynucleotide
taatacgactcactatagggggccgagggcgagttcagtgacacctccagaacagaggagactggagatgtcactgaacaacctggcggcagcgcaaaagatg

SEQ ID NO: 108349 - DNA, 103 bp, Artificial Sequence
  Synthetic Polynucleotide
taatacgactcactataggggtgaggaggcggccgagggcgagttcagtgaacagaggagacactgaatgcgccctcggaacctggcggcagcgcaaaagatg

SEQ ID NO: 108350 - DNA, 103 bp, Artificial Sequence
  Synthetic Polynucleotide
taatacgactcactatagggtgctctttggggctgaggagctcggggttcaacagaggagagaacccatggctcctcagaacctggcggcagcgcaaaagatg

SEQ ID NO: 108351 - DNA, 103 bp, Artificial Sequence
  Synthetic Polynucleotide
taatacgactcactatagggatgaggcctggtgaggaggcggccgagggcaacagaggagagccctcatgcgcctcctcaacctggcggcagcgcaaaagatg

SEQ ID NO: 108352 - DNA, 103 bp, Artificial Sequence
  Synthetic Polynucleotide
taatacgactcactatagggcacagacatcatgaggcctggtgaggaggcaacagaggagagcctccatgccaggcctcaacctggcggcagcgcaaaagatg

SEQ ID NO: 108353 - DNA, 103 bp, Artificial Sequence
  Synthetic Polynucleotide
taatacgactcactatagggggacaggtgacacagacatcatgaggcctgaacagaggagacaggccatgtgatgtctgaacctggcggcagcgcaaaagatg

SEQ ID NO: 108354 - DNA, 103 bp, Artificial Sequence
  Synthetic Polynucleotide
taatacgactcactataggggaggaggaggggacaggtgacacagacatcaacagaggagagatgtcatggtcacctgtaacctggcggcagcgcaaaagatg

SEQ ID NO: 108355 - DNA, 103 bp, Artificial Sequence
  Synthetic Polynucleotide
taatacgactcactataggggatgggagctgaggaggaggggacaggtgaaacagaggagatcacctatgccctcctccaacctggcggcagcgcaaaagatg

SEQ ID NO: 108356 - DNA, 103 bp, Artificial Sequence
  Synthetic Polynucleotide
taatacgactcactataggggggatggggagatgggagctgaggaggaggaacagaggagacctcctatgcagctcccaaacctggcggcagcgcaaaagatg

SEQ ID NO: 108357 - DNA, 103 bp, Artificial Sequence
  Synthetic Polynucleotide
taatacgactcactataggggcgccaggtggggatggggagatgggagctaacagaggagaagctccatgctccccatcaacctggcggcagcgcaaaagatg

SEQ ID NO: 108358 - DNA, 103 bp, Artificial Sequence
  Synthetic Polynucleotide
taatacgactcactatagggggcagggggggcgccaggtggggatggggaaacagaggagatccccaatgccacctggcaacctggcggcagcgcaaaagatg

SEQ ID NO: 108359 - DNA, 103 bp, Artificial Sequence
  Synthetic Polynucleotide
taatacgactcactatagggtcggcactttggcagggggggcgccaggtgaacagaggagacacctgatgccccccctgaacctggcggcagcgcaaaagatg

SEQ ID NO: 108360 - DNA, 103 bp, Artificial Sequence
  Synthetic Polynucleotide
taatacgactcactataggggggctggcactcggcactttggcaggggggaacagaggagaccccccatgcaaagtgccaacctggcggcagcgcaaaagatg

SEQ ID NO: 108361 - DNA, 103 bp, Artificial Sequence
  Synthetic Polynucleotide
taatacgactcactatagggcccctctctctgctctttggggctgaggagaacagaggagactcctcatgcccaaagagaacctggcggcagcgcaaaagatg

SEQ ID NO: 108362 - DNA, 103 bp, Artificial Sequence
  Synthetic Polynucleotide
taatacgactcactataggggtcagcagtggggctggcactcggcactttaacagaggagaaaagtgatgagtgccagcaacctggcggcagcgcaaaagatg

SEQ ID NO: 108363 - DNA, 103 bp, Artificial Sequence
  Synthetic Polynucleotide
taatacgactcactatagggctccagccatgtcagcagtggggctggcacaacagaggagagtgccaatgccactgctgaacctggcggcagcgcaaaagatg

SEQ ID NO: 108364 - DNA, 103 bp, Artificial Sequence
  Synthetic Polynucleotide
taatacgactcactataggggggtgcaaggctccagccatgtcagcagtgaacagaggagacactgcatgcatggctggaacctggcggcagcgcaaaagatg

SEQ ID NO: 108365 - DNA, 103 bp, Artificial Sequence
  Synthetic Polynucleotide
taatacgactcactatagggcttggcactggggtgcaaggctccagccataacagaggagaatggctatggccttgcacaacctggcggcagcgcaaaagatg

SEQ ID NO: 108366 - DNA, 103 bp, Artificial Sequence
  Synthetic Polynucleotide
taatacgactcactatagggtggggttcaccttggcactggggtgcaaggaacagaggagaccttgcatgccagtgccaaacctggcggcagcgcaaaagatg

SEQ ID NO: 108367 - DNA, 103 bp, Artificial Sequence
  Synthetic Polynucleotide
taatacgactcactatagggcgctgcaagttggggttcaccttggcactgaacagaggagacagtgcatgggtgaacccaacctggcggcagcgcaaaagatg

SEQ ID NO: 108368 - DNA, 103 bp, Artificial Sequence
  Synthetic Polynucleotide
taatacgactcactatagggctcatgccgccgctgcaagttggggttcacaacagaggagagtgaacatgaacttgcagaacctggcggcagcgcaaaagatg

SEQ ID NO: 108369 - DNA, 103 bp, Artificial Sequence
  Synthetic Polynucleotide
taatacgactcactatagggtggccatcttctcatgccgccgctgcaagtaacagaggagaacttgcatgggcggcatgaacctggcggcagcgcaaaagatg

SEQ ID NO: 108370 - DNA, 103 bp, Artificial Sequence
  Synthetic Polynucleotide
taatacgactcactatagggttgttcagattggccatcttctcatgccgcaacagaggagagcggcaatggaagatggcaacctggcggcagcgcaaaagatg

SEQ ID NO: 108371 - DNA, 103 bp, Artificial Sequence
  Synthetic Polynucleotide
taatacgactcactataggggtaaatgatgttgttcagattggccatcttaacagaggagaaagatgatgaatctgaacaacctggcggcagcgcaaaagatg

SEQ ID NO: 108372 - DNA, 103 bp, Artificial Sequence
  Synthetic Polynucleotide
taatacgactcactatagggcaggcgacgtcccctctctctgctctttggaacagaggagaccaaagatgagagagaggaacctggcggcagcgcaaaagatg

SEQ ID NO: 108373 - DNA, 103 bp, Artificial Sequence
  Synthetic Polynucleotide
taatacgactcactataggggctctactcggtaaatgatgttgttcagataacagaggagaatctgaatgacatcatttaacctggcggcagcgcaaaagatg

SEQ ID NO: 108374 - DNA, 103 bp, Artificial Sequence
  Synthetic Polynucleotide
taatacgactcactatagggttggcagcccgctctactcggtaaatgatgaacagaggagacatcatatgccgagtagaaacctggcggcagcgcaaaagatg

SEQ ID NO: 108375 - DNA, 103 bp, Artificial Sequence
  Synthetic Polynucleotide
taatacgactcactatagggctcctcccgattggcagcccgctctactcgaacagaggagacgagtaatgcgggctgccaacctggcggcagcgcaaaagatg

SEQ ID NO: 108376 - DNA, 103 bp, Artificial Sequence
  Synthetic Polynucleotide
taatacgactcactatagggactccagggcctcctcccgattggcagcccaacagaggagagggctgatgatcgggaggaacctggcggcagcgcaaaagatg

SEQ ID NO: 108377 - DNA, 103 bp, Artificial Sequence
  Synthetic Polynucleotide
taatacgactcactatagggcagaactcccactccagggcctcctcccgaaacagaggagatcgggaatgggccctggaaacctggcggcagcgcaaaagatg

SEQ ID NO: 108378 - DNA, 103 bp, Artificial Sequence
  Synthetic Polynucleotide
taatacgactcactataggggtgggcccggcaggcgacgtcccctctctcaacagaggagagagagaatggacgtcgccaacctggcggcagcgcaaaagatg

SEQ ID NO: 108379 - DNA, 103 bp, Artificial Sequence
  Synthetic Polynucleotide
taatacgactcactatagggctcggtcagcgtgggcccggcaggcgacgtaacagaggagaacgtcgatggccgggcccaacctggcggcagcgcaaaagatg

SEQ ID NO: 108380 - DNA, 103 bp, Artificial Sequence
  Synthetic Polynucleotide
taatacgactcactatagggggcggcttccctcggtcagcgtgggcccggaacagaggagaccgggcatgcgctgaccgaacctggcggcagcgcaaaagatg

SEQ ID NO: 108381 - DNA, 103 bp, Artificial Sequence
  Synthetic Polynucleotide
taatacgactcactatagggatgcctgggaggcggcttccctcggtcagcaacagaggagagctgacatggggaagccgaacctggcggcagcgcaaaagatg

SEQ ID NO: 108382 - DNA, 103 bp, Artificial Sequence
  Synthetic Polynucleotide
taatacgactcactatagggtttcccgggaatgcctgggaggcggcttccaacagaggagaggaagcatgctcccaggcaacctggcggcagcgcaaaagatg

SEQ ID NO: 108383 - DNA, 103 bp, Artificial Sequence
  Synthetic Polynucleotide
taatacgactcactataggggctccttctggagtcgccgtagatcaaatcaacagaggagagatttgatgtacggcgacaacctggcggcagcgcaaaagatg

SEQ ID NO: 108384 - DNA, 103 bp, Artificial Sequence
  Synthetic Polynucleotide
taatacgactcactatagggtcaggagggctttcccgggaatgcctgggaaacagaggagatcccagatgttcccgggaaacctggcggcagcgcaaaagatg

SEQ ID NO: 108385 - DNA, 103 bp, Artificial Sequence
  Synthetic Polynucleotide
taatacgactcactatagggaaggtttctgtcaggagggctttcccgggaaacagaggagatcccggatgagccctcctaacctggcggcagcgcaaaagatg

SEQ ID NO: 108386 - DNA, 103 bp, Artificial Sequence
  Synthetic Polynucleotide
taatacgactcactatagggtctctgcagcaaggtttctgtcaggagggcaacagaggagagccctcatgacagaaaccaacctggcggcagcgcaaaagatg

SEQ ID NO: 108387 - DNA, 103 bp, Artificial Sequence
  Synthetic Polynucleotide
taatacgactcactatagggccgcctcatttctctgcagcaaggtttctgaacagaggagacagaaaatgtgctgcagaaacctggcggcagcgcaaaagatg

SEQ ID NO: 108388 - DNA, 103 bp, Artificial Sequence
  Synthetic Polynucleotide
taatacgactcactatagggttttgtttttccgcctcatttctctgcagcaacagaggagagctgcaatgaaatgaggcaacctggcggcagcgcaaaagatg

SEQ ID NO: 108389 - DNA, 103 bp, Artificial Sequence
  Synthetic Polynucleotide
taatacgactcactatagggttgaaggcccttttgtttttccgcctcattaacagaggagaaatgagatggaaaaacaaaacctggcggcagcgcaaaagatg

SEQ ID NO: 108390 - DNA, 103 bp, Artificial Sequence
  Synthetic Polynucleotide
taatacgactcactatagggtctgtacttcttgaaggcccttttgtttttaacagaggagaaaaaacatgagggccttcaacctggcggcagcgcaaaagatg

SEQ ID NO: 108391 - DNA, 103 bp, Artificial Sequence
  Synthetic Polynucleotide
taatacgactcactataggggccaaagtgatctgtacttcttgaaggcccaacagaggagagggcctatgagaagtacaaacctggcggcagcgcaaaagatg

SEQ ID NO: 108392 - DNA, 103 bp, Artificial Sequence
  Synthetic Polynucleotide
taatacgactcactatagggcagtctggccgccaaagtgatctgtacttcaacagaggagagaagtaatgatcactttgaacctggcggcagcgcaaaagatg

SEQ ID NO: 108393 - DNA, 103 bp, Artificial Sequence
  Synthetic Polynucleotide
taatacgactcactatagggctgcctcccccagtctggccgccaaagtgaaacagaggagatcacttatgcggccagacaacctggcggcagcgcaaaagatg

SEQ ID NO: 108394 - DNA, 103 bp, Artificial Sequence
  Synthetic Polynucleotide
taatacgactcactatagggacggaattaagctccttctggagtcgccgtaacagaggagaacggcgatgccagaaggaaacctggcggcagcgcaaaagatg

SEQ ID NO: 108395 - DNA, 103 bp, Artificial Sequence
  Synthetic Polynucleotide
taatacgactcactatagggattttctcctctgcctcccccagtctggccaacagaggagaggccagatggggggaggcaacctggcggcagcgcaaaagatg

SEQ ID NO: 108396 - DNA, 103 bp, Artificial Sequence
  Synthetic Polynucleotide
taatacgactcactatagggtaggactttgattttctcctctgcctccccaacagaggagaggggagatggaggagaaaaacctggcggcagcgcaaaagatg

SEQ ID NO: 108397 - DNA, 103 bp, Artificial Sequence
  Synthetic Polynucleotide
taatacgactcactataggggcgctgaatgtaggactttgattttctcctaacagaggagaaggagaatgtcaaagtccaacctggcggcagcgcaaaagatg

SEQ ID NO: 108398 - DNA, 103 bp, Artificial Sequence
  Synthetic Polynucleotide
taatacgactcactataggggtagcctttagcgctgaatgtaggactttgaacagaggagacaaagtatgacattcagcaacctggcggcagcgcaaaagatg

SEQ ID NO: 108399 - DNA, 103 bp, Artificial Sequence
  Synthetic Polynucleotide
taatacgactcactatagggctctgcctgcgtagcctttagcgctgaatgaacagaggagacattcaatgctaaaggctaacctggcggcagcgcaaaagatg

SEQ ID NO: 108400 - DNA, 103 bp, Artificial Sequence
  Synthetic Polynucleotide
taatacgactcactataggggctctagcagctctgcctgcgtagcctttaaacagaggagataaaggatgcgcaggcagaacctggcggcagcgcaaaagatg

SEQ ID NO: 108401 - DNA, 103 bp, Artificial Sequence
  Synthetic Polynucleotide
taatacgactcactatagggttccgccgcagctctagcagctctgcctgcaacagaggagagcaggcatggctgctagaaacctggcggcagcgcaaaagatg

SEQ ID NO: 108402 - DNA, 103 bp, Artificial Sequence
  Synthetic Polynucleotide
taatacgactcactatagggctcgtcgtacttccgccgcagctctagcagaacagaggagactgctaatgctgcggcggaacctggcggcagcgcaaaagatg

SEQ ID NO: 108403 - DNA, 103 bp, Artificial Sequence
  Synthetic Polynucleotide
taatacgactcactatagggatgctgcctcctcgtcgtacttccgccgcaaacagaggagatgcggcatgagtacgacgaacctggcggcagcgcaaaagatg

SEQ ID NO: 108404 - DNA, 103 bp, Artificial Sequence
  Synthetic Polynucleotide
taatacgactcactatagggtctgccttggatgctgcctcctcgtcgtacaacagaggagagtacgaatgggaggcagcaacctggcggcagcgcaaaagatg

SEQ ID NO: 108405 - DNA, 103 bp, Artificial Sequence
  Synthetic Polynucleotide
taatacgactcactatagggctcagaagcgacggaattaagctccttctgaacagaggagacagaagatgcttaattccaacctggcggcagcgcaaaagatg

SEQ ID NO: 108406 - DNA, 103 bp, Artificial Sequence
  Synthetic Polynucleotide
taatacgactcactataggggccgacttcatctgccttggatgctgcctcaacagaggagagaggcaatgtccaaggcaaacctggcggcagcgcaaaagatg

SEQ ID NO: 108407 - DNA, 103 bp, Artificial Sequence
  Synthetic Polynucleotide
taatacgactcactatagggtcatgatcaggccgacttcatctgccttggaacagaggagaccaaggatgatgaagtcgaacctggcggcagcgcaaaagatg

SEQ ID NO: 108408 - DNA, 103 bp, Artificial Sequence
  Synthetic Polynucleotide
taatacgactcactatagggtccaggttggtcatgatcaggccgacttcaaacagaggagatgaagtatgcctgatcataacctggcggcagcgcaaaagatg

SEQ ID NO: 108409 - DNA, 103 bp, Artificial Sequence
  Synthetic Polynucleotide
taatacgactcactatagggattagctttctccaggttggtcatgatcagaacagaggagactgatcatgaccaacctgaacctggcggcagcgcaaaagatg

SEQ ID NO: 108410 - DNA, 103 bp, Artificial Sequence
  Synthetic Polynucleotide
taatacgactcactatagggcagctcgctgattagctttctccaggttggaacagaggagaccaaccatgagaaagctaaacctggcggcagcgcaaaagatg

SEQ ID NO: 108411 - DNA, 103 bp, Artificial Sequence
  Synthetic Polynucleotide
taatacgactcactatagggtgggcagcctcagctcgctgattagctttcaacagaggagagaaagcatgtcagcgagcaacctggcggcagcgcaaaagatg

SEQ ID NO: 108412 - DNA, 103 bp, Artificial Sequence
  Synthetic Polynucleotide
taatacgactcactatagggcacctcccgctgggcagcctcagctcgctgaacagaggagacagcgaatggaggctgccaacctggcggcagcgcaaaagatg

SEQ ID NO: 108413 - DNA, 103 bp, Artificial Sequence
  Synthetic Polynucleotide
taatacgactcactatagggggagactttccacctcccgctgggcagcctaacagaggagaaggctgatgagcgggaggaacctggcggcagcgcaaaagatg

SEQ ID NO: 108414 - DNA, 103 bp, Artificial Sequence
  Synthetic Polynucleotide
taatacgactcactatagggagctgttcccggagactttccacctcccgcaacagaggagagcgggaatgggaaagtctaacctggcggcagcgcaaaagatg

SEQ ID NO: 108415 - DNA, 103 bp, Artificial Sequence
  Synthetic Polynucleotide
taatacgactcactataggggacagaggccagctgttcccggagactttcaacagaggagagaaagtatgcgggaacagaacctggcggcagcgcaaaagatg

SEQ ID NO: 108416 - DNA, 103 bp, Artificial Sequence
  Synthetic Polynucleotide
taatacgactcactataggggtgcagacagctcagaagcgacggaattaaaacagaggagattaattatgtcgcttctgaacctggcggcagcgcaaaagatg

SEQ ID NO: 108417 - DNA, 103 bp, Artificial Sequence
  Synthetic Polynucleotide
taatacgactcactatagggtggagctgttgacagaggccagctgttcccaacagaggagagggaacatgtggcctctgaacctggcggcagcgcaaaagatg

SEQ ID NO: 108418 - DNA, 103 bp, Artificial Sequence
  Synthetic Polynucleotide
taatacgactcactataggggccaggcggatggagctgttgacagaggccaacagaggagaggcctcatgcaacagctcaacctggcggcagcgcaaaagatg

SEQ ID NO: 108419 - DNA, 103 bp, Artificial Sequence
  Synthetic Polynucleotide
taatacgactcactatagggagagcagcaagccaggcggatggagctgttaacagaggagaaacagcatgatccgcctgaacctggcggcagcgcaaaagatg

SEQ ID NO: 108420 - DNA, 103 bp, Artificial Sequence
  Synthetic Polynucleotide
taatacgactcactataggggcccctggggagagcagcaagccaggcggaaacagaggagatccgccatgcttgctgctaacctggcggcagcgcaaaagatg

SEQ ID NO: 108421 - DNA, 103 bp, Artificial Sequence
  Synthetic Polynucleotide
taatacgactcactatagggtccccactgggcccctggggagagcagcaaaacagaggagattgctgatgtccccagggaacctggcggcagcgcaaaagatg

SEQ ID NO: 108422 - DNA, 103 bp, Artificial Sequence
  Synthetic Polynucleotide
taatacgactcactataggggttcaccttatccccactgggcccctggggaacagaggagaccccagatgcccagtgggaacctggcggcagcgcaaaagatg

SEQ ID NO: 108423 - DNA, 103 bp, Artificial Sequence
  Synthetic Polynucleotide
taatacgactcactatagggacagagtgaagttcaccttatccccactggaacagaggagaccagtgatgataaggtgaaacctggcggcagcgcaaaagatg

SEQ ID NO: 108424 - DNA, 103 bp, Artificial Sequence
  Synthetic Polynucleotide
taatacgactcactataggggggcccgagcacagagtgaagttcaccttaaacagaggagataaggtatgcttcactctaacctggcggcagcgcaaaagatg

SEQ ID NO: 108425 - DNA, 103 bp, Artificial Sequence
  Synthetic Polynucleotide
taatacgactcactatagggctccagccgagggcccgagcacagagtgaaaacagaggagattcactatgtgctcgggcaacctggcggcagcgcaaaagatg

SEQ ID NO: 108426 - DNA, 103 bp, Artificial Sequence
  Synthetic Polynucleotide
taatacgactcactatagggccagcgcggcctccagccgagggcccgagcaacagaggagagctcggatgctcggctggaacctggcggcagcgcaaaagatg

SEQ ID NO: 108427 - DNA, 103 bp, Artificial Sequence
  Synthetic Polynucleotide
taatacgactcactatagggtcctcctgccgtgcagacagctcagaagcgaacagaggagacgcttcatggctgtctgcaacctggcggcagcgcaaaagatg

SEQ ID NO: 108428 - DNA, 103 bp, Artificial Sequence
  Synthetic Polynucleotide
taatacgactcactatagggtccttggaggccagcgcggcctccagccgaaacagaggagatcggctatgggccgcgctaacctggcggcagcgcaaaagatg

SEQ ID NO: 108429 - DNA, 103 bp, Artificial Sequence
  Synthetic Polynucleotide
taatacgactcactataggggatctccctgtccttggaggccagcgcggcaacagaggagagccgcgatggcctccaagaacctggcggcagcgcaaaagatg

SEQ ID NO: 108430 - DNA, 103 bp, Artificial Sequence
  Synthetic Polynucleotide
taatacgactcactataggggcagccgcaggatctccctgtccttggaggaacagaggagacctccaatgacagggagaaacctggcggcagcgcaaaagatg

SEQ ID NO: 108431 - DNA, 103 bp, Artificial Sequence
  Synthetic Polynucleotide
taatacgactcactatagggacgtccttcagcagccgcaggatctccctgaacagaggagacagggaatgcctgcggctaacctggcggcagcgcaaaagatg

SEQ ID NO: 108432 - DNA, 103 bp, Artificial Sequence
  Synthetic Polynucleotide
taatacgactcactataggggaggtgctgcacgtccttcagcagccgcagaacagaggagactgcggatgctgaaggacaacctggcggcagcgcaaaagatg

SEQ ID NO: 108433 - DNA, 103 bp, Artificial Sequence
  Synthetic Polynucleotide
taatacgactcactataggggtgagctctggaggtgctgcacgtccttcaaacagaggagatgaaggatgtgcagcaccaacctggcggcagcgcaaaagatg

SEQ ID NO: 108434 - DNA, 103 bp, Artificial Sequence
  Synthetic Polynucleotide
taatacgactcactatagggagctcctgcagtgagctctggaggtgctgcaacagaggagagcagcaatgccagagctcaacctggcggcagcgcaaaagatg

SEQ ID NO: 108435 - DNA, 103 bp, Artificial Sequence
  Synthetic Polynucleotide
taatacgactcactatagggtgcctcctccagctcctgcagtgagctctgaacagaggagacagagcatgctgcaggagaacctggcggcagcgcaaaagatg

SEQ ID NO: 108436 - DNA, 103 bp, Artificial Sequence
  Synthetic Polynucleotide
taatacgactcactatagggggttggcggatgcctcctccagctcctgcaaacagaggagatgcaggatgtggaggaggaacctggcggcagcgcaaaagatg

SEQ ID NO: 108437 - DNA, 103 bp, Artificial Sequence
  Synthetic Polynucleotide
taatacgactcactatagggtcggcgatctggttggcggatgcctcctccaacagaggagaggaggaatgatccgccaaaacctggcggcagcgcaaaagatg

SEQ ID NO: 108438 - DNA, 103 bp, Artificial Sequence
  Synthetic Polynucleotide
taatacgactcactatagggaggctctgggtctgaaccatctccctccataacagaggagaatggagatggatggttcaaacctggcggcagcgcaaaagatg

SEQ ID NO: 108439 - DNA, 103 bp, Artificial Sequence
  Synthetic Polynucleotide
taatacgactcactatagggcatgaagcagttgatgtccggtttgcggcaaacagaggagatgccgcatgccggacatcaacctggcggcagcgcaaaagatg

SEQ ID NO: 108440 - DNA, 103 bp, Artificial Sequence
  Synthetic Polynucleotide
taatacgactcactatagggcttcttctcagacttcttctcccgacgcttaacagaggagaaagcgtatggagaagaagaacctggcggcagcgcaaaagatg

SEQ ID NO: 108441 - DNA, 103 bp, Artificial Sequence
  Synthetic Polynucleotide
taatacgactcactatagggtctccatcaccttcttctcagacttcttctaacagaggagaagaagaatgctgagaagaaacctggcggcagcgcaaaagatg

SEQ ID NO: 108442 - DNA, 103 bp, Artificial Sequence
  Synthetic Polynucleotide
taatacgactcactatagggtcctccttcctctccatcaccttcttctcaaacagaggagatgagaaatgggtgatggaaacctggcggcagcgcaaaagatg

SEQ ID NO: 108443 - DNA, 103 bp, Artificial Sequence
  Synthetic Polynucleotide
taatacgactcactatagggcttgtatcgctcctccttcctctccatcacaacagaggagagtgatgatgaggaaggagaacctggcggcagcgcaaaagatg

SEQ ID NO: 108444 - DNA, 103 bp, Artificial Sequence
  Synthetic Polynucleotide
taatacgactcactataggggccgatgccgcttgtatcgctcctccttccaacagaggagaggaaggatgagcgatacaaacctggcggcagcgcaaaagatg

SEQ ID NO: 108445 - DNA, 103 bp, Artificial Sequence
  Synthetic Polynucleotide
taatacgactcactatagggttctgcttctgccgatgccgcttgtatcgcaacagaggagagcgataatggcggcatcgaacctggcggcagcgcaaaagatg

SEQ ID NO: 108446 - DNA, 103 bp, Artificial Sequence
  Synthetic Polynucleotide
taatacgactcactatagggatccttgtgcttctgcttctgccgatgccgaacagaggagacggcatatgcagaagcagaacctggcggcagcgcaaaagatg

SEQ ID NO: 108447 - DNA, 103 bp, Artificial Sequence
  Synthetic Polynucleotide
taatacgactcactataggggtttccatttatccttgtgcttctgcttctaacagaggagaagaagcatgagcacaaggaacctggcggcagcgcaaaagatg

SEQ ID NO: 108448 - DNA, 103 bp, Artificial Sequence
  Synthetic Polynucleotide
taatacgactcactatagggctctctgggtgtttccatttatccttgtgcaacagaggagagcacaaatgtaaatggaaaacctggcggcagcgcaaaagatg

SEQ ID NO: 108449 - DNA, 103 bp, Artificial Sequence
  Synthetic Polynucleotide
taatacgactcactatagggggcatcagccctctctgggtgtttccatttaacagaggagaaaatggatgcacccagagaacctggcggcagcgcaaaagatg

SEQ ID NO: 108450 - DNA, 103 bp, Artificial Sequence
  Synthetic Polynucleotide
taatacgactcactatagggcacacccgatcatgaagcagttgatgtccgaacagaggagacggacaatgactgcttcaaacctggcggcagcgcaaaagatg

SEQ ID NO: 108451 - DNA, 103 bp, Artificial Sequence
  Synthetic Polynucleotide
taatacgactcactatagggcagggtccttggcatcagccctctctgggtaacagaggagaacccagatggggctgatgaacctggcggcagcgcaaaagatg

SEQ ID NO: 108452 - DNA, 103 bp, Artificial Sequence
  Synthetic Polynucleotide
taatacgactcactatagggggcagtgacgcagggtccttggcatcagccaacagaggagaggctgaatgcaaggacccaacctggcggcagcgcaaaagatg

SEQ ID NO: 108453 - DNA, 103 bp, Artificial Sequence
  Synthetic Polynucleotide
taatacgactcactatagggcaggcactggggcagtgacgcagggtccttaacagaggagaaaggacatggcgtcactgaacctggcggcagcgcaaaagatg

SEQ ID NO: 108454 - DNA, 103 bp, Artificial Sequence
  Synthetic Polynucleotide
taatacgactcactatagggagccgggccccaggcactggggcagtgacgaacagaggagacgtcacatgcccagtgccaacctggcggcagcgcaaaagatg

SEQ ID NO: 108455 - DNA, 103 bp, Artificial Sequence
  Synthetic Polynucleotide
taatacgactcactataggggggcgcacacagccgggccccaggcactggaacagaggagaccagtgatgggggcccggaacctggcggcagcgcaaaagatg

SEQ ID NO: 108456 - DNA, 103 bp, Artificial Sequence
  Synthetic Polynucleotide
taatacgactcactataggggggctgggcggggcgcacacagccgggcccaacagaggagagggcccatgtgtgtgcgcaacctggcggcagcgcaaaagatg

SEQ ID NO: 108457 - DNA, 103 bp, Artificial Sequence
  Synthetic Polynucleotide
taatacgactcactatagggacttggagctgggctgggcggggcgcacacaacagaggagagtgtgcatgccgcccagcaacctggcggcagcgcaaaagatg

SEQ ID NO: 108458 - DNA, 103 bp, Artificial Sequence
  Synthetic Polynucleotide
taatacgactcactatagggtctgagcaatacttggagctgggctgggcgaacagaggagacgcccaatgcagctccaaaacctggcggcagcgcaaaagatg

SEQ ID NO: 108459 - DNA, 103 bp, Artificial Sequence
  Synthetic Polynucleotide
taatacgactcactataggggccacagtcatctgagcaatacttggagctaacagaggagaagctccatgtattgctcaaacctggcggcagcgcaaaagatg

SEQ ID NO: 108460 - DNA, 103 bp, Artificial Sequence
  Synthetic Polynucleotide
taatacgactcactatagggccagcttcatgccacagtcatctgagcaataacagaggagaattgctatgatgactgtgaacctggcggcagcgcaaaagatg

SEQ ID NO: 108461 - DNA, 103 bp, Artificial Sequence
  Synthetic Polynucleotide
taatacgactcactatagggttgcagttgtcacacccgatcatgaagcagaacagaggagactgcttatggatcgggtgaacctggcggcagcgcaaaagatg

SEQ ID NO: 108462 - DNA, 103 bp, Artificial Sequence
  Synthetic Polynucleotide
taatacgactcactatagggcggttggctgccagcttcatgccacagtcaaacagaggagatgactgatgcatgaagctaacctggcggcagcgcaaaagatg

SEQ ID NO: 108463 - DNA, 103 bp, Artificial Sequence
  Synthetic Polynucleotide
taatacgactcactatagggctcgtagatgcggttggctgccagcttcataacagaggagaatgaagatggcagccaacaacctggcggcagcgcaaaagatg

SEQ ID NO: 108464 - DNA, 103 bp, Artificial Sequence
  Synthetic Polynucleotide
taatacgactcactataggggggggaggatctcgtagatgcggttggctgaacagaggagacagccaatggcatctacgaacctggcggcagcgcaaaagatg

SEQ ID NO: 108465 - DNA, 103 bp, Artificial Sequence
  Synthetic Polynucleotide
taatacgactcactatagggtggatgcgctgggggaggatctcgtagatgaacagaggagacatctaatggatcctcccaacctggcggcagcgcaaaagatg

SEQ ID NO: 108466 - DNA, 103 bp, Artificial Sequence
  Synthetic Polynucleotide
taatacgactcactatagggctgccactgctggatgcgctgggggaggataacagaggagaatcctcatgcagcgcatcaacctggcggcagcgcaaaagatg

SEQ ID NO: 108467 - DNA, 103 bp, Artificial Sequence
  Synthetic Polynucleotide
taatacgactcactatagggaagggctctgctgccactgctggatgcgctaacagaggagaagcgcaatgagcagtggcaacctggcggcagcgcaaaagatg

SEQ ID NO: 108468 - DNA, 103 bp, Artificial Sequence
  Synthetic Polynucleotide
taatacgactcactatagggtcagcaatgcaagggctctgctgccactgcaacagaggagagcagtgatggcagagcccaacctggcggcagcgcaaaagatg

SEQ ID NO: 108469 - DNA, 103 bp, Artificial Sequence
  Synthetic Polynucleotide
taatacgactcactataggggccgtgctcttcagcaatgcaagggctctgaacagaggagacagagcatgtgcattgctaacctggcggcagcgcaaaagatg

SEQ ID NO: 108470 - DNA, 103 bp, Artificial Sequence
  Synthetic Polynucleotide
taatacgactcactataggggcagcttcttgccgtgctcttcagcaatgcaacagaggagagcattgatgaagagcacgaacctggcggcagcgcaaaagatg

SEQ ID NO: 108471 - DNA, 103 bp, Artificial Sequence
  Synthetic Polynucleotide
taatacgactcactatagggatgcgttcgagcagcttcttgccgtgctctaacagaggagaagagcaatgcaagaagctaacctggcggcagcgcaaaagatg

SEQ ID NO: 108472 - DNA, 103 bp, Artificial Sequence
  Synthetic Polynucleotide
taatacgactcactataggggaaccactcattgcagttgtcacacccgataacagaggagaatcgggatggacaactgcaacctggcggcagcgcaaaagatg

SEQ ID NO: 108473 - DNA, 103 bp, Artificial Sequence
  Synthetic Polynucleotide
taatacgactcactatagggctctcggcgaatgcgttcgagcagcttcttaacagaggagaaagaagatgctcgaacgcaacctggcggcagcgcaaaagatg

SEQ ID NO: 108474 - DNA, 103 bp, Artificial Sequence
  Synthetic Polynucleotide
taatacgactcactatagggcactctgctgctctcggcgaatgcgttcgaaacagaggagatcgaacatgttcgccgagaacctggcggcagcgcaaaagatg

SEQ ID NO: 108475 - DNA, 103 bp, Artificial Sequence
  Synthetic Polynucleotide
taatacgactcactatagggcgagtgcgggcactctgctgctctcggcgaaacagaggagatcgccgatggcagcagagaacctggcggcagcgcaaaagatg

SEQ ID NO: 108476 - DNA, 103 bp, Artificial Sequence
  Synthetic Polynucleotide
taatacgactcactatagggttcctgaaggcgagtgcgggcactctgctgaacagaggagacagcagatggcccgcactaacctggcggcagcgcaaaagatg

SEQ ID NO: 108477 - DNA, 103 bp, Artificial Sequence
  Synthetic Polynucleotide
taatacgactcactatagggggcgttccatttcctgaaggcgagtgcgggaacagaggagacccgcaatggccttcaggaacctggcggcagcgcaaaagatg

SEQ ID NO: 108478 - DNA, 103 bp, Artificial Sequence
  Synthetic Polynucleotide
taatacgactcactatagggtcatggaatcggcgttccatttcctgaaggaacagaggagaccttcaatgaatggaacgaacctggcggcagcgcaaaagatg

SEQ ID NO: 108479 - DNA, 103 bp, Artificial Sequence
  Synthetic Polynucleotide
taatacgactcactatagggggcctcaagctcatggaatcggcgttccataacagaggagaatggaaatgcgattccataacctggcggcagcgcaaaagatg

SEQ ID NO: 108480 - DNA, 103 bp, Artificial Sequence
  Synthetic Polynucleotide
taatacgactcactataggggtagaatgatggcctcaagctcatggaatcaacagaggagagattccatgagcttgaggaacctggcggcagcgcaaaagatg

SEQ ID NO: 108481 - DNA, 103 bp, Artificial Sequence
  Synthetic Polynucleotide
taatacgactcactatagggtgcttggcacgtagaatgatggcctcaagcaacagaggagagcttgaatgcatcattctaacctggcggcagcgcaaaagatg

SEQ ID NO: 108482 - DNA, 103 bp, Artificial Sequence
  Synthetic Polynucleotide
taatacgactcactatagggcacagcctgctgcttggcacgtagaatgataacagaggagaatcattatgcgtgccaagaacctggcggcagcgcaaaagatg

SEQ ID NO: 108483 - DNA, 103 bp, Artificial Sequence
  Synthetic Polynucleotide
taatacgactcactatagggagtccccatggaaccactcattgcagttgtaacagaggagaacaactatgatgagtggtaacctggcggcagcgcaaaagatg

SEQ ID NO: 108484 - DNA, 103 bp, Artificial Sequence
  Synthetic Polynucleotide
taatacgactcactatagggcatcctcgcgcacagcctgctgcttggcacaacagaggagagtgccaatgagcaggctgaacctggcggcagcgcaaaagatg

SEQ ID NO: 108485 - DNA, 103 bp, Artificial Sequence
  Synthetic Polynucleotide
taatacgactcactatagggttgctctcctcatcctcgcgcacagcctgcaacagaggagagcaggcatggcgcgaggaaacctggcggcagcgcaaaagatg

SEQ ID NO: 108486 - DNA, 103 bp, Artificial Sequence
  Synthetic Polynucleotide
taatacgactcactataggggtcaccctcgttgctctcctcatcctcgcgaacagaggagacgcgagatggaggagagcaacctggcggcagcgcaaaagatg

SEQ ID NO: 108487 - DNA, 103 bp, Artificial Sequence
  Synthetic Polynucleotide
taatacgactcactatagggtgtcatcactgtcaccctcgttgctctcctaacagaggagaaggagaatgacgagggtgaacctggcggcagcgcaaaagatg

SEQ ID NO: 108488 - DNA, 103 bp, Artificial Sequence
  Synthetic Polynucleotide
taatacgactcactatagggtgcaggtctgtgtcatcactgtcaccctcgaacagaggagacgagggatgcagtgatgaaacctggcggcagcgcaaaagatg

SEQ ID NO: 108489 - DNA, 103 bp, Artificial Sequence
  Synthetic Polynucleotide
taatacgactcactatagggacagaagatctgcaggtctgtgtcatcactaacagaggagaagtgatatgacagacctgaacctggcggcagcgcaaaagatg

SEQ ID NO: 108490 - DNA, 103 bp, Artificial Sequence
  Synthetic Polynucleotide
taatacgactcactatagggcacaggaaacacagaagatctgcaggtctgaacagaggagacagaccatgagatcttctaacctggcggcagcgcaaaagatg

SEQ ID NO: 108491 - DNA, 103 bp, Artificial Sequence
  Synthetic Polynucleotide
taatacgactcactatagggatggggtgcccacaggaaacacagaagatcaacagaggagagatcttatgtgtttcctgaacctggcggcagcgcaaaagatg

SEQ ID NO: 108492 - DNA, 103 bp, Artificial Sequence
  Synthetic Polynucleotide
taatacgactcactatagggacgtgggttgatggggtgcccacaggaaacaacagaggagagtttccatggggcaccccaacctggcggcagcgcaaaagatg

SEQ ID NO: 108493 - DNA, 103 bp, Artificial Sequence
  Synthetic Polynucleotide
taatacgactcactataggggcaaggcaacacgtgggttgatggggtgccaacagaggagaggcaccatgtcaacccacaacctggcggcagcgcaaaagatg

SEQ ID NO: 108494 - DNA, 103 bp, Artificial Sequence
  Synthetic Polynucleotide
taatacgactcactatagggatccggatgcagtccccatggaaccactcaaacagaggagatgagtgatgccatggggaaacctggcggcagcgcaaaagatg

SEQ ID NO: 108495 - DNA, 103 bp, Artificial Sequence
  Synthetic Polynucleotide
taatacgactcactatagggtccatgtggcgcaaggcaacacgtgggttgaacagaggagacaacccatgtgttgccttaacctggcggcagcgcaaaagatg

SEQ ID NO: 108496 - DNA, 103 bp, Artificial Sequence
  Synthetic Polynucleotide
taatacgactcactataggggtagcagcgctccatgtggcgcaaggcaacaacagaggagagttgccatgcgccacatgaacctggcggcagcgcaaaagatg

SEQ ID NO: 108497 - DNA, 103 bp, Artificial Sequence
  Synthetic Polynucleotide
taatacgactcactatagggcatacttggcgtagcagcgctccatgtggcaacagaggagagccacaatgagcgctgctaacctggcggcagcgcaaaagatg

SEQ ID NO: 108498 - DNA, 103 bp, Artificial Sequence
  Synthetic Polynucleotide
taatacgactcactataggggtctggctctcatacttggcgtagcagcgcaacagaggagagcgctgatgcgccaagtaaacctggcggcagcgcaaaagatg

SEQ ID NO: 108499 - DNA, 103 bp, Artificial Sequence
  Synthetic Polynucleotide
taatacgactcactatagggcccaaaggacgtctggctctcatacttggcaacagaggagagccaagatggagagccagaacctggcggcagcgcaaaagatg

SEQ ID NO: 108500 - DNA, 103 bp, Artificial Sequence
  Synthetic Polynucleotide
taatacgactcactatagggggtacatggacccaaaggacgtctggctctaacagaggagaagagccatgcgtcctttgaacctggcggcagcgcaaaagatg

SEQ ID NO: 108501 - DNA, 103 bp, Artificial Sequence
  Synthetic Polynucleotide
taatacgactcactatagggatgcgtgtggggtacatggacccaaaggacaacagaggagagtccttatggtccatgtaaacctggcggcagcgcaaaagatg

SEQ ID NO: 108502 - DNA, 103 bp, Artificial Sequence
  Synthetic Polynucleotide
taatacgactcactatagggggccccttcaatgcgtgtggggtacatggaaacagaggagatccatgatgcccacacgcaacctggcggcagcgcaaaagatg

SEQ ID NO: 108503 - DNA, 103 bp, Artificial Sequence
  Synthetic Polynucleotide
taatacgactcactatagggagagtcgtgtggccccttcaatgcgtgtggaacagaggagaccacacatgttgaaggggaacctggcggcagcgcaaaagatg

SEQ ID NO: 108504 - DNA, 103 bp, Artificial Sequence
  Synthetic Polynucleotide
taatacgactcactatagggacatcacagaagagtcgtgtggccccttcaaacagaggagatgaaggatgcacacgactaacctggcggcagcgcaaaagatg

SEQ ID NO: 108505 - DNA, 103 bp, Artificial Sequence
  Synthetic Polynucleotide
taatacgactcactatagggcttctcagtgatccggatgcagtccccatgaacagaggagacatgggatgtgcatccggaacctggcggcagcgcaaaagatg

SEQ ID NO: 108506 - DNA, 103 bp, Artificial Sequence
  Synthetic Polynucleotide
taatacgactcactatagggaggattatacacatcacagaagagtcgtgtaacagaggagaacacgaatgttctgtgataacctggcggcagcgcaaaagatg

SEQ ID NO: 108507 - DNA, 103 bp, Artificial Sequence
  Synthetic Polynucleotide
taatacgactcactatagggttttgctctgaggattatacacatcacagaaacagaggagatctgtgatgtgtataatcaacctggcggcagcgcaaaagatg

SEQ ID NO: 108508 - DNA, 103 bp, Artificial Sequence
  Synthetic Polynucleotide
taatacgactcactatagggttacagtatgttttgctctgaggattatacaacagaggagagtataaatgtcagagcaaaacctggcggcagcgcaaaagatg

SEQ ID NO: 108509 - DNA, 103 bp, Artificial Sequence
  Synthetic Polynucleotide
taatacgactcactatagggctggagccgcttacagtatgttttgctctgaacagaggagacagagcatgacatactgtaacctggcggcagcgcaaaagatg

SEQ ID NO: 108510 - DNA, 103 bp, Artificial Sequence
  Synthetic Polynucleotide
taatacgactcactatagggggcacagcacctggagccgcttacagtatgaacagaggagacatactatgagcggctccaacctggcggcagcgcaaaagatg

SEQ ID NO: 108511 - DNA, 103 bp, Artificial Sequence
  Synthetic Polynucleotide
taatacgactcactataggggagtgctcggggcacagcacctggagccgcaacagaggagagcggctatgggtgctgtgaacctggcggcagcgcaaaagatg

SEQ ID NO: 108512 - DNA, 103 bp, Artificial Sequence
  Synthetic Polynucleotide
taatacgactcactatagggggggtcccgtgagtgctcggggcacagcacaacagaggagagtgctgatgcccgagcacaacctggcggcagcgcaaaagatg

SEQ ID NO: 108513 - DNA, 103 bp, Artificial Sequence
  Synthetic Polynucleotide
taatacgactcactatagggctggcactttggggtcccgtgagtgctcggaacagaggagaccgagcatgcacgggaccaacctggcggcagcgcaaaagatg

SEQ ID NO: 108514 - DNA, 103 bp, Artificial Sequence
  Synthetic Polynucleotide
taatacgactcactatagggacctcgtcagctggcactttggggtcccgtaacagaggagaacgggaatgcaaagtgccaacctggcggcagcgcaaaagatg

SEQ ID NO: 108515 - DNA, 103 bp, Artificial Sequence
  Synthetic Polynucleotide
taatacgactcactataggggcacccgcatacctcgtcagctggcactttaacagaggagaaaagtgatggctgacgagaacctggcggcagcgcaaaagatg

SEQ ID NO: 108516 - DNA, 103 bp, Artificial Sequence
  Synthetic Polynucleotide
taatacgactcactatagggccttggccatcttctcagtgatccggatgcaacagaggagagcatccatgtcactgagaaacctggcggcagcgcaaaagatg

SEQ ID NO: 108517 - DNA, 103 bp, Artificial Sequence
  Synthetic Polynucleotide
taatacgactcactataggggtacaagggggcacccgcatacctcgtcagaacagaggagactgacgatgtatgcgggtaacctggcggcagcgcaaaagatg

SEQ ID NO: 108518 - DNA, 103 bp, Artificial Sequence
  Synthetic Polynucleotide
taatacgactcactatagggaagacatcacgtacaagggggcacccgcataacagaggagaatgcggatgcccccttgtaacctggcggcagcgcaaaagatg

SEQ ID NO: 108519 - DNA, 103 bp, Artificial Sequence
  Synthetic Polynucleotide
taatacgactcactatagggcgtgagctcaaagacatcacgtacaaggggaacagaggagaccccttatgcgtgatgtcaacctggcggcagcgcaaaagatg

SEQ ID NO: 108520 - DNA, 103 bp, Artificial Sequence
  Synthetic Polynucleotide
taatacgactcactatagggagaagtcacccgtgagctcaaagacatcacaacagaggagagtgatgatgttgagctcaaacctggcggcagcgcaaaagatg

SEQ ID NO: 108521 - DNA, 103 bp, Artificial Sequence
  Synthetic Polynucleotide
taatacgactcactatagggggcaggcggcagaagtcacccgtgagctcaaacagaggagatgagctatggggtgacttaacctggcggcagcgcaaaagatg

SEQ ID NO: 108522 - DNA, 103 bp, Artificial Sequence
  Synthetic Polynucleotide
taatacgactcactatagggctggcgcttgggcaggcggcagaagtcaccaacagaggagaggtgacatgtgccgcctgaacctggcggcagcgcaaaagatg

SEQ ID NO: 108523 - DNA, 103 bp, Artificial Sequence
  Synthetic Polynucleotide
taatacgactcactatagggggcgattgcactggcgcttgggcaggcggcaacagaggagagccgccatgccaagcgccaacctggcggcagcgcaaaagatg

SEQ ID NO: 108524 - DNA, 103 bp, Artificial Sequence
  Synthetic Polynucleotide
taatacgactcactatagggcagcagtaatggcgattgcactggcgcttgaacagaggagacaagcgatggtgcaatcgaacctggcggcagcgcaaaagatg

SEQ ID NO: 108525 - DNA, 103 bp, Artificial Sequence
  Synthetic Polynucleotide
taatacgactcactatagggcagcttctcccagcagtaatggcgattgcaaacagaggagatgcaatatgcattactgcaacctggcggcagcgcaaaagatg

SEQ ID NO: 108526 - DNA, 103 bp, Artificial Sequence
  Synthetic Polynucleotide
taatacgactcactatagggccgcacgccgcagcttctcccagcagtaataacagaggagaattactatggggagaagcaacctggcggcagcgcaaaagatg

SEQ ID NO: 108527 - DNA, 103 bp, Artificial Sequence
  Synthetic Polynucleotide
taatacgactcactatagggtcccggatggccttggccatcttctcagtgaacagaggagacactgaatggatggccaaaacctggcggcagcgcaaaagatg

SEQ ID NO: 108528 - DNA, 103 bp, Artificial Sequence
  Synthetic Polynucleotide
taatacgactcactatagggaagtccacttccgcacgccgcagcttctccaacagaggagaggagaaatggcggcgtgcaacctggcggcagcgcaaaagatg

SEQ ID NO: 108529 - DNA, 103 bp, Artificial Sequence
  Synthetic Polynucleotide
taatacgactcactatagggcacgcgctccaagtccacttccgcacgccgaacagaggagacggcgtatggaagtggacaacctggcggcagcgcaaaagatg

SEQ ID NO: 108530 - DNA, 103 bp, Artificial Sequence
  Synthetic Polynucleotide
taatacgactcactatagggaccacacacgcacgcgctccaagtccacttaacagaggagaaagtggatgtggagcgcgaacctggcggcagcgcaaaagatg

SEQ ID NO: 108531 - DNA, 103 bp, Artificial Sequence
  Synthetic Polynucleotide
taatacgactcactatagggtccagcttgtaccacacacgcacgcgctccaacagaggagaggagcgatggcgtgtgtgaacctggcggcagcgcaaaagatg

SEQ ID NO: 108532 - DNA, 103 bp, Artificial Sequence
  Synthetic Polynucleotide
taatacgactcactatagggaaacagctcgtccagcttgtaccacacacgaacagaggagacgtgtgatgtacaagctgaacctggcggcagcgcaaaagatg

SEQ ID NO: 108533 - DNA, 103 bp, Artificial Sequence
  Synthetic Polynucleotide
taatacgactcactataggggctcctgctcaaacagctcgtccagcttgtaacagaggagaacaagcatgacgagctgtaacctggcggcagcgcaaaagatg

SEQ ID NO: 108534 - DNA, 103 bp, Artificial Sequence
  Synthetic Polynucleotide
taatacgactcactatagggcgcacattgcgctcctgctcaaacagctcgaacagaggagacgagctatgtgagcaggaaacctggcggcagcgcaaaagatg

SEQ ID NO: 108535 - DNA, 103 bp, Artificial Sequence
  Synthetic Polynucleotide
taatacgactcactatagggcatggctgtgcgcacattgcgctcctgctcaacagaggagagagcagatgcgcaatgtgaacctggcggcagcgcaaaagatg

SEQ ID NO: 108536 - DNA, 103 bp, Artificial Sequence
  Synthetic Polynucleotide
taatacgactcactatagggcgcggtttgtcatggctgtgcgcacattgcaacagaggagagcaatgatggcacagccaaacctggcggcagcgcaaaagatg

SEQ ID NO: 108537 - DNA, 103 bp, Artificial Sequence
  Synthetic Polynucleotide
taatacgactcactatagggagcaatcccgcgcggtttgtcatggctgtgaacagaggagacacagcatggacaaaccgaacctggcggcagcgcaaaagatg

SEQ ID NO: 108538 - DNA, 103 bp, Artificial Sequence
  Synthetic Polynucleotide
taatacgactcactatagggacagtaccactcccggatggccttggccataacagaggagaatggccatggccatccggaacctggcggcagcgcaaaagatg

SEQ ID NO: 108539 - DNA, 103 bp, Artificial Sequence
  Synthetic Polynucleotide
taatacgactcactatagggcatcagggccagcaatcccgcgcggtttgtaacagaggagaacaaacatggcgggattgaacctggcggcagcgcaaaagatg

SEQ ID NO: 108540 - DNA, 103 bp, Artificial Sequence
  Synthetic Polynucleotide
taatacgactcactatagggtctggtgcagcatcagggccagcaatcccgaacagaggagacgggatatgtggccctgaaacctggcggcagcgcaaaagatg

SEQ ID NO: 108541 - DNA, 103 bp, Artificial Sequence
  Synthetic Polynucleotide
taatacgactcactatagggtgctggatcgtctggtgcagcatcagggccaacagaggagaggccctatggctgcaccaaacctggcggcagcgcaaaagatg

SEQ ID NO: 108542 - DNA, 103 bp, Artificial Sequence
  Synthetic Polynucleotide
taatacgactcactataggggaggggatcgtgctggatcgtctggtgcagaacagaggagactgcacatgacgatccagaacctggcggcagcgcaaaagatg

SEQ ID NO: 108543 - DNA, 103 bp, Artificial Sequence
  Synthetic Polynucleotide
taatacgactcactatagggggtcggtagtgaggggatcgtgctggatcgaacagaggagacgatccatgacgatccccaacctggcggcagcgcaaaagatg

SEQ ID NO: 108544 - DNA, 103 bp, Artificial Sequence
  Synthetic Polynucleotide
taatacgactcactatagggctggagcgcaggtcggtagtgaggggatcgaacagaggagacgatccatgcactaccgaaacctggcggcagcgcaaaagatg

SEQ ID NO: 108545 - DNA, 103 bp, Artificial Sequence
  Synthetic Polynucleotide
taatacgactcactataggggcggtcggcactggagcgcaggtcggtagtaacagaggagaactaccatgctgcgctccaacctggcggcagcgcaaaagatg

SEQ ID NO: 108546 - DNA, 103 bp, Artificial Sequence
  Synthetic Polynucleotide
taatacgactcactatagggcggcatctggaggctctgggtctgaaccataacagaggagaatggttatgacccagagcaacctggcggcagcgcaaaagatg

SEQ ID NO: 108547 - DNA, 103 bp, Artificial Sequence
  Synthetic Polynucleotide
taatacgactcactatagggtgcactcccgacagtaccactcccggatggaacagaggagaccatccatgagtggtactaacctggcggcagcgcaaaagatg

SEQ ID NO: 108548 - DNA, 103 bp, Artificial Sequence
  Synthetic Polynucleotide
taatacgactcactatagggtctttctctctgcactcccgacagtaccacaacagaggagagtggtaatgtcgggagtgaacctggcggcagcgcaaaagatg

SEQ ID NO: 108549 - DNA, 103 bp, Artificial Sequence
  Synthetic Polynucleotide
taatacgactcactatagggtagcttggggtctttctctctgcactcccgaacagaggagacgggagatgagagagaaaaacctggcggcagcgcaaaagatg

SEQ ID NO: 108550 - DNA, 103 bp, Artificial Sequence
  Synthetic Polynucleotide
taatacgactcactatagggagcgaatctctagcttggggtctttctctcaacagaggagagagagaatgaccccaagcaacctggcggcagcgcaaaagatg

SEQ ID NO: 108551 - DNA, 103 bp, Artificial Sequence
  Synthetic Polynucleotide
taatacgactcactatagggttgtgccgatagcgaatctctagcttggggaacagaggagaccccaaatgagagattcgaacctggcggcagcgcaaaagatg

SEQ ID NO: 108552 - DNA, 103 bp, Artificial Sequence
  Synthetic Polynucleotide
taatacgactcactatagggccgtgacttcttgtgccgatagcgaatctcaacagaggagagagattatgtatcggcacaacctggcggcagcgcaaaagatg

SEQ ID NO: 108553 - DNA, 103 bp, Artificial Sequence
  Synthetic Polynucleotide
taatacgactcactatagggcatcccgctcccgtgacttcttgtgccgataacagaggagaatcggcatgagaagtcacaacctggcggcagcgcaaaagatg

SEQ ID NO: 108554 - DNA, 103 bp, Artificial Sequence
  Synthetic Polynucleotide
taatacgactcactatagggcgctcattgccatcccgctcccgtgacttcaacagaggagagaagtcatgggagcgggaaacctggcggcagcgcaaaagatg

SEQ ID NO: 108555 - DNA, 103 bp, Artificial Sequence
  Synthetic Polynucleotide
taatacgactcactatagggactgctgtcccgctcattgccatcccgctcaacagaggagagagcggatgggcaatgagaacctggcggcagcgcaaaagatg

SEQ ID NO: 108556 - DNA, 103 bp, Artificial Sequence
  Synthetic Polynucleotide
taatacgactcactatagggcccggggctcactgctgtcccgctcattgcaacagaggagagcaatgatggggacagcaaacctggcggcagcgcaaaagatg

SEQ ID NO: 108557 - DNA, 103 bp, Artificial Sequence
  Synthetic Polynucleotide
taatacgactcactatagggctgtcctccccggcatctggaggctctgggaacagaggagacccagaatgtccagatgcaacctggcggcagcgcaaaagatg

SEQ ID NO: 108558 - DNA, 103 bp, Artificial Sequence
  Synthetic Polynucleotide
taatacgactcactatagggccaccctcatcccggggctcactgctgtccaacagaggagaggacagatgtgagccccgaacctggcggcagcgcaaaagatg

SEQ ID NO: 108559 - DNA, 103 bp, Artificial Sequence
  Synthetic Polynucleotide
taatacgactcactatagggcttgcgccctccaccctcatcccggggctcaacagaggagagagcccatggatgagggtaacctggcggcagcgcaaaagatg

SEQ ID NO: 108560 - DNA, 103 bp, Artificial Sequence
  Synthetic Polynucleotide
taatacgactcactatagggggacaggcctcttgcgccctccaccctcataacagaggagaatgaggatggagggcgcaaacctggcggcagcgcaaaagatg

SEQ ID NO: 108561 - DNA, 103 bp, Artificial Sequence
  Synthetic Polynucleotide
taatacgactcactatagggtctggatcagggacaggcctcttgcgccctaacagaggagaagggcgatggaggcctgtaacctggcggcagcgcaaaagatg

SEQ ID NO: 108562 - DNA, 103 bp, Artificial Sequence
  Synthetic Polynucleotide
taatacgactcactataggggcgctgcaggtctggatcagggacaggcctaacagaggagaaggcctatgcctgatccaaacctggcggcagcgcaaaagatg

SEQ ID NO: 108563 - DNA, 103 bp, Artificial Sequence
  Synthetic Polynucleotide
taatacgactcactatagggaccctgcccggcgctgcaggtctggatcagaacagaggagactgatcatgacctgcagcaacctggcggcagcgcaaaagatg

SEQ ID NO: 108564 - DNA, 103 bp, Artificial Sequence
  Synthetic Polynucleotide
taatacgactcactatagggcctgtccctgaccctgcccggcgctgcaggaacagaggagacctgcaatgccgggcaggaacctggcggcagcgcaaaagatg

SEQ ID NO: 108565 - DNA, 103 bp, Artificial Sequence
  Synthetic Polynucleotide
taatacgactcactatagggggccccaacccctgtccctgaccctgcccgaacagaggagacgggcaatgtcagggacaaacctggcggcagcgcaaaagatg

SEQ ID NO: 108566 - DNA, 103 bp, Artificial Sequence
  Synthetic Polynucleotide
taatacgactcactataggggagcaagcatggccccaacccctgtccctgaacagaggagacagggaatggggttggggaacctggcggcagcgcaaaagatg

SEQ ID NO: 108567 - DNA, 103 bp, Artificial Sequence
  Synthetic Polynucleotide
taatacgactcactataggggcagagccccgagcaagcatggccccaaccaacagaggagaggttggatgcatgcttgcaacctggcggcagcgcaaaagatg

SEQ ID NO: 108568 - DNA, 103 bp, Artificial Sequence
  Synthetic Polynucleotide
taatacgactcactatagggctcggacttgctgtcctccccggcatctggaacagaggagaccagatatgggggaggacaacctggcggcagcgcaaaagatg

SEQ ID NO: 108569 - DNA, 103 bp, Artificial Sequence
  Synthetic Polynucleotide
taatacgactcactataggggtggggcgaagcagagccccgagcaagcataacagaggagaatgcttatgcggggctctaacctggcggcagcgcaaaagatg

SEQ ID NO: 108570 - DNA, 103 bp, Artificial Sequence
  Synthetic Polynucleotide
taatacgactcactataggggagaggatttgtggggcgaagcagagccccaacagaggagaggggctatgcttcgccccaacctggcggcagcgcaaaagatg

SEQ ID NO: 108571 - DNA, 103 bp, Artificial Sequence
  Synthetic Polynucleotide
taatacgactcactatagggaagggctgcggagaggatttgtggggcgaaaacagaggagattcgccatgcaaatcctcaacctggcggcagcgcaaaagatg

SEQ ID NO: 108572 - DNA, 103 bp, Artificial Sequence
  Synthetic Polynucleotide
taatacgactcactatagggtgtggccaccaagggctgcggagaggatttaacagaggagaaaatccatgccgcagcccaacctggcggcagcgcaaaagatg

SEQ ID NO: 108573 - DNA, 103 bp, Artificial Sequence
  Synthetic Polynucleotide
taatacgactcactataggggctggctgggtgtggccaccaagggctgcgaacagaggagacgcagcatgtggtggccaaacctggcggcagcgcaaaagatg

SEQ ID NO: 108574 - DNA, 103 bp, Artificial Sequence
  Synthetic Polynucleotide
taatacgactcactatagggtgctggtgatgctggctgggtgtggccaccaacagaggagaggtggcatgacccagccaaacctggcggcagcgcaaaagatg

SEQ ID NO: 108575 - DNA, 103 bp, Artificial Sequence
  Synthetic Polynucleotide
taatacgactcactatagggctgctgctgctgctggtgatgctggctgggaacagaggagacccagcatgcatcaccagaacctggcggcagcgcaaaagatg

SEQ ID NO: 108576 - DNA, 103 bp, Artificial Sequence
  Synthetic Polynucleotide
taatacgactcactataggggtttgatctgctgctgctgctgctggtgataacagaggagaatcaccatgagcagcagcaacctggcggcagcgcaaaagatg

SEQ ID NO: 108577 - DNA, 103 bp, Artificial Sequence
  Synthetic Polynucleotide
taatacgactcactatagggcgggctgaccgtttgatctgctgctgctgcaacagaggagagcagcaatggcagatcaaaacctggcggcagcgcaaaagatg

SEQ ID NO: 108578 - DNA, 103 bp, Artificial Sequence
  Synthetic Polynucleotide
taatacgactcactatagggaccacacatgcgggctgaccgtttgatctgaacagaggagacagatcatgcggtcagccaacctggcggcagcgcaaaagatg

SEQ ID NO: 108579 - DNA, 103 bp, Artificial Sequence
  Synthetic Polynucleotide
taatacgactcactatagggtctccccattctcggacttgctgtcctcccaacagaggagagggaggatggcaagtccgaacctggcggcagcgcaaaagatg

SEQ ID NO: 108580 - DNA, 103 bp, Artificial Sequence
  Synthetic Polynucleotide
taatacgactcactatagggcctcacactcaccacacatgcgggctgaccaacagaggagaggtcagatggcatgtgtgaacctggcggcagcgcaaaagatg

SEQ ID NO: 108581 - DNA, 103 bp, Artificial Sequence
  Synthetic Polynucleotide
taatacgactcactatagggcgccgacatgcctcacactcaccacacatgaacagaggagacatgtgatgtgagtgtgaaacctggcggcagcgcaaaagatg

SEQ ID NO: 108582 - DNA, 103 bp, Artificial Sequence
  Synthetic Polynucleotide
taatacgactcactataggggtcctcagtgcgccgacatgcctcacactcaacagaggagagagtgtatggcatgtcggaacctggcggcagcgcaaaagatg

SEQ ID NO: 108583 - DNA, 103 bp, Artificial Sequence
  Synthetic Polynucleotide
taatacgactcactatagggagtgaccacagtcctcagtgcgccgacatgaacagaggagacatgtcatggcactgaggaacctggcggcagcgcaaaagatg

SEQ ID NO: 108584 - DNA, 103 bp, Artificial Sequence
  Synthetic Polynucleotide
taatacgactcactatagggcagaaatcacagtgaccacagtcctcagtgaacagaggagacactgaatgctgtggtcaaacctggcggcagcgcaaaagatg

SEQ ID NO: 108585 - DNA, 103 bp, Artificial Sequence
  Synthetic Polynucleotide
taatacgactcactatagggcatgtcccgacagaaatcacagtgaccacaaacagaggagatgtggtatgtgtgatttcaacctggcggcagcgcaaaagatg

SEQ ID NO: 108586 - DNA, 103 bp, Artificial Sequence
  Synthetic Polynucleotide
taatacgactcactatagggcgaacttcttcatgtcccgacagaaatcacaacagaggagagtgattatggtcgggacaaacctggcggcagcgcaaaagatg

SEQ ID NO: 108587 - DNA, 103 bp, Artificial Sequence
  Synthetic Polynucleotide
taatacgactcactatagggttggggcccccgaacttcttcatgtcccgaaacagaggagatcgggaatggaagaagttaacctggcggcagcgcaaaagatg

SEQ ID NO: 108588 - DNA, 103 bp, Artificial Sequence
  Synthetic Polynucleotide
taatacgactcactatagggccggatcttgttggggcccccgaacttcttaacagaggagaaagaagatggggggccccaacctggcggcagcgcaaaagatg

SEQ ID NO: 108589 - DNA, 103 bp, Artificial Sequence
  Synthetic Polynucleotide
taatacgactcactatagggggcacttctgccggatcttgttggggccccaacagaggagaggggccatgacaagatccaacctggcggcagcgcaaaagatg

SEQ ID NO: 108590 - DNA, 103 bp, Artificial Sequence
  Synthetic Polynucleotide
taatacgactcactatagggatgggcgcattctccccattctcggacttgaacagaggagacaagtcatggaatggggaaacctggcggcagcgcaaaagatg

SEQ ID NO: 108591 - DNA, 103 bp, Artificial Sequence
  Synthetic Polynucleotide
taatacgactcactatagggtggcgcagccggcacttctgccggatcttgaacagaggagacaagatatggcagaagtgaacctggcggcagcgcaaaagatg

SEQ ID NO: 108592 - DNA, 103 bp, Artificial Sequence
  Synthetic Polynucleotide
taatacgactcactatagggcagctggcactggcgcagccggcacttctgaacagaggagacagaagatgcggctgcgcaacctggcggcagcgcaaaagatg

SEQ ID NO: 108593 - DNA, 103 bp, Artificial Sequence
  Synthetic Polynucleotide
taatacgactcactatagggcccgggcccgcagctggcactggcgcagccaacagaggagaggctgcatgagtgccagcaacctggcggcagcgcaaaagatg

SEQ ID NO: 108594 - DNA, 103 bp, Artificial Sequence
  Synthetic Polynucleotide
taatacgactcactatagggttgtacgattcccgggcccgcagctggcacaacagaggagagtgccaatggcgggcccgaacctggcggcagcgcaaaagatg

SEQ ID NO: 108595 - DNA, 103 bp, Artificial Sequence
  Synthetic Polynucleotide
taatacgactcactatagggagggaagtacttgtacgattcccgggcccgaacagaggagacgggccatggaatcgtacaacctggcggcagcgcaaaagatg

SEQ ID NO: 108596 - DNA, 103 bp, Artificial Sequence
  Synthetic Polynucleotide
taatacgactcactatagggagagcgaggaagggaagtacttgtacgattaacagaggagaaatcgtatgagtacttccaacctggcggcagcgcaaaagatg

SEQ ID NO: 108597 - DNA, 103 bp, Artificial Sequence
  Synthetic Polynucleotide
taatacgactcactataggggtcactggtgagagcgaggaagggaagtacaacagaggagagtacttatgttcctcgctaacctggcggcagcgcaaaagatg

SEQ ID NO: 108598 - DNA, 103 bp, Artificial Sequence
  Synthetic Polynucleotide
taatacgactcactatagggctctgagggcgtcactggtgagagcgaggaaacagaggagatcctcgatgtcaccagtgaacctggcggcagcgcaaaagatg

SEQ ID NO: 108599 - DNA, 103 bp, Artificial Sequence
  Synthetic Polynucleotide
taatacgactcactatagggttggcagggactctgagggcgtcactggtgaacagaggagacaccagatgcgccctcagaacctggcggcagcgcaaaagatg

SEQ ID NO: 108600 - DNA, 103 bp, Artificial Sequence
  Synthetic Polynucleotide
taatacgactcactatagggcggcggggccttggcagggactctgagggcaacagaggagagccctcatggtccctgccaacctggcggcagcgcaaaagatg

SEQ ID NO: 108601 - DNA, 103 bp, Artificial Sequence
  Synthetic Polynucleotide
taatacgactcactataggggatgcagtagatgggcgcattctccccattaacagaggagaaatgggatgaatgcgcccaacctggcggcagcgcaaaagatg

SEQ ID NO: 108602 - DNA, 103 bp, Artificial Sequence
  Synthetic Polynucleotide
taatacgactcactataggggggcagtggccggcggggccttggcagggaaacagaggagatccctgatgaggccccgcaacctggcggcagcgcaaaagatg

SEQ ID NO: 108603 - DNA, 103 bp, Artificial Sequence
  Synthetic Polynucleotide
taatacgactcactataggggctgttgggtgggcagtggccggcggggccaacagaggagaggccccatgggccactgcaacctggcggcagcgcaaaagatg

SEQ ID NO: 108604 - DNA, 103 bp, Artificial Sequence
  Synthetic Polynucleotide
taatacgactcactatagggggctgtggctgctgttgggtgggcagtggcaacagaggagagccactatgcacccaacaaacctggcggcagcgcaaaagatg

SEQ ID NO: 108605 - DNA, 103 bp, Artificial Sequence
  Synthetic Polynucleotide
taatacgactcactatagggcttctgtgatggctgtggctgctgttgggtaacagaggagaacccaaatgcagccacagaacctggcggcagcgcaaaagatg

SEQ ID NO: 108606 - DNA, 103 bp, Artificial Sequence
  Synthetic Polynucleotide
taatacgactcactatagggtgcgccctaacttctgtgatggctgtggctaacagaggagaagccacatgcatcacagaaacctggcggcagcgcaaaagatg

SEQ ID NO: 108607 - DNA, 103 bp, Artificial Sequence
  Synthetic Polynucleotide
taatacgactcactatagggtcttcacggatgcgccctaacttctgtgataacagaggagaatcacaatggttagggcgaacctggcggcagcgcaaaagatg

SEQ ID NO: 108608 - DNA, 103 bp, Artificial Sequence
  Synthetic Polynucleotide
taatacgactcactatagggtgccccctcatcttcacggatgcgccctaaaacagaggagattagggatgatccgtgaaaacctggcggcagcgcaaaagatg

SEQ ID NO: 108609 - DNA, 103 bp, Artificial Sequence
  Synthetic Polynucleotide
taatacgactcactatagggatgacgccactgccccctcatcttcacggaaacagaggagatccgtgatgatgagggggaacctggcggcagcgcaaaagatg

SEQ ID NO: 108610 - DNA, 103 bp, Artificial Sequence
  Synthetic Polynucleotide
taatacgactcactatagggttgactgttgatgacgccactgccccctcaaacagaggagatgagggatgagtggcgtcaacctggcggcagcgcaaaagatg

SEQ ID NO: 108611 - DNA, 103 bp, Artificial Sequence
  Synthetic Polynucleotide
taatacgactcactatagggaggaggctccttgactgttgatgacgccacaacagaggagagtggcgatgtcaacagtcaacctggcggcagcgcaaaagatg

SEQ ID NO: 108612 - DNA, 103 bp, Artificial Sequence
  Synthetic Polynucleotide
taatacgactcactataggggtttgcggcagatgcagtagatgggcgcataacagaggagaatgcgcatgtctactgcaaacctggcggcagcgcaaaagatg

SEQ ID NO: 108613 - DNA, 103 bp, Artificial Sequence
  Synthetic Polynucleotide
taatacgactcactatagggctgtagcctcaggaggctccttgactgttgaacagaggagacaacagatgaggagcctcaacctggcggcagcgcaaaagatg

SEQ ID NO: 108614 - DNA, 103 bp, Artificial Sequence
  Synthetic Polynucleotide
taatacgactcactatagggtcaggtgtggctgtagcctcaggaggctccaacagaggagaggagccatgtgaggctacaacctggcggcagcgcaaaagatg

SEQ ID NO: 108615 - DNA, 103 bp, Artificial Sequence
  Synthetic Polynucleotide
taatacgactcactatagggtgagagtggctcaggtgtggctgtagcctcaacagaggagagaggctatggccacacctaacctggcggcagcgcaaaagatg

SEQ ID NO: 108616 - DNA, 103 bp, Artificial Sequence
  Synthetic Polynucleotide
taatacgactcactatagggggtcctcatctgagagtggctcaggtgtggaacagaggagaccacacatgagccactctaacctggcggcagcgcaaaagatg

SEQ ID NO: 108617 - DNA, 103 bp, Artificial Sequence
  Synthetic Polynucleotide
taatacgactcactatagggtccagaggtaggtcctcatctgagagtggcaacagaggagagccactatgagatgaggaaacctggcggcagcgcaaaagatg

SEQ ID NO: 108618 - DNA, 103 bp, Artificial Sequence
  Synthetic Polynucleotide
taatacgactcactatagggcaggtcaggatccagaggtaggtcctcatcaacagaggagagatgagatgctacctctgaacctggcggcagcgcaaaagatg

SEQ ID NO: 108619 - DNA, 103 bp, Artificial Sequence
  Synthetic Polynucleotide
taatacgactcactatagggagtcctgatacaggtcaggatccagaggtaaacagaggagatacctcatgatcctgaccaacctggcggcagcgcaaaagatg

SEQ ID NO: 108620 - DNA, 103 bp, Artificial Sequence
  Synthetic Polynucleotide
taatacgactcactatagggcctgcacagaagtcctgatacaggtcaggaaacagaggagatcctgaatggtatcaggaaacctggcggcagcgcaaaagatg

SEQ ID NO: 108621 - DNA, 103 bp, Artificial Sequence
  Synthetic Polynucleotide
taatacgactcactatagggatcaaaggcccctgcacagaagtcctgataaacagaggagatatcagatgttctgtgcaaacctggcggcagcgcaaaagatg

SEQ ID NO: 108622 - DNA, 103 bp, Artificial Sequence
  Synthetic Polynucleotide
taatacgactcactatagggggccatggtcatcaaaggcccctgcacagaaacagaggagatctgtgatggggcctttgaacctggcggcagcgcaaaagatg

SEQ ID NO: 108623 - DNA, 103 bp, Artificial Sequence
  Synthetic Polynucleotide
taatacgactcactatagggttgatgtccggtttgcggcagatgcagtagaacagaggagactactgatgctgccgcaaaacctggcggcagcgcaaaagatg

SEQ ID NO: 108624 - DNA, 103 bp, Artificial Sequence
  Synthetic Polynucleotide
taatacgactcactatagggatccagggcaggccatggtcatcaaaggccaacagaggagaggccttatgtgaccatggaacctggcggcagcgcaaaagatg

SEQ ID NO: 108625 - DNA, 103 bp, Artificial Sequence
  Synthetic Polynucleotide
taatacgactcactatagggtgtgtcgctcatccagggcaggccatggtcaacagaggagagaccatatgctgccctggaacctggcggcagcgcaaaagatg

SEQ ID NO: 108626 - DNA, 103 bp, Artificial Sequence
  Synthetic Polynucleotide
taatacgactcactataggggggactcttctgtgtcgctcatccagggcaaacagaggagatgccctatgtgagcgacaaacctggcggcagcgcaaaagatg

SEQ ID NO: 108627 - DNA, 103 bp, Artificial Sequence
  Synthetic Polynucleotide
taatacgactcactatagggtccaggaatggggactcttctgtgtcgctcaacagaggagagagcgaatgagaagagtcaacctggcggcagcgcaaaagatg

SEQ ID NO: 108628 - DNA, 103 bp, Artificial Sequence
  Synthetic Polynucleotide
taatacgactcactatagggcagcgcggggtccaggaatggggactcttcaacagaggagagaagagatgccattcctgaacctggcggcagcgcaaaagatg

SEQ ID NO: 108629 - DNA, 103 bp, Artificial Sequence
  Synthetic Polynucleotide
taatacgactcactatagggccctcttccgcagcgcggggtccaggaatgaacagaggagacattccatgaccccgcgcaacctggcggcagcgcaaaagatg

SEQ ID NO: 108630 - DNA, 103 bp, Artificial Sequence
  Synthetic Polynucleotide
taatacgactcactatagggactttcactgccctcttccgcagcgcggggaacagaggagaccccgcatggcggaagagaacctggcggcagcgcaaaagatg

SEQ ID NO: 108631 - DNA, 103 bp, Artificial Sequence
  Synthetic Polynucleotide
taatacgactcactatagggcacatgcttcactttcactgccctcttccgaacagaggagacggaagatggcagtgaaaaacctggcggcagcgcaaaagatg

SEQ ID NO: 108632 - DNA, 103 bp, Artificial Sequence
  Synthetic Polynucleotide
taatacgactcactatagggcccgacgcttcacatgcttcactttcactgaacagaggagacagtgaatgtgaagcatgaacctggcggcagcgcaaaagatg

SEQ ID NO: 108633 - DNA, 103 bp, Artificial Sequence
  Synthetic Polynucleotide
taatacgactcactataggggacttcttctcccgacgcttcacatgcttcaacagaggagagaagcaatggaagcgtcgaacctggcggcagcgcaaaagatg

SEQ ID NO: 108634 - DNA, 103 bp, Artificial Sequence
  Synthetic Polynucleotide
taatacgactcactatagggcggagggatcaaagccgccggcactgccataacagaggagaatggcaatgccggcggctaacctggcggcagcgcaaaagatg

SEQ ID NO: 108635 - DNA, 103 bp, Artificial Sequence
  Synthetic Polynucleotide
taatacgactcactatagggcggagacgaagtcgccgaagaggtggaggtaacagaggagaacctccatgtcttcggcgaacctggcggcagcgcaaaagatg

SEQ ID NO: 108636 - DNA, 103 bp, Artificial Sequence
  Synthetic Polynucleotide
taatacgactcactatagggttcagcaatagctgcattggtagcagcagcaacagaggagagctgctatgaccaatgcaaacctggcggcagcgcaaaagatg

SEQ ID NO: 108637 - DNA, 103 bp, Artificial Sequence
  Synthetic Polynucleotide
taatacgactcactatagggccttcattgcttcagcaatagctgcattggaacagaggagaccaatgatgctattgctgaacctggcggcagcgcaaaagatg

SEQ ID NO: 108638 - DNA, 103 bp, Artificial Sequence
  Synthetic Polynucleotide
taatacgactcactatagggatttttttcaccttcattgcttcagcaataaacagaggagatattgcatgagcaatgaaaacctggcggcagcgcaaaagatg

SEQ ID NO: 108639 - DNA, 103 bp, Artificial Sequence
  Synthetic Polynucleotide
taatacgactcactatagggttctaatttgatttttttcaccttcattgcaacagaggagagcaatgatggtgaaaaaaaacctggcggcagcgcaaaagatg

SEQ ID NO: 108640 - DNA, 103 bp, Artificial Sequence
  Synthetic Polynucleotide
taatacgactcactatagggtgctcatggcttctaatttgatttttttcaaacagaggagatgaaaaatgtcaaattagaacctggcggcagcgcaaaagatg

SEQ ID NO: 108641 - DNA, 103 bp, Artificial Sequence
  Synthetic Polynucleotide
taatacgactcactataggggcatgatagttgctcatggcttctaatttgaacagaggagacaaattatgagccatgagaacctggcggcagcgcaaaagatg

SEQ ID NO: 108642 - DNA, 103 bp, Artificial Sequence
  Synthetic Polynucleotide
taatacgactcactataggggttattactggcatgatagttgctcatggcaacagaggagagccatgatgaactatcataacctggcggcagcgcaaaagatg

SEQ ID NO: 108643 - DNA, 103 bp, Artificial Sequence
  Synthetic Polynucleotide
taatacgactcactatagggctccatgttggttattactggcatgatagtaacagaggagaactatcatgccagtaataaacctggcggcagcgcaaaagatg

SEQ ID NO: 108644 - DNA, 103 bp, Artificial Sequence
  Synthetic Polynucleotide
taatacgactcactatagggtcagagtctgctccatgttggttattactgaacagaggagacagtaaatgccaacatggaacctggcggcagcgcaaaagatg

SEQ ID NO: 108645 - DNA, 103 bp, Artificial Sequence
  Synthetic Polynucleotide
taatacgactcactataggggtccccgttttcagagtctgctccatgttgaacagaggagacaacatatggcagactctaacctggcggcagcgcaaaagatg

SEQ ID NO: 108646 - DNA, 103 bp, Artificial Sequence
  Synthetic Polynucleotide
taatacgactcactatagggtggaaggagccggagacgaagtcgccgaagaacagaggagacttcggatgcttcgtctcaacctggcggcagcgcaaaagatg

SEQ ID NO: 108647 - DNA, 103 bp, Artificial Sequence
  Synthetic Polynucleotide
taatacgactcactatagggttgaattcatgtccccgttttcagagtctgaacagaggagacagactatgaaaacggggaacctggcggcagcgcaaaagatg

SEQ ID NO: 108648 - DNA, 103 bp, Artificial Sequence
  Synthetic Polynucleotide
taatacgactcactatagggagtccgacacttgaattcatgtccccgtttaacagaggagaaaacggatgcatgaattcaacctggcggcagcgcaaaagatg

SEQ ID NO: 108649 - DNA, 103 bp, Artificial Sequence
  Synthetic Polynucleotide
taatacgactcactatagggaggaagttccagtccgacacttgaattcataacagaggagaatgaatatgagtgtcggaaacctggcggcagcgcaaaagatg

SEQ ID NO: 108650 - DNA, 103 bp, Artificial Sequence
  Synthetic Polynucleotide
taatacgactcactatagggtcatcataaaaggaagttccagtccgacacaacagaggagagtgtcgatgtggaacttcaacctggcggcagcgcaaaagatg

SEQ ID NO: 108651 - DNA, 103 bp, Artificial Sequence
  Synthetic Polynucleotide
taatacgactcactataggggggtggggcatcatcataaaaggaagttccaacagaggagaggaactatgttttatgataacctggcggcagcgcaaaagatg

SEQ ID NO: 108652 - DNA, 103 bp, Artificial Sequence
  Synthetic Polynucleotide
taatacgactcactatagggaggaattagagggtggggcatcatcataaaaacagaggagatttatgatgatgccccacaacctggcggcagcgcaaaagatg

SEQ ID NO: 108653 - DNA, 103 bp, Artificial Sequence
  Synthetic Polynucleotide
taatacgactcactataggggtaggctgacaggaattagagggtggggcaaacagaggagatgccccatgctctaattcaacctggcggcagcgcaaaagatg

SEQ ID NO: 108654 - DNA, 103 bp, Artificial Sequence
  Synthetic Polynucleotide
taatacgactcactataggggatgctggaggtaggctgacaggaattagaaacagaggagatctaatatgtgtcagcctaacctggcggcagcgcaaaagatg

SEQ ID NO: 108655 - DNA, 103 bp, Artificial Sequence
  Synthetic Polynucleotide
taatacgactcactatagggcatggtgacagatgctggaggtaggctgacaacagaggagagtcagcatgcctccagcaaacctggcggcagcgcaaaagatg

SEQ ID NO: 108656 - DNA, 103 bp, Artificial Sequence
  Synthetic Polynucleotide
taatacgactcactatagggggctcattgccatggtgacagatgctggagaacagaggagactccagatgctgtcaccaaacctggcggcagcgcaaaagatg

SEQ ID NO: 108657 - DNA, 103 bp, Artificial Sequence
  Synthetic Polynucleotide
taatacgactcactataggggggggtccgatggaaggagccggagacgaaaacagaggagattcgtcatgggctccttcaacctggcggcagcgcaaaagatg

SEQ ID NO: 108658 - DNA, 103 bp, Artificial Sequence
  Synthetic Polynucleotide
taatacgactcactatagggtggttcatctggctcattgccatggtgacaaacagaggagatgtcacatgggcaatgagaacctggcggcagcgcaaaagatg

SEQ ID NO: 108659 - DNA, 103 bp, Artificial Sequence
  Synthetic Polynucleotide
taatacgactcactatagggggtgctgaggtggttcatctggctcattgcaacagaggagagcaatgatgcagatgaacaacctggcggcagcgcaaaagatg

SEQ ID NO: 108660 - DNA, 103 bp, Artificial Sequence
  Synthetic Polynucleotide
taatacgactcactatagggtatttgcaatggtgctgaggtggttcatctaacagaggagaagatgaatgacctcagcaaacctggcggcagcgcaaaagatg

SEQ ID NO: 108661 - DNA, 103 bp, Artificial Sequence
  Synthetic Polynucleotide
taatacgactcactataggggctgctgccatatttgcaatggtgctgaggaacagaggagacctcagatgcattgcaaaaacctggcggcagcgcaaaagatg

SEQ ID NO: 108662 - DNA, 103 bp, Artificial Sequence
  Synthetic Polynucleotide
taatacgactcactatagggaacttgtgctgctgctgccatatttgcaataacagaggagaattgcaatgatggcagcaaacctggcggcagcgcaaaagatg

SEQ ID NO: 108663 - DNA, 103 bp, Artificial Sequence
  Synthetic Polynucleotide
taatacgactcactatagggggggactctgaacttgtgctgctgctgccaaacagaggagatggcagatgcagcacaagaacctggcggcagcgcaaaagatg

SEQ ID NO: 108664 - DNA, 103 bp, Artificial Sequence
  Synthetic Polynucleotide
taatacgactcactatagggactctggatgggggactctgaacttgtgctaacagaggagaagcacaatgtcagagtccaacctggcggcagcgcaaaagatg

SEQ ID NO: 108665 - DNA, 103 bp, Artificial Sequence
  Synthetic Polynucleotide
taatacgactcactatagggtgatgtctcaactctggatgggggactctgaacagaggagacagagtatgccatccagaaacctggcggcagcgcaaaagatg

SEQ ID NO: 108666 - DNA, 103 bp, Artificial Sequence
  Synthetic Polynucleotide
taatacgactcactatagggccttaataactgatgtctcaactctggatgaacagaggagacatccaatgttgagacataacctggcggcagcgcaaaagatg

SEQ ID NO: 108667 - DNA, 103 bp, Artificial Sequence
  Synthetic Polynucleotide
taatacgactcactatagggggaacacgctccttaataactgatgtctcaaacagaggagatgagacatgagttattaaaacctggcggcagcgcaaaagatg

SEQ ID NO: 108668 - DNA, 103 bp, Artificial Sequence
  Synthetic Polynucleotide
taatacgactcactatagggagaggacgccgggggtccgatggaaggagcaacagaggagagctcctatgatcggacccaacctggcggcagcgcaaaagatg

SEQ ID NO: 108669 - DNA, 103 bp, Artificial Sequence
  Synthetic Polynucleotide
taatacgactcactatagggggggctatcaggaacacgctccttaataacaacagaggagagttattatggagcgtgttaacctggcggcagcgcaaaagatg

SEQ ID NO: 108670 - DNA, 103 bp, Artificial Sequence
  Synthetic Polynucleotide
taatacgactcactataggggggcaggtgaggggctatcaggaacacgctaacagaggagaagcgtgatgctgatagccaacctggcggcagcgcaaaagatg

SEQ ID NO: 108671 - DNA, 103 bp, Artificial Sequence
  Synthetic Polynucleotide
taatacgactcactatagggtccagagagggggcaggtgaggggctatcaaacagaggagatgatagatgctcacctgcaacctggcggcagcgcaaaagatg

SEQ ID NO: 108672 - DNA, 103 bp, Artificial Sequence
  Synthetic Polynucleotide
taatacgactcactatagggtctcccctcctccagagagggggcaggtgaaacagaggagatcacctatgccctctctgaacctggcggcagcgcaaaagatg

SEQ ID NO: 108673 - DNA, 103 bp, Artificial Sequence
  Synthetic Polynucleotide
taatacgactcactatagggtgccaggccttctcccctcctccagagaggaacagaggagacctctcatgaggaggggaaacctggcggcagcgcaaaagatg

SEQ ID NO: 108674 - DNA, 103 bp, Artificial Sequence
  Synthetic Polynucleotide
taatacgactcactataggggatgggtgactgccaggccttctcccctccaacagaggagaggagggatgaaggcctggaacctggcggcagcgcaaaagatg

SEQ ID NO: 108675 - DNA, 103 bp, Artificial Sequence
  Synthetic Polynucleotide
taatacgactcactataggggcgatgtgatgatgggtgactgccaggcctaacagaggagaaggcctatgagtcacccaaacctggcggcagcgcaaaagatg

SEQ ID NO: 108676 - DNA, 103 bp, Artificial Sequence
  Synthetic Polynucleotide
taatacgactcactatagggcgctgctgctgcgatgtgatgatgggtgacaacagaggagagtcaccatgcatcacatcaacctggcggcagcgcaaaagatg

SEQ ID NO: 108677 - DNA, 103 bp, Artificial Sequence
  Synthetic Polynucleotide
taatacgactcactataggggagctggacacgctgctgctgcgatgtgataacagaggagaatcacaatgcagcagcagaacctggcggcagcgcaaaagatg

SEQ ID NO: 108678 - DNA, 103 bp, Artificial Sequence
  Synthetic Polynucleotide
taatacgactcactatagggccgagcaggggagctggacacgctgctgctaacagaggagaagcagcatggtgtccagcaacctggcggcagcgcaaaagatg

SEQ ID NO: 108679 - DNA, 103 bp, Artificial Sequence
  Synthetic Polynucleotide
taatacgactcactataggggagttggcccagaggacgccgggggtccgaaacagaggagatcggacatgcggcgtcctaacctggcggcagcgcaaaagatg

SEQ ID NO: 108680 - DNA, 103 bp, Artificial Sequence
  Synthetic Polynucleotide
taatacgactcactatagggagctctcagtccgagcaggggagctggacaaacagaggagatgtccaatgcccctgctcaacctggcggcagcgcaaaagatg

SEQ ID NO: 108681 - DNA, 103 bp, Artificial Sequence
  Synthetic Polynucleotide
taatacgactcactatagggctgtcagaagagctctcagtccgagcagggaacagaggagaccctgcatggactgagagaacctggcggcagcgcaaaagatg

SEQ ID NO: 108682 - DNA, 103 bp, Artificial Sequence
  Synthetic Polynucleotide
taatacgactcactataggggaccgggattctgtcagaagagctctcagtaacagaggagaactgagatgtcttctgacaacctggcggcagcgcaaaagatg

SEQ ID NO: 108683 - DNA, 103 bp, Artificial Sequence
  Synthetic Polynucleotide
taatacgactcactatagggcattctgatggaccgggattctgtcagaagaacagaggagacttctgatggaatcccggaacctggcggcagcgcaaaagatg

SEQ ID NO: 108684 - DNA, 103 bp, Artificial Sequence
  Synthetic Polynucleotide
taatacgactcactatagggatggacaacccattctgatggaccgggattaacagaggagaaatcccatgccatcagaaaacctggcggcagcgcaaaagatg

SEQ ID NO: 108685 - DNA, 103 bp, Artificial Sequence
  Synthetic Polynucleotide
taatacgactcactatagggcatctggttcatggacaacccattctgatgaacagaggagacatcagatggggttgtccaacctggcggcagcgcaaaagatg

SEQ ID NO: 108686 - DNA, 103 bp, Artificial Sequence
  Synthetic Polynucleotide
taatacgactcactatagggagcccatcagcatctggttcatggacaaccaacagaggagaggttgtatgtgaaccagaaacctggcggcagcgcaaaagatg

SEQ ID NO: 108687 - DNA, 103 bp, Artificial Sequence
  Synthetic Polynucleotide
taatacgactcactatagggtttggtgataagcccatcagcatctggttcaacagaggagagaaccaatggctgatgggaacctggcggcagcgcaaaagatg

SEQ ID NO: 108688 - DNA, 103 bp, Artificial Sequence
  Synthetic Polynucleotide
taatacgactcactatagggaggaagtacatttggtgataagcccatcagaacagaggagactgatgatgttatcaccaaacctggcggcagcgcaaaagatg

SEQ ID NO: 108689 - DNA, 103 bp, Artificial Sequence
  Synthetic Polynucleotide
taatacgactcactatagggctttgggcccaggaagtacatttggtgataaacagaggagatatcacatgatgtacttcaacctggcggcagcgcaaaagatg

SEQ ID NO: 108690 - DNA, 103 bp, Artificial Sequence
  Synthetic Polynucleotide
taatacgactcactataggggggcggaacagagttggcccagaggacgccaacagaggagaggcgtcatgtgggccaacaacctggcggcagcgcaaaagatg

SEQ ID NO: 108691 - DNA, 103 bp, Artificial Sequence
  Synthetic Polynucleotide
taatacgactcactatagggaaatctccctctttgggcccaggaagtacaaacagaggagatgtactatgtgggcccaaaacctggcggcagcgcaaaagatg

SEQ ID NO: 108692 - DNA, 103 bp, Artificial Sequence
  Synthetic Polynucleotide
taatacgactcactatagggatgaccggccaaatctccctctttgggcccaacagaggagagggcccatggagggagataacctggcggcagcgcaaaagatg

SEQ ID NO: 108693 - DNA, 103 bp, Artificial Sequence
  Synthetic Polynucleotide
taatacgactcactataggggtcccatgtcatgaccggccaaatctccctaacagaggagaagggagatgtggccggtcaacctggcggcagcgcaaaagatg

SEQ ID NO: 108694 - DNA, 103 bp, Artificial Sequence
  Synthetic Polynucleotide
taatacgactcactatagggtttgactcatgtcccatgtcatgaccggccaacagaggagaggccggatgtgacatgggaacctggcggcagcgcaaaagatg

SEQ ID NO: 108695 - DNA, 103 bp, Artificial Sequence
  Synthetic Polynucleotide
taatacgactcactatagggatgcatcctttttgactcatgtcccatgtcaacagaggagagacatgatgcatgagtcaaacctggcggcagcgcaaaagatg

SEQ ID NO: 108696 - DNA, 103 bp, Artificial Sequence
  Synthetic Polynucleotide
taatacgactcactatagggctttttcaatatgcatcctttttgactcataacagaggagaatgagtatgaaaggatgcaacctggcggcagcgcaaaagatg

SEQ ID NO: 108697 - DNA, 103 bp, Artificial Sequence
  Synthetic Polynucleotide
taatacgactcactatagggggggtctcatctttttcaatatgcatccttaacagaggagaaaggatatgtattgaaaaaacctggcggcagcgcaaaagatg

SEQ ID NO: 108698 - DNA, 103 bp, Artificial Sequence
  Synthetic Polynucleotide
taatacgactcactatagggtgtagaaagcggggtctcatctttttcaataacagaggagaattgaaatggatgagaccaacctggcggcagcgcaaaagatg

SEQ ID NO: 108699 - DNA, 103 bp, Artificial Sequence
  Synthetic Polynucleotide
taatacgactcactatagggttgcggttggtgtagaaagcggggtctcataacagaggagaatgagaatgcgctttctaaacctggcggcagcgcaaaagatg

SEQ ID NO: 108700 - DNA, 103 bp, Artificial Sequence
  Synthetic Polynucleotide
taatacgactcactatagggaggctgtctcttgcggttggtgtagaaagcaacagaggagagctttcatgaccaaccgcaacctggcggcagcgcaaaagatg

SEQ ID NO: 108701 - DNA, 103 bp, Artificial Sequence
  Synthetic Polynucleotide
taatacgactcactataggggatgggctccgggcggaacagagttggcccaacagaggagagggccaatgctgttccgcaacctggcggcagcgcaaaagatg

SEQ ID NO: 108702 - DNA, 103 bp, Artificial Sequence
  Synthetic Polynucleotide
taatacgactcactataggggagtttgtcaaggctgtctcttgcggttggaacagaggagaccaaccatgagagacagcaacctggcggcagcgcaaaagatg

SEQ ID NO: 108703 - DNA, 103 bp, Artificial Sequence
  Synthetic Polynucleotide
taatacgactcactatagggcagttagagagagtttgtcaaggctgtctcaacagaggagagagacaatgttgacaaacaacctggcggcagcgcaaaagatg

SEQ ID NO: 108704 - DNA, 103 bp, Artificial Sequence
  Synthetic Polynucleotide
taatacgactcactatagggtgtccatgcccagttagagagagtttgtcaaacagaggagatgacaaatgctctctaacaacctggcggcagcgcaaaagatg

SEQ ID NO: 108705 - DNA, 103 bp, Artificial Sequence
  Synthetic Polynucleotide
taatacgactcactatagggaggcagtggttgtccatgcccagttagagaaacagaggagatctctaatggggcatggaaacctggcggcagcgcaaaagatg

SEQ ID NO: 108706 - DNA, 103 bp, Artificial Sequence
  Synthetic Polynucleotide
taatacgactcactataggggaaaacctggaggcagtggttgtccatgccaacagaggagaggcatgatgaaccactgcaacctggcggcagcgcaaaagatg

SEQ ID NO: 108707 - DNA, 103 bp, Artificial Sequence
  Synthetic Polynucleotide
taatacgactcactatagggaaaggagatggaaaacctggaggcagtggtaacagaggagaaccactatgtccaggtttaacctggcggcagcgcaaaagatg

SEQ ID NO: 108708 - DNA, 103 bp, Artificial Sequence
  Synthetic Polynucleotide
taatacgactcactatagggaggaaacagaaaaggagatggaaaacctggaacagaggagaccaggtatgccatctcctaacctggcggcagcgcaaaagatg

SEQ ID NO: 108709 - DNA, 103 bp, Artificial Sequence
  Synthetic Polynucleotide
taatacgactcactatagggacagtccatcaggaaacagaaaaggagatgaacagaggagacatctcatgttctgtttcaacctggcggcagcgcaaaagatg

SEQ ID NO: 108710 - DNA, 103 bp, Artificial Sequence
  Synthetic Polynucleotide
taatacgactcactatagggtcgatggaagacagtccatcaggaaacagaaacagaggagatctgttatgtgatggactaacctggcggcagcgcaaaagatg

SEQ ID NO: 108711 - DNA, 103 bp, Artificial Sequence
  Synthetic Polynucleotide
taatacgactcactatagggcagaagagtctcgatggaagacagtccatcaacagaggagagatggaatgtcttccatcaacctggcggcagcgcaaaagatg

SEQ ID NO: 108712 - DNA, 103 bp, Artificial Sequence
  Synthetic Polynucleotide
taatacgactcactatagggccgccgaagcgatgggctccgggcggaacaaacagaggagatgttccatgcggagcccaaacctggcggcagcgcaaaagatg

SEQ ID NO: 108713 - DNA, 103 bp, Artificial Sequence
  Synthetic Polynucleotide
taatacgactcactataggggtatgttagtcagaagagtctcgatggaagaacagaggagacttccaatgagactcttcaacctggcggcagcgcaaaagatg

SEQ ID NO: 108714 - DNA, 103 bp, Artificial Sequence
  Synthetic Polynucleotide
taatacgactcactatagggaacagcccctgtatgttagtcagaagagtcaacagaggagagactctatggactaacataacctggcggcagcgcaaaagatg

SEQ ID NO: 108715 - DNA, 103 bp, Artificial Sequence
  Synthetic Polynucleotide
taatacgactcactatagggggcaactttcaacagcccctgtatgttagtaacagaggagaactaacatgcaggggctgaacctggcggcagcgcaaaagatg

SEQ ID NO: 108716 - DNA, 103 bp, Artificial Sequence
  Synthetic Polynucleotide
taatacgactcactatagggcattatctatggcaactttcaacagcccctaacagaggagaaggggcatgtgaaagttgaacctggcggcagcgcaaaagatg

SEQ ID NO: 108717 - DNA, 103 bp, Artificial Sequence
  Synthetic Polynucleotide
taatacgactcactatagggtgagctctggcattatctatggcaactttcaacagaggagagaaagtatgcatagataaaacctggcggcagcgcaaaagatg

SEQ ID NO: 108718 - DNA, 103 bp, Artificial Sequence
  Synthetic Polynucleotide
taatacgactcactatagggctgtttctcttgagctctggcattatctataacagaggagaatagatatggccagagctaacctggcggcagcgcaaaagatg

SEQ ID NO: 108719 - DNA, 103 bp, Artificial Sequence
  Synthetic Polynucleotide
taatacgactcactatagggccagttggacctgtttctcttgagctctggaacagaggagaccagagatgaagagaaacaacctggcggcagcgcaaaagatg

SEQ ID NO: 108720 - DNA, 103 bp, Artificial Sequence
  Synthetic Polynucleotide
taatacgactcactatagggtcagttttttccagttggacctgtttctctaacagaggagaagagaaatgggtccaactaacctggcggcagcgcaaaagatg

SEQ ID NO: 108721 - DNA, 103 bp, Artificial Sequence
  Synthetic Polynucleotide
taatacgactcactatagggcatcttcagctcagttttttccagttggacaacagaggagagtccaaatggaaaaaactaacctggcggcagcgcaaaagatg

SEQ ID NO: 108722 - DNA, 103 bp, Artificial Sequence
  Synthetic Polynucleotide
taatacgactcactatagggttaaaaaatccatcttcagctcagttttttaacagaggagaaaaaaaatgagctgaagaaacctggcggcagcgcaaaagatg

SEQ ID NO: 108723 - DNA, 103 bp, Artificial Sequence
  Synthetic Polynucleotide
taatacgactcactataggggccgccgccgccgccgaagcgatgggctccaacagaggagaggagccatgcgcttcggcaacctggcggcagcgcaaaagatg

SEQ ID NO: 108724 - DNA, 103 bp, Artificial Sequence
  Synthetic Polynucleotide
taatacgactcactatagggtctctttcccttaaaaaatccatcttcagcaacagaggagagctgaaatgggattttttaacctggcggcagcgcaaaagatg

SEQ ID NO: 108725 - DNA, 103 bp, Artificial Sequence
  Synthetic Polynucleotide
taatacgactcactatagggttcccttagttctctttcccttaaaaaatcaacagaggagagattttatgagggaaagaaacctggcggcagcgcaaaagatg

SEQ ID NO: 108726 - DNA, 103 bp, Artificial Sequence
  Synthetic Polynucleotide
taatacgactcactatagggtctcaagtgtttcccttagttctctttcccaacagaggagagggaaaatgaactaagggaacctggcggcagcgcaaaagatg

SEQ ID NO: 108727 - DNA, 103 bp, Artificial Sequence
  Synthetic Polynucleotide
taatacgactcactataggggccaactgcttctcaagtgtttcccttagtaacagaggagaactaagatgaacacttgaaacctggcggcagcgcaaaagatg

SEQ ID NO: 108728 - DNA, 103 bp, Artificial Sequence
  Synthetic Polynucleotide
taatacgactcactatagggttgttccatagccaactgcttctcaagtgtaacagaggagaacacttatgaagcagttgaacctggcggcagcgcaaaagatg

SEQ ID NO: 108729 - DNA, 103 bp, Artificial Sequence
  Synthetic Polynucleotide
taatacgactcactatagggctctattcttttgttccatagccaactgctaacagaggagaagcagtatgctatggaacaacctggcggcagcgcaaaagatg

SEQ ID NO: 108730 - DNA, 103 bp, Artificial Sequence
  Synthetic Polynucleotide
taatacgactcactatagggtgaactatggctctattcttttgttccataaacagaggagatatggaatgaaagaatagaacctggcggcagcgcaaaagatg

SEQ ID NO: 108731 - DNA, 103 bp, Artificial Sequence
  Synthetic Polynucleotide
taatacgactcactatagggtagcctcttttgaactatggctctattcttaacagaggagaaagaatatggccatagttaacctggcggcagcgcaaaagatg

SEQ ID NO: 108732 - DNA, 103 bp, Artificial Sequence
  Synthetic Polynucleotide
taatacgactcactatagggtctccttctttagcctcttttgaactatggaacagaggagaccatagatgaaaagaggcaacctggcggcagcgcaaaagatg

SEQ ID NO: 108733 - DNA, 103 bp, Artificial Sequence
  Synthetic Polynucleotide
taatacgactcactatagggtttgccttcttctccttctttagcctctttaacagaggagaaaagagatgaaagaaggaaacctggcggcagcgcaaaagatg

SEQ ID NO: 108734 - DNA, 103 bp, Artificial Sequence
  Synthetic Polynucleotide
taatacgactcactataggggactgtggccgccgccgccgccgccgaagcaacagaggagagcttcgatggcggcggcgaacctggcggcagcgcaaaagatg

SEQ ID NO: 108735 - DNA, 103 bp, Artificial Sequence
  Synthetic Polynucleotide
taatacgactcactatagggcaattttctctttgccttcttctccttcttaacagaggagaaagaagatgaagaaggcaaacctggcggcagcgcaaaagatg

SEQ ID NO: 108736 - DNA, 103 bp, Artificial Sequence
  Synthetic Polynucleotide
taatacgactcactataggggtgcttcctgcaattttctctttgccttctaacagaggagaagaaggatgagagaaaataacctggcggcagcgcaaaagatg

SEQ ID NO: 108737 - DNA, 103 bp, Artificial Sequence
  Synthetic Polynucleotide
taatacgactcactatagggtcaaactcaagtgcttcctgcaattttctcaacagaggagagagaaaatggcaggaagcaacctggcggcagcgcaaaagatg

SEQ ID NO: 108738 - DNA, 103 bp, Artificial Sequence
  Synthetic Polynucleotide
taatacgactcactatagggccgtttcgtctcaaactcaagtgcttcctgaacagaggagacaggaaatgcttgagtttaacctggcggcagcgcaaaagatg

SEQ ID NO: 108739 - DNA, 103 bp, Artificial Sequence
  Synthetic Polynucleotide
taatacgactcactatagggcttgttcacgccgtttcgtctcaaactcaaaacagaggagattgagtatgagacgaaacaacctggcggcagcgcaaaagatg

SEQ ID NO: 108740 - DNA, 103 bp, Artificial Sequence
  Synthetic Polynucleotide
taatacgactcactataggggtctgttctgcttgttcacgccgtttcgtcaacagaggagagacgaaatggcgtgaacaaacctggcggcagcgcaaaagatg

SEQ ID NO: 108741 - DNA, 103 bp, Artificial Sequence
  Synthetic Polynucleotide
taatacgactcactatagggctgttttagcgtctgttctgcttgttcacgaacagaggagacgtgaaatggcagaacagaacctggcggcagcgcaaaagatg

SEQ ID NO: 108742 - DNA, 103 bp, Artificial Sequence
  Synthetic Polynucleotide
taatacgactcactatagggttgaagctgcctgttttagcgtctgttctgaacagaggagacagaacatgcgctaaaacaacctggcggcagcgcaaaagatg

SEQ ID NO: 108743 - DNA, 103 bp, Artificial Sequence
  Synthetic Polynucleotide
taatacgactcactatagggagactatctgttgaagctgcctgttttagcaacagaggagagctaaaatgggcagcttcaacctggcggcagcgcaaaagatg

SEQ ID NO: 108744 - DNA, 103 bp, Artificial Sequence
  Synthetic Polynucleotide
taatacgactcactatagggtaagaccctgagactatctgttgaagctgcaacagaggagagcagctatgacagatagtaacctggcggcagcgcaaaagatg

SEQ ID NO: 108745 - DNA, 103 bp, Artificial Sequence
  Synthetic Polynucleotide
taatacgactcactatagggccagctgggtcggagggatcaaagccgccgaacagaggagacggcggatgtgatccctcaacctggcggcagcgcaaaagatg

SEQ ID NO: 108746 - DNA, 103 bp, Artificial Sequence
  Synthetic Polynucleotide
taatacgactcactatagggcggtagaggtgactgtggccgccgccgccgaacagaggagacggcggatgcggccacagaacctggcggcagcgcaaaagatg

SEQ ID NO: 108747 - DNA, 103 bp, Artificial Sequence
  Synthetic Polynucleotide
taatacgactcactataggggagagtcatttaagaccctgagactatctgaacagaggagacagataatgtcagggtctaacctggcggcagcgcaaaagatg

SEQ ID NO: 108748 - DNA, 103 bp, Artificial Sequence
  Synthetic Polynucleotide
taatacgactcactatagggtctggggtcagagagtcatttaagaccctgaacagaggagacagggtatgaaatgactcaacctggcggcagcgcaaaagatg

SEQ ID NO: 108749 - DNA, 103 bp, Artificial Sequence
  Synthetic Polynucleotide
taatacgactcactatagggagcctctatctctggggtcagagagtcattaacagaggagaaatgacatgctgaccccaaacctggcggcagcgcaaaagatg

SEQ ID NO: 108750 - DNA, 103 bp, Artificial Sequence
  Synthetic Polynucleotide
taatacgactcactatagggcactgcggtcagcctctatctctggggtcaaacagaggagatgacccatgagatagaggaacctggcggcagcgcaaaagatg

SEQ ID NO: 108751 - DNA, 103 bp, Artificial Sequence
  Synthetic Polynucleotide
taatacgactcactataggggttctgccgccactgcggtcagcctctatcaacagaggagagatagaatgtgaccgcagaacctggcggcagcgcaaaagatg

SEQ ID NO: 108752 - DNA, 103 bp, Artificial Sequence
  Synthetic Polynucleotide
taatacgactcactatagggttcagcatctgttctgccgccactgcggtcaacagaggagagaccgcatgggcggcagaaacctggcggcagcgcaaaagatg

SEQ ID NO: 108753 - DNA, 103 bp, Artificial Sequence
  Synthetic Polynucleotide
taatacgactcactataggggtattgtcctttcagcatctgttctgccgcaacagaggagagcggcaatgcagatgctgaacctggcggcagcgcaaaagatg

SEQ ID NO: 108754 - DNA, 103 bp, Artificial Sequence
  Synthetic Polynucleotide
taatacgactcactatagggcttccatcttgtattgtcctttcagcatctaacagaggagaagatgcatgaaggacaataacctggcggcagcgcaaaagatg

SEQ ID NO: 108755 - DNA, 103 bp, Artificial Sequence
  Synthetic Polynucleotide
taatacgactcactatagggcaaatacagtcttccatcttgtattgtcctaacagaggagaaggacaatgcaagatggaaacctggcggcagcgcaaaagatg

SEQ ID NO: 108756 - DNA, 103 bp, Artificial Sequence
  Synthetic Polynucleotide
taatacgactcactatagggcagtagttttcaaatacagtcttccatcttaacagaggagaaagatgatggactgtattaacctggcggcagcgcaaaagatg

SEQ ID NO: 108757 - DNA, 103 bp, Artificial Sequence
  Synthetic Polynucleotide
taatacgactcactatagggccgccgccgccggtagaggtgactgtggccaacagaggagaggccacatgcacctctacaacctggcggcagcgcaaaagatg

SEQ ID NO: 108758 - DNA, 103 bp, Artificial Sequence
  Synthetic Polynucleotide
taatacgactcactatagggcagtacatgacagtagttttcaaatacagtaacagaggagaactgtaatggaaaactacaacctggcggcagcgcaaaagatg

SEQ ID NO: 108759 - DNA, 103 bp, Artificial Sequence
  Synthetic Polynucleotide
taatacgactcactataggggccgccgccgccgccgccgccggtagaggtaacagaggagaacctctatgggcggcggcaacctggcggcagcgcaaaagatg

SEQ ID NO: 108760 - DNA, 103 bp, Artificial Sequence
  Synthetic Polynucleotide
taatacgactcactatagggctccgctgccgccgccgccgccgccgccgcaacagaggagagcggcgatggcggcggcgaacctggcggcagcgcaaaagatg

SEQ ID NO: 108761 - DNA, 103 bp, Artificial Sequence
  Synthetic Polynucleotide
taatacgactcactatagggccgccgccgcctccgctgccgccgccgccgaacagaggagacggcggatgcggcagcggaacctggcggcagcgcaaaagatg

SEQ ID NO: 108762 - DNA, 103 bp, Artificial Sequence
  Synthetic Polynucleotide
taatacgactcactataggggccgctgctgccgccgccgcctccgctgccaacagaggagaggcagcatgggcggcggcaacctggcggcagcgcaaaagatg

SEQ ID NO: 108763 - DNA, 103 bp, Artificial Sequence
  Synthetic Polynucleotide
taatacgactcactatagggcgcctccgttgccgctgctgccgccgccgcaacagaggagagcggcgatggcagcagcgaacctggcggcagcgcaaaagatg

SEQ ID NO: 108764 - DNA, 103 bp, Artificial Sequence
  Synthetic Polynucleotide
taatacgactcactatagggccgccaccgccgcctccgttgccgctgctgaacagaggagacagcagatgcaacggaggaacctggcggcagcgcaaaagatg

SEQ ID NO: 108765 - DNA, 103 bp, Artificial Sequence
  Synthetic Polynucleotide
taatacgactcactatagggaccgccgccgccgccaccgccgcctccgttaacagaggagaaacggaatgggcggtggcaacctggcggcagcgcaaaagatg

SEQ ID NO: 108766 - DNA, 103 bp, Artificial Sequence
  Synthetic Polynucleotide
taatacgactcactatagggagttgctgccaccgccgccgccgccaccgcaacagaggagagcggtgatggcggcggcgaacctggcggcagcgcaaaagatg

SEQ ID NO: 108767 - DNA, 103 bp, Artificial Sequence
  Synthetic Polynucleotide
taatacgactcactatagggtgaggggggaccagctgggtcggagggatcaacagaggagagatcccatggacccagctaacctggcggcagcgcaaaagatg

SEQ ID NO: 108768 - DNA, 103 bp, Artificial Sequence
  Synthetic Polynucleotide
taatacgactcactatagggttggggttgcagttgctgccaccgccgccgaacagaggagacggcggatgtggcagcaaaacctggcggcagcgcaaaagatg

SEQ ID NO: 108769 - DNA, 103 bp, Artificial Sequence
  Synthetic Polynucleotide
taatacgactcactatagggggccgccaggttggggttgcagttgctgccaacagaggagaggcagcatgtgcaaccccaacctggcggcagcgcaaaagatg

SEQ ID NO: 108770 - DNA, 103 bp, Artificial Sequence
  Synthetic Polynucleotide
taatacgactcactatagggcgttgctcgcggccgccaggttggggttgcaacagaggagagcaaccatgacctggcggaacctggcggcagcgcaaaagatg

SEQ ID NO: 108771 - DNA, 103 bp, Artificial Sequence
  Synthetic Polynucleotide
taatacgactcactatagggccgccgctgccgttgctcgcggccgccaggaacagaggagacctggcatgcgcgagcaaaacctggcggcagcgcaaaagatg

SEQ ID NO: 108772 - DNA, 103 bp, Artificial Sequence
  Synthetic Polynucleotide
taatacgactcactataggggccgccgccgccgccgctgccgttgctcgcaacagaggagagcgagcatgggcagcggcaacctggcggcagcgcaaaagatg

SEQ ID NO: 108773 - DNA, 103 bp, Artificial Sequence
  Synthetic Polynucleotide
taatacgactcactatagggcgctgatgccgccgccgccgccgccgctgcaacagaggagagcagcgatggcggcggcgaacctggcggcagcgcaaaagatg

SEQ ID NO: 108774 - DNA, 103 bp, Artificial Sequence
  Synthetic Polynucleotide
taatacgactcactatagggccgccgccagcgctgatgccgccgccgccgaacagaggagacggcggatgcggcatcagaacctggcggcagcgcaaaagatg

SEQ ID NO: 108775 - DNA, 103 bp, Artificial Sequence
  Synthetic Polynucleotide
taatacgactcactatagggggaagcgacgccgccgccagcgctgatgccaacagaggagaggcatcatggctggcggcaacctggcggcagcgcaaaagatg

SEQ ID NO: 108776 - DNA, 103 bp, Artificial Sequence
  Synthetic Polynucleotide
taatacgactcactatagggtgggggtgctggaagcgacgccgccgccagaacagaggagactggcgatggcgtcgcttaacctggcggcagcgcaaaagatg

SEQ ID NO: 108777 - DNA, 103 bp, Artificial Sequence
  Synthetic Polynucleotide
taatacgactcactatagggctggcgttgatgggggtgctggaagcgacgaacagaggagacgtcgcatgcagcaccccaacctggcggcagcgcaaaagatg

SEQ ID NO: 108778 - DNA, 103 bp, Artificial Sequence
  Synthetic Polynucleotide
taatacgactcactataggggattgggggttgaggggggaccagctgggtaacagaggagaacccagatggtcccccctaacctggcggcagcgcaaaagatg

SEQ ID NO: 108779 - DNA, 103 bp, Artificial Sequence
  Synthetic Polynucleotide
taatacgactcactataggggctgccggtgctggcgttgatgggggtgctaacagaggagaagcaccatgatcaacgccaacctggcggcagcgcaaaagatg

SEQ ID NO: 108780 - DNA, 103 bp, Artificial Sequence
  Synthetic Polynucleotide
taatacgactcactatagggtgctgctgctgctgccggtgctggcgttgaaacagaggagatcaacgatggcaccggcaaacctggcggcagcgcaaaagatg

SEQ ID NO: 108781 - DNA, 103 bp, Artificial Sequence
  Synthetic Polynucleotide
taatacgactcactatagggctgctactgctgctgctgctgctgccggtgaacagaggagacaccggatgcagcagcagaacctggcggcagcgcaaaagatg

SEQ ID NO: 108782 - DNA, 103 bp, Artificial Sequence
  Synthetic Polynucleotide
taatacgactcactataggggctgctgctgctgctactgctgctgctgctaacagaggagaagcagcatgagcagtagcaacctggcggcagcgcaaaagatg

SEQ ID NO: 108783 - DNA, 103 bp, Artificial Sequence
  Synthetic Polynucleotide
taatacgactcactatagggtactgctgctgctgctgctgctgctactgcaacagaggagagcagtaatggcagcagcaaacctggcggcagcgcaaaagatg

SEQ ID NO: 108784 - DNA, 103 bp, Artificial Sequence
  Synthetic Polynucleotide
taatacgactcactatagggctgctgctactactgctgctgctgctgctgaacagaggagacagcagatgcagcagcagaacctggcggcagcgcaaaagatg

SEQ ID NO: 108785 - DNA, 103 bp, Artificial Sequence
  Synthetic Polynucleotide
taatacgactcactataggggctactgctgctgctgctactactgctgctaacagaggagaagcagcatgagtagcagcaacctggcggcagcgcaaaagatg

SEQ ID NO: 108786 - DNA, 103 bp, Artificial Sequence
  Synthetic Polynucleotide
taatacgactcactatagggagctgctgctgctactgctgctgctgctacaacagaggagagtagcaatggcagcagtaaacctggcggcagcgcaaaagatg

SEQ ID NO: 108787 - DNA, 103 bp, Artificial Sequence
  Synthetic Polynucleotide
taatacgactcactatagggagggggccgcagctgctgctgctactgctgaacagaggagacagcagatgcagcagcagaacctggcggcagcgcaaaagatg

SEQ ID NO: 108788 - DNA, 103 bp, Artificial Sequence
  Synthetic Polynucleotide
taatacgactcactatagggtttcccggggagggggccgcagctgctgctaacagaggagaagcagcatgtgcggccccaacctggcggcagcgcaaaagatg

SEQ ID NO: 108789 - DNA, 103 bp, Artificial Sequence
  Synthetic Polynucleotide
taatacgactcactatagggcagacgtggagattgggggttgaggggggaaacagaggagatcccccatgaacccccaaaacctggcggcagcgcaaaagatg

SEQ ID NO: 108790 - DNA, 103 bp, Artificial Sequence
  Synthetic Polynucleotide
taatacgactcactatagggagtacacgggtttcccggggagggggccgcaacagaggagagcggccatgtccccgggaaacctggcggcagcgcaaaagatg

SEQ ID NO: 108791 - DNA, 103 bp, Artificial Sequence
  Synthetic Polynucleotide
taatacgactcactataggggacggggttgagtacacgggtttcccggggaacagaggagaccccggatgacccgtgtaaacctggcggcagcgcaaaagatg

SEQ ID NO: 108792 - DNA, 103 bp, Artificial Sequence
  Synthetic Polynucleotide
taatacgactcactatagggttccactggggacggggttgagtacacgggaacagaggagacccgtgatgtcaaccccgaacctggcggcagcgcaaaagatg

SEQ ID NO: 108793 - DNA, 103 bp, Artificial Sequence
  Synthetic Polynucleotide
taatacgactcactataggggaggggtgttttccactggggacggggttgaacagaggagacaacccatgccccagtggaacctggcggcagcgcaaaagatg

SEQ ID NO: 108794 - DNA, 103 bp, Artificial Sequence
  Synthetic Polynucleotide
taatacgactcactatagggtcattattctgaggggtgttttccactgggaacagaggagacccagtatgaaacaccccaacctggcggcagcgcaaaagatg

SEQ ID NO: 108795 - DNA, 103 bp, Artificial Sequence
  Synthetic Polynucleotide
taatacgactcactatagggcattttgcactcattattctgaggggtgttaacagaggagaaacaccatgcagaataataacctggcggcagcgcaaaagatg

SEQ ID NO: 108796 - DNA, 103 bp, Artificial Sequence
  Synthetic Polynucleotide
taatacgactcactatagggtcagatccaccattttgcactcattattctaacagaggagaagaataatgagtgcaaaaaacctggcggcagcgcaaaagatg

SEQ ID NO: 108797 - DNA, 103 bp, Artificial Sequence
  Synthetic Polynucleotide
taatacgactcactatagggttggcccccctcagatccaccattttgcacaacagaggagagtgcaaatgggtggatctaacctggcggcagcgcaaaagatg

SEQ ID NO: 108798 - DNA, 103 bp, Artificial Sequence
  Synthetic Polynucleotide
taatacgactcactatagggggaagccactttggcccccctcagatccacaacagaggagagtggatatgaggggggccaacctggcggcagcgcaaaagatg

SEQ ID NO: 108799 - DNA, 103 bp, Artificial Sequence
  Synthetic Polynucleotide
taatacgactcactatagggccaccgtgaaggaagccactttggccccccaacagaggagaggggggatgaagtggcttaacctggcggcagcgcaaaagatg

SEQ ID NO: 108800 - DNA, 103 bp, Artificial Sequence
  Synthetic Polynucleotide
taatacgactcactataggggaggaggaagcagacgtggagattgggggtaacagaggagaacccccatgctccacgtcaacctggcggcagcgcaaaagatg

SEQ ID NO: 108801 - DNA, 103 bp, Artificial Sequence
  Synthetic Polynucleotide
taatacgactcactatagggtcgcagccctccaccgtgaaggaagccactaacagaggagaagtggcatgcttcacggtaacctggcggcagcgcaaaagatg

SEQ ID NO: 108802 - DNA, 103 bp, Artificial Sequence
  Synthetic Polynucleotide
taatacgactcactataggggcagatcagctcgcagccctccaccgtgaaaacagaggagattcacgatggagggctgcaacctggcggcagcgcaaaagatg

SEQ ID NO: 108803 - DNA, 103 bp, Artificial Sequence
  Synthetic Polynucleotide
taatacgactcactatagggcctggggcaggcagatcagctcgcagccctaacagaggagaagggctatgagctgatctaacctggcggcagcgcaaaagatg

SEQ ID NO: 108804 - DNA, 103 bp, Artificial Sequence
  Synthetic Polynucleotide
taatacgactcactatagggaggtcgaaagcctggggcaggcagatcagcaacagaggagagctgatatgcctgccccaaacctggcggcagcgcaaaagatg

SEQ ID NO: 108805 - DNA, 103 bp, Artificial Sequence
  Synthetic Polynucleotide
taatacgactcactatagggcttcaggaacaggtcgaaagcctggggcagaacagaggagactgcccatggctttcgacaacctggcggcagcgcaaaagatg

SEQ ID NO: 108806 - DNA, 103 bp, Artificial Sequence
  Synthetic Polynucleotide
taatacgactcactatagggccaccaagtgcttcaggaacaggtcgaaagaacagaggagactttcgatgtgttcctgaaacctggcggcagcgcaaaagatg

SEQ ID NO: 108807 - DNA, 103 bp, Artificial Sequence
  Synthetic Polynucleotide
taatacgactcactatagggtgcaagccccccaccaagtgcttcaggaacaacagaggagagttcctatggcacttggtaacctggcggcagcgcaaaagatg

SEQ ID NO: 108808 - DNA, 103 bp, Artificial Sequence
  Synthetic Polynucleotide
taatacgactcactataggggtagaccgtatgcaagccccccaccaagtgaacagaggagacacttgatggggggcttgaacctggcggcagcgcaaaagatg

SEQ ID NO: 108809 - DNA, 103 bp, Artificial Sequence
  Synthetic Polynucleotide
taatacgactcactatagggtcagcttggtgtagaccgtatgcaagccccaacagaggagaggggctatgatacggtctaacctggcggcagcgcaaaagatg

SEQ ID NO: 108810 - DNA, 103 bp, Artificial Sequence
  Synthetic Polynucleotide
taatacgactcactatagggtccagccgcttcagcttggtgtagaccgtaaacagaggagatacggtatgcaccaagctaacctggcggcagcgcaaaagatg

SEQ ID NO: 108811 - DNA, 103 bp, Artificial Sequence
  Synthetic Polynucleotide
taatacgactcactatagggggtggtgccagaggaggaagcagacgtggaaacagaggagatccacgatggcttcctccaacctggcggcagcgcaaaagatg

SEQ ID NO: 108812 - DNA, 103 bp, Artificial Sequence
  Synthetic Polynucleotide
taatacgactcactatagggcggcgtgatctccagccgcttcagcttggtaacagaggagaaccaagatgaagcggctgaacctggcggcagcgcaaaagatg

SEQ ID NO: 108813 - DNA, 103 bp, Artificial Sequence
  Synthetic Polynucleotide
taatacgactcactatagggtgcacaccaccggcgtgatctccagccgctaacagaggagaagcggcatgagatcacgcaacctggcggcagcgcaaaagatg

SEQ ID NO: 108814 - DNA, 103 bp, Artificial Sequence
  Synthetic Polynucleotide
taatacgactcactatagggtgttccacattgcacaccaccggcgtgatcaacagaggagagatcacatgggtggtgtgaacctggcggcagcgcaaaagatg

SEQ ID NO: 108815 - DNA, 103 bp, Artificial Sequence
  Synthetic Polynucleotide
taatacgactcactataggggatgcgaacttgttccacattgcacaccacaacagaggagagtggtgatgaatgtggaaaacctggcggcagcgcaaaagatg

SEQ ID NO: 108816 - DNA, 103 bp, Artificial Sequence
  Synthetic Polynucleotide
taatacgactcactataggggtcccctcaggatgcgaacttgttccacataacagaggagaatgtggatgaagttcgcaaacctggcggcagcgcaaaagatg

SEQ ID NO: 108817 - DNA, 103 bp, Artificial Sequence
  Synthetic Polynucleotide
taatacgactcactatagggatggcgcccagtcccctcaggatgcgaactaacagaggagaagttcgatgcctgaggggaacctggcggcagcgcaaaagatg

SEQ ID NO: 108818 - DNA, 103 bp, Artificial Sequence
  Synthetic Polynucleotide
taatacgactcactatagggtcctggctggatggcgcccagtcccctcagaacagaggagactgaggatgctgggcgccaacctggcggcagcgcaaaagatg

SEQ ID NO: 108819 - DNA, 103 bp, Artificial Sequence
  Synthetic Polynucleotide
taatacgactcactatagggagcggttcactcctggctggatggcgcccaaacagaggagatgggcgatgtccagccagaacctggcggcagcgcaaaagatg

SEQ ID NO: 108820 - DNA, 103 bp, Artificial Sequence
  Synthetic Polynucleotide
taatacgactcactatagggatgagtttgcagcggttcactcctggctggaacagaggagaccagccatgagtgaaccgaacctggcggcagcgcaaaagatg

SEQ ID NO: 108821 - DNA, 103 bp, Artificial Sequence
  Synthetic Polynucleotide
taatacgactcactatagggcttcctggagatgagtttgcagcggttcacaacagaggagagtgaacatgtgcaaactcaacctggcggcagcgcaaaagatg

SEQ ID NO: 108822 - DNA, 103 bp, Artificial Sequence
  Synthetic Polynucleotide
taatacgactcactatagggaggtggaggtggtggtgccagaggaggaagaacagaggagacttcctatgctggcaccaaacctggcggcagcgcaaaagatg

SEQ ID NO: 108823 - DNA, 103 bp, Artificial Sequence
  Synthetic Polynucleotide
taatacgactcactatagggtctcgaagtccttcctggagatgagtttgcaacagaggagagcaaacatgtctccaggaaacctggcggcagcgcaaaagatg

SEQ ID NO: 108824 - DNA, 103 bp, Artificial Sequence
  Synthetic Polynucleotide
taatacgactcactatagggttgtagagggtctcgaagtccttcctggagaacagaggagactccagatgggacttcgaaacctggcggcagcgcaaaagatg

SEQ ID NO: 108825 - DNA, 103 bp, Artificial Sequence
  Synthetic Polynucleotide
taatacgactcactatagggggtgcagtcattgtagagggtctcgaagtcaacagaggagagacttcatgaccctctacaacctggcggcagcgcaaaagatg

SEQ ID NO: 108826 - DNA, 103 bp, Artificial Sequence
  Synthetic Polynucleotide
taatacgactcactatagggaacttgcgttggtgcagtcattgtagagggaacagaggagaccctctatgatgactgcaaacctggcggcagcgcaaaagatg

SEQ ID NO: 108827 - DNA, 103 bp, Artificial Sequence
  Synthetic Polynucleotide
taatacgactcactatagggccaggtctagaacttgcgttggtgcagtcaaacagaggagatgactgatgcaacgcaagaacctggcggcagcgcaaaagatg

SEQ ID NO: 108828 - DNA, 103 bp, Artificial Sequence
  Synthetic Polynucleotide
taatacgactcactatagggaggaggccttccaggtctagaacttgcgttaacagaggagaaacgcaatgtctagacctaacctggcggcagcgcaaaagatg

SEQ ID NO: 108829 - DNA, 103 bp, Artificial Sequence
  Synthetic Polynucleotide
taatacgactcactataggggagtcctcttaggaggccttccaggtctagaacagaggagactagacatggaaggcctcaacctggcggcagcgcaaaagatg

SEQ ID NO: 108830 - DNA, 103 bp, Artificial Sequence
  Synthetic Polynucleotide
taatacgactcactataggggtgacactttgagtcctcttaggaggccttaacagaggagaaaggccatgtaagaggacaacctggcggcagcgcaaaagatg

SEQ ID NO: 108831 - DNA, 103 bp, Artificial Sequence
  Synthetic Polynucleotide
taatacgactcactatagggctctggggaggtgacactttgagtcctcttaacagaggagaaagaggatgcaaagtgtcaacctggcggcagcgcaaaagatg

SEQ ID NO: 108832 - DNA, 103 bp, Artificial Sequence
  Synthetic Polynucleotide
taatacgactcactatagggtgtgagagttctctggggaggtgacactttaacagaggagaaaagtgatgcctccccagaacctggcggcagcgcaaaagatg

SEQ ID NO: 108833 - DNA, 103 bp, Artificial Sequence
  Synthetic Polynucleotide
taatacgactcactataggggtcgccgaagaggtggaggtggtggtgccaaacagaggagatggcacatgcacctccacaacctggcggcagcgcaaaagatg

SEQ ID NO: 108834 - DNA, 103 bp, Artificial Sequence
  Synthetic Polynucleotide
taatacgactcactatagggtgcggcatgatgtgagagttctctggggagaacagaggagactccccatggaactctcaaacctggcggcagcgcaaaagatg

SEQ ID NO: 108835 - DNA, 103 bp, Artificial Sequence
  Synthetic Polynucleotide
taatacgactcactatagggagggacagaatgcggcatgatgtgagagttaacagaggagaaactctatgatcatgccgaacctggcggcagcgcaaaagatg

SEQ ID NO: 108836 - DNA, 103 bp, Artificial Sequence
  Synthetic Polynucleotide
taatacgactcactatagggacatgagaccagggacagaatgcggcatgaaacagaggagatcatgcatgattctgtccaacctggcggcagcgcaaaagatg

SEQ ID NO: 108837 - DNA, 103 bp, Artificial Sequence
  Synthetic Polynucleotide
taatacgactcactatagggatcccaggagacatgagaccagggacagaaaacagaggagattctgtatgtggtctcataacctggcggcagcgcaaaagatg

SEQ ID NO: 108838 - DNA, 103 bp, Artificial Sequence
  Synthetic Polynucleotide
taatacgactcactatagggtggtggaattatcccaggagacatgagaccaacagaggagaggtctcatgtctcctgggaacctggcggcagcgcaaaagatg

SEQ ID NO: 108839 - DNA, 103 bp, Artificial Sequence
  Synthetic Polynucleotide
taatacgactcactatagggtcagacctgttggtggaattatcccaggagaacagaggagactcctgatgtaattccacaacctggcggcagcgcaaaagatg

SEQ ID NO: 108840 - DNA, 103 bp, Artificial Sequence
  Synthetic Polynucleotide
taatacgactcactataggggcggctgctgtcagacctgttggtggaattaacagaggagaaattccatgaacaggtctaacctggcggcagcgcaaaagatg

SEQ ID NO: 108841 - DNA, 103 bp, Artificial Sequence
  Synthetic Polynucleotide
taatacgactcactatagggagctgctgcagcggctgctgtcagacctgtaacagaggagaacaggtatgacagcagccaacctggcggcagcgcaaaagatg

SEQ ID NO: 108842 - DNA, 103 bp, Artificial Sequence
  Synthetic Polynucleotide
taatacgactcactatagggtagcagcagcagctgctgcagcggctgctgaacagaggagacagcagatgctgcagcagaacctggcggcagcgcaaaagatg

SEQ ID NO: 108843 - DNA, 103 bp, Artificial Sequence
  Synthetic Polynucleotide
taatacgactcactataggggctgcattggtagcagcagcagctgctgcaaacagaggagatgcagcatgtgctgctgcaacctggcggcagcgcaaaagatg

SEQ ID NO: 108844 - DNA, 103 bp, Artificial Sequence
  Synthetic Polynucleotide
taatacgactcactatagggcggggtcctgtcgctcacaggccgcgccataacagaggagaatggcgatgcctgtgagcaacctggcggcagcgcaaaagatg

SEQ ID NO: 108845 - DNA, 103 bp, Artificial Sequence
  Synthetic Polynucleotide
taatacgactcactatagggcttgctggtcccctgcagaaggctccgcaaaacagaggagattgcggatgcttctgcagaacctggcggcagcgcaaaagatg

SEQ ID NO: 108846 - DNA, 103 bp, Artificial Sequence
  Synthetic Polynucleotide
taatacgactcactataggggctctttgggcttgctggtcccctgcagaaaacagaggagattctgcatgggaccagcaaacctggcggcagcgcaaaagatg

SEQ ID NO: 108847 - DNA, 103 bp, Artificial Sequence
  Synthetic Polynucleotide
taatacgactcactatagggcagctggccggctctttgggcttgctggtcaacagaggagagaccagatggcccaaagaaacctggcggcagcgcaaaagatg

SEQ ID NO: 108848 - DNA, 103 bp, Artificial Sequence
  Synthetic Polynucleotide
taatacgactcactatagggcttcaggagacagctggccggctctttgggaacagaggagacccaaaatgccggccagcaacctggcggcagcgcaaaagatg

SEQ ID NO: 108849 - DNA, 103 bp, Artificial Sequence
  Synthetic Polynucleotide
taatacgactcactataggggctccttttccttcaggagacagctggccgaacagaggagacggccaatggtctcctgaaacctggcggcagcgcaaaagatg

SEQ ID NO: 108850 - DNA, 103 bp, Artificial Sequence
  Synthetic Polynucleotide
taatacgactcactataggggccgccttgcgctccttttccttcaggagaaacagaggagatctcctatgggaaaaggaaacctggcggcagcgcaaaagatg

SEQ ID NO: 108851 - DNA, 103 bp, Artificial Sequence
  Synthetic Polynucleotide
taatacgactcactatagggtgcaggcagggccgccttgcgctccttttcaacagaggagagaaaagatgcgcaaggcgaacctggcggcagcgcaaaagatg

SEQ ID NO: 108852 - DNA, 103 bp, Artificial Sequence
  Synthetic Polynucleotide
taatacgactcactataggggggttgtggctgcaggcagggccgccttgcaacagaggagagcaaggatgccctgcctgaacctggcggcagcgcaaaagatg

SEQ ID NO: 108853 - DNA, 103 bp, Artificial Sequence
  Synthetic Polynucleotide
taatacgactcactatagggcctggcccaggggttgtggctgcaggcaggaacagaggagacctgccatgagccacaacaacctggcggcagcgcaaaagatg

SEQ ID NO: 108854 - DNA, 103 bp, Artificial Sequence
  Synthetic Polynucleotide
taatacgactcactatagggagtctccaggcctggcccaggggttgtggcaacagaggagagccacaatgcctgggccaaacctggcggcagcgcaaaagatg

SEQ ID NO: 108855 - DNA, 103 bp, Artificial Sequence
  Synthetic Polynucleotide
taatacgactcactataggggcagaggggccggggtcctgtcgctcacagaacagaggagactgtgaatgacaggacccaacctggcggcagcgcaaaagatg

SEQ ID NO: 108856 - DNA, 103 bp, Artificial Sequence
  Synthetic Polynucleotide
taatacgactcactatagggccgggcccgcagtctccaggcctggcccagaacagaggagactgggcatggcctggagaaacctggcggcagcgcaaaagatg

SEQ ID NO: 108857 - DNA, 103 bp, Artificial Sequence
  Synthetic Polynucleotide
taatacgactcactatagggggggcatccgccgggcccgcagtctccaggaacagaggagacctggaatgtgcgggcccaacctggcggcagcgcaaaagatg

SEQ ID NO: 108858 - DNA, 103 bp, Artificial Sequence
  Synthetic Polynucleotide
taatacgactcactatagggtgccccagccggggcatccgccgggcccgcaacagaggagagcgggcatggcggatgccaacctggcggcagcgcaaaagatg

SEQ ID NO: 108859 - DNA, 103 bp, Artificial Sequence
  Synthetic Polynucleotide
taatacgactcactatagggcgcccaccactgccccagccggggcatccgaacagaggagacggatgatgcggctggggaacctggcggcagcgcaaaagatg

SEQ ID NO: 108860 - DNA, 103 bp, Artificial Sequence
  Synthetic Polynucleotide
taatacgactcactatagggggggaccctccgcccaccactgccccagccaacagaggagaggctggatgagtggtgggaacctggcggcagcgcaaaagatg

SEQ ID NO: 108861 - DNA, 103 bp, Artificial Sequence
  Synthetic Polynucleotide
taatacgactcactataggggcgcccccgcggggaccctccgcccaccacaacagaggagagtggtgatgggagggtccaacctggcggcagcgcaaaagatg

SEQ ID NO: 108862 - DNA, 103 bp, Artificial Sequence
  Synthetic Polynucleotide
taatacgactcactatagggccggccccgggcgcccccgcggggaccctcaacagaggagagagggtatgcgcgggggcaacctggcggcagcgcaaaagatg

SEQ ID NO: 108863 - DNA, 103 bp, Artificial Sequence
  Synthetic Polynucleotide
taatacgactcactatagggggggcgggcaccggccccgggcgcccccgcaacagaggagagcggggatgcccggggccaacctggcggcagcgcaaaagatg

SEQ ID NO: 108864 - DNA, 103 bp, Artificial Sequence
  Synthetic Polynucleotide
taatacgactcactatagggcaacagacccggggcgggcaccggccccggaacagaggagaccggggatggtgcccgccaacctggcggcagcgcaaaagatg

SEQ ID NO: 108865 - DNA, 103 bp, Artificial Sequence
  Synthetic Polynucleotide
taatacgactcactataggggcagtggcgccaacagacccggggcgggcaaacagaggagatgcccgatgcgggtctgtaacctggcggcagcgcaaaagatg

SEQ ID NO: 108866 - DNA, 103 bp, Artificial Sequence
  Synthetic Polynucleotide
taatacgactcactatagggccgcccagcagcagaggggccggggtcctgaacagaggagacaggacatgggcccctctaacctggcggcagcgcaaaagatg

SEQ ID NO: 108867 - DNA, 103 bp, Artificial Sequence
  Synthetic Polynucleotide
taatacgactcactatagggcgctcccacagcagtggcgccaacagacccaacagaggagagggtctatgggcgccactaacctggcggcagcgcaaaagatg

SEQ ID NO: 108868 - DNA, 103 bp, Artificial Sequence
  Synthetic Polynucleotide
taatacgactcactatagggcggcagcgtgcgctcccacagcagtggcgcaacagaggagagcgccaatgctgtgggagaacctggcggcagcgcaaaagatg

SEQ ID NO: 108869 - DNA, 103 bp, Artificial Sequence
  Synthetic Polynucleotide
taatacgactcactatagggcatcgccgaacggcagcgtgcgctcccacaaacagaggagatgtgggatggcacgctgcaacctggcggcagcgcaaaagatg

SEQ ID NO: 108870 - DNA, 103 bp, Artificial Sequence
  Synthetic Polynucleotide
taatacgactcactatagggacgtactccacatcgccgaacggcagcgtgaacagaggagacacgctatggttcggcgaaacctggcggcagcgcaaaagatg

SEQ ID NO: 108871 - DNA, 103 bp, Artificial Sequence
  Synthetic Polynucleotide
taatacgactcactataggggtccaggtctacgtactccacatcgccgaaaacagaggagattcggcatggtggagtacaacctggcggcagcgcaaaagatg

SEQ ID NO: 108872 - DNA, 103 bp, Artificial Sequence
  Synthetic Polynucleotide
taatacgactcactataggggcaggaaggcgtccaggtctacgtactccaaacagaggagatggagtatgtagacctggaacctggcggcagcgcaaaagatg

SEQ ID NO: 108873 - DNA, 103 bp, Artificial Sequence
  Synthetic Polynucleotide
taatacgactcactatagggccgtgctccagcaggaaggcgtccaggtctaacagaggagaagacctatgcgccttcctaacctggcggcagcgcaaaagatg

SEQ ID NO: 108874 - DNA, 103 bp, Artificial Sequence
  Synthetic Polynucleotide
taatacgactcactataggggggcgggagcccgtgctccagcaggaaggcaacagaggagagccttcatgctggagcacaacctggcggcagcgcaaaagatg

SEQ ID NO: 108875 - DNA, 103 bp, Artificial Sequence
  Synthetic Polynucleotide
taatacgactcactataggggcggcgggctgggcgggagcccgtgctccaaacagaggagatggagcatgggctcccgcaacctggcggcagcgcaaaagatg

SEQ ID NO: 108876 - DNA, 103 bp, Artificial Sequence
  Synthetic Polynucleotide
taatacgactcactatagggccaccggggggcggcgggctgggcgggagcaacagaggagagctcccatgcagcccgccaacctggcggcagcgcaaaagatg

SEQ ID NO: 108877 - DNA, 103 bp, Artificial Sequence
  Synthetic Polynucleotide
taatacgactcactatagggcccggccgggccgcccagcagcagaggggcaacagaggagagcccctatgctgctgggcaacctggcggcagcgcaaaagatg

SEQ ID NO: 108878 - DNA, 103 bp, Artificial Sequence
  Synthetic Polynucleotide
taatacgactcactatagggcggcgacgggccaccggggggcggcgggctaacagaggagaagcccgatgccccccggtaacctggcggcagcgcaaaagatg

SEQ ID NO: 108879 - DNA, 103 bp, Artificial Sequence
  Synthetic Polynucleotide
taatacgactcactataggggcgacggctccggcgacgggccaccgggggaacagaggagacccccgatggcccgtcgcaacctggcggcagcgcaaaagatg

SEQ ID NO: 108880 - DNA, 103 bp, Artificial Sequence
  Synthetic Polynucleotide
taatacgactcactataggggtccgcgcgggcgacggctccggcgacgggaacagaggagacccgtcatgggagccgtcaacctggcggcagcgcaaaagatg

SEQ ID NO: 108881 - DNA, 103 bp, Artificial Sequence
  Synthetic Polynucleotide
taatacgactcactataggggggtgcgggcgtccgcgcgggcgacggctcaacagaggagagagccgatgcccgcgcggaacctggcggcagcgcaaaagatg

SEQ ID NO: 108882 - DNA, 103 bp, Artificial Sequence
  Synthetic Polynucleotide
taatacgactcactataggggccctggggagggtgcgggcgtccgcgcggaacagaggagaccgcgcatgcgcccgcacaacctggcggcagcgcaaaagatg

SEQ ID NO: 108883 - DNA, 103 bp, Artificial Sequence
  Synthetic Polynucleotide
taatacgactcactatagggcacgaacccggccctggggagggtgcgggcaacagaggagagcccgcatgctccccaggaacctggcggcagcgcaaaagatg

SEQ ID NO: 108884 - DNA, 103 bp, Artificial Sequence
  Synthetic Polynucleotide
taatacgactcactatagggagccgagccgcacgaacccggccctggggaaacagaggagatccccaatgccgggttcgaacctggcggcagcgcaaaagatg

SEQ ID NO: 108885 - DNA, 103 bp, Artificial Sequence
  Synthetic Polynucleotide
taatacgactcactatagggagcggggggaagccgagccgcacgaacccgaacagaggagacgggttatggcggctcggaacctggcggcagcgcaaaagatg

SEQ ID NO: 108886 - DNA, 103 bp, Artificial Sequence
  Synthetic Polynucleotide
taatacgactcactatagggccaggagaggagcggggggaagccgagccgaacagaggagacggctcatgttccccccgaacctggcggcagcgcaaaagatg

SEQ ID NO: 108887 - DNA, 103 bp, Artificial Sequence
  Synthetic Polynucleotide
taatacgactcactataggggggggcgtgcccaggagaggagcggggggaaacagaggagatcccccatgtcctctcctaacctggcggcagcgcaaaagatg

SEQ ID NO: 108888 - DNA, 103 bp, Artificial Sequence
  Synthetic Polynucleotide
taatacgactcactatagggcagggggtgtcccggccgggccgcccagcaaacagaggagatgctggatggcccggccgaacctggcggcagcgcaaaagatg

SEQ ID NO: 108889 - DNA, 103 bp, Artificial Sequence
  Synthetic Polynucleotide
taatacgactcactatagggcagcccgggcgggggcgtgcccaggagaggaacagaggagacctctcatgggcacgcccaacctggcggcagcgcaaaagatg

SEQ ID NO: 108890 - DNA, 103 bp, Artificial Sequence
  Synthetic Polynucleotide
taatacgactcactataggggtcccgagggcagcccgggcgggggcgtgcaacagaggagagcacgcatgcgcccgggcaacctggcggcagcgcaaaagatg

SEQ ID NO: 108891 - DNA, 103 bp, Artificial Sequence
  Synthetic Polynucleotide
taatacgactcactataggggccgctggcggtcccgagggcagcccgggcaacagaggagagcccggatggccctcgggaacctggcggcagcgcaaaagatg

SEQ ID NO: 108892 - DNA, 103 bp, Artificial Sequence
  Synthetic Polynucleotide
taatacgactcactatagggctgcgcggtggccgctggcggtcccgagggaacagaggagaccctcgatgccgccagcgaacctggcggcagcgcaaaagatg

SEQ ID NO: 108893 - DNA, 103 bp, Artificial Sequence
  Synthetic Polynucleotide
taatacgactcactataggggaggtcaggcctgcgcggtggccgctggcgaacagaggagacgccagatgccaccgcgcaacctggcggcagcgcaaaagatg

SEQ ID NO: 108894 - DNA, 103 bp, Artificial Sequence
  Synthetic Polynucleotide
taatacgactcactatagggtgtgtcccgagaggtcaggcctgcgcggtgaacagaggagacaccgcatgggcctgaccaacctggcggcagcgcaaaagatg

SEQ ID NO: 108895 - DNA, 103 bp, Artificial Sequence
  Synthetic Polynucleotide
taatacgactcactatagggcagggctgggtgtgtcccgagaggtcaggcaacagaggagagcctgaatgctcgggacaaacctggcggcagcgcaaaagatg

SEQ ID NO: 108896 - DNA, 103 bp, Artificial Sequence
  Synthetic Polynucleotide
taatacgactcactatagggtctgggtccacagggctgggtgtgtcccgaaacagaggagatcgggaatgacccagcccaacctggcggcagcgcaaaagatg

SEQ ID NO: 108897 - DNA, 103 bp, Artificial Sequence
  Synthetic Polynucleotide
taatacgactcactatagggctccacggtgtctgggtccacagggctgggaacagaggagacccagcatggtggacccaaacctggcggcagcgcaaaagatg

SEQ ID NO: 108898 - DNA, 103 bp, Artificial Sequence
  Synthetic Polynucleotide
taatacgactcactatagggtcatcaacacctccacggtgtctgggtccaaacagaggagatggaccatgacaccgtggaacctggcggcagcgcaaaagatg

SEQ ID NO: 108899 - DNA, 103 bp, Artificial Sequence
  Synthetic Polynucleotide
taatacgactcactataggggctcccccgccagggggtgtcccggccgggaacagaggagacccggcatggacacccccaacctggcggcagcgcaaaagatg

SEQ ID NO: 108900 - DNA, 103 bp, Artificial Sequence
  Synthetic Polynucleotide
taatacgactcactatagggggttcaaaggtcatcaacacctccacggtgaacagaggagacaccgtatgggtgttgataacctggcggcagcgcaaaagatg

SEQ ID NO: 108901 - DNA, 103 bp, Artificial Sequence
  Synthetic Polynucleotide
taatacgactcactatagggagctgggtcgggttcaaaggtcatcaacacaacagaggagagtgttgatgacctttgaaaacctggcggcagcgcaaaagatg

SEQ ID NO: 108902 - DNA, 103 bp, Artificial Sequence
  Synthetic Polynucleotide
taatacgactcactataggggggcaagatcagctgggtcgggttcaaaggaacagaggagacctttgatgccgacccagaacctggcggcagcgcaaaagatg

SEQ ID NO: 108903 - DNA, 103 bp, Artificial Sequence
  Synthetic Polynucleotide
taatacgactcactatagggatgcttgatagggcaagatcagctgggtcgaacagaggagacgacccatgtgatcttgcaacctggcggcagcgcaaaagatg

SEQ ID NO: 108904 - DNA, 103 bp, Artificial Sequence
  Synthetic Polynucleotide
taatacgactcactataggggtggccaggaatgcttgatagggcaagatcaacagaggagagatcttatgctatcaagcaacctggcggcagcgcaaaagatg

SEQ ID NO: 108905 - DNA, 103 bp, Artificial Sequence
  Synthetic Polynucleotide
taatacgactcactatagggcaaaggtctcgtggccaggaatgcttgataaacagaggagatatcaaatgttcctggccaacctggcggcagcgcaaaagatg

SEQ ID NO: 108906 - DNA, 103 bp, Artificial Sequence
  Synthetic Polynucleotide
taatacgactcactatagggcttcgagggtcaaaggtctcgtggccaggaaacagaggagatcctggatgcgagaccttaacctggcggcagcgcaaaagatg

SEQ ID NO: 108907 - DNA, 103 bp, Artificial Sequence
  Synthetic Polynucleotide
taatacgactcactataggggaagcgatgtcttcgagggtcaaaggtctcaacagaggagagagaccatggaccctcgaaacctggcggcagcgcaaaagatg

SEQ ID NO: 108908 - DNA, 103 bp, Artificial Sequence
  Synthetic Polynucleotide
taatacgactcactatagggcctcttctgagaagcgatgtcttcgagggtaacagaggagaaccctcatggacatcgctaacctggcggcagcgcaaaagatg

SEQ ID NO: 108909 - DNA, 103 bp, Artificial Sequence
  Synthetic Polynucleotide
taatacgactcactatagggggcttaagttcctcttctgagaagcgatgtaacagaggagaacatcgatgctcagaagaaacctggcggcagcgcaaaagatg

SEQ ID NO: 108910 - DNA, 103 bp, Artificial Sequence
  Synthetic Polynucleotide
taatacgactcactatagggcccaagcagcgctcccccgccagggggtgtaacagaggagaacacccatgggcgggggaaacctggcggcagcgcaaaagatg

SEQ ID NO: 108911 - DNA, 103 bp, Artificial Sequence
  Synthetic Polynucleotide
taatacgactcactataggggattggctggggcttaagttcctcttctgaaacagaggagatcagaaatggaacttaagaacctggcggcagcgcaaaagatg

SEQ ID NO: 108912 - DNA, 103 bp, Artificial Sequence
  Synthetic Polynucleotide
taatacgactcactatagggccttcttcatgattggctggggcttaagttaacagaggagaaacttaatgcccagccaaaacctggcggcagcgcaaaagatg

SEQ ID NO: 108913 - DNA, 103 bp, Artificial Sequence
  Synthetic Polynucleotide
taatacgactcactatagggatttttcttgccttcttcatgattggctggaacagaggagaccagccatgcatgaagaaaacctggcggcagcgcaaaagatg

SEQ ID NO: 108914 - DNA, 103 bp, Artificial Sequence
  Synthetic Polynucleotide
taatacgactcactatagggcggcacctggatttttcttgccttcttcataacagaggagaatgaagatggcaagaaaaaacctggcggcagcgcaaaagatg

SEQ ID NO: 108915 - DNA, 103 bp, Artificial Sequence
  Synthetic Polynucleotide
taatacgactcactatagggtctgctcctccggcacctggatttttcttgaacagaggagacaagaaatgtccaggtgcaacctggcggcagcgcaaaagatg

SEQ ID NO: 108916 - DNA, 103 bp, Artificial Sequence
  Synthetic Polynucleotide
taatacgactcactatagggttctcatccttctgctcctccggcacctggaacagaggagaccaggtatgggaggagcaaacctggcggcagcgcaaaagatg

SEQ ID NO: 108917 - DNA, 103 bp, Artificial Sequence
  Synthetic Polynucleotide
taatacgactcactataggggctccagtatttctcatccttctgctcctcaacagaggagagaggagatgaaggatgagaacctggcggcagcgcaaaagatg

SEQ ID NO: 108918 - DNA, 103 bp, Artificial Sequence
  Synthetic Polynucleotide
taatacgactcactatagggtgtaccgccggctccagtatttctcatcctaacagaggagaaggatgatgaatactggaaacctggcggcagcgcaaaagatg

SEQ ID NO: 108919 - DNA, 103 bp, Artificial Sequence
  Synthetic Polynucleotide
taatacgactcactatagggtcgttgttcttgtaccgccggctccagtataacagaggagaatactgatgccggcggtaaacctggcggcagcgcaaaagatg

SEQ ID NO: 108920 - DNA, 103 bp, Artificial Sequence
  Synthetic Polynucleotide
taatacgactcactatagggcttggctgcctcgttgttcttgtaccgccgaacagaggagacggcggatgaagaacaacaacctggcggcagcgcaaaagatg

SEQ ID NO: 108921 - DNA, 103 bp, Artificial Sequence
  Synthetic Polynucleotide
taatacgactcactatagggggctccgcaacccaagcagcgctcccccgcaacagaggagagcggggatgcgctgcttgaacctggcggcagcgcaaaagatg

SEQ ID NO: 108922 - DNA, 103 bp, Artificial Sequence
  Synthetic Polynucleotide
taatacgactcactatagggcacgggaccgcttggctgcctcgttgttctaacagaggagaagaacaatgaggcagccaaacctggcggcagcgcaaaagatg

SEQ ID NO: 108923 - DNA, 103 bp, Artificial Sequence
  Synthetic Polynucleotide
taatacgactcactatagggcgccgggcgtcacgggaccgcttggctgccaacagaggagaggcagcatggcggtcccgaacctggcggcagcgcaaaagatg

SEQ ID NO: 108924 - DNA, 103 bp, Artificial Sequence
  Synthetic Polynucleotide
taatacgactcactatagggctccttgagccgccgggcgtcacgggaccgaacagaggagacggtccatggacgcccggaacctggcggcagcgcaaaagatg

SEQ ID NO: 108925 - DNA, 103 bp, Artificial Sequence
  Synthetic Polynucleotide
taatacgactcactatagggatatctggttctccttgagccgccgggcgtaacagaggagaacgcccatgggctcaaggaacctggcggcagcgcaaaagatg

SEQ ID NO: 108926 - DNA, 103 bp, Artificial Sequence
  Synthetic Polynucleotide
taatacgactcactataggggcccgcaccgatatctggttctccttgagcaacagaggagagctcaaatggaaccagataacctggcggcagcgcaaaagatg

SEQ ID NO: 108927 - DNA, 103 bp, Artificial Sequence
  Synthetic Polynucleotide
taatacgactcactatagggcaggaaggccgcccgcaccgatatctggttaacagaggagaaaccagatgtcggtgcggaacctggcggcagcgcaaaagatg

SEQ ID NO: 108928 - DNA, 103 bp, Artificial Sequence
  Synthetic Polynucleotide
taatacgactcactatagggtctccttctccaggaaggccgcccgcaccgaacagaggagacggtgcatgcggccttccaacctggcggcagcgcaaaagatg

SEQ ID NO: 108929 - DNA, 103 bp, Artificial Sequence
  Synthetic Polynucleotide
taatacgactcactatagggagcagggcgttctccttctccaggaaggccaacagaggagaggccttatgggagaaggaaacctggcggcagcgcaaaagatg

SEQ ID NO: 108930 - DNA, 103 bp, Artificial Sequence
  Synthetic Polynucleotide
taatacgactcactatagggttcctgccgcagcagggcgttctccttctcaacagaggagagagaagatgaacgccctgaacctggcggcagcgcaaaagatg

SEQ ID NO: 108931 - DNA, 103 bp, Artificial Sequence
  Synthetic Polynucleotide
taatacgactcactatagggcggccacaacttcctgccgcagcagggcgtaacagaggagaacgcccatgtgcggcaggaacctggcggcagcgcaaaagatg

SEQ ID NO: 108932 - DNA, 103 bp, Artificial Sequence
  Synthetic Polynucleotide
taatacgactcactatagggccctgcagaaggctccgcaacccaagcagcaacagaggagagctgctatggttgcggagaacctggcggcagcgcaaaagatg

SEQ ID NO: 108933 - DNA, 103 bp, Artificial Sequence
  Synthetic Polynucleotide
taatacgactcactatagggtcctggcgcacggccacaacttcctgccgcaacagaggagagcggcaatgagttgtggcaacctggcggcagcgcaaaagatg

SEQ ID NO: 108934 - DNA, 103 bp, Artificial Sequence
  Synthetic Polynucleotide
taatacgactcactataggggtgggacagctcctggcgcacggccacaacaacagaggagagttgtgatggtgcgccagaacctggcggcagcgcaaaagatg

SEQ ID NO: 108935 - DNA, 103 bp, Artificial Sequence
  Synthetic Polynucleotide
taatacgactcactatagggcggcgcggtagtgggacagctcctggcgcaaacagaggagatgcgccatgagctgtcccaacctggcggcagcgcaaaagatg

SEQ ID NO: 108936 - DNA, 103 bp, Artificial Sequence
  Synthetic Polynucleotide
taatacgactcactatagggcgggacagcacggcgcggtagtgggacagcaacagaggagagctgtcatgctaccgcgcaacctggcggcagcgcaaaagatg

SEQ ID NO: 108937 - DNA, 103 bp, Artificial Sequence
  Synthetic Polynucleotide
taatacgactcactatagggggcctggtatcgggacagcacggcgcggtaaacagaggagataccgcatggtgctgtccaacctggcggcagcgcaaaagatg

SEQ ID NO: 108938 - DNA, 103 bp, Artificial Sequence
  Synthetic Polynucleotide
taatacgactcactatagggccccgtgctgggcctggtatcgggacagcaaacagaggagatgctgtatggataccaggaacctggcggcagcgcaaaagatg

SEQ ID NO: 108939 - DNA, 103 bp, Artificial Sequence
  Synthetic Polynucleotide
taatacgactcactataggggaaggagaaaggcaatgactcagctgccataacagaggagaatggcaatggagtcattgaacctggcggcagcgcaaaagatg

SEQ ID NO: 108940 - DNA, 103 bp, Artificial Sequence
  Synthetic Polynucleotide
taatacgactcactatagggtgaaacataggtacccccattttcatctgaaacagaggagatcagatatgaatgggggtaacctggcggcagcgcaaaagatg

SEQ ID NO: 108941 - DNA, 103 bp, Artificial Sequence
  Synthetic Polynucleotide
taatacgactcactatagggttccaggaggtgaaacataggtacccccataacagaggagaatggggatgcctatgtttaacctggcggcagcgcaaaagatg

SEQ ID NO: 108942 - DNA, 103 bp, Artificial Sequence
  Synthetic Polynucleotide
taatacgactcactatagggtcctcttcatttccaggaggtgaaacatagaacagaggagactatgtatgacctcctggaacctggcggcagcgcaaaagatg

SEQ ID NO: 108943 - DNA, 103 bp, Artificial Sequence
  Synthetic Polynucleotide
taatacgactcactatagggttttgattcttcctcttcatttccaggaggaacagaggagacctcctatgaatgaagagaacctggcggcagcgcaaaagatg

SEQ ID NO: 108944 - DNA, 103 bp, Artificial Sequence
  Synthetic Polynucleotide
taatacgactcactatagggtggtgaagatttttgattcttcctcttcataacagaggagaatgaagatgaagaatcaaaacctggcggcagcgcaaaagatg

SEQ ID NO: 108945 - DNA, 103 bp, Artificial Sequence
  Synthetic Polynucleotide
taatacgactcactataggggggtcaagagtggtgaagatttttgattctaacagaggagaagaatcatgaatcttcacaacctggcggcagcgcaaaagatg

SEQ ID NO: 108946 - DNA, 103 bp, Artificial Sequence
  Synthetic Polynucleotide
taatacgactcactatagggcagagaagcagggtcaagagtggtgaagataacagaggagaatcttcatgactcttgacaacctggcggcagcgcaaaagatg

SEQ ID NO: 108947 - DNA, 103 bp, Artificial Sequence
  Synthetic Polynucleotide
taatacgactcactatagggtcagccaagccagagaagcagggtcaagagaacagaggagactcttgatgctgcttctcaacctggcggcagcgcaaaagatg

SEQ ID NO: 108948 - DNA, 103 bp, Artificial Sequence
  Synthetic Polynucleotide
taatacgactcactatagggtcctcctcagtcagccaagccagagaagcaaacagaggagatgcttcatgggcttggctaacctggcggcagcgcaaaagatg

SEQ ID NO: 108949 - DNA, 103 bp, Artificial Sequence
  Synthetic Polynucleotide
taatacgactcactatagggtggttctggctcctcctcagtcagccaagcaacagaggagagcttggatgactgaggagaacctggcggcagcgcaaaagatg

SEQ ID NO: 108950 - DNA, 103 bp, Artificial Sequence
  Synthetic Polynucleotide
taatacgactcactatagggacagtgtcccgaaggagaaaggcaatgactaacagaggagaagtcatatgctttctcctaacctggcggcagcgcaaaagatg

SEQ ID NO: 108951 - DNA, 103 bp, Artificial Sequence
  Synthetic Polynucleotide
taatacgactcactatagggtgacctctgctggttctggctcctcctcagaacagaggagactgaggatgagccagaacaacctggcggcagcgcaaaagatg

SEQ ID NO: 108952 - DNA, 103 bp, Artificial Sequence
  Synthetic Polynucleotide
taatacgactcactataggggaggtgcttgtgacctctgctggttctggcaacagaggagagccagaatgagcagaggtaacctggcggcagcgcaaaagatg

SEQ ID NO: 108953 - DNA, 103 bp, Artificial Sequence
  Synthetic Polynucleotide
taatacgactcactatagggagggctctgggaggtgcttgtgacctctgcaacagaggagagcagagatgacaagcaccaacctggcggcagcgcaaaagatg

SEQ ID NO: 108954 - DNA, 103 bp, Artificial Sequence
  Synthetic Polynucleotide
taatacgactcactatagggctggagagtgagggctctgggaggtgcttgaacagaggagacaagcaatgcccagagccaacctggcggcagcgcaaaagatg

SEQ ID NO: 108955 - DNA, 103 bp, Artificial Sequence
  Synthetic Polynucleotide
taatacgactcactatagggtgactggaatctggagagtgagggctctggaacagaggagaccagagatgtcactctccaacctggcggcagcgcaaaagatg

SEQ ID NO: 108956 - DNA, 103 bp, Artificial Sequence
  Synthetic Polynucleotide
taatacgactcactatagggcagggagctctgactggaatctggagagtgaacagaggagacactctatggattccagtaacctggcggcagcgcaaaagatg

SEQ ID NO: 108957 - DNA, 103 bp, Artificial Sequence
  Synthetic Polynucleotide
taatacgactcactatagggcctcctgagccagggagctctgactggaataacagaggagaattccaatgagagctcccaacctggcggcagcgcaaaagatg

SEQ ID NO: 108958 - DNA, 103 bp, Artificial Sequence
  Synthetic Polynucleotide
taatacgactcactatagggtcctcctcttcctcctgagccagggagctcaacagaggagagagctcatgggctcaggaaacctggcggcagcgcaaaagatg

SEQ ID NO: 108959 - DNA, 103 bp, Artificial Sequence
  Synthetic Polynucleotide
taatacgactcactatagggcccttggtcttcctcctcttcctcctgagcaacagaggagagctcagatggaagaggagaacctggcggcagcgcaaaagatg

SEQ ID NO: 108960 - DNA, 103 bp, Artificial Sequence
  Synthetic Polynucleotide
taatacgactcactatagggtcctggttctcccttggtcttcctcctcttaacagaggagaaagaggatgaagaccaagaacctggcggcagcgcaaaagatg

SEQ ID NO: 108961 - DNA, 103 bp, Artificial Sequence
  Synthetic Polynucleotide
taatacgactcactatagggtcccagctggacagtgtcccgaaggagaaaaacagaggagatttctcatgcgggacactaacctggcggcagcgcaaaagatg

SEQ ID NO: 108962 - DNA, 103 bp, Artificial Sequence
  Synthetic Polynucleotide
taatacgactcactatagggtgtttccgtttcctggttctcccttggtctaacagaggagaagaccaatggagaaccagaacctggcggcagcgcaaaagatg

SEQ ID NO: 108963 - DNA, 103 bp, Artificial Sequence
  Synthetic Polynucleotide
taatacgactcactatagggatgaccactctgtttccgtttcctggttctaacagaggagaagaaccatgaaacggaaaaacctggcggcagcgcaaaagatg

SEQ ID NO: 108964 - DNA, 103 bp, Artificial Sequence
  Synthetic Polynucleotide
taatacgactcactataggggggctggggaatgaccactctgtttccgttaacagaggagaaacggaatgagagtggtcaacctggcggcagcgcaaaagatg

SEQ ID NO: 108965 - DNA, 103 bp, Artificial Sequence
  Synthetic Polynucleotide
taatacgactcactatagggtttccagcccgggctggggaatgaccactcaacagaggagagagtggatgttccccagcaacctggcggcagcgcaaaagatg

SEQ ID NO: 108966 - DNA, 103 bp, Artificial Sequence
  Synthetic Polynucleotide
taatacgactcactatagggcatgcgctgctttccagcccgggctggggaaacagaggagatccccaatgcgggctggaaacctggcggcagcgcaaaagatg

SEQ ID NO: 108967 - DNA, 103 bp, Artificial Sequence
  Synthetic Polynucleotide
taatacgactcactatagggctttctccttcatgcgctgctttccagcccaacagaggagagggctgatgagcagcgcaaacctggcggcagcgcaaaagatg

SEQ ID NO: 108968 - DNA, 103 bp, Artificial Sequence
  Synthetic Polynucleotide
taatacgactcactatagggttctcctgttctttctccttcatgcgctgcaacagaggagagcagcgatggaaggagaaaacctggcggcagcgcaaaagatg

SEQ ID NO: 108969 - DNA, 103 bp, Artificial Sequence
  Synthetic Polynucleotide
taatacgactcactatagggtttcctttcattctcctgttctttctccttaacagaggagaaaggagatggaacaggagaacctggcggcagcgcaaaagatg

SEQ ID NO: 108970 - DNA, 103 bp, Artificial Sequence
  Synthetic Polynucleotide
taatacgactcactataggggctgtgccactttcctttcattctcctgttaacagaggagaaacaggatgatgaaaggaaacctggcggcagcgcaaaagatg

SEQ ID NO: 108971 - DNA, 103 bp, Artificial Sequence
  Synthetic Polynucleotide
taatacgactcactatagggtcttcagctagctgtgccactttcctttcaaacagaggagatgaaagatgagtggcacaaacctggcggcagcgcaaaagatg

SEQ ID NO: 108972 - DNA, 103 bp, Artificial Sequence
  Synthetic Polynucleotide
taatacgactcactatagggggcttccagctcccagctggacagtgtcccaacagaggagagggacaatgtccagctggaacctggcggcagcgcaaaagatg

SEQ ID NO: 108973 - DNA, 103 bp, Artificial Sequence
  Synthetic Polynucleotide
taatacgactcactatagggccgttcattctcttcagctagctgtgccacaacagaggagagtggcaatgctagctgaaaacctggcggcagcgcaaaagatg

SEQ ID NO: 108974 - DNA, 103 bp, Artificial Sequence
  Synthetic Polynucleotide
taatacgactcactatagggcctgcttgagccgttcattctcttcagctaaacagaggagatagctgatgagaatgaacaacctggcggcagcgcaaaagatg

SEQ ID NO: 108975 - DNA, 103 bp, Artificial Sequence
  Synthetic Polynucleotide
taatacgactcactatagggcgctcgatttcctgcttgagccgttcattcaacagaggagagaatgaatggctcaagcaaacctggcggcagcgcaaaagatg

SEQ ID NO: 108976 - DNA, 103 bp, Artificial Sequence
  Synthetic Polynucleotide
taatacgactcactatagggcctggtcaggcgctcgatttcctgcttgagaacagaggagactcaagatggaaatcgagaacctggcggcagcgcaaaagatg

SEQ ID NO: 108977 - DNA, 103 bp, Artificial Sequence
  Synthetic Polynucleotide
taatacgactcactatagggcctctacttccctggtcaggcgctcgatttaacagaggagaaaatcgatggcctgaccaaacctggcggcagcgcaaaagatg

SEQ ID NO: 108978 - DNA, 103 bp, Artificial Sequence
  Synthetic Polynucleotide
taatacgactcactatagggcggcgagtcgcctctacttccctggtcaggaacagaggagacctgacatgggaagtagaaacctggcggcagcgcaaaagatg

SEQ ID NO: 108979 - DNA, 103 bp, Artificial Sequence
  Synthetic Polynucleotide
taatacgactcactatagggaatcagagctcggcgagtcgcctctacttcaacagaggagagaagtaatggcgactcgcaacctggcggcagcgcaaaagatg

SEQ ID NO: 108980 - DNA, 103 bp, Artificial Sequence
  Synthetic Polynucleotide
taatacgactcactatagggccattcggtcaatcagagctcggcgagtcgaacagaggagacgactcatggagctctgaaacctggcggcagcgcaaaagatg

SEQ ID NO: 108981 - DNA, 103 bp, Artificial Sequence
  Synthetic Polynucleotide
taatacgactcactatagggtgcagattcaccattcggtcaatcagagctaacagaggagaagctctatgtgaccgaataacctggcggcagcgcaaaagatg

SEQ ID NO: 108982 - DNA, 103 bp, Artificial Sequence
  Synthetic Polynucleotide
taatacgactcactatagggtcatgcttggtgcagattcaccattcggtcaacagaggagagaccgaatggtgaatctgaacctggcggcagcgcaaaagatg

SEQ ID NO: 108983 - DNA, 103 bp, Artificial Sequence
  Synthetic Polynucleotide
taatacgactcactatagggcctcataccaggcttccagctcccagctggaacagaggagaccagctatgagctggaagaacctggcggcagcgcaaaagatg

SEQ ID NO: 108984 - DNA, 103 bp, Artificial Sequence
  Synthetic Polynucleotide
taatacgactcactatagggtcttgcaggtcctcataccaggcttccagcaacagaggagagctggaatgctggtatgaaacctggcggcagcgcaaaagatg

SEQ ID NO: 108985 - DNA, 103 bp, Artificial Sequence
  Synthetic Polynucleotide
taatacgactcactatagggagacaggacctcttgcaggtcctcataccaaacagaggagatggtatatggacctgcaaaacctggcggcagcgcaaaagatg

SEQ ID NO: 108986 - DNA, 103 bp, Artificial Sequence
  Synthetic Polynucleotide
taatacgactcactatagggtttcatctgaagacaggacctcttgcaggtaacagaggagaacctgcatgaggtcctgtaacctggcggcagcgcaaaagatg

SEQ ID NO: 108987 - DNA, 103 bp, Artificial Sequence
  Synthetic Polynucleotide
taatacgactcactataggggtacccccattttcatctgaagacaggaccaacagaggagaggtcctatgttcagatgaaacctggcggcagcgcaaaagatg

SEQ ID NO: 108988 - DNA, 103 bp, Artificial Sequence
  Synthetic Polynucleotide
taatacgactcactatagggcccctcggagaacagtgggccatccagcataacagaggagaatgctgatgggcccactgaacctggcggcagcgcaaaagatg

SEQ ID NO: 108989 - DNA, 103 bp, Artificial Sequence
  Synthetic Polynucleotide
taatacgactcactatagggagtcttcacttctatcaccaatagcttggaaacagaggagatccaagatgttggtgataaacctggcggcagcgcaaaagatg

SEQ ID NO: 108990 - DNA, 103 bp, Artificial Sequence
  Synthetic Polynucleotide
taatacgactcactataggggctccctgtagctttggcttggggatggctaacagaggagaagccatatgcaagccaaaaacctggcggcagcgcaaaagatg

SEQ ID NO: 108991 - DNA, 103 bp, Artificial Sequence
  Synthetic Polynucleotide
taatacgactcactatagggcggtgcctgcgctccctgtagctttggcttaacagaggagaaagccaatgctacagggaaacctggcggcagcgcaaaagatg

SEQ ID NO: 108992 - DNA, 103 bp, Artificial Sequence
  Synthetic Polynucleotide
taatacgactcactatagggggagctatctcggtgcctgcgctccctgtaaacagaggagatacaggatgcgcaggcacaacctggcggcagcgcaaaagatg

SEQ ID NO: 108993 - DNA, 103 bp, Artificial Sequence
  Synthetic Polynucleotide
taatacgactcactatagggagaccccgcaggagctatctcggtgcctgcaacagaggagagcaggcatggagatagctaacctggcggcagcgcaaaagatg

SEQ ID NO: 108994 - DNA, 103 bp, Artificial Sequence
  Synthetic Polynucleotide
taatacgactcactatagggccgcagttgcagaccccgcaggagctatctaacagaggagaagatagatgctgcggggtaacctggcggcagcgcaaaagatg

SEQ ID NO: 108995 - DNA, 103 bp, Artificial Sequence
  Synthetic Polynucleotide
taatacgactcactataggggcacagggagccgcagttgcagaccccgcaaacagaggagatgcgggatgtgcaactgcaacctggcggcagcgcaaaagatg

SEQ ID NO: 108996 - DNA, 103 bp, Artificial Sequence
  Synthetic Polynucleotide
taatacgactcactataggggggatgcggggcacagggagccgcagttgcaacagaggagagcaactatggctccctgtaacctggcggcagcgcaaaagatg

SEQ ID NO: 108997 - DNA, 103 bp, Artificial Sequence
  Synthetic Polynucleotide
taatacgactcactatagggatctgggagcgggatgcggggcacagggagaacagaggagactccctatgccccgcatcaacctggcggcagcgcaaaagatg

SEQ ID NO: 108998 - DNA, 103 bp, Artificial Sequence
  Synthetic Polynucleotide
taatacgactcactatagggtggtgcctggatctgggagcgggatgcgggaacagaggagacccgcaatgcgctcccagaacctggcggcagcgcaaaagatg

SEQ ID NO: 108999 - DNA, 103 bp, Artificial Sequence
  Synthetic Polynucleotide
taatacgactcactataggggcccttgaggtggtgcctggatctgggagcaacagaggagagctcccatgtccaggcacaacctggcggcagcgcaaaagatg

SEQ ID NO: 109000 - DNA, 103 bp, Artificial Sequence
  Synthetic Polynucleotide
taatacgactcactataggggacaggaaatagtcttcacttctatcaccaaacagaggagatggtgaatgaagtgaagaaacctggcggcagcgcaaaagatg

SEQ ID NO: 109001 - DNA, 103 bp, Artificial Sequence
  Synthetic Polynucleotide
taatacgactcactatagggcttccctcgagcccttgaggtggtgcctggaacagaggagaccaggcatgacctcaaggaacctggcggcagcgcaaaagatg

SEQ ID NO: 109002 - DNA, 103 bp, Artificial Sequence
  Synthetic Polynucleotide
taatacgactcactatagggccttctttcccttccctcgagcccttgaggaacagaggagacctcaaatgctcgagggaaacctggcggcagcgcaaaagatg

SEQ ID NO: 109003 - DNA, 103 bp, Artificial Sequence
  Synthetic Polynucleotide
taatacgactcactataggggatctgttctccttctttcccttccctcgaaacagaggagatcgaggatggggaaagaaaacctggcggcagcgcaaaagatg

SEQ ID NO: 109004 - DNA, 103 bp, Artificial Sequence
  Synthetic Polynucleotide
taatacgactcactatagggtgggaaaccagatctgttctccttctttccaacagaggagaggaaagatggagaacagaaacctggcggcagcgcaaaagatg

SEQ ID NO: 109005 - DNA, 103 bp, Artificial Sequence
  Synthetic Polynucleotide
taatacgactcactatagggatccagcatttgggaaaccagatctgttctaacagaggagaagaacaatgctggtttccaacctggcggcagcgcaaaagatg

SEQ ID NO: 109006 - DNA, 103 bp, Artificial Sequence
  Synthetic Polynucleotide
taatacgactcactatagggaggggagggaatccagcatttgggaaaccaaacagaggagatggtttatgaaatgctggaacctggcggcagcgcaaaagatg

SEQ ID NO: 109007 - DNA, 103 bp, Artificial Sequence
  Synthetic Polynucleotide
taatacgactcactataggggctgctttttaggggagggaatccagcattaacagaggagaaatgctatgttccctcccaacctggcggcagcgcaaaagatg

SEQ ID NO: 109008 - DNA, 103 bp, Artificial Sequence
  Synthetic Polynucleotide
taatacgactcactatagggtggcggggcggctgctttttaggggagggaaacagaggagatccctcatgtaaaaagcaaacctggcggcagcgcaaaagatg

SEQ ID NO: 109009 - DNA, 103 bp, Artificial Sequence
  Synthetic Polynucleotide
taatacgactcactatagggtgtctggctatggcggggcggctgctttttaacagaggagaaaaaagatgccgccccgcaacctggcggcagcgcaaaagatg

SEQ ID NO: 109010 - DNA, 103 bp, Artificial Sequence
  Synthetic Polynucleotide
taatacgactcactataggggtctggggagtgtctggctatggcggggcgaacagaggagacgccccatgatagccagaaacctggcggcagcgcaaaagatg

SEQ ID NO: 109011 - DNA, 103 bp, Artificial Sequence
  Synthetic Polynucleotide
taatacgactcactatagggcgactataatgacaggaaatagtcttcactaacagaggagaagtgaaatgtatttcctgaacctggcggcagcgcaaaagatg

SEQ ID NO: 109012 - DNA, 103 bp, Artificial Sequence
  Synthetic Polynucleotide
taatacgactcactatagggggagcccagggtctggggagtgtctggctaaacagaggagatagccaatgactccccagaacctggcggcagcgcaaaagatg

SEQ ID NO: 109013 - DNA, 103 bp, Artificial Sequence
  Synthetic Polynucleotide
taatacgactcactatagggggtgcctccgggagcccagggtctggggagaacagaggagactccccatgccctgggctaacctggcggcagcgcaaaagatg

SEQ ID NO: 109014 - DNA, 103 bp, Artificial Sequence
  Synthetic Polynucleotide
taatacgactcactatagggctctccatccggtgcctccgggagcccaggaacagaggagacctgggatgccggaggcaaacctggcggcagcgcaaaagatg

SEQ ID NO: 109015 - DNA, 103 bp, Artificial Sequence
  Synthetic Polynucleotide
taatacgactcactatagggcccagagattctctccatccggtgcctccgaacagaggagacggaggatgcggatggagaacctggcggcagcgcaaaagatg

SEQ ID NO: 109016 - DNA, 103 bp, Artificial Sequence
  Synthetic Polynucleotide
taatacgactcactatagggctctccaagacccagagattctctccatccaacagaggagaggatggatggaatctctgaacctggcggcagcgcaaaagatg

SEQ ID NO: 109017 - DNA, 103 bp, Artificial Sequence
  Synthetic Polynucleotide
taatacgactcactataggggtcctgccccctctccaagacccagagattaacagaggagaaatctcatggtcttggagaacctggcggcagcgcaaaagatg

SEQ ID NO: 109018 - DNA, 103 bp, Artificial Sequence
  Synthetic Polynucleotide
taatacgactcactatagggagggtctccggtcctgccccctctccaagaaacagaggagatcttggatggggggcaggaacctggcggcagcgcaaaagatg

SEQ ID NO: 109019 - DNA, 103 bp, Artificial Sequence
  Synthetic Polynucleotide
taatacgactcactatagggccaaccctccagggtctccggtcctgccccaacagaggagaggggcaatgccggagaccaacctggcggcagcgcaaaagatg

SEQ ID NO: 109020 - DNA, 103 bp, Artificial Sequence
  Synthetic Polynucleotide
taatacgactcactataggggggtcgccttccaaccctccagggtctccgaacagaggagacggagaatgtggagggttaacctggcggcagcgcaaaagatg

SEQ ID NO: 109021 - DNA, 103 bp, Artificial Sequence
  Synthetic Polynucleotide
taatacgactcactatagggtgggcacggcgggtcgccttccaaccctccaacagaggagaggagggatggaaggcgacaacctggcggcagcgcaaaagatg

SEQ ID NO: 109022 - DNA, 103 bp, Artificial Sequence
  Synthetic Polynucleotide
taatacgactcactatagggaggggcgcggcgactataatgacaggaaataacagaggagaatttccatgcattatagtaacctggcggcagcgcaaaagatg

SEQ ID NO: 109023 - DNA, 103 bp, Artificial Sequence
  Synthetic Polynucleotide
taatacgactcactataggggggcaaggtgtgggcacggcgggtcgccttaacagaggagaaaggcgatgcgccgtgccaacctggcggcagcgcaaaagatg

SEQ ID NO: 109024 - DNA, 103 bp, Artificial Sequence
  Synthetic Polynucleotide
taatacgactcactataggggggaactgcggggcaaggtgtgggcacggcaacagaggagagccgtgatgacaccttgcaacctggcggcagcgcaaaagatg

SEQ ID NO: 109025 - DNA, 103 bp, Artificial Sequence
  Synthetic Polynucleotide
taatacgactcactataggggacaggccctgggaactgcggggcaaggtgaacagaggagacaccttatgccgcagttcaacctggcggcagcgcaaaagatg

SEQ ID NO: 109026 - DNA, 103 bp, Artificial Sequence
  Synthetic Polynucleotide
taatacgactcactatagggttccccacgggacaggccctgggaactgcgaacagaggagacgcagtatgcagggcctgaacctggcggcagcgcaaaagatg

SEQ ID NO: 109027 - DNA, 103 bp, Artificial Sequence
  Synthetic Polynucleotide
taatacgactcactatagggcaaagacgccttccccacgggacaggccctaacagaggagaagggccatgcccgtggggaacctggcggcagcgcaaaagatg

SEQ ID NO: 109028 - DNA, 103 bp, Artificial Sequence
  Synthetic Polynucleotide
taatacgactcactataggggcgtcaatgacaaagacgccttccccacggaacagaggagaccgtggatgaggcgtcttaacctggcggcagcgcaaaagatg

SEQ ID NO: 109029 - DNA, 103 bp, Artificial Sequence
  Synthetic Polynucleotide
taatacgactcactatagggtacgcacgtggcgtcaatgacaaagacgccaacagaggagaggcgtcatggtcattgacaacctggcggcagcgcaaaagatg

SEQ ID NO: 109030 - DNA, 103 bp, Artificial Sequence
  Synthetic Polynucleotide
taatacgactcactatagggatcgtatcactacgcacgtggcgtcaatgaaacagaggagatcattgatgccacgtgcgaacctggcggcagcgcaaaagatg

SEQ ID NO: 109031 - DNA, 103 bp, Artificial Sequence
  Synthetic Polynucleotide
taatacgactcactatagggacatattgggatcgtatcactacgcacgtgaacagaggagacacgtgatgagtgatacgaacctggcggcagcgcaaaagatg

SEQ ID NO: 109032 - DNA, 103 bp, Artificial Sequence
  Synthetic Polynucleotide
taatacgactcactataggggggggttggaacatattgggatcgtatcacaacagaggagagtgataatgtcccaatataacctggcggcagcgcaaaagatg

SEQ ID NO: 109033 - DNA, 103 bp, Artificial Sequence
  Synthetic Polynucleotide
taatacgactcactataggggctgtcgagaaggggcgcggcgactataataacagaggagaattataatggccgcgcccaacctggcggcagcgcaaaagatg

SEQ ID NO: 109034 - DNA, 103 bp, Artificial Sequence
  Synthetic Polynucleotide
taatacgactcactataggggctgggttcggggggttggaacatattgggaacagaggagacccaatatgttccaacccaacctggcggcagcgcaaaagatg

SEQ ID NO: 109035 - DNA, 103 bp, Artificial Sequence
  Synthetic Polynucleotide
taatacgactcactatagggagctgcacctgctgggttcggggggttggaaacagaggagatccaacatgccgaacccaaacctggcggcagcgcaaaagatg

SEQ ID NO: 109036 - DNA, 103 bp, Artificial Sequence
  Synthetic Polynucleotide
taatacgactcactatagggagagggcaaaagctgcacctgctgggttcgaacagaggagacgaaccatgcaggtgcagaacctggcggcagcgcaaaagatg

SEQ ID NO: 109037 - DNA, 103 bp, Artificial Sequence
  Synthetic Polynucleotide
taatacgactcactataggggtgtcaccccagagggcaaaagctgcacctaacagaggagaaggtgcatgttttgccctaacctggcggcagcgcaaaagatg

SEQ ID NO: 109038 - DNA, 103 bp, Artificial Sequence
  Synthetic Polynucleotide
taatacgactcactatagggcccaccacgcgtgtcaccccagagggcaaaaacagaggagatttgccatgtggggtgacaacctggcggcagcgcaaaagatg

SEQ ID NO: 109039 - DNA, 103 bp, Artificial Sequence
  Synthetic Polynucleotide
taatacgactcactataggggggggaatcccccaccacgcgtgtcaccccaacagaggagaggggtgatgcgcgtggtgaacctggcggcagcgcaaaagatg

SEQ ID NO: 109040 - DNA, 103 bp, Artificial Sequence
  Synthetic Polynucleotide
taatacgactcactatagggtcgattggctgggggaatcccccaccacgcaacagaggagagcgtggatggggattcccaacctggcggcagcgcaaaagatg

SEQ ID NO: 109041 - DNA, 103 bp, Artificial Sequence
  Synthetic Polynucleotide
taatacgactcactatagggttgccgggcttcgattggctgggggaatccaacagaggagaggattcatgcagccaatcaacctggcggcagcgcaaaagatg

SEQ ID NO: 109042 - DNA, 103 bp, Artificial Sequence
  Synthetic Polynucleotide
taatacgactcactatagggaccctcctccttgccgggcttcgattggctaacagaggagaagccaaatgaagcccggcaacctggcggcagcgcaaaagatg

SEQ ID NO: 109043 - DNA, 103 bp, Artificial Sequence
  Synthetic Polynucleotide
taatacgactcactatagggtggccccttcaccctcctccttgccgggctaacagaggagaagcccgatgaggaggaggaacctggcggcagcgcaaaagatg

SEQ ID NO: 109044 - DNA, 103 bp, Artificial Sequence
  Synthetic Polynucleotide
taatacgactcactatagggaagtccatgggctgtcgagaaggggcgcggaacagaggagaccgcgcatgttctcgacaaacctggcggcagcgcaaaagatg

SEQ ID NO: 109045 - DNA, 103 bp, Artificial Sequence
  Synthetic Polynucleotide
taatacgactcactatagggggaaagaccgtggccccttcaccctcctccaacagaggagaggaggaatgtgaaggggcaacctggcggcagcgcaaaagatg

SEQ ID NO: 109046 - DNA, 103 bp, Artificial Sequence
  Synthetic Polynucleotide
taatacgactcactatagggacaaggggaaggaaagaccgtggccccttcaacagaggagagaagggatgacggtctttaacctggcggcagcgcaaaagatg

SEQ ID NO: 109047 - DNA, 103 bp, Artificial Sequence
  Synthetic Polynucleotide
taatacgactcactataggggccgcttttgacaaggggaaggaaagaccgaacagaggagacggtctatgcttccccttaacctggcggcagcgcaaaagatg

SEQ ID NO: 109048 - DNA, 103 bp, Artificial Sequence
  Synthetic Polynucleotide
taatacgactcactatagggctgctcgacagccgcttttgacaaggggaaaacagaggagattccccatgtcaaaagcgaacctggcggcagcgcaaaagatg

SEQ ID NO: 109049 - DNA, 103 bp, Artificial Sequence
  Synthetic Polynucleotide
taatacgactcactatagggtaaaaggcgactgctcgacagccgcttttgaacagaggagacaaaagatgctgtcgagcaacctggcggcagcgcaaaagatg

SEQ ID NO: 109050 - DNA, 103 bp, Artificial Sequence
  Synthetic Polynucleotide
taatacgactcactatagggcgggctggtgtaaaaggcgactgctcgacaaacagaggagatgtcgaatggtcgcctttaacctggcggcagcgcaaaagatg

SEQ ID NO: 109051 - DNA, 103 bp, Artificial Sequence
  Synthetic Polynucleotide
taatacgactcactatagggcggcccccgccgggctggtgtaaaaggcgaaacagaggagatcgcctatgacaccagccaacctggcggcagcgcaaaagatg

SEQ ID NO: 109052 - DNA, 103 bp, Artificial Sequence
  Synthetic Polynucleotide
taatacgactcactatagggttcgcccccgcggcccccgccgggctggtgaacagaggagacaccagatgggcgggggcaacctggcggcagcgcaaaagatg

SEQ ID NO: 109053 - DNA, 103 bp, Artificial Sequence
  Synthetic Polynucleotide
taatacgactcactatagggcgccctcagcttcgcccccgcggcccccgcaacagaggagagcggggatggcgggggcgaacctggcggcagcgcaaaagatg

SEQ ID NO: 109054 - DNA, 103 bp, Artificial Sequence
  Synthetic Polynucleotide
taatacgactcactatagggcccggcctcccgccctcagcttcgcccccgaacagaggagacgggggatgagctgagggaacctggcggcagcgcaaaagatg

SEQ ID NO: 109055 - DNA, 103 bp, Artificial Sequence
  Synthetic Polynucleotide
taatacgactcactataggggctggcctggaagtccatgggctgtcgagaaacagaggagatctcgaatgcccatggacaacctggcggcagcgcaaaagatg

SEQ ID NO: 109056 - DNA, 103 bp, Artificial Sequence
  Synthetic Polynucleotide
taatacgactcactatagggtgtggagtcccccggcctcccgccctcagcaacagaggagagctgagatggggaggccgaacctggcggcagcgcaaaagatg

SEQ ID NO: 109057 - DNA, 103 bp, Artificial Sequence
  Synthetic Polynucleotide
taatacgactcactataggggctcctccagtgtggagtcccccggcctccaacagaggagaggaggcatggggactccaaacctggcggcagcgcaaaagatg

SEQ ID NO: 109058 - DNA, 103 bp, Artificial Sequence
  Synthetic Polynucleotide
taatacgactcactatagggcggaaagtgcgctcctccagtgtggagtccaacagaggagaggactcatgactggaggaaacctggcggcagcgcaaaagatg

SEQ ID NO: 109059 - DNA, 103 bp, Artificial Sequence
  Synthetic Polynucleotide
taatacgactcactatagggccccaagatgcggaaagtgcgctcctccagaacagaggagactggagatgcgcactttcaacctggcggcagcgcaaaagatg

SEQ ID NO: 109060 - DNA, 103 bp, Artificial Sequence
  Synthetic Polynucleotide
taatacgactcactataggggggccgggagccccaagatgcggaaagtgcaacagaggagagcacttatggcatcttggaacctggcggcagcgcaaaagatg

SEQ ID NO: 109061 - DNA, 103 bp, Artificial Sequence
  Synthetic Polynucleotide
taatacgactcactatagggtttacttcgggggccgggagccccaagatgaacagaggagacatcttatggctcccggcaacctggcggcagcgcaaaagatg

SEQ ID NO: 109062 - DNA, 103 bp, Artificial Sequence
  Synthetic Polynucleotide
taatacgactcactataggggtcccgcaggtttacttcgggggccgggagaacagaggagactcccgatgcccgaagtaaacctggcggcagcgcaaaagatg

SEQ ID NO: 109063 - DNA, 103 bp, Artificial Sequence
  Synthetic Polynucleotide
taatacgactcactataggggcgtgggggcgtcccgcaggtttacttcggaacagaggagaccgaagatgacctgcgggaacctggcggcagcgcaaaagatg

SEQ ID NO: 109064 - DNA, 103 bp, Artificial Sequence
  Synthetic Polynucleotide
taatacgactcactatagggctacctggctgcgtgggggcgtcccgcaggaacagaggagacctgcgatgcgcccccacaacctggcggcagcgcaaaagatg

SEQ ID NO: 109065 - DNA, 103 bp, Artificial Sequence
  Synthetic Polynucleotide
taatacgactcactataggggtgctctgggctacctggctgcgtgggggcaacagaggagagcccccatgcagccaggtaacctggcggcagcgcaaaagatg

SEQ ID NO: 109066 - DNA, 103 bp, Artificial Sequence
  Synthetic Polynucleotide
taatacgactcactataggggagcccagtggctggcctggaagtccatggaacagaggagaccatggatgtccaggccaaacctggcggcagcgcaaaagatg

SEQ ID NO: 109067 - DNA, 103 bp, Artificial Sequence
  Synthetic Polynucleotide
taatacgactcactatagggctaaggcttggtgctctgggctacctggctaacagaggagaagccagatggcccagagcaacctggcggcagcgcaaaagatg

SEQ ID NO: 109068 - DNA, 103 bp, Artificial Sequence
  Synthetic Polynucleotide
taatacgactcactataggggctgctgggcctaaggcttggtgctctgggaacagaggagacccagaatgccaagccttaacctggcggcagcgcaaaagatg

SEQ ID NO: 109069 - DNA, 103 bp, Artificial Sequence
  Synthetic Polynucleotide
taatacgactcactatagggggctcccgaagctgctgggcctaaggcttgaacagaggagacaagccatgggcccagcaaacctggcggcagcgcaaaagatg

SEQ ID NO: 109070 - DNA, 103 bp, Artificial Sequence
  Synthetic Polynucleotide
taatacgactcactatagggctctgccctgggctcccgaagctgctgggcaacagaggagagcccagatgcttcgggagaacctggcggcagcgcaaaagatg

SEQ ID NO: 109071 - DNA, 103 bp, Artificial Sequence
  Synthetic Polynucleotide
taatacgactcactataggggacccctcggctctgccctgggctcccgaaaacagaggagattcgggatgccagggcagaacctggcggcagcgcaaaagatg

SEQ ID NO: 109072 - DNA, 103 bp, Artificial Sequence
  Synthetic Polynucleotide
taatacgactcactatagggcgccacttccgacccctcggctctgccctgaacagaggagacagggcatggccgaggggaacctggcggcagcgcaaaagatg

SEQ ID NO: 109073 - DNA, 103 bp, Artificial Sequence
  Synthetic Polynucleotide
taatacgactcactataggggctggaccaccgccacttccgacccctcggaacagaggagaccgaggatgcggaagtggaacctggcggcagcgcaaaagatg

SEQ ID NO: 109074 - DNA, 103 bp, Artificial Sequence
  Synthetic Polynucleotide
taatacgactcactatagggccggcgcgccgctggaccaccgccacttccaacagaggagaggaagtatgggtggtccaaacctggcggcagcgcaaaagatg

SEQ ID NO: 109075 - DNA, 103 bp, Artificial Sequence
  Synthetic Polynucleotide
taatacgactcactatagggccagccccggccggcgcgccgctggaccacaacagaggagagtggtcatgcggcgcgccaacctggcggcagcgcaaaagatg

SEQ ID NO: 109076 - DNA, 103 bp, Artificial Sequence
  Synthetic Polynucleotide
taatacgactcactataggggggtccgcgcccagccccggccggcgcgccaacagaggagaggcgcgatggccggggctaacctggcggcagcgcaaaagatg

SEQ ID NO: 109077 - DNA, 103 bp, Artificial Sequence
  Synthetic Polynucleotide
taatacgactcactatagggtggaacccgcgagcccagtggctggcctggaacagaggagaccaggcatgccactgggcaacctggcggcagcgcaaaagatg

SEQ ID NO: 109078 - DNA, 103 bp, Artificial Sequence
  Synthetic Polynucleotide
taatacgactcactatagggtagggccctggggtccgcgcccagccccggaacagaggagaccggggatgggcgcggacaacctggcggcagcgcaaaagatg

SEQ ID NO: 109079 - DNA, 103 bp, Artificial Sequence
  Synthetic Polynucleotide
taatacgactcactatagggggccccggcgtagggccctggggtccgcgcaacagaggagagcgcggatgccagggcccaacctggcggcagcgcaaaagatg

SEQ ID NO: 109080 - DNA, 103 bp, Artificial Sequence
  Synthetic Polynucleotide
taatacgactcactatagggcttctcgcagggccccggcgtagggccctgaacagaggagacagggcatgacgccggggaacctggcggcagcgcaaaagatg

SEQ ID NO: 109081 - DNA, 103 bp, Artificial Sequence
  Synthetic Polynucleotide
taatacgactcactatagggcgggacacggcttctcgcagggccccggcgaacagaggagacgccggatgcctgcgagaaacctggcggcagcgcaaaagatg

SEQ ID NO: 109082 - DNA, 103 bp, Artificial Sequence
  Synthetic Polynucleotide
taatacgactcactataggggcggcggatacgggacacggcttctcgcagaacagaggagactgcgaatggccgtgtccaacctggcggcagcgcaaaagatg

SEQ ID NO: 109083 - DNA, 103 bp, Artificial Sequence
  Synthetic Polynucleotide
taatacgactcactataggggggctgtgtggcggcggatacgggacacggaacagaggagaccgtgtatggtatccgccaacctggcggcagcgcaaaagatg

SEQ ID NO: 109084 - DNA, 103 bp, Artificial Sequence
  Synthetic Polynucleotide
taatacgactcactatagggtccgagtcaggggctgtgtggcggcggataaacagaggagatatccgatgccacacagcaacctggcggcagcgcaaaagatg

SEQ ID NO: 109085 - DNA, 103 bp, Artificial Sequence
  Synthetic Polynucleotide
taatacgactcactatagggttcgtccgtgtccgagtcaggggctgtgtgaacagaggagacacacaatgcctgactcgaacctggcggcagcgcaaaagatg

SEQ ID NO: 109086 - DNA, 103 bp, Artificial Sequence
  Synthetic Polynucleotide
taatacgactcactataggggctcctcagcttcgtccgtgtccgagtcagaacagaggagactgactatgacacggacgaacctggcggcagcgcaaaagatg

SEQ ID NO: 109087 - DNA, 103 bp, Artificial Sequence
  Synthetic Polynucleotide
taatacgactcactatagggtggacgctgagctcctcagcttcgtccgtgaacagaggagacacggaatgagctgaggaaacctggcggcagcgcaaaagatg

SEQ ID NO: 109088 - DNA, 103 bp, Artificial Sequence
  Synthetic Polynucleotide
taatacgactcactatagggcgtgcggttctggaacccgcgagcccagtgaacagaggagacactggatgcgcgggttcaacctggcggcagcgcaaaagatg

SEQ ID NO: 109089 - DNA, 103 bp, Artificial Sequence
  Synthetic Polynucleotide
taatacgactcactatagggggagccgctatggacgctgagctcctcagcaacagaggagagctgagatgctcagcgtcaacctggcggcagcgcaaaagatg

SEQ ID NO: 109090 - DNA, 103 bp, Artificial Sequence
  Synthetic Polynucleotide
taatacgactcactatagggttccatcagaggagccgctatggacgctgaaacagaggagatcagcgatgatagcggctaacctggcggcagcgcaaaagatg

SEQ ID NO: 109091 - DNA, 103 bp, Artificial Sequence
  Synthetic Polynucleotide
taatacgactcactatagggtctgtgtcgcttccatcagaggagccgctaaacagaggagatagcggatgctctgatggaacctggcggcagcgcaaaagatg

SEQ ID NO: 109092 - DNA, 103 bp, Artificial Sequence
  Synthetic Polynucleotide
taatacgactcactataggggcccggggcttctgtgtcgcttccatcagaaacagaggagatctgatatgagcgacacaaacctggcggcagcgcaaaagatg

SEQ ID NO: 109093 - DNA, 103 bp, Artificial Sequence
  Synthetic Polynucleotide
taatacgactcactataggggccaggaggcgcccggggcttctgtgtcgcaacagaggagagcgacaatgaagccccggaacctggcggcagcgcaaaagatg

SEQ ID NO: 109094 - DNA, 103 bp, Artificial Sequence
  Synthetic Polynucleotide
taatacgactcactatagggctctcattccgccaggaggcgcccggggctaacagaggagaagccccatgcgcctcctgaacctggcggcagcgcaaaagatg

SEQ ID NO: 109095 - DNA, 103 bp, Artificial Sequence
  Synthetic Polynucleotide
taatacgactcactataggggggcagggtcctctcattccgccaggaggcaacagaggagagcctccatgcggaatgagaacctggcggcagcgcaaaagatg

SEQ ID NO: 109096 - DNA, 103 bp, Artificial Sequence
  Synthetic Polynucleotide
taatacgactcactatagggttccaacctcgggcagggtcctctcattccaacagaggagaggaatgatgggaccctgcaacctggcggcagcgcaaaagatg

SEQ ID NO: 109097 - DNA, 103 bp, Artificial Sequence
  Synthetic Polynucleotide
taatacgactcactatagggggcgaactgtttccaacctcgggcagggtcaacagaggagagaccctatgcgaggttggaacctggcggcagcgcaaaagatg

SEQ ID NO: 109098 - DNA, 103 bp, Artificial Sequence
  Synthetic Polynucleotide
taatacgactcactatagggatcttcctctggcgaactgtttccaacctcaacagaggagagaggttatgaacagttcgaacctggcggcagcgcaaaagatg

SEQ ID NO: 109099 - DNA, 103 bp, Artificial Sequence
  Synthetic Polynucleotide
taatacgactcactatagggggctgtcaggcccctcggagaacagtgggcaacagaggagagcccacatgtctccgaggaacctggcggcagcgcaaaagatg

SEQ ID NO: 109100 - DNA, 103 bp, Artificial Sequence
  Synthetic Polynucleotide
taatacgactcactataggggcggcccacacgtgcggttctggaacccgcaacagaggagagcgggtatgagaaccgcaaacctggcggcagcgcaaaagatg

SEQ ID NO: 109101 - DNA, 103 bp, Artificial Sequence
  Synthetic Polynucleotide
taatacgactcactatagggctgtcttcccatcttcctctggcgaactgtaacagaggagaacagttatgcagaggaagaacctggcggcagcgcaaaagatg

SEQ ID NO: 109102 - DNA, 103 bp, Artificial Sequence
  Synthetic Polynucleotide
taatacgactcactatagggctcagttccgctgtcttcccatcttcctctaacagaggagaagaggaatgtgggaagacaacctggcggcagcgcaaaagatg

SEQ ID NO: 109103 - DNA, 103 bp, Artificial Sequence
  Synthetic Polynucleotide
taatacgactcactataggggacactgtcgctcagttccgctgtcttcccaacagaggagagggaagatggcggaactgaacctggcggcagcgcaaaagatg

SEQ ID NO: 109104 - DNA, 103 bp, Artificial Sequence
  Synthetic Polynucleotide
taatacgactcactatagggggatctccccgacactgtcgctcagttccgaacagaggagacggaacatggcgacagtgaacctggcggcagcgcaaaagatg

SEQ ID NO: 109105 - DNA, 103 bp, Artificial Sequence
  Synthetic Polynucleotide
taatacgactcactatagggatgacatctaggatctccccgacactgtcgaacagaggagacgacagatgcggggagataacctggcggcagcgcaaaagatg

SEQ ID NO: 109106 - DNA, 103 bp, Artificial Sequence
  Synthetic Polynucleotide
taatacgactcactatagggggtttggcttatgacatctaggatctccccaacagaggagaggggagatgctagatgtcaacctggcggcagcgcaaaagatg

SEQ ID NO: 109107 - DNA, 103 bp, Artificial Sequence
  Synthetic Polynucleotide
taatacgactcactatagggggacctcctcggtttggcttatgacatctaaacagaggagatagatgatgtaagccaaaaacctggcggcagcgcaaaagatg

SEQ ID NO: 109108 - DNA, 103 bp, Artificial Sequence
  Synthetic Polynucleotide
taatacgactcactatagggaccccgaagaggacctcctcggtttggcttaacagaggagaaagccaatgcgaggaggtaacctggcggcagcgcaaaagatg

SEQ ID NO: 109109 - DNA, 103 bp, Artificial Sequence
  Synthetic Polynucleotide
taatacgactcactataggggatgtccctcaccccgaagaggacctcctcaacagaggagagaggagatgctcttcgggaacctggcggcagcgcaaaagatg

SEQ ID NO: 109110 - DNA, 103 bp, Artificial Sequence
  Synthetic Polynucleotide
taatacgactcactataggggggtccctctgatgtccctcaccccgaagaaacagaggagatcttcgatgtgagggacaaacctggcggcagcgcaaaagatg

SEQ ID NO: 109111 - DNA, 103 bp, Artificial Sequence
  Synthetic Polynucleotide
taatacgactcactataggggatcccgggcgcggcccacacgtgcggttcaacagaggagagaaccgatggtgtgggccaacctggcggcagcgcaaaagatg

SEQ ID NO: 109112 - DNA, 103 bp, Artificial Sequence
  Synthetic Polynucleotide
taatacgactcactatagggtttccctgttgggtccctctgatgtccctcaacagaggagagagggaatgcagagggacaacctggcggcagcgcaaaagatg

SEQ ID NO: 109113 - DNA, 103 bp, Artificial Sequence
  Synthetic Polynucleotide
taatacgactcactatagggcctcttcctatttccctgttgggtccctctaacagaggagaagagggatgcaacagggaaacctggcggcagcgcaaaagatg

SEQ ID NO: 109114 - DNA, 103 bp, Artificial Sequence
  Synthetic Polynucleotide
taatacgactcactatagggcggctgtggggatcccgggcgcggcccacaaacagaggagatgtgggatgcgcccgggaaacctggcggcagcgcaaaagatg

SEQ ID NO: 109115 - DNA, 103 bp, Artificial Sequence
  Synthetic Polynucleotide
taatacgactcactatagggggcggggcggcggctgtggggatcccgggcaacagaggagagcccggatgccccacagcaacctggcggcagcgcaaaagatg

SEQ ID NO: 109116 - DNA, 103 bp, Artificial Sequence
  Synthetic Polynucleotide
taatacgactcactataggggcccagggccggcggggcggcggctgtgggaacagaggagacccacaatggccgccccgaacctggcggcagcgcaaaagatg

SEQ ID NO: 109117 - DNA, 103 bp, Artificial Sequence
  Synthetic Polynucleotide
taatacgactcactatagggcaccctggaggcccagggccggcggggcggaacagaggagaccgcccatgcggccctggaacctggcggcagcgcaaaagatg

SEQ ID NO: 109118 - DNA, 103 bp, Artificial Sequence
  Synthetic Polynucleotide
taatacgactcactatagggcctcctgcagcaccctggaggcccagggccaacagaggagaggccctatgcctccagggaacctggcggcagcgcaaaagatg

SEQ ID NO: 109119 - DNA, 103 bp, Artificial Sequence
  Synthetic Polynucleotide
taatacgactcactatagggcagttggtcgcctcctgcagcaccctggagaacagaggagactccagatggctgcaggaaacctggcggcagcgcaaaagatg

SEQ ID NO: 109120 - DNA, 103 bp, Artificial Sequence
  Synthetic Polynucleotide
taatacgactcactatagggccccgcccgccagttggtcgcctcctgcagaacagaggagactgcagatggcgaccaacaacctggcggcagcgcaaaagatg

SEQ ID NO: 109121 - DNA, 103 bp, Artificial Sequence
  Synthetic Polynucleotide
taatacgactcactatagggcggccaggggccccgcccgccagttggtcgaacagaggagacgaccaatgggcgggcggaacctggcggcagcgcaaaagatg

SEQ ID NO: 109122 - DNA, 103 bp, Artificial Sequence
  Synthetic Polynucleotide
taatacgactcactatagggagctcccgggggctgtcaggcccctcggagaacagaggagactccgaatggcctgacagaacctggcggcagcgcaaaagatg

SEQ ID NO: 109123 - DNA, 103 bp, Artificial Sequence
  Synthetic Polynucleotide
taatacgactcactataggggctcggacctcggccaggggccccgcccgcaacagaggagagcgggcatggcccctggcaacctggcggcagcgcaaaagatg

SEQ ID NO: 109124 - DNA, 103 bp, Artificial Sequence
  Synthetic Polynucleotide
taatacgactcactatagggttgctcccgagctcggacctcggccaggggaacagaggagacccctgatggaggtccgaaacctggcggcagcgcaaaagatg

SEQ ID NO: 109125 - DNA, 103 bp, Artificial Sequence
  Synthetic Polynucleotide
taatacgactcactatagggtccttttctcttgctcccgagctcggacctaacagaggagaaggtccatgctcgggagcaacctggcggcagcgcaaaagatg

SEQ ID NO: 109126 - DNA, 103 bp, Artificial Sequence
  Synthetic Polynucleotide
taatacgactcactataggggacgccgctttccttttctcttgctcccgaaacagaggagatcgggaatgagagaaaagaacctggcggcagcgcaaaagatg

SEQ ID NO: 109127 - DNA, 103 bp, Artificial Sequence
  Synthetic Polynucleotide
taatacgactcactatagggccgctcctgcgacgccgctttccttttctcaacagaggagagagaaaatgaaagcggcgaacctggcggcagcgcaaaagatg

SEQ ID NO: 109128 - DNA, 103 bp, Artificial Sequence
  Synthetic Polynucleotide
taatacgactcactatagggccttggcctcccgctcctgcgacgccgcttaacagaggagaaagcggatgcgcaggagcaacctggcggcagcgcaaaagatg

SEQ ID NO: 109129 - DNA, 103 bp, Artificial Sequence
  Synthetic Polynucleotide
taatacgactcactatagggcgctcggtctccttggcctcccgctcctgcaacagaggagagcaggaatgggaggccaaaacctggcggcagcgcaaaagatg

SEQ ID NO: 109130 - DNA, 103 bp, Artificial Sequence
  Synthetic Polynucleotide
taatacgactcactataggggcgcctttttcgctcggtctccttggcctcaacagaggagagaggccatggagaccgagaacctggcggcagcgcaaaagatg

SEQ ID NO: 109131 - DNA, 103 bp, Artificial Sequence
  Synthetic Polynucleotide
taatacgactcactatagggcaccagccttgcgcctttttcgctcggtctaacagaggagaagaccgatggaaaaaggcaacctggcggcagcgcaaaagatg

SEQ ID NO: 109132 - DNA, 103 bp, Artificial Sequence
  Synthetic Polynucleotide
taatacgactcactatagggcgtcgggccccaccagccttgcgcctttttaacagaggagaaaaaagatgcaaggctggaacctggcggcagcgcaaaagatg

SEQ ID NO: 109133 - DNA, 103 bp, Artificial Sequence
  Synthetic Polynucleotide
taatacgactcactatagggctcatcctggagctcccgggggctgtcaggaacagaggagacctgacatgccccgggagaacctggcggcagcgcaaaagatg

SEQ ID NO: 109134 - DNA, 103 bp, Artificial Sequence
  Synthetic Polynucleotide
taatacgactcactatagggcggggggctccgtcgggccccaccagccttaacagaggagaaaggctatgggggcccgaaacctggcggcagcgcaaaagatg

SEQ ID NO: 109135 - DNA, 103 bp, Artificial Sequence
  Synthetic Polynucleotide
taatacgactcactatagggggggtcgacccggggggctccgtcgggcccaacagaggagagggcccatgggagcccccaacctggcggcagcgcaaaagatg

SEQ ID NO: 109136 - DNA, 103 bp, Artificial Sequence
  Synthetic Polynucleotide
taatacgactcactatagggggctccgggcggggtcgacccggggggctcaacagaggagagagcccatggggtcgaccaacctggcggcagcgcaaaagatg

SEQ ID NO: 109137 - DNA, 103 bp, Artificial Sequence
  Synthetic Polynucleotide
taatacgactcactatagggggcgttgcggggctccgggcggggtcgaccaacagaggagaggtcgaatgcgcccggagaacctggcggcagcgcaaaagatg

SEQ ID NO: 109138 - DNA, 103 bp, Artificial Sequence
  Synthetic Polynucleotide
taatacgactcactatagggccacccgaggggcgttgcggggctccgggcaacagaggagagcccggatgcccgcaacgaacctggcggcagcgcaaaagatg

SEQ ID NO: 109139 - DNA, 103 bp, Artificial Sequence
  Synthetic Polynucleotide
taatacgactcactataggggccagctgggccacccgaggggcgttgcggaacagaggagaccgcaaatgccctcgggtaacctggcggcagcgcaaaagatg

SEQ ID NO: 109140 - DNA, 103 bp, Artificial Sequence
  Synthetic Polynucleotide
taatacgactcactatagggagggagccctgccagctgggccacccgaggaacagaggagacctcggatggcccagctgaacctggcggcagcgcaaaagatg

SEQ ID NO: 109141 - DNA, 103 bp, Artificial Sequence
  Synthetic Polynucleotide
taatacgactcactataggggcaagggagcagggagccctgccagctgggaacagaggagacccagcatgcagggctccaacctggcggcagcgcaaaagatg

SEQ ID NO: 109142 - DNA, 103 bp, Artificial Sequence
  Synthetic Polynucleotide
taatacgactcactatagggcgctccggccgcaagggagcagggagccctaacagaggagaagggctatgtgctcccttaacctggcggcagcgcaaaagatg

SEQ ID NO: 109143 - DNA, 103 bp, Artificial Sequence
  Synthetic Polynucleotide
taatacgactcactatagggaggcgccaggcgctccggccgcaagggagcaacagaggagagctcccatgcggccggagaacctggcggcagcgcaaaagatg

SEQ ID NO: 109144 - DNA, 103 bp, Artificial Sequence
  Synthetic Polynucleotide
taatacgactcactatagggtgccagactcctcatcctggagctcccgggaacagaggagacccgggatgtccaggatgaacctggcggcagcgcaaaagatg

SEQ ID NO: 109145 - DNA, 103 bp, Artificial Sequence
  Synthetic Polynucleotide
taatacgactcactatagggctcgccccacaggcgccaggcgctccggccaacagaggagaggccggatggcctggcgcaacctggcggcagcgcaaaagatg

SEQ ID NO: 109146 - DNA, 103 bp, Artificial Sequence
  Synthetic Polynucleotide
taatacgactcactatagggggacggggcgctcgccccacaggcgccaggaacagaggagacctggcatgtgtggggcgaacctggcggcagcgcaaaagatg

SEQ ID NO: 109147 - DNA, 103 bp, Artificial Sequence
  Synthetic Polynucleotide
taatacgactcactatagggctgcgcggatggacggggcgctcgccccacaacagaggagagtggggatggcgccccgtaacctggcggcagcgcaaaagatg

SEQ ID NO: 109148 - DNA, 103 bp, Artificial Sequence
  Synthetic Polynucleotide
taatacgactcactatagggcgctctgcggctgcgcggatggacggggcgaacagaggagacgccccatgcatccgcgcaacctggcggcagcgcaaaagatg

SEQ ID NO: 109149 - DNA, 103 bp, Artificial Sequence
  Synthetic Polynucleotide
taatacgactcactataggggaccctgggtcgctctgcggctgcgcggataacagaggagaatccgcatggccgcagagaacctggcggcagcgcaaaagatg

SEQ ID NO: 109150 - DNA, 103 bp, Artificial Sequence
  Synthetic Polynucleotide
taatacgactcactatagggcgcccacgccgaccctgggtcgctctgcggaacagaggagaccgcagatggacccagggaacctggcggcagcgcaaaagatg

SEQ ID NO: 109151 - DNA, 103 bp, Artificial Sequence
  Synthetic Polynucleotide
taatacgactcactatagggcccagggccccgcccacgccgaccctgggtaacagaggagaacccagatgcggcgtgggaacctggcggcagcgcaaaagatg

SEQ ID NO: 109152 - DNA, 103 bp, Artificial Sequence
  Synthetic Polynucleotide
taatacgactcactatagggcgccgacctccccagggccccgcccacgccaacagaggagaggcgtgatgggggccctgaacctggcggcagcgcaaaagatg

SEQ ID NO: 109153 - DNA, 103 bp, Artificial Sequence
  Synthetic Polynucleotide
taatacgactcactataggggggcccgggccgccgacctccccagggcccaacagaggagagggcccatgggaggtcggaacctggcggcagcgcaaaagatg

SEQ ID NO: 109154 - DNA, 103 bp, Artificial Sequence
  Synthetic Polynucleotide
taatacgactcactatagggcgtagcttgggggcccgggccgccgacctcaacagaggagagaggtcatgggcccgggcaacctggcggcagcgcaaaagatg

SEQ ID NO: 109155 - DNA, 103 bp, Artificial Sequence
  Synthetic Polynucleotide
taatacgactcactatagggcagaggcagctgccagactcctcatcctggaacagaggagaccaggaatgggagtctggaacctggcggcagcgcaaaagatg

SEQ ID NO: 109156 - DNA, 103 bp, Artificial Sequence
  Synthetic Polynucleotide
taatacgactcactatagggaggtgagcctcgtagcttgggggcccgggcaacagaggagagcccggatgcccaagctaaacctggcggcagcgcaaaagatg

SEQ ID NO: 109157 - DNA, 103 bp, Artificial Sequence
  Synthetic Polynucleotide
taatacgactcactatagggtctcagcagcaggtgagcctcgtagcttggaacagaggagaccaagcatggaggctcacaacctggcggcagcgcaaaagatg

SEQ ID NO: 109158 - DNA, 103 bp, Artificial Sequence
  Synthetic Polynucleotide
taatacgactcactatagggcggcagaacctctcagcagcaggtgagcctaacagaggagaaggctcatgtgctgctgaaacctggcggcagcgcaaaagatg

SEQ ID NO: 109159 - DNA, 103 bp, Artificial Sequence
  Synthetic Polynucleotide
taatacgactcactatagggggggcggtcccggcagaacctctcagcagcaacagaggagagctgctatgaggttctgcaacctggcggcagcgcaaaagatg

SEQ ID NO: 109160 - DNA, 103 bp, Artificial Sequence
  Synthetic Polynucleotide
taatacgactcactataggggcggcgtcgtggggcggtcccggcagaaccaacagaggagaggttctatggggaccgccaacctggcggcagcgcaaaagatg

SEQ ID NO: 109161 - DNA, 103 bp, Artificial Sequence
  Synthetic Polynucleotide
taatacgactcactataggggccggtcccagcggcgtcgtggggcggtccaacagaggagaggaccgatgcacgacgccaacctggcggcagcgcaaaagatg

SEQ ID NO: 109162 - DNA, 103 bp, Artificial Sequence
  Synthetic Polynucleotide
taatacgactcactatagggtagggtggcggccggtcccagcggcgtcgtaacagaggagaacgacgatgctgggaccgaacctggcggcagcgcaaaagatg

SEQ ID NO: 109163 - DNA, 103 bp, Artificial Sequence
  Synthetic Polynucleotide
taatacgactcactatagggtggagccacgtagggtggcggccggtcccaaacagaggagatgggacatgccgccacccaacctggcggcagcgcaaaagatg

SEQ ID NO: 109164 - DNA, 103 bp, Artificial Sequence
  Synthetic Polynucleotide
taatacgactcactatagggcgtaagaaggtggagccacgtagggtggcgaacagaggagacgccacatgacgtggctcaacctggcggcagcgcaaaagatg

SEQ ID NO: 109165 - DNA, 103 bp, Artificial Sequence
  Synthetic Polynucleotide
taatacgactcactatagggtgggggccttcgtaagaaggtggagccacgaacagaggagacgtggcatgaccttcttaaacctggcggcagcgcaaaagatg

SEQ ID NO: 109166 - DNA, 103 bp, Artificial Sequence
  Synthetic Polynucleotide
taatacgactcactatagggcttctgcacccagaggcagctgccagactcaacagaggagagagtctatgagctgcctcaacctggcggcagcgcaaaagatg

SEQ ID NO: 109167 - DNA, 103 bp, Artificial Sequence
  Synthetic Polynucleotide
taatacgactcactatagggcaaggtcctatgggggccttcgtaagaaggaacagaggagaccttctatggaaggccccaacctggcggcagcgcaaaagatg

SEQ ID NO: 109168 - DNA, 103 bp, Artificial Sequence
  Synthetic Polynucleotide
taatacgactcactatagggtcttagtccccaaggtcctatgggggccttaacagaggagaaaggccatgataggacctaacctggcggcagcgcaaaagatg

SEQ ID NO: 109169 - DNA, 103 bp, Artificial Sequence
  Synthetic Polynucleotide
taatacgactcactatagggccggggcctctcttagtccccaaggtcctaaacagaggagataggacatgggggactaaaacctggcggcagcgcaaaagatg

SEQ ID NO: 109170 - DNA, 103 bp, Artificial Sequence
  Synthetic Polynucleotide
taatacgactcactatagggctgagagttcccggggcctctcttagtcccaacagaggagagggactatgagaggccccaacctggcggcagcgcaaaagatg

SEQ ID NO: 109171 - DNA, 103 bp, Artificial Sequence
  Synthetic Polynucleotide
taatacgactcactatagggaagtgggcacctgagagttcccggggcctcaacagaggagagaggccatgggaactctcaacctggcggcagcgcaaaagatg

SEQ ID NO: 109172 - DNA, 103 bp, Artificial Sequence
  Synthetic Polynucleotide
taatacgactcactatagggggggctgatgaagtgggcacctgagagttcaacagaggagagaactcatgggtgcccacaacctggcggcagcgcaaaagatg

SEQ ID NO: 109173 - DNA, 103 bp, Artificial Sequence
  Synthetic Polynucleotide
taatacgactcactatagggagtcgcagctggggctgatgaagtgggcacaacagaggagagtgcccatgtcatcagccaacctggcggcagcgcaaaagatg

SEQ ID NO: 109174 - DNA, 103 bp, Artificial Sequence
  Synthetic Polynucleotide
taatacgactcactatagggtcctggctggagtcgcagctggggctgatgaacagaggagacatcagatgcagctgcgaaacctggcggcagcgcaaaagatg

SEQ ID NO: 109175 - DNA, 103 bp, Artificial Sequence
  Synthetic Polynucleotide
taatacgactcactatagggcctccgtctgtcctggctggagtcgcagctaacagaggagaagctgcatgtccagccagaacctggcggcagcgcaaaagatg

SEQ ID NO: 109176 - DNA, 103 bp, Artificial Sequence
  Synthetic Polynucleotide
taatacgactcactatagggctttgtgcgccctccgtctgtcctggctggaacagaggagaccagccatgacagacggaaacctggcggcagcgcaaaagatg

SEQ ID NO: 109177 - DNA, 103 bp, Artificial Sequence
  Synthetic Polynucleotide
taatacgactcactatagggatagcttggacttctgcacccagaggcagcaacagaggagagctgccatggggtgcagaaacctggcggcagcgcaaaagatg

SEQ ID NO: 109178 - DNA, 103 bp, Artificial Sequence
  Synthetic Polynucleotide
taatacgactcactatagggccagcctcttctttgtgcgccctccgtctgaacagaggagacagacgatgggcgcacaaaacctggcggcagcgcaaaagatg

SEQ ID NO: 109179 - DNA, 103 bp, Artificial Sequence
  Synthetic Polynucleotide
taatacgactcactatagggatccgaggatccagcctcttctttgtgcgcaacagaggagagcgcacatggaagaggctaacctggcggcagcgcaaaagatg

SEQ ID NO: 109180 - DNA, 103 bp, Artificial Sequence
  Synthetic Polynucleotide
taatacgactcactataggggtcccggtagatccgaggatccagcctcttaacagaggagaaagaggatggatcctcggaacctggcggcagcgcaaaagatg

SEQ ID NO: 109181 - DNA, 103 bp, Artificial Sequence
  Synthetic Polynucleotide
taatacgactcactatagggccccgaggacgtcccggtagatccgaggataacagaggagaatcctcatgtctaccgggaacctggcggcagcgcaaaagatg

SEQ ID NO: 109182 - DNA, 103 bp, Artificial Sequence
  Synthetic Polynucleotide
taatacgactcactatagggagaccccaagccccgaggacgtcccggtagaacagaggagactaccgatgcgtcctcggaacctggcggcagcgcaaaagatg

SEQ ID NO: 109183 - DNA, 103 bp, Artificial Sequence
  Synthetic Polynucleotide
taatacgactcactatagggcccctgtcggagaccccaagccccgaggacaacagaggagagtcctcatggcttggggtaacctggcggcagcgcaaaagatg

SEQ ID NO: 109184 - DNA, 103 bp, Artificial Sequence
  Synthetic Polynucleotide
taatacgactcactatagggagagaccttgcccctgtcggagaccccaagaacagaggagacttgggatgtccgacaggaacctggcggcagcgcaaaagatg

SEQ ID NO: 109185 - DNA, 103 bp, Artificial Sequence
  Synthetic Polynucleotide
taatacgactcactataggggatccccccaagagaccttgcccctgtcggaacagaggagaccgacaatggcaaggtctaacctggcggcagcgcaaaagatg

SEQ ID NO: 109186 - DNA, 103 bp, Artificial Sequence
  Synthetic Polynucleotide
taatacgactcactatagggacagcctggggatccccccaagagaccttgaacagaggagacaaggtatgttggggggaaacctggcggcagcgcaaaagatg

SEQ ID NO: 109187 - DNA, 103 bp, Artificial Sequence
  Synthetic Polynucleotide
taatacgactcactatagggtggccgctccacagcctggggatccccccaaacagaggagatgggggatgccccaggctaacctggcggcagcgcaaaagatg

SEQ ID NO: 109188 - DNA, 103 bp, Artificial Sequence
  Synthetic Polynucleotide
taatacgactcactatagggtctatcaccaatagcttggacttctgcaccaacagaggagaggtgcaatggtccaagctaacctggcggcagcgcaaaagatg

SEQ ID NO: 109189 - DNA, 103 bp, Artificial Sequence
  Synthetic Polynucleotide
taatacgactcactatagggggccttgctctggccgctccacagcctgggaacagaggagacccaggatgtggagcggcaacctggcggcagcgcaaaagatg

SEQ ID NO: 109190 - DNA, 103 bp, Artificial Sequence
  Synthetic Polynucleotide
taatacgactcactataggggccgggctctggccttgctctggccgctccaacagaggagaggagcgatgagagcaaggaacctggcggcagcgcaaaagatg

SEQ ID NO: 109191 - DNA, 103 bp, Artificial Sequence
  Synthetic Polynucleotide
taatacgactcactatagggcgacccccttgccgggctctggccttgctcaacagaggagagagcaaatgcagagcccgaacctggcggcagcgcaaaagatg

SEQ ID NO: 109192 - DNA, 103 bp, Artificial Sequence
  Synthetic Polynucleotide
taatacgactcactatagggcttttctccacgacccccttgccgggctctaacagaggagaagagccatgcaagggggtaacctggcggcagcgcaaaagatg

SEQ ID NO: 109193 - DNA, 103 bp, Artificial Sequence
  Synthetic Polynucleotide
taatacgactcactatagggcagccccaggcttttctccacgacccccttaacagaggagaaaggggatggtggagaaaaacctggcggcagcgcaaaagatg

SEQ ID NO: 109194 - DNA, 103 bp, Artificial Sequence
  Synthetic Polynucleotide
taatacgactcactatagggcagcagcagccagccccaggcttttctccaaacagaggagatggagaatggcctggggcaacctggcggcagcgcaaaagatg

SEQ ID NO: 109195 - DNA, 103 bp, Artificial Sequence
  Synthetic Polynucleotide
taatacgactcactatagggctgttcaggtcagcagcagccagccccaggaacagaggagacctgggatgggctgctgcaacctggcggcagcgcaaaagatg

SEQ ID NO: 109196 - DNA, 103 bp, Artificial Sequence
  Synthetic Polynucleotide
taatacgactcactataggggtcgctaccactgttcaggtcagcagcagcaacagaggagagctgctatggacctgaacaacctggcggcagcgcaaaagatg

SEQ ID NO: 109197 - DNA, 103 bp, Artificial Sequence
  Synthetic Polynucleotide
taatacgactcactatagggggggatggctgtcgctaccactgttcaggtaacagaggagaacctgaatggtggtagcgaacctggcggcagcgcaaaagatg

SEQ ID NO: 109198 - DNA, 103 bp, Artificial Sequence
  Synthetic Polynucleotide
taatacgactcactataggggctttggcttggggatggctgtcgctaccaaacagaggagatggtagatgcagccatccaacctggcggcagcgcaaaagatg

SEQ ID NO: 109199 - DNA, 103 bp, Artificial Sequence
  Synthetic Polynucleotide
taatacgactcactatagggctgctttgccgccgagtccgagtcctccataacagaggagaatggagatgtcggactcgaacctggcggcagcgcaaaagatg

SEQ ID NO: 109200 - DNA, 103 bp, Artificial Sequence
  Synthetic Polynucleotide
taatacgactcactatagggcggctcctccgcctcgcctcctgccgcggcaacagaggagagccgcgatgggaggcgagaacctggcggcagcgcaaaagatg

SEQ ID NO: 109201 - DNA, 103 bp, Artificial Sequence
  Synthetic Polynucleotide
taatacgactcactatagggctgtcccgagggggtcacggtgaaggtggtaacagaggagaaccaccatgaccgtgaccaacctggcggcagcgcaaaagatg

SEQ ID NO: 109202 - DNA, 103 bp, Artificial Sequence
  Synthetic Polynucleotide
taatacgactcactatagggaggtcgtgatctgtcccgagggggtcacggaacagaggagaccgtgaatgcctcgggacaacctggcggcagcgcaaaagatg

SEQ ID NO: 109203 - DNA, 103 bp, Artificial Sequence
  Synthetic Polynucleotide
taatacgactcactatagggagtgcccccgaggtcgtgatctgtcccgagaacagaggagactcgggatggatcacgacaacctggcggcagcgcaaaagatg

SEQ ID NO: 109204 - DNA, 103 bp, Artificial Sequence
  Synthetic Polynucleotide
taatacgactcactataggggtcaaaggtcagtgcccccgaggtcgtgataacagaggagaatcacgatgtcgggggcaaacctggcggcagcgcaaaagatg

SEQ ID NO: 109205 - DNA, 103 bp, Artificial Sequence
  Synthetic Polynucleotide
taatacgactcactatagggtggacgctcggtcaaaggtcagtgcccccgaacagaggagacgggggatgtgacctttgaacctggcggcagcgcaaaagatg

SEQ ID NO: 109206 - DNA, 103 bp, Artificial Sequence
  Synthetic Polynucleotide
taatacgactcactataggggcctctaccgtggacgctcggtcaaaggtcaacagaggagagaccttatgccgagcgtcaacctggcggcagcgcaaaagatg

SEQ ID NO: 109207 - DNA, 103 bp, Artificial Sequence
  Synthetic Polynucleotide
taatacgactcactataggggacagcagtggcctctaccgtggacgctcgaacagaggagacgagcgatgacggtagagaacctggcggcagcgcaaaagatg

SEQ ID NO: 109208 - DNA, 103 bp, Artificial Sequence
  Synthetic Polynucleotide
taatacgactcactatagggtctctgatatgacagcagtggcctctaccgaacagaggagacggtagatgccactgctgaacctggcggcagcgcaaaagatg

SEQ ID NO: 109209 - DNA, 103 bp, Artificial Sequence
  Synthetic Polynucleotide
taatacgactcactatagggtgggccggactctctgatatgacagcagtgaacagaggagacactgcatgcatatcagaaacctggcggcagcgcaaaagatg

SEQ ID NO: 109210 - DNA, 103 bp, Artificial Sequence
  Synthetic Polynucleotide
taatacgactcactataggggacgtcgccctgggccggactctctgatataacagaggagaatatcaatgagtccggccaacctggcggcagcgcaaaagatg

SEQ ID NO: 109211 - DNA, 103 bp, Artificial Sequence
  Synthetic Polynucleotide
taatacgactcactatagggtgctcagcaccggctcctccgcctcgcctcaacagaggagagaggcgatgcggaggagcaacctggcggcagcgcaaaagatg

SEQ ID NO: 109212 - DNA, 103 bp, Artificial Sequence
  Synthetic Polynucleotide
taatacgactcactatagggcccctgcgaagacgtcgccctgggccggacaacagaggagagtccggatgagggcgacgaacctggcggcagcgcaaaagatg

SEQ ID NO: 109213 - DNA, 103 bp, Artificial Sequence
  Synthetic Polynucleotide
taatacgactcactatagggtggactgtggcccctgcgaagacgtcgcccaacagaggagagggcgaatgcttcgcaggaacctggcggcagcgcaaaagatg

SEQ ID NO: 109214 - DNA, 103 bp, Artificial Sequence
  Synthetic Polynucleotide
taatacgactcactataggggctggcctcttggactgtggcccctgcgaaaacagaggagattcgcaatggccacagtcaacctggcggcagcgcaaaagatg

SEQ ID NO: 109215 - DNA, 103 bp, Artificial Sequence
  Synthetic Polynucleotide
taatacgactcactatagggggggctgcacgctggcctcttggactgtggaacagaggagaccacagatgaagaggccaaacctggcggcagcgcaaaagatg

SEQ ID NO: 109216 - DNA, 103 bp, Artificial Sequence
  Synthetic Polynucleotide
taatacgactcactataggggccctgcatgggggctgcacgctggcctctaacagaggagaagaggcatgcgtgcagccaacctggcggcagcgcaaaagatg

SEQ ID NO: 109217 - DNA, 103 bp, Artificial Sequence
  Synthetic Polynucleotide
taatacgactcactatagggagggtggctggccctgcatgggggctgcacaacagaggagagtgcagatgccatgcaggaacctggcggcagcgcaaaagatg

SEQ ID NO: 109218 - DNA, 103 bp, Artificial Sequence
  Synthetic Polynucleotide
taatacgactcactatagggagtgaggctcagggtggctggccctgcatgaacagaggagacatgcaatgccagccaccaacctggcggcagcgcaaaagatg

SEQ ID NO: 109219 - DNA, 103 bp, Artificial Sequence
  Synthetic Polynucleotide
taatacgactcactatagggtagccggggtagtgaggctcagggtggctgaacagaggagacagccaatgtgagcctcaaacctggcggcagcgcaaaagatg

SEQ ID NO: 109220 - DNA, 103 bp, Artificial Sequence
  Synthetic Polynucleotide
taatacgactcactataggggctgtcctgatagccggggtagtgaggctcaacagaggagagagcctatgtaccccggcaacctggcggcagcgcaaaagatg

SEQ ID NO: 109221 - DNA, 103 bp, Artificial Sequence
  Synthetic Polynucleotide
taatacgactcactatagggcgatctggcagctgtcctgatagccggggtaacagaggagaaccccgatgatcaggacaaacctggcggcagcgcaaaagatg

SEQ ID NO: 109222 - DNA, 103 bp, Artificial Sequence
  Synthetic Polynucleotide
taatacgactcactatagggtcctcgtccctgctcagcaccggctcctccaacagaggagaggaggaatgggtgctgagaacctggcggcagcgcaaaagatg

SEQ ID NO: 109223 - DNA, 103 bp, Artificial Sequence
  Synthetic Polynucleotide
taatacgactcactatagggggaaacggtgcgatctggcagctgtcctgaaacagaggagatcaggaatgctgccagataacctggcggcagcgcaaaagatg

SEQ ID NO: 109224 - DNA, 103 bp, Artificial Sequence
  Synthetic Polynucleotide
taatacgactcactatagggcgcagcttctggaaacggtgcgatctggcaaacagaggagatgccagatggcaccgtttaacctggcggcagcgcaaaagatg

SEQ ID NO: 109225 - DNA, 103 bp, Artificial Sequence
  Synthetic Polynucleotide
taatacgactcactatagggacgttggcaacgcagcttctggaaacggtgaacagaggagacaccgtatgcagaagctgaacctggcggcagcgcaaaagatg

SEQ ID NO: 109226 - DNA, 103 bp, Artificial Sequence
  Synthetic Polynucleotide
taatacgactcactatagggttgggatgtgacgttggcaacgcagcttctaacagaggagaagaagcatggttgccaacaacctggcggcagcgcaaaagatg

SEQ ID NO: 109227 - DNA, 103 bp, Artificial Sequence
  Synthetic Polynucleotide
taatacgactcactatagggcaacactattttgggatgtgacgttggcaaaacagaggagattgccaatgtcacatcccaacctggcggcagcgcaaaagatg

SEQ ID NO: 109228 - DNA, 103 bp, Artificial Sequence
  Synthetic Polynucleotide
taatacgactcactataggggcagggatgtcaacactattttgggatgtgaacagaggagacacatcatgaaatagtgtaacctggcggcagcgcaaaagatg

SEQ ID NO: 109229 - DNA, 103 bp, Artificial Sequence
  Synthetic Polynucleotide
taatacgactcactataggggccagcgcaggcagggatgtcaacactattaacagaggagaaatagtatggacatccctaacctggcggcagcgcaaaagatg

SEQ ID NO: 109230 - DNA, 103 bp, Artificial Sequence
  Synthetic Polynucleotide
taatacgactcactataggggggtgggaccgccagcgcaggcagggatgtaacagaggagaacatccatgcctgcgctgaacctggcggcagcgcaaaagatg

SEQ ID NO: 109231 - DNA, 103 bp, Artificial Sequence
  Synthetic Polynucleotide
taatacgactcactatagggtgggagtcgggggtgggaccgccagcgcagaacagaggagactgcgcatgcggtcccacaacctggcggcagcgcaaaagatg

SEQ ID NO: 109232 - DNA, 103 bp, Artificial Sequence
  Synthetic Polynucleotide
taatacgactcactataggggccgctttggtgggagtcgggggtgggaccaacagaggagaggtcccatgcccgactccaacctggcggcagcgcaaaagatg

SEQ ID NO: 109233 - DNA, 103 bp, Artificial Sequence
  Synthetic Polynucleotide
taatacgactcactatagggctcctccgagtcctcgtccctgctcagcacaacagaggagagtgctgatgagggacgagaacctggcggcagcgcaaaagatg

SEQ ID NO: 109234 - DNA, 103 bp, Artificial Sequence
  Synthetic Polynucleotide
taatacgactcactatagggcgcgggaggtgccgctttggtgggagtcggaacagaggagaccgactatgaccaaagcgaacctggcggcagcgcaaaagatg

SEQ ID NO: 109235 - DNA, 103 bp, Artificial Sequence
  Synthetic Polynucleotide
taatacgactcactatagggcattgaccaacgcgggaggtgccgctttggaacagaggagaccaaagatgcacctcccgaacctggcggcagcgcaaaagatg

SEQ ID NO: 109236 - DNA, 103 bp, Artificial Sequence
  Synthetic Polynucleotide
taatacgactcactatagggagctccagcccattgaccaacgcgggaggtaacagaggagaacctccatggttggtcaaaacctggcggcagcgcaaaagatg

SEQ ID NO: 109237 - DNA, 103 bp, Artificial Sequence
  Synthetic Polynucleotide
taatacgactcactatagggcggctctgacagctccagcccattgaccaaaacagaggagattggtcatggggctggagaacctggcggcagcgcaaaagatg

SEQ ID NO: 109238 - DNA, 103 bp, Artificial Sequence
  Synthetic Polynucleotide
taatacgactcactataggggccagctccgcggctctgacagctccagccaacagaggagaggctggatgtgtcagagcaacctggcggcagcgcaaaagatg

SEQ ID NO: 109239 - DNA, 103 bp, Artificial Sequence
  Synthetic Polynucleotide
taatacgactcactatagggtctaggtacagccagctccgcggctctgacaacagaggagagtcagaatggcggagctgaacctggcggcagcgcaaaagatg

SEQ ID NO: 109240 - DNA, 103 bp, Artificial Sequence
  Synthetic Polynucleotide
taatacgactcactataggggaccatctcttctaggtacagccagctccgaacagaggagacggagcatgctgtacctaaacctggcggcagcgcaaaagatg

SEQ ID NO: 109241 - DNA, 103 bp, Artificial Sequence
  Synthetic Polynucleotide
taatacgactcactataggggcaaggagttgaccatctcttctaggtacaaacagaggagatgtaccatgaagagatggaacctggcggcagcgcaaaagatg

SEQ ID NO: 109242 - DNA, 103 bp, Artificial Sequence
  Synthetic Polynucleotide
taatacgactcactataggggctgtgttgagcaaggagttgaccatctctaacagaggagaagagatatgcaactccttaacctggcggcagcgcaaaagatg

SEQ ID NO: 109243 - DNA, 103 bp, Artificial Sequence
  Synthetic Polynucleotide
taatacgactcactatagggcagctgctgcgctgtgttgagcaaggagttaacagaggagaaactccatgctcaacacaaacctggcggcagcgcaaaagatg

SEQ ID NO: 109244 - DNA, 103 bp, Artificial Sequence
  Synthetic Polynucleotide
taatacgactcactatagggagtctgcgtcctcctccgagtcctcgtcccaacagaggagagggacgatgactcggaggaacctggcggcagcgcaaaagatg

SEQ ID NO: 109245 - DNA, 103 bp, Artificial Sequence
  Synthetic Polynucleotide
taatacgactcactatagggacagcgtcttcagctgctgcgctgtgttgaaacagaggagatcaacaatgcgcagcagcaacctggcggcagcgcaaaagatg

SEQ ID NO: 109246 - DNA, 103 bp, Artificial Sequence
  Synthetic Polynucleotide
taatacgactcactataggggcttgctcaaacagcgtcttcagctgctgcaacagaggagagcagcaatggaagacgctaacctggcggcagcgcaaaagatg

SEQ ID NO: 109247 - DNA, 103 bp, Artificial Sequence
  Synthetic Polynucleotide
taatacgactcactatagggggcatgcttggcttgctcaaacagcgtcttaacagaggagaaagacgatgtttgagcaaaacctggcggcagcgcaaaagatg

SEQ ID NO: 109248 - DNA, 103 bp, Artificial Sequence
  Synthetic Polynucleotide
taatacgactcactatagggggtaggtgctggcatgcttggcttgctcaaaacagaggagattgagcatgccaagcatgaacctggcggcagcgcaaaagatg

SEQ ID NO: 109249 - DNA, 103 bp, Artificial Sequence
  Synthetic Polynucleotide
taatacgactcactataggggcagcttctcggtaggtgctggcatgcttgaacagaggagacaagcaatgcagcacctaaacctggcggcagcgcaaaagatg

SEQ ID NO: 109250 - DNA, 103 bp, Artificial Sequence
  Synthetic Polynucleotide
taatacgactcactatagggctggtttgtggcagcttctcggtaggtgctaacagaggagaagcaccatgcgagaagctaacctggcggcagcgcaaaagatg

SEQ ID NO: 109251 - DNA, 103 bp, Artificial Sequence
  Synthetic Polynucleotide
taatacgactcactatagggggatcttggcctggtttgtggcagcttctcaacagaggagagagaagatgccacaaaccaacctggcggcagcgcaaaagatg

SEQ ID NO: 109252 - DNA, 103 bp, Artificial Sequence
  Synthetic Polynucleotide
taatacgactcactataggggcgtcagcgtggatcttggcctggtttgtgaacagaggagacacaaaatgggccaagataacctggcggcagcgcaaaagatg

SEQ ID NO: 109253 - DNA, 103 bp, Artificial Sequence
  Synthetic Polynucleotide
taatacgactcactatagggcttccgctctgcgtcagcgtggatcttggcaacagaggagagccaagatgcacgctgacaacctggcggcagcgcaaaagatg

SEQ ID NO: 109254 - DNA, 103 bp, Artificial Sequence
  Synthetic Polynucleotide
taatacgactcactatagggaggactgctccttccgctctgcgtcagcgtaacagaggagaacgctgatgcagagcggaaacctggcggcagcgcaaaagatg

SEQ ID NO: 109255 - DNA, 103 bp, Artificial Sequence
  Synthetic Polynucleotide
taatacgactcactatagggtccgcctccgagtctgcgtcctcctccgagaacagaggagactcggaatgggacgcagaaacctggcggcagcgcaaaagatg

SEQ ID NO: 109256 - DNA, 103 bp, Artificial Sequence
  Synthetic Polynucleotide
taatacgactcactatagggcagttaacgcaggactgctccttccgctctaacagaggagaagagcgatgggagcagtcaacctggcggcagcgcaaaagatg

SEQ ID NO: 109257 - DNA, 103 bp, Artificial Sequence
  Synthetic Polynucleotide
taatacgactcactatagggctcccggccgcagttaacgcaggactgctcaacagaggagagagcagatgtgcgttaacaacctggcggcagcgcaaaagatg

SEQ ID NO: 109258 - DNA, 103 bp, Artificial Sequence
  Synthetic Polynucleotide
taatacgactcactatagggcgctcatagcctcccggccgcagttaacgcaacagaggagagcgttaatggcggccgggaacctggcggcagcgcaaaagatg

SEQ ID NO: 109259 - DNA, 103 bp, Artificial Sequence
  Synthetic Polynucleotide
taatacgactcactatagggccggtgcactcgctcatagcctcccggccgaacagaggagacggccgatgggctatgagaacctggcggcagcgcaaaagatg

SEQ ID NO: 109260 - DNA, 103 bp, Artificial Sequence
  Synthetic Polynucleotide
taatacgactcactatagggcttgtggcagccggtgcactcgctcatagcaacagaggagagctatgatggagtgcaccaacctggcggcagcgcaaaagatg

SEQ ID NO: 109261 - DNA, 103 bp, Artificial Sequence
  Synthetic Polynucleotide
taatacgactcactatagggagtagttgaccttgtggcagccggtgcactaacagaggagaagtgcaatggctgccacaaacctggcggcagcgcaaaagatg

SEQ ID NO: 109262 - DNA, 103 bp, Artificial Sequence
  Synthetic Polynucleotide
taatacgactcactatagggaaggtggagcagtagttgaccttgtggcagaacagaggagactgccaatgggtcaactaaacctggcggcagcgcaaaagatg

SEQ ID NO: 109263 - DNA, 103 bp, Artificial Sequence
  Synthetic Polynucleotide
taatacgactcactataggggcgttggcagaaggtggagcagtagttgacaacagaggagagtcaacatgtgctccaccaacctggcggcagcgcaaaagatg

SEQ ID NO: 109264 - DNA, 103 bp, Artificial Sequence
  Synthetic Polynucleotide
taatacgactcactatagggtccagtccttgcgttggcagaaggtggagcaacagaggagagctccaatgtctgccaacaacctggcggcagcgcaaaagatg

SEQ ID NO: 109265 - DNA, 103 bp, Artificial Sequence
  Synthetic Polynucleotide
taatacgactcactatagggtggtgatccttccagtccttgcgttggcagaacagaggagactgccaatgcaaggactgaacctggcggcagcgcaaaagatg

SEQ ID NO: 109266 - DNA, 103 bp, Artificial Sequence
  Synthetic Polynucleotide
taatacgactcactatagggcgtctcccgctccgcctccgagtctgcgtcaacagaggagagacgcaatgtcggaggcgaacctggcggcagcgcaaaagatg

SEQ ID NO: 109267 - DNA, 103 bp, Artificial Sequence
  Synthetic Polynucleotide
taatacgactcactataggggcatatgtgctggtgatccttccagtccttaacagaggagaaaggacatgaaggatcacaacctggcggcagcgcaaaagatg

SEQ ID NO: 109268 - DNA, 103 bp, Artificial Sequence
  Synthetic Polynucleotide
taatacgactcactatagggctgactggccgcatatgtgctggtgatcctaacagaggagaaggatcatgagcacatataacctggcggcagcgcaaaagatg

SEQ ID NO: 109269 - DNA, 103 bp, Artificial Sequence
  Synthetic Polynucleotide
taatacgactcactataggggtgacagctgctgactggccgcatatgtgcaacagaggagagcacatatgcggccagtcaacctggcggcagcgcaaaagatg

SEQ ID NO: 109270 - DNA, 103 bp, Artificial Sequence
  Synthetic Polynucleotide
taatacgactcactatagggtgcctggacggtgacagctgctgactggccaacagaggagaggccagatggcagctgtcaacctggcggcagcgcaaaagatg

SEQ ID NO: 109271 - DNA, 103 bp, Artificial Sequence
  Synthetic Polynucleotide
taatacgactcactatagggggacttcgtctgcctggacggtgacagctgaacagaggagacagctgatgccgtccaggaacctggcggcagcgcaaaagatg

SEQ ID NO: 109272 - DNA, 103 bp, Artificial Sequence
  Synthetic Polynucleotide
taatacgactcactatagggtcagccacgtggacttcgtctgcctggacgaacagaggagacgtccaatgagacgaagtaacctggcggcagcgcaaaagatg

SEQ ID NO: 109273 - DNA, 103 bp, Artificial Sequence
  Synthetic Polynucleotide
taatacgactcactatagggcatcacgctttcagccacgtggacttcgtcaacagaggagagacgaaatgcacgtggctaacctggcggcagcgcaaaagatg

SEQ ID NO: 109274 - DNA, 103 bp, Artificial Sequence
  Synthetic Polynucleotide
taatacgactcactatagggtcaccttctccatcacgctttcagccacgtaacagaggagaacgtggatgaaagcgtgaaacctggcggcagcgcaaaagatg

SEQ ID NO: 109275 - DNA, 103 bp, Artificial Sequence
  Synthetic Polynucleotide
taatacgactcactatagggtgacccgcggcgtctcccgctccgcctccgaacagaggagacggaggatgagcgggagaaacctggcggcagcgcaaaagatg

SEQ ID NO: 109276 - DNA, 103 bp, Artificial Sequence
  Synthetic Polynucleotide
taatacgactcactataggggccactgccgtgacccgcggcgtctcccgcaacagaggagagcgggaatggccgcgggtaacctggcggcagcgcaaaagatg

SEQ ID NO: 109277 - DNA, 103 bp, Artificial Sequence
  Synthetic Polynucleotide
taatacgactcactatagggcgccatcaccgccactgccgtgacccgcggaacagaggagaccgcggatgacggcagtgaacctggcggcagcgcaaaagatg

SEQ ID NO: 109278 - DNA, 103 bp, Artificial Sequence
  Synthetic Polynucleotide
taatacgactcactatagggccaggcccagctgctttgccgccgagtccgaacagaggagacggactatgcggcaaagcaacctggcggcagcgcaaaagatg

SEQ ID NO: 109279 - DNA, 103 bp, Artificial Sequence
  Synthetic Polynucleotide
taatacgactcactatagggcgggctccgccgccatcaccgccactgccgaacagaggagacggcagatgcggtgatggaacctggcggcagcgcaaaagatg

SEQ ID NO: 109280 - DNA, 103 bp, Artificial Sequence
  Synthetic Polynucleotide
taatacgactcactatagggtccatgtgcccgggctccgccgccatcaccaacagaggagaggtgatatgggcggagccaacctggcggcagcgcaaaagatg

SEQ ID NO: 109281 - DNA, 103 bp, Artificial Sequence
  Synthetic Polynucleotide
taatacgactcactatagggggcgcccatgtccatgtgcccgggctccgcaacagaggagagcggagatggggcacatgaacctggcggcagcgcaaaagatg

SEQ ID NO: 109282 - DNA, 103 bp, Artificial Sequence
  Synthetic Polynucleotide
taatacgactcactataggggcagggcctcggcgcccatgtccatgtgccaacagaggagaggcacaatgacatgggcgaacctggcggcagcgcaaaagatg

SEQ ID NO: 109283 - DNA, 103 bp, Artificial Sequence
  Synthetic Polynucleotide
taatacgactcactatagggtcggggccgggcagggcctcggcgcccatgaacagaggagacatgggatgcgaggccctaacctggcggcagcgcaaaagatg

SEQ ID NO: 109284 - DNA, 103 bp, Artificial Sequence
  Synthetic Polynucleotide
taatacgactcactatagggggcggcctcgtcggggccgggcagggcctcaacagaggagagaggccatgcccggccccaacctggcggcagcgcaaaagatg

SEQ ID NO: 109285 - DNA, 103 bp, Artificial Sequence
  Synthetic Polynucleotide
taatacgactcactatagggctgcggcagcggcggcctcgtcggggccggaacagaggagaccggccatgacgaggccgaacctggcggcagcgcaaaagatg

SEQ ID NO: 109286 - DNA, 103 bp, Artificial Sequence
  Synthetic Polynucleotide
taatacgactcactatagggtctgcgaaggctgcggcagcggcggcctcgaacagaggagacgaggcatgcgctgccgcaacctggcggcagcgcaaaagatg

SEQ ID NO: 109287 - DNA, 103 bp, Artificial Sequence
  Synthetic Polynucleotide
taatacgactcactatagggtgtggtcacctctgcgaaggctgcggcagcaacagaggagagctgccatggccttcgcaaacctggcggcagcgcaaaagatg

SEQ ID NO: 109288 - DNA, 103 bp, Artificial Sequence
  Synthetic Polynucleotide
taatacgactcactatagggccactgtcactgtggtcacctctgcgaaggaacagaggagaccttcgatgaggtgaccaaacctggcggcagcgcaaaagatg

SEQ ID NO: 109289 - DNA, 103 bp, Artificial Sequence
  Synthetic Polynucleotide
taatacgactcactataggggccgcctcagccaggcccagctgctttgccaacagaggagaggcaaaatggctgggcctaacctggcggcagcgcaaaagatg

SEQ ID NO: 109290 - DNA, 103 bp, Artificial Sequence
  Synthetic Polynucleotide
taatacgactcactatagggcccacgttggccactgtcactgtggtcaccaacagaggagaggtgacatgagtgacagtaacctggcggcagcgcaaaagatg

SEQ ID NO: 109291 - DNA, 103 bp, Artificial Sequence
  Synthetic Polynucleotide
taatacgactcactatagggtgcagcagcccccacgttggccactgtcacaacagaggagagtgacaatggccaacgtgaacctggcggcagcgcaaaagatg

SEQ ID NO: 109292 - DNA, 103 bp, Artificial Sequence
  Synthetic Polynucleotide
taatacgactcactatagggagacattgtctgcagcagcccccacgttggaacagaggagaccaacgatggggctgctgaacctggcggcagcgcaaaagatg

SEQ ID NO: 109293 - DNA, 103 bp, Artificial Sequence
  Synthetic Polynucleotide
taatacgactcactataggggacgtggtgaagacattgtctgcagcagccaacagaggagaggctgcatgagacaatgtaacctggcggcagcgcaaaagatg

SEQ ID NO: 109294 - DNA, 103 bp, Artificial Sequence
  Synthetic Polynucleotide
taatacgactcactataggggttcgccacagacgtggtgaagacattgtcaacagaggagagacaatatgttcaccacgaacctggcggcagcgcaaaagatg

SEQ ID NO: 109295 - DNA, 103 bp, Artificial Sequence
  Synthetic Polynucleotide
taatacgactcactatagggtggatgccgcgttcgccacagacgtggtgaaacagaggagatcaccaatgctgtggcgaaacctggcggcagcgcaaaagatg

SEQ ID NO: 109296 - DNA, 103 bp, Artificial Sequence
  Synthetic Polynucleotide
taatacgactcactatagggtgtcctgagatggatgccgcgttcgccacaaacagaggagatgtggcatgcgcggcatcaacctggcggcagcgcaaaagatg

SEQ ID NO: 109297 - DNA, 103 bp, Artificial Sequence
  Synthetic Polynucleotide
taatacgactcactatagggagacagaacatgtcctgagatggatgccgcaacagaggagagcggcaatgatctcaggaaacctggcggcagcgcaaaagatg

SEQ ID NO: 109298 - DNA, 103 bp, Artificial Sequence
  Synthetic Polynucleotide
taatacgactcactatagggccgtcctaccagacagaacatgtcctgagaaacagaggagatctcagatgatgttctgtaacctggcggcagcgcaaaagatg

SEQ ID NO: 109299 - DNA, 103 bp, Artificial Sequence
  Synthetic Polynucleotide
taatacgactcactatagggatctgaagggccgtcctaccagacagaacaaacagaggagatgttctatgtggtaggacaacctggcggcagcgcaaaagatg

SEQ ID NO: 109300 - DNA, 103 bp, Artificial Sequence
  Synthetic Polynucleotide
taatacgactcactatagggcgccaccgccgccgcctcagccaggcccagaacagaggagactgggcatggctgaggcgaacctggcggcagcgcaaaagatg

SEQ ID NO: 109301 - DNA, 103 bp, Artificial Sequence
  Synthetic Polynucleotide
taatacgactcactataggggctgtccccgatctgaagggccgtcctaccaacagaggagaggtaggatggcccttcagaacctggcggcagcgcaaaagatg

SEQ ID NO: 109302 - DNA, 103 bp, Artificial Sequence
  Synthetic Polynucleotide
taatacgactcactatagggcggtgttcaggctgtccccgatctgaagggaacagaggagacccttcatgtcggggacaaacctggcggcagcgcaaaagatg

SEQ ID NO: 109303 - DNA, 103 bp, Artificial Sequence
  Synthetic Polynucleotide
taatacgactcactataggggtcgctttttcggtgttcaggctgtccccgaacagaggagacggggaatgcctgaacacaacctggcggcagcgcaaaagatg

SEQ ID NO: 109304 - DNA, 103 bp, Artificial Sequence
  Synthetic Polynucleotide
taatacgactcactataggggacaatcagtgtcgctttttcggtgttcagaacagaggagactgaacatggaaaaagcgaacctggcggcagcgcaaaagatg

SEQ ID NO: 109305 - DNA, 103 bp, Artificial Sequence
  Synthetic Polynucleotide
taatacgactcactatagggctgtgtggacgacaatcagtgtcgctttttaacagaggagaaaaaagatgcactgattgaacctggcggcagcgcaaaagatg

SEQ ID NO: 109306 - DNA, 103 bp, Artificial Sequence
  Synthetic Polynucleotide
taatacgactcactatagggatgctcccatctgtgtggacgacaatcagtaacagaggagaactgatatgcgtccacacaacctggcggcagcgcaaaagatg

SEQ ID NO: 109307 - DNA, 103 bp, Artificial Sequence
  Synthetic Polynucleotide
taatacgactcactatagggggtctccacgatgctcccatctgtgtggacaacagaggagagtccacatggatgggagcaacctggcggcagcgcaaaagatg

SEQ ID NO: 109308 - DNA, 103 bp, Artificial Sequence
  Synthetic Polynucleotide
taatacgactcactatagggtcagcccggtggtctccacgatgctcccataacagaggagaatgggaatgtcgtggagaaacctggcggcagcgcaaaagatg

SEQ ID NO: 109309 - DNA, 103 bp, Artificial Sequence
  Synthetic Polynucleotide
taatacgactcactataggggccgggcctttcagcccggtggtctccacgaacagaggagacgtggaatgcaccgggctaacctggcggcagcgcaaaagatg

SEQ ID NO: 109310 - DNA, 103 bp, Artificial Sequence
  Synthetic Polynucleotide
taatacgactcactataggggaggggagctgccgggcctttcagcccggtaacagaggagaaccgggatgaaaggcccgaacctggcggcagcgcaaaagatg

SEQ ID NO: 109311 - DNA, 103 bp, Artificial Sequence
  Synthetic Polynucleotide
taatacgactcactatagggcggccgcggccgccaccgccgccgcctcagaacagaggagactgaggatgcggcggtggaacctggcggcagcgcaaaagatg

SEQ ID NO: 109312 - DNA, 103 bp, Artificial Sequence
  Synthetic Polynucleotide
taatacgactcactataggggacctggggtgaggggagctgccgggccttaacagaggagaaaggccatgcagctccccaacctggcggcagcgcaaaagatg

SEQ ID NO: 109313 - DNA, 103 bp, Artificial Sequence
  Synthetic Polynucleotide
taatacgactcactatagggggagactgaggacctggggtgaggggagctaacagaggagaagctccatgcaccccaggaacctggcggcagcgcaaaagatg

SEQ ID NO: 109314 - DNA, 103 bp, Artificial Sequence
  Synthetic Polynucleotide
taatacgactcactatagggaggggttggaggagactgaggacctggggtaacagaggagaaccccaatgcctcagtctaacctggcggcagcgcaaaagatg

SEQ ID NO: 109315 - DNA, 103 bp, Artificial Sequence
  Synthetic Polynucleotide
taatacgactcactatagggcgggagccagaggggttggaggagactgagaacagaggagactcagtatgctccaacccaacctggcggcagcgcaaaagatg

SEQ ID NO: 109316 - DNA, 103 bp, Artificial Sequence
  Synthetic Polynucleotide
taatacgactcactatagggttttcttggccgggagccagaggggttggaaacagaggagatccaacatgtctggctccaacctggcggcagcgcaaaagatg

SEQ ID NO: 109317 - DNA, 103 bp, Artificial Sequence
  Synthetic Polynucleotide
taatacgactcactatagggagttccacctttttcttggccgggagccagaacagaggagactggctatgggccaagaaaacctggcggcagcgcaaaagatg

SEQ ID NO: 109318 - DNA, 103 bp, Artificial Sequence
  Synthetic Polynucleotide
taatacgactcactatagggagttgtatttagttccacctttttcttggcaacagaggagagccaagatgaaggtggaaaacctggcggcagcgcaaaagatg

SEQ ID NO: 109319 - DNA, 103 bp, Artificial Sequence
  Synthetic Polynucleotide
taatacgactcactataggggaagggtcccagttgtatttagttccacctaacagaggagaaggtggatgtaaatacaaaacctggcggcagcgcaaaagatg

SEQ ID NO: 109320 - DNA, 103 bp, Artificial Sequence
  Synthetic Polynucleotide
taatacgactcactataggggtcgtacacagaagggtcccagttgtatttaacagaggagaaaatacatgtgggaccctaacctggcggcagcgcaaaagatg

SEQ ID NO: 109321 - DNA, 103 bp, Artificial Sequence
  Synthetic Polynucleotide
taatacgactcactataggggcagctcactgtcgtacacagaagggtcccaacagaggagagggaccatgctgtgtacgaacctggcggcagcgcaaaagatg

SEQ ID NO: 109322 - DNA, 103 bp, Artificial Sequence
  Synthetic Polynucleotide
taatacgactcactataggggccgccacagcggccgcggccgccaccgccaacagaggagaggcggtatgggccgcggcaacctggcggcagcgcaaaagatg

SEQ ID NO: 109323 - DNA, 103 bp, Artificial Sequence
  Synthetic Polynucleotide
taatacgactcactatagggcaccgtacgggcagctcactgtcgtacacaaacagaggagatgtgtaatgcagtgagctaacctggcggcagcgcaaaagatg

SEQ ID NO: 109324 - DNA, 103 bp, Artificial Sequence
  Synthetic Polynucleotide
taatacgactcactataggggatgttccggcaccgtacgggcagctcactaacagaggagaagtgagatgcccgtacggaacctggcggcagcgcaaaagatg

SEQ ID NO: 109325 - DNA, 103 bp, Artificial Sequence
  Synthetic Polynucleotide
taatacgactcactataggggagtgccgctgatgttccggcaccgtacggaacagaggagaccgtacatggccggaacaaacctggcggcagcgcaaaagatg

SEQ ID NO: 109326 - DNA, 103 bp, Artificial Sequence
  Synthetic Polynucleotide
taatacgactcactatagggttcttgtacagagtgccgctgatgttccggaacagaggagaccggaaatgcagcggcacaacctggcggcagcgcaaaagatg

SEQ ID NO: 109327 - DNA, 103 bp, Artificial Sequence
  Synthetic Polynucleotide
taatacgactcactataggggccgagcctgttcttgtacagagtgccgctaacagaggagaagcggcatgctgtacaagaacctggcggcagcgcaaaagatg

SEQ ID NO: 109328 - DNA, 103 bp, Artificial Sequence
  Synthetic Polynucleotide
taatacgactcactatagggggccgcctgagccgagcctgttcttgtacaaacagaggagatgtacaatgacaggctcgaacctggcggcagcgcaaaagatg

SEQ ID NO: 109329 - DNA, 103 bp, Artificial Sequence
  Synthetic Polynucleotide
taatacgactcactatagggcaccgtccccggccgcctgagccgagcctgaacagaggagacaggctatgctcaggcggaacctggcggcagcgcaaaagatg

SEQ ID NO: 109330 - DNA, 103 bp, Artificial Sequence
  Synthetic Polynucleotide
taatacgactcactatagggctgcttgatgcaccgtccccggccgcctgaaacagaggagatcaggcatgcggggacggaacctggcggcagcgcaaaagatg

SEQ ID NO: 109331 - DNA, 103 bp, Artificial Sequence
  Synthetic Polynucleotide
taatacgactcactatagggagttctccccctgcttgatgcaccgtccccaacagaggagaggggacatggcatcaagcaacctggcggcagcgcaaaagatg

SEQ ID NO: 109332 - DNA, 103 bp, Artificial Sequence
  Synthetic Polynucleotide
taatacgactcactatagggggactgtaccagttctccccctgcttgatgaacagaggagacatcaaatggggggagaaaacctggcggcagcgcaaaagatg

SEQ ID NO: 109333 - DNA, 103 bp, Artificial Sequence
  Synthetic Polynucleotide
taatacgactcactatagggcgcggccgccgccgccacagcggccgcggcaacagaggagagccgcgatggctgtggcgaacctggcggcagcgcaaaagatg

SEQ ID NO: 109334 - DNA, 103 bp, Artificial Sequence
  Synthetic Polynucleotide
taatacgactcactatagggaaactcggtgggactgtaccagttctccccaacagaggagaggggagatgtggtacagtaacctggcggcagcgcaaaagatg

SEQ ID NO: 109335 - DNA, 103 bp, Artificial Sequence
  Synthetic Polynucleotide
taatacgactcactatagggccatggcctcaaactcggtgggactgtaccaacagaggagaggtacaatgccaccgagtaacctggcggcagcgcaaaagatg

SEQ ID NO: 109336 - DNA, 103 bp, Artificial Sequence
  Synthetic Polynucleotide
taatacgactcactataggggctcttcctgccatggcctcaaactcggtgaacagaggagacaccgaatgtgaggccataacctggcggcagcgcaaaagatg

SEQ ID NO: 109337 - DNA, 103 bp, Artificial Sequence
  Synthetic Polynucleotide
taatacgactcactatagggcttactgctggctcttcctgccatggcctcaacagaggagagaggccatggcaggaagaaacctggcggcagcgcaaaagatg

SEQ ID NO: 109338 - DNA, 103 bp, Artificial Sequence
  Synthetic Polynucleotide
taatacgactcactatagggttttccagtccttactgctggctcttcctgaacagaggagacaggaaatgccagcagtaaacctggcggcagcgcaaaagatg

SEQ ID NO: 109339 - DNA, 103 bp, Artificial Sequence
  Synthetic Polynucleotide
taatacgactcactatagggcgaatgcttcttttccagtccttactgctgaacagaggagacagcagatgggactggaaaacctggcggcagcgcaaaagatg

SEQ ID NO: 109340 - DNA, 103 bp, Artificial Sequence
  Synthetic Polynucleotide
taatacgactcactataggggcccgcgtagcgaatgcttcttttccagtcaacagaggagagactggatgagaagcattaacctggcggcagcgcaaaagatg

SEQ ID NO: 109341 - DNA, 103 bp, Artificial Sequence
  Synthetic Polynucleotide
taatacgactcactataggggcaagggtcggcccgcgtagcgaatgcttcaacagaggagagaagcaatggctacgcggaacctggcggcagcgcaaaagatg

SEQ ID NO: 109342 - DNA, 103 bp, Artificial Sequence
  Synthetic Polynucleotide
taatacgactcactatagggatgaggcactgcaagggtcggcccgcgtagaacagaggagactacgcatgccgacccttaacctggcggcagcgcaaaagatg

SEQ ID NO: 109343 - DNA, 103 bp, Artificial Sequence
  Synthetic Polynucleotide
taatacgactcactatagggcccatcctggatgaggcactgcaagggtcgaacagaggagacgacccatgcagtgcctcaacctggcggcagcgcaaaagatg

SEQ ID NO: 109344 - DNA, 103 bp, Artificial Sequence
  Synthetic Polynucleotide
taatacgactcactatagggctgccgcggccgcggccgccgccgccacagaacagaggagactgtggatgcggcggccgaacctggcggcagcgcaaaagatg

SEQ ID NO: 109345 - DNA, 103 bp, Artificial Sequence
  Synthetic Polynucleotide
taatacgactcactatagggggtttaagatcccatcctggatgaggcactaacagaggagaagtgccatgtccaggatgaacctggcggcagcgcaaaagatg

SEQ ID NO: 109346 - DNA, 103 bp, Artificial Sequence
  Synthetic Polynucleotide
taatacgactcactataggggcagcgtgagggtttaagatcccatcctggaacagaggagaccaggaatggatcttaaaaacctggcggcagcgcaaaagatg

SEQ ID NO: 109347 - DNA, 103 bp, Artificial Sequence
  Synthetic Polynucleotide
taatacgactcactatagggggtgcaagaggcagcgtgagggtttaagataacagaggagaatcttaatgcctcacgctaacctggcggcagcgcaaaagatg

SEQ ID NO: 109348 - DNA, 103 bp, Artificial Sequence
  Synthetic Polynucleotide
taatacgactcactatagggaggcagcacaggtgcaagaggcagcgtgagaacagaggagactcacgatgcctcttgcaaacctggcggcagcgcaaaagatg

SEQ ID NO: 109349 - DNA, 103 bp, Artificial Sequence
  Synthetic Polynucleotide
taatacgactcactatagggtcgtcgcagcaggcagcacaggtgcaagagaacagaggagactcttgatgctgtgctgcaacctggcggcagcgcaaaagatg

SEQ ID NO: 109350 - DNA, 103 bp, Artificial Sequence
  Synthetic Polynucleotide
taatacgactcactatagggtaaggtcatgtcgtcgcagcaggcagcacaaacagaggagatgtgctatgtgctgcgacaacctggcggcagcgcaaaagatg

SEQ ID NO: 109351 - DNA, 103 bp, Artificial Sequence
  Synthetic Polynucleotide
taatacgactcactatagggctgggccacttaaggtcatgtcgtcgcagcaacagaggagagctgcgatgacatgacctaacctggcggcagcgcaaaagatg

SEQ ID NO: 109352 - DNA, 103 bp, Artificial Sequence
  Synthetic Polynucleotide
taatacgactcactatagggaaaagcctgactgggccacttaaggtcatgaacagaggagacatgacatgaagtggcccaacctggcggcagcgcaaaagatg

SEQ ID NO: 109353 - DNA, 103 bp, Artificial Sequence
  Synthetic Polynucleotide
taatacgactcactataggggtaaggcacaaaaagcctgactgggccactaacagaggagaagtggcatggtcaggcttaacctggcggcagcgcaaaagatg

SEQ ID NO: 109354 - DNA, 103 bp, Artificial Sequence
  Synthetic Polynucleotide
taatacgactcactatagggtgcgccttttgtaaggcacaaaaagcctgaaacagaggagatcaggcatgttgtgccttaacctggcggcagcgcaaaagatg

SEQ ID NO: 109355 - DNA, 103 bp, Artificial Sequence
  Synthetic Polynucleotide
taatacgactcactataggggcctcgcctcctgccgcggccgcggccgccaacagaggagaggcggcatgggccgcggcaacctggcggcagcgcaaaagatg

SEQ ID NO: 109356 - DNA, 103 bp, Artificial Sequence
  Synthetic Polynucleotide
taatacgactcactatagggttctccttcttgcgccttttgtaaggcacaaacagaggagatgtgccatgcaaaaggcgaacctggcggcagcgcaaaagatg

SEQ ID NO: 109357 - DNA, 103 bp, Artificial Sequence
  Synthetic Polynucleotide
taatacgactcactataggggggcagttcattctccttcttgcgccttttaacagaggagaaaaaggatgaagaaggagaacctggcggcagcgcaaaagatg

SEQ ID NO: 109358 - DNA, 103 bp, Artificial Sequence
  Synthetic Polynucleotide
taatacgactcactatagggcgggagttgtgggcagttcattctccttctaacagaggagaagaaggatgatgaactgcaacctggcggcagcgcaaaagatg

SEQ ID NO: 109359 - DNA, 103 bp, Artificial Sequence
  Synthetic Polynucleotide
taatacgactcactatagggtccttcttcacgggagttgtgggcagttcaaacagaggagatgaactatgcacaactccaacctggcggcagcgcaaaagatg

SEQ ID NO: 109360 - DNA, 103 bp, Artificial Sequence
  Synthetic Polynucleotide
taatacgactcactatagggcttgggggagtccttcttcacgggagttgtaacagaggagaacaactatggtgaagaagaacctggcggcagcgcaaaagatg

SEQ ID NO: 109361 - DNA, 103 bp, Artificial Sequence
  Synthetic Polynucleotide
taatacgactcactatagggatgtgatgttcttgggggagtccttcttcaaacagaggagatgaagaatgactcccccaaacctggcggcagcgcaaaagatg

SEQ ID NO: 109362 - DNA, 103 bp, Artificial Sequence
  Synthetic Polynucleotide
taatacgactcactataggggctggaagcaatgtgatgttcttgggggagaacagaggagactccccatggaacatcacaacctggcggcagcgcaaaagatg

SEQ ID NO: 109363 - DNA, 103 bp, Artificial Sequence
  Synthetic Polynucleotide
taatacgactcactatagggagccgcggtggctggaagcaatgtgatgttaacagaggagaaacatcatgttgcttccaaacctggcggcagcgcaaaagatg

SEQ ID NO: 109364 - DNA, 103 bp, Artificial Sequence
  Synthetic Polynucleotide
taatacgactcactatagggtgaaggtggtagccgcggtggctggaagcaaacagaggagatgcttcatgccaccgcggaacctggcggcagcgcaaaagatg

SEQ ID NO: 109365 - DNA, 103 bp, Artificial Sequence
  Synthetic Polynucleotide
taatacgactcactatagggggggtcacggtgaaggtggtagccgcggtgaacagaggagacaccgcatgtaccaccttaacctggcggcagcgcaaaagatg

SEQ ID NO: 109366 - DNA, 103 bp, Artificial Sequence
  Synthetic Polynucleotide
taatacgactcactataggggccccagttctgatggtagtcataactcataacagaggagaatgagtatggactaccataacctggcggcagcgcaaaagatg

SEQ ID NO: 109367 - DNA, 103 bp, Artificial Sequence
  Synthetic Polynucleotide
taatacgactcactataggggccgcctcctccggagcctcggttacctccaacagaggagaggaggtatgcgaggctccaacctggcggcagcgcaaaagatg

SEQ ID NO: 109368 - DNA, 103 bp, Artificial Sequence
  Synthetic Polynucleotide
taatacgactcactatagggatttctttcatggatttcatcaagtacgataacagaggagaatcgtaatggatgaaatcaacctggcggcagcgcaaaagatg

SEQ ID NO: 109369 - DNA, 103 bp, Artificial Sequence
  Synthetic Polynucleotide
taatacgactcactatagggctgactgcagatttctttcatggatttcataacagaggagaatgaaaatgatgaaagaaaacctggcggcagcgcaaaagatg

SEQ ID NO: 109370 - DNA, 103 bp, Artificial Sequence
  Synthetic Polynucleotide
taatacgactcactatagggattaaaacatctgactgcagatttctttcaaacagaggagatgaaagatgtctgcagtcaacctggcggcagcgcaaaagatg

SEQ ID NO: 109371 - DNA, 103 bp, Artificial Sequence
  Synthetic Polynucleotide
taatacgactcactatagggaacaacagtcattaaaacatctgactgcagaacagaggagactgcagatggatgttttaaacctggcggcagcgcaaaagatg

SEQ ID NO: 109372 - DNA, 103 bp, Artificial Sequence
  Synthetic Polynucleotide
taatacgactcactataggggaaggtctttaacaacagtcattaaaacataacagaggagaatgtttatgtgactgttgaacctggcggcagcgcaaaagatg

SEQ ID NO: 109373 - DNA, 103 bp, Artificial Sequence
  Synthetic Polynucleotide
taatacgactcactatagggcgaaaattgagaaggtctttaacaacagtcaacagaggagagactgtatgtaaagacctaacctggcggcagcgcaaaagatg

SEQ ID NO: 109374 - DNA, 103 bp, Artificial Sequence
  Synthetic Polynucleotide
taatacgactcactatagggcaagtcagatcgaaaattgagaaggtctttaacagaggagaaaagacatgctcaattttaacctggcggcagcgcaaaagatg

SEQ ID NO: 109375 - DNA, 103 bp, Artificial Sequence
  Synthetic Polynucleotide
taatacgactcactatagggatattactttcaagtcagatcgaaaattgaaacagaggagatcaattatggatctgactaacctggcggcagcgcaaaagatg

SEQ ID NO: 109376 - DNA, 103 bp, Artificial Sequence
  Synthetic Polynucleotide
taatacgactcactataggggcactcatcaatattactttcaagtcagataacagaggagaatctgaatggaaagtaataacctggcggcagcgcaaaagatg

SEQ ID NO: 109377 - DNA, 103 bp, Artificial Sequence
  Synthetic Polynucleotide
taatacgactcactatagggattcaatgttgcactcatcaatattactttaacagaggagaaaagtaatgttgatgagtaacctggcggcagcgcaaaagatg

SEQ ID NO: 109378 - DNA, 103 bp, Artificial Sequence
  Synthetic Polynucleotide
taatacgactcactatagggctccgccgccgccgcctcctccggagcctcaacagaggagagaggctatggaggaggcgaacctggcggcagcgcaaaagatg

SEQ ID NO: 109379 - DNA, 103 bp, Artificial Sequence
  Synthetic Polynucleotide
taatacgactcactatagggacttttctgcattcaatgttgcactcatcaaacagaggagatgatgaatgcaacattgaaacctggcggcagcgcaaaagatg

SEQ ID NO: 109380 - DNA, 103 bp, Artificial Sequence
  Synthetic Polynucleotide
taatacgactcactatagggtattctgaaaacttttctgcattcaatgttaacagaggagaaacattatgtgcagaaaaaacctggcggcagcgcaaaagatg

SEQ ID NO: 109381 - DNA, 103 bp, Artificial Sequence
  Synthetic Polynucleotide
taatacgactcactataggggttaccaaaatattctgaaaacttttctgcaacagaggagagcagaaatgttttcagaaaacctggcggcagcgcaaaagatg

SEQ ID NO: 109382 - DNA, 103 bp, Artificial Sequence
  Synthetic Polynucleotide
taatacgactcactatagggtcattggacagttaccaaaatattctgaaaaacagaggagatttcagatgattttggtaaacctggcggcagcgcaaaagatg

SEQ ID NO: 109383 - DNA, 103 bp, Artificial Sequence
  Synthetic Polynucleotide
taatacgactcactatagggggtatatgtatcattggacagttaccaaaaaacagaggagattttggatgctgtccaataacctggcggcagcgcaaaagatg

SEQ ID NO: 109384 - DNA, 103 bp, Artificial Sequence
  Synthetic Polynucleotide
taatacgactcactatagggggtaaaaccaggtatatgtatcattggacaaacagaggagatgtccaatgatacatataaacctggcggcagcgcaaaagatg

SEQ ID NO: 109385 - DNA, 103 bp, Artificial Sequence
  Synthetic Polynucleotide
taatacgactcactatagggcaaccggaaaggtaaaaccaggtatatgtaaacagaggagatacataatgctggttttaaacctggcggcagcgcaaaagatg

SEQ ID NO: 109386 - DNA, 103 bp, Artificial Sequence
  Synthetic Polynucleotide
taatacgactcactatagggagatattccacaaccggaaaggtaaaaccaaacagaggagatggtttatgctttccggtaacctggcggcagcgcaaaagatg

SEQ ID NO: 109387 - DNA, 103 bp, Artificial Sequence
  Synthetic Polynucleotide
taatacgactcactatagggatcttccaaaagatattccacaaccggaaaaacagaggagatttccgatggtggaatataacctggcggcagcgcaaaagatg

SEQ ID NO: 109388 - DNA, 103 bp, Artificial Sequence
  Synthetic Polynucleotide
taatacgactcactatagggtttcaattacatcttccaaaagatattccaaacagaggagatggaatatgttttggaagaacctggcggcagcgcaaaagatg

SEQ ID NO: 109389 - DNA, 103 bp, Artificial Sequence
  Synthetic Polynucleotide
taatacgactcactatagggcgaccaccccctccgccgccgccgcctcctaacagaggagaaggaggatgcggcggcggaacctggcggcagcgcaaaagatg

SEQ ID NO: 109390 - DNA, 103 bp, Artificial Sequence
  Synthetic Polynucleotide
taatacgactcactatagggtaccttattttttcaattacatcttccaaaaacagaggagatttggaatgtgtaattgaaacctggcggcagcgcaaaagatg

SEQ ID NO: 109391 - DNA, 103 bp, Artificial Sequence
  Synthetic Polynucleotide
taatacgactcactatagggttctggaacataccttattttttcaattacaacagaggagagtaattatgaaaataaggaacctggcggcagcgcaaaagatg

SEQ ID NO: 109392 - DNA, 103 bp, Artificial Sequence
  Synthetic Polynucleotide
taatacgactcactataggggttctttttgttctggaacataccttatttaacagaggagaaaataaatgatgttccagaacctggcggcagcgcaaaagatg

SEQ ID NO: 109393 - DNA, 103 bp, Artificial Sequence
  Synthetic Polynucleotide
taatacgactcactatagggtgggatctgtgttctttttgttctggaacaaacagaggagatgttccatgacaaaaagaaacctggcggcagcgcaaaagatg

SEQ ID NO: 109394 - DNA, 103 bp, Artificial Sequence
  Synthetic Polynucleotide
taatacgactcactatagggcctcttaaactgggatctgtgttctttttgaacagaggagacaaaaaatgcacagatccaacctggcggcagcgcaaaagatg

SEQ ID NO: 109395 - DNA, 103 bp, Artificial Sequence
  Synthetic Polynucleotide
taatacgactcactataggggcatgaaacccctcttaaactgggatctgtaacagaggagaacagatatgagtttaagaaacctggcggcagcgcaaaagatg

SEQ ID NO: 109396 - DNA, 103 bp, Artificial Sequence
  Synthetic Polynucleotide
taatacgactcactatagggacatgcccttgcatgaaacccctcttaaacaacagaggagagtttaaatggggtttcataacctggcggcagcgcaaaagatg

SEQ ID NO: 109397 - DNA, 103 bp, Artificial Sequence
  Synthetic Polynucleotide
taatacgactcactatagggttgtctatttacatgcccttgcatgaaaccaacagaggagaggtttcatgcaagggcataacctggcggcagcgcaaaagatg

SEQ ID NO: 109398 - DNA, 103 bp, Artificial Sequence
  Synthetic Polynucleotide
taatacgactcactatagggcttctttttcttgtctatttacatgcccttaacagaggagaaagggcatgtaaatagacaacctggcggcagcgcaaaagatg

SEQ ID NO: 109399 - DNA, 103 bp, Artificial Sequence
  Synthetic Polynucleotide
taatacgactcactataggggcttctttttcttctttttcttgtctatttaacagaggagaaaatagatgagaaaaagaaacctggcggcagcgcaaaagatg

SEQ ID NO: 109400 - DNA, 103 bp, Artificial Sequence
  Synthetic Polynucleotide
taatacgactcactatagggcctgccgcctcgaccaccccctccgccgccaacagaggagaggcggcatggggggtggtaacctggcggcagcgcaaaagatg

SEQ ID NO: 109401 - DNA, 103 bp, Artificial Sequence
  Synthetic Polynucleotide
taatacgactcactatagggtttatatattgcttctttttcttctttttcaacagaggagagaaaaaatggaaaaagaaaacctggcggcagcgcaaaagatg

SEQ ID NO: 109402 - DNA, 103 bp, Artificial Sequence
  Synthetic Polynucleotide
taatacgactcactataggggccaacgttctttatatattgcttctttttaacagaggagaaaaaagatgcaatatataaacctggcggcagcgcaaaagatg

SEQ ID NO: 109403 - DNA, 103 bp, Artificial Sequence
  Synthetic Polynucleotide
taatacgactcactatagggacataatctggccaacgttctttatatattaacagaggagaaatataatgagaacgttgaacctggcggcagcgcaaaagatg

SEQ ID NO: 109404 - DNA, 103 bp, Artificial Sequence
  Synthetic Polynucleotide
taatacgactcactatagggcagttcccttacataatctggccaacgttcaacagaggagagaacgtatgccagattataacctggcggcagcgcaaaagatg

SEQ ID NO: 109405 - DNA, 103 bp, Artificial Sequence
  Synthetic Polynucleotide
taatacgactcactatagggaccttcttcgcagttcccttacataatctgaacagaggagacagattatgtaagggaacaacctggcggcagcgcaaaagatg

SEQ ID NO: 109406 - DNA, 103 bp, Artificial Sequence
  Synthetic Polynucleotide
taatacgactcactatagggcttgcagaataccttcttcgcagttcccttaacagaggagaaagggaatggcgaagaagaacctggcggcagcgcaaaagatg

SEQ ID NO: 109407 - DNA, 103 bp, Artificial Sequence
  Synthetic Polynucleotide
taatacgactcactatagggatctacagtacttgcagaataccttcttcgaacagaggagacgaagaatgtattctgcaaacctggcggcagcgcaaaagatg

SEQ ID NO: 109408 - DNA, 103 bp, Artificial Sequence
  Synthetic Polynucleotide
taatacgactcactatagggtttctataacatctacagtacttgcagaataacagaggagaattctgatggtactgtagaacctggcggcagcgcaaaagatg

SEQ ID NO: 109409 - DNA, 103 bp, Artificial Sequence
  Synthetic Polynucleotide
taatacgactcactatagggtcctccatcatttctataacatctacagtaaacagaggagatactgtatgtgttatagaaacctggcggcagcgcaaaagatg

SEQ ID NO: 109410 - DNA, 103 bp, Artificial Sequence
  Synthetic Polynucleotide
taatacgactcactatagggaactttatcatcctccatcatttctataacaacagaggagagttataatgatgatggagaacctggcggcagcgcaaaagatg

SEQ ID NO: 109411 - DNA, 103 bp, Artificial Sequence
  Synthetic Polynucleotide
taatacgactcactataggggatgccggcccctgccgcctcgaccaccccaacagaggagaggggtgatggaggcggcaaacctggcggcagcgcaaaagatg

SEQ ID NO: 109412 - DNA, 103 bp, Artificial Sequence
  Synthetic Polynucleotide
taatacgactcactatagggaattcagatcaactttatcatcctccatcaaacagaggagatgatggatgatgataaagaacctggcggcagcgcaaaagatg

SEQ ID NO: 109413 - DNA, 103 bp, Artificial Sequence
  Synthetic Polynucleotide
taatacgactcactataggggcaacaatcaaattcagatcaactttatcaaacagaggagatgataaatgtgatctgaaaacctggcggcagcgcaaaagatg

SEQ ID NO: 109414 - DNA, 103 bp, Artificial Sequence
  Synthetic Polynucleotide
taatacgactcactatagggtcggatgagggcaacaatcaaattcagatcaacagaggagagatctgatgttgattgttaacctggcggcagcgcaaaagatg

SEQ ID NO: 109415 - DNA, 103 bp, Artificial Sequence
  Synthetic Polynucleotide
taatacgactcactatagggaaacaatgtatcggatgagggcaacaatcaaacagaggagatgattgatgccctcatccaacctggcggcagcgcaaaagatg

SEQ ID NO: 109416 - DNA, 103 bp, Artificial Sequence
  Synthetic Polynucleotide
taatacgactcactatagggtcttcttccaaaacaatgtatcggatgaggaacagaggagacctcatatgatacattgtaacctggcggcagcgcaaaagatg

SEQ ID NO: 109417 - DNA, 103 bp, Artificial Sequence
  Synthetic Polynucleotide
taatacgactcactatagggcgcaccatcctcttcttccaaaacaatgtaaacagaggagatacattatgttggaagaaaacctggcggcagcgcaaaagatg

SEQ ID NO: 109418 - DNA, 103 bp, Artificial Sequence
  Synthetic Polynucleotide
taatacgactcactatagggagaccagtatcgcaccatcctcttcttccaaacagaggagatggaagatgaggatggtgaacctggcggcagcgcaaaagatg

SEQ ID NO: 109419 - DNA, 103 bp, Artificial Sequence
  Synthetic Polynucleotide
taatacgactcactatagggcctggcagaaagaccagtatcgcaccatccaacagaggagaggatggatggatactggtaacctggcggcagcgcaaaagatg

SEQ ID NO: 109420 - DNA, 103 bp, Artificial Sequence
  Synthetic Polynucleotide
taatacgactcactatagggattgtcccagcctggcagaaagaccagtataacagaggagaatactgatgtttctgccaaacctggcggcagcgcaaaagatg

SEQ ID NO: 109421 - DNA, 103 bp, Artificial Sequence
  Synthetic Polynucleotide
taatacgactcactatagggaagtgctgatattgtcccagcctggcagaaaacagaggagattctgcatggctgggacaaacctggcggcagcgcaaaagatg

SEQ ID NO: 109422 - DNA, 103 bp, Artificial Sequence
  Synthetic Polynucleotide
taatacgactcactatagggaggtgcccgggatgccggcccctgccgcctaacagaggagaaggcggatggggccggcaaacctggcggcagcgcaaaagatg

SEQ ID NO: 109423 - DNA, 103 bp, Artificial Sequence
  Synthetic Polynucleotide
taatacgactcactatagggagatcatgtaaagtgctgatattgtcccagaacagaggagactgggaatgtatcagcacaacctggcggcagcgcaaaagatg

SEQ ID NO: 109424 - DNA, 103 bp, Artificial Sequence
  Synthetic Polynucleotide
taatacgactcactatagggtgacatcaagagatcatgtaaagtgctgataacagaggagaatcagcatgttacatgataacctggcggcagcgcaaaagatg

SEQ ID NO: 109425 - DNA, 103 bp, Artificial Sequence
  Synthetic Polynucleotide
taatacgactcactatagggacattacttgtgacatcaagagatcatgtaaacagaggagatacatgatgtcttgatgtaacctggcggcagcgcaaaagatg

SEQ ID NO: 109426 - DNA, 103 bp, Artificial Sequence
  Synthetic Polynucleotide
taatacgactcactatagggtctgatttaaacattacttgtgacatcaagaacagaggagacttgatatgacaagtaataacctggcggcagcgcaaaagatg

SEQ ID NO: 109427 - DNA, 103 bp, Artificial Sequence
  Synthetic Polynucleotide
taatacgactcactatagggtaaaaatttatctgatttaaacattacttgaacagaggagacaagtaatgtttaaatcaaacctggcggcagcgcaaaagatg

SEQ ID NO: 109428 - DNA, 103 bp, Artificial Sequence
  Synthetic Polynucleotide
taatacgactcactatagggaaggtataattaaaaatttatctgatttaaaacagaggagattaaatatgataaattttaacctggcggcagcgcaaaagatg

SEQ ID NO: 109429 - DNA, 103 bp, Artificial Sequence
  Synthetic Polynucleotide
taatacgactcactatagggagtgaatgtaaaggtataattaaaaatttaaacagaggagataaattatgaattataccaacctggcggcagcgcaaaagatg

SEQ ID NO: 109430 - DNA, 103 bp, Artificial Sequence
  Synthetic Polynucleotide
taatacgactcactatagggtgtaggcatcagtgaatgtaaaggtataataacagaggagaattataatgttacattcaaacctggcggcagcgcaaaagatg

SEQ ID NO: 109431 - DNA, 103 bp, Artificial Sequence
  Synthetic Polynucleotide
taatacgactcactatagggtctggttaactgtaggcatcagtgaatgtaaacagaggagatacattatgtgatgcctaaacctggcggcagcgcaaaagatg

SEQ ID NO: 109432 - DNA, 103 bp, Artificial Sequence
  Synthetic Polynucleotide
taatacgactcactatagggaacacctgtgtctggttaactgtaggcatcaacagaggagagatgccatgagttaaccaaacctggcggcagcgcaaaagatg

SEQ ID NO: 109433 - DNA, 103 bp, Artificial Sequence
  Synthetic Polynucleotide
taatacgactcactataggggcggcctttcaggtgcccgggatgccggccaacagaggagaggccggatgcccgggcacaacctggcggcagcgcaaaagatg

SEQ ID NO: 109434 - DNA, 103 bp, Artificial Sequence
  Synthetic Polynucleotide
taatacgactcactatagggggttcttttaaacacctgtgtctggttaacaacagaggagagttaacatgacacaggtgaacctggcggcagcgcaaaagatg

SEQ ID NO: 109435 - DNA, 103 bp, Artificial Sequence
  Synthetic Polynucleotide
taatacgactcactatagggcaccaggaggggttcttttaaacacctgtgaacagaggagacacaggatgttaaaagaaaacctggcggcagcgcaaaagatg

SEQ ID NO: 109436 - DNA, 103 bp, Artificial Sequence
  Synthetic Polynucleotide
taatacgactcactatagggattttccgaacaccaggaggggttcttttaaacagaggagataaaagatgccctcctggaacctggcggcagcgcaaaagatg

SEQ ID NO: 109437 - DNA, 103 bp, Artificial Sequence
  Synthetic Polynucleotide
taatacgactcactatagggagcaattactattttccgaacaccaggaggaacagaggagacctcctatggttcggaaaaacctggcggcagcgcaaaagatg

SEQ ID NO: 109438 - DNA, 103 bp, Artificial Sequence
  Synthetic Polynucleotide
taatacgactcactatagggcaatgttggtagcaattactattttccgaaaacagaggagattcggaatgtagtaattgaacctggcggcagcgcaaaagatg

SEQ ID NO: 109439 - DNA, 103 bp, Artificial Sequence
  Synthetic Polynucleotide
taatacgactcactatagggctagtctccgcaatgttggtagcaattactaacagaggagaagtaatatgtaccaacataacctggcggcagcgcaaaagatg

SEQ ID NO: 109440 - DNA, 103 bp, Artificial Sequence
  Synthetic Polynucleotide
taatacgactcactatagggtatggtaatgctagtctccgcaatgttggtaacagaggagaaccaacatggcggagactaacctggcggcagcgcaaaagatg

SEQ ID NO: 109441 - DNA, 103 bp, Artificial Sequence
  Synthetic Polynucleotide
taatacgactcactatagggcgacatcatctatggtaatgctagtctccgaacagaggagacggagaatggcattaccaaacctggcggcagcgcaaaagatg

SEQ ID NO: 109442 - DNA, 103 bp, Artificial Sequence
  Synthetic Polynucleotide
taatacgactcactatagggatcacataaacgacatcatctatggtaatgaacagaggagacattacatgagatgatgtaacctggcggcagcgcaaaagatg

SEQ ID NO: 109443 - DNA, 103 bp, Artificial Sequence
  Synthetic Polynucleotide
taatacgactcactatagggtcctccatctatcacataaacgacatcatcaacagaggagagatgatatggtttatgtgaacctggcggcagcgcaaaagatg

SEQ ID NO: 109444 - DNA, 103 bp, Artificial Sequence
  Synthetic Polynucleotide
taatacgactcactatagggtgccgatttcgcggcctttcaggtgcccggaacagaggagaccgggcatgtgaaaggccaacctggcggcagcgcaaaagatg

SEQ ID NO: 109445 - DNA, 103 bp, Artificial Sequence
  Synthetic Polynucleotide
taatacgactcactatagggcttttatttttcctccatctatcacataaaaacagaggagatttatgatgtagatggagaacctggcggcagcgcaaaagatg

SEQ ID NO: 109446 - DNA, 103 bp, Artificial Sequence
  Synthetic Polynucleotide
taatacgactcactatagggaaatgcgtctcttttatttttcctccatctaacagaggagaagatggatgaaaaataaaaacctggcggcagcgcaaaagatg

SEQ ID NO: 109447 - DNA, 103 bp, Artificial Sequence
  Synthetic Polynucleotide
taatacgactcactatagggctgagtatcaaaatgcgtctcttttattttaacagaggagaaaaataatggagacgcataacctggcggcagcgcaaaagatg

SEQ ID NO: 109448 - DNA, 103 bp, Artificial Sequence
  Synthetic Polynucleotide
taatacgactcactatagggtgatattgttctgagtatcaaaatgcgtctaacagaggagaagacgcatgttgatactcaacctggcggcagcgcaaaagatg

SEQ ID NO: 109449 - DNA, 103 bp, Artificial Sequence
  Synthetic Polynucleotide
taatacgactcactataggggacattgtactgatattgttctgagtatcaaacagaggagatgatacatggaacaatataacctggcggcagcgcaaaagatg

SEQ ID NO: 109450 - DNA, 103 bp, Artificial Sequence
  Synthetic Polynucleotide
taatacgactcactatagggccactcagcggacattgtactgatattgttaacagaggagaaacaatatgagtacaatgaacctggcggcagcgcaaaagatg

SEQ ID NO: 109451 - DNA, 103 bp, Artificial Sequence
  Synthetic Polynucleotide
taatacgactcactatagggctttactaacccactcagcggacattgtacaacagaggagagtacaaatgccgctgagtaacctggcggcagcgcaaaagatg

SEQ ID NO: 109452 - DNA, 103 bp, Artificial Sequence
  Synthetic Polynucleotide
taatacgactcactatagggttggcattagctttactaacccactcagcgaacagaggagacgctgaatgggttagtaaaacctggcggcagcgcaaaagatg

SEQ ID NO: 109453 - DNA, 103 bp, Artificial Sequence
  Synthetic Polynucleotide
taatacgactcactatagggttttctctgtttggcattagctttactaacaacagaggagagttagtatggctaatgccaacctggcggcagcgcaaaagatg

SEQ ID NO: 109454 - DNA, 103 bp, Artificial Sequence
  Synthetic Polynucleotide
taatacgactcactatagggcagctcgaccttttctctgtttggcattagaacagaggagactaatgatgaacagagaaaacctggcggcagcgcaaaagatg

SEQ ID NO: 109455 - DNA, 103 bp, Artificial Sequence
  Synthetic Polynucleotide
taatacgactcactataggggcgtaccacatgccgatttcgcggcctttcaacagaggagagaaaggatgcgaaatcggaacctggcggcagcgcaaaagatg

SEQ ID NO: 109456 - DNA, 103 bp, Artificial Sequence
  Synthetic Polynucleotide
taatacgactcactatagggtgaactcttccagctcgaccttttctctgtaacagaggagaacagagatgaggtcgagcaacctggcggcagcgcaaaagatg

SEQ ID NO: 109457 - DNA, 103 bp, Artificial Sequence
  Synthetic Polynucleotide
taatacgactcactatagggatgaccaggttgaactcttccagctcgaccaacagaggagaggtcgaatgggaagagttaacctggcggcagcgcaaaagatg

SEQ ID NO: 109458 - DNA, 103 bp, Artificial Sequence
  Synthetic Polynucleotide
taatacgactcactataggggatgatagcaatgaccaggttgaactcttcaacagaggagagaagagatgaacctggtcaacctggcggcagcgcaaaagatg

SEQ ID NO: 109459 - DNA, 103 bp, Artificial Sequence
  Synthetic Polynucleotide
taatacgactcactatagggccattatacagatgatagcaatgaccaggtaacagaggagaacctggatgttgctatcaaacctggcggcagcgcaaaagatg

SEQ ID NO: 109460 - DNA, 103 bp, Artificial Sequence
  Synthetic Polynucleotide
taatacgactcactatagggtgctctaagaccattatacagatgatagcaaacagaggagatgctatatgctgtataataacctggcggcagcgcaaaagatg

SEQ ID NO: 109461 - DNA, 103 bp, Artificial Sequence
  Synthetic Polynucleotide
taatacgactcactatagggctagaagacttgctctaagaccattatacaaacagaggagatgtataatggtcttagagaacctggcggcagcgcaaaagatg

SEQ ID NO: 109462 - DNA, 103 bp, Artificial Sequence
  Synthetic Polynucleotide
taatacgactcactatagggtgatagtcatctagaagacttgctctaagaaacagaggagatcttagatgaagtcttctaacctggcggcagcgcaaaagatg

SEQ ID NO: 109463 - DNA, 103 bp, Artificial Sequence
  Synthetic Polynucleotide
taatacgactcactatagggttctggcagttgatagtcatctagaagactaacagaggagaagtcttatggatgactataacctggcggcagcgcaaaagatg

SEQ ID NO: 109464 - DNA, 103 bp, Artificial Sequence
  Synthetic Polynucleotide
taatacgactcactatagggttctcaaaatttctggcagttgatagtcataacagaggagaatgactatgaactgccagaacctggcggcagcgcaaaagatg

SEQ ID NO: 109465 - DNA, 103 bp, Artificial Sequence
  Synthetic Polynucleotide
taatacgactcactatagggtccaaaggagttctcaaaatttctggcagtaacagaggagaactgccatgaattttgagaacctggcggcagcgcaaaagatg

SEQ ID NO: 109466 - DNA, 103 bp, Artificial Sequence
  Synthetic Polynucleotide
taatacgactcactatagggctgttttttcgcgtaccacatgccgatttcaacagaggagagaaatcatgatgtggtacaacctggcggcagcgcaaaagatg

SEQ ID NO: 109467 - DNA, 103 bp, Artificial Sequence
  Synthetic Polynucleotide
taatacgactcactatagggacaaagttcttccaaaggagttctcaaaataacagaggagaattttgatgactcctttgaacctggcggcagcgcaaaagatg

SEQ ID NO: 109468 - DNA, 103 bp, Artificial Sequence
  Synthetic Polynucleotide
taatacgactcactatagggttatttgtaaacaaagttcttccaaaggagaacagaggagactccttatgaagaactttaacctggcggcagcgcaaaagatg

SEQ ID NO: 109469 - DNA, 103 bp, Artificial Sequence
  Synthetic Polynucleotide
taatacgactcactatagggcttaaaatctttatttgtaaacaaagttctaacagaggagaagaactatgtttacaaataacctggcggcagcgcaaaagatg

SEQ ID NO: 109470 - DNA, 103 bp, Artificial Sequence
  Synthetic Polynucleotide
taatacgactcactatagggtccacctagccttaaaatctttatttgtaaaacagaggagattacaaatgaagattttaaacctggcggcagcgcaaaagatg

SEQ ID NO: 109471 - DNA, 103 bp, Artificial Sequence
  Synthetic Polynucleotide
taatacgactcactatagggaataagcaattccacctagccttaaaatctaacagaggagaagatttatgggctaggtgaacctggcggcagcgcaaaagatg

SEQ ID NO: 109472 - DNA, 103 bp, Artificial Sequence
  Synthetic Polynucleotide
taatacgactcactatagggctactcagaaaataagcaattccacctagcaacagaggagagctaggatgaattgcttaaacctggcggcagcgcaaaagatg

SEQ ID NO: 109473 - DNA, 103 bp, Artificial Sequence
  Synthetic Polynucleotide
taatacgactcactataggggtccattaatctactcagaaaataagcaataacagaggagaattgctatgtttctgagtaacctggcggcagcgcaaaagatg

SEQ ID NO: 109474 - DNA, 103 bp, Artificial Sequence
  Synthetic Polynucleotide
taatacgactcactatagggttgatggtgggtccattaatctactcagaaaacagaggagattctgaatggattaatggaacctggcggcagcgcaaaagatg

SEQ ID NO: 109475 - DNA, 103 bp, Artificial Sequence
  Synthetic Polynucleotide
taatacgactcactatagggactgcctcatttgatggtgggtccattaataacagaggagaattaatatgcccaccatcaacctggcggcagcgcaaaagatg

SEQ ID NO: 109476 - DNA, 103 bp, Artificial Sequence
  Synthetic Polynucleotide
taatacgactcactatagggggagagtaacactgcctcatttgatggtggaacagaggagaccaccaatgaatgaggcaaacctggcggcagcgcaaaagatg

SEQ ID NO: 109477 - DNA, 103 bp, Artificial Sequence
  Synthetic Polynucleotide
taatacgactcactatagggccccatcacggccccagttctgatggtagtaacagaggagaactaccatgagaactgggaacctggcggcagcgcaaaagatg

SEQ ID NO: 109478 - DNA, 103 bp, Artificial Sequence
  Synthetic Polynucleotide
taatacgactcactatagggtcttctgcccctgttttttcgcgtaccacaaacagaggagatgtggtatgcgaaaaaacaacctggcggcagcgcaaaagatg

SEQ ID NO: 109479 - DNA, 103 bp, Artificial Sequence
  Synthetic Polynucleotide
taatacgactcactatagggggtgtcttatggagagtaacactgcctcataacagaggagaatgaggatgtgttactctaacctggcggcagcgcaaaagatg

SEQ ID NO: 109480 - DNA, 103 bp, Artificial Sequence
  Synthetic Polynucleotide
taatacgactcactatagggagctccatcaggtgtcttatggagagtaacaacagaggagagttactatgcataagacaaacctggcggcagcgcaaaagatg

SEQ ID NO: 109481 - DNA, 103 bp, Artificial Sequence
  Synthetic Polynucleotide
taatacgactcactatagggcaaagcgttcagctccatcaggtgtcttataacagaggagaataagaatgctgatggagaacctggcggcagcgcaaaagatg

SEQ ID NO: 109482 - DNA, 103 bp, Artificial Sequence
  Synthetic Polynucleotide
taatacgactcactatagggcttgtttatccaaagcgttcagctccatcaaacagaggagatgatggatgtgaacgcttaacctggcggcagcgcaaaagatg

SEQ ID NO: 109483 - DNA, 103 bp, Artificial Sequence
  Synthetic Polynucleotide
taatacgactcactataggggtcaattcttcttgtttatccaaagcgttcaacagaggagagaacgcatgggataaacaaacctggcggcagcgcaaaagatg

SEQ ID NO: 109484 - DNA, 103 bp, Artificial Sequence
  Synthetic Polynucleotide
taatacgactcactatagggtccaagaggtgtcaattcttcttgtttatcaacagaggagagataaaatggaagaattgaacctggcggcagcgcaaaagatg

SEQ ID NO: 109485 - DNA, 103 bp, Artificial Sequence
  Synthetic Polynucleotide
taatacgactcactatagggccaagtggactccaagaggtgtcaattcttaacagaggagaaagaatatgcacctcttgaacctggcggcagcgcaaaagatg

SEQ ID NO: 109486 - DNA, 103 bp, Artificial Sequence
  Synthetic Polynucleotide
taatacgactcactatagggggtaatcgtgccaagtggactccaagaggtaacagaggagaacctctatgagtccacttaacctggcggcagcgcaaaagatg

SEQ ID NO: 109487 - DNA, 103 bp, Artificial Sequence
  Synthetic Polynucleotide
taatacgactcactatagggtggctcaacgggtaatcgtgccaagtggacaacagaggagagtccacatggcacgattaaacctggcggcagcgcaaaagatg

SEQ ID NO: 109488 - DNA, 103 bp, Artificial Sequence
  Synthetic Polynucleotide
taatacgactcactatagggttccaatatgtggctcaacgggtaatcgtgaacagaggagacacgatatgccgttgagcaacctggcggcagcgcaaaagatg

SEQ ID NO: 109489 - DNA, 103 bp, Artificial Sequence
  Synthetic Polynucleotide
taatacgactcactataggggcttccttgttcttctgcccctgttttttcaacagaggagagaaaaaatgggggcagaaaacctggcggcagcgcaaaagatg

SEQ ID NO: 109490 - DNA, 103 bp, Artificial Sequence
  Synthetic Polynucleotide
taatacgactcactatagggagaatcatttttccaatatgtggctcaacgaacagaggagacgttgaatgacatattggaacctggcggcagcgcaaaagatg

SEQ ID NO: 109491 - DNA, 103 bp, Artificial Sequence
  Synthetic Polynucleotide
taatacgactcactatagggtgctccaaaaagaatcatttttccaatatgaacagaggagacatattatgaaaatgattaacctggcggcagcgcaaaagatg

SEQ ID NO: 109492 - DNA, 103 bp, Artificial Sequence
  Synthetic Polynucleotide
taatacgactcactatagggagcagaacagtgctccaaaaagaatcatttaacagaggagaaaatgaatgtttttggagaacctggcggcagcgcaaaagatg

SEQ ID NO: 109493 - DNA, 103 bp, Artificial Sequence
  Synthetic Polynucleotide
taatacgactcactataggggggtctaagcagcagaacagtgctccaaaaaacagaggagattttggatgactgttctgaacctggcggcagcgcaaaagatg

SEQ ID NO: 109494 - DNA, 103 bp, Artificial Sequence
  Synthetic Polynucleotide
taatacgactcactatagggagtgagtactgggtctaagcagcagaacagaacagaggagactgttcatgtgcttagacaacctggcggcagcgcaaaagatg

SEQ ID NO: 109495 - DNA, 103 bp, Artificial Sequence
  Synthetic Polynucleotide
taatacgactcactatagggtagcagcaatagtgagtactgggtctaagcaacagaggagagcttagatgcagtactcaaacctggcggcagcgcaaaagatg

SEQ ID NO: 109496 - DNA, 103 bp, Artificial Sequence
  Synthetic Polynucleotide
taatacgactcactatagggaaactgagactagcagcaatagtgagtactaacagaggagaagtactatgtattgctgcaacctggcggcagcgcaaaagatg

SEQ ID NO: 109497 - DNA, 103 bp, Artificial Sequence
  Synthetic Polynucleotide
taatacgactcactatagggtggatctttgaaactgagactagcagcaataacagaggagaattgctatgagtctcagtaacctggcggcagcgcaaaagatg

SEQ ID NO: 109498 - DNA, 103 bp, Artificial Sequence
  Synthetic Polynucleotide
taatacgactcactataggggaatgacaaatggatctttgaaactgagacaacagaggagagtctcaatgtcaaagatcaacctggcggcagcgcaaaagatg

SEQ ID NO: 109499 - DNA, 103 bp, Artificial Sequence
  Synthetic Polynucleotide
taatacgactcactatagggcagcccagtggaatgacaaatggatctttgaacagaggagacaaagaatgatttgtcataacctggcggcagcgcaaaagatg

SEQ ID NO: 109500 - DNA, 103 bp, Artificial Sequence
  Synthetic Polynucleotide
taatacgactcactatagggttgcctctccgcttccttgttcttctgcccaacagaggagagggcagatgaacaaggaaaacctggcggcagcgcaaaagatg

SEQ ID NO: 109501 - DNA, 103 bp, Artificial Sequence
  Synthetic Polynucleotide
taatacgactcactatagggagcctcttcccagcccagtggaatgacaaaaacagaggagatttgtcatgccactgggcaacctggcggcagcgcaaaagatg

SEQ ID NO: 109502 - DNA, 103 bp, Artificial Sequence
  Synthetic Polynucleotide
taatacgactcactatagggcacgtcgcctagcctcttcccagcccagtgaacagaggagacactggatggggaagaggaacctggcggcagcgcaaaagatg

SEQ ID NO: 109503 - DNA, 103 bp, Artificial Sequence
  Synthetic Polynucleotide
taatacgactcactatagggtatctgaaaccacgtcgcctagcctcttccaacagaggagaggaagaatgtaggcgacgaacctggcggcagcgcaaaagatg

SEQ ID NO: 109504 - DNA, 103 bp, Artificial Sequence
  Synthetic Polynucleotide
taatacgactcactataggggtccttttcgtatctgaaaccacgtcgcctaacagaggagaaggcgaatgggtttcagaaacctggcggcagcgcaaaagatg

SEQ ID NO: 109505 - DNA, 103 bp, Artificial Sequence
  Synthetic Polynucleotide
taatacgactcactatagggcccagcaatagtccttttcgtatctgaaacaacagaggagagtttcaatgacgaaaaggaacctggcggcagcgcaaaagatg

SEQ ID NO: 109506 - DNA, 103 bp, Artificial Sequence
  Synthetic Polynucleotide
taatacgactcactatagggagaaaatattcccagcaatagtccttttcgaacagaggagacgaaaaatgctattgctgaacctggcggcagcgcaaaagatg

SEQ ID NO: 109507 - DNA, 103 bp, Artificial Sequence
  Synthetic Polynucleotide
taatacgactcactataggggtttgaagacagaaaatattcccagcaataaacagaggagatattgcatggaatattttaacctggcggcagcgcaaaagatg

SEQ ID NO: 109508 - DNA, 103 bp, Artificial Sequence
  Synthetic Polynucleotide
taatacgactcactatagggtctgcagtgtgtttgaagacagaaaatattaacagaggagaaatattatgtgtcttcaaaacctggcggcagcgcaaaagatg

SEQ ID NO: 109509 - DNA, 103 bp, Artificial Sequence
  Synthetic Polynucleotide
taatacgactcactatagggttatgcagcatctgcagtgtgtttgaagacaacagaggagagtcttcatgcacactgcaaacctggcggcagcgcaaaagatg

SEQ ID NO: 109510 - DNA, 103 bp, Artificial Sequence
  Synthetic Polynucleotide
taatacgactcactatagggtcctttcatgttatgcagcatctgcagtgtaacagaggagaacactgatgatgctgcataacctggcggcagcgcaaaagatg

SEQ ID NO: 109511 - DNA, 103 bp, Artificial Sequence
  Synthetic Polynucleotide
taatacgactcactatagggcagctctctcttgcctctccgcttccttgtaacagaggagaacaaggatgcggagaggcaacctggcggcagcgcaaaagatg

SEQ ID NO: 109512 - DNA, 103 bp, Artificial Sequence
  Synthetic Polynucleotide
taatacgactcactatagggcagcaaactgtcctttcatgttatgcagcaaacagaggagatgctgcatgacatgaaagaacctggcggcagcgcaaaagatg

SEQ ID NO: 109513 - DNA, 103 bp, Artificial Sequence
  Synthetic Polynucleotide
taatacgactcactatagggagaagatgctcagcaaactgtcctttcatgaacagaggagacatgaaatgacagtttgcaacctggcggcagcgcaaaagatg

SEQ ID NO: 109514 - DNA, 103 bp, Artificial Sequence
  Synthetic Polynucleotide
taatacgactcactatagggtccagctccaagaagatgctcagcaaactgaacagaggagacagtttatggagcatcttaacctggcggcagcgcaaaagatg

SEQ ID NO: 109515 - DNA, 103 bp, Artificial Sequence
  Synthetic Polynucleotide
taatacgactcactatagggtgcttacaaatccagctccaagaagatgctaacagaggagaagcatcatgttggagctgaacctggcggcagcgcaaaagatg

SEQ ID NO: 109516 - DNA, 103 bp, Artificial Sequence
  Synthetic Polynucleotide
taatacgactcactatagggggatttctactgcttacaaatccagctccaaacagaggagatggagcatgatttgtaagaacctggcggcagcgcaaaagatg

SEQ ID NO: 109517 - DNA, 103 bp, Artificial Sequence
  Synthetic Polynucleotide
taatacgactcactatagggtggatctttaggatttctactgcttacaaaaacagaggagatttgtaatgagtagaaataacctggcggcagcgcaaaagatg

SEQ ID NO: 109518 - DNA, 103 bp, Artificial Sequence
  Synthetic Polynucleotide
taatacgactcactatagggtattagattctggatctttaggatttctacaacagaggagagtagaaatgctaaagatcaacctggcggcagcgcaaaagatg

SEQ ID NO: 109519 - DNA, 103 bp, Artificial Sequence
  Synthetic Polynucleotide
taatacgactcactatagggtctgaatttatattagattctggatctttaaacagaggagataaagaatgagaatctaaaacctggcggcagcgcaaaagatg

SEQ ID NO: 109520 - DNA, 103 bp, Artificial Sequence
  Synthetic Polynucleotide
taatacgactcactatagggcttctcattatctgaatttatattagattcaacagaggagagaatctatgataaattcaaacctggcggcagcgcaaaagatg

SEQ ID NO: 109521 - DNA, 103 bp, Artificial Sequence
  Synthetic Polynucleotide
taatacgactcactatagggctttaattatcttctcattatctgaatttaaacagaggagataaattatgataatgagaaacctggcggcagcgcaaaagatg

SEQ ID NO: 109522 - DNA, 103 bp, Artificial Sequence
  Synthetic Polynucleotide
taatacgactcactatagggatgtgtactacagctctctcttgcctctccaacagaggagaggagagatgagagagagcaacctggcggcagcgcaaaagatg

SEQ ID NO: 109523 - DNA, 103 bp, Artificial Sequence
  Synthetic Polynucleotide
taatacgactcactatagggcagatgacagctttaattatcttctcattaaacagaggagataatgaatggataattaaaacctggcggcagcgcaaaagatg

SEQ ID NO: 109524 - DNA, 103 bp, Artificial Sequence
  Synthetic Polynucleotide
taatacgactcactatagggtaaaccagcacagatgacagctttaattataacagaggagaataattatggctgtcatcaacctggcggcagcgcaaaagatg

SEQ ID NO: 109525 - DNA, 103 bp, Artificial Sequence
  Synthetic Polynucleotide
taatacgactcactatagggctttgggatataaaccagcacagatgacagaacagaggagactgtcaatggtgctggttaacctggcggcagcgcaaaagatg

SEQ ID NO: 109526 - DNA, 103 bp, Artificial Sequence
  Synthetic Polynucleotide
taatacgactcactatagggattttagcaactttgggatataaaccagcaaacagaggagatgctggatgatatcccaaaacctggcggcagcgcaaaagatg

SEQ ID NO: 109527 - DNA, 103 bp, Artificial Sequence
  Synthetic Polynucleotide
taatacgactcactatagggatttagtcgaattttagcaactttgggataaacagaggagatatcccatggttgctaaaaacctggcggcagcgcaaaagatg

SEQ ID NO: 109528 - DNA, 103 bp, Artificial Sequence
  Synthetic Polynucleotide
taatacgactcactatagggttttacccaaatttagtcgaattttagcaaaacagaggagattgctaatgttcgactaaaacctggcggcagcgcaaaagatg

SEQ ID NO: 109529 - DNA, 103 bp, Artificial Sequence
  Synthetic Polynucleotide
taatacgactcactatagggatttttctttttttacccaaatttagtcgaaacagaggagatcgactatgtttgggtaaaacctggcggcagcgcaaaagatg

SEQ ID NO: 109530 - DNA, 103 bp, Artificial Sequence
  Synthetic Polynucleotide
taatacgactcactatagggaacttttaccatttttctttttttacccaaaacagaggagattgggtatgaaaagaaaaaacctggcggcagcgcaaaagatg

SEQ ID NO: 109531 - DNA, 103 bp, Artificial Sequence
  Synthetic Polynucleotide
taatacgactcactatagggtttttgtgtaaacttttaccatttttctttaacagaggagaaaagaaatgtggtaaaagaacctggcggcagcgcaaaagatg

SEQ ID NO: 109532 - DNA, 103 bp, Artificial Sequence
  Synthetic Polynucleotide
taatacgactcactatagggaggccatcggtttttgtgtaaacttttaccaacagaggagaggtaaaatgttacacaaaaacctggcggcagcgcaaaagatg

SEQ ID NO: 109533 - DNA, 103 bp, Artificial Sequence
  Synthetic Polynucleotide
taatacgactcactatagggtcgttcatccatgtgtactacagctctctcaacagaggagagagagaatggtagtacacaacctggcggcagcgcaaaagatg

SEQ ID NO: 109534 - DNA, 103 bp, Artificial Sequence
  Synthetic Polynucleotide
taatacgactcactatagggaacagcaaccaggccatcggtttttgtgtaaacagaggagatacacaatgaccgatggcaacctggcggcagcgcaaaagatg

SEQ ID NO: 109535 - DNA, 103 bp, Artificial Sequence
  Synthetic Polynucleotide
taatacgactcactatagggatttaggatgaacagcaaccaggccatcggaacagaggagaccgatgatgtggttgctgaacctggcggcagcgcaaaagatg

SEQ ID NO: 109536 - DNA, 103 bp, Artificial Sequence
  Synthetic Polynucleotide
taatacgactcactatagggacattaacagatttaggatgaacagcaaccaacagaggagaggttgcatgtcatcctaaaacctggcggcagcgcaaaagatg

SEQ ID NO: 109537 - DNA, 103 bp, Artificial Sequence
  Synthetic Polynucleotide
taatacgactcactatagggtgtttgctccacattaacagatttaggatgaacagaggagacatcctatgtctgttaataacctggcggcagcgcaaaagatg

SEQ ID NO: 109538 - DNA, 103 bp, Artificial Sequence
  Synthetic Polynucleotide
taatacgactcactatagggagtgaaagtctgtttgctccacattaacagaacagaggagactgttaatgtggagcaaaaacctggcggcagcgcaaaagatg

SEQ ID NO: 109539 - DNA, 103 bp, Artificial Sequence
  Synthetic Polynucleotide
taatacgactcactatagggagccagttgtagtgaaagtctgtttgctccaacagaggagaggagcaatgagactttcaaacctggcggcagcgcaaaagatg

SEQ ID NO: 109540 - DNA, 103 bp, Artificial Sequence
  Synthetic Polynucleotide
taatacgactcactataggggtgatagataagccagttgtagtgaaagtcaacagaggagagactttatgtacaactggaacctggcggcagcgcaaaagatg

SEQ ID NO: 109541 - DNA, 103 bp, Artificial Sequence
  Synthetic Polynucleotide
taatacgactcactatagggtcatctttaggtgatagataagccagttgtaacagaggagaacaactatgttatctatcaacctggcggcagcgcaaaagatg

SEQ ID NO: 109542 - DNA, 103 bp, Artificial Sequence
  Synthetic Polynucleotide
taatacgactcactatagggctgcttgttctcatctttaggtgatagataaacagaggagatatctaatgcctaaagataacctggcggcagcgcaaaagatg

SEQ ID NO: 109543 - DNA, 103 bp, Artificial Sequence
  Synthetic Polynucleotide
taatacgactcactatagggcaagtatatactgcttgttctcatctttagaacagaggagactaaagatgagaacaagcaacctggcggcagcgcaaaagatg

SEQ ID NO: 109544 - DNA, 103 bp, Artificial Sequence
  Synthetic Polynucleotide
taatacgactcactataggggttcttctcgtcgttcatccatgtgtactaaacagaggagatagtacatgtggatgaacaacctggcggcagcgcaaaagatg

SEQ ID NO: 109545 - DNA, 103 bp, Artificial Sequence
  Synthetic Polynucleotide
taatacgactcactatagggtgcagtcatacaagtatatactgcttgttcaacagaggagagaacaaatggtatatactaacctggcggcagcgcaaaagatg

SEQ ID NO: 109546 - DNA, 103 bp, Artificial Sequence
  Synthetic Polynucleotide
taatacgactcactataggggaaacctctgtgcagtcatacaagtatataaacagaggagatatataatggtatgactgaacctggcggcagcgcaaaagatg

SEQ ID NO: 109547 - DNA, 103 bp, Artificial Sequence
  Synthetic Polynucleotide
taatacgactcactatagggacagtatggggaaacctctgtgcagtcataaacagaggagatatgacatgacagaggttaacctggcggcagcgcaaaagatg

SEQ ID NO: 109548 - DNA, 103 bp, Artificial Sequence
  Synthetic Polynucleotide
taatacgactcactatagggaaaacaagagacagtatggggaaacctctgaacagaggagacagaggatgccccatactaacctggcggcagcgcaaaagatg

SEQ ID NO: 109549 - DNA, 103 bp, Artificial Sequence
  Synthetic Polynucleotide
taatacgactcactatagggtcacctccaaaaaacaagagacagtatgggaacagaggagacccataatgtctcttgttaacctggcggcagcgcaaaagatg

SEQ ID NO: 109550 - DNA, 103 bp, Artificial Sequence
  Synthetic Polynucleotide
taatacgactcactataggggatggaaatgtcacctccaaaaaacaagagaacagaggagactcttgatgtttggaggtaacctggcggcagcgcaaaagatg

SEQ ID NO: 109551 - DNA, 103 bp, Artificial Sequence
  Synthetic Polynucleotide
taatacgactcactatagggtatccttctggatggaaatgtcacctccaaaacagaggagattggagatgacatttccaaacctggcggcagcgcaaaagatg

SEQ ID NO: 109552 - DNA, 103 bp, Artificial Sequence
  Synthetic Polynucleotide
taatacgactcactatagggtcctgatcgttatccttctggatggaaatgaacagaggagacatttcatgccagaaggaaacctggcggcagcgcaaaagatg

SEQ ID NO: 109553 - DNA, 103 bp, Artificial Sequence
  Synthetic Polynucleotide
taatacgactcactatagggagcaatagtttcctgatcgttatccttctgaacagaggagacagaagatgaacgatcagaacctggcggcagcgcaaaagatg

SEQ ID NO: 109554 - DNA, 103 bp, Artificial Sequence
  Synthetic Polynucleotide
taatacgactcactatagggactcatctacagcaatagtttcctgatcgtaacagaggagaacgatcatgaaactattgaacctggcggcagcgcaaaagatg

SEQ ID NO: 109555 - DNA, 103 bp, Artificial Sequence
  Synthetic Polynucleotide
taatacgactcactatagggtgtacaatttgttcttctcgtcgttcatccaacagaggagaggatgaatgacgagaagaaacctggcggcagcgcaaaagatg

SEQ ID NO: 109556 - DNA, 103 bp, Artificial Sequence
  Synthetic Polynucleotide
taatacgactcactatagggaatacaatccactcatctacagcaatagttaacagaggagaaactatatgtgtagatgaaacctggcggcagcgcaaaagatg

SEQ ID NO: 109557 - DNA, 103 bp, Artificial Sequence
  Synthetic Polynucleotide
taatacgactcactatagggtggagactgaaatacaatccactcatctacaacagaggagagtagatatgtggattgtaaacctggcggcagcgcaaaagatg

SEQ ID NO: 109558 - DNA, 103 bp, Artificial Sequence
  Synthetic Polynucleotide
taatacgactcactatagggcaattcttgctggagactgaaatacaatccaacagaggagaggattgatgttcagtctcaacctggcggcagcgcaaaagatg

SEQ ID NO: 109559 - DNA, 103 bp, Artificial Sequence
  Synthetic Polynucleotide
taatacgactcactatagggacaagatgggcaattcttgctggagactgaaacagaggagatcagtcatgagcaagaataacctggcggcagcgcaaaagatg

SEQ ID NO: 109560 - DNA, 103 bp, Artificial Sequence
  Synthetic Polynucleotide
taatacgactcactatagggtaattccttaacaagatgggcaattcttgcaacagaggagagcaagaatggcccatcttaacctggcggcagcgcaaaagatg

SEQ ID NO: 109561 - DNA, 103 bp, Artificial Sequence
  Synthetic Polynucleotide
taatacgactcactataggggttcctttcttaattccttaacaagatgggaacagaggagacccatcatgttaaggaataacctggcggcagcgcaaaagatg

SEQ ID NO: 109562 - DNA, 103 bp, Artificial Sequence
  Synthetic Polynucleotide
taatacgactcactatagggagaatatctagttcctttcttaattccttaaacagaggagataaggaatgaagaaaggaaacctggcggcagcgcaaaagatg

SEQ ID NO: 109563 - DNA, 103 bp, Artificial Sequence
  Synthetic Polynucleotide
taatacgactcactatagggctcttgcagaagaatatctagttcctttctaacagaggagaagaaagatgctagatattaacctggcggcagcgcaaaagatg

SEQ ID NO: 109564 - DNA, 103 bp, Artificial Sequence
  Synthetic Polynucleotide
taatacgactcactatagggtttcaatcttctcttgcagaagaatatctaaacagaggagatagataatgttctgcaagaacctggcggcagcgcaaaagatg

SEQ ID NO: 109565 - DNA, 103 bp, Artificial Sequence
  Synthetic Polynucleotide
taatacgactcactatagggggatgaggactttcaatcttctcttgcagaaacagaggagatctgcaatggaagattgaaacctggcggcagcgcaaaagatg

SEQ ID NO: 109566 - DNA, 103 bp, Artificial Sequence
  Synthetic Polynucleotide
taatacgactcactatagggattcagtaactgtacaatttgttcttctcgaacagaggagacgagaaatgcaaattgtaaacctggcggcagcgcaaaagatg

SEQ ID NO: 109567 - DNA, 103 bp, Artificial Sequence
  Synthetic Polynucleotide
taatacgactcactatagggccagtctacaggatgaggactttcaatcttaacagaggagaaagattatgagtcctcataacctggcggcagcgcaaaagatg

SEQ ID NO: 109568 - DNA, 103 bp, Artificial Sequence
  Synthetic Polynucleotide
taatacgactcactatagggtagtgtcattccagtctacaggatgaggacaacagaggagagtcctcatgctgtagactaacctggcggcagcgcaaaagatg

SEQ ID NO: 109569 - DNA, 103 bp, Artificial Sequence
  Synthetic Polynucleotide
taatacgactcactatagggtctctggatttagtgtcattccagtctacaaacagaggagatgtagaatggaatgacacaacctggcggcagcgcaaaagatg

SEQ ID NO: 109570 - DNA, 103 bp, Artificial Sequence
  Synthetic Polynucleotide
taatacgactcactatagggtactgcacagtctctggatttagtgtcattaacagaggagaaatgacatgaaatccagaaacctggcggcagcgcaaaagatg

SEQ ID NO: 109571 - DNA, 103 bp, Artificial Sequence
  Synthetic Polynucleotide
taatacgactcactatagggtagctgacagtactgcacagtctctggattaacagaggagaaatccaatgactgtgcagaacctggcggcagcgcaaaagatg

SEQ ID NO: 109572 - DNA, 103 bp, Artificial Sequence
  Synthetic Polynucleotide
taatacgactcactatagggaagtctataatagctgacagtactgcacagaacagaggagactgtgcatgactgtcagcaacctggcggcagcgcaaaagatg

SEQ ID NO: 109573 - DNA, 103 bp, Artificial Sequence
  Synthetic Polynucleotide
taatacgactcactatagggtgttttgatcaagtctataatagctgacagaacagaggagactgtcaatgattatagacaacctggcggcagcgcaaaagatg

SEQ ID NO: 109574 - DNA, 103 bp, Artificial Sequence
  Synthetic Polynucleotide
taatacgactcactatagggccttttcctgtgttttgatcaagtctataaaacagaggagattatagatgtgatcaaaaaacctggcggcagcgcaaaagatg

SEQ ID NO: 109575 - DNA, 103 bp, Artificial Sequence
  Synthetic Polynucleotide
taatacgactcactatagggctgggagttgccttttcctgtgttttgatcaacagaggagagatcaaatgacaggaaaaaacctggcggcagcgcaaaagatg

SEQ ID NO: 109576 - DNA, 103 bp, Artificial Sequence
  Synthetic Polynucleotide
taatacgactcactatagggcggaaagttcctgggagttgccttttcctgaacagaggagacaggaaatggcaactcccaacctggcggcagcgcaaaagatg

SEQ ID NO: 109577 - DNA, 103 bp, Artificial Sequence
  Synthetic Polynucleotide
taatacgactcactatagggcttgaacagaattcagtaactgtacaatttaacagaggagaaaattgatgagttactgaaacctggcggcagcgcaaaagatg

SEQ ID NO: 109578 - DNA, 103 bp, Artificial Sequence
  Synthetic Polynucleotide
taatacgactcactatagggggaatcgtggcggaaagttcctgggagttgaacagaggagacaactcatgggaactttcaacctggcggcagcgcaaaagatg

SEQ ID NO: 109579 - DNA, 103 bp, Artificial Sequence
  Synthetic Polynucleotide
taatacgactcactatagggtatccatcctggaatcgtggcggaaagttcaacagaggagagaacttatggccacgattaacctggcggcagcgcaaaagatg

SEQ ID NO: 109580 - DNA, 103 bp, Artificial Sequence
  Synthetic Polynucleotide
taatacgactcactatagggtcagctgtaatatccatcctggaatcgtggaacagaggagaccacgaatgcaggatggaaacctggcggcagcgcaaaagatg

SEQ ID NO: 109581 - DNA, 103 bp, Artificial Sequence
  Synthetic Polynucleotide
taatacgactcactatagggctgcggggacccccatcacggccccagttcaacagaggagagaactgatgccgtgatggaacctggcggcagcgcaaaagatg

SEQ ID NO: 109582 - DNA, 103 bp, Artificial Sequence
  Synthetic Polynucleotide
taatacgactcactatagggtcattcttcgcttgaacagaattcagtaacaacagaggagagttactatgttctgttcaaacctggcggcagcgcaaaagatg

SEQ ID NO: 109583 - DNA, 103 bp, Artificial Sequence
  Synthetic Polynucleotide
taatacgactcactatagggtgactctttatcattcttcgcttgaacagaaacagaggagatctgttatggcgaagaataacctggcggcagcgcaaaagatg

SEQ ID NO: 109584 - DNA, 103 bp, Artificial Sequence
  Synthetic Polynucleotide
taatacgactcactatagggtctgtgcttctgactctttatcattcttcgaacagaggagacgaagaatgataaagagtaacctggcggcagcgcaaaagatg

SEQ ID NO: 109585 - DNA, 103 bp, Artificial Sequence
  Synthetic Polynucleotide
taatacgactcactatagggaaccaggatatctgtgcttctgactctttaaacagaggagataaagaatgagaagcacaaacctggcggcagcgcaaaagatg

SEQ ID NO: 109586 - DNA, 103 bp, Artificial Sequence
  Synthetic Polynucleotide
taatacgactcactatagggctcaggagcaaaccaggatatctgtgcttcaacagaggagagaagcaatgatatcctggaacctggcggcagcgcaaaagatg

SEQ ID NO: 109587 - DNA, 103 bp, Artificial Sequence
  Synthetic Polynucleotide
taatacgactcactatagggatccatgatcctcaggagcaaaccaggataaacagaggagatatcctatgttgctcctgaacctggcggcagcgcaaaagatg

SEQ ID NO: 109588 - DNA, 103 bp, Artificial Sequence
  Synthetic Polynucleotide
taatacgactcactatagggtcagtaccgtatccatgatcctcaggagcaaacagaggagatgctccatgggatcatggaacctggcggcagcgcaaaagatg

SEQ ID NO: 109589 - DNA, 103 bp, Artificial Sequence
  Synthetic Polynucleotide
taatacgactcactatagggagtagaaacttcagtaccgtatccatgatcaacagaggagagatcatatgtacggtactaacctggcggcagcgcaaaagatg

SEQ ID NO: 109590 - DNA, 103 bp, Artificial Sequence
  Synthetic Polynucleotide
taatacgactcactataggggtgtgttcttagtagaaacttcagtaccgtaacagaggagaacggtaatgaagtttctaaacctggcggcagcgcaaaagatg

SEQ ID NO: 109591 - DNA, 103 bp, Artificial Sequence
  Synthetic Polynucleotide
taatacgactcactatagggtctgagcatggtgtgttcttagtagaaactaacagaggagaagtttcatgtaagaacacaacctggcggcagcgcaaaagatg

SEQ ID NO: 109592 - DNA, 103 bp, Artificial Sequence
  Synthetic Polynucleotide
taatacgactcactatagggcccaccggagctgcggggacccccatcacgaacagaggagacgtgatatgggtccccgcaacctggcggcagcgcaaaagatg

SEQ ID NO: 109593 - DNA, 103 bp, Artificial Sequence
  Synthetic Polynucleotide
taatacgactcactatagggaagtttgttctctgagcatggtgtgttcttaacagaggagaaagaacatgccatgctcaaacctggcggcagcgcaaaagatg

SEQ ID NO: 109594 - DNA, 103 bp, Artificial Sequence
  Synthetic Polynucleotide
taatacgactcactatagggcctggatgtcaagtttgttctctgagcatgaacagaggagacatgctatgagaacaaacaacctggcggcagcgcaaaagatg

SEQ ID NO: 109595 - DNA, 103 bp, Artificial Sequence
  Synthetic Polynucleotide
taatacgactcactatagggaacttcttttcctggatgtcaagtttgttcaacagaggagagaacaaatgtgacatccaaacctggcggcagcgcaaaagatg

SEQ ID NO: 109596 - DNA, 103 bp, Artificial Sequence
  Synthetic Polynucleotide
taatacgactcactatagggttgatttatcaacttcttttcctggatgtcaacagaggagagacatcatggaaaagaagaacctggcggcagcgcaaaagatg

SEQ ID NO: 109597 - DNA, 103 bp, Artificial Sequence
  Synthetic Polynucleotide
taatacgactcactatagggtttttttttcttgatttatcaacttcttttaacagaggagaaaaagaatgtgataaatcaacctggcggcagcgcaaaagatg

SEQ ID NO: 109598 - DNA, 103 bp, Artificial Sequence
  Synthetic Polynucleotide
taatacgactcactatagggattctaaacatttttttttcttgatttatcaacagaggagagataaaatgagaaaaaaaaacctggcggcagcgcaaaagatg

SEQ ID NO: 109599 - DNA, 103 bp, Artificial Sequence
  Synthetic Polynucleotide
taatacgactcactatagggtctgttcctgattctaaacatttttttttcaacagaggagagaaaaaatgatgtttagaaacctggcggcagcgcaaaagatg

SEQ ID NO: 109600 - DNA, 103 bp, Artificial Sequence
  Synthetic Polynucleotide
taatacgactcactatagggcaatatatgatctgttcctgattctaaacaaacagaggagatgtttaatgtcaggaacaaacctggcggcagcgcaaaagatg

SEQ ID NO: 109601 - DNA, 103 bp, Artificial Sequence
  Synthetic Polynucleotide
taatacgactcactataggggaatctcggtcaatatatgatctgttcctgaacagaggagacaggaaatgatcatatataacctggcggcagcgcaaaagatg

SEQ ID NO: 109602 - DNA, 103 bp, Artificial Sequence
  Synthetic Polynucleotide
taatacgactcactataggggagatactcagaatctcggtcaatatatgaaacagaggagatcatatatggaccgagataacctggcggcagcgcaaaagatg

SEQ ID NO: 109603 - DNA, 103 bp, Artificial Sequence
  Synthetic Polynucleotide
taatacgactcactatagggctccatagcccccaccggagctgcggggacaacagaggagagtccccatggctccggtgaacctggcggcagcgcaaaagatg

SEQ ID NO: 109604 - DNA, 103 bp, Artificial Sequence
  Synthetic Polynucleotide
taatacgactcactatagggtttcttgcaagagatactcagaatctcggtaacagaggagaaccgagatgctgagtatcaacctggcggcagcgcaaaagatg

SEQ ID NO: 109605 - DNA, 103 bp, Artificial Sequence
  Synthetic Polynucleotide
taatacgactcactatagggtctggttcattttcttgcaagagatactcaaacagaggagatgagtaatgcttgcaagaaacctggcggcagcgcaaaagatg

SEQ ID NO: 109606 - DNA, 103 bp, Artificial Sequence
  Synthetic Polynucleotide
taatacgactcactatagggtaaagttccatctggttcattttcttgcaaaacagaggagattgcaaatgaatgaaccaaacctggcggcagcgcaaaagatg

SEQ ID NO: 109607 - DNA, 103 bp, Artificial Sequence
  Synthetic Polynucleotide
taatacgactcactatagggatttttggtctaaagttccatctggttcataacagaggagaatgaacatgatggaacttaacctggcggcagcgcaaaagatg

SEQ ID NO: 109608 - DNA, 103 bp, Artificial Sequence
  Synthetic Polynucleotide
taatacgactcactatagggtcttccaataatttttggtctaaagttccaaacagaggagatggaacatgagaccaaaaaacctggcggcagcgcaaaagatg

SEQ ID NO: 109609 - DNA, 103 bp, Artificial Sequence
  Synthetic Polynucleotide
taatacgactcactatagggcttttgtaaatcttccaataatttttggtcaacagaggagagaccaaatgttattggaaaacctggcggcagcgcaaaagatg

SEQ ID NO: 109610 - DNA, 103 bp, Artificial Sequence
  Synthetic Polynucleotide
taatacgactcactatagggcattttttttcttttgtaaatcttccaataaacagaggagatattggatgatttacaaaaacctggcggcagcgcaaaagatg

SEQ ID NO: 109611 - DNA, 103 bp, Artificial Sequence
  Synthetic Polynucleotide
taatacgactcactatagggtaccgaaggtcattttttttcttttgtaaaaacagaggagatttacaatggaaaaaaaaaacctggcggcagcgcaaaagatg

SEQ ID NO: 109612 - DNA, 103 bp, Artificial Sequence
  Synthetic Polynucleotide
taatacgactcactatagggcatttcaatataccgaaggtcattttttttaacagaggagaaaaaaaatggaccttcggaacctggcggcagcgcaaaagatg

SEQ ID NO: 109613 - DNA, 103 bp, Artificial Sequence
  Synthetic Polynucleotide
taatacgactcactatagggtgaaatgctgcatttcaatataccgaaggtaacagaggagaaccttcatgatattgaaaaacctggcggcagcgcaaaagatg

SEQ ID NO: 109614 - DNA, 103 bp, Artificial Sequence
  Synthetic Polynucleotide
taatacgactcactataggggctggcccccctccatagcccccaccggagaacagaggagactccggatggggctatggaacctggcggcagcgcaaaagatg

SEQ ID NO: 109615 - DNA, 103 bp, Artificial Sequence
  Synthetic Polynucleotide
taatacgactcactatagggagcttttctctgaaatgctgcatttcaataaacagaggagatattgaatggcagcatttaacctggcggcagcgcaaaagatg

SEQ ID NO: 109616 - DNA, 103 bp, Artificial Sequence
  Synthetic Polynucleotide
taatacgactcactatagggatacgaaggcagcttttctctgaaatgctgaacagaggagacagcatatgagagaaaagaacctggcggcagcgcaaaagatg

SEQ ID NO: 109617 - DNA, 103 bp, Artificial Sequence
  Synthetic Polynucleotide
taatacgactcactatagggtttgcattccatacgaaggcagcttttctcaacagaggagagagaaaatgtgccttcgtaacctggcggcagcgcaaaagatg

SEQ ID NO: 109618 - DNA, 103 bp, Artificial Sequence
  Synthetic Polynucleotide
taatacgactcactatagggaccaattccttttgcattccatacgaaggcaacagaggagagccttcatgtggaatgcaaacctggcggcagcgcaaaagatg

SEQ ID NO: 109619 - DNA, 103 bp, Artificial Sequence
  Synthetic Polynucleotide
taatacgactcactatagggaattaaatttaccaattccttttgcattccaacagaggagaggaatgatgaaggaattgaacctggcggcagcgcaaaagatg

SEQ ID NO: 109620 - DNA, 103 bp, Artificial Sequence
  Synthetic Polynucleotide
taatacgactcactataggggatggttatcaattaaatttaccaattcctaacagaggagaaggaatatgtaaatttaaaacctggcggcagcgcaaaagatg

SEQ ID NO: 109621 - DNA, 103 bp, Artificial Sequence
  Synthetic Polynucleotide
taatacgactcactatagggactgttacctgatggttatcaattaaatttaacagaggagaaaatttatgtgataaccaaacctggcggcagcgcaaaagatg

SEQ ID NO: 109622 - DNA, 103 bp, Artificial Sequence
  Synthetic Polynucleotide
taatacgactcactatagggaccacttattactgttacctgatggttatcaacagaggagagataacatgcaggtaacaaacctggcggcagcgcaaaagatg

SEQ ID NO: 109623 - DNA, 103 bp, Artificial Sequence
  Synthetic Polynucleotide
taatacgactcactatagggaaccagtttcaccacttattactgttacctaacagaggagaaggtaaatgtaataagtgaacctggcggcagcgcaaaagatg

SEQ ID NO: 109624 - DNA, 103 bp, Artificial Sequence
  Synthetic Polynucleotide
taatacgactcactataggggttttgccacaaccagtttcaccacttattaacagaggagaaataagatgtgaaactggaacctggcggcagcgcaaaagatg

SEQ ID NO: 109625 - DNA, 103 bp, Artificial Sequence
  Synthetic Polynucleotide
taatacgactcactatagggatgaccccctgctggcccccctccatagccaacagaggagaggctatatgggggggccaaacctggcggcagcgcaaaagatg

SEQ ID NO: 109626 - DNA, 103 bp, Artificial Sequence
  Synthetic Polynucleotide
taatacgactcactatagggaacttgagtggttttgccacaaccagtttcaacagaggagagaaactatgtgtggcaaaaacctggcggcagcgcaaaagatg

SEQ ID NO: 109627 - DNA, 103 bp, Artificial Sequence
  Synthetic Polynucleotide
taatacgactcactatagggtgaactgagtaacttgagtggttttgccacaacagaggagagtggcaatgccactcaagaacctggcggcagcgcaaaagatg

SEQ ID NO: 109628 - DNA, 103 bp, Artificial Sequence
  Synthetic Polynucleotide
taatacgactcactatagggttatccaaaatgaactgagtaacttgagtgaacagaggagacactcaatgtactcagttaacctggcggcagcgcaaaagatg

SEQ ID NO: 109629 - DNA, 103 bp, Artificial Sequence
  Synthetic Polynucleotide
taatacgactcactatagggttcaatgtagttatccaaaatgaactgagtaacagaggagaactcagatgattttggataacctggcggcagcgcaaaagatg

SEQ ID NO: 109630 - DNA, 103 bp, Artificial Sequence
  Synthetic Polynucleotide
taatacgactcactatagggcttttcctctttcaatgtagttatccaaaaaacagaggagattttggatgactacattgaacctggcggcagcgcaaaagatg

SEQ ID NO: 109631 - DNA, 103 bp, Artificial Sequence
  Synthetic Polynucleotide
taatacgactcactatagggcaagcagatccttttcctctttcaatgtagaacagaggagactacatatgaagaggaaaaacctggcggcagcgcaaaagatg

SEQ ID NO: 109632 - DNA, 103 bp, Artificial Sequence
  Synthetic Polynucleotide
taatacgactcactatagggaactattctgcaagcagatccttttcctctaacagaggagaagaggaatgggatctgctaacctggcggcagcgcaaaagatg

SEQ ID NO: 109633 - DNA, 103 bp, Artificial Sequence
  Synthetic Polynucleotide
taatacgactcactataggggctgagtacaaactattctgcaagcagatcaacagaggagagatctgatggcagaatagaacctggcggcagcgcaaaagatg

SEQ ID NO: 109634 - DNA, 103 bp, Artificial Sequence
  Synthetic Polynucleotide
taatacgactcactatagggattcttcttggctgagtacaaactattctgaacagaggagacagaatatgttgtactcaaacctggcggcagcgcaaaagatg

SEQ ID NO: 109635 - DNA, 103 bp, Artificial Sequence
  Synthetic Polynucleotide
taatacgactcactatagggaatggcactaattcttcttggctgagtacaaacagaggagatgtactatgccaagaagaaacctggcggcagcgcaaaagatg

SEQ ID NO: 109636 - DNA, 103 bp, Artificial Sequence
  Synthetic Polynucleotide
taatacgactcactatagggggttacctccatgaccccctgctggcccccaacagaggagagggggcatgcagggggtcaacctggcggcagcgcaaaagatg

SEQ ID NO: 109637 - DNA, 103 bp, Artificial Sequence
  Synthetic Polynucleotide
taatacgactcactatagggccgcaactgaaatggcactaattcttcttgaacagaggagacaagaaatgttagtgccaaacctggcggcagcgcaaaagatg

SEQ ID NO: 109638 - DNA, 103 bp, Artificial Sequence
  Synthetic Polynucleotide
taatacgactcactataggggctactctttccgcaactgaaatggcactaaacagaggagatagtgcatgttcagttgcaacctggcggcagcgcaaaagatg

SEQ ID NO: 109639 - DNA, 103 bp, Artificial Sequence
  Synthetic Polynucleotide
taatacgactcactatagggcctttctgcagctactctttccgcaactgaaacagaggagatcagttatggaaagagtaaacctggcggcagcgcaaaagatg

SEQ ID NO: 109640 - DNA, 103 bp, Artificial Sequence
  Synthetic Polynucleotide
taatacgactcactatagggaagattctgccctttctgcagctactctttaacagaggagaaaagagatgctgcagaaaaacctggcggcagcgcaaaagatg

SEQ ID NO: 109641 - DNA, 103 bp, Artificial Sequence
  Synthetic Polynucleotide
taatacgactcactatagggccactgccacaagattctgccctttctgcaaacagaggagatgcagaatgggcagaatcaacctggcggcagcgcaaaagatg

SEQ ID NO: 109642 - DNA, 103 bp, Artificial Sequence
  Synthetic Polynucleotide
taatacgactcactatagggagtactattaccactgccacaagattctgcaacagaggagagcagaaatgtgtggcagtaacctggcggcagcgcaaaagatg

SEQ ID NO: 109643 - DNA, 103 bp, Artificial Sequence
  Synthetic Polynucleotide
taatacgactcactatagggtttgatatccagtactattaccactgccacaacagaggagagtggcaatggtaatagtaaacctggcggcagcgcaaaagatg

SEQ ID NO: 109644 - DNA, 103 bp, Artificial Sequence
  Synthetic Polynucleotide
taatacgactcactatagggtggagacgaatttgatatccagtactattaaacagaggagataatagatgtggatatcaaacctggcggcagcgcaaaagatg

SEQ ID NO: 109645 - DNA, 103 bp, Artificial Sequence
  Synthetic Polynucleotide
taatacgactcactatagggcaaccgactctggagacgaatttgatatccaacagaggagaggatatatgattcgtctcaacctggcggcagcgcaaaagatg

SEQ ID NO: 109646 - DNA, 103 bp, Artificial Sequence
  Synthetic Polynucleotide
taatacgactcactataggggtttccttggcaaccgactctggagacgaaaacagaggagattcgtcatgagagtcggtaacctggcggcagcgcaaaagatg

SEQ ID NO: 109647 - DNA, 103 bp, Artificial Sequence
  Synthetic Polynucleotide
taatacgactcactatagggccggagcctcggttacctccatgaccccctaacagaggagaagggggatgtggaggtaaaacctggcggcagcgcaaaagatg

SEQ ID NO: 109648 - DNA, 103 bp, Artificial Sequence
  Synthetic Polynucleotide
taatacgactcactatagggatagaaccctgtttccttggcaaccgactcaacagaggagagagtcgatggccaaggaaaacctggcggcagcgcaaaagatg

SEQ ID NO: 109649 - DNA, 103 bp, Artificial Sequence
  Synthetic Polynucleotide
taatacgactcactatagggacagtataagatagaaccctgtttccttggaacagaggagaccaaggatgcagggttctaacctggcggcagcgcaaaagatg

SEQ ID NO: 109650 - DNA, 103 bp, Artificial Sequence
  Synthetic Polynucleotide
taatacgactcactatagggttcctgttgtacagtataagatagaaccctaacagaggagaagggttatgtcttatactaacctggcggcagcgcaaaagatg

SEQ ID NO: 109651 - DNA, 103 bp, Artificial Sequence
  Synthetic Polynucleotide
taatacgactcactatagggtgaaggatgattcctgttgtacagtataagaacagaggagacttataatgtacaacaggaacctggcggcagcgcaaaagatg

SEQ ID NO: 109652 - DNA, 103 bp, Artificial Sequence
  Synthetic Polynucleotide
taatacgactcactatagggctggagccactgaaggatgattcctgttgtaacagaggagaacaacaatgatcatccttaacctggcggcagcgcaaaagatg

SEQ ID NO: 109653 - DNA, 103 bp, Artificial Sequence
  Synthetic Polynucleotide
taatacgactcactatagggacgggtctgactggagccactgaaggatgaaacagaggagatcatccatgagtggctccaacctggcggcagcgcaaaagatg

SEQ ID NO: 109654 - DNA, 103 bp, Artificial Sequence
  Synthetic Polynucleotide
taatacgactcactatagggctggacaaatacgggtctgactggagccacaacagaggagagtggctatggtcagacccaacctggcggcagcgcaaaagatg

SEQ ID NO: 109655 - DNA, 103 bp, Artificial Sequence
  Synthetic Polynucleotide
taatacgactcactatagggatgactaacactggacaaatacgggtctgaaacagaggagatcagacatgtatttgtccaacctggcggcagcgcaaaagatg

SEQ ID NO: 109656 - DNA, 103 bp, Artificial Sequence
  Synthetic Polynucleotide
taatacgactcactatagggcaagtacgatatgactaacactggacaaataacagaggagaatttgtatggtgttagtcaacctggcggcagcgcaaaagatg

SEQ ID NO: 109657 - DNA, 103 bp, Artificial Sequence
  Synthetic Polynucleotide
taatacgactcactatagggtggatttcatcaagtacgatatgactaacaaacagaggagatgttagatgtatcgtactaacctggcggcagcgcaaaagatg

SEQ ID NO: 109658 - DNA, 103 bp, Artificial Sequence
  Synthetic Polynucleotide
taatacgactcactatagggggcatacagaaaatttttaacgtcacccataacagaggagaatgggtatggttaaaaataacctggcggcagcgcaaaagatg

SEQ ID NO: 109659 - DNA, 103 bp, Artificial Sequence
  Synthetic Polynucleotide
taatacgactcactatagggcacctgaacctcacacatgaatttctgcctaacagaggagaaggcagatgttcatgtgtaacctggcggcagcgcaaaagatg

SEQ ID NO: 109660 - DNA, 103 bp, Artificial Sequence
  Synthetic Polynucleotide
taatacgactcactatagggattccagttggattgtggaggtgaccaaggaacagaggagaccttggatgcctccacaaaacctggcggcagcgcaaaagatg

SEQ ID NO: 109661 - DNA, 103 bp, Artificial Sequence
  Synthetic Polynucleotide
taatacgactcactatagggtagtccaaggattccagttggattgtggagaacagaggagactccacatgccaactggaaacctggcggcagcgcaaaagatg

SEQ ID NO: 109662 - DNA, 103 bp, Artificial Sequence
  Synthetic Polynucleotide
taatacgactcactatagggatgttgctactagtccaaggattccagttgaacagaggagacaactgatgtccttggacaacctggcggcagcgcaaaagatg

SEQ ID NO: 109663 - DNA, 103 bp, Artificial Sequence
  Synthetic Polynucleotide
taatacgactcactatagggcccctcatcaatgttgctactagtccaaggaacagaggagaccttggatgagtagcaacaacctggcggcagcgcaaaagatg

SEQ ID NO: 109664 - DNA, 103 bp, Artificial Sequence
  Synthetic Polynucleotide
taatacgactcactatagggaagccagaggcccctcatcaatgttgctacaacagaggagagtagcaatgttgatgaggaacctggcggcagcgcaaaagatg

SEQ ID NO: 109665 - DNA, 103 bp, Artificial Sequence
  Synthetic Polynucleotide
taatacgactcactatagggggagtagcaaaagccagaggcccctcatcaaacagaggagatgatgaatggcctctggcaacctggcggcagcgcaaaagatg

SEQ ID NO: 109666 - DNA, 103 bp, Artificial Sequence
  Synthetic Polynucleotide
taatacgactcactatagggtatttgctctggagtagcaaaagccagaggaacagaggagacctctgatgtttgctactaacctggcggcagcgcaaaagatg

SEQ ID NO: 109667 - DNA, 103 bp, Artificial Sequence
  Synthetic Polynucleotide
taatacgactcactatagggggtccatgcttatttgctctggagtagcaaaacagaggagattgctaatgcagagcaaaaacctggcggcagcgcaaaagatg

SEQ ID NO: 109668 - DNA, 103 bp, Artificial Sequence
  Synthetic Polynucleotide
taatacgactcactatagggtcattcttgaggtccatgcttatttgctctaacagaggagaagagcaatgaagcatggaaacctggcggcagcgcaaaagatg

SEQ ID NO: 109669 - DNA, 103 bp, Artificial Sequence
  Synthetic Polynucleotide
taatacgactcactataggggtacatcaattcattcttgaggtccatgctaacagaggagaagcatgatgctcaagaataacctggcggcagcgcaaaagatg

SEQ ID NO: 109670 - DNA, 103 bp, Artificial Sequence
  Synthetic Polynucleotide
taatacgactcactatagggtataaccttccacctgaacctcacacatgaaacagaggagatcatgtatgaggttcaggaacctggcggcagcgcaaaagatg

SEQ ID NO: 109671 - DNA, 103 bp, Artificial Sequence
  Synthetic Polynucleotide
taatacgactcactataggggttccaactggtacatcaattcattcttgaaacagaggagatcaagaatgaattgatgtaacctggcggcagcgcaaaagatg

SEQ ID NO: 109672 - DNA, 103 bp, Artificial Sequence
  Synthetic Polynucleotide
taatacgactcactatagggtcatgatcctgttccaactggtacatcaataacagaggagaattgatatgccagttggaaacctggcggcagcgcaaaagatg

SEQ ID NO: 109673 - DNA, 103 bp, Artificial Sequence
  Synthetic Polynucleotide
taatacgactcactatagggtgcttgcaaatcatgatcctgttccaactgaacagaggagacagttgatgcaggatcataacctggcggcagcgcaaaagatg

SEQ ID NO: 109674 - DNA, 103 bp, Artificial Sequence
  Synthetic Polynucleotide
taatacgactcactatagggcctgcaagattgcttgcaaatcatgatcctaacagaggagaaggatcatgatttgcaagaacctggcggcagcgcaaaagatg

SEQ ID NO: 109675 - DNA, 103 bp, Artificial Sequence
  Synthetic Polynucleotide
taatacgactcactatagggaactctctctcctgcaagattgcttgcaaaaacagaggagatttgcaatgaatcttgcaaacctggcggcagcgcaaaagatg

SEQ ID NO: 109676 - DNA, 103 bp, Artificial Sequence
  Synthetic Polynucleotide
taatacgactcactatagggcacaggcagtaactctctctcctgcaagataacagaggagaatcttgatggagagagagaacctggcggcagcgcaaaagatg

SEQ ID NO: 109677 - DNA, 103 bp, Artificial Sequence
  Synthetic Polynucleotide
taatacgactcactatagggcaaatttcttcacaggcagtaactctctctaacagaggagaagagagatgtactgcctgaacctggcggcagcgcaaaagatg

SEQ ID NO: 109678 - DNA, 103 bp, Artificial Sequence
  Synthetic Polynucleotide
taatacgactcactatagggatctcactttcaaatttcttcacaggcagtaacagaggagaactgccatggaagaaattaacctggcggcagcgcaaaagatg

SEQ ID NO: 109679 - DNA, 103 bp, Artificial Sequence
  Synthetic Polynucleotide
taatacgactcactatagggtgcttccagaatctcactttcaaatttcttaacagaggagaaagaaaatggaaagtgagaacctggcggcagcgcaaaagatg

SEQ ID NO: 109680 - DNA, 103 bp, Artificial Sequence
  Synthetic Polynucleotide
taatacgactcactatagggtttggctgattgcttccagaatctcactttaacagaggagaaaagtgatgttctggaagaacctggcggcagcgcaaaagatg

SEQ ID NO: 109681 - DNA, 103 bp, Artificial Sequence
  Synthetic Polynucleotide
taatacgactcactatagggccagtgtaattataaccttccacctgaaccaacagaggagaggttcaatgggaaggttaaacctggcggcagcgcaaaagatg

SEQ ID NO: 109682 - DNA, 103 bp, Artificial Sequence
  Synthetic Polynucleotide
taatacgactcactatagggacaactgaattttggctgattgcttccagaaacagaggagatctggaatgaatcagccaaacctggcggcagcgcaaaagatg

SEQ ID NO: 109683 - DNA, 103 bp, Artificial Sequence
  Synthetic Polynucleotide
taatacgactcactatagggtctaataatgacaactgaattttggctgataacagaggagaatcagcatgaattcagttaacctggcggcagcgcaaaagatg

SEQ ID NO: 109684 - DNA, 103 bp, Artificial Sequence
  Synthetic Polynucleotide
taatacgactcactatagggcagtagcccctctaataatgacaactgaataacagaggagaattcagatgtcattattaaacctggcggcagcgcaaaagatg

SEQ ID NO: 109685 - DNA, 103 bp, Artificial Sequence
  Synthetic Polynucleotide
taatacgactcactatagggttcccacatccagtagcccctctaataatgaacagaggagacattatatgaggggctacaacctggcggcagcgcaaaagatg

SEQ ID NO: 109686 - DNA, 103 bp, Artificial Sequence
  Synthetic Polynucleotide
taatacgactcactatagggctgtgtggttttcccacatccagtagccccaacagaggagaggggctatgggatgtgggaacctggcggcagcgcaaaagatg

SEQ ID NO: 109687 - DNA, 103 bp, Artificial Sequence
  Synthetic Polynucleotide
taatacgactcactatagggactggggaacctgtgtggttttcccacatcaacagaggagagatgtgatgaaaccacacaacctggcggcagcgcaaaagatg

SEQ ID NO: 109688 - DNA, 103 bp, Artificial Sequence
  Synthetic Polynucleotide
taatacgactcactatagggtctagaatgaactggggaacctgtgtggttaacagaggagaaaccacatgggttccccaaacctggcggcagcgcaaaagatg

SEQ ID NO: 109689 - DNA, 103 bp, Artificial Sequence
  Synthetic Polynucleotide
taatacgactcactataggggataaagtcatctagaatgaactggggaacaacagaggagagttcccatgttcattctaaacctggcggcagcgcaaaagatg

SEQ ID NO: 109690 - DNA, 103 bp, Artificial Sequence
  Synthetic Polynucleotide
taatacgactcactatagggggtcattctggataaagtcatctagaatgaaacagaggagatcattcatgatgactttaaacctggcggcagcgcaaaagatg

SEQ ID NO: 109691 - DNA, 103 bp, Artificial Sequence
  Synthetic Polynucleotide
taatacgactcactatagggtctgctgctcggtcattctggataaagtcaaacagaggagatgacttatgccagaatgaaacctggcggcagcgcaaaagatg

SEQ ID NO: 109692 - DNA, 103 bp, Artificial Sequence
  Synthetic Polynucleotide
taatacgactcactatagggatttcccatgccagtgtaattataaccttcaacagaggagagaaggtatgaattacactaacctggcggcagcgcaaaagatg

SEQ ID NO: 109693 - DNA, 103 bp, Artificial Sequence
  Synthetic Polynucleotide
taatacgactcactataggggatgttacactctgctgctcggtcattctgaacagaggagacagaatatgcgagcagcaaacctggcggcagcgcaaaagatg

SEQ ID NO: 109694 - DNA, 103 bp, Artificial Sequence
  Synthetic Polynucleotide
taatacgactcactataggggagttactacgatgttacactctgctgctcaacagaggagagagcagatgagtgtaacaaacctggcggcagcgcaaaagatg

SEQ ID NO: 109695 - DNA, 103 bp, Artificial Sequence
  Synthetic Polynucleotide
taatacgactcactatagggcttctgggctgagttactacgatgttacacaacagaggagagtgtaaatgcgtagtaacaacctggcggcagcgcaaaagatg

SEQ ID NO: 109696 - DNA, 103 bp, Artificial Sequence
  Synthetic Polynucleotide
taatacgactcactatagggcgcactgattcttctgggctgagttactacaacagaggagagtagtaatgcagcccagaaacctggcggcagcgcaaaagatg

SEQ ID NO: 109697 - DNA, 103 bp, Artificial Sequence
  Synthetic Polynucleotide
taatacgactcactatagggccacagaaaccgcactgattcttctgggctaacagaggagaagcccaatggaatcagtgaacctggcggcagcgcaaaagatg

SEQ ID NO: 109698 - DNA, 103 bp, Artificial Sequence
  Synthetic Polynucleotide
taatacgactcactatagggactcgctctgccacagaaaccgcactgattaacagaggagaaatcagatgggtttctgtaacctggcggcagcgcaaaagatg

SEQ ID NO: 109699 - DNA, 103 bp, Artificial Sequence
  Synthetic Polynucleotide
taatacgactcactatagggttcaaatgcaactcgctctgccacagaaacaacagaggagagtttctatggcagagcgaaacctggcggcagcgcaaaagatg

SEQ ID NO: 109700 - DNA, 103 bp, Artificial Sequence
  Synthetic Polynucleotide
taatacgactcactatagggcttctcctctttcaaatgcaactcgctctgaacagaggagacagagcatgttgcatttgaacctggcggcagcgcaaaagatg

SEQ ID NO: 109701 - DNA, 103 bp, Artificial Sequence
  Synthetic Polynucleotide
taatacgactcactatagggtttccaggctcttctcctctttcaaatgcaaacagaggagatgcattatgaagaggagaaacctggcggcagcgcaaaagatg

SEQ ID NO: 109702 - DNA, 103 bp, Artificial Sequence
  Synthetic Polynucleotide
taatacgactcactataggggccacagctttttccaggctcttctcctctaacagaggagaagaggaatggagcctggaaacctggcggcagcgcaaaagatg

SEQ ID NO: 109703 - DNA, 103 bp, Artificial Sequence
  Synthetic Polynucleotide
taatacgactcactatagggtattggtggaatttcccatgccagtgtaataacagaggagaattacaatggcatgggaaaacctggcggcagcgcaaaagatg

SEQ ID NO: 109704 - DNA, 103 bp, Artificial Sequence
  Synthetic Polynucleotide
taatacgactcactataggggaacgctgtagccacagctttttccaggctaacagaggagaagcctgatgaaagctgtgaacctggcggcagcgcaaaagatg

SEQ ID NO: 109705 - DNA, 103 bp, Artificial Sequence
  Synthetic Polynucleotide
taatacgactcactataggggactcaaatcgaacgctgtagccacagcttaacagaggagaaagctgatgctacagcgtaacctggcggcagcgcaaaagatg

SEQ ID NO: 109706 - DNA, 103 bp, Artificial Sequence
  Synthetic Polynucleotide
taatacgactcactatagggaggaagtatagactcaaatcgaacgctgtaaacagaggagatacagcatgcgatttgagaacctggcggcagcgcaaaagatg

SEQ ID NO: 109707 - DNA, 103 bp, Artificial Sequence
  Synthetic Polynucleotide
taatacgactcactatagggcatgaggacgaggaagtatagactcaaatcaacagaggagagatttgatgctatacttcaacctggcggcagcgcaaaagatg

SEQ ID NO: 109708 - DNA, 103 bp, Artificial Sequence
  Synthetic Polynucleotide
taatacgactcactatagggattatactggcatgaggacgaggaagtataaacagaggagatatactatgtcgtcctcaaacctggcggcagcgcaaaagatg

SEQ ID NO: 109709 - DNA, 103 bp, Artificial Sequence
  Synthetic Polynucleotide
taatacgactcactatagggagtacaaaacattatactggcatgaggacgaacagaggagacgtcctatggccagtataaacctggcggcagcgcaaaagatg

SEQ ID NO: 109710 - DNA, 103 bp, Artificial Sequence
  Synthetic Polynucleotide
taatacgactcactataggggcacacctacagtacaaaacattatactggaacagaggagaccagtaatgtgttttgtaaacctggcggcagcgcaaaagatg

SEQ ID NO: 109711 - DNA, 103 bp, Artificial Sequence
  Synthetic Polynucleotide
taatacgactcactatagggtttctcaggagcacacctacagtacaaaacaacagaggagagttttgatgtgtaggtgtaacctggcggcagcgcaaaagatg

SEQ ID NO: 109712 - DNA, 103 bp, Artificial Sequence
  Synthetic Polynucleotide
taatacgactcactatagggtgcttctaattttctcaggagcacacctacaacagaggagagtaggtatgctcctgagaaacctggcggcagcgcaaaagatg

SEQ ID NO: 109713 - DNA, 103 bp, Artificial Sequence
  Synthetic Polynucleotide
taatacgactcactatagggctcgaatgcctgcttctaattttctcaggaaacagaggagatcctgaatgaattagaagaacctggcggcagcgcaaaagatg

SEQ ID NO: 109714 - DNA, 103 bp, Artificial Sequence
  Synthetic Polynucleotide
taatacgactcactataggggcatcttttttattggtggaatttcccatgaacagaggagacatgggatgttccaccaaaacctggcggcagcgcaaaagatg

SEQ ID NO: 109715 - DNA, 103 bp, Artificial Sequence
  Synthetic Polynucleotide
taatacgactcactatagggtgactgattcctcgaatgcctgcttctaataacagaggagaattagaatgaggcattcgaacctggcggcagcgcaaaagatg

SEQ ID NO: 109716 - DNA, 103 bp, Artificial Sequence
  Synthetic Polynucleotide
taatacgactcactatagggtacaattacatgactgattcctcgaatgccaacagaggagaggcattatgggaatcagtaacctggcggcagcgcaaaagatg

SEQ ID NO: 109717 - DNA, 103 bp, Artificial Sequence
  Synthetic Polynucleotide
taatacgactcactataggggtatttcatctacaattacatgactgattcaacagaggagagaatcaatgatgtaattgaacctggcggcagcgcaaaagatg

SEQ ID NO: 109718 - DNA, 103 bp, Artificial Sequence
  Synthetic Polynucleotide
taatacgactcactatagggtctctttcatgtatttcatctacaattacaaacagaggagatgtaatatgagatgaaataacctggcggcagcgcaaaagatg

SEQ ID NO: 109719 - DNA, 103 bp, Artificial Sequence
  Synthetic Polynucleotide
taatacgactcactatagggagtattaatatctctttcatgtatttcatcaacagaggagagatgaaatgcatgaaagaaacctggcggcagcgcaaaagatg

SEQ ID NO: 109720 - DNA, 103 bp, Artificial Sequence
  Synthetic Polynucleotide
taatacgactcactatagggaaaggaagtcagtattaatatctctttcataacagaggagaatgaaaatgatattaataaacctggcggcagcgcaaaagatg

SEQ ID NO: 109721 - DNA, 103 bp, Artificial Sequence
  Synthetic Polynucleotide
taatacgactcactatagggagtactaccaaaaggaagtcagtattaataaacagaggagatattaaatgtgacttcctaacctggcggcagcgcaaaagatg

SEQ ID NO: 109722 - DNA, 103 bp, Artificial Sequence
  Synthetic Polynucleotide
taatacgactcactatagggaacatcacgcagtactaccaaaaggaagtcaacagaggagagacttcatgttggtagtaaacctggcggcagcgcaaaagatg

SEQ ID NO: 109723 - DNA, 103 bp, Artificial Sequence
  Synthetic Polynucleotide
taatacgactcactatagggaagcctgaacaacatcacgcagtactaccaaacagaggagatggtagatgtgcgtgatgaacctggcggcagcgcaaaagatg

SEQ ID NO: 109724 - DNA, 103 bp, Artificial Sequence
  Synthetic Polynucleotide
taatacgactcactatagggacttcaggataagcctgaacaacatcacgcaacagaggagagcgtgaatgtgttcaggcaacctggcggcagcgcaaaagatg

SEQ ID NO: 109725 - DNA, 103 bp, Artificial Sequence
  Synthetic Polynucleotide
taatacgactcactatagggattgctttgtgcatcttttttattggtggaaacagaggagatccaccatgaaaaaagataacctggcggcagcgcaaaagatg

SEQ ID NO: 109726 - DNA, 103 bp, Artificial Sequence
  Synthetic Polynucleotide
taatacgactcactatagggaacaatgcgaacttcaggataagcctgaacaacagaggagagttcagatgtatcctgaaaacctggcggcagcgcaaaagatg

SEQ ID NO: 109727 - DNA, 103 bp, Artificial Sequence
  Synthetic Polynucleotide
taatacgactcactatagggcagacataagaacaatgcgaacttcaggataacagaggagaatcctgatgttcgcattgaacctggcggcagcgcaaaagatg

SEQ ID NO: 109728 - DNA, 103 bp, Artificial Sequence
  Synthetic Polynucleotide
taatacgactcactatagggtcaatagtagcagacataagaacaatgcgaaacagaggagatcgcatatgtcttatgtcaacctggcggcagcgcaaaagatg

SEQ ID NO: 109729 - DNA, 103 bp, Artificial Sequence
  Synthetic Polynucleotide
taatacgactcactatagggcatgctggtatcaatagtagcagacataagaacagaggagacttatgatggctactattaacctggcggcagcgcaaaagatg

SEQ ID NO: 109730 - DNA, 103 bp, Artificial Sequence
  Synthetic Polynucleotide
taatacgactcactatagggattcacaaaacatgctggtatcaatagtagaacagaggagactactaatgataccagcaaacctggcggcagcgcaaaagatg

SEQ ID NO: 109731 - DNA, 103 bp, Artificial Sequence
  Synthetic Polynucleotide
taatacgactcactatagggttgaagaaatattcacaaaacatgctggtaaacagaggagataccagatggttttgtgaaacctggcggcagcgcaaaagatg

SEQ ID NO: 109732 - DNA, 103 bp, Artificial Sequence
  Synthetic Polynucleotide
taatacgactcactataggggatggggcaattgaagaaatattcacaaaaaacagaggagattttgtatgtatttcttcaacctggcggcagcgcaaaagatg

SEQ ID NO: 109733 - DNA, 103 bp, Artificial Sequence
  Synthetic Polynucleotide
taatacgactcactatagggaaacttcaatgatggggcaattgaagaaataacagaggagaatttctatgattgccccaaacctggcggcagcgcaaaagatg

SEQ ID NO: 109734 - DNA, 103 bp, Artificial Sequence
  Synthetic Polynucleotide
taatacgactcactataggggtcctcccataaacttcaatgatggggcaaaacagaggagattgcccatgcattgaagtaacctggcggcagcgcaaaagatg

SEQ ID NO: 109735 - DNA, 103 bp, Artificial Sequence
  Synthetic Polynucleotide
taatacgactcactatagggaactgggtaagtcctcccataaacttcaataacagaggagaattgaaatgtatgggaggaacctggcggcagcgcaaaagatg

SEQ ID NO: 109736 - DNA, 103 bp, Artificial Sequence
  Synthetic Polynucleotide
taatacgactcactatagggctctggcagcattgctttgtgcatctttttaacagaggagaaaaaagatgcacaaagcaaacctggcggcagcgcaaaagatg

SEQ ID NO: 109737 - DNA, 103 bp, Artificial Sequence
  Synthetic Polynucleotide
taatacgactcactatagggaatattcttgaactgggtaagtcctcccataacagaggagaatgggaatgcttacccagaacctggcggcagcgcaaaagatg

SEQ ID NO: 109738 - DNA, 103 bp, Artificial Sequence
  Synthetic Polynucleotide
taatacgactcactatagggtcttccagaaaatattcttgaactgggtaaaacagaggagattacccatgtcaagaataaacctggcggcagcgcaaaagatg

SEQ ID NO: 109739 - DNA, 103 bp, Artificial Sequence
  Synthetic Polynucleotide
taatacgactcactatagggctgaatgcagtcttccagaaaatattcttgaacagaggagacaagaaatgtttctggaaaacctggcggcagcgcaaaagatg

SEQ ID NO: 109740 - DNA, 103 bp, Artificial Sequence
  Synthetic Polynucleotide
taatacgactcactatagggagtgggtcatctgaatgcagtcttccagaaaacagaggagattctggatgactgcattcaacctggcggcagcgcaaaagatg

SEQ ID NO: 109741 - DNA, 103 bp, Artificial Sequence
  Synthetic Polynucleotide
taatacgactcactatagggggaggaacaaagtgggtcatctgaatgcagaacagaggagactgcatatggatgacccaaacctggcggcagcgcaaaagatg

SEQ ID NO: 109742 - DNA, 103 bp, Artificial Sequence
  Synthetic Polynucleotide
taatacgactcactataggggtcttttggtggaggaacaaagtgggtcataacagaggagaatgaccatgtttgttcctaacctggcggcagcgcaaaagatg

SEQ ID NO: 109743 - DNA, 103 bp, Artificial Sequence
  Synthetic Polynucleotide
taatacgactcactatagggtcttctttttgtcttttggtggaggaacaaaacagaggagattgttcatgcaccaaaagaacctggcggcagcgcaaaagatg

SEQ ID NO: 109744 - DNA, 103 bp, Artificial Sequence
  Synthetic Polynucleotide
taatacgactcactatagggtccttatccttcttctttttgtcttttggtaacagaggagaaccaaaatgcaaaaagaaaacctggcggcagcgcaaaagatg

SEQ ID NO: 109745 - DNA, 103 bp, Artificial Sequence
  Synthetic Polynucleotide
taatacgactcactatagggaccatcatcatccttatccttcttctttttaacagaggagaaaaaagatgaaggataagaacctggcggcagcgcaaaagatg

SEQ ID NO: 109746 - DNA, 103 bp, Artificial Sequence
  Synthetic Polynucleotide
taatacgactcactatagggcatcctcaccaccatcatcatccttatcctaacagaggagaaggataatgatgatgatgaacctggcggcagcgcaaaagatg

SEQ ID NO: 109747 - DNA, 103 bp, Artificial Sequence
  Synthetic Polynucleotide
taatacgactcactatagggttaacaaagtctctggcagcattgctttgtaacagaggagaacaaagatgtgctgccagaacctggcggcagcgcaaaagatg

SEQ ID NO: 109748 - DNA, 103 bp, Artificial Sequence
  Synthetic Polynucleotide
taatacgactcactatagggtttgcatcatcatcctcaccaccatcatcaaacagaggagatgatgaatgtggtgaggaaacctggcggcagcgcaaaagatg

SEQ ID NO: 109749 - DNA, 103 bp, Artificial Sequence
  Synthetic Polynucleotide
taatacgactcactatagggcaagttgcaatttgcatcatcatcctcaccaacagaggagaggtgagatggatgatgcaaacctggcggcagcgcaaaagatg

SEQ ID NO: 109750 - DNA, 103 bp, Artificial Sequence
  Synthetic Polynucleotide
taatacgactcactatagggcaccacagatcaagttgcaatttgcatcataacagaggagaatgatgatgattgcaactaacctggcggcagcgcaaaagatg

SEQ ID NO: 109751 - DNA, 103 bp, Artificial Sequence
  Synthetic Polynucleotide
taatacgactcactatagggccatattcatcaccacagatcaagttgcaaaacagaggagattgcaaatggatctgtggaacctggcggcagcgcaaaagatg

SEQ ID NO: 109752 - DNA, 103 bp, Artificial Sequence
  Synthetic Polynucleotide
taatacgactcactatagggtgtttctggaccatattcatcaccacagataacagaggagaatctgtatggatgaatataacctggcggcagcgcaaaagatg

SEQ ID NO: 109753 - DNA, 103 bp, Artificial Sequence
  Synthetic Polynucleotide
taatacgactcactatagggtgctcaaccttgtttctggaccatattcataacagaggagaatgaatatggtccagaaaaacctggcggcagcgcaaaagatg

SEQ ID NO: 109754 - DNA, 103 bp, Artificial Sequence
  Synthetic Polynucleotide
taatacgactcactatagggaattgagacatgctcaaccttgtttctggaaacagaggagatccagaatgaaggttgagaacctggcggcagcgcaaaagatg

SEQ ID NO: 109755 - DNA, 103 bp, Artificial Sequence
  Synthetic Polynucleotide
taatacgactcactatagggcttttcgttcaattgagacatgctcaacctaacagaggagaaggttgatgatgtctcaaaacctggcggcagcgcaaaagatg

SEQ ID NO: 109756 - DNA, 103 bp, Artificial Sequence
  Synthetic Polynucleotide
taatacgactcactatagggaaggagtttccttttcgttcaattgagacaaacagaggagatgtctcatgtgaacgaaaaacctggcggcagcgcaaaagatg

SEQ ID NO: 109757 - DNA, 103 bp, Artificial Sequence
  Synthetic Polynucleotide
taatacgactcactatagggatgagttcaaaaggagtttccttttcgttcaacagaggagagaacgaatgggaaactccaacctggcggcagcgcaaaagatg

SEQ ID NO: 109758 - DNA, 103 bp, Artificial Sequence
  Synthetic Polynucleotide
taatacgactcactatagggaaccaaatagttaacaaagtctctggcagcaacagaggagagctgccatggactttgttaacctggcggcagcgcaaaagatg

SEQ ID NO: 109759 - DNA, 103 bp, Artificial Sequence
  Synthetic Polynucleotide
taatacgactcactatagggtagagcctcgatgagttcaaaaggagtttcaacagaggagagaaactatgtttgaactcaacctggcggcagcgcaaaagatg

SEQ ID NO: 109760 - DNA, 103 bp, Artificial Sequence
  Synthetic Polynucleotide
taatacgactcactatagggtgtacttaagtagagcctcgatgagttcaaaacagaggagattgaacatgtcgaggctcaacctggcggcagcgcaaaagatg

SEQ ID NO: 109761 - DNA, 103 bp, Artificial Sequence
  Synthetic Polynucleotide
taatacgactcactatagggagggtttcaatgtacttaagtagagcctcgaacagaggagacgaggcatgacttaagtaaacctggcggcagcgcaaaagatg

SEQ ID NO: 109762 - DNA, 103 bp, Artificial Sequence
  Synthetic Polynucleotide
taatacgactcactatagggaggaacattaagggtttcaatgtacttaagaacagaggagacttaagatgattgaaaccaacctggcggcagcgcaaaagatg

SEQ ID NO: 109763 - DNA, 103 bp, Artificial Sequence
  Synthetic Polynucleotide
taatacgactcactatagggacacagctccaggaacattaagggtttcaaaacagaggagattgaaaatgttaatgttcaacctggcggcagcgcaaaagatg

SEQ ID NO: 109764 - DNA, 103 bp, Artificial Sequence
  Synthetic Polynucleotide
taatacgactcactatagggaaaaaaaccaacacagctccaggaacattaaacagaggagataatgtatgtggagctgtaacctggcggcagcgcaaaagatg

SEQ ID NO: 109765 - DNA, 103 bp, Artificial Sequence
  Synthetic Polynucleotide
taatacgactcactatagggccagccaggcaaaaaaaccaacacagctccaacagaggagaggagctatgttggtttttaacctggcggcagcgcaaaagatg

SEQ ID NO: 109766 - DNA, 103 bp, Artificial Sequence
  Synthetic Polynucleotide
taatacgactcactatagggaaatcagattccagccaggcaaaaaaaccaaacagaggagatggtttatgtgcctggctaacctggcggcagcgcaaaagatg

SEQ ID NO: 109767 - DNA, 103 bp, Artificial Sequence
  Synthetic Polynucleotide
taatacgactcactatagggtgcatagtataaatcagattccagccaggcaacagaggagagcctggatggaatctgataacctggcggcagcgcaaaagatg

SEQ ID NO: 109768 - DNA, 103 bp, Artificial Sequence
  Synthetic Polynucleotide
taatacgactcactatagggcaaatgcttctgcatagtataaatcagattaacagaggagaaatctgatgtatactatgaacctggcggcagcgcaaaagatg

SEQ ID NO: 109769 - DNA, 103 bp, Artificial Sequence
  Synthetic Polynucleotide
taatacgactcactatagggtgccacaccaggcatacagaaaatttttaaaacagaggagattaaaaatgttctgtatgaacctggcggcagcgcaaaagatg

SEQ ID NO: 109770 - DNA, 103 bp, Artificial Sequence
  Synthetic Polynucleotide
taatacgactcactatagggcatttattcgaaccaaatagttaacaaagtaacagaggagaactttgatgactatttggaacctggcggcagcgcaaaagatg

SEQ ID NO: 109771 - DNA, 103 bp, Artificial Sequence
  Synthetic Polynucleotide
taatacgactcactataggggattcatttccaaatgcttctgcatagtataacagaggagaatactaatgagaagcattaacctggcggcagcgcaaaagatg

SEQ ID NO: 109772 - DNA, 103 bp, Artificial Sequence
  Synthetic Polynucleotide
taatacgactcactatagggccaaaatgtggattcatttccaaatgcttcaacagaggagagaagcaatgggaaatgaaaacctggcggcagcgcaaaagatg

SEQ ID NO: 109773 - DNA, 103 bp, Artificial Sequence
  Synthetic Polynucleotide
taatacgactcactatagggccgatggcttccaaaatgtggattcatttcaacagaggagagaaatgatgccacattttaacctggcggcagcgcaaaagatg

SEQ ID NO: 109774 - DNA, 103 bp, Artificial Sequence
  Synthetic Polynucleotide
taatacgactcactataggggaatctgataccgatggcttccaaaatgtgaacagaggagacacattatggaagccatcaacctggcggcagcgcaaaagatg

SEQ ID NO: 109775 - DNA, 103 bp, Artificial Sequence
  Synthetic Polynucleotide
taatacgactcactatagggtgcaggggtagaatctgataccgatggcttaacagaggagaaagccaatggtatcagataacctggcggcagcgcaaaagatg

SEQ ID NO: 109776 - DNA, 103 bp, Artificial Sequence
  Synthetic Polynucleotide
taatacgactcactatagggaatctgagaatgcaggggtagaatctgataaacagaggagatatcagatgctacccctgaacctggcggcagcgcaaaagatg

SEQ ID NO: 109777 - DNA, 103 bp, Artificial Sequence
  Synthetic Polynucleotide
taatacgactcactatagggcctctcgaggaatctgagaatgcaggggtaaacagaggagataccccatgattctcagaaacctggcggcagcgcaaaagatg

SEQ ID NO: 109778 - DNA, 103 bp, Artificial Sequence
  Synthetic Polynucleotide
taatacgactcactatagggttgcgctgttcctctcgaggaatctgagaaaacagaggagattctcaatgtcctcgagaaacctggcggcagcgcaaaagatg

SEQ ID NO: 109779 - DNA, 103 bp, Artificial Sequence
  Synthetic Polynucleotide
taatacgactcactatagggatcaaacactttgcgctgttcctctcgaggaacagaggagacctcgaatggaacagcgcaacctggcggcagcgcaaaagatg

SEQ ID NO: 109780 - DNA, 103 bp, Artificial Sequence
  Synthetic Polynucleotide
taatacgactcactatagggctggtactggatcaaacactttgcgctgttaacagaggagaaacagcatgaagtgtttgaacctggcggcagcgcaaaagatg

SEQ ID NO: 109781 - DNA, 103 bp, Artificial Sequence
  Synthetic Polynucleotide
taatacgactcactatagggctctttatttcatttattcgaaccaaatagaacagaggagactatttatgtcgaataaaaacctggcggcagcgcaaaagatg

SEQ ID NO: 109782 - DNA, 103 bp, Artificial Sequence
  Synthetic Polynucleotide
taatacgactcactataggggttactccaactggtactggatcaaacactaacagaggagaagtgttatgtccagtaccaacctggcggcagcgcaaaagatg

SEQ ID NO: 109783 - DNA, 103 bp, Artificial Sequence
  Synthetic Polynucleotide
taatacgactcactatagggaataaccttggttactccaactggtactggaacagaggagaccagtaatggttggagtaaacctggcggcagcgcaaaagatg

SEQ ID NO: 109784 - DNA, 103 bp, Artificial Sequence
  Synthetic Polynucleotide
taatacgactcactatagggttgtggacaaaataaccttggttactccaaaacagaggagattggagatgccaaggttaaacctggcggcagcgcaaaagatg

SEQ ID NO: 109785 - DNA, 103 bp, Artificial Sequence
  Synthetic Polynucleotide
taatacgactcactatagggtcagcaatatttgtggacaaaataaccttgaacagaggagacaaggtatgtttgtccacaacctggcggcagcgcaaaagatg

SEQ ID NO: 109786 - DNA, 103 bp, Artificial Sequence
  Synthetic Polynucleotide
taatacgactcactatagggaatgcttgtttcagcaatatttgtggacaaaacagaggagattgtccatgaatattgctaacctggcggcagcgcaaaagatg

SEQ ID NO: 109787 - DNA, 103 bp, Artificial Sequence
  Synthetic Polynucleotide
taatacgactcactatagggcgtttatggtaatgcttgtttcagcaatataacagaggagaatattgatgaaacaagcaaacctggcggcagcgcaaaagatg

SEQ ID NO: 109788 - DNA, 103 bp, Artificial Sequence
  Synthetic Polynucleotide
taatacgactcactatagggtaaacaacatcgtttatggtaatgcttgttaacagaggagaaacaagatgtaccataaaaacctggcggcagcgcaaaagatg

SEQ ID NO: 109789 - DNA, 103 bp, Artificial Sequence
  Synthetic Polynucleotide
taatacgactcactataggggtcaatgacataaacaacatcgtttatggtaacagaggagaaccataatggatgttgttaacctggcggcagcgcaaaagatg

SEQ ID NO: 109790 - DNA, 103 bp, Artificial Sequence
  Synthetic Polynucleotide
taatacgactcactataggggcttgcaggagtcaatgacataaacaacataacagaggagaatgttgatgatgtcattgaacctggcggcagcgcaaaagatg

SEQ ID NO: 109791 - DNA, 103 bp, Artificial Sequence
  Synthetic Polynucleotide
taatacgactcactatagggttcactttctgcttgcaggagtcaatgacaaacagaggagatgtcatatgctcctgcaaaacctggcggcagcgcaaaagatg

SEQ ID NO: 109792 - DNA, 103 bp, Artificial Sequence
  Synthetic Polynucleotide
taatacgactcactatagggaacttcttcactctttatttcatttattcgaacagaggagacgaataatggaaataaagaacctggcggcagcgcaaaagatg

SEQ ID NO: 109793 - DNA, 103 bp, Artificial Sequence
  Synthetic Polynucleotide
taatacgactcactatagggagtgaagagtttcactttctgcttgcaggaaacagaggagatcctgcatgcagaaagtgaacctggcggcagcgcaaaagatg

SEQ ID NO: 109794 - DNA, 103 bp, Artificial Sequence
  Synthetic Polynucleotide
taatacgactcactatagggtgttgtgagcagtgaagagtttcactttctaacagaggagaagaaagatgaactcttcaaacctggcggcagcgcaaaagatg

SEQ ID NO: 109795 - DNA, 103 bp, Artificial Sequence
  Synthetic Polynucleotide
taatacgactcactatagggttggtcatattgttgtgagcagtgaagagtaacagaggagaactcttatgtgctcacaaaacctggcggcagcgcaaaagatg

SEQ ID NO: 109796 - DNA, 103 bp, Artificial Sequence
  Synthetic Polynucleotide
taatacgactcactatagggggtagcatagttggtcatattgttgtgagcaacagaggagagctcacatgaatatgaccaacctggcggcagcgcaaaagatg

SEQ ID NO: 109797 - DNA, 103 bp, Artificial Sequence
  Synthetic Polynucleotide
taatacgactcactatagggatgcccatacggtagcatagttggtcatataacagaggagaatatgaatgactatgctaaacctggcggcagcgcaaaagatg

SEQ ID NO: 109798 - DNA, 103 bp, Artificial Sequence
  Synthetic Polynucleotide
taatacgactcactatagggtttgtttttgatgcccatacggtagcatagaacagaggagactatgcatgcgtatgggcaacctggcggcagcgcaaaagatg

SEQ ID NO: 109799 - DNA, 103 bp, Artificial Sequence
  Synthetic Polynucleotide
taatacgactcactatagggttgctcaaggtttgtttttgatgcccatacaacagaggagagtatggatgtcaaaaacaaacctggcggcagcgcaaaagatg

SEQ ID NO: 109800 - DNA, 103 bp, Artificial Sequence
  Synthetic Polynucleotide
taatacgactcactataggggccctttccgttgctcaaggtttgtttttgaacagaggagacaaaaaatgaccttgagcaacctggcggcagcgcaaaagatg

SEQ ID NO: 109801 - DNA, 103 bp, Artificial Sequence
  Synthetic Polynucleotide
taatacgactcactatagggcggccagctcgccctttccgttgctcaaggaacagaggagaccttgaatgacggaaaggaacctggcggcagcgcaaaagatg

SEQ ID NO: 109802 - DNA, 103 bp, Artificial Sequence
  Synthetic Polynucleotide
taatacgactcactatagggaggccgtactcggccagctcgccctttccgaacagaggagacggaaaatgcgagctggcaacctggcggcagcgcaaaagatg

SEQ ID NO: 109803 - DNA, 103 bp, Artificial Sequence
  Synthetic Polynucleotide
taatacgactcactatagggcaaaagctggaacttcttcactctttatttaacagaggagaaaataaatggtgaagaagaacctggcggcagcgcaaaagatg

SEQ ID NO: 109804 - DNA, 103 bp, Artificial Sequence
  Synthetic Polynucleotide
taatacgactcactatagggagcagaatccaggccgtactcggccagctcaacagaggagagagctgatggagtacggcaacctggcggcagcgcaaaagatg

SEQ ID NO: 109805 - DNA, 103 bp, Artificial Sequence
  Synthetic Polynucleotide
taatacgactcactatagggcacaggtgaaagcagaatccaggccgtactaacagaggagaagtacgatgtggattctgaacctggcggcagcgcaaaagatg

SEQ ID NO: 109806 - DNA, 103 bp, Artificial Sequence
  Synthetic Polynucleotide
taatacgactcactatagggagctcggctgcacaggtgaaagcagaatccaacagaggagaggattcatgtttcacctgaacctggcggcagcgcaaaagatg

SEQ ID NO: 109807 - DNA, 103 bp, Artificial Sequence
  Synthetic Polynucleotide
taatacgactcactatagggtctcaaaacgagctcggctgcacaggtgaaaacagaggagattcaccatggcagccgagaacctggcggcagcgcaaaagatg

SEQ ID NO: 109808 - DNA, 103 bp, Artificial Sequence
  Synthetic Polynucleotide
taatacgactcactataggggtttcaagtctctcaaaacgagctcggctgaacagaggagacagccgatgtcgttttgaaacctggcggcagcgcaaaagatg

SEQ ID NO: 109809 - DNA, 103 bp, Artificial Sequence
  Synthetic Polynucleotide
taatacgactcactatagggtgtcatgtgggtttcaagtctctcaaaacgaacagaggagacgttttatgagacttgaaaacctggcggcagcgcaaaagatg

SEQ ID NO: 109810 - DNA, 103 bp, Artificial Sequence
  Synthetic Polynucleotide
taatacgactcactatagggacatctctggtgtcatgtgggtttcaagtcaacagaggagagacttgatgcccacatgaaacctggcggcagcgcaaaagatg

SEQ ID NO: 109811 - DNA, 103 bp, Artificial Sequence
  Synthetic Polynucleotide
taatacgactcactatagggggtgttcggaacatctctggtgtcatgtggaacagaggagaccacatatgaccagagataacctggcggcagcgcaaaagatg

SEQ ID NO: 109812 - DNA, 103 bp, Artificial Sequence
  Synthetic Polynucleotide
taatacgactcactatagggttcatgcaatggtgttcggaacatctctggaacagaggagaccagagatgttccgaacaaacctggcggcagcgcaaaagatg

SEQ ID NO: 109813 - DNA, 103 bp, Artificial Sequence
  Synthetic Polynucleotide
taatacgactcactatagggtaagagcaatttcatgcaatggtgttcggaaacagaggagatccgaaatgcattgcatgaacctggcggcagcgcaaaagatg

SEQ ID NO: 109814 - DNA, 103 bp, Artificial Sequence
  Synthetic Polynucleotide
taatacgactcactataggggatgctaccccaaaagctggaacttcttcaaacagaggagatgaagaatgtccagctttaacctggcggcagcgcaaaagatg

SEQ ID NO: 109815 - DNA, 103 bp, Artificial Sequence
  Synthetic Polynucleotide
taatacgactcactatagggagttttatgctaagagcaatttcatgcaataacagaggagaattgcaatgaattgctctaacctggcggcagcgcaaaagatg

SEQ ID NO: 109816 - DNA, 103 bp, Artificial Sequence
  Synthetic Polynucleotide
taatacgactcactatagggtagacgcagaagttttatgctaagagcaataacagaggagaattgctatgagcataaaaaacctggcggcagcgcaaaagatg

SEQ ID NO: 109817 - DNA, 103 bp, Artificial Sequence
  Synthetic Polynucleotide
taatacgactcactatagggcaattcctcctagacgcagaagttttatgcaacagaggagagcataaatgttctgcgtcaacctggcggcagcgcaaaagatg

SEQ ID NO: 109818 - DNA, 103 bp, Artificial Sequence
  Synthetic Polynucleotide
taatacgactcactatagggagaaattggccaattcctcctagacgcagaaacagaggagatctgcgatgaggaggaataacctggcggcagcgcaaaagatg

SEQ ID NO: 109819 - DNA, 103 bp, Artificial Sequence
  Synthetic Polynucleotide
taatacgactcactatagggtgctttggccagaaattggccaattcctccaacagaggagaggaggaatgggccaatttaacctggcggcagcgcaaaagatg

SEQ ID NO: 109820 - DNA, 103 bp, Artificial Sequence
  Synthetic Polynucleotide
taatacgactcactataggggaggttcaattgctttggccagaaattggcaacagaggagagccaatatgtggccaaagaacctggcggcagcgcaaaagatg

SEQ ID NO: 109821 - DNA, 103 bp, Artificial Sequence
  Synthetic Polynucleotide
taatacgactcactatagggtccaaagggggaggttcaattgctttggccaacagaggagaggccaaatgaattgaaccaacctggcggcagcgcaaaagatg

SEQ ID NO: 109822 - DNA, 103 bp, Artificial Sequence
  Synthetic Polynucleotide
taatacgactcactatagggaatcacagcatccaaagggggaggttcaataacagaggagaattgaaatgccccctttgaacctggcggcagcgcaaaagatg

SEQ ID NO: 109823 - DNA, 103 bp, Artificial Sequence
  Synthetic Polynucleotide
taatacgactcactataggggttctgcttcaatcacagcatccaaaggggaacagaggagaccccttatgatgctgtgaaacctggcggcagcgcaaaagatg

SEQ ID NO: 109824 - DNA, 103 bp, Artificial Sequence
  Synthetic Polynucleotide
taatacgactcactatagggctaagagtgtgttctgcttcaatcacagcaaacagaggagatgctgtatgtgaagcagaaacctggcggcagcgcaaaagatg

SEQ ID NO: 109825 - DNA, 103 bp, Artificial Sequence
  Synthetic Polynucleotide
taatacgactcactatagggtgggggcggagatgctaccccaaaagctggaacagaggagaccagctatgggggtagcaaacctggcggcagcgcaaaagatg

SEQ ID NO: 109826 - DNA, 103 bp, Artificial Sequence
  Synthetic Polynucleotide
taatacgactcactatagggatcaagctctctaagagtgtgttctgcttcaacagaggagagaagcaatgcacactcttaacctggcggcagcgcaaaagatg

SEQ ID NO: 109827 - DNA, 103 bp, Artificial Sequence
  Synthetic Polynucleotide
taatacgactcactatagggcatctaatgcatcaagctctctaagagtgtaacagaggagaacactcatggagagcttgaacctggcggcagcgcaaaagatg

SEQ ID NO: 109828 - DNA, 103 bp, Artificial Sequence
  Synthetic Polynucleotide
taatacgactcactatagggtcatcattggcatctaatgcatcaagctctaacagaggagaagagctatgtgcattagaaacctggcggcagcgcaaaagatg

SEQ ID NO: 109829 - DNA, 103 bp, Artificial Sequence
  Synthetic Polynucleotide
taatacgactcactatagggaggagtcaactcatcattggcatctaatgcaacagaggagagcattaatggccaatgataacctggcggcagcgcaaaagatg

SEQ ID NO: 109830 - DNA, 103 bp, Artificial Sequence
  Synthetic Polynucleotide
taatacgactcactatagggttcgtcccaaaggagtcaactcatcattggaacagaggagaccaatgatgagttgactcaacctggcggcagcgcaaaagatg

SEQ ID NO: 109831 - DNA, 103 bp, Artificial Sequence
  Synthetic Polynucleotide
taatacgactcactatagggttagccaggattcgtcccaaaggagtcaacaacagaggagagttgacatgtttgggacgaacctggcggcagcgcaaaagatg

SEQ ID NO: 109832 - DNA, 103 bp, Artificial Sequence
  Synthetic Polynucleotide
taatacgactcactatagggaatggggagtttagccaggattcgtcccaaaacagaggagattgggaatgatcctggctaacctggcggcagcgcaaaagatg

SEQ ID NO: 109833 - DNA, 103 bp, Artificial Sequence
  Synthetic Polynucleotide
taatacgactcactatagggaacgaggctcaatggggagtttagccaggaaacagaggagatcctggatgaactccccaaacctggcggcagcgcaaaagatg

SEQ ID NO: 109834 - DNA, 103 bp, Artificial Sequence
  Synthetic Polynucleotide
taatacgactcactatagggattttgccaaaacgaggctcaatggggagtaacagaggagaactcccatgtgagcctcgaacctggcggcagcgcaaaagatg

SEQ ID NO: 109835 - DNA, 103 bp, Artificial Sequence
  Synthetic Polynucleotide
taatacgactcactatagggcattatcatcattttgccaaaacgaggctcaacagaggagagagcctatgtttggcaaaaacctggcggcagcgcaaaagatg

SEQ ID NO: 109836 - DNA, 103 bp, Artificial Sequence
  Synthetic Polynucleotide
taatacgactcactatagggtatcagtaagtgggggcggagatgctacccaacagaggagagggtagatgctccgccccaacctggcggcagcgcaaaagatg

SEQ ID NO: 109837 - DNA, 103 bp, Artificial Sequence
  Synthetic Polynucleotide
taatacgactcactatagggaaatacaccccattatcatcattttgccaaaacagaggagattggcaatgtgatgataaaacctggcggcagcgcaaaagatg

SEQ ID NO: 109838 - DNA, 103 bp, Artificial Sequence
  Synthetic Polynucleotide
taatacgactcactatagggcccacgtagaaaatacaccccattatcatcaacagaggagagatgatatgggggtgtataacctggcggcagcgcaaaagatg

SEQ ID NO: 109839 - DNA, 103 bp, Artificial Sequence
  Synthetic Polynucleotide
taatacgactcactataggggatagcatctcccacgtagaaaatacacccaacagaggagagggtgtatgttctacgtgaacctggcggcagcgcaaaagatg

SEQ ID NO: 109840 - DNA, 103 bp, Artificial Sequence
  Synthetic Polynucleotide
taatacgactcactatagggcaatggtacagatagcatctcccacgtagaaacagaggagatctacgatggagatgctaaacctggcggcagcgcaaaagatg

SEQ ID NO: 109841 - DNA, 103 bp, Artificial Sequence
  Synthetic Polynucleotide
taatacgactcactataggggtagcagcagcaatggtacagatagcatctaacagaggagaagatgcatgctgtaccataacctggcggcagcgcaaaagatg

SEQ ID NO: 109842 - DNA, 103 bp, Artificial Sequence
  Synthetic Polynucleotide
taatacgactcactatagggtggaaagcaggtagcagcagcaatggtacaaacagaggagatgtaccatggctgctgctaacctggcggcagcgcaaaagatg

SEQ ID NO: 109843 - DNA, 103 bp, Artificial Sequence
  Synthetic Polynucleotide
taatacgactcactatagggtgaaaggctctggaaagcaggtagcagcagaacagaggagactgctgatgcctgctttcaacctggcggcagcgcaaaagatg

SEQ ID NO: 109844 - DNA, 103 bp, Artificial Sequence
  Synthetic Polynucleotide
taatacgactcactatagggccttcattgatgaaaggctctggaaagcagaacagaggagactgcttatgagagcctttaacctggcggcagcgcaaaagatg

SEQ ID NO: 109845 - DNA, 103 bp, Artificial Sequence
  Synthetic Polynucleotide
taatacgactcactatagggcagccgctttccttcattgatgaaaggctcaacagaggagagagcctatgatcaatgaaaacctggcggcagcgcaaaagatg

SEQ ID NO: 109846 - DNA, 103 bp, Artificial Sequence
  Synthetic Polynucleotide
taatacgactcactatagggggatatagcccagccgctttccttcattgaaacagaggagatcaatgatggaaagcggcaacctggcggcagcgcaaaagatg

SEQ ID NO: 109847 - DNA, 103 bp, Artificial Sequence
  Synthetic Polynucleotide
taatacgactcactataggggtgtcaggagtatcagtaagtgggggcggaaacagaggagatccgccatgacttactgaaacctggcggcagcgcaaaagatg

SEQ ID NO: 109848 - DNA, 103 bp, Artificial Sequence
  Synthetic Polynucleotide
taatacgactcactatagggaaatttcgatggatatagcccagccgctttaacagaggagaaaagcgatggggctatataacctggcggcagcgcaaaagatg

SEQ ID NO: 109849 - DNA, 103 bp, Artificial Sequence
  Synthetic Polynucleotide
taatacgactcactataggggtttccagcaaaatttcgatggatatagccaacagaggagaggctatatgcatcgaaataacctggcggcagcgcaaaagatg

SEQ ID NO: 109850 - DNA, 103 bp, Artificial Sequence
  Synthetic Polynucleotide
taatacgactcactatagggcagaaaatctgtttccagcaaaatttcgataacagaggagaatcgaaatgttgctggaaaacctggcggcagcgcaaaagatg

SEQ ID NO: 109851 - DNA, 103 bp, Artificial Sequence
  Synthetic Polynucleotide
taatacgactcactataggggctacgtgatcagaaaatctgtttccagcaaacagaggagatgctggatgcagattttcaacctggcggcagcgcaaaagatg

SEQ ID NO: 109852 - DNA, 103 bp, Artificial Sequence
  Synthetic Polynucleotide
taatacgactcactatagggtgataaaagggctacgtgatcagaaaatctaacagaggagaagatttatggatcacgtaaacctggcggcagcgcaaaagatg

SEQ ID NO: 109853 - DNA, 103 bp, Artificial Sequence
  Synthetic Polynucleotide
taatacgactcactatagggcttggaatactgataaaagggctacgtgataacagaggagaatcacgatgcccttttataacctggcggcagcgcaaaagatg

SEQ ID NO: 109854 - DNA, 103 bp, Artificial Sequence
  Synthetic Polynucleotide
taatacgactcactatagggtcatcccaggcttggaatactgataaaaggaacagaggagaccttttatgagtattccaaacctggcggcagcgcaaaagatg

SEQ ID NO: 109855 - DNA, 103 bp, Artificial Sequence
  Synthetic Polynucleotide
taatacgactcactatagggcattctagcatcatcccaggcttggaatacaacagaggagagtattcatggcctgggataacctggcggcagcgcaaaagatg

SEQ ID NO: 109856 - DNA, 103 bp, Artificial Sequence
  Synthetic Polynucleotide
taatacgactcactatagggcttctccacccattctagcatcatcccaggaacagaggagacctgggatgatgctagaaaacctggcggcagcgcaaaagatg

SEQ ID NO: 109857 - DNA, 103 bp, Artificial Sequence
  Synthetic Polynucleotide
taatacgactcactatagggatctctgcttcttctccacccattctagcaaacagaggagatgctagatggggtggagaaacctggcggcagcgcaaaagatg

SEQ ID NO: 109858 - DNA, 103 bp, Artificial Sequence
  Synthetic Polynucleotide
taatacgactcactatagggatttgctgtagtgtcaggagtatcagtaagaacagaggagacttactatgactcctgacaacctggcggcagcgcaaaagatg

SEQ ID NO: 109859 - DNA, 103 bp, Artificial Sequence
  Synthetic Polynucleotide
taatacgactcactatagggacaaaaacgtatctctgcttcttctccaccaacagaggagaggtggaatggaagcagagaacctggcggcagcgcaaaagatg

SEQ ID NO: 109860 - DNA, 103 bp, Artificial Sequence
  Synthetic Polynucleotide
taatacgactcactatagggttttgtgctcacaaaaacgtatctctgcttaacagaggagaaagcagatgtacgtttttaacctggcggcagcgcaaaagatg

SEQ ID NO: 109861 - DNA, 103 bp, Artificial Sequence
  Synthetic Polynucleotide
taatacgactcactatagggatattaagtcttttgtgctcacaaaaacgtaacagaggagaacgtttatgtgagcacaaaacctggcggcagcgcaaaagatg

SEQ ID NO: 109862 - DNA, 103 bp, Artificial Sequence
  Synthetic Polynucleotide
taatacgactcactatagggtagtgtagccatattaagtcttttgtgctcaacagaggagagagcacatgagacttaataacctggcggcagcgcaaaagatg

SEQ ID NO: 109863 - DNA, 103 bp, Artificial Sequence
  Synthetic Polynucleotide
taatacgactcactatagggaagtcattcttagtgtagccatattaagtcaacagaggagagacttaatgtggctacacaacctggcggcagcgcaaaagatg

SEQ ID NO: 109864 - DNA, 103 bp, Artificial Sequence
  Synthetic Polynucleotide
taatacgactcactatagggttggcttcccaagtcattcttagtgtagccaacagaggagaggctacatgaagaatgacaacctggcggcagcgcaaaagatg

SEQ ID NO: 109865 - DNA, 103 bp, Artificial Sequence
  Synthetic Polynucleotide
taatacgactcactataggggagctgaactttggcttcccaagtcattctaacagaggagaagaatgatgtgggaagccaacctggcggcagcgcaaaagatg

SEQ ID NO: 109866 - DNA, 103 bp, Artificial Sequence
  Synthetic Polynucleotide
taatacgactcactatagggaaatctctttgagctgaactttggcttcccaacagaggagagggaagatgaagttcagcaacctggcggcagcgcaaaagatg

SEQ ID NO: 109867 - DNA, 103 bp, Artificial Sequence
  Synthetic Polynucleotide
taatacgactcactataggggaattaatcaaaatctctttgagctgaactaacagaggagaagttcaatgcaaagagataacctggcggcagcgcaaaagatg

SEQ ID NO: 109868 - DNA, 103 bp, Artificial Sequence
  Synthetic Polynucleotide
taatacgactcactatagggtggaaacccagaattaatcaaaatctctttaacagaggagaaaagagatgttgattaataacctggcggcagcgcaaaagatg

SEQ ID NO: 109869 - DNA, 103 bp, Artificial Sequence
  Synthetic Polynucleotide
taatacgactcactatagggctccttcagcatttgctgtagtgtcaggagaacagaggagactcctgatgctacagcaaaacctggcggcagcgcaaaagatg

SEQ ID NO: 109870 - DNA, 103 bp, Artificial Sequence
  Synthetic Polynucleotide
taatacgactcactatagggaacaatcttctggaaacccagaattaatcaaacagaggagatgattaatgctgggtttcaacctggcggcagcgcaaaagatg

SEQ ID NO: 109871 - DNA, 103 bp, Artificial Sequence
  Synthetic Polynucleotide
taatacgactcactatagggtgtgtcaacaaacaatcttctggaaacccaaacagaggagatgggttatgagaagattgaacctggcggcagcgcaaaagatg

SEQ ID NO: 109872 - DNA, 103 bp, Artificial Sequence
  Synthetic Polynucleotide
taatacgactcactatagggagtaaacacttgtgtcaacaaacaatcttcaacagaggagagaagatatgttgttgacaaacctggcggcagcgcaaaagatg

SEQ ID NO: 109873 - DNA, 103 bp, Artificial Sequence
  Synthetic Polynucleotide
taatacgactcactataggggtccagtgttagtaaacacttgtgtcaacaaacagaggagatgttgaatgaagtgtttaaacctggcggcagcgcaaaagatg

SEQ ID NO: 109874 - DNA, 103 bp, Artificial Sequence
  Synthetic Polynucleotide
taatacgactcactatagggttattatctggtccagtgttagtaaacactaacagaggagaagtgttatgtaacactggaacctggcggcagcgcaaaagatg

SEQ ID NO: 109875 - DNA, 103 bp, Artificial Sequence
  Synthetic Polynucleotide
taatacgactcactatagggaacatccaaattattatctggtccagtgttaacagaggagaaacactatgccagataataacctggcggcagcgcaaaagatg

SEQ ID NO: 109876 - DNA, 103 bp, Artificial Sequence
  Synthetic Polynucleotide
taatacgactcactataggggggagataacaacatccaaattattatctgaacagaggagacagataatgatttggatgaacctggcggcagcgcaaaagatg

SEQ ID NO: 109877 - DNA, 103 bp, Artificial Sequence
  Synthetic Polynucleotide
taatacgactcactatagggaaggccaggagggagataacaacatccaaaaacagaggagatttggaatgtgttatctcaacctggcggcagcgcaaaagatg

SEQ ID NO: 109878 - DNA, 103 bp, Artificial Sequence
  Synthetic Polynucleotide
taatacgactcactataggggtacacaccaaaggccaggagggagataacaacagaggagagttatcatgctcctggccaacctggcggcagcgcaaaagatg

SEQ ID NO: 109879 - DNA, 103 bp, Artificial Sequence
  Synthetic Polynucleotide
taatacgactcactatagggatacattggggtacacaccaaaggccaggaaacagaggagatcctggatgttggtgtgtaacctggcggcagcgcaaaagatg

SEQ ID NO: 109880 - DNA, 103 bp, Artificial Sequence
  Synthetic Polynucleotide
taatacgactcactatagggatcttccttttgccacaccaggcatacagaaacagaggagatctgtaatgctggtgtggaacctggcggcagcgcaaaagatg

SEQ ID NO: 109881 - DNA, 103 bp, Artificial Sequence
  Synthetic Polynucleotide
taatacgactcactataggggttggtaaatctccttcagcatttgctgtaaacagaggagatacagcatgtgctgaaggaacctggcggcagcgcaaaagatg

SEQ ID NO: 109882 - DNA, 103 bp, Artificial Sequence
  Synthetic Polynucleotide
taatacgactcactatagggttatgatagcatacattggggtacacaccaaacagaggagatggtgtatgccccaatgtaacctggcggcagcgcaaaagatg

SEQ ID NO: 109883 - DNA, 103 bp, Artificial Sequence
  Synthetic Polynucleotide
taatacgactcactatagggcctcttttccttatgatagcatacattgggaacagaggagacccaatatgtgctatcataacctggcggcagcgcaaaagatg

SEQ ID NO: 109884 - DNA, 103 bp, Artificial Sequence
  Synthetic Polynucleotide
taatacgactcactatagggtgagaatcttcctcttttccttatgatagcaacagaggagagctatcatgaggaaaagaaacctggcggcagcgcaaaagatg

SEQ ID NO: 109885 - DNA, 103 bp, Artificial Sequence
  Synthetic Polynucleotide
taatacgactcactatagggccttcagtggtgagaatcttcctcttttccaacagaggagaggaaaaatggaagattctaacctggcggcagcgcaaaagatg

SEQ ID NO: 109886 - DNA, 103 bp, Artificial Sequence
  Synthetic Polynucleotide
taatacgactcactatagggtgcattacgcccttcagtggtgagaatcttaacagaggagaaagattatgaccactgaaaacctggcggcagcgcaaaagatg

SEQ ID NO: 109887 - DNA, 103 bp, Artificial Sequence
  Synthetic Polynucleotide
taatacgactcactatagggtgtggataagtgcattacgcccttcagtggaacagaggagaccactgatgggcgtaatgaacctggcggcagcgcaaaagatg

SEQ ID NO: 109888 - DNA, 103 bp, Artificial Sequence
  Synthetic Polynucleotide
taatacgactcactatagggacagatgatttgtggataagtgcattacgcaacagaggagagcgtaaatgacttatccaaacctggcggcagcgcaaaagatg

SEQ ID NO: 109889 - DNA, 103 bp, Artificial Sequence
  Synthetic Polynucleotide
taatacgactcactatagggaggacaattaacagatgatttgtggataagaacagaggagacttatcatgaaatcatctaacctggcggcagcgcaaaagatg

SEQ ID NO: 109890 - DNA, 103 bp, Artificial Sequence
  Synthetic Polynucleotide
taatacgactcactatagggggctactaaaaggacaattaacagatgattaacagaggagaaatcatatgttaattgtcaacctggcggcagcgcaaaagatg

SEQ ID NO: 109891 - DNA, 103 bp, Artificial Sequence
  Synthetic Polynucleotide
taatacgactcactatagggttcatgtcttggctactaaaaggacaattaaacagaggagataattgatgttttagtagaacctggcggcagcgcaaaagatg

SEQ ID NO: 109892 - DNA, 103 bp, Artificial Sequence
  Synthetic Polynucleotide
taatacgactcactatagggtcccatggttgttggtaaatctccttcagcaacagaggagagctgaaatggatttaccaaacctggcggcagcgcaaaagatg

SEQ ID NO: 109893 - DNA, 103 bp, Artificial Sequence
  Synthetic Polynucleotide
taatacgactcactatagggagatgggtacttcatgtcttggctactaaaaacagaggagatttagtatgcaagacatgaacctggcggcagcgcaaaagatg

SEQ ID NO: 109894 - DNA, 103 bp, Artificial Sequence
  Synthetic Polynucleotide
taatacgactcactatagggcaaagaagggagatgggtacttcatgtcttaacagaggagaaagacaatgagtacccataacctggcggcagcgcaaaagatg

SEQ ID NO: 109895 - DNA, 103 bp, Artificial Sequence
  Synthetic Polynucleotide
taatacgactcactatagggtcaccaaatacaaagaagggagatgggtacaacagaggagagtacccatgtcccttcttaacctggcggcagcgcaaaagatg

SEQ ID NO: 109896 - DNA, 103 bp, Artificial Sequence
  Synthetic Polynucleotide
taatacgactcactatagggtcgaatcttttcaccaaatacaaagaagggaacagaggagacccttcatggtatttggtaacctggcggcagcgcaaaagatg

SEQ ID NO: 109897 - DNA, 103 bp, Artificial Sequence
  Synthetic Polynucleotide
taatacgactcactatagggtggctcgagttcgaatcttttcaccaaataaacagaggagatatttgatgaaaagattcaacctggcggcagcgcaaaagatg

SEQ ID NO: 109898 - DNA, 103 bp, Artificial Sequence
  Synthetic Polynucleotide
taatacgactcactatagggttagcagagatggctcgagttcgaatctttaacagaggagaaaagatatgaactcgagcaacctggcggcagcgcaaaagatg

SEQ ID NO: 109899 - DNA, 103 bp, Artificial Sequence
  Synthetic Polynucleotide
taatacgactcactatagggagtcatgcctttagcagagatggctcgagtaacagaggagaactcgaatgatctctgctaacctggcggcagcgcaaaagatg

SEQ ID NO: 109900 - DNA, 103 bp, Artificial Sequence
  Synthetic Polynucleotide
taatacgactcactataggggggtgactaaagtcatgcctttagcagagaaacagaggagatctctgatgaaggcatgaaacctggcggcagcgcaaaagatg

SEQ ID NO: 109901 - DNA, 103 bp, Artificial Sequence
  Synthetic Polynucleotide
taatacgactcactatagggaactgcaggggggtgactaaagtcatgcctaacagaggagaaggcatatgtttagtcacaacctggcggcagcgcaaaagatg

SEQ ID NO: 109902 - DNA, 103 bp, Artificial Sequence
  Synthetic Polynucleotide
taatacgactcactatagggaaagagaagcaactgcaggggggtgactaaaacagaggagattagtcatgcccctgcagaacctggcggcagcgcaaaagatg

SEQ ID NO: 109903 - DNA, 103 bp, Artificial Sequence
  Synthetic Polynucleotide
taatacgactcactataggggaagaggtcctcccatggttgttggtaaataacagaggagaatttacatgcaaccatggaacctggcggcagcgcaaaagatg

SEQ ID NO: 109904 - DNA, 103 bp, Artificial Sequence
  Synthetic Polynucleotide
taatacgactcactatagggtcttggaggcaaagagaagcaactgcagggaacagaggagaccctgcatgtgcttctctaacctggcggcagcgcaaaagatg

SEQ ID NO: 109905 - DNA, 103 bp, Artificial Sequence
  Synthetic Polynucleotide
taatacgactcactataggggattggactttcttggaggcaaagagaagcaacagaggagagcttctatgtgcctccaaaacctggcggcagcgcaaaagatg

SEQ ID NO: 109906 - DNA, 103 bp, Artificial Sequence
  Synthetic Polynucleotide
taatacgactcactatagggctgcccatcagattggactttcttggaggcaacagaggagagcctccatgaaagtccaaaacctggcggcagcgcaaaagatg

SEQ ID NO: 109907 - DNA, 103 bp, Artificial Sequence
  Synthetic Polynucleotide
taatacgactcactatagggcaagcacaatctgcccatcagattggacttaacagaggagaaagtccatgctgatgggcaacctggcggcagcgcaaaagatg

SEQ ID NO: 109908 - DNA, 103 bp, Artificial Sequence
  Synthetic Polynucleotide
taatacgactcactatagggcagtcatctacaagcacaatctgcccatcaaacagaggagatgatggatggattgtgctaacctggcggcagcgcaaaagatg

SEQ ID NO: 109909 - DNA, 103 bp, Artificial Sequence
  Synthetic Polynucleotide
taatacgactcactatagggcagtttaatccagtcatctacaagcacaataacagaggagaattgtgatggtagatgacaacctggcggcagcgcaaaagatg

SEQ ID NO: 109910 - DNA, 103 bp, Artificial Sequence
  Synthetic Polynucleotide
taatacgactcactataggggagatatttgcagtttaatccagtcatctaaacagaggagatagatgatgggattaaacaacctggcggcagcgcaaaagatg

SEQ ID NO: 109911 - DNA, 103 bp, Artificial Sequence
  Synthetic Polynucleotide
taatacgactcactataggggcagcttcatgagatatttgcagtttaatcaacagaggagagattaaatggcaaatatcaacctggcggcagcgcaaaagatg

SEQ ID NO: 109912 - DNA, 103 bp, Artificial Sequence
  Synthetic Polynucleotide
taatacgactcactataggggatacaggcagcagcttcatgagatatttgaacagaggagacaaataatgcatgaagctaacctggcggcagcgcaaaagatg

SEQ ID NO: 109913 - DNA, 103 bp, Artificial Sequence
  Synthetic Polynucleotide
taatacgactcactatagggggagaccagtgatacaggcagcagcttcataacagaggagaatgaagatgctgcctgtaaacctggcggcagcgcaaaagatg

SEQ ID NO: 109914 - DNA, 103 bp, Artificial Sequence
  Synthetic Polynucleotide
taatacgactcactatagggagatgtggaggaagaggtcctcccatggttaacagaggagaaaccatatgaggacctctaacctggcggcagcgcaaaagatg

SEQ ID NO: 109915 - DNA, 103 bp, Artificial Sequence
  Synthetic Polynucleotide
taatacgactcactatagggatggctgcccggagaccagtgatacaggcaaacagaggagatgcctgatgcactggtctaacctggcggcagcgcaaaagatg

SEQ ID NO: 109916 - DNA, 103 bp, Artificial Sequence
  Synthetic Polynucleotide
taatacgactcactatagggcaaagcctccatggctgcccggagaccagtaacagaggagaactggtatgcgggcagccaacctggcggcagcgcaaaagatg

SEQ ID NO: 109917 - DNA, 103 bp, Artificial Sequence
  Synthetic Polynucleotide
taatacgactcactatagggcttcaacaaccaaagcctccatggctgcccaacagaggagagggcagatgtggaggcttaacctggcggcagcgcaaaagatg

SEQ ID NO: 109918 - DNA, 103 bp, Artificial Sequence
  Synthetic Polynucleotide
taatacgactcactatagggtgtttggttacttcaacaaccaaagcctccaacagaggagaggaggcatgggttgttgaaacctggcggcagcgcaaaagatg

SEQ ID NO: 109919 - DNA, 103 bp, Artificial Sequence
  Synthetic Polynucleotide
taatacgactcactataggggatagcaggttgtttggttacttcaacaacaacagaggagagttgttatggtaaccaaaaacctggcggcagcgcaaaagatg

SEQ ID NO: 109920 - DNA, 103 bp, Artificial Sequence
  Synthetic Polynucleotide
taatacgactcactatagggactggctgatgatagcaggttgtttggttaaacagaggagataaccaatgaacctgctaaacctggcggcagcgcaaaagatg

SEQ ID NO: 109921 - DNA, 103 bp, Artificial Sequence
  Synthetic Polynucleotide
taatacgactcactatagggacggggtccaactggctgatgatagcaggtaacagaggagaacctgcatgcatcagccaaacctggcggcagcgcaaaagatg

SEQ ID NO: 109922 - DNA, 103 bp, Artificial Sequence
  Synthetic Polynucleotide
taatacgactcactatagggacgttcatttacggggtccaactggctgataacagaggagaatcagcatgttggaccccaacctggcggcagcgcaaaagatg

SEQ ID NO: 109923 - DNA, 103 bp, Artificial Sequence
  Synthetic Polynucleotide
taatacgactcactatagggtgttcagcatacgttcatttacggggtccaaacagaggagatggaccatgtaaatgaacaacctggcggcagcgcaaaagatg

SEQ ID NO: 109924 - DNA, 103 bp, Artificial Sequence
  Synthetic Polynucleotide
taatacgactcactatagggtgacggatcatgttcagcatacgttcatttaacagaggagaaaatgaatgtatgctgaaaacctggcggcagcgcaaaagatg

SEQ ID NO: 109925 - DNA, 103 bp, Artificial Sequence
  Synthetic Polynucleotide
taatacgactcactatagggtttgagagccagatgtggaggaagaggtccaacagaggagaggacctatgcctccacataacctggcggcagcgcaaaagatg

SEQ ID NO: 109926 - DNA, 103 bp, Artificial Sequence
  Synthetic Polynucleotide
taatacgactcactatagggtctagagatctgacggatcatgttcagcataacagaggagaatgctgatgatgatccgtaacctggcggcagcgcaaaagatg

SEQ ID NO: 109927 - DNA, 103 bp, Artificial Sequence
  Synthetic Polynucleotide
taatacgactcactatagggcagctgagggtctagagatctgacggatcaaacagaggagatgatccatgagatctctaaacctggcggcagcgcaaaagatg

SEQ ID NO: 109928 - DNA, 103 bp, Artificial Sequence
  Synthetic Polynucleotide
taatacgactcactatagggttgataccagcagctgagggtctagagatcaacagaggagagatctcatgaccctcagcaacctggcggcagcgcaaaagatg

SEQ ID NO: 109929 - DNA, 103 bp, Artificial Sequence
  Synthetic Polynucleotide
taatacgactcactatagggaatcataaggttgataccagcagctgagggaacagaggagaccctcaatggctggtatcaacctggcggcagcgcaaaagatg

SEQ ID NO: 109930 - DNA, 103 bp, Artificial Sequence
  Synthetic Polynucleotide
taatacgactcactataggggtgtactgccaatcataaggttgataccagaacagaggagactggtaatgaccttatgaaacctggcggcagcgcaaaagatg

SEQ ID NO: 109931 - DNA, 103 bp, Artificial Sequence
  Synthetic Polynucleotide
taatacgactcactatagggtctccataccgtgtactgccaatcataaggaacagaggagaccttatatgtggcagtacaacctggcggcagcgcaaaagatg

SEQ ID NO: 109932 - DNA, 103 bp, Artificial Sequence
  Synthetic Polynucleotide
taatacgactcactatagggacgtggaccatctccataccgtgtactgccaacagaggagaggcagtatgcggtatggaaacctggcggcagcgcaaaagatg

SEQ ID NO: 109933 - DNA, 103 bp, Artificial Sequence
  Synthetic Polynucleotide
taatacgactcactatagggtcttgggaggacgtggaccatctccataccaacagaggagaggtatgatgatggtccacaacctggcggcagcgcaaaagatg

SEQ ID NO: 109934 - DNA, 103 bp, Artificial Sequence
  Synthetic Polynucleotide
taatacgactcactatagggtatcgggccatcttgggaggacgtggaccaaacagaggagatggtccatgtcctcccaaaacctggcggcagcgcaaaagatg

SEQ ID NO: 109935 - DNA, 103 bp, Artificial Sequence
  Synthetic Polynucleotide
taatacgactcactatagggtccattgtcgtatcgggccatcttgggaggaacagaggagacctcccatgatggcccgaaacctggcggcagcgcaaaagatg

SEQ ID NO: 109936 - DNA, 103 bp, Artificial Sequence
  Synthetic Polynucleotide
taatacgactcactatagggtattttctgctttgagagccagatgtggagaacagaggagactccacatgtggctctcaaacctggcggcagcgcaaaagatg

SEQ ID NO: 109937 - DNA, 103 bp, Artificial Sequence
  Synthetic Polynucleotide
taatacgactcactatagggtatatccgcttccattgtcgtatcgggccaaacagaggagatggcccatgacgacaatgaacctggcggcagcgcaaaagatg

SEQ ID NO: 109938 - DNA, 103 bp, Artificial Sequence
  Synthetic Polynucleotide
taatacgactcactatagggcctccccttctatatccgcttccattgtcgaacagaggagacgacaaatgaagcggataaacctggcggcagcgcaaaagatg

SEQ ID NO: 109939 - DNA, 103 bp, Artificial Sequence
  Synthetic Polynucleotide
taatacgactcactataggggtaactagaacctccccttctatatccgctaacagaggagaagcggaatgagaaggggaaacctggcggcagcgcaaaagatg

SEQ ID NO: 109940 - DNA, 103 bp, Artificial Sequence
  Synthetic Polynucleotide
taatacgactcactatagggctccaccactgtaactagaacctccccttcaacagaggagagaagggatggttctagttaacctggcggcagcgcaaaagatg

SEQ ID NO: 109941 - DNA, 103 bp, Artificial Sequence
  Synthetic Polynucleotide
taatacgactcactatagggccgccatagcctccaccactgtaactagaaaacagaggagattctagatgcagtggtggaacctggcggcagcgcaaaagatg

SEQ ID NO: 109942 - DNA, 103 bp, Artificial Sequence
  Synthetic Polynucleotide
taatacgactcactataggggctatagccaccgccatagcctccaccactaacagaggagaagtggtatgggctatggcaacctggcggcagcgcaaaagatg

SEQ ID NO: 109943 - DNA, 103 bp, Artificial Sequence
  Synthetic Polynucleotide
taatacgactcactatagggagcctccactgctatagccaccgccatagcaacagaggagagctatgatggtggctataaacctggcggcagcgcaaaagatg

SEQ ID NO: 109944 - DNA, 103 bp, Artificial Sequence
  Synthetic Polynucleotide
taatacgactcactatagggccgctaccatagcctccactgctatagccaaacagaggagatggctaatgcagtggaggaacctggcggcagcgcaaaagatg

SEQ ID NO: 109945 - DNA, 103 bp, Artificial Sequence
  Synthetic Polynucleotide
taatacgactcactatagggaccatagcctccgctaccatagcctccactaacagaggagaagtggaatgtatggtagcaacctggcggcagcgcaaaagatg

SEQ ID NO: 109946 - DNA, 103 bp, Artificial Sequence
  Synthetic Polynucleotide
taatacgactcactatagggtggcgctgccaccatagcctccgctaccataacagaggagaatggtaatggaggctatgaacctggcggcagcgcaaaagatg

SEQ ID NO: 109947 - DNA, 103 bp, Artificial Sequence
  Synthetic Polynucleotide
taatacgactcactatagggacctcagaattattttctgctttgagagccaacagaggagaggctctatgagcagaaaaaacctggcggcagcgcaaaagatg

SEQ ID NO: 109948 - DNA, 103 bp, Artificial Sequence
  Synthetic Polynucleotide
taatacgactcactatagggcgaaaggagttggcgctgccaccatagcctaacagaggagaaggctaatgtggcagcgcaacctggcggcagcgcaaaagatg

SEQ ID NO: 109949 - DNA, 103 bp, Artificial Sequence
  Synthetic Polynucleotide
taatacgactcactatagggatatcctgcccgaaaggagttggcgctgccaacagaggagaggcagcatgaactcctttaacctggcggcagcgcaaaagatg

SEQ ID NO: 109950 - DNA, 103 bp, Artificial Sequence
  Synthetic Polynucleotide
taatacgactcactatagggcacctgcaccatatcctgcccgaaaggagtaacagaggagaactcctatggggcaggataacctggcggcagcgcaaaagatg

SEQ ID NO: 109951 - DNA, 103 bp, Artificial Sequence
  Synthetic Polynucleotide
taatacgactcactatagggcctccaccaacacctgcaccatatcctgccaacagaggagaggcaggatgtggtgcaggaacctggcggcagcgcaaaagatg

SEQ ID NO: 109952 - DNA, 103 bp, Artificial Sequence
  Synthetic Polynucleotide
taatacgactcactatagggtcctctatagcctccaccaacacctgcaccaacagaggagaggtgcaatggttggtggaaacctggcggcagcgcaaaagatg

SEQ ID NO: 109953 - DNA, 103 bp, Artificial Sequence
  Synthetic Polynucleotide
taatacgactcactatagggctcgggaaactcctctatagcctccaccaaaacagaggagattggtgatggctatagagaacctggcggcagcgcaaaagatg

SEQ ID NO: 109954 - DNA, 103 bp, Artificial Sequence
  Synthetic Polynucleotide
taatacgactcactatagggctaaagccacctcgggaaactcctctatagaacagaggagactatagatgagtttcccgaacctggcggcagcgcaaaagatg

SEQ ID NO: 109955 - DNA, 103 bp, Artificial Sequence
  Synthetic Polynucleotide
taatacgactcactatagggagagttgcctctaaagccacctcgggaaacaacagaggagagtttccatgggtggctttaacctggcggcagcgcaaaagatg

SEQ ID NO: 109956 - DNA, 103 bp, Artificial Sequence
  Synthetic Polynucleotide
taatacgactcactatagggagtctcctccagagttgcctctaaagccacaacagaggagagtggctatggaggcaactaacctggcggcagcgcaaaagatg

SEQ ID NO: 109957 - DNA, 103 bp, Artificial Sequence
  Synthetic Polynucleotide
taatacgactcactatagggggccctctgtagtctcctccagagttgcctaacagaggagaaggcaaatgtggaggagaaacctggcggcagcgcaaaagatg

SEQ ID NO: 109958 - DNA, 103 bp, Artificial Sequence
  Synthetic Polynucleotide
taatacgactcactatagggagaggcccctacctcagaattattttctgcaacagaggagagcagaaatgaattctgagaacctggcggcagcgcaaaagatg

SEQ ID NO: 109959 - DNA, 103 bp, Artificial Sequence
  Synthetic Polynucleotide
taatacgactcactataggggcctccactaggccctctgtagtctcctccaacagaggagaggaggaatgtacagagggaacctggcggcagcgcaaaagatg

SEQ ID NO: 109960 - DNA, 103 bp, Artificial Sequence
  Synthetic Polynucleotide
taatacgactcactatagggatcctctgtagcctccactaggccctctgtaacagaggagaacagagatgctagtggagaacctggcggcagcgcaaaagatg

SEQ ID NO: 109961 - DNA, 103 bp, Artificial Sequence
  Synthetic Polynucleotide
taatacgactcactatagggaatcccccagatcctctgtagcctccactaaacagaggagatagtggatgctacagaggaacctggcggcagcgcaaaagatg

SEQ ID NO: 109962 - DNA, 103 bp, Artificial Sequence
  Synthetic Polynucleotide
taatacgactcactatagggtcctcgctggaatcccccagatcctctgtaaacagaggagatacagaatgtctgggggaaacctggcggcagcgcaaaagatg

SEQ ID NO: 109963 - DNA, 103 bp, Artificial Sequence
  Synthetic Polynucleotide
taatacgactcactatagggccctaccacctcctcgctggaatcccccagaacagaggagactggggatgtccagcgagaacctggcggcagcgcaaaagatg

SEQ ID NO: 109964 - DNA, 103 bp, Artificial Sequence
  Synthetic Polynucleotide
taatacgactcactatagggccataggcccccctaccacctcctcgctggaacagaggagaccagcgatgaggtggtagaacctggcggcagcgcaaaagatg

SEQ ID NO: 109965 - DNA, 103 bp, Artificial Sequence
  Synthetic Polynucleotide
taatacgactcactataggggtagccagttccataggcccccctaccaccaacagaggagaggtggtatgggggcctataacctggcggcagcgcaaaagatg

SEQ ID NO: 109966 - DNA, 103 bp, Artificial Sequence
  Synthetic Polynucleotide
taatacgactcactatagggcctgtccaaagtagccagttccataggcccaacagaggagagggcctatggaactggctaacctggcggcagcgcaaaagatg

SEQ ID NO: 109967 - DNA, 103 bp, Artificial Sequence
  Synthetic Polynucleotide
taatacgactcactatagggcctcctcttccctgtccaaagtagccagttaacagaggagaaactggatgctttggacaaacctggcggcagcgcaaaagatg

SEQ ID NO: 109968 - DNA, 103 bp, Artificial Sequence
  Synthetic Polynucleotide
taatacgactcactatagggatagccgccacctcctcttccctgtccaaaaacagaggagatttggaatgggaagaggaaacctggcggcagcgcaaaagatg

SEQ ID NO: 109969 - DNA, 103 bp, Artificial Sequence
  Synthetic Polynucleotide
taatacgactcactatagggcaccatagccagaggcccctacctcagaataacagaggagaattctgatgtaggggcctaacctggcggcagcgcaaaagatg

SEQ ID NO: 109970 - DNA, 103 bp, Artificial Sequence
  Synthetic Polynucleotide
taatacgactcactatagggggcccaggaacaccatagccagaggcccctaacagaggagaaggggcatgtggctatggaacctggcggcagcgcaaaagatg

SEQ ID NO: 109971 - DNA, 103 bp, Artificial Sequence
  Synthetic Polynucleotide
taatacgactcactatagggggatggggtcatcttccttttgccacaccaaacagaggagatggtgtatgaaaaggaagaacctggcggcagcgcaaaagatg

SEQ ID NO: 109972 - DNA, 103 bp, Artificial Sequence
  Synthetic Polynucleotide
taatacgactcactataggggtcccaggtgggcccaggaacaccatagccaacagaggagaggctatatggttcctgggaacctggcggcagcgcaaaagatg

SEQ ID NO: 109973 - DNA, 103 bp, Artificial Sequence
  Synthetic Polynucleotide
taatacgactcactatagggtggctcctcggtcccaggtgggcccaggaaaacagaggagattcctgatgccacctgggaacctggcggcagcgcaaaagatg

SEQ ID NO: 109974 - DNA, 103 bp, Artificial Sequence
  Synthetic Polynucleotide
taatacgactcactatagggtccttcaagttggctcctcggtcccaggtgaacagaggagacacctgatgccgaggagcaacctggcggcagcgcaaaagatg

SEQ ID NO: 109975 - DNA, 103 bp, Artificial Sequence
  Synthetic Polynucleotide
taatacgactcactatagggtgagtagtaatccttcaagttggctcctcgaacagaggagacgaggaatgaacttgaagaacctggcggcagcgcaaaagatg

SEQ ID NO: 109976 - DNA, 103 bp, Artificial Sequence
  Synthetic Polynucleotide
taatacgactcactatagggcttcctttcttgagtagtaatccttcaagtaacagaggagaacttgaatgattactactaacctggcggcagcgcaaaagatg

SEQ ID NO: 109977 - DNA, 103 bp, Artificial Sequence
  Synthetic Polynucleotide
taatacgactcactatagggacttcttgttcttcctttcttgagtagtaaaacagaggagattactaatgaagaaaggaaacctggcggcagcgcaaaagatg

SEQ ID NO: 109978 - DNA, 103 bp, Artificial Sequence
  Synthetic Polynucleotide
taatacgactcactatagggagtcgcttgcacttcttgttcttcctttctaacagaggagaagaaagatggaacaagaaaacctggcggcagcgcaaaagatg

SEQ ID NO: 109979 - DNA, 103 bp, Artificial Sequence
  Synthetic Polynucleotide
taatacgactcactatagggctgattctagagtcgcttgcacttcttgttaacagaggagaaacaagatgtgcaagcgaaacctggcggcagcgcaaaagatg

SEQ ID NO: 109980 - DNA, 103 bp, Artificial Sequence
  Synthetic Polynucleotide
taatacgactcactatagggtccacttcttctgattctagagtcgcttgcaacagaggagagcaagcatgtctagaatcaacctggcggcagcgcaaaagatg

SEQ ID NO: 109981 - DNA, 103 bp, Artificial Sequence
  Synthetic Polynucleotide
taatacgactcactatagggagcatttaaatccacttcttctgattctagaacagaggagactagaaatggaagaagtgaacctggcggcagcgcaaaagatg

SEQ ID NO: 109982 - DNA, 103 bp, Artificial Sequence
  Synthetic Polynucleotide
taatacgactcactatagggtaatttcataggatggggtcatcttcctttaacagaggagaaaaggaatgtgaccccataacctggcggcagcgcaaaagatg

SEQ ID NO: 109983 - DNA, 103 bp, Artificial Sequence
  Synthetic Polynucleotide
taatacgactcactatagggcatgaagcccagcatttaaatccacttcttaacagaggagaaagaagatgatttaaatgaacctggcggcagcgcaaaagatg

SEQ ID NO: 109984 - DNA, 103 bp, Artificial Sequence
  Synthetic Polynucleotide
taatacgactcactataggggtccagtttccatgaagcccagcatttaaaaacagaggagatttaaaatgtgggcttcaaacctggcggcagcgcaaaagatg

SEQ ID NO: 109985 - DNA, 103 bp, Artificial Sequence
  Synthetic Polynucleotide
taatacgactcactatagggattttccaaggtccagtttccatgaagcccaacagaggagagggcttatgggaaactggaacctggcggcagcgcaaaagatg

SEQ ID NO: 109986 - DNA, 103 bp, Artificial Sequence
  Synthetic Polynucleotide
taatacgactcactataggggagctttagcattttccaaggtccagtttcaacagaggagagaaactatgccttggaaaaacctggcggcagcgcaaaagatg

SEQ ID NO: 109987 - DNA, 103 bp, Artificial Sequence
  Synthetic Polynucleotide
taatacgactcactatagggtggtttagacgagctttagcattttccaagaacagaggagacttggaatgtgctaaagcaacctggcggcagcgcaaaagatg

SEQ ID NO: 109988 - DNA, 103 bp, Artificial Sequence
  Synthetic Polynucleotide
taatacgactcactatagggctgaaaatattggtttagacgagctttagcaacagaggagagctaaaatgcgtctaaacaacctggcggcagcgcaaaagatg

SEQ ID NO: 109989 - DNA, 103 bp, Artificial Sequence
  Synthetic Polynucleotide
taatacgactcactatagggtcttttctttctgaaaatattggtttagacaacagaggagagtctaaatgaatattttcaacctggcggcagcgcaaaagatg

SEQ ID NO: 109990 - DNA, 103 bp, Artificial Sequence
  Synthetic Polynucleotide
taatacgactcactatagggtctccttggatcttttctttctgaaaatataacagaggagaatatttatggaaagaaaaaacctggcggcagcgcaaaagatg

SEQ ID NO: 109991 - DNA, 103 bp, Artificial Sequence
  Synthetic Polynucleotide
taatacgactcactataggggtacttatattctccttggatcttttctttaacagaggagaaaagaaatgatccaaggaaacctggcggcagcgcaaaagatg

SEQ ID NO: 109992 - DNA, 103 bp, Artificial Sequence
  Synthetic Polynucleotide
taatacgactcactatagggccacttgggtgtacttatattctccttggaaacagaggagatccaagatgaatataagtaacctggcggcagcgcaaaagatg

SEQ ID NO: 109993 - DNA, 103 bp, Artificial Sequence
  Synthetic Polynucleotide
taatacgactcactatagggcccactgctctaatttcataggatggggtcaacagaggagagaccccatgctatgaaataacctggcggcagcgcaaaagatg

SEQ ID NO: 109994 - DNA, 103 bp, Artificial Sequence
  Synthetic Polynucleotide
taatacgactcactatagggtgatcaggacccacttgggtgtacttatataacagaggagaatataaatgcacccaagtaacctggcggcagcgcaaaagatg

SEQ ID NO: 109995 - DNA, 103 bp, Artificial Sequence
  Synthetic Polynucleotide
taatacgactcactataggggctcctgttgtgatcaggacccacttgggtaacagaggagaacccaaatgggtcctgataacctggcggcagcgcaaaagatg

SEQ ID NO: 109996 - DNA, 103 bp, Artificial Sequence
  Synthetic Polynucleotide
taatacgactcactatagggctgcaataaagctcctgttgtgatcaggacaacagaggagagtcctgatgacaacaggaaacctggcggcagcgcaaaagatg

SEQ ID NO: 109997 - DNA, 103 bp, Artificial Sequence
  Synthetic Polynucleotide
taatacgactcactatagggatggtcatttctgcaataaagctcctgttgaacagaggagacaacagatgctttattgcaacctggcggcagcgcaaaagatg

SEQ ID NO: 109998 - DNA, 103 bp, Artificial Sequence
  Synthetic Polynucleotide
taatacgactcactatagggcttgatataaatggtcatttctgcaataaaaacagaggagatttattatggaaatgaccaacctggcggcagcgcaaaagatg

SEQ ID NO: 109999 - DNA, 103 bp, Artificial Sequence
  Synthetic Polynucleotide
taatacgactcactatagggtgcccagctgcttgatataaatggtcatttaacagaggagaaaatgaatgtttatatcaaacctggcggcagcgcaaaagatg

SEQ ID NO: 110000 - DNA, 103 bp, Artificial Sequence
  Synthetic Polynucleotide
taatacgactcactatagggaaaatccttctgcccagctgcttgatataaaacagaggagattatatatggcagctgggaacctggcggcagcgcaaaagatg

SEQ ID NO: 110001 - DNA, 103 bp, Artificial Sequence
  Synthetic Polynucleotide
taatacgactcactatagggttctcgtgcaaaaatccttctgcccagctgaacagaggagacagctgatgagaaggattaacctggcggcagcgcaaaagatg

SEQ ID NO: 110002 - DNA, 103 bp, Artificial Sequence
  Synthetic Polynucleotide
taatacgactcactatagggttgatccatgttctcgtgcaaaaatccttcaacagaggagagaaggaatgttgcacgagaacctggcggcagcgcaaaagatg

SEQ ID NO: 110003 - DNA, 103 bp, Artificial Sequence
  Synthetic Polynucleotide
taatacgactcactatagggaatttcttatttgatccatgttctcgtgcaaacagaggagatgcacgatgacatggatcaacctggcggcagcgcaaaagatg

SEQ ID NO: 110004 - DNA, 103 bp, Artificial Sequence
  Synthetic Polynucleotide
taatacgactcactataggggtttttgttccccactgctctaatttcataaacagaggagatatgaaatgagagcagtgaacctggcggcagcgcaaaagatg

SEQ ID NO: 110005 - DNA, 103 bp, Artificial Sequence
  Synthetic Polynucleotide
taatacgactcactatagggctgtgctgccaatttcttatttgatccatgaacagaggagacatggaatgaataagaaaaacctggcggcagcgcaaaagatg

SEQ ID NO: 110006 - DNA, 103 bp, Artificial Sequence
  Synthetic Polynucleotide
taatacgactcactataggggggcacaggactgtgctgccaatttcttataacagaggagaataagaatgtggcagcacaacctggcggcagcgcaaaagatg

SEQ ID NO: 110007 - DNA, 103 bp, Artificial Sequence
  Synthetic Polynucleotide
taatacgactcactatagggacaagtgacagggcacaggactgtgctgccaacagaggagaggcagcatggtcctgtgcaacctggcggcagcgcaaaagatg

SEQ ID NO: 110008 - DNA, 103 bp, Artificial Sequence
  Synthetic Polynucleotide
taatacgactcactatagggcagttgtctgacaagtgacagggcacaggaaacagaggagatcctgtatgctgtcacttaacctggcggcagcgcaaaagatg

SEQ ID NO: 110009 - DNA, 103 bp, Artificial Sequence
  Synthetic Polynucleotide
taatacgactcactatagggcaagatggtacagttgtctgacaagtgacaaacagaggagatgtcacatgtcagacaacaacctggcggcagcgcaaaagatg

SEQ ID NO: 110010 - DNA, 103 bp, Artificial Sequence
  Synthetic Polynucleotide
taatacgactcactatagggtcaaccactccaagatggtacagttgtctgaacagaggagacagacaatggtaccatctaacctggcggcagcgcaaaagatg

SEQ ID NO: 110011 - DNA, 103 bp, Artificial Sequence
  Synthetic Polynucleotide
taatacgactcactatagggggagtaagcttcaaccactccaagatggtaaacagaggagataccatatgggagtggttaacctggcggcagcgcaaaagatg

SEQ ID NO: 110012 - DNA, 103 bp, Artificial Sequence
  Synthetic Polynucleotide
taatacgactcactatagggttgtaagtccggagtaagcttcaaccactcaacagaggagagagtggatgaagcttactaacctggcggcagcgcaaaagatg

SEQ ID NO: 110013 - DNA, 103 bp, Artificial Sequence
  Synthetic Polynucleotide
taatacgactcactatagggtccttcttctttgtaagtccggagtaagctaacagaggagaagcttaatgcggacttacaacctggcggcagcgcaaaagatg

SEQ ID NO: 110014 - DNA, 103 bp, Artificial Sequence
  Synthetic Polynucleotide
taatacgactcactatagggtgtctctccttccttcttctttgtaagtccaacagaggagaggacttatgaagaagaagaacctggcggcagcgcaaaagatg

SEQ ID NO: 110015 - DNA, 103 bp, Artificial Sequence
  Synthetic Polynucleotide
taatacgactcactatagggatttctgcctgtttttgttccccactgctcaacagaggagagagcagatgggaacaaaaaacctggcggcagcgcaaaagatg

SEQ ID NO: 110016 - DNA, 103 bp, Artificial Sequence
  Synthetic Polynucleotide
taatacgactcactatagggaaggctccactgtctctccttccttcttctaacagaggagaagaagaatgaaggagagaaacctggcggcagcgcaaaagatg

SEQ ID NO: 110017 - DNA, 103 bp, Artificial Sequence
  Synthetic Polynucleotide
taatacgactcactatagggtttactttgtaaggctccactgtctctcctaacagaggagaaggagaatgagtggagccaacctggcggcagcgcaaaagatg

SEQ ID NO: 110018 - DNA, 103 bp, Artificial Sequence
  Synthetic Polynucleotide
taatacgactcactatagggttgagagaggtttactttgtaaggctccacaacagaggagagtggagatgtacaaagtaaacctggcggcagcgcaaaagatg

SEQ ID NO: 110019 - DNA, 103 bp, Artificial Sequence
  Synthetic Polynucleotide
taatacgactcactataggggctctaaatcttgagagaggtttactttgtaacagaggagaacaaagatgacctctctcaacctggcggcagcgcaaaagatg

SEQ ID NO: 110020 - DNA, 103 bp, Artificial Sequence
  Synthetic Polynucleotide
taatacgactcactatagggtgcagctgatgctctaaatcttgagagaggaacagaggagacctctcatgagatttagaaacctggcggcagcgcaaaagatg

SEQ ID NO: 110021 - DNA, 103 bp, Artificial Sequence
  Synthetic Polynucleotide
taatacgactcactatagggaatgatgttttgcagctgatgctctaaatcaacagaggagagatttaatgcatcagctgaacctggcggcagcgcaaaagatg

SEQ ID NO: 110022 - DNA, 103 bp, Artificial Sequence
  Synthetic Polynucleotide
taatacgactcactatagggttagctcttgaatgatgttttgcagctgataacagaggagaatcagcatgaaaacatcaaacctggcggcagcgcaaaagatg

SEQ ID NO: 110023 - DNA, 103 bp, Artificial Sequence
  Synthetic Polynucleotide
taatacgactcactatagggatctcaagatttagctcttgaatgatgtttaacagaggagaaaacatatgtcaagagctaacctggcggcagcgcaaaagatg

SEQ ID NO: 110024 - DNA, 103 bp, Artificial Sequence
  Synthetic Polynucleotide
taatacgactcactatagggcgggggcaaaatctcaagatttagctcttgaacagaggagacaagagatgaatcttgagaacctggcggcagcgcaaaagatg

SEQ ID NO: 110025 - DNA, 103 bp, Artificial Sequence
  Synthetic Polynucleotide
taatacgactcactataggggatcttcaggcgggggcaaaatctcaagataacagaggagaatcttgatgttttgccccaacctggcggcagcgcaaaagatg

SEQ ID NO: 110026 - DNA, 103 bp, Artificial Sequence
  Synthetic Polynucleotide
taatacgactcactatagggtcacacatgaatttctgcctgtttttgttcaacagaggagagaacaaatgcaggcagaaaacctggcggcagcgcaaaagatg

SEQ ID NO: 110027 - DNA, 103 bp, Artificial Sequence
  Synthetic Polynucleotide
taatacgactcactatagggggcacagaaggatcttcaggcgggggcaaaaacagaggagatttgccatggcctgaagaaacctggcggcagcgcaaaagatg

SEQ ID NO: 110028 - DNA, 103 bp, Artificial Sequence
  Synthetic Polynucleotide
taatacgactcactataggggagtgcaactggcacagaaggatcttcaggaacagaggagacctgaaatgccttctgtgaacctggcggcagcgcaaaagatg

SEQ ID NO: 110029 - DNA, 103 bp, Artificial Sequence
  Synthetic Polynucleotide
taatacgactcactatagggtgccaatgttgagtgcaactggcacagaagaacagaggagacttctgatgcagttgcacaacctggcggcagcgcaaaagatg

SEQ ID NO: 110030 - DNA, 103 bp, Artificial Sequence
  Synthetic Polynucleotide
taatacgactcactatagggtgagccaatttgccaatgttgagtgcaactaacagaggagaagttgcatgcaacattggaacctggcggcagcgcaaaagatg

SEQ ID NO: 110031 - DNA, 103 bp, Artificial Sequence
  Synthetic Polynucleotide
taatacgactcactatagggtggttcgaactgagccaatttgccaatgttaacagaggagaaacattatgaaattggctaacctggcggcagcgcaaaagatg

SEQ ID NO: 110032 - DNA, 103 bp, Artificial Sequence
  Synthetic Polynucleotide
taatacgactcactataggggtcgctgagatggttcgaactgagccaattaacagaggagaaattggatgagttcgaacaacctggcggcagcgcaaaagatg

SEQ ID NO: 110033 - DNA, 103 bp, Artificial Sequence
  Synthetic Polynucleotide
taatacgactcactatagggacttggttttgtcgctgagatggttcgaacaacagaggagagttcgaatgatctcagcgaacctggcggcagcgcaaaagatg

SEQ ID NO: 110034 - DNA, 103 bp, Artificial Sequence
  Synthetic Polynucleotide
taatacgactcactatagggaaccacacccacttggttttgtcgctgagaaacagaggagatctcagatgcaaaaccaaaacctggcggcagcgcaaaagatg

SEQ ID NO: 110035 - DNA, 103 bp, Artificial Sequence
  Synthetic Polynucleotide
taatacgactcactataggggtgaccaaggaaccacacccacttggttttaacagaggagaaaaaccatgtgggtgtggaacctggcggcagcgcaaaagatg

SEQ ID NO: 110036 - DNA, 103 bp, Artificial Sequence
  Synthetic Polynucleotide
taatacgactcactataggggattgtggaggtgaccaaggaaccacacccaacagaggagagggtgtatgtccttggtcaacctggcggcagcgcaaaagatg

SEQ ID NO: 110037 - DNA, 103 bp, Artificial Sequence
  Synthetic Polynucleotide
taatacgactcactataggggagactttctggcatggtggtcatggtcataacagaggagaatgaccatgaccaccatgaacctggcggcagcgcaaaagatg

SEQ ID NO: 110038 - DNA, 103 bp, Artificial Sequence
  Synthetic Polynucleotide
taatacgactcactataggggtagtgcccgtgggacatgggagaaggagaaacagaggagatctcctatgcccatgtccaacctggcggcagcgcaaaagatg

SEQ ID NO: 110039 - DNA, 103 bp, Artificial Sequence
  Synthetic Polynucleotide
taatacgactcactatagggagtgcatggagtagtgcccgtgggacatggaacagaggagaccatgtatgacgggcactaacctggcggcagcgcaaaagatg

SEQ ID NO: 110040 - DNA, 103 bp, Artificial Sequence
  Synthetic Polynucleotide
taatacgactcactataggggagtgtaaacagtgcatggagtagtgcccgaacagaggagacgggcaatgctccatgcaaacctggcggcagcgcaaaagatg

SEQ ID NO: 110041 - DNA, 103 bp, Artificial Sequence
  Synthetic Polynucleotide
taatacgactcactatagggatggcccgccgagtgtaaacagtgcatggaaacagaggagatccatgatgtgtttacacaacctggcggcagcgcaaaagatg

SEQ ID NO: 110042 - DNA, 103 bp, Artificial Sequence
  Synthetic Polynucleotide
taatacgactcactatagggcgggctgcgaatggcccgccgagtgtaaacaacagaggagagtttacatgcggcgggccaacctggcggcagcgcaaaagatg

SEQ ID NO: 110043 - DNA, 103 bp, Artificial Sequence
  Synthetic Polynucleotide
taatacgactcactatagggtaggcgccgtcgggctgcgaatggcccgccaacagaggagaggcgggatgttcgcagccaacctggcggcagcgcaaaagatg

SEQ ID NO: 110044 - DNA, 103 bp, Artificial Sequence
  Synthetic Polynucleotide
taatacgactcactatagggggctgagctgtaggcgccgtcgggctgcgaaacagaggagatcgcagatggacggcgccaacctggcggcagcgcaaaagatg

SEQ ID NO: 110045 - DNA, 103 bp, Artificial Sequence
  Synthetic Polynucleotide
taatacgactcactatagggagaaggacgaggctgagctgtaggcgccgtaacagaggagaacggcgatgacagctcagaacctggcggcagcgcaaaagatg

SEQ ID NO: 110046 - DNA, 103 bp, Artificial Sequence
  Synthetic Polynucleotide
taatacgactcactatagggagcggtcgggagaaggacgaggctgagctgaacagaggagacagctcatgctcgtccttaacctggcggcagcgcaaaagatg

SEQ ID NO: 110047 - DNA, 103 bp, Artificial Sequence
  Synthetic Polynucleotide
taatacgactcactatagggggggtagcccagcggtcgggagaaggacgaaacagaggagatcgtccatgtcccgaccgaacctggcggcagcgcaaaagatg

SEQ ID NO: 110048 - DNA, 103 bp, Artificial Sequence
  Synthetic Polynucleotide
taatacgactcactatagggcggggctgttgagactttctggcatggtggaacagaggagaccaccaatgcagaaagtcaacctggcggcagcgcaaaagatg

SEQ ID NO: 110049 - DNA, 103 bp, Artificial Sequence
  Synthetic Polynucleotide
taatacgactcactatagggagttgacgtaggggtagcccagcggtcgggaacagaggagacccgacatgtgggctaccaacctggcggcagcgcaaaagatg

SEQ ID NO: 110050 - DNA, 103 bp, Artificial Sequence
  Synthetic Polynucleotide
taatacgactcactatagggctgctgaccgagttgacgtaggggtagcccaacagaggagagggctaatgctacgtcaaaacctggcggcagcgcaaaagatg

SEQ ID NO: 110051 - DNA, 103 bp, Artificial Sequence
  Synthetic Polynucleotide
taatacgactcactatagggggatgcgtggctgctgaccgagttgacgtaaacagaggagatacgtcatgtcggtcagcaacctggcggcagcgcaaaagatg

SEQ ID NO: 110052 - DNA, 103 bp, Artificial Sequence
  Synthetic Polynucleotide
taatacgactcactatagggtgtaggggctggatgcgtggctgctgaccgaacagaggagacggtcaatggccacgcataacctggcggcagcgcaaaagatg

SEQ ID NO: 110053 - DNA, 103 bp, Artificial Sequence
  Synthetic Polynucleotide
taatacgactcactatagggaccgaactgatgtaggggctggatgcgtggaacagaggagaccacgcatgcagcccctaaacctggcggcagcgcaaaagatg

SEQ ID NO: 110054 - DNA, 103 bp, Artificial Sequence
  Synthetic Polynucleotide
taatacgactcactataggggtaggactgcaccgaactgatgtaggggctaacagaggagaagccccatgatcagttcgaacctggcggcagcgcaaaagatg

SEQ ID NO: 110055 - DNA, 103 bp, Artificial Sequence
  Synthetic Polynucleotide
taatacgactcactatagggcgctgcccgggtaggactgcaccgaactgaaacagaggagatcagttatgtgcagtcctaacctggcggcagcgcaaaagatg

SEQ ID NO: 110056 - DNA, 103 bp, Artificial Sequence
  Synthetic Polynucleotide
taatacgactcactataggggcgaggctggcgctgcccgggtaggactgcaacagaggagagcagtcatgcccgggcagaacctggcggcagcgcaaaagatg

SEQ ID NO: 110057 - DNA, 103 bp, Artificial Sequence
  Synthetic Polynucleotide
taatacgactcactataggggcggctctgggcgaggctggcgctgcccggaacagaggagaccgggcatggccagcctcaacctggcggcagcgcaaaagatg

SEQ ID NO: 110058 - DNA, 103 bp, Artificial Sequence
  Synthetic Polynucleotide
taatacgactcactatagggggtcctccaggcggctctgggcgaggctggaacagaggagaccagccatgcccagagccaacctggcggcagcgcaaaagatg

SEQ ID NO: 110059 - DNA, 103 bp, Artificial Sequence
  Synthetic Polynucleotide
taatacgactcactatagggttgcccgacacggggctgttgagactttctaacagaggagaagaaagatgcaacagcccaacctggcggcagcgcaaaagatg

SEQ ID NO: 110060 - DNA, 103 bp, Artificial Sequence
  Synthetic Polynucleotide
taatacgactcactatagggtccgcccctgggtcctccaggcggctctggaacagaggagaccagagatgcctggaggaaacctggcggcagcgcaaaagatg

SEQ ID NO: 110061 - DNA, 103 bp, Artificial Sequence
  Synthetic Polynucleotide
taatacgactcactatagggcttctccgagtccgcccctgggtcctccagaacagaggagactggagatgccaggggcgaacctggcggcagcgcaaaagatg

SEQ ID NO: 110062 - DNA, 103 bp, Artificial Sequence
  Synthetic Polynucleotide
taatacgactcactatagggccaccgtgctcttctccgagtccgcccctgaacagaggagacaggggatgactcggagaaacctggcggcagcgcaaaagatg

SEQ ID NO: 110063 - DNA, 103 bp, Artificial Sequence
  Synthetic Polynucleotide
taatacgactcactatagggccgccttccaccaccgtgctcttctccgagaacagaggagactcggaatggagcacggtaacctggcggcagcgcaaaagatg

SEQ ID NO: 110064 - DNA, 103 bp, Artificial Sequence
  Synthetic Polynucleotide
taatacgactcactataggggcgcacttcaccgccttccaccaccgtgctaacagaggagaagcacgatggtggaaggcaacctggcggcagcgcaaaagatg

SEQ ID NO: 110065 - DNA, 103 bp, Artificial Sequence
  Synthetic Polynucleotide
taatacgactcactatagggtgccattgaagcgcacttcaccgccttccaaacagaggagatggaagatggtgaagtgcaacctggcggcagcgcaaaagatg

SEQ ID NO: 110066 - DNA, 103 bp, Artificial Sequence
  Synthetic Polynucleotide
taatacgactcactatagggttttttcccttgccattgaagcgcacttcaaacagaggagatgaagtatgcttcaatggaacctggcggcagcgcaaaagatg

SEQ ID NO: 110067 - DNA, 103 bp, Artificial Sequence
  Synthetic Polynucleotide
taatacgactcactatagggtttacggatcttttttcccttgccattgaaaacagaggagattcaatatgaagggaaaaaacctggcggcagcgcaaaagatg

SEQ ID NO: 110068 - DNA, 103 bp, Artificial Sequence
  Synthetic Polynucleotide
taatacgactcactatagggtcgtcctgggtttacggatcttttttccctaacagaggagaagggaaatgagatccgtaaacctggcggcagcgcaaaagatg

SEQ ID NO: 110069 - DNA, 103 bp, Artificial Sequence
  Synthetic Polynucleotide
taatacgactcactatagggctggaataaatcgtcctgggtttacggatcaacagaggagagatccgatgacccaggacaacctggcggcagcgcaaaagatg

SEQ ID NO: 110070 - DNA, 103 bp, Artificial Sequence
  Synthetic Polynucleotide
taatacgactcactatagggaaacaccgccttgcccgacacggggctgttaacagaggagaaacagcatggtgtcgggcaacctggcggcagcgcaaaagatg

SEQ ID NO: 110071 - DNA, 103 bp, Artificial Sequence
  Synthetic Polynucleotide
taatacgactcactatagggcaactgcaaactggaataaatcgtcctgggaacagaggagacccaggatgatttattccaacctggcggcagcgcaaaagatg

SEQ ID NO: 110072 - DNA, 103 bp, Artificial Sequence
  Synthetic Polynucleotide
taatacgactcactatagggtcaaagcctgcaactgcaaactggaataaaaacagaggagatttattatggtttgcagtaacctggcggcagcgcaaaagatg

SEQ ID NO: 110073 - DNA, 103 bp, Artificial Sequence
  Synthetic Polynucleotide
taatacgactcactatagggaacctccggttcaaagcctgcaactgcaaaaacagaggagatttgcaatggcaggctttaacctggcggcagcgcaaaagatg

SEQ ID NO: 110074 - DNA, 103 bp, Artificial Sequence
  Synthetic Polynucleotide
taatacgactcactatagggagtttgctggaacctccggttcaaagcctgaacagaggagacaggctatgaaccggaggaacctggcggcagcgcaaaagatg

SEQ ID NO: 110075 - DNA, 103 bp, Artificial Sequence
  Synthetic Polynucleotide
taatacgactcactatagggctaggtactgagtttgctggaacctccggtaacagaggagaaccggaatgtccagcaaaaacctggcggcagcgcaaaagatg

SEQ ID NO: 110076 - DNA, 103 bp, Artificial Sequence
  Synthetic Polynucleotide
taatacgactcactatagggtccggcagagctaggtactgagtttgctggaacagaggagaccagcaatgtcagtacctaacctggcggcagcgcaaaagatg

SEQ ID NO: 110077 - DNA, 103 bp, Artificial Sequence
  Synthetic Polynucleotide
taatacgactcactatagggctccgccctctccggcagagctaggtactgaacagaggagacagtacatggctctgccgaacctggcggcagcgcaaaagatg

SEQ ID NO: 110078 - DNA, 103 bp, Artificial Sequence
  Synthetic Polynucleotide
taatacgactcactatagggaggccgcgagctccgccctctccggcagagaacagaggagactctgcatgagagggcggaacctggcggcagcgcaaaagatg

SEQ ID NO: 110079 - DNA, 103 bp, Artificial Sequence
  Synthetic Polynucleotide
taatacgactcactatagggagtcccaaagaggccgcgagctccgccctcaacagaggagagagggcatggctcgcggcaacctggcggcagcgcaaaagatg

SEQ ID NO: 110080 - DNA, 103 bp, Artificial Sequence
  Synthetic Polynucleotide
taatacgactcactatagggagtctgtgtgagtcccaaagaggccgcgagaacagaggagactcgcgatgtctttgggaaacctggcggcagcgcaaaagatg

SEQ ID NO: 110081 - DNA, 103 bp, Artificial Sequence
  Synthetic Polynucleotide
taatacgactcactatagggcaaactccataaacaccgccttgcccgacaaacagaggagatgtcggatgaggcggtgtaacctggcggcagcgcaaaagatg

SEQ ID NO: 110082 - DNA, 103 bp, Artificial Sequence
  Synthetic Polynucleotide
taatacgactcactatagggtcttgacctgagtctgtgtgagtcccaaagaacagaggagactttggatgtcacacagaaacctggcggcagcgcaaaagatg

SEQ ID NO: 110083 - DNA, 103 bp, Artificial Sequence
  Synthetic Polynucleotide
taatacgactcactatagggtggaaccagatcttgacctgagtctgtgtgaacagaggagacacacaatgtcaggtcaaaacctggcggcagcgcaaaagatg

SEQ ID NO: 110084 - DNA, 103 bp, Artificial Sequence
  Synthetic Polynucleotide
taatacgactcactatagggtcgcttgttttggaaccagatcttgacctgaacagaggagacaggtcatgatctggttcaacctggcggcagcgcaaaagatg

SEQ ID NO: 110085 - DNA, 103 bp, Artificial Sequence
  Synthetic Polynucleotide
taatacgactcactatagggtgaacttggatcgcttgttttggaaccagaaacagaggagatctggtatgaaaacaagcaacctggcggcagcgcaaaagatg

SEQ ID NO: 110086 - DNA, 103 bp, Artificial Sequence
  Synthetic Polynucleotide
taatacgactcactatagggatcagcttcttgaacttggatcgcttgtttaacagaggagaaaacaaatgatccaagttaacctggcggcagcgcaaaagatg

SEQ ID NO: 110087 - DNA, 103 bp, Artificial Sequence
  Synthetic Polynucleotide
taatacgactcactatagggaccctgcttcatcagcttcttgaacttggaaacagaggagatccaagatgaagaagctgaacctggcggcagcgcaaaagatg

SEQ ID NO: 110088 - DNA, 103 bp, Artificial Sequence
  Synthetic Polynucleotide
taatacgactcactataggggagccgccccaccctgcttcatcagcttctaacagaggagaagaagcatgtgaagcaggaacctggcggcagcgcaaaagatg

SEQ ID NO: 110089 - DNA, 103 bp, Artificial Sequence
  Synthetic Polynucleotide
taatacgactcactatagggctaccctccagagccgccccaccctgcttcaacagaggagagaagcaatgtggggcggcaacctggcggcagcgcaaaagatg

SEQ ID NO: 110090 - DNA, 103 bp, Artificial Sequence
  Synthetic Polynucleotide
taatacgactcactatagggggccaacgcactaccctccagagccgccccaacagaggagaggggcgatgctggagggtaacctggcggcagcgcaaaagatg

SEQ ID NO: 110091 - DNA, 103 bp, Artificial Sequence
  Synthetic Polynucleotide
taatacgactcactatagggcccgaccgttggccaacgcactaccctccaaacagaggagatggaggatggtgcgttggaacctggcggcagcgcaaaagatg

SEQ ID NO: 110092 - DNA, 103 bp, Artificial Sequence
  Synthetic Polynucleotide
taatacgactcactatagggttgggcggcccaaactccataaacaccgccaacagaggagaggcggtatgtatggagttaacctggcggcagcgcaaaagatg

SEQ ID NO: 110093 - DNA, 103 bp, Artificial Sequence
  Synthetic Polynucleotide
taatacgactcactataggggcagacagggcccgaccgttggccaacgcaaacagaggagatgcgttatgcaacggtcgaacctggcggcagcgcaaaagatg

SEQ ID NO: 110094 - DNA, 103 bp, Artificial Sequence
  Synthetic Polynucleotide
taatacgactcactatagggtggggagccagcagacagggcccgaccgttaacagaggagaaacggtatggccctgtctaacctggcggcagcgcaaaagatg

SEQ ID NO: 110095 - DNA, 103 bp, Artificial Sequence
  Synthetic Polynucleotide
taatacgactcactataggggcggcacgggtggggagccagcagacagggaacagaggagaccctgtatgctggctcccaacctggcggcagcgcaaaagatg

SEQ ID NO: 110096 - DNA, 103 bp, Artificial Sequence
  Synthetic Polynucleotide
taatacgactcactatagggttccagccgggcggcacgggtggggagccaaacagaggagatggctcatgacccgtgccaacctggcggcagcgcaaaagatg

SEQ ID NO: 110097 - DNA, 103 bp, Artificial Sequence
  Synthetic Polynucleotide
taatacgactcactatagggagagttagggttccagccgggcggcacgggaacagaggagacccgtgatgcccggctggaacctggcggcagcgcaaaagatg

SEQ ID NO: 110098 - DNA, 103 bp, Artificial Sequence
  Synthetic Polynucleotide
taatacgactcactatagggtcccggatgaagagttagggttccagccggaacagaggagaccggctatgaccctaactaacctggcggcagcgcaaaagatg

SEQ ID NO: 110099 - DNA, 103 bp, Artificial Sequence
  Synthetic Polynucleotide
taatacgactcactatagggcctgagcccttcccggatgaagagttagggaacagaggagaccctaaatgttcatccggaacctggcggcagcgcaaaagatg

SEQ ID NO: 110100 - DNA, 103 bp, Artificial Sequence
  Synthetic Polynucleotide
taatacgactcactatagggcgcgtttcctcctgagcccttcccggatgaaacagaggagatcatccatgaagggctcaaacctggcggcagcgcaaaagatg

SEQ ID NO: 110101 - DNA, 103 bp, Artificial Sequence
  Synthetic Polynucleotide
taatacgactcactatagggtataggagcccgcgtttcctcctgagccctaacagaggagaagggctatggaggaaacgaacctggcggcagcgcaaaagatg

SEQ ID NO: 110102 - DNA, 103 bp, Artificial Sequence
  Synthetic Polynucleotide
taatacgactcactatagggtagctggggatataggagcccgcgtttcctaacagaggagaaggaaaatggggctcctaaacctggcggcagcgcaaaagatg

SEQ ID NO: 110103 - DNA, 103 bp, Artificial Sequence
  Synthetic Polynucleotide
taatacgactcactatagggcatttgctggttgggcggcccaaactccataacagaggagaatggagatggggccgcccaacctggcggcagcgcaaaagatg

SEQ ID NO: 110104 - DNA, 103 bp, Artificial Sequence
  Synthetic Polynucleotide
taatacgactcactatagggccacgatgtgtagctggggatataggagccaacagaggagaggctccatgatccccagcaacctggcggcagcgcaaaagatg

SEQ ID NO: 110105 - DNA, 103 bp, Artificial Sequence
  Synthetic Polynucleotide
taatacgactcactatagggctgaagggtaccacgatgtgtagctggggaaacagaggagatccccaatgacacatcgtaacctggcggcagcgcaaaagatg

SEQ ID NO: 110106 - DNA, 103 bp, Artificial Sequence
  Synthetic Polynucleotide
taatacgactcactatagggtcttggtgcgctgaagggtaccacgatgtgaacagaggagacacatcatggtacccttcaacctggcggcagcgcaaaagatg

SEQ ID NO: 110107 - DNA, 103 bp, Artificial Sequence
  Synthetic Polynucleotide
taatacgactcactatagggctgcatagcttcttggtgcgctgaagggtaaacagaggagataccctatggcgcaccaaaacctggcggcagcgcaaaagatg

SEQ ID NO: 110108 - DNA, 103 bp, Artificial Sequence
  Synthetic Polynucleotide
taatacgactcactataggggttggggttgctgcatagcttcttggtgcgaacagaggagacgcaccatgaagctatgcaacctggcggcagcgcaaaagatg

SEQ ID NO: 110109 - DNA, 103 bp, Artificial Sequence
  Synthetic Polynucleotide
taatacgactcactataggggagaaggagacatttgctggttgggcggccaacagaggagaggccgcatgaccagcaaaaacctggcggcagcgcaaaagatg

SEQ ID NO: 110110 - DNA, 103 bp, Artificial Sequence
  Synthetic Polynucleotide
taatacgactcactatagggtgggacatgggagaaggagacatttgctggaacagaggagaccagcaatggtctccttcaacctggcggcagcgcaaaagatg

SEQ ID NO: 110111 - DNA, 103 bp, Artificial Sequence
  Synthetic Polynucleotide
taatacgactcactatagggagccactagactgtcaaagactccagtcataacagaggagaatgactatggtctttgacaacctggcggcagcgcaaaagatg

SEQ ID NO: 110112 - DNA, 103 bp, Artificial Sequence
  Synthetic Polynucleotide
taatacgactcactataggggttgccacccgggccggcgccgccgccgctaacagaggagaagcggcatgggcgccggcaacctggcggcagcgcaaaagatg

SEQ ID NO: 110113 - DNA, 103 bp, Artificial Sequence
  Synthetic Polynucleotide
taatacgactcactatagggtgctgctgctgttgccacccgggccggcgcaacagaggagagcgccgatgcgggtggcaaacctggcggcagcgcaaaagatg

SEQ ID NO: 110114 - DNA, 103 bp, Artificial Sequence
  Synthetic Polynucleotide
taatacgactcactatagggaggctgctgctgctgctgctgttgccacccaacagaggagagggtggatgcagcagcagaacctggcggcagcgcaaaagatg

SEQ ID NO: 110115 - DNA, 103 bp, Artificial Sequence
  Synthetic Polynucleotide
taatacgactcactataggggggcttgtggaggctgctgctgctgctgctaacagaggagaagcagcatgagcagcagcaacctggcggcagcgcaaaagatg

SEQ ID NO: 110116 - DNA, 103 bp, Artificial Sequence
  Synthetic Polynucleotide
taatacgactcactataggggcgactcctggggcttgtggaggctgctgcaacagaggagagcagcaatgtccacaagcaacctggcggcagcgcaaaagatg

SEQ ID NO: 110117 - DNA, 103 bp, Artificial Sequence
  Synthetic Polynucleotide
taatacgactcactatagggggaagggtgggcgactcctggggcttgtggaacagaggagaccacaaatgccaggagtcaacctggcggcagcgcaaaagatg

SEQ ID NO: 110118 - DNA, 103 bp, Artificial Sequence
  Synthetic Polynucleotide
taatacgactcactatagggggtggacaccggaagggtgggcgactcctgaacagaggagacaggagatgcccacccttaacctggcggcagcgcaaaagatg

SEQ ID NO: 110119 - DNA, 103 bp, Artificial Sequence
  Synthetic Polynucleotide
taatacgactcactatagggtgtcggtggcggtggacaccggaagggtggaacagaggagaccacccatgcggtgtccaaacctggcggcagcgcaaaagatg

SEQ ID NO: 110120 - DNA, 103 bp, Artificial Sequence
  Synthetic Polynucleotide
taatacgactcactatagggtagtagctgctgtcggtggcggtggacaccaacagaggagaggtgtcatgcgccaccgaaacctggcggcagcgcaaaagatg

SEQ ID NO: 110121 - DNA, 103 bp, Artificial Sequence
  Synthetic Polynucleotide
taatacgactcactatagggctggttggtgtagtagctgctgtcggtggcaacagaggagagccaccatgagcagctacaacctggcggcagcgcaaaagatg

SEQ ID NO: 110122 - DNA, 103 bp, Artificial Sequence
  Synthetic Polynucleotide
taatacgactcactatagggagtgcatatcagccactagactgtcaaagaaacagaggagatctttgatggtctagtggaacctggcggcagcgcaaaagatg

SEQ ID NO: 110123 - DNA, 103 bp, Artificial Sequence
  Synthetic Polynucleotide
taatacgactcactatagggccgggtgctgctggttggtgtagtagctgcaacagaggagagcagctatgacaccaaccaacctggcggcagcgcaaaagatg

SEQ ID NO: 110124 - DNA, 103 bp, Artificial Sequence
  Synthetic Polynucleotide
taatacgactcactatagggccgccgcccgccgggtgctgctggttggtgaacagaggagacaccaaatggcagcacccaacctggcggcagcgcaaaagatg

SEQ ID NO: 110125 - DNA, 103 bp, Artificial Sequence
  Synthetic Polynucleotide
taatacgactcactatagggcccgccgccgccgccgcccgccgggtgctgaacagaggagacagcacatggcgggcggcaacctggcggcagcgcaaaagatg

SEQ ID NO: 110126 - DNA, 103 bp, Artificial Sequence
  Synthetic Polynucleotide
taatacgactcactatagggagggcgagcccccgccgccgccgccgcccgaacagaggagacgggcgatggcggcggcgaacctggcggcagcgcaaaagatg

SEQ ID NO: 110127 - DNA, 103 bp, Artificial Sequence
  Synthetic Polynucleotide
taatacgactcactatagggatgtgcgcgtagggcgagcccccgccgccgaacagaggagacggcggatggggctcgccaacctggcggcagcgcaaaagatg

SEQ ID NO: 110128 - DNA, 103 bp, Artificial Sequence
  Synthetic Polynucleotide
taatacgactcactataggggtaggaacccatgtgcgcgtagggcgagccaacagaggagaggctcgatgtacgcgcacaacctggcggcagcgcaaaagatg

SEQ ID NO: 110129 - DNA, 103 bp, Artificial Sequence
  Synthetic Polynucleotide
taatacgactcactatagggcttggtactggtaggaacccatgtgcgcgtaacagaggagaacgcgcatgtgggttcctaacctggcggcagcgcaaaagatg

SEQ ID NO: 110130 - DNA, 103 bp, Artificial Sequence
  Synthetic Polynucleotide
taatacgactcactatagggaggccgctggcttggtactggtaggaacccaacagaggagagggttcatgccagtaccaaacctggcggcagcgcaaaagatg

SEQ ID NO: 110131 - DNA, 103 bp, Artificial Sequence
  Synthetic Polynucleotide
taatacgactcactataggggacgttgttgaggccgctggcttggtactgaacagaggagacagtacatggccagcggcaacctggcggcagcgcaaaagatg

SEQ ID NO: 110132 - DNA, 103 bp, Artificial Sequence
  Synthetic Polynucleotide
taatacgactcactatagggcggagtaagggacgttgttgaggccgctggaacagaggagaccagcgatgtcaacaacgaacctggcggcagcgcaaaagatg

SEQ ID NO: 110133 - DNA, 103 bp, Artificial Sequence
  Synthetic Polynucleotide
taatacgactcactatagggatctgggtcgagtgcatatcagccactagaaacagaggagatctagtatgtgatatgcaaacctggcggcagcgcaaaagatg

SEQ ID NO: 110134 - DNA, 103 bp, Artificial Sequence
  Synthetic Polynucleotide
taatacgactcactatagggctgctcttggcggagtaagggacgttgttgaacagaggagacaacaaatgcccttactcaacctggcggcagcgcaaaagatg

SEQ ID NO: 110135 - DNA, 103 bp, Artificial Sequence
  Synthetic Polynucleotide
taatacgactcactatagggcaggtcatagctgctcttggcggagtaaggaacagaggagaccttacatggccaagagcaacctggcggcagcgcaaaagatg

SEQ ID NO: 110136 - DNA, 103 bp, Artificial Sequence
  Synthetic Polynucleotide
taatacgactcactatagggcggtgtagcccaggtcatagctgctcttggaacagaggagaccaagaatggctatgaccaacctggcggcagcgcaaaagatg

SEQ ID NO: 110137 - DNA, 103 bp, Artificial Sequence
  Synthetic Polynucleotide
taatacgactcactataggggtgtaggcggcggtgtagcccaggtcatagaacagaggagactatgaatggggctacacaacctggcggcagcgcaaaagatg

SEQ ID NO: 110138 - DNA, 103 bp, Artificial Sequence
  Synthetic Polynucleotide
taatacgactcactatagggagcgtaggaggtgtaggcggcggtgtagccaacagaggagaggctacatggccgcctacaacctggcggcagcgcaaaagatg

SEQ ID NO: 110139 - DNA, 103 bp, Artificial Sequence
  Synthetic Polynucleotide
taatacgactcactatagggttccatagggagcgtaggaggtgtaggcggaacagaggagaccgcctatgcctcctacgaacctggcggcagcgcaaaagatg

SEQ ID NO: 110140 - DNA, 103 bp, Artificial Sequence
  Synthetic Polynucleotide
taatacgactcactataggggacgaactggttccatagggagcgtaggagaacagaggagactcctaatgtccctatggaacctggcggcagcgcaaaagatg

SEQ ID NO: 110141 - DNA, 103 bp, Artificial Sequence
  Synthetic Polynucleotide
taatacgactcactataggggttggctggggacgaactggttccatagggaacagaggagaccctatatgaccagttcgaacctggcggcagcgcaaaagatg

SEQ ID NO: 110142 - DNA, 103 bp, Artificial Sequence
  Synthetic Polynucleotide
taatacgactcactatagggcaggctcgttgttggctggggacgaactggaacagaggagaccagttatgccccagccaaacctggcggcagcgcaaaagatg

SEQ ID NO: 110143 - DNA, 103 bp, Artificial Sequence
  Synthetic Polynucleotide
taatacgactcactatagggtcctccttctcaggctcgttgttggctgggaacagaggagacccagcatgcaacgagccaacctggcggcagcgcaaaagatg

SEQ ID NO: 110144 - DNA, 103 bp, Artificial Sequence
  Synthetic Polynucleotide
taatacgactcactatagggggaggcggcgatctgggtcgagtgcatatcaacagaggagagatatgatgtcgacccagaacctggcggcagcgcaaaagatg

SEQ ID NO: 110145 - DNA, 103 bp, Artificial Sequence
  Synthetic Polynucleotide
taatacgactcactatagggaggctcaaggtcctccttctcaggctcgttaacagaggagaaacgagatggagaaggagaacctggcggcagcgcaaaagatg

SEQ ID NO: 110146 - DNA, 103 bp, Artificial Sequence
  Synthetic Polynucleotide
taatacgactcactatagggtccgaatttcaggctcaaggtcctccttctaacagaggagaagaaggatgaccttgagcaacctggcggcagcgcaaaagatg

SEQ ID NO: 110147 - DNA, 103 bp, Artificial Sequence
  Synthetic Polynucleotide
taatacgactcactatagggccgttcactatccgaatttcaggctcaaggaacagaggagaccttgaatgtgaaattcgaacctggcggcagcgcaaaagatg

SEQ ID NO: 110148 - DNA, 103 bp, Artificial Sequence
  Synthetic Polynucleotide
taatacgactcactatagggctttggcttcccgttcactatccgaatttcaacagaggagagaaattatgatagtgaacaacctggcggcagcgcaaaagatg

SEQ ID NO: 110149 - DNA, 103 bp, Artificial Sequence
  Synthetic Polynucleotide
taatacgactcactatagggtccggactttctttggcttcccgttcactaaacagaggagatagtgaatgggaagccaaaacctggcggcagcgcaaaagatg

SEQ ID NO: 110150 - DNA, 103 bp, Artificial Sequence
  Synthetic Polynucleotide
taatacgactcactataggggtgcggggtttccggactttctttggcttcaacagaggagagaagccatggaaagtccgaacctggcggcagcgcaaaagatg

SEQ ID NO: 110151 - DNA, 103 bp, Artificial Sequence
  Synthetic Polynucleotide
taatacgactcactatagggggagtagatggtgcggggtttccggactttaacagaggagaaaagtcatgaaaccccgcaacctggcggcagcgcaaaagatg

SEQ ID NO: 110152 - DNA, 103 bp, Artificial Sequence
  Synthetic Polynucleotide
taatacgactcactataggggctggaaactggagtagatggtgcggggttaacagaggagaaaccccatgccatctactaacctggcggcagcgcaaaagatg

SEQ ID NO: 110153 - DNA, 103 bp, Artificial Sequence
  Synthetic Polynucleotide
taatacgactcactatagggagagccgccagctggaaactggagtagatgaacagaggagacatctaatgcagtttccaaacctggcggcagcgcaaaagatg

SEQ ID NO: 110154 - DNA, 103 bp, Artificial Sequence
  Synthetic Polynucleotide
taatacgactcactatagggacgccgctgaagagccgccagctggaaactaacagaggagaagtttcatgctggcggctaacctggcggcagcgcaaaagatg

SEQ ID NO: 110155 - DNA, 103 bp, Artificial Sequence
  Synthetic Polynucleotide
taatacgactcactatagggggtacgtgctggaggcggcgatctgggtcgaacagaggagacgacccatgtcgccgcctaacctggcggcagcgcaaaagatg

SEQ ID NO: 110156 - DNA, 103 bp, Artificial Sequence
  Synthetic Polynucleotide
taatacgactcactatagggtcttttggaaacgccgctgaagagccgccaaacagaggagatggcggatgttcagcggcaacctggcggcagcgcaaaagatg

SEQ ID NO: 110157 - DNA, 103 bp, Artificial Sequence
  Synthetic Polynucleotide
taatacgactcactatagggaagtattgagtcttttggaaacgccgctgaaacagaggagatcagcgatgtttccaaaaaacctggcggcagcgcaaaagatg

SEQ ID NO: 110158 - DNA, 103 bp, Artificial Sequence
  Synthetic Polynucleotide
taatacgactcactatagggcggcaaggccaagtattgagtcttttggaaaacagaggagattccaaatgactcaatacaacctggcggcagcgcaaaagatg

SEQ ID NO: 110159 - DNA, 103 bp, Artificial Sequence
  Synthetic Polynucleotide
taatacgactcactatagggcggctcgctccggcaaggccaagtattgagaacagaggagactcaatatgtggccttgcaacctggcggcagcgcaaaagatg

SEQ ID NO: 110160 - DNA, 103 bp, Artificial Sequence
  Synthetic Polynucleotide
taatacgactcactataggggccgccagctcggctcgctccggcaaggccaacagaggagaggccttatgggagcgagcaacctggcggcagcgcaaaagatg

SEQ ID NO: 110161 - DNA, 103 bp, Artificial Sequence
  Synthetic Polynucleotide
taatacgactcactataggggcccagagaggccgccagctcggctcgctcaacagaggagagagcgaatggagctggcgaacctggcggcagcgcaaaagatg

SEQ ID NO: 110162 - DNA, 103 bp, Artificial Sequence
  Synthetic Polynucleotide
taatacgactcactatagggtctgggtgaggcccagagaggccgccagctaacagaggagaagctggatgcctctctggaacctggcggcagcgcaaaagatg

SEQ ID NO: 110163 - DNA, 103 bp, Artificial Sequence
  Synthetic Polynucleotide
taatacgactcactatagggttgacctgagtctgggtgaggcccagagagaacagaggagactctctatgcctcacccaaacctggcggcagcgcaaaagatg

SEQ ID NO: 110164 - DNA, 103 bp, Artificial Sequence
  Synthetic Polynucleotide
taatacgactcactataggggaaccagattttgacctgagtctgggtgagaacagaggagactcaccatgactcaggtcaacctggcggcagcgcaaaagatg

SEQ ID NO: 110165 - DNA, 103 bp, Artificial Sequence
  Synthetic Polynucleotide
taatacgactcactatagggggcggttctggaaccagattttgacctgagaacagaggagactcaggatgaaatctggtaacctggcggcagcgcaaaagatg

SEQ ID NO: 110166 - DNA, 103 bp, Artificial Sequence
  Synthetic Polynucleotide
taatacgactcactatagggtggtgctggtggtacgtgctggaggcggcgaacagaggagacgccgcatgcagcacgtaaacctggcggcagcgcaaaagatg

SEQ ID NO: 110167 - DNA, 103 bp, Artificial Sequence
  Synthetic Polynucleotide
taatacgactcactatagggaacttggaccggcggttctggaaccagattaacagaggagaaatctgatgccagaaccgaacctggcggcagcgcaaaagatg

SEQ ID NO: 110168 - DNA, 103 bp, Artificial Sequence
  Synthetic Polynucleotide
taatacgactcactatagggcatcttcttgaacttggaccggcggttctgaacagaggagacagaacatgcggtccaagaacctggcggcagcgcaaaagatg

SEQ ID NO: 110169 - DNA, 103 bp, Artificial Sequence
  Synthetic Polynucleotide
taatacgactcactatagggcacttttccacatcttcttgaacttggaccaacagaggagaggtccaatgtcaagaagaaacctggcggcagcgcaaaagatg

SEQ ID NO: 110170 - DNA, 103 bp, Artificial Sequence
  Synthetic Polynucleotide
taatacgactcactataggggggatctcaccacttttccacatcttcttgaacagaggagacaagaaatggtggaaaagaacctggcggcagcgcaaaagatg

SEQ ID NO: 110171 - DNA, 103 bp, Artificial Sequence
  Synthetic Polynucleotide
taatacgactcactatagggctgctccgaggggatctcaccacttttccaaacagaggagatggaaaatgggtgagatcaacctggcggcagcgcaaaagatg

SEQ ID NO: 110172 - DNA, 103 bp, Artificial Sequence
  Synthetic Polynucleotide
taatacgactcactatagggccccagggtgctgctccgaggggatctcacaacagaggagagtgagaatgcctcggagcaacctggcggcagcgcaaaagatg

SEQ ID NO: 110173 - DNA, 103 bp, Artificial Sequence
  Synthetic Polynucleotide
taatacgactcactataggggaagcgctggccccagggtgctgctccgagaacagaggagactcggaatggcaccctggaacctggcggcagcgcaaaagatg

SEQ ID NO: 110174 - DNA, 103 bp, Artificial Sequence
  Synthetic Polynucleotide
taatacgactcactatagggacaaggtggagaagcgctggccccagggtgaacagaggagacaccctatggccagcgctaacctggcggcagcgcaaaagatg

SEQ ID NO: 110175 - DNA, 103 bp, Artificial Sequence
  Synthetic Polynucleotide
taatacgactcactataggggcggcgaagcacaaggtggagaagcgctggaacagaggagaccagcgatgctccaccttaacctggcggcagcgcaaaagatg

SEQ ID NO: 110176 - DNA, 103 bp, Artificial Sequence
  Synthetic Polynucleotide
taatacgactcactataggggctgagactggcggcgaagcacaaggtggaaacagaggagatccaccatgtgcttcgccaacctggcggcagcgcaaaagatg

SEQ ID NO: 110177 - DNA, 103 bp, Artificial Sequence
  Synthetic Polynucleotide
taatacgactcactatagggcgggggctgctggtgctggtggtacgtgctaacagaggagaagcacgatgcaccagcacaacctggcggcagcgcaaaagatg

SEQ ID NO: 110178 - DNA, 103 bp, Artificial Sequence
  Synthetic Polynucleotide
taatacgactcactatagggggaggccggcgctgagactggcggcgaagcaacagaggagagcttcgatgccagtctcaaacctggcggcagcgcaaaagatg

SEQ ID NO: 110179 - DNA, 103 bp, Artificial Sequence
  Synthetic Polynucleotide
taatacgactcactatagggcaaagtcccaggaggccggcgctgagactgaacagaggagacagtctatgcgccggcctaacctggcggcagcgcaaaagatg

SEQ ID NO: 110180 - DNA, 103 bp, Artificial Sequence
  Synthetic Polynucleotide
taatacgactcactatagggtgcggcacaccaaagtcccaggaggccggcaacagaggagagccggcatgctgggacttaacctggcggcagcgcaaaagatg

SEQ ID NO: 110181 - DNA, 103 bp, Artificial Sequence
  Synthetic Polynucleotide
taatacgactcactatagggcgccatccgctgcggcacaccaaagtcccaaacagaggagatgggacatgggtgtgccgaacctggcggcagcgcaaaagatg

SEQ ID NO: 110182 - DNA, 103 bp, Artificial Sequence
  Synthetic Polynucleotide
taatacgactcactatagggcaccgccgcccgccatccgctgcggcacacaacagaggagagtgtgcatgagcggatggaacctggcggcagcgcaaaagatg

SEQ ID NO: 110183 - DNA, 103 bp, Artificial Sequence
  Synthetic Polynucleotide
taatacgactcactatagggctgcccggaccaccgccgcccgccatccgcaacagaggagagcggatatggggcggcggaacctggcggcagcgcaaaagatg

SEQ ID NO: 110184 - DNA, 103 bp, Artificial Sequence
  Synthetic Polynucleotide
taatacgactcactataggggctgccgccactgcccggaccaccgccgccaacagaggagaggcggcatgggtccgggcaacctggcggcagcgcaaaagatg

SEQ ID NO: 110185 - DNA, 103 bp, Artificial Sequence
  Synthetic Polynucleotide
taatacgactcactatagggtgccggcgccgctgccgccactgcccggacaacagaggagagtccggatggtggcggcaaacctggcggcagcgcaaaagatg

SEQ ID NO: 110186 - DNA, 103 bp, Artificial Sequence
  Synthetic Polynucleotide
taatacgactcactataggggagcccgagctgccggcgccgctgccgccaaacagaggagatggcggatgcggcgccggaacctggcggcagcgcaaaagatg

SEQ ID NO: 110187 - DNA, 103 bp, Artificial Sequence
  Synthetic Polynucleotide
taatacgactcactataggggctcgggctggagcccgagctgccggcgccaacagaggagaggcgccatgagctcgggcaacctggcggcagcgcaaaagatg

SEQ ID NO: 110188 - DNA, 103 bp, Artificial Sequence
  Synthetic Polynucleotide
taatacgactcactatagggcgccgccgctcgggggctgctggtgctggtaacagaggagaaccagcatgagcagccccaacctggcggcagcgcaaaagatg

SEQ ID NO: 110189 - DNA, 103 bp, Artificial Sequence
  Synthetic Polynucleotide
taatacgactcactatagggaggccgcgctgctcgggctggagcccgagcaacagaggagagctcggatgccagcccgaaacctggcggcagcgcaaaagatg

SEQ ID NO: 110190 - DNA, 103 bp, Artificial Sequence
  Synthetic Polynucleotide
taatacgactcactatagggagaaaagccgaggccgcgctgctcgggctgaacagaggagacagcccatgcagcgcggcaacctggcggcagcgcaaaagatg

SEQ ID NO: 110191 - DNA, 103 bp, Artificial Sequence
  Synthetic Polynucleotide
taatacgactcactataggggtagttgcccagaaaagccgaggccgcgctaacagaggagaagcgcgatgtcggcttttaacctggcggcagcgcaaaagatg

SEQ ID NO: 110192 - DNA, 103 bp, Artificial Sequence
  Synthetic Polynucleotide
taatacgactcactatagggggtaccaggggtagttgcccagaaaagccgaacagaggagacggcttatgtgggcaactaacctggcggcagcgcaaaagatg

SEQ ID NO: 110193 - DNA, 103 bp, Artificial Sequence
  Synthetic Polynucleotide
taatacgactcactataggggaggtctggtggtaccaggggtagttgcccaacagaggagagggcaaatgcccctggtaaacctggcggcagcgcaaaagatg

SEQ ID NO: 110194 - DNA, 103 bp, Artificial Sequence
  Synthetic Polynucleotide
taatacgactcactatagggggcggatcccgaggtctggtggtaccagggaacagaggagaccctggatgcaccagaccaacctggcggcagcgcaaaagatg

SEQ ID NO: 110195 - DNA, 103 bp, Artificial Sequence
  Synthetic Polynucleotide
taatacgactcactataggggcaggtgtgaggcggatcccgaggtctggtaacagaggagaaccagaatgcgggatccgaacctggcggcagcgcaaaagatg

SEQ ID NO: 110196 - DNA, 103 bp, Artificial Sequence
  Synthetic Polynucleotide
taatacgactcactataggggccgtggcctgcaggtgtgaggcggatcccaacagaggagagggatcatgctcacacctaacctggcggcagcgcaaaagatg

SEQ ID NO: 110197 - DNA, 103 bp, Artificial Sequence
  Synthetic Polynucleotide
taatacgactcactatagggcagcagcggcgccgtggcctgcaggtgtgaaacagaggagatcacacatgcaggccacgaacctggcggcagcgcaaaagatg

SEQ ID NO: 110198 - DNA, 103 bp, Artificial Sequence
  Synthetic Polynucleotide
taatacgactcactataggggagtggggtgcagcagcggcgccgtggcctaacagaggagaaggccaatgcgccgctgcaacctggcggcagcgcaaaagatg

SEQ ID NO: 110199 - DNA, 103 bp, Artificial Sequence
  Synthetic Polynucleotide
taatacgactcactataggggggccggcgccgccgccgctcgggggctgcaacagaggagagcagccatggagcggcggaacctggcggcagcgcaaaagatg

SEQ ID NO: 110200 - DNA, 103 bp, Artificial Sequence
  Synthetic Polynucleotide
taatacgactcactatagggtgcggggtctgagtggggtgcagcagcggcaacagaggagagccgctatggcaccccacaacctggcggcagcgcaaaagatg

SEQ ID NO: 110201 - DNA, 103 bp, Artificial Sequence
  Synthetic Polynucleotide
taatacgactcactataggggtgatgcggctgcggggtctgagtggggtgaacagaggagacaccccatgcagaccccgaacctggcggcagcgcaaaagatg

SEQ ID NO: 110202 - DNA, 103 bp, Artificial Sequence
  Synthetic Polynucleotide
taatacgactcactatagggggtggtggtggtgatgcggctgcggggtctaacagaggagaagacccatgagccgcatcaacctggcggcagcgcaaaagatg

SEQ ID NO: 110203 - DNA, 103 bp, Artificial Sequence
  Synthetic Polynucleotide
taatacgactcactatagggccgccgtgatggtggtggtggtgatgcggcaacagaggagagccgcaatgccaccaccaaacctggcggcagcgcaaaagatg

SEQ ID NO: 110204 - DNA, 103 bp, Artificial Sequence
  Synthetic Polynucleotide
taatacgactcactatagggggcgcccccgccgccgtgatggtggtggtgaacagaggagacaccacatgcatcacggcaacctggcggcagcgcaaaagatg

SEQ ID NO: 110205 - DNA, 103 bp, Artificial Sequence
  Synthetic Polynucleotide
taatacgactcactatagggcgctcaccggggcgcccccgccgccgtgataacagaggagaatcacgatggcgggggcgaacctggcggcagcgcaaaagatg

SEQ ID NO: 110206 - DNA, 103 bp, Artificial Sequence
  Synthetic Polynucleotide
taatacgactcactatagggatcgtccccgcgctcaccggggcgcccccgaacagaggagacgggggatgcccggtgagaacctggcggcagcgcaaaagatg

SEQ ID NO: 110207 - DNA, 103 bp, Artificial Sequence
  Synthetic Polynucleotide
taatacgactcactataggggccggggagggggcagggcaaagaggtcataacagaggagaatgaccatgttgccctgcaacctggcggcagcgcaaaagatg

SEQ ID NO: 110208 - DNA, 103 bp, Artificial Sequence
  Synthetic Polynucleotide
taatacgactcactatagggtgcggttgtaggggacaagccaagcgggtaaacagaggagatacccgatgggcttgtccaacctggcggcagcgcaaaagatg

SEQ ID NO: 110209 - DNA, 103 bp, Artificial Sequence
  Synthetic Polynucleotide
taatacgactcactatagggtgggggaggctgcggttgtaggggacaagcaacagaggagagcttgtatgctacaaccgaacctggcggcagcgcaaaagatg

SEQ ID NO: 110210 - DNA, 103 bp, Artificial Sequence
  Synthetic Polynucleotide
taatacgactcactatagggtaggacaaattgggggaggctgcggttgtaaacagaggagatacaacatgagcctccccaacctggcggcagcgcaaaagatg

SEQ ID NO: 110211 - DNA, 103 bp, Artificial Sequence
  Synthetic Polynucleotide
taatacgactcactatagggcggcctggagtaggacaaattgggggaggcaacagaggagagcctccatgaatttgtccaacctggcggcagcgcaaaagatg

SEQ ID NO: 110212 - DNA, 103 bp, Artificial Sequence
  Synthetic Polynucleotide
taatacgactcactatagggggtggccatacggcctggagtaggacaaataacagaggagaatttgtatgactccaggcaacctggcggcagcgcaaaagatg

SEQ ID NO: 110213 - DNA, 103 bp, Artificial Sequence
  Synthetic Polynucleotide
taatacgactcactatagggtaagacaggaggtggccatacggcctggagaacagaggagactccagatggtatggccaaacctggcggcagcgcaaaagatg

SEQ ID NO: 110214 - DNA, 103 bp, Artificial Sequence
  Synthetic Polynucleotide
taatacgactcactatagggggtgtaggggtaagacaggaggtggccataaacagaggagatatggcatgctcctgtctaacctggcggcagcgcaaaagatg

SEQ ID NO: 110215 - DNA, 103 bp, Artificial Sequence
  Synthetic Polynucleotide
taatacgactcactatagggtcgctggctcggtgtaggggtaagacaggaaacagaggagatcctgtatgacccctacaaacctggcggcagcgcaaaagatg

SEQ ID NO: 110216 - DNA, 103 bp, Artificial Sequence
  Synthetic Polynucleotide
taatacgactcactatagggtctccggggttcgctggctcggtgtaggggaacagaggagacccctaatgcgagccagcaacctggcggcagcgcaaaagatg

SEQ ID NO: 110217 - DNA, 103 bp, Artificial Sequence
  Synthetic Polynucleotide
taatacgactcactatagggcaggtaggagtctccggggttcgctggctcaacagaggagagagccaatgaaccccggaaacctggcggcagcgcaaaagatg

SEQ ID NO: 110218 - DNA, 103 bp, Artificial Sequence
  Synthetic Polynucleotide
taatacgactcactatagggaggcgtcccggccggggagggggcagggcaaacagaggagatgccctatgccctccccgaacctggcggcagcgcaaaagatg

SEQ ID NO: 110219 - DNA, 103 bp, Artificial Sequence
  Synthetic Polynucleotide
taatacgactcactataggggctggcaggacaggtaggagtctccggggtaacagaggagaaccccgatgactcctaccaacctggcggcagcgcaaaagatg

SEQ ID NO: 110220 - DNA, 103 bp, Artificial Sequence
  Synthetic Polynucleotide
taatacgactcactataggggccgcgggttgctggcaggacaggtaggagaacagaggagactcctaatggtcctgccaaacctggcggcagcgcaaaagatg

SEQ ID NO: 110221 - DNA, 103 bp, Artificial Sequence
  Synthetic Polynucleotide
taatacgactcactatagggctgagagagcgccgcgggttgctggcaggaaacagaggagatcctgcatgcaacccgcgaacctggcggcagcgcaaaagatg

SEQ ID NO: 110222 - DNA, 103 bp, Artificial Sequence
  Synthetic Polynucleotide
taatacgactcactatagggcgcagaggggctgagagagcgccgcgggttaacagaggagaaacccgatgcgctctctcaacctggcggcagcgcaaaagatg

SEQ ID NO: 110223 - DNA, 103 bp, Artificial Sequence
  Synthetic Polynucleotide
taatacgactcactatagggtctgcaggtccgcagaggggctgagagagcaacagaggagagctctcatggcccctctgaacctggcggcagcgcaaaagatg

SEQ ID NO: 110224 - DNA, 103 bp, Artificial Sequence
  Synthetic Polynucleotide
taatacgactcactatagggctgagggtgctctgcaggtccgcagaggggaacagaggagacccctcatgggacctgcaaacctggcggcagcgcaaaagatg

SEQ ID NO: 110225 - DNA, 103 bp, Artificial Sequence
  Synthetic Polynucleotide
taatacgactcactatagggcctcgagttcctgagggtgctctgcaggtcaacagaggagagacctgatgagcaccctcaacctggcggcagcgcaaaagatg

SEQ ID NO: 110226 - DNA, 103 bp, Artificial Sequence
  Synthetic Polynucleotide
taatacgactcactatagggtccgagtctgcctcgagttcctgagggtgcaacagaggagagcacccatgggaactcgaaacctggcggcagcgcaaaagatg

SEQ ID NO: 110227 - DNA, 103 bp, Artificial Sequence
  Synthetic Polynucleotide
taatacgactcactatagggccgcggcttctccgagtctgcctcgagttcaacagaggagagaactcatggcagactcgaacctggcggcagcgcaaaagatg

SEQ ID NO: 110228 - DNA, 103 bp, Artificial Sequence
  Synthetic Polynucleotide
taatacgactcactatagggccggggacagccgcggcttctccgagtctgaacagaggagacagactatgagaagccgcaacctggcggcagcgcaaaagatg

SEQ ID NO: 110229 - DNA, 103 bp, Artificial Sequence
  Synthetic Polynucleotide
taatacgactcactatagggacagctttggaggcgtcccggccggggaggaacagaggagacctcccatgccgggacgcaacctggcggcagcgcaaaagatg

SEQ ID NO: 110230 - DNA, 103 bp, Artificial Sequence
  Synthetic Polynucleotide
taatacgactcactatagggtcggagggttccggggacagccgcggcttcaacagaggagagaagccatggctgtccccaacctggcggcagcgcaaaagatg

SEQ ID NO: 110231 - DNA, 103 bp, Artificial Sequence
  Synthetic Polynucleotide
taatacgactcactatagggagggcgccgctcggagggttccggggacagaacagaggagactgtccatggaaccctccaacctggcggcagcgcaaaagatg

SEQ ID NO: 110232 - DNA, 103 bp, Artificial Sequence
  Synthetic Polynucleotide
taatacgactcactatagggcgggggcctgagggcgccgctcggagggttaacagaggagaaaccctatgagcggcgccaacctggcggcagcgcaaaagatg

SEQ ID NO: 110233 - DNA, 103 bp, Artificial Sequence
  Synthetic Polynucleotide
taatacgactcactatagggagctttttggcgggggcctgagggcgccgcaacagaggagagcggcgatgtcaggccccaacctggcggcagcgcaaaagatg

SEQ ID NO: 110234 - DNA, 103 bp, Artificial Sequence
  Synthetic Polynucleotide
taatacgactcactatagggcggcttgcggagctttttggcgggggcctgaacagaggagacaggccatggccaaaaagaacctggcggcagcgcaaaagatg

SEQ ID NO: 110235 - DNA, 103 bp, Artificial Sequence
  Synthetic Polynucleotide
taatacgactcactatagggagatggtcctcggcttgcggagctttttggaacagaggagaccaaaaatgtccgcaagcaacctggcggcagcgcaaaagatg

SEQ ID NO: 110236 - DNA, 103 bp, Artificial Sequence
  Synthetic Polynucleotide
taatacgactcactatagggaggctggagtagatggtcctcggcttgcggaacagaggagaccgcaaatggaggaccataacctggcggcagcgcaaaagatg

SEQ ID NO: 110237 - DNA, 103 bp, Artificial Sequence
  Synthetic Polynucleotide
taatacgactcactatagggctgcagctgcaggctggagtagatggtcctaacagaggagaaggaccatgtactccagcaacctggcggcagcgcaaaagatg

SEQ ID NO: 110238 - DNA, 103 bp, Artificial Sequence
  Synthetic Polynucleotide
taatacgactcactatagggggtttaggtgctgcagctgcaggctggagtaacagaggagaactccaatgtgcagctgcaacctggcggcagcgcaaaagatg

SEQ ID NO: 110239 - DNA, 103 bp, Artificial Sequence
  Synthetic Polynucleotide
taatacgactcactatagggtggaaacgctggtttaggtgctgcagctgcaacagaggagagcagctatggcacctaaaaacctggcggcagcgcaaaagatg

SEQ ID NO: 110240 - DNA, 103 bp, Artificial Sequence
  Synthetic Polynucleotide
taatacgactcactataggggtctgggaagacagctttggaggcgtcccgaacagaggagacgggacatgtccaaagctaacctggcggcagcgcaaaagatg

SEQ ID NO: 110241 - DNA, 103 bp, Artificial Sequence
  Synthetic Polynucleotide
taatacgactcactatagggctgcgtgtgctggaaacgctggtttaggtgaacagaggagacacctaatgcagcgtttcaacctggcggcagcgcaaaagatg

SEQ ID NO: 110242 - DNA, 103 bp, Artificial Sequence
  Synthetic Polynucleotide
taatacgactcactataggggcgccaggtactgcgtgtgctggaaacgctaacagaggagaagcgttatgagcacacgcaacctggcggcagcgcaaaagatg

SEQ ID NO: 110243 - DNA, 103 bp, Artificial Sequence
  Synthetic Polynucleotide
taatacgactcactatagggctctcgggcagcgccaggtactgcgtgtgcaacagaggagagcacacatggtacctggcaacctggcggcagcgcaaaagatg

SEQ ID NO: 110244 - DNA, 103 bp, Artificial Sequence
  Synthetic Polynucleotide
taatacgactcactatagggcagctgggccctctcgggcagcgccaggtaaacagaggagatacctgatgctgcccgagaacctggcggcagcgcaaaagatg

SEQ ID NO: 110245 - DNA, 103 bp, Artificial Sequence
  Synthetic Polynucleotide
taatacgactcactataggggctgcgctgccagctgggccctctcgggcaaacagaggagatgcccgatggggcccagcaacctggcggcagcgcaaaagatg

SEQ ID NO: 110246 - DNA, 103 bp, Artificial Sequence
  Synthetic Polynucleotide
taatacgactcactataggggtgaggccgagctgcgctgccagctgggccaacagaggagaggcccaatgggcagcgcaaacctggcggcagcgcaaaagatg

SEQ ID NO: 110247 - DNA, 103 bp, Artificial Sequence
  Synthetic Polynucleotide
taatacgactcactatagggctgggtctgggtgaggccgagctgcgctgcaacagaggagagcagcgatgctcggcctcaacctggcggcagcgcaaaagatg

SEQ ID NO: 110248 - DNA, 103 bp, Artificial Sequence
  Synthetic Polynucleotide
taatacgactcactatagggagatctttacctgggtctgggtgaggccgaaacagaggagatcggccatgcccagacccaacctggcggcagcgcaaaagatg

SEQ ID NO: 110249 - DNA, 103 bp, Artificial Sequence
  Synthetic Polynucleotide
taatacgactcactatagggttctgaaaccagatctttacctgggtctggaacagaggagaccagacatgggtaaagataacctggcggcagcgcaaaagatg

SEQ ID NO: 110250 - DNA, 103 bp, Artificial Sequence
  Synthetic Polynucleotide
taatacgactcactatagggggagcgtttgttctgaaaccagatctttacaacagaggagagtaaagatgtggtttcagaacctggcggcagcgcaaaagatg

SEQ ID NO: 110251 - DNA, 103 bp, Artificial Sequence
  Synthetic Polynucleotide
taatacgactcactatagggcaggggcgaggtctgggaagacagctttggaacagaggagaccaaagatgtcttcccagaacctggcggcagcgcaaaagatg

SEQ ID NO: 110252 - DNA, 103 bp, Artificial Sequence
  Synthetic Polynucleotide
taatacgactcactatagggtcttatacttggagcgtttgttctgaaaccaacagaggagaggtttcatgacaaacgctaacctggcggcagcgcaaaagatg

SEQ ID NO: 110253 - DNA, 103 bp, Artificial Sequence
  Synthetic Polynucleotide
taatacgactcactatagggttcaggagcttcttatacttggagcgtttgaacagaggagacaaacgatgcaagtataaaacctggcggcagcgcaaaagatg

SEQ ID NO: 110254 - DNA, 103 bp, Artificial Sequence
  Synthetic Polynucleotide
taatacgactcactatagggagaattctgcttcaggagcttcttatacttaacagaggagaaagtatatgaagctcctgaacctggcggcagcgcaaaagatg

SEQ ID NO: 110255 - DNA, 103 bp, Artificial Sequence
  Synthetic Polynucleotide
taatacgactcactatagggcctgccccccagaattctgcttcaggagctaacagaggagaagctccatgagcagaattaacctggcggcagcgcaaaagatg

SEQ ID NO: 110256 - DNA, 103 bp, Artificial Sequence
  Synthetic Polynucleotide
taatacgactcactatagggaagtccccttcctgccccccagaattctgcaacagaggagagcagaaatgtggggggcaaacctggcggcagcgcaaaagatg

SEQ ID NO: 110257 - DNA, 103 bp, Artificial Sequence
  Synthetic Polynucleotide
taatacgactcactatagggcctcccagggaagtccccttcctgccccccaacagaggagaggggggatggaaggggacaacctggcggcagcgcaaaagatg

SEQ ID NO: 110258 - DNA, 103 bp, Artificial Sequence
  Synthetic Polynucleotide
taatacgactcactatagggcagagaaggtcctcccagggaagtccccttaacagaggagaaaggggatgtccctgggaaacctggcggcagcgcaaaagatg

SEQ ID NO: 110259 - DNA, 103 bp, Artificial Sequence
  Synthetic Polynucleotide
taatacgactcactatagggcagggagacacagagaaggtcctcccagggaacagaggagaccctggatggaccttctcaacctggcggcagcgcaaaagatg

SEQ ID NO: 110260 - DNA, 103 bp, Artificial Sequence
  Synthetic Polynucleotide
taatacgactcactataggggggtggggagcagggagacacagagaaggtaacagaggagaaccttcatggtgtctcccaacctggcggcagcgcaaaagatg

SEQ ID NO: 110261 - DNA, 103 bp, Artificial Sequence
  Synthetic Polynucleotide
taatacgactcactataggggggaggggaggggtggggagcagggagacaaacagaggagatgtctcatggctccccacaacctggcggcagcgcaaaagatg

SEQ ID NO: 110262 - DNA, 103 bp, Artificial Sequence
  Synthetic Polynucleotide
taatacgactcactatagggaccgacgggacaggggcgaggtctgggaagaacagaggagacttcccatgcctcgccccaacctggcggcagcgcaaaagatg

SEQ ID NO: 110263 - DNA, 103 bp, Artificial Sequence
  Synthetic Polynucleotide
taatacgactcactatagggagatcccagagggaggggaggggtggggagaacagaggagactccccatgcctcccctcaacctggcggcagcgcaaaagatg

SEQ ID NO: 110264 - DNA, 103 bp, Artificial Sequence
  Synthetic Polynucleotide
taatacgactcactatagggtgccttgggtagatcccagagggaggggagaacagaggagactccccatgctctgggataacctggcggcagcgcaaaagatg

SEQ ID NO: 110265 - DNA, 103 bp, Artificial Sequence
  Synthetic Polynucleotide
taatacgactcactataggggcagggtccctgccttgggtagatcccagaaacagaggagatctgggatgtacccaaggaacctggcggcagcgcaaaagatg

SEQ ID NO: 110266 - DNA, 103 bp, Artificial Sequence
  Synthetic Polynucleotide
taatacgactcactatagggccactggtgggcagggtccctgccttgggtaacagaggagaacccaaatgagggaccctaacctggcggcagcgcaaaagatg

SEQ ID NO: 110267 - DNA, 103 bp, Artificial Sequence
  Synthetic Polynucleotide
taatacgactcactataggggttgccatagccactggtgggcagggtcccaacagaggagagggaccatgcccaccagtaacctggcggcagcgcaaaagatg

SEQ ID NO: 110268 - DNA, 103 bp, Artificial Sequence
  Synthetic Polynucleotide
taatacgactcactatagggctccaaagctgttgccatagccactggtggaacagaggagaccaccaatggctatggcaaacctggcggcagcgcaaaagatg

SEQ ID NO: 110269 - DNA, 103 bp, Artificial Sequence
  Synthetic Polynucleotide
taatacgactcactatagggtgataccaggctccaaagctgttgccatagaacagaggagactatggatgcagctttggaacctggcggcagcgcaaaagatg

SEQ ID NO: 110270 - DNA, 103 bp, Artificial Sequence
  Synthetic Polynucleotide
taatacgactcactatagggggagtgatgctgataccaggctccaaagctaacagaggagaagctttatggcctggtataacctggcggcagcgcaaaagatg

SEQ ID NO: 110271 - DNA, 103 bp, Artificial Sequence
  Synthetic Polynucleotide
taatacgactcactatagggggacatctgaggagtgatgctgataccaggaacagaggagacctggtatgagcatcactaacctggcggcagcgcaaaagatg

SEQ ID NO: 110272 - DNA, 103 bp, Artificial Sequence
  Synthetic Polynucleotide
taatacgactcactatagggggcgaagccaggacatctgaggagtgatgcaacagaggagagcatcaatgctcagatgtaacctggcggcagcgcaaaagatg

SEQ ID NO: 110273 - DNA, 103 bp, Artificial Sequence
  Synthetic Polynucleotide
taatacgactcactatagggggcagccgctaccgacgggacaggggcgagaacagaggagactcgccatggtcccgtcgaacctggcggcagcgcaaaagatg

SEQ ID NO: 110274 - DNA, 103 bp, Artificial Sequence
  Synthetic Polynucleotide
taatacgactcactatagggcatcatctgaggcgaagccaggacatctgaaacagaggagatcagatatgctggcttcgaacctggcggcagcgcaaaagatg

SEQ ID NO: 110275 - DNA, 103 bp, Artificial Sequence
  Synthetic Polynucleotide
taatacgactcactatagggcaagcgggtaggcagccgctaccgacgggaaacagaggagatcccgtatgtagcggctgaacctggcggcagcgcaaaagatg

SEQ ID NO: 110276 - DNA, 103 bp, Artificial Sequence
  Synthetic Polynucleotide
taatacgactcactatagggggggacaagccaagcgggtaggcagccgctaacagaggagaagcggcatgctacccgctaacctggcggcagcgcaaaagatg

SEQ ID NO: 110277 - DNA, 103 bp, Artificial Sequence
  Synthetic Polynucleotide
taatacgactcactatagggggggacccttctgtcaaacactcctgtcataacagaggagaatgacaatggtgtttgacaacctggcggcagcgcaaaagatg

SEQ ID NO: 110278 - DNA, 103 bp, Artificial Sequence
  Synthetic Polynucleotide
taatacgactcactatagggagactcgggcaaagttggcgattcctgagaaacagaggagatctcagatgtcgccaactaacctggcggcagcgcaaaagatg

SEQ ID NO: 110279 - DNA, 103 bp, Artificial Sequence
  Synthetic Polynucleotide
taatacgactcactatagggcggtagctgaagactcgggcaaagttggcgaacagaggagacgccaaatgtgcccgagtaacctggcggcagcgcaaaagatg

SEQ ID NO: 110280 - DNA, 103 bp, Artificial Sequence
  Synthetic Polynucleotide
taatacgactcactatagggtagtcagaatcggtagctgaagactcgggcaacagaggagagcccgaatgttcagctacaacctggcggcagcgcaaaagatg

SEQ ID NO: 110281 - DNA, 103 bp, Artificial Sequence
  Synthetic Polynucleotide
taatacgactcactatagggagggctgtagtagtcagaatcggtagctgaaacagaggagatcagctatggattctgacaacctggcggcagcgcaaaagatg

SEQ ID NO: 110282 - DNA, 103 bp, Artificial Sequence
  Synthetic Polynucleotide
taatacgactcactatagggctccccccgtagggctgtagtagtcagaataacagaggagaattctgatgactacagccaacctggcggcagcgcaaaagatg

SEQ ID NO: 110283 - DNA, 103 bp, Artificial Sequence
  Synthetic Polynucleotide
taatacgactcactatagggccgtgcggggctccccccgtagggctgtagaacagaggagactacagatgtacggggggaacctggcggcagcgcaaaagatg

SEQ ID NO: 110284 - DNA, 103 bp, Artificial Sequence
  Synthetic Polynucleotide
taatacgactcactatagggagagcagtagccgtgcggggctccccccgtaacagaggagaacggggatggccccgcacaacctggcggcagcgcaaaagatg

SEQ ID NO: 110285 - DNA, 103 bp, Artificial Sequence
  Synthetic Polynucleotide
taatacgactcactatagggccgaggtaggagagcagtagccgtgcggggaacagaggagaccccgcatggctactgctaacctggcggcagcgcaaaagatg

SEQ ID NO: 110286 - DNA, 103 bp, Artificial Sequence
  Synthetic Polynucleotide
taatacgactcactatagggccataggaagccgaggtaggagagcagtagaacagaggagactactgatgtcctacctcaacctggcggcagcgcaaaagatg

SEQ ID NO: 110287 - DNA, 103 bp, Artificial Sequence
  Synthetic Polynucleotide
taatacgactcactataggggagagctttgccataggaagccgaggtaggaacagaggagacctaccatggcttcctataacctggcggcagcgcaaaagatg

SEQ ID NO: 110288 - DNA, 103 bp, Artificial Sequence
  Synthetic Polynucleotide
taatacgactcactatagggatcggatgctggggacccttctgtcaaacaaacagaggagatgtttgatggaagggtccaacctggcggcagcgcaaaagatg

SEQ ID NO: 110289 - DNA, 103 bp, Artificial Sequence
  Synthetic Polynucleotide
taatacgactcactatagggggtaggggttgagagctttgccataggaagaacagaggagacttcctatggcaaagctcaacctggcggcagcgcaaaagatg

SEQ ID NO: 110290 - DNA, 103 bp, Artificial Sequence
  Synthetic Polynucleotide
taatacgactcactatagggtactgatactggtaggggttgagagctttgaacagaggagacaaagcatgcaacccctaaacctggcggcagcgcaaaagatg

SEQ ID NO: 110291 - DNA, 103 bp, Artificial Sequence
  Synthetic Polynucleotide
taatacgactcactatagggcacgccgtgatactgatactggtaggggttaacagaggagaaaccccatgcagtatcagaacctggcggcagcgcaaaagatg

SEQ ID NO: 110292 - DNA, 103 bp, Artificial Sequence
  Synthetic Polynucleotide
taatacgactcactatagggcggagccgttcacgccgtgatactgatactaacagaggagaagtatcatgatcacggcgaacctggcggcagcgcaaaagatg

SEQ ID NO: 110293 - DNA, 103 bp, Artificial Sequence
  Synthetic Polynucleotide
taatacgactcactatagggtagctcccggcggagccgttcacgccgtgaaacagaggagatcacggatggaacggctcaacctggcggcagcgcaaaagatg

SEQ ID NO: 110294 - DNA, 103 bp, Artificial Sequence
  Synthetic Polynucleotide
taatacgactcactatagggtttggctgggtagctcccggcggagccgttaacagaggagaaacggcatggccgggagcaacctggcggcagcgcaaaagatg

SEQ ID NO: 110295 - DNA, 103 bp, Artificial Sequence
  Synthetic Polynucleotide
taatacgactcactatagggcggcataagctttggctgggtagctcccggaacagaggagaccgggaatgacccagccaaacctggcggcagcgcaaaagatg

SEQ ID NO: 110296 - DNA, 103 bp, Artificial Sequence
  Synthetic Polynucleotide
taatacgactcactatagggtagctatagtcggcataagctttggctgggaacagaggagacccagcatgagcttatgcaacctggcggcagcgcaaaagatg

SEQ ID NO: 110297 - DNA, 103 bp, Artificial Sequence
  Synthetic Polynucleotide
taatacgactcactatagggggagctagcgtagctatagtcggcataagcaacagaggagagcttatatggactatagcaacctggcggcagcgcaaaagatg

SEQ ID NO: 110298 - DNA, 103 bp, Artificial Sequence
  Synthetic Polynucleotide
taatacgactcactatagggactggtggtaggagctagcgtagctatagtaacagaggagaactataatgacgctagctaacctggcggcagcgcaaaagatg

SEQ ID NO: 110299 - DNA, 103 bp, Artificial Sequence
  Synthetic Polynucleotide
taatacgactcactatagggaagtcgccggatcggatgctggggacccttaacagaggagaaagggtatgcagcatccgaacctggcggcagcgcaaaagatg

SEQ ID NO: 110300 - DNA, 103 bp, Artificial Sequence
  Synthetic Polynucleotide
taatacgactcactataggggcgccgccgtactggtggtaggagctagcgaacagaggagacgctagatgctaccaccaaacctggcggcagcgcaaaagatg

SEQ ID NO: 110301 - DNA, 103 bp, Artificial Sequence
  Synthetic Polynucleotide
taatacgactcactataggggcggttgtaggcgccgccgtactggtggtaaacagaggagataccacatgtacggcggcaacctggcggcagcgcaaaagatg

SEQ ID NO: 110302 - DNA, 103 bp, Artificial Sequence
  Synthetic Polynucleotide
taatacgactcactatagggcgcttgggacgcggttgtaggcgccgccgtaacagaggagaacggcgatgcctacaaccaacctggcggcagcgcaaaagatg

SEQ ID NO: 110303 - DNA, 103 bp, Artificial Sequence
  Synthetic Polynucleotide
taatacgactcactatagggtggttggtggcgcttgggacgcggttgtagaacagaggagactacaaatgcgtcccaagaacctggcggcagcgcaaaagatg

SEQ ID NO: 110304 - DNA, 103 bp, Artificial Sequence
  Synthetic Polynucleotide
taatacgactcactatagggtttctctggctggttggtggcgcttgggacaacagaggagagtcccaatggccaccaacaacctggcggcagcgcaaaagatg

SEQ ID NO: 110305 - DNA, 103 bp, Artificial Sequence
  Synthetic Polynucleotide
taatacgactcactatagggcggtcacttctttctctggctggttggtggaacagaggagaccaccaatgagccagagaaacctggcggcagcgcaaaagatg

SEQ ID NO: 110306 - DNA, 103 bp, Artificial Sequence
  Synthetic Polynucleotide
taatacgactcactatagggacctcgggctcggtcacttctttctctggcaacagaggagagccagaatgagaagtgacaacctggcggcagcgcaaaagatg

SEQ ID NO: 110307 - DNA, 103 bp, Artificial Sequence
  Synthetic Polynucleotide
taatacgactcactatagggcaccattctcacctcgggctcggtcacttcaacagaggagagaagtgatggagcccgagaacctggcggcagcgcaaaagatg

SEQ ID NO: 110308 - DNA, 103 bp, Artificial Sequence
  Synthetic Polynucleotide
taatacgactcactataggggtttgccattcaccattctcacctcgggctaacagaggagaagcccgatgtgagaatggaacctggcggcagcgcaaaagatg

SEQ ID NO: 110309 - DNA, 103 bp, Artificial Sequence
  Synthetic Polynucleotide
taatacgactcactatagggactttctttggtttgccattcaccattctcaacagaggagagagaatatggaatggcaaaacctggcggcagcgcaaaagatg

SEQ ID NO: 110310 - DNA, 103 bp, Artificial Sequence
  Synthetic Polynucleotide
taatacgactcactatagggcggagcttggaagtcgccggatcggatgctaacagaggagaagcatcatgtccggcgacaacctggcggcagcgcaaaagatg

SEQ ID NO: 110311 - DNA, 103 bp, Artificial Sequence
  Synthetic Polynucleotide
taatacgactcactataggggggtttacgaactttctttggtttgccattaacagaggagaaatggcatgccaaagaaaaacctggcggcagcgcaaaagatg

SEQ ID NO: 110312 - DNA, 103 bp, Artificial Sequence
  Synthetic Polynucleotide
taatacgactcactatagggaaatagtcctgggtttacgaactttctttgaacagaggagacaaagaatgttcgtaaacaacctggcggcagcgcaaaagatg

SEQ ID NO: 110313 - DNA, 103 bp, Artificial Sequence
  Synthetic Polynucleotide
taatacgactcactatagggaagctggaataaatagtcctgggtttacgaaacagaggagatcgtaaatgcaggactataacctggcggcagcgcaaaagatg

SEQ ID NO: 110314 - DNA, 103 bp, Artificial Sequence
  Synthetic Polynucleotide
taatacgactcactatagggggccagctgaaagctggaataaatagtcctaacagaggagaaggactatgtattccagcaacctggcggcagcgcaaaagatg

SEQ ID NO: 110315 - DNA, 103 bp, Artificial Sequence
  Synthetic Polynucleotide
taatacgactcactatagggtctgtaatgcggccagctgaaagctggaataacagaggagaattccaatgttcagctggaacctggcggcagcgcaaaagatg

SEQ ID NO: 110316 - DNA, 103 bp, Artificial Sequence
  Synthetic Polynucleotide
taatacgactcactatagggtgaaaccttctctgtaatgcggccagctgaaacagaggagatcagctatgcgcattacaaacctggcggcagcgcaaaagatg

SEQ ID NO: 110317 - DNA, 103 bp, Artificial Sequence
  Synthetic Polynucleotide
taatacgactcactatagggctgagtcttctgaaaccttctctgtaatgcaacagaggagagcattaatgagaaggtttaacctggcggcagcgcaaaagatg

SEQ ID NO: 110318 - DNA, 103 bp, Artificial Sequence
  Synthetic Polynucleotide
taatacgactcactatagggaggcgaggtactgagtcttctgaaaccttcaacagaggagagaaggtatgagaagactcaacctggcggcagcgcaaaagatg

SEQ ID NO: 110319 - DNA, 103 bp, Artificial Sequence
  Synthetic Polynucleotide
taatacgactcactatagggcgttccggcaaggcgaggtactgagtcttcaacagaggagagaagacatggtacctcgcaacctggcggcagcgcaaaagatg

SEQ ID NO: 110320 - DNA, 103 bp, Artificial Sequence
  Synthetic Polynucleotide
taatacgactcactatagggcagctcggcgcgttccggcaaggcgaggtaaacagaggagatacctcatgttgccggaaaacctggcggcagcgcaaaagatg

SEQ ID NO: 110321 - DNA, 103 bp, Artificial Sequence
  Synthetic Polynucleotide
taatacgactcactatagggacgtctggaacggagcttggaagtcgccggaacagaggagaccggcgatgtccaagctcaacctggcggcagcgcaaaagatg

SEQ ID NO: 110322 - DNA, 103 bp, Artificial Sequence
  Synthetic Polynucleotide
taatacgactcactataggggcgaggcggccagctcggcgcgttccggcaaacagaggagatgccggatggcgccgagcaacctggcggcagcgcaaaagatg

SEQ ID NO: 110323 - DNA, 103 bp, Artificial Sequence
  Synthetic Polynucleotide
taatacgactcactataggggtcaatcccagcgaggcggccagctcggcgaacagaggagacgccgaatgggccgcctcaacctggcggcagcgcaaaagatg

SEQ ID NO: 110324 - DNA, 103 bp, Artificial Sequence
  Synthetic Polynucleotide
taatacgactcactatagggctgtgtttgtgtcaatcccagcgaggcggcaacagaggagagccgccatgctgggattgaacctggcggcagcgcaaaagatg

SEQ ID NO: 110325 - DNA, 103 bp, Artificial Sequence
  Synthetic Polynucleotide
taatacgactcactatagggagattttcacctgtgtttgtgtcaatcccaaacagaggagatgggatatgcacaaacacaacctggcggcagcgcaaaagatg

SEQ ID NO: 110326 - DNA, 103 bp, Artificial Sequence
  Synthetic Polynucleotide
taatacgactcactatagggttctgaaaccagattttcacctgtgtttgtaacagaggagaacaaacatgggtgaaaataacctggcggcagcgcaaaagatg

SEQ ID NO: 110327 - DNA, 103 bp, Artificial Sequence
  Synthetic Polynucleotide
taatacgactcactatagggggatcttttgttctgaaaccagattttcacaacagaggagagtgaaaatgtggtttcagaacctggcggcagcgcaaaagatg

SEQ ID NO: 110328 - DNA, 103 bp, Artificial Sequence
  Synthetic Polynucleotide
taatacgactcactatagggtcttgatcttggatcttttgttctgaaaccaacagaggagaggtttcatgacaaaagataacctggcggcagcgcaaaagatg

SEQ ID NO: 110329 - DNA, 103 bp, Artificial Sequence
  Synthetic Polynucleotide
taatacgactcactatagggttcatgatcttcttgatcttggatcttttgaacagaggagacaaaagatgcaagatcaaaacctggcggcagcgcaaaagatg

SEQ ID NO: 110330 - DNA, 103 bp, Artificial Sequence
  Synthetic Polynucleotide
taatacgactcactatagggctccccgtttttcatgatcttcttgatcttaacagaggagaaagatcatgaagatcatgaacctggcggcagcgcaaaagatg

SEQ ID NO: 110331 - DNA, 103 bp, Artificial Sequence
  Synthetic Polynucleotide
taatacgactcactatagggccgggggcatctccccgtttttcatgatctaacagaggagaagatcaatgaaaacggggaacctggcggcagcgcaaaagatg

SEQ ID NO: 110332 - DNA, 103 bp, Artificial Sequence
  Synthetic Polynucleotide
taatacgactcactatagggatagctgcggacgtctggaacggagcttggaacagaggagaccaagcatggttccagacaacctggcggcagcgcaaaagatg

SEQ ID NO: 110333 - DNA, 103 bp, Artificial Sequence
  Synthetic Polynucleotide
taatacgactcactatagggggactgtgctccgggggcatctccccgtttaacagaggagaaaacggatggatgcccccaacctggcggcagcgcaaaagatg

SEQ ID NO: 110334 - DNA, 103 bp, Artificial Sequence
  Synthetic Polynucleotide
taatacgactcactataggggctggagctgggactgtgctccgggggcataacagaggagaatgcccatggagcacagtaacctggcggcagcgcaaaagatg

SEQ ID NO: 110335 - DNA, 103 bp, Artificial Sequence
  Synthetic Polynucleotide
taatacgactcactatagggccattgggtcgctggagctgggactgtgctaacagaggagaagcacaatgccagctccaaacctggcggcagcgcaaaagatg

SEQ ID NO: 110336 - DNA, 103 bp, Artificial Sequence
  Synthetic Polynucleotide
taatacgactcactataggggagttacacgccattgggtcgctggagctgaacagaggagacagctcatgcgacccaataacctggcggcagcgcaaaagatg

SEQ ID NO: 110337 - DNA, 103 bp, Artificial Sequence
  Synthetic Polynucleotide
taatacgactcactatagggagactgcggcgagttacacgccattgggtcaacagaggagagacccaatggcgtgtaacaacctggcggcagcgcaaaagatg

SEQ ID NO: 110338 - DNA, 103 bp, Artificial Sequence
  Synthetic Polynucleotide
taatacgactcactatagggacaccgctggagactgcggcgagttacacgaacagaggagacgtgtaatgcgccgcagtaacctggcggcagcgcaaaagatg

SEQ ID NO: 110339 - DNA, 103 bp, Artificial Sequence
  Synthetic Polynucleotide
taatacgactcactatagggtggggctcccacaccgctggagactgcggcaacagaggagagccgcaatgtccagcggtaacctggcggcagcgcaaaagatg

SEQ ID NO: 110340 - DNA, 103 bp, Artificial Sequence
  Synthetic Polynucleotide
taatacgactcactatagggggacgagccctggggctcccacaccgctggaacagaggagaccagcgatgtgggagcccaacctggcggcagcgcaaaagatg

SEQ ID NO: 110341 - DNA, 103 bp, Artificial Sequence
  Synthetic Polynucleotide
taatacgactcactatagggtgagcgagcgggacgagccctggggctcccaacagaggagagggagcatgagggctcgtaacctggcggcagcgcaaaagatg

SEQ ID NO: 110342 - DNA, 103 bp, Artificial Sequence
  Synthetic Polynucleotide
taatacgactcactataggggggtggtggctgagcgagcgggacgagcccaacagaggagagggctcatgccgctcgctaacctggcggcagcgcaaaagatg

SEQ ID NO: 110343 - DNA, 103 bp, Artificial Sequence
  Synthetic Polynucleotide
taatacgactcactatagggcggatggtgcatagctgcggacgtctggaaaacagaggagattccagatgtccgcagctaacctggcggcagcgcaaaagatg

SEQ ID NO: 110344 - DNA, 103 bp, Artificial Sequence
  Synthetic Polynucleotide
taatacgactcactataggggtgggcatgagggtggtggctgagcgagcgaacagaggagacgctcgatgagccaccacaacctggcggcagcgcaaaagatg

SEQ ID NO: 110345 - DNA, 103 bp, Artificial Sequence
  Synthetic Polynucleotide
taatacgactcactatagggaggtcggagggtgggcatgagggtggtggcaacagaggagagccaccatgctcatgcccaacctggcggcagcgcaaaagatg

SEQ ID NO: 110346 - DNA, 103 bp, Artificial Sequence
  Synthetic Polynucleotide
taatacgactcactataggggactggttggaggtcggagggtgggcatgaaacagaggagatcatgcatgccctccgacaacctggcggcagcgcaaaagatg

SEQ ID NO: 110347 - DNA, 103 bp, Artificial Sequence
  Synthetic Polynucleotide
taatacgactcactatagggggacgctggggactggttggaggtcggaggaacagaggagacctccgatgtccaaccagaacctggcggcagcgcaaaagatg

SEQ ID NO: 110348 - DNA, 103 bp, Artificial Sequence
  Synthetic Polynucleotide
taatacgactcactatagggccaggtagctggacgctggggactggttggaacagaggagaccaaccatgccccagcgtaacctggcggcagcgcaaaagatg

SEQ ID NO: 110349 - DNA, 103 bp, Artificial Sequence
  Synthetic Polynucleotide
taatacgactcactataggggcagagttctccaggtagctggacgctgggaacagaggagacccagcatgcagctacctaacctggcggcagcgcaaaagatg

SEQ ID NO: 110350 - DNA, 103 bp, Artificial Sequence
  Synthetic Polynucleotide
taatacgactcactataggggtaccaggatgcagagttctccaggtagctaacagaggagaagctacatggagaactctaacctggcggcagcgcaaaagatg

SEQ ID NO: 110351 - DNA, 103 bp, Artificial Sequence
  Synthetic Polynucleotide
taatacgactcactatagggctgcacttgtgtaccaggatgcagagttctaacagaggagaagaactatgcatcctggtaacctggcggcagcgcaaaagatg

SEQ ID NO: 110352 - DNA, 103 bp, Artificial Sequence
  Synthetic Polynucleotide
taatacgactcactatagggattgagctggctgcacttgtgtaccaggataacagaggagaatcctgatgcacaagtgcaacctggcggcagcgcaaaagatg

SEQ ID NO: 110353 - DNA, 103 bp, Artificial Sequence
  Synthetic Polynucleotide
taatacgactcactataggggtgggaattgattgagctggctgcacttgtaacagaggagaacaagtatggccagctcaaacctggcggcagcgcaaaagatg

SEQ ID NO: 110354 - DNA, 103 bp, Artificial Sequence
  Synthetic Polynucleotide
taatacgactcactatagggattcctgagacggatggtgcatagctgcggaacagaggagaccgcagatgtgcaccatcaacctggcggcagcgcaaaagatg

SEQ ID NO: 110355 - DNA, 103 bp, Artificial Sequence
  Synthetic Polynucleotide
taatacgactcactataggggcggcggcaggtgggaattgattgagctggaacagaggagaccagctatgtcaattcccaacctggcggcagcgcaaaagatg

SEQ ID NO: 110356 - DNA, 103 bp, Artificial Sequence
  Synthetic Polynucleotide
taatacgactcactatagggaaggagcccggcggcggcaggtgggaattgaacagaggagacaattcatgcctgccgccaacctggcggcagcgcaaaagatg

SEQ ID NO: 110357 - DNA, 103 bp, Artificial Sequence
  Synthetic Polynucleotide
taatacgactcactatagggcgggtgctgtaaggagcccggcggcggcagaacagaggagactgccgatgccgggctccaacctggcggcagcgcaaaagatg

SEQ ID NO: 110358 - DNA, 103 bp, Artificial Sequence
  Synthetic Polynucleotide
taatacgactcactatagggccagcgccagcgggtgctgtaaggagcccgaacagaggagacgggctatgtacagcaccaacctggcggcagcgcaaaagatg

SEQ ID NO: 110359 - DNA, 103 bp, Artificial Sequence
  Synthetic Polynucleotide
taatacgactcactataggggtcccggaggccagcgccagcgggtgctgtaacagaggagaacagcaatggctggcgctaacctggcggcagcgcaaaagatg

SEQ ID NO: 110360 - DNA, 103 bp, Artificial Sequence
  Synthetic Polynucleotide
taatacgactcactatagggctaatagagtgtcccggaggccagcgccagaacagaggagactggcgatggcctccgggaacctggcggcagcgcaaaagatg

SEQ ID NO: 110361 - DNA, 103 bp, Artificial Sequence
  Synthetic Polynucleotide
taatacgactcactatagggaaagttggcgattcctgagacggatggtgcaacagaggagagcaccaatggtctcaggaaacctggcggcagcgcaaaagatg

SEQ ID NO: 110362 - DNA, 103 bp, Artificial Sequence
  Synthetic Polynucleotide
taatacgactcactatagggtgagtagccgttcaccccgtagtgctgcataacagaggagaatgcagatgtacggggtgaacctggcggcagcgcaaaagatg

SEQ ID NO: 110363 - DNA, 103 bp, Artificial Sequence
  Synthetic Polynucleotide
taatacgactcactatagggtgaaggccggtagtcgggggcatgctgggcaacagaggagagcccagatggcccccgacaacctggcggcagcgcaaaagatg

SEQ ID NO: 110364 - DNA, 103 bp, Artificial Sequence
  Synthetic Polynucleotide
taatacgactcactatagggtgctgggggtgcaggcagcagaggagacccaacagaggagagggtctatgctgctgcctaacctggcggcagcgcaaaagatg

SEQ ID NO: 110365 - DNA, 103 bp, Artificial Sequence
  Synthetic Polynucleotide
taatacgactcactataggggagccaggcctgctgggggtgcaggcagcaaacagaggagatgctgcatgcacccccagaacctggcggcagcgcaaaagatg

SEQ ID NO: 110366 - DNA, 103 bp, Artificial Sequence
  Synthetic Polynucleotide
taatacgactcactataggggctgatgcaggagccaggcctgctgggggtaacagaggagaacccccatgaggcctggcaacctggcggcagcgcaaaagatg

SEQ ID NO: 110367 - DNA, 103 bp, Artificial Sequence
  Synthetic Polynucleotide
taatacgactcactataggggttcagggtagctgatgcaggagccaggccaacagaggagaggcctgatgcctgcatcaaacctggcggcagcgcaaaagatg

SEQ ID NO: 110368 - DNA, 103 bp, Artificial Sequence
  Synthetic Polynucleotide
taatacgactcactatagggtggttttactgttcagggtagctgatgcagaacagaggagactgcatatgctaccctgaaacctggcggcagcgcaaaagatg

SEQ ID NO: 110369 - DNA, 103 bp, Artificial Sequence
  Synthetic Polynucleotide
taatacgactcactatagggtcgatgcttgtggttttactgttcagggtaaacagaggagataccctatgcagtaaaacaacctggcggcagcgcaaaagatg

SEQ ID NO: 110370 - DNA, 103 bp, Artificial Sequence
  Synthetic Polynucleotide
taatacgactcactatagggccgcaggttctcgatgcttgtggttttactaacagaggagaagtaaaatgacaagcatcaacctggcggcagcgcaaaagatg

SEQ ID NO: 110371 - DNA, 103 bp, Artificial Sequence
  Synthetic Polynucleotide
taatacgactcactatagggtggcccggagccgcaggttctcgatgcttgaacagaggagacaagcaatgagaacctgcaacctggcggcagcgcaaaagatg

SEQ ID NO: 110372 - DNA, 103 bp, Artificial Sequence
  Synthetic Polynucleotide
taatacgactcactataggggcgtgctgcttggcccggagccgcaggttcaacagaggagagaacctatggctccgggcaacctggcggcagcgcaaaagatg

SEQ ID NO: 110373 - DNA, 103 bp, Artificial Sequence
  Synthetic Polynucleotide
taatacgactcactatagggcagggaggccgcgtgctgcttggcccggagaacagaggagactccggatgaagcagcacaacctggcggcagcgcaaaagatg

SEQ ID NO: 110374 - DNA, 103 bp, Artificial Sequence
  Synthetic Polynucleotide
taatacgactcactataggggcgcatgcactgaaggccggtagtcgggggaacagaggagacccccgatgaccggccttaacctggcggcagcgcaaaagatg

SEQ ID NO: 110375 - DNA, 103 bp, Artificial Sequence
  Synthetic Polynucleotide
taatacgactcactatagggtatcgagtcccagggaggccgcgtgctgctaacagaggagaagcagcatgcggcctcccaacctggcggcagcgcaaaagatg

SEQ ID NO: 110376 - DNA, 103 bp, Artificial Sequence
  Synthetic Polynucleotide
taatacgactcactatagggttgggcagcgtatcgagtcccagggaggccaacagaggagaggcctcatggggactcgaaacctggcggcagcgcaaaagatg

SEQ ID NO: 110377 - DNA, 103 bp, Artificial Sequence
  Synthetic Polynucleotide
taatacgactcactataggggccaatgtaagcgcatgcactgaaggccggaacagaggagaccggccatgagtgcatgcaacctggcggcagcgcaaaagatg

SEQ ID NO: 110378 - DNA, 103 bp, Artificial Sequence
  Synthetic Polynucleotide
taatacgactcactatagggcaggcgctcagccaatgtaagcgcatgcacaacagaggagagtgcatatgcttacattgaacctggcggcagcgcaaaagatg

SEQ ID NO: 110379 - DNA, 103 bp, Artificial Sequence
  Synthetic Polynucleotide
taatacgactcactatagggtgatgtcagccaggcgctcagccaatgtaaaacagaggagattacatatgctgagcgccaacctggcggcagcgcaaaagatg

SEQ ID NO: 110380 - DNA, 103 bp, Artificial Sequence
  Synthetic Polynucleotide
taatacgactcactataggggcctccaagatgatgtcagccaggcgctcaaacagaggagatgagcgatgggctgacataacctggcggcagcgcaaaagatg

SEQ ID NO: 110381 - DNA, 103 bp, Artificial Sequence
  Synthetic Polynucleotide
taatacgactcactatagggaccataacgggcctccaagatgatgtcagcaacagaggagagctgacatgatcttggagaacctggcggcagcgcaaaagatg

SEQ ID NO: 110382 - DNA, 103 bp, Artificial Sequence
  Synthetic Polynucleotide
taatacgactcactatagggggtgctgggaaccataacgggcctccaagaaacagaggagatcttggatgcccgttatgaacctggcggcagcgcaaaagatg

SEQ ID NO: 110383 - DNA, 103 bp, Artificial Sequence
  Synthetic Polynucleotide
taatacgactcactatagggcgttgtttgcggtgctgggaaccataacggaacagaggagaccgttaatgttcccagcaaacctggcggcagcgcaaaagatg

SEQ ID NO: 110384 - DNA, 103 bp, Artificial Sequence
  Synthetic Polynucleotide
taatacgactcactataggggcggctgcgacgttgtttgcggtgctgggaaacagaggagatcccagatgcgcaaacaaaacctggcggcagcgcaaaagatg

SEQ ID NO: 110385 - DNA, 103 bp, Artificial Sequence
  Synthetic Polynucleotide
taatacgactcactatagggtggcgtgcagtgagtagccgttcaccccgtaacagaggagaacggggatgacggctactaacctggcggcagcgcaaaagatg

SEQ ID NO: 110386 - DNA, 103 bp, Artificial Sequence
  Synthetic Polynucleotide
taatacgactcactatagggtgaacgctgtgcggctgcgacgttgtttgcaacagaggagagcaaacatggtcgcagccaacctggcggcagcgcaaaagatg

SEQ ID NO: 110387 - DNA, 103 bp, Artificial Sequence
  Synthetic Polynucleotide
taatacgactcactatagggtgctgagccgtgaacgctgtgcggctgcgaaacagaggagatcgcagatgcacagcgttaacctggcggcagcgcaaaagatg

SEQ ID NO: 110388 - DNA, 103 bp, Artificial Sequence
  Synthetic Polynucleotide
taatacgactcactatagggggcctcgagctgctgagccgtgaacgctgtaacagaggagaacagcgatgacggctcagaacctggcggcagcgcaaaagatg

SEQ ID NO: 110389 - DNA, 103 bp, Artificial Sequence
  Synthetic Polynucleotide
taatacgactcactatagggtcttttccagggcctcgagctgctgagccgaacagaggagacggctcatgagctcgaggaacctggcggcagcgcaaaagatg

SEQ ID NO: 110390 - DNA, 103 bp, Artificial Sequence
  Synthetic Polynucleotide
taatacgactcactatagggttctggaaggtcttttccagggcctcgagcaacagaggagagctcgaatgcctggaaaaaacctggcggcagcgcaaaagatg

SEQ ID NO: 110391 - DNA, 103 bp, Artificial Sequence
  Synthetic Polynucleotide
taatacgactcactataggggtagtgagtcttctggaaggtcttttccagaacagaggagactggaaatgaccttccagaacctggcggcagcgcaaaagatg

SEQ ID NO: 110392 - DNA, 103 bp, Artificial Sequence
  Synthetic Polynucleotide
taatacgactcactatagggccacatctgggtagtgagtcttctggaaggaacagaggagaccttccatgagactcactaacctggcggcagcgcaaaagatg

SEQ ID NO: 110393 - DNA, 103 bp, Artificial Sequence
  Synthetic Polynucleotide
taatacgactcactatagggtcacgcatcaccacatctgggtagtgagtcaacagaggagagactcaatgcccagatgtaacctggcggcagcgcaaaagatg

SEQ ID NO: 110394 - DNA, 103 bp, Artificial Sequence
  Synthetic Polynucleotide
taatacgactcactatagggggccagcctctcacgcatcaccacatctggaacagaggagaccagatatggtgatgcgtaacctggcggcagcgcaaaagatg

SEQ ID NO: 110395 - DNA, 103 bp, Artificial Sequence
  Synthetic Polynucleotide
taatacgactcactatagggtggtgcacatggccagcctctcacgcatcaaacagaggagatgatgcatgagaggctggaacctggcggcagcgcaaaagatg

SEQ ID NO: 110396 - DNA, 103 bp, Artificial Sequence
  Synthetic Polynucleotide
taatacgactcactatagggagtgagttcatggcgtgcagtgagtagccgaacagaggagacggctaatgactgcacgcaacctggcggcagcgcaaaagatg

SEQ ID NO: 110397 - DNA, 103 bp, Artificial Sequence
  Synthetic Polynucleotide
taatacgactcactatagggtcaggcaggttggtgcacatggccagcctcaacagaggagagaggctatgcatgtgcacaacctggcggcagcgcaaaagatg

SEQ ID NO: 110398 - DNA, 103 bp, Artificial Sequence
  Synthetic Polynucleotide
taatacgactcactatagggcacccgggcctcaggcaggttggtgcacataacagaggagaatgtgcatgaacctgcctaacctggcggcagcgcaaaagatg

SEQ ID NO: 110399 - DNA, 103 bp, Artificial Sequence
  Synthetic Polynucleotide
taatacgactcactatagggaccacacctgcacccgggcctcaggcaggtaacagaggagaacctgcatgaggcccgggaacctggcggcagcgcaaaagatg

SEQ ID NO: 110400 - DNA, 103 bp, Artificial Sequence
  Synthetic Polynucleotide
taatacgactcactatagggcggttcttgaaccacacctgcacccgggccaacagaggagaggcccgatggcaggtgtgaacctggcggcagcgcaaaagatg

SEQ ID NO: 110401 - DNA, 103 bp, Artificial Sequence
  Synthetic Polynucleotide
taatacgactcactatagggcttggcccggcggttcttgaaccacacctgaacagaggagacaggtgatgttcaagaacaacctggcggcagcgcaaaagatg

SEQ ID NO: 110402 - DNA, 103 bp, Artificial Sequence
  Synthetic Polynucleotide
taatacgactcactatagggtcttccggaacttggcccggcggttcttgaaacagaggagatcaagaatggccgggccaaacctggcggcagcgcaaaagatg

SEQ ID NO: 110403 - DNA, 103 bp, Artificial Sequence
  Synthetic Polynucleotide
taatacgactcactatagggctacgctgcttcttccggaacttggcccggaacagaggagaccgggcatggttccggaaaacctggcggcagcgcaaaagatg

SEQ ID NO: 110404 - DNA, 103 bp, Artificial Sequence
  Synthetic Polynucleotide
taatacgactcactatagggcttctgcaggctacgctgcttcttccggaaaacagaggagattccggatgaagcagcgtaacctggcggcagcgcaaaagatg

SEQ ID NO: 110405 - DNA, 103 bp, Artificial Sequence
  Synthetic Polynucleotide
taatacgactcactatagggggagctgttccttctgcaggctacgctgctaacagaggagaagcagcatggcctgcagaaacctggcggcagcgcaaaagatg

SEQ ID NO: 110406 - DNA, 103 bp, Artificial Sequence
  Synthetic Polynucleotide
taatacgactcactatagggttctgcttctggagctgttccttctgcaggaacagaggagacctgcaatgggaacagctaacctggcggcagcgcaaaagatg

SEQ ID NO: 110407 - DNA, 103 bp, Artificial Sequence
  Synthetic Polynucleotide
taatacgactcactatagggcatggcgctgagtgagttcatggcgtgcagaacagaggagactgcacatgatgaactcaaacctggcggcagcgcaaaagatg

SEQ ID NO: 110408 - DNA, 103 bp, Artificial Sequence
  Synthetic Polynucleotide
taatacgactcactatagggctcagcctccttctgcttctggagctgttcaacagaggagagaacagatgcagaagcagaacctggcggcagcgcaaaagatg

SEQ ID NO: 110409 - DNA, 103 bp, Artificial Sequence
  Synthetic Polynucleotide
taatacgactcactatagggcatgggagccctcagcctccttctgcttctaacagaggagaagaagcatgaggaggctgaacctggcggcagcgcaaaagatg

SEQ ID NO: 110410 - DNA, 103 bp, Artificial Sequence
  Synthetic Polynucleotide
taatacgactcactatagggttgccttccccatgggagccctcagcctccaacagaggagaggaggcatggggctcccaaacctggcggcagcgcaaaagatg

SEQ ID NO: 110411 - DNA, 103 bp, Artificial Sequence
  Synthetic Polynucleotide
taatacgactcactatagggggcctcggccttgccttccccatgggagccaacagaggagaggctccatgggggaaggcaacctggcggcagcgcaaaagatg

SEQ ID NO: 110412 - DNA, 103 bp, Artificial Sequence
  Synthetic Polynucleotide
taatacgactcactatagggctggagtgggggcctcggccttgccttcccaacagaggagagggaagatgaggccgaggaacctggcggcagcgcaaaagatg

SEQ ID NO: 110413 - DNA, 103 bp, Artificial Sequence
  Synthetic Polynucleotide
taatacgactcactatagggagctgggtatctggagtgggggcctcggccaacagaggagaggccgaatgccccactccaacctggcggcagcgcaaaagatg

SEQ ID NO: 110414 - DNA, 103 bp, Artificial Sequence
  Synthetic Polynucleotide
taatacgactcactatagggctcagtgtccagctgggtatctggagtgggaacagaggagacccactatggatacccagaacctggcggcagcgcaaaagatg

SEQ ID NO: 110415 - DNA, 103 bp, Artificial Sequence
  Synthetic Polynucleotide
taatacgactcactataggggtgggggctgctcagtgtccagctgggtataacagaggagaatacccatgtggacactgaacctggcggcagcgcaaaagatg

SEQ ID NO: 110416 - DNA, 103 bp, Artificial Sequence
  Synthetic Polynucleotide
taatacgactcactatagggccaggcagacgtgggggctgctcagtgtccaacagaggagaggacacatggcagcccccaacctggcggcagcgcaaaagatg

SEQ ID NO: 110417 - DNA, 103 bp, Artificial Sequence
  Synthetic Polynucleotide
taatacgactcactatagggggggtcgctgccaggcagacgtgggggctgaacagaggagacagcccatgcgtctgcctaacctggcggcagcgcaaaagatg

SEQ ID NO: 110418 - DNA, 103 bp, Artificial Sequence
  Synthetic Polynucleotide
taatacgactcactataggggcaggttgtacatggcgctgagtgagttcaaacagaggagatgaactatgtcagcgccaaacctggcggcagcgcaaaagatg

SEQ ID NO: 110419 - DNA, 103 bp, Artificial Sequence
  Synthetic Polynucleotide
taatacgactcactataggggctcagcaggggggtcgctgccaggcagacaacagaggagagtctgcatggcagcgaccaacctggcggcagcgcaaaagatg

SEQ ID NO: 110420 - DNA, 103 bp, Artificial Sequence
  Synthetic Polynucleotide
taatacgactcactatagggctcaggtgaagctcagcaggggggtcgctgaacagaggagacagcgaatgccctgctgaaacctggcggcagcgcaaaagatg

SEQ ID NO: 110421 - DNA, 103 bp, Artificial Sequence
  Synthetic Polynucleotide
taatacgactcactatagggctcagacagactcaggtgaagctcagcaggaacagaggagacctgctatgcttcacctgaacctggcggcagcgcaaaagatg

SEQ ID NO: 110422 - DNA, 103 bp, Artificial Sequence
  Synthetic Polynucleotide
taatacgactcactatagggtggctgactgctcagacagactcaggtgaaaacagaggagattcaccatggtctgtctgaacctggcggcagcgcaaaagatg

SEQ ID NO: 110423 - DNA, 103 bp, Artificial Sequence
  Synthetic Polynucleotide
taatacgactcactataggggctgactcactggctgactgctcagacagaaacagaggagatctgtcatggcagtcagcaacctggcggcagcgcaaaagatg

SEQ ID NO: 110424 - DNA, 103 bp, Artificial Sequence
  Synthetic Polynucleotide
taatacgactcactatagggatcctcgggggctgactcactggctgactgaacagaggagacagtcaatgagtgagtcaaacctggcggcagcgcaaaagatg

SEQ ID NO: 110425 - DNA, 103 bp, Artificial Sequence
  Synthetic Polynucleotide
taatacgactcactatagggggtccggctgatcctcgggggctgactcacaacagaggagagtgagtatgcccccgaggaacctggcggcagcgcaaaagatg

SEQ ID NO: 110426 - DNA, 103 bp, Artificial Sequence
  Synthetic Polynucleotide
taatacgactcactatagggtcctcctcacggtccggctgatcctcggggaacagaggagaccccgaatgtcagccggaaacctggcggcagcgcaaaagatg

SEQ ID NO: 110427 - DNA, 103 bp, Artificial Sequence
  Synthetic Polynucleotide
taatacgactcactatagggtgccctggggtcctcctcacggtccggctgaacagaggagacagccgatgcgtgaggagaacctggcggcagcgcaaaagatg

SEQ ID NO: 110428 - DNA, 103 bp, Artificial Sequence
  Synthetic Polynucleotide
taatacgactcactatagggcctcagcccctgccctggggtcctcctcacaacagaggagagtgaggatgaccccagggaacctggcggcagcgcaaaagatg

SEQ ID NO: 110429 - DNA, 103 bp, Artificial Sequence
  Synthetic Polynucleotide
taatacgactcactataggggcctgctggtgcaggttgtacatggcgctgaacagaggagacagcgcatggtacaacctaacctggcggcagcgcaaaagatg

SEQ ID NO: 110430 - DNA, 103 bp, Artificial Sequence
  Synthetic Polynucleotide
taatacgactcactataggggctttggggtcctcagcccctgccctggggaacagaggagaccccagatgaggggctgaaacctggcggcagcgcaaaagatg

SEQ ID NO: 110431 - DNA, 103 bp, Artificial Sequence
  Synthetic Polynucleotide
taatacgactcactataggggctcttctcagctttggggtcctcagccccaacagaggagaggggctatggaccccaaaaacctggcggcagcgcaaaagatg

SEQ ID NO: 110432 - DNA, 103 bp, Artificial Sequence
  Synthetic Polynucleotide
taatacgactcactatagggcagccccagggctcttctcagctttggggtaacagaggagaaccccaatgctgagaagaaacctggcggcagcgcaaaagatg

SEQ ID NO: 110433 - DNA, 103 bp, Artificial Sequence
  Synthetic Polynucleotide
taatacgactcactatagggcccttgctgtcagccccagggctcttctcaaacagaggagatgagaaatgccctggggcaacctggcggcagcgcaaaagatg

SEQ ID NO: 110434 - DNA, 103 bp, Artificial Sequence
  Synthetic Polynucleotide
taatacgactcactataggggcagcccagccccttgctgtcagccccaggaacagaggagacctgggatggacagcaagaacctggcggcagcgcaaaagatg

SEQ ID NO: 110435 - DNA, 103 bp, Artificial Sequence
  Synthetic Polynucleotide
taatacgactcactatagggtgcccctcttgcagcccagccccttgctgtaacagaggagaacagcaatgggctgggctaacctggcggcagcgcaaaagatg

SEQ ID NO: 110436 - DNA, 103 bp, Artificial Sequence
  Synthetic Polynucleotide
taatacgactcactataggggccttggggctgcccctcttgcagcccagcaacagaggagagctgggatgcaagaggggaacctggcggcagcgcaaaagatg

SEQ ID NO: 110437 - DNA, 103 bp, Artificial Sequence
  Synthetic Polynucleotide
taatacgactcactatagggtggggaatctgccttggggctgcccctcttaacagaggagaaagaggatgagccccaagaacctggcggcagcgcaaaagatg

SEQ ID NO: 110438 - DNA, 103 bp, Artificial Sequence
  Synthetic Polynucleotide
taatacgactcactatagggtcaggctgcctggggaatctgccttggggcaacagaggagagccccaatgcagattcccaacctggcggcagcgcaaaagatg

SEQ ID NO: 110439 - DNA, 103 bp, Artificial Sequence
  Synthetic Polynucleotide
taatacgactcactatagggggagtgatggtcaggctgcctggggaatctaacagaggagaagattcatgaggcagcctaacctggcggcagcgcaaaagatg

SEQ ID NO: 110440 - DNA, 103 bp, Artificial Sequence
  Synthetic Polynucleotide
taatacgactcactatagggctgctgggctgcctgctggtgcaggttgtaaacagaggagatacaacatgcaccagcagaacctggcggcagcgcaaaagatg

SEQ ID NO: 110441 - DNA, 103 bp, Artificial Sequence
  Synthetic Polynucleotide
taatacgactcactatagggtggggccacaggagtgatggtcaggctgccaacagaggagaggcagcatgaccatcactaacctggcggcagcgcaaaagatg

SEQ ID NO: 110442 - DNA, 103 bp, Artificial Sequence
  Synthetic Polynucleotide
taatacgactcactatagggggccaccccctggggccacaggagtgatggaacagaggagaccatcaatgctgtggcccaacctggcggcagcgcaaaagatg

SEQ ID NO: 110443 - DNA, 103 bp, Artificial Sequence
  Synthetic Polynucleotide
taatacgactcactataggggggcccaggaggccaccccctggggccacaaacagaggagatgtggcatgagggggtggaacctggcggcagcgcaaaagatg

SEQ ID NO: 110444 - DNA, 103 bp, Artificial Sequence
  Synthetic Polynucleotide
taatacgactcactatagggggagtgggaggggcccaggaggccacccccaacagaggagagggggtatgctcctgggcaacctggcggcagcgcaaaagatg

SEQ ID NO: 110445 - DNA, 103 bp, Artificial Sequence
  Synthetic Polynucleotide
taatacgactcactatagggacgaggaataggagtgggaggggcccaggaaacagaggagatcctggatgcctcccactaacctggcggcagcgcaaaagatg

SEQ ID NO: 110446 - DNA, 103 bp, Artificial Sequence
  Synthetic Polynucleotide
taatacgactcactatagggctcagcggggacgaggaataggagtgggagaacagaggagactcccaatgctattcctcaacctggcggcagcgcaaaagatg

SEQ ID NO: 110447 - DNA, 103 bp, Artificial Sequence
  Synthetic Polynucleotide
taatacgactcactatagggacggaagaggctcagcggggacgaggaataaacagaggagatattccatgtccccgctgaacctggcggcagcgcaaaagatg

SEQ ID NO: 110448 - DNA, 103 bp, Artificial Sequence
  Synthetic Polynucleotide
taatacgactcactataggggctcctgcagacggaagaggctcagcggggaacagaggagaccccgcatggcctcttccaacctggcggcagcgcaaaagatg

SEQ ID NO: 110449 - DNA, 103 bp, Artificial Sequence
  Synthetic Polynucleotide
taatacgactcactatagggtggcggaattgctcctgcagacggaagaggaacagaggagacctcttatgtctgcaggaaacctggcggcagcgcaaaagatg

SEQ ID NO: 110450 - DNA, 103 bp, Artificial Sequence
  Synthetic Polynucleotide
taatacgactcactatagggcgccatgtgctggcggaattgctcctgcagaacagaggagactgcagatgcaattccgcaacctggcggcagcgcaaaagatg

SEQ ID NO: 110451 - DNA, 103 bp, Artificial Sequence
  Synthetic Polynucleotide
taatacgactcactatagggcatgctgggcctgctgggctgcctgctggtaacagaggagaaccagcatgcagcccagcaacctggcggcagcgcaaaagatg

SEQ ID NO: 110452 - DNA, 103 bp, Artificial Sequence
  Synthetic Polynucleotide
taatacgactcactatagggtgttggtggccgccatgtgctggcggaattaacagaggagaaattccatgagcacatggaacctggcggcagcgcaaaagatg

SEQ ID NO: 110453 - DNA, 103 bp, Artificial Sequence
  Synthetic Polynucleotide
taatacgactcactatagggtgcaccaggttgttggtggccgccatgtgcaacagaggagagcacatatgggccaccaaaacctggcggcagcgcaaaagatg

SEQ ID NO: 110454 - DNA, 103 bp, Artificial Sequence
  Synthetic Polynucleotide
taatacgactcactatagggggacgagtagtgcaccaggttgttggtggcaacagaggagagccaccatgaacctggtgaacctggcggcagcgcaaaagatg

SEQ ID NO: 110455 - DNA, 103 bp, Artificial Sequence
  Synthetic Polynucleotide
taatacgactcactatagggctacttcgaaggacgagtagtgcaccaggtaacagaggagaacctggatgactactcgtaacctggcggcagcgcaaaagatg

SEQ ID NO: 110456 - DNA, 103 bp, Artificial Sequence
  Synthetic Polynucleotide
taatacgactcactataggggccggaccccctacttcgaaggacgagtagaacagaggagactactcatgcttcgaagtaacctggcggcagcgcaaaagatg

SEQ ID NO: 110457 - DNA, 103 bp, Artificial Sequence
  Synthetic Polynucleotide
taatacgactcactatagggagcagcaggggccggaccccctacttcgaaaacagaggagattcgaaatggggggtccgaacctggcggcagcgcaaaagatg

SEQ ID NO: 110458 - DNA, 103 bp, Artificial Sequence
  Synthetic Polynucleotide
taatacgactcactatagggccgccgctgcagcagcaggggccggaccccaacagaggagaggggtcatgcccctgctgaacctggcggcagcgcaaaagatg

SEQ ID NO: 110459 - DNA, 103 bp, Artificial Sequence
  Synthetic Polynucleotide
taatacgactcactatagggacagcagcagccgccgctgcagcagcagggaacagaggagaccctgcatgtgcagcggcaacctggcggcagcgcaaaagatg

SEQ ID NO: 110460 - DNA, 103 bp, Artificial Sequence
  Synthetic Polynucleotide
taatacgactcactatagggcaggtagggcacagcagcagccgccgctgcaacagaggagagcagcgatggctgctgctaacctggcggcagcgcaaaagatg

SEQ ID NO: 110461 - DNA, 103 bp, Artificial Sequence
  Synthetic Polynucleotide
taatacgactcactatagggtgttgacgcccaggtagggcacagcagcagaacagaggagactgctgatgtgccctaccaacctggcggcagcgcaaaagatg

SEQ ID NO: 110462 - DNA, 103 bp, Artificial Sequence
  Synthetic Polynucleotide
taatacgactcactatagggtagtcgggggcatgctgggcctgctgggctaacagaggagaagcccaatgggcccagcaaacctggcggcagcgcaaaagatg

SEQ ID NO: 110463 - DNA, 103 bp, Artificial Sequence
  Synthetic Polynucleotide
taatacgactcactatagggagcggggccatgttgacgcccaggtagggcaacagaggagagccctaatggggcgtcaaaacctggcggcagcgcaaaagatg

SEQ ID NO: 110464 - DNA, 103 bp, Artificial Sequence
  Synthetic Polynucleotide
taatacgactcactatagggcagtgagcccagcggggccatgttgacgccaacagaggagaggcgtcatgatggccccgaacctggcggcagcgcaaaagatg

SEQ ID NO: 110465 - DNA, 103 bp, Artificial Sequence
  Synthetic Polynucleotide
taatacgactcactatagggactggcagtgcagtgagcccagcggggccaaacagaggagatggcccatgtgggctcacaacctggcggcagcgcaaaagatg

SEQ ID NO: 110466 - DNA, 103 bp, Artificial Sequence
  Synthetic Polynucleotide
taatacgactcactatagggtggtagtaggactggcagtgcagtgagcccaacagaggagagggctcatggcactgccaaacctggcggcagcgcaaaagatg

SEQ ID NO: 110467 - DNA, 103 bp, Artificial Sequence
  Synthetic Polynucleotide
taatacgactcactatagggtgacagggactggtagtaggactggcagtgaacagaggagacactgcatgtcctactacaacctggcggcagcgcaaaagatg

SEQ ID NO: 110468 - DNA, 103 bp, Artificial Sequence
  Synthetic Polynucleotide
taatacgactcactatagggcagcggctgctgacagggactggtagtaggaacagaggagacctactatgagtccctgtaacctggcggcagcgcaaaagatg

SEQ ID NO: 110469 - DNA, 103 bp, Artificial Sequence
  Synthetic Polynucleotide
taatacgactcactatagggtggtgggcagcagcggctgctgacagggacaacagaggagagtccctatgagcagccgcaacctggcggcagcgcaaaagatg

SEQ ID NO: 110470 - DNA, 103 bp, Artificial Sequence
  Synthetic Polynucleotide
taatacgactcactatagggccacacaccctggtgggcagcagcggctgcaacagaggagagcagccatggctgcccacaacctggcggcagcgcaaaagatg

SEQ ID NO: 110471 - DNA, 103 bp, Artificial Sequence
  Synthetic Polynucleotide
taatacgactcactataggggaggagacccccacacaccctggtgggcagaacagaggagactgcccatgagggtgtgtaacctggcggcagcgcaaaagatg

SEQ ID NO: 110472 - DNA, 103 bp, Artificial Sequence
  Synthetic Polynucleotide
taatacgactcactataggggcaggcagcagaggagacccccacacacccaacagaggagagggtgtatgggggtctccaacctggcggcagcgcaaaagatg

SEQ ID NO: 110473 - DNA, 103 bp, Artificial Sequence
  Synthetic Polynucleotide
taatacgactcactataggggggcttgctgaatgcctcgtcgttgggcataacagaggagaatgcccatggacgaggcaaacctggcggcagcgcaaaagatg

SEQ ID NO: 110474 - DNA, 103 bp, Artificial Sequence
  Synthetic Polynucleotide
taatacgactcactatagggccccactagcgccccagacgctttgccaaaaacagaggagatttggcatggcgtctgggaacctggcggcagcgcaaaagatg

SEQ ID NO: 110475 - DNA, 103 bp, Artificial Sequence
  Synthetic Polynucleotide
taatacgactcactataggggctgctcgagagggaaaccaagccagaatcaacagaggagagattctatgttggtttccaacctggcggcagcgcaaaagatg

SEQ ID NO: 110476 - DNA, 103 bp, Artificial Sequence
  Synthetic Polynucleotide
taatacgactcactatagggtaataggagagctgctcgagagggaaaccaaacagaggagatggtttatgtctcgagcaaacctggcggcagcgcaaaagatg

SEQ ID NO: 110477 - DNA, 103 bp, Artificial Sequence
  Synthetic Polynucleotide
taatacgactcactatagggctcttgttactaataggagagctgctcgagaacagaggagactcgagatgctctcctataacctggcggcagcgcaaaagatg

SEQ ID NO: 110478 - DNA, 103 bp, Artificial Sequence
  Synthetic Polynucleotide
taatacgactcactatagggtgcctttgtgctcttgttactaataggagaaacagaggagatctcctatgagtaacaagaacctggcggcagcgcaaaagatg

SEQ ID NO: 110479 - DNA, 103 bp, Artificial Sequence
  Synthetic Polynucleotide
taatacgactcactatagggattcaagcactgcctttgtgctcttgttacaacagaggagagtaacaatggcacaaaggaacctggcggcagcgcaaaagatg

SEQ ID NO: 110480 - DNA, 103 bp, Artificial Sequence
  Synthetic Polynucleotide
taatacgactcactataggggcaggctcacattcaagcactgcctttgtgaacagaggagacacaaaatgagtgcttgaaacctggcggcagcgcaaaagatg

SEQ ID NO: 110481 - DNA, 103 bp, Artificial Sequence
  Synthetic Polynucleotide
taatacgactcactataggggggctccgacgcaggctcacattcaagcacaacagaggagagtgcttatgtgtgagcctaacctggcggcagcgcaaaagatg

SEQ ID NO: 110482 - DNA, 103 bp, Artificial Sequence
  Synthetic Polynucleotide
taatacgactcactatagggtgaagctgctgggctccgacgcaggctcacaacagaggagagtgagcatgcgtcggagcaacctggcggcagcgcaaaagatg

SEQ ID NO: 110483 - DNA, 103 bp, Artificial Sequence
  Synthetic Polynucleotide
taatacgactcactatagggggagtgactgtgaagctgctgggctccgacaacagaggagagtcggaatgcagcagcttaacctggcggcagcgcaaaagatg

SEQ ID NO: 110484 - DNA, 103 bp, Artificial Sequence
  Synthetic Polynucleotide
taatacgactcactatagggctcgatgacgggagtgactgtgaagctgctaacagaggagaagcagcatgacagtcactaacctggcggcagcgcaaaagatg

SEQ ID NO: 110485 - DNA, 103 bp, Artificial Sequence
  Synthetic Polynucleotide
taatacgactcactatagggcgctggccgcccccactagcgccccagacgaacagaggagacgtctgatgcgctagtggaacctggcggcagcgcaaaagatg

SEQ ID NO: 110486 - DNA, 103 bp, Artificial Sequence
  Synthetic Polynucleotide
taatacgactcactatagggactcgtcctcctcgatgacgggagtgactgaacagaggagacagtcaatgccgtcatcgaacctggcggcagcgcaaaagatg

SEQ ID NO: 110487 - DNA, 103 bp, Artificial Sequence
  Synthetic Polynucleotide
taatacgactcactataggggcgctcgagccgctggccgcccccactagcaacagaggagagctagtatgggcggccagaacctggcggcagcgcaaaagatg

SEQ ID NO: 110488 - DNA, 103 bp, Artificial Sequence
  Synthetic Polynucleotide
taatacgactcactataggggctgcccccggcgctcgagccgctggccgcaacagaggagagcggccatgggctcgagcaacctggcggcagcgcaaaagatg

SEQ ID NO: 110489 - DNA, 103 bp, Artificial Sequence
  Synthetic Polynucleotide
taatacgactcactatagggctcctctgctgctgcccccggcgctcgagcaacagaggagagctcgaatgccgggggcaaacctggcggcagcgcaaaagatg

SEQ ID NO: 110490 - DNA, 103 bp, Artificial Sequence
  Synthetic Polynucleotide
taatacgactcactatagggccggagccgcctcctctgctgctgcccccgaacagaggagacgggggatgcagcagaggaacctggcggcagcgcaaaagatg

SEQ ID NO: 110491 - DNA, 103 bp, Artificial Sequence
  Synthetic Polynucleotide
taatacgactcactatagggcgccccggagccggagccgcctcctctgctaacagaggagaagcagaatgggcggctccaacctggcggcagcgcaaaagatg

SEQ ID NO: 110492 - DNA, 103 bp, Artificial Sequence
  Synthetic Polynucleotide
taatacgactcactatagggccaggtccgacgccccggagccggagccgcaacagaggagagcggctatggctccggggaacctggcggcagcgcaaaagatg

SEQ ID NO: 110493 - DNA, 103 bp, Artificial Sequence
  Synthetic Polynucleotide
taatacgactcactatagggctcccggcacccaggtccgacgccccggagaacagaggagactccggatggtcggacctaacctggcggcagcgcaaaagatg

SEQ ID NO: 110494 - DNA, 103 bp, Artificial Sequence
  Synthetic Polynucleotide
taatacgactcactatagggggacttcttgctcccggcacccaggtccgaaacagaggagatcggacatgggtgccgggaacctggcggcagcgcaaaagatg

SEQ ID NO: 110495 - DNA, 103 bp, Artificial Sequence
  Synthetic Polynucleotide
taatacgactcactatagggacggtgtagagggcttgctgaatgcctcgtaacagaggagaacgaggatgtcagcaagcaacctggcggcagcgcaaaagatg

SEQ ID NO: 110496 - DNA, 103 bp, Artificial Sequence
  Synthetic Polynucleotide
taatacgactcactataggggcagccgcggggacttcttgctcccggcacaacagaggagagtgccgatggcaagaagtaacctggcggcagcgcaaaagatg

SEQ ID NO: 110497 - DNA, 103 bp, Artificial Sequence
  Synthetic Polynucleotide
taatacgactcactataggggcgcacttgggcagccgcggggacttcttgaacagaggagacaagaaatgcccgcggctaacctggcggcagcgcaaaagatg

SEQ ID NO: 110498 - DNA, 103 bp, Artificial Sequence
  Synthetic Polynucleotide
taatacgactcactatagggcctgcagcgtgcgcacttgggcagccgcggaacagaggagaccgcggatgcccaagtgcaacctggcggcagcgcaaaagatg

SEQ ID NO: 110499 - DNA, 103 bp, Artificial Sequence
  Synthetic Polynucleotide
taatacgactcactatagggagccgtggttcctgcagcgtgcgcacttggaacagaggagaccaagtatgcacgctgcaaacctggcggcagcgcaaaagatg

SEQ ID NO: 110500 - DNA, 103 bp, Artificial Sequence
  Synthetic Polynucleotide
taatacgactcactatagggggcgaggcgtagccgtggttcctgcagcgtaacagaggagaacgctgatggaaccacggaacctggcggcagcgcaaaagatg

SEQ ID NO: 110501 - DNA, 103 bp, Artificial Sequence
  Synthetic Polynucleotide
taatacgactcactataggggcccttgagcggcgaggcgtagccgtggttaacagaggagaaaccacatgtacgcctcgaacctggcggcagcgcaaaagatg

SEQ ID NO: 110502 - DNA, 103 bp, Artificial Sequence
  Synthetic Polynucleotide
taatacgactcactatagggagcgcttgtggcccttgagcggcgaggcgtaacagaggagaacgcctatgcgctcaaggaacctggcggcagcgcaaaagatg

SEQ ID NO: 110503 - DNA, 103 bp, Artificial Sequence
  Synthetic Polynucleotide
taatacgactcactatagggcacatgcagaagcgcttgtggcccttgagcaacagaggagagctcaaatgccacaagcgaacctggcggcagcgcaaaagatg

SEQ ID NO: 110504 - DNA, 103 bp, Artificial Sequence
  Synthetic Polynucleotide
taatacgactcactataggggcagtcgcgccacatgcagaagcgcttgtgaacagaggagacacaagatgttctgcatgaacctggcggcagcgcaaaagatg

SEQ ID NO: 110505 - DNA, 103 bp, Artificial Sequence
  Synthetic Polynucleotide
taatacgactcactatagggtcttgcactggcagtcgcgccacatgcagaaacagaggagatctgcaatgggcgcgactaacctggcggcagcgcaaaagatg

SEQ ID NO: 110506 - DNA, 103 bp, Artificial Sequence
  Synthetic Polynucleotide
taatacgactcactatagggggggcttccgacggtgtagagggcttgctgaacagaggagacagcaaatgctctacaccaacctggcggcagcgcaaaagatg

SEQ ID NO: 110507 - DNA, 103 bp, Artificial Sequence
  Synthetic Polynucleotide
taatacgactcactatagggaggttgcacttcttgcactggcagtcgcgcaacagaggagagcgcgaatgccagtgcaaaacctggcggcagcgcaaaagatg

SEQ ID NO: 110508 - DNA, 103 bp, Artificial Sequence
  Synthetic Polynucleotide
taatacgactcactatagggctcggcgatcaggttgcacttcttgcactgaacagaggagacagtgcatgaagtgcaacaacctggcggcagcgcaaaagatg

SEQ ID NO: 110509 - DNA, 103 bp, Artificial Sequence
  Synthetic Polynucleotide
taatacgactcactatagggcgcgctgcctctcggcgatcaggttgcactaacagaggagaagtgcaatgtgatcgccgaacctggcggcagcgcaaaagatg

SEQ ID NO: 110510 - DNA, 103 bp, Artificial Sequence
  Synthetic Polynucleotide
taatacgactcactataggggcggccatcacgcgctgcctctcggcgatcaacagaggagagatcgcatggaggcagcgaacctggcggcagcgcaaaagatg

SEQ ID NO: 110511 - DNA, 103 bp, Artificial Sequence
  Synthetic Polynucleotide
taatacgactcactatagggggccacctgcgcggccatcacgcgctgcctaacagaggagaaggcagatggtgatggccaacctggcggcagcgcaaaagatg

SEQ ID NO: 110512 - DNA, 103 bp, Artificial Sequence
  Synthetic Polynucleotide
taatacgactcactataggggccttctcagggccacctgcgcggccatcaaacagaggagatgatggatgcgcaggtggaacctggcggcagcgcaaaagatg

SEQ ID NO: 110513 - DNA, 103 bp, Artificial Sequence
  Synthetic Polynucleotide
taatacgactcactatagggtgggcctgctgccttctcagggccacctgcaacagaggagagcaggtatgcctgagaagaacctggcggcagcgcaaaagatg

SEQ ID NO: 110514 - DNA, 103 bp, Artificial Sequence
  Synthetic Polynucleotide
taatacgactcactatagggttcctcctcctgggcctgctgccttctcagaacagaggagactgagaatgcagcaggccaacctggcggcagcgcaaaagatg

SEQ ID NO: 110515 - DNA, 103 bp, Artificial Sequence
  Synthetic Polynucleotide
taatacgactcactatagggtgatacccaattcctcctcctgggcctgctaacagaggagaagcaggatgaggaggaggaacctggcggcagcgcaaaagatg

SEQ ID NO: 110516 - DNA, 103 bp, Artificial Sequence
  Synthetic Polynucleotide
taatacgactcactatagggatggggtggctgatacccaattcctcctccaacagaggagaggaggaatgattgggtataacctggcggcagcgcaaaagatg

SEQ ID NO: 110517 - DNA, 103 bp, Artificial Sequence
  Synthetic Polynucleotide
taatacgactcactataggggggggcgtgaggggcttccgacggtgtagaaacagaggagatctacaatgtcggaagccaacctggcggcagcgcaaaagatg

SEQ ID NO: 110518 - DNA, 103 bp, Artificial Sequence
  Synthetic Polynucleotide
taatacgactcactataggggggcagtgggatggggtggctgatacccaaaacagaggagattgggtatgagccaccccaacctggcggcagcgcaaaagatg

SEQ ID NO: 110519 - DNA, 103 bp, Artificial Sequence
  Synthetic Polynucleotide
taatacgactcactatagggcggccgcactgggcagtgggatggggtggcaacagaggagagccaccatgtcccactgcaacctggcggcagcgcaaaagatg

SEQ ID NO: 110520 - DNA, 103 bp, Artificial Sequence
  Synthetic Polynucleotide
taatacgactcactatagggacaagcagctcggccgcactgggcagtgggaacagaggagacccactatgcagtgcggcaacctggcggcagcgcaaaagatg

SEQ ID NO: 110521 - DNA, 103 bp, Artificial Sequence
  Synthetic Polynucleotide
taatacgactcactatagggctctcttttgacaagcagctcggccgcactaacagaggagaagtgcgatggagctgcttaacctggcggcagcgcaaaagatg

SEQ ID NO: 110522 - DNA, 103 bp, Artificial Sequence
  Synthetic Polynucleotide
taatacgactcactatagggtgccattgttctctcttttgacaagcagctaacagaggagaagctgcatgtcaaaagagaacctggcggcagcgcaaaagatg

SEQ ID NO: 110523 - DNA, 103 bp, Artificial Sequence
  Synthetic Polynucleotide
taatacgactcactatagggcacgggttactgccattgttctctcttttgaacagaggagacaaaagatggaacaatggaacctggcggcagcgcaaaagatg

SEQ ID NO: 110524 - DNA, 103 bp, Artificial Sequence
  Synthetic Polynucleotide
taatacgactcactatagggagtcatgaggcacgggttactgccattgttaacagaggagaaacaatatgagtaacccgaacctggcggcagcgcaaaagatg

SEQ ID NO: 110525 - DNA, 103 bp, Artificial Sequence
  Synthetic Polynucleotide
taatacgactcactatagggcactgcactcagtcatgaggcacgggttacaacagaggagagtaaccatggcctcatgaaacctggcggcagcgcaaaagatg

SEQ ID NO: 110526 - DNA, 103 bp, Artificial Sequence
  Synthetic Polynucleotide
taatacgactcactatagggtgagaggtgccactgcactcagtcatgaggaacagaggagacctcatatgtgagtgcagaacctggcggcagcgcaaaagatg

SEQ ID NO: 110527 - DNA, 103 bp, Artificial Sequence
  Synthetic Polynucleotide
taatacgactcactatagggcggcggtggctgagaggtgccactgcactcaacagaggagagagtgcatgggcacctctaacctggcggcagcgcaaaagatg

SEQ ID NO: 110528 - DNA, 103 bp, Artificial Sequence
  Synthetic Polynucleotide
taatacgactcactataggggcggtaccccgggggcgtgaggggcttccgaacagaggagacggaagatgctcacgcccaacctggcggcagcgcaaaagatg

SEQ ID NO: 110529 - DNA, 103 bp, Artificial Sequence
  Synthetic Polynucleotide
taatacgactcactatagggggacactggccggcggtggctgagaggtgcaacagaggagagcacctatgagccaccgcaacctggcggcagcgcaaaagatg

SEQ ID NO: 110530 - DNA, 103 bp, Artificial Sequence
  Synthetic Polynucleotide
taatacgactcactataggggcagtggtggggacactggccggcggtggcaacagaggagagccaccatgggccagtgtaacctggcggcagcgcaaaagatg

SEQ ID NO: 110531 - DNA, 103 bp, Artificial Sequence
  Synthetic Polynucleotide
taatacgactcactatagggctctgaagctgcagtggtggggacactggcaacagaggagagccagtatgcccaccactaacctggcggcagcgcaaaagatg

SEQ ID NO: 110532 - DNA, 103 bp, Artificial Sequence
  Synthetic Polynucleotide
taatacgactcactatagggccatacgtccctctgaagctgcagtggtggaacagaggagaccaccaatgcagcttcagaacctggcggcagcgcaaaagatg

SEQ ID NO: 110533 - DNA, 103 bp, Artificial Sequence
  Synthetic Polynucleotide
taatacgactcactatagggtcctggatgaccatacgtccctctgaagctaacagaggagaagcttcatggggacgtataacctggcggcagcgcaaaagatg

SEQ ID NO: 110534 - DNA, 103 bp, Artificial Sequence
  Synthetic Polynucleotide
taatacgactcactatagggagcaggaatatcctggatgaccatacgtccaacagaggagaggacgtatggtcatccagaacctggcggcagcgcaaaagatg

SEQ ID NO: 110535 - DNA, 103 bp, Artificial Sequence
  Synthetic Polynucleotide
taatacgactcactatagggtgctggtgacagcaggaatatcctggatgaaacagaggagatcatccatgatattcctgaacctggcggcagcgcaaaagatg

SEQ ID NO: 110536 - DNA, 103 bp, Artificial Sequence
  Synthetic Polynucleotide
taatacgactcactatagggacatgccctctgctggtgacagcaggaataaacagaggagatattccatgtgtcaccagaacctggcggcagcgcaaaagatg

SEQ ID NO: 110537 - DNA, 103 bp, Artificial Sequence
  Synthetic Polynucleotide
taatacgactcactatagggtgtgttctccacatgccctctgctggtgacaacagaggagagtcaccatgagagggcataacctggcggcagcgcaaaagatg

SEQ ID NO: 110538 - DNA, 103 bp, Artificial Sequence
  Synthetic Polynucleotide
taatacgactcactatagggccaggtcaggtgtgttctccacatgccctcaacagaggagagagggcatgtggagaacaaacctggcggcagcgcaaaagatg

SEQ ID NO: 110539 - DNA, 103 bp, Artificial Sequence
  Synthetic Polynucleotide
taatacgactcactatagggctgccctgcggcggtaccccgggggcgtgaaacagaggagatcacgcatgcggggtaccaacctggcggcagcgcaaaagatg

SEQ ID NO: 110540 - DNA, 103 bp, Artificial Sequence
  Synthetic Polynucleotide
taatacgactcactataggggagtctgaaaccaggtcaggtgtgttctccaacagaggagaggagaaatgacctgacctaacctggcggcagcgcaaaagatg

SEQ ID NO: 110541 - DNA, 103 bp, Artificial Sequence
  Synthetic Polynucleotide
taatacgactcactataggggtagtaggtggagtctgaaaccaggtcaggaacagaggagacctgacatggtttcagacaacctggcggcagcgcaaaagatg

SEQ ID NO: 110542 - DNA, 103 bp, Artificial Sequence
  Synthetic Polynucleotide
taatacgactcactatagggagaagctgctgtagtaggtggagtctgaaaaacagaggagatttcagatgccacctactaacctggcggcagcgcaaaagatg

SEQ ID NO: 110543 - DNA, 103 bp, Artificial Sequence
  Synthetic Polynucleotide
taatacgactcactataggggacggctggtagaagctgctgtagtaggtgaacagaggagacacctaatgcagcagcttaacctggcggcagcgcaaaagatg

SEQ ID NO: 110544 - DNA, 103 bp, Artificial Sequence
  Synthetic Polynucleotide
taatacgactcactatagggaggaaacagagacggctggtagaagctgctaacagaggagaagcagcatgtaccagccgaacctggcggcagcgcaaaagatg

SEQ ID NO: 110545 - DNA, 103 bp, Artificial Sequence
  Synthetic Polynucleotide
taatacgactcactatagggtgttgtaataaggaaacagagacggctggtaacagaggagaaccagcatgctctgtttcaacctggcggcagcgcaaaagatg

SEQ ID NO: 110546 - DNA, 103 bp, Artificial Sequence
  Synthetic Polynucleotide
taatacgactcactatagggttgtatagattgttgtaataaggaaacagaaacagaggagatctgttatgttattacaaaacctggcggcagcgcaaaagatg

SEQ ID NO: 110547 - DNA, 103 bp, Artificial Sequence
  Synthetic Polynucleotide
taatacgactcactatagggctgcgggcagttgtatagattgttgtaataaacagaggagatattacatgaatctatacaacctggcggcagcgcaaaagatg

SEQ ID NO: 110548 - DNA, 103 bp, Artificial Sequence
  Synthetic Polynucleotide
taatacgactcactatagggccatggagtactgcgggcagttgtatagataacagaggagaatctatatgactgcccgcaacctggcggcagcgcaaaagatg

SEQ ID NO: 110549 - DNA, 103 bp, Artificial Sequence
  Synthetic Polynucleotide
taatacgactcactataggggcagccaaggccatggagtactgcgggcagaacagaggagactgcccatggtactccataacctggcggcagcgcaaaagatg

SEQ ID NO: 110550 - DNA, 103 bp, Artificial Sequence
  Synthetic Polynucleotide
taatacgactcactataggggcccccggctctgccctgcggcggtaccccaacagaggagaggggtaatgccgcagggcaacctggcggcagcgcaaaagatg

SEQ ID NO: 110551 - DNA, 103 bp, Artificial Sequence
  Synthetic Polynucleotide
taatacgactcactatagggagcagaatcagcagccaaggccatggagtaaacagaggagatactccatggccttggctaacctggcggcagcgcaaaagatg

SEQ ID NO: 110552 - DNA, 103 bp, Artificial Sequence
  Synthetic Polynucleotide
taatacgactcactatagggcctccccagaagcagaatcagcagccaaggaacagaggagaccttggatgctgattctgaacctggcggcagcgcaaaagatg

SEQ ID NO: 110553 - DNA, 103 bp, Artificial Sequence
  Synthetic Polynucleotide
taatacgactcactatagggggatttcccacctccccagaagcagaatcaaacagaggagatgattcatgttctggggaaacctggcggcagcgcaaaagatg

SEQ ID NO: 110554 - DNA, 103 bp, Artificial Sequence
  Synthetic Polynucleotide
taatacgactcactatagggtcccccgaggggatttcccacctccccagaaacagaggagatctgggatggtgggaaataacctggcggcagcgcaaaagatg

SEQ ID NO: 110555 - DNA, 103 bp, Artificial Sequence
  Synthetic Polynucleotide
taatacgactcactatagggtcacaggggatcccccgaggggatttcccaaacagaggagatgggaaatgccctcggggaacctggcggcagcgcaaaagatg

SEQ ID NO: 110556 - DNA, 103 bp, Artificial Sequence
  Synthetic Polynucleotide
taatacgactcactatagggaggctgttcttcacaggggatcccccgaggaacagaggagacctcggatgatcccctgtaacctggcggcagcgcaaaagatg

SEQ ID NO: 110557 - DNA, 103 bp, Artificial Sequence
  Synthetic Polynucleotide
taatacgactcactataggggaggccccgaaggctgttcttcacaggggaaacagaggagatcccctatgaagaacagcaacctggcggcagcgcaaaagatg

SEQ ID NO: 110558 - DNA, 103 bp, Artificial Sequence
  Synthetic Polynucleotide
taatacgactcactatagggaaggtccggggaggccccgaaggctgttctaacagaggagaagaacaatgttcggggccaacctggcggcagcgcaaaagatg

SEQ ID NO: 110559 - DNA, 103 bp, Artificial Sequence
  Synthetic Polynucleotide
taatacgactcactatagggccaggcacataaggtccggggaggccccgaaacagaggagatcggggatgccccggaccaacctggcggcagcgcaaaagatg

SEQ ID NO: 110560 - DNA, 103 bp, Artificial Sequence
  Synthetic Polynucleotide
taatacgactcactatagggtcctgtctgaccaggcacataaggtccgggaacagaggagacccggaatgtatgtgcctaacctggcggcagcgcaaaagatg

SEQ ID NO: 110561 - DNA, 103 bp, Artificial Sequence
  Synthetic Polynucleotide
taatacgactcactatagggctttgccaaagcccccggctctgccctgcgaacagaggagacgcaggatggagccggggaacctggcggcagcgcaaaagatg

SEQ ID NO: 110562 - DNA, 103 bp, Artificial Sequence
  Synthetic Polynucleotide
taatacgactcactataggggccactggtttcctgtctgaccaggcacataacagaggagaatgtgcatggtcagacagaacctggcggcagcgcaaaagatg

SEQ ID NO: 110563 - DNA, 103 bp, Artificial Sequence
  Synthetic Polynucleotide
taatacgactcactatagggttcttcatctgccactggtttcctgtctgaaacagaggagatcagacatgaaaccagtgaacctggcggcagcgcaaaagatg

SEQ ID NO: 110564 - DNA, 103 bp, Artificial Sequence
  Synthetic Polynucleotide
taatacgactcactataggggttctccatgttcttcatctgccactggttaacagaggagaaaccagatgcagatgaagaacctggcggcagcgcaaaagatg

SEQ ID NO: 110565 - DNA, 103 bp, Artificial Sequence
  Synthetic Polynucleotide
taatacgactcactatagggttgcatggcggttctccatgttcttcatctaacagaggagaagatgaatgacatggagaaacctggcggcagcgcaaaagatg

SEQ ID NO: 110566 - DNA, 103 bp, Artificial Sequence
  Synthetic Polynucleotide
taatacgactcactatagggtgggagctcattgcatggcggttctccatgaacagaggagacatggaatgccgccatgcaacctggcggcagcgcaaaagatg

SEQ ID NO: 110567 - DNA, 103 bp, Artificial Sequence
  Synthetic Polynucleotide
taatacgactcactatagggcatcctgtactgggagctcattgcatggcgaacagaggagacgccatatgatgagctccaacctggcggcagcgcaaaagatg

SEQ ID NO: 110568 - DNA, 103 bp, Artificial Sequence
  Synthetic Polynucleotide
taatacgactcactatagggagtaagaatgcatcctgtactgggagctcaaacagaggagatgagctatgagtacaggaaacctggcggcagcgcaaaagatg

SEQ ID NO: 110569 - DNA, 103 bp, Artificial Sequence
  Synthetic Polynucleotide
taatacgactcactatagggggaggcgggtagtaagaatgcatcctgtacaacagaggagagtacagatggcattcttaaacctggcggcagcgcaaaagatg

SEQ ID NO: 110570 - DNA, 103 bp, Artificial Sequence
  Synthetic Polynucleotide
taatacgactcactatagggcaggtaagagggaggcgggtagtaagaatgaacagaggagacattctatgtacccgcctaacctggcggcagcgcaaaagatg

SEQ ID NO: 110571 - DNA, 103 bp, Artificial Sequence
  Synthetic Polynucleotide
taatacgactcactatagggcgctctggcccaggtaagagggaggcgggtaacagaggagaacccgcatgcctcttaccaacctggcggcagcgcaaaagatg

SEQ ID NO: 110572 - DNA, 103 bp, Artificial Sequence
  Synthetic Polynucleotide
taatacgactcactataggggccccagacgctttgccaaagcccccggctaacagaggagaagccggatgctttggcaaaacctggcggcagcgcaaaagatg

SEQ ID NO: 110573 - DNA, 103 bp, Artificial Sequence
  Synthetic Polynucleotide
taatacgactcactatagggaactggggcacgctctggcccaggtaagagaacagaggagactcttaatggggccagagaacctggcggcagcgcaaaagatg

SEQ ID NO: 110574 - DNA, 103 bp, Artificial Sequence
  Synthetic Polynucleotide
taatacgactcactatagggaaaagtgaagaactggggcacgctctggccaacagaggagaggccagatggtgccccagaacctggcggcagcgcaaaagatg

SEQ ID NO: 110575 - DNA, 103 bp, Artificial Sequence
  Synthetic Polynucleotide
taatacgactcactataggggagcatcctcaaaagtgaagaactggggcaaacagaggagatgccccatgtcttcacttaacctggcggcagcgcaaaagatg

SEQ ID NO: 110576 - DNA, 103 bp, Artificial Sequence
  Synthetic Polynucleotide
taatacgactcactataggggggtaagagggagcatcctcaaaagtgaagaacagaggagacttcacatgtgaggatgcaacctggcggcagcgcaaaagatg

SEQ ID NO: 110577 - DNA, 103 bp, Artificial Sequence
  Synthetic Polynucleotide
taatacgactcactatagggcctggcttccgggtaagagggagcatcctcaacagaggagagaggatatgccctcttacaacctggcggcagcgcaaaagatg

SEQ ID NO: 110578 - DNA, 103 bp, Artificial Sequence
  Synthetic Polynucleotide
taatacgactcactatagggatacgctcgccctggcttccgggtaagaggaacagaggagacctcttatgcggaagccaaacctggcggcagcgcaaaagatg

SEQ ID NO: 110579 - DNA, 103 bp, Artificial Sequence
  Synthetic Polynucleotide
taatacgactcactatagggggcggcgagaatacgctcgccctggcttccaacagaggagaggaagcatgggcgagcgtaacctggcggcagcgcaaaagatg

SEQ ID NO: 110580 - DNA, 103 bp, Artificial Sequence
  Synthetic Polynucleotide
taatacgactcactatagggttgactgctgggcggcgagaatacgctcgcaacagaggagagcgagcatgttctcgccgaacctggcggcagcgcaaaagatg

SEQ ID NO: 110581 - DNA, 103 bp, Artificial Sequence
  Synthetic Polynucleotide
taatacgactcactatagggagccagaatcttgactgctgggcggcgagaaacagaggagatctcgcatgccagcagtcaacctggcggcagcgcaaaagatg

SEQ ID NO: 110582 - DNA, 103 bp, Artificial Sequence
  Synthetic Polynucleotide
taatacgactcactatagggagggaaaccaagccagaatcttgactgctgaacagaggagacagcagatgagattctggaacctggcggcagcgcaaaagatg

SEQ ID NO: 110583 - DNA, 103 bp, Artificial Sequence
  Synthetic Polynucleotide
taatacgactcactatagggggccgcggagccagcctgcgggtcggccataacagaggagaatggccatgccgcaggctaacctggcggcagcgcaaaagatg

SEQ ID NO: 110584 - DNA, 103 bp, Artificial Sequence
  Synthetic Polynucleotide
taatacgactcactatagggcggcgggctgggcccggggggcgtggaccgaacagaggagacggtccatgccccccgggaacctggcggcagcgcaaaagatg

SEQ ID NO: 110585 - DNA, 103 bp, Artificial Sequence
  Synthetic Polynucleotide
taatacgactcactatagggtcttgaggacaagggatactgtctataagtaacagaggagaacttatatgcagtatcccaacctggcggcagcgcaaaagatg

SEQ ID NO: 110586 - DNA, 103 bp, Artificial Sequence
  Synthetic Polynucleotide
taatacgactcactatagggaaactaaaaatcttgaggacaagggatactaacagaggagaagtatcatgtgtcctcaaaacctggcggcagcgcaaaagatg

SEQ ID NO: 110587 - DNA, 103 bp, Artificial Sequence
  Synthetic Polynucleotide
taatacgactcactatagggcacttgggccaaactaaaaatcttgaggacaacagaggagagtcctcatgatttttagtaacctggcggcagcgcaaaagatg

SEQ ID NO: 110588 - DNA, 103 bp, Artificial Sequence
  Synthetic Polynucleotide
taatacgactcactatagggaatggggccacacttgggccaaactaaaaaaacagaggagatttttaatgtggcccaagaacctggcggcagcgcaaaagatg

SEQ ID NO: 110589 - DNA, 103 bp, Artificial Sequence
  Synthetic Polynucleotide
taatacgactcactataggggggtgtcgctaatggggccacacttgggccaacagaggagaggcccaatggtggccccaaacctggcggcagcgcaaaagatg

SEQ ID NO: 110590 - DNA, 103 bp, Artificial Sequence
  Synthetic Polynucleotide
taatacgactcactatagggtggtagaggagggtgtcgctaatggggccaaacagaggagatggcccatgtagcgacacaacctggcggcagcgcaaaagatg

SEQ ID NO: 110591 - DNA, 103 bp, Artificial Sequence
  Synthetic Polynucleotide
taatacgactcactatagggcaggcattgctggtagaggagggtgtcgctaacagaggagaagcgacatgctcctctacaacctggcggcagcgcaaaagatg

SEQ ID NO: 110592 - DNA, 103 bp, Artificial Sequence
  Synthetic Polynucleotide
taatacgactcactatagggtggcatttagcaggcattgctggtagaggaaacagaggagatcctctatgagcaatgccaacctggcggcagcgcaaaagatg

SEQ ID NO: 110593 - DNA, 103 bp, Artificial Sequence
  Synthetic Polynucleotide
taatacgactcactatagggactgaggtggtggcatttagcaggcattgcaacagaggagagcaatgatggctaaatgcaacctggcggcagcgcaaaagatg

SEQ ID NO: 110594 - DNA, 103 bp, Artificial Sequence
  Synthetic Polynucleotide
taatacgactcactatagggcagggcttgaactgaggtggtggcatttagaacagaggagactaaatatgaccacctcaaacctggcggcagcgcaaaagatg

SEQ ID NO: 110595 - DNA, 103 bp, Artificial Sequence
  Synthetic Polynucleotide
taatacgactcactatagggcgtccgccggcggcgggctgggcccgggggaacagaggagacccccgatgccagcccgcaacctggcggcagcgcaaaagatg

SEQ ID NO: 110596 - DNA, 103 bp, Artificial Sequence
  Synthetic Polynucleotide
taatacgactcactatagggccccaggcttcagggcttgaactgaggtggaacagaggagaccacctatgttcaagcccaacctggcggcagcgcaaaagatg

SEQ ID NO: 110597 - DNA, 103 bp, Artificial Sequence
  Synthetic Polynucleotide
taatacgactcactatagggtcccagctggccccaggcttcagggcttgaaacagaggagatcaagcatggaagcctggaacctggcggcagcgcaaaagatg

SEQ ID NO: 110598 - DNA, 103 bp, Artificial Sequence
  Synthetic Polynucleotide
taatacgactcactatagggtcccttcaagtcccagctggccccaggcttaacagaggagaaagcctatggccagctggaacctggcggcagcgcaaaagatg

SEQ ID NO: 110599 - DNA, 103 bp, Artificial Sequence
  Synthetic Polynucleotide
taatacgactcactatagggggactcgtgctcccttcaagtcccagctggaacagaggagaccagctatgacttgaaggaacctggcggcagcgcaaaagatg

SEQ ID NO: 110600 - DNA, 103 bp, Artificial Sequence
  Synthetic Polynucleotide
taatacgactcactatagggagtccatcctggactcgtgctcccttcaagaacagaggagacttgaaatgagcacgagtaacctggcggcagcgcaaaagatg

SEQ ID NO: 110601 - DNA, 103 bp, Artificial Sequence
  Synthetic Polynucleotide
taatacgactcactatagggctctgcactgagtccatcctggactcgtgcaacagaggagagcacgaatgcaggatggaaacctggcggcagcgcaaaagatg

SEQ ID NO: 110602 - DNA, 103 bp, Artificial Sequence
  Synthetic Polynucleotide
taatacgactcactatagggtcatgtcctgctctgcactgagtccatcctaacagaggagaaggatgatgtcagtgcagaacctggcggcagcgcaaaagatg

SEQ ID NO: 110603 - DNA, 103 bp, Artificial Sequence
  Synthetic Polynucleotide
taatacgactcactatagggttcgatggcatcatgtcctgctctgcactgaacagaggagacagtgcatggcaggacataacctggcggcagcgcaaaagatg

SEQ ID NO: 110604 - DNA, 103 bp, Artificial Sequence
  Synthetic Polynucleotide
taatacgactcactatagggaccttccaatttcgatggcatcatgtcctgaacagaggagacaggacatgatgccatcgaacctggcggcagcgcaaaagatg

SEQ ID NO: 110605 - DNA, 103 bp, Artificial Sequence
  Synthetic Polynucleotide
taatacgactcactataggggcaccagggaaccttccaatttcgatggcaaacagaggagatgccatatgaattggaagaacctggcggcagcgcaaaagatg

SEQ ID NO: 110606 - DNA, 103 bp, Artificial Sequence
  Synthetic Polynucleotide
taatacgactcactatagggtcgcagtccccgtccgccggcggcgggctgaacagaggagacagcccatggccggcggaaacctggcggcagcgcaaaagatg

SEQ ID NO: 110607 - DNA, 103 bp, Artificial Sequence
  Synthetic Polynucleotide
taatacgactcactataggggtgtgaggcagcaccagggaaccttccaataacagaggagaattggaatgttccctggtaacctggcggcagcgcaaaagatg

SEQ ID NO: 110608 - DNA, 103 bp, Artificial Sequence
  Synthetic Polynucleotide
taatacgactcactataggggatctcaggagtgtgaggcagcaccagggaaacagaggagatccctgatgctgcctcacaacctggcggcagcgcaaaagatg

SEQ ID NO: 110609 - DNA, 103 bp, Artificial Sequence
  Synthetic Polynucleotide
taatacgactcactatagggtcgtggtctggatctcaggagtgtgaggcaaacagaggagatgcctcatgctcctgagaaacctggcggcagcgcaaaagatg

SEQ ID NO: 110610 - DNA, 103 bp, Artificial Sequence
  Synthetic Polynucleotide
taatacgactcactatagggaggtcacttctcgtggtctggatctcaggaaacagaggagatcctgaatgccagaccacaacctggcggcagcgcaaaagatg

SEQ ID NO: 110611 - DNA, 103 bp, Artificial Sequence
  Synthetic Polynucleotide
taatacgactcactatagggatgaccctgaaggtcacttctcgtggtctgaacagaggagacagaccatgagaagtgacaacctggcggcagcgcaaaagatg

SEQ ID NO: 110612 - DNA, 103 bp, Artificial Sequence
  Synthetic Polynucleotide
taatacgactcactatagggggacagcctgatgaccctgaaggtcacttcaacagaggagagaagtgatgttcagggtcaacctggcggcagcgcaaaagatg

SEQ ID NO: 110613 - DNA, 103 bp, Artificial Sequence
  Synthetic Polynucleotide
taatacgactcactataggggacctctctgggacagcctgatgaccctgaaacagaggagatcagggatgtcaggctgtaacctggcggcagcgcaaaagatg

SEQ ID NO: 110614 - DNA, 103 bp, Artificial Sequence
  Synthetic Polynucleotide
taatacgactcactatagggggagaacgcggacctctctgggacagcctgaacagaggagacaggctatgccagagaggaacctggcggcagcgcaaaagatg

SEQ ID NO: 110615 - DNA, 103 bp, Artificial Sequence
  Synthetic Polynucleotide
taatacgactcactataggggtcggggtggggagaacgcggacctctctgaacagaggagacagagaatgccgcgttctaacctggcggcagcgcaaaagatg

SEQ ID NO: 110616 - DNA, 103 bp, Artificial Sequence
  Synthetic Polynucleotide
taatacgactcactataggggagaaattccgtcggggtggggagaacgcgaacagaggagacgcgttatgcccaccccgaacctggcggcagcgcaaaagatg

SEQ ID NO: 110617 - DNA, 103 bp, Artificial Sequence
  Synthetic Polynucleotide
taatacgactcactatagggttcgtcgtcctcgcagtccccgtccgccggaacagaggagaccggcgatgggggactgcaacctggcggcagcgcaaaagatg

SEQ ID NO: 110618 - DNA, 103 bp, Artificial Sequence
  Synthetic Polynucleotide
taatacgactcactatagggaacaatgggagagaaattccgtcggggtggaacagaggagaccacccatgcggaatttcaacctggcggcagcgcaaaagatg

SEQ ID NO: 110619 - DNA, 103 bp, Artificial Sequence
  Synthetic Polynucleotide
taatacgactcactatagggagtccgtgtcaacaatgggagagaaattccaacagaggagaggaattatgctcccattgaacctggcggcagcgcaaaagatg

SEQ ID NO: 110620 - DNA, 103 bp, Artificial Sequence
  Synthetic Polynucleotide
taatacgactcactataggggctgccagggagtccgtgtcaacaatgggaaacagaggagatcccatatgtgacacggaaacctggcggcagcgcaaaagatg

SEQ ID NO: 110621 - DNA, 103 bp, Artificial Sequence
  Synthetic Polynucleotide
taatacgactcactatagggatgcccttgagctgccagggagtccgtgtcaacagaggagagacacgatgtccctggcaaacctggcggcagcgcaaaagatg

SEQ ID NO: 110622 - DNA, 103 bp, Artificial Sequence
  Synthetic Polynucleotide
taatacgactcactatagggtcgttaagacatgcccttgagctgccagggaacagaggagaccctggatgctcaagggcaacctggcggcagcgcaaaagatg

SEQ ID NO: 110623 - DNA, 103 bp, Artificial Sequence
  Synthetic Polynucleotide
taatacgactcactatagggttgctgatcttcgttaagacatgcccttgaaacagaggagatcaaggatgtgtcttaacaacctggcggcagcgcaaaagatg

SEQ ID NO: 110624 - DNA, 103 bp, Artificial Sequence
  Synthetic Polynucleotide
taatacgactcactatagggggtgttttctttgctgatcttcgttaagacaacagaggagagtcttaatgaagatcagcaacctggcggcagcgcaaaagatg

SEQ ID NO: 110625 - DNA, 103 bp, Artificial Sequence
  Synthetic Polynucleotide
taatacgactcactataggggagggtgcctggtgttttctttgctgatctaacagaggagaagatcaatgaagaaaacaaacctggcggcagcgcaaaagatg

SEQ ID NO: 110626 - DNA, 103 bp, Artificial Sequence
  Synthetic Polynucleotide
taatacgactcactatagggctaagtggcagagggtgcctggtgttttctaacagaggagaagaaaaatgcaggcacccaacctggcggcagcgcaaaagatg

SEQ ID NO: 110627 - DNA, 103 bp, Artificial Sequence
  Synthetic Polynucleotide
taatacgactcactatagggtggattatgtctaagtggcagagggtgcctaacagaggagaaggcacatgctgccacttaacctggcggcagcgcaaaagatg

SEQ ID NO: 110628 - DNA, 103 bp, Artificial Sequence
  Synthetic Polynucleotide
taatacgactcactatagggcgtcgtcatcttcgtcgtcctcgcagtcccaacagaggagagggactatgaggacgacgaacctggcggcagcgcaaaagatg

SEQ ID NO: 110629 - DNA, 103 bp, Artificial Sequence
  Synthetic Polynucleotide
taatacgactcactatagggatgagtggaatggattatgtctaagtggcaaacagaggagatgccacatggacataatcaacctggcggcagcgcaaaagatg

SEQ ID NO: 110630 - DNA, 103 bp, Artificial Sequence
  Synthetic Polynucleotide
taatacgactcactatagggtgctggaataatgagtggaatggattatgtaacagaggagaacataaatgattccactcaacctggcggcagcgcaaaagatg

SEQ ID NO: 110631 - DNA, 103 bp, Artificial Sequence
  Synthetic Polynucleotide
taatacgactcactatagggagtaagtgtttgctggaataatgagtggaaaacagaggagattccacatgttattccagaacctggcggcagcgcaaaagatg

SEQ ID NO: 110632 - DNA, 103 bp, Artificial Sequence
  Synthetic Polynucleotide
taatacgactcactatagggccgatttgtcagtaagtgtttgctggaataaacagaggagatattccatgaaacacttaaacctggcggcagcgcaaaagatg

SEQ ID NO: 110633 - DNA, 103 bp, Artificial Sequence
  Synthetic Polynucleotide
taatacgactcactatagggaactcaggacccgatttgtcagtaagtgttaacagaggagaaacactatgtgacaaatcaacctggcggcagcgcaaaagatg

SEQ ID NO: 110634 - DNA, 103 bp, Artificial Sequence
  Synthetic Polynucleotide
taatacgactcactatagggtggtgttttcaactcaggacccgatttgtcaacagaggagagacaaaatgggtcctgagaacctggcggcagcgcaaaagatg

SEQ ID NO: 110635 - DNA, 103 bp, Artificial Sequence
  Synthetic Polynucleotide
taatacgactcactatagggctttgacaaatggtgttttcaactcaggacaacagaggagagtcctgatgtgaaaacacaacctggcggcagcgcaaaagatg

SEQ ID NO: 110636 - DNA, 103 bp, Artificial Sequence
  Synthetic Polynucleotide
taatacgactcactatagggtcaaaggcctctttgacaaatggtgttttcaacagaggagagaaaacatgatttgtcaaaacctggcggcagcgcaaaagatg

SEQ ID NO: 110637 - DNA, 103 bp, Artificial Sequence
  Synthetic Polynucleotide
taatacgactcactatagggaggggtctcttcaaaggcctctttgacaaaaacagaggagatttgtcatggaggcctttaacctggcggcagcgcaaaagatg

SEQ ID NO: 110638 - DNA, 103 bp, Artificial Sequence
  Synthetic Polynucleotide
taatacgactcactatagggtgtgtttcttaggggtctcttcaaaggcctaacagaggagaaggcctatgaagagacccaacctggcggcagcgcaaaagatg

SEQ ID NO: 110639 - DNA, 103 bp, Artificial Sequence
  Synthetic Polynucleotide
taatacgactcactatagggtcgtccaccccgtcgtcatcttcgtcgtccaacagaggagaggacgaatgagatgacgaaacctggcggcagcgcaaaagatg

SEQ ID NO: 110640 - DNA, 103 bp, Artificial Sequence
  Synthetic Polynucleotide
taatacgactcactatagggaaacactctctgtgtttcttaggggtctctaacagaggagaagagacatgtaagaaacaaacctggcggcagcgcaaaagatg

SEQ ID NO: 110641 - DNA, 103 bp, Artificial Sequence
  Synthetic Polynucleotide
taatacgactcactataggggtccttaactaaacactctctgtgtttcttaacagaggagaaagaaaatgagagagtgtaacctggcggcagcgcaaaagatg

SEQ ID NO: 110642 - DNA, 103 bp, Artificial Sequence
  Synthetic Polynucleotide
taatacgactcactatagggacttctggttgtccttaactaaacactctcaacagaggagagagagtatgtagttaaggaacctggcggcagcgcaaaagatg

SEQ ID NO: 110643 - DNA, 103 bp, Artificial Sequence
  Synthetic Polynucleotide
taatacgactcactataggggtaaatgtgtacttctggttgtccttaactaacagaggagaagttaaatgcaaccagaaaacctggcggcagcgcaaaagatg

SEQ ID NO: 110644 - DNA, 103 bp, Artificial Sequence
  Synthetic Polynucleotide
taatacgactcactatagggtctatctattgtaaatgtgtacttctggttaacagaggagaaaccagatgtacacatttaacctggcggcagcgcaaaagatg

SEQ ID NO: 110645 - DNA, 103 bp, Artificial Sequence
  Synthetic Polynucleotide
taatacgactcactatagggcttttgcacatctatctattgtaaatgtgtaacagaggagaacacatatgcaatagataaacctggcggcagcgcaaaagatg

SEQ ID NO: 110646 - DNA, 103 bp, Artificial Sequence
  Synthetic Polynucleotide
taatacgactcactatagggacaaaaaggtcttttgcacatctatctattaacagaggagaaatagaatgatgtgcaaaaacctggcggcagcgcaaaagatg

SEQ ID NO: 110647 - DNA, 103 bp, Artificial Sequence
  Synthetic Polynucleotide
taatacgactcactatagggttgtttggctacaaaaaggtcttttgcacaaacagaggagatgtgcaatggacctttttaacctggcggcagcgcaaaagatg

SEQ ID NO: 110648 - DNA, 103 bp, Artificial Sequence
  Synthetic Polynucleotide
taatacgactcactatagggttgttccaacttgtttggctacaaaaaggtaacagaggagaacctttatgtagccaaacaacctggcggcagcgcaaaagatg

SEQ ID NO: 110649 - DNA, 103 bp, Artificial Sequence
  Synthetic Polynucleotide
taatacgactcactatagggaccgagagttttgttccaacttgtttggctaacagaggagaagccaaatgagttggaacaacctggcggcagcgcaaaagatg

SEQ ID NO: 110650 - DNA, 103 bp, Artificial Sequence
  Synthetic Polynucleotide
taatacgactcactatagggttccgcgtcttcgtccaccccgtcgtcatcaacagaggagagatgacatgggggtggacaacctggcggcagcgcaaaagatg

SEQ ID NO: 110651 - DNA, 103 bp, Artificial Sequence
  Synthetic Polynucleotide
taatacgactcactatagggtggttcattcaccgagagttttgttccaacaacagaggagagttggaatgaaactctcgaacctggcggcagcgcaaaagatg

SEQ ID NO: 110652 - DNA, 103 bp, Artificial Sequence
  Synthetic Polynucleotide
taatacgactcactatagggaaaatgacagtggttcattcaccgagagttaacagaggagaaactctatgtgaatgaacaacctggcggcagcgcaaaagatg

SEQ ID NO: 110653 - DNA, 103 bp, Artificial Sequence
  Synthetic Polynucleotide
taatacgactcactataggggactcaacagaaaatgacagtggttcattcaacagaggagagaatgaatgactgtcattaacctggcggcagcgcaaaagatg

SEQ ID NO: 110654 - DNA, 103 bp, Artificial Sequence
  Synthetic Polynucleotide
taatacgactcactatagggcttaagaatagactcaacagaaaatgacagaacagaggagactgtcaatgtctgttgagaacctggcggcagcgcaaaagatg

SEQ ID NO: 110655 - DNA, 103 bp, Artificial Sequence
  Synthetic Polynucleotide
taatacgactcactatagggatgaaggcctcttaagaatagactcaacagaacagaggagactgttgatgctattcttaaacctggcggcagcgcaaaagatg

SEQ ID NO: 110656 - DNA, 103 bp, Artificial Sequence
  Synthetic Polynucleotide
taatacgactcactataggggtgatggcagatgaaggcctcttaagaataaacagaggagatattctatggaggccttcaacctggcggcagcgcaaaagatg

SEQ ID NO: 110657 - DNA, 103 bp, Artificial Sequence
  Synthetic Polynucleotide
taatacgactcactatagggagagacacgagtgatggcagatgaaggcctaacagaggagaaggcctatgtctgccatcaacctggcggcagcgcaaaagatg

SEQ ID NO: 110658 - DNA, 103 bp, Artificial Sequence
  Synthetic Polynucleotide
taatacgactcactatagggcgccctcttcttccgcgtcttcgtccacccaacagaggagagggtggatgaagacgcggaacctggcggcagcgcaaaagatg

SEQ ID NO: 110659 - DNA, 103 bp, Artificial Sequence
  Synthetic Polynucleotide
taatacgactcactatagggtcctcgccgtcgccctcttcttccgcgtctaacagaggagaagacgcatgagaagagggaacctggcggcagcgcaaaagatg

SEQ ID NO: 110660 - DNA, 103 bp, Artificial Sequence
  Synthetic Polynucleotide
taatacgactcactatagggcgcgcctgcctcctcgccgtcgccctcttcaacagaggagagaagagatggacggcgagaacctggcggcagcgcaaaagatg

SEQ ID NO: 110661 - DNA, 103 bp, Artificial Sequence
  Synthetic Polynucleotide
taatacgactcactatagggcccagtccccggccgcggagccagcctgcgaacagaggagacgcaggatggctccgcggaacctggcggcagcgcaaaagatg

SEQ ID NO: 110662 - DNA, 103 bp, Artificial Sequence
  Synthetic Polynucleotide
taatacgactcactatagggtcccgggggacgcgcctgcctcctcgccgtaacagaggagaacggcgatgaggcaggcgaacctggcggcagcgcaaaagatg

SEQ ID NO: 110663 - DNA, 103 bp, Artificial Sequence
  Synthetic Polynucleotide
taatacgactcactatagggtggccgggcatcccgggggacgcgcctgccaacagaggagaggcaggatggtcccccggaacctggcggcagcgcaaaagatg

SEQ ID NO: 110664 - DNA, 103 bp, Artificial Sequence
  Synthetic Polynucleotide
taatacgactcactatagggctgctccggctggccgggcatcccgggggaaacagaggagatcccccatgatgcccggcaacctggcggcagcgcaaaagatg

SEQ ID NO: 110665 - DNA, 103 bp, Artificial Sequence
  Synthetic Polynucleotide
taatacgactcactataggggtcccccccgctgctccggctggccgggcaaacagaggagatgcccgatgagccggagcaacctggcggcagcgcaaaagatg

SEQ ID NO: 110666 - DNA, 103 bp, Artificial Sequence
  Synthetic Polynucleotide
taatacgactcactatagggctcggctgcggtcccccccgctgctccggcaacagaggagagccggaatggcgggggggaacctggcggcagcgcaaaagatg

SEQ ID NO: 110667 - DNA, 103 bp, Artificial Sequence
  Synthetic Polynucleotide
taatacgactcactataggggagcggcggcctcggctgcggtcccccccgaacagaggagacgggggatgccgcagccgaacctggcggcagcgcaaaagatg

SEQ ID NO: 110668 - DNA, 103 bp, Artificial Sequence
  Synthetic Polynucleotide
taatacgactcactatagggcctgaggcgcgagcggcggcctcggctgcgaacagaggagacgcagcatgggccgccgcaacctggcggcagcgcaaaagatg

SEQ ID NO: 110669 - DNA, 103 bp, Artificial Sequence
  Synthetic Polynucleotide
taatacgactcactataggggcgggtgaggcctgaggcgcgagcggcggcaacagaggagagccgccatgcgcgcctcaaacctggcggcagcgcaaaagatg

SEQ ID NO: 110670 - DNA, 103 bp, Artificial Sequence
  Synthetic Polynucleotide
taatacgactcactatagggaccggtgccggcgggtgaggcctgaggcgcaacagaggagagcgcctatggcctcacccaacctggcggcagcgcaaaagatg

SEQ ID NO: 110671 - DNA, 103 bp, Artificial Sequence
  Synthetic Polynucleotide
taatacgactcactataggggctctcggggaccggtgccggcgggtgaggaacagaggagacctcacatgccggcaccgaacctggcggcagcgcaaaagatg

SEQ ID NO: 110672 - DNA, 103 bp, Artificial Sequence
  Synthetic Polynucleotide
taatacgactcactatagggacatcgatctcccagtccccggccgcggagaacagaggagactccgcatgcggggactgaacctggcggcagcgcaaaagatg

SEQ ID NO: 110673 - DNA, 103 bp, Artificial Sequence
  Synthetic Polynucleotide
taatacgactcactatagggggagtgcagcgctctcggggaccggtgccgaacagaggagacggcacatgtccccgagaaacctggcggcagcgcaaaagatg

SEQ ID NO: 110674 - DNA, 103 bp, Artificial Sequence
  Synthetic Polynucleotide
taatacgactcactataggggccgcccgcgggagtgcagcgctctcggggaacagaggagaccccgaatgcgctgcactaacctggcggcagcgcaaaagatg

SEQ ID NO: 110675 - DNA, 103 bp, Artificial Sequence
  Synthetic Polynucleotide
taatacgactcactataggggctccgcgccgccgcccgcgggagtgcagcaacagaggagagctgcaatgccgcgggcgaacctggcggcagcgcaaaagatg

SEQ ID NO: 110676 - DNA, 103 bp, Artificial Sequence
  Synthetic Polynucleotide
taatacgactcactatagggagcttgcgcggctccgcgccgccgcccgcgaacagaggagacgcgggatgcggcgcggaaacctggcggcagcgcaaaagatg

SEQ ID NO: 110677 - DNA, 103 bp, Artificial Sequence
  Synthetic Polynucleotide
taatacgactcactatagggcgtgcggctcagcttgcgcggctccgcgccaacagaggagaggcgcgatgccgcgcaagaacctggcggcagcgcaaaagatg

SEQ ID NO: 110678 - DNA, 103 bp, Artificial Sequence
  Synthetic Polynucleotide
taatacgactcactatagggcgcacttgggcgtgcggctcagcttgcgcgaacagaggagacgcgcaatgtgagccgcaaacctggcggcagcgcaaaagatg

SEQ ID NO: 110679 - DNA, 103 bp, Artificial Sequence
  Synthetic Polynucleotide
taatacgactcactatagggcggcagcgcgcgcacttgggcgtgcggctcaacagaggagagagccgatggcccaagtgaacctggcggcagcgcaaaagatg

SEQ ID NO: 110680 - DNA, 103 bp, Artificial Sequence
  Synthetic Polynucleotide
taatacgactcactataggggccgtggttgcggcagcgcgcgcacttgggaacagaggagacccaagatggcgcgctgcaacctggcggcagcgcaaaagatg

SEQ ID NO: 110681 - DNA, 103 bp, Artificial Sequence
  Synthetic Polynucleotide
taatacgactcactatagggaggacaccacgccgtggttgcggcagcgcgaacagaggagacgcgctatggcaaccacgaacctggcggcagcgcaaaagatg

SEQ ID NO: 110682 - DNA, 103 bp, Artificial Sequence
  Synthetic Polynucleotide
taatacgactcactatagggcccttcaggcaggacaccacgccgtggttgaacagaggagacaaccaatgcgtggtgtcaacctggcggcagcgcaaaagatg

SEQ ID NO: 110683 - DNA, 103 bp, Artificial Sequence
  Synthetic Polynucleotide
taatacgactcactatagggcaggctctcgacatcgatctcccagtccccaacagaggagaggggacatggagatcgataacctggcggcagcgcaaaagatg

SEQ ID NO: 110684 - DNA, 103 bp, Artificial Sequence
  Synthetic Polynucleotide
taatacgactcactataggggcgcttgtggcccttcaggcaggacaccacaacagaggagagtggtgatgtgcctgaagaacctggcggcagcgcaaaagatg

SEQ ID NO: 110685 - DNA, 103 bp, Artificial Sequence
  Synthetic Polynucleotide
taatacgactcactatagggagcgacagaagcgcttgtggcccttcaggcaacagaggagagcctgaatggccacaagcaacctggcggcagcgcaaaagatg

SEQ ID NO: 110686 - DNA, 103 bp, Artificial Sequence
  Synthetic Polynucleotide
taatacgactcactatagggcagtcgcgccagcgacagaagcgcttgtggaacagaggagaccacaaatgcttctgtcgaacctggcggcagcgcaaaagatg

SEQ ID NO: 110687 - DNA, 103 bp, Artificial Sequence
  Synthetic Polynucleotide
taatacgactcactatagggggcgcactggcagtcgcgccagcgacagaaaacagaggagattctgtatgtggcgcgacaacctggcggcagcgcaaaagatg

SEQ ID NO: 110688 - DNA, 103 bp, Artificial Sequence
  Synthetic Polynucleotide
taatacgactcactataggggcaggcagttggcgcactggcagtcgcgccaacagaggagaggcgcgatggccagtgcgaacctggcggcagcgcaaaagatg

SEQ ID NO: 110689 - DNA, 103 bp, Artificial Sequence
  Synthetic Polynucleotide
taatacgactcactatagggtccaccaccagcaggcagttggcgcactggaacagaggagaccagtgatgcaactgcctaacctggcggcagcgcaaaagatg

SEQ ID NO: 110690 - DNA, 103 bp, Artificial Sequence
  Synthetic Polynucleotide
taatacgactcactataggggcgctgccgctccaccaccagcaggcagttaacagaggagaaactgcatgctggtggtgaacctggcggcagcgcaaaagatg

SEQ ID NO: 110691 - DNA, 103 bp, Artificial Sequence
  Synthetic Polynucleotide
taatacgactcactatagggcggccatgacgcgctgccgctccaccaccaaacagaggagatggtggatgagcggcagcaacctggcggcagcgcaaaagatg

SEQ ID NO: 110692 - DNA, 103 bp, Artificial Sequence
  Synthetic Polynucleotide
taatacgactcactataggggccacctgggcggccatgacgcgctgccgcaacagaggagagcggcaatgcgtcatggcaacctggcggcagcgcaaaagatg

SEQ ID NO: 110693 - DNA, 103 bp, Artificial Sequence
  Synthetic Polynucleotide
taatacgactcactatagggcctccggagcgccacctgggcggccatgacaacagaggagagtcatgatggcccaggtgaacctggcggcagcgcaaaagatg

SEQ ID NO: 110694 - DNA, 103 bp, Artificial Sequence
  Synthetic Polynucleotide
taatacgactcactatagggcttccagctccaggctctcgacatcgatctaacagaggagaagatcgatgtcgagagccaacctggcggcagcgcaaaagatg

SEQ ID NO: 110695 - DNA, 103 bp, Artificial Sequence
  Synthetic Polynucleotide
taatacgactcactatagggtggcctgctgcctccggagcgccacctgggaacagaggagacccaggatgcgctccggaaacctggcggcagcgcaaaagatg

SEQ ID NO: 110696 - DNA, 103 bp, Artificial Sequence
  Synthetic Polynucleotide
taatacgactcactatagggttgtcctcggtggcctgctgcctccggagcaacagaggagagctccgatggcagcaggcaacctggcggcagcgcaaaagatg

SEQ ID NO: 110697 - DNA, 103 bp, Artificial Sequence
  Synthetic Polynucleotide
taatacgactcactatagggaagccccttcttgtcctcggtggcctgctgaacagaggagacagcagatgaccgaggacaacctggcggcagcgcaaaagatg

SEQ ID NO: 110698 - DNA, 103 bp, Artificial Sequence
  Synthetic Polynucleotide
taatacgactcactataggggtttcccggaaagccccttcttgtcctcggaacagaggagaccgaggatgagaaggggcaacctggcggcagcgcaaaagatg

SEQ ID NO: 110699 - DNA, 103 bp, Artificial Sequence
  Synthetic Polynucleotide
taatacgactcactatagggaaattattctgtttcccggaaagccccttcaacagaggagagaagggatgttccgggaaaacctggcggcagcgcaaaagatg

SEQ ID NO: 110700 - DNA, 103 bp, Artificial Sequence
  Synthetic Polynucleotide
taatacgactcactatagggtttgcgctcgaaattattctgtttcccggaaacagaggagatccgggatgcagaataataacctggcggcagcgcaaaagatg

SEQ ID NO: 110701 - DNA, 103 bp, Artificial Sequence
  Synthetic Polynucleotide
taatacgactcactatagggggtacacagctttgcgctcgaaattattctaacagaggagaagaataatgtcgagcgcaaacctggcggcagcgcaaaagatg

SEQ ID NO: 110702 - DNA, 103 bp, Artificial Sequence
  Synthetic Polynucleotide
taatacgactcactatagggacttgcctctggtacacagctttgcgctcgaacagaggagacgagcgatgagctgtgtaaacctggcggcagcgcaaaagatg

SEQ ID NO: 110703 - DNA, 103 bp, Artificial Sequence
  Synthetic Polynucleotide
taatacgactcactataggggggggctctgacttgcctctggtacacagcaacagaggagagctgtgatgcagaggcaaaacctggcggcagcgcaaaagatg

SEQ ID NO: 110704 - DNA, 103 bp, Artificial Sequence
  Synthetic Polynucleotide
taatacgactcactatagggccagcaaactgggggctctgacttgcctctaacagaggagaagaggcatgtcagagcccaacctggcggcagcgcaaaagatg

SEQ ID NO: 110705 - DNA, 103 bp, Artificial Sequence
  Synthetic Polynucleotide
taatacgactcactatagggcagacgtcctcttccagctccaggctctcgaacagaggagacgagagatgggagctggaaacctggcggcagcgcaaaagatg

SEQ ID NO: 110706 - DNA, 103 bp, Artificial Sequence
  Synthetic Polynucleotide
taatacgactcactatagggatgcttttggccagcaaactgggggctctgaacagaggagacagagcatgcagtttgctaacctggcggcagcgcaaaagatg

SEQ ID NO: 110707 - DNA, 103 bp, Artificial Sequence
  Synthetic Polynucleotide
taatacgactcactataggggccttctaaaatgcttttggccagcaaactaacagaggagaagtttgatggccaaaagcaacctggcggcagcgcaaaagatg

SEQ ID NO: 110708 - DNA, 103 bp, Artificial Sequence
  Synthetic Polynucleotide
taatacgactcactatagggtggggcgatagccttctaaaatgcttttggaacagaggagaccaaaaatgttttagaagaacctggcggcagcgcaaaagatg

SEQ ID NO: 110709 - DNA, 103 bp, Artificial Sequence
  Synthetic Polynucleotide
taatacgactcactatagggtccgctggaatggggcgatagccttctaaaaacagaggagatttagaatgctatcgcccaacctggcggcagcgcaaaagatg

SEQ ID NO: 110710 - DNA, 103 bp, Artificial Sequence
  Synthetic Polynucleotide
taatacgactcactatagggtacataagtctccgctggaatggggcgataaacagaggagatatcgcatgattccagcgaacctggcggcagcgcaaaagatg

SEQ ID NO: 110711 - DNA, 103 bp, Artificial Sequence
  Synthetic Polynucleotide
taatacgactcactatagggaggtccctcctacataagtctccgctggaaaacagaggagattccagatgagacttatgaacctggcggcagcgcaaaagatg

SEQ ID NO: 110712 - DNA, 103 bp, Artificial Sequence
  Synthetic Polynucleotide
taatacgactcactatagggggtagagggaaggtccctcctacataagtcaacagaggagagacttaatgaggagggacaacctggcggcagcgcaaaagatg

SEQ ID NO: 110713 - DNA, 103 bp, Artificial Sequence
  Synthetic Polynucleotide
taatacgactcactatagggaactgggggaggtagagggaaggtccctccaacagaggagaggagggatgttccctctaaacctggcggcagcgcaaaagatg

SEQ ID NO: 110714 - DNA, 103 bp, Artificial Sequence
  Synthetic Polynucleotide
taatacgactcactatagggtcctgtcactaactgggggaggtagagggaaacagaggagatccctcatgctcccccagaacctggcggcagcgcaaaagatg

SEQ ID NO: 110715 - DNA, 103 bp, Artificial Sequence
  Synthetic Polynucleotide
taatacgactcactatagggcttttcctcatcctgtcactaactgggggaaacagaggagatcccccatgtagtgacagaacctggcggcagcgcaaaagatg

SEQ ID NO: 110716 - DNA, 103 bp, Artificial Sequence
  Synthetic Polynucleotide
taatacgactcactatagggcggcgccccgcagacgtcctcttccagctcaacagaggagagagctgatggaggacgtcaacctggcggcagcgcaaaagatg

SEQ ID NO: 110717 - DNA, 103 bp, Artificial Sequence
  Synthetic Polynucleotide
taatacgactcactatagggaaaggctcttcttttcctcatcctgtcactaacagaggagaagtgacatgatgaggaaaaacctggcggcagcgcaaaagatg

SEQ ID NO: 110718 - DNA, 103 bp, Artificial Sequence
  Synthetic Polynucleotide
taatacgactcactatagggctttatcagcaaaggctcttcttttcctcaaacagaggagatgaggaatggaagagcctaacctggcggcagcgcaaaagatg

SEQ ID NO: 110719 - DNA, 103 bp, Artificial Sequence
  Synthetic Polynucleotide
taatacgactcactatagggttctccaactctttatcagcaaaggctcttaacagaggagaaagagcatgtgctgataaaacctggcggcagcgcaaaagatg

SEQ ID NO: 110720 - DNA, 103 bp, Artificial Sequence
  Synthetic Polynucleotide
taatacgactcactatagggcagcataatgttctccaactctttatcagcaacagaggagagctgatatggagttggagaacctggcggcagcgcaaaagatg

SEQ ID NO: 110721 - DNA, 103 bp, Artificial Sequence
  Synthetic Polynucleotide
taatacgactcactatagggattctctctccagcataatgttctccaactaacagaggagaagttggatgacattatgcaacctggcggcagcgcaaaagatg

SEQ ID NO: 110722 - DNA, 103 bp, Artificial Sequence
  Synthetic Polynucleotide
taatacgactcactatagggctttctttatattctctctccagcataatgaacagaggagacattatatgggagagagaaacctggcggcagcgcaaaagatg

SEQ ID NO: 110723 - DNA, 103 bp, Artificial Sequence
  Synthetic Polynucleotide
taatacgactcactatagggcaacatctccctttctttatattctctctcaacagaggagagagagaatgtataaagaaaacctggcggcagcgcaaaagatg

SEQ ID NO: 110724 - DNA, 103 bp, Artificial Sequence
  Synthetic Polynucleotide
taatacgactcactataggggagaagtttccaacatctccctttctttataacagaggagaataaagatggggagatgtaacctggcggcagcgcaaaagatg

SEQ ID NO: 110725 - DNA, 103 bp, Artificial Sequence
  Synthetic Polynucleotide
taatacgactcactataggggcagcagcttgagaagtttccaacatctccaacagaggagaggagatatgggaaacttcaacctggcggcagcgcaaaagatg

SEQ ID NO: 110726 - DNA, 103 bp, Artificial Sequence
  Synthetic Polynucleotide
taatacgactcactatagggcagaaacagagcagcagcttgagaagtttcaacagaggagagaaactatgcaagctgctaacctggcggcagcgcaaaagatg

SEQ ID NO: 110727 - DNA, 103 bp, Artificial Sequence
  Synthetic Polynucleotide
taatacgactcactataggggcgtggaccgcggcgccccgcagacgtcctaacagaggagaaggacgatggcggggcgcaacctggcggcagcgcaaaagatg

SEQ ID NO: 110728 - DNA, 103 bp, Artificial Sequence
  Synthetic Polynucleotide
taatacgactcactatagggtgcggttgggcagaaacagagcagcagcttaacagaggagaaagctgatgctctgtttcaacctggcggcagcgcaaaagatg

SEQ ID NO: 110729 - DNA, 103 bp, Artificial Sequence
  Synthetic Polynucleotide
taatacgactcactatagggccaggcaccatgcggttgggcagaaacagaaacagaggagatctgttatggcccaaccgaacctggcggcagcgcaaaagatg

SEQ ID NO: 110730 - DNA, 103 bp, Artificial Sequence
  Synthetic Polynucleotide
taatacgactcactataggggtagtcaggtccaggcaccatgcggttgggaacagaggagacccaacatgatggtgcctaacctggcggcagcgcaaaagatg

SEQ ID NO: 110731 - DNA, 103 bp, Artificial Sequence
  Synthetic Polynucleotide
taatacgactcactatagggtgtaggaattgtagtcaggtccaggcaccaaacagaggagatggtgcatggacctgactaacctggcggcagcgcaaaagatg

SEQ ID NO: 110732 - DNA, 103 bp, Artificial Sequence
  Synthetic Polynucleotide
taatacgactcactatagggtaggcacttttgtaggaattgtagtcaggtaacagaggagaacctgaatgcaattcctaaacctggcggcagcgcaaaagatg

SEQ ID NO: 110733 - DNA, 103 bp, Artificial Sequence
  Synthetic Polynucleotide
taatacgactcactataggggctggggctgtaggcacttttgtaggaattaacagaggagaaattccatgaaaagtgccaacctggcggcagcgcaaaagatg

SEQ ID NO: 110734 - DNA, 103 bp, Artificial Sequence
  Synthetic Polynucleotide
taatacgactcactataggggttccactgggctggggctgtaggcactttaacagaggagaaaagtgatgacagccccaaacctggcggcagcgcaaaagatg

SEQ ID NO: 110735 - DNA, 103 bp, Artificial Sequence
  Synthetic Polynucleotide
taatacgactcactatagggttgcttggtggttccactgggctggggctgaacagaggagacagcccatgcccagtggaaacctggcggcagcgcaaaagatg

SEQ ID NO: 110736 - DNA, 103 bp, Artificial Sequence
  Synthetic Polynucleotide
taatacgactcactatagggacagaagtccttgcttggtggttccactggaacagaggagaccagtgatgccaccaagcaacctggcggcagcgcaaaagatg

SEQ ID NO: 110737 - DNA, 103 bp, Artificial Sequence
  Synthetic Polynucleotide
taatacgactcactataggggcaaaaaattacagaagtccttgcttggtgaacagaggagacaccaaatgaggacttctaacctggcggcagcgcaaaagatg

SEQ ID NO: 110738 - DNA, 103 bp, Artificial Sequence
  Synthetic Polynucleotide
taatacgactcactatagggggcccggggggcgtggaccgcggcgccccgaacagaggagacggggcatggcggtccacaacctggcggcagcgcaaaagatg

SEQ ID NO: 110739 - DNA, 103 bp, Artificial Sequence
  Synthetic Polynucleotide
taatacgactcactatagggaggcaggtgggcaaaaaattacagaagtccaacagaggagaggacttatgtaattttttaacctggcggcagcgcaaaagatg

SEQ ID NO: 110740 - DNA, 103 bp, Artificial Sequence
  Synthetic Polynucleotide
taatacgactcactatagggggttaaatcaaggcaggtgggcaaaaaattaacagaggagaaattttatgcccacctgcaacctggcggcagcgcaaaagatg

SEQ ID NO: 110741 - DNA, 103 bp, Artificial Sequence
  Synthetic Polynucleotide
taatacgactcactatagggaatactgcatggttaaatcaaggcaggtggaacagaggagaccacctatgttgatttaaaacctggcggcagcgcaaaagatg

SEQ ID NO: 110742 - DNA, 103 bp, Artificial Sequence
  Synthetic Polynucleotide
taatacgactcactatagggccagaccctgaatactgcatggttaaatcaaacagaggagatgatttatgcatgcagtaaacctggcggcagcgcaaaagatg

SEQ ID NO: 110743 - DNA, 103 bp, Artificial Sequence
  Synthetic Polynucleotide
taatacgactcactatagggttccatattcccagaccctgaatactgcataacagaggagaatgcagatgtcagggtctaacctggcggcagcgcaaaagatg

SEQ ID NO: 110744 - DNA, 103 bp, Artificial Sequence
  Synthetic Polynucleotide
taatacgactcactatagggaagaaattagttccatattcccagaccctgaacagaggagacagggtatgggaatatggaacctggcggcagcgcaaaagatg

SEQ ID NO: 110745 - DNA, 103 bp, Artificial Sequence
  Synthetic Polynucleotide
taatacgactcactatagggctgacattagaagaaattagttccatattcaacagaggagagaatatatgactaatttcaacctggcggcagcgcaaaagatg

SEQ ID NO: 110746 - DNA, 103 bp, Artificial Sequence
  Synthetic Polynucleotide
taatacgactcactatagggtgtggccacgctgacattagaagaaattagaacagaggagactaattatgtctaatgtcaacctggcggcagcgcaaaagatg

SEQ ID NO: 110747 - DNA, 103 bp, Artificial Sequence
  Synthetic Polynucleotide
taatacgactcactataggggtctataagttgtggccacgctgacattagaacagaggagactaatgatggcgtggccaaacctggcggcagcgcaaaagatg

SEQ ID NO: 110748 - DNA, 103 bp, Artificial Sequence
  Synthetic Polynucleotide
taatacgactcactatagggaagggatactgtctataagttgtggccacgaacagaggagacgtggcatgaacttatagaacctggcggcagcgcaaaagatg

SEQ ID NO: 110749 - DNA, 103 bp, Artificial Sequence
  Synthetic Polynucleotide
taatacgactcactatagggcccggggccgctggagggcatggcgggcataacagaggagaatgcccatgatgccctccaacctggcggcagcgcaaaagatg

SEQ ID NO: 110750 - DNA, 103 bp, Artificial Sequence
  Synthetic Polynucleotide
taatacgactcactatagggctcttggcgctcctccttgccacgcggctcaacagaggagagagccgatgggcaaggagaacctggcggcagcgcaaaagatg

SEQ ID NO: 110751 - DNA, 103 bp, Artificial Sequence
  Synthetic Polynucleotide
taatacgactcactatagggacacaccactgagaatttgccgtctccgaaaacagaggagattcggaatgggcaaattcaacctggcggcagcgcaaaagatg

SEQ ID NO: 110752 - DNA, 103 bp, Artificial Sequence
  Synthetic Polynucleotide
taatacgactcactataggggcttctcaacacacaccactgagaatttgcaacagaggagagcaaatatgcagtggtgtaacctggcggcagcgcaaaagatg

SEQ ID NO: 110753 - DNA, 103 bp, Artificial Sequence
  Synthetic Polynucleotide
taatacgactcactatagggagcggcatcagcttctcaacacacaccactaacagaggagaagtggtatgtgttgagaaaacctggcggcagcgcaaaagatg

SEQ ID NO: 110754 - DNA, 103 bp, Artificial Sequence
  Synthetic Polynucleotide
taatacgactcactatagggaaacgagctcagcggcatcagcttctcaacaacagaggagagttgagatgctgatgccgaacctggcggcagcgcaaaagatg

SEQ ID NO: 110755 - DNA, 103 bp, Artificial Sequence
  Synthetic Polynucleotide
taatacgactcactatagggacgcactgcaaaacgagctcagcggcatcaaacagaggagatgatgcatgtgagctcgtaacctggcggcagcgcaaaagatg

SEQ ID NO: 110756 - DNA, 103 bp, Artificial Sequence
  Synthetic Polynucleotide
taatacgactcactataggggcctggtggaacgcactgcaaaacgagctcaacagaggagagagctcatgttgcagtgcaacctggcggcagcgcaaaagatg

SEQ ID NO: 110757 - DNA, 103 bp, Artificial Sequence
  Synthetic Polynucleotide
taatacgactcactataggggttgtacgtggcctggtggaacgcactgcaaacagaggagatgcagtatgttccaccagaacctggcggcagcgcaaaagatg

SEQ ID NO: 110758 - DNA, 103 bp, Artificial Sequence
  Synthetic Polynucleotide
taatacgactcactatagggtgggctgcttgttgtacgtggcctggtggaaacagaggagatccaccatgccacgtacaaacctggcggcagcgcaaaagatg

SEQ ID NO: 110759 - DNA, 103 bp, Artificial Sequence
  Synthetic Polynucleotide
taatacgactcactatagggttgcggtacatgggctgcttgttgtacgtgaacagaggagacacgtaatgcaagcagccaacctggcggcagcgcaaaagatg

SEQ ID NO: 110760 - DNA, 103 bp, Artificial Sequence
  Synthetic Polynucleotide
taatacgactcactataggggtagatggctttgcggtacatgggctgcttaacagaggagaaagcagatgatgtaccgcaacctggcggcagcgcaaaagatg

SEQ ID NO: 110761 - DNA, 103 bp, Artificial Sequence
  Synthetic Polynucleotide
taatacgactcactatagggtggtgctgggctcttggcgctcctccttgcaacagaggagagcaaggatgagcgccaagaacctggcggcagcgcaaaagatg

SEQ ID NO: 110762 - DNA, 103 bp, Artificial Sequence
  Synthetic Polynucleotide
taatacgactcactataggggcaggacctcgtagatggctttgcggtacaaacagaggagatgtaccatgaagccatctaacctggcggcagcgcaaaagatg

SEQ ID NO: 110763 - DNA, 103 bp, Artificial Sequence
  Synthetic Polynucleotide
taatacgactcactatagggctggccacctgcaggacctcgtagatggctaacagaggagaagccatatgcgaggtcctaacctggcggcagcgcaaaagatg

SEQ ID NO: 110764 - DNA, 103 bp, Artificial Sequence
  Synthetic Polynucleotide
taatacgactcactatagggcgcgcggctgctggccacctgcaggacctcaacagaggagagaggtcatgcaggtggccaacctggcggcagcgcaaaagatg

SEQ ID NO: 110765 - DNA, 103 bp, Artificial Sequence
  Synthetic Polynucleotide
taatacgactcactatagggacagcttccccgcgcggctgctggccacctaacagaggagaaggtggatggcagccgcgaacctggcggcagcgcaaaagatg

SEQ ID NO: 110766 - DNA, 103 bp, Artificial Sequence
  Synthetic Polynucleotide
taatacgactcactatagggcacaccgggaacagcttccccgcgcggctgaacagaggagacagccgatgggggaagctaacctggcggcagcgcaaaagatg

SEQ ID NO: 110767 - DNA, 103 bp, Artificial Sequence
  Synthetic Polynucleotide
taatacgactcactataggggctgtcgtggcacaccgggaacagcttcccaacagaggagagggaagatgttcccggtgaacctggcggcagcgcaaaagatg

SEQ ID NO: 110768 - DNA, 103 bp, Artificial Sequence
  Synthetic Polynucleotide
taatacgactcactatagggcactctcatcgctgtcgtggcacaccgggaaacagaggagatcccggatggccacgacaaacctggcggcagcgcaaaagatg

SEQ ID NO: 110769 - DNA, 103 bp, Artificial Sequence
  Synthetic Polynucleotide
taatacgactcactatagggttggcagtgtcactctcatcgctgtcgtggaacagaggagaccacgaatgcgatgagagaacctggcggcagcgcaaaagatg

SEQ ID NO: 110770 - DNA, 103 bp, Artificial Sequence
  Synthetic Polynucleotide
taatacgactcactatagggctccacggccttggcagtgtcactctcatcaacagaggagagatgagatggacactgccaacctggcggcagcgcaaaagatg

SEQ ID NO: 110771 - DNA, 103 bp, Artificial Sequence
  Synthetic Polynucleotide
taatacgactcactatagggtgttctgcacctccacggccttggcagtgtaacagaggagaacactgatgaggccgtggaacctggcggcagcgcaaaagatg

SEQ ID NO: 110772 - DNA, 103 bp, Artificial Sequence
  Synthetic Polynucleotide
taatacgactcactatagggttccgtgccgtggtgctgggctcttggcgcaacagaggagagcgccaatggcccagcacaacctggcggcagcgcaaaagatg

SEQ ID NO: 110773 - DNA, 103 bp, Artificial Sequence
  Synthetic Polynucleotide
taatacgactcactatagggatcatgggcttgttctgcacctccacggccaacagaggagaggccgtatgggtgcagaaaacctggcggcagcgcaaaagatg

SEQ ID NO: 110774 - DNA, 103 bp, Artificial Sequence
  Synthetic Polynucleotide
taatacgactcactatagggggcccattcaatcatgggcttgttctgcacaacagaggagagtgcagatgaagcccatgaacctggcggcagcgcaaaagatg

SEQ ID NO: 110775 - DNA, 103 bp, Artificial Sequence
  Synthetic Polynucleotide
taatacgactcactatagggagccccccagggcccattcaatcatgggctaacagaggagaagcccaatgttgaatgggaacctggcggcagcgcaaaagatg

SEQ ID NO: 110776 - DNA, 103 bp, Artificial Sequence
  Synthetic Polynucleotide
taatacgactcactataggggaaggctggaagccccccagggcccattcaaacagaggagatgaatgatgcctggggggaacctggcggcagcgcaaaagatg

SEQ ID NO: 110777 - DNA, 103 bp, Artificial Sequence
  Synthetic Polynucleotide
taatacgactcactatagggcttagggccagaaggctggaagccccccagaacagaggagactggggatgttccagcctaacctggcggcagcgcaaaagatg

SEQ ID NO: 110778 - DNA, 103 bp, Artificial Sequence
  Synthetic Polynucleotide
taatacgactcactataggggctccaggcccttagggccagaaggctggaaacagaggagatccagcatgctggccctaaacctggcggcagcgcaaaagatg

SEQ ID NO: 110779 - DNA, 103 bp, Artificial Sequence
  Synthetic Polynucleotide
taatacgactcactatagggtcttctggtggctccaggcccttagggccaaacagaggagatggcccatggggcctggaaacctggcggcagcgcaaaagatg

SEQ ID NO: 110780 - DNA, 103 bp, Artificial Sequence
  Synthetic Polynucleotide
taatacgactcactatagggattcttctcttcttctggtggctccaggccaacagaggagaggcctgatgccaccagaaaacctggcggcagcgcaaaagatg

SEQ ID NO: 110781 - DNA, 103 bp, Artificial Sequence
  Synthetic Polynucleotide
taatacgactcactatagggctttgtagggattcttctcttcttctggtgaacagaggagacaccagatgaagagaagaaacctggcggcagcgcaaaagatg

SEQ ID NO: 110782 - DNA, 103 bp, Artificial Sequence
  Synthetic Polynucleotide
taatacgactcactataggggtgtacacttctttgtagggattcttctctaacagaggagaagagaaatgtccctacaaaacctggcggcagcgcaaaagatg

SEQ ID NO: 110783 - DNA, 103 bp, Artificial Sequence
  Synthetic Polynucleotide
taatacgactcactatagggccgccccaccttccgtgccgtggtgctgggaacagaggagacccagcatgacggcacggaacctggcggcagcgcaaaagatg

SEQ ID NO: 110784 - DNA, 103 bp, Artificial Sequence
  Synthetic Polynucleotide
taatacgactcactatagggccacatgtccgtgtacacttctttgtagggaacagaggagaccctacatggaagtgtacaacctggcggcagcgcaaaagatg

SEQ ID NO: 110785 - DNA, 103 bp, Artificial Sequence
  Synthetic Polynucleotide
taatacgactcactatagggcaggttccacccacatgtccgtgtacacttaacagaggagaaagtgtatgcggacatgtaacctggcggcagcgcaaaagatg

SEQ ID NO: 110786 - DNA, 103 bp, Artificial Sequence
  Synthetic Polynucleotide
taatacgactcactataggggcagctgcctcaggttccacccacatgtccaacagaggagaggacatatgggtggaaccaacctggcggcagcgcaaaagatg

SEQ ID NO: 110787 - DNA, 103 bp, Artificial Sequence
  Synthetic Polynucleotide
taatacgactcactatagggtggtgcgtaggcagctgcctcaggttccacaacagaggagagtggaaatggaggcagctaacctggcggcagcgcaaaagatg

SEQ ID NO: 110788 - DNA, 103 bp, Artificial Sequence
  Synthetic Polynucleotide
taatacgactcactatagggctggtggaggtggtgcgtaggcagctgcctaacagaggagaaggcagatgcctacgcacaacctggcggcagcgcaaaagatg

SEQ ID NO: 110789 - DNA, 103 bp, Artificial Sequence
  Synthetic Polynucleotide
taatacgactcactatagggggctttttggctggtggaggtggtgcgtagaacagaggagactacgcatgacctccaccaacctggcggcagcgcaaaagatg

SEQ ID NO: 110790 - DNA, 103 bp, Artificial Sequence
  Synthetic Polynucleotide
taatacgactcactataggggctcttccggggctttttggctggtggaggaacagaggagacctccaatggccaaaaagaacctggcggcagcgcaaaagatg

SEQ ID NO: 110791 - DNA, 103 bp, Artificial Sequence
  Synthetic Polynucleotide
taatacgactcactatagggtctccgctgtgctcttccggggctttttggaacagaggagaccaaaaatgcccggaagaaacctggcggcagcgcaaaagatg

SEQ ID NO: 110792 - DNA, 103 bp, Artificial Sequence
  Synthetic Polynucleotide
taatacgactcactatagggaccttgggcttctccgctgtgctcttccggaacagaggagaccggaaatgcacagcggaaacctggcggcagcgcaaaagatg

SEQ ID NO: 110793 - DNA, 103 bp, Artificial Sequence
  Synthetic Polynucleotide
taatacgactcactatagggaatctccttgaccttgggcttctccgctgtaacagaggagaacagcgatgaagcccaagaacctggcggcagcgcaaaagatg

SEQ ID NO: 110794 - DNA, 103 bp, Artificial Sequence
  Synthetic Polynucleotide
taatacgactcactatagggtcctcccaggccgccccaccttccgtgccgaacagaggagacggcacatgaggtggggcaacctggcggcagcgcaaaagatg

SEQ ID NO: 110795 - DNA, 103 bp, Artificial Sequence
  Synthetic Polynucleotide
taatacgactcactataggggctcatcaataatctccttgaccttgggctaacagaggagaagcccaatgtcaaggagaaacctggcggcagcgcaaaagatg

SEQ ID NO: 110796 - DNA, 103 bp, Artificial Sequence
  Synthetic Polynucleotide
taatacgactcactatagggtctcttgtgcgctcatcaataatctccttgaacagaggagacaaggaatgtattgatgaaacctggcggcagcgcaaaagatg

SEQ ID NO: 110797 - DNA, 103 bp, Artificial Sequence
  Synthetic Polynucleotide
taatacgactcactatagggcaccagccgctctcttgtgcgctcatcaataacagaggagaattgatatgcgcacaagaaacctggcggcagcgcaaaagatg

SEQ ID NO: 110798 - DNA, 103 bp, Artificial Sequence
  Synthetic Polynucleotide
taatacgactcactataggggcacctcgtacaccagccgctctcttgtgcaacagaggagagcacaaatgagcggctggaacctggcggcagcgcaaaagatg

SEQ ID NO: 110799 - DNA, 103 bp, Artificial Sequence
  Synthetic Polynucleotide
taatacgactcactatagggcacttctgccgcacctcgtacaccagccgcaacagaggagagcggctatggtacgaggtaacctggcggcagcgcaaaagatg

SEQ ID NO: 110800 - DNA, 103 bp, Artificial Sequence
  Synthetic Polynucleotide
taatacgactcactatagggaatgttccggcacttctgccgcacctcgtaaacagaggagatacgagatgcggcagaagaacctggcggcagcgcaaaagatg

SEQ ID NO: 110801 - DNA, 103 bp, Artificial Sequence
  Synthetic Polynucleotide
taatacgactcactatagggagatgtcctcaatgttccggcacttctgccaacagaggagaggcagaatggccggaacaaacctggcggcagcgcaaaagatg

SEQ ID NO: 110802 - DNA, 103 bp, Artificial Sequence
  Synthetic Polynucleotide
taatacgactcactatagggcaggagatgcagatgtcctcaatgttccggaacagaggagaccggaaatgtgaggacataacctggcggcagcgcaaaagatg

SEQ ID NO: 110803 - DNA, 103 bp, Artificial Sequence
  Synthetic Polynucleotide
taatacgactcactataggggaggctcccacaggagatgcagatgtcctcaacagaggagagaggacatgtgcatctccaacctggcggcagcgcaaaagatg

SEQ ID NO: 110804 - DNA, 103 bp, Artificial Sequence
  Synthetic Polynucleotide
taatacgactcactataggggggtaacattgaggctcccacaggagatgcaacagaggagagcatctatggtgggagccaacctggcggcagcgcaaaagatg

SEQ ID NO: 110805 - DNA, 103 bp, Artificial Sequence
  Synthetic Polynucleotide
taatacgactcactatagggtgcttgcgcttcctcccaggccgccccaccaacagaggagaggtgggatggcctgggagaacctggcggcagcgcaaaagatg

SEQ ID NO: 110806 - DNA, 103 bp, Artificial Sequence
  Synthetic Polynucleotide
taatacgactcactataggggggtgttccagggtaacattgaggctcccaaacagaggagatgggagatgcaatgttacaacctggcggcagcgcaaaagatg

SEQ ID NO: 110807 - DNA, 103 bp, Artificial Sequence
  Synthetic Polynucleotide
taatacgactcactatagggaacgaagagggggtgttccagggtaacattaacagaggagaaatgttatgctggaacacaacctggcggcagcgcaaaagatg

SEQ ID NO: 110808 - DNA, 103 bp, Artificial Sequence
  Synthetic Polynucleotide
taatacgactcactatagggacattcctccaacgaagagggggtgttccaaacagaggagatggaacatgccctcttcgaacctggcggcagcgcaaaagatg

SEQ ID NO: 110809 - DNA, 103 bp, Artificial Sequence
  Synthetic Polynucleotide
taatacgactcactatagggcagttttggcacattcctccaacgaagaggaacagaggagacctcttatgtggaggaataacctggcggcagcgcaaaagatg

SEQ ID NO: 110810 - DNA, 103 bp, Artificial Sequence
  Synthetic Polynucleotide
taatacgactcactataggggcagttcttgcagttttggcacattcctccaacagaggagaggaggaatgtgccaaaacaacctggcggcagcgcaaaagatg

SEQ ID NO: 110811 - DNA, 103 bp, Artificial Sequence
  Synthetic Polynucleotide
taatacgactcactatagggactccagaaagcagttcttgcagttttggcaacagaggagagccaaaatggcaagaactaacctggcggcagcgcaaaagatg

SEQ ID NO: 110812 - DNA, 103 bp, Artificial Sequence
  Synthetic Polynucleotide
taatacgactcactatagggtggtacgcacactccagaaagcagttcttgaacagaggagacaagaaatgctttctggaaacctggcggcagcgcaaaagatg

SEQ ID NO: 110813 - DNA, 103 bp, Artificial Sequence
  Synthetic Polynucleotide
taatacgactcactataggggtcgtcgtactggtacgcacactccagaaaaacagaggagatttctgatgtgtgcgtacaacctggcggcagcgcaaaagatg

SEQ ID NO: 110814 - DNA, 103 bp, Artificial Sequence
  Synthetic Polynucleotide
taatacgactcactatagggggtagccgtcgtcgtcgtactggtacgcacaacagaggagagtgcgtatgagtacgacgaacctggcggcagcgcaaaagatg

SEQ ID NO: 110815 - DNA, 103 bp, Artificial Sequence
  Synthetic Polynucleotide
taatacgactcactatagggcagtaggactggtagccgtcgtcgtcgtacaacagaggagagtacgaatgcgacggctaaacctggcggcagcgcaaaagatg

SEQ ID NO: 110816 - DNA, 103 bp, Artificial Sequence
  Synthetic Polynucleotide
taatacgactcactatagggcaccggggggtgcttgcgcttcctcccaggaacagaggagacctgggatgaagcgcaagaacctggcggcagcgcaaaagatg

SEQ ID NO: 110817 - DNA, 103 bp, Artificial Sequence
  Synthetic Polynucleotide
taatacgactcactataggggcagatggtgcagtaggactggtagccgtcaacagaggagagacggcatgcagtcctacaacctggcggcagcgcaaaagatg

SEQ ID NO: 110818 - DNA, 103 bp, Artificial Sequence
  Synthetic Polynucleotide
taatacgactcactatagggggcccccacagcagatggtgcagtaggactaacagaggagaagtcctatggcaccatctaacctggcggcagcgcaaaagatg

SEQ ID NO: 110819 - DNA, 103 bp, Artificial Sequence
  Synthetic Polynucleotide
taatacgactcactatagggagcacctcacggcccccacagcagatggtgaacagaggagacaccatatgctgtgggggaacctggcggcagcgcaaaagatg

SEQ ID NO: 110820 - DNA, 103 bp, Artificial Sequence
  Synthetic Polynucleotide
taatacgactcactatagggtccgcacatgagcacctcacggcccccacaaacagaggagatgtgggatgcgtgaggtgaacctggcggcagcgcaaaagatg

SEQ ID NO: 110821 - DNA, 103 bp, Artificial Sequence
  Synthetic Polynucleotide
taatacgactcactatagggagttgttgtttccgcacatgagcacctcacaacagaggagagtgaggatgtcatgtgcgaacctggcggcagcgcaaaagatg

SEQ ID NO: 110822 - DNA, 103 bp, Artificial Sequence
  Synthetic Polynucleotide
taatacgactcactatagggcacctgcagcagttgttgtttccgcacatgaacagaggagacatgtgatgaaacaacaaaacctggcggcagcgcaaaagatg

SEQ ID NO: 110823 - DNA, 103 bp, Artificial Sequence
  Synthetic Polynucleotide
taatacgactcactatagggcacgcaaaagcacctgcagcagttgttgttaacagaggagaaacaacatgtgctgcaggaacctggcggcagcgcaaaagatg

SEQ ID NO: 110824 - DNA, 103 bp, Artificial Sequence
  Synthetic Polynucleotide
taatacgactcactatagggccacacactccacgcaaaagcacctgcagcaacagaggagagctgcaatggcttttgcgaacctggcggcagcgcaaaagatg

SEQ ID NO: 110825 - DNA, 103 bp, Artificial Sequence
  Synthetic Polynucleotide
taatacgactcactatagggaccaagaggtccacacactccacgcaaaagaacagaggagacttttgatgggagtgtgtaacctggcggcagcgcaaaagatg

SEQ ID NO: 110826 - DNA, 103 bp, Artificial Sequence
  Synthetic Polynucleotide
taatacgactcactatagggccccggccccaccaagaggtccacacactcaacagaggagagagtgtatggacctcttgaacctggcggcagcgcaaaagatg

SEQ ID NO: 110827 - DNA, 103 bp, Artificial Sequence
  Synthetic Polynucleotide
taatacgactcactatagggcaccgctttccaccggggggtgcttgcgctaacagaggagaagcgcaatgaccccccggaacctggcggcagcgcaaaagatg

SEQ ID NO: 110828 - DNA, 103 bp, Artificial Sequence
  Synthetic Polynucleotide
taatacgactcactatagggcctgggcagcccccggccccaccaagaggtaacagaggagaacctctatgtggggccggaacctggcggcagcgcaaaagatg

SEQ ID NO: 110829 - DNA, 103 bp, Artificial Sequence
  Synthetic Polynucleotide
taatacgactcactatagggttaatggctgcctgggcagcccccggccccaacagaggagaggggccatgggctgcccaaacctggcggcagcgcaaaagatg

SEQ ID NO: 110830 - DNA, 103 bp, Artificial Sequence
  Synthetic Polynucleotide
taatacgactcactatagggggggtcttccttaatggctgcctgggcagcaacagaggagagctgccatggcagccattaacctggcggcagcgcaaaagatg

SEQ ID NO: 110831 - DNA, 103 bp, Artificial Sequence
  Synthetic Polynucleotide
taatacgactcactatagggagcagttccaggggtcttccttaatggctgaacagaggagacagccaatgaggaagaccaacctggcggcagcgcaaaagatg

SEQ ID NO: 110832 - DNA, 103 bp, Artificial Sequence
  Synthetic Polynucleotide
taatacgactcactatagggccgcacatgtagcagttccaggggtcttccaacagaggagaggaagaatgctggaactgaacctggcggcagcgcaaaagatg

SEQ ID NO: 110833 - DNA, 103 bp, Artificial Sequence
  Synthetic Polynucleotide
taatacgactcactatagggacccttgtgcccgcacatgtagcagttccaaacagaggagatggaacatgtacatgtgcaacctggcggcagcgcaaaagatg

SEQ ID NO: 110834 - DNA, 103 bp, Artificial Sequence
  Synthetic Polynucleotide
taatacgactcactataggggcccgtaggtacccttgtgcccgcacatgtaacagaggagaacatgtatgggcacaaggaacctggcggcagcgcaaaagatg

SEQ ID NO: 110835 - DNA, 103 bp, Artificial Sequence
  Synthetic Polynucleotide
taatacgactcactatagggcgccgcagcagcccgtaggtacccttgtgcaacagaggagagcacaaatgtacctacggaacctggcggcagcgcaaaagatg

SEQ ID NO: 110836 - DNA, 103 bp, Artificial Sequence
  Synthetic Polynucleotide
taatacgactcactataggggtcctctcgccgccgcagcagcccgtaggtaacagaggagaacctacatgctgctgcggaacctggcggcagcgcaaaagatg

SEQ ID NO: 110837 - DNA, 103 bp, Artificial Sequence
  Synthetic Polynucleotide
taatacgactcactataggggggagggccagtcctctcgccgccgcagcaaacagaggagatgctgcatgggcgagaggaacctggcggcagcgcaaaagatg

SEQ ID NO: 110838 - DNA, 103 bp, Artificial Sequence
  Synthetic Polynucleotide
taatacgactcactatagggtttggcgtgtcaccgctttccaccggggggaacagaggagaccccccatgggaaagcggaacctggcggcagcgcaaaagatg

SEQ ID NO: 110839 - DNA, 103 bp, Artificial Sequence
  Synthetic Polynucleotide
taatacgactcactatagggatctggagccgggagggccagtcctctcgcaacagaggagagcgagaatgctggccctcaacctggcggcagcgcaaaagatg

SEQ ID NO: 110840 - DNA, 103 bp, Artificial Sequence
  Synthetic Polynucleotide
taatacgactcactatagggagcgaagaacatctggagccgggagggccaaacagaggagatggcccatgcggctccagaacctggcggcagcgcaaaagatg

SEQ ID NO: 110841 - DNA, 103 bp, Artificial Sequence
  Synthetic Polynucleotide
taatacgactcactatagggcgtggttattagcgaagaacatctggagccaacagaggagaggctccatgtgttcttcgaacctggcggcagcgcaaaagatg

SEQ ID NO: 110842 - DNA, 103 bp, Artificial Sequence
  Synthetic Polynucleotide
taatacgactcactatagggaattcctggtcgtggttattagcgaagaacaacagaggagagttcttatgtaataaccaaacctggcggcagcgcaaaagatg

SEQ ID NO: 110843 - DNA, 103 bp, Artificial Sequence
  Synthetic Polynucleotide
taatacgactcactatagggtggagggtcaaattcctggtcgtggttattaacagaggagaaataacatggaccaggaaaacctggcggcagcgcaaaagatg

SEQ ID NO: 110844 - DNA, 103 bp, Artificial Sequence
  Synthetic Polynucleotide
taatacgactcactatagggggtaaacctttggagggtcaaattcctggtaacagaggagaaccaggatgttgaccctcaacctggcggcagcgcaaaagatg

SEQ ID NO: 110845 - DNA, 103 bp, Artificial Sequence
  Synthetic Polynucleotide
taatacgactcactataggggggacaggtgggtaaacctttggagggtcaaacagaggagatgacccatgaaaggtttaaacctggcggcagcgcaaaagatg

SEQ ID NO: 110846 - DNA, 103 bp, Artificial Sequence
  Synthetic Polynucleotide
taatacgactcactatagggcttctcagctgggacaggtgggtaaaccttaacagaggagaaaggttatgccacctgtcaacctggcggcagcgcaaaagatg

SEQ ID NO: 110847 - DNA, 103 bp, Artificial Sequence
  Synthetic Polynucleotide
taatacgactcactatagggtgggcttcctcttctcagctgggacaggtgaacagaggagacacctgatgcagctgagaaacctggcggcagcgcaaaagatg

SEQ ID NO: 110848 - DNA, 103 bp, Artificial Sequence
  Synthetic Polynucleotide
taatacgactcactatagggagcacccggatgggcttcctcttctcagctaacagaggagaagctgaatggaggaagccaacctggcggcagcgcaaaagatg

SEQ ID NO: 110849 - DNA, 103 bp, Artificial Sequence
  Synthetic Polynucleotide
taatacgactcactatagggcgcagggtcctttggcgtgtcaccgctttcaacagaggagagaaagcatggacacgccaaacctggcggcagcgcaaaagatg

SEQ ID NO: 110850 - DNA, 103 bp, Artificial Sequence
  Synthetic Polynucleotide
taatacgactcactatagggaaagagagacagcacccggatgggcttcctaacagaggagaaggaagatgatccgggtgaacctggcggcagcgcaaaagatg

SEQ ID NO: 110851 - DNA, 103 bp, Artificial Sequence
  Synthetic Polynucleotide
taatacgactcactatagggcgattccatcaaagagagacagcacccggaaacagaggagatccgggatgtgtctctctaacctggcggcagcgcaaaagatg

SEQ ID NO: 110852 - DNA, 103 bp, Artificial Sequence
  Synthetic Polynucleotide
taatacgactcactatagggagccctgtagcgattccatcaaagagagacaacagaggagagtctctatgtgatggaataacctggcggcagcgcaaaagatg

SEQ ID NO: 110853 - DNA, 103 bp, Artificial Sequence
  Synthetic Polynucleotide
taatacgactcactatagggcagcaccaggagccctgtagcgattccatcaacagaggagagatggaatggctacagggaacctggcggcagcgcaaaagatg

SEQ ID NO: 110854 - DNA, 103 bp, Artificial Sequence
  Synthetic Polynucleotide
taatacgactcactatagggccaagtccttcagcaccaggagccctgtagaacagaggagactacagatgtcctggtgcaacctggcggcagcgcaaaagatg

SEQ ID NO: 110855 - DNA, 103 bp, Artificial Sequence
  Synthetic Polynucleotide
taatacgactcactatagggacctgaatgcccaagtccttcagcaccaggaacagaggagacctggtatggaaggacttaacctggcggcagcgcaaaagatg

SEQ ID NO: 110856 - DNA, 103 bp, Artificial Sequence
  Synthetic Polynucleotide
taatacgactcactataggggtagcggtccacctgaatgcccaagtccttaacagaggagaaaggacatgggcattcagaacctggcggcagcgcaaaagatg

SEQ ID NO: 110857 - DNA, 103 bp, Artificial Sequence
  Synthetic Polynucleotide
taatacgactcactatagggccgaggcaatgtagcggtccacctgaatgcaacagaggagagcattcatgtggaccgctaacctggcggcagcgcaaaagatg

SEQ ID NO: 110858 - DNA, 103 bp, Artificial Sequence
  Synthetic Polynucleotide
taatacgactcactatagggtcacacacctccgaggcaatgtagcggtccaacagaggagaggaccgatgcattgcctcaacctggcggcagcgcaaaagatg

SEQ ID NO: 110859 - DNA, 103 bp, Artificial Sequence
  Synthetic Polynucleotide
taatacgactcactataggggatggagtcctcacacacctccgaggcaataacagaggagaattgccatggaggtgtgtaacctggcggcagcgcaaaagatg

SEQ ID NO: 110860 - DNA, 103 bp, Artificial Sequence
  Synthetic Polynucleotide
taatacgactcactatagggtgctggtgtccccggggccgctggagggcaaacagaggagatgccctatggcggccccgaacctggcggcagcgcaaaagatg

SEQ ID NO: 110861 - DNA, 103 bp, Artificial Sequence
  Synthetic Polynucleotide
taatacgactcactatagggtggagatcaccgcagggtcctttggcgtgtaacagaggagaacacgcatgaggaccctgaacctggcggcagcgcaaaagatg

SEQ ID NO: 110862 - DNA, 103 bp, Artificial Sequence
  Synthetic Polynucleotide
taatacgactcactatagggtgcccaccgtgatggagtcctcacacacctaacagaggagaaggtgtatgaggactccaaacctggcggcagcgcaaaagatg

SEQ ID NO: 110863 - DNA, 103 bp, Artificial Sequence
  Synthetic Polynucleotide
taatacgactcactatagggtgccgcaccatgcccaccgtgatggagtccaacagaggagaggactcatgcacggtgggaacctggcggcagcgcaaaagatg

SEQ ID NO: 110864 - DNA, 103 bp, Artificial Sequence
  Synthetic Polynucleotide
taatacgactcactatagggcttcccctggtgccgcaccatgcccaccgtaacagaggagaacggtgatgatggtgcggaacctggcggcagcgcaaaagatg

SEQ ID NO: 110865 - DNA, 103 bp, Artificial Sequence
  Synthetic Polynucleotide
taatacgactcactatagggcgtacatgatcttcccctggtgccgcaccaaacagaggagatggtgcatgaccaggggaaacctggcggcagcgcaaaagatg

SEQ ID NO: 110866 - DNA, 103 bp, Artificial Sequence
  Synthetic Polynucleotide
taatacgactcactatagggacgtccccgacgtacatgatcttcccctggaacagaggagaccagggatggatcatgtaaacctggcggcagcgcaaaagatg

SEQ ID NO: 110867 - DNA, 103 bp, Artificial Sequence
  Synthetic Polynucleotide
taatacgactcactataggggacgctgcggacgtccccgacgtacatgataacagaggagaatcatgatggtcggggacaacctggcggcagcgcaaaagatg

SEQ ID NO: 110868 - DNA, 103 bp, Artificial Sequence
  Synthetic Polynucleotide
taatacgactcactataggggcttctgtgtgacgctgcggacgtccccgaaacagaggagatcggggatgtccgcagcgaacctggcggcagcgcaaaagatg

SEQ ID NO: 110869 - DNA, 103 bp, Artificial Sequence
  Synthetic Polynucleotide
taatacgactcactatagggtcctggatatgcttctgtgtgacgctgcggaacagaggagaccgcagatgcacacagaaaacctggcggcagcgcaaaagatg

SEQ ID NO: 110870 - DNA, 103 bp, Artificial Sequence
  Synthetic Polynucleotide
taatacgactcactatagggtgggccccactcctggatatgcttctgtgtaacagaggagaacacagatgcatatccagaacctggcggcagcgcaaaagatg

SEQ ID NO: 110871 - DNA, 103 bp, Artificial Sequence
  Synthetic Polynucleotide
taatacgactcactatagggccagatcgaatgggccccactcctggatataacagaggagaatatccatgagtggggccaacctggcggcagcgcaaaagatg

SEQ ID NO: 110872 - DNA, 103 bp, Artificial Sequence
  Synthetic Polynucleotide
taatacgactcactataggggatggggacttggagatcaccgcagggtccaacagaggagaggacccatgggtgatctcaacctggcggcagcgcaaaagatg

SEQ ID NO: 110873 - DNA, 103 bp, Artificial Sequence
  Synthetic Polynucleotide
taatacgactcactatagggcccccaatcaccagatcgaatgggccccacaacagaggagagtggggatgattcgatctaacctggcggcagcgcaaaagatg

SEQ ID NO: 110874 - DNA, 103 bp, Artificial Sequence
  Synthetic Polynucleotide
taatacgactcactataggggcagggactgcccccaatcaccagatcgaaaacagaggagattcgatatggtgattgggaacctggcggcagcgcaaaagatg

SEQ ID NO: 110875 - DNA, 103 bp, Artificial Sequence
  Synthetic Polynucleotide
taatacgactcactatagggagaggtcattgcagggactgcccccaatcaaacagaggagatgattgatggcagtccctaacctggcggcagcgcaaaagatg

SEQ ID NO: 110876 - DNA, 103 bp, Artificial Sequence
  Synthetic Polynucleotide
taatacgactcactatagggttgacgatggagaggtcattgcagggactgaacagaggagacagtccatgcaatgacctaacctggcggcagcgcaaaagatg

SEQ ID NO: 110877 - DNA, 103 bp, Artificial Sequence
  Synthetic Polynucleotide
taatacgactcactataggggcgagcagggttgacgatggagaggtcattaacagaggagaaatgacatgtccatcgtcaacctggcggcagcgcaaaagatg

SEQ ID NO: 110878 - DNA, 103 bp, Artificial Sequence
  Synthetic Polynucleotide
taatacgactcactatagggagaggcccttgcgagcagggttgacgatggaacagaggagaccatcgatgaccctgctcaacctggcggcagcgcaaaagatg

SEQ ID NO: 110879 - DNA, 103 bp, Artificial Sequence
  Synthetic Polynucleotide
taatacgactcactataggggtgccctcgtagaggcccttgcgagcagggaacagaggagaccctgcatgcaagggcctaacctggcggcagcgcaaaagatg

SEQ ID NO: 110880 - DNA, 103 bp, Artificial Sequence
  Synthetic Polynucleotide
taatacgactcactataggggagccggccagtgccctcgtagaggcccttaacagaggagaaagggcatgtacgagggcaacctggcggcagcgcaaaagatg

SEQ ID NO: 110881 - DNA, 103 bp, Artificial Sequence
  Synthetic Polynucleotide
taatacgactcactatagggactcaaagaagagccggccagtgccctcgtaacagaggagaacgaggatgctggccggcaacctggcggcagcgcaaaagatg

SEQ ID NO: 110882 - DNA, 103 bp, Artificial Sequence
  Synthetic Polynucleotide
taatacgactcactatagggaggcggtagaactcaaagaagagccggccaaacagaggagatggccgatgcttctttgaaacctggcggcagcgcaaaagatg

SEQ ID NO: 110883 - DNA, 103 bp, Artificial Sequence
  Synthetic Polynucleotide
taatacgactcactatagggctgggccatggatggggacttggagatcacaacagaggagagtgatcatgaagtccccaaacctggcggcagcgcaaaagatg

SEQ ID NO: 110884 - DNA, 103 bp, Artificial Sequence
  Synthetic Polynucleotide
taatacgactcactatagggatcatgcaggaggcggtagaactcaaagaaaacagaggagattctttatgttctaccgcaacctggcggcagcgcaaaagatg

SEQ ID NO: 110885 - DNA, 103 bp, Artificial Sequence
  Synthetic Polynucleotide
taatacgactcactatagggtgggccgcgcatcatgcaggaggcggtagaaacagaggagatctaccatgtcctgcatgaacctggcggcagcgcaaaagatg

SEQ ID NO: 110886 - DNA, 103 bp, Artificial Sequence
  Synthetic Polynucleotide
taatacgactcactatagggtctccctccttgggccgcgcatcatgcaggaacagaggagacctgcaatgtgcgcggccaacctggcggcagcgcaaaagatg

SEQ ID NO: 110887 - DNA, 103 bp, Artificial Sequence
  Synthetic Polynucleotide
taatacgactcactatagggggggcgatcatctccctccttgggccgcgcaacagaggagagcgcggatgaaggagggaaacctggcggcagcgcaaaagatg

SEQ ID NO: 110888 - DNA, 103 bp, Artificial Sequence
  Synthetic Polynucleotide
taatacgactcactataggggccagaagaaggggcgatcatctccctcctaacagaggagaaggaggatgatgatcgccaacctggcggcagcgcaaaagatg

SEQ ID NO: 110889 - DNA, 103 bp, Artificial Sequence
  Synthetic Polynucleotide
taatacgactcactatagggttctcaaagagccagaagaaggggcgatcaaacagaggagatgatcgatgcttcttctgaacctggcggcagcgcaaaagatg

SEQ ID NO: 110890 - DNA, 103 bp, Artificial Sequence
  Synthetic Polynucleotide
taatacgactcactatagggggccaccacattctcaaagagccagaagaaaacagaggagattcttcatgctctttgagaacctggcggcagcgcaaaagatg

SEQ ID NO: 110891 - DNA, 103 bp, Artificial Sequence
  Synthetic Polynucleotide
taatacgactcactatagggtaacgcccatggccaccacattctcaaagaaacagaggagatctttgatgatgtggtggaacctggcggcagcgcaaaagatg

SEQ ID NO: 110892 - DNA, 103 bp, Artificial Sequence
  Synthetic Polynucleotide
taatacgactcactatagggctcttgtcactaacgcccatggccaccacaaacagaggagatgtggtatgcatgggcgtaacctggcggcagcgcaaaagatg

SEQ ID NO: 110893 - DNA, 103 bp, Artificial Sequence
  Synthetic Polynucleotide
taatacgactcactatagggcgagatgtccctcttgtcactaacgcccataacagaggagaatgggcatgagtgacaagaacctggcggcagcgcaaaagatg

SEQ ID NO: 110894 - DNA, 103 bp, Artificial Sequence
  Synthetic Polynucleotide
taatacgactcactatagggcgcctgagtcctgggccatggatggggactaacagaggagaagtcccatgccatggcccaacctggcggcagcgcaaaagatg

SEQ ID NO: 110895 - DNA, 103 bp, Artificial Sequence
  Synthetic Polynucleotide
taatacgactcactatagggcgagaaatcgcgagatgtccctcttgtcacaacagaggagagtgacaatggggacatctaacctggcggcagcgcaaaagatg

SEQ ID NO: 110896 - DNA, 103 bp, Artificial Sequence
  Synthetic Polynucleotide
taatacgactcactataggggggttggactcgagaaatcgcgagatgtccaacagaggagaggacatatggcgatttctaacctggcggcagcgcaaaagatg

SEQ ID NO: 110897 - DNA, 103 bp, Artificial Sequence
  Synthetic Polynucleotide
taatacgactcactatagggaatcatcacagggttggactcgagaaatcgaacagaggagacgatttatggagtccaacaacctggcggcagcgcaaaagatg

SEQ ID NO: 110898 - DNA, 103 bp, Artificial Sequence
  Synthetic Polynucleotide
taatacgactcactatagggctttggcatcaatcatcacagggttggactaacagaggagaagtccaatgctgtgatgaaacctggcggcagcgcaaaagatg

SEQ ID NO: 110899 - DNA, 103 bp, Artificial Sequence
  Synthetic Polynucleotide
taatacgactcactataggggctgacacttctttggcatcaatcatcacaaacagaggagatgtgatatgtgatgccaaaacctggcggcagcgcaaaagatg

SEQ ID NO: 110900 - DNA, 103 bp, Artificial Sequence
  Synthetic Polynucleotide
taatacgactcactatagggcctgtgtgcagctgacacttctttggcatcaacagaggagagatgccatggaagtgtcaaacctggcggcagcgcaaaagatg

SEQ ID NO: 110901 - DNA, 103 bp, Artificial Sequence
  Synthetic Polynucleotide
taatacgactcactatagggagtagcgggccctgtgtgcagctgacacttaacagaggagaaagtgtatgctgcacacaaacctggcggcagcgcaaaagatg

SEQ ID NO: 110902 - DNA, 103 bp, Artificial Sequence
  Synthetic Polynucleotide
taatacgactcactatagggttaccccagaagtagcgggccctgtgtgcaaacagaggagatgcacaatgggcccgctaaacctggcggcagcgcaaaagatg

SEQ ID NO: 110903 - DNA, 103 bp, Artificial Sequence
  Synthetic Polynucleotide
taatacgactcactatagggaccgggaaggttaccccagaagtagcgggcaacagaggagagcccgcatgttctggggtaacctggcggcagcgcaaaagatg

SEQ ID NO: 110904 - DNA, 103 bp, Artificial Sequence
  Synthetic Polynucleotide
taatacgactcactataggggcctgttcataccgggaaggttaccccagaaacagaggagatctgggatgaccttcccgaacctggcggcagcgcaaaagatg

SEQ ID NO: 110905 - DNA, 103 bp, Artificial Sequence
  Synthetic Polynucleotide
taatacgactcactatagggagctctgaggcgcctgagtcctgggccatgaacagaggagacatggcatgggactcaggaacctggcggcagcgcaaaagatg

SEQ ID NO: 110906 - DNA, 103 bp, Artificial Sequence
  Synthetic Polynucleotide
taatacgactcactataggggatgccaacggcctgttcataccgggaaggaacagaggagaccttccatgtatgaacagaacctggcggcagcgcaaaagatg

SEQ ID NO: 110907 - DNA, 103 bp, Artificial Sequence
  Synthetic Polynucleotide
taatacgactcactatagggattcacagtggatgccaacggcctgttcataacagaggagaatgaacatgccgttggcaaacctggcggcagcgcaaaagatg

SEQ ID NO: 110908 - DNA, 103 bp, Artificial Sequence
  Synthetic Polynucleotide
taatacgactcactatagggccagcttatcattcacagtggatgccaacgaacagaggagacgttggatgccactgtgaaacctggcggcagcgcaaaagatg

SEQ ID NO: 110909 - DNA, 103 bp, Artificial Sequence
  Synthetic Polynucleotide
taatacgactcactatagggtcctgcagctccagcttatcattcacagtgaacagaggagacactgtatgtgataagctaacctggcggcagcgcaaaagatg

SEQ ID NO: 110910 - DNA, 103 bp, Artificial Sequence
  Synthetic Polynucleotide
taatacgactcactatagggctccagacactcctgcagctccagcttatcaacagaggagagataagatggagctgcagaacctggcggcagcgcaaaagatg

SEQ ID NO: 110911 - DNA, 103 bp, Artificial Sequence
  Synthetic Polynucleotide
taatacgactcactatagggtcctgccatgctccagacactcctgcagctaacagaggagaagctgcatgagtgtctggaacctggcggcagcgcaaaagatg

SEQ ID NO: 110912 - DNA, 103 bp, Artificial Sequence
  Synthetic Polynucleotide
taatacgactcactatagggaacttggctatcctgccatgctccagacacaacagaggagagtgtctatggcatggcagaacctggcggcagcgcaaaagatg

SEQ ID NO: 110913 - DNA, 103 bp, Artificial Sequence
  Synthetic Polynucleotide
taatacgactcactatagggcactttgctgaacttggctatcctgccatgaacagaggagacatggcatgatagccaagaacctggcggcagcgcaaaagatg

SEQ ID NO: 110914 - DNA, 103 bp, Artificial Sequence
  Synthetic Polynucleotide
taatacgactcactatagggtaatggtcctcactttgctgaacttggctaaacagaggagatagccaatgtcagcaaagaacctggcggcagcgcaaaagatg

SEQ ID NO: 110915 - DNA, 103 bp, Artificial Sequence
  Synthetic Polynucleotide
taatacgactcactataggggacctcgtagtaatggtcctcactttgctgaacagaggagacagcaaatggaggaccataacctggcggcagcgcaaaagatg

SEQ ID NO: 110916 - DNA, 103 bp, Artificial Sequence
  Synthetic Polynucleotide
taatacgactcactatagggattgggtaatagctctgaggcgcctgagtcaacagaggagagactcaatggcctcagagaacctggcggcagcgcaaaagatg

SEQ ID NO: 110917 - DNA, 103 bp, Artificial Sequence
  Synthetic Polynucleotide
taatacgactcactatagggtatggagtttgacctcgtagtaatggtcctaacagaggagaaggaccatgactacgaggaacctggcggcagcgcaaaagatg

SEQ ID NO: 110918 - DNA, 103 bp, Artificial Sequence
  Synthetic Polynucleotide
taatacgactcactatagggtgccctgctttatggagtttgacctcgtagaacagaggagactacgaatgcaaactccaaacctggcggcagcgcaaaagatg

SEQ ID NO: 110919 - DNA, 103 bp, Artificial Sequence
  Synthetic Polynucleotide
taatacgactcactatagggtgctggtctttgccctgctttatggagtttaacagaggagaaaactcatgaaagcagggaacctggcggcagcgcaaaagatg

SEQ ID NO: 110920 - DNA, 103 bp, Artificial Sequence
  Synthetic Polynucleotide
taatacgactcactataggggacaggaaaatgctggtctttgccctgcttaacagaggagaaagcagatgaaagaccagaacctggcggcagcgcaaaagatg

SEQ ID NO: 110921 - DNA, 103 bp, Artificial Sequence
  Synthetic Polynucleotide
taatacgactcactatagggcattcatgaagacaggaaaatgctggtcttaacagaggagaaagaccatgattttcctgaacctggcggcagcgcaaaagatg

SEQ ID NO: 110922 - DNA, 103 bp, Artificial Sequence
  Synthetic Polynucleotide
taatacgactcactatagggtcctctttctcattcatgaagacaggaaaaaacagaggagattttccatgcttcatgaaaacctggcggcagcgcaaaagatg

SEQ ID NO: 110923 - DNA, 103 bp, Artificial Sequence
  Synthetic Polynucleotide
taatacgactcactatagggccataagatgtcctctttctcattcatgaaaacagaggagattcatgatggagaaagagaacctggcggcagcgcaaaagatg

SEQ ID NO: 110924 - DNA, 103 bp, Artificial Sequence
  Synthetic Polynucleotide
taatacgactcactatagggtttcagtgcaccataagatgtcctctttctaacagaggagaagaaagatgacatcttataacctggcggcagcgcaaaagatg

SEQ ID NO: 110925 - DNA, 103 bp, Artificial Sequence
  Synthetic Polynucleotide
taatacgactcactatagggaccctttccatttcagtgcaccataagatgaacagaggagacatcttatggtgcactgaaacctggcggcagcgcaaaagatg

SEQ ID NO: 110926 - DNA, 103 bp, Artificial Sequence
  Synthetic Polynucleotide
taatacgactcactataggggaaaccaaataccctttccatttcagtgcaaacagaggagatgcactatgatggaaaggaacctggcggcagcgcaaaagatg

SEQ ID NO: 110927 - DNA, 103 bp, Artificial Sequence
  Synthetic Polynucleotide
taatacgactcactatagggccaagtccccattgggtaatagctctgaggaacagaggagacctcagatgtattacccaaacctggcggcagcgcaaaagatg

SEQ ID NO: 110928 - DNA, 103 bp, Artificial Sequence
  Synthetic Polynucleotide
taatacgactcactatagggagtggactgggaaaccaaataccctttccaaacagaggagatggaaaatgtatttggttaacctggcggcagcgcaaaagatg

SEQ ID NO: 110929 - DNA, 103 bp, Artificial Sequence
  Synthetic Polynucleotide
taatacgactcactatagggacgtcagtatagtggactgggaaaccaaataacagaggagaatttggatgcccagtccaaacctggcggcagcgcaaaagatg

SEQ ID NO: 110930 - DNA, 103 bp, Artificial Sequence
  Synthetic Polynucleotide
taatacgactcactatagggcatgttggagacgtcagtatagtggactggaacagaggagaccagtcatgtatactgacaacctggcggcagcgcaaaagatg

SEQ ID NO: 110931 - DNA, 103 bp, Artificial Sequence
  Synthetic Polynucleotide
taatacgactcactatagggccaagcggctcatgttggagacgtcagtataacagaggagaatactgatgtctccaacaaacctggcggcagcgcaaaagatg

SEQ ID NO: 110932 - DNA, 103 bp, Artificial Sequence
  Synthetic Polynucleotide
taatacgactcactatagggctctgcctcgccaagcggctcatgttggagaacagaggagactccaaatggagccgcttaacctggcggcagcgcaaaagatg

SEQ ID NO: 110933 - DNA, 103 bp, Artificial Sequence
  Synthetic Polynucleotide
taatacgactcactataggggcccagcagtctctgcctcgccaagcggctaacagaggagaagccgcatggcgaggcagaacctggcggcagcgcaaaagatg

SEQ ID NO: 110934 - DNA, 103 bp, Artificial Sequence
  Synthetic Polynucleotide
taatacgactcactatagggtccatgaccggcccagcagtctctgcctcgaacagaggagacgaggcatggactgctggaacctggcggcagcgcaaaagatg

SEQ ID NO: 110935 - DNA, 103 bp, Artificial Sequence
  Synthetic Polynucleotide
taatacgactcactatagggactggcacgctccatgaccggcccagcagtaacagaggagaactgctatgccggtcatgaacctggcggcagcgcaaaagatg

SEQ ID NO: 110936 - DNA, 103 bp, Artificial Sequence
  Synthetic Polynucleotide
taatacgactcactataggggtggcggatgactggcacgctccatgaccgaacagaggagacggtcaatgagcgtgccaaacctggcggcagcgcaaaagatg

SEQ ID NO: 110937 - DNA, 103 bp, Artificial Sequence
  Synthetic Polynucleotide
taatacgactcactataggggagcgaagaggtggcggatgactggcacgcaacagaggagagcgtgcatgtcatccgccaacctggcggcagcgcaaaagatg

SEQ ID NO: 110938 - DNA, 103 bp, Artificial Sequence
  Synthetic Polynucleotide
taatacgactcactatagggctccgcttctccaagtccccattgggtaataacagaggagaattaccatgtggggacttaacctggcggcagcgcaaaagatg

SEQ ID NO: 110939 - DNA, 103 bp, Artificial Sequence
  Synthetic Polynucleotide
taatacgactcactatagggtccttcagcggagcgaagaggtggcggatgaacagaggagacatccgatgcctcttcgcaacctggcggcagcgcaaaagatg

SEQ ID NO: 110940 - DNA, 103 bp, Artificial Sequence
  Synthetic Polynucleotide
taatacgactcactatagggcgcaaaatactccttcagcggagcgaagagaacagaggagactcttcatgccgctgaagaacctggcggcagcgcaaaagatg

SEQ ID NO: 110941 - DNA, 103 bp, Artificial Sequence
  Synthetic Polynucleotide
taatacgactcactatagggctggggctcactccgcttctccaagtccccaacagaggagaggggacatggagaagcggaacctggcggcagcgcaaaagatg

SEQ ID NO: 110942 - DNA, 103 bp, Artificial Sequence
  Synthetic Polynucleotide
taatacgactcactatagggcctcctctggctggggctcactccgcttctaacagaggagaagaagcatggtgagccccaacctggcggcagcgcaaaagatg

SEQ ID NO: 110943 - DNA, 103 bp, Artificial Sequence
  Synthetic Polynucleotide
taatacgactcactataggggcagcagagctgctggtgtccccggggccgaacagaggagacggcccatgggacaccagaacctggcggcagcgcaaaagatg

SEQ ID NO: 110944 - DNA, 103 bp, Artificial Sequence
  Synthetic Polynucleotide
taatacgactcactataggggcagggctcccctcctctggctggggctcaaacagaggagatgagccatggccagaggaaacctggcggcagcgcaaaagatg

SEQ ID NO: 110945 - DNA, 103 bp, Artificial Sequence
  Synthetic Polynucleotide
taatacgactcactatagggctgccccccagcagggctcccctcctctggaacagaggagaccagagatggggagccctaacctggcggcagcgcaaaagatg

SEQ ID NO: 110946 - DNA, 103 bp, Artificial Sequence
  Synthetic Polynucleotide
taatacgactcactatagggccccgcccttctgccccccagcagggctccaacagaggagaggagccatgctggggggcaacctggcggcagcgcaaaagatg

SEQ ID NO: 110947 - DNA, 103 bp, Artificial Sequence
  Synthetic Polynucleotide
taatacgactcactatagggtctgctggggccccgcccttctgccccccaaacagaggagatgggggatggaagggcggaacctggcggcagcgcaaaagatg

SEQ ID NO: 110948 - DNA, 103 bp, Artificial Sequence
  Synthetic Polynucleotide
taatacgactcactatagggaccctctccctctgctggggccccgcccttaacagaggagaaagggcatggccccagcaaacctggcggcagcgcaaaagatg

SEQ ID NO: 110949 - DNA, 103 bp, Artificial Sequence
  Synthetic Polynucleotide
taatacgactcactatagggtctcagctgcaccctctccctctgctggggaacagaggagaccccagatgagggagaggaacctggcggcagcgcaaaagatg

SEQ ID NO: 110950 - DNA, 103 bp, Artificial Sequence
  Synthetic Polynucleotide
taatacgactcactatagggtcaggcagggtctcagctgcaccctctcccaacagaggagagggagaatgtgcagctgaaacctggcggcagcgcaaaagatg

SEQ ID NO: 110951 - DNA, 103 bp, Artificial Sequence
  Synthetic Polynucleotide
taatacgactcactatagggtcttgaggcttcaggcagggtctcagctgcaacagaggagagcagctatgaccctgcctaacctggcggcagcgcaaaagatg

SEQ ID NO: 110952 - DNA, 103 bp, Artificial Sequence
  Synthetic Polynucleotide
taatacgactcactatagggtttccactgctcttgaggcttcaggcagggaacagaggagaccctgcatgaagcctcaaaacctggcggcagcgcaaaagatg

SEQ ID NO: 110953 - DNA, 103 bp, Artificial Sequence
  Synthetic Polynucleotide
taatacgactcactatagggcagcagccattttccactgctcttgaggctaacagaggagaagcctcatgagcagtggaaacctggcggcagcgcaaaagatg

SEQ ID NO: 110954 - DNA, 103 bp, Artificial Sequence
  Synthetic Polynucleotide
taatacgactcactatagggctcccgctccgcagcagagctgctggtgtcaacagaggagagacaccatgagctctgctaacctggcggcagcgcaaaagatg

SEQ ID NO: 110955 - DNA, 103 bp, Artificial Sequence
  Synthetic Polynucleotide
taatacgactcactatagggcttgggggtgcagcagccattttccactgcaacagaggagagcagtgatgaatggctgcaacctggcggcagcgcaaaagatg

SEQ ID NO: 110956 - DNA, 103 bp, Artificial Sequence
  Synthetic Polynucleotide
taatacgactcactatagggctcggccctccttgggggtgcagcagccataacagaggagaatggctatggcacccccaaacctggcggcagcgcaaaagatg

SEQ ID NO: 110957 - DNA, 103 bp, Artificial Sequence
  Synthetic Polynucleotide
taatacgactcactataggggcaggggctcctcggccctccttgggggtgaacagaggagacaccccatgggagggccgaacctggcggcagcgcaaaagatg

SEQ ID NO: 110958 - DNA, 103 bp, Artificial Sequence
  Synthetic Polynucleotide
taatacgactcactataggggcccgcttctgcaggggctcctcggccctcaacagaggagagagggcatgggagcccctaacctggcggcagcgcaaaagatg

SEQ ID NO: 110959 - DNA, 103 bp, Artificial Sequence
  Synthetic Polynucleotide
taatacgactcactatagggtctgttctttgcccgcttctgcaggggctcaacagaggagagagcccatgcagaagcggaacctggcggcagcgcaaaagatg

SEQ ID NO: 110960 - DNA, 103 bp, Artificial Sequence
  Synthetic Polynucleotide
taatacgactcactatagggttggtctccttctgttctttgcccgcttctaacagaggagaagaagcatgcaaagaacaaacctggcggcagcgcaaaagatg

SEQ ID NO: 110961 - DNA, 103 bp, Artificial Sequence
  Synthetic Polynucleotide
taatacgactcactatagggggattcgatgttggtctccttctgttctttaacagaggagaaaagaaatgaaggagaccaacctggcggcagcgcaaaagatg

SEQ ID NO: 110962 - DNA, 103 bp, Artificial Sequence
  Synthetic Polynucleotide
taatacgactcactatagggccattttcatggattcgatgttggtctcctaacagaggagaaggagaatgacatcgaataacctggcggcagcgcaaaagatg

SEQ ID NO: 110963 - DNA, 103 bp, Artificial Sequence
  Synthetic Polynucleotide
taatacgactcactatagggcgggagccctccattttcatggattcgatgaacagaggagacatcgaatgcatgaaaataacctggcggcagcgcaaaagatg

SEQ ID NO: 110964 - DNA, 103 bp, Artificial Sequence
  Synthetic Polynucleotide
taatacgactcactatagggcagccggccccgggagccctccattttcataacagaggagaatgaaaatggagggctccaacctggcggcagcgcaaaagatg

SEQ ID NO: 110965 - DNA, 103 bp, Artificial Sequence
  Synthetic Polynucleotide
taatacgactcactatagggttcggtcctcctcccgctccgcagcagagcaacagaggagagctctgatgcggagcgggaacctggcggcagcgcaaaagatg

SEQ ID NO: 110966 - DNA, 103 bp, Artificial Sequence
  Synthetic Polynucleotide
taatacgactcactatagggagccaccccgcagccggccccgggagccctaacagaggagaagggctatgggggccggcaacctggcggcagcgcaaaagatg

SEQ ID NO: 110967 - DNA, 103 bp, Artificial Sequence
  Synthetic Polynucleotide
taatacgactcactatagggtcccagcccaagccaccccgcagccggcccaacagaggagagggccgatggcggggtggaacctggcggcagcgcaaaagatg

SEQ ID NO: 110968 - DNA, 103 bp, Artificial Sequence
  Synthetic Polynucleotide
taatacgactcactataggggaggctggactcccagcccaagccaccccgaacagaggagacggggtatgttgggctggaacctggcggcagcgcaaaagatg

SEQ ID NO: 110969 - DNA, 103 bp, Artificial Sequence
  Synthetic Polynucleotide
taatacgactcactataggggccgctgacggaggctggactcccagcccaaacagaggagatgggctatgagtccagccaacctggcggcagcgcaaaagatg

SEQ ID NO: 110970 - DNA, 103 bp, Artificial Sequence
  Synthetic Polynucleotide
taatacgactcactatagggctcggcatgggccgctgacggaggctggacaacagaggagagtccagatgccgtcagcgaacctggcggcagcgcaaaagatg

SEQ ID NO: 110971 - DNA, 103 bp, Artificial Sequence
  Synthetic Polynucleotide
taatacgactcactataggggaaggtgagcctcggcatgggccgctgacgaacagaggagacgtcagatgcccatgccgaacctggcggcagcgcaaaagatg

SEQ ID NO: 110972 - DNA, 103 bp, Artificial Sequence
  Synthetic Polynucleotide
taatacgactcactatagggcccccgcctggaaggtgagcctcggcatggaacagaggagaccatgcatgggctcacctaacctggcggcagcgcaaaagatg

SEQ ID NO: 110973 - DNA, 103 bp, Artificial Sequence
  Synthetic Polynucleotide
taatacgactcactatagggtagtaggggtcccccgcctggaaggtgagcaacagaggagagctcacatgccaggcgggaacctggcggcagcgcaaaagatg

SEQ ID NO: 110974 - DNA, 103 bp, Artificial Sequence
  Synthetic Polynucleotide
taatacgactcactatagggcttgctgatgtagtaggggtcccccgcctgaacagaggagacaggcgatggacccctacaacctggcggcagcgcaaaagatg

SEQ ID NO: 110975 - DNA, 103 bp, Artificial Sequence
  Synthetic Polynucleotide
taatacgactcactatagggcccgcttgcgcttgctgatgtagtaggggtaacagaggagaacccctatgacatcagcaaacctggcggcagcgcaaaagatg

SEQ ID NO: 110976 - DNA, 103 bp, Artificial Sequence
  Synthetic Polynucleotide
taatacgactcactatagggtctccgtcctttcggtcctcctcccgctccaacagaggagaggagcgatgggaggaccgaacctggcggcagcgcaaaagatg

SEQ ID NO: 110977 - DNA, 103 bp, Artificial Sequence
  Synthetic Polynucleotide
taatacgactcactatagggagccactcgtcccgcttgcgcttgctgatgaacagaggagacatcagatggcgcaagcgaacctggcggcagcgcaaaagatg

SEQ ID NO: 110978 - DNA, 103 bp, Artificial Sequence
  Synthetic Polynucleotide
taatacgactcactatagggccagcgtgccagccactcgtcccgcttgcgaacagaggagacgcaagatggacgagtggaacctggcggcagcgcaaaagatg

SEQ ID NO: 110979 - DNA, 103 bp, Artificial Sequence
  Synthetic Polynucleotide
taatacgactcactatagggcctcccttttccagcgtgccagccactcgtaacagaggagaacgagtatgtggcacgctaacctggcggcagcgcaaaagatg

SEQ ID NO: 110980 - DNA, 103 bp, Artificial Sequence
  Synthetic Polynucleotide
taatacgactcactatagggttcttctcagcctcccttttccagcgtgccaacagaggagaggcacgatggaaaagggaaacctggcggcagcgcaaaagatg

SEQ ID NO: 110981 - DNA, 103 bp, Artificial Sequence
  Synthetic Polynucleotide
taatacgactcactataggggaccttggctttcttctcagcctcccttttaacagaggagaaaaaggatggctgagaagaacctggcggcagcgcaaaagatg

SEQ ID NO: 110982 - DNA, 103 bp, Artificial Sequence
  Synthetic Polynucleotide
taatacgactcactatagggttcctgcaatgaccttggctttcttctcagaacagaggagactgagaatgaagccaaggaacctggcggcagcgcaaaagatg

SEQ ID NO: 110983 - DNA, 103 bp, Artificial Sequence
  Synthetic Polynucleotide
taatacgactcactatagggacagcattcattcctgcaatgaccttggctaacagaggagaagccaaatgcattgcaggaacctggcggcagcgcaaaagatg

SEQ ID NO: 110984 - DNA, 103 bp, Artificial Sequence
  Synthetic Polynucleotide
taatacgactcactataggggttttcttccacagcattcattcctgcaataacagaggagaattgcaatgatgaatgctaacctggcggcagcgcaaaagatg

SEQ ID NO: 110985 - DNA, 103 bp, Artificial Sequence
  Synthetic Polynucleotide
taatacgactcactatagggcgggcccctggttttcttccacagcattcaaacagaggagatgaatgatgtggaagaaaaacctggcggcagcgcaaaagatg

SEQ ID NO: 110986 - DNA, 103 bp, Artificial Sequence
  Synthetic Polynucleotide
taatacgactcactatagggtgagactccccgggcccctggttttcttccaacagaggagaggaagaatgccaggggccaacctggcggcagcgcaaaagatg

SEQ ID NO: 110987 - DNA, 103 bp, Artificial Sequence
  Synthetic Polynucleotide
taatacgactcactatagggctcctgctcctctccgtcctttcggtcctcaacagaggagagaggacatgaaggacggaaacctggcggcagcgcaaaagatg

SEQ ID NO: 110988 - DNA, 103 bp, Artificial Sequence
  Synthetic Polynucleotide
taatacgactcactatagggctccaccttctgagactccccgggcccctgaacagaggagacaggggatgggggagtctaacctggcggcagcgcaaaagatg

SEQ ID NO: 110989 - DNA, 103 bp, Artificial Sequence
  Synthetic Polynucleotide
taatacgactcactatagggggctggcctcctccaccttctgagactcccaacagaggagagggagtatgagaaggtggaacctggcggcagcgcaaaagatg

SEQ ID NO: 110990 - DNA, 103 bp, Artificial Sequence
  Synthetic Polynucleotide
taatacgactcactatagggacagcaggagggctggcctcctccaccttcaacagaggagagaaggtatgggaggccagaacctggcggcagcgcaaaagatg

SEQ ID NO: 110991 - DNA, 103 bp, Artificial Sequence
  Synthetic Polynucleotide
taatacgactcactataggggggctgctgcacagcaggagggctggcctcaacagaggagagaggccatgcctcctgctaacctggcggcagcgcaaaagatg

SEQ ID NO: 110992 - DNA, 103 bp, Artificial Sequence
  Synthetic Polynucleotide
taatacgactcactatagggcggggtcagtgggctgctgcacagcaggagaacagaggagactcctgatgtgcagcagcaacctggcggcagcgcaaaagatg

SEQ ID NO: 110993 - DNA, 103 bp, Artificial Sequence
  Synthetic Polynucleotide
taatacgactcactataggggtgggggatgcggggtcagtgggctgctgcaacagaggagagcagcaatgcactgacccaacctggcggcagcgcaaaagatg

SEQ ID NO: 110994 - DNA, 103 bp, Artificial Sequence
  Synthetic Polynucleotide
taatacgactcactatagggggtagccacagtgggggatgcggggtcagtaacagaggagaactgacatggcatcccccaacctggcggcagcgcaaaagatg

SEQ ID NO: 110995 - DNA, 103 bp, Artificial Sequence
  Synthetic Polynucleotide
taatacgactcactataggggctcaggcgtggtagccacagtgggggatgaacagaggagacatcccatgctgtggctaaacctggcggcagcgcaaaagatg

SEQ ID NO: 110996 - DNA, 103 bp, Artificial Sequence
  Synthetic Polynucleotide
taatacgactcactataggggaccccacgggctcaggcgtggtagccacaaacagaggagatgtggcatgcacgcctgaaacctggcggcagcgcaaaagatg

SEQ ID NO: 110997 - DNA, 103 bp, Artificial Sequence
  Synthetic Polynucleotide
taatacgactcactatagggcccagcatcggaccccacgggctcaggcgtaacagaggagaacgcctatgcccgtggggaacctggcggcagcgcaaaagatg

SEQ ID NO: 110998 - DNA, 103 bp, Artificial Sequence
  Synthetic Polynucleotide
taatacgactcactatagggcacgcggctcctcctgctcctctccgtcctaacagaggagaaggacgatgaggagcaggaacctggcggcagcgcaaaagatg

SEQ ID NO: 110999 - DNA, 103 bp, Artificial Sequence
  Synthetic Polynucleotide
taatacgactcactatagggcattcttgtccccagcatcggaccccacggaacagaggagaccgtggatgccgatgctgaacctggcggcagcgcaaaagatg

SEQ ID NO: 111000 - DNA, 103 bp, Artificial Sequence
  Synthetic Polynucleotide
taatacgactcactataggggctttggtggcattcttgtccccagcatcgaacagaggagacgatgcatgggacaagaaaacctggcggcagcgcaaaagatg

SEQ ID NO: 111001 - DNA, 103 bp, Artificial Sequence
  Synthetic Polynucleotide
taatacgactcactataggggtcatcgcctgctttggtggcattcttgtcaacagaggagagacaagatggccaccaaaaacctggcggcagcgcaaaagatg

SEQ ID NO: 111002 - DNA, 103 bp, Artificial Sequence
  Synthetic Polynucleotide
taatacgactcactatagggactctggctcgtcatcgcctgctttggtggaacagaggagaccaccaatgcaggcgatgaacctggcggcagcgcaaaagatg

SEQ ID NO: 111003 - DNA, 103 bp, Artificial Sequence
  Synthetic Polynucleotide
taatacgactcactatagggccgtcctcgtactctggctcgtcatcgcctaacagaggagaaggcgaatgcgagccagaaacctggcggcagcgcaaaagatg

SEQ ID NO: 111004 - DNA, 103 bp, Artificial Sequence
  Synthetic Polynucleotide
taatacgactcactatagggaaagccccggccgtcctcgtactctggctcaacagaggagagagccaatgtacgaggacaacctggcggcagcgcaaaagatg

SEQ ID NO: 111005 - DNA, 103 bp, Artificial Sequence
  Synthetic Polynucleotide
taatacgactcactatagggccccaatgccaaagccccggccgtcctcgtaacagaggagaacgaggatggccggggctaacctggcggcagcgcaaaagatg

SEQ ID NO: 111006 - DNA, 103 bp, Artificial Sequence
  Synthetic Polynucleotide
taatacgactcactatagggcacaccagctccccaatgccaaagccccggaacagaggagaccggggatgtggcattggaacctggcggcagcgcaaaagatg

SEQ ID NO: 111007 - DNA, 103 bp, Artificial Sequence
  Synthetic Polynucleotide
taatacgactcactatagggcagtttcccccacaccagctccccaatgccaacagaggagaggcattatggagctggtgaacctggcggcagcgcaaaagatg

SEQ ID NO: 111008 - DNA, 103 bp, Artificial Sequence
  Synthetic Polynucleotide
taatacgactcactatagggagaagccccgcagtttcccccacaccagctaacagaggagaagctggatggggggaaacaacctggcggcagcgcaaaagatg

SEQ ID NO: 111009 - DNA, 103 bp, Artificial Sequence
  Synthetic Polynucleotide
taatacgactcactatagggtcctccttgccacgcggctcctcctgctccaacagaggagaggagcaatgggagccgcgaacctggcggcagcgcaaaagatg

SEQ ID NO: 111010 - DNA, 103 bp, Artificial Sequence
  Synthetic Polynucleotide
taatacgactcactatagggggccaccaggagaagccccgcagtttccccaacagaggagaggggaaatggcggggcttaacctggcggcagcgcaaaagatg

SEQ ID NO: 111011 - DNA, 103 bp, Artificial Sequence
  Synthetic Polynucleotide
taatacgactcactatagggaatgcggcctggccaccaggagaagccccgaacagaggagacggggcatgtcctggtggaacctggcggcagcgcaaaagatg

SEQ ID NO: 111012 - DNA, 103 bp, Artificial Sequence
  Synthetic Polynucleotide
taatacgactcactatagggaccaagacacaatgcggcctggccaccaggaacagaggagacctggtatgcaggccgcaaacctggcggcagcgcaaaagatg

SEQ ID NO: 111013 - DNA, 103 bp, Artificial Sequence
  Synthetic Polynucleotide
taatacgactcactatagggcccgtcatccaccaagacacaatgcggcctaacagaggagaaggccgatgtgtgtcttgaacctggcggcagcgcaaaagatg

SEQ ID NO: 111014 - DNA, 103 bp, Artificial Sequence
  Synthetic Polynucleotide
taatacgactcactatagggtcggctccggcccgtcatccaccaagacacaacagaggagagtgtctatgtggatgacgaacctggcggcagcgcaaaagatg

SEQ ID NO: 111015 - DNA, 103 bp, Artificial Sequence
  Synthetic Polynucleotide
taatacgactcactatagggcttcagctgctcggctccggcccgtcatccaacagaggagaggatgaatggccggagccaacctggcggcagcgcaaaagatg

SEQ ID NO: 111016 - DNA, 103 bp, Artificial Sequence
  Synthetic Polynucleotide
taatacgactcactatagggcagcgggtgccttcagctgctcggctccggaacagaggagaccggagatgagcagctgaaacctggcggcagcgcaaaagatg

SEQ ID NO: 111017 - DNA, 103 bp, Artificial Sequence
  Synthetic Polynucleotide
taatacgactcactatagggccacatgacccagcgggtgccttcagctgcaacagaggagagcagctatgggcacccgcaacctggcggcagcgcaaaagatg

SEQ ID NO: 111018 - DNA, 103 bp, Artificial Sequence
  Synthetic Polynucleotide
taatacgactcactatagggcgtctccgaaccacatgacccagcgggtgcaacagaggagagcacccatggggtcatgtaacctggcggcagcgcaaaagatg

SEQ ID NO: 111019 - DNA, 103 bp, Artificial Sequence
  Synthetic Polynucleotide
taatacgactcactataggggagaatttgccgtctccgaaccacatgaccaacagaggagaggtcatatggttcggagaaacctggcggcagcgcaaaagatg

SEQ ID NO: 111020 - DNA, 103 bp, Artificial Sequence
  Synthetic Polynucleotide
taatacgactcactatagggcttcactacattctccaccacagccgccataacagaggagaatggcgatggtggtggagaacctggcggcagcgcaaaagatg

SEQ ID NO: 111021 - DNA, 103 bp, Artificial Sequence
  Synthetic Polynucleotide
taatacgactcactatagggaggcaggcgcacgctgcgctcagcacagagaacagaggagactctgtatggagcgcagcaacctggcggcagcgcaaaagatg

SEQ ID NO: 111022 - DNA, 103 bp, Artificial Sequence
  Synthetic Polynucleotide
taatacgactcactatagggagtccaagaaaggcaggcgcacgctgcgctaacagaggagaagcgcaatgtgcgcctgcaacctggcggcagcgcaaaagatg

SEQ ID NO: 111023 - DNA, 103 bp, Artificial Sequence
  Synthetic Polynucleotide
taatacgactcactatagggccggtctgtgagtccaagaaaggcaggcgcaacagaggagagcgcctatgtttcttggaaacctggcggcagcgcaaaagatg

SEQ ID NO: 111024 - DNA, 103 bp, Artificial Sequence
  Synthetic Polynucleotide
taatacgactcactatagggctgggctactccggtctgtgagtccaagaaaacagaggagattcttgatgtcacagaccaacctggcggcagcgcaaaagatg

SEQ ID NO: 111025 - DNA, 103 bp, Artificial Sequence
  Synthetic Polynucleotide
taatacgactcactatagggaacaattgctctgggctactccggtctgtgaacagaggagacacagaatggagtagcccaacctggcggcagcgcaaaagatg

SEQ ID NO: 111026 - DNA, 103 bp, Artificial Sequence
  Synthetic Polynucleotide
taatacgactcactatagggatccagatgtaacaattgctctgggctactaacagaggagaagtagcatggagcaattgaacctggcggcagcgcaaaagatg

SEQ ID NO: 111027 - DNA, 103 bp, Artificial Sequence
  Synthetic Polynucleotide
taatacgactcactatagggtcgcttttccatccagatgtaacaattgctaacagaggagaagcaatatgtacatctggaacctggcggcagcgcaaaagatg

SEQ ID NO: 111028 - DNA, 103 bp, Artificial Sequence
  Synthetic Polynucleotide
taatacgactcactataggggaccccggtgtcgcttttccatccagatgtaacagaggagaacatctatgtggaaaagcaacctggcggcagcgcaaaagatg

SEQ ID NO: 111029 - DNA, 103 bp, Artificial Sequence
  Synthetic Polynucleotide
taatacgactcactataggggccaatcctggaccccggtgtcgcttttccaacagaggagaggaaaaatgacaccggggaacctggcggcagcgcaaaagatg

SEQ ID NO: 111030 - DNA, 103 bp, Artificial Sequence
  Synthetic Polynucleotide
taatacgactcactatagggctgtccggaggccaatcctggaccccggtgaacagaggagacaccggatgccaggattgaacctggcggcagcgcaaaagatg

SEQ ID NO: 111031 - DNA, 103 bp, Artificial Sequence
  Synthetic Polynucleotide
taatacgactcactatagggccccaaggagcttcactacattctccaccaaacagaggagatggtggatgatgtagtgaaacctggcggcagcgcaaaagatg

SEQ ID NO: 111032 - DNA, 103 bp, Artificial Sequence
  Synthetic Polynucleotide
taatacgactcactatagggaggagtacagctgtccggaggccaatcctgaacagaggagacaggatatgcctccggacaacctggcggcagcgcaaaagatg

SEQ ID NO: 111033 - DNA, 103 bp, Artificial Sequence
  Synthetic Polynucleotide
taatacgactcactatagggcgggcagggtaggagtacagctgtccggagaacagaggagactccggatggctgtactcaacctggcggcagcgcaaaagatg

SEQ ID NO: 111034 - DNA, 103 bp, Artificial Sequence
  Synthetic Polynucleotide
taatacgactcactatagggccgccagcgccgggcagggtaggagtacagaacagaggagactgtacatgtaccctgccaacctggcggcagcgcaaaagatg

SEQ ID NO: 111035 - DNA, 103 bp, Artificial Sequence
  Synthetic Polynucleotide
taatacgactcactataggggccgctttttccgccagcgccgggcagggtaacagaggagaaccctgatgggcgctggcaacctggcggcagcgcaaaagatg

SEQ ID NO: 111036 - DNA, 103 bp, Artificial Sequence
  Synthetic Polynucleotide
taatacgactcactatagggggatgggctcgccgctttttccgccagcgcaacagaggagagcgctgatggaaaaagcgaacctggcggcagcgcaaaagatg

SEQ ID NO: 111037 - DNA, 103 bp, Artificial Sequence
  Synthetic Polynucleotide
taatacgactcactatagggatcctcagggggatgggctcgccgctttttaacagaggagaaaaaagatgcgagcccataacctggcggcagcgcaaaagatg

SEQ ID NO: 111038 - DNA, 103 bp, Artificial Sequence
  Synthetic Polynucleotide
taatacgactcactatagggaaagtcgtggatcctcagggggatgggctcaacagaggagagagcccatgcccctgaggaacctggcggcagcgcaaaagatg

SEQ ID NO: 111039 - DNA, 103 bp, Artificial Sequence
  Synthetic Polynucleotide
taatacgactcactataggggatgggaaggaaagtcgtggatcctcagggaacagaggagaccctgaatgtccacgactaacctggcggcagcgcaaaagatg

SEQ ID NO: 111040 - DNA, 103 bp, Artificial Sequence
  Synthetic Polynucleotide
taatacgactcactatagggtggcttaatagatgggaaggaaagtcgtggaacagaggagaccacgaatgtccttcccaaacctggcggcagcgcaaaagatg

SEQ ID NO: 111041 - DNA, 103 bp, Artificial Sequence
  Synthetic Polynucleotide
taatacgactcactatagggggtctgtgtctggcttaatagatgggaaggaacagaggagaccttccatgctattaagcaacctggcggcagcgcaaaagatg

SEQ ID NO: 111042 - DNA, 103 bp, Artificial Sequence
  Synthetic Polynucleotide
taatacgactcactatagggtagtactgctccccaaggagcttcactacaaacagaggagatgtagtatggctccttggaacctggcggcagcgcaaaagatg

SEQ ID NO: 111043 - DNA, 103 bp, Artificial Sequence
  Synthetic Polynucleotide
taatacgactcactatagggttcagggtctggtctgtgtctggcttaataaacagaggagatattaaatgagacacagaaacctggcggcagcgcaaaagatg

SEQ ID NO: 111044 - DNA, 103 bp, Artificial Sequence
  Synthetic Polynucleotide
taatacgactcactatagggcccctccttcttcagggtctggtctgtgtcaacagaggagagacacaatgcagaccctgaacctggcggcagcgcaaaagatg

SEQ ID NO: 111045 - DNA, 103 bp, Artificial Sequence
  Synthetic Polynucleotide
taatacgactcactataggggagagatcagcccctccttcttcagggtctaacagaggagaagacccatgagaaggaggaacctggcggcagcgcaaaagatg

SEQ ID NO: 111046 - DNA, 103 bp, Artificial Sequence
  Synthetic Polynucleotide
taatacgactcactatagggctgccatcctgagagatcagcccctccttcaacagaggagagaaggaatggctgatctcaacctggcggcagcgcaaaagatg

SEQ ID NO: 111047 - DNA, 103 bp, Artificial Sequence
  Synthetic Polynucleotide
taatacgactcactatagggctctaaactactgccatcctgagagatcagaacagaggagactgatcatgcaggatggcaacctggcggcagcgcaaaagatg

SEQ ID NO: 111048 - DNA, 103 bp, Artificial Sequence
  Synthetic Polynucleotide
taatacgactcactataggggcaacagagcctctaaactactgccatcctaacagaggagaaggatgatggtagtttagaacctggcggcagcgcaaaagatg

SEQ ID NO: 111049 - DNA, 103 bp, Artificial Sequence
  Synthetic Polynucleotide
taatacgactcactataggggggtcagtgcgcaacagagcctctaaactaaacagaggagatagtttatgggctctgttaacctggcggcagcgcaaaagatg

SEQ ID NO: 111050 - DNA, 103 bp, Artificial Sequence
  Synthetic Polynucleotide
taatacgactcactatagggcttctccagggggtcagtgcgcaacagagcaacagaggagagctctgatgcgcactgacaacctggcggcagcgcaaaagatg

SEQ ID NO: 111051 - DNA, 103 bp, Artificial Sequence
  Synthetic Polynucleotide
taatacgactcactataggggggcacctcgcttctccagggggtcagtgcaacagaggagagcactgatgccctggagaaacctggcggcagcgcaaaagatg

SEQ ID NO: 111052 - DNA, 103 bp, Artificial Sequence
  Synthetic Polynucleotide
taatacgactcactatagggcggggatccggggcacctcgcttctccaggaacagaggagacctggaatggcgaggtgcaacctggcggcagcgcaaaagatg

SEQ ID NO: 111053 - DNA, 103 bp, Artificial Sequence
  Synthetic Polynucleotide
taatacgactcactatagggggcatctttgtagtactgctccccaaggagaacagaggagactccttatggagcagtacaacctggcggcagcgcaaaagatg

SEQ ID NO: 111054 - DNA, 103 bp, Artificial Sequence
  Synthetic Polynucleotide
taatacgactcactatagggatcatcaactcggggatccggggcacctcgaacagaggagacgaggtatgccggatcccaacctggcggcagcgcaaaagatg

SEQ ID NO: 111055 - DNA, 103 bp, Artificial Sequence
  Synthetic Polynucleotide
taatacgactcactatagggccaggctgtcatcatcaactcggggatccgaacagaggagacggatcatggagttgatgaacctggcggcagcgcaaaagatg

SEQ ID NO: 111056 - DNA, 103 bp, Artificial Sequence
  Synthetic Polynucleotide
taatacgactcactatagggggaaactcgcccaggctgtcatcatcaactaacagaggagaagttgaatgtgacagcctaacctggcggcagcgcaaaagatg

SEQ ID NO: 111057 - DNA, 103 bp, Artificial Sequence
  Synthetic Polynucleotide
taatacgactcactataggggttggtcacaggaaactcgcccaggctgtcaacagaggagagacagcatgggcgagtttaacctggcggcagcgcaaaagatg

SEQ ID NO: 111058 - DNA, 103 bp, Artificial Sequence
  Synthetic Polynucleotide
taatacgactcactataggggcgctcgactgttggtcacaggaaactcgcaacagaggagagcgagtatgctgtgaccaaacctggcggcagcgcaaaagatg

SEQ ID NO: 111059 - DNA, 103 bp, Artificial Sequence
  Synthetic Polynucleotide
taatacgactcactatagggtggtcctttcgcgctcgactgttggtcacaaacagaggagatgtgacatgcagtcgagcaacctggcggcagcgcaaaagatg

SEQ ID NO: 111060 - DNA, 103 bp, Artificial Sequence
  Synthetic Polynucleotide
taatacgactcactataggggaagagcaactggtcctttcgcgctcgactaacagaggagaagtcgaatgcgaaaggacaacctggcggcagcgcaaaagatg

SEQ ID NO: 111061 - DNA, 103 bp, Artificial Sequence
  Synthetic Polynucleotide
taatacgactcactatagggagtcatcacagaagagcaactggtcctttcaacagaggagagaaaggatgagttgctctaacctggcggcagcgcaaaagatg

SEQ ID NO: 111062 - DNA, 103 bp, Artificial Sequence
  Synthetic Polynucleotide
taatacgactcactatagggccacgatcgcagtcatcacagaagagcaacaacagaggagagttgctatgctgtgatgaaacctggcggcagcgcaaaagatg

SEQ ID NO: 111063 - DNA, 103 bp, Artificial Sequence
  Synthetic Polynucleotide
taatacgactcactatagggcatgtggtagccacgatcgcagtcatcacaaacagaggagatgtgatatgtgcgatcgtaacctggcggcagcgcaaaagatg

SEQ ID NO: 111064 - DNA, 103 bp, Artificial Sequence
  Synthetic Polynucleotide
taatacgactcactatagggactgctccatggcatctttgtagtactgctaacagaggagaagcagtatgacaaagatgaacctggcggcagcgcaaaagatg

SEQ ID NO: 111065 - DNA, 103 bp, Artificial Sequence
  Synthetic Polynucleotide
taatacgactcactatagggtgagacagtacatgtggtagccacgatcgcaacagaggagagcgatcatggctaccacaaacctggcggcagcgcaaaagatg

SEQ ID NO: 111066 - DNA, 103 bp, Artificial Sequence
  Synthetic Polynucleotide
taatacgactcactatagggatggacggggtgagacagtacatgtggtagaacagaggagactaccaatggtactgtctaacctggcggcagcgcaaaagatg

SEQ ID NO: 111067 - DNA, 103 bp, Artificial Sequence
  Synthetic Polynucleotide
taatacgactcactataggggggctcagacatggacggggtgagacagtaaacagaggagatactgtatgaccccgtccaacctggcggcagcgcaaaagatg

SEQ ID NO: 111068 - DNA, 103 bp, Artificial Sequence
  Synthetic Polynucleotide
taatacgactcactatagggttccttcagggggctcagacatggacggggaacagaggagaccccgtatgtgtctgagcaacctggcggcagcgcaaaagatg

SEQ ID NO: 111069 - DNA, 103 bp, Artificial Sequence
  Synthetic Polynucleotide
taatacgactcactatagggcagctccaacttccttcagggggctcagacaacagaggagagtctgaatgccctgaaggaacctggcggcagcgcaaaagatg

SEQ ID NO: 111070 - DNA, 103 bp, Artificial Sequence
  Synthetic Polynucleotide
taatacgactcactatagggacacaggtggcagctccaacttccttcaggaacagaggagacctgaaatgagttggagcaacctggcggcagcgcaaaagatg

SEQ ID NO: 111071 - DNA, 103 bp, Artificial Sequence
  Synthetic Polynucleotide
taatacgactcactatagggacaggtccagacacaggtggcagctccaacaacagaggagagttggaatggccacctgtaacctggcggcagcgcaaaagatg

SEQ ID NO: 111072 - DNA, 103 bp, Artificial Sequence
  Synthetic Polynucleotide
taatacgactcactatagggttctctttcaacaggtccagacacaggtggaacagaggagaccacctatgtctggacctaacctggcggcagcgcaaaagatg

SEQ ID NO: 111073 - DNA, 103 bp, Artificial Sequence
  Synthetic Polynucleotide
taatacgactcactataggggatggaagctttctctttcaacaggtccagaacagaggagactggacatgttgaaagagaacctggcggcagcgcaaaagatg

SEQ ID NO: 111074 - DNA, 103 bp, Artificial Sequence
  Synthetic Polynucleotide
taatacgactcactatagggggttctggtagatggaagctttctctttcaaacagaggagatgaaagatgaagcttccaaacctggcggcagcgcaaaagatg

SEQ ID NO: 111075 - DNA, 103 bp, Artificial Sequence
  Synthetic Polynucleotide
taatacgactcactatagggtaattgtggcactgctccatggcatctttgaacagaggagacaaagaatgcatggagcaaacctggcggcagcgcaaaagatg

SEQ ID NO: 111076 - DNA, 103 bp, Artificial Sequence
  Synthetic Polynucleotide
taatacgactcactataggggaggagttctggttctggtagatggaagctaacagaggagaagcttcatgctaccagaaaacctggcggcagcgcaaaagatg

SEQ ID NO: 111077 - DNA, 103 bp, Artificial Sequence
  Synthetic Polynucleotide
taatacgactcactataggggcgagcattgtaattgtggcactgctccataacagaggagaatggagatgtgccacaataacctggcggcagcgcaaaagatg

SEQ ID NO: 111078 - DNA, 103 bp, Artificial Sequence
  Synthetic Polynucleotide
taatacgactcactatagggcagcacagaggcgagcattgtaattgtggcaacagaggagagccacaatgacaatgctcaacctggcggcagcgcaaaagatg

SEQ ID NO: 111079 - DNA, 103 bp, Artificial Sequence
  Synthetic Polynucleotide
taatacgactcactatagggacgctgcgctcagcacagaggcgagcattgaacagaggagacaatgcatgcctctgtgcaacctggcggcagcgcaaaagatg

SEQ ID NO: 111080 - DNA, 103 bp, Artificial Sequence
  Synthetic Polynucleotide
taatacgactcactatagggatcatcatcgttgccagacgaggaagccataacagaggagaatggctatgtcgtctggcaacctggcggcagcgcaaaagatg

SEQ ID NO: 111081 - DNA, 103 bp, Artificial Sequence
  Synthetic Polynucleotide
taatacgactcactatagggcaccaccagctctcgagcatcgttggccacaacagaggagagtggccatggatgctcgaaacctggcggcagcgcaaaagatg

SEQ ID NO: 111082 - DNA, 103 bp, Artificial Sequence
  Synthetic Polynucleotide
taatacgactcactatagggtgcagcagttcaccaccagctctcgagcataacagaggagaatgctcatgagctggtggaacctggcggcagcgcaaaagatg

SEQ ID NO: 111083 - DNA, 103 bp, Artificial Sequence
  Synthetic Polynucleotide
taatacgactcactatagggatgaattcagtgcagcagttcaccaccagcaacagaggagagctggtatggaactgctgaacctggcggcagcgcaaaagatg

SEQ ID NO: 111084 - DNA, 103 bp, Artificial Sequence
  Synthetic Polynucleotide
taatacgactcactatagggtataaggtgaatgaattcagtgcagcagttaacagaggagaaactgcatgactgaattcaacctggcggcagcgcaaaagatg

SEQ ID NO: 111085 - DNA, 103 bp, Artificial Sequence
  Synthetic Polynucleotide
taatacgactcactatagggcttcagaagatataaggtgaatgaattcagaacagaggagactgaatatgttcaccttaaacctggcggcagcgcaaaagatg

SEQ ID NO: 111086 - DNA, 103 bp, Artificial Sequence
  Synthetic Polynucleotide
taatacgactcactatagggatctcattggcttcagaagatataaggtgaaacagaggagatcacctatgatcttctgaaacctggcggcagcgcaaaagatg

SEQ ID NO: 111087 - DNA, 103 bp, Artificial Sequence
  Synthetic Polynucleotide
taatacgactcactatagggtttgttacaaatctcattggcttcagaagaaacagaggagatcttctatggccaatgagaacctggcggcagcgcaaaagatg

SEQ ID NO: 111088 - DNA, 103 bp, Artificial Sequence
  Synthetic Polynucleotide
taatacgactcactatagggtcttttccgatttgttacaaatctcattggaacagaggagaccaatgatgtttgtaacaaacctggcggcagcgcaaaagatg

SEQ ID NO: 111089 - DNA, 103 bp, Artificial Sequence
  Synthetic Polynucleotide
taatacgactcactataggggagatggtcttcttttccgatttgttacaaaacagaggagattgtaaatgatcggaaaaaacctggcggcagcgcaaaagatg

SEQ ID NO: 111090 - DNA, 103 bp, Artificial Sequence
  Synthetic Polynucleotide
taatacgactcactatagggatgctctggtgagatggtcttcttttccgaaacagaggagatcggaaatgaagaccatcaacctggcggcagcgcaaaagatg

SEQ ID NO: 111091 - DNA, 103 bp, Artificial Sequence
  Synthetic Polynucleotide
taatacgactcactatagggggatagtgagatcatcatcgttgccagacgaacagaggagacgtctgatgacgatgatgaacctggcggcagcgcaaaagatg

SEQ ID NO: 111092 - DNA, 103 bp, Artificial Sequence
  Synthetic Polynucleotide
taatacgactcactatagggcttgtatgacatgctctggtgagatggtctaacagaggagaagaccaatgcaccagagcaacctggcggcagcgcaaaagatg

SEQ ID NO: 111093 - DNA, 103 bp, Artificial Sequence
  Synthetic Polynucleotide
taatacgactcactatagggctttctagtgcttgtatgacatgctctggtaacagaggagaaccagaatgtgtcatacaaacctggcggcagcgcaaaagatg

SEQ ID NO: 111094 - DNA, 103 bp, Artificial Sequence
  Synthetic Polynucleotide
taatacgactcactatagggaaatcccaaactttctagtgcttgtatgacaacagaggagagtcataatggcactagaaaacctggcggcagcgcaaaagatg

SEQ ID NO: 111095 - DNA, 103 bp, Artificial Sequence
  Synthetic Polynucleotide
taatacgactcactatagggtgtaagagccaaatcccaaactttctagtgaacagaggagacactagatggtttgggataacctggcggcagcgcaaaagatg

SEQ ID NO: 111096 - DNA, 103 bp, Artificial Sequence
  Synthetic Polynucleotide
taatacgactcactatagggacttcactgatgtaagagccaaatcccaaaaacagaggagatttgggatgtggctcttaaacctggcggcagcgcaaaagatg

SEQ ID NO: 111097 - DNA, 103 bp, Artificial Sequence
  Synthetic Polynucleotide
taatacgactcactataggggacttcttttacttcactgatgtaagagccaacagaggagaggctctatgatcagtgaaaacctggcggcagcgcaaaagatg

SEQ ID NO: 111098 - DNA, 103 bp, Artificial Sequence
  Synthetic Polynucleotide
taatacgactcactatagggactcttgcaagacttcttttacttcactgaaacagaggagatcagtgatgtaaaagaagaacctggcggcagcgcaaaagatg

SEQ ID NO: 111099 - DNA, 103 bp, Artificial Sequence
  Synthetic Polynucleotide
taatacgactcactatagggactgttttacactcttgcaagacttcttttaacagaggagaaaaagaatgcttgcaagaaacctggcggcagcgcaaaagatg

SEQ ID NO: 111100 - DNA, 103 bp, Artificial Sequence
  Synthetic Polynucleotide
taatacgactcactatagggttttaatgctactgttttacactcttgcaaaacagaggagattgcaaatgtgtaaaacaaacctggcggcagcgcaaaagatg

SEQ ID NO: 111101 - DNA, 103 bp, Artificial Sequence
  Synthetic Polynucleotide
taatacgactcactatagggcctttcttctttttaatgctactgttttacaacagaggagagtaaaaatgtagcattaaaacctggcggcagcgcaaaagatg

SEQ ID NO: 111102 - DNA, 103 bp, Artificial Sequence
  Synthetic Polynucleotide
taatacgactcactataggggcagctctggggatagtgagatcatcatcgaacagaggagacgatgaatgtctcactataacctggcggcagcgcaaaagatg

SEQ ID NO: 111103 - DNA, 103 bp, Artificial Sequence
  Synthetic Polynucleotide
taatacgactcactatagggcgagaactggcctttcttctttttaatgctaacagaggagaagcattatgaagaagaaaaacctggcggcagcgcaaaagatg

SEQ ID NO: 111104 - DNA, 103 bp, Artificial Sequence
  Synthetic Polynucleotide
taatacgactcactataggggttttccaaacgagaactggcctttcttctaacagaggagaagaagaatggccagttctaacctggcggcagcgcaaaagatg

SEQ ID NO: 111105 - DNA, 103 bp, Artificial Sequence
  Synthetic Polynucleotide
taatacgactcactataggggaatgccaaggttttccaaacgagaactggaacagaggagaccagttatggtttggaaaaacctggcggcagcgcaaaagatg

SEQ ID NO: 111106 - DNA, 103 bp, Artificial Sequence
  Synthetic Polynucleotide
taatacgactcactatagggtcttcttcaggaatgccaaggttttccaaaaacagaggagatttggaatgccttggcataacctggcggcagcgcaaaagatg

SEQ ID NO: 111107 - DNA, 103 bp, Artificial Sequence
  Synthetic Polynucleotide
taatacgactcactatagggtctcaataactcttcttcaggaatgccaagaacagaggagacttggcatgcctgaagaaaacctggcggcagcgcaaaagatg

SEQ ID NO: 111108 - DNA, 103 bp, Artificial Sequence
  Synthetic Polynucleotide
taatacgactcactatagggcttgttgctgtctcaataactcttcttcagaacagaggagactgaagatgagttattgaaacctggcggcagcgcaaaagatg

SEQ ID NO: 111109 - DNA, 103 bp, Artificial Sequence
  Synthetic Polynucleotide
taatacgactcactataggggcaaataattcttgttgctgtctcaataacaacagaggagagttattatgacagcaacaaacctggcggcagcgcaaaagatg

SEQ ID NO: 111110 - DNA, 103 bp, Artificial Sequence
  Synthetic Polynucleotide
taatacgactcactatagggtctagcttttgcaaataattcttgttgctgaacagaggagacagcaaatggaattatttaacctggcggcagcgcaaaagatg

SEQ ID NO: 111111 - DNA, 103 bp, Artificial Sequence
  Synthetic Polynucleotide
taatacgactcactatagggcttgttgctgtctagcttttgcaaataattaacagaggagaaattatatgcaaaagctaaacctggcggcagcgcaaaagatg

SEQ ID NO: 111112 - DNA, 103 bp, Artificial Sequence
  Synthetic Polynucleotide
taatacgactcactataggggccaattctgcttgttgctgtctagcttttaacagaggagaaaaagcatgacagcaacaaacctggcggcagcgcaaaagatg

SEQ ID NO: 111113 - DNA, 103 bp, Artificial Sequence
  Synthetic Polynucleotide
taatacgactcactatagggtttattgatagcagctctggggatagtgagaacagaggagactcactatgcccagagctaacctggcggcagcgcaaaagatg

SEQ ID NO: 111114 - DNA, 103 bp, Artificial Sequence
  Synthetic Polynucleotide
taatacgactcactatagggttcctgttgggccaattctgcttgttgctgaacagaggagacagcaaatggcagaattgaacctggcggcagcgcaaaagatg

SEQ ID NO: 111115 - DNA, 103 bp, Artificial Sequence
  Synthetic Polynucleotide
taatacgactcactatagggtttgaagccattcctgttgggccaattctgaacagaggagacagaatatgcccaacaggaacctggcggcagcgcaaaagatg

SEQ ID NO: 111116 - DNA, 103 bp, Artificial Sequence
  Synthetic Polynucleotide
taatacgactcactataggggcttgctgcatttgaagccattcctgttggaacagaggagaccaacaatgatggcttcaaacctggcggcagcgcaaaagatg

SEQ ID NO: 111117 - DNA, 103 bp, Artificial Sequence
  Synthetic Polynucleotide
taatacgactcactatagggttgttgggcagcttgctgcatttgaagccaaacagaggagatggcttatgatgcagcaaaacctggcggcagcgcaaaagatg

SEQ ID NO: 111118 - DNA, 103 bp, Artificial Sequence
  Synthetic Polynucleotide
taatacgactcactatagggcaagctgggcttgttgggcagcttgctgcaaacagaggagatgcagcatgctgcccaacaacctggcggcagcgcaaaagatg

SEQ ID NO: 111119 - DNA, 103 bp, Artificial Sequence
  Synthetic Polynucleotide
taatacgactcactataggggaggcagcagcaagctgggcttgttgggcaaacagaggagatgcccaatgagcccagctaacctggcggcagcgcaaaagatg

SEQ ID NO: 111120 - DNA, 103 bp, Artificial Sequence
  Synthetic Polynucleotide
taatacgactcactatagggtgcactggctgaggcagcagcaagctgggcaacagaggagagcccagatggctgctgccaacctggcggcagcgcaaaagatg

SEQ ID NO: 111121 - DNA, 103 bp, Artificial Sequence
  Synthetic Polynucleotide
taatacgactcactatagggcctgattagatgcactggctgaggcagcagaacagaggagactgctgatgcagccagtgaacctggcggcagcgcaaaagatg

SEQ ID NO: 111122 - DNA, 103 bp, Artificial Sequence
  Synthetic Polynucleotide
taatacgactcactataggggaagatcccgcctgattagatgcactggctaacagaggagaagccagatgatctaatcaaacctggcggcagcgcaaaagatg

SEQ ID NO: 111123 - DNA, 103 bp, Artificial Sequence
  Synthetic Polynucleotide
taatacgactcactatagggttcatcctgagaagatcccgcctgattagaaacagaggagatctaatatggcgggatctaacctggcggcagcgcaaaagatg

SEQ ID NO: 111124 - DNA, 103 bp, Artificial Sequence
  Synthetic Polynucleotide
taatacgactcactatagggctttgatcattttattgatagcagctctggaacagaggagaccagagatgctatcaataaacctggcggcagcgcaaaagatg

SEQ ID NO: 111125 - DNA, 103 bp, Artificial Sequence
  Synthetic Polynucleotide
taatacgactcactatagggcatcatcttcttcatcctgagaagatcccgaacagaggagacgggatatgctcaggatgaacctggcggcagcgcaaaagatg

SEQ ID NO: 111126 - DNA, 103 bp, Artificial Sequence
  Synthetic Polynucleotide
taatacgactcactatagggcagatatcatcatcatcttcttcatcctgaaacagaggagatcaggaatgagaagatgaaacctggcggcagcgcaaaagatg

SEQ ID NO: 111127 - DNA, 103 bp, Artificial Sequence
  Synthetic Polynucleotide
taatacgactcactatagggggaagagtctctttgatcattttattgataaacagaggagatatcaaatgaatgatcaaaacctggcggcagcgcaaaagatg

SEQ ID NO: 111128 - DNA, 103 bp, Artificial Sequence
  Synthetic Polynucleotide
taatacgactcactatagggccggacattaggaagagtctctttgatcataacagaggagaatgatcatggagactcttaacctggcggcagcgcaaaagatg

SEQ ID NO: 111129 - DNA, 103 bp, Artificial Sequence
  Synthetic Polynucleotide
taatacgactcactatagggcgttggccacccggacattaggaagagtctaacagaggagaagactcatgctaatgtccaacctggcggcagcgcaaaagatg

SEQ ID NO: 111130 - DNA, 103 bp, Artificial Sequence
  Synthetic Polynucleotide
taatacgactcactatagggtctcgagcatcgttggccacccggacattaaacagaggagataatgtatgggtggccaaaacctggcggcagcgcaaaagatg

SEQ ID NO: 111131 - DNA, 103 bp, Artificial Sequence
  Synthetic Polynucleotide
taatacgactcactatagggcgcgttgtacttcttcttcttgctcggcataacagaggagaatgccgatgaagaagaagaacctggcggcagcgcaaaagatg

SEQ ID NO: 111132 - DNA, 103 bp, Artificial Sequence
  Synthetic Polynucleotide
taatacgactcactatagggccgggagatgatgacaggcaccgccgccgcaacagaggagagcggcgatggtgcctgtcaacctggcggcagcgcaaaagatg

SEQ ID NO: 111133 - DNA, 103 bp, Artificial Sequence
  Synthetic Polynucleotide
taatacgactcactataggggctcgagcgcccgggagatgatgacaggcaaacagaggagatgcctgatgtcatctcccaacctggcggcagcgcaaaagatg

SEQ ID NO: 111134 - DNA, 103 bp, Artificial Sequence
  Synthetic Polynucleotide
taatacgactcactatagggtctaggaagagctcgagcgcccgggagatgaacagaggagacatctcatgggcgctcgaaacctggcggcagcgcaaaagatg

SEQ ID NO: 111135 - DNA, 103 bp, Artificial Sequence
  Synthetic Polynucleotide
taatacgactcactatagggcaacagcgactctaggaagagctcgagcgcaacagaggagagcgctcatgctcttcctaaacctggcggcagcgcaaaagatg

SEQ ID NO: 111136 - DNA, 103 bp, Artificial Sequence
  Synthetic Polynucleotide
taatacgactcactatagggaggccttcttcaacagcgactctaggaagaaacagaggagatcttccatgagtcgctgtaacctggcggcagcgcaaaagatg

SEQ ID NO: 111137 - DNA, 103 bp, Artificial Sequence
  Synthetic Polynucleotide
taatacgactcactataggggtcacctggcaggccttcttcaacagcgacaacagaggagagtcgctatggaagaaggcaacctggcggcagcgcaaaagatg

SEQ ID NO: 111138 - DNA, 103 bp, Artificial Sequence
  Synthetic Polynucleotide
taatacgactcactatagggccgcgactgggtcacctggcaggccttcttaacagaggagaaagaagatgtgccaggtgaacctggcggcagcgcaaaagatg

SEQ ID NO: 111139 - DNA, 103 bp, Artificial Sequence
  Synthetic Polynucleotide
taatacgactcactatagggtcttcgcgttccgcgactgggtcacctggcaacagaggagagccaggatgcccagtcgcaacctggcggcagcgcaaaagatg

SEQ ID NO: 111140 - DNA, 103 bp, Artificial Sequence
  Synthetic Polynucleotide
taatacgactcactataggggtggtcatggtcttcgcgttccgcgactggaacagaggagaccagtcatggaacgcgaaaacctggcggcagcgcaaaagatg

SEQ ID NO: 111141 - DNA, 103 bp, Artificial Sequence
  Synthetic Polynucleotide
taatacgactcactatagggcaggtgggatgtggtcatggtcttcgcgttaacagaggagaaacgcgatgaccatgaccaacctggcggcagcgcaaaagatg

SEQ ID NO: 111142 - DNA, 103 bp, Artificial Sequence
  Synthetic Polynucleotide
taatacgactcactataggggcgggaaccgcgcgttgtacttcttcttctaacagaggagaagaagaatgagtacaacgaacctggcggcagcgcaaaagatg

SEQ ID NO: 111143 - DNA, 103 bp, Artificial Sequence
  Synthetic Polynucleotide
taatacgactcactatagggtgcactgcttcaggtgggatgtggtcatggaacagaggagaccatgaatgcatcccaccaacctggcggcagcgcaaaagatg

SEQ ID NO: 111144 - DNA, 103 bp, Artificial Sequence
  Synthetic Polynucleotide
taatacgactcactatagggtccagctcgatgcactgcttcaggtgggataacagaggagaatcccaatggaagcagtgaacctggcggcagcgcaaaagatg

SEQ ID NO: 111145 - DNA, 103 bp, Artificial Sequence
  Synthetic Polynucleotide
taatacgactcactatagggaaactgctgctccagctcgatgcactgcttaacagaggagaaagcagatgatcgagctgaacctggcggcagcgcaaaagatg

SEQ ID NO: 111146 - DNA, 103 bp, Artificial Sequence
  Synthetic Polynucleotide
taatacgactcactatagggtcaagaagtcaaactgctgctccagctcgaaacagaggagatcgagcatgagcagcagtaacctggcggcagcgcaaaagatg

SEQ ID NO: 111147 - DNA, 103 bp, Artificial Sequence
  Synthetic Polynucleotide
taatacgactcactatagggaccaggtccttcaagaagtcaaactgctgcaacagaggagagcagcaatgtgacttcttaacctggcggcagcgcaaaagatg

SEQ ID NO: 111148 - DNA, 103 bp, Artificial Sequence
  Synthetic Polynucleotide
taatacgactcactatagggaacagatgccaccaggtccttcaagaagtcaacagaggagagacttcatgaaggacctgaacctggcggcagcgcaaaagatg

SEQ ID NO: 111149 - DNA, 103 bp, Artificial Sequence
  Synthetic Polynucleotide
taatacgactcactataggggcatgtcgggaacagatgccaccaggtcctaacagaggagaaggaccatgtggcatctgaacctggcggcagcgcaaaagatg

SEQ ID NO: 111150 - DNA, 103 bp, Artificial Sequence
  Synthetic Polynucleotide
taatacgactcactatagggccgtccccctgcatgtcgggaacagatgccaacagaggagaggcatcatgtcccgacataacctggcggcagcgcaaaagatg

SEQ ID NO: 111151 - DNA, 103 bp, Artificial Sequence
  Synthetic Polynucleotide
taatacgactcactataggggttgtcttccccgtccccctgcatgtcgggaacagaggagacccgacatgcagggggacaacctggcggcagcgcaaaagatg

SEQ ID NO: 111152 - DNA, 103 bp, Artificial Sequence
  Synthetic Polynucleotide
taatacgactcactatagggcatccatgtggttgtcttccccgtccccctaacagaggagaagggggatggggaagacaaacctggcggcagcgcaaaagatg

SEQ ID NO: 111153 - DNA, 103 bp, Artificial Sequence
  Synthetic Polynucleotide
taatacgactcactatagggatccgcgccggcgggaaccgcgcgttgtacaacagaggagagtacaaatggcggttcccaacctggcggcagcgcaaaagatg

SEQ ID NO: 111154 - DNA, 103 bp, Artificial Sequence
  Synthetic Polynucleotide
taatacgactcactatagggcccttgtccccatccatgtggttgtcttccaacagaggagaggaagaatgccacatggaaacctggcggcagcgcaaaagatg

SEQ ID NO: 111155 - DNA, 103 bp, Artificial Sequence
  Synthetic Polynucleotide
taatacgactcactatagggcctgcgggcgcccttgtccccatccatgtgaacagaggagacacatgatgggggacaagaacctggcggcagcgcaaaagatg

SEQ ID NO: 111156 - DNA, 103 bp, Artificial Sequence
  Synthetic Polynucleotide
taatacgactcactataggggcttccggcccctgcgggcgcccttgtcccaacagaggagagggacaatggcgcccgcaaacctggcggcagcgcaaaagatg

SEQ ID NO: 111157 - DNA, 103 bp, Artificial Sequence
  Synthetic Polynucleotide
taatacgactcactatagggccgctgcctggcttccggcccctgcgggcgaacagaggagacgcccgatggggccggaaaacctggcggcagcgcaaaagatg

SEQ ID NO: 111158 - DNA, 103 bp, Artificial Sequence
  Synthetic Polynucleotide
taatacgactcactatagggcttccggccgccgctgcctggcttccggccaacagaggagaggccggatgccaggcagcaacctggcggcagcgcaaaagatg

SEQ ID NO: 111159 - DNA, 103 bp, Artificial Sequence
  Synthetic Polynucleotide
taatacgactcactatagggtcccaccgttcttccggccgccgctgcctgaacagaggagacaggcaatggcggccggaaacctggcggcagcgcaaaagatg

SEQ ID NO: 111160 - DNA, 103 bp, Artificial Sequence
  Synthetic Polynucleotide
taatacgactcactatagggttcgttcccatcccaccgttcttccggccgaacagaggagacggccgatggaacggtggaacctggcggcagcgcaaaagatg

SEQ ID NO: 111161 - DNA, 103 bp, Artificial Sequence
  Synthetic Polynucleotide
taatacgactcactataggggtccttgcttttcgttcccatcccaccgttaacagaggagaaacggtatgatgggaacgaacctggcggcagcgcaaaagatg

SEQ ID NO: 111162 - DNA, 103 bp, Artificial Sequence
  Synthetic Polynucleotide
taatacgactcactatagggacagcttcttgtccttgcttttcgttcccaaacagaggagatgggaaatgaaagcaaggaacctggcggcagcgcaaaagatg

SEQ ID NO: 111163 - DNA, 103 bp, Artificial Sequence
  Synthetic Polynucleotide
taatacgactcactatagggtctgtcccggacagcttcttgtccttgcttaacagaggagaaagcaaatgcaagaagctaacctggcggcagcgcaaaagatg

SEQ ID NO: 111164 - DNA, 103 bp, Artificial Sequence
  Synthetic Polynucleotide
taatacgactcactataggggatcttcttgatccgcgccggcgggaaccgaacagaggagacggttcatgccggcgcggaacctggcggcagcgcaaaagatg

SEQ ID NO: 111165 - DNA, 103 bp, Artificial Sequence
  Synthetic Polynucleotide
taatacgactcactatagggctgctccgagtctgtcccggacagcttcttaacagaggagaaagaagatgtccgggacaaacctggcggcagcgcaaaagatg

SEQ ID NO: 111166 - DNA, 103 bp, Artificial Sequence
  Synthetic Polynucleotide
taatacgactcactatagggattcatcctcctgctccgagtctgtcccggaacagaggagaccgggaatgactcggagcaacctggcggcagcgcaaaagatg

SEQ ID NO: 111167 - DNA, 103 bp, Artificial Sequence
  Synthetic Polynucleotide
taatacgactcactataggggtgtcctcagattcatcctcctgctccgagaacagaggagactcggaatgggaggatgaaacctggcggcagcgcaaaagatg

SEQ ID NO: 111168 - DNA, 103 bp, Artificial Sequence
  Synthetic Polynucleotide
taatacgactcactatagggatcagtatctgtgtcctcagattcatcctcaacagaggagagaggatatgtctgaggacaacctggcggcagcgcaaaagatg

SEQ ID NO: 111169 - DNA, 103 bp, Artificial Sequence
  Synthetic Polynucleotide
taatacgactcactatagggcctcttccccatcagtatctgtgtcctcagaacagaggagactgaggatgcagatactgaacctggcggcagcgcaaaagatg

SEQ ID NO: 111170 - DNA, 103 bp, Artificial Sequence
  Synthetic Polynucleotide
taatacgactcactatagggtgtgatgtctcctcttccccatcagtatctaacagaggagaagatacatgtggggaagaaacctggcggcagcgcaaaagatg

SEQ ID NO: 111171 - DNA, 103 bp, Artificial Sequence
  Synthetic Polynucleotide
taatacgactcactataggggggtgggggttgtgatgtctcctcttccccaacagaggagaggggaaatggagacatcaaacctggcggcagcgcaaaagatg

SEQ ID NO: 111172 - DNA, 103 bp, Artificial Sequence
  Synthetic Polynucleotide
taatacgactcactatagggggctggcctggggtgggggttgtgatgtctaacagaggagaagacatatgaacccccacaacctggcggcagcgcaaaagatg

SEQ ID NO: 111173 - DNA, 103 bp, Artificial Sequence
  Synthetic Polynucleotide
taatacgactcactataggggcagaggggtggctggcctggggtgggggtaacagaggagaacccccatgccaggccagaacctggcggcagcgcaaaagatg

SEQ ID NO: 111174 - DNA, 103 bp, Artificial Sequence
  Synthetic Polynucleotide
taatacgactcactatagggctgaaagtgggcagaggggtggctggcctgaacagaggagacaggccatgcacccctctaacctggcggcagcgcaaaagatg

SEQ ID NO: 111175 - DNA, 103 bp, Artificial Sequence
  Synthetic Polynucleotide
taatacgactcactatagggccgtctgcatgatcttcttgatccgcgccgaacagaggagacggcgcatgtcaagaagaaacctggcggcagcgcaaaagatg

SEQ ID NO: 111176 - DNA, 103 bp, Artificial Sequence
  Synthetic Polynucleotide
taatacgactcactatagggtcggggggctctgaaagtgggcagaggggtaacagaggagaacccctatgcccactttcaacctggcggcagcgcaaaagatg

SEQ ID NO: 111177 - DNA, 103 bp, Artificial Sequence
  Synthetic Polynucleotide
taatacgactcactatagggaggaagggtgtcggggggctctgaaagtggaacagaggagaccacttatggagccccccaacctggcggcagcgcaaaagatg

SEQ ID NO: 111178 - DNA, 103 bp, Artificial Sequence
  Synthetic Polynucleotide
taatacgactcactatagggggcgaagggcaggaagggtgtcggggggctaacagaggagaagccccatgacacccttcaacctggcggcagcgcaaaagatg

SEQ ID NO: 111179 - DNA, 103 bp, Artificial Sequence
  Synthetic Polynucleotide
taatacgactcactataggggcagagtagaggcgaagggcaggaagggtgaacagaggagacaccctatgtgcccttcgaacctggcggcagcgcaaaagatg

SEQ ID NO: 111180 - DNA, 103 bp, Artificial Sequence
  Synthetic Polynucleotide
taatacgactcactataggggggggcaaaggcagagtagaggcgaagggcaacagaggagagcccttatgctctactctaacctggcggcagcgcaaaagatg

SEQ ID NO: 111181 - DNA, 103 bp, Artificial Sequence
  Synthetic Polynucleotide
taatacgactcactatagggcgggggcgctgggggcaaaggcagagtagaaacagaggagatctactatgcctttgcccaacctggcggcagcgcaaaagatg

SEQ ID NO: 111182 - DNA, 103 bp, Artificial Sequence
  Synthetic Polynucleotide
taatacgactcactatagggctgaggggcccgggggcgctgggggcaaagaacagaggagactttgcatgcagcgccccaacctggcggcagcgcaaaagatg

SEQ ID NO: 111183 - DNA, 103 bp, Artificial Sequence
  Synthetic Polynucleotide
taatacgactcactatagggtcatcaggtgctgaggggcccgggggcgctaacagaggagaagcgccatggggcccctcaacctggcggcagcgcaaaagatg

SEQ ID NO: 111184 - DNA, 103 bp, Artificial Sequence
  Synthetic Polynucleotide
taatacgactcactatagggttcgtcctcttcatcaggtgctgaggggccaacagaggagaggccccatggcacctgataacctggcggcagcgcaaaagatg

SEQ ID NO: 111185 - DNA, 103 bp, Artificial Sequence
  Synthetic Polynucleotide
taatacgactcactatagggcgtaatcttcttcgtcctcttcatcaggtgaacagaggagacacctgatgaagaggacgaacctggcggcagcgcaaaagatg

SEQ ID NO: 111186 - DNA, 103 bp, Artificial Sequence
  Synthetic Polynucleotide
taatacgactcactatagggatctcttcgtccgtctgcatgatcttcttgaacagaggagacaagaaatgcatgcagacaacctggcggcagcgcaaaagatg

SEQ ID NO: 111187 - DNA, 103 bp, Artificial Sequence
  Synthetic Polynucleotide
taatacgactcactatagggcaccttcccaatctcttcgtccgtctgcataacagaggagaatgcagatggacgaagagaacctggcggcagcgcaaaagatg

SEQ ID NO: 111188 - DNA, 103 bp, Artificial Sequence
  Synthetic Polynucleotide
taatacgactcactatagggccgccgccgccaccttcccaatctcttcgtaacagaggagaacgaagatgttgggaaggaacctggcggcagcgcaaaagatg

SEQ ID NO: 111189 - DNA, 103 bp, Artificial Sequence
  Synthetic Polynucleotide
taatacgactcactatagggatgacaggcaccgccgccgccaccttcccaaacagaggagatgggaaatgggcggcggcaacctggcggcagcgcaaaagatg

SEQ ID NO: 111190 - DNA, 103 bp, Artificial Sequence; identical to SEQ ID NO: 107007
  Synthetic Polynucleotide

SEQ ID NO: 111191 - DNA, 103 bp, Artificial Sequence; identical to SEQ ID NO: 107008
  Synthetic Polynucleotide

SEQ ID NO: 111192 - DNA, 103 bp, Artificial Sequence; identical to SEQ ID NO: 107009
  Synthetic Polynucleotide

SEQ ID NO: 111193 - DNA, 103 bp, Artificial Sequence; identical to SEQ ID NO: 107010
  Synthetic Polynucleotide

SEQ ID NO: 111194 - DNA, 103 bp, Artificial Sequence; identical to SEQ ID NO: 107011
  Synthetic Polynucleotide

SEQ ID NO: 111195 - DNA, 103 bp, Artificial Sequence; identical to SEQ ID NO: 107012
  Synthetic Polynucleotide

SEQ ID NO: 111196 - DNA, 103 bp, Artificial Sequence; identical to SEQ ID NO: 107013
  Synthetic Polynucleotide

SEQ ID NO: 111197 - DNA, 103 bp, Artificial Sequence; identical to SEQ ID NO: 107014
  Synthetic Polynucleotide

SEQ ID NO: 111198 - DNA, 103 bp, Artificial Sequence; identical to SEQ ID NO: 107015
  Synthetic Polynucleotide

SEQ ID NO: 111199 - DNA, 103 bp, Artificial Sequence; identical to SEQ ID NO: 107016
  Synthetic Polynucleotide

SEQ ID NO: 111200 - DNA, 103 bp, Artificial Sequence; identical to SEQ ID NO: 107017
  Synthetic Polynucleotide

SEQ ID NO: 111201 - DNA, 103 bp, Artificial Sequence; identical to SEQ ID NO: 107018
  Synthetic Polynucleotide

SEQ ID NO: 111202 - DNA, 103 bp, Artificial Sequence; identical to SEQ ID NO: 107019
  Synthetic Polynucleotide

SEQ ID NO: 111203 - DNA, 103 bp, Artificial Sequence; identical to SEQ ID NO: 107020
  Synthetic Polynucleotide

SEQ ID NO: 111204 - DNA, 103 bp, Artificial Sequence; identical to SEQ ID NO: 107021
  Synthetic Polynucleotide

SEQ ID NO: 111205 - DNA, 103 bp, Artificial Sequence; identical to SEQ ID NO: 107022
  Synthetic Polynucleotide

SEQ ID NO: 111206 - DNA, 103 bp, Artificial Sequence; identical to SEQ ID NO: 107023
  Synthetic Polynucleotide

SEQ ID NO: 111207 - DNA, 103 bp, Artificial Sequence; identical to SEQ ID NO: 107024
  Synthetic Polynucleotide

SEQ ID NO: 111208 - DNA, 103 bp, Artificial Sequence; identical to SEQ ID NO: 107025
  Synthetic Polynucleotide

SEQ ID NO: 111209 - DNA, 103 bp, Artificial Sequence; identical to SEQ ID NO: 107026
  Synthetic Polynucleotide

SEQ ID NO: 111210 - DNA, 103 bp, Artificial Sequence; identical to SEQ ID NO: 107027
  Synthetic Polynucleotide

SEQ ID NO: 111211 - DNA, 103 bp, Artificial Sequence; identical to SEQ ID NO: 107028
  Synthetic Polynucleotide

SEQ ID NO: 111212 - DNA, 103 bp, Artificial Sequence; identical to SEQ ID NO: 107029
  Synthetic Polynucleotide

SEQ ID NO: 111213 - DNA, 103 bp, Artificial Sequence; identical to SEQ ID NO: 107030
  Synthetic Polynucleotide

SEQ ID NO: 111214 - DNA, 103 bp, Artificial Sequence; identical to SEQ ID NO: 107031
  Synthetic Polynucleotide

SEQ ID NO: 111215 - DNA, 103 bp, Artificial Sequence; identical to SEQ ID NO: 107032
  Synthetic Polynucleotide

SEQ ID NO: 111216 - DNA, 103 bp, Artificial Sequence; identical to SEQ ID NO: 107033
  Synthetic Polynucleotide

SEQ ID NO: 111217 - DNA, 103 bp, Artificial Sequence; identical to SEQ ID NO: 107034
  Synthetic Polynucleotide

SEQ ID NO: 111218 - DNA, 103 bp, Artificial Sequence; identical to SEQ ID NO: 107035
  Synthetic Polynucleotide

SEQ ID NO: 111219 - DNA, 103 bp, Artificial Sequence; identical to SEQ ID NO: 107036
  Synthetic Polynucleotide

SEQ ID NO: 111220 - DNA, 103 bp, Artificial Sequence; identical to SEQ ID NO: 107037
  Synthetic Polynucleotide

SEQ ID NO: 111221 - DNA, 103 bp, Artificial Sequence; identical to SEQ ID NO: 107038
  Synthetic Polynucleotide

SEQ ID NO: 111222 - DNA, 103 bp, Artificial Sequence; identical to SEQ ID NO: 107039
  Synthetic Polynucleotide

SEQ ID NO: 111223 - DNA, 103 bp, Artificial Sequence; identical to SEQ ID NO: 107040
  Synthetic Polynucleotide

SEQ ID NO: 111224 - DNA, 103 bp, Artificial Sequence; identical to SEQ ID NO: 107041
  Synthetic Polynucleotide

SEQ ID NO: 111225 - DNA, 103 bp, Artificial Sequence; identical to SEQ ID NO: 107042
  Synthetic Polynucleotide

SEQ ID NO: 111226 - DNA, 103 bp, Artificial Sequence; identical to SEQ ID NO: 107043
  Synthetic Polynucleotide

SEQ ID NO: 111227 - DNA, 103 bp, Artificial Sequence; identical to SEQ ID NO: 107044
  Synthetic Polynucleotide

SEQ ID NO: 111228 - DNA, 103 bp, Artificial Sequence; identical to SEQ ID NO: 107045
  Synthetic Polynucleotide

SEQ ID NO: 111229 - DNA, 103 bp, Artificial Sequence; identical to SEQ ID NO: 107046
  Synthetic Polynucleotide

SEQ ID NO: 111230 - DNA, 103 bp, Artificial Sequence; identical to SEQ ID NO: 107047
  Synthetic Polynucleotide

SEQ ID NO: 111231 - DNA, 103 bp, Artificial Sequence; identical to SEQ ID NO: 107048
  Synthetic Polynucleotide

SEQ ID NO: 111232 - DNA, 103 bp, Artificial Sequence; identical to SEQ ID NO: 107049
  Synthetic Polynucleotide

SEQ ID NO: 111233 - DNA, 103 bp, Artificial Sequence; identical to SEQ ID NO: 107050
  Synthetic Polynucleotide

SEQ ID NO: 111234 - DNA, 103 bp, Artificial Sequence; identical to SEQ ID NO: 107051
  Synthetic Polynucleotide

SEQ ID NO: 111235 - DNA, 103 bp, Artificial Sequence; identical to SEQ ID NO: 107052
  Synthetic Polynucleotide

SEQ ID NO: 111236 - DNA, 103 bp, Artificial Sequence; identical to SEQ ID NO: 107053
  Synthetic Polynucleotide

SEQ ID NO: 111237 - DNA, 103 bp, Artificial Sequence; identical to SEQ ID NO: 107054
  Synthetic Polynucleotide

SEQ ID NO: 111238 - DNA, 103 bp, Artificial Sequence; identical to SEQ ID NO: 107055
  Synthetic Polynucleotide

SEQ ID NO: 111239 - DNA, 103 bp, Artificial Sequence; identical to SEQ ID NO: 107056
  Synthetic Polynucleotide

SEQ ID NO: 111240 - DNA, 103 bp, Artificial Sequence; identical to SEQ ID NO: 107057
  Synthetic Polynucleotide

SEQ ID NO: 111241 - DNA, 103 bp, Artificial Sequence; identical to SEQ ID NO: 107058
  Synthetic Polynucleotide

SEQ ID NO: 111242 - DNA, 103 bp, Artificial Sequence; identical to SEQ ID NO: 107059
  Synthetic Polynucleotide

SEQ ID NO: 111243 - DNA, 103 bp, Artificial Sequence; identical to SEQ ID NO: 107060
  Synthetic Polynucleotide

SEQ ID NO: 111244 - DNA, 103 bp, Artificial Sequence; identical to SEQ ID NO: 107061
  Synthetic Polynucleotide

SEQ ID NO: 111245 - DNA, 103 bp, Artificial Sequence; identical to SEQ ID NO: 107062
  Synthetic Polynucleotide

SEQ ID NO: 111246 - DNA, 103 bp, Artificial Sequence; identical to SEQ ID NO: 107063
  Synthetic Polynucleotide

SEQ ID NO: 111247 - DNA, 103 bp, Artificial Sequence; identical to SEQ ID NO: 107064
  Synthetic Polynucleotide

SEQ ID NO: 111248 - DNA, 103 bp, Artificial Sequence; identical to SEQ ID NO: 107065
  Synthetic Polynucleotide

SEQ ID NO: 111249 - DNA, 103 bp, Artificial Sequence; identical to SEQ ID NO: 107066
  Synthetic Polynucleotide

SEQ ID NO: 111250 - DNA, 103 bp, Artificial Sequence; identical to SEQ ID NO: 107067
  Synthetic Polynucleotide

SEQ ID NO: 111251 - DNA, 103 bp, Artificial Sequence; identical to SEQ ID NO: 107068
  Synthetic Polynucleotide

SEQ ID NO: 111252 - DNA, 103 bp, Artificial Sequence; identical to SEQ ID NO: 107069
  Synthetic Polynucleotide

SEQ ID NO: 111253 - DNA, 103 bp, Artificial Sequence; identical to SEQ ID NO: 107070
  Synthetic Polynucleotide

SEQ ID NO: 111254 - DNA, 103 bp, Artificial Sequence; identical to SEQ ID NO: 107071
  Synthetic Polynucleotide

SEQ ID NO: 111255 - DNA, 103 bp, Artificial Sequence; identical to SEQ ID NO: 107072
  Synthetic Polynucleotide

SEQ ID NO: 111256 - DNA, 103 bp, Artificial Sequence; identical to SEQ ID NO: 107073
  Synthetic Polynucleotide

SEQ ID NO: 111257 - DNA, 103 bp, Artificial Sequence; identical to SEQ ID NO: 107074
  Synthetic Polynucleotide

SEQ ID NO: 111258 - DNA, 103 bp, Artificial Sequence; identical to SEQ ID NO: 107075
  Synthetic Polynucleotide

SEQ ID NO: 111259 - DNA, 103 bp, Artificial Sequence; identical to SEQ ID NO: 107076
  Synthetic Polynucleotide

SEQ ID NO: 111260 - DNA, 103 bp, Artificial Sequence; identical to SEQ ID NO: 107077
  Synthetic Polynucleotide

SEQ ID NO: 111261 - DNA, 103 bp, Artificial Sequence; identical to SEQ ID NO: 107078
  Synthetic Polynucleotide

SEQ ID NO: 111262 - DNA, 103 bp, Artificial Sequence; identical to SEQ ID NO: 107079
  Synthetic Polynucleotide

SEQ ID NO: 111263 - DNA, 103 bp, Artificial Sequence; identical to SEQ ID NO: 107080
  Synthetic Polynucleotide

SEQ ID NO: 111264 - DNA, 103 bp, Artificial Sequence; identical to SEQ ID NO: 107081
  Synthetic Polynucleotide

SEQ ID NO: 111265 - DNA, 103 bp, Artificial Sequence; identical to SEQ ID NO: 107082
  Synthetic Polynucleotide

SEQ ID NO: 111266 - DNA, 103 bp, Artificial Sequence; identical to SEQ ID NO: 107083
  Synthetic Polynucleotide

SEQ ID NO: 111267 - DNA, 103 bp, Artificial Sequence; identical to SEQ ID NO: 107084
  Synthetic Polynucleotide

SEQ ID NO: 111268 - DNA, 103 bp, Artificial Sequence; identical to SEQ ID NO: 107085
  Synthetic Polynucleotide

SEQ ID NO: 111269 - DNA, 103 bp, Artificial Sequence; identical to SEQ ID NO: 107086
  Synthetic Polynucleotide

SEQ ID NO: 111270 - DNA, 103 bp, Artificial Sequence; identical to SEQ ID NO: 107087
  Synthetic Polynucleotide

SEQ ID NO: 111271 - DNA, 103 bp, Artificial Sequence; identical to SEQ ID NO: 107088
  Synthetic Polynucleotide

SEQ ID NO: 111272 - DNA, 103 bp, Artificial Sequence; identical to SEQ ID NO: 107089
  Synthetic Polynucleotide

SEQ ID NO: 111273 - DNA, 103 bp, Artificial Sequence; identical to SEQ ID NO: 107090
  Synthetic Polynucleotide

SEQ ID NO: 111274 - DNA, 103 bp, Artificial Sequence; identical to SEQ ID NO: 107091
  Synthetic Polynucleotide

SEQ ID NO: 111275 - DNA, 103 bp, Artificial Sequence; identical to SEQ ID NO: 107092
  Synthetic Polynucleotide

SEQ ID NO: 111276 - DNA, 103 bp, Artificial Sequence; identical to SEQ ID NO: 107093
  Synthetic Polynucleotide

SEQ ID NO: 111277 - DNA, 103 bp, Artificial Sequence; identical to SEQ ID NO: 107094
  Synthetic Polynucleotide

SEQ ID NO: 111278 - DNA, 103 bp, Artificial Sequence; identical to SEQ ID NO: 107095
  Synthetic Polynucleotide

SEQ ID NO: 111279 - DNA, 103 bp, Artificial Sequence; identical to SEQ ID NO: 107096
  Synthetic Polynucleotide

SEQ ID NO: 111280 - DNA, 103 bp, Artificial Sequence; identical to SEQ ID NO: 107097
  Synthetic Polynucleotide

SEQ ID NO: 111281 - DNA, 103 bp, Artificial Sequence; identical to SEQ ID NO: 107098
  Synthetic Polynucleotide

SEQ ID NO: 111282 - DNA, 103 bp, Artificial Sequence; identical to SEQ ID NO: 107099
  Synthetic Polynucleotide

SEQ ID NO: 111283 - DNA, 103 bp, Artificial Sequence; identical to SEQ ID NO: 107100
  Synthetic Polynucleotide

SEQ ID NO: 111284 - DNA, 103 bp, Artificial Sequence; identical to SEQ ID NO: 107101
  Synthetic Polynucleotide

SEQ ID NO: 111285 - DNA, 103 bp, Artificial Sequence; identical to SEQ ID NO: 107102
  Synthetic Polynucleotide

SEQ ID NO: 111286 - DNA, 103 bp, Artificial Sequence; identical to SEQ ID NO: 107103
  Synthetic Polynucleotide

SEQ ID NO: 111287 - DNA, 103 bp, Artificial Sequence; identical to SEQ ID NO: 107104
  Synthetic Polynucleotide

SEQ ID NO: 111288 - DNA, 103 bp, Artificial Sequence; identical to SEQ ID NO: 107105
  Synthetic Polynucleotide

SEQ ID NO: 111289 - DNA, 103 bp, Artificial Sequence; identical to SEQ ID NO: 107106
  Synthetic Polynucleotide

SEQ ID NO: 111290 - DNA, 103 bp, Artificial Sequence; identical to SEQ ID NO: 107107
  Synthetic Polynucleotide

SEQ ID NO: 111291 - DNA, 103 bp, Artificial Sequence; identical to SEQ ID NO: 107108
  Synthetic Polynucleotide

SEQ ID NO: 111292 - DNA, 103 bp, Artificial Sequence; identical to SEQ ID NO: 107109
  Synthetic Polynucleotide

SEQ ID NO: 111293 - DNA, 103 bp, Artificial Sequence; identical to SEQ ID NO: 107110
  Synthetic Polynucleotide

SEQ ID NO: 111294 - DNA, 103 bp, Artificial Sequence; identical to SEQ ID NO: 107111
  Synthetic Polynucleotide

SEQ ID NO: 111295 - DNA, 103 bp, Artificial Sequence; identical to SEQ ID NO: 107112
  Synthetic Polynucleotide

SEQ ID NO: 111296 - DNA, 103 bp, Artificial Sequence; identical to SEQ ID NO: 107113
  Synthetic Polynucleotide

SEQ ID NO: 111297 - DNA, 103 bp, Artificial Sequence; identical to SEQ ID NO: 107114
  Synthetic Polynucleotide

SEQ ID NO: 111298 - DNA, 103 bp, Artificial Sequence; identical to SEQ ID NO: 107115
  Synthetic Polynucleotide

SEQ ID NO: 111299 - DNA, 103 bp, Artificial Sequence; identical to SEQ ID NO: 107116
  Synthetic Polynucleotide

SEQ ID NO: 111300 - DNA, 103 bp, Artificial Sequence; identical to SEQ ID NO: 107117
  Synthetic Polynucleotide

SEQ ID NO: 111301 - DNA, 103 bp, Artificial Sequence; identical to SEQ ID NO: 107118
  Synthetic Polynucleotide

SEQ ID NO: 111302 - DNA, 103 bp, Artificial Sequence; identical to SEQ ID NO: 107119
  Synthetic Polynucleotide

SEQ ID NO: 111303 - DNA, 103 bp, Artificial Sequence; identical to SEQ ID NO: 107120
  Synthetic Polynucleotide

SEQ ID NO: 111304 - DNA, 103 bp, Artificial Sequence; identical to SEQ ID NO: 107121
  Synthetic Polynucleotide

SEQ ID NO: 111305 - DNA, 103 bp, Artificial Sequence; identical to SEQ ID NO: 107122
  Synthetic Polynucleotide

SEQ ID NO: 111306 - DNA, 103 bp, Artificial Sequence; identical to SEQ ID NO: 107123
  Synthetic Polynucleotide

SEQ ID NO: 111307 - DNA, 103 bp, Artificial Sequence; identical to SEQ ID NO: 107124
  Synthetic Polynucleotide

SEQ ID NO: 111308 - DNA, 103 bp, Artificial Sequence; identical to SEQ ID NO: 107125
  Synthetic Polynucleotide

SEQ ID NO: 111309 - DNA, 103 bp, Artificial Sequence; identical to SEQ ID NO: 107126
  Synthetic Polynucleotide

SEQ ID NO: 111310 - DNA, 103 bp, Artificial Sequence; identical to SEQ ID NO: 107127
  Synthetic Polynucleotide

SEQ ID NO: 111311 - DNA, 103 bp, Artificial Sequence; identical to SEQ ID NO: 107128
  Synthetic Polynucleotide

SEQ ID NO: 111312 - DNA, 103 bp, Artificial Sequence; identical to SEQ ID NO: 107129
  Synthetic Polynucleotide

SEQ ID NO: 111313 - DNA, 103 bp, Artificial Sequence; identical to SEQ ID NO: 107130
  Synthetic Polynucleotide

SEQ ID NO: 111314 - DNA, 103 bp, Artificial Sequence; identical to SEQ ID NO: 107131
  Synthetic Polynucleotide

SEQ ID NO: 111315 - DNA, 103 bp, Artificial Sequence
  Synthetic Polynucleotide
taatacgactcactataggggccgcccgcaggggccccggccaaggccataacagaggagaatggccatggccggggccaacctggcggcagcgcaaaagatg

SEQ ID NO: 111316 - DNA, 103 bp, Artificial Sequence
  Synthetic Polynucleotide
taatacgactcactatagggctgcgcggcggagatgatgacgatctgcgaaacagaggagatcgcagatggtcatcatcaacctggcggcagcgcaaaagatg

SEQ ID NO: 111317 - DNA, 103 bp, Artificial Sequence
  Synthetic Polynucleotide
taatacgactcactatagggtgaggggggagatgatggtggtggtgacacaacagaggagagtgtcaatgccaccatcaaacctggcggcagcgcaaaagatg

SEQ ID NO: 111318 - DNA, 103 bp, Artificial Sequence
  Synthetic Polynucleotide
taatacgactcactatagggtggtgagggatgaggggggagatgatggtgaacagaggagacaccatatgctcccccctaacctggcggcagcgcaaaagatg

SEQ ID NO: 111319 - DNA, 103 bp, Artificial Sequence
  Synthetic Polynucleotide
taatacgactcactatagggctgggatctgtggtgagggatgaggggggaaacagaggagatcccccatgatccctcacaacctggcggcagcgcaaaagatg

SEQ ID NO: 111320 - DNA, 103 bp, Artificial Sequence
  Synthetic Polynucleotide
taatacgactcactatagggtagagactggctgggatctgtggtgagggaaacagaggagatccctcatgacagatcccaacctggcggcagcgcaaaagatg

SEQ ID NO: 111321 - DNA, 103 bp, Artificial Sequence
  Synthetic Polynucleotide
taatacgactcactatagggccaggctgagtagagactggctgggatctgaacagaggagacagatcatggccagtctcaacctggcggcagcgcaaaagatg

SEQ ID NO: 111322 - DNA, 103 bp, Artificial Sequence
  Synthetic Polynucleotide
taatacgactcactatagggggttcttgctccaggctgagtagagactggaacagaggagaccagtcatgactcagcctaacctggcggcagcgcaaaagatg

SEQ ID NO: 111323 - DNA, 103 bp, Artificial Sequence
  Synthetic Polynucleotide
taatacgactcactatagggggacaacagcggttcttgctccaggctgagaacagaggagactcagcatggagcaagaaaacctggcggcagcgcaaaagatg

SEQ ID NO: 111324 - DNA, 103 bp, Artificial Sequence
  Synthetic Polynucleotide
taatacgactcactatagggtgcccatccgggacaacagcggttcttgctaacagaggagaagcaagatgcgctgttgtaacctggcggcagcgcaaaagatg

SEQ ID NO: 111325 - DNA, 103 bp, Artificial Sequence
  Synthetic Polynucleotide
taatacgactcactataggggcccgcaggctgcccatccgggacaacagcaacagaggagagctgttatgccggatgggaacctggcggcagcgcaaaagatg

SEQ ID NO: 111326 - DNA, 103 bp, Artificial Sequence
  Synthetic Polynucleotide
taatacgactcactataggggtccacgggagcccgcaggctgcccatccgaacagaggagacggatgatgagcctgcggaacctggcggcagcgcaaaagatg

SEQ ID NO: 111327 - DNA, 103 bp, Artificial Sequence
  Synthetic Polynucleotide
taatacgactcactatagggcgctggcgtcctgcgcggcggagatgatgaaacagaggagatcatcaatgccgccgcgcaacctggcggcagcgcaaaagatg

SEQ ID NO: 111328 - DNA, 103 bp, Artificial Sequence
  Synthetic Polynucleotide
taatacgactcactatagggggcggtcctcgtccacgggagcccgcaggcaacagaggagagcctgcatgctcccgtggaacctggcggcagcgcaaaagatg

SEQ ID NO: 111329 - DNA, 103 bp, Artificial Sequence
  Synthetic Polynucleotide
taatacgactcactatagggagcggggacaggcggtcctcgtccacgggaaacagaggagatcccgtatgcgaggaccgaacctggcggcagcgcaaaagatg

SEQ ID NO: 111330 - DNA, 103 bp, Artificial Sequence
  Synthetic Polynucleotide
taatacgactcactatagggggccgccaccagcggggacaggcggtcctcaacagaggagagaggacatgctgtccccgaacctggcggcagcgcaaaagatg

SEQ ID NO: 111331 - DNA, 103 bp, Artificial Sequence
  Synthetic Polynucleotide
taatacgactcactatagggggagcgagtcggccgccaccagcggggacaaacagaggagatgtcccatgtggtggcggaacctggcggcagcgcaaaagatg

SEQ ID NO: 111332 - DNA, 103 bp, Artificial Sequence
  Synthetic Polynucleotide
taatacgactcactatagggacatgctccaggagcgagtcggccgccaccaacagaggagaggtggcatgcgactcgctaacctggcggcagcgcaaaagatg

SEQ ID NO: 111333 - DNA, 103 bp, Artificial Sequence
  Synthetic Polynucleotide
taatacgactcactataggggtcctcccgcacatgctccaggagcgagtcaacagaggagagactcgatgctggagcataacctggcggcagcgcaaaagatg

SEQ ID NO: 111334 - DNA, 103 bp, Artificial Sequence
  Synthetic Polynucleotide
taatacgactcactatagggggccggagaagtcctcccgcacatgctccaaacagaggagatggagcatgtgcgggaggaacctggcggcagcgcaaaagatg

SEQ ID NO: 111335 - DNA, 103 bp, Artificial Sequence
  Synthetic Polynucleotide
taatacgactcactatagggtcagggaggaggccggagaagtcctcccgcaacagaggagagcgggaatgcttctccggaacctggcggcagcgcaaaagatg

SEQ ID NO: 111336 - DNA, 103 bp, Artificial Sequence
  Synthetic Polynucleotide
taatacgactcactataggggatgaactcctcagggaggaggccggagaaaacagaggagattctccatgctcctccctaacctggcggcagcgcaaaagatg

SEQ ID NO: 111337 - DNA, 103 bp, Artificial Sequence
  Synthetic Polynucleotide
taatacgactcactataggggggaaaggctgatgaactcctcagggaggaaacagaggagatcctccatgaggagttcaaacctggcggcagcgcaaaagatg

SEQ ID NO: 111338 - DNA, 103 bp, Artificial Sequence
  Synthetic Polynucleotide
taatacgactcactataggggccggcggggcgctggcgtcctgcgcggcgaacagaggagacgccgcatgggacgccagaacctggcggcagcgcaaaagatg

SEQ ID NO: 111339 - DNA, 103 bp, Artificial Sequence
  Synthetic Polynucleotide
taatacgactcactatagggtcgtggggtggggaaaggctgatgaactccaacagaggagaggagttatgcagcctttcaacctggcggcagcgcaaaagatg

SEQ ID NO: 111340 - DNA, 103 bp, Artificial Sequence
  Synthetic Polynucleotide
taatacgactcactataggggtcgagggcctcgtggggtggggaaaggctaacagaggagaagccttatgccaccccacaacctggcggcagcgcaaaagatg

SEQ ID NO: 111341 - DNA, 103 bp, Artificial Sequence
  Synthetic Polynucleotide
taatacgactcactatagggcgaagtggtagtcgagggcctcgtggggtgaacagaggagacaccccatgaggccctcgaacctggcggcagcgcaaaagatg

SEQ ID NO: 111342 - DNA, 103 bp, Artificial Sequence
  Synthetic Polynucleotide
taatacgactcactatagggtcctcgaggccgaagtggtagtcgagggccaacagaggagaggccctatgctaccacttaacctggcggcagcgcaaaagatg

SEQ ID NO: 111343 - DNA, 103 bp, Artificial Sequence
  Synthetic Polynucleotide
taatacgactcactataggggccctcgccctcctcgaggccgaagtggtaaacagaggagataccacatgggcctcgagaacctggcggcagcgcaaaagatg

SEQ ID NO: 111344 - DNA, 103 bp, Artificial Sequence
  Synthetic Polynucleotide
taatacgactcactatagggggtctctgatgccctcgccctcctcgaggcaacagaggagagcctcgatgagggcgaggaacctggcggcagcgcaaaagatg

SEQ ID NO: 111345 - DNA, 103 bp, Artificial Sequence
  Synthetic Polynucleotide
taatacgactcactatagggcagtcgaagaggtctctgatgccctcgcccaacagaggagagggcgaatgcatcagagaaacctggcggcagcgcaaaagatg

SEQ ID NO: 111346 - DNA, 103 bp, Artificial Sequence
  Synthetic Polynucleotide
taatacgactcactatagggcccaaagtcacagtcgaagaggtctctgataacagaggagaatcagaatgctcttcgacaacctggcggcagcgcaaaagatg

SEQ ID NO: 111347 - DNA, 103 bp, Artificial Sequence
  Synthetic Polynucleotide
taatacgactcactataggggggtgaggtccccaaagtcacagtcgaagaaacagaggagatcttcgatggtgactttgaacctggcggcagcgcaaaagatg

SEQ ID NO: 111348 - DNA, 103 bp, Artificial Sequence
  Synthetic Polynucleotide
taatacgactcactatagggaaatccaggggggtgaggtccccaaagtcaaacagaggagatgacttatgggacctcacaacctggcggcagcgcaaaagatg

SEQ ID NO: 111349 - DNA, 103 bp, Artificial Sequence
  Synthetic Polynucleotide
taatacgactcactataggggccggtgggagccggcggggcgctggcgtcaacagaggagagacgccatggccccgccgaacctggcggcagcgcaaaagatg

SEQ ID NO: 111350 - DNA, 103 bp, Artificial Sequence
  Synthetic Polynucleotide
taatacgactcactataggggcgccgcggggccggtgggagccggcggggaacagaggagaccccgcatgctcccaccgaacctggcggcagcgcaaaagatg

SEQ ID NO: 111351 - DNA, 103 bp, Artificial Sequence
  Synthetic Polynucleotide
taatacgactcactatagggccggcggcgggcgccgcggggccggtgggaaacagaggagatcccacatgccccgcggcaacctggcggcagcgcaaaagatg

SEQ ID NO: 111352 - DNA, 103 bp, Artificial Sequence
  Synthetic Polynucleotide
taatacgactcactataggggtcgcaggggccggcggcgggcgccgcgggaacagaggagacccgcgatgcccgccgccaacctggcggcagcgcaaaagatg

SEQ ID NO: 111353 - DNA, 103 bp, Artificial Sequence
  Synthetic Polynucleotide
taatacgactcactataggggcaggtcagggtcgcaggggccggcggcggaacagaggagaccgccgatggcccctgcgaacctggcggcagcgcaaaagatg

SEQ ID NO: 111354 - DNA, 103 bp, Artificial Sequence
  Synthetic Polynucleotide
taatacgactcactataggggcgaagagcagcaggtcagggtcgcaggggaacagaggagacccctgatgccctgacctaacctggcggcagcgcaaaagatg

SEQ ID NO: 111355 - DNA, 103 bp, Artificial Sequence
  Synthetic Polynucleotide
taatacgactcactatagggctgcggtgtggcgaagagcagcaggtcaggaacagaggagacctgacatgctgctcttcaacctggcggcagcgcaaaagatg

SEQ ID NO: 111356 - DNA, 103 bp, Artificial Sequence
  Synthetic Polynucleotide
taatacgactcactataggggcgcgcatgggccgcccgcaggggccccggaacagaggagaccggggatgctgcgggcgaacctggcggcagcgcaaaagatg

SEQ ID NO: 111357 - DNA, 103 bp, Artificial Sequence
  Synthetic Polynucleotide
taatacgactcactataggggccggggcgcctgcggtgtggcgaagagcaaacagaggagatgctctatgccacaccgcaacctggcggcagcgcaaaagatg

SEQ ID NO: 111358 - DNA, 103 bp, Artificial Sequence
  Synthetic Polynucleotide
taatacgactcactatagggctgggtgtgggccggggcgcctgcggtgtgaacagaggagacacaccatgggcgccccgaacctggcggcagcgcaaaagatg

SEQ ID NO: 111359 - DNA, 103 bp, Artificial Sequence
  Synthetic Polynucleotide
taatacgactcactatagggccgcggcgcactgggtgtgggccggggcgcaacagaggagagcgcccatgcccacacccaacctggcggcagcgcaaaagatg

SEQ ID NO: 111360 - DNA, 103 bp, Artificial Sequence
  Synthetic Polynucleotide
taatacgactcactatagggcgagcgcgggccgcggcgcactgggtgtggaacagaggagaccacacatggtgcgccgcaacctggcggcagcgcaaaagatg

SEQ ID NO: 111361 - DNA, 103 bp, Artificial Sequence
  Synthetic Polynucleotide
taatacgactcactatagggggcgggcggccgagcgcgggccgcggcgcaaacagaggagatgcgccatggcccgcgctaacctggcggcagcgcaaaagatg

SEQ ID NO: 111362 - DNA, 103 bp, Artificial Sequence
  Synthetic Polynucleotide
taatacgactcactatagggccgcttcaccggcgggcggccgagcgcgggaacagaggagacccgcgatgggccgcccgaacctggcggcagcgcaaaagatg

SEQ ID NO: 111363 - DNA, 103 bp, Artificial Sequence
  Synthetic Polynucleotide
taatacgactcactatagggggtccagcctccgcttcaccggcgggcggcaacagaggagagccgccatgcggtgaagcaacctggcggcagcgcaaaagatg

SEQ ID NO: 111364 - DNA, 103 bp, Artificial Sequence
  Synthetic Polynucleotide
taatacgactcactatagggtcagtttccaggtccagcctccgcttcaccaacagaggagaggtgaaatggaggctggaaacctggcggcagcgcaaaagatg

SEQ ID NO: 111365 - DNA, 103 bp, Artificial Sequence
  Synthetic Polynucleotide
taatacgactcactataggggtactgatggtcagtttccaggtccagcctaacagaggagaaggctgatgctggaaactaacctggcggcagcgcaaaagatg

SEQ ID NO: 111366 - DNA, 103 bp, Artificial Sequence
  Synthetic Polynucleotide
taatacgactcactatagggtctcggccaggtactgatggtcagtttccaaacagaggagatggaaaatgaccatcagtaacctggcggcagcgcaaaagatg

SEQ ID NO: 111367 - DNA, 103 bp, Artificial Sequence
  Synthetic Polynucleotide
taatacgactcactatagggtccagcgccggcgcgcatgggccgcccgcaaacagaggagatgcgggatgcccatgcgcaacctggcggcagcgcaaaagatg

SEQ ID NO: 111368 - DNA, 103 bp, Artificial Sequence
  Synthetic Polynucleotide
taatacgactcactatagggggcccactgctctcggccaggtactgatggaacagaggagaccatcaatgcctggccgaaacctggcggcagcgcaaaagatg

SEQ ID NO: 111369 - DNA, 103 bp, Artificial Sequence
  Synthetic Polynucleotide
taatacgactcactataggggccccgagctggcccactgctctcggccagaacagaggagactggccatgagcagtgggaacctggcggcagcgcaaaagatg

SEQ ID NO: 111370 - DNA, 103 bp, Artificial Sequence
  Synthetic Polynucleotide
taatacgactcactatagggggcggcctctgccccgagctggcccactgcaacagaggagagcagtgatgcagctcgggaacctggcggcagcgcaaaagatg

SEQ ID NO: 111371 - DNA, 103 bp, Artificial Sequence
  Synthetic Polynucleotide
taatacgactcactatagggtttcctggatggcggcctctgccccgagctaacagaggagaagctcgatgcagaggccgaacctggcggcagcgcaaaagatg

SEQ ID NO: 111372 - DNA, 103 bp, Artificial Sequence
  Synthetic Polynucleotide
taatacgactcactatagggtttcacaccttttcctggatggcggcctctaacagaggagaagaggcatgcatccaggaaacctggcggcagcgcaaaagatg

SEQ ID NO: 111373 - DNA, 103 bp, Artificial Sequence
  Synthetic Polynucleotide
taatacgactcactatagggcccccggggatttcacaccttttcctggataacagaggagaatccagatgaaggtgtgaaacctggcggcagcgcaaaagatg

SEQ ID NO: 111374 - DNA, 103 bp, Artificial Sequence
  Synthetic Polynucleotide
taatacgactcactatagggcgtgacttctcccccggggatttcacacctaacagaggagaaggtgtatgatccccgggaacctggcggcagcgcaaaagatg

SEQ ID NO: 111375 - DNA, 103 bp, Artificial Sequence
  Synthetic Polynucleotide
taatacgactcactatagggggtctcatagcgtgacttctcccccggggaaacagaggagatccccgatggagaagtcaaacctggcggcagcgcaaaagatg

SEQ ID NO: 111376 - DNA, 103 bp, Artificial Sequence
  Synthetic Polynucleotide
taatacgactcactataggggattcagtgaggtctcatagcgtgacttctaacagaggagaagaagtatggctatgagaaacctggcggcagcgcaaaagatg

SEQ ID NO: 111377 - DNA, 103 bp, Artificial Sequence
  Synthetic Polynucleotide
taatacgactcactatagggttggtggtcagattcagtgaggtctcatagaacagaggagactatgaatgctcactgaaaacctggcggcagcgcaaaagatg

SEQ ID NO: 111378 - DNA, 103 bp, Artificial Sequence
  Synthetic Polynucleotide
taatacgactcactataggggagcagggcctccagcgccggcgcgcatggaacagaggagaccatgcatgccggcgctgaacctggcggcagcgcaaaagatg

SEQ ID NO: 111379 - DNA, 103 bp, Artificial Sequence
  Synthetic Polynucleotide
taatacgactcactatagggcaggaagcgcttggtggtcagattcagtgaaacagaggagatcactgatgctgaccaccaacctggcggcagcgcaaaagatg

SEQ ID NO: 111380 - DNA, 103 bp, Artificial Sequence
  Synthetic Polynucleotide
taatacgactcactatagggtcagcagctccaggaagcgcttggtggtcaaacagaggagatgaccaatgagcgcttccaacctggcggcagcgcaaaagatg

SEQ ID NO: 111381 - DNA, 103 bp, Artificial Sequence
  Synthetic Polynucleotide
taatacgactcactataggggccgagtggctcagcagctccaggaagcgcaacagaggagagcgcttatgggagctgctaacctggcggcagcgcaaaagatg

SEQ ID NO: 111382 - DNA, 103 bp, Artificial Sequence
  Synthetic Polynucleotide
taatacgactcactataggggacaccgtcagccgagtggctcagcagctcaacagaggagagagctgatgagccactcgaacctggcggcagcgcaaaagatg

SEQ ID NO: 111383 - DNA, 103 bp, Artificial Sequence
  Synthetic Polynucleotide
taatacgactcactatagggtcaggtcgacgacaccgtcagccgagtggcaacagaggagagccactatgctgacggtgaacctggcggcagcgcaaaagatg

SEQ ID NO: 111384 - DNA, 103 bp, Artificial Sequence
  Synthetic Polynucleotide
taatacgactcactataggggcagcccagttcaggtcgacgacaccgtcaaacagaggagatgacggatgcgtcgacctaacctggcggcagcgcaaaagatg

SEQ ID NO: 111385 - DNA, 103 bp, Artificial Sequence
  Synthetic Polynucleotide
taatacgactcactatagggcagcacctcggcagcccagttcaggtcgacaacagaggagagtcgacatgaactgggctaacctggcggcagcgcaaaagatg

SEQ ID NO: 111386 - DNA, 103 bp, Artificial Sequence
  Synthetic Polynucleotide
taatacgactcactatagggtctgcaccttcagcacctcggcagcccagtaacagaggagaactgggatgccgaggtgcaacctggcggcagcgcaaaagatg

SEQ ID NO: 111387 - DNA, 103 bp, Artificial Sequence
  Synthetic Polynucleotide
taatacgactcactatagggatgcgccgcttctgcaccttcagcacctcgaacagaggagacgaggtatggaaggtgcaaacctggcggcagcgcaaaagatg

SEQ ID NO: 111388 - DNA, 103 bp, Artificial Sequence
  Synthetic Polynucleotide
taatacgactcactataggggatgtcatagatgcgccgcttctgcaccttaacagaggagaaaggtgatgaagcggcgcaacctggcggcagcgcaaaagatg

SEQ ID NO: 111389 - DNA, 103 bp, Artificial Sequence
  Synthetic Polynucleotide
taatacgactcactatagggcgccggccccgagcagggcctccagcgccgaacagaggagacggcgcatgaggccctgcaacctggcggcagcgcaaaagatg

SEQ ID NO: 111390 - DNA, 103 bp, Artificial Sequence
  Synthetic Polynucleotide
taatacgactcactatagggggacgttggtgatgtcatagatgcgccgctaacagaggagaagcggcatgtctatgacaaacctggcggcagcgcaaaagatg

SEQ ID NO: 111391 - DNA, 103 bp, Artificial Sequence
  Synthetic Polynucleotide
taatacgactcactatagggatgccctcaaggacgttggtgatgtcatagaacagaggagactatgaatgcaccaacgtaacctggcggcagcgcaaaagatg

SEQ ID NO: 111392 - DNA, 103 bp, Artificial Sequence
  Synthetic Polynucleotide
taatacgactcactatagggaatgagctggatgccctcaaggacgttggtaacagaggagaaccaacatgcttgagggcaacctggcggcagcgcaaaagatg

SEQ ID NO: 111393 - DNA, 103 bp, Artificial Sequence
  Synthetic Polynucleotide
taatacgactcactatagggacttcttggcaatgagctggatgccctcaaaacagaggagattgaggatgtccagctcaaacctggcggcagcgcaaaagatg

SEQ ID NO: 111394 - DNA, 103 bp, Artificial Sequence
  Synthetic Polynucleotide
taatacgactcactatagggtggttcttggacttcttggcaatgagctggaacagaggagaccagctatgtgccaagaaaacctggcggcagcgcaaaagatg

SEQ ID NO: 111395 - DNA, 103 bp, Artificial Sequence
  Synthetic Polynucleotide
taatacgactcactatagggccactggatgtggttcttggacttcttggcaacagaggagagccaagatgtccaagaacaacctggcggcagcgcaaaagatg

SEQ ID NO: 111396 - DNA, 103 bp, Artificial Sequence
  Synthetic Polynucleotide
taatacgactcactatagggggctgcccagccactggatgtggttcttggaacagaggagaccaagaatgacatccagtaacctggcggcagcgcaaaagatg

SEQ ID NO: 111397 - DNA, 103 bp, Artificial Sequence
  Synthetic Polynucleotide
taatacgactcactatagggactgtggtgtggctgcccagccactggatgaacagaggagacatccaatggctgggcagaacctggcggcagcgcaaaagatg

SEQ ID NO: 111398 - DNA, 103 bp, Artificial Sequence
  Synthetic Polynucleotide
taatacgactcactataggggccgacgcccactgtggtgtggctgcccagaacagaggagactgggcatgcacaccacaaacctggcggcagcgcaaaagatg

SEQ ID NO: 111399 - DNA, 103 bp, Artificial Sequence
  Synthetic Polynucleotide
taatacgactcactatagggcaagccgtccgccgacgcccactgtggtgtaacagaggagaacaccaatgtgggcgtcgaacctggcggcagcgcaaaagatg

SEQ ID NO: 111400 - DNA, 103 bp, Artificial Sequence
  Synthetic Polynucleotide
taatacgactcactatagggagccgcagcgcgccggccccgagcagggccaacagaggagaggccctatgcggggccggaacctggcggcagcgcaaaagatg

SEQ ID NO: 111401 - DNA, 103 bp, Artificial Sequence
  Synthetic Polynucleotide
taatacgactcactataggggtcaacccctcaagccgtccgccgacgcccaacagaggagagggcgtatgcggacggctaacctggcggcagcgcaaaagatg

SEQ ID NO: 111402 - DNA, 103 bp, Artificial Sequence
  Synthetic Polynucleotide
taatacgactcactataggggaggtcctgggtcaacccctcaagccgtccaacagaggagaggacggatggaggggttgaacctggcggcagcgcaaaagatg

SEQ ID NO: 111403 - DNA, 103 bp, Artificial Sequence
  Synthetic Polynucleotide
taatacgactcactataggggcagctgtcggaggtcctgggtcaacccctaacagaggagaaggggtatgcccaggaccaacctggcggcagcgcaaaagatg

SEQ ID NO: 111404 - DNA, 103 bp, Artificial Sequence
  Synthetic Polynucleotide
taatacgactcactatagggtcgctctcctgcagctgtcggaggtcctggaacagaggagaccaggaatgccgacagctaacctggcggcagcgcaaaagatg

SEQ ID NO: 111405 - DNA, 103 bp, Artificial Sequence
  Synthetic Polynucleotide
taatacgactcactatagggcagctgctgctcgctctcctgcagctgtcgaacagaggagacgacagatgcaggagagcaacctggcggcagcgcaaaagatg

SEQ ID NO: 111406 - DNA, 103 bp, Artificial Sequence
  Synthetic Polynucleotide
taatacgactcactatagggtcaggtggtccagctgctgctcgctctcctaacagaggagaaggagaatgagcagcagcaacctggcggcagcgcaaaagatg

SEQ ID NO: 111407 - DNA, 103 bp, Artificial Sequence
  Synthetic Polynucleotide
taatacgactcactatagggcagatattcatcaggtggtccagctgctgcaacagaggagagcagcaatgggaccacctaacctggcggcagcgcaaaagatg

SEQ ID NO: 111408 - DNA, 103 bp, Artificial Sequence
  Synthetic Polynucleotide
taatacgactcactatagggctgcgtagtacagatattcatcaggtggtcaacagaggagagaccacatgatgaatatcaacctggcggcagcgcaaaagatg

SEQ ID NO: 111409 - DNA, 103 bp, Artificial Sequence
  Synthetic Polynucleotide
taatacgactcactataggggcaggcgcagctgcgtagtacagatattcaaacagaggagatgaataatggtactacgcaacctggcggcagcgcaaaagatg

SEQ ID NO: 111410 - DNA, 103 bp, Artificial Sequence
  Synthetic Polynucleotide
taatacgactcactatagggtcctcggagagcaggcgcagctgcgtagtaaacagaggagatactacatggctgcgcctaacctggcggcagcgcaaaagatg

SEQ ID NO: 111411 - DNA, 103 bp, Artificial Sequence
  Synthetic Polynucleotide
taatacgactcactatagggggagtcgagcagccgcagcgcgccggccccaacagaggagaggggccatggcgctgcggaacctggcggcagcgcaaaagatg

SEQ ID NO: 111412 - DNA, 103 bp, Artificial Sequence
  Synthetic Polynucleotide
taatacgactcactataggggctgtcagtgtcctcggagagcaggcgcagaacagaggagactgcgcatgctctccgagaacctggcggcagcgcaaaagatg

SEQ ID NO: 111413 - DNA, 103 bp, Artificial Sequence
  Synthetic Polynucleotide
taatacgactcactatagggccaggcgctggctgtcagtgtcctcggagaaacagaggagatctccgatgacactgacaaacctggcggcagcgcaaaagatg

SEQ ID NO: 111414 - DNA, 103 bp, Artificial Sequence
  Synthetic Polynucleotide
taatacgactcactataggggtcacgtaggccaggcgctggctgtcagtgaacagaggagacactgaatgccagcgcctaacctggcggcagcgcaaaagatg

SEQ ID NO: 111415 - DNA, 103 bp, Artificial Sequence
  Synthetic Polynucleotide
taatacgactcactataggggtcctgacacgtcacgtaggccaggcgctgaacagaggagacagcgcatggcctacgtgaacctggcggcagcgcaaaagatg

SEQ ID NO: 111416 - DNA, 103 bp, Artificial Sequence
  Synthetic Polynucleotide
taatacgactcactatagggtgctacgaaggtcctgacacgtcacgtaggaacagaggagacctacgatgcgtgtcaggaacctggcggcagcgcaaaagatg

SEQ ID NO: 111417 - DNA, 103 bp, Artificial Sequence
  Synthetic Polynucleotide
taatacgactcactataggggggtctgcaatgctacgaaggtcctgacacaacagaggagagtgtcaatgccttcgtagaacctggcggcagcgcaaaagatg

SEQ ID NO: 111418 - DNA, 103 bp, Artificial Sequence
  Synthetic Polynucleotide
taatacgactcactatagggctgctctgcagggtctgcaatgctacgaagaacagaggagacttcgtatgattgcagacaacctggcggcagcgcaaaagatg

SEQ ID NO: 111419 - DNA, 103 bp, Artificial Sequence
  Synthetic Polynucleotide
taatacgactcactatagggccataaccatctgctctgcagggtctgcaaaacagaggagattgcagatgctgcagagcaacctggcggcagcgcaaaagatg

SEQ ID NO: 111420 - DNA, 103 bp, Artificial Sequence
  Synthetic Polynucleotide
taatacgactcactataggggctttgatcaccataaccatctgctctgcaaacagaggagatgcagaatggatggttataacctggcggcagcgcaaaagatg

SEQ ID NO: 111421 - DNA, 103 bp, Artificial Sequence
  Synthetic Polynucleotide
taatacgactcactatagggctcaggaggggctttgatcaccataaccataacagaggagaatggttatggtgatcaaaaacctggcggcagcgcaaaagatg

SEQ ID NO: 111422 - DNA, 103 bp, Artificial Sequence
  Synthetic Polynucleotide
taatacgactcactatagggcgatctgcgaggagtcgagcagccgcagcgaacagaggagacgctgcatgtgctcgactaacctggcggcagcgcaaaagatg

SEQ ID NO: 111423 - DNA, 103 bp, Artificial Sequence
  Synthetic Polynucleotide
taatacgactcactatagggggagctgggtctcaggaggggctttgatcaaacagaggagatgatcaatgcccctcctgaacctggcggcagcgcaaaagatg

SEQ ID NO: 111424 - DNA, 103 bp, Artificial Sequence
  Synthetic Polynucleotide
taatacgactcactatagggtccacggcttggagctgggtctcaggagggaacagaggagaccctccatggacccagctaacctggcggcagcgcaaaagatg

SEQ ID NO: 111425 - DNA, 103 bp, Artificial Sequence
  Synthetic Polynucleotide
taatacgactcactatagggctccgaagagtccacggcttggagctgggtaacagaggagaacccagatgcaagccgtgaacctggcggcagcgcaaaagatg

SEQ ID NO: 111426 - DNA, 103 bp, Artificial Sequence
  Synthetic Polynucleotide
taatacgactcactatagggtctgaaagttctccgaagagtccacggcttaacagaggagaaagccgatgactcttcggaacctggcggcagcgcaaaagatg

SEQ ID NO: 111427 - DNA, 103 bp, Artificial Sequence
  Synthetic Polynucleotide
taatacgactcactatagggttaagggagatctgaaagttctccgaagagaacagaggagactcttcatggaactttcaaacctggcggcagcgcaaaagatg

SEQ ID NO: 111428 - DNA, 103 bp, Artificial Sequence
  Synthetic Polynucleotide
taatacgactcactatagggttgtttgctcttaagggagatctgaaagttaacagaggagaaactttatgatctcccttaacctggcggcagcgcaaaagatg

SEQ ID NO: 111429 - DNA, 103 bp, Artificial Sequence
  Synthetic Polynucleotide
taatacgactcactatagggcgatcgggccttgtttgctcttaagggagaaacagaggagatctcccatgagagcaaacaacctggcggcagcgcaaaagatg

SEQ ID NO: 111430 - DNA, 103 bp, Artificial Sequence
  Synthetic Polynucleotide
taatacgactcactatagggaggaaaacatcgatcgggccttgtttgctcaacagaggagagagcaaatgaggcccgataacctggcggcagcgcaaaagatg

SEQ ID NO: 111431 - DNA, 103 bp, Artificial Sequence
  Synthetic Polynucleotide
taatacgactcactatagggctcagggcacaggaaaacatcgatcgggccaacagaggagaggcccgatggatgttttcaacctggcggcagcgcaaaagatg

SEQ ID NO: 111432 - DNA, 103 bp, Artificial Sequence
  Synthetic Polynucleotide
taatacgactcactatagggctacggtctcctcagggcacaggaaaacataacagaggagaatgtttatgtgtgccctgaacctggcggcagcgcaaaagatg

SEQ ID NO: 111433 - DNA, 103 bp, Artificial Sequence
  Synthetic Polynucleotide
taatacgactcactataggggagatgatgacgatctgcgaggagtcgagcaacagaggagagctcgaatgctcgcagataacctggcggcagcgcaaaagatg

SEQ ID NO: 111434 - DNA, 103 bp, Artificial Sequence
  Synthetic Polynucleotide
taatacgactcactatagggctgatcccacctacggtctcctcagggcacaacagaggagagtgcccatgggagaccgtaacctggcggcagcgcaaaagatg

SEQ ID NO: 111435 - DNA, 103 bp, Artificial Sequence
  Synthetic Polynucleotide
taatacgactcactatagggcttcccagggctgatcccacctacggtctcaacagaggagagagaccatgggtgggatcaacctggcggcagcgcaaaagatg

SEQ ID NO: 111436 - DNA, 103 bp, Artificial Sequence
  Synthetic Polynucleotide
taatacgactcactataggggggatggggtcttcccagggctgatcccacaacagaggagagtgggaatggccctgggaaacctggcggcagcgcaaaagatg

SEQ ID NO: 111437 - DNA, 103 bp, Artificial Sequence
  Synthetic Polynucleotide
taatacgactcactataggggtgacctcctgggatggggtcttcccagggaacagaggagaccctggatggaccccatcaacctggcggcagcgcaaaagatg

SEQ ID NO: 111438 - DNA, 103 bp, Artificial Sequence
  Synthetic Polynucleotide
taatacgactcactatagggctcctcagaagtgacctcctgggatggggtaacagaggagaaccccaatgcaggaggtcaacctggcggcagcgcaaaagatg

SEQ ID NO: 111439 - DNA, 103 bp, Artificial Sequence
  Synthetic Polynucleotide
taatacgactcactatagggccctgttctcctcctcagaagtgacctcctaacagaggagaaggaggatgcttctgaggaacctggcggcagcgcaaaagatg

SEQ ID NO: 111440 - DNA, 103 bp, Artificial Sequence
  Synthetic Polynucleotide
taatacgactcactataggggagtcagtggccctgttctcctcctcagaaaacagaggagattctgaatgggagaacagaacctggcggcagcgcaaaagatg

SEQ ID NO: 111441 - DNA, 103 bp, Artificial Sequence
  Synthetic Polynucleotide
taatacgactcactatagggtatggtggcagagtcagtggccctgttctcaacagaggagagagaacatggccactgacaacctggcggcagcgcaaaagatg

SEQ ID NO: 111442 - DNA, 103 bp, Artificial Sequence
  Synthetic Polynucleotide
taatacgactcactataggggtggtgacactatggtggcagagtcagtggaacagaggagaccactgatgctgccaccaaacctggcggcagcgcaaaagatg

SEQ ID NO: 111443 - DNA, 103 bp, Artificial Sequence
  Synthetic Polynucleotide
taatacgactcactataggggatgatggtggtggtgacactatggtggcaaacagaggagatgccacatgagtgtcaccaacctggcggcagcgcaaaagatg

SEQ ID NO: 111444 - DNA, 103 bp, Artificial Sequence
  Synthetic Polynucleotide
taatacgactcactatagggcgaagccaaggcccggggcccttgcagcataacagaggagaatgctgatggggccccggaacctggcggcagcgcaaaagatg

SEQ ID NO: 111445 - DNA, 103 bp, Artificial Sequence
  Synthetic Polynucleotide
taatacgactcactatagggagctgggcagagctgggggctgctgaggccaacagaggagaggcctcatgagcccccagaacctggcggcagcgcaaaagatg

SEQ ID NO: 111446 - DNA, 103 bp, Artificial Sequence
  Synthetic Polynucleotide
taatacgactcactataggggctagggtcggtgctgctgctgggctgggcaacagaggagagcccagatgagcagcagcaacctggcggcagcgcaaaagatg

SEQ ID NO: 111447 - DNA, 103 bp, Artificial Sequence
  Synthetic Polynucleotide
taatacgactcactataggggctccatgatgctagggtcggtgctgctgcaacagaggagagcagcaatgccgaccctaaacctggcggcagcgcaaaagatg

SEQ ID NO: 111448 - DNA, 103 bp, Artificial Sequence
  Synthetic Polynucleotide
taatacgactcactataggggatgctgtgggctccatgatgctagggtcgaacagaggagacgacccatgcatcatggaaacctggcggcagcgcaaaagatg

SEQ ID NO: 111449 - DNA, 103 bp, Artificial Sequence
  Synthetic Polynucleotide
taatacgactcactatagggtggcactgaggatgctgtgggctccatgataacagaggagaatcatgatgcccacagcaaacctggcggcagcgcaaaagatg

SEQ ID NO: 111450 - DNA, 103 bp, Artificial Sequence
  Synthetic Polynucleotide
taatacgactcactataggggcgctggtgctggcactgaggatgctgtggaacagaggagaccacagatgcctcagtgcaacctggcggcagcgcaaaagatg

SEQ ID NO: 111451 - DNA, 103 bp, Artificial Sequence
  Synthetic Polynucleotide
taatacgactcactatagggtggggggttggcgctggtgctggcactgagaacagaggagactcagtatgagcaccagcaacctggcggcagcgcaaaagatg

SEQ ID NO: 111452 - DNA, 103 bp, Artificial Sequence
  Synthetic Polynucleotide
taatacgactcactatagggtggggcctgctggggggttggcgctggtgcaacagaggagagcaccaatgccaacccccaacctggcggcagcgcaaaagatg

SEQ ID NO: 111453 - DNA, 103 bp, Artificial Sequence
  Synthetic Polynucleotide
taatacgactcactatagggatggaggcggtggggcctgctggggggttgaacagaggagacaacccatgagcaggcccaacctggcggcagcgcaaaagatg

SEQ ID NO: 111454 - DNA, 103 bp, Artificial Sequence
  Synthetic Polynucleotide
taatacgactcactataggggggaccagggatggaggcggtggggcctgcaacagaggagagcaggcatgaccgcctccaacctggcggcagcgcaaaagatg

SEQ ID NO: 111455 - DNA, 103 bp, Artificial Sequence
  Synthetic Polynucleotide
taatacgactcactatagggagcctccaaggggaccagggatggaggcggaacagaggagaccgcctatgtccctggtcaacctggcggcagcgcaaaagatg

SEQ ID NO: 111456 - DNA, 103 bp, Artificial Sequence
  Synthetic Polynucleotide
taatacgactcactatagggaggtagcagtagctgggcagagctgggggcaacagaggagagcccccatgtctgcccagaacctggcggcagcgcaaaagatg

SEQ ID NO: 111457 - DNA, 103 bp, Artificial Sequence
  Synthetic Polynucleotide
taatacgactcactatagggggctgtcagtagcctccaaggggaccagggaacagaggagaccctggatgccttggaggaacctggcggcagcgcaaaagatg

SEQ ID NO: 111458 - DNA, 103 bp, Artificial Sequence
  Synthetic Polynucleotide
taatacgactcactatagggagctccagcaggctgtcagtagcctccaagaacagaggagacttggaatgtactgacagaacctggcggcagcgcaaaagatg

SEQ ID NO: 111459 - DNA, 103 bp, Artificial Sequence
  Synthetic Polynucleotide
taatacgactcactatagggtgggtgcggcagctccagcaggctgtcagtaacagaggagaactgacatgctgctggagaacctggcggcagcgcaaaagatg

SEQ ID NO: 111460 - DNA, 103 bp, Artificial Sequence
  Synthetic Polynucleotide
taatacgactcactataggggctgcaggagtgggtgcggcagctccagcaaacagaggagatgctggatgtgccgcaccaacctggcggcagcgcaaaagatg

SEQ ID NO: 111461 - DNA, 103 bp, Artificial Sequence
  Synthetic Polynucleotide
taatacgactcactatagggtcctcagtctgctgcaggagtgggtgcggcaacagaggagagccgcaatgactcctgcaaacctggcggcagcgcaaaagatg

SEQ ID NO: 111462 - DNA, 103 bp, Artificial Sequence
  Synthetic Polynucleotide
taatacgactcactatagggcaggaactggtcctcagtctgctgcaggagaacagaggagactcctgatgcagactgagaacctggcggcagcgcaaaagatg

SEQ ID NO: 111463 - DNA, 103 bp, Artificial Sequence
  Synthetic Polynucleotide
taatacgactcactataggggggtcggggacaggaactggtcctcagtctaacagaggagaagactgatgaccagttccaacctggcggcagcgcaaaagatg

SEQ ID NO: 111464 - DNA, 103 bp, Artificial Sequence
  Synthetic Polynucleotide
taatacgactcactatagggctgcacgccagggtcggggacaggaactggaacagaggagaccagttatggtccccgacaacctggcggcagcgcaaaagatg

SEQ ID NO: 111465 - DNA, 103 bp, Artificial Sequence
  Synthetic Polynucleotide
taatacgactcactatagggcagaggggagctgcacgccagggtcggggaaacagaggagatccccgatgctggcgtgcaacctggcggcagcgcaaaagatg

SEQ ID NO: 111466 - DNA, 103 bp, Artificial Sequence
  Synthetic Polynucleotide
taatacgactcactatagggagaagctgatcagaggggagctgcacgccaaacagaggagatggcgtatggctcccctcaacctggcggcagcgcaaaagatg

SEQ ID NO: 111467 - DNA, 103 bp, Artificial Sequence
  Synthetic Polynucleotide
taatacgactcactatagggggtgtgtagtaggtagcagtagctgggcagaacagaggagactgcccatgtactgctacaacctggcggcagcgcaaaagatg

SEQ ID NO: 111468 - DNA, 103 bp, Artificial Sequence
  Synthetic Polynucleotide
taatacgactcactatagggaaggatggggagaagctgatcagaggggagaacagaggagactccccatggatcagcttaacctggcggcagcgcaaaagatg

SEQ ID NO: 111469 - DNA, 103 bp, Artificial Sequence
  Synthetic Polynucleotide
taatacgactcactataggggtcctggtccaaggatggggagaagctgataacagaggagaatcagcatgtccccatccaacctggcggcagcgcaaaagatg

SEQ ID NO: 111470 - DNA, 103 bp, Artificial Sequence
  Synthetic Polynucleotide
taatacgactcactatagggacaggtagtcgtcctggtccaaggatggggaacagaggagaccccatatgtggaccaggaacctggcggcagcgcaaaagatg

SEQ ID NO: 111471 - DNA, 103 bp, Artificial Sequence
  Synthetic Polynucleotide
taatacgactcactatagggtccaagccccacaggtagtcgtcctggtccaacagaggagaggaccaatgcgactacctaacctggcggcagcgcaaaagatg

SEQ ID NO: 111472 - DNA, 103 bp, Artificial Sequence
  Synthetic Polynucleotide
taatacgactcactatagggctcacccgcctccaagccccacaggtagtcaacagaggagagactacatgtggggcttgaacctggcggcagcgcaaaagatg

SEQ ID NO: 111473 - DNA, 103 bp, Artificial Sequence
  Synthetic Polynucleotide
taatacgactcactatagggcgctgatgccctcacccgcctccaagccccaacagaggagaggggctatgaggcgggtgaacctggcggcagcgcaaaagatg

SEQ ID NO: 111474 - DNA, 103 bp, Artificial Sequence
  Synthetic Polynucleotide
taatacgactcactatagggtcgaagagatcgctgatgccctcacccgccaacagaggagaggcgggatggggcatcagaacctggcggcagcgcaaaagatg

SEQ ID NO: 111475 - DNA, 103 bp, Artificial Sequence
  Synthetic Polynucleotide
taatacgactcactataggggtcgtaggagtcgaagagatcgctgatgccaacagaggagaggcatcatggatctcttcaacctggcggcagcgcaaaagatg

SEQ ID NO: 111476 - DNA, 103 bp, Artificial Sequence
  Synthetic Polynucleotide
taatacgactcactatagggggtccccaaggtcgtaggagtcgaagagataacagaggagaatctctatgactcctacgaacctggcggcagcgcaaaagatg

SEQ ID NO: 111477 - DNA, 103 bp, Artificial Sequence
  Synthetic Polynucleotide
taatacgactcactatagggttaatcaacaggtccccaaggtcgtaggagaacagaggagactcctaatgccttggggaaacctggcggcagcgcaaaagatg

SEQ ID NO: 111478 - DNA, 103 bp, Artificial Sequence
  Synthetic Polynucleotide
taatacgactcactatagggcgggtacagcggtgtgtagtaggtagcagtaacagaggagaactgctatgtactacacaaacctggcggcagcgcaaaagatg

SEQ ID NO: 111479 - DNA, 103 bp, Artificial Sequence
  Synthetic Polynucleotide
taatacgactcactataggggcgccgtctgcgggtacagcggtgtgtagtaacagaggagaactacaatgcgctgtaccaacctggcggcagcgcaaaagatg

SEQ ID NO: 111480 - DNA, 103 bp, Artificial Sequence
  Synthetic Polynucleotide
taatacgactcactataggggctgcgggaggcgccgtctgcgggtacagcaacagaggagagctgtaatggcagacggcaacctggcggcagcgcaaaagatg

SEQ ID NO: 111481 - DNA, 103 bp, Artificial Sequence
  Synthetic Polynucleotide
taatacgactcactataggggcctggcgccgctgcgggaggcgccgtctgaacagaggagacagacgatgcctcccgcaaacctggcggcagcgcaaaagatg

SEQ ID NO: 111482 - DNA, 103 bp, Artificial Sequence
  Synthetic Polynucleotide
taatacgactcactatagggcgaggcaggtgcctggcgccgctgcgggagaacagaggagactcccgatgcggcgccagaacctggcggcagcgcaaaagatg

SEQ ID NO: 111483 - DNA, 103 bp, Artificial Sequence
  Synthetic Polynucleotide
taatacgactcactatagggggagtggcgtcgaggcaggtgcctggcgccaacagaggagaggcgccatgcacctgcctaacctggcggcagcgcaaaagatg

SEQ ID NO: 111484 - DNA, 103 bp, Artificial Sequence
  Synthetic Polynucleotide
taatacgactcactataggggggtccgtggggagtggcgtcgaggcaggtaacagaggagaacctgcatggacgccactaacctggcggcagcgcaaaagatg

SEQ ID NO: 111485 - DNA, 103 bp, Artificial Sequence
  Synthetic Polynucleotide
taatacgactcactataggggcccagcggccgaagccaaggcccggggccaacagaggagaggccccatgccttggcttaacctggcggcagcgcaaaagatg

SEQ ID NO: 111486 - DNA, 103 bp, Artificial Sequence
  Synthetic Polynucleotide
taatacgactcactatagggcttggccctcgggtccgtggggagtggcgtaacagaggagaacgccaatgcccacggacaacctggcggcagcgcaaaagatg

SEQ ID NO: 111487 - DNA, 103 bp, Artificial Sequence
  Synthetic Polynucleotide
taatacgactcactatagggcatcgcacaacttggccctcgggtccgtggaacagaggagaccacggatgcgagggccaaacctggcggcagcgcaaaagatg

SEQ ID NO: 111488 - DNA, 103 bp, Artificial Sequence
  Synthetic Polynucleotide
taatacgactcactatagggtgccggcaggcatcgcacaacttggccctcaacagaggagagagggcatggttgtgcgaaacctggcggcagcgcaaaagatg

SEQ ID NO: 111489 - DNA, 103 bp, Artificial Sequence
  Synthetic Polynucleotide
taatacgactcactataggggcagccggcctgccggcaggcatcgcacaaaacagaggagattgtgcatggcctgccggaacctggcggcagcgcaaaagatg

SEQ ID NO: 111490 - DNA, 103 bp, Artificial Sequence
  Synthetic Polynucleotide
taatacgactcactatagggcttttggccggcagccggcctgccggcaggaacagaggagacctgccatgaggccggctaacctggcggcagcgcaaaagatg

SEQ ID NO: 111491 - DNA, 103 bp, Artificial Sequence
  Synthetic Polynucleotide
taatacgactcactatagggatccagcttccttttggccggcagccggccaacagaggagaggccggatgccggccaaaaacctggcggcagcgcaaaagatg

SEQ ID NO: 111492 - DNA, 103 bp, Artificial Sequence
  Synthetic Polynucleotide
taatacgactcactatagggtcccctccagatccagcttccttttggccgaacagaggagacggccaatgggaagctggaacctggcggcagcgcaaaagatg

SEQ ID NO: 111493 - DNA, 103 bp, Artificial Sequence
  Synthetic Polynucleotide
taatacgactcactatagggggcctcccaatcccctccagatccagcttcaacagaggagagaagctatgtctggagggaacctggcggcagcgcaaaagatg

SEQ ID NO: 111494 - DNA, 103 bp, Artificial Sequence
  Synthetic Polynucleotide
taatacgactcactatagggagggacgacgggcctcccaatcccctccagaacagaggagactggagatgattgggaggaacctggcggcagcgcaaaagatg

SEQ ID NO: 111495 - DNA, 103 bp, Artificial Sequence
  Synthetic Polynucleotide
taatacgactcactatagggttgggaactcagggacgacgggcctcccaaaacagaggagattgggaatgccgtcgtccaacctggcggcagcgcaaaagatg

SEQ ID NO: 111496 - DNA, 103 bp, Artificial Sequence
  Synthetic Polynucleotide
taatacgactcactatagggttcggggtctgcccagcggccgaagccaagaacagaggagacttggcatgggccgctggaacctggcggcagcgcaaaagatg

SEQ ID NO: 111497 - DNA, 103 bp, Artificial Sequence
  Synthetic Polynucleotide
taatacgactcactatagggcccttgggggttgggaactcagggacgacgaacagaggagacgtcgtatgtgagttcccaacctggcggcagcgcaaaagatg

SEQ ID NO: 111498 - DNA, 103 bp, Artificial Sequence
  Synthetic Polynucleotide
taatacgactcactataggggatgcacttccccttgggggttgggaactcaacagaggagagagttcatgacccccaagaacctggcggcagcgcaaaagatg

SEQ ID NO: 111499 - DNA, 103 bp, Artificial Sequence
  Synthetic Polynucleotide
taatacgactcactatagggcatccactctgatgcacttccccttgggggaacagaggagacccccaatgggaagtgcaaacctggcggcagcgcaaaagatg

SEQ ID NO: 111500 - DNA, 103 bp, Artificial Sequence
  Synthetic Polynucleotide
taatacgactcactatagggctggggaggccatccactctgatgcacttcaacagaggagagaagtgatgcagagtggaaacctggcggcagcgcaaaagatg

SEQ ID NO: 111501 - DNA, 103 bp, Artificial Sequence
  Synthetic Polynucleotide
taatacgactcactatagggggttttggggctggggaggccatccactctaacagaggagaagagtgatgggcctccccaacctggcggcagcgcaaaagatg

SEQ ID NO: 111502 - DNA, 103 bp, Artificial Sequence
  Synthetic Polynucleotide
taatacgactcactataggggggatttgggggttttggggctggggaggcaacagaggagagcctccatggccccaaaaaacctggcggcagcgcaaaagatg

SEQ ID NO: 111503 - DNA, 103 bp, Artificial Sequence
  Synthetic Polynucleotide
taatacgactcactatagggttctccccgggggatttgggggttttggggaacagaggagaccccaaatgccccaaatcaacctggcggcagcgcaaaagatg

SEQ ID NO: 111504 - DNA, 103 bp, Artificial Sequence
  Synthetic Polynucleotide
taatacgactcactatagggataccgagtcttctccccgggggatttgggaacagaggagacccaaaatgcccggggagaacctggcggcagcgcaaaagatg

SEQ ID NO: 111505 - DNA, 103 bp, Artificial Sequence
  Synthetic Polynucleotide
taatacgactcactataggggcgaagtgtcataccgagtcttctccccggaacagaggagaccggggatgagactcggtaacctggcggcagcgcaaaagatg

SEQ ID NO: 111506 - DNA, 103 bp, Artificial Sequence
  Synthetic Polynucleotide
taatacgactcactatagggagcagccccagcgaagtgtcataccgagtcaacagaggagagactcgatgtgacacttcaacctggcggcagcgcaaaagatg

SEQ ID NO: 111507 - DNA, 103 bp, Artificial Sequence
  Synthetic Polynucleotide
taatacgactcactataggggggcaccaccttcggggtctgcccagcggcaacagaggagagccgctatgcagaccccgaacctggcggcagcgcaaaagatg

SEQ ID NO: 111508 - DNA, 103 bp, Artificial Sequence
  Synthetic Polynucleotide
taatacgactcactatagggcttcttggtgagcagccccagcgaagtgtcaacagaggagagacactatgctggggctgaacctggcggcagcgcaaaagatg

SEQ ID NO: 111509 - DNA, 103 bp, Artificial Sequence
  Synthetic Polynucleotide
taatacgactcactatagggggtaaatgaacttcttggtgagcagccccaaacagaggagatggggcatgtcaccaagaaacctggcggcagcgcaaaagatg

SEQ ID NO: 111510 - DNA, 103 bp, Artificial Sequence
  Synthetic Polynucleotide
taatacgactcactatagggtcgctcaggaggtaaatgaacttcttggtgaacagaggagacaccaaatggttcatttaaacctggcggcagcgcaaaagatg

SEQ ID NO: 111511 - DNA, 103 bp, Artificial Sequence
  Synthetic Polynucleotide
taatacgactcactatagggatcctctgactcgctcaggaggtaaatgaaaacagaggagattcattatgctcctgagcaacctggcggcagcgcaaaagatg

SEQ ID NO: 111512 - DNA, 103 bp, Artificial Sequence
  Synthetic Polynucleotide
taatacgactcactatagggccaggaccccatcctctgactcgctcaggaaacagaggagatcctgaatgagtcagaggaacctggcggcagcgcaaaagatg

SEQ ID NO: 111513 - DNA, 103 bp, Artificial Sequence
  Synthetic Polynucleotide
taatacgactcactatagggcagttcaggtccaggaccccatcctctgacaacagaggagagtcagaatgtggggtcctaacctggcggcagcgcaaaagatg

SEQ ID NO: 111514 - DNA, 103 bp, Artificial Sequence
  Synthetic Polynucleotide
taatacgactcactatagggctcagcggcccagttcaggtccaggaccccaacagaggagaggggtcatggacctgaacaacctggcggcagcgcaaaagatg

SEQ ID NO: 111515 - DNA, 103 bp, Artificial Sequence
  Synthetic Polynucleotide
taatacgactcactatagggcgtccagcacctcagcggcccagttcaggtaacagaggagaacctgaatggggccgctgaacctggcggcagcgcaaaagatg

SEQ ID NO: 111516 - DNA, 103 bp, Artificial Sequence
  Synthetic Polynucleotide
taatacgactcactatagggcgcttctgcacgtccagcacctcagcggccaacagaggagaggccgcatgggtgctggaaacctggcggcagcgcaaaagatg

SEQ ID NO: 111517 - DNA, 103 bp, Artificial Sequence
  Synthetic Polynucleotide
taatacgactcactatagggatagatgcgccgcttctgcacgtccagcacaacagaggagagtgctgatggtgcagaagaacctggcggcagcgcaaaagatg

SEQ ID NO: 111518 - DNA, 103 bp, Artificial Sequence
  Synthetic Polynucleotide
taatacgactcactatagggggctcatcgcgggcaccaccttcggggtctaacagaggagaagacccatgaggtggtgcaacctggcggcagcgcaaaagatg

SEQ ID NO: 111519 - DNA, 103 bp, Artificial Sequence
  Synthetic Polynucleotide
taatacgactcactatagggtggtgatgtcatagatgcgccgcttctgcaaacagaggagatgcagaatgggcgcatctaacctggcggcagcgcaaaagatg

SEQ ID NO: 111520 - DNA, 103 bp, Artificial Sequence
  Synthetic Polynucleotide
taatacgactcactatagggtccagcacgttggtgatgtcatagatgcgcaacagaggagagcgcatatgtgacatcacaacctggcggcagcgcaaaagatg

SEQ ID NO: 111521 - DNA, 103 bp, Artificial Sequence
  Synthetic Polynucleotide
taatacgactcactatagggctggatgccttccagcacgttggtgatgtcaacagaggagagacatcatgaacgtgctgaacctggcggcagcgcaaaagatg

SEQ ID NO: 111522 - DNA, 103 bp, Artificial Sequence
  Synthetic Polynucleotide
taatacgactcactatagggtgcggatgagctggatgccttccagcacgtaacagaggagaacgtgcatgaaggcatccaacctggcggcagcgcaaaagatg

SEQ ID NO: 111523 - DNA, 103 bp, Artificial Sequence
  Synthetic Polynucleotide
taatacgactcactatagggttggccttcttgcggatgagctggatgcctaacagaggagaaggcatatggctcatccgaacctggcggcagcgcaaaagatg

SEQ ID NO: 111524 - DNA, 103 bp, Artificial Sequence
  Synthetic Polynucleotide
taatacgactcactataggggatgttgttcttggccttcttgcggatgagaacagaggagactcatcatgaagaaggccaacctggcggcagcgcaaaagatg

SEQ ID NO: 111525 - DNA, 103 bp, Artificial Sequence
  Synthetic Polynucleotide
taatacgactcactatagggctacccactggatgttgttcttggccttctaacagaggagaagaaggatgagaacaacaaacctggcggcagcgcaaaagatg

SEQ ID NO: 111526 - DNA, 103 bp, Artificial Sequence
  Synthetic Polynucleotide
taatacgactcactatagggattcccctgcctacccactggatgttgttcaacagaggagagaacaaatgccagtgggtaacctggcggcagcgcaaaagatg

SEQ ID NO: 111527 - DNA, 103 bp, Artificial Sequence
  Synthetic Polynucleotide
taatacgactcactataggggtcttcaaacattcccctgcctacccactgaacagaggagacagtggatgggcaggggaaacctggcggcagcgcaaaagatg

SEQ ID NO: 111528 - DNA, 103 bp, Artificial Sequence
  Synthetic Polynucleotide
taatacgactcactataggggtctggtggggtcttcaaacattcccctgcaacagaggagagcagggatgtgtttgaagaacctggcggcagcgcaaaagatg

SEQ ID NO: 111529 - DNA, 103 bp, Artificial Sequence
  Synthetic Polynucleotide
taatacgactcactatagggagctctgtggggctcatcgcgggcaccaccaacagaggagaggtggtatgcgcgatgagaacctggcggcagcgcaaaagatg

SEQ ID NO: 111530 - DNA, 103 bp, Artificial Sequence
  Synthetic Polynucleotide
taatacgactcactatagggtgcttcccaggtctggtggggtcttcaaacaacagaggagagtttgaatgccccaccagaacctggcggcagcgcaaaagatg

SEQ ID NO: 111531 - DNA, 103 bp, Artificial Sequence
  Synthetic Polynucleotide
taatacgactcactatagggcagctgttgctgcttcccaggtctggtgggaacagaggagacccaccatgcctgggaagaacctggcggcagcgcaaaagatg

SEQ ID NO: 111532 - DNA, 103 bp, Artificial Sequence
  Synthetic Polynucleotide
taatacgactcactataggggctcctgccccagctgttgctgcttcccagaacagaggagactgggaatgagcaacagcaacctggcggcagcgcaaaagatg

SEQ ID NO: 111533 - DNA, 103 bp, Artificial Sequence
  Synthetic Polynucleotide
taatacgactcactatagggagctccttcagctcctgccccagctgttgcaacagaggagagcaacaatgggggcaggaaacctggcggcagcgcaaaagatg

SEQ ID NO: 111534 - DNA, 103 bp, Artificial Sequence
  Synthetic Polynucleotide
taatacgactcactatagggcgtgttcatcagctccttcagctcctgcccaacagaggagagggcagatgctgaaggagaacctggcggcagcgcaaaagatg

SEQ ID NO: 111535 - DNA, 103 bp, Artificial Sequence
  Synthetic Polynucleotide
taatacgactcactatagggaggcctgctccgtgttcatcagctccttcaaacagaggagatgaaggatgtgatgaacaaacctggcggcagcgcaaaagatg

SEQ ID NO: 111536 - DNA, 103 bp, Artificial Sequence
  Synthetic Polynucleotide
taatacgactcactatagggagctggtccaaggcctgctccgtgttcatcaacagaggagagatgaaatgggagcaggcaacctggcggcagcgcaaaagatg

SEQ ID NO: 111537 - DNA, 103 bp, Artificial Sequence
  Synthetic Polynucleotide
taatacgactcactataggggctctggatgagctggtccaaggcctgctcaacagaggagagagcagatgttggaccagaacctggcggcagcgcaaaagatg

SEQ ID NO: 111538 - DNA, 103 bp, Artificial Sequence
  Synthetic Polynucleotide
taatacgactcactatagggtcagagagcagctctggatgagctggtccaaacagaggagatggaccatgtcatccagaaacctggcggcagcgcaaaagatg

SEQ ID NO: 111539 - DNA, 103 bp, Artificial Sequence
  Synthetic Polynucleotide
taatacgactcactatagggtgcttgaagctcagagagcagctctggatgaacagaggagacatccaatgctgctctctaacctggcggcagcgcaaaagatg

SEQ ID NO: 111540 - DNA, 103 bp, Artificial Sequence
  Synthetic Polynucleotide
taatacgactcactatagggggatggccacagctctgtggggctcatcgcaacagaggagagcgatgatgcccacagagaacctggcggcagcgcaaaagatg

SEQ ID NO: 111541 - DNA, 103 bp, Artificial Sequence
  Synthetic Polynucleotide
taatacgactcactatagggctcagtcaggtgcttgaagctcagagagcaaacagaggagatgctctatgagcttcaagaacctggcggcagcgcaaaagatg

SEQ ID NO: 111542 - DNA, 103 bp, Artificial Sequence
  Synthetic Polynucleotide
taatacgactcactatagggtggccttgtcctcagtcaggtgcttgaagcaacagaggagagcttcaatgacctgactgaacctggcggcagcgcaaaagatg

SEQ ID NO: 111543 - DNA, 103 bp, Artificial Sequence
  Synthetic Polynucleotide
taatacgactcactatagggagcctcttgttggccttgtcctcagtcaggaacagaggagacctgacatgggacaaggcaacctggcggcagcgcaaaagatg

SEQ ID NO: 111544 - DNA, 103 bp, Artificial Sequence
  Synthetic Polynucleotide
taatacgactcactatagggcacataggccagcctcttgttggccttgtcaacagaggagagacaagatgaacaagaggaacctggcggcagcgcaaaagatg

SEQ ID NO: 111545 - DNA, 103 bp, Artificial Sequence
  Synthetic Polynucleotide
taatacgactcactatagggcctggtaagtcacataggccagcctcttgtaacagaggagaacaagaatgtggcctatgaacctggcggcagcgcaaaagatg

SEQ ID NO: 111546 - DNA, 103 bp, Artificial Sequence
  Synthetic Polynucleotide
taatacgactcactataggggcacggatatcctggtaagtcacataggccaacagaggagaggcctaatggacttaccaaacctggcggcagcgcaaaagatg

SEQ ID NO: 111547 - DNA, 103 bp, Artificial Sequence
  Synthetic Polynucleotide
taatacgactcactataggggttgccaacagcacggatatcctggtaagtaacagaggagaacttacatggatatccgtaacctggcggcagcgcaaaagatg

SEQ ID NO: 111548 - DNA, 103 bp, Artificial Sequence
  Synthetic Polynucleotide
taatacgactcactataggggctccttaaagttgccaacagcacggatataacagaggagaatatccatgctgttggcaaacctggcggcagcgcaaaagatg

SEQ ID NO: 111549 - DNA, 103 bp, Artificial Sequence
  Synthetic Polynucleotide
taatacgactcactatagggatcactgtctgctccttaaagttgccaacaaacagaggagatgttggatgctttaaggaaacctggcggcagcgcaaaagatg

SEQ ID NO: 111550 - DNA, 103 bp, Artificial Sequence
  Synthetic Polynucleotide
taatacgactcactatagggcttgacggcaatcactgtctgctccttaaaaacagaggagatttaagatgcagacagtgaacctggcggcagcgcaaaagatg

SEQ ID NO: 111551 - DNA, 103 bp, Artificial Sequence
  Synthetic Polynucleotide
taatacgactcactatagggtgctgaggccggatggccacagctctgtggaacagaggagaccacagatgtgtggccataacctggcggcagcgcaaaagatg

SEQ ID NO: 111552 - DNA, 103 bp, Artificial Sequence
  Synthetic Polynucleotide
taatacgactcactataggggcggaggggccttgacggcaatcactgtctaacagaggagaagacagatgttgccgtcaaacctggcggcagcgcaaaagatg

SEQ ID NO: 111553 - DNA, 103 bp, Artificial Sequence
  Synthetic Polynucleotide
taatacgactcactatagggagtctcgtctgcggaggggccttgacggcaaacagaggagatgccgtatgggcccctccaacctggcggcagcgcaaaagatg

SEQ ID NO: 111554 - DNA, 103 bp, Artificial Sequence
  Synthetic Polynucleotide
taatacgactcactataggggggcacttccagtctcgtctgcggaggggcaacagaggagagcccctatgcagacgagaaacctggcggcagcgcaaaagatg

SEQ ID NO: 111555 - DNA, 103 bp, Artificial Sequence
  Synthetic Polynucleotide
taatacgactcactatagggcagtcctgtcgggcacttccagtctcgtctaacagaggagaagacgaatgtggaagtgcaacctggcggcagcgcaaaagatg

SEQ ID NO: 111556 - DNA, 103 bp, Artificial Sequence
  Synthetic Polynucleotide
taatacgactcactatagggaggttgtcctcagtcctgtcgggcacttccaacagaggagaggaagtatgcgacaggacaacctggcggcagcgcaaaagatg

SEQ ID NO: 111557 - DNA, 103 bp, Artificial Sequence
  Synthetic Polynucleotide
taatacgactcactatagggatatatctgcaggttgtcctcagtcctgtcaacagaggagagacaggatggaggacaacaacctggcggcagcgcaaaagatg

SEQ ID NO: 111558 - DNA, 103 bp, Artificial Sequence
  Synthetic Polynucleotide
taatacgactcactatagggtgctcttgagatatatctgcaggttgtcctaacagaggagaaggacaatgtgcagatataacctggcggcagcgcaaaagatg

SEQ ID NO: 111559 - DNA, 103 bp, Artificial Sequence
  Synthetic Polynucleotide
taatacgactcactatagggggcccttgggtgctcttgagatatatctgcaacagaggagagcagatatgtctcaagagaacctggcggcagcgcaaaagatg

SEQ ID NO: 111560 - DNA, 103 bp, Artificial Sequence
  Synthetic Polynucleotide
taatacgactcactataggggacttcgatgggcccttgggtgctcttgagaacagaggagactcaagatgacccaagggaacctggcggcagcgcaaaagatg

SEQ ID NO: 111561 - DNA, 103 bp, Artificial Sequence
  Synthetic Polynucleotide
taatacgactcactatagggggcacaggtagacttcgatgggcccttgggaacagaggagacccaagatgccatcgaagaacctggcggcagcgcaaaagatg

SEQ ID NO: 111562 - DNA, 103 bp, Artificial Sequence
  Synthetic Polynucleotide
taatacgactcactatagggagctgggggctgctgaggccggatggccacaacagaggagagtggccatgcggcctcagaacctggcggcagcgcaaaagatg

SEQ ID NO: 111563 - DNA, 103 bp, Artificial Sequence
  Synthetic Polynucleotide
taatacgactcactatagggacctcctctgggcacaggtagacttcgatgaacagaggagacatcgaatgctacctgtgaacctggcggcagcgcaaaagatg

SEQ ID NO: 111564 - DNA, 103 bp, Artificial Sequence
  Synthetic Polynucleotide
taatacgactcactatagggcggctcctgcacctcctctgggcacaggtaaacagaggagatacctgatgccagaggagaacctggcggcagcgcaaaagatg

SEQ ID NO: 111565 - DNA, 103 bp, Artificial Sequence
  Synthetic Polynucleotide
taatacgactcactatagggaaggactgtccggctcctgcacctcctctgaacagaggagacagaggatgtgcaggagcaacctggcggcagcgcaaaagatg

SEQ ID NO: 111566 - DNA, 103 bp, Artificial Sequence
  Synthetic Polynucleotide
taatacgactcactatagggggctcctcggaaggactgtccggctcctgcaacagaggagagcaggaatgggacagtccaacctggcggcagcgcaaaagatg

SEQ ID NO: 111567 - DNA, 103 bp, Artificial Sequence
  Synthetic Polynucleotide
taatacgactcactatagggagaggggagaggctcctcggaaggactgtcaacagaggagagacagtatgtccgaggagaacctggcggcagcgcaaaagatg

SEQ ID NO: 111568 - DNA, 103 bp, Artificial Sequence
  Synthetic Polynucleotide
taatacgactcactataggggggtggaggtagaggggagaggctcctcggaacagaggagaccgaggatgctctcccctaacctggcggcagcgcaaaagatg

SEQ ID NO: 111569 - DNA, 103 bp, Artificial Sequence
  Synthetic Polynucleotide
taatacgactcactatagggctggggcagagggtggaggtagaggggagaaacagaggagatctcccatgtacctccacaacctggcggcagcgcaaaagatg

SEQ ID NO: 111570 - DNA, 103 bp, Artificial Sequence
  Synthetic Polynucleotide
taatacgactcactatagggagagtcagggctggggcagagggtggaggtaacagaggagaacctccatgctctgccccaacctggcggcagcgcaaaagatg

SEQ ID NO: 111571 - DNA, 103 bp, Artificial Sequence
  Synthetic Polynucleotide
taatacgactcactatagggtgggctgggcagagtcagggctggggcagaaacagaggagatctgccatggccctgactaacctggcggcagcgcaaaagatg

SEQ ID NO: 111572 - DNA, 103 bp, Artificial Sequence
  Synthetic Polynucleotide
taatacgactcactataggggtgctgctgctgggctgggcagagtcagggaacagaggagaccctgaatgtgcccagccaacctggcggcagcgcaaaagatg

SEQ ID NO: 111573 - DNA, 103 bp, Artificial Sequence
  Synthetic Polynucleotide
taatacgactcactatagggctccagagcgggctggattccctttctcataacagaggagaatgagaatgggaatccagaacctggcggcagcgcaaaagatg

SEQ ID NO: 111574 - DNA, 103 bp, Artificial Sequence
  Synthetic Polynucleotide
taatacgactcactatagggggctagcagtgcccttttgtccatggaggcaacagaggagagcctccatggacaaaaggaacctggcggcagcgcaaaagatg

SEQ ID NO: 111575 - DNA, 103 bp, Artificial Sequence
  Synthetic Polynucleotide
taatacgactcactatagggtgccaaatgtatttgtaggctctctattgaaacagaggagatcaataatgagcctacaaaacctggcggcagcgcaaaagatg

SEQ ID NO: 111576 - DNA, 103 bp, Artificial Sequence
  Synthetic Polynucleotide
taatacgactcactatagggcttgggtacttgccaaatgtatttgtaggcaacagaggagagcctacatgtacatttggaacctggcggcagcgcaaaagatg

SEQ ID NO: 111577 - DNA, 103 bp, Artificial Sequence
  Synthetic Polynucleotide
taatacgactcactatagggtcaatgggcccttgggtacttgccaaatgtaacagaggagaacatttatgaagtacccaaacctggcggcagcgcaaaagatg

SEQ ID NO: 111578 - DNA, 103 bp, Artificial Sequence
  Synthetic Polynucleotide
taatacgactcactatagggtaagtaaacctcaatgggcccttgggtactaacagaggagaagtaccatggggcccattaacctggcggcagcgcaaaagatg

SEQ ID NO: 111579 - DNA, 103 bp, Artificial Sequence
  Synthetic Polynucleotide
taatacgactcactatagggcttctggacataagtaaacctcaatgggccaacagaggagaggcccaatgaggtttactaacctggcggcagcgcaaaagatg

SEQ ID NO: 111580 - DNA, 103 bp, Artificial Sequence
  Synthetic Polynucleotide
taatacgactcactataggggtttcagtctcttctggacataagtaaaccaacagaggagaggtttaatgatgtccagaaacctggcggcagcgcaaaagatg

SEQ ID NO: 111581 - DNA, 103 bp, Artificial Sequence
  Synthetic Polynucleotide
taatacgactcactatagggtggactgtgtgtttcagtctcttctggacaaacagaggagatgtccaatggagactgaaaacctggcggcagcgcaaaagatg

SEQ ID NO: 111582 - DNA, 103 bp, Artificial Sequence
  Synthetic Polynucleotide
taatacgactcactatagggttgttttcattggactgtgtgtttcagtctaacagaggagaagactgatgcacacagtcaacctggcggcagcgcaaaagatg

SEQ ID NO: 111583 - DNA, 103 bp, Artificial Sequence
  Synthetic Polynucleotide
taatacgactcactatagggtcttggttgtttgttttcattggactgtgtaacagaggagaacacagatgaatgaaaacaacctggcggcagcgcaaaagatg

SEQ ID NO: 111584 - DNA, 103 bp, Artificial Sequence
  Synthetic Polynucleotide
taatacgactcactatagggcccattgtggtcttggttgtttgttttcataacagaggagaatgaaaatgaacaaccaaaacctggcggcagcgcaaaagatg

SEQ ID NO: 111585 - DNA, 103 bp, Artificial Sequence
  Synthetic Polynucleotide
taatacgactcactatagggagccggggctggctagcagtgcccttttgtaacagaggagaacaaaaatgcactgctagaacctggcggcagcgcaaaagatg

SEQ ID NO: 111586 - DNA, 103 bp, Artificial Sequence
  Synthetic Polynucleotide
taatacgactcactatagggtagggatattcccattgtggtcttggttgtaacagaggagaacaaccatgaccacaatgaacctggcggcagcgcaaaagatg

SEQ ID NO: 111587 - DNA, 103 bp, Artificial Sequence
  Synthetic Polynucleotide
taatacgactcactataggggaagcgggtttagggatattcccattgtggaacagaggagaccacaaatggaatatcccaacctggcggcagcgcaaaagatg

SEQ ID NO: 111588 - DNA, 103 bp, Artificial Sequence
  Synthetic Polynucleotide
taatacgactcactatagggcaagtctttggaagcgggtttagggatattaacagaggagaaatatcatgaaacccgctaacctggcggcagcgcaaaagatg

SEQ ID NO: 111589 - DNA, 103 bp, Artificial Sequence
  Synthetic Polynucleotide
taatacgactcactatagggtggttgaagccaagtctttggaagcgggttaacagaggagaaacccgatgccaaagactaacctggcggcagcgcaaaagatg

SEQ ID NO: 111590 - DNA, 103 bp, Artificial Sequence
  Synthetic Polynucleotide
taatacgactcactatagggtgtcctgagttggttgaagccaagtctttgaacagaggagacaaagaatgggcttcaacaacctggcggcagcgcaaaagatg

SEQ ID NO: 111591 - DNA, 103 bp, Artificial Sequence
  Synthetic Polynucleotide
taatacgactcactataggggcaatcgctatgtcctgagttggttgaagcaacagaggagagcttcaatgaactcaggaaacctggcggcagcgcaaaagatg

SEQ ID NO: 111592 - DNA, 103 bp, Artificial Sequence
  Synthetic Polynucleotide
taatacgactcactatagggtagaaactgagcaatcgctatgtcctgagtaacagaggagaactcagatgatagcgattaacctggcggcagcgcaaaagatg

SEQ ID NO: 111593 - DNA, 103 bp, Artificial Sequence
  Synthetic Polynucleotide
taatacgactcactatagggaggtttcccatagaaactgagcaatcgctaaacagaggagatagcgaatgctcagtttcaacctggcggcagcgcaaaagatg

SEQ ID NO: 111594 - DNA, 103 bp, Artificial Sequence
  Synthetic Polynucleotide
taatacgactcactatagggcagaggagaaaggtttcccatagaaactgaaacagaggagatcagttatgatgggaaacaacctggcggcagcgcaaaagatg

SEQ ID NO: 111595 - DNA, 103 bp, Artificial Sequence
  Synthetic Polynucleotide
taatacgactcactatagggctggggaggccagaggagaaaggtttcccaaacagaggagatgggaaatgtttctcctcaacctggcggcagcgcaaaagatg

SEQ ID NO: 111596 - DNA, 103 bp, Artificial Sequence
  Synthetic Polynucleotide
taatacgactcactataggggcggcggcgaagccggggctggctagcagtaacagaggagaactgctatgcagccccggaacctggcggcagcgcaaaagatg

SEQ ID NO: 111597 - DNA, 103 bp, Artificial Sequence
  Synthetic Polynucleotide
taatacgactcactatagggaagaggttggctggggaggccagaggagaaaacagaggagattctccatgggcctccccaacctggcggcagcgcaaaagatg

SEQ ID NO: 111598 - DNA, 103 bp, Artificial Sequence
  Synthetic Polynucleotide
taatacgactcactatagggagtctgctgtaagaggttggctggggaggcaacagaggagagcctccatggccaacctcaacctggcggcagcgcaaaagatg

SEQ ID NO: 111599 - DNA, 103 bp, Artificial Sequence
  Synthetic Polynucleotide
taatacgactcactatagggtttggtcctcagtctgctgtaagaggttggaacagaggagaccaaccatgtacagcagaaacctggcggcagcgcaaaagatg

SEQ ID NO: 111600 - DNA, 103 bp, Artificial Sequence
  Synthetic Polynucleotide
taatacgactcactatagggttggaaggaatttggtcctcagtctgctgtaacagaggagaacagcaatgtgaggaccaaacctggcggcagcgcaaaagatg

SEQ ID NO: 111601 - DNA, 103 bp, Artificial Sequence
  Synthetic Polynucleotide
taatacgactcactatagggtccttctaggttggaaggaatttggtcctcaacagaggagagaggacatgattccttccaacctggcggcagcgcaaaagatg

SEQ ID NO: 111602 - DNA, 103 bp, Artificial Sequence
  Synthetic Polynucleotide
taatacgactcactatagggtcacaaacggtccttctaggttggaaggaaaacagaggagattccttatgacctagaagaacctggcggcagcgcaaaagatg

SEQ ID NO: 111603 - DNA, 103 bp, Artificial Sequence
  Synthetic Polynucleotide
taatacgactcactatagggggcagtaagttcacaaacggtccttctaggaacagaggagacctagaatgaccgtttgtaacctggcggcagcgcaaaagatg

SEQ ID NO: 111604 - DNA, 103 bp, Artificial Sequence
  Synthetic Polynucleotide
taatacgactcactatagggcagcaggggaggcagtaagttcacaaacggaacagaggagaccgtttatgaacttactgaacctggcggcagcgcaaaagatg

SEQ ID NO: 111605 - DNA, 103 bp, Artificial Sequence
  Synthetic Polynucleotide
taatacgactcactatagggagtcctcttgcagcaggggaggcagtaagtaacagaggagaacttacatgctcccctgcaacctggcggcagcgcaaaagatg

SEQ ID NO: 111606 - DNA, 103 bp, Artificial Sequence
  Synthetic Polynucleotide
taatacgactcactatagggctcaggagatagtcctcttgcagcaggggaaacagaggagatcccctatggcaagaggaaacctggcggcagcgcaaaagatg

SEQ ID NO: 111607 - DNA, 103 bp, Artificial Sequence
  Synthetic Polynucleotide
taatacgactcactatagggagcggcggcggcggcggcgaagccggggctaacagaggagaagccccatgttcgccgccaacctggcggcagcgcaaaagatg

SEQ ID NO: 111608 - DNA, 103 bp, Artificial Sequence
  Synthetic Polynucleotide
taatacgactcactatagggctccccgaggctcaggagatagtcctcttgaacagaggagacaagagatgtatctcctgaacctggcggcagcgcaaaagatg

SEQ ID NO: 111609 - DNA, 103 bp, Artificial Sequence
  Synthetic Polynucleotide
taatacgactcactatagggtgccttcctcctccccgaggctcaggagataacagaggagaatctccatggcctcggggaacctggcggcagcgcaaaagatg

SEQ ID NO: 111610 - DNA, 103 bp, Artificial Sequence
  Synthetic Polynucleotide
taatacgactcactatagggagatcgctgatgccttcctcctccccgaggaacagaggagacctcggatgggaggaaggaacctggcggcagcgcaaaagatg

SEQ ID NO: 111611 - DNA, 103 bp, Artificial Sequence
  Synthetic Polynucleotide
taatacgactcactatagggagcatcgaagagatcgctgatgccttcctcaacagaggagagaggaaatgatcagcgataacctggcggcagcgcaaaagatg

SEQ ID NO: 111612 - DNA, 103 bp, Artificial Sequence
  Synthetic Polynucleotide
taatacgactcactatagggccaaatcgtaagcatcgaagagatcgctgaaacagaggagatcagcgatgtcttcgatgaacctggcggcagcgcaaaagatg

SEQ ID NO: 111613 - DNA, 103 bp, Artificial Sequence
  Synthetic Polynucleotide
taatacgactcactataggggggagcttttccaaatcgtaagcatcgaagaacagaggagacttcgaatgttacgatttaacctggcggcagcgcaaaagatg

SEQ ID NO: 111614 - DNA, 103 bp, Artificial Sequence
  Synthetic Polynucleotide
taatacgactcactatagggttccaccagtgggagcttttccaaatcgtaaacagaggagatacgatatggaaaagctcaacctggcggcagcgcaaaagatg

SEQ ID NO: 111615 - DNA, 103 bp, Artificial Sequence
  Synthetic Polynucleotide
taatacgactcactatagggacatgaagtcttccaccagtgggagcttttaacagaggagaaaaagcatgcactggtggaacctggcggcagcgcaaaagatg

SEQ ID NO: 111616 - DNA, 103 bp, Artificial Sequence
  Synthetic Polynucleotide
taatacgactcactataggggggcggcggcagcggcggcggcggcggcgaaacagaggagatcgccgatgccgccgccgaacctggcggcagcgcaaaagatg

SEQ ID NO: 111617 - DNA, 103 bp, Artificial Sequence
  Synthetic Polynucleotide
taatacgactcactatagggtacgcgcccggggcggcggcagcggcggcgaacagaggagacgccgcatgtgccgccgcaacctggcggcagcgcaaaagatg

SEQ ID NO: 111618 - DNA, 103 bp, Artificial Sequence
  Synthetic Polynucleotide
taatacgactcactataggggatctggatgtacgcgcccggggcggcggcaacagaggagagccgccatgccgggcgcgaacctggcggcagcgcaaaagatg

SEQ ID NO: 111619 - DNA, 103 bp, Artificial Sequence
  Synthetic Polynucleotide
taatacgactcactatagggtcgtggtgaggatctggatgtacgcgcccgaacagaggagacgggcgatgacatccagaaacctggcggcagcgcaaaagatg

SEQ ID NO: 111620 - DNA, 103 bp, Artificial Sequence
  Synthetic Polynucleotide
taatacgactcactataggggtggaagtgttcgtggtgaggatctggatgaacagaggagacatccaatgcctcaccacaacctggcggcagcgcaaaagatg

SEQ ID NO: 111621 - DNA, 103 bp, Artificial Sequence
  Synthetic Polynucleotide
taatacgactcactatagggacaggaggtggtggaagtgttcgtggtgagaacagaggagactcaccatgaacacttccaacctggcggcagcgcaaaagatg

SEQ ID NO: 111622 - DNA, 103 bp, Artificial Sequence
  Synthetic Polynucleotide
taatacgactcactatagggccaggtactgctccagagcgggctggattcaacagaggagagaatccatgccgctctggaacctggcggcagcgcaaaagatg

SEQ ID NO: 111623 - DNA, 103 bp, Artificial Sequence
  Synthetic Polynucleotide
taatacgactcactataggggggaggaggaacaggaggtggtggaagtgtaacagaggagaacacttatgccacctcctaacctggcggcagcgcaaaagatg

SEQ ID NO: 111624 - DNA, 103 bp, Artificial Sequence
  Synthetic Polynucleotide
taatacgactcactatagggccgctttggagggaggaggaacaggaggtgaacagaggagacacctcatgttcctcctcaacctggcggcagcgcaaaagatg

SEQ ID NO: 111625 - DNA, 103 bp, Artificial Sequence
  Synthetic Polynucleotide
taatacgactcactatagggggctacggcgccgctttggagggaggaggaaacagaggagatcctccatgctccaaagcaacctggcggcagcgcaaaagatg

SEQ ID NO: 111626 - DNA, 103 bp, Artificial Sequence
  Synthetic Polynucleotide
taatacgactcactataggggggggccggcggctacggcgccgctttggaaacagaggagatccaaaatggcgccgtagaacctggcggcagcgcaaaagatg

SEQ ID NO: 111627 - DNA, 103 bp, Artificial Sequence
  Synthetic Polynucleotide
taatacgactcactatagggctggggaggagggggccggcggctacggcgaacagaggagacgccgtatgcgccggcccaacctggcggcagcgcaaaagatg

SEQ ID NO: 111628 - DNA, 103 bp, Artificial Sequence
  Synthetic Polynucleotide
taatacgactcactataggggccgggggcactggggaggagggggccggcaacagaggagagccggcatgctcctccccaacctggcggcagcgcaaaagatg

SEQ ID NO: 111629 - DNA, 103 bp, Artificial Sequence
  Synthetic Polynucleotide
taatacgactcactatagggtctgctccgcgccgggggcactggggaggaaacagaggagatcctccatggtgcccccgaacctggcggcagcgcaaaagatg

SEQ ID NO: 111630 - DNA, 103 bp, Artificial Sequence
  Synthetic Polynucleotide
taatacgactcactatagggctgccggcggtctgctccgcgccgggggcaaacagaggagatgccccatgcgcggagcaaacctggcggcagcgcaaaagatg

SEQ ID NO: 111631 - DNA, 103 bp, Artificial Sequence
  Synthetic Polynucleotide
taatacgactcactataggggtagaggaggctgccggcggtctgctccgcaacagaggagagcggagatgaccgccggcaacctggcggcagcgcaaaagatg

SEQ ID NO: 111632 - DNA, 103 bp, Artificial Sequence
  Synthetic Polynucleotide
taatacgactcactataggggcggcgtggtgtagaggaggctgccggcggaacagaggagaccgccgatggcctcctctaacctggcggcagcgcaaaagatg

SEQ ID NO: 111633 - DNA, 103 bp, Artificial Sequence
  Synthetic Polynucleotide
taatacgactcactatagggccggcggtcaccaggtactgctccagagcgaacagaggagacgctctatggcagtacctaacctggcggcagcgcaaaagatg

SEQ ID NO: 111634 - DNA, 103 bp, Artificial Sequence
  Synthetic Polynucleotide
taatacgactcactataggggagggtccgtgcggcgtggtgtagaggaggaacagaggagacctcctatgcaccacgccaacctggcggcagcgcaaaagatg

SEQ ID NO: 111635 - DNA, 103 bp, Artificial Sequence
  Synthetic Polynucleotide
taatacgactcactatagggggctctgctggagggtccgtgcggcgtggtaacagaggagaaccacgatgcacggacccaacctggcggcagcgcaaaagatg

SEQ ID NO: 111636 - DNA, 103 bp, Artificial Sequence
  Synthetic Polynucleotide
taatacgactcactataggggcagcagcccggctctgctggagggtccgtaacagaggagaacggacatgccagcagagaacctggcggcagcgcaaaagatg

SEQ ID NO: 111637 - DNA, 103 bp, Artificial Sequence
  Synthetic Polynucleotide
taatacgactcactatagggggtggctgctgcagcagcccggctctgctgaacagaggagacagcagatgcgggctgctaacctggcggcagcgcaaaagatg

SEQ ID NO: 111638 - DNA, 103 bp, Artificial Sequence
  Synthetic Polynucleotide
taatacgactcactatagggtcccagcgctggtggctgctgcagcagcccaacagaggagagggctgatgcagcagccaaacctggcggcagcgcaaaagatg

SEQ ID NO: 111639 - DNA, 103 bp, Artificial Sequence
  Synthetic Polynucleotide
taatacgactcactatagggtgccgccgcgtcccagcgctggtggctgctaacagaggagaagcagcatgcagcgctggaacctggcggcagcgcaaaagatg

SEQ ID NO: 111640 - DNA, 103 bp, Artificial Sequence
  Synthetic Polynucleotide
taatacgactcactatagggccgccgccgctgccgccgcgtcccagcgctaacagaggagaagcgctatgacgcggcggaacctggcggcagcgcaaaagatg

SEQ ID NO: 111641 - DNA, 103 bp, Artificial Sequence
  Synthetic Polynucleotide
taatacgactcactatagggagggccgccgccgccgccgctgccgccgcgaacagaggagacgcggcatgagcggcggcaacctggcggcagcgcaaaagatg

SEQ ID NO: 111642 - DNA, 103 bp, Artificial Sequence
  Synthetic Polynucleotide
taatacgactcactataggggctttgccggagggccgccgccgccgccgcaacagaggagagcggcgatggcggcggccaacctggcggcagcgcaaaagatg

SEQ ID NO: 111643 - DNA, 103 bp, Artificial Sequence
  Synthetic Polynucleotide
taatacgactcactatagggtccagccttcgctttgccggagggccgccgaacagaggagacggcggatgtccggcaaaaacctggcggcagcgcaaaagatg

SEQ ID NO: 111644 - DNA, 103 bp, Artificial Sequence
  Synthetic Polynucleotide
taatacgactcactatagggctccccacccccggcggtcaccaggtactgaacagaggagacagtacatggtgaccgccaacctggcggcagcgcaaaagatg

SEQ ID NO: 111645 - DNA, 103 bp, Artificial Sequence
  Synthetic Polynucleotide
taatacgactcactatagggttctcctagctccagccttcgctttgccggaacagaggagaccggcaatgcgaaggctgaacctggcggcagcgcaaaagatg

SEQ ID NO: 111646 - DNA, 103 bp, Artificial Sequence
  Synthetic Polynucleotide
taatacgactcactataggggatgaccgctttctcctagctccagccttcaacagaggagagaaggcatgagctaggagaacctggcggcagcgcaaaagatg

SEQ ID NO: 111647 - DNA, 103 bp, Artificial Sequence
  Synthetic Polynucleotide
taatacgactcactataggggagaggtactgatgaccgctttctcctagcaacagaggagagctaggatgaagcggtcaaacctggcggcagcgcaaaagatg

SEQ ID NO: 111648 - DNA, 103 bp, Artificial Sequence
  Synthetic Polynucleotide
taatacgactcactatagggtaaaccatctgagaggtactgatgaccgctaacagaggagaagcggtatgcagtacctcaacctggcggcagcgcaaaagatg

SEQ ID NO: 111649 - DNA, 103 bp, Artificial Sequence
  Synthetic Polynucleotide
taatacgactcactatagggtgggggtttttaaaccatctgagaggtactaacagaggagaagtaccatgcagatggttaacctggcggcagcgcaaaagatg

SEQ ID NO: 111650 - DNA, 103 bp, Artificial Sequence
  Synthetic Polynucleotide
taatacgactcactatagggcctttgcccttgggggtttttaaaccatctaacagaggagaagatggatgaaaaaccccaacctggcggcagcgcaaaagatg

SEQ ID NO: 111651 - DNA, 103 bp, Artificial Sequence
  Synthetic Polynucleotide
taatacgactcactatagggtgcagctcttcctttgcccttgggggttttaacagaggagaaaaaccatgaagggcaaaaacctggcggcagcgcaaaagatg

SEQ ID NO: 111652 - DNA, 103 bp, Artificial Sequence
  Synthetic Polynucleotide
taatacgactcactataggggacttcgtagtgcagctcttcctttgccctaacagaggagaagggcaatggaagagctgaacctggcggcagcgcaaaagatg

SEQ ID NO: 111653 - DNA, 103 bp, Artificial Sequence
  Synthetic Polynucleotide
taatacgactcactatagggggactatctggacttcgtagtgcagctcttaacagaggagaaagagcatgactacgaagaacctggcggcagcgcaaaagatg

SEQ ID NO: 111654 - DNA, 103 bp, Artificial Sequence
  Synthetic Polynucleotide
taatacgactcactatagggtggagtttttggactatctggacttcgtagaacagaggagactacgaatgccagatagtaacctggcggcagcgcaaaagatg

SEQ ID NO: 111655 - DNA, 103 bp, Artificial Sequence
  Synthetic Polynucleotide
taatacgactcactatagggcagccgccccctccccacccccggcggtcaaacagaggagatgaccgatgggggtggggaacctggcggcagcgcaaaagatg

SEQ ID NO: 111656 - DNA, 103 bp, Artificial Sequence
  Synthetic Polynucleotide
taatacgactcactatagggagggagattttggagtttttggactatctgaacagaggagacagataatgcaaaaactcaacctggcggcagcgcaaaagatg

SEQ ID NO: 111657 - DNA, 103 bp, Artificial Sequence
  Synthetic Polynucleotide
taatacgactcactataggggttttttctgagggagattttggagtttttaacagaggagaaaaaacatgaaaatctccaacctggcggcagcgcaaaagatg

SEQ ID NO: 111658 - DNA, 103 bp, Artificial Sequence
  Synthetic Polynucleotide
taatacgactcactatagggatcataccgcgttttttctgagggagatttaacagaggagaaaatctatgtcagaaaaaaacctggcggcagcgcaaaagatg

SEQ ID NO: 111659 - DNA, 103 bp, Artificial Sequence
  Synthetic Polynucleotide
taatacgactcactatagggcaagagacgtatcataccgcgttttttctgaacagaggagacagaaaatgcgcggtatgaacctggcggcagcgcaaaagatg

SEQ ID NO: 111660 - DNA, 103 bp, Artificial Sequence
  Synthetic Polynucleotide
taatacgactcactataggggtgagcagaccaagagacgtatcataccgcaacagaggagagcggtaatgtacgtctctaacctggcggcagcgcaaaagatg

SEQ ID NO: 111661 - DNA, 103 bp, Artificial Sequence
  Synthetic Polynucleotide
taatacgactcactataggggaacttcttggtgagcagaccaagagacgtaacagaggagaacgtctatgggtctgctcaacctggcggcagcgcaaaagatg

SEQ ID NO: 111662 - DNA, 103 bp, Artificial Sequence
  Synthetic Polynucleotide
taatacgactcactatagggggagctgaatgaacttcttggtgagcagacaacagaggagagtctgcatgccaagaagtaacctggcggcagcgcaaaagatg

SEQ ID NO: 111663 - DNA, 103 bp, Artificial Sequence
  Synthetic Polynucleotide
taatacgactcactataggggactggctcaggagctgaatgaacttcttgaacagaggagacaagaaatgcattcagctaacctggcggcagcgcaaaagatg

SEQ ID NO: 111664 - DNA, 103 bp, Artificial Sequence
  Synthetic Polynucleotide
taatacgactcactatagggcccatcgggtgactggctcaggagctgaataacagaggagaattcagatgctgagccagaacctggcggcagcgcaaaagatg

SEQ ID NO: 111665 - DNA, 103 bp, Artificial Sequence
  Synthetic Polynucleotide
taatacgactcactatagggaatccaataccccatcgggtgactggctcaaacagaggagatgagccatgcacccgatgaacctggcggcagcgcaaaagatg

SEQ ID NO: 111666 - DNA, 103 bp, Artificial Sequence
  Synthetic Polynucleotide
taatacgactcactataggggcggcgacgacagccgccccctccccacccaacagaggagagggtggatggggggcggcaacctggcggcagcgcaaaagatg

SEQ ID NO: 111667 - DNA, 103 bp, Artificial Sequence
  Synthetic Polynucleotide
taatacgactcactataggggccttgttcaaatccaataccccatcgggtaacagaggagaacccgaatgggtattggaaacctggcggcagcgcaaaagatg

SEQ ID NO: 111668 - DNA, 103 bp, Artificial Sequence
  Synthetic Polynucleotide
taatacgactcactatagggcacttctgctgccttgttcaaatccaatacaacagaggagagtattgatgttgaacaagaacctggcggcagcgcaaaagatg

SEQ ID NO: 111669 - DNA, 103 bp, Artificial Sequence
  Synthetic Polynucleotide
taatacgactcactataggggcacttttagcacttctgctgccttgttcaaacagaggagatgaacaatgcagcagaagaacctggcggcagcgcaaaagatg

SEQ ID NO: 111670 - DNA, 103 bp, Artificial Sequence
  Synthetic Polynucleotide
taatacgactcactatagggcttctcttttgcacttttagcacttctgctaacagaggagaagcagaatggctaaaagtaacctggcggcagcgcaaaagatg

SEQ ID NO: 111671 - DNA, 103 bp, Artificial Sequence
  Synthetic Polynucleotide
taatacgactcactatagggatcataaatccttctcttttgcacttttagaacagaggagactaaaaatgcaaaagagaaacctggcggcagcgcaaaagatg

SEQ ID NO: 111672 - DNA, 103 bp, Artificial Sequence
  Synthetic Polynucleotide
taatacgactcactatagggcgttggtgatatcataaatccttctcttttaacagaggagaaaaagaatgggatttatgaacctggcggcagcgcaaaagatg

SEQ ID NO: 111673 - DNA, 103 bp, Artificial Sequence
  Synthetic Polynucleotide
taatacgactcactatagggccttccagaacgttggtgatatcataaatcaacagaggagagatttaatgtatcaccaaaacctggcggcagcgcaaaagatg

SEQ ID NO: 111674 - DNA, 103 bp, Artificial Sequence
  Synthetic Polynucleotide
taatacgactcactataggggaggtggatgccttccagaacgttggtgataacagaggagaatcaccatggttctggaaaacctggcggcagcgcaaaagatg

SEQ ID NO: 111675 - DNA, 103 bp, Artificial Sequence
  Synthetic Polynucleotide
taatacgactcactatagggtcttcttaatgaggtggatgccttccagaaaacagaggagattctggatggcatccaccaacctggcggcagcgcaaaagatg

SEQ ID NO: 111676 - DNA, 103 bp, Artificial Sequence
  Synthetic Polynucleotide
taatacgactcactatagggtttttagacttcttcttaatgaggtggatgaacagaggagacatccaatgcattaagaaaacctggcggcagcgcaaaagatg

SEQ ID NO: 111677 - DNA, 103 bp, Artificial Sequence
  Synthetic Polynucleotide
taatacgactcactatagggtgcagcggcggcggcgacgacagccgccccaacagaggagaggggcgatggtcgtcgccaacctggcggcagcgcaaaagatg

SEQ ID NO: 111678 - DNA, 103 bp, Artificial Sequence
  Synthetic Polynucleotide
taatacgactcactatagggttggacgttgtttttagacttcttcttaataacagaggagaattaagatgaagtctaaaaacctggcggcagcgcaaaagatg

SEQ ID NO: 111679 - DNA, 103 bp, Artificial Sequence
  Synthetic Polynucleotide
taatacgactcactatagggagcccatccattggacgttgtttttagactaacagaggagaagtctaatgacaacgtccaacctggcggcagcgcaaaagatg

SEQ ID NO: 111680 - DNA, 103 bp, Artificial Sequence
  Synthetic Polynucleotide
taatacgactcactataggggacagactgcagcccatccattggacgttgaacagaggagacaacgtatgatggatgggaacctggcggcagcgcaaaagatg

SEQ ID NO: 111681 - DNA, 103 bp, Artificial Sequence
  Synthetic Polynucleotide
taatacgactcactatagggcccatcctcagacagactgcagcccatccaaacagaggagatggatgatgtgcagtctgaacctggcggcagcgcaaaagatg

SEQ ID NO: 111682 - DNA, 103 bp, Artificial Sequence
  Synthetic Polynucleotide
taatacgactcactatagggccagcatgcccccatcctcagacagactgcaacagaggagagcagtcatgctgaggatgaacctggcggcagcgcaaaagatg

SEQ ID NO: 111683 - DNA, 103 bp, Artificial Sequence
  Synthetic Polynucleotide
taatacgactcactatagggtgacactgggccagcatgcccccatcctcaaacagaggagatgaggaatggggcatgctaacctggcggcagcgcaaaagatg

SEQ ID NO: 111684 - DNA, 103 bp, Artificial Sequence
  Synthetic Polynucleotide
taatacgactcactatagggtgacaggccttgacactgggccagcatgccaacagaggagaggcatgatggcccagtgtaacctggcggcagcgcaaaagatg

SEQ ID NO: 111685 - DNA, 103 bp, Artificial Sequence
  Synthetic Polynucleotide
taatacgactcactatagggtcacttcttttgacaggccttgacactgggaacagaggagacccagtatgaaggcctgtaacctggcggcagcgcaaaagatg

SEQ ID NO: 111686 - DNA, 103 bp, Artificial Sequence
  Synthetic Polynucleotide
taatacgactcactatagggctgagctcggtcacttcttttgacaggcctaacagaggagaaggcctatgaaaagaagtaacctggcggcagcgcaaaagatg

SEQ ID NO: 111687 - DNA, 103 bp, Artificial Sequence
  Synthetic Polynucleotide
taatacgactcactatagggctcttcctgactgagctcggtcacttctttaacagaggagaaaagaaatgaccgagctcaacctggcggcagcgcaaaagatg

SEQ ID NO: 111688 - DNA, 103 bp, Artificial Sequence
  Synthetic Polynucleotide
taatacgactcactatagggccatggaggctgcagcggcggcggcgacgaaacagaggagatcgtcgatgccgccgctgaacctggcggcagcgcaaaagatg

SEQ ID NO: 111689 - DNA, 103 bp, Artificial Sequence
  Synthetic Polynucleotide
taatacgactcactatagggctaatttcttctcttcctgactgagctcggaacagaggagaccgagcatggtcaggaagaacctggcggcagcgcaaaagatg

SEQ ID NO: 111690 - DNA, 103 bp, Artificial Sequence
  Synthetic Polynucleotide
taatacgactcactatagggatcagttcatctaatttcttctcttcctgaaacagaggagatcaggaatggaagaaattaacctggcggcagcgcaaaagatg

SEQ ID NO: 111691 - DNA, 103 bp, Artificial Sequence
  Synthetic Polynucleotide
taatacgactcactataggggcagctttggatcagttcatctaatttcttaacagaggagaaagaaaatggatgaactgaacctggcggcagcgcaaaagatg

SEQ ID NO: 111692 - DNA, 103 bp, Artificial Sequence
  Synthetic Polynucleotide
taatacgactcactatagggggtccagggtgcagctttggatcagttcataacagaggagaatgaacatgtccaaagctaacctggcggcagcgcaaaagatg

SEQ ID NO: 111693 - DNA, 103 bp, Artificial Sequence
  Synthetic Polynucleotide
taatacgactcactatagggaacagtttgaggtccagggtgcagctttggaacagaggagaccaaagatgcaccctggaaacctggcggcagcgcaaaagatg

SEQ ID NO: 111694 - DNA, 103 bp, Artificial Sequence
  Synthetic Polynucleotide
taatacgactcactatagggatcctcggttaacagtttgaggtccagggtaacagaggagaaccctgatgctcaaactgaacctggcggcagcgcaaaagatg

SEQ ID NO: 111695 - DNA, 103 bp, Artificial Sequence
  Synthetic Polynucleotide
taatacgactcactataggggattctctgaatcctcggttaacagtttgaaacagaggagatcaaacatgtaaccgaggaacctggcggcagcgcaaaagatg

SEQ ID NO: 111696 - DNA, 103 bp, Artificial Sequence
  Synthetic Polynucleotide
taatacgactcactataggggctaacctttgattctctgaatcctcggttaacagaggagaaaccgaatgttcagagaaaacctggcggcagcgcaaaagatg

SEQ ID NO: 111697 - DNA, 103 bp, Artificial Sequence
  Synthetic Polynucleotide
taatacgactcactatagggtgtaacataagctaacctttgattctctgaaacagaggagatcagagatgcaaaggttaaacctggcggcagcgcaaaagatg

SEQ ID NO: 111698 - DNA, 103 bp, Artificial Sequence
  Synthetic Polynucleotide
taatacgactcactatagggtatcttgatatgtaacataagctaacctttaacagaggagaaaaggtatgcttatgttaaacctggcggcagcgcaaaagatg

SEQ ID NO: 111699 - DNA, 103 bp, Artificial Sequence
  Synthetic Polynucleotide
taatacgactcactataggggcccttttgtccatggaggctgcagcggcgaacagaggagacgccgcatgagcctccataacctggcggcagcgcaaaagatg

SEQ ID NO: 111700 - DNA, 103 bp, Artificial Sequence
  Synthetic Polynucleotide
taatacgactcactatagggatttttcgaatatcttgatatgtaacataaaacagaggagattatgtatgatatcaagaaacctggcggcagcgcaaaagatg

SEQ ID NO: 111701 - DNA, 103 bp, Artificial Sequence
  Synthetic Polynucleotide
taatacgactcactatagggaaggccactaatttttcgaatatcttgataaacagaggagatatcaaatgattcgaaaaaacctggcggcagcgcaaaagatg

SEQ ID NO: 111702 - DNA, 103 bp, Artificial Sequence
  Synthetic Polynucleotide
taatacgactcactatagggtttggtctttaaggccactaatttttcgaaaacagaggagattcgaaatgttagtggccaacctggcggcagcgcaaaagatg

SEQ ID NO: 111703 - DNA, 103 bp, Artificial Sequence
  Synthetic Polynucleotide
taatacgactcactatagggactataacagtttggtctttaaggccactaaacagaggagatagtggatgtaaagaccaaacctggcggcagcgcaaaagatg

SEQ ID NO: 111704 - DNA, 103 bp, Artificial Sequence
  Synthetic Polynucleotide
taatacgactcactatagggggctttcacaactataacagtttggtctttaacagaggagaaaagacatgactgttataaacctggcggcagcgcaaaagatg

SEQ ID NO: 111705 - DNA, 103 bp, Artificial Sequence
  Synthetic Polynucleotide
taatacgactcactatagggtttctggaggggctttcacaactataacagaacagaggagactgttaatgttgtgaaagaacctggcggcagcgcaaaagatg

SEQ ID NO: 111706 - DNA, 103 bp, Artificial Sequence
  Synthetic Polynucleotide
taatacgactcactatagggtcaagtcttgtttctggaggggctttcacaaacagaggagatgtgaaatgccctccagaaacctggcggcagcgcaaaagatg

SEQ ID NO: 111707 - DNA, 103 bp, Artificial Sequence
  Synthetic Polynucleotide
taatacgactcactataggggtcaggcacttcaagtcttgtttctggaggaacagaggagacctccaatgacaagacttaacctggcggcagcgcaaaagatg

SEQ ID NO: 111708 - DNA, 103 bp, Artificial Sequence
  Synthetic Polynucleotide
taatacgactcactatagggtctctattgagtcaggcacttcaagtcttgaacagaggagacaagacatgaagtgcctgaacctggcggcagcgcaaaagatg

SEQ ID NO: 111709 - DNA, 103 bp, Artificial Sequence
  Synthetic Polynucleotide
taatacgactcactatagggatttgtaggctctctattgagtcaggcactaacagaggagaagtgccatgctcaatagaaacctggcggcagcgcaaaagatg

SEQ ID NO: 111710 - DNA, 103 bp, Artificial Sequence
  Synthetic Polynucleotide
taatacgactcactatagggcggcggcgcctgtggcccggcctccgccataacagaggagaatggcgatggccgggccaaacctggcggcagcgcaaaagatg

SEQ ID NO: 111711 - DNA, 103 bp, Artificial Sequence
  Synthetic Polynucleotide
taatacgactcactatagggcacgccgtccttggcctcctgcagaagggaaacagaggagatcccttatgcaggaggccaacctggcggcagcgcaaaagatg

SEQ ID NO: 111712 - DNA, 103 bp, Artificial Sequence
  Synthetic Polynucleotide
taatacgactcactatagggtgccttgatgggctcaaaggaggtagaaggaacagaggagaccttctatgtcctttgagaacctggcggcagcgcaaaagatg

SEQ ID NO: 111713 - DNA, 103 bp, Artificial Sequence
  Synthetic Polynucleotide
taatacgactcactatagggctgtggggtctgccttgatgggctcaaaggaacagaggagacctttgatgccatcaaggaacctggcggcagcgcaaaagatg

SEQ ID NO: 111714 - DNA, 103 bp, Artificial Sequence
  Synthetic Polynucleotide
taatacgactcactatagggtccaaaacacctgtggggtctgccttgatgaacagaggagacatcaaatgagaccccacaacctggcggcagcgcaaaagatg

SEQ ID NO: 111715 - DNA, 103 bp, Artificial Sequence
  Synthetic Polynucleotide
taatacgactcactatagggtttggggagttccaaaacacctgtggggtcaacagaggagagaccccatgggtgttttgaacctggcggcagcgcaaaagatg

SEQ ID NO: 111716 - DNA, 103 bp, Artificial Sequence
  Synthetic Polynucleotide
taatacgactcactatagggctgacagctctttggggagttccaaaacacaacagaggagagtgtttatgaactccccaaacctggcggcagcgcaaaagatg

SEQ ID NO: 111717 - DNA, 103 bp, Artificial Sequence
  Synthetic Polynucleotide
taatacgactcactatagggtcaaagatttctgacagctctttggggagtaacagaggagaactcccatgagagctgtcaacctggcggcagcgcaaaagatg

SEQ ID NO: 111718 - DNA, 103 bp, Artificial Sequence
  Synthetic Polynucleotide
taatacgactcactatagggtcgtgtgggatcaaagatttctgacagctcaacagaggagagagctgatggaaatctttaacctggcggcagcgcaaaagatg

SEQ ID NO: 111719 - DNA, 103 bp, Artificial Sequence
  Synthetic Polynucleotide
taatacgactcactatagggtcatgcactctcgtgtgggatcaaagatttaacagaggagaaaatctatgatcccacacaacctggcggcagcgcaaaagatg

SEQ ID NO: 111720 - DNA, 103 bp, Artificial Sequence
  Synthetic Polynucleotide
taatacgactcactatagggagctccgagctcatgcactctcgtgtgggaaacagaggagatcccacatgagagtgcataacctggcggcagcgcaaaagatg

SEQ ID NO: 111721 - DNA, 103 bp, Artificial Sequence
  Synthetic Polynucleotide
taatacgactcactatagggctcctccagcagctccgagctcatgcactcaacagaggagagagtgcatgagctcggagaacctggcggcagcgcaaaagatg

SEQ ID NO: 111722 - DNA, 103 bp, Artificial Sequence
  Synthetic Polynucleotide
taatacgactcactatagggtgaggtcaagcacgccgtccttggcctcctaacagaggagaaggaggatgaggacggcgaacctggcggcagcgcaaaagatg

SEQ ID NO: 111723 - DNA, 103 bp, Artificial Sequence
  Synthetic Polynucleotide
taatacgactcactatagggaggacatcaactcctccagcagctccgagcaacagaggagagctcggatgtgctggaggaacctggcggcagcgcaaaagatg

SEQ ID NO: 111724 - DNA, 103 bp, Artificial Sequence
  Synthetic Polynucleotide
taatacgactcactatagggaacacttctgaggacatcaactcctccagcaacagaggagagctggaatggttgatgtcaacctggcggcagcgcaaaagatg

SEQ ID NO: 111725 - DNA, 103 bp, Artificial Sequence
  Synthetic Polynucleotide
taatacgactcactatagggcagaggggcaaacacttctgaggacatcaaaacagaggagattgatgatgtcagaagtgaacctggcggcagcgcaaaagatg

SEQ ID NO: 111726 - DNA, 103 bp, Artificial Sequence
  Synthetic Polynucleotide
taatacgactcactatagggaaagacgaagcagaggggcaaacacttctgaacagaggagacagaagatgttgcccctcaacctggcggcagcgcaaaagatg

SEQ ID NO: 111727 - DNA, 103 bp, Artificial Sequence
  Synthetic Polynucleotide
taatacgactcactataggggggggtggagaaagacgaagcagaggggcaaacagaggagatgccccatggcttcgtctaacctggcggcagcgcaaaagatg

SEQ ID NO: 111728 - DNA, 103 bp, Artificial Sequence
  Synthetic Polynucleotide
taatacgactcactataggggtggtctcccgggggtggagaaagacgaagaacagaggagacttcgtatgtctccacccaacctggcggcagcgcaaaagatg

SEQ ID NO: 111729 - DNA, 103 bp, Artificial Sequence
  Synthetic Polynucleotide
taatacgactcactatagggagatataatcgtggtctcccgggggtggagaacagaggagactccacatgcgggagaccaacctggcggcagcgcaaaagatg

SEQ ID NO: 111730 - DNA, 103 bp, Artificial Sequence
  Synthetic Polynucleotide
taatacgactcactatagggtccaggttgtagatataatcgtggtctcccaacagaggagagggagaatgcgattatataacctggcggcagcgcaaaagatg

SEQ ID NO: 111731 - DNA, 103 bp, Artificial Sequence
  Synthetic Polynucleotide
taatacgactcactatagggttcactctcgtccaggttgtagatataatcaacagaggagagattatatgtacaacctgaacctggcggcagcgcaaaagatg

SEQ ID NO: 111732 - DNA, 103 bp, Artificial Sequence
  Synthetic Polynucleotide
taatacgactcactatagggcacagacaccttcactctcgtccaggttgtaacagaggagaacaaccatgacgagagtgaacctggcggcagcgcaaaagatg

SEQ ID NO: 111733 - DNA, 103 bp, Artificial Sequence
  Synthetic Polynucleotide
taatacgactcactataggggctgccagcttgaggtcaagcacgccgtccaacagaggagaggacggatggcttgacctaacctggcggcagcgcaaaagatg

SEQ ID NO: 111734 - DNA, 103 bp, Artificial Sequence
  Synthetic Polynucleotide
taatacgactcactatagggtcaaagaggtcacagacaccttcactctcgaacagaggagacgagagatgaggtgtctgaacctggcggcagcgcaaaagatg

SEQ ID NO: 111735 - DNA, 103 bp, Artificial Sequence
  Synthetic Polynucleotide
taatacgactcactatagggaacaggcacatcaaagaggtcacagacaccaacagaggagaggtgtcatggacctctttaacctggcggcagcgcaaaagatg

SEQ ID NO: 111736 - DNA, 103 bp, Artificial Sequence
  Synthetic Polynucleotide
taatacgactcactatagggagaggttgagaacaggcacatcaaagaggtaacagaggagaacctctatgatgtgcctgaacctggcggcagcgcaaaagatg

SEQ ID NO: 111737 - DNA, 103 bp, Artificial Sequence
  Synthetic Polynucleotide
taatacgactcactatagggtagggtgtcagctgccagcttgaggtcaagaacagaggagacttgacatgaagctggcaaacctggcggcagcgcaaaagatg

SEQ ID NO: 111738 - DNA, 103 bp, Artificial Sequence
  Synthetic Polynucleotide
taatacgactcactatagggggcgtacagctagggtgtcagctgccagctaacagaggagaagctggatgctgacacccaacctggcggcagcgcaaaagatg

SEQ ID NO: 111739 - DNA, 103 bp, Artificial Sequence
  Synthetic Polynucleotide
taatacgactcactatagggcgccgcttctggcgtacagctagggtgtcaaacagaggagatgacacatgagctgtacgaacctggcggcagcgcaaaagatg

SEQ ID NO: 111740 - DNA, 103 bp, Artificial Sequence
  Synthetic Polynucleotide
taatacgactcactataggggtcgtaaatccgccgcttctggcgtacagcaacagaggagagctgtaatgcagaagcggaacctggcggcagcgcaaaagatg

SEQ ID NO: 111741 - DNA, 103 bp, Artificial Sequence
  Synthetic Polynucleotide
taatacgactcactatagggcattggtaatgtcgtaaatccgccgcttctaacagaggagaagaagcatgggatttacgaacctggcggcagcgcaaaagatg

SEQ ID NO: 111742 - DNA, 103 bp, Artificial Sequence
  Synthetic Polynucleotide
taatacgactcactatagggccttccaaaacattggtaatgtcgtaaatcaacagaggagagatttaatgcattaccaaaacctggcggcagcgcaaaagatg

SEQ ID NO: 111743 - DNA, 103 bp, Artificial Sequence
  Synthetic Polynucleotide
taatacgactcactatagggtagcccgataccttccaaaacattggtaataacagaggagaattaccatggttttggaaaacctggcggcagcgcaaaagatg

SEQ ID NO: 111744 - DNA, 103 bp, Artificial Sequence
  Synthetic Polynucleotide
taatacgactcactatagggtgcccgggggcggcggcgcctgtggcccggaacagaggagaccgggcatgaggcgccgcaacctggcggcagcgcaaaagatg

SEQ ID NO: 111745 - DNA, 103 bp, Artificial Sequence
  Synthetic Polynucleotide
taatacgactcactatagggttttctcgattagcccgataccttccaaaaaacagaggagattttggatggtatcgggcaacctggcggcagcgcaaaagatg

SEQ ID NO: 111746 - DNA, 103 bp, Artificial Sequence
  Synthetic Polynucleotide
taatacgactcactatagggttcttggactttttctcgattagcccgataaacagaggagatatcggatgaatcgagaaaacctggcggcagcgcaaaagatg

SEQ ID NO: 111747 - DNA, 103 bp, Artificial Sequence
  Synthetic Polynucleotide
taatacgactcactatagggctggatgctgttcttggactttttctcgataacagaggagaatcgagatgaagtccaagaacctggcggcagcgcaaaagatg

SEQ ID NO: 111748 - DNA, 103 bp, Artificial Sequence
  Synthetic Polynucleotide
taatacgactcactatagggcacccttccactggatgctgttcttggactaacagaggagaagtccaatgacagcatccaacctggcggcagcgcaaaagatg

SEQ ID NO: 111749 - DNA, 103 bp, Artificial Sequence
  Synthetic Polynucleotide
taatacgactcactatagggccaggccccacacccttccactggatgctgaacagaggagacagcatatggtggaagggaacctggcggcagcgcaaaagatg

SEQ ID NO: 111750 - DNA, 103 bp, Artificial Sequence
  Synthetic Polynucleotide
taatacgactcactatagggggtattgcagccaggccccacacccttccaaacagaggagatggaagatggtggggcctaacctggcggcagcgcaaaagatg

SEQ ID NO: 111751 - DNA, 103 bp, Artificial Sequence
  Synthetic Polynucleotide
taatacgactcactatagggcaatctcccgggtattgcagccaggccccaaacagaggagatggggcatggctgcaataaacctggcggcagcgcaaaagatg

SEQ ID NO: 111752 - DNA, 103 bp, Artificial Sequence
  Synthetic Polynucleotide
taatacgactcactatagggagtttgtcagcaatctcccgggtattgcagaacagaggagactgcaaatgccgggagataacctggcggcagcgcaaaagatg

SEQ ID NO: 111753 - DNA, 103 bp, Artificial Sequence
  Synthetic Polynucleotide
taatacgactcactataggggagctcaatcagtttgtcagcaatctcccgaacagaggagacgggagatggctgacaaaaacctggcggcagcgcaaaagatg

SEQ ID NO: 111754 - DNA, 103 bp, Artificial Sequence
  Synthetic Polynucleotide
taatacgactcactatagggtctctgccttgagctcaatcagtttgtcagaacagaggagactgacaatgtgattgagcaacctggcggcagcgcaaaagatg

SEQ ID NO: 111755 - DNA, 103 bp, Artificial Sequence
  Synthetic Polynucleotide
taatacgactcactatagggcggcttggagtgcccgggggcggcggcgccaacagaggagaggcgccatggcccccgggaacctggcggcagcgcaaaagatg

SEQ ID NO: 111756 - DNA, 103 bp, Artificial Sequence
  Synthetic Polynucleotide
taatacgactcactatagggagctcctcgatctctgccttgagctcaatcaacagaggagagattgaatgcaaggcagaaacctggcggcagcgcaaaagatg

SEQ ID NO: 111757 - DNA, 103 bp, Artificial Sequence
  Synthetic Polynucleotide
taatacgactcactatagggccgctgctgcagctcctcgatctctgccttaacagaggagaaaggcaatgatcgaggagaacctggcggcagcgcaaaagatg

SEQ ID NO: 111758 - DNA, 103 bp, Artificial Sequence
  Synthetic Polynucleotide
taatacgactcactataggggttcttgctcccgctgctgcagctcctcgaaacagaggagatcgaggatgtgcagcagcaacctggcggcagcgcaaaagatg

SEQ ID NO: 111759 - DNA, 103 bp, Artificial Sequence
  Synthetic Polynucleotide
taatacgactcactatagggtgctggtctagttcttgctcccgctgctgcaacagaggagagcagcaatgggagcaagaaacctggcggcagcgcaaaagatg

SEQ ID NO: 111760 - DNA, 103 bp, Artificial Sequence
  Synthetic Polynucleotide
taatacgactcactatagggccacaccttgtgctggtctagttcttgctcaacagaggagagagcaaatgctagaccagaacctggcggcagcgcaaaagatg

SEQ ID NO: 111761 - DNA, 103 bp, Artificial Sequence
  Synthetic Polynucleotide
taatacgactcactatagggtctgctgcacccacaccttgtgctggtctaaacagaggagatagaccatgacaaggtgtaacctggcggcagcgcaaaagatg

SEQ ID NO: 111762 - DNA, 103 bp, Artificial Sequence
  Synthetic Polynucleotide
taatacgactcactatagggttccggatgctctgctgcacccacaccttgaacagaggagacaaggtatgggtgcagcaaacctggcggcagcgcaaaagatg

SEQ ID NO: 111763 - DNA, 103 bp, Artificial Sequence
  Synthetic Polynucleotide
taatacgactcactatagggctctgtgacgttccggatgctctgctgcacaacagaggagagtgcagatgagcatccggaacctggcggcagcgcaaaagatg

SEQ ID NO: 111764 - DNA, 103 bp, Artificial Sequence
  Synthetic Polynucleotide
taatacgactcactatagggtctgcacgtcctctgtgacgttccggatgcaacagaggagagcatccatgacgtcacagaacctggcggcagcgcaaaagatg

SEQ ID NO: 111765 - DNA, 103 bp, Artificial Sequence
  Synthetic Polynucleotide
taatacgactcactatagggaaacagctgttctgcacgtcctctgtgacgaacagaggagacgtcacatgggacgtgcaaacctggcggcagcgcaaaagatg

SEQ ID NO: 111766 - DNA, 103 bp, Artificial Sequence
  Synthetic Polynucleotide
taatacgactcactatagggcttttcgtgccggcttggagtgcccgggggaacagaggagacccccgatgactccaagcaacctggcggcagcgcaaaagatg

SEQ ID NO: 111767 - DNA, 103 bp, Artificial Sequence
  Synthetic Polynucleotide
taatacgactcactataggggacgtaggccaaacagctgttctgcacgtcaacagaggagagacgtgatgaacagctgtaacctggcggcagcgcaaaagatg

SEQ ID NO: 111768 - DNA, 103 bp, Artificial Sequence
  Synthetic Polynucleotide
taatacgactcactatagggcctcatgagtgacgtaggccaaacagctgtaacagaggagaacagctatgtggcctacgaacctggcggcagcgcaaaagatg

SEQ ID NO: 111769 - DNA, 103 bp, Artificial Sequence
  Synthetic Polynucleotide
taatacgactcactatagggctgcagatgtcctcatgagtgacgtaggccaacagaggagaggcctaatgcactcatgaaacctggcggcagcgcaaaagatg

SEQ ID NO: 111770 - DNA, 103 bp, Artificial Sequence
  Synthetic Polynucleotide
taatacgactcactatagggagcaaagcatctgcagatgtcctcatgagtaacagaggagaactcatatggacatctgcaacctggcggcagcgcaaaagatg

SEQ ID NO: 111771 - DNA, 103 bp, Artificial Sequence
  Synthetic Polynucleotide
taatacgactcactataggggggtatctccagcaaagcatctgcagatgtaacagaggagaacatctatggatgctttgaacctggcggcagcgcaaaagatg

SEQ ID NO: 111772 - DNA, 103 bp, Artificial Sequence
  Synthetic Polynucleotide
taatacgactcactatagggatggccaagagggtatctccagcaaagcataacagaggagaatgcttatgtggagatacaacctggcggcagcgcaaaagatg

SEQ ID NO: 111773 - DNA, 103 bp, Artificial Sequence
  Synthetic Polynucleotide
taatacgactcactatagggtggggcccggatggccaagagggtatctccaacagaggagaggagatatgctcttggccaacctggcggcagcgcaaaagatg

SEQ ID NO: 111774 - DNA, 103 bp, Artificial Sequence
  Synthetic Polynucleotide
taatacgactcactatagggtggtgcctgatggggcccggatggccaagaaacagaggagatcttggatgtccgggcccaacctggcggcagcgcaaaagatg

SEQ ID NO: 111775 - DNA, 103 bp, Artificial Sequence
  Synthetic Polynucleotide
taatacgactcactatagggacctccaggctggtgcctgatggggcccggaacagaggagaccgggcatgatcaggcacaacctggcggcagcgcaaaagatg

SEQ ID NO: 111776 - DNA, 103 bp, Artificial Sequence
  Synthetic Polynucleotide
taatacgactcactatagggtgggatgggcacctccaggctggtgcctgaaacagaggagatcaggcatgagcctggagaacctggcggcagcgcaaaagatg

SEQ ID NO: 111777 - DNA, 103 bp, Artificial Sequence
  Synthetic Polynucleotide
taatacgactcactataggggtcccaggctcttttcgtgccggcttggagaacagaggagactccaaatgggcacgaaaaacctggcggcagcgcaaaagatg

SEQ ID NO: 111778 - DNA, 103 bp, Artificial Sequence
  Synthetic Polynucleotide
taatacgactcactatagggtgagaccctctgggatgggcacctccaggcaacagaggagagcctggatgtgcccatccaacctggcggcagcgcaaaagatg

SEQ ID NO: 111779 - DNA, 103 bp, Artificial Sequence
  Synthetic Polynucleotide
taatacgactcactatagggttctgcccattgagaccctctgggatgggcaacagaggagagcccatatgagagggtctaacctggcggcagcgcaaaagatg

SEQ ID NO: 111780 - DNA, 103 bp, Artificial Sequence
  Synthetic Polynucleotide
taatacgactcactatagggctggtacttcttctgcccattgagaccctcaacagaggagagagggtatgaatgggcagaacctggcggcagcgcaaaagatg

SEQ ID NO: 111781 - DNA, 103 bp, Artificial Sequence
  Synthetic Polynucleotide
taatacgactcactatagggtcaggtgaatctggtacttcttctgcccataacagaggagaatgggcatgagaagtaccaacctggcggcagcgcaaaagatg

SEQ ID NO: 111782 - DNA, 103 bp, Artificial Sequence
  Synthetic Polynucleotide
taatacgactcactatagggctcacactcttcaggtgaatctggtacttcaacagaggagagaagtaatggattcacctaacctggcggcagcgcaaaagatg

SEQ ID NO: 111783 - DNA, 103 bp, Artificial Sequence
  Synthetic Polynucleotide
taatacgactcactatagggaatgggaccactcacactcttcaggtgaataacagaggagaattcacatgaagagtgtgaacctggcggcagcgcaaaagatg

SEQ ID NO: 111784 - DNA, 103 bp, Artificial Sequence
  Synthetic Polynucleotide
taatacgactcactataggggcagaacctcaatgggaccactcacactctaacagaggagaagagtgatggtggtcccaaacctggcggcagcgcaaaagatg

SEQ ID NO: 111785 - DNA, 103 bp, Artificial Sequence
  Synthetic Polynucleotide
taatacgactcactatagggttgttcaccagcagaacctcaatgggaccaaacagaggagatggtccatgtgaggttctaacctggcggcagcgcaaaagatg

SEQ ID NO: 111786 - DNA, 103 bp, Artificial Sequence
  Synthetic Polynucleotide
taatacgactcactatagggccatgcctccttgttcaccagcagaacctcaacagaggagagaggttatgctggtgaacaacctggcggcagcgcaaaagatg

SEQ ID NO: 111787 - DNA, 103 bp, Artificial Sequence
  Synthetic Polynucleotide
taatacgactcactatagggggggtgagctccatgcctccttgttcaccaaacagaggagatggtgaatgaggaggcataacctggcggcagcgcaaaagatg

SEQ ID NO: 111788 - DNA, 103 bp, Artificial Sequence
  Synthetic Polynucleotide
taatacgactcactataggggtggtgagcagtcccaggctcttttcgtgcaacagaggagagcacgaatggagcctgggaacctggcggcagcgcaaaagatg

SEQ ID NO: 111789 - DNA, 103 bp, Artificial Sequence
  Synthetic Polynucleotide
taatacgactcactatagggacagccacagggggtgagctccatgcctccaacagaggagaggaggcatggagctcaccaacctggcggcagcgcaaaagatg

SEQ ID NO: 111790 - DNA, 103 bp, Artificial Sequence
  Synthetic Polynucleotide
taatacgactcactatagggtggcacaggcacagccacagggggtgagctaacagaggagaagctcaatgcctgtggctaacctggcggcagcgcaaaagatg

SEQ ID NO: 111791 - DNA, 103 bp, Artificial Sequence
  Synthetic Polynucleotide
taatacgactcactatagggcttcaggtggtggcacaggcacagccacagaacagaggagactgtggatgtgcctgtgcaacctggcggcagcgcaaaagatg

SEQ ID NO: 111792 - DNA, 103 bp, Artificial Sequence
  Synthetic Polynucleotide
taatacgactcactatagggtggagcaaatcttcaggtggtggcacaggcaacagaggagagcctgtatgaccacctgaaacctggcggcagcgcaaaagatg

SEQ ID NO: 111793 - DNA, 103 bp, Artificial Sequence
  Synthetic Polynucleotide
taatacgactcactatagggagatgggctctggagcaaatcttcaggtggaacagaggagaccacctatggatttgctcaacctggcggcagcgcaaaagatg

SEQ ID NO: 111794 - DNA, 103 bp, Artificial Sequence
  Synthetic Polynucleotide
taatacgactcactatagggtagaaacagcagatgggctctggagcaaataacagaggagaatttgcatgagagcccataacctggcggcagcgcaaaagatg

SEQ ID NO: 111795 - DNA, 103 bp, Artificial Sequence
  Synthetic Polynucleotide
taatacgactcactatagggggtggaggtgtagaaacagcagatgggctcaacagaggagagagcccatgtgctgtttcaacctggcggcagcgcaaaagatg

SEQ ID NO: 111796 - DNA, 103 bp, Artificial Sequence
  Synthetic Polynucleotide
taatacgactcactatagggcttgggcagaggtggaggtgtagaaacagcaacagaggagagctgttatgacacctccaaacctggcggcagcgcaaaagatg

SEQ ID NO: 111797 - DNA, 103 bp, Artificial Sequence
  Synthetic Polynucleotide
taatacgactcactatagggctagggcaggcttgggcagaggtggaggtgaacagaggagacacctcatgctctgcccaaacctggcggcagcgcaaaagatg

SEQ ID NO: 111798 - DNA, 103 bp, Artificial Sequence
  Synthetic Polynucleotide
taatacgactcactatagggtgggactgggctagggcaggcttgggcagaaacagaggagatctgccatggcctgccctaacctggcggcagcgcaaaagatg

SEQ ID NO: 111799 - DNA, 103 bp, Artificial Sequence
  Synthetic Polynucleotide
taatacgactcactatagggcacgaacttggtggtgagcagtcccaggctaacagaggagaagcctgatgctgctcaccaacctggcggcagcgcaaaagatg

SEQ ID NO: 111800 - DNA, 103 bp, Artificial Sequence
  Synthetic Polynucleotide
taatacgactcactatagggtgaggcttcctgggactgggctagggcaggaacagaggagacctgccatggcccagtccaacctggcggcagcgcaaaagatg

SEQ ID NO: 111801 - DNA, 103 bp, Artificial Sequence
  Synthetic Polynucleotide
taatacgactcactatagggtatttggacgtgaggcttcctgggactgggaacagaggagacccagtatgaggaagcctaacctggcggcagcgcaaaagatg

SEQ ID NO: 111802 - DNA, 103 bp, Artificial Sequence
  Synthetic Polynucleotide
taatacgactcactatagggagctgaggactatttggacgtgaggcttccaacagaggagaggaagcatgacgtccaaaaacctggcggcagcgcaaaagatg

SEQ ID NO: 111803 - DNA, 103 bp, Artificial Sequence
  Synthetic Polynucleotide
taatacgactcactatagggagtgggagtgagctgaggactatttggacgaacagaggagacgtccaatgagtcctcagaacctggcggcagcgcaaaagatg

SEQ ID NO: 111804 - DNA, 103 bp, Artificial Sequence
  Synthetic Polynucleotide
taatacgactcactatagggcagggacagcagtgggagtgagctgaggacaacagaggagagtcctcatgtcactcccaaacctggcggcagcgcaaaagatg

SEQ ID NO: 111805 - DNA, 103 bp, Artificial Sequence
  Synthetic Polynucleotide
taatacgactcactatagggtctgcactgccagggacagcagtgggagtgaacagaggagacactccatgtgctgtcccaacctggcggcagcgcaaaagatg

SEQ ID NO: 111806 - DNA, 103 bp, Artificial Sequence
  Synthetic Polynucleotide
taatacgactcactatagggtccctggacttctgcactgccagggacagcaacagaggagagctgtcatgggcagtgcaaacctggcggcagcgcaaaagatg

SEQ ID NO: 111807 - DNA, 103 bp, Artificial Sequence
  Synthetic Polynucleotide
taatacgactcactatagggggccagccattccctggacttctgcactgcaacagaggagagcagtgatgaagtccaggaacctggcggcagcgcaaaagatg

SEQ ID NO: 111808 - DNA, 103 bp, Artificial Sequence
  Synthetic Polynucleotide
taatacgactcactatagggtcagctgctgggccagccattccctggactaacagaggagaagtccaatgaatggctggaacctggcggcagcgcaaaagatg

SEQ ID NO: 111809 - DNA, 103 bp, Artificial Sequence
  Synthetic Polynucleotide
taatacgactcactatagggcactgtgatctcagctgctgggccagccataacagaggagaatggctatgccagcagctaacctggcggcagcgcaaaagatg

SEQ ID NO: 111810 - DNA, 103 bp, Artificial Sequence
  Synthetic Polynucleotide
taatacgactcactataggggcagaagggacacgaacttggtggtgagcaaacagaggagatgctcaatgccaagttcgaacctggcggcagcgcaaaagatg

SEQ ID NO: 111811 - DNA, 103 bp, Artificial Sequence
  Synthetic Polynucleotide
taatacgactcactatagggggccgccactcactgtgatctcagctgctgaacagaggagacagcagatgagatcacagaacctggcggcagcgcaaaagatg

SEQ ID NO: 111812 - DNA, 103 bp, Artificial Sequence
  Synthetic Polynucleotide
taatacgactcactatagggtcagtcccagggccgccactcactgtgatcaacagaggagagatcacatggagtggcggaacctggcggcagcgcaaaagatg

SEQ ID NO: 111813 - DNA, 103 bp, Artificial Sequence
  Synthetic Polynucleotide
taatacgactcactataggggtccttgctatcagtcccagggccgccactaacagaggagaagtggcatgcctgggactaacctggcggcagcgcaaaagatg

SEQ ID NO: 111814 - DNA, 103 bp, Artificial Sequence
  Synthetic Polynucleotide
taatacgactcactataggggctcaccactgtccttgctatcagtcccagaacagaggagactgggaatgatagcaaggaacctggcggcagcgcaaaagatg

SEQ ID NO: 111815 - DNA, 103 bp, Artificial Sequence
  Synthetic Polynucleotide
taatacgactcactatagggagtgaactgagctcaccactgtccttgctaaacagaggagatagcaaatgcagtggtgaaacctggcggcagcgcaaaagatg

SEQ ID NO: 111816 - DNA, 103 bp, Artificial Sequence
  Synthetic Polynucleotide
taatacgactcactataggggcccagtgggagtgaactgagctcaccactaacagaggagaagtggtatgctcagttcaaacctggcggcagcgcaaaagatg

SEQ ID NO: 111817 - DNA, 103 bp, Artificial Sequence
  Synthetic Polynucleotide
taatacgactcactataggggtgttgttgggcccagtgggagtgaactgaaacagaggagatcagttatgtcccactggaacctggcggcagcgcaaaagatg

SEQ ID NO: 111818 - DNA, 103 bp, Artificial Sequence
  Synthetic Polynucleotide
taatacgactcactatagggcgggtgtccagtgttgttgggcccagtgggaacagaggagacccactatgcccaacaacaacctggcggcagcgcaaaagatg

SEQ ID NO: 111819 - DNA, 103 bp, Artificial Sequence
  Synthetic Polynucleotide
taatacgactcactatagggctgcagtggccgggtgtccagtgttgttggaacagaggagaccaacaatgctggacaccaacctggcggcagcgcaaaagatg

SEQ ID NO: 111820 - DNA, 103 bp, Artificial Sequence
  Synthetic Polynucleotide
taatacgactcactataggggggcagaagactgcagtggccgggtgtccaaacagaggagatggacaatgggccactgcaacctggcggcagcgcaaaagatg

SEQ ID NO: 111821 - DNA, 103 bp, Artificial Sequence
  Synthetic Polynucleotide
taatacgactcactatagggttggcctcctgcagaagggacacgaacttgaacagaggagacaagttatggtcccttctaacctggcggcagcgcaaaagatg

SEQ ID NO: 111822 - DNA, 103 bp, Artificial Sequence
  Synthetic Polynucleotide
taatacgactcactatagggctgtccagcagggcagaagactgcagtggcaacagaggagagccactatggtcttctgcaacctggcggcagcgcaaaagatg

SEQ ID NO: 111823 - DNA, 103 bp, Artificial Sequence
  Synthetic Polynucleotide
taatacgactcactataggggctgctgctgctgtccagcagggcagaagaaacagaggagatcttctatgctgctggacaacctggcggcagcgcaaaagatg

SEQ ID NO: 111824 - DNA, 103 bp, Artificial Sequence
  Synthetic Polynucleotide
taatacgactcactatagggtgctgctgctgctgctgctgctgtccagcaaacagaggagatgctggatggcagcagcaaacctggcggcagcgcaaaagatg

SEQ ID NO: 111825 - DNA, 103 bp, Artificial Sequence; identical to SEQ ID NO: 88564
  Synthetic Polynucleotide

SEQ ID NO: 111826 - DNA, 103 bp, Artificial Sequence
  Synthetic Polynucleotide
taatacgactcactataggggttgctgctgctgctgctgctgctgctgctaacagaggagaagcagcatgagcagcagcaacctggcggcagcgcaaaagatg

SEQ ID NO: 111827 - DNA, 103 bp, Artificial Sequence
  Synthetic Polynucleotide
taatacgactcactatagggtgctgttactgttgctgctgctgctgctgcaacagaggagagcagcaatggcagcagcaaacctggcggcagcgcaaaagatg

SEQ ID NO: 111828 - DNA, 103 bp, Artificial Sequence
  Synthetic Polynucleotide
taatacgactcactataggggacgaactgctgctgttactgttgctgctgaacagaggagacagcagatgcagtaacagaacctggcggcagcgcaaaagatg

SEQ ID NO: 111829 - DNA, 103 bp, Artificial Sequence
  Synthetic Polynucleotide
taatacgactcactataggggttgggtccggacgaactgctgctgttactaacagaggagaagtaacatgagcagttcgaacctggcggcagcgcaaaagatg

SEQ ID NO: 111830 - DNA, 103 bp, Artificial Sequence
  Synthetic Polynucleotide
taatacgactcactatagggaggtagaagggttgggtccggacgaactgcaacagaggagagcagttatgccggacccaaacctggcggcagcgcaaaagatg

SEQ ID NO: 111831 - DNA, 103 bp, Artificial Sequence
  Synthetic Polynucleotide
taatacgactcactatagggggctcaaaggaggtagaagggttgggtccgaacagaggagacggaccatgcccttctacaacctggcggcagcgcaaaagatg

SEQ ID NO: 111832 - DNA, 103 bp, Artificial Sequence
  Synthetic Polynucleotide
taatacgactcactatagggaatccttatttttgatggagaaggattcataacagaggagaatgaatatgtctccatcaaacctggcggcagcgcaaaagatg

SEQ ID NO: 111833 - DNA, 103 bp, Artificial Sequence
  Synthetic Polynucleotide
taatacgactcactatagggagttaaataaaccagcgatacatcaaaacgaacagaggagacgttttatggtatcgctgaacctggcggcagcgcaaaagatg

SEQ ID NO: 111834 - DNA, 103 bp, Artificial Sequence
  Synthetic Polynucleotide
taatacgactcactatagggtaaattttcgagttaaataaaccagcgataaacagaggagatatcgcatgtttatttaaaacctggcggcagcgcaaaagatg

SEQ ID NO: 111835 - DNA, 103 bp, Artificial Sequence
  Synthetic Polynucleotide
taatacgactcactatagggacaagatccataaattttcgagttaaataaaacagaggagattatttatgtcgaaaattaacctggcggcagcgcaaaagatg

SEQ ID NO: 111836 - DNA, 103 bp, Artificial Sequence
  Synthetic Polynucleotide
taatacgactcactatagggagcagatctgacaagatccataaattttcgaacagaggagacgaaaaatgatggatcttaacctggcggcagcgcaaaagatg

SEQ ID NO: 111837 - DNA, 103 bp, Artificial Sequence
  Synthetic Polynucleotide
taatacgactcactatagggtacccccgggagcagatctgacaagatccaaacagaggagatggatcatgtcagatctgaacctggcggcagcgcaaaagatg

SEQ ID NO: 111838 - DNA, 103 bp, Artificial Sequence
  Synthetic Polynucleotide
taatacgactcactatagggaagtcaagaatacccccgggagcagatctgaacagaggagacagatcatgtcccgggggaacctggcggcagcgcaaaagatg

SEQ ID NO: 111839 - DNA, 103 bp, Artificial Sequence
  Synthetic Polynucleotide
taatacgactcactatagggaaccttgtttaagtcaagaatacccccgggaacagaggagacccgggatgattcttgacaacctggcggcagcgcaaaagatg

SEQ ID NO: 111840 - DNA, 103 bp, Artificial Sequence
  Synthetic Polynucleotide
taatacgactcactataggggtttcgttgcaaccttgtttaagtcaagaaaacagaggagattcttgatgtaaacaaggaacctggcggcagcgcaaaagatg

SEQ ID NO: 111841 - DNA, 103 bp, Artificial Sequence
  Synthetic Polynucleotide
taatacgactcactatagggcggactcccagtttcgttgcaaccttgtttaacagaggagaaaacaaatgtgcaacgaaaacctggcggcagcgcaaaagatg

SEQ ID NO: 111842 - DNA, 103 bp, Artificial Sequence
  Synthetic Polynucleotide
taatacgactcactatagggtctccgctttcggactcccagtttcgttgcaacagaggagagcaacgatgctgggagtcaacctggcggcagcgcaaaagatg

SEQ ID NO: 111843 - DNA, 103 bp, Artificial Sequence
  Synthetic Polynucleotide
taatacgactcactatagggcttctaaattaatccttatttttgatggagaacagaggagactccatatgaaataaggaaacctggcggcagcgcaaaagatg

SEQ ID NO: 111844 - DNA, 103 bp, Artificial Sequence
  Synthetic Polynucleotide
taatacgactcactatagggtgtcatacactctccgctttcggactcccaaacagaggagatgggagatggaaagcggaaacctggcggcagcgcaaaagatg

SEQ ID NO: 111845 - DNA, 103 bp, Artificial Sequence
  Synthetic Polynucleotide
taatacgactcactatagggacattggtgatgtcatacactctccgctttaacagaggagaaaagcgatgagtgtatgaaacctggcggcagcgcaaaagatg

SEQ ID NO: 111846 - DNA, 103 bp, Artificial Sequence
  Synthetic Polynucleotide
taatacgactcactatagggtccatctaagacattggtgatgtcatacacaacagaggagagtgtatatgatcaccaataacctggcggcagcgcaaaagatg

SEQ ID NO: 111847 - DNA, 103 bp, Artificial Sequence
  Synthetic Polynucleotide
taatacgactcactatagggcgaggtcgattccatctaagacattggtgaaacagaggagatcaccaatgtcttagatgaacctggcggcagcgcaaaagatg

SEQ ID NO: 111848 - DNA, 103 bp, Artificial Sequence
  Synthetic Polynucleotide
taatacgactcactatagggttcttttcaacgaggtcgattccatctaagaacagaggagacttagaatgaatcgacctaacctggcggcagcgcaaaagatg

SEQ ID NO: 111849 - DNA, 103 bp, Artificial Sequence
  Synthetic Polynucleotide
taatacgactcactataggggttcttggatttcttttcaacgaggtcgataacagaggagaatcgacatggttgaaaagaacctggcggcagcgcaaaagatg

SEQ ID NO: 111850 - DNA, 103 bp, Artificial Sequence
  Synthetic Polynucleotide
taatacgactcactatagggatctaatatggttcttggatttcttttcaaaacagaggagattgaaaatgaatccaagaaacctggcggcagcgcaaaagatg

SEQ ID NO: 111851 - DNA, 103 bp, Artificial Sequence
  Synthetic Polynucleotide
taatacgactcactataggggatcctatccatctaatatggttcttggataacagaggagaatccaaatgccatattagaacctggcggcagcgcaaaagatg

SEQ ID NO: 111852 - DNA, 103 bp, Artificial Sequence
  Synthetic Polynucleotide
taatacgactcactataggggctaagatcagatcctatccatctaatatgaacagaggagacatattatgtggataggaaacctggcggcagcgcaaaagatg

SEQ ID NO: 111853 - DNA, 103 bp, Artificial Sequence
  Synthetic Polynucleotide
taatacgactcactatagggctccaaaattgctaagatcagatcctatccaacagaggagaggatagatgctgatcttaaacctggcggcagcgcaaaagatg

SEQ ID NO: 111854 - DNA, 103 bp, Artificial Sequence
  Synthetic Polynucleotide
taatacgactcactatagggtgtacattatcttctaaattaatccttattaacagaggagaaataagatgtaatttagaaacctggcggcagcgcaaaagatg

SEQ ID NO: 111855 - DNA, 103 bp, Artificial Sequence
  Synthetic Polynucleotide
taatacgactcactatagggtggggaactgctccaaaattgctaagatcaaacagaggagatgatctatgcaattttggaacctggcggcagcgcaaaagatg

SEQ ID NO: 111856 - DNA, 103 bp, Artificial Sequence
  Synthetic Polynucleotide
taatacgactcactatagggcttcttttgttggggaactgctccaaaattaacagaggagaaattttatggcagttcccaacctggcggcagcgcaaaagatg

SEQ ID NO: 111857 - DNA, 103 bp, Artificial Sequence
  Synthetic Polynucleotide
taatacgactcactatagggcctcctgtagcttcttttgttggggaactgaacagaggagacagttcatgaacaaaagaaacctggcggcagcgcaaaagatg

SEQ ID NO: 111858 - DNA, 103 bp, Artificial Sequence
  Synthetic Polynucleotide
taatacgactcactatagggtcagaaagttcctcctgtagcttcttttgtaacagaggagaacaaaaatggctacaggaaacctggcggcagcgcaaaagatg

SEQ ID NO: 111859 - DNA, 103 bp, Artificial Sequence
  Synthetic Polynucleotide
taatacgactcactatagggtgctgataagtcagaaagttcctcctgtagaacagaggagactacagatggaactttctaacctggcggcagcgcaaaagatg

SEQ ID NO: 111860 - DNA, 103 bp, Artificial Sequence
  Synthetic Polynucleotide
taatacgactcactatagggcatcttccattgctgataagtcagaaagttaacagaggagaaactttatgacttatcagaacctggcggcagcgcaaaagatg

SEQ ID NO: 111861 - DNA, 103 bp, Artificial Sequence
  Synthetic Polynucleotide
taatacgactcactatagggtcatccaaagcatcttccattgctgataagaacagaggagacttatcatgaatggaagaaacctggcggcagcgcaaaagatg

SEQ ID NO: 111862 - DNA, 103 bp, Artificial Sequence
  Synthetic Polynucleotide
taatacgactcactatagggcttaattaactcatccaaagcatcttccataacagaggagaatggaaatggctttggataacctggcggcagcgcaaaagatg

SEQ ID NO: 111863 - DNA, 103 bp, Artificial Sequence
  Synthetic Polynucleotide
taatacgactcactataggggagcacaatccttaattaactcatccaaagaacagaggagactttggatgagttaattaaacctggcggcagcgcaaaagatg

SEQ ID NO: 111864 - DNA, 103 bp, Artificial Sequence
  Synthetic Polynucleotide
taatacgactcactatagggaacagctgctgagcacaatccttaattaacaacagaggagagttaatatgggattgtgcaacctggcggcagcgcaaaagatg

SEQ ID NO: 111865 - DNA, 103 bp, Artificial Sequence
  Synthetic Polynucleotide
taatacgactcactatagggggacacatattgtacattatcttctaaattaacagaggagaaatttaatggataatgtaaacctggcggcagcgcaaaagatg

SEQ ID NO: 111866 - DNA, 103 bp, Artificial Sequence
  Synthetic Polynucleotide
taatacgactcactatagggtgttaactcaaacagctgctgagcacaatcaacagaggagagattgtatgcagcagctgaacctggcggcagcgcaaaagatg

SEQ ID NO: 111867 - DNA, 103 bp, Artificial Sequence
  Synthetic Polynucleotide
taatacgactcactatagggctttgtcatctgttaactcaaacagctgctaacagaggagaagcagcatgttgagttaaaacctggcggcagcgcaaaagatg

SEQ ID NO: 111868 - DNA, 103 bp, Artificial Sequence
  Synthetic Polynucleotide
taatacgactcactatagggctttcattttctttgtcatctgttaactcaaacagaggagatgagttatgagatgacaaaacctggcggcagcgcaaaagatg

SEQ ID NO: 111869 - DNA, 103 bp, Artificial Sequence
  Synthetic Polynucleotide
taatacgactcactatagggatatgctagtctttcattttctttgtcatcaacagaggagagatgacatggaaaatgaaaacctggcggcagcgcaaaagatg

SEQ ID NO: 111870 - DNA, 103 bp, Artificial Sequence
  Synthetic Polynucleotide
taatacgactcactataggggataggtcacatatgctagtctttcattttaacagaggagaaaaatgatggactagcataacctggcggcagcgcaaaagatg

SEQ ID NO: 111871 - DNA, 103 bp, Artificial Sequence
  Synthetic Polynucleotide
taatacgactcactatagggtgaatgtcttgataggtcacatatgctagtaacagaggagaactagcatgtgtgacctaaacctggcggcagcgcaaaagatg

SEQ ID NO: 111872 - DNA, 103 bp, Artificial Sequence
  Synthetic Polynucleotide
taatacgactcactatagggctgaatgctatgaatgtcttgataggtcacaacagaggagagtgaccatgcaagacattaacctggcggcagcgcaaaagatg

SEQ ID NO: 111873 - DNA, 103 bp, Artificial Sequence
  Synthetic Polynucleotide
taatacgactcactatagggcatggaaggcctgaatgctatgaatgtcttaacagaggagaaagacaatgatagcattcaacctggcggcagcgcaaaagatg

SEQ ID NO: 111874 - DNA, 103 bp, Artificial Sequence
  Synthetic Polynucleotide
taatacgactcactatagggacgatctgttcatggaaggcctgaatgctaaacagaggagatagcatatgggccttccaaacctggcggcagcgcaaaagatg

SEQ ID NO: 111875 - DNA, 103 bp, Artificial Sequence
  Synthetic Polynucleotide
taatacgactcactatagggaactgcaatgacgatctgttcatggaaggcaacagaggagagccttcatggaacagatcaacctggcggcagcgcaaaagatg

SEQ ID NO: 111876 - DNA, 103 bp, Artificial Sequence
  Synthetic Polynucleotide
taatacgactcactatagggcttttctcatggacacatattgtacattataacagaggagaataatgatgaatatgtgtaacctggcggcagcgcaaaagatg

SEQ ID NO: 111877 - DNA, 103 bp, Artificial Sequence
  Synthetic Polynucleotide
taatacgactcactatagggctggagctttaactgcaatgacgatctgttaacagaggagaaacagaatgtcattgcagaacctggcggcagcgcaaaagatg

SEQ ID NO: 111878 - DNA, 103 bp, Artificial Sequence
  Synthetic Polynucleotide
taatacgactcactatagggctggtttctgctggagctttaactgcaatgaacagaggagacattgcatgtaaagctccaacctggcggcagcgcaaaagatg

SEQ ID NO: 111879 - DNA, 103 bp, Artificial Sequence
  Synthetic Polynucleotide
taatacgactcactatagggaacatccaatctggtttctgctggagctttaacagaggagaaaagctatggcagaaaccaacctggcggcagcgcaaaagatg

SEQ ID NO: 111880 - DNA, 103 bp, Artificial Sequence
  Synthetic Polynucleotide
taatacgactcactatagggtgggagctggaacatccaatctggtttctgaacagaggagacagaaaatggattggatgaacctggcggcagcgcaaaagatg

SEQ ID NO: 111881 - DNA, 103 bp, Artificial Sequence
  Synthetic Polynucleotide
taatacgactcactataggggagtcttctctgggagctggaacatccaataacagaggagaattggaatgtccagctccaacctggcggcagcgcaaaagatg

SEQ ID NO: 111882 - DNA, 103 bp, Artificial Sequence
  Synthetic Polynucleotide
taatacgactcactatagggcactgtgatagagtcttctctgggagctggaacagaggagaccagctatgagagaagacaacctggcggcagcgcaaaagatg

SEQ ID NO: 111883 - DNA, 103 bp, Artificial Sequence
  Synthetic Polynucleotide
taatacgactcactatagggtccttatgtgcactgtgatagagtcttctcaacagaggagagagaagatgctatcacagaacctggcggcagcgcaaaagatg

SEQ ID NO: 111884 - DNA, 103 bp, Artificial Sequence
  Synthetic Polynucleotide
taatacgactcactatagggccgttggtgctccttatgtgcactgtgataaacagaggagatatcacatggcacataagaacctggcggcagcgcaaaagatg

SEQ ID NO: 111885 - DNA, 103 bp, Artificial Sequence
  Synthetic Polynucleotide
taatacgactcactatagggatcgataggtccgttggtgctccttatgtgaacagaggagacacataatgagcaccaacaacctggcggcagcgcaaaagatg

SEQ ID NO: 111886 - DNA, 103 bp, Artificial Sequence
  Synthetic Polynucleotide
taatacgactcactatagggacaaatagacatcgataggtccgttggtgcaacagaggagagcaccaatggacctatcgaacctggcggcagcgcaaaagatg

SEQ ID NO: 111887 - DNA, 103 bp, Artificial Sequence
  Synthetic Polynucleotide
taatacgactcactatagggacttttagagcttttctcatggacacatataacagaggagaatatgtatgcatgagaaaaacctggcggcagcgcaaaagatg

SEQ ID NO: 111888 - DNA, 103 bp, Artificial Sequence
  Synthetic Polynucleotide
taatacgactcactatagggtccacttcacacaaatagacatcgataggtaacagaggagaacctatatgtgtctatttaacctggcggcagcgcaaaagatg

SEQ ID NO: 111889 - DNA, 103 bp, Artificial Sequence
  Synthetic Polynucleotide
taatacgactcactatagggctgaccctgctccacttcacacaaatagacaacagaggagagtctatatgtgtgaagtgaacctggcggcagcgcaaaagatg

SEQ ID NO: 111890 - DNA, 103 bp, Artificial Sequence
  Synthetic Polynucleotide
taatacgactcactatagggtgttactggtctgaccctgctccacttcacaacagaggagagtgaagatgagcagggtcaacctggcggcagcgcaaaagatg

SEQ ID NO: 111891 - DNA, 103 bp, Artificial Sequence
  Synthetic Polynucleotide
taatacgactcactatagggtcagaccttttgttactggtctgaccctgcaacagaggagagcagggatggaccagtaaaacctggcggcagcgcaaaagatg

SEQ ID NO: 111892 - DNA, 103 bp, Artificial Sequence
  Synthetic Polynucleotide
taatacgactcactatagggcccgacaccttcagaccttttgttactggtaacagaggagaaccagtatgaaaaggtctaacctggcggcagcgcaaaagatg

SEQ ID NO: 111893 - DNA, 103 bp, Artificial Sequence
  Synthetic Polynucleotide
taatacgactcactatagggatgaagaggtcccgacaccttcagacctttaacagaggagaaaaggtatgaaggtgtcgaacctggcggcagcgcaaaagatg

SEQ ID NO: 111894 - DNA, 103 bp, Artificial Sequence
  Synthetic Polynucleotide
taatacgactcactataggggtgctctcagatgaagaggtcccgacacctaacagaggagaaggtgtatggacctcttcaacctggcggcagcgcaaaagatg

SEQ ID NO: 111895 - DNA, 103 bp, Artificial Sequence
  Synthetic Polynucleotide
taatacgactcactatagggttctggatgagtgctctcagatgaagaggtaacagaggagaacctctatgtctgagagcaacctggcggcagcgcaaaagatg

SEQ ID NO: 111896 - DNA, 103 bp, Artificial Sequence
  Synthetic Polynucleotide
taatacgactcactatagggcctcagggccttctggatgagtgctctcagaacagaggagactgagaatgctcatccagaacctggcggcagcgcaaaagatg

SEQ ID NO: 111897 - DNA, 103 bp, Artificial Sequence
  Synthetic Polynucleotide
taatacgactcactatagggttttcttcttcctcagggccttctggatgaaacagaggagatcatccatgaggccctgaaacctggcggcagcgcaaaagatg

SEQ ID NO: 111898 - DNA, 103 bp, Artificial Sequence
  Synthetic Polynucleotide
taatacgactcactatagggaggtctcttcacttttagagcttttctcataacagaggagaatgagaatggctctaaaaaacctggcggcagcgcaaaagatg

SEQ ID NO: 111899 - DNA, 103 bp, Artificial Sequence
  Synthetic Polynucleotide
taatacgactcactatagggttgctgaggattttcttcttcctcagggccaacagaggagaggccctatggaagaagaaaacctggcggcagcgcaaaagatg

SEQ ID NO: 111900 - DNA, 103 bp, Artificial Sequence
  Synthetic Polynucleotide
taatacgactcactatagggattcttcactttgctgaggattttcttcttaacagaggagaaagaagatgatcctcagcaacctggcggcagcgcaaaagatg

SEQ ID NO: 111901 - DNA, 103 bp, Artificial Sequence
  Synthetic Polynucleotide
taatacgactcactatagggacttcaagcaattcttcactttgctgaggaaacagaggagatcctcaatgaagtgaagaaacctggcggcagcgcaaaagatg

SEQ ID NO: 111902 - DNA, 103 bp, Artificial Sequence
  Synthetic Polynucleotide
taatacgactcactatagggtcagttgcttacttcaagcaattcttcactaacagaggagaagtgaaatgttgcttgaaaacctggcggcagcgcaaaagatg

SEQ ID NO: 111903 - DNA, 103 bp, Artificial Sequence
  Synthetic Polynucleotide
taatacgactcactatagggcatcaaaacgaggtctcttcacttttagagaacagaggagactctaaatgtgaagagacaacctggcggcagcgcaaaagatg

SEQ ID NO: 111904 - DNA, 103 bp, Artificial Sequence
  Synthetic Polynucleotide
taatacgactcactatagggaccagcgatacatcaaaacgaggtctcttcaacagaggagagaagagatgtcgttttgaaacctggcggcagcgcaaaagatg

SEQ ID NO: 111905 - DNA, 103 bp, Artificial Sequence
  Synthetic Polynucleotide
taatacgactcactataggggtcttttagtgttaaacaatttacctccataacagaggagaatggagatgaattgtttaaacctggcggcagcgcaaaagatg

SEQ ID NO: 111906 - DNA, 103 bp, Artificial Sequence
  Synthetic Polynucleotide
taatacgactcactatagggccttgatcgatcaacaaatatattttccttaacagaggagaaaggaaatgatatttgttaacctggcggcagcgcaaaagatg

SEQ ID NO: 111907 - DNA, 103 bp, Artificial Sequence
  Synthetic Polynucleotide
taatacgactcactatagggattggctatgtcatagaggcgtcgtaccttaacagaggagaaaggtaatgcgcctctataacctggcggcagcgcaaaagatg

SEQ ID NO: 111908 - DNA, 103 bp, Artificial Sequence
  Synthetic Polynucleotide
taatacgactcactatagggtggtcagaacattggctatgtcatagaggcaacagaggagagcctctatgacatagccaaacctggcggcagcgcaaaagatg

SEQ ID NO: 111909 - DNA, 103 bp, Artificial Sequence
  Synthetic Polynucleotide
taatacgactcactatagggagagccaagctggtcagaacattggctatgaacagaggagacatagcatgtgttctgacaacctggcggcagcgcaaaagatg

SEQ ID NO: 111910 - DNA, 103 bp, Artificial Sequence
  Synthetic Polynucleotide
taatacgactcactatagggtttctttatcagagccaagctggtcagaacaacagaggagagttctgatgagcttggctaacctggcggcagcgcaaaagatg

SEQ ID NO: 111911 - DNA, 103 bp, Artificial Sequence
  Synthetic Polynucleotide
taatacgactcactatagggttacatgcactttctttatcagagccaagcaacagaggagagcttggatgtgataaagaaacctggcggcagcgcaaaagatg

SEQ ID NO: 111912 - DNA, 103 bp, Artificial Sequence
  Synthetic Polynucleotide
taatacgactcactatagggcgctcttctgttacatgcactttctttatcaacagaggagagataaaatgagtgcatgtaacctggcggcagcgcaaaagatg

SEQ ID NO: 111913 - DNA, 103 bp, Artificial Sequence
  Synthetic Polynucleotide
taatacgactcactatagggtttacgacctcgctcttctgttacatgcacaacagaggagagtgcatatgacagaagagaacctggcggcagcgcaaaagatg

SEQ ID NO: 111914 - DNA, 103 bp, Artificial Sequence
  Synthetic Polynucleotide
taatacgactcactatagggtgaaggctggtttacgacctcgctcttctgaacagaggagacagaagatggaggtcgtaaacctggcggcagcgcaaaagatg

SEQ ID NO: 111915 - DNA, 103 bp, Artificial Sequence
  Synthetic Polynucleotide
taatacgactcactatagggccgatccacttgaaggctggtttacgacctaacagaggagaaggtcgatgaccagccttaacctggcggcagcgcaaaagatg

SEQ ID NO: 111916 - DNA, 103 bp, Artificial Sequence
  Synthetic Polynucleotide
taatacgactcactataggggtccacaggcccgatccacttgaaggctggaacagaggagaccagccatgaagtggatcaacctggcggcagcgcaaaagatg

SEQ ID NO: 111917 - DNA, 103 bp, Artificial Sequence
  Synthetic Polynucleotide
taatacgactcactatagggtcggggccatccttgatcgatcaacaaataaacagaggagatatttgatgatcgatcaaaacctggcggcagcgcaaaagatg

SEQ ID NO: 111918 - DNA, 103 bp, Artificial Sequence
  Synthetic Polynucleotide
taatacgactcactatagggttgagctgaagtccacaggcccgatccactaacagaggagaagtggaatgggcctgtggaacctggcggcagcgcaaaagatg

SEQ ID NO: 111919 - DNA, 103 bp, Artificial Sequence
  Synthetic Polynucleotide
taatacgactcactatagggtcttcatcacttgagctgaagtccacaggcaacagaggagagcctgtatgcttcagctcaacctggcggcagcgcaaaagatg

SEQ ID NO: 111920 - DNA, 103 bp, Artificial Sequence
  Synthetic Polynucleotide
taatacgactcactatagggatccaccagttcttcatcacttgagctgaaaacagaggagattcagcatgagtgatgaaaacctggcggcagcgcaaaagatg

SEQ ID NO: 111921 - DNA, 103 bp, Artificial Sequence
  Synthetic Polynucleotide
taatacgactcactatagggatgcagaaacatccaccagttcttcatcacaacagaggagagtgatgatgaactggtggaacctggcggcagcgcaaaagatg

SEQ ID NO: 111922 - DNA, 103 bp, Artificial Sequence
  Synthetic Polynucleotide
taatacgactcactatagggggtaagacagatgcagaaacatccaccagtaacagaggagaactggtatgtgtttctgcaacctggcggcagcgcaaaagatg

SEQ ID NO: 111923 - DNA, 103 bp, Artificial Sequence
  Synthetic Polynucleotide
taatacgactcactatagggtttcaattctggtaagacagatgcagaaacaacagaggagagtttctatgtctgtcttaaacctggcggcagcgcaaaagatg

SEQ ID NO: 111924 - DNA, 103 bp, Artificial Sequence
  Synthetic Polynucleotide
taatacgactcactatagggatgtttctcttttcaattctggtaagacagaacagaggagactgtctatgcagaattgaaacctggcggcagcgcaaaagatg

SEQ ID NO: 111925 - DNA, 103 bp, Artificial Sequence
  Synthetic Polynucleotide
taatacgactcactatagggatctggccatatgtttctcttttcaattctaacagaggagaagaattatgaagagaaacaacctggcggcagcgcaaaagatg

SEQ ID NO: 111926 - DNA, 103 bp, Artificial Sequence
  Synthetic Polynucleotide
taatacgactcactatagggacagacttgaatctggccatatgtttctctaacagaggagaagagaaatgtatggccagaacctggcggcagcgcaaaagatg

SEQ ID NO: 111927 - DNA, 103 bp, Artificial Sequence
  Synthetic Polynucleotide
taatacgactcactatagggtctgttttgcacagacttgaatctggccataacagaggagaatggccatgttcaagtctaacctggcggcagcgcaaaagatg

SEQ ID NO: 111928 - DNA, 103 bp, Artificial Sequence
  Synthetic Polynucleotide
taatacgactcactatagggattggagtcttcggggccatccttgatcgaaacagaggagatcgatcatggatggccccaacctggcggcagcgcaaaagatg

SEQ ID NO: 111929 - DNA, 103 bp, Artificial Sequence
  Synthetic Polynucleotide
taatacgactcactatagggcgagccagcttctgttttgcacagacttgaaacagaggagatcaagtatgtgcaaaacaaacctggcggcagcgcaaaagatg

SEQ ID NO: 111930 - DNA, 103 bp, Artificial Sequence
  Synthetic Polynucleotide
taatacgactcactatagggagaaccatggcgagccagcttctgttttgcaacagaggagagcaaaaatgaagctggctaacctggcggcagcgcaaaagatg

SEQ ID NO: 111931 - DNA, 103 bp, Artificial Sequence
  Synthetic Polynucleotide
taatacgactcactatagggctgtgttaaaagaaccatggcgagccagctaacagaggagaagctggatggccatggttaacctggcggcagcgcaaaagatg

SEQ ID NO: 111932 - DNA, 103 bp, Artificial Sequence
  Synthetic Polynucleotide
taatacgactcactataggggaagcctgaactgtgttaaaagaaccatggaacagaggagaccatggatgttttaacacaacctggcggcagcgcaaaagatg

SEQ ID NO: 111933 - DNA, 103 bp, Artificial Sequence
  Synthetic Polynucleotide
taatacgactcactataggggatcctctcagaagcctgaactgtgttaaaaacagaggagatttaacatggttcaggctaacctggcggcagcgcaaaagatg

SEQ ID NO: 111934 - DNA, 103 bp, Artificial Sequence
  Synthetic Polynucleotide
taatacgactcactatagggctttcctctggatcctctcagaagcctgaaaacagaggagattcaggatgctgagaggaaacctggcggcagcgcaaaagatg

SEQ ID NO: 111935 - DNA, 103 bp, Artificial Sequence
  Synthetic Polynucleotide
taatacgactcactatagggtctgagttcactttcctctggatcctctcaaacagaggagatgagagatgccagaggaaaacctggcggcagcgcaaaagatg

SEQ ID NO: 111936 - DNA, 103 bp, Artificial Sequence
  Synthetic Polynucleotide
taatacgactcactataggggctgctcggttctgagttcactttcctctgaacagaggagacagaggatggtgaactcaaacctggcggcagcgcaaaagatg

SEQ ID NO: 111937 - DNA, 103 bp, Artificial Sequence
  Synthetic Polynucleotide
taatacgactcactatagggctctgtacgggctgctcggttctgagttcaaacagaggagatgaactatgaaccgagcaaacctggcggcagcgcaaaagatg

SEQ ID NO: 111938 - DNA, 103 bp, Artificial Sequence
  Synthetic Polynucleotide
taatacgactcactatagggccttgttcttctctgtacgggctgctcggtaacagaggagaaccgagatgcccgtacagaacctggcggcagcgcaaaagatg

SEQ ID NO: 111939 - DNA, 103 bp, Artificial Sequence
  Synthetic Polynucleotide
taatacgactcactatagggttcattttttattggagtcttcggggccataacagaggagaatggccatgaagactccaaacctggcggcagcgcaaaagatg

SEQ ID NO: 111940 - DNA, 103 bp, Artificial Sequence
  Synthetic Polynucleotide
taatacgactcactataggggccacctgatccttgttcttctctgtacggaacagaggagaccgtacatggaagaacaaaacctggcggcagcgcaaaagatg

SEQ ID NO: 111941 - DNA, 103 bp, Artificial Sequence
  Synthetic Polynucleotide
taatacgactcactatagggctaaagagtagccacctgatccttgttcttaacagaggagaaagaacatggatcaggtgaacctggcggcagcgcaaaagatg

SEQ ID NO: 111942 - DNA, 103 bp, Artificial Sequence
  Synthetic Polynucleotide
taatacgactcactatagggcttccaatttctaaagagtagccacctgataacagaggagaatcaggatgctactctttaacctggcggcagcgcaaaagatg

SEQ ID NO: 111943 - DNA, 103 bp, Artificial Sequence
  Synthetic Polynucleotide
taatacgactcactatagggagctgccaggcttccaatttctaaagagtaaacagaggagatactctatggaaattggaaacctggcggcagcgcaaaagatg

SEQ ID NO: 111944 - DNA, 103 bp, Artificial Sequence
  Synthetic Polynucleotide
taatacgactcactataggggtctatagacagctgccaggcttccaatttaacagaggagaaaattgatggcctggcagaacctggcggcagcgcaaaagatg

SEQ ID NO: 111945 - DNA, 103 bp, Artificial Sequence
  Synthetic Polynucleotide
taatacgactcactatagggtctattttctgtctatagacagctgccaggaacagaggagacctggcatgtgtctatagaacctggcggcagcgcaaaagatg

SEQ ID NO: 111946 - DNA, 103 bp, Artificial Sequence
  Synthetic Polynucleotide
taatacgactcactatagggtgaattgtcttctattttctgtctatagacaacagaggagagtctatatgcagaaaataaacctggcggcagcgcaaaagatg

SEQ ID NO: 111947 - DNA, 103 bp, Artificial Sequence
  Synthetic Polynucleotide
taatacgactcactatagggcttttccctgtgaattgtcttctattttctaacagaggagaagaaaaatgaagacaattaacctggcggcagcgcaaaagatg

SEQ ID NO: 111948 - DNA, 103 bp, Artificial Sequence
  Synthetic Polynucleotide
taatacgactcactatagggctggcaaaggcttttccctgtgaattgtctaacagaggagaagacaaatgacagggaaaaacctggcggcagcgcaaaagatg

SEQ ID NO: 111949 - DNA, 103 bp, Artificial Sequence
  Synthetic Polynucleotide
taatacgactcactatagggcactctcttactggcaaaggcttttccctgaacagaggagacagggaatggcctttgccaacctggcggcagcgcaaaagatg

SEQ ID NO: 111950 - DNA, 103 bp, Artificial Sequence
  Synthetic Polynucleotide
taatacgactcactatagggaatcaattggttcattttttattggagtctaacagaggagaagactcatgtaaaaaatgaacctggcggcagcgcaaaagatg

SEQ ID NO: 111951 - DNA, 103 bp, Artificial Sequence
  Synthetic Polynucleotide
taatacgactcactatagggatggaggcaccactctcttactggcaaaggaacagaggagacctttgatggtaagagagaacctggcggcagcgcaaaagatg

SEQ ID NO: 111952 - DNA, 103 bp, Artificial Sequence
  Synthetic Polynucleotide
taatacgactcactatagggaagctgcttgatggaggcaccactctcttaaacagaggagataagagatgggtgcctccaacctggcggcagcgcaaaagatg

SEQ ID NO: 111953 - DNA, 103 bp, Artificial Sequence
  Synthetic Polynucleotide
taatacgactcactatagggaacagggtccaagctgcttgatggaggcacaacagaggagagtgcctatgtcaagcagcaacctggcggcagcgcaaaagatg

SEQ ID NO: 111954 - DNA, 103 bp, Artificial Sequence
  Synthetic Polynucleotide
taatacgactcactatagggggaaaggagcaacagggtccaagctgcttgaacagaggagacaagcaatgtggaccctgaacctggcggcagcgcaaaagatg

SEQ ID NO: 111955 - DNA, 103 bp, Artificial Sequence
  Synthetic Polynucleotide
taatacgactcactataggggagaggacagggaaaggagcaacagggtccaacagaggagaggacccatgtgctcctttaacctggcggcagcgcaaaagatg

SEQ ID NO: 111956 - DNA, 103 bp, Artificial Sequence
  Synthetic Polynucleotide
taatacgactcactatagggtgggtcaacagagaggacagggaaaggagcaacagaggagagctcctatgcctgtcctcaacctggcggcagcgcaaaagatg

SEQ ID NO: 111957 - DNA, 103 bp, Artificial Sequence
  Synthetic Polynucleotide
taatacgactcactatagggcacaatattctgggtcaacagagaggacagaacagaggagactgtccatgctgttgaccaacctggcggcagcgcaaaagatg

SEQ ID NO: 111958 - DNA, 103 bp, Artificial Sequence
  Synthetic Polynucleotide
taatacgactcactatagggaaaggattaacacaatattctgggtcaacaaacagaggagatgttgaatgagaatattgaacctggcggcagcgcaaaagatg

SEQ ID NO: 111959 - DNA, 103 bp, Artificial Sequence
  Synthetic Polynucleotide
taatacgactcactatagggtgggtgggctaaaggattaacacaatattcaacagaggagagaatatatggttaatcctaacctggcggcagcgcaaaagatg

SEQ ID NO: 111960 - DNA, 103 bp, Artificial Sequence
  Synthetic Polynucleotide
taatacgactcactatagggcagaaaatactgggtgggctaaaggattaaaacagaggagattaatcatgtagcccaccaacctggcggcagcgcaaaagatg

SEQ ID NO: 111961 - DNA, 103 bp, Artificial Sequence
  Synthetic Polynucleotide
taatacgactcactatagggtgcttcgataaatcaattggttcattttttaacagaggagaaaaaaaatgaccaattgaaacctggcggcagcgcaaaagatg

SEQ ID NO: 111962 - DNA, 103 bp, Artificial Sequence
  Synthetic Polynucleotide
taatacgactcactataggggtctgagcaacagaaaatactgggtgggctaacagaggagaagcccaatgagtattttcaacctggcggcagcgcaaaagatg

SEQ ID NO: 111963 - DNA, 103 bp, Artificial Sequence
  Synthetic Polynucleotide
taatacgactcactatagggctgcaggtccgtctgagcaacagaaaatacaacagaggagagtatttatggttgctcagaacctggcggcagcgcaaaagatg

SEQ ID NO: 111964 - DNA, 103 bp, Artificial Sequence
  Synthetic Polynucleotide
taatacgactcactatagggtggagaatgcctgcaggtccgtctgagcaaaacagaggagattgctcatgcggacctgcaacctggcggcagcgcaaaagatg

SEQ ID NO: 111965 - DNA, 103 bp, Artificial Sequence
  Synthetic Polynucleotide
taatacgactcactatagggccgttctgcatggagaatgcctgcaggtccaacagaggagaggacctatgggcattctcaacctggcggcagcgcaaaagatg

SEQ ID NO: 111966 - DNA, 103 bp, Artificial Sequence
  Synthetic Polynucleotide
taatacgactcactatagggtccattcagaccgttctgcatggagaatgcaacagaggagagcattcatgatgcagaacaacctggcggcagcgcaaaagatg

SEQ ID NO: 111967 - DNA, 103 bp, Artificial Sequence
  Synthetic Polynucleotide
taatacgactcactatagggcatccacttgtccattcagaccgttctgcaaacagaggagatgcagaatggtctgaatgaacctggcggcagcgcaaaagatg

SEQ ID NO: 111968 - DNA, 103 bp, Artificial Sequence
  Synthetic Polynucleotide
taatacgactcactataggggcaagtgagacatccacttgtccattcagaaacagaggagatctgaaatgacaagtggaaacctggcggcagcgcaaaagatg

SEQ ID NO: 111969 - DNA, 103 bp, Artificial Sequence
  Synthetic Polynucleotide
taatacgactcactatagggggctgcagaagcaagtgagacatccacttgaacagaggagacaagtgatggtctcacttaacctggcggcagcgcaaaagatg

SEQ ID NO: 111970 - DNA, 103 bp, Artificial Sequence
  Synthetic Polynucleotide
taatacgactcactatagggccacagcagaggctgcagaagcaagtgagaaacagaggagatctcacatgcttctgcagaacctggcggcagcgcaaaagatg

SEQ ID NO: 111971 - DNA, 103 bp, Artificial Sequence
  Synthetic Polynucleotide
taatacgactcactatagggttcaggctctccacagcagaggctgcagaaaacagaggagattctgcatgctctgctgtaacctggcggcagcgcaaaagatg

SEQ ID NO: 111972 - DNA, 103 bp, Artificial Sequence
  Synthetic Polynucleotide
taatacgactcactatagggaaattttttttgcttcgataaatcaattggaacagaggagaccaattatgttatcgaagaacctggcggcagcgcaaaagatg

SEQ ID NO: 111973 - DNA, 103 bp, Artificial Sequence
  Synthetic Polynucleotide
taatacgactcactataggggagtgctggcttcaggctctccacagcagaaacagaggagatctgctatggagagcctgaacctggcggcagcgcaaaagatg

SEQ ID NO: 111974 - DNA, 103 bp, Artificial Sequence
  Synthetic Polynucleotide
taatacgactcactatagggggccagcaaggagtgctggcttcaggctctaacagaggagaagagccatgagccagcacaacctggcggcagcgcaaaagatg

SEQ ID NO: 111975 - DNA, 103 bp, Artificial Sequence
  Synthetic Polynucleotide
taatacgactcactatagggactagaggctggccagcaaggagtgctggcaacagaggagagccagcatgccttgctggaacctggcggcagcgcaaaagatg

SEQ ID NO: 111976 - DNA, 103 bp, Artificial Sequence
  Synthetic Polynucleotide
taatacgactcactataggggggcacatacactagaggctggccagcaagaacagaggagacttgctatgcagcctctaaacctggcggcagcgcaaaagatg

SEQ ID NO: 111977 - DNA, 103 bp, Artificial Sequence
  Synthetic Polynucleotide
taatacgactcactataggggtgaggcagagggcacatacactagaggctaacagaggagaagcctcatgtgtatgtgcaacctggcggcagcgcaaaagatg

SEQ ID NO: 111978 - DNA, 103 bp, Artificial Sequence
  Synthetic Polynucleotide
taatacgactcactatagggagcatgaacagtgaggcagagggcacatacaacagaggagagtatgtatgctctgcctcaacctggcggcagcgcaaaagatg

SEQ ID NO: 111979 - DNA, 103 bp, Artificial Sequence
  Synthetic Polynucleotide
taatacgactcactatagggacttccatacagcatgaacagtgaggcagaaacagaggagatctgccatgctgttcatgaacctggcggcagcgcaaaagatg

SEQ ID NO: 111980 - DNA, 103 bp, Artificial Sequence
  Synthetic Polynucleotide
taatacgactcactatagggcctcctgcagacttccatacagcatgaacaaacagaggagatgttcaatgtgtatggaaaacctggcggcagcgcaaaagatg

SEQ ID NO: 111981 - DNA, 103 bp, Artificial Sequence
  Synthetic Polynucleotide
taatacgactcactataggggacgctggtccctcctgcagacttccatacaacagaggagagtatggatgtctgcaggaaacctggcggcagcgcaaaagatg

SEQ ID NO: 111982 - DNA, 103 bp, Artificial Sequence
  Synthetic Polynucleotide
taatacgactcactatagggccctgaccctgacgctggtccctcctgcagaacagaggagactgcagatgggaccagcgaacctggcggcagcgcaaaagatg

SEQ ID NO: 111983 - DNA, 103 bp, Artificial Sequence
  Synthetic Polynucleotide
taatacgactcactatagggtttctggagtaaattttttttgcttcgataaacagaggagatatcgaatgaaaaaaaataacctggcggcagcgcaaaagatg

SEQ ID NO: 111984 - DNA, 103 bp, Artificial Sequence
  Synthetic Polynucleotide
taatacgactcactatagggccctctctgaccctgaccctgacgctggtcaacagaggagagaccagatgcagggtcagaacctggcggcagcgcaaaagatg

SEQ ID NO: 111985 - DNA, 103 bp, Artificial Sequence
  Synthetic Polynucleotide
taatacgactcactatagggcttctgtcatccctctctgaccctgaccctaacagaggagaagggtcatggtcagagagaacctggcggcagcgcaaaagatg

SEQ ID NO: 111986 - DNA, 103 bp, Artificial Sequence
  Synthetic Polynucleotide
taatacgactcactatagggggcttctgagcttctgtcatccctctctgaaacagaggagatcagagatggatgacagaaacctggcggcagcgcaaaagatg

SEQ ID NO: 111987 - DNA, 103 bp, Artificial Sequence
  Synthetic Polynucleotide
taatacgactcactatagggctgtggctggggcttctgagcttctgtcataacagaggagaatgacaatggctcagaagaacctggcggcagcgcaaaagatg

SEQ ID NO: 111988 - DNA, 103 bp, Artificial Sequence
  Synthetic Polynucleotide
taatacgactcactataggggacagctctactgtggctggggcttctgagaacagaggagactcagaatgcccagccacaacctggcggcagcgcaaaagatg

SEQ ID NO: 111989 - DNA, 103 bp, Artificial Sequence
  Synthetic Polynucleotide
taatacgactcactataggggggtgcagatgacagctctactgtggctggaacagaggagaccagccatggtagagctgaacctggcggcagcgcaaaagatg

SEQ ID NO: 111990 - DNA, 103 bp, Artificial Sequence
  Synthetic Polynucleotide
taatacgactcactatagggtctgagctgagggtgcagatgacagctctaaacagaggagatagagcatgcatctgcacaacctggcggcagcgcaaaagatg

SEQ ID NO: 111991 - DNA, 103 bp, Artificial Sequence
  Synthetic Polynucleotide
taatacgactcactatagggcagaggcgcttctgagctgagggtgcagataacagaggagaatctgcatgctcagctcaaacctggcggcagcgcaaaagatg

SEQ ID NO: 111992 - DNA, 103 bp, Artificial Sequence
  Synthetic Polynucleotide
taatacgactcactatagggcctctcctcacagaggcgcttctgagctgaaacagaggagatcagctatgaagcgcctcaacctggcggcagcgcaaaagatg

SEQ ID NO: 111993 - DNA, 103 bp, Artificial Sequence
  Synthetic Polynucleotide
taatacgactcactatagggcctgaggtttcctctcctcacagaggcgctaacagaggagaagcgccatggtgaggagaaacctggcggcagcgcaaaagatg

SEQ ID NO: 111994 - DNA, 103 bp, Artificial Sequence
  Synthetic Polynucleotide
taatacgactcactatagggatgggatttctttctggagtaaatttttttaacagaggagaaaaaaaatgtactccagaaacctggcggcagcgcaaaagatg

SEQ ID NO: 111995 - DNA, 103 bp, Artificial Sequence
  Synthetic Polynucleotide
taatacgactcactatagggtcatcctcctcctgaggtttcctctcctcaaacagaggagatgaggaatggaaacctcaaacctggcggcagcgcaaaagatg

SEQ ID NO: 111996 - DNA, 103 bp, Artificial Sequence
  Synthetic Polynucleotide
taatacgactcactatagggagtggctggctcatcctcctcctgaggtttaacagaggagaaaacctatggaggaggataacctggcggcagcgcaaaagatg

SEQ ID NO: 111997 - DNA, 103 bp, Artificial Sequence
  Synthetic Polynucleotide
taatacgactcactatagggtttgccttttagtggctggctcatcctcctaacagaggagaaggaggatgagccagccaaacctggcggcagcgcaaaagatg

SEQ ID NO: 111998 - DNA, 103 bp, Artificial Sequence
  Synthetic Polynucleotide
taatacgactcactatagggtattccctactttgccttttagtggctggcaacagaggagagccagcatgtaaaaggcaaacctggcggcagcgcaaaagatg

SEQ ID NO: 111999 - DNA, 103 bp, Artificial Sequence
  Synthetic Polynucleotide
taatacgactcactataggggccgtcttcatattccctactttgccttttaacagaggagaaaaaggatgagtagggaaaacctggcggcagcgcaaaagatg

SEQ ID NO: 112000 - DNA, 103 bp, Artificial Sequence
  Synthetic Polynucleotide
taatacgactcactataggggcgacagcgggccgtcttcatattccctacaacagaggagagtagggatgatgaagacgaacctggcggcagcgcaaaagatg

SEQ ID NO: 112001 - DNA, 103 bp, Artificial Sequence
  Synthetic Polynucleotide
taatacgactcactatagggggcatgacaagcgacagcgggccgtcttcaaacagaggagatgaagaatgcccgctgtcaacctggcggcagcgcaaaagatg

SEQ ID NO: 112002 - DNA, 103 bp, Artificial Sequence
  Synthetic Polynucleotide
taatacgactcactataggggggtttcttgggcatgacaagcgacagcggaacagaggagaccgctgatgcttgtcatgaacctggcggcagcgcaaaagatg

SEQ ID NO: 112003 - DNA, 103 bp, Artificial Sequence
  Synthetic Polynucleotide
taatacgactcactatagggtggaatctgagggtttcttgggcatgacaaaacagaggagattgtcaatgccaagaaacaacctggcggcagcgcaaaagatg

SEQ ID NO: 112004 - DNA, 103 bp, Artificial Sequence
  Synthetic Polynucleotide
taatacgactcactataggggcaaggtctgtggaatctgagggtttcttgaacagaggagacaagaaatgctcagattcaacctggcggcagcgcaaaagatg

SEQ ID NO: 112005 - DNA, 103 bp, Artificial Sequence
  Synthetic Polynucleotide
taatacgactcactatagggaactggagtaatgggatttctttctggagtaacagaggagaactccaatgagaaatcccaacctggcggcagcgcaaaagatg

SEQ ID NO: 112006 - DNA, 103 bp, Artificial Sequence
  Synthetic Polynucleotide
taatacgactcactatagggcttgggagaggcaaggtctgtggaatctgaaacagaggagatcagatatgacagaccttaacctggcggcagcgcaaaagatg

SEQ ID NO: 112007 - DNA, 103 bp, Artificial Sequence
  Synthetic Polynucleotide
taatacgactcactatagggtacccatagtcttgggagaggcaaggtctgaacagaggagacagaccatgcctctcccaaacctggcggcagcgcaaaagatg

SEQ ID NO: 112008 - DNA, 103 bp, Artificial Sequence
  Synthetic Polynucleotide
taatacgactcactataggggatgccctgttacccatagtcttgggagagaacagaggagactctccatggactatgggaacctggcggcagcgcaaaagatg

SEQ ID NO: 112009 - DNA, 103 bp, Artificial Sequence
  Synthetic Polynucleotide
taatacgactcactataggggaggggtatagatgccctgttacccatagtaacagaggagaactatgatgaacagggcaaacctggcggcagcgcaaaagatg

SEQ ID NO: 112010 - DNA, 103 bp, Artificial Sequence
  Synthetic Polynucleotide
taatacgactcactataggggaatgtctttgaggggtatagatgccctgtaacagaggagaacagggatgctataccccaacctggcggcagcgcaaaagatg

SEQ ID NO: 112011 - DNA, 103 bp, Artificial Sequence
  Synthetic Polynucleotide
taatacgactcactatagggccattcacatgaatgtctttgaggggtataaacagaggagatataccatgcaaagacataacctggcggcagcgcaaaagatg

SEQ ID NO: 112012 - DNA, 103 bp, Artificial Sequence
  Synthetic Polynucleotide
taatacgactcactatagggagggagttggccattcacatgaatgtctttaacagaggagaaaagacatgcatgtgaataacctggcggcagcgcaaaagatg

SEQ ID NO: 112013 - DNA, 103 bp, Artificial Sequence
  Synthetic Polynucleotide
taatacgactcactatagggcttctgcagcagggagttggccattcacataacagaggagaatgtgaatggccaactccaacctggcggcagcgcaaaagatg

SEQ ID NO: 112014 - DNA, 103 bp, Artificial Sequence
  Synthetic Polynucleotide
taatacgactcactatagggcctgaaatctcttctgcagcagggagttggaacagaggagaccaactatgtgctgcagaaacctggcggcagcgcaaaagatg

SEQ ID NO: 112015 - DNA, 103 bp, Artificial Sequence
  Synthetic Polynucleotide
taatacgactcactatagggtgttgcctttcctgaaatctcttctgcagcaacagaggagagctgcaatggagatttcaaacctggcggcagcgcaaaagatg

SEQ ID NO: 112016 - DNA, 103 bp, Artificial Sequence
  Synthetic Polynucleotide
taatacgactcactatagggggctgatcaggtcttttagtgttaaacaataacagaggagaattgttatgcactaaaagaacctggcggcagcgcaaaagatg

SEQ ID NO: 112017 - DNA, 103 bp, Artificial Sequence
  Synthetic Polynucleotide
taatacgactcactatagggcaacaaacttaactggagtaatgggatttcaacagaggagagaaatcatgttactccagaacctggcggcagcgcaaaagatg

SEQ ID NO: 112018 - DNA, 103 bp, Artificial Sequence
  Synthetic Polynucleotide
taatacgactcactataggggagagtttgctgttgcctttcctgaaatctaacagaggagaagatttatggaaaggcaaaacctggcggcagcgcaaaagatg

SEQ ID NO: 112019 - DNA, 103 bp, Artificial Sequence
  Synthetic Polynucleotide
taatacgactcactataggggaagaaacaagagagtttgctgttgcctttaacagaggagaaaaggcatgagcaaactcaacctggcggcagcgcaaaagatg

SEQ ID NO: 112020 - DNA, 103 bp, Artificial Sequence
  Synthetic Polynucleotide
taatacgactcactatagggtccccactcagaagaaacaagagagtttgcaacagaggagagcaaacatgcttgtttctaacctggcggcagcgcaaaagatg

SEQ ID NO: 112021 - DNA, 103 bp, Artificial Sequence
  Synthetic Polynucleotide
taatacgactcactatagggttgaaggatttccccactcagaagaaacaaaacagaggagattgtttatgctgagtgggaacctggcggcagcgcaaaagatg

SEQ ID NO: 112022 - DNA, 103 bp, Artificial Sequence
  Synthetic Polynucleotide
taatacgactcactatagggtctgtatttcttgaaggatttccccactcaaacagaggagatgagtgatgaaatccttcaacctggcggcagcgcaaaagatg

SEQ ID NO: 112023 - DNA, 103 bp, Artificial Sequence
  Synthetic Polynucleotide
taatacgactcactatagggcttttcaacatctgtatttcttgaaggattaacagaggagaaatcctatgagaaatacaaacctggcggcagcgcaaaagatg

SEQ ID NO: 112024 - DNA, 103 bp, Artificial Sequence
  Synthetic Polynucleotide
taatacgactcactatagggcttttgaaggcttttcaacatctgtatttcaacagaggagagaaataatgatgttgaaaaacctggcggcagcgcaaaagatg

SEQ ID NO: 112025 - DNA, 103 bp, Artificial Sequence
  Synthetic Polynucleotide
taatacgactcactatagggctttcattttcttttgaaggcttttcaacaaacagaggagatgttgaatggccttcaaaaacctggcggcagcgcaaaagatg

SEQ ID NO: 112026 - DNA, 103 bp, Artificial Sequence
  Synthetic Polynucleotide
taatacgactcactatagggctctttggtgctttcattttcttttgaaggaacagaggagaccttcaatggaaaatgaaaacctggcggcagcgcaaaagatg

SEQ ID NO: 112027 - DNA, 103 bp, Artificial Sequence
  Synthetic Polynucleotide
taatacgactcactataggggcaaagaaggctctttggtgctttcattttaacagaggagaaaaatgatggcaccaaagaacctggcggcagcgcaaaagatg

SEQ ID NO: 112028 - DNA, 103 bp, Artificial Sequence
  Synthetic Polynucleotide
taatacgactcactatagggtgctgtctgtcaacaaacttaactggagtaaacagaggagatactccatgtaagtttgtaacctggcggcagcgcaaaagatg

SEQ ID NO: 112029 - DNA, 103 bp, Artificial Sequence
  Synthetic Polynucleotide
taatacgactcactatagggagatattgtagcaaagaaggctctttggtgaacagaggagacaccaaatggccttctttaacctggcggcagcgcaaaagatg

SEQ ID NO: 112030 - DNA, 103 bp, Artificial Sequence
  Synthetic Polynucleotide
taatacgactcactatagggctgcacacaaagatattgtagcaaagaaggaacagaggagaccttctatgctacaatataacctggcggcagcgcaaaagatg

SEQ ID NO: 112031 - DNA, 103 bp, Artificial Sequence
  Synthetic Polynucleotide
taatacgactcactatagggctgcaggagactgcacacaaagatattgtaaacagaggagatacaatatgtttgtgtgcaacctggcggcagcgcaaaagatg

SEQ ID NO: 112032 - DNA, 103 bp, Artificial Sequence
  Synthetic Polynucleotide
taatacgactcactatagggccatttaatcctgcaggagactgcacacaaaacagaggagattgtgtatggtctcctgcaacctggcggcagcgcaaaagatg

SEQ ID NO: 112033 - DNA, 103 bp, Artificial Sequence
  Synthetic Polynucleotide
taatacgactcactatagggtacattgaaaccatttaatcctgcaggagaaacagaggagatctcctatgggattaaataacctggcggcagcgcaaaagatg

SEQ ID NO: 112034 - DNA, 103 bp, Artificial Sequence
  Synthetic Polynucleotide
taatacgactcactatagggcagataaaagtacattgaaaccatttaatcaacagaggagagattaaatggtttcaatgaacctggcggcagcgcaaaagatg

SEQ ID NO: 112035 - DNA, 103 bp, Artificial Sequence
  Synthetic Polynucleotide
taatacgactcactataggggtttgactgccagataaaagtacattgaaaaacagaggagatttcaaatgacttttatcaacctggcggcagcgcaaaagatg

SEQ ID NO: 112036 - DNA, 103 bp, Artificial Sequence
  Synthetic Polynucleotide
taatacgactcactatagggagtagggggggtttgactgccagataaaagaacagaggagacttttaatgggcagtcaaaacctggcggcagcgcaaaagatg

SEQ ID NO: 112037 - DNA, 103 bp, Artificial Sequence
  Synthetic Polynucleotide
taatacgactcactatagggacgggcccacagtagggggggtttgactgcaacagaggagagcagtcatgccccccctaaacctggcggcagcgcaaaagatg

SEQ ID NO: 112038 - DNA, 103 bp, Artificial Sequence
  Synthetic Polynucleotide
taatacgactcactatagggtgacctgaggacgggcccacagtaggggggaacagaggagaccccccatgtgtgggcccaacctggcggcagcgcaaaagatg

SEQ ID NO: 112039 - DNA, 103 bp, Artificial Sequence
  Synthetic Polynucleotide
taatacgactcactatagggtggttccgcttgctgtctgtcaacaaacttaacagaggagaaagtttatggacagacagaacctggcggcagcgcaaaagatg

SEQ ID NO: 112040 - DNA, 103 bp, Artificial Sequence
  Synthetic Polynucleotide
taatacgactcactatagggagacggcagctgacctgaggacgggcccacaacagaggagagtgggcatgtcctcaggtaacctggcggcagcgcaaaagatg

SEQ ID NO: 112041 - DNA, 103 bp, Artificial Sequence
  Synthetic Polynucleotide
taatacgactcactatagggggacactgaaagacggcagctgacctgaggaacagaggagacctcagatgagctgccgtaacctggcggcagcgcaaaagatg

SEQ ID NO: 112042 - DNA, 103 bp, Artificial Sequence
  Synthetic Polynucleotide
taatacgactcactatagggaccatgcaagggacactgaaagacggcagcaacagaggagagctgccatgtttcagtgtaacctggcggcagcgcaaaagatg

SEQ ID NO: 112043 - DNA, 103 bp, Artificial Sequence
  Synthetic Polynucleotide
taatacgactcactatagggagatggtaagaccatgcaagggacactgaaaacagaggagattcagtatgccttgcatgaacctggcggcagcgcaaaagatg

SEQ ID NO: 112044 - DNA, 103 bp, Artificial Sequence
  Synthetic Polynucleotide
taatacgactcactatagggccagaggtggagatggtaagaccatgcaagaacagaggagacttgcaatgtcttaccataacctggcggcagcgcaaaagatg

SEQ ID NO: 112045 - DNA, 103 bp, Artificial Sequence
  Synthetic Polynucleotide
taatacgactcactatagggggaaaagggcccagaggtggagatggtaagaacagaggagacttaccatgtccacctctaacctggcggcagcgcaaaagatg

SEQ ID NO: 112046 - DNA, 103 bp, Artificial Sequence
  Synthetic Polynucleotide
taatacgactcactatagggatagagaacaggaaaagggcccagaggtggaacagaggagaccacctatgggcccttttaacctggcggcagcgcaaaagatg

SEQ ID NO: 112047 - DNA, 103 bp, Artificial Sequence
  Synthetic Polynucleotide
taatacgactcactatagggttgcaggagaatagagaacaggaaaagggcaacagaggagagcccttatgctgttctctaacctggcggcagcgcaaaagatg

SEQ ID NO: 112048 - DNA, 103 bp, Artificial Sequence
  Synthetic Polynucleotide
taatacgactcactataggggggcccggcattgcaggagaatagagaacaaacagaggagatgttctatgttctcctgcaacctggcggcagcgcaaaagatg

SEQ ID NO: 112049 - DNA, 103 bp, Artificial Sequence
  Synthetic Polynucleotide
taatacgactcactatagggagaagaaaccgggcccggcattgcaggagaaacagaggagatctcctatgatgccgggcaacctggcggcagcgcaaaagatg

SEQ ID NO: 112050 - DNA, 103 bp, Artificial Sequence
  Synthetic Polynucleotide
taatacgactcactatagggtgggtgtccatggttccgcttgctgtctgtaacagaggagaacagacatgaagcggaacaacctggcggcagcgcaaaagatg

SEQ ID NO: 112051 - DNA, 103 bp, Artificial Sequence
  Synthetic Polynucleotide
taatacgactcactatagggcaccaagagtagaagaaaccgggcccggcaaacagaggagatgccggatgcggtttcttaacctggcggcagcgcaaaagatg

SEQ ID NO: 112052 - DNA, 103 bp, Artificial Sequence
  Synthetic Polynucleotide
taatacgactcactatagggtttgggagagcaccaagagtagaagaaaccaacagaggagaggtttcatgtactcttggaacctggcggcagcgcaaaagatg

SEQ ID NO: 112053 - DNA, 103 bp, Artificial Sequence
  Synthetic Polynucleotide
taatacgactcactatagggaggtcctgtgtttgggagagcaccaagagtaacagaggagaactcttatggctctcccaaacctggcggcagcgcaaaagatg

SEQ ID NO: 112054 - DNA, 103 bp, Artificial Sequence
  Synthetic Polynucleotide
taatacgactcactatagggtgaaattcacaggtcctgtgtttgggagagaacagaggagactctccatgacacaggacaacctggcggcagcgcaaaagatg

SEQ ID NO: 112055 - DNA, 103 bp, Artificial Sequence
  Synthetic Polynucleotide
taatacgactcactatagggccaggcaagctgaaattcacaggtcctgtgaacagaggagacacaggatgtgtgaatttaacctggcggcagcgcaaaagatg

SEQ ID NO: 112056 - DNA, 103 bp, Artificial Sequence
  Synthetic Polynucleotide
taatacgactcactatagggtgatccaaggccaggcaagctgaaattcacaacagaggagagtgaatatgagcttgcctaacctggcggcagcgcaaaagatg

SEQ ID NO: 112057 - DNA, 103 bp, Artificial Sequence
  Synthetic Polynucleotide
taatacgactcactataggggctgggctattgatccaaggccaggcaagcaacagaggagagcttgcatggccttggataacctggcggcagcgcaaaagatg

SEQ ID NO: 112058 - DNA, 103 bp, Artificial Sequence
  Synthetic Polynucleotide
taatacgactcactatagggccgacgagaagctgggctattgatccaaggaacagaggagaccttggatgaatagcccaaacctggcggcagcgcaaaagatg

SEQ ID NO: 112059 - DNA, 103 bp, Artificial Sequence
  Synthetic Polynucleotide
taatacgactcactatagggagctgtggggccgacgagaagctgggctataacagaggagaatagccatgcttctcgtcaacctggcggcagcgcaaaagatg

SEQ ID NO: 112060 - DNA, 103 bp, Artificial Sequence
  Synthetic Polynucleotide
taatacgactcactataggggattaaccacagctgtggggccgacgagaaaacagaggagattctcgatggccccacagaacctggcggcagcgcaaaagatg

SEQ ID NO: 112061 - DNA, 103 bp, Artificial Sequence
  Synthetic Polynucleotide
taatacgactcactatagggaggttagctgtgggtgtccatggttccgctaacagaggagaagcggaatgatggacaccaacctggcggcagcgcaaaagatg

SEQ ID NO: 112062 - DNA, 103 bp, Artificial Sequence
  Synthetic Polynucleotide
taatacgactcactataggggacgactttggattaaccacagctgtggggaacagaggagaccccacatgtgtggttaaaacctggcggcagcgcaaaagatg

SEQ ID NO: 112063 - DNA, 103 bp, Artificial Sequence
  Synthetic Polynucleotide
taatacgactcactatagggagggagtgtggacgactttggattaaccacaacagaggagagtggttatgccaaagtcgaacctggcggcagcgcaaaagatg

SEQ ID NO: 112064 - DNA, 103 bp, Artificial Sequence
  Synthetic Polynucleotide
taatacgactcactatagggggtctgcagaagggagtgtggacgactttgaacagaggagacaaagtatgccacactccaacctggcggcagcgcaaaagatg

SEQ ID NO: 112065 - DNA, 103 bp, Artificial Sequence
  Synthetic Polynucleotide
taatacgactcactatagggtgaagctgagggtctgcagaagggagtgtgaacagaggagacacactatgttctgcagaaacctggcggcagcgcaaaagatg

SEQ ID NO: 112066 - DNA, 103 bp, Artificial Sequence
  Synthetic Polynucleotide
taatacgactcactataggggggctgactctgaagctgagggtctgcagaaacagaggagatctgcaatgcctcagcttaacctggcggcagcgcaaaagatg

SEQ ID NO: 112067 - DNA, 103 bp, Artificial Sequence
  Synthetic Polynucleotide
taatacgactcactatagggggtttagtgagggctgactctgaagctgagaacagaggagactcagcatgagagtcagcaacctggcggcagcgcaaaagatg

SEQ ID NO: 112068 - DNA, 103 bp, Artificial Sequence
  Synthetic Polynucleotide
taatacgactcactatagggactggacttaggtttagtgagggctgactcaacagaggagagagtcaatgctcactaaaaacctggcggcagcgcaaaagatg

SEQ ID NO: 112069 - DNA, 103 bp, Artificial Sequence
  Synthetic Polynucleotide
taatacgactcactatagggccttgacatcactggacttaggtttagtgaaacagaggagatcactaatgctaagtccaaacctggcggcagcgcaaaagatg

SEQ ID NO: 112070 - DNA, 103 bp, Artificial Sequence
  Synthetic Polynucleotide
taatacgactcactatagggcactgtgtgaccttgacatcactggacttaaacagaggagataagtcatgtgatgtcaaaacctggcggcagcgcaaaagatg

SEQ ID NO: 112071 - DNA, 103 bp, Artificial Sequence
  Synthetic Polynucleotide
taatacgactcactatagggtgttggacgacactgtgtgaccttgacatcaacagaggagagatgtcatggtcacacagaacctggcggcagcgcaaaagatg

SEQ ID NO: 112072 - DNA, 103 bp, Artificial Sequence
  Synthetic Polynucleotide
taatacgactcactataggggagcatcttcaggttagctgtgggtgtccaaacagaggagatggacaatgacagctaacaacctggcggcagcgcaaaagatg

SEQ ID NO: 112073 - DNA, 103 bp, Artificial Sequence
  Synthetic Polynucleotide
taatacgactcactatagggggactcaggttgttggacgacactgtgtgaaacagaggagatcacacatggtcgtccaaaacctggcggcagcgcaaaagatg

SEQ ID NO: 112074 - DNA, 103 bp, Artificial Sequence
  Synthetic Polynucleotide
taatacgactcactatagggcgtaaacgggggactcaggttgttggacgaaacagaggagatcgtccatgaacctgagtaacctggcggcagcgcaaaagatg

SEQ ID NO: 112075 - DNA, 103 bp, Artificial Sequence
  Synthetic Polynucleotide
taatacgactcactatagggggatgtcccacgtaaacgggggactcaggtaacagaggagaacctgaatgccccgtttaaacctggcggcagcgcaaaagatg

SEQ ID NO: 112076 - DNA, 103 bp, Artificial Sequence
  Synthetic Polynucleotide
taatacgactcactatagggtactgagactggatgtcccacgtaaacgggaacagaggagacccgttatggtgggacataacctggcggcagcgcaaaagatg

SEQ ID NO: 112077 - DNA, 103 bp, Artificial Sequence
  Synthetic Polynucleotide
taatacgactcactataggggtaattttactactgagactggatgtcccaaacagaggagatgggacatgcagtctcagaacctggcggcagcgcaaaagatg

SEQ ID NO: 112078 - DNA, 103 bp, Artificial Sequence
  Synthetic Polynucleotide
taatacgactcactatagggggtgactgatgtaattttactactgagactaacagaggagaagtctcatgagtaaaattaacctggcggcagcgcaaaagatg

SEQ ID NO: 112079 - DNA, 103 bp, Artificial Sequence
  Synthetic Polynucleotide
taatacgactcactatagggcactggaactggtgactgatgtaattttacaacagaggagagtaaaaatgcatcagtcaaacctggcggcagcgcaaaagatg

SEQ ID NO: 112080 - DNA, 103 bp, Artificial Sequence
  Synthetic Polynucleotide
taatacgactcactatagggtcttgggggtcactggaactggtgactgataacagaggagaatcagtatgcagttccagaacctggcggcagcgcaaaagatg

SEQ ID NO: 112081 - DNA, 103 bp, Artificial Sequence
  Synthetic Polynucleotide
taatacgactcactatagggcgttggatgctcttgggggtcactggaactaacagaggagaagttccatggacccccaaaacctggcggcagcgcaaaagatg

SEQ ID NO: 112082 - DNA, 103 bp, Artificial Sequence
  Synthetic Polynucleotide
taatacgactcactatagggacgatgtgtgcgttggatgctcttgggggtaacagaggagaacccccatgagcatccaaaacctggcggcagcgcaaaagatg

SEQ ID NO: 112083 - DNA, 103 bp, Artificial Sequence
  Synthetic Polynucleotide
taatacgactcactatagggcagcactaatgagcatcttcaggttagctgaacagaggagacagctaatgtgaagatgcaacctggcggcagcgcaaaagatg

SEQ ID NO: 112084 - DNA, 103 bp, Artificial Sequence
  Synthetic Polynucleotide
taatacgactcactatagggaaaacgtctcacgatgtgtgcgttggatgcaacagaggagagcatccatggcacacatcaacctggcggcagcgcaaaagatg

SEQ ID NO: 112085 - DNA, 103 bp, Artificial Sequence
  Synthetic Polynucleotide
taatacgactcactatagggggtgtcttgaaaaacgtctcacgatgtgtgaacagaggagacacacaatgtgagacgttaacctggcggcagcgcaaaagatg

SEQ ID NO: 112086 - DNA, 103 bp, Artificial Sequence
  Synthetic Polynucleotide
taatacgactcactatagggaaggctgccgggtgtcttgaaaaacgtctcaacagaggagagagacgatgttcaagacaaacctggcggcagcgcaaaagatg

SEQ ID NO: 112087 - DNA, 103 bp, Artificial Sequence
  Synthetic Polynucleotide
taatacgactcactatagggcagggtctccaaggctgccgggtgtcttgaaacagaggagatcaagaatgccggcagccaacctggcggcagcgcaaaagatg

SEQ ID NO: 112088 - DNA, 103 bp, Artificial Sequence
  Synthetic Polynucleotide
taatacgactcactatagggctcttcaggacagggtctccaaggctgccgaacagaggagacggcagatgtggagacccaacctggcggcagcgcaaaagatg

SEQ ID NO: 112089 - DNA, 103 bp, Artificial Sequence
  Synthetic Polynucleotide
taatacgactcactatagggcctttctcttctcttcaggacagggtctccaacagaggagaggagacatggtcctgaagaacctggcggcagcgcaaaagatg

SEQ ID NO: 112090 - DNA, 103 bp, Artificial Sequence
  Synthetic Polynucleotide
taatacgactcactataggggtgactggttcctttctcttctcttcaggaaacagaggagatcctgaatggaagagaaaaacctggcggcagcgcaaaagatg

SEQ ID NO: 112091 - DNA, 103 bp, Artificial Sequence
  Synthetic Polynucleotide
taatacgactcactatagggctggtgtttcgtgactggttcctttctcttaacagaggagaaagagaatggaaccagtcaacctggcggcagcgcaaaagatg

SEQ ID NO: 112092 - DNA, 103 bp, Artificial Sequence
  Synthetic Polynucleotide
taatacgactcactatagggctgggccgagctggtgtttcgtgactggttaacagaggagaaaccagatgcgaaacaccaacctggcggcagcgcaaaagatg

SEQ ID NO: 112093 - DNA, 103 bp, Artificial Sequence
  Synthetic Polynucleotide
taatacgactcactatagggctagtctcctctgggccgagctggtgtttcaacagaggagagaaacaatggctcggcccaacctggcggcagcgcaaaagatg

SEQ ID NO: 112094 - DNA, 103 bp, Artificial Sequence
  Synthetic Polynucleotide
taatacgactcactatagggtctgggctggcagcactaatgagcatcttcaacagaggagagaagatatgcattagtgcaacctggcggcagcgcaaaagatg

SEQ ID NO: 112095 - DNA, 103 bp, Artificial Sequence
  Synthetic Polynucleotide
taatacgactcactatagggctggggatttctagtctcctctgggccgagaacagaggagactcggcatggaggagactaacctggcggcagcgcaaaagatg

SEQ ID NO: 112096 - DNA, 103 bp, Artificial Sequence
  Synthetic Polynucleotide
taatacgactcactatagggagcgccgccgctggggatttctagtctcctaacagaggagaaggagaatggaaatccccaacctggcggcagcgcaaaagatg

SEQ ID NO: 112097 - DNA, 103 bp, Artificial Sequence
  Synthetic Polynucleotide
taatacgactcactataggggtcccttatatctgggctggcagcactaataacagaggagaattagtatggccagcccaaacctggcggcagcgcaaaagatg

SEQ ID NO: 112098 - DNA, 103 bp, Artificial Sequence
  Synthetic Polynucleotide
taatacgactcactatagggtcttctcccggtcccttatatctgggctggaacagaggagaccagccatgatataagggaacctggcggcagcgcaaaagatg

SEQ ID NO: 112099 - DNA, 103 bp, Artificial Sequence
  Synthetic Polynucleotide
taatacgactcactatagggggctgcctggggctgatcaggtcttttagtaacagaggagaactaaaatgcctgatcagaacctggcggcagcgcaaaagatg

SEQ ID NO: 112100 - DNA, 103 bp, Artificial Sequence
  Synthetic Polynucleotide
taatacgactcactatagggagtccctttttcttctcccggtcccttataaacagaggagatataagatgccgggagaaaacctggcggcagcgcaaaagatg

SEQ ID NO: 112101 - DNA, 103 bp, Artificial Sequence
  Synthetic Polynucleotide
taatacgactcactataggggggtcggaatagtccctttttcttctcccgaacagaggagacgggagatgaaaaagggaaacctggcggcagcgcaaaagatg

SEQ ID NO: 112102 - DNA, 103 bp, Artificial Sequence
  Synthetic Polynucleotide
taatacgactcactatagggtgttttcaatgggtcggaatagtcccttttaacagaggagaaaaaggatgtattccgacaacctggcggcagcgcaaaagatg

SEQ ID NO: 112103 - DNA, 103 bp, Artificial Sequence
  Synthetic Polynucleotide
taatacgactcactataggggcatcgtccttgttttcaatgggtcggaataacagaggagaattccgatgcattgaaaaaacctggcggcagcgcaaaagatg

SEQ ID NO: 112104 - DNA, 103 bp, Artificial Sequence
  Synthetic Polynucleotide
taatacgactcactatagggatctgtaaatgcatcgtccttgttttcaataacagaggagaattgaaatgaaggacgataacctggcggcagcgcaaaagatg

SEQ ID NO: 112105 - DNA, 103 bp, Artificial Sequence
  Synthetic Polynucleotide
taatacgactcactataggggctgtagagaatctgtaaatgcatcgtcctaacagaggagaaggacgatgcatttacagaacctggcggcagcgcaaaagatg

SEQ ID NO: 112106 - DNA, 103 bp, Artificial Sequence
  Synthetic Polynucleotide
taatacgactcactatagggacaacatcaagctgtagagaatctgtaaataacagaggagaatttacatgttctctacaaacctggcggcagcgcaaaagatg

SEQ ID NO: 112107 - DNA, 103 bp, Artificial Sequence
  Synthetic Polynucleotide
taatacgactcactatagggactgtccccaacaacatcaagctgtagagaaacagaggagatctctaatgcttgatgttaacctggcggcagcgcaaaagatg

SEQ ID NO: 112108 - DNA, 103 bp, Artificial Sequence
  Synthetic Polynucleotide
taatacgactcactatagggcgtccacagcactgtccccaacaacatcaaaacagaggagattgatgatgttggggacaaacctggcggcagcgcaaaagatg

SEQ ID NO: 112109 - DNA, 103 bp, Artificial Sequence
  Synthetic Polynucleotide
taatacgactcactatagggttttcaaattcgtccacagcactgtccccaaacagaggagatggggaatgtgctgtggaaacctggcggcagcgcaaaagatg

SEQ ID NO: 112110 - DNA, 103 bp, Artificial Sequence
  Synthetic Polynucleotide
taatacgactcactatagggatctagtctgggctgcctggggctgatcagaacagaggagactgatcatgcccaggcagaacctggcggcagcgcaaaagatg

SEQ ID NO: 112111 - DNA, 103 bp, Artificial Sequence
  Synthetic Polynucleotide
taatacgactcactatagggtggcctttgcttttcaaattcgtccacagcaacagaggagagctgtgatggaatttgaaaacctggcggcagcgcaaaagatg

SEQ ID NO: 112112 - DNA, 103 bp, Artificial Sequence
  Synthetic Polynucleotide
taatacgactcactataggggttttctgcttggcctttgcttttcaaattaacagaggagaaatttgatgagcaaaggcaacctggcggcagcgcaaaagatg

SEQ ID NO: 112113 - DNA, 103 bp, Artificial Sequence
  Synthetic Polynucleotide
taatacgactcactatagggaaacttttctgttttctgcttggcctttgcaacagaggagagcaaagatgaagcagaaaaacctggcggcagcgcaaaagatg

SEQ ID NO: 112114 - DNA, 103 bp, Artificial Sequence
  Synthetic Polynucleotide
taatacgactcactatagggcaggagtcctaaacttttctgttttctgctaacagaggagaagcagaatgcagaaaagtaacctggcggcagcgcaaaagatg

SEQ ID NO: 112115 - DNA, 103 bp, Artificial Sequence
  Synthetic Polynucleotide
taatacgactcactatagggacttctggcacaggagtcctaaacttttctaacagaggagaagaaaaatgtaggactccaacctggcggcagcgcaaaagatg

SEQ ID NO: 112116 - DNA, 103 bp, Artificial Sequence
  Synthetic Polynucleotide
taatacgactcactatagggcgagctagaaacttctggcacaggagtcctaacagaggagaaggactatggtgccagaaaacctggcggcagcgcaaaagatg

SEQ ID NO: 112117 - DNA, 103 bp, Artificial Sequence
  Synthetic Polynucleotide
taatacgactcactatagggacttggatagcgagctagaaacttctggcaaacagaggagatgccagatgtttctagctaacctggcggcagcgcaaaagatg

SEQ ID NO: 112118 - DNA, 103 bp, Artificial Sequence
  Synthetic Polynucleotide
taatacgactcactatagggacaagggataacttggatagcgagctagaaaacagaggagattctagatggctatccaaaacctggcggcagcgcaaaagatg

SEQ ID NO: 112119 - DNA, 103 bp, Artificial Sequence
  Synthetic Polynucleotide
taatacgactcactatagggttctcagttgacaagggataacttggatagaacagaggagactatccatgttatcccttaacctggcggcagcgcaaaagatg

SEQ ID NO: 112120 - DNA, 103 bp, Artificial Sequence
  Synthetic Polynucleotide
taatacgactcactataggggatggtagttttctcagttgacaagggataaacagaggagatatcccatgtcaactgagaacctggcggcagcgcaaaagatg

SEQ ID NO: 112121 - DNA, 103 bp, Artificial Sequence
  Synthetic Polynucleotide
taatacgactcactatagggcaactgcaaaatctagtctgggctgcctggaacagaggagaccaggcatgccagactagaacctggcggcagcgcaaaagatg

SEQ ID NO: 112122 - DNA, 103 bp, Artificial Sequence
  Synthetic Polynucleotide
taatacgactcactatagggcatctagggagatggtagttttctcagttgaacagaggagacaactgatgaaactaccaaacctggcggcagcgcaaaagatg

SEQ ID NO: 112123 - DNA, 103 bp, Artificial Sequence
  Synthetic Polynucleotide
taatacgactcactatagggacagcaacttcatctagggagatggtagttaacagaggagaaactacatgctccctagaaacctggcggcagcgcaaaagatg

SEQ ID NO: 112124 - DNA, 103 bp, Artificial Sequence
  Synthetic Polynucleotide
taatacgactcactatagggaccaagactgacagcaacttcatctagggaaacagaggagatccctaatggaagttgctaacctggcggcagcgcaaaagatg

SEQ ID NO: 112125 - DNA, 103 bp, Artificial Sequence
  Synthetic Polynucleotide
taatacgactcactatagggtcctttccacaccaagactgacagcaacttaacagaggagaaagttgatgtcagtcttgaacctggcggcagcgcaaaagatg

SEQ ID NO: 112126 - DNA, 103 bp, Artificial Sequence
  Synthetic Polynucleotide
taatacgactcactatagggtagatgcgtctcctttccacaccaagactgaacagaggagacagtctatgtgtggaaagaacctggcggcagcgcaaaagatg

SEQ ID NO: 112127 - DNA, 103 bp, Artificial Sequence
  Synthetic Polynucleotide
taatacgactcactatagggtacaatgtcatagatgcgtctcctttccacaacagaggagagtggaaatgagacgcatcaacctggcggcagcgcaaaagatg

SEQ ID NO: 112128 - DNA, 103 bp, Artificial Sequence
  Synthetic Polynucleotide
taatacgactcactatagggccagcacatttacaatgtcatagatgcgtcaacagaggagagacgcaatgatgacattgaacctggcggcagcgcaaaagatg

SEQ ID NO: 112129 - DNA, 103 bp, Artificial Sequence
  Synthetic Polynucleotide
taatacgactcactatagggtgcagcgactccagcacatttacaatgtcaaacagaggagatgacatatgaaatgtgctaacctggcggcagcgcaaaagatg

SEQ ID NO: 112130 - DNA, 103 bp, Artificial Sequence
  Synthetic Polynucleotide
taatacgactcactataggggctgaccagatgcagcgactccagcacattaacagaggagaaatgtgatggagtcgctgaacctggcggcagcgcaaaagatg

SEQ ID NO: 112131 - DNA, 103 bp, Artificial Sequence
  Synthetic Polynucleotide
taatacgactcactatagggtagccacccggctgaccagatgcagcgactaacagaggagaagtcgcatgatctggtcaaacctggcggcagcgcaaaagatg

SEQ ID NO: 112132 - DNA, 103 bp, Artificial Sequence
  Synthetic Polynucleotide
taatacgactcactatagggtccccatcttcaactgcaaaatctagtctgaacagaggagacagactatgttttgcagtaacctggcggcagcgcaaaagatg

SEQ ID NO: 112133 - DNA, 103 bp, Artificial Sequence
  Synthetic Polynucleotide
taatacgactcactatagggtactgattcttagccacccggctgaccagaaacagaggagatctggtatgccgggtggcaacctggcggcagcgcaaaagatg

SEQ ID NO: 112134 - DNA, 103 bp, Artificial Sequence
  Synthetic Polynucleotide
taatacgactcactatagggatgccagccatactgattcttagccacccgaacagaggagacgggtgatgaagaatcagaacctggcggcagcgcaaaagatg

SEQ ID NO: 112135 - DNA, 103 bp, Artificial Sequence
  Synthetic Polynucleotide
taatacgactcactatagggtgtgccgtccatgccagccatactgattctaacagaggagaagaatcatgatggctggcaacctggcggcagcgcaaaagatg

SEQ ID NO: 112136 - DNA, 103 bp, Artificial Sequence
  Synthetic Polynucleotide
taatacgactcactatagggtttggcaggctgtgccgtccatgccagccaaacagaggagatggctgatgtggacggcaaacctggcggcagcgcaaaagatg

SEQ ID NO: 112137 - DNA, 103 bp, Artificial Sequence
  Synthetic Polynucleotide
taatacgactcactatagggcctcagggtttttggcaggctgtgccgtccaacagaggagaggacggatgagcctgccaaacctggcggcagcgcaaaagatg

SEQ ID NO: 112138 - DNA, 103 bp, Artificial Sequence
  Synthetic Polynucleotide
taatacgactcactatagggtctggaggttcctcagggtttttggcaggcaacagaggagagcctgcatgaaaccctgaaacctggcggcagcgcaaaagatg

SEQ ID NO: 112139 - DNA, 103 bp, Artificial Sequence
  Synthetic Polynucleotide
taatacgactcactatagggtctcctagtctctggaggttcctcagggttaacagaggagaaaccctatggaacctccaaacctggcggcagcgcaaaagatg

SEQ ID NO: 112140 - DNA, 103 bp, Artificial Sequence
  Synthetic Polynucleotide
taatacgactcactatagggtttctgctcctctcctagtctctggaggttaacagaggagaaacctcatgagactaggaaacctggcggcagcgcaaaagatg

SEQ ID NO: 112141 - DNA, 103 bp, Artificial Sequence
  Synthetic Polynucleotide
taatacgactcactataggggctcttcatatttctgctcctctcctagtcaacagaggagagactagatgaggagcagaaacctggcggcagcgcaaaagatg

SEQ ID NO: 112142 - DNA, 103 bp, Artificial Sequence
  Synthetic Polynucleotide
taatacgactcactatagggtaggccatttgctcttcatatttctgctccaacagaggagaggagcaatgatatgaagaaacctggcggcagcgcaaaagatg

SEQ ID NO: 112143 - DNA, 103 bp, Artificial Sequence
  Synthetic Polynucleotide
taatacgactcactatagggttgtgcattttccccatcttcaactgcaaaaacagaggagatttgcaatggaagatgggaacctggcggcagcgcaaaagatg

SEQ ID NO: 112144 - DNA, 103 bp, Artificial Sequence
  Synthetic Polynucleotide
taatacgactcactatagggctgttggaggtaggccatttgctcttcataaacagaggagatatgaaatgcaaatggccaacctggcggcagcgcaaaagatg

SEQ ID NO: 112145 - DNA, 103 bp, Artificial Sequence
  Synthetic Polynucleotide
taatacgactcactatagggccagctctttctgttggaggtaggccatttaacagaggagaaaatggatgacctccaacaacctggcggcagcgcaaaagatg

SEQ ID NO: 112146 - DNA, 103 bp, Artificial Sequence
  Synthetic Polynucleotide
taatacgactcactatagggtctatcaggtccagctctttctgttggaggaacagaggagacctccaatggaaagagctaacctggcggcagcgcaaaagatg

SEQ ID NO: 112147 - DNA, 103 bp, Artificial Sequence
  Synthetic Polynucleotide
taatacgactcactatagggaaatttataatctatcaggtccagctctttaacagaggagaaaagagatggacctgataaacctggcggcagcgcaaaagatg

SEQ ID NO: 112148 - DNA, 103 bp, Artificial Sequence
  Synthetic Polynucleotide
taatacgactcactatagggtacgttctccaaatttataatctatcaggtaacagaggagaacctgaatgattataaataacctggcggcagcgcaaaagatg

SEQ ID NO: 112149 - DNA, 103 bp, Artificial Sequence
  Synthetic Polynucleotide
taatacgactcactatagggccatcttttttacgttctccaaatttataaaacagaggagattataaatgtggagaacgaacctggcggcagcgcaaaagatg

SEQ ID NO: 112150 - DNA, 103 bp, Artificial Sequence
  Synthetic Polynucleotide
taatacgactcactatagggatctggatcaccatcttttttacgttctccaacagaggagaggagaaatgaaaaaagataacctggcggcagcgcaaaagatg

SEQ ID NO: 112151 - DNA, 103 bp, Artificial Sequence
  Synthetic Polynucleotide
taatacgactcactataggggttcctgggaatctggatcaccatctttttaacagaggagaaaaaagatggtgatccagaacctggcggcagcgcaaaagatg

SEQ ID NO: 112152 - DNA, 103 bp, Artificial Sequence
  Synthetic Polynucleotide
taatacgactcactatagggagtaactgttgttcctgggaatctggatcaaacagaggagatgatccatgttcccaggaaacctggcggcagcgcaaaagatg

SEQ ID NO: 112153 - DNA, 103 bp, Artificial Sequence
  Synthetic Polynucleotide
taatacgactcactatagggagagaaatccagtaactgttgttcctgggaaacagaggagatcccagatgcaacagttaaacctggcggcagcgcaaaagatg

SEQ ID NO: 112154 - DNA, 103 bp, Artificial Sequence
  Synthetic Polynucleotide
taatacgactcactatagggtattttccttttgtgcattttccccatcttaacagaggagaaagatgatgaaaatgcacaacctggcggcagcgcaaaagatg

SEQ ID NO: 112155 - DNA, 103 bp, Artificial Sequence
  Synthetic Polynucleotide
taatacgactcactatagggagtcgggttcagagaaatccagtaactgttaacagaggagaaacagtatgtggatttctaacctggcggcagcgcaaaagatg

SEQ ID NO: 112156 - DNA, 103 bp, Artificial Sequence
  Synthetic Polynucleotide
taatacgactcactataggggaagagggacagtcgggttcagagaaatccaacagaggagaggatttatgtgaacccgaaacctggcggcagcgcaaaagatg

SEQ ID NO: 112157 - DNA, 103 bp, Artificial Sequence
  Synthetic Polynucleotide
taatacgactcactataggggtttgcagatgaagagggacagtcgggttcaacagaggagagaacccatgtgtccctctaacctggcggcagcgcaaaagatg

SEQ ID NO: 112158 - DNA, 103 bp, Artificial Sequence
  Synthetic Polynucleotide
taatacgactcactatagggcttttctactgtttgcagatgaagagggacaacagaggagagtccctatgcatctgcaaaacctggcggcagcgcaaaagatg

SEQ ID NO: 112159 - DNA, 103 bp, Artificial Sequence
  Synthetic Polynucleotide
taatacgactcactatagggagagacttgtcttttctactgtttgcagataacagaggagaatctgcatgcagtagaaaaacctggcggcagcgcaaaagatg

SEQ ID NO: 112160 - DNA, 103 bp, Artificial Sequence
  Synthetic Polynucleotide
taatacgactcactatagggcataattctcagagacttgtcttttctactaacagaggagaagtagaatggacaagtctaacctggcggcagcgcaaaagatg

SEQ ID NO: 112161 - DNA, 103 bp, Artificial Sequence
  Synthetic Polynucleotide
taatacgactcactatagggacttctggctcataattctcagagacttgtaacagaggagaacaagtatgtgagaattaaacctggcggcagcgcaaaagatg

SEQ ID NO: 112162 - DNA, 103 bp, Artificial Sequence
  Synthetic Polynucleotide
taatacgactcactatagggagcatgacaaacttctggctcataattctcaacagaggagagagaatatggagccagaaaacctggcggcagcgcaaaagatg

SEQ ID NO: 112163 - DNA, 103 bp, Artificial Sequence
  Synthetic Polynucleotide
taatacgactcactataggggacgaggaacagcatgacaaacttctggctaacagaggagaagccagatgtttgtcatgaacctggcggcagcgcaaaagatg

SEQ ID NO: 112164 - DNA, 103 bp, Artificial Sequence
  Synthetic Polynucleotide
taatacgactcactatagggtggttttggagacgaggaacagcatgacaaaacagaggagattgtcaatgtgttcctcgaacctggcggcagcgcaaaagatg

SEQ ID NO: 112165 - DNA, 103 bp, Artificial Sequence
  Synthetic Polynucleotide
taatacgactcactatagggtcaacaaatatattttccttttgtgcatttaacagaggagaaaatgcatgaaaggaaaaaacctggcggcagcgcaaaagatg

SEQ ID NO: 112166 - DNA, 103 bp, Artificial Sequence
  Synthetic Polynucleotide
taatacgactcactataggggtgacaatcttggttttggagacgaggaacaacagaggagagttcctatgctccaaaacaacctggcggcagcgcaaaagatg

SEQ ID NO: 112167 - DNA, 103 bp, Artificial Sequence
  Synthetic Polynucleotide
taatacgactcactatagggcacatccagagtgacaatcttggttttggaaacagaggagatccaaaatgaagattgtcaacctggcggcagcgcaaaagatg

SEQ ID NO: 112168 - DNA, 103 bp, Artificial Sequence
  Synthetic Polynucleotide
taatacgactcactatagggttttggcagccacatccagagtgacaatctaacagaggagaagattgatgctctggatgaacctggcggcagcgcaaaagatg

SEQ ID NO: 112169 - DNA, 103 bp, Artificial Sequence
  Synthetic Polynucleotide
taatacgactcactatagggtctatcagtattttggcagccacatccagaaacagaggagatctggaatgggctgccaaaacctggcggcagcgcaaaagatg

SEQ ID NO: 112170 - DNA, 103 bp, Artificial Sequence
  Synthetic Polynucleotide
taatacgactcactatagggttggctttcttctatcagtattttggcagcaacagaggagagctgccatgatactgataaacctggcggcagcgcaaaagatg

SEQ ID NO: 112171 - DNA, 103 bp, Artificial Sequence
  Synthetic Polynucleotide
taatacgactcactatagggctggggcatcttggctttcttctatcagtaaacagaggagatactgaatgaagaaagccaacctggcggcagcgcaaaagatg

SEQ ID NO: 112172 - DNA, 103 bp, Artificial Sequence
  Synthetic Polynucleotide
taatacgactcactatagggttactatggtctggggcatcttggctttctaacagaggagaagaaagatgagatgccccaacctggcggcagcgcaaaagatg

SEQ ID NO: 112173 - DNA, 103 bp, Artificial Sequence
  Synthetic Polynucleotide
taatacgactcactatagggtgttttaaatttactatggtctggggcatcaacagaggagagatgccatggaccatagtaacctggcggcagcgcaaaagatg

SEQ ID NO: 112174 - DNA, 103 bp, Artificial Sequence
  Synthetic Polynucleotide
taatacgactcactataggggtcgtacctttgttttaaatttactatggtaacagaggagaaccataatgaatttaaaaaacctggcggcagcgcaaaagatg

SEQ ID NO: 112175 - DNA, 103 bp, Artificial Sequence
  Synthetic Polynucleotide
taatacgactcactatagggtcatagaggcgtcgtacctttgttttaaataacagaggagaatttaaatgaaaggtacgaacctggcggcagcgcaaaagatg

SEQ ID NO: 112176 - DNA, 103 bp, Artificial Sequence
  Synthetic Polynucleotide
taatacgactcactatagggacaaaagagattttccttttcgttctccataacagaggagaatggagatggaaaaggaaaacctggcggcagcgcaaaagatg

SEQ ID NO: 112177 - DNA, 103 bp, Artificial Sequence
  Synthetic Polynucleotide
taatacgactcactataggggccaaagtcaggctggatctctgccaacacaacagaggagagtgttgatggagatccagaacctggcggcagcgcaaaagatg

SEQ ID NO: 112178 - DNA, 103 bp, Artificial Sequence
  Synthetic Polynucleotide
taatacgactcactatagggttttcggcctctttcctctgtaacatgaacaacagaggagagttcatatgacagaggaaaacctggcggcagcgcaaaagatg

SEQ ID NO: 112179 - DNA, 103 bp, Artificial Sequence
  Synthetic Polynucleotide
taatacgactcactatagggtgaaagctggttttcggcctctttcctctgaacagaggagacagaggatggaggccgaaaacctggcggcagcgcaaaagatg

SEQ ID NO: 112180 - DNA, 103 bp, Artificial Sequence
  Synthetic Polynucleotide
taatacgactcactatagggccggtccatttgaaagctggttttcggcctaacagaggagaaggccgatgaccagctttaacctggcggcagcgcaaaagatg

SEQ ID NO: 112181 - DNA, 103 bp, Artificial Sequence
  Synthetic Polynucleotide
taatacgactcactataggggatttctgggccggtccatttgaaagctggaacagaggagaccagctatgaaatggaccaacctggcggcagcgcaaaagatg

SEQ ID NO: 112182 - DNA, 103 bp, Artificial Sequence
  Synthetic Polynucleotide
taatacgactcactatagggtatttggactgatttctgggccggtccattaacagaggagaaatggaatggcccagaaaaacctggcggcagcgcaaaagatg

SEQ ID NO: 112183 - DNA, 103 bp, Artificial Sequence
  Synthetic Polynucleotide
taatacgactcactataggggagccactggtatttggactgatttctgggaacagaggagacccagaatgcagtccaaaaacctggcggcagcgcaaaagatg

SEQ ID NO: 112184 - DNA, 103 bp, Artificial Sequence
  Synthetic Polynucleotide
taatacgactcactataggggactgggctggagccactggtatttggactaacagaggagaagtccaatgaccagtggcaacctggcggcagcgcaaaagatg

SEQ ID NO: 112185 - DNA, 103 bp, Artificial Sequence
  Synthetic Polynucleotide
taatacgactcactatagggtaaaatgaatgactgggctggagccactggaacagaggagaccagtgatgccagcccagaacctggcggcagcgcaaaagatg

SEQ ID NO: 112186 - DNA, 103 bp, Artificial Sequence
  Synthetic Polynucleotide
taatacgactcactatagggtcagagggagtaaaatgaatgactgggctgaacagaggagacagcccatgcattcatttaacctggcggcagcgcaaaagatg

SEQ ID NO: 112187 - DNA, 103 bp, Artificial Sequence
  Synthetic Polynucleotide
taatacgactcactatagggcacctccaaatcagagggagtaaaatgaataacagaggagaattcatatgactccctctaacctggcggcagcgcaaaagatg

SEQ ID NO: 112188 - DNA, 103 bp, Artificial Sequence
  Synthetic Polynucleotide
taatacgactcactatagggtggttaaagggccaaagtcaggctggatctaacagaggagaagatccatgctgactttgaacctggcggcagcgcaaaagatg

SEQ ID NO: 112189 - DNA, 103 bp, Artificial Sequence
  Synthetic Polynucleotide
taatacgactcactatagggaagaccgtctcacctccaaatcagagggagaacagaggagactccctatgatttggaggaacctggcggcagcgcaaaagatg

SEQ ID NO: 112190 - DNA, 103 bp, Artificial Sequence
  Synthetic Polynucleotide
taatacgactcactatagggttctcttttgaagaccgtctcacctccaaaaacagaggagatttggaatggagacggtcaacctggcggcagcgcaaaagatg

SEQ ID NO: 112191 - DNA, 103 bp, Artificial Sequence
  Synthetic Polynucleotide
taatacgactcactatagggtttggcacagttctcttttgaagaccgtctaacagaggagaagacggatgtcaaaagagaacctggcggcagcgcaaaagatg

SEQ ID NO: 112192 - DNA, 103 bp, Artificial Sequence
  Synthetic Polynucleotide
taatacgactcactatagggaaaagaggtttttggcacagttctcttttgaacagaggagacaaaagatgactgtgccaaacctggcggcagcgcaaaagatg

SEQ ID NO: 112193 - DNA, 103 bp, Artificial Sequence
  Synthetic Polynucleotide
taatacgactcactatagggccacgtgtggaaaagaggtttttggcacagaacagaggagactgtgcatgaaacctcttaacctggcggcagcgcaaaagatg

SEQ ID NO: 112194 - DNA, 103 bp, Artificial Sequence
  Synthetic Polynucleotide
taatacgactcactataggggtttggtttcccacgtgtggaaaagaggttaacagaggagaaacctcatgtccacacgtaacctggcggcagcgcaaaagatg

SEQ ID NO: 112195 - DNA, 103 bp, Artificial Sequence
  Synthetic Polynucleotide
taatacgactcactataggggtcgagtaaagtttggtttcccacgtgtggaacagaggagaccacacatgggaaaccaaaacctggcggcagcgcaaaagatg

SEQ ID NO: 112196 - DNA, 103 bp, Artificial Sequence
  Synthetic Polynucleotide
taatacgactcactatagggagagatgggtgtcgagtaaagtttggtttcaacagaggagagaaaccatgctttactcgaacctggcggcagcgcaaaagatg

SEQ ID NO: 112197 - DNA, 103 bp, Artificial Sequence
  Synthetic Polynucleotide
taatacgactcactatagggcaatttgataagagatgggtgtcgagtaaaaacagaggagatttactatgcacccatctaacctggcggcagcgcaaaagatg

SEQ ID NO: 112198 - DNA, 103 bp, Artificial Sequence
  Synthetic Polynucleotide
taatacgactcactatagggtactctttaccaatttgataagagatgggtaacagaggagaacccatatgttatcaaataacctggcggcagcgcaaaagatg

SEQ ID NO: 112199 - DNA, 103 bp, Artificial Sequence
  Synthetic Polynucleotide
taatacgactcactatagggttggtaggtgtggttaaagggccaaagtcaaacagaggagatgacttatgccctttaacaacctggcggcagcgcaaaagatg

SEQ ID NO: 112200 - DNA, 103 bp, Artificial Sequence
  Synthetic Polynucleotide
taatacgactcactatagggtcactttctatactctttaccaatttgataaacagaggagatatcaaatgggtaaagagaacctggcggcagcgcaaaagatg

SEQ ID NO: 112201 - DNA, 103 bp, Artificial Sequence
  Synthetic Polynucleotide
taatacgactcactatagggctttctccgatcactttctatactctttacaacagaggagagtaaagatgatagaaagtaacctggcggcagcgcaaaagatg

SEQ ID NO: 112202 - DNA, 103 bp, Artificial Sequence
  Synthetic Polynucleotide
taatacgactcactatagggcagaatttatctttctccgatcactttctaaacagaggagatagaaaatgatcggagaaaacctggcggcagcgcaaaagatg

SEQ ID NO: 112203 - DNA, 103 bp, Artificial Sequence
  Synthetic Polynucleotide
taatacgactcactatagggctactgggcgcagaatttatctttctccgaaacagaggagatcggagatggataaattcaacctggcggcagcgcaaaagatg

SEQ ID NO: 112204 - DNA, 103 bp, Artificial Sequence
  Synthetic Polynucleotide
taatacgactcactatagggcttgatagggctactgggcgcagaatttataacagaggagaataaatatggcgcccagtaacctggcggcagcgcaaaagatg

SEQ ID NO: 112205 - DNA, 103 bp, Artificial Sequence
  Synthetic Polynucleotide
taatacgactcactatagggctttgttggtcttgatagggctactgggcgaacagaggagacgcccaatggccctatcaaacctggcggcagcgcaaaagatg

SEQ ID NO: 112206 - DNA, 103 bp, Artificial Sequence
  Synthetic Polynucleotide
taatacgactcactataggggaactctcagctttgttggtcttgatagggaacagaggagaccctatatggaccaacaaaacctggcggcagcgcaaaagatg

SEQ ID NO: 112207 - DNA, 103 bp, Artificial Sequence
  Synthetic Polynucleotide
taatacgactcactatagggagaattctgagaactctcagctttgttggtaacagaggagaaccaacatggctgagagtaacctggcggcagcgcaaaagatg

SEQ ID NO: 112208 - DNA, 103 bp, Artificial Sequence
  Synthetic Polynucleotide
taatacgactcactatagggggaagggtgcagaattctgagaactctcagaacagaggagactgagaatgctcagaattaacctggcggcagcgcaaaagatg

SEQ ID NO: 112209 - DNA, 103 bp, Artificial Sequence
  Synthetic Polynucleotide
taatacgactcactatagggattttacttgggaagggtgcagaattctgaaacagaggagatcagaaatgtgcacccttaacctggcggcagcgcaaaagatg

SEQ ID NO: 112210 - DNA, 103 bp, Artificial Sequence
  Synthetic Polynucleotide
taatacgactcactatagggttccttgggcttggtaggtgtggttaaaggaacagaggagacctttaatgacacctaccaacctggcggcagcgcaaaagatg

SEQ ID NO: 112211 - DNA, 103 bp, Artificial Sequence
  Synthetic Polynucleotide
taatacgactcactataggggagctgagccattttacttgggaagggtgcaacagaggagagcacccatgccaagtaaaaacctggcggcagcgcaaaagatg

SEQ ID NO: 112212 - DNA, 103 bp, Artificial Sequence
  Synthetic Polynucleotide
taatacgactcactatagggaaatagctgcgagctgagccattttacttgaacagaggagacaagtaatgtggctcagcaacctggcggcagcgcaaaagatg

SEQ ID NO: 112213 - DNA, 103 bp, Artificial Sequence
  Synthetic Polynucleotide
taatacgactcactatagggtgcattttacaaatagctgcgagctgagccaacagaggagaggctcaatgcgcagctataacctggcggcagcgcaaaagatg

SEQ ID NO: 112214 - DNA, 103 bp, Artificial Sequence
  Synthetic Polynucleotide
taatacgactcactatagggctcttctaactgcattttacaaatagctgcaacagaggagagcagctatgtgtaaaatgaacctggcggcagcgcaaaagatg

SEQ ID NO: 112215 - DNA, 103 bp, Artificial Sequence
  Synthetic Polynucleotide
taatacgactcactatagggcacttgattgctcttctaactgcattttacaacagaggagagtaaaaatgagttagaagaacctggcggcagcgcaaaagatg

SEQ ID NO: 112216 - DNA, 103 bp, Artificial Sequence
  Synthetic Polynucleotide
taatacgactcactatagggtgtctggattcacttgattgctcttctaacaacagaggagagttagaatggcaatcaagaacctggcggcagcgcaaaagatg

SEQ ID NO: 112217 - DNA, 103 bp, Artificial Sequence
  Synthetic Polynucleotide
taatacgactcactatagggtttcactttctgtctggattcacttgattgaacagaggagacaatcaatggaatccagaaacctggcggcagcgcaaaagatg

SEQ ID NO: 112218 - DNA, 103 bp, Artificial Sequence
  Synthetic Polynucleotide
taatacgactcactatagggccagctgtactttcactttctgtctggattaacagaggagaaatccaatgagaaagtgaaacctggcggcagcgcaaaagatg

SEQ ID NO: 112219 - DNA, 103 bp, Artificial Sequence
  Synthetic Polynucleotide
taatacgactcactatagggccagatcttgccagctgtactttcactttcaacagaggagagaaagtatgagtacagctaacctggcggcagcgcaaaagatg

SEQ ID NO: 112220 - DNA, 103 bp, Artificial Sequence
  Synthetic Polynucleotide
taatacgactcactatagggtttgcagggtccagatcttgccagctgtacaacagaggagagtacagatggcaagatctaacctggcggcagcgcaaaagatg

SEQ ID NO: 112221 - DNA, 103 bp, Artificial Sequence
  Synthetic Polynucleotide
taatacgactcactatagggcctgagagccttccttgggcttggtaggtgaacagaggagacacctaatgagcccaaggaacctggcggcagcgcaaaagatg

SEQ ID NO: 112222 - DNA, 103 bp, Artificial Sequence
  Synthetic Polynucleotide
taatacgactcactataggggggctactggtttgcagggtccagatcttgaacagaggagacaagatatggaccctgcaaacctggcggcagcgcaaaagatg

SEQ ID NO: 112223 - DNA, 103 bp, Artificial Sequence
  Synthetic Polynucleotide
taatacgactcactataggggggtccagaggggctactggtttgcagggtaacagaggagaaccctgatgaccagtagcaacctggcggcagcgcaaaagatg

SEQ ID NO: 112224 - DNA, 103 bp, Artificial Sequence
  Synthetic Polynucleotide
taatacgactcactatagggattcactggggggtccagaggggctactggaacagaggagaccagtaatgcctctggacaacctggcggcagcgcaaaagatg

SEQ ID NO: 112225 - DNA, 103 bp, Artificial Sequence
  Synthetic Polynucleotide
taatacgactcactatagggccatctcagcattcactggggggtccagagaacagaggagactctggatgccccagtgaaacctggcggcagcgcaaaagatg

SEQ ID NO: 112226 - DNA, 103 bp, Artificial Sequence
  Synthetic Polynucleotide
taatacgactcactataggggctgtcagctccatctcagcattcactgggaacagaggagacccagtatgtgctgagataacctggcggcagcgcaaaagatg

SEQ ID NO: 112227 - DNA, 103 bp, Artificial Sequence
  Synthetic Polynucleotide
taatacgactcactataggggagggacggtgctgtcagctccatctcagcaacagaggagagctgagatggagctgacaaacctggcggcagcgcaaaagatg

SEQ ID NO: 112228 - DNA, 103 bp, Artificial Sequence
  Synthetic Polynucleotide
taatacgactcactatagggggggctggatgagggacggtgctgtcagctaacagaggagaagctgaatgcaccgtcccaacctggcggcagcgcaaaagatg

SEQ ID NO: 112229 - DNA, 103 bp, Artificial Sequence
  Synthetic Polynucleotide
taatacgactcactatagggaccattcccaggggctggatgagggacggtaacagaggagaaccgtcatgcatccagccaacctggcggcagcgcaaaagatg

SEQ ID NO: 112230 - DNA, 103 bp, Artificial Sequence
  Synthetic Polynucleotide
taatacgactcactataggggatcaggggaaccattcccaggggctggataacagaggagaatccagatgctgggaatgaacctggcggcagcgcaaaagatg

SEQ ID NO: 112231 - DNA, 103 bp, Artificial Sequence
  Synthetic Polynucleotide
taatacgactcactatagggaggggctggggatcaggggaaccattcccaaacagaggagatgggaaatgttcccctgaaacctggcggcagcgcaaaagatg

SEQ ID NO: 112232 - DNA, 103 bp, Artificial Sequence
  Synthetic Polynucleotide
taatacgactcactatagggcacggctctccctgagagccttccttgggcaacagaggagagcccaaatgaggctctcaaacctggcggcagcgcaaaagatg

SEQ ID NO: 112233 - DNA, 103 bp, Artificial Sequence
  Synthetic Polynucleotide
taatacgactcactataggggctgatgacaaggggctggggatcaggggaaacagaggagatcccctatgccccagcccaacctggcggcagcgcaaaagatg

SEQ ID NO: 112234 - DNA, 103 bp, Artificial Sequence
  Synthetic Polynucleotide
taatacgactcactatagggcaggggcactgctgatgacaaggggctgggaacagaggagacccagcatgttgtcatcaaacctggcggcagcgcaaaagatg

SEQ ID NO: 112235 - DNA, 103 bp, Artificial Sequence
  Synthetic Polynucleotide
taatacgactcactataggggaggtaggatcaggggcactgctgatgacaaacagaggagatgtcatatgcagtgccccaacctggcggcagcgcaaaagatg

SEQ ID NO: 112236 - DNA, 103 bp, Artificial Sequence
  Synthetic Polynucleotide
taatacgactcactataggggaaggggcctgaggtaggatcaggggcactaacagaggagaagtgccatggatcctaccaacctggcggcagcgcaaaagatg

SEQ ID NO: 112237 - DNA, 103 bp, Artificial Sequence
  Synthetic Polynucleotide
taatacgactcactatagggggatgggcctgaaggggcctgaggtaggataacagaggagaatcctaatgcaggcccctaacctggcggcagcgcaaaagatg

SEQ ID NO: 112238 - DNA, 103 bp, Artificial Sequence
  Synthetic Polynucleotide
taatacgactcactatagggagatggcataggatgggcctgaaggggcctaacagaggagaaggcccatgcaggcccataacctggcggcagcgcaaaagatg

SEQ ID NO: 112239 - DNA, 103 bp, Artificial Sequence
  Synthetic Polynucleotide
taatacgactcactatagggggctgcaggtagatggcataggatgggcctaacagaggagaaggcccatgctatgccataacctggcggcagcgcaaaagatg

SEQ ID NO: 112240 - DNA, 103 bp, Artificial Sequence
  Synthetic Polynucleotide
taatacgactcactatagggggcttgagtgggctgcaggtagatggcataaacagaggagatatgccatgtacctgcagaacctggcggcagcgcaaaagatg

SEQ ID NO: 112241 - DNA, 103 bp, Artificial Sequence
  Synthetic Polynucleotide
taatacgactcactatagggcactttggtgggcttgagtgggctgcaggtaacagaggagaacctgcatgccactcaagaacctggcggcagcgcaaaagatg

SEQ ID NO: 112242 - DNA, 103 bp, Artificial Sequence
  Synthetic Polynucleotide
taatacgactcactatagggggtggcgtcacactttggtgggcttgagtgaacagaggagacactcaatgccaccaaagaacctggcggcagcgcaaaagatg

SEQ ID NO: 112243 - DNA, 103 bp, Artificial Sequence
  Synthetic Polynucleotide
taatacgactcactatagggtgtcggtgtccacggctctccctgagagccaacagaggagaggctctatgggagagccgaacctggcggcagcgcaaaagatg

SEQ ID NO: 112244 - DNA, 103 bp, Artificial Sequence
  Synthetic Polynucleotide
taatacgactcactatagggcaggccttggggtggcgtcacactttggtgaacagaggagacaccaaatggtgacgccaaacctggcggcagcgcaaaagatg

SEQ ID NO: 112245 - DNA, 103 bp, Artificial Sequence
  Synthetic Polynucleotide
taatacgactcactatagggccgttgggctcaggccttggggtggcgtcaaacagaggagatgacgcatgcccaaggccaacctggcggcagcgcaaaagatg

SEQ ID NO: 112246 - DNA, 103 bp, Artificial Sequence
  Synthetic Polynucleotide
taatacgactcactataggggtggtgcacaccgttgggctcaggccttggaacagaggagaccaaggatggagcccaacaacctggcggcagcgcaaaagatg

SEQ ID NO: 112247 - DNA, 103 bp, Artificial Sequence
  Synthetic Polynucleotide
taatacgactcactatagggagaagagtgggtggtgcacaccgttgggctaacagaggagaagcccaatggtgtgcaccaacctggcggcagcgcaaaagatg

SEQ ID NO: 112248 - DNA, 103 bp, Artificial Sequence
  Synthetic Polynucleotide
taatacgactcactatagggcagtagctttagaagagtgggtggtgcacaaacagaggagatgtgcaatgcccactcttaacctggcggcagcgcaaaagatg

SEQ ID NO: 112249 - DNA, 103 bp, Artificial Sequence
  Synthetic Polynucleotide
taatacgactcactatagggtcttttgagccagtagctttagaagagtggaacagaggagaccactcatgtaaagctacaacctggcggcagcgcaaaagatg

SEQ ID NO: 112250 - DNA, 103 bp, Artificial Sequence
  Synthetic Polynucleotide
taatacgactcactatagggatctgtggagtcttttgagccagtagctttaacagaggagaaaagctatgggctcaaaaaacctggcggcagcgcaaaagatg

SEQ ID NO: 112251 - DNA, 103 bp, Artificial Sequence
  Synthetic Polynucleotide
taatacgactcactatagggcagtggtggcatctgtggagtcttttgagcaacagaggagagctcaaatgactccacagaacctggcggcagcgcaaaagatg

SEQ ID NO: 112252 - DNA, 103 bp, Artificial Sequence
  Synthetic Polynucleotide
taatacgactcactataggggctgccttctcagtggtggcatctgtggagaacagaggagactccacatgtgccaccacaacctggcggcagcgcaaaagatg

SEQ ID NO: 112253 - DNA, 103 bp, Artificial Sequence
  Synthetic Polynucleotide
taatacgactcactatagggggtatcattggctgccttctcagtggtggcaacagaggagagccaccatggagaaggcaaacctggcggcagcgcaaaagatg

SEQ ID NO: 112254 - DNA, 103 bp, Artificial Sequence
  Synthetic Polynucleotide
taatacgactcactatagggtcaggttggctgtcggtgtccacggctctcaacagaggagagagagcatgggacaccgaaacctggcggcagcgcaaaagatg

SEQ ID NO: 112255 - DNA, 103 bp, Artificial Sequence
  Synthetic Polynucleotide
taatacgactcactatagggtggcctttgaggtatcattggctgccttctaacagaggagaagaaggatgccaatgataaacctggcggcagcgcaaaagatg

SEQ ID NO: 112256 - DNA, 103 bp, Artificial Sequence
  Synthetic Polynucleotide
taatacgactcactataggggtagaggcactggcctttgaggtatcattgaacagaggagacaatgaatgctcaaaggcaacctggcggcagcgcaaaagatg

SEQ ID NO: 112257 - DNA, 103 bp, Artificial Sequence
  Synthetic Polynucleotide
taatacgactcactatagggtccaggcctggtagaggcactggcctttgaaacagaggagatcaaagatgagtgcctctaacctggcggcagcgcaaaagatg

SEQ ID NO: 112258 - DNA, 103 bp, Artificial Sequence
  Synthetic Polynucleotide
taatacgactcactataggggcagcaagcttccaggcctggtagaggcacaacagaggagagtgcctatgccaggcctgaacctggcggcagcgcaaaagatg

SEQ ID NO: 112259 - DNA, 103 bp, Artificial Sequence
  Synthetic Polynucleotide
taatacgactcactatagggtctggtgctggcagcaagcttccaggcctgaacagaggagacaggccatgaagcttgctaacctggcggcagcgcaaaagatg

SEQ ID NO: 112260 - DNA, 103 bp, Artificial Sequence
  Synthetic Polynucleotide
taatacgactcactatagggcccttgcctctctggtgctggcagcaagctaacagaggagaagcttgatgccagcaccaaacctggcggcagcgcaaaagatg

SEQ ID NO: 112261 - DNA, 103 bp, Artificial Sequence
  Synthetic Polynucleotide
taatacgactcactatagggggctctttgccccttgcctctctggtgctgaacagaggagacagcacatgagaggcaagaacctggcggcagcgcaaaagatg

SEQ ID NO: 112262 - DNA, 103 bp, Artificial Sequence
  Synthetic Polynucleotide
taatacgactcactatagggtccctggttcggctctttgccccttgcctcaacagaggagagaggcaatgggcaaagagaacctggcggcagcgcaaaagatg

SEQ ID NO: 112263 - DNA, 103 bp, Artificial Sequence
  Synthetic Polynucleotide
taatacgactcactatagggtccagctggctccctggttcggctctttgcaacagaggagagcaaagatgcgaaccaggaacctggcggcagcgcaaaagatg

SEQ ID NO: 112264 - DNA, 103 bp, Artificial Sequence
  Synthetic Polynucleotide
taatacgactcactatagggagcctctttctccagctggctccctggttcaacagaggagagaaccaatgagccagctgaacctggcggcagcgcaaaagatg

SEQ ID NO: 112265 - DNA, 103 bp, Artificial Sequence
  Synthetic Polynucleotide
taatacgactcactatagggatgagcattttcaggttggctgtcggtgtcaacagaggagagacaccatgagccaacctaacctggcggcagcgcaaaagatg

SEQ ID NO: 112266 - DNA, 103 bp, Artificial Sequence
  Synthetic Polynucleotide
taatacgactcactataggggccctctttgagcctctttctccagctggcaacagaggagagccagcatgagaaagaggaacctggcggcagcgcaaaagatg

SEQ ID NO: 112267 - DNA, 103 bp, Artificial Sequence
  Synthetic Polynucleotide
taatacgactcactataggggagcatgcttgccctctttgagcctctttcaacagaggagagaaagaatgtcaaagaggaacctggcggcagcgcaaaagatg

SEQ ID NO: 112268 - DNA, 103 bp, Artificial Sequence
  Synthetic Polynucleotide
taatacgactcactatagggcactgtcctcgagcatgcttgccctctttgaacagaggagacaaagaatgcaagcatgcaacctggcggcagcgcaaaagatg

SEQ ID NO: 112269 - DNA, 103 bp, Artificial Sequence
  Synthetic Polynucleotide
taatacgactcactatagggtttttggaaccactgtcctcgagcatgcttaacagaggagaaagcatatgcgaggacagaacctggcggcagcgcaaaagatg

SEQ ID NO: 112270 - DNA, 103 bp, Artificial Sequence
  Synthetic Polynucleotide
taatacgactcactatagggtttaaatttctttttggaaccactgtcctcaacagaggagagaggacatgggttccaaaaacctggcggcagcgcaaaagatg

SEQ ID NO: 112271 - DNA, 103 bp, Artificial Sequence
  Synthetic Polynucleotide
taatacgactcactatagggttaggtcctctttaaatttctttttggaacaacagaggagagttccaatgagaaatttaaacctggcggcagcgcaaaagatg

SEQ ID NO: 112272 - DNA, 103 bp, Artificial Sequence
  Synthetic Polynucleotide
taatacgactcactatagggtcaagtccttttaggtcctctttaaatttcaacagaggagagaaattatgagaggacctaacctggcggcagcgcaaaagatg

SEQ ID NO: 112273 - DNA, 103 bp, Artificial Sequence
  Synthetic Polynucleotide
taatacgactcactatagggggagacattttcaagtccttttaggtcctcaacagaggagagaggacatgaaaggacttaacctggcggcagcgcaaaagatg

SEQ ID NO: 112274 - DNA, 103 bp, Artificial Sequence
  Synthetic Polynucleotide
taatacgactcactatagggacaaggttgcggagacattttcaagtccttaacagaggagaaaggacatgaaaatgtctaacctggcggcagcgcaaaagatg

SEQ ID NO: 112275 - DNA, 103 bp, Artificial Sequence
  Synthetic Polynucleotide
taatacgactcactatagggcctgatgggaacaaggttgcggagacatttaacagaggagaaaatgtatgcgcaaccttaacctggcggcagcgcaaaagatg

SEQ ID NO: 112276 - DNA, 103 bp, Artificial Sequence
  Synthetic Polynucleotide
taatacgactcactatagggcacagcactgatgagcattttcaggttggcaacagaggagagccaacatgaaaatgctcaacctggcggcagcgcaaaagatg

SEQ ID NO: 112277 - DNA, 103 bp, Artificial Sequence
  Synthetic Polynucleotide
taatacgactcactataggggattaggtatcctgatgggaacaaggttgcaacagaggagagcaaccatgttcccatcaaacctggcggcagcgcaaaagatg

SEQ ID NO: 112278 - DNA, 103 bp, Artificial Sequence
  Synthetic Polynucleotide
taatacgactcactataggggcgtgagagggattaggtatcctgatgggaaacagaggagatcccatatggatacctaaaacctggcggcagcgcaaaagatg

SEQ ID NO: 112279 - DNA, 103 bp, Artificial Sequence
  Synthetic Polynucleotide
taatacgactcactataggggatgagcactgcgtgagagggattaggtataacagaggagaatacctatgccctctcacaacctggcggcagcgcaaaagatg

SEQ ID NO: 112280 - DNA, 103 bp, Artificial Sequence
  Synthetic Polynucleotide
taatacgactcactatagggtgcccccagggatgagcactgcgtgagaggaacagaggagacctctcatgcagtgctcaaacctggcggcagcgcaaaagatg

SEQ ID NO: 112281 - DNA, 103 bp, Artificial Sequence
  Synthetic Polynucleotide
taatacgactcactatagggaaatggactctgcccccagggatgagcactaacagaggagaagtgctatgccctgggggaacctggcggcagcgcaaaagatg

SEQ ID NO: 112282 - DNA, 103 bp, Artificial Sequence
  Synthetic Polynucleotide
taatacgactcactatagggttaccagacaaaatggactctgcccccaggaacagaggagacctgggatgagagtccataacctggcggcagcgcaaaagatg

SEQ ID NO: 112283 - DNA, 103 bp, Artificial Sequence
  Synthetic Polynucleotide
taatacgactcactatagggtgagttttctttaccagacaaaatggactcaacagaggagagagtccatgttgtctggtaacctggcggcagcgcaaaagatg

SEQ ID NO: 112284 - DNA, 103 bp, Artificial Sequence
  Synthetic Polynucleotide
taatacgactcactatagggaaagagcacttgagttttctttaccagacaaacagaggagatgtctgatgaagaaaactaacctggcggcagcgcaaaagatg

SEQ ID NO: 112285 - DNA, 103 bp, Artificial Sequence
  Synthetic Polynucleotide
taatacgactcactatagggtggtttggggaaagagcacttgagttttctaacagaggagaagaaaaatgaagtgctctaacctggcggcagcgcaaaagatg

SEQ ID NO: 112286 - DNA, 103 bp, Artificial Sequence
  Synthetic Polynucleotide
taatacgactcactataggggtaaatcctgtggtttggggaaagagcactaacagaggagaagtgctatgtccccaaacaacctggcggcagcgcaaaagatg

SEQ ID NO: 112287 - DNA, 103 bp, Artificial Sequence
  Synthetic Polynucleotide
taatacgactcactatagggtatgtggctcacaaaagagattttccttttaacagaggagaaaaaggatgatctcttttaacctggcggcagcgcaaaagatg

SEQ ID NO: 112288 - DNA, 103 bp, Artificial Sequence
  Synthetic Polynucleotide
taatacgactcactatagggtctcagggctcacagcactgatgagcatttaacagaggagaaaatgcatgtcagtgctgaacctggcggcagcgcaaaagatg

SEQ ID NO: 112289 - DNA, 103 bp, Artificial Sequence
  Synthetic Polynucleotide
taatacgactcactatagggttggggagctgtaaatcctgtggtttggggaacagaggagaccccaaatgacaggatttaacctggcggcagcgcaaaagatg

SEQ ID NO: 112290 - DNA, 103 bp, Artificial Sequence
  Synthetic Polynucleotide
taatacgactcactatagggacacctgcaattggggagctgtaaatcctgaacagaggagacaggatatgcagctccccaacctggcggcagcgcaaaagatg

SEQ ID NO: 112291 - DNA, 103 bp, Artificial Sequence
  Synthetic Polynucleotide
taatacgactcactatagggcactggaataacacctgcaattggggagctaacagaggagaagctccatgattgcaggtaacctggcggcagcgcaaaagatg

SEQ ID NO: 112292 - DNA, 103 bp, Artificial Sequence
  Synthetic Polynucleotide
taatacgactcactatagggcagatgatgtcactggaataacacctgcaaaacagaggagattgcagatgttattccagaacctggcggcagcgcaaaagatg

SEQ ID NO: 112293 - DNA, 103 bp, Artificial Sequence
  Synthetic Polynucleotide
taatacgactcactataggggcagtgagttcagatgatgtcactggaataaacagaggagatattccatggacatcatcaacctggcggcagcgcaaaagatg

SEQ ID NO: 112294 - DNA, 103 bp, Artificial Sequence
  Synthetic Polynucleotide
taatacgactcactatagggaaaattaacagcagtgagttcagatgatgtaacagaggagaacatcaatggaactcactaacctggcggcagcgcaaaagatg

SEQ ID NO: 112295 - DNA, 103 bp, Artificial Sequence
  Synthetic Polynucleotide
taatacgactcactataggggaaaagagggaaaattaacagcagtgagttaacagaggagaaactcaatgctgttaattaacctggcggcagcgcaaaagatg

SEQ ID NO: 112296 - DNA, 103 bp, Artificial Sequence
  Synthetic Polynucleotide
taatacgactcactatagggggtgttacatgaaaagagggaaaattaacaaacagaggagatgttaaatgtccctctttaacctggcggcagcgcaaaagatg

SEQ ID NO: 112297 - DNA, 103 bp, Artificial Sequence
  Synthetic Polynucleotide
taatacgactcactatagggtagcttcaacggtgttacatgaaaagagggaacagaggagaccctctatgcatgtaacaaacctggcggcagcgcaaaagatg

SEQ ID NO: 112298 - DNA, 103 bp, Artificial Sequence
  Synthetic Polynucleotide
taatacgactcactataggggtgagaccattagcttcaacggtgttacataacagaggagaatgtaaatgcgttgaagcaacctggcggcagcgcaaaagatg

SEQ ID NO: 112299 - DNA, 103 bp, Artificial Sequence
  Synthetic Polynucleotide
taatacgactcactatagggctgttgcggatctcagggctcacagcactgaacagaggagacagtgcatggagccctgaaacctggcggcagcgcaaaagatg

SEQ ID NO: 112300 - DNA, 103 bp, Artificial Sequence
  Synthetic Polynucleotide
taatacgactcactatagggacggaagttggtgagaccattagcttcaacaacagaggagagttgaaatgaatggtctcaacctggcggcagcgcaaaagatg

SEQ ID NO: 112301 - DNA, 103 bp, Artificial Sequence
  Synthetic Polynucleotide
taatacgactcactatagggtacggctgccacggaagttggtgagaccataacagaggagaatggtcatgccaacttccaacctggcggcagcgcaaaagatg

SEQ ID NO: 112302 - DNA, 103 bp, Artificial Sequence
  Synthetic Polynucleotide
taatacgactcactatagggtcccgacaggtacggctgccacggaagttgaacagaggagacaacttatgtggcagccgaacctggcggcagcgcaaaagatg

SEQ ID NO: 112303 - DNA, 103 bp, Artificial Sequence
  Synthetic Polynucleotide
taatacgactcactataggggccgggctgttcccgacaggtacggctgccaacagaggagaggcagcatgacctgtcggaacctggcggcagcgcaaaagatg

SEQ ID NO: 112304 - DNA, 103 bp, Artificial Sequence
  Synthetic Polynucleotide
taatacgactcactatagggtgaagcgagagccgggctgttcccgacaggaacagaggagacctgtcatgaacagcccgaacctggcggcagcgcaaaagatg

SEQ ID NO: 112305 - DNA, 103 bp, Artificial Sequence
  Synthetic Polynucleotide
taatacgactcactatagggcagggtggcttgaagcgagagccgggctgtaacagaggagaacagccatgctctcgcttaacctggcggcagcgcaaaagatg

SEQ ID NO: 112306 - DNA, 103 bp, Artificial Sequence
  Synthetic Polynucleotide
taatacgactcactatagggtggatgggaacagggtggcttgaagcgagaaacagaggagatctcgcatgaagccacccaacctggcggcagcgcaaaagatg

SEQ ID NO: 112307 - DNA, 103 bp, Artificial Sequence
  Synthetic Polynucleotide
taatacgactcactataggggcttgggttctggatgggaacagggtggctaacagaggagaagccacatggttcccatcaacctggcggcagcgcaaaagatg

SEQ ID NO: 112308 - DNA, 103 bp, Artificial Sequence
  Synthetic Polynucleotide
taatacgactcactatagggcaatggctgagcttgggttctggatgggaaaacagaggagattcccaatgagaacccaaaacctggcggcagcgcaaaagatg

SEQ ID NO: 112309 - DNA, 103 bp, Artificial Sequence
  Synthetic Polynucleotide
taatacgactcactataggggtgaagtttacaatggctgagcttgggttcaacagaggagagaacccatgctcagccataacctggcggcagcgcaaaagatg

SEQ ID NO: 112310 - DNA, 103 bp, Artificial Sequence
  Synthetic Polynucleotide
taatacgactcactatagggtttctgatctctgttgcggatctcagggctaacagaggagaagccctatgatccgcaacaacctggcggcagcgcaaaagatg

SEQ ID NO: 112311 - DNA, 103 bp, Artificial Sequence
  Synthetic Polynucleotide
taatacgactcactataggggtgctgcagggtgaagtttacaatggctgaaacagaggagatcagccatggtaaacttcaacctggcggcagcgcaaaagatg

SEQ ID NO: 112312 - DNA, 103 bp, Artificial Sequence
  Synthetic Polynucleotide
taatacgactcactatagggtgagtcccaggtgctgcagggtgaagtttaaacagaggagataaactatgccctgcagcaacctggcggcagcgcaaaagatg

SEQ ID NO: 112313 - DNA, 103 bp, Artificial Sequence
  Synthetic Polynucleotide
taatacgactcactatagggttgggtgagatgagtcccaggtgctgcaggaacagaggagacctgcaatgcctgggactaacctggcggcagcgcaaaagatg

SEQ ID NO: 112314 - DNA, 103 bp, Artificial Sequence
  Synthetic Polynucleotide
taatacgactcactatagggcaactgcacattgggtgagatgagtcccagaacagaggagactgggaatgatctcacccaacctggcggcagcgcaaaagatg

SEQ ID NO: 112315 - DNA, 103 bp, Artificial Sequence
  Synthetic Polynucleotide
taatacgactcactatagggggctggcagacaactgcacattgggtgagaaacagaggagatctcacatgatgtgcagtaacctggcggcagcgcaaaagatg

SEQ ID NO: 112316 - DNA, 103 bp, Artificial Sequence
  Synthetic Polynucleotide
taatacgactcactatagggccagacccagggctggcagacaactgcacaaacagaggagatgtgcaatggtctgccagaacctggcggcagcgcaaaagatg

SEQ ID NO: 112317 - DNA, 103 bp, Artificial Sequence
  Synthetic Polynucleotide
taatacgactcactatagggaggaacgattccagacccagggctggcagaaacagaggagatctgccatgcctgggtctaacctggcggcagcgcaaaagatg

SEQ ID NO: 112318 - DNA, 103 bp, Artificial Sequence
  Synthetic Polynucleotide
taatacgactcactatagggttggagacacaggaacgattccagacccagaacagaggagactgggtatggaatcgttcaacctggcggcagcgcaaaagatg

SEQ ID NO: 112319 - DNA, 103 bp, Artificial Sequence
  Synthetic Polynucleotide
taatacgactcactataggggactctattcttggagacacaggaacgattaacagaggagaaatcgtatgtgtgtctccaacctggcggcagcgcaaaagatg

SEQ ID NO: 112320 - DNA, 103 bp, Artificial Sequence
  Synthetic Polynucleotide
taatacgactcactataggggacattaacagactctattcttggagacacaacagaggagagtgtctatgagaatagagaacctggcggcagcgcaaaagatg

SEQ ID NO: 112321 - DNA, 103 bp, Artificial Sequence
  Synthetic Polynucleotide
taatacgactcactatagggacaaaccccttttctgatctctgttgcggaaacagaggagatccgcaatggagatcagaaacctggcggcagcgcaaaagatg

SEQ ID NO: 112322 - DNA, 103 bp, Artificial Sequence
  Synthetic Polynucleotide
taatacgactcactatagggtttctggtgcgacattaacagactctattcaacagaggagagaatagatgctgttaatgaacctggcggcagcgcaaaagatg

SEQ ID NO: 112323 - DNA, 103 bp, Artificial Sequence
  Synthetic Polynucleotide
taatacgactcactataggggtgcctgcattttctggtgcgacattaacaaacagaggagatgttaaatgcgcaccagaaacctggcggcagcgcaaaagatg

SEQ ID NO: 112324 - DNA, 103 bp, Artificial Sequence
  Synthetic Polynucleotide
taatacgactcactatagggtccttgctgagtgcctgcattttctggtgcaacagaggagagcaccaatgaatgcaggcaacctggcggcagcgcaaaagatg

SEQ ID NO: 112325 - DNA, 103 bp, Artificial Sequence
  Synthetic Polynucleotide
taatacgactcactatagggtggtggcccttccttgctgagtgcctgcataacagaggagaatgcagatgctcagcaagaacctggcggcagcgcaaaagatg

SEQ ID NO: 112326 - DNA, 103 bp, Artificial Sequence
  Synthetic Polynucleotide
taatacgactcactataggggagtcatagttggtggcccttccttgctgaaacagaggagatcagcaatgaagggccacaacctggcggcagcgcaaaagatg

SEQ ID NO: 112327 - DNA, 103 bp, Artificial Sequence
  Synthetic Polynucleotide
taatacgactcactatagggtgggactggtgagtcatagttggtggccctaacagaggagaagggccatgaactatgacaacctggcggcagcgcaaaagatg

SEQ ID NO: 112328 - DNA, 103 bp, Artificial Sequence
  Synthetic Polynucleotide
taatacgactcactatagggggctctggcctgggactggtgagtcatagtaacagaggagaactatgatgcaccagtccaacctggcggcagcgcaaaagatg

SEQ ID NO: 112329 - DNA, 103 bp, Artificial Sequence
  Synthetic Polynucleotide
taatacgactcactatagggccatttggctggctctggcctgggactggtaacagaggagaaccagtatgaggccagagaacctggcggcagcgcaaaagatg

SEQ ID NO: 112330 - DNA, 103 bp, Artificial Sequence
  Synthetic Polynucleotide
taatacgactcactatagggaactgattgtccatttggctggctctggccaacagaggagaggccagatgcagccaaataacctggcggcagcgcaaaagatg

SEQ ID NO: 112331 - DNA, 103 bp, Artificial Sequence
  Synthetic Polynucleotide
taatacgactcactatagggctgtcacagcaactgattgtccatttggctaacagaggagaagccaaatggacaatcagaacctggcggcagcgcaaaagatg

SEQ ID NO: 112332 - DNA, 103 bp, Artificial Sequence
  Synthetic Polynucleotide
taatacgactcactatagggctgttgtcaaacaaaccccttttctgatctaacagaggagaagatcaatgaaggggtttaacctggcggcagcgcaaaagatg

SEQ ID NO: 112333 - DNA, 103 bp, Artificial Sequence
  Synthetic Polynucleotide
taatacgactcactatagggtgttgtgcccctgtcacagcaactgattgtaacagaggagaacaatcatgtgctgtgacaacctggcggcagcgcaaaagatg

SEQ ID NO: 112334 - DNA, 103 bp, Artificial Sequence
  Synthetic Polynucleotide
taatacgactcactatagggaggaacaggctgttgtgcccctgtcacagcaacagaggagagctgtgatgggggcacaaaacctggcggcagcgcaaaagatg

SEQ ID NO: 112335 - DNA, 103 bp, Artificial Sequence
  Synthetic Polynucleotide
taatacgactcactatagggtgggtgtcacaggaacaggctgttgtgcccaacagaggagagggcacatgagcctgttcaacctggcggcagcgcaaaagatg

SEQ ID NO: 112336 - DNA, 103 bp, Artificial Sequence
  Synthetic Polynucleotide
taatacgactcactatagggtgtgaccctttgggtgtcacaggaacaggcaacagaggagagcctgtatgtgtgacaccaacctggcggcagcgcaaaagatg

SEQ ID NO: 112337 - DNA, 103 bp, Artificial Sequence
  Synthetic Polynucleotide
taatacgactcactatagggggccactaattgtgaccctttgggtgtcacaacagaggagagtgacaatgaaagggtcaaacctggcggcagcgcaaaagatg

SEQ ID NO: 112338 - DNA, 103 bp, Artificial Sequence
  Synthetic Polynucleotide
taatacgactcactatagggagaaactttcggccactaattgtgacccttaacagaggagaaagggtatgaattagtggaacctggcggcagcgcaaaagatg

SEQ ID NO: 112339 - DNA, 103 bp, Artificial Sequence
  Synthetic Polynucleotide
taatacgactcactatagggggggtacggaagaaactttcggccactaataacagaggagaattagtatgcgaaagtttaacctggcggcagcgcaaaagatg

SEQ ID NO: 112340 - DNA, 103 bp, Artificial Sequence
  Synthetic Polynucleotide
taatacgactcactataggggggtccacctggggtacggaagaaactttcaacagaggagagaaagtatgttccgtaccaacctggcggcagcgcaaaagatg

SEQ ID NO: 112341 - DNA, 103 bp, Artificial Sequence
  Synthetic Polynucleotide
taatacgactcactatagggttggcttggtgggtccacctggggtacggaaacagaggagatccgtaatgcaggtggacaacctggcggcagcgcaaaagatg

SEQ ID NO: 112342 - DNA, 103 bp, Artificial Sequence
  Synthetic Polynucleotide
taatacgactcactataggggatgagctggttggcttggtgggtccacctaacagaggagaaggtggatgcaccaagccaacctggcggcagcgcaaaagatg

SEQ ID NO: 112343 - DNA, 103 bp, Artificial Sequence
  Synthetic Polynucleotide
taatacgactcactatagggtaatccacttctgttgtcaaacaaacccctaacagaggagaaggggtatgtttgacaacaacctggcggcagcgcaaaagatg

SEQ ID NO: 112344 - DNA, 103 bp, Artificial Sequence
  Synthetic Polynucleotide
taatacgactcactatagggatccatgcaggatgagctggttggcttggtaacagaggagaaccaagatgaccagctcaaacctggcggcagcgcaaaagatg

SEQ ID NO: 112345 - DNA, 103 bp, Artificial Sequence
  Synthetic Polynucleotide
taatacgactcactatagggcaccctcaaaatccatgcaggatgagctggaacagaggagaccagctatgcctgcatggaacctggcggcagcgcaaaagatg

SEQ ID NO: 112346 - DNA, 103 bp, Artificial Sequence
  Synthetic Polynucleotide
taatacgactcactataggggttttattagcaccctcaaaatccatgcagaacagaggagactgcatatgttttgagggaacctggcggcagcgcaaaagatg

SEQ ID NO: 112347 - DNA, 103 bp, Artificial Sequence
  Synthetic Polynucleotide
taatacgactcactatagggtcctaaggaggttttattagcaccctcaaaaacagaggagatttgagatggctaataaaaacctggcggcagcgcaaaagatg

SEQ ID NO: 112348 - DNA, 103 bp, Artificial Sequence
  Synthetic Polynucleotide
taatacgactcactatagggcaaagagagttcctaaggaggttttattagaacagaggagactaataatgcctccttagaacctggcggcagcgcaaaagatg

SEQ ID NO: 112349 - DNA, 103 bp, Artificial Sequence
  Synthetic Polynucleotide
taatacgactcactatagggcgctgtgggacaaagagagttcctaaggagaacagaggagactccttatgaactctcttaacctggcggcagcgcaaaagatg

SEQ ID NO: 112350 - DNA, 103 bp, Artificial Sequence
  Synthetic Polynucleotide
taatacgactcactatagggttccagttttcgctgtgggacaaagagagtaacagaggagaactctcatggtcccacagaacctggcggcagcgcaaaagatg

SEQ ID NO: 112351 - DNA, 103 bp, Artificial Sequence
  Synthetic Polynucleotide
taatacgactcactatagggctgttgagacttccagttttcgctgtgggaaacagaggagatcccacatggaaaactggaacctggcggcagcgcaaaagatg

SEQ ID NO: 112352 - DNA, 103 bp, Artificial Sequence
  Synthetic Polynucleotide
taatacgactcactatagggtggacatcctctgttgagacttccagttttaacagaggagaaaaactatgagtctcaacaacctggcggcagcgcaaaagatg

SEQ ID NO: 112353 - DNA, 103 bp, Artificial Sequence
  Synthetic Polynucleotide
taatacgactcactatagggtggcctcaggtaatccacttctgttgtcaaaacagaggagattgacaatggaagtggataacctggcggcagcgcaaaagatg

SEQ ID NO: 112354 - DNA, 103 bp, Artificial Sequence
  Synthetic Polynucleotide
taatacgactcactatagggatacagtctttggcctcaggtaatccacttaacagaggagaaagtggatgacctgaggcaacctggcggcagcgcaaaagatg

SEQ ID NO: 112355 - DNA, 103 bp, Artificial Sequence
  Synthetic Polynucleotide
taatacgactcactataggggtgttcgtgtatacagtctttggcctcaggaacagaggagacctgagatgaaagactgtaacctggcggcagcgcaaaagatg

SEQ ID NO: 112356 - DNA, 103 bp, Artificial Sequence
  Synthetic Polynucleotide
taatacgactcactatagggctccagataagtgttcgtgtatacagtcttaacagaggagaaagactatgtacacgaacaacctggcggcagcgcaaaagatg

SEQ ID NO: 112357 - DNA, 103 bp, Artificial Sequence
  Synthetic Polynucleotide
taatacgactcactatagggagtccccttttatgtggctcacaaaagagaaacagaggagatctcttatgtgagccacaaacctggcggcagcgcaaaagatg

SEQ ID NO: 112358 - DNA, 103 bp, Artificial Sequence
  Synthetic Polynucleotide
taatacgactcactatagggtcaaattcatctccagataagtgttcgtgtaacagaggagaacacgaatgcttatctggaacctggcggcagcgcaaaagatg

SEQ ID NO: 112359 - DNA, 103 bp, Artificial Sequence
  Synthetic Polynucleotide
taatacgactcactatagggttgggatttctcaaattcatctccagataaaacagaggagattatctatggatgaatttaacctggcggcagcgcaaaagatg

SEQ ID NO: 112360 - DNA, 103 bp, Artificial Sequence
  Synthetic Polynucleotide
taatacgactcactatagggttcgacttggttgggatttctcaaattcataacagaggagaatgaatatgagaaatcccaacctggcggcagcgcaaaagatg

SEQ ID NO: 112361 - DNA, 103 bp, Artificial Sequence
  Synthetic Polynucleotide
taatacgactcactatagggcttttctcttttcgacttggttgggatttcaacagaggagagaaatcatgaccaagtcgaacctggcggcagcgcaaaagatg

SEQ ID NO: 112362 - DNA, 103 bp, Artificial Sequence
  Synthetic Polynucleotide
taatacgactcactatagggtaatcctaaacttttctcttttcgacttggaacagaggagaccaagtatgaaagagaaaaacctggcggcagcgcaaaagatg

SEQ ID NO: 112363 - DNA, 103 bp, Artificial Sequence
  Synthetic Polynucleotide
taatacgactcactatagggtatgacacaataatcctaaacttttctcttaacagaggagaaagagaatggtttaggataacctggcggcagcgcaaaagatg

SEQ ID NO: 112364 - DNA, 103 bp, Artificial Sequence
  Synthetic Polynucleotide
taatacgactcactataggggctaagaacttatgacacaataatcctaaaaacagaggagatttaggatgattgtgtcaaacctggcggcagcgcaaaagatg

SEQ ID NO: 112365 - DNA, 103 bp, Artificial Sequence
  Synthetic Polynucleotide
taatacgactcactatagggaggatatcgtgctaagaacttatgacacaaaacagaggagattgtgtatgaagttcttaaacctggcggcagcgcaaaagatg

SEQ ID NO: 112366 - DNA, 103 bp, Artificial Sequence
  Synthetic Polynucleotide
taatacgactcactatagggtgggataattaggatatcgtgctaagaactaacagaggagaagttctatgcacgatatcaacctggcggcagcgcaaaagatg

SEQ ID NO: 112367 - DNA, 103 bp, Artificial Sequence
  Synthetic Polynucleotide
taatacgactcactatagggacagcagggttgggataattaggatatcgtaacagaggagaacgataatgtaattatccaacctggcggcagcgcaaaagatg

SEQ ID NO: 112368 - DNA, 103 bp, Artificial Sequence
  Synthetic Polynucleotide
taatacgactcactatagggtgttttcattagtccccttttatgtggctcaacagaggagagagccaatgaaaaggggaaacctggcggcagcgcaaaagatg

SEQ ID NO: 112369 - DNA, 103 bp, Artificial Sequence
  Synthetic Polynucleotide
taatacgactcactataggggtcattattcacagcagggttgggataattaacagaggagaaattatatgaaccctgctaacctggcggcagcgcaaaagatg

SEQ ID NO: 112370 - DNA, 103 bp, Artificial Sequence
  Synthetic Polynucleotide
taatacgactcactatagggcaaggcagatgtcattattcacagcagggtaacagaggagaaccctgatgtgaataatgaacctggcggcagcgcaaaagatg

SEQ ID NO: 112371 - DNA, 103 bp, Artificial Sequence
  Synthetic Polynucleotide
taatacgactcactataggggccacttcgtcaaggcagatgtcattattcaacagaggagagaataaatgcatctgcctaacctggcggcagcgcaaaagatg

SEQ ID NO: 112372 - DNA, 103 bp, Artificial Sequence
  Synthetic Polynucleotide
taatacgactcactatagggaagttcctctgccacttcgtcaaggcagataacagaggagaatctgcatggacgaagtgaacctggcggcagcgcaaaagatg

SEQ ID NO: 112373 - DNA, 103 bp, Artificial Sequence
  Synthetic Polynucleotide
taatacgactcactataggggttcaacattaagttcctctgccacttcgtaacagaggagaacgaagatgcagaggaacaacctggcggcagcgcaaaagatg

SEQ ID NO: 112374 - DNA, 103 bp, Artificial Sequence
  Synthetic Polynucleotide
taatacgactcactatagggatgcgtcgacgttcaacattaagttcctctaacagaggagaagaggaatgtaatgttgaaacctggcggcagcgcaaaagatg

SEQ ID NO: 112375 - DNA, 103 bp, Artificial Sequence
  Synthetic Polynucleotide
taatacgactcactataggggatatcgtaaatgcgtcgacgttcaacattaacagaggagaaatgttatgcgtcgacgcaacctggcggcagcgcaaaagatg

SEQ ID NO: 112376 - DNA, 103 bp, Artificial Sequence
  Synthetic Polynucleotide
taatacgactcactatagggggacgttcacgatatcgtaaatgcgtcgacaacagaggagagtcgacatgtttacgataaacctggcggcagcgcaaaagatg

SEQ ID NO: 112377 - DNA, 103 bp, Artificial Sequence
  Synthetic Polynucleotide
taatacgactcactatagggaaactctctaggacgttcacgatatcgtaaaacagaggagattacgaatgcgtgaacgtaacctggcggcagcgcaaaagatg

SEQ ID NO: 112378 - DNA, 103 bp, Artificial Sequence
  Synthetic Polynucleotide
taatacgactcactatagggcaccatatgtaaactctctaggacgttcacaacagaggagagtgaacatgctagagagtaacctggcggcagcgcaaaagatg

SEQ ID NO: 112379 - DNA, 103 bp, Artificial Sequence
  Synthetic Polynucleotide
taatacgactcactatagggctttcagaggtgttttcattagtcccctttaacagaggagaaaagggatgtaatgaaaaaacctggcggcagcgcaaaagatg

SEQ ID NO: 112380 - DNA, 103 bp, Artificial Sequence
  Synthetic Polynucleotide
taatacgactcactatagggcgaggcggctcaccatatgtaaactctctaaacagaggagatagagaatgtacatatggaacctggcggcagcgcaaaagatg

SEQ ID NO: 112381 - DNA, 103 bp, Artificial Sequence
  Synthetic Polynucleotide
taatacgactcactatagggctgtttttggcgaggcggctcaccatatgtaacagaggagaacatatatggagccgcctaacctggcggcagcgcaaaagatg

SEQ ID NO: 112382 - DNA, 103 bp, Artificial Sequence
  Synthetic Polynucleotide
taatacgactcactatagggccaagtgtacctgtttttggcgaggcggctaacagaggagaagccgcatggccaaaaacaacctggcggcagcgcaaaagatg

SEQ ID NO: 112383 - DNA, 103 bp, Artificial Sequence
  Synthetic Polynucleotide
taatacgactcactataggggtcgcccgtgccaagtgtacctgtttttggaacagaggagaccaaaaatgggtacacttaacctggcggcagcgcaaaagatg

SEQ ID NO: 112384 - DNA, 103 bp, Artificial Sequence
  Synthetic Polynucleotide
taatacgactcactatagggttgagattgtgtcgcccgtgccaagtgtacaacagaggagagtacacatggcacgggcgaacctggcggcagcgcaaaagatg

SEQ ID NO: 112385 - DNA, 103 bp, Artificial Sequence
  Synthetic Polynucleotide
taatacgactcactatagggaagggttttgttgagattgtgtcgcccgtgaacagaggagacacgggatgcacaatctcaacctggcggcagcgcaaaagatg

SEQ ID NO: 112386 - DNA, 103 bp, Artificial Sequence
  Synthetic Polynucleotide
taatacgactcactatagggtcaaggtgccaagggttttgttgagattgtaacagaggagaacaatcatgacaaaacccaacctggcggcagcgcaaaagatg

SEQ ID NO: 112387 - DNA, 103 bp, Artificial Sequence
  Synthetic Polynucleotide
taatacgactcactatagggccgatgctcttcaaggtgccaagggttttgaacagaggagacaaaacatgtggcaccttaacctggcggcagcgcaaaagatg

SEQ ID NO: 112388 - DNA, 103 bp, Artificial Sequence
  Synthetic Polynucleotide
taatacgactcactatagggattctcctccccgatgctcttcaaggtgccaacagaggagaggcaccatgaagagcatcaacctggcggcagcgcaaaagatg

SEQ ID NO: 112389 - DNA, 103 bp, Artificial Sequence
  Synthetic Polynucleotide
taatacgactcactatagggcggcgtacttattctcctccccgatgctctaacagaggagaagagcaatggggaggagaaacctggcggcagcgcaaaagatg

SEQ ID NO: 112390 - DNA, 103 bp, Artificial Sequence
  Synthetic Polynucleotide
taatacgactcactataggggtggtggattctttcagaggtgttttcattaacagaggagaaatgaaatgacctctgaaaacctggcggcagcgcaaaagatg

SEQ ID NO: 112391 - DNA, 103 bp, Artificial Sequence
  Synthetic Polynucleotide
taatacgactcactatagggataatctgctcggcgtacttattctcctccaacagaggagaggaggaatgtaagtacgcaacctggcggcagcgcaaaagatg

SEQ ID NO: 112392 - DNA, 103 bp, Artificial Sequence
  Synthetic Polynucleotide
taatacgactcactatagggtttgatcatcataatctgctcggcgtacttaacagaggagaaagtacatggagcagattaacctggcggcagcgcaaaagatg

SEQ ID NO: 112393 - DNA, 103 bp, Artificial Sequence
  Synthetic Polynucleotide
taatacgactcactatagggattctttctttttgatcatcataatctgctaacagaggagaagcagaatgtgatgatcaaacctggcggcagcgcaaaagatg

SEQ ID NO: 112394 - DNA, 103 bp, Artificial Sequence
  Synthetic Polynucleotide
taatacgactcactatagggtcttgctcatattctttctttttgatcatcaacagaggagagatgatatgaaagaaagaaacctggcggcagcgcaaaagatg

SEQ ID NO: 112395 - DNA, 103 bp, Artificial Sequence
  Synthetic Polynucleotide
taatacgactcactatagggaaagtcaaactcttgctcatattctttcttaacagaggagaaagaaaatgtatgagcaaaacctggcggcagcgcaaaagatg

SEQ ID NO: 112396 - DNA, 103 bp, Artificial Sequence
  Synthetic Polynucleotide
taatacgactcactatagggaactcttaataaagtcaaactcttgctcataacagaggagaatgagcatgagtttgactaacctggcggcagcgcaaaagatg

SEQ ID NO: 112397 - DNA, 103 bp, Artificial Sequence
  Synthetic Polynucleotide
taatacgactcactatagggtctatactgtaactcttaataaagtcaaacaacagaggagagtttgaatgtattaagagaacctggcggcagcgcaaaagatg

SEQ ID NO: 112398 - DNA, 103 bp, Artificial Sequence
  Synthetic Polynucleotide
taatacgactcactataggggatatgatcctctatactgtaactcttaataacagaggagaattaagatgtacagtataaacctggcggcagcgcaaaagatg

SEQ ID NO: 112399 - DNA, 103 bp, Artificial Sequence
  Synthetic Polynucleotide
taatacgactcactatagggttgatttgatgatatgatcctctatactgtaacagaggagaacagtaatgaggatcataaacctggcggcagcgcaaaagatg

SEQ ID NO: 112400 - DNA, 103 bp, Artificial Sequence
  Synthetic Polynucleotide
taatacgactcactataggggggccagtgtttgatttgatgatatgatccaacagaggagaggatcaatgcatcaaatcaacctggcggcagcgcaaaagatg

SEQ ID NO: 112401 - DNA, 103 bp, Artificial Sequence
  Synthetic Polynucleotide
taatacgactcactataggggatatttgctgtggtggattctttcagaggaacagaggagacctctgatggaatccaccaacctggcggcagcgcaaaagatg

SEQ ID NO: 112402 - DNA, 103 bp, Artificial Sequence
  Synthetic Polynucleotide
taatacgactcactataggggtgtccatttgggccagtgtttgatttgataacagaggagaatcaaaatgaacactggcaacctggcggcagcgcaaaagatg

SEQ ID NO: 112403 - DNA, 103 bp, Artificial Sequence
  Synthetic Polynucleotide
taatacgactcactatagggacatgtctgggtgtccatttgggccagtgtaacagaggagaacactgatgcaaatggacaacctggcggcagcgcaaaagatg

SEQ ID NO: 112404 - DNA, 103 bp, Artificial Sequence
  Synthetic Polynucleotide
taatacgactcactatagggtccacaaaacacatgtctgggtgtccatttaacagaggagaaaatggatgcccagacataacctggcggcagcgcaaaagatg

SEQ ID NO: 112405 - DNA, 103 bp, Artificial Sequence
  Synthetic Polynucleotide
taatacgactcactatagggtccagggagttccacaaaacacatgtctggaacagaggagaccagacatgtgttttgtgaacctggcggcagcgcaaaagatg

SEQ ID NO: 112406 - DNA, 103 bp, Artificial Sequence
  Synthetic Polynucleotide
taatacgactcactataggggaaattccactccagggagttccacaaaacaacagaggagagttttgatgaactccctgaacctggcggcagcgcaaaagatg

SEQ ID NO: 112407 - DNA, 103 bp, Artificial Sequence
  Synthetic Polynucleotide
taatacgactcactataggggaagctgcccgaaattccactccagggagtaacagaggagaactcccatgagtggaattaacctggcggcagcgcaaaagatg

SEQ ID NO: 112408 - DNA, 103 bp, Artificial Sequence
  Synthetic Polynucleotide
taatacgactcactataggggctgtttacagaagctgcccgaaattccacaacagaggagagtggaaatgcgggcagctaacctggcggcagcgcaaaagatg

SEQ ID NO: 112409 - DNA, 103 bp, Artificial Sequence
  Synthetic Polynucleotide
taatacgactcactatagggtgtctttgcggctgtttacagaagctgcccaacagaggagagggcagatgctgtaaacaaacctggcggcagcgcaaaagatg

SEQ ID NO: 112410 - DNA, 103 bp, Artificial Sequence
  Synthetic Polynucleotide
taatacgactcactatagggcttaaagacttgtctttgcggctgtttacaaacagaggagatgtaaaatgccgcaaagaaacctggcggcagcgcaaaagatg

SEQ ID NO: 112411 - DNA, 103 bp, Artificial Sequence
  Synthetic Polynucleotide
taatacgactcactataggggctcattacccttaaagacttgtctttgcgaacagaggagacgcaaaatgaagtctttaaacctggcggcagcgcaaaagatg

SEQ ID NO: 112412 - DNA, 103 bp, Artificial Sequence
  Synthetic Polynucleotide
taatacgactcactatagggctgccaacacgatatttgctgtggtggattaacagaggagaaatccaatgcagcaaataaacctggcggcagcgcaaaagatg

SEQ ID NO: 112413 - DNA, 103 bp, Artificial Sequence
  Synthetic Polynucleotide
taatacgactcactatagggcaaatttctggctcattacccttaaagactaacagaggagaagtcttatggggtaatgaaacctggcggcagcgcaaaagatg

SEQ ID NO: 112414 - DNA, 103 bp, Artificial Sequence
  Synthetic Polynucleotide
taatacgactcactatagggaacagcatcacaaatttctggctcattaccaacagaggagaggtaatatgccagaaattaacctggcggcagcgcaaaagatg

SEQ ID NO: 112415 - DNA, 103 bp, Artificial Sequence
  Synthetic Polynucleotide
taatacgactcactatagggtgacaccaaaaacagcatcacaaatttctgaacagaggagacagaaaatggtgatgctgaacctggcggcagcgcaaaagatg

SEQ ID NO: 112416 - DNA, 103 bp, Artificial Sequence
  Synthetic Polynucleotide
taatacgactcactatagggtctgaggcgttgacaccaaaaacagcatcaaacagaggagatgatgcatgttttggtgtaacctggcggcagcgcaaaagatg

SEQ ID NO: 112417 - DNA, 103 bp, Artificial Sequence
  Synthetic Polynucleotide
taatacgactcactatagggaggcttactatctgaggcgttgacaccaaaaacagaggagatttggtatgaacgcctcaaacctggcggcagcgcaaaagatg

SEQ ID NO: 112418 - DNA, 103 bp, Artificial Sequence
  Synthetic Polynucleotide
taatacgactcactatagggagcaacttctaggcttactatctgaggcgtaacagaggagaacgcctatgatagtaagcaacctggcggcagcgcaaaagatg

SEQ ID NO: 112419 - DNA, 103 bp, Artificial Sequence
  Synthetic Polynucleotide
taatacgactcactatagggaaatcttggcagcaacttctaggcttactaaacagaggagatagtaaatgtagaagttgaacctggcggcagcgcaaaagatg

SEQ ID NO: 112420 - DNA, 103 bp, Artificial Sequence
  Synthetic Polynucleotide
taatacgactcactatagggtccccaattaaaatcttggcagcaacttctaacagaggagaagaagtatgtgccaagataacctggcggcagcgcaaaagatg

SEQ ID NO: 112421 - DNA, 103 bp, Artificial Sequence
  Synthetic Polynucleotide
taatacgactcactatagggcacatggtcctccccaattaaaatcttggcaacagaggagagccaagatgttaattgggaacctggcggcagcgcaaaagatg

SEQ ID NO: 112422 - DNA, 103 bp, Artificial Sequence
  Synthetic Polynucleotide
taatacgactcactatagggccaaatcttccacatggtcctccccaattaaacagaggagataattgatgaggaccatgaacctggcggcagcgcaaaagatg

SEQ ID NO: 112423 - DNA, 103 bp, Artificial Sequence
  Synthetic Polynucleotide
taatacgactcactatagggggctggatctctgccaacacgatatttgctaacagaggagaagcaaaatgcgtgttggcaacctggcggcagcgcaaaagatg

SEQ ID NO: 112424 - DNA, 103 bp, Artificial Sequence
  Synthetic Polynucleotide
taatacgactcactatagggttgcttttatccaaatcttccacatggtccaacagaggagaggaccaatgggaagatttaacctggcggcagcgcaaaagatg

SEQ ID NO: 112425 - DNA, 103 bp, Artificial Sequence
  Synthetic Polynucleotide
taatacgactcactatagggtgttttaaacttgcttttatccaaatcttcaacagaggagagaagatatggataaaagcaacctggcggcagcgcaaaagatg

SEQ ID NO: 112426 - DNA, 103 bp, Artificial Sequence
  Synthetic Polynucleotide
taatacgactcactatagggtcctaatttttgttttaaacttgcttttataacagaggagaataaaaatgagtttaaaaaacctggcggcagcgcaaaagatg

SEQ ID NO: 112427 - DNA, 103 bp, Artificial Sequence
  Synthetic Polynucleotide
taatacgactcactatagggtcatacaacctcctaatttttgttttaaacaacagaggagagtttaaatgaaaaattagaacctggcggcagcgcaaaagatg

SEQ ID NO: 112428 - DNA, 103 bp, Artificial Sequence
  Synthetic Polynucleotide
taatacgactcactatagggattagctatatcatacaacctcctaattttaacagaggagaaaaattatgaggttgtataacctggcggcagcgcaaaagatg

SEQ ID NO: 112429 - DNA, 103 bp, Artificial Sequence
  Synthetic Polynucleotide
taatacgactcactatagggtactcagaacattagctatatcatacaaccaacagaggagaggttgtatgatatagctaaacctggcggcagcgcaaaagatg

SEQ ID NO: 112430 - DNA, 103 bp, Artificial Sequence
  Synthetic Polynucleotide
taatacgactcactatagggagatccaggctactcagaacattagctataaacagaggagatatagcatgtgttctgagaacctggcggcagcgcaaaagatg

SEQ ID NO: 112431 - DNA, 103 bp, Artificial Sequence
  Synthetic Polynucleotide
taatacgactcactatagggtttcttgataagatccaggctactcagaacaacagaggagagttctgatgagcctggataacctggcggcagcgcaaaagatg

SEQ ID NO: 112432 - DNA, 103 bp, Artificial Sequence
  Synthetic Polynucleotide
taatacgactcactatagggtaacatgaactttcttgataagatccaggcaacagaggagagcctggatgttatcaagaaacctggcggcagcgcaaaagatg

SEQ ID NO: 112433 - DNA, 103 bp, Artificial Sequence
  Synthetic Polynucleotide
taatacgactcactatagggctttcctctgtaacatgaactttcttgataaacagaggagatatcaaatgagttcatgtaacctggcggcagcgcaaaagatg

SEQ ID NO: 112434 - DNA, 103 bp, Artificial Sequence
  Synthetic Polynucleotide
taatacgactcactatagggcgtcacccgcactgccatcgcgccctccataacagaggagaatggagatggcgatggcaaacctggcggcagcgcaaaagatg

SEQ ID NO: 112435 - DNA, 103 bp, Artificial Sequence
  Synthetic Polynucleotide
taatacgactcactataggggctgggggccaaggccgccgccaccgccgcaacagaggagagcggcgatggcggcggccaacctggcggcagcgcaaaagatg

SEQ ID NO: 112436 - DNA, 103 bp, Artificial Sequence
  Synthetic Polynucleotide
taatacgactcactatagggctgcatctggacgtggacttcgtggatgacaacagaggagagtcatcatggaagtccacaacctggcggcagcgcaaaagatg

SEQ ID NO: 112437 - DNA, 103 bp, Artificial Sequence
  Synthetic Polynucleotide
taatacgactcactataggggggacagctcctgcatctggacgtggacttaacagaggagaaagtccatgtccagatgcaacctggcggcagcgcaaaagatg

SEQ ID NO: 112438 - DNA, 103 bp, Artificial Sequence
  Synthetic Polynucleotide
taatacgactcactatagggttcatgcccagggacagctcctgcatctggaacagaggagaccagatatgggagctgtcaacctggcggcagcgcaaaagatg

SEQ ID NO: 112439 - DNA, 103 bp, Artificial Sequence
  Synthetic Polynucleotide
taatacgactcactatagggggccagggctttcatgcccagggacagctcaacagaggagagagctgatgctgggcatgaacctggcggcagcgcaaaagatg

SEQ ID NO: 112440 - DNA, 103 bp, Artificial Sequence
  Synthetic Polynucleotide
taatacgactcactatagggggggctctggggccagggctttcatgcccaaacagaggagatgggcaatgaagccctggaacctggcggcagcgcaaaagatg

SEQ ID NO: 112441 - DNA, 103 bp, Artificial Sequence
  Synthetic Polynucleotide
taatacgactcactatagggtgggagacggggggctctggggccagggctaacagaggagaagccctatgcccagagccaacctggcggcagcgcaaaagatg

SEQ ID NO: 112442 - DNA, 103 bp, Artificial Sequence
  Synthetic Polynucleotide
taatacgactcactatagggggggagctcctgggagacggggggctctggaacagaggagaccagagatgcccgtctccaacctggcggcagcgcaaaagatg

SEQ ID NO: 112443 - DNA, 103 bp, Artificial Sequence
  Synthetic Polynucleotide
taatacgactcactatagggcgctggagcaggggagctcctgggagacggaacagaggagaccgtctatgaggagctccaacctggcggcagcgcaaaagatg

SEQ ID NO: 112444 - DNA, 103 bp, Artificial Sequence
  Synthetic Polynucleotide
taatacgactcactatagggcggctgccctcgctggagcaggggagctccaacagaggagaggagctatgctgctccagaacctggcggcagcgcaaaagatg

SEQ ID NO: 112445 - DNA, 103 bp, Artificial Sequence
  Synthetic Polynucleotide
taatacgactcactatagggcaggttctcacggctgccctcgctggagcaaacagaggagatgctccatggagggcagcaacctggcggcagcgcaaaagatg

SEQ ID NO: 112446 - DNA, 103 bp, Artificial Sequence
  Synthetic Polynucleotide
taatacgactcactatagggcgaggaagccgctgggggccaaggccgccgaacagaggagacggcggatgtggcccccaaacctggcggcagcgcaaaagatg

SEQ ID NO: 112447 - DNA, 103 bp, Artificial Sequence
  Synthetic Polynucleotide
taatacgactcactatagggcctggtgcagcaggttctcacggctgccctaacagaggagaagggcaatggtgagaaccaacctggcggcagcgcaaaagatg

SEQ ID NO: 112448 - DNA, 103 bp, Artificial Sequence
  Synthetic Polynucleotide
taatacgactcactatagggttctgcatggcctggtgcagcaggttctcaaacagaggagatgagaaatggctgcaccaaacctggcggcagcgcaaaagatg

SEQ ID NO: 112449 - DNA, 103 bp, Artificial Sequence
  Synthetic Polynucleotide
taatacgactcactataggggatgccggagttctgcatggcctggtgcagaacagaggagactgcacatggccatgcagaacctggcggcagcgcaaaagatg

SEQ ID NO: 112450 - DNA, 103 bp, Artificial Sequence
  Synthetic Polynucleotide
taatacgactcactataggggctcaaggacgatgccggagttctgcatggaacagaggagaccatgcatgactccggcaaacctggcggcagcgcaaaagatg

SEQ ID NO: 112451 - DNA, 103 bp, Artificial Sequence
  Synthetic Polynucleotide
taatacgactcactatagggccagcagcgcgctcaaggacgatgccggagaacagaggagactccggatgcgtccttgaaacctggcggcagcgcaaaagatg

SEQ ID NO: 112452 - DNA, 103 bp, Artificial Sequence
  Synthetic Polynucleotide
taatacgactcactatagggaccctcctccccagcagcgcgctcaaggacaacagaggagagtccttatgcgcgctgctaacctggcggcagcgcaaaagatg

SEQ ID NO: 112453 - DNA, 103 bp, Artificial Sequence
  Synthetic Polynucleotide
taatacgactcactataggggctccagggcaccctcctccccagcagcgcaacagaggagagcgctgatggggaggaggaacctggcggcagcgcaaaagatg

SEQ ID NO: 112454 - DNA, 103 bp, Artificial Sequence
  Synthetic Polynucleotide
taatacgactcactataggggcaggagctggctccagggcaccctcctccaacagaggagaggaggaatgtgccctggaaacctggcggcagcgcaaaagatg

SEQ ID NO: 112455 - DNA, 103 bp, Artificial Sequence
  Synthetic Polynucleotide
taatacgactcactatagggggacccggcagcaggagctggctccagggcaacagaggagagccctgatgccagctcctaacctggcggcagcgcaaaagatg

SEQ ID NO: 112456 - DNA, 103 bp, Artificial Sequence
  Synthetic Polynucleotide
taatacgactcactataggggctggggactggacccggcagcaggagctgaacagaggagacagctcatgctgccgggtaacctggcggcagcgcaaaagatg

SEQ ID NO: 112457 - DNA, 103 bp, Artificial Sequence
  Synthetic Polynucleotide
taatacgactcactataggggccgggaggccgaggaagccgctgggggccaacagaggagaggccccatgcggcttcctaacctggcggcagcgcaaaagatg

SEQ ID NO: 112458 - DNA, 103 bp, Artificial Sequence
  Synthetic Polynucleotide
taatacgactcactatagggactgccaggggctggggactggacccggcaaacagaggagatgccggatgcagtccccaaacctggcggcagcgcaaaagatg

SEQ ID NO: 112459 - DNA, 103 bp, Artificial Sequence
  Synthetic Polynucleotide
taatacgactcactatagggcggggctgccactgccaggggctggggactaacagaggagaagtcccatgcccctggcaaacctggcggcagcgcaaaagatg

SEQ ID NO: 112460 - DNA, 103 bp, Artificial Sequence
  Synthetic Polynucleotide
taatacgactcactatagggccggcagctgcggggctgccactgccagggaacagaggagaccctggatgtggcagcccaacctggcggcagcgcaaaagatg

SEQ ID NO: 112461 - DNA, 103 bp, Artificial Sequence
  Synthetic Polynucleotide
taatacgactcactatagggacttccagtaccggcagctgcggggctgccaacagaggagaggcagcatggcagctgccaacctggcggcagcgcaaaagatg

SEQ ID NO: 112462 - DNA, 103 bp, Artificial Sequence
  Synthetic Polynucleotide
taatacgactcactatagggcagcggctgcacttccagtaccggcagctgaacagaggagacagctgatggtactggaaaacctggcggcagcgcaaaagatg

SEQ ID NO: 112463 - DNA, 103 bp, Artificial Sequence
  Synthetic Polynucleotide
taatacgactcactatagggcctgtgtctccagcggctgcacttccagtaaacagaggagatactggatgtgcagccgcaacctggcggcagcgcaaaagatg

SEQ ID NO: 112464 - DNA, 103 bp, Artificial Sequence
  Synthetic Polynucleotide
taatacgactcactatagggtcgctggccacctgtgtctccagcggctgcaacagaggagagcagccatgggagacacaaacctggcggcagcgcaaaagatg

SEQ ID NO: 112465 - DNA, 103 bp, Artificial Sequence
  Synthetic Polynucleotide
taatacgactcactatagggcgctgaggcctcgctggccacctgtgtctcaacagaggagagagacaatggtggccagcaacctggcggcagcgcaaaagatg

SEQ ID NO: 112466 - DNA, 103 bp, Artificial Sequence
  Synthetic Polynucleotide
taatacgactcactatagggtcctgggcaccgctgaggcctcgctggccaaacagaggagatggccaatgaggcctcagaacctggcggcagcgcaaaagatg

SEQ ID NO: 112467 - DNA, 103 bp, Artificial Sequence
  Synthetic Polynucleotide
taatacgactcactatagggcatgggtgggtcctgggcaccgctgaggccaacagaggagaggcctcatgggtgcccagaacctggcggcagcgcaaaagatg

SEQ ID NO: 112468 - DNA, 103 bp, Artificial Sequence
  Synthetic Polynucleotide
taatacgactcactataggggctgaagggcgccgggaggccgaggaagccaacagaggagaggcttcatgggcctcccgaacctggcggcagcgcaaaagatg

SEQ ID NO: 112469 - DNA, 103 bp, Artificial Sequence
  Synthetic Polynucleotide
taatacgactcactataggggcactgaggacatgggtgggtcctgggcacaacagaggagagtgcccatgacccacccaaacctggcggcagcgcaaaagatg

SEQ ID NO: 112470 - DNA, 103 bp, Artificial Sequence
  Synthetic Polynucleotide
taatacgactcactatagggaggtctcactgcactgaggacatgggtgggaacagaggagacccaccatggtcctcagtaacctggcggcagcgcaaaagatg

SEQ ID NO: 112471 - DNA, 103 bp, Artificial Sequence
  Synthetic Polynucleotide
taatacgactcactataggggctgtcgggaaggtctcactgcactgaggaaacagaggagatcctcaatgcagtgagacaacctggcggcagcgcaaaagatg

SEQ ID NO: 112472 - DNA, 103 bp, Artificial Sequence
  Synthetic Polynucleotide
taatacgactcactatagggcagggtggctgctgtcgggaaggtctcactaacagaggagaagtgagatgttcccgacaaacctggcggcagcgcaaaagatg

SEQ ID NO: 112473 - DNA, 103 bp, Artificial Sequence
  Synthetic Polynucleotide
taatacgactcactatagggtgtgggcctccagggtggctgctgtcgggaaacagaggagatcccgaatgcagccacccaacctggcggcagcgcaaaagatg

SEQ ID NO: 112474 - DNA, 103 bp, Artificial Sequence
  Synthetic Polynucleotide
taatacgactcactatagggtggcccctcttgtgggcctccagggtggctaacagaggagaagccacatgggaggcccaaacctggcggcagcgcaaaagatg

SEQ ID NO: 112475 - DNA, 103 bp, Artificial Sequence
  Synthetic Polynucleotide
taatacgactcactatagggcggcccggtgtggcccctcttgtgggcctcaacagaggagagaggccatgaagaggggcaacctggcggcagcgcaaaagatg

SEQ ID NO: 112476 - DNA, 103 bp, Artificial Sequence
  Synthetic Polynucleotide
taatacgactcactatagggcgaacggcctcggcccggtgtggcccctctaacagaggagaagagggatgacaccgggcaacctggcggcagcgcaaaagatg

SEQ ID NO: 112477 - DNA, 103 bp, Artificial Sequence
  Synthetic Polynucleotide
taatacgactcactatagggtgcgcgcaggcgaacggcctcggcccggtgaacagaggagacaccggatggaggccgttaacctggcggcagcgcaaaagatg

SEQ ID NO: 112478 - DNA, 103 bp, Artificial Sequence
  Synthetic Polynucleotide
taatacgactcactatagggcttgccacactgcgcgcaggcgaacggcctaacagaggagaaggccgatggcctgcgcgaacctggcggcagcgcaaaagatg

SEQ ID NO: 112479 - DNA, 103 bp, Artificial Sequence
  Synthetic Polynucleotide
taatacgactcactatagggcatcttcctcgctgaagggcgccgggaggcaacagaggagagcctccatgcgcccttcaaacctggcggcagcgcaaaagatg

SEQ ID NO: 112480 - DNA, 103 bp, Artificial Sequence
  Synthetic Polynucleotide
taatacgactcactatagggtggggaaggccttgccacactgcgcgcaggaacagaggagacctgcgatgagtgtggcaaacctggcggcagcgcaaaagatg

SEQ ID NO: 112481 - DNA, 103 bp, Artificial Sequence
  Synthetic Polynucleotide
taatacgactcactatagggaggtaggccttggggaaggccttgccacacaacagaggagagtgtggatgggccttcccaacctggcggcagcgcaaaagatg

SEQ ID NO: 112482 - DNA, 103 bp, Artificial Sequence
  Synthetic Polynucleotide
taatacgactcactatagggcttcttgagcaggtaggccttggggaaggcaacagaggagagccttcatgaaggcctacaacctggcggcagcgcaaaagatg

SEQ ID NO: 112483 - DNA, 103 bp, Artificial Sequence
  Synthetic Polynucleotide
taatacgactcactatagggcctcctggtgcttcttgagcaggtaggcctaacagaggagaaggcctatgtgctcaagaaacctggcggcagcgcaaaagatg

SEQ ID NO: 112484 - DNA, 103 bp, Artificial Sequence
  Synthetic Polynucleotide
taatacgactcactatagggcgcacgtgcacctcctggtgcttcttgagcaacagaggagagctcaaatggcaccaggaaacctggcggcagcgcaaaagatg

SEQ ID NO: 112485 - DNA, 103 bp, Artificial Sequence
  Synthetic Polynucleotide
taatacgactcactataggggcggcgctcacgcacgtgcacctcctggtgaacagaggagacaccagatggtgcacgtgaacctggcggcagcgcaaaagatg

SEQ ID NO: 112486 - DNA, 103 bp, Artificial Sequence
  Synthetic Polynucleotide
taatacgactcactatagggcacagcggaagcggcgctcacgcacgtgcaaacagaggagatgcacgatggtgagcgccaacctggcggcagcgcaaaagatg

SEQ ID NO: 112487 - DNA, 103 bp, Artificial Sequence
  Synthetic Polynucleotide
taatacgactcactatagggccgcagtcgccacagcggaagcggcgctcaaacagaggagatgagcgatgcttccgctgaacctggcggcagcgcaaaagatg

SEQ ID NO: 112488 - DNA, 103 bp, Artificial Sequence
  Synthetic Polynucleotide
taatacgactcactataggggtagagcttcccgcagtcgccacagcggaaaacagaggagattccgcatgggcgactgcaacctggcggcagcgcaaaagatg

SEQ ID NO: 112489 - DNA, 103 bp, Artificial Sequence
  Synthetic Polynucleotide
taatacgactcactatagggcaatggtcttgtagagcttcccgcagtcgcaacagaggagagcgactatgggaagctctaacctggcggcagcgcaaaagatg

SEQ ID NO: 112490 - DNA, 103 bp, Artificial Sequence
  Synthetic Polynucleotide
taatacgactcactatagggacatcgtcctcatcttcctcgctgaagggcaacagaggagagcccttatgcgaggaagaaacctggcggcagcgcaaaagatg

SEQ ID NO: 112491 - DNA, 103 bp, Artificial Sequence
  Synthetic Polynucleotide
taatacgactcactatagggcgcacatgggcaatggtcttgtagagcttcaacagaggagagaagctatgcaagaccataacctggcggcagcgcaaaagatg

SEQ ID NO: 112492 - DNA, 103 bp, Artificial Sequence
  Synthetic Polynucleotide
taatacgactcactatagggccggtggccacgcacatgggcaatggtcttaacagaggagaaagaccatggcccatgtgaacctggcggcagcgcaaaagatg

SEQ ID NO: 112493 - DNA, 103 bp, Artificial Sequence
  Synthetic Polynucleotide
taatacgactcactatagggagtggacgcgccggtggccacgcacatgggaacagaggagacccatgatggtggccaccaacctggcggcagcgcaaaagatg

SEQ ID NO: 112494 - DNA, 103 bp, Artificial Sequence
  Synthetic Polynucleotide
taatacgactcactatagggcgctcgtctgagtggacgcgccggtggccaaacagaggagatggccaatggcgcgtccaaacctggcggcagcgcaaaagatg

SEQ ID NO: 112495 - DNA, 103 bp, Artificial Sequence
  Synthetic Polynucleotide
taatacgactcactatagggagggtagggccgctcgtctgagtggacgcgaacagaggagacgcgtcatgtcagacgagaacctggcggcagcgcaaaagatg

SEQ ID NO: 112496 - DNA, 103 bp, Artificial Sequence
  Synthetic Polynucleotide
taatacgactcactatagggacttgggacaagggtagggccgctcgtctgaacagaggagacagacgatgggccctaccaacctggcggcagcgcaaaagatg

SEQ ID NO: 112497 - DNA, 103 bp, Artificial Sequence
  Synthetic Polynucleotide
taatacgactcactatagggcgcttgccacacttgggacaagggtagggcaacagaggagagccctaatgttgtcccaaaacctggcggcagcgcaaaagatg

SEQ ID NO: 112498 - DNA, 103 bp, Artificial Sequence
  Synthetic Polynucleotide
taatacgactcactatagggagtcttgtagcgcttgccacacttgggacaaacagaggagatgtcccatgtgtggcaagaacctggcggcagcgcaaaagatg

SEQ ID NO: 112499 - DNA, 103 bp, Artificial Sequence
  Synthetic Polynucleotide
taatacgactcactataggggtgcgttcttagtcttgtagcgcttgccacaacagaggagagtggcaatggctacaagaaacctggcggcagcgcaaaagatg

SEQ ID NO: 112500 - DNA, 103 bp, Artificial Sequence
  Synthetic Polynucleotide
taatacgactcactatagggtgcacctgctgtgcgttcttagtcttgtagaacagaggagactacaaatgtaagaacgcaacctggcggcagcgcaaaagatg

SEQ ID NO: 112501 - DNA, 103 bp, Artificial Sequence
  Synthetic Polynucleotide
taatacgactcactataggggcatctgtgcacatcgtcctcatcttcctcaacagaggagagaggaaatggaggacgataacctggcggcagcgcaaaagatg

SEQ ID NO: 112502 - DNA, 103 bp, Artificial Sequence
  Synthetic Polynucleotide
taatacgactcactatagggtgtcctgaagtgcacctgctgtgcgttcttaacagaggagaaagaacatgcagcaggtgaacctggcggcagcgcaaaagatg

SEQ ID NO: 112503 - DNA, 103 bp, Artificial Sequence
  Synthetic Polynucleotide
taatacgactcactatagggcctccaggtgtgtcctgaagtgcacctgctaacagaggagaagcaggatgacttcaggaaacctggcggcagcgcaaaagatg

SEQ ID NO: 112504 - DNA, 103 bp, Artificial Sequence
  Synthetic Polynucleotide
taatacgactcactatagggtgcggcttctcctccaggtgtgtcctgaagaacagaggagacttcagatgacacctggaaacctggcggcagcgcaaaagatg

SEQ ID NO: 112505 - DNA, 103 bp, Artificial Sequence
  Synthetic Polynucleotide
taatacgactcactatagggctggcacacgtgcggcttctcctccaggtgaacagaggagacacctgatggagaagccgaacctggcggcagcgcaaaagatg

SEQ ID NO: 112506 - DNA, 103 bp, Artificial Sequence
  Synthetic Polynucleotide
taatacgactcactatagggggctgcagaactggcacacgtgcggcttctaacagaggagaagaagcatgacgtgtgccaacctggcggcagcgcaaaagatg

SEQ ID NO: 112507 - DNA, 103 bp, Artificial Sequence
  Synthetic Polynucleotide
taatacgactcactatagggcggaagccacggctgcagaactggcacacgaacagaggagacgtgtgatggttctgcagaacctggcggcagcgcaaaagatg

SEQ ID NO: 112508 - DNA, 103 bp, Artificial Sequence
  Synthetic Polynucleotide
taatacgactcactataggggcccttctctcggaagccacggctgcagaaaacagaggagattctgcatgcgtggcttcaacctggcggcagcgcaaaagatg

SEQ ID NO: 112509 - DNA, 103 bp, Artificial Sequence
  Synthetic Polynucleotide
taatacgactcactataggggcaccagtgagcccttctctcggaagccacaacagaggagagtggctatggagagaaggaacctggcggcagcgcaaaagatg

SEQ ID NO: 112510 - DNA, 103 bp, Artificial Sequence
  Synthetic Polynucleotide
taatacgactcactatagggcgcacgtgccgcaccagtgagcccttctctaacagaggagaagagaaatgctcactggtaacctggcggcagcgcaaaagatg

SEQ ID NO: 112511 - DNA, 103 bp, Artificial Sequence
  Synthetic Polynucleotide
taatacgactcactatagggtgtgtggtgtcgcacgtgccgcaccagtgaaacagaggagatcactgatgcggcacgtgaacctggcggcagcgcaaaagatg

SEQ ID NO: 112512 - DNA, 103 bp, Artificial Sequence
  Synthetic Polynucleotide
taatacgactcactatagggggcagcggccgcatctgtgcacatcgtcctaacagaggagaaggacgatgtgcacagataacctggcggcagcgcaaaagatg

SEQ ID NO: 112513 - DNA, 103 bp, Artificial Sequence
  Synthetic Polynucleotide
taatacgactcactataggggcttctcgcctgtgtggtgtcgcacgtgccaacagaggagaggcacgatggacaccacaaacctggcggcagcgcaaaagatg

SEQ ID NO: 112514 - DNA, 103 bp, Artificial Sequence
  Synthetic Polynucleotide
taatacgactcactatagggcacttgaacggcttctcgcctgtgtggtgtaacagaggagaacaccaatgaggcgagaaaacctggcggcagcgcaaaagatg

SEQ ID NO: 112515 - DNA, 103 bp, Artificial Sequence
  Synthetic Polynucleotide
taatacgactcactataggggcacttgtagcacttgaacggcttctcgccaacagaggagaggcgagatgccgttcaagaacctggcggcagcgcaaaagatg

SEQ ID NO: 112516 - DNA, 103 bp, Artificial Sequence
  Synthetic Polynucleotide
taatacgactcactatagggagccacggccgcacttgtagcacttgaacgaacagaggagacgttcaatggctacaagtaacctggcggcagcgcaaaagatg

SEQ ID NO: 112517 - DNA, 103 bp, Artificial Sequence
  Synthetic Polynucleotide
taatacgactcactatagggtgctcggcgaagccacggccgcacttgtagaacagaggagactacaaatgcggccgtggaacctggcggcagcgcaaaagatg

SEQ ID NO: 112518 - DNA, 103 bp, Artificial Sequence
  Synthetic Polynucleotide
taatacgactcactatagggcagcgtgccgtgctcggcgaagccacggccaacagaggagaggccgtatgttcgccgagaacctggcggcagcgcaaaagatg

SEQ ID NO: 112519 - DNA, 103 bp, Artificial Sequence
  Synthetic Polynucleotide
taatacgactcactatagggggtgccggttcagcgtgccgtgctcggcgaaacagaggagatcgccgatgacggcacgcaacctggcggcagcgcaaaagatg

SEQ ID NO: 112520 - DNA, 103 bp, Artificial Sequence
  Synthetic Polynucleotide
taatacgactcactatagggttggtgcgcaggtgccggttcagcgtgccgaacagaggagacggcacatggaaccggcaaacctggcggcagcgcaaaagatg

SEQ ID NO: 112521 - DNA, 103 bp, Artificial Sequence
  Synthetic Polynucleotide
taatacgactcactataggggcagccccctttggtgcgcaggtgccggttaacagaggagaaaccggatgctgcgcaccaacctggcggcagcgcaaaagatg

SEQ ID NO: 112522 - DNA, 103 bp, Artificial Sequence
  Synthetic Polynucleotide
taatacgactcactatagggcctccagcaggcagccccctttggtgcgcaaacagaggagatgcgcaatgaagggggctaacctggcggcagcgcaaaagatg

SEQ ID NO: 112523 - DNA, 103 bp, Artificial Sequence
  Synthetic Polynucleotide
taatacgactcactatagggaactctgcctggcagcggccgcatctgtgcaacagaggagagcacagatgcggccgctgaacctggcggcagcgcaaaagatg

SEQ ID NO: 112524 - DNA, 103 bp, Artificial Sequence
  Synthetic Polynucleotide
taatacgactcactatagggaactcctccacctccagcaggcagccccctaacagaggagaagggggatgcctgctggaaacctggcggcagcgcaaaagatg

SEQ ID NO: 112525 - DNA, 103 bp, Artificial Sequence
  Synthetic Polynucleotide
taatacgactcactatagggagacaccagcaactcctccacctccagcagaacagaggagactgctgatggtggaggagaacctggcggcagcgcaaaagatg

SEQ ID NO: 112526 - DNA, 103 bp, Artificial Sequence
  Synthetic Polynucleotide
taatacgactcactatagggggctgtcctcagacaccagcaactcctccaaacagaggagatggaggatgtgctggtgtaacctggcggcagcgcaaaagatg

SEQ ID NO: 112527 - DNA, 103 bp, Artificial Sequence
  Synthetic Polynucleotide
taatacgactcactataggggctgccgcggggctgtcctcagacaccagcaacagaggagagctggtatgtgaggacagaacctggcggcagcgcaaaagatg

SEQ ID NO: 112528 - DNA, 103 bp, Artificial Sequence
  Synthetic Polynucleotide
taatacgactcactataggggacggtggtggctgccgcggggctgtcctcaacagaggagagaggacatgcccgcggcaaacctggcggcagcgcaaaagatg

SEQ ID NO: 112529 - DNA, 103 bp, Artificial Sequence
  Synthetic Polynucleotide
taatacgactcactatagggcttccgtgaggacggtggtggctgccgcggaacagaggagaccgcggatgccaccaccgaacctggcggcagcgcaaaagatg

SEQ ID NO: 112530 - DNA, 103 bp, Artificial Sequence
  Synthetic Polynucleotide
taatacgactcactataggggtgtgcgggtcttccgtgaggacggtggtgaacagaggagacaccacatgcctcacggaaacctggcggcagcgcaaaagatg

SEQ ID NO: 112531 - DNA, 103 bp, Artificial Sequence
  Synthetic Polynucleotide
taatacgactcactatagggcaccaacactgtgtgcgggtcttccgtgagaacagaggagactcacgatggacccgcacaacctggcggcagcgcaaaagatg

SEQ ID NO: 112532 - DNA, 103 bp, Artificial Sequence
  Synthetic Polynucleotide
taatacgactcactatagggacgagaactccaccaacactgtgtgcgggtaacagaggagaacccgcatgcagtgttggaacctggcggcagcgcaaaagatg

SEQ ID NO: 112533 - DNA, 103 bp, Artificial Sequence
  Synthetic Polynucleotide
taatacgactcactataggggctaccacggacgagaactccaccaacactaacagaggagaagtgttatgggagttctcaacctggcggcagcgcaaaagatg

SEQ ID NO: 112534 - DNA, 103 bp, Artificial Sequence
  Synthetic Polynucleotide
taatacgactcactatagggcaaggcggtgaactctgcctggcagcggccaacagaggagaggccgcatgcaggcagagaacctggcggcagcgcaaaagatg

SEQ ID NO: 112535 - DNA, 103 bp, Artificial Sequence
  Synthetic Polynucleotide
taatacgactcactatagggctgggtgtcagctaccacggacgagaactcaacagaggagagagttcatgtccgtggtaaacctggcggcagcgcaaaagatg

SEQ ID NO: 112536 - DNA, 103 bp, Artificial Sequence
  Synthetic Polynucleotide
taatacgactcactatagggtgatatactcctgggtgtcagctaccacggaacagaggagaccgtggatgctgacacccaacctggcggcagcgcaaaagatg

SEQ ID NO: 112537 - DNA, 103 bp, Artificial Sequence
  Synthetic Polynucleotide
taatacgactcactataggggtggcctcgatgatatactcctgggtgtcaaacagaggagatgacacatgggagtatataacctggcggcagcgcaaaagatg

SEQ ID NO: 112538 - DNA, 103 bp, Artificial Sequence
  Synthetic Polynucleotide
taatacgactcactatagggatcgtccgcagtggcctcgatgatatactcaacagaggagagagtatatgatcgaggccaacctggcggcagcgcaaaagatg

SEQ ID NO: 112539 - DNA, 103 bp, Artificial Sequence
  Synthetic Polynucleotide
taatacgactcactatagggtggtctccgcatcgtccgcagtggcctcgaaacagaggagatcgaggatgctgcggacgaacctggcggcagcgcaaaagatg

SEQ ID NO: 112540 - DNA, 103 bp, Artificial Sequence
  Synthetic Polynucleotide
taatacgactcactataggggtggcctcactggtctccgcatcgtccgcaaacagaggagatgcggaatgtgcggagacaacctggcggcagcgcaaaagatg

SEQ ID NO: 112541 - DNA, 103 bp, Artificial Sequence
  Synthetic Polynucleotide
taatacgactcactataggggatgatctccgtggcctcactggtctccgcaacagaggagagcggagatgagtgaggccaacctggcggcagcgcaaaagatg

SEQ ID NO: 112542 - DNA, 103 bp, Artificial Sequence
  Synthetic Polynucleotide
taatacgactcactataggggggtgccctcgatgatctccgtggcctcacaacagaggagagtgaggatgcggagatcaaacctggcggcagcgcaaaagatg

SEQ ID NO: 112543 - DNA, 103 bp, Artificial Sequence
  Synthetic Polynucleotide
taatacgactcactatagggacctctgtctgggtgccctcgatgatctccaacagaggagaggagatatgcgagggcacaacctggcggcagcgcaaaagatg

SEQ ID NO: 112544 - DNA, 103 bp, Artificial Sequence
  Synthetic Polynucleotide
taatacgactcactataggggtggctgtccacctctgtctgggtgccctcaacagaggagagagggcatgcagacagagaacctggcggcagcgcaaaagatg

SEQ ID NO: 112545 - DNA, 103 bp, Artificial Sequence
  Synthetic Polynucleotide
taatacgactcactatagggtatgagcggccgtcacccgcactgccatcgaacagaggagacgatggatgtgcgggtgaaacctggcggcagcgcaaaagatg

SEQ ID NO: 112546 - DNA, 103 bp, Artificial Sequence
  Synthetic Polynucleotide
taatacgactcactatagggcaaaatcctccaaggcggtgaactctgcctaacagaggagaaggcagatgtcaccgcctaacctggcggcagcgcaaaagatg

SEQ ID NO: 112547 - DNA, 103 bp, Artificial Sequence
  Synthetic Polynucleotide
taatacgactcactatagggccttcatgatgtggctgtccacctctgtctaacagaggagaagacagatgtggacagccaacctggcggcagcgcaaaagatg

SEQ ID NO: 112548 - DNA, 103 bp, Artificial Sequence
  Synthetic Polynucleotide
taatacgactcactatagggtgctgcaccaccttcatgatgtggctgtccaacagaggagaggacagatgcatcatgaaaacctggcggcagcgcaaaagatg

SEQ ID NO: 112549 - DNA, 103 bp, Artificial Sequence
  Synthetic Polynucleotide
taatacgactcactataggggtgcacgatctgctgcaccaccttcatgataacagaggagaatcatgatggtggtgcagaacctggcggcagcgcaaaagatg

SEQ ID NO: 112550 - DNA, 103 bp, Artificial Sequence
  Synthetic Polynucleotide
taatacgactcactatagggcgctagcctggtgcacgatctgctgcaccaaacagaggagatggtgcatgagatcgtgcaacctggcggcagcgcaaaagatg

SEQ ID NO: 112551 - DNA, 103 bp, Artificial Sequence
  Synthetic Polynucleotide
taatacgactcactatagggtggtggccggcgctagcctggtgcacgatcaacagaggagagatcgtatgccaggctagaacctggcggcagcgcaaaagatg

SEQ ID NO: 112552 - DNA, 103 bp, Artificial Sequence
  Synthetic Polynucleotide
taatacgactcactatagggcacgatgatctggtggccggcgctagcctgaacagaggagacaggctatggccggccacaacctggcggcagcgcaaaagatg

SEQ ID NO: 112553 - DNA, 103 bp, Artificial Sequence
  Synthetic Polynucleotide
taatacgactcactatagggtgacgttctgcacgatgatctggtggccggaacagaggagaccggccatgagatcatcgaacctggcggcagcgcaaaagatg

SEQ ID NO: 112554 - DNA, 103 bp, Artificial Sequence
  Synthetic Polynucleotide
taatacgactcactatagggtcgtccatggtgacgttctgcacgatgatcaacagaggagagatcatatggcagaacgtaacctggcggcagcgcaaaagatg

SEQ ID NO: 112555 - DNA, 103 bp, Artificial Sequence
  Synthetic Polynucleotide
taatacgactcactatagggcgccgtctcctcgtccatggtgacgttctgaacagaggagacagaacatgaccatggacaacctggcggcagcgcaaaagatg

SEQ ID NO: 112556 - DNA, 103 bp, Artificial Sequence
  Synthetic Polynucleotide
taatacgactcactatagggctgggcccagcgccgtctcctcgtccatggaacagaggagaccatggatgaggagacggaacctggcggcagcgcaaaagatg

SEQ ID NO: 112557 - DNA, 103 bp, Artificial Sequence
  Synthetic Polynucleotide
taatacgactcactatagggttgtgctgaacaaaatcctccaaggcggtgaacagaggagacaccgcatgggaggatttaacctggcggcagcgcaaaagatg

SEQ ID NO: 112558 - DNA, 103 bp, Artificial Sequence
  Synthetic Polynucleotide
taatacgactcactataggggcagccgcctctgggcccagcgccgtctccaacagaggagaggagacatggctgggcccaacctggcggcagcgcaaaagatg

SEQ ID NO: 112559 - DNA, 103 bp, Artificial Sequence
  Synthetic Polynucleotide
taatacgactcactatagggggtgtcggcggcagccgcctctgggcccagaacagaggagactgggcatggaggcggctaacctggcggcagcgcaaaagatg

SEQ ID NO: 112560 - DNA, 103 bp, Artificial Sequence
  Synthetic Polynucleotide
taatacgactcactatagggcgatggtgatggtgtcggcggcagccgcctaacagaggagaaggcggatgccgccgacaaacctggcggcagcgcaaaagatg

SEQ ID NO: 112561 - DNA, 103 bp, Artificial Sequence
  Synthetic Polynucleotide
taatacgactcactatagggtcgggggtggcgatggtgatggtgtcggcgaacagaggagacgccgaatgcatcaccataacctggcggcagcgcaaaagatg

SEQ ID NO: 112562 - DNA, 103 bp, Artificial Sequence
  Synthetic Polynucleotide
taatacgactcactatagggtgtcaggctctcgggggtggcgatggtgataacagaggagaatcaccatggccacccccaacctggcggcagcgcaaaagatg

SEQ ID NO: 112563 - DNA, 103 bp, Artificial Sequence
  Synthetic Polynucleotide
taatacgactcactatagggccacctgctctgtcaggctctcgggggtggaacagaggagaccacccatgagagcctgaaacctggcggcagcgcaaaagatg

SEQ ID NO: 112564 - DNA, 103 bp, Artificial Sequence
  Synthetic Polynucleotide
taatacgactcactatagggagcgtcatggccacctgctctgtcaggctcaacagaggagagagcctatgagagcaggtaacctggcggcagcgcaaaagatg

SEQ ID NO: 112565 - DNA, 103 bp, Artificial Sequence
  Synthetic Polynucleotide
taatacgactcactatagggggccgaggccagcgtcatggccacctgctcaacagaggagagagcagatggccatgacgaacctggcggcagcgcaaaagatg

SEQ ID NO: 112566 - DNA, 103 bp, Artificial Sequence
  Synthetic Polynucleotide
taatacgactcactatagggcctcgctgatggccgaggccagcgtcatggaacagaggagaccatgaatgtggcctcggaacctggcggcagcgcaaaagatg

SEQ ID NO: 112567 - DNA, 103 bp, Artificial Sequence
  Synthetic Polynucleotide
taatacgactcactatagggagcacagtgccctcgctgatggccgaggccaacagaggagaggcctcatgcatcagcgaaacctggcggcagcgcaaaagatg

SEQ ID NO: 112568 - DNA, 103 bp, Artificial Sequence
  Synthetic Polynucleotide
taatacgactcactatagggcttctgaatcttgtgctgaacaaaatcctcaacagaggagagaggatatggttcagcacaacctggcggcagcgcaaaagatg

SEQ ID NO: 112569 - DNA, 103 bp, Artificial Sequence
  Synthetic Polynucleotide
taatacgactcactatagggccgggcggcaagcacagtgccctcgctgataacagaggagaatcagcatgggcactgtgaacctggcggcagcgcaaaagatg

SEQ ID NO: 112570 - DNA, 103 bp, Artificial Sequence
  Synthetic Polynucleotide
taatacgactcactatagggttgtccctgcccgggcggcaagcacagtgcaacagaggagagcactgatgttgccgcccaacctggcggcagcgcaaaagatg

SEQ ID NO: 112571 - DNA, 103 bp, Artificial Sequence
  Synthetic Polynucleotide
taatacgactcactatagggtcagtgccacttgtccctgcccgggcggcaaacagaggagatgccgcatgggcagggacaacctggcggcagcgcaaaagatg

SEQ ID NO: 112572 - DNA, 103 bp, Artificial Sequence
  Synthetic Polynucleotide
taatacgactcactatagggagtggcctgttcagtgccacttgtccctgcaacagaggagagcagggatgagtggcactaacctggcggcagcgcaaaagatg

SEQ ID NO: 112573 - DNA, 103 bp, Artificial Sequence
  Synthetic Polynucleotide
taatacgactcactatagggccatggtcacagtggcctgttcagtgccacaacagaggagagtggcaatgaacaggccaaacctggcggcagcgcaaaagatg

SEQ ID NO: 112574 - DNA, 103 bp, Artificial Sequence
  Synthetic Polynucleotide
taatacgactcactatagggtctgatgacaccatggtcacagtggcctgtaacagaggagaacaggcatgtgtgaccataacctggcggcagcgcaaaagatg

SEQ ID NO: 112575 - DNA, 103 bp, Artificial Sequence
  Synthetic Polynucleotide
taatacgactcactatagggctcgatgtcctctgatgacaccatggtcacaacagaggagagtgaccatggtgtcatcaaacctggcggcagcgcaaaagatg

SEQ ID NO: 112576 - DNA, 103 bp, Artificial Sequence
  Synthetic Polynucleotide
taatacgactcactataggggctccaggatctcgatgtcctctgatgacaaacagaggagatgtcatatgaggacatcgaacctggcggcagcgcaaaagatg

SEQ ID NO: 112577 - DNA, 103 bp, Artificial Sequence
  Synthetic Polynucleotide
taatacgactcactatagggtcgcctgcatgctccaggatctcgatgtccaacagaggagaggacatatggatcctggaaacctggcggcagcgcaaaagatg

SEQ ID NO: 112578 - DNA, 103 bp, Artificial Sequence
  Synthetic Polynucleotide
taatacgactcactataggggatgaccagctcgcctgcatgctccaggataacagaggagaatcctgatgcatgcaggcaacctggcggcagcgcaaaagatg

SEQ ID NO: 112579 - DNA, 103 bp, Artificial Sequence
  Synthetic Polynucleotide
taatacgactcactataggggctggcaggccttctgaatcttgtgctgaaaacagaggagattcagcatgagattcagaaacctggcggcagcgcaaaagatg

SEQ ID NO: 112580 - DNA, 103 bp, Artificial Sequence
  Synthetic Polynucleotide
taatacgactcactatagggccggcgaggcgatgaccagctcgcctgcataacagaggagaatgcagatgagctggtcaaacctggcggcagcgcaaaagatg

SEQ ID NO: 112581 - DNA, 103 bp, Artificial Sequence
  Synthetic Polynucleotide
taatacgactcactatagggagctggccctccggcgaggcgatgaccagcaacagaggagagctggtatgcgcctcgccaacctggcggcagcgcaaaagatg

SEQ ID NO: 112582 - DNA, 103 bp, Artificial Sequence
  Synthetic Polynucleotide
taatacgactcactatagggctgcacctccagctggccctccggcgaggcaacagaggagagcctcgatggagggccagaacctggcggcagcgcaaaagatg

SEQ ID NO: 112583 - DNA, 103 bp, Artificial Sequence
  Synthetic Polynucleotide
taatacgactcactatagggcgatgaccgtctgcacctccagctggccctaacagaggagaagggccatgtggaggtgcaacctggcggcagcgcaaaagatg

SEQ ID NO: 112584 - DNA, 103 bp, Artificial Sequence
  Synthetic Polynucleotide
taatacgactcactatagggggaggggcccgctggcaggccttctgaatcaacagaggagagattcaatgggcctgccaaacctggcggcagcgcaaaagatg

SEQ ID NO: 112585 - DNA, 103 bp, Artificial Sequence
  Synthetic Polynucleotide
taatacgactcactatagggcagggcctccggaggggcccgctggcaggcaacagaggagagcctgcatgcgggcccctaacctggcggcagcgcaaaagatg

SEQ ID NO: 112586 - DNA, 103 bp, Artificial Sequence
  Synthetic Polynucleotide
taatacgactcactataggggggtggcaggcagggcctccggaggggcccaacagaggagagggcccatgcggaggcccaacctggcggcagcgcaaaagatg

SEQ ID NO: 112587 - DNA, 103 bp, Artificial Sequence
  Synthetic Polynucleotide
taatacgactcactataggggtggtggcaggggtggcaggcagggcctccaacagaggagaggaggcatggcctgccacaacctggcggcagcgcaaaagatg

SEQ ID NO: 112588 - DNA, 103 bp, Artificial Sequence
  Synthetic Polynucleotide
taatacgactcactatagggcagcaacgctgtggtggcaggggtggcaggaacagaggagacctgccatgcctgccaccaacctggcggcagcgcaaaagatg

SEQ ID NO: 112589 - DNA, 103 bp, Artificial Sequence
  Synthetic Polynucleotide
taatacgactcactatagggcctcctggcccagcaacgctgtggtggcagaacagaggagactgccaatgcagcgttgcaacctggcggcagcgcaaaagatg

SEQ ID NO: 112590 - DNA, 103 bp, Artificial Sequence
  Synthetic Polynucleotide
taatacgactcactataggggcttctgccgtatgagcggccgtcacccgcaacagaggagagcgggtatgggccgctcaaacctggcggcagcgcaaaagatg

SEQ ID NO: 112591 - DNA, 103 bp, Artificial Sequence
  Synthetic Polynucleotide
taatacgactcactataggggccggcaccacctcctggcccagcaacgctaacagaggagaagcgttatggggccaggaaacctggcggcagcgcaaaagatg

SEQ ID NO: 112592 - DNA, 103 bp, Artificial Sequence
  Synthetic Polynucleotide
taatacgactcactataggggcctggtgctgccggcaccacctcctggccaacagaggagaggccagatggtggtgccgaacctggcggcagcgcaaaagatg

SEQ ID NO: 112593 - DNA, 103 bp, Artificial Sequence
  Synthetic Polynucleotide
taatacgactcactataggggctcctctgggcctggtgctgccggcaccaaacagaggagatggtgcatgcagcaccagaacctggcggcagcgcaaaagatg

SEQ ID NO: 112594 - DNA, 103 bp, Artificial Sequence
  Synthetic Polynucleotide
taatacgactcactatagggacagtgatgggctcctctgggcctggtgctaacagaggagaagcaccatgcccagaggaaacctggcggcagcgcaaaagatg

SEQ ID NO: 112595 - DNA, 103 bp, Artificial Sequence
  Synthetic Polynucleotide
taatacgactcactataggggatgtgggccacagtgatgggctcctctggaacagaggagaccagagatgcccatcactaacctggcggcagcgcaaaagatg

SEQ ID NO: 112596 - DNA, 103 bp, Artificial Sequence
  Synthetic Polynucleotide
taatacgactcactatagggcctccaccacgatgtgggccacagtgatggaacagaggagaccatcaatgtggcccacaaacctggcggcagcgcaaaagatg

SEQ ID NO: 112597 - DNA, 103 bp, Artificial Sequence
  Synthetic Polynucleotide
taatacgactcactatagggagagaggccgcctccaccacgatgtgggccaacagaggagaggcccaatgcgtggtggaaacctggcggcagcgcaaaagatg

SEQ ID NO: 112598 - DNA, 103 bp, Artificial Sequence
  Synthetic Polynucleotide
taatacgactcactataggggtctgctgccagagaggccgcctccaccacaacagaggagagtggtgatggcggcctctaacctggcggcagcgcaaaagatg

SEQ ID NO: 112599 - DNA, 103 bp, Artificial Sequence
  Synthetic Polynucleotide
taatacgactcactatagggcgtggctgatgtctgctgccagagaggccgaacagaggagacggcctatgtggcagcagaacctggcggcagcgcaaaagatg

SEQ ID NO: 112600 - DNA, 103 bp, Artificial Sequence
  Synthetic Polynucleotide
taatacgactcactatagggaggtcagatgcgtggctgatgtctgctgccaacagaggagaggcagcatgcatcagccaaacctggcggcagcgcaaaagatg

SEQ ID NO: 112601 - DNA, 103 bp, Artificial Sequence
  Synthetic Polynucleotide
taatacgactcactatagggttcggcctgggcttctgccgtatgagcggcaacagaggagagccgctatgacggcagaaaacctggcggcagcgcaaaagatg

SEQ ID NO: 112602 - DNA, 103 bp, Artificial Sequence
  Synthetic Polynucleotide
taatacgactcactatagggaccaccaacaaggtcagatgcgtggctgataacagaggagaatcagcatggcatctgacaacctggcggcagcgcaaaagatg

SEQ ID NO: 112603 - DNA, 103 bp, Artificial Sequence
  Synthetic Polynucleotide
taatacgactcactatagggtgatgtgcccaccaccaacaaggtcagatgaacagaggagacatctgatgttgttggtgaacctggcggcagcgcaaaagatg

SEQ ID NO: 112604 - DNA, 103 bp, Artificial Sequence
  Synthetic Polynucleotide
taatacgactcactatagggatgacctctttgatgtgcccaccaccaacaaacagaggagatgttggatgtgggcacataacctggcggcagcgcaaaagatg

SEQ ID NO: 112605 - DNA, 103 bp, Artificial Sequence
  Synthetic Polynucleotide
taatacgactcactatagggagcagccacgatgacctctttgatgtgcccaacagaggagagggcacatgaaagaggtcaacctggcggcagcgcaaaagatg

SEQ ID NO: 112606 - DNA, 103 bp, Artificial Sequence
  Synthetic Polynucleotide
taatacgactcactataggggctccgcctcagcagccacgatgacctcttaacagaggagaaagaggatgtcgtggctgaacctggcggcagcgcaaaagatg

SEQ ID NO: 112607 - DNA, 103 bp, Artificial Sequence
  Synthetic Polynucleotide
taatacgactcactatagggccgtctcccagctccgcctcagcagccacgaacagaggagacgtggcatgtgaggcggaaacctggcggcagcgcaaaagatg

SEQ ID NO: 112608 - DNA, 103 bp, Artificial Sequence
  Synthetic Polynucleotide
taatacgactcactatagggggccatctcaccgtctcccagctccgcctcaacagaggagagaggcgatgctgggagacaacctggcggcagcgcaaaagatg

SEQ ID NO: 112609 - DNA, 103 bp, Artificial Sequence
  Synthetic Polynucleotide
taatacgactcactatagggccggggcctcggccatctcaccgtctcccaaacagaggagatgggagatggtgagatggaacctggcggcagcgcaaaagatg

SEQ ID NO: 112610 - DNA, 103 bp, Artificial Sequence
  Synthetic Polynucleotide
taatacgactcactatagggcgggggctgcccggggcctcggccatctcaaacagaggagatgagatatgcgaggccccaacctggcggcagcgcaaaagatg

SEQ ID NO: 112611 - DNA, 103 bp, Artificial Sequence
  Synthetic Polynucleotide
taatacgactcactatagggcccctgctggcgggggctgcccggggcctcaacagaggagagaggccatgggcagccccaacctggcggcagcgcaaaagatg

SEQ ID NO: 112612 - DNA, 103 bp, Artificial Sequence
  Synthetic Polynucleotide
taatacgactcactatagggcccgcccggcttcggcctgggcttctgccgaacagaggagacggcagatgcccaggccgaacctggcggcagcgcaaaagatg

SEQ ID NO: 112613 - DNA, 103 bp, Artificial Sequence
  Synthetic Polynucleotide
taatacgactcactatagggcgagccccagcccctgctggcgggggctgcaacagaggagagcagccatggccagcaggaacctggcggcagcgcaaaagatg

SEQ ID NO: 112614 - DNA, 103 bp, Artificial Sequence
  Synthetic Polynucleotide
taatacgactcactatagggccctcccctgcgagccccagcccctgctggaacagaggagaccagcaatggctggggctaacctggcggcagcgcaaaagatg

SEQ ID NO: 112615 - DNA, 103 bp, Artificial Sequence
  Synthetic Polynucleotide
taatacgactcactatagggggcctgctcaccctcccctgcgagccccagaacagaggagactggggatggcaggggagaacctggcggcagcgcaaaagatg

SEQ ID NO: 112616 - DNA, 103 bp, Artificial Sequence
  Synthetic Polynucleotide
taatacgactcactataggggcttcacctgggcctgctcaccctcccctgaacagaggagacaggggatggtgagcaggaacctggcggcagcgcaaaagatg

SEQ ID NO: 112617 - DNA, 103 bp, Artificial Sequence
  Synthetic Polynucleotide
taatacgactcactatagggttcaccagtagcttcacctgggcctgctcaaacagaggagatgagcaatgccaggtgaaaacctggcggcagcgcaaaagatg

SEQ ID NO: 112618 - DNA, 103 bp, Artificial Sequence
  Synthetic Polynucleotide
taatacgactcactataggggccatccttgttcaccagtagcttcacctgaacagaggagacaggtgatgctactggtgaacctggcggcagcgcaaaagatg

SEQ ID NO: 112619 - DNA, 103 bp, Artificial Sequence
  Synthetic Polynucleotide
taatacgactcactatagggacacatagcggccatccttgttcaccagtaaacagaggagatactggatgacaaggatgaacctggcggcagcgcaaaagatg

SEQ ID NO: 112620 - DNA, 103 bp, Artificial Sequence
  Synthetic Polynucleotide
taatacgactcactatagggcacagcgcacacacatagcggccatccttgaacagaggagacaaggaatgccgctatgtaacctggcggcagcgcaaaagatg

SEQ ID NO: 112621 - DNA, 103 bp, Artificial Sequence
  Synthetic Polynucleotide
taatacgactcactatagggggtcttgtggcacagcgcacacacatagcgaacagaggagacgctatatgtgtgcgctgaacctggcggcagcgcaaaagatg

SEQ ID NO: 112622 - DNA, 103 bp, Artificial Sequence
  Synthetic Polynucleotide
taatacgactcactatagggccgtcttgaaggtcttgtggcacagcgcacaacagaggagagtgcgcatggccacaagaaacctggcggcagcgcaaaagatg

SEQ ID NO: 112623 - DNA, 103 bp, Artificial Sequence
  Synthetic Polynucleotide
taatacgactcactatagggtcgcccgcttcccgcccggcttcggcctggaacagaggagaccaggcatgagccgggcgaacctggcggcagcgcaaaagatg

SEQ ID NO: 112624 - DNA, 103 bp, Artificial Sequence
  Synthetic Polynucleotide
taatacgactcactatagggaggatgctgcccgtcttgaaggtcttgtggaacagaggagaccacaaatgcttcaagacaacctggcggcagcgcaaaagatg

SEQ ID NO: 112625 - DNA, 103 bp, Artificial Sequence
  Synthetic Polynucleotide
taatacgactcactataggggtgggccttgaggatgctgcccgtcttgaaaacagaggagattcaagatgggcagcatcaacctggcggcagcgcaaaagatg

SEQ ID NO: 112626 - DNA, 103 bp, Artificial Sequence
  Synthetic Polynucleotide
taatacgactcactataggggagtgaccatgtgggccttgaggatgctgcaacagaggagagcagcaatgtcaaggcccaacctggcggcagcgcaaaagatg

SEQ ID NO: 112627 - DNA, 103 bp, Artificial Sequence
  Synthetic Polynucleotide
taatacgactcactatagggcggctgctgtgagtgaccatgtgggccttgaacagaggagacaaggcatgcatggtcacaacctggcggcagcgcaaaagatg

SEQ ID NO: 112628 - DNA, 103 bp, Artificial Sequence
  Synthetic Polynucleotide
taatacgactcactataggggtggtccttgcggctgctgtgagtgaccataacagaggagaatggtcatgcacagcagcaacctggcggcagcgcaaaagatg

SEQ ID NO: 112629 - DNA, 103 bp, Artificial Sequence
  Synthetic Polynucleotide
taatacgactcactataggggcttgcactcgtggtccttgcggctgctgtaacagaggagaacagcaatggcaaggaccaacctggcggcagcgcaaaagatg

SEQ ID NO: 112630 - DNA, 103 bp, Artificial Sequence
  Synthetic Polynucleotide
taatacgactcactataggggccccacagagcttgcactcgtggtccttgaacagaggagacaaggaatgcgagtgcaaaacctggcggcagcgcaaaagatg

SEQ ID NO: 112631 - DNA, 103 bp, Artificial Sequence
  Synthetic Polynucleotide
taatacgactcactataggggcggaaggaggccccacagagcttgcactcaacagaggagagagtgcatgctctgtgggaacctggcggcagcgcaaaagatg

SEQ ID NO: 112632 - DNA, 103 bp, Artificial Sequence
  Synthetic Polynucleotide
taatacgactcactatagggagcccttggtgcggaaggaggccccacagaaacagaggagatctgtgatgcctccttccaacctggcggcagcgcaaaagatg

SEQ ID NO: 112633 - DNA, 103 bp, Artificial Sequence
  Synthetic Polynucleotide
taatacgactcactatagggcggatgagtgagcccttggtgcggaaggagaacagaggagactccttatgcaccaagggaacctggcggcagcgcaaaagatg

SEQ ID NO: 112634 - DNA, 103 bp, Artificial Sequence
  Synthetic Polynucleotide
taatacgactcactatagggaactgcaccctcgcccgcttcccgcccggcaacagaggagagccgggatggaagcgggcaacctggcggcagcgcaaaagatg

SEQ ID NO: 112635 - DNA, 103 bp, Artificial Sequence
  Synthetic Polynucleotide
taatacgactcactatagggccggtggtgccggatgagtgagcccttggtaacagaggagaaccaagatgtcactcatcaacctggcggcagcgcaaaagatg

SEQ ID NO: 112636 - DNA, 103 bp, Artificial Sequence
  Synthetic Polynucleotide
taatacgactcactatagggccgtgtgccgccggtggtgccggatgagtgaacagaggagacactcaatgggcaccaccaacctggcggcagcgcaaaagatg

SEQ ID NO: 112637 - DNA, 103 bp, Artificial Sequence
  Synthetic Polynucleotide
taatacgactcactataggggggcgctcatccgtgtgccgccggtggtgcaacagaggagagcaccaatggcggcacacaacctggcggcagcgcaaaagatg

SEQ ID NO: 112638 - DNA, 103 bp, Artificial Sequence
  Synthetic Polynucleotide
taatacgactcactataggggcacttgtaggggcgctcatccgtgtgccgaacagaggagacggcacatggatgagcgcaacctggcggcagcgcaaaagatg

SEQ ID NO: 112639 - DNA, 103 bp, Artificial Sequence
  Synthetic Polynucleotide
taatacgactcactatagggcacacttggagcacttgtaggggcgctcataacagaggagaatgagcatgcctacaagtaacctggcggcagcgcaaaagatg

SEQ ID NO: 112640 - DNA, 103 bp, Artificial Sequence
  Synthetic Polynucleotide
taatacgactcactatagggaagctctttccacacttggagcacttgtagaacagaggagactacaaatgctccaagtgaacctggcggcagcgcaaaagatg

SEQ ID NO: 112641 - DNA, 103 bp, Artificial Sequence
  Synthetic Polynucleotide
taatacgactcactatagggcgactcccggaagctctttccacacttggaaacagaggagatccaagatgggaaagagcaacctggcggcagcgcaaaagatg

SEQ ID NO: 112642 - DNA, 103 bp, Artificial Sequence
  Synthetic Polynucleotide
taatacgactcactatagggtcagtgcacccgactcccggaagctctttcaacagaggagagaaagaatgtccgggagtaacctggcggcagcgcaaaagatg

SEQ ID NO: 112643 - DNA, 103 bp, Artificial Sequence
  Synthetic Polynucleotide
taatacgactcactatagggaggtgccgggtcagtgcacccgactcccggaacagaggagaccgggaatggggtgcactaacctggcggcagcgcaaaagatg

SEQ ID NO: 112644 - DNA, 103 bp, Artificial Sequence
  Synthetic Polynucleotide
taatacgactcactataggggagagacttgaggtgccgggtcagtgcaccaacagaggagaggtgcaatgacccggcacaacctggcggcagcgcaaaagatg

SEQ ID NO: 112645 - DNA, 103 bp, Artificial Sequence
  Synthetic Polynucleotide
taatacgactcactatagggccaccgccgcaactgcaccctcgcccgcttaacagaggagaaagcggatgagggtgcagaacctggcggcagcgcaaaagatg

SEQ ID NO: 112646 - DNA, 103 bp, Artificial Sequence
  Synthetic Polynucleotide
taatacgactcactatagggtgcagggggtgagagacttgaggtgccgggaacagaggagacccggcatgtcaagtctcaacctggcggcagcgcaaaagatg

SEQ ID NO: 112647 - DNA, 103 bp, Artificial Sequence
  Synthetic Polynucleotide
taatacgactcactatagggattttctctgtgcagggggtgagagacttgaacagaggagacaagtcatgcaccccctgaacctggcggcagcgcaaaagatg

SEQ ID NO: 112648 - DNA, 103 bp, Artificial Sequence
  Synthetic Polynucleotide
taatacgactcactatagggactgaagcggattttctctgtgcagggggtaacagaggagaacccccatgacagagaaaaacctggcggcagcgcaaaagatg

SEQ ID NO: 112649 - DNA, 103 bp, Artificial Sequence
  Synthetic Polynucleotide
taatacgactcactatagggccttgctcacactgaagcggattttctctgaacagaggagacagagaatgtccgcttcaaacctggcggcagcgcaaaagatg

SEQ ID NO: 112650 - DNA, 103 bp, Artificial Sequence
  Synthetic Polynucleotide
taatacgactcactatagggacaaccacgtccttgctcacactgaagcggaacagaggagaccgcttatgtgtgagcaaaacctggcggcagcgcaaaagatg

SEQ ID NO: 112651 - DNA, 103 bp, Artificial Sequence
  Synthetic Polynucleotide
taatacgactcactatagggctctttgctgacaaccacgtccttgctcacaacagaggagagtgagcatggacgtggttaacctggcggcagcgcaaaagatg

SEQ ID NO: 112652 - DNA, 103 bp, Artificial Sequence
  Synthetic Polynucleotide
taatacgactcactatagggcacgtgcgtcctctttgctgacaaccacgtaacagaggagaacgtggatgtcagcaaagaacctggcggcagcgcaaaagatg

SEQ ID NO: 112653 - DNA, 103 bp, Artificial Sequence
  Synthetic Polynucleotide
taatacgactcactatagggccagaacctgcacgtgcgtcctctttgctgaacagaggagacagcaaatgggacgcacgaacctggcggcagcgcaaaagatg

SEQ ID NO: 112654 - DNA, 103 bp, Artificial Sequence
  Synthetic Polynucleotide
taatacgactcactatagggagctccagctccagaacctgcacgtgcgtcaacagaggagagacgcaatggcaggttctaacctggcggcagcgcaaaagatg

SEQ ID NO: 112655 - DNA, 103 bp, Artificial Sequence
  Synthetic Polynucleotide
taatacgactcactatagggccaagccggcagctccagctccagaacctgaacagaggagacaggttatggagctggagaacctggcggcagcgcaaaagatg

SEQ ID NO: 112656 - DNA, 103 bp, Artificial Sequence
  Synthetic Polynucleotide
taatacgactcactatagggaaggccgccgccaccgccgcaactgcacccaacagaggagagggtgcatgtgcggcggtaacctggcggcagcgcaaaagatg

SEQ ID NO: 112657 - DNA, 103 bp, Artificial Sequence
  Synthetic Polynucleotide
taatacgactcactataggggtggctgtccccaagccggcagctccagctaacagaggagaagctggatgtgccggcttaacctggcggcagcgcaaaagatg

SEQ ID NO: 112658 - DNA, 103 bp, Artificial Sequence
  Synthetic Polynucleotide
taatacgactcactatagggcaccgatgatgtggctgtccccaagccggcaacagaggagagccggcatggggacagccaacctggcggcagcgcaaaagatg

SEQ ID NO: 112659 - DNA, 103 bp, Artificial Sequence
  Synthetic Polynucleotide
taatacgactcactataggggctcgcctgtcaccgatgatgtggctgtccaacagaggagaggacagatgcatcatcggaacctggcggcagcgcaaaagatg

SEQ ID NO: 112660 - DNA, 103 bp, Artificial Sequence
  Synthetic Polynucleotide
taatacgactcactataggggtctctataggctcgcctgtcaccgatgataacagaggagaatcatcatggacaggcgaaacctggcggcagcgcaaaagatg

SEQ ID NO: 112661 - DNA, 103 bp, Artificial Sequence
  Synthetic Polynucleotide
taatacgactcactatagggcacgggtgaagtctctataggctcgcctgtaacagaggagaacaggcatgcctatagagaacctggcggcagcgcaaaagatg

SEQ ID NO: 112662 - DNA, 103 bp, Artificial Sequence
  Synthetic Polynucleotide
taatacgactcactatagggccaggtgaatcacgggtgaagtctctatagaacagaggagactatagatgcttcacccgaacctggcggcagcgcaaaagatg

SEQ ID NO: 112663 - DNA, 103 bp, Artificial Sequence
  Synthetic Polynucleotide
taatacgactcactataggggcatctgtcaccaggtgaatcacgggtgaaaacagaggagattcaccatggattcacctaacctggcggcagcgcaaaagatg

SEQ ID NO: 112664 - DNA, 103 bp, Artificial Sequence
  Synthetic Polynucleotide
taatacgactcactatagggggtgcccttggcatctgtcaccaggtgaataacagaggagaattcacatggtgacagataacctggcggcagcgcaaaagatg

SEQ ID NO: 112665 - DNA, 103 bp, Artificial Sequence
  Synthetic Polynucleotide
taatacgactcactatagggcgtggatgacggtgcccttggcatctgtcaaacagaggagatgacagatgccaagggcaaacctggcggcagcgcaaaagatg

SEQ ID NO: 112666 - DNA, 103 bp, Artificial Sequence
  Synthetic Polynucleotide
taatacgactcactatagggacgtggacttcgtggatgacggtgcccttgaacagaggagacaagggatgcgtcatccaaacctggcggcagcgcaaaagatg

SEQ ID NO: 112667 - DNA, 103 bp, Artificial Sequence
  Synthetic Polynucleotide
taatacgactcactatagggtaggtgtgagaatcccgctgcgctattcataacagaggagaatgaatatggcagcgggaaacctggcggcagcgcaaaagatg

SEQ ID NO: 112668 - DNA, 103 bp, Artificial Sequence
  Synthetic Polynucleotide
taatacgactcactatagggaggtttgaagtcatagcgcacagtgtggaaaacagaggagattccacatggtgcgctataacctggcggcagcgcaaaagatg

SEQ ID NO: 112669 - DNA, 103 bp, Artificial Sequence
  Synthetic Polynucleotide
taatacgactcactatagggcaatagaagcaggtttgaagtcatagcgcaaacagaggagatgcgctatgacttcaaacaacctggcggcagcgcaaaagatg

SEQ ID NO: 112670 - DNA, 103 bp, Artificial Sequence
  Synthetic Polynucleotide
taatacgactcactataggggaagaagtgtcaatagaagcaggtttgaagaacagaggagacttcaaatgtgcttctataacctggcggcagcgcaaaagatg

SEQ ID NO: 112671 - DNA, 103 bp, Artificial Sequence
  Synthetic Polynucleotide
taatacgactcactataggggtatccttcagaagaagtgtcaatagaagcaacagaggagagcttctatggacacttctaacctggcggcagcgcaaaagatg

SEQ ID NO: 112672 - DNA, 103 bp, Artificial Sequence
  Synthetic Polynucleotide
taatacgactcactatagggcaacctcaaggtatccttcagaagaagtgtaacagaggagaacacttatgctgaaggataacctggcggcagcgcaaaagatg

SEQ ID NO: 112673 - DNA, 103 bp, Artificial Sequence
  Synthetic Polynucleotide
taatacgactcactatagggtcaccttcaccaacctcaaggtatccttcaaacagaggagatgaaggatgccttgaggtaacctggcggcagcgcaaaagatg

SEQ ID NO: 112674 - DNA, 103 bp, Artificial Sequence
  Synthetic Polynucleotide
taatacgactcactatagggggtcacctgttcaccttcaccaacctcaagaacagaggagacttgagatgggtgaaggtaacctggcggcagcgcaaaagatg

SEQ ID NO: 112675 - DNA, 103 bp, Artificial Sequence
  Synthetic Polynucleotide
taatacgactcactataggggcagagttatggtcacctgttcaccttcacaacagaggagagtgaagatgaacaggtgaaacctggcggcagcgcaaaagatg

SEQ ID NO: 112676 - DNA, 103 bp, Artificial Sequence
  Synthetic Polynucleotide
taatacgactcactatagggtctatatttggcagagttatggtcacctgtaacagaggagaacaggtatgcataactctaacctggcggcagcgcaaaagatg

SEQ ID NO: 112677 - DNA, 103 bp, Artificial Sequence
  Synthetic Polynucleotide
taatacgactcactatagggagttgaaccttctatatttggcagagttataacagaggagaataactatgccaaatataaacctggcggcagcgcaaaagatg

SEQ ID NO: 112678 - DNA, 103 bp, Artificial Sequence
  Synthetic Polynucleotide
taatacgactcactatagggcgcgacggtctaggtgtgagaatcccgctgaacagaggagacagcggatgtctcacaccaacctggcggcagcgcaaaagatg

SEQ ID NO: 112679 - DNA, 103 bp, Artificial Sequence
  Synthetic Polynucleotide
taatacgactcactatagggttactggtggagttgaaccttctatatttgaacagaggagacaaataatgaaggttcaaaacctggcggcagcgcaaaagatg

SEQ ID NO: 112680 - DNA, 103 bp, Artificial Sequence
  Synthetic Polynucleotide
taatacgactcactatagggttgaaaacagttactggtggagttgaacctaacagaggagaaggttcatgtccaccagtaacctggcggcagcgcaaaagatg

SEQ ID NO: 112681 - DNA, 103 bp, Artificial Sequence
  Synthetic Polynucleotide
taatacgactcactatagggttttgaacctttgaaaacagttactggtggaacagaggagaccaccaatgactgttttcaacctggcggcagcgcaaaagatg

SEQ ID NO: 112682 - DNA, 103 bp, Artificial Sequence
  Synthetic Polynucleotide
taatacgactcactatagggagtaaggtttttttgaacctttgaaaacagaacagaggagactgtttatgaaggttcaaaacctggcggcagcgcaaaagatg

SEQ ID NO: 112683 - DNA, 103 bp, Artificial Sequence
  Synthetic Polynucleotide
taatacgactcactatagggcattcttttaagtaaggtttttttgaacctaacagaggagaaggttcatgaaaaccttaaacctggcggcagcgcaaaagatg

SEQ ID NO: 112684 - DNA, 103 bp, Artificial Sequence
  Synthetic Polynucleotide
taatacgactcactatagggaatcaaaatgcattcttttaagtaaggtttaacagaggagaaaacctatgttaaaagaaaacctggcggcagcgcaaaagatg

SEQ ID NO: 112685 - DNA, 103 bp, Artificial Sequence
  Synthetic Polynucleotide
taatacgactcactatagggcatggttaataatcaaaatgcattcttttaaacagaggagataaaagatggcattttgaaacctggcggcagcgcaaaagatg

SEQ ID NO: 112686 - DNA, 103 bp, Artificial Sequence
  Synthetic Polynucleotide
taatacgactcactatagggtctccagtatcatggttaataatcaaaatgaacagaggagacattttatgtattaaccaaacctggcggcagcgcaaaagatg

SEQ ID NO: 112687 - DNA, 103 bp, Artificial Sequence
  Synthetic Polynucleotide
taatacgactcactatagggtagccgacattctccagtatcatggttaataacagaggagaattaacatggatactggaaacctggcggcagcgcaaaagatg

SEQ ID NO: 112688 - DNA, 103 bp, Artificial Sequence
  Synthetic Polynucleotide
taatacgactcactatagggtgagtttttctagccgacattctccagtataacagaggagaatactgatgaatgtcggcaacctggcggcagcgcaaaagatg

SEQ ID NO: 112689 - DNA, 103 bp, Artificial Sequence
  Synthetic Polynucleotide
taatacgactcactatagggagaacccgctcgcgacggtctaggtgtgagaacagaggagactcacaatgagaccgtcgaacctggcggcagcgcaaaagatg

SEQ ID NO: 112690 - DNA, 103 bp, Artificial Sequence
  Synthetic Polynucleotide
taatacgactcactatagggatgttgctgctgagtttttctagccgacataacagaggagaatgtcgatgagaaaaactaacctggcggcagcgcaaaagatg

SEQ ID NO: 112691 - DNA, 103 bp, Artificial Sequence
  Synthetic Polynucleotide
taatacgactcactatagggttttacagtgatgttgctgctgagtttttcaacagaggagagaaaaaatgagcagcaacaacctggcggcagcgcaaaagatg

SEQ ID NO: 112692 - DNA, 103 bp, Artificial Sequence
  Synthetic Polynucleotide
taatacgactcactatagggctcttgttttttttacagtgatgttgctgcaacagaggagagcagcaatgtcactgtaaaacctggcggcagcgcaaaagatg

SEQ ID NO: 112693 - DNA, 103 bp, Artificial Sequence
  Synthetic Polynucleotide
taatacgactcactatagggcttccttcaactcttgttttttttacagtgaacagaggagacactgtatgaaaaacaagaacctggcggcagcgcaaaagatg

SEQ ID NO: 112694 - DNA, 103 bp, Artificial Sequence
  Synthetic Polynucleotide
taatacgactcactatagggaattttactgcttccttcaactcttgttttaacagaggagaaaaacaatggttgaaggaaacctggcggcagcgcaaaagatg

SEQ ID NO: 112695 - DNA, 103 bp, Artificial Sequence
  Synthetic Polynucleotide
taatacgactcactatagggtacgatactgaattttactgcttccttcaaaacagaggagattgaagatggcagtaaaaaacctggcggcagcgcaaaagatg

SEQ ID NO: 112696 - DNA, 103 bp, Artificial Sequence
  Synthetic Polynucleotide
taatacgactcactatagggtgttgttctttacgatactgaattttactgaacagaggagacagtaaatgtcagtatcgaacctggcggcagcgcaaaagatg

SEQ ID NO: 112697 - DNA, 103 bp, Artificial Sequence
  Synthetic Polynucleotide
taatacgactcactatagggttgttgttgctgttgttctttacgatactgaacagaggagacagtatatgaaagaacaaaacctggcggcagcgcaaaagatg

SEQ ID NO: 112698 - DNA, 103 bp, Artificial Sequence
  Synthetic Polynucleotide
taatacgactcactatagggaattccacatttgttgttgctgttgttcttaacagaggagaaagaacatgagcaacaacaacctggcggcagcgcaaaagatg

SEQ ID NO: 112699 - DNA, 103 bp, Artificial Sequence
  Synthetic Polynucleotide
taatacgactcactataggggtcctggctgaattccacatttgttgttgcaacagaggagagcaacaatgaatgtggaaaacctggcggcagcgcaaaagatg

SEQ ID NO: 112700 - DNA, 103 bp, Artificial Sequence
  Synthetic Polynucleotide
taatacgactcactatagggccctaacttgagaacccgctcgcgacggtcaacagaggagagaccgtatggagcgggttaacctggcggcagcgcaaaagatg

SEQ ID NO: 112701 - DNA, 103 bp, Artificial Sequence
  Synthetic Polynucleotide
taatacgactcactatagggaagattgggagtcctggctgaattccacataacagaggagaatgtggatgtcagccaggaacctggcggcagcgcaaaagatg

SEQ ID NO: 112702 - DNA, 103 bp, Artificial Sequence
  Synthetic Polynucleotide
taatacgactcactatagggaatgttttacaagattgggagtcctggctgaacagaggagacagccaatgctcccaatcaacctggcggcagcgcaaaagatg

SEQ ID NO: 112703 - DNA, 103 bp, Artificial Sequence
  Synthetic Polynucleotide
taatacgactcactatagggtcagatggagaatgttttacaagattgggaaacagaggagatcccaaatgtgtaaaacaaacctggcggcagcgcaaaagatg

SEQ ID NO: 112704 - DNA, 103 bp, Artificial Sequence
  Synthetic Polynucleotide
taatacgactcactatagggcatcttatcttcagatggagaatgttttacaacagaggagagtaaaaatgtctccatctaacctggcggcagcgcaaaagatg

SEQ ID NO: 112705 - DNA, 103 bp, Artificial Sequence
  Synthetic Polynucleotide
taatacgactcactatagggatgctggggacatcttatcttcagatggagaacagaggagactccatatgaagataagaaacctggcggcagcgcaaaagatg

SEQ ID NO: 112706 - DNA, 103 bp, Artificial Sequence
  Synthetic Polynucleotide
taatacgactcactatagggtctattggagatgctggggacatcttatctaacagaggagaagataaatggtccccagcaacctggcggcagcgcaaaagatg

SEQ ID NO: 112707 - DNA, 103 bp, Artificial Sequence
  Synthetic Polynucleotide
taatacgactcactatagggttcgatatcatctattggagatgctggggaaacagaggagatccccaatgtctccaataaacctggcggcagcgcaaaagatg

SEQ ID NO: 112708 - DNA, 103 bp, Artificial Sequence
  Synthetic Polynucleotide
taatacgactcactatagggtcagttctctttcgatatcatctattggagaacagaggagactccaaatgatgatatcgaacctggcggcagcgcaaaagatg

SEQ ID NO: 112709 - DNA, 103 bp, Artificial Sequence
  Synthetic Polynucleotide
taatacgactcactataggggcttctgccttcagttctctttcgatatcaaacagaggagatgatatatgaagagaactaacctggcggcagcgcaaaagatg

SEQ ID NO: 112710 - DNA, 103 bp, Artificial Sequence
  Synthetic Polynucleotide
taatacgactcactatagggcattagactagcttctgccttcagttctctaacagaggagaagagaaatgaaggcagaaaacctggcggcagcgcaaaagatg

SEQ ID NO: 112711 - DNA, 103 bp, Artificial Sequence
  Synthetic Polynucleotide
taatacgactcactatagggcgaaactctcccctaacttgagaacccgctaacagaggagaagcgggatgtcaagttagaacctggcggcagcgcaaaagatg

SEQ ID NO: 112712 - DNA, 103 bp, Artificial Sequence
  Synthetic Polynucleotide
taatacgactcactatagggtcatctggtccattagactagcttctgcctaacagaggagaaggcagatgctagtctaaaacctggcggcagcgcaaaagatg

SEQ ID NO: 112713 - DNA, 103 bp, Artificial Sequence
  Synthetic Polynucleotide
taatacgactcactatagggtcacaactactcatctggtccattagactaaacagaggagatagtctatgggaccagataacctggcggcagcgcaaaagatg

SEQ ID NO: 112714 - DNA, 103 bp, Artificial Sequence
  Synthetic Polynucleotide
taatacgactcactatagggtgatgaactatcacaactactcatctggtcaacagaggagagaccagatgagtagttgtaacctggcggcagcgcaaaagatg

SEQ ID NO: 112715 - DNA, 103 bp, Artificial Sequence
  Synthetic Polynucleotide
taatacgactcactatagggttttggaatctgatgaactatcacaactacaacagaggagagtagttatgatagttcataacctggcggcagcgcaaaagatg

SEQ ID NO: 112716 - DNA, 103 bp, Artificial Sequence
  Synthetic Polynucleotide
taatacgactcactataggggatgatgaacttttggaatctgatgaactaaacagaggagatagttcatgagattccaaaacctggcggcagcgcaaaagatg

SEQ ID NO: 112717 - DNA, 103 bp, Artificial Sequence
  Synthetic Polynucleotide
taatacgactcactatagggactacttgaagatgatgaacttttggaatcaacagaggagagattccatgagttcatcaaacctggcggcagcgcaaaagatg

SEQ ID NO: 112718 - DNA, 103 bp, Artificial Sequence
  Synthetic Polynucleotide
taatacgactcactatagggaactatcctcactacttgaagatgatgaacaacagaggagagttcatatgcttcaagtaaacctggcggcagcgcaaaagatg

SEQ ID NO: 112719 - DNA, 103 bp, Artificial Sequence
  Synthetic Polynucleotide
taatacgactcactataggggagtcactagaactatcctcactacttgaaaacagaggagattcaagatgtgaggatagaacctggcggcagcgcaaaagatg

SEQ ID NO: 112720 - DNA, 103 bp, Artificial Sequence
  Synthetic Polynucleotide
taatacgactcactatagggttcatcttctgagtcactagaactatcctcaacagaggagagaggatatgtctagtgacaacctggcggcagcgcaaaagatg

SEQ ID NO: 112721 - DNA, 103 bp, Artificial Sequence
  Synthetic Polynucleotide
taatacgactcactatagggatttgcaatcttcatcttctgagtcactagaacagaggagactagtgatgcagaagatgaacctggcggcagcgcaaaagatg

SEQ ID NO: 112722 - DNA, 103 bp, Artificial Sequence
  Synthetic Polynucleotide
taatacgactcactatagggggctgcttctcgaaactctcccctaacttgaacagaggagacaagttatgggagagtttaacctggcggcagcgcaaaagatg

SEQ ID NO: 112723 - DNA, 103 bp, Artificial Sequence
  Synthetic Polynucleotide
taatacgactcactataggggaagtagaggatttgcaatcttcatcttctaacagaggagaagaagaatgagattgcaaaacctggcggcagcgcaaaagatg

SEQ ID NO: 112724 - DNA, 103 bp, Artificial Sequence
  Synthetic Polynucleotide
taatacgactcactatagggccctgtatcagaagtagaggatttgcaatcaacagaggagagattgcatgtcctctactaacctggcggcagcgcaaaagatg

SEQ ID NO: 112725 - DNA, 103 bp, Artificial Sequence
  Synthetic Polynucleotide
taatacgactcactatagggagacacaattccctgtatcagaagtagaggaacagaggagacctctaatgctgatacagaacctggcggcagcgcaaaagatg

SEQ ID NO: 112726 - DNA, 103 bp, Artificial Sequence
  Synthetic Polynucleotide
taatacgactcactatagggggatgtcctgagacacaattccctgtatcaaacagaggagatgatacatggaattgtgtaacctggcggcagcgcaaaagatg

SEQ ID NO: 112727 - DNA, 103 bp, Artificial Sequence
  Synthetic Polynucleotide
taatacgactcactatagggtgtcatggtaggatgtcctgagacacaattaacagaggagaaattgtatgtcaggacataacctggcggcagcgcaaaagatg

SEQ ID NO: 112728 - DNA, 103 bp, Artificial Sequence
  Synthetic Polynucleotide
taatacgactcactatagggtcctgtactgtgtcatggtaggatgtcctgaacagaggagacaggacatgctaccatgaaacctggcggcagcgcaaaagatg

SEQ ID NO: 112729 - DNA, 103 bp, Artificial Sequence
  Synthetic Polynucleotide
taatacgactcactatagggatatcaggaatcctgtactgtgtcatggtaaacagaggagataccatatgacagtacagaacctggcggcagcgcaaaagatg

SEQ ID NO: 112730 - DNA, 103 bp, Artificial Sequence
  Synthetic Polynucleotide
taatacgactcactatagggactggcatctatatcaggaatcctgtactgaacagaggagacagtacatgattcctgataacctggcggcagcgcaaaagatg

SEQ ID NO: 112731 - DNA, 103 bp, Artificial Sequence
  Synthetic Polynucleotide
taatacgactcactatagggatctattatgactggcatctatatcaggaaaacagaggagattcctgatgtagatgccaaacctggcggcagcgcaaaagatg

SEQ ID NO: 112732 - DNA, 103 bp, Artificial Sequence
  Synthetic Polynucleotide
taatacgactcactatagggttgtctcgaaatctattatgactggcatctaacagaggagaagatgcatgtcataatagaacctggcggcagcgcaaaagatg

SEQ ID NO: 112733 - DNA, 103 bp, Artificial Sequence
  Synthetic Polynucleotide
taatacgactcactatagggggcgcagcgcggctgcttctcgaaactctcaacagaggagagagagtatggagaagcagaacctggcggcagcgcaaaagatg

SEQ ID NO: 112734 - DNA, 103 bp, Artificial Sequence
  Synthetic Polynucleotide
taatacgactcactatagggaaggccactgttgtctcgaaatctattatgaacagaggagacataatatgtttcgagacaacctggcggcagcgcaaaagatg

SEQ ID NO: 112735 - DNA, 103 bp, Artificial Sequence
  Synthetic Polynucleotide
taatacgactcactatagggtattcatcagaaggccactgttgtctcgaaaacagaggagattcgagatgacagtggccaacctggcggcagcgcaaaagatg

SEQ ID NO: 112736 - DNA, 103 bp, Artificial Sequence
  Synthetic Polynucleotide
taatacgactcactatagggtttcttaaagtattcatcagaaggccactgaacagaggagacagtggatgtctgatgaaaacctggcggcagcgcaaaagatg

SEQ ID NO: 112737 - DNA, 103 bp, Artificial Sequence
  Synthetic Polynucleotide
taatacgactcactatagggctgcaaatcatttcttaaagtattcatcagaacagaggagactgatgatgactttaagaaacctggcggcagcgcaaaagatg

SEQ ID NO: 112738 - DNA, 103 bp, Artificial Sequence
  Synthetic Polynucleotide
taatacgactcactatagggattcactcagctgcaaatcatttcttaaagaacagaggagactttaaatgatgatttgcaacctggcggcagcgcaaaagatg

SEQ ID NO: 112739 - DNA, 103 bp, Artificial Sequence
  Synthetic Polynucleotide
taatacgactcactatagggtcacttcctgattcactcagctgcaaatcaaacagaggagatgatttatggctgagtgaaacctggcggcagcgcaaaagatg

SEQ ID NO: 112740 - DNA, 103 bp, Artificial Sequence
  Synthetic Polynucleotide
taatacgactcactataggggtcatcactgtcacttcctgattcactcagaacagaggagactgagtatgtcaggaagtaacctggcggcagcgcaaaagatg

SEQ ID NO: 112741 - DNA, 103 bp, Artificial Sequence
  Synthetic Polynucleotide
taatacgactcactatagggcagtgtggaaggcgcagcgcggctgcttctaacagaggagaagaagcatgcgcgctgcgaacctggcggcagcgcaaaagatg

SEQ ID NO: 112742 - DNA, 103 bp, Artificial Sequence
  Synthetic Polynucleotide
taatacgactcactatagggtcatagcgcacagtgtggaaggcgcagcgcaacagaggagagcgctgatgcttccacacaacctggcggcagcgcaaaagatg

SEQ ID NO: 112743 - DNA, 103 bp, Artificial Sequence
  Synthetic Polynucleotide
taatacgactcactatagggtcttcctaaagtatcttgaattccaaacataacagaggagaatgtttatgattcaagataacctggcggcagcgcaaaagatg

SEQ ID NO: 112744 - DNA, 103 bp, Artificial Sequence
  Synthetic Polynucleotide
taatacgactcactataggggacattagcgtccaccactccgacattccgaacagaggagacggaatatgggagtggtgaacctggcggcagcgcaaaagatg

SEQ ID NO: 112745 - DNA, 103 bp, Artificial Sequence
  Synthetic Polynucleotide
taatacgactcactatagggttcatttaatgctgtgtaaatgaaccttccaacagaggagaggaaggatgatttacacaaacctggcggcagcgcaaaagatg

SEQ ID NO: 112746 - DNA, 103 bp, Artificial Sequence
  Synthetic Polynucleotide
taatacgactcactatagggctatggtgggttcatttaatgctgtgtaaaaacagaggagatttacaatgcattaaatgaacctggcggcagcgcaaaagatg

SEQ ID NO: 112747 - DNA, 103 bp, Artificial Sequence
  Synthetic Polynucleotide
taatacgactcactatagggaagccatagtctatggtgggttcatttaataacagaggagaattaaaatgacccaccataacctggcggcagcgcaaaagatg

SEQ ID NO: 112748 - DNA, 103 bp, Artificial Sequence
  Synthetic Polynucleotide
taatacgactcactatagggcagtctctggaagccatagtctatggtgggaacagaggagacccaccatggactatggcaacctggcggcagcgcaaaagatg

SEQ ID NO: 112749 - DNA, 103 bp, Artificial Sequence
  Synthetic Polynucleotide
taatacgactcactatagggtgaccttctgcagtctctggaagccatagtaacagaggagaactatgatgtccagagacaacctggcggcagcgcaaaagatg

SEQ ID NO: 112750 - DNA, 103 bp, Artificial Sequence
  Synthetic Polynucleotide
taatacgactcactatagggtgcctagggatgaccttctgcagtctctggaacagaggagaccagagatggcagaaggtaacctggcggcagcgcaaaagatg

SEQ ID NO: 112751 - DNA, 103 bp, Artificial Sequence
  Synthetic Polynucleotide
taatacgactcactatagggatctccaggatgcctagggatgaccttctgaacagaggagacagaagatgatccctaggaacctggcggcagcgcaaaagatg

SEQ ID NO: 112752 - DNA, 103 bp, Artificial Sequence
  Synthetic Polynucleotide
taatacgactcactatagggatctctcaggatctccaggatgcctagggaaacagaggagatccctaatgatcctggagaacctggcggcagcgcaaaagatg

SEQ ID NO: 112753 - DNA, 103 bp, Artificial Sequence
  Synthetic Polynucleotide
taatacgactcactatagggtccttagctaatctctcaggatctccaggaaacagaggagatcctggatgtcctgagagaacctggcggcagcgcaaaagatg

SEQ ID NO: 112754 - DNA, 103 bp, Artificial Sequence
  Synthetic Polynucleotide
taatacgactcactatagggcaacagcatctccttagctaatctctcaggaacagaggagacctgagatgttagctaagaacctggcggcagcgcaaaagatg

SEQ ID NO: 112755 - DNA, 103 bp, Artificial Sequence
  Synthetic Polynucleotide
taatacgactcactatagggtctgcgcggcgacattagcgtccaccactcaacagaggagagagtggatgacgctaatgaacctggcggcagcgcaaaagatg

SEQ ID NO: 112756 - DNA, 103 bp, Artificial Sequence
  Synthetic Polynucleotide
taatacgactcactatagggcagctcttttcaacagcatctccttagctaaacagaggagatagctaatgagatgctgtaacctggcggcagcgcaaaagatg

SEQ ID NO: 112757 - DNA, 103 bp, Artificial Sequence
  Synthetic Polynucleotide
taatacgactcactatagggactagatctgcagctcttttcaacagcatcaacagaggagagatgctatggaaaagagcaacctggcggcagcgcaaaagatg

SEQ ID NO: 112758 - DNA, 103 bp, Artificial Sequence
  Synthetic Polynucleotide
taatacgactcactatagggaagagcttccactagatctgcagctcttttaacagaggagaaaaagaatggcagatctaaacctggcggcagcgcaaaagatg

SEQ ID NO: 112759 - DNA, 103 bp, Artificial Sequence
  Synthetic Polynucleotide
taatacgactcactataggggtgtgccataaagagcttccactagatctgaacagaggagacagatcatgtggaagctcaacctggcggcagcgcaaaagatg

SEQ ID NO: 112760 - DNA, 103 bp, Artificial Sequence
  Synthetic Polynucleotide
taatacgactcactatagggttattgtgtggtgtgccataaagagcttccaacagaggagaggaagcatgttatggcacaacctggcggcagcgcaaaagatg

SEQ ID NO: 112761 - DNA, 103 bp, Artificial Sequence
  Synthetic Polynucleotide
taatacgactcactataggggatgtcctggttattgtgtggtgtgccataaacagaggagatatggcatgccacacaataacctggcggcagcgcaaaagatg

SEQ ID NO: 112762 - DNA, 103 bp, Artificial Sequence
  Synthetic Polynucleotide
taatacgactcactataggggcttcaaaatgatgtcctggttattgtgtgaacagaggagacacacaatgaccaggacaaacctggcggcagcgcaaaagatg

SEQ ID NO: 112763 - DNA, 103 bp, Artificial Sequence
  Synthetic Polynucleotide
taatacgactcactatagggtctgcggctcgcttcaaaatgatgtcctggaacagaggagaccaggaatgcattttgaaaacctggcggcagcgcaaaagatg

SEQ ID NO: 112764 - DNA, 103 bp, Artificial Sequence
  Synthetic Polynucleotide
taatacgactcactatagggttcagcaatgtctgcggctcgcttcaaaataacagaggagaattttgatgcgagccgcaaacctggcggcagcgcaaaagatg

SEQ ID NO: 112765 - DNA, 103 bp, Artificial Sequence
  Synthetic Polynucleotide
taatacgactcactatagggtgtagagagcttcagcaatgtctgcggctcaacagaggagagagccgatgacattgctgaacctggcggcagcgcaaaagatg

SEQ ID NO: 112766 - DNA, 103 bp, Artificial Sequence
  Synthetic Polynucleotide
taatacgactcactataggggcgaccccgctctgcgcggcgacattagcgaacagaggagacgctaaatgcgccgcgcaaacctggcggcagcgcaaaagatg

SEQ ID NO: 112767 - DNA, 103 bp, Artificial Sequence
  Synthetic Polynucleotide
taatacgactcactatagggctggggacgctgtagagagcttcagcaatgaacagaggagacattgcatgagctctctaaacctggcggcagcgcaaaagatg

SEQ ID NO: 112768 - DNA, 103 bp, Artificial Sequence
  Synthetic Polynucleotide
taatacgactcactataggggctgggattcctggggacgctgtagagagcaacagaggagagctctcatgagcgtccccaacctggcggcagcgcaaaagatg

SEQ ID NO: 112769 - DNA, 103 bp, Artificial Sequence
  Synthetic Polynucleotide
taatacgactcactatagggctggaagctggctgggattcctggggacgcaacagaggagagcgtccatgggaatcccaaacctggcggcagcgcaaaagatg

SEQ ID NO: 112770 - DNA, 103 bp, Artificial Sequence
  Synthetic Polynucleotide
taatacgactcactatagggctagagagggctggaagctggctgggattcaacagaggagagaatccatgccagcttccaacctggcggcagcgcaaaagatg

SEQ ID NO: 112771 - DNA, 103 bp, Artificial Sequence
  Synthetic Polynucleotide
taatacgactcactatagggcgctggggagctagagagggctggaagctgaacagaggagacagcttatggccctctctaacctggcggcagcgcaaaagatg

SEQ ID NO: 112772 - DNA, 103 bp, Artificial Sequence
  Synthetic Polynucleotide
taatacgactcactatagggtgccactgtgcgctggggagctagagagggaacagaggagaccctctatggctccccagaacctggcggcagcgcaaaagatg

SEQ ID NO: 112773 - DNA, 103 bp, Artificial Sequence
  Synthetic Polynucleotide
taatacgactcactatagggattcccatcatgccactgtgcgctggggagaacagaggagactccccatggcacagtggaacctggcggcagcgcaaaagatg

SEQ ID NO: 112774 - DNA, 103 bp, Artificial Sequence
  Synthetic Polynucleotide
taatacgactcactatagggataggagttgattcccatcatgccactgtgaacagaggagacacagtatgatgatgggaaacctggcggcagcgcaaaagatg

SEQ ID NO: 112775 - DNA, 103 bp, Artificial Sequence
  Synthetic Polynucleotide
taatacgactcactataggggctggctgccataggagttgattcccatcaaacagaggagatgatggatgtcaactcctaacctggcggcagcgcaaaagatg

SEQ ID NO: 112776 - DNA, 103 bp, Artificial Sequence
  Synthetic Polynucleotide
taatacgactcactatagggctgaccccaagctggctgccataggagttgaacagaggagacaactcatgtggcagccaaacctggcggcagcgcaaaagatg

SEQ ID NO: 112777 - DNA, 103 bp, Artificial Sequence
  Synthetic Polynucleotide
taatacgactcactatagggccgggacagggcgaccccgctctgcgcggcaacagaggagagccgcgatgagcggggtcaacctggcggcagcgcaaaagatg

SEQ ID NO: 112778 - DNA, 103 bp, Artificial Sequence
  Synthetic Polynucleotide
taatacgactcactatagggctctgagatgctgaccccaagctggctgccaacagaggagaggcagcatgcttggggtcaacctggcggcagcgcaaaagatg

SEQ ID NO: 112779 - DNA, 103 bp, Artificial Sequence
  Synthetic Polynucleotide
taatacgactcactatagggcttgtgttgactctgagatgctgaccccaaaacagaggagattggggatggcatctcagaacctggcggcagcgcaaaagatg

SEQ ID NO: 112780 - DNA, 103 bp, Artificial Sequence
  Synthetic Polynucleotide
taatacgactcactatagggtgattatttccttgtgttgactctgagatgaacagaggagacatctcatggtcaacacaaacctggcggcagcgcaaaagatg

SEQ ID NO: 112781 - DNA, 103 bp, Artificial Sequence
  Synthetic Polynucleotide
taatacgactcactataggggatgtacccttgattatttccttgtgttgaaacagaggagatcaacaatgggaaataataacctggcggcagcgcaaaagatg

SEQ ID NO: 112782 - DNA, 103 bp, Artificial Sequence
  Synthetic Polynucleotide
taatacgactcactatagggttgtgttgcggatgtacccttgattatttcaacagaggagagaaataatgaagggtacaaacctggcggcagcgcaaaagatg

SEQ ID NO: 112783 - DNA, 103 bp, Artificial Sequence
  Synthetic Polynucleotide
taatacgactcactataggggagatgctgcttgtgttgcggatgtaccctaacagaggagaagggtaatgccgcaacacaacctggcggcagcgcaaaagatg

SEQ ID NO: 112784 - DNA, 103 bp, Artificial Sequence
  Synthetic Polynucleotide
taatacgactcactatagggtccccgcggagagatgctgcttgtgttgcgaacagaggagacgcaacatgagcagcatcaacctggcggcagcgcaaaagatg

SEQ ID NO: 112785 - DNA, 103 bp, Artificial Sequence
  Synthetic Polynucleotide
taatacgactcactatagggtggaagagtatccccgcggagagatgctgcaacagaggagagcagcaatgctccgcgggaacctggcggcagcgcaaaagatg

SEQ ID NO: 112786 - DNA, 103 bp, Artificial Sequence
  Synthetic Polynucleotide
taatacgactcactatagggggcgtggagctggaagagtatccccgcggaaacagaggagatccgcgatgatactcttcaacctggcggcagcgcaaaagatg

SEQ ID NO: 112787 - DNA, 103 bp, Artificial Sequence
  Synthetic Polynucleotide
taatacgactcactatagggagactgttgaggcgtggagctggaagagtaaacagaggagatactctatgagctccacgaacctggcggcagcgcaaaagatg

SEQ ID NO: 112788 - DNA, 103 bp, Artificial Sequence
  Synthetic Polynucleotide
taatacgactcactatagggcaaagtgggcccgggacagggcgaccccgcaacagaggagagcggggatgccctgtcccaacctggcggcagcgcaaaagatg

SEQ ID NO: 112789 - DNA, 103 bp, Artificial Sequence
  Synthetic Polynucleotide
taatacgactcactatagggtactgtaattagactgttgaggcgtggagcaacagaggagagctccaatgctcaacagtaacctggcggcagcgcaaaagatg

SEQ ID NO: 112790 - DNA, 103 bp, Artificial Sequence
  Synthetic Polynucleotide
taatacgactcactatagggttgctggaggtactgtaattagactgttgaaacagaggagatcaacaatgtaattacagaacctggcggcagcgcaaaagatg

SEQ ID NO: 112791 - DNA, 103 bp, Artificial Sequence
  Synthetic Polynucleotide
taatacgactcactatagggattcatactgttgctggaggtactgtaattaacagaggagaaattacatgacctccagcaacctggcggcagcgcaaaagatg

SEQ ID NO: 112792 - DNA, 103 bp, Artificial Sequence
  Synthetic Polynucleotide
taatacgactcactatagggtgctgtagccattcatactgttgctggaggaacagaggagacctccaatgacagtatgaaacctggcggcagcgcaaaagatg

SEQ ID NO: 112793 - DNA, 103 bp, Artificial Sequence
  Synthetic Polynucleotide
taatacgactcactatagggatggggacattgctgtagccattcatactgaacagaggagacagtatatgtggctacagaacctggcggcagcgcaaaagatg

SEQ ID NO: 112794 - DNA, 103 bp, Artificial Sequence
  Synthetic Polynucleotide
taatacgactcactatagggcaagttggccatggggacattgctgtagccaacagaggagaggctacatgaatgtccccaacctggcggcagcgcaaaagatg

SEQ ID NO: 112795 - DNA, 103 bp, Artificial Sequence
  Synthetic Polynucleotide
taatacgactcactatagggctggaacacccaagttggccatggggacataacagaggagaatgtccatgtggccaactaacctggcggcagcgcaaaagatg

SEQ ID NO: 112796 - DNA, 103 bp, Artificial Sequence
  Synthetic Polynucleotide
taatacgactcactatagggcctggtgaacctggaacacccaagttggccaacagaggagaggccaaatggggtgttccaacctggcggcagcgcaaaagatg

SEQ ID NO: 112797 - DNA, 103 bp, Artificial Sequence
  Synthetic Polynucleotide
taatacgactcactatagggatttagaaatcctggtgaacctggaacaccaacagaggagaggtgttatgggttcaccaaacctggcggcagcgcaaaagatg

SEQ ID NO: 112798 - DNA, 103 bp, Artificial Sequence
  Synthetic Polynucleotide
taatacgactcactatagggtgggtgagccatttagaaatcctggtgaacaacagaggagagttcacatggatttctaaaacctggcggcagcgcaaaagatg

SEQ ID NO: 112799 - DNA, 103 bp, Artificial Sequence
  Synthetic Polynucleotide
taatacgactcactatagggggctgtttctcaaagtgggcccgggacaggaacagaggagacctgtcatgggcccacttaacctggcggcagcgcaaaagatg

SEQ ID NO: 112800 - DNA, 103 bp, Artificial Sequence
  Synthetic Polynucleotide
taatacgactcactatagggggagagccggtgggtgagccatttagaaataacagaggagaatttctatgtggctcaccaacctggcggcagcgcaaaagatg

SEQ ID NO: 112801 - DNA, 103 bp, Artificial Sequence
  Synthetic Polynucleotide
taatacgactcactataggggattccataaggagagccggtgggtgagccaacagaggagaggctcaatgaccggctctaacctggcggcagcgcaaaagatg

SEQ ID NO: 112802 - DNA, 103 bp, Artificial Sequence
  Synthetic Polynucleotide
taatacgactcactatagggttgatgacatgattccataaggagagccggaacagaggagaccggctatgcttatggaaaacctggcggcagcgcaaaagatg

SEQ ID NO: 112803 - DNA, 103 bp, Artificial Sequence
  Synthetic Polynucleotide
taatacgactcactatagggacggtgggacttgatgacatgattccataaaacagaggagattatggatgcatgtcatcaacctggcggcagcgcaaaagatg

SEQ ID NO: 112804 - DNA, 103 bp, Artificial Sequence
  Synthetic Polynucleotide
taatacgactcactatagggggaagacccaacggtgggacttgatgacataacagaggagaatgtcaatgagtcccaccaacctggcggcagcgcaaaagatg

SEQ ID NO: 112805 - DNA, 103 bp, Artificial Sequence
  Synthetic Polynucleotide
taatacgactcactatagggaggatgtgctggaagacccaacggtgggacaacagaggagagtcccaatgttgggtcttaacctggcggcagcgcaaaagatg

SEQ ID NO: 112806 - DNA, 103 bp, Artificial Sequence
  Synthetic Polynucleotide
taatacgactcactataggggggaggatggaggatgtgctggaagacccaaacagaggagatgggtcatgcagcacatcaacctggcggcagcgcaaaagatg

SEQ ID NO: 112807 - DNA, 103 bp, Artificial Sequence
  Synthetic Polynucleotide
taatacgactcactatagggagaggaaaatgggaggatggaggatgtgctaacagaggagaagcacaatgtccatcctcaacctggcggcagcgcaaaagatg

SEQ ID NO: 112808 - DNA, 103 bp, Artificial Sequence
  Synthetic Polynucleotide
taatacgactcactataggggaaaaactgaagaggaaaatgggaggatggaacagaggagaccatccatgcattttcctaacctggcggcagcgcaaaagatg

SEQ ID NO: 112809 - DNA, 103 bp, Artificial Sequence
  Synthetic Polynucleotide
taatacgactcactatagggttgacagcaggaaaaactgaagaggaaaataacagaggagaattttcatgttcagttttaacctggcggcagcgcaaaagatg

SEQ ID NO: 112810 - DNA, 103 bp, Artificial Sequence
  Synthetic Polynucleotide
taatacgactcactataggggttggaaggaggctgtttctcaaagtgggcaacagaggagagcccacatggagaaacagaacctggcggcagcgcaaaagatg

SEQ ID NO: 112811 - DNA, 103 bp, Artificial Sequence
  Synthetic Polynucleotide
taatacgactcactatagggactcttctgtttgacagcaggaaaaactgaaacagaggagatcagttatgcctgctgtcaacctggcggcagcgcaaaagatg

SEQ ID NO: 112812 - DNA, 103 bp, Artificial Sequence
  Synthetic Polynucleotide
taatacgactcactataggggggcaaaggcactcttctgtttgacagcagaacagaggagactgctgatgaacagaagaaacctggcggcagcgcaaaagatg

SEQ ID NO: 112813 - DNA, 103 bp, Artificial Sequence
  Synthetic Polynucleotide
taatacgactcactatagggctgatgacaggggcaaaggcactcttctgtaacagaggagaacagaaatgtgcctttgcaacctggcggcagcgcaaaagatg

SEQ ID NO: 112814 - DNA, 103 bp, Artificial Sequence
  Synthetic Polynucleotide
taatacgactcactataggggccttggggcctgatgacaggggcaaaggcaacagaggagagcctttatgcctgtcatcaacctggcggcagcgcaaaagatg

SEQ ID NO: 112815 - DNA, 103 bp, Artificial Sequence
  Synthetic Polynucleotide
taatacgactcactataggggtgaaggggagccttggggcctgatgacagaacagaggagactgtcaatgggccccaagaacctggcggcagcgcaaaagatg

SEQ ID NO: 112816 - DNA, 103 bp, Artificial Sequence
  Synthetic Polynucleotide
taatacgactcactataggggagcaggcaggtgaaggggagccttggggcaacagaggagagccccaatgctccccttcaacctggcggcagcgcaaaagatg

SEQ ID NO: 112817 - DNA, 103 bp, Artificial Sequence
  Synthetic Polynucleotide
taatacgactcactatagggattgccgctggagcaggcaggtgaaggggaaacagaggagatcccctatgcctgcctgcaacctggcggcagcgcaaaagatg

SEQ ID NO: 112818 - DNA, 103 bp, Artificial Sequence
  Synthetic Polynucleotide
taatacgactcactatagggatccatttccattgccgctggagcaggcagaacagaggagactgcctatgccagcggcaaacctggcggcagcgcaaaagatg

SEQ ID NO: 112819 - DNA, 103 bp, Artificial Sequence
  Synthetic Polynucleotide
taatacgactcactatagggatggctctgaatccatttccattgccgctgaacagaggagacagcggatgtggaaatggaacctggcggcagcgcaaaagatg

SEQ ID NO: 112820 - DNA, 103 bp, Artificial Sequence
  Synthetic Polynucleotide
taatacgactcactatagggaagtccggtcatggctctgaatccatttccaacagaggagaggaaatatgttcagagccaacctggcggcagcgcaaaagatg

SEQ ID NO: 112821 - DNA, 103 bp, Artificial Sequence
  Synthetic Polynucleotide
taatacgactcactatagggatttcctcaagttggaaggaggctgtttctaacagaggagaagaaacatgctccttccaaacctggcggcagcgcaaaagatg

SEQ ID NO: 112822 - DNA, 103 bp, Artificial Sequence
  Synthetic Polynucleotide
taatacgactcactatagggggggtacaacaagtccggtcatggctctgaaacagaggagatcagagatgtgaccggacaacctggcggcagcgcaaaagatg

SEQ ID NO: 112823 - DNA, 103 bp, Artificial Sequence
  Synthetic Polynucleotide
taatacgactcactatagggaagaagttggatttcctcaagttggaaggaaacagaggagatccttcatgcttgaggaaaacctggcggcagcgcaaaagatg

SEQ ID NO: 112824 - DNA, 103 bp, Artificial Sequence
  Synthetic Polynucleotide
taatacgactcactataggggacgaagtgaaagaagttggatttcctcaaaacagaggagattgaggatgtccaacttcaacctggcggcagcgcaaaagatg

SEQ ID NO: 112825 - DNA, 103 bp, Artificial Sequence
  Synthetic Polynucleotide
taatacgactcactataggggagttggtcctcttcctaaagtatcttgaaaacagaggagattcaagatgctttaggaaaacctggcggcagcgcaaaagatg

SEQ ID NO: 112826 - DNA, 103 bp, Artificial Sequence
  Synthetic Polynucleotide
taatacgactcactatagggagagcgccaggacgaagtgaaagaagttggaacagaggagaccaactatgttcacttcgaacctggcggcagcgcaaaagatg

SEQ ID NO: 112827 - DNA, 103 bp, Artificial Sequence
  Synthetic Polynucleotide
taatacgactcactatagggtgcctgtcatagagcgccaggacgaagtgaaacagaggagatcacttatgcctggcgctaacctggcggcagcgcaaaagatg

SEQ ID NO: 112828 - DNA, 103 bp, Artificial Sequence
  Synthetic Polynucleotide
taatacgactcactatagggcggctggccctgcctgtcatagagcgccagaacagaggagactggcgatgtatgacaggaacctggcggcagcgcaaaagatg

SEQ ID NO: 112829 - DNA, 103 bp, Artificial Sequence
  Synthetic Polynucleotide
taatacgactcactatagggcgatctccaccggctggccctgcctgtcataacagaggagaatgacaatgagggccagcaacctggcggcagcgcaaaagatg

SEQ ID NO: 112830 - DNA, 103 bp, Artificial Sequence
  Synthetic Polynucleotide
taatacgactcactataggggccgtccgctcgatctccaccggctggcccaacagaggagagggccaatgggtggagataacctggcggcagcgcaaaagatg

SEQ ID NO: 112831 - DNA, 103 bp, Artificial Sequence
  Synthetic Polynucleotide
taatacgactcactataggggtccacgaaggccgtccgctcgatctccacaacagaggagagtggagatggagcggacgaacctggcggcagcgcaaaagatg

SEQ ID NO: 112832 - DNA, 103 bp, Artificial Sequence
  Synthetic Polynucleotide
taatacgactcactatagggtctccacaaagtccacgaaggccgtccgctaacagaggagaagcggaatgccttcgtggaacctggcggcagcgcaaaagatg

SEQ ID NO: 112833 - DNA, 103 bp, Artificial Sequence
  Synthetic Polynucleotide
taatacgactcactatagggtctttgtcattctccacaaagtccacgaagaacagaggagacttcgtatgctttgtggaaacctggcggcagcgcaaaagatg

SEQ ID NO: 112834 - DNA, 103 bp, Artificial Sequence
  Synthetic Polynucleotide
taatacgactcactataggggttgccttgttctttgtcattctccacaaaaacagaggagatttgtgatgaatgacaaaaacctggcggcagcgcaaaagatg

SEQ ID NO: 112835 - DNA, 103 bp, Artificial Sequence
  Synthetic Polynucleotide
taatacgactcactatagggtggtcttctcgttgccttgttctttgtcataacagaggagaatgacaatgaacaaggcaaacctggcggcagcgcaaaagatg

SEQ ID NO: 112836 - DNA, 103 bp, Artificial Sequence
  Synthetic Polynucleotide
taatacgactcactatagggttctctttcagagttggtcctcttcctaaaaacagaggagatttaggatgaggaccaacaacctggcggcagcgcaaaagatg

SEQ ID NO: 112837 - DNA, 103 bp, Artificial Sequence
  Synthetic Polynucleotide
taatacgactcactataggggtgccgttgttggtcttctcgttgccttgtaacagaggagaacaaggatgcgagaagacaacctggcggcagcgcaaaagatg

SEQ ID NO: 112838 - DNA, 103 bp, Artificial Sequence
  Synthetic Polynucleotide
taatacgactcactatagggcttgtagtgagtgccgttgttggtcttctcaacagaggagagagaagatgaacaacggcaacctggcggcagcgcaaaagatg

SEQ ID NO: 112839 - DNA, 103 bp, Artificial Sequence
  Synthetic Polynucleotide
taatacgactcactatagggggagctgtaacttgtagtgagtgccgttgtaacagaggagaacaacgatgctcactacaaacctggcggcagcgcaaaagatg

SEQ ID NO: 112840 - DNA, 103 bp, Artificial Sequence
  Synthetic Polynucleotide
taatacgactcactatagggttgctgtagaggagctgtaacttgtagtgaaacagaggagatcactaatggttacagctaacctggcggcagcgcaaaagatg

SEQ ID NO: 112841 - DNA, 103 bp, Artificial Sequence
  Synthetic Polynucleotide
taatacgactcactataggggcggacaccgttgctgtagaggagctgtaaaacagaggagattacagatgctctacagcaacctggcggcagcgcaaaagatg

SEQ ID NO: 112842 - DNA, 103 bp, Artificial Sequence
  Synthetic Polynucleotide
taatacgactcactatagggcctgttccgtgcggacaccgttgctgtagaaacagaggagatctacaatgacggtgtccaacctggcggcagcgcaaaagatg

SEQ ID NO: 112843 - DNA, 103 bp, Artificial Sequence
  Synthetic Polynucleotide
taatacgactcactatagggacatagaggtcctgttccgtgcggacaccgaacagaggagacggtgtatgcacggaacaaacctggcggcagcgcaaaagatg

SEQ ID NO: 112844 - DNA, 103 bp, Artificial Sequence
  Synthetic Polynucleotide
taatacgactcactataggggatgagcctgacatagaggtcctgttccgtaacagaggagaacggaaatggacctctataacctggcggcagcgcaaaagatg

SEQ ID NO: 112845 - DNA, 103 bp, Artificial Sequence
  Synthetic Polynucleotide
taatacgactcactatagggtgaccgagtcgatgagcctgacatagaggtaacagaggagaacctctatgtcaggctcaaacctggcggcagcgcaaaagatg

SEQ ID NO: 112846 - DNA, 103 bp, Artificial Sequence
  Synthetic Polynucleotide
taatacgactcactatagggggctgcttggtgaccgagtcgatgagcctgaacagaggagacaggctatgcgactcggtaacctggcggcagcgcaaaagatg

SEQ ID NO: 112847 - DNA, 103 bp, Artificial Sequence
  Synthetic Polynucleotide
taatacgactcactataggggcccagcgatttctctttcagagttggtccaacagaggagaggaccaatgctgaaagagaacctggcggcagcgcaaaagatg

SEQ ID NO: 112848 - DNA, 103 bp, Artificial Sequence
  Synthetic Polynucleotide
taatacgactcactataggggtaagcgatgggctgcttggtgaccgagtcaacagaggagagactcgatgaccaagcagaacctggcggcagcgcaaaagatg

SEQ ID NO: 112849 - DNA, 103 bp, Artificial Sequence
  Synthetic Polynucleotide
taatacgactcactatagggtctgtccctcgtaagcgatgggctgcttggaacagaggagaccaagcatgccatcgcttaacctggcggcagcgcaaaagatg

SEQ ID NO: 112850 - DNA, 103 bp, Artificial Sequence
  Synthetic Polynucleotide
taatacgactcactatagggggattcttattctgtccctcgtaagcgatgaacagaggagacatcgcatgcgagggacaaacctggcggcagcgcaaaagatg

SEQ ID NO: 112851 - DNA, 103 bp, Artificial Sequence
  Synthetic Polynucleotide
taatacgactcactataggggcacatttccggattcttattctgtccctcaacagaggagagagggaatgaataagaataacctggcggcagcgcaaaagatg

SEQ ID NO: 112852 - DNA, 103 bp, Artificial Sequence
  Synthetic Polynucleotide
taatacgactcactatagggggagaactcggcacatttccggattcttataacagaggagaataagaatgcggaaatgtaacctggcggcagcgcaaaagatg

SEQ ID NO: 112853 - DNA, 103 bp, Artificial Sequence
  Synthetic Polynucleotide
taatacgactcactatagggtcgtgcgtcaggagaactcggcacatttccaacagaggagaggaaatatgccgagttctaacctggcggcagcgcaaaagatg

SEQ ID NO: 112854 - DNA, 103 bp, Artificial Sequence
  Synthetic Polynucleotide
taatacgactcactatagggacacatcacttcgtgcgtcaggagaactcgaacagaggagacgagttatgctgacgcacaacctggcggcagcgcaaaagatg

SEQ ID NO: 112855 - DNA, 103 bp, Artificial Sequence
  Synthetic Polynucleotide
taatacgactcactatagggagcatcgactacacatcacttcgtgcgtcaaacagaggagatgacgcatgaagtgatgtaacctggcggcagcgcaaaagatg

SEQ ID NO: 112856 - DNA, 103 bp, Artificial Sequence
  Synthetic Polynucleotide
taatacgactcactatagggttcttttcgcagcatcgactacacatcactaacagaggagaagtgatatgtagtcgatgaacctggcggcagcgcaaaagatg

SEQ ID NO: 112857 - DNA, 103 bp, Artificial Sequence
  Synthetic Polynucleotide
taatacgactcactatagggtccacagcttttcttttcgcagcatcgactaacagaggagaagtcgaatgtgcgaaaagaacctggcggcagcgcaaaagatg

SEQ ID NO: 112858 - DNA, 103 bp, Artificial Sequence
  Synthetic Polynucleotide
taatacgactcactatagggccatctccgcgcccagcgatttctctttcaaacagaggagatgaaagatgaatcgctggaacctggcggcagcgcaaaagatg

SEQ ID NO: 112859 - DNA, 103 bp, Artificial Sequence
  Synthetic Polynucleotide
taatacgactcactatagggcatttcggtttccacagcttttcttttcgcaacagaggagagcgaaaatgaaagctgtgaacctggcggcagcgcaaaagatg

SEQ ID NO: 112860 - DNA, 103 bp, Artificial Sequence
  Synthetic Polynucleotide
taatacgactcactataggggatggagtctcatttcggtttccacagcttaacagaggagaaagctgatgaaaccgaaaaacctggcggcagcgcaaaagatg

SEQ ID NO: 112861 - DNA, 103 bp, Artificial Sequence
  Synthetic Polynucleotide
taatacgactcactataggggactgggtccgatggagtctcatttcggttaacagaggagaaaccgaatggagactccaaacctggcggcagcgcaaaagatg

SEQ ID NO: 112862 - DNA, 103 bp, Artificial Sequence
  Synthetic Polynucleotide
taatacgactcactatagggtgtcaattatgactgggtccgatggagtctaacagaggagaagactcatgcggacccagaacctggcggcagcgcaaaagatg

SEQ ID NO: 112863 - DNA, 103 bp, Artificial Sequence
  Synthetic Polynucleotide
taatacgactcactatagggaaaaagaatctgtcaattatgactgggtccaacagaggagaggacccatgcataattgaaacctggcggcagcgcaaaagatg

SEQ ID NO: 112864 - DNA, 103 bp, Artificial Sequence
  Synthetic Polynucleotide
taatacgactcactataggggaaaaattttaaaaagaatctgtcaattataacagaggagaataattatgagattctttaacctggcggcagcgcaaaagatg

SEQ ID NO: 112865 - DNA, 103 bp, Artificial Sequence
  Synthetic Polynucleotide
taatacgactcactatagggtgcacttgaggaaaaattttaaaaagaatcaacagaggagagattctatgtaaaattttaacctggcggcagcgcaaaagatg

SEQ ID NO: 112866 - DNA, 103 bp, Artificial Sequence
  Synthetic Polynucleotide
taatacgactcactatagggcaattctgattgcacttgaggaaaaattttaacagaggagaaaaattatgcctcaagtgaacctggcggcagcgcaaaagatg

SEQ ID NO: 112867 - DNA, 103 bp, Artificial Sequence
  Synthetic Polynucleotide
taatacgactcactatagggtgttttcaaacaattctgattgcacttgagaacagaggagactcaagatgaatcagaataacctggcggcagcgcaaaagatg

SEQ ID NO: 112868 - DNA, 103 bp, Artificial Sequence
  Synthetic Polynucleotide
taatacgactcactatagggggtttcctgctgttttcaaacaattctgataacagaggagaatcagaatggtttgaaaaaacctggcggcagcgcaaaagatg

SEQ ID NO: 112869 - DNA, 103 bp, Artificial Sequence
  Synthetic Polynucleotide
taatacgactcactatagggctgaccgaatccatctccgcgcccagcgataacagaggagaatcgctatgcgcggagataacctggcggcagcgcaaaagatg

SEQ ID NO: 112870 - DNA, 103 bp, Artificial Sequence
  Synthetic Polynucleotide
taatacgactcactatagggatgtcccttgggtttcctgctgttttcaaaaacagaggagatttgaaatgagcaggaaaaacctggcggcagcgcaaaagatg

SEQ ID NO: 112871 - DNA, 103 bp, Artificial Sequence
  Synthetic Polynucleotide
taatacgactcactatagggaaaccgtctcatgtcccttgggtttcctgcaacagaggagagcaggaatgccaagggacaacctggcggcagcgcaaaagatg

SEQ ID NO: 112872 - DNA, 103 bp, Artificial Sequence
  Synthetic Polynucleotide
taatacgactcactatagggacacaacctgaaaccgtctcatgtcccttgaacagaggagacaagggatgtgagacggtaacctggcggcagcgcaaaagatg

SEQ ID NO: 112873 - DNA, 103 bp, Artificial Sequence
  Synthetic Polynucleotide
taatacgactcactataggggttgttgacaacacaacctgaaaccgtctcaacagaggagagagacgatgtcaggttgtaacctggcggcagcgcaaaagatg

SEQ ID NO: 112874 - DNA, 103 bp, Artificial Sequence
  Synthetic Polynucleotide
taatacgactcactatagggcacattcaccgttgttgacaacacaacctgaacagaggagacaggttatgttgtcaacaaacctggcggcagcgcaaaagatg

SEQ ID NO: 112875 - DNA, 103 bp, Artificial Sequence
  Synthetic Polynucleotide
taatacgactcactatagggcgtgtccatccacattcaccgttgttgacaaacagaggagatgtcaaatgcggtgaatgaacctggcggcagcgcaaaagatg

SEQ ID NO: 112876 - DNA, 103 bp, Artificial Sequence
  Synthetic Polynucleotide
taatacgactcactatagggacagccaggacgtgtccatccacattcaccaacagaggagaggtgaaatgggatggacaaacctggcggcagcgcaaaagatg

SEQ ID NO: 112877 - DNA, 103 bp, Artificial Sequence
  Synthetic Polynucleotide
taatacgactcactataggggttgtcagaaacagccaggacgtgtccatcaacagaggagagatggaatggtcctggctaacctggcggcagcgcaaaagatg

SEQ ID NO: 112878 - DNA, 103 bp, Artificial Sequence
  Synthetic Polynucleotide
taatacgactcactataggggaacaaacatgttgtcagaaacagccaggaaacagaggagatcctggatgtttctgacaaacctggcggcagcgcaaaagatg

SEQ ID NO: 112879 - DNA, 103 bp, Artificial Sequence
  Synthetic Polynucleotide
taatacgactcactataggggagttgttatgaacaaacatgttgtcagaaaacagaggagattctgaatgcatgtttgtaacctggcggcagcgcaaaagatg

SEQ ID NO: 112880 - DNA, 103 bp, Artificial Sequence
  Synthetic Polynucleotide
taatacgactcactataggggacccaggacctgaccgaatccatctccgcaacagaggagagcggagatggattcggtcaacctggcggcagcgcaaaagatg

SEQ ID NO: 112881 - DNA, 103 bp, Artificial Sequence
  Synthetic Polynucleotide
taatacgactcactatagggtccatgcttggagttgttatgaacaaacataacagaggagaatgtttatgcataacaacaacctggcggcagcgcaaaagatg

SEQ ID NO: 112882 - DNA, 103 bp, Artificial Sequence
  Synthetic Polynucleotide
taatacgactcactatagggttgctctccgtccatgcttggagttgttataacagaggagaataacaatgccaagcatgaacctggcggcagcgcaaaagatg

SEQ ID NO: 112883 - DNA, 103 bp, Artificial Sequence
  Synthetic Polynucleotide
taatacgactcactatagggtcgagtcttcttgctctccgtccatgcttgaacagaggagacaagcaatgacggagagcaacctggcggcagcgcaaaagatg

SEQ ID NO: 112884 - DNA, 103 bp, Artificial Sequence
  Synthetic Polynucleotide
taatacgactcactatagggttccgatggatcgagtcttcttgctctccgaacagaggagacggagaatgagaagactcaacctggcggcagcgcaaaagatg

SEQ ID NO: 112885 - DNA, 103 bp, Artificial Sequence
  Synthetic Polynucleotide
taatacgactcactatagggagggggtagcttccgatggatcgagtcttcaacagaggagagaagacatgatccatcggaacctggcggcagcgcaaaagatg

SEQ ID NO: 112886 - DNA, 103 bp, Artificial Sequence
  Synthetic Polynucleotide
taatacgactcactataggggctttgatgcagggggtagcttccgatggaaacagaggagatccatcatgagctaccccaacctggcggcagcgcaaaagatg

SEQ ID NO: 112887 - DNA, 103 bp, Artificial Sequence
  Synthetic Polynucleotide
taatacgactcactatagggcgggctaatggctttgatgcagggggtagcaacagaggagagctaccatgtgcatcaaaaacctggcggcagcgcaaaagatg

SEQ ID NO: 112888 - DNA, 103 bp, Artificial Sequence
  Synthetic Polynucleotide
taatacgactcactatagggagccttcactcgggctaatggctttgatgcaacagaggagagcatcaatgccattagccaacctggcggcagcgcaaaagatg

SEQ ID NO: 112889 - DNA, 103 bp, Artificial Sequence
  Synthetic Polynucleotide
taatacgactcactatagggcctgtggtccagccttcactcgggctaatgaacagaggagacattagatggagtgaaggaacctggcggcagcgcaaaagatg

SEQ ID NO: 112890 - DNA, 103 bp, Artificial Sequence
  Synthetic Polynucleotide
taatacgactcactatagggcatggctcctcctgtggtccagccttcactaacagaggagaagtgaaatgtggaccacaaacctggcggcagcgcaaaagatg

SEQ ID NO: 112891 - DNA, 103 bp, Artificial Sequence
  Synthetic Polynucleotide
taatacgactcactatagggcgacattccggacccaggacctgaccgaataacagaggagaattcggatgggtcctgggaacctggcggcagcgcaaaagatg

SEQ ID NO: 112892 - DNA, 103 bp, Artificial Sequence
  Synthetic Polynucleotide
taatacgactcactatagggtgatgatgaccatggctcctcctgtggtccaacagaggagaggaccaatggaggagccaaacctggcggcagcgcaaaagatg

SEQ ID NO: 112893 - DNA, 103 bp, Artificial Sequence
  Synthetic Polynucleotide
taatacgactcactatagggttgtccccgatgatgatgaccatggctcctaacagaggagaaggagcatgggtcatcataacctggcggcagcgcaaaagatg

SEQ ID NO: 112894 - DNA, 103 bp, Artificial Sequence
  Synthetic Polynucleotide
taatacgactcactatagggatcaaagaagttgtccccgatgatgatgacaacagaggagagtcatcatgatcggggacaacctggcggcagcgcaaaagatg

SEQ ID NO: 112895 - DNA, 103 bp, Artificial Sequence
  Synthetic Polynucleotide
taatacgactcactatagggcttggagaccatcaaagaagttgtccccgaaacagaggagatcggggatgacttctttgaacctggcggcagcgcaaaagatg

SEQ ID NO: 112896 - DNA, 103 bp, Artificial Sequence
  Synthetic Polynucleotide
taatacgactcactatagggccaaacaccacttggagaccatcaaagaagaacagaggagacttcttatgtggtctccaaacctggcggcagcgcaaaagatg

SEQ ID NO: 112897 - DNA, 103 bp, Artificial Sequence
  Synthetic Polynucleotide
taatacgactcactatagggaagcatagtcccaaacaccacttggagaccaacagaggagaggtctcatggtggtgtttaacctggcggcagcgcaaaagatg

SEQ ID NO: 112898 - DNA, 103 bp, Artificial Sequence
  Synthetic Polynucleotide
taatacgactcactatagggcgctccatacaagcatagtcccaaacaccaaacagaggagatggtgtatgggactatgcaacctggcggcagcgcaaaagatg

SEQ ID NO: 112899 - DNA, 103 bp, Artificial Sequence
  Synthetic Polynucleotide
taatacgactcactataggggttattagctcgctccatacaagcatagtcaacagaggagagactatatgtgtatggagaacctggcggcagcgcaaaagatg

SEQ ID NO: 112900 - DNA, 103 bp, Artificial Sequence
  Synthetic Polynucleotide
taatacgactcactatagggggcatgaggggttattagctcgctccatacaacagaggagagtatggatggagctaataaacctggcggcagcgcaaaagatg

SEQ ID NO: 112901 - DNA, 103 bp, Artificial Sequence
  Synthetic Polynucleotide
taatacgactcactataggggtactctgatggcatgaggggttattagctaacagaggagaagctaaatgcccctcatgaacctggcggcagcgcaaaagatg

SEQ ID NO: 112902 - DNA, 103 bp, Artificial Sequence
  Synthetic Polynucleotide
taatacgactcactatagggtccaccactccgacattccggacccaggacaacagaggagagtcctgatgccggaatgtaacctggcggcagcgcaaaagatg

SEQ ID NO: 112903 - DNA, 103 bp, Artificial Sequence
  Synthetic Polynucleotide
taatacgactcactatagggggaggagtctgtactctgatggcatgagggaacagaggagaccctcaatgcatcagagtaacctggcggcagcgcaaaagatg

SEQ ID NO: 112904 - DNA, 103 bp, Artificial Sequence
  Synthetic Polynucleotide
taatacgactcactataggggatgtgccggggaggagtctgtactctgataacagaggagaatcagaatgcagactcctaacctggcggcagcgcaaaagatg

SEQ ID NO: 112905 - DNA, 103 bp, Artificial Sequence
  Synthetic Polynucleotide
taatacgactcactatagggccacgcctgggatgtgccggggaggagtctaacagaggagaagactcatgcccggcacaaacctggcggcagcgcaaaagatg

SEQ ID NO: 112906 - DNA, 103 bp, Artificial Sequence
  Synthetic Polynucleotide
taatacgactcactataggggtcacctctaccacgcctgggatgtgccggaacagaggagaccggcaatgcccaggcgtaacctggcggcagcgcaaaagatg

SEQ ID NO: 112907 - DNA, 103 bp, Artificial Sequence
  Synthetic Polynucleotide
taatacgactcactatagggataagataatgtcacctctaccacgcctggaacagaggagaccaggcatggtagaggtgaacctggcggcagcgcaaaagatg

SEQ ID NO: 112908 - DNA, 103 bp, Artificial Sequence
  Synthetic Polynucleotide
taatacgactcactataggggtttagatttataagataatgtcacctctaaacagaggagatagaggatgcattatcttaacctggcggcagcgcaaaagatg

SEQ ID NO: 112909 - DNA, 103 bp, Artificial Sequence
  Synthetic Polynucleotide
taatacgactcactatagggttgcagaactgtttagatttataagataataacagaggagaattatcatgtaaatctaaaacctggcggcagcgcaaaagatg

SEQ ID NO: 112910 - DNA, 103 bp, Artificial Sequence
  Synthetic Polynucleotide
taatacgactcactatagggtggggctcctttgcagaactgtttagatttaacagaggagaaaatctatgcagttctgcaacctggcggcagcgcaaaagatg

SEQ ID NO: 112911 - DNA, 103 bp, Artificial Sequence
  Synthetic Polynucleotide
taatacgactcactatagggtgaaccttcctggggctcctttgcagaactaacagaggagaagttctatgaaggagcccaacctggcggcagcgcaaaagatg

SEQ ID NO: 112912 - DNA, 103 bp, Artificial Sequence
  Synthetic Polynucleotide
taatacgactcactataggggctgtgtaaatgaaccttcctggggctcctaacagaggagaaggagcatgaggaaggttaacctggcggcagcgcaaaagatg

SEQ ID NO: 112913 - DNA, 103 bp, Artificial Sequence
  Synthetic Polynucleotide
taatacgactcactataggggcgcggaatattctcctgaatcccaaacataacagaggagaatgtttatgattcaggagaacctggcggcagcgcaaaagatg

SEQ ID NO: 112914 - DNA, 103 bp, Artificial Sequence
  Synthetic Polynucleotide
taatacgactcactataggggttggcgtccaccacgcccgccgtgtgcataacagaggagaatgcacatggcgggcgtgaacctggcggcagcgcaaaagatg

SEQ ID NO: 112915 - DNA, 103 bp, Artificial Sequence
  Synthetic Polynucleotide
taatacgactcactatagggattaagggcggtgtagacaaagcgcccaggaacagaggagacctgggatgtttgtctacaacctggcggcagcgcaaaagatg

SEQ ID NO: 112916 - DNA, 103 bp, Artificial Sequence
  Synthetic Polynucleotide
taatacgactcactatagggtggttggttcattaagggcggtgtagacaaaacagaggagattgtctatgccgcccttaaacctggcggcagcgcaaaagatg

SEQ ID NO: 112917 - DNA, 103 bp, Artificial Sequence
  Synthetic Polynucleotide
taatacgactcactatagggccgtaatctatggttggttcattaagggcgaacagaggagacgccctatgtgaaccaacaacctggcggcagcgcaaaagatg

SEQ ID NO: 112918 - DNA, 103 bp, Artificial Sequence
  Synthetic Polynucleotide
taatacgactcactatagggcctctgaaagccgtaatctatggttggttcaacagaggagagaaccaatgatagattacaacctggcggcagcgcaaaagatg

SEQ ID NO: 112919 - DNA, 103 bp, Artificial Sequence
  Synthetic Polynucleotide
taatacgactcactatagggctttctgcaacctctgaaagccgtaatctaaacagaggagatagattatggctttcagaaacctggcggcagcgcaaaagatg

SEQ ID NO: 112920 - DNA, 103 bp, Artificial Sequence
  Synthetic Polynucleotide
taatacgactcactatagggcttgggatcactttctgcaacctctgaaagaacagaggagactttcaatggttgcagaaaacctggcggcagcgcaaaagatg

SEQ ID NO: 112921 - DNA, 103 bp, Artificial Sequence
  Synthetic Polynucleotide
taatacgactcactatagggacccggatgtcttgggatcactttctgcaaaacagaggagattgcagatggtgatcccaaacctggcggcagcgcaaaagatg

SEQ ID NO: 112922 - DNA, 103 bp, Artificial Sequence
  Synthetic Polynucleotide
taatacgactcactatagggtttcgggatcacccggatgtcttgggatcaaacagaggagatgatccatggacatccggaacctggcggcagcgcaaaagatg

SEQ ID NO: 112923 - DNA, 103 bp, Artificial Sequence
  Synthetic Polynucleotide
taatacgactcactatagggttgggtaacctttcgggatcacccggatgtaacagaggagaacatccatgtgatcccgaaacctggcggcagcgcaaaagatg

SEQ ID NO: 112924 - DNA, 103 bp, Artificial Sequence
  Synthetic Polynucleotide
taatacgactcactatagggtaacacctccttgggtaacctttcgggatcaacagaggagagatcccatgaggttacccaacctggcggcagcgcaaaagatg

SEQ ID NO: 112925 - DNA, 103 bp, Artificial Sequence
  Synthetic Polynucleotide
taatacgactcactataggggggcggccgtgttggcgtccaccacgcccgaacagaggagacgggcgatgtggacgccaaacctggcggcagcgcaaaagatg

SEQ ID NO: 112926 - DNA, 103 bp, Artificial Sequence
  Synthetic Polynucleotide
taatacgactcactatagggcccgcttcagtaacacctccttgggtaaccaacagaggagaggttacatgaggaggtgtaacctggcggcagcgcaaaagatg

SEQ ID NO: 112927 - DNA, 103 bp, Artificial Sequence
  Synthetic Polynucleotide
taatacgactcactatagggaggtccgccgcccgcttcagtaacacctccaacagaggagaggaggtatgactgaagcgaacctggcggcagcgcaaaagatg

SEQ ID NO: 112928 - DNA, 103 bp, Artificial Sequence
  Synthetic Polynucleotide
taatacgactcactatagggggcttccaccaggtccgccgcccgcttcagaacagaggagactgaagatggcggcggacaacctggcggcagcgcaaaagatg

SEQ ID NO: 112929 - DNA, 103 bp, Artificial Sequence
  Synthetic Polynucleotide
taatacgactcactatagggttccgtataaggcttccaccaggtccgccgaacagaggagacggcggatgtggtggaagaacctggcggcagcgcaaaagatg

SEQ ID NO: 112930 - DNA, 103 bp, Artificial Sequence
  Synthetic Polynucleotide
taatacgactcactatagggttgtgaggcattccgtataaggcttccaccaacagaggagaggtggaatgcttatacggaacctggcggcagcgcaaaagatg

SEQ ID NO: 112931 - DNA, 103 bp, Artificial Sequence
  Synthetic Polynucleotide
taatacgactcactatagggctcctggttgttgtgaggcattccgtataaaacagaggagattatacatgatgcctcacaacctggcggcagcgcaaaagatg

SEQ ID NO: 112932 - DNA, 103 bp, Artificial Sequence
  Synthetic Polynucleotide
taatacgactcactatagggtcaagatgatctcctggttgttgtgaggcaaacagaggagatgcctcatgacaaccaggaacctggcggcagcgcaaaagatg

SEQ ID NO: 112933 - DNA, 103 bp, Artificial Sequence
  Synthetic Polynucleotide
taatacgactcactataggggccgctcgcttcaagatgatctcctggttgaacagaggagacaaccaatggatcatcttaacctggcggcagcgcaaaagatg

SEQ ID NO: 112934 - DNA, 103 bp, Artificial Sequence
  Synthetic Polynucleotide
taatacgactcactatagggggcgatgtccgccgctcgcttcaagatgataacagaggagaatcatcatgaagcgagcgaacctggcggcagcgcaaaagatg

SEQ ID NO: 112935 - DNA, 103 bp, Artificial Sequence
  Synthetic Polynucleotide
taatacgactcactatagggacagcgcctcggcgatgtccgccgctcgctaacagaggagaagcgagatgcggacatcgaacctggcggcagcgcaaaagatg

SEQ ID NO: 112936 - DNA, 103 bp, Artificial Sequence
  Synthetic Polynucleotide
taatacgactcactatagggacgccgctctgggcggccgtgttggcgtccaacagaggagaggacgcatgcacggccgcaacctggcggcagcgcaaaagatg

SEQ ID NO: 112937 - DNA, 103 bp, Artificial Sequence
  Synthetic Polynucleotide
taatacgactcactatagggggaacgctgtacagcgcctcggcgatgtccaacagaggagaggacatatgcgaggcgctaacctggcggcagcgcaaaagatg

SEQ ID NO: 112938 - DNA, 103 bp, Artificial Sequence
  Synthetic Polynucleotide
taatacgactcactataggggtgattgcggggaacgctgtacagcgcctcaacagaggagagaggcgatgtacagcgttaacctggcggcagcgcaaaagatg

SEQ ID NO: 112939 - DNA, 103 bp, Artificial Sequence
  Synthetic Polynucleotide
taatacgactcactatagggggatctggttgtgattgcggggaacgctgtaacagaggagaacagcgatgcccgcaatcaacctggcggcagcgcaaaagatg

SEQ ID NO: 112940 - DNA, 103 bp, Artificial Sequence
  Synthetic Polynucleotide
taatacgactcactatagggcccagggtggggatctggttgtgattgcggaacagaggagaccgcaaatgcaaccagataacctggcggcagcgcaaaagatg

SEQ ID NO: 112941 - DNA, 103 bp, Artificial Sequence
  Synthetic Polynucleotide
taatacgactcactatagggagggttgttgcccagggtggggatctggttaacagaggagaaaccagatgcccaccctgaacctggcggcagcgcaaaagatg

SEQ ID NO: 112942 - DNA, 103 bp, Artificial Sequence
  Synthetic Polynucleotide
taatacgactcactatagggccgtgtgtgcagggttgttgcccagggtggaacagaggagaccacccatggcaacaaccaacctggcggcagcgcaaaagatg

SEQ ID NO: 112943 - DNA, 103 bp, Artificial Sequence
  Synthetic Polynucleotide
taatacgactcactatagggcccatcatgcccgtgtgtgcagggttgttgaacagaggagacaacaaatgtgcacacacaacctggcggcagcgcaaaagatg

SEQ ID NO: 112944 - DNA, 103 bp, Artificial Sequence
  Synthetic Polynucleotide
taatacgactcactatagggggagttgacgcccatcatgcccgtgtgtgcaacagaggagagcacacatgggcatgatgaacctggcggcagcgcaaaagatg

SEQ ID NO: 112945 - DNA, 103 bp, Artificial Sequence
  Synthetic Polynucleotide
taatacgactcactatagggggctgctgaaggagttgacgcccatcatgcaacagaggagagcatgaatggcgtcaactaacctggcggcagcgcaaaagatg

SEQ ID NO: 112946 - DNA, 103 bp, Artificial Sequence
  Synthetic Polynucleotide
taatacgactcactatagggacggctagctggctgctgaaggagttgacgaacagaggagacgtcaaatgcttcagcagaacctggcggcagcgcaaaagatg

SEQ ID NO: 112947 - DNA, 103 bp, Artificial Sequence
  Synthetic Polynucleotide
taatacgactcactatagggcgccagccccacgccgctctgggcggccgtaacagaggagaacggccatgcagagcggcaacctggcggcagcgcaaaagatg

SEQ ID NO: 112948 - DNA, 103 bp, Artificial Sequence
  Synthetic Polynucleotide
taatacgactcactatagggtgacacgttgacggctagctggctgctgaaaacagaggagattcagcatgcagctagccaacctggcggcagcgcaaaagatg

SEQ ID NO: 112949 - DNA, 103 bp, Artificial Sequence
  Synthetic Polynucleotide
taatacgactcactataggggtgacgtctctgacacgttgacggctagctaacagaggagaagctagatgtcaacgtgtaacctggcggcagcgcaaaagatg

SEQ ID NO: 112950 - DNA, 103 bp, Artificial Sequence
  Synthetic Polynucleotide
taatacgactcactatagggtcgttggcttgtgacgtctctgacacgttgaacagaggagacaacgtatgagagacgtcaacctggcggcagcgcaaaagatg

SEQ ID NO: 112951 - DNA, 103 bp, Artificial Sequence
  Synthetic Polynucleotide
taatacgactcactataggggccgacttggtcgttggcttgtgacgtctcaacagaggagagagacgatgcaagccaacaacctggcggcagcgcaaaagatg

SEQ ID NO: 112952 - DNA, 103 bp, Artificial Sequence
  Synthetic Polynucleotide
taatacgactcactatagggtgcgactgtagccgacttggtcgttggcttaacagaggagaaagccaatgaccaagtcgaacctggcggcagcgcaaaagatg

SEQ ID NO: 112953 - DNA, 103 bp, Artificial Sequence
  Synthetic Polynucleotide
taatacgactcactatagggctgcttgtattgcgactgtagccgacttggaacagaggagaccaagtatgctacagtcgaacctggcggcagcgcaaaagatg

SEQ ID NO: 112954 - DNA, 103 bp, Artificial Sequence
  Synthetic Polynucleotide
taatacgactcactatagggcggggacacgctgcttgtattgcgactgtaaacagaggagatacagtatgaatacaagcaacctggcggcagcgcaaaagatg

SEQ ID NO: 112955 - DNA, 103 bp, Artificial Sequence
  Synthetic Polynucleotide
taatacgactcactatagggcgtagcctcgcggggacacgctgcttgtataacagaggagaatacaaatggcgtgtcccaacctggcggcagcgcaaaagatg

SEQ ID NO: 112956 - DNA, 103 bp, Artificial Sequence
  Synthetic Polynucleotide
taatacgactcactatagggctgctggggacgtagcctcgcggggacacgaacagaggagacgtgtcatggcgaggctaaacctggcggcagcgcaaaagatg

SEQ ID NO: 112957 - DNA, 103 bp, Artificial Sequence
  Synthetic Polynucleotide
taatacgactcactatagggctggggagtactgctggggacgtagcctcgaacagaggagacgaggcatggtccccagcaacctggcggcagcgcaaaagatg

SEQ ID NO: 112958 - DNA, 103 bp, Artificial Sequence
  Synthetic Polynucleotide
taatacgactcactatagggagtgcgcccgcgccagccccacgccgctctaacagaggagaagagcgatgtggggctggaacctggcggcagcgcaaaagatg

SEQ ID NO: 112959 - DNA, 103 bp, Artificial Sequence
  Synthetic Polynucleotide
taatacgactcactatagggaattggactgctggggagtactgctggggaaacagaggagatccccaatggtactccccaacctggcggcagcgcaaaagatg

SEQ ID NO: 112960 - DNA, 103 bp, Artificial Sequence
  Synthetic Polynucleotide
taatacgactcactatagggactgtgttgtaattggactgctggggagtaaacagaggagatactccatggcagtccaaaacctggcggcagcgcaaaagatg

SEQ ID NO: 112961 - DNA, 103 bp, Artificial Sequence
  Synthetic Polynucleotide
taatacgactcactataggggctagtgctgactgtgttgtaattggactgaacagaggagacagtccatgtacaacacaaacctggcggcagcgcaaaagatg

SEQ ID NO: 112962 - DNA, 103 bp, Artificial Sequence
  Synthetic Polynucleotide
taatacgactcactatagggatccattcatgctagtgctgactgtgttgtaacagaggagaacaacaatgtcagcactaaacctggcggcagcgcaaaagatg

SEQ ID NO: 112963 - DNA, 103 bp, Artificial Sequence
  Synthetic Polynucleotide
taatacgactcactatagggccacttccatatccattcatgctagtgctgaacagaggagacagcacatgcatgaatggaacctggcggcagcgcaaaagatg

SEQ ID NO: 112964 - DNA, 103 bp, Artificial Sequence
  Synthetic Polynucleotide
taatacgactcactatagggggccatggcgccacttccatatccattcataacagaggagaatgaatatgtatggaagtaacctggcggcagcgcaaaagatg

SEQ ID NO: 112965 - DNA, 103 bp, Artificial Sequence
  Synthetic Polynucleotide
taatacgactcactatagggcccctagactggccatggcgccacttccataacagaggagaatggaaatggcgccatggaacctggcggcagcgcaaaagatg

SEQ ID NO: 112966 - DNA, 103 bp, Artificial Sequence
  Synthetic Polynucleotide
taatacgactcactataggggagccagggacccctagactggccatggcgaacagaggagacgccatatgcagtctaggaacctggcggcagcgcaaaagatg

SEQ ID NO: 112967 - DNA, 103 bp, Artificial Sequence
  Synthetic Polynucleotide
taatacgactcactatagggaaatccaggcgagccagggacccctagactaacagaggagaagtctaatggtccctggcaacctggcggcagcgcaaaagatg

SEQ ID NO: 112968 - DNA, 103 bp, Artificial Sequence
  Synthetic Polynucleotide
taatacgactcactatagggagccattaagaaatccaggcgagccagggaaacagaggagatccctgatgcgcctggataacctggcggcagcgcaaaagatg

SEQ ID NO: 112969 - DNA, 103 bp, Artificial Sequence
  Synthetic Polynucleotide
taatacgactcactatagggtgcttctcgaagtgcgcccgcgccagccccaacagaggagaggggctatggcgggcgcaaacctggcggcagcgcaaaagatg

SEQ ID NO: 112970 - DNA, 103 bp, Artificial Sequence
  Synthetic Polynucleotide
taatacgactcactatagggttagcggaggagccattaagaaatccaggcaacagaggagagcctggatgtcttaatggaacctggcggcagcgcaaaagatg

SEQ ID NO: 112971 - DNA, 103 bp, Artificial Sequence
  Synthetic Polynucleotide
taatacgactcactataggggtagggagagttagcggaggagccattaagaacagaggagacttaatatgtcctccgctaacctggcggcagcgcaaaagatg

SEQ ID NO: 112972 - DNA, 103 bp, Artificial Sequence
  Synthetic Polynucleotide
taatacgactcactataggggtttcatgccgtagggagagttagcggaggaacagaggagacctccgatgactctccctaacctggcggcagcgcaaaagatg

SEQ ID NO: 112973 - DNA, 103 bp, Artificial Sequence
  Synthetic Polynucleotide
taatacgactcactataggggcgctcttctgtttcatgccgtagggagagaacagaggagactctccatgcggcatgaaaacctggcggcagcgcaaaagatg

SEQ ID NO: 112974 - DNA, 103 bp, Artificial Sequence
  Synthetic Polynucleotide
taatacgactcactataggggggcgcgaaggcgctcttctgtttcatgccaacagaggagaggcatgatgcagaagagcaacctggcggcagcgcaaaagatg

SEQ ID NO: 112975 - DNA, 103 bp, Artificial Sequence
  Synthetic Polynucleotide
taatacgactcactataggggccggaccacgggcgcgaaggcgctcttctaacagaggagaagaagaatgccttcgcgcaacctggcggcagcgcaaaagatg

SEQ ID NO: 112976 - DNA, 103 bp, Artificial Sequence
  Synthetic Polynucleotide
taatacgactcactataggggaggcttggggccggaccacgggcgcgaagaacagaggagacttcgcatgcgtggtccgaacctggcggcagcgcaaaagatg

SEQ ID NO: 112977 - DNA, 103 bp, Artificial Sequence
  Synthetic Polynucleotide
taatacgactcactatagggaggaggaggagaggcttggggccggaccacaacagaggagagtggtcatgccccaagccaacctggcggcagcgcaaaagatg

SEQ ID NO: 112978 - DNA, 103 bp, Artificial Sequence
  Synthetic Polynucleotide
taatacgactcactatagggtggtgcaggaaggaggaggagaggcttgggaacagaggagacccaagatgctcctcctcaacctggcggcagcgcaaaagatg

SEQ ID NO: 112979 - DNA, 103 bp, Artificial Sequence
  Synthetic Polynucleotide
taatacgactcactatagggccgttggcgctggtgcaggaaggaggaggaaacagaggagatcctccatgttcctgcacaacctggcggcagcgcaaaagatg

SEQ ID NO: 112980 - DNA, 103 bp, Artificial Sequence
  Synthetic Polynucleotide
taatacgactcactatagggggaaggcggctgcttctcgaagtgcgcccgaacagaggagacgggcgatgttcgagaagaacctggcggcagcgcaaaagatg

SEQ ID NO: 112981 - DNA, 103 bp, Artificial Sequence
  Synthetic Polynucleotide
taatacgactcactatagggcagtccattcccgttggcgctggtgcaggaaacagaggagatcctgcatgagcgccaacaacctggcggcagcgcaaaagatg

SEQ ID NO: 112982 - DNA, 103 bp, Artificial Sequence
  Synthetic Polynucleotide
taatacgactcactatagggacatagcttgcagtccattcccgttggcgcaacagaggagagcgccaatgggaatggacaacctggcggcagcgcaaaagatg

SEQ ID NO: 112983 - DNA, 103 bp, Artificial Sequence
  Synthetic Polynucleotide
taatacgactcactatagggaccagcccagacatagcttgcagtccattcaacagaggagagaatggatggcaagctataacctggcggcagcgcaaaagatg

SEQ ID NO: 112984 - DNA, 103 bp, Artificial Sequence
  Synthetic Polynucleotide
taatacgactcactatagggtggcgggactaccagcccagacatagcttgaacagaggagacaagctatgtctgggctgaacctggcggcagcgcaaaagatg

SEQ ID NO: 112985 - DNA, 103 bp, Artificial Sequence
  Synthetic Polynucleotide
taatacgactcactatagggtccggaggttggaaggcggctgcttctcgaaacagaggagatcgagaatgagccgccttaacctggcggcagcgcaaaagatg

SEQ ID NO: 112986 - DNA, 103 bp, Artificial Sequence
  Synthetic Polynucleotide
taatacgactcactatagggaaattggatttccggaggttggaaggcggcaacagaggagagccgccatgcaacctccgaacctggcggcagcgcaaaagatg

SEQ ID NO: 112987 - DNA, 103 bp, Artificial Sequence
  Synthetic Polynucleotide
taatacgactcactataggggaagtggaagaaattggatttccggaggttaacagaggagaaacctcatgaaatccaataacctggcggcagcgcaaaagatg

SEQ ID NO: 112988 - DNA, 103 bp, Artificial Sequence
  Synthetic Polynucleotide
taatacgactcactatagggtcgtccccccgcgcggaatattctcctgaaaacagaggagattcaggatgatattccgcaacctggcggcagcgcaaaagatg

SEQ ID NO: 112989 - DNA, 103 bp, Artificial Sequence
  Synthetic Polynucleotide
taatacgactcactataggggcgccagcacgaagtggaagaaattggattaacagaggagaaatccaatgtcttccactaacctggcggcagcgcaaaagatg

SEQ ID NO: 112990 - DNA, 103 bp, Artificial Sequence
  Synthetic Polynucleotide
taatacgactcactatagggctatcgtagagcgccagcacgaagtggaagaacagaggagacttccaatgcgtgctggcaacctggcggcagcgcaaaagatg

SEQ ID NO: 112991 - DNA, 103 bp, Artificial Sequence
  Synthetic Polynucleotide
taatacgactcactatagggctgcccctgcctatcgtagagcgccagcacaacagaggagagtgctgatgctctacgataacctggcggcagcgcaaaagatg

SEQ ID NO: 112992 - DNA, 103 bp, Artificial Sequence
  Synthetic Polynucleotide
taatacgactcactatagggtctccaccggctgcccctgcctatcgtagaaacagaggagatctacgatgggcaggggcaacctggcggcagcgcaaaagatg

SEQ ID NO: 112993 - DNA, 103 bp, Artificial Sequence
  Synthetic Polynucleotide
taatacgactcactataggggtcctttcaatctccaccggctgcccctgcaacagaggagagcagggatggccggtggaaacctggcggcagcgcaaaagatg

SEQ ID NO: 112994 - DNA, 103 bp, Artificial Sequence
  Synthetic Polynucleotide
taatacgactcactatagggcacaaaagcggtcctttcaatctccaccggaacagaggagaccggtgatgattgaaaggaacctggcggcagcgcaaaagatg

SEQ ID NO: 112995 - DNA, 103 bp, Artificial Sequence
  Synthetic Polynucleotide
taatacgactcactatagggccacaaagtccacaaaagcggtcctttcaaaacagaggagattgaaaatgccgcttttgaacctggcggcagcgcaaaagatg

SEQ ID NO: 112996 - DNA, 103 bp, Artificial Sequence
  Synthetic Polynucleotide
taatacgactcactatagggttctctttctccacaaagtccacaaaagcgaacagaggagacgctttatgggactttgtaacctggcggcagcgcaaaagatg

SEQ ID NO: 112997 - DNA, 103 bp, Artificial Sequence
  Synthetic Polynucleotide
taatacgactcactataggggtttggctctttctctttctccacaaagtcaacagaggagagactttatggagaaagagaacctggcggcagcgcaaaagatg

SEQ ID NO: 112998 - DNA, 103 bp, Artificial Sequence
  Synthetic Polynucleotide
taatacgactcactatagggttttctcgttgtttggctctttctctttctaacagaggagaagaaagatgaagagccaaaacctggcggcagcgcaaaagatg

SEQ ID NO: 112999 - DNA, 103 bp, Artificial Sequence
  Synthetic Polynucleotide
taatacgactcactatagggtccttcatggtcgtccccccgcgcggaataaacagaggagatattccatgcggggggacaacctggcggcagcgcaaaagatg

SEQ ID NO: 113000 - DNA, 103 bp, Artificial Sequence
  Synthetic Polynucleotide
taatacgactcactatagggccgttgttggttttctcgttgtttggctctaacagaggagaagagccatgcaacgagaaaacctggcggcagcgcaaaagatg

SEQ ID NO: 113001 - DNA, 103 bp, Artificial Sequence
  Synthetic Polynucleotide
taatacgactcactatagggatagtggatgccgttgttggttttctcgttaacagaggagaaacgagatgaccaacaacaacctggcggcagcgcaaaagatg

SEQ ID NO: 113002 - DNA, 103 bp, Artificial Sequence
  Synthetic Polynucleotide
taatacgactcactatagggactggagtttatagtggatgccgttgttggaacagaggagaccaacaatggcatccactaacctggcggcagcgcaaaagatg

SEQ ID NO: 113003 - DNA, 103 bp, Artificial Sequence
  Synthetic Polynucleotide
taatacgactcactatagggctgtacaataactggagtttatagtggatgaacagaggagacatccaatgtaaactccaaacctggcggcagcgcaaaagatg

SEQ ID NO: 113004 - DNA, 103 bp, Artificial Sequence
  Synthetic Polynucleotide
taatacgactcactataggggactccgttgctgtacaataactggagtttaacagaggagaaaactcatgttattgtacaacctggcggcagcgcaaaagatg

SEQ ID NO: 113005 - DNA, 103 bp, Artificial Sequence
  Synthetic Polynucleotide
taatacgactcactataggggctctgttctgactccgttgctgtacaataaacagaggagatattgtatggcaacggagaacctggcggcagcgcaaaagatg

SEQ ID NO: 113006 - DNA, 103 bp, Artificial Sequence
  Synthetic Polynucleotide
taatacgactcactatagggtacagatcttgctctgttctgactccgttgaacagaggagacaacggatgcagaacagaaacctggcggcagcgcaaaagatg

SEQ ID NO: 113007 - DNA, 103 bp, Artificial Sequence
  Synthetic Polynucleotide
taatacgactcactataggggaggcgaacatacagatcttgctctgttctaacagaggagaagaacaatgcaagatctgaacctggcggcagcgcaaaagatg

SEQ ID NO: 113008 - DNA, 103 bp, Artificial Sequence
  Synthetic Polynucleotide
taatacgactcactatagggttgaatctatgaggcgaacatacagatcttaacagaggagaaagatcatgatgttcgccaacctggcggcagcgcaaaagatg

SEQ ID NO: 113009 - DNA, 103 bp, Artificial Sequence
  Synthetic Polynucleotide
taatacgactcactatagggtgtttggtcattgaatctatgaggcgaacaaacagaggagatgttcgatgcatagattcaacctggcggcagcgcaaaagatg

SEQ ID NO: 113010 - DNA, 103 bp, Artificial Sequence
  Synthetic Polynucleotide
taatacgactcactatagggcagcggctcctccttcatggtcgtccccccaacagaggagaggggggatgaccatgaagaacctggcggcagcgcaaaagatg

SEQ ID NO: 113011 - DNA, 103 bp, Artificial Sequence
  Synthetic Polynucleotide
taatacgactcactataggggacgatggcctgtttggtcattgaatctataacagaggagaatagatatgatgaccaaaaacctggcggcagcgcaaaagatg

SEQ ID NO: 113012 - DNA, 103 bp, Artificial Sequence
  Synthetic Polynucleotide
taatacgactcactatagggggccctcgtagacgatggcctgtttggtcaaacagaggagatgaccaatgaggccatcgaacctggcggcagcgcaaaagatg

SEQ ID NO: 113013 - DNA, 103 bp, Artificial Sequence
  Synthetic Polynucleotide
taatacgactcactatagggttcttgtcctggccctcgtagacgatggccaacagaggagaggccatatgctacgagggaacctggcggcagcgcaaaagatg

SEQ ID NO: 113014 - DNA, 103 bp, Artificial Sequence
  Synthetic Polynucleotide
taatacgactcactatagggcatctccgggttcttgtcctggccctcgtaaacagaggagatacgagatgcaggacaagaacctggcggcagcgcaaaagatg

SEQ ID NO: 113015 - DNA, 103 bp, Artificial Sequence
  Synthetic Polynucleotide
taatacgactcactataggggcacacggcacatctccgggttcttgtcctaacagaggagaaggacaatgacccggagaaacctggcggcagcgcaaaagatg

SEQ ID NO: 113016 - DNA, 103 bp, Artificial Sequence
  Synthetic Polynucleotide
taatacgactcactatagggtgggtcagcagcacacggcacatctccgggaacagaggagacccggaatggtgccgtgtaacctggcggcagcgcaaaagatg

SEQ ID NO: 113017 - DNA, 103 bp, Artificial Sequence
  Synthetic Polynucleotide
taatacgactcactatagggcatgatctcgtgggtcagcagcacacggcaaacagaggagatgccgtatgctgctgaccaacctggcggcagcgcaaaagatg

SEQ ID NO: 113018 - DNA, 103 bp, Artificial Sequence
  Synthetic Polynucleotide
taatacgactcactatagggaccggctgcacatgatctcgtgggtcagcaaacagaggagatgctgaatgacgagatcaaacctggcggcagcgcaaaagatg

SEQ ID NO: 113019 - DNA, 103 bp, Artificial Sequence
  Synthetic Polynucleotide
taatacgactcactatagggttgtcacagcaccggctgcacatgatctcgaacagaggagacgagatatggtgcagccgaacctggcggcagcgcaaaagatg

SEQ ID NO: 113020 - DNA, 103 bp, Artificial Sequence
  Synthetic Polynucleotide
taatacgactcactatagggacaacttttcttgtcacagcaccggctgcaaacagaggagatgcagcatgtgctgtgacaacctggcggcagcgcaaaagatg

SEQ ID NO: 113021 - DNA, 103 bp, Artificial Sequence
  Synthetic Polynucleotide
taatacgactcactatagggtgccgctgcccagcggctcctccttcatggaacagaggagaccatgaatgaggagccgcaacctggcggcagcgcaaaagatg

SEQ ID NO: 113022 - DNA, 103 bp, Artificial Sequence
  Synthetic Polynucleotide
taatacgactcactatagggttctattgccacaacttttcttgtcacagcaacagaggagagctgtgatgagaaaagttaacctggcggcagcgcaaaagatg

SEQ ID NO: 113023 - DNA, 103 bp, Artificial Sequence
  Synthetic Polynucleotide
taatacgactcactatagggggcgtttcgtttctattgccacaacttttcaacagaggagagaaaagatgtggcaatagaacctggcggcagcgcaaaagatg

SEQ ID NO: 113024 - DNA, 103 bp, Artificial Sequence
  Synthetic Polynucleotide
taatacgactcactatagggagggtctgagggcgtttcgtttctattgccaacagaggagaggcaatatgaacgaaacgaacctggcggcagcgcaaaagatg

SEQ ID NO: 113025 - DNA, 103 bp, Artificial Sequence
  Synthetic Polynucleotide
taatacgactcactatagggcaatgattacagggtctgagggcgtttcgtaacagaggagaacgaaaatgcctcagaccaacctggcggcagcgcaaaagatg

SEQ ID NO: 113026 - DNA, 103 bp, Artificial Sequence
  Synthetic Polynucleotide
taatacgactcactatagggaagaatctgtcaatgattacagggtctgagaacagaggagactcagaatgtgtaatcataacctggcggcagcgcaaaagatg

SEQ ID NO: 113027 - DNA, 103 bp, Artificial Sequence
  Synthetic Polynucleotide
taatacgactcactatagggaaactttagaaagaatctgtcaatgattacaacagaggagagtaatcatggacagattcaacctggcggcagcgcaaaagatg

SEQ ID NO: 113028 - DNA, 103 bp, Artificial Sequence
  Synthetic Polynucleotide
taatacgactcactatagggacttgaggaaaaactttagaaagaatctgtaacagaggagaacagatatgttctaaagtaacctggcggcagcgcaaaagatg

SEQ ID NO: 113029 - DNA, 103 bp, Artificial Sequence
  Synthetic Polynucleotide
taatacgactcactatagggttctgattgcacttgaggaaaaactttagaaacagaggagatctaaaatgtttcctcaaaacctggcggcagcgcaaaagatg

SEQ ID NO: 113030 - DNA, 103 bp, Artificial Sequence
  Synthetic Polynucleotide
taatacgactcactatagggcttcaaacagttctgattgcacttgaggaaaacagaggagattcctcatgtgcaatcagaacctggcggcagcgcaaaagatg

SEQ ID NO: 113031 - DNA, 103 bp, Artificial Sequence
  Synthetic Polynucleotide
taatacgactcactatagggtgcctgcattcttcaaacagttctgattgcaacagaggagagcaatcatgactgtttgaaacctggcggcagcgcaaaagatg

SEQ ID NO: 113032 - DNA, 103 bp, Artificial Sequence
  Synthetic Polynucleotide
taatacgactcactatagggaccgggttcatgccgctgcccagcggctccaacagaggagaggagccatggggcagcggaacctggcggcagcgcaaaagatg

SEQ ID NO: 113033 - DNA, 103 bp, Artificial Sequence
  Synthetic Polynucleotide
taatacgactcactatagggtctcgagggttgcctgcattcttcaaacagaacagaggagactgtttatggaatgcaggaacctggcggcagcgcaaaagatg

SEQ ID NO: 113034 - DNA, 103 bp, Artificial Sequence
  Synthetic Polynucleotide
taatacgactcactatagggtctccgcatatctcgagggttgcctgcattaacagaggagaaatgcaatgaaccctcgaaacctggcggcagcgcaaaagatg

SEQ ID NO: 113035 - DNA, 103 bp, Artificial Sequence
  Synthetic Polynucleotide
taatacgactcactatagggcaacctggaatctccgcatatctcgagggtaacagaggagaaccctcatgatatgcggaaacctggcggcagcgcaaaagatg

SEQ ID NO: 113036 - DNA, 103 bp, Artificial Sequence
  Synthetic Polynucleotide
taatacgactcactataggggtcgatacaacaacctggaatctccgcataaacagaggagatatgcgatgattccaggtaacctggcggcagcgcaaaagatg

SEQ ID NO: 113037 - DNA, 103 bp, Artificial Sequence
  Synthetic Polynucleotide
taatacgactcactataggggttgactgttgtcgatacaacaacctggaaaacagaggagattccagatggttgtatcgaacctggcggcagcgcaaaagatg

SEQ ID NO: 113038 - DNA, 103 bp, Artificial Sequence
  Synthetic Polynucleotide
taatacgactcactatagggggccgtccacgttgactgttgtcgatacaaaacagaggagattgtatatgcaacagtcaaacctggcggcagcgcaaaagatg

SEQ ID NO: 113039 - DNA, 103 bp, Artificial Sequence
  Synthetic Polynucleotide
taatacgactcactataggggccagcacgtggccgtccacgttgactgttaacagaggagaaacagtatgcgtggacggaacctggcggcagcgcaaaagatg

SEQ ID NO: 113040 - DNA, 103 bp, Artificial Sequence
  Synthetic Polynucleotide
taatacgactcactataggggtctgacacggccagcacgtggccgtccacaacagaggagagtggacatgcacgtgctgaacctggcggcagcgcaaaagatg

SEQ ID NO: 113041 - DNA, 103 bp, Artificial Sequence
  Synthetic Polynucleotide
taatacgactcactatagggcaaacatgttgtctgacacggccagcacgtaacagaggagaacgtgcatgccgtgtcagaacctggcggcagcgcaaaagatg

SEQ ID NO: 113042 - DNA, 103 bp, Artificial Sequence
  Synthetic Polynucleotide
taatacgactcactatagggttgttgtgcacaaacatgttgtctgacacgaacagaggagacgtgtcatgcaacatgttaacctggcggcagcgcaaaagatg

SEQ ID NO: 113043 - DNA, 103 bp, Artificial Sequence
  Synthetic Polynucleotide
taatacgactcactatagggccacgagcgcaccgggttcatgccgctgccaacagaggagaggcagcatgatgaacccgaacctggcggcagcgcaaaagatg

SEQ ID NO: 113044 - DNA, 103 bp, Artificial Sequence
  Synthetic Polynucleotide
taatacgactcactataggggtgtttggaattgttgtgcacaaacatgttaacagaggagaaacatgatggtgcacaacaacctggcggcagcgcaaaagatg

SEQ ID NO: 113045 - DNA, 103 bp, Artificial Sequence
  Synthetic Polynucleotide
taatacgactcactatagggcccgcctcccgtgtttggaattgttgtgcaaacagaggagatgcacaatgattccaaacaacctggcggcagcgcaaaagatg

SEQ ID NO: 113046 - DNA, 103 bp, Artificial Sequence
  Synthetic Polynucleotide
taatacgactcactatagggaggcggcgggcccgcctcccgtgtttggaaaacagaggagattccaaatgcgggaggcgaacctggcggcagcgcaaaagatg

SEQ ID NO: 113047 - DNA, 103 bp, Artificial Sequence
  Synthetic Polynucleotide
taatacgactcactatagggtgacgggtctaggcggcgggcccgcctcccaacagaggagagggaggatggcccgccgcaacctggcggcagcgcaaaagatg

SEQ ID NO: 113048 - DNA, 103 bp, Artificial Sequence
  Synthetic Polynucleotide
taatacgactcactataggggagtggcttctgacgggtctaggcggcgggaacagaggagacccgccatgtagacccgtaacctggcggcagcgcaaaagatg

SEQ ID NO: 113049 - DNA, 103 bp, Artificial Sequence
  Synthetic Polynucleotide
taatacgactcactatagggttgatgcacggagtggcttctgacgggtctaacagaggagaagacccatgagaagccacaacctggcggcagcgcaaaagatg

SEQ ID NO: 113050 - DNA, 103 bp, Artificial Sequence
  Synthetic Polynucleotide
taatacgactcactatagggactgatggccttgatgcacggagtggcttcaacagaggagagaagccatgccgtgcatcaacctggcggcagcgcaaaagatg

SEQ ID NO: 113051 - DNA, 103 bp, Artificial Sequence
  Synthetic Polynucleotide
taatacgactcactatagggcttcactgggactgatggccttgatgcacgaacagaggagacgtgcaatgaggccatcaaacctggcggcagcgcaaaagatg

SEQ ID NO: 113052 - DNA, 103 bp, Artificial Sequence
  Synthetic Polynucleotide
taatacgactcactataggggtggtccagccttcactgggactgatggccaacagaggagaggccatatgtcccagtgaaacctggcggcagcgcaaaagatg

SEQ ID NO: 113053 - DNA, 103 bp, Artificial Sequence
  Synthetic Polynucleotide
taatacgactcactatagggggcaccccccgtggtccagccttcactgggaacagaggagacccagtatgggctggaccaacctggcggcagcgcaaaagatg

SEQ ID NO: 113054 - DNA, 103 bp, Artificial Sequence
  Synthetic Polynucleotide
taatacgactcactatagggccgtgtgcatccacgagcgcaccgggttcaaacagaggagatgaaccatgtgcgctcgtaacctggcggcagcgcaaaagatg

SEQ ID NO: 113055 - DNA, 103 bp, Artificial Sequence
  Synthetic Polynucleotide
taatacgactcactatagggtgatgacggtggcaccccccgtggtccagcaacagaggagagctggaatgcggggggtgaacctggcggcagcgcaaaagatg

SEQ ID NO: 113056 - DNA, 103 bp, Artificial Sequence
  Synthetic Polynucleotide
taatacgactcactatagggtcgccaattatgatgacggtggcaccccccaacagaggagaggggggatgcaccgtcataacctggcggcagcgcaaaagatg

SEQ ID NO: 113057 - DNA, 103 bp, Artificial Sequence
  Synthetic Polynucleotide
taatacgactcactatagggaaagaagttgtcgccaattatgatgacggtaacagaggagaaccgtcatgataattggcaacctggcggcagcgcaaaagatg

SEQ ID NO: 113058 - DNA, 103 bp, Artificial Sequence
  Synthetic Polynucleotide
taatacgactcactataggggcagcccgtcaaagaagttgtcgccaattaaacagaggagataattgatgacaacttctaacctggcggcagcgcaaaagatg

SEQ ID NO: 113059 - DNA, 103 bp, Artificial Sequence
  Synthetic Polynucleotide
taatacgactcactatagggaatacaacttgcagcccgtcaaagaagttgaacagaggagacaacttatgtgacgggctaacctggcggcagcgcaaaagatg

SEQ ID NO: 113060 - DNA, 103 bp, Artificial Sequence
  Synthetic Polynucleotide
taatacgactcactatagggcatagttccgaatacaacttgcagcccgtcaacagaggagagacgggatgcaagttgtaaacctggcggcagcgcaaaagatg

SEQ ID NO: 113061 - DNA, 103 bp, Artificial Sequence
  Synthetic Polynucleotide
taatacgactcactatagggtccacaccaacatagttccgaatacaacttaacagaggagaaagttgatgtcggaactaaacctggcggcagcgcaaaagatg

SEQ ID NO: 113062 - DNA, 103 bp, Artificial Sequence
  Synthetic Polynucleotide
taatacgactcactatagggatcagctcgctccacaccaacatagttccgaacagaggagacggaacatggttggtgtgaacctggcggcagcgcaaaagatg

SEQ ID NO: 113063 - DNA, 103 bp, Artificial Sequence
  Synthetic Polynucleotide
taatacgactcactatagggatggggagttatcagctcgctccacaccaaaacagaggagattggtgatgagcgagctgaacctggcggcagcgcaaaagatg

SEQ ID NO: 113064 - DNA, 103 bp, Artificial Sequence
  Synthetic Polynucleotide
taatacgactcactatagggctcggatggcatggggagttatcagctcgcaacagaggagagcgagcatgtaactccccaacctggcggcagcgcaaaagatg

SEQ ID NO: 113065 - DNA, 103 bp, Artificial Sequence
  Synthetic Polynucleotide
taatacgactcactatagggaccacgcccgccgtgtgcatccacgagcgcaacagaggagagcgctcatggatgcacacaacctggcggcagcgcaaaagatg

SEQ ID NO: 113066 - DNA, 103 bp, Artificial Sequence
  Synthetic Polynucleotide
taatacgactcactatagggggggtctggactcggatggcatggggagttaacagaggagaaactccatgtgccatccgaacctggcggcagcgcaaaagatg

SEQ ID NO: 113067 - DNA, 103 bp, Artificial Sequence
  Synthetic Polynucleotide
taatacgactcactataggggtgcctcggcggggtctggactcggatggcaacagaggagagccatcatggtccagaccaacctggcggcagcgcaaaagatg

SEQ ID NO: 113068 - DNA, 103 bp, Artificial Sequence
  Synthetic Polynucleotide
taatacgactcactatagggcgccaggaatgtgcctcggcggggtctggaaacagaggagatccagaatgcgccgaggcaacctggcggcagcgcaaaagatg

SEQ ID NO: 113069 - DNA, 103 bp, Artificial Sequence
  Synthetic Polynucleotide
taatacgactcactatagggacttcgacgacgccaggaatgtgcctcggcaacagaggagagccgagatgcattcctggaacctggcggcagcgcaaaagatg

SEQ ID NO: 113070 - DNA, 103 bp, Artificial Sequence
  Synthetic Polynucleotide
taatacgactcactatagggggagagggtcacttcgacgacgccaggaataacagaggagaattcctatggtcgtcgaaaacctggcggcagcgcaaaagatg

SEQ ID NO: 113071 - DNA, 103 bp, Artificial Sequence
  Synthetic Polynucleotide
taatacgactcactatagggtggatttgtaggagagggtcacttcgacgaaacagaggagatcgtcgatgtgaccctctaacctggcggcagcgcaaaagatg

SEQ ID NO: 113072 - DNA, 103 bp, Artificial Sequence
  Synthetic Polynucleotide
taatacgactcactatagggcagaactgcttggatttgtaggagagggtcaacagaggagagaccctatgctacaaatcaacctggcggcagcgcaaaagatg

SEQ ID NO: 113073 - DNA, 103 bp, Artificial Sequence
  Synthetic Polynucleotide
taatacgactcactatagggagcacctttgcagaactgcttggatttgtaaacagaggagatacaaaatgaagcagttcaacctggcggcagcgcaaaagatg

SEQ ID NO: 113074 - DNA, 103 bp, Artificial Sequence
  Synthetic Polynucleotide
taatacgactcactatagggagcgcccaggagcacctttgcagaactgctaacagaggagaagcagtatggcaaaggtgaacctggcggcagcgcaaaagatg

SEQ ID NO: 113075 - DNA, 103 bp, Artificial Sequence
  Synthetic Polynucleotide
taatacgactcactataggggtgtagacaaagcgcccaggagcacctttgaacagaggagacaaaggatgtcctgggcgaacctggcggcagcgcaaaagatg

SEQ ID NO: 113076 - DNA, 103 bp, Artificial Sequence
  Synthetic Polynucleotide
taatacgactcactataggggttcagcccgctgcggggcagagcgtccataacagaggagaatggacatgctgccccgcaacctggcggcagcgcaaaagatg

SEQ ID NO: 113077 - DNA, 103 bp, Artificial Sequence
  Synthetic Polynucleotide
taatacgactcactatagggcgccgcggtgctggcgtccaggatgcccgcaacagaggagagcgggcatgctggacgccaacctggcggcagcgcaaaagatg

SEQ ID NO: 113078 - DNA, 103 bp, Artificial Sequence
  Synthetic Polynucleotide
taatacgactcactataggggggctcgttcagagctgtgtagacaaagcgaacagaggagacgctttatgtacacagctaacctggcggcagcgcaaaagatg

SEQ ID NO: 113079 - DNA, 103 bp, Artificial Sequence
  Synthetic Polynucleotide
taatacgactcactatagggagtcaatggtgggctcgttcagagctgtgtaacagaggagaacacagatgtgaacgagcaacctggcggcagcgcaaaagatg

SEQ ID NO: 113080 - DNA, 103 bp, Artificial Sequence
  Synthetic Polynucleotide
taatacgactcactatagggtggaatccgtagtcaatggtgggctcgttcaacagaggagagaacgaatgcaccattgaaacctggcggcagcgcaaaagatg

SEQ ID NO: 113081 - DNA, 103 bp, Artificial Sequence
  Synthetic Polynucleotide
taatacgactcactatagggctgtagcctctggaatccgtagtcaatggtaacagaggagaaccattatgtacggattcaacctggcggcagcgcaaaagatg

SEQ ID NO: 113082 - DNA, 103 bp, Artificial Sequence
  Synthetic Polynucleotide
taatacgactcactataggggaatgactttctgtagcctctggaatccgtaacagaggagaacggatatgagaggctacaacctggcggcagcgcaaaagatg

SEQ ID NO: 113083 - DNA, 103 bp, Artificial Sequence
  Synthetic Polynucleotide
taatacgactcactataggggggtgtctgggaatgactttctgtagcctcaacagaggagagaggctatggaaagtcataacctggcggcagcgcaaaagatg

SEQ ID NO: 113084 - DNA, 103 bp, Artificial Sequence
  Synthetic Polynucleotide
taatacgactcactatagggggggtctccggggtgtctgggaatgactttaacagaggagaaaagtcatgcccagacacaacctggcggcagcgcaaaagatg

SEQ ID NO: 113085 - DNA, 103 bp, Artificial Sequence
  Synthetic Polynucleotide
taatacgactcactataggggcagcctctcggggtctccggggtgtctggaacagaggagaccagacatgccggagaccaacctggcggcagcgcaaaagatg

SEQ ID NO: 113086 - DNA, 103 bp, Artificial Sequence
  Synthetic Polynucleotide
taatacgactcactatagggacttccttgggcagcctctcggggtctccgaacagaggagacggagaatgcgagaggctaacctggcggcagcgcaaaagatg

SEQ ID NO: 113087 - DNA, 103 bp, Artificial Sequence
  Synthetic Polynucleotide
taatacgactcactatagggcttcagcagcacttccttgggcagcctctcaacagaggagagagaggatgcccaaggaaaacctggcggcagcgcaaaagatg

SEQ ID NO: 113088 - DNA, 103 bp, Artificial Sequence
  Synthetic Polynucleotide
taatacgactcactatagggcgccactctgcgccgcggtgctggcgtccaaacagaggagatggacgatggcaccgcggaacctggcggcagcgcaaaagatg

SEQ ID NO: 113089 - DNA, 103 bp, Artificial Sequence
  Synthetic Polynucleotide
taatacgactcactatagggcggccgcccgcttcagcagcacttccttggaacagaggagaccaaggatgtgctgctgaaacctggcggcagcgcaaaagatg

SEQ ID NO: 113090 - DNA, 103 bp, Artificial Sequence
  Synthetic Polynucleotide
taatacgactcactatagggtctgccaagtcggccgcccgcttcagcagcaacagaggagagctgctatggcgggcggcaacctggcggcagcgcaaaagatg

SEQ ID NO: 113091 - DNA, 103 bp, Artificial Sequence
  Synthetic Polynucleotide
taatacgactcactataggggtacagggcttctgccaagtcggccgcccgaacagaggagacgggcgatggacttggcaaacctggcggcagcgcaaaagatg

SEQ ID NO: 113092 - DNA, 103 bp, Artificial Sequence
  Synthetic Polynucleotide
taatacgactcactatagggcgggcactccgtacagggcttctgccaagtaacagaggagaacttggatgaagccctgtaacctggcggcagcgcaaaagatg

SEQ ID NO: 113093 - DNA, 103 bp, Artificial Sequence
  Synthetic Polynucleotide
taatacgactcactatagggtggttactgccgggcactccgtacagggctaacagaggagaagccctatgcggagtgccaacctggcggcagcgcaaaagatg

SEQ ID NO: 113094 - DNA, 103 bp, Artificial Sequence
  Synthetic Polynucleotide
taatacgactcactataggggagcagctcctggttactgccgggcactccaacagaggagaggagtgatgggcagtaacaacctggcggcagcgcaaaagatg

SEQ ID NO: 113095 - DNA, 103 bp, Artificial Sequence
  Synthetic Polynucleotide
taatacgactcactatagggcgcgcttcaggagcagctcctggttactgcaacagaggagagcagtaatgaggagctgcaacctggcggcagcgcaaaagatg

SEQ ID NO: 113096 - DNA, 103 bp, Artificial Sequence
  Synthetic Polynucleotide
taatacgactcactatagggacgtccgccgcgcgcttcaggagcagctccaacagaggagaggagctatgcctgaagcgaacctggcggcagcgcaaaagatg

SEQ ID NO: 113097 - DNA, 103 bp, Artificial Sequence
  Synthetic Polynucleotide
taatacgactcactatagggagcctcggccacgtccgccgcgcgcttcagaacagaggagactgaagatggcggcggacaacctggcggcagcgcaaaagatg

SEQ ID NO: 113098 - DNA, 103 bp, Artificial Sequence
  Synthetic Polynucleotide
taatacgactcactatagggtgctgtacagagcctcggccacgtccgccgaacagaggagacggcggatgtggccgaggaacctggcggcagcgcaaaagatg

SEQ ID NO: 113099 - DNA, 103 bp, Artificial Sequence
  Synthetic Polynucleotide
taatacgactcactataggggccagacccacgccactctgcgccgcggtgaacagaggagacaccgcatggcagagtggaacctggcggcagcgcaaaagatg

SEQ ID NO: 113100 - DNA, 103 bp, Artificial Sequence
  Synthetic Polynucleotide
taatacgactcactataggggcgcggggggtgctgtacagagcctcggccaacagaggagaggccgaatgtctgtacagaacctggcggcagcgcaaaagatg

SEQ ID NO: 113101 - DNA, 103 bp, Artificial Sequence
  Synthetic Polynucleotide
taatacgactcactatagggcggcccgggtgcgcggggggtgctgtacagaacagaggagactgtacatgaccccccgcaacctggcggcagcgcaaaagatg

SEQ ID NO: 113102 - DNA, 103 bp, Artificial Sequence
  Synthetic Polynucleotide
taatacgactcactatagggggggtgcgagcggcccgggtgcgcggggggaacagaggagaccccccatgcacccgggcaacctggcggcagcgcaaaagatg

SEQ ID NO: 113103 - DNA, 103 bp, Artificial Sequence
  Synthetic Polynucleotide
taatacgactcactatagggctcggggccaggggtgcgagcggcccgggtaacagaggagaacccggatggctcgcaccaacctggcggcagcgcaaaagatg

SEQ ID NO: 113104 - DNA, 103 bp, Artificial Sequence
  Synthetic Polynucleotide
taatacgactcactataggggtgtgggtggctcggggccaggggtgcgagaacagaggagactcgcaatgctggccccgaacctggcggcagcgcaaaagatg

SEQ ID NO: 113105 - DNA, 103 bp, Artificial Sequence
  Synthetic Polynucleotide
taatacgactcactatagggcgacggcggggtgtgggtggctcggggccaaacagaggagatggcccatggccacccacaacctggcggcagcgcaaaagatg

SEQ ID NO: 113106 - DNA, 103 bp, Artificial Sequence
  Synthetic Polynucleotide
taatacgactcactatagggttgatgcccacgacggcggggtgtgggtggaacagaggagaccacccatgccccgccgtaacctggcggcagcgcaaaagatg

SEQ ID NO: 113107 - DNA, 103 bp, Artificial Sequence
  Synthetic Polynucleotide
taatacgactcactataggggctgaaggcgttgatgcccacgacggcgggaacagaggagacccgccatggtgggcatcaacctggcggcagcgcaaaagatg

SEQ ID NO: 113108 - DNA, 103 bp, Artificial Sequence
  Synthetic Polynucleotide
taatacgactcactatagggccagcgggctgctgaaggcgttgatgcccaaacagaggagatgggcaatgacgccttcaaacctggcggcagcgcaaaagatg

SEQ ID NO: 113109 - DNA, 103 bp, Artificial Sequence
  Synthetic Polynucleotide
taatacgactcactatagggacggcgatggccagcgggctgctgaaggcgaacagaggagacgccttatgcagcccgctaacctggcggcagcgcaaaagatg

SEQ ID NO: 113110 - DNA, 103 bp, Artificial Sequence
  Synthetic Polynucleotide
taatacgactcactatagggatgtgctcgtgccagacccacgccactctgaacagaggagacagagtatggtgggtctgaacctggcggcagcgcaaaagatg

SEQ ID NO: 113111 - DNA, 103 bp, Artificial Sequence
  Synthetic Polynucleotide
taatacgactcactatagggggcgtccccgacggcgatggccagcgggctaacagaggagaagcccgatggccatcgccaacctggcggcagcgcaaaagatg

SEQ ID NO: 113112 - DNA, 103 bp, Artificial Sequence
  Synthetic Polynucleotide
taatacgactcactataggggccccggggtggcgtccccgacggcgatggaacagaggagaccatcgatgtcggggacgaacctggcggcagcgcaaaagatg

SEQ ID NO: 113113 - DNA, 103 bp, Artificial Sequence
  Synthetic Polynucleotide
taatacgactcactatagggcccggctcgggccccggggtggcgtccccgaacagaggagacggggaatgcaccccgggaacctggcggcagcgcaaaagatg

SEQ ID NO: 113114 - DNA, 103 bp, Artificial Sequence
  Synthetic Polynucleotide
taatacgactcactataggggcgcgcgtagcccggctcgggccccggggtaacagaggagaaccccgatgcccgagccgaacctggcggcagcgcaaaagatg

SEQ ID NO: 113115 - DNA, 103 bp, Artificial Sequence
  Synthetic Polynucleotide
taatacgactcactatagggtgctgcagctgcgcgcgtagcccggctcggaacagaggagaccgagcatggctacgcgcaacctggcggcagcgcaaaagatg

SEQ ID NO: 113116 - DNA, 103 bp, Artificial Sequence
  Synthetic Polynucleotide
taatacgactcactatagggggggacgcgctgctgcagctgcgcgcgtagaacagaggagactacgcatgcagctgcagaacctggcggcagcgcaaaagatg

SEQ ID NO: 113117 - DNA, 103 bp, Artificial Sequence
  Synthetic Polynucleotide
taatacgactcactataggggaacccgcggggggacgcgctgctgcagctaacagaggagaagctgcatgagcgcgtccaacctggcggcagcgcaaaagatg

SEQ ID NO: 113118 - DNA, 103 bp, Artificial Sequence
  Synthetic Polynucleotide
taatacgactcactatagggggctgggcgcgaacccgcggggggacgcgcaacagaggagagcgcgtatgcccgcgggtaacctggcggcagcgcaaaagatg

SEQ ID NO: 113119 - DNA, 103 bp, Artificial Sequence
  Synthetic Polynucleotide
taatacgactcactatagggtgcgagccggggctgggcgcgaacccgcggaacagaggagaccgcggatgcgcgcccagaacctggcggcagcgcaaaagatg

SEQ ID NO: 113120 - DNA, 103 bp, Artificial Sequence
  Synthetic Polynucleotide
taatacgactcactataggggccgctctgctgcgagccggggctgggcgcaacagaggagagcgcccatgcccggctcgaacctggcggcagcgcaaaagatg

SEQ ID NO: 113121 - DNA, 103 bp, Artificial Sequence
  Synthetic Polynucleotide
taatacgactcactataggggcttctcaaaatgtgctcgtgccagacccaaacagaggagatgggtcatgcacgagcacaacctggcggcagcgcaaaagatg

SEQ ID NO: 113122 - DNA, 103 bp, Artificial Sequence
  Synthetic Polynucleotide
taatacgactcactatagggcgccgccgtagccgctctgctgcgagccggaacagaggagaccggctatgagcagagcgaacctggcggcagcgcaaaagatg

SEQ ID NO: 113123 - DNA, 103 bp, Artificial Sequence
  Synthetic Polynucleotide
taatacgactcactataggggctccgaggccgccgccgtagccgctctgcaacagaggagagcagagatgctacggcggaacctggcggcagcgcaaaagatg

SEQ ID NO: 113124 - DNA, 103 bp, Artificial Sequence
  Synthetic Polynucleotide
taatacgactcactataggggcccaggccagctccgaggccgccgccgtaaacagaggagatacggcatgggcctcggaaacctggcggcagcgcaaaagatg

SEQ ID NO: 113125 - DNA, 103 bp, Artificial Sequence
  Synthetic Polynucleotide
taatacgactcactatagggcgccgtagccgcccaggccagctccgaggcaacagaggagagcctcgatgctggcctggaacctggcggcagcgcaaaagatg

SEQ ID NO: 113126 - DNA, 103 bp, Artificial Sequence
  Synthetic Polynucleotide
taatacgactcactatagggacgcccggcgcgccgtagccgcccaggccaaacagaggagatggcctatgcggctacggaacctggcggcagcgcaaaagatg

SEQ ID NO: 113127 - DNA, 103 bp, Artificial Sequence
  Synthetic Polynucleotide
taatacgactcactataggggaggccggccacgcccggcgcgccgtagccaacagaggagaggctacatggcgccgggcaacctggcggcagcgcaaaagatg

SEQ ID NO: 113128 - DNA, 103 bp, Artificial Sequence
  Synthetic Polynucleotide
taatacgactcactatagggcaggcacgccgaggccggccacgcccggcgaacagaggagacgccggatgtggccggccaacctggcggcagcgcaaaagatg

SEQ ID NO: 113129 - DNA, 103 bp, Artificial Sequence
  Synthetic Polynucleotide
taatacgactcactatagggctgggggacccaggcacgccgaggccggccaacagaggagaggccggatgcggcgtgccaacctggcggcagcgcaaaagatg

SEQ ID NO: 113130 - DNA, 103 bp, Artificial Sequence
  Synthetic Polynucleotide
taatacgactcactatagggattgaggaagctgggggacccaggcacgccaacagaggagaggcgtgatggggtcccccaacctggcggcagcgcaaaagatg

SEQ ID NO: 113131 - DNA, 103 bp, Artificial Sequence
  Synthetic Polynucleotide
taatacgactcactatagggcggtggagccattgaggaagctgggggaccaacagaggagaggtcccatggcttcctcaaacctggcggcagcgcaaaagatg

SEQ ID NO: 113132 - DNA, 103 bp, Artificial Sequence
  Synthetic Polynucleotide
taatacgactcactataggggagggaggctgcttctcaaaatgtgctcgtaacagaggagaacgagcatgttttgagaaaacctggcggcagcgcaaaagatg

SEQ ID NO: 113133 - DNA, 103 bp, Artificial Sequence
  Synthetic Polynucleotide
taatacgactcactatagggggcgaggtggcggtggagccattgaggaagaacagaggagacttcctatgtggctccacaacctggcggcagcgcaaaagatg

SEQ ID NO: 113134 - DNA, 103 bp, Artificial Sequence
  Synthetic Polynucleotide
taatacgactcactataggggatggcgaagggcgaggtggcggtggagccaacagaggagaggctccatggccacctcgaacctggcggcagcgcaaaagatg

SEQ ID NO: 113135 - DNA, 103 bp, Artificial Sequence
  Synthetic Polynucleotide
taatacgactcactatagggtagagggcatgatggcgaagggcgaggtggaacagaggagaccacctatgccttcgccaaacctggcggcagcgcaaaagatg

SEQ ID NO: 113136 - DNA, 103 bp, Artificial Sequence
  Synthetic Polynucleotide
taatacgactcactatagggagcggggggctagagggcatgatggcgaagaacagaggagacttcgcatgcatgccctcaacctggcggcagcgcaaaagatg

SEQ ID NO: 113137 - DNA, 103 bp, Artificial Sequence
  Synthetic Polynucleotide
taatacgactcactatagggggcagccgccagcggggggctagagggcataacagaggagaatgcccatgagccccccgaacctggcggcagcgcaaaagatg

SEQ ID NO: 113138 - DNA, 103 bp, Artificial Sequence
  Synthetic Polynucleotide
taatacgactcactatagggacatggaggaggcagccgccagcggggggcaacagaggagagcccccatgtggcggctgaacctggcggcagcgcaaaagatg

SEQ ID NO: 113139 - DNA, 103 bp, Artificial Sequence
  Synthetic Polynucleotide
taatacgactcactataggggccgggagggacatggaggaggcagccgccaacagaggagaggcggcatgctcctccataacctggcggcagcgcaaaagatg

SEQ ID NO: 113140 - DNA, 103 bp, Artificial Sequence
  Synthetic Polynucleotide
taatacgactcactataggggggggcagcggccgggagggacatggaggaaacagaggagatcctccatgtccctcccgaacctggcggcagcgcaaaagatg

SEQ ID NO: 113141 - DNA, 103 bp, Artificial Sequence
  Synthetic Polynucleotide
taatacgactcactatagggcgctggtggtgggggcagcggccgggagggaacagaggagaccctccatgccgctgcccaacctggcggcagcgcaaaagatg

SEQ ID NO: 113142 - DNA, 103 bp, Artificial Sequence
  Synthetic Polynucleotide
taatacgactcactatagggaaggagaacacgctggtggtgggggcagcgaacagaggagacgctgcatgcaccaccagaacctggcggcagcgcaaaagatg

SEQ ID NO: 113143 - DNA, 103 bp, Artificial Sequence
  Synthetic Polynucleotide
taatacgactcactatagggcctgaggttggagggaggctgcttctcaaaaacagaggagatttgagatgcagcctcccaacctggcggcagcgcaaaagatg

SEQ ID NO: 113144 - DNA, 103 bp, Artificial Sequence
  Synthetic Polynucleotide
taatacgactcactataggggacaggcgagaaggagaacacgctggtggtaacagaggagaaccaccatggtgttctccaacctggcggcagcgcaaaagatg

SEQ ID NO: 113145 - DNA, 103 bp, Artificial Sequence
  Synthetic Polynucleotide
taatacgactcactatagggagatcatgttgacaggcgagaaggagaacaaacagaggagatgttctatgtctcgcctgaacctggcggcagcgcaaaagatg

SEQ ID NO: 113146 - DNA, 103 bp, Artificial Sequence
  Synthetic Polynucleotide
taatacgactcactatagggttgacggcggagatcatgttgacaggcgagaacagaggagactcgccatgcaacatgataacctggcggcagcgcaaaagatg

SEQ ID NO: 113147 - DNA, 103 bp, Artificial Sequence
  Synthetic Polynucleotide
taatacgactcactataggggctcctctgtttgacggcggagatcatgttaacagaggagaaacatgatgtccgccgtcaacctggcggcagcgcaaaagatg

SEQ ID NO: 113148 - DNA, 103 bp, Artificial Sequence
  Synthetic Polynucleotide
taatacgactcactataggggggcgaaggcgctcctctgtttgacggcggaacagaggagaccgccgatgaacagaggaaacctggcggcagcgcaaaagatg

SEQ ID NO: 113149 - DNA, 103 bp, Artificial Sequence
  Synthetic Polynucleotide
taatacgactcactatagggcgcagcacgggggcgaaggcgctcctctgtaacagaggagaacagagatgcgccttcgcaacctggcggcagcgcaaaagatg

SEQ ID NO: 113150 - DNA, 103 bp, Artificial Sequence
  Synthetic Polynucleotide
taatacgactcactataggggcttggggggcgcagcacgggggcgaaggcaacagaggagagccttcatgcccgtgctgaacctggcggcagcgcaaaagatg

SEQ ID NO: 113151 - DNA, 103 bp, Artificial Sequence
  Synthetic Polynucleotide
taatacgactcactatagggggggtggggagcttggggggcgcagcacggaacagaggagaccgtgcatggccccccaaaacctggcggcagcgcaaaagatg

SEQ ID NO: 113152 - DNA, 103 bp, Artificial Sequence
  Synthetic Polynucleotide
taatacgactcactataggggggcaggcctggggtggggagcttggggggaacagaggagaccccccatgctccccaccaacctggcggcagcgcaaaagatg

SEQ ID NO: 113153 - DNA, 103 bp, Artificial Sequence
  Synthetic Polynucleotide
taatacgactcactataggggtgggctctggggcaggcctggggtggggaaacagaggagatccccaatgcaggcctgcaacctggcggcagcgcaaaagatg

SEQ ID NO: 113154 - DNA, 103 bp, Artificial Sequence
  Synthetic Polynucleotide
taatacgactcactatagggagttggatttcctgaggttggagggaggctaacagaggagaagcctcatgccaacctcaaacctggcggcagcgcaaaagatg

SEQ ID NO: 113155 - DNA, 103 bp, Artificial Sequence
  Synthetic Polynucleotide
taatacgactcactataggggcccctctccgtgggctctggggcaggcctaacagaggagaaggcctatgccagagcccaacctggcggcagcgcaaaagatg

SEQ ID NO: 113156 - DNA, 103 bp, Artificial Sequence
  Synthetic Polynucleotide
taatacgactcactatagggtggtctggaagcccctctccgtgggctctgaacagaggagacagagcatgcggagagggaacctggcggcagcgcaaaagatg

SEQ ID NO: 113157 - DNA, 103 bp, Artificial Sequence
  Synthetic Polynucleotide
taatacgactcactatagggctcaaaagactggtctggaagcccctctccaacagaggagaggagagatgcttccagacaacctggcggcagcgcaaaagatg

SEQ ID NO: 113158 - DNA, 103 bp, Artificial Sequence
  Synthetic Polynucleotide
taatacgactcactatagggtgtcagaatcctcaaaagactggtctggaaaacagaggagattccagatgagtcttttgaacctggcggcagcgcaaaagatg

SEQ ID NO: 113159 - DNA, 103 bp, Artificial Sequence
  Synthetic Polynucleotide
taatacgactcactataggggagtgaaacttgtcagaatcctcaaaagacaacagaggagagtctttatgggattctgaaacctggcggcagcgcaaaagatg

SEQ ID NO: 113160 - DNA, 103 bp, Artificial Sequence
  Synthetic Polynucleotide
taatacgactcactatagggccgggctggagagtgaaacttgtcagaatcaacagaggagagattctatgaagtttcacaacctggcggcagcgcaaaagatg

SEQ ID NO: 113161 - DNA, 103 bp, Artificial Sequence
  Synthetic Polynucleotide
taatacgactcactatagggcctgaagcccccgggctggagagtgaaactaacagaggagaagtttcatgctccagcccaacctggcggcagcgcaaaagatg

SEQ ID NO: 113162 - DNA, 103 bp, Artificial Sequence
  Synthetic Polynucleotide
taatacgactcactatagggtatgccaggccctgaagcccccgggctggaaacagaggagatccagcatgggggcttcaaacctggcggcagcgcaaaagatg

SEQ ID NO: 113163 - DNA, 103 bp, Artificial Sequence
  Synthetic Polynucleotide
taatacgactcactatagggaagtggaagaagttggatttcctgaggttgaacagaggagacaacctatggaaatccaaaacctggcggcagcgcaaaagatg

SEQ ID NO: 113164 - DNA, 103 bp, Artificial Sequence
  Synthetic Polynucleotide
taatacgactcactatagggggccagcacgaagtggaagaagttggatttaacagaggagaaaatccatgttcttccacaacctggcggcagcgcaaaagatg

SEQ ID NO: 113165 - DNA, 103 bp, Artificial Sequence
  Synthetic Polynucleotide
taatacgactcactatagggcctccttcaggttcagcccgctgcggggcaaacagaggagatgccccatggcgggctgaaacctggcggcagcgcaaaagatg

SEQ ID NO: 113166 - DNA, 103 bp, Artificial Sequence
  Synthetic Polynucleotide
taatacgactcactatagggggtcgtacatggccagcacgaagtggaagaaacagaggagatcttccatgtcgtgctggaacctggcggcagcgcaaaagatg

SEQ ID NO: 113167 - DNA, 103 bp, Artificial Sequence
  Synthetic Polynucleotide
taatacgactcactatagggtgcccctgccggtcgtacatggccagcacgaacagaggagacgtgctatgcatgtacgaaacctggcggcagcgcaaaagatg

SEQ ID NO: 113168 - DNA, 103 bp, Artificial Sequence
  Synthetic Polynucleotide
taatacgactcactatagggctccacgggctgcccctgccggtcgtacataacagaggagaatgtacatgcggcaggggaacctggcggcagcgcaaaagatg

SEQ ID NO: 113169 - DNA, 103 bp, Artificial Sequence
  Synthetic Polynucleotide
taatacgactcactatagggtgcgctccacctccacgggctgcccctgccaacagaggagaggcaggatgagcccgtggaacctggcggcagcgcaaaagatg

SEQ ID NO: 113170 - DNA, 103 bp, Artificial Sequence
  Synthetic Polynucleotide
taatacgactcactatagggatgaaggctgtgcgctccacctccacgggcaacagaggagagcccgtatgggtggagcgaacctggcggcagcgcaaaagatg

SEQ ID NO: 113171 - DNA, 103 bp, Artificial Sequence
  Synthetic Polynucleotide
taatacgactcactatagggcacgaagtcgatgaaggctgtgcgctccacaacagaggagagtggagatgacagccttcaacctggcggcagcgcaaaagatg

SEQ ID NO: 113172 - DNA, 103 bp, Artificial Sequence
  Synthetic Polynucleotide
taatacgactcactatagggggtccttttccacgaagtcgatgaaggctgaacagaggagacagcctatgtcgacttcgaacctggcggcagcgcaaaagatg

SEQ ID NO: 113173 - DNA, 103 bp, Artificial Sequence
  Synthetic Polynucleotide
taatacgactcactatagggccgggctctcggtccttttccacgaagtcgaacagaggagacgacttatgggaaaaggaaacctggcggcagcgcaaaagatg

SEQ ID NO: 113174 - DNA, 103 bp, Artificial Sequence
  Synthetic Polynucleotide
taatacgactcactatagggcttttccgccccgggctctcggtccttttcaacagaggagagaaaagatgcgagagcccaacctggcggcagcgcaaaagatg

SEQ ID NO: 113175 - DNA, 103 bp, Artificial Sequence
  Synthetic Polynucleotide
taatacgactcactatagggcattgttagtcttttccgccccgggctctcaacagaggagagagagcatggggcggaaaaacctggcggcagcgcaaaagatg

SEQ ID NO: 113176 - DNA, 103 bp, Artificial Sequence
  Synthetic Polynucleotide
taatacgactcactatagggagcagcggctcctccttcaggttcagcccgaacagaggagacgggctatgcctgaaggaaacctggcggcagcgcaaaagatg

SEQ ID NO: 113177 - DNA, 103 bp, Artificial Sequence
  Synthetic Polynucleotide
taatacgactcactatagggtaatggatcccattgttagtcttttccgccaacagaggagaggcggaatggactaacaaaacctggcggcagcgcaaaagatg

SEQ ID NO: 113178 - DNA, 103 bp, Artificial Sequence
  Synthetic Polynucleotide
taatacgactcactatagggccggaggcggtaatggatcccattgttagtaacagaggagaactaacatggggatccataacctggcggcagcgcaaaagatg

SEQ ID NO: 113179 - DNA, 103 bp, Artificial Sequence
  Synthetic Polynucleotide
taatacgactcactatagggtatacaccagccggaggcggtaatggatccaacagaggagaggatccatgaccgcctccaacctggcggcagcgcaaaagatg

SEQ ID NO: 113180 - DNA, 103 bp, Artificial Sequence
  Synthetic Polynucleotide
taatacgactcactatagggagtccattgttatacaccagccggaggcggaacagaggagaccgcctatggctggtgtaaacctggcggcagcgcaaaagatg

SEQ ID NO: 113181 - DNA, 103 bp, Artificial Sequence
  Synthetic Polynucleotide
taatacgactcactatagggctctgtccgcagtccattgttatacaccagaacagaggagactggtgatgaacaatggaaacctggcggcagcgcaaaagatg

SEQ ID NO: 113182 - DNA, 103 bp, Artificial Sequence
  Synthetic Polynucleotide
taatacgactcactatagggagaggtcttgctctgtccgcagtccattgtaacagaggagaacaatgatgtgcggacagaacctggcggcagcgcaaaagatg

SEQ ID NO: 113183 - DNA, 103 bp, Artificial Sequence
  Synthetic Polynucleotide
taatacgactcactatagggagacgcacgtagaggtcttgctctgtccgcaacagaggagagcggacatggcaagacctaacctggcggcagcgcaaaagatg

SEQ ID NO: 113184 - DNA, 103 bp, Artificial Sequence
  Synthetic Polynucleotide
taatacgactcactatagggggagtcgatgagacgcacgtagaggtcttgaacagaggagacaagacatgtacgtgcgtaacctggcggcagcgcaaaagatg

SEQ ID NO: 113185 - DNA, 103 bp, Artificial Sequence
  Synthetic Polynucleotide
taatacgactcactataggggtttggacatggagtcgatgagacgcacgtaacagaggagaacgtgcatgtcatcgactaacctggcggcagcgcaaaagatg

SEQ ID NO: 113186 - DNA, 103 bp, Artificial Sequence
  Synthetic Polynucleotide
taatacgactcactatagggatgatggcctgtttggacatggagtcgatgaacagaggagacatcgaatgcatgtccaaaacctggcggcagcgcaaaagatg

SEQ ID NO: 113187 - DNA, 103 bp, Artificial Sequence
  Synthetic Polynucleotide
taatacgactcactataggggccggcgggcagcagcggctcctccttcagaacagaggagactgaagatggagccgctgaacctggcggcagcgcaaaagatg

SEQ ID NO: 113188 - DNA, 103 bp, Artificial Sequence
  Synthetic Polynucleotide
taatacgactcactatagggcccctcatagatgatggcctgtttggacataacagaggagaatgtccatgcaggccatcaacctggcggcagcgcaaaagatg

SEQ ID NO: 113189 - DNA, 103 bp, Artificial Sequence
  Synthetic Polynucleotide
taatacgactcactatagggtcttgtcctgcccctcatagatgatggcctaacagaggagaaggccaatgtctatgaggaacctggcggcagcgcaaaagatg

SEQ ID NO: 113190 - DNA, 103 bp, Artificial Sequence
  Synthetic Polynucleotide
taatacgactcactatagggatttcggggttcttgtcctgcccctcatagaacagaggagactatgaatggcaggacaaaacctggcggcagcgcaaaagatg

SEQ ID NO: 113191 - DNA, 103 bp, Artificial Sequence
  Synthetic Polynucleotide
taatacgactcactatagggcactcggcacatttcggggttcttgtcctgaacagaggagacaggacatgaaccccgaaaacctggcggcagcgcaaaagatg

SEQ ID NO: 113192 - DNA, 103 bp, Artificial Sequence
  Synthetic Polynucleotide
taatacgactcactataggggggtgagcagcactcggcacatttcggggtaacagaggagaaccccgatgtgtgccgagaacctggcggcagcgcaaaagatg

SEQ ID NO: 113193 - DNA, 103 bp, Artificial Sequence
  Synthetic Polynucleotide
taatacgactcactatagggatgatctcatgggtgagcagcactcggcacaacagaggagagtgccgatggctgctcacaacctggcggcagcgcaaaagatg

SEQ ID NO: 113194 - DNA, 103 bp, Artificial Sequence
  Synthetic Polynucleotide
taatacgactcactatagggccggctgcacatgatctcatgggtgagcagaacagaggagactgctcatgcatgagatcaacctggcggcagcgcaaaagatg

SEQ ID NO: 113195 - DNA, 103 bp, Artificial Sequence
  Synthetic Polynucleotide
taatacgactcactatagggggtcacagcaccggctgcacatgatctcataacagaggagaatgagaatgtgtgcagccaacctggcggcagcgcaaaagatg

SEQ ID NO: 113196 - DNA, 103 bp, Artificial Sequence
  Synthetic Polynucleotide
taatacgactcactatagggcagctcttccggtcacagcaccggctgcacaacagaggagagtgcagatggtgctgtgaaacctggcggcagcgcaaaagatg

SEQ ID NO: 113197 - DNA, 103 bp, Artificial Sequence
  Synthetic Polynucleotide
taatacgactcactatagggccggttgccacagctcttccggtcacagcaaacagaggagatgctgtatgcggaagagcaacctggcggcagcgcaaaagatg

SEQ ID NO: 113198 - DNA, 103 bp, Artificial Sequence
  Synthetic Polynucleotide
taatacgactcactatagggctgagcccaggccggcgggcagcagcggctaacagaggagaagccgcatgtgcccgccgaacctggcggcagcgcaaaagatg

SEQ ID NO: 113199 - DNA, 103 bp, Artificial Sequence
  Synthetic Polynucleotide
taatacgactcactataggggcgtctcattccggttgccacagctcttccaacagaggagaggaagaatggtggcaaccaacctggcggcagcgcaaaagatg

SEQ ID NO: 113200 - DNA, 103 bp, Artificial Sequence
  Synthetic Polynucleotide
taatacgactcactataggggggtctgagggcgtctcattccggttgccaaacagaggagatggcaaatggaatgagacaacctggcggcagcgcaaaagatg

SEQ ID NO: 113201 - DNA, 103 bp, Artificial Sequence
  Synthetic Polynucleotide
taatacgactcactatagggaatgatgacggggtctgagggcgtctcattaacagaggagaaatgagatgccctcagacaacctggcggcagcgcaaaagatg

SEQ ID NO: 113202 - DNA, 103 bp, Artificial Sequence
  Synthetic Polynucleotide
taatacgactcactatagggagaacctgtcaatgatgacggggtctgaggaacagaggagacctcagatgccgtcatcaaacctggcggcagcgcaaaagatg

SEQ ID NO: 113203 - DNA, 103 bp, Artificial Sequence
  Synthetic Polynucleotide
taatacgactcactatagggaacttgaggaagaacctgtcaatgatgacgaacagaggagacgtcatatgtgacaggttaacctggcggcagcgcaaaagatg

SEQ ID NO: 113204 - DNA, 103 bp, Artificial Sequence
  Synthetic Polynucleotide
taatacgactcactatagggtttgaggaagaacttgaggaagaacctgtcaacagaggagagacaggatgttcctcaagaacctggcggcagcgcaaaagatg

SEQ ID NO: 113205 - DNA, 103 bp, Artificial Sequence
  Synthetic Polynucleotide
taatacgactcactatagggtctggttgcatttgaggaagaacttgaggaaacagaggagatcctcaatgtcttcctcaaacctggcggcagcgcaaaagatg

SEQ ID NO: 113206 - DNA, 103 bp, Artificial Sequence
  Synthetic Polynucleotide
taatacgactcactatagggttcaggcagttctggttgcatttgaggaagaacagaggagacttcctatgatgcaaccaaacctggcggcagcgcaaaagatg

SEQ ID NO: 113207 - DNA, 103 bp, Artificial Sequence
  Synthetic Polynucleotide
taatacgactcactatagggccccgcattcttcaggcagttctggttgcaaacagaggagatgcaacatgaactgcctgaacctggcggcagcgcaaaagatg

SEQ ID NO: 113208 - DNA, 103 bp, Artificial Sequence
  Synthetic Polynucleotide
taatacgactcactatagggctctgggattccccgcattcttcaggcagtaacagaggagaactgccatgagaatgcggaacctggcggcagcgcaaaagatg

SEQ ID NO: 113209 - DNA, 103 bp, Artificial Sequence
  Synthetic Polynucleotide
taatacgactcactatagggcaggagcgcactgagcccaggccggcgggcaacagaggagagcccgcatgcctgggctcaacctggcggcagcgcaaaagatg

SEQ ID NO: 113210 - DNA, 103 bp, Artificial Sequence
  Synthetic Polynucleotide
taatacgactcactatagggcggcgcatgtctctgggattccccgcattcaacagaggagagaatgcatggaatcccagaacctggcggcagcgcaaaagatg

SEQ ID NO: 113211 - DNA, 103 bp, Artificial Sequence
  Synthetic Polynucleotide
taatacgactcactatagggcacctggaagcggcgcatgtctctgggattaacagaggagaaatcccatggacatgcgcaacctggcggcagcgcaaaagatg

SEQ ID NO: 113212 - DNA, 103 bp, Artificial Sequence
  Synthetic Polynucleotide
taatacgactcactatagggtggacaccaccacctggaagcggcgcatgtaacagaggagaacatgcatggcttccaggaacctggcggcagcgcaaaagatg

SEQ ID NO: 113213 - DNA, 103 bp, Artificial Sequence
  Synthetic Polynucleotide
taatacgactcactatagggctcaccgtcgtggacaccaccacctggaagaacagaggagacttccaatgggtggtgtcaacctggcggcagcgcaaaagatg

SEQ ID NO: 113214 - DNA, 103 bp, Artificial Sequence
  Synthetic Polynucleotide
taatacgactcactatagggtccgtccacgctcaccgtcgtggacaccacaacagaggagagtggtgatgacgacggtgaacctggcggcagcgcaaaagatg

SEQ ID NO: 113215 - DNA, 103 bp, Artificial Sequence
  Synthetic Polynucleotide
taatacgactcactatagggccagcacgtgtccgtccacgctcaccgtcgaacagaggagacgacggatggcgtggacgaacctggcggcagcgcaaaagatg

SEQ ID NO: 113216 - DNA, 103 bp, Artificial Sequence
  Synthetic Polynucleotide
taatacgactcactatagggtcggacacggccagcacgtgtccgtccacgaacagaggagacgtggaatgacacgtgctaacctggcggcagcgcaaaagatg

SEQ ID NO: 113217 - DNA, 103 bp, Artificial Sequence
  Synthetic Polynucleotide
taatacgactcactatagggaaacatgttgtcggacacggccagcacgtgaacagaggagacacgtgatggccgtgtccaacctggcggcagcgcaaaagatg

SEQ ID NO: 113218 - DNA, 103 bp, Artificial Sequence
  Synthetic Polynucleotide
taatacgactcactatagggtgttgtgcacaaacatgttgtcggacacggaacagaggagaccgtgtatgacaacatgtaacctggcggcagcgcaaaagatg

SEQ ID NO: 113219 - DNA, 103 bp, Artificial Sequence
  Synthetic Polynucleotide
taatacgactcactatagggtgcttggagttgttgtgcacaaacatgttgaacagaggagacaacatatgtgtgcacaaaacctggcggcagcgcaaaagatg

SEQ ID NO: 113220 - DNA, 103 bp, Artificial Sequence
  Synthetic Polynucleotide
taatacgactcactataggggccctgcatccaggagcgcactgagcccagaacagaggagactgggcatggtgcgctccaacctggcggcagcgcaaaagatg

SEQ ID NO: 113221 - DNA, 103 bp, Artificial Sequence
  Synthetic Polynucleotide
taatacgactcactatagggcctgcggccatgcttggagttgttgtgcacaacagaggagagtgcacatgaactccaagaacctggcggcagcgcaaaagatg

SEQ ID NO: 113222 - DNA, 103 bp, Artificial Sequence
  Synthetic Polynucleotide
taatacgactcactatagggggcggcgcgccctgcggccatgcttggagtaacagaggagaactccaatgatggccgcaaacctggcggcagcgcaaaagatg

SEQ ID NO: 113223 - DNA, 103 bp, Artificial Sequence
  Synthetic Polynucleotide
taatacgactcactataggggaggggtccaggcggcgcgccctgcggccaaacagaggagatggccgatgggcgcgccgaacctggcggcagcgcaaaagatg

SEQ ID NO: 113224 - DNA, 103 bp, Artificial Sequence
  Synthetic Polynucleotide
taatacgactcactatagggggcagcttcggaggggtccaggcggcgcgcaacagaggagagcgcgcatgctggaccccaacctggcggcagcgcaaaagatg

SEQ ID NO: 113225 - DNA, 103 bp, Artificial Sequence
  Synthetic Polynucleotide
taatacgactcactatagggtgcagggggtggcagcttcggaggggtccaaacagaggagatggaccatgccgaagctgaacctggcggcagcgcaaaagatg

SEQ ID NO: 113226 - DNA, 103 bp, Artificial Sequence
  Synthetic Polynucleotide
taatacgactcactatagggatggccttgatgcagggggtggcagcttcgaacagaggagacgaagcatgcaccccctgaacctggcggcagcgcaaaagatg

SEQ ID NO: 113227 - DNA, 103 bp, Artificial Sequence
  Synthetic Polynucleotide
taatacgactcactatagggcccggggctgatggccttgatgcagggggtaacagaggagaacccccatgatcaaggccaacctggcggcagcgcaaaagatg

SEQ ID NO: 113228 - DNA, 103 bp, Artificial Sequence
  Synthetic Polynucleotide
taatacgactcactatagggtccagccctccccggggctgatggccttgaaacagaggagatcaaggatgtcagccccgaacctggcggcagcgcaaaagatg

SEQ ID NO: 113229 - DNA, 103 bp, Artificial Sequence
  Synthetic Polynucleotide
taatacgactcactatagggccgcccgtggtccagccctccccggggctgaacagaggagacagcccatgggagggctgaacctggcggcagcgcaaaagatg

SEQ ID NO: 113230 - DNA, 103 bp, Artificial Sequence
  Synthetic Polynucleotide
taatacgactcactataggggacggtggcgccgcccgtggtccagccctcaacagaggagagagggcatgaccacgggcaacctggcggcagcgcaaaagatg

SEQ ID NO: 113231 - DNA, 103 bp, Artificial Sequence
  Synthetic Polynucleotide
taatacgactcactatagggggatgcccgcgccctgcatccaggagcgcaaacagaggagatgcgctatgggatgcaggaacctggcggcagcgcaaaagatg

SEQ ID NO: 113232 - DNA, 103 bp, Artificial Sequence
  Synthetic Polynucleotide
taatacgactcactatagggcgatgacaatgacggtggcgccgcccgtggaacagaggagaccacggatggcgccaccgaacctggcggcagcgcaaaagatg

SEQ ID NO: 113233 - DNA, 103 bp, Artificial Sequence
  Synthetic Polynucleotide
taatacgactcactatagggaagttgtcgccgatgacaatgacggtggcgaacagaggagacgccacatgcattgtcataacctggcggcagcgcaaaagatg

SEQ ID NO: 113234 - DNA, 103 bp, Artificial Sequence
  Synthetic Polynucleotide
taatacgactcactatagggcccgtcgaagaagttgtcgccgatgacaataacagaggagaattgtcatgggcgacaacaacctggcggcagcgcaaaagatg

SEQ ID NO: 113235 - DNA, 103 bp, Artificial Sequence
  Synthetic Polynucleotide
taatacgactcactatagggcgacctgcaacccgtcgaagaagttgtcgcaacagaggagagcgacaatgtcttcgacgaacctggcggcagcgcaaaagatg

SEQ ID NO: 113236 - DNA, 103 bp, Artificial Sequence
  Synthetic Polynucleotide
taatacgactcactatagggtttccgaacacgacctgcaacccgtcgaagaacagaggagacttcgaatggttgcaggtaacctggcggcagcgcaaaagatg

SEQ ID NO: 113237 - DNA, 103 bp, Artificial Sequence
  Synthetic Polynucleotide
taatacgactcactatagggcacgagcacgtttccgaacacgacctgcaaaacagaggagattgcagatggtgttcggaaacctggcggcagcgcaaaagatg

SEQ ID NO: 113238 - DNA, 103 bp, Artificial Sequence
  Synthetic Polynucleotide
taatacgactcactataggggctcgctccacacgagcacgtttccgaacaaacagaggagatgttcgatgacgtgctcgaacctggcggcagcgcaaaagatg

SEQ ID NO: 113239 - DNA, 103 bp, Artificial Sequence
  Synthetic Polynucleotide
taatacgactcactatagggggcgtgatgagctcgctccacacgagcacgaacagaggagacgtgctatggtggagcgaaacctggcggcagcgcaaaagatg

SEQ ID NO: 113240 - DNA, 103 bp, Artificial Sequence
  Synthetic Polynucleotide
taatacgactcactataggggatggcgtggggcgtgatgagctcgctccaaacagaggagatggagcatgctcatcacgaacctggcggcagcgcaaaagatg

SEQ ID NO: 113241 - DNA, 103 bp, Artificial Sequence
  Synthetic Polynucleotide
taatacgactcactatagggtctgcacccggatggcgtggggcgtgatgaaacagaggagatcatcaatgcccacgccaaacctggcggcagcgcaaaagatg

SEQ ID NO: 113242 - DNA, 103 bp, Artificial Sequence
  Synthetic Polynucleotide
taatacgactcactatagggctggcgtccaggatgcccgcgccctgcatcaacagaggagagatgcaatgcgcgggcataacctggcggcagcgcaaaagatg

SEQ ID NO: 113243 - DNA, 103 bp, Artificial Sequence
  Synthetic Polynucleotide
taatacgactcactatagggcgcgggggcgtctgcacccggatggcgtggaacagaggagaccacgcatgccgggtgcaaacctggcggcagcgcaaaagatg

SEQ ID NO: 113244 - DNA, 103 bp, Artificial Sequence
  Synthetic Polynucleotide
taatacgactcactatagggggggatgtgccgcgggggcgtctgcacccgaacagaggagacgggtgatgacgcccccgaacctggcggcagcgcaaaagatg

SEQ ID NO: 113245 - DNA, 103 bp, Artificial Sequence
  Synthetic Polynucleotide
taatacgactcactatagggccaccaccccggggatgtgccgcgggggcgaacagaggagacgccccatgggcacatccaacctggcggcagcgcaaaagatg

SEQ ID NO: 113246 - DNA, 103 bp, Artificial Sequence
  Synthetic Polynucleotide
taatacgactcactatagggagggtcacctccaccaccccggggatgtgcaacagaggagagcacatatgcggggtggtaacctggcggcagcgcaaaagatg

SEQ ID NO: 113247 - DNA, 103 bp, Artificial Sequence
  Synthetic Polynucleotide
taatacgactcactatagggcttgtaggagagggtcacctccaccaccccaacagaggagaggggtgatggaggtgaccaacctggcggcagcgcaaaagatg

SEQ ID NO: 113248 - DNA, 103 bp, Artificial Sequence
  Synthetic Polynucleotide
taatacgactcactatagggactgcttggacttgtaggagagggtcacctaacagaggagaaggtgaatgtctcctacaaacctggcggcagcgcaaaagatg

SEQ ID NO: 113249 - DNA, 103 bp, Artificial Sequence
  Synthetic Polynucleotide
taatacgactcactatagggcccttgcaaaactgcttggacttgtaggagaacagaggagactcctaatggtccaagcaaacctggcggcagcgcaaaagatg

SEQ ID NO: 113250 - DNA, 103 bp, Artificial Sequence
  Synthetic Polynucleotide
taatacgactcactataggggccggggcatcccttgcaaaactgcttggaaacagaggagatccaagatgttttgcaagaacctggcggcagcgcaaaagatg

SEQ ID NO: 113251 - DNA, 103 bp, Artificial Sequence
  Synthetic Polynucleotide
taatacgactcactatagggagacaaagcggccggggcatcccttgcaaaaacagaggagatttgcaatggatgccccgaacctggcggcagcgcaaaagatg

SEQ ID NO: 113252 - DNA, 103 bp, Artificial Sequence
  Synthetic Polynucleotide
taatacgactcactatagggagagctgtgtagacaaagcggccggggcataacagaggagaatgcccatgccgctttgtaacctggcggcagcgcaaaagatg

SEQ ID NO: 113253 - DNA, 103 bp, Artificial Sequence
  Synthetic Polynucleotide
taatacgactcactatagggcggcgcagtcgacacttccctctcggacataacagaggagaatgtccatgagggaagtgaacctggcggcagcgcaaaagatg

SEQ ID NO: 113254 - DNA, 103 bp, Artificial Sequence
  Synthetic Polynucleotide
taatacgactcactataggggtcatcattctcgtctccagagaggtctggaacagaggagaccagacatgtctggagacaacctggcggcagcgcaaaagatg

SEQ ID NO: 113255 - DNA, 103 bp, Artificial Sequence
  Synthetic Polynucleotide
taatacgactcactatagggagacactggatctctcatacattgctggtgaacagaggagacaccagatgtgtatgagaaacctggcggcagcgcaaaagatg

SEQ ID NO: 113256 - DNA, 103 bp, Artificial Sequence
  Synthetic Polynucleotide
taatacgactcactataggggaagattcggagacactggatctctcatacaacagaggagagtatgaatgatccagtgtaacctggcggcagcgcaaaagatg

SEQ ID NO: 113257 - DNA, 103 bp, Artificial Sequence
  Synthetic Polynucleotide
taatacgactcactatagggaaatgctggcgaagattcggagacactggaaacagaggagatccagtatgtccgaatctaacctggcggcagcgcaaaagatg

SEQ ID NO: 113258 - DNA, 103 bp, Artificial Sequence
  Synthetic Polynucleotide
taatacgactcactatagggttcacaagacaaatgctggcgaagattcggaacagaggagaccgaatatgcgccagcataacctggcggcagcgcaaaagatg

SEQ ID NO: 113259 - DNA, 103 bp, Artificial Sequence
  Synthetic Polynucleotide
taatacgactcactatagggcaatggcattttcacaagacaaatgctggcaacagaggagagccagcatgtgtcttgtgaacctggcggcagcgcaaaagatg

SEQ ID NO: 113260 - DNA, 103 bp, Artificial Sequence
  Synthetic Polynucleotide
taatacgactcactatagggttccagcacacaatggcattttcacaagacaacagaggagagtcttgatgaaatgccataacctggcggcagcgcaaaagatg

SEQ ID NO: 113261 - DNA, 103 bp, Artificial Sequence
  Synthetic Polynucleotide
taatacgactcactatagggcttgccaggtttccagcacacaatggcattaacagaggagaaatgccatggtgtgctggaacctggcggcagcgcaaaagatg

SEQ ID NO: 113262 - DNA, 103 bp, Artificial Sequence
  Synthetic Polynucleotide
taatacgactcactatagggcatcttccatcttgccaggtttccagcacaaacagaggagatgtgctatgaacctggcaaacctggcggcagcgcaaaagatg

SEQ ID NO: 113263 - DNA, 103 bp, Artificial Sequence
  Synthetic Polynucleotide
taatacgactcactatagggttatctatatcatcttccatcttgccaggtaacagaggagaacctggatggatggaagaaacctggcggcagcgcaaaagatg

SEQ ID NO: 113264 - DNA, 103 bp, Artificial Sequence
  Synthetic Polynucleotide
taatacgactcactataggggggtttaattttatctatatcatcttccataacagaggagaatggaaatggatatagataacctggcggcagcgcaaaagatg

SEQ ID NO: 113265 - DNA, 103 bp, Artificial Sequence
  Synthetic Polynucleotide
taatacgactcactatagggtactgacagcgtcatcattctcgtctccagaacagaggagactggagatgagaatgatgaacctggcggcagcgcaaaagatg

SEQ ID NO: 113266 - DNA, 103 bp, Artificial Sequence
  Synthetic Polynucleotide
taatacgactcactatagggtagattcactgggtttaattttatctatataacagaggagaatatagatgaaattaaacaacctggcggcagcgcaaaagatg

SEQ ID NO: 113267 - DNA, 103 bp, Artificial Sequence
  Synthetic Polynucleotide
taatacgactcactatagggatagtcacattagattcactgggtttaattaacagaggagaaattaaatgcagtgaatcaacctggcggcagcgcaaaagatg

SEQ ID NO: 113268 - DNA, 103 bp, Artificial Sequence
  Synthetic Polynucleotide
taatacgactcactatagggtcgcccaagaatagtcacattagattcactaacagaggagaagtgaaatgaatgtgactaacctggcggcagcgcaaaagatg

SEQ ID NO: 113269 - DNA, 103 bp, Artificial Sequence
  Synthetic Polynucleotide
taatacgactcactatagggtgtaatcaaatcgcccaagaatagtcacataacagaggagaatgtgaatgttcttgggcaacctggcggcagcgcaaaagatg

SEQ ID NO: 113270 - DNA, 103 bp, Artificial Sequence
  Synthetic Polynucleotide
taatacgactcactatagggtcacactggctgtaatcaaatcgcccaagaaacagaggagatcttggatgatttgattaaacctggcggcagcgcaaaagatg

SEQ ID NO: 113271 - DNA, 103 bp, Artificial Sequence
  Synthetic Polynucleotide
taatacgactcactataggggtaccaaatgtcacactggctgtaatcaaaaacagaggagatttgatatgagccagtgtaacctggcggcagcgcaaaagatg

SEQ ID NO: 113272 - DNA, 103 bp, Artificial Sequence
  Synthetic Polynucleotide
taatacgactcactatagggaaaacctcatgtaccaaatgtcacactggcaacagaggagagccagtatgacatttggtaacctggcggcagcgcaaaagatg

SEQ ID NO: 113273 - DNA, 103 bp, Artificial Sequence
  Synthetic Polynucleotide
taatacgactcactatagggaaatccatagaaaacctcatgtaccaaatgaacagaggagacatttgatgcatgaggttaacctggcggcagcgcaaaagatg

SEQ ID NO: 113274 - DNA, 103 bp, Artificial Sequence
  Synthetic Polynucleotide
taatacgactcactatagggcttttgccagaaatccatagaaaacctcataacagaggagaatgaggatgtctatggataacctggcggcagcgcaaaagatg

SEQ ID NO: 113275 - DNA, 103 bp, Artificial Sequence
  Synthetic Polynucleotide
taatacgactcactatagggatgcaagcatcttttgccagaaatccatagaacagaggagactatggatgtctggcaaaaacctggcggcagcgcaaaagatg

SEQ ID NO: 113276 - DNA, 103 bp, Artificial Sequence
  Synthetic Polynucleotide
taatacgactcactatagggccactttctatactgacagcgtcatcattcaacagaggagagaatgaatgcgctgtcagaacctggcggcagcgcaaaagatg

SEQ ID NO: 113277 - DNA, 103 bp, Artificial Sequence
  Synthetic Polynucleotide
taatacgactcactatagggtgattgcccaatgcaagcatcttttgccagaacagaggagactggcaatggatgcttgcaacctggcggcagcgcaaaagatg

SEQ ID NO: 113278 - DNA, 103 bp, Artificial Sequence
  Synthetic Polynucleotide
taatacgactcactatagggtttgccaacttgattgcccaatgcaagcataacagaggagaatgcttatgttgggcaataacctggcggcagcgcaaaagatg

SEQ ID NO: 113279 - DNA, 103 bp, Artificial Sequence
  Synthetic Polynucleotide
taatacgactcactatagggaaacataaagtttgccaacttgattgcccaaacagaggagatgggcaatgaagttggcaaacctggcggcagcgcaaaagatg

SEQ ID NO: 113280 - DNA, 103 bp, Artificial Sequence
  Synthetic Polynucleotide
taatacgactcactatagggtctaaatcccaaacataaagtttgccaactaacagaggagaagttggatgactttatgtaacctggcggcagcgcaaaagatg

SEQ ID NO: 113281 - DNA, 103 bp, Artificial Sequence
  Synthetic Polynucleotide
taatacgactcactatagggatcttctacttctaaatcccaaacataaagaacagaggagactttatatgtgggatttaaacctggcggcagcgcaaaagatg

SEQ ID NO: 113282 - DNA, 103 bp, Artificial Sequence
  Synthetic Polynucleotide
taatacgactcactatagggctttatgaggatcttctacttctaaatcccaacagaggagagggattatgaagtagaagaacctggcggcagcgcaaaagatg

SEQ ID NO: 113283 - DNA, 103 bp, Artificial Sequence
  Synthetic Polynucleotide
taatacgactcactataggggtacatttggctttatgaggatcttctactaacagaggagaagtagaatgtcctcataaaacctggcggcagcgcaaaagatg

SEQ ID NO: 113284 - DNA, 103 bp, Artificial Sequence
  Synthetic Polynucleotide
taatacgactcactatagggagtcagtgttgtacatttggctttatgaggaacagaggagacctcatatggccaaatgtaacctggcggcagcgcaaaagatg

SEQ ID NO: 113285 - DNA, 103 bp, Artificial Sequence
  Synthetic Polynucleotide
taatacgactcactatagggatttatgatgagtcagtgttgtacatttggaacagaggagaccaaatatgcaacactgaaacctggcggcagcgcaaaagatg

SEQ ID NO: 113286 - DNA, 103 bp, Artificial Sequence
  Synthetic Polynucleotide
taatacgactcactataggggcagcaccacatttatgatgagtcagtgttaacagaggagaaacactatgtcatcataaaacctggcggcagcgcaaaagatg

SEQ ID NO: 113287 - DNA, 103 bp, Artificial Sequence
  Synthetic Polynucleotide
taatacgactcactatagggagtgtttgtaccactttctatactgacagcaacagaggagagctgtcatgatagaaagtaacctggcggcagcgcaaaagatg

SEQ ID NO: 113288 - DNA, 103 bp, Artificial Sequence
  Synthetic Polynucleotide
taatacgactcactatagggttgtcgaatagcagcaccacatttatgatgaacagaggagacatcatatgtgtggtgctaacctggcggcagcgcaaaagatg

SEQ ID NO: 113289 - DNA, 103 bp, Artificial Sequence
  Synthetic Polynucleotide
taatacgactcactatagggtaaaactggtttgtcgaatagcagcaccacaacagaggagagtggtgatgctattcgacaacctggcggcagcgcaaaagatg

SEQ ID NO: 113290 - DNA, 103 bp, Artificial Sequence
  Synthetic Polynucleotide
taatacgactcactatagggctatccctgctaaaactggtttgtcgaataaacagaggagatattcgatgaaccagtttaacctggcggcagcgcaaaagatg

SEQ ID NO: 113291 - DNA, 103 bp, Artificial Sequence
  Synthetic Polynucleotide
taatacgactcactatagggaagaatgctgctatccctgctaaaactggtaacagaggagaaccagtatgagcagggataacctggcggcagcgcaaaagatg

SEQ ID NO: 113292 - DNA, 103 bp, Artificial Sequence
  Synthetic Polynucleotide
taatacgactcactatagggaaacagctataagaatgctgctatccctgcaacagaggagagcagggatggcagcattcaacctggcggcagcgcaaaagatg

SEQ ID NO: 113293 - DNA, 103 bp, Artificial Sequence
  Synthetic Polynucleotide
taatacgactcactataggggcatcatcacaaacagctataagaatgctgaacagaggagacagcatatgtatagctgtaacctggcggcagcgcaaaagatg

SEQ ID NO: 113294 - DNA, 103 bp, Artificial Sequence
  Synthetic Polynucleotide
taatacgactcactatagggccaaatactggcatcatcacaaacagctataacagaggagaatagctatgtgtgatgataacctggcggcagcgcaaaagatg

SEQ ID NO: 113295 - DNA, 103 bp, Artificial Sequence
  Synthetic Polynucleotide
taatacgactcactataggggatcccagcgccaaatactggcatcatcacaacagaggagagtgatgatgccagtatttaacctggcggcagcgcaaaagatg

SEQ ID NO: 113296 - DNA, 103 bp, Artificial Sequence
  Synthetic Polynucleotide
taatacgactcactatagggtatcgaagtcgatcccagcgccaaatactgaacagaggagacagtatatggcgctgggaaacctggcggcagcgcaaaagatg

SEQ ID NO: 113297 - DNA, 103 bp, Artificial Sequence
  Synthetic Polynucleotide
taatacgactcactatagggcagggcgttcagtgtttgtaccactttctaaacagaggagatagaaaatggtacaaacaaacctggcggcagcgcaaaagatg

SEQ ID NO: 113298 - DNA, 103 bp, Artificial Sequence
  Synthetic Polynucleotide
taatacgactcactataggggtaggtgtatcagggcgttcagtgtttgtaaacagaggagatacaaaatgtgaacgcccaacctggcggcagcgcaaaagatg

SEQ ID NO: 113299 - DNA, 103 bp, Artificial Sequence
  Synthetic Polynucleotide
taatacgactcactatagggtggcgtgtttgtaggtgtatcagggcgttcaacagaggagagaacgcatggatacacctaacctggcggcagcgcaaaagatg

SEQ ID NO: 113300 - DNA, 103 bp, Artificial Sequence
  Synthetic Polynucleotide
taatacgactcactatagggcaggtgcatttggcgtgtttgtaggtgtataacagaggagaatacacatgcaaacacgcaacctggcggcagcgcaaaagatg

SEQ ID NO: 113301 - DNA, 103 bp, Artificial Sequence
  Synthetic Polynucleotide
taatacgactcactatagggcttttccttccaggtgcatttggcgtgtttaacagaggagaaaacacatgaaatgcaccaacctggcggcagcgcaaaagatg

SEQ ID NO: 113302 - DNA, 103 bp, Artificial Sequence
  Synthetic Polynucleotide
taatacgactcactatagggctttccccaacttttccttccaggtgcattaacagaggagaaatgcaatgggaaggaaaaacctggcggcagcgcaaaagatg

SEQ ID NO: 113303 - DNA, 103 bp, Artificial Sequence
  Synthetic Polynucleotide
taatacgactcactatagggctgttcccgccggcgcagtcgacacttcccaacagaggagagggaagatgcgactgcgcaacctggcggcagcgcaaaagatg

SEQ ID NO: 113304 - DNA, 103 bp, Artificial Sequence
  Synthetic Polynucleotide
taatacgactcactatagggtccattttccctttccccaacttttccttcaacagaggagagaaggaatggttggggaaaacctggcggcagcgcaaaagatg

SEQ ID NO: 113305 - DNA, 103 bp, Artificial Sequence
  Synthetic Polynucleotide
taatacgactcactatagggttctttgacttccattttccctttccccaaaacagaggagattggggatggggaaaatgaacctggcggcagcgcaaaagatg

SEQ ID NO: 113306 - DNA, 103 bp, Artificial Sequence
  Synthetic Polynucleotide
taatacgactcactatagggatatttgcatttctttgacttccattttccaacagaggagaggaaaaatgaagtcaaagaacctggcggcagcgcaaaagatg

SEQ ID NO: 113307 - DNA, 103 bp, Artificial Sequence
  Synthetic Polynucleotide
taatacgactcactatagggatttgaaagaatatttgcatttctttgactaacagaggagaagtcaaatgaatgcaaataacctggcggcagcgcaaaagatg

SEQ ID NO: 113308 - DNA, 103 bp, Artificial Sequence
  Synthetic Polynucleotide
taatacgactcactatagggctatttacacatttgaaagaatatttgcataacagaggagaatgcaaatgttctttcaaaacctggcggcagcgcaaaagatg

SEQ ID NO: 113309 - DNA, 103 bp, Artificial Sequence
  Synthetic Polynucleotide
taatacgactcactatagggttccttgagactatttacacatttgaaagaaacagaggagatctttcatgtgtgtaaataacctggcggcagcgcaaaagatg

SEQ ID NO: 113310 - DNA, 103 bp, Artificial Sequence
  Synthetic Polynucleotide
taatacgactcactatagggggttatgatcttccttgagactatttacacaacagaggagagtgtaaatggtctcaaggaacctggcggcagcgcaaaagatg

SEQ ID NO: 113311 - DNA, 103 bp, Artificial Sequence
  Synthetic Polynucleotide
taatacgactcactatagggaacaatggttggttatgatcttccttgagaaacagaggagatctcaaatgagatcataaaacctggcggcagcgcaaaagatg

SEQ ID NO: 113312 - DNA, 103 bp, Artificial Sequence
  Synthetic Polynucleotide
taatacgactcactatagggctgaactccaaacaatggttggttatgatcaacagaggagagatcatatgcaaccattgaacctggcggcagcgcaaaagatg

SEQ ID NO: 113313 - DNA, 103 bp, Artificial Sequence
  Synthetic Polynucleotide
taatacgactcactataggggccagttaaactgaactccaaacaatggttaacagaggagaaaccatatgttggagttcaacctggcggcagcgcaaaagatg

SEQ ID NO: 113314 - DNA, 103 bp, Artificial Sequence
  Synthetic Polynucleotide
taatacgactcactataggggcaggcatgtctgttcccgccggcgcagtcaacagaggagagactgcatgggcgggaacaacctggcggcagcgcaaaagatg

SEQ ID NO: 113315 - DNA, 103 bp, Artificial Sequence
  Synthetic Polynucleotide
taatacgactcactatagggtctttactgtgccagttaaactgaactccaaacagaggagatggagtatggtttaactgaacctggcggcagcgcaaaagatg

SEQ ID NO: 113316 - DNA, 103 bp, Artificial Sequence
  Synthetic Polynucleotide
taatacgactcactatagggtggatctccttctttactgtgccagttaaaaacagaggagatttaacatgcacagtaaaaacctggcggcagcgcaaaagatg

SEQ ID NO: 113317 - DNA, 103 bp, Artificial Sequence
  Synthetic Polynucleotide
taatacgactcactatagggcaaacactaatggatctccttctttactgtaacagaggagaacagtaatgaaggagatcaacctggcggcagcgcaaaagatg

SEQ ID NO: 113318 - DNA, 103 bp, Artificial Sequence
  Synthetic Polynucleotide
taatacgactcactatagggcctacagttgcaaacactaatggatctcctaacagaggagaaggagaatgattagtgttaacctggcggcagcgcaaaagatg

SEQ ID NO: 113319 - DNA, 103 bp, Artificial Sequence
  Synthetic Polynucleotide
taatacgactcactatagggtctgttgcttcctacagttgcaaacactaaaacagaggagattagtgatggcaactgtaaacctggcggcagcgcaaaagatg

SEQ ID NO: 113320 - DNA, 103 bp, Artificial Sequence
  Synthetic Polynucleotide
taatacgactcactatagggacaaggtaactctgttgcttcctacagttgaacagaggagacaactgatggaagcaacaaacctggcggcagcgcaaaagatg

SEQ ID NO: 113321 - DNA, 103 bp, Artificial Sequence
  Synthetic Polynucleotide
taatacgactcactatagggtgacattcatacaaggtaactctgttgcttaacagaggagaaagcaaatgagttaccttaacctggcggcagcgcaaaagatg

SEQ ID NO: 113322 - DNA, 103 bp, Artificial Sequence
  Synthetic Polynucleotide
taatacgactcactatagggtccttgtgaatgacattcatacaaggtaacaacagaggagagttaccatgtatgaatgtaacctggcggcagcgcaaaagatg

SEQ ID NO: 113323 - DNA, 103 bp, Artificial Sequence
  Synthetic Polynucleotide
taatacgactcactatagggaccggatttctccttgtgaatgacattcataacagaggagaatgaatatgattcacaagaacctggcggcagcgcaaaagatg

SEQ ID NO: 113324 - DNA, 103 bp, Artificial Sequence
  Synthetic Polynucleotide
taatacgactcactataggggattgcaacaaccggatttctccttgtgaaaacagaggagattcacaatgagaaatccgaacctggcggcagcgcaaaagatg

SEQ ID NO: 113325 - DNA, 103 bp, Artificial Sequence
  Synthetic Polynucleotide
taatacgactcactatagggcttcttggccgcaggcatgtctgttcccgcaacagaggagagcgggaatggacatgcctaacctggcggcagcgcaaaagatg

SEQ ID NO: 113326 - DNA, 103 bp, Artificial Sequence
  Synthetic Polynucleotide
taatacgactcactatagggatccacgtaagattgcaacaaccggatttcaacagaggagagaaatcatgttgttgcaaaacctggcggcagcgcaaaagatg

SEQ ID NO: 113327 - DNA, 103 bp, Artificial Sequence
  Synthetic Polynucleotide
taatacgactcactatagggcagcatcagcatccacgtaagattgcaacaaacagaggagatgttgcatgcttacgtggaacctggcggcagcgcaaaagatg

SEQ ID NO: 113328 - DNA, 103 bp, Artificial Sequence
  Synthetic Polynucleotide
taatacgactcactatagggaagttttcatcagcatcagcatccacgtaaaacagaggagattacgtatgtgctgatgcaacctggcggcagcgcaaaagatg

SEQ ID NO: 113329 - DNA, 103 bp, Artificial Sequence
  Synthetic Polynucleotide
taatacgactcactatagggacaagtgtaaaagttttcatcagcatcagcaacagaggagagctgatatggatgaaaacaacctggcggcagcgcaaaagatg

SEQ ID NO: 113330 - DNA, 103 bp, Artificial Sequence
  Synthetic Polynucleotide
taatacgactcactatagggaggtccatgcacaagtgtaaaagttttcataacagaggagaatgaaaatgtttacacttaacctggcggcagcgcaaaagatg

SEQ ID NO: 113331 - DNA, 103 bp, Artificial Sequence
  Synthetic Polynucleotide
taatacgactcactatagggttgctatcataggtccatgcacaagtgtaaaacagaggagattacacatgtgcatggacaacctggcggcagcgcaaaagatg

SEQ ID NO: 113332 - DNA, 103 bp, Artificial Sequence
  Synthetic Polynucleotide
taatacgactcactatagggatggctcgtattgctatcataggtccatgcaacagaggagagcatggatgtatgatagcaacctggcggcagcgcaaaagatg

SEQ ID NO: 113333 - DNA, 103 bp, Artificial Sequence
  Synthetic Polynucleotide
taatacgactcactatagggccagcagaggatggctcgtattgctatcataacagaggagaatgataatgatacgagccaacctggcggcagcgcaaaagatg

SEQ ID NO: 113334 - DNA, 103 bp, Artificial Sequence
  Synthetic Polynucleotide
taatacgactcactatagggccagctacagccagcagaggatggctcgtaaacagaggagatacgagatgtcctctgctaacctggcggcagcgcaaaagatg

SEQ ID NO: 113335 - DNA, 103 bp, Artificial Sequence
  Synthetic Polynucleotide
taatacgactcactataggggcctctagatccagctacagccagcagaggaacagaggagacctctgatggctgtagctaacctggcggcagcgcaaaagatg

SEQ ID NO: 113336 - DNA, 103 bp, Artificial Sequence
  Synthetic Polynucleotide
taatacgactcactatagggtcagcttctgcttcttggccgcaggcatgtaacagaggagaacatgcatgcggccaagaaacctggcggcagcgcaaaagatg

SEQ ID NO: 113337 - DNA, 103 bp, Artificial Sequence
  Synthetic Polynucleotide
taatacgactcactatagggtcctaattatgcctctagatccagctacagaacagaggagactgtagatggatctagagaacctggcggcagcgcaaaagatg

SEQ ID NO: 113338 - DNA, 103 bp, Artificial Sequence
  Synthetic Polynucleotide
taatacgactcactatagggggatttattatcctaattatgcctctagataacagaggagaatctagatgcataattagaacctggcggcagcgcaaaagatg

SEQ ID NO: 113339 - DNA, 103 bp, Artificial Sequence
  Synthetic Polynucleotide
taatacgactcactatagggcattgttataggatttattatcctaattataacagaggagaataattatgataataaataacctggcggcagcgcaaaagatg

SEQ ID NO: 113340 - DNA, 103 bp, Artificial Sequence
  Synthetic Polynucleotide
taatacgactcactatagggttatacactgcattgttataggatttattaaacagaggagataataaatgctataacaaaacctggcggcagcgcaaaagatg

SEQ ID NO: 113341 - DNA, 103 bp, Artificial Sequence
  Synthetic Polynucleotide
taatacgactcactatagggacatagtgctttatacactgcattgttataaacagaggagatataacatggcagtgtataacctggcggcagcgcaaaagatg

SEQ ID NO: 113342 - DNA, 103 bp, Artificial Sequence
  Synthetic Polynucleotide
taatacgactcactatagggtccatggccaacatagtgctttatacactgaacagaggagacagtgtatgaagcactataacctggcggcagcgcaaaagatg

SEQ ID NO: 113343 - DNA, 103 bp, Artificial Sequence
  Synthetic Polynucleotide
taatacgactcactatagggtgatagcatttccatggccaacatagtgctaacagaggagaagcactatgttggccatgaacctggcggcagcgcaaaagatg

SEQ ID NO: 113344 - DNA, 103 bp, Artificial Sequence
  Synthetic Polynucleotide
taatacgactcactatagggttcagctcattgatagcatttccatggccaaacagaggagatggccaatgaaatgctataacctggcggcagcgcaaaagatg

SEQ ID NO: 113345 - DNA, 103 bp, Artificial Sequence
  Synthetic Polynucleotide
taatacgactcactatagggtggatggaatttcagctcattgatagcattaacagaggagaaatgctatgaatgagctgaacctggcggcagcgcaaaagatg

SEQ ID NO: 113346 - DNA, 103 bp, Artificial Sequence
  Synthetic Polynucleotide
taatacgactcactatagggttggatctcttggatggaatttcagctcataacagaggagaatgagcatgaattccatcaacctggcggcagcgcaaaagatg

SEQ ID NO: 113347 - DNA, 103 bp, Artificial Sequence
  Synthetic Polynucleotide
taatacgactcactatagggtcgtcactgctcagcttctgcttcttggccaacagaggagaggccaaatggcagaagctaacctggcggcagcgcaaaagatg

SEQ ID NO: 113348 - DNA, 103 bp, Artificial Sequence
  Synthetic Polynucleotide
taatacgactcactatagggaggagaagatttggatctcttggatggaataacagaggagaattccaatgaagagatccaacctggcggcagcgcaaaagatg

SEQ ID NO: 113349 - DNA, 103 bp, Artificial Sequence
  Synthetic Polynucleotide
taatacgactcactatagggacttactgacaggagaagatttggatctctaacagaggagaagagatatgaatcttctcaacctggcggcagcgcaaaagatg

SEQ ID NO: 113350 - DNA, 103 bp, Artificial Sequence
  Synthetic Polynucleotide
taatacgactcactatagggcatgatctttacttactgacaggagaagataacagaggagaatcttcatgtgtcagtaaaacctggcggcagcgcaaaagatg

SEQ ID NO: 113351 - DNA, 103 bp, Artificial Sequence
  Synthetic Polynucleotide
taatacgactcactatagggaatcgtaaagcatgatctttacttactgacaacagaggagagtcagtatgtaaagatcaaacctggcggcagcgcaaaagatg

SEQ ID NO: 113352 - DNA, 103 bp, Artificial Sequence
  Synthetic Polynucleotide
taatacgactcactataggggatattccataatcgtaaagcatgatctttaacagaggagaaaagatatggctttacgaaacctggcggcagcgcaaaagatg

SEQ ID NO: 113353 - DNA, 103 bp, Artificial Sequence
  Synthetic Polynucleotide
taatacgactcactatagggtgtccgtctggatattccataatcgtaaagaacagaggagactttacatgtatggaataaacctggcggcagcgcaaaagatg

SEQ ID NO: 113354 - DNA, 103 bp, Artificial Sequence
  Synthetic Polynucleotide
taatacgactcactataggggccaccagagtgtccgtctggatattccataacagaggagaatggaaatgccagacggaaacctggcggcagcgcaaaagatg

SEQ ID NO: 113355 - DNA, 103 bp, Artificial Sequence
  Synthetic Polynucleotide
taatacgactcactatagggtccaaatattgccaccagagtgtccgtctgaacagaggagacagacgatgactctggtgaacctggcggcagcgcaaaagatg

SEQ ID NO: 113356 - DNA, 103 bp, Artificial Sequence
  Synthetic Polynucleotide
taatacgactcactatagggcttctacgcctccaaatattgccaccagagaacagaggagactctggatgcaatatttgaacctggcggcagcgcaaaagatg

SEQ ID NO: 113357 - DNA, 103 bp, Artificial Sequence
  Synthetic Polynucleotide
taatacgactcactatagggtctctgtgcccttctacgcctccaaatattaacagaggagaaatattatgaggcgtagaaacctggcggcagcgcaaaagatg

SEQ ID NO: 113358 - DNA, 103 bp, Artificial Sequence
  Synthetic Polynucleotide
taatacgactcactatagggattgctgttctcgtcactgctcagcttctgaacagaggagacagaagatgagcagtgacaacctggcggcagcgcaaaagatg

SEQ ID NO: 113359 - DNA, 103 bp, Artificial Sequence
  Synthetic Polynucleotide
taatacgactcactatagggtagaacttcatctctgtgcccttctacgccaacagaggagaggcgtaatggggcacagaaacctggcggcagcgcaaaagatg

SEQ ID NO: 113360 - DNA, 103 bp, Artificial Sequence
  Synthetic Polynucleotide
taatacgactcactatagggaatcagcacttagaacttcatctctgtgccaacagaggagaggcacaatgatgaagttcaacctggcggcagcgcaaaagatg

SEQ ID NO: 113361 - DNA, 103 bp, Artificial Sequence
  Synthetic Polynucleotide
taatacgactcactatagggaaaagatcataatcagcacttagaacttcaaacagaggagatgaagtatgaagtgctgaaacctggcggcagcgcaaaagatg

SEQ ID NO: 113362 - DNA, 103 bp, Artificial Sequence
  Synthetic Polynucleotide
taatacgactcactatagggtttttcacccaaaagatcataatcagcactaacagaggagaagtgctatgtatgatcttaacctggcggcagcgcaaaagatg

SEQ ID NO: 113363 - DNA, 103 bp, Artificial Sequence
  Synthetic Polynucleotide
taatacgactcactatagggaggacattattttttcacccaaaagatcataacagaggagaatgatcatgtgggtgaaaaacctggcggcagcgcaaaagatg

SEQ ID NO: 113364 - DNA, 103 bp, Artificial Sequence
  Synthetic Polynucleotide
taatacgactcactatagggtccataccacaggacattattttttcacccaacagaggagagggtgaatgaataatgtcaacctggcggcagcgcaaaagatg

SEQ ID NO: 113365 - DNA, 103 bp, Artificial Sequence
  Synthetic Polynucleotide
taatacgactcactatagggaagagaatgatccataccacaggacattataacagaggagaataatgatgtgtggtatgaacctggcggcagcgcaaaagatg

SEQ ID NO: 113366 - DNA, 103 bp, Artificial Sequence
  Synthetic Polynucleotide
taatacgactcactatagggtccaaagtttaagagaatgatccataccacaacagaggagagtggtaatgatcattctcaacctggcggcagcgcaaaagatg

SEQ ID NO: 113367 - DNA, 103 bp, Artificial Sequence
  Synthetic Polynucleotide
taatacgactcactataggggaattgatcctccaaagtttaagagaatgaaacagaggagatcattcatgtaaactttgaacctggcggcagcgcaaaagatg

SEQ ID NO: 113368 - DNA, 103 bp, Artificial Sequence
  Synthetic Polynucleotide
taatacgactcactatagggcattctctttgaattgatcctccaaagtttaacagaggagaaaacttatgaggatcaataacctggcggcagcgcaaaagatg

SEQ ID NO: 113369 - DNA, 103 bp, Artificial Sequence
  Synthetic Polynucleotide
taatacgactcactatagggagaggtctggattgctgttctcgtcactgcaacagaggagagcagtgatgagaacagcaaacctggcggcagcgcaaaagatg

SEQ ID NO: 113370 - DNA, 103 bp, Artificial Sequence
  Synthetic Polynucleotide
taatacgactcactatagggttgcattcatcattctctttgaattgatccaacagaggagaggatcaatgcaaagagaaaacctggcggcagcgcaaaagatg

SEQ ID NO: 113371 - DNA, 103 bp, Artificial Sequence
  Synthetic Polynucleotide
taatacgactcactataggggattccttaattgcattcatcattctctttaacagaggagaaaagagatggatgaatgcaacctggcggcagcgcaaaagatg

SEQ ID NO: 113372 - DNA, 103 bp, Artificial Sequence
  Synthetic Polynucleotide
taatacgactcactatagggataatcataagattccttaattgcattcataacagaggagaatgaatatgattaaggaaaacctggcggcagcgcaaaagatg

SEQ ID NO: 113373 - DNA, 103 bp, Artificial Sequence
  Synthetic Polynucleotide
taatacgactcactatagggtatttggattataatcataagattccttaaaacagaggagattaaggatgcttatgattaacctggcggcagcgcaaaagatg

SEQ ID NO: 113374 - DNA, 103 bp, Artificial Sequence
  Synthetic Polynucleotide
taatacgactcactatagggctgttagttttatttggattataatcataaaacagaggagattatgaatgtaatccaaaaacctggcggcagcgcaaaagatg

SEQ ID NO: 113375 - DNA, 103 bp, Artificial Sequence
  Synthetic Polynucleotide
taatacgactcactatagggaataaatggcctgttagttttatttggattaacagaggagaaatccaatgaaaactaacaacctggcggcagcgcaaaagatg

SEQ ID NO: 113376 - DNA, 103 bp, Artificial Sequence
  Synthetic Polynucleotide
taatacgactcactatagggttttctgagaaataaatggcctgttagtttaacagaggagaaaactaatgggccatttaaacctggcggcagcgcaaaagatg

SEQ ID NO: 113377 - DNA, 103 bp, Artificial Sequence
  Synthetic Polynucleotide
taatacgactcactatagggggaaaatggattttctgagaaataaatggcaacagaggagagccattatgttctcagaaaacctggcggcagcgcaaaagatg

SEQ ID NO: 113378 - DNA, 103 bp, Artificial Sequence
  Synthetic Polynucleotide
taatacgactcactatagggagaaaaatcaggaaaatggattttctgagaaacagaggagatctcagatgatccattttaacctggcggcagcgcaaaagatg

SEQ ID NO: 113379 - DNA, 103 bp, Artificial Sequence
  Synthetic Polynucleotide
taatacgactcactatagggtgtctctggtagaaaaatcaggaaaatggaaacagaggagatccattatgctgatttttaacctggcggcagcgcaaaagatg

SEQ ID NO: 113380 - DNA, 103 bp, Artificial Sequence
  Synthetic Polynucleotide
taatacgactcactatagggtcgtctccagagaggtctggattgctgttcaacagaggagagaacagatgtccagacctaacctggcggcagcgcaaaagatg

SEQ ID NO: 113381 - DNA, 103 bp, Artificial Sequence
  Synthetic Polynucleotide
taatacgactcactatagggttcctatgtatgtctctggtagaaaaatcaaacagaggagatgatttatgtaccagagaaacctggcggcagcgcaaaagatg

SEQ ID NO: 113382 - DNA, 103 bp, Artificial Sequence
  Synthetic Polynucleotide
taatacgactcactatagggatcaacataattcctatgtatgtctctggtaacagaggagaaccagaatgatacataggaacctggcggcagcgcaaaagatg

SEQ ID NO: 113383 - DNA, 103 bp, Artificial Sequence
  Synthetic Polynucleotide
taatacgactcactatagggatcgcacacaatcaacataattcctatgtaaacagaggagatacataatgattatgttgaacctggcggcagcgcaaaagatg

SEQ ID NO: 113384 - DNA, 103 bp, Artificial Sequence
  Synthetic Polynucleotide
taatacgactcactatagggtcgcctaaccatcgcacacaatcaacataaaacagaggagattatgtatgttgtgtgcgaacctggcggcagcgcaaaagatg

SEQ ID NO: 113385 - DNA, 103 bp, Artificial Sequence
  Synthetic Polynucleotide
taatacgactcactatagggaagtatcaaatcgcctaaccatcgcacacaaacagaggagatgtgtgatgtggttaggcaacctggcggcagcgcaaaagatg

SEQ ID NO: 113386 - DNA, 103 bp, Artificial Sequence
  Synthetic Polynucleotide
taatacgactcactatagggcactcttagaaagtatcaaatcgcctaaccaacagaggagaggttagatgatttgatacaacctggcggcagcgcaaaagatg

SEQ ID NO: 113387 - DNA, 103 bp, Artificial Sequence
  Synthetic Polynucleotide
taatacgactcactatagggatggcacggccactcttagaaagtatcaaaaacagaggagatttgatatgttctaagagaacctggcggcagcgcaaaagatg

SEQ ID NO: 113388 - DNA, 103 bp, Artificial Sequence
  Synthetic Polynucleotide
taatacgactcactatagggggaatgtaaaatggcacggccactcttagaaacagaggagatctaagatgggccgtgccaacctggcggcagcgcaaaagatg

SEQ ID NO: 113389 - DNA, 103 bp, Artificial Sequence
  Synthetic Polynucleotide
taatacgactcactatagggattgctggtgggaatgtaaaatggcacggcaacagaggagagccgtgatgttttacattaacctggcggcagcgcaaaagatg

SEQ ID NO: 113390 - DNA, 103 bp, Artificial Sequence
  Synthetic Polynucleotide
taatacgactcactatagggtctctcatacattgctggtgggaatgtaaaaacagaggagatttacaatgccaccagcaaacctggcggcagcgcaaaagatg

SEQ ID NO: 113391 - DNA, 103 bp, Artificial Sequence
  Synthetic Polynucleotide
taatacgactcactatagggcagctgcatctcggccttggccgcggccataacagaggagaatggccatggccaaggccaacctggcggcagcgcaaaagatg

SEQ ID NO: 113392 - DNA, 103 bp, Artificial Sequence
  Synthetic Polynucleotide
taatacgactcactatagggcagcatcatctcctccagcttagggtagttaacagaggagaaactacatgaagctggagaacctggcggcagcgcaaaagatg

SEQ ID NO: 113393 - DNA, 103 bp, Artificial Sequence
  Synthetic Polynucleotide
taatacgactcactataggggcaagcgtaagggcgttcgtgggggggcgtaacagaggagaacgcccatgcacgaacgcaacctggcggcagcgcaaaagatg

SEQ ID NO: 113394 - DNA, 103 bp, Artificial Sequence
  Synthetic Polynucleotide
taatacgactcactatagggactccactgggcaagcgtaagggcgttcgtaacagaggagaacgaacatgcttacgcttaacctggcggcagcgcaaaagatg

SEQ ID NO: 113395 - DNA, 103 bp, Artificial Sequence
  Synthetic Polynucleotide
taatacgactcactatagggcgatcacaggactccactgggcaagcgtaaaacagaggagattacgcatgcccagtggaaacctggcggcagcgcaaaagatg

SEQ ID NO: 113396 - DNA, 103 bp, Artificial Sequence
  Synthetic Polynucleotide
taatacgactcactatagggggagaagcggcgatcacaggactccactggaacagaggagaccagtgatgtcctgtgataacctggcggcagcgcaaaagatg

SEQ ID NO: 113397 - DNA, 103 bp, Artificial Sequence
  Synthetic Polynucleotide
taatacgactcactatagggcgtcggagcgggagaagcggcgatcacaggaacagaggagacctgtgatggccgcttctaacctggcggcagcgcaaaagatg

SEQ ID NO: 113398 - DNA, 103 bp, Artificial Sequence
  Synthetic Polynucleotide
taatacgactcactatagggcgggtgagctcgtcggagcgggagaagcggaacagaggagaccgcttatgccgctccgaaacctggcggcagcgcaaaagatg

SEQ ID NO: 113399 - DNA, 103 bp, Artificial Sequence
  Synthetic Polynucleotide
taatacgactcactataggggcggatgtggcgggtgagctcgtcggagcgaacagaggagacgctccatggagctcaccaacctggcggcagcgcaaaagatg

SEQ ID NO: 113400 - DNA, 103 bp, Artificial Sequence
  Synthetic Polynucleotide
taatacgactcactatagggctgtgtggatgcggatgtggcgggtgagctaacagaggagaagctcaatggccacatccaacctggcggcagcgcaaaagatg

SEQ ID NO: 113401 - DNA, 103 bp, Artificial Sequence
  Synthetic Polynucleotide
taatacgactcactatagggggcttctggcctgtgtggatgcggatgtggaacagaggagaccacatatgcatccacacaacctggcggcagcgcaaaagatg

SEQ ID NO: 113402 - DNA, 103 bp, Artificial Sequence
  Synthetic Polynucleotide
taatacgactcactataggggcactggaagggcttctggcctgtgtggataacagaggagaatccacatgggccagaagaacctggcggcagcgcaaaagatg

SEQ ID NO: 113403 - DNA, 103 bp, Artificial Sequence
  Synthetic Polynucleotide
taatacgactcactatagggcgttgctcagcagcatcatctcctccagctaacagaggagaagctggatgagatgatgcaacctggcggcagcgcaaaagatg

SEQ ID NO: 113404 - DNA, 103 bp, Artificial Sequence
  Synthetic Polynucleotide
taatacgactcactatagggtgcagatgcggcactggaagggcttctggcaacagaggagagccagaatgccttccagtaacctggcggcagcgcaaaagatg

SEQ ID NO: 113405 - DNA, 103 bp, Artificial Sequence
  Synthetic Polynucleotide
taatacgactcactatagggaagttgcgcatgcagatgcggcactggaagaacagaggagacttccaatgccgcatctgaacctggcggcagcgcaaaagatg

SEQ ID NO: 113406 - DNA, 103 bp, Artificial Sequence
  Synthetic Polynucleotide
taatacgactcactataggggctgcggctgaagttgcgcatgcagatgcgaacagaggagacgcatcatgatgcgcaacaacctggcggcagcgcaaaagatg

SEQ ID NO: 113407 - DNA, 103 bp, Artificial Sequence
  Synthetic Polynucleotide
taatacgactcactatagggtgaggtggtcgctgcggctgaagttgcgcaaacagaggagatgcgcaatgtcagccgcaaacctggcggcagcgcaaaagatg

SEQ ID NO: 113408 - DNA, 103 bp, Artificial Sequence
  Synthetic Polynucleotide
taatacgactcactatagggatgtgggtggtgaggtggtcgctgcggctgaacagaggagacagccgatgcgaccacctaacctggcggcagcgcaaaagatg

SEQ ID NO: 113409 - DNA, 103 bp, Artificial Sequence
  Synthetic Polynucleotide
taatacgactcactataggggtgggtgcggatgtgggtggtgaggtggtcaacagaggagagaccacatgaccacccacaacctggcggcagcgcaaaagatg

SEQ ID NO: 113410 - DNA, 103 bp, Artificial Sequence
  Synthetic Polynucleotide
taatacgactcactatagggtttcgcctgtgtgggtgcggatgtgggtggaacagaggagaccacccatgtccgcacccaacctggcggcagcgcaaaagatg

SEQ ID NO: 113411 - DNA, 103 bp, Artificial Sequence
  Synthetic Polynucleotide
taatacgactcactataggggcgaagggcttttcgcctgtgtgggtgcggaacagaggagaccgcacatgcacaggcgaaacctggcggcagcgcaaaagatg

SEQ ID NO: 113412 - DNA, 103 bp, Artificial Sequence
  Synthetic Polynucleotide
taatacgactcactataggggatgtcgcaggcgaagggcttttcgcctgtaacagaggagaacaggcatgaagcccttcaacctggcggcagcgcaaaagatg

SEQ ID NO: 113413 - DNA, 103 bp, Artificial Sequence
  Synthetic Polynucleotide
taatacgactcactatagggttcttccacagatgtcgcaggcgaagggctaacagaggagaagccctatgcctgcgacaaacctggcggcagcgcaaaagatg

SEQ ID NO: 113414 - DNA, 103 bp, Artificial Sequence
  Synthetic Polynucleotide
taatacgactcactatagggtggggagccccgttgctcagcagcatcatcaacagaggagagatgatatggctgagcaaaacctggcggcagcgcaaaagatg

SEQ ID NO: 113415 - DNA, 103 bp, Artificial Sequence
  Synthetic Polynucleotide
taatacgactcactatagggctggcaaactttcttccacagatgtcgcagaacagaggagactgcgaatgctgtggaagaacctggcggcagcgcaaaagatg

SEQ ID NO: 113416 - DNA, 103 bp, Artificial Sequence
  Synthetic Polynucleotide
taatacgactcactatagggttcatcgctcctggcaaactttcttccacaaacagaggagatgtggaatgaagtttgccaacctggcggcagcgcaaaagatg

SEQ ID NO: 113417 - DNA, 103 bp, Artificial Sequence
  Synthetic Polynucleotide
taatacgactcactataggggcctcttgcgttcatcgctcctggcaaactaacagaggagaagtttgatgggagcgatgaacctggcggcagcgcaaaagatg

SEQ ID NO: 113418 - DNA, 103 bp, Artificial Sequence
  Synthetic Polynucleotide
taatacgactcactatagggatcttggtatgcctcttgcgttcatcgctcaacagaggagagagcgaatgacgcaagagaacctggcggcagcgcaaaagatg

SEQ ID NO: 113419 - DNA, 103 bp, Artificial Sequence
  Synthetic Polynucleotide
taatacgactcactatagggccgcaagtggatcttggtatgcctcttgcgaacagaggagacgcaagatgcataccaagaacctggcggcagcgcaaaagatg

SEQ ID NO: 113420 - DNA, 103 bp, Artificial Sequence
  Synthetic Polynucleotide
taatacgactcactatagggtgtccttctgccgcaagtggatcttggtataacagaggagaataccaatgtccacttgcaacctggcggcagcgcaaaagatg

SEQ ID NO: 113421 - DNA, 103 bp, Artificial Sequence
  Synthetic Polynucleotide
taatacgactcactatagggtctgctttcttgtccttctgccgcaagtggaacagaggagaccacttatggcagaaggaaacctggcggcagcgcaaaagatg

SEQ ID NO: 113422 - DNA, 103 bp, Artificial Sequence
  Synthetic Polynucleotide
taatacgactcactatagggaacacttttgtctgctttcttgtccttctgaacagaggagacagaagatgaagaaagcaaacctggcggcagcgcaaaagatg

SEQ ID NO: 113423 - DNA, 103 bp, Artificial Sequence
  Synthetic Polynucleotide
taatacgactcactatagggaagaggccacaacacttttgtctgctttctaacagaggagaagaaagatgacaaaagtgaacctggcggcagcgcaaaagatg

SEQ ID NO: 113424 - DNA, 103 bp, Artificial Sequence
  Synthetic Polynucleotide
taatacgactcactataggggaggtggccgaagaggccacaacacttttgaacagaggagacaaaagatgtgtggcctcaacctggcggcagcgcaaaagatg

SEQ ID NO: 113425 - DNA, 103 bp, Artificial Sequence
  Synthetic Polynucleotide
taatacgactcactataggggccgaggaactggggagccccgttgctcagaacagaggagactgagcatgggggctcccaacctggcggcagcgcaaaagatg

SEQ ID NO: 113426 - DNA, 103 bp, Artificial Sequence
  Synthetic Polynucleotide
taatacgactcactatagggagagagagaggaggtggccgaagaggccacaacagaggagagtggccatgtcggccaccaacctggcggcagcgcaaaagatg

SEQ ID NO: 113427 - DNA, 103 bp, Artificial Sequence
  Synthetic Polynucleotide
taatacgactcactatagggacgggtaggaagagagagaggaggtggccgaacagaggagacggccaatgcctctctctaacctggcggcagcgcaaaagatg

SEQ ID NO: 113428 - DNA, 103 bp, Artificial Sequence
  Synthetic Polynucleotide
taatacgactcactataggggcaaccggggacgggtaggaagagagagagaacagaggagactctctatgttcctacccaacctggcggcagcgcaaaagatg

SEQ ID NO: 113429 - DNA, 103 bp, Artificial Sequence
  Synthetic Polynucleotide
taatacgactcactataggggtaagaggtagcaaccggggacgggtaggaaacagaggagatcctacatgtccccggttaacctggcggcagcgcaaaagatg

SEQ ID NO: 113430 - DNA, 103 bp, Artificial Sequence
  Synthetic Polynucleotide
taatacgactcactatagggccggggacgggtaagaggtagcaaccggggaacagaggagaccccggatgctacctcttaacctggcggcagcgcaaaagatg

SEQ ID NO: 113431 - DNA, 103 bp, Artificial Sequence
  Synthetic Polynucleotide
taatacgactcactataggggaggtagtaaccggggacgggtaagaggtaaacagaggagatacctcatgcccgtccccaacctggcggcagcgcaaaagatg

SEQ ID NO: 113432 - DNA, 103 bp, Artificial Sequence
  Synthetic Polynucleotide
taatacgactcactatagggggatggataagaggtagtaaccggggacggaacagaggagaccgtccatggttactaccaacctggcggcagcgcaaaagatg

SEQ ID NO: 113433 - DNA, 103 bp, Artificial Sequence
  Synthetic Polynucleotide
taatacgactcactatagggtggtggccggggatggataagaggtagtaaaacagaggagattactaatgcttatccataacctggcggcagcgcaaaagatg

SEQ ID NO: 113434 - DNA, 103 bp, Artificial Sequence
  Synthetic Polynucleotide
taatacgactcactataggggggtatgaggtggtggccggggatggataaaacagaggagattatccatgcccggccacaacctggcggcagcgcaaaagatg

SEQ ID NO: 113435 - DNA, 103 bp, Artificial Sequence
  Synthetic Polynucleotide
taatacgactcactatagggcacaggggatgggtatgaggtggtggccggaacagaggagaccggccatgacctcatacaacctggcggcagcgcaaaagatg

SEQ ID NO: 113436 - DNA, 103 bp, Artificial Sequence
  Synthetic Polynucleotide
taatacgactcactatagggccccggcggcgccgaggaactggggagcccaacagaggagagggctcatgagttcctcgaacctggcggcagcgcaaaagatg

SEQ ID NO: 113437 - DNA, 103 bp, Artificial Sequence
  Synthetic Polynucleotide
taatacgactcactatagggaggaggtgggcacaggggatgggtatgaggaacagaggagacctcatatgcatcccctgaacctggcggcagcgcaaaagatg

SEQ ID NO: 113438 - DNA, 103 bp, Artificial Sequence
  Synthetic Polynucleotide
taatacgactcactatagggggagaggagaaggaggtgggcacaggggataacagaggagaatccccatggcccacctcaacctggcggcagcgcaaaagatg

SEQ ID NO: 113439 - DNA, 103 bp, Artificial Sequence
  Synthetic Polynucleotide
taatacgactcactatagggcgaggagccgggagaggagaaggaggtgggaacagaggagacccaccatgttctcctctaacctggcggcagcgcaaaagatg

SEQ ID NO: 113440 - DNA, 103 bp, Artificial Sequence
  Synthetic Polynucleotide
taatacgactcactatagggatgggtaggtcgaggagccgggagaggagaaacagaggagatctcctatgccggctcctaacctggcggcagcgcaaaagatg

SEQ ID NO: 113441 - DNA, 103 bp, Artificial Sequence
  Synthetic Polynucleotide
taatacgactcactatagggtgcacaggggatgggtaggtcgaggagccgaacagaggagacggctcatggacctacccaacctggcggcagcgcaaaagatg

SEQ ID NO: 113442 - DNA, 103 bp, Artificial Sequence
  Synthetic Polynucleotide
taatacgactcactataggggaagccactgtgcacaggggatgggtaggtaacagaggagaacctacatgtcccctgtgaacctggcggcagcgcaaaagatg

SEQ ID NO: 113443 - DNA, 103 bp, Artificial Sequence
  Synthetic Polynucleotide
taatacgactcactatagggacggggaggggaagccactgtgcacaggggaacagaggagacccctgatgacagtggctaacctggcggcagcgcaaaagatg

SEQ ID NO: 113444 - DNA, 103 bp, Artificial Sequence
  Synthetic Polynucleotide
taatacgactcactataggggtggccaccgacggggaggggaagccactgaacagaggagacagtggatgcccctccccaacctggcggcagcgcaaaagatg

SEQ ID NO: 113445 - DNA, 103 bp, Artificial Sequence
  Synthetic Polynucleotide
taatacgactcactatagggggagtacgtggtggccaccgacggggagggaacagaggagaccctccatgtcggtggccaacctggcggcagcgcaaaagatg

SEQ ID NO: 113446 - DNA, 103 bp, Artificial Sequence
  Synthetic Polynucleotide
taatacgactcactatagggggggaacagaggagtacgtggtggccaccgaacagaggagacggtggatgccacgtactaacctggcggcagcgcaaaagatg

SEQ ID NO: 113447 - DNA, 103 bp, Artificial Sequence
  Synthetic Polynucleotide
taatacgactcactatagggccctctggggccccggcggcgccgaggaacaacagaggagagttcctatgcgccgccggaacctggcggcagcgcaaaagatg

SEQ ID NO: 113448 - DNA, 103 bp, Artificial Sequence
  Synthetic Polynucleotide
taatacgactcactataggggggaaagcagggggaacagaggagtacgtgaacagaggagacacgtaatgctctgttccaacctggcggcagcgcaaaagatg

SEQ ID NO: 113449 - DNA, 103 bp, Artificial Sequence
  Synthetic Polynucleotide
taatacgactcactataggggacctgggccgggaaagcagggggaacagaaacagaggagatctgttatgcctgctttcaacctggcggcagcgcaaaagatg

SEQ ID NO: 113450 - DNA, 103 bp, Artificial Sequence
  Synthetic Polynucleotide
taatacgactcactatagggggaagctgctgacctgggccgggaaagcagaacagaggagactgcttatgcggcccaggaacctggcggcagcgcaaaagatg

SEQ ID NO: 113451 - DNA, 103 bp, Artificial Sequence
  Synthetic Polynucleotide
taatacgactcactataggggctgaggaagggaagctgctgacctgggccaacagaggagaggcccaatgcagcagcttaacctggcggcagcgcaaaagatg

SEQ ID NO: 113452 - DNA, 103 bp, Artificial Sequence
  Synthetic Polynucleotide
taatacgactcactataggggttggtgacagctgaggaagggaagctgctaacagaggagaagcagcatgccttcctcaaacctggcggcagcgcaaaagatg

SEQ ID NO: 113453 - DNA, 103 bp, Artificial Sequence
  Synthetic Polynucleotide
taatacgactcactatagggcgctgaaggagttggtgacagctgaggaagaacagaggagacttcctatgctgtcaccaaacctggcggcagcgcaaaagatg

SEQ ID NO: 113454 - DNA, 103 bp, Artificial Sequence
  Synthetic Polynucleotide
taatacgactcactatagggcctgtggaggcgctgaaggagttggtgacaaacagaggagatgtcacatgctccttcagaacctggcggcagcgcaaaagatg

SEQ ID NO: 113455 - DNA, 103 bp, Artificial Sequence
  Synthetic Polynucleotide
taatacgactcactataggggtccgaaagccctgtggaggcgctgaaggaaacagaggagatccttcatggcctccacaaacctggcggcagcgcaaaagatg

SEQ ID NO: 113456 - DNA, 103 bp, Artificial Sequence
  Synthetic Polynucleotide
taatacgactcactatagggttgctgtcatgtccgaaagccctgtggaggaacagaggagacctccaatgggctttcggaacctggcggcagcgcaaaagatg

SEQ ID NO: 113457 - DNA, 103 bp, Artificial Sequence
  Synthetic Polynucleotide
taatacgactcactatagggggagaaaaggttgctgtcatgtccgaaagcaacagaggagagctttcatgcatgacagcaacctggcggcagcgcaaaagatg

SEQ ID NO: 113458 - DNA, 103 bp, Artificial Sequence
  Synthetic Polynucleotide
taatacgactcactataggggctgccgctgccctctggggccccggcggcaacagaggagagccgccatggccccagagaacctggcggcagcgcaaaagatg

SEQ ID NO: 113459 - DNA, 103 bp, Artificial Sequence
  Synthetic Polynucleotide
taatacgactcactatagggaattgtcctgggagaaaaggttgctgtcataacagaggagaatgacaatgaccttttctaacctggcggcagcgcaaaagatg

SEQ ID NO: 113460 - DNA, 103 bp, Artificial Sequence
  Synthetic Polynucleotide
taatacgactcactatagggagcaaatttcaattgtcctgggagaaaaggaacagaggagaccttttatgccaggacaaaacctggcggcagcgcaaaagatg

SEQ ID NO: 113461 - DNA, 103 bp, Artificial Sequence
  Synthetic Polynucleotide
taatacgactcactatagggtgctgctgttgctgccgctgccctctggggaacagaggagaccccagatggcagcggcaaacctggcggcagcgcaaaagatg

SEQ ID NO: 113462 - DNA, 103 bp, Artificial Sequence
  Synthetic Polynucleotide
taatacgactcactatagggctgctgctgctgctgctgttgctgccgctgaacagaggagacagcggatgcaacagcagaacctggcggcagcgcaaaagatg

SEQ ID NO: 113463 - DNA, 103 bp, Artificial Sequence
  Synthetic Polynucleotide
taatacgactcactatagggaccgcccccgctgctgctgctgctgctgttaacagaggagaaacagcatgagcagcagcaacctggcggcagcgcaaaagatg

SEQ ID NO: 113464 - DNA, 103 bp, Artificial Sequence
  Synthetic Polynucleotide
taatacgactcactataggggcggggacatcagctgcatctcggccttggaacagaggagaccaaggatgagatgcagcaacctggcggcagcgcaaaagatg

SEQ ID NO: 113465 - DNA, 103 bp, Artificial Sequence
  Synthetic Polynucleotide
taatacgactcactatagggcgccgcctccaccgcccccgctgctgctgcaacagaggagagcagcaatggcgggggcgaacctggcggcagcgcaaaagatg

SEQ ID NO: 113466 - DNA, 103 bp, Artificial Sequence
  Synthetic Polynucleotide
taatacgactcactatagggctgccgcccccgccgcctccaccgcccccgaacagaggagacgggggatgtggaggcggaacctggcggcagcgcaaaagatg

SEQ ID NO: 113467 - DNA, 103 bp, Artificial Sequence
  Synthetic Polynucleotide
taatacgactcactataggggctgctgttgctgccgcccccgccgcctccaacagaggagaggaggcatggggggcggcaacctggcggcagcgcaaaagatg

SEQ ID NO: 113468 - DNA, 103 bp, Artificial Sequence
  Synthetic Polynucleotide
taatacgactcactatagggtgctgctgctgctgctgttgctgccgccccaacagaggagaggggcgatggcaacagcaaacctggcggcagcgcaaaagatg

SEQ ID NO: 113469 - DNA, 103 bp, Artificial Sequence
  Synthetic Polynucleotide
taatacgactcactatagggttgaaggtgctgctgctgctgctgctgttgaacagaggagacaacagatgcagcagcagaacctggcggcagcgcaaaagatg

SEQ ID NO: 113470 - DNA, 103 bp, Artificial Sequence
  Synthetic Polynucleotide
taatacgactcactatagggcgcctgagggttgaaggtgctgctgctgctaacagaggagaagcagcatgagcaccttcaacctggcggcagcgcaaaagatg

SEQ ID NO: 113471 - DNA, 103 bp, Artificial Sequence
  Synthetic Polynucleotide
taatacgactcactatagggcgcccgtgtccgcctgagggttgaaggtgcaacagaggagagcacctatgaccctcaggaacctggcggcagcgcaaaagatg

SEQ ID NO: 113472 - DNA, 103 bp, Artificial Sequence
  Synthetic Polynucleotide
taatacgactcactatagggtagggctgctcgcccgtgtccgcctgagggaacagaggagaccctcaatgggacacgggaacctggcggcagcgcaaaagatg

SEQ ID NO: 113473 - DNA, 103 bp, Artificial Sequence
  Synthetic Polynucleotide
taatacgactcactatagggcaggtgctcgtagggctgctcgcccgtgtcaacagaggagagacacgatggagcagcccaacctggcggcagcgcaaaagatg

SEQ ID NO: 113474 - DNA, 103 bp, Artificial Sequence
  Synthetic Polynucleotide
taatacgactcactatagggactctgcggtcaggtgctcgtagggctgctaacagaggagaagcagcatgacgagcaccaacctggcggcagcgcaaaagatg

SEQ ID NO: 113475 - DNA, 103 bp, Artificial Sequence
  Synthetic Polynucleotide
taatacgactcactataggggagatctgcagcggggacatcagctgcatcaacagaggagagatgcaatggatgtccccaacctggcggcagcgcaaaagatg

SEQ ID NO: 113476 - DNA, 103 bp, Artificial Sequence
  Synthetic Polynucleotide
taatacgactcactatagggtcaggaaaagactctgcggtcaggtgctcgaacagaggagacgagcaatggaccgcagaaacctggcggcagcgcaaaagatg

SEQ ID NO: 113477 - DNA, 103 bp, Artificial Sequence
  Synthetic Polynucleotide
taatacgactcactatagggcagagagatgtcaggaaaagactctgcggtaacagaggagaaccgcaatgtcttttcctaacctggcggcagcgcaaaagatg

SEQ ID NO: 113478 - DNA, 103 bp, Artificial Sequence
  Synthetic Polynucleotide
taatacgactcactatagggtctcgttgttcagagagatgtcaggaaaagaacagaggagacttttcatgacatctctcaacctggcggcagcgcaaaagatg

SEQ ID NO: 113479 - DNA, 103 bp, Artificial Sequence
  Synthetic Polynucleotide
taatacgactcactatagggaccagcaccttctcgttgttcagagagatgaacagaggagacatctcatggaacaacgaaacctggcggcagcgcaaaagatg

SEQ ID NO: 113480 - DNA, 103 bp, Artificial Sequence
  Synthetic Polynucleotide
taatacgactcactatagggactggtctccaccagcaccttctcgttgttaacagaggagaaacaacatgaaggtgctgaacctggcggcagcgcaaaagatg

SEQ ID NO: 113481 - DNA, 103 bp, Artificial Sequence
  Synthetic Polynucleotide
taatacgactcactatagggggctggggtaactggtctccaccagcacctaacagaggagaaggtgcatgtggagaccaaacctggcggcagcgcaaaagatg

SEQ ID NO: 113482 - DNA, 103 bp, Artificial Sequence
  Synthetic Polynucleotide
taatacgactcactatagggcgagtggtttggctggggtaactggtctccaacagaggagaggagacatgttaccccagaacctggcggcagcgcaaaagatg

SEQ ID NO: 113483 - DNA, 103 bp, Artificial Sequence
  Synthetic Polynucleotide
taatacgactcactatagggggggggcagtcgagtggtttggctggggtaaacagaggagataccccatgcaaaccactaacctggcggcagcgcaaaagatg

SEQ ID NO: 113484 - DNA, 103 bp, Artificial Sequence
  Synthetic Polynucleotide
taatacgactcactatagggtataggtgatggggggcagtcgagtggtttaacagaggagaaaaccaatggactgccccaacctggcggcagcgcaaaagatg

SEQ ID NO: 113485 - DNA, 103 bp, Artificial Sequence
  Synthetic Polynucleotide
taatacgactcactatagggaagcggccagtataggtgatggggggcagtaacagaggagaactgccatgcatcacctaaacctggcggcagcgcaaaagatg

SEQ ID NO: 113486 - DNA, 103 bp, Artificial Sequence
  Synthetic Polynucleotide
taatacgactcactataggggaacgggtcagagatctgcagcggggacataacagaggagaatgtccatgctgcagatcaacctggcggcagcgcaaaagatg

SEQ ID NO: 113487 - DNA, 103 bp, Artificial Sequence
  Synthetic Polynucleotide
taatacgactcactatagggctccagggaaaagcggccagtataggtgataacagaggagaatcaccatgactggccgcaacctggcggcagcgcaaaagatg

SEQ ID NO: 113488 - DNA, 103 bp, Artificial Sequence
  Synthetic Polynucleotide
taatacgactcactatagggtgggtgcaggctccagggaaaagcggccagaacagaggagactggccatgtttccctggaacctggcggcagcgcaaaagatg

SEQ ID NO: 113489 - DNA, 103 bp, Artificial Sequence
  Synthetic Polynucleotide
taatacgactcactatagggttgccactgttgggtgcaggctccagggaaaacagaggagattccctatggcctgcaccaacctggcggcagcgcaaaagatg

SEQ ID NO: 113490 - DNA, 103 bp, Artificial Sequence
  Synthetic Polynucleotide
taatacgactcactatagggccacaaggtgttgccactgttgggtgcaggaacagaggagacctgcaatgaacagtggcaacctggcggcagcgcaaaagatg

SEQ ID NO: 113491 - DNA, 103 bp, Artificial Sequence
  Synthetic Polynucleotide
taatacgactcactatagggggggctcgggccacaaggtgttgccactgtaacagaggagaacagtgatgacaccttgtaacctggcggcagcgcaaaagatg

SEQ ID NO: 113492 - DNA, 103 bp, Artificial Sequence
  Synthetic Polynucleotide
taatacgactcactatagggaagctgaagaggggctcgggccacaaggtgaacagaggagacaccttatggcccgagccaacctggcggcagcgcaaaagatg

SEQ ID NO: 113493 - DNA, 103 bp, Artificial Sequence
  Synthetic Polynucleotide
taatacgactcactataggggccactgaccaagctgaagaggggctcgggaacagaggagacccgagatgctcttcagcaacctggcggcagcgcaaaagatg

SEQ ID NO: 113494 - DNA, 103 bp, Artificial Sequence
  Synthetic Polynucleotide
taatacgactcactatagggtgctcactaggccactgaccaagctgaagaaacagaggagatcttcaatgtggtcagtgaacctggcggcagcgcaaaagatg

SEQ ID NO: 113495 - DNA, 103 bp, Artificial Sequence
  Synthetic Polynucleotide
taatacgactcactataggggggttggtcatgctcactaggccactgaccaacagaggagaggtcagatgcctagtgagaacctggcggcagcgcaaaagatg

SEQ ID NO: 113496 - DNA, 103 bp, Artificial Sequence
  Synthetic Polynucleotide
taatacgactcactatagggggaggccggtgggttggtcatgctcactagaacagaggagactagtgatgatgaccaacaacctggcggcagcgcaaaagatg

SEQ ID NO: 113497 - DNA, 103 bp, Artificial Sequence
  Synthetic Polynucleotide
taatacgactcactataggggaaaggatccgaacgggtcagagatctgcaaacagaggagatgcagaatgctgacccgtaacctggcggcagcgcaaaagatg

SEQ ID NO: 113498 - DNA, 103 bp, Artificial Sequence
  Synthetic Polynucleotide
taatacgactcactatagggctgaggacgaggaggccggtgggttggtcaaacagaggagatgaccaatgcaccggcctaacctggcggcagcgcaaaagatg

SEQ ID NO: 113499 - DNA, 103 bp, Artificial Sequence
  Synthetic Polynucleotide
taatacgactcactatagggggagatggtgctgaggacgaggaggccggtaacagaggagaaccggcatgctcgtcctcaacctggcggcagcgcaaaagatg

SEQ ID NO: 113500 - DNA, 103 bp, Artificial Sequence
  Synthetic Polynucleotide
taatacgactcactatagggggaggccgctggagatggtgctgaggacgaaacagaggagatcgtccatggcaccatctaacctggcggcagcgcaaaagatg

SEQ ID NO: 113501 - DNA, 103 bp, Artificial Sequence
  Synthetic Polynucleotide
taatacgactcactatagggcggaggcggaggaggccgctggagatggtgaacagaggagacaccatatgcagcggcctaacctggcggcagcgcaaaagatg

SEQ ID NO: 113502 - DNA, 103 bp, Artificial Sequence
  Synthetic Polynucleotide
taatacgactcactatagggctctgggaggcggaggcggaggaggccgctaacagaggagaagcggcatgctccgcctcaacctggcggcagcgcaaaagatg

SEQ ID NO: 113503 - DNA, 103 bp, Artificial Sequence
  Synthetic Polynucleotide
taatacgactcactatagggcaggggtgggctctgggaggcggaggcggaaacagaggagatccgccatggcctcccagaacctggcggcagcgcaaaagatg

SEQ ID NO: 113504 - DNA, 103 bp, Artificial Sequence
  Synthetic Polynucleotide
taatacgactcactatagggctgcgcagctcaggggtgggctctgggaggaacagaggagacctcccatggcccaccccaacctggcggcagcgcaaaagatg

SEQ ID NO: 113505 - DNA, 103 bp, Artificial Sequence
  Synthetic Polynucleotide
taatacgactcactatagggttggatggcactgcgcagctcaggggtgggaacagaggagacccaccatggagctgcgcaacctggcggcagcgcaaaagatg

SEQ ID NO: 113506 - DNA, 103 bp, Artificial Sequence
  Synthetic Polynucleotide
taatacgactcactatagggactgctgtcgttggatggcactgcgcagctaacagaggagaagctgcatggtgccatccaacctggcggcagcgcaaaagatg

SEQ ID NO: 113507 - DNA, 103 bp, Artificial Sequence
  Synthetic Polynucleotide
taatacgactcactatagggagtaaatgggactgctgtcgttggatggcaaacagaggagatgccatatgacgacagcaaacctggcggcagcgcaaaagatg

SEQ ID NO: 113508 - DNA, 103 bp, Artificial Sequence
  Synthetic Polynucleotide
taatacgactcactatagggggcgagtgaggaaaggatccgaacgggtcaaacagaggagatgacccatgcggatccttaacctggcggcagcgcaaaagatg

SEQ ID NO: 113509 - DNA, 103 bp, Artificial Sequence
  Synthetic Polynucleotide
taatacgactcactatagggggtgccgctgagtaaatgggactgctgtcgaacagaggagacgacagatgtcccatttaaacctggcggcagcgcaaaagatg

SEQ ID NO: 113510 - DNA, 103 bp, Artificial Sequence
  Synthetic Polynucleotide
taatacgactcactatagggggggaaggtgggtgccgctgagtaaatgggaacagaggagacccattatgtcagcggcaaacctggcggcagcgcaaaagatg

SEQ ID NO: 113511 - DNA, 103 bp, Artificial Sequence
  Synthetic Polynucleotide
taatacgactcactatagggtgttcggcgtggggaaggtgggtgccgctgaacagaggagacagcggatgccaccttccaacctggcggcagcgcaaaagatg

SEQ ID NO: 113512 - DNA, 103 bp, Artificial Sequence
  Synthetic Polynucleotide
taatacgactcactatagggaaaatgtcagtgttcggcgtggggaaggtgaacagaggagacaccttatgcacgccgaaaacctggcggcagcgcaaaagatg

SEQ ID NO: 113513 - DNA, 103 bp, Artificial Sequence
  Synthetic Polynucleotide
taatacgactcactatagggtggctcagggaaaatgtcagtgttcggcgtaacagaggagaacgccgatgactgacattaacctggcggcagcgcaaaagatg

SEQ ID NO: 113514 - DNA, 103 bp, Artificial Sequence
  Synthetic Polynucleotide
taatacgactcactatagggcctggctttgtggctcagggaaaatgtcagaacagaggagactgacaatgtccctgagcaacctggcggcagcgcaaaagatg

SEQ ID NO: 113515 - DNA, 103 bp, Artificial Sequence
  Synthetic Polynucleotide
taatacgactcactatagggcccgggaaggcctggctttgtggctcagggaacagaggagaccctgaatgacaaagccaaacctggcggcagcgcaaaagatg

SEQ ID NO: 113516 - DNA, 103 bp, Artificial Sequence
  Synthetic Polynucleotide
taatacgactcactatagggccctgccgagcccgggaaggcctggctttgaacagaggagacaaagcatggccttcccgaacctggcggcagcgcaaaagatg

SEQ ID NO: 113517 - DNA, 103 bp, Artificial Sequence
  Synthetic Polynucleotide
taatacgactcactatagggggagcgctgtccctgccgagcccgggaaggaacagaggagaccttccatggctcggcagaacctggcggcagcgcaaaagatg

SEQ ID NO: 113518 - DNA, 103 bp, Artificial Sequence
  Synthetic Polynucleotide
taatacgactcactatagggggcgggtactggagcgctgtccctgccgagaacagaggagactcggcatggacagcgctaacctggcggcagcgcaaaagatg

SEQ ID NO: 113519 - DNA, 103 bp, Artificial Sequence
  Synthetic Polynucleotide
taatacgactcactataggggtccatggtgggcgagtgaggaaaggatccaacagaggagaggatccatgcctcactcgaacctggcggcagcgcaaaagatg

SEQ ID NO: 113520 - DNA, 103 bp, Artificial Sequence
  Synthetic Polynucleotide
taatacgactcactataggggtaggcaggaggcgggtactggagcgctgtaacagaggagaacagcgatgcagtacccgaacctggcggcagcgcaaaagatg

SEQ ID NO: 113521 - DNA, 103 bp, Artificial Sequence
  Synthetic Polynucleotide
taatacgactcactatagggtggcggcagggtaggcaggaggcgggtactaacagaggagaagtaccatgctcctgcctaacctggcggcagcgcaaaagatg

SEQ ID NO: 113522 - DNA, 103 bp, Artificial Sequence
  Synthetic Polynucleotide
taatacgactcactatagggaagccacccttggcggcagggtaggcaggaaacagaggagatcctgcatgccctgccgcaacctggcggcagcgcaaaagatg

SEQ ID NO: 113523 - DNA, 103 bp, Artificial Sequence
  Synthetic Polynucleotide
taatacgactcactataggggggaacctggaagccacccttggcggcaggaacagaggagacctgccatgaagggtggcaacctggcggcagcgcaaaagatg

SEQ ID NO: 113524 - DNA, 103 bp, Artificial Sequence
  Synthetic Polynucleotide
taatacgactcactatagggcggggatcatgggaacctggaagccaccctaacagaggagaagggtgatgtccaggttcaacctggcggcagcgcaaaagatg

SEQ ID NO: 113525 - DNA, 103 bp, Artificial Sequence
  Synthetic Polynucleotide
taatacgactcactatagggaacaggtagtcggggatcatgggaacctggaacagaggagaccaggtatgcatgatcccaacctggcggcagcgcaaaagatg

SEQ ID NO: 113526 - DNA, 103 bp, Artificial Sequence
  Synthetic Polynucleotide
taatacgactcactatagggctgctgtggaaacaggtagtcggggatcataacagaggagaatgatcatggactacctgaacctggcggcagcgcaaaagatg

SEQ ID NO: 113527 - DNA, 103 bp, Artificial Sequence
  Synthetic Polynucleotide
taatacgactcactataggggatccccctgctgctgtggaaacaggtagtaacagaggagaactaccatgttccacagcaacctggcggcagcgcaaaagatg

SEQ ID NO: 113528 - DNA, 103 bp, Artificial Sequence
  Synthetic Polynucleotide
taatacgactcactatagggcccaggcccagatccccctgctgctgtggaaacagaggagatccacaatggcagggggaaacctggcggcagcgcaaaagatg

SEQ ID NO: 113529 - DNA, 103 bp, Artificial Sequence
  Synthetic Polynucleotide
taatacgactcactataggggtctggggtgcccaggcccagatccccctgaacagaggagacaggggatgctgggcctgaacctggcggcagcgcaaaagatg

SEQ ID NO: 113530 - DNA, 103 bp, Artificial Sequence
  Synthetic Polynucleotide
taatacgactcactatagggtagggtagttgtccatggtgggcgagtgagaacagaggagactcactatgccaccatggaacctggcggcagcgcaaaagatg

SEQ ID NO: 113531 - DNA, 103 bp, Artificial Sequence
  Synthetic Polynucleotide
taatacgactcactatagggagggcttctggtctggggtgcccaggcccaaacagaggagatgggccatggcaccccagaacctggcggcagcgcaaaagatg

SEQ ID NO: 113532 - DNA, 103 bp, Artificial Sequence
  Synthetic Polynucleotide
taatacgactcactatagggaggccctggaagggcttctggtctggggtgaacagaggagacaccccatgccagaagccaacctggcggcagcgcaaaagatg

SEQ ID NO: 113533 - DNA, 103 bp, Artificial Sequence
  Synthetic Polynucleotide
taatacgactcactataggggcggctctccaggccctggaagggcttctgaacagaggagacagaagatgttccagggcaacctggcggcagcgcaaaagatg

SEQ ID NO: 113534 - DNA, 103 bp, Artificial Sequence
  Synthetic Polynucleotide
taatacgactcactataggggctgctgggtgcggctctccaggccctggaaacagaggagatccaggatgtggagagccaacctggcggcagcgcaaaagatg

SEQ ID NO: 113535 - DNA, 103 bp, Artificial Sequence
  Synthetic Polynucleotide
taatacgactcactataggggttagcgaaggctgctgggtgcggctctccaacagaggagaggagagatgcacccagcaaacctggcggcagcgcaaaagatg

SEQ ID NO: 113536 - DNA, 103 bp, Artificial Sequence
  Synthetic Polynucleotide
taatacgactcactatagggagacagaggggttagcgaaggctgctgggtaacagaggagaacccagatgccttcgctaaacctggcggcagcgcaaaagatg

SEQ ID NO: 113537 - DNA, 103 bp, Artificial Sequence
  Synthetic Polynucleotide
taatacgactcactatagggccttaatagtagacagaggggttagcgaagaacagaggagacttcgcatgcccctctgtaacctggcggcagcgcaaaagatg

SEQ ID NO: 113538 - DNA, 103 bp, Artificial Sequence
  Synthetic Polynucleotide
taatacgactcactataggggtggcaaaggccttaatagtagacagagggaacagaggagaccctctatgtactattaaaacctggcggcagcgcaaaagatg

SEQ ID NO: 113539 - DNA, 103 bp, Artificial Sequence
  Synthetic Polynucleotide
taatacgactcactataggggcccgactgagtggcaaaggccttaatagtaacagaggagaactattatggcctttgccaacctggcggcagcgcaaaagatg

SEQ ID NO: 113540 - DNA, 103 bp, Artificial Sequence
  Synthetic Polynucleotide
taatacgactcactatagggggtcctgggagcccgactgagtggcaaaggaacagaggagacctttgatgctcagtcggaacctggcggcagcgcaaaagatg

SEQ ID NO: 113541 - DNA, 103 bp, Artificial Sequence
  Synthetic Polynucleotide
taatacgactcactatagggtcctccagcttagggtagttgtccatggtgaacagaggagacaccatatgcaactacccaacctggcggcagcgcaaaagatg

SEQ ID NO: 113542 - DNA, 103 bp, Artificial Sequence
  Synthetic Polynucleotide
taatacgactcactatagggagggccttcaggtcctgggagcccgactgaaacagaggagatcagtcatgctcccaggaaacctggcggcagcgcaaaagatg

SEQ ID NO: 113543 - DNA, 103 bp, Artificial Sequence
  Synthetic Polynucleotide
taatacgactcactataggggctggtattgagggccttcaggtcctgggaaacagaggagatcccagatgctgaaggccaacctggcggcagcgcaaaagatg

SEQ ID NO: 113544 - DNA, 103 bp, Artificial Sequence
  Synthetic Polynucleotide
taatacgactcactataggggggactggtagctggtattgagggccttcaaacagaggagatgaaggatgtcaataccaaacctggcggcagcgcaaaagatg

SEQ ID NO: 113545 - DNA, 103 bp, Artificial Sequence
  Synthetic Polynucleotide
taatacgactcactatagggttgatgagctgggactggtagctggtattgaacagaggagacaatacatgctaccagtcaacctggcggcagcgcaaaagatg

SEQ ID NO: 113546 - DNA, 103 bp, Artificial Sequence
  Synthetic Polynucleotide
taatacgactcactataggggcggctgggtttgatgagctgggactggtaaacagaggagataccagatgcagctcatcaacctggcggcagcgcaaaagatg

SEQ ID NO: 113547 - DNA, 103 bp, Artificial Sequence
  Synthetic Polynucleotide
taatacgactcactatagggacttgcgcatgcggctgggtttgatgagctaacagaggagaagctcaatgaacccagccaacctggcggcagcgcaaaagatg

SEQ ID NO: 113548 - DNA, 103 bp, Artificial Sequence
  Synthetic Polynucleotide
taatacgactcactatagggcggttggggtacttgcgcatgcggctgggtaacagaggagaacccagatgcatgcgcaaaacctggcggcagcgcaaaagatg

SEQ ID NO: 113549 - DNA, 103 bp, Artificial Sequence
  Synthetic Polynucleotide
taatacgactcactatagggcttgctgggccggttggggtacttgcgcataacagaggagaatgcgcatgtaccccaacaacctggcggcagcgcaaaagatg

SEQ ID NO: 113550 - DNA, 103 bp, Artificial Sequence
  Synthetic Polynucleotide
taatacgactcactataggggggggggcgtcttgctgggccggttggggtaacagaggagaaccccaatgggcccagcaaacctggcggcagcgcaaaagatg

SEQ ID NO: 113551 - DNA, 103 bp, Artificial Sequence
  Synthetic Polynucleotide
taatacgactcactataggggggcgttcgtgggggggcgtcttgctgggcaacagaggagagcccagatggacgcccccaacctggcggcagcgcaaaagatg

SEQ ID NO: 113552 - DNA, 103 bp, Artificial Sequence
  Synthetic Polynucleotide
taatacgactcactataggggattttgtctacggccttggcggtcatcataacagaggagaatgatgatggccaaggccaacctggcggcagcgcaaaagatg

SEQ ID NO: 113553 - DNA, 103 bp, Artificial Sequence
  Synthetic Polynucleotide
taatacgactcactataggggggaaagatggtcaccgacgtggcggcgagaacagaggagactcgccatgacgtcggtgaacctggcggcagcgcaaaagatg

SEQ ID NO: 113554 - DNA, 103 bp, Artificial Sequence
  Synthetic Polynucleotide
taatacgactcactataggggtagggcctctcgtgcaccggcgtcttgctaacagaggagaagcaagatgccggtgcacaacctggcggcagcgcaaaagatg

SEQ ID NO: 113555 - DNA, 103 bp, Artificial Sequence
  Synthetic Polynucleotide
taatacgactcactatagggctgggcacgggtagggcctctcgtgcaccgaacagaggagacggtgcatgagaggccctaacctggcggcagcgcaaaagatg

SEQ ID NO: 113556 - DNA, 103 bp, Artificial Sequence
  Synthetic Polynucleotide
taatacgactcactatagggcagccttctgctgggcacgggtagggcctcaacagaggagagaggccatgcccgtgcccaacctggcggcagcgcaaaagatg

SEQ ID NO: 113557 - DNA, 103 bp, Artificial Sequence
  Synthetic Polynucleotide
taatacgactcactatagggccgccggtcgcagccttctgctgggcacggaacagaggagaccgtgcatggcagaaggcaacctggcggcagcgcaaaagatg

SEQ ID NO: 113558 - DNA, 103 bp, Artificial Sequence
  Synthetic Polynucleotide
taatacgactcactatagggagcgggagaaccgccggtcgcagccttctgaacagaggagacagaagatggcgaccggcaacctggcggcagcgcaaaagatg

SEQ ID NO: 113559 - DNA, 103 bp, Artificial Sequence
  Synthetic Polynucleotide
taatacgactcactatagggagctcgtcagagcgggagaaccgccggtcgaacagaggagacgaccgatggttctcccgaacctggcggcagcgcaaaagatg

SEQ ID NO: 113560 - DNA, 103 bp, Artificial Sequence
  Synthetic Polynucleotide
taatacgactcactataggggtgccgtgtcagctcgtcagagcgggagaaaacagaggagattctccatgtctgacgagaacctggcggcagcgcaaaagatg

SEQ ID NO: 113561 - DNA, 103 bp, Artificial Sequence
  Synthetic Polynucleotide
taatacgactcactatagggggattcggatgtgccgtgtcagctcgtcagaacagaggagactgacgatgtgacacggcaacctggcggcagcgcaaaagatg

SEQ ID NO: 113562 - DNA, 103 bp, Artificial Sequence
  Synthetic Polynucleotide
taatacgactcactatagggtgcccagtgtggattcggatgtgccgtgtcaacagaggagagacacgatgcatccgaataacctggcggcagcgcaaaagatg

SEQ ID NO: 113563 - DNA, 103 bp, Artificial Sequence
  Synthetic Polynucleotide
taatacgactcactataggggaagggcttatgcccagtgtggattcggataacagaggagaatccgaatgcacactgggaacctggcggcagcgcaaaagatg

SEQ ID NO: 113564 - DNA, 103 bp, Artificial Sequence
  Synthetic Polynucleotide
taatacgactcactataggggttcggcattgggaaagatggtcaccgacgaacagaggagacgtcggatgccatctttcaacctggcggcagcgcaaaagatg

SEQ ID NO: 113565 - DNA, 103 bp, Artificial Sequence
  Synthetic Polynucleotide
taatacgactcactatagggtccgacactggaagggcttatgcccagtgtaacagaggagaacactgatgataagccctaacctggcggcagcgcaaaagatg

SEQ ID NO: 113566 - DNA, 103 bp, Artificial Sequence
  Synthetic Polynucleotide
taatacgactcactatagggcgcatgcagatccgacactggaagggcttaaacagaggagataagccatgccagtgtcgaacctggcggcagcgcaaaagatg

SEQ ID NO: 113567 - DNA, 103 bp, Artificial Sequence
  Synthetic Polynucleotide
taatacgactcactataggggctgaagttgcgcatgcagatccgacactgaacagaggagacagtgtatgatctgcatgaacctggcggcagcgcaaaagatg

SEQ ID NO: 113568 - DNA, 103 bp, Artificial Sequence
  Synthetic Polynucleotide
taatacgactcactatagggggtcactgcggctgaagttgcgcatgcagaaacagaggagatctgcaatggcaacttcaaacctggcggcagcgcaaaagatg

SEQ ID NO: 113569 - DNA, 103 bp, Artificial Sequence
  Synthetic Polynucleotide
taatacgactcactataggggtggtgaggtggtcactgcggctgaagttgaacagaggagacaacttatgccgcagtgaaacctggcggcagcgcaaaagatg

SEQ ID NO: 113570 - DNA, 103 bp, Artificial Sequence
  Synthetic Polynucleotide
taatacgactcactataggggcggatatgggtggtgaggtggtcactgcgaacagaggagacgcagtatgcacctcaccaacctggcggcagcgcaaaagatg

SEQ ID NO: 113571 - DNA, 103 bp, Artificial Sequence
  Synthetic Polynucleotide
taatacgactcactatagggcggtgtgggtgcggatatgggtggtgaggtaacagaggagaacctcaatgcccatatccaacctggcggcagcgcaaaagatg

SEQ ID NO: 113572 - DNA, 103 bp, Artificial Sequence
  Synthetic Polynucleotide
taatacgactcactatagggggcttctcaccggtgtgggtgcggatatggaacagaggagaccatatatgcacccacacaacctggcggcagcgcaaaagatg

SEQ ID NO: 113573 - DNA, 103 bp, Artificial Sequence
  Synthetic Polynucleotide
taatacgactcactatagggacaggcgaagggcttctcaccggtgtgggtaacagaggagaacccacatgggtgagaagaacctggcggcagcgcaaaagatg

SEQ ID NO: 113574 - DNA, 103 bp, Artificial Sequence
  Synthetic Polynucleotide
taatacgactcactatagggcacagtagtcacaggcgaagggcttctcacaacagaggagagtgagaatgccttcgcctaacctggcggcagcgcaaaagatg

SEQ ID NO: 113575 - DNA, 103 bp, Artificial Sequence
  Synthetic Polynucleotide
taatacgactcactataggggggcctcccagttcggcattgggaaagatgaacagaggagacatcttatgcaatgccgaaacctggcggcagcgcaaaagatg

SEQ ID NO: 113576 - DNA, 103 bp, Artificial Sequence
  Synthetic Polynucleotide
taatacgactcactatagggaactttcggccacagtagtcacaggcgaagaacagaggagacttcgcatgtgactactgaacctggcggcagcgcaaaagatg

SEQ ID NO: 113577 - DNA, 103 bp, Artificial Sequence
  Synthetic Polynucleotide
taatacgactcactatagggactccgggcaaactttcggccacagtagtcaacagaggagagactacatgggccgaaagaacctggcggcagcgcaaaagatg

SEQ ID NO: 113578 - DNA, 103 bp, Artificial Sequence
  Synthetic Polynucleotide
taatacgactcactatagggtcctctcatcactccgggcaaactttcggcaacagaggagagccgaaatgttgcccggaaacctggcggcagcgcaaaagatg

SEQ ID NO: 113579 - DNA, 103 bp, Artificial Sequence
  Synthetic Polynucleotide
taatacgactcactataggggtgtggcgcttcctctcatcactccgggcaaacagaggagatgcccgatgtgatgagagaacctggcggcagcgcaaaagatg

SEQ ID NO: 113580 - DNA, 103 bp, Artificial Sequence
  Synthetic Polynucleotide
taatacgactcactataggggtggatcttggtgtggcgcttcctctcatcaacagaggagagatgagatgaagcgccacaacctggcggcagcgcaaaagatg

SEQ ID NO: 113581 - DNA, 103 bp, Artificial Sequence
  Synthetic Polynucleotide
taatacgactcactatagggtctgtctcaggtggatcttggtgtggcgctaacagaggagaagcgccatgccaagatccaacctggcggcagcgcaaaagatg

SEQ ID NO: 113582 - DNA, 103 bp, Artificial Sequence
  Synthetic Polynucleotide
taatacgactcactatagggttccgctctttctgtctcaggtggatcttgaacagaggagacaagatatgcctgagacaaacctggcggcagcgcaaaagatg

SEQ ID NO: 113583 - DNA, 103 bp, Artificial Sequence
  Synthetic Polynucleotide
taatacgactcactatagggggcactgcttttccgctctttctgtctcagaacagaggagactgagaatgaaagagcggaacctggcggcagcgcaaaagatg

SEQ ID NO: 113584 - DNA, 103 bp, Artificial Sequence
  Synthetic Polynucleotide
taatacgactcactatagggatgcagagggggcactgcttttccgctcttaacagaggagaaagagcatgaaagcagtgaacctggcggcagcgcaaaagatg

SEQ ID NO: 113585 - DNA, 103 bp, Artificial Sequence
  Synthetic Polynucleotide
taatacgactcactataggggctggcaccgatgcagagggggcactgcttaacagaggagaaagcagatgcccctctgcaacctggcggcagcgcaaaagatg

SEQ ID NO: 113586 - DNA, 103 bp, Artificial Sequence
  Synthetic Polynucleotide
taatacgactcactatagggctggtcaaaggggcctcccagttcggcattaacagaggagaaatgccatgctgggaggcaacctggcggcagcgcaaaagatg

SEQ ID NO: 113587 - DNA, 103 bp, Artificial Sequence
  Synthetic Polynucleotide
taatacgactcactatagggtgtagagggggctggcaccgatgcagagggaacagaggagaccctctatgtcggtgccaaacctggcggcagcgcaaaagatg

SEQ ID NO: 113588 - DNA, 103 bp, Artificial Sequence
  Synthetic Polynucleotide
taatacgactcactatagggagcaggaggctgtagagggggctggcaccgaacagaggagacggtgcatgccccctctaaacctggcggcagcgcaaaagatg

SEQ ID NO: 113589 - DNA, 103 bp, Artificial Sequence
  Synthetic Polynucleotide
taatacgactcactatagggacgcccccagagcaggaggctgtagaggggaacagaggagacccctcatgagcctcctgaacctggcggcagcgcaaaagatg

SEQ ID NO: 113590 - DNA, 103 bp, Artificial Sequence
  Synthetic Polynucleotide
taatacgactcactatagggcccaggctgcacgcccccagagcaggaggcaacagaggagagcctccatgtctgggggcaacctggcggcagcgcaaaagatg

SEQ ID NO: 113591 - DNA, 103 bp, Artificial Sequence
  Synthetic Polynucleotide
taatacgactcactatagggacagggtacccccaggctgcacgcccccagaacagaggagactggggatgtgcagcctgaacctggcggcagcgcaaaagatg

SEQ ID NO: 113592 - DNA, 103 bp, Artificial Sequence
  Synthetic Polynucleotide
taatacgactcactatagggttactgctgcacagggtacccccaggctgcaacagaggagagcagccatggggtaccctaacctggcggcagcgcaaaagatg

SEQ ID NO: 113593 - DNA, 103 bp, Artificial Sequence
  Synthetic Polynucleotide
taatacgactcactatagggactgctgctgttactgctgcacagggtaccaacagaggagaggtaccatgtgcagcagtaacctggcggcagcgcaaaagatg

SEQ ID NO: 113594 - DNA, 103 bp, Artificial Sequence
  Synthetic Polynucleotide
taatacgactcactatagggctccgccaagactgctgctgttactgctgcaacagaggagagcagcaatgacagcagcaaacctggcggcagcgcaaaagatg

SEQ ID NO: 113595 - DNA, 103 bp, Artificial Sequence
  Synthetic Polynucleotide
taatacgactcactataggggcgagcggccctccgccaagactgctgctgaacagaggagacagcagatgtcttggcggaacctggcggcagcgcaaaagatg

SEQ ID NO: 113596 - DNA, 103 bp, Artificial Sequence
  Synthetic Polynucleotide
taatacgactcactatagggggagcaaggggcgagcggccctccgccaagaacagaggagacttggcatggggccgctcaacctggcggcagcgcaaaagatg

SEQ ID NO: 113597 - DNA, 103 bp, Artificial Sequence
  Synthetic Polynucleotide
taatacgactcactatagggctccgttcatctggtcaaaggggcctcccaaacagaggagatgggagatgcctttgaccaacctggcggcagcgcaaaagatg

SEQ ID NO: 113598 - DNA, 103 bp, Artificial Sequence
  Synthetic Polynucleotide
taatacgactcactataggggggtccgagaggagcaaggggcgagcggccaacagaggagaggccgcatgccccttgctaacctggcggcagcgcaaaagatg

SEQ ID NO: 113599 - DNA, 103 bp, Artificial Sequence
  Synthetic Polynucleotide
taatacgactcactatagggcaaggtgtccgggtccgagaggagcaagggaacagaggagacccttgatgctctcggacaacctggcggcagcgcaaaagatg

SEQ ID NO: 113600 - DNA, 103 bp, Artificial Sequence
  Synthetic Polynucleotide
taatacgactcactatagggtctccggccactccgttcatctggtcaaagaacagaggagactttgaatggatgaacggaacctggcggcagcgcaaaagatg

SEQ ID NO: 113601 - DNA, 103 bp, Artificial Sequence
  Synthetic Polynucleotide
taatacgactcactataggggatcatgccatctccggccactccgttcataacagaggagaatgaacatggtggccggaaacctggcggcagcgcaaaagatg

SEQ ID NO: 113602 - DNA, 103 bp, Artificial Sequence
  Synthetic Polynucleotide
taatacgactcactatagggtgtcaatgttgatcatgccatctccggccaaacagaggagatggccgatgatggcatgaaacctggcggcagcgcaaaagatg

SEQ ID NO: 113603 - DNA, 103 bp, Artificial Sequence
  Synthetic Polynucleotide
taatacgactcactatagggtctccagtcatgtcaatgttgatcatgccaaacagaggagatggcatatgcaacattgaaacctggcggcagcgcaaaagatg

SEQ ID NO: 113604 - DNA, 103 bp, Artificial Sequence
  Synthetic Polynucleotide
taatacgactcactatagggcgacctcttctctccagtcatgtcaatgttaacagaggagaaacattatgatgactggaaacctggcggcagcgcaaaagatg

SEQ ID NO: 113605 - DNA, 103 bp, Artificial Sequence
  Synthetic Polynucleotide
taatacgactcactataggggagttactgggattttgtctacggccttggaacagaggagaccaaggatgtagacaaaaaacctggcggcagcgcaaaagatg

SEQ ID NO: 113606 - DNA, 103 bp, Artificial Sequence
  Synthetic Polynucleotide
taatacgactcactatagggggagatccaacgacctcttctctccagtcaaacagaggagatgactgatgagaagaggtaacctggcggcagcgcaaaagatg

SEQ ID NO: 113607 - DNA, 103 bp, Artificial Sequence
  Synthetic Polynucleotide
taatacgactcactatagggctgggatatgggagatccaacgacctcttcaacagaggagagaagagatggttggatctaacctggcggcagcgcaaaagatg

SEQ ID NO: 113608 - DNA, 103 bp, Artificial Sequence
  Synthetic Polynucleotide
taatacgactcactatagggagcaaagctgctgggatatgggagatccaaaacagaggagattggatatgccatatcccaacctggcggcagcgcaaaagatg

SEQ ID NO: 113609 - DNA, 103 bp, Artificial Sequence
  Synthetic Polynucleotide
taatacgactcactatagggcagagacgggagcaaagctgctgggatatgaacagaggagacatatcatggcagctttgaacctggcggcagcgcaaaagatg

SEQ ID NO: 113610 - DNA, 103 bp, Artificial Sequence
  Synthetic Polynucleotide
taatacgactcactatagggtttctaggtgcagagacgggagcaaagctgaacagaggagacagcttatgtcccgtctcaacctggcggcagcgcaaaagatg

SEQ ID NO: 113611 - DNA, 103 bp, Artificial Sequence
  Synthetic Polynucleotide
taatacgactcactataggggaaggtctggtttctaggtgcagagacgggaacagaggagacccgtcatggcacctagaaacctggcggcagcgcaaaagatg

SEQ ID NO: 113612 - DNA, 103 bp, Artificial Sequence
  Synthetic Polynucleotide
taatacgactcactatagggccatgtaagtgaaggtctggtttctaggtgaacagaggagacacctaatgaccagacctaacctggcggcagcgcaaaagatg

SEQ ID NO: 113613 - DNA, 103 bp, Artificial Sequence
  Synthetic Polynucleotide
taatacgactcactataggggagaacttgcccatgtaagtgaaggtctggaacagaggagaccagacatgcacttacataacctggcggcagcgcaaaagatg

SEQ ID NO: 113614 - DNA, 103 bp, Artificial Sequence
  Synthetic Polynucleotide
taatacgactcactatagggagggtcaatggagaacttgcccatgtaagtaacagaggagaacttacatgggcaagttcaacctggcggcagcgcaaaagatg

SEQ ID NO: 113615 - DNA, 103 bp, Artificial Sequence
  Synthetic Polynucleotide
taatacgactcactatagggcagggtactgagggtcaatggagaacttgcaacagaggagagcaagtatgccattgaccaacctggcggcagcgcaaaagatg

SEQ ID NO: 113616 - DNA, 103 bp, Artificial Sequence
  Synthetic Polynucleotide
taatacgactcactatagggaaaccactgagagttactgggattttgtctaacagaggagaagacaaatgcccagtaacaacctggcggcagcgcaaaagatg

SEQ ID NO: 113617 - DNA, 103 bp, Artificial Sequence
  Synthetic Polynucleotide
taatacgactcactatagggcagctggcaccagggtactgagggtcaatgaacagaggagacattgaatgtcagtacccaacctggcggcagcgcaaaagatg

SEQ ID NO: 113618 - DNA, 103 bp, Artificial Sequence
  Synthetic Polynucleotide
taatacgactcactatagggttctgggtagcagctggcaccagggtactgaacagaggagacagtacatgggtgccagcaacctggcggcagcgcaaaagatg

SEQ ID NO: 113619 - DNA, 103 bp, Artificial Sequence
  Synthetic Polynucleotide
taatacgactcactatagggtgattatgccttctgggtagcagctggcacaacagaggagagtgccaatggctacccagaacctggcggcagcgcaaaagatg

SEQ ID NO: 113620 - DNA, 103 bp, Artificial Sequence
  Synthetic Polynucleotide
taatacgactcactatagggctcacaatattgattatgccttctgggtagaacagaggagactacccatgaggcataataacctggcggcagcgcaaaagatg

SEQ ID NO: 113621 - DNA, 103 bp, Artificial Sequence
  Synthetic Polynucleotide
taatacgactcactataggggatgcctgcactcacaatattgattatgccaacagaggagaggcataatgaatattgtgaacctggcggcagcgcaaaagatg

SEQ ID NO: 113622 - DNA, 103 bp, Artificial Sequence
  Synthetic Polynucleotide
taatacgactcactatagggccccttgcaagatgcctgcactcacaatataacagaggagaatattgatggtgcaggcaaacctggcggcagcgcaaaagatg

SEQ ID NO: 113623 - DNA, 103 bp, Artificial Sequence
  Synthetic Polynucleotide
taatacgactcactatagggggggaagtgaccccttgcaagatgcctgcaaacagaggagatgcaggatgcttgcaaggaacctggcggcagcgcaaaagatg

SEQ ID NO: 113624 - DNA, 103 bp, Artificial Sequence
  Synthetic Polynucleotide
taatacgactcactatagggggttgaagctggggaagtgaccccttgcaaaacagaggagattgcaaatggtcacttccaacctggcggcagcgcaaaagatg

SEQ ID NO: 113625 - DNA, 103 bp, Artificial Sequence
  Synthetic Polynucleotide
taatacgactcactatagggatgaggctgtggttgaagctggggaagtgaaacagaggagatcacttatgcagcttcaaaacctggcggcagcgcaaaagatg

SEQ ID NO: 113626 - DNA, 103 bp, Artificial Sequence
  Synthetic Polynucleotide
taatacgactcactataggggtgacgctggatgaggctgtggttgaagctaacagaggagaagcttcatgcacagcctcaacctggcggcagcgcaaaagatg

SEQ ID NO: 113627 - DNA, 103 bp, Artificial Sequence
  Synthetic Polynucleotide
taatacgactcactatagggctggtgcacaaaaccactgagagttactggaacagaggagaccagtaatgctcagtggtaacctggcggcagcgcaaaagatg

SEQ ID NO: 113628 - DNA, 103 bp, Artificial Sequence
  Synthetic Polynucleotide
taatacgactcactatagggggaggcagaggtgacgctggatgaggctgtaacagaggagaacagccatgtccagcgtcaacctggcggcagcgcaaaagatg

SEQ ID NO: 113629 - DNA, 103 bp, Artificial Sequence
  Synthetic Polynucleotide
taatacgactcactataggggtgggttgggggaggcagaggtgacgctggaacagaggagaccagcgatgcctctgcctaacctggcggcagcgcaaaagatg

SEQ ID NO: 113630 - DNA, 103 bp, Artificial Sequence
  Synthetic Polynucleotide
taatacgactcactatagggcctgtggccagtgggttgggggaggcagagaacagaggagactctgcatgccccaacccaacctggcggcagcgcaaaagatg

SEQ ID NO: 113631 - DNA, 103 bp, Artificial Sequence
  Synthetic Polynucleotide
taatacgactcactatagggacccaggggtcctgtggccagtgggttgggaacagaggagacccaacatgctggccacaaacctggcggcagcgcaaaagatg

SEQ ID NO: 113632 - DNA, 103 bp, Artificial Sequence
  Synthetic Polynucleotide
taatacgactcactatagggtggtgcacacacccaggggtcctgtggccaaacagaggagatggccaatggacccctggaacctggcggcagcgcaaaagatg

SEQ ID NO: 113633 - DNA, 103 bp, Artificial Sequence
  Synthetic Polynucleotide
taatacgactcactataggggtctgggacatggtgcacacacccaggggtaacagaggagaacccctatgtgtgtgcacaacctggcggcagcgcaaaagatg

SEQ ID NO: 113634 - DNA, 103 bp, Artificial Sequence
  Synthetic Polynucleotide
taatacgactcactataggggtcaggctgggtctgggacatggtgcacacaacagaggagagtgtgcatgatgtcccagaacctggcggcagcgcaaaagatg

SEQ ID NO: 113635 - DNA, 103 bp, Artificial Sequence
  Synthetic Polynucleotide
taatacgactcactatagggggtggtccaggtcaggctgggtctgggacaaacagaggagatgtcccatgcccagcctgaacctggcggcagcgcaaaagatg

SEQ ID NO: 113636 - DNA, 103 bp, Artificial Sequence
  Synthetic Polynucleotide
taatacgactcactatagggggagagtacaggtggtccaggtcaggctggaacagaggagaccagccatgcctggaccaaacctggcggcagcgcaaaagatg

SEQ ID NO: 113637 - DNA, 103 bp, Artificial Sequence
  Synthetic Polynucleotide
taatacgactcactatagggaggcggtggcggagagtacaggtggtccagaacagaggagactggacatgctgtactctaacctggcggcagcgcaaaagatg

SEQ ID NO: 113638 - DNA, 103 bp, Artificial Sequence
  Synthetic Polynucleotide
taatacgactcactatagggtgtcagacagctggtgcacaaaaccactgaaacagaggagatcagtgatgttgtgcaccaacctggcggcagcgcaaaagatg

SEQ ID NO: 113639 - DNA, 103 bp, Artificial Sequence
  Synthetic Polynucleotide
taatacgactcactatagggaaggaggaggaggcggtggcggagagtacaaacagaggagatgtactatgcgccaccgcaacctggcggcagcgcaaaagatg

SEQ ID NO: 113640 - DNA, 103 bp, Artificial Sequence
  Synthetic Polynucleotide
taatacgactcactatagggcagccagaataaggaggaggaggcggtggcaacagaggagagccaccatgtcctcctccaacctggcggcagcgcaaaagatg

SEQ ID NO: 113641 - DNA, 103 bp, Artificial Sequence
  Synthetic Polynucleotide
taatacgactcactataggggtctcctgcacagccagaataaggaggaggaacagaggagacctcctatgtattctggcaacctggcggcagcgcaaaagatg

SEQ ID NO: 113642 - DNA, 103 bp, Artificial Sequence
  Synthetic Polynucleotide
taatacgactcactatagggcctggtagaggtctcctgcacagccagaataacagaggagaattctgatggtgcaggagaacctggcggcagcgcaaaagatg

SEQ ID NO: 113643 - DNA, 103 bp, Artificial Sequence
  Synthetic Polynucleotide
taatacgactcactataggggcagaagggtcctggtagaggtctcctgcaaacagaggagatgcaggatgcctctaccaaacctggcggcagcgcaaaagatg

SEQ ID NO: 113644 - DNA, 103 bp, Artificial Sequence
  Synthetic Polynucleotide
taatacgactcactatagggtgacaggaacgcagaagggtcctggtagagaacagaggagactctacatggacccttctaacctggcggcagcgcaaaagatg

SEQ ID NO: 113645 - DNA, 103 bp, Artificial Sequence
  Synthetic Polynucleotide
taatacgactcactatagggtggtggctgctgacaggaacgcagaagggtaacagaggagaacccttatgcgttcctgtaacctggcggcagcgcaaaagatg

SEQ ID NO: 113646 - DNA, 103 bp, Artificial Sequence
  Synthetic Polynucleotide
taatacgactcactataggggaggtggaggtggtggctgctgacaggaacaacagaggagagttcctatgagcagccacaacctggcggcagcgcaaaagatg

SEQ ID NO: 113647 - DNA, 103 bp, Artificial Sequence
  Synthetic Polynucleotide
taatacgactcactatagggcagagaggaagaggtggaggtggtggctgcaacagaggagagcagccatgacctccaccaacctggcggcagcgcaaaagatg

SEQ ID NO: 113648 - DNA, 103 bp, Artificial Sequence
  Synthetic Polynucleotide
taatacgactcactataggggtgggtaggccagagaggaagaggtggaggaacagaggagacctccaatgcttcctctcaacctggcggcagcgcaaaagatg

SEQ ID NO: 113649 - DNA, 103 bp, Artificial Sequence
  Synthetic Polynucleotide
taatacgactcactataggggggtagatgttgtcagacagctggtgcacaaacagaggagatgtgcaatggctgtctgaaacctggcggcagcgcaaaagatg

SEQ ID NO: 113650 - DNA, 103 bp, Artificial Sequence
  Synthetic Polynucleotide
taatacgactcactataggggaaggaggtggtgggtaggccagagaggaaaacagaggagattcctcatgggcctacccaacctggcggcagcgcaaaagatg

SEQ ID NO: 113651 - DNA, 103 bp, Artificial Sequence
  Synthetic Polynucleotide
taatacgactcactatagggggatggataggaaggaggtggtgggtaggcaacagaggagagcctacatgccacctcctaacctggcggcagcgcaaaagatg

SEQ ID NO: 113652 - DNA, 103 bp, Artificial Sequence
  Synthetic Polynucleotide
taatacgactcactatagggctggcttgggggatggataggaaggaggtgaacagaggagacacctcatgcctatccataacctggcggcagcgcaaaagatg

SEQ ID NO: 113653 - DNA, 103 bp, Artificial Sequence
  Synthetic Polynucleotide
taatacgactcactataggggggtccgtggctggcttgggggatggatagaacagaggagactatccatgccccaagccaacctggcggcagcgcaaaagatg

SEQ ID NO: 113654 - DNA, 103 bp, Artificial Sequence
  Synthetic Polynucleotide
taatacgactcactataggggaagagacctgggtccgtggctggcttgggaacagaggagacccaagatggccacggacaacctggcggcagcgcaaaagatg

SEQ ID NO: 113655 - DNA, 103 bp, Artificial Sequence
  Synthetic Polynucleotide
taatacgactcactatagggggatcattgggaagagacctgggtccgtggaacagaggagaccacggatgcaggtctctaacctggcggcagcgcaaaagatg

SEQ ID NO: 113656 - DNA, 103 bp, Artificial Sequence
  Synthetic Polynucleotide
taatacgactcactatagggggatagtctgggatcattgggaagagacctaacagaggagaaggtctatgcccaatgataacctggcggcagcgcaaaagatg

SEQ ID NO: 113657 - DNA, 103 bp, Artificial Sequence
  Synthetic Polynucleotide
taatacgactcactatagggaaagaatccaggatagtctgggatcattggaacagaggagaccaatgatgccagactataacctggcggcagcgcaaaagatg

SEQ ID NO: 113658 - DNA, 103 bp, Artificial Sequence
  Synthetic Polynucleotide
taatacgactcactatagggactgagatggaaagaatccaggatagtctgaacagaggagacagactatgctggattctaacctggcggcagcgcaaaagatg

SEQ ID NO: 113659 - DNA, 103 bp, Artificial Sequence
  Synthetic Polynucleotide
taatacgactcactatagggtctctctggcactgagatggaaagaatccaaacagaggagatggattatgtccatctcaaacctggcggcagcgcaaaagatg

SEQ ID NO: 113660 - DNA, 103 bp, Artificial Sequence
  Synthetic Polynucleotide
taatacgactcactataggggtcctccaccgggtagatgttgtcagacagaacagaggagactgtctatgaacatctacaacctggcggcagcgcaaaagatg

SEQ ID NO: 113661 - DNA, 103 bp, Artificial Sequence
  Synthetic Polynucleotide
taatacgactcactatagggaccatgtaggtctctctggcactgagatggaacagaggagaccatctatgtgccagagaaacctggcggcagcgcaaaagatg

SEQ ID NO: 113662 - DNA, 103 bp, Artificial Sequence
  Synthetic Polynucleotide
taatacgactcactatagggggccagctgtaccatgtaggtctctctggcaacagaggagagccagaatgacctacatgaacctggcggcagcgcaaaagatg

SEQ ID NO: 113663 - DNA, 103 bp, Artificial Sequence
  Synthetic Polynucleotide
taatacgactcactatagggttacggtctgggccagctgtaccatgtaggaacagaggagacctacaatgtacagctggaacctggcggcagcgcaaaagatg

SEQ ID NO: 113664 - DNA, 103 bp, Artificial Sequence
  Synthetic Polynucleotide
taatacgactcactataggggggaaagggcttacggtctgggccagctgtaacagaggagaacagctatgccagaccgtaacctggcggcagcgcaaaagatg

SEQ ID NO: 113665 - DNA, 103 bp, Artificial Sequence
  Synthetic Polynucleotide
taatacgactcactatagggccagtgggcagggaaagggcttacggtctgaacagaggagacagaccatgagccctttcaacctggcggcagcgcaaaagatg

SEQ ID NO: 113666 - DNA, 103 bp, Artificial Sequence
  Synthetic Polynucleotide
taatacgactcactatagggcgcagggtgtccagtgggcagggaaagggcaacagaggagagcccttatgctgcccactaacctggcggcagcgcaaaagatg

SEQ ID NO: 113667 - DNA, 103 bp, Artificial Sequence
  Synthetic Polynucleotide
taatacgactcactatagggagggggcacccgcagggtgtccagtgggcaaacagaggagatgcccaatggacaccctgaacctggcggcagcgcaaaagatg

SEQ ID NO: 113668 - DNA, 103 bp, Artificial Sequence
  Synthetic Polynucleotide
taatacgactcactataggggagtgagtggagggggcacccgcagggtgtaacagaggagaacacccatggggtgccccaacctggcggcagcgcaaaagatg

SEQ ID NO: 113669 - DNA, 103 bp, Artificial Sequence
  Synthetic Polynucleotide
taatacgactcactataggggtagagagtggagtgagtggagggggcaccaacagaggagaggtgccatgtccactcacaacctggcggcagcgcaaaagatg

SEQ ID NO: 113670 - DNA, 103 bp, Artificial Sequence
  Synthetic Polynucleotide
taatacgactcactataggggttacggattgtagagagtggagtgagtggaacagaggagaccactcatgccactctctaacctggcggcagcgcaaaagatg

SEQ ID NO: 113671 - DNA, 103 bp, Artificial Sequence
  Synthetic Polynucleotide
taatacgactcactatagggtggcggcgaggtcctccaccgggtagatgtaacagaggagaacatctatgcggtggaggaacctggcggcagcgcaaaagatg

SEQ ID NO: 113672 - DNA, 103 bp, Artificial Sequence
  Synthetic Polynucleotide
taatacgactcactatagggccagggtaaagttacggattgtagagagtgaacagaggagacactctatgcaatccgtaaacctggcggcagcgcaaaagatg

SEQ ID NO: 113673 - DNA, 103 bp, Artificial Sequence
  Synthetic Polynucleotide
taatacgactcactatagggctggggccccccagggtaaagttacggattaacagaggagaaatccgatgctttaccctaacctggcggcagcgcaaaagatg

SEQ ID NO: 113674 - DNA, 103 bp, Artificial Sequence
  Synthetic Polynucleotide
taatacgactcactatagggcaccccagcactggggccccccagggtaaaaacagaggagatttaccatggggggccccaacctggcggcagcgcaaaagatg

SEQ ID NO: 113675 - DNA, 103 bp, Artificial Sequence
  Synthetic Polynucleotide
taatacgactcactatagggctggtccggtcaccccagcactggggccccaacagaggagaggggccatggtgctggggaacctggcggcagcgcaaaagatg

SEQ ID NO: 113676 - DNA, 103 bp, Artificial Sequence
  Synthetic Polynucleotide
taatacgactcactatagggccactggcccctggtccggtcaccccagcaaacagaggagatgctggatggaccggaccaacctggcggcagcgcaaaagatg

SEQ ID NO: 113677 - DNA, 103 bp, Artificial Sequence
  Synthetic Polynucleotide
taatacgactcactatagggctcgctgcctccactggcccctggtccggtaacagaggagaaccggaatgggggccagtaacctggcggcagcgcaaaagatg

SEQ ID NO: 113678 - DNA, 103 bp, Artificial Sequence
  Synthetic Polynucleotide
taatacgactcactataggggccggggtccctcgctgcctccactggcccaacagaggagagggccaatggaggcagcgaacctggcggcagcgcaaaagatg

SEQ ID NO: 113679 - DNA, 103 bp, Artificial Sequence
  Synthetic Polynucleotide
taatacgactcactatagggctaccaggcagccggggtccctcgctgcctaacagaggagaaggcagatggggaccccgaacctggcggcagcgcaaaagatg

SEQ ID NO: 113680 - DNA, 103 bp, Artificial Sequence
  Synthetic Polynucleotide
taatacgactcactatagggtgctgagctgctaccaggcagccggggtccaacagaggagaggacccatgctgcctggtaacctggcggcagcgcaaaagatg

SEQ ID NO: 113681 - DNA, 103 bp, Artificial Sequence
  Synthetic Polynucleotide
taatacgactcactatagggctgctgctgctgctgagctgctaccaggcaaacagaggagatgcctgatggcagctcagaacctggcggcagcgcaaaagatg

SEQ ID NO: 113682 - DNA, 103 bp, Artificial Sequence
  Synthetic Polynucleotide
taatacgactcactataggggtcaccgacgtggcggcgaggtcctccaccaacagaggagaggtggaatgcctcgccgcaacctggcggcagcgcaaaagatg

SEQ ID NO: 113683 - DNA, 103 bp, Artificial Sequence
  Synthetic Polynucleotide
taatacgactcactataggggcggcggcggctgctgctgctgctgagctgaacagaggagacagctcatgagcagcagcaacctggcggcagcgcaaaagatg

SEQ ID NO: 113684 - DNA, 103 bp, Artificial Sequence
  Synthetic Polynucleotide
taatacgactcactatagggataggcggcggcggcggcggctgctgctgcaacagaggagagcagcaatggccgccgccaacctggcggcagcgcaaaagatg

SEQ ID NO: 113685 - DNA, 103 bp, Artificial Sequence
  Synthetic Polynucleotide
taatacgactcactatagggggtgtgggttataggcggcggcggcggcggaacagaggagaccgccgatgccgccgcctaacctggcggcagcgcaaaagatg

SEQ ID NO: 113686 - DNA, 103 bp, Artificial Sequence
  Synthetic Polynucleotide
taatacgactcactatagggagtggcaggtggtgtgggttataggcggcgaacagaggagacgccgcatgtaacccacaaacctggcggcagcgcaaaagatg

SEQ ID NO: 113687 - DNA, 103 bp, Artificial Sequence
  Synthetic Polynucleotide
taatacgactcactatagggaatgggccgcagtggcaggtggtgtgggttaacagaggagaaacccaatgcacctgccaaacctggcggcagcgcaaaagatg

SEQ ID NO: 113688 - DNA, 103 bp, Artificial Sequence
  Synthetic Polynucleotide
taatacgactcactataggggaggcctcagaatgggccgcagtggcaggtaacagaggagaacctgcatgtgcggcccaaacctggcggcagcgcaaaagatg

SEQ ID NO: 113689 - DNA, 103 bp, Artificial Sequence
  Synthetic Polynucleotide
taatacgactcactataggggggtacttgcgaggcctcagaatgggccgcaacagaggagagcggccatgtctgaggccaacctggcggcagcgcaaaagatg

SEQ ID NO: 113690 - DNA, 103 bp, Artificial Sequence
  Synthetic Polynucleotide
taatacgactcactataggggggtctgttggggtacttgcgaggcctcagaacagaggagactgaggatgcgcaagtacaacctggcggcagcgcaaaagatg

SEQ ID NO: 113691 - DNA, 103 bp, Artificial Sequence
  Synthetic Polynucleotide
taatacgactcactataggggcgtcttgctgggtctgttggggtacttgcaacagaggagagcaagtatgccaacagacaacctggcggcagcgcaaaagatg

SEQ ID NO: 113692 - DNA, 103 bp, Artificial Sequence
  Synthetic Polynucleotide
taatacgactcactatagggtcgtgcaccggcgtcttgctgggtctgttgaacagaggagacaacagatgcagcaagacaacctggcggcagcgcaaaagatg

SEQ ID NO: 113693 - DNA, 103 bp, Artificial Sequence
  Synthetic Polynucleotide
taatacgactcactatagggcggcagcttctcggcgagtttgccggtcataacagaggagaatgaccatgaaactcgccaacctggcggcagcgcaaaagatg

SEQ ID NO: 113694 - DNA, 103 bp, Artificial Sequence
  Synthetic Polynucleotide
taatacgactcactataggggctgctgccggagaagaggttgagcgcgctaacagaggagaagcgcgatgaacctcttcaacctggcggcagcgcaaaagatg

SEQ ID NO: 113695 - DNA, 103 bp, Artificial Sequence
  Synthetic Polynucleotide
taatacgactcactataggggcgcccgcagaactcgcaggcaaagggcttaacagaggagaaagcccatggcctgcgagaacctggcggcagcgcaaaagatg

SEQ ID NO: 113696 - DNA, 103 bp, Artificial Sequence
  Synthetic Polynucleotide
taatacgactcactataggggcgcaaacttgcgcccgcagaactcgcaggaacagaggagacctgcgatgtctgcgggcaacctggcggcagcgcaaaagatg

SEQ ID NO: 113697 - DNA, 103 bp, Artificial Sequence
  Synthetic Polynucleotide
taatacgactcactatagggtcgtcgctgcgcgcaaacttgcgcccgcagaacagaggagactgcggatgcaagtttgcaacctggcggcagcgcaaaagatg

SEQ ID NO: 113698 - DNA, 103 bp, Artificial Sequence
  Synthetic Polynucleotide
taatacgactcactataggggcgcttgcgctcgtcgctgcgcgcaaacttaacagaggagaaagtttatgcgcagcgacaacctggcggcagcgcaaaagatg

SEQ ID NO: 113699 - DNA, 103 bp, Artificial Sequence
  Synthetic Polynucleotide
taatacgactcactatagggtcttggcgtggcgcttgcgctcgtcgctgcaacagaggagagcagcgatgagcgcaagcaacctggcggcagcgcaaaagatg

SEQ ID NO: 113700 - DNA, 103 bp, Artificial Sequence
  Synthetic Polynucleotide
taatacgactcactatagggttgaggtggatcttggcgtggcgcttgcgcaacagaggagagcgcaaatgccacgccaaaacctggcggcagcgcaaaagatg

SEQ ID NO: 113701 - DNA, 103 bp, Artificial Sequence
  Synthetic Polynucleotide
taatacgactcactatagggctccttttgcttgaggtggatcttggcgtgaacagaggagacacgccatgatccacctcaacctggcggcagcgcaaaagatg

SEQ ID NO: 113702 - DNA, 103 bp, Artificial Sequence
  Synthetic Polynucleotide
taatacgactcactatagggccgccttcttctccttttgcttgaggtggaaacagaggagatccaccatgagcaaaaggaacctggcggcagcgcaaaagatg

SEQ ID NO: 113703 - DNA, 103 bp, Artificial Sequence
  Synthetic Polynucleotide
taatacgactcactatagggccgcccttctccgccttcttctccttttgcaacagaggagagcaaaaatggaagaaggcaacctggcggcagcgcaaaagatg

SEQ ID NO: 113704 - DNA, 103 bp, Artificial Sequence
  Synthetic Polynucleotide
taatacgactcactatagggagagggtgcaccgcccttctccgccttcttaacagaggagaaagaagatggagaagggcaacctggcggcagcgcaaaagatg

SEQ ID NO: 113705 - DNA, 103 bp, Artificial Sequence
  Synthetic Polynucleotide
taatacgactcactatagggctaccgagtcgctgctgccggagaagaggtaacagaggagaacctctatgccggcagcaaacctggcggcagcgcaaaagatg

SEQ ID NO: 113706 - DNA, 103 bp, Artificial Sequence
  Synthetic Polynucleotide
taatacgactcactatagggccgaggatgcagagggtgcaccgcccttctaacagaggagaagaaggatggtgcaccctaacctggcggcagcgcaaaagatg

SEQ ID NO: 113707 - DNA, 103 bp, Artificial Sequence
  Synthetic Polynucleotide
taatacgactcactatagggacggggggcgccgaggatgcagagggtgcaaacagaggagatgcaccatgtgcatcctcaacctggcggcagcgcaaaagatg

SEQ ID NO: 113708 - DNA, 103 bp, Artificial Sequence
  Synthetic Polynucleotide
taatacgactcactatagggggccagcgacacggggggcgccgaggatgcaacagaggagagcatccatggcgccccccaacctggcggcagcgcaaaagatg

SEQ ID NO: 113709 - DNA, 103 bp, Artificial Sequence
  Synthetic Polynucleotide
taatacgactcactatagggtgaccacgggggccagcgacacggggggcgaacagaggagacgccccatgtgtcgctggaacctggcggcagcgcaaaagatg

SEQ ID NO: 113710 - DNA, 103 bp, Artificial Sequence
  Synthetic Polynucleotide
taatacgactcactataggggcgcaggtggtgaccacgggggccagcgacaacagaggagagtcgctatgccccgtggtaacctggcggcagcgcaaaagatg

SEQ ID NO: 113711 - DNA, 103 bp, Artificial Sequence
  Synthetic Polynucleotide
taatacgactcactatagggttgtaatggactaccgagtcgctgctgccgaacagaggagacggcagatgcgactcggtaacctggcggcagcgcaaaagatg

SEQ ID NO: 113712 - DNA, 103 bp, Artificial Sequence
  Synthetic Polynucleotide
taatacgactcactatagggagccatctgattgtaatggactaccgagtcaacagaggagagactcgatggtccattacaacctggcggcagcgcaaaagatg

SEQ ID NO: 113713 - DNA, 103 bp, Artificial Sequence
  Synthetic Polynucleotide
taatacgactcactatagggcattctctgtagccatctgattgtaatggaaacagaggagatccattatgatcagatggaacctggcggcagcgcaaaagatg

SEQ ID NO: 113714 - DNA, 103 bp, Artificial Sequence
  Synthetic Polynucleotide
taatacgactcactatagggatgtccattacattctctgtagccatctgaaacagaggagatcagatatgtacagagaaaacctggcggcagcgcaaaagatg

SEQ ID NO: 113715 - DNA, 103 bp, Artificial Sequence
  Synthetic Polynucleotide
taatacgactcactatagggggtcagaccgatgtccattacattctctgtaacagaggagaacagagatggtaatggacaacctggcggcagcgcaaaagatg

SEQ ID NO: 113716 - DNA, 103 bp, Artificial Sequence
  Synthetic Polynucleotide
taatacgactcactataggggcttctcgttggtcagaccgatgtccattaaacagaggagataatggatgtcggtctgaaacctggcggcagcgcaaaagatg

SEQ ID NO: 113717 - DNA, 103 bp, Artificial Sequence
  Synthetic Polynucleotide
taatacgactcactatagggtccgggttgggcttctcgttggtcagaccgaacagaggagacggtctatgcaacgagaaaacctggcggcagcgcaaaagatg

SEQ ID NO: 113718 - DNA, 103 bp, Artificial Sequence
  Synthetic Polynucleotide
taatacgactcactataggggtaagagagttccgggttgggcttctcgttaacagaggagaaacgagatgcccaacccgaacctggcggcagcgcaaaagatg

SEQ ID NO: 113719 - DNA, 103 bp, Artificial Sequence
  Synthetic Polynucleotide
taatacgactcactatagggtcatggtcaccggcagcttctcggcgagttaacagaggagaaactcgatgagaagctgcaacctggcggcagcgcaaaagatg

SEQ ID NO: 113720 - DNA, 103 bp, Artificial Sequence
  Synthetic Polynucleotide
taatacgactcactatagggaggagccggagtaagagagttccgggttggaacagaggagaccaaccatgaactctcttaacctggcggcagcgcaaaagatg

SEQ ID NO: 113721 - DNA, 103 bp, Artificial Sequence
  Synthetic Polynucleotide
taatacgactcactataggggctggctggaaggagccggagtaagagagtaacagaggagaactctcatgctccggctcaacctggcggcagcgcaaaagatg

SEQ ID NO: 113722 - DNA, 103 bp, Artificial Sequence
  Synthetic Polynucleotide
taatacgactcactataggggttgccgggggctggctggaaggagccggaaacagaggagatccggcatgttccagccaaacctggcggcagcgcaaaagatg

SEQ ID NO: 113723 - DNA, 103 bp, Artificial Sequence
  Synthetic Polynucleotide
taatacgactcactatagggtcacggtcttgttgccgggggctggctggaaacagaggagatccagcatgcccccggcaaacctggcggcagcgcaaaagatg

SEQ ID NO: 113724 - DNA, 103 bp, Artificial Sequence
  Synthetic Polynucleotide
taatacgactcactatagggcccaagtaggtcacggtcttgttgccggggaacagaggagaccccggatgcaagaccgtaacctggcggcagcgcaaaagatg

SEQ ID NO: 113725 - DNA, 103 bp, Artificial Sequence
  Synthetic Polynucleotide
taatacgactcactatagggggcgaactttcccaagtaggtcacggtcttaacagaggagaaagaccatgacctacttgaacctggcggcagcgcaaaagatg

SEQ ID NO: 113726 - DNA, 103 bp, Artificial Sequence
  Synthetic Polynucleotide
taatacgactcactataggggggagtcgaaggcgaactttcccaagtaggaacagaggagacctactatggaaagttcgaacctggcggcagcgcaaaagatg

SEQ ID NO: 113727 - DNA, 103 bp, Artificial Sequence
  Synthetic Polynucleotide
taatacgactcactatagggcagttggaaggggagtcgaaggcgaactttaacagaggagaaaagttatgcttcgactcaacctggcggcagcgcaaaagatg

SEQ ID NO: 113728 - DNA, 103 bp, Artificial Sequence
  Synthetic Polynucleotide
taatacgactcactataggggtcctggcaccagttggaaggggagtcgaaaacagaggagattcgacatgccttccaacaacctggcggcagcgcaaaagatg

SEQ ID NO: 113729 - DNA, 103 bp, Artificial Sequence
  Synthetic Polynucleotide
taatacgactcactatagggtaatgatgttgtcctggcaccagttggaagaacagaggagacttccaatgggtgccaggaacctggcggcagcgcaaaagatg

SEQ ID NO: 113730 - DNA, 103 bp, Artificial Sequence
  Synthetic Polynucleotide
taatacgactcactatagggagcaaactgctcatggtcaccggcagcttcaacagaggagagaagctatgggtgaccataacctggcggcagcgcaaaagatg

SEQ ID NO: 113731 - DNA, 103 bp, Artificial Sequence
  Synthetic Polynucleotide
taatacgactcactatagggctcatgaggctaatgatgttgtcctggcacaacagaggagagtgccaatgcaacatcataacctggcggcagcgcaaaagatg

SEQ ID NO: 113732 - DNA, 103 bp, Artificial Sequence
  Synthetic Polynucleotide
taatacgactcactataggggatgccggcgctcatgaggctaatgatgttaacagaggagaaacatcatgagcctcatgaacctggcggcagcgcaaaagatg

SEQ ID NO: 113733 - DNA, 103 bp, Artificial Sequence
  Synthetic Polynucleotide
taatacgactcactataggggcacccccaagatgccggcgctcatgaggcaacagaggagagcctcaatggcgccggcaaacctggcggcagcgcaaaagatg

SEQ ID NO: 113734 - DNA, 103 bp, Artificial Sequence
  Synthetic Polynucleotide
taatacgactcactataggggaagccgggggcacccccaagatgccggcgaacagaggagacgccggatgcttgggggtaacctggcggcagcgcaaaagatg

SEQ ID NO: 113735 - DNA, 103 bp, Artificial Sequence
  Synthetic Polynucleotide
taatacgactcactataggggagcgcccctgaagccgggggcacccccaaaacagaggagattggggatgcccccggctaacctggcggcagcgcaaaagatg

SEQ ID NO: 113736 - DNA, 103 bp, Artificial Sequence
  Synthetic Polynucleotide
taatacgactcactatagggtctgcgtgctgagcgcccctgaagccggggaacagaggagaccccggatgcaggggcgcaacctggcggcagcgcaaaagatg

SEQ ID NO: 113737 - DNA, 103 bp, Artificial Sequence
  Synthetic Polynucleotide
taatacgactcactataggggccgtggacgtctgcgtgctgagcgcccctaacagaggagaaggggcatgcagcacgcaaacctggcggcagcgcaaaagatg

SEQ ID NO: 113738 - DNA, 103 bp, Artificial Sequence
  Synthetic Polynucleotide
taatacgactcactatagggcaccatgctggccgtggacgtctgcgtgctaacagaggagaagcacgatgacgtccacgaacctggcggcagcgcaaaagatg

SEQ ID NO: 113739 - DNA, 103 bp, Artificial Sequence
  Synthetic Polynucleotide
taatacgactcactataggggcggtggctgcaccatgctggccgtggacgaacagaggagacgtccaatgccagcatggaacctggcggcagcgcaaaagatg

SEQ ID NO: 113740 - DNA, 103 bp, Artificial Sequence
  Synthetic Polynucleotide
taatacgactcactatagggacgtcaccctgcggtggctgcaccatgctgaacagaggagacagcatatggcagccaccaacctggcggcagcgcaaaagatg

SEQ ID NO: 113741 - DNA, 103 bp, Artificial Sequence
  Synthetic Polynucleotide
taatacgactcactatagggcagttggtttagcaaactgctcatggtcacaacagaggagagtgaccatgagcagtttgaacctggcggcagcgcaaaagatg

SEQ ID NO: 113742 - DNA, 103 bp, Artificial Sequence
  Synthetic Polynucleotide
taatacgactcactatagggcatggcctccacgtcaccctgcggtggctgaacagaggagacagccaatgcagggtgacaacctggcggcagcgcaaaagatg

SEQ ID NO: 113743 - DNA, 103 bp, Artificial Sequence
  Synthetic Polynucleotide
taatacgactcactataggggcgcgggatacatggcctccacgtcaccctaacagaggagaagggtgatgtggaggccaaacctggcggcagcgcaaaagatg

SEQ ID NO: 113744 - DNA, 103 bp, Artificial Sequence
  Synthetic Polynucleotide
taatacgactcactatagggtaggggggtagcgcgggatacatggcctccaacagaggagaggaggcatggtatcccgcaacctggcggcagcgcaaaagatg

SEQ ID NO: 113745 - DNA, 103 bp, Artificial Sequence
  Synthetic Polynucleotide
taatacgactcactataggggcagttggagtaggggggtagcgcgggataaacagaggagatatcccatgctaccccccaacctggcggcagcgcaaaagatg

SEQ ID NO: 113746 - DNA, 103 bp, Artificial Sequence
  Synthetic Polynucleotide
taatacgactcactatagggagaggtcgccgcagttggagtaggggggtaaacagaggagataccccatgactccaactaacctggcggcagcgcaaaagatg

SEQ ID NO: 113747 - DNA, 103 bp, Artificial Sequence
  Synthetic Polynucleotide
taatacgactcactatagggggctctgagtagaggtcgccgcagttggagaacagaggagactccaaatgcggcgacctaacctggcggcagcgcaaaagatg

SEQ ID NO: 113748 - DNA, 103 bp, Artificial Sequence
  Synthetic Polynucleotide
taatacgactcactataggggaaagacacgggctctgagtagaggtcgccaacagaggagaggcgacatgtactcagagaacctggcggcagcgcaaaagatg

SEQ ID NO: 113749 - DNA, 103 bp, Artificial Sequence
  Synthetic Polynucleotide
taatacgactcactataggggggggtcgtggaaagacacgggctctgagtaacagaggagaactcagatgccgtgtcttaacctggcggcagcgcaaaagatg

SEQ ID NO: 113750 - DNA, 103 bp, Artificial Sequence
  Synthetic Polynucleotide
taatacgactcactatagggggattgccctgggggtcgtggaaagacacgaacagaggagacgtgtcatgccacgacccaacctggcggcagcgcaaaagatg

SEQ ID NO: 113751 - DNA, 103 bp, Artificial Sequence
  Synthetic Polynucleotide
taatacgactcactatagggggcgagcccgggattgccctgggggtcgtgaacagaggagacacgacatgcagggcaataacctggcggcagcgcaaaagatg

SEQ ID NO: 113752 - DNA, 103 bp, Artificial Sequence
  Synthetic Polynucleotide
taatacgactcactataggggattgtcaggcagttggtttagcaaactgcaacagaggagagcagttatgtaaaccaacaacctggcggcagcgcaaaagatg

SEQ ID NO: 113753 - DNA, 103 bp, Artificial Sequence
  Synthetic Polynucleotide
taatacgactcactatagggggggggaataggcgagcccgggattgccctaacagaggagaagggcaatgccgggctcgaacctggcggcagcgcaaaagatg

SEQ ID NO: 113754 - DNA, 103 bp, Artificial Sequence
  Synthetic Polynucleotide
taatacgactcactatagggtggtaatcctggggggaataggcgagcccgaacagaggagacgggctatgctattccccaacctggcggcagcgcaaaagatg

SEQ ID NO: 113755 - DNA, 103 bp, Artificial Sequence
  Synthetic Polynucleotide
taatacgactcactatagggcttggccgattggtaatcctggggggaataaacagaggagatattccatgcaggattacaacctggcggcagcgcaaaagatg

SEQ ID NO: 113756 - DNA, 103 bp, Artificial Sequence
  Synthetic Polynucleotide
taatacgactcactatagggccaacgccggcttggccgattggtaatcctaacagaggagaaggattatgaatcggccaaacctggcggcagcgcaaaagatg

SEQ ID NO: 113757 - DNA, 103 bp, Artificial Sequence
  Synthetic Polynucleotide
taatacgactcactatagggagattgctgtccaacgccggcttggccgataacagaggagaatcggcatggccggcgttaacctggcggcagcgcaaaagatg

SEQ ID NO: 113758 - DNA, 103 bp, Artificial Sequence
  Synthetic Polynucleotide
taatacgactcactatagggcatggggaagagattgctgtccaacgccggaacagaggagaccggcgatggacagcaataacctggcggcagcgcaaaagatg

SEQ ID NO: 113759 - DNA, 103 bp, Artificial Sequence
  Synthetic Polynucleotide
taatacgactcactatagggagtcaggaatcatggggaagagattgctgtaacagaggagaacagcaatgtcttccccaaacctggcggcagcgcaaaagatg

SEQ ID NO: 113760 - DNA, 103 bp, Artificial Sequence
  Synthetic Polynucleotide
taatacgactcactatagggtagaggttgtagtcaggaatcatggggaagaacagaggagacttcccatggattcctgaaacctggcggcagcgcaaaagatg

SEQ ID NO: 113761 - DNA, 103 bp, Artificial Sequence
  Synthetic Polynucleotide
taatacgactcactatagggggggtggtggtagaggttgtagtcaggaataacagaggagaattcctatgtacaacctcaacctggcggcagcgcaaaagatg

SEQ ID NO: 113762 - DNA, 103 bp, Artificial Sequence
  Synthetic Polynucleotide
taatacgactcactatagggccatgtcgttggggtggtggtagaggttgtaacagaggagaacaaccatgaccaccaccaacctggcggcagcgcaaaagatg

SEQ ID NO: 113763 - DNA, 103 bp, Artificial Sequence
  Synthetic Polynucleotide
taatacgactcactatagggtcggggtacagattgtcaggcagttggtttaacagaggagaaaaccaatggcctgacaaaacctggcggcagcgcaaaagatg

SEQ ID NO: 113764 - DNA, 103 bp, Artificial Sequence
  Synthetic Polynucleotide
taatacgactcactatagggggaatggagcccatgtcgttggggtggtggaacagaggagaccaccaatgcaacgacataacctggcggcagcgcaaaagatg

SEQ ID NO: 113765 - DNA, 103 bp, Artificial Sequence
  Synthetic Polynucleotide
taatacgactcactatagggcttgtgctccggaatggagcccatgtcgttaacagaggagaaacgacatgggctccattaacctggcggcagcgcaaaagatg

SEQ ID NO: 113766 - DNA, 103 bp, Artificial Sequence
  Synthetic Polynucleotide
taatacgactcactatagggcctggaagggcttgtgctccggaatggagcaacagaggagagctccaatgcggagcacaaacctggcggcagcgcaaaagatg

SEQ ID NO: 113767 - DNA, 103 bp, Artificial Sequence
  Synthetic Polynucleotide
taatacgactcactataggggggtccatgccctggaagggcttgtgctccaacagaggagaggagcaatggcccttccaaacctggcggcagcgcaaaagatg

SEQ ID NO: 113768 - DNA, 103 bp, Artificial Sequence
  Synthetic Polynucleotide
taatacgactcactataggggacccggatggggtccatgccctggaagggaacagaggagacccttcatgggcatggacaacctggcggcagcgcaaaagatg

SEQ ID NO: 113769 - DNA, 103 bp, Artificial Sequence
  Synthetic Polynucleotide
taatacgactcactatagggggggcgggttgacccggatggggtccatgcaacagaggagagcatggatgccatccgggaacctggcggcagcgcaaaagatg

SEQ ID NO: 113770 - DNA, 103 bp, Artificial Sequence
  Synthetic Polynucleotide
taatacgactcactatagggggggtaatagggggcgggttgacccggatgaacagaggagacatccgatgcaacccgccaacctggcggcagcgcaaaagatg

SEQ ID NO: 113771 - DNA, 103 bp, Artificial Sequence
  Synthetic Polynucleotide
taatacgactcactatagggggtctccagaggggtaatagggggcgggttaacagaggagaaacccgatgcctattaccaacctggcggcagcgcaaaagatg

SEQ ID NO: 113772 - DNA, 103 bp, Artificial Sequence
  Synthetic Polynucleotide
taatacgactcactatagggatgccttgatggtctccagaggggtaatagaacagaggagactattaatgctctggagaaacctggcggcagcgcaaaagatg

SEQ ID NO: 113773 - DNA, 103 bp, Artificial Sequence
  Synthetic Polynucleotide
taatacgactcactatagggttgtctttgaatgccttgatggtctccagaaacagaggagatctggaatgcatcaaggcaacctggcggcagcgcaaaagatg

SEQ ID NO: 113774 - DNA, 103 bp, Artificial Sequence
  Synthetic Polynucleotide
taatacgactcactatagggggggatctcctcggggtacagattgtcaggaacagaggagacctgacatgctgtaccccaacctggcggcagcgcaaaagatg

SEQ ID NO: 113775 - DNA, 103 bp, Artificial Sequence
  Synthetic Polynucleotide
taatacgactcactataggggtggatctgcttgtctttgaatgccttgataacagaggagaatcaagatgttcaaagacaacctggcggcagcgcaaaagatg

SEQ ID NO: 113776 - DNA, 103 bp, Artificial Sequence
  Synthetic Polynucleotide
taatacgactcactatagggcaaagcccgggtggatctgcttgtctttgaaacagaggagatcaaagatgagcagatccaacctggcggcagcgcaaaagatg

SEQ ID NO: 113777 - DNA, 103 bp, Artificial Sequence
  Synthetic Polynucleotide
taatacgactcactatagggggcaggctgccaaagcccgggtggatctgcaacagaggagagcagatatgcccgggcttaacctggcggcagcgcaaaagatg

SEQ ID NO: 113778 - DNA, 103 bp, Artificial Sequence
  Synthetic Polynucleotide
taatacgactcactatagggcggcggctggggcaggctgccaaagcccggaacagaggagaccgggcatgggcagcctgaacctggcggcagcgcaaaagatg

SEQ ID NO: 113779 - DNA, 103 bp, Artificial Sequence
  Synthetic Polynucleotide
taatacgactcactatagggtgagggtgagcggcggctggggcaggctgcaacagaggagagcagccatgcccagccgcaacctggcggcagcgcaaaagatg

SEQ ID NO: 113780 - DNA, 103 bp, Artificial Sequence
  Synthetic Polynucleotide
taatacgactcactatagggcggatgggcttgagggtgagcggcggctggaacagaggagaccagccatggctcaccctaacctggcggcagcgcaaaagatg

SEQ ID NO: 113781 - DNA, 103 bp, Artificial Sequence
  Synthetic Polynucleotide
taatacgactcactatagggcttgcggggccggatgggcttgagggtgagaacagaggagactcaccatgaagcccatcaacctggcggcagcgcaaaagatg

SEQ ID NO: 113782 - DNA, 103 bp, Artificial Sequence
  Synthetic Polynucleotide
taatacgactcactatagggggttggggtacttgcggggccggatgggctaacagaggagaagcccaatgggccccgcaaacctggcggcagcgcaaaagatg

SEQ ID NO: 113783 - DNA, 103 bp, Artificial Sequence
  Synthetic Polynucleotide
taatacgactcactatagggttgctaggccggttggggtacttgcggggcaacagaggagagccccgatggtaccccaaaacctggcggcagcgcaaaagatg

SEQ ID NO: 113784 - DNA, 103 bp, Artificial Sequence
  Synthetic Polynucleotide
taatacgactcactataggggagcggtgtcttgctaggccggttggggtaaacagaggagataccccatgcggcctagcaacctggcggcagcgcaaaagatg

SEQ ID NO: 113785 - DNA, 103 bp, Artificial Sequence
  Synthetic Polynucleotide
taatacgactcactatagggtgagcgcgctggggatctcctcggggtacaaacagaggagatgtaccatgaggagatccaacctggcggcagcgcaaaagatg

SEQ ID NO: 113786 - DNA, 103 bp, Artificial Sequence
  Synthetic Polynucleotide
taatacgactcactataggggccgttcgtggagcggtgtcttgctaggccaacagaggagaggcctaatgagacaccgcaacctggcggcagcgcaaaagatg

SEQ ID NO: 113787 - DNA, 103 bp, Artificial Sequence
  Synthetic Polynucleotide
taatacgactcactatagggcacgcgtggggccgttcgtggagcggtgtcaacagaggagagacaccatgccacgaacgaacctggcggcagcgcaaaagatg

SEQ ID NO: 113788 - DNA, 103 bp, Artificial Sequence
  Synthetic Polynucleotide
taatacgactcactatagggctcggccgggcacgcgtggggccgttcgtgaacagaggagacacgaaatgccccacgcgaacctggcggcagcgcaaaagatg

SEQ ID NO: 113789 - DNA, 103 bp, Artificial Sequence
  Synthetic Polynucleotide
taatacgactcactatagggggtcgcagccctcggccgggcacgcgtgggaacagaggagacccacgatggcccggccgaacctggcggcagcgcaaaagatg

SEQ ID NO: 113790 - DNA, 103 bp, Artificial Sequence
  Synthetic Polynucleotide
taatacgactcactatagggctgaaacggcggtcgcagccctcggccgggaacagaggagacccggcatggggctgcgaaacctggcggcagcgcaaaagatg

SEQ ID NO: 113791 - DNA, 103 bp, Artificial Sequence
  Synthetic Polynucleotide
taatacgactcactataggggtccgaacggctgaaacggcggtcgcagccaacagaggagaggctgcatgcgccgtttcaacctggcggcagcgcaaaagatg

SEQ ID NO: 113792 - DNA, 103 bp, Artificial Sequence
  Synthetic Polynucleotide
taatacgactcactataggggggtcagctcgtccgaacggctgaaacggcaacagaggagagccgttatggccgttcggaacctggcggcagcgcaaaagatg

SEQ ID NO: 113793 - DNA, 103 bp, Artificial Sequence
  Synthetic Polynucleotide
taatacgactcactatagggcgcaggtgccgggtcagctcgtccgaacggaacagaggagaccgttcatgcgagctgacaacctggcggcagcgcaaaagatg

SEQ ID NO: 113794 - DNA, 103 bp, Artificial Sequence
  Synthetic Polynucleotide
taatacgactcactatagggcgtgtggatgcgcaggtgccgggtcagctcaacagaggagagagctgatgcggcacctgaacctggcggcagcgcaaaagatg

SEQ ID NO: 113795 - DNA, 103 bp, Artificial Sequence
  Synthetic Polynucleotide
taatacgactcactataggggcttgtggcccgtgtggatgcgcaggtgccaacagaggagaggcaccatggcatccacaaacctggcggcagcgcaaaagatg

SEQ ID NO: 113796 - DNA, 103 bp, Artificial Sequence
  Synthetic Polynucleotide
taatacgactcactataggggagaagaggttgagcgcgctggggatctccaacagaggagaggagatatgcagcgcgctaacctggcggcagcgcaaaagatg

SEQ ID NO: 113797 - DNA, 103 bp, Artificial Sequence
  Synthetic Polynucleotide
taatacgactcactatagggcactggaagggcttgtggcccgtgtggatgaacagaggagacatccaatggggccacaaaacctggcggcagcgcaaaagatg

SEQ ID NO: 113798 - DNA, 103 bp, Artificial Sequence
  Synthetic Polynucleotide
taatacgactcactataggggcagatccggcactggaagggcttgtggccaacagaggagaggccacatgcccttccagaacctggcggcagcgcaaaagatg

SEQ ID NO: 113799 - DNA, 103 bp, Artificial Sequence
  Synthetic Polynucleotide
taatacgactcactatagggagctccgcatgcagatccggcactggaaggaacagaggagaccttccatggccggatctaacctggcggcagcgcaaaagatg

SEQ ID NO: 113800 - DNA, 103 bp, Artificial Sequence
  Synthetic Polynucleotide
taatacgactcactatagggctgcggctgaagctccgcatgcagatccggaacagaggagaccggatatgcatgcggagaacctggcggcagcgcaaaagatg

SEQ ID NO: 113801 - DNA, 103 bp, Artificial Sequence
  Synthetic Polynucleotide
taatacgactcactataggggaggtggtcgctgcggctgaagctccgcataacagaggagaatgcggatgttcagccgcaacctggcggcagcgcaaaagatg

SEQ ID NO: 113802 - DNA, 103 bp, Artificial Sequence
  Synthetic Polynucleotide
taatacgactcactatagggtgtgagtggtgaggtggtcgctgcggctgaaacagaggagatcagccatggcgaccaccaacctggcggcagcgcaaaagatg

SEQ ID NO: 113803 - DNA, 103 bp, Artificial Sequence
  Synthetic Polynucleotide
taatacgactcactatagggtgagtgcggatgtgagtggtgaggtggtcgaacagaggagacgaccaatgcaccactcaaacctggcggcagcgcaaaagatg

SEQ ID NO: 113804 - DNA, 103 bp, Artificial Sequence
  Synthetic Polynucleotide
taatacgactcactatagggctcgcccgtatgagtgcggatgtgagtggtaacagaggagaaccactatgatccgcactaacctggcggcagcgcaaaagatg

SEQ ID NO: 113805 - DNA, 103 bp, Artificial Sequence
  Synthetic Polynucleotide
taatacgactcactatagggcaaagggcttctcgcccgtatgagtgcggaaacagaggagatccgcaatgatacgggcgaacctggcggcagcgcaaaagatg

SEQ ID NO: 113806 - DNA, 103 bp, Artificial Sequence
  Synthetic Polynucleotide
taatacgactcactatagggaactcgcaggcaaagggcttctcgcccgtaaacagaggagatacgggatggaagcccttaacctggcggcagcgcaaaagatg

SEQ ID NO: 113807 - DNA, 103 bp, Artificial Sequence
  Synthetic Polynucleotide
taatacgactcactatagggcgggcttccgactccccgggccactgccataacagaggagaatggcaatggcccggggaaacctggcggcagcgcaaaagatg

SEQ ID NO: 113808 - DNA, 103 bp, Artificial Sequence
  Synthetic Polynucleotide
taatacgactcactatagggtcgggcggcggctcctcgcctctccaaagcaacagaggagagctttgatgaggcgaggaaacctggcggcagcgcaaaagatg

SEQ ID NO: 113809 - DNA, 103 bp, Artificial Sequence
  Synthetic Polynucleotide
taatacgactcactatagggccctattacgggaaaacgagcctccggggcaacagaggagagccccgatggctcgttttaacctggcggcagcgcaaaagatg

SEQ ID NO: 113810 - DNA, 103 bp, Artificial Sequence
  Synthetic Polynucleotide
taatacgactcactatagggcaatcttggtccctattacgggaaaacgagaacagaggagactcgttatgccgtaatagaacctggcggcagcgcaaaagatg

SEQ ID NO: 113811 - DNA, 103 bp, Artificial Sequence
  Synthetic Polynucleotide
taatacgactcactatagggagcaagtcctcaatcttggtccctattacgaacagaggagacgtaatatggaccaagataacctggcggcagcgcaaaagatg

SEQ ID NO: 113812 - DNA, 103 bp, Artificial Sequence
  Synthetic Polynucleotide
taatacgactcactataggggctgatggacagcaagtcctcaatcttggtaacagaggagaaccaagatggaggacttgaacctggcggcagcgcaaaagatg

SEQ ID NO: 113813 - DNA, 103 bp, Artificial Sequence
  Synthetic Polynucleotide
taatacgactcactatagggccgcagggcagctgatggacagcaagtcctaacagaggagaaggactatgtgtccatcaaacctggcggcagcgcaaaagatg

SEQ ID NO: 113814 - DNA, 103 bp, Artificial Sequence
  Synthetic Polynucleotide
taatacgactcactataggggccggcagttccgcagggcagctgatggacaacagaggagagtccatatgctgccctgcaacctggcggcagcgcaaaagatg

SEQ ID NO: 113815 - DNA, 103 bp, Artificial Sequence
  Synthetic Polynucleotide
taatacgactcactatagggggctgggacggccggcagttccgcagggcaaacagaggagatgccctatggaactgccgaacctggcggcagcgcaaaagatg

SEQ ID NO: 113816 - DNA, 103 bp, Artificial Sequence
  Synthetic Polynucleotide
taatacgactcactatagggagagtctgttggctgggacggccggcagttaacagaggagaaactgcatgccgtcccagaacctggcggcagcgcaaaagatg

SEQ ID NO: 113817 - DNA, 103 bp, Artificial Sequence
  Synthetic Polynucleotide
taatacgactcactatagggccgctgggatagagtctgttggctgggacgaacagaggagacgtcccatgcaacagactaacctggcggcagcgcaaaagatg

SEQ ID NO: 113818 - DNA, 103 bp, Artificial Sequence
  Synthetic Polynucleotide
taatacgactcactataggggtcataggccccgctgggatagagtctgttaacagaggagaaacagaatgtatcccagcaacctggcggcagcgcaaaagatg

SEQ ID NO: 113819 - DNA, 103 bp, Artificial Sequence
  Synthetic Polynucleotide
taatacgactcactatagggcgcaccggcctcgggcggcggctcctcgccaacagaggagaggcgagatgccgccgcccaacctggcggcagcgcaaaagatg

SEQ ID NO: 113820 - DNA, 103 bp, Artificial Sequence
  Synthetic Polynucleotide
taatacgactcactataggggcgggaaagcgtcataggccccgctgggataacagaggagaatcccaatggggcctatgaacctggcggcagcgcaaaagatg

SEQ ID NO: 113821 - DNA, 103 bp, Artificial Sequence
  Synthetic Polynucleotide
taatacgactcactatagggcccggggccagcgggaaagcgtcataggccaacagaggagaggcctaatgcgctttcccaacctggcggcagcgcaaaagatg

SEQ ID NO: 113822 - DNA, 103 bp, Artificial Sequence
  Synthetic Polynucleotide
taatacgactcactatagggccctaagtcacccggggccagcgggaaagcaacagaggagagctttcatgctggccccgaacctggcggcagcgcaaaagatg

SEQ ID NO: 113823 - DNA, 103 bp, Artificial Sequence
  Synthetic Polynucleotide
taatacgactcactatagggcagccccctcccctaagtcacccggggccaaacagaggagatggcccatggtgacttagaacctggcggcagcgcaaaagatg

SEQ ID NO: 113824 - DNA, 103 bp, Artificial Sequence
  Synthetic Polynucleotide
taatacgactcactataggggggaggccctcagccccctcccctaagtcaaacagaggagatgacttatgggagggggcaacctggcggcagcgcaaaagatg

SEQ ID NO: 113825 - DNA, 103 bp, Artificial Sequence
  Synthetic Polynucleotide
taatacgactcactatagggcaggagcccagggaggccctcagccccctcaacagaggagagaggggatggagggcctcaacctggcggcagcgcaaaagatg

SEQ ID NO: 113826 - DNA, 103 bp, Artificial Sequence
  Synthetic Polynucleotide
taatacgactcactatagggtaggaggggtcaggagcccagggaggccctaacagaggagaagggccatgctgggctccaacctggcggcagcgcaaaagatg

SEQ ID NO: 113827 - DNA, 103 bp, Artificial Sequence
  Synthetic Polynucleotide
taatacgactcactatagggccctccccactaggaggggtcaggagcccaaacagaggagatgggctatggacccctccaacctggcggcagcgcaaaagatg

SEQ ID NO: 113828 - DNA, 103 bp, Artificial Sequence
  Synthetic Polynucleotide
taatacgactcactataggggctactccctccctccccactaggaggggtaacagaggagaacccctatgagtggggagaacctggcggcagcgcaaaagatg

SEQ ID NO: 113829 - DNA, 103 bp, Artificial Sequence
  Synthetic Polynucleotide
taatacgactcactatagggcgccgtcgccgctactccctccctccccacaacagaggagagtggggatggagggagtaaacctggcggcagcgcaaaagatg

SEQ ID NO: 113830 - DNA, 103 bp, Artificial Sequence
  Synthetic Polynucleotide
taatacgactcactatagggctcgctcgcccgcaccggcctcgggcggcgaacagaggagacgccgcatgaggccggtgaacctggcggcagcgcaaaagatg

SEQ ID NO: 113831 - DNA, 103 bp, Artificial Sequence
  Synthetic Polynucleotide
taatacgactcactatagggagaaactctccgccgtcgccgctactccctaacagaggagaagggagatgcggcgacggaacctggcggcagcgcaaaagatg

SEQ ID NO: 113832 - DNA, 103 bp, Artificial Sequence
  Synthetic Polynucleotide
taatacgactcactatagggcgtactggccagaaactctccgccgtcgccaacagaggagaggcgacatgggagagtttaacctggcggcagcgcaaaagatg

SEQ ID NO: 113833 - DNA, 103 bp, Artificial Sequence
  Synthetic Polynucleotide
taatacgactcactataggggctgaggctgcgtactggccagaaactctcaacagaggagagagagtatgtggccagtaaacctggcggcagcgcaaaagatg

SEQ ID NO: 113834 - DNA, 103 bp, Artificial Sequence
  Synthetic Polynucleotide
taatacgactcactatagggagcggggaaagctgaggctgcgtactggccaacagaggagaggccagatggcagcctcaaacctggcggcagcgcaaaagatg

SEQ ID NO: 113835 - DNA, 103 bp, Artificial Sequence
  Synthetic Polynucleotide
taatacgactcactataggggcgaaggcccagcggggaaagctgaggctgaacagaggagacagcctatgctttccccgaacctggcggcagcgcaaaagatg

SEQ ID NO: 113836 - DNA, 103 bp, Artificial Sequence
  Synthetic Polynucleotide
taatacgactcactatagggcggcggcgctgcgaaggcccagcggggaaaaacagaggagatttcccatgtgggccttcaacctggcggcagcgcaaaagatg

SEQ ID NO: 113837 - DNA, 103 bp, Artificial Sequence
  Synthetic Polynucleotide
taatacgactcactatagggaagtccgccgcggcggcgctgcgaaggcccaacagaggagagggcctatgcagcgccgcaacctggcggcagcgcaaaagatg

SEQ ID NO: 113838 - DNA, 103 bp, Artificial Sequence
  Synthetic Polynucleotide
taatacgactcactatagggaggtttagggaagtccgccgcggcggcgctaacagaggagaagcgccatggcggcggacaacctggcggcagcgcaaaagatg

SEQ ID NO: 113839 - DNA, 103 bp, Artificial Sequence
  Synthetic Polynucleotide
taatacgactcactatagggccgccaccagaggtttagggaagtccgccgaacagaggagacggcggatgtccctaaacaacctggcggcagcgcaaaagatg

SEQ ID NO: 113840 - DNA, 103 bp, Artificial Sequence
  Synthetic Polynucleotide
taatacgactcactatagggccagggatgtccgccaccagaggtttagggaacagaggagaccctaaatgtctggtggcaacctggcggcagcgcaaaagatg

SEQ ID NO: 113841 - DNA, 103 bp, Artificial Sequence
  Synthetic Polynucleotide
taatacgactcactatagggccgcggcgccctcgctcgcccgcaccggccaacagaggagaggccggatggggcgagcgaacctggcggcagcgcaaaagatg

SEQ ID NO: 113842 - DNA, 103 bp, Artificial Sequence
  Synthetic Polynucleotide
taatacgactcactataggggccactgcttccagggatgtccgccaccagaacagaggagactggtgatggacatccctaacctggcggcagcgcaaaagatg

SEQ ID NO: 113843 - DNA, 103 bp, Artificial Sequence
  Synthetic Polynucleotide
taatacgactcactataggggtgcagccacgccactgcttccagggatgtaacagaggagaacatccatggaagcagtgaacctggcggcagcgcaaaagatg

SEQ ID NO: 113844 - DNA, 103 bp, Artificial Sequence
  Synthetic Polynucleotide
taatacgactcactatagggggcacgggtggtgcagccacgccactgcttaacagaggagaaagcagatgcgtggctgcaacctggcggcagcgcaaaagatg

SEQ ID NO: 113845 - DNA, 103 bp, Artificial Sequence
  Synthetic Polynucleotide
taatacgactcactatagggcggcggcggcggcacgggtggtgcagccacaacagaggagagtggctatgccacccgtgaacctggcggcagcgcaaaagatg

SEQ ID NO: 113846 - DNA, 103 bp, Artificial Sequence
  Synthetic Polynucleotide
taatacgactcactatagggaaggggtgggcggcggcggcggcacgggtgaacagaggagacacccgatgcgccgccgcaacctggcggcagcgcaaaagatg

SEQ ID NO: 113847 - DNA, 103 bp, Artificial Sequence
  Synthetic Polynucleotide
taatacgactcactataggggcctgggggaaaggggtgggcggcggcggcaacagaggagagccgccatggcccaccccaacctggcggcagcgcaaaagatg

SEQ ID NO: 113848 - DNA, 103 bp, Artificial Sequence
  Synthetic Polynucleotide
taatacgactcactatagggtcgcgccttggcctgggggaaaggggtgggaacagaggagacccaccatgttcccccagaacctggcggcagcgcaaaagatg

SEQ ID NO: 113849 - DNA, 103 bp, Artificial Sequence
  Synthetic Polynucleotide
taatacgactcactataggggccccttgcgtcgcgccttggcctgggggaaacagaggagatcccccatgccaaggcgcaacctggcggcagcgcaaaagatg

SEQ ID NO: 113850 - DNA, 103 bp, Artificial Sequence
  Synthetic Polynucleotide
taatacgactcactatagggccgccgcggcgccccttgcgtcgcgccttgaacagaggagacaaggcatgacgcaagggaacctggcggcagcgcaaaagatg

SEQ ID NO: 113851 - DNA, 103 bp, Artificial Sequence
  Synthetic Polynucleotide
taatacgactcactataggggctgcatttgccgccgcggcgccccttgcgaacagaggagacgcaagatgcgccgcggcaacctggcggcagcgcaaaagatg

SEQ ID NO: 113852 - DNA, 103 bp, Artificial Sequence
  Synthetic Polynucleotide
taatacgactcactatagggagtcggggagccgcggcgccctcgctcgccaacagaggagaggcgagatggggcgccgcaacctggcggcagcgcaaaagatg

SEQ ID NO: 113853 - DNA, 103 bp, Artificial Sequence
  Synthetic Polynucleotide
taatacgactcactatagggagcagcgcgtgctgcatttgccgccgcggcaacagaggagagccgcgatggcaaatgcaaacctggcggcagcgcaaaagatg

SEQ ID NO: 113854 - DNA, 103 bp, Artificial Sequence
  Synthetic Polynucleotide
taatacgactcactatagggcgcgggcagaagcagcgcgtgctgcatttgaacagaggagacaaatgatgcacgcgctgaacctggcggcagcgcaaaagatg

SEQ ID NO: 113855 - DNA, 103 bp, Artificial Sequence
  Synthetic Polynucleotide
taatacgactcactatagggggcgtgcggccgcgggcagaagcagcgcgtaacagaggagaacgcgcatgttctgcccgaacctggcggcagcgcaaaagatg

SEQ ID NO: 113856 - DNA, 103 bp, Artificial Sequence
  Synthetic Polynucleotide
taatacgactcactatagggcgaaggccttggcgtgcggccgcgggcagaaacagaggagatctgccatgggccgcacgaacctggcggcagcgcaaaagatg

SEQ ID NO: 113857 - DNA, 103 bp, Artificial Sequence
  Synthetic Polynucleotide
taatacgactcactatagggaccgggcaagcgaaggccttggcgtgcggcaacagaggagagccgcaatgcaaggccttaacctggcggcagcgcaaaagatg

SEQ ID NO: 113858 - DNA, 103 bp, Artificial Sequence
  Synthetic Polynucleotide
taatacgactcactatagggacaactctccaccgggcaagcgaaggccttaacagaggagaaaggccatggcttgcccgaacctggcggcagcgcaaaagatg

SEQ ID NO: 113859 - DNA, 103 bp, Artificial Sequence
  Synthetic Polynucleotide
taatacgactcactatagggagctccgcacacaactctccaccgggcaagaacagaggagacttgccatgtggagagttaacctggcggcagcgcaaaagatg

SEQ ID NO: 113860 - DNA, 103 bp, Artificial Sequence
  Synthetic Polynucleotide
taatacgactcactataggggagcgcgcaaagctccgcacacaactctccaacagaggagaggagagatgtgtgcggagaacctggcggcagcgcaaaagatg

SEQ ID NO: 113861 - DNA, 103 bp, Artificial Sequence
  Synthetic Polynucleotide
taatacgactcactataggggagctcgtcggagcgcgcaaagctccgcacaacagaggagagtgcggatgtttgcgcgcaacctggcggcagcgcaaaagatg

SEQ ID NO: 113862 - DNA, 103 bp, Artificial Sequence
  Synthetic Polynucleotide
taatacgactcactatagggggtggcgattgagctcgtcggagcgcgcaaaacagaggagattgcgcatgccgacgagcaacctggcggcagcgcaaaagatg

SEQ ID NO: 113863 - DNA, 103 bp, Artificial Sequence
  Synthetic Polynucleotide
taatacgactcactatagggctgggaaaggagtcggggagccgcggcgccaacagaggagaggcgccatggctccccgaaacctggcggcagcgcaaaagatg

SEQ ID NO: 113864 - DNA, 103 bp, Artificial Sequence
  Synthetic Polynucleotide
taatacgactcactatagggtggatgcgcaggtggcgattgagctcgtcgaacagaggagacgacgaatgcaatcgccaaacctggcggcagcgcaaaagatg

SEQ ID NO: 113865 - DNA, 103 bp, Artificial Sequence
  Synthetic Polynucleotide
taatacgactcactataggggtggcccgtgtggatgcgcaggtggcgattaacagaggagaaatcgcatgctgcgcatcaacctggcggcagcgcaaaagatg

SEQ ID NO: 113866 - DNA, 103 bp, Artificial Sequence
  Synthetic Polynucleotide
taatacgactcactatagggggaagggtttgtggcccgtgtggatgcgcaaacagaggagatgcgcaatgacacgggccaacctggcggcagcgcaaaagatg

SEQ ID NO: 113867 - DNA, 103 bp, Artificial Sequence
  Synthetic Polynucleotide
taatacgactcactatagggatgcggcactggaagggtttgtggcccgtgaacagaggagacacgggatgcaaacccttaacctggcggcagcgcaaaagatg

SEQ ID NO: 113868 - DNA, 103 bp, Artificial Sequence
  Synthetic Polynucleotide
taatacgactcactataggggcggaggcagatgcggcactggaagggtttaacagaggagaaaacccatgcagtgccgcaacctggcggcagcgcaaaagatg

SEQ ID NO: 113869 - DNA, 103 bp, Artificial Sequence
  Synthetic Polynucleotide
taatacgactcactatagggggctgaagttgcggaggcagatgcggcactaacagaggagaagtgccatgtctgcctccaacctggcggcagcgcaaaagatg

SEQ ID NO: 113870 - DNA, 103 bp, Artificial Sequence
  Synthetic Polynucleotide
taatacgactcactatagggtggtcgctgcggctgaagttgcggaggcagaacagaggagactgcctatgcaacttcagaacctggcggcagcgcaaaagatg

SEQ ID NO: 113871 - DNA, 103 bp, Artificial Sequence
  Synthetic Polynucleotide
taatacgactcactatagggcgtggtgaggtggtcgctgcggctgaagttaacagaggagaaacttcatgcgcagcgacaacctggcggcagcgcaaaagatg

SEQ ID NO: 113872 - DNA, 103 bp, Artificial Sequence
  Synthetic Polynucleotide
taatacgactcactatagggtgcgcacgtgcgtggtgaggtggtcgctgcaacagaggagagcagcgatgacctcaccaaacctggcggcagcgcaaaagatg

SEQ ID NO: 113873 - DNA, 103 bp, Artificial Sequence
  Synthetic Polynucleotide
taatacgactcactatagggccggtgtgggtgcgcacgtgcgtggtgaggaacagaggagacctcacatggcacgtgcgaacctggcggcagcgcaaaagatg

SEQ ID NO: 113874 - DNA, 103 bp, Artificial Sequence
  Synthetic Polynucleotide
taatacgactcactataggggcactcacctctgggaaaggagtcggggagaacagaggagactccccatgtcctttcccaacctggcggcagcgcaaaagatg

SEQ ID NO: 113875 - DNA, 103 bp, Artificial Sequence
  Synthetic Polynucleotide
taatacgactcactatagggaggcttctcgccggtgtgggtgcgcacgtgaacagaggagacacgtgatgacccacaccaacctggcggcagcgcaaaagatg

SEQ ID NO: 113876 - DNA, 103 bp, Artificial Sequence
  Synthetic Polynucleotide
taatacgactcactatagggcgcaagcaaaaggcttctcgccggtgtgggaacagaggagacccacaatggcgagaagcaacctggcggcagcgcaaaagatg

SEQ ID NO: 113877 - DNA, 103 bp, Artificial Sequence
  Synthetic Polynucleotide
taatacgactcactatagggccgcacacgtcgcaagcaaaaggcttctcgaacagaggagacgagaaatgttttgcttgaacctggcggcagcgcaaaagatg

SEQ ID NO: 113878 - DNA, 103 bp, Artificial Sequence
  Synthetic Polynucleotide
taatacgactcactataggggaagcggcggccgcacacgtcgcaagcaaaaacagaggagatttgctatggacgtgtgcaacctggcggcagcgcaaaagatg

SEQ ID NO: 113879 - DNA, 103 bp, Artificial Sequence
  Synthetic Polynucleotide
taatacgactcactatagggcgctgcgcgcgaagcggcggccgcacacgtaacagaggagaacgtgtatggccgccgctaacctggcggcagcgcaaaagatg

SEQ ID NO: 113880 - DNA, 103 bp, Artificial Sequence
  Synthetic Polynucleotide
taatacgactcactatagggttcttctcatcgctgcgcgcgaagcggcggaacagaggagaccgccgatgcgcgcgcagaacctggcggcagcgcaaaagatg

SEQ ID NO: 113881 - DNA, 103 bp, Artificial Sequence
  Synthetic Polynucleotide
taatacgactcactataggggctgtgccgtttcttctcatcgctgcgcgcaacagaggagagcgcgcatggatgagaagaacctggcggcagcgcaaaagatg

SEQ ID NO: 113882 - DNA, 103 bp, Artificial Sequence
  Synthetic Polynucleotide
taatacgactcactatagggggtgcaccttgctgtgccgtttcttctcataacagaggagaatgagaatgaacggcacaaacctggcggcagcgcaaaagatg

SEQ ID NO: 113883 - DNA, 103 bp, Artificial Sequence
  Synthetic Polynucleotide
taatacgactcactatagggttctgcttgaggtgcaccttgctgtgccgtaacagaggagaacggcaatgcaaggtgcaaacctggcggcagcgcaaaagatg

SEQ ID NO: 113884 - DNA, 103 bp, Artificial Sequence
  Synthetic Polynucleotide
taatacgactcactatagggggcgcgcgccttctgcttgaggtgcaccttaacagaggagaaaggtgatgctcaagcagaacctggcggcagcgcaaaagatg

SEQ ID NO: 113885 - DNA, 103 bp, Artificial Sequence
  Synthetic Polynucleotide
taatacgactcactatagggctggcttcgggcactcacctctgggaaaggaacagaggagacctttcatggaggtgagtaacctggcggcagcgcaaaagatg

SEQ ID NO: 113886 - DNA, 103 bp, Artificial Sequence
  Synthetic Polynucleotide
taatacgactcactataggggccgctcctcggcgcgcgccttctgcttgaaacagaggagatcaagcatgaggcgcgcgaacctggcggcagcgcaaaagatg

SEQ ID NO: 113887 - DNA, 103 bp, Artificial Sequence
  Synthetic Polynucleotide
taatacgactcactatagggaggcccttgagccgctcctcggcgcgcgccaacagaggagaggcgcgatgcgaggagcgaacctggcggcagcgcaaaagatg

SEQ ID NO: 113888 - DNA, 103 bp, Artificial Sequence
  Synthetic Polynucleotide
taatacgactcactataggggtaaaagccgaggcccttgagccgctcctcaacagaggagagaggagatgctcaagggcaacctggcggcagcgcaaaagatg

SEQ ID NO: 113889 - DNA, 103 bp, Artificial Sequence
  Synthetic Polynucleotide
taatacgactcactatagggggcccagcgagtaaaagccgaggcccttgaaacagaggagatcaaggatgtcggcttttaacctggcggcagcgcaaaagatg

SEQ ID NO: 113890 - DNA, 103 bp, Artificial Sequence
  Synthetic Polynucleotide
taatacgactcactataggggcgaaggagaggcccagcgagtaaaagccgaacagaggagacggcttatgctcgctgggaacctggcggcagcgcaaaagatg

SEQ ID NO: 113891 - DNA, 103 bp, Artificial Sequence
  Synthetic Polynucleotide
taatacgactcactatagggtcagagagaagcgaaggagaggcccagcgaaacagaggagatcgctgatgctctccttcaacctggcggcagcgcaaaagatg

SEQ ID NO: 113892 - DNA, 103 bp, Artificial Sequence
  Synthetic Polynucleotide
taatacgactcactataggggcccgggctcctggcttcgggcactcacctaacagaggagaaggtgaatgcccgaagccaacctggcggcagcgcaaaagatg

SEQ ID NO: 113893 - DNA, 103 bp, Artificial Sequence
  Synthetic Polynucleotide
taatacgactcactatagggagacctaggcgcccgggctcctggcttcggaacagaggagaccgaagatgggagcccggaacctggcggcagcgcaaaagatg

SEQ ID NO: 113894 - DNA, 103 bp, Artificial Sequence
  Synthetic Polynucleotide
taatacgactcactataggggcgctggctccgggcttccgactccccgggaacagaggagacccgggatgtcggaagccaacctggcggcagcgcaaaagatg

SEQ ID NO: 113895 - DNA, 103 bp, Artificial Sequence
  Synthetic Polynucleotide
taatacgactcactatagggcgcagcgcacagacctaggcgcccgggctcaacagaggagagagcccatgcgcctaggtaacctggcggcagcgcaaaagatg

SEQ ID NO: 113896 - DNA, 103 bp, Artificial Sequence
  Synthetic Polynucleotide
taatacgactcactatagggaggggttccccgcagcgcacagacctaggcaacagaggagagcctagatgtgtgcgctgaacctggcggcagcgcaaaagatg

SEQ ID NO: 113897 - DNA, 103 bp, Artificial Sequence
  Synthetic Polynucleotide
taatacgactcactatagggggctggcggtaggggttccccgcagcgcacaacagaggagagtgcgcatgggggaacccaacctggcggcagcgcaaaagatg

SEQ ID NO: 113898 - DNA, 103 bp, Artificial Sequence
  Synthetic Polynucleotide
taatacgactcactataggggtggcggggaggctggcggtaggggttcccaacagaggagagggaacatgtaccgccagaacctggcggcagcgcaaaagatg

SEQ ID NO: 113899 - DNA, 103 bp, Artificial Sequence
  Synthetic Polynucleotide
taatacgactcactataggggggcgcgcgggtggcggggaggctggcggtaacagaggagaaccgccatgctccccgccaacctggcggcagcgcaaaagatg

SEQ ID NO: 113900 - DNA, 103 bp, Artificial Sequence
  Synthetic Polynucleotide
taatacgactcactatagggctgggcttgggggcgcgcgggtggcggggaaacagaggagatccccgatgcccgcgcgcaacctggcggcagcgcaaaagatg

SEQ ID NO: 113901 - DNA, 103 bp, Artificial Sequence
  Synthetic Polynucleotide
taatacgactcactataggggcctcgcccgctgggcttgggggcgcgcggaacagaggagaccgcgcatgcccaagcccaacctggcggcagcgcaaaagatg

SEQ ID NO: 113902 - DNA, 103 bp, Artificial Sequence
  Synthetic Polynucleotide
taatacgactcactatagggggcgcccggggcctcgcccgctgggcttggaacagaggagaccaagcatggcgggcgagaacctggcggcagcgcaaaagatg

SEQ ID NO: 113903 - DNA, 103 bp, Artificial Sequence
  Synthetic Polynucleotide
taatacgactcactatagggccggctgtggggcgcccggggcctcgcccgaacagaggagacgggcgatgccccgggcgaacctggcggcagcgcaaaagatg

SEQ ID NO: 113904 - DNA, 103 bp, Artificial Sequence
  Synthetic Polynucleotide
taatacgactcactatagggtggcgcggcgccggctgtggggcgcccgggaacagaggagacccgggatgcccacagccaacctggcggcagcgcaaaagatg

SEQ ID NO: 113905 - DNA, 103 bp, Artificial Sequence
  Synthetic Polynucleotide
taatacgactcactatagggagctgcggcggcgctggctccgggcttccgaacagaggagacggaagatgggagccagcaacctggcggcagcgcaaaagatg

SEQ ID NO: 113906 - DNA, 103 bp, Artificial Sequence
  Synthetic Polynucleotide
taatacgactcactatagggaggtggagcatggcgcggcgccggctgtggaacagaggagaccacagatggcgccgcgcaacctggcggcagcgcaaaagatg

SEQ ID NO: 113907 - DNA, 103 bp, Artificial Sequence
  Synthetic Polynucleotide
taatacgactcactatagggaaactcgctaaggtggagcatggcgcggcgaacagaggagacgccgcatgatgctccacaacctggcggcagcgcaaaagatg

SEQ ID NO: 113908 - DNA, 103 bp, Artificial Sequence
  Synthetic Polynucleotide
taatacgactcactatagggcgggttcggaaaactcgctaaggtggagcaaacagaggagatgctccatgttagcgagtaacctggcggcagcgcaaaagatg

SEQ ID NO: 113909 - DNA, 103 bp, Artificial Sequence
  Synthetic Polynucleotide
taatacgactcactatagggaggagcgcgtcgggttcggaaaactcgctaaacagaggagatagcgaatgttccgaaccaacctggcggcagcgcaaaagatg

SEQ ID NO: 113910 - DNA, 103 bp, Artificial Sequence
  Synthetic Polynucleotide
taatacgactcactatagggggacttgacgaggagcgcgtcgggttcggaaacagaggagatccgaaatggacgcgctcaacctggcggcagcgcaaaagatg

SEQ ID NO: 113911 - DNA, 103 bp, Artificial Sequence
  Synthetic Polynucleotide
taatacgactcactatagggagccttcagtggacttgacgaggagcgcgtaacagaggagaacgcgcatgtcgtcaagtaacctggcggcagcgcaaaagatg

SEQ ID NO: 113912 - DNA, 103 bp, Artificial Sequence
  Synthetic Polynucleotide
taatacgactcactatagggtcggcgcaacagccttcagtggacttgacgaacagaggagacgtcaaatgcactgaaggaacctggcggcagcgcaaaagatg

SEQ ID NO: 113913 - DNA, 103 bp, Artificial Sequence
  Synthetic Polynucleotide
taatacgactcactatagggagcgctgggttcggcgcaacagccttcagtaacagaggagaactgaaatgtgttgcgccaacctggcggcagcgcaaaagatg

SEQ ID NO: 113914 - DNA, 103 bp, Artificial Sequence
  Synthetic Polynucleotide
taatacgactcactatagggggggcaattcagcgctgggttcggcgcaacaacagaggagagttgcgatgaacccagcgaacctggcggcagcgcaaaagatg

SEQ ID NO: 113915 - DNA, 103 bp, Artificial Sequence
  Synthetic Polynucleotide
taatacgactcactataggggcaggcagccggggcaattcagcgctgggtaacagaggagaacccagatgtgaattgccaacctggcggcagcgcaaaagatg

SEQ ID NO: 113916 - DNA, 103 bp, Artificial Sequence
  Synthetic Polynucleotide
taatacgactcactatagggccacttatatagctgcggcggcgctggctcaacagaggagagagccaatgccgccgcagaacctggcggcagcgcaaaagatg

SEQ ID NO: 113917 - DNA, 103 bp, Artificial Sequence
  Synthetic Polynucleotide
taatacgactcactatagggagcgtccctggcaggcagccggggcaattcaacagaggagagaattgatgcggctgcctaacctggcggcagcgcaaaagatg

SEQ ID NO: 113918 - DNA, 103 bp, Artificial Sequence
  Synthetic Polynucleotide
taatacgactcactatagggtggccgcgggagcgtccctggcaggcagccaacagaggagaggctgcatgccagggacgaacctggcggcagcgcaaaagatg

SEQ ID NO: 113919 - DNA, 103 bp, Artificial Sequence
  Synthetic Polynucleotide
taatacgactcactataggggggtagccggtggccgcgggagcgtccctgaacagaggagacagggaatgtcccgcggcaacctggcggcagcgcaaaagatg

SEQ ID NO: 113920 - DNA, 103 bp, Artificial Sequence
  Synthetic Polynucleotide
taatacgactcactataggggcctgctccagggtagccggtggccgcgggaacagaggagacccgcgatgaccggctacaacctggcggcagcgcaaaagatg

SEQ ID NO: 113921 - DNA, 103 bp, Artificial Sequence
  Synthetic Polynucleotide
taatacgactcactatagggtcaagaagtcgcctgctccagggtagccggaacagaggagaccggctatgctggagcagaacctggcggcagcgcaaaagatg

SEQ ID NO: 113922 - DNA, 103 bp, Artificial Sequence
  Synthetic Polynucleotide
taatacgactcactatagggaaagcccagctcaagaagtcgcctgctccaaacagaggagatggagcatgcgacttcttaacctggcggcagcgcaaaagatg

SEQ ID NO: 113923 - DNA, 103 bp, Artificial Sequence
  Synthetic Polynucleotide
taatacgactcactataggggcagctgttcaaagcccagctcaagaagtcaacagaggagagacttcatgagctgggctaacctggcggcagcgcaaaagatg

SEQ ID NO: 113924 - DNA, 103 bp, Artificial Sequence
  Synthetic Polynucleotide
taatacgactcactatagggcacttgcgccgcagctgttcaaagcccagcaacagaggagagctgggatgtgaacagctaacctggcggcagcgcaaaagatg

SEQ ID NO: 113925 - DNA, 103 bp, Artificial Sequence
  Synthetic Polynucleotide
taatacgactcactataggggctaagtccccacttgcgccgcagctgttcaacagaggagagaacagatgcggcgcaagaacctggcggcagcgcaaaagatg

SEQ ID NO: 113926 - DNA, 103 bp, Artificial Sequence
  Synthetic Polynucleotide
taatacgactcactataggggcaggagtcggctaagtccccacttgcgccaacagaggagaggcgcaatgggggacttaaacctggcggcagcgcaaaagatg

SEQ ID NO: 113927 - DNA, 103 bp, Artificial Sequence
  Synthetic Polynucleotide
taatacgactcactatagggcacagcccccccacttatatagctgcggcgaacagaggagacgccgcatgtatataagtaacctggcggcagcgcaaaagatg

SEQ ID NO: 113928 - DNA, 103 bp, Artificial Sequence
  Synthetic Polynucleotide
taatacgactcactatagggcctccaggaagcaggagtcggctaagtcccaacagaggagagggactatgccgactcctaacctggcggcagcgcaaaagatg

SEQ ID NO: 113929 - DNA, 103 bp, Artificial Sequence
  Synthetic Polynucleotide
taatacgactcactatagggggcgcaggcccctccaggaagcaggagtcgaacagaggagacgactcatgcttcctggaaacctggcggcagcgcaaaagatg

SEQ ID NO: 113930 - DNA, 103 bp, Artificial Sequence
  Synthetic Polynucleotide
taatacgactcactatagggagggggtgtgggcgcaggcccctccaggaaaacagaggagattcctgatggggcctgcgaacctggcggcagcgcaaaagatg

SEQ ID NO: 113931 - DNA, 103 bp, Artificial Sequence
  Synthetic Polynucleotide
taatacgactcactatagggtgaggccgggagggggtgtgggcgcaggccaacagaggagaggcctgatgccacaccccaacctggcggcagcgcaaaagatg

SEQ ID NO: 113932 - DNA, 103 bp, Artificial Sequence
  Synthetic Polynucleotide
taatacgactcactatagggccgctgtagctgaggccgggagggggtgtgaacagaggagacacaccatgtcccggcctaacctggcggcagcgcaaaagatg

SEQ ID NO: 113933 - DNA, 103 bp, Artificial Sequence
  Synthetic Polynucleotide
taatacgactcactataggggaagaagctaccgctgtagctgaggccgggaacagaggagacccggcatgagctacagcaacctggcggcagcgcaaaagatg

SEQ ID NO: 113934 - DNA, 103 bp, Artificial Sequence
  Synthetic Polynucleotide
taatacgactcactatagggctgcctgaatgaagaagctaccgctgtagcaacagaggagagctacaatggtagcttctaacctggcggcagcgcaaaagatg

SEQ ID NO: 113935 - DNA, 103 bp, Artificial Sequence
  Synthetic Polynucleotide
taatacgactcactatagggtgttcgggcactgcctgaatgaagaagctaaacagaggagatagcttatgcattcaggcaacctggcggcagcgcaaaagatg

SEQ ID NO: 113936 - DNA, 103 bp, Artificial Sequence
  Synthetic Polynucleotide
taatacgactcactataggggtcgtgcgggtgttcgggcactgcctgaataacagaggagaattcagatggtgcccgaaaacctggcggcagcgcaaaagatg

SEQ ID NO: 113937 - DNA, 103 bp, Artificial Sequence
  Synthetic Polynucleotide
taatacgactcactataggggtgcctccgggtcgtgcgggtgttcgggcaaacagaggagatgcccgatgacccgcacgaacctggcggcagcgcaaaagatg

SEQ ID NO: 113938 - DNA, 103 bp, Artificial Sequence
  Synthetic Polynucleotide
taatacgactcactatagggtcccccagcccacagcccccccacttatataacagaggagaatataaatgggggggctgaacctggcggcagcgcaaaagatg

SEQ ID NO: 113939 - DNA, 103 bp, Artificial Sequence
  Synthetic Polynucleotide
taatacgactcactatagggaggttgaagagtgcctccgggtcgtgcgggaacagaggagacccgcaatgcccggaggcaacctggcggcagcgcaaaagatg

SEQ ID NO: 113940 - DNA, 103 bp, Artificial Sequence
  Synthetic Polynucleotide
taatacgactcactataggggcccgacatgaggttgaagagtgcctccggaacagaggagaccggagatgctcttcaacaacctggcggcagcgcaaaagatg

SEQ ID NO: 113941 - DNA, 103 bp, Artificial Sequence
  Synthetic Polynucleotide
taatacgactcactatagggggcctaagatgcccgacatgaggttgaagaaacagaggagatcttcaatgtcatgtcggaacctggcggcagcgcaaaagatg

SEQ ID NO: 113942 - DNA, 103 bp, Artificial Sequence
  Synthetic Polynucleotide
taatacgactcactatagggaagggtgccaggcctaagatgcccgacatgaacagaggagacatgtcatgcatcttaggaacctggcggcagcgcaaaagatg

SEQ ID NO: 113943 - DNA, 103 bp, Artificial Sequence
  Synthetic Polynucleotide
taatacgactcactatagggtggaccggggaagggtgccaggcctaagataacagaggagaatcttaatgctggcacccaacctggcggcagcgcaaaagatg

SEQ ID NO: 113944 - DNA, 103 bp, Artificial Sequence
  Synthetic Polynucleotide
taatacgactcactatagggctgctgcctctggaccggggaagggtgccaaacagaggagatggcacatgtccccggtcaacctggcggcagcgcaaaagatg

SEQ ID NO: 113945 - DNA, 103 bp, Artificial Sequence
  Synthetic Polynucleotide
taatacgactcactataggggatctggacgctgctgcctctggaccggggaacagaggagaccccggatgagaggcagcaacctggcggcagcgcaaaagatg

SEQ ID NO: 113946 - DNA, 103 bp, Artificial Sequence
  Synthetic Polynucleotide
taatacgactcactatagggatccagcggggatctggacgctgctgcctcaacagaggagagaggcaatggcgtccagaaacctggcggcagcgcaaaagatg

SEQ ID NO: 113947 - DNA, 103 bp, Artificial Sequence
  Synthetic Polynucleotide
taatacgactcactataggggaaaaggggcatccagcggggatctggacgaacagaggagacgtccaatgccccgctggaacctggcggcagcgcaaaagatg

SEQ ID NO: 113948 - DNA, 103 bp, Artificial Sequence
  Synthetic Polynucleotide
taatacgactcactataggggaccccgcaggaaaaggggcatccagcgggaacagaggagacccgctatgtgcccctttaacctggcggcagcgcaaaagatg

SEQ ID NO: 113949 - DNA, 103 bp, Artificial Sequence
  Synthetic Polynucleotide
taatacgactcactataggggctgccgggctcccccagcccacagcccccaacagaggagagggggcatggggctggggaacctggcggcagcgcaaaagatg

SEQ ID NO: 113950 - DNA, 103 bp, Artificial Sequence
  Synthetic Polynucleotide
taatacgactcactatagggcaaggcatcggaccccgcaggaaaaggggcaacagaggagagcccctatgcctgcggggaacctggcggcagcgcaaaagatg

SEQ ID NO: 113951 - DNA, 103 bp, Artificial Sequence
  Synthetic Polynucleotide
taatacgactcactataggggacccggcagcaaggcatcggaccccgcagaacagaggagactgcggatgccgatgcctaacctggcggcagcgcaaaagatg

SEQ ID NO: 113952 - DNA, 103 bp, Artificial Sequence
  Synthetic Polynucleotide
taatacgactcactatagggaggtccggcggacccggcagcaaggcatcgaacagaggagacgatgcatggctgccgggaacctggcggcagcgcaaaagatg

SEQ ID NO: 113953 - DNA, 103 bp, Artificial Sequence
  Synthetic Polynucleotide
taatacgactcactatagggcggggagtaaaggtccggcggacccggcagaacagaggagactgccgatgccgccggacaacctggcggcagcgcaaaagatg

SEQ ID NO: 113954 - DNA, 103 bp, Artificial Sequence
  Synthetic Polynucleotide
taatacgactcactatagggcgcccagatccggggagtaaaggtccggcgaacagaggagacgccggatgtttactcccaacctggcggcagcgcaaaagatg

SEQ ID NO: 113955 - DNA, 103 bp, Artificial Sequence
  Synthetic Polynucleotide
taatacgactcactatagggaaaggggcagcgcccagatccggggagtaaaacagaggagattactcatgggatctgggaacctggcggcagcgcaaaagatg

SEQ ID NO: 113956 - DNA, 103 bp, Artificial Sequence
  Synthetic Polynucleotide
taatacgactcactatagggcgcctctgggaaaggggcagcgcccagatcaacagaggagagatctgatggctgcccctaacctggcggcagcgcaaaagatg

SEQ ID NO: 113957 - DNA, 103 bp, Artificial Sequence
  Synthetic Polynucleotide
taatacgactcactatagggcctcccagaacgcctctgggaaaggggcagaacagaggagactgcccatgtcccagaggaacctggcggcagcgcaaaagatg

SEQ ID NO: 113958 - DNA, 103 bp, Artificial Sequence
  Synthetic Polynucleotide
taatacgactcactatagggcaaggcgaggcctcccagaacgcctctgggaacagaggagacccagaatggttctgggaaacctggcggcagcgcaaaagatg

SEQ ID NO: 113959 - DNA, 103 bp, Artificial Sequence
  Synthetic Polynucleotide
taatacgactcactatagggggcacccgcgcaaggcgaggcctcccagaaaacagaggagattctggatggcctcgcctaacctggcggcagcgcaaaagatg

SEQ ID NO: 113960 - DNA, 103 bp, Artificial Sequence
  Synthetic Polynucleotide
taatacgactcactatagggtctccaaagcgctgccgggctcccccagccaacagaggagaggctggatgagcccggcaaacctggcggcagcgcaaaagatg

SEQ ID NO: 113961 - DNA, 103 bp, Artificial Sequence
  Synthetic Polynucleotide
taatacgactcactatagggactgcgagggggcacccgcgcaaggcgaggaacagaggagacctcgcatggcgcgggtgaacctggcggcagcgcaaaagatg

SEQ ID NO: 113962 - DNA, 103 bp, Artificial Sequence
  Synthetic Polynucleotide
taatacgactcactatagggtcatacaggcactgcgagggggcacccgcgaacagaggagacgcgggatgcccctcgcaaacctggcggcagcgcaaaagatg

SEQ ID NO: 113963 - DNA, 103 bp, Artificial Sequence
  Synthetic Polynucleotide
taatacgactcactataggggagctgaggctcatacaggcactgcgagggaacagaggagaccctcgatgtgcctgtataacctggcggcagcgcaaaagatg

SEQ ID NO: 113964 - DNA, 103 bp, Artificial Sequence
  Synthetic Polynucleotide
taatacgactcactatagggcgggcggggagagctgaggctcatacaggcaacagaggagagcctgtatgagcctcagcaacctggcggcagcgcaaaagatg

SEQ ID NO: 113965 - DNA, 103 bp, Artificial Sequence
  Synthetic Polynucleotide
taatacgactcactatagggggcttgacgtcgggcggggagagctgaggcaacagaggagagcctcaatgctccccgccaacctggcggcagcgcaaaagatg

SEQ ID NO: 113966 - DNA, 103 bp, Artificial Sequence
  Synthetic Polynucleotide
taatacgactcactatagggccggaggccgggcttgacgtcgggcggggaaacagaggagatccccgatggacgtcaagaacctggcggcagcgcaaaagatg

SEQ ID NO: 113967 - DNA, 103 bp, Artificial Sequence
  Synthetic Polynucleotide
taatacgactcactatagggcgggaggcgcccggaggccgggcttgacgtaacagaggagaacgtcaatgccggcctccaacctggcggcagcgcaaaagatg

SEQ ID NO: 113968 - DNA, 103 bp, Artificial Sequence
  Synthetic Polynucleotide
taatacgactcactataggggctggcgaggcgggaggcgcccggaggccgaacagaggagacggcctatgggcgcctccaacctggcggcagcgcaaaagatg

SEQ ID NO: 113969 - DNA, 103 bp, Artificial Sequence
  Synthetic Polynucleotide
taatacgactcactatagggagcgtccagcgctggcgaggcgggaggcgcaacagaggagagcgcctatggcctcgccaaacctggcggcagcgcaaaagatg

SEQ ID NO: 113970 - DNA, 103 bp, Artificial Sequence
  Synthetic Polynucleotide
taatacgactcactatagggaggcagagacagcgtccagcgctggcgaggaacagaggagacctcgcatgcgctggacgaacctggcggcagcgcaaaagatg

SEQ ID NO: 113971 - DNA, 103 bp, Artificial Sequence
  Synthetic Polynucleotide
taatacgactcactataggggctcctcgcctctccaaagcgctgccgggcaacagaggagagcccggatgcgctttggaaacctggcggcagcgcaaaagatg

SEQ ID NO: 113972 - DNA, 103 bp, Artificial Sequence
  Synthetic Polynucleotide
taatacgactcactatagggggacccttgaaggcagagacagcgtccagcaacagaggagagctggaatgtgtctctgcaacctggcggcagcgcaaaagatg

SEQ ID NO: 113973 - DNA, 103 bp, Artificial Sequence
  Synthetic Polynucleotide
taatacgactcactataggggggcgcgtagggacccttgaaggcagagacaacagaggagagtctctatgttcaagggtaacctggcggcagcgcaaaagatg

SEQ ID NO: 113974 - DNA, 103 bp, Artificial Sequence
  Synthetic Polynucleotide
taatacgactcactataggggcagctcccagggcgcgtagggacccttgaaacagaggagatcaaggatgcctacgcgcaacctggcggcagcgcaaaagatg

SEQ ID NO: 113975 - DNA, 103 bp, Artificial Sequence
  Synthetic Polynucleotide
taatacgactcactatagggcccacagaaagcagctcccagggcgcgtagaacagaggagactacgcatgctgggagctaacctggcggcagcgcaaaagatg

SEQ ID NO: 113976 - DNA, 103 bp, Artificial Sequence
  Synthetic Polynucleotide
taatacgactcactatagggccctggggcccccacagaaagcagctcccaaacagaggagatgggagatgctttctgtgaacctggcggcagcgcaaaagatg

SEQ ID NO: 113977 - DNA, 103 bp, Artificial Sequence
  Synthetic Polynucleotide
taatacgactcactatagggacccacagttccctggggcccccacagaaaaacagaggagatttctgatggggccccagaacctggcggcagcgcaaaagatg

SEQ ID NO: 113978 - DNA, 103 bp, Artificial Sequence
  Synthetic Polynucleotide
taatacgactcactatagggtctccctgtgacccacagttccctggggccaacagaggagaggccccatggaactgtggaacctggcggcagcgcaaaagatg

SEQ ID NO: 113979 - DNA, 103 bp, Artificial Sequence
  Synthetic Polynucleotide
taatacgactcactatagggggcctggtagtctccctgtgacccacagttaacagaggagaaactgtatgtcacagggaaacctggcggcagcgcaaaagatg

SEQ ID NO: 113980 - DNA, 103 bp, Artificial Sequence
  Synthetic Polynucleotide
taatacgactcactatagggcctccggggcggcctggtagtctccctgtgaacagaggagacacaggatgactaccaggaacctggcggcagcgcaaaagatg

SEQ ID NO: 113981 - DNA, 103 bp, Artificial Sequence
  Synthetic Polynucleotide
taatacgactcactatagggggaaaacgagcctccggggcggcctggtagaacagaggagactaccaatgcgccccggaaacctggcggcagcgcaaaagatg

SEQ ID NO: 113982 - DNA, 103 bp, Artificial Sequence
  Synthetic Polynucleotide
taatacgactcactatagggattcattacaccacctccttccagaatcataacagaggagaatgattatggaaggaggtaacctggcggcagcgcaaaagatg

SEQ ID NO: 113983 - DNA, 103 bp, Artificial Sequence
  Synthetic Polynucleotide
taatacgactcactataggggcctccaaaaaacccactggaaacattgcaaacagaggagatgcaatatgtccagtgggaacctggcggcagcgcaaaagatg

SEQ ID NO: 113984 - DNA, 103 bp, Artificial Sequence
  Synthetic Polynucleotide
taatacgactcactatagggcatgccactggcctccaaaaaacccactggaacagaggagaccagtgatgtttttggagaacctggcggcagcgcaaaagatg

SEQ ID NO: 113985 - DNA, 103 bp, Artificial Sequence
  Synthetic Polynucleotide
taatacgactcactatagggggatgaatttcatgccactggcctccaaaaaacagaggagattttggatgccagtggcaaacctggcggcagcgcaaaagatg

SEQ ID NO: 113986 - DNA, 103 bp, Artificial Sequence
  Synthetic Polynucleotide
taatacgactcactatagggccagtactgaggatgaatttcatgccactgaacagaggagacagtggatggaaattcataacctggcggcagcgcaaaagatg

SEQ ID NO: 113987 - DNA, 103 bp, Artificial Sequence
  Synthetic Polynucleotide
taatacgactcactatagggggtacttggtccagtactgaggatgaatttaacagaggagaaaattcatgctcagtactaacctggcggcagcgcaaaagatg

SEQ ID NO: 113988 - DNA, 103 bp, Artificial Sequence
  Synthetic Polynucleotide
taatacgactcactatagggtcccacacctggtacttggtccagtactgaaacagaggagatcagtaatggaccaagtaaacctggcggcagcgcaaaagatg

SEQ ID NO: 113989 - DNA, 103 bp, Artificial Sequence
  Synthetic Polynucleotide
taatacgactcactatagggctggagccactcccacacctggtacttggtaacagaggagaaccaagatgcaggtgtggaacctggcggcagcgcaaaagatg

SEQ ID NO: 113990 - DNA, 103 bp, Artificial Sequence
  Synthetic Polynucleotide
taatacgactcactatagggccaggaggtgctggagccactcccacacctaacagaggagaaggtgtatgagtggctccaacctggcggcagcgcaaaagatg

SEQ ID NO: 113991 - DNA, 103 bp, Artificial Sequence
  Synthetic Polynucleotide
taatacgactcactatagggtggttggtgtccaggaggtgctggagccacaacagaggagagtggctatggcacctcctaacctggcggcagcgcaaaagatg

SEQ ID NO: 113992 - DNA, 103 bp, Artificial Sequence
  Synthetic Polynucleotide
taatacgactcactatagggggcatccagctggttggtgtccaggaggtgaacagaggagacacctcatggacaccaacaacctggcggcagcgcaaaagatg

SEQ ID NO: 113993 - DNA, 103 bp, Artificial Sequence
  Synthetic Polynucleotide
taatacgactcactatagggcggggttgagattcattacaccacctccttaacagaggagaaaggagatggtgtaatgaaacctggcggcagcgcaaaagatg

SEQ ID NO: 113994 - DNA, 103 bp, Artificial Sequence
  Synthetic Polynucleotide
taatacgactcactatagggggatacaattggcatccagctggttggtgtaacagaggagaacaccaatgagctggatgaacctggcggcagcgcaaaagatg

SEQ ID NO: 113995 - DNA, 103 bp, Artificial Sequence
  Synthetic Polynucleotide
taatacgactcactatagggtcttggaaagggatacaattggcatccagcaacagaggagagctggaatgcaattgtataacctggcggcagcgcaaaagatg

SEQ ID NO: 113996 - DNA, 103 bp, Artificial Sequence
  Synthetic Polynucleotide
taatacgactcactataggggatgtcgaactcttggaaagggatacaattaacagaggagaaattgtatgcctttccaaaacctggcggcagcgcaaaagatg

SEQ ID NO: 113997 - DNA, 103 bp, Artificial Sequence
  Synthetic Polynucleotide
taatacgactcactataggggctcgccgttgatgtcgaactcttggaaagaacagaggagactttccatgagttcgacaaacctggcggcagcgcaaaagatg

SEQ ID NO: 113998 - DNA, 103 bp, Artificial Sequence
  Synthetic Polynucleotide
taatacgactcactatagggctgcagaggtgctcgccgttgatgtcgaacaacagaggagagttcgaatgcaacggcgaaacctggcggcagcgcaaaagatg

SEQ ID NO: 113999 - DNA, 103 bp, Artificial Sequence
  Synthetic Polynucleotide
taatacgactcactatagggcaaactcatgctgcagaggtgctcgccgttaacagaggagaaacggcatgcacctctgcaacctggcggcagcgcaaaagatg

SEQ ID NO: 114000 - DNA, 103 bp, Artificial Sequence
  Synthetic Polynucleotide
taatacgactcactatagggtgaactcctgcaaactcatgctgcagaggtaacagaggagaacctctatggcatgagttaacctggcggcagcgcaaaagatg

SEQ ID NO: 114001 - DNA, 103 bp, Artificial Sequence
  Synthetic Polynucleotide
taatacgactcactataggggccgcccgggtgaactcctgcaaactcatgaacagaggagacatgagatggcaggagttaacctggcggcagcgcaaaagatg

SEQ ID NO: 114002 - DNA, 103 bp, Artificial Sequence
  Synthetic Polynucleotide
taatacgactcactatagggcgccgtccctgccgcccgggtgaactcctgaacagaggagacaggagatgacccgggcgaacctggcggcagcgcaaaagatg

SEQ ID NO: 114003 - DNA, 103 bp, Artificial Sequence
  Synthetic Polynucleotide
taatacgactcactatagggggagctgccccgccgtccctgccgcccgggaacagaggagacccgggatgcagggacggaacctggcggcagcgcaaaagatg

SEQ ID NO: 114004 - DNA, 103 bp, Artificial Sequence
  Synthetic Polynucleotide
taatacgactcactatagggaggttgttgccggggttgagattcattacaaacagaggagatgtaatatgtctcaacccaacctggcggcagcgcaaaagatg

SEQ ID NO: 114005 - DNA, 103 bp, Artificial Sequence
  Synthetic Polynucleotide
taatacgactcactatagggttgctgtagaggagctgccccgccgtccctaacagaggagaagggacatgggggcagctaacctggcggcagcgcaaaagatg

SEQ ID NO: 114006 - DNA, 103 bp, Artificial Sequence
  Synthetic Polynucleotide
taatacgactcactatagggatgctgcaagttgctgtagaggagctgcccaacagaggagagggcagatgctctacagcaacctggcggcagcgcaaaagatg

SEQ ID NO: 114007 - DNA, 103 bp, Artificial Sequence
  Synthetic Polynucleotide
taatacgactcactatagggtccacttcagatgctgcaagttgctgtagaaacagaggagatctacaatgacttgcagcaacctggcggcagcgcaaaagatg

SEQ ID NO: 114008 - DNA, 103 bp, Artificial Sequence
  Synthetic Polynucleotide
taatacgactcactatagggcactggccgttccacttcagatgctgcaagaacagaggagacttgcaatgtctgaagtgaacctggcggcagcgcaaaagatg

SEQ ID NO: 114009 - DNA, 103 bp, Artificial Sequence
  Synthetic Polynucleotide
taatacgactcactataggggtcactactgcactggccgttccacttcagaacagaggagactgaagatgaacggccagaacctggcggcagcgcaaaagatg

SEQ ID NO: 114010 - DNA, 103 bp, Artificial Sequence
  Synthetic Polynucleotide
taatacgactcactatagggactggaacaggtcactactgcactggccgtaacagaggagaacggccatggcagtagtgaacctggcggcagcgcaaaagatg

SEQ ID NO: 114011 - DNA, 103 bp, Artificial Sequence
  Synthetic Polynucleotide
taatacgactcactatagggttgtgtgtggactggaacaggtcactactgaacagaggagacagtagatgcctgttccaaacctggcggcagcgcaaaagatg

SEQ ID NO: 114012 - DNA, 103 bp, Artificial Sequence
  Synthetic Polynucleotide
taatacgactcactataggggacaatgacattgtgtgtggactggaacagaacagaggagactgttcatgtccacacacaacctggcggcagcgcaaaagatg

SEQ ID NO: 114013 - DNA, 103 bp, Artificial Sequence
  Synthetic Polynucleotide
taatacgactcactataggggttcagtcttgacaatgacattgtgtgtggaacagaggagaccacacatgatgtcattgaacctggcggcagcgcaaaagatg

SEQ ID NO: 114014 - DNA, 103 bp, Artificial Sequence
  Synthetic Polynucleotide
taatacgactcactatagggggctcagtttgttcagtcttgacaatgacaaacagaggagatgtcatatgcaagactgaaacctggcggcagcgcaaaagatg

SEQ ID NO: 114015 - DNA, 103 bp, Artificial Sequence
  Synthetic Polynucleotide
taatacgactcactatagggctggtgaaggaggttgttgccggggttgagaacagaggagactcaacatgggcaacaacaacctggcggcagcgcaaaagatg

SEQ ID NO: 114016 - DNA, 103 bp, Artificial Sequence
  Synthetic Polynucleotide
taatacgactcactatagggcatgatggaaggctcagtttgttcagtcttaacagaggagaaagactatgcaaactgagaacctggcggcagcgcaaaagatg

SEQ ID NO: 114017 - DNA, 103 bp, Artificial Sequence
  Synthetic Polynucleotide
taatacgactcactatagggtccaggtgttcatgatggaaggctcagtttaacagaggagaaaactgatgcttccatcaaacctggcggcagcgcaaaagatg

SEQ ID NO: 114018 - DNA, 103 bp, Artificial Sequence
  Synthetic Polynucleotide
taatacgactcactatagggttctcgtctttccaggtgttcatgatggaaaacagaggagattccatatggaacacctgaacctggcggcagcgcaaaagatg

SEQ ID NO: 114019 - DNA, 103 bp, Artificial Sequence
  Synthetic Polynucleotide
taatacgactcactatagggatataaatagttctcgtctttccaggtgttaacagaggagaaacaccatgaaagacgagaacctggcggcagcgcaaaagatg

SEQ ID NO: 114020 - DNA, 103 bp, Artificial Sequence
  Synthetic Polynucleotide
taatacgactcactatagggagttggtgtcatataaatagttctcgtcttaacagaggagaaagacgatgactatttataacctggcggcagcgcaaaagatg

SEQ ID NO: 114021 - DNA, 103 bp, Artificial Sequence
  Synthetic Polynucleotide
taatacgactcactataggggtgctaccatagttggtgtcatataaatagaacagaggagactatttatgtgacaccaaaacctggcggcagcgcaaaagatg

SEQ ID NO: 114022 - DNA, 103 bp, Artificial Sequence
  Synthetic Polynucleotide
taatacgactcactatagggcaaatctactgtgctaccatagttggtgtcaacagaggagagacaccatgtatggtagcaacctggcggcagcgcaaaagatg

SEQ ID NO: 114023 - DNA, 103 bp, Artificial Sequence
  Synthetic Polynucleotide
taatacgactcactatagggtgctgtccaacaaatctactgtgctaccataacagaggagaatggtaatgcagtagattaacctggcggcagcgcaaaagatg

SEQ ID NO: 114024 - DNA, 103 bp, Artificial Sequence
  Synthetic Polynucleotide
taatacgactcactatagggcagaaagttttgctgtccaacaaatctactaacagaggagaagtagaatggttggacagaacctggcggcagcgcaaaagatg

SEQ ID NO: 114025 - DNA, 103 bp, Artificial Sequence
  Synthetic Polynucleotide
taatacgactcactatagggctgagcccggcagaaagttttgctgtccaaaacagaggagattggacatgaaaactttcaacctggcggcagcgcaaaagatg

SEQ ID NO: 114026 - DNA, 103 bp, Artificial Sequence
  Synthetic Polynucleotide
taatacgactcactatagggaggctggcggctggtgaaggaggttgttgcaacagaggagagcaacaatgtccttcaccaacctggcggcagcgcaaaagatg

SEQ ID NO: 114027 - DNA, 103 bp, Artificial Sequence
  Synthetic Polynucleotide
taatacgactcactatagggtcatggagatctgagcccggcagaaagtttaacagaggagaaaacttatggccgggctcaacctggcggcagcgcaaaagatg

SEQ ID NO: 114028 - DNA, 103 bp, Artificial Sequence
  Synthetic Polynucleotide
taatacgactcactatagggctggtggttgtcatggagatctgagcccggaacagaggagaccgggcatggatctccataacctggcggcagcgcaaaagatg

SEQ ID NO: 114029 - DNA, 103 bp, Artificial Sequence
  Synthetic Polynucleotide
taatacgactcactatagggaggaaggtgactggtggttgtcatggagataacagaggagaatctccatgacaaccaccaacctggcggcagcgcaaaagatg

SEQ ID NO: 114030 - DNA, 103 bp, Artificial Sequence
  Synthetic Polynucleotide
taatacgactcactatagggactctgcaacaggaaggtgactggtggttgaacagaggagacaaccaatggtcaccttcaacctggcggcagcgcaaaagatg

SEQ ID NO: 114031 - DNA, 103 bp, Artificial Sequence
  Synthetic Polynucleotide
taatacgactcactatagggatatcaggtgactctgcaacaggaaggtgaaacagaggagatcacctatgtgttgcagaaacctggcggcagcgcaaaagatg

SEQ ID NO: 114032 - DNA, 103 bp, Artificial Sequence
  Synthetic Polynucleotide
taatacgactcactatagggctcctttttcatatcaggtgactctgcaacaacagaggagagttgcaatgtcacctgataacctggcggcagcgcaaaagatg

SEQ ID NO: 114033 - DNA, 103 bp, Artificial Sequence
  Synthetic Polynucleotide
taatacgactcactataggggggggtcttgctcctttttcatatcaggtgaacagaggagacacctgatgtgaaaaaggaacctggcggcagcgcaaaagatg

SEQ ID NO: 114034 - DNA, 103 bp, Artificial Sequence
  Synthetic Polynucleotide
taatacgactcactatagggcacttggcaggggggtcttgctcctttttcaacagaggagagaaaaaatggcaagacccaacctggcggcagcgcaaaagatg

SEQ ID NO: 114035 - DNA, 103 bp, Artificial Sequence
  Synthetic Polynucleotide
taatacgactcactatagggtttggtgtggcacttggcaggggggtcttgaacagaggagacaagacatgcctgccaagaacctggcggcagcgcaaaagatg

SEQ ID NO: 114036 - DNA, 103 bp, Artificial Sequence
  Synthetic Polynucleotide
taatacgactcactatagggggttgtgctttttggtgtggcacttggcagaacagaggagactgccaatggccacaccaaacctggcggcagcgcaaaagatg

SEQ ID NO: 114037 - DNA, 103 bp, Artificial Sequence
  Synthetic Polynucleotide
taatacgactcactatagggctgtctgtccaggctggcggctggtgaaggaacagaggagaccttcaatggccgccagcaacctggcggcagcgcaaaagatg

SEQ ID NO: 114038 - DNA, 103 bp, Artificial Sequence
  Synthetic Polynucleotide
taatacgactcactataggggtccctctcgggttgtgctttttggtgtggaacagaggagaccacacatgaaagcacaaaacctggcggcagcgcaaaagatg

SEQ ID NO: 114039 - DNA, 103 bp, Artificial Sequence
  Synthetic Polynucleotide
taatacgactcactatagggccataagtgagtccctctcgggttgtgcttaacagaggagaaagcacatgccgagagggaacctggcggcagcgcaaaagatg

SEQ ID NO: 114040 - DNA, 103 bp, Artificial Sequence
  Synthetic Polynucleotide
taatacgactcactatagggggatgaattcccataagtgagtccctctcgaacagaggagacgagagatgctcacttataacctggcggcagcgcaaaagatg

SEQ ID NO: 114041 - DNA, 103 bp, Artificial Sequence
  Synthetic Polynucleotide
taatacgactcactatagggaggatgtcgcggatgaattcccataagtgaaacagaggagatcacttatgggaattcataacctggcggcagcgcaaaagatg

SEQ ID NO: 114042 - DNA, 103 bp, Artificial Sequence
  Synthetic Polynucleotide
taatacgactcactatagggtgggttcaagaggatgtcgcggatgaattcaacagaggagagaattcatgcgcgacatcaacctggcggcagcgcaaaagatg

SEQ ID NO: 114043 - DNA, 103 bp, Artificial Sequence
  Synthetic Polynucleotide
taatacgactcactatagggggttcttgtctgggttcaagaggatgtcgcaacagaggagagcgacaatgtcttgaaccaacctggcggcagcgcaaaagatg

SEQ ID NO: 114044 - DNA, 103 bp, Artificial Sequence
  Synthetic Polynucleotide
taatacgactcactatagggattaatcctgggttcttgtctgggttcaagaacagaggagacttgaaatgagacaagaaaacctggcggcagcgcaaaagatg

SEQ ID NO: 114045 - DNA, 103 bp, Artificial Sequence
  Synthetic Polynucleotide
taatacgactcactatagggttcccattttattaatcctgggttcttgtcaacagaggagagacaagatgccaggattaaacctggcggcagcgcaaaagatg

SEQ ID NO: 114046 - DNA, 103 bp, Artificial Sequence
  Synthetic Polynucleotide
taatacgactcactatagggcagatcggtcttcccattttattaatcctgaacagaggagacaggatatgtaaaatgggaacctggcggcagcgcaaaagatg

SEQ ID NO: 114047 - DNA, 103 bp, Artificial Sequence
  Synthetic Polynucleotide
taatacgactcactatagggaagacgccctcagatcggtcttcccattttaacagaggagaaaaatgatgagaccgatcaacctggcggcagcgcaaaagatg

SEQ ID NO: 114048 - DNA, 103 bp, Artificial Sequence
  Synthetic Polynucleotide
taatacgactcactatagggcgtggagtagctgtctgtccaggctggcggaacagaggagaccgccaatgtggacagacaacctggcggcagcgcaaaagatg

SEQ ID NO: 114049 - DNA, 103 bp, Artificial Sequence
  Synthetic Polynucleotide
taatacgactcactatagggcaagaacctgaagacgccctcagatcggtcaacagaggagagaccgaatggagggcgtcaacctggcggcagcgcaaaagatg

SEQ ID NO: 114050 - DNA, 103 bp, Artificial Sequence
  Synthetic Polynucleotide
taatacgactcactatagggcctctgatttcaagaacctgaagacgccctaacagaggagaagggcgatgtcaggttctaacctggcggcagcgcaaaagatg

SEQ ID NO: 114051 - DNA, 103 bp, Artificial Sequence
  Synthetic Polynucleotide
taatacgactcactatagggtgagccactgcctctgatttcaagaacctgaacagaggagacaggttatggaaatcagaaacctggcggcagcgcaaaagatg

SEQ ID NO: 114052 - DNA, 103 bp, Artificial Sequence
  Synthetic Polynucleotide
taatacgactcactatagggaccccatagctgagccactgcctctgatttaacagaggagaaaatcaatggcagtggctaacctggcggcagcgcaaaagatg

SEQ ID NO: 114053 - DNA, 103 bp, Artificial Sequence
  Synthetic Polynucleotide
taatacgactcactatagggtcttctttttaccccatagctgagccactgaacagaggagacagtggatgagctatgggaacctggcggcagcgcaaaagatg

SEQ ID NO: 114054 - DNA, 103 bp, Artificial Sequence
  Synthetic Polynucleotide
taatacgactcactatagggctgctgttgttcttctttttaccccatagcaacagaggagagctatgatgtaaaaagaaaacctggcggcagcgcaaaagatg

SEQ ID NO: 114055 - DNA, 103 bp, Artificial Sequence
  Synthetic Polynucleotide
taatacgactcactatagggataggtcatgctgctgttgttcttctttttaacagaggagaaaaaagatgaacaacagcaacctggcggcagcgcaaaagatg

SEQ ID NO: 114056 - DNA, 103 bp, Artificial Sequence
  Synthetic Polynucleotide
taatacgactcactatagggtgagcttttcataggtcatgctgctgttgtaacagaggagaacaacaatggcatgacctaacctggcggcagcgcaaaagatg

SEQ ID NO: 114057 - DNA, 103 bp, Artificial Sequence
  Synthetic Polynucleotide
taatacgactcactatagggatagctcggctgagcttttcataggtcatgaacagaggagacatgacatgtgaaaagctaacctggcggcagcgcaaaagatg

SEQ ID NO: 114058 - DNA, 103 bp, Artificial Sequence
  Synthetic Polynucleotide
taatacgactcactataggggtaatatctcatagctcggctgagcttttcaacagaggagagaaaagatgagccgagctaacctggcggcagcgcaaaagatg

SEQ ID NO: 114059 - DNA, 103 bp, Artificial Sequence
  Synthetic Polynucleotide
taatacgactcactatagggaaacattgcacgtggagtagctgtctgtccaacagaggagaggacagatggctactccaaacctggcggcagcgcaaaagatg

SEQ ID NO: 114060 - DNA, 103 bp, Artificial Sequence
  Synthetic Polynucleotide
taatacgactcactatagggctcttttgtagtaatatctcatagctcggcaacagaggagagccgagatgtgagatattaacctggcggcagcgcaaaagatg

SEQ ID NO: 114061 - DNA, 103 bp, Artificial Sequence
  Synthetic Polynucleotide
taatacgactcactatagggtccagaatttctcttttgtagtaatatctcaacagaggagagagataatgctacaaaagaacctggcggcagcgcaaaagatg

SEQ ID NO: 114062 - DNA, 103 bp, Artificial Sequence
  Synthetic Polynucleotide
taatacgactcactatagggatccacacgctccagaatttctcttttgtaaacagaggagatacaaaatggaaattctgaacctggcggcagcgcaaaagatg

SEQ ID NO: 114063 - DNA, 103 bp, Artificial Sequence
  Synthetic Polynucleotide
taatacgactcactataggggtcttcgtccatccacacgctccagaatttaacagaggagaaaattcatgagcgtgtggaacctggcggcagcgcaaaagatg

SEQ ID NO: 114064 - DNA, 103 bp, Artificial Sequence
  Synthetic Polynucleotide
taatacgactcactatagggttatataccagtcttcgtccatccacacgcaacagaggagagcgtgtatgtggacgaagaacctggcggcagcgcaaaagatg

SEQ ID NO: 114065 - DNA, 103 bp, Artificial Sequence
  Synthetic Polynucleotide
taatacgactcactatagggcttcccaaatttatataccagtcttcgtccaacagaggagaggacgaatgctggtatataacctggcggcagcgcaaaagatg

SEQ ID NO: 114066 - DNA, 103 bp, Artificial Sequence
  Synthetic Polynucleotide
taatacgactcactatagggctcgggcattcttcccaaatttatataccaaacagaggagatggtatatgaatttgggaaacctggcggcagcgcaaaagatg

SEQ ID NO: 114067 - DNA, 103 bp, Artificial Sequence
  Synthetic Polynucleotide
taatacgactcactatagggtctctccatcctcgggcattcttcccaaataacagaggagaatttggatggaatgcccgaacctggcggcagcgcaaaagatg

SEQ ID NO: 114068 - DNA, 103 bp, Artificial Sequence
  Synthetic Polynucleotide
taatacgactcactataggggttttcattttctctccatcctcgggcattaacagaggagaaatgccatgggatggagaaacctggcggcagcgcaaaagatg

SEQ ID NO: 114069 - DNA, 103 bp, Artificial Sequence
  Synthetic Polynucleotide
taatacgactcactatagggaacccactggaaacattgcacgtggagtagaacagaggagactactcatggtgcaatgtaacctggcggcagcgcaaaagatg

SEQ ID NO: 114070 - DNA, 103 bp, Artificial Sequence
  Synthetic Polynucleotide
taatacgactcactatagggcaaccccctccctctcggtagaccccgcataacagaggagaatgcggatgctaccgagaaacctggcggcagcgcaaaagatg

SEQ ID NO: 114071 - DNA, 103 bp, Artificial Sequence
  Synthetic Polynucleotide
taatacgactcactatagggccggggcctacctcttcctctgtggggcccaacagaggagagggcccatgagaggaagaaacctggcggcagcgcaaaagatg

SEQ ID NO: 114072 - DNA, 103 bp, Artificial Sequence
  Synthetic Polynucleotide
taatacgactcactatagggcacgcgctcatccacagagtaggaatcataaacagaggagatatgatatgtactctgtgaacctggcggcagcgcaaaagatg

SEQ ID NO: 114073 - DNA, 103 bp, Artificial Sequence
  Synthetic Polynucleotide
taatacgactcactatagggtgtcggagtccacgcgctcatccacagagtaacagaggagaactctgatgatgagcgcgaacctggcggcagcgcaaaagatg

SEQ ID NO: 114074 - DNA, 103 bp, Artificial Sequence
  Synthetic Polynucleotide
taatacgactcactatagggtcagacttgctgtcggagtccacgcgctcaaacagaggagatgagcgatgggactccgaaacctggcggcagcgcaaaagatg

SEQ ID NO: 114075 - DNA, 103 bp, Artificial Sequence
  Synthetic Polynucleotide
taatacgactcactatagggagcttcaacttcagacttgctgtcggagtcaacagaggagagactccatgagcaagtctaacctggcggcagcgcaaaagatg

SEQ ID NO: 114076 - DNA, 103 bp, Artificial Sequence
  Synthetic Polynucleotide
taatacgactcactataggggttcagttagagcttcaacttcagacttgcaacagaggagagcaagtatgaagttgaagaacctggcggcagcgcaaaagatg

SEQ ID NO: 114077 - DNA, 103 bp, Artificial Sequence
  Synthetic Polynucleotide
taatacgactcactatagggtcacttagttgttcagttagagcttcaactaacagaggagaagttgaatgtctaactgaaacctggcggcagcgcaaaagatg

SEQ ID NO: 114078 - DNA, 103 bp, Artificial Sequence
  Synthetic Polynucleotide
taatacgactcactatagggctcctcctcttcacttagttgttcagttagaacagaggagactaactatgcaactaagtaacctggcggcagcgcaaaagatg

SEQ ID NO: 114079 - DNA, 103 bp, Artificial Sequence
  Synthetic Polynucleotide
taatacgactcactatagggcctcttcctcctcctcctcttcacttagttaacagaggagaaactaaatgaagaggaggaacctggcggcagcgcaaaagatg

SEQ ID NO: 114080 - DNA, 103 bp, Artificial Sequence
  Synthetic Polynucleotide
taatacgactcactatagggtcttcttcctcctcttcctcctcctcctctaacagaggagaagaggaatgggaggaagaaacctggcggcagcgcaaaagatg

SEQ ID NO: 114081 - DNA, 103 bp, Artificial Sequence
  Synthetic Polynucleotide
taatacgactcactatagggttcctcttcttcttcttcctcctcttcctcaacagaggagagaggaaatggaggaagaaaacctggcggcagcgcaaaagatg

SEQ ID NO: 114082 - DNA, 103 bp, Artificial Sequence
  Synthetic Polynucleotide
taatacgactcactatagggagagtaggctccggggcctacctcttcctcaacagaggagagaggaaatggtaggccccaacctggcggcagcgcaaaagatg

SEQ ID NO: 114083 - DNA, 103 bp, Artificial Sequence
  Synthetic Polynucleotide
taatacgactcactatagggcctcctcctcttcctcttcttcttcttcctaacagaggagaaggaagatgaagaagaggaacctggcggcagcgcaaaagatg

SEQ ID NO: 114084 - DNA, 103 bp, Artificial Sequence
  Synthetic Polynucleotide
taatacgactcactatagggtcttcctcttcctcctcctcttcctcttctaacagaggagaagaagaatgagaggaggaaacctggcggcagcgcaaaagatg

SEQ ID NO: 114085 - DNA, 103 bp, Artificial Sequence
  Synthetic Polynucleotide
taatacgactcactatagggttcctcttcttcttcctcttcctcctcctcaacagaggagagaggagatggaagaggaaaacctggcggcagcgcaaaagatg

SEQ ID NO: 114086 - DNA, 103 bp, Artificial Sequence
  Synthetic Polynucleotide
taatacgactcactatagggactcctcatcttcctcttcttcttcctcttaacagaggagaaagaggatgaagaagaggaacctggcggcagcgcaaaagatg

SEQ ID NO: 114087 - DNA, 103 bp, Artificial Sequence
  Synthetic Polynucleotide
taatacgactcactatagggtgattccctgactcctcatcttcctcttctaacagaggagaagaagaatgagatgaggaaacctggcggcagcgcaaaagatg

SEQ ID NO: 114088 - DNA, 103 bp, Artificial Sequence
  Synthetic Polynucleotide
taatacgactcactatagggcctatctgactgattccctgactcctcatcaacagaggagagatgagatgtcagggaataacctggcggcagcgcaaaagatg

SEQ ID NO: 114089 - DNA, 103 bp, Artificial Sequence
  Synthetic Polynucleotide
taatacgactcactatagggtggaaccactcctatctgactgattccctgaacagaggagacagggaatgagtcagataaacctggcggcagcgcaaaagatg

SEQ ID NO: 114090 - DNA, 103 bp, Artificial Sequence
  Synthetic Polynucleotide
taatacgactcactatagggcgccggccactggaaccactcctatctgacaacagaggagagtcagaatggagtggttcaacctggcggcagcgcaaaagatg

SEQ ID NO: 114091 - DNA, 103 bp, Artificial Sequence
  Synthetic Polynucleotide
taatacgactcactatagggcttggccttgcgccggccactggaaccactaacagaggagaagtggtatgagtggccggaacctggcggcagcgcaaaagatg

SEQ ID NO: 114092 - DNA, 103 bp, Artificial Sequence
  Synthetic Polynucleotide
taatacgactcactataggggccatttcttcttggccttgcgccggccacaacagaggagagtggccatggcaaggccaaacctggcggcagcgcaaaagatg

SEQ ID NO: 114093 - DNA, 103 bp, Artificial Sequence
  Synthetic Polynucleotide
taatacgactcactatagggctgggaagagagagtaggctccggggcctaaacagaggagataggccatggagcctactaacctggcggcagcgcaaaagatg

SEQ ID NO: 114094 - DNA, 103 bp, Artificial Sequence
  Synthetic Polynucleotide
taatacgactcactatagggctgtcttttcgccatttcttcttggccttgaacagaggagacaaggcatggaagaaatgaacctggcggcagcgcaaaagatg

SEQ ID NO: 114095 - DNA, 103 bp, Artificial Sequence
  Synthetic Polynucleotide
taatacgactcactatagggcacccatgggctgtcttttcgccatttcttaacagaggagaaagaaaatgcgaaaagacaacctggcggcagcgcaaaagatg

SEQ ID NO: 114096 - DNA, 103 bp, Artificial Sequence
  Synthetic Polynucleotide
taatacgactcactataggggagacggcttcacccatgggctgtcttttcaacagaggagagaaaagatggcccatgggaacctggcggcagcgcaaaagatg

SEQ ID NO: 114097 - DNA, 103 bp, Artificial Sequence
  Synthetic Polynucleotide
taatacgactcactatagggcgccgtttccgagacggcttcacccatgggaacagaggagacccatgatggaagccgtcaacctggcggcagcgcaaaagatg

SEQ ID NO: 114098 - DNA, 103 bp, Artificial Sequence
  Synthetic Polynucleotide
taatacgactcactatagggctcccgcttgcgccgtttccgagacggcttaacagaggagaaagccgatgcggaaacggaacctggcggcagcgcaaaagatg

SEQ ID NO: 114099 - DNA, 103 bp, Artificial Sequence
  Synthetic Polynucleotide
taatacgactcactatagggcccgcggaggctcccgcttgcgccgtttccaacagaggagaggaaacatggcaagcgggaacctggcggcagcgcaaaagatg

SEQ ID NO: 114100 - DNA, 103 bp, Artificial Sequence
  Synthetic Polynucleotide
taatacgactcactatagggggctccttggcccgcggaggctcccgcttgaacagaggagacaagcgatggcctccgcgaacctggcggcagcgcaaaagatg

SEQ ID NO: 114101 - DNA, 103 bp, Artificial Sequence
  Synthetic Polynucleotide
taatacgactcactatagggcacccctcgtggctccttggcccgcggaggaacagaggagacctccgatggccaaggagaacctggcggcagcgcaaaagatg

SEQ ID NO: 114102 - DNA, 103 bp, Artificial Sequence
  Synthetic Polynucleotide
taatacgactcactatagggtgtcattggacacccctcgtggctccttggaacagaggagaccaaggatgcacgaggggaacctggcggcagcgcaaaagatg

SEQ ID NO: 114103 - DNA, 103 bp, Artificial Sequence
  Synthetic Polynucleotide
taatacgactcactatagggagcgaagatgtgtcattggacacccctcgtaacagaggagaacgaggatggtccaatgaaacctggcggcagcgcaaaagatg

SEQ ID NO: 114104 - DNA, 103 bp, Artificial Sequence
  Synthetic Polynucleotide
taatacgactcactatagggtgcctgggccctgggaagagagagtaggctaacagaggagaagcctaatgtctcttcccaacctggcggcagcgcaaaagatg

SEQ ID NO: 114105 - DNA, 103 bp, Artificial Sequence
  Synthetic Polynucleotide
taatacgactcactatagggctctgtctccagcgaagatgtgtcattggaaacagaggagatccaatatgacatcttcgaacctggcggcagcgcaaaagatg

SEQ ID NO: 114106 - DNA, 103 bp, Artificial Sequence
  Synthetic Polynucleotide
taatacgactcactatagggcaaaccctcgctctgtctccagcgaagatgaacagaggagacatcttatgtggagacagaacctggcggcagcgcaaaagatg

SEQ ID NO: 114107 - DNA, 103 bp, Artificial Sequence
  Synthetic Polynucleotide
taatacgactcactatagggggcaactcctcaaaccctcgctctgtctccaacagaggagaggagacatggcgagggttaacctggcggcagcgcaaaagatg

SEQ ID NO: 114108 - DNA, 103 bp, Artificial Sequence
  Synthetic Polynucleotide
taatacgactcactataggggctgcacaggggcaactcctcaaaccctcgaacagaggagacgagggatggaggagttgaacctggcggcagcgcaaaagatg

SEQ ID NO: 114109 - DNA, 103 bp, Artificial Sequence
  Synthetic Polynucleotide
taatacgactcactatagggccatgcggcagctgcacaggggcaactcctaacagaggagaaggagtatgccctgtgcaaacctggcggcagcgcaaaagatg

SEQ ID NO: 114110 - DNA, 103 bp, Artificial Sequence
  Synthetic Polynucleotide
taatacgactcactatagggttgggtgcctccatgcggcagctgcacaggaacagaggagacctgtgatgctgccgcataacctggcggcagcgcaaaagatg

SEQ ID NO: 114111 - DNA, 103 bp, Artificial Sequence
  Synthetic Polynucleotide
taatacgactcactataggggcggtcaatcttgggtgcctccatgcggcaaacagaggagatgccgcatggaggcacccaacctggcggcagcgcaaaagatg

SEQ ID NO: 114112 - DNA, 103 bp, Artificial Sequence
  Synthetic Polynucleotide
taatacgactcactatagggtctcgctgatgcggtcaatcttgggtgcctaacagaggagaaggcacatgagattgaccaacctggcggcagcgcaaaagatg

SEQ ID NO: 114113 - DNA, 103 bp, Artificial Sequence
  Synthetic Polynucleotide
taatacgactcactatagggtgccccgccctctcgctgatgcggtcaatcaacagaggagagattgaatgcatcagcgaaacctggcggcagcgcaaaagatg

SEQ ID NO: 114114 - DNA, 103 bp, Artificial Sequence
  Synthetic Polynucleotide
taatacgactcactatagggcatgcacttgtgccccgccctctcgctgataacagaggagaatcagcatgagggcggggaacctggcggcagcgcaaaagatg

SEQ ID NO: 114115 - DNA, 103 bp, Artificial Sequence
  Synthetic Polynucleotide
taatacgactcactataggggggtccaggatgcctgggccctgggaagagaacagaggagactcttcatggggcccaggaacctggcggcagcgcaaaagatg

SEQ ID NO: 114116 - DNA, 103 bp, Artificial Sequence
  Synthetic Polynucleotide
taatacgactcactatagggtctcagtggccatgcacttgtgccccgcccaacagaggagagggcggatgacaagtgcaaacctggcggcagcgcaaaagatg

SEQ ID NO: 114117 - DNA, 103 bp, Artificial Sequence
  Synthetic Polynucleotide
taatacgactcactatagggccgtccacactctcagtggccatgcacttgaacagaggagacaagtgatgggccactgaaacctggcggcagcgcaaaagatg

SEQ ID NO: 114118 - DNA, 103 bp, Artificial Sequence
  Synthetic Polynucleotide
taatacgactcactatagggtgacagctctccgtccacactctcagtggcaacagaggagagccactatgagtgtggacaacctggcggcagcgcaaaagatg

SEQ ID NO: 114119 - DNA, 103 bp, Artificial Sequence
  Synthetic Polynucleotide
taatacgactcactatagggcattgcagcctgacagctctccgtccacacaacagaggagagtgtggatggagagctgtaacctggcggcagcgcaaaagatg

SEQ ID NO: 114120 - DNA, 103 bp, Artificial Sequence
  Synthetic Polynucleotide
taatacgactcactatagggaggatggcggcattgcagcctgacagctctaacagaggagaagagctatgaggctgcaaaacctggcggcagcgcaaaagatg

SEQ ID NO: 114121 - DNA, 103 bp, Artificial Sequence
  Synthetic Polynucleotide
taatacgactcactatagggctcccgcttgaggatggcggcattgcagccaacagaggagaggctgcatggccgccatcaacctggcggcagcgcaaaagatg

SEQ ID NO: 114122 - DNA, 103 bp, Artificial Sequence
  Synthetic Polynucleotide
taatacgactcactataggggcctcatggtctcccgcttgaggatggcggaacagaggagaccgccaatgtcaagcgggaacctggcggcagcgcaaaagatg

SEQ ID NO: 114123 - DNA, 103 bp, Artificial Sequence
  Synthetic Polynucleotide
taatacgactcactatagggcggctggatggcctcatggtctcccgcttgaacagaggagacaagcgatggaccatgagaacctggcggcagcgcaaaagatg

SEQ ID NO: 114124 - DNA, 103 bp, Artificial Sequence
  Synthetic Polynucleotide
taatacgactcactatagggcagggccacacggctggatggcctcatggtaacagaggagaaccatgatgccatccagcaacctggcggcagcgcaaaagatg

SEQ ID NO: 114125 - DNA, 103 bp, Artificial Sequence
  Synthetic Polynucleotide
taatacgactcactatagggagagcaccatcagggccacacggctggatgaacagaggagacatccaatggtgtggcccaacctggcggcagcgcaaaagatg

SEQ ID NO: 114126 - DNA, 103 bp, Artificial Sequence
  Synthetic Polynucleotide
taatacgactcactataggggagagttggggggtccaggatgcctgggccaacagaggagaggcccaatgatcctggacaacctggcggcagcgcaaaagatg

SEQ ID NO: 114127 - DNA, 103 bp, Artificial Sequence
  Synthetic Polynucleotide
taatacgactcactatagggtgggtctcacagagcaccatcagggccacaaacagaggagatgtggcatggatggtgctaacctggcggcagcgcaaaagatg

SEQ ID NO: 114128 - DNA, 103 bp, Artificial Sequence
  Synthetic Polynucleotide
taatacgactcactataggggcgggcgcggtgggtctcacagagcaccataacagaggagaatggtgatgtgtgagaccaacctggcggcagcgcaaaagatg

SEQ ID NO: 114129 - DNA, 103 bp, Artificial Sequence
  Synthetic Polynucleotide
taatacgactcactataggggtttgaccatgcgggcgcggtgggtctcacaacagaggagagtgagaatgaccgcgcccaacctggcggcagcgcaaaagatg

SEQ ID NO: 114130 - DNA, 103 bp, Artificial Sequence
  Synthetic Polynucleotide
taatacgactcactatagggcagcagtggtgtttgaccatgcgggcgcggaacagaggagaccgcgcatgcatggtcaaaacctggcggcagcgcaaaagatg

SEQ ID NO: 114131 - DNA, 103 bp, Artificial Sequence
  Synthetic Polynucleotide
taatacgactcactataggggcagcccgggcagcagtggtgtttgaccataacagaggagaatggtcatgcaccactgcaacctggcggcagcgcaaaagatg

SEQ ID NO: 114132 - DNA, 103 bp, Artificial Sequence
  Synthetic Polynucleotide
taatacgactcactatagggagaagtagccgcagcccgggcagcagtggtaacagaggagaaccactatggcccgggctaacctggcggcagcgcaaaagatg

SEQ ID NO: 114133 - DNA, 103 bp, Artificial Sequence
  Synthetic Polynucleotide
taatacgactcactatagggcccgccgtgcagaagtagccgcagcccgggaacagaggagacccgggatgcggctacttaacctggcggcagcgcaaaagatg

SEQ ID NO: 114134 - DNA, 103 bp, Artificial Sequence
  Synthetic Polynucleotide
taatacgactcactatagggcaggaaggtgcccgccgtgcagaagtagccaacagaggagaggctacatgtgcacggcgaacctggcggcagcgcaaaagatg

SEQ ID NO: 114135 - DNA, 103 bp, Artificial Sequence
  Synthetic Polynucleotide
taatacgactcactatagggggtggcactccaggaaggtgcccgccgtgcaacagaggagagcacggatggcaccttccaacctggcggcagcgcaaaagatg

SEQ ID NO: 114136 - DNA, 103 bp, Artificial Sequence
  Synthetic Polynucleotide
taatacgactcactatagggcggaagtcagggtggcactccaggaaggtgaacagaggagacaccttatgggagtgccaaacctggcggcagcgcaaaagatg

SEQ ID NO: 114137 - DNA, 103 bp, Artificial Sequence
  Synthetic Polynucleotide
taatacgactcactatagggcagcccagtagagagttggggggtccaggaaacagaggagatcctggatgccccaactcaacctggcggcagcgcaaaagatg

SEQ ID NO: 114138 - DNA, 103 bp, Artificial Sequence
  Synthetic Polynucleotide
taatacgactcactataggggtgggccacacggaagtcagggtggcactcaacagaggagagagtgcatgcctgacttcaacctggcggcagcgcaaaagatg

SEQ ID NO: 114139 - DNA, 103 bp, Artificial Sequence
  Synthetic Polynucleotide
taatacgactcactatagggtgtggaagcggtgggccacacggaagtcagaacagaggagactgactatggtgtggcccaacctggcggcagcgcaaaagatg

SEQ ID NO: 114140 - DNA, 103 bp, Artificial Sequence
  Synthetic Polynucleotide
taatacgactcactatagggacacaggccttgtggaagcggtgggccacaaacagaggagatgtggcatgccgcttccaaacctggcggcagcgcaaaagatg

SEQ ID NO: 114141 - DNA, 103 bp, Artificial Sequence
  Synthetic Polynucleotide
taatacgactcactatagggcagctgagacacacaggccttgtggaagcgaacagaggagacgcttcatgaaggcctgtaacctggcggcagcgcaaaagatg

SEQ ID NO: 114142 - DNA, 103 bp, Artificial Sequence
  Synthetic Polynucleotide
taatacgactcactatagggccatcccattcagctgagacacacaggcctaacagaggagaaggcctatgtgtctcagcaacctggcggcagcgcaaaagatg

SEQ ID NO: 114143 - DNA, 103 bp, Artificial Sequence
  Synthetic Polynucleotide
taatacgactcactatagggggacagaagaccatcccattcagctgagacaacagaggagagtctcaatggaatgggataacctggcggcagcgcaaaagatg

SEQ ID NO: 114144 - DNA, 103 bp, Artificial Sequence
  Synthetic Polynucleotide
taatacgactcactatagggcccacagtggggacagaagaccatcccattaacagaggagaaatgggatggtcttctgtaacctggcggcagcgcaaaagatg

SEQ ID NO: 114145 - DNA, 103 bp, Artificial Sequence
  Synthetic Polynucleotide
taatacgactcactatagggaagcatcctccccacagtggggacagaagaaacagaggagatcttctatgcccactgtgaacctggcggcagcgcaaaagatg

SEQ ID NO: 114146 - DNA, 103 bp, Artificial Sequence
  Synthetic Polynucleotide
taatacgactcactatagggtgagcttcagaagcatcctccccacagtggaacagaggagaccactgatgggaggatgcaacctggcggcagcgcaaaagatg

SEQ ID NO: 114147 - DNA, 103 bp, Artificial Sequence
  Synthetic Polynucleotide
taatacgactcactatagggggtcacctcttgagcttcagaagcatcctcaacagaggagagaggatatgtctgaagctaacctggcggcagcgcaaaagatg

SEQ ID NO: 114148 - DNA, 103 bp, Artificial Sequence
  Synthetic Polynucleotide
taatacgactcactataggggagggctggtcagcccagtagagagttgggaacagaggagacccaacatgctactgggcaacctggcggcagcgcaaaagatg

SEQ ID NO: 114149 - DNA, 103 bp, Artificial Sequence
  Synthetic Polynucleotide
taatacgactcactatagggcccgggggatggtcacctcttgagcttcagaacagaggagactgaagatgaagaggtgaaacctggcggcagcgcaaaagatg

SEQ ID NO: 114150 - DNA, 103 bp, Artificial Sequence
  Synthetic Polynucleotide
taatacgactcactatagggaccccgtcaccccgggggatggtcacctctaacagaggagaagaggtatgcatcccccgaacctggcggcagcgcaaaagatg

SEQ ID NO: 114151 - DNA, 103 bp, Artificial Sequence
  Synthetic Polynucleotide
taatacgactcactatagggcggtggggtcaccccgtcaccccgggggataacagaggagaatccccatgggtgacgggaacctggcggcagcgcaaaagatg

SEQ ID NO: 114152 - DNA, 103 bp, Artificial Sequence
  Synthetic Polynucleotide
taatacgactcactatagggcagtgccggccggtggggtcaccccgtcacaacagaggagagtgacgatgtgaccccacaacctggcggcagcgcaaaagatg

SEQ ID NO: 114153 - DNA, 103 bp, Artificial Sequence
  Synthetic Polynucleotide
taatacgactcactataggggcaggagctgcagtgccggccggtggggtcaacagaggagagaccccatgggccggcacaacctggcggcagcgcaaaagatg

SEQ ID NO: 114154 - DNA, 103 bp, Artificial Sequence
  Synthetic Polynucleotide
taatacgactcactataggggggtgggggtgcaggagctgcagtgccggcaacagaggagagccggcatggcagctcctaacctggcggcagcgcaaaagatg

SEQ ID NO: 114155 - DNA, 103 bp, Artificial Sequence
  Synthetic Polynucleotide
taatacgactcactatagggcctgggacaggggtgggggtgcaggagctgaacagaggagacagctcatgcacccccacaacctggcggcagcgcaaaagatg

SEQ ID NO: 114156 - DNA, 103 bp, Artificial Sequence
  Synthetic Polynucleotide
taatacgactcactatagggccggggacatcctgggacaggggtgggggtaacagaggagaacccccatgcctgtcccaaacctggcggcagcgcaaaagatg

SEQ ID NO: 114157 - DNA, 103 bp, Artificial Sequence
  Synthetic Polynucleotide
taatacgactcactataggggtctgctctcccggggacatcctgggacagaacagaggagactgtccatggatgtccccaacctggcggcagcgcaaaagatg

SEQ ID NO: 114158 - DNA, 103 bp, Artificial Sequence
  Synthetic Polynucleotide
taatacgactcactataggggctgagaagtgtctgctctcccggggacataacagaggagaatgtccatgggagagcagaacctggcggcagcgcaaaagatg

SEQ ID NO: 114159 - DNA, 103 bp, Artificial Sequence
  Synthetic Polynucleotide
taatacgactcactatagggcaagggacaggagggctggtcagcccagtaaacagaggagatactggatggaccagcccaacctggcggcagcgcaaaagatg

SEQ ID NO: 114160 - DNA, 103 bp, Artificial Sequence
  Synthetic Polynucleotide
taatacgactcactatagggcgggcactgggctgagaagtgtctgctctcaacagaggagagagagcatgcacttctcaaacctggcggcagcgcaaaagatg

SEQ ID NO: 114161 - DNA, 103 bp, Artificial Sequence
  Synthetic Polynucleotide
taatacgactcactatagggccctcgcatccgggcactgggctgagaagtaacagaggagaacttctatgcccagtgccaacctggcggcagcgcaaaagatg

SEQ ID NO: 114162 - DNA, 103 bp, Artificial Sequence
  Synthetic Polynucleotide
taatacgactcactataggggttccccatgccctcgcatccgggcactggaacagaggagaccagtgatgggatgcgagaacctggcggcagcgcaaaagatg

SEQ ID NO: 114163 - DNA, 103 bp, Artificial Sequence
  Synthetic Polynucleotide
taatacgactcactataggggggcgccggggttccccatgccctcgcatcaacagaggagagatgcgatggcatggggaaacctggcggcagcgcaaaagatg

SEQ ID NO: 114164 - DNA, 103 bp, Artificial Sequence
  Synthetic Polynucleotide
taatacgactcactatagggatcgcagggcgggcgccggggttccccatgaacagaggagacatgggatgccccggcgcaacctggcggcagcgcaaaagatg

SEQ ID NO: 114165 - DNA, 103 bp, Artificial Sequence
  Synthetic Polynucleotide
taatacgactcactatagggcagccaggggatcgcagggcgggcgccgggaacagaggagacccggcatgcgccctgcgaacctggcggcagcgcaaaagatg

SEQ ID NO: 114166 - DNA, 103 bp, Artificial Sequence
  Synthetic Polynucleotide
taatacgactcactatagggtcaatggtgtcagccaggggatcgcagggcaacagaggagagccctgatgtcccctggcaacctggcggcagcgcaaaagatg

SEQ ID NO: 114167 - DNA, 103 bp, Artificial Sequence
  Synthetic Polynucleotide
taatacgactcactatagggccctgagctgtcaatggtgtcagccaggggaacagaggagacccctgatggacaccattaacctggcggcagcgcaaaagatg

SEQ ID NO: 114168 - DNA, 103 bp, Artificial Sequence
  Synthetic Polynucleotide
taatacgactcactatagggtcagggagggccctgagctgtcaatggtgtaacagaggagaacaccaatgacagctcagaacctggcggcagcgcaaaagatg

SEQ ID NO: 114169 - DNA, 103 bp, Artificial Sequence
  Synthetic Polynucleotide
taatacgactcactatagggttgggcagggtcagggagggccctgagctgaacagaggagacagctcatggccctccctaacctggcggcagcgcaaaagatg

SEQ ID NO: 114170 - DNA, 103 bp, Artificial Sequence
  Synthetic Polynucleotide
taatacgactcactatagggggaggggagacaagggacaggagggctggtaacagaggagaaccagcatgcctgtccctaacctggcggcagcgcaaaagatg

SEQ ID NO: 114171 - DNA, 103 bp, Artificial Sequence
  Synthetic Polynucleotide
taatacgactcactataggggcagcccccattgggcagggtcagggagggaacagaggagaccctccatgaccctgcccaacctggcggcagcgcaaaagatg

SEQ ID NO: 114172 - DNA, 103 bp, Artificial Sequence
  Synthetic Polynucleotide
taatacgactcactatagggcggctgaaaggcagcccccattgggcagggaacagaggagaccctgcatgatgggggctaacctggcggcagcgcaaaagatg

SEQ ID NO: 114173 - DNA, 103 bp, Artificial Sequence
  Synthetic Polynucleotide
taatacgactcactatagggggcagccccacggctgaaaggcagcccccaaacagaggagatgggggatgcctttcagcaacctggcggcagcgcaaaagatg

SEQ ID NO: 114174 - DNA, 103 bp, Artificial Sequence
  Synthetic Polynucleotide
taatacgactcactatagggtggccccagtggcagccccacggctgaaagaacagaggagactttcaatggtggggctgaacctggcggcagcgcaaaagatg

SEQ ID NO: 114175 - DNA, 103 bp, Artificial Sequence
  Synthetic Polynucleotide
taatacgactcactatagggcctcccggcctggccccagtggcagccccaaacagaggagatggggcatgcactggggcaacctggcggcagcgcaaaagatg

SEQ ID NO: 114176 - DNA, 103 bp, Artificial Sequence
  Synthetic Polynucleotide
taatacgactcactatagggttttccagggcctcccggcctggccccagtaacagaggagaactgggatgaggccgggaaacctggcggcagcgcaaaagatg

SEQ ID NO: 114177 - DNA, 103 bp, Artificial Sequence
  Synthetic Polynucleotide
taatacgactcactataggggaccagggccttttccagggcctcccggccaacagaggagaggccggatggccctggaaaacctggcggcagcgcaaaagatg

SEQ ID NO: 114178 - DNA, 103 bp, Artificial Sequence
  Synthetic Polynucleotide
taatacgactcactatagggactcctggatgaccagggccttttccagggaacagaggagaccctggatgaggccctggaacctggcggcagcgcaaaagatg

SEQ ID NO: 114179 - DNA, 103 bp, Artificial Sequence
  Synthetic Polynucleotide
taatacgactcactatagggcgcctctctgactcctggatgaccagggccaacagaggagaggccctatgcatccaggaaacctggcggcagcgcaaaagatg

SEQ ID NO: 114180 - DNA, 103 bp, Artificial Sequence
  Synthetic Polynucleotide
taatacgactcactataggggagcttcttccgcctctctgactcctggataacagaggagaatccagatgtcagagaggaacctggcggcagcgcaaaagatg

SEQ ID NO: 114181 - DNA, 103 bp, Artificial Sequence
  Synthetic Polynucleotide
taatacgactcactataggggggcccgcatcaaccccctccctctcggtaaacagaggagataccgaatgggagggggtaacctggcggcagcgcaaaagatg

SEQ ID NO: 114182 - DNA, 103 bp, Artificial Sequence
  Synthetic Polynucleotide
taatacgactcactatagggcctccccctgggaggggagacaagggacagaacagaggagactgtccatggtctcccctaacctggcggcagcgcaaaagatg

SEQ ID NO: 114183 - DNA, 103 bp, Artificial Sequence
  Synthetic Polynucleotide
taatacgactcactatagggggtggaaacggagcttcttccgcctctctgaacagaggagacagagaatgggaagaagcaacctggcggcagcgcaaaagatg

SEQ ID NO: 114184 - DNA, 103 bp, Artificial Sequence
  Synthetic Polynucleotide
taatacgactcactatagggaactgccgagggtggaaacggagcttcttcaacagaggagagaagaaatgccgtttccaaacctggcggcagcgcaaaagatg

SEQ ID NO: 114185 - DNA, 103 bp, Artificial Sequence
  Synthetic Polynucleotide
taatacgactcactatagggggacaggtacaactgccgagggtggaaacgaacagaggagacgtttcatgcctcggcagaacctggcggcagcgcaaaagatg

SEQ ID NO: 114186 - DNA, 103 bp, Artificial Sequence
  Synthetic Polynucleotide
taatacgactcactatagggcctgcttcacggacaggtacaactgccgagaacagaggagactcggcatgtgtacctgtaacctggcggcagcgcaaaagatg

SEQ ID NO: 114187 - DNA, 103 bp, Artificial Sequence
  Synthetic Polynucleotide
taatacgactcactatagggtgcagctcgccctgcttcacggacaggtacaacagaggagagtacctatgcgtgaagcaaacctggcggcagcgcaaaagatg

SEQ ID NO: 114188 - DNA, 103 bp, Artificial Sequence
  Synthetic Polynucleotide
taatacgactcactataggggatcaccttctgcagctcgccctgcttcacaacagaggagagtgaagatgggcgagctgaacctggcggcagcgcaaaagatg

SEQ ID NO: 114189 - DNA, 103 bp, Artificial Sequence
  Synthetic Polynucleotide
taatacgactcactatagggacagcatcaggatcaccttctgcagctcgcaacagaggagagcgagcatgagaaggtgaaacctggcggcagcgcaaaagatg

SEQ ID NO: 114190 - DNA, 103 bp, Artificial Sequence
  Synthetic Polynucleotide
taatacgactcactatagggaggttgtccaacagcatcaggatcaccttcaacagaggagagaaggtatgcctgatgctaacctggcggcagcgcaaaagatg

SEQ ID NO: 114191 - DNA, 103 bp, Artificial Sequence
  Synthetic Polynucleotide
taatacgactcactataggggttggggtccaggttgtccaacagcatcagaacagaggagactgatgatgttggacaacaacctggcggcagcgcaaaagatg

SEQ ID NO: 114192 - DNA, 103 bp, Artificial Sequence
  Synthetic Polynucleotide
taatacgactcactatagggcgctctggaagttggggtccaggttgtccaaacagaggagatggacaatgtggaccccaaacctggcggcagcgcaaaagatg

SEQ ID NO: 114193 - DNA, 103 bp, Artificial Sequence
  Synthetic Polynucleotide
taatacgactcactatagggtcagcgggggcctccccctgggaggggagaaacagaggagatctcccatgccagggggaaacctggcggcagcgcaaaagatg

SEQ ID NO: 114194 - DNA, 103 bp, Artificial Sequence
  Synthetic Polynucleotide
taatacgactcactatagggctctgctggtcgctctggaagttggggtccaacagaggagaggacccatgcttccagagaacctggcggcagcgcaaaagatg

SEQ ID NO: 114195 - DNA, 103 bp, Artificial Sequence
  Synthetic Polynucleotide
taatacgactcactatagggcgtgcgcttgctctgctggtcgctctggaaaacagaggagattccagatggaccagcagaacctggcggcagcgcaaaagatg

SEQ ID NO: 114196 - DNA, 103 bp, Artificial Sequence
  Synthetic Polynucleotide
taatacgactcactatagggcatgcaggggcgtgcgcttgctctgctggtaacagaggagaaccagcatggcaagcgcaaacctggcggcagcgcaaaagatg

SEQ ID NO: 114197 - DNA, 103 bp, Artificial Sequence
  Synthetic Polynucleotide
taatacgactcactatagggtgggcggctgcatgcaggggcgtgcgcttgaacagaggagacaagcgatggcccctgcaaacctggcggcagcgcaaaagatg

SEQ ID NO: 114198 - DNA, 103 bp, Artificial Sequence
  Synthetic Polynucleotide
taatacgactcactatagggggagcccttctgggcggctgcatgcaggggaacagaggagacccctgatggcagccgccaacctggcggcagcgcaaaagatg

SEQ ID NO: 114199 - DNA, 103 bp, Artificial Sequence
  Synthetic Polynucleotide
taatacgactcactatagggagatctccacggagcccttctgggcggctgaacagaggagacagccgatgagaagggctaacctggcggcagcgcaaaagatg

SEQ ID NO: 114200 - DNA, 103 bp, Artificial Sequence
  Synthetic Polynucleotide
taatacgactcactatagggagcacatggcagatctccacggagcccttcaacagaggagagaagggatgcgtggagataacctggcggcagcgcaaaagatg

SEQ ID NO: 114201 - DNA, 103 bp, Artificial Sequence
  Synthetic Polynucleotide
taatacgactcactatagggagcctgcagcagcacatggcagatctccacaacagaggagagtggagatgtgccatgtgaacctggcggcagcgcaaaagatg

SEQ ID NO: 114202 - DNA, 103 bp, Artificial Sequence
  Synthetic Polynucleotide
taatacgactcactatagggtgttggctccagcctgcagcagcacatggcaacagaggagagccatgatgtgctgcaggaacctggcggcagcgcaaaagatg

SEQ ID NO: 114203 - DNA, 103 bp, Artificial Sequence
  Synthetic Polynucleotide
taatacgactcactatagggactgcatttatgttggctccagcctgcagcaacagaggagagctgcaatgtggagccaaaacctggcggcagcgcaaaagatg

SEQ ID NO: 114204 - DNA, 103 bp, Artificial Sequence
  Synthetic Polynucleotide
taatacgactcactatagggcgcccccatctcagcgggggcctccccctgaacagaggagacaggggatggcccccgctaacctggcggcagcgcaaaagatg

SEQ ID NO: 114205 - DNA, 103 bp, Artificial Sequence
  Synthetic Polynucleotide
taatacgactcactatagggctgtttgtccactgcatttatgttggctccaacagaggagaggagccatgataaatgcaaacctggcggcagcgcaaaagatg

SEQ ID NO: 114206 - DNA, 103 bp, Artificial Sequence
  Synthetic Polynucleotide
taatacgactcactataggggcgtccgctgctgtttgtccactgcatttaaacagaggagataaatgatgtggacaaacaacctggcggcagcgcaaaagatg

SEQ ID NO: 114207 - DNA, 103 bp, Artificial Sequence
  Synthetic Polynucleotide
taatacgactcactatagggtccatcagtggcgtccgctgctgtttgtccaacagaggagaggacaaatggcagcggacaacctggcggcagcgcaaaagatg

SEQ ID NO: 114208 - DNA, 103 bp, Artificial Sequence
  Synthetic Polynucleotide
taatacgactcactatagggcaccacggcctccatcagtggcgtccgctgaacagaggagacagcggatgccactgatgaacctggcggcagcgcaaaagatg

SEQ ID NO: 114209 - DNA, 103 bp, Artificial Sequence
  Synthetic Polynucleotide
taatacgactcactatagggggtggttgttcaccacggcctccatcagtgaacagaggagacactgaatgaggccgtggaacctggcggcagcgcaaaagatg

SEQ ID NO: 114210 - DNA, 103 bp, Artificial Sequence
  Synthetic Polynucleotide
taatacgactcactataggggctacctccaggtggttgttcaccacggccaacagaggagaggccgtatggaacaaccaaacctggcggcagcgcaaaagatg

SEQ ID NO: 114211 - DNA, 103 bp, Artificial Sequence
  Synthetic Polynucleotide
taatacgactcactatagggcatgtaacgggctacctccaggtggttgttaacagaggagaaacaacatgctggaggtaaacctggcggcagcgcaaaagatg

SEQ ID NO: 114212 - DNA, 103 bp, Artificial Sequence
  Synthetic Polynucleotide
taatacgactcactatagggcacgctgcaccatgtaacgggctacctccaaacagaggagatggaggatgcccgttacaaacctggcggcagcgcaaaagatg

SEQ ID NO: 114213 - DNA, 103 bp, Artificial Sequence
  Synthetic Polynucleotide
taatacgactcactatagggacacagccaccacgctgcaccatgtaacggaacagaggagaccgttaatgggtgcagcgaacctggcggcagcgcaaaagatg

SEQ ID NO: 114214 - DNA, 103 bp, Artificial Sequence
  Synthetic Polynucleotide
taatacgactcactatagggcttgctatagacacagccaccacgctgcacaacagaggagagtgcagatgggtggctgtaacctggcggcagcgcaaaagatg

SEQ ID NO: 114215 - DNA, 103 bp, Artificial Sequence
  Synthetic Polynucleotide
taatacgactcactatagggccagcagcagcgcccccatctcagcgggggaacagaggagacccccgatgagatgggggaacctggcggcagcgcaaaagatg

SEQ ID NO: 114216 - DNA, 103 bp, Artificial Sequence
  Synthetic Polynucleotide
taatacgactcactatagggcgtcctcctccttgctatagacacagccacaacagaggagagtggctatgtctatagcaaacctggcggcagcgcaaaagatg

SEQ ID NO: 114217 - DNA, 103 bp, Artificial Sequence
  Synthetic Polynucleotide
taatacgactcactatagggcaggtggaaccgtcctcctccttgctatagaacagaggagactatagatgggaggaggaaacctggcggcagcgcaaaagatg

SEQ ID NO: 114218 - DNA, 103 bp, Artificial Sequence
  Synthetic Polynucleotide
taatacgactcactataggggtggtggaggcaggtggaaccgtcctcctcaacagaggagagaggagatgggttccaccaacctggcggcagcgcaaaagatg

SEQ ID NO: 114219 - DNA, 103 bp, Artificial Sequence
  Synthetic Polynucleotide
taatacgactcactatagggttttggctgcgtggtggaggcaggtggaacaacagaggagagttccaatggcctccaccaacctggcggcagcgcaaaagatg

SEQ ID NO: 114220 - DNA, 103 bp, Artificial Sequence
  Synthetic Polynucleotide
taatacgactcactatagggaagttcccgattttggctgcgtggtggaggaacagaggagacctccaatgcgcagccaaaacctggcggcagcgcaaaagatg

SEQ ID NO: 114221 - DNA, 103 bp, Artificial Sequence
  Synthetic Polynucleotide
taatacgactcactataggggaccatctccaagttcccgattttggctgcaacagaggagagcagccatgatcgggaacaacctggcggcagcgcaaaagatg

SEQ ID NO: 114222 - DNA, 103 bp, Artificial Sequence
  Synthetic Polynucleotide
taatacgactcactataggggcagcaggctgaccatctccaagttcccgaaacagaggagatcgggaatgtggagatggaacctggcggcagcgcaaaagatg

SEQ ID NO: 114223 - DNA, 103 bp, Artificial Sequence
  Synthetic Polynucleotide
taatacgactcactatagggcctgtgctcagcagcaggctgaccatctccaacagaggagaggagatatgcagcctgctaacctggcggcagcgcaaaagatg

SEQ ID NO: 114224 - DNA, 103 bp, Artificial Sequence
  Synthetic Polynucleotide
taatacgactcactataggggtccacctgtcctgtgctcagcagcaggctaacagaggagaagcctgatgctgagcacaaacctggcggcagcgcaaaagatg

SEQ ID NO: 114225 - DNA, 103 bp, Artificial Sequence
  Synthetic Polynucleotide
taatacgactcactataggggggcgttgacgtccacctgtcctgtgctcaaacagaggagatgagcaatggacaggtggaacctggcggcagcgcaaaagatg

SEQ ID NO: 114226 - DNA, 103 bp, Artificial Sequence
  Synthetic Polynucleotide
taatacgactcactataggggtttccttctccagcagcagcgcccccatcaacagaggagagatgggatggctgctgctaacctggcggcagcgcaaaagatg

SEQ ID NO: 114227 - DNA, 103 bp, Artificial Sequence
  Synthetic Polynucleotide
taatacgactcactatagggccactgtcctgggcgttgacgtccacctgtaacagaggagaacaggtatgcgtcaacgcaacctggcggcagcgcaaaagatg

SEQ ID NO: 114228 - DNA, 103 bp, Artificial Sequence
  Synthetic Polynucleotide
taatacgactcactatagggcgtccaccccccactgtcctgggcgttgacaacagaggagagtcaacatgcaggacagtaacctggcggcagcgcaaaagatg

SEQ ID NO: 114229 - DNA, 103 bp, Artificial Sequence
  Synthetic Polynucleotide
taatacgactcactatagggagatgatgggcgtccaccccccactgtcctaacagaggagaaggacaatggggggtggaaacctggcggcagcgcaaaagatg

SEQ ID NO: 114230 - DNA, 103 bp, Artificial Sequence
  Synthetic Polynucleotide
taatacgactcactatagggtctgcagcccagatgatgggcgtccaccccaacagaggagaggggtgatggcccatcataacctggcggcagcgcaaaagatg

SEQ ID NO: 114231 - DNA, 103 bp, Artificial Sequence
  Synthetic Polynucleotide
taatacgactcactataggggtgcttgtgctctgcagcccagatgatgggaacagaggagacccatcatgtgggctgcaaacctggcggcagcgcaaaagatg

SEQ ID NO: 114232 - DNA, 103 bp, Artificial Sequence
  Synthetic Polynucleotide
taatacgactcactatagggtcacctcgatgtgcttgtgctctgcagcccaacagaggagagggctgatgagcacaagcaacctggcggcagcgcaaaagatg

SEQ ID NO: 114233 - DNA, 103 bp, Artificial Sequence
  Synthetic Polynucleotide
taatacgactcactatagggagcatgcggatcacctcgatgtgcttgtgcaacagaggagagcacaaatgcatcgaggtaacctggcggcagcgcaaaagatg

SEQ ID NO: 114234 - DNA, 103 bp, Artificial Sequence
  Synthetic Polynucleotide
taatacgactcactatagggccgcgtcagtagcatgcggatcacctcgataacagaggagaatcgagatgatccgcatgaacctggcggcagcgcaaaagatg

SEQ ID NO: 114235 - DNA, 103 bp, Artificial Sequence
  Synthetic Polynucleotide
taatacgactcactatagggcgtcggcgccccgcgtcagtagcatgcggaaacagaggagatccgcaatgtactgacgcaacctggcggcagcgcaaaagatg

SEQ ID NO: 114236 - DNA, 103 bp, Artificial Sequence
  Synthetic Polynucleotide
taatacgactcactataggggtgagggtgacgtcggcgccccgcgtcagtaacagaggagaactgacatggggcgccgaaacctggcggcagcgcaaaagatg

SEQ ID NO: 114237 - DNA, 103 bp, Artificial Sequence
  Synthetic Polynucleotide
taatacgactcactatagggggctcctctggtttccttctccagcagcagaacagaggagactgctgatggagaaggaaaacctggcggcagcgcaaaagatg

SEQ ID NO: 114238 - DNA, 103 bp, Artificial Sequence
  Synthetic Polynucleotide
taatacgactcactatagggctcgttgtcagtgagggtgacgtcggcgccaacagaggagaggcgccatggtcaccctcaacctggcggcagcgcaaaagatg

SEQ ID NO: 114239 - DNA, 103 bp, Artificial Sequence
  Synthetic Polynucleotide
taatacgactcactatagggagatgttctcctcgttgtcagtgagggtgaaacagaggagatcacccatgctgacaacgaacctggcggcagcgcaaaagatg

SEQ ID NO: 114240 - DNA, 103 bp, Artificial Sequence
  Synthetic Polynucleotide
taatacgactcactatagggcagtgcaggcagatgttctcctcgttgtcaaacagaggagatgacaaatgggagaacataacctggcggcagcgcaaaagatg

SEQ ID NO: 114241 - DNA, 103 bp, Artificial Sequence
  Synthetic Polynucleotide
taatacgactcactataggggaaggaggcccagtgcaggcagatgttctcaacagaggagagagaacatgtgcctgcacaacctggcggcagcgcaaaagatg

SEQ ID NO: 114242 - DNA, 103 bp, Artificial Sequence
  Synthetic Polynucleotide
taatacgactcactatagggcgctgcccgtgaaggaggcccagtgcaggcaacagaggagagcctgcatggggcctcctaacctggcggcagcgcaaaagatg

SEQ ID NO: 114243 - DNA, 103 bp, Artificial Sequence
  Synthetic Polynucleotide
taatacgactcactataggggcgatggcggcgctgcccgtgaaggaggccaacagaggagaggcctcatgcacgggcagaacctggcggcagcgcaaaagatg

SEQ ID NO: 114244 - DNA, 103 bp, Artificial Sequence
  Synthetic Polynucleotide
taatacgactcactatagggaaggacttcggcgatggcggcgctgcccgtaacagaggagaacgggcatggccgccatcaacctggcggcagcgcaaaagatg

SEQ ID NO: 114245 - DNA, 103 bp, Artificial Sequence
  Synthetic Polynucleotide
taatacgactcactataggggcgcattcagaaggacttcggcgatggcggaacagaggagaccgccaatgccgaagtccaacctggcggcagcgcaaaagatg

SEQ ID NO: 114246 - DNA, 103 bp, Artificial Sequence
  Synthetic Polynucleotide
taatacgactcactatagggaggtcacagcgcgcattcagaaggacttcgaacagaggagacgaagtatgtctgaatgcaacctggcggcagcgcaaaagatg

SEQ ID NO: 114247 - DNA, 103 bp, Artificial Sequence
  Synthetic Polynucleotide
taatacgactcactataggggacagcatggaggtcacagcgcgcattcagaacagaggagactgaatatgcgctgtgacaacctggcggcagcgcaaaagatg

SEQ ID NO: 114248 - DNA, 103 bp, Artificial Sequence
  Synthetic Polynucleotide
taatacgactcactatagggctctctcggtggctcctctggtttccttctaacagaggagaagaaggatgccagaggagaacctggcggcagcgcaaaagatg

SEQ ID NO: 114249 - DNA, 103 bp, Artificial Sequence
  Synthetic Polynucleotide
taatacgactcactatagggcatggtagttgacagcatggaggtcacagcaacagaggagagctgtgatgtccatgctgaacctggcggcagcgcaaaagatg

SEQ ID NO: 114250 - DNA, 103 bp, Artificial Sequence
  Synthetic Polynucleotide
taatacgactcactatagggggggtgtccccatggtagttgacagcatggaacagaggagaccatgcatgcaactaccaaacctggcggcagcgcaaaagatg

SEQ ID NO: 114251 - DNA, 103 bp, Artificial Sequence
  Synthetic Polynucleotide
taatacgactcactataggggatgtgcaggggggtgtccccatggtagttaacagaggagaaactacatgggggacaccaacctggcggcagcgcaaaagatg

SEQ ID NO: 114252 - DNA, 103 bp, Artificial Sequence
  Synthetic Polynucleotide
taatacgactcactatagggcccgagctgcgatgtgcaggggggtgtcccaacagaggagagggacaatgccctgcacaaacctggcggcagcgcaaaagatg

SEQ ID NO: 114253 - DNA, 103 bp, Artificial Sequence
  Synthetic Polynucleotide
taatacgactcactatagggtggtagctctcccgagctgcgatgtgcaggaacagaggagacctgcaatgcgcagctcgaacctggcggcagcgcaaaagatg

SEQ ID NO: 114254 - DNA, 103 bp, Artificial Sequence
  Synthetic Polynucleotide
taatacgactcactatagggcacgcagtcatggtagctctcccgagctgcaacagaggagagcagctatggagagctacaacctggcggcagcgcaaaagatg

SEQ ID NO: 114255 - DNA, 103 bp, Artificial Sequence
  Synthetic Polynucleotide
taatacgactcactatagggggaataacagcacgcagtcatggtagctctaacagaggagaagagctatgatgactgcgaacctggcggcagcgcaaaagatg

SEQ ID NO: 114256 - DNA, 103 bp, Artificial Sequence
  Synthetic Polynucleotide
taatacgactcactatagggccacgtgacaggaataacagcacgcagtcaaacagaggagatgactgatggctgttattaacctggcggcagcgcaaaagatg

SEQ ID NO: 114257 - DNA, 103 bp, Artificial Sequence
  Synthetic Polynucleotide
taatacgactcactatagggagggttggccccacgtgacaggaataacagaacagaggagactgttaatgctgtcacgtaacctggcggcagcgcaaaagatg

SEQ ID NO: 114258 - DNA, 103 bp, Artificial Sequence
  Synthetic Polynucleotide
taatacgactcactatagggtccgcagctcagggttggccccacgtgacaaacagaggagatgtcacatggggccaaccaacctggcggcagcgcaaaagatg

SEQ ID NO: 114259 - DNA, 103 bp, Artificial Sequence
  Synthetic Polynucleotide
taatacgactcactataggggagccatgaactctctcggtggctcctctgaacagaggagacagaggatgcaccgagagaacctggcggcagcgcaaaagatg

SEQ ID NO: 114260 - DNA, 103 bp, Artificial Sequence
  Synthetic Polynucleotide
taatacgactcactatagggccctctttgttccgcagctcagggttggccaacagaggagaggccaaatgtgagctgcgaacctggcggcagcgcaaaagatg

SEQ ID NO: 114261 - DNA, 103 bp, Artificial Sequence
  Synthetic Polynucleotide
taatacgactcactatagggtgctgtgtccccctctttgttccgcagctcaacagaggagagagctgatgaacaaagagaacctggcggcagcgcaaaagatg

SEQ ID NO: 114262 - DNA, 103 bp, Artificial Sequence
  Synthetic Polynucleotide
taatacgactcactatagggtcaggtcccatgctgtgtccccctctttgtaacagaggagaacaaagatggggacacagaacctggcggcagcgcaaaagatg

SEQ ID NO: 114263 - DNA, 103 bp, Artificial Sequence
  Synthetic Polynucleotide
taatacgactcactatagggcgctcgggagtcaggtcccatgctgtgtccaacagaggagaggacacatgatgggacctaacctggcggcagcgcaaaagatg

SEQ ID NO: 114264 - DNA, 103 bp, Artificial Sequence
  Synthetic Polynucleotide
taatacgactcactatagggcacgtcggagcgctcgggagtcaggtcccaaacagaggagatgggacatgactcccgagaacctggcggcagcgcaaaagatg

SEQ ID NO: 114265 - DNA, 103 bp, Artificial Sequence
  Synthetic Polynucleotide
taatacgactcactataggggcgcaaaccacacgtcggagcgctcgggagaacagaggagactcccgatggctccgacgaacctggcggcagcgcaaaagatg

SEQ ID NO: 114266 - DNA, 103 bp, Artificial Sequence
  Synthetic Polynucleotide
taatacgactcactatagggttgagttgaagcgcaaaccacacgtcggagaacagaggagactccgaatggtggtttgcaacctggcggcagcgcaaaagatg

SEQ ID NO: 114267 - DNA, 103 bp, Artificial Sequence
  Synthetic Polynucleotide
taatacgactcactataggggagcttgcggttgagttgaagcgcaaaccaaacagaggagatggtttatgcttcaactcaacctggcggcagcgcaaaagatg

SEQ ID NO: 114268 - DNA, 103 bp, Artificial Sequence
  Synthetic Polynucleotide
taatacgactcactatagggccccaagtcggagcttgcggttgagttgaaaacagaggagattcaacatgaccgcaagcaacctggcggcagcgcaaaagatg

SEQ ID NO: 114269 - DNA, 103 bp, Artificial Sequence
  Synthetic Polynucleotide
taatacgactcactatagggcgatttcccaccccaagtcggagcttgcggaacagaggagaccgcaaatgccgacttggaacctggcggcagcgcaaaagatg

SEQ ID NO: 114270 - DNA, 103 bp, Artificial Sequence
  Synthetic Polynucleotide
taatacgactcactataggggtcccccaaagagccatgaactctctcggtaacagaggagaaccgagatggttcatggcaacctggcggcagcgcaaaagatg

SEQ ID NO: 114271 - DNA, 103 bp, Artificial Sequence
  Synthetic Polynucleotide
taatacgactcactataggggcggatggcccgatttcccaccccaagtcgaacagaggagacgacttatggtgggaaataacctggcggcagcgcaaaagatg

SEQ ID NO: 114272 - DNA, 103 bp, Artificial Sequence
  Synthetic Polynucleotide
taatacgactcactatagggtcttctctgtgcggatggcccgatttcccaaacagaggagatgggaaatggggccatccaacctggcggcagcgcaaaagatg

SEQ ID NO: 114273 - DNA, 103 bp, Artificial Sequence
  Synthetic Polynucleotide
taatacgactcactatagggcggcagatgatcttctctgtgcggatggccaacagaggagaggccatatgcacagagaaaacctggcggcagcgcaaaagatg

SEQ ID NO: 114274 - DNA, 103 bp, Artificial Sequence
  Synthetic Polynucleotide
taatacgactcactatagggagccacgtcccggcagatgatcttctctgtaacagaggagaacagagatgatcatctgcaacctggcggcagcgcaaaagatg

SEQ ID NO: 114275 - DNA, 103 bp, Artificial Sequence
  Synthetic Polynucleotide
taatacgactcactatagggcatagccccgagccacgtcccggcagatgaaacagaggagatcatctatggggacgtggaacctggcggcagcgcaaaagatg

SEQ ID NO: 114276 - DNA, 103 bp, Artificial Sequence
  Synthetic Polynucleotide
taatacgactcactatagggggcacgttctcatagccccgagccacgtccaacagaggagaggacgtatgtcggggctaaacctggcggcagcgcaaaagatg

SEQ ID NO: 114277 - DNA, 103 bp, Artificial Sequence
  Synthetic Polynucleotide
taatacgactcactatagggacagggaatgggcacgttctcatagccccgaacagaggagacggggcatggagaacgtgaacctggcggcagcgcaaaagatg

SEQ ID NO: 114278 - DNA, 103 bp, Artificial Sequence
  Synthetic Polynucleotide
taatacgactcactatagggcaccgttgacacagggaatgggcacgttctaacagaggagaagaacgatgccattccctaacctggcggcagcgcaaaagatg

SEQ ID NO: 114279 - DNA, 103 bp, Artificial Sequence
  Synthetic Polynucleotide
taatacgactcactatagggtccccatccacaccgttgacacagggaatgaacagaggagacattccatgtgtcaacggaacctggcggcagcgcaaaagatg

SEQ ID NO: 114280 - DNA, 103 bp, Artificial Sequence
  Synthetic Polynucleotide
taatacgactcactatagggagggcagggctccccatccacaccgttgacaacagaggagagtcaacatggtggatgggaacctggcggcagcgcaaaagatg

SEQ ID NO: 114281 - DNA, 103 bp, Artificial Sequence
  Synthetic Polynucleotide
taatacgactcactatagggtacgaggggtgtcccccaaagagccatgaaaacagaggagattcatgatgctttgggggaacctggcggcagcgcaaaagatg

SEQ ID NO: 114282 - DNA, 103 bp, Artificial Sequence
  Synthetic Polynucleotide
taatacgactcactatagggtgtaatcctcagggcagggctccccatccaaacagaggagatggatgatgagccctgccaacctggcggcagcgcaaaagatg

SEQ ID NO: 114283 - DNA, 103 bp, Artificial Sequence
  Synthetic Polynucleotide
taatacgactcactataggggagatgtacttgtaatcctcagggcagggcaacagaggagagccctgatgtgaggattaaacctggcggcagcgcaaaagatg

SEQ ID NO: 114284 - DNA, 103 bp, Artificial Sequence
  Synthetic Polynucleotide
taatacgactcactataggggcagttctctgagatgtacttgtaatcctcaacagaggagagaggatatgaagtacatcaacctggcggcagcgcaaaagatg

SEQ ID NO: 114285 - DNA, 103 bp, Artificial Sequence
  Synthetic Polynucleotide
taatacgactcactatagggtggacgtctcgcagttctctgagatgtactaacagaggagaagtacaatgcagagaactaacctggcggcagcgcaaaagatg

SEQ ID NO: 114286 - DNA, 103 bp, Artificial Sequence
  Synthetic Polynucleotide
taatacgactcactatagggatgttcatggtggacgtctcgcagttctctaacagaggagaagagaaatgcgagacgtcaacctggcggcagcgcaaaagatg

SEQ ID NO: 114287 - DNA, 103 bp, Artificial Sequence
  Synthetic Polynucleotide
taatacgactcactataggggttgcgatcgatgttcatggtggacgtctcaacagaggagagagacgatgaccatgaacaacctggcggcagcgcaaaagatg

SEQ ID NO: 114288 - DNA, 103 bp, Artificial Sequence
  Synthetic Polynucleotide
taatacgactcactatagggggtgggtgatgttgcgatcgatgttcatggaacagaggagaccatgaatgtcgatcgcaaacctggcggcagcgcaaaagatg

SEQ ID NO: 114289 - DNA, 103 bp, Artificial Sequence
  Synthetic Polynucleotide
taatacgactcactatagggcagtgctgcaggtgggtgatgttgcgatcgaacagaggagacgatcgatgcatcacccaaacctggcggcagcgcaaaagatg

SEQ ID NO: 114290 - DNA, 103 bp, Artificial Sequence
  Synthetic Polynucleotide
taatacgactcactatagggcacacacgtgcagtgctgcaggtgggtgataacagaggagaatcaccatgctgcagcacaacctggcggcagcgcaaaagatg

SEQ ID NO: 114291 - DNA, 103 bp, Artificial Sequence
  Synthetic Polynucleotide
taatacgactcactatagggagcagtcgtccacacacgtgcagtgctgcaaacagaggagatgcagcatggcacgtgtgaacctggcggcagcgcaaaagatg

SEQ ID NO: 114292 - DNA, 103 bp, Artificial Sequence
  Synthetic Polynucleotide
taatacgactcactatagggcccctcccccgggcccgcatcaaccccctcaacagaggagagaggggatggatgcgggcaacctggcggcagcgcaaaagatg

SEQ ID NO: 114293 - DNA, 103 bp, Artificial Sequence
  Synthetic Polynucleotide
taatacgactcactataggggtttcttcactacgaggggtgtcccccaaaaacagaggagatttgggatgcacccctcgaacctggcggcagcgcaaaagatg

SEQ ID NO: 114294 - DNA, 103 bp, Artificial Sequence
  Synthetic Polynucleotide
taatacgactcactatagggttggagctagagcagtcgtccacacacgtgaacagaggagacacgtgatgggacgactgaacctggcggcagcgcaaaagatg

SEQ ID NO: 114295 - DNA, 103 bp, Artificial Sequence
  Synthetic Polynucleotide
taatacgactcactataggggcacaggcagttggagctagagcagtcgtcaacagaggagagacgacatgtctagctccaacctggcggcagcgcaaaagatg

SEQ ID NO: 114296 - DNA, 103 bp, Artificial Sequence
  Synthetic Polynucleotide
taatacgactcactatagggtgagctggccgcacaggcagttggagctagaacagaggagactagctatgactgcctgtaacctggcggcagcgcaaaagatg

SEQ ID NO: 114297 - DNA, 103 bp, Artificial Sequence
  Synthetic Polynucleotide
taatacgactcactatagggcaccggatgctgagctggccgcacaggcagaacagaggagactgcctatgcggccagctaacctggcggcagcgcaaaagatg

SEQ ID NO: 114298 - DNA, 103 bp, Artificial Sequence
  Synthetic Polynucleotide
taatacgactcactataggggtcataccagcaccggatgctgagctggccaacagaggagaggccagatgagcatccggaacctggcggcagcgcaaaagatg

SEQ ID NO: 114299 - DNA, 103 bp, Artificial Sequence
  Synthetic Polynucleotide
taatacgactcactataggggcccatccttgtcataccagcaccggatgcaacagaggagagcatccatggctggtatgaacctggcggcagcgcaaaagatg

SEQ ID NO: 114300 - DNA, 103 bp, Artificial Sequence
  Synthetic Polynucleotide
taatacgactcactatagggtggagcaatcgcccatccttgtcataccagaacagaggagactggtaatgcaaggatggaacctggcggcagcgcaaaagatg

SEQ ID NO: 114301 - DNA, 103 bp, Artificial Sequence
  Synthetic Polynucleotide
taatacgactcactataggggttaaattcctggagcaatcgcccatccttaacagaggagaaaggatatgcgattgctcaacctggcggcagcgcaaaagatg

SEQ ID NO: 114302 - DNA, 103 bp, Artificial Sequence
  Synthetic Polynucleotide
taatacgactcactataggggctcaatcttgttaaattcctggagcaatcaacagaggagagattgcatgaggaatttaaacctggcggcagcgcaaaagatg

SEQ ID NO: 114303 - DNA, 103 bp, Artificial Sequence
  Synthetic Polynucleotide
taatacgactcactatagggatcagcggaggctcaatcttgttaaattccaacagaggagaggaattatgcaagattgaaacctggcggcagcgcaaaagatg

SEQ ID NO: 114304 - DNA, 103 bp, Artificial Sequence
  Synthetic Polynucleotide
taatacgactcactatagggcttgggcagggtttcttcactacgaggggtaacagaggagaacccctatgagtgaagaaaacctggcggcagcgcaaaagatg

SEQ ID NO: 114305 - DNA, 103 bp, Artificial Sequence
  Synthetic Polynucleotide
taatacgactcactatagggacactcgaaaatcagcggaggctcaatcttaacagaggagaaagattatgcctccgctgaacctggcggcagcgcaaaagatg

SEQ ID NO: 114306 - DNA, 103 bp, Artificial Sequence
  Synthetic Polynucleotide
taatacgactcactatagggacgcctggttacactcgaaaatcagcggagaacagaggagactccgcatgttttcgagtaacctggcggcagcgcaaaagatg

SEQ ID NO: 114307 - DNA, 103 bp, Artificial Sequence
  Synthetic Polynucleotide
taatacgactcactatagggcagcatgagcacgcctggttacactcgaaaaacagaggagatttcgaatgtaaccaggcaacctggcggcagcgcaaaagatg

SEQ ID NO: 114308 - DNA, 103 bp, Artificial Sequence
  Synthetic Polynucleotide
taatacgactcactataggggcagtttctccagcatgagcacgcctggttaacagaggagaaaccagatgtgctcatgcaacctggcggcagcgcaaaagatg

SEQ ID NO: 114309 - DNA, 103 bp, Artificial Sequence
  Synthetic Polynucleotide
taatacgactcactatagggcccggttcttgcagtttctccagcatgagcaacagaggagagctcatatgggagaaactaacctggcggcagcgcaaaagatg

SEQ ID NO: 114310 - DNA, 103 bp, Artificial Sequence
  Synthetic Polynucleotide
taatacgactcactatagggctctgtacgacccggttcttgcagtttctcaacagaggagagagaaaatgcaagaaccgaacctggcggcagcgcaaaagatg

SEQ ID NO: 114311 - DNA, 103 bp, Artificial Sequence
  Synthetic Polynucleotide
taatacgactcactatagggcttgatgccactctgtacgacccggttcttaacagaggagaaagaacatggtcgtacagaacctggcggcagcgcaaaagatg

SEQ ID NO: 114312 - DNA, 103 bp, Artificial Sequence
  Synthetic Polynucleotide
taatacgactcactataggggtagccgcaccttgatgccactctgtacgaaacagaggagatcgtacatggtggcatcaaacctggcggcagcgcaaaagatg

SEQ ID NO: 114313 - DNA, 103 bp, Artificial Sequence
  Synthetic Polynucleotide
taatacgactcactatagggcggtagagctgtagccgcaccttgatgccaaacagaggagatggcatatgggtgcggctaacctggcggcagcgcaaaagatg

SEQ ID NO: 114314 - DNA, 103 bp, Artificial Sequence
  Synthetic Polynucleotide
taatacgactcactatagggcttggctgttcggtagagctgtagccgcacaacagaggagagtgcggatgcagctctacaacctggcggcagcgcaaaagatg

SEQ ID NO: 114315 - DNA, 103 bp, Artificial Sequence
  Synthetic Polynucleotide
taatacgactcactatagggcgggggtggccttgggcagggtttcttcacaacagaggagagtgaagatgccctgcccaaacctggcggcagcgcaaaagatg

SEQ ID NO: 114316 - DNA, 103 bp, Artificial Sequence
  Synthetic Polynucleotide
taatacgactcactatagggcccagcccatcttggctgttcggtagagctaacagaggagaagctctatggaacagccaaacctggcggcagcgcaaaagatg

SEQ ID NO: 114317 - DNA, 103 bp, Artificial Sequence
  Synthetic Polynucleotide
taatacgactcactataggggcgcggaccccccagcccatcttggctgttaacagaggagaaacagcatggatgggctgaacctggcggcagcgcaaaagatg

SEQ ID NO: 114318 - DNA, 103 bp, Artificial Sequence
  Synthetic Polynucleotide
taatacgactcactatagggggtctgcagggcgcggaccccccagcccataacagaggagaatgggcatgggggtccgcaacctggcggcagcgcaaaagatg

SEQ ID NO: 114319 - DNA, 103 bp, Artificial Sequence
  Synthetic Polynucleotide
taatacgactcactatagggcctgtgggatggtctgcagggcgcggacccaacagaggagagggtccatgccctgcagaaacctggcggcagcgcaaaagatg

SEQ ID NO: 114320 - DNA, 103 bp, Artificial Sequence
  Synthetic Polynucleotide
taatacgactcactatagggatgaaggtcccctgtgggatggtctgcaggaacagaggagacctgcaatgcatcccacaaacctggcggcagcgcaaaagatg

SEQ ID NO: 114321 - DNA, 103 bp, Artificial Sequence
  Synthetic Polynucleotide
taatacgactcactatagggatactcgcagatgaaggtcccctgtgggataacagaggagaatcccaatggggaccttcaacctggcggcagcgcaaaagatg

SEQ ID NO: 114322 - DNA, 103 bp, Artificial Sequence
  Synthetic Polynucleotide
taatacgactcactataggggctccccgacatactcgcagatgaaggtccaacagaggagaggacctatgtctgcgagtaacctggcggcagcgcaaaagatg

SEQ ID NO: 114323 - DNA, 103 bp, Artificial Sequence
  Synthetic Polynucleotide
taatacgactcactatagggtcagagatcagctccccgacatactcgcagaacagaggagactgcgaatgtgtcggggaaacctggcggcagcgcaaaagatg

SEQ ID NO: 114324 - DNA, 103 bp, Artificial Sequence
  Synthetic Polynucleotide
taatacgactcactatagggagcctcagcatcagagatcagctccccgacaacagaggagagtcgggatgctgatctctaacctggcggcagcgcaaaagatg

SEQ ID NO: 114325 - DNA, 103 bp, Artificial Sequence
  Synthetic Polynucleotide
taatacgactcactatagggctctcacatcagcctcagcatcagagatcaaacagaggagatgatctatgatgctgaggaacctggcggcagcgcaaaagatg

SEQ ID NO: 114326 - DNA, 103 bp, Artificial Sequence
  Synthetic Polynucleotide
taatacgactcactatagggtccagggagtcgggggtggccttgggcaggaacagaggagacctgccatgggccaccccaacctggcggcagcgcaaaagatg

SEQ ID NO: 114327 - DNA, 103 bp, Artificial Sequence
  Synthetic Polynucleotide
taatacgactcactataggggaatcatcctctctcacatcagcctcagcaaacagaggagatgctgaatgtgatgtgagaacctggcggcagcgcaaaagatg

SEQ ID NO: 114328 - DNA, 103 bp, Artificial Sequence
  Synthetic Polynucleotide
taatacgactcactataggggaagaggtaagaatcatcctctctcacatcaacagaggagagatgtgatggaggatgataacctggcggcagcgcaaaagatg

SEQ ID NO: 114329 - DNA, 103 bp, Artificial Sequence
  Synthetic Polynucleotide
taatacgactcactatagggtgtctaagtcgaagaggtaagaatcatcctaacagaggagaaggatgatgcttacctctaacctggcggcagcgcaaaagatg

SEQ ID NO: 114330 - DNA, 103 bp, Artificial Sequence
  Synthetic Polynucleotide
taatacgactcactatagggccatccttgttgtctaagtcgaagaggtaaaacagaggagattacctatgcgacttagaaacctggcggcagcgcaaaagatg

SEQ ID NO: 114331 - DNA, 103 bp, Artificial Sequence
  Synthetic Polynucleotide
taatacgactcactataggggtacacctctccatccttgttgtctaagtcaacagaggagagacttaatgaacaaggataacctggcggcagcgcaaaagatg

SEQ ID NO: 114332 - DNA, 103 bp, Artificial Sequence
  Synthetic Polynucleotide
taatacgactcactatagggcatctatgcagtacacctctccatccttgtaacagaggagaacaaggatggagaggtgtaacctggcggcagcgcaaaagatg

SEQ ID NO: 114333 - DNA, 103 bp, Artificial Sequence
  Synthetic Polynucleotide
taatacgactcactatagggtagtaacgggcatctatgcagtacacctctaacagaggagaagaggtatgctgcatagaaacctggcggcagcgcaaaagatg

SEQ ID NO: 114334 - DNA, 103 bp, Artificial Sequence
  Synthetic Polynucleotide
taatacgactcactataggggatgttgccatagtaacgggcatctatgcaaacagaggagatgcataatggcccgttacaacctggcggcagcgcaaaagatg

SEQ ID NO: 114335 - DNA, 103 bp, Artificial Sequence
  Synthetic Polynucleotide
taatacgactcactatagggtgaagcggctgatgttgccatagtaacgggaacagaggagacccgttatgatggcaacaaacctggcggcagcgcaaaagatg

SEQ ID NO: 114336 - DNA, 103 bp, Artificial Sequence
  Synthetic Polynucleotide
taatacgactcactatagggaggtggttgatgaagcggctgatgttgccaaacagaggagatggcaaatgcagccgcttaacctggcggcagcgcaaaagatg

SEQ ID NO: 114337 - DNA, 103 bp, Artificial Sequence
  Synthetic Polynucleotide
taatacgactcactataggggccagcaggctccagggagtcgggggtggcaacagaggagagccaccatggactccctgaacctggcggcagcgcaaaagatg

SEQ ID NO: 114338 - DNA, 103 bp, Artificial Sequence
  Synthetic Polynucleotide
taatacgactcactatagggggggtcacacaggtggttgatgaagcggctaacagaggagaagccgcatgatcaaccacaacctggcggcagcgcaaaagatg

SEQ ID NO: 114339 - DNA, 103 bp, Artificial Sequence
  Synthetic Polynucleotide
taatacgactcactataggggaatgatgttggggtcacacaggtggttgaaacagaggagatcaaccatgtgtgtgaccaacctggcggcagcgcaaaagatg

SEQ ID NO: 114340 - DNA, 103 bp, Artificial Sequence
  Synthetic Polynucleotide
taatacgactcactatagggacccggacgggaatgatgttggggtcacacaacagaggagagtgtgaatgcaacatcataacctggcggcagcgcaaaagatg

SEQ ID NO: 114341 - DNA, 103 bp, Artificial Sequence
  Synthetic Polynucleotide
taatacgactcactatagggcagcatgaagacccggacgggaatgatgttaacagaggagaaacatcatgcccgtccggaacctggcggcagcgcaaaagatg

SEQ ID NO: 114342 - DNA, 103 bp, Artificial Sequence
  Synthetic Polynucleotide
taatacgactcactatagggggtcttggtgcagcatgaagacccggacggaacagaggagaccgtccatgtcttcatgcaacctggcggcagcgcaaaagatg

SEQ ID NO: 114343 - DNA, 103 bp, Artificial Sequence
  Synthetic Polynucleotide
taatacgactcactatagggggaaatcgcaggtcttggtgcagcatgaagaacagaggagacttcatatggcaccaagaaacctggcggcagcgcaaaagatg

SEQ ID NO: 114344 - DNA, 103 bp, Artificial Sequence
  Synthetic Polynucleotide
taatacgactcactatagggggcgatgcgtggaaatcgcaggtcttggtgaacagaggagacaccaaatgctgcgatttaacctggcggcagcgcaaaagatg

SEQ ID NO: 114345 - DNA, 103 bp, Artificial Sequence
  Synthetic Polynucleotide
taatacgactcactatagggaactgaagaaggcgatgcgtggaaatcgcaaacagaggagatgcgatatgcacgcatcgaacctggcggcagcgcaaaagatg

SEQ ID NO: 114346 - DNA, 103 bp, Artificial Sequence
  Synthetic Polynucleotide
taatacgactcactatagggatgtctcgggaactgaagaaggcgatgcgtaacagaggagaacgcatatgcttcttcagaacctggcggcagcgcaaaagatg

SEQ ID NO: 114347 - DNA, 103 bp, Artificial Sequence
  Synthetic Polynucleotide
taatacgactcactatagggcccagtccggatgtctcgggaactgaagaaaacagaggagattcttcatgtcccgagacaacctggcggcagcgcaaaagatg

SEQ ID NO: 114348 - DNA, 103 bp, Artificial Sequence
  Synthetic Polynucleotide
taatacgactcactataggggagatgaggggccagcaggctccagggagtaacagaggagaactcccatgagcctgctgaacctggcggcagcgcaaaagatg

SEQ ID NO: 114349 - DNA, 103 bp, Artificial Sequence
  Synthetic Polynucleotide
taatacgactcactatagggctagctcctccccagtccggatgtctcgggaacagaggagacccgagatgtccggactgaacctggcggcagcgcaaaagatg

SEQ ID NO: 114350 - DNA, 103 bp, Artificial Sequence
  Synthetic Polynucleotide
taatacgactcactatagggtagtcaaaccctagctcctccccagtccggaacagaggagaccggacatgggaggagctaacctggcggcagcgcaaaagatg

SEQ ID NO: 114351 - DNA, 103 bp, Artificial Sequence
  Synthetic Polynucleotide
taatacgactcactataggggcggtcgccatagtcaaaccctagctcctcaacagaggagagaggagatggggtttgacaacctggcggcagcgcaaaagatg

SEQ ID NO: 114352 - DNA, 103 bp, Artificial Sequence
  Synthetic Polynucleotide
taatacgactcactatagggtgtcccagaagcggtcgccatagtcaaaccaacagaggagaggtttgatgatggcgaccaacctggcggcagcgcaaaagatg

SEQ ID NO: 114353 - DNA, 103 bp, Artificial Sequence
  Synthetic Polynucleotide
taatacgactcactatagggttgcttttgatgtcccagaagcggtcgccaaacagaggagatggcgaatgcttctgggaaacctggcggcagcgcaaaagatg

SEQ ID NO: 114354 - DNA, 103 bp, Artificial Sequence
  Synthetic Polynucleotide
taatacgactcactatagggggtgaaatatttgcttttgatgtcccagaaaacagaggagattctggatgatcaaaagcaacctggcggcagcgcaaaagatg

SEQ ID NO: 114355 - DNA, 103 bp, Artificial Sequence
  Synthetic Polynucleotide
taatacgactcactatagggcacattggcaggtgaaatatttgcttttgaaacagaggagatcaaaaatgaatatttcaaacctggcggcagcgcaaaagatg

SEQ ID NO: 114356 - DNA, 103 bp, Artificial Sequence
  Synthetic Polynucleotide
taatacgactcactatagggttctcagagccacattggcaggtgaaatataacagaggagaatatttatgctgccaatgaacctggcggcagcgcaaaagatg

SEQ ID NO: 114357 - DNA, 103 bp, Artificial Sequence
  Synthetic Polynucleotide
taatacgactcactataggggtgcttgcacttctcagagccacattggcaaacagaggagatgccaaatgggctctgagaacctggcggcagcgcaaaagatg

SEQ ID NO: 114358 - DNA, 103 bp, Artificial Sequence
  Synthetic Polynucleotide
taatacgactcactatagggcttcggctgagtgcttgcacttctcagagcaacagaggagagctctgatgagtgcaagcaacctggcggcagcgcaaaagatg

SEQ ID NO: 114359 - DNA, 103 bp, Artificial Sequence
  Synthetic Polynucleotide
taatacgactcactatagggacagaggctggagatgaggggccagcaggcaacagaggagagcctgcatgcccctcatcaacctggcggcagcgcaaaagatg

SEQ ID NO: 114360 - DNA, 103 bp, Artificial Sequence
  Synthetic Polynucleotide
taatacgactcactatagggagggcaatggcttcggctgagtgcttgcacaacagaggagagtgcaaatgctcagccgaaacctggcggcagcgcaaaagatg

SEQ ID NO: 114361 - DNA, 103 bp, Artificial Sequence
  Synthetic Polynucleotide
taatacgactcactataggggctctgctccagggcaatggcttcggctgaaacagaggagatcagccatggccattgccaacctggcggcagcgcaaaagatg

SEQ ID NO: 114362 - DNA, 103 bp, Artificial Sequence
  Synthetic Polynucleotide
taatacgactcactataggggggccagacggctctgctccagggcaatggaacagaggagaccattgatgtggagcagaaacctggcggcagcgcaaaagatg

SEQ ID NO: 114363 - DNA, 103 bp, Artificial Sequence
  Synthetic Polynucleotide
taatacgactcactataggggggtccaggcgggccagacggctctgctccaacagaggagaggagcaatgccgtctggcaacctggcggcagcgcaaaagatg

SEQ ID NO: 114364 - DNA, 103 bp, Artificial Sequence
  Synthetic Polynucleotide
taatacgactcactatagggctcagggtgtgggtccaggcgggccagacgaacagaggagacgtctgatgcgcctggacaacctggcggcagcgcaaaagatg

SEQ ID NO: 114365 - DNA, 103 bp, Artificial Sequence
  Synthetic Polynucleotide
taatacgactcactatagggcgggcagcagctcagggtgtgggtccaggcaacagaggagagcctggatgcacaccctgaacctggcggcagcgcaaaagatg

SEQ ID NO: 114366 - DNA, 103 bp, Artificial Sequence
  Synthetic Polynucleotide
taatacgactcactataggggagccgagctcgggcagcagctcagggtgtaacagaggagaacacccatggctgctgccaacctggcggcagcgcaaaagatg

SEQ ID NO: 114367 - DNA, 103 bp, Artificial Sequence
  Synthetic Polynucleotide
taatacgactcactatagggagggggcagggagccgagctcgggcagcagaacagaggagactgctgatggagctcggcaacctggcggcagcgcaaaagatg

SEQ ID NO: 114368 - DNA, 103 bp, Artificial Sequence
  Synthetic Polynucleotide
taatacgactcactatagggatgtgttgacagggggcagggagccgagctaacagaggagaagctcgatgccctgccccaacctggcggcagcgcaaaagatg

SEQ ID NO: 114369 - DNA, 103 bp, Artificial Sequence
  Synthetic Polynucleotide
taatacgactcactatagggagtgacagtgacagaggctggagatgagggaacagaggagaccctcaatgccagcctctaacctggcggcagcgcaaaagatg

SEQ ID NO: 114370 - DNA, 103 bp, Artificial Sequence
  Synthetic Polynucleotide
taatacgactcactatagggcatcaccaacagtgacagtgacagaggctgaacagaggagacagcctatgtcactgtcaaacctggcggcagcgcaaaagatg

SEQ ID NO: 114371 - DNA, 103 bp, Artificial Sequence
  Synthetic Polynucleotide
taatacgactcactatagggtcagccccctcatcaccaacagtgacagtgaacagaggagacactgtatgtgttggtgaaacctggcggcagcgcaaaagatg

SEQ ID NO: 114372 - DNA, 103 bp, Artificial Sequence
  Synthetic Polynucleotide
taatacgactcactatagggggccgcacgacccctcccccgggcccgcataacagaggagaatgcggatgcgggggaggaacctggcggcagcgcaaaagatg

SEQ ID NO: 114373 - DNA, 103 bp, Artificial Sequence
  Synthetic Polynucleotide
taatacgactcactatagggtacaggggtgtcagccccctcatcaccaacaacagaggagagttggtatggagggggctaacctggcggcagcgcaaaagatg

SEQ ID NO: 114374 - DNA, 103 bp, Artificial Sequence
  Synthetic Polynucleotide
taatacgactcactataggggtgtagcccctacaggggtgtcagccccctaacagaggagaagggggatgacacccctgaacctggcggcagcgcaaaagatg

SEQ ID NO: 114375 - DNA, 103 bp, Artificial Sequence
  Synthetic Polynucleotide
taatacgactcactatagggccaatgagtggtgtagcccctacaggggtgaacagaggagacaccccatgaggggctacaacctggcggcagcgcaaaagatg

SEQ ID NO: 114376 - DNA, 103 bp, Artificial Sequence
  Synthetic Polynucleotide
taatacgactcactatagggagattcatccccaatgagtggtgtagccccaacagaggagaggggctatgccactcattaacctggcggcagcgcaaaagatg

SEQ ID NO: 114377 - DNA, 103 bp, Artificial Sequence
  Synthetic Polynucleotide
taatacgactcactatagggcaagattctcagattcatccccaatgagtgaacagaggagacactcaatggggatgaataacctggcggcagcgcaaaagatg

SEQ ID NO: 114378 - DNA, 103 bp, Artificial Sequence
  Synthetic Polynucleotide
taatacgactcactatagggccatctccctcaagattctcagattcatccaacagaggagaggatgaatgtgagaatctaacctggcggcagcgcaaaagatg

SEQ ID NO: 114379 - DNA, 103 bp, Artificial Sequence
  Synthetic Polynucleotide
taatacgactcactatagggacggaggtccccatctccctcaagattctcaacagaggagagagaatatggagggagataacctggcggcagcgcaaaagatg

SEQ ID NO: 114380 - DNA, 103 bp, Artificial Sequence
  Synthetic Polynucleotide
taatacgactcactatagggtccggcccccacggaggtccccatctccctaacagaggagaagggagatggggacctccaacctggcggcagcgcaaaagatg

SEQ ID NO: 114381 - DNA, 103 bp, Artificial Sequence
  Synthetic Polynucleotide
taatacgactcactatagggcccagcaggatccggcccccacggaggtccaacagaggagaggacctatgtgggggccgaacctggcggcagcgcaaaagatg

SEQ ID NO: 114382 - DNA, 103 bp, Artificial Sequence
  Synthetic Polynucleotide
taatacgactcactatagggtgtggcatggcccagcaggatccggcccccaacagaggagagggggcatgatcctgctgaacctggcggcagcgcaaaagatg

SEQ ID NO: 114383 - DNA, 103 bp, Artificial Sequence
  Synthetic Polynucleotide
taatacgactcactatagggtgcccggaggggccgcacgacccctcccccaacagaggagagggggaatggtcgtgcggaacctggcggcagcgcaaaagatg

SEQ ID NO: 114384 - DNA, 103 bp, Artificial Sequence
  Synthetic Polynucleotide
taatacgactcactatagggggaatgactttgtggcatggcccagcaggaaacagaggagatcctgcatggccatgccaaacctggcggcagcgcaaaagatg

SEQ ID NO: 114385 - DNA, 103 bp, Artificial Sequence
  Synthetic Polynucleotide
taatacgactcactatagggggggaagaggggaatgactttgtggcatggaacagaggagaccatgcatgaaagtcattaacctggcggcagcgcaaaagatg

SEQ ID NO: 114386 - DNA, 103 bp, Artificial Sequence
  Synthetic Polynucleotide
taatacgactcactatagggccccttgctgggggaagaggggaatgacttaacagaggagaaagtcaatgccctcttccaacctggcggcagcgcaaaagatg

SEQ ID NO: 114387 - DNA, 103 bp, Artificial Sequence
  Synthetic Polynucleotide
taatacgactcactataggggacaggaaccccccttgctgggggaagaggaacagaggagacctcttatgccagcaaggaacctggcggcagcgcaaaagatg

SEQ ID NO: 114388 - DNA, 103 bp, Artificial Sequence
  Synthetic Polynucleotide
taatacgactcactataggggcccggctaggacaggaaccccccttgctgaacagaggagacagcaaatggggttcctgaacctggcggcagcgcaaaagatg

SEQ ID NO: 114389 - DNA, 103 bp, Artificial Sequence
  Synthetic Polynucleotide
taatacgactcactatagggtgacatcttggcccggctaggacaggaaccaacagaggagaggttccatgcctagccggaacctggcggcagcgcaaaagatg

SEQ ID NO: 114390 - DNA, 103 bp, Artificial Sequence
  Synthetic Polynucleotide
taatacgactcactatagggcccctgtcattgacatcttggcccggctagaacagaggagactagccatgccaagatgtaacctggcggcagcgcaaaagatg

SEQ ID NO: 114391 - DNA, 103 bp, Artificial Sequence
  Synthetic Polynucleotide
taatacgactcactataggggattttcccgcccctgtcattgacatcttgaacagaggagacaagatatgaatgacaggaacctggcggcagcgcaaaagatg

SEQ ID NO: 114392 - DNA, 103 bp, Artificial Sequence
  Synthetic Polynucleotide
taatacgactcactatagggagatggaggtgattttcccgcccctgtcataacagaggagaatgacaatggcgggaaaaaacctggcggcagcgcaaaagatg

SEQ ID NO: 114393 - DNA, 103 bp, Artificial Sequence
  Synthetic Polynucleotide
taatacgactcactatagggaactctggacagatggaggtgattttcccgaacagaggagacgggaaatgcacctccataacctggcggcagcgcaaaagatg

SEQ ID NO: 114394 - DNA, 103 bp, Artificial Sequence
  Synthetic Polynucleotide
taatacgactcactatagggcggcctcggctgcccggaggggccgcacgaaacagaggagatcgtgcatgccctccgggaacctggcggcagcgcaaaagatg

SEQ ID NO: 114395 - DNA, 103 bp, Artificial Sequence
  Synthetic Polynucleotide
taatacgactcactatagggctcatagccaaactctggacagatggaggtaacagaggagaacctccatgtgtccagagaacctggcggcagcgcaaaagatg

SEQ ID NO: 114396 - DNA, 103 bp, Artificial Sequence
  Synthetic Polynucleotide
taatacgactcactatagggactcagtagcctcatagccaaactctggacaacagaggagagtccagatgttggctatgaacctggcggcagcgcaaaagatg

SEQ ID NO: 114397 - DNA, 103 bp, Artificial Sequence
  Synthetic Polynucleotide
taatacgactcactatagggctcctggcatactcagtagcctcatagccaaacagaggagatggctaatgggctactgaaacctggcggcagcgcaaaagatg

SEQ ID NO: 114398 - DNA, 103 bp, Artificial Sequence
  Synthetic Polynucleotide
taatacgactcactataggggctccctgggctcctggcatactcagtagcaacagaggagagctactatgtatgccaggaacctggcggcagcgcaaaagatg

SEQ ID NO: 114399 - DNA, 103 bp, Artificial Sequence
  Synthetic Polynucleotide
taatacgactcactatagggtgctgctgcagctccctgggctcctggcataacagaggagaatgccaatggcccagggaaacctggcggcagcgcaaaagatg

SEQ ID NO: 114400 - DNA, 103 bp, Artificial Sequence
  Synthetic Polynucleotide
taatacgactcactataggggttcagaccctgctgctgcagctccctgggaacagaggagacccaggatgctgcagcagaacctggcggcagcgcaaaagatg

SEQ ID NO: 114401 - DNA, 103 bp, Artificial Sequence
  Synthetic Polynucleotide
taatacgactcactataggggctggagggggttcagaccctgctgctgcaaacagaggagatgcagcatgagggtctgaaacctggcggcagcgcaaaagatg

SEQ ID NO: 114402 - DNA, 103 bp, Artificial Sequence
  Synthetic Polynucleotide
taatacgactcactataggggctcgtggtggctggagggggttcagacccaacagaggagagggtctatgccccctccaaacctggcggcagcgcaaaagatg

SEQ ID NO: 114403 - DNA, 103 bp, Artificial Sequence
  Synthetic Polynucleotide
taatacgactcactataggggtccctctgggctcgtggtggctggaggggaacagaggagacccctcatgccaccacgaaacctggcggcagcgcaaaagatg

SEQ ID NO: 114404 - DNA, 103 bp, Artificial Sequence
  Synthetic Polynucleotide
taatacgactcactatagggaccttgggctgtccctctgggctcgtggtgaacagaggagacaccacatgcccagagggaacctggcggcagcgcaaaagatg

SEQ ID NO: 114405 - DNA, 103 bp, Artificial Sequence
  Synthetic Polynucleotide
taatacgactcactatagggcccccttccgcggcctcggctgcccggaggaacagaggagacctccgatgagccgaggcaacctggcggcagcgcaaaagatg

SEQ ID NO: 114406 - DNA, 103 bp, Artificial Sequence
  Synthetic Polynucleotide
taatacgactcactatagggggctcggtggaccttgggctgtccctctggaacagaggagaccagagatgcagcccaagaacctggcggcagcgcaaaagatg

SEQ ID NO: 114407 - DNA, 103 bp, Artificial Sequence
  Synthetic Polynucleotide
taatacgactcactatagggtggttttgcgggctcggtggaccttgggctaacagaggagaagcccaatgtccaccgagaacctggcggcagcgcaaaagatg

SEQ ID NO: 114408 - DNA, 103 bp, Artificial Sequence
  Synthetic Polynucleotide
taatacgactcactatagggggtttggacatggttttgcgggctcggtggaacagaggagaccaccgatgccgcaaaacaacctggcggcagcgcaaaagatg

SEQ ID NO: 114409 - DNA, 103 bp, Artificial Sequence
  Synthetic Polynucleotide
taatacgactcactatagggtccatttcctggtttggacatggttttgcgaacagaggagacgcaaaatgatgtccaaaaacctggcggcagcgcaaaagatg

SEQ ID NO: 114410 - DNA, 103 bp, Artificial Sequence
  Synthetic Polynucleotide
taatacgactcactatagggccgggggctgtccatttcctggtttggacaaacagaggagatgtccaatgcaggaaatgaacctggcggcagcgcaaaagatg

SEQ ID NO: 114411 - DNA, 103 bp, Artificial Sequence
  Synthetic Polynucleotide
taatacgactcactatagggttctcagggaccgggggctgtccatttcctaacagaggagaaggaaaatgacagcccccaacctggcggcagcgcaaaagatg

SEQ ID NO: 114412 - DNA, 103 bp, Artificial Sequence
  Synthetic Polynucleotide
taatacgactcactatagggagggggccgcttctcagggaccgggggctgaacagaggagacagcccatggtccctgagaacctggcggcagcgcaaaagatg

SEQ ID NO: 114413 - DNA, 103 bp, Artificial Sequence
  Synthetic Polynucleotide
taatacgactcactataggggctgtatttcagggggccgcttctcagggaaacagaggagatccctgatgagcggccccaacctggcggcagcgcaaaagatg

SEQ ID NO: 114414 - DNA, 103 bp, Artificial Sequence
  Synthetic Polynucleotide
taatacgactcactatagggatgcggaaatgctgtatttcagggggccgcaacagaggagagcggccatgtgaaatacaaacctggcggcagcgcaaaagatg

SEQ ID NO: 114415 - DNA, 103 bp, Artificial Sequence
  Synthetic Polynucleotide
taatacgactcactatagggatcatcactcatgcggaaatgctgtatttcaacagaggagagaaataatgcatttccgcaacctggcggcagcgcaaaagatg

SEQ ID NO: 114416 - DNA, 103 bp, Artificial Sequence
  Synthetic Polynucleotide
taatacgactcactatagggtgtggggccccccccttccgcggcctcggcaacagaggagagccgagatggcggaagggaacctggcggcagcgcaaaagatg

SEQ ID NO: 114417 - DNA, 103 bp, Artificial Sequence
  Synthetic Polynucleotide
taatacgactcactataggggtgagtggacatcatcactcatgcggaaataacagaggagaatttccatgtgagtgatgaacctggcggcagcgcaaaagatg

SEQ ID NO: 114418 - DNA, 103 bp, Artificial Sequence
  Synthetic Polynucleotide
taatacgactcactatagggacctttcccagtgagtggacatcatcactcaacagaggagagagtgaatgtgtccactcaacctggcggcagcgcaaaagatg

SEQ ID NO: 114419 - DNA, 103 bp, Artificial Sequence
  Synthetic Polynucleotide
taatacgactcactatagggatctgaggtcacctttcccagtgagtggacaacagaggagagtccacatgctgggaaagaacctggcggcagcgcaaaagatg

SEQ ID NO: 114420 - DNA, 103 bp, Artificial Sequence
  Synthetic Polynucleotide
taatacgactcactatagggttttggccagatctgaggtcacctttcccaaacagaggagatgggaaatgtgacctcagaacctggcggcagcgcaaaagatg

SEQ ID NO: 114421 - DNA, 103 bp, Artificial Sequence
  Synthetic Polynucleotide
taatacgactcactatagggagcttcctccttttggccagatctgaggtcaacagaggagagacctcatgtctggccaaaacctggcggcagcgcaaaagatg

SEQ ID NO: 114422 - DNA, 103 bp, Artificial Sequence
  Synthetic Polynucleotide
taatacgactcactatagggtcctgagttcagcttcctccttttggccagaacagaggagactggccatgaggaggaagaacctggcggcagcgcaaaagatg

SEQ ID NO: 114423 - DNA, 103 bp, Artificial Sequence
  Synthetic Polynucleotide
taatacgactcactatagggacaggccacctcctgagttcagcttcctccaacagaggagaggaggaatgtgaactcagaacctggcggcagcgcaaaagatg

SEQ ID NO: 114424 - DNA, 103 bp, Artificial Sequence
  Synthetic Polynucleotide
taatacgactcactatagggaactcctctgacaggccacctcctgagttcaacagaggagagaactcatgaggtggcctaacctggcggcagcgcaaaagatg

SEQ ID NO: 114425 - DNA, 103 bp, Artificial Sequence
  Synthetic Polynucleotide
taatacgactcactatagggggcagaacctaactcctctgacaggccaccaacagaggagaggtggcatgtcagaggagaacctggcggcagcgcaaaagatg

SEQ ID NO: 114426 - DNA, 103 bp, Artificial Sequence
  Synthetic Polynucleotide
taatacgactcactatagggctgaacgccgggcagaacctaactcctctgaacagaggagacagaggatgtaggttctgaacctggcggcagcgcaaaagatg

SEQ ID NO: 114427 - DNA, 103 bp, Artificial Sequence
  Synthetic Polynucleotide
taatacgactcactatagggcctcttcctctgtggggccccccccttccgaacagaggagacggaagatgggggccccaaacctggcggcagcgcaaaagatg

SEQ ID NO: 114428 - DNA, 103 bp, Artificial Sequence
  Synthetic Polynucleotide
taatacgactcactataggggtcacttctcctgaacgccgggcagaacctaacagaggagaaggttcatgccggcgttcaacctggcggcagcgcaaaagatg

SEQ ID NO: 114429 - DNA, 103 bp, Artificial Sequence
  Synthetic Polynucleotide
taatacgactcactatagggtttcgtcagggtcacttctcctgaacgccgaacagaggagacggcgtatgggagaagtgaacctggcggcagcgcaaaagatg

SEQ ID NO: 114430 - DNA, 103 bp, Artificial Sequence
  Synthetic Polynucleotide
taatacgactcactatagggcggggtcccctttcgtcagggtcacttctcaacagaggagagagaagatgccctgacgaaacctggcggcagcgcaaaagatg

SEQ ID NO: 114431 - DNA, 103 bp, Artificial Sequence
  Synthetic Polynucleotide
taatacgactcactatagggtccagggacccggggtcccctttcgtcaggaacagaggagacctgacatgaggggacccaacctggcggcagcgcaaaagatg

SEQ ID NO: 114432 - DNA, 103 bp, Artificial Sequence
  Synthetic Polynucleotide
taatacgactcactatagggctcccactcctccagggacccggggtccccaacagaggagaggggacatggggtccctgaacctggcggcagcgcaaaagatg

SEQ ID NO: 114433 - DNA, 103 bp, Artificial Sequence
  Synthetic Polynucleotide
taatacgactcactatagggccaccaccgtctcccactcctccagggaccaacagaggagaggtcccatgaggagtgggaacctggcggcagcgcaaaagatg

SEQ ID NO: 114434 - DNA, 103 bp, Artificial Sequence
  Synthetic Polynucleotide
taatacgactcactatagggaagtcatcacccaccaccgtctcccactccaacagaggagaggagtgatggacggtggtaacctggcggcagcgcaaaagatg

SEQ ID NO: 114435 - DNA, 103 bp, Artificial Sequence
  Synthetic Polynucleotide
taatacgactcactataggggtagagactgaagtcatcacccaccaccgtaacagaggagaacggtgatgggtgatgacaacctggcggcagcgcaaaagatg

SEQ ID NO: 114436 - DNA, 103 bp, Artificial Sequence
  Synthetic Polynucleotide
taatacgactcactatagggaggaatcatagtagagactgaagtcatcacaacagaggagagtgatgatgtcagtctctaacctggcggcagcgcaaaagatg

SEQ ID NO: 114437 - DNA, 103 bp, Artificial Sequence
  Synthetic Polynucleotide
taatacgactcactatagggtccacagagtaggaatcatagtagagactgaacagaggagacagtctatgctatgattcaacctggcggcagcgcaaaagatg

SEQ ID NO: 114438 - DNA, 103 bp, Artificial Sequence
  Synthetic Polynucleotide
taatacgactcactatagggtaggtcgttctgttggacaacagcagccataacagaggagaatggctatggttgtccaaaacctggcggcagcgcaaaagatg

SEQ ID NO: 114439 - DNA, 103 bp, Artificial Sequence
  Synthetic Polynucleotide
taatacgactcactatagggaggaacatgttccacaattacggcaggaaaaacagaggagatttcctatggtaattgtgaacctggcggcagcgcaaaagatg

SEQ ID NO: 114440 - DNA, 103 bp, Artificial Sequence
  Synthetic Polynucleotide
taatacgactcactatagggtcctccttttacccctggacttgaagatacaacagaggagagtatctatgagtccagggaacctggcggcagcgcaaaagatg

SEQ ID NO: 114441 - DNA, 103 bp, Artificial Sequence
  Synthetic Polynucleotide
taatacgactcactatagggctgtagtggctcctccttttacccctggacaacagaggagagtccagatgtaaaaggagaacctggcggcagcgcaaaagatg

SEQ ID NO: 114442 - DNA, 103 bp, Artificial Sequence
  Synthetic Polynucleotide
taatacgactcactatagggggttttagaactgtagtggctcctccttttaacagaggagaaaaaggatgagccactacaacctggcggcagcgcaaaagatg

SEQ ID NO: 114443 - DNA, 103 bp, Artificial Sequence
  Synthetic Polynucleotide
taatacgactcactatagggagaattccctggttttagaactgtagtggcaacagaggagagccactatggttctaaaaaacctggcggcagcgcaaaagatg

SEQ ID NO: 114444 - DNA, 103 bp, Artificial Sequence
  Synthetic Polynucleotide
taatacgactcactatagggttgcagctttagaattccctggttttagaaaacagaggagattctaaatgcagggaattaacctggcggcagcgcaaaagatg

SEQ ID NO: 114445 - DNA, 103 bp, Artificial Sequence
  Synthetic Polynucleotide
taatacgactcactatagggtctttgggttttgcagctttagaattccctaacagaggagaagggaaatgtaaagctgcaacctggcggcagcgcaaaagatg

SEQ ID NO: 114446 - DNA, 103 bp, Artificial Sequence
  Synthetic Polynucleotide
taatacgactcactatagggttccacaggatctttgggttttgcagctttaacagaggagaaaagctatgaaacccaaaaacctggcggcagcgcaaaagatg

SEQ ID NO: 114447 - DNA, 103 bp, Artificial Sequence
  Synthetic Polynucleotide
taatacgactcactataggggttgtgcaacttccacaggatctttgggttaacagaggagaaacccaatgatcctgtggaacctggcggcagcgcaaaagatg

SEQ ID NO: 114448 - DNA, 103 bp, Artificial Sequence
  Synthetic Polynucleotide
taatacgactcactatagggacttctgatggttgtgcaacttccacaggaaacagaggagatcctgtatgagttgcacaaacctggcggcagcgcaaaagatg

SEQ ID NO: 114449 - DNA, 103 bp, Artificial Sequence
  Synthetic Polynucleotide
taatacgactcactatagggtgtcctcaaaacttctgatggttgtgcaacaacagaggagagttgcaatgccatcagaaaacctggcggcagcgcaaaagatg

SEQ ID NO: 114450 - DNA, 103 bp, Artificial Sequence
  Synthetic Polynucleotide
taatacgactcactatagggtatcagcaccaggaacatgttccacaattaaacagaggagataattgatgaacatgttcaacctggcggcagcgcaaaagatg

SEQ ID NO: 114451 - DNA, 103 bp, Artificial Sequence
  Synthetic Polynucleotide
taatacgactcactatagggtgggctgcactgtcctcaaaacttctgatgaacagaggagacatcagatgttttgaggaaacctggcggcagcgcaaaagatg

SEQ ID NO: 114452 - DNA, 103 bp, Artificial Sequence
  Synthetic Polynucleotide
taatacgactcactatagggggagactgcgtgggctgcactgtcctcaaaaacagaggagatttgagatgagtgcagccaacctggcggcagcgcaaaagatg

SEQ ID NO: 114453 - DNA, 103 bp, Artificial Sequence
  Synthetic Polynucleotide
taatacgactcactatagggggtaggatatggagactgcgtgggctgcacaacagaggagagtgcagatgacgcagtctaacctggcggcagcgcaaaagatg

SEQ ID NO: 114454 - DNA, 103 bp, Artificial Sequence
  Synthetic Polynucleotide
taatacgactcactatagggggaagagctgggtaggatatggagactgcgaacagaggagacgcagtatgcatatcctaaacctggcggcagcgcaaaagatg

SEQ ID NO: 114455 - DNA, 103 bp, Artificial Sequence
  Synthetic Polynucleotide
taatacgactcactatagggtgaacagtccggaagagctgggtaggatataacagaggagaatatccatgccagctcttaacctggcggcagcgcaaaagatg

SEQ ID NO: 114456 - DNA, 103 bp, Artificial Sequence
  Synthetic Polynucleotide
taatacgactcactatagggctgtactacatgaacagtccggaagagctgaacagaggagacagctcatgcggactgttaacctggcggcagcgcaaaagatg

SEQ ID NO: 114457 - DNA, 103 bp, Artificial Sequence
  Synthetic Polynucleotide
taatacgactcactatagggcctgtactggctgtactacatgaacagtccaacagaggagaggactgatgatgtagtacaacctggcggcagcgcaaaagatg

SEQ ID NO: 114458 - DNA, 103 bp, Artificial Sequence
  Synthetic Polynucleotide
taatacgactcactatagggtctgggacagcctgtactggctgtactacaaacagaggagatgtagtatggccagtacaaacctggcggcagcgcaaaagatg

SEQ ID NO: 114459 - DNA, 103 bp, Artificial Sequence
  Synthetic Polynucleotide
taatacgactcactatagggtgcttctccctctgggacagcctgtactggaacagaggagaccagtaatggctgtcccaaacctggcggcagcgcaaaagatg

SEQ ID NO: 114460 - DNA, 103 bp, Artificial Sequence
  Synthetic Polynucleotide
taatacgactcactatagggtggttctagctgcttctccctctgggacagaacagaggagactgtccatgagggagaagaacctggcggcagcgcaaaagatg

SEQ ID NO: 114461 - DNA, 103 bp, Artificial Sequence
  Synthetic Polynucleotide
taatacgactcactatagggctattgagaatatcagcaccaggaacatgtaacagaggagaacatgtatgtggtgctgaaacctggcggcagcgcaaaagatg

SEQ ID NO: 114462 - DNA, 103 bp, Artificial Sequence
  Synthetic Polynucleotide
taatacgactcactatagggtgcatggtactggttctagctgcttctcccaacagaggagagggagaatgagctagaacaacctggcggcagcgcaaaagatg

SEQ ID NO: 114463 - DNA, 103 bp, Artificial Sequence
  Synthetic Polynucleotide
taatacgactcactatagggtgtttcatcctgcatggtactggttctagcaacagaggagagctagaatgagtaccatgaacctggcggcagcgcaaaagatg

SEQ ID NO: 114464 - DNA, 103 bp, Artificial Sequence
  Synthetic Polynucleotide
taatacgactcactatagggaagaatttaatgtttcatcctgcatggtacaacagaggagagtaccaatgaggatgaaaaacctggcggcagcgcaaaagatg

SEQ ID NO: 114465 - DNA, 103 bp, Artificial Sequence
  Synthetic Polynucleotide
taatacgactcactatagggctctgaacggaagaatttaatgtttcatccaacagaggagaggatgaatgattaaattcaacctggcggcagcgcaaaagatg

SEQ ID NO: 114466 - DNA, 103 bp, Artificial Sequence
  Synthetic Polynucleotide
taatacgactcactatagggagtcctaatactctgaacggaagaatttaaaacagaggagattaaatatgtccgttcagaacctggcggcagcgcaaaagatg

SEQ ID NO: 114467 - DNA, 103 bp, Artificial Sequence
  Synthetic Polynucleotide
taatacgactcactataggggagcctgtatagtcctaatactctgaacggaacagaggagaccgttcatggtattaggaaacctggcggcagcgcaaaagatg

SEQ ID NO: 114468 - DNA, 103 bp, Artificial Sequence
  Synthetic Polynucleotide
taatacgactcactatagggacttgggttggagcctgtatagtcctaataaacagaggagatattagatgtatacaggcaacctggcggcagcgcaaaagatg

SEQ ID NO: 114469 - DNA, 103 bp, Artificial Sequence
  Synthetic Polynucleotide
taatacgactcactatagggaaccactggaacttgggttggagcctgtataacagaggagaatacagatgccaacccaaaacctggcggcagcgcaaaagatg

SEQ ID NO: 114470 - DNA, 103 bp, Artificial Sequence
  Synthetic Polynucleotide
taatacgactcactatagggtaggagacacaaccactggaacttgggttgaacagaggagacaacccatgttccagtggaacctggcggcagcgcaaaagatg

SEQ ID NO: 114471 - DNA, 103 bp, Artificial Sequence
  Synthetic Polynucleotide
taatacgactcactatagggtgctgattcctaggagacacaaccactggaaacagaggagatccagtatgtgtgtctccaacctggcggcagcgcaaaagatg

SEQ ID NO: 114472 - DNA, 103 bp, Artificial Sequence
  Synthetic Polynucleotide
taatacgactcactatagggaccggcataactattgagaatatcagcaccaacagaggagaggtgctatgattctcaataacctggcggcagcgcaaaagatg

SEQ ID NO: 114473 - DNA, 103 bp, Artificial Sequence
  Synthetic Polynucleotide
taatacgactcactatagggtgtatgcaactgctgattcctaggagacacaacagaggagagtgtctatgaggaatcagaacctggcggcagcgcaaaagatg

SEQ ID NO: 114474 - DNA, 103 bp, Artificial Sequence
  Synthetic Polynucleotide
taatacgactcactatagggggagtgttactgtatgcaactgctgattccaacagaggagaggaatcatgagttgcataaacctggcggcagcgcaaaagatg

SEQ ID NO: 114475 - DNA, 103 bp, Artificial Sequence
  Synthetic Polynucleotide
taatacgactcactatagggggcactgtttggagtgttactgtatgcaacaacagaggagagttgcaatgagtaacactaacctggcggcagcgcaaaagatg

SEQ ID NO: 114476 - DNA, 103 bp, Artificial Sequence
  Synthetic Polynucleotide
taatacgactcactatagggtgttgtgagtggcactgtttggagtgttacaacagaggagagtaacaatgcaaacagtgaacctggcggcagcgcaaaagatg

SEQ ID NO: 114477 - DNA, 103 bp, Artificial Sequence
  Synthetic Polynucleotide
taatacgactcactatagggtggctataactgttgtgagtggcactgtttaacagaggagaaaacagatgcactcacaaaacctggcggcagcgcaaaagatg

SEQ ID NO: 114478 - DNA, 103 bp, Artificial Sequence
  Synthetic Polynucleotide
taatacgactcactatagggggatctgtgctggctataactgttgtgagtaacagaggagaactcacatgagttatagcaacctggcggcagcgcaaaagatg

SEQ ID NO: 114479 - DNA, 103 bp, Artificial Sequence
  Synthetic Polynucleotide
taatacgactcactatagggacctgctgatggatctgtgctggctataacaacagaggagagttataatgagcacagataacctggcggcagcgcaaaagatg

SEQ ID NO: 114480 - DNA, 103 bp, Artificial Sequence
  Synthetic Polynucleotide
taatacgactcactataggggagatccagtacctgctgatggatctgtgcaacagaggagagcacagatgcatcagcagaacctggcggcagcgcaaaagatg

SEQ ID NO: 114481 - DNA, 103 bp, Artificial Sequence
  Synthetic Polynucleotide
taatacgactcactatagggataaacttctgagatccagtacctgctgataacagaggagaatcagcatgtactggatcaacctggcggcagcgcaaaagatg

SEQ ID NO: 114482 - DNA, 103 bp, Artificial Sequence
  Synthetic Polynucleotide
taatacgactcactatagggggcttgtaaaataaacttctgagatccagtaacagaggagaactggaatgcagaagtttaacctggcggcagcgcaaaagatg

SEQ ID NO: 114483 - DNA, 103 bp, Artificial Sequence
  Synthetic Polynucleotide
taatacgactcactatagggcacaggctagaccggcataactattgagaaaacagaggagattctcaatggttatgccgaacctggcggcagcgcaaaagatg

SEQ ID NO: 114484 - DNA, 103 bp, Artificial Sequence
  Synthetic Polynucleotide
taatacgactcactatagggatgatggaatggcttgtaaaataaacttctaacagaggagaagaagtatgttttacaagaacctggcggcagcgcaaaagatg

SEQ ID NO: 114485 - DNA, 103 bp, Artificial Sequence
  Synthetic Polynucleotide
taatacgactcactatagggatgggctgtgatgatggaatggcttgtaaaaacagaggagatttacaatgcattccatcaacctggcggcagcgcaaaagatg

SEQ ID NO: 114486 - DNA, 103 bp, Artificial Sequence
  Synthetic Polynucleotide
taatacgactcactatagggcagtactgtcatgggctgtgatgatggaataacagaggagaattccaatgtcacagcccaacctggcggcagcgcaaaagatg

SEQ ID NO: 114487 - DNA, 103 bp, Artificial Sequence
  Synthetic Polynucleotide
taatacgactcactatagggcattttctttcagtactgtcatgggctgtgaacagaggagacacagcatgtgacagtacaacctggcggcagcgcaaaagatg

SEQ ID NO: 114488 - DNA, 103 bp, Artificial Sequence
  Synthetic Polynucleotide
taatacgactcactatagggtgcagcatgacattttctttcagtactgtcaacagaggagagacagtatggaaagaaaaaacctggcggcagcgcaaaagatg

SEQ ID NO: 114489 - DNA, 103 bp, Artificial Sequence
  Synthetic Polynucleotide
taatacgactcactatagggcttttgtgactgcagcatgacattttctttaacagaggagaaaagaaatggtcatgctgaacctggcggcagcgcaaaagatg

SEQ ID NO: 114490 - DNA, 103 bp, Artificial Sequence
  Synthetic Polynucleotide
taatacgactcactataggggagagcccgccttttgtgactgcagcatgaaacagaggagatcatgcatgagtcacaaaaacctggcggcagcgcaaaagatg

SEQ ID NO: 114491 - DNA, 103 bp, Artificial Sequence
  Synthetic Polynucleotide
taatacgactcactatagggattgaaggaggagagcccgccttttgtgacaacagaggagagtcacaatgggcgggctcaacctggcggcagcgcaaaagatg

SEQ ID NO: 114492 - DNA, 103 bp, Artificial Sequence
  Synthetic Polynucleotide
taatacgactcactataggggcccaagacaattgaaggaggagagcccgcaacagaggagagcgggcatgcctccttcaaacctggcggcagcgcaaaagatg

SEQ ID NO: 114493 - DNA, 103 bp, Artificial Sequence
  Synthetic Polynucleotide
taatacgactcactatagggcctgggcagggcccaagacaattgaaggagaacagaggagactccttatgttgtcttggaacctggcggcagcgcaaaagatg

SEQ ID NO: 114494 - DNA, 103 bp, Artificial Sequence
  Synthetic Polynucleotide
taatacgactcactatagggggctcttccacacaggctagaccggcataaaacagaggagattatgcatgtctagcctgaacctggcggcagcgcaaaagatg

SEQ ID NO: 114495 - DNA, 103 bp, Artificial Sequence
  Synthetic Polynucleotide
taatacgactcactatagggacctgctgaacctgggcagggcccaagacaaacagaggagatgtcttatgccctgcccaaacctggcggcagcgcaaaagatg

SEQ ID NO: 114496 - DNA, 103 bp, Artificial Sequence
  Synthetic Polynucleotide
taatacgactcactataggggctagtaaggacctgctgaacctgggcaggaacagaggagacctgccatggttcagcagaacctggcggcagcgcaaaagatg

SEQ ID NO: 114497 - DNA, 103 bp, Artificial Sequence
  Synthetic Polynucleotide
taatacgactcactatagggtctgaacattgctagtaaggacctgctgaaaacagaggagattcagcatgtccttactaaacctggcggcagcgcaaaagatg

SEQ ID NO: 114498 - DNA, 103 bp, Artificial Sequence
  Synthetic Polynucleotide
taatacgactcactatagggttgcaaatggtctgaacattgctagtaaggaacagaggagaccttacatgcaatgttcaaacctggcggcagcgcaaaagatg

SEQ ID NO: 114499 - DNA, 103 bp, Artificial Sequence
  Synthetic Polynucleotide
taatacgactcactataggggacggttccattgcaaatggtctgaacattaacagaggagaaatgttatgaccatttgcaacctggcggcagcgcaaaagatg

SEQ ID NO: 114500 - DNA, 103 bp, Artificial Sequence
  Synthetic Polynucleotide
taatacgactcactatagggaagccacactgacggttccattgcaaatggaacagaggagaccatttatgatggaaccgaacctggcggcagcgcaaaagatg

SEQ ID NO: 114501 - DNA, 103 bp, Artificial Sequence
  Synthetic Polynucleotide
taatacgactcactataggggatggagaggaagccacactgacggttccaaacagaggagatggaacatgcagtgtggcaacctggcggcagcgcaaaagatg

SEQ ID NO: 114502 - DNA, 103 bp, Artificial Sequence
  Synthetic Polynucleotide
taatacgactcactatagggagcactgaaggatggagaggaagccacactaacagaggagaagtgtgatgtcctctccaaacctggcggcagcgcaaaagatg

SEQ ID NO: 114503 - DNA, 103 bp, Artificial Sequence
  Synthetic Polynucleotide
taatacgactcactatagggcaggtgcagtagcactgaaggatggagaggaacagaggagacctctcatgccttcagtgaacctggcggcagcgcaaaagatg

SEQ ID NO: 114504 - DNA, 103 bp, Artificial Sequence
  Synthetic Polynucleotide
taatacgactcactatagggaaggtcaccacaggtgcagtagcactgaagaacagaggagacttcagatgtactgcaccaacctggcggcagcgcaaaagatg

SEQ ID NO: 114505 - DNA, 103 bp, Artificial Sequence
  Synthetic Polynucleotide
taatacgactcactatagggcatgtcattgggctcttccacacaggctagaacagaggagactagccatggtggaagagaacctggcggcagcgcaaaagatg

SEQ ID NO: 114506 - DNA, 103 bp, Artificial Sequence
  Synthetic Polynucleotide
taatacgactcactataggggcgaggagaaaaggtcaccacaggtgcagtaacagaggagaactgcaatggtggtgaccaacctggcggcagcgcaaaagatg

SEQ ID NO: 114507 - DNA, 103 bp, Artificial Sequence
  Synthetic Polynucleotide
taatacgactcactataggggctgtgaactgcgaggagaaaaggtcaccaaacagaggagatggtgaatgtttctcctcaacctggcggcagcgcaaaagatg

SEQ ID NO: 114508 - DNA, 103 bp, Artificial Sequence
  Synthetic Polynucleotide
taatacgactcactatagggtgagcaaccagctgtgaactgcgaggagaaaacagaggagattctccatgcagttcacaaacctggcggcagcgcaaaagatg

SEQ ID NO: 114509 - DNA, 103 bp, Artificial Sequence
  Synthetic Polynucleotide
taatacgactcactataggggccaggtgggtgagcaaccagctgtgaactaacagaggagaagttcaatgctggttgctaacctggcggcagcgcaaaagatg

SEQ ID NO: 114510 - DNA, 103 bp, Artificial Sequence
  Synthetic Polynucleotide
taatacgactcactatagggtgattacagtgccaggtgggtgagcaaccaaacagaggagatggttgatgacccacctgaacctggcggcagcgcaaaagatg

SEQ ID NO: 114511 - DNA, 103 bp, Artificial Sequence
  Synthetic Polynucleotide
taatacgactcactatagggataactgaagtgattacagtgccaggtgggaacagaggagacccaccatgcactgtaataacctggcggcagcgcaaaagatg

SEQ ID NO: 114512 - DNA, 103 bp, Artificial Sequence
  Synthetic Polynucleotide
taatacgactcactatagggttgagttttgataactgaagtgattacagtaacagaggagaactgtaatgacttcagttaacctggcggcagcgcaaaagatg

SEQ ID NO: 114513 - DNA, 103 bp, Artificial Sequence
  Synthetic Polynucleotide
taatacgactcactatagggtttttgtttcttgagttttgataactgaagaacagaggagacttcagatgtcaaaactcaacctggcggcagcgcaaaagatg

SEQ ID NO: 114514 - DNA, 103 bp, Artificial Sequence
  Synthetic Polynucleotide
taatacgactcactatagggtgtgtaagagtttttgtttcttgagttttgaacagaggagacaaaacatgagaaacaaaaacctggcggcagcgcaaaagatg

SEQ ID NO: 114515 - DNA, 103 bp, Artificial Sequence
  Synthetic Polynucleotide
taatacgactcactatagggctctacttcctgtgtaagagtttttgtttcaacagaggagagaaacaatgactcttacaaacctggcggcagcgcaaaagatg

SEQ ID NO: 114516 - DNA, 103 bp, Artificial Sequence
  Synthetic Polynucleotide
taatacgactcactatagggtctcagtaatcatgtcattgggctcttccaaacagaggagatggaagatgccaatgacaaacctggcggcagcgcaaaagatg

SEQ ID NO: 114517 - DNA, 103 bp, Artificial Sequence
  Synthetic Polynucleotide
taatacgactcactatagggattcctttttctctacttcctgtgtaagagaacagaggagactcttaatgaggaagtagaacctggcggcagcgcaaaagatg

SEQ ID NO: 114518 - DNA, 103 bp, Artificial Sequence
  Synthetic Polynucleotide
taatacgactcactatagggtgatcttcagattcctttttctctacttccaacagaggagaggaagtatggaaaaaggaaacctggcggcagcgcaaaagatg

SEQ ID NO: 114519 - DNA, 103 bp, Artificial Sequence
  Synthetic Polynucleotide
taatacgactcactatagggctctttcaaatgatcttcagattcctttttaacagaggagaaaaaagatgtctgaagataacctggcggcagcgcaaaagatg

SEQ ID NO: 114520 - DNA, 103 bp, Artificial Sequence
  Synthetic Polynucleotide
taatacgactcactatagggtctcagtgttctctttcaaatgatcttcagaacagaggagactgaagatgatttgaaagaacctggcggcagcgcaaaagatg

SEQ ID NO: 114521 - DNA, 103 bp, Artificial Sequence
  Synthetic Polynucleotide
taatacgactcactatagggtgctccgttttctcagtgttctctttcaaaaacagaggagatttgaaatggaacactgaaacctggcggcagcgcaaaagatg

SEQ ID NO: 114522 - DNA, 103 bp, Artificial Sequence
  Synthetic Polynucleotide
taatacgactcactatagggctgtggctgctgctccgttttctcagtgttaacagaggagaaacactatgaaaacggagaacctggcggcagcgcaaaagatg

SEQ ID NO: 114523 - DNA, 103 bp, Artificial Sequence
  Synthetic Polynucleotide
taatacgactcactatagggtcacataaggctgtggctgctgctccgtttaacagaggagaaaacggatgagcagccacaacctggcggcagcgcaaaagatg

SEQ ID NO: 114524 - DNA, 103 bp, Artificial Sequence
  Synthetic Polynucleotide
taatacgactcactataggggacactaccatcacataaggctgtggctgcaacagaggagagcagccatggccttatgtaacctggcggcagcgcaaaagatg

SEQ ID NO: 114525 - DNA, 103 bp, Artificial Sequence
  Synthetic Polynucleotide
taatacgactcactatagggattggaactggacactaccatcacataaggaacagaggagaccttatatgatggtagtgaacctggcggcagcgcaaaagatg

SEQ ID NO: 114526 - DNA, 103 bp, Artificial Sequence
  Synthetic Polynucleotide
taatacgactcactatagggaagtaaatccattggaactggacactaccaaacagaggagatggtagatgccagttccaaacctggcggcagcgcaaaagatg

SEQ ID NO: 114527 - DNA, 103 bp, Artificial Sequence
  Synthetic Polynucleotide
taatacgactcactatagggtccagtgaactctcagtaatcatgtcattgaacagaggagacaatgaatggattactgaaacctggcggcagcgcaaaagatg

SEQ ID NO: 114528 - DNA, 103 bp, Artificial Sequence
  Synthetic Polynucleotide
taatacgactcactataggggctacctgagaagtaaatccattggaactgaacagaggagacagttcatgtggatttacaacctggcggcagcgcaaaagatg

SEQ ID NO: 114529 - DNA, 103 bp, Artificial Sequence
  Synthetic Polynucleotide
taatacgactcactatagggttgtttcatagctacctgagaagtaaatccaacagaggagaggatttatgtctcaggtaaacctggcggcagcgcaaaagatg

SEQ ID NO: 114530 - DNA, 103 bp, Artificial Sequence
  Synthetic Polynucleotide
taatacgactcactataggggcagttcgttttgtttcatagctacctgagaacagaggagactcaggatgctatgaaacaacctggcggcagcgcaaaagatg

SEQ ID NO: 114531 - DNA, 103 bp, Artificial Sequence
  Synthetic Polynucleotide
taatacgactcactatagggttgggttccagcagttcgttttgtttcataaacagaggagatatgaaatgaaacgaactaacctggcggcagcgcaaaagatg

SEQ ID NO: 114532 - DNA, 103 bp, Artificial Sequence
  Synthetic Polynucleotide
taatacgactcactatagggctaaaaagagttgggttccagcagttcgttaacagaggagaaacgaaatgctggaacccaacctggcggcagcgcaaaagatg

SEQ ID NO: 114533 - DNA, 103 bp, Artificial Sequence
  Synthetic Polynucleotide
taatacgactcactatagggttcagcaacatccagtgaactctcagtaataacagaggagaattactatgagttcactgaacctggcggcagcgcaaaagatg

SEQ ID NO: 114534 - DNA, 103 bp, Artificial Sequence
  Synthetic Polynucleotide
taatacgactcactatagggattcaaatactaggtcgttctgttggacaaaacagaggagattgtccatgagaacgaccaacctggcggcagcgcaaaagatg

SEQ ID NO: 114535 - DNA, 103 bp, Artificial Sequence
  Synthetic Polynucleotide
taatacgactcactatagggtgatttcttcttcagcaacatccagtgaacaacagaggagagttcacatgatgttgctgaacctggcggcagcgcaaaagatg

SEQ ID NO: 114536 - DNA, 103 bp, Artificial Sequence
  Synthetic Polynucleotide
taatacgactcactatagggtcatcgtctatgatttcttcttcagcaacaaacagaggagatgttgcatgagaagaaataacctggcggcagcgcaaaagatg

SEQ ID NO: 114537 - DNA, 103 bp, Artificial Sequence
  Synthetic Polynucleotide
taatacgactcactataggggtcatcatcatcatcgtctatgatttcttcaacagaggagagaagaaatgatagacgataacctggcggcagcgcaaaagatg

SEQ ID NO: 114538 - DNA, 103 bp, Artificial Sequence
  Synthetic Polynucleotide
taatacgactcactatagggtaagggtgatgtcatcatcatcatcgtctaaacagaggagatagacgatgatgatgatgaacctggcggcagcgcaaaagatg

SEQ ID NO: 114539 - DNA, 103 bp, Artificial Sequence
  Synthetic Polynucleotide
taatacgactcactataggggcttcaactgtaagggtgatgtcatcatcaaacagaggagatgatgaatgcatcaccctaacctggcggcagcgcaaaagatg

SEQ ID NO: 114540 - DNA, 103 bp, Artificial Sequence
  Synthetic Polynucleotide
taatacgactcactatagggatgacaagaagcttcaactgtaagggtgataacagaggagaatcaccatgacagttgaaaacctggcggcagcgcaaaagatg

SEQ ID NO: 114541 - DNA, 103 bp, Artificial Sequence
  Synthetic Polynucleotide
taatacgactcactatagggcatccccgtcatgacaagaagcttcaactgaacagaggagacagttgatgcttcttgtcaacctggcggcagcgcaaaagatg

SEQ ID NO: 114542 - DNA, 103 bp, Artificial Sequence
  Synthetic Polynucleotide
taatacgactcactatagggtcaattgtttcatccccgtcatgacaagaaaacagaggagattcttgatgtgacggggaaacctggcggcagcgcaaaagatg

SEQ ID NO: 114543 - DNA, 103 bp, Artificial Sequence
  Synthetic Polynucleotide
taatacgactcactatagggctcaatagtttcaattgtttcatccccgtcaacagaggagagacgggatggaaacaattaacctggcggcagcgcaaaagatg

SEQ ID NO: 114544 - DNA, 103 bp, Artificial Sequence
  Synthetic Polynucleotide
taatacgactcactatagggcctcagcagcctcaatagtttcaattgtttaacagaggagaaaacaaatgaaactattgaacctggcggcagcgcaaaagatg

SEQ ID NO: 114545 - DNA, 103 bp, Artificial Sequence
  Synthetic Polynucleotide
taatacgactcactatagggttactagcaaattcaaatactaggtcgttcaacagaggagagaacgaatgagtatttgaaacctggcggcagcgcaaaagatg

SEQ ID NO: 114546 - DNA, 103 bp, Artificial Sequence
  Synthetic Polynucleotide
taatacgactcactatagggttgaggagtgcctcagcagcctcaatagttaacagaggagaaactatatgggctgctgaaacctggcggcagcgcaaaagatg

SEQ ID NO: 114547 - DNA, 103 bp, Artificial Sequence
  Synthetic Polynucleotide
taatacgactcactatagggggaatccatattgaggagtgcctcagcagcaacagaggagagctgctatggcactcctcaacctggcggcagcgcaaaagatg

SEQ ID NO: 114548 - DNA, 103 bp, Artificial Sequence
  Synthetic Polynucleotide
taatacgactcactatagggtagggccaggggaatccatattgaggagtgaacagaggagacactccatgatatggattaacctggcggcagcgcaaaagatg

SEQ ID NO: 114549 - DNA, 103 bp, Artificial Sequence
  Synthetic Polynucleotide
taatacgactcactatagggtcatccagcatagggccaggggaatccataaacagaggagatatggaatgccctggcccaacctggcggcagcgcaaaagatg

SEQ ID NO: 114550 - DNA, 103 bp, Artificial Sequence
  Synthetic Polynucleotide
taatacgactcactatagggtattcgtttttcatccagcatagggccaggaacagaggagacctggcatgatgctggataacctggcggcagcgcaaaagatg

SEQ ID NO: 114551 - DNA, 103 bp, Artificial Sequence
  Synthetic Polynucleotide
taatacgactcactatagggtattattatttattcgtttttcatccagcaaacagaggagatgctggatgaaaaacgaaaacctggcggcagcgcaaaagatg

SEQ ID NO: 114552 - DNA, 103 bp, Artificial Sequence
  Synthetic Polynucleotide
taatacgactcactataggggaactaaatatattattatttattcgttttaacagaggagaaaaacgatgaaataataaaacctggcggcagcgcaaaagatg

SEQ ID NO: 114553 - DNA, 103 bp, Artificial Sequence
  Synthetic Polynucleotide
taatacgactcactatagggatcttcaggtgaactaaatatattattattaacagaggagaaataatatgatatttagtaacctggcggcagcgcaaaagatg

SEQ ID NO: 114554 - DNA, 103 bp, Artificial Sequence
  Synthetic Polynucleotide
taatacgactcactatagggcaaccatgtcatcttcaggtgaactaaataaacagaggagatatttaatgcacctgaagaacctggcggcagcgcaaaagatg

SEQ ID NO: 114555 - DNA, 103 bp, Artificial Sequence
  Synthetic Polynucleotide
taatacgactcactatagggactggggcaacaaccatgtcatcttcaggtaacagaggagaacctgaatgtgacatggtaacctggcggcagcgcaaaagatg

SEQ ID NO: 114556 - DNA, 103 bp, Artificial Sequence
  Synthetic Polynucleotide
taatacgactcactatagggctccatgacgttactagcaaattcaaatacaacagaggagagtatttatgtttgctagtaacctggcggcagcgcaaaagatg

SEQ ID NO: 114557 - DNA, 103 bp, Artificial Sequence
  Synthetic Polynucleotide
taatacgactcactatagggcacatgggtgactggggcaacaaccatgtcaacagaggagagacatgatggttgccccaaacctggcggcagcgcaaaagatg

SEQ ID NO: 114558 - DNA, 103 bp, Artificial Sequence
  Synthetic Polynucleotide
taatacgactcactatagggatgtgacggacacatgggtgactggggcaaaacagaggagattgcccatgtcacccatgaacctggcggcagcgcaaaagatg

SEQ ID NO: 114559 - DNA, 103 bp, Artificial Sequence
  Synthetic Polynucleotide
taatacgactcactatagggatcccatctaatgtgacggacacatgggtgaacagaggagacacccaatggtccgtcacaacctggcggcagcgcaaaagatg

SEQ ID NO: 114560 - DNA, 103 bp, Artificial Sequence
  Synthetic Polynucleotide
taatacgactcactatagggcacttcaggaatcccatctaatgtgacggaaacagaggagatccgtcatgttagatgggaacctggcggcagcgcaaaagatg

SEQ ID NO: 114561 - DNA, 103 bp, Artificial Sequence
  Synthetic Polynucleotide
taatacgactcactataggggtgtttccatcacttcaggaatcccatctaaacagaggagatagatgatgttcctgaagaacctggcggcagcgcaaaagatg

SEQ ID NO: 114562 - DNA, 103 bp, Artificial Sequence
  Synthetic Polynucleotide
taatacgactcactatagggtgcacctgctgtgtttccatcacttcaggaaacagaggagatcctgaatggatggaaacaacctggcggcagcgcaaaagatg

SEQ ID NO: 114563 - DNA, 103 bp, Artificial Sequence
  Synthetic Polynucleotide
taatacgactcactatagggatatttttcttgcacctgctgtgtttccataacagaggagaatggaaatgcagcaggtgaacctggcggcagcgcaaaagatg

SEQ ID NO: 114564 - DNA, 103 bp, Artificial Sequence
  Synthetic Polynucleotide
taatacgactcactataggggtgagtctgcatatttttcttgcacctgctaacagaggagaagcaggatgaagaaaaataacctggcggcagcgcaaaagatg

SEQ ID NO: 114565 - DNA, 103 bp, Artificial Sequence
  Synthetic Polynucleotide
taatacgactcactataggggaggctcccggtgagtctgcatatttttctaacagaggagaagaaaaatgtgcagactcaacctggcggcagcgcaaaagatg

SEQ ID NO: 114566 - DNA, 103 bp, Artificial Sequence
  Synthetic Polynucleotide
taatacgactcactatagggttctggtgatgaggctcccggtgagtctgcaacagaggagagcagacatgccgggagccaacctggcggcagcgcaaaagatg

SEQ ID NO: 114567 - DNA, 103 bp, Artificial Sequence
  Synthetic Polynucleotide
taatacgactcactataggggtcgttcatcctccatgacgttactagcaaaacagaggagattgctaatgacgtcatggaacctggcggcagcgcaaaagatg

SEQ ID NO: 114568 - DNA, 103 bp, Artificial Sequence
  Synthetic Polynucleotide
taatacgactcactatagggtcttaggctgttctggtgatgaggctcccgaacagaggagacgggagatgcatcaccagaacctggcggcagcgcaaaagatg

SEQ ID NO: 114569 - DNA, 103 bp, Artificial Sequence
  Synthetic Polynucleotide
taatacgactcactatagggccttttttcctcttaggctgttctggtgataacagaggagaatcaccatgacagcctaaaacctggcggcagcgcaaaagatg

SEQ ID NO: 114570 - DNA, 103 bp, Artificial Sequence
  Synthetic Polynucleotide
taatacgactcactatagggagtttttcttccttttttcctcttaggctgaacagaggagacagcctatgaggaaaaaaaacctggcggcagcgcaaaagatg

SEQ ID NO: 114571 - DNA, 103 bp, Artificial Sequence
  Synthetic Polynucleotide
taatacgactcactataggggtggtggtttagtttttcttccttttttccaacagaggagaggaaaaatggaagaaaaaaacctggcggcagcgcaaaagatg

SEQ ID NO: 114572 - DNA, 103 bp, Artificial Sequence
  Synthetic Polynucleotide
taatacgactcactataggggaatctggtcgtggtggtttagtttttcttaacagaggagaaagaaaatgtaaaccaccaacctggcggcagcgcaaaagatg

SEQ ID NO: 114573 - DNA, 103 bp, Artificial Sequence
  Synthetic Polynucleotide
taatacgactcactatagggagtggctggggaatctggtcgtggtggtttaacagaggagaaaaccaatgcgaccagataacctggcggcagcgcaaaagatg

SEQ ID NO: 114574 - DNA, 103 bp, Artificial Sequence
  Synthetic Polynucleotide
taatacgactcactatagggtatttggcgtagtggctggggaatctggtcaacagaggagagaccagatgccccagccaaacctggcggcagcgcaaaagatg

SEQ ID NO: 114575 - DNA, 103 bp, Artificial Sequence
  Synthetic Polynucleotide
taatacgactcactatagggttcacagatatatttggcgtagtggctgggaacagaggagacccagcatgtacgccaaaaacctggcggcagcgcaaaagatg

SEQ ID NO: 114576 - DNA, 103 bp, Artificial Sequence
  Synthetic Polynucleotide
taatacgactcactataggggtttttcttcttcacagatatatttggcgtaacagaggagaacgccaatgatatctgtgaacctggcggcagcgcaaaagatg

SEQ ID NO: 114577 - DNA, 103 bp, Artificial Sequence
  Synthetic Polynucleotide
taatacgactcactatagggttccatctttgtttttcttcttcacagataaacagaggagatatctgatgagaagaaaaaacctggcggcagcgcaaaagatg

SEQ ID NO: 114578 - DNA, 103 bp, Artificial Sequence
  Synthetic Polynucleotide
taatacgactcactatagggtcaccaagctgtcgttcatcctccatgacgaacagaggagacgtcatatgggatgaacgaacctggcggcagcgcaaaagatg

SEQ ID NO: 114579 - DNA, 103 bp, Artificial Sequence
  Synthetic Polynucleotide
taatacgactcactataggggtgtttccctttccatctttgtttttcttcaacagaggagagaagaaatgcaaagatggaacctggcggcagcgcaaaagatg

SEQ ID NO: 114580 - DNA, 103 bp, Artificial Sequence
  Synthetic Polynucleotide
taatacgactcactatagggaagataaattgtgtttccctttccatctttaacagaggagaaaagatatgaagggaaacaacctggcggcagcgcaaaagatg

SEQ ID NO: 114581 - DNA, 103 bp, Artificial Sequence
  Synthetic Polynucleotide
taatacgactcactatagggaaaactcccaaagataaattgtgtttccctaacagaggagaagggaaatgcaatttatcaacctggcggcagcgcaaaagatg

SEQ ID NO: 114582 - DNA, 103 bp, Artificial Sequence
  Synthetic Polynucleotide
taatacgactcactatagggagtgccagtaaaaactcccaaagataaattaacagaggagaaatttaatgttgggagttaacctggcggcagcgcaaaagatg

SEQ ID NO: 114583 - DNA, 103 bp, Artificial Sequence
  Synthetic Polynucleotide
taatacgactcactataggggtcctggagcagtgccagtaaaaactcccaaacagaggagatgggagatgttactggcaaacctggcggcagcgcaaaagatg

SEQ ID NO: 114584 - DNA, 103 bp, Artificial Sequence
  Synthetic Polynucleotide
taatacgactcactatagggaagtagccttgtcctggagcagtgccagtaaacagaggagatactggatgtgctccaggaacctggcggcagcgcaaaagatg

SEQ ID NO: 114585 - DNA, 103 bp, Artificial Sequence
  Synthetic Polynucleotide
taatacgactcactatagggtatttaggacaagtagccttgtcctggagcaacagaggagagctccaatgcaaggctacaacctggcggcagcgcaaaagatg

SEQ ID NO: 114586 - DNA, 103 bp, Artificial Sequence
  Synthetic Polynucleotide
taatacgactcactatagggccacttgatgtatttaggacaagtagccttaacagaggagaaaggctatgtgtcctaaaaacctggcggcagcgcaaaagatg

SEQ ID NO: 114587 - DNA, 103 bp, Artificial Sequence
  Synthetic Polynucleotide
taatacgactcactatagggctcgctgggtccacttgatgtatttaggacaacagaggagagtcctaatgacatcaagtaacctggcggcagcgcaaaagatg

SEQ ID NO: 114588 - DNA, 103 bp, Artificial Sequence
  Synthetic Polynucleotide
taatacgactcactatagggatgcctttctctcgctgggtccacttgatgaacagaggagacatcaaatggacccagcgaacctggcggcagcgcaaaagatg

SEQ ID NO: 114589 - DNA, 103 bp, Artificial Sequence
  Synthetic Polynucleotide
taatacgactcactatagggaatagctggatcaccaagctgtcgttcatcaacagaggagagatgaaatgcagcttggtaacctggcggcagcgcaaaagatg

SEQ ID NO: 114590 - DNA, 103 bp, Artificial Sequence
  Synthetic Polynucleotide
taatacgactcactatagggcaatttaaaaatgcctttctctcgctgggtaacagaggagaacccagatggagaaaggcaacctggcggcagcgcaaaagatg

SEQ ID NO: 114591 - DNA, 103 bp, Artificial Sequence
  Synthetic Polynucleotide
taatacgactcactatagggtagaatccaccaatttaaaaatgcctttctaacagaggagaagaaagatgtttttaaataacctggcggcagcgcaaaagatg

SEQ ID NO: 114592 - DNA, 103 bp, Artificial Sequence
  Synthetic Polynucleotide
taatacgactcactataggggacactgctttagaatccaccaatttaaaaaacagaggagattttaaatgggtggattcaacctggcggcagcgcaaaagatg

SEQ ID NO: 114593 - DNA, 103 bp, Artificial Sequence
  Synthetic Polynucleotide
taatacgactcactatagggccacaacctggacactgctttagaatccacaacagaggagagtggatatgaaagcagtgaacctggcggcagcgcaaaagatg

SEQ ID NO: 114594 - DNA, 103 bp, Artificial Sequence
  Synthetic Polynucleotide
taatacgactcactatagggtgtgcttcccccacaacctggacactgcttaacagaggagaaagcagatgccaggttgtaacctggcggcagcgcaaaagatg

SEQ ID NO: 114595 - DNA, 103 bp, Artificial Sequence
  Synthetic Polynucleotide
taatacgactcactatagggggtttgtttttgtgcttcccccacaacctgaacagaggagacaggttatgggggaagcaaacctggcggcagcgcaaaagatg

SEQ ID NO: 114596 - DNA, 103 bp, Artificial Sequence
  Synthetic Polynucleotide
taatacgactcactatagggattcatatcaggtttgtttttgtgcttcccaacagaggagagggaagatgaaaaacaaaaacctggcggcagcgcaaaagatg

SEQ ID NO: 114597 - DNA, 103 bp, Artificial Sequence
  Synthetic Polynucleotide
taatacgactcactatagggtggtctcataattcatatcaggtttgttttaacagaggagaaaaacaatgctgatatgaaacctggcggcagcgcaaaagatg

SEQ ID NO: 114598 - DNA, 103 bp, Artificial Sequence
  Synthetic Polynucleotide
taatacgactcactataggggctcttcccatggtctcataattcatatcaaacagaggagatgatatatgttatgagacaacctggcggcagcgcaaaagatg

SEQ ID NO: 114599 - DNA, 103 bp, Artificial Sequence
  Synthetic Polynucleotide
taatacgactcactataggggtacctgagtgctcttcccatggtctcataaacagaggagatatgagatgatgggaagaaacctggcggcagcgcaaaagatg

SEQ ID NO: 114600 - DNA, 103 bp, Artificial Sequence
  Synthetic Polynucleotide
taatacgactcactatagggcggcaggaaaaatagctggatcaccaagctaacagaggagaagcttgatgatccagctaaacctggcggcagcgcaaaagatg

SEQ ID NO: 114601 - DNA, 103 bp, Artificial Sequence
  Synthetic Polynucleotide
taatacgactcactatagggtttggtaatagtacctgagtgctcttcccaaacagaggagatgggaaatgcactcaggtaacctggcggcagcgcaaaagatg

SEQ ID NO: 114602 - DNA, 103 bp, Artificial Sequence
  Synthetic Polynucleotide
taatacgactcactatagggagaatacccctttggtaatagtacctgagtaacagaggagaactcagatgctattaccaaacctggcggcagcgcaaaagatg

SEQ ID NO: 114603 - DNA, 103 bp, Artificial Sequence
  Synthetic Polynucleotide
taatacgactcactatagggcacttttgccagaatacccctttggtaataaacagaggagatattacatgaggggtattaacctggcggcagcgcaaaagatg

SEQ ID NO: 114604 - DNA, 103 bp, Artificial Sequence
  Synthetic Polynucleotide
taatacgactcactataggggctgaccttccacttttgccagaataccccaacagaggagaggggtaatgtggcaaaagaacctggcggcagcgcaaaagatg

SEQ ID NO: 114605 - DNA, 103 bp, Artificial Sequence
  Synthetic Polynucleotide
taatacgactcactatagggtacaccaagcgctgaccttccacttttgccaacagaggagaggcaaaatgggaaggtcaaacctggcggcagcgcaaaagatg

SEQ ID NO: 114606 - DNA, 103 bp, Artificial Sequence
  Synthetic Polynucleotide
taatacgactcactatagggtttaaactgatacaccaagcgctgaccttcaacagaggagagaaggtatgcgcttggtgaacctggcggcagcgcaaaagatg

SEQ ID NO: 114607 - DNA, 103 bp, Artificial Sequence
  Synthetic Polynucleotide
taatacgactcactatagggttggcatttctttaaactgatacaccaagcaacagaggagagcttggatgatcagtttaaacctggcggcagcgcaaaagatg

SEQ ID NO: 114608 - DNA, 103 bp, Artificial Sequence
  Synthetic Polynucleotide
taatacgactcactatagggataagatcttttggcatttctttaaactgaaacagaggagatcagttatgagaaatgccaacctggcggcagcgcaaaagatg

SEQ ID NO: 114609 - DNA, 103 bp, Artificial Sequence
  Synthetic Polynucleotide
taatacgactcactatagggatttatatatataagatcttttggcatttcaacagaggagagaaatgatgaaagatcttaacctggcggcagcgcaaaagatg

SEQ ID NO: 114610 - DNA, 103 bp, Artificial Sequence
  Synthetic Polynucleotide
taatacgactcactataggggatcctcatcatttatatatataagatcttaacagaggagaaagatcatgtatatataaaacctggcggcagcgcaaaagatg

SEQ ID NO: 114611 - DNA, 103 bp, Artificial Sequence
  Synthetic Polynucleotide
taatacgactcactatagggtccacaattacggcaggaaaaatagctggaaacagaggagatccagcatgttttcctgcaacctggcggcagcgcaaaagatg

SEQ ID NO: 114612 - DNA, 103 bp, Artificial Sequence
  Synthetic Polynucleotide
taatacgactcactatagggctggaacttggatcctcatcatttatatataacagaggagaatatatatgtgatgaggaaacctggcggcagcgcaaaagatg

SEQ ID NO: 114613 - DNA, 103 bp, Artificial Sequence
  Synthetic Polynucleotide
taatacgactcactatagggagactctatgctggaacttggatcctcatcaacagaggagagatgagatgccaagttccaacctggcggcagcgcaaaagatg

SEQ ID NO: 114614 - DNA, 103 bp, Artificial Sequence
  Synthetic Polynucleotide
taatacgactcactatagggatggatctgaagactctatgctggaacttgaacagaggagacaagttatggcatagagtaacctggcggcagcgcaaaagatg

SEQ ID NO: 114615 - DNA, 103 bp, Artificial Sequence
  Synthetic Polynucleotide
taatacgactcactataggggaagatagcgatggatctgaagactctatgaacagaggagacatagaatgttcagatccaacctggcggcagcgcaaaagatg

SEQ ID NO: 114616 - DNA, 103 bp, Artificial Sequence
  Synthetic Polynucleotide
taatacgactcactatagggagtggctgatgaagatagcgatggatctgaaacagaggagatcagatatgtcgctatctaacctggcggcagcgcaaaagatg

SEQ ID NO: 114617 - DNA, 103 bp, Artificial Sequence
  Synthetic Polynucleotide
taatacgactcactatagggtcctatttgaagtggctgatgaagatagcgaacagaggagacgctatatgcatcagccaaacctggcggcagcgcaaaagatg

SEQ ID NO: 114618 - DNA, 103 bp, Artificial Sequence
  Synthetic Polynucleotide
taatacgactcactatagggctggtttgattcctatttgaagtggctgataacagaggagaatcagcatgttcaaatagaacctggcggcagcgcaaaagatg

SEQ ID NO: 114619 - DNA, 103 bp, Artificial Sequence
  Synthetic Polynucleotide
taatacgactcactatagggtctcgaccggctggtttgattcctatttgaaacagaggagatcaaatatgaatcaaaccaacctggcggcagcgcaaaagatg

SEQ ID NO: 114620 - DNA, 103 bp, Artificial Sequence
  Synthetic Polynucleotide
taatacgactcactatagggttgaagatactctcgaccggctggtttgataacagaggagaatcaaaatggccggtcgaaacctggcggcagcgcaaaagatg

SEQ ID NO: 114621 - DNA, 103 bp, Artificial Sequence
  Synthetic Polynucleotide
taatacgactcactatagggacccctggacttgaagatactctcgaccggaacagaggagaccggtcatgagtatcttcaacctggcggcagcgcaaaagatg

SEQ ID NO: 114622 - DNA, 103 bp, Artificial Sequence
  Synthetic Polynucleotide
taatacgactcactatagggaatgttgctaatctcacaggttgcagccataacagaggagaatggctatgacctgtgagaacctggcggcagcgcaaaagatg

SEQ ID NO: 114623 - DNA, 103 bp, Artificial Sequence
  Synthetic Polynucleotide
taatacgactcactatagggcaagtcatcggccccaaaggtggcagcaggaacagaggagacctgctatgacctttgggaacctggcggcagcgcaaaagatg

SEQ ID NO: 114624 - DNA, 103 bp, Artificial Sequence
  Synthetic Polynucleotide
taatacgactcactatagggctcccgtttgtagtagtacctcatggcccgaacagaggagacgggccatgaggtactacaacctggcggcagcgcaaaagatg

SEQ ID NO: 114625 - DNA, 103 bp, Artificial Sequence
  Synthetic Polynucleotide
taatacgactcactataggggttccaggatctcccgtttgtagtagtaccaacagaggagaggtactatgacaaacgggaacctggcggcagcgcaaaagatg

SEQ ID NO: 114626 - DNA, 103 bp, Artificial Sequence
  Synthetic Polynucleotide
taatacgactcactatagggccatccacccgttccaggatctcccgtttgaacagaggagacaaacgatggatcctggaaacctggcggcagcgcaaaagatg

SEQ ID NO: 114627 - DNA, 103 bp, Artificial Sequence
  Synthetic Polynucleotide
taatacgactcactataggggagtcgccggccatccacccgttccaggataacagaggagaatcctgatgcgggtggataacctggcggcagcgcaaaagatg

SEQ ID NO: 114628 - DNA, 103 bp, Artificial Sequence
  Synthetic Polynucleotide
taatacgactcactatagggacttgtagacgagtcgccggccatccacccaacagaggagagggtggatggccggcgacaacctggcggcagcgcaaaagatg

SEQ ID NO: 114629 - DNA, 103 bp, Artificial Sequence
  Synthetic Polynucleotide
taatacgactcactatagggtttttgccaaacttgtagacgagtcgccggaacagaggagaccggcgatgcgtctacaaaacctggcggcagcgcaaaagatg

SEQ ID NO: 114630 - DNA, 103 bp, Artificial Sequence
  Synthetic Polynucleotide
taatacgactcactataggggccgcttgagtttttgccaaacttgtagacaacagaggagagtctacatgtttggcaaaaacctggcggcagcgcaaaagatg

SEQ ID NO: 114631 - DNA, 103 bp, Artificial Sequence
  Synthetic Polynucleotide
taatacgactcactatagggcctccttccagccgcttgagtttttgccaaaacagaggagattggcaatgactcaagcgaacctggcggcagcgcaaaagatg

SEQ ID NO: 114632 - DNA, 103 bp, Artificial Sequence
  Synthetic Polynucleotide
taatacgactcactatagggagaacctcttcctccttccagccgcttgagaacagaggagactcaagatgctggaaggaaacctggcggcagcgcaaaagatg

SEQ ID NO: 114633 - DNA, 103 bp, Artificial Sequence
  Synthetic Polynucleotide
taatacgactcactatagggccgactctggagaacctcttcctccttccaaacagaggagatggaagatggaagaggttaacctggcggcagcgcaaaagatg

SEQ ID NO: 114634 - DNA, 103 bp, Artificial Sequence
  Synthetic Polynucleotide
taatacgactcactataggggggtcagtaccaagtcatcggccccaaaggaacagaggagacctttgatgccgatgactaacctggcggcagcgcaaaagatg

SEQ ID NO: 114635 - DNA, 103 bp, Artificial Sequence
  Synthetic Polynucleotide
taatacgactcactataggggggttgctcagggtcagtaccaagtcatcgaacagaggagacgatgaatgggtactgacaacctggcggcagcgcaaaagatg

SEQ ID NO: 114636 - DNA, 103 bp, Artificial Sequence
  Synthetic Polynucleotide
taatacgactcactatagggtgacatctgggggttgctcagggtcagtacaacagaggagagtactgatgctgagcaacaacctggcggcagcgcaaaagatg

SEQ ID NO: 114637 - DNA, 103 bp, Artificial Sequence
  Synthetic Polynucleotide
taatacgactcactatagggtaccctccaatgacatctgggggttgctcaaacagaggagatgagcaatgcccagatgtaacctggcggcagcgcaaaagatg

SEQ ID NO: 114638 - DNA, 103 bp, Artificial Sequence
  Synthetic Polynucleotide
taatacgactcactataggggccttctctgtaccctccaatgacatctggaacagaggagaccagatatgattggagggaacctggcggcagcgcaaaagatg

SEQ ID NO: 114639 - DNA, 103 bp, Artificial Sequence
  Synthetic Polynucleotide
taatacgactcactatagggcaaccagctggccttctctgtaccctccaaaacagaggagattggagatgacagagaagaacctggcggcagcgcaaaagatg

SEQ ID NO: 114640 - DNA, 103 bp, Artificial Sequence
  Synthetic Polynucleotide
taatacgactcactataggggctgttcccccaaccagctggccttctctgaacagaggagacagagaatgccagctggtaacctggcggcagcgcaaaagatg

SEQ ID NO: 114641 - DNA, 103 bp, Artificial Sequence
  Synthetic Polynucleotide
taatacgactcactatagggcagaactggggctgttcccccaaccagctgaacagaggagacagctgatggggggaacaaacctggcggcagcgcaaaagatg

SEQ ID NO: 114642 - DNA, 103 bp, Artificial Sequence
  Synthetic Polynucleotide
taatacgactcactatagggcgtcttcgaccagaactggggctgttccccaacagaggagaggggaaatgccccagttcaacctggcggcagcgcaaaagatg

SEQ ID NO: 114643 - DNA, 103 bp, Artificial Sequence
  Synthetic Polynucleotide
taatacgactcactatagggagttgctaaaaatgttgctaatctcacaggaacagaggagacctgtgatgttagcaacaaacctggcggcagcgcaaaagatg

SEQ ID NO: 114644 - DNA, 103 bp, Artificial Sequence
  Synthetic Polynucleotide
taatacgactcactatagggccagaacctgcgtcttcgaccagaactgggaacagaggagacccagtatgggtcgaagaaacctggcggcagcgcaaaagatg

SEQ ID NO: 114645 - DNA, 103 bp, Artificial Sequence
  Synthetic Polynucleotide
taatacgactcactatagggctgatccagtccagaacctgcgtcttcgacaacagaggagagtcgaaatggcaggttctaacctggcggcagcgcaaaagatg

SEQ ID NO: 114646 - DNA, 103 bp, Artificial Sequence
  Synthetic Polynucleotide
taatacgactcactatagggcacttggtagctgatccagtccagaacctgaacagaggagacaggttatggactggatcaacctggcggcagcgcaaaagatg

SEQ ID NO: 114647 - DNA, 103 bp, Artificial Sequence
  Synthetic Polynucleotide
taatacgactcactatagggtgttcttctccacttggtagctgatccagtaacagaggagaactggaatggctaccaagaacctggcggcagcgcaaaagatg

SEQ ID NO: 114648 - DNA, 103 bp, Artificial Sequence
  Synthetic Polynucleotide
taatacgactcactataggggcgtcgtacttgttcttctccacttggtagaacagaggagactaccaatgggagaagaaaacctggcggcagcgcaaaagatg

SEQ ID NO: 114649 - DNA, 103 bp, Artificial Sequence
  Synthetic Polynucleotide
taatacgactcactatagggaatggcgcttgcgtcgtacttgttcttctcaacagaggagagagaagatgaagtacgacaacctggcggcagcgcaaaagatg

SEQ ID NO: 114650 - DNA, 103 bp, Artificial Sequence
  Synthetic Polynucleotide
taatacgactcactataggggtgagaagtcaatggcgcttgcgtcgtactaacagaggagaagtacgatgcaagcgccaaacctggcggcagcgcaaaagatg

SEQ ID NO: 114651 - DNA, 103 bp, Artificial Sequence
  Synthetic Polynucleotide
taatacgactcactatagggatgtcacatcgtgagaagtcaatggcgcttaacagaggagaaagcgcatgtgacttctcaacctggcggcagcgcaaaagatg

SEQ ID NO: 114652 - DNA, 103 bp, Artificial Sequence
  Synthetic Polynucleotide
taatacgactcactatagggggcgccatccatgtcacatcgtgagaagtcaacagaggagagacttcatgcgatgtgacaacctggcggcagcgcaaaagatg

SEQ ID NO: 114653 - DNA, 103 bp, Artificial Sequence
  Synthetic Polynucleotide
taatacgactcactatagggtgcagagggtggcgccatccatgtcacatcaacagaggagagatgtgatgtggatggcgaacctggcggcagcgcaaaagatg

SEQ ID NO: 114654 - DNA, 103 bp, Artificial Sequence
  Synthetic Polynucleotide
taatacgactcactataggggcactgaagtagttgctaaaaatgttgctaaacagaggagatagcaaatgttttagcaaaacctggcggcagcgcaaaagatg

SEQ ID NO: 114655 - DNA, 103 bp, Artificial Sequence
  Synthetic Polynucleotide
taatacgactcactatagggagggcacaattgcagagggtggcgccatccaacagaggagaggatggatgcaccctctgaacctggcggcagcgcaaaagatg

SEQ ID NO: 114656 - DNA, 103 bp, Artificial Sequence
  Synthetic Polynucleotide
taatacgactcactatagggcagctcctcaagggcacaattgcagagggtaacagaggagaaccctcatgaattgtgccaacctggcggcagcgcaaaagatg

SEQ ID NO: 114657 - DNA, 103 bp, Artificial Sequence
  Synthetic Polynucleotide
taatacgactcactatagggagaccagacgcagctcctcaagggcacaataacagaggagaattgtgatgttgaggagcaacctggcggcagcgcaaaagatg

SEQ ID NO: 114658 - DNA, 103 bp, Artificial Sequence
  Synthetic Polynucleotide
taatacgactcactatagggagaggcccaaagaccagacgcagctcctcaaacagaggagatgaggaatggcgtctggtaacctggcggcagcgcaaaagatg

SEQ ID NO: 114659 - DNA, 103 bp, Artificial Sequence
  Synthetic Polynucleotide
taatacgactcactatagggttggtcccccagaggcccaaagaccagacgaacagaggagacgtctgatgtttgggcctaacctggcggcagcgcaaaagatg

SEQ ID NO: 114660 - DNA, 103 bp, Artificial Sequence
  Synthetic Polynucleotide
taatacgactcactataggggggcatggagttggtcccccagaggcccaaaacagaggagattgggcatgtgggggaccaacctggcggcagcgcaaaagatg

SEQ ID NO: 114661 - DNA, 103 bp, Artificial Sequence
  Synthetic Polynucleotide
taatacgactcactatagggtctcgcagctgggcatggagttggtcccccaacagaggagagggggaatgactccatgcaacctggcggcagcgcaaaagatg

SEQ ID NO: 114662 - DNA, 103 bp, Artificial Sequence
  Synthetic Polynucleotide
taatacgactcactatagggggaagtgaggtctcgcagctgggcatggagaacagaggagactccatatgcagctgcgaaacctggcggcagcgcaaaagatg

SEQ ID NO: 114663 - DNA, 103 bp, Artificial Sequence
  Synthetic Polynucleotide
taatacgactcactatagggcagaagagctggaagtgaggtctcgcagctaacagaggagaagctgcatgacctcacttaacctggcggcagcgcaaaagatg

SEQ ID NO: 114664 - DNA, 103 bp, Artificial Sequence
  Synthetic Polynucleotide
taatacgactcactatagggctgagctcatcagaagagctggaagtgaggaacagaggagacctcacatgcagctcttcaacctggcggcagcgcaaaagatg

SEQ ID NO: 114665 - DNA, 103 bp, Artificial Sequence
  Synthetic Polynucleotide
taatacgactcactataggggctgtacatcgcactgaagtagttgctaaaaacagaggagatttagcatgtacttcagtaacctggcggcagcgcaaaagatg

SEQ ID NO: 114666 - DNA, 103 bp, Artificial Sequence
  Synthetic Polynucleotide
taatacgactcactatagggaatgatccaactgagctcatcagaagagctaacagaggagaagctctatggatgagctcaacctggcggcagcgcaaaagatg

SEQ ID NO: 114667 - DNA, 103 bp, Artificial Sequence
  Synthetic Polynucleotide
taatacgactcactatagggccagcagctcaatgatccaactgagctcataacagaggagaatgagcatggttggatcaaacctggcggcagcgcaaaagatg

SEQ ID NO: 114668 - DNA, 103 bp, Artificial Sequence
  Synthetic Polynucleotide
taatacgactcactatagggccatccttctccagcagctcaatgatccaaaacagaggagattggatatgtgagctgctaacctggcggcagcgcaaaagatg

SEQ ID NO: 114669 - DNA, 103 bp, Artificial Sequence
  Synthetic Polynucleotide
taatacgactcactataggggaaggccatgccatccttctccagcagctcaacagaggagagagctgatggagaaggataacctggcggcagcgcaaaagatg

SEQ ID NO: 114670 - DNA, 103 bp, Artificial Sequence
  Synthetic Polynucleotide
taatacgactcactataggggggcctcctggaaggccatgccatccttctaacagaggagaagaaggatggcatggcctaacctggcggcagcgcaaaagatg

SEQ ID NO: 114671 - DNA, 103 bp, Artificial Sequence
  Synthetic Polynucleotide
taatacgactcactatagggcctgggtctagggcctcctggaaggccatgaacagaggagacatggcatgccaggaggcaacctggcggcagcgcaaaagatg

SEQ ID NO: 114672 - DNA, 103 bp, Artificial Sequence
  Synthetic Polynucleotide
taatacgactcactataggggtcaaagggccctgggtctagggcctcctgaacagaggagacaggagatgctagacccaaacctggcggcagcgcaaaagatg

SEQ ID NO: 114673 - DNA, 103 bp, Artificial Sequence
  Synthetic Polynucleotide
taatacgactcactatagggggctgccctggtcaaagggccctgggtctaaacagaggagatagaccatgggccctttgaacctggcggcagcgcaaaagatg

SEQ ID NO: 114674 - DNA, 103 bp, Artificial Sequence
  Synthetic Polynucleotide
taatacgactcactatagggtgggcaaaggggctgccctggtcaaagggcaacagaggagagcccttatgccagggcagaacctggcggcagcgcaaaagatg

SEQ ID NO: 114675 - DNA, 103 bp, Artificial Sequence
  Synthetic Polynucleotide
taatacgactcactatagggcagcagctcctgggcaaaggggctgccctgaacagaggagacagggcatgccctttgccaacctggcggcagcgcaaaagatg

SEQ ID NO: 114676 - DNA, 103 bp, Artificial Sequence
  Synthetic Polynucleotide
taatacgactcactatagggagtcctccgagctgtacatcgcactgaagtaacagaggagaacttcaatgcgatgtacaaacctggcggcagcgcaaaagatg

SEQ ID NO: 114677 - DNA, 103 bp, Artificial Sequence
  Synthetic Polynucleotide
taatacgactcactataggggaccgtcgtccagcagctcctgggcaaaggaacagaggagacctttgatgaggagctgcaacctggcggcagcgcaaaagatg

SEQ ID NO: 114678 - DNA, 103 bp, Artificial Sequence
  Synthetic Polynucleotide
taatacgactcactatagggctggcttgctgaccgtcgtccagcagctccaacagaggagaggagctatgggacgacggaacctggcggcagcgcaaaagatg

SEQ ID NO: 114679 - DNA, 103 bp, Artificial Sequence
  Synthetic Polynucleotide
taatacgactcactataggggtggtaggggctggcttgctgaccgtcgtcaacagaggagagacgacatgcagcaagccaacctggcggcagcgcaaaagatg

SEQ ID NO: 114680 - DNA, 103 bp, Artificial Sequence
  Synthetic Polynucleotide
taatacgactcactatagggagctgccggggtggtaggggctggcttgctaacagaggagaagcaagatggcccctaccaacctggcggcagcgcaaaagatg

SEQ ID NO: 114681 - DNA, 103 bp, Artificial Sequence
  Synthetic Polynucleotide
taatacgactcactatagggcctgcgccacagctgccggggtggtaggggaacagaggagacccctaatgccccggcagaacctggcggcagcgcaaaagatg

SEQ ID NO: 114682 - DNA, 103 bp, Artificial Sequence
  Synthetic Polynucleotide
taatacgactcactatagggggagggggctcctgcgccacagctgccgggaacagaggagacccggcatgtgtggcgcaaacctggcggcagcgcaaaagatg

SEQ ID NO: 114683 - DNA, 103 bp, Artificial Sequence
  Synthetic Polynucleotide
taatacgactcactatagggagctgccaggggagggggctcctgcgccacaacagaggagagtggcgatggagccccctaacctggcggcagcgcaaaagatg

SEQ ID NO: 114684 - DNA, 103 bp, Artificial Sequence
  Synthetic Polynucleotide
taatacgactcactataggggagacgtcagagctgccaggggagggggctaacagaggagaagccccatgccctggcagaacctggcggcagcgcaaaagatg

SEQ ID NO: 114685 - DNA, 103 bp, Artificial Sequence
  Synthetic Polynucleotide
taatacgactcactatagggccctgcggtggagacgtcagagctgccaggaacagaggagacctggcatgtctgacgtcaacctggcggcagcgcaaaagatg

SEQ ID NO: 114686 - DNA, 103 bp, Artificial Sequence
  Synthetic Polynucleotide
taatacgactcactatagggaagcaccagtccctgcggtggagacgtcagaacagaggagactgacgatgccaccgcagaacctggcggcagcgcaaaagatg

SEQ ID NO: 114687 - DNA, 103 bp, Artificial Sequence
  Synthetic Polynucleotide
taatacgactcactataggggccagggtggagtcctccgagctgtacatcaacagaggagagatgtaatgctcggaggaaacctggcggcagcgcaaaagatg

SEQ ID NO: 114688 - DNA, 103 bp, Artificial Sequence
  Synthetic Polynucleotide
taatacgactcactataggggagctccgagaagcaccagtccctgcggtgaacagaggagacaccgcatggactggtgcaacctggcggcagcgcaaaagatg

SEQ ID NO: 114689 - DNA, 103 bp, Artificial Sequence
  Synthetic Polynucleotide
taatacgactcactatagggtgaggagtgggagctccgagaagcaccagtaacagaggagaactggtatgtctcggagcaacctggcggcagcgcaaaagatg

SEQ ID NO: 114690 - DNA, 103 bp, Artificial Sequence
  Synthetic Polynucleotide
taatacgactcactatagggcaccggagtctgaggagtgggagctccgagaacagaggagactcggaatgcccactcctaacctggcggcagcgcaaaagatg

SEQ ID NO: 114691 - DNA, 103 bp, Artificial Sequence
  Synthetic Polynucleotide
taatacgactcactatagggacgtcacttccaccggagtctgaggagtggaacagaggagaccactcatgagactccggaacctggcggcagcgcaaaagatg

SEQ ID NO: 114692 - DNA, 103 bp, Artificial Sequence
  Synthetic Polynucleotide
taatacgactcactatagggatccaggtccacgtcacttccaccggagtcaacagaggagagactccatgggaagtgacaacctggcggcagcgcaaaagatg

SEQ ID NO: 114693 - DNA, 103 bp, Artificial Sequence
  Synthetic Polynucleotide
taatacgactcactatagggcatcagtgggatccaggtccacgtcacttcaacagaggagagaagtgatgtggacctggaacctggcggcagcgcaaaagatg

SEQ ID NO: 114694 - DNA, 103 bp, Artificial Sequence
  Synthetic Polynucleotide
taatacgactcactatagggaagagcttgccatcagtgggatccaggtccaacagaggagaggacctatgtcccactgaaacctggcggcagcgcaaaagatg

SEQ ID NO: 114695 - DNA, 103 bp, Artificial Sequence
  Synthetic Polynucleotide
taatacgactcactatagggatcgctggggaagagcttgccatcagtgggaacagaggagacccactatgggcaagctcaacctggcggcagcgcaaaagatg

SEQ ID NO: 114696 - DNA, 103 bp, Artificial Sequence
  Synthetic Polynucleotide
taatacgactcactatagggcacgaaaaccatcgctggggaagagcttgcaacagaggagagcaagcatgtccccagcgaacctggcggcagcgcaaaagatg

SEQ ID NO: 114697 - DNA, 103 bp, Artificial Sequence
  Synthetic Polynucleotide
taatacgactcactatagggttcttgcagtcacgaaaaccatcgctggggaacagaggagaccccagatgtggttttcgaacctggcggcagcgcaaaagatg

SEQ ID NO: 114698 - DNA, 103 bp, Artificial Sequence
  Synthetic Polynucleotide
taatacgactcactataggggggaacagaggccagggtggagtcctccgaaacagaggagatcggagatgtccaccctgaacctggcggcagcgcaaaagatg

SEQ ID NO: 114699 - DNA, 103 bp, Artificial Sequence
  Synthetic Polynucleotide
taatacgactcactataggggggatcccccttcttgcagtcacgaaaaccaacagaggagaggttttatggactgcaagaacctggcggcagcgcaaaagatg

SEQ ID NO: 114700 - DNA, 103 bp, Artificial Sequence
  Synthetic Polynucleotide
taatacgactcactatagggtcccgtgcttgggatcccccttcttgcagtaacagaggagaactgcaatgagggggatcaacctggcggcagcgcaaaagatg

SEQ ID NO: 114701 - DNA, 103 bp, Artificial Sequence
  Synthetic Polynucleotide
taatacgactcactatagggcgtttccgcttcccgtgcttgggatcccccaacagaggagagggggaatgcaagcacggaacctggcggcagcgcaaaagatg

SEQ ID NO: 114702 - DNA, 103 bp, Artificial Sequence
  Synthetic Polynucleotide
taatacgactcactataggggggccggcctcgtttccgcttcccgtgcttaacagaggagaaagcacatgaagcggaaaaacctggcggcagcgcaaaagatg

SEQ ID NO: 114703 - DNA, 103 bp, Artificial Sequence
  Synthetic Polynucleotide
taatacgactcactatagggtcagctttcggggccggcctcgtttccgctaacagaggagaagcggaatggaggccggcaacctggcggcagcgcaaaagatg

SEQ ID NO: 114704 - DNA, 103 bp, Artificial Sequence
  Synthetic Polynucleotide
taatacgactcactatagggtactctttgctcagctttcggggccggcctaacagaggagaaggccgatgccgaaagctaacctggcggcagcgcaaaagatg

SEQ ID NO: 114705 - DNA, 103 bp, Artificial Sequence
  Synthetic Polynucleotide
taatacgactcactatagggacagtcccagtactctttgctcagctttcgaacagaggagacgaaagatgagcaaagagaacctggcggcagcgcaaaagatg

SEQ ID NO: 114706 - DNA, 103 bp, Artificial Sequence
  Synthetic Polynucleotide
taatacgactcactatagggtgccctcgagacagtcccagtactctttgcaacagaggagagcaaagatgactgggactaacctggcggcagcgcaaaagatg

SEQ ID NO: 114707 - DNA, 103 bp, Artificial Sequence
  Synthetic Polynucleotide
taatacgactcactatagggttgctcttcttgccctcgagacagtcccagaacagaggagactgggaatgtctcgagggaacctggcggcagcgcaaaagatg

SEQ ID NO: 114708 - DNA, 103 bp, Artificial Sequence
  Synthetic Polynucleotide
taatacgactcactataggggggcgcgtgcttgctcttcttgccctcgagaacagaggagactcgagatgaagaagagcaacctggcggcagcgcaaaagatg

SEQ ID NO: 114709 - DNA, 103 bp, Artificial Sequence
  Synthetic Polynucleotide
taatacgactcactatagggtggcagcagggggaacagaggccagggtggaacagaggagaccacccatgcctctgttcaacctggcggcagcgcaaaagatg

SEQ ID NO: 114710 - DNA, 103 bp, Artificial Sequence
  Synthetic Polynucleotide
taatacgactcactataggggggtgcctctgggcgcgtgcttgctcttctaacagaggagaagaagaatgagcacgcgcaacctggcggcagcgcaaaagatg

SEQ ID NO: 114711 - DNA, 103 bp, Artificial Sequence
  Synthetic Polynucleotide
taatacgactcactatagggtcccacaggtgggtgcctctgggcgcgtgcaacagaggagagcacgcatgcagaggcacaacctggcggcagcgcaaaagatg

SEQ ID NO: 114712 - DNA, 103 bp, Artificial Sequence
  Synthetic Polynucleotide
taatacgactcactatagggccggatgaactcccacaggtgggtgcctctaacagaggagaagaggcatgcacctgtggaacctggcggcagcgcaaaagatg

SEQ ID NO: 114713 - DNA, 103 bp, Artificial Sequence
  Synthetic Polynucleotide
taatacgactcactatagggtgaggatgtcccggatgaactcccacaggtaacagaggagaacctgtatgagttcatccaacctggcggcagcgcaaaagatg

SEQ ID NO: 114714 - DNA, 103 bp, Artificial Sequence
  Synthetic Polynucleotide
taatacgactcactatagggtccgggtggatgaggatgtcccggatgaacaacagaggagagttcatatgggacatcctaacctggcggcagcgcaaaagatg

SEQ ID NO: 114715 - DNA, 103 bp, Artificial Sequence
  Synthetic Polynucleotide
taatacgactcactatagggctcgttgagctccgggtggatgaggatgtcaacagaggagagacatcatgatccacccgaacctggcggcagcgcaaaagatg

SEQ ID NO: 114716 - DNA, 103 bp, Artificial Sequence
  Synthetic Polynucleotide
taatacgactcactatagggtcatgaggccctcgttgagctccgggtggaaacagaggagatccaccatgagctcaacgaacctggcggcagcgcaaaagatg

SEQ ID NO: 114717 - DNA, 103 bp, Artificial Sequence
  Synthetic Polynucleotide
taatacgactcactatagggttctcccacttcatgaggccctcgttgagcaacagaggagagctcaaatggggcctcataacctggcggcagcgcaaaagatg

SEQ ID NO: 114718 - DNA, 103 bp, Artificial Sequence
  Synthetic Polynucleotide
taatacgactcactatagggttcatgccgattctcccacttcatgaggccaacagaggagaggcctcatgaagtgggagaacctggcggcagcgcaaaagatg

SEQ ID NO: 114719 - DNA, 103 bp, Artificial Sequence
  Synthetic Polynucleotide
taatacgactcactatagggtgaagacgccttcatgccgattctcccactaacagaggagaagtgggatgatcggcatgaacctggcggcagcgcaaaagatg

SEQ ID NO: 114720 - DNA, 103 bp, Artificial Sequence
  Synthetic Polynucleotide
taatacgactcactataggggccccaaaggtggcagcagggggaacagagaacagaggagactctgtatgccctgctgcaacctggcggcagcgcaaaagatg

SEQ ID NO: 114721 - DNA, 103 bp, Artificial Sequence
  Synthetic Polynucleotide
taatacgactcactatagggcgcaggaacttgaagacgccttcatgccgaaacagaggagatcggcaatgaggcgtcttaacctggcggcagcgcaaaagatg

SEQ ID NO: 114722 - DNA, 103 bp, Artificial Sequence
  Synthetic Polynucleotide
taatacgactcactatagggagcctcggagcgcaggaacttgaagacgccaacagaggagaggcgtcatgaagttcctgaacctggcggcagcgcaaaagatg

SEQ ID NO: 114723 - DNA, 103 bp, Artificial Sequence
  Synthetic Polynucleotide
taatacgactcactataggggttgggccacagcctcggagcgcaggaactaacagaggagaagttccatggctccgaggaacctggcggcagcgcaaaagatg

SEQ ID NO: 114724 - DNA, 103 bp, Artificial Sequence
  Synthetic Polynucleotide
taatacgactcactatagggtggccccatagttgggccacagcctcggagaacagaggagactccgaatgtgtggcccaaacctggcggcagcgcaaaagatg

SEQ ID NO: 114725 - DNA, 103 bp, Artificial Sequence
  Synthetic Polynucleotide
taatacgactcactatagggctttttcttttggccccatagttgggccacaacagaggagagtggccatgctatggggcaacctggcggcagcgcaaaagatg

SEQ ID NO: 114726 - DNA, 103 bp, Artificial Sequence
  Synthetic Polynucleotide
taatacgactcactatagggtgttgctgttctttttcttttggccccataaacagaggagatatgggatgaaaagaaaaaacctggcggcagcgcaaaagatg

SEQ ID NO: 114727 - DNA, 103 bp, Artificial Sequence
  Synthetic Polynucleotide
taatacgactcactatagggtcgtaggtcatgttgctgttctttttctttaacagaggagaaaagaaatggaacagcaaaacctggcggcagcgcaaaagatg

SEQ ID NO: 114728 - DNA, 103 bp, Artificial Sequence
  Synthetic Polynucleotide
taatacgactcactataggggctcagcttctcgtaggtcatgttgctgttaacagaggagaaacagcatgatgacctacaacctggcggcagcgcaaaagatg

SEQ ID NO: 114729 - DNA, 103 bp, Artificial Sequence
  Synthetic Polynucleotide
taatacgactcactatagggtcatggcccggctcagcttctcgtaggtcaaacagaggagatgacctatgagaagctgaaacctggcggcagcgcaaaagatg

SEQ ID NO: 114730 - DNA, 103 bp, Artificial Sequence
  Synthetic Polynucleotide
taatacgactcactatagggtagtagtacctcatggcccggctcagcttcaacagaggagagaagctatgccgggccataacctggcggcagcgcaaaagatg

SEQ ID NO: 114731 - DNA, 103 bp, Artificial Sequence
  Synthetic Polynucleotide
taatacgactcactatagggcaggtcactgggctgtagggtaatagccataacagaggagaatggctatgaccctacagaacctggcggcagcgcaaaagatg

SEQ ID NO: 114732 - DNA, 103 bp, Artificial Sequence
  Synthetic Polynucleotide
taatacgactcactatagggtacctgctccacgatcacagctgggaacacaacagaggagagtgttcatggctgtgatcaacctggcggcagcgcaaaagatg

SEQ ID NO: 114733 - DNA, 103 bp, Artificial Sequence
  Synthetic Polynucleotide
taatacgactcactataggggggggcagatctggatgagaccctggagctaacagaggagaagctccatggtctcatccaacctggcggcagcgcaaaagatg

SEQ ID NO: 114734 - DNA, 103 bp, Artificial Sequence
  Synthetic Polynucleotide
taatacgactcactatagggccttgccctggggggcagatctggatgagaaacagaggagatctcatatggatctgcccaacctggcggcagcgcaaaagatg

SEQ ID NO: 114735 - DNA, 103 bp, Artificial Sequence
  Synthetic Polynucleotide
taatacgactcactataggggaagagctgcccttgccctggggggcagataacagaggagaatctgcatgccagggcaaaacctggcggcagcgcaaaagatg

SEQ ID NO: 114736 - DNA, 103 bp, Artificial Sequence
  Synthetic Polynucleotide
taatacgactcactatagggcttctcccaagaagagctgcccttgccctgaacagaggagacagggcatgggcagctctaacctggcggcagcgcaaaagatg

SEQ ID NO: 114737 - DNA, 103 bp, Artificial Sequence
  Synthetic Polynucleotide
taatacgactcactataggggaatttttggcttctcccaagaagagctgcaacagaggagagcagctatgcttgggagaaacctggcggcagcgcaaaagatg

SEQ ID NO: 114738 - DNA, 103 bp, Artificial Sequence
  Synthetic Polynucleotide
taatacgactcactatagggccgacatgctgaatttttggcttctcccaaaacagaggagattgggaatggccaaaaataacctggcggcagcgcaaaagatg

SEQ ID NO: 114739 - DNA, 103 bp, Artificial Sequence
  Synthetic Polynucleotide
taatacgactcactatagggtggctggagaccgacatgctgaatttttggaacagaggagaccaaaaatgcagcatgtcaacctggcggcagcgcaaaagatg

SEQ ID NO: 114740 - DNA, 103 bp, Artificial Sequence
  Synthetic Polynucleotide
taatacgactcactataggggactcgcagatggctggagaccgacatgctaacagaggagaagcatgatggtctccagcaacctggcggcagcgcaaaagatg

SEQ ID NO: 114741 - DNA, 103 bp, Artificial Sequence
  Synthetic Polynucleotide
taatacgactcactatagggcccaattccagactcgcagatggctggagaaacagaggagatctccaatgatctgcgagaacctggcggcagcgcaaaagatg

SEQ ID NO: 114742 - DNA, 103 bp, Artificial Sequence
  Synthetic Polynucleotide
taatacgactcactatagggtagcgacggtcccaattccagactcgcagaaacagaggagatctgcgatgctggaattgaacctggcggcagcgcaaaagatg

SEQ ID NO: 114743 - DNA, 103 bp, Artificial Sequence
  Synthetic Polynucleotide
taatacgactcactatagggcagggtagggtacctgctccacgatcacagaacagaggagactgtgaatgtggagcaggaacctggcggcagcgcaaaagatg

SEQ ID NO: 114744 - DNA, 103 bp, Artificial Sequence
  Synthetic Polynucleotide
taatacgactcactatagggtctcctcgtctagcgacggtcccaattccaaacagaggagatggaatatggaccgtcgcaacctggcggcagcgcaaaagatg

SEQ ID NO: 114745 - DNA, 103 bp, Artificial Sequence
  Synthetic Polynucleotide
taatacgactcactataggggtagtggggatctcctcgtctagcgacggtaacagaggagaaccgtcatgagacgaggaaacctggcggcagcgcaaaagatg

SEQ ID NO: 114746 - DNA, 103 bp, Artificial Sequence
  Synthetic Polynucleotide
taatacgactcactatagggcatggtggaggtagtggggatctcctcgtcaacagaggagagacgagatgatccccactaacctggcggcagcgcaaaagatg

SEQ ID NO: 114747 - DNA, 103 bp, Artificial Sequence
  Synthetic Polynucleotide
taatacgactcactataggggagagacgagcatggtggaggtagtggggaaacagaggagatccccaatgcctccaccaaacctggcggcagcgcaaaagatg

SEQ ID NO: 114748 - DNA, 103 bp, Artificial Sequence
  Synthetic Polynucleotide
taatacgactcactatagggccctctgctggagagacgagcatggtggagaacagaggagactccacatggctcgtctcaacctggcggcagcgcaaaagatg

SEQ ID NO: 114749 - DNA, 103 bp, Artificial Sequence
  Synthetic Polynucleotide
taatacgactcactatagggcttgacctggccctctgctggagagacgagaacagaggagactcgtcatgccagcagagaacctggcggcagcgcaaaagatg

SEQ ID NO: 114750 - DNA, 103 bp, Artificial Sequence
  Synthetic Polynucleotide
taatacgactcactatagggctttggtgagcttgacctggccctctgctgaacagaggagacagcagatggccaggtcaaacctggcggcagcgcaaaagatg

SEQ ID NO: 114751 - DNA, 103 bp, Artificial Sequence
  Synthetic Polynucleotide
taatacgactcactataggggcactcacagctttggtgagcttgacctggaacagaggagaccaggtatggctcaccaaaacctggcggcagcgcaaaagatg

SEQ ID NO: 114752 - DNA, 103 bp, Artificial Sequence
  Synthetic Polynucleotide
taatacgactcactatagggcactgaagatgcactcacagctttggtgagaacagaggagactcaccatggctgtgagtaacctggcggcagcgcaaaagatg

SEQ ID NO: 114753 - DNA, 103 bp, Artificial Sequence
  Synthetic Polynucleotide
taatacgactcactatagggtgttgctgggcactgaagatgcactcacagaacagaggagactgtgaatgcatcttcagaacctggcggcagcgcaaaagatg

SEQ ID NO: 114754 - DNA, 103 bp, Artificial Sequence
  Synthetic Polynucleotide
taatacgactcactatagggtgcagtaaatcagggtagggtacctgctccaacagaggagaggagcaatgaccctacccaacctggcggcagcgcaaaagatg

SEQ ID NO: 114755 - DNA, 103 bp, Artificial Sequence
  Synthetic Polynucleotide
taatacgactcactatagggcctaggtggatgttgctgggcactgaagataacagaggagaatcttcatggcccagcaaaacctggcggcagcgcaaaagatg

SEQ ID NO: 114756 - DNA, 103 bp, Artificial Sequence
  Synthetic Polynucleotide
taatacgactcactataggggggggccactcctaggtggatgttgctgggaacagaggagacccagcatgatccacctaaacctggcggcagcgcaaaagatg

SEQ ID NO: 114757 - DNA, 103 bp, Artificial Sequence
  Synthetic Polynucleotide
taatacgactcactatagggccgaccccacgggggccactcctaggtggaaacagaggagatccaccatggagtggcccaacctggcggcagcgcaaaagatg

SEQ ID NO: 114758 - DNA, 103 bp, Artificial Sequence
  Synthetic Polynucleotide
taatacgactcactatagggagggccgagcccgaccccacgggggccactaacagaggagaagtggcatgcgtggggtcaacctggcggcagcgcaaaagatg

SEQ ID NO: 114759 - DNA, 103 bp, Artificial Sequence
  Synthetic Polynucleotide
taatacgactcactatagggctgcagggtcagggccgagcccgaccccacaacagaggagagtggggatgggctcggccaacctggcggcagcgcaaaagatg

SEQ ID NO: 114760 - DNA, 103 bp, Artificial Sequence
  Synthetic Polynucleotide
taatacgactcactataggggtgggatcgtctgcagggtcagggccgagcaacagaggagagctcggatgtgaccctgcaacctggcggcagcgcaaaagatg

SEQ ID NO: 114761 - DNA, 103 bp, Artificial Sequence
  Synthetic Polynucleotide
taatacgactcactatagggaccgtggtcagtgggatcgtctgcagggtcaacagaggagagaccctatggacgatcccaacctggcggcagcgcaaaagatg

SEQ ID NO: 114762 - DNA, 103 bp, Artificial Sequence
  Synthetic Polynucleotide
taatacgactcactatagggattggtcagcaccgtggtcagtgggatcgtaacagaggagaacgatcatgctgaccacgaacctggcggcagcgcaaaagatg

SEQ ID NO: 114763 - DNA, 103 bp, Artificial Sequence
  Synthetic Polynucleotide
taatacgactcactatagggcaggaggcccattggtcagcaccgtggtcaaacagaggagatgaccaatgtgctgaccaaacctggcggcagcgcaaaagatg

SEQ ID NO: 114764 - DNA, 103 bp, Artificial Sequence
  Synthetic Polynucleotide
taatacgactcactataggggtagtactggcaggaggcccattggtcagcaacagaggagagctgacatgtgggcctccaacctggcggcagcgcaaaagatg

SEQ ID NO: 114765 - DNA, 103 bp, Artificial Sequence
  Synthetic Polynucleotide
taatacgactcactatagggcgagtacagatgcagtaaatcagggtagggaacagaggagaccctacatggatttactgaacctggcggcagcgcaaaagatg

SEQ ID NO: 114766 - DNA, 103 bp, Artificial Sequence
  Synthetic Polynucleotide
taatacgactcactatagggagtgggagcagtagtactggcaggaggcccaacagaggagagggcctatggccagtactaacctggcggcagcgcaaaagatg

SEQ ID NO: 114767 - DNA, 103 bp, Artificial Sequence
  Synthetic Polynucleotide
taatacgactcactataggggaacgagctgagtgggagcagtagtactggaacagaggagaccagtaatgctgctcccaaacctggcggcagcgcaaaagatg

SEQ ID NO: 114768 - DNA, 103 bp, Artificial Sequence
  Synthetic Polynucleotide
taatacgactcactatagggacactctggagaacgagctgagtgggagcaaacagaggagatgctccatgtcagctcgtaacctggcggcagcgcaaaagatg

SEQ ID NO: 114769 - DNA, 103 bp, Artificial Sequence
  Synthetic Polynucleotide
taatacgactcactatagggggccgctggaacactctggagaacgagctgaacagaggagacagctcatgctccagagtaacctggcggcagcgcaaaagatg

SEQ ID NO: 114770 - DNA, 103 bp, Artificial Sequence
  Synthetic Polynucleotide
taatacgactcactatagggtgaaagtagaggccgctggaacactctggaaacagaggagatccagaatgttccagcggaacctggcggcagcgcaaaagatg

SEQ ID NO: 114771 - DNA, 103 bp, Artificial Sequence
  Synthetic Polynucleotide
taatacgactcactatagggaaggtgtccttgaaagtagaggccgctggaaacagaggagatccagcatgctctactttaacctggcggcagcgcaaaagatg

SEQ ID NO: 114772 - DNA, 103 bp, Artificial Sequence
  Synthetic Polynucleotide
taatacgactcactatagggctgcaaagtgaaggtgtccttgaaagtagaaacagaggagatctactatgaaggacaccaacctggcggcagcgcaaaagatg

SEQ ID NO: 114773 - DNA, 103 bp, Artificial Sequence
  Synthetic Polynucleotide
taatacgactcactatagggggaaagaggcctgcaaagtgaaggtgtcctaacagaggagaaggacaatgtcactttgcaacctggcggcagcgcaaaagatg

SEQ ID NO: 114774 - DNA, 103 bp, Artificial Sequence
  Synthetic Polynucleotide
taatacgactcactataggggcgttcagggggaaagaggcctgcaaagtgaacagaggagacactttatgggcctctttaacctggcggcagcgcaaaagatg

SEQ ID NO: 114775 - DNA, 103 bp, Artificial Sequence
  Synthetic Polynucleotide
taatacgactcactatagggttggaaactggcgttcagggggaaagaggcaacagaggagagcctctatgcccctgaacaacctggcggcagcgcaaaagatg

SEQ ID NO: 114776 - DNA, 103 bp, Artificial Sequence
  Synthetic Polynucleotide
taatacgactcactatagggactccagtcccgagtacagatgcagtaaataacagaggagaatttacatgatctgtactaacctggcggcagcgcaaaagatg

SEQ ID NO: 114777 - DNA, 103 bp, Artificial Sequence
  Synthetic Polynucleotide
taatacgactcactatagggcctggctgtcttggaaactggcgttcagggaacagaggagaccctgaatgccagtttccaacctggcggcagcgcaaaagatg

SEQ ID NO: 114778 - DNA, 103 bp, Artificial Sequence
  Synthetic Polynucleotide
taatacgactcactatagggggggctgccacctggctgtcttggaaactgaacagaggagacagtttatgagacagccaaacctggcggcagcgcaaaagatg

SEQ ID NO: 114779 - DNA, 103 bp, Artificial Sequence
  Synthetic Polynucleotide
taatacgactcactatagggtggagcccctggggctgccacctggctgtcaacagaggagagacagcatggtggcagccaacctggcggcagcgcaaaagatg

SEQ ID NO: 114780 - DNA, 103 bp, Artificial Sequence
  Synthetic Polynucleotide
taatacgactcactatagggtgagaatcagtggagcccctggggctgccaaacagaggagatggcagatgcaggggctcaacctggcggcagcgcaaaagatg

SEQ ID NO: 114781 - DNA, 103 bp, Artificial Sequence
  Synthetic Polynucleotide
taatacgactcactataggggggaggccactgagaatcagtggagcccctaacagaggagaaggggcatgactgattctaacctggcggcagcgcaaaagatg

SEQ ID NO: 114782 - DNA, 103 bp, Artificial Sequence
  Synthetic Polynucleotide
taatacgactcactatagggcagaagttgggggaggccactgagaatcagaacagaggagactgattatgagtggcctcaacctggcggcagcgcaaaagatg

SEQ ID NO: 114783 - DNA, 103 bp, Artificial Sequence
  Synthetic Polynucleotide
taatacgactcactatagggtggccccagccagaagttgggggaggccacaacagaggagagtggccatgcccaacttcaacctggcggcagcgcaaaagatg

SEQ ID NO: 114784 - DNA, 103 bp, Artificial Sequence
  Synthetic Polynucleotide
taatacgactcactataggggtcggacggttggccccagccagaagttggaacagaggagaccaactatgggctggggcaacctggcggcagcgcaaaagatg

SEQ ID NO: 114785 - DNA, 103 bp, Artificial Sequence
  Synthetic Polynucleotide
taatacgactcactatagggcgccgggttggtcggacggttggccccagcaacagaggagagctgggatgaaccgtccgaacctggcggcagcgcaaaagatg

SEQ ID NO: 114786 - DNA, 103 bp, Artificial Sequence
  Synthetic Polynucleotide
taatacgactcactatagggccgtgggtggcgccgggttggtcggacggtaacagaggagaaccgtcatgccaacccggaacctggcggcagcgcaaaagatg

SEQ ID NO: 114787 - DNA, 103 bp, Artificial Sequence
  Synthetic Polynucleotide
taatacgactcactatagggacgtcgtccaactccagtcccgagtacagaaacagaggagatctgtaatggggactggaaacctggcggcagcgcaaaagatg

SEQ ID NO: 114788 - DNA, 103 bp, Artificial Sequence
  Synthetic Polynucleotide
taatacgactcactataggggcccctgtgaccgtgggtggcgccgggttgaacagaggagacaacccatggccacccacaacctggcggcagcgcaaaagatg

SEQ ID NO: 114789 - DNA, 103 bp, Artificial Sequence
  Synthetic Polynucleotide
taatacgactcactatagggtgctggtccagcccctgtgaccgtgggtggaacagaggagaccacccatggtcacagggaacctggcggcagcgcaaaagatg

SEQ ID NO: 114790 - DNA, 103 bp, Artificial Sequence
  Synthetic Polynucleotide
taatacgactcactatagggagctgggccctgctggtccagcccctgtgaaacagaggagatcacagatgctggaccagaacctggcggcagcgcaaaagatg

SEQ ID NO: 114791 - DNA, 103 bp, Artificial Sequence
  Synthetic Polynucleotide
taatacgactcactataggggggggctgagagctgggccctgctggtccaaacagaggagatggaccatgagggcccagaacctggcggcagcgcaaaagatg

SEQ ID NO: 114792 - DNA, 103 bp, Artificial Sequence
  Synthetic Polynucleotide
taatacgactcactataggggacagtcccagggggctgagagctgggcccaacagaggagagggcccatgtctcagcccaacctggcggcagcgcaaaagatg

SEQ ID NO: 114793 - DNA, 103 bp, Artificial Sequence
  Synthetic Polynucleotide
taatacgactcactatagggaggcagcaatgacagtcccagggggctgagaacagaggagactcagcatgctgggactgaacctggcggcagcgcaaaagatg

SEQ ID NO: 114794 - DNA, 103 bp, Artificial Sequence
  Synthetic Polynucleotide
taatacgactcactataggggtcctgatgaaggcagcaatgacagtcccaaacagaggagatgggacatgcattgctgcaacctggcggcagcgcaaaagatg

SEQ ID NO: 114795 - DNA, 103 bp, Artificial Sequence
  Synthetic Polynucleotide
taatacgactcactatagggagtgccagaagtcctgatgaaggcagcaataacagaggagaattgctatgttcatcaggaacctggcggcagcgcaaaagatg

SEQ ID NO: 114796 - DNA, 103 bp, Artificial Sequence
  Synthetic Polynucleotide
taatacgactcactataggggggctgctgtagtgccagaagtcctgatgaaacagaggagatcatcaatgcttctggcaaacctggcggcagcgcaaaagatg

SEQ ID NO: 114797 - DNA, 103 bp, Artificial Sequence
  Synthetic Polynucleotide
taatacgactcactatagggttgaccctaggggctgctgtagtgccagaaaacagaggagattctggatgtacagcagcaacctggcggcagcgcaaaagatg

SEQ ID NO: 114798 - DNA, 103 bp, Artificial Sequence
  Synthetic Polynucleotide
taatacgactcactataggggccattgtgaacgtcgtccaactccagtccaacagaggagaggactgatgttggacgacaacctggcggcagcgcaaaagatg

SEQ ID NO: 114799 - DNA, 103 bp, Artificial Sequence
  Synthetic Polynucleotide
taatacgactcactatagggtggcccctccttgaccctaggggctgctgtaacagaggagaacagcaatgcctagggtcaacctggcggcagcgcaaaagatg

SEQ ID NO: 114800 - DNA, 103 bp, Artificial Sequence
  Synthetic Polynucleotide
taatacgactcactatagggaggacctcagtggcccctccttgaccctagaacagaggagactagggatgaggaggggcaacctggcggcagcgcaaaagatg

SEQ ID NO: 114801 - DNA, 103 bp, Artificial Sequence
  Synthetic Polynucleotide
taatacgactcactatagggacataggaggaggacctcagtggcccctccaacagaggagaggagggatgactgaggtcaacctggcggcagcgcaaaagatg

SEQ ID NO: 114802 - DNA, 103 bp, Artificial Sequence
  Synthetic Polynucleotide
taatacgactcactatagggcataccctgaacataggaggaggacctcagaacagaggagactgaggatgtcctcctataacctggcggcagcgcaaaagatg

SEQ ID NO: 114803 - DNA, 103 bp, Artificial Sequence
  Synthetic Polynucleotide
taatacgactcactatagggcccccgtcaccataccctgaacataggaggaacagaggagacctcctatgttcagggtaaacctggcggcagcgcaaaagatg

SEQ ID NO: 114804 - DNA, 103 bp, Artificial Sequence
  Synthetic Polynucleotide
taatacgactcactatagggtccatgggggcccccgtcaccataccctgaaacagaggagatcagggatgggtgacgggaacctggcggcagcgcaaaagatg

SEQ ID NO: 114805 - DNA, 103 bp, Artificial Sequence
  Synthetic Polynucleotide
taatacgactcactatagggcagcagcccctccatgggggcccccgtcacaacagaggagagtgacgatggcccccatgaacctggcggcagcgcaaaagatg

SEQ ID NO: 114806 - DNA, 103 bp, Artificial Sequence
  Synthetic Polynucleotide
taatacgactcactatagggcttcaggaaccagcagcccctccatgggggaacagaggagacccccaatgaggggctgcaacctggcggcagcgcaaaagatg

SEQ ID NO: 114807 - DNA, 103 bp, Artificial Sequence
  Synthetic Polynucleotide
taatacgactcactatagggctcagggtctcttcaggaaccagcagccccaacagaggagaggggctatgggttcctgaaacctggcggcagcgcaaaagatg

SEQ ID NO: 114808 - DNA, 103 bp, Artificial Sequence
  Synthetic Polynucleotide
taatacgactcactatagggcaggagctccctcagggtctcttcaggaacaacagaggagagttcctatggagaccctgaacctggcggcagcgcaaaagatg

SEQ ID NO: 114809 - DNA, 103 bp, Artificial Sequence
  Synthetic Polynucleotide
taatacgactcactatagggctgttatgatgccattgtgaacgtcgtccaaacagaggagatggacgatgttcacaatgaacctggcggcagcgcaaaagatg

SEQ ID NO: 114810 - DNA, 103 bp, Artificial Sequence
  Synthetic Polynucleotide
taatacgactcactatagggcctgatctctcaggagctccctcagggtctaacagaggagaagacccatggggagctccaacctggcggcagcgcaaaagatg

SEQ ID NO: 114811 - DNA, 103 bp, Artificial Sequence
  Synthetic Polynucleotide
taatacgactcactatagggtgaagatgagcctgatctctcaggagctccaacagaggagaggagctatggagagatcaaacctggcggcagcgcaaaagatg

SEQ ID NO: 114812 - DNA, 103 bp, Artificial Sequence
  Synthetic Polynucleotide
taatacgactcactatagggtggaagtggctgaagatgagcctgatctctaacagaggagaagagatatggctcatcttaacctggcggcagcgcaaaagatg

SEQ ID NO: 114813 - DNA, 103 bp, Artificial Sequence
  Synthetic Polynucleotide
taatacgactcactatagggccacctgggttggaagtggctgaagatgagaacagaggagactcatcatgagccacttcaacctggcggcagcgcaaaagatg

SEQ ID NO: 114814 - DNA, 103 bp, Artificial Sequence
  Synthetic Polynucleotide
taatacgactcactatagggcccctggaaaccacctgggttggaagtggcaacagaggagagccactatgaacccaggtaacctggcggcagcgcaaaagatg

SEQ ID NO: 114815 - DNA, 103 bp, Artificial Sequence
  Synthetic Polynucleotide
taatacgactcactatagggattgtgggaacccctggaaaccacctgggtaacagaggagaacccagatggtttccaggaacctggcggcagcgcaaaagatg

SEQ ID NO: 114816 - DNA, 103 bp, Artificial Sequence
  Synthetic Polynucleotide
taatacgactcactataggggaaggctcggattgtgggaacccctggaaaaacagaggagatttccaatggttcccacaaacctggcggcagcgcaaaagatg

SEQ ID NO: 114817 - DNA, 103 bp, Artificial Sequence
  Synthetic Polynucleotide
taatacgactcactatagggtggttgcccagaaggctcggattgtgggaaaacagaggagattcccaatgtccgagcctaacctggcggcagcgcaaaagatg

SEQ ID NO: 114818 - DNA, 103 bp, Artificial Sequence
  Synthetic Polynucleotide
taatacgactcactatagggagacaaagtctggttgcccagaaggctcggaacagaggagaccgagcatgctgggcaacaacctggcggcagcgcaaaagatg

SEQ ID NO: 114819 - DNA, 103 bp, Artificial Sequence
  Synthetic Polynucleotide
taatacgactcactatagggggctgggaggagacaaagtctggttgcccaaacagaggagatgggcaatgagactttgtaacctggcggcagcgcaaaagatg

SEQ ID NO: 114820 - DNA, 103 bp, Artificial Sequence
  Synthetic Polynucleotide
taatacgactcactatagggaaggtcccgtctgttatgatgccattgtgaaacagaggagatcacaaatgcatcataacaacctggcggcagcgcaaaagatg

SEQ ID NO: 114821 - DNA, 103 bp, Artificial Sequence
  Synthetic Polynucleotide
taatacgactcactatagggacagtggggcggctgggaggagacaaagtcaacagaggagagactttatgtcctcccagaacctggcggcagcgcaaaagatg

SEQ ID NO: 114822 - DNA, 103 bp, Artificial Sequence
  Synthetic Polynucleotide
taatacgactcactatagggggtcagcccaacagtggggcggctgggaggaacagaggagacctcccatgcgccccactaacctggcggcagcgcaaaagatg

SEQ ID NO: 114823 - DNA, 103 bp, Artificial Sequence
  Synthetic Polynucleotide
taatacgactcactatagggcagccactggggtcagcccaacagtggggcaacagaggagagccccaatgttgggctgaaacctggcggcagcgcaaaagatg

SEQ ID NO: 114824 - DNA, 103 bp, Artificial Sequence
  Synthetic Polynucleotide
taatacgactcactatagggagctcaagttcagccactggggtcagcccaaacagaggagatgggctatgcccagtggcaacctggcggcagcgcaaaagatg

SEQ ID NO: 114825 - DNA, 103 bp, Artificial Sequence
  Synthetic Polynucleotide
taatacgactcactataggggcctgaggagagctcaagttcagccactggaacagaggagaccagtgatggaacttgagaacctggcggcagcgcaaaagatg

SEQ ID NO: 114826 - DNA, 103 bp, Artificial Sequence
  Synthetic Polynucleotide
taatacgactcactataggggggaccctgagcctgaggagagctcaagttaacagaggagaaacttgatgtctcctcagaacctggcggcagcgcaaaagatg

SEQ ID NO: 114827 - DNA, 103 bp, Artificial Sequence
  Synthetic Polynucleotide
taatacgactcactataggggccatcagcagggaccctgagcctgaggagaacagaggagactcctcatgctcagggtcaacctggcggcagcgcaaaagatg

SEQ ID NO: 114828 - DNA, 103 bp, Artificial Sequence
  Synthetic Polynucleotide
taatacgactcactatagggactaggctcagccatcagcagggaccctgaaacagaggagatcagggatgctgctgatgaacctggcggcagcgcaaaagatg

SEQ ID NO: 114829 - DNA, 103 bp, Artificial Sequence
  Synthetic Polynucleotide
taatacgactcactatagggatgtggtcacactaggctcagccatcagcaaacagaggagatgctgaatgctgagcctaaacctggcggcagcgcaaaagatg

SEQ ID NO: 114830 - DNA, 103 bp, Artificial Sequence
  Synthetic Polynucleotide
taatacgactcactatagggaggctcccagatgtggtcacactaggctcaaacagaggagatgagccatgtgtgaccacaacctggcggcagcgcaaaagatg

SEQ ID NO: 114831 - DNA, 103 bp, Artificial Sequence
  Synthetic Polynucleotide
taatacgactcactatagggcgtcatgcacaaggtcccgtctgttatgataacagaggagaatcataatggacgggaccaacctggcggcagcgcaaaagatg

SEQ ID NO: 114832 - DNA, 103 bp, Artificial Sequence
  Synthetic Polynucleotide
taatacgactcactatagggtcttgtcagaaggctcccagatgtggtcacaacagaggagagtgaccatgtctgggagcaacctggcggcagcgcaaaagatg

SEQ ID NO: 114833 - DNA, 103 bp, Artificial Sequence
  Synthetic Polynucleotide
taatacgactcactataggggggtgggggatcttgtcagaaggctcccagaacagaggagactgggaatgttctgacaaaacctggcggcagcgcaaaagatg

SEQ ID NO: 114834 - DNA, 103 bp, Artificial Sequence
  Synthetic Polynucleotide
taatacgactcactatagggaaaggggctggggtgggggatcttgtcagaaacagaggagatctgacatgatcccccacaacctggcggcagcgcaaaagatg

SEQ ID NO: 114835 - DNA, 103 bp, Artificial Sequence
  Synthetic Polynucleotide
taatacgactcactataggggaatggggagaaaggggctggggtgggggaaacagaggagatcccccatgccagcccctaacctggcggcagcgcaaaagatg

SEQ ID NO: 114836 - DNA, 103 bp, Artificial Sequence
  Synthetic Polynucleotide
taatacgactcactatagggaagtagggttgaatggggagaaaggggctgaacagaggagacagcccatgtctccccataacctggcggcagcgcaaaagatg

SEQ ID NO: 114837 - DNA, 103 bp, Artificial Sequence
  Synthetic Polynucleotide
taatacgactcactatagggttaatgagggaagtagggttgaatggggagaacagaggagactccccatgcaaccctacaacctggcggcagcgcaaaagatg

SEQ ID NO: 114838 - DNA, 103 bp, Artificial Sequence
  Synthetic Polynucleotide
taatacgactcactataggggggctccatcttaatgagggaagtagggttaacagaggagaaaccctatgtccctcattaacctggcggcagcgcaaaagatg

SEQ ID NO: 114839 - DNA, 103 bp, Artificial Sequence
  Synthetic Polynucleotide
taatacgactcactatagggatatgtcatggggctccatcttaatgagggaacagaggagaccctcaatgagatggagcaacctggcggcagcgcaaaagatg

SEQ ID NO: 114840 - DNA, 103 bp, Artificial Sequence
  Synthetic Polynucleotide
taatacgactcactatagggactcaaagatcaggtcactgggctgtagggaacagaggagaccctacatgccagtgaccaacctggcggcagcgcaaaagatg

SEQ ID NO: 114841 - DNA, 103 bp, Artificial Sequence
  Synthetic Polynucleotide
taatacgactcactatagggtctgatcctgcgtcatgcacaaggtcccgtaacagaggagaacgggaatgtgtgcatgaaacctggcggcagcgcaaaagatg

SEQ ID NO: 114842 - DNA, 103 bp, Artificial Sequence
  Synthetic Polynucleotide
taatacgactcactatagggccttccaggatctgatcctgcgtcatgcacaacagaggagagtgcatatggcaggatcaaacctggcggcagcgcaaaagatg

SEQ ID NO: 114843 - DNA, 103 bp, Artificial Sequence
  Synthetic Polynucleotide
taatacgactcactatagggcaaaaaactgccttccaggatctgatcctgaacagaggagacaggatatgatcctggaaaacctggcggcagcgcaaaagatg

SEQ ID NO: 114844 - DNA, 103 bp, Artificial Sequence
  Synthetic Polynucleotide
taatacgactcactatagggcatctgtcagcaaaaaactgccttccaggaaacagaggagatcctggatggcagtttttaacctggcggcagcgcaaaagatg

SEQ ID NO: 114845 - DNA, 103 bp, Artificial Sequence
  Synthetic Polynucleotide
taatacgactcactataggggcctcattgtcatctgtcagcaaaaaactgaacagaggagacagtttatggctgacagaaacctggcggcagcgcaaaagatg

SEQ ID NO: 114846 - DNA, 103 bp, Artificial Sequence
  Synthetic Polynucleotide
taatacgactcactataggggtgcgaggtggcctcattgtcatctgtcagaacagaggagactgacaatggacaatgagaacctggcggcagcgcaaaagatg

SEQ ID NO: 114847 - DNA, 103 bp, Artificial Sequence
  Synthetic Polynucleotide
taatacgactcactatagggttgacatggtgtgcgaggtggcctcattgtaacagaggagaacaatgatgccacctcgcaacctggcggcagcgcaaaagatg

SEQ ID NO: 114848 - DNA, 103 bp, Artificial Sequence
  Synthetic Polynucleotide
taatacgactcactatagggacttccgcggttgacatggtgtgcgaggtgaacagaggagacacctcatgcaccatgtcaacctggcggcagcgcaaaagatg

SEQ ID NO: 114849 - DNA, 103 bp, Artificial Sequence
  Synthetic Polynucleotide
taatacgactcactatagggattgagtaagacttccgcggttgacatggtaacagaggagaaccatgatgaccgcggaaaacctggcggcagcgcaaaagatg

SEQ ID NO: 114850 - DNA, 103 bp, Artificial Sequence
  Synthetic Polynucleotide
taatacgactcactataggggagactccatattgagtaagacttccgcggaacagaggagaccgcggatgtcttactcaaacctggcggcagcgcaaaagatg

SEQ ID NO: 114851 - DNA, 103 bp, Artificial Sequence
  Synthetic Polynucleotide
taatacgactcactatagggttgcttgcgaactcaaagatcaggtcactgaacagaggagacagtgaatggatctttgaaacctggcggcagcgcaaaagatg

SEQ ID NO: 114852 - DNA, 103 bp, Artificial Sequence
  Synthetic Polynucleotide
taatacgactcactatagggatatcgctgggagactccatattgagtaagaacagaggagacttactatgtatggagtcaacctggcggcagcgcaaaagatg

SEQ ID NO: 114853 - DNA, 103 bp, Artificial Sequence
  Synthetic Polynucleotide
taatacgactcactatagggctcatccaggatatcgctgggagactccataacagaggagaatggagatgcccagcgataacctggcggcagcgcaaaagatg

SEQ ID NO: 114854 - DNA, 103 bp, Artificial Sequence
  Synthetic Polynucleotide
taatacgactcactatagggagatctgcttctcatccaggatatcgctggaacagaggagaccagcgatgtcctggatgaacctggcggcagcgcaaaagatg

SEQ ID NO: 114855 - DNA, 103 bp, Artificial Sequence
  Synthetic Polynucleotide
taatacgactcactataggggaggtactgaagatctgcttctcatccaggaacagaggagacctggaatggaagcagataacctggcggcagcgcaaaagatg

SEQ ID NO: 114856 - DNA, 103 bp, Artificial Sequence
  Synthetic Polynucleotide
taatacgactcactatagggaagcatttcggaggtactgaagatctgcttaacagaggagaaagcagatgttcagtaccaacctggcggcagcgcaaaagatg

SEQ ID NO: 114857 - DNA, 103 bp, Artificial Sequence
  Synthetic Polynucleotide
taatacgactcactatagggccgagtctggaagcatttcggaggtactgaaacagaggagatcagtaatgccgaaatgcaacctggcggcagcgcaaaagatg

SEQ ID NO: 114858 - DNA, 103 bp, Artificial Sequence
  Synthetic Polynucleotide
taatacgactcactatagggggtgcagggtccgagtctggaagcatttcgaacagaggagacgaaatatgtccagactcaacctggcggcagcgcaaaagatg

SEQ ID NO: 114859 - DNA, 103 bp, Artificial Sequence
  Synthetic Polynucleotide
taatacgactcactatagggagtgacagctggtgcagggtccgagtctggaacagaggagaccagacatggaccctgcaaacctggcggcagcgcaaaagatg

SEQ ID NO: 114860 - DNA, 103 bp, Artificial Sequence
  Synthetic Polynucleotide
taatacgactcactatagggagttgggcagagtgacagctggtgcagggtaacagaggagaaccctgatgcagctgtcaaacctggcggcagcgcaaaagatg

SEQ ID NO: 114861 - DNA, 103 bp, Artificial Sequence
  Synthetic Polynucleotide
taatacgactcactatagggggaaacaggtagttgggcagagtgacagctaacagaggagaagctgtatgtctgcccaaaacctggcggcagcgcaaaagatg

SEQ ID NO: 114862 - DNA, 103 bp, Artificial Sequence
  Synthetic Polynucleotide
taatacgactcactatagggatccatcccgttgcttgcgaactcaaagataacagaggagaatctttatgttcgcaagcaacctggcggcagcgcaaaagatg

SEQ ID NO: 114863 - DNA, 103 bp, Artificial Sequence
  Synthetic Polynucleotide
taatacgactcactatagggctcagaggcaggaaacaggtagttgggcagaacagaggagactgcccatgtacctgtttaacctggcggcagcgcaaaagatg

SEQ ID NO: 114864 - DNA, 103 bp, Artificial Sequence
  Synthetic Polynucleotide
taatacgactcactataggggggcatcgggctcagaggcaggaaacaggtaacagaggagaacctgtatgctgcctctgaacctggcggcagcgcaaaagatg

SEQ ID NO: 114865 - DNA, 103 bp, Artificial Sequence
  Synthetic Polynucleotide
taatacgactcactataggggccctgttcagggcatcgggctcagaggcaaacagaggagatgcctcatggcccgatgcaacctggcggcagcgcaaaagatg

SEQ ID NO: 114866 - DNA, 103 bp, Artificial Sequence
  Synthetic Polynucleotide
taatacgactcactatagggagtgtcacccgccctgttcagggcatcgggaacagaggagacccgatatgctgaacaggaacctggcggcagcgcaaaagatg

SEQ ID NO: 114867 - DNA, 103 bp, Artificial Sequence
  Synthetic Polynucleotide
taatacgactcactatagggcctggtcactagtgtcacccgccctgttcaaacagaggagatgaacaatgcgggtgacaaacctggcggcagcgcaaaagatg

SEQ ID NO: 114868 - DNA, 103 bp, Artificial Sequence
  Synthetic Polynucleotide
taatacgactcactataggggaatgcccctcctggtcactagtgtcacccaacagaggagagggtgaatgtagtgaccaaacctggcggcagcgcaaaagatg

SEQ ID NO: 114869 - DNA, 103 bp, Artificial Sequence
  Synthetic Polynucleotide
taatacgactcactatagggctcctccagagaatgcccctcctggtcactaacagaggagaagtgacatggaggggcataacctggcggcagcgcaaaagatg

SEQ ID NO: 114870 - DNA, 103 bp, Artificial Sequence
  Synthetic Polynucleotide
taatacgactcactatagggtggaggccttctcctccagagaatgcccctaacagaggagaaggggcatgctctggaggaacctggcggcagcgcaaaagatg

SEQ ID NO: 114871 - DNA, 103 bp, Artificial Sequence
  Synthetic Polynucleotide
taatacgactcactatagggctttcctctctggaggccttctcctccagaaacagaggagatctggaatggaaggcctcaacctggcggcagcgcaaaagatg

SEQ ID NO: 114872 - DNA, 103 bp, Artificial Sequence
  Synthetic Polynucleotide
taatacgactcactatagggcttcttggcactttcctctctggaggccttaacagaggagaaaggccatgagagaggaaaacctggcggcagcgcaaaagatg

SEQ ID NO: 114873 - DNA, 103 bp, Artificial Sequence
  Synthetic Polynucleotide
taatacgactcactatagggggatatcatcatccatcccgttgcttgcgaaacagaggagatcgcaaatgacgggatggaacctggcggcagcgcaaaagatg

SEQ ID NO: 114874 - DNA, 103 bp, Artificial Sequence
  Synthetic Polynucleotide
taatacgactcactatagggatttcccagtcttcttggcactttcctctcaacagaggagagagaggatggtgccaagaaacctggcggcagcgcaaaagatg

SEQ ID NO: 114875 - DNA, 103 bp, Artificial Sequence
  Synthetic Polynucleotide
taatacgactcactatagggctcttctttgatttcccagtcttcttggcaaacagaggagatgccaaatggactgggaaaacctggcggcagcgcaaaagatg

SEQ ID NO: 114876 - DNA, 103 bp, Artificial Sequence
  Synthetic Polynucleotide
taatacgactcactatagggcttccggattctcttctttgatttcccagtaacagaggagaactgggatgtcaaagaagaacctggcggcagcgcaaaagatg

SEQ ID NO: 114877 - DNA, 103 bp, Artificial Sequence
  Synthetic Polynucleotide
taatacgactcactatagggtgcccttggtcttccggattctcttctttgaacagaggagacaaagaatggaatccggaaacctggcggcagcgcaaaagatg

SEQ ID NO: 114878 - DNA, 103 bp, Artificial Sequence
  Synthetic Polynucleotide
taatacgactcactataggggtacttcggttgcccttggtcttccggattaacagaggagaaatccgatggaccaagggaacctggcggcagcgcaaaagatg

SEQ ID NO: 114879 - DNA, 103 bp, Artificial Sequence
  Synthetic Polynucleotide
taatacgactcactataggggacaggtgaggtacttcggttgcccttggtaacagaggagaaccaagatgaaccgaagtaacctggcggcagcgcaaaagatg

SEQ ID NO: 114880 - DNA, 103 bp, Artificial Sequence
  Synthetic Polynucleotide
taatacgactcactatagggtggggtcagtgacaggtgaggtacttcggtaacagaggagaaccgaaatgcctcacctgaacctggcggcagcgcaaaagatg

SEQ ID NO: 114881 - DNA, 103 bp, Artificial Sequence
  Synthetic Polynucleotide
taatacgactcactatagggatggggatgctggggtcagtgacaggtgagaacagaggagactcaccatgcactgacccaacctggcggcagcgcaaaagatg

SEQ ID NO: 114882 - DNA, 103 bp, Artificial Sequence
  Synthetic Polynucleotide
taatacgactcactatagggtttcttcctaatggggatgctggggtcagtaacagaggagaactgacatgagcatccccaacctggcggcagcgcaaaagatg

SEQ ID NO: 114883 - DNA, 103 bp, Artificial Sequence
  Synthetic Polynucleotide
taatacgactcactatagggcatcctttgatttcttcctaatggggatgcaacagaggagagcatccatgttaggaagaaacctggcggcagcgcaaaagatg

SEQ ID NO: 114884 - DNA, 103 bp, Artificial Sequence
  Synthetic Polynucleotide
taatacgactcactatagggtccagctggtggatatcatcatccatcccgaacagaggagacgggatatgtgatgatataacctggcggcagcgcaaaagatg

SEQ ID NO: 114885 - DNA, 103 bp, Artificial Sequence
  Synthetic Polynucleotide
taatacgactcactatagggctgcctttgccatcctttgatttcttcctaaacagaggagataggaaatgatcaaaggaaacctggcggcagcgcaaaagatg

SEQ ID NO: 114886 - DNA, 103 bp, Artificial Sequence
  Synthetic Polynucleotide
taatacgactcactatagggatagatggtgctgcctttgccatcctttgaaacagaggagatcaaagatgggcaaaggcaacctggcggcagcgcaaaagatg

SEQ ID NO: 114887 - DNA, 103 bp, Artificial Sequence
  Synthetic Polynucleotide
taatacgactcactatagggactcccacagatagatggtgctgcctttgcaacagaggagagcaaagatggcaccatctaacctggcggcagcgcaaaagatg

SEQ ID NO: 114888 - DNA, 103 bp, Artificial Sequence
  Synthetic Polynucleotide
taatacgactcactataggggccaggaggaactcccacagatagatggtgaacagaggagacaccatatgtctgtgggaaacctggcggcagcgcaaaagatg

SEQ ID NO: 114889 - DNA, 103 bp, Artificial Sequence
  Synthetic Polynucleotide
taatacgactcactatagggttgcagaagagccaggaggaactcccacagaacagaggagactgtggatgttcctcctgaacctggcggcagcgcaaaagatg

SEQ ID NO: 114890 - DNA, 103 bp, Artificial Sequence
  Synthetic Polynucleotide
taatacgactcactatagggtgtttctgtcttgcagaagagccaggaggaaacagaggagatcctccatgctcttctgcaacctggcggcagcgcaaaagatg

SEQ ID NO: 114891 - DNA, 103 bp, Artificial Sequence
  Synthetic Polynucleotide
taatacgactcactatagggttgggacaggtgtttctgtcttgcagaagaaacagaggagatcttctatgagacagaaaaacctggcggcagcgcaaaagatg

SEQ ID NO: 114892 - DNA, 103 bp, Artificial Sequence
  Synthetic Polynucleotide
taatacgactcactatagggcttgatgtacttgggacaggtgtttctgtcaacagaggagagacagaatgacctgtcccaacctggcggcagcgcaaaagatg

SEQ ID NO: 114893 - DNA, 103 bp, Artificial Sequence
  Synthetic Polynucleotide
taatacgactcactataggggctgggtccacttgatgtacttgggacaggaacagaggagacctgtcatgagtacatcaaacctggcggcagcgcaaaagatg

SEQ ID NO: 114894 - DNA, 103 bp, Artificial Sequence
  Synthetic Polynucleotide
taatacgactcactatagggcctttctctcgctgggtccacttgatgtacaacagaggagagtacatatggtggacccaaacctggcggcagcgcaaaagatg

SEQ ID NO: 114895 - DNA, 103 bp, Artificial Sequence
  Synthetic Polynucleotide
taatacgactcactatagggagaggggtcttccagctggtggatatcatcaacagaggagagatgatatgcaccagctgaacctggcggcagcgcaaaagatg

SEQ ID NO: 114896 - DNA, 103 bp, Artificial Sequence
  Synthetic Polynucleotide
taatacgactcactatagggtttgaagatgcctttctctcgctgggtccaaacagaggagatggaccatgcgagagaaaaacctggcggcagcgcaaaagatg

SEQ ID NO: 114897 - DNA, 103 bp, Artificial Sequence
  Synthetic Polynucleotide
taatacgactcactatagggagtccaccagtttgaagatgcctttctctcaacagaggagagagagaatggcatcttcaaacctggcggcagcgcaaaagatg

SEQ ID NO: 114898 - DNA, 103 bp, Artificial Sequence
  Synthetic Polynucleotide
taatacgactcactatagggacagctttggagtccaccagtttgaagatgaacagaggagacatcttatgactggtggaaacctggcggcagcgcaaaagatg

SEQ ID NO: 114899 - DNA, 103 bp, Artificial Sequence
  Synthetic Polynucleotide
taatacgactcactatagggcagcttggacacagctttggagtccaccagaacagaggagactggtgatgtccaaagctaacctggcggcagcgcaaaagatg

SEQ ID NO: 114900 - DNA, 103 bp, Artificial Sequence
  Synthetic Polynucleotide
taatacgactcactataggggcttcccccacagcttggacacagctttggaacagaggagaccaaagatgtgtccaagcaacctggcggcagcgcaaaagatg

SEQ ID NO: 114901 - DNA, 103 bp, Artificial Sequence
  Synthetic Polynucleotide
taatacgactcactatagggttgtttttctgcttcccccacagcttggacaacagaggagagtccaaatggtgggggaaaacctggcggcagcgcaaaagatg

SEQ ID NO: 114902 - DNA, 103 bp, Artificial Sequence
  Synthetic Polynucleotide
taatacgactcactatagggcatgtcaggcttgtttttctgcttcccccaaacagaggagatgggggatgcagaaaaacaacctggcggcagcgcaaaagatg

SEQ ID NO: 114903 - DNA, 103 bp, Artificial Sequence
  Synthetic Polynucleotide
taatacgactcactatagggtctcatagttcatgtcaggcttgtttttctaacagaggagaagaaaaatgagcctgacaaacctggcggcagcgcaaaagatg

SEQ ID NO: 114904 - DNA, 103 bp, Artificial Sequence
  Synthetic Polynucleotide
taatacgactcactatagggcgccccattgtctcatagttcatgtcaggcaacagaggagagcctgaatggaactatgaaacctggcggcagcgcaaaagatg

SEQ ID NO: 114905 - DNA, 103 bp, Artificial Sequence
  Synthetic Polynucleotide
taatacgactcactatagggtcttagtgcccgccccattgtctcatagttaacagaggagaaactatatgacaatggggaacctggcggcagcgcaaaagatg

SEQ ID NO: 114906 - DNA, 103 bp, Artificial Sequence
  Synthetic Polynucleotide
taatacgactcactatagggctgggaacacagaggggtcttccagctggtaacagaggagaaccagcatgaagacccctaacctggcggcagcgcaaaagatg

SEQ ID NO: 114907 - DNA, 103 bp, Artificial Sequence
  Synthetic Polynucleotide
taatacgactcactatagggggtagtagtatcttagtgcccgccccattgaacagaggagacaatggatggggcactaaaacctggcggcagcgcaaaagatg

SEQ ID NO: 114908 - DNA, 103 bp, Artificial Sequence
  Synthetic Polynucleotide
taatacgactcactatagggatgcctctttggtagtagtatcttagtgccaacagaggagaggcactatgatactactaaacctggcggcagcgcaaaagatg

SEQ ID NO: 114909 - DNA, 103 bp, Artificial Sequence
  Synthetic Polynucleotide
taatacgactcactatagggtttggccagtatgcctctttggtagtagtaaacagaggagatactacatgcaaagaggcaacctggcggcagcgcaaaagatg

SEQ ID NO: 114910 - DNA, 103 bp, Artificial Sequence
  Synthetic Polynucleotide
taatacgactcactataggggcccttccactttggccagtatgcctctttaacagaggagaaaagagatgtactggccaaacctggcggcagcgcaaaagatg

SEQ ID NO: 114911 - DNA, 103 bp, Artificial Sequence
  Synthetic Polynucleotide
taatacgactcactatagggaccagcctctgcccttccactttggccagtaacagaggagaactggcatgagtggaaggaacctggcggcagcgcaaaagatg

SEQ ID NO: 114912 - DNA, 103 bp, Artificial Sequence
  Synthetic Polynucleotide
taatacgactcactatagggaaactggtacaccagcctctgcccttccacaacagaggagagtggaaatgcagaggctgaacctggcggcagcgcaaaagatg

SEQ ID NO: 114913 - DNA, 103 bp, Artificial Sequence
  Synthetic Polynucleotide
taatacgactcactataggggcatctccttaaactggtacaccagcctctaacagaggagaagaggcatgtgtaccagtaacctggcggcagcgcaaaagatg

SEQ ID NO: 114914 - DNA, 103 bp, Artificial Sequence
  Synthetic Polynucleotide
taatacgactcactatagggaggtccttgggcatctccttaaactggtacaacagaggagagtaccaatgtaaggagataacctggcggcagcgcaaaagatg

SEQ ID NO: 114915 - DNA, 103 bp, Artificial Sequence
  Synthetic Polynucleotide
taatacgactcactatagggaatgaccaccaggtccttgggcatctccttaacagaggagaaaggagatgcccaaggacaacctggcggcagcgcaaaagatg

SEQ ID NO: 114916 - DNA, 103 bp, Artificial Sequence
  Synthetic Polynucleotide
taatacgactcactatagggcctcatcttcaatgaccaccaggtccttggaacagaggagaccaaggatgtggtggtcaaacctggcggcagcgcaaaagatg

SEQ ID NO: 114917 - DNA, 103 bp, Artificial Sequence
  Synthetic Polynucleotide
taatacgactcactatagggacgatcacagctgggaacacagaggggtctaacagaggagaagacccatgtgtgttcccaacctggcggcagcgcaaaagatg

SEQ ID NO: 114918 - DNA, 103 bp, Artificial Sequence
  Synthetic Polynucleotide
taatacgactcactatagggctgctctcatcctcatcttcaatgaccaccaacagaggagaggtggtatgtgaagatgaaacctggcggcagcgcaaaagatg

SEQ ID NO: 114919 - DNA, 103 bp, Artificial Sequence
  Synthetic Polynucleotide
taatacgactcactatagggtgtggcttcgctgctctcatcctcatcttcaacagaggagagaagatatggatgagagcaacctggcggcagcgcaaaagatg

SEQ ID NO: 114920 - DNA, 103 bp, Artificial Sequence
  Synthetic Polynucleotide
taatacgactcactataggggtggggctgctgtggcttcgctgctctcataacagaggagaatgagaatggcgaagccaaacctggcggcagcgcaaaagatg

SEQ ID NO: 114921 - DNA, 103 bp, Artificial Sequence
  Synthetic Polynucleotide
taatacgactcactataggggaggcctgaggtggggctgctgtggcttcgaacagaggagacgaagcatgagcagccccaacctggcggcagcgcaaaagatg

SEQ ID NO: 114922 - DNA, 103 bp, Artificial Sequence
  Synthetic Polynucleotide
taatacgactcactatagggagaggccgtggaggcctgaggtggggctgcaacagaggagagcagccatgcctcaggccaacctggcggcagcgcaaaagatg

SEQ ID NO: 114923 - DNA, 103 bp, Artificial Sequence
  Synthetic Polynucleotide
taatacgactcactatagggcagaggccacagaggccgtggaggcctgagaacagaggagactcaggatgccacggcctaacctggcggcagcgcaaaagatg

SEQ ID NO: 114924 - DNA, 103 bp, Artificial Sequence
  Synthetic Polynucleotide
taatacgactcactataggggtggtactggcagaggccacagaggccgtgaacagaggagacacggcatgtgtggcctcaacctggcggcagcgcaaaagatg

SEQ ID NO: 114925 - DNA, 103 bp, Artificial Sequence
  Synthetic Polynucleotide
taatacgactcactatagggggttcgccgggtggtactggcagaggccacaacagaggagagtggccatggccagtaccaacctggcggcagcgcaaaagatg

SEQ ID NO: 114926 - DNA, 103 bp, Artificial Sequence
  Synthetic Polynucleotide
taatacgactcactatagggccctggagctggttcgccgggtggtactggaacagaggagaccagtaatgcccggcgaaaacctggcggcagcgcaaaagatg

SEQ ID NO: 114927 - DNA, 103 bp, Artificial Sequence
  Synthetic Polynucleotide
taatacgactcactatagggctggatgagaccctggagctggttcgccggaacagaggagaccggcgatgcagctccagaacctggcggcagcgcaaaagatg

SEQ ID NO: 114928 - DNA, 103 bp, Artificial Sequence
  Synthetic Polynucleotide
taatacgactcactatagggtaccctgtgggagtgaggcagagatggcataacagaggagaatgccaatgctgcctcacaacctggcggcagcgcaaaagatg

SEQ ID NO: 114929 - DNA, 103 bp, Artificial Sequence
  Synthetic Polynucleotide
taatacgactcactatagggttcattgctgaacagatcagtccacgacataacagaggagaatgtcgatgactgatctgaacctggcggcagcgcaaaagatg

SEQ ID NO: 114930 - DNA, 103 bp, Artificial Sequence
  Synthetic Polynucleotide
taatacgactcactatagggggtagtactcttcattgctgaacagatcagaacagaggagactgatcatgtcagcaatgaacctggcggcagcgcaaaagatg

SEQ ID NO: 114931 - DNA, 103 bp, Artificial Sequence
  Synthetic Polynucleotide
taatacgactcactatagggtcaaaggcagggtagtactcttcattgctgaacagaggagacagcaaatgagagtactaaacctggcggcagcgcaaaagatg

SEQ ID NO: 114932 - DNA, 103 bp, Artificial Sequence
  Synthetic Polynucleotide
taatacgactcactatagggtgtctgatgctcaaaggcagggtagtactcaacagaggagagagtacatgcctgcctttaacctggcggcagcgcaaaagatg

SEQ ID NO: 114933 - DNA, 103 bp, Artificial Sequence
  Synthetic Polynucleotide
taatacgactcactatagggagtcacaggctgtctgatgctcaaaggcagaacagaggagactgcctatgagcatcagaaacctggcggcagcgcaaaagatg

SEQ ID NO: 114934 - DNA, 103 bp, Artificial Sequence
  Synthetic Polynucleotide
taatacgactcactataggggtccagtatgagtcacaggctgtctgatgcaacagaggagagcatcaatgagcctgtgaaacctggcggcagcgcaaaagatg

SEQ ID NO: 114935 - DNA, 103 bp, Artificial Sequence
  Synthetic Polynucleotide
taatacgactcactataggggtggactgatgtccagtatgagtcacaggcaacagaggagagcctgtatgtcatactggaacctggcggcagcgcaaaagatg

SEQ ID NO: 114936 - DNA, 103 bp, Artificial Sequence
  Synthetic Polynucleotide
taatacgactcactatagggagtattcagggtggactgatgtccagtatgaacagaggagacatactatgcatcagtccaacctggcggcagcgcaaaagatg

SEQ ID NO: 114937 - DNA, 103 bp, Artificial Sequence
  Synthetic Polynucleotide
taatacgactcactatagggcgcttagtccagtattcagggtggactgataacagaggagaatcagtatgccctgaataaacctggcggcagcgcaaaagatg

SEQ ID NO: 114938 - DNA, 103 bp, Artificial Sequence
  Synthetic Polynucleotide
taatacgactcactatagggccacacatggcgcttagtccagtattcaggaacagaggagacctgaaatgtggactaagaacctggcggcagcgcaaaagatg

SEQ ID NO: 114939 - DNA, 103 bp, Artificial Sequence
  Synthetic Polynucleotide
taatacgactcactatagggagtccaacattaccctgtgggagtgaggcaaacagaggagatgcctcatgcccacagggaacctggcggcagcgcaaaagatg

SEQ ID NO: 114940 - DNA, 103 bp, Artificial Sequence
  Synthetic Polynucleotide
taatacgactcactatagggggagccactcccacacatggcgcttagtccaacagaggagaggactaatggccatgtgtaacctggcggcagcgcaaaagatg

SEQ ID NO: 114941 - DNA, 103 bp, Artificial Sequence
  Synthetic Polynucleotide
taatacgactcactatagggcagcagaactggagccactcccacacatggaacagaggagaccatgtatgggagtggctaacctggcggcagcgcaaaagatg

SEQ ID NO: 114942 - DNA, 103 bp, Artificial Sequence
  Synthetic Polynucleotide
taatacgactcactataggggtactggtcgcagcagaactggagccactcaacagaggagagagtggatgcagttctgcaacctggcggcagcgcaaaagatg

SEQ ID NO: 114943 - DNA, 103 bp, Artificial Sequence
  Synthetic Polynucleotide
taatacgactcactatagggtgtccaacttgtactggtcgcagcagaactaacagaggagaagttctatggcgaccagtaacctggcggcagcgcaaaagatg

SEQ ID NO: 114944 - DNA, 103 bp, Artificial Sequence
  Synthetic Polynucleotide
taatacgactcactatagggatgcaattggtgtccaacttgtactggtcgaacagaggagacgaccaatgcaagttggaaacctggcggcagcgcaaaagatg

SEQ ID NO: 114945 - DNA, 103 bp, Artificial Sequence
  Synthetic Polynucleotide
taatacgactcactataggggcagaaggagatgcaattggtgtccaacttaacagaggagaaagttgatgaccaattgcaacctggcggcagcgcaaaagatg

SEQ ID NO: 114946 - DNA, 103 bp, Artificial Sequence
  Synthetic Polynucleotide
taatacgactcactatagggtgttgaagttgcagaaggagatgcaattggaacagaggagaccaattatgtctccttctaacctggcggcagcgcaaaagatg

SEQ ID NO: 114947 - DNA, 103 bp, Artificial Sequence
  Synthetic Polynucleotide
taatacgactcactatagggaggccactgatgttgaagttgcagaaggagaacagaggagactccttatgcaacttcaaaacctggcggcagcgcaaaagatg

SEQ ID NO: 114948 - DNA, 103 bp, Artificial Sequence
  Synthetic Polynucleotide
taatacgactcactataggggcacagctgcaggccactgatgttgaagttaacagaggagaaacttcatgatcagtggcaacctggcggcagcgcaaaagatg

SEQ ID NO: 114949 - DNA, 103 bp, Artificial Sequence
  Synthetic Polynucleotide
taatacgactcactataggggtgtcatgctgcacagctgcaggccactgaaacagaggagatcagtgatgtgcagctgtaacctggcggcagcgcaaaagatg

SEQ ID NO: 114950 - DNA, 103 bp, Artificial Sequence
  Synthetic Polynucleotide
taatacgactcactatagggtgtgtcaccgagtccaacattaccctgtggaacagaggagaccacagatgaatgttggaaacctggcggcagcgcaaaagatg

SEQ ID NO: 114951 - DNA, 103 bp, Artificial Sequence
  Synthetic Polynucleotide
taatacgactcactatagggaactcctcctgtgtcatgctgcacagctgcaacagaggagagcagctatgcagcatgacaacctggcggcagcgcaaaagatg

SEQ ID NO: 114952 - DNA, 103 bp, Artificial Sequence
  Synthetic Polynucleotide
taatacgactcactatagggtgcctcgacgaactcctcctgtgtcatgctaacagaggagaagcatgatgcaggaggagaacctggcggcagcgcaaaagatg

SEQ ID NO: 114953 - DNA, 103 bp, Artificial Sequence
  Synthetic Polynucleotide
taatacgactcactatagggagaggccagctgcctcgacgaactcctcctaacagaggagaaggaggatgtcgtcgaggaacctggcggcagcgcaaaagatg

SEQ ID NO: 114954 - DNA, 103 bp, Artificial Sequence
  Synthetic Polynucleotide
taatacgactcactatagggtactcgccgcagaggccagctgcctcgacgaacagaggagacgtcgaatgagctggcctaacctggcggcagcgcaaaagatg

SEQ ID NO: 114955 - DNA, 103 bp, Artificial Sequence
  Synthetic Polynucleotide
taatacgactcactataggggaagtacaggtactcgccgcagaggccagcaacagaggagagctggcatgtgcggcgagaacctggcggcagcgcaaaagatg

SEQ ID NO: 114956 - DNA, 103 bp, Artificial Sequence
  Synthetic Polynucleotide
taatacgactcactatagggtctggaggatgaagtacaggtactcgccgcaacagaggagagcggcgatgacctgtactaacctggcggcagcgcaaaagatg

SEQ ID NO: 114957 - DNA, 103 bp, Artificial Sequence
  Synthetic Polynucleotide
taatacgactcactataggggtgcggatgttctggaggatgaagtacaggaacagaggagacctgtaatgcatcctccaaacctggcggcagcgcaaaagatg

SEQ ID NO: 114958 - DNA, 103 bp, Artificial Sequence
  Synthetic Polynucleotide
taatacgactcactataggggtaaccttgtgtgcggatgttctggaggataacagaggagaatcctcatgaacatccgcaacctggcggcagcgcaaaagatg

SEQ ID NO: 114959 - DNA, 103 bp, Artificial Sequence
  Synthetic Polynucleotide
taatacgactcactatagggtaaaaaaggagtaaccttgtgtgcggatgtaacagaggagaacatccatgcacaaggttaacctggcggcagcgcaaaagatg

SEQ ID NO: 114960 - DNA, 103 bp, Artificial Sequence
  Synthetic Polynucleotide
taatacgactcactatagggtcagcgtcattaaaaaaggagtaaccttgtaacagaggagaacaaggatgctcctttttaacctggcggcagcgcaaaagatg

SEQ ID NO: 114961 - DNA, 103 bp, Artificial Sequence
  Synthetic Polynucleotide
taatacgactcactataggggaaggtgctgtgtgtcaccgagtccaacataacagaggagaatgttgatgtcggtgacaaacctggcggcagcgcaaaagatg

SEQ ID NO: 114962 - DNA, 103 bp, Artificial Sequence
  Synthetic Polynucleotide
taatacgactcactatagggcttgctttcttcagcgtcattaaaaaaggaaacagaggagatcctttatgaatgacgctaacctggcggcagcgcaaaagatg

SEQ ID NO: 114963 - DNA, 103 bp, Artificial Sequence
  Synthetic Polynucleotide
taatacgactcactatagggtgatggtggccttgctttcttcagcgtcataacagaggagaatgacgatgaagaaagcaaacctggcggcagcgcaaaagatg

SEQ ID NO: 114964 - DNA, 103 bp, Artificial Sequence
  Synthetic Polynucleotide
taatacgactcactataggggcatagtctttgatggtggccttgctttctaacagaggagaagaaagatgggccaccataacctggcggcagcgcaaaagatg

SEQ ID NO: 114965 - DNA, 103 bp, Artificial Sequence
  Synthetic Polynucleotide
taatacgactcactataggggttggaatcagcatagtctttgatggtggcaacagaggagagccaccatgaaagactataacctggcggcagcgcaaaagatg

SEQ ID NO: 114966 - DNA, 103 bp, Artificial Sequence
  Synthetic Polynucleotide
taatacgactcactatagggttttcaagcagttggaatcagcatagtcttaacagaggagaaagactatgctgattccaaacctggcggcagcgcaaaagatg

SEQ ID NO: 114967 - DNA, 103 bp, Artificial Sequence
  Synthetic Polynucleotide
taatacgactcactatagggatgccacttgttttcaagcagttggaatcaaacagaggagatgattcatgctgcttgaaaacctggcggcagcgcaaaagatg

SEQ ID NO: 114968 - DNA, 103 bp, Artificial Sequence
  Synthetic Polynucleotide
taatacgactcactatagggttgacttttgatgccacttgttttcaagcaaacagaggagatgcttgatgacaagtggcaacctggcggcagcgcaaaagatg

SEQ ID NO: 114969 - DNA, 103 bp, Artificial Sequence
  Synthetic Polynucleotide
taatacgactcactatagggtgtgacagtcttgacttttgatgccacttgaacagaggagacaagtgatgtcaaaagtcaacctggcggcagcgcaaaagatg

SEQ ID NO: 114970 - DNA, 103 bp, Artificial Sequence
  Synthetic Polynucleotide
taatacgactcactatagggctactatgactgtgacagtcttgacttttgaacagaggagacaaaagatgagactgtcaaacctggcggcagcgcaaaagatg

SEQ ID NO: 114971 - DNA, 103 bp, Artificial Sequence
  Synthetic Polynucleotide
taatacgactcactataggggaggcttgttctactatgactgtgacagtcaacagaggagagactgtatgagtcatagtaacctggcggcagcgcaaaagatg

SEQ ID NO: 114972 - DNA, 103 bp, Artificial Sequence
  Synthetic Polynucleotide
taatacgactcactatagggcattaggcaggaaggtgctgtgtgtcaccgaacagaggagacggtgaatgacagcacctaacctggcggcagcgcaaaagatg

SEQ ID NO: 114973 - DNA, 103 bp, Artificial Sequence
  Synthetic Polynucleotide
taatacgactcactataggggagaactttggaggcttgttctactatgacaacagaggagagtcataatggaacaagccaacctggcggcagcgcaaaagatg

SEQ ID NO: 114974 - DNA, 103 bp, Artificial Sequence
  Synthetic Polynucleotide
taatacgactcactatagggtcccatagatgagaactttggaggcttgttaacagaggagaaacaagatgccaaagttcaacctggcggcagcgcaaaagatg

SEQ ID NO: 114975 - DNA, 103 bp, Artificial Sequence
  Synthetic Polynucleotide
taatacgactcactatagggtcgtacaaattcccatagatgagaactttgaacagaggagacaaagtatgcatctatggaacctggcggcagcgcaaaagatg

SEQ ID NO: 114976 - DNA, 103 bp, Artificial Sequence
  Synthetic Polynucleotide
taatacgactcactataggggaagcaggtctcgtacaaattcccatagataacagaggagaatctatatgaatttgtacaacctggcggcagcgcaaaagatg

SEQ ID NO: 114977 - DNA, 103 bp, Artificial Sequence
  Synthetic Polynucleotide
taatacgactcactatagggtcaggagatagaagcaggtctcgtacaaataacagaggagaatttgtatgagacctgctaacctggcggcagcgcaaaagatg

SEQ ID NO: 114978 - DNA, 103 bp, Artificial Sequence
  Synthetic Polynucleotide
taatacgactcactatagggacagttttcttcaggagatagaagcaggtcaacagaggagagacctgatgctatctcctaacctggcggcagcgcaaaagatg

SEQ ID NO: 114979 - DNA, 103 bp, Artificial Sequence
  Synthetic Polynucleotide
taatacgactcactatagggccagaatgccacagttttcttcaggagataaacagaggagatatctcatgaagaaaactaacctggcggcagcgcaaaagatg

SEQ ID NO: 114980 - DNA, 103 bp, Artificial Sequence
  Synthetic Polynucleotide
taatacgactcactatagggtcttcccattccagaatgccacagttttctaacagaggagaagaaaaatgtggcattctaacctggcggcagcgcaaaagatg

SEQ ID NO: 114981 - DNA, 103 bp, Artificial Sequence
  Synthetic Polynucleotide
taatacgactcactatagggttgttccctatcttcccattccagaatgccaacagaggagaggcattatggaatgggaaaacctggcggcagcgcaaaagatg

SEQ ID NO: 114982 - DNA, 103 bp, Artificial Sequence
  Synthetic Polynucleotide
taatacgactcactataggggaaaaattccttgttccctatcttcccattaacagaggagaaatgggatgatagggaacaacctggcggcagcgcaaaagatg

SEQ ID NO: 114983 - DNA, 103 bp, Artificial Sequence
  Synthetic Polynucleotide
taatacgactcactatagggcagaaggatgcattaggcaggaaggtgctgaacagaggagacagcacatgcctgcctaaaacctggcggcagcgcaaaagatg

SEQ ID NO: 114984 - DNA, 103 bp, Artificial Sequence
  Synthetic Polynucleotide
taatacgactcactatagggttaaccacccgaaaaattccttgttccctaaacagaggagatagggaatgaggaattttaacctggcggcagcgcaaaagatg

SEQ ID NO: 114985 - DNA, 103 bp, Artificial Sequence
  Synthetic Polynucleotide
taatacgactcactatagggggcttccgatttaaccacccgaaaaattccaacagaggagaggaattatgcgggtggttaacctggcggcagcgcaaaagatg

SEQ ID NO: 114986 - DNA, 103 bp, Artificial Sequence
  Synthetic Polynucleotide
taatacgactcactatagggtctttgccagggcttccgatttaaccacccaacagaggagagggtggatgaatcggaagaacctggcggcagcgcaaaagatg

SEQ ID NO: 114987 - DNA, 103 bp, Artificial Sequence
  Synthetic Polynucleotide
taatacgactcactatagggtgtccccacatctttgccagggcttccgataacagaggagaatcggaatgcctggcaaaaacctggcggcagcgcaaaagatg

SEQ ID NO: 114988 - DNA, 103 bp, Artificial Sequence
  Synthetic Polynucleotide
taatacgactcactatagggtttcttcctttgtccccacatctttgccagaacagaggagactggcaatgatgtggggaaacctggcggcagcgcaaaagatg

SEQ ID NO: 114989 - DNA, 103 bp, Artificial Sequence
  Synthetic Polynucleotide
taatacgactcactatagggttctgtcatttttcttcctttgtccccacaaacagaggagatgtgggatgaaaggaagaaacctggcggcagcgcaaaagatg

SEQ ID NO: 114990 - DNA, 103 bp, Artificial Sequence
  Synthetic Polynucleotide
taatacgactcactatagggtcatatgtcattctgtcatttttcttccttaacagaggagaaaggaaatgaaatgacagaacctggcggcagcgcaaaagatg

SEQ ID NO: 114991 - DNA, 103 bp, Artificial Sequence
  Synthetic Polynucleotide
taatacgactcactataggggctcaacttttcatatgtcattctgtcattaacagaggagaaatgacatgatgacatataacctggcggcagcgcaaaagatg

SEQ ID NO: 114992 - DNA, 103 bp, Artificial Sequence
  Synthetic Polynucleotide
taatacgactcactatagggtcagggctctgctcaacttttcatatgtcaaacagaggagatgacatatgaaaagttgaaacctggcggcagcgcaaaagatg

SEQ ID NO: 114993 - DNA, 103 bp, Artificial Sequence
  Synthetic Polynucleotide
taatacgactcactatagggtagtagtatctcagggctctgctcaactttaacagaggagaaaagttatgcagagccctaacctggcggcagcgcaaaagatg

SEQ ID NO: 114994 - DNA, 103 bp, Artificial Sequence
  Synthetic Polynucleotide
taatacgactcactatagggcaggggatcgcagaaggatgcattaggcagaacagaggagactgcctatggcatccttcaacctggcggcagcgcaaaagatg

SEQ ID NO: 114995 - DNA, 103 bp, Artificial Sequence
  Synthetic Polynucleotide
taatacgactcactatagggtcctgttttatagtagtatctcagggctctaacagaggagaagagccatgagatactacaacctggcggcagcgcaaaagatg

SEQ ID NO: 114996 - DNA, 103 bp, Artificial Sequence
  Synthetic Polynucleotide
taatacgactcactataggggctccaaaattcctgttttatagtagtatcaacagaggagagatactatgataaaacagaacctggcggcagcgcaaaagatg

SEQ ID NO: 114997 - DNA, 103 bp, Artificial Sequence
  Synthetic Polynucleotide
taatacgactcactatagggcggtcaacccgctccaaaattcctgttttaaacagaggagataaaacatgaattttggaaacctggcggcagcgcaaaagatg

SEQ ID NO: 114998 - DNA, 103 bp, Artificial Sequence
  Synthetic Polynucleotide
taatacgactcactatagggcactaaccttcggtcaacccgctccaaaataacagaggagaattttgatgcgggttgacaacctggcggcagcgcaaaagatg

SEQ ID NO: 114999 - DNA, 103 bp, Artificial Sequence
  Synthetic Polynucleotide
taatacgactcactatagggcaaatttgtacactaaccttcggtcaacccaacagaggagagggttgatggaaggttagaacctggcggcagcgcaaaagatg

SEQ ID NO: 115000 - DNA, 103 bp, Artificial Sequence
  Synthetic Polynucleotide
taatacgactcactataggggcattttttccaaatttgtacactaaccttaacagaggagaaaggttatggtacaaattaacctggcggcagcgcaaaagatg

SEQ ID NO: 115001 - DNA, 103 bp, Artificial Sequence
  Synthetic Polynucleotide
taatacgactcactatagggccacccgtgtgcattttttccaaatttgtaaacagaggagatacaaaatgggaaaaaataacctggcggcagcgcaaaagatg

SEQ ID NO: 115002 - DNA, 103 bp, Artificial Sequence
  Synthetic Polynucleotide
taatacgactcactatagggtgtcttcctgccacccgtgtgcattttttcaacagaggagagaaaaaatgcacacgggtaacctggcggcagcgcaaaagatg

SEQ ID NO: 115003 - DNA, 103 bp, Artificial Sequence
  Synthetic Polynucleotide
taatacgactcactatagggtccacgacatcaggggatcgcagaaggatgaacagaggagacatcctatggcgatccccaacctggcggcagcgcaaaagatg

SEQ ID NO: 115004 - DNA, 103 bp, Artificial Sequence
  Synthetic Polynucleotide
taatacgactcactatagggaacagatcagtccacgacatcaggggatcgaacagaggagacgatccatggatgtcgtgaacctggcggcagcgcaaaagatg

SEQ ID NO: 115005 - DNA, 103 bp, Artificial Sequence
  Synthetic Polynucleotide
taatacgactcactatagggaaactgccacagcgtcacagatgggtccataacagaggagaatggacatgtctgtgacgaacctggcggcagcgcaaaagatg

SEQ ID NO: 115006 - DNA, 103 bp, Artificial Sequence
  Synthetic Polynucleotide
taatacgactcactatagggctctgcatccaccagcttgaattcaccaccaacagaggagaggtggtatgttcaagctgaacctggcggcagcgcaaaagatg

SEQ ID NO: 115007 - DNA, 103 bp, Artificial Sequence
  Synthetic Polynucleotide
taatacgactcactatagggtcccgatcctggggtccgttcgggtcccggaacagaggagaccgggaatggaacggaccaacctggcggcagcgcaaaagatg

SEQ ID NO: 115008 - DNA, 103 bp, Artificial Sequence
  Synthetic Polynucleotide
taatacgactcactatagggcggagccacttcccgatcctggggtccgttaacagaggagaaacggaatgcaggatcggaacctggcggcagcgcaaaagatg

SEQ ID NO: 115009 - DNA, 103 bp, Artificial Sequence
  Synthetic Polynucleotide
taatacgactcactataggggcctggaggccggagccacttcccgatcctaacagaggagaaggatcatgaagtggctcaacctggcggcagcgcaaaagatg

SEQ ID NO: 115010 - DNA, 103 bp, Artificial Sequence
  Synthetic Polynucleotide
taatacgactcactatagggcggccccggagcctggaggccggagccactaacagaggagaagtggcatgggcctccagaacctggcggcagcgcaaaagatg

SEQ ID NO: 115011 - DNA, 103 bp, Artificial Sequence
  Synthetic Polynucleotide
taatacgactcactataggggggtcagcgccggccccggagcctggaggcaacagaggagagcctccatgctccggggcaacctggcggcagcgcaaaagatg

SEQ ID NO: 115012 - DNA, 103 bp, Artificial Sequence
  Synthetic Polynucleotide
taatacgactcactatagggagcagggatggggtcagcgccggccccggaaacagaggagatccgggatgggcgctgacaacctggcggcagcgcaaaagatg

SEQ ID NO: 115013 - DNA, 103 bp, Artificial Sequence
  Synthetic Polynucleotide
taatacgactcactatagggatgcgtaggaagcagggatggggtcagcgcaacagaggagagcgctgatgccatccctgaacctggcggcagcgcaaaagatg

SEQ ID NO: 115014 - DNA, 103 bp, Artificial Sequence
  Synthetic Polynucleotide
taatacgactcactataggggggtcaatgtatgcgtaggaagcagggatgaacagaggagacatcccatgttcctacgcaacctggcggcagcgcaaaagatg

SEQ ID NO: 115015 - DNA, 103 bp, Artificial Sequence
  Synthetic Polynucleotide
taatacgactcactatagggagcagcaccggggtcaatgtatgcgtaggaaacagaggagatcctacatgtacattgacaacctggcggcagcgcaaaagatg

SEQ ID NO: 115016 - DNA, 103 bp, Artificial Sequence
  Synthetic Polynucleotide
taatacgactcactataggggctgggtgtcagcagcaccggggtcaatgtaacagaggagaacattgatgccggtgctgaacctggcggcagcgcaaaagatg

SEQ ID NO: 115017 - DNA, 103 bp, Artificial Sequence
  Synthetic Polynucleotide
taatacgactcactataggggggccacctcctctgcatccaccagcttgaaacagaggagatcaagcatgtggatgcagaacctggcggcagcgcaaaagatg

SEQ ID NO: 115018 - DNA, 103 bp, Artificial Sequence
  Synthetic Polynucleotide
taatacgactcactataggggaggcagcgagctgggtgtcagcagcaccgaacagaggagacggtgcatgtgacacccaaacctggcggcagcgcaaaagatg

SEQ ID NO: 115019 - DNA, 103 bp, Artificial Sequence
  Synthetic Polynucleotide
taatacgactcactatagggtgaatgctaggaggcagcgagctgggtgtcaacagaggagagacaccatgctcgctgccaacctggcggcagcgcaaaagatg

SEQ ID NO: 115020 - DNA, 103 bp, Artificial Sequence
  Synthetic Polynucleotide
taatacgactcactataggggctccagaagtgaatgctaggaggcagcgaaacagaggagatcgctgatgcctagcattaacctggcggcagcgcaaaagatg

SEQ ID NO: 115021 - DNA, 103 bp, Artificial Sequence
  Synthetic Polynucleotide
taatacgactcactataggggactcagggtgctccagaagtgaatgctagaacagaggagactagcaatgacttctggaaacctggcggcagcgcaaaagatg

SEQ ID NO: 115022 - DNA, 103 bp, Artificial Sequence
  Synthetic Polynucleotide
taatacgactcactatagggggcgcaatgggactcagggtgctccagaagaacagaggagacttctgatgcaccctgagaacctggcggcagcgcaaaagatg

SEQ ID NO: 115023 - DNA, 103 bp, Artificial Sequence
  Synthetic Polynucleotide
taatacgactcactatagggcgggctacggggcgcaatgggactcagggtaacagaggagaaccctgatgcccattgcgaacctggcggcagcgcaaaagatg

SEQ ID NO: 115024 - DNA, 103 bp, Artificial Sequence
  Synthetic Polynucleotide
taatacgactcactatagggagagcttggccgggctacggggcgcaatggaacagaggagaccattgatgcccgtagccaacctggcggcagcgcaaaagatg

SEQ ID NO: 115025 - DNA, 103 bp, Artificial Sequence
  Synthetic Polynucleotide
taatacgactcactatagggaactggaaggagagcttggccgggctacggaacagaggagaccgtagatgggccaagctaacctggcggcagcgcaaaagatg

SEQ ID NO: 115026 - DNA, 103 bp, Artificial Sequence
  Synthetic Polynucleotide
taatacgactcactatagggactggatggaaactggaaggagagcttggcaacagaggagagccaagatgtccttccagaacctggcggcagcgcaaaagatg

SEQ ID NO: 115027 - DNA, 103 bp, Artificial Sequence
  Synthetic Polynucleotide
taatacgactcactataggggggcgctgccactggatggaaactggaaggaacagaggagaccttccatgttccatccaaacctggcggcagcgcaaaagatg

SEQ ID NO: 115028 - DNA, 103 bp, Artificial Sequence
  Synthetic Polynucleotide
taatacgactcactatagggccccacagccgggccacctcctctgcatccaacagaggagaggatgcatgggaggtggcaacctggcggcagcgcaaaagatg

SEQ ID NO: 115029 - DNA, 103 bp, Artificial Sequence
  Synthetic Polynucleotide
taatacgactcactatagggatgtgcacctgggcgctgccactggatggaaacagaggagatccatcatgtggcagcgcaacctggcggcagcgcaaaagatg

SEQ ID NO: 115030 - DNA, 103 bp, Artificial Sequence
  Synthetic Polynucleotide
taatacgactcactataggggatagaagggatgtgcacctgggcgctgccaacagaggagaggcagcatgcaggtgcacaacctggcggcagcgcaaaagatg

SEQ ID NO: 115031 - DNA, 103 bp, Artificial Sequence
  Synthetic Polynucleotide
taatacgactcactatagggcatccacgctgatagaagggatgtgcacctaacagaggagaaggtgcatgtcccttctaaacctggcggcagcgcaaaagatg

SEQ ID NO: 115032 - DNA, 103 bp, Artificial Sequence
  Synthetic Polynucleotide
taatacgactcactataggggtcgagaggccatccacgctgatagaagggaacagaggagacccttcatgcagcgtggaaacctggcggcagcgcaaaagatg

SEQ ID NO: 115033 - DNA, 103 bp, Artificial Sequence
  Synthetic Polynucleotide
taatacgactcactatagggcaccacgggggtcgagaggccatccacgctaacagaggagaagcgtgatgggcctctcgaacctggcggcagcgcaaaagatg

SEQ ID NO: 115034 - DNA, 103 bp, Artificial Sequence
  Synthetic Polynucleotide
taatacgactcactatagggctggggagagcaccacgggggtcgagaggcaacagaggagagcctctatgcccccgtggaacctggcggcagcgcaaaagatg

SEQ ID NO: 115035 - DNA, 103 bp, Artificial Sequence
  Synthetic Polynucleotide
taatacgactcactatagggttctggggccctggggagagcaccacggggaacagaggagaccccgtatggctctccccaacctggcggcagcgcaaaagatg

SEQ ID NO: 115036 - DNA, 103 bp, Artificial Sequence
  Synthetic Polynucleotide
taatacgactcactatagggcttgcgtagcccccacagccgggccacctcaacagaggagagaggtgatgcggctgtggaacctggcggcagcgcaaaagatg

SEQ ID NO: 115037 - DNA, 103 bp, Artificial Sequence
  Synthetic Polynucleotide
taatacgactcactatagggtggtcttgttcttgcgtagcccccacagccaacagaggagaggctgtatgggctacgcaaacctggcggcagcgcaaaagatg

SEQ ID NO: 115038 - DNA, 103 bp, Artificial Sequence
  Synthetic Polynucleotide
taatacgactcactatagggtaattcatgttggtcttgttcttgcgtagcaacagaggagagctacgatggaacaagacaacctggcggcagcgcaaaagatg

SEQ ID NO: 115039 - DNA, 103 bp, Artificial Sequence
  Synthetic Polynucleotide
taatacgactcactataggggagcttgtcgtaattcatgttggtcttgttaacagaggagaaacaagatgaacatgaataacctggcggcagcgcaaaagatg

SEQ ID NO: 115040 - DNA, 103 bp, Artificial Sequence
  Synthetic Polynucleotide
taatacgactcactatagggaggcccggctgagcttgtcgtaattcatgtaacagaggagaacatgaatgacgacaagcaacctggcggcagcgcaaaagatg

SEQ ID NO: 115041 - DNA, 103 bp, Artificial Sequence
  Synthetic Polynucleotide
taatacgactcactatagggtagtaccgcaaggcccggctgagcttgtcgaacagaggagacgacaaatgcagccgggcaacctggcggcagcgcaaaagatg

SEQ ID NO: 115042 - DNA, 103 bp, Artificial Sequence
  Synthetic Polynucleotide
taatacgactcactatagggcttgtcatagtagtaccgcaaggcccggctaacagaggagaagccggatgttgcggtacaacctggcggcagcgcaaaagatg

SEQ ID NO: 115043 - DNA, 103 bp, Artificial Sequence
  Synthetic Polynucleotide
taatacgactcactataggggctgcagcagaaactgccacagcgtcacagaacagaggagactgtgaatgtgtggcagtaacctggcggcagcgcaaaagatg

SEQ ID NO: 115044 - DNA, 103 bp, Artificial Sequence
  Synthetic Polynucleotide
taatacgactcactatagggggatgatgttcttgtcatagtagtaccgcaaacagaggagatgcggtatgactatgacaaacctggcggcagcgcaaaagatg

SEQ ID NO: 115045 - DNA, 103 bp, Artificial Sequence
  Synthetic Polynucleotide
taatacgactcactatagggctcaccttgcggatgatgttcttgtcatagaacagaggagactatgaatggaacatcataacctggcggcagcgcaaaagatg

SEQ ID NO: 115046 - DNA, 103 bp, Artificial Sequence
  Synthetic Polynucleotide
taatacgactcactatagggcttctggccgctcaccttgcggatgatgttaacagaggagaaacatcatgcgcaaggtgaacctggcggcagcgcaaaagatg

SEQ ID NO: 115047 - DNA, 103 bp, Artificial Sequence
  Synthetic Polynucleotide
taatacgactcactatagggtgtagacgaacttctggccgctcaccttgcaacagaggagagcaaggatggcggccagaaacctggcggcagcgcaaaagatg

SEQ ID NO: 115048 - DNA, 103 bp, Artificial Sequence
  Synthetic Polynucleotide
taatacgactcactataggggacacaaacttgtagacgaacttctggccgaacagaggagacggccaatggttcgtctaaacctggcggcagcgcaaaagatg

SEQ ID NO: 115049 - DNA, 103 bp, Artificial Sequence
  Synthetic Polynucleotide
taatacgactcactatagggctcagggtaggacacaaacttgtagacgaaaacagaggagattcgtcatgaagtttgtgaacctggcggcagcgcaaaagatg

SEQ ID NO: 115050 - DNA, 103 bp, Artificial Sequence
  Synthetic Polynucleotide
taatacgactcactatagggaccctgcgacctcagggtaggacacaaactaacagaggagaagtttgatgcctaccctgaacctggcggcagcgcaaaagatg

SEQ ID NO: 115051 - DNA, 103 bp, Artificial Sequence
  Synthetic Polynucleotide
taatacgactcactatagggtcagtggagcaccctgcgacctcagggtagaacagaggagactacccatgggtcgcaggaacctggcggcagcgcaaaagatg

SEQ ID NO: 115052 - DNA, 103 bp, Artificial Sequence
  Synthetic Polynucleotide
taatacgactcactatagggcgggcagtcctcagtggagcaccctgcgacaacagaggagagtcgcaatgtgctccactaacctggcggcagcgcaaaagatg

SEQ ID NO: 115053 - DNA, 103 bp, Artificial Sequence
  Synthetic Polynucleotide
taatacgactcactatagggctggctggggcgggcagtcctcagtggagcaacagaggagagctccaatgaggactgccaacctggcggcagcgcaaaagatg

SEQ ID NO: 115054 - DNA, 103 bp, Artificial Sequence
  Synthetic Polynucleotide
taatacgactcactatagggtctctcagcagctgcagcagaaactgccacaacagaggagagtggcaatgtctgctgcaaacctggcggcagcgcaaaagatg

SEQ ID NO: 115055 - DNA, 103 bp, Artificial Sequence
  Synthetic Polynucleotide
taatacgactcactatagggacagacacctctggctggggcgggcagtccaacagaggagaggactgatggccccagccaacctggcggcagcgcaaaagatg

SEQ ID NO: 115056 - DNA, 103 bp, Artificial Sequence
  Synthetic Polynucleotide
taatacgactcactatagggggtggaggtaacagacacctctggctggggaacagaggagaccccagatggaggtgtctaacctggcggcagcgcaaaagatg

SEQ ID NO: 115057 - DNA, 103 bp, Artificial Sequence
  Synthetic Polynucleotide
taatacgactcactatagggcatttggcatggtggaggtaacagacacctaacagaggagaaggtgtatgttacctccaaacctggcggcagcgcaaaagatg

SEQ ID NO: 115058 - DNA, 103 bp, Artificial Sequence
  Synthetic Polynucleotide
taatacgactcactataggggcaggggccacatttggcatggtggaggtaaacagaggagatacctcatgcatgccaaaaacctggcggcagcgcaaaagatg

SEQ ID NO: 115059 - DNA, 103 bp, Artificial Sequence
  Synthetic Polynucleotide
taatacgactcactatagggatgtatagcagcaggggccacatttggcataacagaggagaatgccaatggtggcccctaacctggcggcagcgcaaaagatg

SEQ ID NO: 115060 - DNA, 103 bp, Artificial Sequence
  Synthetic Polynucleotide
taatacgactcactatagggctggggcggcatgtatagcagcaggggccaaacagaggagatggcccatgctgctatacaacctggcggcagcgcaaaagatg

SEQ ID NO: 115061 - DNA, 103 bp, Artificial Sequence
  Synthetic Polynucleotide
taatacgactcactatagggacagtgtcccctggggcggcatgtatagcaaacagaggagatgctatatgtgccgccccaacctggcggcagcgcaaaagatg

SEQ ID NO: 115062 - DNA, 103 bp, Artificial Sequence
  Synthetic Polynucleotide
taatacgactcactatagggctttccagagacagtgtcccctggggcggcaacagaggagagccgccatgggggacactaacctggcggcagcgcaaaagatg

SEQ ID NO: 115063 - DNA, 103 bp, Artificial Sequence
  Synthetic Polynucleotide
taatacgactcactataggggtgtgcctggctttccagagacagtgtcccaacagaggagagggacaatgtctctggaaaacctggcggcagcgcaaaagatg

SEQ ID NO: 115064 - DNA, 103 bp, Artificial Sequence
  Synthetic Polynucleotide
taatacgactcactataggggcacccttgggtgtgcctggctttccagagaacagaggagactctggatggccaggcacaacctggcggcagcgcaaaagatg

SEQ ID NO: 115065 - DNA, 103 bp, Artificial Sequence
  Synthetic Polynucleotide
taatacgactcactatagggattgccttgctctctcagcagctgcagcagaacagaggagactgctgatgctgctgagaaacctggcggcagcgcaaaagatg

SEQ ID NO: 115066 - DNA, 103 bp, Artificial Sequence
  Synthetic Polynucleotide
taatacgactcactatagggtgccattcctgcacccttgggtgtgcctggaacagaggagaccaggcatgcccaagggtaacctggcggcagcgcaaaagatg

SEQ ID NO: 115067 - DNA, 103 bp, Artificial Sequence
  Synthetic Polynucleotide
taatacgactcactatagggcgcctgggcctgccattcctgcacccttggaacagaggagaccaaggatgcaggaatggaacctggcggcagcgcaaaagatg

SEQ ID NO: 115068 - DNA, 103 bp, Artificial Sequence
  Synthetic Polynucleotide
taatacgactcactatagggcgtgccaaaccgcctgggcctgccattcctaacagaggagaaggaatatgaggcccaggaacctggcggcagcgcaaaagatg

SEQ ID NO: 115069 - DNA, 103 bp, Artificial Sequence
  Synthetic Polynucleotide
taatacgactcactatagggccggctgctgcgtgccaaaccgcctgggccaacagaggagaggcccaatgggtttggcaaacctggcggcagcgcaaaagatg

SEQ ID NO: 115070 - DNA, 103 bp, Artificial Sequence
  Synthetic Polynucleotide
taatacgactcactatagggtgtactcgttccggctgctgcgtgccaaacaacagaggagagtttggatggcagcagccaacctggcggcagcgcaaaagatg

SEQ ID NO: 115071 - DNA, 103 bp, Artificial Sequence
  Synthetic Polynucleotide
taatacgactcactatagggcccgagcgcatgtactcgttccggctgctgaacagaggagacagcagatggaacgagtaaacctggcggcagcgcaaaagatg

SEQ ID NO: 115072 - DNA, 103 bp, Artificial Sequence
  Synthetic Polynucleotide
taatacgactcactatagggggaatagaggcccgagcgcatgtactcgttaacagaggagaaacgagatgatgcgctcgaacctggcggcagcgcaaaagatg

SEQ ID NO: 115073 - DNA, 103 bp, Artificial Sequence
  Synthetic Polynucleotide
taatacgactcactatagggtggtgaaggtggaatagaggcccgagcgcaaacagaggagatgcgctatggcctctattaacctggcggcagcgcaaaagatg

SEQ ID NO: 115074 - DNA, 103 bp, Artificial Sequence
  Synthetic Polynucleotide
taatacgactcactatagggagagactggatggtgaaggtggaatagaggaacagaggagacctctaatgcaccttcacaacctggcggcagcgcaaaagatg

SEQ ID NO: 115075 - DNA, 103 bp, Artificial Sequence
  Synthetic Polynucleotide
taatacgactcactatagggctgcggctgcagagactggatggtgaaggtaacagaggagaaccttcatgatccagtctaacctggcggcagcgcaaaagatg

SEQ ID NO: 115076 - DNA, 103 bp, Artificial Sequence
  Synthetic Polynucleotide
taatacgactcactatagggtgatgtggccattgccttgctctctcagcaaacagaggagatgctgaatgagcaaggcaaacctggcggcagcgcaaaagatg

SEQ ID NO: 115077 - DNA, 103 bp, Artificial Sequence
  Synthetic Polynucleotide
taatacgactcactataggggagggggtggctgcggctgcagagactggaaacagaggagatccagtatgtgcagccgcaacctggcggcagcgcaaaagatg

SEQ ID NO: 115078 - DNA, 103 bp, Artificial Sequence
  Synthetic Polynucleotide
taatacgactcactatagggggccgaggatgagggggtggctgcggctgcaacagaggagagcagccatggccacccccaacctggcggcagcgcaaaagatg

SEQ ID NO: 115079 - DNA, 103 bp, Artificial Sequence
  Synthetic Polynucleotide
taatacgactcactatagggcaccacagcaggccgaggatgagggggtggaacagaggagaccacccatgcatcctcggaacctggcggcagcgcaaaagatg

SEQ ID NO: 115080 - DNA, 103 bp, Artificial Sequence
  Synthetic Polynucleotide
taatacgactcactatagggcactggggagcaccacagcaggccgaggataacagaggagaatcctcatgctgctgtggaacctggcggcagcgcaaaagatg

SEQ ID NO: 115081 - DNA, 103 bp, Artificial Sequence
  Synthetic Polynucleotide
taatacgactcactataggggcaggagctgcactggggagcaccacagcaaacagaggagatgctgtatggctccccagaacctggcggcagcgcaaaagatg

SEQ ID NO: 115082 - DNA, 103 bp, Artificial Sequence
  Synthetic Polynucleotide
taatacgactcactatagggtgctgcccctgcaggagctgcactggggagaacagaggagactccccatggcagctcctaacctggcggcagcgcaaaagatg

SEQ ID NO: 115083 - DNA, 103 bp, Artificial Sequence
  Synthetic Polynucleotide
taatacgactcactatagggaggggggcgctgctgcccctgcaggagctgaacagaggagacagctcatgcaggggcagaacctggcggcagcgcaaaagatg

SEQ ID NO: 115084 - DNA, 103 bp, Artificial Sequence
  Synthetic Polynucleotide
taatacgactcactatagggctgctccccgaggggggcgctgctgcccctaacagaggagaaggggcatgagcgcccccaacctggcggcagcgcaaaagatg

SEQ ID NO: 115085 - DNA, 103 bp, Artificial Sequence
  Synthetic Polynucleotide
taatacgactcactatagggactggtgctcctgctccccgaggggggcgcaacagaggagagcgcccatgtcggggagcaacctggcggcagcgcaaaagatg

SEQ ID NO: 115086 - DNA, 103 bp, Artificial Sequence
  Synthetic Polynucleotide
taatacgactcactatagggaggggcttggactggtgctcctgctccccgaacagaggagacggggaatgggagcaccaaacctggcggcagcgcaaaagatg

SEQ ID NO: 115087 - DNA, 103 bp, Artificial Sequence
  Synthetic Polynucleotide
taatacgactcactataggggtccaggagatgatgtggccattgccttgcaacagaggagagcaaggatgtggccacataacctggcggcagcgcaaaagatg

SEQ ID NO: 115088 - DNA, 103 bp, Artificial Sequence
  Synthetic Polynucleotide
taatacgactcactatagggcaggcctccaaggggcttggactggtgctcaacagaggagagagcacatgtccaagcccaacctggcggcagcgcaaaagatg

SEQ ID NO: 115089 - DNA, 103 bp, Artificial Sequence
  Synthetic Polynucleotide
taatacgactcactatagggagcctccagacaggcctccaaggggcttggaacagaggagaccaagcatgttggaggccaacctggcggcagcgcaaaagatg

SEQ ID NO: 115090 - DNA, 103 bp, Artificial Sequence
  Synthetic Polynucleotide
taatacgactcactatagggcggcctcttcagcctccagacaggcctccaaacagaggagatggaggatggtctggaggaacctggcggcagcgcaaaagatg

SEQ ID NO: 115091 - DNA, 103 bp, Artificial Sequence
  Synthetic Polynucleotide
taatacgactcactatagggagaggcaagccggcctcttcagcctccagaaacagaggagatctggaatgtgaagaggcaacctggcggcagcgcaaaagatg

SEQ ID NO: 115092 - DNA, 103 bp, Artificial Sequence
  Synthetic Polynucleotide
taatacgactcactataggggatgacctgcagaggcaagccggcctcttcaacagaggagagaagagatgggcttgcctaacctggcggcagcgcaaaagatg

SEQ ID NO: 115093 - DNA, 103 bp, Artificial Sequence
  Synthetic Polynucleotide
taatacgactcactataggggcggggtcaggatgacctgcagaggcaagcaacagaggagagcttgcatgtgcaggtcaaacctggcggcagcgcaaaagatg

SEQ ID NO: 115094 - DNA, 103 bp, Artificial Sequence
  Synthetic Polynucleotide
taatacgactcactatagggggggcctcgggcggggtcaggatgacctgcaacagaggagagcaggtatgcctgaccccaacctggcggcagcgcaaaagatg

SEQ ID NO: 115095 - DNA, 103 bp, Artificial Sequence
  Synthetic Polynucleotide
taatacgactcactatagggtttcaggtttggggcctcgggcggggtcagaacagaggagactgaccatgcccgaggccaacctggcggcagcgcaaaagatg

SEQ ID NO: 115096 - DNA, 103 bp, Artificial Sequence
  Synthetic Polynucleotide
taatacgactcactataggggctcttccgatttcaggtttggggcctcggaacagaggagaccgaggatgcaaacctgaaacctggcggcagcgcaaaagatg

SEQ ID NO: 115097 - DNA, 103 bp, Artificial Sequence
  Synthetic Polynucleotide
taatacgactcactatagggtccacattaagctcttccgatttcaggtttaacagaggagaaaacctatgatcggaagaaacctggcggcagcgcaaaagatg

SEQ ID NO: 115098 - DNA, 103 bp, Artificial Sequence
  Synthetic Polynucleotide
taatacgactcactatagggatcccgtgaagtccaggagatgatgtggccaacagaggagaggccacatgatctcctggaacctggcggcagcgcaaaagatg

SEQ ID NO: 115099 - DNA, 103 bp, Artificial Sequence
  Synthetic Polynucleotide
taatacgactcactatagggcaaacccggctccacattaagctcttccgaaacagaggagatcggaaatgcttaatgtgaacctggcggcagcgcaaaagatg

SEQ ID NO: 115100 - DNA, 103 bp, Artificial Sequence
  Synthetic Polynucleotide
taatacgactcactatagggaagcccggcccaaacccggctccacattaaaacagaggagattaatgatgagccgggttaacctggcggcagcgcaaaagatg

SEQ ID NO: 115101 - DNA, 103 bp, Artificial Sequence
  Synthetic Polynucleotide
taatacgactcactatagggtctgggggcaaagcccggcccaaacccggcaacagaggagagccgggatggggccgggcaacctggcggcagcgcaaaagatg

SEQ ID NO: 115102 - DNA, 103 bp, Artificial Sequence
  Synthetic Polynucleotide
taatacgactcactatagggtactttcacttctgggggcaaagcccggccaacagaggagaggccggatgttgcccccaaacctggcggcagcgcaaaagatg

SEQ ID NO: 115103 - DNA, 103 bp, Artificial Sequence
  Synthetic Polynucleotide
taatacgactcactatagggtgggcccttctactttcacttctgggggcaaacagaggagatgccccatgaagtgaaagaacctggcggcagcgcaaaagatg

SEQ ID NO: 115104 - DNA, 103 bp, Artificial Sequence
  Synthetic Polynucleotide
taatacgactcactatagggaactcttccttgggcccttctactttcactaacagaggagaagtgaaatgagaagggccaacctggcggcagcgcaaaagatg

SEQ ID NO: 115105 - DNA, 103 bp, Artificial Sequence
  Synthetic Polynucleotide
taatacgactcactatagggcgcaacttccaactcttccttgggcccttcaacagaggagagaagggatgaaggaagagaacctggcggcagcgcaaaagatg

SEQ ID NO: 115106 - DNA, 103 bp, Artificial Sequence
  Synthetic Polynucleotide
taatacgactcactatagggctctctcccccgcaacttccaactcttcctaacagaggagaaggaagatgtggaagttgaacctggcggcagcgcaaaagatg

SEQ ID NO: 115107 - DNA, 103 bp, Artificial Sequence
  Synthetic Polynucleotide
taatacgactcactatagggggcacaaaccctctctcccccgcaacttccaacagaggagaggaagtatggggggagagaacctggcggcagcgcaaaagatg

SEQ ID NO: 115108 - DNA, 103 bp, Artificial Sequence
  Synthetic Polynucleotide
taatacgactcactatagggggtggtttctggcacaaaccctctctccccaacagaggagaggggagatggggtttgtgaacctggcggcagcgcaaaagatg

SEQ ID NO: 115109 - DNA, 103 bp, Artificial Sequence
  Synthetic Polynucleotide
taatacgactcactatagggattcaccaccatcccgtgaagtccaggagaaacagaggagatctcctatgcttcacgggaacctggcggcagcgcaaaagatg

SEQ ID NO: 115110 - DNA, 103 bp, Artificial Sequence
  Synthetic Polynucleotide
taatacgactcactataggggctcggccttggtggtttctggcacaaaccaacagaggagaggtttgatgcagaaaccaaacctggcggcagcgcaaaagatg

SEQ ID NO: 115111 - DNA, 103 bp, Artificial Sequence
  Synthetic Polynucleotide
taatacgactcactataggggggacttctggctcggccttggtggtttctaacagaggagaagaaacatgcaaggccgaaacctggcggcagcgcaaaagatg

SEQ ID NO: 115112 - DNA, 103 bp, Artificial Sequence
  Synthetic Polynucleotide
taatacgactcactatagggctcctgtggagggacttctggctcggccttaacagaggagaaaggccatgccagaagtcaacctggcggcagcgcaaaagatg

SEQ ID NO: 115113 - DNA, 103 bp, Artificial Sequence
  Synthetic Polynucleotide
taatacgactcactatagggctggcacgccctcctgtggagggacttctgaacagaggagacagaagatgctccacaggaacctggcggcagcgcaaaagatg

SEQ ID NO: 115114 - DNA, 103 bp, Artificial Sequence
  Synthetic Polynucleotide
taatacgactcactatagggggcagccgggctggcacgccctcctgtggaaacagaggagatccacaatggggcgtgccaacctggcggcagcgcaaaagatg

SEQ ID NO: 115115 - DNA, 103 bp, Artificial Sequence
  Synthetic Polynucleotide
taatacgactcactatagggaacaaccgcgggcagccgggctggcacgccaacagaggagaggcgtgatggcccggctgaacctggcggcagcgcaaaagatg

SEQ ID NO: 115116 - DNA, 103 bp, Artificial Sequence
  Synthetic Polynucleotide
taatacgactcactatagggcggtgtccataacaaccgcgggcagccgggaacagaggagacccggcatgccgcggttgaacctggcggcagcgcaaaagatg

SEQ ID NO: 115117 - DNA, 103 bp, Artificial Sequence
  Synthetic Polynucleotide
taatacgactcactataggggcctgccctgcggtgtccataacaaccgcgaacagaggagacgcggtatgtatggacacaacctggcggcagcgcaaaagatg

SEQ ID NO: 115118 - DNA, 103 bp, Artificial Sequence
  Synthetic Polynucleotide
taatacgactcactatagggatggccgcccgcctgccctgcggtgtccataacagaggagaatggacatggcagggcagaacctggcggcagcgcaaaagatg

SEQ ID NO: 115119 - DNA, 103 bp, Artificial Sequence
  Synthetic Polynucleotide
taatacgactcactatagggtggaagccgcatggccgcccgcctgccctgaacagaggagacagggcatgcgggcggccaacctggcggcagcgcaaaagatg

SEQ ID NO: 115120 - DNA, 103 bp, Artificial Sequence
  Synthetic Polynucleotide
taatacgactcactatagggaccagcttgaattcaccaccatcccgtgaaaacagaggagattcacgatgtggtggtgaaacctggcggcagcgcaaaagatg

SEQ ID NO: 115121 - DNA, 103 bp, Artificial Sequence
  Synthetic Polynucleotide
taatacgactcactatagggatctcagggctggaagccgcatggccgcccaacagaggagagggcggatgtgcggcttcaacctggcggcagcgcaaaagatg

SEQ ID NO: 115122 - DNA, 103 bp, Artificial Sequence
  Synthetic Polynucleotide
taatacgactcactatagggcggctgggagatctcagggctggaagccgcaacagaggagagcggctatgagccctgagaacctggcggcagcgcaaaagatg

SEQ ID NO: 115123 - DNA, 103 bp, Artificial Sequence
  Synthetic Polynucleotide
taatacgactcactatagggggcccttctgcggctgggagatctcagggcaacagaggagagccctgatgtctcccagcaacctggcggcagcgcaaaagatg

SEQ ID NO: 115124 - DNA, 103 bp, Artificial Sequence
  Synthetic Polynucleotide
taatacgactcactatagggcggggcttccggcccttctgcggctgggagaacagaggagactcccaatggcagaagggaacctggcggcagcgcaaaagatg

SEQ ID NO: 115125 - DNA, 103 bp, Artificial Sequence
  Synthetic Polynucleotide
taatacgactcactatagggctctaggtcccggggcttccggcccttctgaacagaggagacagaagatgcggaagcccaacctggcggcagcgcaaaagatg

SEQ ID NO: 115126 - DNA, 103 bp, Artificial Sequence
  Synthetic Polynucleotide
taatacgactcactatagggtgagtggaagctctaggtcccggggcttccaacagaggagaggaagcatggggacctagaacctggcggcagcgcaaaagatg

SEQ ID NO: 115127 - DNA, 103 bp, Artificial Sequence
  Synthetic Polynucleotide
taatacgactcactatagggaggctcgggctgagtggaagctctaggtccaacagaggagaggacctatggcttccactaacctggcggcagcgcaaaagatg

SEQ ID NO: 115128 - DNA, 103 bp, Artificial Sequence
  Synthetic Polynucleotide
taatacgactcactatagggcccacctagcaggctcgggctgagtggaagaacagaggagacttccaatgagcccgagcaacctggcggcagcgcaaaagatg

SEQ ID NO: 115129 - DNA, 103 bp, Artificial Sequence
  Synthetic Polynucleotide
taatacgactcactatagggcgggtcccggcccacctagcaggctcgggcaacagaggagagcccgaatgtgctaggtgaacctggcggcagcgcaaaagatg

SEQ ID NO: 115130 - DNA, 103 bp, Artificial Sequence
  Synthetic Polynucleotide
taatacgactcactatagggggggtccgttcgggtcccggcccacctagcaacagaggagagctaggatggccgggaccaacctggcggcagcgcaaaagatg

SEQ ID NO: 115131 - DNA, 103 bp, Artificial Sequence
  Synthetic Polynucleotide
taatacgactcactataggggaactgccacagcgtgattgcactctccataacagaggagaatggagatggcaatcacgaacctggcggcagcgcaaaagatg

SEQ ID NO: 115132 - DNA, 103 bp, Artificial Sequence
  Synthetic Polynucleotide
taatacgactcactatagggttcttctgctttgaggagcttgaattcaccaacagaggagaggtgaaatgaagctcctcaacctggcggcagcgcaaaagatg

SEQ ID NO: 115133 - DNA, 103 bp, Artificial Sequence
  Synthetic Polynucleotide
taatacgactcactatagggaagcaatccatttggtgtctgtgcggtgaaaacagaggagattcaccatgcagacaccaaacctggcggcagcgcaaaagatg

SEQ ID NO: 115134 - DNA, 103 bp, Artificial Sequence
  Synthetic Polynucleotide
taatacgactcactatagggtcggagtcagaagcaatccatttggtgtctaacagaggagaagacacatgatggattgcaacctggcggcagcgcaaaagatg

SEQ ID NO: 115135 - DNA, 103 bp, Artificial Sequence
  Synthetic Polynucleotide
taatacgactcactatagggagcagtggactcggagtcagaagcaatccaaacagaggagatggattatgtctgactccaacctggcggcagcgcaaaagatg

SEQ ID NO: 115136 - DNA, 103 bp, Artificial Sequence
  Synthetic Polynucleotide
taatacgactcactatagggtatgctggagagcagtggactcggagtcagaacagaggagactgactatgagtccactgaacctggcggcagcgcaaaagatg

SEQ ID NO: 115137 - DNA, 103 bp, Artificial Sequence
  Synthetic Polynucleotide
taatacgactcactatagggtccagaaatgtatgctggagagcagtggacaacagaggagagtccacatgtctccagcaaacctggcggcagcgcaaaagatg

SEQ ID NO: 115138 - DNA, 103 bp, Artificial Sequence
  Synthetic Polynucleotide
taatacgactcactatagggctaaggctgctccagaaatgtatgctggagaacagaggagactccagatgacatttctgaacctggcggcagcgcaaaagatg

SEQ ID NO: 115139 - DNA, 103 bp, Artificial Sequence
  Synthetic Polynucleotide
taatacgactcactatagggagcaactggactaaggctgctccagaaatgaacagaggagacatttcatgagcagccttaacctggcggcagcgcaaaagatg

SEQ ID NO: 115140 - DNA, 103 bp, Artificial Sequence
  Synthetic Polynucleotide
taatacgactcactataggggactcagcggagcaactggactaaggctgcaacagaggagagcagccatggtccagttgaacctggcggcagcgcaaaagatg

SEQ ID NO: 115141 - DNA, 103 bp, Artificial Sequence
  Synthetic Polynucleotide
taatacgactcactatagggagcctggcaggactcagcggagcaactggaaacagaggagatccagtatgtccgctgagaacctggcggcagcgcaaaagatg

SEQ ID NO: 115142 - DNA, 103 bp, Artificial Sequence
  Synthetic Polynucleotide
taatacgactcactatagggtggcccttgcagcctggcaggactcagcggaacagaggagaccgctgatgcctgccaggaacctggcggcagcgcaaaagatg

SEQ ID NO: 115143 - DNA, 103 bp, Artificial Sequence
  Synthetic Polynucleotide
taatacgactcactataggggcttggccacttcttctgctttgaggagctaacagaggagaagctccatgaagcagaagaacctggcggcagcgcaaaagatg

SEQ ID NO: 115144 - DNA, 103 bp, Artificial Sequence
  Synthetic Polynucleotide
taatacgactcactatagggacagcgtgcttggcccttgcagcctggcagaacagaggagactgccaatgtgcaagggcaacctggcggcagcgcaaaagatg

SEQ ID NO: 115145 - DNA, 103 bp, Artificial Sequence
  Synthetic Polynucleotide
taatacgactcactataggggggaactggaacagcgtgcttggcccttgcaacagaggagagcaaggatgaagcacgctaacctggcggcagcgcaaaagatg

SEQ ID NO: 115146 - DNA, 103 bp, Artificial Sequence
  Synthetic Polynucleotide
taatacgactcactatagggaagcagtgtggggaactggaacagcgtgctaacagaggagaagcacgatgttccagttcaacctggcggcagcgcaaaagatg

SEQ ID NO: 115147 - DNA, 103 bp, Artificial Sequence
  Synthetic Polynucleotide
taatacgactcactatagggtgtggccattaagcagtgtggggaactggaaacagaggagatccagtatgccacactgcaacctggcggcagcgcaaaagatg

SEQ ID NO: 115148 - DNA, 103 bp, Artificial Sequence
  Synthetic Polynucleotide
taatacgactcactatagggggcactggcatgtggccattaagcagtgtgaacagaggagacacactatgtaatggccaaacctggcggcagcgcaaaagatg

SEQ ID NO: 115149 - DNA, 103 bp, Artificial Sequence
  Synthetic Polynucleotide
taatacgactcactatagggactggggattggcactggcatgtggccattaacagaggagaaatggcatgatgccagtgaacctggcggcagcgcaaaagatg

SEQ ID NO: 115150 - DNA, 103 bp, Artificial Sequence
  Synthetic Polynucleotide
taatacgactcactatagggctctgtccagactggggattggcactggcaaacagaggagatgccagatgcaatccccaaacctggcggcagcgcaaaagatg

SEQ ID NO: 115151 - DNA, 103 bp, Artificial Sequence
  Synthetic Polynucleotide
taatacgactcactatagggggagaagcagctctgtccagactggggattaacagaggagaaatcccatgtctggacagaacctggcggcagcgcaaaagatg

SEQ ID NO: 115152 - DNA, 103 bp, Artificial Sequence
  Synthetic Polynucleotide
taatacgactcactatagggaagcagtactggagaagcagctctgtccagaacagaggagactggacatggctgcttctaacctggcggcagcgcaaaagatg

SEQ ID NO: 115153 - DNA, 103 bp, Artificial Sequence
  Synthetic Polynucleotide
taatacgactcactatagggagtttgaagaaagcagtactggagaagcagaacagaggagactgcttatgcagtactgcaacctggcggcagcgcaaaagatg

SEQ ID NO: 115154 - DNA, 103 bp, Artificial Sequence
  Synthetic Polynucleotide
taatacgactcactatagggagtccccacagcttggccacttcttctgctaacagaggagaagcagaatgagtggccaaaacctggcggcagcgcaaaagatg

SEQ ID NO: 115155 - DNA, 103 bp, Artificial Sequence
  Synthetic Polynucleotide
taatacgactcactataggggatttctgagagtttgaagaaagcagtactaacagaggagaagtactatgttcttcaaaaacctggcggcagcgcaaaagatg

SEQ ID NO: 115156 - DNA, 103 bp, Artificial Sequence
  Synthetic Polynucleotide
taatacgactcactataggggttttttcggagtccccacagcttggccacaacagaggagagtggccatgctgtggggaaacctggcggcagcgcaaaagatg

SEQ ID NO: 115157 - DNA, 103 bp, Artificial Sequence
  Synthetic Polynucleotide
taatacgactcactatagggtatttgttttgttttttcggagtccccacaaacagaggagatgtgggatgtccgaaaaaaacctggcggcagcgcaaaagatg

SEQ ID NO: 115158 - DNA, 103 bp, Artificial Sequence
  Synthetic Polynucleotide
taatacgactcactatagggtcatagttcatatttgttttgttttttcggaacagaggagaccgaaaatgcaaaacaaaaacctggcggcagcgcaaaagatg

SEQ ID NO: 115159 - DNA, 103 bp, Artificial Sequence
  Synthetic Polynucleotide
taatacgactcactataggggctcagcttatcatagttcatatttgttttaacagaggagaaaaacaatgatgaactataacctggcggcagcgcaaaagatg

SEQ ID NO: 115160 - DNA, 103 bp, Artificial Sequence
  Synthetic Polynucleotide
taatacgactcactataggggcagggctctgctcagcttatcatagttcaaacagaggagatgaactatgataagctgaaacctggcggcagcgcaaaagatg

SEQ ID NO: 115161 - DNA, 103 bp, Artificial Sequence
  Synthetic Polynucleotide
taatacgactcactatagggtaatagtatcgcagggctctgctcagcttaaacagaggagataagctatgcagagccctaacctggcggcagcgcaaaagatg

SEQ ID NO: 115162 - DNA, 103 bp, Artificial Sequence
  Synthetic Polynucleotide
taatacgactcactataggggttcttgtcataatagtatcgcagggctctaacagaggagaagagccatgcgatactataacctggcggcagcgcaaaagatg

SEQ ID NO: 115163 - DNA, 103 bp, Artificial Sequence
  Synthetic Polynucleotide
taatacgactcactatagggactgcaacaggaactgccacagcgtgattgaacagaggagacaatcaatgtgtggcagtaacctggcggcagcgcaaaagatg

SEQ ID NO: 115164 - DNA, 103 bp, Artificial Sequence
  Synthetic Polynucleotide
taatacgactcactatagggtcttgatgatgttcttgtcataatagtatcaacagaggagagatactatgatgacaagaaacctggcggcagcgcaaaagatg

SEQ ID NO: 115165 - DNA, 103 bp, Artificial Sequence
  Synthetic Polynucleotide
taatacgactcactatagggccgatcaccttcttgatgatgttcttgtcaaacagaggagatgacaaatgcatcatcaaaacctggcggcagcgcaaaagatg

SEQ ID NO: 115166 - DNA, 103 bp, Artificial Sequence
  Synthetic Polynucleotide
taatacgactcactatagggaaacttctgcccgatcaccttcttgatgataacagaggagaatcatcatgaaggtgatcaacctggcggcagcgcaaaagatg

SEQ ID NO: 115167 - DNA, 103 bp, Artificial Sequence
  Synthetic Polynucleotide
taatacgactcactatagggacttgtacacaaacttctgcccgatcacctaacagaggagaaggtgaatgggcagaagtaacctggcggcagcgcaaaagatg

SEQ ID NO: 115168 - DNA, 103 bp, Artificial Sequence
  Synthetic Polynucleotide
taatacgactcactatagggaaagagacaaacttgtacacaaacttctgcaacagaggagagcagaaatgtgtgtacaaaacctggcggcagcgcaaaagatg

SEQ ID NO: 115169 - DNA, 103 bp, Artificial Sequence
  Synthetic Polynucleotide
taatacgactcactataggggatctccgggaaagagacaaacttgtacacaacagaggagagtgtacatgtttgtctctaacctggcggcagcgcaaaagatg

SEQ ID NO: 115170 - DNA, 103 bp, Artificial Sequence
  Synthetic Polynucleotide
taatacgactcactatagggccatcttcaggatctccgggaaagagacaaaacagaggagattgtctatgtcccggagaaacctggcggcagcgcaaaagatg

SEQ ID NO: 115171 - DNA, 103 bp, Artificial Sequence
  Synthetic Polynucleotide
taatacgactcactataggggcgtgaggatccatcttcaggatctccgggaacagaggagacccggaatgcctgaagataacctggcggcagcgcaaaagatg

SEQ ID NO: 115172 - DNA, 103 bp, Artificial Sequence
  Synthetic Polynucleotide
taatacgactcactataggggatctccaccgcgtgaggatccatcttcagaacagaggagactgaagatggatcctcacaacctggcggcagcgcaaaagatg

SEQ ID NO: 115173 - DNA, 103 bp, Artificial Sequence
  Synthetic Polynucleotide
taatacgactcactatagggtctcccggctgatctccaccgcgtgaggataacagaggagaatcctcatgcggtggagaaacctggcggcagcgcaaaagatg

SEQ ID NO: 115174 - DNA, 103 bp, Artificial Sequence
  Synthetic Polynucleotide
taatacgactcactatagggtccagcagcaactgcaacaggaactgccacaacagaggagagtggcaatgcctgttgcaaacctggcggcagcgcaaaagatg

SEQ ID NO: 115175 - DNA, 103 bp, Artificial Sequence
  Synthetic Polynucleotide
taatacgactcactatagggagcagaaggctctcccggctgatctccaccaacagaggagaggtggaatgcagccgggaaacctggcggcagcgcaaaagatg

SEQ ID NO: 115176 - DNA, 103 bp, Artificial Sequence
  Synthetic Polynucleotide
taatacgactcactataggggctgtcctgcagcagaaggctctcccggctaacagaggagaagccggatgagccttctgaacctggcggcagcgcaaaagatg

SEQ ID NO: 115177 - DNA, 103 bp, Artificial Sequence
  Synthetic Polynucleotide
taatacgactcactatagggccttgcagtcgctgtcctgcagcagaaggcaacagaggagagccttcatgtgcaggacaaacctggcggcagcgcaaaagatg

SEQ ID NO: 115178 - DNA, 103 bp, Artificial Sequence
  Synthetic Polynucleotide
taatacgactcactatagggtccggagacgccttgcagtcgctgtcctgcaacagaggagagcaggaatgcgactgcaaaacctggcggcagcgcaaaagatg

SEQ ID NO: 115179 - DNA, 103 bp, Artificial Sequence
  Synthetic Polynucleotide
taatacgactcactatagggctcgcggccctccggagacgccttgcagtcaacagaggagagactgcatggcgtctccgaacctggcggcagcgcaaaagatg

SEQ ID NO: 115180 - DNA, 103 bp, Artificial Sequence
  Synthetic Polynucleotide
taatacgactcactataggggtttgtgggcctcgcggccctccggagacgaacagaggagacgtctcatgagggccgcgaacctggcggcagcgcaaaagatg

SEQ ID NO: 115181 - DNA, 103 bp, Artificial Sequence
  Synthetic Polynucleotide
taatacgactcactataggggccaggccgtgtttgtgggcctcgcggcccaacagaggagagggccgatgggcccacaaaacctggcggcagcgcaaaagatg

SEQ ID NO: 115182 - DNA, 103 bp, Artificial Sequence
  Synthetic Polynucleotide
taatacgactcactatagggtctgagggcggccaggccgtgtttgtgggcaacagaggagagcccacatgcacggcctgaacctggcggcagcgcaaaagatg

SEQ ID NO: 115183 - DNA, 103 bp, Artificial Sequence
  Synthetic Polynucleotide
taatacgactcactatagggggctcgtgcttctgagggcggccaggccgtaacagaggagaacggccatgccgccctcaaacctggcggcagcgcaaaagatg

SEQ ID NO: 115184 - DNA, 103 bp, Artificial Sequence
  Synthetic Polynucleotide
taatacgactcactatagggtattcgttgcggctcgtgcttctgagggcgaacagaggagacgccctatgaagcacgagaacctggcggcagcgcaaaagatg

SEQ ID NO: 115185 - DNA, 103 bp, Artificial Sequence
  Synthetic Polynucleotide
taatacgactcactatagggatgtttctgatccagcagcaactgcaacagaacagaggagactgttgatgttgctgctgaacctggcggcagcgcaaaagatg

SEQ ID NO: 115186 - DNA, 103 bp, Artificial Sequence
  Synthetic Polynucleotide
taatacgactcactatagggtgagtggatgtattcgttgcggctcgtgctaacagaggagaagcacgatgcgcaacgaaaacctggcggcagcgcaaaagatg

SEQ ID NO: 115187 - DNA, 103 bp, Artificial Sequence
  Synthetic Polynucleotide
taatacgactcactatagggagtacaggcctgagtggatgtattcgttgcaacagaggagagcaacgatgacatccactaacctggcggcagcgcaaaagatg

SEQ ID NO: 115188 - DNA, 103 bp, Artificial Sequence
  Synthetic Polynucleotide
taatacgactcactataggggtgaaggacgagtacaggcctgagtggatgaacagaggagacatccaatgaggcctgtaaacctggcggcagcgcaaaagatg

SEQ ID NO: 115189 - DNA, 103 bp, Artificial Sequence
  Synthetic Polynucleotide
taatacgactcactatagggggaattaatggtgaaggacgagtacaggccaacagaggagaggcctgatgtcgtccttcaacctggcggcagcgcaaaagatg

SEQ ID NO: 115190 - DNA, 103 bp, Artificial Sequence
  Synthetic Polynucleotide
taatacgactcactatagggggttctgcagggaattaatggtgaaggacgaacagaggagacgtcctatgccattaattaacctggcggcagcgcaaaagatg

SEQ ID NO: 115191 - DNA, 103 bp, Artificial Sequence
  Synthetic Polynucleotide
taatacgactcactataggggcgtctggtgggttctgcagggaattaatgaacagaggagacattaaatgcctgcagaaaacctggcggcagcgcaaaagatg

SEQ ID NO: 115192 - DNA, 103 bp, Artificial Sequence
  Synthetic Polynucleotide
taatacgactcactatagggggccttgaaggcgtctggtgggttctgcagaacagaggagactgcagatgccaccagacaacctggcggcagcgcaaaagatg

SEQ ID NO: 115193 - DNA, 103 bp, Artificial Sequence
  Synthetic Polynucleotide
taatacgactcactatagggccgtcttgatggccttgaaggcgtctggtgaacagaggagacaccagatgccttcaaggaacctggcggcagcgcaaaagatg

SEQ ID NO: 115194 - DNA, 103 bp, Artificial Sequence
  Synthetic Polynucleotide
taatacgactcactatagggtccagcttctccgtcttgatggccttgaagaacagaggagacttcaaatgcatcaagacaacctggcggcagcgcaaaagatg

SEQ ID NO: 115195 - DNA, 103 bp, Artificial Sequence
  Synthetic Polynucleotide
taatacgactcactataggggggcggctcctccagcttctccgtcttgataacagaggagaatcaagatggagaagctgaacctggcggcagcgcaaaagatg

SEQ ID NO: 115196 - DNA, 103 bp, Artificial Sequence
  Synthetic Polynucleotide
taatacgactcactatagggtcaaatgctcatgtttctgatccagcagcaaacagaggagatgctgcatgatcagaaacaacctggcggcagcgcaaaagatg

SEQ ID NO: 115197 - DNA, 103 bp, Artificial Sequence
  Synthetic Polynucleotide
taatacgactcactatagggggctgtcttcgggcggctcctccagcttctaacagaggagaagaagcatgaggagccgcaacctggcggcagcgcaaaagatg

SEQ ID NO: 115198 - DNA, 103 bp, Artificial Sequence
  Synthetic Polynucleotide
taatacgactcactatagggtccacgggggggctgtcttcgggcggctccaacagaggagaggagccatgcgaagacagaacctggcggcagcgcaaaagatg

SEQ ID NO: 115199 - DNA, 103 bp, Artificial Sequence
  Synthetic Polynucleotide
taatacgactcactatagggcctgacttcttccacgggggggctgtcttcaacagaggagagaagacatgccccccgtgaacctggcggcagcgcaaaagatg

SEQ ID NO: 115200 - DNA, 103 bp, Artificial Sequence
  Synthetic Polynucleotide
taatacgactcactatagggtgatcacagtcctgacttcttccacgggggaacagaggagacccccgatgaagaagtcaaacctggcggcagcgcaaaagatg

SEQ ID NO: 115201 - DNA, 103 bp, Artificial Sequence
  Synthetic Polynucleotide
taatacgactcactataggggtcacaaacctgatcacagtcctgacttctaacagaggagaagaagtatggactgtgataacctggcggcagcgcaaaagatg

SEQ ID NO: 115202 - DNA, 103 bp, Artificial Sequence
  Synthetic Polynucleotide
taatacgactcactatagggggttttattggtcacaaacctgatcacagtaacagaggagaactgtgatgaggtttgtgaacctggcggcagcgcaaaagatg

SEQ ID NO: 115203 - DNA, 103 bp, Artificial Sequence
  Synthetic Polynucleotide
taatacgactcactatagggcgtgcttgtcggttttattggtcacaaaccaacagaggagaggtttgatgccaataaaaaacctggcggcagcgcaaaagatg

SEQ ID NO: 115204 - DNA, 103 bp, Artificial Sequence
  Synthetic Polynucleotide
taatacgactcactatagggggcctggtgacgtgcttgtcggttttattgaacagaggagacaataaatgcgacaagcaaacctggcggcagcgcaaaagatg

SEQ ID NO: 115205 - DNA, 103 bp, Artificial Sequence
  Synthetic Polynucleotide
taatacgactcactatagggggacaccaccggcctggtgacgtgcttgtcaacagaggagagacaagatggtcaccaggaacctggcggcagcgcaaaagatg

SEQ ID NO: 115206 - DNA, 103 bp, Artificial Sequence
  Synthetic Polynucleotide
taatacgactcactatagggtggaaggcagggacaccaccggcctggtgaaacagaggagatcaccaatgcggtggtgtaacctggcggcagcgcaaaagatg

SEQ ID NO: 115207 - DNA, 103 bp, Artificial Sequence
  Synthetic Polynucleotide
taatacgactcactataggggtccagcagatcaaatgctcatgtttctgaaacagaggagatcagaaatgtgagcatttaacctggcggcagcgcaaaagatg

SEQ ID NO: 115208 - DNA, 103 bp, Artificial Sequence
  Synthetic Polynucleotide
taatacgactcactataggggcctctgacgtggaaggcagggacaccaccaacagaggagaggtggtatgcctgccttcaacctggcggcagcgcaaaagatg

SEQ ID NO: 115209 - DNA, 103 bp, Artificial Sequence
  Synthetic Polynucleotide
taatacgactcactatagggcgccgccgcagcctctgacgtggaaggcagaacagaggagactgcctatgacgtcagagaacctggcggcagcgcaaaagatg

SEQ ID NO: 115210 - DNA, 103 bp, Artificial Sequence
  Synthetic Polynucleotide
taatacgactcactatagggggaaggcggacgccgccgcagcctctgacgaacagaggagacgtcagatgctgcggcggaacctggcggcagcgcaaaagatg

SEQ ID NO: 115211 - DNA, 103 bp, Artificial Sequence
  Synthetic Polynucleotide
taatacgactcactataggggacgaggccaggaaggcggacgccgccgcaaacagaggagatgcggcatggtccgccttaacctggcggcagcgcaaaagatg

SEQ ID NO: 115212 - DNA, 103 bp, Artificial Sequence
  Synthetic Polynucleotide
taatacgactcactatagggggccgagacggacgaggccaggaaggcggaaacagaggagatccgccatgctggcctcgaacctggcggcagcgcaaaagatg

SEQ ID NO: 115213 - DNA, 103 bp, Artificial Sequence
  Synthetic Polynucleotide
taatacgactcactatagggaggagatcttggccgagacggacgaggccaaacagaggagatggcctatgccgtctcggaacctggcggcagcgcaaaagatg

SEQ ID NO: 115214 - DNA, 103 bp, Artificial Sequence
  Synthetic Polynucleotide
taatacgactcactatagggaacattaaagaggagatcttggccgagacgaacagaggagacgtctcatgcaagatctcaacctggcggcagcgcaaaagatg

SEQ ID NO: 115215 - DNA, 103 bp, Artificial Sequence
  Synthetic Polynucleotide
taatacgactcactatagggagcgtttggcaacattaaagaggagatcttaacagaggagaaagatcatgtctttaatgaacctggcggcagcgcaaaagatg

SEQ ID NO: 115216 - DNA, 103 bp, Artificial Sequence
  Synthetic Polynucleotide
taatacgactcactatagggaaatactggcagcgtttggcaacattaaagaacagaggagactttaaatgtgccaaacgaacctggcggcagcgcaaaagatg

SEQ ID NO: 115217 - DNA, 103 bp, Artificial Sequence
  Synthetic Polynucleotide
taatacgactcactataggggaggcggatgaaatactggcagcgtttggcaacagaggagagccaaaatgtgccagtataacctggcggcagcgcaaaagatg

SEQ ID NO: 115218 - DNA, 103 bp, Artificial Sequence
  Synthetic Polynucleotide
taatacgactcactatagggatcgttcgaggtccagcagatcaaatgctcaacagaggagagagcatatgatctgctggaacctggcggcagcgcaaaagatg

SEQ ID NO: 115219 - DNA, 103 bp, Artificial Sequence
  Synthetic Polynucleotide
taatacgactcactatagggtgagaagggtgaggcggatgaaatactggcaacagaggagagccagtatgtcatccgccaacctggcggcagcgcaaaagatg

SEQ ID NO: 115220 - DNA, 103 bp, Artificial Sequence
  Synthetic Polynucleotide
taatacgactcactataggggggaccgagatgagaagggtgaggcggatgaacagaggagacatccgatgcacccttctaacctggcggcagcgcaaaagatg

SEQ ID NO: 115221 - DNA, 103 bp, Artificial Sequence
  Synthetic Polynucleotide
taatacgactcactataggggacagggacggggaccgagatgagaagggtaacagaggagaacccttatgatctcggtcaacctggcggcagcgcaaaagatg

SEQ ID NO: 115222 - DNA, 103 bp, Artificial Sequence
  Synthetic Polynucleotide
taatacgactcactatagggtgagttgggggacagggacggggaccgagaaacagaggagatctcggatgccgtccctgaacctggcggcagcgcaaaagatg

SEQ ID NO: 115223 - DNA, 103 bp, Artificial Sequence
  Synthetic Polynucleotide
taatacgactcactatagggaagggaggggtgagttgggggacagggacgaacagaggagacgtcccatgcccccaactaacctggcggcagcgcaaaagatg

SEQ ID NO: 115224 - DNA, 103 bp, Artificial Sequence
  Synthetic Polynucleotide
taatacgactcactatagggctgtgttcagaagggaggggtgagttggggaacagaggagaccccaaatgacccctcccaacctggcggcagcgcaaaagatg

SEQ ID NO: 115225 - DNA, 103 bp, Artificial Sequence
  Synthetic Polynucleotide
taatacgactcactataggggaagaggcttctgtgttcagaagggaggggaacagaggagacccctcatgtctgaacacaacctggcggcagcgcaaaagatg

SEQ ID NO: 115226 - DNA, 103 bp, Artificial Sequence
  Synthetic Polynucleotide
taatacgactcactatagggcggcctccaggaagaggcttctgtgttcagaacagaggagactgaacatggaagcctctaacctggcggcagcgcaaaagatg

SEQ ID NO: 115227 - DNA, 103 bp, Artificial Sequence
  Synthetic Polynucleotide
taatacgactcactatagggtcatggcaggcggcctccaggaagaggcttaacagaggagaaagcctatgcctggaggcaacctggcggcagcgcaaaagatg

SEQ ID NO: 115228 - DNA, 103 bp, Artificial Sequence
  Synthetic Polynucleotide
taatacgactcactatagggggaatcggagtcatggcaggcggcctccagaacagaggagactggagatggcctgccataacctggcggcagcgcaaaagatg

SEQ ID NO: 115229 - DNA, 103 bp, Artificial Sequence
  Synthetic Polynucleotide
taatacgactcactatagggtgaattcaccatcgttcgaggtccagcagaaacagaggagatctgctatgcctcgaacgaacctggcggcagcgcaaaagatg

SEQ ID NO: 115230 - DNA, 103 bp, Artificial Sequence
  Synthetic Polynucleotide
taatacgactcactatagggagggctccagggaatcggagtcatggcaggaacagaggagacctgccatgactccgattaacctggcggcagcgcaaaagatg

SEQ ID NO: 115231 - DNA, 103 bp, Artificial Sequence
  Synthetic Polynucleotide
taatacgactcactataggggacaggttcaagggctccagggaatcggagaacagaggagactccgaatgcctggagccaacctggcggcagcgcaaaagatg

SEQ ID NO: 115232 - DNA, 103 bp, Artificial Sequence
  Synthetic Polynucleotide
taatacgactcactatagggggagcccgatgacaggttcaagggctccagaacagaggagactggagatgttgaacctgaacctggcggcagcgcaaaagatg

SEQ ID NO: 115233 - DNA, 103 bp, Artificial Sequence
  Synthetic Polynucleotide
taatacgactcactatagggacttggtcttggagcccgatgacaggttcaaacagaggagatgaaccatgcatcgggctaacctggcggcagcgcaaaagatg

SEQ ID NO: 115234 - DNA, 103 bp, Artificial Sequence
  Synthetic Polynucleotide
taatacgactcactatagggagagatggagacttggtcttggagcccgataacagaggagaatcgggatgcaagaccaaaacctggcggcagcgcaaaagatg

SEQ ID NO: 115235 - DNA, 103 bp, Artificial Sequence
  Synthetic Polynucleotide
taatacgactcactatagggctttgggggaagagatggagacttggtcttaacagaggagaaagaccatgtctccatctaacctggcggcagcgcaaaagatg

SEQ ID NO: 115236 - DNA, 103 bp, Artificial Sequence
  Synthetic Polynucleotide
taatacgactcactataggggttttttggcctttgggggaagagatggagaacagaggagactccatatgttcccccaaaacctggcggcagcgcaaaagatg

SEQ ID NO: 115237 - DNA, 103 bp, Artificial Sequence
  Synthetic Polynucleotide
taatacgactcactatagggaagcctttgggttttttggcctttgggggaaacagaggagatcccccatgggccaaaaaaacctggcggcagcgcaaaagatg

SEQ ID NO: 115238 - DNA, 103 bp, Artificial Sequence
  Synthetic Polynucleotide
taatacgactcactatagggtgagatttccaagcctttgggttttttggcaacagaggagagccaaaatgcccaaaggcaacctggcggcagcgcaaaagatg

SEQ ID NO: 115239 - DNA, 103 bp, Artificial Sequence
  Synthetic Polynucleotide
taatacgactcactataggggcgggggcgctgagatttccaagcctttggaacagaggagaccaaagatgtggaaatctaacctggcggcagcgcaaaagatg

SEQ ID NO: 115240 - DNA, 103 bp, Artificial Sequence
  Synthetic Polynucleotide
taatacgactcactatagggttgaggagcttgaattcaccatcgttcgagaacagaggagactcgaaatgtggtgaattaacctggcggcagcgcaaaagatg

SEQ ID NO: 115241 - DNA, 103 bp, Artificial Sequence
  Synthetic Polynucleotide
taatacgactcactataggggagagcaccagcgggggcgctgagatttccaacagaggagaggaaatatgagcgcccccaacctggcggcagcgcaaaagatg

SEQ ID NO: 115242 - DNA, 103 bp, Artificial Sequence
  Synthetic Polynucleotide
taatacgactcactataggggtcggtgccggagagcaccagcgggggcgcaacagaggagagcgcccatgctggtgctcaacctggcggcagcgcaaaagatg

SEQ ID NO: 115243 - DNA, 103 bp, Artificial Sequence
  Synthetic Polynucleotide
taatacgactcactatagggtggagccgatgtcggtgccggagagcaccaaacagaggagatggtgcatgccggcaccgaacctggcggcagcgcaaaagatg

SEQ ID NO: 115244 - DNA, 103 bp, Artificial Sequence
  Synthetic Polynucleotide
taatacgactcactatagggttgagggcgatggagccgatgtcggtgccgaacagaggagacggcacatgcatcggctcaacctggcggcagcgcaaaagatg

SEQ ID NO: 115245 - DNA, 103 bp, Artificial Sequence
  Synthetic Polynucleotide
taatacgactcactatagggggctgggctgttgagggcgatggagccgataacagaggagaatcggcatgatcgccctcaacctggcggcagcgcaaaagatg

SEQ ID NO: 115246 - DNA, 103 bp, Artificial Sequence
  Synthetic Polynucleotide
taatacgactcactatagggccgaggggagggctgggctgttgagggcgaaacagaggagatcgcccatgacagcccagaacctggcggcagcgcaaaagatg

SEQ ID NO: 115247 - DNA, 103 bp, Artificial Sequence
  Synthetic Polynucleotide
taatacgactcactataggggtgagggatcccgaggggagggctgggctgaacagaggagacagcccatgcctcccctcaacctggcggcagcgcaaaagatg

SEQ ID NO: 115248 - DNA, 103 bp, Artificial Sequence
  Synthetic Polynucleotide
taatacgactcactataggggaaggctggggtgagggatcccgaggggagaacagaggagactccccatgggatccctcaacctggcggcagcgcaaaagatg

SEQ ID NO: 115249 - DNA, 103 bp, Artificial Sequence
  Synthetic Polynucleotide
taatacgactcactataggggtgcggtgaagaaggctggggtgagggatcaacagaggagagatcccatgccccagcctaacctggcggcagcgcaaaagatg

SEQ ID NO: 115250 - DNA, 103 bp, Artificial Sequence
  Synthetic Polynucleotide
taatacgactcactatagggtttggtgtctgtgcggtgaagaaggctgggaacagaggagacccagcatgcttcaccgcaacctggcggcagcgcaaaagatg

SEQ ID NO: 115251 - DNA, 103 bp, Artificial Sequence
  Synthetic Polynucleotide
taatacgactcactataggggaactgccacagggtgatagcactgtccataacagaggagaatggacatggctatcaccaacctggcggcagcgcaaaagatg

SEQ ID NO: 115252 - DNA, 103 bp, Artificial Sequence
  Synthetic Polynucleotide
taatacgactcactatagggctcttctgcctgcaaaagcttaaactgcccaacagaggagagggcagatgaagcttttgaacctggcggcagcgcaaaagatg

SEQ ID NO: 115253 - DNA, 103 bp, Artificial Sequence
  Synthetic Polynucleotide
taatacgactcactatagggtgggcttggatcactgctcgtgatcacaagaacagaggagacttgtgatgacgagcagtaacctggcggcagcgcaaaagatg

SEQ ID NO: 115254 - DNA, 103 bp, Artificial Sequence
  Synthetic Polynucleotide
taatacgactcactataggggtattcccagtgggcttggatcactgctcgaacagaggagacgagcaatgatccaagccaacctggcggcagcgcaaaagatg

SEQ ID NO: 115255 - DNA, 103 bp, Artificial Sequence
  Synthetic Polynucleotide
taatacgactcactataggggatgggctcagtattcccagtgggcttggaaacagaggagatccaagatgactgggaataacctggcggcagcgcaaaagatg

SEQ ID NO: 115256 - DNA, 103 bp, Artificial Sequence
  Synthetic Polynucleotide
taatacgactcactatagggtgtagggagagatgggctcagtattcccagaacagaggagactgggaatgctgagcccaaacctggcggcagcgcaaaagatg

SEQ ID NO: 115257 - DNA, 103 bp, Artificial Sequence
  Synthetic Polynucleotide
taatacgactcactatagggtaagagaagctgtagggagagatgggctcaaacagaggagatgagccatgctctccctaaacctggcggcagcgcaaaagatg

SEQ ID NO: 115258 - DNA, 103 bp, Artificial Sequence
  Synthetic Polynucleotide
taatacgactcactatagggaatgctggtgtaagagaagctgtagggagaaacagaggagatctcccatgagcttctctaacctggcggcagcgcaaaagatg

SEQ ID NO: 115259 - DNA, 103 bp, Artificial Sequence
  Synthetic Polynucleotide
taatacgactcactatagggctgtgaaaaaaatgctggtgtaagagaagcaacagaggagagcttctatgacaccagcaaacctggcggcagcgcaaaagatg

SEQ ID NO: 115260 - DNA, 103 bp, Artificial Sequence
  Synthetic Polynucleotide
taatacgactcactatagggagcaagctacctgtgaaaaaaatgctggtgaacagaggagacaccagatgttttttcacaacctggcggcagcgcaaaagatg

SEQ ID NO: 115261 - DNA, 103 bp, Artificial Sequence
  Synthetic Polynucleotide
taatacgactcactatagggataaagagcgagcaagctacctgtgaaaaaaacagaggagatttttcatgggtagcttgaacctggcggcagcgcaaaagatg

SEQ ID NO: 115262 - DNA, 103 bp, Artificial Sequence
  Synthetic Polynucleotide
taatacgactcactatagggtggtgacaccataaagagcgagcaagctacaacagaggagagtagctatgtcgctctttaacctggcggcagcgcaaaagatg

SEQ ID NO: 115263 - DNA, 103 bp, Artificial Sequence
  Synthetic Polynucleotide
taatacgactcactataggggacgagccacctcttctgcctgcaaaagctaacagaggagaagctttatgaggcagaagaacctggcggcagcgcaaaagatg

SEQ ID NO: 115264 - DNA, 103 bp, Artificial Sequence
  Synthetic Polynucleotide
taatacgactcactatagggatgaaagcaatggtgacaccataaagagcgaacagaggagacgctctatgtggtgtcacaacctggcggcagcgcaaaagatg

SEQ ID NO: 115265 - DNA, 103 bp, Artificial Sequence
  Synthetic Polynucleotide
taatacgactcactataggggggcaaataaatgaaagcaatggtgacaccaacagaggagaggtgtcatgattgctttcaacctggcggcagcgcaaaagatg

SEQ ID NO: 115266 - DNA, 103 bp, Artificial Sequence
  Synthetic Polynucleotide
taatacgactcactatagggttgcttaaaagggcaaataaatgaaagcaaaacagaggagattgcttatgtttatttgcaacctggcggcagcgcaaaagatg

SEQ ID NO: 115267 - DNA, 103 bp, Artificial Sequence
  Synthetic Polynucleotide
taatacgactcactatagggaattctggatttgcttaaaagggcaaataaaacagaggagattatttatgcttttaagcaacctggcggcagcgcaaaagatg

SEQ ID NO: 115268 - DNA, 103 bp, Artificial Sequence
  Synthetic Polynucleotide
taatacgactcactatagggtgagtgtataaattctggatttgcttaaaaaacagaggagattttaaatgaatccagaaaacctggcggcagcgcaaaagatg

SEQ ID NO: 115269 - DNA, 103 bp, Artificial Sequence
  Synthetic Polynucleotide
taatacgactcactatagggaaagcaaacttgagtgtataaattctggataacagaggagaatccagatgttatacactaacctggcggcagcgcaaaagatg

SEQ ID NO: 115270 - DNA, 103 bp, Artificial Sequence
  Synthetic Polynucleotide
taatacgactcactatagggtaagtaacagaaagcaaacttgagtgtataaacagaggagatatacaatgaagtttgctaacctggcggcagcgcaaaagatg

SEQ ID NO: 115271 - DNA, 103 bp, Artificial Sequence
  Synthetic Polynucleotide
taatacgactcactatagggaagacaaacctaagtaacagaaagcaaactaacagaggagaagtttgatgtctgttactaacctggcggcagcgcaaaagatg

SEQ ID NO: 115272 - DNA, 103 bp, Artificial Sequence
  Synthetic Polynucleotide
taatacgactcactatagggtaacctttctaagacaaacctaagtaacagaacagaggagactgttaatgaggtttgtcaacctggcggcagcgcaaaagatg

SEQ ID NO: 115273 - DNA, 103 bp, Artificial Sequence
  Synthetic Polynucleotide
taatacgactcactatagggcagtcacacataacctttctaagacaaaccaacagaggagaggtttgatgtagaaaggtaacctggcggcagcgcaaaagatg

SEQ ID NO: 115274 - DNA, 103 bp, Artificial Sequence
  Synthetic Polynucleotide
taatacgactcactatagggatcccccagagacgagccacctcttctgccaacagaggagaggcagaatgggtggctcgaacctggcggcagcgcaaaagatg

SEQ ID NO: 115275 - DNA, 103 bp, Artificial Sequence
  Synthetic Polynucleotide
taatacgactcactataggggttcttgcgaatcccccagagacgagccacaacagaggagagtggctatgctctgggggaacctggcggcagcgcaaaagatg

SEQ ID NO: 115276 - DNA, 103 bp, Artificial Sequence
  Synthetic Polynucleotide
taatacgactcactatagggtgttaggcttgttcttgcgaatcccccagaaacagaggagatctgggatgttcgcaagaaacctggcggcagcgcaaaagatg

SEQ ID NO: 115277 - DNA, 103 bp, Artificial Sequence
  Synthetic Polynucleotide
taatacgactcactatagggtcataattcatgttaggcttgttcttgcgaaacagaggagatcgcaaatgcaagcctaaaacctggcggcagcgcaaaagatg

SEQ ID NO: 115278 - DNA, 103 bp, Artificial Sequence
  Synthetic Polynucleotide
taatacgactcactataggggctgagtttgtcataattcatgttaggcttaacagaggagaaagcctatgatgaattataacctggcggcagcgcaaaagatg

SEQ ID NO: 115279 - DNA, 103 bp, Artificial Sequence
  Synthetic Polynucleotide
taatacgactcactatagggtgagggctcggctgagtttgtcataattcaaacagaggagatgaattatgacaaactcaaacctggcggcagcgcaaaagatg

SEQ ID NO: 115280 - DNA, 103 bp, Artificial Sequence
  Synthetic Polynucleotide
taatacgactcactatagggtaatagtatctgagggctcggctgagtttgaacagaggagacaaactatgccgagccctaacctggcggcagcgcaaaagatg

SEQ ID NO: 115281 - DNA, 103 bp, Artificial Sequence
  Synthetic Polynucleotide
taatacgactcactatagggattctttacataatagtatctgagggctcgaacagaggagacgagccatgagatactataacctggcggcagcgcaaaagatg

SEQ ID NO: 115282 - DNA, 103 bp, Artificial Sequence
  Synthetic Polynucleotide
taatacgactcactataggggctgaagaaggaactgccacagggtgatagaacagaggagactatcaatgtgtggcagtaacctggcggcagcgcaaaagatg

SEQ ID NO: 115283 - DNA, 103 bp, Artificial Sequence
  Synthetic Polynucleotide
taatacgactcactatagggttttgatgatattctttacataatagtatcaacagaggagagatactatgatgtaaagaaacctggcggcagcgcaaaagatg

SEQ ID NO: 115284 - DNA, 103 bp, Artificial Sequence
  Synthetic Polynucleotide
taatacgactcactatagggccattcacttttttgatgatattctttacaaacagaggagatgtaaaatgtatcatcaaaacctggcggcagcgcaaaagatg

SEQ ID NO: 115285 - DNA, 103 bp, Artificial Sequence
  Synthetic Polynucleotide
taatacgactcactatagggaaacttctgaccattcacttttttgatgataacagaggagaatcatcatgaaagtgaataacctggcggcagcgcaaaagatg

SEQ ID NO: 115286 - DNA, 103 bp, Artificial Sequence
  Synthetic Polynucleotide
taatacgactcactatagggacttgtacacaaacttctgaccattcacttaacagaggagaaagtgaatggtcagaagtaacctggcggcagcgcaaaagatg

SEQ ID NO: 115287 - DNA, 103 bp, Artificial Sequence
  Synthetic Polynucleotide
taatacgactcactatagggtaagagacaaacttgtacacaaacttctgaaacagaggagatcagaaatgtgtgtacaaaacctggcggcagcgcaaaagatg

SEQ ID NO: 115288 - DNA, 103 bp, Artificial Sequence
  Synthetic Polynucleotide
taatacgactcactatagggaatctctggataagagacaaacttgtacacaacagaggagagtgtacatgtttgtctctaacctggcggcagcgcaaaagatg

SEQ ID NO: 115289 - DNA, 103 bp, Artificial Sequence
  Synthetic Polynucleotide
taatacgactcactatagggccatgttcaaaatctctggataagagacaaaacagaggagattgtctatgatccagagaaacctggcggcagcgcaaaagatg

SEQ ID NO: 115290 - DNA, 103 bp, Artificial Sequence
  Synthetic Polynucleotide
taatacgactcactataggggtcattggatccatgttcaaaatctctggaaacagaggagatccagaatgtttgaacataacctggcggcagcgcaaaagatg

SEQ ID NO: 115291 - DNA, 103 bp, Artificial Sequence
  Synthetic Polynucleotide
taatacgactcactatagggcctgcccactgtcattggatccatgttcaaaacagaggagattgaacatggatccaatgaacctggcggcagcgcaaaagatg

SEQ ID NO: 115292 - DNA, 103 bp, Artificial Sequence
  Synthetic Polynucleotide
taatacgactcactatagggcaccctcaatcctgcccactgtcattggataacagaggagaatccaaatgcagtgggcaaacctggcggcagcgcaaaagatg

SEQ ID NO: 115293 - DNA, 103 bp, Artificial Sequence
  Synthetic Polynucleotide
taatacgactcactatagggttctgcaggagctgaagaaggaactgccacaacagaggagagtggcaatgccttcttcaaacctggcggcagcgcaaaagatg

SEQ ID NO: 115294 - DNA, 103 bp, Artificial Sequence
  Synthetic Polynucleotide
taatacgactcactatagggctttcacagtcaccctcaatcctgcccactaacagaggagaagtgggatggattgagggaacctggcggcagcgcaaaagatg

SEQ ID NO: 115295 - DNA, 103 bp, Artificial Sequence
  Synthetic Polynucleotide
taatacgactcactataggggaagtttaaactttcacagtcaccctcaataacagaggagaattgagatggactgtgaaaacctggcggcagcgcaaaagatg

SEQ ID NO: 115296 - DNA, 103 bp, Artificial Sequence
  Synthetic Polynucleotide
taatacgactcactatagggtgacttcactgaagtttaaactttcacagtaacagaggagaactgtgatggtttaaactaacctggcggcagcgcaaaagatg

SEQ ID NO: 115297 - DNA, 103 bp, Artificial Sequence
  Synthetic Polynucleotide
taatacgactcactataggggaactgctgctgacttcactgaagtttaaaaacagaggagatttaaaatgcagtgaagtaacctggcggcagcgcaaaagatg

SEQ ID NO: 115298 - DNA, 103 bp, Artificial Sequence
  Synthetic Polynucleotide
taatacgactcactatagggcacatctttggaactgctgctgacttcactaacagaggagaagtgaaatgagcagcagtaacctggcggcagcgcaaaagatg

SEQ ID NO: 115299 - DNA, 103 bp, Artificial Sequence
  Synthetic Polynucleotide
taatacgactcactatagggctccattctccacatctttggaactgctgcaacagaggagagcagcaatgccaaagatgaacctggcggcagcgcaaaagatg

SEQ ID NO: 115300 - DNA, 103 bp, Artificial Sequence
  Synthetic Polynucleotide
taatacgactcactatagggttatctttccctccattctccacatctttgaacagaggagacaaagaatgggagaatggaacctggcggcagcgcaaaagatg

SEQ ID NO: 115301 - DNA, 103 bp, Artificial Sequence
  Synthetic Polynucleotide
taatacgactcactatagggctgaggtggtttatctttccctccattctcaacagaggagagagaatatggggaaagataacctggcggcagcgcaaaagatg

SEQ ID NO: 115302 - DNA, 103 bp, Artificial Sequence
  Synthetic Polynucleotide
taatacgactcactatagggtggcaccaggctgaggtggtttatctttccaacagaggagaggaaagatgaaccacctcaacctggcggcagcgcaaaagatg

SEQ ID NO: 115303 - DNA, 103 bp, Artificial Sequence
  Synthetic Polynucleotide
taatacgactcactatagggctagaggtcttggcaccaggctgaggtggtaacagaggagaaccaccatggcctggtgcaacctggcggcagcgcaaaagatg

SEQ ID NO: 115304 - DNA, 103 bp, Artificial Sequence
  Synthetic Polynucleotide
taatacgactcactataggggttctgaggcttctgcaggagctgaagaagaacagaggagacttcttatgctcctgcagaacctggcggcagcgcaaaagatg

SEQ ID NO: 115305 - DNA, 103 bp, Artificial Sequence
  Synthetic Polynucleotide
taatacgactcactataggggtcattgcggctagaggtcttggcaccaggaacagaggagacctggtatgaagacctctaacctggcggcagcgcaaaagatg

SEQ ID NO: 115306 - DNA, 103 bp, Artificial Sequence
  Synthetic Polynucleotide
taatacgactcactatagggagtgtatgtagtcattgcggctagaggtctaacagaggagaagacctatggccgcaatgaacctggcggcagcgcaaaagatg

SEQ ID NO: 115307 - DNA, 103 bp, Artificial Sequence
  Synthetic Polynucleotide
taatacgactcactatagggtataagccagagtgtatgtagtcattgcggaacagaggagaccgcaaatgctacatacaaacctggcggcagcgcaaaagatg

SEQ ID NO: 115308 - DNA, 103 bp, Artificial Sequence
  Synthetic Polynucleotide
taatacgactcactatagggaaatgaagaatataagccagagtgtatgtaaacagaggagatacataatgtctggcttaaacctggcggcagcgcaaaagatg

SEQ ID NO: 115309 - DNA, 103 bp, Artificial Sequence
  Synthetic Polynucleotide
taatacgactcactatagggagttgagagtaaatgaagaatataagccagaacagaggagactggctatgattcttcataacctggcggcagcgcaaaagatg

SEQ ID NO: 115310 - DNA, 103 bp, Artificial Sequence
  Synthetic Polynucleotide
taatacgactcactataggggagttcaaagagttgagagtaaatgaagaaaacagaggagattcttcatgtactctcaaaacctggcggcagcgcaaaagatg

SEQ ID NO: 115311 - DNA, 103 bp, Artificial Sequence
  Synthetic Polynucleotide
taatacgactcactatagggtacattggaggagttcaaagagttgagagtaacagaggagaactctcatgtctttgaacaacctggcggcagcgcaaaagatg

SEQ ID NO: 115312 - DNA, 103 bp, Artificial Sequence
  Synthetic Polynucleotide
taatacgactcactatagggtgaaaagctttacattggaggagttcaaagaacagaggagactttgaatgcctccaatgaacctggcggcagcgcaaaagatg

SEQ ID NO: 115313 - DNA, 103 bp, Artificial Sequence
  Synthetic Polynucleotide
taatacgactcactatagggtttatcaatttgaaaagctttacattggagaacagaggagactccaaatgaaagcttttaacctggcggcagcgcaaaagatg

SEQ ID NO: 115314 - DNA, 103 bp, Artificial Sequence
  Synthetic Polynucleotide
taatacgactcactatagggattctcagtctttatcaatttgaaaagcttaacagaggagaaagcttatgaaattgataaacctggcggcagcgcaaaagatg

SEQ ID NO: 115315 - DNA, 103 bp, Artificial Sequence
  Synthetic Polynucleotide
taatacgactcactatagggtcatgtgcttgttctgaggcttctgcaggaaacagaggagatcctgcatgagcctcagaaacctggcggcagcgcaaaagatg

SEQ ID NO: 115316 - DNA, 103 bp, Artificial Sequence
  Synthetic Polynucleotide
taatacgactcactatagggtctcggctggattctcagtctttatcaattaacagaggagaaattgaatgagactgagaaacctggcggcagcgcaaaagatg

SEQ ID NO: 115317 - DNA, 103 bp, Artificial Sequence
  Synthetic Polynucleotide
taatacgactcactatagggtctgccagtttctcggctggattctcagtcaacagaggagagactgaatgtccagccgaaacctggcggcagcgcaaaagatg

SEQ ID NO: 115318 - DNA, 103 bp, Artificial Sequence
  Synthetic Polynucleotide
taatacgactcactatagggagattttttctctgccagtttctcggctggaacagaggagaccagccatgaaactggcaaacctggcggcagcgcaaaagatg

SEQ ID NO: 115319 - DNA, 103 bp, Artificial Sequence
  Synthetic Polynucleotide
taatacgactcactataggggctcctgaggagattttttctctgccagttaacagaggagaaactggatgagaaaaaataacctggcggcagcgcaaaagatg

SEQ ID NO: 115320 - DNA, 103 bp, Artificial Sequence
  Synthetic Polynucleotide
taatacgactcactataggggatggtgtgggctcctgaggagattttttcaacagaggagagaaaaaatgtcctcaggaaacctggcggcagcgcaaaagatg

SEQ ID NO: 115321 - DNA, 103 bp, Artificial Sequence
  Synthetic Polynucleotide
taatacgactcactatagggtttgatgacagatggtgtgggctcctgaggaacagaggagacctcagatgcccacaccaaacctggcggcagcgcaaaagatg

SEQ ID NO: 115322 - DNA, 103 bp, Artificial Sequence
  Synthetic Polynucleotide
taatacgactcactatagggtcgtgacaaatttgatgacagatggtgtggaacagaggagaccacacatgctgtcatcaaacctggcggcagcgcaaaagatg

SEQ ID NO: 115323 - DNA, 103 bp, Artificial Sequence
  Synthetic Polynucleotide
taatacgactcactatagggttggaaggtgtcgtgacaaatttgatgacaaacagaggagatgtcatatgatttgtcacaacctggcggcagcgcaaaagatg

SEQ ID NO: 115324 - DNA, 103 bp, Artificial Sequence
  Synthetic Polynucleotide
taatacgactcactatagggcggtggctttttggaaggtgtcgtgacaaaaacagaggagatttgtcatgacaccttccaacctggcggcagcgcaaaagatg

SEQ ID NO: 115325 - DNA, 103 bp, Artificial Sequence
  Synthetic Polynucleotide
taatacgactcactatagggcaggttcaaccggtggctttttggaaggtgaacagaggagacaccttatgaaaagccacaacctggcggcagcgcaaaagatg

SEQ ID NO: 115326 - DNA, 103 bp, Artificial Sequence
  Synthetic Polynucleotide
taatacgactcactataggggtccaacagatcatgtgcttgttctgaggcaacagaggagagcctcaatgcaagcacataacctggcggcagcgcaaaagatg

SEQ ID NO: 115327 - DNA, 103 bp, Artificial Sequence
  Synthetic Polynucleotide
taatacgactcactataggggtggcagcaacaggttcaaccggtggctttaacagaggagaaaagccatgggttgaaccaacctggcggcagcgcaaaagatg

SEQ ID NO: 115328 - DNA, 103 bp, Artificial Sequence
  Synthetic Polynucleotide
taatacgactcactatagggaattgaaatggtggcagcaacaggttcaacaacagaggagagttgaaatggttgctgccaacctggcggcagcgcaaaagatg

SEQ ID NO: 115329 - DNA, 103 bp, Artificial Sequence
  Synthetic Polynucleotide
taatacgactcactatagggtacttgggccaattgaaatggtggcagcaaaacagaggagattgctgatgccatttcaaaacctggcggcagcgcaaaagatg

SEQ ID NO: 115330 - DNA, 103 bp, Artificial Sequence
  Synthetic Polynucleotide
taatacgactcactataggggatggagaaatacttgggccaattgaaatgaacagaggagacatttcatgtggcccaagaacctggcggcagcgcaaaagatg

SEQ ID NO: 115331 - DNA, 103 bp, Artificial Sequence
  Synthetic Polynucleotide
taatacgactcactatagggttcttctgaagatggagaaatacttgggccaacagaggagaggcccaatgatttctccaaacctggcggcagcgcaaaagatg

SEQ ID NO: 115332 - DNA, 103 bp, Artificial Sequence
  Synthetic Polynucleotide
taatacgactcactatagggcttggatagtttcttctgaagatggagaaaaacagaggagatttctcatgcttcagaagaacctggcggcagcgcaaaagatg

SEQ ID NO: 115333 - DNA, 103 bp, Artificial Sequence
  Synthetic Polynucleotide
taatacgactcactataggggtctccaaagcttggatagtttcttctgaaaacagaggagattcagaatgaactatccaaacctggcggcagcgcaaaagatg

SEQ ID NO: 115334 - DNA, 103 bp, Artificial Sequence
  Synthetic Polynucleotide
taatacgactcactatagggggaaaccaatgtctccaaagcttggatagtaacagaggagaactatcatggctttggagaacctggcggcagcgcaaaagatg

SEQ ID NO: 115335 - DNA, 103 bp, Artificial Sequence
  Synthetic Polynucleotide
taatacgactcactataggggcagttttggggaaaccaatgtctccaaagaacagaggagactttggatgcattggtttaacctggcggcagcgcaaaagatg

SEQ ID NO: 115336 - DNA, 103 bp, Artificial Sequence
  Synthetic Polynucleotide
taatacgactcactatagggtccagggaaggcagttttggggaaaccaataacagaggagaattggtatgcccaaaactaacctggcggcagcgcaaaagatg

SEQ ID NO: 115337 - DNA, 103 bp, Artificial Sequence
  Synthetic Polynucleotide
taatacgactcactatagggatcattagaggtccaacagatcatgtgcttaacagaggagaaagcacatgatctgttggaacctggcggcagcgcaaaagatg

SEQ ID NO: 115338 - DNA, 103 bp, Artificial Sequence
  Synthetic Polynucleotide
taatacgactcactatagggggttggggcttccagggaaggcagttttggaacagaggagaccaaaaatgccttccctgaacctggcggcagcgcaaaagatg

SEQ ID NO: 115339 - DNA, 103 bp, Artificial Sequence
  Synthetic Polynucleotide
taatacgactcactatagggtagaggcagaggttggggcttccagggaagaacagaggagacttcccatgaagccccaaaacctggcggcagcgcaaaagatg

SEQ ID NO: 115340 - DNA, 103 bp, Artificial Sequence
  Synthetic Polynucleotide
taatacgactcactataggggtcattacgttagaggcagaggttggggctaacagaggagaagccccatgctctgcctcaacctggcggcagcgcaaaagatg

SEQ ID NO: 115341 - DNA, 103 bp, Artificial Sequence
  Synthetic Polynucleotide
taatacgactcactatagggggcaaaagcagtcattacgttagaggcagaaacagaggagatctgccatgaacgtaatgaacctggcggcagcgcaaaagatg

SEQ ID NO: 115342 - DNA, 103 bp, Artificial Sequence
  Synthetic Polynucleotide
taatacgactcactataggggtggtgtggtggcaaaagcagtcattacgtaacagaggagaacgtaaatgctgcttttgaacctggcggcagcgcaaaagatg

SEQ ID NO: 115343 - DNA, 103 bp, Artificial Sequence
  Synthetic Polynucleotide
taatacgactcactataggggacgaaatgggtggtgtggtggcaaaagcaaacagaggagatgctttatgcaccacaccaacctggcggcagcgcaaaagatg

SEQ ID NO: 115344 - DNA, 103 bp, Artificial Sequence
  Synthetic Polynucleotide
taatacgactcactatagggagggggtatggacgaaatgggtggtgtggtaacagaggagaaccacaatgcccatttcgaacctggcggcagcgcaaaagatg

SEQ ID NO: 115345 - DNA, 103 bp, Artificial Sequence
  Synthetic Polynucleotide
taatacgactcactataggggttcctgcaaagggggtatggacgaaatggaacagaggagaccatttatgccataccccaacctggcggcagcgcaaaagatg

SEQ ID NO: 115346 - DNA, 103 bp, Artificial Sequence
  Synthetic Polynucleotide
taatacgactcactataggggttctgggaggttcctgcaaagggggtatgaacagaggagacataccatgtttgcaggaaacctggcggcagcgcaaaagatg

SEQ ID NO: 115347 - DNA, 103 bp, Artificial Sequence
  Synthetic Polynucleotide
taatacgactcactatagggtggtgaaggtgttctgggaggttcctgcaaaacagaggagattgcagatgcctcccagaaacctggcggcagcgcaaaagatg

SEQ ID NO: 115348 - DNA, 103 bp, Artificial Sequence
  Synthetic Polynucleotide
taatacgactcactatagggtaaactgcccatcattagaggtccaacagaaacagaggagatctgttatgcctctaatgaacctggcggcagcgcaaaagatg

SEQ ID NO: 115349 - DNA, 103 bp, Artificial Sequence
  Synthetic Polynucleotide
taatacgactcactatagggaactcagtggtggtgaaggtgttctgggagaacagaggagactcccaatgcaccttcacaacctggcggcagcgcaaaagatg

SEQ ID NO: 115350 - DNA, 103 bp, Artificial Sequence
  Synthetic Polynucleotide
taatacgactcactatagggtctgggtgagaactcagtggtggtgaaggtaacagaggagaaccttcatgaccactgagaacctggcggcagcgcaaaagatg

SEQ ID NO: 115351 - DNA, 103 bp, Artificial Sequence
  Synthetic Polynucleotide
taatacgactcactatagggtgtgtcgatgtctgggtgagaactcagtggaacagaggagaccactgatgtctcacccaaacctggcggcagcgcaaaagatg

SEQ ID NO: 115352 - DNA, 103 bp, Artificial Sequence
  Synthetic Polynucleotide
taatacgactcactatagggaatcaatgtctgtgtcgatgtctgggtgagaacagaggagactcaccatgacatcgacaaacctggcggcagcgcaaaagatg

SEQ ID NO: 115353 - DNA, 103 bp, Artificial Sequence
  Synthetic Polynucleotide
taatacgactcactataggggaagccactgaatcaatgtctgtgtcgatgaacagaggagacatcgaatgagacattgaaacctggcggcagcgcaaaagatg

SEQ ID NO: 115354 - DNA, 103 bp, Artificial Sequence
  Synthetic Polynucleotide
taatacgactcactatagggcattggctgagaagccactgaatcaatgtcaacagaggagagacattatgtcagtggctaacctggcggcagcgcaaaagatg

SEQ ID NO: 115355 - DNA, 103 bp, Artificial Sequence
  Synthetic Polynucleotide
taatacgactcactatagggctggaagttccattggctgagaagccactgaacagaggagacagtggatgctcagccaaaacctggcggcagcgcaaaagatg

SEQ ID NO: 115356 - DNA, 103 bp, Artificial Sequence
  Synthetic Polynucleotide
taatacgactcactataggggacaaattctctggaagttccattggctgaaacagaggagatcagccatgggaacttccaacctggcggcagcgcaaaagatg

SEQ ID NO: 115357 - DNA, 103 bp, Artificial Sequence
  Synthetic Polynucleotide
taatacgactcactatagggaggctccagtgacaaattctctggaagttcaacagaggagagaacttatggagaatttgaacctggcggcagcgcaaaagatg

SEQ ID NO: 115358 - DNA, 103 bp, Artificial Sequence
  Synthetic Polynucleotide
taatacgactcactatagggcctggtctttaggctccagtgacaaattctaacagaggagaagaattatgcactggagcaacctggcggcagcgcaaaagatg

SEQ ID NO: 115359 - DNA, 103 bp, Artificial Sequence
  Synthetic Polynucleotide
taatacgactcactatagggtgcaaaagcttaaactgcccatcattagagaacagaggagactctaaatgtgggcagttaacctggcggcagcgcaaaagatg

SEQ ID NO: 115360 - DNA, 103 bp, Artificial Sequence
  Synthetic Polynucleotide
taatacgactcactatagggaagactgaatcctggtctttaggctccagtaacagaggagaactggaatgtaaagaccaaacctggcggcagcgcaaaagatg

SEQ ID NO: 115361 - DNA, 103 bp, Artificial Sequence
  Synthetic Polynucleotide
taatacgactcactatagggcttttctagcaagactgaatcctggtctttaacagaggagaaaagacatggattcagtcaacctggcggcagcgcaaaagatg

SEQ ID NO: 115362 - DNA, 103 bp, Artificial Sequence
  Synthetic Polynucleotide
taatacgactcactatagggttactttgtccttttctagcaagactgaataacagaggagaattcagatgtgctagaaaaacctggcggcagcgcaaaagatg

SEQ ID NO: 115363 - DNA, 103 bp, Artificial Sequence
  Synthetic Polynucleotide
taatacgactcactataggggatgaattatttactttgtccttttctagcaacagaggagagctagaatgggacaaagtaacctggcggcagcgcaaaagatg

SEQ ID NO: 115364 - DNA, 103 bp, Artificial Sequence
  Synthetic Polynucleotide
taatacgactcactatagggcttggatcttgatgaattatttactttgtcaacagaggagagacaaaatgaataattcaaacctggcggcagcgcaaaagatg

SEQ ID NO: 115365 - DNA, 103 bp, Artificial Sequence
  Synthetic Polynucleotide
taatacgactcactatagggctttgggtttcttggatcttgatgaattataacagaggagaataattatgcaagatccaaacctggcggcagcgcaaaagatg

SEQ ID NO: 115366 - DNA, 103 bp, Artificial Sequence
  Synthetic Polynucleotide
taatacgactcactatagggagttctaaccctttgggtttcttggatcttaacagaggagaaagatcatggaaacccaaaacctggcggcagcgcaaaagatg

SEQ ID NO: 115367 - DNA, 103 bp, Artificial Sequence
  Synthetic Polynucleotide
taatacgactcactatagggggtgggtgccagttctaaccctttgggtttaacagaggagaaaacccatggggttagaaaacctggcggcagcgcaaaagatg

SEQ ID NO: 115368 - DNA, 103 bp, Artificial Sequence
  Synthetic Polynucleotide
taatacgactcactatagggtgatcacaagggtgggtgccagttctaaccaacagaggagaggttagatgtggcacccaaacctggcggcagcgcaaaagatg

SEQ ID NO: 115369 - DNA, 103 bp, Artificial Sequence
  Synthetic Polynucleotide
taatacgactcactatagggtcactgctcgtgatcacaagggtgggtgccaacagaggagaggcaccatgccttgtgataacctggcggcagcgcaaaagatg

SEQ ID NO: 115370 - DNA, 103 bp, Artificial Sequence
  Synthetic Polynucleotide
taatacgactcactatagggtcctctcagaggctcctggagctcctccataacagaggagaatggagatgctccaggagaacctggcggcagcgcaaaagatg

SEQ ID NO: 115371 - DNA, 103 bp, Artificial Sequence
  Synthetic Polynucleotide
taatacgactcactatagggacactcttgcagcgcccgcagggcagcgtcaacagaggagagacgctatgctgcgggcgaacctggcggcagcgcaaaagatg

SEQ ID NO: 115372 - DNA, 103 bp, Artificial Sequence
  Synthetic Polynucleotide
taatacgactcactatagggtcgccgaactcttttaatctctgctcccagaacagaggagactgggaatggagattaaaaacctggcggcagcgcaaaagatg

SEQ ID NO: 115373 - DNA, 103 bp, Artificial Sequence
  Synthetic Polynucleotide
taatacgactcactatagggctggagttcctcgccgaactcttttaatctaacagaggagaagattaatggagttcggcaacctggcggcagcgcaaaagatg

SEQ ID NO: 115374 - DNA, 103 bp, Artificial Sequence
  Synthetic Polynucleotide
taatacgactcactatagggaccttgtattctggagttcctcgccgaactaacagaggagaagttcgatgaggaactccaacctggcggcagcgcaaaagatg

SEQ ID NO: 115375 - DNA, 103 bp, Artificial Sequence
  Synthetic Polynucleotide
taatacgactcactataggggtcttccaggaccttgtattctggagttccaacagaggagaggaactatggaatacaagaacctggcggcagcgcaaaagatg

SEQ ID NO: 115376 - DNA, 103 bp, Artificial Sequence
  Synthetic Polynucleotide
taatacgactcactatagggggattatcttgtcttccaggaccttgtattaacagaggagaaatacaatgtcctggaagaacctggcggcagcgcaaaagatg

SEQ ID NO: 115377 - DNA, 103 bp, Artificial Sequence
  Synthetic Polynucleotide
taatacgactcactatagggttatattcctggattatcttgtcttccaggaacagaggagacctggaatgcaagataataacctggcggcagcgcaaaagatg

SEQ ID NO: 115378 - DNA, 103 bp, Artificial Sequence
  Synthetic Polynucleotide
taatacgactcactatagggcctgaactttttatattcctggattatcttaacagaggagaaagataatgcaggaatataacctggcggcagcgcaaaagatg

SEQ ID NO: 115379 - DNA, 103 bp, Artificial Sequence
  Synthetic Polynucleotide
taatacgactcactatagggggtactgcttcctgaactttttatattcctaacagaggagaaggaatatgaaaagttcaaacctggcggcagcgcaaaagatg

SEQ ID NO: 115380 - DNA, 103 bp, Artificial Sequence
  Synthetic Polynucleotide
taatacgactcactatagggctgtaacttgggtactgcttcctgaactttaacagaggagaaaagttatggaagcagtaaacctggcggcagcgcaaaagatg

SEQ ID NO: 115381 - DNA, 103 bp, Artificial Sequence
  Synthetic Polynucleotide
taatacgactcactatagggcttttcttctctgtaacttgggtactgcttaacagaggagaaagcagatgccaagttacaacctggcggcagcgcaaaagatg

SEQ ID NO: 115382 - DNA, 103 bp, Artificial Sequence
  Synthetic Polynucleotide
taatacgactcactataggggttgccgctgacactcttgcagcgcccgcaaacagaggagatgcgggatgtgcaagagtaacctggcggcagcgcaaaagatg

SEQ ID NO: 115383 - DNA, 103 bp, Artificial Sequence
  Synthetic Polynucleotide
taatacgactcactatagggcacagcgacgcttttcttctctgtaacttgaacagaggagacaagttatggagaagaaaaacctggcggcagcgcaaaagatg

SEQ ID NO: 115384 - DNA, 103 bp, Artificial Sequence
  Synthetic Polynucleotide
taatacgactcactatagggtgaaggtactcacagcgacgcttttcttctaacagaggagaagaagaatggcgtcgctgaacctggcggcagcgcaaaagatg

SEQ ID NO: 115385 - DNA, 103 bp, Artificial Sequence
  Synthetic Polynucleotide
taatacgactcactatagggcaatttctggtgaaggtactcacagcgacgaacagaggagacgtcgcatggagtaccttaacctggcggcagcgcaaaagatg

SEQ ID NO: 115386 - DNA, 103 bp, Artificial Sequence
  Synthetic Polynucleotide
taatacgactcactatagggtaatgtgggacaatttctggtgaaggtactaacagaggagaagtaccatgaccagaaataacctggcggcagcgcaaaagatg

SEQ ID NO: 115387 - DNA, 103 bp, Artificial Sequence
  Synthetic Polynucleotide
taatacgactcactatagggatgagacctttaatgtgggacaatttctggaacagaggagaccagaaatggtcccacataacctggcggcagcgcaaaagatg

SEQ ID NO: 115388 - DNA, 103 bp, Artificial Sequence
  Synthetic Polynucleotide
taatacgactcactatagggaaactccaggatgagacctttaatgtgggaaacagaggagatcccacatgaaaggtctcaacctggcggcagcgcaaaagatg

SEQ ID NO: 115389 - DNA, 103 bp, Artificial Sequence
  Synthetic Polynucleotide
taatacgactcactatagggtcttttcctcaaactccaggatgagaccttaacagaggagaaaggtcatgtcctggagtaacctggcggcagcgcaaaagatg

SEQ ID NO: 115390 - DNA, 103 bp, Artificial Sequence
  Synthetic Polynucleotide
taatacgactcactatagggctgcccctgttcttttcctcaaactccaggaacagaggagacctggaatgtgaggaaaaaacctggcggcagcgcaaaagatg

SEQ ID NO: 115391 - DNA, 103 bp, Artificial Sequence
  Synthetic Polynucleotide
taatacgactcactatagggggccgtacctgttgccgctgacactcttgcaacagaggagagcaagaatgtcagcggcaaacctggcggcagcgcaaaagatg

SEQ ID NO: 115392 - DNA, 103 bp, Artificial Sequence
  Synthetic Polynucleotide
taatacgactcactatagggagcaatcaccggccgtacctgttgccgctgaacagaggagacagcggatgcaggtacggaacctggcggcagcgcaaaagatg

SEQ ID NO: 115393 - DNA, 103 bp, Artificial Sequence
  Synthetic Polynucleotide
taatacgactcactatagggggccttggaaagcaatcaccggccgtacctaacagaggagaaggtacatgcggtgattgaacctggcggcagcgcaaaagatg

SEQ ID NO: 115394 - DNA, 103 bp, Artificial Sequence
  Synthetic Polynucleotide
taatacgactcactatagggtaccctcggtggccttggaaagcaatcaccaacagaggagaggtgatatgtttccaaggaacctggcggcagcgcaaaagatg

SEQ ID NO: 115395 - DNA, 103 bp, Artificial Sequence
  Synthetic Polynucleotide
taatacgactcactataggggagtctcagataccctcggtggccttggaaaacagaggagattccaaatgcaccgagggaacctggcggcagcgcaaaagatg

SEQ ID NO: 115396 - DNA, 103 bp, Artificial Sequence
  Synthetic Polynucleotide
taatacgactcactatagggcagggcctgggagtctcagataccctcggtaacagaggagaaccgagatgatctgagacaacctggcggcagcgcaaaagatg

SEQ ID NO: 115397 - DNA, 103 bp, Artificial Sequence
  Synthetic Polynucleotide
taatacgactcactatagggcaggaccaaccagggcctgggagtctcagaaacagaggagatctgagatgcccaggcccaacctggcggcagcgcaaaagatg

SEQ ID NO: 115398 - DNA, 103 bp, Artificial Sequence
  Synthetic Polynucleotide
taatacgactcactatagggggagaagaggcaggaccaaccagggcctggaacagaggagaccaggcatgggttggtccaacctggcggcagcgcaaaagatg

SEQ ID NO: 115399 - DNA, 103 bp, Artificial Sequence
  Synthetic Polynucleotide
taatacgactcactataggggccggagctgtcctctcagaggctcctggaaacagaggagatccaggatgctctgagagaacctggcggcagcgcaaaagatg

SEQ ID NO: 115400 - DNA, 103 bp, Artificial Sequence
  Synthetic Polynucleotide
taatacgactcactatagggacactatgaaggagaagaggcaggaccaacaacagaggagagttggtatggcctcttctaacctggcggcagcgcaaaagatg

SEQ ID NO: 115401 - DNA, 103 bp, Artificial Sequence
  Synthetic Polynucleotide
taatacgactcactatagggcaacactgggacactatgaaggagaagaggaacagaggagacctcttatgcttcatagtaacctggcggcagcgcaaaagatg

SEQ ID NO: 115402 - DNA, 103 bp, Artificial Sequence
  Synthetic Polynucleotide
taatacgactcactataggggccctcctgacaacactgggacactatgaaaacagaggagattcataatgtcccagtgtaacctggcggcagcgcaaaagatg

SEQ ID NO: 115403 - DNA, 103 bp, Artificial Sequence
  Synthetic Polynucleotide
taatacgactcactatagggtaccaccagcgccctcctgacaacactgggaacagaggagacccagtatggtcaggaggaacctggcggcagcgcaaaagatg

SEQ ID NO: 115404 - DNA, 103 bp, Artificial Sequence
  Synthetic Polynucleotide
taatacgactcactatagggaggtccaagctaccaccagcgccctcctgaaacagaggagatcaggaatgcgctggtggaacctggcggcagcgcaaaagatg

SEQ ID NO: 115405 - DNA, 103 bp, Artificial Sequence
  Synthetic Polynucleotide
taatacgactcactatagggttggcacacaaggtccaagctaccaccagcaacagaggagagctggtatgagcttggacaacctggcggcagcgcaaaagatg

SEQ ID NO: 115406 - DNA, 103 bp, Artificial Sequence
  Synthetic Polynucleotide
taatacgactcactatagggtgaggaagcgttggcacacaaggtccaagcaacagaggagagcttggatgttgtgtgccaacctggcggcagcgcaaaagatg

SEQ ID NO: 115407 - DNA, 103 bp, Artificial Sequence
  Synthetic Polynucleotide
taatacgactcactatagggggcccagacctgaggaagcgttggcacacaaacagaggagatgtgtgatgacgcttcctaacctggcggcagcgcaaaagatg

SEQ ID NO: 115408 - DNA, 103 bp, Artificial Sequence
  Synthetic Polynucleotide
taatacgactcactataggggaggctgttaggcccagacctgaggaagcgaacagaggagacgcttcatgaggtctgggaacctggcggcagcgcaaaagatg

SEQ ID NO: 115409 - DNA, 103 bp, Artificial Sequence
  Synthetic Polynucleotide
taatacgactcactatagggccaggcagtggaggctgttaggcccagaccaacagaggagaggtctgatgctaacagccaacctggcggcagcgcaaaagatg

SEQ ID NO: 115410 - DNA, 103 bp, Artificial Sequence
  Synthetic Polynucleotide
taatacgactcactataggggtgaagcagagccggagctgtcctctcagaaacagaggagatctgagatgacagctccgaacctggcggcagcgcaaaagatg

SEQ ID NO: 115411 - DNA, 103 bp, Artificial Sequence
  Synthetic Polynucleotide
taatacgactcactatagggctgagtgagcccaggcagtggaggctgttaaacagaggagataacagatgccactgcctaacctggcggcagcgcaaaagatg

SEQ ID NO: 115412 - DNA, 103 bp, Artificial Sequence
  Synthetic Polynucleotide
taatacgactcactataggggaggcgctccctgagtgagcccaggcagtgaacagaggagacactgcatgggctcactcaacctggcggcagcgcaaaagatg

SEQ ID NO: 115413 - DNA, 103 bp, Artificial Sequence
  Synthetic Polynucleotide
taatacgactcactatagggcccaaataatgaggcgctccctgagtgagcaacagaggagagctcacatggggagcgccaacctggcggcagcgcaaaagatg

SEQ ID NO: 115414 - DNA, 103 bp, Artificial Sequence
  Synthetic Polynucleotide
taatacgactcactatagggtccatggctgcccaaataatgaggcgctccaacagaggagaggagcgatgcattatttgaacctggcggcagcgcaaaagatg

SEQ ID NO: 115415 - DNA, 103 bp, Artificial Sequence
  Synthetic Polynucleotide
taatacgactcactatagggtgggatagaatccatggctgcccaaataataacagaggagaattattatggcagccatgaacctggcggcagcgcaaaagatg

SEQ ID NO: 115416 - DNA, 103 bp, Artificial Sequence
  Synthetic Polynucleotide
taatacgactcactatagggatgatggggctgggatagaatccatggctgaacagaggagacagccaatgattctatccaacctggcggcagcgcaaaagatg

SEQ ID NO: 115417 - DNA, 103 bp, Artificial Sequence
  Synthetic Polynucleotide
taatacgactcactatagggccctgaactgatgatggggctgggatagaaaacagaggagattctatatgagccccatcaacctggcggcagcgcaaaagatg

SEQ ID NO: 115418 - DNA, 103 bp, Artificial Sequence
  Synthetic Polynucleotide
taatacgactcactatagggcaggttgtgtccctgaactgatgatggggcaacagaggagagccccaatgtcagttcagaacctggcggcagcgcaaaagatg

SEQ ID NO: 115419 - DNA, 103 bp, Artificial Sequence
  Synthetic Polynucleotide
taatacgactcactatagggcatcttcagtcaggttgtgtccctgaactgaacagaggagacagttcatggacacaaccaacctggcggcagcgcaaaagatg

SEQ ID NO: 115420 - DNA, 103 bp, Artificial Sequence
  Synthetic Polynucleotide
taatacgactcactatagggggatgtctggcatcttcagtcaggttgtgtaacagaggagaacacaaatggactgaagaaacctggcggcagcgcaaaagatg

SEQ ID NO: 115421 - DNA, 103 bp, Artificial Sequence
  Synthetic Polynucleotide
taatacgactcactatagggggcagcttgcgtgaagcagagccggagctgaacagaggagacagctcatgctctgcttcaacctggcggcagcgcaaaagatg

SEQ ID NO: 115422 - DNA, 103 bp, Artificial Sequence
  Synthetic Polynucleotide
taatacgactcactatagggccaactctcaggatgtctggcatcttcagtaacagaggagaactgaaatggccagacataacctggcggcagcgcaaaagatg

SEQ ID NO: 115423 - DNA, 103 bp, Artificial Sequence
  Synthetic Polynucleotide
taatacgactcactatagggctgtgttctgccaactctcaggatgtctggaacagaggagaccagacatgctgagagttaacctggcggcagcgcaaaagatg

SEQ ID NO: 115424 - DNA, 103 bp, Artificial Sequence
  Synthetic Polynucleotide
taatacgactcactataggggaatagcctcctgtgttctgccaactctcaaacagaggagatgagagatggcagaacacaacctggcggcagcgcaaaagatg

SEQ ID NO: 115425 - DNA, 103 bp, Artificial Sequence
  Synthetic Polynucleotide
taatacgactcactatagggatctccttcagaatagcctcctgtgttctgaacagaggagacagaacatgggaggctataacctggcggcagcgcaaaagatg

SEQ ID NO: 115426 - DNA, 103 bp, Artificial Sequence
  Synthetic Polynucleotide
taatacgactcactataggggtgatactgcatctccttcagaatagcctcaacagaggagagaggctatgctgaaggagaacctggcggcagcgcaaaagatg

SEQ ID NO: 115427 - DNA, 103 bp, Artificial Sequence
  Synthetic Polynucleotide
taatacgactcactatagggatctgtggctgtgatactgcatctccttcaaacagaggagatgaaggatgtgcagtatcaacctggcggcagcgcaaaagatg

SEQ ID NO: 115428 - DNA, 103 bp, Artificial Sequence
  Synthetic Polynucleotide
taatacgactcactatagggctctagtgccatctgtggctgtgatactgcaacagaggagagcagtaatgcagccacagaacctggcggcagcgcaaaagatg

SEQ ID NO: 115429 - DNA, 103 bp, Artificial Sequence
  Synthetic Polynucleotide
taatacgactcactatagggctgacacctcctctagtgccatctgtggctaacagaggagaagccacatgtggcactagaacctggcggcagcgcaaaagatg

SEQ ID NO: 115430 - DNA, 103 bp, Artificial Sequence
  Synthetic Polynucleotide
taatacgactcactatagggggatctgacactgacacctcctctagtgccaacagaggagaggcactatgggaggtgtcaacctggcggcagcgcaaaagatg

SEQ ID NO: 115431 - DNA, 103 bp, Artificial Sequence
  Synthetic Polynucleotide
taatacgactcactataggggcttgccagtggatctgacactgacacctcaacagaggagagaggtgatggtgtcagataacctggcggcagcgcaaaagatg

SEQ ID NO: 115432 - DNA, 103 bp, Artificial Sequence
  Synthetic Polynucleotide
taatacgactcactatagggggctagtccgggcagcttgcgtgaagcagaaacagaggagatctgctatgcgcaagctgaacctggcggcagcgcaaaagatg

SEQ ID NO: 115433 - DNA, 103 bp, Artificial Sequence
  Synthetic Polynucleotide
taatacgactcactataggggtccttggttgcttgccagtggatctgacaaacagaggagatgtcagatgcactggcaaaacctggcggcagcgcaaaagatg

SEQ ID NO: 115434 - DNA, 103 bp, Artificial Sequence
  Synthetic Polynucleotide
taatacgactcactataggggggagtgactgtccttggttgcttgccagtaacagaggagaactggcatgcaaccaaggaacctggcggcagcgcaaaagatg

SEQ ID NO: 115435 - DNA, 103 bp, Artificial Sequence
  Synthetic Polynucleotide
taatacgactcactatagggtgaggatcctgggagtgactgtccttggttaacagaggagaaaccaaatgcagtcactcaacctggcggcagcgcaaaagatg

SEQ ID NO: 115436 - DNA, 103 bp, Artificial Sequence
  Synthetic Polynucleotide
taatacgactcactatagggtgtgctcccttgaggatcctgggagtgactaacagaggagaagtcacatgcaggatcctaacctggcggcagcgcaaaagatg

SEQ ID NO: 115437 - DNA, 103 bp, Artificial Sequence
  Synthetic Polynucleotide
taatacgactcactatagggcactgtgccatgtgctcccttgaggatcctaacagaggagaaggatcatgaagggagcaaacctggcggcagcgcaaaagatg

SEQ ID NO: 115438 - DNA, 103 bp, Artificial Sequence
  Synthetic Polynucleotide
taatacgactcactatagggtctcacttcccactgtgccatgtgctccctaacagaggagaagggagatgatggcacagaacctggcggcagcgcaaaagatg

SEQ ID NO: 115439 - DNA, 103 bp, Artificial Sequence
  Synthetic Polynucleotide
taatacgactcactataggggggtctggcttctcacttcccactgtgccaaacagaggagatggcacatggggaagtgaaacctggcggcagcgcaaaagatg

SEQ ID NO: 115440 - DNA, 103 bp, Artificial Sequence
  Synthetic Polynucleotide
taatacgactcactatagggtttggaacatgggtctggcttctcacttccaacagaggagaggaagtatgaagccagacaacctggcggcagcgcaaaagatg

SEQ ID NO: 115441 - DNA, 103 bp, Artificial Sequence
  Synthetic Polynucleotide
taatacgactcactatagggaggttctctgtttggaacatgggtctggctaacagaggagaagccagatgcatgttccaaacctggcggcagcgcaaaagatg

SEQ ID NO: 115442 - DNA, 103 bp, Artificial Sequence
  Synthetic Polynucleotide
taatacgactcactataggggtgcctgaacaggttctctgtttggaacataacagaggagaatgttcatgacagagaacaacctggcggcagcgcaaaagatg

SEQ ID NO: 115443 - DNA, 103 bp, Artificial Sequence
  Synthetic Polynucleotide
taatacgactcactatagggagcagtaagaggctagtccgggcagcttgcaacagaggagagcaagcatgccggactagaacctggcggcagcgcaaaagatg

SEQ ID NO: 115444 - DNA, 103 bp, Artificial Sequence
  Synthetic Polynucleotide
taatacgactcactataggggaggaaggcagtgcctgaacaggttctctgaacagaggagacagagaatgtgttcaggcaacctggcggcagcgcaaaagatg

SEQ ID NO: 115445 - DNA, 103 bp, Artificial Sequence
  Synthetic Polynucleotide
taatacgactcactatagggccggctggcagaggaaggcagtgcctgaacaacagaggagagttcagatgctgccttccaacctggcggcagcgcaaaagatg

SEQ ID NO: 115446 - DNA, 103 bp, Artificial Sequence
  Synthetic Polynucleotide
taatacgactcactatagggccagacgtttccggctggcagaggaaggcaaacagaggagatgccttatgctgccagccaacctggcggcagcgcaaaagatg

SEQ ID NO: 115447 - DNA, 103 bp, Artificial Sequence
  Synthetic Polynucleotide
taatacgactcactatagggcgtttcttgtccagacgtttccggctggcaaacagaggagatgccagatggaaacgtctaacctggcggcagcgcaaaagatg

SEQ ID NO: 115448 - DNA, 103 bp, Artificial Sequence
  Synthetic Polynucleotide
taatacgactcactatagggaggcactgaacgtttcttgtccagacgtttaacagaggagaaaacgtatggacaagaaaaacctggcggcagcgcaaaagatg

SEQ ID NO: 115449 - DNA, 103 bp, Artificial Sequence
  Synthetic Polynucleotide
taatacgactcactatagggcagtggctacaggcactgaacgtttcttgtaacagaggagaacaagaatggttcagtgcaacctggcggcagcgcaaaagatg

SEQ ID NO: 115450 - DNA, 103 bp, Artificial Sequence
  Synthetic Polynucleotide
taatacgactcactatagggtccagttctacagtggctacaggcactgaaaacagaggagattcagtatgtgtagccacaacctggcggcagcgcaaaagatg

SEQ ID NO: 115451 - DNA, 103 bp, Artificial Sequence
  Synthetic Polynucleotide
taatacgactcactatagggcctcttttcttccagttctacagtggctacaacagaggagagtagccatggtagaactgaacctggcggcagcgcaaaagatg

SEQ ID NO: 115452 - DNA, 103 bp, Artificial Sequence
  Synthetic Polynucleotide
taatacgactcactataggggagttctgaacctcttttcttccagttctaaacagaggagatagaacatgaagaaaagaaacctggcggcagcgcaaaagatg

SEQ ID NO: 115453 - DNA, 103 bp, Artificial Sequence
  Synthetic Polynucleotide
taatacgactcactatagggactaaaggcagagttctgaacctcttttctaacagaggagaagaaaaatggttcagaacaacctggcggcagcgcaaaagatg

SEQ ID NO: 115454 - DNA, 103 bp, Artificial Sequence
  Synthetic Polynucleotide
taatacgactcactataggggttgagcctgagcagtaagaggctagtccgaacagaggagacggactatgctcttactgaacctggcggcagcgcaaaagatg

SEQ ID NO: 115455 - DNA, 103 bp, Artificial Sequence
  Synthetic Polynucleotide
taatacgactcactatagggggggcttggcactaaaggcagagttctgaaaacagaggagattcagaatgctgcctttaaacctggcggcagcgcaaaagatg

SEQ ID NO: 115456 - DNA, 103 bp, Artificial Sequence
  Synthetic Polynucleotide
taatacgactcactatagggggccttgtagggggcttggcactaaaggcaaacagaggagatgccttatgtgccaagccaacctggcggcagcgcaaaagatg

SEQ ID NO: 115457 - DNA, 103 bp, Artificial Sequence
  Synthetic Polynucleotide
taatacgactcactatagggtgattggtcaggccttgtagggggcttggcaacagaggagagccaagatgcctacaaggaacctggcggcagcgcaaaagatg

SEQ ID NO: 115458 - DNA, 103 bp, Artificial Sequence
  Synthetic Polynucleotide
taatacgactcactatagggttgtaaatcctgattggtcaggccttgtagaacagaggagactacaaatgctgaccaataacctggcggcagcgcaaaagatg

SEQ ID NO: 115459 - DNA, 103 bp, Artificial Sequence
  Synthetic Polynucleotide
taatacgactcactatagggcttctccctcttgtaaatcctgattggtcaaacagaggagatgaccaatgaggatttacaacctggcggcagcgcaaaagatg

SEQ ID NO: 115460 - DNA, 103 bp, Artificial Sequence
  Synthetic Polynucleotide
taatacgactcactatagggtgctcccaatcttctccctcttgtaaatccaacagaggagaggatttatgagagggagaaacctggcggcagcgcaaaagatg

SEQ ID NO: 115461 - DNA, 103 bp, Artificial Sequence
  Synthetic Polynucleotide
taatacgactcactatagggctcatcttcttgctcccaatcttctccctcaacagaggagagagggaatggattgggagaacctggcggcagcgcaaaagatg

SEQ ID NO: 115462 - DNA, 103 bp, Artificial Sequence
  Synthetic Polynucleotide
taatacgactcactatagggggtccatgtcctcatcttcttgctcccaataacagaggagaattgggatgaagaagatgaacctggcggcagcgcaaaagatg

SEQ ID NO: 115463 - DNA, 103 bp, Artificial Sequence
  Synthetic Polynucleotide
taatacgactcactatagggtctaatctggggtccatgtcctcatcttctaacagaggagaagaagaatgggacatggaaacctggcggcagcgcaaaagatg

SEQ ID NO: 115464 - DNA, 103 bp, Artificial Sequence
  Synthetic Polynucleotide
taatacgactcactatagggggaactgtgttctaatctggggtccatgtcaacagaggagagacatgatgcccagattaaacctggcggcagcgcaaaagatg

SEQ ID NO: 115465 - DNA, 103 bp, Artificial Sequence
  Synthetic Polynucleotide
taatacgactcactataggggggcagcgtcgttgagcctgagcagtaagaaacagaggagatcttacatgtcaggctcaaacctggcggcagcgcaaaagatg

SEQ ID NO: 115466 - DNA, 103 bp, Artificial Sequence
  Synthetic Polynucleotide
taatacgactcactatagggcttgaactgaggaactgtgttctaatctggaacagaggagaccagatatgaacacagttaacctggcggcagcgcaaaagatg

SEQ ID NO: 115467 - DNA, 103 bp, Artificial Sequence
  Synthetic Polynucleotide
taatacgactcactatagggtcagaatcttcttgaactgaggaactgtgtaacagaggagaacacagatgctcagttcaaacctggcggcagcgcaaaagatg

SEQ ID NO: 115468 - DNA, 103 bp, Artificial Sequence
  Synthetic Polynucleotide
taatacgactcactatagggacttggggattcagaatcttcttgaactgaaacagaggagatcagttatggaagattctaacctggcggcagcgcaaaagatg

SEQ ID NO: 115469 - DNA, 103 bp, Artificial Sequence
  Synthetic Polynucleotide
taatacgactcactatagggtatcttcaggacttggggattcagaatcttaacagaggagaaagattatgaatccccaaaacctggcggcagcgcaaaagatg

SEQ ID NO: 115470 - DNA, 103 bp, Artificial Sequence
  Synthetic Polynucleotide
taatacgactcactatagggtagtctggtatatcttcaggacttggggataacagaggagaatccccatgtcctgaagaaacctggcggcagcgcaaaagatg

SEQ ID NO: 115471 - DNA, 103 bp, Artificial Sequence
  Synthetic Polynucleotide
taatacgactcactatagggttgcaggaggtagtctggtatatcttcaggaacagaggagacctgaaatgataccagacaacctggcggcagcgcaaaagatg

SEQ ID NO: 115472 - DNA, 103 bp, Artificial Sequence
  Synthetic Polynucleotide
taatacgactcactatagggtggccctgtattgcaggaggtagtctggtaaacagaggagataccagatgacctcctgcaacctggcggcagcgcaaaagatg

SEQ ID NO: 115473 - DNA, 103 bp, Artificial Sequence
  Synthetic Polynucleotide
taatacgactcactataggggcactgtggatggccctgtattgcaggaggaacagaggagacctcctatgatacagggcaacctggcggcagcgcaaaagatg

SEQ ID NO: 115474 - DNA, 103 bp, Artificial Sequence
  Synthetic Polynucleotide
taatacgactcactatagggttgctgttctgcactgtggatggccctgtaaacagaggagatacaggatgatccacagtaacctggcggcagcgcaaaagatg

SEQ ID NO: 115475 - DNA, 103 bp, Artificial Sequence
  Synthetic Polynucleotide
taatacgactcactatagggcataggcatgttgctgttctgcactgtggaaacagaggagatccacaatgcagaacagcaacctggcggcagcgcaaaagatg

SEQ ID NO: 115476 - DNA, 103 bp, Artificial Sequence
  Synthetic Polynucleotide
taatacgactcactatagggagcgcccgcagggcagcgtcgttgagcctgaacagaggagacaggctatgcgacgctgcaacctggcggcagcgcaaaagatg

SEQ ID NO: 115477 - DNA, 103 bp, Artificial Sequence
  Synthetic Polynucleotide
taatacgactcactatagggaagtcctgctcataggcatgttgctgttctaacagaggagaagaacaatgacatgcctaaacctggcggcagcgcaaaagatg

SEQ ID NO: 115478 - DNA, 103 bp, Artificial Sequence
  Synthetic Polynucleotide
taatacgactcactatagggatctgtctcaaagtcctgctcataggcatgaacagaggagacatgccatggagcaggacaacctggcggcagcgcaaaagatg

SEQ ID NO: 115479 - DNA, 103 bp, Artificial Sequence
  Synthetic Polynucleotide
taatacgactcactatagggattcagcataatctgtctcaaagtcctgctaacagaggagaagcaggatgttgagacagaacctggcggcagcgcaaaagatg

SEQ ID NO: 115480 - DNA, 103 bp, Artificial Sequence
  Synthetic Polynucleotide
taatacgactcactatagggaggatgcggtattcagcataatctgtctcaaacagaggagatgagacatgttatgctgaaacctggcggcagcgcaaaagatg

SEQ ID NO: 115481 - DNA, 103 bp, Artificial Sequence
  Synthetic Polynucleotide
taatacgactcactatagggacgggcatgcaggatgcggtattcagcataaacagaggagatatgctatgtaccgcatcaacctggcggcagcgcaaaagatg

SEQ ID NO: 115482 - DNA, 103 bp, Artificial Sequence
  Synthetic Polynucleotide
taatacgactcactatagggcagtcccaacacgggcatgcaggatgcggtaacagaggagaaccgcaatgtgcatgcccaacctggcggcagcgcaaaagatg

SEQ ID NO: 115483 - DNA, 103 bp, Artificial Sequence
  Synthetic Polynucleotide
taatacgactcactatagggctttggcttgcagtcccaacacgggcatgcaacagaggagagcatgcatgtgttgggacaacctggcggcagcgcaaaagatg

SEQ ID NO: 115484 - DNA, 103 bp, Artificial Sequence
  Synthetic Polynucleotide
taatacgactcactatagggctctatgaacctttggcttgcagtcccaacaacagaggagagttgggatggcaagccaaaacctggcggcagcgcaaaagatg

SEQ ID NO: 115485 - DNA, 103 bp, Artificial Sequence
  Synthetic Polynucleotide
taatacgactcactatagggctgctcccagctctatgaacctttggcttgaacagaggagacaagccatgggttcatagaacctggcggcagcgcaaaagatg

SEQ ID NO: 115486 - DNA, 103 bp, Artificial Sequence
  Synthetic Polynucleotide
taatacgactcactatagggcttttaatctctgctcccagctctatgaacaacagaggagagttcatatggctgggagcaacctggcggcagcgcaaaagatg

SEQ ID NO: 115487 - DNA, 103 bp, Artificial Sequence
  Synthetic Polynucleotide
taatacgactcactatagggctgagccttgggctgggcctggaggttcataacagaggagaatgaacatgcaggcccagaacctggcggcagcgcaaaagatg

SEQ ID NO: 115488 - DNA, 103 bp, Artificial Sequence
  Synthetic Polynucleotide
taatacgactcactatagggtctgatggactgctgggggggctgcaggggaacagaggagacccctgatgcccccccagaacctggcggcagcgcaaaagatg

SEQ ID NO: 115489 - DNA, 103 bp, Artificial Sequence
  Synthetic Polynucleotide
taatacgactcactataggggatctggacctgaggtagcgctggctgcggaacagaggagaccgcagatggcgctacctaacctggcggcagcgcaaaagatg

SEQ ID NO: 115490 - DNA, 103 bp, Artificial Sequence
  Synthetic Polynucleotide
taatacgactcactataggggggggaaggggatctggacctgaggtagcgaacagaggagacgctacatgaggtccagaaacctggcggcagcgcaaaagatg

SEQ ID NO: 115491 - DNA, 103 bp, Artificial Sequence
  Synthetic Polynucleotide
taatacgactcactatagggcgggagcggcgggggaaggggatctggaccaacagaggagaggtccaatgccccttcccaacctggcggcagcgcaaaagatg

SEQ ID NO: 115492 - DNA, 103 bp, Artificial Sequence
  Synthetic Polynucleotide
taatacgactcactatagggagagaggcggcgggagcggcgggggaagggaacagaggagacccttcatgcgccgctccaacctggcggcagcgcaaaagatg

SEQ ID NO: 115493 - DNA, 103 bp, Artificial Sequence
  Synthetic Polynucleotide
taatacgactcactatagggtaccctccttagagaggcggcgggagcggcaacagaggagagccgctatggccgcctctaacctggcggcagcgcaaaagatg

SEQ ID NO: 115494 - DNA, 103 bp, Artificial Sequence
  Synthetic Polynucleotide
taatacgactcactatagggggaggcaggataccctccttagagaggcggaacagaggagaccgcctatgtaaggagggaacctggcggcagcgcaaaagatg

SEQ ID NO: 115495 - DNA, 103 bp, Artificial Sequence
  Synthetic Polynucleotide
taatacgactcactatagggcagggcgctgggaggcaggataccctccttaacagaggagaaaggagatgatcctgcctaacctggcggcagcgcaaaagatg

SEQ ID NO: 115496 - DNA, 103 bp, Artificial Sequence
  Synthetic Polynucleotide
taatacgactcactatagggcagccccatccagggcgctgggaggcaggaaacagaggagatcctgcatgccagcgcccaacctggcggcagcgcaaaagatg

SEQ ID NO: 115497 - DNA, 103 bp, Artificial Sequence
  Synthetic Polynucleotide
taatacgactcactatagggggctgggtgccagccccatccagggcgctgaacagaggagacagcgcatgggatggggcaacctggcggcagcgcaaaagatg

SEQ ID NO: 115498 - DNA, 103 bp, Artificial Sequence
  Synthetic Polynucleotide
taatacgactcactatagggctcctgcccaggctgggtgccagccccatcaacagaggagagatgggatgggcacccagaacctggcggcagcgcaaaagatg

SEQ ID NO: 115499 - DNA, 103 bp, Artificial Sequence
  Synthetic Polynucleotide
taatacgactcactatagggcctccttcactctgatggactgctggggggaacagaggagaccccccatgagtccatcaaacctggcggcagcgcaaaagatg

SEQ ID NO: 115500 - DNA, 103 bp, Artificial Sequence
  Synthetic Polynucleotide
taatacgactcactatagggtgccagtggcctcctgcccaggctgggtgcaacagaggagagcacccatgctgggcaggaacctggcggcagcgcaaaagatg

SEQ ID NO: 115501 - DNA, 103 bp, Artificial Sequence
  Synthetic Polynucleotide
taatacgactcactatagggaggaacaggttgccagtggcctcctgcccaaacagaggagatgggcaatgggccactggaacctggcggcagcgcaaaagatg

SEQ ID NO: 115502 - DNA, 103 bp, Artificial Sequence
  Synthetic Polynucleotide
taatacgactcactatagggccagtgatgtaggaacaggttgccagtggcaacagaggagagccactatgaacctgttcaacctggcggcagcgcaaaagatg

SEQ ID NO: 115503 - DNA, 103 bp, Artificial Sequence
  Synthetic Polynucleotide
taatacgactcactataggggctgcaggggccagtgatgtaggaacaggtaacagaggagaacctgtatgtacatcactaacctggcggcagcgcaaaagatg

SEQ ID NO: 115504 - DNA, 103 bp, Artificial Sequence
  Synthetic Polynucleotide
taatacgactcactatagggggtggcggctgctgcaggggccagtgatgtaacagaggagaacatcaatggcccctgcaaacctggcggcagcgcaaaagatg

SEQ ID NO: 115505 - DNA, 103 bp, Artificial Sequence
  Synthetic Polynucleotide
taatacgactcactatagggcagggagccaggtggcggctgctgcaggggaacagaggagacccctgatgcagccgccaaacctggcggcagcgcaaaagatg

SEQ ID NO: 115506 - DNA, 103 bp, Artificial Sequence
  Synthetic Polynucleotide
taatacgactcactatagggggggctgccccagggagccaggtggcggctaacagaggagaagccgcatgctggctcccaacctggcggcagcgcaaaagatg

SEQ ID NO: 115507 - DNA, 103 bp, Artificial Sequence
  Synthetic Polynucleotide
taatacgactcactataggggcttcaggatggggctgccccagggagccaaacagaggagatggctcatgggggcagccaacctggcggcagcgcaaaagatg

SEQ ID NO: 115508 - DNA, 103 bp, Artificial Sequence
  Synthetic Polynucleotide
taatacgactcactataggggaatcccagagcttcaggatggggctgcccaacagaggagagggcagatgcatcctgaaaacctggcggcagcgcaaaagatg

SEQ ID NO: 115509 - DNA, 103 bp, Artificial Sequence
  Synthetic Polynucleotide
taatacgactcactataggggctccagcgggaatcccagagcttcaggataacagaggagaatcctgatgctctgggataacctggcggcagcgcaaaagatg

SEQ ID NO: 115510 - DNA, 103 bp, Artificial Sequence
  Synthetic Polynucleotide
taatacgactcactatagggaggtactgctcctccttcactctgatggacaacagaggagagtccatatgagtgaaggaaacctggcggcagcgcaaaagatg

SEQ ID NO: 115511 - DNA, 103 bp, Artificial Sequence
  Synthetic Polynucleotide
taatacgactcactataggggactccctcagctccagcgggaatcccagaaacagaggagatctgggatgcccgctggaaacctggcggcagcgcaaaagatg

SEQ ID NO: 115512 - DNA, 103 bp, Artificial Sequence
  Synthetic Polynucleotide
taatacgactcactatagggcagtagctgcgactccctcagctccagcggaacagaggagaccgctgatgctgagggagaacctggcggcagcgcaaaagatg

SEQ ID NO: 115513 - DNA, 103 bp, Artificial Sequence
  Synthetic Polynucleotide
taatacgactcactatagggccccatcaggcagtagctgcgactccctcaaacagaggagatgagggatgcgcagctacaacctggcggcagcgcaaaagatg

SEQ ID NO: 115514 - DNA, 103 bp, Artificial Sequence
  Synthetic Polynucleotide
taatacgactcactataggggctagtctctccccatcaggcagtagctgcaacagaggagagcagctatggcctgatggaacctggcggcagcgcaaaagatg

SEQ ID NO: 115515 - DNA, 103 bp, Artificial Sequence
  Synthetic Polynucleotide
taatacgactcactataggggccattgggtgctagtctctccccatcaggaacagaggagacctgatatggagagactaaacctggcggcagcgcaaaagatg

SEQ ID NO: 115516 - DNA, 103 bp, Artificial Sequence
  Synthetic Polynucleotide
taatacgactcactatagggctcgctcccggccattgggtgctagtctctaacagaggagaagagacatgcacccaatgaacctggcggcagcgcaaaagatg

SEQ ID NO: 115517 - DNA, 103 bp, Artificial Sequence
  Synthetic Polynucleotide
taatacgactcactataggggcaggagcctctcgctcccggccattgggtaacagaggagaacccaaatgccgggagcgaacctggcggcagcgcaaaagatg

SEQ ID NO: 115518 - DNA, 103 bp, Artificial Sequence
  Synthetic Polynucleotide
taatacgactcactataggggctgcccatggcaggagcctctcgctcccgaacagaggagacgggagatggaggctcctaacctggcggcagcgcaaaagatg

SEQ ID NO: 115519 - DNA, 103 bp, Artificial Sequence
  Synthetic Polynucleotide
taatacgactcactatagggtgccctcctcgctgcccatggcaggagcctaacagaggagaaggctcatgccatgggcaaacctggcggcagcgcaaaagatg

SEQ ID NO: 115520 - DNA, 103 bp, Artificial Sequence
  Synthetic Polynucleotide
taatacgactcactatagggactgccctcatgccctcctcgctgcccatgaacagaggagacatgggatgcgaggagggaacctggcggcagcgcaaaagatg

SEQ ID NO: 115521 - DNA, 103 bp, Artificial Sequence
  Synthetic Polynucleotide
taatacgactcactatagggctcgtgcccgaggtactgctcctccttcacaacagaggagagtgaagatggagcagtacaacctggcggcagcgcaaaagatg

SEQ ID NO: 115522 - DNA, 103 bp, Artificial Sequence
  Synthetic Polynucleotide
taatacgactcactatagggccctgtgctcactgccctcatgccctcctcaacagaggagagaggagatgatgagggcaaacctggcggcagcgcaaaagatg

SEQ ID NO: 115523 - DNA, 103 bp, Artificial Sequence
  Synthetic Polynucleotide
taatacgactcactataggggcccacagtcccctgtgctcactgccctcaaacagaggagatgagggatgtgagcacagaacctggcggcagcgcaaaagatg

SEQ ID NO: 115524 - DNA, 103 bp, Artificial Sequence
  Synthetic Polynucleotide
taatacgactcactatagggcgtagcacctgcccacagtcccctgtgctcaacagaggagagagcacatgggactgtggaacctggcggcagcgcaaaagatg

SEQ ID NO: 115525 - DNA, 103 bp, Artificial Sequence
  Synthetic Polynucleotide
taatacgactcactatagggcactccgccccgtagcacctgcccacagtcaacagaggagagactgtatgcaggtgctaaacctggcggcagcgcaaaagatg

SEQ ID NO: 115526 - DNA, 103 bp, Artificial Sequence
  Synthetic Polynucleotide
taatacgactcactatagggtgctctggatcactccgccccgtagcacctaacagaggagaaggtgcatgggggcggagaacctggcggcagcgcaaaagatg

SEQ ID NO: 115527 - DNA, 103 bp, Artificial Sequence
  Synthetic Polynucleotide
taatacgactcactatagggctccgtcgcgtgctctggatcactccgcccaacagaggagagggcggatggatccagagaacctggcggcagcgcaaaagatg

SEQ ID NO: 115528 - DNA, 103 bp, Artificial Sequence
  Synthetic Polynucleotide
taatacgactcactatagggtgcccggcgcctccgtcgcgtgctctggataacagaggagaatccagatgacgcgacggaacctggcggcagcgcaaaagatg

SEQ ID NO: 115529 - DNA, 103 bp, Artificial Sequence
  Synthetic Polynucleotide
taatacgactcactatagggcctcctgggatgcccggcgcctccgtcgcgaacagaggagacgcgacatgggcgccgggaacctggcggcagcgcaaaagatg

SEQ ID NO: 115530 - DNA, 103 bp, Artificial Sequence
  Synthetic Polynucleotide
taatacgactcactatagggagcaaattggcctcctgggatgcccggcgcaacagaggagagcgccgatgatcccaggaaacctggcggcagcgcaaaagatg

SEQ ID NO: 115531 - DNA, 103 bp, Artificial Sequence
  Synthetic Polynucleotide
taatacgactcactatagggggccagggtcagcaaattggcctcctgggaaacagaggagatcccagatggccaatttgaacctggcggcagcgcaaaagatg

SEQ ID NO: 115532 - DNA, 103 bp, Artificial Sequence
  Synthetic Polynucleotide
taatacgactcactatagggctcctggaccctcgtgcccgaggtactgctaacagaggagaagcagtatgtcgggcacgaacctggcggcagcgcaaaagatg

SEQ ID NO: 115533 - DNA, 103 bp, Artificial Sequence
  Synthetic Polynucleotide
taatacgactcactatagggcagccttctgggccagggtcagcaaattggaacagaggagaccaattatgtgaccctggaacctggcggcagcgcaaaagatg

SEQ ID NO: 115534 - DNA, 103 bp, Artificial Sequence
  Synthetic Polynucleotide
taatacgactcactataggggccagctccacagccttctgggccagggtcaacagaggagagaccctatgccagaaggcaacctggcggcagcgcaaaagatg

SEQ ID NO: 115535 - DNA, 103 bp, Artificial Sequence
  Synthetic Polynucleotide
taatacgactcactatagggctgcagtgaggccagctccacagccttctgaacagaggagacagaagatggtggagctgaacctggcggcagcgcaaaagatg

SEQ ID NO: 115536 - DNA, 103 bp, Artificial Sequence
  Synthetic Polynucleotide
taatacgactcactatagggcctttgcattctgcagtgaggccagctccaaacagaggagatggagcatgcctcactgcaacctggcggcagcgcaaaagatg

SEQ ID NO: 115537 - DNA, 103 bp, Artificial Sequence
  Synthetic Polynucleotide
taatacgactcactatagggccactgccatcctttgcattctgcagtgagaacagaggagactcactatggaatgcaaaaacctggcggcagcgcaaaagatg

SEQ ID NO: 115538 - DNA, 103 bp, Artificial Sequence
  Synthetic Polynucleotide
taatacgactcactatagggctcttcagaaccactgccatcctttgcattaacagaggagaaatgcaatggatggcagtaacctggcggcagcgcaaaagatg

SEQ ID NO: 115539 - DNA, 103 bp, Artificial Sequence
  Synthetic Polynucleotide
taatacgactcactatagggttttccgcttctcttcagaaccactgccataacagaggagaatggcaatggttctgaagaacctggcggcagcgcaaaagatg

SEQ ID NO: 115540 - DNA, 103 bp, Artificial Sequence
  Synthetic Polynucleotide
taatacgactcactataggggccaatacacttttccgcttctcttcagaaaacagaggagattctgaatggaagcggaaaacctggcggcagcgcaaaagatg

SEQ ID NO: 115541 - DNA, 103 bp, Artificial Sequence
  Synthetic Polynucleotide
taatacgactcactatagggggtagttgaggccaatacacttttccgcttaacagaggagaaagcggatgagtgtattgaacctggcggcagcgcaaaagatg

SEQ ID NO: 115542 - DNA, 103 bp, Artificial Sequence
  Synthetic Polynucleotide
taatacgactcactatagggccccacacttggtagttgaggccaatacacaacagaggagagtgtatatgcctcaactaaacctggcggcagcgcaaaagatg

SEQ ID NO: 115543 - DNA, 103 bp, Artificial Sequence
  Synthetic Polynucleotide
taatacgactcactataggggagactgcccctcctggaccctcgtgcccgaacagaggagacgggcaatggggtccaggaacctggcggcagcgcaaaagatg

SEQ ID NO: 115544 - DNA, 103 bp, Artificial Sequence
  Synthetic Polynucleotide
taatacgactcactataggggaaaactccaccccacacttggtagttgagaacagaggagactcaacatgcaagtgtggaacctggcggcagcgcaaaagatg

SEQ ID NO: 115545 - DNA, 103 bp, Artificial Sequence
  Synthetic Polynucleotide
taatacgactcactatagggggaaggctcagaaaactccaccccacacttaacagaggagaaagtgtatggtggagtttaacctggcggcagcgcaaaagatg

SEQ ID NO: 115546 - DNA, 103 bp, Artificial Sequence
  Synthetic Polynucleotide
taatacgactcactatagggtggtggctaaggaaggctcagaaaactccaaacagaggagatggagtatgctgagccttaacctggcggcagcgcaaaagatg

SEQ ID NO: 115547 - DNA, 103 bp, Artificial Sequence
  Synthetic Polynucleotide
taatacgactcactatagggcgtgctcgcttggtggctaaggaaggctcaaacagaggagatgagccatgcttagccacaacctggcggcagcgcaaaagatg

SEQ ID NO: 115548 - DNA, 103 bp, Artificial Sequence
  Synthetic Polynucleotide
taatacgactcactatagggactgtcttctcgtgctcgcttggtggctaaaacagaggagattagccatgaagcgagcaaacctggcggcagcgcaaaagatg

SEQ ID NO: 115549 - DNA, 103 bp, Artificial Sequence
  Synthetic Polynucleotide
taatacgactcactataggggtaccatcccactgtcttctcgtgctcgctaacagaggagaagcgagatggagaagacaaacctggcggcagcgcaaaagatg

SEQ ID NO: 115550 - DNA, 103 bp, Artificial Sequence
  Synthetic Polynucleotide
taatacgactcactatagggatgatgaggggtaccatcccactgtcttctaacagaggagaagaagaatgtgggatggtaacctggcggcagcgcaaaagatg

SEQ ID NO: 115551 - DNA, 103 bp, Artificial Sequence
  Synthetic Polynucleotide
taatacgactcactatagggagacactgggatgatgaggggtaccatcccaacagaggagagggatgatgcccctcatcaacctggcggcagcgcaaaagatg

SEQ ID NO: 115552 - DNA, 103 bp, Artificial Sequence
  Synthetic Polynucleotide
taatacgactcactataggggcacaggcacagacactgggatgatgagggaacagaggagaccctcaatgtcccagtgtaacctggcggcagcgcaaaagatg

SEQ ID NO: 115553 - DNA, 103 bp, Artificial Sequence
  Synthetic Polynucleotide
taatacgactcactatagggtccacagttcgcacaggcacagacactgggaacagaggagacccagtatgtgtgcctgtaacctggcggcagcgcaaaagatg

SEQ ID NO: 115554 - DNA, 103 bp, Artificial Sequence
  Synthetic Polynucleotide
taatacgactcactatagggctgagaggtggagactgcccctcctggaccaacagaggagaggtccaatgggggcagtcaacctggcggcagcgcaaaagatg

SEQ ID NO: 115555 - DNA, 103 bp, Artificial Sequence
  Synthetic Polynucleotide
taatacgactcactatagggctcagttgggtccacagttcgcacaggcacaacagaggagagtgcctatgcgaactgtgaacctggcggcagcgcaaaagatg

SEQ ID NO: 115556 - DNA, 103 bp, Artificial Sequence
  Synthetic Polynucleotide
taatacgactcactatagggcctgggctgcctcagttgggtccacagttcaacagaggagagaactgatgacccaactgaacctggcggcagcgcaaaagatg

SEQ ID NO: 115557 - DNA, 103 bp, Artificial Sequence
  Synthetic Polynucleotide
taatacgactcactatagggagacctccagcctgggctgcctcagttgggaacagaggagacccaacatgggcagcccaaacctggcggcagcgcaaaagatg

SEQ ID NO: 115558 - DNA, 103 bp, Artificial Sequence
  Synthetic Polynucleotide
taatacgactcactataggggtcctcatcaagacctccagcctgggctgcaacagaggagagcagccatggctggaggtaacctggcggcagcgcaaaagatg

SEQ ID NO: 115559 - DNA, 103 bp, Artificial Sequence
  Synthetic Polynucleotide
taatacgactcactataggggacccttcccgtcctcatcaagacctccagaacagaggagactggagatgttgatgaggaacctggcggcagcgcaaaagatg

SEQ ID NO: 115560 - DNA, 103 bp, Artificial Sequence
  Synthetic Polynucleotide
taatacgactcactatagggttctgttcaggacccttcccgtcctcatcaaacagaggagatgatgaatgcgggaagggaacctggcggcagcgcaaaagatg

SEQ ID NO: 115561 - DNA, 103 bp, Artificial Sequence
  Synthetic Polynucleotide
taatacgactcactatagggctcagcagggttctgttcaggacccttcccaacagaggagagggaagatgcctgaacagaacctggcggcagcgcaaaagatg

SEQ ID NO: 115562 - DNA, 103 bp, Artificial Sequence
  Synthetic Polynucleotide
taatacgactcactatagggatggcttgtgctcagcagggttctgttcagaacagaggagactgaacatgaccctgctgaacctggcggcagcgcaaaagatg

SEQ ID NO: 115563 - DNA, 103 bp, Artificial Sequence
  Synthetic Polynucleotide
taatacgactcactatagggacgatgactgatggcttgtgctcagcagggaacagaggagaccctgcatggcacaagccaacctggcggcagcgcaaaagatg

SEQ ID NO: 115564 - DNA, 103 bp, Artificial Sequence
  Synthetic Polynucleotide
taatacgactcactatagggcctgcgggtgacgatgactgatggcttgtgaacagaggagacacaagatgtcagtcatcaacctggcggcagcgcaaaagatg

SEQ ID NO: 115565 - DNA, 103 bp, Artificial Sequence
  Synthetic Polynucleotide
taatacgactcactataggggttccacaggctgagaggtggagactgcccaacagaggagagggcagatgccacctctcaacctggcggcagcgcaaaagatg

SEQ ID NO: 115566 - DNA, 103 bp, Artificial Sequence
  Synthetic Polynucleotide
taatacgactcactataggggggtggaccgcctgcgggtgacgatgactgaacagaggagacagtcaatgtcacccgcaaacctggcggcagcgcaaaagatg

SEQ ID NO: 115567 - DNA, 103 bp, Artificial Sequence
  Synthetic Polynucleotide
taatacgactcactatagggccggggattcgggtggaccgcctgcgggtgaacagaggagacacccgatggcggtccacaacctggcggcagcgcaaaagatg

SEQ ID NO: 115568 - DNA, 103 bp, Artificial Sequence
  Synthetic Polynucleotide
taatacgactcactatagggagcatctgtcccggggattcgggtggaccgaacagaggagacggtccatgcgaatccccaacctggcggcagcgcaaaagatg

SEQ ID NO: 115569 - DNA, 103 bp, Artificial Sequence
  Synthetic Polynucleotide
taatacgactcactatagggcctgagcttgagcatctgtcccggggattcaacagaggagagaatccatgggacagatgaacctggcggcagcgcaaaagatg

SEQ ID NO: 115570 - DNA, 103 bp, Artificial Sequence
  Synthetic Polynucleotide
taatacgactcactatagggatgtcctctgcctgagcttgagcatctgtcaacagaggagagacagaatgtcaagctcaaacctggcggcagcgcaaaagatg

SEQ ID NO: 115571 - DNA, 103 bp, Artificial Sequence
  Synthetic Polynucleotide
taatacgactcactatagggcttgacattcatgtcctctgcctgagcttgaacagaggagacaagctatggcagaggacaacctggcggcagcgcaaaagatg

SEQ ID NO: 115572 - DNA, 103 bp, Artificial Sequence
  Synthetic Polynucleotide
taatacgactcactatagggccccctccaacttgacattcatgtcctctgaacagaggagacagaggatgtgaatgtcaaacctggcggcagcgcaaaagatg

SEQ ID NO: 115573 - DNA, 103 bp, Artificial Sequence
  Synthetic Polynucleotide
taatacgactcactatagggacggaaggctccccctccaacttgacattcaacagaggagagaatgtatggttggagggaacctggcggcagcgcaaaagatg

SEQ ID NO: 115574 - DNA, 103 bp, Artificial Sequence
  Synthetic Polynucleotide
taatacgactcactatagggtggtttccgcacggaaggctccccctccaaaacagaggagattggagatggagccttccaacctggcggcagcgcaaaagatg

SEQ ID NO: 115575 - DNA, 103 bp, Artificial Sequence
  Synthetic Polynucleotide
taatacgactcactataggggccgctgctttggtttccgcacggaaggctaacagaggagaagccttatgtgcggaaacaacctggcggcagcgcaaaagatg

SEQ ID NO: 115576 - DNA, 103 bp, Artificial Sequence
  Synthetic Polynucleotide
taatacgactcactatagggggagggggcagttccacaggctgagaggtgaacagaggagacacctcatggcctgtggaaacctggcggcagcgcaaaagatg

SEQ ID NO: 115577 - DNA, 103 bp, Artificial Sequence
  Synthetic Polynucleotide
taatacgactcactatagggtcgggcctgggccgctgctttggtttccgcaacagaggagagcggaaatgaaagcagcgaacctggcggcagcgcaaaagatg

SEQ ID NO: 115578 - DNA, 103 bp, Artificial Sequence
  Synthetic Polynucleotide
taatacgactcactataggggatgaggggctcgggcctgggccgctgcttaacagaggagaaagcagatgcccaggcccaacctggcggcagcgcaaaagatg

SEQ ID NO: 115579 - DNA, 103 bp, Artificial Sequence
  Synthetic Polynucleotide
taatacgactcactatagggtggtggggatgatgaggggctcgggcctggaacagaggagaccaggcatgagcccctcaaacctggcggcagcgcaaaagatg

SEQ ID NO: 115580 - DNA, 103 bp, Artificial Sequence
  Synthetic Polynucleotide
taatacgactcactataggggtgcccgccttggtggggatgatgaggggcaacagaggagagcccctatgcatccccacaacctggcggcagcgcaaaagatg

SEQ ID NO: 115581 - DNA, 103 bp, Artificial Sequence
  Synthetic Polynucleotide
taatacgactcactatagggggcgatgaaagtgcccgccttggtggggataacagaggagaatccccatgaaggcgggcaacctggcggcagcgcaaaagatg

SEQ ID NO: 115582 - DNA, 103 bp, Artificial Sequence
  Synthetic Polynucleotide
taatacgactcactatagggagacgggaggggcgatgaaagtgcccgcctaacagaggagaaggcggatgctttcatcgaacctggcggcagcgcaaaagatg

SEQ ID NO: 115583 - DNA, 103 bp, Artificial Sequence
  Synthetic Polynucleotide
taatacgactcactatagggatgttggagtagacgggaggggcgatgaaaaacagaggagatttcatatgccctcccgtaacctggcggcagcgcaaaagatg

SEQ ID NO: 115584 - DNA, 103 bp, Artificial Sequence
  Synthetic Polynucleotide
taatacgactcactataggggtatggggtgatgttggagtagacgggaggaacagaggagacctcccatgtactccaacaacctggcggcagcgcaaaagatg

SEQ ID NO: 115585 - DNA, 103 bp, Artificial Sequence
  Synthetic Polynucleotide
taatacgactcactatagggggtggctctggtatggggtgatgttggagtaacagaggagaactccaatgtcaccccataacctggcggcagcgcaaaagatg

SEQ ID NO: 115586 - DNA, 103 bp, Artificial Sequence
  Synthetic Polynucleotide
taatacgactcactatagggggagagcgcaggtggctctggtatggggtgaacagaggagacaccccatgccagagccaaacctggcggcagcgcaaaagatg

SEQ ID NO: 115587 - DNA, 103 bp, Artificial Sequence
  Synthetic Polynucleotide
taatacgactcactatagggcaggctgctaggagggggcagttccacaggaacagaggagacctgtgatgctgccccctaacctggcggcagcgcaaaagatg

SEQ ID NO: 115588 - DNA, 103 bp, Artificial Sequence
  Synthetic Polynucleotide
taatacgactcactatagggtaggcgcacgggagagcgcaggtggctctgaacagaggagacagagcatgctgcgctctaacctggcggcagcgcaaaagatg

SEQ ID NO: 115589 - DNA, 103 bp, Artificial Sequence
  Synthetic Polynucleotide
taatacgactcactatagggggtggtcagctaggcgcacgggagagcgcaaacagaggagatgcgctatgccgtgcgccaacctggcggcagcgcaaaagatg

SEQ ID NO: 115590 - DNA, 103 bp, Artificial Sequence
  Synthetic Polynucleotide
taatacgactcactatagggcgctcagaggggtggtcagctaggcgcacgaacagaggagacgtgcgatgagctgaccaaacctggcggcagcgcaaaagatg

SEQ ID NO: 115591 - DNA, 103 bp, Artificial Sequence
  Synthetic Polynucleotide
taatacgactcactatagggctcaaagctccgctcagaggggtggtcagcaacagaggagagctgacatgccctctgagaacctggcggcagcgcaaaagatg

SEQ ID NO: 115592 - DNA, 103 bp, Artificial Sequence
  Synthetic Polynucleotide
taatacgactcactatagggagggaggtagctcaaagctccgctcagaggaacagaggagacctctgatgggagctttgaacctggcggcagcgcaaaagatg

SEQ ID NO: 115593 - DNA, 103 bp, Artificial Sequence
  Synthetic Polynucleotide
taatacgactcactatagggggcggcgtgtagggaggtagctcaaagctcaacagaggagagagcttatggctacctccaacctggcggcagcgcaaaagatg

SEQ ID NO: 115594 - DNA, 103 bp, Artificial Sequence
  Synthetic Polynucleotide
taatacgactcactataggggaggatggggggcggcgtgtagggaggtagaacagaggagactacctatgtacacgccgaacctggcggcagcgcaaaagatg

SEQ ID NO: 115595 - DNA, 103 bp, Artificial Sequence
  Synthetic Polynucleotide
taatacgactcactataggggcacagggctgaggatggggggcggcgtgtaacagaggagaacacgcatgcccccatccaacctggcggcagcgcaaaagatg

SEQ ID NO: 115596 - DNA, 103 bp, Artificial Sequence
  Synthetic Polynucleotide
taatacgactcactataggggagccttcccgcacagggctgaggatggggaacagaggagaccccatatgcagccctgtaacctggcggcagcgcaaaagatg

SEQ ID NO: 115597 - DNA, 103 bp, Artificial Sequence
  Synthetic Polynucleotide
taatacgactcactataggggtagaggccagagccttcccgcacagggctaacagaggagaagccctatgcgggaaggcaacctggcggcagcgcaaaagatg

SEQ ID NO: 115598 - DNA, 103 bp, Artificial Sequence
  Synthetic Polynucleotide
taatacgactcactatagggtccgcttgttctgagccttgggctgggcctaacagaggagaaggcccatgccaaggctcaacctggcggcagcgcaaaagatg

SEQ ID NO: 115599 - DNA, 103 bp, Artificial Sequence
  Synthetic Polynucleotide
taatacgactcactatagggtcagcagggccaggctgctaggagggggcaaacagaggagatgccccatgctagcagccaacctggcggcagcgcaaaagatg

SEQ ID NO: 115600 - DNA, 103 bp, Artificial Sequence
  Synthetic Polynucleotide
taatacgactcactatagggtggcattgaagtagaggccagagccttcccaacagaggagagggaagatgctggcctctaacctggcggcagcgcaaaagatg

SEQ ID NO: 115601 - DNA, 103 bp, Artificial Sequence
  Synthetic Polynucleotide
taatacgactcactataggggttgatatgatggcattgaagtagaggccaaacagaggagatggcctatgcttcaatgcaacctggcggcagcgcaaaagatg

SEQ ID NO: 115602 - DNA, 103 bp, Artificial Sequence
  Synthetic Polynucleotide
taatacgactcactataggggatggtgctggttgatatgatggcattgaaaacagaggagattcaatatgatcatatcaaacctggcggcagcgcaaaagatg

SEQ ID NO: 115603 - DNA, 103 bp, Artificial Sequence
  Synthetic Polynucleotide
taatacgactcactataggggaggggcagggatggtgctggttgatatgaaacagaggagatcatatatgccagcaccaaacctggcggcagcgcaaaagatg

SEQ ID NO: 115604 - DNA, 103 bp, Artificial Sequence
  Synthetic Polynucleotide
taatacgactcactataggggtgatgggaggaggggcagggatggtgctgaacagaggagacagcacatgccctgccccaacctggcggcagcgcaaaagatg

SEQ ID NO: 115605 - DNA, 103 bp, Artificial Sequence
  Synthetic Polynucleotide
taatacgactcactatagggactcttaggcgtgatgggaggaggggcaggaacagaggagacctgccatgcctcccatcaacctggcggcagcgcaaaagatg

SEQ ID NO: 115606 - DNA, 103 bp, Artificial Sequence
  Synthetic Polynucleotide
taatacgactcactatagggtgcgatgggcactcttaggcgtgatgggagaacagaggagactcccaatgcgcctaagaaacctggcggcagcgcaaaagatg

SEQ ID NO: 115607 - DNA, 103 bp, Artificial Sequence
  Synthetic Polynucleotide
taatacgactcactatagggcggagcagcgtgcgatgggcactcttaggcaacagaggagagcctaaatgtgcccatcgaacctggcggcagcgcaaaagatg

SEQ ID NO: 115608 - DNA, 103 bp, Artificial Sequence
  Synthetic Polynucleotide
taatacgactcactatagggactgttagtccggagcagcgtgcgatgggcaacagaggagagcccatatgacgctgctcaacctggcggcagcgcaaaagatg

SEQ ID NO: 115609 - DNA, 103 bp, Artificial Sequence
  Synthetic Polynucleotide
taatacgactcactatagggttacttcagcactgttagtccggagcagcgaacagaggagacgctgcatgggactaacaaacctggcggcagcgcaaaagatg

SEQ ID NO: 115610 - DNA, 103 bp, Artificial Sequence
  Synthetic Polynucleotide
taatacgactcactatagggaccacagagttcagcagggccaggctgctaaacagaggagatagcagatgggccctgctaacctggcggcagcgcaaaagatg

SEQ ID NO: 115611 - DNA, 103 bp, Artificial Sequence
  Synthetic Polynucleotide
taatacgactcactatagggacaggcggggttacttcagcactgttagtcaacagaggagagactaaatgtgctgaagtaacctggcggcagcgcaaaagatg

SEQ ID NO: 115612 - DNA, 103 bp, Artificial Sequence
  Synthetic Polynucleotide
taatacgactcactatagggcacagagaggacaggcggggttacttcagcaacagaggagagctgaaatgaccccgcctaacctggcggcagcgcaaaagatg

SEQ ID NO: 115613 - DNA, 103 bp, Artificial Sequence
  Synthetic Polynucleotide
taatacgactcactatagggcctcccccatcacagagaggacaggcggggaacagaggagaccccgcatgtcctctctgaacctggcggcagcgcaaaagatg

SEQ ID NO: 115614 - DNA, 103 bp, Artificial Sequence
  Synthetic Polynucleotide
taatacgactcactatagggactggggtggcctcccccatcacagagaggaacagaggagacctctcatggatgggggaaacctggcggcagcgcaaaagatg

SEQ ID NO: 115615 - DNA, 103 bp, Artificial Sequence
  Synthetic Polynucleotide
taatacgactcactatagggctcgatgctcactggggtggcctcccccataacagaggagaatggggatggccaccccaaacctggcggcagcgcaaaagatg

SEQ ID NO: 115616 - DNA, 103 bp, Artificial Sequence
  Synthetic Polynucleotide
taatacgactcactatagggtgatccgtggctcgatgctcactggggtggaacagaggagaccacccatgtgagcatcgaacctggcggcagcgcaaaagatg

SEQ ID NO: 115617 - DNA, 103 bp, Artificial Sequence
  Synthetic Polynucleotide
taatacgactcactataggggagcccacgttgatccgtggctcgatgctcaacagaggagagagcatatggccacggataacctggcggcagcgcaaaagatg

SEQ ID NO: 115618 - DNA, 103 bp, Artificial Sequence
  Synthetic Polynucleotide
taatacgactcactatagggctggaaccgggagcccacgttgatccgtggaacagaggagaccacggatgaacgtgggcaacctggcggcagcgcaaaagatg

SEQ ID NO: 115619 - DNA, 103 bp, Artificial Sequence
  Synthetic Polynucleotide
taatacgactcactatagggggatttctgcctggaaccgggagcccacgtaacagaggagaacgtggatgcccggttccaacctggcggcagcgcaaaagatg

SEQ ID NO: 115620 - DNA, 103 bp, Artificial Sequence
  Synthetic Polynucleotide
taatacgactcactatagggctcatcaaggggatttctgcctggaaccggaacagaggagaccggttatgggcagaaataacctggcggcagcgcaaaagatg

SEQ ID NO: 115621 - DNA, 103 bp, Artificial Sequence
  Synthetic Polynucleotide
taatacgactcactatagggaggcccatataccacagagttcagcagggcaacagaggagagccctgatgaactctgtgaacctggcggcagcgcaaaagatg

SEQ ID NO: 115622 - DNA, 103 bp, Artificial Sequence
  Synthetic Polynucleotide
taatacgactcactatagggggcacggtccctcatcaaggggatttctgcaacagaggagagcagaaatgcccttgatgaacctggcggcagcgcaaaagatg

SEQ ID NO: 115623 - DNA, 103 bp, Artificial Sequence
  Synthetic Polynucleotide
taatacgactcactatagggcagctgccagggcacggtccctcatcaaggaacagaggagaccttgaatggggaccgtgaacctggcggcagcgcaaaagatg

SEQ ID NO: 115624 - DNA, 103 bp, Artificial Sequence
  Synthetic Polynucleotide
taatacgactcactatagggtggggatctgcagctgccagggcacggtccaacagaggagaggaccgatgcctggcagcaacctggcggcagcgcaaaagatg

SEQ ID NO: 115625 - DNA, 103 bp, Artificial Sequence
  Synthetic Polynucleotide
taatacgactcactataggggtcagccttgtggggatctgcagctgccagaacagaggagactggcaatggcagatcccaacctggcggcagcgcaaaagatg

SEQ ID NO: 115626 - DNA, 103 bp, Artificial Sequence
  Synthetic Polynucleotide
taatacgactcactataggggccacaccaagtcagccttgtggggatctgaacagaggagacagatcatgacaaggctgaacctggcggcagcgcaaaagatg

SEQ ID NO: 115627 - DNA, 103 bp, Artificial Sequence
  Synthetic Polynucleotide
taatacgactcactatagggtcccatggctgccacaccaagtcagccttgaacagaggagacaaggcatgcttggtgtgaacctggcggcagcgcaaaagatg

SEQ ID NO: 115628 - DNA, 103 bp, Artificial Sequence
  Synthetic Polynucleotide
taatacgactcactatagggctctaggtcctcccatggctgccacaccaaaacagaggagattggtgatgcagccatggaacctggcggcagcgcaaaagatg

SEQ ID NO: 115629 - DNA, 103 bp, Artificial Sequence
  Synthetic Polynucleotide
taatacgactcactatagggcccggctgctctctaggtcctcccatggctaacagaggagaagccatatgaggacctagaacctggcggcagcgcaaaagatg

SEQ ID NO: 115630 - DNA, 103 bp, Artificial Sequence
  Synthetic Polynucleotide
taatacgactcactatagggctctgcttctcccggctgctctctaggtccaacagaggagaggacctatggagcagccgaacctggcggcagcgcaaaagatg

SEQ ID NO: 115631 - DNA, 103 bp, Artificial Sequence
  Synthetic Polynucleotide
taatacgactcactatagggttccacttgcctctgcttctcccggctgctaacagaggagaagcagcatggagaagcagaacctggcggcagcgcaaaagatg

SEQ ID NO: 115632 - DNA, 103 bp, Artificial Sequence
  Synthetic Polynucleotide
taatacgactcactatagggaggtccgctcaggcccatataccacagagtaacagaggagaactctgatgtatatgggcaacctggcggcagcgcaaaagatg

SEQ ID NO: 115633 - DNA, 103 bp, Artificial Sequence
  Synthetic Polynucleotide
taatacgactcactatagggtcagcaggtcttccacttgcctctgcttctaacagaggagaagaagcatgggcaagtggaacctggcggcagcgcaaaagatg

SEQ ID NO: 115634 - DNA, 103 bp, Artificial Sequence
  Synthetic Polynucleotide
taatacgactcactatagggcaggcggctgtcagcaggtcttccacttgcaacagaggagagcaagtatgagacctgctaacctggcggcagcgcaaaagatg

SEQ ID NO: 115635 - DNA, 103 bp, Artificial Sequence
  Synthetic Polynucleotide
taatacgactcactatagggaatgctggagcaggcggctgtcagcaggtcaacagaggagagacctgatgacagccgccaacctggcggcagcgcaaaagatg

SEQ ID NO: 115636 - DNA, 103 bp, Artificial Sequence
  Synthetic Polynucleotide
taatacgactcactatagggcaccagggaaaatgctggagcaggcggctgaacagaggagacagccgatggctccagcaaacctggcggcagcgcaaaagatg

SEQ ID NO: 115637 - DNA, 103 bp, Artificial Sequence
  Synthetic Polynucleotide
taatacgactcactatagggttggtgccagcaccagggaaaatgctggagaacagaggagactccagatgtttccctggaacctggcggcagcgcaaaagatg

SEQ ID NO: 115638 - DNA, 103 bp, Artificial Sequence
  Synthetic Polynucleotide
taatacgactcactatagggcagctcctggttggtgccagcaccagggaaaacagaggagattccctatggctggcaccaacctggcggcagcgcaaaagatg

SEQ ID NO: 115639 - DNA, 103 bp, Artificial Sequence
  Synthetic Polynucleotide
taatacgactcactatagggagtgcagggccagctcctggttggtgccagaacagaggagactggcaatgaccaggagcaacctggcggcagcgcaaaagatg

SEQ ID NO: 115640 - DNA, 103 bp, Artificial Sequence
  Synthetic Polynucleotide
taatacgactcactatagggtcgtgcagacagtgcagggccagctcctggaacagaggagaccaggaatgggccctgcaaacctggcggcagcgcaaaagatg

SEQ ID NO: 115641 - DNA, 103 bp, Artificial Sequence
  Synthetic Polynucleotide
taatacgactcactatagggtcctctggattcgtgcagacagtgcagggcaacagaggagagccctgatgtgtctgcacaacctggcggcagcgcaaaagatg

SEQ ID NO: 115642 - DNA, 103 bp, Artificial Sequence
  Synthetic Polynucleotide
taatacgactcactatagggccaggatgtctcctctggattcgtgcagacaacagaggagagtctgcatgaatccagagaacctggcggcagcgcaaaagatg

SEQ ID NO: 115643 - DNA, 103 bp, Artificial Sequence
  Synthetic Polynucleotide
taatacgactcactatagggatggctgctgaggtccgctcaggcccatataacagaggagaatatggatgtgagcggacaacctggcggcagcgcaaaagatg

SEQ ID NO: 115644 - DNA, 103 bp, Artificial Sequence
  Synthetic Polynucleotide
taatacgactcactatagggttcagcgtttccaggatgtctcctctggataacagaggagaatccagatgagacatcctaacctggcggcagcgcaaaagatg

SEQ ID NO: 115645 - DNA, 103 bp, Artificial Sequence
  Synthetic Polynucleotide
taatacgactcactatagggcagcagcttattcagcgtttccaggatgtcaacagaggagagacatcatggaaacgctgaacctggcggcagcgcaaaagatg

SEQ ID NO: 115646 - DNA, 103 bp, Artificial Sequence
  Synthetic Polynucleotide
taatacgactcactataggggcttcttcagcagcagcttattcagcgtttaacagaggagaaaacgcatgataagctgcaacctggcggcagcgcaaaagatg

SEQ ID NO: 115647 - DNA, 103 bp, Artificial Sequence
  Synthetic Polynucleotide
taatacgactcactatagggggccgcaggggcttcttcagcagcagcttaaacagaggagataagctatggctgaagaaaacctggcggcagcgcaaaagatg

SEQ ID NO: 115648 - DNA, 103 bp, Artificial Sequence
  Synthetic Polynucleotide
taatacgactcactatagggatggttgtggggccgcaggggcttcttcagaacagaggagactgaagatgcccctgcggaacctggcggcagcgcaaaagatg

SEQ ID NO: 115649 - DNA, 103 bp, Artificial Sequence
  Synthetic Polynucleotide
taatacgactcactatagggttgccagcggatggttgtggggccgcagggaacagaggagaccctgcatgcccacaaccaacctggcggcagcgcaaaagatg

SEQ ID NO: 115650 - DNA, 103 bp, Artificial Sequence
  Synthetic Polynucleotide
taatacgactcactatagggtagtgataagttgccagcggatggttgtggaacagaggagaccacaaatgtccgctggcaacctggcggcagcgcaaaagatg

SEQ ID NO: 115651 - DNA, 103 bp, Artificial Sequence
  Synthetic Polynucleotide
taatacgactcactatagggagagcctgtgtagtgataagttgccagcggaacagaggagaccgctgatgacttatcacaacctggcggcagcgcaaaagatg

SEQ ID NO: 115652 - DNA, 103 bp, Artificial Sequence
  Synthetic Polynucleotide
taatacgactcactatagggtccactggtcagagcctgtgtagtgataagaacagaggagacttatcatgacacaggctaacctggcggcagcgcaaaagatg

SEQ ID NO: 115653 - DNA, 103 bp, Artificial Sequence
  Synthetic Polynucleotide
taatacgactcactatagggtcggccatcttccactggtcagagcctgtgaacagaggagacacaggatgtgaccagtgaacctggcggcagcgcaaaagatg

SEQ ID NO: 115654 - DNA, 103 bp, Artificial Sequence
  Synthetic Polynucleotide
taatacgactcactatagggctgggacagcatggctgctgaggtccgctcaacagaggagagagcggatgtcagcagccaacctggcggcagcgcaaaagatg

SEQ ID NO: 115655 - DNA, 103 bp, Artificial Sequence
  Synthetic Polynucleotide
taatacgactcactatagggcagcttcctctcggccatcttccactggtcaacagaggagagaccagatgaagatggccaacctggcggcagcgcaaaagatg

SEQ ID NO: 115656 - DNA, 103 bp, Artificial Sequence
  Synthetic Polynucleotide
taatacgactcactatagggctttgttgaacagcttcctctcggccatctaacagaggagaagatggatgagaggaagcaacctggcggcagcgcaaaagatg

SEQ ID NO: 115657 - DNA, 103 bp, Artificial Sequence
  Synthetic Polynucleotide
taatacgactcactatagggatggcaatgcctttgttgaacagcttcctcaacagaggagagaggaaatggttcaacaaaacctggcggcagcgcaaaagatg

SEQ ID NO: 115658 - DNA, 103 bp, Artificial Sequence
  Synthetic Polynucleotide
taatacgactcactatagggcttcttgtagatggcaatgcctttgttgaaaacagaggagattcaacatgggcattgccaacctggcggcagcgcaaaagatg

SEQ ID NO: 115659 - DNA, 103 bp, Artificial Sequence
  Synthetic Polynucleotide
taatacgactcactatagggggaagaaatccttcttgtagatggcaatgcaacagaggagagcattgatgtctacaagaaacctggcggcagcgcaaaagatg

SEQ ID NO: 115660 - DNA, 103 bp, Artificial Sequence
  Synthetic Polynucleotide
taatacgactcactatagggttctgcaccaggaagaaatccttcttgtagaacagaggagactacaaatgggatttcttaacctggcggcagcgcaaaagatg

SEQ ID NO: 115661 - DNA, 103 bp, Artificial Sequence
  Synthetic Polynucleotide
taatacgactcactatagggctggatcagcttctgcaccaggaagaaatcaacagaggagagatttcatgctggtgcagaacctggcggcagcgcaaaagatg

SEQ ID NO: 115662 - DNA, 103 bp, Artificial Sequence
  Synthetic Polynucleotide
taatacgactcactatagggcggtcttggtctggatcagcttctgcaccaaacagaggagatggtgcatgagctgatccaacctggcggcagcgcaaaagatg

SEQ ID NO: 115663 - DNA, 103 bp, Artificial Sequence
  Synthetic Polynucleotide
taatacgactcactatagggcactgggccacggtcttggtctggatcagcaacagaggagagctgatatggaccaagacaacctggcggcagcgcaaaagatg

SEQ ID NO: 115664 - DNA, 103 bp, Artificial Sequence
  Synthetic Polynucleotide
taatacgactcactataggggaactccacgcactgggccacggtcttggtaacagaggagaaccaagatggtggcccagaacctggcggcagcgcaaaagatg

SEQ ID NO: 115665 - DNA, 103 bp, Artificial Sequence
  Synthetic Polynucleotide
taatacgactcactatagggaggccacctgctgggacagcatggctgctgaacagaggagacagcagatgtgctgtcccaacctggcggcagcgcaaaagatg

SEQ ID NO: 115666 - DNA, 103 bp, Artificial Sequence
  Synthetic Polynucleotide
taatacgactcactatagggaggtgtagtagaactccacgcactgggccaaacagaggagatggcccatggcgtggagtaacctggcggcagcgcaaaagatg

SEQ ID NO: 115667 - DNA, 103 bp, Artificial Sequence
  Synthetic Polynucleotide
taatacgactcactatagggtgcttcttgtaggtgtagtagaactccacgaacagaggagacgtggaatgctactacacaacctggcggcagcgcaaaagatg

SEQ ID NO: 115668 - DNA, 103 bp, Artificial Sequence
  Synthetic Polynucleotide
taatacgactcactataggggattttcacctgcttcttgtaggtgtagtaaacagaggagatactacatgtacaagaagaacctggcggcagcgcaaaagatg

SEQ ID NO: 115669 - DNA, 103 bp, Artificial Sequence
  Synthetic Polynucleotide
taatacgactcactatagggcattgcggccgattttcacctgcttcttgtaacagaggagaacaagaatgaggtgaaaaaacctggcggcagcgcaaaagatg

SEQ ID NO: 115670 - DNA, 103 bp, Artificial Sequence
  Synthetic Polynucleotide
taatacgactcactataggggttagagtcccattgcggccgattttcaccaacagaggagaggtgaaatgcggccgcaaaacctggcggcagcgcaaaagatg

SEQ ID NO: 115671 - DNA, 103 bp, Artificial Sequence
  Synthetic Polynucleotide
taatacgactcactatagggatccccaaaggttagagtcccattgcggccaacagaggagaggccgcatggggactctaaacctggcggcagcgcaaaagatg

SEQ ID NO: 115672 - DNA, 103 bp, Artificial Sequence
  Synthetic Polynucleotide
taatacgactcactatagggtcgtatccacatccccaaaggttagagtccaacagaggagaggactcatgcctttggggaacctggcggcagcgcaaaagatg

SEQ ID NO: 115673 - DNA, 103 bp, Artificial Sequence
  Synthetic Polynucleotide
taatacgactcactatagggttctcatcgctcgtatccacatccccaaagaacagaggagactttggatgtgtggatacaacctggcggcagcgcaaaagatg

SEQ ID NO: 115674 - DNA, 103 bp, Artificial Sequence
  Synthetic Polynucleotide
taatacgactcactatagggctgggccgacttctcatcgctcgtatccacaacagaggagagtggatatgagcgatgagaacctggcggcagcgcaaaagatg

SEQ ID NO: 115675 - DNA, 103 bp, Artificial Sequence
  Synthetic Polynucleotide
taatacgactcactatagggcaacctcttcctgggccgacttctcatcgcaacagaggagagcgatgatgagtcggcccaacctggcggcagcgcaaaagatg

SEQ ID NO: 115676 - DNA, 103 bp, Artificial Sequence
  Synthetic Polynucleotide
taatacgactcactatagggcactttactgaggccacctgctgggacagcaacagaggagagctgtcatggcaggtggcaacctggcggcagcgcaaaagatg

SEQ ID NO: 115677 - DNA, 103 bp, Artificial Sequence
  Synthetic Polynucleotide
taatacgactcactatagggatatccacttcaacctcttcctgggccgacaacagaggagagtcggcatgggaagaggtaacctggcggcagcgcaaaagatg

SEQ ID NO: 115678 - DNA, 103 bp, Artificial Sequence
  Synthetic Polynucleotide
taatacgactcactatagggggaagtcttaatatccacttcaacctcttcaacagaggagagaagagatggaagtggataacctggcggcagcgcaaaagatg

SEQ ID NO: 115679 - DNA, 103 bp, Artificial Sequence
  Synthetic Polynucleotide
taatacgactcactatagggggaacttttgggaagtcttaatatccacttaacagaggagaaagtggatgttaagacttaacctggcggcagcgcaaaagatg

SEQ ID NO: 115680 - DNA, 103 bp, Artificial Sequence
  Synthetic Polynucleotide
taatacgactcactatagggggcacccttgggaacttttgggaagtcttaaacagaggagataagacatgccaaaagttaacctggcggcagcgcaaaagatg

SEQ ID NO: 115681 - DNA, 103 bp, Artificial Sequence
  Synthetic Polynucleotide
taatacgactcactatagggtctgggaagaggcacccttgggaacttttgaacagaggagacaaaagatgccaagggtgaacctggcggcagcgcaaaagatg

SEQ ID NO: 115682 - DNA, 103 bp, Artificial Sequence
  Synthetic Polynucleotide
taatacgactcactataggggggactctcttctgggaagaggcacccttgaacagaggagacaagggatgctcttcccaaacctggcggcagcgcaaaagatg

SEQ ID NO: 115683 - DNA, 103 bp, Artificial Sequence
  Synthetic Polynucleotide
taatacgactcactatagggtcttcacttggggactctcttctgggaagaaacagaggagatcttccatgaagagagtcaacctggcggcagcgcaaaagatg

SEQ ID NO: 115684 - DNA, 103 bp, Artificial Sequence
  Synthetic Polynucleotide
taatacgactcactatagggctccagcctctcttcacttggggactctctaacagaggagaagagagatgccaagtgaaaacctggcggcagcgcaaaagatg

SEQ ID NO: 115685 - DNA, 103 bp, Artificial Sequence
  Synthetic Polynucleotide
taatacgactcactatagggccctcttgggctccagcctctcttcacttgaacagaggagacaagtgatgagaggctggaacctggcggcagcgcaaaagatg

SEQ ID NO: 115686 - DNA, 103 bp, Artificial Sequence
  Synthetic Polynucleotide
taatacgactcactatagggtccttcacctccctcttgggctccagcctcaacagaggagagaggctatggcccaagagaacctggcggcagcgcaaaagatg

SEQ ID NO: 115687 - DNA, 103 bp, Artificial Sequence
  Synthetic Polynucleotide
taatacgactcactatagggagagttgggccactttactgaggccacctgaacagaggagacaggtgatgtcagtaaagaacctggcggcagcgcaaaagatg

SEQ ID NO: 115688 - DNA, 103 bp, Artificial Sequence
  Synthetic Polynucleotide
taatacgactcactatagggcttcctgggctccttcacctccctcttgggaacagaggagacccaagatggaggtgaagaacctggcggcagcgcaaaagatg

SEQ ID NO: 115689 - DNA, 103 bp, Artificial Sequence
  Synthetic Polynucleotide
taatacgactcactatagggcctccccctccttcctgggctccttcacctaacagaggagaaggtgaatgagcccaggaaacctggcggcagcgcaaaagatg

SEQ ID NO: 115690 - DNA, 103 bp, Artificial Sequence
  Synthetic Polynucleotide
taatacgactcactatagggggcacctcctcctccccctccttcctgggcaacagaggagagcccagatgggagggggaaacctggcggcagcgcaaaagatg

SEQ ID NO: 115691 - DNA, 103 bp, Artificial Sequence
  Synthetic Polynucleotide
taatacgactcactatagggttggatctctggcacctcctcctccccctcaacagaggagagaggggatggaggaggtgaacctggcggcagcgcaaaagatg

SEQ ID NO: 115692 - DNA, 103 bp, Artificial Sequence
  Synthetic Polynucleotide
taatacgactcactatagggcctccttctcttggatctctggcacctcctaacagaggagaaggaggatgcagagatccaacctggcggcagcgcaaaagatg

SEQ ID NO: 115693 - DNA, 103 bp, Artificial Sequence
  Synthetic Polynucleotide
taatacgactcactatagggtcttcctgctcctccttctcttggatctctaacagaggagaagagatatgagagaaggaaacctggcggcagcgcaaaagatg

SEQ ID NO: 115694 - DNA, 103 bp, Artificial Sequence
  Synthetic Polynucleotide
taatacgactcactatagggctctcgcccctcttcctgctcctccttctcaacagaggagagagaagatggagcaggaaaacctggcggcagcgcaaaagatg

SEQ ID NO: 115695 - DNA, 103 bp, Artificial Sequence
  Synthetic Polynucleotide
taatacgactcactataggggcctgctgcgctctcgcccctcttcctgctaacagaggagaagcaggatgaggggcgagaacctggcggcagcgcaaaagatg

SEQ ID NO: 115696 - DNA, 103 bp, Artificial Sequence
  Synthetic Polynucleotide
taatacgactcactataggggccgctgcccgcctgctgcgctctcgccccaacagaggagaggggcgatggcgcagcagaacctggcggcagcgcaaaagatg

SEQ ID NO: 115697 - DNA, 103 bp, Artificial Sequence
  Synthetic Polynucleotide
taatacgactcactatagggggctttgactgccgctgcccgcctgctgcgaacagaggagacgcagcatgcgggcagcgaacctggcggcagcgcaaaagatg

SEQ ID NO: 115698 - DNA, 103 bp, Artificial Sequence
  Synthetic Polynucleotide
taatacgactcactataggggagccatcacagagttgggccactttactgaacagaggagacagtaaatgggcccaactaacctggcggcagcgcaaaagatg

SEQ ID NO: 115699 - DNA, 103 bp, Artificial Sequence
  Synthetic Polynucleotide
taatacgactcactataggggtgtctgcgtggctttgactgccgctgcccaacagaggagagggcagatgcagtcaaagaacctggcggcagcgcaaaagatg

SEQ ID NO: 115700 - DNA, 103 bp, Artificial Sequence
  Synthetic Polynucleotide
taatacgactcactatagggttggcctgtagtgtctgcgtggctttgactaacagaggagaagtcaaatgcacgcagacaacctggcggcagcgcaaaagatg

SEQ ID NO: 115701 - DNA, 103 bp, Artificial Sequence
  Synthetic Polynucleotide
taatacgactcactatagggggccgactcattggcctgtagtgtctgcgtaacagaggagaacgcagatgctacaggccaacctggcggcagcgcaaaagatg

SEQ ID NO: 115702 - DNA, 103 bp, Artificial Sequence
  Synthetic Polynucleotide
taatacgactcactatagggggatgtcactggccgactcattggcctgtaaacagaggagatacaggatgatgagtcggaacctggcggcagcgcaaaagatg

SEQ ID NO: 115703 - DNA, 103 bp, Artificial Sequence
  Synthetic Polynucleotide
taatacgactcactatagggcggaggatgaggatgtcactggccgactcaaacagaggagatgagtcatgcagtgacataacctggcggcagcgcaaaagatg

SEQ ID NO: 115704 - DNA, 103 bp, Artificial Sequence
  Synthetic Polynucleotide
taatacgactcactatagggctcgtggctccggaggatgaggatgtcactaacagaggagaagtgacatgctcatcctcaacctggcggcagcgcaaaagatg

SEQ ID NO: 115705 - DNA, 103 bp, Artificial Sequence
  Synthetic Polynucleotide
taatacgactcactataggggggcgttggactcgtggctccggaggatgaaacagaggagatcatccatgggagccacgaacctggcggcagcgcaaaagatg

SEQ ID NO: 115706 - DNA, 103 bp, Artificial Sequence
  Synthetic Polynucleotide
taatacgactcactataggggcagacccaggggcgttggactcgtggctcaacagaggagagagccaatggtccaacgcaacctggcggcagcgcaaaagatg

SEQ ID NO: 115707 - DNA, 103 bp, Artificial Sequence
  Synthetic Polynucleotide
taatacgactcactatagggctggccaccggcagacccaggggcgttggaaacagaggagatccaacatgcctgggtctaacctggcggcagcgcaaaagatg

SEQ ID NO: 115708 - DNA, 103 bp, Artificial Sequence
  Synthetic Polynucleotide
taatacgactcactatagggtctccgaggcctggccaccggcagacccagaacagaggagactgggtatgccggtggccaacctggcggcagcgcaaaagatg

SEQ ID NO: 115709 - DNA, 103 bp, Artificial Sequence
  Synthetic Polynucleotide
taatacgactcactatagggaggcaacgcttccgcttgttctgagccttgaacagaggagacaaggcatggaacaagcgaacctggcggcagcgcaaaagatg

SEQ ID NO: 115710 - DNA, 103 bp, Artificial Sequence
  Synthetic Polynucleotide
taatacgactcactatagggccccgccctggagccatcacagagttgggcaacagaggagagcccaaatgtgtgatggcaacctggcggcagcgcaaaagatg

SEQ ID NO: 115711 - DNA, 103 bp, Artificial Sequence
  Synthetic Polynucleotide
taatacgactcactatagggtcccttggcttctccgaggcctggccaccgaacagaggagacggtggatgggcctcggaaacctggcggcagcgcaaaagatg

SEQ ID NO: 115712 - DNA, 103 bp, Artificial Sequence
  Synthetic Polynucleotide
taatacgactcactatagggccctgtcccttcccttggcttctccgaggcaacagaggagagcctcgatgaagccaaggaacctggcggcagcgcaaaagatg

SEQ ID NO: 115713 - DNA, 103 bp, Artificial Sequence
  Synthetic Polynucleotide
taatacgactcactatagggttcgtgacttccctgtcccttcccttggctaacagaggagaagccaaatgaagggacagaacctggcggcagcgcaaaagatg

SEQ ID NO: 115714 - DNA, 103 bp, Artificial Sequence
  Synthetic Polynucleotide
taatacgactcactatagggggtagtgcccttcgtgacttccctgtccctaacagaggagaagggacatggaagtcacgaacctggcggcagcgcaaaagatg

SEQ ID NO: 115715 - DNA, 103 bp, Artificial Sequence
  Synthetic Polynucleotide
taatacgactcactatagggctctgaaaaaggtagtgcccttcgtgacttaacagaggagaaagtcaatgagggcactaaacctggcggcagcgcaaaagatg

SEQ ID NO: 115716 - DNA, 103 bp, Artificial Sequence
  Synthetic Polynucleotide
taatacgactcactatagggttttcttcttctctgaaaaaggtagtgcccaacagaggagagggcacatgctttttcagaacctggcggcagcgcaaaagatg

SEQ ID NO: 115717 - DNA, 103 bp, Artificial Sequence
  Synthetic Polynucleotide
taatacgactcactataggggtctctgtttttttcttcttctctgaaaaaaacagaggagatttttcatggaagaagaaaacctggcggcagcgcaaaagatg

SEQ ID NO: 115718 - DNA, 103 bp, Artificial Sequence
  Synthetic Polynucleotide
taatacgactcactatagggcttactgaatgtctctgtttttttcttcttaacagaggagaaagaagatgaaaacagagaacctggcggcagcgcaaaagatg

SEQ ID NO: 115719 - DNA, 103 bp, Artificial Sequence
  Synthetic Polynucleotide
taatacgactcactataggggattctgggtcttactgaatgtctctgtttaacagaggagaaaacagatgcattcagtaaacctggcggcagcgcaaaagatg

SEQ ID NO: 115720 - DNA, 103 bp, Artificial Sequence
  Synthetic Polynucleotide
taatacgactcactataggggtgttctcctgattctgggtcttactgaataacagaggagaattcagatggacccagaaaacctggcggcagcgcaaaagatg

SEQ ID NO: 115721 - DNA, 103 bp, Artificial Sequence
  Synthetic Polynucleotide
taatacgactcactatagggacgctccgggccccgccctggagccatcacaacagaggagagtgatgatgccagggcggaacctggcggcagcgcaaaagatg

SEQ ID NO: 115722 - DNA, 103 bp, Artificial Sequence
  Synthetic Polynucleotide
taatacgactcactatagggacaggggaaagtgttctcctgattctgggtaacagaggagaacccagatgcaggagaacaacctggcggcagcgcaaaagatg

SEQ ID NO: 115723 - DNA, 103 bp, Artificial Sequence
  Synthetic Polynucleotide
taatacgactcactatagggcacattttttacaggggaaagtgttctcctaacagaggagaaggagaatgctttcccctaacctggcggcagcgcaaaagatg

SEQ ID NO: 115724 - DNA, 103 bp, Artificial Sequence
  Synthetic Polynucleotide
taatacgactcactatagggcacctcctccacgctccgggccccgccctgaacagaggagacagggcatggcccggagcaacctggcggcagcgcaaaagatg

SEQ ID NO: 115725 - DNA, 103 bp, Artificial Sequence
  Synthetic Polynucleotide
taatacgactcactatagggctgacacccccacctcctccacgctccgggaacagaggagacccggaatgtggaggaggaacctggcggcagcgcaaaagatg

SEQ ID NO: 115726 - DNA, 103 bp, Artificial Sequence
  Synthetic Polynucleotide
taatacgactcactataggggctgctgtcactgacacccccacctcctccaacagaggagaggaggaatggggggtgtcaacctggcggcagcgcaaaagatg

SEQ ID NO: 115727 - DNA, 103 bp, Artificial Sequence
  Synthetic Polynucleotide
taatacgactcactataggggctgctgccagctgctgtcactgacaccccaacagaggagaggggtgatggtgacagcaaacctggcggcagcgcaaaagatg

SEQ ID NO: 115728 - DNA, 103 bp, Artificial Sequence
  Synthetic Polynucleotide
taatacgactcactatagggtggcctggctgctgctgccagctgctgtcaaacagaggagatgacagatgctggcagcaaacctggcggcagcgcaaaagatg

SEQ ID NO: 115729 - DNA, 103 bp, Artificial Sequence
  Synthetic Polynucleotide
taatacgactcactataggggggtggaggctggcctggctgctgctgccaaacagaggagatggcagatgcagccaggcaacctggcggcagcgcaaaagatg

SEQ ID NO: 115730 - DNA, 103 bp, Artificial Sequence
  Synthetic Polynucleotide
taatacgactcactatagggatgttgaatggggtggaggctggcctggctaacagaggagaagccagatgagcctccacaacctggcggcagcgcaaaagatg

SEQ ID NO: 115731 - DNA, 103 bp, Artificial Sequence
  Synthetic Polynucleotide
taatacgactcactatagggtggcagttccatgttgaatggggtggaggcaacagaggagagcctccatgccattcaacaacctggcggcagcgcaaaagatg

SEQ ID NO: 115732 - DNA, 103 bp, Artificial Sequence
  Synthetic Polynucleotide
taatacgactcactataggggcccccgaagaggcaacgcttccgcttgttaacagaggagaaacaagatgaagcgttgcaacctggcggcagcgcaaaagatg

SEQ ID NO: 115733 - DNA, 103 bp, Artificial Sequence
  Synthetic Polynucleotide
taatacgactcactatagggggacagactgtggcagttccatgttgaatgaacagaggagacattcaatgtggaactgcaacctggcggcagcgcaaaagatg

SEQ ID NO: 115734 - DNA, 103 bp, Artificial Sequence
  Synthetic Polynucleotide
taatacgactcactatagggcactgtagagggacagactgtggcagttccaacagaggagaggaactatgacagtctgtaacctggcggcagcgcaaaagatg

SEQ ID NO: 115735 - DNA, 103 bp, Artificial Sequence
  Synthetic Polynucleotide
taatacgactcactatagggcccttggttgcactgtagagggacagactgaacagaggagacagtctatgcctctacagaacctggcggcagcgcaaaagatg

SEQ ID NO: 115736 - DNA, 103 bp, Artificial Sequence
  Synthetic Polynucleotide
taatacgactcactatagggatgcgggctccccttggttgcactgtagagaacagaggagactctacatggcaaccaagaacctggcggcagcgcaaaagatg

SEQ ID NO: 115737 - DNA, 103 bp, Artificial Sequence
  Synthetic Polynucleotide
taatacgactcactatagggccactccaggatgcgggctccccttggttgaacagaggagacaaccaatgggagcccgcaacctggcggcagcgcaaaagatg

SEQ ID NO: 115738 - DNA, 103 bp, Artificial Sequence
  Synthetic Polynucleotide
taatacgactcactataggggtcgggactcccactccaggatgcgggctcaacagaggagagagcccatgtcctggagtaacctggcggcagcgcaaaagatg

SEQ ID NO: 115739 - DNA, 103 bp, Artificial Sequence
  Synthetic Polynucleotide
taatacgactcactataggggttatagtaagtcgggactcccactccaggaacagaggagacctggaatgggagtcccgaacctggcggcagcgcaaaagatg

SEQ ID NO: 115740 - DNA, 103 bp, Artificial Sequence
  Synthetic Polynucleotide
taatacgactcactatagggcctcagggtggttatagtaagtcgggactcaacagaggagagagtccatgcttactataaacctggcggcagcgcaaaagatg

SEQ ID NO: 115741 - DNA, 103 bp, Artificial Sequence
  Synthetic Polynucleotide
taatacgactcactatagggcgcttcagtgcctcagggtggttatagtaaaacagaggagattactaatgccaccctgaaacctggcggcagcgcaaaagatg

SEQ ID NO: 115742 - DNA, 103 bp, Artificial Sequence
  Synthetic Polynucleotide
taatacgactcactatagggcgctttctcccgcttcagtgcctcagggtgaacagaggagacaccctatggcactgaagaacctggcggcagcgcaaaagatg

SEQ ID NO: 115743 - DNA, 103 bp, Artificial Sequence
  Synthetic Polynucleotide
taatacgactcactatagggctggttcctggcccccgaagaggcaacgctaacagaggagaagcgttatgtcttcggggaacctggcggcagcgcaaaagatg

SEQ ID NO: 115744 - DNA, 103 bp, Artificial Sequence
  Synthetic Polynucleotide
taatacgactcactataggggtgggccccccgctttctcccgcttcagtgaacagaggagacactgaatggggagaaagaacctggcggcagcgcaaaagatg

SEQ ID NO: 115745 - DNA, 103 bp, Artificial Sequence
  Synthetic Polynucleotide
taatacgactcactatagggcggtccagctgtgggccccccgctttctccaacagaggagaggagaaatgggggggcccaacctggcggcagcgcaaaagatg

SEQ ID NO: 115746 - DNA, 103 bp, Artificial Sequence
  Synthetic Polynucleotide
taatacgactcactatagggtcgcacatagcggtccagctgtgggcccccaacagaggagagggggcatgcagctggacaacctggcggcagcgcaaaagatg

SEQ ID NO: 115747 - DNA, 103 bp, Artificial Sequence
  Synthetic Polynucleotide
taatacgactcactataggggcatcattggtcgcacatagcggtccagctaacagaggagaagctggatggctatgtgcaacctggcggcagcgcaaaagatg

SEQ ID NO: 115748 - DNA, 103 bp, Artificial Sequence
  Synthetic Polynucleotide
taatacgactcactatagggaccttctgtggcatcattggtcgcacatagaacagaggagactatgtatgaccaatgataacctggcggcagcgcaaaagatg

SEQ ID NO: 115749 - DNA, 103 bp, Artificial Sequence
  Synthetic Polynucleotide
taatacgactcactatagggctccagctgcaccttctgtggcatcattggaacagaggagaccaatgatgccacagaagaacctggcggcagcgcaaaagatg

SEQ ID NO: 115750 - DNA, 103 bp, Artificial Sequence
  Synthetic Polynucleotide
taatacgactcactataggggccgccctacctccagctgcaccttctgtgaacagaggagacacagaatgtgcagctggaacctggcggcagcgcaaaagatg

SEQ ID NO: 115751 - DNA, 103 bp, Artificial Sequence
  Synthetic Polynucleotide
taatacgactcactatagggggtgcctggggccgccctacctccagctgcaacagaggagagcagctatgggtagggcgaacctggcggcagcgcaaaagatg

SEQ ID NO: 115752 - DNA, 103 bp, Artificial Sequence
  Synthetic Polynucleotide
taatacgactcactatagggagaattcaggggtgcctggggccgccctacaacagaggagagtagggatgccccaggcaaacctggcggcagcgcaaaagatg

SEQ ID NO: 115753 - DNA, 103 bp, Artificial Sequence
  Synthetic Polynucleotide
taatacgactcactatagggctgcgtggaaagaattcaggggtgcctgggaacagaggagacccaggatgccctgaattaacctggcggcagcgcaaaagatg

SEQ ID NO: 115754 - DNA, 103 bp, Artificial Sequence
  Synthetic Polynucleotide
taatacgactcactatagggtccttgggagctggttcctggcccccgaagaacagaggagacttcggatgccaggaaccaacctggcggcagcgcaaaagatg

SEQ ID NO: 115755 - DNA, 103 bp, Artificial Sequence
  Synthetic Polynucleotide
taatacgactcactatagggggtttcttggctgcgtggaaagaattcaggaacagaggagacctgaaatgtttccacgcaacctggcggcagcgcaaaagatg

SEQ ID NO: 115756 - DNA, 103 bp, Artificial Sequence
  Synthetic Polynucleotide
taatacgactcactatagggctggtttgggggtttcttggctgcgtggaaaacagaggagattccacatggccaagaaaaacctggcggcagcgcaaaagatg

SEQ ID NO: 115757 - DNA, 103 bp, Artificial Sequence
  Synthetic Polynucleotide
taatacgactcactatagggggggcagtgactggtttgggggtttcttggaacagaggagaccaagaatgccccaaaccaacctggcggcagcgcaaaagatg

SEQ ID NO: 115758 - DNA, 103 bp, Artificial Sequence
  Synthetic Polynucleotide
taatacgactcactatagggaagggttgcaggggcagtgactggtttgggaacagaggagacccaaaatggtcactgccaacctggcggcagcgcaaaagatg

SEQ ID NO: 115759 - DNA, 103 bp, Artificial Sequence
  Synthetic Polynucleotide
taatacgactcactatagggtgccagctggaagggttgcaggggcagtgaaacagaggagatcactgatgctgcaacccaacctggcggcagcgcaaaagatg

SEQ ID NO: 115760 - DNA, 103 bp, Artificial Sequence
  Synthetic Polynucleotide
taatacgactcactatagggggtggccgaatgccagctggaagggttgcaaacagaggagatgcaacatgtccagctggaacctggcggcagcgcaaaagatg

SEQ ID NO: 115761 - DNA, 103 bp, Artificial Sequence
  Synthetic Polynucleotide
taatacgactcactatagggcggttcacctggtggccgaatgccagctggaacagaggagaccagctatgattcggccaaacctggcggcagcgcaaaagatg

SEQ ID NO: 115762 - DNA, 103 bp, Artificial Sequence
  Synthetic Polynucleotide
taatacgactcactataggggaagacctgccggttcacctggtggccgaaaacagaggagattcggcatgcaggtgaacaacctggcggcagcgcaaaagatg

SEQ ID NO: 115763 - DNA, 103 bp, Artificial Sequence
  Synthetic Polynucleotide
taatacgactcactatagggggccctgccggaagacctgccggttcacctaacagaggagaaggtgaatgggcaggtctaacctggcggcagcgcaaaagatg

SEQ ID NO: 115764 - DNA, 103 bp, Artificial Sequence
  Synthetic Polynucleotide
taatacgactcactataggggggggcggtgggccctgccggaagacctgcaacagaggagagcaggtatgccggcagggaacctggcggcagcgcaaaagatg

SEQ ID NO: 115765 - DNA, 103 bp, Artificial Sequence
  Synthetic Polynucleotide
taatacgactcactatagggagggggctgctccttgggagctggttcctgaacagaggagacaggaaatggctcccaagaacctggcggcagcgcaaaagatg

SEQ ID NO: 115766 - DNA, 103 bp, Artificial Sequence
  Synthetic Polynucleotide
taatacgactcactatagggcaccgggtttgggggcggtgggccctgccgaacagaggagacggcagatgccaccgcccaacctggcggcagcgcaaaagatg

SEQ ID NO: 115767 - DNA, 103 bp, Artificial Sequence
  Synthetic Polynucleotide
taatacgactcactatagggggaaggcagccaccgggtttgggggcggtgaacagaggagacaccgcatgcaaacccggaacctggcggcagcgcaaaagatg

SEQ ID NO: 115768 - DNA, 103 bp, Artificial Sequence
  Synthetic Polynucleotide
taatacgactcactatagggttctgtggagggaaggcagccaccgggtttaacagaggagaaaacccatgggctgccttaacctggcggcagcgcaaaagatg

SEQ ID NO: 115769 - DNA, 103 bp, Artificial Sequence
  Synthetic Polynucleotide
taatacgactcactatagggctgctgctgcttctgtggagggaaggcagcaacagaggagagctgccatgcctccacagaacctggcggcagcgcaaaagatg

SEQ ID NO: 115770 - DNA, 103 bp, Artificial Sequence
  Synthetic Polynucleotide
taatacgactcactataggggttgctgctgctgctgctgcttctgtggagaacagaggagactccacatgagcagcagcaacctggcggcagcgcaaaagatg

SEQ ID NO: 115771 - DNA, 103 bp, Artificial Sequence
  Synthetic Polynucleotide
taatacgactcactatagggtgctgctgtggttgctgctgctgctgctgcaacagaggagagcagcaatggcagcagcaaacctggcggcagcgcaaaagatg

SEQ ID NO: 115772 - DNA, 103 bp, Artificial Sequence
  Synthetic Polynucleotide
taatacgactcactatagggctgctgctgctgctgctgtggttgctgctgaacagaggagacagcagatgccacagcagaacctggcggcagcgcaaaagatg

SEQ ID NO: 115773 - DNA, 103 bp, Artificial Sequence
  Synthetic Polynucleotide
taatacgactcactatagggctgcctgctgctgctgctgctgctgctgtgaacagaggagacacagcatgagcagcagcaacctggcggcagcgcaaaagatg

SEQ ID NO: 115774 - DNA, 103 bp, Artificial Sequence
  Synthetic Polynucleotide
taatacgactcactatagggtggggtagggctgcctgctgctgctgctgcaacagaggagagcagcaatggcagcaggcaacctggcggcagcgcaaaagatg

SEQ ID NO: 115775 - DNA, 103 bp, Artificial Sequence
  Synthetic Polynucleotide
taatacgactcactataggggagcggcatctggggtagggctgcctgctgaacagaggagacagcagatggccctacccaacctggcggcagcgcaaaagatg

SEQ ID NO: 115776 - DNA, 103 bp, Artificial Sequence
  Synthetic Polynucleotide
taatacgactcactataggggctgcaggggagggggctgctccttgggagaacagaggagactcccaatgagcagccccaacctggcggcagcgcaaaagatg

SEQ ID NO: 115777 - DNA, 103 bp, Artificial Sequence
  Synthetic Polynucleotide
taatacgactcactatagggagttctcaaagagcggcatctggggtagggaacagaggagaccctacatgagatgccgcaacctggcggcagcgcaaaagatg

SEQ ID NO: 115778 - DNA, 103 bp, Artificial Sequence
  Synthetic Polynucleotide
taatacgactcactatagggatggaatagaagttctcaaagagcggcatcaacagaggagagatgccatgctttgagaaaacctggcggcagcgcaaaagatg

SEQ ID NO: 115779 - DNA, 103 bp, Artificial Sequence
  Synthetic Polynucleotide
taatacgactcactatagggttgctgcggcatggaatagaagttctcaaaaacagaggagatttgagatgttctattccaacctggcggcagcgcaaaagatg

SEQ ID NO: 115780 - DNA, 103 bp, Artificial Sequence
  Synthetic Polynucleotide
taatacgactcactataggggctgcgagggttgctgcggcatggaatagaaacagaggagatctattatgtgccgcagcaacctggcggcagcgcaaaagatg

SEQ ID NO: 115781 - DNA, 103 bp, Artificial Sequence
  Synthetic Polynucleotide
taatacgactcactatagggtcctggggttgctgcgagggttgctgcggcaacagaggagagccgcaatgaccctcgcaaacctggcggcagcgcaaaagatg

SEQ ID NO: 115782 - DNA, 103 bp, Artificial Sequence
  Synthetic Polynucleotide
taatacgactcactatagggcaggccaaagtcctggggttgctgcgagggaacagaggagaccctcgatgcaaccccagaacctggcggcagcgcaaaagatg

SEQ ID NO: 115783 - DNA, 103 bp, Artificial Sequence
  Synthetic Polynucleotide
taatacgactcactatagggcagctggctgcaggccaaagtcctggggttaacagaggagaaaccccatgactttggccaacctggcggcagcgcaaaagatg

SEQ ID NO: 115784 - DNA, 103 bp, Artificial Sequence
  Synthetic Polynucleotide
taatacgactcactatagggcccagtggcccagctggctgcaggccaaagaacagaggagactttggatggcagccagcaacctggcggcagcgcaaaagatg

SEQ ID NO: 115785 - DNA, 103 bp, Artificial Sequence
  Synthetic Polynucleotide
taatacgactcactataggggtgggactgtcccagtggcccagctggctgaacagaggagacagccaatggggccactgaacctggcggcagcgcaaaagatg

SEQ ID NO: 115786 - DNA, 103 bp, Artificial Sequence
  Synthetic Polynucleotide
taatacgactcactatagggggtgagccaggtgggactgtcccagtggccaacagaggagaggccacatggacagtcccaacctggcggcagcgcaaaagatg

SEQ ID NO: 115787 - DNA, 103 bp, Artificial Sequence
  Synthetic Polynucleotide
taatacgactcactatagggtgctgggggggctgcaggggagggggctgcaacagaggagagcagccatgtcccctgcaaacctggcggcagcgcaaaagatg

SEQ ID NO: 115788 - DNA, 103 bp, Artificial Sequence
  Synthetic Polynucleotide
taatacgactcactataggggccatgctgtggtgagccaggtgggactgtaacagaggagaacagtcatgcctggctcaaacctggcggcagcgcaaaagatg

SEQ ID NO: 115789 - DNA, 103 bp, Artificial Sequence
  Synthetic Polynucleotide
taatacgactcactatagggggggtagggtgccatgctgtggtgagccagaacagaggagactggctatgcacagcatgaacctggcggcagcgcaaaagatg

SEQ ID NO: 115790 - DNA, 103 bp, Artificial Sequence
  Synthetic Polynucleotide
taatacgactcactatagggtgggggggaaggggtagggtgccatgctgtaacagaggagaacagcaatgcaccctaccaacctggcggcagcgcaaaagatg

SEQ ID NO: 115791 - DNA, 103 bp, Artificial Sequence
  Synthetic Polynucleotide
taatacgactcactatagggatatctgggttgggggggaaggggtagggtaacagaggagaaccctaatgcttccccccaacctggcggcagcgcaaaagatg

SEQ ID NO: 115792 - DNA, 103 bp, Artificial Sequence
  Synthetic Polynucleotide
taatacgactcactatagggttctgggttcatatctgggttgggggggaaaacagaggagattccccatgaacccagataacctggcggcagcgcaaaagatg

SEQ ID NO: 115793 - DNA, 103 bp, Artificial Sequence
  Synthetic Polynucleotide
taatacgactcactatagggccttgcgcagttctgggttcatatctgggtaacagaggagaacccagatgtgaacccagaacctggcggcagcgcaaaagatg

SEQ ID NO: 115794 - DNA, 103 bp, Artificial Sequence
  Synthetic Polynucleotide
taatacgactcactatagggtgcagaagggccttgcgcagttctgggttcaacagaggagagaacccatgactgcgcaaaacctggcggcagcgcaaaagatg

SEQ ID NO: 115795 - DNA, 103 bp, Artificial Sequence
  Synthetic Polynucleotide
taatacgactcactatagggggctgagtcctgcagaagggccttgcgcagaacagaggagactgcgcatggcccttctgaacctggcggcagcgcaaaagatg

SEQ ID NO: 115796 - DNA, 103 bp, Artificial Sequence
  Synthetic Polynucleotide
taatacgactcactatagggctggctgcggggctgagtcctgcagaagggaacagaggagacccttcatgaggactcagaacctggcggcagcgcaaaagatg

SEQ ID NO: 115797 - DNA, 103 bp, Artificial Sequence
  Synthetic Polynucleotide
taatacgactcactatagggtgaggtagcgctggctgcggggctgagtccaacagaggagaggactcatgcccgcagccaacctggcggcagcgcaaaagatg

SEQ ID NO: 115798 - DNA, 103 bp, Artificial Sequence
  Synthetic Polynucleotide
taatacgactcactatagggacttttaggttccggctgctgttcttccataacagaggagaatggaaatgcagcagccgaacctggcggcagcgcaaaagatg

SEQ ID NO: 115799 - DNA, 103 bp, Artificial Sequence
  Synthetic Polynucleotide
taatacgactcactataggggccgctgctgccgctggcgcccggactgagaacagaggagactcagtatgggcgccagcaacctggcggcagcgcaaaagatg

SEQ ID NO: 115800 - DNA, 103 bp, Artificial Sequence
  Synthetic Polynucleotide
taatacgactcactataggggagttcctgggccagggtctgccgccgctgaacagaggagacagcggatgcagaccctgaacctggcggcagcgcaaaagatg

SEQ ID NO: 115801 - DNA, 103 bp, Artificial Sequence
  Synthetic Polynucleotide
taatacgactcactatagggcgttgaggctgagttcctgggccagggtctaacagaggagaagacccatgcccaggaacaacctggcggcagcgcaaaagatg

SEQ ID NO: 115802 - DNA, 103 bp, Artificial Sequence
  Synthetic Polynucleotide
taatacgactcactatagggatctgggactcgttgaggctgagttcctggaacagaggagaccaggaatgcagcctcaaaacctggcggcagcgcaaaagatg

SEQ ID NO: 115803 - DNA, 103 bp, Artificial Sequence
  Synthetic Polynucleotide
taatacgactcactatagggccagatcttgatctgggactcgttgaggctaacagaggagaagcctcatggagtcccagaacctggcggcagcgcaaaagatg

SEQ ID NO: 115804 - DNA, 103 bp, Artificial Sequence
  Synthetic Polynucleotide
taatacgactcactatagggtgttctggaaccagatcttgatctgggactaacagaggagaagtcccatgtcaagatctaacctggcggcagcgcaaaagatg

SEQ ID NO: 115805 - DNA, 103 bp, Artificial Sequence
  Synthetic Polynucleotide
taatacgactcactatagggttggcgcgcttgttctggaaccagatcttgaacagaggagacaagatatggttccagaaaacctggcggcagcgcaaaagatg

SEQ ID NO: 115806 - DNA, 103 bp, Artificial Sequence
  Synthetic Polynucleotide
taatacgactcactatagggtttcttgatcttggcgcgcttgttctggaaaacagaggagattccagatgaagcgcgccaacctggcggcagcgcaaaagatg

SEQ ID NO: 115807 - DNA, 103 bp, Artificial Sequence
  Synthetic Polynucleotide
taatacgactcactatagggtgcctgtggctttcttgatcttggcgcgctaacagaggagaagcgcgatgagatcaagaaacctggcggcagcgcaaaagatg

SEQ ID NO: 115808 - DNA, 103 bp, Artificial Sequence
  Synthetic Polynucleotide
taatacgactcactatagggccgttcttgatgcctgtggctttcttgatcaacagaggagagatcaaatgagccacaggaacctggcggcagcgcaaaagatg

SEQ ID NO: 115809 - DNA, 103 bp, Artificial Sequence
  Synthetic Polynucleotide
taatacgactcactatagggcagcgccaggccgttcttgatgcctgtggcaacagaggagagccacaatgatcaagaacaacctggcggcagcgcaaaagatg

SEQ ID NO: 115810 - DNA, 103 bp, Artificial Sequence
  Synthetic Polynucleotide
taatacgactcactatagggcgctgccgctgccgctgctgccgctggcgcaacagaggagagcgccaatggcagcagcgaacctggcggcagcgcaaaagatg

SEQ ID NO: 115811 - DNA, 103 bp, Artificial Sequence
  Synthetic Polynucleotide
taatacgactcactatagggccatgaggtgcagcgccaggccgttcttgaaacagaggagatcaagaatggcctggcgcaacctggcggcagcgcaaaagatg

SEQ ID NO: 115812 - DNA, 103 bp, Artificial Sequence
  Synthetic Polynucleotide
taatacgactcactatagggagtccctgggccatgaggtgcagcgccaggaacagaggagacctggcatggcacctcataacctggcggcagcgcaaaagatg

SEQ ID NO: 115813 - DNA, 103 bp, Artificial Sequence
  Synthetic Polynucleotide
taatacgactcactataggggtggttgtacagtccctgggccatgaggtgaacagaggagacacctcatggcccagggaaacctggcggcagcgcaaaagatg

SEQ ID NO: 115814 - DNA, 103 bp, Artificial Sequence
  Synthetic Polynucleotide
taatacgactcactatagggtggtggtggagtggttgtacagtccctgggaacagaggagacccaggatgtgtacaaccaacctggcggcagcgcaaaagatg

SEQ ID NO: 115815 - DNA, 103 bp, Artificial Sequence
  Synthetic Polynucleotide
taatacgactcactatagggtcctggaccgtggtggtggagtggttgtacaacagaggagagtacaaatgctccaccacaacctggcggcagcgcaaaagatg

SEQ ID NO: 115816 - DNA, 103 bp, Artificial Sequence
  Synthetic Polynucleotide
taatacgactcactatagggctcgtctttgtcctggaccgtggtggtggaaacagaggagatccaccatgacggtccagaacctggcggcagcgcaaaagatg

SEQ ID NO: 115817 - DNA, 103 bp, Artificial Sequence
  Synthetic Polynucleotide
taatacgactcactatagggctgtctccatcgctgccgctgccgctgctgaacagaggagacagcagatgcagcggcagaacctggcggcagcgcaaaagatg

SEQ ID NO: 115818 - DNA, 103 bp, Artificial Sequence
  Synthetic Polynucleotide
taatacgactcactatagggcaccggcacgctgtctccatcgctgccgctaacagaggagaagcggcatggatggagacaacctggcggcagcgcaaaagatg

SEQ ID NO: 115819 - DNA, 103 bp, Artificial Sequence
  Synthetic Polynucleotide
taatacgactcactataggggctgcggggacaccggcacgctgtctccataacagaggagaatggagatggcgtgccggaacctggcggcagcgcaaaagatg

SEQ ID NO: 115820 - DNA, 103 bp, Artificial Sequence
  Synthetic Polynucleotide
taatacgactcactataggggggggcgcaggctgcggggacaccggcacgaacagaggagacgtgccatggtccccgcaaacctggcggcagcgcaaaagatg

SEQ ID NO: 115821 - DNA, 103 bp, Artificial Sequence
  Synthetic Polynucleotide
taatacgactcactataggggggcggcgaggggggcgcaggctgcggggaaacagaggagatccccgatgcctgcgcccaacctggcggcagcgcaaaagatg

SEQ ID NO: 115822 - DNA, 103 bp, Artificial Sequence
  Synthetic Polynucleotide
taatacgactcactatagggaaggcgccgcgggcggcgaggggggcgcagaacagaggagactgcgcatgcctcgccgcaacctggcggcagcgcaaaagatg

SEQ ID NO: 115823 - DNA, 103 bp, Artificial Sequence
  Synthetic Polynucleotide
taatacgactcactatagggggcggcaggcaaggcgccgcgggcggcgagaacagaggagactcgccatgcgcggcgccaacctggcggcagcgcaaaagatg

SEQ ID NO: 115824 - DNA, 103 bp, Artificial Sequence
  Synthetic Polynucleotide
taatacgactcactataggggtgggccaggggcggcaggcaaggcgccgcaacagaggagagcggcgatgtgcctgccgaacctggcggcagcgcaaaagatg

SEQ ID NO: 115825 - DNA, 103 bp, Artificial Sequence
  Synthetic Polynucleotide
taatacgactcactatagggagtcgcgctgacttttaggttccggctgctaacagaggagaagcagcatgaacctaaaaaacctggcggcagcgcaaaagatg

SEQ ID NO: 115826 - DNA, 103 bp, Artificial Sequence
  Synthetic Polynucleotide
taatacgactcactatagggggtgcgggtggtgggccaggggcggcaggcaacagaggagagcctgcatgccctggcccaacctggcggcagcgcaaaagatg

SEQ ID NO: 115827 - DNA, 103 bp, Artificial Sequence
  Synthetic Polynucleotide
taatacgactcactatagggtgtggggggaggtgcgggtggtgggccaggaacagaggagacctggcatgccacccgcaaacctggcggcagcgcaaaagatg

SEQ ID NO: 115828 - DNA, 103 bp, Artificial Sequence
  Synthetic Polynucleotide
taatacgactcactataggggggcggggggtgtggggggaggtgcgggtgaacagaggagacacccgatgctccccccaaacctggcggcagcgcaaaagatg

SEQ ID NO: 115829 - DNA, 103 bp, Artificial Sequence
  Synthetic Polynucleotide
taatacgactcactataggggaggcggcgggggcggggggtgtggggggaaacagaggagatcccccatgaccccccgcaacctggcggcagcgcaaaagatg

SEQ ID NO: 115830 - DNA, 103 bp, Artificial Sequence
  Synthetic Polynucleotide
taatacgactcactataggggcgagatgctgaggcggcgggggcggggggaacagaggagaccccccatgcccgccgccaacctggcggcagcgcaaaagatg

SEQ ID NO: 115831 - DNA, 103 bp, Artificial Sequence
  Synthetic Polynucleotide
taatacgactcactatagggagcaggcgccgcgagatgctgaggcggcggaacagaggagaccgccgatgcagcatctcaacctggcggcagcgcaaaagatg

SEQ ID NO: 115832 - DNA, 103 bp, Artificial Sequence
  Synthetic Polynucleotide
taatacgactcactataggggcggctggtgagcaggcgccgcgagatgctaacagaggagaagcatcatgcggcgcctgaacctggcggcagcgcaaaagatg

SEQ ID NO: 115833 - DNA, 103 bp, Artificial Sequence
  Synthetic Polynucleotide
taatacgactcactataggggccgctggctgcggctggtgagcaggcgccaacagaggagaggcgccatgtcaccagccaacctggcggcagcgcaaaagatg

SEQ ID NO: 115834 - DNA, 103 bp, Artificial Sequence
  Synthetic Polynucleotide
taatacgactcactataggggtgcagctgggccgctggctgcggctggtgaacagaggagacaccagatgcagccagcgaacctggcggcagcgcaaaagatg

SEQ ID NO: 115835 - DNA, 103 bp, Artificial Sequence
  Synthetic Polynucleotide
taatacgactcactatagggtggtggtgcggtgcagctgggccgctggctaacagaggagaagccagatgcccagctgcaacctggcggcagcgcaaaagatg

SEQ ID NO: 115836 - DNA, 103 bp, Artificial Sequence
  Synthetic Polynucleotide
taatacgactcactatagggccgagggccgagtcgcgctgacttttaggtaacagaggagaacctaaatgtcagcgcgaaacctggcggcagcgcaaaagatg

SEQ ID NO: 115837 - DNA, 103 bp, Artificial Sequence
  Synthetic Polynucleotide
taatacgactcactatagggatgaaaaagttggtggtgcggtgcagctggaacagaggagaccagctatgccgcaccacaacctggcggcagcgcaaaagatg

SEQ ID NO: 115838 - DNA, 103 bp, Artificial Sequence
  Synthetic Polynucleotide
taatacgactcactataggggatgttgtcgatgaaaaagttggtggtgcgaacagaggagacgcaccatgaactttttcaacctggcggcagcgcaaaagatg

SEQ ID NO: 115839 - DNA, 103 bp, Artificial Sequence
  Synthetic Polynucleotide
taatacgactcactatagggccggcctcaggatgttgtcgatgaaaaagtaacagaggagaacttttatgtcgacaacaaacctggcggcagcgcaaaagatg

SEQ ID NO: 115840 - DNA, 103 bp, Artificial Sequence
  Synthetic Polynucleotide
taatacgactcactatagggcagccgaagtccggcctcaggatgttgtcgaacagaggagacgacaaatgcctgaggccaacctggcggcagcgcaaaagatg

SEQ ID NO: 115841 - DNA, 103 bp, Artificial Sequence
  Synthetic Polynucleotide
taatacgactcactatagggctcctttttgcagccgaagtccggcctcagaacagaggagactgaggatggacttcggcaacctggcggcagcgcaaaagatg

SEQ ID NO: 115842 - DNA, 103 bp, Artificial Sequence
  Synthetic Polynucleotide
taatacgactcactataggggtggcggctgctcctttttgcagccgaagtaacagaggagaacttcgatggcaaaaaggaacctggcggcagcgcaaaagatg

SEQ ID NO: 115843 - DNA, 103 bp, Artificial Sequence
  Synthetic Polynucleotide
taatacgactcactatagggagaagctgcggtggcggctgctcctttttgaacagaggagacaaaaaatggcagccgccaacctggcggcagcgcaaaagatg

SEQ ID NO: 115844 - DNA, 103 bp, Artificial Sequence
  Synthetic Polynucleotide
taatacgactcactatagggcgcagccaccagaagctgcggtggcggctgaacagaggagacagccgatgccgcagcttaacctggcggcagcgcaaaagatg

SEQ ID NO: 115845 - DNA, 103 bp, Artificial Sequence
  Synthetic Polynucleotide
taatacgactcactatagggctctggccgccgcagccaccagaagctgcgaacagaggagacgcagcatgtggtggctgaacctggcggcagcgcaaaagatg

SEQ ID NO: 115846 - DNA, 103 bp, Artificial Sequence
  Synthetic Polynucleotide
taatacgactcactatagggcctgcgcctcctctggccgccgcagccaccaacagaggagaggtggcatgggcggccagaacctggcggcagcgcaaaagatg

SEQ ID NO: 115847 - DNA, 103 bp, Artificial Sequence
  Synthetic Polynucleotide
taatacgactcactatagggcgccgccgcgccgagggccgagtcgcgctgaacagaggagacagcgcatgtcggccctcaacctggcggcagcgcaaaagatg

SEQ ID NO: 115848 - DNA, 103 bp, Artificial Sequence
  Synthetic Polynucleotide
taatacgactcactataggggcctcctcctcctgcgcctcctctggccgcaacagaggagagcggccatgggaggcgcaaacctggcggcagcgcaaaagatg

SEQ ID NO: 115849 - DNA, 103 bp, Artificial Sequence
  Synthetic Polynucleotide
taatacgactcactataggggctcgacccggcctcctcctcctgcgcctcaacagaggagagaggcgatggaggaggagaacctggcggcagcgcaaaagatg

SEQ ID NO: 115850 - DNA, 103 bp, Artificial Sequence
  Synthetic Polynucleotide
taatacgactcactatagggcctctgtcacgctcgacccggcctcctcctaacagaggagaaggaggatgccgggtcgaaacctggcggcagcgcaaaagatg

SEQ ID NO: 115851 - DNA, 103 bp, Artificial Sequence
  Synthetic Polynucleotide
taatacgactcactatagggggcagtctggcctctgtcacgctcgacccgaacagaggagacgggtcatgcgtgacagaaacctggcggcagcgcaaaagatg

SEQ ID NO: 115852 - DNA, 103 bp, Artificial Sequence
  Synthetic Polynucleotide
taatacgactcactatagggctctacctgcggcagtctggcctctgtcacaacagaggagagtgacaatggccagactgaacctggcggcagcgcaaaagatg

SEQ ID NO: 115853 - DNA, 103 bp, Artificial Sequence
  Synthetic Polynucleotide
taatacgactcactatagggtggacagggtctctacctgcggcagtctggaacagaggagaccagacatgcgcaggtagaacctggcggcagcgcaaaagatg

SEQ ID NO: 115854 - DNA, 103 bp, Artificial Sequence
  Synthetic Polynucleotide
taatacgactcactataggggcccaacgggtggacagggtctctacctgcaacagaggagagcaggtatggaccctgtcaacctggcggcagcgcaaaagatg

SEQ ID NO: 115855 - DNA, 103 bp, Artificial Sequence
  Synthetic Polynucleotide
taatacgactcactataggggcgcccgggtgcccaacgggtggacagggtaacagaggagaaccctgatgacccgttggaacctggcggcagcgcaaaagatg

SEQ ID NO: 115856 - DNA, 103 bp, Artificial Sequence
  Synthetic Polynucleotide
taatacgactcactataggggcagcgcctggcgcccgggtgcccaacgggaacagaggagacccgttatgcacccgggcaacctggcggcagcgcaaaagatg

SEQ ID NO: 115857 - DNA, 103 bp, Artificial Sequence
  Synthetic Polynucleotide
taatacgactcactatagggcaggagcgaggcagcgcctggcgcccgggtaacagaggagaacccggatgccaggcgctaacctggcggcagcgcaaaagatg

SEQ ID NO: 115858 - DNA, 103 bp, Artificial Sequence
  Synthetic Polynucleotide
taatacgactcactataggggagtcgccgccgccgccgcgccgagggccgaacagaggagacggcccatggcgcggcggaacctggcggcagcgcaaaagatg

SEQ ID NO: 115859 - DNA, 103 bp, Artificial Sequence
  Synthetic Polynucleotide
taatacgactcactatagggccggggcgcacaggagcgaggcagcgcctgaacagaggagacaggcgatgcctcgctccaacctggcggcagcgcaaaagatg

SEQ ID NO: 115860 - DNA, 103 bp, Artificial Sequence
  Synthetic Polynucleotide
taatacgactcactatagggcagttcgcgtccggggcgcacaggagcgagaacagaggagactcgctatggtgcgccccaacctggcggcagcgcaaaagatg

SEQ ID NO: 115861 - DNA, 103 bp, Artificial Sequence
  Synthetic Polynucleotide
taatacgactcactataggggggtgggccacagttcgcgtccggggcgcaaacagaggagatgcgccatggacgcgaacaacctggcggcagcgcaaaagatg

SEQ ID NO: 115862 - DNA, 103 bp, Artificial Sequence
  Synthetic Polynucleotide
taatacgactcactataggggggagccgtcgggtgggccacagttcgcgtaacagaggagaacgcgaatggtggcccacaacctggcggcagcgcaaaagatg

SEQ ID NO: 115863 - DNA, 103 bp, Artificial Sequence
  Synthetic Polynucleotide
taatacgactcactataggggcggctggctgggagccgtcgggtgggccaaacagaggagatggcccatgcgacggctcaacctggcggcagcgcaaaagatg

SEQ ID NO: 115864 - DNA, 103 bp, Artificial Sequence
  Synthetic Polynucleotide
taatacgactcactatagggcgcgccggcggcggctggctgggagccgtcaacagaggagagacggcatgcagccagccaacctggcggcagcgcaaaagatg

SEQ ID NO: 115865 - DNA, 103 bp, Artificial Sequence
  Synthetic Polynucleotide
taatacgactcactatagggtagacgcgcccgcgccggcggcggctggctaacagaggagaagccagatgccgccggcgaacctggcggcagcgcaaaagatg

SEQ ID NO: 115866 - DNA, 103 bp, Artificial Sequence
  Synthetic Polynucleotide
taatacgactcactatagggttcccagctttagacgcgcccgcgccggcgaacagaggagacgccggatggggcgcgtcaacctggcggcagcgcaaaagatg

SEQ ID NO: 115867 - DNA, 103 bp, Artificial Sequence
  Synthetic Polynucleotide
taatacgactcactatagggcgcagccgggttcccagctttagacgcgccaacagaggagaggcgcgatgaaagctgggaacctggcggcagcgcaaaagatg

SEQ ID NO: 115868 - DNA, 103 bp, Artificial Sequence
  Synthetic Polynucleotide
taatacgactcactatagggccgccgccgccgcagccgggttcccagcttaacagaggagaaagctgatgacccggctgaacctggcggcagcgcaaaagatg

SEQ ID NO: 115869 - DNA, 103 bp, Artificial Sequence
  Synthetic Polynucleotide
taatacgactcactatagggaggccgcccggagtcgccgccgccgccgcgaacagaggagacgcggcatgggcggcgacaacctggcggcagcgcaaaagatg

SEQ ID NO: 115870 - DNA, 103 bp, Artificial Sequence
  Synthetic Polynucleotide
taatacgactcactataggggccgcggccgccgccgccgccgcagccgggaacagaggagacccggcatgggcggcggcaacctggcggcagcgcaaaagatg

SEQ ID NO: 115871 - DNA, 103 bp, Artificial Sequence
  Synthetic Polynucleotide
taatacgactcactatagggcgccactgccgccgcggccgccgccgccgcaacagaggagagcggcgatggcggccgcgaacctggcggcagcgcaaaagatg

SEQ ID NO: 115872 - DNA, 103 bp, Artificial Sequence
  Synthetic Polynucleotide
taatacgactcactatagggccgccgccgccgccactgccgccgcggccgaacagaggagacggccgatgcggcagtggaacctggcggcagcgcaaaagatg

SEQ ID NO: 115873 - DNA, 103 bp, Artificial Sequence
  Synthetic Polynucleotide
taatacgactcactataggggctgcggccgccgccgccgccgccactgccaacagaggagaggcagtatgggcggcggcaacctggcggcagcgcaaaagatg

SEQ ID NO: 115874 - DNA, 103 bp, Artificial Sequence
  Synthetic Polynucleotide
taatacgactcactataggggggcttggctgctgcggccgccgccgccgcaacagaggagagcggcgatggcggccgcaaacctggcggcagcgcaaaagatg

SEQ ID NO: 115875 - DNA, 103 bp, Artificial Sequence
  Synthetic Polynucleotide
taatacgactcactatagggcggtgtccgagggcttggctgctgcggccgaacagaggagacggccgatgcagccaagcaacctggcggcagcgcaaaagatg

SEQ ID NO: 115876 - DNA, 103 bp, Artificial Sequence
  Synthetic Polynucleotide
taatacgactcactatagggccgccgccaccggtgtccgagggcttggctaacagaggagaagccaaatgctcggacacaacctggcggcagcgcaaaagatg

SEQ ID NO: 115877 - DNA, 103 bp, Artificial Sequence
  Synthetic Polynucleotide
taatacgactcactataggggcctccactgccgccgccaccggtgtccgaaacagaggagatcggacatgggtggcggcaacctggcggcagcgcaaaagatg

SEQ ID NO: 115878 - DNA, 103 bp, Artificial Sequence
  Synthetic Polynucleotide
taatacgactcactatagggtccccgcgccgcctccactgccgccgccacaacagaggagagtggcgatggcagtggagaacctggcggcagcgcaaaagatg

SEQ ID NO: 115879 - DNA, 103 bp, Artificial Sequence
  Synthetic Polynucleotide
taatacgactcactataggggctccggggctccccgcgccgcctccactgaacagaggagacagtggatgcggcgcgggaacctggcggcagcgcaaaagatg

SEQ ID NO: 115880 - DNA, 103 bp, Artificial Sequence
  Synthetic Polynucleotide
taatacgactcactataggggctcaggctgaggccgcccggagtcgccgcaacagaggagagcggcgatgccgggcggcaacctggcggcagcgcaaaagatg

SEQ ID NO: 115881 - DNA, 103 bp, Artificial Sequence
  Synthetic Polynucleotide
taatacgactcactatagggggtgccctgcgctccggggctccccgcgccaacagaggagaggcgcgatgagccccggaaacctggcggcagcgcaaaagatg

SEQ ID NO: 115882 - DNA, 103 bp, Artificial Sequence
  Synthetic Polynucleotide
taatacgactcactatagggccgggtatttggtgccctgcgctccggggcaacagaggagagccccgatgcgcagggcaaacctggcggcagcgcaaaagatg

SEQ ID NO: 115883 - DNA, 103 bp, Artificial Sequence
  Synthetic Polynucleotide
taatacgactcactatagggttgccgtgctccgggtatttggtgccctgcaacagaggagagcagggatgcaaatacccaacctggcggcagcgcaaaagatg

SEQ ID NO: 115884 - DNA, 103 bp, Artificial Sequence
  Synthetic Polynucleotide
taatacgactcactataggggatagccgggttgccgtgctccgggtatttaacagaggagaaaatacatggagcacggcaacctggcggcagcgcaaaagatg

SEQ ID NO: 115885 - DNA, 103 bp, Artificial Sequence
  Synthetic Polynucleotide
taatacgactcactatagggccataagtaggatagccgggttgccgtgctaacagaggagaagcacgatgacccggctaaacctggcggcagcgcaaaagatg

SEQ ID NO: 115886 - DNA, 103 bp, Artificial Sequence
  Synthetic Polynucleotide
taatacgactcactatagggttggctgagcccataagtaggatagccgggaacagaggagacccggcatgcctacttataacctggcggcagcgcaaaagatg

SEQ ID NO: 115887 - DNA, 103 bp, Artificial Sequence
  Synthetic Polynucleotide
taatacgactcactataggggggcccgccgttggctgagcccataagtagaacagaggagactacttatgggctcagccaacctggcggcagcgcaaaagatg

SEQ ID NO: 115888 - DNA, 103 bp, Artificial Sequence
  Synthetic Polynucleotide
taatacgactcactatagggttttgaccacgggcccgccgttggctgagcaacagaggagagctcagatgacggcgggcaacctggcggcagcgcaaaagatg

SEQ ID NO: 115889 - DNA, 103 bp, Artificial Sequence
  Synthetic Polynucleotide
taatacgactcactatagggtgcgagtcagttttgaccacgggcccgccgaacagaggagacggcggatgcgtggtcaaaacctggcggcagcgcaaaagatg

SEQ ID NO: 115890 - DNA, 103 bp, Artificial Sequence
  Synthetic Polynucleotide
taatacgactcactataggggagaggctgctgcgagtcagttttgaccacaacagaggagagtggtcatgactgactcgaacctggcggcagcgcaaaagatg

SEQ ID NO: 115891 - DNA, 103 bp, Artificial Sequence
  Synthetic Polynucleotide
taatacgactcactatagggccggactgaggctcaggctgaggccgcccgaacagaggagacgggcgatgtcagcctgaaacctggcggcagcgcaaaagatg

SEQ ID NO: 115892 - DNA, 103 bp, Artificial Sequence
  Synthetic Polynucleotide
taatacgactcactatagggcgggccatacgagaggctgctgcgagtcagaacagaggagactgactatgagcagcctcaacctggcggcagcgcaaaagatg

SEQ ID NO: 115893 - DNA, 103 bp, Artificial Sequence
  Synthetic Polynucleotide
taatacgactcactatagggtacacccaggcgggccatacgagaggctgcaacagaggagagcagccatgcgtatggccaacctggcggcagcgcaaaagatg

SEQ ID NO: 115894 - DNA, 103 bp, Artificial Sequence
  Synthetic Polynucleotide
taatacgactcactatagggacgtgtgcagtacacccaggcgggccatacaacagaggagagtatggatggcctgggtgaacctggcggcagcgcaaaagatg

SEQ ID NO: 115895 - DNA, 103 bp, Artificial Sequence
  Synthetic Polynucleotide
taatacgactcactataggggatccgaataacgtgtgcagtacacccaggaacagaggagacctgggatgactgcacacaacctggcggcagcgcaaaagatg

SEQ ID NO: 115896 - DNA, 103 bp, Artificial Sequence
  Synthetic Polynucleotide
taatacgactcactataggggaggatggacgatccgaataacgtgtgcagaacagaggagactgcacatgttattcggaaacctggcggcagcgcaaaagatg

SEQ ID NO: 115897 - DNA, 103 bp, Artificial Sequence
  Synthetic Polynucleotide
taatacgactcactataggggcgcggaccggaggatggacgatccgaataaacagaggagatattcgatgcgtccatccaacctggcggcagcgcaaaagatg

SEQ ID NO: 115898 - DNA, 103 bp, Artificial Sequence
  Synthetic Polynucleotide
taatacgactcactataggggcttcctggtgcgcggaccggaggatggacaacagaggagagtccatatgccggtccgcaacctggcggcagcgcaaaagatg

SEQ ID NO: 115899 - DNA, 103 bp, Artificial Sequence
  Synthetic Polynucleotide
taatacgactcactatagggttcttcttcagcttcctggtgcgcggaccgaacagaggagacggtccatgcaccaggaaaacctggcggcagcgcaaaagatg

SEQ ID NO: 115900 - DNA, 103 bp, Artificial Sequence
  Synthetic Polynucleotide
taatacgactcactatagggctcgttcttcttcttcttcagcttcctggtaacagaggagaaccaggatgctgaagaagaacctggcggcagcgcaaaagatg

SEQ ID NO: 115901 - DNA, 103 bp, Artificial Sequence
  Synthetic Polynucleotide
taatacgactcactatagggtgtcctccttctcgttcttcttcttcttcaaacagaggagatgaagaatgagaagaacgaacctggcggcagcgcaaaagatg

SEQ ID NO: 115902 - DNA, 103 bp, Artificial Sequence
  Synthetic Polynucleotide
taatacgactcactatagggccgctggcgcccggactgaggctcaggctgaacagaggagacagcctatgcctcagtccaacctggcggcagcgcaaaagatg

SEQ ID NO: 115903 - DNA, 103 bp, Artificial Sequence
  Synthetic Polynucleotide
taatacgactcactatagggcgcggccgcttgtcctccttctcgttcttcaacagaggagagaagaaatggaaggaggaaacctggcggcagcgcaaaagatg

SEQ ID NO: 115904 - DNA, 103 bp, Artificial Sequence
  Synthetic Polynucleotide
taatacgactcactataggggaacgcggtccgcggccgcttgtcctccttaacagaggagaaaggagatgaagcggccgaacctggcggcagcgcaaaagatg

SEQ ID NO: 115905 - DNA, 103 bp, Artificial Sequence
  Synthetic Polynucleotide
taatacgactcactataggggctcggccgtgaacgcggtccgcggccgctaacagaggagaagcggcatgggaccgcgtaacctggcggcagcgcaaaagatg

SEQ ID NO: 115906 - DNA, 103 bp, Artificial Sequence
  Synthetic Polynucleotide
taatacgactcactatagggctctgcagctgctcggccgtgaacgcggtcaacagaggagagaccgcatgcacggccgaaacctggcggcagcgcaaaagatg

SEQ ID NO: 115907 - DNA, 103 bp, Artificial Sequence
  Synthetic Polynucleotide
taatacgactcactatagggcgccttgagtctctgcagctgctcggccgtaacagaggagaacggccatgcagctgcagaacctggcggcagcgcaaaagatg

SEQ ID NO: 115908 - DNA, 103 bp, Artificial Sequence
  Synthetic Polynucleotide
taatacgactcactatagggcctggaactccgccttgagtctctgcagctaacagaggagaagctgcatggactcaaggaacctggcggcagcgcaaaagatg

SEQ ID NO: 115909 - DNA, 103 bp, Artificial Sequence
  Synthetic Polynucleotide
taatacgactcactatagggtagcggtttgcctggaactccgccttgagtaacagaggagaactcaaatgggagttccaaacctggcggcagcgcaaaagatg

SEQ ID NO: 115910 - DNA, 103 bp, Artificial Sequence
  Synthetic Polynucleotide
taatacgactcactatagggctccgtgatgtagcggtttgcctggaactcaacagaggagagagttcatggcaaaccgcaacctggcggcagcgcaaaagatg

SEQ ID NO: 115911 - DNA, 103 bp, Artificial Sequence
  Synthetic Polynucleotide
taatacgactcactataggggccgccgctgctccgtgatgtagcggtttgaacagaggagacaaaccatgacatcacggaacctggcggcagcgcaaaagatg

SEQ ID NO: 115912 - DNA, 103 bp, Artificial Sequence
  Synthetic Polynucleotide
taatacgactcactataggggccagggtctgccgccgctgctccgtgatgaacagaggagacatcacatggcagcggcgaacctggcggcagcgcaaaagatg

SEQ ID NO: 115913 - DNA, 103 bp, Artificial Sequence
  Synthetic Polynucleotide
taatacgactcactatagggctccctggcatggatcttgagaatagacataacagaggagaatgtctatgctcaagatcaacctggcggcagcgcaaaagatg

SEQ ID NO: 115914 - DNA, 103 bp, Artificial Sequence
  Synthetic Polynucleotide
taatacgactcactatagggtgaagcaccactgggcacagcagctctgaaaacagaggagattcagaatggctgtgcccaacctggcggcagcgcaaaagatg

SEQ ID NO: 115915 - DNA, 103 bp, Artificial Sequence
  Synthetic Polynucleotide
taatacgactcactataggggaggcagttgcaggacttctcgttcacggcaacagaggagagccgtgatggagaagtccaacctggcggcagcgcaaaagatg

SEQ ID NO: 115916 - DNA, 103 bp, Artificial Sequence
  Synthetic Polynucleotide
taatacgactcactatagggctttgagcaggaggcagttgcaggacttctaacagaggagaagaagtatggcaactgccaacctggcggcagcgcaaaagatg

SEQ ID NO: 115917 - DNA, 103 bp, Artificial Sequence
  Synthetic Polynucleotide
taatacgactcactatagggatctggttgactttgagcaggaggcagttgaacagaggagacaactgatgcctgctcaaaacctggcggcagcgcaaaagatg

SEQ ID NO: 115918 - DNA, 103 bp, Artificial Sequence
  Synthetic Polynucleotide
taatacgactcactatagggcacggagccaatctggttgactttgagcagaacagaggagactgctcatggtcaaccagaacctggcggcagcgcaaaagatg

SEQ ID NO: 115919 - DNA, 103 bp, Artificial Sequence
  Synthetic Polynucleotide
taatacgactcactataggggagactcggtcacggagccaatctggttgaaacagaggagatcaaccatgttggctccgaacctggcggcagcgcaaaagatg

SEQ ID NO: 115920 - DNA, 103 bp, Artificial Sequence
  Synthetic Polynucleotide
taatacgactcactatagggcacgcctgaagagactcggtcacggagccaaacagaggagatggctcatggaccgagtcaacctggcggcagcgcaaaagatg

SEQ ID NO: 115921 - DNA, 103 bp, Artificial Sequence
  Synthetic Polynucleotide
taatacgactcactatagggggccagcttgcacgcctgaagagactcggtaacagaggagaaccgagatgcttcaggcgaacctggcggcagcgcaaaagatg

SEQ ID NO: 115922 - DNA, 103 bp, Artificial Sequence
  Synthetic Polynucleotide
taatacgactcactatagggcattggcctgggccagcttgcacgcctgaaaacagaggagattcaggatggcaagctggaacctggcggcagcgcaaaagatg

SEQ ID NO: 115923 - DNA, 103 bp, Artificial Sequence
  Synthetic Polynucleotide
taatacgactcactatagggacgccccaaccattggcctgggccagcttgaacagaggagacaagctatgccaggccaaaacctggcggcagcgcaaaagatg

SEQ ID NO: 115924 - DNA, 103 bp, Artificial Sequence
  Synthetic Polynucleotide
taatacgactcactatagggagacaccatgacgccccaaccattggcctgaacagaggagacaggccatgggttggggcaacctggcggcagcgcaaaagatg

SEQ ID NO: 115925 - DNA, 103 bp, Artificial Sequence
  Synthetic Polynucleotide
taatacgactcactatagggagataccagttgaagcaccactgggcacagaacagaggagactgtgcatggtggtgcttaacctggcggcagcgcaaaagatg

SEQ ID NO: 115926 - DNA, 103 bp, Artificial Sequence
  Synthetic Polynucleotide
taatacgactcactatagggccgaacgatgagacaccatgacgccccaacaacagaggagagttgggatgtcatggtgtaacctggcggcagcgcaaaagatg

SEQ ID NO: 115927 - DNA, 103 bp, Artificial Sequence
  Synthetic Polynucleotide
taatacgactcactatagggtcagtctcccccgaacgatgagacaccatgaacagaggagacatggtatgtcatcgttcaacctggcggcagcgcaaaagatg

SEQ ID NO: 115928 - DNA, 103 bp, Artificial Sequence
  Synthetic Polynucleotide
taatacgactcactataggggaaggtatcttcagtctcccccgaacgatgaacagaggagacatcgtatgggggagactaacctggcggcagcgcaaaagatg

SEQ ID NO: 115929 - DNA, 103 bp, Artificial Sequence
  Synthetic Polynucleotide
taatacgactcactatagggggtcagcgatgaaggtatcttcagtctcccaacagaggagagggagaatgaagatacctaacctggcggcagcgcaaaagatg

SEQ ID NO: 115930 - DNA, 103 bp, Artificial Sequence
  Synthetic Polynucleotide
taatacgactcactatagggcccacaaccaggtcagcgatgaaggtatctaacagaggagaagatacatgcatcgctgaaacctggcggcagcgcaaaagatg

SEQ ID NO: 115931 - DNA, 103 bp, Artificial Sequence
  Synthetic Polynucleotide
taatacgactcactatagggagtgcacagccccacaaccaggtcagcgataacagaggagaatcgctatgctggttgtgaacctggcggcagcgcaaaagatg

SEQ ID NO: 115932 - DNA, 103 bp, Artificial Sequence
  Synthetic Polynucleotide
taatacgactcactatagggtgatctgcccagtgcacagccccacaaccaaacagaggagatggttgatgggctgtgcaaacctggcggcagcgcaaaagatg

SEQ ID NO: 115933 - DNA, 103 bp, Artificial Sequence
  Synthetic Polynucleotide
taatacgactcactataggggcaccagtcttgatctgcccagtgcacagcaacagaggagagctgtgatgtgggcagataacctggcggcagcgcaaaagatg

SEQ ID NO: 115934 - DNA, 103 bp, Artificial Sequence
  Synthetic Polynucleotide
taatacgactcactatagggtcggcaaggggcaccagtcttgatctgcccaacagaggagagggcagatgaagactggtaacctggcggcagcgcaaaagatg

SEQ ID NO: 115935 - DNA, 103 bp, Artificial Sequence
  Synthetic Polynucleotide
taatacgactcactatagggagcgctcagatcggcaaggggcaccagtctaacagaggagaagactgatgccccttgccaacctggcggcagcgcaaaagatg

SEQ ID NO: 115936 - DNA, 103 bp, Artificial Sequence
  Synthetic Polynucleotide
taatacgactcactatagggagggcctcatagataccagttgaagcaccaaacagaggagatggtgcatgaactggtataacctggcggcagcgcaaaagatg

SEQ ID NO: 115937 - DNA, 103 bp, Artificial Sequence
  Synthetic Polynucleotide
taatacgactcactatagggtacttggccaagcgctcagatcggcaagggaacagaggagacccttgatgatctgagcgaacctggcggcagcgcaaaagatg

SEQ ID NO: 115938 - DNA, 103 bp, Artificial Sequence
  Synthetic Polynucleotide
taatacgactcactataggggagctggttgtacttggccaagcgctcagaaacagaggagatctgagatgttggccaagaacctggcggcagcgcaaaagatg

SEQ ID NO: 115939 - DNA, 103 bp, Artificial Sequence
  Synthetic Polynucleotide
taatacgactcactatagggcaattctgaggagctggttgtacttggccaaacagaggagatggccaatgacaaccagcaacctggcggcagcgcaaaagatg

SEQ ID NO: 115940 - DNA, 103 bp, Artificial Sequence
  Synthetic Polynucleotide
taatacgactcactatagggagctcctcttcaattctgaggagctggttgaacagaggagacaaccaatgcctcagaataacctggcggcagcgcaaaagatg

SEQ ID NO: 115941 - DNA, 103 bp, Artificial Sequence
  Synthetic Polynucleotide
taatacgactcactatagggcttgctgcccagctcctcttcaattctgagaacagaggagactcagaatggaagaggagaacctggcggcagcgcaaaagatg

SEQ ID NO: 115942 - DNA, 103 bp, Artificial Sequence
  Synthetic Polynucleotide
taatacgactcactatagggcaaacttagccttgctgcccagctcctcttaacagaggagaaagaggatgtgggcagcaaacctggcggcagcgcaaaagatg

SEQ ID NO: 115943 - DNA, 103 bp, Artificial Sequence
  Synthetic Polynucleotide
taatacgactcactatagggttcctgccggcaaacttagccttgctgcccaacagaggagagggcagatgggctaagttaacctggcggcagcgcaaaagatg

SEQ ID NO: 115944 - DNA, 103 bp, Artificial Sequence
  Synthetic Polynucleotide
taatacgactcactataggggtttctgaagttcctgccggcaaacttagcaacagaggagagctaagatggccggcaggaacctggcggcagcgcaaaagatg

SEQ ID NO: 115945 - DNA, 103 bp, Artificial Sequence
  Synthetic Polynucleotide
taatacgactcactatagggtggccaaggggtttctgaagttcctgccggaacagaggagaccggcaatgacttcagaaaacctggcggcagcgcaaaagatg

SEQ ID NO: 115946 - DNA, 103 bp, Artificial Sequence
  Synthetic Polynucleotide
taatacgactcactatagggccggagctctagggcctcatagataccagtaacagaggagaactggtatgtatgaggccaacctggcggcagcgcaaaagatg

SEQ ID NO: 115947 - DNA, 103 bp, Artificial Sequence
  Synthetic Polynucleotide
taatacgactcactatagggtatcattgtcccggagctctagggcctcataacagaggagaatgaggatgtagagctccaacctggcggcagcgcaaaagatg

SEQ ID NO: 115948 - DNA, 103 bp, Artificial Sequence
  Synthetic Polynucleotide
taatacgactcactatagggtagcgagtcttatcattgtcccggagctctaacagaggagaagagctatgggacaatgaaacctggcggcagcgcaaaagatg

SEQ ID NO: 115949 - DNA, 103 bp, Artificial Sequence
  Synthetic Polynucleotide
taatacgactcactatagggcttccccatatagcgagtcttatcattgtcaacagaggagagacaatatgaagactcgcaacctggcggcagcgcaaaagatg

SEQ ID NO: 115950 - DNA, 103 bp, Artificial Sequence
  Synthetic Polynucleotide
taatacgactcactatagggttgagacacccttccccatatagcgagtctaacagaggagaagactcatgatatggggaaacctggcggcagcgcaaaagatg

SEQ ID NO: 115951 - DNA, 103 bp, Artificial Sequence
  Synthetic Polynucleotide
taatacgactcactatagggtcaacagcctttgagacacccttccccataaacagaggagatatgggatggggtgtctcaacctggcggcagcgcaaaagatg

SEQ ID NO: 115952 - DNA, 103 bp, Artificial Sequence
  Synthetic Polynucleotide
taatacgactcactatagggattgatgtgctcaacagcctttgagacaccaacagaggagaggtgtcatgaaggctgttaacctggcggcagcgcaaaagatg

SEQ ID NO: 115953 - DNA, 103 bp, Artificial Sequence
  Synthetic Polynucleotide
taatacgactcactatagggagtcaaagatctccctggcatggatcttgaaacagaggagatcaagaatgatgccagggaacctggcggcagcgcaaaagatg

SEQ ID NO: 115954 - DNA, 103 bp, Artificial Sequence
  Synthetic Polynucleotide
taatacgactcactatagggcaatagttttattgatgtgctcaacagcctaacagaggagaaggctgatgagcacatcaaacctggcggcagcgcaaaagatg

SEQ ID NO: 115955 - DNA, 103 bp, Artificial Sequence
  Synthetic Polynucleotide
taatacgactcactatagggagggcaggcgcaatagttttattgatgtgcaacagaggagagcacatatgtaaaactataacctggcggcagcgcaaaagatg

SEQ ID NO: 115956 - DNA, 103 bp, Artificial Sequence
  Synthetic Polynucleotide
taatacgactcactatagggcttgctaaccagggcaggcgcaatagttttaacagaggagaaaaactatggcgcctgccaacctggcggcagcgcaaaagatg

SEQ ID NO: 115957 - DNA, 103 bp, Artificial Sequence
  Synthetic Polynucleotide
taatacgactcactatagggcgttcagtttcttgctaaccagggcaggcgaacagaggagacgcctgatgtggttagcaaacctggcggcagcgcaaaagatg

SEQ ID NO: 115958 - DNA, 103 bp, Artificial Sequence
  Synthetic Polynucleotide
taatacgactcactatagggtgttctgtgacgttcagtttcttgctaaccaacagaggagaggttagatggaaactgaaaacctggcggcagcgcaaaagatg

SEQ ID NO: 115959 - DNA, 103 bp, Artificial Sequence
  Synthetic Polynucleotide
taatacgactcactatagggaatcttctcttgttctgtgacgttcagtttaacagaggagaaaactgatggtcacagaaaacctggcggcagcgcaaaagatg

SEQ ID NO: 115960 - DNA, 103 bp, Artificial Sequence
  Synthetic Polynucleotide
taatacgactcactatagggtcagtttgtcaatcttctcttgttctgtgaaacagaggagatcacagatgaagagaagaaacctggcggcagcgcaaaagatg

SEQ ID NO: 115961 - DNA, 103 bp, Artificial Sequence
  Synthetic Polynucleotide
taatacgactcactatagggatctcgatcatcagtttgtcaatcttctctaacagaggagaagagaaatgtgacaaactaacctggcggcagcgcaaaagatg

SEQ ID NO: 115962 - DNA, 103 bp, Artificial Sequence
  Synthetic Polynucleotide
taatacgactcactatagggtgttccatccatctcgatcatcagtttgtcaacagaggagagacaaaatgatgatcgagaacctggcggcagcgcaaaagatg

SEQ ID NO: 115963 - DNA, 103 bp, Artificial Sequence
  Synthetic Polynucleotide
taatacgactcactatagggatttattttctgttccatccatctcgatcaaacagaggagatgatcgatgtggatggaaaacctggcggcagcgcaaaagatg

SEQ ID NO: 115964 - DNA, 103 bp, Artificial Sequence
  Synthetic Polynucleotide
taatacgactcactatagggttcccgcgagagtcaaagatctccctggcaaacagaggagatgccagatggatctttgaaacctggcggcagcgcaaaagatg

SEQ ID NO: 115965 - DNA, 103 bp, Artificial Sequence
  Synthetic Polynucleotide
taatacgactcactatagggccaaacttagatttattttctgttccatccaacagaggagaggatggatgagaaaataaaacctggcggcagcgcaaaagatg

SEQ ID NO: 115966 - DNA, 103 bp, Artificial Sequence
  Synthetic Polynucleotide
taatacgactcactatagggggcgttcgcaccaaacttagatttattttcaacagaggagagaaaatatgtctaagtttaacctggcggcagcgcaaaagatg

SEQ ID NO: 115967 - DNA, 103 bp, Artificial Sequence
  Synthetic Polynucleotide
taatacgactcactatagggcccccagaatggcgttcgcaccaaacttagaacagaggagactaagtatggtgcgaacgaacctggcggcagcgcaaaagatg

SEQ ID NO: 115968 - DNA, 103 bp, Artificial Sequence
  Synthetic Polynucleotide
taatacgactcactataggggcaagggacacccccagaatggcgttcgcaaacagaggagatgcgaaatgcattctgggaacctggcggcagcgcaaaagatg

SEQ ID NO: 115969 - DNA, 103 bp, Artificial Sequence
  Synthetic Polynucleotide
taatacgactcactatagggtttgcagacggcaagggacacccccagaataacagaggagaattctgatggtgtcccttaacctggcggcagcgcaaaagatg

SEQ ID NO: 115970 - DNA, 103 bp, Artificial Sequence
  Synthetic Polynucleotide
taatacgactcactatagggcggcaccagctttgcagacggcaagggacaaacagaggagatgtcccatgccgtctgcaaacctggcggcagcgcaaaagatg

SEQ ID NO: 115971 - DNA, 103 bp, Artificial Sequence
  Synthetic Polynucleotide
taatacgactcactatagggcccttctcaacggcaccagctttgcagacgaacagaggagacgtctgatgagctggtgcaacctggcggcagcgcaaaagatg

SEQ ID NO: 115972 - DNA, 103 bp, Artificial Sequence
  Synthetic Polynucleotide
taatacgactcactatagggcagggggacccccttctcaacggcaccagcaacagaggagagctggtatggttgagaagaacctggcggcagcgcaaaagatg

SEQ ID NO: 115973 - DNA, 103 bp, Artificial Sequence
  Synthetic Polynucleotide
taatacgactcactatagggtgtggcggtacagggggacccccttctcaaaacagaggagattgagaatggggtcccccaacctggcggcagcgcaaaagatg

SEQ ID NO: 115974 - DNA, 103 bp, Artificial Sequence
  Synthetic Polynucleotide
taatacgactcactatagggaagtcagcgatgtggcggtacagggggaccaacagaggagaggtcccatggtaccgccaaacctggcggcagcgcaaaagatg

SEQ ID NO: 115975 - DNA, 103 bp, Artificial Sequence
  Synthetic Polynucleotide
taatacgactcactatagggaacagtgggattcccgcgagagtcaaagataacagaggagaatctttatgtctcgcgggaacctggcggcagcgcaaaagatg

SEQ ID NO: 115976 - DNA, 103 bp, Artificial Sequence
  Synthetic Polynucleotide
taatacgactcactataggggttgccagccaagtcagcgatgtggcggtaaacagaggagataccgcatgatcgctgacaacctggcggcagcgcaaaagatg

SEQ ID NO: 115977 - DNA, 103 bp, Artificial Sequence
  Synthetic Polynucleotide
taatacgactcactatagggtgacttcagagttgccagccaagtcagcgaaacagaggagatcgctgatgtggctggcaaacctggcggcagcgcaaaagatg

SEQ ID NO: 115978 - DNA, 103 bp, Artificial Sequence
  Synthetic Polynucleotide
taatacgactcactatagggactggcaggatgacttcagagttgccagccaacagaggagaggctggatgctctgaagtaacctggcggcagcgcaaaagatg

SEQ ID NO: 115979 - DNA, 103 bp, Artificial Sequence
  Synthetic Polynucleotide
taatacgactcactataggggaacgccgggactggcaggatgacttcagaaacagaggagatctgaaatgatcctgccaaacctggcggcagcgcaaaagatg

SEQ ID NO: 115980 - DNA, 103 bp, Artificial Sequence
  Synthetic Polynucleotide
taatacgactcactatagggtgatgacattgaacgccgggactggcaggaaacagaggagatcctgcatgtcccggcgtaacctggcggcagcgcaaaagatg

SEQ ID NO: 115981 - DNA, 103 bp, Artificial Sequence
  Synthetic Polynucleotide
taatacgactcactataggggaaccgccattgatgacattgaacgccgggaacagaggagacccggcatgcaatgtcataacctggcggcagcgcaaaagatg

SEQ ID NO: 115982 - DNA, 103 bp, Artificial Sequence
  Synthetic Polynucleotide
taatacgactcactataggggccagcatgagaaccgccattgatgacattaacagaggagaaatgtcatgaatggcggtaacctggcggcagcgcaaaagatg

SEQ ID NO: 115983 - DNA, 103 bp, Artificial Sequence
  Synthetic Polynucleotide
taatacgactcactatagggccagcttgttgccagcatgagaaccgccataacagaggagaatggcgatgctcatgctgaacctggcggcagcgcaaaagatg

SEQ ID NO: 115984 - DNA, 103 bp, Artificial Sequence
  Synthetic Polynucleotide
taatacgactcactatagggtcctgcatggccagcttgttgccagcatgaaacagaggagatcatgcatgcaacaagctaacctggcggcagcgcaaaagatg

SEQ ID NO: 115985 - DNA, 103 bp, Artificial Sequence
  Synthetic Polynucleotide
taatacgactcactataggggatcatgaactcctgcatggccagcttgttaacagaggagaaacaagatggccatgcagaacctggcggcagcgcaaaagatg

SEQ ID NO: 115986 - DNA, 103 bp, Artificial Sequence
  Synthetic Polynucleotide
taatacgactcactataggggatcaacctcaacagtgggattcccgcgagaacagaggagactcgcgatgatcccactgaacctggcggcagcgcaaaagatg

SEQ ID NO: 115987 - DNA, 103 bp, Artificial Sequence
  Synthetic Polynucleotide
taatacgactcactatagggcgactgggaggatcatgaactcctgcatggaacagaggagaccatgcatgagttcatgaaacctggcggcagcgcaaaagatg

SEQ ID NO: 115988 - DNA, 103 bp, Artificial Sequence
  Synthetic Polynucleotide
taatacgactcactatagggtttgctgcaccgactgggaggatcatgaacaacagaggagagttcatatgcctcccagtaacctggcggcagcgcaaaagatg

SEQ ID NO: 115989 - DNA, 103 bp, Artificial Sequence
  Synthetic Polynucleotide
taatacgactcactatagggttccctgaagtttgctgcaccgactgggagaacagaggagactcccaatgggtgcagcaaacctggcggcagcgcaaaagatg

SEQ ID NO: 115990 - DNA, 103 bp, Artificial Sequence
  Synthetic Polynucleotide
taatacgactcactatagggtgcgcatggcttccctgaagtttgctgcacaacagaggagagtgcagatgacttcagggaacctggcggcagcgcaaaagatg

SEQ ID NO: 115991 - DNA, 103 bp, Artificial Sequence
  Synthetic Polynucleotide
taatacgactcactatagggtctgctccaatgcgcatggcttccctgaagaacagaggagacttcagatgagccatgcgaacctggcggcagcgcaaaagatg

SEQ ID NO: 115992 - DNA, 103 bp, Artificial Sequence
  Synthetic Polynucleotide
taatacgactcactataggggtggtaaacctctgctccaatgcgcatggcaacagaggagagccatgatgattggagcaaacctggcggcagcgcaaaagatg

SEQ ID NO: 115993 - DNA, 103 bp, Artificial Sequence
  Synthetic Polynucleotide
taatacgactcactatagggtcttcaggttgtggtaaacctctgctccaaaacagaggagattggagatgaggtttaccaacctggcggcagcgcaaaagatg

SEQ ID NO: 115994 - DNA, 103 bp, Artificial Sequence
  Synthetic Polynucleotide
taatacgactcactatagggttgatgacattcttcaggttgtggtaaaccaacagaggagaggtttaatgcaacctgaaaacctggcggcagcgcaaaagatg

SEQ ID NO: 115995 - DNA, 103 bp, Artificial Sequence
  Synthetic Polynucleotide
taatacgactcactatagggatatttctccttgatgacattcttcaggttaacagaggagaaacctgatgaatgtcatcaacctggcggcagcgcaaaagatg

SEQ ID NO: 115996 - DNA, 103 bp, Artificial Sequence
  Synthetic Polynucleotide
taatacgactcactatagggcatctttcccatatttctccttgatgacataacagaggagaatgtcaatgaggagaaataacctggcggcagcgcaaaagatg

SEQ ID NO: 115997 - DNA, 103 bp, Artificial Sequence
  Synthetic Polynucleotide
taatacgactcactataggggaggtgaagagatcaacctcaacagtgggaaacagaggagatcccacatgtgaggttgaaacctggcggcagcgcaaaagatg

SEQ ID NO: 115998 - DNA, 103 bp, Artificial Sequence
  Synthetic Polynucleotide
taatacgactcactatagggacattggtggcatctttcccatatttctccaacagaggagaggagaaatgtgggaaagaaacctggcggcagcgcaaaagatg

SEQ ID NO: 115999 - DNA, 103 bp, Artificial Sequence
  Synthetic Polynucleotide
taatacgactcactatagggttcatcccccacattggtggcatctttcccaacagaggagagggaaaatggccaccaataacctggcggcagcgcaaaagatg

SEQ ID NO: 116000 - DNA, 103 bp, Artificial Sequence
  Synthetic Polynucleotide
taatacgactcactatagggcaaacccgccttcatcccccacattggtggaacagaggagaccaccaatgtgggggatgaacctggcggcagcgcaaaagatg

SEQ ID NO: 116001 - DNA, 103 bp, Artificial Sequence
  Synthetic Polynucleotide
taatacgactcactatagggatgttgggagcaaacccgccttcatcccccaacagaggagagggggaatgaggcgggttaacctggcggcagcgcaaaagatg

SEQ ID NO: 116002 - DNA, 103 bp, Artificial Sequence
  Synthetic Polynucleotide
taatacgactcactatagggattctccaggatgttgggagcaaacccgccaacagaggagaggcgggatggctcccaacaacctggcggcagcgcaaaagatg

SEQ ID NO: 116003 - DNA, 103 bp, Artificial Sequence
  Synthetic Polynucleotide
taatacgactcactatagggggccttctttattctccaggatgttgggagaacagaggagactcccaatgtcctggagaaacctggcggcagcgcaaaagatg

SEQ ID NO: 116004 - DNA, 103 bp, Artificial Sequence
  Synthetic Polynucleotide
taatacgactcactatagggagcagctccaggccttctttattctccaggaacagaggagacctggaatgtaaagaaggaacctggcggcagcgcaaaagatg

SEQ ID NO: 116005 - DNA, 103 bp, Artificial Sequence
  Synthetic Polynucleotide
taatacgactcactatagggagcagtcttcagcagctccaggccttctttaacagaggagaaaagaaatgctggagctgaacctggcggcagcgcaaaagatg

SEQ ID NO: 116006 - DNA, 103 bp, Artificial Sequence
  Synthetic Polynucleotide
taatacgactcactatagggctttcccaatagcagtcttcagcagctccaaacagaggagatggagcatgtgaagactgaacctggcggcagcgcaaaagatg

SEQ ID NO: 116007 - DNA, 103 bp, Artificial Sequence
  Synthetic Polynucleotide
taatacgactcactataggggtgtagccagctttcccaatagcagtcttcaacagaggagagaagacatgtattgggaaaacctggcggcagcgcaaaagatg

SEQ ID NO: 116008 - DNA, 103 bp, Artificial Sequence
  Synthetic Polynucleotide
taatacgactcactataggggagaccttttgaggtgaagagatcaacctcaacagaggagagaggttatgctcttcaccaacctggcggcagcgcaaaagatg

SEQ ID NO: 116009 - DNA, 103 bp, Artificial Sequence
  Synthetic Polynucleotide
taatacgactcactatagggcaccttatcagtgtagccagctttcccaataacagaggagaattgggatggctggctacaacctggcggcagcgcaaaagatg

SEQ ID NO: 116010 - DNA, 103 bp, Artificial Sequence
  Synthetic Polynucleotide
taatacgactcactatagggtgccgatgaccaccttatcagtgtagccagaacagaggagactggctatgctgataaggaacctggcggcagcgcaaaagatg

SEQ ID NO: 116011 - DNA, 103 bp, Artificial Sequence
  Synthetic Polynucleotide
taatacgactcactataggggctacgtccatgccgatgaccaccttatcaaacagaggagatgataaatgggtcatcggaacctggcggcagcgcaaaagatg

SEQ ID NO: 116012 - DNA, 103 bp, Artificial Sequence
  Synthetic Polynucleotide
taatacgactcactatagggctcggaggccgctacgtccatgccgatgacaacagaggagagtcatcatgatggacgtaaacctggcggcagcgcaaaagatg

SEQ ID NO: 116013 - DNA, 103 bp, Artificial Sequence
  Synthetic Polynucleotide
taatacgactcactatagggacctgaagaactcggaggccgctacgtccaaacagaggagatggacgatgcggcctccgaacctggcggcagcgcaaaagatg

SEQ ID NO: 116014 - DNA, 103 bp, Artificial Sequence
  Synthetic Polynucleotide
taatacgactcactatagggtacttcccagacctgaagaactcggaggccaacagaggagaggcctcatggttcttcagaacctggcggcagcgcaaaagatg

SEQ ID NO: 116015 - DNA, 103 bp, Artificial Sequence
  Synthetic Polynucleotide
taatacgactcactataggggtccaggtcatacttcccagacctgaagaaaacagaggagattcttcatgtctgggaagaacctggcggcagcgcaaaagatg

SEQ ID NO: 116016 - DNA, 103 bp, Artificial Sequence
  Synthetic Polynucleotide
taatacgactcactataggggagacttgaagtccaggtcatacttcccagaacagaggagactgggaatgatgacctggaacctggcggcagcgcaaaagatg

SEQ ID NO: 116017 - DNA, 103 bp, Artificial Sequence
  Synthetic Polynucleotide
taatacgactcactataggggggtcatcgggagacttgaagtccaggtcaaacagaggagatgacctatgcttcaagtcaacctggcggcagcgcaaaagatg

SEQ ID NO: 116018 - DNA, 103 bp, Artificial Sequence
  Synthetic Polynucleotide
taatacgactcactataggggtacctgctggggtcatcgggagacttgaaaacagaggagattcaagatgcccgatgacaacctggcggcagcgcaaaagatg

SEQ ID NO: 116019 - DNA, 103 bp, Artificial Sequence
  Synthetic Polynucleotide
taatacgactcactatagggcagctctgaagagaccttttgaggtgaagaaacagaggagatcttcaatgcaaaaggtcaacctggcggcagcgcaaaagatg

SEQ ID NO: 116020 - DNA, 103 bp, Artificial Sequence
  Synthetic Polynucleotide
taatacgactcactatagggcaggcgagatgtacctgctggggtcatcggaacagaggagaccgatgatgccagcaggtaacctggcggcagcgcaaaagatg

SEQ ID NO: 116021 - DNA, 103 bp, Artificial Sequence
  Synthetic Polynucleotide
taatacgactcactataggggccagctggtcaggcgagatgtacctgctgaacagaggagacagcagatgcatctcgccaacctggcggcagcgcaaaagatg

SEQ ID NO: 116022 - DNA, 103 bp, Artificial Sequence
  Synthetic Polynucleotide
taatacgactcactataggggtacaggtcagccagctggtcaggcgagataacagaggagaatctcgatggaccagctgaacctggcggcagcgcaaaagatg

SEQ ID NO: 116023 - DNA, 103 bp, Artificial Sequence
  Synthetic Polynucleotide
taatacgactcactatagggtgaaggacttgtacaggtcagccagctggtaacagaggagaaccagcatgctgacctgtaacctggcggcagcgcaaaagatg

SEQ ID NO: 116024 - DNA, 103 bp, Artificial Sequence
  Synthetic Polynucleotide
taatacgactcactatagggtagtccttgatgaaggacttgtacaggtcaaacagaggagatgacctatgcaagtccttaacctggcggcagcgcaaaagatg

SEQ ID NO: 116025 - DNA, 103 bp, Artificial Sequence
  Synthetic Polynucleotide
taatacgactcactatagggcaccactgggtagtccttgatgaaggacttaacagaggagaaagtccatgatcaaggacaacctggcggcagcgcaaaagatg

SEQ ID NO: 116026 - DNA, 103 bp, Artificial Sequence
  Synthetic Polynucleotide
taatacgactcactatagggcttcgatagacaccactgggtagtccttgaaacagaggagatcaaggatgacccagtggaacctggcggcagcgcaaaagatg

SEQ ID NO: 116027 - DNA, 103 bp, Artificial Sequence
  Synthetic Polynucleotide
taatacgactcactatagggtcaaagggatcttcgatagacaccactgggaacagaggagacccagtatggtctatcgaaacctggcggcagcgcaaaagatg

SEQ ID NO: 116028 - DNA, 103 bp, Artificial Sequence
  Synthetic Polynucleotide
taatacgactcactataggggtcatcctggtcaaagggatcttcgatagaaacagaggagatctatcatggatccctttaacctggcggcagcgcaaaagatg

SEQ ID NO: 116029 - DNA, 103 bp, Artificial Sequence
  Synthetic Polynucleotide
taatacgactcactatagggaagctccccagtcatcctggtcaaagggataacagaggagaatccctatgaccaggatgaacctggcggcagcgcaaaagatg

SEQ ID NO: 116030 - DNA, 103 bp, Artificial Sequence
  Synthetic Polynucleotide
taatacgactcactatagggctgggcacagcagctctgaagagaccttttaacagaggagaaaaaggatgcttcagagcaacctggcggcagcgcaaaagatg

SEQ ID NO: 116031 - DNA, 103 bp, Artificial Sequence
  Synthetic Polynucleotide
taatacgactcactatagggaacttctgccaagctccccagtcatcctggaacagaggagaccaggaatgctggggagcaacctggcggcagcgcaaaagatg

SEQ ID NO: 116032 - DNA, 103 bp, Artificial Sequence
  Synthetic Polynucleotide
taatacgactcactatagggactggctgtgaacttctgccaagctccccaaacagaggagatggggaatgtggcagaagaacctggcggcagcgcaaaagatg

SEQ ID NO: 116033 - DNA, 103 bp, Artificial Sequence
  Synthetic Polynucleotide
taatacgactcactatagggggattcctgcactggctgtgaacttctgccaacagaggagaggcagaatgtcacagccaaacctggcggcagcgcaaaagatg

SEQ ID NO: 116034 - DNA, 103 bp, Artificial Sequence
  Synthetic Polynucleotide
taatacgactcactatagggcccactacctggattcctgcactggctgtgaacagaggagacacagcatgtgcaggaataacctggcggcagcgcaaaagatg

SEQ ID NO: 116035 - DNA, 103 bp, Artificial Sequence
  Synthetic Polynucleotide
taatacgactcactataggggagatcatcccccactacctggattcctgcaacagaggagagcaggaatgcaggtagtgaacctggcggcagcgcaaaagatg

SEQ ID NO: 116036 - DNA, 103 bp, Artificial Sequence
  Synthetic Polynucleotide
taatacgactcactatagggtggtcactgtgagatcatcccccactacctaacagaggagaaggtagatggggatgatcaacctggcggcagcgcaaaagatg

SEQ ID NO: 116037 - DNA, 103 bp, Artificial Sequence
  Synthetic Polynucleotide
taatacgactcactatagggctctttgggttggtcactgtgagatcatccaacagaggagaggatgaatgcacagtgacaacctggcggcagcgcaaaagatg

SEQ ID NO: 116038 - DNA, 103 bp, Artificial Sequence
  Synthetic Polynucleotide
taatacgactcactatagggcttggcgatcctctttgggttggtcactgtaacagaggagaacagtgatgaacccaaagaacctggcggcagcgcaaaagatg

SEQ ID NO: 116039 - DNA, 103 bp, Artificial Sequence
  Synthetic Polynucleotide
taatacgactcactatagggcgttcacggccttggcgatcctctttgggtaacagaggagaacccaaatgggatcgccaaacctggcggcagcgcaaaagatg

SEQ ID NO: 116040 - DNA, 103 bp, Artificial Sequence
  Synthetic Polynucleotide
taatacgactcactatagggcaggacttctcgttcacggccttggcgatcaacagaggagagatcgcatgggccgtgaaaacctggcggcagcgcaaaagatg

SEQ ID NO: 116041 - DNA, 103 bp, Artificial Sequence
  Synthetic Polynucleotide
taatacgactcactataggggctcaccaagagctgctcccctaactgcataacagaggagaatgcagatgggggagcagaacctggcggcagcgcaaaagatg

SEQ ID NO: 116042 - DNA, 103 bp, Artificial Sequence
  Synthetic Polynucleotide
taatacgactcactatagggggccgcgctggggaggtggccagcgctcccaacagaggagagggagcatgggccacctcaacctggcggcagcgcaaaagatg

SEQ ID NO: 116043 - DNA, 103 bp, Artificial Sequence
  Synthetic Polynucleotide
taatacgactcactatagggggctttgccacaggtcacccatttgcccccaacagaggagagggggcatgtgggtgaccaacctggcggcagcgcaaaagatg

SEQ ID NO: 116044 - DNA, 103 bp, Artificial Sequence
  Synthetic Polynucleotide
taatacgactcactatagggtgttattgtcggctttgccacaggtcacccaacagaggagagggtgaatggtggcaaagaacctggcggcagcgcaaaagatg

SEQ ID NO: 116045 - DNA, 103 bp, Artificial Sequence
  Synthetic Polynucleotide
taatacgactcactatagggttgccctgcatgttattgtcggctttgccaaacagaggagatggcaaatgcgacaataaaacctggcggcagcgcaaaagatg

SEQ ID NO: 116046 - DNA, 103 bp, Artificial Sequence
  Synthetic Polynucleotide
taatacgactcactatagggatacattttgttgccctgcatgttattgtcaacagaggagagacaatatgatgcagggcaacctggcggcagcgcaaaagatg

SEQ ID NO: 116047 - DNA, 103 bp, Artificial Sequence
  Synthetic Polynucleotide
taatacgactcactatagggctgggtgaacatacattttgttgccctgcaaacagaggagatgcaggatgacaaaatgtaacctggcggcagcgcaaaagatg

SEQ ID NO: 116048 - DNA, 103 bp, Artificial Sequence
  Synthetic Polynucleotide
taatacgactcactatagggttaggagactctgggtgaacatacattttgaacagaggagacaaaatatgtgttcacccaacctggcggcagcgcaaaagatg

SEQ ID NO: 116049 - DNA, 103 bp, Artificial Sequence
  Synthetic Polynucleotide
taatacgactcactatagggggaaccagtattaggagactctgggtgaacaacagaggagagttcacatggagtctcctaacctggcggcagcgcaaaagatg

SEQ ID NO: 116050 - DNA, 103 bp, Artificial Sequence
  Synthetic Polynucleotide
taatacgactcactatagggtcatccagtgggaaccagtattaggagactaacagaggagaagtctcatgatactggttaacctggcggcagcgcaaaagatg

SEQ ID NO: 116051 - DNA, 103 bp, Artificial Sequence
  Synthetic Polynucleotide
taatacgactcactatagggatctcctgtctcatccagtgggaaccagtaaacagaggagatactggatgccactggataacctggcggcagcgcaaaagatg

SEQ ID NO: 116052 - DNA, 103 bp, Artificial Sequence
  Synthetic Polynucleotide
taatacgactcactatagggcccgaatgaaatctcctgtctcatccagtgaacagaggagacactggatgagacaggagaacctggcggcagcgcaaaagatg

SEQ ID NO: 116053 - DNA, 103 bp, Artificial Sequence
  Synthetic Polynucleotide
taatacgactcactataggggaggagagggggccgcgctggggaggtggcaacagaggagagccaccatgccagcgcggaacctggcggcagcgcaaaagatg

SEQ ID NO: 116054 - DNA, 103 bp, Artificial Sequence
  Synthetic Polynucleotide
taatacgactcactataggggttttaatttcccgaatgaaatctcctgtcaacagaggagagacaggatgtttcattcgaacctggcggcagcgcaaaagatg

SEQ ID NO: 116055 - DNA, 103 bp, Artificial Sequence
  Synthetic Polynucleotide
taatacgactcactatagggttattggtgagttttaatttcccgaatgaaaacagaggagattcattatggaaattaaaaacctggcggcagcgcaaaagatg

SEQ ID NO: 116056 - DNA, 103 bp, Artificial Sequence
  Synthetic Polynucleotide
taatacgactcactatagggtgcgcctttgttattggtgagttttaatttaacagaggagaaaattaatgctcaccaataacctggcggcagcgcaaaagatg

SEQ ID NO: 116057 - DNA, 103 bp, Artificial Sequence
  Synthetic Polynucleotide
taatacgactcactatagggtgttgttatttgcgcctttgttattggtgaaacagaggagatcaccaatgacaaaggcgaacctggcggcagcgcaaaagatg

SEQ ID NO: 116058 - DNA, 103 bp, Artificial Sequence
  Synthetic Polynucleotide
taatacgactcactatagggatctgggtgttgttgttatttgcgcctttgaacagaggagacaaaggatgaaataacaaaacctggcggcagcgcaaaagatg

SEQ ID NO: 116059 - DNA, 103 bp, Artificial Sequence
  Synthetic Polynucleotide
taatacgactcactatagggtaagactatcatctgggtgttgttgttattaacagaggagaaataacatgaacacccagaacctggcggcagcgcaaaagatg

SEQ ID NO: 116060 - DNA, 103 bp, Artificial Sequence
  Synthetic Polynucleotide
taatacgactcactataggggtaaggattgtaagactatcatctgggtgtaacagaggagaacacccatgtgatagtctaacctggcggcagcgcaaaagatg

SEQ ID NO: 116061 - DNA, 103 bp, Artificial Sequence
  Synthetic Polynucleotide
taatacgactcactatagggtggtatttgtgtaaggattgtaagactatcaacagaggagagatagtatgacaatccttaacctggcggcagcgcaaaagatg

SEQ ID NO: 116062 - DNA, 103 bp, Artificial Sequence
  Synthetic Polynucleotide
taatacgactcactatagggcagtcggggttggtatttgtgtaaggattgaacagaggagacaatccatgcacaaatacaacctggcggcagcgcaaaagatg

SEQ ID NO: 116063 - DNA, 103 bp, Artificial Sequence
  Synthetic Polynucleotide
taatacgactcactatagggcaacaatatgcagtcggggttggtatttgtaacagaggagaacaaatatgaaccccgacaacctggcggcagcgcaaaagatg

SEQ ID NO: 116064 - DNA, 103 bp, Artificial Sequence
  Synthetic Polynucleotide
taatacgactcactatagggtccaacttctgaggagagggggccgcgctgaacagaggagacagcgcatgcccctctccaacctggcggcagcgcaaaagatg

SEQ ID NO: 116065 - DNA, 103 bp, Artificial Sequence
  Synthetic Polynucleotide
taatacgactcactatagggtctgtaacttcaacaatatgcagtcggggtaacagaggagaaccccgatggcatattgtaacctggcggcagcgcaaaagatg

SEQ ID NO: 116066 - DNA, 103 bp, Artificial Sequence
  Synthetic Polynucleotide
taatacgactcactatagggcacgccatcctctgtaacttcaacaatatgaacagaggagacatattatggaagttacaaacctggcggcagcgcaaaagatg

SEQ ID NO: 116067 - DNA, 103 bp, Artificial Sequence
  Synthetic Polynucleotide
taatacgactcactatagggtcaagtcctccacgccatcctctgtaacttaacagaggagaaagttaatgaggatggcgaacctggcggcagcgcaaaagatg

SEQ ID NO: 116068 - DNA, 103 bp, Artificial Sequence
  Synthetic Polynucleotide
taatacgactcactataggggagggctcattcaagtcctccacgccatccaacagaggagaggatggatgggaggacttaacctggcggcagcgcaaaagatg

SEQ ID NO: 116069 - DNA, 103 bp, Artificial Sequence
  Synthetic Polynucleotide
taatacgactcactatagggctgggtctttgagggctcattcaagtcctcaacagaggagagaggacatgaatgagcccaacctggcggcagcgcaaaagatg

SEQ ID NO: 116070 - DNA, 103 bp, Artificial Sequence
  Synthetic Polynucleotide
taatacgactcactatagggaggtaaaagtctgggtctttgagggctcataacagaggagaatgagcatgcaaagacccaacctggcggcagcgcaaaagatg

SEQ ID NO: 116071 - DNA, 103 bp, Artificial Sequence
  Synthetic Polynucleotide
taatacgactcactataggggtttctgagaaggtaaaagtctgggtctttaacagaggagaaaagacatggacttttacaacctggcggcagcgcaaaagatg

SEQ ID NO: 116072 - DNA, 103 bp, Artificial Sequence
  Synthetic Polynucleotide
taatacgactcactatagggaatgaattgcgtttctgagaaggtaaaagtaacagaggagaacttttatgttctcagaaaacctggcggcagcgcaaaagatg

SEQ ID NO: 116073 - DNA, 103 bp, Artificial Sequence
  Synthetic Polynucleotide
taatacgactcactatagggcagtcactgcaatgaattgcgtttctgagaaacagaggagatctcagatgcgcaattcaaacctggcggcagcgcaaaagatg

SEQ ID NO: 116074 - DNA, 103 bp, Artificial Sequence
  Synthetic Polynucleotide
taatacgactcactatagggttttggtaggcagtcactgcaatgaattgcaacagaggagagcaattatgtgcagtgacaacctggcggcagcgcaaaagatg

SEQ ID NO: 116075 - DNA, 103 bp, Artificial Sequence
  Synthetic Polynucleotide
taatacgactcactatagggtttgtctaagtccaacttctgaggagagggaacagaggagaccctctatgcagaagttgaacctggcggcagcgcaaaagatg

SEQ ID NO: 116076 - DNA, 103 bp, Artificial Sequence
  Synthetic Polynucleotide
taatacgactcactatagggaatatcggtgttttggtaggcagtcactgcaacagaggagagcagtgatggcctaccaaaacctggcggcagcgcaaaagatg

SEQ ID NO: 116077 - DNA, 103 bp, Artificial Sequence
  Synthetic Polynucleotide
taatacgactcactatagggttagttgagtaatatcggtgttttggtaggaacagaggagacctaccatgacaccgataaacctggcggcagcgcaaaagatg

SEQ ID NO: 116078 - DNA, 103 bp, Artificial Sequence
  Synthetic Polynucleotide
taatacgactcactatagggtgatcaatctttagttgagtaatatcggtgaacagaggagacaccgaatgtactcaactaacctggcggcagcgcaaaagatg

SEQ ID NO: 116079 - DNA, 103 bp, Artificial Sequence
  Synthetic Polynucleotide
taatacgactcactatagggaaaggggttatgatcaatctttagttgagtaacagaggagaactcaaatgaagattgataacctggcggcagcgcaaaagatg

SEQ ID NO: 116080 - DNA, 103 bp, Artificial Sequence
  Synthetic Polynucleotide
taatacgactcactatagggagccttttgcaaaggggttatgatcaatctaacagaggagaagattgatgataacccctaacctggcggcagcgcaaaagatg

SEQ ID NO: 116081 - DNA, 103 bp, Artificial Sequence
  Synthetic Polynucleotide
taatacgactcactatagggttgtctctgaagccttttgcaaaggggttaaacagaggagataacccatgtgcaaaaggaacctggcggcagcgcaaaagatg

SEQ ID NO: 116082 - DNA, 103 bp, Artificial Sequence
  Synthetic Polynucleotide
taatacgactcactatagggggaatcatagttgtctctgaagccttttgcaacagaggagagcaaaaatgttcagagacaacctggcggcagcgcaaaagatg

SEQ ID NO: 116083 - DNA, 103 bp, Artificial Sequence
  Synthetic Polynucleotide
taatacgactcactatagggcggtgtacatggaatcatagttgtctctgaaacagaggagatcagagatgactatgattaacctggcggcagcgcaaaagatg

SEQ ID NO: 116084 - DNA, 103 bp, Artificial Sequence
  Synthetic Polynucleotide
taatacgactcactatagggttttctgaagcggtgtacatggaatcatagaacagaggagactatgaatgcatgtacacaacctggcggcagcgcaaaagatg

SEQ ID NO: 116085 - DNA, 103 bp, Artificial Sequence
  Synthetic Polynucleotide
taatacgactcactatagggtaacctgtcattttctgaagcggtgtacataacagaggagaatgtacatggcttcagaaaacctggcggcagcgcaaaagatg

SEQ ID NO: 116086 - DNA, 103 bp, Artificial Sequence
  Synthetic Polynucleotide
taatacgactcactatagggtcttggacgctttgtctaagtccaacttctaacagaggagaagaagtatgacttagacaaacctggcggcagcgcaaaagatg

SEQ ID NO: 116087 - DNA, 103 bp, Artificial Sequence
  Synthetic Polynucleotide
taatacgactcactataggggagatggagttaacctgtcattttctgaagaacagaggagacttcagatgatgacaggtaacctggcggcagcgcaaaagatg

SEQ ID NO: 116088 - DNA, 103 bp, Artificial Sequence
  Synthetic Polynucleotide
taatacgactcactataggggaatccgtgggagatggagttaacctgtcaaacagaggagatgacagatgaactccatcaacctggcggcagcgcaaaagatg

SEQ ID NO: 116089 - DNA, 103 bp, Artificial Sequence
  Synthetic Polynucleotide
taatacgactcactatagggggatctaggagaatccgtgggagatggagtaacagaggagaactccaatgcccacggataacctggcggcagcgcaaaagatg

SEQ ID NO: 116090 - DNA, 103 bp, Artificial Sequence
  Synthetic Polynucleotide
taatacgactcactatagggcaatctgatgggatctaggagaatccgtggaacagaggagaccacggatgctcctagataacctggcggcagcgcaaaagatg

SEQ ID NO: 116091 - DNA, 103 bp, Artificial Sequence
  Synthetic Polynucleotide
taatacgactcactatagggcctccagggacaatctgatgggatctaggaaacagaggagatcctagatgccatcagataacctggcggcagcgcaaaagatg

SEQ ID NO: 116092 - DNA, 103 bp, Artificial Sequence
  Synthetic Polynucleotide
taatacgactcactataggggccgtaccgacctccagggacaatctgatgaacagaggagacatcagatggtccctggaaacctggcggcagcgcaaaagatg

SEQ ID NO: 116093 - DNA, 103 bp, Artificial Sequence
  Synthetic Polynucleotide
taatacgactcactatagggaggattgaacgccgtaccgacctccagggaaacagaggagatccctgatggtcggtacgaacctggcggcagcgcaaaagatg

SEQ ID NO: 116094 - DNA, 103 bp, Artificial Sequence
  Synthetic Polynucleotide
taatacgactcactatagggtccgggaagaaggattgaacgccgtaccgaaacagaggagatcggtaatgcgttcaatcaacctggcggcagcgcaaaagatg

SEQ ID NO: 116095 - DNA, 103 bp, Artificial Sequence
  Synthetic Polynucleotide
taatacgactcactataggggacaaagggctccgggaagaaggattgaacaacagaggagagttcaaatgttcttcccgaacctggcggcagcgcaaaagatg

SEQ ID NO: 116096 - DNA, 103 bp, Artificial Sequence
  Synthetic Polynucleotide
taatacgactcactataggggtaaagtgttgacaaagggctccgggaagaaacagaggagatcttccatgagccctttgaacctggcggcagcgcaaaagatg

SEQ ID NO: 116097 - DNA, 103 bp, Artificial Sequence
  Synthetic Polynucleotide
taatacgactcactatagggccggaaaacttcttggacgctttgtctaagaacagaggagacttagaatgagcgtccaaaacctggcggcagcgcaaaagatg

SEQ ID NO: 116098 - DNA, 103 bp, Artificial Sequence
  Synthetic Polynucleotide
taatacgactcactatagggcgggcttgaggtaaagtgttgacaaagggcaacagaggagagcccttatgcaacactttaacctggcggcagcgcaaaagatg

SEQ ID NO: 116099 - DNA, 103 bp, Artificial Sequence
  Synthetic Polynucleotide
taatacgactcactatagggattataatagcgggcttgaggtaaagtgttaacagaggagaaacactatgcctcaagccaacctggcggcagcgcaaaagatg

SEQ ID NO: 116100 - DNA, 103 bp, Artificial Sequence
  Synthetic Polynucleotide
taatacgactcactatagggttctctcgccattataatagcgggcttgagaacagaggagactcaagatggctattataaacctggcggcagcgcaaaagatg

SEQ ID NO: 116101 - DNA, 103 bp, Artificial Sequence
  Synthetic Polynucleotide
taatacgactcactatagggtgtggcacggttctctcgccattataatagaacagaggagactattaatgtggcgagagaacctggcggcagcgcaaaagatg

SEQ ID NO: 116102 - DNA, 103 bp, Artificial Sequence
  Synthetic Polynucleotide
taatacgactcactataggggccgttggtctgtggcacggttctctcgccaacagaggagaggcgagatgaccgtgccaaacctggcggcagcgcaaaagatg

SEQ ID NO: 116103 - DNA, 103 bp, Artificial Sequence
  Synthetic Polynucleotide
taatacgactcactataggggtgaaaggaggccgttggtctgtggcacggaacagaggagaccgtgcatgagaccaacgaacctggcggcagcgcaaaagatg

SEQ ID NO: 116104 - DNA, 103 bp, Artificial Sequence
  Synthetic Polynucleotide
taatacgactcactatagggctctgttggggtgaaaggaggccgttggtcaacagaggagagaccaaatgcctcctttcaacctggcggcagcgcaaaagatg

SEQ ID NO: 116105 - DNA, 103 bp, Artificial Sequence
  Synthetic Polynucleotide
taatacgactcactatagggcacctcttcgctctgttggggtgaaaggagaacagaggagactccttatgccccaacagaacctggcggcagcgcaaaagatg

SEQ ID NO: 116106 - DNA, 103 bp, Artificial Sequence
  Synthetic Polynucleotide
taatacgactcactataggggagggttggccacctcttcgctctgttgggaacagaggagacccaacatggcgaagaggaacctggcggcagcgcaaaagatg

SEQ ID NO: 116107 - DNA, 103 bp, Artificial Sequence
  Synthetic Polynucleotide
taatacgactcactatagggcaccgctggggagggttggccacctcttcgaacagaggagacgaagaatgggccaacccaacctggcggcagcgcaaaagatg

SEQ ID NO: 116108 - DNA, 103 bp, Artificial Sequence
  Synthetic Polynucleotide
taatacgactcactatagggggagagactgccggaaaacttcttggacgcaacagaggagagcgtccatgaagttttccaacctggcggcagcgcaaaagatg

SEQ ID NO: 116109 - DNA, 103 bp, Artificial Sequence
  Synthetic Polynucleotide
taatacgactcactatagggcgtgacaagccaccgctggggagggttggcaacagaggagagccaacatgccccagcggaacctggcggcagcgcaaaagatg

SEQ ID NO: 116110 - DNA, 103 bp, Artificial Sequence
  Synthetic Polynucleotide
taatacgactcactataggggctggacaggcgtgacaagccaccgctgggaacagaggagacccagcatgggcttgtcaaacctggcggcagcgcaaaagatg

SEQ ID NO: 116111 - DNA, 103 bp, Artificial Sequence
  Synthetic Polynucleotide
taatacgactcactataggggtcccaggttgctggacaggcgtgacaagcaacagaggagagcttgtatggcctgtccaaacctggcggcagcgcaaaagatg

SEQ ID NO: 116112 - DNA, 103 bp, Artificial Sequence
  Synthetic Polynucleotide
taatacgactcactatagggtagtttgttggtcccaggttgctggacaggaacagaggagacctgtcatgcaacctgggaacctggcggcagcgcaaaagatg

SEQ ID NO: 116113 - DNA, 103 bp, Artificial Sequence
  Synthetic Polynucleotide
taatacgactcactatagggaactgatgtctagtttgttggtcccaggttaacagaggagaaacctgatgccaacaaacaacctggcggcagcgcaaaagatg

SEQ ID NO: 116114 - DNA, 103 bp, Artificial Sequence
  Synthetic Polynucleotide
taatacgactcactataggggattcataggaactgatgtctagtttgttgaacagaggagacaacaaatgagacatcagaacctggcggcagcgcaaaagatg

SEQ ID NO: 116115 - DNA, 103 bp, Artificial Sequence
  Synthetic Polynucleotide
taatacgactcactatagggagtatattcagattcataggaactgatgtcaacagaggagagacatcatgtcctatgaaaacctggcggcagcgcaaaagatg

SEQ ID NO: 116116 - DNA, 103 bp, Artificial Sequence
  Synthetic Polynucleotide
taatacgactcactatagggatgtgctagaagtatattcagattcataggaacagaggagacctatgatgctgaatataaacctggcggcagcgcaaaagatg

SEQ ID NO: 116117 - DNA, 103 bp, Artificial Sequence
  Synthetic Polynucleotide
taatacgactcactatagggtatgggagcaatgtgctagaagtatattcaaacagaggagatgaataatgttctagcacaacctggcggcagcgcaaaagatg

SEQ ID NO: 116118 - DNA, 103 bp, Artificial Sequence
  Synthetic Polynucleotide
taatacgactcactatagggtttaatgccatatgggagcaatgtgctagaaacagaggagatctagcatgttgctcccaaacctggcggcagcgcaaaagatg

SEQ ID NO: 116119 - DNA, 103 bp, Artificial Sequence
  Synthetic Polynucleotide
taatacgactcactatagggccgcctcgcaggagagactgccggaaaactaacagaggagaagttttatggcagtctctaacctggcggcagcgcaaaagatg

SEQ ID NO: 116120 - DNA, 103 bp, Artificial Sequence
  Synthetic Polynucleotide
taatacgactcactatagggggggcaaggatttaatgccatatgggagcaaacagaggagatgctccatgatggcattaaacctggcggcagcgcaaaagatg

SEQ ID NO: 116121 - DNA, 103 bp, Artificial Sequence
  Synthetic Polynucleotide
taatacgactcactataggggatgtctgaaggggcaaggatttaatgccaaacagaggagatggcatatgatccttgccaacctggcggcagcgcaaaagatg

SEQ ID NO: 116122 - DNA, 103 bp, Artificial Sequence
  Synthetic Polynucleotide
taatacgactcactatagggcagggcatgggatgtctgaaggggcaaggaaacagaggagatccttgatgcttcagacaaacctggcggcagcgcaaaagatg

SEQ ID NO: 116123 - DNA, 103 bp, Artificial Sequence
  Synthetic Polynucleotide
taatacgactcactatagggggtaataccccagggcatgggatgtctgaaaacagaggagattcagaatgcccatgcccaacctggcggcagcgcaaaagatg

SEQ ID NO: 116124 - DNA, 103 bp, Artificial Sequence
  Synthetic Polynucleotide
taatacgactcactataggggttgggtctgggtaataccccagggcatggaacagaggagaccatgcatgggggtattaaacctggcggcagcgcaaaagatg

SEQ ID NO: 116125 - DNA, 103 bp, Artificial Sequence
  Synthetic Polynucleotide
taatacgactcactatagggtgcaggaaaggttgggtctgggtaatacccaacagaggagagggtatatgccagacccaaacctggcggcagcgcaaaagatg

SEQ ID NO: 116126 - DNA, 103 bp, Artificial Sequence
  Synthetic Polynucleotide
taatacgactcactatagggaccctgccattgcaggaaaggttgggtctgaacagaggagacagaccatgcctttcctgaacctggcggcagcgcaaaagatg

SEQ ID NO: 116127 - DNA, 103 bp, Artificial Sequence
  Synthetic Polynucleotide
taatacgactcactatagggcgacctccccaccctgccattgcaggaaagaacagaggagactttccatgaatggcaggaacctggcggcagcgcaaaagatg

SEQ ID NO: 116128 - DNA, 103 bp, Artificial Sequence
  Synthetic Polynucleotide
taatacgactcactataggggtaagaacctcgacctccccaccctgccataacagaggagaatggcaatgtggggaggtaacctggcggcagcgcaaaagatg

SEQ ID NO: 116129 - DNA, 103 bp, Artificial Sequence
  Synthetic Polynucleotide
taatacgactcactatagggtcttcctctggtaagaacctcgacctccccaacagaggagaggggagatggaggttcttaacctggcggcagcgcaaaagatg

SEQ ID NO: 116130 - DNA, 103 bp, Artificial Sequence
  Synthetic Polynucleotide
taatacgactcactatagggtccccgctcaccgcctcgcaggagagactgaacagaggagacagtctatgctgcgaggcaacctggcggcagcgcaaaagatg

SEQ ID NO: 116131 - DNA, 103 bp, Artificial Sequence
  Synthetic Polynucleotide
taatacgactcactatagggccagctgccatcttcctctggtaagaacctaacagaggagaaggttcatgccagaggaaaacctggcggcagcgcaaaagatg

SEQ ID NO: 116132 - DNA, 103 bp, Artificial Sequence
  Synthetic Polynucleotide
taatacgactcactatagggccatggtagtccagctgccatcttcctctgaacagaggagacagaggatgatggcagctaacctggcggcagcgcaaaagatg

SEQ ID NO: 116133 - DNA, 103 bp, Artificial Sequence
  Synthetic Polynucleotide
taatacgactcactatagggttctggaggtccatggtagtccagctgccaaacagaggagatggcagatggactaccataacctggcggcagcgcaaaagatg

SEQ ID NO: 116134 - DNA, 103 bp, Artificial Sequence
  Synthetic Polynucleotide
taatacgactcactataggggtggggcttgttctggaggtccatggtagtaacagaggagaactaccatggacctccagaacctggcggcagcgcaaaagatg

SEQ ID NO: 116135 - DNA, 103 bp, Artificial Sequence
  Synthetic Polynucleotide
taatacgactcactatagggagagaacacagtggggcttgttctggaggtaacagaggagaacctccatgacaagccccaacctggcggcagcgcaaaagatg

SEQ ID NO: 116136 - DNA, 103 bp, Artificial Sequence
  Synthetic Polynucleotide
taatacgactcactataggggctgatcttcagagaacacagtggggcttgaacagaggagacaagccatgctgtgttctaacctggcggcagcgcaaaagatg

SEQ ID NO: 116137 - DNA, 103 bp, Artificial Sequence
  Synthetic Polynucleotide
taatacgactcactatagggtccttggagagctgatcttcagagaacacaaacagaggagatgtgttatgtgaagatcaaacctggcggcagcgcaaaagatg

SEQ ID NO: 116138 - DNA, 103 bp, Artificial Sequence
  Synthetic Polynucleotide
taatacgactcactatagggtttcactttctccttggagagctgatcttcaacagaggagagaagatatgctctccaagaacctggcggcagcgcaaaagatg

SEQ ID NO: 116139 - DNA, 103 bp, Artificial Sequence
  Synthetic Polynucleotide
taatacgactcactatagggcaatttcctctttcactttctccttggagaaacagaggagatctccaatgagaaagtgaaacctggcggcagcgcaaaagatg

SEQ ID NO: 116140 - DNA, 103 bp, Artificial Sequence
  Synthetic Polynucleotide
taatacgactcactatagggcaagaagagccaatttcctctttcactttcaacagaggagagaaagtatgagaggaaataacctggcggcagcgcaaaagatg

SEQ ID NO: 116141 - DNA, 103 bp, Artificial Sequence
  Synthetic Polynucleotide
taatacgactcactatagggggctgcgggctccccgctcaccgcctcgcaaacagaggagatgcgagatggtgagcgggaacctggcggcagcgcaaaagatg

SEQ ID NO: 116142 - DNA, 103 bp, Artificial Sequence
  Synthetic Polynucleotide
taatacgactcactatagggtgtctctatccaagaagagccaatttcctcaacagaggagagaggaaatgggctcttctaacctggcggcagcgcaaaagatg

SEQ ID NO: 116143 - DNA, 103 bp, Artificial Sequence
  Synthetic Polynucleotide
taatacgactcactatagggtggaagggggtgtctctatccaagaagagcaacagaggagagctcttatgggatagagaaacctggcggcagcgcaaaagatg

SEQ ID NO: 116144 - DNA, 103 bp, Artificial Sequence
  Synthetic Polynucleotide
taatacgactcactatagggagagatttgatggaagggggtgtctctatcaacagaggagagatagaatgacccccttcaacctggcggcagcgcaaaagatg

SEQ ID NO: 116145 - DNA, 103 bp, Artificial Sequence
  Synthetic Polynucleotide
taatacgactcactatagggattggaatctagagatttgatggaagggggaacagaggagaccccctatgatcaaatctaacctggcggcagcgcaaaagatg

SEQ ID NO: 116146 - DNA, 103 bp, Artificial Sequence
  Synthetic Polynucleotide
taatacgactcactatagggctcctgaatcattggaatctagagatttgaaacagaggagatcaaatatgtagattccaaacctggcggcagcgcaaaagatg

SEQ ID NO: 116147 - DNA, 103 bp, Artificial Sequence
  Synthetic Polynucleotide
taatacgactcactatagggctggtgtatactcctgaatcattggaatctaacagaggagaagattcatgtgattcaggaacctggcggcagcgcaaaagatg

SEQ ID NO: 116148 - DNA, 103 bp, Artificial Sequence
  Synthetic Polynucleotide
taatacgactcactatagggcttacaagcactggtgtatactcctgaatcaacagaggagagattcaatggtatacaccaacctggcggcagcgcaaaagatg

SEQ ID NO: 116149 - DNA, 103 bp, Artificial Sequence
  Synthetic Polynucleotide
taatacgactcactataggggccgccttcgcttacaagcactggtgtataaacagaggagatatacaatggtgcttgtaaacctggcggcagcgcaaaagatg

SEQ ID NO: 116150 - DNA, 103 bp, Artificial Sequence
  Synthetic Polynucleotide
taatacgactcactatagggctaggagacagccgccttcgcttacaagcaaacagaggagatgcttgatggcgaaggcgaacctggcggcagcgcaaaagatg

SEQ ID NO: 116151 - DNA, 103 bp, Artificial Sequence
  Synthetic Polynucleotide
taatacgactcactatagggactggagttgctaggagacagccgccttcgaacagaggagacgaaggatgctgtctcctaacctggcggcagcgcaaaagatg

SEQ ID NO: 116152 - DNA, 103 bp, Artificial Sequence
  Synthetic Polynucleotide
taatacgactcactatagggggttcactgagctcaccaagagctgctcccaacagaggagagggagcatgtcttggtgaaacctggcggcagcgcaaaagatg

SEQ ID NO: 116153 - DNA, 103 bp, Artificial Sequence
  Synthetic Polynucleotide
taatacgactcactatagggctgcgctggcggctgcgggctccccgctcaaacagaggagatgagcgatgagcccgcagaacctggcggcagcgcaaaagatg

SEQ ID NO: 116154 - DNA, 103 bp, Artificial Sequence
  Synthetic Polynucleotide
taatacgactcactatagggaattttcattactggagttgctaggagacaaacagaggagatgtctcatggcaactccaaacctggcggcagcgcaaaagatg

SEQ ID NO: 116155 - DNA, 103 bp, Artificial Sequence
  Synthetic Polynucleotide
taatacgactcactatagggatggagggtgaattttcattactggagttgaacagaggagacaactcatgtaatgaaaaaacctggcggcagcgcaaaagatg

SEQ ID NO: 116156 - DNA, 103 bp, Artificial Sequence
  Synthetic Polynucleotide
taatacgactcactatagggctcacactttatggagggtgaattttcattaacagaggagaaatgaaatgtcaccctccaacctggcggcagcgcaaaagatg

SEQ ID NO: 116157 - DNA, 103 bp, Artificial Sequence
  Synthetic Polynucleotide
taatacgactcactatagggcattaatgtcctcacactttatggagggtgaacagaggagacaccctatgtaaagtgtgaacctggcggcagcgcaaaagatg

SEQ ID NO: 116158 - DNA, 103 bp, Artificial Sequence
  Synthetic Polynucleotide
taatacgactcactatagggtactcttcagcattaatgtcctcacactttaacagaggagaaaagtgatgggacattaaaacctggcggcagcgcaaaagatg

SEQ ID NO: 116159 - DNA, 103 bp, Artificial Sequence
  Synthetic Polynucleotide
taatacgactcactataggggtctttactatactcttcagcattaatgtcaacagaggagagacattatggctgaagagaacctggcggcagcgcaaaagatg

SEQ ID NO: 116160 - DNA, 103 bp, Artificial Sequence
  Synthetic Polynucleotide
taatacgactcactatagggcttttgaggtgtctttactatactcttcagaacagaggagactgaagatgatagtaaagaacctggcggcagcgcaaaagatg

SEQ ID NO: 116161 - DNA, 103 bp, Artificial Sequence
  Synthetic Polynucleotide
taatacgactcactatagggcctcccatgccttttgaggtgtctttactaaacagaggagatagtaaatgcacctcaaaaacctggcggcagcgcaaaagatg

SEQ ID NO: 116162 - DNA, 103 bp, Artificial Sequence
  Synthetic Polynucleotide
taatacgactcactatagggagcataataccctcccatgccttttgaggtaacagaggagaacctcaatgggcatgggaaacctggcggcagcgcaaaagatg

SEQ ID NO: 116163 - DNA, 103 bp, Artificial Sequence
  Synthetic Polynucleotide
taatacgactcactatagggttgtgtaaaaagcataataccctcccatgcaacagaggagagcatggatgggtattatgaacctggcggcagcgcaaaagatg

SEQ ID NO: 116164 - DNA, 103 bp, Artificial Sequence
  Synthetic Polynucleotide
taatacgactcactataggggcgggggcccctgcgctggcggctgcgggcaacagaggagagcccgcatgcgccagcgcaacctggcggcagcgcaaaagatg

SEQ ID NO: 116165 - DNA, 103 bp, Artificial Sequence
  Synthetic Polynucleotide
taatacgactcactatagggaagcatggccgcgggggcccctgcgctggcaacagaggagagccagcatgggggcccccaacctggcggcagcgcaaaagatg

SEQ ID NO: 116166 - DNA, 103 bp, Artificial Sequence
  Synthetic Polynucleotide
taatacgactcactatagggcggtgtcactaagcatggccgcgggggcccaacagaggagagggcccatgcggccatgcaacctggcggcagcgcaaaagatg

SEQ ID NO: 116167 - DNA, 103 bp, Artificial Sequence
  Synthetic Polynucleotide
taatacgactcactatagggtccccggcgtcggtgtcactaagcatggccaacagaggagaggccatatgtagtgacacaacctggcggcagcgcaaaagatg

SEQ ID NO: 116168 - DNA, 103 bp, Artificial Sequence
  Synthetic Polynucleotide
taatacgactcactatagggggcaaatgcgtccccggcgtcggtgtcactaacagaggagaagtgacatggacgccgggaacctggcggcagcgcaaaagatg

SEQ ID NO: 116169 - DNA, 103 bp, Artificial Sequence
  Synthetic Polynucleotide
taatacgactcactatagggccgcagcgctggcaaatgcgtccccggcgtaacagaggagaacgccgatgacgcatttgaacctggcggcagcgcaaaagatg

SEQ ID NO: 116170 - DNA, 103 bp, Artificial Sequence
  Synthetic Polynucleotide
taatacgactcactatagggttggccactgccgcagcgctggcaaatgcgaacagaggagacgcattatgcagcgctgcaacctggcggcagcgcaaaagatg

SEQ ID NO: 116171 - DNA, 103 bp, Artificial Sequence
  Synthetic Polynucleotide
taatacgactcactataggggggccccggcttggccactgccgcagcgctaacagaggagaagcgctatggcagtggccaacctggcggcagcgcaaaagatg

SEQ ID NO: 116172 - DNA, 103 bp, Artificial Sequence
  Synthetic Polynucleotide
taatacgactcactatagggggccgtccgggggccccggcttggccactgaacagaggagacagtggatgagccggggcaacctggcggcagcgcaaaagatg

SEQ ID NO: 116173 - DNA, 103 bp, Artificial Sequence
  Synthetic Polynucleotide
taatacgactcactataggggcgccaggcaggttcactgagctcaccaagaacagaggagacttggtatgctcagtgaaaacctggcggcagcgcaaaagatg

SEQ ID NO: 116174 - DNA, 103 bp, Artificial Sequence
  Synthetic Polynucleotide
taatacgactcactataggggagcccttgcggccgtccgggggccccggcaacagaggagagccgggatgcccggacggaacctggcggcagcgcaaaagatg

SEQ ID NO: 116175 - DNA, 103 bp, Artificial Sequence
  Synthetic Polynucleotide
taatacgactcactatagggcccgcagggggagcccttgcggccgtccggaacagaggagaccggacatgcgcaagggcaacctggcggcagcgcaaaagatg

SEQ ID NO: 116176 - DNA, 103 bp, Artificial Sequence
  Synthetic Polynucleotide
taatacgactcactataggggctcctcctccccgcagggggagcccttgcaacagaggagagcaaggatgccccctgcgaacctggcggcagcgcaaaagatg

SEQ ID NO: 116177 - DNA, 103 bp, Artificial Sequence
  Synthetic Polynucleotide
taatacgactcactataggggcggagggcagctcctcctccccgcaggggaacagaggagacccctgatgggaggaggaaacctggcggcagcgcaaaagatg

SEQ ID NO: 116178 - DNA, 103 bp, Artificial Sequence
  Synthetic Polynucleotide
taatacgactcactatagggggctgcagcggcggagggcagctcctcctcaacagaggagagaggagatgctgccctccaacctggcggcagcgcaaaagatg

SEQ ID NO: 116179 - DNA, 103 bp, Artificial Sequence
  Synthetic Polynucleotide
taatacgactcactatagggcggcggcggcggctgcagcggcggagggcaaacagaggagatgccctatgccgctgcagaacctggcggcagcgcaaaagatg

SEQ ID NO: 116180 - DNA, 103 bp, Artificial Sequence
  Synthetic Polynucleotide
taatacgactcactataggggcggcggcggcggcggcggcggctgcagcgaacagaggagacgctgcatgcgccgccgcaacctggcggcagcgcaaaagatg

SEQ ID NO: 116181 - DNA, 103 bp, Artificial Sequence
  Synthetic Polynucleotide
taatacgactcactatagggggccgcagccgcggcggcggcggcggcggcaacagaggagagccgccatggccgccgccaacctggcggcagcgcaaaagatg

SEQ ID NO: 116182 - DNA, 103 bp, Artificial Sequence
  Synthetic Polynucleotide
taatacgactcactatagggagcgcgcagtggccgcagccgcggcggcggaacagaggagaccgccgatgcggctgcggaacctggcggcagcgcaaaagatg

SEQ ID NO: 116183 - DNA, 103 bp, Artificial Sequence
  Synthetic Polynucleotide
taatacgactcactatagggtccatggagtagcgcgcagtggccgcagccaacagaggagaggctgcatgcactgcgcgaacctggcggcagcgcaaaagatg

SEQ ID NO: 116184 - DNA, 103 bp, Artificial Sequence
  Synthetic Polynucleotide
taatacgactcactataggggtagaagtgcgcgccaggcaggttcactgaaacagaggagatcagtgatgctgcctggcaacctggcggcagcgcaaaagatg

SEQ ID NO: 116185 - DNA, 103 bp, Artificial Sequence
  Synthetic Polynucleotide
taatacgactcactataggggctcaggctgtccatggagtagcgcgcagtaacagaggagaactgcgatgtactccatgaacctggcggcagcgcaaaagatg

SEQ ID NO: 116186 - DNA, 103 bp, Artificial Sequence
  Synthetic Polynucleotide
taatacgactcactatagggaccgctcggagctcaggctgtccatggagtaacagaggagaactccaatgacagcctgaaacctggcggcagcgcaaaagatg

SEQ ID NO: 116187 - DNA, 103 bp, Artificial Sequence
  Synthetic Polynucleotide
taatacgactcactatagggtggaggtagtaccgctcggagctcaggctgaacagaggagacagcctatgctccgagcgaacctggcggcagcgcaaaagatg

SEQ ID NO: 116188 - DNA, 103 bp, Artificial Sequence
  Synthetic Polynucleotide
taatacgactcactatagggaccgggggactggaggtagtaccgctcggaaacagaggagatccgagatgtactacctcaacctggcggcagcgcaaaagatg

SEQ ID NO: 116189 - DNA, 103 bp, Artificial Sequence
  Synthetic Polynucleotide
taatacgactcactatagggacccctgaggaccgggggactggaggtagtaacagaggagaactaccatgagtcccccgaacctggcggcagcgcaaaagatg

SEQ ID NO: 116190 - DNA, 103 bp, Artificial Sequence
  Synthetic Polynucleotide
taatacgactcactataggggccagctccgacccctgaggaccgggggacaacagaggagagtccccatgtcctcagggaacctggcggcagcgcaaaagatg

SEQ ID NO: 116191 - DNA, 103 bp, Artificial Sequence
  Synthetic Polynucleotide
taatacgactcactataggggcagggcgcagccagctccgacccctgaggaacagaggagacctcagatgtcggagctgaacctggcggcagcgcaaaagatg

SEQ ID NO: 116192 - DNA, 103 bp, Artificial Sequence
  Synthetic Polynucleotide
taatacgactcactatagggggaagagtgagcagggcgcagccagctccgaacagaggagacggagcatgctgcgccctaacctggcggcagcgcaaaagatg

SEQ ID NO: 116193 - DNA, 103 bp, Artificial Sequence
  Synthetic Polynucleotide
taatacgactcactataggggcctggtacgggaagagtgagcagggcgcaaacagaggagatgcgccatgctcactcttaacctggcggcagcgcaaaagatg

SEQ ID NO: 116194 - DNA, 103 bp, Artificial Sequence
  Synthetic Polynucleotide
taatacgactcactatagggcccagccgccgcctggtacgggaagagtgaaacagaggagatcactcatgccgtaccagaacctggcggcagcgcaaaagatg

SEQ ID NO: 116195 - DNA, 103 bp, Artificial Sequence
  Synthetic Polynucleotide
taatacgactcactatagggtctccagcgggtagaagtgcgcgccaggcaaacagaggagatgcctgatgcgcacttctaacctggcggcagcgcaaaagatg

SEQ ID NO: 116196 - DNA, 103 bp, Artificial Sequence
  Synthetic Polynucleotide
taatacgactcactatagggcgtggggcgccccagccgccgcctggtacgaacagaggagacgtaccatgcggcggctgaacctggcggcagcgcaaaagatg

SEQ ID NO: 116197 - DNA, 103 bp, Artificial Sequence
  Synthetic Polynucleotide
taatacgactcactatagggtacacaggtccgtggggcgccccagccgccaacagaggagaggcggcatgggcgccccaaacctggcggcagcgcaaaagatg

SEQ ID NO: 116198 - DNA, 103 bp, Artificial Sequence
  Synthetic Polynucleotide
taatacgactcactatagggaggagccgggtacacaggtccgtggggcgcaacagaggagagcgcccatgggacctgtgaacctggcggcagcgcaaaagatg

SEQ ID NO: 116199 - DNA, 103 bp, Artificial Sequence
  Synthetic Polynucleotide
taatacgactcactataggggcgccccgttaggagccgggtacacaggtcaacagaggagagacctgatgacccggctcaacctggcggcagcgcaaaagatg

SEQ ID NO: 116200 - DNA, 103 bp, Artificial Sequence
  Synthetic Polynucleotide
taatacgactcactatagggtaggggtagcgcgccccgttaggagccgggaacagaggagacccggcatgtaacggggcaacctggcggcagcgcaaaagatg

SEQ ID NO: 116201 - DNA, 103 bp, Artificial Sequence
  Synthetic Polynucleotide
taatacgactcactatagggcatggagccgtaggggtagcgcgccccgttaacagaggagaaacgggatgcgctaccccaacctggcggcagcgcaaaagatg

SEQ ID NO: 116202 - DNA, 103 bp, Artificial Sequence
  Synthetic Polynucleotide
taatacgactcactatagggcggggggcagcatggagccgtaggggtagcaacagaggagagctaccatgacggctccaaacctggcggcagcgcaaaagatg

SEQ ID NO: 116203 - DNA, 103 bp, Artificial Sequence
  Synthetic Polynucleotide
taatacgactcactataggggggaagccgccggggggcagcatggagccgaacagaggagacggctcatggctgcccccaacctggcggcagcgcaaaagatg

SEQ ID NO: 116204 - DNA, 103 bp, Artificial Sequence
  Synthetic Polynucleotide
taatacgactcactatagggcacagccgcggggaagccgccggggggcagaacagaggagactgcccatgggcggcttcaacctggcggcagcgcaaaagatg

SEQ ID NO: 116205 - DNA, 103 bp, Artificial Sequence
  Synthetic Polynucleotide
taatacgactcactatagggcgggtgggcacacagccgcggggaagccgcaacagaggagagcggctatgccgcggctgaacctggcggcagcgcaaaagatg

SEQ ID NO: 116206 - DNA, 103 bp, Artificial Sequence
  Synthetic Polynucleotide
taatacgactcactatagggcctcgcgcactctccagcgggtagaagtgcaacagaggagagcacttatgcccgctggaaacctggcggcagcgcaaaagatg

SEQ ID NO: 116207 - DNA, 103 bp, Artificial Sequence
  Synthetic Polynucleotide
taatacgactcactatagggtgcgccctcccgggtgggcacacagccgcgaacagaggagacgcggcatggtgcccaccaacctggcggcagcgcaaaagatg

SEQ ID NO: 116208 - DNA, 103 bp, Artificial Sequence
  Synthetic Polynucleotide
taatacgactcactatagggtgggccgaactgcgccctcccgggtgggcaaacagaggagatgcccaatggggagggcgaacctggcggcagcgcaaaagatg

SEQ ID NO: 116209 - DNA, 103 bp, Artificial Sequence
  Synthetic Polynucleotide
taatacgactcactatagggcaccggctcctgggccgaactgcgccctccaacagaggagaggagggatgagttcggccaacctggcggcagcgcaaaagatg

SEQ ID NO: 116210 - DNA, 103 bp, Artificial Sequence
  Synthetic Polynucleotide
taatacgactcactatagggccactgcccgcaccggctcctgggccgaacaacagaggagagttcggatgaggagccggaacctggcggcagcgcaaaagatg

SEQ ID NO: 116211 - DNA, 103 bp, Artificial Sequence
  Synthetic Polynucleotide
taatacgactcactatagggaccgcccgcgccactgcccgcaccggctccaacagaggagaggagccatggcgggcagtaacctggcggcagcgcaaaagatg

SEQ ID NO: 116212 - DNA, 103 bp, Artificial Sequence
  Synthetic Polynucleotide
taatacgactcactatagggcgccgctgctaccgcccgcgccactgcccgaacagaggagacgggcaatggcgcgggcgaacctggcggcagcgcaaaagatg

SEQ ID NO: 116213 - DNA, 103 bp, Artificial Sequence
  Synthetic Polynucleotide
taatacgactcactatagggccgccgcccccgccgctgctaccgcccgcgaacagaggagacgcgggatgtagcagcggaacctggcggcagcgcaaaagatg

SEQ ID NO: 116214 - DNA, 103 bp, Artificial Sequence
  Synthetic Polynucleotide
taatacgactcactatagggggtgcccgggccgccgcccccgccgctgctaacagaggagaagcagcatggggggcggcaacctggcggcagcgcaaaagatg

SEQ ID NO: 116215 - DNA, 103 bp, Artificial Sequence
  Synthetic Polynucleotide
taatacgactcactatagggtgtactgataggtgcccgggccgccgccccaacagaggagaggggcgatggcccgggcaaacctggcggcagcgcaaaagatg

SEQ ID NO: 116216 - DNA, 103 bp, Artificial Sequence
  Synthetic Polynucleotide
taatacgactcactataggggccccctggctgtactgataggtgcccgggaacagaggagacccgggatgctatcagtaaacctggcggcagcgcaaaagatg

SEQ ID NO: 116217 - DNA, 103 bp, Artificial Sequence
  Synthetic Polynucleotide
taatacgactcactataggggccgctgccgcctcgcgcactctccagcggaacagaggagaccgctgatgagtgcgcgaaacctggcggcagcgcaaaagatg

SEQ ID NO: 116218 - DNA, 103 bp, Artificial Sequence
  Synthetic Polynucleotide
taatacgactcactataggggtagagcggagccccctggctgtactgataaacagaggagatatcagatgagccaggggaacctggcggcagcgcaaaagatg

SEQ ID NO: 116219 - DNA, 103 bp, Artificial Sequence
  Synthetic Polynucleotide
taatacgactcactatagggggtacggcccgtagagcggagccccctggcaacagaggagagccaggatgctccgctctaacctggcggcagcgcaaaagatg

SEQ ID NO: 116220 - DNA, 103 bp, Artificial Sequence
  Synthetic Polynucleotide
taatacgactcactataggggcggctccagggtacggcccgtagagcggaaacagaggagatccgctatgcgggccgtaaacctggcggcagcgcaaaagatg

SEQ ID NO: 116221 - DNA, 103 bp, Artificial Sequence
  Synthetic Polynucleotide
taatacgactcactatagggtcccgccgctgcggctccagggtacggcccaacagaggagagggccgatgcctggagccaacctggcggcagcgcaaaagatg

SEQ ID NO: 116222 - DNA, 103 bp, Artificial Sequence
  Synthetic Polynucleotide
taatacgactcactatagggctccgcaagatcccgccgctgcggctccagaacagaggagactggagatgcagcggcggaacctggcggcagcgcaaaagatg

SEQ ID NO: 116223 - DNA, 103 bp, Artificial Sequence
  Synthetic Polynucleotide
taatacgactcactatagggccccccagtcctccgcaagatcccgccgctaacagaggagaagcggcatgatcttgcggaacctggcggcagcgcaaaagatg

SEQ ID NO: 116224 - DNA, 103 bp, Artificial Sequence
  Synthetic Polynucleotide
taatacgactcactatagggaacccccaggccccccagtcctccgcaagaaacagaggagatcttgcatgggactggggaacctggcggcagcgcaaaagatg

SEQ ID NO: 116225 - DNA, 103 bp, Artificial Sequence
  Synthetic Polynucleotide
taatacgactcactatagggcagaacctggaacccccaggccccccagtcaacagaggagagactggatggcctgggggaacctggcggcagcgcaaaagatg

SEQ ID NO: 116226 - DNA, 103 bp, Artificial Sequence
  Synthetic Polynucleotide
taatacgactcactataggggcacggaagccagaacctggaacccccaggaacagaggagacctgggatgtccaggttcaacctggcggcagcgcaaaagatg

SEQ ID NO: 116227 - DNA, 103 bp, Artificial Sequence
  Synthetic Polynucleotide
taatacgactcactataggggtagacgtgggcacggaagccagaacctggaacagaggagaccaggtatgggcttccgtaacctggcggcagcgcaaaagatg

SEQ ID NO: 116228 - DNA, 103 bp, Artificial Sequence
  Synthetic Polynucleotide
taatacgactcactatagggcagcgctcccgccgctgccgcctcgcgcacaacagaggagagtgcgcatggcggcagcgaacctggcggcagcgcaaaagatg

SEQ ID NO: 116229 - DNA, 103 bp, Artificial Sequence
  Synthetic Polynucleotide
taatacgactcactatagggggttgcacaggtagacgtgggcacggaagcaacagaggagagcttccatgcccacgtctaacctggcggcagcgcaaaagatg

SEQ ID NO: 116230 - DNA, 103 bp, Artificial Sequence
  Synthetic Polynucleotide
taatacgactcactatagggcacagaggccggttgcacaggtagacgtggaacagaggagaccacgtatgcctgtgcaaaacctggcggcagcgcaaaagatg

SEQ ID NO: 116231 - DNA, 103 bp, Artificial Sequence
  Synthetic Polynucleotide
taatacgactcactataggggaatttgagccacagaggccggttgcacagaacagaggagactgtgcatgcggcctctgaacctggcggcagcgcaaaagatg

SEQ ID NO: 116232 - DNA, 103 bp, Artificial Sequence
  Synthetic Polynucleotide
taatacgactcactatagggggtggcggtggaatttgagccacagaggccaacagaggagaggcctcatgggctcaaataacctggcggcagcgcaaaagatg

SEQ ID NO: 116233 - DNA, 103 bp, Artificial Sequence
  Synthetic Polynucleotide
taatacgactcactatagggatctcagtttggtggcggtggaatttgagcaacagaggagagctcaaatgccaccgccaaacctggcggcagcgcaaaagatg

SEQ ID NO: 116234 - DNA, 103 bp, Artificial Sequence
  Synthetic Polynucleotide
taatacgactcactatagggcgtaatgatcatctcagtttggtggcggtgaacagaggagacaccgcatgcaaactgagaacctggcggcagcgcaaaagatg

SEQ ID NO: 116235 - DNA, 103 bp, Artificial Sequence
  Synthetic Polynucleotide
taatacgactcactatagggtgccctgtttcgtaatgatcatctcagtttaacagaggagaaaactgatgtgatcattaaacctggcggcagcgcaaaagatg

SEQ ID NO: 116236 - DNA, 103 bp, Artificial Sequence
  Synthetic Polynucleotide
taatacgactcactatagggaacatgcgcctgccctgtttcgtaatgatcaacagaggagagatcatatggaaacagggaacctggcggcagcgcaaaagatg

SEQ ID NO: 116237 - DNA, 103 bp, Artificial Sequence
  Synthetic Polynucleotide
taatacgactcactatagggcaagaaaggaaacatgcgcctgccctgtttaacagaggagaaaacagatgaggcgcatgaacctggcggcagcgcaaaagatg

SEQ ID NO: 116238 - DNA, 103 bp, Artificial Sequence
  Synthetic Polynucleotide
taatacgactcactatagggtgttgaagctcaagaaaggaaacatgcgccaacagaggagaggcgcaatgttcctttctaacctggcggcagcgcaaaagatg

SEQ ID NO: 116239 - DNA, 103 bp, Artificial Sequence
  Synthetic Polynucleotide
taatacgactcactataggggggaggtggccagcgctcccgccgctgccgaacagaggagacggcagatgcgggagcgcaacctggcggcagcgcaaaagatg

SEQ ID NO: 116240 - DNA, 103 bp, Artificial Sequence
  Synthetic Polynucleotide
taatacgactcactatagggagtccgtttatgttgaagctcaagaaaggaaacagaggagatcctttatggagcttcaaaacctggcggcagcgcaaaagatg

SEQ ID NO: 116241 - DNA, 103 bp, Artificial Sequence
  Synthetic Polynucleotide
taatacgactcactatagggagtgggattgagtccgtttatgttgaagctaacagaggagaagcttcatgataaacggaaacctggcggcagcgcaaaagatg

SEQ ID NO: 116242 - DNA, 103 bp, Artificial Sequence
  Synthetic Polynucleotide
taatacgactcactatagggtgtagtgggcagtgggattgagtccgtttaaacagaggagataaacgatgtcaatcccaaacctggcggcagcgcaaaagatg

SEQ ID NO: 116243 - DNA, 103 bp, Artificial Sequence
  Synthetic Polynucleotide
taatacgactcactatagggacgaacacattgtagtgggcagtgggattgaacagaggagacaatccatgtgcccactaaacctggcggcagcgcaaaagatg

SEQ ID NO: 116244 - DNA, 103 bp, Artificial Sequence
  Synthetic Polynucleotide
taatacgactcactatagggcaccacctctacgaacacattgtagtgggcaacagaggagagcccacatgaatgtgttcaacctggcggcagcgcaaaagatg

SEQ ID NO: 116245 - DNA, 103 bp, Artificial Sequence
  Synthetic Polynucleotide
taatacgactcactatagggggtccgccagcaccacctctacgaacacataacagaggagaatgtgtatgtagaggtggaacctggcggcagcgcaaaagatg

SEQ ID NO: 116246 - DNA, 103 bp, Artificial Sequence
  Synthetic Polynucleotide
taatacgactcactatagggcagtggttggggtccgccagcaccacctctaacagaggagaagaggtatggctggcggaaacctggcggcagcgcaaaagatg

SEQ ID NO: 116247 - DNA, 103 bp, Artificial Sequence
  Synthetic Polynucleotide
taatacgactcactatagggctggaagcgccagtggttggggtccgccagaacagaggagactggcgatgcccaaccacaacctggcggcagcgcaaaagatg

SEQ ID NO: 116248 - DNA, 103 bp, Artificial Sequence
  Synthetic Polynucleotide
taatacgactcactatagggatttgcccccctggaagcgccagtggttggaacagaggagaccaaccatgggcgcttccaacctggcggcagcgcaaaagatg

SEQ ID NO: 116249 - DNA, 103 bp, Artificial Sequence
  Synthetic Polynucleotide
taatacgactcactatagggcaggtcacccatttgcccccctggaagcgcaacagaggagagcgcttatgggggggcaaaacctggcggcagcgcaaaagatg

SEQ ID NO: 116250 - DNA, 103 bp, Artificial Sequence
  Synthetic Polynucleotide
taatacgactcactatagggcggccccggttccaccacattctcggccataacagaggagaatggccatgaatgtggtgaacctggcggcagcgcaaaagatg

SEQ ID NO: 116251 - DNA, 103 bp, Artificial Sequence
  Synthetic Polynucleotide
taatacgactcactatagggctccaagtcaaatagagagccaaaatctgtaacagaggagaacagatatgggctctctaaacctggcggcagcgcaaaagatg

SEQ ID NO: 116252 - DNA, 103 bp, Artificial Sequence
  Synthetic Polynucleotide
taatacgactcactatagggctgctggatgagcttgcgcttctctggatcaacagaggagagatccaatgaagcgcaagaacctggcggcagcgcaaaagatg

SEQ ID NO: 116253 - DNA, 103 bp, Artificial Sequence
  Synthetic Polynucleotide
taatacgactcactataggggaacaagctgctgctggatgagcttgcgctaacagaggagaagcgcaatgtcatccagcaacctggcggcagcgcaaaagatg

SEQ ID NO: 116254 - DNA, 103 bp, Artificial Sequence
  Synthetic Polynucleotide
taatacgactcactatagggtgcaaaaggagaacaagctgctgctggatgaacagaggagacatccaatggcagcttgtaacctggcggcagcgcaaaagatg

SEQ ID NO: 116255 - DNA, 103 bp, Artificial Sequence
  Synthetic Polynucleotide
taatacgactcactatagggcttgtgagcatgcaaaaggagaacaagctgaacagaggagacagcttatgctccttttgaacctggcggcagcgcaaaagatg

SEQ ID NO: 116256 - DNA, 103 bp, Artificial Sequence
  Synthetic Polynucleotide
taatacgactcactatagggggcgctggcacttgtgagcatgcaaaaggaaacagaggagatcctttatgatgctcacaaacctggcggcagcgcaaaagatg

SEQ ID NO: 116257 - DNA, 103 bp, Artificial Sequence
  Synthetic Polynucleotide
taatacgactcactataggggcctgttcccggcgctggcacttgtgagcaaacagaggagatgctcaatggtgccagcgaacctggcggcagcgcaaaagatg

SEQ ID NO: 116258 - DNA, 103 bp, Artificial Sequence
  Synthetic Polynucleotide
taatacgactcactatagggttccccattggcctgttcccggcgctggcaaacagaggagatgccagatgcgggaacagaacctggcggcagcgcaaaagatg

SEQ ID NO: 116259 - DNA, 103 bp, Artificial Sequence
  Synthetic Polynucleotide
taatacgactcactatagggactgcctcacttccccattggcctgttcccaacagaggagagggaacatgccaatggggaacctggcggcagcgcaaaagatg

SEQ ID NO: 116260 - DNA, 103 bp, Artificial Sequence
  Synthetic Polynucleotide
taatacgactcactatagggggaaggttgcactgcctcacttccccattgaacagaggagacaatggatgagtgaggcaaacctggcggcagcgcaaaagatg

SEQ ID NO: 116261 - DNA, 103 bp, Artificial Sequence
  Synthetic Polynucleotide
taatacgactcactataggggcgacagtggggaaggttgcactgcctcacaacagaggagagtgaggatgtgcaaccttaacctggcggcagcgcaaaagatg

SEQ ID NO: 116262 - DNA, 103 bp, Artificial Sequence
  Synthetic Polynucleotide
taatacgactcactataggggtaagtcgtgctccaagtcaaatagagagcaacagaggagagctctcatgttgacttggaacctggcggcagcgcaaaagatg

SEQ ID NO: 116263 - DNA, 103 bp, Artificial Sequence
  Synthetic Polynucleotide
taatacgactcactatagggtcttcattgtgcgacagtggggaaggttgcaacagaggagagcaaccatgcccactgtcaacctggcggcagcgcaaaagatg

SEQ ID NO: 116264 - DNA, 103 bp, Artificial Sequence
  Synthetic Polynucleotide
taatacgactcactatagggtttaggacattcttcattgtgcgacagtggaacagaggagaccactgatgcacaatgaaaacctggcggcagcgcaaaagatg

SEQ ID NO: 116265 - DNA, 103 bp, Artificial Sequence
  Synthetic Polynucleotide
taatacgactcactatagggtgtcatgtggtttaggacattcttcattgtaacagaggagaacaatgatgaatgtcctaaacctggcggcagcgcaaaagatg

SEQ ID NO: 116266 - DNA, 103 bp, Artificial Sequence
  Synthetic Polynucleotide
taatacgactcactatagggactggcagtgtgtcatgtggtttaggacataacagaggagaatgtccatgaccacatgaaacctggcggcagcgcaaaagatg

SEQ ID NO: 116267 - DNA, 103 bp, Artificial Sequence
  Synthetic Polynucleotide
taatacgactcactataggggacttgcctgactggcagtgtgtcatgtggaacagaggagaccacatatgacactgccaaacctggcggcagcgcaaaagatg

SEQ ID NO: 116268 - DNA, 103 bp, Artificial Sequence
  Synthetic Polynucleotide
taatacgactcactatagggcacttggcaagacttgcctgactggcagtgaacagaggagacactgcatgtcaggcaagaacctggcggcagcgcaaaagatg

SEQ ID NO: 116269 - DNA, 103 bp, Artificial Sequence
  Synthetic Polynucleotide
taatacgactcactatagggcacagtgtgccacttggcaagacttgcctgaacagaggagacaggcaatgcttgccaagaacctggcggcagcgcaaaagatg

SEQ ID NO: 116270 - DNA, 103 bp, Artificial Sequence
  Synthetic Polynucleotide
taatacgactcactatagggcgagaagatgcacagtgtgccacttggcaaaacagaggagattgccaatgggcacactgaacctggcggcagcgcaaaagatg

SEQ ID NO: 116271 - DNA, 103 bp, Artificial Sequence
  Synthetic Polynucleotide
taatacgactcactatagggaatgatttgtcgagaagatgcacagtgtgcaacagaggagagcacacatggcatcttctaacctggcggcagcgcaaaagatg

SEQ ID NO: 116272 - DNA, 103 bp, Artificial Sequence
  Synthetic Polynucleotide
taatacgactcactatagggtccagtgtgaaatgatttgtcgagaagatgaacagaggagacatcttatggacaaatcaaacctggcggcagcgcaaaagatg

SEQ ID NO: 116273 - DNA, 103 bp, Artificial Sequence
  Synthetic Polynucleotide
taatacgactcactatagggaattcatctggtaagtcgtgctccaagtcaaacagaggagatgacttatggcacgacttaacctggcggcagcgcaaaagatg

SEQ ID NO: 116274 - DNA, 103 bp, Artificial Sequence
  Synthetic Polynucleotide
taatacgactcactataggggtacaattcttccagtgtgaaatgatttgtaacagaggagaacaaatatgttcacactgaacctggcggcagcgcaaaagatg

SEQ ID NO: 116275 - DNA, 103 bp, Artificial Sequence
  Synthetic Polynucleotide
taatacgactcactatagggatcatgtcttgtacaattcttccagtgtgaaacagaggagatcacacatgaagaattgtaacctggcggcagcgcaaaagatg

SEQ ID NO: 116276 - DNA, 103 bp, Artificial Sequence
  Synthetic Polynucleotide
taatacgactcactatagggacacaggacaatcatgtcttgtacaattctaacagaggagaagaattatgcaagacatgaacctggcggcagcgcaaaagatg

SEQ ID NO: 116277 - DNA, 103 bp, Artificial Sequence
  Synthetic Polynucleotide
taatacgactcactatagggagggggagacacacaggacaatcatgtcttaacagaggagaaagacaatgttgtcctgtaacctggcggcagcgcaaaagatg

SEQ ID NO: 116278 - DNA, 103 bp, Artificial Sequence
  Synthetic Polynucleotide
taatacgactcactatagggagcatttttgagggggagacacacaggacaaacagaggagatgtcctatgtgtctccccaacctggcggcagcgcaaaagatg

SEQ ID NO: 116279 - DNA, 103 bp, Artificial Sequence
  Synthetic Polynucleotide
taatacgactcactatagggtcttatcaccagcatttttgagggggagacaacagaggagagtctccatgtcaaaaatgaacctggcggcagcgcaaaagatg

SEQ ID NO: 116280 - DNA, 103 bp, Artificial Sequence
  Synthetic Polynucleotide
taatacgactcactatagggtgttgatttctcttatcaccagcatttttgaacagaggagacaaaaaatgtggtgataaaacctggcggcagcgcaaaagatg

SEQ ID NO: 116281 - DNA, 103 bp, Artificial Sequence
  Synthetic Polynucleotide
taatacgactcactatagggcaaaattggctgttgatttctcttatcaccaacagaggagaggtgatatgagaaatcaaaacctggcggcagcgcaaaagatg

SEQ ID NO: 116282 - DNA, 103 bp, Artificial Sequence
  Synthetic Polynucleotide
taatacgactcactataggggtgctccagtcaaaattggctgttgatttcaacagaggagagaaatcatgagccaatttaacctggcggcagcgcaaaagatg

SEQ ID NO: 116283 - DNA, 103 bp, Artificial Sequence
  Synthetic Polynucleotide
taatacgactcactatagggagtccaacgggtgctccagtcaaaattggcaacagaggagagccaatatggactggagcaacctggcggcagcgcaaaagatg

SEQ ID NO: 116284 - DNA, 103 bp, Artificial Sequence
  Synthetic Polynucleotide
taatacgactcactatagggagagttgattaattcatctggtaagtcgtgaacagaggagacacgacatgccagatgaaaacctggcggcagcgcaaaagatg

SEQ ID NO: 116285 - DNA, 103 bp, Artificial Sequence
  Synthetic Polynucleotide
taatacgactcactatagggaggatttccaagtccaacgggtgctccagtaacagaggagaactggaatgcccgttggaaacctggcggcagcgcaaaagatg

SEQ ID NO: 116286 - DNA, 103 bp, Artificial Sequence
  Synthetic Polynucleotide
taatacgactcactatagggctagagagctaggatttccaagtccaacggaacagaggagaccgttgatgttggaaatcaacctggcggcagcgcaaaagatg

SEQ ID NO: 116287 - DNA, 103 bp, Artificial Sequence
  Synthetic Polynucleotide
taatacgactcactatagggtgacccacccctagagagctaggatttccaaacagaggagatggaaaatgtagctctctaacctggcggcagcgcaaaagatg

SEQ ID NO: 116288 - DNA, 103 bp, Artificial Sequence
  Synthetic Polynucleotide
taatacgactcactatagggggcagactgttgacccacccctagagagctaacagaggagaagctctatgggggtgggtaacctggcggcagcgcaaaagatg

SEQ ID NO: 116289 - DNA, 103 bp, Artificial Sequence
  Synthetic Polynucleotide
taatacgactcactatagggttaggttgggggcagactgttgacccacccaacagaggagagggtggatgaacagtctgaacctggcggcagcgcaaaagatg

SEQ ID NO: 116290 - DNA, 103 bp, Artificial Sequence
  Synthetic Polynucleotide
taatacgactcactatagggctaacagtgcttaggttgggggcagactgtaacagaggagaacagtcatgccccaacctaacctggcggcagcgcaaaagatg

SEQ ID NO: 116291 - DNA, 103 bp, Artificial Sequence
  Synthetic Polynucleotide
taatacgactcactatagggatcaatctgactaacagtgcttaggttgggaacagaggagacccaacatgagcactgttaacctggcggcagcgcaaaagatg

SEQ ID NO: 116292 - DNA, 103 bp, Artificial Sequence
  Synthetic Polynucleotide
taatacgactcactatagggtggagctgggatcaatctgactaacagtgcaacagaggagagcactgatggtcagattgaacctggcggcagcgcaaaagatg

SEQ ID NO: 116293 - DNA, 103 bp, Artificial Sequence
  Synthetic Polynucleotide
taatacgactcactataggggctctttctatggagctgggatcaatctgaaacagaggagatcagatatgtcccagctcaacctggcggcagcgcaaaagatg

SEQ ID NO: 116294 - DNA, 103 bp, Artificial Sequence
  Synthetic Polynucleotide
taatacgactcactatagggagctgcataggctctttctatggagctgggaacagaggagacccagcatgatagaaagaaacctggcggcagcgcaaaagatg

SEQ ID NO: 116295 - DNA, 103 bp, Artificial Sequence
  Synthetic Polynucleotide
taatacgactcactatagggccaattctgtagagttgattaattcatctgaacagaggagacagatgatgtaatcaactaacctggcggcagcgcaaaagatg

SEQ ID NO: 116296 - DNA, 103 bp, Artificial Sequence
  Synthetic Polynucleotide
taatacgactcactataggggtagtccaagagctgcataggctctttctaaacagaggagatagaaaatgcctatgcagaacctggcggcagcgcaaaagatg

SEQ ID NO: 116297 - DNA, 103 bp, Artificial Sequence
  Synthetic Polynucleotide
taatacgactcactatagggacttgatagggtagtccaagagctgcatagaacagaggagactatgcatgtcttggactaacctggcggcagcgcaaaagatg

SEQ ID NO: 116298 - DNA, 103 bp, Artificial Sequence
  Synthetic Polynucleotide
taatacgactcactatagggcatctgatttacttgatagggtagtccaagaacagaggagacttggaatgccctatcaaaacctggcggcagcgcaaaagatg

SEQ ID NO: 116299 - DNA, 103 bp, Artificial Sequence
  Synthetic Polynucleotide
taatacgactcactataggggttgtgtcggcatctgatttacttgataggaacagaggagacctatcatgtaaatcagaaacctggcggcagcgcaaaagatg

SEQ ID NO: 116300 - DNA, 103 bp, Artificial Sequence
  Synthetic Polynucleotide
taatacgactcactatagggtgcacctggggttgtgtcggcatctgatttaacagaggagaaaatcaatggccgacacaaacctggcggcagcgcaaaagatg

SEQ ID NO: 116301 - DNA, 103 bp, Artificial Sequence
  Synthetic Polynucleotide
taatacgactcactataggggttctttgcttgcacctggggttgtgtcggaacagaggagaccgacaatgccccaggtgaacctggcggcagcgcaaaagatg

SEQ ID NO: 116302 - DNA, 103 bp, Artificial Sequence
  Synthetic Polynucleotide
taatacgactcactataggggattctgctggttctttgcttgcacctgggaacagaggagacccaggatgaagcaaagaaacctggcggcagcgcaaaagatg

SEQ ID NO: 116303 - DNA, 103 bp, Artificial Sequence
  Synthetic Polynucleotide
taatacgactcactatagggccaggctgctgattctgctggttctttgctaacagaggagaagcaaaatgccagcagaaaacctggcggcagcgcaaaagatg

SEQ ID NO: 116304 - DNA, 103 bp, Artificial Sequence
  Synthetic Polynucleotide
taatacgactcactataggggggagactgcccaggctgctgattctgctgaacagaggagacagcagatgcagcagcctaacctggcggcagcgcaaaagatg

SEQ ID NO: 116305 - DNA, 103 bp, Artificial Sequence
  Synthetic Polynucleotide
taatacgactcactataggggcatgccttggggagactgcccaggctgctaacagaggagaagcagcatgggcagtctcaacctggcggcagcgcaaaagatg

SEQ ID NO: 116306 - DNA, 103 bp, Artificial Sequence
  Synthetic Polynucleotide
taatacgactcactatagggttggttagtcccaattctgtagagttgattaacagaggagaaatcaaatgtacagaattaacctggcggcagcgcaaaagatg

SEQ ID NO: 116307 - DNA, 103 bp, Artificial Sequence
  Synthetic Polynucleotide
taatacgactcactatagggctcatgggccgcatgccttggggagactgcaacagaggagagcagtcatgccaaggcataacctggcggcagcgcaaaagatg

SEQ ID NO: 116308 - DNA, 103 bp, Artificial Sequence
  Synthetic Polynucleotide
taatacgactcactatagggactcatgttgctcatgggccgcatgccttgaacagaggagacaaggcatgcggcccatgaacctggcggcagcgcaaaagatg

SEQ ID NO: 116309 - DNA, 103 bp, Artificial Sequence
  Synthetic Polynucleotide
taatacgactcactatagggtaggactagcactcatgttgctcatgggccaacagaggagaggcccaatggcaacatgaaacctggcggcagcgcaaaagatg

SEQ ID NO: 116310 - DNA, 103 bp, Artificial Sequence
  Synthetic Polynucleotide
taatacgactcactatagggtttactcccataggactagcactcatgttgaacagaggagacaacatatgtgctagtccaacctggcggcagcgcaaaagatg

SEQ ID NO: 116311 - DNA, 103 bp, Artificial Sequence
  Synthetic Polynucleotide
taatacgactcactatagggtacacctccatttactcccataggactagcaacagaggagagctagtatgatgggagtaaacctggcggcagcgcaaaagatg

SEQ ID NO: 116312 - DNA, 103 bp, Artificial Sequence
  Synthetic Polynucleotide
taatacgactcactatagggtttgaactcctacacctccatttactcccaaacagaggagatgggagatgatggaggtgaacctggcggcagcgcaaaagatg

SEQ ID NO: 116313 - DNA, 103 bp, Artificial Sequence
  Synthetic Polynucleotide
taatacgactcactatagggagactcggcgtttgaactcctacacctccaaacagaggagatggaggatgaggagttcaaacctggcggcagcgcaaaagatg

SEQ ID NO: 116314 - DNA, 103 bp, Artificial Sequence
  Synthetic Polynucleotide
taatacgactcactataggggtcagaaagaagactcggcgtttgaactccaacagaggagaggagttatgacgccgagtaacctggcggcagcgcaaaagatg

SEQ ID NO: 116315 - DNA, 103 bp, Artificial Sequence
  Synthetic Polynucleotide
taatacgactcactataggggcaacattgagtcagaaagaagactcggcgaacagaggagacgccgaatgttctttctgaacctggcggcagcgcaaaagatg

SEQ ID NO: 116316 - DNA, 103 bp, Artificial Sequence
  Synthetic Polynucleotide
taatacgactcactatagggatggctgaatgcaacattgagtcagaaagaaacagaggagatctttcatgctcaatgttaacctggcggcagcgcaaaagatg

SEQ ID NO: 116317 - DNA, 103 bp, Artificial Sequence
  Synthetic Polynucleotide
taatacgactcactatagggatcaccaccattggttagtcccaattctgtaacagaggagaacagaaatgggactaaccaacctggcggcagcgcaaaagatg

SEQ ID NO: 116318 - DNA, 103 bp, Artificial Sequence
  Synthetic Polynucleotide
taatacgactcactatagggttgagaatttatggctgaatgcaacattgaaacagaggagatcaatgatgcattcagccaacctggcggcagcgcaaaagatg

SEQ ID NO: 116319 - DNA, 103 bp, Artificial Sequence
  Synthetic Polynucleotide
taatacgactcactatagggtcattgggttttgagaatttatggctgaataacagaggagaattcagatgtaaattctcaacctggcggcagcgcaaaagatg

SEQ ID NO: 116320 - DNA, 103 bp, Artificial Sequence
  Synthetic Polynucleotide
taatacgactcactatagggttttcactcatcattgggttttgagaatttaacagaggagaaaattcatgaaacccaataacctggcggcagcgcaaaagatg

SEQ ID NO: 116321 - DNA, 103 bp, Artificial Sequence
  Synthetic Polynucleotide
taatacgactcactatagggcacactggcattttcactcatcattgggttaacagaggagaaacccaatgatgagtgaaaacctggcggcagcgcaaaagatg

SEQ ID NO: 116322 - DNA, 103 bp, Artificial Sequence
  Synthetic Polynucleotide
taatacgactcactatagggccagggagggcacactggcattttcactcaaacagaggagatgagtgatgatgccagtgaacctggcggcagcgcaaaagatg

SEQ ID NO: 116323 - DNA, 103 bp, Artificial Sequence
  Synthetic Polynucleotide
taatacgactcactatagggggcataggacccagggagggcacactggcaaacagaggagatgccagatggccctccctaacctggcggcagcgcaaaagatg

SEQ ID NO: 116324 - DNA, 103 bp, Artificial Sequence
  Synthetic Polynucleotide
taatacgactcactatagggagctgctgttggcataggacccagggagggaacagaggagaccctccatgggtcctatgaacctggcggcagcgcaaaagatg

SEQ ID NO: 116325 - DNA, 103 bp, Artificial Sequence
  Synthetic Polynucleotide
taatacgactcactatagggtggatggttgagctgctgttggcataggacaacagaggagagtcctaatgcaacagcagaacctggcggcagcgcaaaagatg

SEQ ID NO: 116326 - DNA, 103 bp, Artificial Sequence
  Synthetic Polynucleotide
taatacgactcactatagggattccagtagtggatggttgagctgctgttaacagaggagaaacagcatgtcaaccatcaacctggcggcagcgcaaaagatg

SEQ ID NO: 116327 - DNA, 103 bp, Artificial Sequence
  Synthetic Polynucleotide
taatacgactcactatagggctgtttccgaattccagtagtggatggttgaacagaggagacaaccaatgactactggaaacctggcggcagcgcaaaagatg

SEQ ID NO: 116328 - DNA, 103 bp, Artificial Sequence
  Synthetic Polynucleotide
taatacgactcactataggggctgattaatatcaccaccattggttagtcaacagaggagagactaaatgatggtggtgaacctggcggcagcgcaaaagatg

SEQ ID NO: 116329 - DNA, 103 bp, Artificial Sequence
  Synthetic Polynucleotide
taatacgactcactatagggcttcgtgccactgtttccgaattccagtagaacagaggagactactgatgttcggaaacaacctggcggcagcgcaaaagatg

SEQ ID NO: 116330 - DNA, 103 bp, Artificial Sequence
  Synthetic Polynucleotide
taatacgactcactatagggtgagtaatatcttcgtgccactgtttccgaaacagaggagatcggaaatggtggcacgaaacctggcggcagcgcaaaagatg

SEQ ID NO: 116331 - DNA, 103 bp, Artificial Sequence
  Synthetic Polynucleotide
taatacgactcactatagggtcgaagatcctgagtaatatcttcgtgccaaacagaggagatggcacatggatattactaacctggcggcagcgcaaaagatg

SEQ ID NO: 116332 - DNA, 103 bp, Artificial Sequence
  Synthetic Polynucleotide
taatacgactcactatagggcaagatgatttcgaagatcctgagtaatataacagaggagaatattaatgaggatcttcaacctggcggcagcgcaaaagatg

SEQ ID NO: 116333 - DNA, 103 bp, Artificial Sequence
  Synthetic Polynucleotide
taatacgactcactatagggagtttgtgaacaagatgatttcgaagatccaacagaggagaggatctatgaaatcatctaacctggcggcagcgcaaaagatg

SEQ ID NO: 116334 - DNA, 103 bp, Artificial Sequence
  Synthetic Polynucleotide
taatacgactcactatagggggcttggacgagtttgtgaacaagatgattaacagaggagaaatcatatggttcacaaaaacctggcggcagcgcaaaagatg

SEQ ID NO: 116335 - DNA, 103 bp, Artificial Sequence
  Synthetic Polynucleotide
taatacgactcactatagggtaggaaatatggcttggacgagtttgtgaaaacagaggagattcacaatgtcgtccaagaacctggcggcagcgcaaaagatg

SEQ ID NO: 116336 - DNA, 103 bp, Artificial Sequence
  Synthetic Polynucleotide
taatacgactcactatagggggatccggcgtaggaaatatggcttggacgaacagaggagacgtccaatgcatatttccaacctggcggcagcgcaaaagatg

SEQ ID NO: 116337 - DNA, 103 bp, Artificial Sequence
  Synthetic Polynucleotide
taatacgactcactatagggtaaagcagcaggatccggcgtaggaaatataacagaggagaatatttatgacgccggataacctggcggcagcgcaaaagatg

SEQ ID NO: 116338 - DNA, 103 bp, Artificial Sequence
  Synthetic Polynucleotide
taatacgactcactataggggtctgtcttttaaagcagcaggatccggcgaacagaggagacgccggatgctgctgcttaacctggcggcagcgcaaaagatg

SEQ ID NO: 116339 - DNA, 103 bp, Artificial Sequence
  Synthetic Polynucleotide
taatacgactcactatagggcttgtctgaagctgattaatatcaccaccaaacagaggagatggtggatgtattaatcaaacctggcggcagcgcaaaagatg

SEQ ID NO: 116340 - DNA, 103 bp, Artificial Sequence
  Synthetic Polynucleotide
taatacgactcactatagggttttccatccgtctgtcttttaaagcagcaaacagaggagatgctgcatgaaaagacagaacctggcggcagcgcaaaagatg

SEQ ID NO: 116341 - DNA, 103 bp, Artificial Sequence
  Synthetic Polynucleotide
taatacgactcactatagggtgcaactaggttttccatccgtctgtctttaacagaggagaaaagacatgcggatggaaaacctggcggcagcgcaaaagatg

SEQ ID NO: 116342 - DNA, 103 bp, Artificial Sequence
  Synthetic Polynucleotide
taatacgactcactatagggtccgagcatatgcaactaggttttccatccaacagaggagaggatggatgacctagttgaacctggcggcagcgcaaaagatg

SEQ ID NO: 116343 - DNA, 103 bp, Artificial Sequence
  Synthetic Polynucleotide
taatacgactcactatagggccttcaactttccgagcatatgcaactaggaacagaggagacctagtatgatatgctcgaacctggcggcagcgcaaaagatg

SEQ ID NO: 116344 - DNA, 103 bp, Artificial Sequence
  Synthetic Polynucleotide
taatacgactcactatagggatacatgtccccttcaactttccgagcataaacagaggagatatgctatgaaagttgaaaacctggcggcagcgcaaaagatg

SEQ ID NO: 116345 - DNA, 103 bp, Artificial Sequence
  Synthetic Polynucleotide
taatacgactcactatagggttgcagattcatacatgtccccttcaacttaacagaggagaaagttgatggggacatgtaacctggcggcagcgcaaaagatg

SEQ ID NO: 116346 - DNA, 103 bp, Artificial Sequence
  Synthetic Polynucleotide
taatacgactcactataggggctcgattgtttgcagattcatacatgtccaacagaggagaggacatatgtgaatctgcaacctggcggcagcgcaaaagatg

SEQ ID NO: 116347 - DNA, 103 bp, Artificial Sequence
  Synthetic Polynucleotide
taatacgactcactataggggtagtattccgctcgattgtttgcagattcaacagaggagagaatctatgaacaatcgaaacctggcggcagcgcaaaagatg

SEQ ID NO: 116348 - DNA, 103 bp, Artificial Sequence
  Synthetic Polynucleotide
taatacgactcactatagggctagaaggtggtagtattccgctcgattgtaacagaggagaacaatcatgcggaatactaacctggcggcagcgcaaaagatg

SEQ ID NO: 116349 - DNA, 103 bp, Artificial Sequence
  Synthetic Polynucleotide
taatacgactcactatagggattttctcagctagaaggtggtagtattccaacagaggagaggaataatgccaccttctaacctggcggcagcgcaaaagatg

SEQ ID NO: 116350 - DNA, 103 bp, Artificial Sequence
  Synthetic Polynucleotide
taatacgactcactatagggcatgccaagacttgtctgaagctgattaataacagaggagaattaatatgcttcagacaaacctggcggcagcgcaaaagatg

SEQ ID NO: 116351 - DNA, 103 bp, Artificial Sequence
  Synthetic Polynucleotide
taatacgactcactataggggatcttatagattttctcagctagaaggtgaacagaggagacaccttatggctgagaaaaacctggcggcagcgcaaaagatg

SEQ ID NO: 116352 - DNA, 103 bp, Artificial Sequence
  Synthetic Polynucleotide
taatacgactcactataggggttctttctggatcttatagattttctcagaacagaggagactgagaatgtctataagaaacctggcggcagcgcaaaagatg

SEQ ID NO: 116353 - DNA, 103 bp, Artificial Sequence
  Synthetic Polynucleotide
taatacgactcactatagggttttcttctagttctttctggatcttatagaacagaggagactataaatgccagaaagaaacctggcggcagcgcaaaagatg

SEQ ID NO: 116354 - DNA, 103 bp, Artificial Sequence
  Synthetic Polynucleotide
taatacgactcactatagggggtccttcgtttttcttctagttctttctgaacagaggagacagaaaatgctagaagaaaacctggcggcagcgcaaaagatg

SEQ ID NO: 116355 - DNA, 103 bp, Artificial Sequence
  Synthetic Polynucleotide
taatacgactcactatagggtctgtagtctggtccttcgtttttcttctaaacagaggagatagaagatgaacgaaggaaacctggcggcagcgcaaaagatg

SEQ ID NO: 116356 - DNA, 103 bp, Artificial Sequence
  Synthetic Polynucleotide
taatacgactcactatagggatgttctgcttctgtagtctggtccttcgtaacagaggagaacgaagatgcagactacaaacctggcggcagcgcaaaagatg

SEQ ID NO: 116357 - DNA, 103 bp, Artificial Sequence
  Synthetic Polynucleotide
taatacgactcactatagggatttggtagcatgttctgcttctgtagtctaacagaggagaagactaatgaagcagaacaacctggcggcagcgcaaaagatg

SEQ ID NO: 116358 - DNA, 103 bp, Artificial Sequence
  Synthetic Polynucleotide
taatacgactcactatagggtgcctgcagcatttggtagcatgttctgctaacagaggagaagcagaatgtgctaccaaaacctggcggcagcgcaaaagatg

SEQ ID NO: 116359 - DNA, 103 bp, Artificial Sequence
  Synthetic Polynucleotide
taatacgactcactatagggactggaaccatgcctgcagcatttggtagcaacagaggagagctaccatgtgctgcaggaacctggcggcagcgcaaaagatg

SEQ ID NO: 116360 - DNA, 103 bp, Artificial Sequence
  Synthetic Polynucleotide
taatacgactcactatagggattcatggaaactggaaccatgcctgcagcaacagaggagagctgcaatgatggttccaaacctggcggcagcgcaaaagatg

SEQ ID NO: 116361 - DNA, 103 bp, Artificial Sequence
  Synthetic Polynucleotide
taatacgactcactatagggtggctgaaggcggccccggttccaccacataacagaggagaatgtggatgaaccggggcaacctggcggcagcgcaaaagatg

SEQ ID NO: 116362 - DNA, 103 bp, Artificial Sequence
  Synthetic Polynucleotide
taatacgactcactatagggcatcttgtaccatgccaagacttgtctgaaaacagaggagattcagaatggtcttggcaaacctggcggcagcgcaaaagatg

SEQ ID NO: 116363 - DNA, 103 bp, Artificial Sequence
  Synthetic Polynucleotide
taatacgactcactatagggtaggccctggattcatggaaactggaaccaaacagaggagatggttcatgtttccatgaaacctggcggcagcgcaaaagatg

SEQ ID NO: 116364 - DNA, 103 bp, Artificial Sequence
  Synthetic Polynucleotide
taatacgactcactatagggtgtcccatgttaggccctggattcatggaaaacagaggagattccatatgtccagggccaacctggcggcagcgcaaaagatg

SEQ ID NO: 116365 - DNA, 103 bp, Artificial Sequence
  Synthetic Polynucleotide
taatacgactcactatagggtggttgcggctgtcccatgttaggccctggaacagaggagaccagggatgaacatgggaaacctggcggcagcgcaaaagatg

SEQ ID NO: 116366 - DNA, 103 bp, Artificial Sequence
  Synthetic Polynucleotide
taatacgactcactatagggaagtcattcctggttgcggctgtcccatgtaacagaggagaacatggatgagccgcaacaacctggcggcagcgcaaaagatg

SEQ ID NO: 116367 - DNA, 103 bp, Artificial Sequence
  Synthetic Polynucleotide
taatacgactcactataggggggccattagaagtcattcctggttgcggcaacagaggagagccgcaatgaggaatgacaacctggcggcagcgcaaaagatg

SEQ ID NO: 116368 - DNA, 103 bp, Artificial Sequence
  Synthetic Polynucleotide
taatacgactcactataggggtcaggtagagggccattagaagtcattccaacagaggagaggaatgatgtctaatggcaacctggcggcagcgcaaaagatg

SEQ ID NO: 116369 - DNA, 103 bp, Artificial Sequence
  Synthetic Polynucleotide
taatacgactcactatagggtcatacttgggtcaggtagagggccattagaacagaggagactaatgatgctctacctgaacctggcggcagcgcaaaagatg

SEQ ID NO: 116370 - DNA, 103 bp, Artificial Sequence
  Synthetic Polynucleotide
taatacgactcactatagggctgccacggatcatacttgggtcaggtagaaacagaggagatctaccatgcccaagtataacctggcggcagcgcaaaagatg

SEQ ID NO: 116371 - DNA, 103 bp, Artificial Sequence
  Synthetic Polynucleotide
taatacgactcactataggggtttggcacactgccacggatcatacttggaacagaggagaccaagtatgatccgtggcaacctggcggcagcgcaaaagatg

SEQ ID NO: 116372 - DNA, 103 bp, Artificial Sequence
  Synthetic Polynucleotide
taatacgactcactataggggcatcatctggtttggcacactgccacggaaacagaggagatccgtgatggtgtgccaaaacctggcggcagcgcaaaagatg

SEQ ID NO: 116373 - DNA, 103 bp, Artificial Sequence
  Synthetic Polynucleotide
taatacgactcactatagggttagaagctgcatcttgtaccatgccaagaaacagaggagatcttggatgggtacaagaaacctggcggcagcgcaaaagatg

SEQ ID NO: 116374 - DNA, 103 bp, Artificial Sequence
  Synthetic Polynucleotide
taatacgactcactataggggttattcgaggcatcatctggtttggcacaaacagaggagatgtgccatgccagatgataacctggcggcagcgcaaaagatg

SEQ ID NO: 116375 - DNA, 103 bp, Artificial Sequence
  Synthetic Polynucleotide
taatacgactcactatagggagattgtggagttattcgaggcatcatctgaacagaggagacagatgatgcctcgaataaacctggcggcagcgcaaaagatg

SEQ ID NO: 116376 - DNA, 103 bp, Artificial Sequence
  Synthetic Polynucleotide
taatacgactcactataggggattcaaaccagattgtggagttattcgagaacagaggagactcgaaatgctccacaataacctggcggcagcgcaaaagatg

SEQ ID NO: 116377 - DNA, 103 bp, Artificial Sequence
  Synthetic Polynucleotide
taatacgactcactatagggtggccaaattgattcaaaccagattgtggaaacagaggagatccacaatgtggtttgaaaacctggcggcagcgcaaaagatg

SEQ ID NO: 116378 - DNA, 103 bp, Artificial Sequence
  Synthetic Polynucleotide
taatacgactcactatagggcatgctcatctggccaaattgattcaaaccaacagaggagaggtttgatgcaatttggcaacctggcggcagcgcaaaagatg

SEQ ID NO: 116379 - DNA, 103 bp, Artificial Sequence
  Synthetic Polynucleotide
taatacgactcactatagggggggctgggccatgctcatctggccaaattaacagaggagaaatttgatgagatgagcaaacctggcggcagcgcaaaagatg

SEQ ID NO: 116380 - DNA, 103 bp, Artificial Sequence
  Synthetic Polynucleotide
taatacgactcactatagggggtacaatagggggctgggccatgctcatcaacagaggagagatgagatgggcccagccaacctggcggcagcgcaaaagatg

SEQ ID NO: 116381 - DNA, 103 bp, Artificial Sequence
  Synthetic Polynucleotide
taatacgactcactatagggggtttgccggggtacaatagggggctgggcaacagaggagagcccagatgcctattgtaaacctggcggcagcgcaaaagatg

SEQ ID NO: 116382 - DNA, 103 bp, Artificial Sequence
  Synthetic Polynucleotide
taatacgactcactataggggaagaggaggggtttgccggggtacaatagaacagaggagactattgatgcccggcaaaaacctggcggcagcgcaaaagatg

SEQ ID NO: 116383 - DNA, 103 bp, Artificial Sequence
  Synthetic Polynucleotide
taatacgactcactatagggccatggtgctgaagaggaggggtttgccggaacagaggagaccggcaatgccctcctctaacctggcggcagcgcaaaagatg

SEQ ID NO: 116384 - DNA, 103 bp, Artificial Sequence
  Synthetic Polynucleotide
taatacgactcactatagggctgtttatgtttagaagctgcatcttgtacaacagaggagagtacaaatggcagcttctaacctggcggcagcgcaaaagatg

SEQ ID NO: 116385 - DNA, 103 bp, Artificial Sequence
  Synthetic Polynucleotide
taatacgactcactatagggagccaactgtccatggtgctgaagaggaggaacagaggagacctcctatgcagcaccataacctggcggcagcgcaaaagatg

SEQ ID NO: 116386 - DNA, 103 bp, Artificial Sequence
  Synthetic Polynucleotide
taatacgactcactatagggctccaggttgagccaactgtccatggtgctaacagaggagaagcaccatggacagttggaacctggcggcagcgcaaaagatg

SEQ ID NO: 116387 - DNA, 103 bp, Artificial Sequence
  Synthetic Polynucleotide
taatacgactcactataggggggttgagagctccaggttgagccaactgtaacagaggagaacagttatgtcaacctggaacctggcggcagcgcaaaagatg

SEQ ID NO: 116388 - DNA, 103 bp, Artificial Sequence
  Synthetic Polynucleotide
taatacgactcactataggggcccataggcgggttgagagctccaggttgaacagaggagacaacctatggctctcaacaacctggcggcagcgcaaaagatg

SEQ ID NO: 116389 - DNA, 103 bp, Artificial Sequence
  Synthetic Polynucleotide
taatacgactcactataggggaggcccatagcccataggcgggttgagagaacagaggagactctcaatgcgcctatggaacctggcggcagcgcaaaagatg

SEQ ID NO: 116390 - DNA, 103 bp, Artificial Sequence
  Synthetic Polynucleotide
taatacgactcactatagggtgttgcatacgaggcccatagcccataggcaacagaggagagcctatatgctatgggccaacctggcggcagcgcaaaagatg

SEQ ID NO: 116391 - DNA, 103 bp, Artificial Sequence
  Synthetic Polynucleotide
taatacgactcactataggggttggaaggctgttgcatacgaggcccataaacagaggagatatgggatgcgtatgcaaaacctggcggcagcgcaaaagatg

SEQ ID NO: 116392 - DNA, 103 bp, Artificial Sequence
  Synthetic Polynucleotide
taatacgactcactatagggactggccctggttggaaggctgttgcatacaacagaggagagtatgcatgagccttccaaacctggcggcagcgcaaaagatg

SEQ ID NO: 116393 - DNA, 103 bp, Artificial Sequence
  Synthetic Polynucleotide
taatacgactcactatagggtgaggaaggaactggccctggttggaaggcaacagaggagagccttcatgccagggccaaacctggcggcagcgcaaaagatg

SEQ ID NO: 116394 - DNA, 103 bp, Artificial Sequence
  Synthetic Polynucleotide
taatacgactcactataggggaactgagtctgaggaaggaactggccctgaacagaggagacagggcatgttccttcctaacctggcggcagcgcaaaagatg

SEQ ID NO: 116395 - DNA, 103 bp, Artificial Sequence
  Synthetic Polynucleotide
taatacgactcactatagggattctgacagctgtttatgtttagaagctgaacagaggagacagcttatgaacataaacaacctggcggcagcgcaaaagatg

SEQ ID NO: 116396 - DNA, 103 bp, Artificial Sequence
  Synthetic Polynucleotide
taatacgactcactatagggcctgtgatgggaactgagtctgaggaaggaaacagaggagatccttcatgagactcagtaacctggcggcagcgcaaaagatg

SEQ ID NO: 116397 - DNA, 103 bp, Artificial Sequence
  Synthetic Polynucleotide
taatacgactcactatagggacattcattccctgtgatgggaactgagtcaacagaggagagactcaatgcccatcacaaacctggcggcagcgcaaaagatg

SEQ ID NO: 116398 - DNA, 103 bp, Artificial Sequence
  Synthetic Polynucleotide
taatacgactcactataggggatatttgttacattcattccctgtgatggaacagaggagaccatcaatgggaatgaataacctggcggcagcgcaaaagatg

SEQ ID NO: 116399 - DNA, 103 bp, Artificial Sequence
  Synthetic Polynucleotide
taatacgactcactataggggagccaaagggatatttgttacattcattcaacagaggagagaatgaatgtaacaaataaacctggcggcagcgcaaaagatg

SEQ ID NO: 116400 - DNA, 103 bp, Artificial Sequence
  Synthetic Polynucleotide
taatacgactcactatagggccgctggacggagccaaagggatatttgttaacagaggagaaacaaaatgccctttggcaacctggcggcagcgcaaaagatg

SEQ ID NO: 116401 - DNA, 103 bp, Artificial Sequence
  Synthetic Polynucleotide
taatacgactcactatagggtggagcttgaccgctggacggagccaaaggaacagaggagacctttgatgccgtccagcaacctggcggcagcgcaaaagatg

SEQ ID NO: 116402 - DNA, 103 bp, Artificial Sequence
  Synthetic Polynucleotide
taatacgactcactatagggcttgagacactggagcttgaccgctggacgaacagaggagacgtccaatggtcaagctcaacctggcggcagcgcaaaagatg

SEQ ID NO: 116403 - DNA, 103 bp, Artificial Sequence
  Synthetic Polynucleotide
taatacgactcactataggggacatttgtgcttgagacactggagcttgaaacagaggagatcaagcatgagtgtctcaaacctggcggcagcgcaaaagatg

SEQ ID NO: 116404 - DNA, 103 bp, Artificial Sequence
  Synthetic Polynucleotide
taatacgactcactatagggggaagaactagacatttgtgcttgagacacaacagaggagagtgtctatggcacaaatgaacctggcggcagcgcaaaagatg

SEQ ID NO: 116405 - DNA, 103 bp, Artificial Sequence
  Synthetic Polynucleotide
taatacgactcactatagggtcaccgggcaggaagaactagacatttgtgaacagaggagacacaaaatgctagttcttaacctggcggcagcgcaaaagatg

SEQ ID NO: 116406 - DNA, 103 bp, Artificial Sequence
  Synthetic Polynucleotide
taatacgactcactataggggatcgcagcaattctgacagctgtttatgtaacagaggagaacataaatggctgtcagaaacctggcggcagcgcaaaagatg

SEQ ID NO: 116407 - DNA, 103 bp, Artificial Sequence
  Synthetic Polynucleotide
taatacgactcactatagggataggagagttcaccgggcaggaagaactaaacagaggagatagttcatgctgcccggtaacctggcggcagcgcaaaagatg

SEQ ID NO: 116408 - DNA, 103 bp, Artificial Sequence
  Synthetic Polynucleotide
taatacgactcactatagggtggaggcattataggagagttcaccgggcaaacagaggagatgcccgatgaactctcctaacctggcggcagcgcaaaagatg

SEQ ID NO: 116409 - DNA, 103 bp, Artificial Sequence
  Synthetic Polynucleotide
taatacgactcactatagggcctgagaccctggaggcattataggagagtaacagaggagaactctcatgtaatgcctcaacctggcggcagcgcaaaagatg

SEQ ID NO: 116410 - DNA, 103 bp, Artificial Sequence
  Synthetic Polynucleotide
taatacgactcactatagggatgtggctcccctgagaccctggaggcattaacagaggagaaatgccatgagggtctcaaacctggcggcagcgcaaaagatg

SEQ ID NO: 116411 - DNA, 103 bp, Artificial Sequence
  Synthetic Polynucleotide
taatacgactcactataggggggacagtgaatgtggctcccctgagacccaacagaggagagggtctatggggagccacaacctggcggcagcgcaaaagatg

SEQ ID NO: 116412 - DNA, 103 bp, Artificial Sequence
  Synthetic Polynucleotide
taatacgactcactataggggaggaagctggggacagtgaatgtggctccaacagaggagaggagccatgttcactgtcaacctggcggcagcgcaaaagatg

SEQ ID NO: 116413 - DNA, 103 bp, Artificial Sequence
  Synthetic Polynucleotide
taatacgactcactatagggagagctggttgaggaagctggggacagtgaaacagaggagatcactgatgccagcttccaacctggcggcagcgcaaaagatg

SEQ ID NO: 116414 - DNA, 103 bp, Artificial Sequence
  Synthetic Polynucleotide
taatacgactcactatagggattctgatgaagagctggttgaggaagctgaacagaggagacagcttatgcaaccagctaacctggcggcagcgcaaaagatg

SEQ ID NO: 116415 - DNA, 103 bp, Artificial Sequence
  Synthetic Polynucleotide
taatacgactcactataggggcgagggtgaattctgatgaagagctggttaacagaggagaaaccagatgttcatcagaaacctggcggcagcgcaaaagatg

SEQ ID NO: 116416 - DNA, 103 bp, Artificial Sequence
  Synthetic Polynucleotide
taatacgactcactatagggctaggtacaggcgagggtgaattctgatgaaacagaggagatcatcaatgttcaccctcaacctggcggcagcgcaaaagatg

SEQ ID NO: 116417 - DNA, 103 bp, Artificial Sequence
  Synthetic Polynucleotide
taatacgactcactatagggggaactaccagatcgcagcaattctgacagaacagaggagactgtcaatgttgctgcgaaacctggcggcagcgcaaaagatg

SEQ ID NO: 116418 - DNA, 103 bp, Artificial Sequence
  Synthetic Polynucleotide
taatacgactcactataggggggggtacgactaggtacaggcgagggtgaaacagaggagatcacccatgcctgtacctaacctggcggcagcgcaaaagatg

SEQ ID NO: 116419 - DNA, 103 bp, Artificial Sequence
  Synthetic Polynucleotide
taatacgactcactatagggggtgaggggtgggggtacgactaggtacagaacagaggagactgtacatggtcgtacccaacctggcggcagcgcaaaagatg

SEQ ID NO: 116420 - DNA, 103 bp, Artificial Sequence
  Synthetic Polynucleotide
taatacgactcactataggggggggagtatggtgaggggtgggggtacgaaacagaggagatcgtacatgcacccctcaaacctggcggcagcgcaaaagatg

SEQ ID NO: 116421 - DNA, 103 bp, Artificial Sequence
  Synthetic Polynucleotide
taatacgactcactatagggccctatgcttgggggagtatggtgaggggtaacagaggagaacccctatgcatactcccaacctggcggcagcgcaaaagatg

SEQ ID NO: 116422 - DNA, 103 bp, Artificial Sequence
  Synthetic Polynucleotide
taatacgactcactataggggctgctgagcccctatgcttgggggagtataacagaggagaatactcatgcaagcatagaacctggcggcagcgcaaaagatg

SEQ ID NO: 116423 - DNA, 103 bp, Artificial Sequence
  Synthetic Polynucleotide
taatacgactcactataggggttgctggtggctgctgagcccctatgcttaacagaggagaaagcatatgggctcagcaaacctggcggcagcgcaaaagatg

SEQ ID NO: 116424 - DNA, 103 bp, Artificial Sequence
  Synthetic Polynucleotide
taatacgactcactatagggtggaattgttgttgctggtggctgctgagcaacagaggagagctcagatgccaccagcaaacctggcggcagcgcaaaagatg

SEQ ID NO: 116425 - DNA, 103 bp, Artificial Sequence
  Synthetic Polynucleotide
taatacgactcactataggggaacaggggctggaattgttgttgctggtgaacagaggagacaccagatgcaacaattcaacctggcggcagcgcaaaagatg

SEQ ID NO: 116426 - DNA, 103 bp, Artificial Sequence
  Synthetic Polynucleotide
taatacgactcactatagggggaggtgtaggaacaggggctggaattgttaacagaggagaaacaatatgagcccctgtaacctggcggcagcgcaaaagatg

SEQ ID NO: 116427 - DNA, 103 bp, Artificial Sequence
  Synthetic Polynucleotide
taatacgactcactatagggtggcatggcaggaggtgtaggaacaggggcaacagaggagagcccctatgcctacacctaacctggcggcagcgcaaaagatg

SEQ ID NO: 116428 - DNA, 103 bp, Artificial Sequence
  Synthetic Polynucleotide
taatacgactcactatagggtgaggttaggggaactaccagatcgcagcaaacagaggagatgctgcatgctggtagttaacctggcggcagcgcaaaagatg

SEQ ID NO: 116429 - DNA, 103 bp, Artificial Sequence
  Synthetic Polynucleotide
taatacgactcactataggggtggcccaggtggcatggcaggaggtgtagaacagaggagactacacatgctgccatgcaacctggcggcagcgcaaaagatg

SEQ ID NO: 116430 - DNA, 103 bp, Artificial Sequence
  Synthetic Polynucleotide
taatacgactcactataggggcctgggactgtggcccaggtggcatggcaaacagaggagatgccatatgacctgggccaacctggcggcagcgcaaaagatg

SEQ ID NO: 116431 - DNA, 103 bp, Artificial Sequence
  Synthetic Polynucleotide
taatacgactcactataggggggatgtagagcctgggactgtggcccaggaacagaggagacctgggatgcagtcccagaacctggcggcagcgcaaaagatg

SEQ ID NO: 116432 - DNA, 103 bp, Artificial Sequence
  Synthetic Polynucleotide
taatacgactcactataggggccttggagggggatgtagagcctgggactaacagaggagaagtcccatgctctacatcaacctggcggcagcgcaaaagatg

SEQ ID NO: 116433 - DNA, 103 bp, Artificial Sequence
  Synthetic Polynucleotide
taatacgactcactataggggtaggtgtctgccttggagggggatgtagaaacagaggagatctacaatgccctccaagaacctggcggcagcgcaaaagatg

SEQ ID NO: 116434 - DNA, 103 bp, Artificial Sequence
  Synthetic Polynucleotide
taatacgactcactatagggtgttggtggtgtaggtgtctgccttggaggaacagaggagacctccaatgcagacacctaacctggcggcagcgcaaaagatg

SEQ ID NO: 116435 - DNA, 103 bp, Artificial Sequence
  Synthetic Polynucleotide
taatacgactcactataggggaagttgtgttgttggtggtgtaggtgtctaacagaggagaagacacatgcaccaccaaaacctggcggcagcgcaaaagatg

SEQ ID NO: 116436 - DNA, 103 bp, Artificial Sequence
  Synthetic Polynucleotide
taatacgactcactatagggacttgttggggaagttgtgttgttggtggtaacagaggagaaccaccatgaacacaactaacctggcggcagcgcaaaagatg

SEQ ID NO: 116437 - DNA, 103 bp, Artificial Sequence
  Synthetic Polynucleotide
taatacgactcactatagggtgaaggctgcacttgttggggaagttgtgtaacagaggagaacacaaatgccccaacaaaacctggcggcagcgcaaaagatg

SEQ ID NO: 116438 - DNA, 103 bp, Artificial Sequence
  Synthetic Polynucleotide
taatacgactcactatagggcagcaggaagtgaaggctgcacttgttgggaacagaggagacccaacatgtgcagccttaacctggcggcagcgcaaaagatg

SEQ ID NO: 116439 - DNA, 103 bp, Artificial Sequence
  Synthetic Polynucleotide
taatacgactcactatagggactcccatattgaggttaggggaactaccaaacagaggagatggtagatgccctaacctaacctggcggcagcgcaaaagatg

SEQ ID NO: 116440 - DNA, 103 bp, Artificial Sequence
  Synthetic Polynucleotide
taatacgactcactataggggcagaaggtgcagcaggaagtgaaggctgcaacagaggagagcagccatgacttcctgcaacctggcggcagcgcaaaagatg

SEQ ID NO: 116441 - DNA, 103 bp, Artificial Sequence
  Synthetic Polynucleotide
taatacgactcactataggggggctggtcagcagaaggtgcagcaggaagaacagaggagacttcctatggcaccttctaacctggcggcagcgcaaaagatg

SEQ ID NO: 116442 - DNA, 103 bp, Artificial Sequence
  Synthetic Polynucleotide
taatacgactcactataggggctgctgctggggctggtcagcagaaggtgaacagaggagacaccttatgctgaccagcaacctggcggcagcgcaaaagatg

SEQ ID NO: 116443 - DNA, 103 bp, Artificial Sequence
  Synthetic Polynucleotide
taatacgactcactatagggtgtgagcgaggctgctgctggggctggtcaaacagaggagatgaccaatgccagcagcaaacctggcggcagcgcaaaagatg

SEQ ID NO: 116444 - DNA, 103 bp, Artificial Sequence
  Synthetic Polynucleotide
taatacgactcactatagggtgtgctctgctgtgagcgaggctgctgctgaacagaggagacagcagatgcctcgctcaaacctggcggcagcgcaaaagatg

SEQ ID NO: 116445 - DNA, 103 bp, Artificial Sequence
  Synthetic Polynucleotide
taatacgactcactatagggcagacgctgctgtgctctgctgtgagcgagaacagaggagactcgctatgagcagagcaaacctggcggcagcgcaaaagatg

SEQ ID NO: 116446 - DNA, 103 bp, Artificial Sequence
  Synthetic Polynucleotide
taatacgactcactatagggggggtaggaacagacgctgctgtgctctgcaacagaggagagcagagatgagcagcgtcaacctggcggcagcgcaaaagatg

SEQ ID NO: 116447 - DNA, 103 bp, Artificial Sequence
  Synthetic Polynucleotide
taatacgactcactatagggcggtgctgttggggtaggaacagacgctgcaacagaggagagcagcgatggttcctaccaacctggcggcagcgcaaaagatg

SEQ ID NO: 116448 - DNA, 103 bp, Artificial Sequence
  Synthetic Polynucleotide
taatacgactcactataggggaggaagcagcggtgctgttggggtaggaaaacagaggagattcctaatgcaacagcacaacctggcggcagcgcaaaagatg

SEQ ID NO: 116449 - DNA, 103 bp, Artificial Sequence
  Synthetic Polynucleotide
taatacgactcactataggggcaggctgcggaggaagcagcggtgctgttaacagaggagaaacagcatggctgcttccaacctggcggcagcgcaaaagatg

SEQ ID NO: 116450 - DNA, 103 bp, Artificial Sequence
  Synthetic Polynucleotide
taatacgactcactatagggtgggccaccaactcccatattgaggttaggaacagaggagacctaacatgaatatgggaaacctggcggcagcgcaaaagatg

SEQ ID NO: 116451 - DNA, 103 bp, Artificial Sequence
  Synthetic Polynucleotide
taatacgactcactatagggaagtggagttgcaggctgcggaggaagcagaacagaggagactgcttatgccgcagcctaacctggcggcagcgcaaaagatg

SEQ ID NO: 116452 - DNA, 103 bp, Artificial Sequence
  Synthetic Polynucleotide
taatacgactcactatagggctggctgggaaagtggagttgcaggctgcgaacagaggagacgcagcatgcaactccacaacctggcggcagcgcaaaagatg

SEQ ID NO: 116453 - DNA, 103 bp, Artificial Sequence
  Synthetic Polynucleotide
taatacgactcactatagggatgcttacagctggctgggaaagtggagttaacagaggagaaactccatgttcccagccaacctggcggcagcgcaaaagatg

SEQ ID NO: 116454 - DNA, 103 bp, Artificial Sequence
  Synthetic Polynucleotide
taatacgactcactatagggctgtccttcaatgcttacagctggctgggaaacagaggagatcccagatggctgtaagcaacctggcggcagcgcaaaagatg

SEQ ID NO: 116455 - DNA, 103 bp, Artificial Sequence
  Synthetic Polynucleotide
taatacgactcactataggggatttgatacctgtccttcaatgcttacagaacagaggagactgtaaatgttgaaggacaacctggcggcagcgcaaaagatg

SEQ ID NO: 116456 - DNA, 103 bp, Artificial Sequence
  Synthetic Polynucleotide
taatacgactcactataggggtagatggaggatttgatacctgtccttcaaacagaggagatgaaggatgggtatcaaaaacctggcggcagcgcaaaagatg

SEQ ID NO: 116457 - DNA, 103 bp, Artificial Sequence
  Synthetic Polynucleotide
taatacgactcactatagggtgtgctactagtagatggaggatttgatacaacagaggagagtatcaatgcctccatctaacctggcggcagcgcaaaagatg

SEQ ID NO: 116458 - DNA, 103 bp, Artificial Sequence
  Synthetic Polynucleotide
taatacgactcactatagggaattcacttctgtgctactagtagatggagaacagaggagactccatatgctagtagcaaacctggcggcagcgcaaaagatg

SEQ ID NO: 116459 - DNA, 103 bp, Artificial Sequence
  Synthetic Polynucleotide
taatacgactcactatagggatggcctgagaattcacttctgtgctactaaacagaggagatagtagatgagaagtgaaaacctggcggcagcgcaaaagatg

SEQ ID NO: 116460 - DNA, 103 bp, Artificial Sequence
  Synthetic Polynucleotide
taatacgactcactatagggcttctcagcaatggcctgagaattcacttcaacagaggagagaagtgatgtctcaggccaacctggcggcagcgcaaaagatg

SEQ ID NO: 116461 - DNA, 103 bp, Artificial Sequence
  Synthetic Polynucleotide
taatacgactcactatagggtgacttgacctgggccaccaactcccatataacagaggagaatatggatgttggtggccaacctggcggcagcgcaaaagatg

SEQ ID NO: 116462 - DNA, 103 bp, Artificial Sequence
  Synthetic Polynucleotide
taatacgactcactataggggggaaggctgcttctcagcaatggcctgagaacagaggagactcaggatgttgctgagaaacctggcggcagcgcaaaagatg

SEQ ID NO: 116463 - DNA, 103 bp, Artificial Sequence
  Synthetic Polynucleotide
taatacgactcactatagggttcacttcctgggaaggctgcttctcagcaaacagaggagatgctgaatggcagccttcaacctggcggcagcgcaaaagatg

SEQ ID NO: 116464 - DNA, 103 bp, Artificial Sequence
  Synthetic Polynucleotide
taatacgactcactatagggggcctccatcttcacttcctgggaaggctgaacagaggagacagcctatgcaggaagtgaacctggcggcagcgcaaaagatg

SEQ ID NO: 116465 - DNA, 103 bp, Artificial Sequence
  Synthetic Polynucleotide
taatacgactcactatagggcttccattttggcctccatcttcacttcctaacagaggagaaggaagatgagatggaggaacctggcggcagcgcaaaagatg

SEQ ID NO: 116466 - DNA, 103 bp, Artificial Sequence
  Synthetic Polynucleotide
taatacgactcactatagggggttgatccacttccattttggcctccatcaacagaggagagatggaatgcaaaatggaaacctggcggcagcgcaaaagatg

SEQ ID NO: 116467 - DNA, 103 bp, Artificial Sequence
  Synthetic Polynucleotide
taatacgactcactatagggtgctggttctggttgatccacttccattttaacagaggagaaaaatgatggtggatcaaaacctggcggcagcgcaaaagatg

SEQ ID NO: 116468 - DNA, 103 bp, Artificial Sequence
  Synthetic Polynucleotide
taatacgactcactataggggctgagtatctgctggttctggttgatccaaacagaggagatggatcatgcagaaccagaacctggcggcagcgcaaaagatg

SEQ ID NO: 116469 - DNA, 103 bp, Artificial Sequence
  Synthetic Polynucleotide
taatacgactcactatagggatatcctccggctgagtatctgctggttctaacagaggagaagaaccatgagatactcaaacctggcggcagcgcaaaagatg

SEQ ID NO: 116470 - DNA, 103 bp, Artificial Sequence
  Synthetic Polynucleotide
taatacgactcactatagggagactctgaaatatcctccggctgagtatcaacagaggagagatactatgccggaggataacctggcggcagcgcaaaagatg

SEQ ID NO: 116471 - DNA, 103 bp, Artificial Sequence
  Synthetic Polynucleotide
taatacgactcactatagggcttccactttagactctgaaatatcctccgaacagaggagacggaggatgtttcagagtaacctggcggcagcgcaaaagatg

SEQ ID NO: 116472 - DNA, 103 bp, Artificial Sequence
  Synthetic Polynucleotide
taatacgactcactatagggttaggccgcttggctgaaggcggccccggtaacagaggagaaccgggatggccttcagcaacctggcggcagcgcaaaagatg

SEQ ID NO: 116473 - DNA, 103 bp, Artificial Sequence
  Synthetic Polynucleotide
taatacgactcactatagggtggctggccatgacttgacctgggccaccaaacagaggagatggtggatgaggtcaagtaacctggcggcagcgcaaaagatg

SEQ ID NO: 116474 - DNA, 103 bp, Artificial Sequence
  Synthetic Polynucleotide
taatacgactcactatagggattttacagtcttccactttagactctgaaaacagaggagattcagaatgtaaagtggaaacctggcggcagcgcaaaagatg

SEQ ID NO: 116475 - DNA, 103 bp, Artificial Sequence
  Synthetic Polynucleotide
taatacgactcactatagggggtagattccattttacagtcttccactttaacagaggagaaaagtgatggactgtaaaaacctggcggcagcgcaaaagatg

SEQ ID NO: 116476 - DNA, 103 bp, Artificial Sequence
  Synthetic Polynucleotide
taatacgactcactatagggcttctgtttcggtagattccattttacagtaacagaggagaactgtaatgtggaatctaaacctggcggcagcgcaaaagatg

SEQ ID NO: 116477 - DNA, 103 bp, Artificial Sequence
  Synthetic Polynucleotide
taatacgactcactataggggtgcttctctcttctgtttcggtagattccaacagaggagaggaatcatgcgaaacagaaacctggcggcagcgcaaaagatg

SEQ ID NO: 116478 - DNA, 103 bp, Artificial Sequence
  Synthetic Polynucleotide
taatacgactcactatagggttttaactcagtgcttctctcttctgtttcaacagaggagagaaacaatggagagaagcaacctggcggcagcgcaaaagatg

SEQ ID NO: 116479 - DNA, 103 bp, Artificial Sequence
  Synthetic Polynucleotide
taatacgactcactatagggttatttcagtttttaactcagtgcttctctaacagaggagaagagaaatgctgagttaaaacctggcggcagcgcaaaagatg

SEQ ID NO: 116480 - DNA, 103 bp, Artificial Sequence
  Synthetic Polynucleotide
taatacgactcactatagggtcctcctcttttatttcagtttttaactcaaacagaggagatgagttatgaactgaaataacctggcggcagcgcaaaagatg

SEQ ID NO: 116481 - DNA, 103 bp, Artificial Sequence
  Synthetic Polynucleotide
taatacgactcactatagggtggctggtcttcctcctcttttatttcagtaacagaggagaactgaaatgaaagaggagaacctggcggcagcgcaaaagatg

SEQ ID NO: 116482 - DNA, 103 bp, Artificial Sequence
  Synthetic Polynucleotide
taatacgactcactatagggctgaagtacttggctggtcttcctcctcttaacagaggagaaagaggatgaagaccagcaacctggcggcagcgcaaaagatg

SEQ ID NO: 116483 - DNA, 103 bp, Artificial Sequence
  Synthetic Polynucleotide
taatacgactcactataggggactgggtagctgaagtacttggctggtctaacagaggagaagaccaatgaagtacttcaacctggcggcagcgcaaaagatg

SEQ ID NO: 116484 - DNA, 103 bp, Artificial Sequence
  Synthetic Polynucleotide
taatacgactcactatagggctgttgggcctggctggccatgacttgaccaacagaggagaggtcaaatgatggccagcaacctggcggcagcgcaaaagatg

SEQ ID NO: 116485 - DNA, 103 bp, Artificial Sequence
  Synthetic Polynucleotide
taatacgactcactatagggagccggagatgactgggtagctgaagtactaacagaggagaagtactatggctacccagaacctggcggcagcgcaaaagatg

SEQ ID NO: 116486 - DNA, 103 bp, Artificial Sequence
  Synthetic Polynucleotide
taatacgactcactatagggactgtcctggagccggagatgactgggtagaacagaggagactacccatgcatctccggaacctggcggcagcgcaaaagatg

SEQ ID NO: 116487 - DNA, 103 bp, Artificial Sequence
  Synthetic Polynucleotide
taatacgactcactatagggtttttctttgactgtcctggagccggagataacagaggagaatctccatgtccaggacaaacctggcggcagcgcaaaagatg

SEQ ID NO: 116488 - DNA, 103 bp, Artificial Sequence
  Synthetic Polynucleotide
taatacgactcactatagggtttgaaaatctttttctttgactgtcctggaacagaggagaccaggaatgtcaaagaaaaacctggcggcagcgcaaaagatg

SEQ ID NO: 116489 - DNA, 103 bp, Artificial Sequence
  Synthetic Polynucleotide
taatacgactcactataggggttcttctggtttgaaaatctttttctttgaacagaggagacaaagaatgagattttcaaacctggcggcagcgcaaaagatg

SEQ ID NO: 116490 - DNA, 103 bp, Artificial Sequence
  Synthetic Polynucleotide
taatacgactcactataggggcctgtcgtagttcttctggtttgaaaatcaacagaggagagattttatgaccagaagaaacctggcggcagcgcaaaagatg

SEQ ID NO: 116491 - DNA, 103 bp, Artificial Sequence
  Synthetic Polynucleotide
taatacgactcactatagggtggcatcagtgcctgtcgtagttcttctggaacagaggagaccagaaatgctacgacagaacctggcggcagcgcaaaagatg

SEQ ID NO: 116492 - DNA, 103 bp, Artificial Sequence
  Synthetic Polynucleotide
taatacgactcactatagggcctccaaagttggcatcagtgcctgtcgtaaacagaggagatacgacatgcactgatgcaacctggcggcagcgcaaaagatg

SEQ ID NO: 116493 - DNA, 103 bp, Artificial Sequence
  Synthetic Polynucleotide
taatacgactcactatagggcggtaaagtgcctccaaagttggcatcagtaacagaggagaactgatatgaactttggaaacctggcggcagcgcaaaagatg

SEQ ID NO: 116494 - DNA, 103 bp, Artificial Sequence
  Synthetic Polynucleotide
taatacgactcactatagggtggatcctgacggtaaagtgcctccaaagtaacagaggagaactttgatggcactttacaacctggcggcagcgcaaaagatg

SEQ ID NO: 116495 - DNA, 103 bp, Artificial Sequence
  Synthetic Polynucleotide
taatacgactcactatagggcaggactgctctgttgggcctggctggccaaacagaggagatggccaatgaggcccaacaacctggcggcagcgcaaaagatg

SEQ ID NO: 116496 - DNA, 103 bp, Artificial Sequence
  Synthetic Polynucleotide
taatacgactcactataggggaagggattctggatcctgacggtaaagtgaacagaggagacactttatggtcaggatcaacctggcggcagcgcaaaagatg

SEQ ID NO: 116497 - DNA, 103 bp, Artificial Sequence
  Synthetic Polynucleotide
taatacgactcactatagggtgacgaaagggaagggattctggatcctgaaacagaggagatcaggaatgagaatccctaacctggcggcagcgcaaaagatg

SEQ ID NO: 116498 - DNA, 103 bp, Artificial Sequence
  Synthetic Polynucleotide
taatacgactcactataggggtccacaggttgacgaaagggaagggattcaacagaggagagaatccatgccctttcgtaacctggcggcagcgcaaaagatg

SEQ ID NO: 116499 - DNA, 103 bp, Artificial Sequence
  Synthetic Polynucleotide
taatacgactcactatagggaaagctgagggtccacaggttgacgaaaggaacagaggagacctttcatgaacctgtggaacctggcggcagcgcaaaagatg

SEQ ID NO: 116500 - DNA, 103 bp, Artificial Sequence
  Synthetic Polynucleotide
taatacgactcactataggggggattcctaaaagctgagggtccacaggtaacagaggagaacctgtatgccctcagctaacctggcggcagcgcaaaagatg

SEQ ID NO: 116501 - DNA, 103 bp, Artificial Sequence
  Synthetic Polynucleotide
taatacgactcactatagggaaagtaatcagggattcctaaaagctgaggaacagaggagacctcagatgttaggaatcaacctggcggcagcgcaaaagatg

SEQ ID NO: 116502 - DNA, 103 bp, Artificial Sequence
  Synthetic Polynucleotide
taatacgactcactatagggtcacaatatcaaagtaatcagggattcctaaacagaggagataggaaatgctgattactaacctggcggcagcgcaaaagatg

SEQ ID NO: 116503 - DNA, 103 bp, Artificial Sequence
  Synthetic Polynucleotide
taatacgactcactatagggatggggctcttcacaatatcaaagtaatcaaacagaggagatgattaatgtgatattgtaacctggcggcagcgcaaaagatg

SEQ ID NO: 116504 - DNA, 103 bp, Artificial Sequence
  Synthetic Polynucleotide
taatacgactcactatagggagaaagatccatggggctcttcacaatatcaacagaggagagatattatgaagagccccaacctggcggcagcgcaaaagatg

SEQ ID NO: 116505 - DNA, 103 bp, Artificial Sequence
  Synthetic Polynucleotide
taatacgactcactatagggtcttaatggtagaaagatccatggggctctaacagaggagaagagccatgtggatctttaacctggcggcagcgcaaaagatg

SEQ ID NO: 116506 - DNA, 103 bp, Artificial Sequence
  Synthetic Polynucleotide
taatacgactcactatagggaaacctaatccaggactgctctgttgggccaacagaggagaggcccaatggagcagtccaacctggcggcagcgcaaaagatg

SEQ ID NO: 116507 - DNA, 103 bp, Artificial Sequence
  Synthetic Polynucleotide
taatacgactcactatagggtctaacttcctcttaatggtagaaagatccaacagaggagaggatctatgtaccattaaaacctggcggcagcgcaaaagatg

SEQ ID NO: 116508 - DNA, 103 bp, Artificial Sequence
  Synthetic Polynucleotide
taatacgactcactatagggctgtccagtgtctaacttcctcttaatggtaacagaggagaaccattatgaggaagttaaacctggcggcagcgcaaaagatg

SEQ ID NO: 116509 - DNA, 103 bp, Artificial Sequence
  Synthetic Polynucleotide
taatacgactcactataggggctcctgatactgtccagtgtctaacttccaacagaggagaggaagtatgacactggacaacctggcggcagcgcaaaagatg

SEQ ID NO: 116510 - DNA, 103 bp, Artificial Sequence
  Synthetic Polynucleotide
taatacgactcactatagggtactgccagggctcctgatactgtccagtgaacagaggagacactggatggtatcaggaaacctggcggcagcgcaaaagatg

SEQ ID NO: 116511 - DNA, 103 bp, Artificial Sequence
  Synthetic Polynucleotide
taatacgactcactatagggatcatcgacatactgccagggctcctgataaacagaggagatatcagatgccctggcagaacctggcggcagcgcaaaagatg

SEQ ID NO: 116512 - DNA, 103 bp, Artificial Sequence
  Synthetic Polynucleotide
taatacgactcactatagggtaagccaaatatcatcgacatactgccaggaacagaggagacctggcatgatgtcgatgaacctggcggcagcgcaaaagatg

SEQ ID NO: 116513 - DNA, 103 bp, Artificial Sequence
  Synthetic Polynucleotide
taatacgactcactatagggttattgaacataagccaaatatcatcgacaaacagaggagatgtcgaatgtatttggctaacctggcggcagcgcaaaagatg

SEQ ID NO: 116514 - DNA, 103 bp, Artificial Sequence
  Synthetic Polynucleotide
taatacgactcactatagggtaaccaggcattattgaacataagccaaataacagaggagaatttggatgatgttcaataacctggcggcagcgcaaaagatg

SEQ ID NO: 116515 - DNA, 103 bp, Artificial Sequence
  Synthetic Polynucleotide
taatacgactcactatagggtccggttatataaccaggcattattgaacaaacagaggagatgttcaatgatgcctggtaacctggcggcagcgcaaaagatg

SEQ ID NO: 116516 - DNA, 103 bp, Artificial Sequence
  Synthetic Polynucleotide
taatacgactcactatagggcgtgatgttttccggttatataaccaggcaaacagaggagatgcctgatgatataaccgaacctggcggcagcgcaaaagatg

SEQ ID NO: 116517 - DNA, 103 bp, Artificial Sequence
  Synthetic Polynucleotide
taatacgactcactataggggctatttatcaaacctaatccaggactgctaacagaggagaagcagtatgggattaggtaacctggcggcagcgcaaaagatg

SEQ ID NO: 116518 - DNA, 103 bp, Artificial Sequence
  Synthetic Polynucleotide
taatacgactcactatagggtttgtatacccgtgatgttttccggttataaacagaggagatataacatgaaaacatcaaacctggcggcagcgcaaaagatg

SEQ ID NO: 116519 - DNA, 103 bp, Artificial Sequence
  Synthetic Polynucleotide
taatacgactcactatagggtggagcagtatttgtatacccgtgatgtttaacagaggagaaaacatatggggtatacaaacctggcggcagcgcaaaagatg

SEQ ID NO: 116520 - DNA, 103 bp, Artificial Sequence
  Synthetic Polynucleotide
taatacgactcactatagggtcagagagcttggagcagtatttgtataccaacagaggagaggtataatgatactgctcaacctggcggcagcgcaaaagatg

SEQ ID NO: 116521 - DNA, 103 bp, Artificial Sequence
  Synthetic Polynucleotide
taatacgactcactatagggttcaaagacctcagagagcttggagcagtaaacagaggagatactgcatgaagctctctaacctggcggcagcgcaaaagatg

SEQ ID NO: 116522 - DNA, 103 bp, Artificial Sequence
  Synthetic Polynucleotide
taatacgactcactatagggcaatttcttgttcaaagacctcagagagctaacagaggagaagctctatgaggtctttgaacctggcggcagcgcaaaagatg

SEQ ID NO: 116523 - DNA, 103 bp, Artificial Sequence
  Synthetic Polynucleotide
taatacgactcactatagggatcactgggtcaatttcttgttcaaagaccaacagaggagaggtcttatgacaagaaataacctggcggcagcgcaaaagatg

SEQ ID NO: 116524 - DNA, 103 bp, Artificial Sequence
  Synthetic Polynucleotide
taatacgactcactatagggaaggctttgcatcactgggtcaatttcttgaacagaggagacaagaaatggacccagtgaacctggcggcagcgcaaaagatg

SEQ ID NO: 116525 - DNA, 103 bp, Artificial Sequence
  Synthetic Polynucleotide
taatacgactcactatagggaacagtatccaaggctttgcatcactgggtaacagaggagaacccagatgtgcaaagccaacctggcggcagcgcaaaagatg

SEQ ID NO: 116526 - DNA, 103 bp, Artificial Sequence
  Synthetic Polynucleotide
taatacgactcactatagggtttctgccacaacagtatccaaggctttgcaacagaggagagcaaagatgtggatactgaacctggcggcagcgcaaaagatg

SEQ ID NO: 116527 - DNA, 103 bp, Artificial Sequence
  Synthetic Polynucleotide
taatacgactcactataggggaactccaactttctgccacaacagtatccaacagaggagaggatacatgtgtggcagaaacctggcggcagcgcaaaagatg

SEQ ID NO: 116528 - DNA, 103 bp, Artificial Sequence
  Synthetic Polynucleotide
taatacgactcactatagggttttgaccatgctatttatcaaacctaatcaacagaggagagattagatgtgataaataaacctggcggcagcgcaaaagatg

SEQ ID NO: 116529 - DNA, 103 bp, Artificial Sequence
  Synthetic Polynucleotide
taatacgactcactatagggtctgtggagagaactccaactttctgccacaacagaggagagtggcaatgagttggagtaacctggcggcagcgcaaaagatg

SEQ ID NO: 116530 - DNA, 103 bp, Artificial Sequence
  Synthetic Polynucleotide
taatacgactcactatagggcaacacagtgtctgtggagagaactccaacaacagaggagagttggaatgctctccacaaacctggcggcagcgcaaaagatg

SEQ ID NO: 116531 - DNA, 103 bp, Artificial Sequence
  Synthetic Polynucleotide
taatacgactcactatagggtttgccgtagcaacacagtgtctgtggagaaacagaggagatctccaatgacactgtgtaacctggcggcagcgcaaaagatg

SEQ ID NO: 116532 - DNA, 103 bp, Artificial Sequence
  Synthetic Polynucleotide
taatacgactcactatagggtgcacaactgtttgccgtagcaacacagtgaacagaggagacactgtatggctacggcaaacctggcggcagcgcaaaagatg

SEQ ID NO: 116533 - DNA, 103 bp, Artificial Sequence
  Synthetic Polynucleotide
taatacgactcactatagggcgaggtattgtgcacaactgtttgccgtagaacagaggagactacggatgacagttgtgaacctggcggcagcgcaaaagatg

SEQ ID NO: 116534 - DNA, 103 bp, Artificial Sequence
  Synthetic Polynucleotide
taatacgactcactatagggagtggcatcacgaggtattgtgcacaactgaacagaggagacagttgatgacaatacctaacctggcggcagcgcaaaagatg

SEQ ID NO: 116535 - DNA, 103 bp, Artificial Sequence
  Synthetic Polynucleotide
taatacgactcactatagggaactgtaataagtggcatcacgaggtattgaacagaggagacaatacatggtgatgccaaacctggcggcagcgcaaaagatg

SEQ ID NO: 116536 - DNA, 103 bp, Artificial Sequence
  Synthetic Polynucleotide
taatacgactcactatagggctgttctggtaactgtaataagtggcatcaaacagaggagatgatgcatgttattacagaacctggcggcagcgcaaaagatg

SEQ ID NO: 116537 - DNA, 103 bp, Artificial Sequence
  Synthetic Polynucleotide
taatacgactcactataggggaaatgatacctgttctggtaactgtaataaacagaggagatattacatgtaccagaacaacctggcggcagcgcaaaagatg

SEQ ID NO: 116538 - DNA, 103 bp, Artificial Sequence
  Synthetic Polynucleotide
taatacgactcactatagggacttctcacagaaatgatacctgttctggtaacagaggagaaccagaatgggtatcattaacctggcggcagcgcaaaagatg

SEQ ID NO: 116539 - DNA, 103 bp, Artificial Sequence
  Synthetic Polynucleotide
taatacgactcactataggggtcattgggcttttgaccatgctatttatcaacagaggagagataaaatgcatggtcaaaacctggcggcagcgcaaaagatg

SEQ ID NO: 116540 - DNA, 103 bp, Artificial Sequence
  Synthetic Polynucleotide
taatacgactcactatagggtcattgaaacacttctcacagaaatgatacaacagaggagagtatcaatgctgtgagaaaacctggcggcagcgcaaaagatg

SEQ ID NO: 116541 - DNA, 103 bp, Artificial Sequence
  Synthetic Polynucleotide
taatacgactcactatagggcccttggatctcattgaaacacttctcacaaacagaggagatgtgagatgtgtttcaataacctggcggcagcgcaaaagatg

SEQ ID NO: 116542 - DNA, 103 bp, Artificial Sequence
  Synthetic Polynucleotide
taatacgactcactatagggaaacgctctccccttggatctcattgaaacaacagaggagagtttcaatgagatccaagaacctggcggcagcgcaaaagatg

SEQ ID NO: 116543 - DNA, 103 bp, Artificial Sequence
  Synthetic Polynucleotide
taatacgactcactatagggtcccccaaagaaacgctctccccttggatcaacagaggagagatccaatgggagagcgtaacctggcggcagcgcaaaagatg

SEQ ID NO: 116544 - DNA, 103 bp, Artificial Sequence
  Synthetic Polynucleotide
taatacgactcactatagggggaagggtcatcccccaaagaaacgctctcaacagaggagagagagcatgtctttggggaacctggcggcagcgcaaaagatg

SEQ ID NO: 116545 - DNA, 103 bp, Artificial Sequence
  Synthetic Polynucleotide
taatacgactcactatagggtttgaggctgggaagggtcatcccccaaagaacagaggagactttggatgatgacccttaacctggcggcagcgcaaaagatg

SEQ ID NO: 116546 - DNA, 103 bp, Artificial Sequence
  Synthetic Polynucleotide
taatacgactcactatagggtttattgtagtttgaggctgggaagggtcaaacagaggagatgacccatgccagcctcaaacctggcggcagcgcaaaagatg

SEQ ID NO: 116547 - DNA, 103 bp, Artificial Sequence
  Synthetic Polynucleotide
taatacgactcactatagggttgttctttatttattgtagtttgaggctgaacagaggagacagcctatgactacaataaacctggcggcagcgcaaaagatg

SEQ ID NO: 116548 - DNA, 103 bp, Artificial Sequence
  Synthetic Polynucleotide
taatacgactcactatagggtcttggaaaattgttctttatttattgtagaacagaggagactacaaatgataaagaacaacctggcggcagcgcaaaagatg

SEQ ID NO: 116549 - DNA, 103 bp, Artificial Sequence
  Synthetic Polynucleotide
taatacgactcactatagggtcattttttctcttggaaaattgttctttaaacagaggagataaagaatgattttccaaaacctggcggcagcgcaaaagatg

SEQ ID NO: 116550 - DNA, 103 bp, Artificial Sequence
  Synthetic Polynucleotide
taatacgactcactataggggcctgcctgtgtcattgggcttttgaccataacagaggagaatggtcatgagcccaatgaacctggcggcagcgcaaaagatg

SEQ ID NO: 116551 - DNA, 103 bp, Artificial Sequence
  Synthetic Polynucleotide
taatacgactcactatagggatccagtgtgtcattttttctcttggaaaaaacagaggagattttccatgagaaaaaataacctggcggcagcgcaaaagatg

SEQ ID NO: 116552 - DNA, 103 bp, Artificial Sequence
  Synthetic Polynucleotide
taatacgactcactatagggacagttcaggatccagtgtgtcattttttcaacagaggagagaaaaaatgacacactggaacctggcggcagcgcaaaagatg

SEQ ID NO: 116553 - DNA, 103 bp, Artificial Sequence
  Synthetic Polynucleotide
taatacgactcactatagggcattcaacaaacagttcaggatccagtgtgaacagaggagacacactatgtcctgaactaacctggcggcagcgcaaaagatg

SEQ ID NO: 116554 - DNA, 103 bp, Artificial Sequence
  Synthetic Polynucleotide
taatacgactcactataggggcactctgtacattcaacaaacagttcaggaacagaggagacctgaaatgtttgttgaaaacctggcggcagcgcaaaagatg

SEQ ID NO: 116555 - DNA, 103 bp, Artificial Sequence
  Synthetic Polynucleotide
taatacgactcactatagggtctttcttccgcactctgtacattcaacaaaacagaggagattgttgatggtacagagtaacctggcggcagcgcaaaagatg

SEQ ID NO: 116556 - DNA, 103 bp, Artificial Sequence
  Synthetic Polynucleotide
taatacgactcactatagggatctgatgcatctttcttccgcactctgtaaacagaggagatacagaatgcggaagaaaaacctggcggcagcgcaaaagatg

SEQ ID NO: 116557 - DNA, 103 bp, Artificial Sequence
  Synthetic Polynucleotide
taatacgactcactatagggaaggacacagatctgatgcatctttcttccaacagaggagaggaagaatgatgcatcagaacctggcggcagcgcaaaagatg

SEQ ID NO: 116558 - DNA, 103 bp, Artificial Sequence
  Synthetic Polynucleotide
taatacgactcactatagggtctcatggtgaaggacacagatctgatgcaaacagaggagatgcatcatgtctgtgtccaacctggcggcagcgcaaaagatg

SEQ ID NO: 116559 - DNA, 103 bp, Artificial Sequence
  Synthetic Polynucleotide
taatacgactcactatagggggccagatgatctcatggtgaaggacacagaacagaggagactgtgtatgtcaccatgaaacctggcggcagcgcaaaagatg

SEQ ID NO: 116560 - DNA, 103 bp, Artificial Sequence
  Synthetic Polynucleotide
taatacgactcactataggggaatccagcaggccagatgatctcatggtgaacagaggagacaccatatgatcatctggaacctggcggcagcgcaaaagatg

SEQ ID NO: 116561 - DNA, 103 bp, Artificial Sequence
  Synthetic Polynucleotide
taatacgactcactataggggagaagtcaagcctgcctgtgtcattgggcaacagaggagagcccaaatgcacaggcagaacctggcggcagcgcaaaagatg

SEQ ID NO: 116562 - DNA, 103 bp, Artificial Sequence
  Synthetic Polynucleotide
taatacgactcactatagggcatcacagacgaatccagcaggccagatgaaacagaggagatcatctatgctgctggataacctggcggcagcgcaaaagatg

SEQ ID NO: 116563 - DNA, 103 bp, Artificial Sequence
  Synthetic Polynucleotide
taatacgactcactatagggtttaaacagccatcacagacgaatccagcaaacagaggagatgctggatgcgtctgtgaaacctggcggcagcgcaaaagatg

SEQ ID NO: 116564 - DNA, 103 bp, Artificial Sequence
  Synthetic Polynucleotide
taatacgactcactatagggtgcacttttctttaaacagccatcacagacaacagaggagagtctgtatgggctgtttaaacctggcggcagcgcaaaagatg

SEQ ID NO: 116565 - DNA, 103 bp, Artificial Sequence
  Synthetic Polynucleotide
taatacgactcactatagggtcctagttcgtgcacttttctttaaacagcaacagaggagagctgttatgagaaaagtgaacctggcggcagcgcaaaagatg

SEQ ID NO: 116566 - DNA, 103 bp, Artificial Sequence
  Synthetic Polynucleotide
taatacgactcactatagggttattttctttcctagttcgtgcacttttcaacagaggagagaaaagatgacgaactagaacctggcggcagcgcaaaagatg

SEQ ID NO: 116567 - DNA, 103 bp, Artificial Sequence
  Synthetic Polynucleotide
taatacgactcactatagggagcagaaaacttattttctttcctagttcgaacagaggagacgaactatgaaagaaaataacctggcggcagcgcaaaagatg

SEQ ID NO: 116568 - DNA, 103 bp, Artificial Sequence
  Synthetic Polynucleotide
taatacgactcactataggggcaaccttttagcagaaaacttattttcttaacagaggagaaagaaaatgagttttctgaacctggcggcagcgcaaaagatg

SEQ ID NO: 116569 - DNA, 103 bp, Artificial Sequence
  Synthetic Polynucleotide
taatacgactcactatagggctggtagatggcaaccttttagcagaaaacaacagaggagagttttcatgtaaaaggttaacctggcggcagcgcaaaagatg

SEQ ID NO: 116570 - DNA, 103 bp, Artificial Sequence
  Synthetic Polynucleotide
taatacgactcactatagggggtgccaagtctggtagatggcaaccttttaacagaggagaaaaaggatgccatctaccaacctggcggcagcgcaaaagatg

SEQ ID NO: 116571 - DNA, 103 bp, Artificial Sequence
  Synthetic Polynucleotide
taatacgactcactatagggtctctagaaaggtgccaagtctggtagatgaacagaggagacatctaatggacttggcaaacctggcggcagcgcaaaagatg

SEQ ID NO: 116572 - DNA, 103 bp, Artificial Sequence
  Synthetic Polynucleotide
taatacgactcactatagggcccatgttgggagaagtcaagcctgcctgtaacagaggagaacaggcatgcttgacttcaacctggcggcagcgcaaaagatg

SEQ ID NO: 116573 - DNA, 103 bp, Artificial Sequence
  Synthetic Polynucleotide
taatacgactcactatagggttcacacgattctctagaaaggtgccaagtaacagaggagaacttggatgctttctagaaacctggcggcagcgcaaaagatg

SEQ ID NO: 116574 - DNA, 103 bp, Artificial Sequence
  Synthetic Polynucleotide
taatacgactcactatagggcagaaagtcattcacacgattctctagaaaaacagaggagatttctaatgaatcgtgtgaacctggcggcagcgcaaaagatg

SEQ ID NO: 116575 - DNA, 103 bp, Artificial Sequence
  Synthetic Polynucleotide
taatacgactcactatagggtctgtcgcctcagaaagtcattcacacgataacagaggagaatcgtgatgatgactttcaacctggcggcagcgcaaaagatg

SEQ ID NO: 116576 - DNA, 103 bp, Artificial Sequence
  Synthetic Polynucleotide
taatacgactcactatagggtcagggtgattctgtcgcctcagaaagtcaaacagaggagatgacttatggaggcgacaaacctggcggcagcgcaaaagatg

SEQ ID NO: 116577 - DNA, 103 bp, Artificial Sequence
  Synthetic Polynucleotide
taatacgactcactatagggctctcctgactcagggtgattctgtcgcctaacagaggagaaggcgaatgaatcaccctaacctggcggcagcgcaaaagatg

SEQ ID NO: 116578 - DNA, 103 bp, Artificial Sequence
  Synthetic Polynucleotide
taatacgactcactatagggtaacagtgacctctcctgactcagggtgataacagaggagaatcaccatgagtcaggagaacctggcggcagcgcaaaagatg

SEQ ID NO: 116579 - DNA, 103 bp, Artificial Sequence
  Synthetic Polynucleotide
taatacgactcactatagggtgaactactctaacagtgacctctcctgacaacagaggagagtcaggatgggtcactgtaacctggcggcagcgcaaaagatg

SEQ ID NO: 116580 - DNA, 103 bp, Artificial Sequence
  Synthetic Polynucleotide
taatacgactcactataggggtcagaagcatgaactactctaacagtgacaacagaggagagtcactatgagagtagttaacctggcggcagcgcaaaagatg

SEQ ID NO: 116581 - DNA, 103 bp, Artificial Sequence
  Synthetic Polynucleotide
taatacgactcactatagggccacggttttgtcagaagcatgaactactcaacagaggagagagtagatgatgcttctgaacctggcggcagcgcaaaagatg

SEQ ID NO: 116582 - DNA, 103 bp, Artificial Sequence
  Synthetic Polynucleotide
taatacgactcactatagggggttttacttccacggttttgtcagaagcaaacagaggagatgcttcatgcaaaaccgtaacctggcggcagcgcaaaagatg

SEQ ID NO: 116583 - DNA, 103 bp, Artificial Sequence
  Synthetic Polynucleotide
taatacgactcactatagggagatgagagtttaggccgcttggctgaaggaacagaggagaccttcaatgaagcggcctaacctggcggcagcgcaaaagatg

SEQ ID NO: 116584 - DNA, 103 bp, Artificial Sequence
  Synthetic Polynucleotide
taatacgactcactatagggagtgcccatccccatgttgggagaagtcaaaacagaggagattgactatgcccaacatgaacctggcggcagcgcaaaagatg

SEQ ID NO: 116585 - DNA, 103 bp, Artificial Sequence
  Synthetic Polynucleotide
taatacgactcactatagggtttcatgcctggttttacttccacggttttaacagaggagaaaaaccatggaagtaaaaaacctggcggcagcgcaaaagatg

SEQ ID NO: 116586 - DNA, 103 bp, Artificial Sequence
  Synthetic Polynucleotide
taatacgactcactatagggcaaaccttgctttcatgcctggttttacttaacagaggagaaagtaaatgcaggcatgaaacctggcggcagcgcaaaagatg

SEQ ID NO: 116587 - DNA, 103 bp, Artificial Sequence
  Synthetic Polynucleotide
taatacgactcactatagggccactgtccacaaaccttgctttcatgcctaacagaggagaaggcatatgagcaaggttaacctggcggcagcgcaaaagatg

SEQ ID NO: 116588 - DNA, 103 bp, Artificial Sequence
  Synthetic Polynucleotide
taatacgactcactatagggtgccatctctccactgtccacaaaccttgcaacagaggagagcaaggatggtggacagtaacctggcggcagcgcaaaagatg

SEQ ID NO: 116589 - DNA, 103 bp, Artificial Sequence
  Synthetic Polynucleotide
taatacgactcactataggggaaaggattctgccatctctccactgtccaaacagaggagatggacaatggagagatggaacctggcggcagcgcaaaagatg

SEQ ID NO: 116590 - DNA, 103 bp, Artificial Sequence
  Synthetic Polynucleotide
taatacgactcactataggggttcggtatggaaaggattctgccatctctaacagaggagaagagatatgagaatccttaacctggcggcagcgcaaaagatg

SEQ ID NO: 116591 - DNA, 103 bp, Artificial Sequence
  Synthetic Polynucleotide
taatacgactcactataggggagggctttggttcggtatggaaaggattcaacagaggagagaatccatgccataccgaaacctggcggcagcgcaaaagatg

SEQ ID NO: 116592 - DNA, 103 bp, Artificial Sequence
  Synthetic Polynucleotide
taatacgactcactatagggcaaaggcaaagagggctttggttcggtatgaacagaggagacataccatgccaaagcccaacctggcggcagcgcaaaagatg

SEQ ID NO: 116593 - DNA, 103 bp, Artificial Sequence
  Synthetic Polynucleotide
taatacgactcactatagggtcaatttcttcaaaggcaaagagggctttgaacagaggagacaaagcatgctttgccttaacctggcggcagcgcaaaagatg

SEQ ID NO: 116594 - DNA, 103 bp, Artificial Sequence
  Synthetic Polynucleotide
taatacgactcactataggggtcaacaccatcaatttcttcaaaggcaaaaacagaggagatttgccatggaagaaattaacctggcggcagcgcaaaagatg

SEQ ID NO: 116595 - DNA, 103 bp, Artificial Sequence
  Synthetic Polynucleotide
taatacgactcactatagggttggtccactagtgcccatccccatgttggaacagaggagaccaacaatgggatgggcaaacctggcggcagcgcaaaagatg

SEQ ID NO: 116596 - DNA, 103 bp, Artificial Sequence
  Synthetic Polynucleotide
taatacgactcactatagggagaagcacaggtcaacaccatcaatttcttaacagaggagaaagaaaatgatggtgttgaacctggcggcagcgcaaaagatg

SEQ ID NO: 116597 - DNA, 103 bp, Artificial Sequence
  Synthetic Polynucleotide
taatacgactcactatagggtgcatgccaaagaagcacaggtcaacaccaaacagaggagatggtgtatgcctgtgcttaacctggcggcagcgcaaaagatg

SEQ ID NO: 116598 - DNA, 103 bp, Artificial Sequence
  Synthetic Polynucleotide
taatacgactcactatagggctcttgaacatgcatgccaaagaagcacagaacagaggagactgtgcatgtttggcatgaacctggcggcagcgcaaaagatg

SEQ ID NO: 116599 - DNA, 103 bp, Artificial Sequence
  Synthetic Polynucleotide
taatacgactcactatagggcagagccatactcttgaacatgcatgccaaaacagaggagattggcaatgatgttcaagaacctggcggcagcgcaaaagatg

SEQ ID NO: 116600 - DNA, 103 bp, Artificial Sequence
  Synthetic Polynucleotide
taatacgactcactatagggggagggcagtcagagccatactcttgaacaaacagaggagatgttcaatggtatggctcaacctggcggcagcgcaaaagatg

SEQ ID NO: 116601 - DNA, 103 bp, Artificial Sequence
  Synthetic Polynucleotide
taatacgactcactatagggctggttgggtggagggcagtcagagccataaacagaggagatatggcatggactgccctaacctggcggcagcgcaaaagatg

SEQ ID NO: 116602 - DNA, 103 bp, Artificial Sequence
  Synthetic Polynucleotide
taatacgactcactatagggatactctcctctggttgggtggagggcagtaacagaggagaactgccatgcacccaaccaacctggcggcagcgcaaaagatg

SEQ ID NO: 116603 - DNA, 103 bp, Artificial Sequence
  Synthetic Polynucleotide
taatacgactcactatagggtaagatatgtatactctcctctggttgggtaacagaggagaacccaaatggaggagagtaacctggcggcagcgcaaaagatg

SEQ ID NO: 116604 - DNA, 103 bp, Artificial Sequence
  Synthetic Polynucleotide
taatacgactcactatagggactatcgaggtaagatatgtatactctcctaacagaggagaaggagaatgtacatatctaacctggcggcagcgcaaaagatg

SEQ ID NO: 116605 - DNA, 103 bp, Artificial Sequence
  Synthetic Polynucleotide
taatacgactcactatagggagaaatgaacactatcgaggtaagatatgtaacagaggagaacatatatgacctcgataaacctggcggcagcgcaaaagatg

SEQ ID NO: 116606 - DNA, 103 bp, Artificial Sequence
  Synthetic Polynucleotide
taatacgactcactatagggggaccctgatttggtccactagtgcccatcaacagaggagagatgggatgtagtggaccaacctggcggcagcgcaaaagatg

SEQ ID NO: 116607 - DNA, 103 bp, Artificial Sequence
  Synthetic Polynucleotide
taatacgactcactatagggttaggacggaagaaatgaacactatcgaggaacagaggagacctcgaatgtgttcatttaacctggcggcagcgcaaaagatg

SEQ ID NO: 116608 - DNA, 103 bp, Artificial Sequence
  Synthetic Polynucleotide
taatacgactcactatagggcctcaagcatttaggacggaagaaatgaacaacagaggagagttcatatgttccgtcctaacctggcggcagcgcaaaagatg

SEQ ID NO: 116609 - DNA, 103 bp, Artificial Sequence
  Synthetic Polynucleotide
taatacgactcactatagggagactgcagtcctcaagcatttaggacggaaacagaggagatccgtcatgaatgcttgaaacctggcggcagcgcaaaagatg

SEQ ID NO: 116610 - DNA, 103 bp, Artificial Sequence
  Synthetic Polynucleotide
taatacgactcactatagggatttcatgatagactgcagtcctcaagcataacagaggagaatgcttatggactgcagtaacctggcggcagcgcaaaagatg

SEQ ID NO: 116611 - DNA, 103 bp, Artificial Sequence
  Synthetic Polynucleotide
taatacgactcactatagggtccaattaggatttcatgatagactgcagtaacagaggagaactgcaatgtatcatgaaaacctggcggcagcgcaaaagatg

SEQ ID NO: 116612 - DNA, 103 bp, Artificial Sequence
  Synthetic Polynucleotide
taatacgactcactatagggattctaaatatccaattaggatttcatgataacagaggagaatcatgatgtcctaattgaacctggcggcagcgcaaaagatg

SEQ ID NO: 116613 - DNA, 103 bp, Artificial Sequence
  Synthetic Polynucleotide
taatacgactcactatagggttcttgacatattctaaatatccaattaggaacagaggagacctaatatgatatttagaaacctggcggcagcgcaaaagatg

SEQ ID NO: 116614 - DNA, 103 bp, Artificial Sequence
  Synthetic Polynucleotide
taatacgactcactataggggtaacctaatttcttgacatattctaaataaacagaggagatatttaatgtatgtcaagaacctggcggcagcgcaaaagatg

SEQ ID NO: 116615 - DNA, 103 bp, Artificial Sequence
  Synthetic Polynucleotide
taatacgactcactataggggccctgttgtgtaacctaatttcttgacataacagaggagaatgtcaatgaattaggttaacctggcggcagcgcaaaagatg

SEQ ID NO: 116616 - DNA, 103 bp, Artificial Sequence
  Synthetic Polynucleotide
taatacgactcactataggggcccaaatatgccctgttgtgtaacctaataacagaggagaattaggatgcacaacaggaacctggcggcagcgcaaaagatg

SEQ ID NO: 116617 - DNA, 103 bp, Artificial Sequence
  Synthetic Polynucleotide
taatacgactcactatagggtgactgcgtaggaccctgatttggtccactaacagaggagaagtggaatgaatcagggtaacctggcggcagcgcaaaagatg

SEQ ID NO: 116618 - DNA, 103 bp, Artificial Sequence
  Synthetic Polynucleotide
taatacgactcactatagggtggtggacatgcccaaatatgccctgttgtaacagaggagaacaacaatgcatatttggaacctggcggcagcgcaaaagatg

SEQ ID NO: 116619 - DNA, 103 bp, Artificial Sequence
  Synthetic Polynucleotide
taatacgactcactatagggctccctcacttggtggacatgcccaaatataacagaggagaatatttatgcatgtccacaacctggcggcagcgcaaaagatg

SEQ ID NO: 116620 - DNA, 103 bp, Artificial Sequence
  Synthetic Polynucleotide
taatacgactcactatagggatataatcatctccctcacttggtggacataacagaggagaatgtccatgaagtgagggaacctggcggcagcgcaaaagatg

SEQ ID NO: 116621 - DNA, 103 bp, Artificial Sequence
  Synthetic Polynucleotide
taatacgactcactataggggcaatggaagatataatcatctccctcactaacagaggagaagtgagatggatgattataacctggcggcagcgcaaaagatg

SEQ ID NO: 116622 - DNA, 103 bp, Artificial Sequence
  Synthetic Polynucleotide
taatacgactcactatagggcaggaggatggcaatggaagatataatcataacagaggagaatgattatgtcttccattaacctggcggcagcgcaaaagatg

SEQ ID NO: 116623 - DNA, 103 bp, Artificial Sequence
  Synthetic Polynucleotide
taatacgactcactatagggatcttctggtcaggaggatggcaatggaagaacagaggagacttccaatgccatcctccaacctggcggcagcgcaaaagatg

SEQ ID NO: 116624 - DNA, 103 bp, Artificial Sequence
  Synthetic Polynucleotide
taatacgactcactataggggggcttgggtatcttctggtcaggaggatgaacagaggagacatcctatggaccagaagaacctggcggcagcgcaaaagatg

SEQ ID NO: 116625 - DNA, 103 bp, Artificial Sequence
  Synthetic Polynucleotide
taatacgactcactataggggcagtcgcttgggcttgggtatcttctggtaacagaggagaaccagaatgtacccaagcaacctggcggcagcgcaaaagatg

SEQ ID NO: 116626 - DNA, 103 bp, Artificial Sequence
  Synthetic Polynucleotide
taatacgactcactatagggtaccattcctgcagtcgcttgggcttgggtaacagaggagaacccaaatgcaagcgactaacctggcggcagcgcaaaagatg

SEQ ID NO: 116627 - DNA, 103 bp, Artificial Sequence
  Synthetic Polynucleotide
taatacgactcactatagggcatttttttgtaccattcctgcagtcgcttaacagaggagaaagcgaatgcaggaatggaacctggcggcagcgcaaaagatg

SEQ ID NO: 116628 - DNA, 103 bp, Artificial Sequence
  Synthetic Polynucleotide
taatacgactcactatagggtcatacctgttgactgcgtaggaccctgataacagaggagaatcaggatgctacgcagtaacctggcggcagcgcaaaagatg

SEQ ID NO: 116629 - DNA, 103 bp, Artificial Sequence
  Synthetic Polynucleotide
taatacgactcactatagggccttgtcaagcatttttttgtaccattcctaacagaggagaaggaatatgacaaaaaaaaacctggcggcagcgcaaaagatg

SEQ ID NO: 116630 - DNA, 103 bp, Artificial Sequence
  Synthetic Polynucleotide
taatacgactcactatagggtctgatacagccttgtcaagcatttttttgaacagaggagacaaaaaatggcttgacaaaacctggcggcagcgcaaaagatg

SEQ ID NO: 116631 - DNA, 103 bp, Artificial Sequence
  Synthetic Polynucleotide
taatacgactcactataggggacaatacgctctgatacagccttgtcaagaacagaggagacttgacatggctgtatcaaacctggcggcagcgcaaaagatg

SEQ ID NO: 116632 - DNA, 103 bp, Artificial Sequence
  Synthetic Polynucleotide
taatacgactcactatagggtgtagtcatggacaatacgctctgatacagaacagaggagactgtatatgagcgtattgaacctggcggcagcgcaaaagatg

SEQ ID NO: 116633 - DNA, 103 bp, Artificial Sequence
  Synthetic Polynucleotide
taatacgactcactatagggaaaatatccttgtagtcatggacaatacgcaacagaggagagcgtatatgccatgactaaacctggcggcagcgcaaaagatg

SEQ ID NO: 116634 - DNA, 103 bp, Artificial Sequence
  Synthetic Polynucleotide
taatacgactcactatagggagcttgtttaaaaatatccttgtagtcatgaacagaggagacatgacatgaaggatattaacctggcggcagcgcaaaagatg

SEQ ID NO: 116635 - DNA, 103 bp, Artificial Sequence
  Synthetic Polynucleotide
taatacgactcactatagggtatcttcagtagcttgtttaaaaatatcctaacagaggagaaggataatgttaaacaagaacctggcggcagcgcaaaagatg

SEQ ID NO: 116636 - DNA, 103 bp, Artificial Sequence
  Synthetic Polynucleotide
taatacgactcactatagggcttgttaatctatcttcagtagcttgtttaaacagaggagataaacaatgtactgaagaaacctggcggcagcgcaaaagatg

SEQ ID NO: 116637 - DNA, 103 bp, Artificial Sequence
  Synthetic Polynucleotide
taatacgactcactatagggttcctttgcacttgttaatctatcttcagtaacagaggagaactgaaatgagattaacaaacctggcggcagcgcaaaagatg

SEQ ID NO: 116638 - DNA, 103 bp, Artificial Sequence
  Synthetic Polynucleotide
taatacgactcactatagggaataaggcaattcctttgcacttgttaatcaacagaggagagattaaatggtgcaaaggaacctggcggcagcgcaaaagatg

SEQ ID NO: 116639 - DNA, 103 bp, Artificial Sequence
  Synthetic Polynucleotide
taatacgactcactatagggggactgttcatcatacctgttgactgcgtaaacagaggagatacgcaatgaacaggtataacctggcggcagcgcaaaagatg

SEQ ID NO: 116640 - DNA, 103 bp, Artificial Sequence
  Synthetic Polynucleotide
taatacgactcactatagggtcaccctcgaaataaggcaattcctttgcaaacagaggagatgcaaaatgattgccttaaacctggcggcagcgcaaaagatg

SEQ ID NO: 116641 - DNA, 103 bp, Artificial Sequence
  Synthetic Polynucleotide
taatacgactcactataggggggccagaaatcaccctcgaaataaggcaaaacagaggagattgcctatgttcgagggtaacctggcggcagcgcaaaagatg

SEQ ID NO: 116642 - DNA, 103 bp, Artificial Sequence
  Synthetic Polynucleotide
taatacgactcactatagggccagaacattgggccagaaatcaccctcgaaacagaggagatcgaggatgatttctggcaacctggcggcagcgcaaaagatg

SEQ ID NO: 116643 - DNA, 103 bp, Artificial Sequence
  Synthetic Polynucleotide
taatacgactcactatagggatgctttcttccagaacattgggccagaaaaacagaggagatttctgatgcaatgttctaacctggcggcagcgcaaaagatg

SEQ ID NO: 116644 - DNA, 103 bp, Artificial Sequence
  Synthetic Polynucleotide
taatacgactcactatagggcagttccttaatgctttcttccagaacattaacagaggagaaatgttatggaagaaagcaacctggcggcagcgcaaaagatg

SEQ ID NO: 116645 - DNA, 103 bp, Artificial Sequence
  Synthetic Polynucleotide
taatacgactcactatagggcctcctgttccagttccttaatgctttcttaacagaggagaaagaaaatgttaaggaacaacctggcggcagcgcaaaagatg

SEQ ID NO: 116646 - DNA, 103 bp, Artificial Sequence
  Synthetic Polynucleotide
taatacgactcactatagggctctcttcttcctcctgttccagttccttaaacagaggagataaggaatgggaacaggaaacctggcggcagcgcaaaagatg

SEQ ID NO: 116647 - DNA, 103 bp, Artificial Sequence
  Synthetic Polynucleotide
taatacgactcactatagggctctcgttttctctcttcttcctcctgttcaacagaggagagaacagatggaagaagagaacctggcggcagcgcaaaagatg

SEQ ID NO: 116648 - DNA, 103 bp, Artificial Sequence
  Synthetic Polynucleotide
taatacgactcactatagggtggtgttttcctctcgttttctctcttcttaacagaggagaaagaagatggaaaacgagaacctggcggcagcgcaaaagatg

SEQ ID NO: 116649 - DNA, 103 bp, Artificial Sequence
  Synthetic Polynucleotide
taatacgactcactatagggctttcattgctggtgttttcctctcgttttaacagaggagaaaaacgatgggaaaacacaacctggcggcagcgcaaaagatg

SEQ ID NO: 116650 - DNA, 103 bp, Artificial Sequence
  Synthetic Polynucleotide
taatacgactcactatagggctgatttactggactgttcatcatacctgtaacagaggagaacaggtatgatgaacagtaacctggcggcagcgcaaaagatg

SEQ ID NO: 116651 - DNA, 103 bp, Artificial Sequence
  Synthetic Polynucleotide
taatacgactcactatagggcacatctgtgctttcattgctggtgttttcaacagaggagagaaaacatgagcaatgaaaacctggcggcagcgcaaaagatg

SEQ ID NO: 116652 - DNA, 103 bp, Artificial Sequence
  Synthetic Polynucleotide
taatacgactcactatagggctcccttggtcacatctgtgctttcattgcaacagaggagagcaatgatggcacagatgaacctggcggcagcgcaaaagatg

SEQ ID NO: 116653 - DNA, 103 bp, Artificial Sequence
  Synthetic Polynucleotide
taatacgactcactatagggtttttgctgtctcccttggtcacatctgtgaacagaggagacacagaatggaccaagggaacctggcggcagcgcaaaagatg

SEQ ID NO: 116654 - DNA, 103 bp, Artificial Sequence
  Synthetic Polynucleotide
taatacgactcactatagggctttttagcatttttgctgtctcccttggtaacagaggagaaccaagatggacagcaaaaacctggcggcagcgcaaaagatg

SEQ ID NO: 116655 - DNA, 103 bp, Artificial Sequence
  Synthetic Polynucleotide
taatacgactcactatagggtattattcttctttttagcatttttgctgtaacagaggagaacagcaatgatgctaaaaaacctggcggcagcgcaaaagatg

SEQ ID NO: 116656 - DNA, 103 bp, Artificial Sequence
  Synthetic Polynucleotide
taatacgactcactatagggctggttttcttattattcttctttttagcaaacagaggagatgctaaatggaagaataaaacctggcggcagcgcaaaagatg

SEQ ID NO: 116657 - DNA, 103 bp, Artificial Sequence
  Synthetic Polynucleotide
taatacgactcactatagggcttatttttgctggttttcttattattcttaacagaggagaaagaatatgaagaaaaccaacctggcggcagcgcaaaagatg

SEQ ID NO: 116658 - DNA, 103 bp, Artificial Sequence
  Synthetic Polynucleotide
taatacgactcactatagggtcaggctgctcttatttttgctggttttctaacagaggagaagaaaaatggcaaaaataaacctggcggcagcgcaaaagatg

SEQ ID NO: 116659 - DNA, 103 bp, Artificial Sequence
  Synthetic Polynucleotide
taatacgactcactatagggttgcccctactcaggctgctcttatttttgaacagaggagacaaaaaatggagcagcctaacctggcggcagcgcaaaagatg

SEQ ID NO: 116660 - DNA, 103 bp, Artificial Sequence
  Synthetic Polynucleotide
taatacgactcactatagggtttcttcttgttgcccctactcaggctgctaacagaggagaagcagcatgagtaggggcaacctggcggcagcgcaaaagatg

SEQ ID NO: 116661 - DNA, 103 bp, Artificial Sequence
  Synthetic Polynucleotide
taatacgactcactatagggccatggcaggctgatttactggactgttcaaacagaggagatgaacaatgcagtaaatcaacctggcggcagcgcaaaagatg

SEQ ID NO: 116662 - DNA, 103 bp, Artificial Sequence
  Synthetic Polynucleotide
taatacgactcactataggggcatcccgggtttcttcttgttgcccctacaacagaggagagtagggatgacaagaagaaacctggcggcagcgcaaaagatg

SEQ ID NO: 116663 - DNA, 103 bp, Artificial Sequence
  Synthetic Polynucleotide
taatacgactcactataggggatacattgggcatcccgggtttcttcttgaacagaggagacaagaaatgacccgggataacctggcggcagcgcaaaagatg

SEQ ID NO: 116664 - DNA, 103 bp, Artificial Sequence
  Synthetic Polynucleotide
taatacgactcactataggggaggtcgttagatacattgggcatcccgggaacagaggagacccgggatgcccaatgtaaacctggcggcagcgcaaaagatg

SEQ ID NO: 116665 - DNA, 103 bp, Artificial Sequence
  Synthetic Polynucleotide
taatacgactcactataggggtttctgtgagaggtcgttagatacattggaacagaggagaccaatgatgctaacgaccaacctggcggcagcgcaaaagatg

SEQ ID NO: 116666 - DNA, 103 bp, Artificial Sequence
  Synthetic Polynucleotide
taatacgactcactataggggtggcatatagtttctgtgagaggtcgttaaacagaggagataacgaatgctcacagaaaacctggcggcagcgcaaaagatg

SEQ ID NO: 116667 - DNA, 103 bp, Artificial Sequence
  Synthetic Polynucleotide
taatacgactcactatagggcttctccatggtggcatatagtttctgtgaaacagaggagatcacagatgctatatgccaacctggcggcagcgcaaaagatg

SEQ ID NO: 116668 - DNA, 103 bp, Artificial Sequence
  Synthetic Polynucleotide
taatacgactcactatagggcctctttatgcttctccatggtggcatataaacagaggagatatatgatgccatggagaaacctggcggcagcgcaaaagatg

SEQ ID NO: 116669 - DNA, 103 bp, Artificial Sequence
  Synthetic Polynucleotide
taatacgactcactatagggacaaagaagacctctttatgcttctccatgaacagaggagacatggaatggcataaagaaacctggcggcagcgcaaaagatg

SEQ ID NO: 116670 - DNA, 103 bp, Artificial Sequence
  Synthetic Polynucleotide
taatacgactcactataggggaggcggatcacaaagaagacctctttatgaacagaggagacataaaatggtcttctttaacctggcggcagcgcaaaagatg

SEQ ID NO: 116671 - DNA, 103 bp, Artificial Sequence
  Synthetic Polynucleotide
taatacgactcactatagggggccagcaatgaggcggatcacaaagaagaaacagaggagatcttctatgtgatccgccaacctggcggcagcgcaaaagatg

SEQ ID NO: 116672 - DNA, 103 bp, Artificial Sequence
  Synthetic Polynucleotide
taatacgactcactataggggtgttcattcccatggcaggctgatttactaacagaggagaagtaaaatggcctgccataacctggcggcagcgcaaaagatg

SEQ ID NO: 116673 - DNA, 103 bp, Artificial Sequence
  Synthetic Polynucleotide
taatacgactcactatagggttggcagcagggccagcaatgaggcggatcaacagaggagagatccgatgcattgctggaacctggcggcagcgcaaaagatg

SEQ ID NO: 116674 - DNA, 103 bp, Artificial Sequence
  Synthetic Polynucleotide
taatacgactcactatagggaggcagggagttggcagcagggccagcaataacagaggagaattgctatgcctgctgccaacctggcggcagcgcaaaagatg

SEQ ID NO: 116675 - DNA, 103 bp, Artificial Sequence
  Synthetic Polynucleotide
taatacgactcactatagggcaacaatgggaggcagggagttggcagcagaacagaggagactgctgatgactccctgcaacctggcggcagcgcaaaagatg

SEQ ID NO: 116676 - DNA, 103 bp, Artificial Sequence
  Synthetic Polynucleotide
taatacgactcactatagggggatcaggatcaacaatgggaggcagggagaacagaggagactccctatgtcccattgtaacctggcggcagcgcaaaagatg

SEQ ID NO: 116677 - DNA, 103 bp, Artificial Sequence
  Synthetic Polynucleotide
taatacgactcactatagggggggatgagaggatcaggatcaacaatgggaacagaggagacccattatggatcctgataacctggcggcagcgcaaaagatg

SEQ ID NO: 116678 - DNA, 103 bp, Artificial Sequence
  Synthetic Polynucleotide
taatacgactcactatagggtcagatcgcaggggatgagaggatcaggataacagaggagaatcctgatgctctcatccaacctggcggcagcgcaaaagatg

SEQ ID NO: 116679 - DNA, 103 bp, Artificial Sequence
  Synthetic Polynucleotide
taatacgactcactatagggcgaccatccatcagatcgcaggggatgagaaacagaggagatctcatatgctgcgatctaacctggcggcagcgcaaaagatg

SEQ ID NO: 116680 - DNA, 103 bp, Artificial Sequence
  Synthetic Polynucleotide
taatacgactcactatagggaaacgcatcccgaccatccatcagatcgcaaacagaggagatgcgatatgatggatggtaacctggcggcagcgcaaaagatg

SEQ ID NO: 116681 - DNA, 103 bp, Artificial Sequence
  Synthetic Polynucleotide
taatacgactcactatagggccagcgtgagaaacgcatcccgaccatccaaacagaggagatggatgatggggatgcgtaacctggcggcagcgcaaaagatg

SEQ ID NO: 116682 - DNA, 103 bp, Artificial Sequence
  Synthetic Polynucleotide
taatacgactcactatagggttgtcccttgccagcgtgagaaacgcatccaacagaggagaggatgcatgtctcacgctaacctggcggcagcgcaaaagatg

SEQ ID NO: 116683 - DNA, 103 bp, Artificial Sequence
  Synthetic Polynucleotide
taatacgactcactatagggattcatccctgtgttcattcccatggcaggaacagaggagacctgccatgggaatgaacaacctggcggcagcgcaaaagatg

SEQ ID NO: 116684 - DNA, 103 bp, Artificial Sequence
  Synthetic Polynucleotide
taatacgactcactatagggctccaggtgcttgtcccttgccagcgtgagaacagaggagactcacgatggcaagggacaacctggcggcagcgcaaaagatg

SEQ ID NO: 116685 - DNA, 103 bp, Artificial Sequence
  Synthetic Polynucleotide
taatacgactcactataggggtgaagagaactccaggtgcttgtcccttgaacagaggagacaagggatgagcacctggaacctggcggcagcgcaaaagatg

SEQ ID NO: 116686 - DNA, 103 bp, Artificial Sequence
  Synthetic Polynucleotide
taatacgactcactataggggctcttcggagtgaagagaactccaggtgcaacagaggagagcacctatggttctcttcaacctggcggcagcgcaaaagatg

SEQ ID NO: 116687 - DNA, 103 bp, Artificial Sequence
  Synthetic Polynucleotide
taatacgactcactatagggggaccactgggctcttcggagtgaagagaaaacagaggagattctctatgctccgaagaaacctggcggcagcgcaaaagatg

SEQ ID NO: 116688 - DNA, 103 bp, Artificial Sequence
  Synthetic Polynucleotide
taatacgactcactatagggtgcacatggtggaccactgggctcttcggaaacagaggagatccgaaatgcccagtggtaacctggcggcagcgcaaaagatg

SEQ ID NO: 116689 - DNA, 103 bp, Artificial Sequence
  Synthetic Polynucleotide
taatacgactcactatagggtccaccagcatgcacatggtggaccactggaacagaggagaccagtgatgcaccatgtgaacctggcggcagcgcaaaagatg

SEQ ID NO: 116690 - DNA, 103 bp, Artificial Sequence
  Synthetic Polynucleotide
taatacgactcactatagggcgtgtgcagctccaccagcatgcacatggtaacagaggagaaccatgatgatgctggtgaacctggcggcagcgcaaaagatg

SEQ ID NO: 116691 - DNA, 103 bp, Artificial Sequence
  Synthetic Polynucleotide
taatacgactcactatagggcctggctctgcgtgtgcagctccaccagcaaacagaggagatgctggatgagctgcacaaacctggcggcagcgcaaaagatg

SEQ ID NO: 116692 - DNA, 103 bp, Artificial Sequence
  Synthetic Polynucleotide
taatacgactcactatagggacaaagcggtcctggctctgcgtgtgcagcaacagaggagagctgcaatggcagagccaaacctggcggcagcgcaaaagatg

SEQ ID NO: 116693 - DNA, 103 bp, Artificial Sequence
  Synthetic Polynucleotide
taatacgactcactataggggcaggtgtagacaaagcggtcctggctctgaacagaggagacagagcatggaccgctttaacctggcggcagcgcaaaagatg

SEQ ID NO: 116694 - DNA, 103 bp, Artificial Sequence
  Synthetic Polynucleotide
taatacgactcactatagggagagggccggagatgagagtttaggccgctaacagaggagaagcggcatgaactctcataacctggcggcagcgcaaaagatg

SEQ ID NO: 116695 - DNA, 103 bp, Artificial Sequence
  Synthetic Polynucleotide
taatacgactcactatagggtcatgcccgcattcatccctgtgttcattcaacagaggagagaatgaatgcagggatgaaacctggcggcagcgcaaaagatg

SEQ ID NO: 116696 - DNA, 103 bp, Artificial Sequence
  Synthetic Polynucleotide
taatacgactcactatagggtgcattcattgcaggtgtagacaaagcggtaacagaggagaaccgctatgtctacacctaacctggcggcagcgcaaaagatg

SEQ ID NO: 116697 - DNA, 103 bp, Artificial Sequence
  Synthetic Polynucleotide
taatacgactcactatagggacatggtgcttgcattcattgcaggtgtagaacagaggagactacacatgcaatgaatgaacctggcggcagcgcaaaagatg

SEQ ID NO: 116698 - DNA, 103 bp, Artificial Sequence
  Synthetic Polynucleotide
taatacgactcactataggggcgtgtctccacatggtgcttgcattcattaacagaggagaaatgaaatgaagcaccataacctggcggcagcgcaaaagatg

SEQ ID NO: 116699 - DNA, 103 bp, Artificial Sequence
  Synthetic Polynucleotide
taatacgactcactatagggtacagtgccagcgtgtctccacatggtgctaacagaggagaagcaccatgtggagacacaacctggcggcagcgcaaaagatg

SEQ ID NO: 116700 - DNA, 103 bp, Artificial Sequence
  Synthetic Polynucleotide
taatacgactcactatagggtcacagacagtacagtgccagcgtgtctccaacagaggagaggagacatgctggcactgaacctggcggcagcgcaaaagatg

SEQ ID NO: 116701 - DNA, 103 bp, Artificial Sequence
  Synthetic Polynucleotide
taatacgactcactataggggtcataatcctcacagacagtacagtgccaaacagaggagatggcacatgactgtctgtaacctggcggcagcgcaaaagatg

SEQ ID NO: 116702 - DNA, 103 bp, Artificial Sequence
  Synthetic Polynucleotide
taatacgactcactatagggtgatacacaagtcataatcctcacagacagaacagaggagactgtctatgaggattatgaacctggcggcagcgcaaaagatg

SEQ ID NO: 116703 - DNA, 103 bp, Artificial Sequence
  Synthetic Polynucleotide
taatacgactcactatagggttatagcaggtgatacacaagtcataatccaacagaggagaggattaatgcttgtgtataacctggcggcagcgcaaaagatg

SEQ ID NO: 116704 - DNA, 103 bp, Artificial Sequence
  Synthetic Polynucleotide
taatacgactcactataggggtttttagtgttatagcaggtgatacacaaaacagaggagattgtgtatgacctgctataacctggcggcagcgcaaaagatg

SEQ ID NO: 116705 - DNA, 103 bp, Artificial Sequence
  Synthetic Polynucleotide
taatacgactcactatagggtgtggtcatggtttttagtgttatagcaggaacagaggagacctgctatgacactaaaaaacctggcggcagcgcaaaagatg

SEQ ID NO: 116706 - DNA, 103 bp, Artificial Sequence
  Synthetic Polynucleotide
taatacgactcactatagggattccaggattcatgcccgcattcatccctaacagaggagaagggatatgtgcgggcataacctggcggcagcgcaaaagatg

SEQ ID NO: 116707 - DNA, 103 bp, Artificial Sequence
  Synthetic Polynucleotide
taatacgactcactatagggttctccattttgtggtcatggtttttagtgaacagaggagacactaaatgccatgaccaaacctggcggcagcgcaaaagatg

SEQ ID NO: 116708 - DNA, 103 bp, Artificial Sequence
  Synthetic Polynucleotide
taatacgactcactatagggaaggcctagtttctccattttgtggtcatgaacagaggagacatgacatgaaaatggagaacctggcggcagcgcaaaagatg

SEQ ID NO: 116709 - DNA, 103 bp, Artificial Sequence
  Synthetic Polynucleotide
taatacgactcactatagggcatctaagccaaggcctagtttctccatttaacagaggagaaaatggatgaactaggccaacctggcggcagcgcaaaagatg

SEQ ID NO: 116710 - DNA, 103 bp, Artificial Sequence
  Synthetic Polynucleotide
taatacgactcactatagggttgctctcatcatctaagccaaggcctagtaacagaggagaactaggatgtggcttagaaacctggcggcagcgcaaaagatg

SEQ ID NO: 116711 - DNA, 103 bp, Artificial Sequence
  Synthetic Polynucleotide
taatacgactcactatagggctgctggttgttgctctcatcatctaagccaacagaggagaggcttaatggatgagagcaacctggcggcagcgcaaaagatg

SEQ ID NO: 116712 - DNA, 103 bp, Artificial Sequence
  Synthetic Polynucleotide
taatacgactcactatagggtggctgcagcctgctggttgttgctctcataacagaggagaatgagaatgacaaccagcaacctggcggcagcgcaaaagatg

SEQ ID NO: 116713 - DNA, 103 bp, Artificial Sequence
  Synthetic Polynucleotide
taatacgactcactataggggggctctgggtggctgcagcctgctggttgaacagaggagacaaccaatgggctgcagcaacctggcggcagcgcaaaagatg

SEQ ID NO: 116714 - DNA, 103 bp, Artificial Sequence
  Synthetic Polynucleotide
taatacgactcactatagggagaatcgcctgggctctgggtggctgcagcaacagaggagagctgcaatgacccagagcaacctggcggcagcgcaaaagatg

SEQ ID NO: 116715 - DNA, 103 bp, Artificial Sequence
  Synthetic Polynucleotide
taatacgactcactatagggtcaggcggcgagaatcgcctgggctctgggaacagaggagacccagaatgcaggcgattaacctggcggcagcgcaaaagatg

SEQ ID NO: 116716 - DNA, 103 bp, Artificial Sequence
  Synthetic Polynucleotide
taatacgactcactatagggcgctggatactcaggcggcgagaatcgcctaacagaggagaaggcgaatgtcgccgcctaacctggcggcagcgcaaaagatg

SEQ ID NO: 116717 - DNA, 103 bp, Artificial Sequence
  Synthetic Polynucleotide
taatacgactcactatagggtgcagccaacattccaggattcatgcccgcaacagaggagagcgggcatgaatcctggaaacctggcggcagcgcaaaagatg

SEQ ID NO: 116718 - DNA, 103 bp, Artificial Sequence
  Synthetic Polynucleotide
taatacgactcactatagggctggatgcagcgctggatactcaggcggcgaacagaggagacgccgcatgagtatccagaacctggcggcagcgcaaaagatg

SEQ ID NO: 116719 - DNA, 103 bp, Artificial Sequence
  Synthetic Polynucleotide
taatacgactcactatagggggaccagagactggatgcagcgctggatacaacagaggagagtatccatggctgcatccaacctggcggcagcgcaaaagatg

SEQ ID NO: 116720 - DNA, 103 bp, Artificial Sequence
  Synthetic Polynucleotide
taatacgactcactatagggtggcaagcatggaccagagactggatgcagaacagaggagactgcatatggtctctggtaacctggcggcagcgcaaaagatg

SEQ ID NO: 116721 - DNA, 103 bp, Artificial Sequence
  Synthetic Polynucleotide
taatacgactcactatagggattccgacactggcaagcatggaccagagaaacagaggagatctctgatgcatgcttgcaacctggcggcagcgcaaaagatg

SEQ ID NO: 116722 - DNA, 103 bp, Artificial Sequence
  Synthetic Polynucleotide
taatacgactcactatagggagcaattggcattccgacactggcaagcataacagaggagaatgcttatgagtgtcggaaacctggcggcagcgcaaaagatg

SEQ ID NO: 116723 - DNA, 103 bp, Artificial Sequence
  Synthetic Polynucleotide
taatacgactcactataggggatggcagtgagcaattggcattccgacacaacagaggagagtgtcgatgtgccaattgaacctggcggcagcgcaaaagatg

SEQ ID NO: 116724 - DNA, 103 bp, Artificial Sequence
  Synthetic Polynucleotide
taatacgactcactatagggcttctggcaggatggcagtgagcaattggcaacagaggagagccaatatgtcactgccaaacctggcggcagcgcaaaagatg

SEQ ID NO: 116725 - DNA, 103 bp, Artificial Sequence
  Synthetic Polynucleotide
taatacgactcactatagggcccgcttcatcttctggcaggatggcagtgaacagaggagacactgcatgcctgccagaaacctggcggcagcgcaaaagatg

SEQ ID NO: 116726 - DNA, 103 bp, Artificial Sequence
  Synthetic Polynucleotide
taatacgactcactatagggtgctgcacaacccgcttcatcttctggcagaacagaggagactgccaatggatgaagcgaacctggcggcagcgcaaaagatg

SEQ ID NO: 116727 - DNA, 103 bp, Artificial Sequence
  Synthetic Polynucleotide
taatacgactcactatagggacccttggtatgctgcacaacccgcttcataacagaggagaatgaagatggttgtgcagaacctggcggcagcgcaaaagatg

SEQ ID NO: 116728 - DNA, 103 bp, Artificial Sequence
  Synthetic Polynucleotide
taatacgactcactataggggtccattgcctgcagccaacattccaggataacagaggagaatcctgatgtgttggctgaacctggcggcagcgcaaaagatg

SEQ ID NO: 116729 - DNA, 103 bp, Artificial Sequence
  Synthetic Polynucleotide
taatacgactcactatagggtccgtttgcaacccttggtatgctgcacaaaacagaggagattgtgcatgataccaaggaacctggcggcagcgcaaaagatg

SEQ ID NO: 116730 - DNA, 103 bp, Artificial Sequence
  Synthetic Polynucleotide
taatacgactcactatagggccattggttttccgtttgcaacccttggtaaacagaggagataccaaatgttgcaaacgaacctggcggcagcgcaaaagatg

SEQ ID NO: 116731 - DNA, 103 bp, Artificial Sequence
  Synthetic Polynucleotide
taatacgactcactatagggggggcacccgccattggttttccgtttgcaaacagaggagatgcaaaatgaaaaccaataacctggcggcagcgcaaaagatg

SEQ ID NO: 116732 - DNA, 103 bp, Artificial Sequence
  Synthetic Polynucleotide
taatacgactcactataggggcttgcagatggggcacccgccattggtttaacagaggagaaaaccaatggcgggtgccaacctggcggcagcgcaaaagatg

SEQ ID NO: 116733 - DNA, 103 bp, Artificial Sequence
  Synthetic Polynucleotide
taatacgactcactataggggcaatgagctgcttgcagatggggcacccgaacagaggagacgggtgatgcatctgcaaaacctggcggcagcgcaaaagatg

SEQ ID NO: 116734 - DNA, 103 bp, Artificial Sequence
  Synthetic Polynucleotide
taatacgactcactataggggcagcagagggcaatgagctgcttgcagataacagaggagaatctgcatgcagctcattaacctggcggcagcgcaaaagatg

SEQ ID NO: 116735 - DNA, 103 bp, Artificial Sequence
  Synthetic Polynucleotide
taatacgactcactatagggtggcatggtagcagcagagggcaatgagctaacagaggagaagctcaatgccctctgctaacctggcggcagcgcaaaagatg

SEQ ID NO: 116736 - DNA, 103 bp, Artificial Sequence
  Synthetic Polynucleotide
taatacgactcactatagggtggcagtgcttggcatggtagcagcagaggaacagaggagacctctgatgctaccatgcaacctggcggcagcgcaaaagatg

SEQ ID NO: 116737 - DNA, 103 bp, Artificial Sequence
  Synthetic Polynucleotide
taatacgactcactatagggtttgttctcctggcagtgcttggcatggtaaacagaggagataccatatgaagcactgcaacctggcggcagcgcaaaagatg

SEQ ID NO: 116738 - DNA, 103 bp, Artificial Sequence
  Synthetic Polynucleotide
taatacgactcactataggggcaccgggcatttgttctcctggcagtgctaacagaggagaagcactatgaggagaacaaacctggcggcagcgcaaaagatg

SEQ ID NO: 116739 - DNA, 103 bp, Artificial Sequence
  Synthetic Polynucleotide
taatacgactcactatagggattatcccttgtccattgcctgcagccaacaacagaggagagttggcatgaggcaatggaacctggcggcagcgcaaaagatg

SEQ ID NO: 116740 - DNA, 103 bp, Artificial Sequence
  Synthetic Polynucleotide
taatacgactcactatagggaggcagaacggcaccgggcatttgttctccaacagaggagaggagaaatgatgcccggtaacctggcggcagcgcaaaagatg

SEQ ID NO: 116741 - DNA, 103 bp, Artificial Sequence
  Synthetic Polynucleotide
taatacgactcactatagggcttgatgtttaggcagaacggcaccgggcaaacagaggagatgcccgatgccgttctgcaacctggcggcagcgcaaaagatg

SEQ ID NO: 116742 - DNA, 103 bp, Artificial Sequence
  Synthetic Polynucleotide
taatacgactcactatagggggagcttctgcttgatgtttaggcagaacgaacagaggagacgttctatgtaaacatcaaacctggcggcagcgcaaaagatg

SEQ ID NO: 116743 - DNA, 103 bp, Artificial Sequence
  Synthetic Polynucleotide
taatacgactcactatagggtgttgctgccggagcttctgcttgatgtttaacagaggagaaaacatatggcagaagctaacctggcggcagcgcaaaagatg

SEQ ID NO: 116744 - DNA, 103 bp, Artificial Sequence
  Synthetic Polynucleotide
taatacgactcactataggggtgctgcagctgttgctgccggagcttctgaacagaggagacagaagatgcggcagcaaaacctggcggcagcgcaaaagatg

SEQ ID NO: 116745 - DNA, 103 bp, Artificial Sequence
  Synthetic Polynucleotide
taatacgactcactataggggctgtagtcggtgctgcagctgttgctgccaacagaggagaggcagcatgagctgcagcaacctggcggcagcgcaaaagatg

SEQ ID NO: 116746 - DNA, 103 bp, Artificial Sequence
  Synthetic Polynucleotide
taatacgactcactatagggatttgggcctgctgtagtcggtgctgcagcaacagaggagagctgcaatgccgactacaaacctggcggcagcgcaaaagatg

SEQ ID NO: 116747 - DNA, 103 bp, Artificial Sequence
  Synthetic Polynucleotide
taatacgactcactatagggcctgcgaagcatttgggcctgctgtagtcgaacagaggagacgactaatgcaggcccaaaacctggcggcagcgcaaaagatg

SEQ ID NO: 116748 - DNA, 103 bp, Artificial Sequence
  Synthetic Polynucleotide
taatacgactcactatagggtggccatcctcctgcgaagcatttgggcctaacagaggagaaggcccatgtgcttcgcaaacctggcggcagcgcaaaagatg

SEQ ID NO: 116749 - DNA, 103 bp, Artificial Sequence
  Synthetic Polynucleotide
taatacgactcactatagggcgctgcatgctggccatcctcctgcgaagcaacagaggagagcttcgatggaggatggcaacctggcggcagcgcaaaagatg

SEQ ID NO: 116750 - DNA, 103 bp, Artificial Sequence
  Synthetic Polynucleotide
taatacgactcactatagggttgattaggcattatcccttgtccattgccaacagaggagaggcaatatgcaagggataaacctggcggcagcgcaaaagatg

SEQ ID NO: 116751 - DNA, 103 bp, Artificial Sequence
  Synthetic Polynucleotide
taatacgactcactatagggcacaccagtccgctgcatgctggccatcctaacagaggagaaggatgatgagcatgcagaacctggcggcagcgcaaaagatg

SEQ ID NO: 116752 - DNA, 103 bp, Artificial Sequence
  Synthetic Polynucleotide
taatacgactcactataggggctgcccaaccacaccagtccgctgcatgcaacagaggagagcatgcatgggactggtgaacctggcggcagcgcaaaagatg

SEQ ID NO: 116753 - DNA, 103 bp, Artificial Sequence
  Synthetic Polynucleotide
taatacgactcactatagggaggccctgttgctgcccaaccacaccagtcaacagaggagagactggatgggttgggcaaacctggcggcagcgcaaaagatg

SEQ ID NO: 116754 - DNA, 103 bp, Artificial Sequence
  Synthetic Polynucleotide
taatacgactcactataggggggggaagggaggccctgttgctgcccaacaacagaggagagttgggatgcaacagggcaacctggcggcagcgcaaaagatg

SEQ ID NO: 116755 - DNA, 103 bp, Artificial Sequence
  Synthetic Polynucleotide
taatacgactcactatagggtggcaggagtgggggaagggaggccctgttaacagaggagaaacaggatgtcccttcccaacctggcggcagcgcaaaagatg

SEQ ID NO: 116756 - DNA, 103 bp, Artificial Sequence
  Synthetic Polynucleotide
taatacgactcactataggggtcgttggagtggcaggagtgggggaagggaacagaggagacccttcatgcactcctgcaacctggcggcagcgcaaaagatg

SEQ ID NO: 116757 - DNA, 103 bp, Artificial Sequence
  Synthetic Polynucleotide
taatacgactcactataggggccagttggtgtcgttggagtggcaggagtaacagaggagaactcctatgactccaacgaacctggcggcagcgcaaaagatg

SEQ ID NO: 116758 - DNA, 103 bp, Artificial Sequence
  Synthetic Polynucleotide
taatacgactcactatagggttggctgttggccagttggtgtcgttggagaacagaggagactccaaatgcaccaactgaacctggcggcagcgcaaaagatg

SEQ ID NO: 116759 - DNA, 103 bp, Artificial Sequence
  Synthetic Polynucleotide
taatacgactcactatagggtgcggggtggttggctgttggccagttggtaacagaggagaaccaacatgccaacagccaacctggcggcagcgcaaaagatg

SEQ ID NO: 116760 - DNA, 103 bp, Artificial Sequence
  Synthetic Polynucleotide
taatacgactcactatagggctggggcgtctgcggggtggttggctgttgaacagaggagacaacagatgaccaccccgaacctggcggcagcgcaaaagatg

SEQ ID NO: 116761 - DNA, 103 bp, Artificial Sequence
  Synthetic Polynucleotide
taatacgactcactatagggcgttcatgacttgattaggcattatcccttaacagaggagaaagggaatgtgcctaatcaacctggcggcagcgcaaaagatg

SEQ ID NO: 116762 - DNA, 103 bp, Artificial Sequence
  Synthetic Polynucleotide
taatacgactcactataggggagaagtgggctggggcgtctgcggggtggaacagaggagaccacccatgagacgccccaacctggcggcagcgcaaaagatg

SEQ ID NO: 116763 - DNA, 103 bp, Artificial Sequence
  Synthetic Polynucleotide
taatacgactcactatagggggctgaggctgagaagtgggctggggcgtcaacagaggagagacgccatggcccacttcaacctggcggcagcgcaaaagatg

SEQ ID NO: 116764 - DNA, 103 bp, Artificial Sequence
  Synthetic Polynucleotide
taatacgactcactataggggggaggggtaggctgaggctgagaagtgggaacagaggagacccactatgcagcctcagaacctggcggcagcgcaaaagatg

SEQ ID NO: 116765 - DNA, 103 bp, Artificial Sequence
  Synthetic Polynucleotide
taatacgactcactataggggcatgctattgggaggggtaggctgaggctaacagaggagaagcctcatgctacccctcaacctggcggcagcgcaaaagatg

SEQ ID NO: 116766 - DNA, 103 bp, Artificial Sequence
  Synthetic Polynucleotide
taatacgactcactatagggaagtagggtggcatgctattgggaggggtaaacagaggagataccccatgcaatagcataacctggcggcagcgcaaaagatg

SEQ ID NO: 116767 - DNA, 103 bp, Artificial Sequence
  Synthetic Polynucleotide
taatacgactcactatagggagtcctgggcaagtagggtggcatgctattaacagaggagaaatagcatgccaccctacaacctggcggcagcgcaaaagatg

SEQ ID NO: 116768 - DNA, 103 bp, Artificial Sequence
  Synthetic Polynucleotide
taatacgactcactatagggcagcagcttgagtcctgggcaagtagggtgaacagaggagacaccctatgtgcccaggaaacctggcggcagcgcaaaagatg

SEQ ID NO: 116769 - DNA, 103 bp, Artificial Sequence
  Synthetic Polynucleotide
taatacgactcactataggggacacagggccagcagcttgagtcctgggcaacagaggagagcccagatgtcaagctgcaacctggcggcagcgcaaaagatg

SEQ ID NO: 116770 - DNA, 103 bp, Artificial Sequence
  Synthetic Polynucleotide
taatacgactcactatagggcttaccctgggacacagggccagcagcttgaacagaggagacaagctatgggccctgtgaacctggcggcagcgcaaaagatg

SEQ ID NO: 116771 - DNA, 103 bp, Artificial Sequence
  Synthetic Polynucleotide
taatacgactcactatagggggcctgctgccttaccctgggacacagggcaacagaggagagccctgatgcccagggtaaacctggcggcagcgcaaaagatg

SEQ ID NO: 116772 - DNA, 103 bp, Artificial Sequence
  Synthetic Polynucleotide
taatacgactcactatagggccaattgaaccgttcatgacttgattaggcaacagaggagagcctaaatgagtcatgaaaacctggcggcagcgcaaaagatg

SEQ ID NO: 116773 - DNA, 103 bp, Artificial Sequence
  Synthetic Polynucleotide
taatacgactcactatagggggggtcacctggcctgctgccttaccctggaacagaggagaccagggatgggcagcaggaacctggcggcagcgcaaaagatg

SEQ ID NO: 116774 - DNA, 103 bp, Artificial Sequence
  Synthetic Polynucleotide
taatacgactcactatagggaggggttggaggggtcacctggcctgctgcaacagaggagagcagcaatgcaggtgaccaacctggcggcagcgcaaaagatg

SEQ ID NO: 116775 - DNA, 103 bp, Artificial Sequence
  Synthetic Polynucleotide
taatacgactcactatagggcagtctgaggaggggttggaggggtcacctaacagaggagaaggtgaatgctccaacccaacctggcggcagcgcaaaagatg

SEQ ID NO: 116776 - DNA, 103 bp, Artificial Sequence
  Synthetic Polynucleotide
taatacgactcactatagggggtggctgagcagtctgaggaggggttggaaacagaggagatccaacatgtcctcagacaacctggcggcagcgcaaaagatg

SEQ ID NO: 116777 - DNA, 103 bp, Artificial Sequence
  Synthetic Polynucleotide
taatacgactcactatagggccctggaaggggtggctgagcagtctgaggaacagaggagacctcagatggctcagccaaacctggcggcagcgcaaaagatg

SEQ ID NO: 116778 - DNA, 103 bp, Artificial Sequence
  Synthetic Polynucleotide
taatacgactcactatagggcaggtgggggccctggaaggggtggctgagaacagaggagactcagcatgcccttccagaacctggcggcagcgcaaaagatg

SEQ ID NO: 116779 - DNA, 103 bp, Artificial Sequence
  Synthetic Polynucleotide
taatacgactcactatagggtccactgctgcaggtgggggccctggaaggaacagaggagaccttccatggcccccaccaacctggcggcagcgcaaaagatg

SEQ ID NO: 116780 - DNA, 103 bp, Artificial Sequence
  Synthetic Polynucleotide
taatacgactcactatagggcattgccatttccactgctgcaggtgggggaacagaggagacccccaatggcagcagtgaacctggcggcagcgcaaaagatg

SEQ ID NO: 116781 - DNA, 103 bp, Artificial Sequence
  Synthetic Polynucleotide
taatacgactcactatagggtctgaatctgcattgccatttccactgctgaacagaggagacagcagatgaaatggcaaaacctggcggcagcgcaaaagatg

SEQ ID NO: 116782 - DNA, 103 bp, Artificial Sequence
  Synthetic Polynucleotide
taatacgactcactatagggtccgctgctctctgaatctgcattgccattaacagaggagaaatggcatggcagattcaaacctggcggcagcgcaaaagatg

SEQ ID NO: 116783 - DNA, 103 bp, Artificial Sequence
  Synthetic Polynucleotide
taatacgactcactatagggtcggcctgctccaattgaaccgttcatgacaacagaggagagtcatgatgggttcaattaacctggcggcagcgcaaaagatg

SEQ ID NO: 116784 - DNA, 103 bp, Artificial Sequence
  Synthetic Polynucleotide
taatacgactcactataggggcgctgcgtctccgctgctctctgaatctgaacagaggagacagattatgagagcagcgaacctggcggcagcgcaaaagatg

SEQ ID NO: 116785 - DNA, 103 bp, Artificial Sequence
  Synthetic Polynucleotide
taatacgactcactataggggggccatctggcgctgcgtctccgctgctcaacagaggagagagcagatgagacgcagcaacctggcggcagcgcaaaagatg

SEQ ID NO: 116786 - DNA, 103 bp, Artificial Sequence
  Synthetic Polynucleotide
taatacgactcactatagggatttgcacgtgggccatctggcgctgcgtcaacagaggagagacgcaatgccagatggcaacctggcggcagcgcaaaagatg

SEQ ID NO: 116787 - DNA, 103 bp, Artificial Sequence
  Synthetic Polynucleotide
taatacgactcactatagggcctttgaaaaatttgcacgtgggccatctgaacagaggagacagatgatgcacgtgcaaaacctggcggcagcgcaaaagatg

SEQ ID NO: 116788 - DNA, 103 bp, Artificial Sequence
  Synthetic Polynucleotide
taatacgactcactataggggttggattggcctttgaaaaatttgcacgtaacagaggagaacgtgcatgtttttcaaaaacctggcggcagcgcaaaagatg

SEQ ID NO: 116789 - DNA, 103 bp, Artificial Sequence
  Synthetic Polynucleotide
taatacgactcactatagggggcatctggtgttggattggcctttgaaaaaacagaggagattttcaatggccaatccaaacctggcggcagcgcaaaagatg

SEQ ID NO: 116790 - DNA, 103 bp, Artificial Sequence
  Synthetic Polynucleotide
taatacgactcactatagggagtcatcgggggcatctggtgttggattggaacagaggagaccaatcatgcaccagatgaacctggcggcagcgcaaaagatg

SEQ ID NO: 116791 - DNA, 103 bp, Artificial Sequence
  Synthetic Polynucleotide
taatacgactcactataggggggccatgggagtcatcgggggcatctggtaacagaggagaaccagaatgccccgatgaaacctggcggcagcgcaaaagatg

SEQ ID NO: 116792 - DNA, 103 bp, Artificial Sequence
  Synthetic Polynucleotide
taatacgactcactatagggatacccatgggggccatgggagtcatcgggaacagaggagacccgatatgtcccatggcaacctggcggcagcgcaaaagatg

SEQ ID NO: 116793 - DNA, 103 bp, Artificial Sequence
  Synthetic Polynucleotide
taatacgactcactatagggaggtgggttcatacccatgggggccatgggaacagaggagacccatgatgcccatgggtaacctggcggcagcgcaaaagatg

SEQ ID NO: 116794 - DNA, 103 bp, Artificial Sequence
  Synthetic Polynucleotide
taatacgactcactatagggtctgtcgccctcggcctgctccaattgaacaacagaggagagttcaaatggagcaggccaacctggcggcagcgcaaaagatg

SEQ ID NO: 116795 - DNA, 103 bp, Artificial Sequence
  Synthetic Polynucleotide
taatacgactcactatagggtggtcatgggaggtgggttcatacccatggaacagaggagaccatggatgtgaacccacaacctggcggcagcgcaaaagatg

SEQ ID NO: 116796 - DNA, 103 bp, Artificial Sequence
  Synthetic Polynucleotide
taatacgactcactatagggctgggacctctggtcatgggaggtgggttcaacagaggagagaacccatgtcccatgacaacctggcggcagcgcaaaagatg

SEQ ID NO: 116797 - DNA, 103 bp, Artificial Sequence
  Synthetic Polynucleotide
taatacgactcactatagggcaaatgcccactgggacctctggtcatgggaacagaggagacccatgatgagaggtcccaacctggcggcagcgcaaaagatg

SEQ ID NO: 116798 - DNA, 103 bp, Artificial Sequence
  Synthetic Polynucleotide
taatacgactcactatagggtccctggctccaaatgcccactgggacctcaacagaggagagaggtcatggtgggcattaacctggcggcagcgcaaaagatg

SEQ ID NO: 116799 - DNA, 103 bp, Artificial Sequence
  Synthetic Polynucleotide
taatacgactcactataggggtcggtcccatccctggctccaaatgcccaaacagaggagatgggcaatgggagccaggaacctggcggcagcgcaaaagatg

SEQ ID NO: 116800 - DNA, 103 bp, Artificial Sequence
  Synthetic Polynucleotide
taatacgactcactatagggctgcatccctgtcggtcccatccctggctcaacagaggagagagccaatgatgggaccgaacctggcggcagcgcaaaagatg

SEQ ID NO: 116801 - DNA, 103 bp, Artificial Sequence
  Synthetic Polynucleotide
taatacgactcactataggggtggctgttgctgcatccctgtcggtcccaaacagaggagatgggacatgcagggatgcaacctggcggcagcgcaaaagatg

SEQ ID NO: 116802 - DNA, 103 bp, Artificial Sequence
  Synthetic Polynucleotide
taatacgactcactatagggtggctccagggtggctgttgctgcatccctaacagaggagaagggatatggcaacagccaacctggcggcagcgcaaaagatg

SEQ ID NO: 116803 - DNA, 103 bp, Artificial Sequence
  Synthetic Polynucleotide
taatacgactcactatagggcaatcctccttggctccagggtggctgttgaacagaggagacaacagatgccctggagcaacctggcggcagcgcaaaagatg

SEQ ID NO: 116804 - DNA, 103 bp, Artificial Sequence
  Synthetic Polynucleotide
taatacgactcactatagggggggctgaggcaatcctccttggctccaggaacagaggagacctggaatgaaggaggataacctggcggcagcgcaaaagatg

SEQ ID NO: 116805 - DNA, 103 bp, Artificial Sequence
  Synthetic Polynucleotide
taatacgactcactataggggcggacgccgagagggccggagatgagagtaacagaggagaactctcatgtccggccctaacctggcggcagcgcaaaagatg

SEQ ID NO: 116806 - DNA, 103 bp, Artificial Sequence
  Synthetic Polynucleotide
taatacgactcactatagggtactgcatattctgtcgccctcggcctgctaacagaggagaagcaggatgagggcgacaaacctggcggcagcgcaaaagatg

SEQ ID NO: 116807 - DNA, 103 bp, Artificial Sequence
  Synthetic Polynucleotide
taatacgactcactatagggtgtagttgctggggctgaggcaatcctcctaacagaggagaaggaggatggcctcagccaacctggcggcagcgcaaaagatg

SEQ ID NO: 116808 - DNA, 103 bp, Artificial Sequence
  Synthetic Polynucleotide
taatacgactcactatagggcatcccagactgtagttgctggggctgaggaacagaggagacctcagatgcagcaactaaacctggcggcagcgcaaaagatg

SEQ ID NO: 116809 - DNA, 103 bp, Artificial Sequence
  Synthetic Polynucleotide
taatacgactcactatagggctggccttggcatcccagactgtagttgctaacagaggagaagcaacatgagtctgggaaacctggcggcagcgcaaaagatg

SEQ ID NO: 116810 - DNA, 103 bp, Artificial Sequence
  Synthetic Polynucleotide
taatacgactcactataggggacatcatggctggccttggcatcccagacaacagaggagagtctggatggccaaggccaacctggcggcagcgcaaaagatg

SEQ ID NO: 116811 - DNA, 103 bp, Artificial Sequence
  Synthetic Polynucleotide
taatacgactcactatagggctgggccactgacatcatggctggccttggaacagaggagaccaaggatggccatgatgaacctggcggcagcgcaaaagatg

SEQ ID NO: 116812 - DNA, 103 bp, Artificial Sequence
  Synthetic Polynucleotide
taatacgactcactataggggttgaccatgctgggccactgacatcatggaacagaggagaccatgaatgcagtggcccaacctggcggcagcgcaaaagatg

SEQ ID NO: 116813 - DNA, 103 bp, Artificial Sequence
  Synthetic Polynucleotide
taatacgactcactatagggatgttcaaaggttgaccatgctgggccactaacagaggagaagtggcatggcatggtcaaacctggcggcagcgcaaaagatg

SEQ ID NO: 116814 - DNA, 103 bp, Artificial Sequence
  Synthetic Polynucleotide
taatacgactcactatagggttgtggagccatgttcaaaggttgaccatgaacagaggagacatggtatgcctttgaacaacctggcggcagcgcaaaagatg

SEQ ID NO: 116815 - DNA, 103 bp, Artificial Sequence
  Synthetic Polynucleotide
taatacgactcactatagggccaatcctggttgtggagccatgttcaaagaacagaggagactttgaatgtggctccacaacctggcggcagcgcaaaagatg

SEQ ID NO: 116816 - DNA, 103 bp, Artificial Sequence
  Synthetic Polynucleotide
taatacgactcactatagggcctacctggcccaatcctggttgtggagccaacagaggagaggctccatgaccaggattaacctggcggcagcgcaaaagatg

SEQ ID NO: 116817 - DNA, 103 bp, Artificial Sequence
  Synthetic Polynucleotide
taatacgactcactatagggtgggtttgggtactgcatattctgtcgcccaacagaggagagggcgaatgaatatgcagaacctggcggcagcgcaaaagatg

SEQ ID NO: 116818 - DNA, 103 bp, Artificial Sequence
  Synthetic Polynucleotide
taatacgactcactatagggtgggctgatacctacctggcccaatcctggaacagaggagaccaggaatgggccaggtaaacctggcggcagcgcaaaagatg

SEQ ID NO: 116819 - DNA, 103 bp, Artificial Sequence
  Synthetic Polynucleotide
taatacgactcactatagggctggtttgagtgggctgatacctacctggcaacagaggagagccaggatggtatcagccaacctggcggcagcgcaaaagatg

SEQ ID NO: 116820 - DNA, 103 bp, Artificial Sequence
  Synthetic Polynucleotide
taatacgactcactataggggacacagtgcctggtttgagtgggctgataaacagaggagatatcagatgactcaaaccaacctggcggcagcgcaaaagatg

SEQ ID NO: 116821 - DNA, 103 bp, Artificial Sequence
  Synthetic Polynucleotide
taatacgactcactatagggggcttgttgagacacagtgcctggtttgagaacagaggagactcaaaatgggcactgtgaacctggcggcagcgcaaaagatg

SEQ ID NO: 116822 - DNA, 103 bp, Artificial Sequence
  Synthetic Polynucleotide
taatacgactcactatagggggttttgtaaggcttgttgagacacagtgcaacagaggagagcactgatgctcaacaagaacctggcggcagcgcaaaagatg

SEQ ID NO: 116823 - DNA, 103 bp, Artificial Sequence
  Synthetic Polynucleotide
taatacgactcactataggggtccgcaaaaggttttgtaaggcttgttgaaacagaggagatcaacaatgcttacaaaaaacctggcggcagcgcaaaagatg

SEQ ID NO: 116824 - DNA, 103 bp, Artificial Sequence
  Synthetic Polynucleotide
taatacgactcactatagggagacctgagagtccgcaaaaggttttgtaaaacagaggagattacaaatgcttttgcggaacctggcggcagcgcaaaagatg

SEQ ID NO: 116825 - DNA, 103 bp, Artificial Sequence
  Synthetic Polynucleotide
taatacgactcactataggggagagctgggagacctgagagtccgcaaaaaacagaggagattttgcatgctctcaggtaacctggcggcagcgcaaaagatg

SEQ ID NO: 116826 - DNA, 103 bp, Artificial Sequence
  Synthetic Polynucleotide
taatacgactcactatagggtgctgcaggggagagctgggagacctgagaaacagaggagatctcagatgtcccagctcaacctggcggcagcgcaaaagatg

SEQ ID NO: 116827 - DNA, 103 bp, Artificial Sequence
  Synthetic Polynucleotide
taatacgactcactatagggcacctgttgctgctgcaggggagagctgggaacagaggagacccagcatgcccctgcagaacctggcggcagcgcaaaagatg

SEQ ID NO: 116828 - DNA, 103 bp, Artificial Sequence
  Synthetic Polynucleotide
taatacgactcactatagggttcccatgcctgggtttgggtactgcatataacagaggagaatatgcatgacccaaaccaacctggcggcagcgcaaaagatg

SEQ ID NO: 116829 - DNA, 103 bp, Artificial Sequence
  Synthetic Polynucleotide
taatacgactcactatagggggatactaagcacctgttgctgctgcagggaacagaggagaccctgcatgagcaacaggaacctggcggcagcgcaaaagatg

SEQ ID NO: 116830 - DNA, 103 bp, Artificial Sequence
  Synthetic Polynucleotide
taatacgactcactatagggttggcgtgaaggatactaagcacctgttgcaacagaggagagcaacaatggcttagtataacctggcggcagcgcaaaagatg

SEQ ID NO: 116831 - DNA, 103 bp, Artificial Sequence
  Synthetic Polynucleotide
taatacgactcactatagggcagctgggggttggcgtgaaggatactaagaacagaggagacttagtatgcttcacgccaacctggcggcagcgcaaaagatg

SEQ ID NO: 116832 - DNA, 103 bp, Artificial Sequence
  Synthetic Polynucleotide
taatacgactcactatagggatgcagccaacagctgggggttggcgtgaaaacagaggagattcacgatgacccccagcaacctggcggcagcgcaaaagatg

SEQ ID NO: 116833 - DNA, 103 bp, Artificial Sequence
  Synthetic Polynucleotide
taatacgactcactatagggtgcttgatgaatgcagccaacagctgggggaacagaggagacccccaatggttggctgcaacctggcggcagcgcaaaagatg

SEQ ID NO: 116834 - DNA, 103 bp, Artificial Sequence
  Synthetic Polynucleotide
taatacgactcactatagggggcagcccgctgcttgatgaatgcagccaaaacagaggagattggctatgttcatcaagaacctggcggcagcgcaaaagatg

SEQ ID NO: 116835 - DNA, 103 bp, Artificial Sequence
  Synthetic Polynucleotide
taatacgactcactatagggtggcatacttggcagcccgctgcttgatgaaacagaggagatcatcaatgagcgggctgaacctggcggcagcgcaaaagatg

SEQ ID NO: 116836 - DNA, 103 bp, Artificial Sequence
  Synthetic Polynucleotide
taatacgactcactatagggggattagagttggcatacttggcagcccgcaacagaggagagcgggcatgcaagtatgcaacctggcggcagcgcaaaagatg

SEQ ID NO: 116837 - DNA, 103 bp, Artificial Sequence
  Synthetic Polynucleotide
taatacgactcactataggggatgggttgtggattagagttggcatacttaacagaggagaaagtatatgaactctaataacctggcggcagcgcaaaagatg

SEQ ID NO: 116838 - DNA, 103 bp, Artificial Sequence
  Synthetic Polynucleotide
taatacgactcactataggggctgcccagggatgggttgtggattagagtaacagaggagaactctaatgcacaacccaaacctggcggcagcgcaaaagatg

SEQ ID NO: 116839 - DNA, 103 bp, Artificial Sequence
  Synthetic Polynucleotide
taatacgactcactatagggttgccagcacttcccatgcctgggtttgggaacagaggagacccaaaatgaggcatgggaacctggcggcagcgcaaaagatg

SEQ ID NO: 116840 - DNA, 103 bp, Artificial Sequence
  Synthetic Polynucleotide
taatacgactcactatagggggcatgccaggctgcccagggatgggttgtaacagaggagaacaaccatgccctgggcaaacctggcggcagcgcaaaagatg

SEQ ID NO: 116841 - DNA, 103 bp, Artificial Sequence
  Synthetic Polynucleotide
taatacgactcactatagggctgcccctggggcatgccaggctgcccaggaacagaggagacctgggatgcctggcatgaacctggcggcagcgcaaaagatg

SEQ ID NO: 116842 - DNA, 103 bp, Artificial Sequence
  Synthetic Polynucleotide
taatacgactcactataggggtagccctggctgcccctggggcatgccagaacagaggagactggcaatgcccaggggcaacctggcggcagcgcaaaagatg

SEQ ID NO: 116843 - DNA, 103 bp, Artificial Sequence
  Synthetic Polynucleotide
taatacgactcactataggggtaggtggctgtagccctggctgcccctggaacagaggagaccagggatggccagggctaacctggcggcagcgcaaaagatg

SEQ ID NO: 116844 - DNA, 103 bp, Artificial Sequence
  Synthetic Polynucleotide
taatacgactcactatagggacctggcatggtaggtggctgtagccctggaacagaggagaccagggatgcagccacctaacctggcggcagcgcaaaagatg

SEQ ID NO: 116845 - DNA, 103 bp, Artificial Sequence
  Synthetic Polynucleotide
taatacgactcactatagggccccctgctgacctggcatggtaggtggctaacagaggagaagccacatgccatgccagaacctggcggcagcgcaaaagatg

SEQ ID NO: 116846 - DNA, 103 bp, Artificial Sequence
  Synthetic Polynucleotide
taatacgactcactatagggttggagtggaccccctgctgacctggcatgaacagaggagacatgccatgtcagcagggaacctggcggcagcgcaaaagatg

SEQ ID NO: 116847 - DNA, 103 bp, Artificial Sequence
  Synthetic Polynucleotide
taatacgactcactatagggcatggctggattggagtggaccccctgctgaacagaggagacagcagatggtccactccaacctggcggcagcgcaaaagatg

SEQ ID NO: 116848 - DNA, 103 bp, Artificial Sequence
  Synthetic Polynucleotide
taatacgactcactatagggtcatgttctgcatggctggattggagtggaaacagaggagatccactatgatccagccaaacctggcggcagcgcaaaagatg

SEQ ID NO: 116849 - DNA, 103 bp, Artificial Sequence
  Synthetic Polynucleotide
taatacgactcactatagggtgcattggattcatgttctgcatggctggaaacagaggagatccagcatggcagaacataacctggcggcagcgcaaaagatg

SEQ ID NO: 116850 - DNA, 103 bp, Artificial Sequence
  Synthetic Polynucleotide
taatacgactcactatagggagtcagtaagttgccagcacttcccatgccaacagaggagaggcatgatgagtgctggcaacctggcggcagcgcaaaagatg

SEQ ID NO: 116851 - DNA, 103 bp, Artificial Sequence
  Synthetic Polynucleotide
taatacgactcactatagggaacgcccgcctgcattggattcatgttctgaacagaggagacagaacatgaatccaatgaacctggcggcagcgcaaaagatg

SEQ ID NO: 116852 - DNA, 103 bp, Artificial Sequence
  Synthetic Polynucleotide
taatacgactcactatagggcagccctctgaacgcccgcctgcattggataacagaggagaatccaaatgaggcgggcgaacctggcggcagcgcaaaagatg

SEQ ID NO: 116853 - DNA, 103 bp, Artificial Sequence
  Synthetic Polynucleotide
taatacgactcactatagggtggggcaggccagccctctgaacgcccgccaacagaggagaggcgggatgtcagagggcaacctggcggcagcgcaaaagatg

SEQ ID NO: 116854 - DNA, 103 bp, Artificial Sequence
  Synthetic Polynucleotide
taatacgactcactatagggtggttgctgctggggcaggccagccctctgaacagaggagacagaggatgggcctgcccaacctggcggcagcgcaaaagatg

SEQ ID NO: 116855 - DNA, 103 bp, Artificial Sequence
  Synthetic Polynucleotide
taatacgactcactataggggttgctgctgtggttgctgctggggcaggcaacagaggagagcctgcatgagcagcaacaacctggcggcagcgcaaaagatg

SEQ ID NO: 116856 - DNA, 103 bp, Artificial Sequence
  Synthetic Polynucleotide
taatacgactcactatagggggtggctggagttgctgctgtggttgctgcaacagaggagagcagcaatgacagcagcaaacctggcggcagcgcaaaagatg

SEQ ID NO: 116857 - DNA, 103 bp, Artificial Sequence
  Synthetic Polynucleotide
taatacgactcactatagggccctcccatgggtggctggagttgctgctgaacagaggagacagcagatgctccagccaaacctggcggcagcgcaaaagatg

SEQ ID NO: 116858 - DNA, 103 bp, Artificial Sequence
  Synthetic Polynucleotide
taatacgactcactataggggggggctcatccctcccatgggtggctggaaacagaggagatccagcatgccatgggagaacctggcggcagcgcaaaagatg

SEQ ID NO: 116859 - DNA, 103 bp, Artificial Sequence
  Synthetic Polynucleotide
taatacgactcactatagggtgctgagcctgggggctcatccctcccatgaacagaggagacatgggatggatgagcccaacctggcggcagcgcaaaagatg

SEQ ID NO: 116860 - DNA, 103 bp, Artificial Sequence
  Synthetic Polynucleotide
taatacgactcactatagggcatgttcatctgctgagcctgggggctcataacagaggagaatgagcatgcaggctcagaacctggcggcagcgcaaaagatg

SEQ ID NO: 116861 - DNA, 103 bp, Artificial Sequence
  Synthetic Polynucleotide
taatacgactcactataggggaagaggctcagtcagtaagttgccagcacaacagaggagagtgctgatgacttactgaaacctggcggcagcgcaaaagatg

SEQ ID NO: 116862 - DNA, 103 bp, Artificial Sequence
  Synthetic Polynucleotide
taatacgactcactatagggtgttgtggttcatgttcatctgctgagcctaacagaggagaaggctcatgagatgaacaaacctggcggcagcgcaaaagatg

SEQ ID NO: 116863 - DNA, 103 bp, Artificial Sequence
  Synthetic Polynucleotide
taatacgactcactataggggaaggcatggtgttgtggttcatgttcatcaacagaggagagatgaaatggaaccacaaaacctggcggcagcgcaaaagatg

SEQ ID NO: 116864 - DNA, 103 bp, Artificial Sequence
  Synthetic Polynucleotide
taatacgactcactatagggtcggaattgtgaaggcatggtgttgtggttaacagaggagaaaccacatgaccatgcctaacctggcggcagcgcaaaagatg

SEQ ID NO: 116865 - DNA, 103 bp, Artificial Sequence
  Synthetic Polynucleotide
taatacgactcactatagggtcaagatgtctcggaattgtgaaggcatggaacagaggagaccatgcatgcacaattccaacctggcggcagcgcaaaagatg

SEQ ID NO: 116866 - DNA, 103 bp, Artificial Sequence
  Synthetic Polynucleotide
taatacgactcactatagggtgctgtcgtctcaagatgtctcggaattgtaacagaggagaacaattatgagacatcttaacctggcggcagcgcaaaagatg

SEQ ID NO: 116867 - DNA, 103 bp, Artificial Sequence
  Synthetic Polynucleotide
taatacgactcactatagggttgcatcatttgctgtcgtctcaagatgtcaacagaggagagacatcatgagacgacagaacctggcggcagcgcaaaagatg

SEQ ID NO: 116868 - DNA, 103 bp, Artificial Sequence
  Synthetic Polynucleotide
taatacgactcactataggggctgctgctgttgcatcatttgctgtcgtcaacagaggagagacgacatgaaatgatgcaacctggcggcagcgcaaaagatg

SEQ ID NO: 116869 - DNA, 103 bp, Artificial Sequence
  Synthetic Polynucleotide
taatacgactcactataggggctccctgttgctgctgctgttgcatcattaacagaggagaaatgatatgacagcagcaaacctggcggcagcgcaaaagatg

SEQ ID NO: 116870 - DNA, 103 bp, Artificial Sequence
  Synthetic Polynucleotide
taatacgactcactatagggtcctggccctgctccctgttgctgctgctgaacagaggagacagcagatgcaacagggaaacctggcggcagcgcaaaagatg

SEQ ID NO: 116871 - DNA, 103 bp, Artificial Sequence
  Synthetic Polynucleotide
taatacgactcactatagggcagggcctattcctggccctgctccctgttaacagaggagaaacaggatgcagggccagaacctggcggcagcgcaaaagatg

SEQ ID NO: 116872 - DNA, 103 bp, Artificial Sequence
  Synthetic Polynucleotide
taatacgactcactataggggagccctgctgaagaggctcagtcagtaagaacagaggagacttactatgtgagcctctaacctggcggcagcgcaaaagatg

SEQ ID NO: 116873 - DNA, 103 bp, Artificial Sequence
  Synthetic Polynucleotide
taatacgactcactatagggttggccattccagggcctattcctggccctaacagaggagaagggccatgaataggcccaacctggcggcagcgcaaaagatg

SEQ ID NO: 116874 - DNA, 103 bp, Artificial Sequence
  Synthetic Polynucleotide
taatacgactcactatagggctggttatggttggccattccagggcctataacagaggagaataggcatgggaatggccaacctggcggcagcgcaaaagatg

SEQ ID NO: 116875 - DNA, 103 bp, Artificial Sequence
  Synthetic Polynucleotide
taatacgactcactataggggttgctggaactggttatggttggccattcaacagaggagagaatggatgaccataaccaacctggcggcagcgcaaaagatg

SEQ ID NO: 116876 - DNA, 103 bp, Artificial Sequence
  Synthetic Polynucleotide
taatacgactcactatagggactccttggggttgctggaactggttatggaacagaggagaccataaatggttccagcaaacctggcggcagcgcaaaagatg

SEQ ID NO: 116877 - DNA, 103 bp, Artificial Sequence
  Synthetic Polynucleotide
taatacgactcactatagggtgggtagccaactccttggggttgctggaaaacagaggagattccagatgccccaaggaaacctggcggcagcgcaaaagatg

SEQ ID NO: 116878 - DNA, 103 bp, Artificial Sequence
  Synthetic Polynucleotide
taatacgactcactataggggctgctgtggtgggtagccaactccttgggaacagaggagacccaagatgttggctaccaacctggcggcagcgcaaaagatg

SEQ ID NO: 116879 - DNA, 103 bp, Artificial Sequence
  Synthetic Polynucleotide
taatacgactcactatagggatccgctgctgctgctgtggtgggtagccaaacagaggagatggctaatgaccacagcaaacctggcggcagcgcaaaagatg

SEQ ID NO: 116880 - DNA, 103 bp, Artificial Sequence
  Synthetic Polynucleotide
taatacgactcactataggggtgatgctgcatccgctgctgctgctgtggaacagaggagaccacagatgcagcagcggaacctggcggcagcgcaaaagatg

SEQ ID NO: 116881 - DNA, 103 bp, Artificial Sequence
  Synthetic Polynucleotide
taatacgactcactatagggtctgttgcatgtgatgctgcatccgctgctaacagaggagaagcagcatgtgcagcatcaacctggcggcagcgcaaaagatg

SEQ ID NO: 116882 - DNA, 103 bp, Artificial Sequence
  Synthetic Polynucleotide
taatacgactcactatagggccttgttgcatctgttgcatgtgatgctgcaacagaggagagcagcaatgcatgcaacaaacctggcggcagcgcaaaagatg

SEQ ID NO: 116883 - DNA, 103 bp, Artificial Sequence
  Synthetic Polynucleotide
taatacgactcactatagggcatctggggagagccctgctgaagaggctcaacagaggagagagcctatgcagcagggcaacctggcggcagcgcaaaagatg

SEQ ID NO: 116884 - DNA, 103 bp, Artificial Sequence
  Synthetic Polynucleotide
taatacgactcactatagggtcccatatttccttgttgcatctgttgcataacagaggagaatgcaaatgatgcaacaaaacctggcggcagcgcaaaagatg

SEQ ID NO: 116885 - DNA, 103 bp, Artificial Sequence
  Synthetic Polynucleotide
taatacgactcactatagggggcctatctgtcccatatttccttgttgcaaacagaggagatgcaacatggaaatatggaacctggcggcagcgcaaaagatg

SEQ ID NO: 116886 - DNA, 103 bp, Artificial Sequence
  Synthetic Polynucleotide
taatacgactcactatagggtggggaagctggcctatctgtcccatatttaacagaggagaaaatatatgacagataggaacctggcggcagcgcaaaagatg

SEQ ID NO: 116887 - DNA, 103 bp, Artificial Sequence
  Synthetic Polynucleotide
taatacgactcactatagggtcccaaggcctggggaagctggcctatctgaacagaggagacagataatgcagcttcccaacctggcggcagcgcaaaagatg

SEQ ID NO: 116888 - DNA, 103 bp, Artificial Sequence
  Synthetic Polynucleotide
taatacgactcactatagggctgcctctgctcccaaggcctggggaagctaacagaggagaagcttcatgaggccttggaacctggcggcagcgcaaaagatg

SEQ ID NO: 116889 - DNA, 103 bp, Artificial Sequence
  Synthetic Polynucleotide
taatacgactcactatagggagactggcacctgcctctgctcccaaggccaacagaggagaggccttatgagcagaggcaacctggcggcagcgcaaaagatg

SEQ ID NO: 116890 - DNA, 103 bp, Artificial Sequence
  Synthetic Polynucleotide
taatacgactcactatagggataggcctgtagactggcacctgcctctgcaacagaggagagcagagatgggtgccagtaacctggcggcagcgcaaaagatg

SEQ ID NO: 116891 - DNA, 103 bp, Artificial Sequence
  Synthetic Polynucleotide
taatacgactcactataggggtcgctgctgataggcctgtagactggcacaacagaggagagtgccaatgtacaggcctaacctggcggcagcgcaaaagatg

SEQ ID NO: 116892 - DNA, 103 bp, Artificial Sequence
  Synthetic Polynucleotide
taatacgactcactatagggtgctgaaggagtcgctgctgataggcctgtaacagaggagaacaggcatgtcagcagcgaacctggcggcagcgcaaaagatg

SEQ ID NO: 116893 - DNA, 103 bp, Artificial Sequence
  Synthetic Polynucleotide
taatacgactcactatagggccccatctgttgctgaaggagtcgctgctgaacagaggagacagcagatgctccttcagaacctggcggcagcgcaaaagatg

SEQ ID NO: 116894 - DNA, 103 bp, Artificial Sequence
  Synthetic Polynucleotide
taatacgactcactatagggtttgtcctcccatctggggagagccctgctaacagaggagaagcaggatgctccccagaaacctggcggcagcgcaaaagatg

SEQ ID NO: 116895 - DNA, 103 bp, Artificial Sequence
  Synthetic Polynucleotide
taatacgactcactataggggaacaggggaccccatctgttgctgaaggaaacagaggagatccttcatgaacagatggaacctggcggcagcgcaaaagatg

SEQ ID NO: 116896 - DNA, 103 bp, Artificial Sequence
  Synthetic Polynucleotide
taatacgactcactataggggggttgggctgaacaggggaccccatctgtaacagaggagaacagatatggtcccctgtaacctggcggcagcgcaaaagatg

SEQ ID NO: 116897 - DNA, 103 bp, Artificial Sequence
  Synthetic Polynucleotide
taatacgactcactatagggggggctcatggggttgggctgaacaggggaaacagaggagatcccctatgcagcccaacaacctggcggcagcgcaaaagatg

SEQ ID NO: 116898 - DNA, 103 bp, Artificial Sequence
  Synthetic Polynucleotide
taatacgactcactatagggtatgctgctgggggctcatggggttgggctaacagaggagaagcccaatgccatgagccaacctggcggcagcgcaaaagatg

SEQ ID NO: 116899 - DNA, 103 bp, Artificial Sequence
  Synthetic Polynucleotide
taatacgactcactatagggtttgggagcatatgctgctgggggctcatgaacagaggagacatgagatgccagcagcaaacctggcggcagcgcaaaagatg

SEQ ID NO: 116900 - DNA, 103 bp, Artificial Sequence
  Synthetic Polynucleotide
taatacgactcactatagggctgggcctgatttgggagcatatgctgctgaacagaggagacagcagatgatgctcccaaacctggcggcagcgcaaaagatg

SEQ ID NO: 116901 - DNA, 103 bp, Artificial Sequence
  Synthetic Polynucleotide
taatacgactcactatagggggtgtggggactgggcctgatttgggagcaaacagaggagatgctccatgatcaggcccaacctggcggcagcgcaaaagatg

SEQ ID NO: 116902 - DNA, 103 bp, Artificial Sequence
  Synthetic Polynucleotide
taatacgactcactatagggtggccttgtaggtgtggggactgggcctgaaacagaggagatcaggcatggtccccacaaacctggcggcagcgcaaaagatg

SEQ ID NO: 116903 - DNA, 103 bp, Artificial Sequence
  Synthetic Polynucleotide
taatacgactcactatagggagggatctgctggccttgtaggtgtggggaaacagaggagatccccaatgctacaaggcaacctggcggcagcgcaaaagatg

SEQ ID NO: 116904 - DNA, 103 bp, Artificial Sequence
  Synthetic Polynucleotide
taatacgactcactatagggagagagaattagggatctgctggccttgtaaacagaggagatacaagatgagcagatccaacctggcggcagcgcaaaagatg

SEQ ID NO: 116905 - DNA, 103 bp, Artificial Sequence
  Synthetic Polynucleotide
taatacgactcactatagggctcaatcctgtttgtcctcccatctggggaaacagaggagatccccaatggggaggacaaacctggcggcagcgcaaaagatg

SEQ ID NO: 116906 - DNA, 103 bp, Artificial Sequence
  Synthetic Polynucleotide
taatacgactcactatagggacttgattggagagagaattagggatctgcaacagaggagagcagatatgtaattctctaacctggcggcagcgcaaaagatg

SEQ ID NO: 116907 - DNA, 103 bp, Artificial Sequence
  Synthetic Polynucleotide
taatacgactcactataggggggagagcgcacttgattggagagagaattaacagaggagaaattctatgtccaatcaaaacctggcggcagcgcaaaagatg

SEQ ID NO: 116908 - DNA, 103 bp, Artificial Sequence
  Synthetic Polynucleotide
taatacgactcactatagggggacaggctggggagagcgcacttgattggaacagaggagaccaatcatgtgcgctctcaacctggcggcagcgcaaaagatg

SEQ ID NO: 116909 - DNA, 103 bp, Artificial Sequence
  Synthetic Polynucleotide
taatacgactcactatagggcgtggagaagggacaggctggggagagcgcaacagaggagagcgctcatgccagcctgtaacctggcggcagcgcaaaagatg

SEQ ID NO: 116910 - DNA, 103 bp, Artificial Sequence
  Synthetic Polynucleotide
taatacgactcactatagggggactgtggccgtggagaagggacaggctgaacagaggagacagcctatgccttctccaaacctggcggcagcgcaaaagatg

SEQ ID NO: 116911 - DNA, 103 bp, Artificial Sequence
  Synthetic Polynucleotide
taatacgactcactataggggggggggctgggactgtggccgtggagaagaacagaggagacttctcatgggccacagtaacctggcggcagcgcaaaagatg

SEQ ID NO: 116912 - DNA, 103 bp, Artificial Sequence
  Synthetic Polynucleotide
taatacgactcactatagggggactggagtgggggggctgggactgtggcaacagaggagagccacaatgccagcccccaacctggcggcagcgcaaaagatg

SEQ ID NO: 116913 - DNA, 103 bp, Artificial Sequence
  Synthetic Polynucleotide
taatacgactcactatagggccttggggaaggactggagtgggggggctgaacagaggagacagcccatgcactccagtaacctggcggcagcgcaaaagatg

SEQ ID NO: 116914 - DNA, 103 bp, Artificial Sequence
  Synthetic Polynucleotide
taatacgactcactataggggaggctgcatccttggggaaggactggagtaacagaggagaactccaatgcttccccaaaacctggcggcagcgcaaaagatg

SEQ ID NO: 116915 - DNA, 103 bp, Artificial Sequence
  Synthetic Polynucleotide
taatacgactcactatagggggagaaggctgaggctgcatccttggggaaaacagaggagattccccatggatgcagccaacctggcggcagcgcaaaagatg

SEQ ID NO: 116916 - DNA, 103 bp, Artificial Sequence
  Synthetic Polynucleotide
taatacgactcactataggggccatcgctggcggacgccgagagggccggaacagaggagaccggccatgtcggcgtccaacctggcggcagcgcaaaagatg

SEQ ID NO: 116917 - DNA, 103 bp, Artificial Sequence
  Synthetic Polynucleotide
taatacgactcactatagggctgggggcctctcaatcctgtttgtcctccaacagaggagaggaggaatgacaggattgaacctggcggcagcgcaaaagatg

SEQ ID NO: 116918 - DNA, 103 bp, Artificial Sequence
  Synthetic Polynucleotide
taatacgactcactatagggaacgtggtgtggagaaggctgaggctgcataacagaggagaatgcagatgcagccttctaacctggcggcagcgcaaaagatg

SEQ ID NO: 116919 - DNA, 103 bp, Artificial Sequence
  Synthetic Polynucleotide
taatacgactcactatagggtctgtggggaaacgtggtgtggagaaggctaacagaggagaagccttatgcacaccacgaacctggcggcagcgcaaaagatg

SEQ ID NO: 116920 - DNA, 103 bp, Artificial Sequence
  Synthetic Polynucleotide
taatacgactcactatagggggggaacttgtctgtggggaaacgtggtgtaacagaggagaacaccaatgttccccacaaacctggcggcagcgcaaaagatg

SEQ ID NO: 116921 - DNA, 103 bp, Artificial Sequence
  Synthetic Polynucleotide
taatacgactcactatagggtccaggatgtggggaacttgtctgtggggaaacagaggagatccccaatgacaagttccaacctggcggcagcgcaaaagatg

SEQ ID NO: 116922 - DNA, 103 bp, Artificial Sequence
  Synthetic Polynucleotide
taatacgactcactatagggcagctaccagtccaggatgtggggaacttgaacagaggagacaagttatgcacatcctgaacctggcggcagcgcaaaagatg

SEQ ID NO: 116923 - DNA, 103 bp, Artificial Sequence
  Synthetic Polynucleotide
taatacgactcactatagggttggcctgggcagctaccagtccaggatgtaacagaggagaacatccatgactggtagcaacctggcggcagcgcaaaagatg

SEQ ID NO: 116924 - DNA, 103 bp, Artificial Sequence
  Synthetic Polynucleotide
taatacgactcactatagggttccatggggttggcctgggcagctaccagaacagaggagactggtaatggcccaggccaacctggcggcagcgcaaaagatg

SEQ ID NO: 116925 - DNA, 103 bp, Artificial Sequence
  Synthetic Polynucleotide
taatacgactcactatagggaatgcccttgttccatggggttggcctgggaacagaggagacccaggatgaccccatggaacctggcggcagcgcaaaagatg

SEQ ID NO: 116926 - DNA, 103 bp, Artificial Sequence
  Synthetic Polynucleotide
taatacgactcactataggggggctggcaaaatgcccttgttccatggggaacagaggagaccccatatgacaagggcaaacctggcggcagcgcaaaagatg

SEQ ID NO: 116927 - DNA, 103 bp, Artificial Sequence
  Synthetic Polynucleotide
taatacgactcactatagggattctggtccgggctggcaaaatgcccttgaacagaggagacaagggatgtttgccagcaacctggcggcagcgcaaaagatg

SEQ ID NO: 116928 - DNA, 103 bp, Artificial Sequence
  Synthetic Polynucleotide
taatacgactcactatagggtcttaagaggctgggggcctctcaatcctgaacagaggagacaggatatggaggcccccaacctggcggcagcgcaaaagatg

SEQ ID NO: 116929 - DNA, 103 bp, Artificial Sequence
  Synthetic Polynucleotide
taatacgactcactatagggaaagcattgaattctggtccgggctggcaaaacagaggagattgccaatgcggaccagaaacctggcggcagcgcaaaagatg

SEQ ID NO: 116930 - DNA, 103 bp, Artificial Sequence
  Synthetic Polynucleotide
taatacgactcactataggggcaagctgagaaagcattgaattctggtccaacagaggagaggaccaatgttcaatgctaacctggcggcagcgcaaaagatg

SEQ ID NO: 116931 - DNA, 103 bp, Artificial Sequence
  Synthetic Polynucleotide
taatacgactcactatagggtggattgctagcaagctgagaaagcattgaaacagaggagatcaatgatgtctcagcttaacctggcggcagcgcaaaagatg

SEQ ID NO: 116932 - DNA, 103 bp, Artificial Sequence
  Synthetic Polynucleotide
taatacgactcactatagggttgccatgcctggattgctagcaagctgagaacagaggagactcagcatgctagcaatcaacctggcggcagcgcaaaagatg

SEQ ID NO: 116933 - DNA, 103 bp, Artificial Sequence
  Synthetic Polynucleotide
taatacgactcactatagggccatggaggtttgccatgcctggattgctaaacagaggagatagcaaatgaggcatggcaacctggcggcagcgcaaaagatg

SEQ ID NO: 116934 - DNA, 103 bp, Artificial Sequence
  Synthetic Polynucleotide
taatacgactcactatagggggcgcttgcaccatggaggtttgccatgccaacagaggagaggcatgatgaacctccataacctggcggcagcgcaaaagatg

SEQ ID NO: 116935 - DNA, 103 bp, Artificial Sequence
  Synthetic Polynucleotide
taatacgactcactatagggccaggtccgtggcgcttgcaccatggaggtaacagaggagaacctccatggtgcaagcgaacctggcggcagcgcaaaagatg

SEQ ID NO: 116936 - DNA, 103 bp, Artificial Sequence
  Synthetic Polynucleotide
taatacgactcactataggggtgctgagtcccaggtccgtggcgcttgcaaacagaggagatgcaagatgcacggacctaacctggcggcagcgcaaaagatg

SEQ ID NO: 116937 - DNA, 103 bp, Artificial Sequence
  Synthetic Polynucleotide
taatacgactcactatagggtgagttatcggtgctgagtcccaggtccgtaacagaggagaacggacatgggactcagcaacctggcggcagcgcaaaagatg

SEQ ID NO: 116938 - DNA, 103 bp, Artificial Sequence
  Synthetic Polynucleotide
taatacgactcactatagggaattcaagtctgagttatcggtgctgagtcaacagaggagagactcaatgccgataactaacctggcggcagcgcaaaagatg

SEQ ID NO: 116939 - DNA, 103 bp, Artificial Sequence
  Synthetic Polynucleotide
taatacgactcactatagggatcattcccatcttaagaggctgggggcctaacagaggagaaggcccatggcctcttaaaacctggcggcagcgcaaaagatg

SEQ ID NO: 116940 - DNA, 103 bp, Artificial Sequence
  Synthetic Polynucleotide
taatacgactcactataggggagaggtttgaattcaagtctgagttatcgaacagaggagacgataaatgagacttgaaaacctggcggcagcgcaaaagatg

SEQ ID NO: 116941 - DNA, 103 bp, Artificial Sequence
  Synthetic Polynucleotide
taatacgactcactatagggtgtactctgtgagaggtttgaattcaagtcaacagaggagagacttgatgtcaaacctcaacctggcggcagcgcaaaagatg

SEQ ID NO: 116942 - DNA, 103 bp, Artificial Sequence
  Synthetic Polynucleotide
taatacgactcactataggggtatgtctagtgtactctgtgagaggtttgaacagaggagacaaaccatgcacagagtaaacctggcggcagcgcaaaagatg

SEQ ID NO: 116943 - DNA, 103 bp, Artificial Sequence
  Synthetic Polynucleotide
taatacgactcactatagggggggttgttcatcattcccatcttaagaggaacagaggagacctcttatgatgggaatgaacctggcggcagcgcaaaagatg

SEQ ID NO: 116944 - DNA, 103 bp, Artificial Sequence
  Synthetic Polynucleotide
taatacgactcactatagggcataaggattggggttgttcatcattcccaaacagaggagatgggaaatgtgaacaaccaacctggcggcagcgcaaaagatg

SEQ ID NO: 116945 - DNA, 103 bp, Artificial Sequence
  Synthetic Polynucleotide
taatacgactcactatagggtatggtgaaccataaggattggggttgttcaacagaggagagaacaaatgcaatccttaaacctggcggcagcgcaaaagatg

SEQ ID NO: 116946 - DNA, 103 bp, Artificial Sequence
  Synthetic Polynucleotide
taatacgactcactatagggattctgagtatatggtgaaccataaggattaacagaggagaaatcctatgggttcaccaaacctggcggcagcgcaaaagatg

SEQ ID NO: 116947 - DNA, 103 bp, Artificial Sequence
  Synthetic Polynucleotide
taatacgactcactataggggctgtccaggattctgagtatatggtgaacaacagaggagagttcacatgatactcagaaacctggcggcagcgcaaaagatg

SEQ ID NO: 116948 - DNA, 103 bp, Artificial Sequence
  Synthetic Polynucleotide
taatacgactcactataggggctccaatctgctgtccaggattctgagtaaacagaggagatactcaatgtcctggacaaacctggcggcagcgcaaaagatg

SEQ ID NO: 116949 - DNA, 103 bp, Artificial Sequence
  Synthetic Polynucleotide
taatacgactcactatagggaaggccactggctccaatctgctgtccaggaacagaggagacctggaatgcagattggaaacctggcggcagcgcaaaagatg

SEQ ID NO: 116950 - DNA, 103 bp, Artificial Sequence
  Synthetic Polynucleotide
taatacgactcactatagggcaaaatctgtgccatcgctggcggacgccgaacagaggagacggcgtatgccagcgatgaacctggcggcagcgcaaaagatg

SEQ ID NO: 116951 - DNA, 103 bp, Artificial Sequence
  Synthetic Polynucleotide
taatacgactcactatagggtctggagaccaaggccactggctccaatctaacagaggagaagattgatgccagtggccaacctggcggcagcgcaaaagatg

SEQ ID NO: 116952 - DNA, 103 bp, Artificial Sequence
  Synthetic Polynucleotide
taatacgactcactatagggtttgtctgaatctggagaccaaggccactgaacagaggagacagtggatgtggtctccaaacctggcggcagcgcaaaagatg

SEQ ID NO: 116953 - DNA, 103 bp, Artificial Sequence
  Synthetic Polynucleotide
taatacgactcactatagggtagtacagtttttgtctgaatctggagaccaacagaggagaggtctcatgattcagacaaacctggcggcagcgcaaaagatg

SEQ ID NO: 116954 - DNA, 103 bp, Artificial Sequence
  Synthetic Polynucleotide
taatacgactcactatagggagttatttgatagtacagtttttgtctgaaaacagaggagattcagaatgaaactgtacaacctggcggcagcgcaaaagatg

SEQ ID NO: 116955 - DNA, 103 bp, Artificial Sequence
  Synthetic Polynucleotide
taatacgactcactatagggaatggagataagttatttgatagtacagttaacagaggagaaactgtatgatcaaataaaacctggcggcagcgcaaaagatg

SEQ ID NO: 116956 - DNA, 103 bp, Artificial Sequence
  Synthetic Polynucleotide
taatacgactcactataggggtccatagcaaatggagataagttatttgaaacagaggagatcaaatatgttatctccaaacctggcggcagcgcaaaagatg

SEQ ID NO: 116957 - DNA, 103 bp, Artificial Sequence
  Synthetic Polynucleotide
taatacgactcactatagggctgcctttttgtccatagcaaatggagataaacagaggagatatctcatgttgctatggaacctggcggcagcgcaaaagatg

SEQ ID NO: 116958 - DNA, 103 bp, Artificial Sequence
  Synthetic Polynucleotide
taatacgactcactatagggccaccaggaactgcctttttgtccatagcaaacagaggagatgctatatgcaaaaaggcaacctggcggcagcgcaaaagatg

SEQ ID NO: 116959 - DNA, 103 bp, Artificial Sequence
  Synthetic Polynucleotide
taatacgactcactataggggggcattcctccaccaggaactgcctttttaacagaggagaaaaaagatggttcctggtaacctggcggcagcgcaaaagatg

SEQ ID NO: 116960 - DNA, 103 bp, Artificial Sequence
  Synthetic Polynucleotide
taatacgactcactataggggacccatgttgggcattcctccaccaggaaaacagaggagattcctgatggaggaatgcaacctggcggcagcgcaaaagatg

SEQ ID NO: 116961 - DNA, 103 bp, Artificial Sequence
  Synthetic Polynucleotide
taatacgactcactatagggaatagagagccaaaatctgtgccatcgctgaacagaggagacagcgaatgcacagatttaacctggcggcagcgcaaaagatg

SEQ ID NO: 116962 - DNA, 103 bp, Artificial Sequence
  Synthetic Polynucleotide
taatacgactcactataggggctggctgttgacccatgttgggcattcctaacagaggagaaggaatatgcaacatgggaacctggcggcagcgcaaaagatg

SEQ ID NO: 116963 - DNA, 103 bp, Artificial Sequence
  Synthetic Polynucleotide
taatacgactcactataggggacctgcggggctggctgttgacccatgttaacagaggagaaacatgatgcaacagccaaacctggcggcagcgcaaaagatg

SEQ ID NO: 116964 - DNA, 103 bp, Artificial Sequence
  Synthetic Polynucleotide
taatacgactcactatagggctggctgctggacctgcggggctggctgttaacagaggagaaacagcatgccccgcaggaacctggcggcagcgcaaaagatg

SEQ ID NO: 116965 - DNA, 103 bp, Artificial Sequence
  Synthetic Polynucleotide
taatacgactcactataggggtcaccaggcctggctgctggacctgcgggaacagaggagacccgcaatgccagcagccaacctggcggcagcgcaaaagatg

SEQ ID NO: 116966 - DNA, 103 bp, Artificial Sequence
  Synthetic Polynucleotide
taatacgactcactatagggggcaactggagtcaccaggcctggctgctgaacagaggagacagcagatgggcctggtgaacctggcggcagcgcaaaagatg

SEQ ID NO: 116967 - DNA, 103 bp, Artificial Sequence
  Synthetic Polynucleotide
taatacgactcactatagggccatcccttgggcaactggagtcaccaggcaacagaggagagcctggatgctccagttgaacctggcggcagcgcaaaagatg

SEQ ID NO: 116968 - DNA, 103 bp, Artificial Sequence
  Synthetic Polynucleotide
taatacgactcactataggggctccagaacccatcccttgggcaactggaaacagaggagatccagtatgccaagggataacctggcggcagcgcaaaagatg

SEQ ID NO: 116969 - DNA, 103 bp, Artificial Sequence
  Synthetic Polynucleotide
taatacgactcactatagggagctgtatgtgctccagaacccatcccttgaacagaggagacaagggatgggttctggaaacctggcggcagcgcaaaagatg

SEQ ID NO: 116970 - DNA, 103 bp, Artificial Sequence
  Synthetic Polynucleotide
taatacgactcactatagggtctctggatcagctgtatgtgctccagaacaacagaggagagttctgatgcacatacagaacctggcggcagcgcaaaagatg

SEQ ID NO: 116971 - DNA, 103 bp, Artificial Sequence
  Synthetic Polynucleotide
taatacgactcactatagggagcttgcgcttctctggatcagctgtatgtaacagaggagaacatacatgtgatccagaaacctggcggcagcgcaaaagatg

SEQ ID NO: 116972 - DNA, 103 bp, Artificial Sequence
  Synthetic Polynucleotide
taatacgactcactatagggccagacccaaagtcctgtcgccggcttcataacagaggagaatgaagatggcgacaggaaacctggcggcagcgcaaaagatg

SEQ ID NO: 116973 - DNA, 103 bp, Artificial Sequence
  Synthetic Polynucleotide
taatacgactcactatagggagagagagagctcagtttattctccgttccaacagaggagaggaacgatgaataaactgaacctggcggcagcgcaaaagatg

SEQ ID NO: 116974 - DNA, 103 bp, Artificial Sequence
  Synthetic Polynucleotide
taatacgactcactatagggtcctgtgccaatgccatcacaagcttttggaacagaggagaccaaaaatgtgtgatggcaacctggcggcagcgcaaaagatg

SEQ ID NO: 116975 - DNA, 103 bp, Artificial Sequence
  Synthetic Polynucleotide
taatacgactcactatagggacatcaatgatcctgtgccaatgccatcacaacagaggagagtgatgatgttggcacagaacctggcggcagcgcaaaagatg

SEQ ID NO: 116976 - DNA, 103 bp, Artificial Sequence
  Synthetic Polynucleotide
taatacgactcactataggggtctgagctgacatcaatgatcctgtgccaaacagaggagatggcacatgatcattgataacctggcggcagcgcaaaagatg

SEQ ID NO: 116977 - DNA, 103 bp, Artificial Sequence
  Synthetic Polynucleotide
taatacgactcactatagggggaatccacagtctgagctgacatcaatgaaacagaggagatcattgatgtcagctcagaacctggcggcagcgcaaaagatg

SEQ ID NO: 116978 - DNA, 103 bp, Artificial Sequence
  Synthetic Polynucleotide
taatacgactcactatagggcaatgttactggaatccacagtctgagctgaacagaggagacagctcatgctgtggattaacctggcggcagcgcaaaagatg

SEQ ID NO: 116979 - DNA, 103 bp, Artificial Sequence
  Synthetic Polynucleotide
taatacgactcactatagggatgaatttgtcaatgttactggaatccacaaacagaggagatgtggaatgcagtaacataacctggcggcagcgcaaaagatg

SEQ ID NO: 116980 - DNA, 103 bp, Artificial Sequence
  Synthetic Polynucleotide
taatacgactcactatagggggtacagtttatgaatttgtcaatgttactaacagaggagaagtaacatggacaaattcaacctggcggcagcgcaaaagatg

SEQ ID NO: 116981 - DNA, 103 bp, Artificial Sequence
  Synthetic Polynucleotide
taatacgactcactatagggcattgatcttggtacagtttatgaatttgtaacagaggagaacaaatatgtaaactgtaaacctggcggcagcgcaaaagatg

SEQ ID NO: 116982 - DNA, 103 bp, Artificial Sequence
  Synthetic Polynucleotide
taatacgactcactatagggatcaaattcccattgatcttggtacagtttaacagaggagaaaactgatgcaagatcaaaacctggcggcagcgcaaaagatg

SEQ ID NO: 116983 - DNA, 103 bp, Artificial Sequence
  Synthetic Polynucleotide
taatacgactcactataggggactagaaagatcaaattcccattgatcttaacagaggagaaagatcatggggaatttgaacctggcggcagcgcaaaagatg

SEQ ID NO: 116984 - DNA, 103 bp, Artificial Sequence
  Synthetic Polynucleotide
taatacgactcactataggggttccaggtcagagagagagctcagtttataacagaggagaataaacatggctctctctaacctggcggcagcgcaaaagatg

SEQ ID NO: 116985 - DNA, 103 bp, Artificial Sequence
  Synthetic Polynucleotide
taatacgactcactataggggaataccagtgactagaaagatcaaattccaacagaggagaggaattatgtctttctagaacctggcggcagcgcaaaagatg

SEQ ID NO: 116986 - DNA, 103 bp, Artificial Sequence
  Synthetic Polynucleotide
taatacgactcactataggggggtccccatgaataccagtgactagaaagaacagaggagactttctatgcactggtataacctggcggcagcgcaaaagatg

SEQ ID NO: 116987 - DNA, 103 bp, Artificial Sequence
  Synthetic Polynucleotide
taatacgactcactatagggtgcattgtaagggtccccatgaataccagtaacagaggagaactggtatgcatggggacaacctggcggcagcgcaaaagatg

SEQ ID NO: 116988 - DNA, 103 bp, Artificial Sequence
  Synthetic Polynucleotide
taatacgactcactatagggtggcttcaattgcattgtaagggtccccataacagaggagaatggggatgcttacaatgaacctggcggcagcgcaaaagatg

SEQ ID NO: 116989 - DNA, 103 bp, Artificial Sequence
  Synthetic Polynucleotide
taatacgactcactatagggtctgggtctatggcttcaattgcattgtaaaacagaggagattacaaatgaattgaagcaacctggcggcagcgcaaaagatg

SEQ ID NO: 116990 - DNA, 103 bp, Artificial Sequence
  Synthetic Polynucleotide
taatacgactcactataggggttcagtttctctgggtctatggcttcaataacagaggagaattgaaatgatagacccaaacctggcggcagcgcaaaagatg

SEQ ID NO: 116991 - DNA, 103 bp, Artificial Sequence
  Synthetic Polynucleotide
taatacgactcactatagggtccgaaagacgttcagtttctctgggtctaaacagaggagatagaccatgagaaactgaaacctggcggcagcgcaaaagatg

SEQ ID NO: 116992 - DNA, 103 bp, Artificial Sequence
  Synthetic Polynucleotide
taatacgactcactatagggtctctgactgtccgaaagacgttcagtttcaacagaggagagaaactatgcgtctttcgaacctggcggcagcgcaaaagatg

SEQ ID NO: 116993 - DNA, 103 bp, Artificial Sequence
  Synthetic Polynucleotide
taatacgactcactatagggacctgttatctctctgactgtccgaaagacaacagaggagagtctttatgacagtcagaaacctggcggcagcgcaaaagatg

SEQ ID NO: 116994 - DNA, 103 bp, Artificial Sequence
  Synthetic Polynucleotide
taatacgactcactatagggtgttcaggaaacctgttatctctctgactgaacagaggagacagtcaatgagataacagaacctggcggcagcgcaaaagatg

SEQ ID NO: 116995 - DNA, 103 bp, Artificial Sequence
  Synthetic Polynucleotide
taatacgactcactatagggcggtactgctgttccaggtcagagagagagaacagaggagactctctatgtgacctggaaacctggcggcagcgcaaaagatg

SEQ ID NO: 116996 - DNA, 103 bp, Artificial Sequence
  Synthetic Polynucleotide
taatacgactcactatagggcatgactgtatgttcaggaaacctgttatcaacagaggagagataacatgtttcctgaaaacctggcggcagcgcaaaagatg

SEQ ID NO: 116997 - DNA, 103 bp, Artificial Sequence
  Synthetic Polynucleotide
taatacgactcactataggggtttggtggccatgactgtatgttcaggaaaacagaggagattcctgatgatacagtcaaacctggcggcagcgcaaaagatg

SEQ ID NO: 116998 - DNA, 103 bp, Artificial Sequence
  Synthetic Polynucleotide
taatacgactcactatagggagtcagtcatgtttggtggccatgactgtaaacagaggagatacagtatgggccaccaaaacctggcggcagcgcaaaagatg

SEQ ID NO: 116999 - DNA, 103 bp, Artificial Sequence
  Synthetic Polynucleotide
taatacgactcactatagggaaaacactgaagtcagtcatgtttggtggcaacagaggagagccaccatgcatgactgaaacctggcggcagcgcaaaagatg

SEQ ID NO: 117000 - DNA, 103 bp, Artificial Sequence
  Synthetic Polynucleotide
taatacgactcactatagggcaggttagaaaaaacactgaagtcagtcataacagaggagaatgactatgttcagtgttaacctggcggcagcgcaaaagatg

SEQ ID NO: 117001 - DNA, 103 bp, Artificial Sequence
  Synthetic Polynucleotide
taatacgactcactatagggcaatggtcaccaggttagaaaaaacactgaaacagaggagatcagtgatgtttctaaccaacctggcggcagcgcaaaagatg

SEQ ID NO: 117002 - DNA, 103 bp, Artificial Sequence
  Synthetic Polynucleotide
taatacgactcactatagggactcttccaccaatggtcaccaggttagaaaacagaggagattctaaatgggtgaccataacctggcggcagcgcaaaagatg

SEQ ID NO: 117003 - DNA, 103 bp, Artificial Sequence
  Synthetic Polynucleotide
taatacgactcactatagggactatagagtactcttccaccaatggtcacaacagaggagagtgaccatgggtggaagaaacctggcggcagcgcaaaagatg

SEQ ID NO: 117004 - DNA, 103 bp, Artificial Sequence
  Synthetic Polynucleotide
taatacgactcactatagggaggacaggccactatagagtactcttccacaacagaggagagtggaaatgtactctataaacctggcggcagcgcaaaagatg

SEQ ID NO: 117005 - DNA, 103 bp, Artificial Sequence
  Synthetic Polynucleotide
taatacgactcactatagggaggataagcaaggacaggccactatagagtaacagaggagaactctaatgtggcctgtcaacctggcggcagcgcaaaagatg

SEQ ID NO: 117006 - DNA, 103 bp, Artificial Sequence
  Synthetic Polynucleotide
taatacgactcactataggggcgcaaggctcggtactgctgttccaggtcaacagaggagagacctgatgcagcagtacaacctggcggcagcgcaaaagatg

SEQ ID NO: 117007 - DNA, 103 bp, Artificial Sequence
  Synthetic Polynucleotide
taatacgactcactatagggctgttgcttgaggataagcaaggacaggccaacagaggagaggcctgatgttgcttatcaacctggcggcagcgcaaaagatg

SEQ ID NO: 117008 - DNA, 103 bp, Artificial Sequence
  Synthetic Polynucleotide
taatacgactcactatagggaggtgatgccctgttgcttgaggataagcaaacagaggagatgcttaatgtcaagcaacaacctggcggcagcgcaaaagatg

SEQ ID NO: 117009 - DNA, 103 bp, Artificial Sequence
  Synthetic Polynucleotide
taatacgactcactatagggaactgtagagaggtgatgccctgttgcttgaacagaggagacaagcaatggggcatcacaacctggcggcagcgcaaaagatg

SEQ ID NO: 117010 - DNA, 103 bp, Artificial Sequence
  Synthetic Polynucleotide
taatacgactcactatagggcagggactggaactgtagagaggtgatgccaacagaggagaggcatcatgtctctacagaacctggcggcagcgcaaaagatg

SEQ ID NO: 117011 - DNA, 103 bp, Artificial Sequence
  Synthetic Polynucleotide
taatacgactcactatagggtgatttccttcagggactggaactgtagagaacagaggagactctacatgtccagtcccaacctggcggcagcgcaaaagatg

SEQ ID NO: 117012 - DNA, 103 bp, Artificial Sequence
  Synthetic Polynucleotide
taatacgactcactatagggtttcctgcgctgatttccttcagggactggaacagaggagaccagtcatggaaggaaataacctggcggcagcgcaaaagatg

SEQ ID NO: 117013 - DNA, 103 bp, Artificial Sequence
  Synthetic Polynucleotide
taatacgactcactatagggaatatagatgtttcctgcgctgatttccttaacagaggagaaaggaaatgagcgcaggaaacctggcggcagcgcaaaagatg

SEQ ID NO: 117014 - DNA, 103 bp, Artificial Sequence
  Synthetic Polynucleotide
taatacgactcactatagggtgttgtcagtaatatagatgtttcctgcgcaacagaggagagcgcagatgacatctataaacctggcggcagcgcaaaagatg

SEQ ID NO: 117015 - DNA, 103 bp, Artificial Sequence
  Synthetic Polynucleotide
taatacgactcactatagggcacaggttgctgttgtcagtaatatagatgaacagaggagacatctaatgtactgacaaaacctggcggcagcgcaaaagatg

SEQ ID NO: 117016 - DNA, 103 bp, Artificial Sequence
  Synthetic Polynucleotide
taatacgactcactatagggatgataataacacaggttgctgttgtcagtaacagaggagaactgacatgagcaacctgaacctggcggcagcgcaaaagatg

SEQ ID NO: 117017 - DNA, 103 bp, Artificial Sequence
  Synthetic Polynucleotide
taatacgactcactatagggcatagtacttgcgcaaggctcggtactgctaacagaggagaagcagtatggagccttgcaacctggcggcagcgcaaaagatg

SEQ ID NO: 117018 - DNA, 103 bp, Artificial Sequence
  Synthetic Polynucleotide
taatacgactcactatagggagttaatggtatgataataacacaggttgcaacagaggagagcaaccatggttattatcaacctggcggcagcgcaaaagatg

SEQ ID NO: 117019 - DNA, 103 bp, Artificial Sequence
  Synthetic Polynucleotide
taatacgactcactatagggagtgttgtccagttaatggtatgataataaaacagaggagattattaatgtaccattaaaacctggcggcagcgcaaaagatg

SEQ ID NO: 117020 - DNA, 103 bp, Artificial Sequence
  Synthetic Polynucleotide
taatacgactcactatagggtgtgctgaagagtgttgtccagttaatggtaacagaggagaaccattatgtggacaacaaacctggcggcagcgcaaaagatg

SEQ ID NO: 117021 - DNA, 103 bp, Artificial Sequence
  Synthetic Polynucleotide
taatacgactcactatagggtctggttgattgtgctgaagagtgttgtccaacagaggagaggacaaatgtcttcagcaaacctggcggcagcgcaaaagatg

SEQ ID NO: 117022 - DNA, 103 bp, Artificial Sequence
  Synthetic Polynucleotide
taatacgactcactatagggattactattctctggttgattgtgctgaagaacagaggagacttcagatgaatcaaccaaacctggcggcagcgcaaaagatg

SEQ ID NO: 117023 - DNA, 103 bp, Artificial Sequence
  Synthetic Polynucleotide
taatacgactcactataggggttgtcccggattactattctctggttgataacagaggagaatcaacatgagaatagtaaacctggcggcagcgcaaaagatg

SEQ ID NO: 117024 - DNA, 103 bp, Artificial Sequence
  Synthetic Polynucleotide
taatacgactcactatagggcagcttttctgttgtcccggattactattcaacagaggagagaatagatgtccgggacaaacctggcggcagcgcaaaagatg

SEQ ID NO: 117025 - DNA, 103 bp, Artificial Sequence
  Synthetic Polynucleotide
taatacgactcactataggggtacaattttcagcttttctgttgtcccggaacagaggagaccgggaatgcagaaaagcaacctggcggcagcgcaaaagatg

SEQ ID NO: 117026 - DNA, 103 bp, Artificial Sequence
  Synthetic Polynucleotide
taatacgactcactatagggtccttcagcagtacaattttcagcttttctaacagaggagaagaaaaatggaaaattgtaacctggcggcagcgcaaaagatg

SEQ ID NO: 117027 - DNA, 103 bp, Artificial Sequence
  Synthetic Polynucleotide
taatacgactcactatagggtgcacaccattccttcagcagtacaattttaacagaggagaaaaattatgctgctgaagaacctggcggcagcgcaaaagatg

SEQ ID NO: 117028 - DNA, 103 bp, Artificial Sequence
  Synthetic Polynucleotide
taatacgactcactatagggtcacagttttcatagtacttgcgcaaggctaacagaggagaagccttatgcaagtactaaacctggcggcagcgcaaaagatg

SEQ ID NO: 117029 - DNA, 103 bp, Artificial Sequence
  Synthetic Polynucleotide
taatacgactcactatagggcacagatggttgcacaccattccttcagcaaacagaggagatgctgaatgaatggtgtgaacctggcggcagcgcaaaagatg

SEQ ID NO: 117030 - DNA, 103 bp, Artificial Sequence
  Synthetic Polynucleotide
taatacgactcactatagggatcactggaacacagatggttgcacaccataacagaggagaatggtgatgaaccatctgaacctggcggcagcgcaaaagatg

SEQ ID NO: 117031 - DNA, 103 bp, Artificial Sequence
  Synthetic Polynucleotide
taatacgactcactatagggcccaacagccatcactggaacacagatggtaacagaggagaaccatcatggttccagtgaacctggcggcagcgcaaaagatg

SEQ ID NO: 117032 - DNA, 103 bp, Artificial Sequence
  Synthetic Polynucleotide
taatacgactcactatagggggcccaggtccccaacagccatcactggaaaacagaggagattccagatgtggctgttgaacctggcggcagcgcaaaagatg

SEQ ID NO: 117033 - DNA, 103 bp, Artificial Sequence
  Synthetic Polynucleotide
taatacgactcactatagggacattggtctggcccaggtccccaacagccaacagaggagaggctgtatgggacctgggaacctggcggcagcgcaaaagatg

SEQ ID NO: 117034 - DNA, 103 bp, Artificial Sequence
  Synthetic Polynucleotide
taatacgactcactataggggacacgacagacattggtctggcccaggtcaacagaggagagacctgatgcagaccaataacctggcggcagcgcaaaagatg

SEQ ID NO: 117035 - DNA, 103 bp, Artificial Sequence
  Synthetic Polynucleotide
taatacgactcactatagggctgaagcggcgacacgacagacattggtctaacagaggagaagaccaatgtctgtcgtgaacctggcggcagcgcaaaagatg

SEQ ID NO: 117036 - DNA, 103 bp, Artificial Sequence
  Synthetic Polynucleotide
taatacgactcactatagggccttcctctactgaagcggcgacacgacagaacagaggagactgtcgatgcgccgcttcaacctggcggcagcgcaaaagatg

SEQ ID NO: 117037 - DNA, 103 bp, Artificial Sequence
  Synthetic Polynucleotide
taatacgactcactatagggctatgcagatccttcctctactgaagcggcaacagaggagagccgctatggtagaggaaaacctggcggcagcgcaaaagatg

SEQ ID NO: 117038 - DNA, 103 bp, Artificial Sequence
  Synthetic Polynucleotide
taatacgactcactatagggttacaagactctatgcagatccttcctctaaacagaggagatagaggatggatctgcataacctggcggcagcgcaaaagatg

SEQ ID NO: 117039 - DNA, 103 bp, Artificial Sequence
  Synthetic Polynucleotide
taatacgactcactatagggcatgacaacctcacagttttcatagtacttaacagaggagaaagtacatggaaaactgtaacctggcggcagcgcaaaagatg

SEQ ID NO: 117040 - DNA, 103 bp, Artificial Sequence
  Synthetic Polynucleotide
taatacgactcactatagggatcatagaggttacaagactctatgcagataacagaggagaatctgcatggagtcttgtaacctggcggcagcgcaaaagatg

SEQ ID NO: 117041 - DNA, 103 bp, Artificial Sequence
  Synthetic Polynucleotide
taatacgactcactataggggaaattcaccatcatagaggttacaagactaacagaggagaagtcttatgacctctatgaacctggcggcagcgcaaaagatg

SEQ ID NO: 117042 - DNA, 103 bp, Artificial Sequence
  Synthetic Polynucleotide
taatacgactcactatagggtcaaactcccgaaattcaccatcatagaggaacagaggagacctctaatgtggtgaattaacctggcggcagcgcaaaagatg

SEQ ID NO: 117043 - DNA, 103 bp, Artificial Sequence
  Synthetic Polynucleotide
taatacgactcactatagggggagccattctcaaactcccgaaattcaccaacagaggagaggtgaaatgcgggagtttaacctggcggcagcgcaaaagatg

SEQ ID NO: 117044 - DNA, 103 bp, Artificial Sequence
  Synthetic Polynucleotide
taatacgactcactatagggccacacagatggagccattctcaaactcccaacagaggagagggagtatgagaatggctaacctggcggcagcgcaaaagatg

SEQ ID NO: 117045 - DNA, 103 bp, Artificial Sequence
  Synthetic Polynucleotide
taatacgactcactataggggggtcacactccacacagatggagccattcaacagaggagagaatggatgcatctgtgtaacctggcggcagcgcaaaagatg

SEQ ID NO: 117046 - DNA, 103 bp, Artificial Sequence
  Synthetic Polynucleotide
taatacgactcactatagggctcacactgggggtcacactccacacagataacagaggagaatctgtatggagtgtgacaacctggcggcagcgcaaaagatg

SEQ ID NO: 117047 - DNA, 103 bp, Artificial Sequence
  Synthetic Polynucleotide
taatacgactcactatagggcttccatcttctcacactgggggtcacactaacagaggagaagtgtgatgcccagtgtgaacctggcggcagcgcaaaagatg

SEQ ID NO: 117048 - DNA, 103 bp, Artificial Sequence
  Synthetic Polynucleotide
taatacgactcactatagggaggaggccatcttccatcttctcacactggaacagaggagaccagtgatggaagatggaaacctggcggcagcgcaaaagatg

SEQ ID NO: 117049 - DNA, 103 bp, Artificial Sequence
  Synthetic Polynucleotide
taatacgactcactatagggatggcatgtgaggaggccatcttccatcttaacagaggagaaagatgatggatggcctcaacctggcggcagcgcaaaagatg

SEQ ID NO: 117050 - DNA, 103 bp, Artificial Sequence
  Synthetic Polynucleotide
taatacgactcactatagggccaggttgcccatgacaacctcacagttttaacagaggagaaaaactatgaggttgtcaaacctggcggcagcgcaaaagatg

SEQ ID NO: 117051 - DNA, 103 bp, Artificial Sequence
  Synthetic Polynucleotide
taatacgactcactataggggacccggtccatggcatgtgaggaggccataacagaggagaatggccatgtcacatgccaacctggcggcagcgcaaaagatg

SEQ ID NO: 117052 - DNA, 103 bp, Artificial Sequence
  Synthetic Polynucleotide
taatacgactcactatagggcagttgtcaggacccggtccatggcatgtgaacagaggagacacatgatgtggaccgggaacctggcggcagcgcaaaagatg

SEQ ID NO: 117053 - DNA, 103 bp, Artificial Sequence
  Synthetic Polynucleotide
taatacgactcactataggggcactttgtacagttgtcaggacccggtccaacagaggagaggaccgatgcctgacaacaacctggcggcagcgcaaaagatg

SEQ ID NO: 117054 - DNA, 103 bp, Artificial Sequence
  Synthetic Polynucleotide
taatacgactcactatagggtaaaatgagagcactttgtacagttgtcagaacagaggagactgacaatggtacaaagtaacctggcggcagcgcaaaagatg

SEQ ID NO: 117055 - DNA, 103 bp, Artificial Sequence
  Synthetic Polynucleotide
taatacgactcactataggggggccatctttaaaatgagagcactttgtaaacagaggagatacaaaatgctctcatttaacctggcggcagcgcaaaagatg

SEQ ID NO: 117056 - DNA, 103 bp, Artificial Sequence
  Synthetic Polynucleotide
taatacgactcactatagggcacacagtttgggccatctttaaaatgagaaacagaggagatctcatatgaaagatggcaacctggcggcagcgcaaaagatg

SEQ ID NO: 117057 - DNA, 103 bp, Artificial Sequence
  Synthetic Polynucleotide
taatacgactcactataggggacatttttccacacagtttgggccatcttaacagaggagaaagatgatgcaaactgtgaacctggcggcagcgcaaaagatg

SEQ ID NO: 117058 - DNA, 103 bp, Artificial Sequence
  Synthetic Polynucleotide
taatacgactcactatagggaagccatctggacatttttccacacagtttaacagaggagaaaactgatgggaaaaatgaacctggcggcagcgcaaaagatg

SEQ ID NO: 117059 - DNA, 103 bp, Artificial Sequence
  Synthetic Polynucleotide
taatacgactcactatagggtgccccctgtaagccatctggacatttttcaacagaggagagaaaaaatgccagatggcaacctggcggcagcgcaaaagatg

SEQ ID NO: 117060 - DNA, 103 bp, Artificial Sequence
  Synthetic Polynucleotide
taatacgactcactatagggtgaaactgtttgccccctgtaagccatctgaacagaggagacagatgatgtacagggggaacctggcggcagcgcaaaagatg

SEQ ID NO: 117061 - DNA, 103 bp, Artificial Sequence
  Synthetic Polynucleotide
taatacgactcactatagggctggttatctccaggttgcccatgacaaccaacagaggagaggttgtatggggcaacctaacctggcggcagcgcaaaagatg

SEQ ID NO: 117062 - DNA, 103 bp, Artificial Sequence
  Synthetic Polynucleotide
taatacgactcactatagggtacttgaaaatgaaactgtttgccccctgtaacagaggagaacagggatgaaacagtttaacctggcggcagcgcaaaagatg

SEQ ID NO: 117063 - DNA, 103 bp, Artificial Sequence
  Synthetic Polynucleotide
taatacgactcactatagggtggatcagcatacttgaaaatgaaactgttaacagaggagaaacagtatgattttcaagaacctggcggcagcgcaaaagatg

SEQ ID NO: 117064 - DNA, 103 bp, Artificial Sequence
  Synthetic Polynucleotide
taatacgactcactatagggactcccgatctggatcagcatacttgaaaaaacagaggagattttcaatgatgctgatcaacctggcggcagcgcaaaagatg

SEQ ID NO: 117065 - DNA, 103 bp, Artificial Sequence
  Synthetic Polynucleotide
taatacgactcactatagggcatgggtggcactcccgatctggatcagcaaacagaggagatgctgaatgagatcgggaaacctggcggcagcgcaaaagatg

SEQ ID NO: 117066 - DNA, 103 bp, Artificial Sequence
  Synthetic Polynucleotide
taatacgactcactataggggtttggatggcatgggtggcactcccgatcaacagaggagagatcggatgtgccacccaaacctggcggcagcgcaaaagatg

SEQ ID NO: 117067 - DNA, 103 bp, Artificial Sequence
  Synthetic Polynucleotide
taatacgactcactatagggcttgggtgcagtttggatggcatgggtggcaacagaggagagccaccatggccatccaaaacctggcggcagcgcaaaagatg

SEQ ID NO: 117068 - DNA, 103 bp, Artificial Sequence
  Synthetic Polynucleotide
taatacgactcactatagggccgttacacccttgggtgcagtttggatggaacagaggagaccatccatgctgcacccaaacctggcggcagcgcaaaagatg

SEQ ID NO: 117069 - DNA, 103 bp, Artificial Sequence
  Synthetic Polynucleotide
taatacgactcactatagggactagtgggaccgttacacccttgggtgcaaacagaggagatgcaccatggggtgtaacaacctggcggcagcgcaaaagatg

SEQ ID NO: 117070 - DNA, 103 bp, Artificial Sequence
  Synthetic Polynucleotide
taatacgactcactatagggtgcagtcatgactagtgggaccgttacaccaacagaggagaggtgtaatggtcccactaaacctggcggcagcgcaaaagatg

SEQ ID NO: 117071 - DNA, 103 bp, Artificial Sequence
  Synthetic Polynucleotide
taatacgactcactataggggggtagtaaatgcagtcatgactagtgggaaacagaggagatcccacatgtcatgactgaacctggcggcagcgcaaaagatg

SEQ ID NO: 117072 - DNA, 103 bp, Artificial Sequence
  Synthetic Polynucleotide
taatacgactcactataggggtgctcaatgctggttatctccaggttgccaacagaggagaggcaacatggagataaccaacctggcggcagcgcaaaagatg

SEQ ID NO: 117073 - DNA, 103 bp, Artificial Sequence
  Synthetic Polynucleotide
taatacgactcactataggggcccgtccatgggtagtaaatgcagtcatgaacagaggagacatgacatgatttactacaacctggcggcagcgcaaaagatg

SEQ ID NO: 117074 - DNA, 103 bp, Artificial Sequence
  Synthetic Polynucleotide
taatacgactcactatagggaagtggaatggcccgtccatgggtagtaaaaacagaggagatttactatgcatggacggaacctggcggcagcgcaaaagatg

SEQ ID NO: 117075 - DNA, 103 bp, Artificial Sequence
  Synthetic Polynucleotide
taatacgactcactatagggtgttgtggtaaagtggaatggcccgtccataacagaggagaatggacatgccattccacaacctggcggcagcgcaaaagatg

SEQ ID NO: 117076 - DNA, 103 bp, Artificial Sequence
  Synthetic Polynucleotide
taatacgactcactatagggagttctagcatgttgtggtaaagtggaatgaacagaggagacattccatgttaccacaaaacctggcggcagcgcaaaagatg

SEQ ID NO: 117077 - DNA, 103 bp, Artificial Sequence
  Synthetic Polynucleotide
taatacgactcactatagggcaatcaggggagttctagcatgttgtggtaaacagaggagataccacatgatgctagaaaacctggcggcagcgcaaaagatg

SEQ ID NO: 117078 - DNA, 103 bp, Artificial Sequence
  Synthetic Polynucleotide
taatacgactcactatagggactccagctgcaatcaggggagttctagcaaacagaggagatgctagatgtcccctgataacctggcggcagcgcaaaagatg

SEQ ID NO: 117079 - DNA, 103 bp, Artificial Sequence
  Synthetic Polynucleotide
taatacgactcactatagggcccaccaattactccagctgcaatcaggggaacagaggagacccctgatggcagctggaaacctggcggcagcgcaaaagatg

SEQ ID NO: 117080 - DNA, 103 bp, Artificial Sequence
  Synthetic Polynucleotide
taatacgactcactataggggaatgaagagcccaccaattactccagctgaacagaggagacagctgatgtaattggtgaacctggcggcagcgcaaaagatg

SEQ ID NO: 117081 - DNA, 103 bp, Artificial Sequence
  Synthetic Polynucleotide
taatacgactcactatagggacaatgaccagaatgaagagcccaccaattaacagaggagaaattggatggctcttcataacctggcggcagcgcaaaagatg

SEQ ID NO: 117082 - DNA, 103 bp, Artificial Sequence
  Synthetic Polynucleotide
taatacgactcactatagggtgtcagacccacaatgaccagaatgaagagaacagaggagactcttcatgctggtcattaacctggcggcagcgcaaaagatg

SEQ ID NO: 117083 - DNA, 103 bp, Artificial Sequence
  Synthetic Polynucleotide
taatacgactcactataggggaaggctcacccagacccaaagtcctgtcgaacagaggagacgacagatgtttgggtctaacctggcggcagcgcaaaagatg

SEQ ID NO: 117084 - DNA, 103 bp, Artificial Sequence
  Synthetic Polynucleotide
taatacgactcactatagggggtcccggttgtgctcaatgctggttatctaacagaggagaagataaatggcattgagcaacctggcggcagcgcaaaagatg

SEQ ID NO: 117085 - DNA, 103 bp, Artificial Sequence
  Synthetic Polynucleotide
taatacgactcactatagggaaacagcaaatgtcagacccacaatgaccaaacagaggagatggtcaatgtgggtctgaaacctggcggcagcgcaaaagatg

SEQ ID NO: 117086 - DNA, 103 bp, Artificial Sequence
  Synthetic Polynucleotide
taatacgactcactatagggcttctaacataaacagcaaatgtcagacccaacagaggagagggtctatgatttgctgtaacctggcggcagcgcaaaagatg

SEQ ID NO: 117087 - DNA, 103 bp, Artificial Sequence
  Synthetic Polynucleotide
taatacgactcactataggggatgctcttccttctaacataaacagcaaaaacagaggagatttgctatgtatgttagaaacctggcggcagcgcaaaagatg

SEQ ID NO: 117088 - DNA, 103 bp, Artificial Sequence
  Synthetic Polynucleotide
taatacgactcactatagggttttctttttgatgctcttccttctaacataacagaggagaatgttaatgggaagagcaaacctggcggcagcgcaaaagatg

SEQ ID NO: 117089 - DNA, 103 bp, Artificial Sequence
  Synthetic Polynucleotide
taatacgactcactatagggctcaaggctcttttctttttgatgctcttcaacagaggagagaagagatgcaaaaagaaaacctggcggcagcgcaaaagatg

SEQ ID NO: 117090 - DNA, 103 bp, Artificial Sequence
  Synthetic Polynucleotide
taatacgactcactatagggcaagaatcttctcaaggctcttttctttttaacagaggagaaaaaagatgagagccttgaacctggcggcagcgcaaaagatg

SEQ ID NO: 117091 - DNA, 103 bp, Artificial Sequence
  Synthetic Polynucleotide
taatacgactcactatagggactctgtttccaagaatcttctcaaggctcaacagaggagagagcctatggaagattctaacctggcggcagcgcaaaagatg

SEQ ID NO: 117092 - DNA, 103 bp, Artificial Sequence
  Synthetic Polynucleotide
taatacgactcactatagggggttccaccaactctgtttccaagaatcttaacagaggagaaagattatgggaaacagaaacctggcggcagcgcaaaagatg

SEQ ID NO: 117093 - DNA, 103 bp, Artificial Sequence
  Synthetic Polynucleotide
taatacgactcactataggggggagttaatggttccaccaactctgtttcaacagaggagagaaacaatgttggtggaaaacctggcggcagcgcaaaagatg

SEQ ID NO: 117094 - DNA, 103 bp, Artificial Sequence
  Synthetic Polynucleotide
taatacgactcactatagggctgtgccactgggagttaatggttccaccaaacagaggagatggtggatgcattaactcaacctggcggcagcgcaaaagatg

SEQ ID NO: 117095 - DNA, 103 bp, Artificial Sequence
  Synthetic Polynucleotide
taatacgactcactatagggaggaaggagaggtcccggttgtgctcaatgaacagaggagacattgaatgcaaccgggaaacctggcggcagcgcaaaagatg

SEQ ID NO: 117096 - DNA, 103 bp, Artificial Sequence
  Synthetic Polynucleotide
taatacgactcactatagggtgattgggtgctgtgccactgggagttaataacagaggagaattaacatgcagtggcacaacctggcggcagcgcaaaagatg

SEQ ID NO: 117097 - DNA, 103 bp, Artificial Sequence
  Synthetic Polynucleotide
taatacgactcactatagggaagttgagcttgattgggtgctgtgccactaacagaggagaagtggcatggcacccaataacctggcggcagcgcaaaagatg

SEQ ID NO: 117098 - DNA, 103 bp, Artificial Sequence
  Synthetic Polynucleotide
taatacgactcactatagggtcaaaatacgaagttgagcttgattgggtgaacagaggagacacccaatgaagctcaacaacctggcggcagcgcaaaagatg

SEQ ID NO: 117099 - DNA, 103 bp, Artificial Sequence
  Synthetic Polynucleotide
taatacgactcactatagggtcagtttctttcaaaatacgaagttgagctaacagaggagaagctcaatgtcgtattttaacctggcggcagcgcaaaagatg

SEQ ID NO: 117100 - DNA, 103 bp, Artificial Sequence
  Synthetic Polynucleotide
taatacgactcactatagggcctcttcagctcagtttctttcaaaatacgaacagaggagacgtattatgaaagaaactaacctggcggcagcgcaaaagatg

SEQ ID NO: 117101 - DNA, 103 bp, Artificial Sequence
  Synthetic Polynucleotide
taatacgactcactatagggggacttttaccctcttcagctcagtttcttaacagaggagaaagaaaatgagctgaagaaacctggcggcagcgcaaaagatg

SEQ ID NO: 117102 - DNA, 103 bp, Artificial Sequence
  Synthetic Polynucleotide
taatacgactcactatagggcctgagccaaggacttttaccctcttcagcaacagaggagagctgaaatgggtaaaagtaacctggcggcagcgcaaaagatg

SEQ ID NO: 117103 - DNA, 103 bp, Artificial Sequence
  Synthetic Polynucleotide
taatacgactcactatagggtccaaaagcacctgagccaaggacttttacaacagaggagagtaaaaatgcttggctcaaacctggcggcagcgcaaaagatg

SEQ ID NO: 117104 - DNA, 103 bp, Artificial Sequence
  Synthetic Polynucleotide
taatacgactcactatagggtataaaccgttccaaaagcacctgagccaaaacagaggagattggctatggtgcttttgaacctggcggcagcgcaaaagatg

SEQ ID NO: 117105 - DNA, 103 bp, Artificial Sequence
  Synthetic Polynucleotide
taatacgactcactatagggcaaatacctttataaaccgttccaaaagcaaacagaggagatgctttatgaacggtttaaacctggcggcagcgcaaaagatg

SEQ ID NO: 117106 - DNA, 103 bp, Artificial Sequence
  Synthetic Polynucleotide
taatacgactcactatagggaacagaccgcaggaaggagaggtcccggttaacagaggagaaaccggatgctctccttcaacctggcggcagcgcaaaagatg

SEQ ID NO: 117107 - DNA, 103 bp, Artificial Sequence
  Synthetic Polynucleotide
taatacgactcactatagggttcaggtacccaaatacctttataaaccgtaacagaggagaacggttatgaaaggtattaacctggcggcagcgcaaaagatg

SEQ ID NO: 117108 - DNA, 103 bp, Artificial Sequence
  Synthetic Polynucleotide
taatacgactcactatagggcagtttctccttcaggtacccaaataccttaacagaggagaaaggtaatggggtacctgaacctggcggcagcgcaaaagatg

SEQ ID NO: 117109 - DNA, 103 bp, Artificial Sequence
  Synthetic Polynucleotide
taatacgactcactatagggggaatcttcacagtttctccttcaggtaccaacagaggagaggtaccatgaggagaaacaacctggcggcagcgcaaaagatg

SEQ ID NO: 117110 - DNA, 103 bp, Artificial Sequence
  Synthetic Polynucleotide
taatacgactcactatagggaatagccacaggaatcttcacagtttctccaacagaggagaggagaaatggtgaagattaacctggcggcagcgcaaaagatg

SEQ ID NO: 117111 - DNA, 103 bp, Artificial Sequence
  Synthetic Polynucleotide
taatacgactcactatagggtaagaatcttaatagccacaggaatcttcaaacagaggagatgaagaatgctgtggctaaacctggcggcagcgcaaaagatg

SEQ ID NO: 117112 - DNA, 103 bp, Artificial Sequence
  Synthetic Polynucleotide
taatacgactcactataggggttgtctcattaagaatcttaatagccacaaacagaggagatgtggcatgtaagattctaacctggcggcagcgcaaaagatg

SEQ ID NO: 117113 - DNA, 103 bp, Artificial Sequence
  Synthetic Polynucleotide
taatacgactcactatagggcttgggaccagttgtctcattaagaatcttaacagaggagaaagattatgaatgagacaaacctggcggcagcgcaaaagatg

SEQ ID NO: 117114 - DNA, 103 bp, Artificial Sequence
  Synthetic Polynucleotide
taatacgactcactatagggccacatttgccttgggaccagttgtctcataacagaggagaatgagaatgctggtcccaaacctggcggcagcgcaaaagatg

SEQ ID NO: 117115 - DNA, 103 bp, Artificial Sequence
  Synthetic Polynucleotide
taatacgactcactatagggtccatgaactccacatttgccttgggaccaaacagaggagatggtccatgggcaaatgtaacctggcggcagcgcaaaagatg

SEQ ID NO: 117116 - DNA, 103 bp, Artificial Sequence
  Synthetic Polynucleotide
taatacgactcactatagggcagagcttcatccatgaactccacatttgcaacagaggagagcaaatatggagttcatgaacctggcggcagcgcaaaagatg

SEQ ID NO: 117117 - DNA, 103 bp, Artificial Sequence
  Synthetic Polynucleotide
taatacgactcactatagggtgacttctcgaacagaccgcaggaaggagaaacagaggagatctcctatgtgcggtctgaacctggcggcagcgcaaaagatg

SEQ ID NO: 117118 - DNA, 103 bp, Artificial Sequence
  Synthetic Polynucleotide
taatacgactcactatagggttgccatgatcagagcttcatccatgaactaacagaggagaagttcaatgatgaagctcaacctggcggcagcgcaaaagatg

SEQ ID NO: 117119 - DNA, 103 bp, Artificial Sequence
  Synthetic Polynucleotide
taatacgactcactatagggtgatccatacttgccatgatcagagcttcaaacagaggagatgaagcatggatcatggcaacctggcggcagcgcaaaagatg

SEQ ID NO: 117120 - DNA, 103 bp, Artificial Sequence
  Synthetic Polynucleotide
taatacgactcactatagggtaggtgtggatgatccatacttgccatgataacagaggagaatcatgatgagtatggataacctggcggcagcgcaaaagatg

SEQ ID NO: 117121 - DNA, 103 bp, Artificial Sequence
  Synthetic Polynucleotide
taatacgactcactataggggcaaccggactaggtgtggatgatccatacaacagaggagagtatggatgatccacaccaacctggcggcagcgcaaaagatg

SEQ ID NO: 117122 - DNA, 103 bp, Artificial Sequence
  Synthetic Polynucleotide
taatacgactcactatagggcacacacccagcaaccggactaggtgtggaaacagaggagatccacaatgagtccggttaacctggcggcagcgcaaaagatg

SEQ ID NO: 117123 - DNA, 103 bp, Artificial Sequence
  Synthetic Polynucleotide
taatacgactcactatagggtgggctcagacacacacccagcaaccggacaacagaggagagtccggatgctgggtgtgaacctggcggcagcgcaaaagatg

SEQ ID NO: 117124 - DNA, 103 bp, Artificial Sequence
  Synthetic Polynucleotide
taatacgactcactataggggctggatggttgggctcagacacacacccaaacagaggagatgggtgatggtctgagccaacctggcggcagcgcaaaagatg

SEQ ID NO: 117125 - DNA, 103 bp, Artificial Sequence
  Synthetic Polynucleotide
taatacgactcactatagggtgagtaaccagctggatggttgggctcagaaacagaggagatctgagatgaaccatccaaacctggcggcagcgcaaaagatg

SEQ ID NO: 117126 - DNA, 103 bp, Artificial Sequence
  Synthetic Polynucleotide
taatacgactcactataggggggcataagttgagtaaccagctggatggtaacagaggagaaccatcatgctggttactaacctggcggcagcgcaaaagatg

SEQ ID NO: 117127 - DNA, 103 bp, Artificial Sequence
  Synthetic Polynucleotide
taatacgactcactatagggggcagccatggggcataagttgagtaaccaaacagaggagatggttaatgaacttatgcaacctggcggcagcgcaaaagatg

SEQ ID NO: 117128 - DNA, 103 bp, Artificial Sequence
  Synthetic Polynucleotide
taatacgactcactatagggacgtagcctgtgacttctcgaacagaccgcaacagaggagagcggtcatgtcgagaagtaacctggcggcagcgcaaaagatg

SEQ ID NO: 117129 - DNA, 103 bp, Artificial Sequence
  Synthetic Polynucleotide
taatacgactcactatagggtactccaacaggcagccatggggcataagtaacagaggagaacttatatgccatggctgaacctggcggcagcgcaaaagatg

SEQ ID NO: 117130 - DNA, 103 bp, Artificial Sequence
  Synthetic Polynucleotide
taatacgactcactatagggctcgtggacatactccaacaggcagccatgaacagaggagacatggcatgctgttggagaacctggcggcagcgcaaaagatg

SEQ ID NO: 117131 - DNA, 103 bp, Artificial Sequence
  Synthetic Polynucleotide
taatacgactcactatagggtatccttgtgctcgtggacatactccaacaaacagaggagatgttggatgatgtccacgaacctggcggcagcgcaaaagatg

SEQ ID NO: 117132 - DNA, 103 bp, Artificial Sequence
  Synthetic Polynucleotide
taatacgactcactataggggatccaatgttatccttgtgctcgtggacaaacagaggagatgtccaatggcacaaggaaacctggcggcagcgcaaaagatg

SEQ ID NO: 117133 - DNA, 103 bp, Artificial Sequence
  Synthetic Polynucleotide
taatacgactcactatagggcagcagttgtgatccaatgttatccttgtgaacagaggagacacaagatgaacattggaaacctggcggcagcgcaaaagatg

SEQ ID NO: 117134 - DNA, 103 bp, Artificial Sequence
  Synthetic Polynucleotide
taatacgactcactatagggaccagttaagcagcagttgtgatccaatgtaacagaggagaacattgatgcacaactgcaacctggcggcagcgcaaaagatg

SEQ ID NO: 117135 - DNA, 103 bp, Artificial Sequence
  Synthetic Polynucleotide
taatacgactcactatagggatctggacacaccagttaagcagcagttgtaacagaggagaacaactatggcttaactgaacctggcggcagcgcaaaagatg

SEQ ID NO: 117136 - DNA, 103 bp, Artificial Sequence
  Synthetic Polynucleotide
taatacgactcactatagggtcccttagctatctggacacaccagttaagaacagaggagacttaacatgtgtgtccagaacctggcggcagcgcaaaagatg

SEQ ID NO: 117137 - DNA, 103 bp, Artificial Sequence
  Synthetic Polynucleotide
taatacgactcactatagggggtacatcattcccttagctatctggacacaacagaggagagtgtccatgtagctaaggaacctggcggcagcgcaaaagatg

SEQ ID NO: 117138 - DNA, 103 bp, Artificial Sequence
  Synthetic Polynucleotide
taatacgactcactatagggctttcttccaggtacatcattcccttagctaacagaggagaagctaaatgaatgatgtaaacctggcggcagcgcaaaagatg

SEQ ID NO: 117139 - DNA, 103 bp, Artificial Sequence
  Synthetic Polynucleotide
taatacgactcactatagggagccactaacacgtagcctgtgacttctcgaacagaggagacgagaaatgacaggctacaacctggcggcagcgcaaaagatg

SEQ ID NO: 117140 - DNA, 103 bp, Artificial Sequence
  Synthetic Polynucleotide
taatacgactcactatagggaacgagtcgtctttcttccaggtacatcataacagaggagaatgatgatgctggaagaaaacctggcggcagcgcaaaagatg

SEQ ID NO: 117141 - DNA, 103 bp, Artificial Sequence
  Synthetic Polynucleotide
taatacgactcactatagggaatcccgatgaacgagtcgtctttcttccaaacagaggagatggaagatggacgactcgaacctggcggcagcgcaaaagatg

SEQ ID NO: 117142 - DNA, 103 bp, Artificial Sequence
  Synthetic Polynucleotide
taatacgactcactatagggcgggctgccaaatcccgatgaacgagtcgtaacagaggagaacgactatgtcatcgggaaacctggcggcagcgcaaaagatg

SEQ ID NO: 117143 - DNA, 103 bp, Artificial Sequence
  Synthetic Polynucleotide
taatacgactcactatagggtaagacattacgggctgccaaatcccgatgaacagaggagacatcggatgttggcagccaacctggcggcagcgcaaaagatg

SEQ ID NO: 117144 - DNA, 103 bp, Artificial Sequence
  Synthetic Polynucleotide
taatacgactcactataggggagatttcactaagacattacgggctgccaaacagaggagatggcagatggtaatgtctaacctggcggcagcgcaaaagatg

SEQ ID NO: 117145 - DNA, 103 bp, Artificial Sequence
  Synthetic Polynucleotide
taatacgactcactatagggacatggtttggagatttcactaagacattaaacagaggagataatgtatgagtgaaatcaacctggcggcagcgcaaaagatg

SEQ ID NO: 117146 - DNA, 103 bp, Artificial Sequence
  Synthetic Polynucleotide
taatacgactcactatagggtgtgattttcacatggtttggagatttcacaacagaggagagtgaaaatgccaaaccataacctggcggcagcgcaaaagatg

SEQ ID NO: 117147 - DNA, 103 bp, Artificial Sequence
  Synthetic Polynucleotide
taatacgactcactataggggcccaaaatctgtgattttcacatggtttgaacagaggagacaaaccatgtgaaaatcaaacctggcggcagcgcaaaagatg

SEQ ID NO: 117148 - DNA, 103 bp, Artificial Sequence
  Synthetic Polynucleotide
taatacgactcactatagggagtctggctagcccaaaatctgtgattttcaacagaggagagaaaatatgagattttggaacctggcggcagcgcaaaagatg

SEQ ID NO: 117149 - DNA, 103 bp, Artificial Sequence
  Synthetic Polynucleotide
taatacgactcactatagggtccttccaagagtctggctagcccaaaatcaacagaggagagattttatgctagccagaaacctggcggcagcgcaaaagatg

SEQ ID NO: 117150 - DNA, 103 bp, Artificial Sequence
  Synthetic Polynucleotide
taatacgactcactatagggactgattaagagccactaacacgtagcctgaacagaggagacaggctatgtgttagtggaacctggcggcagcgcaaaagatg

SEQ ID NO: 117151 - DNA, 103 bp, Artificial Sequence
  Synthetic Polynucleotide
taatacgactcactatagggctttttcatctccttccaagagtctggctaaacagaggagatagccaatgtcttggaagaacctggcggcagcgcaaaagatg

SEQ ID NO: 117152 - DNA, 103 bp, Artificial Sequence
  Synthetic Polynucleotide
taatacgactcactataggggcattgtactctttttcatctccttccaagaacagaggagacttggaatgagatgaaaaaacctggcggcagcgcaaaagatg

SEQ ID NO: 117153 - DNA, 103 bp, Artificial Sequence
  Synthetic Polynucleotide
taatacgactcactatagggtcctccatcagcattgtactctttttcatcaacagaggagagatgaaatggagtacaataacctggcggcagcgcaaaagatg

SEQ ID NO: 117154 - DNA, 103 bp, Artificial Sequence
  Synthetic Polynucleotide
taatacgactcactatagggttggcatctttcctccatcagcattgtactaacagaggagaagtacaatgctgatggagaacctggcggcagcgcaaaagatg

SEQ ID NO: 117155 - DNA, 103 bp, Artificial Sequence
  Synthetic Polynucleotide
taatacgactcactatagggatccatttaattggcatctttcctccatcaaacagaggagatgatggatgaaagatgccaacctggcggcagcgcaaaagatg

SEQ ID NO: 117156 - DNA, 103 bp, Artificial Sequence
  Synthetic Polynucleotide
taatacgactcactatagggctccagagccatccatttaattggcatcttaacagaggagaaagatgatgattaaatggaacctggcggcagcgcaaaagatg

SEQ ID NO: 117157 - DNA, 103 bp, Artificial Sequence
  Synthetic Polynucleotide
taatacgactcactatagggaatgtatacactccagagccatccatttaaaacagaggagattaaatatgtggctctggaacctggcggcagcgcaaaagatg

SEQ ID NO: 117158 - DNA, 103 bp, Artificial Sequence
  Synthetic Polynucleotide
taatacgactcactatagggaatttcctgtaatgtatacactccagagccaacagaggagaggctctatggtgtatacaaacctggcggcagcgcaaaagatg

SEQ ID NO: 117159 - DNA, 103 bp, Artificial Sequence
  Synthetic Polynucleotide
taatacgactcactatagggctgatgggtgaatttcctgtaatgtatacaaacagaggagatgtataatgtacaggaaaaacctggcggcagcgcaaaagatg

SEQ ID NO: 117160 - DNA, 103 bp, Artificial Sequence
  Synthetic Polynucleotide
taatacgactcactatagggaaacgtcactctgatgggtgaatttcctgtaacagaggagaacaggaatgtcacccatcaacctggcggcagcgcaaaagatg

SEQ ID NO: 117161 - DNA, 103 bp, Artificial Sequence
  Synthetic Polynucleotide
taatacgactcactatagggaggtaacgaaactgattaagagccactaacaacagaggagagttagtatgtcttaatcaaacctggcggcagcgcaaaagatg

SEQ ID NO: 117162 - DNA, 103 bp, Artificial Sequence
  Synthetic Polynucleotide
taatacgactcactatagggccatagctccaaacgtcactctgatgggtgaacagaggagacacccaatggagtgacgtaacctggcggcagcgcaaaagatg

SEQ ID NO: 117163 - DNA, 103 bp, Artificial Sequence
  Synthetic Polynucleotide
taatacgactcactatagggtatagtaactccatagctccaaacgtcactaacagaggagaagtgacatgtggagctataacctggcggcagcgcaaaagatg

SEQ ID NO: 117164 - DNA, 103 bp, Artificial Sequence
  Synthetic Polynucleotide
taatacgactcactatagggtcagttcccatatagtaactccatagctccaacagaggagaggagctatggagttactaaacctggcggcagcgcaaaagatg

SEQ ID NO: 117165 - DNA, 103 bp, Artificial Sequence
  Synthetic Polynucleotide
taatacgactcactatagggccaaaggtcatcagttcccatatagtaactaacagaggagaagttacatgatgggaactaacctggcggcagcgcaaaagatg

SEQ ID NO: 117166 - DNA, 103 bp, Artificial Sequence
  Synthetic Polynucleotide
taatacgactcactataggggggttttcctccaaaggtcatcagttcccaaacagaggagatgggaaatgatgacctttaacctggcggcagcgcaaaagatg

SEQ ID NO: 117167 - DNA, 103 bp, Artificial Sequence
  Synthetic Polynucleotide
taatacgactcactatagggttccatcatagggttttcctccaaaggtcaaacagaggagatgacctatggaggaaaacaacctggcggcagcgcaaaagatg

SEQ ID NO: 117168 - DNA, 103 bp, Artificial Sequence
  Synthetic Polynucleotide
taatacgactcactatagggcgcgttggaattccatcatagggttttcctaacagaggagaaggaaaatgctatgatggaacctggcggcagcgcaaaagatg

SEQ ID NO: 117169 - DNA, 103 bp, Artificial Sequence
  Synthetic Polynucleotide
taatacgactcactatagggagggatttctcgcgttggaattccatcataaacagaggagatatgatatgattccaacgaacctggcggcagcgcaaaagatg

SEQ ID NO: 117170 - DNA, 103 bp, Artificial Sequence
  Synthetic Polynucleotide
taatacgactcactatagggctaataaatcagggatttctcgcgttggaaaacagaggagattccaaatggagaaatccaacctggcggcagcgcaaaagatg

SEQ ID NO: 117171 - DNA, 103 bp, Artificial Sequence
  Synthetic Polynucleotide
taatacgactcactatagggtctcctttctctaataaatcagggatttctaacagaggagaagaaatatgtgatttattaacctggcggcagcgcaaaagatg

SEQ ID NO: 117172 - DNA, 103 bp, Artificial Sequence
  Synthetic Polynucleotide
taatacgactcactatagggctccagaggcaggtaacgaaactgattaagaacagaggagacttaatatgtttcgttacaacctggcggcagcgcaaaagatg

SEQ ID NO: 117173 - DNA, 103 bp, Artificial Sequence
  Synthetic Polynucleotide
taatacgactcactatagggaggcaaacgttctcctttctctaataaatcaacagaggagagatttaatggagaaaggaaacctggcggcagcgcaaaagatg

SEQ ID NO: 117174 - DNA, 103 bp, Artificial Sequence
  Synthetic Polynucleotide
taatacgactcactatagggtgggaggctgaggcaaacgttctcctttctaacagaggagaagaaagatgaacgtttgcaacctggcggcagcgcaaaagatg

SEQ ID NO: 117175 - DNA, 103 bp, Artificial Sequence
  Synthetic Polynucleotide
taatacgactcactatagggatagtgcagatgggaggctgaggcaaacgtaacagaggagaacgtttatgtcagcctccaacctggcggcagcgcaaaagatg

SEQ ID NO: 117176 - DNA, 103 bp, Artificial Sequence
  Synthetic Polynucleotide
taatacgactcactataggggtaaacgtcaatagtgcagatgggaggctgaacagaggagacagcctatgatctgcactaacctggcggcagcgcaaaagatg

SEQ ID NO: 117177 - DNA, 103 bp, Artificial Sequence
  Synthetic Polynucleotide
taatacgactcactatagggccatgaccatgtaaacgtcaatagtgcagaaacagaggagatctgcaatgttgacgtttaacctggcggcagcgcaaaagatg

SEQ ID NO: 117178 - DNA, 103 bp, Artificial Sequence
  Synthetic Polynucleotide
taatacgactcactatagggcaacatttgaccatgaccatgtaaacgtcaaacagaggagatgacgtatgcatggtcataacctggcggcagcgcaaaagatg

SEQ ID NO: 117179 - DNA, 103 bp, Artificial Sequence
  Synthetic Polynucleotide
taatacgactcactatagggatcaatcatccaacatttgaccatgaccataacagaggagaatggtcatggtcaaatgtaacctggcggcagcgcaaaagatg

SEQ ID NO: 117180 - DNA, 103 bp, Artificial Sequence
  Synthetic Polynucleotide
taatacgactcactatagggtactgtcagcatcaatcatccaacatttgaaacagaggagatcaaatatgggatgattgaacctggcggcagcgcaaaagatg

SEQ ID NO: 117181 - DNA, 103 bp, Artificial Sequence
  Synthetic Polynucleotide
taatacgactcactatagggaatttaggtctactgtcagcatcaatcatcaacagaggagagatgatatgtgctgacagaacctggcggcagcgcaaaagatg

SEQ ID NO: 117182 - DNA, 103 bp, Artificial Sequence
  Synthetic Polynucleotide
taatacgactcactatagggcagttccttaaatttaggtctactgtcagcaacagaggagagctgacatgagacctaaaaacctggcggcagcgcaaaagatg

SEQ ID NO: 117183 - DNA, 103 bp, Artificial Sequence
  Synthetic Polynucleotide
taatacgactcactatagggtgcgtaaattctccagaggcaggtaacgaaaacagaggagattcgttatgtgcctctggaacctggcggcagcgcaaaagatg

SEQ ID NO: 117184 - DNA, 103 bp, Artificial Sequence
  Synthetic Polynucleotide
taatacgactcactatagggactcagcagccagttccttaaatttaggtcaacagaggagagacctaatgttaaggaacaacctggcggcagcgcaaaagatg

SEQ ID NO: 117185 - DNA, 103 bp, Artificial Sequence
  Synthetic Polynucleotide
taatacgactcactatagggatccttgaaaactcagcagccagttccttaaacagaggagataaggaatgggctgctgaaacctggcggcagcgcaaaagatg

SEQ ID NO: 117186 - DNA, 103 bp, Artificial Sequence
  Synthetic Polynucleotide
taatacgactcactataggggtctcgagccatccttgaaaactcagcagcaacagaggagagctgctatgttttcaaggaacctggcggcagcgcaaaagatg

SEQ ID NO: 117187 - DNA, 103 bp, Artificial Sequence
  Synthetic Polynucleotide
taatacgactcactatagggatctttgagggtctcgagccatccttgaaaaacagaggagatttcaaatgtggctcgagaacctggcggcagcgcaaaagatg

SEQ ID NO: 117188 - DNA, 103 bp, Artificial Sequence
  Synthetic Polynucleotide
taatacgactcactatagggataactaggtatctttgagggtctcgagccaacagaggagaggctcgatgccctcaaagaacctggcggcagcgcaaaagatg

SEQ ID NO: 117189 - DNA, 103 bp, Artificial Sequence
  Synthetic Polynucleotide
taatacgactcactatagggatcaccctgaataactaggtatctttgaggaacagaggagacctcaaatgtacctagttaacctggcggcagcgcaaaagatg

SEQ ID NO: 117190 - DNA, 103 bp, Artificial Sequence
  Synthetic Polynucleotide
taatacgactcactatagggtcatacgatcatcaccctgaataactaggtaacagaggagaacctagatgttcagggtgaacctggcggcagcgcaaaagatg

SEQ ID NO: 117191 - DNA, 103 bp, Artificial Sequence
  Synthetic Polynucleotide
taatacgactcactatagggctgggaagcttcatacgatcatcaccctgaaacagaggagatcagggatgtgatcgtataacctggcggcagcgcaaaagatg

SEQ ID NO: 117192 - DNA, 103 bp, Artificial Sequence
  Synthetic Polynucleotide
taatacgactcactataggggtcatttggactgggaagcttcatacgatcaacagaggagagatcgtatgaagcttcccaacctggcggcagcgcaaaagatg

SEQ ID NO: 117193 - DNA, 103 bp, Artificial Sequence
  Synthetic Polynucleotide
taatacgactcactatagggagaacttgctgtcatttggactgggaagctaacagaggagaagcttcatggtccaaatgaacctggcggcagcgcaaaagatg

SEQ ID NO: 117194 - DNA, 103 bp, Artificial Sequence
  Synthetic Polynucleotide
taatacgactcactataggggccgccacgagaaggctcacccagacccaaaacagaggagattgggtatgggtgagcctaacctggcggcagcgcaaaagatg

SEQ ID NO: 117195 - DNA, 103 bp, Artificial Sequence
  Synthetic Polynucleotide
taatacgactcactatagggccacgaataatgcgtaaattctccagaggcaacagaggagagcctctatggaatttacgaacctggcggcagcgcaaaagatg

SEQ ID NO: 117196 - DNA, 103 bp, Artificial Sequence
  Synthetic Polynucleotide
taatacgactcactatagggagattctgaaagaacttgctgtcatttggaaacagaggagatccaaaatgcagcaagttaacctggcggcagcgcaaaagatg

SEQ ID NO: 117197 - DNA, 103 bp, Artificial Sequence
  Synthetic Polynucleotide
taatacgactcactatagggttcatccaagagattctgaaagaacttgctaacagaggagaagcaagatgtttcagaataacctggcggcagcgcaaaagatg

SEQ ID NO: 117198 - DNA, 103 bp, Artificial Sequence
  Synthetic Polynucleotide
taatacgactcactatagggccaaatcctcttcatccaagagattctgaaaacagaggagattcagaatgtcttggatgaacctggcggcagcgcaaaagatg

SEQ ID NO: 117199 - DNA, 103 bp, Artificial Sequence
  Synthetic Polynucleotide
taatacgactcactatagggatcatatcttccaaatcctcttcatccaagaacagaggagacttggaatgagaggatttaacctggcggcagcgcaaaagatg

SEQ ID NO: 117200 - DNA, 103 bp, Artificial Sequence
  Synthetic Polynucleotide
taatacgactcactatagggctcagcatccatcatatcttccaaatcctcaacagaggagagaggatatggaagatatgaacctggcggcagcgcaaaagatg

SEQ ID NO: 117201 - DNA, 103 bp, Artificial Sequence
  Synthetic Polynucleotide
taatacgactcactatagggccaagtactcctcagcatccatcatatcttaacagaggagaaagataatgtggatgctgaacctggcggcagcgcaaaagatg

SEQ ID NO: 117202 - DNA, 103 bp, Artificial Sequence
  Synthetic Polynucleotide
taatacgactcactataggggcctgagggaccaagtactcctcagcatccaacagaggagaggatgcatgggagtacttaacctggcggcagcgcaaaagatg

SEQ ID NO: 117203 - DNA, 103 bp, Artificial Sequence
  Synthetic Polynucleotide
taatacgactcactataggggatgttgaaagcctgagggaccaagtactcaacagaggagagagtacatggtccctcagaacctggcggcagcgcaaaagatg

SEQ ID NO: 117204 - DNA, 103 bp, Artificial Sequence
  Synthetic Polynucleotide
taatacgactcactatagggtgggaggtgggatgttgaaagcctgagggaaacagaggagatccctcatgctttcaacaaacctggcggcagcgcaaaagatg

SEQ ID NO: 117205 - DNA, 103 bp, Artificial Sequence
  Synthetic Polynucleotide
taatacgactcactataggggaagtatagatgggaggtgggatgttgaaaaacagaggagatttcaaatgcccacctccaacctggcggcagcgcaaaagatg

SEQ ID NO: 117206 - DNA, 103 bp, Artificial Sequence
  Synthetic Polynucleotide
taatacgactcactatagggaagttttgtcccacgaataatgcgtaaattaacagaggagaaatttaatgattattcgtaacctggcggcagcgcaaaagatg

SEQ ID NO: 117207 - DNA, 103 bp, Artificial Sequence
  Synthetic Polynucleotide
taatacgactcactatagggtcttgctctggaagtatagatgggaggtggaacagaggagaccacctatgatctatactaacctggcggcagcgcaaaagatg

SEQ ID NO: 117208 - DNA, 103 bp, Artificial Sequence
  Synthetic Polynucleotide
taatacgactcactatagggtcgagtcaattcttgctctggaagtatagaaacagaggagatctataatgccagagcaaaacctggcggcagcgcaaaagatg

SEQ ID NO: 117209 - DNA, 103 bp, Artificial Sequence
  Synthetic Polynucleotide
taatacgactcactatagggtcactcctattcgagtcaattcttgctctgaacagaggagacagagcatgaattgactcaacctggcggcagcgcaaaagatg

SEQ ID NO: 117210 - DNA, 103 bp, Artificial Sequence
  Synthetic Polynucleotide
taatacgactcactataggggtgtccaatttcactcctattcgagtcaataacagaggagaattgacatgaataggagtaacctggcggcagcgcaaaagatg

SEQ ID NO: 117211 - DNA, 103 bp, Artificial Sequence
  Synthetic Polynucleotide
taatacgactcactataggggaggagggctgtgtccaatttcactcctataacagaggagaataggaatgaaattggacaacctggcggcagcgcaaaagatg

SEQ ID NO: 117212 - DNA, 103 bp, Artificial Sequence
  Synthetic Polynucleotide
taatacgactcactataggggtgtaggcaggaggagggctgtgtccaattaacagaggagaaattggatgcagccctccaacctggcggcagcgcaaaagatg

SEQ ID NO: 117213 - DNA, 103 bp, Artificial Sequence
  Synthetic Polynucleotide
taatacgactcactatagggtgacatgggggtgtaggcaggaggagggctaacagaggagaagccctatgcctgcctacaacctggcggcagcgcaaaagatg

SEQ ID NO: 117214 - DNA, 103 bp, Artificial Sequence
  Synthetic Polynucleotide
taatacgactcactatagggactggtttcctgacatgggggtgtaggcagaacagaggagactgcctatgcccccatgtaacctggcggcagcgcaaaagatg

SEQ ID NO: 117215 - DNA, 103 bp, Artificial Sequence
  Synthetic Polynucleotide
taatacgactcactatagggcggtatacaaactggtttcctgacatggggaacagaggagaccccatatgaggaaaccaaacctggcggcagcgcaaaagatg

SEQ ID NO: 117216 - DNA, 103 bp, Artificial Sequence
  Synthetic Polynucleotide
taatacgactcactatagggacctccatctcggtatacaaactggtttccaacagaggagaggaaacatgtttgtatacaacctggcggcagcgcaaaagatg

SEQ ID NO: 117217 - DNA, 103 bp, Artificial Sequence
  Synthetic Polynucleotide
taatacgactcactataggggatcctcataaagttttgtcccacgaataaaacagaggagattattcatgggacaaaacaacctggcggcagcgcaaaagatg

SEQ ID NO: 117218 - DNA, 103 bp, Artificial Sequence
  Synthetic Polynucleotide
taatacgactcactatagggcagcagcaaaacctccatctcggtatacaaaacagaggagattgtatatggagatggagaacctggcggcagcgcaaaagatg

SEQ ID NO: 117219 - DNA, 103 bp, Artificial Sequence
  Synthetic Polynucleotide
taatacgactcactatagggactccttgttcagcagcaaaacctccatctaacagaggagaagatggatgttttgctgcaacctggcggcagcgcaaaagatg

SEQ ID NO: 117220 - DNA, 103 bp, Artificial Sequence
  Synthetic Polynucleotide
taatacgactcactataggggggcacagacactccttgttcagcagcaaaaacagaggagatttgctatggaacaaggaaacctggcggcagcgcaaaagatg

SEQ ID NO: 117221 - DNA, 103 bp, Artificial Sequence
  Synthetic Polynucleotide
taatacgactcactataggggggctctgtagggcacagacactccttgttaacagaggagaaacaagatgtgtctgtgcaacctggcggcagcgcaaaagatg

SEQ ID NO: 117222 - DNA, 103 bp, Artificial Sequence
  Synthetic Polynucleotide
taatacgactcactataggggtgctagttggggctctgtagggcacagacaacagaggagagtctgtatgctacagagcaacctggcggcagcgcaaaagatg

SEQ ID NO: 117223 - DNA, 103 bp, Artificial Sequence
  Synthetic Polynucleotide
taatacgactcactatagggttctggaattgtgctagttggggctctgtaaacagaggagatacagaatgccaactagcaacctggcggcagcgcaaaagatg

SEQ ID NO: 117224 - DNA, 103 bp, Artificial Sequence
  Synthetic Polynucleotide
taatacgactcactatagggccacaggagcttctggaattgtgctagttgaacagaggagacaactaatgcaattccagaacctggcggcagcgcaaaagatg

SEQ ID NO: 117225 - DNA, 103 bp, Artificial Sequence
  Synthetic Polynucleotide
taatacgactcactataggggcaccctgtgccacaggagcttctggaattaacagaggagaaattccatgagctcctgtaacctggcggcagcgcaaaagatg

SEQ ID NO: 117226 - DNA, 103 bp, Artificial Sequence
  Synthetic Polynucleotide
taatacgactcactatagggctcagcagtagcaccctgtgccacaggagcaacagaggagagctcctatggcacagggtaacctggcggcagcgcaaaagatg

SEQ ID NO: 117227 - DNA, 103 bp, Artificial Sequence
  Synthetic Polynucleotide
taatacgactcactatagggcatcaaaaatctcagcagtagcaccctgtgaacagaggagacacaggatgctactgctgaacctggcggcagcgcaaaagatg

SEQ ID NO: 117228 - DNA, 103 bp, Artificial Sequence
  Synthetic Polynucleotide
taatacgactcactatagggaaggcatatcgatcctcataaagttttgtcaacagaggagagacaaaatgttatgaggaaacctggcggcagcgcaaaagatg

SEQ ID NO: 117229 - DNA, 103 bp, Artificial Sequence
  Synthetic Polynucleotide
taatacgactcactatagggcagcaggagtcatcaaaaatctcagcagtaaacagaggagatactgcatggatttttgaaacctggcggcagcgcaaaagatg

SEQ ID NO: 117230 - DNA, 103 bp, Artificial Sequence
  Synthetic Polynucleotide
taatacgactcactatagggggtgccattacagcaggagtcatcaaaaataacagaggagaatttttatggactcctgcaacctggcggcagcgcaaaagatg

SEQ ID NO: 117231 - DNA, 103 bp, Artificial Sequence
  Synthetic Polynucleotide
taatacgactcactataggggcttgcgtagggtgccattacagcaggagtaacagaggagaactcctatggtaatggcaaacctggcggcagcgcaaaagatg

SEQ ID NO: 117232 - DNA, 103 bp, Artificial Sequence
  Synthetic Polynucleotide
taatacgactcactatagggggtgccactggcttgcgtagggtgccattaaacagaggagataatggatgcctacgcaaaacctggcggcagcgcaaaagatg

SEQ ID NO: 117233 - DNA, 103 bp, Artificial Sequence
  Synthetic Polynucleotide
taatacgactcactatagggttggacatggggtgccactggcttgcgtagaacagaggagactacgcatgccagtggcaaacctggcggcagcgcaaaagatg

SEQ ID NO: 117234 - DNA, 103 bp, Artificial Sequence
  Synthetic Polynucleotide
taatacgactcactatagggtactgtcctcttggacatggggtgccactgaacagaggagacagtggatgcccatgtccaacctggcggcagcgcaaaagatg

SEQ ID NO: 117235 - DNA, 103 bp, Artificial Sequence
  Synthetic Polynucleotide
taatacgactcactatagggctctgggtgctactgtcctcttggacatggaacagaggagaccatgtatgagaggacagaacctggcggcagcgcaaaagatg

SEQ ID NO: 117236 - DNA, 103 bp, Artificial Sequence
  Synthetic Polynucleotide
taatacgactcactatagggagcactgtacctctgggtgctactgtcctcaacagaggagagaggacatgagcacccagaacctggcggcagcgcaaaagatg

SEQ ID NO: 117237 - DNA, 103 bp, Artificial Sequence
  Synthetic Polynucleotide
taatacgactcactatagggcggtggggtcagcactgtacctctgggtgcaacagaggagagcacccatgggtacagtgaacctggcggcagcgcaaaagatg

SEQ ID NO: 117238 - DNA, 103 bp, Artificial Sequence
  Synthetic Polynucleotide
taatacgactcactatagggggggcaaacacggtggggtcagcactgtacaacagaggagagtacagatgtgaccccacaacctggcggcagcgcaaaagatg

SEQ ID NO: 117239 - DNA, 103 bp, Artificial Sequence
  Synthetic Polynucleotide
taatacgactcactatagggaaatattgccaaggcatatcgatcctcataaacagaggagatatgagatgcgatatgccaacctggcggcagcgcaaaagatg

SEQ ID NO: 117240 - DNA, 103 bp, Artificial Sequence
  Synthetic Polynucleotide
taatacgactcactataggggctccgttctggggcaaacacggtggggtcaacagaggagagaccccatggtgtttgccaacctggcggcagcgcaaaagatg

SEQ ID NO: 117241 - DNA, 103 bp, Artificial Sequence
  Synthetic Polynucleotide
taatacgactcactatagggctcctcgtgggctccgttctggggcaaacaaacagaggagatgtttgatgcagaacggaaacctggcggcagcgcaaaagatg

SEQ ID NO: 117242 - DNA, 103 bp, Artificial Sequence
  Synthetic Polynucleotide
taatacgactcactatagggtcatccagctctcctcgtgggctccgttctaacagaggagaagaacgatgcccacgaggaacctggcggcagcgcaaaagatg

SEQ ID NO: 117243 - DNA, 103 bp, Artificial Sequence
  Synthetic Polynucleotide
taatacgactcactataggggtaaccttcctcatccagctctcctcgtggaacagaggagaccacgaatggagctggataacctggcggcagcgcaaaagatg

SEQ ID NO: 117244 - DNA, 103 bp, Artificial Sequence
  Synthetic Polynucleotide
taatacgactcactatagggtaggagtcatgtaaccttcctcatccagctaacagaggagaagctggatgaggaaggttaacctggcggcagcgcaaaagatg

SEQ ID NO: 117245 - DNA, 103 bp, Artificial Sequence
  Synthetic Polynucleotide
taatacgactcactatagggttgtctcgcataggagtcatgtaaccttccaacagaggagaggaaggatgcatgactccaacctggcggcagcgcaaaagatg

SEQ ID NO: 117246 - DNA, 103 bp, Artificial Sequence
  Synthetic Polynucleotide
taatacgactcactatagggttgtttgggtttgtctcgcataggagtcataacagaggagaatgactatgatgcgagacaacctggcggcagcgcaaaagatg

SEQ ID NO: 117247 - DNA, 103 bp, Artificial Sequence
  Synthetic Polynucleotide
taatacgactcactatagggtcaggtattcttgtttgggtttgtctcgcaaacagaggagatgcgagatgaacccaaacaacctggcggcagcgcaaaagatg

SEQ ID NO: 117248 - DNA, 103 bp, Artificial Sequence
  Synthetic Polynucleotide
taatacgactcactatagggtccactggattcaggtattcttgtttgggtaacagaggagaacccaaatgagaatacctaacctggcggcagcgcaaaagatg

SEQ ID NO: 117249 - DNA, 103 bp, Artificial Sequence
  Synthetic Polynucleotide
taatacgactcactatagggagggttctcctccactggattcaggtattcaacagaggagagaatacatgaatccagtgaacctggcggcagcgcaaaagatg

SEQ ID NO: 117250 - DNA, 103 bp, Artificial Sequence
  Synthetic Polynucleotide
taatacgactcactatagggtgtagtttaaaaatattgccaaggcatatcaacagaggagagatatgatgtggcaatataacctggcggcagcgcaaaagatg

SEQ ID NO: 117251 - DNA, 103 bp, Artificial Sequence
  Synthetic Polynucleotide
taatacgactcactataggggagaaacaaaagggttctcctccactggataacagaggagaatccagatgaggagaaccaacctggcggcagcgcaaaagatg

SEQ ID NO: 117252 - DNA, 103 bp, Artificial Sequence
  Synthetic Polynucleotide
taatacgactcactatagggttttttctccgagaaacaaaagggttctccaacagaggagaggagaaatgttttgtttcaacctggcggcagcgcaaaagatg

SEQ ID NO: 117253 - DNA, 103 bp, Artificial Sequence
  Synthetic Polynucleotide
taatacgactcactatagggaaggtctccattttttctccgagaaacaaaaacagaggagatttgttatgcggagaaaaaacctggcggcagcgcaaaagatg

SEQ ID NO: 117254 - DNA, 103 bp, Artificial Sequence
  Synthetic Polynucleotide
taatacgactcactatagggccaatgcttgaaggtctccattttttctccaacagaggagaggagaaatgatggagaccaacctggcggcagcgcaaaagatg

SEQ ID NO: 117255 - DNA, 103 bp, Artificial Sequence
  Synthetic Polynucleotide
taatacgactcactatagggtcgggattatccaatgcttgaaggtctccaaacagaggagatggagaatgtcaagcattaacctggcggcagcgcaaaagatg

SEQ ID NO: 117256 - DNA, 103 bp, Artificial Sequence
  Synthetic Polynucleotide
taatacgactcactatagggattgtgatattcgggattatccaatgcttgaacagaggagacaagcaatggataatcccaacctggcggcagcgcaaaagatg

SEQ ID NO: 117257 - DNA, 103 bp, Artificial Sequence
  Synthetic Polynucleotide
taatacgactcactatagggcattggatgcattgtgatattcgggattataacagaggagaataatcatgaatatcacaaacctggcggcagcgcaaaagatg

SEQ ID NO: 117258 - DNA, 103 bp, Artificial Sequence
  Synthetic Polynucleotide
taatacgactcactatagggttgggtggaccattggatgcattgtgatataacagaggagaatatcaatgtgcatccaaaacctggcggcagcgcaaaagatg

SEQ ID NO: 117259 - DNA, 103 bp, Artificial Sequence
  Synthetic Polynucleotide
taatacgactcactatagggatcctcggccttgggtggaccattggatgcaacagaggagagcatccatgggtccacccaacctggcggcagcgcaaaagatg

SEQ ID NO: 117260 - DNA, 103 bp, Artificial Sequence
  Synthetic Polynucleotide
taatacgactcactatagggtcacatactcatcctcggccttgggtggacaacagaggagagtccacatgaggccgaggaacctggcggcagcgcaaaagatg

SEQ ID NO: 117261 - DNA, 103 bp, Artificial Sequence
  Synthetic Polynucleotide
taatacgactcactatagggccatcttttctgtagtttaaaaatattgccaacagaggagaggcaatatgtttaaactaaacctggcggcagcgcaaaagatg

SEQ ID NO: 117262 - DNA, 103 bp, Artificial Sequence
  Synthetic Polynucleotide
taatacgactcactatagggagtggctcattcacatactcatcctcggccaacagaggagaggccgaatgtgagtatgtaacctggcggcagcgcaaaagatg

SEQ ID NO: 117263 - DNA, 103 bp, Artificial Sequence
  Synthetic Polynucleotide
taatacgactcactataggggttgaggtacagtggctcattcacatactcaacagaggagagagtatatgaatgagccaaacctggcggcagcgcaaaagatg

SEQ ID NO: 117264 - DNA, 103 bp, Artificial Sequence
  Synthetic Polynucleotide
taatacgactcactatagggtggcaaaggtgttgaggtacagtggctcataacagaggagaatgagcatgtgtacctcaaacctggcggcagcgcaaaagatg

SEQ ID NO: 117265 - DNA, 103 bp, Artificial Sequence
  Synthetic Polynucleotide
taatacgactcactatagggcccaaggtgttggcaaaggtgttgaggtacaacagaggagagtacctatgcacctttgcaacctggcggcagcgcaaaagatg

SEQ ID NO: 117266 - DNA, 103 bp, Artificial Sequence
  Synthetic Polynucleotide
taatacgactcactatagggctcagcttttcccaaggtgttggcaaaggtaacagaggagaacctttatgaacaccttgaacctggcggcagcgcaaaagatg

SEQ ID NO: 117267 - DNA, 103 bp, Artificial Sequence
  Synthetic Polynucleotide
taatacgactcactatagggtcttcaggtactcagcttttcccaaggtgtaacagaggagaacacctatggaaaagctgaacctggcggcagcgcaaaagatg

SEQ ID NO: 117268 - DNA, 103 bp, Artificial Sequence
  Synthetic Polynucleotide
taatacgactcactatagggagtatgttgttcttcaggtactcagcttttaacagaggagaaaaagcatggtacctgaaaacctggcggcagcgcaaaagatg

SEQ ID NO: 117269 - DNA, 103 bp, Artificial Sequence
  Synthetic Polynucleotide
taatacgactcactatagggtggcattgacagtatgttgttcttcaggtaaacagaggagatacctgatgaacaacataaacctggcggcagcgcaaaagatg

SEQ ID NO: 117270 - DNA, 103 bp, Artificial Sequence
  Synthetic Polynucleotide
taatacgactcactatagggtggccttctctggcattgacagtatgttgtaacagaggagaacaacaatgtgtcaatgcaacctggcggcagcgcaaaagatg

SEQ ID NO: 117271 - DNA, 103 bp, Artificial Sequence
  Synthetic Polynucleotide
taatacgactcactatagggaacgctttcttggccttctctggcattgacaacagaggagagtcaatatgagagaaggcaacctggcggcagcgcaaaagatg

SEQ ID NO: 117272 - DNA, 103 bp, Artificial Sequence
  Synthetic Polynucleotide
taatacgactcactatagggtccaaagtttccatcttttctgtagtttaaaacagaggagattaaacatgagaaaagataacctggcggcagcgcaaaagatg

SEQ ID NO: 117273 - DNA, 103 bp, Artificial Sequence
  Synthetic Polynucleotide
taatacgactcactatagggagggttgtcaaacgctttcttggccttctcaacagaggagagagaagatgaagaaagcgaacctggcggcagcgcaaaagatg

SEQ ID NO: 117274 - DNA, 103 bp, Artificial Sequence
  Synthetic Polynucleotide
taatacgactcactatagggtccagtagtcagggttgtcaaacgctttctaacagaggagaagaaagatgttgacaaccaacctggcggcagcgcaaaagatg

SEQ ID NO: 117275 - DNA, 103 bp, Artificial Sequence
  Synthetic Polynucleotide
taatacgactcactatagggaggctgtggttccagtagtcagggttgtcaaacagaggagatgacaaatgtgactactgaacctggcggcagcgcaaaagatg

SEQ ID NO: 117276 - DNA, 103 bp, Artificial Sequence
  Synthetic Polynucleotide
taatacgactcactatagggccgaggtggcaggctgtggttccagtagtcaacagaggagagactacatgaaccacagcaacctggcggcagcgcaaaagatg

SEQ ID NO: 117277 - DNA, 103 bp, Artificial Sequence
  Synthetic Polynucleotide
taatacgactcactataggggaagggtgctccgaggtggcaggctgtggtaacagaggagaaccacaatgtgccacctcaacctggcggcagcgcaaaagatg

SEQ ID NO: 117278 - DNA, 103 bp, Artificial Sequence
  Synthetic Polynucleotide
taatacgactcactatagggtctgggtgctgaagggtgctccgaggtggcaacagaggagagccaccatggagcaccctaacctggcggcagcgcaaaagatg

SEQ ID NO: 117279 - DNA, 103 bp, Artificial Sequence
  Synthetic Polynucleotide
taatacgactcactatagggctgcaggtagtctgggtgctgaagggtgctaacagaggagaagcaccatgcagcacccaaacctggcggcagcgcaaaagatg

SEQ ID NO: 117280 - DNA, 103 bp, Artificial Sequence
  Synthetic Polynucleotide
taatacgactcactatagggtgctgtactcctgcaggtagtctgggtgctaacagaggagaagcaccatgactacctgcaacctggcggcagcgcaaaagatg

SEQ ID NO: 117281 - DNA, 103 bp, Artificial Sequence
  Synthetic Polynucleotide
taatacgactcactatagggaaatattttgtgctgtactcctgcaggtagaacagaggagactacctatgggagtacagaacctggcggcagcgcaaaagatg

SEQ ID NO: 117282 - DNA, 103 bp, Artificial Sequence
  Synthetic Polynucleotide
taatacgactcactatagggctgtttataaaaatattttgtgctgtactcaacagaggagagagtacatgacaaaatataacctggcggcagcgcaaaagatg

SEQ ID NO: 117283 - DNA, 103 bp, Artificial Sequence
  Synthetic Polynucleotide
taatacgactcactataggggttcttgaagtccaaagtttccatcttttcaacagaggagagaaaagatggaaactttgaacctggcggcagcgcaaaagatg

SEQ ID NO: 117284 - DNA, 103 bp, Artificial Sequence
  Synthetic Polynucleotide
taatacgactcactatagggtccgcccattctgtttataaaaatattttgaacagaggagacaaaatatgtttataaacaacctggcggcagcgcaaaagatg

SEQ ID NO: 117285 - DNA, 103 bp, Artificial Sequence
  Synthetic Polynucleotide
taatacgactcactatagggataggccggatccgcccattctgtttataaaacagaggagattataaatggaatgggcgaacctggcggcagcgcaaaagatg

SEQ ID NO: 117286 - DNA, 103 bp, Artificial Sequence
  Synthetic Polynucleotide
taatacgactcactatagggctctgccacaataggccggatccgcccattaacagaggagaaatgggatgatccggcctaacctggcggcagcgcaaaagatg

SEQ ID NO: 117287 - DNA, 103 bp, Artificial Sequence
  Synthetic Polynucleotide
taatacgactcactatagggattcaggattctctgccacaataggccggaaacagaggagatccggcatgttgtggcagaacctggcggcagcgcaaaagatg

SEQ ID NO: 117288 - DNA, 103 bp, Artificial Sequence
  Synthetic Polynucleotide
taatacgactcactatagggtcagagaggtattcaggattctctgccacaaacagaggagatgtggcatggaatcctgaaacctggcggcagcgcaaaagatg

SEQ ID NO: 117289 - DNA, 103 bp, Artificial Sequence
  Synthetic Polynucleotide
taatacgactcactatagggcagggagaactcagagaggtattcaggattaacagaggagaaatcctatgtacctctctaacctggcggcagcgcaaaagatg

SEQ ID NO: 117290 - DNA, 103 bp, Artificial Sequence
  Synthetic Polynucleotide
taatacgactcactatagggtgcctggcttcagggagaactcagagaggtaacagaggagaacctctatgagttctcccaacctggcggcagcgcaaaagatg

SEQ ID NO: 117291 - DNA, 103 bp, Artificial Sequence
  Synthetic Polynucleotide
taatacgactcactatagggggcagcacagtgcctggcttcagggagaacaacagaggagagttctcatggaagccaggaacctggcggcagcgcaaaagatg

SEQ ID NO: 117292 - DNA, 103 bp, Artificial Sequence
  Synthetic Polynucleotide
taatacgactcactatagggaggtggaggcggcagcacagtgcctggcttaacagaggagaaagccaatgactgtgctgaacctggcggcagcgcaaaagatg

SEQ ID NO: 117293 - DNA, 103 bp, Artificial Sequence
  Synthetic Polynucleotide
taatacgactcactatagggggtgtctgtaaggtggaggcggcagcacagaacagaggagactgtgcatgcgcctccacaacctggcggcagcgcaaaagatg

SEQ ID NO: 117294 - DNA, 103 bp, Artificial Sequence
  Synthetic Polynucleotide
taatacgactcactatagggtttaatccaagttcttgaagtccaaagtttaacagaggagaaaacttatgacttcaagaaacctggcggcagcgcaaaagatg

SEQ ID NO: 117295 - DNA, 103 bp, Artificial Sequence
  Synthetic Polynucleotide
taatacgactcactatagggacagtattccggtgtctgtaaggtggaggcaacagaggagagcctccatgttacagacaaacctggcggcagcgcaaaagatg

SEQ ID NO: 117296 - DNA, 103 bp, Artificial Sequence
  Synthetic Polynucleotide
taatacgactcactataggggacggtccccgccgccacgagaaggctcacaacagaggagagtgagcatgctcgtggcgaacctggcggcagcgcaaaagatg

SEQ ID NO: 117297 - DNA, 103 bp, Artificial Sequence
  Synthetic Polynucleotide
taatacgactcactatagggtgtcaagttctttaatccaagttcttgaagaacagaggagacttcaaatgcttggattaaacctggcggcagcgcaaaagatg

SEQ ID NO: 117298 - DNA, 103 bp, Artificial Sequence
  Synthetic Polynucleotide
taatacgactcactatagggttaggatttctgtcaagttctttaatccaaaacagaggagattggatatgagaacttgaaacctggcggcagcgcaaaagatg

SEQ ID NO: 117299 - DNA, 103 bp, Artificial Sequence
  Synthetic Polynucleotide
taatacgactcactatagggactccaccatttaggatttctgtcaagttcaacagaggagagaacttatgagaaatcctaacctggcggcagcgcaaaagatg

SEQ ID NO: 117300 - DNA, 103 bp, Artificial Sequence
  Synthetic Polynucleotide
taatacgactcactataggggtctacatagactccaccatttaggatttcaacagaggagagaaatcatgaatggtggaaacctggcggcagcgcaaaagatg

SEQ ID NO: 117301 - DNA, 103 bp, Artificial Sequence
  Synthetic Polynucleotide
taatacgactcactatagggatttgttctggtctacatagactccaccataacagaggagaatggtgatgtctatgtagaacctggcggcagcgcaaaagatg

SEQ ID NO: 117302 - DNA, 103 bp, Artificial Sequence
  Synthetic Polynucleotide
taatacgactcactatagggtaacaaaggaatttgttctggtctacatagaacagaggagactatgtatgccagaacaaaacctggcggcagcgcaaaagatg

SEQ ID NO: 117303 - DNA, 103 bp, Artificial Sequence
  Synthetic Polynucleotide
taatacgactcactatagggggtgtctgcataacaaaggaatttgttctgaacagaggagacagaacatgttcctttgtaacctggcggcagcgcaaaagatg

SEQ ID NO: 117304 - DNA, 103 bp, Artificial Sequence
  Synthetic Polynucleotide
taatacgactcactataggggccaatgaatggtgtctgcataacaaaggaaacagaggagatcctttatgatgcagacaaacctggcggcagcgcaaaagatg

SEQ ID NO: 117305 - DNA, 103 bp, Artificial Sequence
  Synthetic Polynucleotide
taatacgactcactatagggacaatatcttgccaatgaatggtgtctgcaaacagaggagatgcagaatgcattcattgaacctggcggcagcgcaaaagatg

SEQ ID NO: 117306 - DNA, 103 bp, Artificial Sequence
  Synthetic Polynucleotide
taatacgactcactatagggtgggttccgaacaatatcttgccaatgaataacagaggagaattcatatgcaagatattaacctggcggcagcgcaaaagatg

SEQ ID NO: 117307 - DNA, 103 bp, Artificial Sequence
  Synthetic Polynucleotide
taatacgactcactatagggcgctgggctggacggtccccgccgccacgaaacagaggagatcgtggatgcggggaccgaacctggcggcagcgcaaaagatg

SEQ ID NO: 117308 - DNA, 103 bp, Artificial Sequence
  Synthetic Polynucleotide
taatacgactcactatagggtggaaggccatgggttccgaacaatatcttaacagaggagaaagataatgttcggaaccaacctggcggcagcgcaaaagatg

SEQ ID NO: 117309 - DNA, 103 bp, Artificial Sequence
  Synthetic Polynucleotide
taatacgactcactatagggagagtcaagttggaaggccatgggttccgaaacagaggagatcggaaatgatggccttcaacctggcggcagcgcaaaagatg

SEQ ID NO: 117310 - DNA, 103 bp, Artificial Sequence
  Synthetic Polynucleotide
taatacgactcactatagggtgttgacacaagagtcaagttggaaggccaaacagaggagatggcctatgaacttgactaacctggcggcagcgcaaaagatg

SEQ ID NO: 117311 - DNA, 103 bp, Artificial Sequence
  Synthetic Polynucleotide
taatacgactcactatagggaactaccatttgttgacacaagagtcaagtaacagaggagaacttgaatgttgtgtcaaaacctggcggcagcgcaaaagatg

SEQ ID NO: 117312 - DNA, 103 bp, Artificial Sequence
  Synthetic Polynucleotide
taatacgactcactatagggccacatcctgaactaccatttgttgacacaaacagaggagatgtgtcatgaaatggtagaacctggcggcagcgcaaaagatg

SEQ ID NO: 117313 - DNA, 103 bp, Artificial Sequence
  Synthetic Polynucleotide
taatacgactcactatagggatggcaacgtccacatcctgaactaccattaacagaggagaaatggtatgtcaggatgtaacctggcggcagcgcaaaagatg

SEQ ID NO: 117314 - DNA, 103 bp, Artificial Sequence
  Synthetic Polynucleotide
taatacgactcactatagggtacaggacttatggcaacgtccacatcctgaacagaggagacaggatatggacgttgccaacctggcggcagcgcaaaagatg

SEQ ID NO: 117315 - DNA, 103 bp, Artificial Sequence
  Synthetic Polynucleotide
taatacgactcactatagggcaacggccagtacaggacttatggcaacgtaacagaggagaacgttgatgtaagtcctgaacctggcggcagcgcaaaagatg

SEQ ID NO: 117316 - DNA, 103 bp, Artificial Sequence
  Synthetic Polynucleotide
taatacgactcactataggggggtccccagcaacggccagtacaggacttaacagaggagaaagtccatgactggccgtaacctggcggcagcgcaaaagatg

SEQ ID NO: 117317 - DNA, 103 bp, Artificial Sequence
  Synthetic Polynucleotide
taatacgactcactataggggattttctgtgggtccccagcaacggccagaacagaggagactggccatggctggggacaacctggcggcagcgcaaaagatg

SEQ ID NO: 117318 - DNA, 103 bp, Artificial Sequence
  Synthetic Polynucleotide
taatacgactcactataggggactgagaatcgctgggctggacggtccccaacagaggagaggggacatgccagcccagaacctggcggcagcgcaaaagatg

SEQ ID NO: 117319 - DNA, 103 bp, Artificial Sequence
  Synthetic Polynucleotide
taatacgactcactataggggtctggcaatgattttctgtgggtccccagaacagaggagactggggatgcacagaaaaaacctggcggcagcgcaaaagatg

SEQ ID NO: 117320 - DNA, 103 bp, Artificial Sequence
  Synthetic Polynucleotide
taatacgactcactatagggccttgtcaaagtctggcaatgattttctgtaacagaggagaacagaaatgcattgccagaacctggcggcagcgcaaaagatg

SEQ ID NO: 117321 - DNA, 103 bp, Artificial Sequence
  Synthetic Polynucleotide
taatacgactcactatagggcacacaccgtccttgtcaaagtctggcaataacagaggagaattgccatgctttgacaaaacctggcggcagcgcaaaagatg

SEQ ID NO: 117322 - DNA, 103 bp, Artificial Sequence
  Synthetic Polynucleotide
taatacgactcactatagggcattgttctgcacacaccgtccttgtcaaaaacagaggagatttgacatggacggtgtgaacctggcggcagcgcaaaagatg

SEQ ID NO: 117323 - DNA, 103 bp, Artificial Sequence
  Synthetic Polynucleotide
taatacgactcactatagggtctgccgtcacattgttctgcacacaccgtaacagaggagaacggtgatggcagaacaaaacctggcggcagcgcaaaagatg

SEQ ID NO: 117324 - DNA, 103 bp, Artificial Sequence
  Synthetic Polynucleotide
taatacgactcactataggggtccgtagcatctgccgtcacattgttctgaacagaggagacagaacatggtgacggcaaacctggcggcagcgcaaaagatg

SEQ ID NO: 117325 - DNA, 103 bp, Artificial Sequence
  Synthetic Polynucleotide
taatacgactcactatagggctgacgtaaggtccgtagcatctgccgtcaaacagaggagatgacggatgatgctacggaacctggcggcagcgcaaaagatg

SEQ ID NO: 117326 - DNA, 103 bp, Artificial Sequence
  Synthetic Polynucleotide
taatacgactcactataggggcagcagtcactgacgtaaggtccgtagcaaacagaggagatgctacatgccttacgtcaacctggcggcagcgcaaaagatg

SEQ ID NO: 117327 - DNA, 103 bp, Artificial Sequence
  Synthetic Polynucleotide
taatacgactcactatagggattctcgatggcagcagtcactgacgtaagaacagaggagacttacgatggtgactgctaacctggcggcagcgcaaaagatg

SEQ ID NO: 117328 - DNA, 103 bp, Artificial Sequence
  Synthetic Polynucleotide
taatacgactcactatagggcctccagcacattctcgatggcagcagtcaaacagaggagatgactgatgccatcgagaaacctggcggcagcgcaaaagatg

SEQ ID NO: 117329 - DNA, 103 bp, Artificial Sequence
  Synthetic Polynucleotide
taatacgactcactatagggtgcacacactgactgagaatcgctgggctgaacagaggagacagcccatggattctcagaacctggcggcagcgcaaaagatg

SEQ ID NO: 117330 - DNA, 103 bp, Artificial Sequence
  Synthetic Polynucleotide
taatacgactcactatagggtcctgagcagcctccagcacattctcgatgaacagaggagacatcgaatgtgtgctggaaacctggcggcagcgcaaaagatg

SEQ ID NO: 117331 - DNA, 103 bp, Artificial Sequence
  Synthetic Polynucleotide
taatacgactcactatagggtgtccttaggtcctgagcagcctccagcacaacagaggagagtgctgatggctgctcagaacctggcggcagcgcaaaagatg

SEQ ID NO: 117332 - DNA, 103 bp, Artificial Sequence
  Synthetic Polynucleotide
taatacgactcactatagggaagcagtctgtgtccttaggtcctgagcagaacagaggagactgctcatgacctaaggaaacctggcggcagcgcaaaagatg

SEQ ID NO: 117333 - DNA, 103 bp, Artificial Sequence
  Synthetic Polynucleotide
taatacgactcactatagggcatgcaggcaaagcagtctgtgtccttaggaacagaggagacctaagatgacagactgcaacctggcggcagcgcaaaagatg

SEQ ID NO: 117334 - DNA, 103 bp, Artificial Sequence
  Synthetic Polynucleotide
taatacgactcactatagggcattgaaattcatgcaggcaaagcagtctgaacagaggagacagactatgttgcctgcaaacctggcggcagcgcaaaagatg

SEQ ID NO: 117335 - DNA, 103 bp, Artificial Sequence
  Synthetic Polynucleotide
taatacgactcactataggggctccactgtcattgaaattcatgcaggcaaacagaggagatgcctgatggaatttcaaaacctggcggcagcgcaaaagatg

SEQ ID NO: 117336 - DNA, 103 bp, Artificial Sequence
  Synthetic Polynucleotide
taatacgactcactatagggagtaacacatgctccactgtcattgaaattaacagaggagaaatttcatggacagtggaaacctggcggcagcgcaaaagatg

SEQ ID NO: 117337 - DNA, 103 bp, Artificial Sequence
  Synthetic Polynucleotide
taatacgactcactatagggggggacactgagtaacacatgctccactgtaacagaggagaacagtgatgcatgtgttaaacctggcggcagcgcaaaagatg

SEQ ID NO: 117338 - DNA, 103 bp, Artificial Sequence
  Synthetic Polynucleotide
taatacgactcactatagggacaaaggtttggggacactgagtaacacataacagaggagaatgtgtatgtcagtgtccaacctggcggcagcgcaaaagatg

SEQ ID NO: 117339 - DNA, 103 bp, Artificial Sequence
  Synthetic Polynucleotide
taatacgactcactatagggtggattgtagacaaaggtttggggacactgaacagaggagacagtgtatgcaaacctttaacctggcggcagcgcaaaagatg

SEQ ID NO: 117340 - DNA, 103 bp, Artificial Sequence
  Synthetic Polynucleotide
taatacgactcactatagggtctccgttcctgcacacactgactgagaataacagaggagaattctcatgcagtgtgtgaacctggcggcagcgcaaaagatg

SEQ ID NO: 117341 - DNA, 103 bp, Artificial Sequence
  Synthetic Polynucleotide
taatacgactcactataggggaaaggtggttggattgtagacaaaggtttaacagaggagaaaacctatgtctacaatcaacctggcggcagcgcaaaagatg

SEQ ID NO: 117342 - DNA, 103 bp, Artificial Sequence
  Synthetic Polynucleotide
taatacgactcactatagggtgctccagttgaaaggtggttggattgtagaacagaggagactacaaatgaaccaccttaacctggcggcagcgcaaaagatg

SEQ ID NO: 117343 - DNA, 103 bp, Artificial Sequence
  Synthetic Polynucleotide
taatacgactcactatagggattgaaattgtgctccagttgaaaggtggtaacagaggagaaccaccatgcaactggagaacctggcggcagcgcaaaagatg

SEQ ID NO: 117344 - DNA, 103 bp, Artificial Sequence
  Synthetic Polynucleotide
taatacgactcactatagggtgtactttgcattgaaattgtgctccagttaacagaggagaaactggatgacaatttcaaacctggcggcagcgcaaaagatg

SEQ ID NO: 117345 - DNA, 103 bp, Artificial Sequence
  Synthetic Polynucleotide
taatacgactcactataggggctccatatgtgtactttgcattgaaattgaacagaggagacaatttatgtgcaaagtaaacctggcggcagcgcaaaagatg

SEQ ID NO: 117346 - DNA, 103 bp, Artificial Sequence
  Synthetic Polynucleotide
taatacgactcactataggggacacagaatgctccatatgtgtactttgcaacagaggagagcaaagatgacatatggaaacctggcggcagcgcaaaagatg

SEQ ID NO: 117347 - DNA, 103 bp, Artificial Sequence
  Synthetic Polynucleotide
taatacgactcactataggggacatttcttgacacagaatgctccatatgaacagaggagacatatgatgcattctgtgaacctggcggcagcgcaaaagatg

SEQ ID NO: 117348 - DNA, 103 bp, Artificial Sequence
  Synthetic Polynucleotide
taatacgactcactatagggaagttatgtggacatttcttgacacagaataacagaggagaattctgatgcaagaaatgaacctggcggcagcgcaaaagatg

SEQ ID NO: 117349 - DNA, 103 bp, Artificial Sequence
  Synthetic Polynucleotide
taatacgactcactatagggatctaccacaaagttatgtggacatttcttaacagaggagaaagaaaatgccacataacaacctggcggcagcgcaaaagatg

SEQ ID NO: 117350 - DNA, 103 bp, Artificial Sequence
  Synthetic Polynucleotide
taatacgactcactatagggaagaactggaatctaccacaaagttatgtgaacagaggagacacataatgttgtggtagaacctggcggcagcgcaaaagatg

SEQ ID NO: 117351 - DNA, 103 bp, Artificial Sequence
  Synthetic Polynucleotide
taatacgactcactatagggctcagtttattctccgttcctgcacacactaacagaggagaagtgtgatgaggaacggaaacctggcggcagcgcaaaagatg

SEQ ID NO: 117352 - DNA, 103 bp, Artificial Sequence
  Synthetic Polynucleotide
taatacgactcactataggggcacgcacacaagaactggaatctaccacaaacagaggagatgtggtatgttccagttcaacctggcggcagcgcaaaagatg

SEQ ID NO: 117353 - DNA, 103 bp, Artificial Sequence
  Synthetic Polynucleotide
taatacgactcactatagggactagggcaggcacgcacacaagaactggaaacagaggagatccagtatgtgtgtgcgtaacctggcggcagcgcaaaagatg

SEQ ID NO: 117354 - DNA, 103 bp, Artificial Sequence
  Synthetic Polynucleotide
taatacgactcactatagggccatcttggaactagggcaggcacgcacacaacagaggagagtgtgcatgcctgccctaaacctggcggcagcgcaaaagatg

SEQ ID NO: 117355 - DNA, 103 bp, Artificial Sequence
  Synthetic Polynucleotide
taatacgactcactatagggtcttctacttccatcttggaactagggcagaacagaggagactgcccatgttccaagataacctggcggcagcgcaaaagatg

SEQ ID NO: 117356 - DNA, 103 bp, Artificial Sequence
  Synthetic Polynucleotide
taatacgactcactatagggaatcccattttcttctacttccatcttggaaacagaggagatccaagatggaagtagaaaacctggcggcagcgcaaaagatg

SEQ ID NO: 117357 - DNA, 103 bp, Artificial Sequence
  Synthetic Polynucleotide
taatacgactcactatagggtacacattttaatcccattttcttctacttaacagaggagaaagtagatgaaaatgggaaacctggcggcagcgcaaaagatg

SEQ ID NO: 117358 - DNA, 103 bp, Artificial Sequence
  Synthetic Polynucleotide
taatacgactcactataggggtgcaaggtttacacattttaatcccatttaacagaggagaaaatggatgtaaaatgtgaacctggcggcagcgcaaaagatg

SEQ ID NO: 117359 - DNA, 103 bp, Artificial Sequence
  Synthetic Polynucleotide
taatacgactcactataggggcaaatgtcagtgcaaggtttacacattttaacagaggagaaaaatgatgaaaccttgcaacctggcggcagcgcaaaagatg

SEQ ID NO: 117360 - DNA, 103 bp, Artificial Sequence
  Synthetic Polynucleotide
taatacgactcactatagggaagcttttgggcaaatgtcagtgcaaggttaacagaggagaaaccttatgctgacatttaacctggcggcagcgcaaaagatg

SEQ ID NO: 117361 - DNA, 103 bp, Artificial Sequence
  Synthetic Polynucleotide
taatacgactcactatagggatgccatcacaagcttttgggcaaatgtcaaacagaggagatgacatatgcccaaaagcaacctggcggcagcgcaaaagatg

SEQ ID NO: 117362 - DNA, 103 bp, Artificial Sequence
  Synthetic Polynucleotide
taatacgactcactatagggtgataaggcttccttaatagtgctggccataacagaggagaatggccatgactattaagaacctggcggcagcgcaaaagatg

SEQ ID NO: 117363 - DNA, 103 bp, Artificial Sequence
  Synthetic Polynucleotide
taatacgactcactataggggtcgctggaggaggacgcggtcatctctgtaacagaggagaacagagatgaccgcgtccaacctggcggcagcgcaaaagatg

SEQ ID NO: 117364 - DNA, 103 bp, Artificial Sequence
  Synthetic Polynucleotide
taatacgactcactatagggcttgaactccccgttggtgccttcccaggtaacagaggagaacctggatgggcaccaacaacctggcggcagcgcaaaagatg

SEQ ID NO: 117365 - DNA, 103 bp, Artificial Sequence
  Synthetic Polynucleotide
taatacgactcactataggggatccgtcatcttgaactccccgttggtgcaacagaggagagcaccaatggggagttcaaacctggcggcagcgcaaaagatg

SEQ ID NO: 117366 - DNA, 103 bp, Artificial Sequence
  Synthetic Polynucleotide
taatacgactcactatagggacctcgtcgggatccgtcatcttgaactccaacagaggagaggagttatggatgacggaaacctggcggcagcgcaaaagatg

SEQ ID NO: 117367 - DNA, 103 bp, Artificial Sequence
  Synthetic Polynucleotide
taatacgactcactataggggcgccgggccacctcgtcgggatccgtcataacagaggagaatgacgatgcccgacgagaacctggcggcagcgcaaaagatg

SEQ ID NO: 117368 - DNA, 103 bp, Artificial Sequence
  Synthetic Polynucleotide
taatacgactcactataggggctctccccagcgccgggccacctcgtcggaacagaggagaccgacgatgtggcccggcaacctggcggcagcgcaaaagatg

SEQ ID NO: 117369 - DNA, 103 bp, Artificial Sequence
  Synthetic Polynucleotide
taatacgactcactatagggttgctcttccgctctccccagcgccgggccaacagaggagaggcccgatgctggggagaaacctggcggcagcgcaaaagatg

SEQ ID NO: 117370 - DNA, 103 bp, Artificial Sequence
  Synthetic Polynucleotide
taatacgactcactatagggcatgttgggtttgctcttccgctctccccaaacagaggagatggggaatgcggaagagcaacctggcggcagcgcaaaagatg

SEQ ID NO: 117371 - DNA, 103 bp, Artificial Sequence
  Synthetic Polynucleotide
taatacgactcactatagggtatcgtagttcatgttgggtttgctcttccaacagaggagaggaagaatgaacccaacaaacctggcggcagcgcaaaagatg

SEQ ID NO: 117372 - DNA, 103 bp, Artificial Sequence
  Synthetic Polynucleotide
taatacgactcactatagggcggctgagcttatcgtagttcatgttgggtaacagaggagaacccaaatggaactacgaaacctggcggcagcgcaaaagatg

SEQ ID NO: 117373 - DNA, 103 bp, Artificial Sequence
  Synthetic Polynucleotide
taatacgactcactatagggacggagggcgcggctgagcttatcgtagttaacagaggagaaactacatgaagctcagcaacctggcggcagcgcaaaagatg

SEQ ID NO: 117374 - DNA, 103 bp, Artificial Sequence
  Synthetic Polynucleotide
taatacgactcactatagggtctgtccatagtcgctggaggaggacgcggaacagaggagaccgcgtatgcctccagcgaacctggcggcagcgcaaaagatg

SEQ ID NO: 117375 - DNA, 103 bp, Artificial Sequence
  Synthetic Polynucleotide
taatacgactcactatagggcatagtagtaacggagggcgcggctgagctaacagaggagaagctcaatggcgccctccaacctggcggcagcgcaaaagatg

SEQ ID NO: 117376 - DNA, 103 bp, Artificial Sequence
  Synthetic Polynucleotide
taatacgactcactatagggatgttcttgtcatagtagtaacggagggcgaacagaggagacgccctatgttactactaaacctggcggcagcgcaaaagatg

SEQ ID NO: 117377 - DNA, 103 bp, Artificial Sequence
  Synthetic Polynucleotide
taatacgactcactatagggcttggtcatgatgttcttgtcatagtagtaaacagaggagatactacatggacaagaacaacctggcggcagcgcaaaagatg

SEQ ID NO: 117378 - DNA, 103 bp, Artificial Sequence
  Synthetic Polynucleotide
taatacgactcactatagggtcccatggaccttggtcatgatgttcttgtaacagaggagaacaagaatgtcatgaccaaacctggcggcagcgcaaaagatg

SEQ ID NO: 117379 - DNA, 103 bp, Artificial Sequence
  Synthetic Polynucleotide
taatacgactcactataggggcgtagcgcttcccatggaccttggtcatgaacagaggagacatgacatgggtccatggaacctggcggcagcgcaaaagatg

SEQ ID NO: 117380 - DNA, 103 bp, Artificial Sequence
  Synthetic Polynucleotide
taatacgactcactataggggaacttgtaggcgtagcgcttcccatggacaacagaggagagtccatatgaagcgctacaacctggcggcagcgcaaaagatg

SEQ ID NO: 117381 - DNA, 103 bp, Artificial Sequence
  Synthetic Polynucleotide
taatacgactcactatagggcgtggaagtcgaacttgtaggcgtagcgctaacagaggagaagcgctatgcctacaagtaacctggcggcagcgcaaaagatg

SEQ ID NO: 117382 - DNA, 103 bp, Artificial Sequence
  Synthetic Polynucleotide
taatacgactcactatagggtgggcgatcccgtggaagtcgaacttgtagaacagaggagactacaaatgcgacttccaaacctggcggcagcgcaaaagatg

SEQ ID NO: 117383 - DNA, 103 bp, Artificial Sequence
  Synthetic Polynucleotide
taatacgactcactatagggctggagggcctgggcgatcccgtggaagtcaacagaggagagacttcatggggatcgccaacctggcggcagcgcaaaagatg

SEQ ID NO: 117384 - DNA, 103 bp, Artificial Sequence
  Synthetic Polynucleotide
taatacgactcactataggggggggtggggctggagggcctgggcgatccaacagaggagaggatcgatgaggccctccaacctggcggcagcgcaaaagatg

SEQ ID NO: 117385 - DNA, 103 bp, Artificial Sequence
  Synthetic Polynucleotide
taatacgactcactatagggatcttggaagtctgtccatagtcgctggagaacagaggagactccagatgctatggacaaacctggcggcagcgcaaaagatg

SEQ ID NO: 117386 - DNA, 103 bp, Artificial Sequence
  Synthetic Polynucleotide
taatacgactcactataggggatgactccggggggtggggctggagggccaacagaggagaggccctatggccccacccaacctggcggcagcgcaaaagatg

SEQ ID NO: 117387 - DNA, 103 bp, Artificial Sequence
  Synthetic Polynucleotide
taatacgactcactatagggcttgtacagagatgactccggggggtggggaacagaggagaccccacatgccggagtcaaacctggcggcagcgcaaaagatg

SEQ ID NO: 117388 - DNA, 103 bp, Artificial Sequence
  Synthetic Polynucleotide
taatacgactcactatagggctgaggggtacttgtacagagatgactccgaacagaggagacggagtatgctctgtacaaacctggcggcagcgcaaaagatg

SEQ ID NO: 117389 - DNA, 103 bp, Artificial Sequence
  Synthetic Polynucleotide
taatacgactcactatagggtacgggaggtctgaggggtacttgtacagaaacagaggagatctgtaatggtacccctcaacctggcggcagcgcaaaagatg

SEQ ID NO: 117390 - DNA, 103 bp, Artificial Sequence
  Synthetic Polynucleotide
taatacgactcactatagggggagcccatgtacgggaggtctgaggggtaaacagaggagataccccatggacctcccgaacctggcggcagcgcaaaagatg

SEQ ID NO: 117391 - DNA, 103 bp, Artificial Sequence
  Synthetic Polynucleotide
taatacgactcactataggggggcgtgataggagcccatgtacgggaggtaacagaggagaacctccatgacatgggctaacctggcggcagcgcaaaagatg

SEQ ID NO: 117392 - DNA, 103 bp, Artificial Sequence
  Synthetic Polynucleotide
taatacgactcactatagggttctgtgggtgggcgtgataggagcccatgaacagaggagacatgggatgctatcacgcaacctggcggcagcgcaaaagatg

SEQ ID NO: 117393 - DNA, 103 bp, Artificial Sequence
  Synthetic Polynucleotide
taatacgactcactatagggaaagttcatcttctgtgggtgggcgtgataaacagaggagatatcacatgcacccacagaacctggcggcagcgcaaaagatg

SEQ ID NO: 117394 - DNA, 103 bp, Artificial Sequence
  Synthetic Polynucleotide
taatacgactcactatagggggggcgccacaaagttcatcttctgtgggtaacagaggagaacccacatgagatgaactaacctggcggcagcgcaaaagatg

SEQ ID NO: 117395 - DNA, 103 bp, Artificial Sequence
  Synthetic Polynucleotide
taatacgactcactataggggctggagggtggggcgccacaaagttcatcaacagaggagagatgaaatgtgtggcgccaacctggcggcagcgcaaaagatg

SEQ ID NO: 117396 - DNA, 103 bp, Artificial Sequence
  Synthetic Polynucleotide
taatacgactcactataggggcgtgggctcatcttggaagtctgtccataaacagaggagatatggaatgacttccaagaacctggcggcagcgcaaaagatg

SEQ ID NO: 117397 - DNA, 103 bp, Artificial Sequence
  Synthetic Polynucleotide
taatacgactcactatagggcacggggagggctggagggtggggcgccacaacagaggagagtggcgatgcaccctccaaacctggcggcagcgcaaaagatg

SEQ ID NO: 117398 - DNA, 103 bp, Artificial Sequence
  Synthetic Polynucleotide
taatacgactcactatagggtggaagatgtcacggggagggctggagggtaacagaggagaaccctcatgccctccccgaacctggcggcagcgcaaaagatg

SEQ ID NO: 117399 - DNA, 103 bp, Artificial Sequence
  Synthetic Polynucleotide
taatacgactcactataggggcaaaaaaactggaagatgtcacggggaggaacagaggagacctcccatggacatcttcaacctggcggcagcgcaaaagatg

SEQ ID NO: 117400 - DNA, 103 bp, Artificial Sequence
  Synthetic Polynucleotide
taatacgactcactataggggtttggggcagcaaaaaaactggaagatgtaacagaggagaacatctatgagtttttttaacctggcggcagcgcaaaagatg

SEQ ID NO: 117401 - DNA, 103 bp, Artificial Sequence
  Synthetic Polynucleotide
taatacgactcactatagggtccagtatgggtttggggcagcaaaaaaacaacagaggagagtttttatgctgccccaaaacctggcggcagcgcaaaagatg

SEQ ID NO: 117402 - DNA, 103 bp, Artificial Sequence
  Synthetic Polynucleotide
taatacgactcactataggggttggtgaattccagtatgggtttggggcaaacagaggagatgccccatgcccatactgaacctggcggcagcgcaaaagatg

SEQ ID NO: 117403 - DNA, 103 bp, Artificial Sequence
  Synthetic Polynucleotide
taatacgactcactatagggtatacccccagttggtgaattccagtatggaacagaggagaccatacatgaattcaccaaacctggcggcagcgcaaaagatg

SEQ ID NO: 117404 - DNA, 103 bp, Artificial Sequence
  Synthetic Polynucleotide
taatacgactcactatagggtgttggggtatatacccccagttggtgaataacagaggagaattcacatgctgggggtaaacctggcggcagcgcaaaagatg

SEQ ID NO: 117405 - DNA, 103 bp, Artificial Sequence
  Synthetic Polynucleotide
taatacgactcactataggggggagcctagtgttggggtatatacccccaaacagaggagatgggggatgataccccaaaacctggcggcagcgcaaaagatg

SEQ ID NO: 117406 - DNA, 103 bp, Artificial Sequence
  Synthetic Polynucleotide
taatacgactcactatagggatggctggtggggagcctagtgttggggtaaacagaggagataccccatgactaggctcaacctggcggcagcgcaaaagatg

SEQ ID NO: 117407 - DNA, 103 bp, Artificial Sequence
  Synthetic Polynucleotide
taatacgactcactataggggctgagggacgcgtgggctcatcttggaagaacagaggagacttccaatgtgagcccacaacctggcggcagcgcaaaagatg

SEQ ID NO: 117408 - DNA, 103 bp, Artificial Sequence
  Synthetic Polynucleotide
taatacgactcactataggggagaaggcatatggctggtggggagcctagaacagaggagactaggcatgccaccagccaacctggcggcagcgcaaaagatg

SEQ ID NO: 117409 - DNA, 103 bp, Artificial Sequence
  Synthetic Polynucleotide
taatacgactcactataggggtgcccagatgagaaggcatatggctggtgaacagaggagacaccagatgtatgccttcaacctggcggcagcgcaaaagatg

SEQ ID NO: 117410 - DNA, 103 bp, Artificial Sequence
  Synthetic Polynucleotide
taatacgactcactatagggttagtagtaagtgcccagatgagaaggcataacagaggagaatgcctatgcatctgggcaacctggcggcagcgcaaaagatg

SEQ ID NO: 117411 - DNA, 103 bp, Artificial Sequence
  Synthetic Polynucleotide
taatacgactcactatagggagccaatcctgctgagggacgcgtgggctcaacagaggagagagcccatgcgtccctcaaacctggcggcagcgcaaaagatg

SEQ ID NO: 117412 - DNA, 103 bp, Artificial Sequence
  Synthetic Polynucleotide
taatacgactcactataggggggttgagacagccaatcctgctgagggacaacagaggagagtccctatgcaggattggaacctggcggcagcgcaaaagatg

SEQ ID NO: 117413 - DNA, 103 bp, Artificial Sequence
  Synthetic Polynucleotide
taatacgactcactatagggccctggctgggggttgagacagccaatcctaacagaggagaaggattatgtgtctcaacaacctggcggcagcgcaaaagatg

SEQ ID NO: 117414 - DNA, 103 bp, Artificial Sequence
  Synthetic Polynucleotide
taatacgactcactatagggttgatggtgaccctggctgggggttgagacaacagaggagagtctcaatgcccagccagaacctggcggcagcgcaaaagatg

SEQ ID NO: 117415 - DNA, 103 bp, Artificial Sequence
  Synthetic Polynucleotide
taatacgactcactatagggacattccattttgatggtgaccctggctggaacagaggagaccagccatggtcaccatcaacctggcggcagcgcaaaagatg

SEQ ID NO: 117416 - DNA, 103 bp, Artificial Sequence
  Synthetic Polynucleotide
taatacgactcactatagggcactcacaactgataaggcttccttaatagaacagaggagactattaatgaagccttataacctggcggcagcgcaaaagatg

SEQ ID NO: 117417 - DNA, 103 bp, Artificial Sequence
  Synthetic Polynucleotide
taatacgactcactatagggggctagggttacattccattttgatggtgaaacagaggagatcaccaatgaaatggaataacctggcggcagcgcaaaagatg

SEQ ID NO: 117418 - DNA, 103 bp, Artificial Sequence
  Synthetic Polynucleotide
taatacgactcactatagggccattcacctggctagggttacattccattaacagaggagaaatggaatgtaaccctagaacctggcggcagcgcaaaagatg

SEQ ID NO: 117419 - DNA, 103 bp, Artificial Sequence
  Synthetic Polynucleotide
taatacgactcactataggggttccttgagccattcacctggctagggttaacagaggagaaaccctatgcaggtgaataacctggcggcagcgcaaaagatg

SEQ ID NO: 117420 - DNA, 103 bp, Artificial Sequence
  Synthetic Polynucleotide
taatacgactcactatagggcatcaggagagttccttgagccattcacctaacagaggagaaggtgaatggctcaaggaaacctggcggcagcgcaaaagatg

SEQ ID NO: 117421 - DNA, 103 bp, Artificial Sequence
  Synthetic Polynucleotide
taatacgactcactatagggacactgcattcatcaggagagttccttgagaacagaggagactcaagatgctctcctgaaacctggcggcagcgcaaaagatg

SEQ ID NO: 117422 - DNA, 103 bp, Artificial Sequence
  Synthetic Polynucleotide
taatacgactcactataggggcctttggccacactgcattcatcaggagaaacagaggagatctcctatggaatgcagtaacctggcggcagcgcaaaagatg

SEQ ID NO: 117423 - DNA, 103 bp, Artificial Sequence
  Synthetic Polynucleotide
taatacgactcactatagggccatcttcccgcctttggccacactgcattaacagaggagaaatgcaatgtggccaaagaacctggcggcagcgcaaaagatg

SEQ ID NO: 117424 - DNA, 103 bp, Artificial Sequence
  Synthetic Polynucleotide
taatacgactcactataggggggctgcccaccatcttcccgcctttggccaacagaggagaggccaaatgcgggaagataacctggcggcagcgcaaaagatg

SEQ ID NO: 117425 - DNA, 103 bp, Artificial Sequence
  Synthetic Polynucleotide
taatacgactcactatagggaacggtgtctgggctgcccaccatcttcccaacagaggagagggaagatggtgggcagcaacctggcggcagcgcaaaagatg

SEQ ID NO: 117426 - DNA, 103 bp, Artificial Sequence
  Synthetic Polynucleotide
taatacgactcactatagggagttcatcccaacggtgtctgggctgcccaaacagaggagatgggcaatgcagacaccgaacctggcggcagcgcaaaagatg

SEQ ID NO: 117427 - DNA, 103 bp, Artificial Sequence
  Synthetic Polynucleotide
taatacgactcactataggggactggtcctcactcacaactgataaggctaacagaggagaagccttatgagttgtgagaacctggcggcagcgcaaaagatg

SEQ ID NO: 117428 - DNA, 103 bp, Artificial Sequence
  Synthetic Polynucleotide
taatacgactcactatagggtagctgccgtagttcatcccaacggtgtctaacagaggagaagacacatgtgggatgaaaacctggcggcagcgcaaaagatg

SEQ ID NO: 117429 - DNA, 103 bp, Artificial Sequence
  Synthetic Polynucleotide
taatacgactcactatagggctcctccatgtagctgccgtagttcatcccaacagaggagagggatgatgtacggcagcaacctggcggcagcgcaaaagatg

SEQ ID NO: 117430 - DNA, 103 bp, Artificial Sequence
  Synthetic Polynucleotide
taatacgactcactataggggcatgtgcttctcctccatgtagctgccgtaacagaggagaacggcaatgacatggaggaacctggcggcagcgcaaaagatg

SEQ ID NO: 117431 - DNA, 103 bp, Artificial Sequence
  Synthetic Polynucleotide
taatacgactcactatagggtttgggggtggcatgtgcttctcctccatgaacagaggagacatggaatggaagcacataacctggcggcagcgcaaaagatg

SEQ ID NO: 117432 - DNA, 103 bp, Artificial Sequence
  Synthetic Polynucleotide
taatacgactcactatagggcgtggtcatgtttgggggtggcatgtgcttaacagaggagaaagcacatgccacccccaaacctggcggcagcgcaaaagatg

SEQ ID NO: 117433 - DNA, 103 bp, Artificial Sequence
  Synthetic Polynucleotide
taatacgactcactatagggtgcgctcgttcgtggtcatgtttgggggtgaacagaggagacaccccatgacatgaccaaacctggcggcagcgcaaaagatg

SEQ ID NO: 117434 - DNA, 103 bp, Artificial Sequence
  Synthetic Polynucleotide
taatacgactcactatagggacgataactctgcgctcgttcgtggtcatgaacagaggagacatgacatggaacgagcgaacctggcggcagcgcaaaagatg

SEQ ID NO: 117435 - DNA, 103 bp, Artificial Sequence
  Synthetic Polynucleotide
taatacgactcactatagggatctgctggcacgataactctgcgctcgttaacagaggagaaacgagatgagagttatcaacctggcggcagcgcaaaagatg

SEQ ID NO: 117436 - DNA, 103 bp, Artificial Sequence
  Synthetic Polynucleotide
taatacgactcactatagggatagcgtaggatctgctggcacgataactcaacagaggagagagttaatgtgccagcagaacctggcggcagcgcaaaagatg

SEQ ID NO: 117437 - DNA, 103 bp, Artificial Sequence
  Synthetic Polynucleotide
taatacgactcactatagggtctgtactccatagcgtaggatctgctggcaacagaggagagccagcatgtcctacgctaacctggcggcagcgcaaaagatg

SEQ ID NO: 117438 - DNA, 103 bp, Artificial Sequence
  Synthetic Polynucleotide
taatacgactcactatagggctcaaacaacgactggtcctcactcacaacaacagaggagagttgtgatggaggaccagaacctggcggcagcgcaaaagatg

SEQ ID NO: 117439 - DNA, 103 bp, Artificial Sequence
  Synthetic Polynucleotide
taatacgactcactatagggccgcacatggtctgtactccatagcgtaggaacagaggagacctacgatgtggagtacaaacctggcggcagcgcaaaagatg

SEQ ID NO: 117440 - DNA, 103 bp, Artificial Sequence
  Synthetic Polynucleotide
taatacgactcactatagggccagccactgccgcacatggtctgtactccaacagaggagaggagtaatgaccatgtgcaacctggcggcagcgcaaaagatg

SEQ ID NO: 117441 - DNA, 103 bp, Artificial Sequence
  Synthetic Polynucleotide
taatacgactcactatagggaccgcccactccagccactgccgcacatggaacagaggagaccatgtatggcagtggctaacctggcggcagcgcaaaagatg

SEQ ID NO: 117442 - DNA, 103 bp, Artificial Sequence
  Synthetic Polynucleotide
taatacgactcactatagggatattctttcaccgcccactccagccactgaacagaggagacagtggatggagtgggcgaacctggcggcagcgcaaaagatg

SEQ ID NO: 117443 - DNA, 103 bp, Artificial Sequence
  Synthetic Polynucleotide
taatacgactcactatagggctggaaggccatattctttcaccgcccactaacagaggagaagtgggatgtgaaagaataacctggcggcagcgcaaaagatg

SEQ ID NO: 117444 - DNA, 103 bp, Artificial Sequence
  Synthetic Polynucleotide
taatacgactcactatagggatgttgacgtctggaaggccatattctttcaacagaggagagaaagaatgtggccttccaacctggcggcagcgcaaaagatg

SEQ ID NO: 117445 - DNA, 103 bp, Artificial Sequence
  Synthetic Polynucleotide
taatacgactcactataggggaataacaagatgttgacgtctggaaggccaacagaggagaggccttatggacgtcaacaacctggcggcagcgcaaaagatg

SEQ ID NO: 117446 - DNA, 103 bp, Artificial Sequence
  Synthetic Polynucleotide
taatacgactcactatagggcgatgttctggaataacaagatgttgacgtaacagaggagaacgtcaatgtcttgttataacctggcggcagcgcaaaagatg

SEQ ID NO: 117447 - DNA, 103 bp, Artificial Sequence
  Synthetic Polynucleotide
taatacgactcactatagggtccttcccatcgatgttctggaataacaagaacagaggagacttgttatgccagaacataacctggcggcagcgcaaaagatg

SEQ ID NO: 117448 - DNA, 103 bp, Artificial Sequence
  Synthetic Polynucleotide
taatacgactcactatagggcttgcacagttccttcccatcgatgttctgaacagaggagacagaacatggatgggaagaacctggcggcagcgcaaaagatg

SEQ ID NO: 117449 - DNA, 103 bp, Artificial Sequence
  Synthetic Polynucleotide
taatacgactcactatagggcgtaggcacactcaaacaacgactggtcctaacagaggagaaggaccatgcgttgtttgaacctggcggcagcgcaaaagatg

SEQ ID NO: 117450 - DNA, 103 bp, Artificial Sequence
  Synthetic Polynucleotide
taatacgactcactatagggccttggtcatcttgcacagttccttcccataacagaggagaatgggaatgaactgtgcaaacctggcggcagcgcaaaagatg

SEQ ID NO: 117451 - DNA, 103 bp, Artificial Sequence
  Synthetic Polynucleotide
taatacgactcactatagggtggaagtcgtccttggtcatcttgcacagtaacagaggagaactgtgatggatgaccaaaacctggcggcagcgcaaaagatg

SEQ ID NO: 117452 - DNA, 103 bp, Artificial Sequence
  Synthetic Polynucleotide
taatacgactcactatagggggtgagcctctggaagtcgtccttggtcataacagaggagaatgaccatggacgacttcaacctggcggcagcgcaaaagatg

SEQ ID NO: 117453 - DNA, 103 bp, Artificial Sequence
  Synthetic Polynucleotide
taatacgactcactatagggtgtagctgggggtgagcctctggaagtcgtaacagaggagaacgactatgagaggctcaaacctggcggcagcgcaaaagatg

SEQ ID NO: 117454 - DNA, 103 bp, Artificial Sequence
  Synthetic Polynucleotide
taatacgactcactatagggatgtcggcgttgtagctgggggtgagcctcaacagaggagagaggctatgccccagctaaacctggcggcagcgcaaaagatg

SEQ ID NO: 117455 - DNA, 103 bp, Artificial Sequence
  Synthetic Polynucleotide
taatacgactcactatagggtgagagaaggatgtcggcgttgtagctgggaacagaggagacccagcatgaacgccgacaacctggcggcagcgcaaaagatg

SEQ ID NO: 117456 - DNA, 103 bp, Artificial Sequence
  Synthetic Polynucleotide
taatacgactcactatagggagtggagatgtgagagaaggatgtcggcgtaacagaggagaacgccgatgtccttctctaacctggcggcagcgcaaaagatg

SEQ ID NO: 117457 - DNA, 103 bp, Artificial Sequence
  Synthetic Polynucleotide
taatacgactcactatagggtctctgaggtagtggagatgtgagagaaggaacagaggagaccttctatgacatctccaaacctggcggcagcgcaaaagatg

SEQ ID NO: 117458 - DNA, 103 bp, Artificial Sequence
  Synthetic Polynucleotide
taatacgactcactatagggaagaggagtctctctgaggtagtggagatgaacagaggagacatctcatgtacctcagaaacctggcggcagcgcaaaagatg

SEQ ID NO: 117459 - DNA, 103 bp, Artificial Sequence
  Synthetic Polynucleotide
taatacgactcactatagggtcaaatgtggaagaggagtctctctgaggtaacagaggagaacctcaatgagactcctcaacctggcggcagcgcaaaagatg

SEQ ID NO: 117460 - DNA, 103 bp, Artificial Sequence
  Synthetic Polynucleotide
taatacgactcactatagggtgtggcgttccgtaggcacactcaaacaacaacagaggagagttgttatggtgtgcctaaacctggcggcagcgcaaaagatg

SEQ ID NO: 117461 - DNA, 103 bp, Artificial Sequence
  Synthetic Polynucleotide
taatacgactcactatagggtcatctgaagtcaaatgtggaagaggagtcaacagaggagagactccatgtccacatttaacctggcggcagcgcaaaagatg

SEQ ID NO: 117462 - DNA, 103 bp, Artificial Sequence
  Synthetic Polynucleotide
taatacgactcactatagggtttatcaacatcatctgaagtcaaatgtggaacagaggagaccacatatgacttcagataacctggcggcagcgcaaaagatg

SEQ ID NO: 117463 - DNA, 103 bp, Artificial Sequence
  Synthetic Polynucleotide
taatacgactcactatagggtttgtaaggctttatcaacatcatctgaagaacagaggagacttcagatgatgttgataaacctggcggcagcgcaaaagatg

SEQ ID NO: 117464 - DNA, 103 bp, Artificial Sequence
  Synthetic Polynucleotide
taatacgactcactatagggcgtggagagttttgtaaggctttatcaacaaacagaggagatgttgaatgagccttacaaacctggcggcagcgcaaaagatg

SEQ ID NO: 117465 - DNA, 103 bp, Artificial Sequence
  Synthetic Polynucleotide
taatacgactcactatagggatgcattaaccgtggagagttttgtaaggcaacagaggagagccttaatgaactctccaaacctggcggcagcgcaaaagatg

SEQ ID NO: 117466 - DNA, 103 bp, Artificial Sequence
  Synthetic Polynucleotide
taatacgactcactatagggtgtttctagcatgcattaaccgtggagagtaacagaggagaactctcatgggttaatgcaacctggcggcagcgcaaaagatg

SEQ ID NO: 117467 - DNA, 103 bp, Artificial Sequence
  Synthetic Polynucleotide
taatacgactcactataggggcaccccctgtgtttctagcatgcattaacaacagaggagagttaatatgtgctagaaaaacctggcggcagcgcaaaagatg

SEQ ID NO: 117468 - DNA, 103 bp, Artificial Sequence
  Synthetic Polynucleotide
taatacgactcactatagggaataaaagctgcaccccctgtgtttctagcaacagaggagagctagaatgacagggggtaacctggcggcagcgcaaaagatg

SEQ ID NO: 117469 - DNA, 103 bp, Artificial Sequence
  Synthetic Polynucleotide
taatacgactcactatagggtatttgggaaaataaaagctgcaccccctgaacagaggagacaggggatgcagcttttaaacctggcggcagcgcaaaagatg

SEQ ID NO: 117470 - DNA, 103 bp, Artificial Sequence
  Synthetic Polynucleotide
taatacgactcactatagggtatactgaagtatttgggaaaataaaagctaacagaggagaagctttatgtttcccaaaaacctggcggcagcgcaaaagatg

SEQ ID NO: 117471 - DNA, 103 bp, Artificial Sequence
  Synthetic Polynucleotide
taatacgactcactatagggcttagccaggtgtggcgttccgtaggcacaaacagaggagatgtgccatgggaacgccaaacctggcggcagcgcaaaagatg

SEQ ID NO: 117472 - DNA, 103 bp, Artificial Sequence
  Synthetic Polynucleotide
taatacgactcactatagggagcttcaggatatactgaagtatttgggaaaacagaggagattcccaatgacttcagtaaacctggcggcagcgcaaaagatg

SEQ ID NO: 117473 - DNA, 103 bp, Artificial Sequence
  Synthetic Polynucleotide
taatacgactcactatagggttctttgcgtagcttcaggatatactgaagaacagaggagacttcagatgatcctgaagaacctggcggcagcgcaaaagatg

SEQ ID NO: 117474 - DNA, 103 bp, Artificial Sequence
  Synthetic Polynucleotide
taatacgactcactatagggctagttgtaattctttgcgtagcttcaggaaacagaggagatcctgaatgtacgcaaagaacctggcggcagcgcaaaagatg

SEQ ID NO: 117475 - DNA, 103 bp, Artificial Sequence
  Synthetic Polynucleotide
taatacgactcactatagggtaaatctggcctagttgtaattctttgcgtaacagaggagaacgcaaatgattacaactaacctggcggcagcgcaaaagatg

SEQ ID NO: 117476 - DNA, 103 bp, Artificial Sequence
  Synthetic Polynucleotide
taatacgactcactataggggctcatatggtaaatctggcctagttgtaaaacagaggagattacaaatgggccagattaacctggcggcagcgcaaaagatg

SEQ ID NO: 117477 - DNA, 103 bp, Artificial Sequence
  Synthetic Polynucleotide
taatacgactcactatagggctcctggggggctcatatggtaaatctggcaacagaggagagccagaatgaccatatgaaacctggcggcagcgcaaaagatg

SEQ ID NO: 117478 - DNA, 103 bp, Artificial Sequence
  Synthetic Polynucleotide
taatacgactcactatagggccaggctgatctcctggggggctcatatggaacagaggagaccatatatgccccccaggaacctggcggcagcgcaaaagatg

SEQ ID NO: 117479 - DNA, 103 bp, Artificial Sequence
  Synthetic Polynucleotide
taatacgactcactatagggcgtgaccggtccaggctgatctcctgggggaacagaggagacccccaatggatcagcctaacctggcggcagcgcaaaagatg

SEQ ID NO: 117480 - DNA, 103 bp, Artificial Sequence
  Synthetic Polynucleotide
taatacgactcactataggggtggggtggccgtgaccggtccaggctgataacagaggagaatcagcatggaccggtcaaacctggcggcagcgcaaaagatg

SEQ ID NO: 117481 - DNA, 103 bp, Artificial Sequence
  Synthetic Polynucleotide
taatacgactcactatagggcgactggggcgtggggtggccgtgaccggtaacagaggagaaccggtatgggccaccccaacctggcggcagcgcaaaagatg

SEQ ID NO: 117482 - DNA, 103 bp, Artificial Sequence
  Synthetic Polynucleotide
taatacgactcactatagggtcatctctgtcttagccaggtgtggcgttcaacagaggagagaacgcatgacctggctaaacctggcggcagcgcaaaagatg

SEQ ID NO: 117483 - DNA, 103 bp, Artificial Sequence
  Synthetic Polynucleotide
taatacgactcactataggggagcagctttcgactggggcgtggggtggcaacagaggagagccaccatgcgccccagtaacctggcggcagcgcaaaagatg

SEQ ID NO: 117484 - DNA, 103 bp, Artificial Sequence
  Synthetic Polynucleotide
taatacgactcactatagggggagatggttgagcagctttcgactggggcaacagaggagagccccaatggaaagctgcaacctggcggcagcgcaaaagatg

SEQ ID NO: 117485 - DNA, 103 bp, Artificial Sequence
  Synthetic Polynucleotide
taatacgactcactatagggcactgtggaaggagatggttgagcagctttaacagaggagaaaagctatgcaaccatctaacctggcggcagcgcaaaagatg

SEQ ID NO: 117486 - DNA, 103 bp, Artificial Sequence
  Synthetic Polynucleotide
taatacgactcactatagggcagttttgggcactgtggaaggagatggttaacagaggagaaaccatatgcttccacagaacctggcggcagcgcaaaagatg

SEQ ID NO: 117487 - DNA, 103 bp, Artificial Sequence
  Synthetic Polynucleotide
taatacgactcactatagggcgctggtcttcagttttgggcactgtggaaaacagaggagattccacatggcccaaaacaacctggcggcagcgcaaaagatg

SEQ ID NO: 117488 - DNA, 103 bp, Artificial Sequence
  Synthetic Polynucleotide
taatacgactcactatagggtaactgaggacgctggtcttcagttttgggaacagaggagacccaaaatggaagaccagaacctggcggcagcgcaaaagatg

SEQ ID NO: 117489 - DNA, 103 bp, Artificial Sequence
  Synthetic Polynucleotide
taatacgactcactataggggataaggatctaactgaggacgctggtcttaacagaggagaaagaccatggtcctcagtaacctggcggcagcgcaaaagatg

SEQ ID NO: 117490 - DNA, 103 bp, Artificial Sequence
  Synthetic Polynucleotide
taatacgactcactatagggccaagaatctgataaggatctaactgaggaaacagaggagatcctcaatgagatccttaaacctggcggcagcgcaaaagatg

SEQ ID NO: 117491 - DNA, 103 bp, Artificial Sequence
  Synthetic Polynucleotide
taatacgactcactatagggacttgttggtccaagaatctgataaggatcaacagaggagagatcctatgcagattcttaacctggcggcagcgcaaaagatg

SEQ ID NO: 117492 - DNA, 103 bp, Artificial Sequence
  Synthetic Polynucleotide
taatacgactcactatagggcaaggcggctacttgttggtccaagaatctaacagaggagaagattcatggaccaacaaaacctggcggcagcgcaaaagatg

SEQ ID NO: 117493 - DNA, 103 bp, Artificial Sequence
  Synthetic Polynucleotide
taatacgactcactataggggaggacgcggtcatctctgtcttagccaggaacagaggagacctggcatggacagagataacctggcggcagcgcaaaagatg

SEQ ID NO: 117494 - DNA, 103 bp, Artificial Sequence
  Synthetic Polynucleotide
taatacgactcactatagggcctggatttgcaaggcggctacttgttggtaacagaggagaaccaacatgtagccgcctaacctggcggcagcgcaaaagatg

SEQ ID NO: 117495 - DNA, 103 bp, Artificial Sequence
  Synthetic Polynucleotide
taatacgactcactatagggctggccactgcctggatttgcaaggcggctaacagaggagaagccgcatggcaaatccaaacctggcggcagcgcaaaagatg

SEQ ID NO: 117496 - DNA, 103 bp, Artificial Sequence
  Synthetic Polynucleotide
taatacgactcactatagggaaagctggatctggccactgcctggatttgaacagaggagacaaatcatggcagtggccaacctggcggcagcgcaaaagatg

SEQ ID NO: 117497 - DNA, 103 bp, Artificial Sequence
  Synthetic Polynucleotide
taatacgactcactatagggaggaactgccaaagctggatctggccactgaacagaggagacagtggatggatccagctaacctggcggcagcgcaaaagatg

SEQ ID NO: 117498 - DNA, 103 bp, Artificial Sequence
  Synthetic Polynucleotide
taatacgactcactataggggagctccaggaggaactgccaaagctggataacagaggagaatccagatgtggcagttcaacctggcggcagcgcaaaagatg

SEQ ID NO: 117499 - DNA, 103 bp, Artificial Sequence
  Synthetic Polynucleotide
taatacgactcactatagggtgtccgacaggagctccaggaggaactgccaacagaggagaggcagtatgtcctggagcaacctggcggcagcgcaaaagatg

SEQ ID NO: 117500 - DNA, 103 bp, Artificial Sequence
  Synthetic Polynucleotide
taatacgactcactataggggagttggagctgtccgacaggagctccaggaacagaggagacctggaatgcctgtcggaaacctggcggcagcgcaaaagatg

SEQ ID NO: 117501 - DNA, 103 bp, Artificial Sequence
  Synthetic Polynucleotide
taatacgactcactataggggatgcagctggagttggagctgtccgacagaacagaggagactgtcgatgagctccaacaacctggcggcagcgcaaaagatg

SEQ ID NO: 117502 - DNA, 103 bp, Artificial Sequence
  Synthetic Polynucleotide
taatacgactcactatagggcttcccaggtgatgcagctggagttggagcaacagaggagagctccaatgccagctgcaaacctggcggcagcgcaaaagatg

SEQ ID NO: 117503 - DNA, 103 bp, Artificial Sequence
  Synthetic Polynucleotide
taatacgactcactatagggccgttggtgccttcccaggtgatgcagctgaacagaggagacagctgatgcacctgggaaacctggcggcagcgcaaaagatg

SEQ ID NO: 117504 - DNA, 103 bp, Artificial Sequence
  Synthetic Polynucleotide
taatacgactcactatagggagatgctttggtgtggagggtcatggtcataacagaggagaatgaccatgaccctccacaacctggcggcagcgcaaaagatg

SEQ ID NO: 117505 - DNA, 103 bp, Artificial Sequence
  Synthetic Polynucleotide
taatacgactcactataggggcccaggggccgctccagggggatcttgagaacagaggagactcaagatgcccctggagaacctggcggcagcgcaaaagatg

SEQ ID NO: 117506 - DNA, 103 bp, Artificial Sequence
  Synthetic Polynucleotide
taatacgactcactatagggagcttcactgaagggtctggtaggatcataaacagaggagatatgatatgaccagacccaacctggcggcagcgcaaaagatg

SEQ ID NO: 117507 - DNA, 103 bp, Artificial Sequence
  Synthetic Polynucleotide
taatacgactcactatagggccatcatcgaagcttcactgaagggtctggaacagaggagaccagacatgtcagtgaagaacctggcggcagcgcaaaagatg

SEQ ID NO: 117508 - DNA, 103 bp, Artificial Sequence
  Synthetic Polynucleotide
taatacgactcactataggggtcagtaagcccatcatcgaagcttcactgaacagaggagacagtgaatgttcgatgataacctggcggcagcgcaaaagatg

SEQ ID NO: 117509 - DNA, 103 bp, Artificial Sequence
  Synthetic Polynucleotide
taatacgactcactatagggtgccaggttggtcagtaagcccatcatcgaaacagaggagatcgatgatgggcttactgaacctggcggcagcgcaaaagatg

SEQ ID NO: 117510 - DNA, 103 bp, Artificial Sequence
  Synthetic Polynucleotide
taatacgactcactataggggctccctgtctgccaggttggtcagtaagcaacagaggagagcttacatgccaacctggaacctggcggcagcgcaaaagatg

SEQ ID NO: 117511 - DNA, 103 bp, Artificial Sequence
  Synthetic Polynucleotide
taatacgactcactatagggatgtgaaccagctccctgtctgccaggttgaacagaggagacaacctatgagacagggaaacctggcggcagcgcaaaagatg

SEQ ID NO: 117512 - DNA, 103 bp, Artificial Sequence
  Synthetic Polynucleotide
taatacgactcactatagggccagttgatcatgtgaaccagctccctgtcaacagaggagagacaggatgctggttcacaacctggcggcagcgcaaaagatg

SEQ ID NO: 117513 - DNA, 103 bp, Artificial Sequence
  Synthetic Polynucleotide
taatacgactcactatagggccctcttcgcccagttgatcatgtgaaccaaacagaggagatggttcatgtgatcaactaacctggcggcagcgcaaaagatg

SEQ ID NO: 117514 - DNA, 103 bp, Artificial Sequence
  Synthetic Polynucleotide
taatacgactcactatagggaagcctggcaccctcttcgcccagttgatcaacagaggagagatcaaatgggcgaagagaacctggcggcagcgcaaaagatg

SEQ ID NO: 117515 - DNA, 103 bp, Artificial Sequence
  Synthetic Polynucleotide
taatacgactcactatagggcaaatccacaaagcctggcaccctcttcgcaacagaggagagcgaagatggtgccaggcaacctggcggcagcgcaaaagatg

SEQ ID NO: 117516 - DNA, 103 bp, Artificial Sequence
  Synthetic Polynucleotide
taatacgactcactatagggggtacacctcgcccaggggccgctccagggaacagaggagaccctggatgggcccctggaacctggcggcagcgcaaaagatg

SEQ ID NO: 117517 - DNA, 103 bp, Artificial Sequence
  Synthetic Polynucleotide
taatacgactcactatagggcatggagggtcaaatccacaaagcctggcaaacagaggagatgccagatgttgtggattaacctggcggcagcgcaaaagatg

SEQ ID NO: 117518 - DNA, 103 bp, Artificial Sequence
  Synthetic Polynucleotide
taatacgactcactatagggtggacctgatcatggagggtcaaatccacaaacagaggagatgtggaatggaccctccaaacctggcggcagcgcaaaagatg

SEQ ID NO: 117519 - DNA, 103 bp, Artificial Sequence
  Synthetic Polynucleotide
taatacgactcactatagggttctagaaggtggacctgatcatggagggtaacagaggagaaccctcatggatcaggtcaacctggcggcagcgcaaaagatg

SEQ ID NO: 117520 - DNA, 103 bp, Artificial Sequence
  Synthetic Polynucleotide
taatacgactcactataggggccaggcacattctagaaggtggacctgataacagaggagaatcaggatgaccttctagaacctggcggcagcgcaaaagatg

SEQ ID NO: 117521 - DNA, 103 bp, Artificial Sequence
  Synthetic Polynucleotide
taatacgactcactatagggaggatctctagccaggcacattctagaaggaacagaggagaccttctatgatgtgcctgaacctggcggcagcgcaaaagatg

SEQ ID NO: 117522 - DNA, 103 bp, Artificial Sequence
  Synthetic Polynucleotide
taatacgactcactatagggaccaatcatcaggatctctagccaggcacaaacagaggagatgtgccatgctagagatcaacctggcggcagcgcaaaagatg

SEQ ID NO: 117523 - DNA, 103 bp, Artificial Sequence
  Synthetic Polynucleotide
taatacgactcactataggggccagacgagaccaatcatcaggatctctaaacagaggagatagagaatgtgatgattgaacctggcggcagcgcaaaagatg

SEQ ID NO: 117524 - DNA, 103 bp, Artificial Sequence
  Synthetic Polynucleotide
taatacgactcactatagggtccatggagcgccagacgagaccaatcatcaacagaggagagatgatatgtctcgtctgaacctggcggcagcgcaaaagatg

SEQ ID NO: 117525 - DNA, 103 bp, Artificial Sequence
  Synthetic Polynucleotide
taatacgactcactatagggccctgggtgctccatggagcgccagacgagaacagaggagactcgtcatgcgctccatgaacctggcggcagcgcaaaagatg

SEQ ID NO: 117526 - DNA, 103 bp, Artificial Sequence
  Synthetic Polynucleotide
taatacgactcactatagggacagtagcttccctgggtgctccatggagcaacagaggagagctccaatgagcacccagaacctggcggcagcgcaaaagatg

SEQ ID NO: 117527 - DNA, 103 bp, Artificial Sequence
  Synthetic Polynucleotide
taatacgactcactatagggctgctgtccaggtacacctcgcccaggggcaacagaggagagcccctatgcgaggtgtaaacctggcggcagcgcaaaagatg

SEQ ID NO: 117528 - DNA, 103 bp, Artificial Sequence
  Synthetic Polynucleotide
taatacgactcactatagggttaggagcaaacagtagcttccctgggtgcaacagaggagagcacccatggaagctactaacctggcggcagcgcaaaagatg

SEQ ID NO: 117529 - DNA, 103 bp, Artificial Sequence
  Synthetic Polynucleotide
taatacgactcactatagggcaagagcaagttaggagcaaacagtagcttaacagaggagaaagctaatgtttgctcctaacctggcggcagcgcaaaagatg

SEQ ID NO: 117530 - DNA, 103 bp, Artificial Sequence
  Synthetic Polynucleotide
taatacgactcactatagggggttcctgtccaagagcaagttaggagcaaaacagaggagattgctcatgacttgctctaacctggcggcagcgcaaaagatg

SEQ ID NO: 117531 - DNA, 103 bp, Artificial Sequence
  Synthetic Polynucleotide
taatacgactcactatagggcattttccctggttcctgtccaagagcaagaacagaggagacttgctatgggacaggaaaacctggcggcagcgcaaaagatg

SEQ ID NO: 117532 - DNA, 103 bp, Artificial Sequence
  Synthetic Polynucleotide
taatacgactcactataggggccctctacacattttccctggttcctgtcaacagaggagagacaggatgcagggaaaaaacctggcggcagcgcaaaagatg

SEQ ID NO: 117533 - DNA, 103 bp, Artificial Sequence
  Synthetic Polynucleotide
taatacgactcactatagggtctccaccatgccctctacacattttccctaacagaggagaagggaaatggtgtagaggaacctggcggcagcgcaaaagatg

SEQ ID NO: 117534 - DNA, 103 bp, Artificial Sequence
  Synthetic Polynucleotide
taatacgactcactatagggatgtcgaagatctccaccatgccctctacaaacagaggagatgtagaatgcatggtggaaacctggcggcagcgcaaaagatg

SEQ ID NO: 117535 - DNA, 103 bp, Artificial Sequence
  Synthetic Polynucleotide
taatacgactcactatagggagccagcagcatgtcgaagatctccaccataacagaggagaatggtgatgatcttcgacaacctggcggcagcgcaaaagatg

SEQ ID NO: 117536 - DNA, 103 bp, Artificial Sequence
  Synthetic Polynucleotide
taatacgactcactataggggagatgatgtagccagcagcatgtcgaagaaacagaggagatcttcgatgtgctgctggaacctggcggcagcgcaaaagatg

SEQ ID NO: 117537 - DNA, 103 bp, Artificial Sequence
  Synthetic Polynucleotide
taatacgactcactatagggatgcggaaccgagatgatgtagccagcagcaacagaggagagctgctatgtacatcatcaacctggcggcagcgcaaaagatg

SEQ ID NO: 117538 - DNA, 103 bp, Artificial Sequence
  Synthetic Polynucleotide
taatacgactcactatagggggcgggcttgctgctgtccaggtacacctcaacagaggagagaggtgatgctggacagcaacctggcggcagcgcaaaagatg

SEQ ID NO: 117539 - DNA, 103 bp, Artificial Sequence
  Synthetic Polynucleotide
taatacgactcactatagggcagattcatcatgcggaaccgagatgatgtaacagaggagaacatcaatgcggttccgcaacctggcggcagcgcaaaagatg

SEQ ID NO: 117540 - DNA, 103 bp, Artificial Sequence
  Synthetic Polynucleotide
taatacgactcactatagggcctctccctgcagattcatcatgcggaaccaacagaggagaggttccatgtgatgaatcaacctggcggcagcgcaaaagatg

SEQ ID NO: 117541 - DNA, 103 bp, Artificial Sequence
  Synthetic Polynucleotide
taatacgactcactatagggcacacaaactcctctccctgcagattcatcaacagaggagagatgaaatggcagggagaaacctggcggcagcgcaaaagatg

SEQ ID NO: 117542 - DNA, 103 bp, Artificial Sequence
  Synthetic Polynucleotide
taatacgactcactatagggagatttgaggcacacaaactcctctccctgaacagaggagacagggaatggagtttgtgaacctggcggcagcgcaaaagatg

SEQ ID NO: 117543 - DNA, 103 bp, Artificial Sequence
  Synthetic Polynucleotide
taatacgactcactataggggcaaaataatagatttgaggcacacaaactaacagaggagaagtttgatggcctcaaataacctggcggcagcgcaaaagatg

SEQ ID NO: 117544 - DNA, 103 bp, Artificial Sequence
  Synthetic Polynucleotide
taatacgactcactatagggccagaattaagcaaaataatagatttgaggaacagaggagacctcaaatgtattattttaacctggcggcagcgcaaaagatg

SEQ ID NO: 117545 - DNA, 103 bp, Artificial Sequence
  Synthetic Polynucleotide
taatacgactcactatagggtgtgtacactccagaattaagcaaaataataacagaggagaattattatgcttaattctaacctggcggcagcgcaaaagatg

SEQ ID NO: 117546 - DNA, 103 bp, Artificial Sequence
  Synthetic Polynucleotide
taatacgactcactatagggtggacagaaatgtgtacactccagaattaaaacagaggagattaattatggagtgtacaaacctggcggcagcgcaaaagatg

SEQ ID NO: 117547 - DNA, 103 bp, Artificial Sequence
  Synthetic Polynucleotide
taatacgactcactatagggttcagggtgctggacagaaatgtgtacactaacagaggagaagtgtaatgatttctgtcaacctggcggcagcgcaaaagatg

SEQ ID NO: 117548 - DNA, 103 bp, Artificial Sequence
  Synthetic Polynucleotide
taatacgactcactatagggttccagagacttcagggtgctggacagaaaaacagaggagatttctgatgagcaccctgaacctggcggcagcgcaaaagatg

SEQ ID NO: 117549 - DNA, 103 bp, Artificial Sequence
  Synthetic Polynucleotide
taatacgactcactatagggagttgtacacggcgggcttgctgctgtccaaacagaggagatggacaatggcaagcccgaacctggcggcagcgcaaaagatg

SEQ ID NO: 117550 - DNA, 103 bp, Artificial Sequence
  Synthetic Polynucleotide
taatacgactcactatagggggtccttctcttccagagacttcagggtgcaacagaggagagcacccatgagtctctggaacctggcggcagcgcaaaagatg

SEQ ID NO: 117551 - DNA, 103 bp, Artificial Sequence
  Synthetic Polynucleotide
taatacgactcactatagggcggtggatatggtccttctcttccagagacaacagaggagagtctctatgagagaaggaaacctggcggcagcgcaaaagatg

SEQ ID NO: 117552 - DNA, 103 bp, Artificial Sequence
  Synthetic Polynucleotide
taatacgactcactataggggtccaggactcggtggatatggtccttctcaacagaggagagagaagatgcatatccacaacctggcggcagcgcaaaagatg

SEQ ID NO: 117553 - DNA, 103 bp, Artificial Sequence
  Synthetic Polynucleotide
taatacgactcactatagggctgtgatcttgtccaggactcggtggatataacagaggagaatatccatggagtcctggaacctggcggcagcgcaaaagatg

SEQ ID NO: 117554 - DNA, 103 bp, Artificial Sequence
  Synthetic Polynucleotide
taatacgactcactatagggatcaaagtgtctgtgatcttgtccaggactaacagaggagaagtcctatgcaagatcacaacctggcggcagcgcaaaagatg

SEQ ID NO: 117555 - DNA, 103 bp, Artificial Sequence
  Synthetic Polynucleotide
taatacgactcactatagggcatcaggtggatcaaagtgtctgtgatcttaacagaggagaaagatcatggacactttgaacctggcggcagcgcaaaagatg

SEQ ID NO: 117556 - DNA, 103 bp, Artificial Sequence
  Synthetic Polynucleotide
taatacgactcactatagggctgccttggccatcaggtggatcaaagtgtaacagaggagaacacttatgtccacctgaaacctggcggcagcgcaaaagatg

SEQ ID NO: 117557 - DNA, 103 bp, Artificial Sequence
  Synthetic Polynucleotide
taatacgactcactatagggagggtcaggcctgccttggccatcaggtggaacagaggagaccacctatgggccaaggcaacctggcggcagcgcaaaagatg

SEQ ID NO: 117558 - DNA, 103 bp, Artificial Sequence
  Synthetic Polynucleotide
taatacgactcactatagggctgctgctgcagggtcaggcctgccttggcaacagaggagagccaagatgggcctgaccaacctggcggcagcgcaaaagatg

SEQ ID NO: 117559 - DNA, 103 bp, Artificial Sequence
  Synthetic Polynucleotide
taatacgactcactataggggccgctggtgctgctgctgcagggtcaggcaacagaggagagcctgaatgtgcagcagcaacctggcggcagcgcaaaagatg

SEQ ID NO: 117560 - DNA, 103 bp, Artificial Sequence
  Synthetic Polynucleotide
taatacgactcactatagggccctcggggtagttgtacacggcgggcttgaacagaggagacaagccatgcgtgtacaaaacctggcggcagcgcaaaagatg

SEQ ID NO: 117561 - DNA, 103 bp, Artificial Sequence
  Synthetic Polynucleotide
taatacgactcactatagggagctgggccagccgctggtgctgctgctgcaacagaggagagcagcaatggcaccagcgaacctggcggcagcgcaaaagatg

SEQ ID NO: 117562 - DNA, 103 bp, Artificial Sequence
  Synthetic Polynucleotide
taatacgactcactataggggatgaggaggagctgggccagccgctggtgaacagaggagacaccagatgctggcccagaacctggcggcagcgcaaaagatg

SEQ ID NO: 117563 - DNA, 103 bp, Artificial Sequence
  Synthetic Polynucleotide
taatacgactcactatagggtgtgggagaggatgaggaggagctgggccaaacagaggagatggcccatgtcctcctcaaacctggcggcagcgcaaaagatg

SEQ ID NO: 117564 - DNA, 103 bp, Artificial Sequence
  Synthetic Polynucleotide
taatacgactcactatagggatgtgcctgatgtgggagaggatgaggaggaacagaggagacctcctatgcctctcccaaacctggcggcagcgcaaaagatg

SEQ ID NO: 117565 - DNA, 103 bp, Artificial Sequence
  Synthetic Polynucleotide
taatacgactcactatagggtttgttactcatgtgcctgatgtgggagagaacagaggagactctccatgatcaggcacaacctggcggcagcgcaaaagatg

SEQ ID NO: 117566 - DNA, 103 bp, Artificial Sequence
  Synthetic Polynucleotide
taatacgactcactataggggctccatgcctttgttactcatgtgcctgaaacagaggagatcaggcatgtgagtaacaaacctggcggcagcgcaaaagatg

SEQ ID NO: 117567 - DNA, 103 bp, Artificial Sequence
  Synthetic Polynucleotide
taatacgactcactatagggctgtacagatgctccatgcctttgttactcaacagaggagagagtaaatgaggcatggaaacctggcggcagcgcaaaagatg

SEQ ID NO: 117568 - DNA, 103 bp, Artificial Sequence
  Synthetic Polynucleotide
taatacgactcactataggggcacttcatgctgtacagatgctccatgccaacagaggagaggcatgatgcatctgtacaacctggcggcagcgcaaaagatg

SEQ ID NO: 117569 - DNA, 103 bp, Artificial Sequence
  Synthetic Polynucleotide
taatacgactcactatagggccacgttcttgcacttcatgctgtacagataacagaggagaatctgtatggcatgaagtaacctggcggcagcgcaaaagatg

SEQ ID NO: 117570 - DNA, 103 bp, Artificial Sequence
  Synthetic Polynucleotide
taatacgactcactatagggtagaggggcaccacgttcttgcacttcatgaacagaggagacatgaaatgcaagaacgtaacctggcggcagcgcaaaagatg

SEQ ID NO: 117571 - DNA, 103 bp, Artificial Sequence
  Synthetic Polynucleotide
taatacgactcactataggggtaggcggcgccctcggggtagttgtacacaacagaggagagtgtacatgtaccccgagaacctggcggcagcgcaaaagatg

SEQ ID NO: 117572 - DNA, 103 bp, Artificial Sequence
  Synthetic Polynucleotide
taatacgactcactatagggcagcaggtcatagaggggcaccacgttcttaacagaggagaaagaacatggtgcccctcaacctggcggcagcgcaaaagatg

SEQ ID NO: 117573 - DNA, 103 bp, Artificial Sequence
  Synthetic Polynucleotide
taatacgactcactataggggcatctccagcagcaggtcatagaggggcaaacagaggagatgccccatgatgacctgcaacctggcggcagcgcaaaagatg

SEQ ID NO: 117574 - DNA, 103 bp, Artificial Sequence
  Synthetic Polynucleotide
taatacgactcactatagggtgggcgtccagcatctccagcagcaggtcaaacagaggagatgacctatggctggagataacctggcggcagcgcaaaagatg

SEQ ID NO: 117575 - DNA, 103 bp, Artificial Sequence
  Synthetic Polynucleotide
taatacgactcactatagggatgtaggcggtgggcgtccagcatctccagaacagaggagactggagatgctggacgccaacctggcggcagcgcaaaagatg

SEQ ID NO: 117576 - DNA, 103 bp, Artificial Sequence
  Synthetic Polynucleotide
taatacgactcactatagggtagtgggcgcatgtaggcggtgggcgtccaaacagaggagatggacgatgaccgcctacaacctggcggcagcgcaaaagatg

SEQ ID NO: 117577 - DNA, 103 bp, Artificial Sequence
  Synthetic Polynucleotide
taatacgactcactatagggcctccacggctagtgggcgcatgtaggcggaacagaggagaccgcctatgtgcgcccacaacctggcggcagcgcaaaagatg

SEQ ID NO: 117578 - DNA, 103 bp, Artificial Sequence
  Synthetic Polynucleotide
taatacgactcactatagggcacggatgcccctccacggctagtgggcgcaacagaggagagcgcccatgagccgtggaaacctggcggcagcgcaaaagatg

SEQ ID NO: 117579 - DNA, 103 bp, Artificial Sequence
  Synthetic Polynucleotide
taatacgactcactatagggccgtctcctccacggatgcccctccacggcaacagaggagagccgtgatggggcatccgaacctggcggcagcgcaaaagatg

SEQ ID NO: 117580 - DNA, 103 bp, Artificial Sequence
  Synthetic Polynucleotide
taatacgactcactatagggtggctttggtccgtctcctccacggatgccaacagaggagaggcatcatgggaggagacaacctggcggcagcgcaaaagatg

SEQ ID NO: 117581 - DNA, 103 bp, Artificial Sequence
  Synthetic Polynucleotide
taatacgactcactatagggagtggccaagtggctttggtccgtctcctcaacagaggagagaggagatggaccaaagcaacctggcggcagcgcaaaagatg

SEQ ID NO: 117582 - DNA, 103 bp, Artificial Sequence
  Synthetic Polynucleotide
taatacgactcactatagggcgttgaactcgtaggcggcgccctcggggtaacagaggagaaccccgatggcgccgcctaacctggcggcagcgcaaaagatg

SEQ ID NO: 117583 - DNA, 103 bp, Artificial Sequence
  Synthetic Polynucleotide
taatacgactcactatagggtagagcccgcagtggccaagtggctttggtaacagaggagaaccaaaatgacttggccaaacctggcggcagcgcaaaagatg

SEQ ID NO: 117584 - DNA, 103 bp, Artificial Sequence
  Synthetic Polynucleotide
taatacgactcactatagggtgcgatgaagtagagcccgcagtggccaagaacagaggagacttggcatgtgcgggctcaacctggcggcagcgcaaaagatg

SEQ ID NO: 117585 - DNA, 103 bp, Artificial Sequence
  Synthetic Polynucleotide
taatacgactcactatagggttgcaaggaatgcgatgaagtagagcccgcaacagaggagagcgggcatgacttcatcgaacctggcggcagcgcaaaagatg

SEQ ID NO: 117586 - DNA, 103 bp, Artificial Sequence
  Synthetic Polynucleotide
taatacgactcactatagggtgtaatacttttgcaaggaatgcgatgaagaacagaggagacttcatatgattccttgcaacctggcggcagcgcaaaagatg

SEQ ID NO: 117587 - DNA, 103 bp, Artificial Sequence
  Synthetic Polynucleotide
taatacgactcactatagggtcccccgtgatgtaatacttttgcaaggaaaacagaggagattccttatgaaagtattaaacctggcggcagcgcaaaagatg

SEQ ID NO: 117588 - DNA, 103 bp, Artificial Sequence
  Synthetic Polynucleotide
taatacgactcactatagggaccctctgcctcccccgtgatgtaatacttaacagaggagaaagtatatgatcacggggaacctggcggcagcgcaaaagatg

SEQ ID NO: 117589 - DNA, 103 bp, Artificial Sequence
  Synthetic Polynucleotide
taatacgactcactatagggtggcagggaaaccctctgcctcccccgtgaaacagaggagatcacggatgaggcagaggaacctggcggcagcgcaaaagatg

SEQ ID NO: 117590 - DNA, 103 bp, Artificial Sequence
  Synthetic Polynucleotide
taatacgactcactataggggcggccgcggcgttgaactcgtaggcggcgaacagaggagacgccgcatgcgagttcaaaacctggcggcagcgcaaaagatg

SEQ ID NO: 117591 - DNA, 103 bp, Artificial Sequence
  Synthetic Polynucleotide
taatacgactcactatagggcgcgttggcggcggccgcggcgttgaactcaacagaggagagagttcatggccgcggccaacctggcggcagcgcaaaagatg

SEQ ID NO: 117592 - DNA, 103 bp, Artificial Sequence
  Synthetic Polynucleotide
taatacgactcactataggggggccatcccagatgctttggtgtggagggaacagaggagaccctccatgccaaagcataacctggcggcagcgcaaaagatg

SEQ ID NO: 117593 - DNA, 103 bp, Artificial Sequence
  Synthetic Polynucleotide
taatacgactcactatagggcgtagacctgcgcgttggcggcggccgcggaacagaggagaccgcggatgccgccaacgaacctggcggcagcgcaaaagatg

SEQ ID NO: 117594 - DNA, 103 bp, Artificial Sequence
  Synthetic Polynucleotide
taatacgactcactatagggccggtctgaccgtagacctgcgcgttggcgaacagaggagacgccaaatggcaggtctaaacctggcggcagcgcaaaagatg

SEQ ID NO: 117595 - DNA, 103 bp, Artificial Sequence
  Synthetic Polynucleotide
taatacgactcactataggggtaggggaggccggtctgaccgtagacctgaacagaggagacaggtcatgggtcagaccaacctggcggcagcgcaaaagatg

SEQ ID NO: 117596 - DNA, 103 bp, Artificial Sequence
  Synthetic Polynucleotide
taatacgactcactatagggacccggggccgtaggggaggccggtctgacaacagaggagagtcagaatggcctcccctaacctggcggcagcgcaaaagatg

SEQ ID NO: 117597 - DNA, 103 bp, Artificial Sequence
  Synthetic Polynucleotide
taatacgactcactataggggcagcctcagacccggggccgtaggggaggaacagaggagacctcccatgcggccccggaacctggcggcagcgcaaaagatg

SEQ ID NO: 117598 - DNA, 103 bp, Artificial Sequence
  Synthetic Polynucleotide
taatacgactcactataggggccgaacgccgcagcctcagacccggggccaacagaggagaggccccatgtctgaggctaacctggcggcagcgcaaaagatg

SEQ ID NO: 117599 - DNA, 103 bp, Artificial Sequence
  Synthetic Polynucleotide
taatacgactcactatagggggccgttggagccgaacgccgcagcctcagaacagaggagactgaggatgcggcgttcgaacctggcggcagcgcaaaagatg

SEQ ID NO: 117600 - DNA, 103 bp, Artificial Sequence
  Synthetic Polynucleotide
taatacgactcactatagggaaaccccccaggccgttggagccgaacgccaacagaggagaggcgttatgctccaacggaacctggcggcagcgcaaaagatg

SEQ ID NO: 117601 - DNA, 103 bp, Artificial Sequence
  Synthetic Polynucleotide
taatacgactcactataggggagtggggggaaaccccccaggccgttggaaacagaggagatccaacatgctggggggtaacctggcggcagcgcaaaagatg

SEQ ID NO: 117602 - DNA, 103 bp, Artificial Sequence
  Synthetic Polynucleotide
taatacgactcactatagggacacgctgttgagtggggggaaaccccccaaacagaggagatgggggatgtccccccacaacctggcggcagcgcaaaagatg

SEQ ID NO: 117603 - DNA, 103 bp, Artificial Sequence
  Synthetic Polynucleotide
taatacgactcactatagggtgatgcagtagggccatcccagatgctttgaacagaggagacaaagcatgtgggatggcaacctggcggcagcgcaaaagatg

SEQ ID NO: 117604 - DNA, 103 bp, Artificial Sequence
  Synthetic Polynucleotide
taatacgactcactataggggggctcggagacacgctgttgagtggggggaacagaggagaccccccatgcaacagcgtaacctggcggcagcgcaaaagatg

SEQ ID NO: 117605 - DNA, 103 bp, Artificial Sequence
  Synthetic Polynucleotide
taatacgactcactatagggtagcatcagcgggctcggagacacgctgttaacagaggagaaacagcatgtctccgagcaacctggcggcagcgcaaaagatg

SEQ ID NO: 117606 - DNA, 103 bp, Artificial Sequence
  Synthetic Polynucleotide
taatacgactcactataggggcgggtgcagtagcatcagcgggctcggagaacagaggagactccgaatgcgctgatgcaacctggcggcagcgcaaaagatg

SEQ ID NO: 117607 - DNA, 103 bp, Artificial Sequence
  Synthetic Polynucleotide
taatacgactcactatagggagctgcggcggcgggtgcagtagcatcagcaacagaggagagctgatatgactgcacccaacctggcggcagcgcaaaagatg

SEQ ID NO: 117608 - DNA, 103 bp, Artificial Sequence
  Synthetic Polynucleotide
taatacgactcactataggggaaaggcgacagctgcggcggcgggtgcagaacagaggagactgcacatgccgccgcagaacctggcggcagcgcaaaagatg

SEQ ID NO: 117609 - DNA, 103 bp, Artificial Sequence
  Synthetic Polynucleotide
taatacgactcactatagggggggctgcaggaaaggcgacagctgcggcgaacagaggagacgccgcatgtgtcgccttaacctggcggcagcgcaaaagatg

SEQ ID NO: 117610 - DNA, 103 bp, Artificial Sequence
  Synthetic Polynucleotide
taatacgactcactatagggtgctggccgtggggctgcaggaaaggcgacaacagaggagagtcgccatgcctgcagccaacctggcggcagcgcaaaagatg

SEQ ID NO: 117611 - DNA, 103 bp, Artificial Sequence
  Synthetic Polynucleotide
taatacgactcactataggggtagggcacctgctggccgtggggctgcagaacagaggagactgcagatgcacggccagaacctggcggcagcgcaaaagatg

SEQ ID NO: 117612 - DNA, 103 bp, Artificial Sequence
  Synthetic Polynucleotide
taatacgactcactatagggtctccaggtagtagggcacctgctggccgtaacagaggagaacggccatgaggtgccctaacctggcggcagcgcaaaagatg

SEQ ID NO: 117613 - DNA, 103 bp, Artificial Sequence
  Synthetic Polynucleotide
taatacgactcactatagggctgggctcgttctccaggtagtagggcaccaacagaggagaggtgccatgctacctggaaacctggcggcagcgcaaaagatg

SEQ ID NO: 117614 - DNA, 103 bp, Artificial Sequence
  Synthetic Polynucleotide
taatacgactcactatagggcccttggatctgatgcagtagggccatcccaacagaggagagggatgatgctactgcataacctggcggcagcgcaaaagatg

SEQ ID NO: 117615 - DNA, 103 bp, Artificial Sequence
  Synthetic Polynucleotide
taatacgactcactatagggcgtgtagccgctgggctcgttctccaggtaaacagaggagatacctgatgaacgagcccaacctggcggcagcgcaaaagatg

SEQ ID NO: 117616 - DNA, 103 bp, Artificial Sequence
  Synthetic Polynucleotide
taatacgactcactatagggcctcgcgcaccgtgtagccgctgggctcgtaacagaggagaacgagcatggcggctacaaacctggcggcagcgcaaaagatg

SEQ ID NO: 117617 - DNA, 103 bp, Artificial Sequence
  Synthetic Polynucleotide
taatacgactcactatagggggcgggccggcctcgcgcaccgtgtagccgaacagaggagacggctaatgggtgcgcgaaacctggcggcagcgcaaaagatg

SEQ ID NO: 117618 - DNA, 103 bp, Artificial Sequence
  Synthetic Polynucleotide
taatacgactcactataggggtagaatgccggcgggccggcctcgcgcacaacagaggagagtgcgcatggccggcccgaacctggcggcagcgcaaaagatg

SEQ ID NO: 117619 - DNA, 103 bp, Artificial Sequence
  Synthetic Polynucleotide
taatacgactcactatagggaatttggcctgtagaatgccggcgggccggaacagaggagaccggccatgcggcattctaacctggcggcagcgcaaaagatg

SEQ ID NO: 117620 - DNA, 103 bp, Artificial Sequence
  Synthetic Polynucleotide
taatacgactcactatagggcgattatctgaatttggcctgtagaatgccaacagaggagaggcattatgcaggccaaaaacctggcggcagcgcaaaagatg

SEQ ID NO: 117621 - DNA, 103 bp, Artificial Sequence
  Synthetic Polynucleotide
taatacgactcactatagggaccctggcgtcgattatctgaatttggcctaacagaggagaaggccaatgtcagataataacctggcggcagcgcaaaagatg

SEQ ID NO: 117622 - DNA, 103 bp, Artificial Sequence
  Synthetic Polynucleotide
taatacgactcactatagggtttctctgccaccctggcgtcgattatctgaacagaggagacagataatggacgccaggaacctggcggcagcgcaaaagatg

SEQ ID NO: 117623 - DNA, 103 bp, Artificial Sequence
  Synthetic Polynucleotide
taatacgactcactatagggctggccaatctttctctgccaccctggcgtaacagaggagaacgccaatgtggcagagaaacctggcggcagcgcaaaagatg

SEQ ID NO: 117624 - DNA, 103 bp, Artificial Sequence
  Synthetic Polynucleotide
taatacgactcactataggggtcattggtactggccaatctttctctgccaacagaggagaggcagaatgagattggccaacctggcggcagcgcaaaagatg

SEQ ID NO: 117625 - DNA, 103 bp, Artificial Sequence
  Synthetic Polynucleotide
taatacgactcactatagggccagctcgttcccttggatctgatgcagtaaacagaggagatactgcatgagatccaagaacctggcggcagcgcaaaagatg

SEQ ID NO: 117626 - DNA, 103 bp, Artificial Sequence
  Synthetic Polynucleotide
taatacgactcactatagggtacttcccttgtcattggtactggccaatcaacagaggagagattggatggtaccaatgaacctggcggcagcgcaaaagatg

SEQ ID NO: 117627 - DNA, 103 bp, Artificial Sequence
  Synthetic Polynucleotide
taatacgactcactatagggtccatagccatacttcccttgtcattggtaaacagaggagataccaaatgcaagggaagaacctggcggcagcgcaaaagatg

SEQ ID NO: 117628 - DNA, 103 bp, Artificial Sequence
  Synthetic Polynucleotide
taatacgactcactatagggcttggcagattccatagccatacttcccttaacagaggagaaagggaatgatggctatgaacctggcggcagcgcaaaagatg

SEQ ID NO: 117629 - DNA, 103 bp, Artificial Sequence
  Synthetic Polynucleotide
taatacgactcactatagggagcgagtctccttggcagattccatagccaaacagaggagatggctaatgaatctgccaaacctggcggcagcgcaaaagatg

SEQ ID NO: 117630 - DNA, 103 bp, Artificial Sequence
  Synthetic Polynucleotide
taatacgactcactatagggactgcacagtagcgagtctccttggcagataacagaggagaatctgcatgggagactcgaacctggcggcagcgcaaaagatg

SEQ ID NO: 117631 - DNA, 103 bp, Artificial Sequence
  Synthetic Polynucleotide
taatacgactcactataggggtcattgcacactgcacagtagcgagtctcaacagaggagagagactatgtactgtgcaaacctggcggcagcgcaaaagatg

SEQ ID NO: 117632 - DNA, 103 bp, Artificial Sequence
  Synthetic Polynucleotide
taatacgactcactatagggctgaagcatagtcattgcacactgcacagtaacagaggagaactgtgatgtgtgcaatgaacctggcggcagcgcaaaagatg

SEQ ID NO: 117633 - DNA, 103 bp, Artificial Sequence
  Synthetic Polynucleotide
taatacgactcactatagggtaatggtagcctgaagcatagtcattgcacaacagaggagagtgcaaatgctatgcttcaacctggcggcagcgcaaaagatg

SEQ ID NO: 117634 - DNA, 103 bp, Artificial Sequence
  Synthetic Polynucleotide
taatacgactcactatagggccagactccataatggtagcctgaagcataaacagaggagatatgctatgggctaccataacctggcggcagcgcaaaagatg

SEQ ID NO: 117635 - DNA, 103 bp, Artificial Sequence
  Synthetic Polynucleotide
taatacgactcactatagggcctcacaggaccagactccataatggtagcaacagaggagagctaccatgatggagtctaacctggcggcagcgcaaaagatg

SEQ ID NO: 117636 - DNA, 103 bp, Artificial Sequence
  Synthetic Polynucleotide
taatacgactcactatagggttcaggggctccagctcgttcccttggatcaacagaggagagatccaatggaacgagctaacctggcggcagcgcaaaagatg

SEQ ID NO: 117637 - DNA, 103 bp, Artificial Sequence
  Synthetic Polynucleotide
taatacgactcactataggggccttgcagccctcacaggaccagactccaaacagaggagatggagtatggtcctgtgaaacctggcggcagcgcaaaagatg

SEQ ID NO: 117638 - DNA, 103 bp, Artificial Sequence
  Synthetic Polynucleotide
taatacgactcactatagggcttgaagaaggccttgcagccctcacaggaaacagaggagatcctgtatgggctgcaagaacctggcggcagcgcaaaagatg

SEQ ID NO: 117639 - DNA, 103 bp, Artificial Sequence
  Synthetic Polynucleotide
taatacgactcactataggggaatacttctcttgaagaaggccttgcagcaacagaggagagctgcaatgccttcttcaaacctggcggcagcgcaaaagatg

SEQ ID NO: 117640 - DNA, 103 bp, Artificial Sequence
  Synthetic Polynucleotide
taatacgactcactatagggttatgtccttgaatacttctcttgaagaagaacagaggagacttcttatggagaagtataacctggcggcagcgcaaaagatg

SEQ ID NO: 117641 - DNA, 103 bp, Artificial Sequence
  Synthetic Polynucleotide
taatacgactcactatagggcatatagtcgttatgtccttgaatacttctaacagaggagaagaagtatgcaaggacataacctggcggcagcgcaaaagatg

SEQ ID NO: 117642 - DNA, 103 bp, Artificial Sequence
  Synthetic Polynucleotide
taatacgactcactatagggtggctggacacatatagtcgttatgtccttaacagaggagaaaggacatgacgactataaacctggcggcagcgcaaaagatg

SEQ ID NO: 117643 - DNA, 103 bp, Artificial Sequence
  Synthetic Polynucleotide
taatacgactcactatagggcactggttggtggctggacacatatagtcgaacagaggagacgactaatggtgtccagcaacctggcggcagcgcaaaagatg

SEQ ID NO: 117644 - DNA, 103 bp, Artificial Sequence
  Synthetic Polynucleotide
taatacgactcactatagggatcaatggtgcactggttggtggctggacaaacagaggagatgtccaatgaccaaccagaacctggcggcagcgcaaaagatg

SEQ ID NO: 117645 - DNA, 103 bp, Artificial Sequence
  Synthetic Polynucleotide
taatacgactcactatagggtcctgtttttatcaatggtgcactggttggaacagaggagaccaaccatggcaccattgaacctggcggcagcgcaaaagatg

SEQ ID NO: 117646 - DNA, 103 bp, Artificial Sequence
  Synthetic Polynucleotide
taatacgactcactatagggcagctcttcctcctgtttttatcaatggtgaacagaggagacaccatatgtaaaaacagaacctggcggcagcgcaaaagatg

SEQ ID NO: 117647 - DNA, 103 bp, Artificial Sequence
  Synthetic Polynucleotide
taatacgactcactatagggctgcggacggttcaggggctccagctcgttaacagaggagaaacgagatggagcccctgaacctggcggcagcgcaaaagatg

SEQ ID NO: 117648 - DNA, 103 bp, Artificial Sequence
  Synthetic Polynucleotide
taatacgactcactataggggcaggcctggcagctcttcctcctgtttttaacagaggagaaaaaacatgaggaagagcaacctggcggcagcgcaaaagatg

SEQ ID NO: 117649 - DNA, 103 bp, Artificial Sequence
  Synthetic Polynucleotide
taatacgactcactatagggtacggagccggcaggcctggcagctcttccaacagaggagaggaagaatggccaggcctaacctggcggcagcgcaaaagatg

SEQ ID NO: 117650 - DNA, 103 bp, Artificial Sequence
  Synthetic Polynucleotide
taatacgactcactatagggtcgtagcatttacggagccggcaggcctggaacagaggagaccaggcatgccggctccgaacctggcggcagcgcaaaagatg

SEQ ID NO: 117651 - DNA, 103 bp, Artificial Sequence
  Synthetic Polynucleotide
taatacgactcactatagggcattcccacttcgtagcatttacggagccgaacagaggagacggctcatgaaatgctacaacctggcggcagcgcaaaagatg

SEQ ID NO: 117652 - DNA, 103 bp, Artificial Sequence
  Synthetic Polynucleotide
taatacgactcactatagggcacctttcatcattcccacttcgtagcattaacagaggagaaatgctatgaagtgggaaaacctggcggcagcgcaaaagatg

SEQ ID NO: 117653 - DNA, 103 bp, Artificial Sequence
  Synthetic Polynucleotide
taatacgactcactatagggtttcgtatcccacctttcatcattcccactaacagaggagaagtgggatggatgaaaggaacctggcggcagcgcaaaagatg

SEQ ID NO: 117654 - DNA, 103 bp, Artificial Sequence
  Synthetic Polynucleotide
taatacgactcactatagggtcttcggtcttttcgtatcccacctttcataacagaggagaatgaaaatggggatacgaaacctggcggcagcgcaaaagatg

SEQ ID NO: 117655 - DNA, 103 bp, Artificial Sequence
  Synthetic Polynucleotide
taatacgactcactatagggttctccctcctcttcggtcttttcgtatccaacagaggagaggatacatgaagaccgaaaacctggcggcagcgcaaaagatg

SEQ ID NO: 117656 - DNA, 103 bp, Artificial Sequence
  Synthetic Polynucleotide
taatacgactcactatagggtgtttcaacattctccctcctcttcggtctaacagaggagaagaccgatgaggagggagaacctggcggcagcgcaaaagatg

SEQ ID NO: 117657 - DNA, 103 bp, Artificial Sequence
  Synthetic Polynucleotide
taatacgactcactatagggctggcgcttgtgtttcaacattctccctccaacagaggagaggagggatgatgttgaaaaacctggcggcagcgcaaaagatg

SEQ ID NO: 117658 - DNA, 103 bp, Artificial Sequence
  Synthetic Polynucleotide
taatacgactcactatagggggatcttgagctgcggacggttcaggggctaacagaggagaagccccatgaccgtccgcaacctggcggcagcgcaaaagatg

SEQ ID NO: 117659 - DNA, 103 bp, Artificial Sequence
  Synthetic Polynucleotide
taatacgactcactatagggcatcatctctctggcgcttgtgtttcaacaaacagaggagatgttgaatgacaagcgccaacctggcggcagcgcaaaagatg

SEQ ID NO: 117660 - DNA, 103 bp, Artificial Sequence
  Synthetic Polynucleotide
taatacgactcactatagggctgccctccccatcatctctctggcgcttgaacagaggagacaagcgatggagagatgaaacctggcggcagcgcaaaagatg

SEQ ID NO: 117661 - DNA, 103 bp, Artificial Sequence
  Synthetic Polynucleotide
taatacgactcactatagggcacttcacccctgccctccccatcatctctaacagaggagaagagatatgggggagggcaacctggcggcagcgcaaaagatg

SEQ ID NO: 117662 - DNA, 103 bp, Artificial Sequence
  Synthetic Polynucleotide
taatacgactcactatagggcagcagaccccacttcacccctgccctcccaacagaggagagggaggatgggggtgaagaacctggcggcagcgcaaaagatg

SEQ ID NO: 117663 - DNA, 103 bp, Artificial Sequence
  Synthetic Polynucleotide
taatacgactcactatagggctcatgtctccagcagaccccacttcacccaacagaggagagggtgaatgggggtctgcaacctggcggcagcgcaaaagatg

SEQ ID NO: 117664 - DNA, 103 bp, Artificial Sequence
  Synthetic Polynucleotide
taatacgactcactataggggttggcagctctcatgtctccagcagacccaacagaggagagggtctatgggagacatgaacctggcggcagcgcaaaagatg

SEQ ID NO: 117665 - DNA, 103 bp, Artificial Sequence
  Synthetic Polynucleotide
taatacgactcactatagggttggccaaaggttggcagctctcatgtctcaacagaggagagagacaatggagctgccaaacctggcggcagcgcaaaagatg

SEQ ID NO: 117666 - DNA, 103 bp, Artificial Sequence
  Synthetic Polynucleotide
taatacgactcactatagggatgagcgggcttggccaaaggttggcagctaacagaggagaagctgcatgcctttggccaacctggcggcagcgcaaaagatg

SEQ ID NO: 117667 - DNA, 103 bp, Artificial Sequence
  Synthetic Polynucleotide
taatacgactcactataggggcgtttgatcatgagcgggcttggccaaagaacagaggagactttggatgagcccgctcaacctggcggcagcgcaaaagatg

SEQ ID NO: 117668 - DNA, 103 bp, Artificial Sequence
  Synthetic Polynucleotide
taatacgactcactatagggtcttcttagagcgtttgatcatgagcgggcaacagaggagagcccgcatgtgatcaaacaacctggcggcagcgcaaaagatg

SEQ ID NO: 117669 - DNA, 103 bp, Artificial Sequence
  Synthetic Polynucleotide
taatacgactcactatagggcgctccagggggatcttgagctgcggacggaacagaggagaccgtccatggctcaagataacctggcggcagcgcaaaagatg

SEQ ID NO: 117670 - DNA, 103 bp, Artificial Sequence
  Synthetic Polynucleotide
taatacgactcactataggggccaggctgttcttcttagagcgtttgatcaacagaggagagatcaaatgctctaagaaaacctggcggcagcgcaaaagatg

SEQ ID NO: 117671 - DNA, 103 bp, Artificial Sequence
  Synthetic Polynucleotide
taatacgactcactatagggcagggacaaggccaggctgttcttcttagaaacagaggagatctaagatgaacagcctgaacctggcggcagcgcaaaagatg

SEQ ID NO: 117672 - DNA, 103 bp, Artificial Sequence
  Synthetic Polynucleotide
taatacgactcactatagggggtcggccgtcagggacaaggccaggctgtaacagaggagaacagccatgccttgtcccaacctggcggcagcgcaaaagatg

SEQ ID NO: 117673 - DNA, 103 bp, Artificial Sequence
  Synthetic Polynucleotide
taatacgactcactatagggctgaccatctggtcggccgtcagggacaagaacagaggagacttgtcatggacggccgaaacctggcggcagcgcaaaagatg

SEQ ID NO: 117674 - DNA, 103 bp, Artificial Sequence
  Synthetic Polynucleotide
taatacgactcactatagggcaacaaggcactgaccatctggtcggccgtaacagaggagaacggccatgcagatggtcaacctggcggcagcgcaaaagatg

SEQ ID NO: 117675 - DNA, 103 bp, Artificial Sequence
  Synthetic Polynucleotide
taatacgactcactataggggctcagcatccaacaaggcactgaccatctaacagaggagaagatggatggtgccttgtaacctggcggcagcgcaaaagatg

SEQ ID NO: 117676 - DNA, 103 bp, Artificial Sequence
  Synthetic Polynucleotide
taatacgactcactatagggagtatcgggggctcagcatccaacaaggcaaacagaggagatgccttatgggatgctgaaacctggcggcagcgcaaaagatg

SEQ ID NO: 117677 - DNA, 103 bp, Artificial Sequence
  Synthetic Polynucleotide
taatacgactcactatagggctcggaatagagtatcgggggctcagcatcaacagaggagagatgctatgcccccgataaacctggcggcagcgcaaaagatg

SEQ ID NO: 117678 - DNA, 103 bp, Artificial Sequence
  Synthetic Polynucleotide
taatacgactcactatagggtaggatcatactcggaatagagtatcggggaacagaggagaccccgaatgtctattccgaacctggcggcagcgcaaaagatg

SEQ ID NO: 117679 - DNA, 103 bp, Artificial Sequence
  Synthetic Polynucleotide
taatacgactcactatagggaagggtctggtaggatcatactcggaatagaacagaggagactattcatggtatgatccaacctggcggcagcgcaaaagatg

SEQ ID NO: 117680 - DNA, 103 bp, Artificial Sequence
  Synthetic Polynucleotide
taatacgactcactatagggaaggctagatggtgagttttttatatccataacagaggagaatggatatgaaaaactcaaacctggcggcagcgcaaaagatg

SEQ ID NO: 117681 - DNA, 103 bp, Artificial Sequence
  Synthetic Polynucleotide
taatacgactcactataggggtggctgtctacataggaggaaggtatgtaaacagaggagatacataatgtcctcctataacctggcggcagcgcaaaagatg

SEQ ID NO: 117682 - DNA, 103 bp, Artificial Sequence
  Synthetic Polynucleotide
taatacgactcactataggggttcagcaagtgagccagcttccggctgctaacagaggagaagcagcatgaagctggctaacctggcggcagcgcaaaagatg

SEQ ID NO: 117683 - DNA, 103 bp, Artificial Sequence
  Synthetic Polynucleotide
taatacgactcactatagggcggtcacggcgttcagcaagtgagccagctaacagaggagaagctggatgacttgctgaaacctggcggcagcgcaaaagatg

SEQ ID NO: 117684 - DNA, 103 bp, Artificial Sequence
  Synthetic Polynucleotide
taatacgactcactatagggaccaaagcatcggtcacggcgttcagcaagaacagaggagacttgctatgcgccgtgacaacctggcggcagcgcaaaagatg

SEQ ID NO: 117685 - DNA, 103 bp, Artificial Sequence
  Synthetic Polynucleotide
taatacgactcactatagggaatcacccaaaccaaagcatcggtcacggcaacagaggagagccgtgatggatgctttgaacctggcggcagcgcaaaagatg

SEQ ID NO: 117686 - DNA, 103 bp, Artificial Sequence
  Synthetic Polynucleotide
taatacgactcactatagggcgctcttggcaatcacccaaaccaaagcataacagaggagaatgcttatgtttgggtgaaacctggcggcagcgcaaaagatg

SEQ ID NO: 117687 - DNA, 103 bp, Artificial Sequence
  Synthetic Polynucleotide
taatacgactcactataggggaggagatgccgctcttggcaatcacccaaaacagaggagattgggtatgtgccaagagaacctggcggcagcgcaaaagatg

SEQ ID NO: 117688 - DNA, 103 bp, Artificial Sequence
  Synthetic Polynucleotide
taatacgactcactatagggttgctgctgggaggagatgccgctcttggcaacagaggagagccaagatgggcatctccaacctggcggcagcgcaaaagatg

SEQ ID NO: 117689 - DNA, 103 bp, Artificial Sequence
  Synthetic Polynucleotide
taatacgactcactatagggggcgcatggattgctgctgggaggagatgcaacagaggagagcatctatgcccagcagcaacctggcggcagcgcaaaagatg

SEQ ID NO: 117690 - DNA, 103 bp, Artificial Sequence
  Synthetic Polynucleotide
taatacgactcactatagggaggttagccaggcgcatggattgctgctggaacagaggagaccagcaatgatccatgcgaacctggcggcagcgcaaaagatg

SEQ ID NO: 117691 - DNA, 103 bp, Artificial Sequence
  Synthetic Polynucleotide
taatacgactcactataggggagcatcaggaggttagccaggcgcatggaaacagaggagatccatgatgctggctaacaacctggcggcagcgcaaaagatg

SEQ ID NO: 117692 - DNA, 103 bp, Artificial Sequence
  Synthetic Polynucleotide
taatacgactcactataggggatattcatggtggctgtctacataggaggaacagaggagacctcctatgtagacagccaacctggcggcagcgcaaaagatg

SEQ ID NO: 117693 - DNA, 103 bp, Artificial Sequence
  Synthetic Polynucleotide
taatacgactcactatagggcgtgggacaggagcatcaggaggttagccaaacagaggagatggctaatgtcctgatgcaacctggcggcagcgcaaaagatg

SEQ ID NO: 117694 - DNA, 103 bp, Artificial Sequence
  Synthetic Polynucleotide
taatacgactcactataggggcatgcctgacgtgggacaggagcatcaggaacagaggagacctgatatgcctgtcccaaacctggcggcagcgcaaaagatg

SEQ ID NO: 117695 - DNA, 103 bp, Artificial Sequence
  Synthetic Polynucleotide
taatacgactcactatagggcttgttactcgcatgcctgacgtgggacagaacagaggagactgtccatggtcaggcataacctggcggcagcgcaaaagatg

SEQ ID NO: 117696 - DNA, 103 bp, Artificial Sequence
  Synthetic Polynucleotide
taatacgactcactataggggttccatgcccttgttactcgcatgcctgaaacagaggagatcaggcatgcgagtaacaaacctggcggcagcgcaaaagatg

SEQ ID NO: 117697 - DNA, 103 bp, Artificial Sequence
  Synthetic Polynucleotide
taatacgactcactatagggttgagcagatgttccatgcccttgttactcaacagaggagagagtaaatggggcatggaaacctggcggcagcgcaaaagatg

SEQ ID NO: 117698 - DNA, 103 bp, Artificial Sequence
  Synthetic Polynucleotide
taatacgactcactataggggcacttcatgttgagcagatgttccatgccaacagaggagaggcatgatgcatctgctcaacctggcggcagcgcaaaagatg

SEQ ID NO: 117699 - DNA, 103 bp, Artificial Sequence
  Synthetic Polynucleotide
taatacgactcactatagggccacatttttgcacttcatgttgagcagataacagaggagaatctgcatgacatgaagtaacctggcggcagcgcaaaagatg

SEQ ID NO: 117700 - DNA, 103 bp, Artificial Sequence
  Synthetic Polynucleotide
taatacgactcactatagggtacactgggaccacatttttgcacttcatgaacagaggagacatgaaatgcaaaaatgtaacctggcggcagcgcaaaagatg

SEQ ID NO: 117701 - DNA, 103 bp, Artificial Sequence
  Synthetic Polynucleotide
taatacgactcactatagggcagcaggtcatacactgggaccacatttttaacagaggagaaaaaatatggtcccagtgaacctggcggcagcgcaaaagatg

SEQ ID NO: 117702 - DNA, 103 bp, Artificial Sequence
  Synthetic Polynucleotide
taatacgactcactataggggcatctccagcagcaggtcatacactgggaaacagaggagatcccagatgatgacctgcaacctggcggcagcgcaaaagatg

SEQ ID NO: 117703 - DNA, 103 bp, Artificial Sequence
  Synthetic Polynucleotide
taatacgactcactataggggtcatggctggatattcatggtggctgtctaacagaggagaagacagatgccatgaataaacctggcggcagcgcaaaagatg

SEQ ID NO: 117704 - DNA, 103 bp, Artificial Sequence
  Synthetic Polynucleotide
taatacgactcactatagggtgggcattcagcatctccagcagcaggtcaaacagaggagatgacctatggctggagataacctggcggcagcgcaaaagatg

SEQ ID NO: 117705 - DNA, 103 bp, Artificial Sequence
  Synthetic Polynucleotide
taatacgactcactataggggcgaagcacgtgggcattcagcatctccagaacagaggagactggagatgctgaatgccaacctggcggcagcgcaaaagatg

SEQ ID NO: 117706 - DNA, 103 bp, Artificial Sequence
  Synthetic Polynucleotide
taatacgactcactatagggacttgcacccgcgaagcacgtgggcattcaaacagaggagatgaatgatgacgtgcttcaacctggcggcagcgcaaaagatg

SEQ ID NO: 117707 - DNA, 103 bp, Artificial Sequence
  Synthetic Polynucleotide
taatacgactcactataggggtgatggaggacttgcacccgcgaagcacgaacagaggagacgtgctatgcgggtgcaaaacctggcggcagcgcaaaagatg

SEQ ID NO: 117708 - DNA, 103 bp, Artificial Sequence
  Synthetic Polynucleotide
taatacgactcactatagggctcggaccccgtgatggaggacttgcacccaacagaggagagggtgcatgtcctccatcaacctggcggcagcgcaaaagatg

SEQ ID NO: 117709 - DNA, 103 bp, Artificial Sequence
  Synthetic Polynucleotide
taatacgactcactatagggccgggctgcactcggaccccgtgatggaggaacagaggagacctccaatgcggggtccgaacctggcggcagcgcaaaagatg

SEQ ID NO: 117710 - DNA, 103 bp, Artificial Sequence
  Synthetic Polynucleotide
taatacgactcactatagggctgtcctctgccgggctgcactcggaccccaacagaggagaggggtcatggtgcagcccaacctggcggcagcgcaaaagatg

SEQ ID NO: 117711 - DNA, 103 bp, Artificial Sequence
  Synthetic Polynucleotide
taatacgactcactatagggtttgcttttactgtcctctgccgggctgcaaacagaggagatgcagcatggcagaggacaacctggcggcagcgcaaaagatg

SEQ ID NO: 117712 - DNA, 103 bp, Artificial Sequence
  Synthetic Polynucleotide
taatacgactcactataggggggagccctctttgcttttactgtcctctgaacagaggagacagaggatggtaaaagcaaacctggcggcagcgcaaaagatg

SEQ ID NO: 117713 - DNA, 103 bp, Artificial Sequence
  Synthetic Polynucleotide
taatacgactcactatagggtgtgggttctgggagccctctttgcttttaaacagaggagataaaagatgagagggctcaacctggcggcagcgcaaaagatg

SEQ ID NO: 117714 - DNA, 103 bp, Artificial Sequence
  Synthetic Polynucleotide
taatacgactcactataggggctatagaatgtcatggctggatattcatgaacagaggagacatgaaatgccagccatgaacctggcggcagcgcaaaagatg

SEQ ID NO: 117715 - DNA, 103 bp, Artificial Sequence
  Synthetic Polynucleotide
taatacgactcactatagggtcactgagactgtgggttctgggagccctcaacagaggagagagggcatgcagaacccaaacctggcggcagcgcaaaagatg

SEQ ID NO: 117716 - DNA, 103 bp, Artificial Sequence
  Synthetic Polynucleotide
taatacgactcactatagggtcacagcagggctatagaatgtcatggctgaacagaggagacagccaatgcattctataaacctggcggcagcgcaaaagatg

SEQ ID NO: 117717 - DNA, 103 bp, Artificial Sequence
  Synthetic Polynucleotide
taatacgactcactatagggctgtaattcatcacagcagggctatagaataacagaggagaattctaatgccctgctgtaacctggcggcagcgcaaaagatg

SEQ ID NO: 117718 - DNA, 103 bp, Artificial Sequence
  Synthetic Polynucleotide
taatacgactcactataggggctgggaatgctgtaattcatcacagcaggaacagaggagacctgctatgatgaattacaacctggcggcagcgcaaaagatg

SEQ ID NO: 117719 - DNA, 103 bp, Artificial Sequence
  Synthetic Polynucleotide
taatacgactcactatagggtagtgacattgctgggaatgctgtaattcaaacagaggagatgaattatggcattcccaaacctggcggcagcgcaaaagatg

SEQ ID NO: 117720 - DNA, 103 bp, Artificial Sequence
  Synthetic Polynucleotide
taatacgactcactatagggccttccaagttagtgacattgctgggaatgaacagaggagacattccatgcaatgtcacaacctggcggcagcgcaaaagatg

SEQ ID NO: 117721 - DNA, 103 bp, Artificial Sequence
  Synthetic Polynucleotide
taatacgactcactatagggaccaggcccaccttccaagttagtgacattaacagaggagaaatgtcatgaacttggaaaacctggcggcagcgcaaaagatg

SEQ ID NO: 117722 - DNA, 103 bp, Artificial Sequence
  Synthetic Polynucleotide
taatacgactcactatagggaaggagaattaaggctagatggtgagttttaacagaggagaaaaactatgcatctagccaacctggcggcagcgcaaaagatg

SEQ ID NO: 117723 - DNA, 103 bp, Artificial Sequence
  Synthetic Polynucleotide
taatacgactcactatagggtggtctgccgaccaggcccaccttccaagtaacagaggagaacttggatggtgggcctgaacctggcggcagcgcaaaagatg

SEQ ID NO: 117724 - DNA, 103 bp, Artificial Sequence
  Synthetic Polynucleotide
taatacgactcactatagggtttgggcttgtggtctgccgaccaggcccaaacagaggagatgggccatgtcggcagacaacctggcggcagcgcaaaagatg

SEQ ID NO: 117725 - DNA, 103 bp, Artificial Sequence
  Synthetic Polynucleotide
taatacgactcactatagggccacaacacatttgggcttgtggtctgccgaacagaggagacggcagatgacaagcccaaacctggcggcagcgcaaaagatg

SEQ ID NO: 117726 - DNA, 103 bp, Artificial Sequence
  Synthetic Polynucleotide
taatacgactcactatagggcaggtgttggccacaacacatttgggcttgaacagaggagacaagccatgatgtgttgtaacctggcggcagcgcaaaagatg

SEQ ID NO: 117727 - DNA, 103 bp, Artificial Sequence
  Synthetic Polynucleotide
taatacgactcactataggggaaaggtgcccaggtgttggccacaacacaaacagaggagatgtgttatggccaacaccaacctggcggcagcgcaaaagatg

SEQ ID NO: 117728 - DNA, 103 bp, Artificial Sequence
  Synthetic Polynucleotide
taatacgactcactatagggcactaaaggagaaaggtgcccaggtgttggaacagaggagaccaacaatggggcaccttaacctggcggcagcgcaaaagatg

SEQ ID NO: 117729 - DNA, 103 bp, Artificial Sequence
  Synthetic Polynucleotide
taatacgactcactatagggggcgatggaccactaaaggagaaaggtgccaacagaggagaggcaccatgctcctttagaacctggcggcagcgcaaaagatg

SEQ ID NO: 117730 - DNA, 103 bp, Artificial Sequence
  Synthetic Polynucleotide
taatacgactcactatagggtgtgataactggcgatggaccactaaaggaaacagaggagatcctttatgggtccatcgaacctggcggcagcgcaaaagatg

SEQ ID NO: 117731 - DNA, 103 bp, Artificial Sequence
  Synthetic Polynucleotide
taatacgactcactatagggcgcatacagatgtgataactggcgatggacaacagaggagagtccatatgcagttatcaaacctggcggcagcgcaaaagatg

SEQ ID NO: 117732 - DNA, 103 bp, Artificial Sequence
  Synthetic Polynucleotide
taatacgactcactatagggtttgaggttccgcatacagatgtgataactaacagaggagaagttatatgatctgtatgaacctggcggcagcgcaaaagatg

SEQ ID NO: 117733 - DNA, 103 bp, Artificial Sequence
  Synthetic Polynucleotide
taatacgactcactatagggttgtaggaggaaggagaattaaggctagataacagaggagaatctagatgtaattctccaacctggcggcagcgcaaaagatg

SEQ ID NO: 117734 - DNA, 103 bp, Artificial Sequence
  Synthetic Polynucleotide
taatacgactcactatagggcagggactcttttgaggttccgcatacagaaacagaggagatctgtaatgggaacctcaaacctggcggcagcgcaaaagatg

SEQ ID NO: 117735 - DNA, 103 bp, Artificial Sequence
  Synthetic Polynucleotide
taatacgactcactatagggtgcttcacaccagggactcttttgaggttcaacagaggagagaacctatgaagagtcccaacctggcggcagcgcaaaagatg

SEQ ID NO: 117736 - DNA, 103 bp, Artificial Sequence
  Synthetic Polynucleotide
taatacgactcactatagggctagcgatcttgcttcacaccagggactctaacagaggagaagagtcatgggtgtgaagaacctggcggcagcgcaaaagatg

SEQ ID NO: 117737 - DNA, 103 bp, Artificial Sequence
  Synthetic Polynucleotide
taatacgactcactatagggaaggtgtgttctagcgatcttgcttcacacaacagaggagagtgtgaatgaagatcgctaacctggcggcagcgcaaaagatg

SEQ ID NO: 117738 - DNA, 103 bp, Artificial Sequence
  Synthetic Polynucleotide
taatacgactcactataggggtttacaggtaaggtgtgttctagcgatctaacagaggagaagatcgatggaacacaccaacctggcggcagcgcaaaagatg

SEQ ID NO: 117739 - DNA, 103 bp, Artificial Sequence
  Synthetic Polynucleotide
taatacgactcactataggggtgtctctctgtttacaggtaaggtgtgttaacagaggagaaacacaatgtacctgtaaaacctggcggcagcgcaaaagatg

SEQ ID NO: 117740 - DNA, 103 bp, Artificial Sequence
  Synthetic Polynucleotide
taatacgactcactatagggttccttttcagtgtctctctgtttacaggtaacagaggagaacctgtatgcagagagacaacctggcggcagcgcaaaagatg

SEQ ID NO: 117741 - DNA, 103 bp, Artificial Sequence
  Synthetic Polynucleotide
taatacgactcactatagggcccactaaccttccttttcagtgtctctctaacagaggagaagagagatgctgaaaaggaacctggcggcagcgcaaaagatg

SEQ ID NO: 117742 - DNA, 103 bp, Artificial Sequence
  Synthetic Polynucleotide
taatacgactcactatagggcgcaacggttcccactaaccttccttttcaaacagaggagatgaaaaatgaggttagtgaacctggcggcagcgcaaaagatg

SEQ ID NO: 117743 - DNA, 103 bp, Artificial Sequence
  Synthetic Polynucleotide
taatacgactcactatagggacagggctggcgcaacggttcccactaaccaacagaggagaggttagatggaaccgttgaacctggcggcagcgcaaaagatg

SEQ ID NO: 117744 - DNA, 103 bp, Artificial Sequence
  Synthetic Polynucleotide
taatacgactcactatagggttgactgcagttgtaggaggaaggagaattaacagaggagaaattctatgtcctcctacaacctggcggcagcgcaaaagatg

SEQ ID NO: 117745 - DNA, 103 bp, Artificial Sequence
  Synthetic Polynucleotide
taatacgactcactatagggtggaccagtaacagggctggcgcaacggttaacagaggagaaaccgtatggccagccctaacctggcggcagcgcaaaagatg

SEQ ID NO: 117746 - DNA, 103 bp, Artificial Sequence
  Synthetic Polynucleotide
taatacgactcactatagggtctttgaacctggaccagtaacagggctggaacagaggagaccagccatgttactggtcaacctggcggcagcgcaaaagatg

SEQ ID NO: 117747 - DNA, 103 bp, Artificial Sequence
  Synthetic Polynucleotide
taatacgactcactatagggtgagcatccctctttgaacctggaccagtaaacagaggagatactggatgaggttcaaaaacctggcggcagcgcaaaagatg

SEQ ID NO: 117748 - DNA, 103 bp, Artificial Sequence
  Synthetic Polynucleotide
taatacgactcactatagggagcgcagaagtgagcatccctctttgaaccaacagaggagaggttcaatgagggatgctaacctggcggcagcgcaaaagatg

SEQ ID NO: 117749 - DNA, 103 bp, Artificial Sequence
  Synthetic Polynucleotide
taatacgactcactatagggcgctgcagacagcgcagaagtgagcatcccaacagaggagagggatgatgacttctgcgaacctggcggcagcgcaaaagatg

SEQ ID NO: 117750 - DNA, 103 bp, Artificial Sequence
  Synthetic Polynucleotide
taatacgactcactataggggatgcgtaatcgctgcagacagcgcagaagaacagaggagacttctgatgtgtctgcagaacctggcggcagcgcaaaagatg

SEQ ID NO: 117751 - DNA, 103 bp, Artificial Sequence
  Synthetic Polynucleotide
taatacgactcactataggggtgatatcccgatgcgtaatcgctgcagacaacagaggagagtctgcatggattacgcaaacctggcggcagcgcaaaagatg

SEQ ID NO: 117752 - DNA, 103 bp, Artificial Sequence
  Synthetic Polynucleotide
taatacgactcactatagggagactccatagtgatatcccgatgcgtaataacagaggagaattacgatgcgggatatcaacctggcggcagcgcaaaagatg

SEQ ID NO: 117753 - DNA, 103 bp, Artificial Sequence
  Synthetic Polynucleotide
taatacgactcactatagggtcacacgaccagactccatagtgatatcccaacagaggagagggataatgctatggagtaacctggcggcagcgcaaaagatg

SEQ ID NO: 117754 - DNA, 103 bp, Artificial Sequence
  Synthetic Polynucleotide
taatacgactcactatagggcttacatccttcacacgaccagactccataaacagaggagatatggaatgtggtcgtgtaacctggcggcagcgcaaaagatg

SEQ ID NO: 117755 - DNA, 103 bp, Artificial Sequence
  Synthetic Polynucleotide
taatacgactcactataggggtaagatggattgactgcagttgtaggaggaacagaggagacctcctatgactgcagtcaacctggcggcagcgcaaaagatg

SEQ ID NO: 117756 - DNA, 103 bp, Artificial Sequence
  Synthetic Polynucleotide
taatacgactcactatagggtaaaaaaggccttacatccttcacacgaccaacagaggagaggtcgtatgaaggatgtaaacctggcggcagcgcaaaagatg

SEQ ID NO: 117757 - DNA, 103 bp, Artificial Sequence
  Synthetic Polynucleotide
taatacgactcactatagggatgcttcttttaaaaaaggccttacatcctaacagaggagaaggatgatgggcctttttaacctggcggcagcgcaaaagatg

SEQ ID NO: 117758 - DNA, 103 bp, Artificial Sequence
  Synthetic Polynucleotide
taatacgactcactatagggatgtccttgaatgcttcttttaaaaaaggcaacagaggagagcctttatgaaaagaagcaacctggcggcagcgcaaaagatg

SEQ ID NO: 117759 - DNA, 103 bp, Artificial Sequence
  Synthetic Polynucleotide
taatacgactcactatagggtataatcattatgtccttgaatgcttctttaacagaggagaaaagaaatgttcaaggacaacctggcggcagcgcaaaagatg

SEQ ID NO: 117760 - DNA, 103 bp, Artificial Sequence
  Synthetic Polynucleotide
taatacgactcactataggggctggacaaatataatcattatgtccttgaaacagaggagatcaaggatgtaatgattaaacctggcggcagcgcaaaagatg

SEQ ID NO: 117761 - DNA, 103 bp, Artificial Sequence
  Synthetic Polynucleotide
taatacgactcactatagggctgatttgtagctggacaaatataatcattaacagaggagaaatgatatgatttgtccaaacctggcggcagcgcaaaagatg

SEQ ID NO: 117762 - DNA, 103 bp, Artificial Sequence
  Synthetic Polynucleotide
taatacgactcactatagggcgattgtacactgatttgtagctggacaaaaacagaggagatttgtcatgctacaaatcaacctggcggcagcgcaaaagatg

SEQ ID NO: 117763 - DNA, 103 bp, Artificial Sequence
  Synthetic Polynucleotide
taatacgactcactatagggcggtttttatcgattgtacactgatttgtaaacagaggagatacaaaatggtgtacaataacctggcggcagcgcaaaagatg

SEQ ID NO: 117764 - DNA, 103 bp, Artificial Sequence
  Synthetic Polynucleotide
taatacgactcactataggggctcttgcgccggtttttatcgattgtacaaacagaggagatgtacaatggataaaaacaacctggcggcagcgcaaaagatg

SEQ ID NO: 117765 - DNA, 103 bp, Artificial Sequence
  Synthetic Polynucleotide
taatacgactcactatagggaggcctggcagctcttgcgccggtttttataacagaggagaataaaaatgggcgcaagaaacctggcggcagcgcaaaagatg

SEQ ID NO: 117766 - DNA, 103 bp, Artificial Sequence
  Synthetic Polynucleotide
taatacgactcactatagggtgctccaggggtaagatggattgactgcagaacagaggagactgcagatgatccatcttaacctggcggcagcgcaaaagatg

SEQ ID NO: 117767 - DNA, 103 bp, Artificial Sequence
  Synthetic Polynucleotide
taatacgactcactatagggcgaagtcggcaggcctggcagctcttgcgcaacagaggagagcgcaaatgctgccaggcaacctggcggcagcgcaaaagatg

SEQ ID NO: 117768 - DNA, 103 bp, Artificial Sequence
  Synthetic Polynucleotide
taatacgactcactataggggtaacacttccgaagtcggcaggcctggcaaacagaggagatgccagatgtgccgacttaacctggcggcagcgcaaaagatg

SEQ ID NO: 117769 - DNA, 103 bp, Artificial Sequence
  Synthetic Polynucleotide
taatacgactcactatagggttcccacttcgtaacacttccgaagtcggcaacagaggagagccgacatgggaagtgttaacctggcggcagcgcaaaagatg

SEQ ID NO: 117770 - DNA, 103 bp, Artificial Sequence
  Synthetic Polynucleotide
taatacgactcactatagggcacttcaccattcccacttcgtaacacttcaacagaggagagaagtgatgcgaagtgggaacctggcggcagcgcaaaagatg

SEQ ID NO: 117771 - DNA, 103 bp, Artificial Sequence
  Synthetic Polynucleotide
taatacgactcactatagggccgggagccacacttcaccattcccacttcaacagaggagagaagtgatgatggtgaagaacctggcggcagcgcaaaagatg

SEQ ID NO: 117772 - DNA, 103 bp, Artificial Sequence
  Synthetic Polynucleotide
taatacgactcactatagggatctctctctccgggagccacacttcaccaaacagaggagatggtgaatggtggctcccaacctggcggcagcgcaaaagatg

SEQ ID NO: 117773 - DNA, 103 bp, Artificial Sequence
  Synthetic Polynucleotide
taatacgactcactatagggcggtacccacatctctctctccgggagccaaacagaggagatggctcatggagagagagaacctggcggcagcgcaaaagatg

SEQ ID NO: 117774 - DNA, 103 bp, Artificial Sequence
  Synthetic Polynucleotide
taatacgactcactatagggccgcacaaggcggtacccacatctctctctaacagaggagaagagagatgtgtgggtacaacctggcggcagcgcaaaagatg

SEQ ID NO: 117775 - DNA, 103 bp, Artificial Sequence
  Synthetic Polynucleotide
taatacgactcactatagggttctctgtctccgcacaaggcggtacccacaacagaggagagtgggtatggccttgtgcaacctggcggcagcgcaaaagatg

SEQ ID NO: 117776 - DNA, 103 bp, Artificial Sequence
  Synthetic Polynucleotide
taatacgactcactatagggtcgtcggcacttctctgtctccgcacaaggaacagaggagaccttgtatggagacagagaacctggcggcagcgcaaaagatg

SEQ ID NO: 117777 - DNA, 103 bp, Artificial Sequence
  Synthetic Polynucleotide
taatacgactcactatagggtatggagccgtgctccaggggtaagatggaaacagaggagatccatcatgcccctggagaacctggcggcagcgcaaaagatg

SEQ ID NO: 117778 - DNA, 103 bp, Artificial Sequence
  Synthetic Polynucleotide
taatacgactcactataggggtgcagctgctcgtcggcacttctctgtctaacagaggagaagacagatgagtgccgacaacctggcggcagcgcaaaagatg

SEQ ID NO: 117779 - DNA, 103 bp, Artificial Sequence
  Synthetic Polynucleotide
taatacgactcactatagggtgccggcacagtgcagctgctcgtcggcacaacagaggagagtgccgatgagcagctgcaacctggcggcagcgcaaaagatg

SEQ ID NO: 117780 - DNA, 103 bp, Artificial Sequence
  Synthetic Polynucleotide
taatacgactcactatagggctcttggccttgccggcacagtgcagctgcaacagaggagagcagctatgctgtgccggaacctggcggcagcgcaaaagatg

SEQ ID NO: 117781 - DNA, 103 bp, Artificial Sequence
  Synthetic Polynucleotide
taatacgactcactataggggccgccacttctcttggccttgccggcacaaacagaggagatgtgccatgaaggccaagaacctggcggcagcgcaaaagatg

SEQ ID NO: 117782 - DNA, 103 bp, Artificial Sequence
  Synthetic Polynucleotide
taatacgactcactatagggggggcgcgtggccgccacttctcttggcctaacagaggagaaggccaatggaagtggcgaacctggcggcagcgcaaaagatg

SEQ ID NO: 117783 - DNA, 103 bp, Artificial Sequence
  Synthetic Polynucleotide
taatacgactcactatagggtcccgcactcggggcgcgtggccgccacttaacagaggagaaagtggatgccacgcgccaacctggcggcagcgcaaaagatg

SEQ ID NO: 117784 - DNA, 103 bp, Artificial Sequence
  Synthetic Polynucleotide
taatacgactcactatagggcagcagcagctcccgcactcggggcgcgtgaacagaggagacacgcgatgcgagtgcggaacctggcggcagcgcaaaagatg

SEQ ID NO: 117785 - DNA, 103 bp, Artificial Sequence
  Synthetic Polynucleotide
taatacgactcactatagggtcagggcgtccagcagcagctcccgcactcaacagaggagagagtgcatgagctgctgcaacctggcggcagcgcaaaagatg

SEQ ID NO: 117786 - DNA, 103 bp, Artificial Sequence
  Synthetic Polynucleotide
taatacgactcactatagggtgctcggggctcagggcgtccagcagcagcaacagaggagagctgctatgggacgccctaacctggcggcagcgcaaaagatg

SEQ ID NO: 117787 - DNA, 103 bp, Artificial Sequence
  Synthetic Polynucleotide
taatacgactcactataggggagcactagctgctcggggctcagggcgtcaacagaggagagacgccatgagccccgagaacctggcggcagcgcaaaagatg

SEQ ID NO: 117788 - DNA, 103 bp, Artificial Sequence
  Synthetic Polynucleotide
taatacgactcactatagggaaggtatgtatatggagccgtgctccagggaacagaggagaccctggatgacggctccaaacctggcggcagcgcaaaagatg

SEQ ID NO: 117789 - DNA, 103 bp, Artificial Sequence
  Synthetic Polynucleotide
taatacgactcactatagggccaggagggtgagcactagctgctcggggcaacagaggagagccccgatgagctagtgcaacctggcggcagcgcaaaagatg

SEQ ID NO: 117790 - DNA, 103 bp, Artificial Sequence
  Synthetic Polynucleotide
taatacgactcactatagggggctcagcctccaggagggtgagcactagcaacagaggagagctagtatgcaccctcctaacctggcggcagcgcaaaagatg

SEQ ID NO: 117791 - DNA, 103 bp, Artificial Sequence
  Synthetic Polynucleotide
taatacgactcactatagggcacatggggcggctcagcctccaggagggtaacagaggagaaccctcatggaggctgagaacctggcggcagcgcaaaagatg

SEQ ID NO: 117792 - DNA, 103 bp, Artificial Sequence
  Synthetic Polynucleotide
taatacgactcactatagggggctgatcagcacatggggcggctcagcctaacagaggagaaggctgatgcgccccatgaacctggcggcagcgcaaaagatg

SEQ ID NO: 117793 - DNA, 103 bp, Artificial Sequence
  Synthetic Polynucleotide
taatacgactcactataggggcactggggcggctgatcagcacatggggcaacagaggagagccccaatggctgatcagaacctggcggcagcgcaaaagatg

SEQ ID NO: 117794 - DNA, 103 bp, Artificial Sequence
  Synthetic Polynucleotide
taatacgactcactatagggggtgaagggcgcactggggcggctgatcagaacagaggagactgatcatgcgccccagtaacctggcggcagcgcaaaagatg

SEQ ID NO: 117795 - DNA, 103 bp, Artificial Sequence
  Synthetic Polynucleotide
taatacgactcactatagggtggaggcctcggtgaagggcgcactggggcaacagaggagagccccaatgcgcccttcaaacctggcggcagcgcaaaagatg

SEQ ID NO: 117796 - DNA, 103 bp, Artificial Sequence
  Synthetic Polynucleotide
taatacgactcactataggggacatcatcatggaggcctcggtgaagggcaacagaggagagcccttatgcgaggcctcaacctggcggcagcgcaaaagatg

SEQ ID NO: 117797 - DNA, 103 bp, Artificial Sequence
  Synthetic Polynucleotide
taatacgactcactatagggcttggtcagggacatcatcatggaggcctcaacagaggagagaggccatgatgatgatgaacctggcggcagcgcaaaagatg

SEQ ID NO: 117798 - DNA, 103 bp, Artificial Sequence
  Synthetic Polynucleotide
taatacgactcactatagggtgtcggccaacttggtcagggacatcatcaaacagaggagatgatgaatgccctgaccaaacctggcggcagcgcaaaagatg

SEQ ID NO: 117799 - DNA, 103 bp, Artificial Sequence
  Synthetic Polynucleotide
taatacgactcactatagggacataggaggaaggtatgtatatggagccgaacagaggagacggctcatgatacataccaacctggcggcagcgcaaaagatg

SEQ ID NO: 117800 - DNA, 103 bp, Artificial Sequence
  Synthetic Polynucleotide
taatacgactcactatagggaccaactccttgtcggccaacttggtcaggaacagaggagacctgacatggttggccgaaacctggcggcagcgcaaaagatg

SEQ ID NO: 117801 - DNA, 103 bp, Artificial Sequence
  Synthetic Polynucleotide
taatacgactcactataggggatcatgtgtaccaactccttgtcggccaaaacagaggagattggccatgaaggagttgaacctggcggcagcgcaaaagatg

SEQ ID NO: 117802 - DNA, 103 bp, Artificial Sequence
  Synthetic Polynucleotide
taatacgactcactatagggtggcccagctgatcatgtgtaccaactcctaacagaggagaaggagtatgtacacatgaaacctggcggcagcgcaaaagatg

SEQ ID NO: 117803 - DNA, 103 bp, Artificial Sequence
  Synthetic Polynucleotide
taatacgactcactatagggggaatcttcttggcccagctgatcatgtgtaacagaggagaacacatatgcagctgggcaacctggcggcagcgcaaaagatg

SEQ ID NO: 117804 - DNA, 103 bp, Artificial Sequence
  Synthetic Polynucleotide
taatacgactcactataggggtacataccgggaatcttcttggcccagctaacagaggagaagctggatgaagaagattaacctggcggcagcgcaaaagatg

SEQ ID NO: 117805 - DNA, 103 bp, Artificial Sequence
  Synthetic Polynucleotide
taatacgactcactatagggtgaccagagggtacataccgggaatcttctaacagaggagaagaagaatgccggtatgtaacctggcggcagcgcaaaagatg

SEQ ID NO: 117806 - DNA, 103 bp, Artificial Sequence
  Synthetic Polynucleotide
taatacgactcactatagggtgggtcgctgtgaccagagggtacataccgaacagaggagacggtatatgccctctggtaacctggcggcagcgcaaaagatg

SEQ ID NO: 117807 - DNA, 103 bp, Artificial Sequence
  Synthetic Polynucleotide
taatacgactcactataggggtcagcatcctgggtcgctgtgaccagaggaacagaggagacctctgatgacagcgaccaacctggcggcagcgcaaaagatg

SEQ ID NO: 117808 - DNA, 103 bp, Artificial Sequence
  Synthetic Polynucleotide
taatacgactcactatagggtccggctgctgtcagcatcctgggtcgctgaacagaggagacagcgaatgaggatgctgaacctggcggcagcgcaaaagatg

SEQ ID NO: 117809 - DNA, 103 bp, Artificial Sequence
  Synthetic Polynucleotide
taatacgactcactatagggtgagccagcttccggctgctgtcagcatccaacagaggagaggatgcatgcagcagccgaacctggcggcagcgcaaaagatg

SEQ ID NO: 117810 - DNA, 103 bp, Artificial Sequence
  Synthetic Polynucleotide
taatacgactcactatagggaggctcaatgcccaccacctggctggacataacagaggagaatgtccatgcaggtggtgaacctggcggcagcgcaaaagatg

SEQ ID NO: 117811 - DNA, 103 bp, Artificial Sequence
  Synthetic Polynucleotide
taatacgactcactatagggaccaggggccagggccacaggaggctcggtaacagaggagaaccgagatgcctgtggccaacctggcggcagcgcaaaagatg

SEQ ID NO: 117812 - DNA, 103 bp, Artificial Sequence
  Synthetic Polynucleotide
taatacgactcactatagggcacagagtctgaattggcaagggccaaggcaacagaggagagccttgatgcttgccaataacctggcggcagcgcaaaagatg

SEQ ID NO: 117813 - DNA, 103 bp, Artificial Sequence
  Synthetic Polynucleotide
taatacgactcactatagggcttcgatgtgcacagagtctgaattggcaaaacagaggagattgccaatgcagactctgaacctggcggcagcgcaaaagatg

SEQ ID NO: 117814 - DNA, 103 bp, Artificial Sequence
  Synthetic Polynucleotide
taatacgactcactataggggcctcggcatcttcgatgtgcacagagtctaacagaggagaagactcatggcacatcgaaacctggcggcagcgcaaaagatg

SEQ ID NO: 117815 - DNA, 103 bp, Artificial Sequence
  Synthetic Polynucleotide
taatacgactcactatagggctgctccacagcctcggcatcttcgatgtgaacagaggagacacatcatggatgccgagaacctggcggcagcgcaaaagatg

SEQ ID NO: 117816 - DNA, 103 bp, Artificial Sequence
  Synthetic Polynucleotide
taatacgactcactatagggcttctcgcagctgctccacagcctcggcataacagaggagaatgccgatgctgtggagcaacctggcggcagcgcaaaagatg

SEQ ID NO: 117817 - DNA, 103 bp, Artificial Sequence
  Synthetic Polynucleotide
taatacgactcactatagggtcgtgcagagcttctcgcagctgctccacaaacagaggagatgtggaatggctgcgagaaacctggcggcagcgcaaaagatg

SEQ ID NO: 117818 - DNA, 103 bp, Artificial Sequence
  Synthetic Polynucleotide
taatacgactcactatagggcagcagggcctcgtgcagagcttctcgcagaacagaggagactgcgaatggctctgcacaacctggcggcagcgcaaaagatg

SEQ ID NO: 117819 - DNA, 103 bp, Artificial Sequence
  Synthetic Polynucleotide
taatacgactcactatagggcttcatactccagcagggcctcgtgcagagaacagaggagactctgcatgaggccctgcaacctggcggcagcgcaaaagatg

SEQ ID NO: 117820 - DNA, 103 bp, Artificial Sequence
  Synthetic Polynucleotide
taatacgactcactataggggcccggccggcttcatactccagcagggccaacagaggagaggccctatgggagtatgaaacctggcggcagcgcaaaagatg

SEQ ID NO: 117821 - DNA, 103 bp, Artificial Sequence
  Synthetic Polynucleotide
taatacgactcactatagggtccggggccagcccggccggcttcatactcaacagaggagagagtatatggccggccggaacctggcggcagcgcaaaagatg

SEQ ID NO: 117822 - DNA, 103 bp, Artificial Sequence
  Synthetic Polynucleotide
taatacgactcactatagggtgggagctggaccaggggccagggccacagaacagaggagactgtggatgtggcccctgaacctggcggcagcgcaaaagatg

SEQ ID NO: 117823 - DNA, 103 bp, Artificial Sequence
  Synthetic Polynucleotide
taatacgactcactatagggcagcaccccctccggggccagcccggccggaacagaggagaccggccatgctggccccgaacctggcggcagcgcaaaagatg

SEQ ID NO: 117824 - DNA, 103 bp, Artificial Sequence
  Synthetic Polynucleotide
taatacgactcactatagggcgccgccgctcagcaccccctccggggccaaacagaggagatggcccatgagggggtgcaacctggcggcagcgcaaaagatg

SEQ ID NO: 117825 - DNA, 103 bp, Artificial Sequence
  Synthetic Polynucleotide
taatacgactcactatagggcctgcccgcccgccgccgctcagcacccccaacagaggagagggggtatggagcggcggaacctggcggcagcgcaaaagatg

SEQ ID NO: 117826 - DNA, 103 bp, Artificial Sequence
  Synthetic Polynucleotide
taatacgactcactatagggtgagcagcagcctgcccgcccgccgccgctaacagaggagaagcggcatggggcgggcaaacctggcggcagcgcaaaagatg

SEQ ID NO: 117827 - DNA, 103 bp, Artificial Sequence
  Synthetic Polynucleotide
taatacgactcactatagggagcggtagcgtgagcagcagcctgcccgccaacagaggagaggcgggatggctgctgctaacctggcggcagcgcaaaagatg

SEQ ID NO: 117828 - DNA, 103 bp, Artificial Sequence
  Synthetic Polynucleotide
taatacgactcactatagggctggcggaggagcggtagcgtgagcagcagaacagaggagactgctgatgacgctaccgaacctggcggcagcgcaaaagatg

SEQ ID NO: 117829 - DNA, 103 bp, Artificial Sequence
  Synthetic Polynucleotide
taatacgactcactatagggtgcccgctgtctggcggaggagcggtagcgaacagaggagacgctacatgtcctccgccaacctggcggcagcgcaaaagatg

SEQ ID NO: 117830 - DNA, 103 bp, Artificial Sequence
  Synthetic Polynucleotide
taatacgactcactataggggccagcactttgcccgctgtctggcggaggaacagaggagacctccgatggacagcgggaacctggcggcagcgcaaaagatg

SEQ ID NO: 117831 - DNA, 103 bp, Artificial Sequence
  Synthetic Polynucleotide
taatacgactcactatagggatagaaatgggccagcactttgcccgctgtaacagaggagaacagcgatgaaagtgctgaacctggcggcagcgcaaaagatg

SEQ ID NO: 117832 - DNA, 103 bp, Artificial Sequence
  Synthetic Polynucleotide
taatacgactcactataggggcttcaccccatagaaatgggccagcacttaacagaggagaaagtgcatgcccatttctaacctggcggcagcgcaaaagatg

SEQ ID NO: 117833 - DNA, 103 bp, Artificial Sequence
  Synthetic Polynucleotide
taatacgactcactatagggaggcagcgagtgggagctggaccaggggccaacagaggagaggccccatgtccagctccaacctggcggcagcgcaaaagatg

SEQ ID NO: 117834 - DNA, 103 bp, Artificial Sequence
  Synthetic Polynucleotide
taatacgactcactatagggttgccctccagcttcaccccatagaaatggaacagaggagaccatttatgtggggtgaaaacctggcggcagcgcaaaagatg

SEQ ID NO: 117835 - DNA, 103 bp, Artificial Sequence
  Synthetic Polynucleotide
taatacgactcactatagggcatgggcaccttgccctccagcttcaccccaacagaggagaggggtgatgctggagggcaacctggcggcagcgcaaaagatg

SEQ ID NO: 117836 - DNA, 103 bp, Artificial Sequence
  Synthetic Polynucleotide
taatacgactcactatagggacagcttgtgcatgggcaccttgccctccaaacagaggagatggaggatgaggtgcccaaacctggcggcagcgcaaaagatg

SEQ ID NO: 117837 - DNA, 103 bp, Artificial Sequence
  Synthetic Polynucleotide
taatacgactcactatagggatctccaagaacagcttgtgcatgggcaccaacagaggagaggtgccatggcacaagctaacctggcggcagcgcaaaagatg

SEQ ID NO: 117838 - DNA, 103 bp, Artificial Sequence
  Synthetic Polynucleotide
taatacgactcactatagggggcctcgagcatctccaagaacagcttgtgaacagaggagacacaagatgttcttggagaacctggcggcagcgcaaaagatg

SEQ ID NO: 117839 - DNA, 103 bp, Artificial Sequence
  Synthetic Polynucleotide
taatacgactcactatagggagtccatcatggcctcgagcatctccaagaaacagaggagatcttggatgtgctcgaggaacctggcggcagcgcaaaagatg

SEQ ID NO: 117840 - DNA, 103 bp, Artificial Sequence
  Synthetic Polynucleotide
taatacgactcactataggggtggcctgggaggcagcgagtgggagctggaacagaggagaccagctatgactcgctgcaacctggcggcagcgcaaaagatg

SEQ ID NO: 117841 - DNA, 103 bp, Artificial Sequence
  Synthetic Polynucleotide
taatacgactcactatagggcctcttccttgtggcctgggaggcagcgagaacagaggagactcgctatgtcccaggccaacctggcggcagcgcaaaagatg

SEQ ID NO: 117842 - DNA, 103 bp, Artificial Sequence
  Synthetic Polynucleotide
taatacgactcactatagggtccccatcctcctcttccttgtggcctgggaacagaggagacccaggatgcaaggaagaaacctggcggcagcgcaaaagatg

SEQ ID NO: 117843 - DNA, 103 bp, Artificial Sequence
  Synthetic Polynucleotide
taatacgactcactatagggcccagccccctccccatcctcctcttccttaacagaggagaaaggaaatggaggatgggaacctggcggcagcgcaaaagatg

SEQ ID NO: 117844 - DNA, 103 bp, Artificial Sequence
  Synthetic Polynucleotide
taatacgactcactataggggctcgccaggcccagccccctccccatcctaacagaggagaaggatgatgagggggctgaacctggcggcagcgcaaaagatg

SEQ ID NO: 117845 - DNA, 103 bp, Artificial Sequence
  Synthetic Polynucleotide
taatacgactcactatagggccaccgccctgctcgccaggcccagcccccaacagaggagagggggcatggcctggcgaaacctggcggcagcgcaaaagatg

SEQ ID NO: 117846 - DNA, 103 bp, Artificial Sequence
  Synthetic Polynucleotide
taatacgactcactatagggcaccagcttcccaccgccctgctcgccaggaacagaggagacctggcatgcagggcggtaacctggcggcagcgcaaaagatg

SEQ ID NO: 117847 - DNA, 103 bp, Artificial Sequence
  Synthetic Polynucleotide
taatacgactcactatagggtgatgtagagaggctcaatgcccaccacctaacagaggagaaggtggatggcattgagcaacctggcggcagcgcaaaagatg

SEQ ID NO: 117848 - DNA, 103 bp, Artificial Sequence
  Synthetic Polynucleotide
taatacgactcactataggggggagctgagcaccagcttcccaccgccctaacagaggagaagggcgatgggaagctggaacctggcggcagcgcaaaagatg

SEQ ID NO: 117849 - DNA, 103 bp, Artificial Sequence
  Synthetic Polynucleotide
taatacgactcactatagggcgcttgggcagggagctgagcaccagcttcaacagaggagagaagctatggctcagctcaacctggcggcagcgcaaaagatg

SEQ ID NO: 117850 - DNA, 103 bp, Artificial Sequence
  Synthetic Polynucleotide
taatacgactcactatagggcaggcagaggcgcttgggcagggagctgagaacagaggagactcagcatgctgcccaagaacctggcggcagcgcaaaagatg

SEQ ID NO: 117851 - DNA, 103 bp, Artificial Sequence
  Synthetic Polynucleotide
taatacgactcactatagggccccacagaccaggcagaggcgcttgggcaaacagaggagatgcccaatggcctctgccaacctggcggcagcgcaaaagatg

SEQ ID NO: 117852 - DNA, 103 bp, Artificial Sequence
  Synthetic Polynucleotide
taatacgactcactataggggaggccacgtccccacagaccaggcagaggaacagaggagacctctgatgggtctgtggaacctggcggcagcgcaaaagatg

SEQ ID NO: 117853 - DNA, 103 bp, Artificial Sequence
  Synthetic Polynucleotide
taatacgactcactataggggtggtagccggaggccacgtccccacagacaacagaggagagtctgtatggacgtggccaacctggcggcagcgcaaaagatg

SEQ ID NO: 117854 - DNA, 103 bp, Artificial Sequence
  Synthetic Polynucleotide
taatacgactcactatagggccacaccatagtggtagccggaggccacgtaacagaggagaacgtggatgccggctaccaacctggcggcagcgcaaaagatg

SEQ ID NO: 117855 - DNA, 103 bp, Artificial Sequence
  Synthetic Polynucleotide
taatacgactcactatagggtcacaggatgccacaccatagtggtagccgaacagaggagacggctaatgctatggtgtaacctggcggcagcgcaaaagatg

SEQ ID NO: 117856 - DNA, 103 bp, Artificial Sequence
  Synthetic Polynucleotide
taatacgactcactatagggtttgcaggcctcacaggatgccacaccataaacagaggagatatggtatggcatcctgtaacctggcggcagcgcaaaagatg

SEQ ID NO: 117857 - DNA, 103 bp, Artificial Sequence
  Synthetic Polynucleotide
taatacgactcactatagggtgaagaaggctttgcaggcctcacaggatgaacagaggagacatcctatgaggcctgcaaacctggcggcagcgcaaaagatg

SEQ ID NO: 117858 - DNA, 103 bp, Artificial Sequence
  Synthetic Polynucleotide
taatacgactcactatagggggctctgccttgatgtagagaggctcaatgaacagaggagacattgaatgtctctacataacctggcggcagcgcaaaagatg

SEQ ID NO: 117859 - DNA, 103 bp, Artificial Sequence
  Synthetic Polynucleotide
taatacgactcactatagggatggtcctcttgaagaaggctttgcaggccaacagaggagaggcctgatgagccttcttaacctggcggcagcgcaaaagatg

SEQ ID NO: 117860 - DNA, 103 bp, Artificial Sequence
  Synthetic Polynucleotide
taatacgactcactataggggctcccctggatggtcctcttgaagaaggcaacagaggagagccttcatgaagaggaccaacctggcggcagcgcaaaagatg

SEQ ID NO: 117861 - DNA, 103 bp, Artificial Sequence
  Synthetic Polynucleotide
taatacgactcactatagggtgtactcgatgctcccctggatggtcctctaacagaggagaagaggaatgtccaggggaaacctggcggcagcgcaaaagatg

SEQ ID NO: 117862 - DNA, 103 bp, Artificial Sequence
  Synthetic Polynucleotide
taatacgactcactataggggccggacagctgtactcgatgctcccctggaacagaggagaccagggatgcatcgagtaaacctggcggcagcgcaaaagatg

SEQ ID NO: 117863 - DNA, 103 bp, Artificial Sequence
  Synthetic Polynucleotide
taatacgactcactatagggctcgttggaggccggacagctgtactcgataacagaggagaatcgagatgagctgtccgaacctggcggcagcgcaaaagatg

SEQ ID NO: 117864 - DNA, 103 bp, Artificial Sequence
  Synthetic Polynucleotide
taatacgactcactatagggtgatctcacactcgttggaggccggacagcaacagaggagagctgtcatgcctccaacgaacctggcggcagcgcaaaagatg

SEQ ID NO: 117865 - DNA, 103 bp, Artificial Sequence
  Synthetic Polynucleotide
taatacgactcactatagggctccgcttggtgatctcacactcgttggagaacagaggagactccaaatggtgtgagataacctggcggcagcgcaaaagatg

SEQ ID NO: 117866 - DNA, 103 bp, Artificial Sequence
  Synthetic Polynucleotide
taatacgactcactatagggggccttgcgtctccgcttggtgatctcacaaacagaggagatgtgagatgaccaagcggaacctggcggcagcgcaaaagatg

SEQ ID NO: 117867 - DNA, 103 bp, Artificial Sequence
  Synthetic Polynucleotide
taatacgactcactatagggaggcctggcaggccttgcgtctccgcttggaacagaggagaccaagcatggacgcaaggaacctggcggcagcgcaaaagatg

SEQ ID NO: 117868 - DNA, 103 bp, Artificial Sequence
  Synthetic Polynucleotide
taatacgactcactataggggtgaagcggcaggcctggcaggccttgcgtaacagaggagaacgcaaatgctgccaggcaacctggcggcagcgcaaaagatg

SEQ ID NO: 117869 - DNA, 103 bp, Artificial Sequence
  Synthetic Polynucleotide
taatacgactcactatagggagggctggccggctctgccttgatgtagagaacagaggagactctacatgaaggcagagaacctggcggcagcgcaaaagatg

SEQ ID NO: 117870 - DNA, 103 bp, Artificial Sequence
  Synthetic Polynucleotide
taatacgactcactatagggcaggcacttggtgaagcggcaggcctggcaaacagaggagatgccagatgtgccgcttcaacctggcggcagcgcaaaagatg

SEQ ID NO: 117871 - DNA, 103 bp, Artificial Sequence
  Synthetic Polynucleotide
taatacgactcactatagggtgcccacccgcaggcacttggtgaagcggcaacagaggagagccgctatgccaagtgccaacctggcggcagcgcaaaagatg

SEQ ID NO: 117872 - DNA, 103 bp, Artificial Sequence
  Synthetic Polynucleotide
taatacgactcactatagggtccttgagcatgcccacccgcaggcacttgaacagaggagacaagtgatggcgggtgggaacctggcggcagcgcaaaagatg

SEQ ID NO: 117873 - DNA, 103 bp, Artificial Sequence
  Synthetic Polynucleotide
taatacgactcactataggggcgcactccctccttgagcatgcccacccgaacagaggagacgggtgatgatgctcaagaacctggcggcagcgcaaaagatg

SEQ ID NO: 117874 - DNA, 103 bp, Artificial Sequence
  Synthetic Polynucleotide
taatacgactcactatagggcgcggtccaggcgcactccctccttgagcaaacagaggagatgctcaatgagggagtgcaacctggcggcagcgcaaaagatg

SEQ ID NO: 117875 - DNA, 103 bp, Artificial Sequence
  Synthetic Polynucleotide
taatacgactcactatagggccaccccggacgcggtccaggcgcactcccaacagaggagagggagtatgcctggaccgaacctggcggcagcgcaaaagatg

SEQ ID NO: 117876 - DNA, 103 bp, Artificial Sequence
  Synthetic Polynucleotide
taatacgactcactatagggcttctgccgcccaccccggacgcggtccagaacagaggagactggacatggtccggggtaacctggcggcagcgcaaaagatg

SEQ ID NO: 117877 - DNA, 103 bp, Artificial Sequence
  Synthetic Polynucleotide
taatacgactcactataggggccgcttgtacttctgccgcccaccccggaaacagaggagatccgggatgggcggcagaaacctggcggcagcgcaaaagatg

SEQ ID NO: 117878 - DNA, 103 bp, Artificial Sequence
  Synthetic Polynucleotide
taatacgactcactatagggacctccggccgccgcttgtacttctgccgcaacagaggagagcggcaatggtacaagcgaacctggcggcagcgcaaaagatg

SEQ ID NO: 117879 - DNA, 103 bp, Artificial Sequence
  Synthetic Polynucleotide
taatacgactcactatagggcagtgggtccacctccggccgccgcttgtaaacagaggagatacaagatgcggccggagaacctggcggcagcgcaaaagatg

SEQ ID NO: 117880 - DNA, 103 bp, Artificial Sequence
  Synthetic Polynucleotide
taatacgactcactatagggttggactgtcagggctggccggctctgcctaacagaggagaaggcagatgcggccagccaacctggcggcagcgcaaaagatg

SEQ ID NO: 117881 - DNA, 103 bp, Artificial Sequence
  Synthetic Polynucleotide
taatacgactcactatagggccgggaagggcagtgggtccacctccggccaacagaggagaggccggatgtggacccacaacctggcggcagcgcaaaagatg

SEQ ID NO: 117882 - DNA, 103 bp, Artificial Sequence
  Synthetic Polynucleotide
taatacgactcactataggggggaaggggcccgggaagggcagtgggtccaacagaggagaggacccatggcccttcccaacctggcggcagcgcaaaagatg

SEQ ID NO: 117883 - DNA, 103 bp, Artificial Sequence
  Synthetic Polynucleotide
taatacgactcactataggggggcccagcagggaaggggcccgggaagggaacagaggagacccttcatgggccccttcaacctggcggcagcgcaaaagatg

SEQ ID NO: 117884 - DNA, 103 bp, Artificial Sequence
  Synthetic Polynucleotide
taatacgactcactatagggcgactgccaggggcccagcagggaaggggcaacagaggagagcccctatgctgctgggcaacctggcggcagcgcaaaagatg

SEQ ID NO: 117885 - DNA, 103 bp, Artificial Sequence
  Synthetic Polynucleotide
taatacgactcactataggggggcctccagcgactgccaggggcccagcaaacagaggagatgctggatgcctggcagtaacctggcggcagcgcaaaagatg

SEQ ID NO: 117886 - DNA, 103 bp, Artificial Sequence
  Synthetic Polynucleotide
taatacgactcactatagggtgtcttccgggggcctccagcgactgccagaacagaggagactggcaatggctggaggcaacctggcggcagcgcaaaagatg

SEQ ID NO: 117887 - DNA, 103 bp, Artificial Sequence
  Synthetic Polynucleotide
taatacgactcactatagggctggggctgctgtcttccgggggcctccagaacagaggagactggagatgcccggaagaaacctggcggcagcgcaaaagatg

SEQ ID NO: 117888 - DNA, 103 bp, Artificial Sequence
  Synthetic Polynucleotide
taatacgactcactatagggagtgcattcactggggctgctgtcttccggaacagaggagaccggaaatgagcagccccaacctggcggcagcgcaaaagatg

SEQ ID NO: 117889 - DNA, 103 bp, Artificial Sequence
  Synthetic Polynucleotide
taatacgactcactatagggatgagacaccagtgcattcactggggctgcaacagaggagagcagccatggtgaatgcaaacctggcggcagcgcaaaagatg

SEQ ID NO: 117890 - DNA, 103 bp, Artificial Sequence
  Synthetic Polynucleotide
taatacgactcactatagggccaccagcagatgagacaccagtgcattcaaacagaggagatgaatgatgtggtgtctcaacctggcggcagcgcaaaagatg

SEQ ID NO: 117891 - DNA, 103 bp, Artificial Sequence
  Synthetic Polynucleotide
taatacgactcactataggggaggaaccctttggactgtcagggctggccaacagaggagaggccagatgtgacagtccaacctggcggcagcgcaaaagatg

SEQ ID NO: 117892 - DNA, 103 bp, Artificial Sequence
  Synthetic Polynucleotide
taatacgactcactatagggtcaggctcaaccaccagcagatgagacaccaacagaggagaggtgtcatgtctgctggtaacctggcggcagcgcaaaagatg

SEQ ID NO: 117893 - DNA, 103 bp, Artificial Sequence
  Synthetic Polynucleotide
taatacgactcactatagggatagagcttctcaggctcaaccaccagcagaacagaggagactgctgatggttgagcctaacctggcggcagcgcaaaagatg

SEQ ID NO: 117894 - DNA, 103 bp, Artificial Sequence
  Synthetic Polynucleotide
taatacgactcactatagggcaggcatggcatagagcttctcaggctcaaaacagaggagattgagcatgagaagctctaacctggcggcagcgcaaaagatg

SEQ ID NO: 117895 - DNA, 103 bp, Artificial Sequence
  Synthetic Polynucleotide
taatacgactcactatagggcctgcggggtcaggcatggcatagagcttcaacagaggagagaagctatgtgccatgccaacctggcggcagcgcaaaagatg

SEQ ID NO: 117896 - DNA, 103 bp, Artificial Sequence
  Synthetic Polynucleotide
taatacgactcactatagggcccatcagggcctgcggggtcaggcatggcaacagaggagagccatgatggaccccgcaaacctggcggcagcgcaaaagatg

SEQ ID NO: 117897 - DNA, 103 bp, Artificial Sequence
  Synthetic Polynucleotide
taatacgactcactatagggctgggaggtgcccatcagggcctgcggggtaacagaggagaaccccgatggccctgatgaacctggcggcagcgcaaaagatg

SEQ ID NO: 117898 - DNA, 103 bp, Artificial Sequence
  Synthetic Polynucleotide
taatacgactcactataggggtagccacggctgggaggtgcccatcagggaacagaggagaccctgaatggcacctcccaacctggcggcagcgcaaaagatg

SEQ ID NO: 117899 - DNA, 103 bp, Artificial Sequence
  Synthetic Polynucleotide
taatacgactcactataggggtcacagagggtagccacggctgggaggtgaacagaggagacacctcatggccgtggctaacctggcggcagcgcaaaagatg

SEQ ID NO: 117900 - DNA, 103 bp, Artificial Sequence
  Synthetic Polynucleotide
taatacgactcactatagggggtcaaagaggtcacagagggtagccacggaacagaggagaccgtggatgccctctgtgaacctggcggcagcgcaaaagatg

SEQ ID NO: 117901 - DNA, 103 bp, Artificial Sequence
  Synthetic Polynucleotide
taatacgactcactatagggacaatctctcggtcaaagaggtcacagaggaacagaggagacctctgatgcctctttgaaacctggcggcagcgcaaaagatg

SEQ ID NO: 117902 - DNA, 103 bp, Artificial Sequence
  Synthetic Polynucleotide
taatacgactcactatagggctctgtctccgaggaaccctttggactgtcaacagaggagagacagtatgaagggttccaacctggcggcagcgcaaaagatg

SEQ ID NO: 117903 - DNA, 103 bp, Artificial Sequence
  Synthetic Polynucleotide
taatacgactcactataggggatggtgaccacaatctctcggtcaaagagaacagaggagactctttatgcgagagattaacctggcggcagcgcaaaagatg

SEQ ID NO: 117904 - DNA, 103 bp, Artificial Sequence
  Synthetic Polynucleotide
taatacgactcactatagggtggcccagctgatggtgaccacaatctctcaacagaggagagagagaatgtggtcaccaaacctggcggcagcgcaaaagatg

SEQ ID NO: 117905 - DNA, 103 bp, Artificial Sequence
  Synthetic Polynucleotide
taatacgactcactataggggggatgctcttggcccagctgatggtgaccaacagaggagaggtcacatgcagctgggcaacctggcggcagcgcaaaagatg

SEQ ID NO: 117906 - DNA, 103 bp, Artificial Sequence
  Synthetic Polynucleotide
taatacgactcactatagggtgagaagcctgggatgctcttggcccagctaacagaggagaagctggatgaagagcatcaacctggcggcagcgcaaaagatg

SEQ ID NO: 117907 - DNA, 103 bp, Artificial Sequence
  Synthetic Polynucleotide
taatacgactcactataggggcgacagcgatgagaagcctgggatgctctaacagaggagaagagcaatgcaggcttctaacctggcggcagcgcaaaagatg

SEQ ID NO: 117908 - DNA, 103 bp, Artificial Sequence
  Synthetic Polynucleotide
taatacgactcactatagggtggtcagacagcgacagcgatgagaagcctaacagaggagaaggcttatgatcgctgtcaacctggcggcagcgcaaaagatg

SEQ ID NO: 117909 - DNA, 103 bp, Artificial Sequence
  Synthetic Polynucleotide
taatacgactcactatagggtactgacatctggtcagacagcgacagcgaaacagaggagatcgctgatgctgtctgacaacctggcggcagcgcaaaagatg

SEQ ID NO: 117910 - DNA, 103 bp, Artificial Sequence
  Synthetic Polynucleotide
taatacgactcactatagggcgctctgcagtactgacatctggtcagacaaacagaggagatgtctgatgagatgtcagaacctggcggcagcgcaaaagatg

SEQ ID NO: 117911 - DNA, 103 bp, Artificial Sequence
  Synthetic Polynucleotide
taatacgactcactatagggtccatccacacgctctgcagtactgacatcaacagaggagagatgtcatgactgcagagaacctggcggcagcgcaaaagatg

SEQ ID NO: 117912 - DNA, 103 bp, Artificial Sequence
  Synthetic Polynucleotide
taatacgactcactatagggcaccagcacctccatccacacgctctgcagaacagaggagactgcagatggtgtggatgaacctggcggcagcgcaaaagatg

SEQ ID NO: 117913 - DNA, 103 bp, Artificial Sequence
  Synthetic Polynucleotide
taatacgactcactataggggaggctcggtctctgtctccgaggaaccctaacagaggagaagggttatgcggagacagaacctggcggcagcgcaaaagatg

SEQ ID NO: 117914 - DNA, 103 bp, Artificial Sequence
  Synthetic Polynucleotide
taatacgactcactatagggccacacccagcaccagcacctccatccacaaacagaggagatgtggaatgaggtgctggaacctggcggcagcgcaaaagatg

SEQ ID NO: 117915 - DNA, 103 bp, Artificial Sequence
  Synthetic Polynucleotide
taatacgactcactataggggagcgctgggccacacccagcaccagcaccaacagaggagaggtgctatggctgggtgtaacctggcggcagcgcaaaagatg

SEQ ID NO: 117916 - DNA, 103 bp, Artificial Sequence
  Synthetic Polynucleotide
taatacgactcactatagggcagtggcagtgagcgctgggccacacccagaacagaggagactgggtatggcccagcgcaacctggcggcagcgcaaaagatg

SEQ ID NO: 117917 - DNA, 103 bp, Artificial Sequence
  Synthetic Polynucleotide
taatacgactcactataggggctcatcctgcagtggcagtgagcgctgggaacagaggagacccagcatgcactgccacaacctggcggcagcgcaaaagatg

SEQ ID NO: 117918 - DNA, 103 bp, Artificial Sequence
  Synthetic Polynucleotide
taatacgactcactataggggcgaaggccagctcatcctgcagtggcagtaacagaggagaactgccatggcaggatgaaacctggcggcagcgcaaaagatg

SEQ ID NO: 117919 - DNA, 103 bp, Artificial Sequence
  Synthetic Polynucleotide
taatacgactcactatagggtaagtcctcagcgaaggccagctcatcctgaacagaggagacaggatatgctggccttcaacctggcggcagcgcaaaagatg

SEQ ID NO: 117920 - DNA, 103 bp, Artificial Sequence
  Synthetic Polynucleotide
taatacgactcactatagggcatccaggactaagtcctcagcgaaggccaaacagaggagatggcctatgctgaggactaacctggcggcagcgcaaaagatg

SEQ ID NO: 117921 - DNA, 103 bp, Artificial Sequence
  Synthetic Polynucleotide
taatacgactcactataggggccccctcttcatccaggactaagtcctcaaacagaggagatgaggaatgagtcctggaaacctggcggcagcgcaaaagatg

SEQ ID NO: 117922 - DNA, 103 bp, Artificial Sequence
  Synthetic Polynucleotide
taatacgactcactatagggagctgcccgtgccccctcttcatccaggacaacagaggagagtcctgatggaagaggggaacctggcggcagcgcaaaagatg

SEQ ID NO: 117923 - DNA, 103 bp, Artificial Sequence
  Synthetic Polynucleotide
taatacgactcactatagggcccccaggccagctgcccgtgccccctcttaacagaggagaaagaggatgcacgggcagaacctggcggcagcgcaaaagatg

SEQ ID NO: 117924 - DNA, 103 bp, Artificial Sequence
  Synthetic Polynucleotide
taatacgactcactatagggagggccacaggaggctcggtctctgtctccaacagaggagaggagacatggaccgagccaacctggcggcagcgcaaaagatg

SEQ ID NO: 117925 - DNA, 103 bp, Artificial Sequence
  Synthetic Polynucleotide
taatacgactcactataggggcccccagttcccccaggccagctgcccgtaacagaggagaacgggcatgtggcctgggaacctggcggcagcgcaaaagatg

SEQ ID NO: 117926 - DNA, 103 bp, Artificial Sequence
  Synthetic Polynucleotide
taatacgactcactatagggcagcagggcagcccccagttcccccaggccaacagaggagaggcctgatggaactggggaacctggcggcagcgcaaaagatg

SEQ ID NO: 117927 - DNA, 103 bp, Artificial Sequence
  Synthetic Polynucleotide
taatacgactcactataggggcactagttgcagcagggcagcccccagttaacagaggagaaactggatgctgccctgcaacctggcggcagcgcaaaagatg

SEQ ID NO: 117928 - DNA, 103 bp, Artificial Sequence
  Synthetic Polynucleotide
taatacgactcactatagggtgcagccgccgcactagttgcagcagggcaaacagaggagatgccctatggcaactagtaacctggcggcagcgcaaaagatg

SEQ ID NO: 117929 - DNA, 103 bp, Artificial Sequence
  Synthetic Polynucleotide
taatacgactcactatagggccgcagggcctgcagccgccgcactagttgaacagaggagacaactaatgcggcggctgaacctggcggcagcgcaaaagatg

SEQ ID NO: 117930 - DNA, 103 bp, Artificial Sequence
  Synthetic Polynucleotide
taatacgactcactatagggctcgctccagccgcagggcctgcagccgccaacagaggagaggcggcatgaggccctgcaacctggcggcagcgcaaaagatg

SEQ ID NO: 117931 - DNA, 103 bp, Artificial Sequence
  Synthetic Polynucleotide
taatacgactcactatagggacatactcctctcgctccagccgcagggccaacagaggagaggccctatggctggagcgaacctggcggcagcgcaaaagatg

SEQ ID NO: 117932 - DNA, 103 bp, Artificial Sequence
  Synthetic Polynucleotide
taatacgactcactatagggctttagtagaacatactcctctcgctccagaacagaggagactggagatggaggagtataacctggcggcagcgcaaaagatg

SEQ ID NO: 117933 - DNA, 103 bp, Artificial Sequence
  Synthetic Polynucleotide
taatacgactcactataggggggccaaggcctttagtagaacatactcctaacagaggagaaggagtatgttctactaaaacctggcggcagcgcaaaagatg

SEQ ID NO: 117934 - DNA, 103 bp, Artificial Sequence
  Synthetic Polynucleotide
taatacgactcactataggggaattggcaagggccaaggcctttagtagaaacagaggagatctactatgggccttggcaacctggcggcagcgcaaaagatg

SEQ ID NO: 117935 - DNA, 103 bp, Artificial Sequence
  Synthetic Polynucleotide
taatacgactcactatagggggagcccaggtgcctgtcgtccgaggacataacagaggagaatgtccatggacgacaggaacctggcggcagcgcaaaagatg

SEQ ID NO: 117936 - DNA, 103 bp, Artificial Sequence
  Synthetic Polynucleotide
taatacgactcactataggggtcggacgagccactggggctgtggtggctaacagaggagaagccacatgagccccagtaacctggcggcagcgcaaaagatg

SEQ ID NO: 117937 - DNA, 103 bp, Artificial Sequence
  Synthetic Polynucleotide
taatacgactcactatagggctcctccttctccaccttgagcttcttgtaaacagaggagatacaagatgctcaaggtgaacctggcggcagcgcaaaagatg

SEQ ID NO: 117938 - DNA, 103 bp, Artificial Sequence
  Synthetic Polynucleotide
taatacgactcactataggggcgtcacaaactcctccttctccaccttgaaacagaggagatcaaggatgagaaggaggaacctggcggcagcgcaaaagatg

SEQ ID NO: 117939 - DNA, 103 bp, Artificial Sequence
  Synthetic Polynucleotide
taatacgactcactatagggagggccttgagcgtcacaaactcctccttcaacagaggagagaaggaatggtttgtgacaacctggcggcagcgcaaaagatg

SEQ ID NO: 117940 - DNA, 103 bp, Artificial Sequence
  Synthetic Polynucleotide
taatacgactcactatagggggcgagggccagggccttgagcgtcacaaaaacagaggagatttgtgatgctcaaggccaacctggcggcagcgcaaaagatg

SEQ ID NO: 117941 - DNA, 103 bp, Artificial Sequence
  Synthetic Polynucleotide
taatacgactcactatagggaatcggagttggcgagggccagggccttgaaacagaggagatcaaggatgtggccctcgaacctggcggcagcgcaaaagatg

SEQ ID NO: 117942 - DNA, 103 bp, Artificial Sequence
  Synthetic Polynucleotide
taatacgactcactatagggatgtacatggaatcggagttggcgagggccaacagaggagaggccctatgcaactccgaaacctggcggcagcgcaaaagatg

SEQ ID NO: 117943 - DNA, 103 bp, Artificial Sequence
  Synthetic Polynucleotide
taatacgactcactatagggtagatcctcgatgtacatggaatcggagttaacagaggagaaactccatgtccatgtacaacctggcggcagcgcaaaagatg

SEQ ID NO: 117944 - DNA, 103 bp, Artificial Sequence
  Synthetic Polynucleotide
taatacgactcactatagggggacagcctctagatcctcgatgtacatggaacagaggagaccatgtatgtcgaggatcaacctggcggcagcgcaaaagatg

SEQ ID NO: 117945 - DNA, 103 bp, Artificial Sequence
  Synthetic Polynucleotide
taatacgactcactatagggtgcagcttctggacagcctctagatcctcgaacagaggagacgaggaatgagaggctgtaacctggcggcagcgcaaaagatg

SEQ ID NO: 117946 - DNA, 103 bp, Artificial Sequence
  Synthetic Polynucleotide
taatacgactcactatagggcagcaggtcctgcagcttctggacagcctcaacagaggagagaggctatgcagaagctgaacctggcggcagcgcaaaagatg

SEQ ID NO: 117947 - DNA, 103 bp, Artificial Sequence
  Synthetic Polynucleotide
taatacgactcactatagggcgccgctggcgtcggacgagccactggggcaacagaggagagccccaatggctcgtccgaacctggcggcagcgcaaaagatg

SEQ ID NO: 117948 - DNA, 103 bp, Artificial Sequence
  Synthetic Polynucleotide
taatacgactcactataggggtgcctcgtgcagcaggtcctgcagcttctaacagaggagaagaagcatgaggacctgcaacctggcggcagcgcaaaagatg

SEQ ID NO: 117949 - DNA, 103 bp, Artificial Sequence
  Synthetic Polynucleotide
taatacgactcactatagggtagtcctgcagtgcctcgtgcagcaggtccaacagaggagaggacctatggcacgaggcaacctggcggcagcgcaaaagatg

SEQ ID NO: 117950 - DNA, 103 bp, Artificial Sequence
  Synthetic Polynucleotide
taatacgactcactataggggctcagctcgtagtcctgcagtgcctcgtgaacagaggagacacgagatgctgcaggacaacctggcggcagcgcaaaagatg

SEQ ID NO: 117951 - DNA, 103 bp, Artificial Sequence
  Synthetic Polynucleotide
taatacgactcactatagggcatggcgctggctcagctcgtagtcctgcaaacagaggagatgcaggatgacgagctgaaacctggcggcagcgcaaaagatg

SEQ ID NO: 117952 - DNA, 103 bp, Artificial Sequence
  Synthetic Polynucleotide
taatacgactcactatagggcagggctcctcatggcgctggctcagctcgaacagaggagacgagctatgccagcgccaaacctggcggcagcgcaaaagatg

SEQ ID NO: 117953 - DNA, 103 bp, Artificial Sequence
  Synthetic Polynucleotide
taatacgactcactataggggcccgtcctccagggctcctcatggcgctgaacagaggagacagcgcatggaggagcccaacctggcggcagcgcaaaagatg

SEQ ID NO: 117954 - DNA, 103 bp, Artificial Sequence
  Synthetic Polynucleotide
taatacgactcactataggggcagcagcttgcccgtcctccagggctcctaacagaggagaaggagcatgggaggacggaacctggcggcagcgcaaaagatg

SEQ ID NO: 117955 - DNA, 103 bp, Artificial Sequence
  Synthetic Polynucleotide
taatacgactcactatagggggcagtgtcagcagcagcttgcccgtcctcaacagaggagagaggacatgcaagctgctaacctggcggcagcgcaaaagatg

SEQ ID NO: 117956 - DNA, 103 bp, Artificial Sequence
  Synthetic Polynucleotide
taatacgactcactatagggccgcagcagcggcagtgtcagcagcagcttaacagaggagaaagctgatgctgacactgaacctggcggcagcgcaaaagatg

SEQ ID NO: 117957 - DNA, 103 bp, Artificial Sequence
  Synthetic Polynucleotide
taatacgactcactatagggcggccgtctgccgcagcagcggcagtgtcaaacagaggagatgacacatgcgctgctgcaacctggcggcagcgcaaaagatg

SEQ ID NO: 117958 - DNA, 103 bp, Artificial Sequence
  Synthetic Polynucleotide
taatacgactcactatagggaggccaaagccgccgctggcgtcggacgagaacagaggagactcgtcatgcgccagcggaacctggcggcagcgcaaaagatg

SEQ ID NO: 117959 - DNA, 103 bp, Artificial Sequence
  Synthetic Polynucleotide
taatacgactcactatagggacggccttggcggccgtctgccgcagcagcaacagaggagagctgctatggcagacggcaacctggcggcagcgcaaaagatg

SEQ ID NO: 117960 - DNA, 103 bp, Artificial Sequence
  Synthetic Polynucleotide
taatacgactcactataggggaagtgctgcacggccttggcggccgtctgaacagaggagacagacgatggccaaggccaacctggcggcagcgcaaaagatg

SEQ ID NO: 117961 - DNA, 103 bp, Artificial Sequence
  Synthetic Polynucleotide
taatacgactcactatagggtgacgctatagaagtgctgcacggccttggaacagaggagaccaaggatgtgcagcactaacctggcggcagcgcaaaagatg

SEQ ID NO: 117962 - DNA, 103 bp, Artificial Sequence
  Synthetic Polynucleotide
taatacgactcactatagggccctgcagtttgacgctatagaagtgctgcaacagaggagagcagcaatgctatagcgtaacctggcggcagcgcaaaagatg

SEQ ID NO: 117963 - DNA, 103 bp, Artificial Sequence
  Synthetic Polynucleotide
taatacgactcactataggggggcactttgccctgcagtttgacgctataaacagaggagatatagcatgaaactgcagaacctggcggcagcgcaaaagatg

SEQ ID NO: 117964 - DNA, 103 bp, Artificial Sequence
  Synthetic Polynucleotide
taatacgactcactataggggtttgtgcatgggcactttgccctgcagttaacagaggagaaactgcatggcaaagtgcaacctggcggcagcgcaaaagatg

SEQ ID NO: 117965 - DNA, 103 bp, Artificial Sequence
  Synthetic Polynucleotide
taatacgactcactatagggtccaggaagagtttgtgcatgggcactttgaacagaggagacaaagtatgcatgcacaaaacctggcggcagcgcaaaagatg

SEQ ID NO: 117966 - DNA, 103 bp, Artificial Sequence
  Synthetic Polynucleotide
taatacgactcactatagggctccagcatctccaggaagagtttgtgcataacagaggagaatgcacatgctcttcctgaacctggcggcagcgcaaaagatg

SEQ ID NO: 117967 - DNA, 103 bp, Artificial Sequence
  Synthetic Polynucleotide
taatacgactcactatagggcaaccttggcctccagcatctccaggaagaaacagaggagatcttccatgagatgctggaacctggcggcagcgcaaaagatg

SEQ ID NO: 117968 - DNA, 103 bp, Artificial Sequence
  Synthetic Polynucleotide
taatacgactcactatagggtgctcttggccaaccttggcctccagcatcaacagaggagagatgctatgggccaaggtaacctggcggcagcgcaaaagatg

SEQ ID NO: 117969 - DNA, 103 bp, Artificial Sequence
  Synthetic Polynucleotide
taatacgactcactataggggcccagggccaggccaaagccgccgctggcaacagaggagagccagcatgggctttggcaacctggcggcagcgcaaaagatg

SEQ ID NO: 117970 - DNA, 103 bp, Artificial Sequence
  Synthetic Polynucleotide
taatacgactcactatagggtcctctaagctgctcttggccaaccttggcaacagaggagagccaagatgggccaagagaacctggcggcagcgcaaaagatg

SEQ ID NO: 117971 - DNA, 103 bp, Artificial Sequence
  Synthetic Polynucleotide
taatacgactcactatagggccttgggagatcctctaagctgctcttggcaacagaggagagccaagatgagcttagagaacctggcggcagcgcaaaagatg

SEQ ID NO: 117972 - DNA, 103 bp, Artificial Sequence
  Synthetic Polynucleotide
taatacgactcactatagggattctttcatccttgggagatcctctaagcaacagaggagagcttagatgatctcccaaaacctggcggcagcgcaaaagatg

SEQ ID NO: 117973 - DNA, 103 bp, Artificial Sequence
  Synthetic Polynucleotide
taatacgactcactatagggatggcttgacattctttcatccttgggagaaacagaggagatctcccatggatgaaagaaacctggcggcagcgcaaaagatg

SEQ ID NO: 117974 - DNA, 103 bp, Artificial Sequence
  Synthetic Polynucleotide
taatacgactcactatagggattttccatcatggcttgacattctttcataacagaggagaatgaaaatgtgtcaagccaacctggcggcagcgcaaaagatg

SEQ ID NO: 117975 - DNA, 103 bp, Artificial Sequence
  Synthetic Polynucleotide
taatacgactcactatagggtggaaggggcattttccatcatggcttgacaacagaggagagtcaagatgtgatggaaaaacctggcggcagcgcaaaagatg

SEQ ID NO: 117976 - DNA, 103 bp, Artificial Sequence
  Synthetic Polynucleotide
taatacgactcactatagggggcagctgattggaaggggcattttccatcaacagaggagagatggaatgtgccccttcaacctggcggcagcgcaaaagatg

SEQ ID NO: 117977 - DNA, 103 bp, Artificial Sequence
  Synthetic Polynucleotide
taatacgactcactatagggtgcttgtgaaggcagctgattggaaggggcaacagaggagagcccctatgaatcagctgaacctggcggcagcgcaaaagatg

SEQ ID NO: 117978 - DNA, 103 bp, Artificial Sequence
  Synthetic Polynucleotide
taatacgactcactatagggctctgatccctgcttgtgaaggcagctgataacagaggagaatcagcatgcttcacaagaacctggcggcagcgcaaaagatg

SEQ ID NO: 117979 - DNA, 103 bp, Artificial Sequence
  Synthetic Polynucleotide
taatacgactcactatagggcggggagttgctctgatccctgcttgtgaaaacagaggagattcacaatgagggatcagaacctggcggcagcgcaaaagatg

SEQ ID NO: 117980 - DNA, 103 bp, Artificial Sequence
  Synthetic Polynucleotide
taatacgactcactatagggtggcgtgggtgcccagggccaggccaaagcaacagaggagagctttgatgtggccctggaacctggcggcagcgcaaaagatg

SEQ ID NO: 117981 - DNA, 103 bp, Artificial Sequence
  Synthetic Polynucleotide
taatacgactcactatagggtggggatccccggggagttgctctgatcccaacagaggagagggatcatggcaactcccaacctggcggcagcgcaaaagatg

SEQ ID NO: 117982 - DNA, 103 bp, Artificial Sequence
  Synthetic Polynucleotide
taatacgactcactataggggggcgtggattggggatccccggggagttgaacagaggagacaactcatgggggatcccaacctggcggcagcgcaaaagatg

SEQ ID NO: 117983 - DNA, 103 bp, Artificial Sequence
  Synthetic Polynucleotide
taatacgactcactatagggtggactagaagggcgtggattggggatcccaacagaggagagggatcatgaatccacgcaacctggcggcagcgcaaaagatg

SEQ ID NO: 117984 - DNA, 103 bp, Artificial Sequence
  Synthetic Polynucleotide
taatacgactcactatagggtgaggggggttggactagaagggcgtggataacagaggagaatccacatgcttctagtcaacctggcggcagcgcaaaagatg

SEQ ID NO: 117985 - DNA, 103 bp, Artificial Sequence
  Synthetic Polynucleotide
taatacgactcactatagggcctctctcattgaggggggttggactagaaaacagaggagattctagatgaacccccctaacctggcggcagcgcaaaagatg

SEQ ID NO: 117986 - DNA, 103 bp, Artificial Sequence
  Synthetic Polynucleotide
taatacgactcactataggggatctgcctgcctctctcattgaggggggtaacagaggagaacccccatgaatgagagaaacctggcggcagcgcaaaagatg

SEQ ID NO: 117987 - DNA, 103 bp, Artificial Sequence
  Synthetic Polynucleotide
taatacgactcactatagggtgctgggtgagatctgcctgcctctctcataacagaggagaatgagaatggcaggcagaaacctggcggcagcgcaaaagatg

SEQ ID NO: 117988 - DNA, 103 bp, Artificial Sequence
  Synthetic Polynucleotide
taatacgactcactatagggggtgtcctagtgctgggtgagatctgcctgaacagaggagacaggcaatgctcacccagaacctggcggcagcgcaaaagatg

SEQ ID NO: 117989 - DNA, 103 bp, Artificial Sequence
  Synthetic Polynucleotide
taatacgactcactatagggctggcctcctggtgtcctagtgctgggtgaaacagaggagatcacccatgactaggacaaacctggcggcagcgcaaaagatg

SEQ ID NO: 117990 - DNA, 103 bp, Artificial Sequence
  Synthetic Polynucleotide
taatacgactcactataggggatgctttccctggcctcctggtgtcctagaacagaggagactaggaatgcaggaggccaacctggcggcagcgcaaaagatg

SEQ ID NO: 117991 - DNA, 103 bp, Artificial Sequence
  Synthetic Polynucleotide
taatacgactcactatagggtccagaccgttggcgtgggtgcccagggccaacagaggagaggccctatgcacccacgcaacctggcggcagcgcaaaagatg

SEQ ID NO: 117992 - DNA, 103 bp, Artificial Sequence
  Synthetic Polynucleotide
taatacgactcactataggggtgagccagagatgctttccctggcctcctaacagaggagaaggaggatggggaaagcaaacctggcggcagcgcaaaagatg

SEQ ID NO: 117993 - DNA, 103 bp, Artificial Sequence
  Synthetic Polynucleotide
taatacgactcactataggggggtggcgagtccagaccgttggcgtgggtaacagaggagaacccacatgaacggtctgaacctggcggcagcgcaaaagatg

SEQ ID NO: 117994 - DNA, 103 bp, Artificial Sequence
  Synthetic Polynucleotide
taatacgactcactatagggctgcaaacatgggtggcgagtccagaccgtaacagaggagaacggtcatgactcgccacaacctggcggcagcgcaaaagatg

SEQ ID NO: 117995 - DNA, 103 bp, Artificial Sequence
  Synthetic Polynucleotide
taatacgactcactatagggagcccggcgcctgcaaacatgggtggcgagaacagaggagactcgccatgcatgtttgcaacctggcggcagcgcaaaagatg

SEQ ID NO: 117996 - DNA, 103 bp, Artificial Sequence
  Synthetic Polynucleotide
taatacgactcactatagggggtgcctcccagcccggcgcctgcaaacataacagaggagaatgtttatgggcgccgggaacctggcggcagcgcaaaagatg

SEQ ID NO: 117997 - DNA, 103 bp, Artificial Sequence
  Synthetic Polynucleotide
taatacgactcactatagggagccgcagctggagcccaggtgcctgtcgtaacagaggagaacgacaatgacctgggctaacctggcggcagcgcaaaagatg

SEQ ID NO: 117998 - DNA, 103 bp, Artificial Sequence
  Synthetic Polynucleotide
taatacgactcactatagggtgcggcatggggtgcctcccagcccggcgcaacagaggagagcgccgatgtgggaggcaaacctggcggcagcgcaaaagatg

SEQ ID NO: 117999 - DNA, 103 bp, Artificial Sequence
  Synthetic Polynucleotide
taatacgactcactatagggtcgtagctcttgcggcatggggtgcctcccaacagaggagagggaggatgcccatgccgaacctggcggcagcgcaaaagatg

SEQ ID NO: 118000 - DNA, 103 bp, Artificial Sequence
  Synthetic Polynucleotide
taatacgactcactatagggggcacagtcctcgtagctcttgcggcatggaacagaggagaccatgcatgaagagctacaacctggcggcagcgcaaaagatg

SEQ ID NO: 118001 - DNA, 103 bp, Artificial Sequence
  Synthetic Polynucleotide
taatacgactcactatagggtgatgccgctggcacagtcctcgtagctctaacagaggagaagagctatgaggactgtgaacctggcggcagcgcaaaagatg

SEQ ID NO: 118002 - DNA, 103 bp, Artificial Sequence
  Synthetic Polynucleotide
taatacgactcactataggggagtcctccatgatgccgctggcacagtccaacagaggagaggactgatgcagcggcataacctggcggcagcgcaaaagatg

SEQ ID NO: 118003 - DNA, 103 bp, Artificial Sequence
  Synthetic Polynucleotide
taatacgactcactatagggcttgatggccgagtcctccatgatgccgctaacagaggagaagcggcatgatggaggacaacctggcggcagcgcaaaagatg

SEQ ID NO: 118004 - DNA, 103 bp, Artificial Sequence
  Synthetic Polynucleotide
taatacgactcactatagggtgtactcgcacttgatggccgagtcctccaaacagaggagatggaggatgcggccatcaaacctggcggcagcgcaaaagatg

SEQ ID NO: 118005 - DNA, 103 bp, Artificial Sequence
  Synthetic Polynucleotide
taatacgactcactataggggcgttgagcatgtactcgcacttgatggccaacagaggagaggccatatggtgcgagtaaacctggcggcagcgcaaaagatg

SEQ ID NO: 118006 - DNA, 103 bp, Artificial Sequence
  Synthetic Polynucleotide
taatacgactcactatagggcttggggatggcgttgagcatgtactcgcaaacagaggagatgcgagatgatgctcaacaacctggcggcagcgcaaaagatg

SEQ ID NO: 118007 - DNA, 103 bp, Artificial Sequence
  Synthetic Polynucleotide
taatacgactcactatagggggcacaggcgcttggggatggcgttgagcaaacagaggagatgctcaatgccatccccaaacctggcggcagcgcaaaagatg

SEQ ID NO: 118008 - DNA, 103 bp, Artificial Sequence
  Synthetic Polynucleotide
taatacgactcactatagggttgatgaaggagccgcagctggagcccaggaacagaggagacctgggatgcagctgcggaacctggcggcagcgcaaaagatg

SEQ ID NO: 118009 - DNA, 103 bp, Artificial Sequence
  Synthetic Polynucleotide
taatacgactcactatagggccgcacacgaggcacaggcgcttggggatgaacagaggagacatcccatggcgcctgtgaacctggcggcagcgcaaaagatg

SEQ ID NO: 118010 - DNA, 103 bp, Artificial Sequence
  Synthetic Polynucleotide
taatacgactcactatagggggcaatgtccccgcacacgaggcacaggcgaacagaggagacgcctgatgctcgtgtgcaacctggcggcagcgcaaaagatg

SEQ ID NO: 118011 - DNA, 103 bp, Artificial Sequence
  Synthetic Polynucleotide
taatacgactcactatagggggtagccagaggcaatgtccccgcacacgaaacagaggagatcgtgtatggggacattgaacctggcggcagcgcaaaagatg

SEQ ID NO: 118012 - DNA, 103 bp, Artificial Sequence
  Synthetic Polynucleotide
taatacgactcactatagggacgccgtagtggtagccagaggcaatgtccaacagaggagaggacatatgctctggctaaacctggcggcagcgcaaaagatg

SEQ ID NO: 118013 - DNA, 103 bp, Artificial Sequence
  Synthetic Polynucleotide
taatacgactcactataggggcaggaggccacgccgtagtggtagccagaaacagaggagatctggcatgcactacggcaacctggcggcagcgcaaaagatg

SEQ ID NO: 118014 - DNA, 103 bp, Artificial Sequence
  Synthetic Polynucleotide
taatacgactcactatagggtgcaagcctcgcaggaggccacgccgtagtaacagaggagaactacgatgtggcctcctaacctggcggcagcgcaaaagatg

SEQ ID NO: 118015 - DNA, 103 bp, Artificial Sequence
  Synthetic Polynucleotide
taatacgactcactatagggaagaaggccttgcaagcctcgcaggaggccaacagaggagaggcctcatgcgaggcttgaacctggcggcagcgcaaaagatg

SEQ ID NO: 118016 - DNA, 103 bp, Artificial Sequence
  Synthetic Polynucleotide
taatacgactcactatagggagtcctcttgaagaaggccttgcaagcctcaacagaggagagaggctatgaaggccttcaacctggcggcagcgcaaaagatg

SEQ ID NO: 118017 - DNA, 103 bp, Artificial Sequence
  Synthetic Polynucleotide
taatacgactcactatagggtcccttggatagtcctcttgaagaaggcctaacagaggagaaggcctatgtcaagaggaaacctggcggcagcgcaaaagatg

SEQ ID NO: 118018 - DNA, 103 bp, Artificial Sequence
  Synthetic Polynucleotide
taatacgactcactatagggtactcaatgttcccttggatagtcctcttgaacagaggagacaagagatgtatccaaggaacctggcggcagcgcaaaagatg

SEQ ID NO: 118019 - DNA, 103 bp, Artificial Sequence
  Synthetic Polynucleotide
taatacgactcactatagggcggctcagtcttgatgaaggagccgcagctaacagaggagaagctgcatgtccttcatcaacctggcggcagcgcaaaagatg

SEQ ID NO: 118020 - DNA, 103 bp, Artificial Sequence
  Synthetic Polynucleotide
taatacgactcactatagggcgggcagctgtactcaatgttcccttggataacagaggagaatccaaatgaacattgagaacctggcggcagcgcaaaagatg

SEQ ID NO: 118021 - DNA, 103 bp, Artificial Sequence
  Synthetic Polynucleotide
taatacgactcactatagggcgttggtggccgggcagctgtactcaatgtaacagaggagaacattgatgacagctgccaacctggcggcagcgcaaaagatg

SEQ ID NO: 118022 - DNA, 103 bp, Artificial Sequence
  Synthetic Polynucleotide
taatacgactcactatagggatctcgcactcgttggtggccgggcagctgaacagaggagacagctgatgggccaccaaaacctggcggcagcgcaaaagatg

SEQ ID NO: 118023 - DNA, 103 bp, Artificial Sequence
  Synthetic Polynucleotide
taatacgactcactatagggccgtttggtgatctcgcactcgttggtggcaacagaggagagccaccatggagtgcgagaacctggcggcagcgcaaaagatg

SEQ ID NO: 118024 - DNA, 103 bp, Artificial Sequence
  Synthetic Polynucleotide
taatacgactcactatagggacttgcgcctccgtttggtgatctcgcactaacagaggagaagtgcgatgtcaccaaacaacctggcggcagcgcaaaagatg

SEQ ID NO: 118025 - DNA, 103 bp, Artificial Sequence
  Synthetic Polynucleotide
taatacgactcactataggggcctggcaggacttgcgcctccgtttggtgaacagaggagacaccaaatggaggcgcaaaacctggcggcagcgcaaaagatg

SEQ ID NO: 118026 - DNA, 103 bp, Artificial Sequence
  Synthetic Polynucleotide
taatacgactcactataggggaagcggcaggcctggcaggacttgcgcctaacagaggagaaggcgcatgtcctgccagaacctggcggcagcgcaaaagatg

SEQ ID NO: 118027 - DNA, 103 bp, Artificial Sequence
  Synthetic Polynucleotide
taatacgactcactatagggggcatttcatgaagcggcaggcctggcaggaacagaggagacctgccatgcctgccgctaacctggcggcagcgcaaaagatg

SEQ ID NO: 118028 - DNA, 103 bp, Artificial Sequence
  Synthetic Polynucleotide
taatacgactcactatagggcccactttgaggcatttcatgaagcggcagaacagaggagactgccgatgcatgaaatgaacctggcggcagcgcaaaagatg

SEQ ID NO: 118029 - DNA, 103 bp, Artificial Sequence
  Synthetic Polynucleotide
taatacgactcactatagggcttcagcatccccactttgaggcatttcataacagaggagaatgaaaatgctcaaagtgaacctggcggcagcgcaaaagatg

SEQ ID NO: 118030 - DNA, 103 bp, Artificial Sequence
  Synthetic Polynucleotide
taatacgactcactatagggacgggctggacggctcagtcttgatgaaggaacagaggagaccttcaatgagactgagcaacctggcggcagcgcaaaagatg

SEQ ID NO: 118031 - DNA, 103 bp, Artificial Sequence
  Synthetic Polynucleotide
taatacgactcactataggggcacaccttccttcagcatccccactttgaaacagaggagatcaaagatgggatgctgaaacctggcggcagcgcaaaagatg

SEQ ID NO: 118032 - DNA, 103 bp, Artificial Sequence
  Synthetic Polynucleotide
taatacgactcactatagggcgatcaaggcgcacaccttccttcagcatcaacagaggagagatgctatgggaaggtgtaacctggcggcagcgcaaaagatg

SEQ ID NO: 118033 - DNA, 103 bp, Artificial Sequence
  Synthetic Polynucleotide
taatacgactcactatagggtccacgcactcgatcaaggcgcacaccttcaacagaggagagaaggtatgcgccttgataacctggcggcagcgcaaaagatg

SEQ ID NO: 118034 - DNA, 103 bp, Artificial Sequence
  Synthetic Polynucleotide
taatacgactcactatagggtctgacggcctccacgcactcgatcaaggcaacagaggagagccttgatggagtgcgtgaacctggcggcagcgcaaaagatg

SEQ ID NO: 118035 - DNA, 103 bp, Artificial Sequence
  Synthetic Polynucleotide
taatacgactcactatagggcgcttgtatttctgacggcctccacgcactaacagaggagaagtgcgatgaggccgtcaaacctggcggcagcgcaaaagatg

SEQ ID NO: 118036 - DNA, 103 bp, Artificial Sequence
  Synthetic Polynucleotide
taatacgactcactataggggtccagccgtcgcttgtatttctgacggccaacagaggagaggccgtatgaaatacaagaacctggcggcagcgcaaaagatg

SEQ ID NO: 118037 - DNA, 103 bp, Artificial Sequence
  Synthetic Polynucleotide
taatacgactcactatagggtgctctctgagtccagccgtcgcttgtattaacagaggagaaatacaatggacggctggaacctggcggcagcgcaaaagatg

SEQ ID NO: 118038 - DNA, 103 bp, Artificial Sequence
  Synthetic Polynucleotide
taatacgactcactatagggaggtatgggctgctctctgagtccagccgtaacagaggagaacggctatgctcagagagaacctggcggcagcgcaaaagatg

SEQ ID NO: 118039 - DNA, 103 bp, Artificial Sequence
  Synthetic Polynucleotide
taatacgactcactatagggttgtaagctcaggtatgggctgctctctgaaacagaggagatcagagatgagcccatacaacctggcggcagcgcaaaagatg

SEQ ID NO: 118040 - DNA, 103 bp, Artificial Sequence
  Synthetic Polynucleotide
taatacgactcactataggggtggagaaatttgtaagctcaggtatgggcaacagaggagagcccatatgtgagcttacaacctggcggcagcgcaaaagatg

SEQ ID NO: 118041 - DNA, 103 bp, Artificial Sequence
  Synthetic Polynucleotide
taatacgactcactatagggatgcccgaggacgggctggacggctcagtcaacagaggagagactgaatggtccagcccaacctggcggcagcgcaaaagatg

SEQ ID NO: 118042 - DNA, 103 bp, Artificial Sequence
  Synthetic Polynucleotide
taatacgactcactatagggtttttagcaggtggagaaatttgtaagctcaacagaggagagagcttatgaatttctccaacctggcggcagcgcaaaagatg

SEQ ID NO: 118043 - DNA, 103 bp, Artificial Sequence
  Synthetic Polynucleotide
taatacgactcactatagggggtcaatggctttttagcaggtggagaaataacagaggagaatttctatgcctgctaaaaacctggcggcagcgcaaaagatg

SEQ ID NO: 118044 - DNA, 103 bp, Artificial Sequence
  Synthetic Polynucleotide
taatacgactcactatagggagacaatcttggtcaatggctttttagcagaacagaggagactgctaatgagccattgaaacctggcggcagcgcaaaagatg

SEQ ID NO: 118045 - DNA, 103 bp, Artificial Sequence
  Synthetic Polynucleotide
taatacgactcactatagggagtaggtatgagacaatcttggtcaatggcaacagaggagagccattatgcaagattgtaacctggcggcagcgcaaaagatg

SEQ ID NO: 118046 - DNA, 103 bp, Artificial Sequence
  Synthetic Polynucleotide
taatacgactcactatagggctcagccaccagtaggtatgagacaatcttaacagaggagaaagattatgtcatacctaaacctggcggcagcgcaaaagatg

SEQ ID NO: 118047 - DNA, 103 bp, Artificial Sequence
  Synthetic Polynucleotide
taatacgactcactataggggcttgtccggctcagccaccagtaggtatgaacagaggagacataccatgtggtggctgaacctggcggcagcgcaaaagatg

SEQ ID NO: 118048 - DNA, 103 bp, Artificial Sequence
  Synthetic Polynucleotide
taatacgactcactatagggatggcatagagcttgtccggctcagccaccaacagaggagaggtggcatggccggacaaaacctggcggcagcgcaaaagatg

SEQ ID NO: 118049 - DNA, 103 bp, Artificial Sequence
  Synthetic Polynucleotide
taatacgactcactatagggagggggaggcatggcatagagcttgtccggaacagaggagaccggacatgctctatgccaacctggcggcagcgcaaaagatg

SEQ ID NO: 118050 - DNA, 103 bp, Artificial Sequence
  Synthetic Polynucleotide
taatacgactcactatagggcaggcataccagggggaggcatggcatagaaacagaggagatctatgatgtgcctccccaacctggcggcagcgcaaaagatg

SEQ ID NO: 118051 - DNA, 103 bp, Artificial Sequence
  Synthetic Polynucleotide
taatacgactcactatagggatgtccccctcaggcataccagggggaggcaacagaggagagcctccatgtggtatgccaacctggcggcagcgcaaaagatg

SEQ ID NO: 118052 - DNA, 103 bp, Artificial Sequence
  Synthetic Polynucleotide
taatacgactcactataggggagggcatcgatgcccgaggacgggctggaaacagaggagatccagcatgtcctcgggcaacctggcggcagcgcaaaagatg

SEQ ID NO: 118053 - DNA, 103 bp, Artificial Sequence
  Synthetic Polynucleotide
taatacgactcactatagggcagggccttgatgtccccctcaggcataccaacagaggagaggtatgatggagggggacaacctggcggcagcgcaaaagatg

SEQ ID NO: 118054 - DNA, 103 bp, Artificial Sequence
  Synthetic Polynucleotide
taatacgactcactatagggagagagtggtcagggccttgatgtccccctaacagaggagaagggggatgtcaaggcccaacctggcggcagcgcaaaagatg

SEQ ID NO: 118055 - DNA, 103 bp, Artificial Sequence
  Synthetic Polynucleotide
taatacgactcactataggggccaggtcacagagagtggtcagggccttgaacagaggagacaaggcatggaccactctaacctggcggcagcgcaaaagatg

SEQ ID NO: 118056 - DNA, 103 bp, Artificial Sequence
  Synthetic Polynucleotide
taatacgactcactatagggctctcggtctgccaggtcacagagagtggtaacagaggagaaccactatgtgtgacctgaacctggcggcagcgcaaaagatg

SEQ ID NO: 118057 - DNA, 103 bp, Artificial Sequence
  Synthetic Polynucleotide
taatacgactcactatagggtgaccacaagctctcggtctgccaggtcacaacagaggagagtgaccatgcagaccgagaacctggcggcagcgcaaaagatg

SEQ ID NO: 118058 - DNA, 103 bp, Artificial Sequence
  Synthetic Polynucleotide
taatacgactcactatagggcagccaatgatgaccacaagctctcggtctaacagaggagaagaccgatggcttgtggtaacctggcggcagcgcaaaagatg

SEQ ID NO: 118059 - DNA, 103 bp, Artificial Sequence
  Synthetic Polynucleotide
taatacgactcactataggggtgcttggcccagccaatgatgaccacaagaacagaggagacttgtgatgatcattggcaacctggcggcagcgcaaaagatg

SEQ ID NO: 118060 - DNA, 103 bp, Artificial Sequence
  Synthetic Polynucleotide
taatacgactcactatagggagcctgggatgtgcttggcccagccaatgaaacagaggagatcattgatggggccaagcaacctggcggcagcgcaaaagatg

SEQ ID NO: 118061 - DNA, 103 bp, Artificial Sequence
  Synthetic Polynucleotide
taatacgactcactatagggaggcttgagaagcctgggatgtgcttggccaacagaggagaggccaaatgcatcccaggaacctggcggcagcgcaaaagatg

SEQ ID NO: 118062 - DNA, 103 bp, Artificial Sequence
  Synthetic Polynucleotide
taatacgactcactatagggccccagggagaggcttgagaagcctgggataacagaggagaatcccaatgttctcaagcaacctggcggcagcgcaaaagatg

SEQ ID NO: 118063 - DNA, 103 bp, Artificial Sequence
  Synthetic Polynucleotide
taatacgactcactatagggtgtggtggctgagggcatcgatgcccgaggaacagaggagacctcggatgtcgatgcccaacctggcggcagcgcaaaagatg

SEQ ID NO: 118064 - DNA, 103 bp, Artificial Sequence
  Synthetic Polynucleotide
taatacgactcactatagggtcatctggtcccccagggagaggcttgagaaacagaggagatctcaaatgtctccctggaacctggcggcagcgcaaaagatg

SEQ ID NO: 118065 - DNA, 103 bp, Artificial Sequence
  Synthetic Polynucleotide
taatacgactcactatagggtgcagcaggctcatctggtcccccagggagaacagaggagactccctatgggaccagataacctggcggcagcgcaaaagatg

SEQ ID NO: 118066 - DNA, 103 bp, Artificial Sequence
  Synthetic Polynucleotide
taatacgactcactatagggccaggcactctgcagcaggctcatctggtcaacagaggagagaccagatgagcctgctgaacctggcggcagcgcaaaagatg

SEQ ID NO: 118067 - DNA, 103 bp, Artificial Sequence
  Synthetic Polynucleotide
taatacgactcactatagggggatttccatccaggcactctgcagcaggcaacagaggagagcctgcatgagagtgcctaacctggcggcagcgcaaaagatg

SEQ ID NO: 118068 - DNA, 103 bp, Artificial Sequence
  Synthetic Polynucleotide
taatacgactcactatagggcccaggatgaggatttccatccaggcactcaacagaggagagagtgcatggatggaaataacctggcggcagcgcaaaagatg

SEQ ID NO: 118069 - DNA, 103 bp, Artificial Sequence
  Synthetic Polynucleotide
taatacgactcactataggggtacacgatgcccaggatgaggatttccataacagaggagaatggaaatgctcatcctgaacctggcggcagcgcaaaagatg

SEQ ID NO: 118070 - DNA, 103 bp, Artificial Sequence
  Synthetic Polynucleotide
taatacgactcactataggggcagcgagcggtacacgatgcccaggatgaaacagaggagatcatccatggcatcgtgtaacctggcggcagcgcaaaagatg

SEQ ID NO: 118071 - DNA, 103 bp, Artificial Sequence
  Synthetic Polynucleotide
taatacgactcactatagggtcgtcatagggcagcgagcggtacacgatgaacagaggagacatcgtatgccgctcgctaacctggcggcagcgcaaaagatg

SEQ ID NO: 118072 - DNA, 103 bp, Artificial Sequence
  Synthetic Polynucleotide
taatacgactcactatagggcaccagcttgtcgtcatagggcagcgagcgaacagaggagacgctcgatgccctatgacaacctggcggcagcgcaaaagatg

SEQ ID NO: 118073 - DNA, 103 bp, Artificial Sequence
  Synthetic Polynucleotide
taatacgactcactatagggcctcagcgtacaccagcttgtcgtcataggaacagaggagacctatgatgacaagctggaacctggcggcagcgcaaaagatg

SEQ ID NO: 118074 - DNA, 103 bp, Artificial Sequence
  Synthetic Polynucleotide
taatacgactcactatagggccactggggctgtggtggctgagggcatcgaacagaggagacgatgcatgcagccaccaaacctggcggcagcgcaaaagatg

SEQ ID NO: 118075 - DNA, 103 bp, Artificial Sequence
  Synthetic Polynucleotide
taatacgactcactatagggatgatgtagtcctcagcgtacaccagcttgaacagaggagacaagctatggtacgctgaaacctggcggcagcgcaaaagatg

SEQ ID NO: 118076 - DNA, 103 bp, Artificial Sequence
  Synthetic Polynucleotide
taatacgactcactatagggctcctcatccatgatgtagtcctcagcgtaaacagaggagatacgctatggactacatcaacctggcggcagcgcaaaagatg

SEQ ID NO: 118077 - DNA, 103 bp, Artificial Sequence
  Synthetic Polynucleotide
taatacgactcactatagggggcgggagtgctcctcatccatgatgtagtaacagaggagaactacaatgtggatgaggaacctggcggcagcgcaaaagatg

SEQ ID NO: 118078 - DNA, 103 bp, Artificial Sequence
  Synthetic Polynucleotide
taatacgactcactatagggagccccgcgaggcgggagtgctcctcatccaacagaggagaggatgaatggcactcccgaacctggcggcagcgcaaaagatg

SEQ ID NO: 118079 - DNA, 103 bp, Artificial Sequence
  Synthetic Polynucleotide
taatacgactcactataggggagctccagcagccccgcgaggcgggagtgaacagaggagacactccatgctcgcggggaacctggcggcagcgcaaaagatg

SEQ ID NO: 118080 - DNA, 103 bp, Artificial Sequence
  Synthetic Polynucleotide
taatacgactcactatagggtggcccggtagagctccagcagccccgcgaaacagaggagatcgcggatgtgctggagcaacctggcggcagcgcaaaagatg

SEQ ID NO: 118081 - DNA, 103 bp, Artificial Sequence
  Synthetic Polynucleotide
taatacgactcactatagggagctgcaggatggcccggtagagctccagcaacagaggagagctggaatgctaccgggcaacctggcggcagcgcaaaagatg

SEQ ID NO: 118082 - DNA, 103 bp, Artificial Sequence
  Synthetic Polynucleotide
taatacgactcactatagggcctgcgtaccagctgcaggatggcccggtaaacagaggagataccggatgatcctgcagaacctggcggcagcgcaaaagatg

SEQ ID NO: 118083 - DNA, 103 bp, Artificial Sequence
  Synthetic Polynucleotide
taatacgactcactataggggcttcttgtacctgcgtaccagctgcaggaaacagaggagatcctgcatgtggtacgcaaacctggcggcagcgcaaaagatg

SEQ ID NO: 118084 - DNA, 103 bp, Artificial Sequence
  Synthetic Polynucleotide
taatacgactcactatagggtccaccttgagcttcttgtacctgcgtaccaacagaggagaggtacgatggtacaagaaaacctggcggcagcgcaaaagatg

SEQ ID NO: 118085 - DNA, 103 bp, Artificial Sequence
  Synthetic Polynucleotide
taatacgactcactatagggtccaagaccccaatcacattctcgccacataacagaggagaatgtggatggaatgtgataacctggcggcagcgcaaaagatg

SEQ ID NO: 118086 - DNA, 103 bp, Artificial Sequence
  Synthetic Polynucleotide
taatacgactcactatagggacagctggaatcaatgtgtcgatctttgttaacagaggagaaacaaaatgcgacacattaacctggcggcagcgcaaaagatg

SEQ ID NO: 118087 - DNA, 103 bp, Artificial Sequence
  Synthetic Polynucleotide
taatacgactcactataggggtctgcatagacaagttcatcctcaaacgaaacagaggagatcgtttatggatgaacttaacctggcggcagcgcaaaagatg

SEQ ID NO: 118088 - DNA, 103 bp, Artificial Sequence
  Synthetic Polynucleotide
taatacgactcactatagggttatataatcgtctgcatagacaagttcataacagaggagaatgaacatgtctatgcagaacctggcggcagcgcaaaagatg

SEQ ID NO: 118089 - DNA, 103 bp, Artificial Sequence
  Synthetic Polynucleotide
taatacgactcactatagggtcttcgtccattatataatcgtctgcatagaacagaggagactatgcatgcgattatataacctggcggcagcgcaaaagatg

SEQ ID NO: 118090 - DNA, 103 bp, Artificial Sequence
  Synthetic Polynucleotide
taatacgactcactatagggtttggactggtcttcgtccattatataatcaacagaggagagattatatgatggacgaaaacctggcggcagcgcaaaagatg

SEQ ID NO: 118091 - DNA, 103 bp, Artificial Sequence
  Synthetic Polynucleotide
taatacgactcactatagggggcctgctaatttggactggtcttcgtccaaacagaggagatggacgatgaccagtccaaacctggcggcagcgcaaaagatg

SEQ ID NO: 118092 - DNA, 103 bp, Artificial Sequence
  Synthetic Polynucleotide
taatacgactcactatagggagatcaagaaggcctgctaatttggactggaacagaggagaccagtcatgattagcaggaacctggcggcagcgcaaaagatg

SEQ ID NO: 118093 - DNA, 103 bp, Artificial Sequence
  Synthetic Polynucleotide
taatacgactcactatagggagcattatttagatcaagaaggcctgctaaaacagaggagattagcaatgcttcttgataacctggcggcagcgcaaaagatg

SEQ ID NO: 118094 - DNA, 103 bp, Artificial Sequence
  Synthetic Polynucleotide
taatacgactcactataggggctgcaggatagcattatttagatcaagaaaacagaggagattcttgatgtaaataatgaacctggcggcagcgcaaaagatg

SEQ ID NO: 118095 - DNA, 103 bp, Artificial Sequence
  Synthetic Polynucleotide
taatacgactcactatagggttctttaccagctgcaggatagcattatttaacagaggagaaaataaatgtatcctgcaaacctggcggcagcgcaaaagatg

SEQ ID NO: 118096 - DNA, 103 bp, Artificial Sequence
  Synthetic Polynucleotide
taatacgactcactataggggctcttgtatttctttaccagctgcaggataacagaggagaatcctgatgctggtaaagaacctggcggcagcgcaaaagatg

SEQ ID NO: 118097 - DNA, 103 bp, Artificial Sequence
  Synthetic Polynucleotide
taatacgactcactatagggtgaaggacgaacagctggaatcaatgtgtcaacagaggagagacacaatgattccagctaacctggcggcagcgcaaaagatg

SEQ ID NO: 118098 - DNA, 103 bp, Artificial Sequence
  Synthetic Polynucleotide
taatacgactcactatagggccagcttcatgctcttgtatttctttaccaaacagaggagatggtaaatgaatacaagaaacctggcggcagcgcaaaagatg

SEQ ID NO: 118099 - DNA, 103 bp, Artificial Sequence
  Synthetic Polynucleotide
taatacgactcactatagggtcttctttttccagcttcatgctcttgtataacagaggagaatacaaatgcatgaagctaacctggcggcagcgcaaaagatg

SEQ ID NO: 118100 - DNA, 103 bp, Artificial Sequence
  Synthetic Polynucleotide
taatacgactcactatagggggtgacaaattcttctttttccagcttcataacagaggagaatgaagatggaaaaagaaaacctggcggcagcgcaaaagatg

SEQ ID NO: 118101 - DNA, 103 bp, Artificial Sequence
  Synthetic Polynucleotide
taatacgactcactatagggtagctttgagggtgacaaattcttctttttaacagaggagaaaaaagatgaatttgtcaaacctggcggcagcgcaaaagatg

SEQ ID NO: 118102 - DNA, 103 bp, Artificial Sequence
  Synthetic Polynucleotide
taatacgactcactataggggcaagagctatagctttgagggtgacaaataacagaggagaatttgtatgcctcaaagcaacctggcggcagcgcaaaagatg

SEQ ID NO: 118103 - DNA, 103 bp, Artificial Sequence
  Synthetic Polynucleotide
taatacgactcactataggggtctgaattagcaagagctatagctttgagaacagaggagactcaaaatgatagctcttaacctggcggcagcgcaaaagatg

SEQ ID NO: 118104 - DNA, 103 bp, Artificial Sequence
  Synthetic Polynucleotide
taatacgactcactatagggtgtgcatggagtctgaattagcaagagctaaacagaggagatagctcatgctaattcagaacctggcggcagcgcaaaagatg

SEQ ID NO: 118105 - DNA, 103 bp, Artificial Sequence
  Synthetic Polynucleotide
taatacgactcactatagggacatcttctatgtgcatggagtctgaattaaacagaggagataattcatgctccatgcaaacctggcggcagcgcaaaagatg

SEQ ID NO: 118106 - DNA, 103 bp, Artificial Sequence
  Synthetic Polynucleotide
taatacgactcactatagggaacggcttcaacatcttctatgtgcatggaaacagaggagatccatgatgatagaagataacctggcggcagcgcaaaagatg

SEQ ID NO: 118107 - DNA, 103 bp, Artificial Sequence
  Synthetic Polynucleotide
taatacgactcactataggggaagcttctgaacggcttcaacatcttctaaacagaggagatagaagatgttgaagccgaacctggcggcagcgcaaaagatg

SEQ ID NO: 118108 - DNA, 103 bp, Artificial Sequence
  Synthetic Polynucleotide
taatacgactcactatagggtccgtcttgatgaaggacgaacagctggaaaacagaggagattccagatgttcgtccttaacctggcggcagcgcaaaagatg

SEQ ID NO: 118109 - DNA, 103 bp, Artificial Sequence
  Synthetic Polynucleotide
taatacgactcactatagggaagacatcctgaagcttctgaacggcttcaaacagaggagatgaagcatgtcagaagctaacctggcggcagcgcaaaagatg

SEQ ID NO: 118110 - DNA, 103 bp, Artificial Sequence
  Synthetic Polynucleotide
taatacgactcactatagggcgcttcatgtaagacatcctgaagcttctgaacagaggagacagaagatgcaggatgtcaacctggcggcagcgcaaaagatg

SEQ ID NO: 118111 - DNA, 103 bp, Artificial Sequence
  Synthetic Polynucleotide
taatacgactcactatagggaatcctgcagcgcttcatgtaagacatcctaacagaggagaaggatgatgtacatgaagaacctggcggcagcgcaaaagatg

SEQ ID NO: 118112 - DNA, 103 bp, Artificial Sequence
  Synthetic Polynucleotide
taatacgactcactatagggccagcttcataatcctgcagcgcttcatgtaacagaggagaacatgaatggctgcaggaaacctggcggcagcgcaaaagatg

SEQ ID NO: 118113 - DNA, 103 bp, Artificial Sequence
  Synthetic Polynucleotide
taatacgactcactatagggcatgtgctggccagcttcataatcctgcagaacagaggagactgcagatgtatgaagctaacctggcggcagcgcaaaagatg

SEQ ID NO: 118114 - DNA, 103 bp, Artificial Sequence
  Synthetic Polynucleotide
taatacgactcactataggggagggtcttccatgtgctggccagcttcataacagaggagaatgaagatggccagcacaaacctggcggcagcgcaaaagatg

SEQ ID NO: 118115 - DNA, 103 bp, Artificial Sequence
  Synthetic Polynucleotide
taatacgactcactatagggccagctcgacgagggtcttccatgtgctggaacagaggagaccagcaatgggaagacccaacctggcggcagcgcaaaagatg

SEQ ID NO: 118116 - DNA, 103 bp, Artificial Sequence
  Synthetic Polynucleotide
taatacgactcactatagggcagcatcttgccagctcgacgagggtcttcaacagaggagagaagacatgcgtcgagctaacctggcggcagcgcaaaagatg

SEQ ID NO: 118117 - DNA, 103 bp, Artificial Sequence
  Synthetic Polynucleotide
taatacgactcactataggggcagtgtcatcagcatcttgccagctcgacaacagaggagagtcgagatggcaagatgcaacctggcggcagcgcaaaagatg

SEQ ID NO: 118118 - DNA, 103 bp, Artificial Sequence
  Synthetic Polynucleotide
taatacgactcactatagggctcaggagtggcagtgtcatcagcatcttgaacagaggagacaagatatggatgacactaacctggcggcagcgcaaaagatg

SEQ ID NO: 118119 - DNA, 103 bp, Artificial Sequence
  Synthetic Polynucleotide
taatacgactcactataggggctggaaggttccgtcttgatgaaggacgaaacagaggagatcgtccatgatcaagacgaacctggcggcagcgcaaaagatg

SEQ ID NO: 118120 - DNA, 103 bp, Artificial Sequence
  Synthetic Polynucleotide
taatacgactcactatagggagaggtctgcctcaggagtggcagtgtcataacagaggagaatgacaatgccactcctgaacctggcggcagcgcaaaagatg

SEQ ID NO: 118121 - DNA, 103 bp, Artificial Sequence
  Synthetic Polynucleotide
taatacgactcactatagggcggccttggtagaggtctgcctcaggagtgaacagaggagacactccatgggcagacctaacctggcggcagcgcaaaagatg

SEQ ID NO: 118122 - DNA, 103 bp, Artificial Sequence
  Synthetic Polynucleotide
taatacgactcactatagggaaatgctgcacggccttggtagaggtctgcaacagaggagagcagacatgtaccaaggcaacctggcggcagcgcaaaagatg

SEQ ID NO: 118123 - DNA, 103 bp, Artificial Sequence
  Synthetic Polynucleotide
taatacgactcactataggggatgttgtagaaatgctgcacggccttggtaacagaggagaaccaagatggtgcagcataacctggcggcagcgcaaaagatg

SEQ ID NO: 118124 - DNA, 103 bp, Artificial Sequence
  Synthetic Polynucleotide
taatacgactcactatagggcttctagtttgatgttgtagaaatgctgcaaacagaggagatgcagcatgtctacaacaaacctggcggcagcgcaaaagatg

SEQ ID NO: 118125 - DNA, 103 bp, Artificial Sequence
  Synthetic Polynucleotide
taatacgactcactataggggggactttgccttctagtttgatgttgtagaacagaggagactacaaatgcaaactagaaacctggcggcagcgcaaaagatg

SEQ ID NO: 118126 - DNA, 103 bp, Artificial Sequence
  Synthetic Polynucleotide
taatacgactcactatagggtttgtgcattgggactttgccttctagtttaacagaggagaaaactaatgggcaaagtcaacctggcggcagcgcaaaagatg

SEQ ID NO: 118127 - DNA, 103 bp, Artificial Sequence
  Synthetic Polynucleotide
taatacgactcactatagggccaaaaaaagtttgtgcattgggactttgcaacagaggagagcaaagatgcaatgcacaaacctggcggcagcgcaaaagatg

SEQ ID NO: 118128 - DNA, 103 bp, Artificial Sequence
  Synthetic Polynucleotide
taatacgactcactatagggtccaacatttccaaaaaaagtttgtgcattaacagaggagaaatgcaatgactttttttaacctggcggcagcgcaaaagatg

SEQ ID NO: 118129 - DNA, 103 bp, Artificial Sequence
  Synthetic Polynucleotide
taatacgactcactataggggaccttggcctccaacatttccaaaaaaagaacagaggagactttttatggaaatgttgaacctggcggcagcgcaaaagatg

SEQ ID NO: 118130 - DNA, 103 bp, Artificial Sequence
  Synthetic Polynucleotide
taatacgactcactataggggggaggctgggctggaaggttccgtcttgaaacagaggagatcaagaatgaaccttccaaacctggcggcagcgcaaaagatg

SEQ ID NO: 118131 - DNA, 103 bp, Artificial Sequence
  Synthetic Polynucleotide
taatacgactcactatagggctgtccgtcagggaggctgggctggaaggtaacagaggagaaccttcatgcccagcctcaacctggcggcagcgcaaaagatg

SEQ ID NO: 118132 - DNA, 103 bp, Artificial Sequence
  Synthetic Polynucleotide
taatacgactcactataggggtggttgacgctgtccgtcagggaggctggaacagaggagaccagccatgctgacggacaacctggcggcagcgcaaaagatg

SEQ ID NO: 118133 - DNA, 103 bp, Artificial Sequence
  Synthetic Polynucleotide
taatacgactcactatagggcagggctgtggtggttgacgctgtccgtcaaacagaggagatgacggatggcgtcaaccaacctggcggcagcgcaaaagatg

SEQ ID NO: 118134 - DNA, 103 bp, Artificial Sequence
  Synthetic Polynucleotide
taatacgactcactataggggaagagccaccagggctgtggtggttgacgaacagaggagacgtcaaatgccacagcccaacctggcggcagcgcaaaagatg

SEQ ID NO: 118135 - DNA, 103 bp, Artificial Sequence
  Synthetic Polynucleotide
taatacgactcactatagggactggcgtctgaagagccaccagggctgtgaacagaggagacacagcatgggtggctctaacctggcggcagcgcaaaagatg

SEQ ID NO: 118136 - DNA, 103 bp, Artificial Sequence
  Synthetic Polynucleotide
taatacgactcactatagggacttgactgctccaagaccccaatcacattaacagaggagaaatgtgatgggggtcttgaacctggcggcagcgcaaaagatg

SEQ ID NO: 118137 - DNA, 103 bp, Artificial Sequence
  Synthetic Polynucleotide
taatacgactcactatagggtgtagctcccactggcgtctgaagagccacaacagaggagagtggctatgcagacgccaaacctggcggcagcgcaaaagatg

SEQ ID NO: 118138 - DNA, 103 bp, Artificial Sequence
  Synthetic Polynucleotide
taatacgactcactatagggatggttgaactgtagctcccactggcgtctaacagaggagaagacgcatgtgggagctaaacctggcggcagcgcaaaagatg

SEQ ID NO: 118139 - DNA, 103 bp, Artificial Sequence
  Synthetic Polynucleotide
taatacgactcactatagggatggccattcatggttgaactgtagctcccaacagaggagagggagcatgagttcaaccaacctggcggcagcgcaaaagatg

SEQ ID NO: 118140 - DNA, 103 bp, Artificial Sequence
  Synthetic Polynucleotide
taatacgactcactataggggtccgttctgatggccattcatggttgaacaacagaggagagttcaaatgtgaatggccaacctggcggcagcgcaaaagatg

SEQ ID NO: 118141 - DNA, 103 bp, Artificial Sequence
  Synthetic Polynucleotide
taatacgactcactatagggggcgagtcaagtccgttctgatggccattcaacagaggagagaatggatgtcagaacggaacctggcggcagcgcaaaagatg

SEQ ID NO: 118142 - DNA, 103 bp, Artificial Sequence
  Synthetic Polynucleotide
taatacgactcactataggggtagagaggtggcgagtcaagtccgttctgaacagaggagacagaacatgcttgactcgaacctggcggcagcgcaaaagatg

SEQ ID NO: 118143 - DNA, 103 bp, Artificial Sequence
  Synthetic Polynucleotide
taatacgactcactataggggagcagaagggtagagaggtggcgagtcaaaacagaggagattgactatgcacctctctaacctggcggcagcgcaaaagatg

SEQ ID NO: 118144 - DNA, 103 bp, Artificial Sequence
  Synthetic Polynucleotide
taatacgactcactatagggcccaggataggagcagaagggtagagaggtaacagaggagaacctctatgcccttctgcaacctggcggcagcgcaaaagatg

SEQ ID NO: 118145 - DNA, 103 bp, Artificial Sequence
  Synthetic Polynucleotide
taatacgactcactatagggcccactacctcccaggataggagcagaaggaacagaggagaccttctatgcctatcctgaacctggcggcagcgcaaaagatg

SEQ ID NO: 118146 - DNA, 103 bp, Artificial Sequence
  Synthetic Polynucleotide
taatacgactcactatagggtcctgacaggcccactacctcccaggatagaacagaggagactatccatggaggtagtgaacctggcggcagcgcaaaagatg

SEQ ID NO: 118147 - DNA, 103 bp, Artificial Sequence
  Synthetic Polynucleotide
taatacgactcactataggggccagatcagacttgactgctccaagacccaacagaggagagggtctatgagcagtcaaaacctggcggcagcgcaaaagatg

SEQ ID NO: 118148 - DNA, 103 bp, Artificial Sequence
  Synthetic Polynucleotide
taatacgactcactatagggtcatacagtttcctgacaggcccactacctaacagaggagaaggtagatggcctgtcagaacctggcggcagcgcaaaagatg

SEQ ID NO: 118149 - DNA, 103 bp, Artificial Sequence
  Synthetic Polynucleotide
taatacgactcactatagggggagcagtcatcatacagtttcctgacaggaacagaggagacctgtcatgaaactgtataacctggcggcagcgcaaaagatg

SEQ ID NO: 118150 - DNA, 103 bp, Artificial Sequence
  Synthetic Polynucleotide
taatacgactcactatagggcaatggtgctggagcagtcatcatacagttaacagaggagaaactgtatgatgactgctaacctggcggcagcgcaaaagatg

SEQ ID NO: 118151 - DNA, 103 bp, Artificial Sequence
  Synthetic Polynucleotide
taatacgactcactatagggggatcttcaacaatggtgctggagcagtcaaacagaggagatgactgatgcagcaccataacctggcggcagcgcaaaagatg

SEQ ID NO: 118152 - DNA, 103 bp, Artificial Sequence
  Synthetic Polynucleotide
taatacgactcactatagggcttggtctggggatcttcaacaatggtgctaacagaggagaagcaccatggttgaagataacctggcggcagcgcaaaagatg

SEQ ID NO: 118153 - DNA, 103 bp, Artificial Sequence
  Synthetic Polynucleotide
taatacgactcactatagggtgtattcacacttggtctggggatcttcaaaacagaggagattgaagatgcccagaccaaacctggcggcagcgcaaaagatg

SEQ ID NO: 118154 - DNA, 103 bp, Artificial Sequence
  Synthetic Polynucleotide
taatacgactcactataggggagttgagcatgtattcacacttggtctggaacagaggagaccagacatggtgtgaataaacctggcggcagcgcaaaagatg

SEQ ID NO: 118155 - DNA, 103 bp, Artificial Sequence
  Synthetic Polynucleotide
taatacgactcactatagggcttgggcatcgagttgagcatgtattcacaaacagaggagatgtgaaatgatgctcaacaacctggcggcagcgcaaaagatg

SEQ ID NO: 118156 - DNA, 103 bp, Artificial Sequence
  Synthetic Polynucleotide
taatacgactcactatagggaacacagtctcttgggcatcgagttgagcaaacagaggagatgctcaatgcgatgcccaaacctggcggcagcgcaaaagatg

SEQ ID NO: 118157 - DNA, 103 bp, Artificial Sequence
  Synthetic Polynucleotide
taatacgactcactatagggccacacactaaacacagtctcttgggcatcaacagaggagagatgccatggagactgtgaacctggcggcagcgcaaaagatg

SEQ ID NO: 118158 - DNA, 103 bp, Artificial Sequence
  Synthetic Polynucleotide
taatacgactcactatagggaggaacacaggccagatcagacttgactgcaacagaggagagcagtcatgtctgatctgaacctggcggcagcgcaaaagatg

SEQ ID NO: 118159 - DNA, 103 bp, Artificial Sequence
  Synthetic Polynucleotide
taatacgactcactatagggagcgatgtcaccacacactaaacacagtctaacagaggagaagactgatgttagtgtgtaacctggcggcagcgcaaaagatg

SEQ ID NO: 118160 - DNA, 103 bp, Artificial Sequence
  Synthetic Polynucleotide
taatacgactcactatagggggtacccagaagcgatgtcaccacacactaaacagaggagatagtgtatggtgacatcgaacctggcggcagcgcaaaagatg

SEQ ID NO: 118161 - DNA, 103 bp, Artificial Sequence
  Synthetic Polynucleotide
taatacgactcactatagggaccccatagtggtacccagaagcgatgtcaaacagaggagatgacatatgttctgggtaaacctggcggcagcgcaaaagatg

SEQ ID NO: 118162 - DNA, 103 bp, Artificial Sequence
  Synthetic Polynucleotide
taatacgactcactatagggacatgatgctaccccatagtggtacccagaaacagaggagatctgggatgcactatgggaacctggcggcagcgcaaaagatg

SEQ ID NO: 118163 - DNA, 103 bp, Artificial Sequence
  Synthetic Polynucleotide
taatacgactcactatagggtgcaggcttcacatgatgctaccccatagtaacagaggagaactatgatgtagcatcataacctggcggcagcgcaaaagatg

SEQ ID NO: 118164 - DNA, 103 bp, Artificial Sequence
  Synthetic Polynucleotide
taatacgactcactatagggaagaatgccttgcaggcttcacatgatgctaacagaggagaagcatcatgtgaagcctgaacctggcggcagcgcaaaagatg

SEQ ID NO: 118165 - DNA, 103 bp, Artificial Sequence
  Synthetic Polynucleotide
taatacgactcactatagggtgtcctcttgaagaatgccttgcaggcttcaacagaggagagaagccatgaaggcattcaacctggcggcagcgcaaaagatg

SEQ ID NO: 118166 - DNA, 103 bp, Artificial Sequence
  Synthetic Polynucleotide
taatacgactcactatagggtgccttgaattgtcctcttgaagaatgcctaacagaggagaaggcatatgtcaagaggaaacctggcggcagcgcaaaagatg

SEQ ID NO: 118167 - DNA, 103 bp, Artificial Sequence
  Synthetic Polynucleotide
taatacgactcactatagggtattctatattgccttgaattgtcctcttgaacagaggagacaagagatgaattcaaggaacctggcggcagcgcaaaagatg

SEQ ID NO: 118168 - DNA, 103 bp, Artificial Sequence
  Synthetic Polynucleotide
taatacgactcactatagggagggcagctgtattctatattgccttgaataacagaggagaattcaaatgaatatagaaaacctggcggcagcgcaaaagatg

SEQ ID NO: 118169 - DNA, 103 bp, Artificial Sequence
  Synthetic Polynucleotide
taatacgactcactatagggttttagctgaaggaacacaggccagatcagaacagaggagactgatcatgcctgtgttcaacctggcggcagcgcaaaagatg

SEQ ID NO: 118170 - DNA, 103 bp, Artificial Sequence
  Synthetic Polynucleotide
taatacgactcactatagggcattcgtggcagggcagctgtattctatataacagaggagaatatagatgacagctgccaacctggcggcagcgcaaaagatg

SEQ ID NO: 118171 - DNA, 103 bp, Artificial Sequence
  Synthetic Polynucleotide
taatacgactcactatagggatttcacattcattcgtggcagggcagctgaacagaggagacagctgatgtgccacgaaaacctggcggcagcgcaaaagatg

SEQ ID NO: 118172 - DNA, 103 bp, Artificial Sequence
  Synthetic Polynucleotide
taatacgactcactataggggcgctttgtgatttcacattcattcgtggcaacagaggagagccacgatggaatgtgaaaacctggcggcagcgcaaaagatg

SEQ ID NO: 118173 - DNA, 103 bp, Artificial Sequence
  Synthetic Polynucleotide
taatacgactcactatagggatttacgtctgcgctttgtgatttcacattaacagaggagaaatgtgatgtcacaaagcaacctggcggcagcgcaaaagatg

SEQ ID NO: 118174 - DNA, 103 bp, Artificial Sequence
  Synthetic Polynucleotide
taatacgactcactataggggcctggcaggatttacgtctgcgctttgtgaacagaggagacacaaaatgcagacgtaaaacctggcggcagcgcaaaagatg

SEQ ID NO: 118175 - DNA, 103 bp, Artificial Sequence
  Synthetic Polynucleotide
taatacgactcactataggggaagcggcaagcctggcaggatttacgtctaacagaggagaagacgtatgtcctgccagaacctggcggcagcgcaaaagatg

SEQ ID NO: 118176 - DNA, 103 bp, Artificial Sequence
  Synthetic Polynucleotide
taatacgactcactatagggaacacttcatgaagcggcaagcctggcaggaacagaggagacctgccatgcttgccgctaacctggcggcagcgcaaaagatg

SEQ ID NO: 118177 - DNA, 103 bp, Artificial Sequence
  Synthetic Polynucleotide
taatacgactcactatagggcccacttttaaacacttcatgaagcggcaaaacagaggagattgccgatgcatgaagtgaacctggcggcagcgcaaaagatg

SEQ ID NO: 118178 - DNA, 103 bp, Artificial Sequence
  Synthetic Polynucleotide
taatacgactcactatagggtttcagcatgcccacttttaaacacttcataacagaggagaatgaagatgttaaaagtgaacctggcggcagcgcaaaagatg

SEQ ID NO: 118179 - DNA, 103 bp, Artificial Sequence
  Synthetic Polynucleotide
taatacgactcactataggggcaccccttctttcagcatgcccacttttaaacagaggagataaaagatggcatgctgaaacctggcggcagcgcaaaagatg

SEQ ID NO: 118180 - DNA, 103 bp, Artificial Sequence
  Synthetic Polynucleotide
taatacgactcactatagggcagagaagccttttagctgaaggaacacagaacagaggagactgtgtatgttcagctaaaacctggcggcagcgcaaaagatg

SEQ ID NO: 118181 - DNA, 103 bp, Artificial Sequence
  Synthetic Polynucleotide
taatacgactcactatagggctgtcaagacgcaccccttctttcagcatgaacagaggagacatgctatgagaaggggtaacctggcggcagcgcaaaagatg

SEQ ID NO: 118182 - DNA, 103 bp, Artificial Sequence
  Synthetic Polynucleotide
taatacgactcactatagggtccacgtactctgtcaagacgcaccccttcaacagaggagagaagggatgcgtcttgacaacctggcggcagcgcaaaagatg

SEQ ID NO: 118183 - DNA, 103 bp, Artificial Sequence
  Synthetic Polynucleotide
taatacgactcactatagggtctgccgacctccacgtactctgtcaagacaacagaggagagtcttgatggagtacgtgaacctggcggcagcgcaaaagatg

SEQ ID NO: 118184 - DNA, 103 bp, Artificial Sequence
  Synthetic Polynucleotide
taatacgactcactatagggcgcttgtacttctgccgacctccacgtactaacagaggagaagtacgatgaggtcggcaaacctggcggcagcgcaaaagatg

SEQ ID NO: 118185 - DNA, 103 bp, Artificial Sequence
  Synthetic Polynucleotide
taatacgactcactatagggatctatcctgcgcttgtacttctgccgaccaacagaggagaggtcggatgaagtacaagaacctggcggcagcgcaaaagatg

SEQ ID NO: 118186 - DNA, 103 bp, Artificial Sequence
  Synthetic Polynucleotide
taatacgactcactatagggtgttctccgcatctatcctgcgcttgtactaacagaggagaagtacaatggcaggatagaacctggcggcagcgcaaaagatg

SEQ ID NO: 118187 - DNA, 103 bp, Artificial Sequence
  Synthetic Polynucleotide
taatacgactcactatagggaggtatgggctgttctccgcatctatcctgaacagaggagacaggatatgtgcggagaaaacctggcggcagcgcaaaagatg

SEQ ID NO: 118188 - DNA, 103 bp, Artificial Sequence
  Synthetic Polynucleotide
taatacgactcactatagggctgagggttcaggtatgggctgttctccgcaacagaggagagcggagatgagcccatacaacctggcggcagcgcaaaagatg

SEQ ID NO: 118189 - DNA, 103 bp, Artificial Sequence
  Synthetic Polynucleotide
taatacgactcactataggggctgaaccagctgagggttcaggtatgggcaacagaggagagcccatatgtgaaccctcaacctggcggcagcgcaaaagatg

SEQ ID NO: 118190 - DNA, 103 bp, Artificial Sequence
  Synthetic Polynucleotide
taatacgactcactatagggtttttggctggctgaaccagctgagggttcaacagaggagagaacccatggctggttcaaacctggcggcagcgcaaaagatg

SEQ ID NO: 118191 - DNA, 103 bp, Artificial Sequence
  Synthetic Polynucleotide
taatacgactcactatagggtgacattctgcagagaagccttttagctgaaacagaggagatcagctatgaggcttctcaacctggcggcagcgcaaaagatg

SEQ ID NO: 118192 - DNA, 103 bp, Artificial Sequence
  Synthetic Polynucleotide
taatacgactcactataggggagcaatggctttttggctggctgaaccagaacagaggagactggttatgccagccaaaaacctggcggcagcgcaaaagatg

SEQ ID NO: 118193 - DNA, 103 bp, Artificial Sequence
  Synthetic Polynucleotide
taatacgactcactataggggatcagaccagagcaatggctttttggctgaacagaggagacagccaatgagccattgcaacctggcggcagcgcaaaagatg

SEQ ID NO: 118194 - DNA, 103 bp, Artificial Sequence
  Synthetic Polynucleotide
taatacgactcactatagggttatctgcaggatcagaccagagcaatggcaacagaggagagccattatgctggtctgaaacctggcggcagcgcaaaagatg

SEQ ID NO: 118195 - DNA, 103 bp, Artificial Sequence
  Synthetic Polynucleotide
taatacgactcactataggggacaatcttgttatctgcaggatcagaccaaacagaggagatggtctatgcctgcagataacctggcggcagcgcaaaagatg

SEQ ID NO: 118196 - DNA, 103 bp, Artificial Sequence
  Synthetic Polynucleotide
taatacgactcactatagggacaaatgtgagacaatcttgttatctgcagaacagaggagactgcagatgacaagattgaacctggcggcagcgcaaaagatg

SEQ ID NO: 118197 - DNA, 103 bp, Artificial Sequence
  Synthetic Polynucleotide
taatacgactcactatagggtcagccaccaacaaatgtgagacaatcttgaacagaggagacaagatatgctcacatttaacctggcggcagcgcaaaagatg

SEQ ID NO: 118198 - DNA, 103 bp, Artificial Sequence
  Synthetic Polynucleotide
taatacgactcactatagggcttctccggttcagccaccaacaaatgtgaaacagaggagatcacatatgttggtggctaacctggcggcagcgcaaaagatg

SEQ ID NO: 118199 - DNA, 103 bp, Artificial Sequence
  Synthetic Polynucleotide
taatacgactcactatagggtggcatagatcttctccggttcagccaccaaacagaggagatggtggatgaaccggagaaacctggcggcagcgcaaaagatg

SEQ ID NO: 118200 - DNA, 103 bp, Artificial Sequence
  Synthetic Polynucleotide
taatacgactcactataggggggtcaggcatggcatagatcttctccggtaacagaggagaaccggaatggatctatgcaacctggcggcagcgcaaaagatg

SEQ ID NO: 118201 - DNA, 103 bp, Artificial Sequence
  Synthetic Polynucleotide
taatacgactcactatagggggggacagtagggtcaggcatggcatagataacagaggagaatctatatgatgcctgacaacctggcggcagcgcaaaagatg

SEQ ID NO: 118202 - DNA, 103 bp, Artificial Sequence
  Synthetic Polynucleotide
taatacgactcactataggggatctttgtttgacattctgcagagaagccaacagaggagaggcttcatggcagaatgtaacctggcggcagcgcaaaagatg

SEQ ID NO: 118203 - DNA, 103 bp, Artificial Sequence
  Synthetic Polynucleotide
taatacgactcactatagggtgtcactgtcggggacagtagggtcaggcaaacagaggagatgcctgatgctactgtccaacctggcggcagcgcaaaagatg

SEQ ID NO: 118204 - DNA, 103 bp, Artificial Sequence
  Synthetic Polynucleotide
taatacgactcactatagggagggctttgatgtcactgtcggggacagtaaacagaggagatactgtatgcgacagtgaaacctggcggcagcgcaaaagatg

SEQ ID NO: 118205 - DNA, 103 bp, Artificial Sequence
  Synthetic Polynucleotide
taatacgactcactatagggcagtgtagtgagggctttgatgtcactgtcaacagaggagagacagtatgatcaaagccaacctggcggcagcgcaaaagatg

SEQ ID NO: 118206 - DNA, 103 bp, Artificial Sequence
  Synthetic Polynucleotide
taatacgactcactatagggccaagtcacacagtgtagtgagggctttgaaacagaggagatcaaagatgtcactacacaacctggcggcagcgcaaaagatg

SEQ ID NO: 118207 - DNA, 103 bp, Artificial Sequence
  Synthetic Polynucleotide
taatacgactcactatagggtctcggtcggccaagtcacacagtgtagtgaacagaggagacactacatggtgtgacttaacctggcggcagcgcaaaagatg

SEQ ID NO: 118208 - DNA, 103 bp, Artificial Sequence
  Synthetic Polynucleotide
taatacgactcactatagggaaccaccaactctcggtcggccaagtcacaaacagaggagatgtgacatggccgaccgaaacctggcggcagcgcaaaagatg

SEQ ID NO: 118209 - DNA, 103 bp, Artificial Sequence
  Synthetic Polynucleotide
taatacgactcactatagggatccaatgataaccaccaactctcggtcggaacagaggagaccgaccatgagttggtggaacctggcggcagcgcaaaagatg

SEQ ID NO: 118210 - DNA, 103 bp, Artificial Sequence
  Synthetic Polynucleotide
taatacgactcactatagggtgcttcgcccatccaatgataaccaccaacaacagaggagagttggtatgtatcattggaacctggcggcagcgcaaaagatg

SEQ ID NO: 118211 - DNA, 103 bp, Artificial Sequence
  Synthetic Polynucleotide
taatacgactcactataggggcctggaatatgcttcgcccatccaatgataacagaggagaatcattatgtgggcgaagaacctggcggcagcgcaaaagatg

SEQ ID NO: 118212 - DNA, 103 bp, Artificial Sequence
  Synthetic Polynucleotide
taatacgactcactataggggcgtggagaagcctggaatatgcttcgcccaacagaggagagggcgaatgatattccagaacctggcggcagcgcaaaagatg

SEQ ID NO: 118213 - DNA, 103 bp, Artificial Sequence
  Synthetic Polynucleotide
taatacgactcactatagggtcaatgtgtcgatctttgtttgacattctgaacagaggagacagaatatgaaacaaagaaacctggcggcagcgcaaaagatg

SEQ ID NO: 118214 - DNA, 103 bp, Artificial Sequence
  Synthetic Polynucleotide
taatacgactcactataggggccagggacagcgtggagaagcctggaataaacagaggagatattccatgcttctccacaacctggcggcagcgcaaaagatg

SEQ ID NO: 118215 - DNA, 103 bp, Artificial Sequence
  Synthetic Polynucleotide
taatacgactcactatagggcatctggtccgccagggacagcgtggagaaaacagaggagattctccatgctgtccctgaacctggcggcagcgcaaaagatg

SEQ ID NO: 118216 - DNA, 103 bp, Artificial Sequence
  Synthetic Polynucleotide
taatacgactcactataggggcagaaggctcatctggtccgccagggacaaacagaggagatgtcccatgcggaccagaaacctggcggcagcgcaaaagatg

SEQ ID NO: 118217 - DNA, 103 bp, Artificial Sequence
  Synthetic Polynucleotide
taatacgactcactatagggcaagcactctgcagaaggctcatctggtccaacagaggagaggaccaatggagccttctaacctggcggcagcgcaaaagatg

SEQ ID NO: 118218 - DNA, 103 bp, Artificial Sequence
  Synthetic Polynucleotide
taatacgactcactatagggaatttccatccaagcactctgcagaaggctaacagaggagaagccttatgcagagtgctaacctggcggcagcgcaaaagatg

SEQ ID NO: 118219 - DNA, 103 bp, Artificial Sequence
  Synthetic Polynucleotide
taatacgactcactatagggcaaggatcaaaatttccatccaagcactctaacagaggagaagagtgatgggatggaaaaacctggcggcagcgcaaaagatg

SEQ ID NO: 118220 - DNA, 103 bp, Artificial Sequence
  Synthetic Polynucleotide
taatacgactcactatagggtatacgacaccaaggatcaaaatttccatcaacagaggagagatggaatgtttgatcctaacctggcggcagcgcaaaagatg

SEQ ID NO: 118221 - DNA, 103 bp, Artificial Sequence
  Synthetic Polynucleotide
taatacgactcactatagggaagagaccggtatacgacaccaaggatcaaaacagaggagattgatcatgggtgtcgtaaacctggcggcagcgcaaaagatg

SEQ ID NO: 118222 - DNA, 103 bp, Artificial Sequence
  Synthetic Polynucleotide
taatacgactcactatagggcctcaaacgaaagagaccggtatacgacacaacagaggagagtgtcgatgaccggtctcaacctggcggcagcgcaaaagatg

SEQ ID NO: 118223 - DNA, 103 bp, Artificial Sequence
  Synthetic Polynucleotide
taatacgactcactatagggacaagttcatcctcaaacgaaagagaccggaacagaggagaccggtcatgttcgtttgaaacctggcggcagcgcaaaagatg

SEQ ID NO: 118224 - DNA, 103 bp, Artificial Sequence
  Synthetic Polynucleotide
taatacgactcactatagggactgtgggtgtacccgcgaagagactccataacagaggagaatggagatgcttcgcgggaacctggcggcagcgcaaaagatg

SEQ ID NO: 118225 - DNA, 103 bp, Artificial Sequence
  Synthetic Polynucleotide
taatacgactcactatagggtccccttgccatcagcgaggtcacggtaagaacagaggagacttaccatgacctcgctgaacctggcggcagcgcaaaagatg

SEQ ID NO: 118226 - DNA, 103 bp, Artificial Sequence
  Synthetic Polynucleotide
taatacgactcactatagggtggcacacgcgccatgggcggcccgggtggaacagaggagaccacccatgccgcccatgaacctggcggcagcgcaaaagatg

SEQ ID NO: 118227 - DNA, 103 bp, Artificial Sequence
  Synthetic Polynucleotide
taatacgactcactataggggcggcccgggtggcacacgcgccatgggcgaacagaggagacgcccaatgcgcgtgtgcaacctggcggcagcgcaaaagatg

SEQ ID NO: 118228 - DNA, 103 bp, Artificial Sequence
  Synthetic Polynucleotide
taatacgactcactatagggggcgccatgggcggcccgggtggcacacgcaacagaggagagcgtgtatgacccgggccaacctggcggcagcgcaaaagatg

SEQ ID NO: 118229 - DNA, 103 bp, Artificial Sequence
  Synthetic Polynucleotide
taatacgactcactataggggggtggcagaggcgccatgggcggcccgggaacagaggagacccgggatgcccatggcgaacctggcggcagcgcaaaagatg

SEQ ID NO: 118230 - DNA, 103 bp, Artificial Sequence
  Synthetic Polynucleotide
taatacgactcactatagggtgggcggcccgggtggcagaggcgccatggaacagaggagaccatggatgctctgccacaacctggcggcagcgcaaaagatg

SEQ ID NO: 118231 - DNA, 103 bp, Artificial Sequence
  Synthetic Polynucleotide
taatacgactcactatagggagaggcgccatgggcggcccgggtggcagaaacagaggagatctgccatgcgggccgccaacctggcggcagcgcaaaagatg

SEQ ID NO: 118232 - DNA, 103 bp, Artificial Sequence
  Synthetic Polynucleotide
taatacgactcactatagggcccgggtggcagaggcgccatgggcggcccaacagaggagagggccgatgatggcgcctaacctggcggcagcgcaaaagatg

SEQ ID NO: 118233 - DNA, 103 bp, Artificial Sequence
  Synthetic Polynucleotide
taatacgactcactatagggccatgggcggcccgggtggcagaggcgccaaacagaggagatggcgcatgtgccacccgaacctggcggcagcgcaaaagatg

SEQ ID NO: 118234 - DNA, 103 bp, Artificial Sequence
  Synthetic Polynucleotide
taatacgactcactatagggggcagaggcgccatgggcggcccgggtggcaacagaggagagccaccatggccgcccataacctggcggcagcgcaaaagatg

SEQ ID NO: 118235 - DNA, 103 bp, Artificial Sequence
  Synthetic Polynucleotide
taatacgactcactatagggcggcccgggtggcagaggcgccatgggcggaacagaggagaccgcccatggcgcctctgaacctggcggcagcgcaaaagatg

SEQ ID NO: 118236 - DNA, 103 bp, Artificial Sequence
  Synthetic Polynucleotide
taatacgactcactatagggcgtcctctcctccccttgccatcagcgaggaacagaggagacctcgcatgtggcaagggaacctggcggcagcgcaaaagatg

SEQ ID NO: 118237 - DNA, 103 bp, Artificial Sequence
  Synthetic Polynucleotide
taatacgactcactataggggcgccatgggcggcccgggtggcagaggcgaacagaggagacgcctcatgcacccgggcaacctggcggcagcgcaaaagatg

SEQ ID NO: 118238 - DNA, 103 bp, Artificial Sequence
  Synthetic Polynucleotide
taatacgactcactatagggggtggcagaggcgccatgggcggcccgggtaacagaggagaacccggatggcccatggcaacctggcggcagcgcaaaagatg

SEQ ID NO: 118239 - DNA, 103 bp, Artificial Sequence
  Synthetic Polynucleotide
taatacgactcactatagggatgtgacctgggtggcagaggcgccatgggaacagaggagacccatgatgcctctgccaaacctggcggcagcgcaaaagatg

SEQ ID NO: 118240 - DNA, 103 bp, Artificial Sequence
  Synthetic Polynucleotide
taatacgactcactatagggtgtgaggcacatgtgacctgggtggcagagaacagaggagactctgcatgccaggtcacaacctggcggcagcgcaaaagatg

SEQ ID NO: 118241 - DNA, 103 bp, Artificial Sequence
  Synthetic Polynucleotide
taatacgactcactataggggccaggccagtgtgaggcacatgtgacctgaacagaggagacaggtcatgtgtgcctcaaacctggcggcagcgcaaaagatg

SEQ ID NO: 118242 - DNA, 103 bp, Artificial Sequence
  Synthetic Polynucleotide
taatacgactcactataggggtgtacaggagccaggccagtgtgaggcacaacagaggagagtgcctatgactggcctgaacctggcggcagcgcaaaagatg

SEQ ID NO: 118243 - DNA, 103 bp, Artificial Sequence
  Synthetic Polynucleotide
taatacgactcactatagggcccatgtgatgtgtacaggagccaggccagaacagaggagactggccatgctcctgtacaacctggcggcagcgcaaaagatg

SEQ ID NO: 118244 - DNA, 103 bp, Artificial Sequence
  Synthetic Polynucleotide
taatacgactcactatagggatgacaggggcccatgtgatgtgtacaggaaacagaggagatcctgtatgcatcacatgaacctggcggcagcgcaaaagatg

SEQ ID NO: 118245 - DNA, 103 bp, Artificial Sequence
  Synthetic Polynucleotide
taatacgactcactatagggataactgttgatgacaggggcccatgtgataacagaggagaatcacaatggcccctgtcaacctggcggcagcgcaaaagatg

SEQ ID NO: 118246 - DNA, 103 bp, Artificial Sequence
  Synthetic Polynucleotide
taatacgactcactataggggacatgcataataactgttgatgacaggggaacagaggagacccctgatgtcaacagttaacctggcggcagcgcaaaagatg

SEQ ID NO: 118247 - DNA, 103 bp, Artificial Sequence
  Synthetic Polynucleotide
taatacgactcactataggggtattctcctcgtcctctcctccccttgccaacagaggagaggcaagatgaggagaggaaacctggcggcagcgcaaaagatg

SEQ ID NO: 118248 - DNA, 103 bp, Artificial Sequence
  Synthetic Polynucleotide
taatacgactcactatagggtagaaaaagggacatgcataataactgttgaacagaggagacaacagatgttatgcatgaacctggcggcagcgcaaaagatg

SEQ ID NO: 118249 - DNA, 103 bp, Artificial Sequence
  Synthetic Polynucleotide
taatacgactcactatagggtttggaccgtgtattctcctcgtcctctccaacagaggagaggagagatggaggagaataacctggcggcagcgcaaaagatg

SEQ ID NO: 118250 - DNA, 103 bp, Artificial Sequence
  Synthetic Polynucleotide
taatacgactcactatagggcgtactcaggtttggaccgtgtattctcctaacagaggagaaggagaatgcacggtccaaacctggcggcagcgcaaaagatg

SEQ ID NO: 118251 - DNA, 103 bp, Artificial Sequence
  Synthetic Polynucleotide
taatacgactcactataggggcttctgttccgtactcaggtttggaccgtaacagaggagaacggtcatgacctgagtaaacctggcggcagcgcaaaagatg

SEQ ID NO: 118252 - DNA, 103 bp, Artificial Sequence
  Synthetic Polynucleotide
taatacgactcactataggggttgttttccgcttctgttccgtactcaggaacagaggagacctgagatgggaacagaaaacctggcggcagcgcaaaagatg

SEQ ID NO: 118253 - DNA, 103 bp, Artificial Sequence
  Synthetic Polynucleotide
taatacgactcactatagggccgtgccaacgttgttttccgcttctgttcaacagaggagagaacagatgcggaaaacaaacctggcggcagcgcaaaagatg

SEQ ID NO: 118254 - DNA, 103 bp, Artificial Sequence
  Synthetic Polynucleotide
taatacgactcactatagggacggacccttccgtgccaacgttgttttccaacagaggagaggaaaaatgcgttggcacaacctggcggcagcgcaaaagatg

SEQ ID NO: 118255 - DNA, 103 bp, Artificial Sequence
  Synthetic Polynucleotide
taatacgactcactataggggtccgaggggacggacccttccgtgccaacaacagaggagagttggcatggaagggtccaacctggcggcagcgcaaaagatg

SEQ ID NO: 118256 - DNA, 103 bp, Artificial Sequence
  Synthetic Polynucleotide
taatacgactcactatagggagccaatatcactgtgggtgtacccgcgaaaacagaggagattcgcgatgacacccacaaacctggcggcagcgcaaaagatg

SEQ ID NO: 118257 - DNA, 103 bp, Artificial Sequence
  Synthetic Polynucleotide
taatacgactcactatagggggtcttggtcgtccgaggggacggacccttaacagaggagaaagggtatgtcccctcggaacctggcggcagcgcaaaagatg

SEQ ID NO: 118258 - DNA, 103 bp, Artificial Sequence
  Synthetic Polynucleotide
taatacgactcactatagggccaccctcacggtcttggtcgtccgaggggaacagaggagacccctcatgcgaccaagaaacctggcggcagcgcaaaagatg

SEQ ID NO: 118259 - DNA, 103 bp, Artificial Sequence
  Synthetic Polynucleotide
taatacgactcactataggggtggccgccgccaccctcacggtcttggtcaacagaggagagaccaaatgcgtgagggtaacctggcggcagcgcaaaagatg

SEQ ID NO: 118260 - DNA, 103 bp, Artificial Sequence
  Synthetic Polynucleotide
taatacgactcactataggggctccggctcgtggccgccgccaccctcacaacagaggagagtgaggatggcggcggccaacctggcggcagcgcaaaagatg

SEQ ID NO: 118261 - DNA, 103 bp, Artificial Sequence
  Synthetic Polynucleotide
taatacgactcactatagggtcctgctgttgctccggctcgtggccgccgaacagaggagacggcggatgcgagccggaaacctggcggcagcgcaaaagatg

SEQ ID NO: 118262 - DNA, 103 bp, Artificial Sequence
  Synthetic Polynucleotide
taatacgactcactataggggggcggctcctcctgctgttgctccggctcaacagaggagagagccgatgcaacagcagaacctggcggcagcgcaaaagatg

SEQ ID NO: 118263 - DNA, 103 bp, Artificial Sequence
  Synthetic Polynucleotide
taatacgactcactataggggcttggtcaggggcggctcctcctgctgttaacagaggagaaacagcatgaggagccgcaacctggcggcagcgcaaaagatg

SEQ ID NO: 118264 - DNA, 103 bp, Artificial Sequence
  Synthetic Polynucleotide
taatacgactcactatagggtgttgctccggcttggtcaggggcggctccaacagaggagaggagccatgcctgaccaaaacctggcggcagcgcaaaagatg

SEQ ID NO: 118265 - DNA, 103 bp, Artificial Sequence
  Synthetic Polynucleotide
taatacgactcactatagggctcctcctgctgttgctccggcttggtcagaacagaggagactgaccatgccggagcaaaacctggcggcagcgcaaaagatg

SEQ ID NO: 118266 - DNA, 103 bp, Artificial Sequence
  Synthetic Polynucleotide
taatacgactcactataggggcaggggcggctcctcctgctgttgctccgaacagaggagacggagcatgagcaggaggaacctggcggcagcgcaaaagatg

SEQ ID NO: 118267 - DNA, 103 bp, Artificial Sequence
  Synthetic Polynucleotide
taatacgactcactatagggaggctgcggtagccaatatcactgtgggtgaacagaggagacacccaatgtgatattggaacctggcggcagcgcaaaagatg

SEQ ID NO: 118268 - DNA, 103 bp, Artificial Sequence
  Synthetic Polynucleotide
taatacgactcactatagggttcagctcgagcaggggcggctcctcctgcaacagaggagagcaggaatggccgcccctaacctggcggcagcgcaaaagatg

SEQ ID NO: 118269 - DNA, 103 bp, Artificial Sequence
  Synthetic Polynucleotide
taatacgactcactatagggctgctcttgcttcagctcgagcaggggcggaacagaggagaccgcccatgctcgagctgaacctggcggcagcgcaaaagatg

SEQ ID NO: 118270 - DNA, 103 bp, Artificial Sequence
  Synthetic Polynucleotide
taatacgactcactataggggcggctcctcctgctcttgcttcagctcgaaacagaggagatcgagcatgagcaagagcaacctggcggcagcgcaaaagatg

SEQ ID NO: 118271 - DNA, 103 bp, Artificial Sequence
  Synthetic Polynucleotide
taatacgactcactataggggtcgtctggggcggctcctcctgctcttgcaacagaggagagcaagaatgggaggagccaacctggcggcagcgcaaaagatg

SEQ ID NO: 118272 - DNA, 103 bp, Artificial Sequence
  Synthetic Polynucleotide
taatacgactcactatagggcccctccacggtcgtctggggcggctcctcaacagaggagagaggagatgccccagacgaacctggcggcagcgcaaaagatg

SEQ ID NO: 118273 - DNA, 103 bp, Artificial Sequence
  Synthetic Polynucleotide
taatacgactcactatagggccggctgtggcccctccacggtcgtctgggaacagaggagacccagaatgccgtggaggaacctggcggcagcgcaaaagatg

SEQ ID NO: 118274 - DNA, 103 bp, Artificial Sequence
  Synthetic Polynucleotide
taatacgactcactatagggggcccctccgccggctgtggcccctccacgaacagaggagacgtggaatggccacagccaacctggcggcagcgcaaaagatg

SEQ ID NO: 118275 - DNA, 103 bp, Artificial Sequence
  Synthetic Polynucleotide
taatacgactcactatagggagcggtttgtggcccctccgccggctgtggaacagaggagaccacagatggcggaggggaacctggcggcagcgcaaaagatg

SEQ ID NO: 118276 - DNA, 103 bp, Artificial Sequence
  Synthetic Polynucleotide
taatacgactcactataggggtggtccctcagcggtttgtggcccctccgaacagaggagacggaggatgcacaaaccgaacctggcggcagcgcaaaagatg

SEQ ID NO: 118277 - DNA, 103 bp, Artificial Sequence
  Synthetic Polynucleotide
taatacgactcactatagggtctgggggctgtggtccctcagcggtttgtaacagaggagaacaaacatgtgagggaccaacctggcggcagcgcaaaagatg

SEQ ID NO: 118278 - DNA, 103 bp, Artificial Sequence
  Synthetic Polynucleotide
taatacgactcactataggggccgactgccaggctgcggtagccaatatcaacagaggagagatattatgtaccgcagcaacctggcggcagcgcaaaagatg

SEQ ID NO: 118279 - DNA, 103 bp, Artificial Sequence
  Synthetic Polynucleotide
taatacgactcactataggggcgtttcctctctgggggctgtggtccctcaacagaggagagagggaatgcagcccccaaacctggcggcagcgcaaaagatg

SEQ ID NO: 118280 - DNA, 103 bp, Artificial Sequence
  Synthetic Polynucleotide
taatacgactcactatagggtgcggcggcggcgtttcctctctgggggctaacagaggagaagccccatgagaggaaacaacctggcggcagcgcaaaagatg

SEQ ID NO: 118281 - DNA, 103 bp, Artificial Sequence
  Synthetic Polynucleotide
taatacgactcactataggggtgaacgcggtgcggcggcggcgtttcctcaacagaggagagaggaaatgccgccgccgaacctggcggcagcgcaaaagatg

SEQ ID NO: 118282 - DNA, 103 bp, Artificial Sequence
  Synthetic Polynucleotide
taatacgactcactatagggctgaaactgcgtgaacgcggtgcggcggcgaacagaggagacgccgcatgaccgcgttcaacctggcggcagcgcaaaagatg

SEQ ID NO: 118283 - DNA, 103 bp, Artificial Sequence
  Synthetic Polynucleotide
taatacgactcactataggggctcctgcagctgaaactgcgtgaacgcggaacagaggagaccgcgtatgcgcagtttcaacctggcggcagcgcaaaagatg

SEQ ID NO: 118284 - DNA, 103 bp, Artificial Sequence
  Synthetic Polynucleotide
taatacgactcactatagggaagttctctagctcctgcagctgaaactgcaacagaggagagcagttatggctgcaggaaacctggcggcagcgcaaaagatg

SEQ ID NO: 118285 - DNA, 103 bp, Artificial Sequence
  Synthetic Polynucleotide
taatacgactcactatagggttcatcgaaaaagttctctagctcctgcagaacagaggagactgcagatgctagagaacaacctggcggcagcgcaaaagatg

SEQ ID NO: 118286 - DNA, 103 bp, Artificial Sequence
  Synthetic Polynucleotide
taatacgactcactataggggatattgagattcatcgaaaaagttctctaaacagaggagatagagaatgttttcgatgaacctggcggcagcgcaaaagatg

SEQ ID NO: 118287 - DNA, 103 bp, Artificial Sequence
  Synthetic Polynucleotide
taatacgactcactatagggacaacgtcgggatattgagattcatcgaaaaacagaggagatttcgaatgatctcaataaacctggcggcagcgcaaaagatg

SEQ ID NO: 118288 - DNA, 103 bp, Artificial Sequence
  Synthetic Polynucleotide
taatacgactcactatagggctctcgcgccacaacgtcgggatattgagaaacagaggagatctcaaatgcccgacgttaacctggcggcagcgcaaaagatg

SEQ ID NO: 118289 - DNA, 103 bp, Artificial Sequence
  Synthetic Polynucleotide
taatacgactcactatagggcgatgtcctcgccgactgccaggctgcggtaacagaggagaaccgcaatgtggcagtcgaacctggcggcagcgcaaaagatg

SEQ ID NO: 118290 - DNA, 103 bp, Artificial Sequence
  Synthetic Polynucleotide
taatacgactcactatagggctgcaagtctctctcgcgccacaacgtcggaacagaggagaccgacgatgtggcgcgagaacctggcggcagcgcaaaagatg

SEQ ID NO: 118291 - DNA, 103 bp, Artificial Sequence
  Synthetic Polynucleotide
taatacgactcactatagggttcaggcgtgctgcaagtctctctcgcgccaacagaggagaggcgcgatggagacttgcaacctggcggcagcgcaaaagatg

SEQ ID NO: 118292 - DNA, 103 bp, Artificial Sequence
  Synthetic Polynucleotide
taatacgactcactatagggttcagtcaaattcaggcgtgctgcaagtctaacagaggagaagacttatggcacgcctgaacctggcggcagcgcaaaagatg

SEQ ID NO: 118293 - DNA, 103 bp, Artificial Sequence
  Synthetic Polynucleotide
taatacgactcactataggggcactctgtcttcagtcaaattcaggcgtgaacagaggagacacgccatgatttgactgaacctggcggcagcgcaaaagatg

SEQ ID NO: 118294 - DNA, 103 bp, Artificial Sequence
  Synthetic Polynucleotide
taatacgactcactatagggaaccaaacctgcactctgtcttcagtcaaaaacagaggagatttgacatgagacagagtaacctggcggcagcgcaaaagatg

SEQ ID NO: 118295 - DNA, 103 bp, Artificial Sequence
  Synthetic Polynucleotide
taatacgactcactatagggtctgttctgaaaccaaacctgcactctgtcaacagaggagagacagaatgcaggtttggaacctggcggcagcgcaaaagatg

SEQ ID NO: 118296 - DNA, 103 bp, Artificial Sequence
  Synthetic Polynucleotide
taatacgactcactatagggacttggctcttctgttctgaaaccaaacctaacagaggagaaggtttatgttcagaacaaacctggcggcagcgcaaaagatg

SEQ ID NO: 118297 - DNA, 103 bp, Artificial Sequence
  Synthetic Polynucleotide
taatacgactcactatagggtttcgtttccacttggctcttctgttctgaaacagaggagatcagaaatgaagagccaaaacctggcggcagcgcaaaagatg

SEQ ID NO: 118298 - DNA, 103 bp, Artificial Sequence
  Synthetic Polynucleotide
taatacgactcactatagggcaccctctgatttcgtttccacttggctctaacagaggagaagagccatgtggaaacgaaacctggcggcagcgcaaaagatg

SEQ ID NO: 118299 - DNA, 103 bp, Artificial Sequence
  Synthetic Polynucleotide
taatacgactcactatagggtcaacattagcaccctctgatttcgtttccaacagaggagaggaaacatgatcagagggaacctggcggcagcgcaaaagatg

SEQ ID NO: 118300 - DNA, 103 bp, Artificial Sequence
  Synthetic Polynucleotide
taatacgactcactatagggttcacttcctcgatgtcctcgccgactgccaacagaggagaggcagtatgcgaggacataacctggcggcagcgcaaaagatg

SEQ ID NO: 118301 - DNA, 103 bp, Artificial Sequence
  Synthetic Polynucleotide
taatacgactcactataggggcagtgtttctcaacattagcaccctctgaaacagaggagatcagagatggctaatgttaacctggcggcagcgcaaaagatg

SEQ ID NO: 118302 - DNA, 103 bp, Artificial Sequence
  Synthetic Polynucleotide
taatacgactcactataggggtcagcagtagcagtgtttctcaacattagaacagaggagactaatgatgagaaacactaacctggcggcagcgcaaaagatg

SEQ ID NO: 118303 - DNA, 103 bp, Artificial Sequence
  Synthetic Polynucleotide
taatacgactcactatagggggtgggccaggtcagcagtagcagtgtttcaacagaggagagaaacaatgctactgctgaacctggcggcagcgcaaaagatg

SEQ ID NO: 118304 - DNA, 103 bp, Artificial Sequence
  Synthetic Polynucleotide
taatacgactcactatagggatgtccaaagggtgggccaggtcagcagtaaacagaggagatactgcatgcctggcccaaacctggcggcagcgcaaaagatg

SEQ ID NO: 118305 - DNA, 103 bp, Artificial Sequence
  Synthetic Polynucleotide
taatacgactcactatagggacccaagaacatgtccaaagggtgggccagaacagaggagactggccatgcctttggacaacctggcggcagcgcaaaagatg

SEQ ID NO: 118306 - DNA, 103 bp, Artificial Sequence
  Synthetic Polynucleotide
taatacgactcactatagggaataggccccacccaagaacatgtccaaagaacagaggagactttggatgtgttcttggaacctggcggcagcgcaaaagatg

SEQ ID NO: 118307 - DNA, 103 bp, Artificial Sequence
  Synthetic Polynucleotide
taatacgactcactatagggggagcagcataataggccccacccaagaacaacagaggagagttcttatgtggggcctaaacctggcggcagcgcaaaagatg

SEQ ID NO: 118308 - DNA, 103 bp, Artificial Sequence
  Synthetic Polynucleotide
taatacgactcactatagggatccagagcaggagcagcataataggccccaacagaggagaggggccatgtatgctgctaacctggcggcagcgcaaaagatg

SEQ ID NO: 118309 - DNA, 103 bp, Artificial Sequence
  Synthetic Polynucleotide
taatacgactcactatagggacaaagcaggatccagagcaggagcagcataacagaggagaatgctgatgctgctctggaacctggcggcagcgcaaaagatg

SEQ ID NO: 118310 - DNA, 103 bp, Artificial Sequence
  Synthetic Polynucleotide
taatacgactcactatagggagatgaacacacaaagcaggatccagagcaaacagaggagatgctctatgtcctgctttaacctggcggcagcgcaaaagatg

SEQ ID NO: 118311 - DNA, 103 bp, Artificial Sequence
  Synthetic Polynucleotide
taatacgactcactatagggtttctcatcattcacttcctcgatgtcctcaacagaggagagaggacatggaggaagtgaacctggcggcagcgcaaaagatg

SEQ ID NO: 118312 - DNA, 103 bp, Artificial Sequence
  Synthetic Polynucleotide
taatacgactcactatagggttgtggcaccagatgaacacacaaagcaggaacagaggagacctgctatgtgtgttcataacctggcggcagcgcaaaagatg

SEQ ID NO: 118313 - DNA, 103 bp, Artificial Sequence
  Synthetic Polynucleotide
taatacgactcactataggggtctaggtagttgtggcaccagatgaacacaacagaggagagtgttcatgtggtgccacaacctggcggcagcgcaaaagatg

SEQ ID NO: 118314 - DNA, 103 bp, Artificial Sequence
  Synthetic Polynucleotide
taatacgactcactatagggagcacaggtggtctaggtagttgtggcaccaacagaggagaggtgccatgactacctagaacctggcggcagcgcaaaagatg

SEQ ID NO: 118315 - DNA, 103 bp, Artificial Sequence
  Synthetic Polynucleotide
taatacgactcactatagggtggcacaggcagcacaggtggtctaggtagaacagaggagactacctatgccacctgtgaacctggcggcagcgcaaaagatg

SEQ ID NO: 118316 - DNA, 103 bp, Artificial Sequence
  Synthetic Polynucleotide
taatacgactcactataggggtggcataggtggcacaggcagcacaggtgaacagaggagacacctgatgtgcctgtgcaacctggcggcagcgcaaaagatg

SEQ ID NO: 118317 - DNA, 103 bp, Artificial Sequence
  Synthetic Polynucleotide
taatacgactcactatagggggtggcctgggtggcataggtggcacaggcaacagaggagagcctgtatgacctatgccaacctggcggcagcgcaaaagatg

SEQ ID NO: 118318 - DNA, 103 bp, Artificial Sequence
  Synthetic Polynucleotide
taatacgactcactatagggagggaccatgggtggcctgggtggcataggaacagaggagacctatgatgcccaggccaaacctggcggcagcgcaaaagatg

SEQ ID NO: 118319 - DNA, 103 bp, Artificial Sequence
  Synthetic Polynucleotide
taatacgactcactatagggtgggtggcatagggaccatgggtggcctggaacagaggagaccaggcatgccatggtccaacctggcggcagcgcaaaagatg

SEQ ID NO: 118320 - DNA, 103 bp, Artificial Sequence
  Synthetic Polynucleotide
taatacgactcactatagggatgggtggcctgggtggcatagggaccatgaacagaggagacatggtatgtatgccaccaacctggcggcagcgcaaaagatg

SEQ ID NO: 118321 - DNA, 103 bp, Artificial Sequence
  Synthetic Polynucleotide
taatacgactcactatagggcataggtgctatgggtggcctgggtggcataacagaggagaatgccaatgaggccacccaacctggcggcagcgcaaaagatg

SEQ ID NO: 118322 - DNA, 103 bp, Artificial Sequence
  Synthetic Polynucleotide
taatacgactcactatagggtcacggtaagtttctcatcattcacttcctaacagaggagaaggaagatgatgatgagaaacctggcggcagcgcaaaagatg

SEQ ID NO: 118323 - DNA, 103 bp, Artificial Sequence
  Synthetic Polynucleotide
taatacgactcactatagggccatgggtggcataggtgctatgggtggccaacagaggagaggccacatgtagcacctaaacctggcggcagcgcaaaagatg

SEQ ID NO: 118324 - DNA, 103 bp, Artificial Sequence
  Synthetic Polynucleotide
taatacgactcactatagggggcacaggcgccatgggtggcataggtgctaacagaggagaagcaccatggccacccataacctggcggcagcgcaaaagatg

SEQ ID NO: 118325 - DNA, 103 bp, Artificial Sequence
  Synthetic Polynucleotide
taatacgactcactatagggtgagccgggtggcacaggcgccatgggtggaacagaggagaccacccatggcgcctgtgaacctggcggcagcgcaaaagatg

SEQ ID NO: 118326 - DNA, 103 bp, Artificial Sequence
  Synthetic Polynucleotide
taatacgactcactataggggcgccatgcgtgagccgggtggcacaggcgaacagaggagacgcctgatgcacccggctaacctggcggcagcgcaaaagatg

SEQ ID NO: 118327 - DNA, 103 bp, Artificial Sequence
  Synthetic Polynucleotide
taatacgactcactatagggggtggcacaggcgccatgcgtgagccgggtaacagaggagaacccggatgacgcatggcaacctggcggcagcgcaaaagatg

SEQ ID NO: 118328 - DNA, 103 bp, Artificial Sequence
  Synthetic Polynucleotide
taatacgactcactataggggcgtggcccgggtggcacaggcgccatgcgaacagaggagacgcatgatgcctgtgccaaacctggcggcagcgcaaaagatg

SEQ ID NO: 118329 - DNA, 103 bp, Artificial Sequence
  Synthetic Polynucleotide
taatacgactcactatagggcaggcgccatgcgtggcccgggtggcacagaacagaggagactgtgcatgccgggccacaacctggcggcagcgcaaaagatg

SEQ ID NO: 118330 - DNA, 103 bp, Artificial Sequence
  Synthetic Polynucleotide
taatacgactcactatagggcagggtggcacaggcgccatgcgtggcccgaacagaggagacgggccatgcatggcgccaacctggcggcagcgcaaaagatg

SEQ ID NO: 118331 - DNA, 103 bp, Artificial Sequence
  Synthetic Polynucleotide
taatacgactcactatagggcatgggcggccagggtggcacaggcgccataacagaggagaatggcgatggtgccacccaacctggcggcagcgcaaaagatg

SEQ ID NO: 118332 - DNA, 103 bp, Artificial Sequence
  Synthetic Polynucleotide
taatacgactcactataggggcacaggcgccatgggcggccagggtggcaaacagaggagatgccacatgggccgcccaaacctggcggcagcgcaaaagatg

SEQ ID NO: 118333 - DNA, 103 bp, Artificial Sequence
  Synthetic Polynucleotide
taatacgactcactatagggatcagcgaggtcacggtaagtttctcatcaaacagaggagatgatgaatgacttaccgtaacctggcggcagcgcaaaagatg

SEQ ID NO: 118334 - DNA, 103 bp, Artificial Sequence
  Synthetic Polynucleotide
taatacgactcactatagggggccagggtggcacaggcgccatgggcggcaacagaggagagccgccatgggcgcctgtaacctggcggcagcgcaaaagatg

SEQ ID NO: 118335 - DNA, 103 bp, Artificial Sequence
  Synthetic Polynucleotide
taatacgactcactatagggcgccatgggcggccagggtggcacaggcgcaacagaggagagcgcctatgccaccctggaacctggcggcagcgcaaaagatg

SEQ ID NO: 118336 - DNA, 103 bp, Artificial Sequence
  Synthetic Polynucleotide
taatacgactcactatagggttggcacaggcgccatgggcggccagggtgaacagaggagacaccctatgcgcccatggaacctggcggcagcgcaaaagatg

SEQ ID NO: 118337 - DNA, 103 bp, Artificial Sequence
  Synthetic Polynucleotide
taatacgactcactatagggggcggcccggttggcacaggcgccatgggcaacagaggagagcccatatggcctgtgccaacctggcggcagcgcaaaagatg

SEQ ID NO: 118338 - DNA, 103 bp, Artificial Sequence
  Synthetic Polynucleotide
taatacgactcactatagggaggcgccatgggcggcccggttggcacaggaacagaggagacctgtgatgaccgggccgaacctggcggcagcgcaaaagatg

SEQ ID NO: 118339 - DNA, 103 bp, Artificial Sequence
  Synthetic Polynucleotide
taatacgactcactatagggcgggtggcacaggcgccatgggcggcccggaacagaggagaccgggcatgccatggcgcaacctggcggcagcgcaaaagatg

SEQ ID NO: 118340 - DNA, 103 bp, Artificial Sequence
  Synthetic Polynucleotide
taatacgactcactatagggatgggcggcccgggtggcacaggcgccatgaacagaggagacatggcatgtgtgccaccaacctggcggcagcgcaaaagatg

SEQ ID NO: 118341 - DNA, 103 bp, Artificial Sequence
  Synthetic Polynucleotide
taatacgactcactatagggcacacgcgccatgggcggcccgggtggcacaacagaggagagtgccaatggggccgcccaacctggcggcagcgcaaaagatg

SEQ ID NO: 118342 - DNA, 103 bp, Artificial Sequence
  Synthetic Polynucleotide
taatacgactcactataggggcccgggtggcacacgcgccatgggcggccaacagaggagaggccgcatgtggcgcgtgaacctggcggcagcgcaaaagatg

SEQ ID NO: 118343 - DNA, 103 bp, Artificial Sequence
  Synthetic Polynucleotide
taatacgactcactataggggccatgggcggcccgggtggcacacgcgccaacagaggagaggcgcgatggccacccggaacctggcggcagcgcaaaagatg

SEQ ID NO: 118344 - DNA, 103 bp, Artificial Sequence
  Synthetic Polynucleotide
taatacgactcactatagggagtcggcttgagatcgacggccgccttcataacagaggagaatgaagatggccgtcgataacctggcggcagcgcaaaagatg

SEQ ID NO: 118345 - DNA, 103 bp, Artificial Sequence
  Synthetic Polynucleotide
taatacgactcactataggggcttggagttaatagtgggacatctgcacaaacagaggagatgtgcaatggtcccactaaacctggcggcagcgcaaaagatg

SEQ ID NO: 118346 - DNA, 103 bp, Artificial Sequence
  Synthetic Polynucleotide
taatacgactcactatagggaaactgccatagctggattggtccactgccaacagaggagaggcagtatgccaatccagaacctggcggcagcgcaaaagatg

SEQ ID NO: 118347 - DNA, 103 bp, Artificial Sequence
  Synthetic Polynucleotide
taatacgactcactatagggattccagaagaaactgccatagctggattgaacagaggagacaatccatgtatggcagtaacctggcggcagcgcaaaagatg

SEQ ID NO: 118348 - DNA, 103 bp, Artificial Sequence
  Synthetic Polynucleotide
taatacgactcactatagggtcagtgagtaattccagaagaaactgccataacagaggagaatggcaatgtcttctggaaacctggcggcagcgcaaaagatg

SEQ ID NO: 118349 - DNA, 103 bp, Artificial Sequence
  Synthetic Polynucleotide
taatacgactcactatagggacaggatttatcagtgagtaattccagaagaacagaggagacttctgatgttactcactaacctggcggcagcgcaaaagatg

SEQ ID NO: 118350 - DNA, 103 bp, Artificial Sequence
  Synthetic Polynucleotide
taatacgactcactatagggtaaaagactgacaggatttatcagtgagtaaacagaggagatactcaatgataaatcctaacctggcggcagcgcaaaagatg

SEQ ID NO: 118351 - DNA, 103 bp, Artificial Sequence
  Synthetic Polynucleotide
taatacgactcactataggggtccagctgataaaagactgacaggatttaaacagaggagataaatcatgtcagtctttaacctggcggcagcgcaaaagatg

SEQ ID NO: 118352 - DNA, 103 bp, Artificial Sequence
  Synthetic Polynucleotide
taatacgactcactataggggccatctcctgtccagctgataaaagactgaacagaggagacagtctatgatcagctggaacctggcggcagcgcaaaagatg

SEQ ID NO: 118353 - DNA, 103 bp, Artificial Sequence
  Synthetic Polynucleotide
taatacgactcactatagggtgaattcccagccatctcctgtccagctgaaacagaggagatcagctatgcaggagatgaacctggcggcagcgcaaaagatg

SEQ ID NO: 118354 - DNA, 103 bp, Artificial Sequence
  Synthetic Polynucleotide
taatacgactcactatagggtcagaaagtttgaattcccagccatctcctaacagaggagaaggagaatgctgggaattaacctggcggcagcgcaaaagatg

SEQ ID NO: 118355 - DNA, 103 bp, Artificial Sequence
  Synthetic Polynucleotide
taatacgactcactatagggctcatctgggtcagaaagtttgaattcccaaacagaggagatgggaaatgaaactttctaacctggcggcagcgcaaaagatg

SEQ ID NO: 118356 - DNA, 103 bp, Artificial Sequence
  Synthetic Polynucleotide
taatacgactcactatagggtttctttgctgcttggagttaatagtgggaaacagaggagatcccacatgtaactccaaaacctggcggcagcgcaaaagatg

SEQ ID NO: 118357 - DNA, 103 bp, Artificial Sequence
  Synthetic Polynucleotide
taatacgactcactatagggtcctggccacctcatctgggtcagaaagttaacagaggagaaactttatgacccagatgaacctggcggcagcgcaaaagatg

SEQ ID NO: 118358 - DNA, 103 bp, Artificial Sequence
  Synthetic Polynucleotide
taatacgactcactatagggtttccccatctcctggccacctcatctgggaacagaggagacccagaatgggtggccagaacctggcggcagcgcaaaagatg

SEQ ID NO: 118359 - DNA, 103 bp, Artificial Sequence
  Synthetic Polynucleotide
taatacgactcactataggggtttttcctctttccccatctcctggccacaacagaggagagtggccatgagatggggaaacctggcggcagcgcaaaagatg

SEQ ID NO: 118360 - DNA, 103 bp, Artificial Sequence
  Synthetic Polynucleotide
taatacgactcactatagggtcttaggtttgtttttcctctttccccatcaacagaggagagatgggatgagaggaaaaaacctggcggcagcgcaaaagatg

SEQ ID NO: 118361 - DNA, 103 bp, Artificial Sequence
  Synthetic Polynucleotide
taatacgactcactatagggtcataattcatcttaggtttgtttttcctcaacagaggagagaggaaatgcaaacctaaaacctggcggcagcgcaaaagatg

SEQ ID NO: 118362 - DNA, 103 bp, Artificial Sequence
  Synthetic Polynucleotide
taatacgactcactataggggctcagtttctcataattcatcttaggtttaacagaggagaaaacctatgatgaattataacctggcggcagcgcaaaagatg

SEQ ID NO: 118363 - DNA, 103 bp, Artificial Sequence
  Synthetic Polynucleotide
taatacgactcactataggggtaggccacggctcagtttctcataattcaaacagaggagatgaattatgagaaactgaaacctggcggcagcgcaaaagatg

SEQ ID NO: 118364 - DNA, 103 bp, Artificial Sequence
  Synthetic Polynucleotide
taatacgactcactatagggtaatagtagcgtaggccacggctcagtttcaacagaggagagaaactatgccgtggcctaacctggcggcagcgcaaaagatg

SEQ ID NO: 118365 - DNA, 103 bp, Artificial Sequence
  Synthetic Polynucleotide
taatacgactcactataggggtttttgtcgtaatagtagcgtaggccacgaacagaggagacgtggcatgcgctactataacctggcggcagcgcaaaagatg

SEQ ID NO: 118366 - DNA, 103 bp, Artificial Sequence
  Synthetic Polynucleotide
taatacgactcactatagggtgtggatgatgtttttgtcgtaatagtagcaacagaggagagctactatgacgacaaaaaacctggcggcagcgcaaaagatg

SEQ ID NO: 118367 - DNA, 103 bp, Artificial Sequence
  Synthetic Polynucleotide
taatacgactcactatagggtgagacatcatttctttgctgcttggagttaacagaggagaaactccatgcagcaaagaaacctggcggcagcgcaaaagatg

SEQ ID NO: 118368 - DNA, 103 bp, Artificial Sequence
  Synthetic Polynucleotide
taatacgactcactatagggcccgctgtcttgtggatgatgtttttgtcgaacagaggagacgacaaatgcatcatccaaacctggcggcagcgcaaaagatg

SEQ ID NO: 118369 - DNA, 103 bp, Artificial Sequence
  Synthetic Polynucleotide
taatacgactcactataggggtagcgtttccccgctgtcttgtggatgataacagaggagaatcatcatgaagacagcgaacctggcggcagcgcaaaagatg

SEQ ID NO: 118370 - DNA, 103 bp, Artificial Sequence
  Synthetic Polynucleotide
taatacgactcactatagggagcggtacacgtagcgtttccccgctgtctaacagaggagaagacagatgggaaacgctaacctggcggcagcgcaaaagatg

SEQ ID NO: 118371 - DNA, 103 bp, Artificial Sequence
  Synthetic Polynucleotide
taatacgactcactatagggtcacacacaaagcggtacacgtagcgtttcaacagaggagagaaacgatgcgtgtaccgaacctggcggcagcgcaaaagatg

SEQ ID NO: 118372 - DNA, 103 bp, Artificial Sequence
  Synthetic Polynucleotide
taatacgactcactataggggctctgcaggtcacacacaaagcggtacacaacagaggagagtgtacatgtttgtgtgtaacctggcggcagcgcaaaagatg

SEQ ID NO: 118373 - DNA, 103 bp, Artificial Sequence
  Synthetic Polynucleotide
taatacgactcactatagggaccccagcaggctctgcaggtcacacacaaaacagaggagattgtgtatgacctgcagaaacctggcggcagcgcaaaagatg

SEQ ID NO: 118374 - DNA, 103 bp, Artificial Sequence
  Synthetic Polynucleotide
taatacgactcactatagggtcaggggtgtaccccagcaggctctgcaggaacagaggagacctgcaatgcctgctgggaacctggcggcagcgcaaaagatg

SEQ ID NO: 118375 - DNA, 103 bp, Artificial Sequence
  Synthetic Polynucleotide
taatacgactcactataggggtgcagctcctcaggggtgtaccccagcagaacagaggagactgctgatgtacacccctaacctggcggcagcgcaaaagatg

SEQ ID NO: 118376 - DNA, 103 bp, Artificial Sequence
  Synthetic Polynucleotide
taatacgactcactatagggccagcatggcgtgcagctcctcaggggtgtaacagaggagaacacccatgaggagctgcaacctggcggcagcgcaaaagatg

SEQ ID NO: 118377 - DNA, 103 bp, Artificial Sequence
  Synthetic Polynucleotide
taatacgactcactatagggggcttgacgtccagcatggcgtgcagctccaacagaggagaggagctatgcgccatgctaacctggcggcagcgcaaaagatg

SEQ ID NO: 118378 - DNA, 103 bp, Artificial Sequence
  Synthetic Polynucleotide
taatacgactcactatagggttttaatgcttgagacatcatttctttgctaacagaggagaagcaaaatgatgatgtctaacctggcggcagcgcaaaagatg

SEQ ID NO: 118379 - DNA, 103 bp, Artificial Sequence
  Synthetic Polynucleotide
taatacgactcactataggggtcggcatctggcttgacgtccagcatggcaacagaggagagccatgatggacgtcaagaacctggcggcagcgcaaaagatg

SEQ ID NO: 118380 - DNA, 103 bp, Artificial Sequence
  Synthetic Polynucleotide
taatacgactcactatagggtgaaagtagcttttaatgcttgagacatcaaacagaggagatgatgtatgaagcattaaaacctggcggcagcgcaaaagatg

SEQ ID NO: 118381 - DNA, 103 bp, Artificial Sequence
  Synthetic Polynucleotide
taatacgactcactataggggtgaaaccactgaaagtagcttttaatgctaacagaggagaagcattatgagctactttaacctggcggcagcgcaaaagatg

SEQ ID NO: 118382 - DNA, 103 bp, Artificial Sequence
  Synthetic Polynucleotide
taatacgactcactatagggctgttctttagtgaaaccactgaaagtagcaacagaggagagctactatgagtggtttcaacctggcggcagcgcaaaagatg

SEQ ID NO: 118383 - DNA, 103 bp, Artificial Sequence
  Synthetic Polynucleotide
taatacgactcactatagggccagtcgttgctgttctttagtgaaaccacaacagaggagagtggttatgctaaagaacaacctggcggcagcgcaaaagatg

SEQ ID NO: 118384 - DNA, 103 bp, Artificial Sequence
  Synthetic Polynucleotide
taatacgactcactatagggtttgggatccccagtcgttgctgttctttaaacagaggagataaagaatggcaacgactaacctggcggcagcgcaaaagatg

SEQ ID NO: 118385 - DNA, 103 bp, Artificial Sequence
  Synthetic Polynucleotide
taatacgactcactatagggccgggggtcttttgggatccccagtcgttgaacagaggagacaacgaatggggatcccaaacctggcggcagcgcaaaagatg

SEQ ID NO: 118386 - DNA, 103 bp, Artificial Sequence
  Synthetic Polynucleotide
taatacgactcactatagggtgatggtgagagtcggcttgagatcgacggaacagaggagaccgtcgatgtcaagccgaaacctggcggcagcgcaaaagatg

SEQ ID NO: 118387 - DNA, 103 bp, Artificial Sequence
  Synthetic Polynucleotide
taatacgactcactatagggctgtccactgccgggggtcttttgggatccaacagaggagaggatccatgaagacccccaacctggcggcagcgcaaaagatg

SEQ ID NO: 118388 - DNA, 103 bp, Artificial Sequence
  Synthetic Polynucleotide
taatacgactcactatagggacatgggtttctgtccactgccgggggtctaacagaggagaagacccatggcagtggacaacctggcggcagcgcaaaagatg

SEQ ID NO: 118389 - DNA, 103 bp, Artificial Sequence
  Synthetic Polynucleotide
taatacgactcactatagggccagtcccgaacatgggtttctgtccactgaacagaggagacagtggatggaaacccataacctggcggcagcgcaaaagatg

SEQ ID NO: 118390 - DNA, 103 bp, Artificial Sequence
  Synthetic Polynucleotide
taatacgactcactatagggcccacatcacccagtcccgaacatgggtttaacagaggagaaaacccatgttcgggactaacctggcggcagcgcaaaagatg

SEQ ID NO: 118391 - DNA, 103 bp, Artificial Sequence
  Synthetic Polynucleotide
taatacgactcactatagggtcattcacagcccacatcacccagtcccgaaacagaggagatcgggaatgggtgatgtgaacctggcggcagcgcaaaagatg

SEQ ID NO: 118392 - DNA, 103 bp, Artificial Sequence
  Synthetic Polynucleotide
taatacgactcactatagggcaggctgaattcattcacagcccacatcacaacagaggagagtgatgatggctgtgaataacctggcggcagcgcaaaagatg

SEQ ID NO: 118393 - DNA, 103 bp, Artificial Sequence
  Synthetic Polynucleotide
taatacgactcactatagggctacacctttcaggctgaattcattcacagaacagaggagactgtgaatgaattcagccaacctggcggcagcgcaaaagatg

SEQ ID NO: 118394 - DNA, 103 bp, Artificial Sequence
  Synthetic Polynucleotide
taatacgactcactatagggttctggaagtctacacctttcaggctgaataacagaggagaattcagatggaaaggtgtaacctggcggcagcgcaaaagatg

SEQ ID NO: 118395 - DNA, 103 bp, Artificial Sequence
  Synthetic Polynucleotide
taatacgactcactatagggcatacagaacttctggaagtctacacctttaacagaggagaaaaggtatggacttccagaacctggcggcagcgcaaaagatg

SEQ ID NO: 118396 - DNA, 103 bp, Artificial Sequence
  Synthetic Polynucleotide
taatacgactcactatagggctgctccattcatacagaacttctggaagtaacagaggagaacttccatgagttctgtaaacctggcggcagcgcaaaagatg

SEQ ID NO: 118397 - DNA, 103 bp, Artificial Sequence
  Synthetic Polynucleotide
taatacgactcactatagggtccgtcttgatgatggtgagagtcggcttgaacagaggagacaagccatgtctcaccataacctggcggcagcgcaaaagatg

SEQ ID NO: 118398 - DNA, 103 bp, Artificial Sequence
  Synthetic Polynucleotide
taatacgactcactataggggcgcagagggctgctccattcatacagaacaacagaggagagttctgatggaatggagcaacctggcggcagcgcaaaagatg

SEQ ID NO: 118399 - DNA, 103 bp, Artificial Sequence
  Synthetic Polynucleotide
taatacgactcactatagggtttacccagggcgcagagggctgctccattaacagaggagaaatggaatggccctctgcaacctggcggcagcgcaaaagatg

SEQ ID NO: 118400 - DNA, 103 bp, Artificial Sequence
  Synthetic Polynucleotide
taatacgactcactataggggaaagcagtctttacccagggcgcagagggaacagaggagaccctctatgccctgggtaaacctggcggcagcgcaaaagatg

SEQ ID NO: 118401 - DNA, 103 bp, Artificial Sequence
  Synthetic Polynucleotide
taatacgactcactataggggccagctcgagaaagcagtctttacccaggaacagaggagacctgggatgagactgcttaacctggcggcagcgcaaaagatg

SEQ ID NO: 118402 - DNA, 103 bp, Artificial Sequence
  Synthetic Polynucleotide
taatacgactcactatagggaaagtctggggccagctcgagaaagcagtcaacagaggagagactgcatgctcgagctgaacctggcggcagcgcaaaagatg

SEQ ID NO: 118403 - DNA, 103 bp, Artificial Sequence
  Synthetic Polynucleotide
taatacgactcactatagggtgtccccaacaaagtctggggccagctcgaaacagaggagatcgagcatgccccagactaacctggcggcagcgcaaaagatg

SEQ ID NO: 118404 - DNA, 103 bp, Artificial Sequence
  Synthetic Polynucleotide
taatacgactcactatagggtcccataagatgtccccaacaaagtctgggaacagaggagacccagaatgtgttggggaaacctggcggcagcgcaaaagatg

SEQ ID NO: 118405 - DNA, 103 bp, Artificial Sequence
  Synthetic Polynucleotide
taatacgactcactatagggctctagatgttcccataagatgtccccaacaacagaggagagttgggatgatcttatggaacctggcggcagcgcaaaagatg

SEQ ID NO: 118406 - DNA, 103 bp, Artificial Sequence
  Synthetic Polynucleotide
taatacgactcactatagggtctgcaggatctctagatgttcccataagaaacagaggagatcttatatgaacatctagaacctggcggcagcgcaaaagatg

SEQ ID NO: 118407 - DNA, 103 bp, Artificial Sequence
  Synthetic Polynucleotide
taatacgactcactatagggacatcctctttctgcaggatctctagatgtaacagaggagaacatctatggatcctgcaaacctggcggcagcgcaaaagatg

SEQ ID NO: 118408 - DNA, 103 bp, Artificial Sequence
  Synthetic Polynucleotide
taatacgactcactatagggatcgactttttccgtcttgatgatggtgagaacagaggagactcaccatgatcaagacgaacctggcggcagcgcaaaagatg

SEQ ID NO: 118409 - DNA, 103 bp, Artificial Sequence
  Synthetic Polynucleotide
taatacgactcactatagggatatggtttcacatcctctttctgcaggataacagaggagaatcctgatgaaagaggataacctggcggcagcgcaaaagatg

SEQ ID NO: 118410 - DNA, 103 bp, Artificial Sequence
  Synthetic Polynucleotide
taatacgactcactatagggcattaacttgatatggtttcacatcctcttaacagaggagaaagaggatgtgaaaccataacctggcggcagcgcaaaagatg

SEQ ID NO: 118411 - DNA, 103 bp, Artificial Sequence
  Synthetic Polynucleotide
taatacgactcactataggggggttgactccattaacttgatatggtttcaacagaggagagaaaccatgtcaagttaaaacctggcggcagcgcaaaagatg

SEQ ID NO: 118412 - DNA, 103 bp, Artificial Sequence
  Synthetic Polynucleotide
taatacgactcactatagggtggataggctgggttgactccattaacttgaacagaggagacaagttatgggagtcaacaacctggcggcagcgcaaaagatg

SEQ ID NO: 118413 - DNA, 103 bp, Artificial Sequence
  Synthetic Polynucleotide
taatacgactcactatagggagcgggattctggataggctgggttgactcaacagaggagagagtcaatgcagcctatcaacctggcggcagcgcaaaagatg

SEQ ID NO: 118414 - DNA, 103 bp, Artificial Sequence
  Synthetic Polynucleotide
taatacgactcactatagggtccgaggtatagcgggattctggataggctaacagaggagaagcctaatgagaatcccgaacctggcggcagcgcaaaagatg

SEQ ID NO: 118415 - DNA, 103 bp, Artificial Sequence
  Synthetic Polynucleotide
taatacgactcactatagggaatgaagtaatccgaggtatagcgggattcaacagaggagagaatccatgtatacctcgaacctggcggcagcgcaaaagatg

SEQ ID NO: 118416 - DNA, 103 bp, Artificial Sequence
  Synthetic Polynucleotide
taatacgactcactatagggtaccatagctaatgaagtaatccgaggtataacagaggagaatacctatgattacttcaaacctggcggcagcgcaaaagatg

SEQ ID NO: 118417 - DNA, 103 bp, Artificial Sequence
  Synthetic Polynucleotide
taatacgactcactataggggcatgctcaataccatagctaatgaagtaaaacagaggagattacttatgtagctatggaacctggcggcagcgcaaaagatg

SEQ ID NO: 118418 - DNA, 103 bp, Artificial Sequence
  Synthetic Polynucleotide
taatacgactcactatagggaacacactgggcatgctcaataccatagctaacagaggagaagctatatgattgagcataacctggcggcagcgcaaaagatg

SEQ ID NO: 118419 - DNA, 103 bp, Artificial Sequence
  Synthetic Polynucleotide
taatacgactcactatagggaaagctccagatcgactttttccgtcttgaaacagaggagatcaagaatgaaaaagtcgaacctggcggcagcgcaaaagatg

SEQ ID NO: 118420 - DNA, 103 bp, Artificial Sequence
  Synthetic Polynucleotide
taatacgactcactatagggccgatggtggaacacactgggcatgctcaaaacagaggagattgagcatgcccagtgtgaacctggcggcagcgcaaaagatg

SEQ ID NO: 118421 - DNA, 103 bp, Artificial Sequence
  Synthetic Polynucleotide
taatacgactcactatagggtctgagaactccgatggtggaacacactggaacagaggagaccagtgatgtccaccatcaacctggcggcagcgcaaaagatg

SEQ ID NO: 118422 - DNA, 103 bp, Artificial Sequence
  Synthetic Polynucleotide
taatacgactcactataggggaagctgggctctgagaactccgatggtggaacagaggagaccaccaatggagttctcaaacctggcggcagcgcaaaagatg

SEQ ID NO: 118423 - DNA, 103 bp, Artificial Sequence
  Synthetic Polynucleotide
taatacgactcactatagggactctgtgatgaagctgggctctgagaactaacagaggagaagttctatgagcccagctaacctggcggcagcgcaaaagatg

SEQ ID NO: 118424 - DNA, 103 bp, Artificial Sequence
  Synthetic Polynucleotide
taatacgactcactataggggtctgataggactctgtgatgaagctgggcaacagaggagagcccagatgcatcacagaaacctggcggcagcgcaaaagatg

SEQ ID NO: 118425 - DNA, 103 bp, Artificial Sequence
  Synthetic Polynucleotide
taatacgactcactataggggggatggagcgtctgataggactctgtgataacagaggagaatcacaatgtcctatcagaacctggcggcagcgcaaaagatg

SEQ ID NO: 118426 - DNA, 103 bp, Artificial Sequence
  Synthetic Polynucleotide
taatacgactcactatagggccgagctgatgggatggagcgtctgataggaacagaggagacctatcatgcgctccatcaacctggcggcagcgcaaaagatg

SEQ ID NO: 118427 - DNA, 103 bp, Artificial Sequence
  Synthetic Polynucleotide
taatacgactcactatagggaggagctcttccgagctgatgggatggagcaacagaggagagctccaatgcatcagctcaacctggcggcagcgcaaaagatg

SEQ ID NO: 118428 - DNA, 103 bp, Artificial Sequence
  Synthetic Polynucleotide
taatacgactcactatagggcttgagggagaggagctcttccgagctgataacagaggagaatcagcatggaagagctcaacctggcggcagcgcaaaagatg

SEQ ID NO: 118429 - DNA, 103 bp, Artificial Sequence
  Synthetic Polynucleotide
taatacgactcactatagggcattctcatacttgagggagaggagctcttaacagaggagaaagagcatgtctccctcaaacctggcggcagcgcaaaagatg

SEQ ID NO: 118430 - DNA, 103 bp, Artificial Sequence
  Synthetic Polynucleotide
taatacgactcactatagggggggaggggaaaagctccagatcgacttttaacagaggagaaaaagtatgtctggagctaacctggcggcagcgcaaaagatg

SEQ ID NO: 118431 - DNA, 103 bp, Artificial Sequence
  Synthetic Polynucleotide
taatacgactcactataggggaggggtagtcattctcatacttgagggagaacagaggagactccctatggtatgagaaaacctggcggcagcgcaaaagatg

SEQ ID NO: 118432 - DNA, 103 bp, Artificial Sequence
  Synthetic Polynucleotide
taatacgactcactataggggagaatgaccgaggggtagtcattctcataaacagaggagatatgagatggactaccccaacctggcggcagcgcaaaagatg

SEQ ID NO: 118433 - DNA, 103 bp, Artificial Sequence
  Synthetic Polynucleotide
taatacgactcactataggggagggtctcggagaatgaccgaggggtagtaacagaggagaactaccatgcggtcattcaacctggcggcagcgcaaaagatg

SEQ ID NO: 118434 - DNA, 103 bp, Artificial Sequence
  Synthetic Polynucleotide
taatacgactcactatagggtctgtctggagagggtctcggagaatgaccaacagaggagaggtcatatgccgagacccaacctggcggcagcgcaaaagatg

SEQ ID NO: 118435 - DNA, 103 bp, Artificial Sequence
  Synthetic Polynucleotide
taatacgactcactatagggctgcaaggtgtctgtctggagagggtctcgaacagaggagacgagacatgctccagacaaacctggcggcagcgcaaaagatg

SEQ ID NO: 118436 - DNA, 103 bp, Artificial Sequence
  Synthetic Polynucleotide
taatacgactcactatagggagtagtcattctgcaaggtgtctgtctggaaacagaggagatccagaatgacaccttgcaacctggcggcagcgcaaaagatg

SEQ ID NO: 118437 - DNA, 103 bp, Artificial Sequence
  Synthetic Polynucleotide
taatacgactcactatagggttgatagcaaagtagtcattctgcaaggtgaacagaggagacaccttatggaatgactaaacctggcggcagcgcaaaagatg

SEQ ID NO: 118438 - DNA, 103 bp, Artificial Sequence
  Synthetic Polynucleotide
taatacgactcactataggggacttcttgtttgatagcaaagtagtcattaacagaggagaaatgacatgtttgctatcaacctggcggcagcgcaaaagatg

SEQ ID NO: 118439 - DNA, 103 bp, Artificial Sequence
  Synthetic Polynucleotide
taatacgactcactatagggctggggtgacgacttcttgtttgatagcaaaacagaggagattgctaatgaacaagaagaacctggcggcagcgcaaaagatg

SEQ ID NO: 118440 - DNA, 103 bp, Artificial Sequence
  Synthetic Polynucleotide
taatacgactcactatagggcacatgttgtctggggtgacgacttcttgtaacagaggagaacaagaatgcgtcaccccaacctggcggcagcgcaaaagatg

SEQ ID NO: 118441 - DNA, 103 bp, Artificial Sequence
  Synthetic Polynucleotide
taatacgactcactatagggttccatatccggggaggggaaaagctccagaacagaggagactggagatgttcccctccaacctggcggcagcgcaaaagatg

SEQ ID NO: 118442 - DNA, 103 bp, Artificial Sequence
  Synthetic Polynucleotide
taatacgactcactatagggcctccccatgcacatgttgtctggggtgacaacagaggagagtcaccatggacaacatgaacctggcggcagcgcaaaagatg

SEQ ID NO: 118443 - DNA, 103 bp, Artificial Sequence
  Synthetic Polynucleotide
taatacgactcactatagggcacgactggtcctccccatgcacatgttgtaacagaggagaacaacaatggcatggggaaacctggcggcagcgcaaaagatg

SEQ ID NO: 118444 - DNA, 103 bp, Artificial Sequence
  Synthetic Polynucleotide
taatacgactcactatagggccgagtttaccacgactggtcctccccatgaacagaggagacatgggatggaccagtcgaacctggcggcagcgcaaaagatg

SEQ ID NO: 118445 - DNA, 103 bp, Artificial Sequence
  Synthetic Polynucleotide
taatacgactcactataggggtcctggcccccgagtttaccacgactggtaacagaggagaaccagtatgggtaaactcaacctggcggcagcgcaaaagatg

SEQ ID NO: 118446 - DNA, 103 bp, Artificial Sequence
  Synthetic Polynucleotide
taatacgactcactatagggtttcaaaagagtcctggcccccgagtttacaacagaggagagtaaacatgggggccaggaacctggcggcagcgcaaaagatg

SEQ ID NO: 118447 - DNA, 103 bp, Artificial Sequence
  Synthetic Polynucleotide
taatacgactcactatagggctctctatgctttcaaaagagtcctggcccaacagaggagagggccaatgctcttttgaaacctggcggcagcgcaaaagatg

SEQ ID NO: 118448 - DNA, 103 bp, Artificial Sequence
  Synthetic Polynucleotide
taatacgactcactatagggactatcgtagctctctatgctttcaaaagaaacagaggagatcttttatgagcatagagaacctggcggcagcgcaaaagatg

SEQ ID NO: 118449 - DNA, 103 bp, Artificial Sequence
  Synthetic Polynucleotide
taatacgactcactatagggggcgatcacaactatcgtagctctctatgcaacagaggagagcatagatggctacgataaacctggcggcagcgcaaaagatg

SEQ ID NO: 118450 - DNA, 103 bp, Artificial Sequence
  Synthetic Polynucleotide
taatacgactcactataggggactgggtgaggcgatcacaactatcgtagaacagaggagactacgaatgttgtgatcgaacctggcggcagcgcaaaagatg

SEQ ID NO: 118451 - DNA, 103 bp, Artificial Sequence
  Synthetic Polynucleotide
taatacgactcactataggggctgctccaggactgggtgaggcgatcacaaacagaggagatgtgatatgctcacccagaacctggcggcagcgcaaaagatg

SEQ ID NO: 118452 - DNA, 103 bp, Artificial Sequence
  Synthetic Polynucleotide
taatacgactcactatagggcatctgcacattccatatccggggaggggaaacagaggagatcccctatgcggatatggaacctggcggcagcgcaaaagatg

SEQ ID NO: 118453 - DNA, 103 bp, Artificial Sequence
  Synthetic Polynucleotide
taatacgactcactatagggaagatgactggctgctccaggactgggtgaaacagaggagatcacccatgcctggagcaaacctggcggcagcgcaaaagatg

SEQ ID NO: 118454 - DNA, 103 bp, Artificial Sequence
  Synthetic Polynucleotide
taatacgactcactatagggaggctgttgaaagatgactggctgctccagaacagaggagactggagatgccagtcatcaacctggcggcagcgcaaaagatg

SEQ ID NO: 118455 - DNA, 103 bp, Artificial Sequence
  Synthetic Polynucleotide
taatacgactcactatagggaacacgctgcaggctgttgaaagatgactgaacagaggagacagtcaatgttcaacagcaacctggcggcagcgcaaaagatg

SEQ ID NO: 118456 - DNA, 103 bp, Artificial Sequence
  Synthetic Polynucleotide
taatacgactcactatagggcataggagggaacacgctgcaggctgttgaaacagaggagatcaacaatgtgcagcgtgaacctggcggcagcgcaaaagatg

SEQ ID NO: 118457 - DNA, 103 bp, Artificial Sequence
  Synthetic Polynucleotide
taatacgactcactatagggtcgaagctgtcataggagggaacacgctgcaacagaggagagcagcgatgtccctcctaaacctggcggcagcgcaaaagatg

SEQ ID NO: 118458 - DNA, 103 bp, Artificial Sequence
  Synthetic Polynucleotide
taatacgactcactataggggtcctctgagtcgaagctgtcataggagggaacagaggagaccctccatggacagcttcaacctggcggcagcgcaaaagatg

SEQ ID NO: 118459 - DNA, 103 bp, Artificial Sequence
  Synthetic Polynucleotide
taatacgactcactatagggcagccggatagtcctctgagtcgaagctgtaacagaggagaacagctatgactcagaggaacctggcggcagcgcaaaagatg

SEQ ID NO: 118460 - DNA, 103 bp, Artificial Sequence
  Synthetic Polynucleotide
taatacgactcactatagggttgggcagggcagccggatagtcctctgagaacagaggagactcagaatgctatccggcaacctggcggcagcgcaaaagatg

SEQ ID NO: 118461 - DNA, 103 bp, Artificial Sequence
  Synthetic Polynucleotide
taatacgactcactataggggggcttgtggttgggcagggcagccggataaacagaggagatatccgatggccctgcccaacctggcggcagcgcaaaagatg

SEQ ID NO: 118462 - DNA, 103 bp, Artificial Sequence
  Synthetic Polynucleotide
taatacgactcactatagggaggtgcccttgggcttgtggttgggcagggaacagaggagaccctgcatgaccacaagcaacctggcggcagcgcaaaagatg

SEQ ID NO: 118463 - DNA, 103 bp, Artificial Sequence
  Synthetic Polynucleotide
taatacgactcactatagggaatagtgggacatctgcacattccatatccaacagaggagaggatatatgatgtgcagaaacctggcggcagcgcaaaagatg

SEQ ID NO: 118464 - DNA, 103 bp, Artificial Sequence
  Synthetic Polynucleotide
taatacgactcactatagggtagtccttgaaggtgcccttgggcttgtggaacagaggagaccacaaatgcaagggcacaacctggcggcagcgcaaaagatg

SEQ ID NO: 118465 - DNA, 103 bp, Artificial Sequence
  Synthetic Polynucleotide
taatacgactcactataggggtcccgcacatagtccttgaaggtgcccttaacagaggagaaagggcatgttcaaggacaacctggcggcagcgcaaaagatg

SEQ ID NO: 118466 - DNA, 103 bp, Artificial Sequence
  Synthetic Polynucleotide
taatacgactcactatagggggtcagcacggtcccgcacatagtccttgaaacagaggagatcaaggatgatgtgcgggaacctggcggcagcgcaaaagatg

SEQ ID NO: 118467 - DNA, 103 bp, Artificial Sequence
  Synthetic Polynucleotide
taatacgactcactatagggtccttattgaggtcagcacggtcccgcacaaacagaggagatgtgcgatgccgtgctgaaacctggcggcagcgcaaaagatg

SEQ ID NO: 118468 - DNA, 103 bp, Artificial Sequence
  Synthetic Polynucleotide
taatacgactcactataggggacaggcttgtccttattgaggtcagcacgaacagaggagacgtgctatgctcaataagaacctggcggcagcgcaaaagatg

SEQ ID NO: 118469 - DNA, 103 bp, Artificial Sequence
  Synthetic Polynucleotide
taatacgactcactatagggcagcaggaatgacaggcttgtccttattgaaacagaggagatcaataatgacaagcctgaacctggcggcagcgcaaaagatg

SEQ ID NO: 118470 - DNA, 103 bp, Artificial Sequence
  Synthetic Polynucleotide
taatacgactcactataggggctagggcagcagcaggaatgacaggcttgaacagaggagacaagccatgcattcctgcaacctggcggcagcgcaaaagatg

SEQ ID NO: 118471 - DNA, 103 bp, Artificial Sequence
  Synthetic Polynucleotide
taatacgactcactatagggtgtgtagccagctagggcagcagcaggaataacagaggagaattcctatggctgccctaaacctggcggcagcgcaaaagatg

SEQ ID NO: 118472 - DNA, 103 bp, Artificial Sequence
  Synthetic Polynucleotide
taatacgactcactataggggtccactgcctgtgtagccagctagggcagaacagaggagactgcccatgctggctacaaacctggcggcagcgcaaaagatg

SEQ ID NO: 118473 - DNA, 103 bp, Artificial Sequence
  Synthetic Polynucleotide
taatacgactcactatagggagctggattggtccactgcctgtgtagccaaacagaggagatggctaatgaggcagtggaacctggcggcagcgcaaaagatg

SEQ ID NO: 118474 - DNA, 103 bp, Artificial Sequence
  Synthetic Polynucleotide
taatacgactcactataggggtccatattcttgattccgaaatcattcataacagaggagaatgaatatgttcggaatcaacctggcggcagcgcaaaagatg

SEQ ID NO: 118475 - DNA, 103 bp, Artificial Sequence
  Synthetic Polynucleotide
taatacgactcactatagggaaaaacagcaaacagggacccatcaaaggtaacagaggagaacctttatggggtccctgaacctggcggcagcgcaaaagatg

SEQ ID NO: 118476 - DNA, 103 bp, Artificial Sequence
  Synthetic Polynucleotide
taatacgactcactataggggtcactcctctcttggatgtaatccttgaaaacagaggagattcaagatgtacatccaaaacctggcggcagcgcaaaagatg

SEQ ID NO: 118477 - DNA, 103 bp, Artificial Sequence
  Synthetic Polynucleotide
taatacgactcactataggggctccactgggtcactcctctcttggatgtaacagaggagaacatccatgagaggagtgaacctggcggcagcgcaaaagatg

SEQ ID NO: 118478 - DNA, 103 bp, Artificial Sequence
  Synthetic Polynucleotide
taatacgactcactatagggggtttgccttgctccactgggtcactcctcaacagaggagagaggagatgcccagtggaaacctggcggcagcgcaaaagatg

SEQ ID NO: 118479 - DNA, 103 bp, Artificial Sequence
  Synthetic Polynucleotide
taatacgactcactatagggaggtataactggtttgccttgctccactggaacagaggagaccagtgatgcaaggcaaaaacctggcggcagcgcaaaagatg

SEQ ID NO: 118480 - DNA, 103 bp, Artificial Sequence
  Synthetic Polynucleotide
taatacgactcactataggggcacagctgcaggtataactggtttgccttaacagaggagaaaggcaatgcagttatacaacctggcggcagcgcaaaagatg

SEQ ID NO: 118481 - DNA, 103 bp, Artificial Sequence
  Synthetic Polynucleotide
taatacgactcactatagggaagccggccagcacagctgcaggtataactaacagaggagaagttatatgtgcagctgtaacctggcggcagcgcaaaagatg

SEQ ID NO: 118482 - DNA, 103 bp, Artificial Sequence
  Synthetic Polynucleotide
taatacgactcactatagggacttcctgtgaagccggccagcacagctgcaacagaggagagcagctatgctggccggcaacctggcggcagcgcaaaagatg

SEQ ID NO: 118483 - DNA, 103 bp, Artificial Sequence
  Synthetic Polynucleotide
taatacgactcactataggggaataggtccacttcctgtgaagccggccaaacagaggagatggccgatgtcacaggaaaacctggcggcagcgcaaaagatg

SEQ ID NO: 118484 - DNA, 103 bp, Artificial Sequence
  Synthetic Polynucleotide
taatacgactcactatagggtgccacagctgaataggtccacttcctgtgaacagaggagacacaggatgtggacctataacctggcggcagcgcaaaagatg

SEQ ID NO: 118485 - DNA, 103 bp, Artificial Sequence
  Synthetic Polynucleotide
taatacgactcactatagggcaggagaaactgccacagctgaataggtccaacagaggagaggacctatgcagctgtggaacctggcggcagcgcaaaagatg

SEQ ID NO: 118486 - DNA, 103 bp, Artificial Sequence
  Synthetic Polynucleotide
taatacgactcactatagggttagagaaggaaaaacagcaaacagggaccaacagaggagaggtcccatgttgctgtttaacctggcggcagcgcaaaagatg

SEQ ID NO: 118487 - DNA, 103 bp, Artificial Sequence
  Synthetic Polynucleotide
taatacgactcactatagggatagcagctccaggagaaactgccacagctaacagaggagaagctgtatgagtttctccaacctggcggcagcgcaaaagatg

SEQ ID NO: 118488 - DNA, 103 bp, Artificial Sequence
  Synthetic Polynucleotide
taatacgactcactataggggatttgtctgatagcagctccaggagaaacaacagaggagagtttctatgggagctgctaacctggcggcagcgcaaaagatg

SEQ ID NO: 118489 - DNA, 103 bp, Artificial Sequence
  Synthetic Polynucleotide
taatacgactcactatagggtgactggcaggatttgtctgatagcagctcaacagaggagagagctgatgtcagacaaaaacctggcggcagcgcaaaagatg

SEQ ID NO: 118490 - DNA, 103 bp, Artificial Sequence
  Synthetic Polynucleotide
taatacgactcactatagggagctgatgaatgactggcaggatttgtctgaacagaggagacagacaatgcctgccagtaacctggcggcagcgcaaaagatg

SEQ ID NO: 118491 - DNA, 103 bp, Artificial Sequence
  Synthetic Polynucleotide
taatacgactcactatagggtctccagtccagctgatgaatgactggcagaacagaggagactgccaatgattcatcagaacctggcggcagcgcaaaagatg

SEQ ID NO: 118492 - DNA, 103 bp, Artificial Sequence
  Synthetic Polynucleotide
taatacgactcactatagggctcccatccgtctccagtccagctgatgaaaacagaggagattcatcatgtggactggaaacctggcggcagcgcaaaagatg

SEQ ID NO: 118493 - DNA, 103 bp, Artificial Sequence
  Synthetic Polynucleotide
taatacgactcactatagggcgagcttaaactcccatccgtctccagtccaacagaggagaggactgatgacggatgggaacctggcggcagcgcaaaagatg

SEQ ID NO: 118494 - DNA, 103 bp, Artificial Sequence
  Synthetic Polynucleotide
taatacgactcactatagggtcggggtcggcgagcttaaactcccatccgaacagaggagacggatgatggtttaagctaacctggcggcagcgcaaaagatg

SEQ ID NO: 118495 - DNA, 103 bp, Artificial Sequence
  Synthetic Polynucleotide
taatacgactcactatagggggccacctcatcggggtcggcgagcttaaaaacagaggagatttaagatggccgaccccaacctggcggcagcgcaaaagatg

SEQ ID NO: 118496 - DNA, 103 bp, Artificial Sequence
  Synthetic Polynucleotide
taatacgactcactatagggcccaccggcgggccacctcatcggggtcggaacagaggagaccgaccatgatgaggtggaacctggcggcagcgcaaaagatg

SEQ ID NO: 118497 - DNA, 103 bp, Artificial Sequence
  Synthetic Polynucleotide
taatacgactcactatagggtgctcttcatttagagaaggaaaaacagcaaacagaggagatgctgtatgtccttctctaacctggcggcagcgcaaaagatg

SEQ ID NO: 118498 - DNA, 103 bp, Artificial Sequence
  Synthetic Polynucleotide
taatacgactcactatagggttcctctttccccaccggcgggccacctcaaacagaggagatgaggtatgccgccggtgaacctggcggcagcgcaaaagatg

SEQ ID NO: 118499 - DNA, 103 bp, Artificial Sequence
  Synthetic Polynucleotide
taatacgactcactataggggggcttatttttcctctttccccaccggcgaacagaggagacgccggatgggaaagaggaacctggcggcagcgcaaaagatg

SEQ ID NO: 118500 - DNA, 103 bp, Artificial Sequence
  Synthetic Polynucleotide
taatacgactcactatagggagttcatcttgggcttatttttcctctttcaacagaggagagaaagaatgaaaataagcaacctggcggcagcgcaaaagatg

SEQ ID NO: 118501 - DNA, 103 bp, Artificial Sequence
  Synthetic Polynucleotide
taatacgactcactatagggagcttctcgtagttcatcttgggcttatttaacagaggagaaaataaatgcaagatgaaaacctggcggcagcgcaaaagatg

SEQ ID NO: 118502 - DNA, 103 bp, Artificial Sequence
  Synthetic Polynucleotide
taatacgactcactataggggccccggctcagcttctcgtagttcatcttaacagaggagaaagatgatgtacgagaagaacctggcggcagcgcaaaagatg

SEQ ID NO: 118503 - DNA, 103 bp, Artificial Sequence
  Synthetic Polynucleotide
taatacgactcactatagggagtagcgtaagccccggctcagcttctcgtaacagaggagaacgagaatgtgagccgggaacctggcggcagcgcaaaagatg

SEQ ID NO: 118504 - DNA, 103 bp, Artificial Sequence
  Synthetic Polynucleotide
taatacgactcactatagggttgtcgtaatagtagcgtaagccccggctcaacagaggagagagccgatgcttacgctaaacctggcggcagcgcaaaagatg

SEQ ID NO: 118505 - DNA, 103 bp, Artificial Sequence
  Synthetic Polynucleotide
taatacgactcactataggggatgatgttcttgtcgtaatagtagcgtaaaacagaggagattacgcatgtattacgacaacctggcggcagcgcaaaagatg

SEQ ID NO: 118506 - DNA, 103 bp, Artificial Sequence
  Synthetic Polynucleotide
taatacgactcactatagggacgtcttgtggatgatgttcttgtcgtaataacagaggagaattacgatgagaacatcaaacctggcggcagcgcaaaagatg

SEQ ID NO: 118507 - DNA, 103 bp, Artificial Sequence
  Synthetic Polynucleotide
taatacgactcactatagggcgcttccccgacgtcttgtggatgatgttcaacagaggagagaacatatgccacaagacaacctggcggcagcgcaaaagatg

SEQ ID NO: 118508 - DNA, 103 bp, Artificial Sequence
  Synthetic Polynucleotide
taatacgactcactatagggttgcagtgtttgctcttcatttagagaaggaacagaggagaccttctatgaatgaagagaacctggcggcagcgcaaaagatg

SEQ ID NO: 118509 - DNA, 103 bp, Artificial Sequence
  Synthetic Polynucleotide
taatacgactcactataggggtacacgtagcgcttccccgacgtcttgtgaacagaggagacacaagatgtcggggaagaacctggcggcagcgcaaaagatg

SEQ ID NO: 118510 - DNA, 103 bp, Artificial Sequence
  Synthetic Polynucleotide
taatacgactcactatagggacacgaagcggtacacgtagcgcttccccgaacagaggagacggggaatggctacgtgtaacctggcggcagcgcaaaagatg

SEQ ID NO: 118511 - DNA, 103 bp, Artificial Sequence
  Synthetic Polynucleotide
taatacgactcactatagggtggaggtcgcacacgaagcggtacacgtagaacagaggagactacgtatgccgcttcgtaacctggcggcagcgcaaaagatg

SEQ ID NO: 118512 - DNA, 103 bp, Artificial Sequence
  Synthetic Polynucleotide
taatacgactcactatagggcagcaagttctggaggtcgcacacgaagcgaacagaggagacgcttcatgtgcgacctcaacctggcggcagcgcaaaagatg

SEQ ID NO: 118513 - DNA, 103 bp, Artificial Sequence
  Synthetic Polynucleotide
taatacgactcactataggggcgtgaaccccagcaagttctggaggtcgcaacagaggagagcgaccatgagaacttgcaacctggcggcagcgcaaaagatg

SEQ ID NO: 118514 - DNA, 103 bp, Artificial Sequence
  Synthetic Polynucleotide
taatacgactcactatagggagttcctcgggcgtgaaccccagcaagttcaacagaggagagaacttatgggggttcacaacctggcggcagcgcaaaagatg

SEQ ID NO: 118515 - DNA, 103 bp, Artificial Sequence
  Synthetic Polynucleotide
taatacgactcactataggggatggcgtgcagttcctcgggcgtgaacccaacagaggagagggttcatgcccgaggaaaacctggcggcagcgcaaaagatg

SEQ ID NO: 118516 - DNA, 103 bp, Artificial Sequence
  Synthetic Polynucleotide
taatacgactcactatagggggacgcccaggatggcgtgcagttcctcggaacagaggagaccgaggatgtgcacgccaaacctggcggcagcgcaaaagatg

SEQ ID NO: 118517 - DNA, 103 bp, Artificial Sequence
  Synthetic Polynucleotide
taatacgactcactataggggtgtcgggctggacgcccaggatggcgtgcaacagaggagagcacgcatgcctgggcgtaacctggcggcagcgcaaaagatg

SEQ ID NO: 118518 - DNA, 103 bp, Artificial Sequence
  Synthetic Polynucleotide
taatacgactcactatagggtcagtcctccgtgtcgggctggacgcccagaacagaggagactgggcatgcagcccgacaacctggcggcagcgcaaaagatg

SEQ ID NO: 118519 - DNA, 103 bp, Artificial Sequence
  Synthetic Polynucleotide
taatacgactcactatagggttggcacttcttgcagtgtttgctcttcataacagaggagaatgaagatgaaacactgcaacctggcggcagcgcaaaagatg

SEQ ID NO: 118520 - DNA, 103 bp, Artificial Sequence
  Synthetic Polynucleotide
taatacgactcactatagggtccaagcctgttggcacttcttgcagtgttaacagaggagaaacactatgagaagtgccaacctggcggcagcgcaaaagatg

SEQ ID NO: 118521 - DNA, 103 bp, Artificial Sequence
  Synthetic Polynucleotide
taatacgactcactatagggagaaatggaatccaagcctgttggcacttcaacagaggagagaagtgatgacaggcttgaacctggcggcagcgcaaaagatg

SEQ ID NO: 118522 - DNA, 103 bp, Artificial Sequence
  Synthetic Polynucleotide
taatacgactcactatagggcggagtcatgagaaatggaatccaagcctgaacagaggagacaggctatgattccatttaacctggcggcagcgcaaaagatg

SEQ ID NO: 118523 - DNA, 103 bp, Artificial Sequence
  Synthetic Polynucleotide
taatacgactcactatagggtcacagttggcggagtcatgagaaatggaaaacagaggagattccatatgtcatgactcaacctggcggcagcgcaaaagatg

SEQ ID NO: 118524 - DNA, 103 bp, Artificial Sequence
  Synthetic Polynucleotide
taatacgactcactatagggcaaaggcaattcacagttggcggagtcatgaacagaggagacatgacatggccaactgtaacctggcggcagcgcaaaagatg

SEQ ID NO: 118525 - DNA, 103 bp, Artificial Sequence
  Synthetic Polynucleotide
taatacgactcactataggggggctacctggtccatattcttgattccgaaacagaggagatcggaaatgagaatatggaacctggcggcagcgcaaaagatg

SEQ ID NO: 118526 - DNA, 103 bp, Artificial Sequence
  Synthetic Polynucleotide
taatacgactcactatagggacggggttaacaaaggcaattcacagttggaacagaggagaccaactatgaattgccttaacctggcggcagcgcaaaagatg

SEQ ID NO: 118527 - DNA, 103 bp, Artificial Sequence
  Synthetic Polynucleotide
taatacgactcactataggggccttgctgcacggggttaacaaaggcaataacagaggagaattgccatggttaaccccaacctggcggcagcgcaaaagatg

SEQ ID NO: 118528 - DNA, 103 bp, Artificial Sequence
  Synthetic Polynucleotide
taatacgactcactatagggactcatcacagccttgctgcacggggttaaaacagaggagattaaccatgtgcagcaagaacctggcggcagcgcaaaagatg

SEQ ID NO: 118529 - DNA, 103 bp, Artificial Sequence
  Synthetic Polynucleotide
taatacgactcactatagggttaaggcttgactcatcacagccttgctgcaacagaggagagcagcaatgctgtgatgaaacctggcggcagcgcaaaagatg

SEQ ID NO: 118530 - DNA, 103 bp, Artificial Sequence
  Synthetic Polynucleotide
taatacgactcactatagggaaggtagcttttaaggcttgactcatcacaaacagaggagatgtgatatgtcaagccttaacctggcggcagcgcaaaagatg

SEQ ID NO: 118531 - DNA, 103 bp, Artificial Sequence
  Synthetic Polynucleotide
taatacgactcactataggggaagccactgaaggtagcttttaaggcttgaacagaggagacaagccatgaaagctaccaacctggcggcagcgcaaaagatg

SEQ ID NO: 118532 - DNA, 103 bp, Artificial Sequence
  Synthetic Polynucleotide
taatacgactcactataggggttcctttttgaagccactgaaggtagcttaacagaggagaaagctaatgtcagtggctaacctggcggcagcgcaaaagatg

SEQ ID NO: 118533 - DNA, 103 bp, Artificial Sequence
  Synthetic Polynucleotide
taatacgactcactatagggaggcgccgctgttcctttttgaagccactgaacagaggagacagtggatgcaaaaaggaaacctggcggcagcgcaaaagatg

SEQ ID NO: 118534 - DNA, 103 bp, Artificial Sequence
  Synthetic Polynucleotide
taatacgactcactatagggtggaatgcccaggcgccgctgttcctttttaacagaggagaaaaaagatgcagcggcgcaacctggcggcagcgcaaaagatg

SEQ ID NO: 118535 - DNA, 103 bp, Artificial Sequence
  Synthetic Polynucleotide
taatacgactcactatagggaggggttctttggaatgcccaggcgccgctaacagaggagaagcggcatgtgggcattcaacctggcggcagcgcaaaagatg

SEQ ID NO: 118536 - DNA, 103 bp, Artificial Sequence
  Synthetic Polynucleotide
taatacgactcactatagggttagccacaggggctacctggtccatattcaacagaggagagaatatatgccaggtagcaacctggcggcagcgcaaaagatg

SEQ ID NO: 118537 - DNA, 103 bp, Artificial Sequence
  Synthetic Polynucleotide
taatacgactcactatagggctccacagccaggggttctttggaatgcccaacagaggagagggcatatgaaagaacccaacctggcggcagcgcaaaagatg

SEQ ID NO: 118538 - DNA, 103 bp, Artificial Sequence
  Synthetic Polynucleotide
taatacgactcactatagggctgttgctcactccacagccaggggttcttaacagaggagaaagaacatgtggctgtggaacctggcggcagcgcaaaagatg

SEQ ID NO: 118539 - DNA, 103 bp, Artificial Sequence
  Synthetic Polynucleotide
taatacgactcactatagggactggcatacctgttgctcactccacagccaacagaggagaggctgtatggtgagcaacaacctggcggcagcgcaaaagatg

SEQ ID NO: 118540 - DNA, 103 bp, Artificial Sequence
  Synthetic Polynucleotide
taatacgactcactatagggcagagaagccactggcatacctgttgctcaaacagaggagatgagcaatgggtatgccaaacctggcggcagcgcaaaagatg

SEQ ID NO: 118541 - DNA, 103 bp, Artificial Sequence
  Synthetic Polynucleotide
taatacgactcactatagggattggtggcccagagaagccactggcatacaacagaggagagtatgcatgtggcttctcaacctggcggcagcgcaaaagatg

SEQ ID NO: 118542 - DNA, 103 bp, Artificial Sequence
  Synthetic Polynucleotide
taatacgactcactataggggactgaactcattggtggcccagagaagccaacagaggagaggcttcatggggccaccaaacctggcggcagcgcaaaagatg

SEQ ID NO: 118543 - DNA, 103 bp, Artificial Sequence
  Synthetic Polynucleotide
taatacgactcactatagggacgttcaccagactgaactcattggtggccaacagaggagaggccacatgtgagttcagaacctggcggcagcgcaaaagatg

SEQ ID NO: 118544 - DNA, 103 bp, Artificial Sequence
  Synthetic Polynucleotide
taatacgactcactatagggctgcagattcacgttcaccagactgaactcaacagaggagagagttcatgctggtgaacaacctggcggcagcgcaaaagatg

SEQ ID NO: 118545 - DNA, 103 bp, Artificial Sequence
  Synthetic Polynucleotide
taatacgactcactatagggtgccgaacctctgcagattcacgttcaccaaacagaggagatggtgaatgtgaatctgcaacctggcggcagcgcaaaagatg

SEQ ID NO: 118546 - DNA, 103 bp, Artificial Sequence
  Synthetic Polynucleotide
taatacgactcactatagggtggccattcatgccgaacctctgcagattcaacagaggagagaatctatggaggttcggaacctggcggcagcgcaaaagatg

SEQ ID NO: 118547 - DNA, 103 bp, Artificial Sequence
  Synthetic Polynucleotide
taatacgactcactatagggtctgtaactgttagccacaggggctacctgaacagaggagacaggtaatgcctgtggctaacctggcggcagcgcaaaagatg

SEQ ID NO: 118548 - DNA, 103 bp, Artificial Sequence
  Synthetic Polynucleotide
taatacgactcactatagggacacagcatctggccattcatgccgaacctaacagaggagaaggttcatgatgaatggcaacctggcggcagcgcaaaagatg

SEQ ID NO: 118549 - DNA, 103 bp, Artificial Sequence
  Synthetic Polynucleotide
taatacgactcactatagggtgccaaggttacacagcatctggccattcaaacagaggagatgaatgatgagatgctgtaacctggcggcagcgcaaaagatg

SEQ ID NO: 118550 - DNA, 103 bp, Artificial Sequence
  Synthetic Polynucleotide
taatacgactcactatagggaagcgttccttgccaaggttacacagcatcaacagaggagagatgctatgtaaccttggaacctggcggcagcgcaaaagatg

SEQ ID NO: 118551 - DNA, 103 bp, Artificial Sequence
  Synthetic Polynucleotide
taatacgactcactatagggcagctccagaaagcgttccttgccaaggttaacagaggagaaaccttatgaaggaacgcaacctggcggcagcgcaaaagatg

SEQ ID NO: 118552 - DNA, 103 bp, Artificial Sequence
  Synthetic Polynucleotide
taatacgactcactatagggagtcaggtgccagctccagaaagcgttcctaacagaggagaaggaacatgttctggagcaacctggcggcagcgcaaaagatg

SEQ ID NO: 118553 - DNA, 103 bp, Artificial Sequence
  Synthetic Polynucleotide
taatacgactcactatagggtcacccacaaagtcaggtgccagctccagaaacagaggagatctggaatgggcacctgaaacctggcggcagcgcaaaagatg

SEQ ID NO: 118554 - DNA, 103 bp, Artificial Sequence
  Synthetic Polynucleotide
taatacgactcactatagggccagagaatgtcacccacaaagtcaggtgcaacagaggagagcacctatgtttgtgggtaacctggcggcagcgcaaaagatg

SEQ ID NO: 118555 - DNA, 103 bp, Artificial Sequence
  Synthetic Polynucleotide
taatacgactcactatagggccagatgttcccagagaatgtcacccacaaaacagaggagattgtggatgacattctctaacctggcggcagcgcaaaagatg

SEQ ID NO: 118556 - DNA, 103 bp, Artificial Sequence
  Synthetic Polynucleotide
taatacgactcactatagggatcatttgctccagatgttcccagagaatgaacagaggagacattctatgggaacatctaacctggcggcagcgcaaaagatg

SEQ ID NO: 118557 - DNA, 103 bp, Artificial Sequence
  Synthetic Polynucleotide
taatacgactcactataggggttttctttgatcatttgctccagatgttcaacagaggagagaacatatggagcaaatgaacctggcggcagcgcaaaagatg

SEQ ID NO: 118558 - DNA, 103 bp, Artificial Sequence
  Synthetic Polynucleotide
taatacgactcactatagggtgagtgtccctctgtaactgttagccacagaacagaggagactgtggatgacagttacaaacctggcggcagcgcaaaagatg

SEQ ID NO: 118559 - DNA, 103 bp, Artificial Sequence
  Synthetic Polynucleotide
taatacgactcactatagggtcttttcttggttttctttgatcatttgctaacagaggagaagcaaaatgtcaaagaaaaacctggcggcagcgcaaaagatg

SEQ ID NO: 118560 - DNA, 103 bp, Artificial Sequence
  Synthetic Polynucleotide
taatacgactcactatagggtgatcttctgtcttttcttggttttctttgaacagaggagacaaagaatgccaagaaaaaacctggcggcagcgcaaaagatg

SEQ ID NO: 118561 - DNA, 103 bp, Artificial Sequence
  Synthetic Polynucleotide
taatacgactcactatagggttcttcatattgatcttctgtcttttcttgaacagaggagacaagaaatgacagaagataacctggcggcagcgcaaaagatg

SEQ ID NO: 118562 - DNA, 103 bp, Artificial Sequence
  Synthetic Polynucleotide
taatacgactcactatagggggtgtgaattttcttcatattgatcttctgaacagaggagacagaagatgaatatgaagaacctggcggcagcgcaaaagatg

SEQ ID NO: 118563 - DNA, 103 bp, Artificial Sequence
  Synthetic Polynucleotide
taatacgactcactatagggacggaggtgaggtgtgaattttcttcatataacagaggagaatatgaatgaaattcacaaacctggcggcagcgcaaaagatg

SEQ ID NO: 118564 - DNA, 103 bp, Artificial Sequence
  Synthetic Polynucleotide
taatacgactcactatagggccaatgaggaacggaggtgaggtgtgaattaacagaggagaaattcaatgctcacctccaacctggcggcagcgcaaaagatg

SEQ ID NO: 118565 - DNA, 103 bp, Artificial Sequence
  Synthetic Polynucleotide
taatacgactcactatagggtgctgttaatccaatgaggaacggaggtgaaacagaggagatcacctatgttcctcattaacctggcggcagcgcaaaagatg

SEQ ID NO: 118566 - DNA, 103 bp, Artificial Sequence
  Synthetic Polynucleotide
taatacgactcactatagggcctaatgtattgctgttaatccaatgaggaaacagaggagatcctcaatggattaacagaacctggcggcagcgcaaaagatg

SEQ ID NO: 118567 - DNA, 103 bp, Artificial Sequence
  Synthetic Polynucleotide
taatacgactcactatagggtgtgccaaaacctaatgtattgctgttaataacagaggagaattaacatgaatacattaaacctggcggcagcgcaaaagatg

SEQ ID NO: 118568 - DNA, 103 bp, Artificial Sequence
  Synthetic Polynucleotide
taatacgactcactataggggcgcctgctctgtgccaaaacctaatgtataacagaggagaatacatatggttttggcaaacctggcggcagcgcaaaagatg

SEQ ID NO: 118569 - DNA, 103 bp, Artificial Sequence
  Synthetic Polynucleotide
taatacgactcactatagggggctggcgcttgagtgtccctctgtaactgaacagaggagacagttaatgagggacactaacctggcggcagcgcaaaagatg

SEQ ID NO: 118570 - DNA, 103 bp, Artificial Sequence
  Synthetic Polynucleotide
taatacgactcactatagggattccatagggcgcctgctctgtgccaaaaaacagaggagattttggatgagagcaggcaacctggcggcagcgcaaaagatg

SEQ ID NO: 118571 - DNA, 103 bp, Artificial Sequence
  Synthetic Polynucleotide
taatacgactcactatagggctgtgtctgcattccatagggcgcctgctcaacagaggagagagcagatgccctatggaaacctggcggcagcgcaaaagatg

SEQ ID NO: 118572 - DNA, 103 bp, Artificial Sequence
  Synthetic Polynucleotide
taatacgactcactatagggtggggtaattctgtgtctgcattccataggaacagaggagacctatgatgtgcagacacaacctggcggcagcgcaaaagatg

SEQ ID NO: 118573 - DNA, 103 bp, Artificial Sequence
  Synthetic Polynucleotide
taatacgactcactatagggaggccgcctttggggtaattctgtgtctgcaacagaggagagcagacatggaattacccaacctggcggcagcgcaaaagatg

SEQ ID NO: 118574 - DNA, 103 bp, Artificial Sequence
  Synthetic Polynucleotide
taatacgactcactataggggctgtccaggaggccgcctttggggtaattaacagaggagaaattacatgaaaggcggcaacctggcggcagcgcaaaagatg

SEQ ID NO: 118575 - DNA, 103 bp, Artificial Sequence
  Synthetic Polynucleotide
taatacgactcactatagggccggacacatgctgtccaggaggccgccttaacagaggagaaaggcgatgtcctggacaaacctggcggcagcgcaaaagatg

SEQ ID NO: 118576 - DNA, 103 bp, Artificial Sequence
  Synthetic Polynucleotide
taatacgactcactatagggggtgtggaggccggacacatgctgtccaggaacagaggagacctggaatgcatgtgtccaacctggcggcagcgcaaaagatg

SEQ ID NO: 118577 - DNA, 103 bp, Artificial Sequence
  Synthetic Polynucleotide
taatacgactcactataggggagtacgctgggtgtggaggccggacacataacagaggagaatgtgtatggcctccacaaacctggcggcagcgcaaaagatg

SEQ ID NO: 118578 - DNA, 103 bp, Artificial Sequence
  Synthetic Polynucleotide
taatacgactcactataggggctcagagctgagtacgctgggtgtggaggaacagaggagacctccaatgccagcgtacaacctggcggcagcgcaaaagatg

SEQ ID NO: 118579 - DNA, 103 bp, Artificial Sequence
  Synthetic Polynucleotide
taatacgactcactatagggtgaaactcctgctcagagctgagtacgctgaacagaggagacagcgtatgcagctctgaaacctggcggcagcgcaaaagatg

SEQ ID NO: 118580 - DNA, 103 bp, Artificial Sequence
  Synthetic Polynucleotide
taatacgactcactataggggtcaaaggctggctggcgcttgagtgtcccaacagaggagagggacaatgaagcgccagaacctggcggcagcgcaaaagatg

SEQ ID NO: 118581 - DNA, 103 bp, Artificial Sequence
  Synthetic Polynucleotide
taatacgactcactatagggggggaacatctgaaactcctgctcagagctaacagaggagaagctctatgcaggagtttaacctggcggcagcgcaaaagatg

SEQ ID NO: 118582 - DNA, 103 bp, Artificial Sequence
  Synthetic Polynucleotide
taatacgactcactataggggccgagacttggggaacatctgaaactcctaacagaggagaaggagtatgagatgttccaacctggcggcagcgcaaaagatg

SEQ ID NO: 118583 - DNA, 103 bp, Artificial Sequence
  Synthetic Polynucleotide
taatacgactcactatagggacggagctgagccgagacttggggaacatcaacagaggagagatgttatgcaagtctcgaacctggcggcagcgcaaaagatg

SEQ ID NO: 118584 - DNA, 103 bp, Artificial Sequence
  Synthetic Polynucleotide
taatacgactcactatagggggtgacgctgacggagctgagccgagacttaacagaggagaaagtctatgctcagctccaacctggcggcagcgcaaaagatg

SEQ ID NO: 118585 - DNA, 103 bp, Artificial Sequence
  Synthetic Polynucleotide
taatacgactcactatagggcagagcagtaggtgacgctgacggagctgaaacagaggagatcagctatgtcagcgtcaaacctggcggcagcgcaaaagatg

SEQ ID NO: 118586 - DNA, 103 bp, Artificial Sequence
  Synthetic Polynucleotide
taatacgactcactatagggtcctgactgacagagcagtaggtgacgctgaacagaggagacagcgtatgctactgctcaacctggcggcagcgcaaaagatg

SEQ ID NO: 118587 - DNA, 103 bp, Artificial Sequence
  Synthetic Polynucleotide
taatacgactcactataggggcctgggaagtcctgactgacagagcagtaaacagaggagatactgcatggtcagtcagaacctggcggcagcgcaaaagatg

SEQ ID NO: 118588 - DNA, 103 bp, Artificial Sequence
  Synthetic Polynucleotide
taatacgactcactatagggtcaagttgctgcctgggaagtcctgactgaaacagaggagatcagtcatgacttcccagaacctggcggcagcgcaaaagatg

SEQ ID NO: 118589 - DNA, 103 bp, Artificial Sequence
  Synthetic Polynucleotide
taatacgactcactataggggtgagcaaattcaagttgctgcctgggaagaacagaggagacttcccatgcagcaacttaacctggcggcagcgcaaaagatg

SEQ ID NO: 118590 - DNA, 103 bp, Artificial Sequence
  Synthetic Polynucleotide
taatacgactcactatagggagaattgttggtgagcaaattcaagttgctaacagaggagaagcaacatgaatttgctcaacctggcggcagcgcaaaagatg

SEQ ID NO: 118591 - DNA, 103 bp, Artificial Sequence
  Synthetic Polynucleotide
taatacgactcactatagggcatcaaaggtgtcaaaggctggctggcgctaacagaggagaagcgccatgcagcctttgaacctggcggcagcgcaaaagatg

SEQ ID NO: 118592 - DNA, 103 bp, Artificial Sequence
  Synthetic Polynucleotide
taatacgactcactatagggtgggagtcccagaattgttggtgagcaaataacagaggagaatttgcatgccaacaattaacctggcggcagcgcaaaagatg

SEQ ID NO: 118593 - DNA, 103 bp, Artificial Sequence
  Synthetic Polynucleotide
taatacgactcactatagggtcgtggtctttgggagtcccagaattgttgaacagaggagacaacaaatgtgggactccaacctggcggcagcgcaaaagatg

SEQ ID NO: 118594 - DNA, 103 bp, Artificial Sequence
  Synthetic Polynucleotide
taatacgactcactatagggctcaggggagtcgtggtctttgggagtcccaacagaggagagggactatgaaagaccacaacctggcggcagcgcaaaagatg

SEQ ID NO: 118595 - DNA, 103 bp, Artificial Sequence
  Synthetic Polynucleotide
taatacgactcactatagggccgcaccgttctcaggggagtcgtggtcttaacagaggagaaagaccatgactcccctgaacctggcggcagcgcaaaagatg

SEQ ID NO: 118596 - DNA, 103 bp, Artificial Sequence
  Synthetic Polynucleotide
taatacgactcactatagggtcgaagctgtccgcaccgttctcaggggagaacagaggagactccccatggaacggtgcaacctggcggcagcgcaaaagatg

SEQ ID NO: 118597 - DNA, 103 bp, Artificial Sequence
  Synthetic Polynucleotide
taatacgactcactataggggtctgagctctcgaagctgtccgcaccgttaacagaggagaaacggtatggacagcttcaacctggcggcagcgcaaaagatg

SEQ ID NO: 118598 - DNA, 103 bp, Artificial Sequence
  Synthetic Polynucleotide
taatacgactcactatagggggaggagggagtctgagctctcgaagctgtaacagaggagaacagctatgagagctcagaacctggcggcagcgcaaaagatg

SEQ ID NO: 118599 - DNA, 103 bp, Artificial Sequence
  Synthetic Polynucleotide
taatacgactcactatagggttccaggactggaggagggagtctgagctcaacagaggagagagctcatgctccctcctaacctggcggcagcgcaaaagatg

SEQ ID NO: 118600 - DNA, 103 bp, Artificial Sequence
  Synthetic Polynucleotide
taatacgactcactatagggcgactggctgttccaggactggaggagggaaacagaggagatccctcatgcagtcctggaacctggcggcagcgcaaaagatg

SEQ ID NO: 118601 - DNA, 103 bp, Artificial Sequence
  Synthetic Polynucleotide
taatacgactcactatagggccagcaaggacgactggctgttccaggactaacagaggagaagtcctatgacagccagtaacctggcggcagcgcaaaagatg

SEQ ID NO: 118602 - DNA, 103 bp, Artificial Sequence
  Synthetic Polynucleotide
taatacgactcactatagggaacagggacccatcaaaggtgtcaaaggctaacagaggagaagccttatgcacctttgaaacctggcggcagcgcaaaagatg

SEQ ID NO: 118603 - DNA, 103 bp, Artificial Sequence
  Synthetic Polynucleotide
taatacgactcactatagggcgttgcacatccagcaaggacgactggctgaacagaggagacagccaatggtccttgctaacctggcggcagcgcaaaagatg

SEQ ID NO: 118604 - DNA, 103 bp, Artificial Sequence
  Synthetic Polynucleotide
taatacgactcactatagggggaaggaacccgttgcacatccagcaaggaaacagaggagatccttgatggatgtgcaaaacctggcggcagcgcaaaagatg

SEQ ID NO: 118605 - DNA, 103 bp, Artificial Sequence
  Synthetic Polynucleotide
taatacgactcactatagggagctctcgaaggaaggaacccgttgcacataacagaggagaatgtgcatggggttccttaacctggcggcagcgcaaaagatg

SEQ ID NO: 118606 - DNA, 103 bp, Artificial Sequence
  Synthetic Polynucleotide
taatacgactcactatagggtcatcttcgaagctctcgaaggaaggaaccaacagaggagaggttccatgcttcgagagaacctggcggcagcgcaaaagatg

SEQ ID NO: 118607 - DNA, 103 bp, Artificial Sequence
  Synthetic Polynucleotide
taatacgactcactatagggctggctgcagtcatcttcgaagctctcgaaaacagaggagattcgagatgttcgaagataacctggcggcagcgcaaaagatg

SEQ ID NO: 118608 - DNA, 103 bp, Artificial Sequence
  Synthetic Polynucleotide
taatacgactcactatagggggcagagagactggctgcagtcatcttcgaaacagaggagatcgaagatgactgcagccaacctggcggcagcgcaaaagatg

SEQ ID NO: 118609 - DNA, 103 bp, Artificial Sequence
  Synthetic Polynucleotide
taatacgactcactatagggggcttattgaggcagagagactggctgcagaacagaggagactgcagatggtctctctgaacctggcggcagcgcaaaagatg

SEQ ID NO: 118610 - DNA, 103 bp, Artificial Sequence
  Synthetic Polynucleotide
taatacgactcactatagggagacatggttggcttattgaggcagagagaaacagaggagatctctcatgctcaataagaacctggcggcagcgcaaaagatg

SEQ ID NO: 118611 - DNA, 103 bp, Artificial Sequence
  Synthetic Polynucleotide
taatacgactcactatagggaatccttgaaagacatggttggcttattgaaacagaggagatcaataatgcaaccatgtaacctggcggcagcgcaaaagatg

SEQ ID NO: 118612 - DNA, 103 bp, Artificial Sequence
  Synthetic Polynucleotide
taatacgactcactatagggtcttggatgtaatccttgaaagacatggttaacagaggagaaaccatatgtttcaaggaaacctggcggcagcgcaaaagatg

SEQ ID NO: 118613 - DNA, 103 bp, Artificial Sequence
  Synthetic Polynucleotide
taatacgactcactatagggaggcacttgctggtcataaaatccatccataacagaggagaatggatatgttttatgacaacctggcggcagcgcaaaagatg

SEQ ID NO: 118614 - DNA, 103 bp, Artificial Sequence
  Synthetic Polynucleotide
taatacgactcactatagggagccagatctctgttaatgaattttcttttaacagaggagaaaaagaatgttcattaacaacctggcggcagcgcaaaagatg

SEQ ID NO: 118615 - DNA, 103 bp, Artificial Sequence
  Synthetic Polynucleotide
taatacgactcactatagggaccagtccaggcaataaaatgagaatttgaaacagaggagatcaaatatgcattttattaacctggcggcagcgcaaaagatg

SEQ ID NO: 118616 - DNA, 103 bp, Artificial Sequence
  Synthetic Polynucleotide
taatacgactcactatagggccatgcctcgaccagtccaggcaataaaataacagaggagaattttaatgcctggactgaacctggcggcagcgcaaaagatg

SEQ ID NO: 118617 - DNA, 103 bp, Artificial Sequence
  Synthetic Polynucleotide
taatacgactcactatagggagtttaaattccatgcctcgaccagtccagaacagaggagactggacatgtcgaggcataacctggcggcagcgcaaaagatg

SEQ ID NO: 118618 - DNA, 103 bp, Artificial Sequence
  Synthetic Polynucleotide
taatacgactcactatagggaggctcaatcagtttaaattccatgcctcgaacagaggagacgaggcatggaatttaaaaacctggcggcagcgcaaaagatg

SEQ ID NO: 118619 - DNA, 103 bp, Artificial Sequence
  Synthetic Polynucleotide
taatacgactcactatagggccacctcttcaggctcaatcagtttaaattaacagaggagaaatttaatgtgattgagcaacctggcggcagcgcaaaagatg

SEQ ID NO: 118620 - DNA, 103 bp, Artificial Sequence
  Synthetic Polynucleotide
taatacgactcactatagggcaacgtcgggccacctcttcaggctcaatcaacagaggagagattgaatgtgaagaggtaacctggcggcagcgcaaaagatg

SEQ ID NO: 118621 - DNA, 103 bp, Artificial Sequence
  Synthetic Polynucleotide
taatacgactcactatagggctgaatgccccaacgtcgggccacctcttcaacagaggagagaagagatggcccgacgtaacctggcggcagcgcaaaagatg

SEQ ID NO: 118622 - DNA, 103 bp, Artificial Sequence
  Synthetic Polynucleotide
taatacgactcactataggggcctgtttttctgaatgccccaacgtcgggaacagaggagacccgacatgggggcattcaacctggcggcagcgcaaaagatg

SEQ ID NO: 118623 - DNA, 103 bp, Artificial Sequence
  Synthetic Polynucleotide
taatacgactcactatagggttcatagctggcctgtttttctgaatgcccaacagaggagagggcatatggaaaaacagaacctggcggcagcgcaaaagatg

SEQ ID NO: 118624 - DNA, 103 bp, Artificial Sequence
  Synthetic Polynucleotide
taatacgactcactatagggtttatcatagttcatagctggcctgtttttaacagaggagaaaaaacatgccagctatgaacctggcggcagcgcaaaagatg

SEQ ID NO: 118625 - DNA, 103 bp, Artificial Sequence
  Synthetic Polynucleotide
taatacgactcactatagggctgaatcatgagccagatctctgttaatgaaacagaggagatcattaatggagatctggaacctggcggcagcgcaaaagatg

SEQ ID NO: 118626 - DNA, 103 bp, Artificial Sequence
  Synthetic Polynucleotide
taatacgactcactatagggaacggctaagtttatcatagttcatagctgaacagaggagacagctaatgactatgataaacctggcggcagcgcaaaagatg

SEQ ID NO: 118627 - DNA, 103 bp, Artificial Sequence
  Synthetic Polynucleotide
taatacgactcactatagggtagcggagtgaacggctaagtttatcatagaacagaggagactatgaatgacttagccgaacctggcggcagcgcaaaagatg

SEQ ID NO: 118628 - DNA, 103 bp, Artificial Sequence
  Synthetic Polynucleotide
taatacgactcactatagggctcatagtaatagcggagtgaacggctaagaacagaggagacttagcatgtcactccgcaacctggcggcagcgcaaaagatg

SEQ ID NO: 118629 - DNA, 103 bp, Artificial Sequence
  Synthetic Polynucleotide
taatacgactcactatagggtaattcctttctcatagtaatagcggagtgaacagaggagacactccatgattactatgaacctggcggcagcgcaaaagatg

SEQ ID NO: 118630 - DNA, 103 bp, Artificial Sequence
  Synthetic Polynucleotide
taatacgactcactatagggaccttttgcataattcctttctcatagtaaaacagaggagattactaatggaaaggaataacctggcggcagcgcaaaagatg

SEQ ID NO: 118631 - DNA, 103 bp, Artificial Sequence
  Synthetic Polynucleotide
taatacgactcactatagggctctccagccaccttttgcataattcctttaacagaggagaaaaggaatgatgcaaaagaacctggcggcagcgcaaaagatg

SEQ ID NO: 118632 - DNA, 103 bp, Artificial Sequence
  Synthetic Polynucleotide
taatacgactcactatagggagacatatctctctccagccaccttttgcaaacagaggagatgcaaaatgtggctggagaacctggcggcagcgcaaaagatg

SEQ ID NO: 118633 - DNA, 103 bp, Artificial Sequence
  Synthetic Polynucleotide
taatacgactcactatagggacaaacttgtagacatatctctctccagccaacagaggagaggctggatggagatatgtaacctggcggcagcgcaaaagatg

SEQ ID NO: 118634 - DNA, 103 bp, Artificial Sequence
  Synthetic Polynucleotide
taatacgactcactatagggtggatcacacacaaacttgtagacatatctaacagaggagaagatatatgtacaagtttaacctggcggcagcgcaaaagatg

SEQ ID NO: 118635 - DNA, 103 bp, Artificial Sequence
  Synthetic Polynucleotide
taatacgactcactatagggaaagggcttctggatcacacacaaacttgtaacagaggagaacaagtatgtgtgtgatcaacctggcggcagcgcaaaagatg

SEQ ID NO: 118636 - DNA, 103 bp, Artificial Sequence
  Synthetic Polynucleotide
taatacgactcactatagggaagagttcttctgaatcatgagccagatctaacagaggagaagatctatgtcatgattcaacctggcggcagcgcaaaagatg

SEQ ID NO: 118637 - DNA, 103 bp, Artificial Sequence
  Synthetic Polynucleotide
taatacgactcactataggggccatggagaaaagggcttctggatcacacaacagaggagagtgtgaatgagaagccctaacctggcggcagcgcaaaagatg

SEQ ID NO: 118638 - DNA, 103 bp, Artificial Sequence
  Synthetic Polynucleotide
taatacgactcactatagggatctggaaaggccatggagaaaagggcttcaacagaggagagaagccatgttctccatgaacctggcggcagcgcaaaagatg

SEQ ID NO: 118639 - DNA, 103 bp, Artificial Sequence
  Synthetic Polynucleotide
taatacgactcactataggggacgctgattatctggaaaggccatggagaaacagaggagatctccaatgcctttccagaacctggcggcagcgcaaaagatg

SEQ ID NO: 118640 - DNA, 103 bp, Artificial Sequence
  Synthetic Polynucleotide
taatacgactcactatagggttcagcagtggacgctgattatctggaaagaacagaggagactttccatgtaatcagcgaacctggcggcagcgcaaaagatg

SEQ ID NO: 118641 - DNA, 103 bp, Artificial Sequence
  Synthetic Polynucleotide
taatacgactcactatagggcatgtctgtcttcagcagtggacgctgattaacagaggagaaatcagatgccactgctgaacctggcggcagcgcaaaagatg

SEQ ID NO: 118642 - DNA, 103 bp, Artificial Sequence
  Synthetic Polynucleotide
taatacgactcactatagggtgtgacgttccatgtctgtcttcagcagtgaacagaggagacactgcatgagacagacaaacctggcggcagcgcaaaagatg

SEQ ID NO: 118643 - DNA, 103 bp, Artificial Sequence
  Synthetic Polynucleotide
taatacgactcactatagggtcctcgttgatgtgacgttccatgtctgtcaacagaggagagacagaatgggaacgtcaaacctggcggcagcgcaaaagatg

SEQ ID NO: 118644 - DNA, 103 bp, Artificial Sequence
  Synthetic Polynucleotide
taatacgactcactatagggcactgtgtcctcctcgttgatgtgacgttcaacagaggagagaacgtatgatcaacgagaacctggcggcagcgcaaaagatg

SEQ ID NO: 118645 - DNA, 103 bp, Artificial Sequence
  Synthetic Polynucleotide
taatacgactcactataggggagaaagaggcactgtgtcctcctcgttgaaacagaggagatcaacgatgaggacacagaacctggcggcagcgcaaaagatg

SEQ ID NO: 118646 - DNA, 103 bp, Artificial Sequence
  Synthetic Polynucleotide
taatacgactcactatagggtcatcaaagtgagaaagaggcactgtgtccaacagaggagaggacacatggcctctttcaacctggcggcagcgcaaaagatg

SEQ ID NO: 118647 - DNA, 103 bp, Artificial Sequence
  Synthetic Polynucleotide
taatacgactcactatagggtagatcttgaaagagttcttctgaatcatgaacagaggagacatgatatggaagaactcaacctggcggcagcgcaaaagatg

SEQ ID NO: 118648 - DNA, 103 bp, Artificial Sequence
  Synthetic Polynucleotide
taatacgactcactatagggggccatgctctcatcaaagtgagaaagaggaacagaggagacctcttatgcactttgataacctggcggcagcgcaaaagatg

SEQ ID NO: 118649 - DNA, 103 bp, Artificial Sequence
  Synthetic Polynucleotide
taatacgactcactatagggccggcatgtaggccatgctctcatcaaagtaacagaggagaactttgatgagagcatggaacctggcggcagcgcaaaagatg

SEQ ID NO: 118650 - DNA, 103 bp, Artificial Sequence
  Synthetic Polynucleotide
taatacgactcactatagggcagcccccttccggcatgtaggccatgctcaacagaggagagagcatatgctacatgccaacctggcggcagcgcaaaagatg

SEQ ID NO: 118651 - DNA, 103 bp, Artificial Sequence
  Synthetic Polynucleotide
taatacgactcactatagggggggttgcagcagcccccttccggcatgtaaacagaggagatacatgatggaagggggcaacctggcggcagcgcaaaagatg

SEQ ID NO: 118652 - DNA, 103 bp, Artificial Sequence
  Synthetic Polynucleotide
taatacgactcactatagggtgtaggggtgggggttgcagcagcccccttaacagaggagaaaggggatggctgcaaccaacctggcggcagcgcaaaagatg

SEQ ID NO: 118653 - DNA, 103 bp, Artificial Sequence
  Synthetic Polynucleotide
taatacgactcactatagggtagccttcgttgtaggggtgggggttgcagaacagaggagactgcaaatgccacccctaaacctggcggcagcgcaaaagatg

SEQ ID NO: 118654 - DNA, 103 bp, Artificial Sequence
  Synthetic Polynucleotide
taatacgactcactatagggttaatacacgtagccttcgttgtaggggtgaacagaggagacaccccatgaacgaaggcaacctggcggcagcgcaaaagatg

SEQ ID NO: 118655 - DNA, 103 bp, Artificial Sequence
  Synthetic Polynucleotide
taatacgactcactataggggtaattgacttagatcttgaaagagttcttaacagaggagaaagaacatgttcaagatcaacctggcggcagcgcaaaagatg

SEQ ID NO: 118656 - DNA, 103 bp, Artificial Sequence
  Synthetic Polynucleotide
taatacgactcactatagggcatgtttcctgtaattgacttagatcttgaaacagaggagatcaagaatgaagtcaattaacctggcggcagcgcaaaagatg

SEQ ID NO: 118657 - DNA, 103 bp, Artificial Sequence
  Synthetic Polynucleotide
taatacgactcactatagggttctgcaagccatgtttcctgtaattgactaacagaggagaagtcaaatgcaggaaacaaacctggcggcagcgcaaaagatg

SEQ ID NO: 118658 - DNA, 103 bp, Artificial Sequence
  Synthetic Polynucleotide
taatacgactcactataggggaaaagccacttctgcaagccatgtttcctaacagaggagaaggaaaatgggcttgcagaacctggcggcagcgcaaaagatg

SEQ ID NO: 118659 - DNA, 103 bp, Artificial Sequence
  Synthetic Polynucleotide
taatacgactcactatagggggcaggccatgaaaagccacttctgcaagcaacagaggagagcttgcatgagtggctttaacctggcggcagcgcaaaagatg

SEQ ID NO: 118660 - DNA, 103 bp, Artificial Sequence
  Synthetic Polynucleotide
taatacgactcactataggggattttcagtggcaggccatgaaaagccacaacagaggagagtggctatgcatggcctgaacctggcggcagcgcaaaagatg

SEQ ID NO: 118661 - DNA, 103 bp, Artificial Sequence
  Synthetic Polynucleotide
taatacgactcactatagggtgaccatgtaaggcacttgctggtcataaaaacagaggagatttatgatgagcaagtgcaacctggcggcagcgcaaaagatg

SEQ ID NO: 118662 - DNA, 103 bp, Artificial Sequence
  Synthetic Polynucleotide
taatacgactcactataggggttctttcttgattttcagtggcaggccataacagaggagaatggccatgcactgaaaaaacctggcggcagcgcaaaagatg

SEQ ID NO: 118663 - DNA, 103 bp, Artificial Sequence
  Synthetic Polynucleotide
taatacgactcactatagggggactgtggggttctttcttgattttcagtaacagaggagaactgaaatgcaagaaagaaacctggcggcagcgcaaaagatg

SEQ ID NO: 118664 - DNA, 103 bp, Artificial Sequence
  Synthetic Polynucleotide
taatacgactcactatagggttctgaacatggactgtggggttctttcttaacagaggagaaagaaaatgccccacagtaacctggcggcagcgcaaaagatg

SEQ ID NO: 118665 - DNA, 103 bp, Artificial Sequence
  Synthetic Polynucleotide
taatacgactcactatagggcagagctgatttctgaacatggactgtgggaacagaggagacccacaatgcatgttcagaacctggcggcagcgcaaaagatg

SEQ ID NO: 118666 - DNA, 103 bp, Artificial Sequence
  Synthetic Polynucleotide
taatacgactcactatagggtgactgcaggcagagctgatttctgaacataacagaggagaatgttcatgaatcagctcaacctggcggcagcgcaaaagatg

SEQ ID NO: 118667 - DNA, 103 bp, Artificial Sequence
  Synthetic Polynucleotide
taatacgactcactataggggggctgttcttgactgcaggcagagctgataacagaggagaatcagcatggcctgcagtaacctggcggcagcgcaaaagatg

SEQ ID NO: 118668 - DNA, 103 bp, Artificial Sequence
  Synthetic Polynucleotide
taatacgactcactatagggtgaatttaaagggctgttcttgactgcaggaacagaggagacctgcaatgaagaacagcaacctggcggcagcgcaaaagatg

SEQ ID NO: 118669 - DNA, 103 bp, Artificial Sequence
  Synthetic Polynucleotide
taatacgactcactatagggtctccatagctgaatttaaagggctgttctaacagaggagaagaacaatgctttaaattaacctggcggcagcgcaaaagatg

SEQ ID NO: 118670 - DNA, 103 bp, Artificial Sequence
  Synthetic Polynucleotide
taatacgactcactatagggcaggcacttttctccatagctgaatttaaaaacagaggagatttaaaatgagctatggaaacctggcggcagcgcaaaagatg

SEQ ID NO: 118671 - DNA, 103 bp, Artificial Sequence
  Synthetic Polynucleotide
taatacgactcactatagggtgacattgtacaggcacttttctccatagcaacagaggagagctatgatgaaaagtgccaacctggcggcagcgcaaaagatg

SEQ ID NO: 118672 - DNA, 103 bp, Artificial Sequence
  Synthetic Polynucleotide
taatacgactcactatagggtgactattggtgaccatgtaaggcacttgcaacagaggagagcaagtatgttacatggtaacctggcggcagcgcaaaagatg

SEQ ID NO: 118673 - DNA, 103 bp, Artificial Sequence
  Synthetic Polynucleotide
taatacgactcactatagggtcataggcactgacattgtacaggcactttaacagaggagaaaagtgatggtacaatgtaacctggcggcagcgcaaaagatg

SEQ ID NO: 118674 - DNA, 103 bp, Artificial Sequence
  Synthetic Polynucleotide
taatacgactcactatagggtggcttctgatcataggcactgacattgtaaacagaggagatacaatatgagtgcctataacctggcggcagcgcaaaagatg

SEQ ID NO: 118675 - DNA, 103 bp, Artificial Sequence
  Synthetic Polynucleotide
taatacgactcactatagggttcccacttgtggcttctgatcataggcacaacagaggagagtgcctatgatcagaagcaacctggcggcagcgcaaaagatg

SEQ ID NO: 118676 - DNA, 103 bp, Artificial Sequence
  Synthetic Polynucleotide
taatacgactcactataggggagggcctcattcccacttgtggcttctgaaacagaggagatcagaaatgacaagtgggaacctggcggcagcgcaaaagatg

SEQ ID NO: 118677 - DNA, 103 bp, Artificial Sequence
  Synthetic Polynucleotide
taatacgactcactataggggggggggttggagggcctcattcccacttgaacagaggagacaagtgatgatgaggcccaacctggcggcagcgcaaaagatg

SEQ ID NO: 118678 - DNA, 103 bp, Artificial Sequence
  Synthetic Polynucleotide
taatacgactcactatagggtggatggtgtgggggggttggagggcctcaaacagaggagatgaggcatgccaacccccaacctggcggcagcgcaaaagatg

SEQ ID NO: 118679 - DNA, 103 bp, Artificial Sequence
  Synthetic Polynucleotide
taatacgactcactatagggactggcgtgctggatggtgtgggggggttgaacagaggagacaacccatgcacaccatcaacctggcggcagcgcaaaagatg

SEQ ID NO: 118680 - DNA, 103 bp, Artificial Sequence
  Synthetic Polynucleotide
taatacgactcactatagggcagtggggacactggcgtgctggatggtgtaacagaggagaacaccaatgagcacgccaaacctggcggcagcgcaaaagatg

SEQ ID NO: 118681 - DNA, 103 bp, Artificial Sequence
  Synthetic Polynucleotide
taatacgactcactatagggatgcatgatgcagtggggacactggcgtgcaacagaggagagcacgcatgtgtccccacaacctggcggcagcgcaaaagatg

SEQ ID NO: 118682 - DNA, 103 bp, Artificial Sequence
  Synthetic Polynucleotide
taatacgactcactataggggagtttggagatgcatgatgcagtggggacaacagaggagagtccccatggcatcatgcaacctggcggcagcgcaaaagatg

SEQ ID NO: 118683 - DNA, 103 bp, Artificial Sequence
  Synthetic Polynucleotide
taatacgactcactatagggtctcccacgctgactattggtgaccatgtaaacagaggagatacatgatgaccaatagtaacctggcggcagcgcaaaagatg

SEQ ID NO: 118684 - DNA, 103 bp, Artificial Sequence
  Synthetic Polynucleotide
taatacgactcactatagggtgtatgagttgagtttggagatgcatgatgaacagaggagacatcatatgtctccaaacaacctggcggcagcgcaaaagatg

SEQ ID NO: 118685 - DNA, 103 bp, Artificial Sequence
  Synthetic Polynucleotide
taatacgactcactatagggcaggtttcggtgtatgagttgagtttggagaacagaggagactccaaatgcaactcataaacctggcggcagcgcaaaagatg

SEQ ID NO: 118686 - DNA, 103 bp, Artificial Sequence
  Synthetic Polynucleotide
taatacgactcactatagggaaggcccggtcaggtttcggtgtatgagttaacagaggagaaactcaatgaccgaaaccaacctggcggcagcgcaaaagatg

SEQ ID NO: 118687 - DNA, 103 bp, Artificial Sequence
  Synthetic Polynucleotide
taatacgactcactataggggtgagctgggaaggcccggtcaggtttcggaacagaggagaccgaaaatggaccgggccaacctggcggcagcgcaaaagatg

SEQ ID NO: 118688 - DNA, 103 bp, Artificial Sequence
  Synthetic Polynucleotide
taatacgactcactatagggatggagggaggtgagctgggaaggcccggtaacagaggagaaccgggatgtcccagctcaacctggcggcagcgcaaaagatg

SEQ ID NO: 118689 - DNA, 103 bp, Artificial Sequence
  Synthetic Polynucleotide
taatacgactcactatagggatggactgcgatggagggaggtgagctgggaacagaggagacccagcatgcctccctccaacctggcggcagcgcaaaagatg

SEQ ID NO: 118690 - DNA, 103 bp, Artificial Sequence
  Synthetic Polynucleotide
taatacgactcactataggggctatctggtatggactgcgatggagggagaacagaggagactccctatgtcgcagtccaacctggcggcagcgcaaaagatg

SEQ ID NO: 118691 - DNA, 103 bp, Artificial Sequence
  Synthetic Polynucleotide
taatacgactcactatagggtggggtagctgctatctggtatggactgcgaacagaggagacgcagtatgtaccagataaacctggcggcagcgcaaaagatg

SEQ ID NO: 118692 - DNA, 103 bp, Artificial Sequence
  Synthetic Polynucleotide
taatacgactcactatagggctgtggtccatggggtagctgctatctggtaacagaggagaaccagaatgcagctacccaacctggcggcagcgcaaaagatg

SEQ ID NO: 118693 - DNA, 103 bp, Artificial Sequence
  Synthetic Polynucleotide
taatacgactcactataggggcggcgaaatctgtggtccatggggtagctaacagaggagaagctacatgatggaccacaacctggcggcagcgcaaaagatg

SEQ ID NO: 118694 - DNA, 103 bp, Artificial Sequence
  Synthetic Polynucleotide
taatacgactcactatagggcgttacaatttctcccacgctgactattggaacagaggagaccaataatgagcgtgggaaacctggcggcagcgcaaaagatg

SEQ ID NO: 118695 - DNA, 103 bp, Artificial Sequence
  Synthetic Polynucleotide
taatacgactcactatagggcagaaagctggcggcgaaatctgtggtccaaacagaggagatggaccatggatttcgccaacctggcggcagcgcaaaagatg

SEQ ID NO: 118696 - DNA, 103 bp, Artificial Sequence
  Synthetic Polynucleotide
taatacgactcactatagggttacagggttcagaaagctggcggcgaaataacagaggagaatttcgatgccagctttcaacctggcggcagcgcaaaagatg

SEQ ID NO: 118697 - DNA, 103 bp, Artificial Sequence
  Synthetic Polynucleotide
taatacgactcactatagggaggaaaggagttacagggttcagaaagctgaacagaggagacagcttatggaaccctgtaacctggcggcagcgcaaaagatg

SEQ ID NO: 118698 - DNA, 103 bp, Artificial Sequence
  Synthetic Polynucleotide
taatacgactcactatagggtcggcaaaggaggaaaggagttacagggttaacagaggagaaaccctatgactcctttcaacctggcggcagcgcaaaagatg

SEQ ID NO: 118699 - DNA, 103 bp, Artificial Sequence
  Synthetic Polynucleotide
taatacgactcactatagggcttggcatcgtcggcaaaggaggaaaggagaacagaggagactccttatgtcctttgccaacctggcggcagcgcaaaagatg

SEQ ID NO: 118700 - DNA, 103 bp, Artificial Sequence
  Synthetic Polynucleotide
taatacgactcactatagggacgtccttcccttggcatcgtcggcaaaggaacagaggagacctttgatgacgatgccaaacctggcggcagcgcaaaagatg

SEQ ID NO: 118701 - DNA, 103 bp, Artificial Sequence
  Synthetic Polynucleotide
taatacgactcactatagggggtacataggacgtccttcccttggcatcgaacagaggagacgatgcatggggaaggacaacctggcggcagcgcaaaagatg

SEQ ID NO: 118702 - DNA, 103 bp, Artificial Sequence
  Synthetic Polynucleotide
taatacgactcactatagggatctggcgttggtacataggacgtccttccaacagaggagaggaaggatgtcctatgtaaacctggcggcagcgcaaaagatg

SEQ ID NO: 118703 - DNA, 103 bp, Artificial Sequence
  Synthetic Polynucleotide
taatacgactcactatagggtggctcagacatctggcgttggtacataggaacagaggagacctatgatgcaacgccagaacctggcggcagcgcaaaagatg

SEQ ID NO: 118704 - DNA, 103 bp, Artificial Sequence
  Synthetic Polynucleotide
taatacgactcactatagggaggggatgtttggctcagacatctggcgttaacagaggagaaacgccatgtgtctgagcaacctggcggcagcgcaaaagatg

SEQ ID NO: 118705 - DNA, 103 bp, Artificial Sequence
  Synthetic Polynucleotide
taatacgactcactataggggttggtttctcgttacaatttctcccacgcaacagaggagagcgtggatgaaattgtaaaacctggcggcagcgcaaaagatg

SEQ ID NO: 118706 - DNA, 103 bp, Artificial Sequence
  Synthetic Polynucleotide
taatacgactcactatagggtgtggtgggaaggggatgtttggctcagacaacagaggagagtctgaatgaaacatcccaacctggcggcagcgcaaaagatg

SEQ ID NO: 118707 - DNA, 103 bp, Artificial Sequence
  Synthetic Polynucleotide
taatacgactcactatagggcttaaagccttgtggtgggaaggggatgttaacagaggagaaacatcatgttcccaccaaacctggcggcagcgcaaaagatg

SEQ ID NO: 118708 - DNA, 103 bp, Artificial Sequence
  Synthetic Polynucleotide
taatacgactcactatagggggtactcctgcttaaagccttgtggtgggaaacagaggagatcccacatgaaggctttaaacctggcggcagcgcaaaagatg

SEQ ID NO: 118709 - DNA, 103 bp, Artificial Sequence
  Synthetic Polynucleotide
taatacgactcactatagggactgggtcgtggtactcctgcttaaagcctaacagaggagaaggcttatggcaggagtaaacctggcggcagcgcaaaagatg

SEQ ID NO: 118710 - DNA, 103 bp, Artificial Sequence
  Synthetic Polynucleotide
taatacgactcactataggggtgttcatacactgggtcgtggtactcctgaacagaggagacaggagatgcacgacccaaacctggcggcagcgcaaaagatg

SEQ ID NO: 118711 - DNA, 103 bp, Artificial Sequence
  Synthetic Polynucleotide
taatacgactcactatagggccatggtgttgtgttcatacactgggtcgtaacagaggagaacgaccatgtgtatgaacaacctggcggcagcgcaaaagatg

SEQ ID NO: 118712 - DNA, 103 bp, Artificial Sequence
  Synthetic Polynucleotide
taatacgactcactataggggcactgccaaccatggtgttgtgttcatacaacagaggagagtatgaatgcaacaccataacctggcggcagcgcaaaagatg

SEQ ID NO: 118713 - DNA, 103 bp, Artificial Sequence
  Synthetic Polynucleotide
taatacgactcactatagggttggctggccgcactgccaaccatggtgttaacagaggagaaacaccatggttggcagtaacctggcggcagcgcaaaagatg

SEQ ID NO: 118714 - DNA, 103 bp, Artificial Sequence
  Synthetic Polynucleotide
taatacgactcactatagggggggaaagctttggctggccgcactgccaaaacagaggagattggcaatgcggccagccaacctggcggcagcgcaaaagatg

SEQ ID NO: 118715 - DNA, 103 bp, Artificial Sequence
  Synthetic Polynucleotide
taatacgactcactatagggatcagaggagggggaaagctttggctggccaacagaggagaggccagatgaagctttccaacctggcggcagcgcaaaagatg

SEQ ID NO: 118716 - DNA, 103 bp, Artificial Sequence
  Synthetic Polynucleotide
taatacgactcactatagggcctgacatttgttggtttctcgttacaattaacagaggagaaattgtatggagaaaccaaacctggcggcagcgcaaaagatg

SEQ ID NO: 118717 - DNA, 103 bp, Artificial Sequence
  Synthetic Polynucleotide
taatacgactcactatagggctgtttaatcatcagaggagggggaaagctaacagaggagaagctttatgcctcctctgaacctggcggcagcgcaaaagatg

SEQ ID NO: 118718 - DNA, 103 bp, Artificial Sequence
  Synthetic Polynucleotide
taatacgactcactatagggctctgggttcctgtttaatcatcagaggagaacagaggagactcctcatgtgattaaacaacctggcggcagcgcaaaagatg

SEQ ID NO: 118719 - DNA, 103 bp, Artificial Sequence
  Synthetic Polynucleotide
taatacgactcactatagggtatgcaaaatctctgggttcctgtttaatcaacagaggagagattaaatgggaacccagaacctggcggcagcgcaaaagatg

SEQ ID NO: 118720 - DNA, 103 bp, Artificial Sequence
  Synthetic Polynucleotide
taatacgactcactatagggttctgagtcatatgcaaaatctctgggttcaacagaggagagaacccatggattttgcaaacctggcggcagcgcaaaagatg

SEQ ID NO: 118721 - DNA, 103 bp, Artificial Sequence
  Synthetic Polynucleotide
taatacgactcactatagggagctaggcacttctgagtcatatgcaaaataacagaggagaattttgatgatgactcagaacctggcggcagcgcaaaagatg

SEQ ID NO: 118722 - DNA, 103 bp, Artificial Sequence
  Synthetic Polynucleotide
taatacgactcactatagggatggagtggcagctaggcacttctgagtcaaacagaggagatgactcatgagtgcctagaacctggcggcagcgcaaaagatg

SEQ ID NO: 118723 - DNA, 103 bp, Artificial Sequence
  Synthetic Polynucleotide
taatacgactcactatagggcctcatataaatggagtggcagctaggcacaacagaggagagtgcctatgtgccactccaacctggcggcagcgcaaaagatg

SEQ ID NO: 118724 - DNA, 103 bp, Artificial Sequence
  Synthetic Polynucleotide
taatacgactcactatagggagccttcttgcctcatataaatggagtggcaacagaggagagccactatgtttatatgaaacctggcggcagcgcaaaagatg

SEQ ID NO: 118725 - DNA, 103 bp, Artificial Sequence
  Synthetic Polynucleotide
taatacgactcactatagggtgagccaggaagccttcttgcctcatataaaacagaggagattatatatggcaagaaggaacctggcggcagcgcaaaagatg

SEQ ID NO: 118726 - DNA, 103 bp, Artificial Sequence
  Synthetic Polynucleotide
taatacgactcactatagggtctgctgggatgagccaggaagccttcttgaacagaggagacaagaaatgttcctggctaacctggcggcagcgcaaaagatg

SEQ ID NO: 118727 - DNA, 103 bp, Artificial Sequence
  Synthetic Polynucleotide
taatacgactcactatagggattttcttttcctgacatttgttggtttctaacagaggagaagaaacatgcaaatgtcaaacctggcggcagcgcaaaagatg

SEQ ID NO: 118728 - DNA, 103 bp, Artificial Sequence
  Synthetic Polynucleotide
taatacgactcactatagggagccttctgttctgctgggatgagccaggaaacagaggagatcctggatgatcccagcaaacctggcggcagcgcaaaagatg

SEQ ID NO: 118729 - DNA, 103 bp, Artificial Sequence
  Synthetic Polynucleotide
taatacgactcactatagggtcaaacatacagccttctgttctgctgggaaacagaggagatcccagatgaacagaaggaacctggcggcagcgcaaaagatg

SEQ ID NO: 118730 - DNA, 103 bp, Artificial Sequence
  Synthetic Polynucleotide
taatacgactcactatagggggggcccttttcaaacatacagccttctgtaacagaggagaacagaaatgtgtatgtttaacctggcggcagcgcaaaagatg

SEQ ID NO: 118731 - DNA, 103 bp, Artificial Sequence
  Synthetic Polynucleotide
taatacgactcactatagggaaaactgcctggggcccttttcaaacatacaacagaggagagtatgtatgaaaagggccaacctggcggcagcgcaaaagatg

SEQ ID NO: 118732 - DNA, 103 bp, Artificial Sequence
  Synthetic Polynucleotide
taatacgactcactataggggtgtcatcataaaactgcctggggccctttaacagaggagaaaagggatgcaggcagttaacctggcggcagcgcaaaagatg

SEQ ID NO: 118733 - DNA, 103 bp, Artificial Sequence
  Synthetic Polynucleotide
taatacgactcactataggggacaacacaggtgtcatcataaaactgcctaacagaggagaaggcagatgtatgatgacaacctggcggcagcgcaaaagatg

SEQ ID NO: 118734 - DNA, 103 bp, Artificial Sequence
  Synthetic Polynucleotide
taatacgactcactatagggatttttctgggacaacacaggtgtcatcataacagaggagaatgatgatgcctgtgttgaacctggcggcagcgcaaaagatg

SEQ ID NO: 118735 - DNA, 103 bp, Artificial Sequence
  Synthetic Polynucleotide
taatacgactcactatagggtctccatcgaatttttctgggacaacacagaacagaggagactgtgtatgcccagaaaaaacctggcggcagcgcaaaagatg

SEQ ID NO: 118736 - DNA, 103 bp, Artificial Sequence
  Synthetic Polynucleotide
taatacgactcactatagggttgtttgatgtctccatcgaatttttctggaacagaggagaccagaaatgttcgatggaaacctggcggcagcgcaaaagatg

SEQ ID NO: 118737 - DNA, 103 bp, Artificial Sequence
  Synthetic Polynucleotide
taatacgactcactatagggttcctggctcttgtttgatgtctccatcgaaacagaggagatcgatgatgacatcaaacaacctggcggcagcgcaaaagatg

SEQ ID NO: 118738 - DNA, 103 bp, Artificial Sequence
  Synthetic Polynucleotide
taatacgactcactatagggctgttaatgaattttcttttcctgacatttaacagaggagaaaatgtatggaaaagaaaaacctggcggcagcgcaaaagatg

SEQ ID NO: 118739 - DNA, 103 bp, Artificial Sequence
  Synthetic Polynucleotide
taatacgactcactatagggtcccgatacattcctggctcttgtttgatgaacagaggagacatcaaatgagagccaggaacctggcggcagcgcaaaagatg

SEQ ID NO: 118740 - DNA, 103 bp, Artificial Sequence
  Synthetic Polynucleotide
taatacgactcactatagggtgtgggtccttcccgatacattcctggctcaacagaggagagagccaatgatgtatcggaacctggcggcagcgcaaaagatg

SEQ ID NO: 118741 - DNA, 103 bp, Artificial Sequence
  Synthetic Polynucleotide
taatacgactcactataggggccgttggtatgtgggtccttcccgatacaaacagaggagatgtatcatgaaggacccaaacctggcggcagcgcaaaagatg

SEQ ID NO: 118742 - DNA, 103 bp, Artificial Sequence
  Synthetic Polynucleotide
taatacgactcactatagggagtgatcctcgccgttggtatgtgggtcctaacagaggagaaggaccatgataccaacgaacctggcggcagcgcaaaagatg

SEQ ID NO: 118743 - DNA, 103 bp, Artificial Sequence
  Synthetic Polynucleotide
taatacgactcactatagggccagagctgaagtgatcctcgccgttggtaaacagaggagataccaaatgcgaggatcaaacctggcggcagcgcaaaagatg

SEQ ID NO: 118744 - DNA, 103 bp, Artificial Sequence
  Synthetic Polynucleotide
taatacgactcactatagggccaaaaactgccagagctgaagtgatcctcaacagaggagagaggatatgttcagctctaacctggcggcagcgcaaaagatg

SEQ ID NO: 118745 - DNA, 103 bp, Artificial Sequence
  Synthetic Polynucleotide
taatacgactcactatagggagaagagctaccaaaaactgccagagctgaaacagaggagatcagctatggcagtttttaacctggcggcagcgcaaaagatg

SEQ ID NO: 118746 - DNA, 103 bp, Artificial Sequence
  Synthetic Polynucleotide
taatacgactcactatagggagggtcatccagaagagctaccaaaaactgaacagaggagacagtttatggtagctcttaacctggcggcagcgcaaaagatg

SEQ ID NO: 118747 - DNA, 103 bp, Artificial Sequence
  Synthetic Polynucleotide
taatacgactcactataggggagaatttgaagggtcatccagaagagctaaacagaggagatagctcatgtggatgaccaacctggcggcagcgcaaaagatg

SEQ ID NO: 118748 - DNA, 103 bp, Artificial Sequence
  Synthetic Polynucleotide
taatacgactcactataggggcaataaaatgagaatttgaagggtcatccaacagaggagaggatgaatgttcaaattcaacctggcggcagcgcaaaagatg

SEQ ID NO: 118749 - DNA, 103 bp, Artificial Sequence
  Synthetic Polynucleotide
taatacgactcactatagggggatgcctcatcccagttccacaggtccataacagaggagaatggacatgtggaactggaacctggcggcagcgcaaaagatg

SEQ ID NO: 118750 - DNA, 103 bp, Artificial Sequence
  Synthetic Polynucleotide
taatacgactcactataggggtccccttggagtgccagatcagggaaacaaacagaggagatgtttcatggatctggcaaacctggcggcagcgcaaaagatg

SEQ ID NO: 118751 - DNA, 103 bp, Artificial Sequence
  Synthetic Polynucleotide
taatacgactcactatagggctctgctccccgtccgcctcccgcacagtcaacagaggagagactgtatgggaggcggaaacctggcggcagcgcaaaagatg

SEQ ID NO: 118752 - DNA, 103 bp, Artificial Sequence
  Synthetic Polynucleotide
taatacgactcactatagggctgtcggcgtgtccccttggagtgccagataacagaggagaatctggatgtccaaggggaacctggcggcagcgcaaaagatg

SEQ ID NO: 118753 - DNA, 103 bp, Artificial Sequence
  Synthetic Polynucleotide
taatacgactcactatagggtctgctgtcgctgtcggcgtgtccccttggaacagaggagaccaaggatgcacgccgacaacctggcggcagcgcaaaagatg

SEQ ID NO: 118754 - DNA, 103 bp, Artificial Sequence
  Synthetic Polynucleotide
taatacgactcactatagggccagcatgtctctgctgtcgctgtcggcgtaacagaggagaacgccgatggcgacagcaaacctggcggcagcgcaaaagatg

SEQ ID NO: 118755 - DNA, 103 bp, Artificial Sequence
  Synthetic Polynucleotide
taatacgactcactatagggttgtacctttccagcatgtctctgctgtcgaacagaggagacgacagatgagacatgctaacctggcggcagcgcaaaagatg

SEQ ID NO: 118756 - DNA, 103 bp, Artificial Sequence
  Synthetic Polynucleotide
taatacgactcactatagggagggatgagcttgtacctttccagcatgtcaacagaggagagacatgatggaaaggtacaacctggcggcagcgcaaaagatg

SEQ ID NO: 118757 - DNA, 103 bp, Artificial Sequence
  Synthetic Polynucleotide
taatacgactcactataggggaagcttgccagggatgagcttgtacctttaacagaggagaaaaggtatgagctcatccaacctggcggcagcgcaaaagatg

SEQ ID NO: 118758 - DNA, 103 bp, Artificial Sequence
  Synthetic Polynucleotide
taatacgactcactatagggccagctgtgggaagcttgccagggatgagcaacagaggagagctcatatgtggcaagctaacctggcggcagcgcaaaagatg

SEQ ID NO: 118759 - DNA, 103 bp, Artificial Sequence
  Synthetic Polynucleotide
taatacgactcactataggggagccccagtccagctgtgggaagcttgccaacagaggagaggcaagatgcccacagctaacctggcggcagcgcaaaagatg

SEQ ID NO: 118760 - DNA, 103 bp, Artificial Sequence
  Synthetic Polynucleotide
taatacgactcactatagggcagtaacgcggagccccagtccagctgtggaacagaggagaccacagatggactggggcaacctggcggcagcgcaaaagatg

SEQ ID NO: 118761 - DNA, 103 bp, Artificial Sequence
  Synthetic Polynucleotide
taatacgactcactatagggcttcctgtggggatgcctcatcccagttccaacagaggagaggaactatgatgaggcataacctggcggcagcgcaaaagatg

SEQ ID NO: 118762 - DNA, 103 bp, Artificial Sequence
  Synthetic Polynucleotide
taatacgactcactatagggcttctgggtgcagtaacgcggagccccagtaacagaggagaactgggatgccgcgttacaacctggcggcagcgcaaaagatg

SEQ ID NO: 118763 - DNA, 103 bp, Artificial Sequence
  Synthetic Polynucleotide
taatacgactcactatagggccccatggaacttctgggtgcagtaacgcgaacagaggagacgcgttatggcacccagaaacctggcggcagcgcaaaagatg

SEQ ID NO: 118764 - DNA, 103 bp, Artificial Sequence
  Synthetic Polynucleotide
taatacgactcactataggggggctccgccccccatggaacttctgggtgaacagaggagacacccaatggttccatggaacctggcggcagcgcaaaagatg

SEQ ID NO: 118765 - DNA, 103 bp, Artificial Sequence
  Synthetic Polynucleotide
taatacgactcactatagggcctgagagtcgggctccgccccccatggaaaacagaggagattccatatggggcggagcaacctggcggcagcgcaaaagatg

SEQ ID NO: 118766 - DNA, 103 bp, Artificial Sequence
  Synthetic Polynucleotide
taatacgactcactatagggcacggaagagcctgagagtcgggctccgccaacagaggagaggcggaatgcgactctcaaacctggcggcagcgcaaaagatg

SEQ ID NO: 118767 - DNA, 103 bp, Artificial Sequence
  Synthetic Polynucleotide
taatacgactcactataggggtccccggaccacggaagagcctgagagtcaacagaggagagactctatggctcttccgaacctggcggcagcgcaaaagatg

SEQ ID NO: 118768 - DNA, 103 bp, Artificial Sequence
  Synthetic Polynucleotide
taatacgactcactatagggtgtctgtccagtccccggaccacggaagagaacagaggagactcttcatgggtccggggaacctggcggcagcgcaaaagatg

SEQ ID NO: 118769 - DNA, 103 bp, Artificial Sequence
  Synthetic Polynucleotide
taatacgactcactataggggtgcacgccatgtctgtccagtccccggacaacagaggagagtccggatgctggacagaaacctggcggcagcgcaaaagatg

SEQ ID NO: 118770 - DNA, 103 bp, Artificial Sequence
  Synthetic Polynucleotide
taatacgactcactataggggtcccaggctgtgcacgccatgtctgtccaaacagaggagatggacaatgatggcgtgcaacctggcggcagcgcaaaagatg

SEQ ID NO: 118771 - DNA, 103 bp, Artificial Sequence
  Synthetic Polynucleotide
taatacgactcactatagggcgctccaagagtcccaggctgtgcacgccaaacagaggagatggcgtatgcagcctgggaacctggcggcagcgcaaaagatg

SEQ ID NO: 118772 - DNA, 103 bp, Artificial Sequence
  Synthetic Polynucleotide
taatacgactcactatagggcctggaggcacttcctgtggggatgcctcaaacagaggagatgaggcatgcccacaggaaacctggcggcagcgcaaaagatg

SEQ ID NO: 118773 - DNA, 103 bp, Artificial Sequence
  Synthetic Polynucleotide
taatacgactcactatagggtgcgaggcgccgctccaagagtcccaggctaacagaggagaagcctgatgctcttggagaacctggcggcagcgcaaaagatg

SEQ ID NO: 118774 - DNA, 103 bp, Artificial Sequence
  Synthetic Polynucleotide
taatacgactcactataggggcccagggtctgcgaggcgccgctccaagaaacagaggagatcttggatgggcgcctcgaacctggcggcagcgcaaaagatg

SEQ ID NO: 118775 - DNA, 103 bp, Artificial Sequence
  Synthetic Polynucleotide
taatacgactcactataggggaggggcggggcccagggtctgcgaggcgcaacagaggagagcgcctatgagaccctggaacctggcggcagcgcaaaagatg

SEQ ID NO: 118776 - DNA, 103 bp, Artificial Sequence
  Synthetic Polynucleotide
taatacgactcactatagggcccgggccgagaggggcggggcccagggtcaacagaggagagaccctatgccccgccccaacctggcggcagcgcaaaagatg

SEQ ID NO: 118777 - DNA, 103 bp, Artificial Sequence
  Synthetic Polynucleotide
taatacgactcactatagggggggatggggcccgggccgagaggggcgggaacagaggagacccgccatgctcggcccgaacctggcggcagcgcaaaagatg

SEQ ID NO: 118778 - DNA, 103 bp, Artificial Sequence
  Synthetic Polynucleotide
taatacgactcactatagggagccggcggcggggatggggcccgggccgaaacagaggagatcggccatggccccatccaacctggcggcagcgcaaaagatg

SEQ ID NO: 118779 - DNA, 103 bp, Artificial Sequence
  Synthetic Polynucleotide
taatacgactcactataggggcgccttcggagccggcggcggggatggggaacagaggagaccccatatgcgccgccggaacctggcggcagcgcaaaagatg

SEQ ID NO: 118780 - DNA, 103 bp, Artificial Sequence
  Synthetic Polynucleotide
taatacgactcactatagggctggcccgcggcgccttcggagccggcggcaacagaggagagccgccatgtccgaaggcaacctggcggcagcgcaaaagatg

SEQ ID NO: 118781 - DNA, 103 bp, Artificial Sequence
  Synthetic Polynucleotide
taatacgactcactatagggggacgcagttctggcccgcggcgccttcggaacagaggagaccgaagatgccgcgggccaacctggcggcagcgcaaaagatg

SEQ ID NO: 118782 - DNA, 103 bp, Artificial Sequence
  Synthetic Polynucleotide
taatacgactcactatagggcccgccacggggacgcagttctggcccgcgaacagaggagacgcgggatggaactgcgtaacctggcggcagcgcaaaagatg

SEQ ID NO: 118783 - DNA, 103 bp, Artificial Sequence
  Synthetic Polynucleotide
taatacgactcactatagggcagcttgttccctggaggcacttcctgtggaacagaggagaccacagatggtgcctccaaacctggcggcagcgcaaaagatg

SEQ ID NO: 118784 - DNA, 103 bp, Artificial Sequence
  Synthetic Polynucleotide
taatacgactcactatagggggtggcctctcccgccacggggacgcagttaacagaggagaaactgcatgcccgtggcgaacctggcggcagcgcaaaagatg

SEQ ID NO: 118785 - DNA, 103 bp, Artificial Sequence
  Synthetic Polynucleotide
taatacgactcactataggggcgaccacgaggtggcctctcccgccacggaacagaggagaccgtggatggagaggccaaacctggcggcagcgcaaaagatg

SEQ ID NO: 118786 - DNA, 103 bp, Artificial Sequence
  Synthetic Polynucleotide
taatacgactcactataggggcctgggcgcgcgaccacgaggtggcctctaacagaggagaagaggcatgctcgtggtcaacctggcggcagcgcaaaagatg

SEQ ID NO: 118787 - DNA, 103 bp, Artificial Sequence
  Synthetic Polynucleotide
taatacgactcactataggggctcccggcggcctgggcgcgcgaccacgaaacagaggagatcgtggatgcgcgcccagaacctggcggcagcgcaaaagatg

SEQ ID NO: 118788 - DNA, 103 bp, Artificial Sequence
  Synthetic Polynucleotide
taatacgactcactatagggagctggtgttgctcccggcggcctgggcgcaacagaggagagcgcccatgccgccgggaaacctggcggcagcgcaaaagatg

SEQ ID NO: 118789 - DNA, 103 bp, Artificial Sequence
  Synthetic Polynucleotide
taatacgactcactataggggaacagtcccagctggtgttgctcccggcgaacagaggagacgccggatgcaacaccagaacctggcggcagcgcaaaagatg

SEQ ID NO: 118790 - DNA, 103 bp, Artificial Sequence
  Synthetic Polynucleotide
taatacgactcactataggggggccccacagaacagtcccagctggtgttaacagaggagaaacaccatgtgggactgtaacctggcggcagcgcaaaagatg

SEQ ID NO: 118791 - DNA, 103 bp, Artificial Sequence
  Synthetic Polynucleotide
taatacgactcactatagggtatcgccgtcgggccccacagaacagtcccaacagaggagagggactatgctgtggggcaacctggcggcagcgcaaaagatg

SEQ ID NO: 118792 - DNA, 103 bp, Artificial Sequence
  Synthetic Polynucleotide
taatacgactcactatagggccccagtaggtatcgccgtcgggccccacaaacagaggagatgtgggatgcgacggcgaaacctggcggcagcgcaaaagatg

SEQ ID NO: 118793 - DNA, 103 bp, Artificial Sequence
  Synthetic Polynucleotide
taatacgactcactatagggcaggccactgccccagtaggtatcgccgtcaacagaggagagacggcatgacctactggaacctggcggcagcgcaaaagatg

SEQ ID NO: 118794 - DNA, 103 bp, Artificial Sequence
  Synthetic Polynucleotide
taatacgactcactatagggcaagccctgccagcttgttccctggaggcaaacagaggagatgcctcatgggaacaagcaacctggcggcagcgcaaaagatg

SEQ ID NO: 118795 - DNA, 103 bp, Artificial Sequence
  Synthetic Polynucleotide
taatacgactcactataggggctccccgcccaggccactgccccagtaggaacagaggagacctactatggcagtggccaacctggcggcagcgcaaaagatg

SEQ ID NO: 118796 - DNA, 103 bp, Artificial Sequence
  Synthetic Polynucleotide
taatacgactcactatagggtccgtgcgcggctccccgcccaggccactgaacagaggagacagtggatggggcggggaaacctggcggcagcgcaaaagatg

SEQ ID NO: 118797 - DNA, 103 bp, Artificial Sequence
  Synthetic Polynucleotide
taatacgactcactatagggaatggtacagtccgtgcgcggctccccgccaacagaggagaggcgggatgccgcgcacgaacctggcggcagcgcaaaagatg

SEQ ID NO: 118798 - DNA, 103 bp, Artificial Sequence
  Synthetic Polynucleotide
taatacgactcactatagggcgccccacgaaatggtacagtccgtgcgcgaacagaggagacgcgcaatgactgtaccaaacctggcggcagcgcaaaagatg

SEQ ID NO: 118799 - DNA, 103 bp, Artificial Sequence
  Synthetic Polynucleotide
taatacgactcactatagggcccgcgggcccgccccacgaaatggtacagaacagaggagactgtacatgttcgtggggaacctggcggcagcgcaaaagatg

SEQ ID NO: 118800 - DNA, 103 bp, Artificial Sequence
  Synthetic Polynucleotide
taatacgactcactatagggacagtccgggcccgcgggcccgccccacgaaacagaggagatcgtggatggggcccgcgaacctggcggcagcgcaaaagatg

SEQ ID NO: 118801 - DNA, 103 bp, Artificial Sequence
  Synthetic Polynucleotide
taatacgactcactatagggaggaggtggtacagtccgggcccgcgggccaacagaggagaggcccgatggcccggactaacctggcggcagcgcaaaagatg

SEQ ID NO: 118802 - DNA, 103 bp, Artificial Sequence
  Synthetic Polynucleotide
taatacgactcactatagggcccgggttccaggaggtggtacagtccgggaacagaggagacccggaatgtaccacctcaacctggcggcagcgcaaaagatg

SEQ ID NO: 118803 - DNA, 103 bp, Artificial Sequence
  Synthetic Polynucleotide
taatacgactcactatagggcgcatgcagccccgggttccaggaggtggtaacagaggagaaccaccatgtggaacccgaacctggcggcagcgcaaaagatg

SEQ ID NO: 118804 - DNA, 103 bp, Artificial Sequence
  Synthetic Polynucleotide
taatacgactcactatagggtggtgccacccgcatgcagccccgggttccaacagaggagaggaaccatgggctgcatgaacctggcggcagcgcaaaagatg

SEQ ID NO: 118805 - DNA, 103 bp, Artificial Sequence
  Synthetic Polynucleotide
taatacgactcactatagggttggctccttcaagccctgccagcttgttcaacagaggagagaacaaatgggcagggctaacctggcggcagcgcaaaagatg

SEQ ID NO: 118806 - DNA, 103 bp, Artificial Sequence
  Synthetic Polynucleotide
taatacgactcactatagggttcaaagaggtggtgccacccgcatgcagcaacagaggagagctgcaatggggtggcacaacctggcggcagcgcaaaagatg

SEQ ID NO: 118807 - DNA, 103 bp, Artificial Sequence
  Synthetic Polynucleotide
taatacgactcactatagggctggtaccgcttcaaagaggtggtgccaccaacagaggagaggtggcatgacctctttgaacctggcggcagcgcaaaagatg

SEQ ID NO: 118808 - DNA, 103 bp, Artificial Sequence
  Synthetic Polynucleotide
taatacgactcactataggggagctgagctctggtaccgcttcaaagaggaacagaggagacctcttatgagcggtaccaacctggcggcagcgcaaaagatg

SEQ ID NO: 118809 - DNA, 103 bp, Artificial Sequence
  Synthetic Polynucleotide
taatacgactcactatagggcaaacggtgagagctgagctctggtaccgcaacagaggagagcggtaatggagctcagcaacctggcggcagcgcaaaagatg

SEQ ID NO: 118810 - DNA, 103 bp, Artificial Sequence
  Synthetic Polynucleotide
taatacgactcactatagggcggttcggagcaaacggtgagagctgagctaacagaggagaagctcaatgctcaccgttaacctggcggcagcgcaaaagatg

SEQ ID NO: 118811 - DNA, 103 bp, Artificial Sequence
  Synthetic Polynucleotide
taatacgactcactatagggactgcgggctcggttcggagcaaacggtgaaacagaggagatcaccgatggctccgaacaacctggcggcagcgcaaaagatg

SEQ ID NO: 118812 - DNA, 103 bp, Artificial Sequence
  Synthetic Polynucleotide
taatacgactcactataggggcacggtccgactgcgggctcggttcggagaacagaggagactccgaatggagcccgcaaacctggcggcagcgcaaaagatg

SEQ ID NO: 118813 - DNA, 103 bp, Artificial Sequence
  Synthetic Polynucleotide
taatacgactcactatagggagccaaactggcacggtccgactgcgggctaacagaggagaagcccgatgtcggaccgtaacctggcggcagcgcaaaagatg

SEQ ID NO: 118814 - DNA, 103 bp, Artificial Sequence
  Synthetic Polynucleotide
taatacgactcactatagggtggggcatcgagccaaactggcacggtccgaacagaggagacggaccatgccagtttggaacctggcggcagcgcaaaagatg

SEQ ID NO: 118815 - DNA, 103 bp, Artificial Sequence
  Synthetic Polynucleotide
taatacgactcactatagggtggttagttttggggcatcgagccaaactgaacagaggagacagtttatgtcgatgcccaacctggcggcagcgcaaaagatg

SEQ ID NO: 118816 - DNA, 103 bp, Artificial Sequence
  Synthetic Polynucleotide
taatacgactcactataggggaagcctaatttggctccttcaagccctgcaacagaggagagcagggatggaaggagccaacctggcggcagcgcaaaagatg

SEQ ID NO: 118817 - DNA, 103 bp, Artificial Sequence
  Synthetic Polynucleotide
taatacgactcactataggggggacctcggtggttagttttggggcatcgaacagaggagacgatgcatgaaaactaacaacctggcggcagcgcaaaagatg

SEQ ID NO: 118818 - DNA, 103 bp, Artificial Sequence
  Synthetic Polynucleotide
taatacgactcactatagggacagctgaatgggacctcggtggttagtttaacagaggagaaaactaatgaccgaggtcaacctggcggcagcgcaaaagatg

SEQ ID NO: 118819 - DNA, 103 bp, Artificial Sequence
  Synthetic Polynucleotide
taatacgactcactatagggaggaactgccacagctgaatgggacctcggaacagaggagaccgaggatgcattcagctaacctggcggcagcgcaaaagatg

SEQ ID NO: 118820 - DNA, 103 bp, Artificial Sequence
  Synthetic Polynucleotide
taatacgactcactatagggcagctccaggaggaactgccacagctgaataacagaggagaattcagatgtggcagttcaacctggcggcagcgcaaaagatg

SEQ ID NO: 118821 - DNA, 103 bp, Artificial Sequence
  Synthetic Polynucleotide
taatacgactcactatagggcgtcgtggagcagctccaggaggaactgccaacagaggagaggcagtatgtcctggagcaacctggcggcagcgcaaaagatg

SEQ ID NO: 118822 - DNA, 103 bp, Artificial Sequence
  Synthetic Polynucleotide
taatacgactcactatagggctacgcgccccgtcgtggagcagctccaggaacagaggagacctggaatggctccacgaaacctggcggcagcgcaaaagatg

SEQ ID NO: 118823 - DNA, 103 bp, Artificial Sequence
  Synthetic Polynucleotide
taatacgactcactataggggatgcagctgctacgcgccccgtcgtggagaacagaggagactccacatgggggcgcgtaacctggcggcagcgcaaaagatg

SEQ ID NO: 118824 - DNA, 103 bp, Artificial Sequence
  Synthetic Polynucleotide
taatacgactcactatagggcagtccaacggatgcagctgctacgcgcccaacagaggagagggcgcatggcagctgcaaacctggcggcagcgcaaaagatg

SEQ ID NO: 118825 - DNA, 103 bp, Artificial Sequence
  Synthetic Polynucleotide
taatacgactcactatagggcggctgttgccagtccaacggatgcagctgaacagaggagacagctgatgccgttggacaacctggcggcagcgcaaaagatg

SEQ ID NO: 118826 - DNA, 103 bp, Artificial Sequence
  Synthetic Polynucleotide
taatacgactcactatagggctggaactcgcggctgttgccagtccaacgaacagaggagacgttggatgggcaacagcaacctggcggcagcgcaaaagatg

SEQ ID NO: 118827 - DNA, 103 bp, Artificial Sequence
  Synthetic Polynucleotide
taatacgactcactatagggcagggaaacagaagcctaatttggctccttaacagaggagaaaggagatgaattaggctaacctggcggcagcgcaaaagatg

SEQ ID NO: 118828 - DNA, 103 bp, Artificial Sequence
  Synthetic Polynucleotide
taatacgactcactatagggggtcgcacagctggaactcgcggctgttgcaacagaggagagcaacaatggcgagttccaacctggcggcagcgcaaaagatg

SEQ ID NO: 118829 - DNA, 103 bp, Artificial Sequence
  Synthetic Polynucleotide
taatacgactcactatagggacctctttggggtcgcacagctggaactcgaacagaggagacgagttatggctgtgcgaaacctggcggcagcgcaaaagatg

SEQ ID NO: 118830 - DNA, 103 bp, Artificial Sequence
  Synthetic Polynucleotide
taatacgactcactatagggcagccgagccacctctttggggtcgcacagaacagaggagactgtgcatgcccaaagagaacctggcggcagcgcaaaagatg

SEQ ID NO: 118831 - DNA, 103 bp, Artificial Sequence
  Synthetic Polynucleotide
taatacgactcactataggggctcgccccacagccgagccacctctttggaacagaggagaccaaagatgtggctcggcaacctggcggcagcgcaaaagatg

SEQ ID NO: 118832 - DNA, 103 bp, Artificial Sequence
  Synthetic Polynucleotide
taatacgactcactatagggtttctcttgcgctcgccccacagccgagccaacagaggagaggctcgatggtggggcgaaacctggcggcagcgcaaaagatg

SEQ ID NO: 118833 - DNA, 103 bp, Artificial Sequence
  Synthetic Polynucleotide
taatacgactcactatagggcatgcccggctttctcttgcgctcgccccaaacagaggagatggggcatgcgcaagagaaacctggcggcagcgcaaaagatg

SEQ ID NO: 118834 - DNA, 103 bp, Artificial Sequence
  Synthetic Polynucleotide
taatacgactcactatagggtctcgtaattcatgcccggctttctcttgcaacagaggagagcaagaatgagccgggcaaacctggcggcagcgcaaaagatg

SEQ ID NO: 118835 - DNA, 103 bp, Artificial Sequence
  Synthetic Polynucleotide
taatacgactcactatagggcggctcagcttctcgtaattcatgcccggcaacagaggagagccgggatggaattacgaaacctggcggcagcgcaaaagatg

SEQ ID NO: 118836 - DNA, 103 bp, Artificial Sequence
  Synthetic Polynucleotide
taatacgactcactataggggcgaaggccccggctcagcttctcgtaattaacagaggagaaattacatgaagctgagcaacctggcggcagcgcaaaagatg

SEQ ID NO: 118837 - DNA, 103 bp, Artificial Sequence
  Synthetic Polynucleotide
taatacgactcactataggggatagtagtagcgaaggccccggctcagctaacagaggagaagctgaatgggggccttcaacctggcggcagcgcaaaagatg

SEQ ID NO: 118838 - DNA, 103 bp, Artificial Sequence
  Synthetic Polynucleotide
taatacgactcactatagggagtgccagatcagggaaacagaagcctaataacagaggagaattaggatgctgtttcccaacctggcggcagcgcaaaagatg

SEQ ID NO: 118839 - DNA, 103 bp, Artificial Sequence
  Synthetic Polynucleotide
taatacgactcactatagggatgtcgcggcgatagtagtagcgaaggcccaacagaggagagggcctatgctactactaaacctggcggcagcgcaaaagatg

SEQ ID NO: 118840 - DNA, 103 bp, Artificial Sequence
  Synthetic Polynucleotide
taatacgactcactatagggcttgcgcacgatgtcgcggcgatagtagtaaacagaggagatactacatgcgccgcgacaacctggcggcagcgcaaaagatg

SEQ ID NO: 118841 - DNA, 103 bp, Artificial Sequence
  Synthetic Polynucleotide
taatacgactcactataggggccccccgctcttgcgcacgatgtcgcggcaacagaggagagccgcgatgtcgtgcgcaaacctggcggcagcgcaaaagatg

SEQ ID NO: 118842 - DNA, 103 bp, Artificial Sequence
  Synthetic Polynucleotide
taatacgactcactataggggtgtactttcgccccccgctcttgcgcacgaacagaggagacgtgcgatggagcgggggaacctggcggcagcgcaaaagatg

SEQ ID NO: 118843 - DNA, 103 bp, Artificial Sequence
  Synthetic Polynucleotide
taatacgactcactataggggaagcggtacgtgtactttcgccccccgctaacagaggagaagcgggatgcgaaagtacaacctggcggcagcgcaaaagatg

SEQ ID NO: 118844 - DNA, 103 bp, Artificial Sequence
  Synthetic Polynucleotide
taatacgactcactatagggcgcggcccccgaagcggtacgtgtactttcaacagaggagagaaagtatgcgtaccgctaacctggcggcagcgcaaaagatg

SEQ ID NO: 118845 - DNA, 103 bp, Artificial Sequence
  Synthetic Polynucleotide
taatacgactcactatagggaggctgggcacgcggcccccgaagcggtacaacagaggagagtaccgatgcgggggccgaacctggcggcagcgcaaaagatg

SEQ ID NO: 118846 - DNA, 103 bp, Artificial Sequence
  Synthetic Polynucleotide
taatacgactcactatagggcggataggctaggctgggcacgcggcccccaacagaggagagggggcatggtgcccagcaacctggcggcagcgcaaaagatg

SEQ ID NO: 118847 - DNA, 103 bp, Artificial Sequence
  Synthetic Polynucleotide
taatacgactcactatagggccgcacagtccggataggctaggctgggcaaacagaggagatgcccaatgtagcctatcaacctggcggcagcgcaaaagatg

SEQ ID NO: 118848 - DNA, 103 bp, Artificial Sequence
  Synthetic Polynucleotide
taatacgactcactatagggcgtccgcctcccgcacagtccggataggctaacagaggagaagcctaatgggactgtgcaacctggcggcagcgcaaaagatg

SEQ ID NO: 118849 - DNA, 103 bp, Artificial Sequence
  Synthetic Polynucleotide
taatacgactcactatagggcttttccacgatgctacagccggctttcataacagaggagaatgaaaatgggctgtagcaacctggcggcagcgcaaaagatg

SEQ ID NO: 118850 - DNA, 103 bp, Artificial Sequence
  Synthetic Polynucleotide
taatacgactcactataggggaagtgccacagctggatctgccgggagccaacagaggagaggctccatgcagatccagaacctggcggcagcgcaaaagatg

SEQ ID NO: 118851 - DNA, 103 bp, Artificial Sequence
  Synthetic Polynucleotide
taatacgactcactatagggagttgactcctcaggatgcatttggcactgaacagaggagacagtgcatgatgcatcctaacctggcggcagcgcaaaagatg

SEQ ID NO: 118852 - DNA, 103 bp, Artificial Sequence
  Synthetic Polynucleotide
taatacgactcactatagggtggagaactgagttgactcctcaggatgcaaacagaggagatgcatcatgaggagtcaaaacctggcggcagcgcaaaagatg

SEQ ID NO: 118853 - DNA, 103 bp, Artificial Sequence
  Synthetic Polynucleotide
taatacgactcactatagggtgcagcttgatggagaactgagttgactccaacagaggagaggagtcatgtcagttctcaacctggcggcagcgcaaaagatg

SEQ ID NO: 118854 - DNA, 103 bp, Artificial Sequence
  Synthetic Polynucleotide
taatacgactcactatagggtggtgggggctgcagcttgatggagaactgaacagaggagacagttcatgatcaagctgaacctggcggcagcgcaaaagatg

SEQ ID NO: 118855 - DNA, 103 bp, Artificial Sequence
  Synthetic Polynucleotide
taatacgactcactatagggtccgcccaactggtgggggctgcagcttgaaacagaggagatcaagcatgagcccccacaacctggcggcagcgcaaaagatg

SEQ ID NO: 118856 - DNA, 103 bp, Artificial Sequence
  Synthetic Polynucleotide
taatacgactcactatagggtcccggttcttccgcccaactggtgggggcaacagaggagagcccccatgagttgggcgaacctggcggcagcgcaaaagatg

SEQ ID NO: 118857 - DNA, 103 bp, Artificial Sequence
  Synthetic Polynucleotide
taatacgactcactatagggctcaaccctctcccggttcttccgcccaacaacagaggagagttgggatgaagaaccggaacctggcggcagcgcaaaagatg

SEQ ID NO: 118858 - DNA, 103 bp, Artificial Sequence
  Synthetic Polynucleotide
taatacgactcactatagggcctcgctgctctcaaccctctcccggttctaacagaggagaagaaccatgagagggttgaacctggcggcagcgcaaaagatg

SEQ ID NO: 118859 - DNA, 103 bp, Artificial Sequence
  Synthetic Polynucleotide
taatacgactcactatagggggtgctgactcctcgctgctctcaaccctcaacagaggagagagggtatggagcagcgaaacctggcggcagcgcaaaagatg

SEQ ID NO: 118860 - DNA, 103 bp, Artificial Sequence
  Synthetic Polynucleotide
taatacgactcactatagggcgtggtgactggtgctgactcctcgctgctaacagaggagaagcagcatggagtcagcaaacctggcggcagcgcaaaagatg

SEQ ID NO: 118861 - DNA, 103 bp, Artificial Sequence
  Synthetic Polynucleotide
taatacgactcactataggggctccaggatgaagtgccacagctggatctaacagaggagaagatccatgtgtggcactaacctggcggcagcgcaaaagatg

SEQ ID NO: 118862 - DNA, 103 bp, Artificial Sequence
  Synthetic Polynucleotide
taatacgactcactatagggccatggtgggcgtggtgactggtgctgactaacagaggagaagtcagatgcagtcaccaaacctggcggcagcgcaaaagatg

SEQ ID NO: 118863 - DNA, 103 bp, Artificial Sequence
  Synthetic Polynucleotide
taatacgactcactatagggggaatagaagccatggtgggcgtggtgactaacagaggagaagtcacatggcccaccataacctggcggcagcgcaaaagatg

SEQ ID NO: 118864 - DNA, 103 bp, Artificial Sequence
  Synthetic Polynucleotide
taatacgactcactataggggattcttgggggaatagaagccatggtgggaacagaggagacccaccatggcttctattaacctggcggcagcgcaaaagatg

SEQ ID NO: 118865 - DNA, 103 bp, Artificial Sequence
  Synthetic Polynucleotide
taatacgactcactataggggttccaccttgattcttgggggaatagaagaacagaggagacttctaatgccccaagaaaacctggcggcagcgcaaaagatg

SEQ ID NO: 118866 - DNA, 103 bp, Artificial Sequence
  Synthetic Polynucleotide
taatacgactcactatagggtcagaggcaggttccaccttgattcttgggaacagaggagacccaagatgcaaggtggaaacctggcggcagcgcaaaagatg

SEQ ID NO: 118867 - DNA, 103 bp, Artificial Sequence
  Synthetic Polynucleotide
taatacgactcactatagggaggatccttttcagaggcaggttccaccttaacagaggagaaaggtgatgcctgcctctaacctggcggcagcgcaaaagatg

SEQ ID NO: 118868 - DNA, 103 bp, Artificial Sequence
  Synthetic Polynucleotide
taatacgactcactatagggtgaggctctcaggatccttttcagaggcagaacagaggagactgcctatgaaaaggatcaacctggcggcagcgcaaaagatg

SEQ ID NO: 118869 - DNA, 103 bp, Artificial Sequence
  Synthetic Polynucleotide
taatacgactcactataggggccgactgcctgaggctctcaggatcctttaacagaggagaaaaggaatgtgagagcctaacctggcggcagcgcaaaagatg

SEQ ID NO: 118870 - DNA, 103 bp, Artificial Sequence
  Synthetic Polynucleotide
taatacgactcactatagggcttctctcgtgccgactgcctgaggctctcaacagaggagagagagcatgaggcagtcgaacctggcggcagcgcaaaagatg

SEQ ID NO: 118871 - DNA, 103 bp, Artificial Sequence
  Synthetic Polynucleotide
taatacgactcactatagggtgtgctcctccttctctcgtgccgactgccaacagaggagaggcagtatgcacgagagaaacctggcggcagcgcaaaagatg

SEQ ID NO: 118872 - DNA, 103 bp, Artificial Sequence
  Synthetic Polynucleotide
taatacgactcactatagggttctgcagcagctccaggatgaagtgccacaacagaggagagtggcaatgcatcctggaaacctggcggcagcgcaaaagatg

SEQ ID NO: 118873 - DNA, 103 bp, Artificial Sequence
  Synthetic Polynucleotide
taatacgactcactatagggtcttcttgagtgtgctcctccttctctcgtaacagaggagaacgagaatgggaggagcaaacctggcggcagcgcaaaagatg

SEQ ID NO: 118874 - DNA, 103 bp, Artificial Sequence
  Synthetic Polynucleotide
taatacgactcactatagggcacagtgccctcttcttgagtgtgctcctcaacagaggagagaggagatgactcaagaaaacctggcggcagcgcaaaagatg

SEQ ID NO: 118875 - DNA, 103 bp, Artificial Sequence
  Synthetic Polynucleotide
taatacgactcactatagggtcctgcttggcacagtgccctcttcttgagaacagaggagactcaagatgagggcactgaacctggcggcagcgcaaaagatg

SEQ ID NO: 118876 - DNA, 103 bp, Artificial Sequence
  Synthetic Polynucleotide
taatacgactcactatagggtcttcaatggtcctgcttggcacagtgcccaacagaggagagggcacatggccaagcagaacctggcggcagcgcaaaagatg

SEQ ID NO: 118877 - DNA, 103 bp, Artificial Sequence
  Synthetic Polynucleotide
taatacgactcactataggggcctttttcctcttcaatggtcctgcttggaacagaggagaccaagcatgaccattgaaaacctggcggcagcgcaaaagatg

SEQ ID NO: 118878 - DNA, 103 bp, Artificial Sequence
  Synthetic Polynucleotide
taatacgactcactatagggcaaagatggtgcctttttcctcttcaatggaacagaggagaccattgatgaggaaaaagaacctggcggcagcgcaaaagatg

SEQ ID NO: 118879 - DNA, 103 bp, Artificial Sequence
  Synthetic Polynucleotide
taatacgactcactataggggcaggacgggcaaagatggtgcctttttccaacagaggagaggaaaaatgcaccatcttaacctggcggcagcgcaaaagatg

SEQ ID NO: 118880 - DNA, 103 bp, Artificial Sequence
  Synthetic Polynucleotide
taatacgactcactataggggggtggtgcagcaggacgggcaaagatggtaacagaggagaaccatcatggcccgtcctaacctggcggcagcgcaaaagatg

SEQ ID NO: 118881 - DNA, 103 bp, Artificial Sequence
  Synthetic Polynucleotide
taatacgactcactatagggagggccagatgggtggtgcagcaggacgggaacagaggagacccgtcatgctgcaccacaacctggcggcagcgcaaaagatg

SEQ ID NO: 118882 - DNA, 103 bp, Artificial Sequence
  Synthetic Polynucleotide
taatacgactcactatagggatgggcacagagggccagatgggtggtgcaaacagaggagatgcaccatgcatctggccaacctggcggcagcgcaaaagatg

SEQ ID NO: 118883 - DNA, 103 bp, Artificial Sequence
  Synthetic Polynucleotide
taatacgactcactataggggaactcttccttctgcagcagctccaggataacagaggagaatcctgatgctgctgcagaacctggcggcagcgcaaaagatg

SEQ ID NO: 118884 - DNA, 103 bp, Artificial Sequence
  Synthetic Polynucleotide
taatacgactcactatagggtggggtgctaatgggcacagagggccagataacagaggagaatctggatgtctgtgcccaacctggcggcagcgcaaaagatg

SEQ ID NO: 118885 - DNA, 103 bp, Artificial Sequence
  Synthetic Polynucleotide
taatacgactcactataggggttctccacttggggtgctaatgggcacagaacagaggagactgtgcatgttagcacccaacctggcggcagcgcaaaagatg

SEQ ID NO: 118886 - DNA, 103 bp, Artificial Sequence
  Synthetic Polynucleotide
taatacgactcactatagggacctccagaggttctccacttggggtgctaaacagaggagatagcacatgaagtggagaaacctggcggcagcgcaaaagatg

SEQ ID NO: 118887 - DNA, 103 bp, Artificial Sequence
  Synthetic Polynucleotide
taatacgactcactataggggtcttcagtcacctccagaggttctccactaacagaggagaagtggaatgcctctggagaacctggcggcagcgcaaaagatg

SEQ ID NO: 118888 - DNA, 103 bp, Artificial Sequence
  Synthetic Polynucleotide
taatacgactcactatagggtatcctcactgtcttcagtcacctccagagaacagaggagactctggatgtgactgaagaacctggcggcagcgcaaaagatg

SEQ ID NO: 118889 - DNA, 103 bp, Artificial Sequence
  Synthetic Polynucleotide
taatacgactcactatagggttgccaggcctatcctcactgtcttcagtcaacagaggagagactgaatgcagtgaggaaacctggcggcagcgcaaaagatg

SEQ ID NO: 118890 - DNA, 103 bp, Artificial Sequence
  Synthetic Polynucleotide
taatacgactcactatagggactgggctctttgccaggcctatcctcactaacagaggagaagtgagatgaggcctggcaacctggcggcagcgcaaaagatg

SEQ ID NO: 118891 - DNA, 103 bp, Artificial Sequence
  Synthetic Polynucleotide
taatacgactcactatagggtctcaggtgcactgggctctttgccaggccaacagaggagaggcctgatgaagagcccaaacctggcggcagcgcaaaagatg

SEQ ID NO: 118892 - DNA, 103 bp, Artificial Sequence
  Synthetic Polynucleotide
taatacgactcactatagggtcttctttcttctcaggtgcactgggctctaacagaggagaagagccatgtgcacctgaaacctggcggcagcgcaaaagatg

SEQ ID NO: 118893 - DNA, 103 bp, Artificial Sequence
  Synthetic Polynucleotide
taatacgactcactatagggcatcagtgcatcttctttcttctcaggtgcaacagaggagagcacctatgaagaaagaaaacctggcggcagcgcaaaagatg

SEQ ID NO: 118894 - DNA, 103 bp, Artificial Sequence
  Synthetic Polynucleotide
taatacgactcactatagggtgacatggcggaactcttccttctgcagcaaacagaggagatgctgcatgaggaagagtaacctggcggcagcgcaaaagatg

SEQ ID NO: 118895 - DNA, 103 bp, Artificial Sequence
  Synthetic Polynucleotide
taatacgactcactataggggcttggggggcatcagtgcatcttctttctaacagaggagaagaaagatgatgcactgaaacctggcggcagcgcaaaagatg

SEQ ID NO: 118896 - DNA, 103 bp, Artificial Sequence
  Synthetic Polynucleotide
taatacgactcactatagggttcaaccgaagcttggggggcatcagtgcaaacagaggagatgcactatggccccccaaaacctggcggcagcgcaaaagatg

SEQ ID NO: 118897 - DNA, 103 bp, Artificial Sequence
  Synthetic Polynucleotide
taatacgactcactatagggccagcgccgcttcaaccgaagcttggggggaacagaggagaccccccatgcttcggttgaacctggcggcagcgcaaaagatg

SEQ ID NO: 118898 - DNA, 103 bp, Artificial Sequence
  Synthetic Polynucleotide
taatacgactcactatagggggtcatcattccagcgccgcttcaaccgaaaacagaggagattcggtatgagcggcgctaacctggcggcagcgcaaaagatg

SEQ ID NO: 118899 - DNA, 103 bp, Artificial Sequence
  Synthetic Polynucleotide
taatacgactcactatagggcgggcttcagggtcatcattccagcgccgcaacagaggagagcggcgatggaatgatgaaacctggcggcagcgcaaaagatg

SEQ ID NO: 118900 - DNA, 103 bp, Artificial Sequence
  Synthetic Polynucleotide
taatacgactcactataggggctcagctctcgggcttcagggtcatcattaacagaggagaaatgatatgcctgaagccaacctggcggcagcgcaaaagatg

SEQ ID NO: 118901 - DNA, 103 bp, Artificial Sequence
  Synthetic Polynucleotide
taatacgactcactatagggtgccactcttgctcagctctcgggcttcagaacagaggagactgaagatggagagctgaaacctggcggcagcgcaaaagatg

SEQ ID NO: 118902 - DNA, 103 bp, Artificial Sequence
  Synthetic Polynucleotide
taatacgactcactatagggcagagaaacttgccactcttgctcagctctaacagaggagaagagctatgcaagagtggaacctggcggcagcgcaaaagatg

SEQ ID NO: 118903 - DNA, 103 bp, Artificial Sequence
  Synthetic Polynucleotide
taatacgactcactatagggtgacccattccagagaaacttgccactcttaacagaggagaaagagtatgaagtttctcaacctggcggcagcgcaaaagatg

SEQ ID NO: 118904 - DNA, 103 bp, Artificial Sequence
  Synthetic Polynucleotide
taatacgactcactatagggcctggggtcctgacccattccagagaaactaacagaggagaagtttcatgggaatgggtaacctggcggcagcgcaaaagatg

SEQ ID NO: 118905 - DNA, 103 bp, Artificial Sequence
  Synthetic Polynucleotide
taatacgactcactatagggtgccaggcgatgacatggcggaactcttccaacagaggagaggaagaatgccgccatgtaacctggcggcagcgcaaaagatg

SEQ ID NO: 118906 - DNA, 103 bp, Artificial Sequence
  Synthetic Polynucleotide
taatacgactcactataggggttgccaagccctggggtcctgacccattcaacagaggagagaatggatgaggaccccaaacctggcggcagcgcaaaagatg

SEQ ID NO: 118907 - DNA, 103 bp, Artificial Sequence
  Synthetic Polynucleotide
taatacgactcactatagggagcagctgctgttgccaagccctggggtccaacagaggagaggacccatgggcttggcaaacctggcggcagcgcaaaagatg

SEQ ID NO: 118908 - DNA, 103 bp, Artificial Sequence
  Synthetic Polynucleotide
taatacgactcactatagggctctccctgctgccaggcgatgacatggcgaacagaggagacgccatatgatcgcctggaacctggcggcagcgcaaaagatg

SEQ ID NO: 118909 - DNA, 103 bp, Artificial Sequence
  Synthetic Polynucleotide
taatacgactcactatagggattccccgtactctccctgctgccaggcgaaacagaggagatcgcctatgagcagggagaacctggcggcagcgcaaaagatg

SEQ ID NO: 118910 - DNA, 103 bp, Artificial Sequence
  Synthetic Polynucleotide
taatacgactcactatagggttgatgacaaattccccgtactctccctgcaacagaggagagcagggatggtacggggaaacctggcggcagcgcaaaagatg

SEQ ID NO: 118911 - DNA, 103 bp, Artificial Sequence
  Synthetic Polynucleotide
taatacgactcactatagggatctggatccttgatgacaaattccccgtaaacagaggagatacgggatgtttgtcatcaacctggcggcagcgcaaaagatg

SEQ ID NO: 118912 - DNA, 103 bp, Artificial Sequence
  Synthetic Polynucleotide
taatacgactcactatagggctccttctggcttttccacgatgctacagcaacagaggagagctgtaatgtcgtggaaaaacctggcggcagcgcaaaagatg

SEQ ID NO: 118913 - DNA, 103 bp, Artificial Sequence
  Synthetic Polynucleotide
taatacgactcactataggggggccacctcatctggatccttgatgacaaaacagaggagattgtcaatgaggatccagaacctggcggcagcgcaaaagatg

SEQ ID NO: 118914 - DNA, 103 bp, Artificial Sequence
  Synthetic Polynucleotide
taatacgactcactatagggccccagaggcgggccacctcatctggatccaacagaggagaggatccatgtgaggtggcaacctggcggcagcgcaaaagatg

SEQ ID NO: 118915 - DNA, 103 bp, Artificial Sequence
  Synthetic Polynucleotide
taatacgactcactatagggtttcctgcggccccagaggcgggccacctcaacagaggagagaggtgatgcgcctctggaacctggcggcagcgcaaaagatg

SEQ ID NO: 118916 - DNA, 103 bp, Artificial Sequence
  Synthetic Polynucleotide
taatacgactcactataggggtggtttgcatttcctgcggccccagaggcaacagaggagagcctctatggccgcaggaaacctggcggcagcgcaaaagatg

SEQ ID NO: 118917 - DNA, 103 bp, Artificial Sequence
  Synthetic Polynucleotide
taatacgactcactatagggtaattcatctgtggtttgcatttcctgcggaacagaggagaccgcagatgatgcaaaccaacctggcggcagcgcaaaagatg

SEQ ID NO: 118918 - DNA, 103 bp, Artificial Sequence
  Synthetic Polynucleotide
taatacgactcactatagggcagcttgtcataattcatctgtggtttgcaaacagaggagatgcaaaatgcagatgaataacctggcggcagcgcaaaagatg

SEQ ID NO: 118919 - DNA, 103 bp, Artificial Sequence
  Synthetic Polynucleotide
taatacgactcactataggggggcccggctcagcttgtcataattcatctaacagaggagaagatgaatgatgacaagcaacctggcggcagcgcaaaagatg

SEQ ID NO: 118920 - DNA, 103 bp, Artificial Sequence
  Synthetic Polynucleotide
taatacgactcactatagggtagtatctgagggcccggctcagcttgtcaaacagaggagatgacaaatggagccgggcaacctggcggcagcgcaaaagatg

SEQ ID NO: 118921 - DNA, 103 bp, Artificial Sequence
  Synthetic Polynucleotide
taatacgactcactatagggcttgttgtaatagtatctgagggcccggctaacagaggagaagccggatgctcagatacaacctggcggcagcgcaaaagatg

SEQ ID NO: 118922 - DNA, 103 bp, Artificial Sequence
  Synthetic Polynucleotide
taatacgactcactataggggaaggatcctcttgttgtaatagtatctgaaacagaggagatcagatatgattacaacaaacctggcggcagcgcaaaagatg

SEQ ID NO: 118923 - DNA, 103 bp, Artificial Sequence
  Synthetic Polynucleotide
taatacgactcactatagggtaccctccacctccttctggcttttccacgaacagaggagacgtggaatggccagaaggaacctggcggcagcgcaaaagatg

SEQ ID NO: 118924 - DNA, 103 bp, Artificial Sequence
  Synthetic Polynucleotide
taatacgactcactatagggtttgttttatgaaggatcctcttgttgtaaaacagaggagattacaaatggaggatcctaacctggcggcagcgcaaaagatg

SEQ ID NO: 118925 - DNA, 103 bp, Artificial Sequence
  Synthetic Polynucleotide
taatacgactcactatagggtcttttcccttttgttttatgaaggatcctaacagaggagaaggatcatgcataaaacaaacctggcggcagcgcaaaagatg

SEQ ID NO: 118926 - DNA, 103 bp, Artificial Sequence
  Synthetic Polynucleotide
taatacgactcactatagggtataggtaaatcttttcccttttgttttataacagaggagaataaaaatgaagggaaaaaacctggcggcagcgcaaaagatg

SEQ ID NO: 118927 - DNA, 103 bp, Artificial Sequence
  Synthetic Polynucleotide
taatacgactcactatagggaagttaaatttataggtaaatcttttccctaacagaggagaagggaaatgatttacctaaacctggcggcagcgcaaaagatg

SEQ ID NO: 118928 - DNA, 103 bp, Artificial Sequence
  Synthetic Polynucleotide
taatacgactcactatagggcagcttgttgaagttaaatttataggtaaaaacagaggagatttaccatgaaatttaacaacctggcggcagcgcaaaagatg

SEQ ID NO: 118929 - DNA, 103 bp, Artificial Sequence
  Synthetic Polynucleotide
taatacgactcactatagggtgggcatcaccagcttgttgaagttaaattaacagaggagaaatttaatgtcaacaagcaacctggcggcagcgcaaaagatg

SEQ ID NO: 118930 - DNA, 103 bp, Artificial Sequence
  Synthetic Polynucleotide
taatacgactcactatagggaatgggtagttgggcatcaccagcttgttgaacagaggagacaacaaatgggtgatgccaacctggcggcagcgcaaaagatg

SEQ ID NO: 118931 - DNA, 103 bp, Artificial Sequence
  Synthetic Polynucleotide
taatacgactcactatagggaatgttgatgaatgggtagttgggcatcacaacagaggagagtgatgatgaactacccaaacctggcggcagcgcaaaagatg

SEQ ID NO: 118932 - DNA, 103 bp, Artificial Sequence
  Synthetic Polynucleotide
taatacgactcactatagggcacttgaccgaatgttgatgaatgggtagtaacagaggagaactaccatgtcatcaacaaacctggcggcagcgcaaaagatg

SEQ ID NO: 118933 - DNA, 103 bp, Artificial Sequence
  Synthetic Polynucleotide
taatacgactcactatagggggaaccacaccacttgaccgaatgttgatgaacagaggagacatcaaatgtcggtcaagaacctggcggcagcgcaaaagatg

SEQ ID NO: 118934 - DNA, 103 bp, Artificial Sequence
  Synthetic Polynucleotide
taatacgactcactatagggaggaaactgataccctccacctccttctggaacagaggagaccagaaatgggtggagggaacctggcggcagcgcaaaagatg

SEQ ID NO: 118935 - DNA, 103 bp, Artificial Sequence
  Synthetic Polynucleotide
taatacgactcactatagggtgcactctgaggaaccacaccacttgaccgaacagaggagacggtcaatgggtgtggttaacctggcggcagcgcaaaagatg

SEQ ID NO: 118936 - DNA, 103 bp, Artificial Sequence
  Synthetic Polynucleotide
taatacgactcactataggggcactggtggtgcactctgaggaaccacacaacagaggagagtgtggatgctcagagtgaacctggcggcagcgcaaaagatg

SEQ ID NO: 118937 - DNA, 103 bp, Artificial Sequence
  Synthetic Polynucleotide
taatacgactcactataggggaggctgttggcactggtggtgcactctgaaacagaggagatcagagatgaccaccagtaacctggcggcagcgcaaaagatg

SEQ ID NO: 118938 - DNA, 103 bp, Artificial Sequence
  Synthetic Polynucleotide
taatacgactcactataggggaaccgggaagaggctgttggcactggtggaacagaggagaccaccaatgccaacagccaacctggcggcagcgcaaaagatg

SEQ ID NO: 118939 - DNA, 103 bp, Artificial Sequence
  Synthetic Polynucleotide
taatacgactcactataggggtgggaaatggaaccgggaagaggctgttgaacagaggagacaacagatgcttcccggtaacctggcggcagcgcaaaagatg

SEQ ID NO: 118940 - DNA, 103 bp, Artificial Sequence
  Synthetic Polynucleotide
taatacgactcactataggggtgtccagaggtgggaaatggaaccgggaaaacagaggagattcccgatgccatttcccaacctggcggcagcgcaaaagatg

SEQ ID NO: 118941 - DNA, 103 bp, Artificial Sequence
  Synthetic Polynucleotide
taatacgactcactatagggtggagaatgggtgtccagaggtgggaaatgaacagaggagacatttcatgcctctggacaacctggcggcagcgcaaaagatg

SEQ ID NO: 118942 - DNA, 103 bp, Artificial Sequence
  Synthetic Polynucleotide
taatacgactcactatagggcatcattggttggagaatgggtgtccagagaacagaggagactctggatgcccattctcaacctggcggcagcgcaaaagatg

SEQ ID NO: 118943 - DNA, 103 bp, Artificial Sequence
  Synthetic Polynucleotide
taatacgactcactatagggcccggctgcacatcattggttggagaatggaacagaggagaccattcatgaaccaatgaaacctggcggcagcgcaaaagatg

SEQ ID NO: 118944 - DNA, 103 bp, Artificial Sequence
  Synthetic Polynucleotide
taatacgactcactatagggagagaaccgtcccggctgcacatcattggtaacagaggagaaccaatatggtgcagccgaacctggcggcagcgcaaaagatg

SEQ ID NO: 118945 - DNA, 103 bp, Artificial Sequence
  Synthetic Polynucleotide
taatacgactcactatagggaggcccagtcaggaaactgataccctccacaacagaggagagtggagatgatcagtttcaacctggcggcagcgcaaaagatg

SEQ ID NO: 118946 - DNA, 103 bp, Artificial Sequence
  Synthetic Polynucleotide
taatacgactcactataggggggagctagcagagaaccgtcccggctgcaaacagaggagatgcagcatggacggttctaacctggcggcagcgcaaaagatg

SEQ ID NO: 118947 - DNA, 103 bp, Artificial Sequence
  Synthetic Polynucleotide
taatacgactcactataggggaagcagttagggagctagcagagaaccgtaacagaggagaacggttatgtgctagctcaacctggcggcagcgcaaaagatg

SEQ ID NO: 118948 - DNA, 103 bp, Artificial Sequence
  Synthetic Polynucleotide
taatacgactcactatagggctcctggccagaagcagttagggagctagcaacagaggagagctagcatgctaactgctaacctggcggcagcgcaaaagatg

SEQ ID NO: 118949 - DNA, 103 bp, Artificial Sequence
  Synthetic Polynucleotide
taatacgactcactatagggcattactggactcctggccagaagcagttaaacagaggagataactgatgctggccaggaacctggcggcagcgcaaaagatg

SEQ ID NO: 118950 - DNA, 103 bp, Artificial Sequence
  Synthetic Polynucleotide
taatacgactcactatagggctatcagtaccattactggactcctggccaaacagaggagatggccaatggtccagtaaaacctggcggcagcgcaaaagatg

SEQ ID NO: 118951 - DNA, 103 bp, Artificial Sequence
  Synthetic Polynucleotide
taatacgactcactatagggctcagtctttctatcagtaccattactggaaacagaggagatccagtatgggtactgataacctggcggcagcgcaaaagatg

SEQ ID NO: 118952 - DNA, 103 bp, Artificial Sequence
  Synthetic Polynucleotide
taatacgactcactataggggctctgaaagctcagtctttctatcagtacaacagaggagagtactgatggaaagactgaacctggcggcagcgcaaaagatg

SEQ ID NO: 118953 - DNA, 103 bp, Artificial Sequence
  Synthetic Polynucleotide
taatacgactcactatagggccatcctccagctctgaaagctcagtctttaacagaggagaaaagacatggctttcagaaacctggcggcagcgcaaaagatg

SEQ ID NO: 118954 - DNA, 103 bp, Artificial Sequence
  Synthetic Polynucleotide
taatacgactcactatagggagcagctgagccatcctccagctctgaaagaacagaggagactttcaatgctggaggataacctggcggcagcgcaaaagatg

SEQ ID NO: 118955 - DNA, 103 bp, Artificial Sequence
  Synthetic Polynucleotide
taatacgactcactatagggggcgccagtcagcagctgagccatcctccaaacagaggagatggaggatggctcagctgaacctggcggcagcgcaaaagatg

SEQ ID NO: 118956 - DNA, 103 bp, Artificial Sequence
  Synthetic Polynucleotide
taatacgactcactatagggtctgttttgtaggcccagtcaggaaactgaaacagaggagatcagttatgtgactgggcaacctggcggcagcgcaaaagatg

SEQ ID NO: 118957 - DNA, 103 bp, Artificial Sequence
  Synthetic Polynucleotide
taatacgactcactatagggtccacaccccggcgccagtcagcagctgagaacagaggagactcagcatgtgactggcgaacctggcggcagcgcaaaagatg

SEQ ID NO: 118958 - DNA, 103 bp, Artificial Sequence
  Synthetic Polynucleotide
taatacgactcactatagggggacacgggatccacaccccggcgccagtcaacagaggagagactggatgcggggtgtgaacctggcggcagcgcaaaagatg

SEQ ID NO: 118959 - DNA, 103 bp, Artificial Sequence
  Synthetic Polynucleotide
taatacgactcactatagggcattcctggaggacacgggatccacaccccaacagaggagaggggtgatgatcccgtgtaacctggcggcagcgcaaaagatg

SEQ ID NO: 118960 - DNA, 103 bp, Artificial Sequence
  Synthetic Polynucleotide
taatacgactcactatagggccaccaatggcattcctggaggacacgggaaacagaggagatcccgtatgctccaggaaaacctggcggcagcgcaaaagatg

SEQ ID NO: 118961 - DNA, 103 bp, Artificial Sequence
  Synthetic Polynucleotide
taatacgactcactatagggaatccctcctccaccaatggcattcctggaaacagaggagatccaggatggccattggtaacctggcggcagcgcaaaagatg

SEQ ID NO: 118962 - DNA, 103 bp, Artificial Sequence
  Synthetic Polynucleotide
taatacgactcactatagggtctgatggccaatccctcctccaccaatggaacagaggagaccattgatggaggagggaaacctggcggcagcgcaaaagatg

SEQ ID NO: 118963 - DNA, 103 bp, Artificial Sequence
  Synthetic Polynucleotide
taatacgactcactatagggggcttgcgtttctgatggccaatccctcctaacagaggagaaggaggatgtggccatcaaacctggcggcagcgcaaaagatg

SEQ ID NO: 118964 - DNA, 103 bp, Artificial Sequence
  Synthetic Polynucleotide
taatacgactcactatagggcattatgtcaggcttgcgtttctgatggccaacagaggagaggccatatgaaacgcaagaacctggcggcagcgcaaaagatg

SEQ ID NO: 118965 - DNA, 103 bp, Artificial Sequence
  Synthetic Polynucleotide
taatacgactcactatagggacagaggaagcattatgtcaggcttgcgttaacagaggagaaacgcaatgctgacataaaacctggcggcagcgcaaaagatg

SEQ ID NO: 118966 - DNA, 103 bp, Artificial Sequence
  Synthetic Polynucleotide
taatacgactcactatagggggcctagcaaacagaggaagcattatgtcaaacagaggagatgacatatggcttcctctaacctggcggcagcgcaaaagatg

SEQ ID NO: 118967 - DNA, 103 bp, Artificial Sequence
  Synthetic Polynucleotide
taatacgactcactatagggtggggatgactctgttttgtaggcccagtcaacagaggagagactggatgtacaaaacaaacctggcggcagcgcaaaagatg

SEQ ID NO: 118968 - DNA, 103 bp, Artificial Sequence
  Synthetic Polynucleotide
taatacgactcactataggggtacatccctggcctagcaaacagaggaagaacagaggagacttcctatgtttgctaggaacctggcggcagcgcaaaagatg

SEQ ID NO: 118969 - DNA, 103 bp, Artificial Sequence
  Synthetic Polynucleotide
taatacgactcactataggggggggtcagggtacatccctggcctagcaaaacagaggagattgctaatgcagggatgtaacctggcggcagcgcaaaagatg

SEQ ID NO: 118970 - DNA, 103 bp, Artificial Sequence
  Synthetic Polynucleotide
taatacgactcactatagggaagggactgtgggggtcagggtacatccctaacagaggagaagggatatgccctgacccaacctggcggcagcgcaaaagatg

SEQ ID NO: 118971 - DNA, 103 bp, Artificial Sequence
  Synthetic Polynucleotide
taatacgactcactatagggagagacagcgaagggactgtgggggtcaggaacagaggagacctgacatgcacagtcccaacctggcggcagcgcaaaagatg

SEQ ID NO: 118972 - DNA, 103 bp, Artificial Sequence
  Synthetic Polynucleotide
taatacgactcactatagggcagggattggagagacagcgaagggactgtaacagaggagaacagtcatgtcgctgtctaacctggcggcagcgcaaaagatg

SEQ ID NO: 118973 - DNA, 103 bp, Artificial Sequence
  Synthetic Polynucleotide
taatacgactcactatagggcctccgcggccagggattggagagacagcgaacagaggagacgctgtatgtccaatcccaacctggcggcagcgcaaaagatg

SEQ ID NO: 118974 - DNA, 103 bp, Artificial Sequence
  Synthetic Polynucleotide
taatacgactcactatagggattaaggacacctccgcggccagggattggaacagaggagaccaatcatgggccgcggaaacctggcggcagcgcaaaagatg

SEQ ID NO: 118975 - DNA, 103 bp, Artificial Sequence
  Synthetic Polynucleotide
taatacgactcactatagggaaatggggacattaaggacacctccgcggcaacagaggagagccgcgatggtgtccttaaacctggcggcagcgcaaaagatg

SEQ ID NO: 118976 - DNA, 103 bp, Artificial Sequence
  Synthetic Polynucleotide
taatacgactcactatagggagggctggtgaaatggggacattaaggacaaacagaggagatgtcctatgtgtccccataacctggcggcagcgcaaaagatg

SEQ ID NO: 118977 - DNA, 103 bp, Artificial Sequence
  Synthetic Polynucleotide
taatacgactcactatagggagtcagggagagggctggtgaaatggggacaacagaggagagtccccatgtcaccagccaacctggcggcagcgcaaaagatg

SEQ ID NO: 118978 - DNA, 103 bp, Artificial Sequence
  Synthetic Polynucleotide
taatacgactcactataggggccgggagcctggggatgactctgttttgtaacagaggagaacaaaaatgagtcatcccaacctggcggcagcgcaaaagatg

SEQ ID NO: 118979 - DNA, 103 bp, Artificial Sequence
  Synthetic Polynucleotide
taatacgactcactatagggagatggtgggagtcagggagagggctggtgaacagaggagacaccagatgtctccctgaaacctggcggcagcgcaaaagatg

SEQ ID NO: 118980 - DNA, 103 bp, Artificial Sequence
  Synthetic Polynucleotide
taatacgactcactatagggctataggagaagatggtgggagtcagggagaacagaggagactccctatgtcccaccataacctggcggcagcgcaaaagatg

SEQ ID NO: 118981 - DNA, 103 bp, Artificial Sequence
  Synthetic Polynucleotide
taatacgactcactatagggtggtgatgggctataggagaagatggtgggaacagaggagacccaccatgttctcctataacctggcggcagcgcaaaagatg

SEQ ID NO: 118982 - DNA, 103 bp, Artificial Sequence
  Synthetic Polynucleotide
taatacgactcactatagggggctcaggcctggtgatgggctataggagaaacagaggagatctcctatggcccatcacaacctggcggcagcgcaaaagatg

SEQ ID NO: 118983 - DNA, 103 bp, Artificial Sequence
  Synthetic Polynucleotide
taatacgactcactatagggctggtgaaagggctcaggcctggtgatgggaacagaggagacccatcatgaggcctgagaacctggcggcagcgcaaaagatg

SEQ ID NO: 118984 - DNA, 103 bp, Artificial Sequence
  Synthetic Polynucleotide
taatacgactcactataggggcagctgctgctggtgaaagggctcaggccaacagaggagaggcctgatgcctttcaccaacctggcggcagcgcaaaagatg

SEQ ID NO: 118985 - DNA, 103 bp, Artificial Sequence
  Synthetic Polynucleotide
taatacgactcactatagggtgaaggagaagcagctgctgctggtgaaagaacagaggagactttcaatggcagcagctaacctggcggcagcgcaaaagatg

SEQ ID NO: 118986 - DNA, 103 bp, Artificial Sequence
  Synthetic Polynucleotide
taatacgactcactatagggtcctcagggttgaaggagaagcagctgctgaacagaggagacagcagatgcttctccttaacctggcggcagcgcaaaagatg

SEQ ID NO: 118987 - DNA, 103 bp, Artificial Sequence
  Synthetic Polynucleotide
taatacgactcactataggggtgtttcatttcctcagggttgaaggagaaaacagaggagattctccatgaaccctgagaacctggcggcagcgcaaaagatg

SEQ ID NO: 118988 - DNA, 103 bp, Artificial Sequence
  Synthetic Polynucleotide
taatacgactcactatagggaatgaaggtagtgtttcatttcctcagggtaacagaggagaaccctgatgaaatgaaacaacctggcggcagcgcaaaagatg

SEQ ID NO: 118989 - DNA, 103 bp, Artificial Sequence
  Synthetic Polynucleotide
taatacgactcactatagggagctggatctgccgggagcctggggatgacaacagaggagagtcatcatgaggctcccgaacctggcggcagcgcaaaagatg

SEQ ID NO: 118990 - DNA, 103 bp, Artificial Sequence
  Synthetic Polynucleotide
taatacgactcactatagggcaagcttgagaatgaaggtagtgtttcattaacagaggagaaatgaaatgctaccttcaaacctggcggcagcgcaaaagatg

SEQ ID NO: 118991 - DNA, 103 bp, Artificial Sequence
  Synthetic Polynucleotide
taatacgactcactataggggaacacagaacaagcttgagaatgaaggtaaacagaggagataccttatgtctcaagctaacctggcggcagcgcaaaagatg

SEQ ID NO: 118992 - DNA, 103 bp, Artificial Sequence
  Synthetic Polynucleotide
taatacgactcactataggggatggtagttgaacacagaacaagcttgagaacagaggagactcaagatggttctgtgtaacctggcggcagcgcaaaagatg

SEQ ID NO: 118993 - DNA, 103 bp, Artificial Sequence
  Synthetic Polynucleotide
taatacgactcactatagggcgaggactcagatggtagttgaacacagaaaacagaggagattctgtatgcaactaccaaacctggcggcagcgcaaaagatg

SEQ ID NO: 118994 - DNA, 103 bp, Artificial Sequence
  Synthetic Polynucleotide
taatacgactcactataggggggaaaagtccgaggactcagatggtagttaacagaggagaaactacatgctgagtcctaacctggcggcagcgcaaaagatg

SEQ ID NO: 118995 - DNA, 103 bp, Artificial Sequence
  Synthetic Polynucleotide
taatacgactcactatagggctgggtaacggggaaaagtccgaggactcaaacagaggagatgagtcatgggacttttcaacctggcggcagcgcaaaagatg

SEQ ID NO: 118996 - DNA, 103 bp, Artificial Sequence
  Synthetic Polynucleotide
taatacgactcactatagggaccatgagccctgggtaacggggaaaagtcaacagaggagagactttatgccgttacccaacctggcggcagcgcaaaagatg

SEQ ID NO: 118997 - DNA, 103 bp, Artificial Sequence
  Synthetic Polynucleotide
taatacgactcactatagggcagtggtggaaccatgagccctgggtaacgaacagaggagacgttacatggggctcatgaacctggcggcagcgcaaaagatg

SEQ ID NO: 118998 - DNA, 103 bp, Artificial Sequence
  Synthetic Polynucleotide
taatacgactcactatagggtttggcactgcagtggtggaaccatgagccaacagaggagaggctcaatgttccaccacaacctggcggcagcgcaaaagatg

SEQ ID NO: 118999 - DNA, 103 bp, Artificial Sequence
  Synthetic Polynucleotide
taatacgactcactatagggtcaggatgcatttggcactgcagtggtggaaacagaggagatccaccatggcagtgccaaacctggcggcagcgcaaaagatg

SEQ ID NO: 119000 - DNA, 103 bp, Artificial Sequence
  Synthetic Polynucleotide
taatacgactcactatagggcaagtatccggctttcatcctccgctccataacagaggagaatggagatgaggatgaaaaacctggcggcagcgcaaaagatg

SEQ ID NO: 119001 - DNA, 103 bp, Artificial Sequence
  Synthetic Polynucleotide
taatacgactcactatagggcatgagcttccccagcgggccgatcagcgcaacagaggagagcgctgatgggcccgctgaacctggcggcagcgcaaaagatg

SEQ ID NO: 119002 - DNA, 103 bp, Artificial Sequence
  Synthetic Polynucleotide
taatacgactcactatagggggcaccccggcgctggtagggcggcccctcaacagaggagagaggggatgccctaccagaacctggcggcagcgcaaaagatg

SEQ ID NO: 119003 - DNA, 103 bp, Artificial Sequence
  Synthetic Polynucleotide
taatacgactcactatagggacagctgcagggcaccccggcgctggtaggaacagaggagacctaccatggccggggtgaacctggcggcagcgcaaaagatg

SEQ ID NO: 119004 - DNA, 103 bp, Artificial Sequence
  Synthetic Polynucleotide
taatacgactcactatagggagaaattgccacagctgcagggcaccccggaacagaggagaccggggatgcctgcagctaacctggcggcagcgcaaaagatg

SEQ ID NO: 119005 - DNA, 103 bp, Artificial Sequence
  Synthetic Polynucleotide
taatacgactcactatagggcaaggccaccagaaattgccacagctgcagaacagaggagactgcagatgtggcaatttaacctggcggcagcgcaaaagatg

SEQ ID NO: 119006 - DNA, 103 bp, Artificial Sequence
  Synthetic Polynucleotide
taatacgactcactatagggggtcatccagcaaggccaccagaaattgccaacagaggagaggcaatatgtggtggcctaacctggcggcagcgcaaaagatg

SEQ ID NO: 119007 - DNA, 103 bp, Artificial Sequence
  Synthetic Polynucleotide
taatacgactcactataggggcatttgttgggtcatccagcaaggccaccaacagaggagaggtggcatggctggatgaaacctggcggcagcgcaaaagatg

SEQ ID NO: 119008 - DNA, 103 bp, Artificial Sequence
  Synthetic Polynucleotide
taatacgactcactatagggaatgaaatgggcatttgttgggtcatccagaacagaggagactggatatgccaacaaataacctggcggcagcgcaaaagatg

SEQ ID NO: 119009 - DNA, 103 bp, Artificial Sequence
  Synthetic Polynucleotide
taatacgactcactatagggccgtccaggcaatgaaatgggcatttgttgaacagaggagacaacaaatgcccatttcaaacctggcggcagcgcaaaagatg

SEQ ID NO: 119010 - DNA, 103 bp, Artificial Sequence
  Synthetic Polynucleotide
taatacgactcactatagggattccccggcccgtccaggcaatgaaatggaacagaggagaccatttatgtgcctggacaacctggcggcagcgcaaaagatg

SEQ ID NO: 119011 - DNA, 103 bp, Artificial Sequence
  Synthetic Polynucleotide
taatacgactcactatagggcttgaactccattccccggcccgtccaggcaacagaggagagcctggatgggccggggaaacctggcggcagcgcaaaagatg

SEQ ID NO: 119012 - DNA, 103 bp, Artificial Sequence
  Synthetic Polynucleotide
taatacgactcactatagggagcccgggtccatgagcttccccagcgggcaacagaggagagcccgcatgggaagctcaaacctggcggcagcgcaaaagatg

SEQ ID NO: 119013 - DNA, 103 bp, Artificial Sequence
  Synthetic Polynucleotide
taatacgactcactataggggctcaatgagcttgaactccattccccggcaacagaggagagccgggatgtggagttcaaacctggcggcagcgcaaaagatg

SEQ ID NO: 119014 - DNA, 103 bp, Artificial Sequence
  Synthetic Polynucleotide
taatacgactcactatagggacctcctcaggctcaatgagcttgaactccaacagaggagaggagttatggctcattgaaacctggcggcagcgcaaaagatg

SEQ ID NO: 119015 - DNA, 103 bp, Artificial Sequence
  Synthetic Polynucleotide
taatacgactcactataggggagcctggcgacctcctcaggctcaatgagaacagaggagactcattatgcctgaggagaacctggcggcagcgcaaaagatg

SEQ ID NO: 119016 - DNA, 103 bp, Artificial Sequence
  Synthetic Polynucleotide
taatacgactcactatagggggatgccccagagcctggcgacctcctcagaacagaggagactgaggatgtcgccaggcaacctggcggcagcgcaaaagatg

SEQ ID NO: 119017 - DNA, 103 bp, Artificial Sequence
  Synthetic Polynucleotide
taatacgactcactatagggcggttcttctggatgccccagagcctggcgaacagaggagacgccagatgctggggcataacctggcggcagcgcaaaagatg

SEQ ID NO: 119018 - DNA, 103 bp, Artificial Sequence
  Synthetic Polynucleotide
taatacgactcactatagggcatggctggccggttcttctggatgccccaaacagaggagatggggcatgcagaagaacaacctggcggcagcgcaaaagatg

SEQ ID NO: 119019 - DNA, 103 bp, Artificial Sequence
  Synthetic Polynucleotide
taatacgactcactatagggtgtcgtaattcatggctggccggttcttctaacagaggagaagaagaatgggccagccaaacctggcggcagcgcaaaagatg

SEQ ID NO: 119020 - DNA, 103 bp, Artificial Sequence
  Synthetic Polynucleotide
taatacgactcactatagggcggctcagcttgtcgtaattcatggctggcaacagaggagagccagcatggaattacgaaacctggcggcagcgcaaaagatg

SEQ ID NO: 119021 - DNA, 103 bp, Artificial Sequence
  Synthetic Polynucleotide
taatacgactcactatagggtcggagcgagcggctcagcttgtcgtaattaacagaggagaaattacatgaagctgagcaacctggcggcagcgcaaaagatg

SEQ ID NO: 119022 - DNA, 103 bp, Artificial Sequence
  Synthetic Polynucleotide
taatacgactcactatagggcataatagtatcggagcgagcggctcagctaacagaggagaagctgaatggctcgctccaacctggcggcagcgcaaaagatg

SEQ ID NO: 119023 - DNA, 103 bp, Artificial Sequence
  Synthetic Polynucleotide
taatacgactcactatagggggcggcagggagcccgggtccatgagcttcaacagaggagagaagctatgggacccgggaacctggcggcagcgcaaaagatg

SEQ ID NO: 119024 - DNA, 103 bp, Artificial Sequence
  Synthetic Polynucleotide
taatacgactcactatagggatgcctttctcataatagtatcggagcgagaacagaggagactcgctatgatactattaaacctggcggcagcgcaaaagatg

SEQ ID NO: 119025 - DNA, 103 bp, Artificial Sequence
  Synthetic Polynucleotide
taatacgactcactatagggcttctgcatgatgcctttctcataatagtaaacagaggagatactatatggagaaaggcaacctggcggcagcgcaaaagatg

SEQ ID NO: 119026 - DNA, 103 bp, Artificial Sequence
  Synthetic Polynucleotide
taatacgactcactatagggcaccagccaccttctgcatgatgcctttctaacagaggagaagaaagatgtcatgcagaaacctggcggcagcgcaaaagatg

SEQ ID NO: 119027 - DNA, 103 bp, Artificial Sequence
  Synthetic Polynucleotide
taatacgactcactatagggacgtaacgctcaccagccaccttctgcatgaacagaggagacatgcaatgggtggctggaacctggcggcagcgcaaaagatg

SEQ ID NO: 119028 - DNA, 103 bp, Artificial Sequence
  Synthetic Polynucleotide
taatacgactcactatagggaaacttgtacacgtaacgctcaccagccacaacagaggagagtggctatggagcgttacaacctggcggcagcgcaaaagatg

SEQ ID NO: 119029 - DNA, 103 bp, Artificial Sequence
  Synthetic Polynucleotide
taatacgactcactataggggctcacacacaaacttgtacacgtaacgctaacagaggagaagcgttatgtgtacaagtaacctggcggcagcgcaaaagatg

SEQ ID NO: 119030 - DNA, 103 bp, Artificial Sequence
  Synthetic Polynucleotide
taatacgactcactatagggagggcctcgggctcacacacaaacttgtacaacagaggagagtacaaatgtgtgtgtgaaacctggcggcagcgcaaaagatg

SEQ ID NO: 119031 - DNA, 103 bp, Artificial Sequence
  Synthetic Polynucleotide
taatacgactcactatagggcaaagagaagagggcctcgggctcacacacaacagaggagagtgtgtatgcccgaggccaacctggcggcagcgcaaaagatg

SEQ ID NO: 119032 - DNA, 103 bp, Artificial Sequence
  Synthetic Polynucleotide
taatacgactcactatagggccgggaaggccaaagagaagagggcctcggaacagaggagaccgaggatgtcttctcttaacctggcggcagcgcaaaagatg

SEQ ID NO: 119033 - DNA, 103 bp, Artificial Sequence
  Synthetic Polynucleotide
taatacgactcactatagggcgctgattgtccgggaaggccaaagagaagaacagaggagacttctcatgggccttcccaacctggcggcagcgcaaaagatg

SEQ ID NO: 119034 - DNA, 103 bp, Artificial Sequence
  Synthetic Polynucleotide
taatacgactcactatagggagagtcgaggggcggcagggagcccgggtcaacagaggagagacccgatgtccctgccgaacctggcggcagcgcaaaagatg

SEQ ID NO: 119035 - DNA, 103 bp, Artificial Sequence
  Synthetic Polynucleotide
taatacgactcactataggggagagctggacgctgattgtccgggaaggcaacagaggagagccttcatggacaatcagaacctggcggcagcgcaaaagatg

SEQ ID NO: 119036 - DNA, 103 bp, Artificial Sequence
  Synthetic Polynucleotide
taatacgactcactatagggactcagccttgagagctggacgctgattgtaacagaggagaacaatcatggtccagctcaacctggcggcagcgcaaaagatg

SEQ ID NO: 119037 - DNA, 103 bp, Artificial Sequence
  Synthetic Polynucleotide
taatacgactcactatagggggccggtcaaactcagccttgagagctggaaacagaggagatccagcatgcaaggctgaaacctggcggcagcgcaaaagatg

SEQ ID NO: 119038 - DNA, 103 bp, Artificial Sequence
  Synthetic Polynucleotide
taatacgactcactatagggctcactgacaggccggtcaaactcagccttaacagaggagaaaggctatgtttgaccggaacctggcggcagcgcaaaagatg

SEQ ID NO: 119039 - DNA, 103 bp, Artificial Sequence
  Synthetic Polynucleotide
taatacgactcactatagggctgtgtcctcctcactgacaggccggtcaaaacagaggagattgaccatgctgtcagtgaacctggcggcagcgcaaaagatg

SEQ ID NO: 119040 - DNA, 103 bp, Artificial Sequence
  Synthetic Polynucleotide
taatacgactcactataggggacaaagggactgtgtcctcctcactgacaaacagaggagatgtcagatgggaggacacaacctggcggcagcgcaaaagatg

SEQ ID NO: 119041 - DNA, 103 bp, Artificial Sequence
  Synthetic Polynucleotide
taatacgactcactatagggatccaagtgggacaaagggactgtgtcctcaacagaggagagaggacatggtccctttgaacctggcggcagcgcaaaagatg

SEQ ID NO: 119042 - DNA, 103 bp, Artificial Sequence
  Synthetic Polynucleotide
taatacgactcactatagggcggggctctcatccaagtgggacaaagggaaacagaggagatcccttatgcccacttggaacctggcggcagcgcaaaagatg

SEQ ID NO: 119043 - DNA, 103 bp, Artificial Sequence
  Synthetic Polynucleotide
taatacgactcactataggggggaggtaggcggggctctcatccaagtggaacagaggagaccacttatgtgagagcccaacctggcggcagcgcaaaagatg

SEQ ID NO: 119044 - DNA, 103 bp, Artificial Sequence
  Synthetic Polynucleotide
taatacgactcactatagggagccagctctgggaggtaggcggggctctcaacagaggagagagagcatggcctacctcaacctggcggcagcgcaaaagatg

SEQ ID NO: 119045 - DNA, 103 bp, Artificial Sequence
  Synthetic Polynucleotide
taatacgactcactatagggagagatcttcagagtcgaggggcggcagggaacagaggagaccctgcatgccctcgactaacctggcggcagcgcaaaagatg

SEQ ID NO: 119046 - DNA, 103 bp, Artificial Sequence
  Synthetic Polynucleotide
taatacgactcactataggggggcggggccagccagctctgggaggtaggaacagaggagacctaccatgcagagctggaacctggcggcagcgcaaaagatg

SEQ ID NO: 119047 - DNA, 103 bp, Artificial Sequence
  Synthetic Polynucleotide
taatacgactcactatagggccaaatggctgggcggggccagccagctctaacagaggagaagagctatgtggccccgcaacctggcggcagcgcaaaagatg

SEQ ID NO: 119048 - DNA, 103 bp, Artificial Sequence
  Synthetic Polynucleotide
taatacgactcactatagggacccttggggccaaatggctgggcggggccaacagaggagaggccccatgcagccatttaacctggcggcagcgcaaaagatg

SEQ ID NO: 119049 - DNA, 103 bp, Artificial Sequence
  Synthetic Polynucleotide
taatacgactcactatagggaagagtagccacccttggggccaaatggctaacagaggagaagccatatggccccaaggaacctggcggcagcgcaaaagatg

SEQ ID NO: 119050 - DNA, 103 bp, Artificial Sequence
  Synthetic Polynucleotide
taatacgactcactatagggagatcctggaagagatcttcagagtcgaggaacagaggagacctcgaatgtgaagatctaacctggcggcagcgcaaaagatg

SEQ ID NO: 119051 - DNA, 103 bp, Artificial Sequence
  Synthetic Polynucleotide
taatacgactcactataggggaagtgacttagatcctggaagagatcttcaacagaggagagaagatatgttccaggataacctggcggcagcgcaaaagatg

SEQ ID NO: 119052 - DNA, 103 bp, Artificial Sequence
  Synthetic Polynucleotide
taatacgactcactatagggacgtctcctggaagtgacttagatcctggaaacagaggagatccaggatgtaagtcactaacctggcggcagcgcaaaagatg

SEQ ID NO: 119053 - DNA, 103 bp, Artificial Sequence
  Synthetic Polynucleotide
taatacgactcactatagggtcagcgagccacgtctcctggaagtgacttaacagaggagaaagtcaatgccaggagacaacctggcggcagcgcaaaagatg

SEQ ID NO: 119054 - DNA, 103 bp, Artificial Sequence
  Synthetic Polynucleotide
taatacgactcactatagggtacctgagcttcagcgagccacgtctcctgaacagaggagacaggagatgtggctcgctaacctggcggcagcgcaaaagatg

SEQ ID NO: 119055 - DNA, 103 bp, Artificial Sequence
  Synthetic Polynucleotide
taatacgactcactatagggcttgctggtccaagtatccggctttcatccaacagaggagaggatgaatgccggatactaacctggcggcagcgcaaaagatg

SEQ ID NO: 119056 - DNA, 103 bp, Artificial Sequence
  Synthetic Polynucleotide
taatacgactcactatagggcactgtctggtacctgagcttcagcgagccaacagaggagaggctcgatgaagctcaggaacctggcggcagcgcaaaagatg

SEQ ID NO: 119057 - DNA, 103 bp, Artificial Sequence
  Synthetic Polynucleotide
taatacgactcactatagggaactgctcatcactgtctggtacctgagctaacagaggagaagctcaatgaccagacagaacctggcggcagcgcaaaagatg

SEQ ID NO: 119058 - DNA, 103 bp, Artificial Sequence
  Synthetic Polynucleotide
taatacgactcactatagggatcaggaacaaactgctcatcactgtctggaacagaggagaccagacatggatgagcagaacctggcggcagcgcaaaagatg

SEQ ID NO: 119059 - DNA, 103 bp, Artificial Sequence
  Synthetic Polynucleotide
taatacgactcactatagggctgaatggaaatcaggaacaaactgctcataacagaggagaatgagcatgttgttcctgaacctggcggcagcgcaaaagatg

SEQ ID NO: 119060 - DNA, 103 bp, Artificial Sequence
  Synthetic Polynucleotide
taatacgactcactataggggctaggttttctgaatggaaatcaggaacaaacagaggagatgttccatgtttccattcaacctggcggcagcgcaaaagatg

SEQ ID NO: 119061 - DNA, 103 bp, Artificial Sequence
  Synthetic Polynucleotide
taatacgactcactataggggctgtggaaagctaggttttctgaatggaaaacagaggagattccatatggaaaacctaaacctggcggcagcgcaaaagatg

SEQ ID NO: 119062 - DNA, 103 bp, Artificial Sequence
  Synthetic Polynucleotide
taatacgactcactatagggtggtggtggggctgtggaaagctaggttttaacagaggagaaaaaccatgctttccacaaacctggcggcagcgcaaaagatg

SEQ ID NO: 119063 - DNA, 103 bp, Artificial Sequence
  Synthetic Polynucleotide
taatacgactcactatagggttcttgatcctggtggtggggctgtggaaaaacagaggagatttccaatgccccaccacaacctggcggcagcgcaaaagatg

SEQ ID NO: 119064 - DNA, 103 bp, Artificial Sequence
  Synthetic Polynucleotide
taatacgactcactatagggctggggctccttcttgatcctggtggtgggaacagaggagacccaccatgaggatcaagaacctggcggcagcgcaaaagatg

SEQ ID NO: 119065 - DNA, 103 bp, Artificial Sequence
  Synthetic Polynucleotide
taatacgactcactatagggtgcggggactctggggctccttcttgatccaacagaggagaggatcaatgaggagccccaacctggcggcagcgcaaaagatg

SEQ ID NO: 119066 - DNA, 103 bp, Artificial Sequence
  Synthetic Polynucleotide
taatacgactcactataggggtgtagggcacttgctggtccaagtatccgaacagaggagacggataatgggaccagcaaacctggcggcagcgcaaaagatg

SEQ ID NO: 119067 - DNA, 103 bp, Artificial Sequence
  Synthetic Polynucleotide
taatacgactcactataggggccgggtctgtgcggggactctggggctccaacagaggagaggagccatggagtccccgaacctggcggcagcgcaaaagatg

SEQ ID NO: 119068 - DNA, 103 bp, Artificial Sequence
  Synthetic Polynucleotide
taatacgactcactataggggcaggacagggccgggtctgtgcggggactaacagaggagaagtcccatgacagacccgaacctggcggcagcgcaaaagatg

SEQ ID NO: 119069 - DNA, 103 bp, Artificial Sequence
  Synthetic Polynucleotide
taatacgactcactataggggcttcctgctgcaggacagggccgggtctgaacagaggagacagaccatgccctgtcctaacctggcggcagcgcaaaagatg

SEQ ID NO: 119070 - DNA, 103 bp, Artificial Sequence
  Synthetic Polynucleotide
taatacgactcactataggggggagtggcggcttcctgctgcaggacaggaacagaggagacctgtcatgcagcaggaaaacctggcggcagcgcaaaagatg

SEQ ID NO: 119071 - DNA, 103 bp, Artificial Sequence
  Synthetic Polynucleotide
taatacgactcactatagggatggtggtaggggagtggcggcttcctgctaacagaggagaagcaggatgccgccactcaacctggcggcagcgcaaaagatg

SEQ ID NO: 119072 - DNA, 103 bp, Artificial Sequence
  Synthetic Polynucleotide
taatacgactcactatagggactgctcgccatggtggtaggggagtggcgaacagaggagacgccacatgcctaccaccaacctggcggcagcgcaaaagatg

SEQ ID NO: 119073 - DNA, 103 bp, Artificial Sequence
  Synthetic Polynucleotide
taatacgactcactataggggagtaaaggcactgctcgccatggtggtagaacagaggagactaccaatgtggcgagcaaacctggcggcagcgcaaaagatg

SEQ ID NO: 119074 - DNA, 103 bp, Artificial Sequence
  Synthetic Polynucleotide
taatacgactcactatagggataggcactggagtaaaggcactgctcgccaacagaggagaggcgagatgtgcctttacaacctggcggcagcgcaaaagatg

SEQ ID NO: 119075 - DNA, 103 bp, Artificial Sequence
  Synthetic Polynucleotide
taatacgactcactatagggtgggggggtcataggcactggagtaaaggcaacagaggagagcctttatgccagtgcctaacctggcggcagcgcaaaagatg

SEQ ID NO: 119076 - DNA, 103 bp, Artificial Sequence
  Synthetic Polynucleotide
taatacgactcactataggggcgatttgtctgggggggtcataggcactgaacagaggagacagtgcatgtgaccccccaacctggcggcagcgcaaaagatg

SEQ ID NO: 119077 - DNA, 103 bp, Artificial Sequence
  Synthetic Polynucleotide
taatacgactcactataggggctgctgaaggtgtagggcacttgctggtcaacagaggagagaccagatggtgccctacaacctggcggcagcgcaaaagatg

SEQ ID NO: 119078 - DNA, 103 bp, Artificial Sequence
  Synthetic Polynucleotide
taatacgactcactatagggggacttgatggcgatttgtctgggggggtcaacagaggagagaccccatgagacaaatcaacctggcggcagcgcaaaagatg

SEQ ID NO: 119079 - DNA, 103 bp, Artificial Sequence
  Synthetic Polynucleotide
taatacgactcactatagggcaggggcaggggacttgatggcgatttgtcaacagaggagagacaaaatgccatcaagtaacctggcggcagcgcaaaagatg

SEQ ID NO: 119080 - DNA, 103 bp, Artificial Sequence
  Synthetic Polynucleotide
taatacgactcactatagggccaagggcaccaggggcaggggacttgatgaacagaggagacatcaaatgccctgccccaacctggcggcagcgcaaaagatg

SEQ ID NO: 119081 - DNA, 103 bp, Artificial Sequence
  Synthetic Polynucleotide
taatacgactcactataggggggcgactgtccaagggcaccaggggcaggaacagaggagacctgccatgggtgcccttaacctggcggcagcgcaaaagatg

SEQ ID NO: 119082 - DNA, 103 bp, Artificial Sequence
  Synthetic Polynucleotide
taatacgactcactatagggagggctgtaggggcgactgtccaagggcacaacagaggagagtgcccatggacagtcgcaacctggcggcagcgcaaaagatg

SEQ ID NO: 119083 - DNA, 103 bp, Artificial Sequence
  Synthetic Polynucleotide
taatacgactcactataggggcccggggaaagggctgtaggggcgactgtaacagaggagaacagtcatgcctacagccaacctggcggcagcgcaaaagatg

SEQ ID NO: 119084 - DNA, 103 bp, Artificial Sequence
  Synthetic Polynucleotide
taatacgactcactatagggccgttgctctgcccggggaaagggctgtagaacagaggagactacagatgtttccccggaacctggcggcagcgcaaaagatg

SEQ ID NO: 119085 - DNA, 103 bp, Artificial Sequence
  Synthetic Polynucleotide
taatacgactcactatagggtcaggaaattccgttgctctgcccggggaaaacagaggagattccccatgcagagcaacaacctggcggcagcgcaaaagatg

SEQ ID NO: 119086 - DNA, 103 bp, Artificial Sequence
  Synthetic Polynucleotide
taatacgactcactatagggccagaggatctcaggaaattccgttgctctaacagaggagaagagcaatggaatttcctaacctggcggcagcgcaaaagatg

SEQ ID NO: 119087 - DNA, 103 bp, Artificial Sequence
  Synthetic Polynucleotide
taatacgactcactatagggctgggaggtgccagaggatctcaggaaattaacagaggagaaatttcatgagatcctctaacctggcggcagcgcaaaagatg

SEQ ID NO: 119088 - DNA, 103 bp, Artificial Sequence
  Synthetic Polynucleotide
taatacgactcactatagggcgggcgatttgctgctgaaggtgtagggcaaacagaggagatgccctatgccttcagcaaacctggcggcagcgcaaaagatg

SEQ ID NO: 119089 - DNA, 103 bp, Artificial Sequence
  Synthetic Polynucleotide
taatacgactcactatagggcagggtggggctgggaggtgccagaggatcaacagaggagagatcctatggcacctcccaacctggcggcagcgcaaaagatg

SEQ ID NO: 119090 - DNA, 103 bp, Artificial Sequence
  Synthetic Polynucleotide
taatacgactcactatagggtacccatggccagggtggggctgggaggtgaacagaggagacacctcatggccccacccaacctggcggcagcgcaaaagatg

SEQ ID NO: 119091 - DNA, 103 bp, Artificial Sequence
  Synthetic Polynucleotide
taatacgactcactatagggttccccgaggtacccatggccagggtggggaacagaggagaccccacatgggccatgggaacctggcggcagcgcaaaagatg

SEQ ID NO: 119092 - DNA, 103 bp, Artificial Sequence
  Synthetic Polynucleotide
taatacgactcactatagggcggagctatgttccccgaggtacccatggcaacagaggagagccatgatgacctcggggaacctggcggcagcgcaaaagatg

SEQ ID NO: 119093 - DNA, 103 bp, Artificial Sequence
  Synthetic Polynucleotide
taatacgactcactatagggtgctggaagacggagctatgttccccgaggaacagaggagacctcggatgacatagctcaacctggcggcagcgcaaaagatg

SEQ ID NO: 119094 - DNA, 103 bp, Artificial Sequence
  Synthetic Polynucleotide
taatacgactcactataggggtccaggggctgctggaagacggagctatgaacagaggagacatagcatggtcttccagaacctggcggcagcgcaaaagatg

SEQ ID NO: 119095 - DNA, 103 bp, Artificial Sequence
  Synthetic Polynucleotide
taatacgactcactatagggagtggcaaatgtccaggggctgctggaagaaacagaggagatcttccatgagcccctggaacctggcggcagcgcaaaagatg

SEQ ID NO: 119096 - DNA, 103 bp, Artificial Sequence
  Synthetic Polynucleotide
taatacgactcactataggggatgtgaaggagtggcaaatgtccaggggcaacagaggagagcccctatgcatttgccaaacctggcggcagcgcaaaagatg

SEQ ID NO: 119097 - DNA, 103 bp, Artificial Sequence
  Synthetic Polynucleotide
taatacgactcactatagggccctccctgagatgtgaaggagtggcaaataacagaggagaatttgcatgtccttcacaaacctggcggcagcgcaaaagatg

SEQ ID NO: 119098 - DNA, 103 bp, Artificial Sequence
  Synthetic Polynucleotide
taatacgactcactataggggttcccggccccctccctgagatgtgaaggaacagaggagaccttcaatgctcagggagaacctggcggcagcgcaaaagatg

SEQ ID NO: 119099 - DNA, 103 bp, Artificial Sequence
  Synthetic Polynucleotide
taatacgactcactatagggctcccatttccgggcgatttgctgctgaagaacagaggagacttcagatgcaaatcgccaacctggcggcagcgcaaaagatg

SEQ ID NO: 119100 - DNA, 103 bp, Artificial Sequence
  Synthetic Polynucleotide
taatacgactcactataggggctgggaggggttcccggccccctccctgaaacagaggagatcagggatggggccgggaaacctggcggcagcgcaaaagatg

SEQ ID NO: 119101 - DNA, 103 bp, Artificial Sequence
  Synthetic Polynucleotide
taatacgactcactatagggttggtagggggctgggaggggttcccggccaacagaggagaggccggatgcccctcccaaacctggcggcagcgcaaaagatg

SEQ ID NO: 119102 - DNA, 103 bp, Artificial Sequence
  Synthetic Polynucleotide
taatacgactcactatagggacagctggtgttggtagggggctgggagggaacagaggagaccctccatgccccctaccaacctggcggcagcgcaaaagatg

SEQ ID NO: 119103 - DNA, 103 bp, Artificial Sequence
  Synthetic Polynucleotide
taatacgactcactatagggcagggctccgacagctggtgttggtaggggaacagaggagacccctaatgacaccagctaacctggcggcagcgcaaaagatg

SEQ ID NO: 119104 - DNA, 103 bp, Artificial Sequence
  Synthetic Polynucleotide
taatacgactcactatagggatagggtgggcagggctccgacagctggtgaacagaggagacaccagatgtcggagcccaacctggcggcagcgcaaaagatg

SEQ ID NO: 119105 - DNA, 103 bp, Artificial Sequence
  Synthetic Polynucleotide
taatacgactcactatagggtctgctggggatagggtgggcagggctccgaacagaggagacggagcatggcccaccctaacctggcggcagcgcaaaagatg

SEQ ID NO: 119106 - DNA, 103 bp, Artificial Sequence
  Synthetic Polynucleotide
taatacgactcactatagggtgcttaaagctctgctggggatagggtgggaacagaggagacccaccatgtccccagcaaacctggcggcagcgcaaaagatg

SEQ ID NO: 119107 - DNA, 103 bp, Artificial Sequence
  Synthetic Polynucleotide
taatacgactcactatagggatggtattcttgcttaaagctctgctggggaacagaggagaccccagatgagctttaagaacctggcggcagcgcaaaagatg

SEQ ID NO: 119108 - DNA, 103 bp, Artificial Sequence
  Synthetic Polynucleotide
taatacgactcactatagggacaggggatcatggtattcttgcttaaagcaacagaggagagctttaatgaagaataccaacctggcggcagcgcaaaagatg

SEQ ID NO: 119109 - DNA, 103 bp, Artificial Sequence
  Synthetic Polynucleotide
taatacgactcactataggggcctgttcatacaggggatcatggtattctaacagaggagaagaataatgtgatcccctaacctggcggcagcgcaaaagatg

SEQ ID NO: 119110 - DNA, 103 bp, Artificial Sequence
  Synthetic Polynucleotide
taatacgactcactatagggttcgcgcaagctcccatttccgggcgatttaacagaggagaaaatcgatgggaaatgggaacctggcggcagcgcaaaagatg

SEQ ID NO: 119111 - DNA, 103 bp, Artificial Sequence
  Synthetic Polynucleotide
taatacgactcactatagggtggctggcccgcctgttcatacaggggatcaacagaggagagatcccatgtatgaacagaacctggcggcagcgcaaaagatg

SEQ ID NO: 119112 - DNA, 103 bp, Artificial Sequence
  Synthetic Polynucleotide
taatacgactcactatagggggtccacggctggctggcccgcctgttcataacagaggagaatgaacatgcgggccagcaacctggcggcagcgcaaaagatg

SEQ ID NO: 119113 - DNA, 103 bp, Artificial Sequence
  Synthetic Polynucleotide
taatacgactcactatagggaccccaccctggtccacggctggctggcccaacagaggagagggccaatgagccgtggaaacctggcggcagcgcaaaagatg

SEQ ID NO: 119114 - DNA, 103 bp, Artificial Sequence
  Synthetic Polynucleotide
taatacgactcactataggggtgcccattgaccccaccctggtccacggcaacagaggagagccgtgatgcagggtgggaacctggcggcagcgcaaaagatg

SEQ ID NO: 119115 - DNA, 103 bp, Artificial Sequence
  Synthetic Polynucleotide
taatacgactcactatagggctgggtacctgtgcccattgaccccaccctaacagaggagaagggtgatgtcaatgggcaacctggcggcagcgcaaaagatg

SEQ ID NO: 119116 - DNA, 103 bp, Artificial Sequence
  Synthetic Polynucleotide
taatacgactcactatagggacccccgcccctgggtacctgtgcccattgaacagaggagacaatggatgcaggtacccaacctggcggcagcgcaaaagatg

SEQ ID NO: 119117 - DNA, 103 bp, Artificial Sequence
  Synthetic Polynucleotide
taatacgactcactatagggtttgatcaccacccccgcccctgggtacctaacagaggagaaggtacatgggggcggggaacctggcggcagcgcaaaagatg

SEQ ID NO: 119118 - DNA, 103 bp, Artificial Sequence
  Synthetic Polynucleotide
taatacgactcactatagggtctgttcctgtttgatcaccacccccgcccaacagaggagagggcggatgtggtgatcaaacctggcggcagcgcaaaagatg

SEQ ID NO: 119119 - DNA, 103 bp, Artificial Sequence
  Synthetic Polynucleotide
taatacgactcactataggggcgaagtccgtctgttcctgtttgatcaccaacagaggagaggtgatatgacaggaacaaacctggcggcagcgcaaaagatg

SEQ ID NO: 119120 - DNA, 103 bp, Artificial Sequence
  Synthetic Polynucleotide
taatacgactcactatagggtgagtcgtaggcgaagtccgtctgttcctgaacagaggagacaggaaatgacggacttcaacctggcggcagcgcaaaagatg

SEQ ID NO: 119121 - DNA, 103 bp, Artificial Sequence
  Synthetic Polynucleotide
taatacgactcactatagggcgatcagcgcttcgcgcaagctcccatttcaacagaggagagaaatgatggcttgcgcgaacctggcggcagcgcaaaagatg

SEQ ID NO: 119122 - DNA, 103 bp, Artificial Sequence
  Synthetic Polynucleotide
taatacgactcactatagggcggtgacatctgagtcgtaggcgaagtccgaacagaggagacggactatgcctacgactaacctggcggcagcgcaaaagatg

SEQ ID NO: 119123 - DNA, 103 bp, Artificial Sequence
  Synthetic Polynucleotide
taatacgactcactataggggatgcgcacccggtgacatctgagtcgtagaacagaggagactacgaatgagatgtcacaacctggcggcagcgcaaaagatg

SEQ ID NO: 119124 - DNA, 103 bp, Artificial Sequence
  Synthetic Polynucleotide
taatacgactcactataggggaggtacattgatgcgcacccggtgacatcaacagaggagagatgtcatggggtgcgcaaacctggcggcagcgcaaaagatg

SEQ ID NO: 119125 - DNA, 103 bp, Artificial Sequence
  Synthetic Polynucleotide
taatacgactcactatagggcctctgtgtggaggtacattgatgcgcaccaacagaggagaggtgcgatgcaatgtaccaacctggcggcagcgcaaaagatg

SEQ ID NO: 119126 - DNA, 103 bp, Artificial Sequence
  Synthetic Polynucleotide
taatacgactcactatagggccagagaagccctctgtgtggaggtacattaacagaggagaaatgtaatgccacacagaaacctggcggcagcgcaaaagatg

SEQ ID NO: 119127 - DNA, 103 bp, Artificial Sequence
  Synthetic Polynucleotide
taatacgactcactatagggtggagagggcccagagaagccctctgtgtgaacagaggagacacacaatgggcttctctaacctggcggcagcgcaaaagatg

SEQ ID NO: 119128 - DNA, 103 bp, Artificial Sequence
  Synthetic Polynucleotide
taatacgactcactatagggccccgtcacctggagagggcccagagaagcaacagaggagagcttctatgggccctctcaacctggcggcagcgcaaaagatg

SEQ ID NO: 119129 - DNA, 103 bp, Artificial Sequence
  Synthetic Polynucleotide
taatacgactcactatagggtagcccatggccccgtcacctggagagggcaacagaggagagccctcatgaggtgacggaacctggcggcagcgcaaaagatg

SEQ ID NO: 119130 - DNA, 103 bp, Artificial Sequence
  Synthetic Polynucleotide
taatacgactcactatagggctcatagccatagcccatggccccgtcaccaacagaggagaggtgacatggccatgggcaacctggcggcagcgcaaaagatg

SEQ ID NO: 119131 - DNA, 103 bp, Artificial Sequence
  Synthetic Polynucleotide
taatacgactcactataggggcagaggtttctcatagccatagcccatggaacagaggagaccatggatgatggctatgaacctggcggcagcgcaaaagatg

SEQ ID NO: 119132 - DNA, 103 bp, Artificial Sequence
  Synthetic Polynucleotide
taatacgactcactatagggcccagcgggccgatcagcgcttcgcgcaagaacagaggagacttgcgatgagcgctgataacctggcggcagcgcaaaagatg

SEQ ID NO: 119133 - DNA, 103 bp, Artificial Sequence
  Synthetic Polynucleotide
taatacgactcactataggggggaatggtcgcagaggtttctcatagccaaacagaggagatggctaatggaaacctctaacctggcggcagcgcaaaagatg

SEQ ID NO: 119134 - DNA, 103 bp, Artificial Sequence
  Synthetic Polynucleotide
taatacgactcactataggggacatcatctgggaatggtcgcagaggtttaacagaggagaaaacctatgcgaccattcaacctggcggcagcgcaaaagatg

SEQ ID NO: 119135 - DNA, 103 bp, Artificial Sequence
  Synthetic Polynucleotide
taatacgactcactatagggggacaacgcagacatcatctgggaatggtcaacagaggagagaccatatgcagatgatgaacctggcggcagcgcaaaagatg

SEQ ID NO: 119136 - DNA, 103 bp, Artificial Sequence
  Synthetic Polynucleotide
taatacgactcactatagggaatttctcagggacaacgcagacatcatctaacagaggagaagatgaatgctgcgttgtaacctggcggcagcgcaaaagatg

SEQ ID NO: 119137 - DNA, 103 bp, Artificial Sequence
  Synthetic Polynucleotide
taatacgactcactataggggtctccttcaaatttctcagggacaacgcaaacagaggagatgcgttatgcctgagaaaaacctggcggcagcgcaaaagatg

SEQ ID NO: 119138 - DNA, 103 bp, Artificial Sequence
  Synthetic Polynucleotide
taatacgactcactatagggcctgcttgatgtctccttcaaatttctcagaacagaggagactgagaatgttgaaggagaacctggcggcagcgcaaaagatg

SEQ ID NO: 119139 - DNA, 103 bp, Artificial Sequence
  Synthetic Polynucleotide
taatacgactcactatagggccgaccccttcctgcttgatgtctccttcaaacagaggagatgaaggatgcatcaagcaaacctggcggcagcgcaaaagatg

SEQ ID NO: 119140 - DNA, 103 bp, Artificial Sequence
  Synthetic Polynucleotide
taatacgactcactatagggtcgaaatgcaccgaccccttcctgcttgataacagaggagaatcaagatggaaggggtcaacctggcggcagcgcaaaagatg

SEQ ID NO: 119141 - DNA, 103 bp, Artificial Sequence
  Synthetic Polynucleotide
taatacgactcactataggggcggcccctctcgaaatgcaccgaccccttaacagaggagaaaggggatggtgcatttcaacctggcggcagcgcaaaagatg

SEQ ID NO: 119142 - DNA, 103 bp, Artificial Sequence
  Synthetic Polynucleotide
taatacgactcactatagggcgctggtagggcggcccctctcgaaatgcaaacagaggagatgcattatgagaggggccaacctggcggcagcgcaaaagatg

SEQ ID NO: 119143 - DNA, 103 bp, Artificial Sequence
  Synthetic Polynucleotide
taatacgactcactatagggagggacttgctgatcataaaacccgtccataacagaggagaatggacatgttttatgataacctggcggcagcgcaaaagatg

SEQ ID NO: 119144 - DNA, 103 bp, Artificial Sequence
  Synthetic Polynucleotide
taatacgactcactatagggagccagatctgtgtccaaaaacttcctcttaacagaggagaaagaggatgtttttggacaacctggcggcagcgcaaaagatg

SEQ ID NO: 119145 - DNA, 103 bp, Artificial Sequence
  Synthetic Polynucleotide
taatacgactcactatagggaacacaagtgtcgtcaaagtataatcggggaacagaggagaccccgaatgtactttgacaacctggcggcagcgcaaaagatg

SEQ ID NO: 119146 - DNA, 103 bp, Artificial Sequence
  Synthetic Polynucleotide
taatacgactcactatagggtctcaggcacaacacaagtgtcgtcaaagtaacagaggagaactttgatgacacttgtgaacctggcggcagcgcaaaagatg

SEQ ID NO: 119147 - DNA, 103 bp, Artificial Sequence
  Synthetic Polynucleotide
taatacgactcactatagggccttccagtctctcaggcacaacacaagtgaacagaggagacacttgatgtgtgcctgaaacctggcggcagcgcaaaagatg

SEQ ID NO: 119148 - DNA, 103 bp, Artificial Sequence
  Synthetic Polynucleotide
taatacgactcactatagggtttgactttgccttccagtctctcaggcacaacagaggagagtgcctatgagactggaaaacctggcggcagcgcaaaagatg

SEQ ID NO: 119149 - DNA, 103 bp, Artificial Sequence
  Synthetic Polynucleotide
taatacgactcactatagggtaggctcctgtttgactttgccttccagtcaacagaggagagactggatggcaaagtcaaacctggcggcagcgcaaaagatg

SEQ ID NO: 119150 - DNA, 103 bp, Artificial Sequence
  Synthetic Polynucleotide
taatacgactcactatagggcgatacatggtaggctcctgtttgactttgaacagaggagacaaagtatgacaggagccaacctggcggcagcgcaaaagatg

SEQ ID NO: 119151 - DNA, 103 bp, Artificial Sequence
  Synthetic Polynucleotide
taatacgactcactataggggggcccctctcgatacatggtaggctcctgaacagaggagacaggagatgaccatgtataacctggcggcagcgcaaaagatg

SEQ ID NO: 119152 - DNA, 103 bp, Artificial Sequence
  Synthetic Polynucleotide
taatacgactcactatagggtctggtaagggggcccctctcgatacatggaacagaggagaccatgtatggagaggggcaacctggcggcagcgcaaaagatg

SEQ ID NO: 119153 - DNA, 103 bp, Artificial Sequence
  Synthetic Polynucleotide
taatacgactcactataggggaacctcgcctctggtaagggggcccctctaacagaggagaagagggatgcccttaccaaacctggcggcagcgcaaaagatg

SEQ ID NO: 119154 - DNA, 103 bp, Artificial Sequence
  Synthetic Polynucleotide
taatacgactcactatagggcagctgaagggaacctcgcctctggtaaggaacagaggagaccttacatgaggcgaggtaacctggcggcagcgcaaaagatg

SEQ ID NO: 119155 - DNA, 103 bp, Artificial Sequence
  Synthetic Polynucleotide
taatacgactcactatagggcagaatcgtgagccagatctgtgtccaaaaaacagaggagattttggatgcagatctggaacctggcggcagcgcaaaagatg

SEQ ID NO: 119156 - DNA, 103 bp, Artificial Sequence
  Synthetic Polynucleotide
taatacgactcactatagggggaactgccacagctgaagggaacctcgccaacagaggagaggcgagatgcccttcagcaacctggcggcagcgcaaaagatg

SEQ ID NO: 119157 - DNA, 103 bp, Artificial Sequence
  Synthetic Polynucleotide
taatacgactcactatagggagggtgaccaggaactgccacagctgaaggaacagaggagaccttcaatggtggcagttaacctggcggcagcgcaaaagatg

SEQ ID NO: 119158 - DNA, 103 bp, Artificial Sequence
  Synthetic Polynucleotide
taatacgactcactataggggtcatcaagaagggtgaccaggaactgccaaacagaggagatggcagatgctggtcaccaacctggcggcagcgcaaaagatg

SEQ ID NO: 119159 - DNA, 103 bp, Artificial Sequence
  Synthetic Polynucleotide
taatacgactcactatagggcattggctgggtcatcaagaagggtgaccaaacagaggagatggtcaatgttcttgatgaacctggcggcagcgcaaaagatg

SEQ ID NO: 119160 - DNA, 103 bp, Artificial Sequence
  Synthetic Polynucleotide
taatacgactcactatagggatgaagtgggcattggctgggtcatcaagaaacagaggagatcttgaatgcccagccaaaacctggcggcagcgcaaaagatg

SEQ ID NO: 119161 - DNA, 103 bp, Artificial Sequence
  Synthetic Polynucleotide
taatacgactcactatagggtgtccaggcaatgaagtgggcattggctggaacagaggagaccagccatggcccacttcaacctggcggcagcgcaaaagatg

SEQ ID NO: 119162 - DNA, 103 bp, Artificial Sequence
  Synthetic Polynucleotide
taatacgactcactatagggtgcctcgacctgtccaggcaatgaagtgggaacagaggagacccactatgttgcctggaaacctggcggcagcgcaaaagatg

SEQ ID NO: 119163 - DNA, 103 bp, Artificial Sequence
  Synthetic Polynucleotide
taatacgactcactatagggttgaactccatgcctcgacctgtccaggcaaacagaggagatgcctgatgaggtcgaggaacctggcggcagcgcaaaagatg

SEQ ID NO: 119164 - DNA, 103 bp, Artificial Sequence
  Synthetic Polynucleotide
taatacgactcactatagggttctatcagcttgaactccatgcctcgaccaacagaggagaggtcgaatgatggagttcaacctggcggcagcgcaaaagatg

SEQ ID NO: 119165 - DNA, 103 bp, Artificial Sequence
  Synthetic Polynucleotide
taatacgactcactatagggcctcttccggttctatcagcttgaactccaaacagaggagatggagtatgagctgatagaacctggcggcagcgcaaaagatg

SEQ ID NO: 119166 - DNA, 103 bp, Artificial Sequence
  Synthetic Polynucleotide
taatacgactcactatagggaatagctcttcagaatcgtgagccagatctaacagaggagaagatctatgtcacgattcaacctggcggcagcgcaaaagatg

SEQ ID NO: 119167 - DNA, 103 bp, Artificial Sequence
  Synthetic Polynucleotide
taatacgactcactatagggcgccgagcaacctcttccggttctatcagcaacagaggagagctgatatgaccggaagaaacctggcggcagcgcaaaagatg

SEQ ID NO: 119168 - DNA, 103 bp, Artificial Sequence
  Synthetic Polynucleotide
taatacgactcactataggggatgccccagcgccgagcaacctcttccggaacagaggagaccggaaatggttgctcggaacctggcggcagcgcaaaagatg

SEQ ID NO: 119169 - DNA, 103 bp, Artificial Sequence
  Synthetic Polynucleotide
taatacgactcactatagggggttcttctggatgccccagcgccgagcaaaacagaggagattgctcatggctggggcaaacctggcggcagcgcaaaagatg

SEQ ID NO: 119170 - DNA, 103 bp, Artificial Sequence
  Synthetic Polynucleotide
taatacgactcactatagggatggctggccggttcttctggatgccccagaacagaggagactggggatgccagaagaaaacctggcggcagcgcaaaagatg

SEQ ID NO: 119171 - DNA, 103 bp, Artificial Sequence
  Synthetic Polynucleotide
taatacgactcactataggggtcatagttcatggctggccggttcttctgaacagaggagacagaagatgcggccagccaacctggcggcagcgcaaaagatg

SEQ ID NO: 119172 - DNA, 103 bp, Artificial Sequence
  Synthetic Polynucleotide
taatacgactcactatagggggctcagcttgtcatagttcatggctggccaacagaggagaggccagatgtgaactatgaacctggcggcagcgcaaaagatg

SEQ ID NO: 119173 - DNA, 103 bp, Artificial Sequence
  Synthetic Polynucleotide
taatacgactcactatagggcggagagagcggctcagcttgtcatagttcaacagaggagagaactaatgcaagctgagaacctggcggcagcgcaaaagatg

SEQ ID NO: 119174 - DNA, 103 bp, Artificial Sequence
  Synthetic Polynucleotide
taatacgactcactatagggatagtaatagcggagagagcggctcagcttaacagaggagaaagctgatgcgctctctcaacctggcggcagcgcaaaagatg

SEQ ID NO: 119175 - DNA, 103 bp, Artificial Sequence
  Synthetic Polynucleotide
taatacgactcactatagggtgcccttttcatagtaatagcggagagagcaacagaggagagctctcatggctattactaacctggcggcagcgcaaaagatg

SEQ ID NO: 119176 - DNA, 103 bp, Artificial Sequence
  Synthetic Polynucleotide
taatacgactcactatagggttctgcatgatgcccttttcatagtaatagaacagaggagactattaatgtgaaaagggaacctggcggcagcgcaaaagatg

SEQ ID NO: 119177 - DNA, 103 bp, Artificial Sequence
  Synthetic Polynucleotide
taatacgactcactataggggagatcctgaaatagctcttcagaatcgtgaacagaggagacacgatatggaagagctaaacctggcggcagcgcaaaagatg

SEQ ID NO: 119178 - DNA, 103 bp, Artificial Sequence
  Synthetic Polynucleotide
taatacgactcactatagggtccagccaccttctgcatgatgcccttttcaacagaggagagaaaagatgatcatgcagaacctggcggcagcgcaaaagatg

SEQ ID NO: 119179 - DNA, 103 bp, Artificial Sequence
  Synthetic Polynucleotide
taatacgactcactatagggcgtatcgctctccagccaccttctgcatgaaacagaggagatcatgcatgaggtggctgaacctggcggcagcgcaaaagatg

SEQ ID NO: 119180 - DNA, 103 bp, Artificial Sequence
  Synthetic Polynucleotide
taatacgactcactatagggaatttgtagacgtatcgctctccagccaccaacagaggagaggtggcatgagagcgataaacctggcggcagcgcaaaagatg

SEQ ID NO: 119181 - DNA, 103 bp, Artificial Sequence
  Synthetic Polynucleotide
taatacgactcactataggggtcacagacaaatttgtagacgtatcgctcaacagaggagagagcgaatggtctacaaaaacctggcggcagcgcaaaagatg

SEQ ID NO: 119182 - DNA, 103 bp, Artificial Sequence
  Synthetic Polynucleotide
taatacgactcactataggggggcatctgggtcacagacaaatttgtagaaacagaggagatctacaatgttgtctgtgaacctggcggcagcgcaaaagatg

SEQ ID NO: 119183 - DNA, 103 bp, Artificial Sequence
  Synthetic Polynucleotide
taatacgactcactatagggatggagaagagggcatctgggtcacagacaaacagaggagatgtctgatgcccagatgcaacctggcggcagcgcaaaagatg

SEQ ID NO: 119184 - DNA, 103 bp, Artificial Sequence
  Synthetic Polynucleotide
taatacgactcactatagggcgggaaagccatggagaagagggcatctggaacagaggagaccagatatgctcttctccaacctggcggcagcgcaaaagatg

SEQ ID NO: 119185 - DNA, 103 bp, Artificial Sequence
  Synthetic Polynucleotide
taatacgactcactataggggctggttatccgggaaagccatggagaagaaacagaggagatcttctatgtggctttccaacctggcggcagcgcaaaagatg

SEQ ID NO: 119186 - DNA, 103 bp, Artificial Sequence
  Synthetic Polynucleotide
taatacgactcactatagggaggaacggacgctggttatccgggaaagccaacagaggagaggctttatgggataaccaaacctggcggcagcgcaaaagatg

SEQ ID NO: 119187 - DNA, 103 bp, Artificial Sequence
  Synthetic Polynucleotide
taatacgactcactatagggctctgccttcaggaacggacgctggttatcaacagaggagagataacatgcgtccgttcaacctggcggcagcgcaaaagatg

SEQ ID NO: 119188 - DNA, 103 bp, Artificial Sequence
  Synthetic Polynucleotide
taatacgactcactataggggaagttgactgagatcctgaaatagctcttaacagaggagaaagagcatgttcaggatcaacctggcggcagcgcaaaagatg

SEQ ID NO: 119189 - DNA, 103 bp, Artificial Sequence
  Synthetic Polynucleotide
taatacgactcactatagggggcactcggactctgccttcaggaacggacaacagaggagagtccgtatgtgaaggcagaacctggcggcagcgcaaaagatg

SEQ ID NO: 119190 - DNA, 103 bp, Artificial Sequence
  Synthetic Polynucleotide
taatacgactcactatagggtcgctgaggtggcactcggactctgccttcaacagaggagagaaggcatggtccgagtgaacctggcggcagcgcaaaagatg

SEQ ID NO: 119191 - DNA, 103 bp, Artificial Sequence
  Synthetic Polynucleotide
taatacgactcactatagggggtgtcctcctcgctgaggtggcactcggaaacagaggagatccgagatgcacctcagcaacctggcggcagcgcaaaagatg

SEQ ID NO: 119192 - DNA, 103 bp, Artificial Sequence
  Synthetic Polynucleotide
taatacgactcactatagggtcagcggcagggtgtcctcctcgctgaggtaacagaggagaacctcaatgaggaggacaaacctggcggcagcgcaaaagatg

SEQ ID NO: 119193 - DNA, 103 bp, Artificial Sequence
  Synthetic Polynucleotide
taatacgactcactatagggtcaaagtgggtcagcggcagggtgtcctccaacagaggagaggaggaatgcctgccgctaacctggcggcagcgcaaaagatg

SEQ ID NO: 119194 - DNA, 103 bp, Artificial Sequence
  Synthetic Polynucleotide
taatacgactcactatagggggggctgtcttcaaagtgggtcagcggcagaacagaggagactgccgatgacccactttaacctggcggcagcgcaaaagatg

SEQ ID NO: 119195 - DNA, 103 bp, Artificial Sequence
  Synthetic Polynucleotide
taatacgactcactatagggggaggtaagcggggctgtcttcaaagtgggaacagaggagacccactatgaagacagccaacctggcggcagcgcaaaagatg

SEQ ID NO: 119196 - DNA, 103 bp, Artificial Sequence
  Synthetic Polynucleotide
taatacgactcactatagggtccatgtccaggaggtaagcggggctgtctaacagaggagaagacagatgcgcttacctaacctggcggcagcgcaaaagatg

SEQ ID NO: 119197 - DNA, 103 bp, Artificial Sequence
  Synthetic Polynucleotide
taatacgactcactataggggctgcagcggtccatgtccaggaggtaagcaacagaggagagcttacatgctggacatgaacctggcggcagcgcaaaagatg

SEQ ID NO: 119198 - DNA, 103 bp, Artificial Sequence
  Synthetic Polynucleotide
taatacgactcactatagggaggggaggctgctgcagcggtccatgtccaaacagaggagatggacaatgaccgctgcaaacctggcggcagcgcaaaagatg

SEQ ID NO: 119199 - DNA, 103 bp, Artificial Sequence
  Synthetic Polynucleotide
taatacgactcactatagggcaagcctcttgaagttgactgagatcctgaaacagaggagatcaggaatgcagtcaactaacctggcggcagcgcaaaagatg

SEQ ID NO: 119200 - DNA, 103 bp, Artificial Sequence
  Synthetic Polynucleotide
taatacgactcactatagggccttcggcataggggaggctgctgcagcggaacagaggagaccgctgatgcagcctcccaacctggcggcagcgcaaaagatg

SEQ ID NO: 119201 - DNA, 103 bp, Artificial Sequence
  Synthetic Polynucleotide
taatacgactcactataggggtaagcaaagccttcggcataggggaggctaacagaggagaagcctcatgtatgccgaaaacctggcggcagcgcaaaagatg

SEQ ID NO: 119202 - DNA, 103 bp, Artificial Sequence
  Synthetic Polynucleotide
taatacgactcactatagggttcagctaaccaagcctcttgaagttgactaacagaggagaagtcaaatgcaagaggctaacctggcggcagcgcaaaagatg

SEQ ID NO: 119203 - DNA, 103 bp, Artificial Sequence
  Synthetic Polynucleotide
taatacgactcactataggggaacttgtgcttcagctaaccaagcctcttaacagaggagaaagaggatgggttagctgaacctggcggcagcgcaaaagatg

SEQ ID NO: 119204 - DNA, 103 bp, Artificial Sequence
  Synthetic Polynucleotide
taatacgactcactatagggtcatcatcaggaacttgtgcttcagctaacaacagaggagagttagcatgagcacaagtaacctggcggcagcgcaaaagatg

SEQ ID NO: 119205 - DNA, 103 bp, Artificial Sequence
  Synthetic Polynucleotide
taatacgactcactataggggacaaactgttcatcatcaggaacttgtgcaacagaggagagcacaaatgcctgatgataacctggcggcagcgcaaaagatg

SEQ ID NO: 119206 - DNA, 103 bp, Artificial Sequence
  Synthetic Polynucleotide
taatacgactcactatagggggaccataaaagggacttgctgatcataaaaacagaggagatttatgatgagcaagtccaacctggcggcagcgcaaaagatg

SEQ ID NO: 119207 - DNA, 103 bp, Artificial Sequence
  Synthetic Polynucleotide
taatacgactcactataggggaaaatctgggacaaactgttcatcatcagaacagaggagactgatgatgaacagtttgaacctggcggcagcgcaaaagatg

SEQ ID NO: 119208 - DNA, 103 bp, Artificial Sequence
  Synthetic Polynucleotide
taatacgactcactatagggttatcagactgaaaatctgggacaaactgtaacagaggagaacagttatgcccagatttaacctggcggcagcgcaaaagatg

SEQ ID NO: 119209 - DNA, 103 bp, Artificial Sequence
  Synthetic Polynucleotide
taatacgactcactatagggaagcaccaggttatcagactgaaaatctggaacagaggagaccagatatgcagtctgataacctggcggcagcgcaaaagatg

SEQ ID NO: 119210 - DNA, 103 bp, Artificial Sequence
  Synthetic Polynucleotide
taatacgactcactataggggtggggcatgaagcaccaggttatcagactaacagaggagaagtctgatgacctggtgcaacctggcggcagcgcaaaagatg

SEQ ID NO: 119211 - DNA, 103 bp, Artificial Sequence
  Synthetic Polynucleotide
taatacgactcactatagggttggttggaggtggggcatgaagcaccaggaacagaggagacctggtatgtcatgccccaacctggcggcagcgcaaaagatg

SEQ ID NO: 119212 - DNA, 103 bp, Artificial Sequence
  Synthetic Polynucleotide
taatacgactcactatagggccgtttgatcttggttggaggtggggcatgaacagaggagacatgccatgcctccaaccaacctggcggcagcgcaaaagatg

SEQ ID NO: 119213 - DNA, 103 bp, Artificial Sequence
  Synthetic Polynucleotide
taatacgactcactatagggtgtgcagctcccgtttgatcttggttggagaacagaggagactccaaatgagatcaaacaacctggcggcagcgcaaaagatg

SEQ ID NO: 119214 - DNA, 103 bp, Artificial Sequence
  Synthetic Polynucleotide
taatacgactcactataggggaggaggggctgtgcagctcccgtttgatcaacagaggagagatcaaatgggagctgcaaacctggcggcagcgcaaaagatg

SEQ ID NO: 119215 - DNA, 103 bp, Artificial Sequence
  Synthetic Polynucleotide
taatacgactcactatagggcgacagctcagaggaggggctgtgcagctcaacagaggagagagctgatgagcccctccaacctggcggcagcgcaaaagatg

SEQ ID NO: 119216 - DNA, 103 bp, Artificial Sequence
  Synthetic Polynucleotide
taatacgactcactatagggggctacaagacgacagctcagaggaggggcaacagaggagagcccctatgctgagctgtaacctggcggcagcgcaaaagatg

SEQ ID NO: 119217 - DNA, 103 bp, Artificial Sequence
  Synthetic Polynucleotide
taatacgactcactataggggatttccctgggaccataaaagggacttgcaacagaggagagcaagtatgttttatggtaacctggcggcagcgcaaaagatg

SEQ ID NO: 119218 - DNA, 103 bp, Artificial Sequence
  Synthetic Polynucleotide
taatacgactcactataggggcctgctcatggctacaagacgacagctcaaacagaggagatgagctatggtcttgtagaacctggcggcagcgcaaaagatg

SEQ ID NO: 119219 - DNA, 103 bp, Artificial Sequence
  Synthetic Polynucleotide
taatacgactcactatagggagcaccaagagcctgctcatggctacaagaaacagaggagatcttgtatgcatgagcagaacctggcggcagcgcaaaagatg

SEQ ID NO: 119220 - DNA, 103 bp, Artificial Sequence
  Synthetic Polynucleotide
taatacgactcactatagggctccatagttagcaccaagagcctgctcataacagaggagaatgagcatgctcttggtgaacctggcggcagcgcaaaagatg

SEQ ID NO: 119221 - DNA, 103 bp, Artificial Sequence
  Synthetic Polynucleotide
taatacgactcactatagggaggcacttttctccatagttagcaccaagaaacagaggagatcttggatgtaactatggaacctggcggcagcgcaaaagatg

SEQ ID NO: 119222 - DNA, 103 bp, Artificial Sequence
  Synthetic Polynucleotide
taatacgactcactatagggatagttgtagaggcacttttctccatagttaacagaggagaaactatatggaaaagtgcaacctggcggcagcgcaaaagatg

SEQ ID NO: 119223 - DNA, 103 bp, Artificial Sequence
  Synthetic Polynucleotide
taatacgactcactatagggcataggcacaatagttgtagaggcacttttaacagaggagaaaaagtatgtctacaactaacctggcggcagcgcaaaagatg

SEQ ID NO: 119224 - DNA, 103 bp, Artificial Sequence
  Synthetic Polynucleotide
taatacgactcactatagggggcttcctatcataggcacaatagttgtagaacagaggagactacaaatgttgtgcctaaacctggcggcagcgcaaaagatg

SEQ ID NO: 119225 - DNA, 103 bp, Artificial Sequence
  Synthetic Polynucleotide
taatacgactcactatagggcccagagggaggcttcctatcataggcacaaacagaggagatgtgccatggataggaagaacctggcggcagcgcaaaagatg

SEQ ID NO: 119226 - DNA, 103 bp, Artificial Sequence
  Synthetic Polynucleotide
taatacgactcactatagggatggcttgaacccagagggaggcttcctataacagaggagaataggaatgctccctctgaacctggcggcagcgcaaaagatg

SEQ ID NO: 119227 - DNA, 103 bp, Artificial Sequence
  Synthetic Polynucleotide
taatacgactcactatagggggaggggttaatggcttgaacccagagggaaacagaggagatccctcatggttcaagccaacctggcggcagcgcaaaagatg

SEQ ID NO: 119228 - DNA, 103 bp, Artificial Sequence
  Synthetic Polynucleotide
taatacgactcactatagggctcagatcgagatttccctgggaccataaaaacagaggagatttatgatgccagggaaaaacctggcggcagcgcaaaagatg

SEQ ID NO: 119229 - DNA, 103 bp, Artificial Sequence
  Synthetic Polynucleotide
taatacgactcactataggggggggttgtaggaggggttaatggcttgaaaacagaggagattcaagatgttaacccctaacctggcggcagcgcaaaagatg

SEQ ID NO: 119230 - DNA, 103 bp, Artificial Sequence
  Synthetic Polynucleotide
taatacgactcactatagggtgggtgagaggggggttgtaggaggggttaaacagaggagataacccatgctacaacccaacctggcggcagcgcaaaagatg

SEQ ID NO: 119231 - DNA, 103 bp, Artificial Sequence
  Synthetic Polynucleotide
taatacgactcactatagggttctgatgggtgggtgagaggggggttgtaaacagaggagatacaacatgcctctcaccaacctggcggcagcgcaaaagatg

SEQ ID NO: 119232 - DNA, 103 bp, Artificial Sequence
  Synthetic Polynucleotide
taatacgactcactatagggaaataggggattctgatgggtgggtgagagaacagaggagactctcaatgacccatcagaacctggcggcagcgcaaaagatg

SEQ ID NO: 119233 - DNA, 103 bp, Artificial Sequence
  Synthetic Polynucleotide
taatacgactcactataggggaggtgggggaaataggggattctgatgggaacagaggagacccatcatgatcccctataacctggcggcagcgcaaaagatg

SEQ ID NO: 119234 - DNA, 103 bp, Artificial Sequence
  Synthetic Polynucleotide
taatacgactcactatagggagagttgcctgaggtgggggaaataggggaaacagaggagatcccctatgtcccccaccaacctggcggcagcgcaaaagatg

SEQ ID NO: 119235 - DNA, 103 bp, Artificial Sequence
  Synthetic Polynucleotide
taatacgactcactatagggtgaggtgggcagagttgcctgaggtgggggaacagaggagacccccaatgcaggcaactaacctggcggcagcgcaaaagatg

SEQ ID NO: 119236 - DNA, 103 bp, Artificial Sequence
  Synthetic Polynucleotide
taatacgactcactataggggggcatgccctgaggtgggcagagttgcctaacagaggagaaggcaaatgtgcccacctaacctggcggcagcgcaaaagatg

SEQ ID NO: 119237 - DNA, 103 bp, Artificial Sequence
  Synthetic Polynucleotide
taatacgactcactatagggccagctgcaggggcatgccctgaggtgggcaacagaggagagcccacatgagggcatgcaacctggcggcagcgcaaaagatg

SEQ ID NO: 119238 - DNA, 103 bp, Artificial Sequence
  Synthetic Polynucleotide
taatacgactcactatagggttgaactgggccagctgcaggggcatgcccaacagaggagagggcatatgcctgcagctaacctggcggcagcgcaaaagatg

SEQ ID NO: 119239 - DNA, 103 bp, Artificial Sequence
  Synthetic Polynucleotide
taatacgactcactatagggctctgcattcctcagatcgagatttccctgaacagaggagacagggaatgctcgatctgaacctggcggcagcgcaaaagatg

SEQ ID NO: 119240 - DNA, 103 bp, Artificial Sequence
  Synthetic Polynucleotide
taatacgactcactatagggggcccacaccttgaactgggccagctgcagaacagaggagactgcagatggcccagttcaacctggcggcagcgcaaaagatg

SEQ ID NO: 119241 - DNA, 103 bp, Artificial Sequence
  Synthetic Polynucleotide
taatacgactcactataggggcgggggcggggcccacaccttgaactgggaacagaggagacccagtatgaggtgtgggaacctggcggcagcgcaaaagatg

SEQ ID NO: 119242 - DNA, 103 bp, Artificial Sequence
  Synthetic Polynucleotide
taatacgactcactatagggcgaatggggggcgggggcggggcccacaccaacagaggagaggtgtgatgcccgcccccaacctggcggcagcgcaaaagatg

SEQ ID NO: 119243 - DNA, 103 bp, Artificial Sequence
  Synthetic Polynucleotide
taatacgactcactataggggctctggaagcgaatggggggcgggggcggaacagaggagaccgcccatgccccccattaacctggcggcagcgcaaaagatg

SEQ ID NO: 119244 - DNA, 103 bp, Artificial Sequence
  Synthetic Polynucleotide
taatacgactcactatagggtgtggtccaggctctggaagcgaatgggggaacagaggagacccccaatggcttccagaaacctggcggcagcgcaaaagatg

SEQ ID NO: 119245 - DNA, 103 bp, Artificial Sequence
  Synthetic Polynucleotide
taatacgactcactatagggtgtttgctgctgtggtccaggctctggaagaacagaggagacttccaatgcctggaccaaacctggcggcagcgcaaaagatg

SEQ ID NO: 119246 - DNA, 103 bp, Artificial Sequence
  Synthetic Polynucleotide
taatacgactcactatagggggaccgcaaatgtttgctgctgtggtccagaacagaggagactggacatgagcagcaaaaacctggcggcagcgcaaaagatg

SEQ ID NO: 119247 - DNA, 103 bp, Artificial Sequence
  Synthetic Polynucleotide
taatacgactcactatagggggtggtcgggggaccgcaaatgtttgctgcaacagaggagagcagcaatgatttgcggtaacctggcggcagcgcaaaagatg

SEQ ID NO: 119248 - DNA, 103 bp, Artificial Sequence
  Synthetic Polynucleotide
taatacgactcactataggggggctgatgtggtggtcgggggaccgcaaaaacagaggagatttgcgatgccccgaccaaacctggcggcagcgcaaaagatg

SEQ ID NO: 119249 - DNA, 103 bp, Artificial Sequence
  Synthetic Polynucleotide
taatacgactcactataggggcatctgcaggggctgatgtggtggtcgggaacagaggagacccgacatgcacatcagcaacctggcggcagcgcaaaagatg

SEQ ID NO: 119250 - DNA, 103 bp, Artificial Sequence
  Synthetic Polynucleotide
taatacgactcactatagggacaggccgccctctgcattcctcagatcgaaacagaggagatcgatcatgggaatgcagaacctggcggcagcgcaaaagatg

SEQ ID NO: 119251 - DNA, 103 bp, Artificial Sequence
  Synthetic Polynucleotide
taatacgactcactatagggatcatctttggcatctgcaggggctgatgtaacagaggagaacatcaatgcctgcagataacctggcggcagcgcaaaagatg

SEQ ID NO: 119252 - DNA, 103 bp, Artificial Sequence
  Synthetic Polynucleotide
taatacgactcactataggggttttcaggcatcatctttggcatctgcagaacagaggagactgcagatgccaaagatgaacctggcggcagcgcaaaagatg

SEQ ID NO: 119253 - DNA, 103 bp, Artificial Sequence
  Synthetic Polynucleotide
taatacgactcactatagggatggatactggttttcaggcatcatctttgaacagaggagacaaagaatgtgcctgaaaaacctggcggcagcgcaaaagatg

SEQ ID NO: 119254 - DNA, 103 bp, Artificial Sequence
  Synthetic Polynucleotide
taatacgactcactatagggctctgttctgatggatactggttttcaggcaacagaggagagcctgaatgccagtatccaacctggcggcagcgcaaaagatg

SEQ ID NO: 119255 - DNA, 103 bp, Artificial Sequence
  Synthetic Polynucleotide
taatacgactcactatagggtctctgaaatctctgttctgatggatactgaacagaggagacagtatatgtcagaacagaacctggcggcagcgcaaaagatg

SEQ ID NO: 119256 - DNA, 103 bp, Artificial Sequence
  Synthetic Polynucleotide
taatacgactcactatagggcagacagttgtctctgaaatctctgttctgaacagaggagacagaacatggatttcagaaacctggcggcagcgcaaaagatg

SEQ ID NO: 119257 - DNA, 103 bp, Artificial Sequence
  Synthetic Polynucleotide
taatacgactcactatagggtggcagggttcagacagttgtctctgaaataacagaggagaatttcaatgacaactgtcaacctggcggcagcgcaaaagatg

SEQ ID NO: 119258 - DNA, 103 bp, Artificial Sequence
  Synthetic Polynucleotide
taatacgactcactatagggagggaaggggtggcagggttcagacagttgaacagaggagacaactgatggaaccctgcaacctggcggcagcgcaaaagatg

SEQ ID NO: 119259 - DNA, 103 bp, Artificial Sequence
  Synthetic Polynucleotide
taatacgactcactatagggctggctgaggagggaaggggtggcagggttaacagaggagaaaccctatgaccccttccaacctggcggcagcgcaaaagatg

SEQ ID NO: 119260 - DNA, 103 bp, Artificial Sequence
  Synthetic Polynucleotide
taatacgactcactatagggccaggaactcctggctgaggagggaaggggaacagaggagaccccttatgtcctcagccaacctggcggcagcgcaaaagatg

SEQ ID NO: 119261 - DNA, 103 bp, Artificial Sequence
  Synthetic Polynucleotide
taatacgactcactatagggtctgtcaatcacaggccgccctctgcattcaacagaggagagaatgcatggggcggcctaacctggcggcagcgcaaaagatg

SEQ ID NO: 119262 - DNA, 103 bp, Artificial Sequence
  Synthetic Polynucleotide
taatacgactcactataggggcgattatctccaggaactcctggctgaggaacagaggagacctcagatgggagttcctaacctggcggcagcgcaaaagatg

SEQ ID NO: 119263 - DNA, 103 bp, Artificial Sequence
  Synthetic Polynucleotide
taatacgactcactatagggggtaactggggcgattatctccaggaactcaacagaggagagagttcatggagataatcaacctggcggcagcgcaaaagatg

SEQ ID NO: 119264 - DNA, 103 bp, Artificial Sequence
  Synthetic Polynucleotide
taatacgactcactatagggatttgccgatggtaactggggcgattatctaacagaggagaagataaatgccccagttaaacctggcggcagcgcaaaagatg

SEQ ID NO: 119265 - DNA, 103 bp, Artificial Sequence
  Synthetic Polynucleotide
taatacgactcactatagggaggttctgacatttgccgatggtaactgggaacagaggagacccagtatgcatcggcaaaacctggcggcagcgcaaaagatg

SEQ ID NO: 119266 - DNA, 103 bp, Artificial Sequence
  Synthetic Polynucleotide
taatacgactcactatagggcagggacaataggttctgacatttgccgataacagaggagaatcggcatgtgtcagaacaacctggcggcagcgcaaaagatg

SEQ ID NO: 119267 - DNA, 103 bp, Artificial Sequence
  Synthetic Polynucleotide
taatacgactcactataggggggggagctgcagggacaataggttctgacaacagaggagagtcagaatgtattgtcccaacctggcggcagcgcaaaagatg

SEQ ID NO: 119268 - DNA, 103 bp, Artificial Sequence
  Synthetic Polynucleotide
taatacgactcactatagggctgagggggcgggggagctgcagggacaataacagaggagaattgtcatggcagctcccaacctggcggcagcgcaaaagatg

SEQ ID NO: 119269 - DNA, 103 bp, Artificial Sequence
  Synthetic Polynucleotide
taatacgactcactataggggtttgaatccctgagggggcgggggagctgaacagaggagacagctcatgcgccccctcaacctggcggcagcgcaaaagatg

SEQ ID NO: 119270 - DNA, 103 bp, Artificial Sequence
  Synthetic Polynucleotide
taatacgactcactatagggtggtattcttgtttgaatccctgagggggcaacagaggagagcccccatggggattcaaaacctggcggcagcgcaaaagatg

SEQ ID NO: 119271 - DNA, 103 bp, Artificial Sequence
  Synthetic Polynucleotide
taatacgactcactataggggagtgggtcatggtattcttgtttgaatccaacagaggagaggattcatgcaagaatacaacctggcggcagcgcaaaagatg

SEQ ID NO: 119272 - DNA, 103 bp, Artificial Sequence
  Synthetic Polynucleotide
taatacgactcactatagggacttcctctttctgtcaatcacaggccgccaacagaggagaggcggcatgtgattgacaaacctggcggcagcgcaaaagatg

SEQ ID NO: 119273 - DNA, 103 bp, Artificial Sequence
  Synthetic Polynucleotide
taatacgactcactatagggcatgttcatagagtgggtcatggtattcttaacagaggagaaagaatatgatgacccacaacctggcggcagcgcaaaagatg

SEQ ID NO: 119274 - DNA, 103 bp, Artificial Sequence
  Synthetic Polynucleotide
taatacgactcactatagggcccgggaccccatgttcatagagtgggtcaaacagaggagatgacccatgctatgaacaaacctggcggcagcgcaaaagatg

SEQ ID NO: 119275 - DNA, 103 bp, Artificial Sequence
  Synthetic Polynucleotide
taatacgactcactatagggccctggcatgcccgggaccccatgttcataaacagaggagatatgaaatgggggtcccgaacctggcggcagcgcaaaagatg

SEQ ID NO: 119276 - DNA, 103 bp, Artificial Sequence
  Synthetic Polynucleotide
taatacgactcactataggggtgctgggggccctggcatgcccgggacccaacagaggagagggtccatggcatgccagaacctggcggcagcgcaaaagatg

SEQ ID NO: 119277 - DNA, 103 bp, Artificial Sequence
  Synthetic Polynucleotide
taatacgactcactatagggtggaacccgtgtgctgggggccctggcatgaacagaggagacatgccatggcccccagcaacctggcggcagcgcaaaagatg

SEQ ID NO: 119278 - DNA, 103 bp, Artificial Sequence
  Synthetic Polynucleotide
taatacgactcactatagggcattggtgactggaacccgtgtgctgggggaacagaggagacccccaatgcacgggttcaacctggcggcagcgcaaaagatg

SEQ ID NO: 119279 - DNA, 103 bp, Artificial Sequence
  Synthetic Polynucleotide
taatacgactcactataggggcttgattcccattggtgactggaacccgtaacagaggagaacgggtatgagtcaccaaaacctggcggcagcgcaaaagatg

SEQ ID NO: 119280 - DNA, 103 bp, Artificial Sequence
  Synthetic Polynucleotide
taatacgactcactatagggcgaggctcctgcttgattcccattggtgacaacagaggagagtcaccatggggaatcaaaacctggcggcagcgcaaaagatg

SEQ ID NO: 119281 - DNA, 103 bp, Artificial Sequence
  Synthetic Polynucleotide
taatacgactcactataggggcagtaatcccgaggctcctgcttgattccaacagaggagaggaatcatgcaggagcctaacctggcggcagcgcaaaagatg

SEQ ID NO: 119282 - DNA, 103 bp, Artificial Sequence
  Synthetic Polynucleotide
taatacgactcactatagggctgaatcgacgcagtaatcccgaggctcctaacagaggagaaggagcatggggattactaacctggcggcagcgcaaaagatg

SEQ ID NO: 119283 - DNA, 103 bp, Artificial Sequence
  Synthetic Polynucleotide
taatacgactcactataggggtgtccaaaaacttcctctttctgtcaatcaacagaggagagattgaatgaaagaggaaaacctggcggcagcgcaaaagatg

SEQ ID NO: 119284 - DNA, 103 bp, Artificial Sequence
  Synthetic Polynucleotide
taatacgactcactatagggttaggcacttctgaatcgacgcagtaatccaacagaggagaggattaatgcgtcgattcaacctggcggcagcgcaaaagatg

SEQ ID NO: 119285 - DNA, 103 bp, Artificial Sequence
  Synthetic Polynucleotide
taatacgactcactatagggtgactggcagttaggcacttctgaatcgacaacagaggagagtcgatatggaagtgcctaacctggcggcagcgcaaaagatg

SEQ ID NO: 119286 - DNA, 103 bp, Artificial Sequence
  Synthetic Polynucleotide
taatacgactcactatagggtcatgtaggatgactggcagttaggcacttaacagaggagaaagtgcatgactgccagtaacctggcggcagcgcaaaagatg

SEQ ID NO: 119287 - DNA, 103 bp, Artificial Sequence
  Synthetic Polynucleotide
taatacgactcactatagggtaaccccctctcatgtaggatgactggcagaacagaggagactgccaatgatcctacataacctggcggcagcgcaaaagatg

SEQ ID NO: 119288 - DNA, 103 bp, Artificial Sequence
  Synthetic Polynucleotide
taatacgactcactataggggctggagaaataaccccctctcatgtaggaaacagaggagatcctacatgagagggggtaacctggcggcagcgcaaaagatg

SEQ ID NO: 119289 - DNA, 103 bp, Artificial Sequence
  Synthetic Polynucleotide
taatacgactcactatagggcttcatggctgctggagaaataaccccctcaacagaggagagaggggatgatttctccaaacctggcggcagcgcaaaagatg

SEQ ID NO: 119290 - DNA, 103 bp, Artificial Sequence
  Synthetic Polynucleotide
taatacgactcactatagggtatgaaaaaccttcatggctgctggagaaaaacagaggagatttctcatgcagccatgaaacctggcggcagcgcaaaagatg

SEQ ID NO: 119291 - DNA, 103 bp, Artificial Sequence
  Synthetic Polynucleotide
taatacgactcactatagggatctttttcatatgaaaaaccttcatggctaacagaggagaagccatatgggtttttcaaacctggcggcagcgcaaaagatg

SEQ ID NO: 119292 - DNA, 103 bp, Artificial Sequence
  Synthetic Polynucleotide
taatacgactcactatagggataatcggggatctttttcatatgaaaaacaacagaggagagtttttatgatgaaaaagaacctggcggcagcgcaaaagatg

SEQ ID NO: 119293 - DNA, 103 bp, Artificial Sequence
  Synthetic Polynucleotide
taatacgactcactatagggtcgtcaaagtataatcggggatctttttcaaacagaggagatgaaaaatgtccccgattaacctggcggcagcgcaaaagatg

SEQ ID NO: 119294 - DNA, 103 bp, Artificial Sequence
  Synthetic Polynucleotide
taatacgactcactatagggaatgctacactgagcaggagtctcagacataacagaggagaatgtctatgactcctgctaacctggcggcagcgcaaaagatg

SEQ ID NO: 119295 - DNA, 103 bp, Artificial Sequence
  Synthetic Polynucleotide
taatacgactcactatagggcgctcgaggcactggaacatgaagtggcgtaacagaggagaacgccaatgcatgttccaaacctggcggcagcgcaaaagatg

SEQ ID NO: 119296 - DNA, 103 bp, Artificial Sequence
  Synthetic Polynucleotide
taatacgactcactatagggcagtctacagtctgctattctcccaatgggaacagaggagacccattatgagaatagcaaacctggcggcagcgcaaaagatg

SEQ ID NO: 119297 - DNA, 103 bp, Artificial Sequence
  Synthetic Polynucleotide
taatacgactcactatagggaatcccaaagcagtctacagtctgctattcaacagaggagagaatagatgactgtagacaacctggcggcagcgcaaaagatg

SEQ ID NO: 119298 - DNA, 103 bp, Artificial Sequence
  Synthetic Polynucleotide
taatacgactcactatagggtgatagacgtaatcccaaagcagtctacagaacagaggagactgtagatggctttgggaaacctggcggcagcgcaaaagatg

SEQ ID NO: 119299 - DNA, 103 bp, Artificial Sequence
  Synthetic Polynucleotide
taatacgactcactatagggagaaagcaactgatagacgtaatcccaaagaacagaggagactttggatgtacgtctataacctggcggcagcgcaaaagatg

SEQ ID NO: 119300 - DNA, 103 bp, Artificial Sequence
  Synthetic Polynucleotide
taatacgactcactatagggaccggctgtcagaaagcaactgatagacgtaacagaggagaacgtctatgagttgctttaacctggcggcagcgcaaaagatg

SEQ ID NO: 119301 - DNA, 103 bp, Artificial Sequence
  Synthetic Polynucleotide
taatacgactcactatagggaagttttcgtaccggctgtcagaaagcaacaacagaggagagttgctatgtgacagccgaacctggcggcagcgcaaaagatg

SEQ ID NO: 119302 - DNA, 103 bp, Artificial Sequence
  Synthetic Polynucleotide
taatacgactcactatagggccatcggatgaagttttcgtaccggctgtcaacagaggagagacagcatgtacgaaaacaacctggcggcagcgcaaaagatg

SEQ ID NO: 119303 - DNA, 103 bp, Artificial Sequence
  Synthetic Polynucleotide
taatacgactcactatagggctttgtcctcccatcggatgaagttttcgtaacagaggagaacgaaaatgtcatccgataacctggcggcagcgcaaaagatg

SEQ ID NO: 119304 - DNA, 103 bp, Artificial Sequence
  Synthetic Polynucleotide
taatacgactcactatagggattttggattctttgtcctcccatcggatgaacagaggagacatccgatgggaggacaaaacctggcggcagcgcaaaagatg

SEQ ID NO: 119305 - DNA, 103 bp, Artificial Sequence
  Synthetic Polynucleotide
taatacgactcactatagggtatccggaatattttggattctttgtcctcaacagaggagagaggacatggaatccaaaaacctggcggcagcgcaaaagatg

SEQ ID NO: 119306 - DNA, 103 bp, Artificial Sequence
  Synthetic Polynucleotide
taatacgactcactatagggccatcctgagcgctcgaggcactggaacataacagaggagaatgttcatgtgcctcgagaacctggcggcagcgcaaaagatg

SEQ ID NO: 119307 - DNA, 103 bp, Artificial Sequence
  Synthetic Polynucleotide
taatacgactcactatagggtgggatccactatccggaatattttggattaacagaggagaaatccaatgtattccggaaacctggcggcagcgcaaaagatg

SEQ ID NO: 119308 - DNA, 103 bp, Artificial Sequence
  Synthetic Polynucleotide
taatacgactcactataggggccagtccgttgggatccactatccggaataacagaggagaattccgatgagtggatccaacctggcggcagcgcaaaagatg

SEQ ID NO: 119309 - DNA, 103 bp, Artificial Sequence
  Synthetic Polynucleotide
taatacgactcactatagggccacagtcgagccagtccgttgggatccacaacagaggagagtggatatgaacggactgaacctggcggcagcgcaaaagatg

SEQ ID NO: 119310 - DNA, 103 bp, Artificial Sequence
  Synthetic Polynucleotide
taatacgactcactatagggtatggtttccccacagtcgagccagtccgtaacagaggagaacggacatgctcgactgtaacctggcggcagcgcaaaagatg

SEQ ID NO: 119311 - DNA, 103 bp, Artificial Sequence
  Synthetic Polynucleotide
taatacgactcactataggggttctgttcttatggtttccccacagtcgaaacagaggagatcgactatggggaaaccaaacctggcggcagcgcaaaagatg

SEQ ID NO: 119312 - DNA, 103 bp, Artificial Sequence
  Synthetic Polynucleotide
taatacgactcactatagggggtcatgtttgttctgttcttatggtttccaacagaggagaggaaacatgaagaacagaaacctggcggcagcgcaaaagatg

SEQ ID NO: 119313 - DNA, 103 bp, Artificial Sequence
  Synthetic Polynucleotide
taatacgactcactatagggttttctcataggtcatgtttgttctgttctaacagaggagaagaacaatgcaaacatgaaacctggcggcagcgcaaaagatg

SEQ ID NO: 119314 - DNA, 103 bp, Artificial Sequence
  Synthetic Polynucleotide
taatacgactcactataggggctctggacattttctcataggtcatgtttaacagaggagaaaacatatgctatgagaaaacctggcggcagcgcaaaagatg

SEQ ID NO: 119315 - DNA, 103 bp, Artificial Sequence
  Synthetic Polynucleotide
taatacgactcactataggggtggcgcagggctctggacattttctcataaacagaggagatatgagatgatgtccagaaacctggcggcagcgcaaaagatg

SEQ ID NO: 119316 - DNA, 103 bp, Artificial Sequence
  Synthetic Polynucleotide
taatacgactcactataggggtttgtagtagtggcgcagggctctggacaaacagaggagatgtccaatgccctgcgccaacctggcggcagcgcaaaagatg

SEQ ID NO: 119317 - DNA, 103 bp, Artificial Sequence
  Synthetic Polynucleotide
taatacgactcactataggggagtcttcctccatcctgagcgctcgaggcaacagaggagagcctcgatggctcaggataacctggcggcagcgcaaaagatg

SEQ ID NO: 119318 - DNA, 103 bp, Artificial Sequence
  Synthetic Polynucleotide
taatacgactcactatagggataatgtttagtttgtagtagtggcgcaggaacagaggagacctgcgatgctactacaaaacctggcggcagcgcaaaagatg

SEQ ID NO: 119319 - DNA, 103 bp, Artificial Sequence
  Synthetic Polynucleotide
taatacgactcactatagggctccttcctgataatgtttagtttgtagtaaacagaggagatactacatgctaaacattaacctggcggcagcgcaaaagatg

SEQ ID NO: 119320 - DNA, 103 bp, Artificial Sequence
  Synthetic Polynucleotide
taatacgactcactatagggtttgtcctggctccttcctgataatgtttaaacagaggagataaacaatgtcaggaaggaacctggcggcagcgcaaaagatg

SEQ ID NO: 119321 - DNA, 103 bp, Artificial Sequence
  Synthetic Polynucleotide
taatacgactcactatagggaacaaaagcctttgtcctggctccttcctgaacagaggagacaggaaatggccaggacaaacctggcggcagcgcaaaagatg

SEQ ID NO: 119322 - DNA, 103 bp, Artificial Sequence
  Synthetic Polynucleotide
taatacgactcactatagggcataaacctgaacaaaagcctttgtcctggaacagaggagaccaggaatgaggcttttgaacctggcggcagcgcaaaagatg

SEQ ID NO: 119323 - DNA, 103 bp, Artificial Sequence
  Synthetic Polynucleotide
taatacgactcactatagggctggggttttcataaacctgaacaaaagccaacagaggagaggctttatgtcaggtttaaacctggcggcagcgcaaaagatg

SEQ ID NO: 119324 - DNA, 103 bp, Artificial Sequence
  Synthetic Polynucleotide
taatacgactcactatagggatgatttcatctggggttttcataaacctgaacagaggagacaggttatggaaaaccccaacctggcggcagcgcaaaagatg

SEQ ID NO: 119325 - DNA, 103 bp, Artificial Sequence
  Synthetic Polynucleotide
taatacgactcactatagggtcggccactcatgatttcatctggggttttaacagaggagaaaaaccatggatgaaatcaacctggcggcagcgcaaaagatg

SEQ ID NO: 119326 - DNA, 103 bp, Artificial Sequence
  Synthetic Polynucleotide
taatacgactcactataggggacggtctgttcggccactcatgatttcataacagaggagaatgaaaatgtgagtggccaacctggcggcagcgcaaaagatg

SEQ ID NO: 119327 - DNA, 103 bp, Artificial Sequence
  Synthetic Polynucleotide
taatacgactcactatagggaggtgctccagacggtctgttcggccactcaacagaggagagagtggatgaacagaccgaacctggcggcagcgcaaaagatg

SEQ ID NO: 119328 - DNA, 103 bp, Artificial Sequence
  Synthetic Polynucleotide
taatacgactcactatagggcaggcggatcgagtcttcctccatcctgagaacagaggagactcaggatggaggaagacaacctggcggcagcgcaaaagatg

SEQ ID NO: 119329 - DNA, 103 bp, Artificial Sequence
  Synthetic Polynucleotide
taatacgactcactatagggctgggactctaggtgctccagacggtctgtaacagaggagaacagacatgctggagcacaacctggcggcagcgcaaaagatg

SEQ ID NO: 119330 - DNA, 103 bp, Artificial Sequence
  Synthetic Polynucleotide
taatacgactcactatagggcatccagctcctgggactctaggtgctccaaacagaggagatggagcatgtagagtcccaacctggcggcagcgcaaaagatg

SEQ ID NO: 119331 - DNA, 103 bp, Artificial Sequence
  Synthetic Polynucleotide
taatacgactcactatagggtatatttgttcatccagctcctgggactctaacagaggagaagagtcatgggagctggaaacctggcggcagcgcaaaagatg

SEQ ID NO: 119332 - DNA, 103 bp, Artificial Sequence
  Synthetic Polynucleotide
taatacgactcactatagggatcttcttggtatatttgttcatccagctcaacagaggagagagctgatggaacaaataaacctggcggcagcgcaaaagatg

SEQ ID NO: 119333 - DNA, 103 bp, Artificial Sequence
  Synthetic Polynucleotide
taatacgactcactatagggggtgcgcaggcaggcggatcgagtcttcctaacagaggagaaggaagatgcgatccgccaacctggcggcagcgcaaaagatg

SEQ ID NO: 119334 - DNA, 103 bp, Artificial Sequence
  Synthetic Polynucleotide
taatacgactcactatagggtgcaagcgcaggtgcgcaggcaggcggatcaacagaggagagatccgatggcctgcgcaaacctggcggcagcgcaaaagatg

SEQ ID NO: 119335 - DNA, 103 bp, Artificial Sequence
  Synthetic Polynucleotide
taatacgactcactataggggtaaattggctgcaagcgcaggtgcgcaggaacagaggagacctgcgatgctgcgcttgaacctggcggcagcgcaaaagatg

SEQ ID NO: 119336 - DNA, 103 bp, Artificial Sequence
  Synthetic Polynucleotide
taatacgactcactatagggccctgctccagtaaattggctgcaagcgcaaacagaggagatgcgctatgagccaatttaacctggcggcagcgcaaaagatg

SEQ ID NO: 119337 - DNA, 103 bp, Artificial Sequence
  Synthetic Polynucleotide
taatacgactcactataggggctacgtcatccctgctccagtaaattggcaacagaggagagccaatatgctggagcagaacctggcggcagcgcaaaagatg

SEQ ID NO: 119338 - DNA, 103 bp, Artificial Sequence
  Synthetic Polynucleotide
taatacgactcactataggggagccactgggctacgtcatccctgctccaaacagaggagatggagcatggatgacgtaaacctggcggcagcgcaaaagatg

SEQ ID NO: 119339 - DNA, 103 bp, Artificial Sequence
  Synthetic Polynucleotide
taatacgactcactataggggttcctgcttaatgctacactgagcaggagaacagaggagactcctgatgagtgtagcaaacctggcggcagcgcaaaagatg

SEQ ID NO: 119340 - DNA, 103 bp, Artificial Sequence
  Synthetic Polynucleotide
taatacgactcactatagggcagcccacttgagccactgggctacgtcataacagaggagaatgacgatgcccagtggcaacctggcggcagcgcaaaagatg

SEQ ID NO: 119341 - DNA, 103 bp, Artificial Sequence
  Synthetic Polynucleotide
taatacgactcactatagggaactcattttcagcccacttgagccactggaacagaggagaccagtgatgcaagtgggcaacctggcggcagcgcaaaagatg

SEQ ID NO: 119342 - DNA, 103 bp, Artificial Sequence
  Synthetic Polynucleotide
taatacgactcactatagggccttaaagaaaactcattttcagcccacttaacagaggagaaagtggatggaaaatgagaacctggcggcagcgcaaaagatg

SEQ ID NO: 119343 - DNA, 103 bp, Artificial Sequence
  Synthetic Polynucleotide
taatacgactcactatagggtgtcaattggccttaaagaaaactcattttaacagaggagaaaaatgatgtttctttaaaacctggcggcagcgcaaaagatg

SEQ ID NO: 119344 - DNA, 103 bp, Artificial Sequence
  Synthetic Polynucleotide
taatacgactcactatagggaacgtgttgctgtcaattggccttaaagaaaacagaggagattctttatggccaattgaaacctggcggcagcgcaaaagatg

SEQ ID NO: 119345 - DNA, 103 bp, Artificial Sequence
  Synthetic Polynucleotide
taatacgactcactatagggattcatttcaaacgtgttgctgtcaattggaacagaggagaccaattatgagcaacacgaacctggcggcagcgcaaaagatg

SEQ ID NO: 119346 - DNA, 103 bp, Artificial Sequence
  Synthetic Polynucleotide
taatacgactcactataggggagctttgccattcatttcaaacgtgttgcaacagaggagagcaacaatgttgaaatgaaacctggcggcagcgcaaaagatg

SEQ ID NO: 119347 - DNA, 103 bp, Artificial Sequence
  Synthetic Polynucleotide
taatacgactcactatagggagcagcaggagagctttgccattcatttcaaacagaggagatgaaatatgtggcaaagcaacctggcggcagcgcaaaagatg

SEQ ID NO: 119348 - DNA, 103 bp, Artificial Sequence
  Synthetic Polynucleotide
taatacgactcactatagggctctttggtcagcagcaggagagctttgccaacagaggagaggcaaaatgctcctgctgaacctggcggcagcgcaaaagatg

SEQ ID NO: 119349 - DNA, 103 bp, Artificial Sequence
  Synthetic Polynucleotide
taatacgactcactatagggagcgaaagtcctctttggtcagcagcaggaaacagaggagatcctgcatgtgaccaaagaacctggcggcagcgcaaaagatg

SEQ ID NO: 119350 - DNA, 103 bp, Artificial Sequence
  Synthetic Polynucleotide
taatacgactcactatagggtatgaaattcgttcctgcttaatgctacacaacagaggagagtgtagatgtaagcaggaaacctggcggcagcgcaaaagatg

SEQ ID NO: 119351 - DNA, 103 bp, Artificial Sequence
  Synthetic Polynucleotide
taatacgactcactatagggggagatcgatagcgaaagtcctctttggtcaacagaggagagaccaaatgggactttcgaacctggcggcagcgcaaaagatg

SEQ ID NO: 119352 - DNA, 103 bp, Artificial Sequence
  Synthetic Polynucleotide
taatacgactcactatagggacctgaatgaggagatcgatagcgaaagtcaacagaggagagactttatgtatcgatctaacctggcggcagcgcaaaagatg

SEQ ID NO: 119353 - DNA, 103 bp, Artificial Sequence
  Synthetic Polynucleotide
taatacgactcactatagggagagcacatcacctgaatgaggagatcgataacagaggagaatcgatatgctcattcagaacctggcggcagcgcaaaagatg

SEQ ID NO: 119354 - DNA, 103 bp, Artificial Sequence
  Synthetic Polynucleotide
taatacgactcactatagggaggagttcatagagcacatcacctgaatgaaacagaggagatcattcatgtgatgtgctaacctggcggcagcgcaaaagatg

SEQ ID NO: 119355 - DNA, 103 bp, Artificial Sequence
  Synthetic Polynucleotide
taatacgactcactatagggaatatgctgaaggagttcatagagcacatcaacagaggagagatgtgatgtatgaactcaacctggcggcagcgcaaaagatg

SEQ ID NO: 119356 - DNA, 103 bp, Artificial Sequence
  Synthetic Polynucleotide
taatacgactcactatagggtctgcttcagaatatgctgaaggagttcataacagaggagaatgaacatgttcagcataaacctggcggcagcgcaaaagatg

SEQ ID NO: 119357 - DNA, 103 bp, Artificial Sequence
  Synthetic Polynucleotide
taatacgactcactatagggcgaggtttcctctgcttcagaatatgctgaaacagaggagatcagcaatgtctgaagcaaacctggcggcagcgcaaaagatg

SEQ ID NO: 119358 - DNA, 103 bp, Artificial Sequence
  Synthetic Polynucleotide
taatacgactcactatagggaaaaagaatccgaggtttcctctgcttcagaacagaggagactgaagatgaggaaacctaacctggcggcagcgcaaaagatg

SEQ ID NO: 119359 - DNA, 103 bp, Artificial Sequence
  Synthetic Polynucleotide
taatacgactcactatagggagaatggtgaaaaaagaatccgaggtttccaacagaggagaggaaacatgggattctttaacctggcggcagcgcaaaagatg

SEQ ID NO: 119360 - DNA, 103 bp, Artificial Sequence
  Synthetic Polynucleotide
taatacgactcactatagggccagggtggaagaatggtgaaaaaagaatcaacagaggagagattctatgttcaccattaacctggcggcagcgcaaaagatg
